United States Patent 11,254,933 (CRISPR/CAS TRANSCRIPTIONAL MODULATION) - sequence listing, part 15

SEQ ID NO: 648098 - DNA, 20 bp, mouse
gaatgcgcggaggggcactg

SEQ ID NO: 648099 - DNA, 20 bp, mouse
gaaaaggtcaaggggcagat

SEQ ID NO: 648100 - DNA, 20 bp, mouse
ggtggaagctgcctccgagg

SEQ ID NO: 648101 - DNA, 20 bp, mouse
gcaagagtttagactggggg

SEQ ID NO: 648102 - DNA, 20 bp, mouse
gctgcagctctccacctcgg

SEQ ID NO: 648103 - DNA, 20 bp, mouse
gactgtggaagctgcctccg

SEQ ID NO: 648104 - DNA, 20 bp, mouse
gttcctgggcatcacaagca

SEQ ID NO: 648105 - DNA, 20 bp, mouse
gaggcgcaggcaagaagtgt

SEQ ID NO: 648106 - DNA, 20 bp, mouse
gtgtctgtggagagtcgtgc

SEQ ID NO: 648107 - DNA, 20 bp, mouse
gtcgtgcgggcatagagtgg

SEQ ID NO: 648108 - DNA, 20 bp, mouse
ggtcccagggagtgcctggt

SEQ ID NO: 648109 - DNA, 20 bp, mouse
ggagtcgtgcgggcatagag

SEQ ID NO: 648110 - DNA, 20 bp, mouse
gccaataggggagatgtctc

SEQ ID NO: 648111 - DNA, 20 bp, mouse
gaggagtgagcgtccccacc

SEQ ID NO: 648112 - DNA, 20 bp, mouse
gtaatcaaggagaccagacc

SEQ ID NO: 648113 - DNA, 20 bp, mouse
gtagggggtctcagagcctg

SEQ ID NO: 648114 - DNA, 20 bp, mouse
gcgcgcacgcatggcatgct

SEQ ID NO: 648115 - DNA, 20 bp, mouse
gtgccatctcgccagagtgc

SEQ ID NO: 648116 - DNA, 20 bp, mouse
ggaccaaagcacacactaga

SEQ ID NO: 648117 - DNA, 20 bp, mouse
gacctggtagaggtcaaaga

SEQ ID NO: 648118 - DNA, 20 bp, mouse
gacccctctagtgtgtgctt

SEQ ID NO: 648119 - DNA, 20 bp, mouse
gccagcctgggctacggaga

SEQ ID NO: 648120 - DNA, 20 bp, mouse
gctagaggggtgacagaggc

SEQ ID NO: 648121 - DNA, 20 bp, mouse
ggcttggtggagctgagtca

SEQ ID NO: 648122 - DNA, 20 bp, mouse
gacacttattgctgtgggtg

SEQ ID NO: 648123 - DNA, 20 bp, mouse
gagcctcagcctcactacct

SEQ ID NO: 648124 - DNA, 20 bp, mouse
gacaacactccccaggggac

SEQ ID NO: 648125 - DNA, 20 bp, mouse
gagagtgtagagagataccc

SEQ ID NO: 648126 - DNA, 20 bp, mouse
gaaagtgcccgtcaagttcg

SEQ ID NO: 648127 - DNA, 20 bp, mouse
gcccggagtaggatgtacgc

SEQ ID NO: 648128 - DNA, 20 bp, mouse
gagcgcgtgcggctctcggc

SEQ ID NO: 648129 - DNA, 20 bp, mouse
gtctcggctggtgtatggag

SEQ ID NO: 648130 - DNA, 20 bp, mouse
gtacccgcccccgaacttga

SEQ ID NO: 648131 - DNA, 20 bp, mouse
gtgttgccccagctcttccc

SEQ ID NO: 648132 - DNA, 20 bp, mouse
gtggaagcgctagacctgtg

SEQ ID NO: 648133 - DNA, 20 bp, mouse
ggcggctctcggctggtgta

SEQ ID NO: 648134 - DNA, 20 bp, mouse
gtgcccgtcaagttcggggg

SEQ ID NO: 648135 - DNA, 20 bp, mouse
gtgcctgtgagagtgtaagt

SEQ ID NO: 648136 - DNA, 20 bp, mouse
gcgggtggagctcaagggag

SEQ ID NO: 648137 - DNA, 20 bp, mouse
gggcgccgggtggagctcaa

SEQ ID NO: 648138 - DNA, 20 bp, mouse
gctctcccggaagtgagcga

SEQ ID NO: 648139 - DNA, 20 bp, mouse
gggagactagaagtagaacg

SEQ ID NO: 648140 - DNA, 20 bp, mouse
ggatgccaagaggcgccggg

SEQ ID NO: 648141 - DNA, 20 bp, mouse
gggctgggaccaggcagcac

SEQ ID NO: 648142 - DNA, 20 bp, mouse
gtggggatgccaagaggcgc

SEQ ID NO: 648143 - DNA, 20 bp, mouse
gcaggcagcacagggcacga

SEQ ID NO: 648144 - DNA, 20 bp, mouse
ggcagacgggcgcagcctgc

SEQ ID NO: 648145 - DNA, 20 bp, mouse
ggcacagggcacgagggtct

SEQ ID NO: 648146 - DNA, 20 bp, mouse
gcacgtgcggggaccggcag

SEQ ID NO: 648147 - DNA, 20 bp, mouse
gcctgcaagctcggccctct

SEQ ID NO: 648148 - DNA, 20 bp, mouse
gggacccggtctattgtcaa

SEQ ID NO: 648149 - DNA, 20 bp, mouse
gcagcagggaaggactcggg

SEQ ID NO: 648150 - DNA, 20 bp, mouse
gaggcagcggccactgtggg

SEQ ID NO: 648151 - DNA, 20 bp, mouse
ggcgccgcccagcgggatcc

SEQ ID NO: 648152 - DNA, 20 bp, mouse
gcggccggggcccgaggagg

SEQ ID NO: 648153 - DNA, 20 bp, mouse
ggggcggcgccgcctctgcc

SEQ ID NO: 648154 - DNA, 20 bp, mouse
ggggaccggcaggggcttcc

SEQ ID NO: 648155 - DNA, 20 bp, mouse
gcggctgctcgggacggagg

SEQ ID NO: 648156 - DNA, 20 bp, mouse
gcccgcccgcgcagcgtgac

SEQ ID NO: 648157 - DNA, 20 bp, mouse
gcctccggagctcgctgcgg

SEQ ID NO: 648158 - DNA, 20 bp, mouse
gaggcggcggctggtggcgt

SEQ ID NO: 648159 - DNA, 20 bp, mouse
gccagcccgcaacgcagcca

SEQ ID NO: 648160 - DNA, 20 bp, mouse
ggccgccagtcacgctgcgc

SEQ ID NO: 648161 - DNA, 20 bp, mouse
gagcgcgagcgccaggggag

SEQ ID NO: 648162 - DNA, 20 bp, mouse
ggagccaagaaccgggcgat

SEQ ID NO: 648163 - DNA, 20 bp, mouse
gcggccgccgcagcgagctc

SEQ ID NO: 648164 - DNA, 20 bp, mouse
ggcgcctccggagctcgctg

SEQ ID NO: 648165 - DNA, 20 bp, mouse
gcgcccggttcttggctcct

SEQ ID NO: 648166 - DNA, 20 bp, mouse
gagggcggggctgatctccc

SEQ ID NO: 648167 - DNA, 20 bp, mouse
gggccggggcgtgtcctaaa

SEQ ID NO: 648168 - DNA, 20 bp, mouse
ggggcgtgtcctaaagggcg

SEQ ID NO: 648169 - DNA, 20 bp, mouse
gtcggactctcggaggggtg

SEQ ID NO: 648170 - DNA, 20 bp, mouse
ggcgaggctcggactctcgg

SEQ ID NO: 648171 - DNA, 20 bp, mouse
gctgggggagggtccgttgg

SEQ ID NO: 648172 - DNA, 20 bp, mouse
gtgggggcgtggcacgggtc

SEQ ID NO: 648173 - DNA, 20 bp, mouse
gtctggatagggtgcagctc

SEQ ID NO: 648174 - DNA, 20 bp, mouse
gaggggtgtggcttgctttt

SEQ ID NO: 648175 - DNA, 20 bp, mouse
ggaaagggtcaggctccctg

SEQ ID NO: 648176 - DNA, 20 bp, mouse
gtagctccacaggcgttctg

SEQ ID NO: 648177 - DNA, 20 bp, mouse
gtcccggattccatccaccg

SEQ ID NO: 648178 - DNA, 20 bp, mouse
gcgactgcagatcaggacct

SEQ ID NO: 648179 - DNA, 20 bp, mouse
gctgtggagctacagagcaa

SEQ ID NO: 648180 - DNA, 20 bp, mouse
gctgcagatcaggacctcgg

SEQ ID NO: 648181 - DNA, 20 bp, mouse
gaaagacgctggggcagacg

SEQ ID NO: 648182 - DNA, 20 bp, mouse
ggctggggcagacgtgggac

SEQ ID NO: 648183 - DNA, 20 bp, mouse
gggagagccgactgcagatc

SEQ ID NO: 648184 - DNA, 20 bp, mouse
ggacctcggtggatggaatc

SEQ ID NO: 648185 - DNA, 20 bp, mouse
gacgccaagctatgcgtcat

SEQ ID NO: 648186 - DNA, 20 bp, mouse
ggcagtgaaggcaaacatgg

SEQ ID NO: 648187 - DNA, 20 bp, mouse
gagaagcccgagcatcagta

SEQ ID NO: 648188 - DNA, 20 bp, mouse
gcacagaattgcaaatgaga

SEQ ID NO: 648189 - DNA, 20 bp, mouse
gctagagcatccggcagtga

SEQ ID NO: 648190 - DNA, 20 bp, mouse
gggggaggggctagagcatc

SEQ ID NO: 648191 - DNA, 20 bp, mouse
ggagccctggaaagaaatgt

SEQ ID NO: 648192 - DNA, 20 bp, mouse
gttaaagaaggattctgcca

SEQ ID NO: 648193 - DNA, 20 bp, mouse
gctagcacctgctagaagat

SEQ ID NO: 648194 - DNA, 20 bp, mouse
ggctgtgccaagtttgtgag

SEQ ID NO: 648195 - DNA, 20 bp, mouse
gagcccctgtctcactggag

SEQ ID NO: 648196 - DNA, 20 bp, mouse
gaaaagggaccgtgctgtgt

SEQ ID NO: 648197 - DNA, 20 bp, mouse
gtgccttggaaacctgtggg

SEQ ID NO: 648198 - DNA, 20 bp, mouse
gttggtcacctctacacttt

SEQ ID NO: 648199 - DNA, 20 bp, mouse
gggcgtgcagagcctcttgg

SEQ ID NO: 648200 - DNA, 20 bp, mouse
gcacctttcccaaagtgtag

SEQ ID NO: 648201 - DNA, 20 bp, mouse
gcgaggccccgccctccaag

SEQ ID NO: 648202 - DNA, 20 bp, mouse
gcacctctacactttgggaa

SEQ ID NO: 648203 - DNA, 20 bp, mouse
gttgctgtctgggcataagt

SEQ ID NO: 648204 - DNA, 20 bp, mouse
gggctctgcacgccgcccac

SEQ ID NO: 648205 - DNA, 20 bp, mouse
gcgccgcccacaggtttcca

SEQ ID NO: 648206 - DNA, 20 bp, mouse
gagaggcgcgcgcaagtcgg

SEQ ID NO: 648207 - DNA, 20 bp, mouse
gtctcccagctgcgccaaga

SEQ ID NO: 648208 - DNA, 20 bp, mouse
gaggcgggcccgtacagctc

SEQ ID NO: 648209 - DNA, 20 bp, mouse
gcgcaagtcgggggagggag

SEQ ID NO: 648210 - DNA, 20 bp, mouse
gtacagctccgggatgtcag

SEQ ID NO: 648211 - DNA, 20 bp, mouse
gcacgcgcaggagagcgagc

SEQ ID NO: 648212 - DNA, 20 bp, mouse
ggggcacgccagggagccga

SEQ ID NO: 648213 - DNA, 20 bp, mouse
gaggccccgcccctcgccct

SEQ ID NO: 648214 - DNA, 20 bp, mouse
ggcgcgcgcaagtcggggga

SEQ ID NO: 648215 - DNA, 20 bp, mouse
gtcacggcgggcatgggaga

SEQ ID NO: 648216 - DNA, 20 bp, mouse
gcgaggacgccaggtcacgt

SEQ ID NO: 648217 - DNA, 20 bp, mouse
gccgaagcctccagggggaa

SEQ ID NO: 648218 - DNA, 20 bp, mouse
gcccgcgggaggaggtgcgc

SEQ ID NO: 648219 - DNA, 20 bp, mouse
gctgtcatccgaagcctcca

SEQ ID NO: 648220 - DNA, 20 bp, mouse
gggaagggctcgcggactcg

SEQ ID NO: 648221 - DNA, 20 bp, mouse
gcgcgagcccttccccctgg

SEQ ID NO: 648222 - DNA, 20 bp, mouse
gtgcgcagcagtgctggcgg

SEQ ID NO: 648223 - DNA, 20 bp, mouse
gtgctgaacctcctcctctt

SEQ ID NO: 648224 - DNA, 20 bp, mouse
gcatccagggcgctaaaggt

SEQ ID NO: 648225 - DNA, 20 bp, mouse
gtaccctgccaggtccccgg

SEQ ID NO: 648226 - DNA, 20 bp, mouse
ggccgcctggccaatggaga

SEQ ID NO: 648227 - DNA, 20 bp, mouse
gcccgcgcaaaaggaacaag

SEQ ID NO: 648228 - DNA, 20 bp, mouse
ggcgcctccgcgtcacgtga

SEQ ID NO: 648229 - DNA, 20 bp, mouse
gggctctcgcgagagtgagt

SEQ ID NO: 648230 - DNA, 20 bp, mouse
gtggcagcccacgacatcag

SEQ ID NO: 648231 - DNA, 20 bp, mouse
gtcttcccacgtgctctgga

SEQ ID NO: 648232 - DNA, 20 bp, mouse
gccccaggaaggtctaaggg

SEQ ID NO: 648233 - DNA, 20 bp, mouse
gacgtcagccgagagttcgt

SEQ ID NO: 648234 - DNA, 20 bp, mouse
gaggtctaagggtggcggat

SEQ ID NO: 648235 - DNA, 20 bp, mouse
gtctggacccctgatgtcgt

SEQ ID NO: 648236 - DNA, 20 bp, mouse
gggcttctcgggtcattaaa

SEQ ID NO: 648237 - DNA, 20 bp, mouse
gggctgtgctcatgtgatga

SEQ ID NO: 648238 - DNA, 20 bp, mouse
ggaccagaggctccgacacc

SEQ ID NO: 648239 - DNA, 20 bp, mouse
gaagggggacgaggggtttg

SEQ ID NO: 648240 - DNA, 20 bp, mouse
ggctgctgggggcctggtgt

SEQ ID NO: 648241 - DNA, 20 bp, mouse
ggatgctgcaaggcgtgtct

SEQ ID NO: 648242 - DNA, 20 bp, mouse
gtctggtcctagcagcctag

SEQ ID NO: 648243 - DNA, 20 bp, mouse
gcctagggggagatgctgca

SEQ ID NO: 648244 - DNA, 20 bp, mouse
ggggtttggggtctgtccca

SEQ ID NO: 648245 - DNA, 20 bp, mouse
ggtgctcatgtgatgaaggg

SEQ ID NO: 648246 - DNA, 20 bp, mouse
ggccaagaagccttcctatt

SEQ ID NO: 648247 - DNA, 20 bp, mouse
gtgggctcacagaacatgat

SEQ ID NO: 648248 - DNA, 20 bp, mouse
gtggttgctaaggaacgatg

SEQ ID NO: 648249 - DNA, 20 bp, mouse
gttctgtgagcccaatagga

SEQ ID NO: 648250 - DNA, 20 bp, mouse
ggtggcttccggtgatgggg

SEQ ID NO: 648251 - DNA, 20 bp, mouse
gcaaagtgatcaaagtcggg

SEQ ID NO: 648252 - DNA, 20 bp, mouse
ggccgcctgcggcccggggt

SEQ ID NO: 648253 - DNA, 20 bp, mouse
ggaagggtggcttccggtga

SEQ ID NO: 648254 - DNA, 20 bp, mouse
gcggcaaagtgatcaaagtc

SEQ ID NO: 648255 - DNA, 20 bp, mouse
gtgatggggcggataggaga

SEQ ID NO: 648256 - DNA, 20 bp, mouse
gtgtgccgggaggactggtg

SEQ ID NO: 648257 - DNA, 20 bp, mouse
gcgcctcctgggaagaagct

SEQ ID NO: 648258 - DNA, 20 bp, mouse
gccagctgtgccgggaggac

SEQ ID NO: 648259 - DNA, 20 bp, mouse
ggtcacctcaccagtcctcc

SEQ ID NO: 648260 - DNA, 20 bp, mouse
gctgaggtcgaatagcatgt

SEQ ID NO: 648261 - DNA, 20 bp, mouse
ggatgcaggcccagctgtgc

SEQ ID NO: 648262 - DNA, 20 bp, mouse
gtcttcccaggaggcgatgc

SEQ ID NO: 648263 - DNA, 20 bp, mouse
gagcctagcttcttcccagg

SEQ ID NO: 648264 - DNA, 20 bp, mouse
gctgggcctgcatcgcctcc

SEQ ID NO: 648265 - DNA, 20 bp, mouse
gagtgctgccacagcaacga

SEQ ID NO: 648266 - DNA, 20 bp, mouse
gtggccctggggaaatccta

SEQ ID NO: 648267 - DNA, 20 bp, mouse
gtaggggcgggtctagtcgg

SEQ ID NO: 648268 - DNA, 20 bp, mouse
gggttctgccggcaagtcaa

SEQ ID NO: 648269 - DNA, 20 bp, mouse
gtggctgtacaggaggggcg

SEQ ID NO: 648270 - DNA, 20 bp, mouse
gaagggggcggagctctcga

SEQ ID NO: 648271 - DNA, 20 bp, mouse
ggtccgctggagcccaccaa

SEQ ID NO: 648272 - DNA, 20 bp, mouse
gcaagggatggcagcgaagg

SEQ ID NO: 648273 - DNA, 20 bp, mouse
ggggtgggcggtgagtaaac

SEQ ID NO: 648274 - DNA, 20 bp, mouse
gcataattaggcagtggggt

SEQ ID NO: 648275 - DNA, 20 bp, mouse
gggagaaggcgattggccct

SEQ ID NO: 648276 - DNA, 20 bp, mouse
gtagccctggagcctgacca

SEQ ID NO: 648277 - DNA, 20 bp, mouse
ggggccaggctcctctgaag

SEQ ID NO: 648278 - DNA, 20 bp, mouse
gctagtcggcccaggatggg

SEQ ID NO: 648279 - DNA, 20 bp, mouse
ggcccctccctagtcggccc

SEQ ID NO: 648280 - DNA, 20 bp, mouse
ggcaactgccctcccatcct

SEQ ID NO: 648281 - DNA, 20 bp, mouse
gcggccttggtcaggctcca

SEQ ID NO: 648282 - DNA, 20 bp, mouse
gtccctagtcggcccaggat

SEQ ID NO: 648283 - DNA, 20 bp, mouse
gaatgctagcggccttggtc

SEQ ID NO: 648284 - DNA, 20 bp, mouse
gctgcctgaggcaatgctag

SEQ ID NO: 648285 - DNA, 20 bp, mouse
gaggccgctagcattgcctc

SEQ ID NO: 648286 - DNA, 20 bp, mouse
gcacccacctcaaatactaa

SEQ ID NO: 648287 - DNA, 20 bp, mouse
gaaatgggggagtatgggag

SEQ ID NO: 648288 - DNA, 20 bp, mouse
gtgagtgctcaaaaaaaggg

SEQ ID NO: 648289 - DNA, 20 bp, mouse
gcaaggccagttcttctaac

SEQ ID NO: 648290 - DNA, 20 bp, mouse
ggagtgaaatgggggagtat

SEQ ID NO: 648291 - DNA, 20 bp, mouse
ggaaagccaggtcagataag

SEQ ID NO: 648292 - DNA, 20 bp, mouse
gctgagtgttagagtgaaat

SEQ ID NO: 648293 - DNA, 20 bp, mouse
gtatttgaggtgggtgaata

SEQ ID NO: 648294 - DNA, 20 bp, mouse
gggactagccagtgtgaatc

SEQ ID NO: 648295 - DNA, 20 bp, mouse
gtttttgagcactcaatctt

SEQ ID NO: 648296 - DNA, 20 bp, mouse
ggaaaaatgtgtcctccagt

SEQ ID NO: 648297 - DNA, 20 bp, mouse
ggcctactgtggtactacaa

SEQ ID NO: 648298 - DNA, 20 bp, mouse
gtgtcctccagtaggtagct

SEQ ID NO: 648299 - DNA, 20 bp, mouse
gagtatgccaagctacctac

SEQ ID NO: 648300 - DNA, 20 bp, mouse
gtagatcactgagaatccta

SEQ ID NO: 648301 - DNA, 20 bp, mouse
gtaaacaggaggcatcccaa

SEQ ID NO: 648302 - DNA, 20 bp, mouse
gacagaatcgctcccagtct

SEQ ID NO: 648303 - DNA, 20 bp, mouse
gatgccaagctacctactgg

SEQ ID NO: 648304 - DNA, 20 bp, mouse
gtacagccaacaatgatcac

SEQ ID NO: 648305 - DNA, 20 bp, mouse
gatggaaaacagtaagtggg

SEQ ID NO: 648306 - DNA, 20 bp, mouse
gcgcgtggagcagtggggcg

SEQ ID NO: 648307 - DNA, 20 bp, mouse
gtgcagcggtgatgcgtccg

SEQ ID NO: 648308 - DNA, 20 bp, mouse
gccaatgcgcgtggagcagt

SEQ ID NO: 648309 - DNA, 20 bp, mouse
gaagcaggaggactgcaaga

SEQ ID NO: 648310 - DNA, 20 bp, mouse
gtgggcagtcggctggcagg

SEQ ID NO: 648311 - DNA, 20 bp, mouse
ggggaccactaaagcaaagc

SEQ ID NO: 648312 - DNA, 20 bp, mouse
ggcggtgatgcgtccggggc

SEQ ID NO: 648313 - DNA, 20 bp, mouse
ggacctccgtgctcccgccc

SEQ ID NO: 648314 - DNA, 20 bp, mouse
gtggggcggggctagggccg

SEQ ID NO: 648315 - DNA, 20 bp, mouse
gaggccgctgggcagtcggc

SEQ ID NO: 648316 - DNA, 20 bp, mouse
gagggcttttgtattgtctc

SEQ ID NO: 648317 - DNA, 20 bp, mouse
gatgcagctcattatgggaa

SEQ ID NO: 648318 - DNA, 20 bp, mouse
gctacccgagaacaccctca

SEQ ID NO: 648319 - DNA, 20 bp, mouse
ggagagaataaaggtgcaag

SEQ ID NO: 648320 - DNA, 20 bp, mouse
gatgaggagccctgtttctt

SEQ ID NO: 648321 - DNA, 20 bp, mouse
gagcgatcaaattgcctgat

SEQ ID NO: 648322 - DNA, 20 bp, mouse
gaatgcagtccaaagaaaca

SEQ ID NO: 648323 - DNA, 20 bp, mouse
gtgtagagcagcaaacgaag

SEQ ID NO: 648324 - DNA, 20 bp, mouse
gtcatgcagcaggtcaaaca

SEQ ID NO: 648325 - DNA, 20 bp, mouse
gccctcagggcagacctagc

SEQ ID NO: 648326 - DNA, 20 bp, mouse
gtctgggagtgagtgagtcg

SEQ ID NO: 648327 - DNA, 20 bp, mouse
ggaggggaaactgtggtctg

SEQ ID NO: 648328 - DNA, 20 bp, mouse
gcgttcacatgttacttcac

SEQ ID NO: 648329 - DNA, 20 bp, mouse
gccaaggaggaatgaatctg

SEQ ID NO: 648330 - DNA, 20 bp, mouse
ggaaactgtggtctgcgggg

SEQ ID NO: 648331 - DNA, 20 bp, mouse
gtgaaaaacaaacctagagt

SEQ ID NO: 648332 - DNA, 20 bp, mouse
gagaaaagagcagccctccg

SEQ ID NO: 648333 - DNA, 20 bp, mouse
gtcatactcaagcctactct

SEQ ID NO: 648334 - DNA, 20 bp, mouse
ggtaactctcatatcaggga

SEQ ID NO: 648335 - DNA, 20 bp, mouse
gattagcatggcatgtttgt

SEQ ID NO: 648336 - DNA, 20 bp, mouse
gaggctgggcggatcggcgg

SEQ ID NO: 648337 - DNA, 20 bp, mouse
gtgcaacccggaaggctggg

SEQ ID NO: 648338 - DNA, 20 bp, mouse
gctagtgcgcaagagcgtcc

SEQ ID NO: 648339 - DNA, 20 bp, mouse
gccgatccgcccagccttcc

SEQ ID NO: 648340 - DNA, 20 bp, mouse
gctcgggagttgtgcctcaa

SEQ ID NO: 648341 - DNA, 20 bp, mouse
ggcgcactagcttacccttg

SEQ ID NO: 648342 - DNA, 20 bp, mouse
gtgtagatttgcaacccgga

SEQ ID NO: 648343 - DNA, 20 bp, mouse
gtagaagtgcgcctgcgcgc

SEQ ID NO: 648344 - DNA, 20 bp, mouse
gcgggctccaggggcacggg

SEQ ID NO: 648345 - DNA, 20 bp, mouse
gacatggaagacgacgagga

SEQ ID NO: 648346 - DNA, 20 bp, mouse
gagtaaggcggggtcgtcgg

SEQ ID NO: 648347 - DNA, 20 bp, mouse
gaccaggcgagcacacgcgt

SEQ ID NO: 648348 - DNA, 20 bp, mouse
ggagagtaaggcggggtcgt

SEQ ID NO: 648349 - DNA, 20 bp, mouse
gcgtgtgtggaaggacccca

SEQ ID NO: 648350 - DNA, 20 bp, mouse
gaagatggaaaggttcgaag

SEQ ID NO: 648351 - DNA, 20 bp, mouse
gccaataggcgtgaagtccg

SEQ ID NO: 648352 - DNA, 20 bp, mouse
gaagaggtgtaaaaatagac

SEQ ID NO: 648353 - DNA, 20 bp, mouse
ggacaggtagcgaaaccaat

SEQ ID NO: 648354 - DNA, 20 bp, mouse
gggaggcggagagtaaggcg

SEQ ID NO: 648355 - DNA, 20 bp, mouse
gggcgcaggtttttgttaac

SEQ ID NO: 648356 - DNA, 20 bp, mouse
gaggcgaaggagaagactat

SEQ ID NO: 648357 - DNA, 20 bp, mouse
gtgcgcgcccggcttgaccg

SEQ ID NO: 648358 - DNA, 20 bp, mouse
gggcccgacacccactgctc

SEQ ID NO: 648359 - DNA, 20 bp, mouse
gccccggagcagtgggtgtc

SEQ ID NO: 648360 - DNA, 20 bp, mouse
gtgggagaaggctctaccgt

SEQ ID NO: 648361 - DNA, 20 bp, mouse
ggttccgagcaccgggtccc

SEQ ID NO: 648362 - DNA, 20 bp, mouse
gcggggcggagggagggtca

SEQ ID NO: 648363 - DNA, 20 bp, mouse
ggggttgagagggaacctgt

SEQ ID NO: 648364 - DNA, 20 bp, mouse
gacccactgctccggggacc

SEQ ID NO: 648365 - DNA, 20 bp, mouse
gtggaattggaaatgcagcg

SEQ ID NO: 648366 - DNA, 20 bp, mouse
gtgggcggggccgggtcgag

SEQ ID NO: 648367 - DNA, 20 bp, mouse
gcgcgtgcgcccggagaagc

SEQ ID NO: 648368 - DNA, 20 bp, mouse
ggacccggccccgcccacac

SEQ ID NO: 648369 - DNA, 20 bp, mouse
gcgggtgaggggctgtaccc

SEQ ID NO: 648370 - DNA, 20 bp, mouse
gggcggagccggtgtgggcg

SEQ ID NO: 648371 - DNA, 20 bp, mouse
ggatccacactgacctgtcg

SEQ ID NO: 648372 - DNA, 20 bp, mouse
ggccgggtcgaggggcacgt

SEQ ID NO: 648373 - DNA, 20 bp, mouse
gcggagaagcaggccgggtg

SEQ ID NO: 648374 - DNA, 20 bp, mouse
gtcgcgtctgaagctgatta

SEQ ID NO: 648375 - DNA, 20 bp, mouse
gagggccgcgggaacacgga

SEQ ID NO: 648376 - DNA, 20 bp, mouse
gaggggaagaagtcggaaaa

SEQ ID NO: 648377 - DNA, 20 bp, mouse
gggaagaagtaggccggtct

SEQ ID NO: 648378 - DNA, 20 bp, mouse
gcaggtgcgaaagacctccc

SEQ ID NO: 648379 - DNA, 20 bp, mouse
gcggcagagagcgtgaaggg

SEQ ID NO: 648380 - DNA, 20 bp, mouse
gcgccccctgcggaagaagt

SEQ ID NO: 648381 - DNA, 20 bp, mouse
ggggccgagcccaggctcgc

SEQ ID NO: 648382 - DNA, 20 bp, mouse
gaagacctcccaggccactc

SEQ ID NO: 648383 - DNA, 20 bp, mouse
gggcgccatgggccgagccc

SEQ ID NO: 648384 - DNA, 20 bp, mouse
gagaagtaggccggtctggg

SEQ ID NO: 648385 - DNA, 20 bp, mouse
gctccggcagagagcgtgaa

SEQ ID NO: 648386 - DNA, 20 bp, mouse
ggggcccgcccccggtgcgc

SEQ ID NO: 648387 - DNA, 20 bp, mouse
gcagggatcggcctgaaagg

SEQ ID NO: 648388 - DNA, 20 bp, mouse
ggcgcacgatcccaagttcc

SEQ ID NO: 648389 - DNA, 20 bp, mouse
gggcccgccagagtgcattc

SEQ ID NO: 648390 - DNA, 20 bp, mouse
ggggcagggatcggcctgaa

SEQ ID NO: 648391 - DNA, 20 bp, mouse
gatttgtggggtttcgtgaa

SEQ ID NO: 648392 - DNA, 20 bp, mouse
gatcgtgcgccttggatgac

SEQ ID NO: 648393 - DNA, 20 bp, mouse
gaacttgggatcgtgcgcct

SEQ ID NO: 648394 - DNA, 20 bp, mouse
gctacgactcccgtcatcca

SEQ ID NO: 648395 - DNA, 20 bp, mouse
gggggccgcaggatttgaat

SEQ ID NO: 648396 - DNA, 20 bp, mouse
ggatgggaagagaacttctg

SEQ ID NO: 648397 - DNA, 20 bp, mouse
gaggagggggggttactctg

SEQ ID NO: 648398 - DNA, 20 bp, mouse
gagtgtggggctgcattgat

SEQ ID NO: 648399 - DNA, 20 bp, mouse
gaggctgggcgcttcctgca

SEQ ID NO: 648400 - DNA, 20 bp, mouse
gaagagaccaattttggggt

SEQ ID NO: 648401 - DNA, 20 bp, mouse
gggcgcttcctgcaaggagg

SEQ ID NO: 648402 - DNA, 20 bp, mouse
gaaggcctcagctgcagggg

SEQ ID NO: 648403 - DNA, 20 bp, mouse
ggatgcttgtctgtgagctg

SEQ ID NO: 648404 - DNA, 20 bp, mouse
gctgggcgcttcctgcaagg

SEQ ID NO: 648405 - DNA, 20 bp, mouse
ggttgtggttgcaactgagg

SEQ ID NO: 648406 - DNA, 20 bp, mouse
gacagccagccctgagcaga

SEQ ID NO: 648407 - DNA, 20 bp, mouse
gcctaagcccacaacgttgc

SEQ ID NO: 648408 - DNA, 20 bp, mouse
gcttccaccggcaacgttgt

SEQ ID NO: 648409 - DNA, 20 bp, mouse
gggaagggctgttggcatag

SEQ ID NO: 648410 - DNA, 20 bp, mouse
ggttgtcaatgacactggga

SEQ ID NO: 648411 - DNA, 20 bp, mouse
gcaggagtaactggattctg

SEQ ID NO: 648412 - DNA, 20 bp, mouse
gagtcactttgcagaacaga

SEQ ID NO: 648413 - DNA, 20 bp, mouse
gcagggctggctgtgccttg

SEQ ID NO: 648414 - DNA, 20 bp, mouse
gaagcccacaacgttgccgg

SEQ ID NO: 648415 - DNA, 20 bp, mouse
ggtgcccctctgctcagggc

SEQ ID NO: 648416 - DNA, 20 bp, mouse
gggtgtgtctaacccagcct

SEQ ID NO: 648417 - DNA, 20 bp, mouse
gagcactcggtgtcctcccc

SEQ ID NO: 648418 - DNA, 20 bp, mouse
gtgtcctccccgggtaggga

SEQ ID NO: 648419 - DNA, 20 bp, mouse
gtcgtcaggacccccagccc

SEQ ID NO: 648420 - DNA, 20 bp, mouse
gcacacagagcttactcgtc

SEQ ID NO: 648421 - DNA, 20 bp, mouse
gcccccctccctacccgggg

SEQ ID NO: 648422 - DNA, 20 bp, mouse
gttgttagagaaaaatggca

SEQ ID NO: 648423 - DNA, 20 bp, mouse
gcattctgggcgctggaggt

SEQ ID NO: 648424 - DNA, 20 bp, mouse
ggagttcagttcagttcaca

SEQ ID NO: 648425 - DNA, 20 bp, mouse
gcccctcccatggatcaaag

SEQ ID NO: 648426 - DNA, 20 bp, mouse
ggaccccctaggtatcatag

SEQ ID NO: 648427 - DNA, 20 bp, mouse
ggcggccagaaggaccccct

SEQ ID NO: 648428 - DNA, 20 bp, mouse
gaccgcgcaggcacctctct

SEQ ID NO: 648429 - DNA, 20 bp, mouse
gggcccacagtgcaccgcgc

SEQ ID NO: 648430 - DNA, 20 bp, mouse
ggatacctagggggtccttc

SEQ ID NO: 648431 - DNA, 20 bp, mouse
gagatcctctatgataccta

SEQ ID NO: 648432 - DNA, 20 bp, mouse
gaagctacgtggacagtctt

SEQ ID NO: 648433 - DNA, 20 bp, mouse
gtctaaaatggggtttgcag

SEQ ID NO: 648434 - DNA, 20 bp, mouse
gctacgtggacagtcttggg

SEQ ID NO: 648435 - DNA, 20 bp, mouse
gataggggatcataaatctc

SEQ ID NO: 648436 - DNA, 20 bp, mouse
gagtgcccgcccccaggctg

SEQ ID NO: 648437 - DNA, 20 bp, mouse
gttccctgctgcagagtgca

SEQ ID NO: 648438 - DNA, 20 bp, mouse
ggtgtgtggacaaaaataac

SEQ ID NO: 648439 - DNA, 20 bp, mouse
gcccgcagcagtgcccgcac

SEQ ID NO: 648440 - DNA, 20 bp, mouse
gcgagagtgcacatactcta

SEQ ID NO: 648441 - DNA, 20 bp, mouse
ggagccttgcactctgcagc

SEQ ID NO: 648442 - DNA, 20 bp, mouse
gcagtgcccgcacaggtgtg

SEQ ID NO: 648443 - DNA, 20 bp, mouse
gtggcacaggaagtgcattt

SEQ ID NO: 648444 - DNA, 20 bp, mouse
ggataacaagagatatcggt

SEQ ID NO: 648445 - DNA, 20 bp, mouse
ggtgcatttcggtttttcgt

SEQ ID NO: 648446 - DNA, 20 bp, mouse
gtccgtgccgctaggaccta

SEQ ID NO: 648447 - DNA, 20 bp, mouse
gactagagataaggagactg

SEQ ID NO: 648448 - DNA, 20 bp, mouse
ggacacagacgtcttcttct

SEQ ID NO: 648449 - DNA, 20 bp, mouse
ggctctgcttgcgccccacg

SEQ ID NO: 648450 - DNA, 20 bp, mouse
gcgggcaaacactgccacgt

SEQ ID NO: 648451 - DNA, 20 bp, mouse
gaaccagcagactagagata

SEQ ID NO: 648452 - DNA, 20 bp, mouse
gtggttgcacggctgagaga

SEQ ID NO: 648453 - DNA, 20 bp, mouse
gcgatgccgcggttctgaag

SEQ ID NO: 648454 - DNA, 20 bp, mouse
gtccctaggtcctagcggca

SEQ ID NO: 648455 - DNA, 20 bp, mouse
gagagacggatccttctgat

SEQ ID NO: 648456 - DNA, 20 bp, mouse
gtaacgctagtgaactgcgt

SEQ ID NO: 648457 - DNA, 20 bp, mouse
gcagccacagccaagggttg

SEQ ID NO: 648458 - DNA, 20 bp, mouse
gtaaagtcagcacagtgcaa

SEQ ID NO: 648459 - DNA, 20 bp, mouse
gtgggtgctcatgcagtttg

SEQ ID NO: 648460 - DNA, 20 bp, mouse
gatgccccaacccttggctg

SEQ ID NO: 648461 - DNA, 20 bp, mouse
gtattgggtatgcggatcag

SEQ ID NO: 648462 - DNA, 20 bp, mouse
gaggcgggctcttaccacat

SEQ ID NO: 648463 - DNA, 20 bp, mouse
gggcagaatgcatgctttat

SEQ ID NO: 648464 - DNA, 20 bp, mouse
ggcacagtgcaaaggctatc

SEQ ID NO: 648465 - DNA, 20 bp, mouse
gatgtcctggataaaggagg

SEQ ID NO: 648466 - DNA, 20 bp, mouse
gcatcagggagatttccctc

SEQ ID NO: 648467 - DNA, 20 bp, mouse
gcccccctcccgcaatgaac

SEQ ID NO: 648468 - DNA, 20 bp, mouse
gaaagactgggatgaacttc

SEQ ID NO: 648469 - DNA, 20 bp, mouse
gtaaaagcttacaaaagact

SEQ ID NO: 648470 - DNA, 20 bp, mouse
gacgtcctggatgaagaggc

SEQ ID NO: 648471 - DNA, 20 bp, mouse
gactttgtagagctacttag

SEQ ID NO: 648472 - DNA, 20 bp, mouse
gtgaacttccggttcattgc

SEQ ID NO: 648473 - DNA, 20 bp, mouse
gagcctgtaggtattccatg

SEQ ID NO: 648474 - DNA, 20 bp, mouse
gtggcgcttgcagtaagagc

SEQ ID NO: 648475 - DNA, 20 bp, mouse
gctttcaccccatgcgccta

SEQ ID NO: 648476 - DNA, 20 bp, mouse
gactactatcgtctctctaa

SEQ ID NO: 648477 - DNA, 20 bp, mouse
gcccttgctaaccatttgac

SEQ ID NO: 648478 - DNA, 20 bp, mouse
gtcctgtcaaatggttagca

SEQ ID NO: 648479 - DNA, 20 bp, mouse
ggcatggctaactttcagaa

SEQ ID NO: 648480 - DNA, 20 bp, mouse
gctttgctaattatgttgta

SEQ ID NO: 648481 - DNA, 20 bp, mouse
gcattttaagaactcaattg

SEQ ID NO: 648482 - DNA, 20 bp, mouse
gatagtagtatttaaacagt

SEQ ID NO: 648483 - DNA, 20 bp, mouse
gtattagagaagagattaat

SEQ ID NO: 648484 - DNA, 20 bp, mouse
gattgagttcttaaaatgat

SEQ ID NO: 648485 - DNA, 20 bp, mouse
gctaatggacaccaactcaa

SEQ ID NO: 648486 - DNA, 20 bp, mouse
gcatggctaactgccagaaa

SEQ ID NO: 648487 - DNA, 20 bp, mouse
gacaagggacactccctttc

SEQ ID NO: 648488 - DNA, 20 bp, mouse
gcttgagcacttaaagtgat

SEQ ID NO: 648489 - DNA, 20 bp, mouse
gataaagtacgtgtttactg

SEQ ID NO: 648490 - DNA, 20 bp, mouse
gactactattgtctgtctaa

SEQ ID NO: 648491 - DNA, 20 bp, mouse
gcctgtctaatggttaacaa

SEQ ID NO: 648492 - DNA, 20 bp, mouse
gtagtagtatttaaaacagt

SEQ ID NO: 648493 - DNA, 20 bp, mouse
gcactttaagtgctcaagtg

SEQ ID NO: 648494 - DNA, 20 bp, mouse
gatactattaaagaagagat

SEQ ID NO: 648495 - DNA, 20 bp, mouse
gttttttctttatgtttaca

SEQ ID NO: 648496 - DNA, 20 bp, mouse
gatggacagcaatcaatcac

SEQ ID NO: 648497 - DNA, 20 bp, mouse
ggtagctgaagttactttct

SEQ ID NO: 648498 - DNA, 20 bp, mouse
gctcctggaaagttaaacaa

SEQ ID NO: 648499 - DNA, 20 bp, mouse
gtaattgtgtaaattgttaa

SEQ ID NO: 648500 - DNA, 20 bp, mouse
gagcctccagtttttgtctc

SEQ ID NO: 648501 - DNA, 20 bp, mouse
gaacttcagctactgggctc

SEQ ID NO: 648502 - DNA, 20 bp, mouse
gaagttaaacaatggcatgt

SEQ ID NO: 648503 - DNA, 20 bp, mouse
ggatcaagaaacattgtgtc

SEQ ID NO: 648504 - DNA, 20 bp, mouse
gaagaaacattgtgtctggg

SEQ ID NO: 648505 - DNA, 20 bp, mouse
gggagaagagactatttagg

SEQ ID NO: 648506 - DNA, 20 bp, mouse
gtaccagtttgggtctgtgt

SEQ ID NO: 648507 - DNA, 20 bp, mouse
gtgggtctgtgtgggatccc

SEQ ID NO: 648508 - DNA, 20 bp, mouse
gatcccacacagacccaaac

SEQ ID NO: 648509 - DNA, 20 bp, mouse
gatggctgagggtagcccta

SEQ ID NO: 648510 - DNA, 20 bp, mouse
gacaactagaacagtatcct

SEQ ID NO: 648511 - DNA, 20 bp, mouse
gacctaaggcacatgagaac

SEQ ID NO: 648512 - DNA, 20 bp, mouse
gctcaaccagagcaaactcc

SEQ ID NO: 648513 - DNA, 20 bp, mouse
gagaagtagaccagccctta

SEQ ID NO: 648514 - DNA, 20 bp, mouse
gtaatgccctattagagcaa

SEQ ID NO: 648515 - DNA, 20 bp, mouse
gggctggtctacttctatat

SEQ ID NO: 648516 - DNA, 20 bp, mouse
ggcagtcaatggcacggggg

SEQ ID NO: 648517 - DNA, 20 bp, mouse
gaatcagcagtcaatggcac

SEQ ID NO: 648518 - DNA, 20 bp, mouse
gttacagcattctacttgtg

SEQ ID NO: 648519 - DNA, 20 bp, mouse
gtgtatgagaataaacggtc

SEQ ID NO: 648520 - DNA, 20 bp, mouse
ggtctagagtggaaagtttg

SEQ ID NO: 648521 - DNA, 20 bp, mouse
gcaatggagaacagaacaat

SEQ ID NO: 648522 - DNA, 20 bp, mouse
gaaacagcgatcgccaattt

SEQ ID NO: 648523 - DNA, 20 bp, mouse
gttgctgacaatgtctagag

SEQ ID NO: 648524 - DNA, 20 bp, mouse
gatgagtaatcagcagtcaa

SEQ ID NO: 648525 - DNA, 20 bp, mouse
gacagaactggggatcattc

SEQ ID NO: 648526 - DNA, 20 bp, mouse
gcctaccttccctttggtat

SEQ ID NO: 648527 - DNA, 20 bp, mouse
gacactgcttagacattaga

SEQ ID NO: 648528 - DNA, 20 bp, mouse
gctgaatgataccaagtcac

SEQ ID NO: 648529 - DNA, 20 bp, mouse
gctggctaatggataaccaa

SEQ ID NO: 648530 - DNA, 20 bp, mouse
gattaaacaggtaatgtcac

SEQ ID NO: 648531 - DNA, 20 bp, mouse
ggaacagtcaatcagcttcc

SEQ ID NO: 648532 - DNA, 20 bp, mouse
gtattggtcaatcattaaac

SEQ ID NO: 648533 - DNA, 20 bp, mouse
gagcacttacacctgtctaa

SEQ ID NO: 648534 - DNA, 20 bp, mouse
gagctgttccaagcggttaa

SEQ ID NO: 648535 - DNA, 20 bp, mouse
ggcggttaagggacaatcac

SEQ ID NO: 648536 - DNA, 20 bp, mouse
ggaaagagaacagaagggtg

SEQ ID NO: 648537 - DNA, 20 bp, mouse
ggcatgactgatgataatgg

SEQ ID NO: 648538 - DNA, 20 bp, mouse
gtctcattcttgaaaagttg

SEQ ID NO: 648539 - DNA, 20 bp, mouse
gatgttggctagtactccag

SEQ ID NO: 648540 - DNA, 20 bp, mouse
gttcttctgtcaaactgcct

SEQ ID NO: 648541 - DNA, 20 bp, mouse
gagcattatagacacaagat

SEQ ID NO: 648542 - DNA, 20 bp, mouse
gttaagataattaaaaagct

SEQ ID NO: 648543 - DNA, 20 bp, mouse
ggataatggaggtcagaaaa

SEQ ID NO: 648544 - DNA, 20 bp, mouse
gcatgcatgactgatgataa

SEQ ID NO: 648545 - DNA, 20 bp, mouse
ggaaagggagcagaaagcaa

SEQ ID NO: 648546 - DNA, 20 bp, mouse
gaaagctaacttaagctaac

SEQ ID NO: 648547 - DNA, 20 bp, mouse
gatataatctgtgtcacgtg

SEQ ID NO: 648548 - DNA, 20 bp, mouse
gaagaaaagaactgaacaaa

SEQ ID NO: 648549 - DNA, 20 bp, mouse
gtttctaatggaagagagac

SEQ ID NO: 648550 - DNA, 20 bp, mouse
gactatacaattatacatat

SEQ ID NO: 648551 - DNA, 20 bp, mouse
gcacagattatataatagcc

SEQ ID NO: 648552 - DNA, 20 bp, mouse
gacaggggatggatctgagt

SEQ ID NO: 648553 - DNA, 20 bp, mouse
gagtgggagaggaagtagga

SEQ ID NO: 648554 - DNA, 20 bp, mouse
gggaagtaggaaggactgaa

SEQ ID NO: 648555 - DNA, 20 bp, mouse
ggtaggaaggactgaaggga

SEQ ID NO: 648556 - DNA, 20 bp, mouse
ggacctctgtgccacctggg

SEQ ID NO: 648557 - DNA, 20 bp, mouse
gtagcaatacttctaggtaa

SEQ ID NO: 648558 - DNA, 20 bp, mouse
gaaccagtagcaatacttct

SEQ ID NO: 648559 - DNA, 20 bp, mouse
gtattgctactggttggaaa

SEQ ID NO: 648560 - DNA, 20 bp, mouse
gtatatgaaacacccttcag

SEQ ID NO: 648561 - DNA, 20 bp, mouse
gtaaatctccataagattga

SEQ ID NO: 648562 - DNA, 20 bp, mouse
gtgaaacacccttcagtggt

SEQ ID NO: 648563 - DNA, 20 bp, mouse
gagtggacctctgtgccacc

SEQ ID NO: 648564 - DNA, 20 bp, mouse
gggaaggggaaggtctcatg

SEQ ID NO: 648565 - DNA, 20 bp, mouse
gttggttgataaacagtctg

SEQ ID NO: 648566 - DNA, 20 bp, mouse
gcatccatgaaagttgggga

SEQ ID NO: 648567 - DNA, 20 bp, mouse
gccagcattgtagacacgat

SEQ ID NO: 648568 - DNA, 20 bp, mouse
gttctcatccatgaaagttg

SEQ ID NO: 648569 - DNA, 20 bp, mouse
ggtatgcagcatttcatagt

SEQ ID NO: 648570 - DNA, 20 bp, mouse
gattgtagacacgataggca

SEQ ID NO: 648571 - DNA, 20 bp, mouse
gtagaggagcagagagcaag

SEQ ID NO: 648572 - DNA, 20 bp, mouse
gggtgttgatgatcaaaccc

SEQ ID NO: 648573 - DNA, 20 bp, mouse
gcaagcatgactaatgccca

SEQ ID NO: 648574 - DNA, 20 bp, mouse
ggcagagagcaaggggagaa

SEQ ID NO: 648575 - DNA, 20 bp, mouse
gaagctggaatgcagctcag

SEQ ID NO: 648576 - DNA, 20 bp, mouse
gtcagactctacttgatcat

SEQ ID NO: 648577 - DNA, 20 bp, mouse
gccccagctccactagggct

SEQ ID NO: 648578 - DNA, 20 bp, mouse
gccctggaagtctaggtcag

SEQ ID NO: 648579 - DNA, 20 bp, mouse
gtccaagccctagtggagct

SEQ ID NO: 648580 - DNA, 20 bp, mouse
ggacaccatccttatttccc

SEQ ID NO: 648581 - DNA, 20 bp, mouse
gctagacttccagggaaata

SEQ ID NO: 648582 - DNA, 20 bp, mouse
gtgtcaaatatgattggaca

SEQ ID NO: 648583 - DNA, 20 bp, mouse
gtagaagctgtttatctatt

SEQ ID NO: 648584 - DNA, 20 bp, mouse
gaataacaggaagaggttat

SEQ ID NO: 648585 - DNA, 20 bp, mouse
gccccctgacctagacttcc

SEQ ID NO: 648586 - DNA, 20 bp, mouse
gagaactgagcactaggagg

SEQ ID NO: 648587 - DNA, 20 bp, mouse
gtaggcagttgtcgtagtca

SEQ ID NO: 648588 - DNA, 20 bp, mouse
gaaaagaactgagcactagg

SEQ ID NO: 648589 - DNA, 20 bp, mouse
gacaaaaaacactgccgtac

SEQ ID NO: 648590 - DNA, 20 bp, mouse
gaaaacactgccgtactggc

SEQ ID NO: 648591 - DNA, 20 bp, mouse
gctcagttcttttatgcaat

SEQ ID NO: 648592 - DNA, 20 bp, mouse
gcaccaaaggaggtcaaggc

SEQ ID NO: 648593 - DNA, 20 bp, mouse
gtcatcaccaaaggaggtca

SEQ ID NO: 648594 - DNA, 20 bp, mouse
gcataaaagaactgagcact

SEQ ID NO: 648595 - DNA, 20 bp, mouse
gttggtgatgaacagcacaa

SEQ ID NO: 648596 - DNA, 20 bp, mouse
ggctcggagacggaattctt

SEQ ID NO: 648597 - DNA, 20 bp, mouse
gcaaccaaacccaattgctt

SEQ ID NO: 648598 - DNA, 20 bp, mouse
gtcaggggacctaagcaatt

SEQ ID NO: 648599 - DNA, 20 bp, mouse
gggtcgcttggtgctctgat

SEQ ID NO: 648600 - DNA, 20 bp, mouse
gaggacagagcactggatct

SEQ ID NO: 648601 - DNA, 20 bp, mouse
gggacctaagcaattgggtt

SEQ ID NO: 648602 - DNA, 20 bp, mouse
gtaggcaggttgctcggaga

SEQ ID NO: 648603 - DNA, 20 bp, mouse
ggcttaggtcccctgaaaga

SEQ ID NO: 648604 - DNA, 20 bp, mouse
ggagcatagtccatctttca

SEQ ID NO: 648605 - DNA, 20 bp, mouse
ggccgctaaagtgcaggaag

SEQ ID NO: 648606 - DNA, 20 bp, mouse
gttgaactggtgaggatgaa

SEQ ID NO: 648607 - DNA, 20 bp, mouse
ggaggtcagctgatcccggc

SEQ ID NO: 648608 - DNA, 20 bp, mouse
gtgtggatcttgaactggtg

SEQ ID NO: 648609 - DNA, 20 bp, mouse
ggtaagaagtggggccgtcc

SEQ ID NO: 648610 - DNA, 20 bp, mouse
gcccaggaggggaccagcgc

SEQ ID NO: 648611 - DNA, 20 bp, mouse
gccggctgtggatcttgaac

SEQ ID NO: 648612 - DNA, 20 bp, mouse
gcggatcctgaagctgacac

SEQ ID NO: 648613 - DNA, 20 bp, mouse
gggggggcgggacttcgcgg

SEQ ID NO: 648614 - DNA, 20 bp, mouse
gcacagccggtgtcagcttc

SEQ ID NO: 648615 - DNA, 20 bp, mouse
gtgtcccgggctggggggtc

SEQ ID NO: 648616 - DNA, 20 bp, mouse
ggggccgcgctcgcgctcac

SEQ ID NO: 648617 - DNA, 20 bp, mouse
gctggctcggggccacccga

SEQ ID NO: 648618 - DNA, 20 bp, mouse
ggctcggggccacccgaggg

SEQ ID NO: 648619 - DNA, 20 bp, mouse
gagctggagctctggatctg

SEQ ID NO: 648620 - DNA, 20 bp, mouse
gcgcaggcgccgccctcggg

SEQ ID NO: 648621 - DNA, 20 bp, mouse
gccccgcaggcgccgccctc

SEQ ID NO: 648622 - DNA, 20 bp, mouse
gtacccgcgtggccctggct

SEQ ID NO: 648623 - DNA, 20 bp, mouse
gctctcccggctcccaagat

SEQ ID NO: 648624 - DNA, 20 bp, mouse
gtgagtccacagcaaggtct

SEQ ID NO: 648625 - DNA, 20 bp, mouse
gtcccaagatggggacagtt

SEQ ID NO: 648626 - DNA, 20 bp, mouse
gtcccgagcgatcacgagtt

SEQ ID NO: 648627 - DNA, 20 bp, mouse
gtgggcaagagcgacagcaa

SEQ ID NO: 648628 - DNA, 20 bp, mouse
gagggtcagcgggacggcgc

SEQ ID NO: 648629 - DNA, 20 bp, mouse
ggcccaactcgtgatcgctc

SEQ ID NO: 648630 - DNA, 20 bp, mouse
gttggcaagggtcagcggga

SEQ ID NO: 648631 - DNA, 20 bp, mouse
gtagaacgcaaagttggcaa

SEQ ID NO: 648632 - DNA, 20 bp, mouse
ggtagtgccccgcattaaca

SEQ ID NO: 648633 - DNA, 20 bp, mouse
gcccatgctcacacaagcgt

SEQ ID NO: 648634 - DNA, 20 bp, mouse
gctgaggggctcgggataaa

SEQ ID NO: 648635 - DNA, 20 bp, mouse
ggccgcttgcgtgtgagcat

SEQ ID NO: 648636 - DNA, 20 bp, mouse
gaactgacgtagtagaccaa

SEQ ID NO: 648637 - DNA, 20 bp, mouse
gcgcaagcgcaggaactagg

SEQ ID NO: 648638 - DNA, 20 bp, mouse
ggcccccccagctcagaacg

SEQ ID NO: 648639 - DNA, 20 bp, mouse
gacgtagtagaccaagggaa

SEQ ID NO: 648640 - DNA, 20 bp, mouse
gtaggaggcaggcaggctca

SEQ ID NO: 648641 - DNA, 20 bp, mouse
gtctgagctgggggggcgga

SEQ ID NO: 648642 - DNA, 20 bp, mouse
gccccctcccacccgctggc

SEQ ID NO: 648643 - DNA, 20 bp, mouse
ggaccgcaagcgcaggaact

SEQ ID NO: 648644 - DNA, 20 bp, mouse
gacagccccctcccacccgc

SEQ ID NO: 648645 - DNA, 20 bp, mouse
gaggcccagtgattacttcc

SEQ ID NO: 648646 - DNA, 20 bp, mouse
gtggtctgaggacactcaga

SEQ ID NO: 648647 - DNA, 20 bp, mouse
ggcagaagggcagtcaggaa

SEQ ID NO: 648648 - DNA, 20 bp, mouse
gctgaggcgccacccttagt

SEQ ID NO: 648649 - DNA, 20 bp, mouse
gaggcgccacccttagtggg

SEQ ID NO: 648650 - DNA, 20 bp, mouse
gggggacagagacctgcctg

SEQ ID NO: 648651 - DNA, 20 bp, mouse
ggccacccttagtgggagga

SEQ ID NO: 648652 - DNA, 20 bp, mouse
gagtgaacaggccatctgct

SEQ ID NO: 648653 - DNA, 20 bp, mouse
gtggagccaggcaggacgca

SEQ ID NO: 648654 - DNA, 20 bp, mouse
ggtaggaatgcacactggtg

SEQ ID NO: 648655 - DNA, 20 bp, mouse
gccacagctcctcagtgaac

SEQ ID NO: 648656 - DNA, 20 bp, mouse
gccggcgggaggggagacga

SEQ ID NO: 648657 - DNA, 20 bp, mouse
gaggagggcgggcggcggta

SEQ ID NO: 648658 - DNA, 20 bp, mouse
gcctccgccccgtggcccag

SEQ ID NO: 648659 - DNA, 20 bp, mouse
gcggcggcaagaagcttcgg

SEQ ID NO: 648660 - DNA, 20 bp, mouse
gaggaggcggagactctact

SEQ ID NO: 648661 - DNA, 20 bp, mouse
ggggagacgaagggctgcag

SEQ ID NO: 648662 - DNA, 20 bp, mouse
gagacgaagggctgcagggg

SEQ ID NO: 648663 - DNA, 20 bp, mouse
gcggcggcggcaagaagctt

SEQ ID NO: 648664 - DNA, 20 bp, mouse
gggagactctacttgggaat

SEQ ID NO: 648665 - DNA, 20 bp, mouse
ggagccgctgggccacgggg

SEQ ID NO: 648666 - DNA, 20 bp, mouse
gagcggaagcgcccagtcta

SEQ ID NO: 648667 - DNA, 20 bp, mouse
gagagagagccattcggcat

SEQ ID NO: 648668 - DNA, 20 bp, mouse
ggtacttccgggaggtgttg

SEQ ID NO: 648669 - DNA, 20 bp, mouse
gcctgggcgctgttacgtaa

SEQ ID NO: 648670 - DNA, 20 bp, mouse
gcgagcggcgctaacttgat

SEQ ID NO: 648671 - DNA, 20 bp, mouse
ggaagcttcaatccctgggg

SEQ ID NO: 648672 - DNA, 20 bp, mouse
gaccatggatacccacccag

SEQ ID NO: 648673 - DNA, 20 bp, mouse
gtaagggggaggtacgagcg

SEQ ID NO: 648674 - DNA, 20 bp, mouse
gcacacgccacgtccaatgg

SEQ ID NO: 648675 - DNA, 20 bp, mouse
gaaagaagcttcaatccctg

SEQ ID NO: 648676 - DNA, 20 bp, mouse
gctctcgggcaactctggat

SEQ ID NO: 648677 - DNA, 20 bp, mouse
gctcccttcggggcagtctc

SEQ ID NO: 648678 - DNA, 20 bp, mouse
gaagccagggcacctcccag

SEQ ID NO: 648679 - DNA, 20 bp, mouse
ggcgggctctcgggcaactc

SEQ ID NO: 648680 - DNA, 20 bp, mouse
gttgaggtgggaaggcccga

SEQ ID NO: 648681 - DNA, 20 bp, mouse
gcggccagatccacgctgag

SEQ ID NO: 648682 - DNA, 20 bp, mouse
ggtgaactctgggatgagtt

SEQ ID NO: 648683 - DNA, 20 bp, mouse
gtcaagtgagacccgagctg

SEQ ID NO: 648684 - DNA, 20 bp, mouse
gagaccgtcaagtgaactct

SEQ ID NO: 648685 - DNA, 20 bp, mouse
gctcgggtctcacttgaggt

SEQ ID NO: 648686 - DNA, 20 bp, mouse
gctgccggagccaagagcgc

SEQ ID NO: 648687 - DNA, 20 bp, mouse
gaggcctgagacatagtccc

SEQ ID NO: 648688 - DNA, 20 bp, mouse
ggagaggagcccaaacagag

SEQ ID NO: 648689 - DNA, 20 bp, mouse
gcgccctgcgctcttggctc

SEQ ID NO: 648690 - DNA, 20 bp, mouse
gccggcccggcaaggtgcca

SEQ ID NO: 648691 - DNA, 20 bp, mouse
ggcatagggctgttcgtaga

SEQ ID NO: 648692 - DNA, 20 bp, mouse
gcgcaggagtctgacgcata

SEQ ID NO: 648693 - DNA, 20 bp, mouse
gactcctgggactatgtctc

SEQ ID NO: 648694 - DNA, 20 bp, mouse
ggacggggcaagtccctttt

SEQ ID NO: 648695 - DNA, 20 bp, mouse
gacccaaggcgcatgcgcgg

SEQ ID NO: 648696 - DNA, 20 bp, mouse
gaagagaaggcacagaacaa

SEQ ID NO: 648697 - DNA, 20 bp, mouse
gacagaacaaggggagtgaa

SEQ ID NO: 648698 - DNA, 20 bp, mouse
gaaggtgccctggatttata

SEQ ID NO: 648699 - DNA, 20 bp, mouse
gtaggcactggggctctgaa

SEQ ID NO: 648700 - DNA, 20 bp, mouse
gtgagggaactgaaggtcag

SEQ ID NO: 648701 - DNA, 20 bp, mouse
gtggcctccttcatggctga

SEQ ID NO: 648702 - DNA, 20 bp, mouse
gttaaggccgaggcggaagg

SEQ ID NO: 648703 - DNA, 20 bp, mouse
gttagtttcactaccccaga

SEQ ID NO: 648704 - DNA, 20 bp, mouse
gccatgaaggaggccactaa

SEQ ID NO: 648705 - DNA, 20 bp, mouse
gagaggcctgagatacctta

SEQ ID NO: 648706 - DNA, 20 bp, mouse
gagatggcaaacatacgcaa

SEQ ID NO: 648707 - DNA, 20 bp, mouse
gaagtcttgtgcatgggggt

SEQ ID NO: 648708 - DNA, 20 bp, mouse
gcacactgaaatgctcaaat

SEQ ID NO: 648709 - DNA, 20 bp, mouse
gtggacaaagtcttgtgcat

SEQ ID NO: 648710 - DNA, 20 bp, mouse
gtaatgaagaatgtgtatga

SEQ ID NO: 648711 - DNA, 20 bp, mouse
gtaggaaccaatgaaatgcg

SEQ ID NO: 648712 - DNA, 20 bp, mouse
ggaggggtgggtctcattat

SEQ ID NO: 648713 - DNA, 20 bp, mouse
gatgaaatgcgaggtaagta

SEQ ID NO: 648714 - DNA, 20 bp, mouse
ggatggtatgattttgtaat

SEQ ID NO: 648715 - DNA, 20 bp, mouse
gtatgattttgtaatggggt

SEQ ID NO: 648716 - DNA, 20 bp, mouse
gaggcgctgcaggaccaagt

SEQ ID NO: 648717 - DNA, 20 bp, mouse
gagagctggcggcccctggt

SEQ ID NO: 648718 - DNA, 20 bp, mouse
gaagagcgggatcgagagta

SEQ ID NO: 648719 - DNA, 20 bp, mouse
gcacgctggccaatgaagag

SEQ ID NO: 648720 - DNA, 20 bp, mouse
gggccagcgtgtcctgtggg

SEQ ID NO: 648721 - DNA, 20 bp, mouse
gtcccgcccagcttcctcgg

SEQ ID NO: 648722 - DNA, 20 bp, mouse
gccagcccccgcgctctggt

SEQ ID NO: 648723 - DNA, 20 bp, mouse
gcccccgcgctctggtgggc

SEQ ID NO: 648724 - DNA, 20 bp, mouse
gctgcagcgcctctaggctg

SEQ ID NO: 648725 - DNA, 20 bp, mouse
ggcgctgccgccgaggaagc

SEQ ID NO: 648726 - DNA, 20 bp, mouse
gcggggagaacagacatggt

SEQ ID NO: 648727 - DNA, 20 bp, mouse
ggcccggaagcgagctatat

SEQ ID NO: 648728 - DNA, 20 bp, mouse
gggtgggtggggtcccgcac

SEQ ID NO: 648729 - DNA, 20 bp, mouse
gcgcgcggctctaaagtagg

SEQ ID NO: 648730 - DNA, 20 bp, mouse
ggtttcggggagaacagaca

SEQ ID NO: 648731 - DNA, 20 bp, mouse
ggcgcgatgcggcctatggg

SEQ ID NO: 648732 - DNA, 20 bp, mouse
ggagaacagacatggttggg

SEQ ID NO: 648733 - DNA, 20 bp, mouse
gcggcctatgggcggatgct

SEQ ID NO: 648734 - DNA, 20 bp, mouse
gaggggcggggccaaccgta

SEQ ID NO: 648735 - DNA, 20 bp, mouse
ggctgggaaatgtagtttcg

SEQ ID NO: 648736 - DNA, 20 bp, mouse
gcccgcagagtataggggcg

SEQ ID NO: 648737 - DNA, 20 bp, mouse
ggggcttcgagcacccagaa

SEQ ID NO: 648738 - DNA, 20 bp, mouse
ggggccgccacgtggagcgt

SEQ ID NO: 648739 - DNA, 20 bp, mouse
gtccgcgcccgcagagtata

SEQ ID NO: 648740 - DNA, 20 bp, mouse
ggccccgcccctatactctg

SEQ ID NO: 648741 - DNA, 20 bp, mouse
gacagcttcccagaaaggta

SEQ ID NO: 648742 - DNA, 20 bp, mouse
ggcgcccacgctccacgtgg

SEQ ID NO: 648743 - DNA, 20 bp, mouse
gtctgcgggcgcggagcctg

SEQ ID NO: 648744 - DNA, 20 bp, mouse
gtacgccacggcaacggcgc

SEQ ID NO: 648745 - DNA, 20 bp, mouse
gccacgctacgccacggcaa

SEQ ID NO: 648746 - DNA, 20 bp, mouse
gcactcacttgtaacaccta

SEQ ID NO: 648747 - DNA, 20 bp, mouse
gcacacccttagcacaggtt

SEQ ID NO: 648748 - DNA, 20 bp, mouse
gaacttcagggctgaggtgc

SEQ ID NO: 648749 - DNA, 20 bp, mouse
ggtctccagatagaacttca

SEQ ID NO: 648750 - DNA, 20 bp, mouse
gtcagccctgaagttctatc

SEQ ID NO: 648751 - DNA, 20 bp, mouse
gctgaggtgcaggttcctta

SEQ ID NO: 648752 - DNA, 20 bp, mouse
ggcacacacacccttagcac

SEQ ID NO: 648753 - DNA, 20 bp, mouse
gccaagccaaacctgtgcta

SEQ ID NO: 648754 - DNA, 20 bp, mouse
ggatttacatgtaaaggcaa

SEQ ID NO: 648755 - DNA, 20 bp, mouse
ggatctgctggaataaggat

SEQ ID NO: 648756 - DNA, 20 bp, mouse
ggggctgctcgggaccccgg

SEQ ID NO: 648757 - DNA, 20 bp, mouse
gccgcggcccacgctcccgc

SEQ ID NO: 648758 - DNA, 20 bp, mouse
ggcccctcgcgccacgcgga

SEQ ID NO: 648759 - DNA, 20 bp, mouse
gggccggagcgcagcctcgg

SEQ ID NO: 648760 - DNA, 20 bp, mouse
ggcgcccgggggggcctcga

SEQ ID NO: 648761 - DNA, 20 bp, mouse
gtcccgccgaggctgcgctc

SEQ ID NO: 648762 - DNA, 20 bp, mouse
ggcccgcacggtcaagtccg

SEQ ID NO: 648763 - DNA, 20 bp, mouse
gccggcagagggcagcagtt

SEQ ID NO: 648764 - DNA, 20 bp, mouse
ggccgcgcgcggcgcccgca

SEQ ID NO: 648765 - DNA, 20 bp, mouse
gcggccgtcgaggccccccc

SEQ ID NO: 648766 - DNA, 20 bp, mouse
gaggggcagggacaacagga

SEQ ID NO: 648767 - DNA, 20 bp, mouse
gggaccgtcccgctcccgga

SEQ ID NO: 648768 - DNA, 20 bp, mouse
gtggctgcaggacggaggaa

SEQ ID NO: 648769 - DNA, 20 bp, mouse
gccgcagcctaggtcggtct

SEQ ID NO: 648770 - DNA, 20 bp, mouse
gcgggcttccgcagcctagt

SEQ ID NO: 648771 - DNA, 20 bp, mouse
ggtccctgcccctccgggag

SEQ ID NO: 648772 - DNA, 20 bp, mouse
gacaggaggggtagcagcgg

SEQ ID NO: 648773 - DNA, 20 bp, mouse
ggacggtcccagaccgacct

SEQ ID NO: 648774 - DNA, 20 bp, mouse
gctctggccgcagcctaggt

SEQ ID NO: 648775 - DNA, 20 bp, mouse
gtcccgctcccggaggggca

SEQ ID NO: 648776 - DNA, 20 bp, mouse
gtacacccttaacacagatt

SEQ ID NO: 648777 - DNA, 20 bp, mouse
ggtgtagaagaacctcttgg

SEQ ID NO: 648778 - DNA, 20 bp, mouse
gcaagccaaatctgtgttaa

SEQ ID NO: 648779 - DNA, 20 bp, mouse
gagaggttcttctacactat

SEQ ID NO: 648780 - DNA, 20 bp, mouse
gttgtcctcagtaggagcta

SEQ ID NO: 648781 - DNA, 20 bp, mouse
gtcacccctagctcctactg

SEQ ID NO: 648782 - DNA, 20 bp, mouse
ggccaaaaacagagcctaga

SEQ ID NO: 648783 - DNA, 20 bp, mouse
gtacatccataccccaggtc

SEQ ID NO: 648784 - DNA, 20 bp, mouse
gctaaaatagactaggaaac

SEQ ID NO: 648785 - DNA, 20 bp, mouse
gagcatcctgacctggggta

SEQ ID NO: 648786 - DNA, 20 bp, mouse
gtatcaacaaggtctgtcaa

SEQ ID NO: 648787 - DNA, 20 bp, mouse
ggagccgggcatgtgatcct

SEQ ID NO: 648788 - DNA, 20 bp, mouse
gtggacctaagattaggcta

SEQ ID NO: 648789 - DNA, 20 bp, mouse
gattaggctaggggaaatca

SEQ ID NO: 648790 - DNA, 20 bp, mouse
gcttccagaggattctgatt

SEQ ID NO: 648791 - DNA, 20 bp, mouse
gtgatgctggacctaagatt

SEQ ID NO: 648792 - DNA, 20 bp, mouse
gggaaaaccccacctctctc

SEQ ID NO: 648793 - DNA, 20 bp, mouse
gtccctcttttgattgtcaa

SEQ ID NO: 648794 - DNA, 20 bp, mouse
gagccgagatccctcagtgg

SEQ ID NO: 648795 - DNA, 20 bp, mouse
gcacatgcccggctctatcc

SEQ ID NO: 648796 - DNA, 20 bp, mouse
gcccccagatatgaccaatc

SEQ ID NO: 648797 - DNA, 20 bp, mouse
gggaaagccggagccctctg

SEQ ID NO: 648798 - DNA, 20 bp, mouse
gagtccctagaatggggtga

SEQ ID NO: 648799 - DNA, 20 bp, mouse
gaatccctcaccccattcta

SEQ ID NO: 648800 - DNA, 20 bp, mouse
gtccccgcacccccaattcc

SEQ ID NO: 648801 - DNA, 20 bp, mouse
gtttccctagtccctagaat

SEQ ID NO: 648802 - DNA, 20 bp, mouse
gcaaggtccccgcaaatgga

SEQ ID NO: 648803 - DNA, 20 bp, mouse
ggggccctgggcgaccagtt

SEQ ID NO: 648804 - DNA, 20 bp, mouse
gcataggaggccctccggcc

SEQ ID NO: 648805 - DNA, 20 bp, mouse
gagagaagaggcgggctcta

SEQ ID NO: 648806 - DNA, 20 bp, mouse
gtccagcaagcccttgggtt

SEQ ID NO: 648807 - DNA, 20 bp, mouse
ggaatcggtgcctaacccaa

SEQ ID NO: 648808 - DNA, 20 bp, mouse
gtaggctatccatggagcag

SEQ ID NO: 648809 - DNA, 20 bp, mouse
gggactccgcctctgctcca

SEQ ID NO: 648810 - DNA, 20 bp, mouse
ggctatccatggagcagagg

SEQ ID NO: 648811 - DNA, 20 bp, mouse
gcgaacacttaggctatcca

SEQ ID NO: 648812 - DNA, 20 bp, mouse
gggtctgagtaatttatgga

SEQ ID NO: 648813 - DNA, 20 bp, mouse
gtactcagacccgcggagtt

SEQ ID NO: 648814 - DNA, 20 bp, mouse
gaggtcccgcccctcaccgc

SEQ ID NO: 648815 - DNA, 20 bp, mouse
gcggagtccagcaagccctt

SEQ ID NO: 648816 - DNA, 20 bp, mouse
gccctgcagccgccaatggg

SEQ ID NO: 648817 - DNA, 20 bp, mouse
gctaggagcgcacaccactc

SEQ ID NO: 648818 - DNA, 20 bp, mouse
gccagcccctcacggcctaa

SEQ ID NO: 648819 - DNA, 20 bp, mouse
ggcgccccttaggccgtgag

SEQ ID NO: 648820 - DNA, 20 bp, mouse
gcacatctgtgcagatatgg

SEQ ID NO: 648821 - DNA, 20 bp, mouse
ggcctaaggggcgcgacccc

SEQ ID NO: 648822 - DNA, 20 bp, mouse
gagcgcacaccactctggct

SEQ ID NO: 648823 - DNA, 20 bp, mouse
gttgaggtgcaggacgtcat

SEQ ID NO: 648824 - DNA, 20 bp, mouse
gaatgggaggcggagacacg

SEQ ID NO: 648825 - DNA, 20 bp, mouse
ggccccctgcagccgccaat

SEQ ID NO: 648826 - DNA, 20 bp, mouse
gcaaaacccgtgtgaagcag

SEQ ID NO: 648827 - DNA, 20 bp, mouse
gggcctgtgaaagtttgtgt

SEQ ID NO: 648828 - DNA, 20 bp, mouse
ggccaggctggattactcag

SEQ ID NO: 648829 - DNA, 20 bp, mouse
gcccgtgtgaagcagaggtc

SEQ ID NO: 648830 - DNA, 20 bp, mouse
gtcagtggcccccacgccca

SEQ ID NO: 648831 - DNA, 20 bp, mouse
gccacgcccagggcaaacac

SEQ ID NO: 648832 - DNA, 20 bp, mouse
ggcccacaactgcgtgactg

SEQ ID NO: 648833 - DNA, 20 bp, mouse
gaggactctgaggtccaagt

SEQ ID NO: 648834 - DNA, 20 bp, mouse
gatgcacaagggtcccactg

SEQ ID NO: 648835 - DNA, 20 bp, mouse
gtccaagtgggcggggagaa

SEQ ID NO: 648836 - DNA, 20 bp, mouse
gcccggggaccgcaatcccg

SEQ ID NO: 648837 - DNA, 20 bp, mouse
gaggaggaactgaggcccga

SEQ ID NO: 648838 - DNA, 20 bp, mouse
gcggccgggtgagcaccctc

SEQ ID NO: 648839 - DNA, 20 bp, mouse
gcggctagattagaggtaag

SEQ ID NO: 648840 - DNA, 20 bp, mouse
gggcgaagggagactacttc

SEQ ID NO: 648841 - DNA, 20 bp, mouse
gccaagcgtcctctaggagg

SEQ ID NO: 648842 - DNA, 20 bp, mouse
ggacgcggaagaagtccttc

SEQ ID NO: 648843 - DNA, 20 bp, mouse
gaatcccgcggctagattag

SEQ ID NO: 648844 - DNA, 20 bp, mouse
gctagattagaggtaagggg

SEQ ID NO: 648845 - DNA, 20 bp, mouse
gtcgctgggcctgggtaggg

SEQ ID NO: 648846 - DNA, 20 bp, mouse
gtcagctggaggtagatcga

SEQ ID NO: 648847 - DNA, 20 bp, mouse
gcagttctgagcattgactg

SEQ ID NO: 648848 - DNA, 20 bp, mouse
gccagctaacagcttccacc

SEQ ID NO: 648849 - DNA, 20 bp, mouse
ggactggggatagctgacgg

SEQ ID NO: 648850 - DNA, 20 bp, mouse
gtagctgacggaggaaggga

SEQ ID NO: 648851 - DNA, 20 bp, mouse
gtctcagaccgcagaaaagg

SEQ ID NO: 648852 - DNA, 20 bp, mouse
ggaggtagatcgagggtcac

SEQ ID NO: 648853 - DNA, 20 bp, mouse
gagtgcctgcccctggggcg

SEQ ID NO: 648854 - DNA, 20 bp, mouse
gagaaaacgggatctgtgaa

SEQ ID NO: 648855 - DNA, 20 bp, mouse
ggggaacttcaatgtgaagg

SEQ ID NO: 648856 - DNA, 20 bp, mouse
gcctcctgggcacagctcta

SEQ ID NO: 648857 - DNA, 20 bp, mouse
ggggcacagctctagggaac

SEQ ID NO: 648858 - DNA, 20 bp, mouse
gcagctctagggaaccggaa

SEQ ID NO: 648859 - DNA, 20 bp, mouse
gaggaggtggtatcgatgtc

SEQ ID NO: 648860 - DNA, 20 bp, mouse
gtgtgcccaggaggcaatga

SEQ ID NO: 648861 - DNA, 20 bp, mouse
gtagtgaggagaaaagtcat

SEQ ID NO: 648862 - DNA, 20 bp, mouse
gtgaaaggagtcagctagtg

SEQ ID NO: 648863 - DNA, 20 bp, mouse
ggaaaagtcatgggggtgaa

SEQ ID NO: 648864 - DNA, 20 bp, mouse
gtctagggaaccggaatggc

SEQ ID NO: 648865 - DNA, 20 bp, mouse
gccctccctcattgcctcct

SEQ ID NO: 648866 - DNA, 20 bp, mouse
gtccttcggggcccctcctc

SEQ ID NO: 648867 - DNA, 20 bp, mouse
ggggaagggtacccgaggag

SEQ ID NO: 648868 - DNA, 20 bp, mouse
gaccataaggagaggagacg

SEQ ID NO: 648869 - DNA, 20 bp, mouse
gagccaggctgggagatgga

SEQ ID NO: 648870 - DNA, 20 bp, mouse
gtgggtcataccataaggag

SEQ ID NO: 648871 - DNA, 20 bp, mouse
gacccgaggaggggccccga

SEQ ID NO: 648872 - DNA, 20 bp, mouse
gtctgtgcaggatctgtcat

SEQ ID NO: 648873 - DNA, 20 bp, mouse
gccggagcgcactacctctg

SEQ ID NO: 648874 - DNA, 20 bp, mouse
ggggacccggtcgacgcgac

SEQ ID NO: 648875 - DNA, 20 bp, mouse
gtcgcccggtccacctcctt

SEQ ID NO: 648876 - DNA, 20 bp, mouse
gccctggagaagaacgtgcg

SEQ ID NO: 648877 - DNA, 20 bp, mouse
ggagcatccgacattgagaa

SEQ ID NO: 648878 - DNA, 20 bp, mouse
gtggggcaaccgttcaatta

SEQ ID NO: 648879 - DNA, 20 bp, mouse
gctctctgagctgttgagat

SEQ ID NO: 648880 - DNA, 20 bp, mouse
gcgggaaagcgggagcccgg

SEQ ID NO: 648881 - DNA, 20 bp, mouse
ggcaggatctcaggggtcgc

SEQ ID NO: 648882 - DNA, 20 bp, mouse
gtgcacgaattcatcttgct

SEQ ID NO: 648883 - DNA, 20 bp, mouse
gaactcaccgttctcaatgt

SEQ ID NO: 648884 - DNA, 20 bp, mouse
gaaaccgcgagtttggcctt

SEQ ID NO: 648885 - DNA, 20 bp, mouse
gagtgctcccgtcacaatta

SEQ ID NO: 648886 - DNA, 20 bp, mouse
gtcccaggggtgggaatgat

SEQ ID NO: 648887 - DNA, 20 bp, mouse
ggaccaatcacctattccca

SEQ ID NO: 648888 - DNA, 20 bp, mouse
gtcaaaggtggaagcgttct

SEQ ID NO: 648889 - DNA, 20 bp, mouse
gacccctgggaataggtgat

SEQ ID NO: 648890 - DNA, 20 bp, mouse
gaccgagcctctccattgga

SEQ ID NO: 648891 - DNA, 20 bp, mouse
ggggaactccgattggctgt

SEQ ID NO: 648892 - DNA, 20 bp, mouse
gaggtcccgcccccttgcta

SEQ ID NO: 648893 - DNA, 20 bp, mouse
gctatgcagtaccaagtcga

SEQ ID NO: 648894 - DNA, 20 bp, mouse
gcctaaccgggaactccgat

SEQ ID NO: 648895 - DNA, 20 bp, mouse
gagggaagacgccccctaac

SEQ ID NO: 648896 - DNA, 20 bp, mouse
gtggggcgaggctacccaat

SEQ ID NO: 648897 - DNA, 20 bp, mouse
gtacccaatgggatccccgg

SEQ ID NO: 648898 - DNA, 20 bp, mouse
gaccccagcgggagaggatg

SEQ ID NO: 648899 - DNA, 20 bp, mouse
ggggcaggggctgtgtctag

SEQ ID NO: 648900 - DNA, 20 bp, mouse
gcggacgaccccagcgggag

SEQ ID NO: 648901 - DNA, 20 bp, mouse
gctcccccggggatcccatt

SEQ ID NO: 648902 - DNA, 20 bp, mouse
gcgctcgcagaatggggctg

SEQ ID NO: 648903 - DNA, 20 bp, mouse
gaaggcgcggacgaccccag

SEQ ID NO: 648904 - DNA, 20 bp, mouse
gttacccagagggtaaggcg

SEQ ID NO: 648905 - DNA, 20 bp, mouse
gggcggggacaaggctgagg

SEQ ID NO: 648906 - DNA, 20 bp, mouse
ggaagctggcgacatggaag

SEQ ID NO: 648907 - DNA, 20 bp, mouse
ggcgctggaagctggcgaca

SEQ ID NO: 648908 - DNA, 20 bp, mouse
gggaagatggcgctggaagc

SEQ ID NO: 648909 - DNA, 20 bp, mouse
ggaagcgcggccggaatgag

SEQ ID NO: 648910 - DNA, 20 bp, mouse
ggtcatgtcggaatccgagt

SEQ ID NO: 648911 - DNA, 20 bp, mouse
gcctgcgcgccgcgggaaga

SEQ ID NO: 648912 - DNA, 20 bp, mouse
gagacggggctggacgcccg

SEQ ID NO: 648913 - DNA, 20 bp, mouse
gtgcaaatggcggtgagcga

SEQ ID NO: 648914 - DNA, 20 bp, mouse
gttgcagaggcctatcgctg

SEQ ID NO: 648915 - DNA, 20 bp, mouse
gcggccggaatgagaggcgc

SEQ ID NO: 648916 - DNA, 20 bp, mouse
gcaaatgaggacactgggcc

SEQ ID NO: 648917 - DNA, 20 bp, mouse
gttgcatatccgaacctggg

SEQ ID NO: 648918 - DNA, 20 bp, mouse
gccctagaaaggaggaagta

SEQ ID NO: 648919 - DNA, 20 bp, mouse
gcacacacagttgatatgaa

SEQ ID NO: 648920 - DNA, 20 bp, mouse
gcctgtgagtccatctcagg

SEQ ID NO: 648921 - DNA, 20 bp, mouse
gcatttgcatatccgaacct

SEQ ID NO: 648922 - DNA, 20 bp, mouse
gggaaagttctgaagcgcag

SEQ ID NO: 648923 - DNA, 20 bp, mouse
gtcctgattccaaactcgga

SEQ ID NO: 648924 - DNA, 20 bp, mouse
gcatatccgaacctgggagg

SEQ ID NO: 648925 - DNA, 20 bp, mouse
gaccatccgagtttggaatc

SEQ ID NO: 648926 - DNA, 20 bp, mouse
gcctcccagtgggctctact

SEQ ID NO: 648927 - DNA, 20 bp, mouse
ggggcaggggtggaccacta

SEQ ID NO: 648928 - DNA, 20 bp, mouse
ggcgaggggcggaatctctg

SEQ ID NO: 648929 - DNA, 20 bp, mouse
gagggaacaggacctcgggg

SEQ ID NO: 648930 - DNA, 20 bp, mouse
gtgaagacccggggccctca

SEQ ID NO: 648931 - DNA, 20 bp, mouse
gtagagcccactgggaggaa

SEQ ID NO: 648932 - DNA, 20 bp, mouse
gactagggaacaggacctcg

SEQ ID NO: 648933 - DNA, 20 bp, mouse
gggcccaagctactcactct

SEQ ID NO: 648934 - DNA, 20 bp, mouse
ggggtggaccactagggaac

SEQ ID NO: 648935 - DNA, 20 bp, mouse
gggaaagaggcgaccctggc

SEQ ID NO: 648936 - DNA, 20 bp, mouse
gaaggtctgggacactggtg

SEQ ID NO: 648937 - DNA, 20 bp, mouse
gcggccgggacctatattta

SEQ ID NO: 648938 - DNA, 20 bp, mouse
gcgcgcgccaggcaggggtt

SEQ ID NO: 648939 - DNA, 20 bp, mouse
gaagaccggtgagtgagcag

SEQ ID NO: 648940 - DNA, 20 bp, mouse
gagggcaggggttaccgaga

SEQ ID NO: 648941 - DNA, 20 bp, mouse
ggaaccgtccaattgaaggt

SEQ ID NO: 648942 - DNA, 20 bp, mouse
gactcagccggaatgtgggt

SEQ ID NO: 648943 - DNA, 20 bp, mouse
ggggccgctatccggattgc

SEQ ID NO: 648944 - DNA, 20 bp, mouse
gacattcatccctgcgtggg

SEQ ID NO: 648945 - DNA, 20 bp, mouse
ggagtgagcccggcagtcca

SEQ ID NO: 648946 - DNA, 20 bp, mouse
gacctggagccacaattcag

SEQ ID NO: 648947 - DNA, 20 bp, mouse
gcacaattcaggggtatatt

SEQ ID NO: 648948 - DNA, 20 bp, mouse
gacaacctattcagcgtggt

SEQ ID NO: 648949 - DNA, 20 bp, mouse
ggactcatctgcagccagga

SEQ ID NO: 648950 - DNA, 20 bp, mouse
gcacccccaccacgctgaat

SEQ ID NO: 648951 - DNA, 20 bp, mouse
ggctccaggtaaggccatcc

SEQ ID NO: 648952 - DNA, 20 bp, mouse
ggcatcttattgtttccaga

SEQ ID NO: 648953 - DNA, 20 bp, mouse
gtggaatgcgccgcagaatg

SEQ ID NO: 648954 - DNA, 20 bp, mouse
gttagattagtaaaagggga

SEQ ID NO: 648955 - DNA, 20 bp, mouse
gcagccaggatggccttacc

SEQ ID NO: 648956 - DNA, 20 bp, mouse
gtgtggagcgaatgctgcta

SEQ ID NO: 648957 - DNA, 20 bp, mouse
ggcgggcagcaagagaactg

SEQ ID NO: 648958 - DNA, 20 bp, mouse
gacggcgctactactaccac

SEQ ID NO: 648959 - DNA, 20 bp, mouse
gctactcagaggacggggtt

SEQ ID NO: 648960 - DNA, 20 bp, mouse
gttactagaacctgtttctg

SEQ ID NO: 648961 - DNA, 20 bp, mouse
gagcgccgtcctggcacagg

SEQ ID NO: 648962 - DNA, 20 bp, mouse
ggggtaagacatggtgccgg

SEQ ID NO: 648963 - DNA, 20 bp, mouse
ggtggattggctgagtgctg

SEQ ID NO: 648964 - DNA, 20 bp, mouse
ggcaacctactcagaggacg

SEQ ID NO: 648965 - DNA, 20 bp, mouse
gcggaacacgccacagaaac

SEQ ID NO: 648966 - DNA, 20 bp, mouse
gtccctcactgtgtgatcta

SEQ ID NO: 648967 - DNA, 20 bp, mouse
gtacaggtgaggaaactatg

SEQ ID NO: 648968 - DNA, 20 bp, mouse
gtcctcacctgtacagagtc

SEQ ID NO: 648969 - DNA, 20 bp, mouse
gctaacattctatgagtgta

SEQ ID NO: 648970 - DNA, 20 bp, mouse
gtactgggtcatggtaggag

SEQ ID NO: 648971 - DNA, 20 bp, mouse
ggaaagctgaatctgtcaag

SEQ ID NO: 648972 - DNA, 20 bp, mouse
gcctaccatgacccagtagg

SEQ ID NO: 648973 - DNA, 20 bp, mouse
ggagctacaagggagtctta

SEQ ID NO: 648974 - DNA, 20 bp, mouse
gtgaatctgtcaagaggctc

SEQ ID NO: 648975 - DNA, 20 bp, mouse
ggatcacacagtgagggaca

SEQ ID NO: 648976 - DNA, 20 bp, mouse
gctgccaacagggccctaga

SEQ ID NO: 648977 - DNA, 20 bp, mouse
ggggttccatgatgtgggaa

SEQ ID NO: 648978 - DNA, 20 bp, mouse
gcctcagaggtggagtagtg

SEQ ID NO: 648979 - DNA, 20 bp, mouse
gaaggccacgccctcagagg

SEQ ID NO: 648980 - DNA, 20 bp, mouse
gtctccccaggactggtcta

SEQ ID NO: 648981 - DNA, 20 bp, mouse
gaagtggggcactgttaggt

SEQ ID NO: 648982 - DNA, 20 bp, mouse
gcttccctctagggccctgt

SEQ ID NO: 648983 - DNA, 20 bp, mouse
gggtaaggccacgccctcag

SEQ ID NO: 648984 - DNA, 20 bp, mouse
gagggcgggaccaggacggg

SEQ ID NO: 648985 - DNA, 20 bp, mouse
gtggcagggttccatgatgt

SEQ ID NO: 648986 - DNA, 20 bp, mouse
gggctctgaacgggggggcg

SEQ ID NO: 648987 - DNA, 20 bp, mouse
gaggcgaggtctgggagaaa

SEQ ID NO: 648988 - DNA, 20 bp, mouse
ggggggcgggctctgaacgg

SEQ ID NO: 648989 - DNA, 20 bp, mouse
gcggagccttggataaggcg

SEQ ID NO: 648990 - DNA, 20 bp, mouse
gcatggctaagtccattctt

SEQ ID NO: 648991 - DNA, 20 bp, mouse
gccttggataaggcgaggtc

SEQ ID NO: 648992 - DNA, 20 bp, mouse
gcaccccagaccctgcccag

SEQ ID NO: 648993 - DNA, 20 bp, mouse
gacaagttcatgtacggtga

SEQ ID NO: 648994 - DNA, 20 bp, mouse
gaaggcctcctaccctttcc

SEQ ID NO: 648995 - DNA, 20 bp, mouse
gtgaaatcgcctctttacga

SEQ ID NO: 648996 - DNA, 20 bp, mouse
ggggggggggtcaccggttc

SEQ ID NO: 648997 - DNA, 20 bp, mouse
gtgccgccgccgctaggctc

SEQ ID NO: 648998 - DNA, 20 bp, mouse
gcagctctcagagtggccag

SEQ ID NO: 648999 - DNA, 20 bp, mouse
gcagagtggccagaggctga

SEQ ID NO: 649000 - DNA, 20 bp, mouse
gtcactggcaatggagaaca

SEQ ID NO: 649001 - DNA, 20 bp, mouse
ggggaccactcatcgccttc

SEQ ID NO: 649002 - DNA, 20 bp, mouse
gcgtctctggctgataatga

SEQ ID NO: 649003 - DNA, 20 bp, mouse
gggaacaggacgcaacgcaa

SEQ ID NO: 649004 - DNA, 20 bp, mouse
gtcggacggaagcgtggggg

SEQ ID NO: 649005 - DNA, 20 bp, mouse
gttccagagcctagcggcgg

SEQ ID NO: 649006 - DNA, 20 bp, mouse
ggggctgggcgccctcaagg

SEQ ID NO: 649007 - DNA, 20 bp, mouse
ggcagcggcgtggcccaagt

SEQ ID NO: 649008 - DNA, 20 bp, mouse
gcggcgtggcccaagtggga

SEQ ID NO: 649009 - DNA, 20 bp, mouse
gcacacgggcccatcccact

SEQ ID NO: 649010 - DNA, 20 bp, mouse
ggtgggaggggcgagagagc

SEQ ID NO: 649011 - DNA, 20 bp, mouse
gcctcccattgggtcccaac

SEQ ID NO: 649012 - DNA, 20 bp, mouse
gccacaggcggggcgcacac

SEQ ID NO: 649013 - DNA, 20 bp, mouse
gggaggggggggagcgaagt

SEQ ID NO: 649014 - DNA, 20 bp, mouse
gaggaaggcgtgtaagcggg

SEQ ID NO: 649015 - DNA, 20 bp, mouse
gggggcttccagacgggagg

SEQ ID NO: 649016 - DNA, 20 bp, mouse
ggggacccgatagaagatta

SEQ ID NO: 649017 - DNA, 20 bp, mouse
gtcagcgtcccgcgagaatg

SEQ ID NO: 649018 - DNA, 20 bp, mouse
gcccgggttgaggaactcaa

SEQ ID NO: 649019 - DNA, 20 bp, mouse
ggacccaccgagaactgcgg

SEQ ID NO: 649020 - DNA, 20 bp, mouse
gagcgcgcggggtgaaaggt

SEQ ID NO: 649021 - DNA, 20 bp, mouse
gttcccgcccggagaaaaga

SEQ ID NO: 649022 - DNA, 20 bp, mouse
gcgcgcgccggccgttcccc

SEQ ID NO: 649023 - DNA, 20 bp, mouse
gcggtcgccagcctgggcaa

SEQ ID NO: 649024 - DNA, 20 bp, mouse
gcgcccgagtacaccaatcc

SEQ ID NO: 649025 - DNA, 20 bp, mouse
gtggccactcgtggagggcg

SEQ ID NO: 649026 - DNA, 20 bp, mouse
gggaatgcgtccgggagagg

SEQ ID NO: 649027 - DNA, 20 bp, mouse
ggggaggaggcggaagtcca

SEQ ID NO: 649028 - DNA, 20 bp, mouse
gctcccggacgcattcccaa

SEQ ID NO: 649029 - DNA, 20 bp, mouse
gcggaaaattcgactcgcta

SEQ ID NO: 649030 - DNA, 20 bp, mouse
gggctcgcaccaatgccaga

SEQ ID NO: 649031 - DNA, 20 bp, mouse
gcgggagcggatgtgacgtc

SEQ ID NO: 649032 - DNA, 20 bp, mouse
ggtagtgggtgaagcgcttc

SEQ ID NO: 649033 - DNA, 20 bp, mouse
gtgggactcggacaacccgc

SEQ ID NO: 649034 - DNA, 20 bp, mouse
gggcggaagtccatggcgtg

SEQ ID NO: 649035 - DNA, 20 bp, mouse
gccagaggggaaacgggagg

SEQ ID NO: 649036 - DNA, 20 bp, mouse
gcacccatcacggacaaacc

SEQ ID NO: 649037 - DNA, 20 bp, mouse
gcggtcaaagttcagaagtg

SEQ ID NO: 649038 - DNA, 20 bp, mouse
ggggcggagcttgccaagtt

SEQ ID NO: 649039 - DNA, 20 bp, mouse
gagccgggtttgtccgtgat

SEQ ID NO: 649040 - DNA, 20 bp, mouse
gggcggggatggtctgcact

SEQ ID NO: 649041 - DNA, 20 bp, mouse
ggttccttgtagcgcttcct

SEQ ID NO: 649042 - DNA, 20 bp, mouse
ggagcaaagcgcctctctgt

SEQ ID NO: 649043 - DNA, 20 bp, mouse
ggcctcaggcaaaacctggc

SEQ ID NO: 649044 - DNA, 20 bp, mouse
gaggagcagctactaacccg

SEQ ID NO: 649045 - DNA, 20 bp, mouse
ggcgctacaaggaacagtaa

SEQ ID NO: 649046 - DNA, 20 bp, mouse
gaacgcaggcgtagttgcgc

SEQ ID NO: 649047 - DNA, 20 bp, mouse
gcctgactcaatttctcatg

SEQ ID NO: 649048 - DNA, 20 bp, mouse
gcacacggcccagttgttgt

SEQ ID NO: 649049 - DNA, 20 bp, mouse
gactacgcctgcgttagttt

SEQ ID NO: 649050 - DNA, 20 bp, mouse
gcacaagcttatcgctgatg

SEQ ID NO: 649051 - DNA, 20 bp, mouse
gcgcagactcttggatgact

SEQ ID NO: 649052 - DNA, 20 bp, mouse
gcaaattgcaagctttggac

SEQ ID NO: 649053 - DNA, 20 bp, mouse
ggccctgccagccggccggg

SEQ ID NO: 649054 - DNA, 20 bp, mouse
gatcaccaaattgcaagctt

SEQ ID NO: 649055 - DNA, 20 bp, mouse
gctctcgtagatacaggctc

SEQ ID NO: 649056 - DNA, 20 bp, mouse
gcagtctgttaattagactc

SEQ ID NO: 649057 - DNA, 20 bp, mouse
ggaacctagtgtgtgagagt

SEQ ID NO: 649058 - DNA, 20 bp, mouse
gactctgggcataggcagag

SEQ ID NO: 649059 - DNA, 20 bp, mouse
ggacgcccagagcgtgagac

SEQ ID NO: 649060 - DNA, 20 bp, mouse
gtcaaaggagatgcgttcta

SEQ ID NO: 649061 - DNA, 20 bp, mouse
gtgtagccaatgaatcattt

SEQ ID NO: 649062 - DNA, 20 bp, mouse
gaaggtgctccaaaaatctt

SEQ ID NO: 649063 - DNA, 20 bp, mouse
gcataggcagagtggaaagc

SEQ ID NO: 649064 - DNA, 20 bp, mouse
gttaattagactcagggagc

SEQ ID NO: 649065 - DNA, 20 bp, mouse
gggttccggtctcacgctct

SEQ ID NO: 649066 - DNA, 20 bp, mouse
gaccggcctgcagtcctcgg

SEQ ID NO: 649067 - DNA, 20 bp, mouse
gaggggtgaagccagtgcac

SEQ ID NO: 649068 - DNA, 20 bp, mouse
ggtgaccggcctgcagtcct

SEQ ID NO: 649069 - DNA, 20 bp, mouse
gcggctccgccgaggactgc

SEQ ID NO: 649070 - DNA, 20 bp, mouse
gacttgccgcactcggtgac

SEQ ID NO: 649071 - DNA, 20 bp, mouse
ggtcctcggcggagccgcgc

SEQ ID NO: 649072 - DNA, 20 bp, mouse
gaagccagtgcacaggtcca

SEQ ID NO: 649073 - DNA, 20 bp, mouse
ggcaggccggtcaccgagtg

SEQ ID NO: 649074 - DNA, 20 bp, mouse
gggcgccgggcatccttaga

SEQ ID NO: 649075 - DNA, 20 bp, mouse
gcgtgcagagcagccatcta

SEQ ID NO: 649076 - DNA, 20 bp, mouse
ggagcgagcccgtaaggcga

SEQ ID NO: 649077 - DNA, 20 bp, mouse
gtgggcggagtcatcgtgga

SEQ ID NO: 649078 - DNA, 20 bp, mouse
ggcggctggggttaggtcag

SEQ ID NO: 649079 - DNA, 20 bp, mouse
gagcccgtaaggcgaggggg

SEQ ID NO: 649080 - DNA, 20 bp, mouse
gtcgagaagcctggcggctg

SEQ ID NO: 649081 - DNA, 20 bp, mouse
gccaggcttctcgaattcca

SEQ ID NO: 649082 - DNA, 20 bp, mouse
ggcccctcacaggaatccgt

SEQ ID NO: 649083 - DNA, 20 bp, mouse
ggggagcgcgcgtgctcctc

SEQ ID NO: 649084 - DNA, 20 bp, mouse
gaccacggccaaagcttgag

SEQ ID NO: 649085 - DNA, 20 bp, mouse
gcggagtcatcgtggagggg

SEQ ID NO: 649086 - DNA, 20 bp, mouse
gtcgtctcgcggagaggact

SEQ ID NO: 649087 - DNA, 20 bp, mouse
gaatggacaggggtcggagc

SEQ ID NO: 649088 - DNA, 20 bp, mouse
gtcgccctcgtctcgcggag

SEQ ID NO: 649089 - DNA, 20 bp, mouse
gccgcgagacgagggcgaca

SEQ ID NO: 649090 - DNA, 20 bp, mouse
gcgaccagctactatctgaa

SEQ ID NO: 649091 - DNA, 20 bp, mouse
gggaaacggaagttaaatcc

SEQ ID NO: 649092 - DNA, 20 bp, mouse
ggctactatctgaatggaca

SEQ ID NO: 649093 - DNA, 20 bp, mouse
ggggcgggaggtttaaatgc

SEQ ID NO: 649094 - DNA, 20 bp, mouse
gcgagacgagggcgacaggg

SEQ ID NO: 649095 - DNA, 20 bp, mouse
gacgagggcgacagggcggg

SEQ ID NO: 649096 - DNA, 20 bp, mouse
gaatacccagagtcagaagt

SEQ ID NO: 649097 - DNA, 20 bp, mouse
gccaaggagaggtctctaaa

SEQ ID NO: 649098 - DNA, 20 bp, mouse
gcactgtagcgttggcaaga

SEQ ID NO: 649099 - DNA, 20 bp, mouse
gatggagtgctgagaagtgg

SEQ ID NO: 649100 - DNA, 20 bp, mouse
gcgaaggcgcagacattgct

SEQ ID NO: 649101 - DNA, 20 bp, mouse
gcactactacactgtagcgt

SEQ ID NO: 649102 - DNA, 20 bp, mouse
gtgtgccaatggaccaattg

SEQ ID NO: 649103 - DNA, 20 bp, mouse
ggctacagtgtagtagtgtg

SEQ ID NO: 649104 - DNA, 20 bp, mouse
gtggaggaagcaaattataa

SEQ ID NO: 649105 - DNA, 20 bp, mouse
gtagcacagctgcctaccca

SEQ ID NO: 649106 - DNA, 20 bp, mouse
gggccggcgggcttggaagg

SEQ ID NO: 649107 - DNA, 20 bp, mouse
ggggcaggcaatctggagga

SEQ ID NO: 649108 - DNA, 20 bp, mouse
gtcgcagcggcattggccgg

SEQ ID NO: 649109 - DNA, 20 bp, mouse
gaatagggcaggcaatctgg

SEQ ID NO: 649110 - DNA, 20 bp, mouse
gcggaggccccgcccccctt

SEQ ID NO: 649111 - DNA, 20 bp, mouse
ggccggctgcgtgggctggg

SEQ ID NO: 649112 - DNA, 20 bp, mouse
gggcctctgcagatttgcat

SEQ ID NO: 649113 - DNA, 20 bp, mouse
gttcgcacagcggagaaata

SEQ ID NO: 649114 - DNA, 20 bp, mouse
gctcctatgcaaatctgcag

SEQ ID NO: 649115 - DNA, 20 bp, mouse
gcgcccccttccaagcccgc

SEQ ID NO: 649116 - DNA, 20 bp, mouse
ggcaataggccgaccagtac

SEQ ID NO: 649117 - DNA, 20 bp, mouse
ggctctggcaggttcttccg

SEQ ID NO: 649118 - DNA, 20 bp, mouse
gactgcgttccagtactggt

SEQ ID NO: 649119 - DNA, 20 bp, mouse
ggagtgatggagatgaggaa

SEQ ID NO: 649120 - DNA, 20 bp, mouse
gcgcggcagcgagtgagtga

SEQ ID NO: 649121 - DNA, 20 bp, mouse
gggaggctgccatgttaaaa

SEQ ID NO: 649122 - DNA, 20 bp, mouse
gcgtccctgagcaaggcgta

SEQ ID NO: 649123 - DNA, 20 bp, mouse
gttccggggtcacgactcca

SEQ ID NO: 649124 - DNA, 20 bp, mouse
gggcagcctccgccataaag

SEQ ID NO: 649125 - DNA, 20 bp, mouse
gcactcgctgccgcggtcca

SEQ ID NO: 649126 - DNA, 20 bp, mouse
gctacagcatactgtctggg

SEQ ID NO: 649127 - DNA, 20 bp, mouse
gtaagggaggaaggattcta

SEQ ID NO: 649128 - DNA, 20 bp, mouse
ggtgctacagcatactgtct

SEQ ID NO: 649129 - DNA, 20 bp, mouse
gggctcgtagaccccagaac

SEQ ID NO: 649130 - DNA, 20 bp, mouse
gtaggcctgtggaccagttc

SEQ ID NO: 649131 - DNA, 20 bp, mouse
gtgcgcagggagaccggcag

SEQ ID NO: 649132 - DNA, 20 bp, mouse
ggtgcccggaagtcccgcgt

SEQ ID NO: 649133 - DNA, 20 bp, mouse
gcagtatgctgtagcacact

SEQ ID NO: 649134 - DNA, 20 bp, mouse
gacaatgctgtgtctttgtc

SEQ ID NO: 649135 - DNA, 20 bp, mouse
ggaccccagaactggtccac

SEQ ID NO: 649136 - DNA, 20 bp, mouse
gggagtcaggggcacatgtg

SEQ ID NO: 649137 - DNA, 20 bp, mouse
ggccgggtggagacgctgaa

SEQ ID NO: 649138 - DNA, 20 bp, mouse
gaagggaatatggtcggaat

SEQ ID NO: 649139 - DNA, 20 bp, mouse
gcggactccgggctacccac

SEQ ID NO: 649140 - DNA, 20 bp, mouse
gccctggcaactaaagggcc

SEQ ID NO: 649141 - DNA, 20 bp, mouse
gcgcatccctggcaactaaa

SEQ ID NO: 649142 - DNA, 20 bp, mouse
ggcggggcaacccggactcc

SEQ ID NO: 649143 - DNA, 20 bp, mouse
ggttgcgcgtagttcctctt

SEQ ID NO: 649144 - DNA, 20 bp, mouse
gtacaagttccgggagagtg

SEQ ID NO: 649145 - DNA, 20 bp, mouse
gccgggttgccccgcatccc

SEQ ID NO: 649146 - DNA, 20 bp, mouse
gacccaagacggataagctg

SEQ ID NO: 649147 - DNA, 20 bp, mouse
gaggagccatgggtggccga

SEQ ID NO: 649148 - DNA, 20 bp, mouse
gcccgcgcctccacgaagtc

SEQ ID NO: 649149 - DNA, 20 bp, mouse
gtgcgctcttaactgatcgg

SEQ ID NO: 649150 - DNA, 20 bp, mouse
gttgttgtgcgccacctcct

SEQ ID NO: 649151 - DNA, 20 bp, mouse
gtggggttgaagcggatccg

SEQ ID NO: 649152 - DNA, 20 bp, mouse
gcgctgccggggagcccagg

SEQ ID NO: 649153 - DNA, 20 bp, mouse
gaagcaggaggtggggcgta

SEQ ID NO: 649154 - DNA, 20 bp, mouse
gccacgaagtccggtcgcta

SEQ ID NO: 649155 - DNA, 20 bp, mouse
gcaacgtgggcgacccaaga

SEQ ID NO: 649156 - DNA, 20 bp, mouse
gcgcgtgcgtgccgcccagt

SEQ ID NO: 649157 - DNA, 20 bp, mouse
gaagccgcctccggggccga

SEQ ID NO: 649158 - DNA, 20 bp, mouse
gggacagcgctgccgcgtca

SEQ ID NO: 649159 - DNA, 20 bp, mouse
gagtccctcggccccggagg

SEQ ID NO: 649160 - DNA, 20 bp, mouse
gggacaccgcgagcacactc

SEQ ID NO: 649161 - DNA, 20 bp, mouse
ggccgcgtcacggcatcgtg

SEQ ID NO: 649162 - DNA, 20 bp, mouse
gaggggcggcggccgacgag

SEQ ID NO: 649163 - DNA, 20 bp, mouse
gaccgcgagcacactccggc

SEQ ID NO: 649164 - DNA, 20 bp, mouse
ggcagacgaggcccgctcgt

SEQ ID NO: 649165 - DNA, 20 bp, mouse
gcccctgaagagtgaatggg

SEQ ID NO: 649166 - DNA, 20 bp, mouse
gtgcaggaaaggagcgtgaa

SEQ ID NO: 649167 - DNA, 20 bp, mouse
gtatgcctgagcgaggatgg

SEQ ID NO: 649168 - DNA, 20 bp, mouse
ggctgagtgagagcgtggat

SEQ ID NO: 649169 - DNA, 20 bp, mouse
ggtactgattggtaggaacc

SEQ ID NO: 649170 - DNA, 20 bp, mouse
gcagttgagacccacagcga

SEQ ID NO: 649171 - DNA, 20 bp, mouse
gccacagcgagggcgactgc

SEQ ID NO: 649172 - DNA, 20 bp, mouse
ggcgagggcgactgcaggaa

SEQ ID NO: 649173 - DNA, 20 bp, mouse
gggctggagggcgggccctt

SEQ ID NO: 649174 - DNA, 20 bp, mouse
gagtgagagcgtggataggc

SEQ ID NO: 649175 - DNA, 20 bp, mouse
gacgcaggtctgttaggttc

SEQ ID NO: 649176 - DNA, 20 bp, mouse
ggcagaactagggcgaacgg

SEQ ID NO: 649177 - DNA, 20 bp, mouse
gggaggctggaggtcacgtg

SEQ ID NO: 649178 - DNA, 20 bp, mouse
gggccgagaggcgggacaag

SEQ ID NO: 649179 - DNA, 20 bp, mouse
gagcacaccctggtggagaa

SEQ ID NO: 649180 - DNA, 20 bp, mouse
gaatagagccagtagctgat

SEQ ID NO: 649181 - DNA, 20 bp, mouse
gtagggcgaacggaggctgg

SEQ ID NO: 649182 - DNA, 20 bp, mouse
gccacacccccgcaagctat

SEQ ID NO: 649183 - DNA, 20 bp, mouse
gagcagtaggtgcagaacta

SEQ ID NO: 649184 - DNA, 20 bp, mouse
gacaccctggtggagaaagg

SEQ ID NO: 649185 - DNA, 20 bp, mouse
gaactagggcgaacggaggc

SEQ ID NO: 649186 - DNA, 20 bp, mouse
ggggctaccacaaccccctt

SEQ ID NO: 649187 - DNA, 20 bp, mouse
gttgggtgaatagtaatcgt

SEQ ID NO: 649188 - DNA, 20 bp, mouse
gcacactagagagactttat

SEQ ID NO: 649189 - DNA, 20 bp, mouse
gtgagtcccgaagggggttg

SEQ ID NO: 649190 - DNA, 20 bp, mouse
gggtagccccagggactcat

SEQ ID NO: 649191 - DNA, 20 bp, mouse
gaagaatttgagtcccgaag

SEQ ID NO: 649192 - DNA, 20 bp, mouse
gcagacatttggcggagaaa

SEQ ID NO: 649193 - DNA, 20 bp, mouse
gtgttctaagcctgaggtat

SEQ ID NO: 649194 - DNA, 20 bp, mouse
ggggggttgtggtagcccca

SEQ ID NO: 649195 - DNA, 20 bp, mouse
gacaaataactgtagtctta

SEQ ID NO: 649196 - DNA, 20 bp, mouse
gtacacacgcagaagggaag

SEQ ID NO: 649197 - DNA, 20 bp, mouse
gggagggagtacggtaggat

SEQ ID NO: 649198 - DNA, 20 bp, mouse
gatcagggagggagtacggt

SEQ ID NO: 649199 - DNA, 20 bp, mouse
gttacggccctgggatcagt

SEQ ID NO: 649200 - DNA, 20 bp, mouse
gtaggattacacacgcagaa

SEQ ID NO: 649201 - DNA, 20 bp, mouse
gaggatgggcttacggccct

SEQ ID NO: 649202 - DNA, 20 bp, mouse
ggccccttgtgacatcacaa

SEQ ID NO: 649203 - DNA, 20 bp, mouse
gagccatcagggagggagta

SEQ ID NO: 649204 - DNA, 20 bp, mouse
ggacaacagctgtagctggg

SEQ ID NO: 649205 - DNA, 20 bp, mouse
ggtagacaacagctgtagct

SEQ ID NO: 649206 - DNA, 20 bp, mouse
gcgtccccaaagcccggact

SEQ ID NO: 649207 - DNA, 20 bp, mouse
gggcgtccctagcaacgcgc

SEQ ID NO: 649208 - DNA, 20 bp, mouse
ggtctagtgacgctcttctg

SEQ ID NO: 649209 - DNA, 20 bp, mouse
ggccccgcgtgaggcagtga

SEQ ID NO: 649210 - DNA, 20 bp, mouse
gtagcagtagtgaatctaat

SEQ ID NO: 649211 - DNA, 20 bp, mouse
gcgttgctagggacgccccg

SEQ ID NO: 649212 - DNA, 20 bp, mouse
gccgggctttggggacgcta

SEQ ID NO: 649213 - DNA, 20 bp, mouse
gggaggggaagcgagttgac

SEQ ID NO: 649214 - DNA, 20 bp, mouse
ggcaagagataaaaaatcat

SEQ ID NO: 649215 - DNA, 20 bp, mouse
gaaccagcccgcgcgttgct

SEQ ID NO: 649216 - DNA, 20 bp, mouse
gaggcccttcccaaggtctc

SEQ ID NO: 649217 - DNA, 20 bp, mouse
gtagtctggggcggggactt

SEQ ID NO: 649218 - DNA, 20 bp, mouse
gtgggaaaggggtgtgcgtt

SEQ ID NO: 649219 - DNA, 20 bp, mouse
ggagtgcctaggagttgtga

SEQ ID NO: 649220 - DNA, 20 bp, mouse
ggcagcctgggaatccctgg

SEQ ID NO: 649221 - DNA, 20 bp, mouse
gaagcccagagaccttggga

SEQ ID NO: 649222 - DNA, 20 bp, mouse
gtaaacccccagggattccc

SEQ ID NO: 649223 - DNA, 20 bp, mouse
ggctacagtgggagctaagg

SEQ ID NO: 649224 - DNA, 20 bp, mouse
ggctaaggaggcccttccca

SEQ ID NO: 649225 - DNA, 20 bp, mouse
gggacctggccccgaggcga

SEQ ID NO: 649226 - DNA, 20 bp, mouse
ggggcggatagaagatgctg

SEQ ID NO: 649227 - DNA, 20 bp, mouse
gcagggccccagggaagttg

SEQ ID NO: 649228 - DNA, 20 bp, mouse
gcagggtgtgggagctgtct

SEQ ID NO: 649229 - DNA, 20 bp, mouse
gtggggaggaaccgcaggca

SEQ ID NO: 649230 - DNA, 20 bp, mouse
gcggctccgcctcatctgcc

SEQ ID NO: 649231 - DNA, 20 bp, mouse
ggatgtgagcctggcagatg

SEQ ID NO: 649232 - DNA, 20 bp, mouse
gtgaagcagccttcagggtg

SEQ ID NO: 649233 - DNA, 20 bp, mouse
ggagacctataggagctgat

SEQ ID NO: 649234 - DNA, 20 bp, mouse
gtgcctgtcgctgcagccaa

SEQ ID NO: 649235 - DNA, 20 bp, mouse
gagcgcagacgcctgctcac

SEQ ID NO: 649236 - DNA, 20 bp, mouse
gttgccaagaaaacaaggta

SEQ ID NO: 649237 - DNA, 20 bp, mouse
gccctccccaactaaggagc

SEQ ID NO: 649238 - DNA, 20 bp, mouse
ggacagcagtagaaaggctt

SEQ ID NO: 649239 - DNA, 20 bp, mouse
gtcaggtccctccccaacta

SEQ ID NO: 649240 - DNA, 20 bp, mouse
gcacgcccacccaattttag

SEQ ID NO: 649241 - DNA, 20 bp, mouse
gggtggggcgcgcttttccg

SEQ ID NO: 649242 - DNA, 20 bp, mouse
gagtgatgacagcagtagaa

SEQ ID NO: 649243 - DNA, 20 bp, mouse
gagtagaaaggctttgggtg

SEQ ID NO: 649244 - DNA, 20 bp, mouse
gcaaggtagggatgcatttt

SEQ ID NO: 649245 - DNA, 20 bp, mouse
gacctgctccttagttgggg

SEQ ID NO: 649246 - DNA, 20 bp, mouse
gaggcccccagcaagtgctg

SEQ ID NO: 649247 - DNA, 20 bp, mouse
ggggccccagtaagtgacag

SEQ ID NO: 649248 - DNA, 20 bp, mouse
gccttcagaagtctagttta

SEQ ID NO: 649249 - DNA, 20 bp, mouse
gcgttccagcccaaaaaagg

SEQ ID NO: 649250 - DNA, 20 bp, mouse
ggcgtggaggaaggtgtgac

SEQ ID NO: 649251 - DNA, 20 bp, mouse
gtggggcccccagcacttgc

SEQ ID NO: 649252 - DNA, 20 bp, mouse
gtgacgggggcagaagggac

SEQ ID NO: 649253 - DNA, 20 bp, mouse
gcccaaaaaaggcggggctc

SEQ ID NO: 649254 - DNA, 20 bp, mouse
gcccagagccccgccttttt

SEQ ID NO: 649255 - DNA, 20 bp, mouse
gcctcgttccagcccaaaaa

SEQ ID NO: 649256 - DNA, 20 bp, mouse
ggggggacacaatgagctgt

SEQ ID NO: 649257 - DNA, 20 bp, mouse
ggctctggcaagtcatgaat

SEQ ID NO: 649258 - DNA, 20 bp, mouse
ggaagcaagtgtcaatatcc

SEQ ID NO: 649259 - DNA, 20 bp, mouse
gggcacacaaacccgtcctg

SEQ ID NO: 649260 - DNA, 20 bp, mouse
gacacaatgagctgtaggtc

SEQ ID NO: 649261 - DNA, 20 bp, mouse
gcaagctgccctgaagggag

SEQ ID NO: 649262 - DNA, 20 bp, mouse
gggcaagtcatgaatcggtg

SEQ ID NO: 649263 - DNA, 20 bp, mouse
gtagcaagcaggtttgacaa

SEQ ID NO: 649264 - DNA, 20 bp, mouse
gtaaagatgccctgcagctc

SEQ ID NO: 649265 - DNA, 20 bp, mouse
gcgggtttgtgtgccggtgt

SEQ ID NO: 649266 - DNA, 20 bp, mouse
gagggacagtgatctctgat

SEQ ID NO: 649267 - DNA, 20 bp, mouse
gctggctccgcccctgtctc

SEQ ID NO: 649268 - DNA, 20 bp, mouse
gtaaaagctaggtagagatg

SEQ ID NO: 649269 - DNA, 20 bp, mouse
gagaaggatgcgttggaagg

SEQ ID NO: 649270 - DNA, 20 bp, mouse
gacaggagagaaggatgcgt

SEQ ID NO: 649271 - DNA, 20 bp, mouse
ggagagaaggatgcgttgga

SEQ ID NO: 649272 - DNA, 20 bp, mouse
gactgtccctccagtgccac

SEQ ID NO: 649273 - DNA, 20 bp, mouse
gcggccctgccttcaggcgc

SEQ ID NO: 649274 - DNA, 20 bp, mouse
gctaggtagagatggggcag

SEQ ID NO: 649275 - DNA, 20 bp, mouse
gtgaaggcagggccggtcgc

SEQ ID NO: 649276 - DNA, 20 bp, mouse
gggggagagggtagtgcaag

SEQ ID NO: 649277 - DNA, 20 bp, mouse
ggagcactgagtggctgtgc

SEQ ID NO: 649278 - DNA, 20 bp, mouse
gcgcagaaaggggaagtgcc

SEQ ID NO: 649279 - DNA, 20 bp, mouse
gaaggaggaggagcaagggt

SEQ ID NO: 649280 - DNA, 20 bp, mouse
gagcaagaggtggaggagta

SEQ ID NO: 649281 - DNA, 20 bp, mouse
gttcccctttctgcgcagga

SEQ ID NO: 649282 - DNA, 20 bp, mouse
gggggacctttggaaactga

SEQ ID NO: 649283 - DNA, 20 bp, mouse
gaacaaagttgcaggacctg

SEQ ID NO: 649284 - DNA, 20 bp, mouse
gtttggaaactgatggtaaa

SEQ ID NO: 649285 - DNA, 20 bp, mouse
ggaaggtaactcaaaaccac

SEQ ID NO: 649286 - DNA, 20 bp, mouse
gaagctgaaggggaattcag

SEQ ID NO: 649287 - DNA, 20 bp, mouse
gaggaagagccttagaattt

SEQ ID NO: 649288 - DNA, 20 bp, mouse
ggtggcgctgagacaggaag

SEQ ID NO: 649289 - DNA, 20 bp, mouse
gatgccccgcccatcagacc

SEQ ID NO: 649290 - DNA, 20 bp, mouse
gtgtaccccacattccagtt

SEQ ID NO: 649291 - DNA, 20 bp, mouse
gaacctggagtcacaatggg

SEQ ID NO: 649292 - DNA, 20 bp, mouse
gtgaaacctggagtcacaat

SEQ ID NO: 649293 - DNA, 20 bp, mouse
ggatgggcggggcatcgctg

SEQ ID NO: 649294 - DNA, 20 bp, mouse
gccagacccaactggaatgt

SEQ ID NO: 649295 - DNA, 20 bp, mouse
gcgccacccattgtgactcc

SEQ ID NO: 649296 - DNA, 20 bp, mouse
gctggggaatgggtgaacat

SEQ ID NO: 649297 - DNA, 20 bp, mouse
gagcctgggcccattggtga

SEQ ID NO: 649298 - DNA, 20 bp, mouse
gtgggcccattggtgaggga

SEQ ID NO: 649299 - DNA, 20 bp, mouse
gtaggtggaatctggggaat

SEQ ID NO: 649300 - DNA, 20 bp, mouse
gaggctctaggtggaatctg

SEQ ID NO: 649301 - DNA, 20 bp, mouse
gtattagggtgcaagtcggt

SEQ ID NO: 649302 - DNA, 20 bp, mouse
gatgagccagccagagggac

SEQ ID NO: 649303 - DNA, 20 bp, mouse
gggaggaggtgacgcgtgtt

SEQ ID NO: 649304 - DNA, 20 bp, mouse
gagggtgcaagtcggtgggt

SEQ ID NO: 649305 - DNA, 20 bp, mouse
gcaggcttctgatatccatc

SEQ ID NO: 649306 - DNA, 20 bp, mouse
gggctctggctctcaaggtg

SEQ ID NO: 649307 - DNA, 20 bp, mouse
gtggctctcaaggtgtggct

SEQ ID NO: 649308 - DNA, 20 bp, mouse
gcaagacagtagtgaatggg

SEQ ID NO: 649309 - DNA, 20 bp, mouse
ggtgaactgaagtctggctc

SEQ ID NO: 649310 - DNA, 20 bp, mouse
gctgacaagacagtagtgaa

SEQ ID NO: 649311 - DNA, 20 bp, mouse
gctggaggcaggctctactc

SEQ ID NO: 649312 - DNA, 20 bp, mouse
gggcctaccctgtagatctc

SEQ ID NO: 649313 - DNA, 20 bp, mouse
ggcaggagacataggacccc

SEQ ID NO: 649314 - DNA, 20 bp, mouse
gcagcacaagtttctctttc

SEQ ID NO: 649315 - DNA, 20 bp, mouse
gccagggtgactatatctag

SEQ ID NO: 649316 - DNA, 20 bp, mouse
gaaactccttatttggagta

SEQ ID NO: 649317 - DNA, 20 bp, mouse
gtggagtcatccaagagtga

SEQ ID NO: 649318 - DNA, 20 bp, mouse
gttcagggaaactccttatt

SEQ ID NO: 649319 - DNA, 20 bp, mouse
gaaggaacttgtctgataac

SEQ ID NO: 649320 - DNA, 20 bp, mouse
gcgacccccaaaaggggaca

SEQ ID NO: 649321 - DNA, 20 bp, mouse
gtaactggtttgtctttcaa

SEQ ID NO: 649322 - DNA, 20 bp, mouse
gccgagatcgacccccaaaa

SEQ ID NO: 649323 - DNA, 20 bp, mouse
gcattcctgccctggagagt

SEQ ID NO: 649324 - DNA, 20 bp, mouse
gtatgttcctgctttctcat

SEQ ID NO: 649325 - DNA, 20 bp, mouse
gctctgccctactccaaata

SEQ ID NO: 649326 - DNA, 20 bp, mouse
gaaacccccagggagggtgg

SEQ ID NO: 649327 - DNA, 20 bp, mouse
gcagggagggaatcagtcag

SEQ ID NO: 649328 - DNA, 20 bp, mouse
gacccctccaccctccctgg

SEQ ID NO: 649329 - DNA, 20 bp, mouse
gcctctggagttcagctccc

SEQ ID NO: 649330 - DNA, 20 bp, mouse
gctgtcagtgacaactcctc

SEQ ID NO: 649331 - DNA, 20 bp, mouse
gggtaggaaacccccaggga

SEQ ID NO: 649332 - DNA, 20 bp, mouse
gctggagaggccctggcaaa

SEQ ID NO: 649333 - DNA, 20 bp, mouse
gccagggcctctccagcggc

SEQ ID NO: 649334 - DNA, 20 bp, mouse
gagagaggaagggttggtgg

SEQ ID NO: 649335 - DNA, 20 bp, mouse
ggtcatggtaggaaaccccc

SEQ ID NO: 649336 - DNA, 20 bp, mouse
gccagaagaaagttgtgagg

SEQ ID NO: 649337 - DNA, 20 bp, mouse
gggtagagaagagttcctag

SEQ ID NO: 649338 - DNA, 20 bp, mouse
gcctaacccgggagccaggg

SEQ ID NO: 649339 - DNA, 20 bp, mouse
gcagcctaacccgggagcca

SEQ ID NO: 649340 - DNA, 20 bp, mouse
gagagaaacaagtagaacga

SEQ ID NO: 649341 - DNA, 20 bp, mouse
gccaccagccagtggtctgt

SEQ ID NO: 649342 - DNA, 20 bp, mouse
gcagccccgggttataaata

SEQ ID NO: 649343 - DNA, 20 bp, mouse
gcagctactcagcctaaccc

SEQ ID NO: 649344 - DNA, 20 bp, mouse
ggtagtggcccacagaccac

SEQ ID NO: 649345 - DNA, 20 bp, mouse
gagagaagagttcctagggg

SEQ ID NO: 649346 - DNA, 20 bp, mouse
ggcgctcgacccggcccgta

SEQ ID NO: 649347 - DNA, 20 bp, mouse
gcgtagggctgcaacaggca

SEQ ID NO: 649348 - DNA, 20 bp, mouse
ggacgcgcagggtcaggcac

SEQ ID NO: 649349 - DNA, 20 bp, mouse
ggggtcgagcgccgcgctcc

SEQ ID NO: 649350 - DNA, 20 bp, mouse
ggggcgccctggcaacgcag

SEQ ID NO: 649351 - DNA, 20 bp, mouse
gcggcccgtagggctgcaac

SEQ ID NO: 649352 - DNA, 20 bp, mouse
gaggcacccgcctggggctc

SEQ ID NO: 649353 - DNA, 20 bp, mouse
ggtgacggacaaggatgtgt

SEQ ID NO: 649354 - DNA, 20 bp, mouse
gaacgcagaggcacccgcct

SEQ ID NO: 649355 - DNA, 20 bp, mouse
gacaggaagacaaccatcga

SEQ ID NO: 649356 - DNA, 20 bp, mouse
gcagcctcccacctaatgtg

SEQ ID NO: 649357 - DNA, 20 bp, mouse
gcaccctcagccacagattc

SEQ ID NO: 649358 - DNA, 20 bp, mouse
gggccaacgtcctgaatctg

SEQ ID NO: 649359 - DNA, 20 bp, mouse
gttgtctggctgtaaaaagt

SEQ ID NO: 649360 - DNA, 20 bp, mouse
gcatctcccccacattaggt

SEQ ID NO: 649361 - DNA, 20 bp, mouse
gagccacagattcaggacgt

SEQ ID NO: 649362 - DNA, 20 bp, mouse
gtggcaaggtgtggaagtcc

SEQ ID NO: 649363 - DNA, 20 bp, mouse
gcagttcacaggatagggtg

SEQ ID NO: 649364 - DNA, 20 bp, mouse
gaaaagagaaggatgtccat

SEQ ID NO: 649365 - DNA, 20 bp, mouse
gagtgcctaaggattaggga

SEQ ID NO: 649366 - DNA, 20 bp, mouse
gagaggcgggcccgcagaat

SEQ ID NO: 649367 - DNA, 20 bp, mouse
gacgcggcaaaggcacactc

SEQ ID NO: 649368 - DNA, 20 bp, mouse
gggtggagctaggcaagagc

SEQ ID NO: 649369 - DNA, 20 bp, mouse
gaggccccgcccctacctgg

SEQ ID NO: 649370 - DNA, 20 bp, mouse
gtacgcaggggcattcgatt

SEQ ID NO: 649371 - DNA, 20 bp, mouse
ggggcctccaggtaggggcg

SEQ ID NO: 649372 - DNA, 20 bp, mouse
ggtaggggcggggcctccgg

SEQ ID NO: 649373 - DNA, 20 bp, mouse
ggccgcgtgtccaccttaaa

SEQ ID NO: 649374 - DNA, 20 bp, mouse
gggcgggcccgcagaatggg

SEQ ID NO: 649375 - DNA, 20 bp, mouse
ggcgcccgccctaggacgat

SEQ ID NO: 649376 - DNA, 20 bp, mouse
gcccgcgcgaacaacacctc

SEQ ID NO: 649377 - DNA, 20 bp, mouse
gggcggggcgcggagaggaa

SEQ ID NO: 649378 - DNA, 20 bp, mouse
gcgaacaacacctcggggcg

SEQ ID NO: 649379 - DNA, 20 bp, mouse
gagctcgcggaccgaccgaa

SEQ ID NO: 649380 - DNA, 20 bp, mouse
gcggagctgcgcggccactc

SEQ ID NO: 649381 - DNA, 20 bp, mouse
gacagccagggtgcgatcct

SEQ ID NO: 649382 - DNA, 20 bp, mouse
gttggcttggggacattccg

SEQ ID NO: 649383 - DNA, 20 bp, mouse
ggggagagagttgttggctt

SEQ ID NO: 649384 - DNA, 20 bp, mouse
ggggagctttcgcagtctgg

SEQ ID NO: 649385 - DNA, 20 bp, mouse
gggggtgcccagtgacccaa

SEQ ID NO: 649386 - DNA, 20 bp, mouse
gggtgcccaccagcgaactc

SEQ ID NO: 649387 - DNA, 20 bp, mouse
gcaagctggaccatcgggtg

SEQ ID NO: 649388 - DNA, 20 bp, mouse
ggaagccagagttcgctggt

SEQ ID NO: 649389 - DNA, 20 bp, mouse
gggcaccctcctccacatga

SEQ ID NO: 649390 - DNA, 20 bp, mouse
gaagacagctcctgagacgt

SEQ ID NO: 649391 - DNA, 20 bp, mouse
gcctggaagccagagttcgc

SEQ ID NO: 649392 - DNA, 20 bp, mouse
ggacaaggaaccacacccga

SEQ ID NO: 649393 - DNA, 20 bp, mouse
ggtcgcccaagctggaccat

SEQ ID NO: 649394 - DNA, 20 bp, mouse
ggaaatactacccacgtctc

SEQ ID NO: 649395 - DNA, 20 bp, mouse
gctctggcttccaggggaaa

SEQ ID NO: 649396 - DNA, 20 bp, mouse
gagggcctcacatgtgatac

SEQ ID NO: 649397 - DNA, 20 bp, mouse
gttcttcccaacagaatgtt

SEQ ID NO: 649398 - DNA, 20 bp, mouse
gagttccagtatcacatgtg

SEQ ID NO: 649399 - DNA, 20 bp, mouse
gcacaacagtagacttactg

SEQ ID NO: 649400 - DNA, 20 bp, mouse
ggggaaaactaaaaccgcac

SEQ ID NO: 649401 - DNA, 20 bp, mouse
gggattgccacaggtctcaa

SEQ ID NO: 649402 - DNA, 20 bp, mouse
ggacacatggccacagttcc

SEQ ID NO: 649403 - DNA, 20 bp, mouse
gccaatgaggtgccgccatt

SEQ ID NO: 649404 - DNA, 20 bp, mouse
ggacttactgcgggaccact

SEQ ID NO: 649405 - DNA, 20 bp, mouse
gctaggtttctgaaaaacgg

SEQ ID NO: 649406 - DNA, 20 bp, mouse
gcggggacgcgccctaccct

SEQ ID NO: 649407 - DNA, 20 bp, mouse
ggccctaccctgggtaagga

SEQ ID NO: 649408 - DNA, 20 bp, mouse
gacgcgccctaccctgggta

SEQ ID NO: 649409 - DNA, 20 bp, mouse
gaatgccagtcccactgtcg

SEQ ID NO: 649410 - DNA, 20 bp, mouse
gtcgaggcgactacgattct

SEQ ID NO: 649411 - DNA, 20 bp, mouse
gtacagcggcggctgttaac

SEQ ID NO: 649412 - DNA, 20 bp, mouse
gggaactgtctgtctgaact

SEQ ID NO: 649413 - DNA, 20 bp, mouse
ggggcagctcctggcgtcgc

SEQ ID NO: 649414 - DNA, 20 bp, mouse
gcagtgggcgggagtaggga

SEQ ID NO: 649415 - DNA, 20 bp, mouse
gaggactgggaggttgccgg

SEQ ID NO: 649416 - DNA, 20 bp, mouse
ggggccgcacgtgacgtgga

SEQ ID NO: 649417 - DNA, 20 bp, mouse
ggggagggacctgggctcgg

SEQ ID NO: 649418 - DNA, 20 bp, mouse
gcacggggccgcacgtgacg

SEQ ID NO: 649419 - DNA, 20 bp, mouse
ggaaccatccacgtcacgtg

SEQ ID NO: 649420 - DNA, 20 bp, mouse
gagactcggggtgaatgggg

SEQ ID NO: 649421 - DNA, 20 bp, mouse
gggttccagcattaagtcag

SEQ ID NO: 649422 - DNA, 20 bp, mouse
gtggggaggtgaaacggtga

SEQ ID NO: 649423 - DNA, 20 bp, mouse
gggaagctgcttcctttcga

SEQ ID NO: 649424 - DNA, 20 bp, mouse
gtggccctggggaggtgaaa

SEQ ID NO: 649425 - DNA, 20 bp, mouse
gataccagactcggggtgaa

SEQ ID NO: 649426 - DNA, 20 bp, mouse
ggagtggcatctctagtgag

SEQ ID NO: 649427 - DNA, 20 bp, mouse
ggaggaaggagcgctgggag

SEQ ID NO: 649428 - DNA, 20 bp, mouse
ggggaggtgcagtcatccct

SEQ ID NO: 649429 - DNA, 20 bp, mouse
ggcccagcttcggaagccaa

SEQ ID NO: 649430 - DNA, 20 bp, mouse
gtcagctagggtctagggta

SEQ ID NO: 649431 - DNA, 20 bp, mouse
gtcaaattgcagcccagctt

SEQ ID NO: 649432 - DNA, 20 bp, mouse
ggaagggaggaaggagcgct

SEQ ID NO: 649433 - DNA, 20 bp, mouse
gtcgacccggagaagcctcg

SEQ ID NO: 649434 - DNA, 20 bp, mouse
gggctagaggcgattcgacc

SEQ ID NO: 649435 - DNA, 20 bp, mouse
gatcgcctctagccagtgag

SEQ ID NO: 649436 - DNA, 20 bp, mouse
ggtggctggcgctacttcgg

SEQ ID NO: 649437 - DNA, 20 bp, mouse
gcggaggcaacggaagggcg

SEQ ID NO: 649438 - DNA, 20 bp, mouse
ggaggtgcgagggcgagcag

SEQ ID NO: 649439 - DNA, 20 bp, mouse
ggcggtggctggcgctactt

SEQ ID NO: 649440 - DNA, 20 bp, mouse
gcctccgcggcctaatcacg

SEQ ID NO: 649441 - DNA, 20 bp, mouse
gggcctgcgggcgcctccct

SEQ ID NO: 649442 - DNA, 20 bp, mouse
gcccgcgcggaggcaacgga

SEQ ID NO: 649443 - DNA, 20 bp, mouse
gacttcggaggagcccgacg

SEQ ID NO: 649444 - DNA, 20 bp, mouse
gtccgcagagcgcctgcgta

SEQ ID NO: 649445 - DNA, 20 bp, mouse
ggcccgaagcgagcggcgat

SEQ ID NO: 649446 - DNA, 20 bp, mouse
gaggcgctgggcggccacca

SEQ ID NO: 649447 - DNA, 20 bp, mouse
gagaagccgcgtggcccgct

SEQ ID NO: 649448 - DNA, 20 bp, mouse
gtggctttcgctctgacccc

SEQ ID NO: 649449 - DNA, 20 bp, mouse
gtgtgggtatgcaaatatcg

SEQ ID NO: 649450 - DNA, 20 bp, mouse
gaggacagctgggtatactc

SEQ ID NO: 649451 - DNA, 20 bp, mouse
gtgtcctagtgtacagttct

SEQ ID NO: 649452 - DNA, 20 bp, mouse
gagaggcggagtcaaggcgg

SEQ ID NO: 649453 - DNA, 20 bp, mouse
ggcgtggcccgctcggtttc

SEQ ID NO: 649454 - DNA, 20 bp, mouse
gggcacttccggaaaccgag

SEQ ID NO: 649455 - DNA, 20 bp, mouse
ggacatctgggacaaattcg

SEQ ID NO: 649456 - DNA, 20 bp, mouse
ggggcggggcagataaactg

SEQ ID NO: 649457 - DNA, 20 bp, mouse
gcggcgagggagacacccag

SEQ ID NO: 649458 - DNA, 20 bp, mouse
gaagaggactcgcacaacat

SEQ ID NO: 649459 - DNA, 20 bp, mouse
gttcctgcccaccctagcat

SEQ ID NO: 649460 - DNA, 20 bp, mouse
gcagccttcccggacggggc

SEQ ID NO: 649461 - DNA, 20 bp, mouse
gccccccagtaagtgattaa

SEQ ID NO: 649462 - DNA, 20 bp, mouse
ggtgagggtagcgattcagg

SEQ ID NO: 649463 - DNA, 20 bp, mouse
gcgcaagcgcgcagccttcc

SEQ ID NO: 649464 - DNA, 20 bp, mouse
gaactgatccaatgctaggg

SEQ ID NO: 649465 - DNA, 20 bp, mouse
gatcacttactggggggtga

SEQ ID NO: 649466 - DNA, 20 bp, mouse
ggctctcagaataaatacag

SEQ ID NO: 649467 - DNA, 20 bp, mouse
ggtaaggggataatggacat

SEQ ID NO: 649468 - DNA, 20 bp, mouse
gttgcagggaacacagtaag

SEQ ID NO: 649469 - DNA, 20 bp, mouse
gtattgcatgtgaggacatt

SEQ ID NO: 649470 - DNA, 20 bp, mouse
gtattctgagagctgattgc

SEQ ID NO: 649471 - DNA, 20 bp, mouse
gaacacacatataccctcga

SEQ ID NO: 649472 - DNA, 20 bp, mouse
gaacatgagggtcagaatct

SEQ ID NO: 649473 - DNA, 20 bp, mouse
gtaaaataatgagagcctgc

SEQ ID NO: 649474 - DNA, 20 bp, mouse
gaagggtgtggactaattgc

SEQ ID NO: 649475 - DNA, 20 bp, mouse
ggctttgaagacaatcattt

SEQ ID NO: 649476 - DNA, 20 bp, mouse
gcagcccaggtccaactctg

SEQ ID NO: 649477 - DNA, 20 bp, mouse
gcccagggagaacaggggat

SEQ ID NO: 649478 - DNA, 20 bp, mouse
ggatccctacagcccagccc

SEQ ID NO: 649479 - DNA, 20 bp, mouse
gtaaaggtcaactttcccca

SEQ ID NO: 649480 - DNA, 20 bp, mouse
gtcactgtgggaaaccagtg

SEQ ID NO: 649481 - DNA, 20 bp, mouse
gccatggttactgactctga

SEQ ID NO: 649482 - DNA, 20 bp, mouse
gagaccagagggagagtctt

SEQ ID NO: 649483 - DNA, 20 bp, mouse
gcaaggccaatcagggtctt

SEQ ID NO: 649484 - DNA, 20 bp, mouse
gagtacccagatgaaccccc

SEQ ID NO: 649485 - DNA, 20 bp, mouse
gtagagttcagaccctagaa

SEQ ID NO: 649486 - DNA, 20 bp, mouse
gacgaacgcccagacatcaa

SEQ ID NO: 649487 - DNA, 20 bp, mouse
gttaaactatagcgtagagt

SEQ ID NO: 649488 - DNA, 20 bp, mouse
gtcagctcctgctgcaaatc

SEQ ID NO: 649489 - DNA, 20 bp, mouse
gcaaatccggctgccttcct

SEQ ID NO: 649490 - DNA, 20 bp, mouse
ggtgccttgaacgattgctg

SEQ ID NO: 649491 - DNA, 20 bp, mouse
ggcgccccagcaatcgttca

SEQ ID NO: 649492 - DNA, 20 bp, mouse
gtaaaatgcagggactacgg

SEQ ID NO: 649493 - DNA, 20 bp, mouse
gaggcagccggatttgcagc

SEQ ID NO: 649494 - DNA, 20 bp, mouse
gctatagcgtagagtaggct

SEQ ID NO: 649495 - DNA, 20 bp, mouse
gctccgggataactcagtcc

SEQ ID NO: 649496 - DNA, 20 bp, mouse
gtgggcccacggggagtgca

SEQ ID NO: 649497 - DNA, 20 bp, mouse
gccgccctcagggcctcata

SEQ ID NO: 649498 - DNA, 20 bp, mouse
gccccagccggacaacagag

SEQ ID NO: 649499 - DNA, 20 bp, mouse
gagtcccctgcactccccgt

SEQ ID NO: 649500 - DNA, 20 bp, mouse
gacacgaagcggtccctatg

SEQ ID NO: 649501 - DNA, 20 bp, mouse
gaaccagctgtgtgcagcgt

SEQ ID NO: 649502 - DNA, 20 bp, mouse
gctggctggcggtgggccca

SEQ ID NO: 649503 - DNA, 20 bp, mouse
ggctccatctgcaaccaagc

SEQ ID NO: 649504 - DNA, 20 bp, mouse
gaacgccggctggctggcgg

SEQ ID NO: 649505 - DNA, 20 bp, mouse
gaaaacaggagggagtctgg

SEQ ID NO: 649506 - DNA, 20 bp, mouse
gaatttattaagagggtcag

SEQ ID NO: 649507 - DNA, 20 bp, mouse
gcagaagttcatgtcataat

SEQ ID NO: 649508 - DNA, 20 bp, mouse
ggaggtcaatgcatcatagc

SEQ ID NO: 649509 - DNA, 20 bp, mouse
gttgtcaacttgaccatacc

SEQ ID NO: 649510 - DNA, 20 bp, mouse
gaacttggaatgcctcagac

SEQ ID NO: 649511 - DNA, 20 bp, mouse
gtggaggagtgttcctccaa

SEQ ID NO: 649512 - DNA, 20 bp, mouse
ggggtctccacagaaccccc

SEQ ID NO: 649513 - DNA, 20 bp, mouse
gggatcctaatctcgagaat

SEQ ID NO: 649514 - DNA, 20 bp, mouse
gaggagtgttcctccaatgg

SEQ ID NO: 649515 - DNA, 20 bp, mouse
gatctcctattctcgagatt

SEQ ID NO: 649516 - DNA, 20 bp, mouse
gagagcgcctggaataaagt

SEQ ID NO: 649517 - DNA, 20 bp, mouse
gacctcctttactccaaacc

SEQ ID NO: 649518 - DNA, 20 bp, mouse
gagcagccagtgaccgggac

SEQ ID NO: 649519 - DNA, 20 bp, mouse
gtggccagcagccagtgacc

SEQ ID NO: 649520 - DNA, 20 bp, mouse
gaagttgggcgaggtagatg

SEQ ID NO: 649521 - DNA, 20 bp, mouse
gcaccggaagtgatcaagtt

SEQ ID NO: 649522 - DNA, 20 bp, mouse
gcccgggagccacagctcgc

SEQ ID NO: 649523 - DNA, 20 bp, mouse
ggaagtgatcaagttgggcg

SEQ ID NO: 649524 - DNA, 20 bp, mouse
gtggccaagtgaagtgttgt

SEQ ID NO: 649525 - DNA, 20 bp, mouse
gaatccagaagttaggggtt

SEQ ID NO: 649526 - DNA, 20 bp, mouse
gaaaagttctcggatgtgac

SEQ ID NO: 649527 - DNA, 20 bp, mouse
gtctgtgggcgggcctggca

SEQ ID NO: 649528 - DNA, 20 bp, mouse
gggccgcggtgctcacgtgg

SEQ ID NO: 649529 - DNA, 20 bp, mouse
gagctgaaggggctgtcacg

SEQ ID NO: 649530 - DNA, 20 bp, mouse
gacgtgactctcagctgaag

SEQ ID NO: 649531 - DNA, 20 bp, mouse
gcgtggccgcggtgctcacg

SEQ ID NO: 649532 - DNA, 20 bp, mouse
ggcagccgtaatcggaagcg

SEQ ID NO: 649533 - DNA, 20 bp, mouse
gttgtgttctggcgcttctg

SEQ ID NO: 649534 - DNA, 20 bp, mouse
ggttctggcgcttctgtggg

SEQ ID NO: 649535 - DNA, 20 bp, mouse
gaggggctgtcacgtggccg

SEQ ID NO: 649536 - DNA, 20 bp, mouse
ggcagtcttgacagtgctca

SEQ ID NO: 649537 - DNA, 20 bp, mouse
gagaactgagacgtcgacaa

SEQ ID NO: 649538 - DNA, 20 bp, mouse
gtacaggcaataataggttt

SEQ ID NO: 649539 - DNA, 20 bp, mouse
gctgtcctccattaccactc

SEQ ID NO: 649540 - DNA, 20 bp, mouse
gcagcttgatatgaaaagtc

SEQ ID NO: 649541 - DNA, 20 bp, mouse
ggcatatagtcgttcattac

SEQ ID NO: 649542 - DNA, 20 bp, mouse
gtagaccagagtggtaatgg

SEQ ID NO: 649543 - DNA, 20 bp, mouse
gccagcgattgtggaatttt

SEQ ID NO: 649544 - DNA, 20 bp, mouse
ggcactttgaacagccaatc

SEQ ID NO: 649545 - DNA, 20 bp, mouse
gttctagaccagagtggtaa

SEQ ID NO: 649546 - DNA, 20 bp, mouse
ggaaaacagtgggcgggcga

SEQ ID NO: 649547 - DNA, 20 bp, mouse
ggggcgtggtattggcaggg

SEQ ID NO: 649548 - DNA, 20 bp, mouse
gccgcgtgggagcggaagta

SEQ ID NO: 649549 - DNA, 20 bp, mouse
ggggactagctccgggagta

SEQ ID NO: 649550 - DNA, 20 bp, mouse
gagtctggcaagtcccattt

SEQ ID NO: 649551 - DNA, 20 bp, mouse
gaagtagggagtccctgcaa

SEQ ID NO: 649552 - DNA, 20 bp, mouse
ggggacgtccgtgatatgat

SEQ ID NO: 649553 - DNA, 20 bp, mouse
gtggctacacaccctactcc

SEQ ID NO: 649554 - DNA, 20 bp, mouse
gaatcgggcgtggtattggc

SEQ ID NO: 649555 - DNA, 20 bp, mouse
gcaccaaggaaaacagtggg

SEQ ID NO: 649556 - DNA, 20 bp, mouse
gagcctacggctgacgacag

SEQ ID NO: 649557 - DNA, 20 bp, mouse
ggcagcagcgagagccgctc

SEQ ID NO: 649558 - DNA, 20 bp, mouse
gggcaggaggggagatagtc

SEQ ID NO: 649559 - DNA, 20 bp, mouse
ggtggctactgcaactgcgg

SEQ ID NO: 649560 - DNA, 20 bp, mouse
ggtggcctggcgcgagccta

SEQ ID NO: 649561 - DNA, 20 bp, mouse
gggctctcgctgctgcgctg

SEQ ID NO: 649562 - DNA, 20 bp, mouse
ggcggctgaagcgcacaaac

SEQ ID NO: 649563 - DNA, 20 bp, mouse
gagccgctgtcgtcagccgt

SEQ ID NO: 649564 - DNA, 20 bp, mouse
gcggctcctgcccgtctcca

SEQ ID NO: 649565 - DNA, 20 bp, mouse
ggacagcggctgatcccact

SEQ ID NO: 649566 - DNA, 20 bp, mouse
gggaggacgctggcgagtag

SEQ ID NO: 649567 - DNA, 20 bp, mouse
gggacgctggcgagtagcgg

SEQ ID NO: 649568 - DNA, 20 bp, mouse
gcccaagcgcggcggagccg

SEQ ID NO: 649569 - DNA, 20 bp, mouse
gaccgccctcccaagcgcgg

SEQ ID NO: 649570 - DNA, 20 bp, mouse
gggtgcgcgcgggtgcccgg

SEQ ID NO: 649571 - DNA, 20 bp, mouse
gcgcttgggagggcggtgac

SEQ ID NO: 649572 - DNA, 20 bp, mouse
gcagcaattctgtgtggcgg

SEQ ID NO: 649573 - DNA, 20 bp, mouse
gtgaggaccaaaggggttta

SEQ ID NO: 649574 - DNA, 20 bp, mouse
gggcggtgaccggaggacgc

SEQ ID NO: 649575 - DNA, 20 bp, mouse
gtccgccgcgcttgggaggg

SEQ ID NO: 649576 - DNA, 20 bp, mouse
ggccgggtcctgtgctctcg

SEQ ID NO: 649577 - DNA, 20 bp, mouse
gtggtcaggcggcagggtga

SEQ ID NO: 649578 - DNA, 20 bp, mouse
gaccccgagagcacaggacc

SEQ ID NO: 649579 - DNA, 20 bp, mouse
gcccgcccgcgtcccgctag

SEQ ID NO: 649580 - DNA, 20 bp, mouse
ggccgcccctagcgggacgc

SEQ ID NO: 649581 - DNA, 20 bp, mouse
ggcacccgagccgggctctg

SEQ ID NO: 649582 - DNA, 20 bp, mouse
ggcccgccccgagtccgccg

SEQ ID NO: 649583 - DNA, 20 bp, mouse
gggctgtgggcgggggacga

SEQ ID NO: 649584 - DNA, 20 bp, mouse
gaagagcctcggcggactcg

SEQ ID NO: 649585 - DNA, 20 bp, mouse
gtgccggcgcggaagagcct

SEQ ID NO: 649586 - DNA, 20 bp, mouse
ggggaggcgactgtctcaaa

SEQ ID NO: 649587 - DNA, 20 bp, mouse
ggtgggctccccagggagat

SEQ ID NO: 649588 - DNA, 20 bp, mouse
ggtgacctggggcgtcctcc

SEQ ID NO: 649589 - DNA, 20 bp, mouse
gtcctccaggtgggctcccc

SEQ ID NO: 649590 - DNA, 20 bp, mouse
gcccacctggaggacgcccc

SEQ ID NO: 649591 - DNA, 20 bp, mouse
gttgaagctgtggtgacctg

SEQ ID NO: 649592 - DNA, 20 bp, mouse
gacgcccctatcaacaccaa

SEQ ID NO: 649593 - DNA, 20 bp, mouse
gccctggggagcccacctgg

SEQ ID NO: 649594 - DNA, 20 bp, mouse
gctcaggcctctgcagttat

SEQ ID NO: 649595 - DNA, 20 bp, mouse
gagcagacagggagacacgg

SEQ ID NO: 649596 - DNA, 20 bp, mouse
gtcccttcctcccctctccg

SEQ ID NO: 649597 - DNA, 20 bp, mouse
gagaccgggataggacagag

SEQ ID NO: 649598 - DNA, 20 bp, mouse
gcccccacagagaccgggat

SEQ ID NO: 649599 - DNA, 20 bp, mouse
gtgaccttggaagaaggtgc

SEQ ID NO: 649600 - DNA, 20 bp, mouse
ggacagagcggggcggagtt

SEQ ID NO: 649601 - DNA, 20 bp, mouse
gaccttcttccaaggtcagt

SEQ ID NO: 649602 - DNA, 20 bp, mouse
gctgtccaagatggttccca

SEQ ID NO: 649603 - DNA, 20 bp, mouse
gtcctatcccggtctctgtg

SEQ ID NO: 649604 - DNA, 20 bp, mouse
ggccccgctctgtcctatcc

SEQ ID NO: 649605 - DNA, 20 bp, mouse
gtctttttctcctcggagag

SEQ ID NO: 649606 - DNA, 20 bp, mouse
ggctgggaagaggatcagca

SEQ ID NO: 649607 - DNA, 20 bp, mouse
gaggatcagcagggatgaac

SEQ ID NO: 649608 - DNA, 20 bp, mouse
gtgtggtgtctgtgcataga

SEQ ID NO: 649609 - DNA, 20 bp, mouse
gagcaagcataggactagct

SEQ ID NO: 649610 - DNA, 20 bp, mouse
ggctctccattcaatcatct

SEQ ID NO: 649611 - DNA, 20 bp, mouse
gtgaatggagagccttgatt

SEQ ID NO: 649612 - DNA, 20 bp, mouse
gtttccgcagccaccacaga

SEQ ID NO: 649613 - DNA, 20 bp, mouse
ggcccacacactgtacacac

SEQ ID NO: 649614 - DNA, 20 bp, mouse
gaacaggaacctcccaatca

SEQ ID NO: 649615 - DNA, 20 bp, mouse
gacacacactgcaggcacat

SEQ ID NO: 649616 - DNA, 20 bp, mouse
ggcccagcccgggatggcag

SEQ ID NO: 649617 - DNA, 20 bp, mouse
gtgggtaggaggaacgttac

SEQ ID NO: 649618 - DNA, 20 bp, mouse
ggggaagagaggcgctttga

SEQ ID NO: 649619 - DNA, 20 bp, mouse
gacgtgcgtgtgtttgtctc

SEQ ID NO: 649620 - DNA, 20 bp, mouse
gggcccagagctagcgagcg

SEQ ID NO: 649621 - DNA, 20 bp, mouse
gggaaccagtgaactgactc

SEQ ID NO: 649622 - DNA, 20 bp, mouse
gctctgggcccagcccggga

SEQ ID NO: 649623 - DNA, 20 bp, mouse
ggccgcgcgcacgcgcccgg

SEQ ID NO: 649624 - DNA, 20 bp, mouse
gacgcgcccggaggctccgg

SEQ ID NO: 649625 - DNA, 20 bp, mouse
gtgtcccagagtcagttcac

SEQ ID NO: 649626 - DNA, 20 bp, mouse
ggtcccacccggccgagagg

SEQ ID NO: 649627 - DNA, 20 bp, mouse
gggggcgcagccaatcgcag

SEQ ID NO: 649628 - DNA, 20 bp, mouse
ggggagccgcccagcccggt

SEQ ID NO: 649629 - DNA, 20 bp, mouse
gggcaccccggcaccctggg

SEQ ID NO: 649630 - DNA, 20 bp, mouse
gaccctgggcggctccctac

SEQ ID NO: 649631 - DNA, 20 bp, mouse
gaggcggcgcggagcccgca

SEQ ID NO: 649632 - DNA, 20 bp, mouse
gcgggctccgcgccgcctct

SEQ ID NO: 649633 - DNA, 20 bp, mouse
gcgcagaggcggccccgtgc

SEQ ID NO: 649634 - DNA, 20 bp, mouse
gctccgcgccgcctctcggc

SEQ ID NO: 649635 - DNA, 20 bp, mouse
ggggctgggcggctcccccg

SEQ ID NO: 649636 - DNA, 20 bp, mouse
ggaagagcaaaaggacttag

SEQ ID NO: 649637 - DNA, 20 bp, mouse
gggacactggggccctctgg

SEQ ID NO: 649638 - DNA, 20 bp, mouse
ggacgacttgtgaggttctg

SEQ ID NO: 649639 - DNA, 20 bp, mouse
ggcttccagccaagcagact

SEQ ID NO: 649640 - DNA, 20 bp, mouse
gcagaggattggtgtgtaat

SEQ ID NO: 649641 - DNA, 20 bp, mouse
ggtgtcccagtctgcttggc

SEQ ID NO: 649642 - DNA, 20 bp, mouse
ggaatgccttcagccctcag

SEQ ID NO: 649643 - DNA, 20 bp, mouse
gctaccagctatggtaactt

SEQ ID NO: 649644 - DNA, 20 bp, mouse
gtgagcattcgtgcagacgt

SEQ ID NO: 649645 - DNA, 20 bp, mouse
gctaggaaatgaccgctcag

SEQ ID NO: 649646 - DNA, 20 bp, mouse
gcagccccgccaaggctctc

SEQ ID NO: 649647 - DNA, 20 bp, mouse
ggggctgcccagccccgcca

SEQ ID NO: 649648 - DNA, 20 bp, mouse
gcacgcccgagagccttggc

SEQ ID NO: 649649 - DNA, 20 bp, mouse
gtctgcgcgcacacgcggct

SEQ ID NO: 649650 - DNA, 20 bp, mouse
gcgcgcgccacgagctttgg

SEQ ID NO: 649651 - DNA, 20 bp, mouse
gcggcgcgcgccacgagctt

SEQ ID NO: 649652 - DNA, 20 bp, mouse
ggctcccaggaggcgcgagt

SEQ ID NO: 649653 - DNA, 20 bp, mouse
gcgagcacgcccgagagcct

SEQ ID NO: 649654 - DNA, 20 bp, mouse
ggtcgggcgggacccaccgt

SEQ ID NO: 649655 - DNA, 20 bp, mouse
ggtggcgcgcgccgcaggcg

SEQ ID NO: 649656 - DNA, 20 bp, mouse
gcagagcttcgggatctcta

SEQ ID NO: 649657 - DNA, 20 bp, mouse
gctctgggaggaccgcccat

SEQ ID NO: 649658 - DNA, 20 bp, mouse
gctaatgtcacgtgaccaat

SEQ ID NO: 649659 - DNA, 20 bp, mouse
gcgggtgagctgaactggtt

SEQ ID NO: 649660 - DNA, 20 bp, mouse
ggcagtgagcgagtctctcc

SEQ ID NO: 649661 - DNA, 20 bp, mouse
gggggagcccagtagatgtc

SEQ ID NO: 649662 - DNA, 20 bp, mouse
ggagatcccgaagctctggg

SEQ ID NO: 649663 - DNA, 20 bp, mouse
ggcagcggccggcctgacat

SEQ ID NO: 649664 - DNA, 20 bp, mouse
gctaacgtgggcgactgctt

SEQ ID NO: 649665 - DNA, 20 bp, mouse
gcgactcgctagaggacgtt

SEQ ID NO: 649666 - DNA, 20 bp, mouse
gaggacgacaccctcttatt

SEQ ID NO: 649667 - DNA, 20 bp, mouse
gaccctgggtacccaataag

SEQ ID NO: 649668 - DNA, 20 bp, mouse
ggtctcctgagggcccttgg

SEQ ID NO: 649669 - DNA, 20 bp, mouse
gcaaaggcgcgtgaaggtcc

SEQ ID NO: 649670 - DNA, 20 bp, mouse
gggccccacgtgaccgggcg

SEQ ID NO: 649671 - DNA, 20 bp, mouse
gagccccgcccggtcacgtg

SEQ ID NO: 649672 - DNA, 20 bp, mouse
gacacccaggctaagacttc

SEQ ID NO: 649673 - DNA, 20 bp, mouse
gagaccggaagggatgtcaa

SEQ ID NO: 649674 - DNA, 20 bp, mouse
gccgtgtcaccgggaaagtc

SEQ ID NO: 649675 - DNA, 20 bp, mouse
gatcgcccagctgtctcctg

SEQ ID NO: 649676 - DNA, 20 bp, mouse
gggcacgcgctcggcgtcca

SEQ ID NO: 649677 - DNA, 20 bp, mouse
gcaggtgagcaggcacggga

SEQ ID NO: 649678 - DNA, 20 bp, mouse
gtccgcgtggcgcttggccc

SEQ ID NO: 649679 - DNA, 20 bp, mouse
gagacgctgcgaacgtgcac

SEQ ID NO: 649680 - DNA, 20 bp, mouse
gtaggcggagcaggtctcag

SEQ ID NO: 649681 - DNA, 20 bp, mouse
gtagctgcagggcacgcgct

SEQ ID NO: 649682 - DNA, 20 bp, mouse
ggcgaacgtgcaccgggttg

SEQ ID NO: 649683 - DNA, 20 bp, mouse
gcaagccaggagaagcgatc

SEQ ID NO: 649684 - DNA, 20 bp, mouse
ggcggaaagatccatcgcgc

SEQ ID NO: 649685 - DNA, 20 bp, mouse
gtctcggggcgtggttagag

SEQ ID NO: 649686 - DNA, 20 bp, mouse
gagggctgctcagaactaac

SEQ ID NO: 649687 - DNA, 20 bp, mouse
ggggcaggagaagcagtaac

SEQ ID NO: 649688 - DNA, 20 bp, mouse
gggcgtggccacattaggag

SEQ ID NO: 649689 - DNA, 20 bp, mouse
gtaactggcacaaaatgtag

SEQ ID NO: 649690 - DNA, 20 bp, mouse
ggaagtcgctgtccaggcaa

SEQ ID NO: 649691 - DNA, 20 bp, mouse
ggaagttcagcgctctctct

SEQ ID NO: 649692 - DNA, 20 bp, mouse
gacgtcacagagttggacct

SEQ ID NO: 649693 - DNA, 20 bp, mouse
gaggaagaactacaagtccc

SEQ ID NO: 649694 - DNA, 20 bp, mouse
ggtaactggcaatagcgggc

SEQ ID NO: 649695 - DNA, 20 bp, mouse
gaatgtagaggcatccaaag

SEQ ID NO: 649696 - DNA, 20 bp, mouse
gtggcaggaccctggcgaag

SEQ ID NO: 649697 - DNA, 20 bp, mouse
gaggccaggcggccttcagg

SEQ ID NO: 649698 - DNA, 20 bp, mouse
gtaggaccgcccacaaggag

SEQ ID NO: 649699 - DNA, 20 bp, mouse
gatggaatgggcagggccga

SEQ ID NO: 649700 - DNA, 20 bp, mouse
ggaggaggcggcaccccagg

SEQ ID NO: 649701 - DNA, 20 bp, mouse
gagcagggcgggaggccgga

SEQ ID NO: 649702 - DNA, 20 bp, mouse
gcaggaccctggcgaagggg

SEQ ID NO: 649703 - DNA, 20 bp, mouse
gcaagtagagttcgcggcgt

SEQ ID NO: 649704 - DNA, 20 bp, mouse
gccgcccacaaggagggggg

SEQ ID NO: 649705 - DNA, 20 bp, mouse
gtgtacaggaattaaagtgg

SEQ ID NO: 649706 - DNA, 20 bp, mouse
gaaactggggacgggctcta

SEQ ID NO: 649707 - DNA, 20 bp, mouse
gtgtctccctgagaccaaaa

SEQ ID NO: 649708 - DNA, 20 bp, mouse
gccggggcggggtgaagtgt

SEQ ID NO: 649709 - DNA, 20 bp, mouse
gtcggaaactgccgggactc

SEQ ID NO: 649710 - DNA, 20 bp, mouse
gcggataggggacaaaaaca

SEQ ID NO: 649711 - DNA, 20 bp, mouse
gagtctccctttttggtctc

SEQ ID NO: 649712 - DNA, 20 bp, mouse
gtggggcggtcaggatagga

SEQ ID NO: 649713 - DNA, 20 bp, mouse
gaaatcccgggaggggcgac

SEQ ID NO: 649714 - DNA, 20 bp, mouse
ggggcaaggagcgttgctta

SEQ ID NO: 649715 - DNA, 20 bp, mouse
ggcccaagcccctacttgga

SEQ ID NO: 649716 - DNA, 20 bp, mouse
ggcgccgcctcccgggagga

SEQ ID NO: 649717 - DNA, 20 bp, mouse
gggctggcccggggagcgga

SEQ ID NO: 649718 - DNA, 20 bp, mouse
gcggccgccagagcccagag

SEQ ID NO: 649719 - DNA, 20 bp, mouse
gccagagtggcaaggggaca

SEQ ID NO: 649720 - DNA, 20 bp, mouse
ggcagtggtggggcgatctt

SEQ ID NO: 649721 - DNA, 20 bp, mouse
gacccggtgcgggcagtggt

SEQ ID NO: 649722 - DNA, 20 bp, mouse
ggccaccataggggcgtgag

SEQ ID NO: 649723 - DNA, 20 bp, mouse
gtcggtgcctgtaggaatgg

SEQ ID NO: 649724 - DNA, 20 bp, mouse
gggaggcggagagcggagga

SEQ ID NO: 649725 - DNA, 20 bp, mouse
gggtcagcccgcgctggagg

SEQ ID NO: 649726 - DNA, 20 bp, mouse
gtgacccttccctgctaaaa

SEQ ID NO: 649727 - DNA, 20 bp, mouse
gttagaaaaggtagcgatag

SEQ ID NO: 649728 - DNA, 20 bp, mouse
gggcaacgacagtgagcaac

SEQ ID NO: 649729 - DNA, 20 bp, mouse
gcctgacactgtgctgtaag

SEQ ID NO: 649730 - DNA, 20 bp, mouse
ggatgagccagcatgtttgt

SEQ ID NO: 649731 - DNA, 20 bp, mouse
ggatcacatcgagtaagaaa

SEQ ID NO: 649732 - DNA, 20 bp, mouse
gcactgtgctgtaagtggag

SEQ ID NO: 649733 - DNA, 20 bp, mouse
ggagcatcctaacaccagga

SEQ ID NO: 649734 - DNA, 20 bp, mouse
gtggagtggaaaataaacac

SEQ ID NO: 649735 - DNA, 20 bp, mouse
ggggaagggtcagattacag

SEQ ID NO: 649736 - DNA, 20 bp, mouse
gaaggccaaccctggtccgg

SEQ ID NO: 649737 - DNA, 20 bp, mouse
gggaactgggaaaatggttg

SEQ ID NO: 649738 - DNA, 20 bp, mouse
ggggaatgcggagaattcaa

SEQ ID NO: 649739 - DNA, 20 bp, mouse
gaggctgcccacgtggcgta

SEQ ID NO: 649740 - DNA, 20 bp, mouse
gcacgtggcgtaagggaact

SEQ ID NO: 649741 - DNA, 20 bp, mouse
ggtgggcagcctccggacca

SEQ ID NO: 649742 - DNA, 20 bp, mouse
gagaaatcgcccaagaccaa

SEQ ID NO: 649743 - DNA, 20 bp, mouse
gccaggccccgccaagtccg

SEQ ID NO: 649744 - DNA, 20 bp, mouse
gtgggaaaatggttggggcg

SEQ ID NO: 649745 - DNA, 20 bp, mouse
gcgtaagggaactgggaaaa

SEQ ID NO: 649746 - DNA, 20 bp, mouse
ggcactctaaagactggagt

SEQ ID NO: 649747 - DNA, 20 bp, mouse
gagcgccccgcaggcggaag

SEQ ID NO: 649748 - DNA, 20 bp, mouse
gatggaggccccactccccg

SEQ ID NO: 649749 - DNA, 20 bp, mouse
gtctaggcaacctcggggag

SEQ ID NO: 649750 - DNA, 20 bp, mouse
gagagtgccctgtctgatgg

SEQ ID NO: 649751 - DNA, 20 bp, mouse
gcaagggatgagggttcccg

SEQ ID NO: 649752 - DNA, 20 bp, mouse
ggatgagggttcccgaggtg

SEQ ID NO: 649753 - DNA, 20 bp, mouse
ggggttcccgaggtggggtg

SEQ ID NO: 649754 - DNA, 20 bp, mouse
gtcctccagggaaggaacaa

SEQ ID NO: 649755 - DNA, 20 bp, mouse
ggaaccctcatcccttgcca

SEQ ID NO: 649756 - DNA, 20 bp, mouse
ggggccaggacgtggtgttc

SEQ ID NO: 649757 - DNA, 20 bp, mouse
gtgggagcggggccaggacg

SEQ ID NO: 649758 - DNA, 20 bp, mouse
gaggtactgccagttatcca

SEQ ID NO: 649759 - DNA, 20 bp, mouse
gccagcaccgctgccctcct

SEQ ID NO: 649760 - DNA, 20 bp, mouse
gctgctgccgctggggtggg

SEQ ID NO: 649761 - DNA, 20 bp, mouse
ggatcctgaacaccacgtcc

SEQ ID NO: 649762 - DNA, 20 bp, mouse
gggaaggaggaagtagtgtt

SEQ ID NO: 649763 - DNA, 20 bp, mouse
gttcagaggagcctgggtgt

SEQ ID NO: 649764 - DNA, 20 bp, mouse
gaaggggattcatctacagt

SEQ ID NO: 649765 - DNA, 20 bp, mouse
gaggaagtagtgttgggctc

SEQ ID NO: 649766 - DNA, 20 bp, mouse
ggggtgtgaagcgcacaggg

SEQ ID NO: 649767 - DNA, 20 bp, mouse
gtcaaagaacgaactgatcg

SEQ ID NO: 649768 - DNA, 20 bp, mouse
gtcatcctgctcctccaaga

SEQ ID NO: 649769 - DNA, 20 bp, mouse
gggctcttccgtttctccaa

SEQ ID NO: 649770 - DNA, 20 bp, mouse
gaagaacgaactgatcgtgg

SEQ ID NO: 649771 - DNA, 20 bp, mouse
gttggaggagcaggatgaac

SEQ ID NO: 649772 - DNA, 20 bp, mouse
gccatccccccttggagaaa

SEQ ID NO: 649773 - DNA, 20 bp, mouse
gctcactgctagctctgagg

SEQ ID NO: 649774 - DNA, 20 bp, mouse
gaagctcactgctagctctg

SEQ ID NO: 649775 - DNA, 20 bp, mouse
gctgttggcttcttgaagtt

SEQ ID NO: 649776 - DNA, 20 bp, mouse
gagcggatgtgcggccacta

SEQ ID NO: 649777 - DNA, 20 bp, mouse
gggcagctaggggtgagaga

SEQ ID NO: 649778 - DNA, 20 bp, mouse
ggcatggaaagagaagtcaa

SEQ ID NO: 649779 - DNA, 20 bp, mouse
gcagaggaggcaacggatga

SEQ ID NO: 649780 - DNA, 20 bp, mouse
gaggtggggaggagtctgta

SEQ ID NO: 649781 - DNA, 20 bp, mouse
ggaggagcagctgaagcgtg

SEQ ID NO: 649782 - DNA, 20 bp, mouse
gaggggcgcggcgacaggac

SEQ ID NO: 649783 - DNA, 20 bp, mouse
gcggcggcaccgaggagccc

SEQ ID NO: 649784 - DNA, 20 bp, mouse
gggaggcaacggatgaggga

SEQ ID NO: 649785 - DNA, 20 bp, mouse
gaccacctcctccatcacgg

SEQ ID NO: 649786 - DNA, 20 bp, mouse
gagggggcgggaagcccata

SEQ ID NO: 649787 - DNA, 20 bp, mouse
gctgcctagaaccagaattg

SEQ ID NO: 649788 - DNA, 20 bp, mouse
gaacaagttcagagcagaat

SEQ ID NO: 649789 - DNA, 20 bp, mouse
ggagggagagctaagataaa

SEQ ID NO: 649790 - DNA, 20 bp, mouse
ggctgactcccgaaggcctc

SEQ ID NO: 649791 - DNA, 20 bp, mouse
gaacccccaattctggttct

SEQ ID NO: 649792 - DNA, 20 bp, mouse
gtgggaggcggagcaatcac

SEQ ID NO: 649793 - DNA, 20 bp, mouse
gtaaatcccagcctgcccta

SEQ ID NO: 649794 - DNA, 20 bp, mouse
gcaggtcaaatagcagtggg

SEQ ID NO: 649795 - DNA, 20 bp, mouse
gccagggtacagtgctggcc

SEQ ID NO: 649796 - DNA, 20 bp, mouse
gctgactagagggtatttta

SEQ ID NO: 649797 - DNA, 20 bp, mouse
gaccctcctaatgaagtgtt

SEQ ID NO: 649798 - DNA, 20 bp, mouse
gtagtcctgattggtctctc

SEQ ID NO: 649799 - DNA, 20 bp, mouse
gtgtctacgatctgactaga

SEQ ID NO: 649800 - DNA, 20 bp, mouse
gtagtcagatcgtagacatt

SEQ ID NO: 649801 - DNA, 20 bp, mouse
gtcccaacacttcattagga

SEQ ID NO: 649802 - DNA, 20 bp, mouse
gcatttcccaacacttcatt

SEQ ID NO: 649803 - DNA, 20 bp, mouse
gcaaggaaacaagtaaggtt

SEQ ID NO: 649804 - DNA, 20 bp, mouse
ggctgatttgtgtttgtaga

SEQ ID NO: 649805 - DNA, 20 bp, mouse
gtatgtagcagtatttctat

SEQ ID NO: 649806 - DNA, 20 bp, mouse
ggaacaatgtgtatttcctc

SEQ ID NO: 649807 - DNA, 20 bp, mouse
gtctctgtaatgcacgatgt

SEQ ID NO: 649808 - DNA, 20 bp, mouse
ggcaatgcctctttgaccag

SEQ ID NO: 649809 - DNA, 20 bp, mouse
gctactctgagttttcttgg

SEQ ID NO: 649810 - DNA, 20 bp, mouse
gcattgaacagctcagatca

SEQ ID NO: 649811 - DNA, 20 bp, mouse
gcacttctcaggggatctcc

SEQ ID NO: 649812 - DNA, 20 bp, mouse
gaaagctgaccacttctcag

SEQ ID NO: 649813 - DNA, 20 bp, mouse
gttagccattgtgctcaaaa

SEQ ID NO: 649814 - DNA, 20 bp, mouse
gactcatttaaacatgatat

SEQ ID NO: 649815 - DNA, 20 bp, mouse
gacttgcatggatatttcac

SEQ ID NO: 649816 - DNA, 20 bp, mouse
gtatacaatataggggttaa

SEQ ID NO: 649817 - DNA, 20 bp, mouse
gtcgctactgaagggaaact

SEQ ID NO: 649818 - DNA, 20 bp, mouse
gaacaaattcacttaatcaa

SEQ ID NO: 649819 - DNA, 20 bp, mouse
gctagtatgagatcttacgt

SEQ ID NO: 649820 - DNA, 20 bp, mouse
ggttataaagcagcagccaa

SEQ ID NO: 649821 - DNA, 20 bp, mouse
gatcacttatatacaatata

SEQ ID NO: 649822 - DNA, 20 bp, mouse
gaattatgttgcaatagagg

SEQ ID NO: 649823 - DNA, 20 bp, mouse
gacaagtaattacactcaac

SEQ ID NO: 649824 - DNA, 20 bp, mouse
gatgaattatgttgcaatag

SEQ ID NO: 649825 - DNA, 20 bp, mouse
gatcttacgtaggcacttag

SEQ ID NO: 649826 - DNA, 20 bp, mouse
ggaagagggtcccacagagg

SEQ ID NO: 649827 - DNA, 20 bp, mouse
gccgcctctggcacaaacag

SEQ ID NO: 649828 - DNA, 20 bp, mouse
gacaggaactgatgtgtgtg

SEQ ID NO: 649829 - DNA, 20 bp, mouse
gcccacagagggggcgagat

SEQ ID NO: 649830 - DNA, 20 bp, mouse
ggtaagcctaggccactcgt

SEQ ID NO: 649831 - DNA, 20 bp, mouse
gacctcatgaagggggttct

SEQ ID NO: 649832 - DNA, 20 bp, mouse
gcaggggagtgtcccacgag

SEQ ID NO: 649833 - DNA, 20 bp, mouse
gtctctgtgtcctccgcctc

SEQ ID NO: 649834 - DNA, 20 bp, mouse
gtaggcttacacctcatgaa

SEQ ID NO: 649835 - DNA, 20 bp, mouse
ggagcgagtggtcgtctaag

SEQ ID NO: 649836 - DNA, 20 bp, mouse
gtgtctgctcaggagcacgt

SEQ ID NO: 649837 - DNA, 20 bp, mouse
gggactgaagcgggatcggg

SEQ ID NO: 649838 - DNA, 20 bp, mouse
ggtctgagagtcactgggga

SEQ ID NO: 649839 - DNA, 20 bp, mouse
gtcatagctcgaggagagag

SEQ ID NO: 649840 - DNA, 20 bp, mouse
ggaaaagtcaaacgggatgg

SEQ ID NO: 649841 - DNA, 20 bp, mouse
gttctgatgcctgtctgctc

SEQ ID NO: 649842 - DNA, 20 bp, mouse
ggcagggactgaagcgggat

SEQ ID NO: 649843 - DNA, 20 bp, mouse
gggtggaaagtgcgagagga

SEQ ID NO: 649844 - DNA, 20 bp, mouse
gggccagcctaggacaccag

SEQ ID NO: 649845 - DNA, 20 bp, mouse
ggacgtcagcacgcgaggca

SEQ ID NO: 649846 - DNA, 20 bp, mouse
ggaggcggggcgacgattga

SEQ ID NO: 649847 - DNA, 20 bp, mouse
ggaagcagaggggacctcgg

SEQ ID NO: 649848 - DNA, 20 bp, mouse
gcacatgggcggggcctttc

SEQ ID NO: 649849 - DNA, 20 bp, mouse
gagggaagagcgcagatagg

SEQ ID NO: 649850 - DNA, 20 bp, mouse
gtgggcggggcatgcgtgaa

SEQ ID NO: 649851 - DNA, 20 bp, mouse
gcggggttacagcacatggg

SEQ ID NO: 649852 - DNA, 20 bp, mouse
gagagcgcagataggaggcg

SEQ ID NO: 649853 - DNA, 20 bp, mouse
ggaagacgggtcttgctagt

SEQ ID NO: 649854 - DNA, 20 bp, mouse
ggtggggcgggctcagtgtt

SEQ ID NO: 649855 - DNA, 20 bp, mouse
gtagaggcctgtccgggtga

SEQ ID NO: 649856 - DNA, 20 bp, mouse
gcaagtgcctatagcgaagg

SEQ ID NO: 649857 - DNA, 20 bp, mouse
gtgcctcctggctgatgaat

SEQ ID NO: 649858 - DNA, 20 bp, mouse
gctgatgaatgggagcggaa

SEQ ID NO: 649859 - DNA, 20 bp, mouse
gctaaagcccatcttgggtg

SEQ ID NO: 649860 - DNA, 20 bp, mouse
ggtgcaagtgcctatagcga

SEQ ID NO: 649861 - DNA, 20 bp, mouse
gcctggctgatgaatgggag

SEQ ID NO: 649862 - DNA, 20 bp, mouse
ggcgcctgcgcagttgaaaa

SEQ ID NO: 649863 - DNA, 20 bp, mouse
gctgccgcgcgtccccagcc

SEQ ID NO: 649864 - DNA, 20 bp, mouse
gggatggcgttccaagaaaa

SEQ ID NO: 649865 - DNA, 20 bp, mouse
gacacacccccacccaagat

SEQ ID NO: 649866 - DNA, 20 bp, mouse
gaacgtcatcactccctcca

SEQ ID NO: 649867 - DNA, 20 bp, mouse
gccgccaccggcaaagatgg

SEQ ID NO: 649868 - DNA, 20 bp, mouse
gcgcctcgcgcaaggcatga

SEQ ID NO: 649869 - DNA, 20 bp, mouse
ggcgcgacagagcgcagagt

SEQ ID NO: 649870 - DNA, 20 bp, mouse
gcgcagagtcggcgccctgg

SEQ ID NO: 649871 - DNA, 20 bp, mouse
gctaggctccctcagttcat

SEQ ID NO: 649872 - DNA, 20 bp, mouse
gaatcaggtgtgtaagacag

SEQ ID NO: 649873 - DNA, 20 bp, mouse
gccaccttgggaagactctt

SEQ ID NO: 649874 - DNA, 20 bp, mouse
gactgcggctcgacgattct

SEQ ID NO: 649875 - DNA, 20 bp, mouse
gggcctgagaaccggaattg

SEQ ID NO: 649876 - DNA, 20 bp, mouse
gccgccgcgcgggtgaatcg

SEQ ID NO: 649877 - DNA, 20 bp, mouse
ggacgcgcgggctcgatccg

SEQ ID NO: 649878 - DNA, 20 bp, mouse
ggtggctggcgctacttcgg

SEQ ID NO: 649879 - DNA, 20 bp, mouse
gccgcggcgtgctgacgcgc

SEQ ID NO: 649880 - DNA, 20 bp, mouse
gcacgccgcggcgtcacttc

SEQ ID NO: 649881 - DNA, 20 bp, mouse
gcgcttcgggcccgcgacgc

SEQ ID NO: 649882 - DNA, 20 bp, mouse
gcggaggcaacggaagggcg

SEQ ID NO: 649883 - DNA, 20 bp, mouse
ggcccgaagcgagcggcgat

SEQ ID NO: 649884 - DNA, 20 bp, mouse
ggaggtgcgagggcgagcag

SEQ ID NO: 649885 - DNA, 20 bp, mouse
ggcggcctcctcgctggctc

SEQ ID NO: 649886 - DNA, 20 bp, mouse
gtccccggccggaggaacgg

SEQ ID NO: 649887 - DNA, 20 bp, mouse
gagtccaagcgctgcggcag

SEQ ID NO: 649888 - DNA, 20 bp, mouse
gtgggtgagtccaagcgctg

SEQ ID NO: 649889 - DNA, 20 bp, mouse
gcccaaagacgggcgagctg

SEQ ID NO: 649890 - DNA, 20 bp, mouse
gcggcagagcgcgcctccgg

SEQ ID NO: 649891 - DNA, 20 bp, mouse
gcgaccgcatgccccaaaga

SEQ ID NO: 649892 - DNA, 20 bp, mouse
gtgcgcgcatccccggccgg

SEQ ID NO: 649893 - DNA, 20 bp, mouse
gggaacggcgggcaggcccg

SEQ ID NO: 649894 - DNA, 20 bp, mouse
gcgctctcaagccccggatg

SEQ ID NO: 649895 - DNA, 20 bp, mouse
gcccgccgttcctccggccg

SEQ ID NO: 649896 - DNA, 20 bp, mouse
gtgccgctggagattcaagg

SEQ ID NO: 649897 - DNA, 20 bp, mouse
gaggtaggcggggcaagcga

SEQ ID NO: 649898 - DNA, 20 bp, mouse
gacaccgccgagtggcagga

SEQ ID NO: 649899 - DNA, 20 bp, mouse
gtggggaaaatgaactgcta

SEQ ID NO: 649900 - DNA, 20 bp, mouse
gctagtcgaacgcaggcgag

SEQ ID NO: 649901 - DNA, 20 bp, mouse
gggaggagctgacaggtagg

SEQ ID NO: 649902 - DNA, 20 bp, mouse
gccctgccgctggagattca

SEQ ID NO: 649903 - DNA, 20 bp, mouse
ggacccggaagcgtttcccc

SEQ ID NO: 649904 - DNA, 20 bp, mouse
gtgctagggaagcgagtcaa

SEQ ID NO: 649905 - DNA, 20 bp, mouse
ggaagcgagtcaaaggaact

SEQ ID NO: 649906 - DNA, 20 bp, mouse
gctggcaaggattcatacaa

SEQ ID NO: 649907 - DNA, 20 bp, mouse
gtagggaaagggggtgatct

SEQ ID NO: 649908 - DNA, 20 bp, mouse
gttattaacagtggcgggta

SEQ ID NO: 649909 - DNA, 20 bp, mouse
gtgatcttattaacagtggc

SEQ ID NO: 649910 - DNA, 20 bp, mouse
gctcttgatcttattaacag

SEQ ID NO: 649911 - DNA, 20 bp, mouse
gtatgaatccttgccagcgt

SEQ ID NO: 649912 - DNA, 20 bp, mouse
gatgatatcccacgctggca

SEQ ID NO: 649913 - DNA, 20 bp, mouse
gtggattctagcttatagag

SEQ ID NO: 649914 - DNA, 20 bp, mouse
gaagagatgatatcccacgc

SEQ ID NO: 649915 - DNA, 20 bp, mouse
gtttagtgtgaatttcctta

SEQ ID NO: 649916 - DNA, 20 bp, mouse
ggctagcgcgcatgcgtgga

SEQ ID NO: 649917 - DNA, 20 bp, mouse
gggtgctgcgcctgtccctg

SEQ ID NO: 649918 - DNA, 20 bp, mouse
gcaggcagagactgcgcaga

SEQ ID NO: 649919 - DNA, 20 bp, mouse
gcggggcagccacagcgacc

SEQ ID NO: 649920 - DNA, 20 bp, mouse
gaagaaaaccaaaactgcgg

SEQ ID NO: 649921 - DNA, 20 bp, mouse
gttcaaacacccatgaccca

SEQ ID NO: 649922 - DNA, 20 bp, mouse
gcggactagccctgggtcat

SEQ ID NO: 649923 - DNA, 20 bp, mouse
ggctgcgcctgtccctgcgg

SEQ ID NO: 649924 - DNA, 20 bp, mouse
ggaggagagcggactagccc

SEQ ID NO: 649925 - DNA, 20 bp, mouse
gtgctccgcctctctagcgt

SEQ ID NO: 649926 - DNA, 20 bp, mouse
ggccggccgacccactcggg

SEQ ID NO: 649927 - DNA, 20 bp, mouse
ggccgcgccctgttgggtca

SEQ ID NO: 649928 - DNA, 20 bp, mouse
gctgcagcgccgcgccctgt

SEQ ID NO: 649929 - DNA, 20 bp, mouse
gtgtgagcgtcgggcactga

SEQ ID NO: 649930 - DNA, 20 bp, mouse
gggggccggccgacccactc

SEQ ID NO: 649931 - DNA, 20 bp, mouse
gtccacgcagcctcccgagt

SEQ ID NO: 649932 - DNA, 20 bp, mouse
gcagaactacaacaacgagt

SEQ ID NO: 649933 - DNA, 20 bp, mouse
ggacttagctgtgcaggcgg

SEQ ID NO: 649934 - DNA, 20 bp, mouse
gcgcgggctggtgaacgtca

SEQ ID NO: 649935 - DNA, 20 bp, mouse
ggtgcagaccatgacccaac

SEQ ID NO: 649936 - DNA, 20 bp, mouse
gggtgagggcggggctagaa

SEQ ID NO: 649937 - DNA, 20 bp, mouse
gcagggcggggcttgatgta

SEQ ID NO: 649938 - DNA, 20 bp, mouse
gcggggcgagcgagtgctta

SEQ ID NO: 649939 - DNA, 20 bp, mouse
gcagccgcgcgccggtgggg

SEQ ID NO: 649940 - DNA, 20 bp, mouse
gcgcggagggcggagtgaga

SEQ ID NO: 649941 - DNA, 20 bp, mouse
gggcggggcttgatgtaggg

SEQ ID NO: 649942 - DNA, 20 bp, mouse
ggtggggcggggagagcgca

SEQ ID NO: 649943 - DNA, 20 bp, mouse
ggcgagctctggtgtctcgg

SEQ ID NO: 649944 - DNA, 20 bp, mouse
gcagcgggcagcccagagta

SEQ ID NO: 649945 - DNA, 20 bp, mouse
gcagcagccgcgcgccggtg

SEQ ID NO: 649946 - DNA, 20 bp, mouse
gtcgacgtggacagggatct

SEQ ID NO: 649947 - DNA, 20 bp, mouse
gttggttgagcgtttctgta

SEQ ID NO: 649948 - DNA, 20 bp, mouse
gggagggggtgggacataaa

SEQ ID NO: 649949 - DNA, 20 bp, mouse
gacgtggacagggatctggg

SEQ ID NO: 649950 - DNA, 20 bp, mouse
gcccccgctcactacaggtt

SEQ ID NO: 649951 - DNA, 20 bp, mouse
gtgggacataaatggtgtta

SEQ ID NO: 649952 - DNA, 20 bp, mouse
gtgtccctctcccaccccgg

SEQ ID NO: 649953 - DNA, 20 bp, mouse
ggcaaagatgcaattaaatg

SEQ ID NO: 649954 - DNA, 20 bp, mouse
gtccacgtcgactaggaacc

SEQ ID NO: 649955 - DNA, 20 bp, mouse
gatccctgtccacgtcgact

SEQ ID NO: 649956 - DNA, 20 bp, mouse
gcgaggcatccattcctctc

SEQ ID NO: 649957 - DNA, 20 bp, mouse
ggacaagagtcgccaggaga

SEQ ID NO: 649958 - DNA, 20 bp, mouse
gcaaaactacgattcctact

SEQ ID NO: 649959 - DNA, 20 bp, mouse
ggaggctagtaacaatgcac

SEQ ID NO: 649960 - DNA, 20 bp, mouse
gctccgccccccgaagatgg

SEQ ID NO: 649961 - DNA, 20 bp, mouse
ggagccgcgtctggaccgga

SEQ ID NO: 649962 - DNA, 20 bp, mouse
gggtccttccggtccagacg

SEQ ID NO: 649963 - DNA, 20 bp, mouse
gcggctccgccccccgaaga

SEQ ID NO: 649964 - DNA, 20 bp, mouse
gtggctacctccatcttcgg

SEQ ID NO: 649965 - DNA, 20 bp, mouse
gttccgcctccgctgtgttt

SEQ ID NO: 649966 - DNA, 20 bp, mouse
gaaccaaggccactaatcat

SEQ ID NO: 649967 - DNA, 20 bp, mouse
ggataaggaccatacacata

SEQ ID NO: 649968 - DNA, 20 bp, mouse
gtcaaatattaaccacctgg

SEQ ID NO: 649969 - DNA, 20 bp, mouse
gaccatacacataaggaaag

SEQ ID NO: 649970 - DNA, 20 bp, mouse
ggggtcaaatattaaccacc

SEQ ID NO: 649971 - DNA, 20 bp, mouse
gaatacacacagcacttcct

SEQ ID NO: 649972 - DNA, 20 bp, mouse
ggaagttggcctgaacgtca

SEQ ID NO: 649973 - DNA, 20 bp, mouse
gttcagtcctaccctgagca

SEQ ID NO: 649974 - DNA, 20 bp, mouse
gtgcccatgattagtggcct

SEQ ID NO: 649975 - DNA, 20 bp, mouse
gcactaatcatgggcaaaca

SEQ ID NO: 649976 - DNA, 20 bp, mouse
ggtgggcgttccagcctcgg

SEQ ID NO: 649977 - DNA, 20 bp, mouse
gcaggcagacccaatgggga

SEQ ID NO: 649978 - DNA, 20 bp, mouse
gtgggtttctgtacagaaat

SEQ ID NO: 649979 - DNA, 20 bp, mouse
gacttccaagcagacaaggt

SEQ ID NO: 649980 - DNA, 20 bp, mouse
gagggtcttcctgacagtca

SEQ ID NO: 649981 - DNA, 20 bp, mouse
gccacgcaaacagattgggg

SEQ ID NO: 649982 - DNA, 20 bp, mouse
gcaaggatgcccctccccat

SEQ ID NO: 649983 - DNA, 20 bp, mouse
gcctggaaggttctcccctg

SEQ ID NO: 649984 - DNA, 20 bp, mouse
ggaaacccaccttgtctgct

SEQ ID NO: 649985 - DNA, 20 bp, mouse
ggggcaccaagtggttccag

SEQ ID NO: 649986 - DNA, 20 bp, mouse
ggtacattatccaggtaggg

SEQ ID NO: 649987 - DNA, 20 bp, mouse
gtttgttatactacggatgg

SEQ ID NO: 649988 - DNA, 20 bp, mouse
gggataatgtacaagacctt

SEQ ID NO: 649989 - DNA, 20 bp, mouse
gtcttgtacattatccaggt

SEQ ID NO: 649990 - DNA, 20 bp, mouse
gacaagaccttaggtttttt

SEQ ID NO: 649991 - DNA, 20 bp, mouse
gcttagagttcccccctacc

SEQ ID NO: 649992 - DNA, 20 bp, mouse
gtttaagatataccaaggac

SEQ ID NO: 649993 - DNA, 20 bp, mouse
ggagaaagatggctgcgcca

SEQ ID NO: 649994 - DNA, 20 bp, mouse
gtctgggcccagtaggaact

SEQ ID NO: 649995 - DNA, 20 bp, mouse
gcctaaggaatagagaaaga

SEQ ID NO: 649996 - DNA, 20 bp, mouse
gacagatagtaaccacctgg

SEQ ID NO: 649997 - DNA, 20 bp, mouse
ggggacagatagtaaccacc

SEQ ID NO: 649998 - DNA, 20 bp, mouse
gaacctatgtatctctactt

SEQ ID NO: 649999 - DNA, 20 bp, mouse
gtgtccgtgattagtgtcct

SEQ ID NO: 650000 - DNA, 20 bp, mouse
gatatatagtgctcgtgtga

SEQ ID NO: 650001 - DNA, 20 bp, mouse
gggaccacacatttttttca

SEQ ID NO: 650002 - DNA, 20 bp, mouse
gcatctgcaggaaaaaaata

SEQ ID NO: 650003 - DNA, 20 bp, mouse
gcccaggcatgctcagggaa

SEQ ID NO: 650004 - DNA, 20 bp, mouse
gatggagggaagaggaactc

SEQ ID NO: 650005 - DNA, 20 bp, mouse
gtgccaaagtagagatacat

SEQ ID NO: 650006 - DNA, 20 bp, mouse
gggtctgagaactaaacctg

SEQ ID NO: 650007 - DNA, 20 bp, mouse
gtccaggcatcgcatatgtg

SEQ ID NO: 650008 - DNA, 20 bp, mouse
gggcattacctcataagcag

SEQ ID NO: 650009 - DNA, 20 bp, mouse
gaccacacatatgcgatgcc

SEQ ID NO: 650010 - DNA, 20 bp, mouse
ggctttgttgtgtcctctcc

SEQ ID NO: 650011 - DNA, 20 bp, mouse
gtatcctgctgtgtagtttc

SEQ ID NO: 650012 - DNA, 20 bp, mouse
gaagaaaaggagtacttcct

SEQ ID NO: 650013 - DNA, 20 bp, mouse
gatggagggaagatgaaccc

SEQ ID NO: 650014 - DNA, 20 bp, mouse
gtggttgcgggcacttcctc

SEQ ID NO: 650015 - DNA, 20 bp, mouse
ggacagctttaaagaacagg

SEQ ID NO: 650016 - DNA, 20 bp, mouse
ggaggaagatgactgcacca

SEQ ID NO: 650017 - DNA, 20 bp, mouse
gctgcaccatggagtcagtt

SEQ ID NO: 650018 - DNA, 20 bp, mouse
ggatataccaagggattcaa

SEQ ID NO: 650019 - DNA, 20 bp, mouse
gttgggcccaatagggactt

SEQ ID NO: 650020 - DNA, 20 bp, mouse
gttctgaaagagcatgttaa

SEQ ID NO: 650021 - DNA, 20 bp, mouse
gcgtaacccaagtccctatt

SEQ ID NO: 650022 - DNA, 20 bp, mouse
gttgaaggtctttgcgccct

SEQ ID NO: 650023 - DNA, 20 bp, mouse
gaatcatccattgaatccct

SEQ ID NO: 650024 - DNA, 20 bp, mouse
gatcccttggtatatcttga

SEQ ID NO: 650025 - DNA, 20 bp, mouse
gccaaggcaaagatggaatt

SEQ ID NO: 650026 - DNA, 20 bp, mouse
ggggcgggttgcaaagggag

SEQ ID NO: 650027 - DNA, 20 bp, mouse
ggggctgcgttagaaggcac

SEQ ID NO: 650028 - DNA, 20 bp, mouse
ggtggggcggggtcgaacag

SEQ ID NO: 650029 - DNA, 20 bp, mouse
ggctccgccccacgctagca

SEQ ID NO: 650030 - DNA, 20 bp, mouse
gtattgggaacaagagaaag

SEQ ID NO: 650031 - DNA, 20 bp, mouse
gggggtcgaacagaggagac

SEQ ID NO: 650032 - DNA, 20 bp, mouse
gctccgcctcctcaccgccc

SEQ ID NO: 650033 - DNA, 20 bp, mouse
gagggaggggctgcgttaga

SEQ ID NO: 650034 - DNA, 20 bp, mouse
ggagccttgctagcgtgggg

SEQ ID NO: 650035 - DNA, 20 bp, mouse
gtagaaggcaccggtttcta

SEQ ID NO: 650036 - DNA, 20 bp, mouse
gtgcgcggacagccatttcc

SEQ ID NO: 650037 - DNA, 20 bp, mouse
gcggacagccatttcctggt

SEQ ID NO: 650038 - DNA, 20 bp, mouse
gcttccgccctaccaggaaa

SEQ ID NO: 650039 - DNA, 20 bp, mouse
gttaagacataggaaggagc

SEQ ID NO: 650040 - DNA, 20 bp, mouse
gcggccgggagccgagtgat

SEQ ID NO: 650041 - DNA, 20 bp, mouse
ggcggaaggctagcgcttga

SEQ ID NO: 650042 - DNA, 20 bp, mouse
ggggaggagcgtctcgccgc

SEQ ID NO: 650043 - DNA, 20 bp, mouse
gagaaggcaagatggtgacc

SEQ ID NO: 650044 - DNA, 20 bp, mouse
ggagccgagtgatggggatc

SEQ ID NO: 650045 - DNA, 20 bp, mouse
gcagccatttcctggtaggg

SEQ ID NO: 650046 - DNA, 20 bp, mouse
ggactcaaggcaattgtctg

SEQ ID NO: 650047 - DNA, 20 bp, mouse
gtgagtgtgcccctatgcta

SEQ ID NO: 650048 - DNA, 20 bp, mouse
gagcacacccgaacctatta

SEQ ID NO: 650049 - DNA, 20 bp, mouse
gaggcaattgtctgcggaag

SEQ ID NO: 650050 - DNA, 20 bp, mouse
gcatgacctcgatcatgtat

SEQ ID NO: 650051 - DNA, 20 bp, mouse
gacacccgaacctattaagg

SEQ ID NO: 650052 - DNA, 20 bp, mouse
gggaggcccatacatgatcg

SEQ ID NO: 650053 - DNA, 20 bp, mouse
gggcggatcggcttacaaat

SEQ ID NO: 650054 - DNA, 20 bp, mouse
gcatcagcaatccttagcat

SEQ ID NO: 650055 - DNA, 20 bp, mouse
gaaggattgctgatggcttt

SEQ ID NO: 650056 - DNA, 20 bp, mouse
ggacatgcccaggggtcttg

SEQ ID NO: 650057 - DNA, 20 bp, mouse
ggaagatagtgggtgagcca

SEQ ID NO: 650058 - DNA, 20 bp, mouse
gtgcccaggggtcttgtggc

SEQ ID NO: 650059 - DNA, 20 bp, mouse
gctggctagtgaccccctac

SEQ ID NO: 650060 - DNA, 20 bp, mouse
gtgtactgcagaagccttct

SEQ ID NO: 650061 - DNA, 20 bp, mouse
ggtgcctctgacatgcccag

SEQ ID NO: 650062 - DNA, 20 bp, mouse
gtggaaaagcacatttacaa

SEQ ID NO: 650063 - DNA, 20 bp, mouse
gctgcagtacacagtccttt

SEQ ID NO: 650064 - DNA, 20 bp, mouse
gtaagcttgcagagtatctg

SEQ ID NO: 650065 - DNA, 20 bp, mouse
gcacccactatcttcctgta

SEQ ID NO: 650066 - DNA, 20 bp, mouse
gggcggccttgagcacgcca

SEQ ID NO: 650067 - DNA, 20 bp, mouse
gtgagcacgccagggaagac

SEQ ID NO: 650068 - DNA, 20 bp, mouse
gagactcaatgcttcccact

SEQ ID NO: 650069 - DNA, 20 bp, mouse
ggcaaggctctctcccaagt

SEQ ID NO: 650070 - DNA, 20 bp, mouse
ggctgctggcttcccctctg

SEQ ID NO: 650071 - DNA, 20 bp, mouse
ggcaggaggcgaggcctcag

SEQ ID NO: 650072 - DNA, 20 bp, mouse
gccccctctgattccaagtt

SEQ ID NO: 650073 - DNA, 20 bp, mouse
gagggagcaaagtgatgttg

SEQ ID NO: 650074 - DNA, 20 bp, mouse
gcctccccaggctgctctgg

SEQ ID NO: 650075 - DNA, 20 bp, mouse
gactgcacaatcaaagcaga

SEQ ID NO: 650076 - DNA, 20 bp, mouse
ggcagcgagaggaaatccta

SEQ ID NO: 650077 - DNA, 20 bp, mouse
gtcctctcgctgccgaggtg

SEQ ID NO: 650078 - DNA, 20 bp, mouse
gaggctgaatagctctaaca

SEQ ID NO: 650079 - DNA, 20 bp, mouse
gacaaggagagattgtgtgc

SEQ ID NO: 650080 - DNA, 20 bp, mouse
ggcgagaggaaatcctaagg

SEQ ID NO: 650081 - DNA, 20 bp, mouse
ggggtaggaacctcctcctt

SEQ ID NO: 650082 - DNA, 20 bp, mouse
gaagggcaccatctggaaac

SEQ ID NO: 650083 - DNA, 20 bp, mouse
gttgaaggaagggcaccatc

SEQ ID NO: 650084 - DNA, 20 bp, mouse
ggccccacctcggcagcgag

SEQ ID NO: 650085 - DNA, 20 bp, mouse
ggagtctactgagaacgaga

SEQ ID NO: 650086 - DNA, 20 bp, mouse
gccgccaaagcaggcaggag

SEQ ID NO: 650087 - DNA, 20 bp, mouse
gcctgtctggagctgagggg

SEQ ID NO: 650088 - DNA, 20 bp, mouse
gccgcccaggccgccaaagc

SEQ ID NO: 650089 - DNA, 20 bp, mouse
gccagcaacgtcagccttca

SEQ ID NO: 650090 - DNA, 20 bp, mouse
gccaggccgccaaagcaggc

SEQ ID NO: 650091 - DNA, 20 bp, mouse
gcaggcggcccgcccctgtc

SEQ ID NO: 650092 - DNA, 20 bp, mouse
ggctgtgcaagcagctgctt

SEQ ID NO: 650093 - DNA, 20 bp, mouse
gcctcagctccagacagggg

SEQ ID NO: 650094 - DNA, 20 bp, mouse
ggggatcctcttgcactggt

SEQ ID NO: 650095 - DNA, 20 bp, mouse
gttgctggggtgccctgtgt

SEQ ID NO: 650096 - DNA, 20 bp, mouse
ggaaatgagcaactaatagg

SEQ ID NO: 650097 - DNA, 20 bp, mouse
gtcaatggcaactgaaatca

SEQ ID NO: 650098 - DNA, 20 bp, mouse
gaacaacttggaaagacttg

SEQ ID NO: 650099 - DNA, 20 bp, mouse
gatctaactcaacatggggg

SEQ ID NO: 650100 - DNA, 20 bp, mouse
gtatccgacgacagaaacag

SEQ ID NO: 650101 - DNA, 20 bp, mouse
gcattgatctaactcaacat

SEQ ID NO: 650102 - DNA, 20 bp, mouse
gggctaagacatgtgaaata

SEQ ID NO: 650103 - DNA, 20 bp, mouse
gtagcctctgtttctgtcgt

SEQ ID NO: 650104 - DNA, 20 bp, mouse
ggataaacaaactacaaaca

SEQ ID NO: 650105 - DNA, 20 bp, mouse
gatgcacacacaaggttggc

SEQ ID NO: 650106 - DNA, 20 bp, mouse
gagcgagtggccaagtttta

SEQ ID NO: 650107 - DNA, 20 bp, mouse
gtcccagcccggttcaatgg

SEQ ID NO: 650108 - DNA, 20 bp, mouse
ggagaaggggtcagtcaaga

SEQ ID NO: 650109 - DNA, 20 bp, mouse
gagggagagcattggaggcg

SEQ ID NO: 650110 - DNA, 20 bp, mouse
gcccggttcaatggaggaaa

SEQ ID NO: 650111 - DNA, 20 bp, mouse
gcactgcatggttcatccta

SEQ ID NO: 650112 - DNA, 20 bp, mouse
ggcatcccagcccggttcaa

SEQ ID NO: 650113 - DNA, 20 bp, mouse
gcctagcccgcatcccagcc

SEQ ID NO: 650114 - DNA, 20 bp, mouse
gaggaaagggcgtacaaatc

SEQ ID NO: 650115 - DNA, 20 bp, mouse
ggtgggagggagagcattgg

SEQ ID NO: 650116 - DNA, 20 bp, mouse
gagaaaggaagagactcgta

SEQ ID NO: 650117 - DNA, 20 bp, mouse
gaggcctgggcaaggggatc

SEQ ID NO: 650118 - DNA, 20 bp, mouse
gctccggagcatgataacag

SEQ ID NO: 650119 - DNA, 20 bp, mouse
ggaagagactcgtagggcag

SEQ ID NO: 650120 - DNA, 20 bp, mouse
gcaggggctcacacctctac

SEQ ID NO: 650121 - DNA, 20 bp, mouse
ggctggggacacccttaaag

SEQ ID NO: 650122 - DNA, 20 bp, mouse
gctgcccagggttctcacac

SEQ ID NO: 650123 - DNA, 20 bp, mouse
gtccccagcgccaggcatca

SEQ ID NO: 650124 - DNA, 20 bp, mouse
ggctccggaggcctgggcaa

SEQ ID NO: 650125 - DNA, 20 bp, mouse
gctaggccctggtagacttg

SEQ ID NO: 650126 - DNA, 20 bp, mouse
gcccagagactgtacagacg

SEQ ID NO: 650127 - DNA, 20 bp, mouse
gcagcgtaaacctaggccag

SEQ ID NO: 650128 - DNA, 20 bp, mouse
gtagcacacagggccctcgt

SEQ ID NO: 650129 - DNA, 20 bp, mouse
gacagtctctgggctcagac

SEQ ID NO: 650130 - DNA, 20 bp, mouse
gtgaccctcccagatgaggt

SEQ ID NO: 650131 - DNA, 20 bp, mouse
gtcctcgtctgtacagtctc

SEQ ID NO: 650132 - DNA, 20 bp, mouse
gtggcaggccataatctaat

SEQ ID NO: 650133 - DNA, 20 bp, mouse
gcctcccagatgaggtggga

SEQ ID NO: 650134 - DNA, 20 bp, mouse
gcacctgaccctcccagatg

SEQ ID NO: 650135 - DNA, 20 bp, mouse
gtgtacctccacccctacga

SEQ ID NO: 650136 - DNA, 20 bp, mouse
ggcgccgcgcggaggaaatc

SEQ ID NO: 650137 - DNA, 20 bp, mouse
gacaccgctggcgacccggg

SEQ ID NO: 650138 - DNA, 20 bp, mouse
ggagccgtgcgcagcggagc

SEQ ID NO: 650139 - DNA, 20 bp, mouse
gcggcgccccggtcccccgc

SEQ ID NO: 650140 - DNA, 20 bp, mouse
gccccctcccgggtcgccag

SEQ ID NO: 650141 - DNA, 20 bp, mouse
ggggggcgctgcgctcgcac

SEQ ID NO: 650142 - DNA, 20 bp, mouse
ggcgcggaggaaatcagggg

SEQ ID NO: 650143 - DNA, 20 bp, mouse
ggcggccgagccgtgcgcag

SEQ ID NO: 650144 - DNA, 20 bp, mouse
gcggagcggggagtcaggcg

SEQ ID NO: 650145 - DNA, 20 bp, mouse
gacgctccggggacagcatg

SEQ ID NO: 650146 - DNA, 20 bp, mouse
ggccgggtctacacagacac

SEQ ID NO: 650147 - DNA, 20 bp, mouse
ggtggccctcagattggctt

SEQ ID NO: 650148 - DNA, 20 bp, mouse
ggtagacccggcctttgaga

SEQ ID NO: 650149 - DNA, 20 bp, mouse
gcaaccagaaaaggccttat

SEQ ID NO: 650150 - DNA, 20 bp, mouse
gtagcagtggcaagtcccct

SEQ ID NO: 650151 - DNA, 20 bp, mouse
gtagaaggaaactgctgaga

SEQ ID NO: 650152 - DNA, 20 bp, mouse
gccgcgccaaagccaatctg

SEQ ID NO: 650153 - DNA, 20 bp, mouse
gaaggaaaagactggttggt

SEQ ID NO: 650154 - DNA, 20 bp, mouse
gctgcatgtggccctcagat

SEQ ID NO: 650155 - DNA, 20 bp, mouse
gtatcgggcaccagggtgca

SEQ ID NO: 650156 - DNA, 20 bp, mouse
gcaggcacagatccagtaat

SEQ ID NO: 650157 - DNA, 20 bp, mouse
gcctgggacgggtgcaattt

SEQ ID NO: 650158 - DNA, 20 bp, mouse
gtgactgtctgaactcgaaa

SEQ ID NO: 650159 - DNA, 20 bp, mouse
ggaagcgtaggttttatgcg

SEQ ID NO: 650160 - DNA, 20 bp, mouse
ggggctgtctggtggtaagt

SEQ ID NO: 650161 - DNA, 20 bp, mouse
gctgtctggtggtaagtggg

SEQ ID NO: 650162 - DNA, 20 bp, mouse
gcgtaggttttatgcgtggc

SEQ ID NO: 650163 - DNA, 20 bp, mouse
ggctacaatgaagaacactg

SEQ ID NO: 650164 - DNA, 20 bp, mouse
gtggggaaggggcgcgcgct

SEQ ID NO: 650165 - DNA, 20 bp, mouse
gctttctctaggtacttcgg

SEQ ID NO: 650166 - DNA, 20 bp, mouse
gaatctctgaagcgtcccag

SEQ ID NO: 650167 - DNA, 20 bp, mouse
gtctgaagcgtcccaggggc

SEQ ID NO: 650168 - DNA, 20 bp, mouse
gtacccaggaggcagcagtg

SEQ ID NO: 650169 - DNA, 20 bp, mouse
gacccccactgctgcctcct

SEQ ID NO: 650170 - DNA, 20 bp, mouse
gggggtggtaacgagagatc

SEQ ID NO: 650171 - DNA, 20 bp, mouse
ggaaagcattgggtataccc

SEQ ID NO: 650172 - DNA, 20 bp, mouse
gactgcagtgagccagcccc

SEQ ID NO: 650173 - DNA, 20 bp, mouse
gcacatgtgttgaaagcatt

SEQ ID NO: 650174 - DNA, 20 bp, mouse
gtaacgagagatcgggttac

SEQ ID NO: 650175 - DNA, 20 bp, mouse
gagagcatttacattcggct

SEQ ID NO: 650176 - DNA, 20 bp, mouse
gcacatgcaggttgcacctt

SEQ ID NO: 650177 - DNA, 20 bp, mouse
gcacagtagtggatagagtg

SEQ ID NO: 650178 - DNA, 20 bp, mouse
ggaagcgcaggagatgctca

SEQ ID NO: 650179 - DNA, 20 bp, mouse
gaggccgagaatgtgcccga

SEQ ID NO: 650180 - DNA, 20 bp, mouse
gtgggaaggcctttagctga

SEQ ID NO: 650181 - DNA, 20 bp, mouse
gtggccatcgggcacattct

SEQ ID NO: 650182 - DNA, 20 bp, mouse
ggccctaggacagctttagc

SEQ ID NO: 650183 - DNA, 20 bp, mouse
gacagctttagccggctcag

SEQ ID NO: 650184 - DNA, 20 bp, mouse
gctgcgcttcagttctggtg

SEQ ID NO: 650185 - DNA, 20 bp, mouse
gtttagctgagggctaaagt

SEQ ID NO: 650186 - DNA, 20 bp, mouse
gccaccctgagggagacccg

SEQ ID NO: 650187 - DNA, 20 bp, mouse
gtccacctcgggtctccctc

SEQ ID NO: 650188 - DNA, 20 bp, mouse
gttgcctcaaaggtggtcaa

SEQ ID NO: 650189 - DNA, 20 bp, mouse
gtcaacctgggttgcctcaa

SEQ ID NO: 650190 - DNA, 20 bp, mouse
ggctctgagcccaatcgctc

SEQ ID NO: 650191 - DNA, 20 bp, mouse
gtagccaggcaaagcagatg

SEQ ID NO: 650192 - DNA, 20 bp, mouse
gaccacctttgaggcaaccc

SEQ ID NO: 650193 - DNA, 20 bp, mouse
gtctcttggggatgtgtttg

SEQ ID NO: 650194 - DNA, 20 bp, mouse
gccctgagggagacccgagg

SEQ ID NO: 650195 - DNA, 20 bp, mouse
gaaaatgggagactccacct

SEQ ID NO: 650196 - DNA, 20 bp, mouse
gtggcatcccatgtactcta

SEQ ID NO: 650197 - DNA, 20 bp, mouse
gggaagggctggagaacgga

SEQ ID NO: 650198 - DNA, 20 bp, mouse
gaaactgtacagggaactga

SEQ ID NO: 650199 - DNA, 20 bp, mouse
ggggatgccacacctaaagg

SEQ ID NO: 650200 - DNA, 20 bp, mouse
gatgaactgagcatttccga

SEQ ID NO: 650201 - DNA, 20 bp, mouse
gtccagcccttccctgtctt

SEQ ID NO: 650202 - DNA, 20 bp, mouse
gcgcagaccagcccaagaca

SEQ ID NO: 650203 - DNA, 20 bp, mouse
gcatgggatgccacacctaa

SEQ ID NO: 650204 - DNA, 20 bp, mouse
ggccaaaccctagagtacat

SEQ ID NO: 650205 - DNA, 20 bp, mouse
ggggtttggctctacacaaa

SEQ ID NO: 650206 - DNA, 20 bp, mouse
gcatcgcggggccgcagcgg

SEQ ID NO: 650207 - DNA, 20 bp, mouse
gcgtaggccccgcccatcgc

SEQ ID NO: 650208 - DNA, 20 bp, mouse
gaccacgcaagtgctcgtct

SEQ ID NO: 650209 - DNA, 20 bp, mouse
ggcccatcgcggggccgcag

SEQ ID NO: 650210 - DNA, 20 bp, mouse
gcgtgggtgaagctcacagt

SEQ ID NO: 650211 - DNA, 20 bp, mouse
gcctggcagcagctgtgcgt

SEQ ID NO: 650212 - DNA, 20 bp, mouse
ggtactcctaaacagagtgc

SEQ ID NO: 650213 - DNA, 20 bp, mouse
gactctgtttaggagtaccc

SEQ ID NO: 650214 - DNA, 20 bp, mouse
gctaaacagagtgcaggaag

SEQ ID NO: 650215 - DNA, 20 bp, mouse
gacgcaagtgctcgtctggg

SEQ ID NO: 650216 - DNA, 20 bp, mouse
gaaggtggtgcagagctcac

SEQ ID NO: 650217 - DNA, 20 bp, mouse
gtaaaagggagccatgactt

SEQ ID NO: 650218 - DNA, 20 bp, mouse
ggagctctgcaccaccttag

SEQ ID NO: 650219 - DNA, 20 bp, mouse
gtaaacacacaccgaagtca

SEQ ID NO: 650220 - DNA, 20 bp, mouse
ggtgggagcacgtctttgaa

SEQ ID NO: 650221 - DNA, 20 bp, mouse
gctaacagaagtatagaaga

SEQ ID NO: 650222 - DNA, 20 bp, mouse
gagagtctaggtatattctc

SEQ ID NO: 650223 - DNA, 20 bp, mouse
gtcactcacaggttcacaaa

SEQ ID NO: 650224 - DNA, 20 bp, mouse
gggcccccttaagagaactg

SEQ ID NO: 650225 - DNA, 20 bp, mouse
gcggtccttgcagatacaat

SEQ ID NO: 650226 - DNA, 20 bp, mouse
ggtactccaggcgatcgtca

SEQ ID NO: 650227 - DNA, 20 bp, mouse
ggcaaacatggactattctg

SEQ ID NO: 650228 - DNA, 20 bp, mouse
gcgtcagggtagagcaaaca

SEQ ID NO: 650229 - DNA, 20 bp, mouse
gcaagtctcgcgagaatgga

SEQ ID NO: 650230 - DNA, 20 bp, mouse
gggaagttgctctaggcggg

SEQ ID NO: 650231 - DNA, 20 bp, mouse
gacaacttgggttatcaaac

SEQ ID NO: 650232 - DNA, 20 bp, mouse
ggtctcgcgagaatggatgg

SEQ ID NO: 650233 - DNA, 20 bp, mouse
gttggaaggtttgacaagcg

SEQ ID NO: 650234 - DNA, 20 bp, mouse
gctgggctatctcgtactcc

SEQ ID NO: 650235 - DNA, 20 bp, mouse
gacactggttacaaatatag

SEQ ID NO: 650236 - DNA, 20 bp, mouse
ggggcgggaggcagcaggtt

SEQ ID NO: 650237 - DNA, 20 bp, mouse
ggcgggtcaacgcagcttgg

SEQ ID NO: 650238 - DNA, 20 bp, mouse
gtgacccgcgtaggcctagg

SEQ ID NO: 650239 - DNA, 20 bp, mouse
gcaaccgcctaggcctacgc

SEQ ID NO: 650240 - DNA, 20 bp, mouse
ggaggctggccaatagctag

SEQ ID NO: 650241 - DNA, 20 bp, mouse
gaagctgcgttgacccgcgt

SEQ ID NO: 650242 - DNA, 20 bp, mouse
gcgggcgttcacaaccgcct

SEQ ID NO: 650243 - DNA, 20 bp, mouse
gggagaccggaagtcagctc

SEQ ID NO: 650244 - DNA, 20 bp, mouse
gaagtcagctcgggagaagc

SEQ ID NO: 650245 - DNA, 20 bp, mouse
gcgccccttagactcatcac

SEQ ID NO: 650246 - DNA, 20 bp, mouse
gaggaaggacggtggggaac

SEQ ID NO: 650247 - DNA, 20 bp, mouse
gggagaggctgaagggttcc

SEQ ID NO: 650248 - DNA, 20 bp, mouse
ggagcccgaagctggtggag

SEQ ID NO: 650249 - DNA, 20 bp, mouse
gtggggcggcagtcgaagga

SEQ ID NO: 650250 - DNA, 20 bp, mouse
gtgggtggggcggcagtcga

SEQ ID NO: 650251 - DNA, 20 bp, mouse
gagggagaggaaggacggtg

SEQ ID NO: 650252 - DNA, 20 bp, mouse
ggcccggcgccggtagcggt

SEQ ID NO: 650253 - DNA, 20 bp, mouse
ggagacccgaactcgcgggg

SEQ ID NO: 650254 - DNA, 20 bp, mouse
gtgaagggttcctggagccg

SEQ ID NO: 650255 - DNA, 20 bp, mouse
gccctgagacccgaactcgc

SEQ ID NO: 650256 - DNA, 20 bp, mouse
gtcgctgccagagtaaggtg

SEQ ID NO: 650257 - DNA, 20 bp, mouse
gccaccttggcggaagaaga

SEQ ID NO: 650258 - DNA, 20 bp, mouse
gggtcactgtactgactcta

SEQ ID NO: 650259 - DNA, 20 bp, mouse
gctgctcttcaggtctggga

SEQ ID NO: 650260 - DNA, 20 bp, mouse
gccttggcggaagaagaagg

SEQ ID NO: 650261 - DNA, 20 bp, mouse
gtcttcaggtctgggagggt

SEQ ID NO: 650262 - DNA, 20 bp, mouse
ggaggggcatgccctcttcc

SEQ ID NO: 650263 - DNA, 20 bp, mouse
gaagatctggtcctggaaga

SEQ ID NO: 650264 - DNA, 20 bp, mouse
gagtcagatcgcagcaggag

SEQ ID NO: 650265 - DNA, 20 bp, mouse
gaagagggcatgcccctctc

SEQ ID NO: 650266 - DNA, 20 bp, mouse
gccaaaccctggagtccctc

SEQ ID NO: 650267 - DNA, 20 bp, mouse
ggcaagccagagggactcca

SEQ ID NO: 650268 - DNA, 20 bp, mouse
ggcagctagtcaatcccgat

SEQ ID NO: 650269 - DNA, 20 bp, mouse
ggccccgccccacgccgatc

SEQ ID NO: 650270 - DNA, 20 bp, mouse
ggagctggggataaagagcg

SEQ ID NO: 650271 - DNA, 20 bp, mouse
gaactcctggatacccctga

SEQ ID NO: 650272 - DNA, 20 bp, mouse
gacgtccggagcaagccaga

SEQ ID NO: 650273 - DNA, 20 bp, mouse
gactagctgcaccctacgtc

SEQ ID NO: 650274 - DNA, 20 bp, mouse
gagtcaatcccgatcggcgt

SEQ ID NO: 650275 - DNA, 20 bp, mouse
ggggtttggtgcgtacatct

SEQ ID NO: 650276 - DNA, 20 bp, mouse
gcagcagcgacaactcgggg

SEQ ID NO: 650277 - DNA, 20 bp, mouse
gggcgcgggcagcttggtcg

SEQ ID NO: 650278 - DNA, 20 bp, mouse
gagcgcgccgagtccgactc

SEQ ID NO: 650279 - DNA, 20 bp, mouse
ggggctgaggatgaatacgg

SEQ ID NO: 650280 - DNA, 20 bp, mouse
gctctccagcagcgacaact

SEQ ID NO: 650281 - DNA, 20 bp, mouse
gcgcgagcgcagcccggcag

SEQ ID NO: 650282 - DNA, 20 bp, mouse
gcggggtcctgagtcggact

SEQ ID NO: 650283 - DNA, 20 bp, mouse
gcgcagcccggcagtggcgc

SEQ ID NO: 650284 - DNA, 20 bp, mouse
gctgcctccggagccgcctg

SEQ ID NO: 650285 - DNA, 20 bp, mouse
gcggctccggaggcagcccg

SEQ ID NO: 650286 - DNA, 20 bp, mouse
gggcgggtctgaatgggggt

SEQ ID NO: 650287 - DNA, 20 bp, mouse
gtccaggggcgggtctgaat

SEQ ID NO: 650288 - DNA, 20 bp, mouse
ggattggtggtgtctgagac

SEQ ID NO: 650289 - DNA, 20 bp, mouse
ggggaggagtcagcacaact

SEQ ID NO: 650290 - DNA, 20 bp, mouse
gtaattgcagatttgtccag

SEQ ID NO: 650291 - DNA, 20 bp, mouse
gcacaggagtataagtccag

SEQ ID NO: 650292 - DNA, 20 bp, mouse
gcccacgttgaattagcctc

SEQ ID NO: 650293 - DNA, 20 bp, mouse
gcaagtccttctgtggatgc

SEQ ID NO: 650294 - DNA, 20 bp, mouse
gggtgtctgagacaggcccg

SEQ ID NO: 650295 - DNA, 20 bp, mouse
gagaaggacttgagctttag

SEQ ID NO: 650296 - DNA, 20 bp, mouse
gcctcaatggccaggtcggg

SEQ ID NO: 650297 - DNA, 20 bp, mouse
gcaaaaggagacatttggaa

SEQ ID NO: 650298 - DNA, 20 bp, mouse
gcccccgcgcctcaatggcc

SEQ ID NO: 650299 - DNA, 20 bp, mouse
gtgtccctgtacttcttaat

SEQ ID NO: 650300 - DNA, 20 bp, mouse
ggcccacagaagtcactacc

SEQ ID NO: 650301 - DNA, 20 bp, mouse
gtggctgaggcagacaatgg

SEQ ID NO: 650302 - DNA, 20 bp, mouse
gcattgggatgcagctagac

SEQ ID NO: 650303 - DNA, 20 bp, mouse
gtgcctggtagtgacttctg

SEQ ID NO: 650304 - DNA, 20 bp, mouse
gcccgaaccgcgccactctt

SEQ ID NO: 650305 - DNA, 20 bp, mouse
gctacgaggtccaaaccaaa

SEQ ID NO: 650306 - DNA, 20 bp, mouse
ggggccccgagggtccaccg

SEQ ID NO: 650307 - DNA, 20 bp, mouse
gaggcgcagaggcgcgtcgc

SEQ ID NO: 650308 - DNA, 20 bp, mouse
gggaagatgacgtgcagcgc

SEQ ID NO: 650309 - DNA, 20 bp, mouse
gtacctccgcggggccccga

SEQ ID NO: 650310 - DNA, 20 bp, mouse
gccaggagccggaaacgcgg

SEQ ID NO: 650311 - DNA, 20 bp, mouse
ggccccgcggaggtaggcga

SEQ ID NO: 650312 - DNA, 20 bp, mouse
gaagtctggggagtcgtcct

SEQ ID NO: 650313 - DNA, 20 bp, mouse
gcggaaacgcggaggcgcag

SEQ ID NO: 650314 - DNA, 20 bp, mouse
gctgcagagcggtatgctgt

SEQ ID NO: 650315 - DNA, 20 bp, mouse
ggtagggagctggcgaagtc

SEQ ID NO: 650316 - DNA, 20 bp, mouse
gccctggcttcccgatacgt

SEQ ID NO: 650317 - DNA, 20 bp, mouse
ggccgcggcgtatgcgaatc

SEQ ID NO: 650318 - DNA, 20 bp, mouse
ggcttcccagacactaagtc

SEQ ID NO: 650319 - DNA, 20 bp, mouse
gggagatgacaagctggccg

SEQ ID NO: 650320 - DNA, 20 bp, mouse
gagcttgtcatctccctctt

SEQ ID NO: 650321 - DNA, 20 bp, mouse
gccaccagtggccaattcag

SEQ ID NO: 650322 - DNA, 20 bp, mouse
gccagccctagctatataac

SEQ ID NO: 650323 - DNA, 20 bp, mouse
ggatgactcgcattgctgag

SEQ ID NO: 650324 - DNA, 20 bp, mouse
gtggctgggaagtgttgctt

SEQ ID NO: 650325 - DNA, 20 bp, mouse
gtgtgagagggtcattcctt

SEQ ID NO: 650326 - DNA, 20 bp, mouse
gcccgcgcctggatagggtg

SEQ ID NO: 650327 - DNA, 20 bp, mouse
ggaggctggcgcctgggata

SEQ ID NO: 650328 - DNA, 20 bp, mouse
ggcagggcggggccttctca

SEQ ID NO: 650329 - DNA, 20 bp, mouse
ggggtggggcctcccgcagg

SEQ ID NO: 650330 - DNA, 20 bp, mouse
gcgagcgcagcgagcactga

SEQ ID NO: 650331 - DNA, 20 bp, mouse
gcgctgctgacgcccgtggt

SEQ ID NO: 650332 - DNA, 20 bp, mouse
gcgtctggtggtgaagttag

SEQ ID NO: 650333 - DNA, 20 bp, mouse
gtgctcgctgcgctcggatg

SEQ ID NO: 650334 - DNA, 20 bp, mouse
gatagggtggggcctcccgc

SEQ ID NO: 650335 - DNA, 20 bp, mouse
gcgaggcccgcgcctggata

SEQ ID NO: 650336 - DNA, 20 bp, mouse
gctacaaagcaaggcttcac

SEQ ID NO: 650337 - DNA, 20 bp, mouse
gtccttgcctaggggaggaa

SEQ ID NO: 650338 - DNA, 20 bp, mouse
ggcaaggcaaaccaccagat

SEQ ID NO: 650339 - DNA, 20 bp, mouse
gaaacccagaccagctagag

SEQ ID NO: 650340 - DNA, 20 bp, mouse
gataaagagctcctatctgg

SEQ ID NO: 650341 - DNA, 20 bp, mouse
gctgagtccttgcctagggg

SEQ ID NO: 650342 - DNA, 20 bp, mouse
gtagtgctgagtccttgcct

SEQ ID NO: 650343 - DNA, 20 bp, mouse
gggcttcacaggacaggatg

SEQ ID NO: 650344 - DNA, 20 bp, mouse
gaaggaagacacaccaagcc

SEQ ID NO: 650345 - DNA, 20 bp, mouse
ggggatcatgcaagggacag

SEQ ID NO: 650346 - DNA, 20 bp, mouse
gtccccggccgacggctcga

SEQ ID NO: 650347 - DNA, 20 bp, mouse
gccgtccctgggctccccgg

SEQ ID NO: 650348 - DNA, 20 bp, mouse
ggcggcgggtggcgttcttg

SEQ ID NO: 650349 - DNA, 20 bp, mouse
gggaagtcctggagccgcgt

SEQ ID NO: 650350 - DNA, 20 bp, mouse
gccccgacgcgcccgtccct

SEQ ID NO: 650351 - DNA, 20 bp, mouse
gcgcgcgctccgctcctccg

SEQ ID NO: 650352 - DNA, 20 bp, mouse
gcctgggctccccggaggag

SEQ ID NO: 650353 - DNA, 20 bp, mouse
ggatgtgcaaaaggcggcat

SEQ ID NO: 650354 - DNA, 20 bp, mouse
gcgcgagcacgtgacccggg

SEQ ID NO: 650355 - DNA, 20 bp, mouse
gcagccctcgagccgtcggc

SEQ ID NO: 650356 - DNA, 20 bp, mouse
gcaggccggaccaaaccatc

SEQ ID NO: 650357 - DNA, 20 bp, mouse
ggggcaggggacgagagtcg

SEQ ID NO: 650358 - DNA, 20 bp, mouse
gtggagcgcaccactggaag

SEQ ID NO: 650359 - DNA, 20 bp, mouse
ggagatctcgggcttctcgg

SEQ ID NO: 650360 - DNA, 20 bp, mouse
gtggggaggctccagccgga

SEQ ID NO: 650361 - DNA, 20 bp, mouse
gacaacaaacaacgatctgt

SEQ ID NO: 650362 - DNA, 20 bp, mouse
gcgtggaaggcagcctgggg

SEQ ID NO: 650363 - DNA, 20 bp, mouse
ggatggaagaggcccgattg

SEQ ID NO: 650364 - DNA, 20 bp, mouse
gcggtcgcgtcccccggccg

SEQ ID NO: 650365 - DNA, 20 bp, mouse
gcggcctgcgcgctcacccc

SEQ ID NO: 650366 - DNA, 20 bp, mouse
ggacgcgcgcccgcaccctc

SEQ ID NO: 650367 - DNA, 20 bp, mouse
gcagcccgagcggacggtga

SEQ ID NO: 650368 - DNA, 20 bp, mouse
gaagcgaatgcggggaagag

SEQ ID NO: 650369 - DNA, 20 bp, mouse
gtggatgccaagtgggttgg

SEQ ID NO: 650370 - DNA, 20 bp, mouse
ggcaaaatgccaaagggtgg

SEQ ID NO: 650371 - DNA, 20 bp, mouse
gtgtccctcaccgtccgctc

SEQ ID NO: 650372 - DNA, 20 bp, mouse
gcccacttggcatccaagta

SEQ ID NO: 650373 - DNA, 20 bp, mouse
gatgccctgcatctctctta

SEQ ID NO: 650374 - DNA, 20 bp, mouse
gacccccgacccaacgcttc

SEQ ID NO: 650375 - DNA, 20 bp, mouse
ggaaatgggggaggctttta

SEQ ID NO: 650376 - DNA, 20 bp, mouse
gtcaggccctagattcctcc

SEQ ID NO: 650377 - DNA, 20 bp, mouse
gcctgtgcaaggacttgctc

SEQ ID NO: 650378 - DNA, 20 bp, mouse
gtgagggaggttgacaaaca

SEQ ID NO: 650379 - DNA, 20 bp, mouse
gtgggccttcgtaaaggagg

SEQ ID NO: 650380 - DNA, 20 bp, mouse
gagatggccagttatcctgg

SEQ ID NO: 650381 - DNA, 20 bp, mouse
gggctgtaggcgaggagaga

SEQ ID NO: 650382 - DNA, 20 bp, mouse
ggctggcaaggctgtaggcg

SEQ ID NO: 650383 - DNA, 20 bp, mouse
ggggttccctaacctgtgca

SEQ ID NO: 650384 - DNA, 20 bp, mouse
gggaagacaccaccggatat

SEQ ID NO: 650385 - DNA, 20 bp, mouse
ggtgctctgggccttcgtaa

SEQ ID NO: 650386 - DNA, 20 bp, mouse
ggcggggctacatggagtta

SEQ ID NO: 650387 - DNA, 20 bp, mouse
gccgtagctacgggaggcga

SEQ ID NO: 650388 - DNA, 20 bp, mouse
gccgcccgcccccagcgcgc

SEQ ID NO: 650389 - DNA, 20 bp, mouse
ggggcgccccctgcgggcac

SEQ ID NO: 650390 - DNA, 20 bp, mouse
ggcgcttcaaaatgaagttc

SEQ ID NO: 650391 - DNA, 20 bp, mouse
gtcggtggggttgttccgga

SEQ ID NO: 650392 - DNA, 20 bp, mouse
gtggcactgggattgggcca

SEQ ID NO: 650393 - DNA, 20 bp, mouse
gtgaagcgccatggtcggtg

SEQ ID NO: 650394 - DNA, 20 bp, mouse
ggctacatggagttagggcg

SEQ ID NO: 650395 - DNA, 20 bp, mouse
gtagctacggcaaccactgc

SEQ ID NO: 650396 - DNA, 20 bp, mouse
ggacgctagcggagagaatc

SEQ ID NO: 650397 - DNA, 20 bp, mouse
gagtacgcgtgtgtgatgcg

SEQ ID NO: 650398 - DNA, 20 bp, mouse
gtgccgagagtcggggaaaa

SEQ ID NO: 650399 - DNA, 20 bp, mouse
gcacacacgcgtactcgtca

SEQ ID NO: 650400 - DNA, 20 bp, mouse
ggaagcactccgaactggaa

SEQ ID NO: 650401 - DNA, 20 bp, mouse
gccaagacgcaccctcccac

SEQ ID NO: 650402 - DNA, 20 bp, mouse
ggtggggcctcgggctccca

SEQ ID NO: 650403 - DNA, 20 bp, mouse
ggcggagagaatctggctgg

SEQ ID NO: 650404 - DNA, 20 bp, mouse
gggggacccagggagctcta

SEQ ID NO: 650405 - DNA, 20 bp, mouse
gggtggcgaaagcacagacg

SEQ ID NO: 650406 - DNA, 20 bp, mouse
gtccaggcgcactcccccgg

SEQ ID NO: 650407 - DNA, 20 bp, mouse
gagggcggggagcttggcgg

SEQ ID NO: 650408 - DNA, 20 bp, mouse
gggaaagccgagcaggcgtc

SEQ ID NO: 650409 - DNA, 20 bp, mouse
ggtgcccgggaaagccgagc

SEQ ID NO: 650410 - DNA, 20 bp, mouse
gtcagactcggtctccccag

SEQ ID NO: 650411 - DNA, 20 bp, mouse
gcgtgggcgcagggaagcag

SEQ ID NO: 650412 - DNA, 20 bp, mouse
gggggcccgggctaagtcgg

SEQ ID NO: 650413 - DNA, 20 bp, mouse
gcgcccgcggtccctgcttg

SEQ ID NO: 650414 - DNA, 20 bp, mouse
gcactccaggcgcactcccc

SEQ ID NO: 650415 - DNA, 20 bp, mouse
ggggagaccgagtctgagcg

SEQ ID NO: 650416 - DNA, 20 bp, mouse
gaggggaggggcaagttccc

SEQ ID NO: 650417 - DNA, 20 bp, mouse
gtaggccagaggttagggga

SEQ ID NO: 650418 - DNA, 20 bp, mouse
gtggcttcccatgctccctg

SEQ ID NO: 650419 - DNA, 20 bp, mouse
gtctggtaggccagaggtta

SEQ ID NO: 650420 - DNA, 20 bp, mouse
gtgtccgaggtgaaggtgac

SEQ ID NO: 650421 - DNA, 20 bp, mouse
gttcacctcggacagcccca

SEQ ID NO: 650422 - DNA, 20 bp, mouse
gagaaggcacaccgccccga

SEQ ID NO: 650423 - DNA, 20 bp, mouse
gggaagccactgtccaggcc

SEQ ID NO: 650424 - DNA, 20 bp, mouse
gccgaggtgaaggtgacagg

SEQ ID NO: 650425 - DNA, 20 bp, mouse
gaaggacagctgcgggaaag

SEQ ID NO: 650426 - DNA, 20 bp, mouse
gctgggaggaggaacttctt

SEQ ID NO: 650427 - DNA, 20 bp, mouse
ggggccctttaagtgtctgg

SEQ ID NO: 650428 - DNA, 20 bp, mouse
ggtgactctcactaatgagt

SEQ ID NO: 650429 - DNA, 20 bp, mouse
gagagtcacgggatctagtt

SEQ ID NO: 650430 - DNA, 20 bp, mouse
gtatgatggccactgaatgc

SEQ ID NO: 650431 - DNA, 20 bp, mouse
gactcagaaaccggttcccc

SEQ ID NO: 650432 - DNA, 20 bp, mouse
ggtacctctgccagtggagg

SEQ ID NO: 650433 - DNA, 20 bp, mouse
gatgagttggctgactatga

SEQ ID NO: 650434 - DNA, 20 bp, mouse
gaaggtgctagtggcagcgg

SEQ ID NO: 650435 - DNA, 20 bp, mouse
gtttcccccagacacttaaa

SEQ ID NO: 650436 - DNA, 20 bp, mouse
gcagggtagtgggtgtccaa

SEQ ID NO: 650437 - DNA, 20 bp, mouse
ggcagcaggtgcagggtagt

SEQ ID NO: 650438 - DNA, 20 bp, mouse
ggagctgtctggtgctgagt

SEQ ID NO: 650439 - DNA, 20 bp, mouse
gtgggaatgtggcccactgg

SEQ ID NO: 650440 - DNA, 20 bp, mouse
gggcgggaaaaggagctgtc

SEQ ID NO: 650441 - DNA, 20 bp, mouse
gagaccatggggtggtaaaa

SEQ ID NO: 650442 - DNA, 20 bp, mouse
gaatgtggcccactgggggc

SEQ ID NO: 650443 - DNA, 20 bp, mouse
gccaggcatcccagaccatg

SEQ ID NO: 650444 - DNA, 20 bp, mouse
ggctgcacccacatctacca

SEQ ID NO: 650445 - DNA, 20 bp, mouse
ggcccactgggggcgggaaa

SEQ ID NO: 650446 - DNA, 20 bp, mouse
ggggaggggcctgaaatcta

SEQ ID NO: 650447 - DNA, 20 bp, mouse
ggagcgtgtcggtgcaggag

SEQ ID NO: 650448 - DNA, 20 bp, mouse
gagggaccatcatggagttg

SEQ ID NO: 650449 - DNA, 20 bp, mouse
gcggggcggagccttttcag

SEQ ID NO: 650450 - DNA, 20 bp, mouse
gagcgggccctgagctttcg

SEQ ID NO: 650451 - DNA, 20 bp, mouse
gaacttagaacggatgtgag

SEQ ID NO: 650452 - DNA, 20 bp, mouse
ggggctctgccctcctcctg

SEQ ID NO: 650453 - DNA, 20 bp, mouse
gaatgaagactggaaggtga

SEQ ID NO: 650454 - DNA, 20 bp, mouse
gcacatccgttctaagttcc

SEQ ID NO: 650455 - DNA, 20 bp, mouse
gggatggagcgtgtcggtgc

SEQ ID NO: 650456 - DNA, 20 bp, mouse
gaacccggggtttaaggcgg

SEQ ID NO: 650457 - DNA, 20 bp, mouse
gtcagggcgctgcaacctag

SEQ ID NO: 650458 - DNA, 20 bp, mouse
gcccgcagtcctggagtact

SEQ ID NO: 650459 - DNA, 20 bp, mouse
ggcccgggttagcctcggtt

SEQ ID NO: 650460 - DNA, 20 bp, mouse
gcggggtttaaggcggaggt

SEQ ID NO: 650461 - DNA, 20 bp, mouse
ggcaaggcttcaacaggaat

SEQ ID NO: 650462 - DNA, 20 bp, mouse
gaacccagacccagtactcc

SEQ ID NO: 650463 - DNA, 20 bp, mouse
gttctctaacccggggttta

SEQ ID NO: 650464 - DNA, 20 bp, mouse
gcccaaaccgaggctaaccc

SEQ ID NO: 650465 - DNA, 20 bp, mouse
gtcgtggcgtggaagagtaa

SEQ ID NO: 650466 - DNA, 20 bp, mouse
gtcagtcggaggtggggccc

SEQ ID NO: 650467 - DNA, 20 bp, mouse
gtctgggcacgcgcactccc

SEQ ID NO: 650468 - DNA, 20 bp, mouse
gaggaagcgcggagtcgcct

SEQ ID NO: 650469 - DNA, 20 bp, mouse
gctagcttgagtaggaagcg

SEQ ID NO: 650470 - DNA, 20 bp, mouse
ggtcccgcctctcgaattct

SEQ ID NO: 650471 - DNA, 20 bp, mouse
gcacgcgcactccctggttc

SEQ ID NO: 650472 - DNA, 20 bp, mouse
ggggcggggctagcttgagt

SEQ ID NO: 650473 - DNA, 20 bp, mouse
gcaagctgggcccctgaaat

SEQ ID NO: 650474 - DNA, 20 bp, mouse
gcgcgtgcccagaattcgag

SEQ ID NO: 650475 - DNA, 20 bp, mouse
ggtgcccagaattcgagagg

SEQ ID NO: 650476 - DNA, 20 bp, mouse
ggggctccgcctctccgcgg

SEQ ID NO: 650477 - DNA, 20 bp, mouse
gggcggtggtggtaatattg

SEQ ID NO: 650478 - DNA, 20 bp, mouse
ggcgcggccgccaatcgcgg

SEQ ID NO: 650479 - DNA, 20 bp, mouse
gagcgggcgggccaggtggc

SEQ ID NO: 650480 - DNA, 20 bp, mouse
ggggtaccgggtaacggccc

SEQ ID NO: 650481 - DNA, 20 bp, mouse
ggggacggaaactgggtacc

SEQ ID NO: 650482 - DNA, 20 bp, mouse
gaggtctccctggctcgcac

SEQ ID NO: 650483 - DNA, 20 bp, mouse
ggccaggtggcggggcgtct

SEQ ID NO: 650484 - DNA, 20 bp, mouse
gccgcctctccgcggaggga

SEQ ID NO: 650485 - DNA, 20 bp, mouse
gccgggatggcacgtggagg

SEQ ID NO: 650486 - DNA, 20 bp, mouse
gctgacacgcctcaccccgc

SEQ ID NO: 650487 - DNA, 20 bp, mouse
ggggtgaggcgtgtcagcgc

SEQ ID NO: 650488 - DNA, 20 bp, mouse
gagcgagacctgagtgtgga

SEQ ID NO: 650489 - DNA, 20 bp, mouse
gggagtgcacgcggagctct

SEQ ID NO: 650490 - DNA, 20 bp, mouse
gtgagagtgtcctggacgtg

SEQ ID NO: 650491 - DNA, 20 bp, mouse
gtgtaaatggaaaccgtctg

SEQ ID NO: 650492 - DNA, 20 bp, mouse
ggggctgtgctatgtgcccg

SEQ ID NO: 650493 - DNA, 20 bp, mouse
gagggctctgggagtgcacg

SEQ ID NO: 650494 - DNA, 20 bp, mouse
ggaggcgtgtcagcgcgggc

SEQ ID NO: 650495 - DNA, 20 bp, mouse
gtccaagtggagtgcatgct

SEQ ID NO: 650496 - DNA, 20 bp, mouse
gctggccagaaccaaatagt

SEQ ID NO: 650497 - DNA, 20 bp, mouse
gtggttctggccagcgcgtc

SEQ ID NO: 650498 - DNA, 20 bp, mouse
gtgtcagtgacgctctcgag

SEQ ID NO: 650499 - DNA, 20 bp, mouse
gctgcaagggcctgacgcgc

SEQ ID NO: 650500 - DNA, 20 bp, mouse
gcgaaaacaccgggaagaga

SEQ ID NO: 650501 - DNA, 20 bp, mouse
gctggcaggccgaaaacacc

SEQ ID NO: 650502 - DNA, 20 bp, mouse
gaaggaggatcaggcaccag

SEQ ID NO: 650503 - DNA, 20 bp, mouse
gcagcgccatagacggagat

SEQ ID NO: 650504 - DNA, 20 bp, mouse
gacgctctcgagcggtcgcc

SEQ ID NO: 650505 - DNA, 20 bp, mouse
gctacctgccgaatgtggat

SEQ ID NO: 650506 - DNA, 20 bp, mouse
gaggtcaagcgggttaggaa

SEQ ID NO: 650507 - DNA, 20 bp, mouse
gtagggcaaggattgagcaa

SEQ ID NO: 650508 - DNA, 20 bp, mouse
ggagctgagtgaattcctcc

SEQ ID NO: 650509 - DNA, 20 bp, mouse
ggctgacttcccacgatgaa

SEQ ID NO: 650510 - DNA, 20 bp, mouse
ggggagaaagatcagcccgg

SEQ ID NO: 650511 - DNA, 20 bp, mouse
ggagccaggtcaagcgggtt

SEQ ID NO: 650512 - DNA, 20 bp, mouse
ggaagggagaaagatcagcc

SEQ ID NO: 650513 - DNA, 20 bp, mouse
ggccaccatccaagtctagc

SEQ ID NO: 650514 - DNA, 20 bp, mouse
gctagcaggatcttagggca

SEQ ID NO: 650515 - DNA, 20 bp, mouse
gacactcaggctccacagct

SEQ ID NO: 650516 - DNA, 20 bp, mouse
gtggccgtgtggtggtggca

SEQ ID NO: 650517 - DNA, 20 bp, mouse
gccttcccggttagagtccc

SEQ ID NO: 650518 - DNA, 20 bp, mouse
gccgccaagggctgctccct

SEQ ID NO: 650519 - DNA, 20 bp, mouse
gcccgggcggagatggagtc

SEQ ID NO: 650520 - DNA, 20 bp, mouse
gcggggtgaaagcgaggcag

SEQ ID NO: 650521 - DNA, 20 bp, mouse
gcgccccagggccgaaggag

SEQ ID NO: 650522 - DNA, 20 bp, mouse
gaggaccgtaatccgcccca

SEQ ID NO: 650523 - DNA, 20 bp, mouse
gacggtcctcagtggggagt

SEQ ID NO: 650524 - DNA, 20 bp, mouse
ggggcagggaaagcccccgg

SEQ ID NO: 650525 - DNA, 20 bp, mouse
gaggcgccccgccccgccaa

SEQ ID NO: 650526 - DNA, 20 bp, mouse
gaagaatgggaagtcaagat

SEQ ID NO: 650527 - DNA, 20 bp, mouse
gggagcgcttaggtttgttt

SEQ ID NO: 650528 - DNA, 20 bp, mouse
gaatctggatggttcctgaa

SEQ ID NO: 650529 - DNA, 20 bp, mouse
gagtcccctaaggagcgctt

SEQ ID NO: 650530 - DNA, 20 bp, mouse
gtgcgccccgggcacagcgc

SEQ ID NO: 650531 - DNA, 20 bp, mouse
gaacctataaacccctaagg

SEQ ID NO: 650532 - DNA, 20 bp, mouse
gaatgggaagtcaagattgg

SEQ ID NO: 650533 - DNA, 20 bp, mouse
ggtcgtgggagagtccccta

SEQ ID NO: 650534 - DNA, 20 bp, mouse
ggtggggagcggcttggtgc

SEQ ID NO: 650535 - DNA, 20 bp, mouse
gtgtgcagaggggtgtaggg

SEQ ID NO: 650536 - DNA, 20 bp, mouse
gcaacgagatggctatggga

SEQ ID NO: 650537 - DNA, 20 bp, mouse
gacggggcggggcttaggag

SEQ ID NO: 650538 - DNA, 20 bp, mouse
gcggggcttaggagcggagg

SEQ ID NO: 650539 - DNA, 20 bp, mouse
gcaagggcacggggactagt

SEQ ID NO: 650540 - DNA, 20 bp, mouse
gggccagaagatgctctccg

SEQ ID NO: 650541 - DNA, 20 bp, mouse
ggcctggagtggagacgggg

SEQ ID NO: 650542 - DNA, 20 bp, mouse
gtggacgcagacccggacca

SEQ ID NO: 650543 - DNA, 20 bp, mouse
gcagtggcctggagtggaga

SEQ ID NO: 650544 - DNA, 20 bp, mouse
ggctccgccgcgctgcaggt

SEQ ID NO: 650545 - DNA, 20 bp, mouse
ggagatggctatgggatgga

SEQ ID NO: 650546 - DNA, 20 bp, mouse
gtacctgcccctgtggggaa

SEQ ID NO: 650547 - DNA, 20 bp, mouse
gcgaggaagctgaaaggagg

SEQ ID NO: 650548 - DNA, 20 bp, mouse
gctccagccgggaacagaga

SEQ ID NO: 650549 - DNA, 20 bp, mouse
gtcaaggagaactagggaca

SEQ ID NO: 650550 - DNA, 20 bp, mouse
gaggagaactagggacaagg

SEQ ID NO: 650551 - DNA, 20 bp, mouse
gggtgcctacctgcccctgt

SEQ ID NO: 650552 - DNA, 20 bp, mouse
gcctaccggtgacaagactt

SEQ ID NO: 650553 - DNA, 20 bp, mouse
ggcccgctggcgcccgagaa

SEQ ID NO: 650554 - DNA, 20 bp, mouse
gggaagtcatagaagtagga

SEQ ID NO: 650555 - DNA, 20 bp, mouse
gcacttgcgcaaatacacca

SEQ ID NO: 650556 - DNA, 20 bp, mouse
gcagaaagacgggggactta

SEQ ID NO: 650557 - DNA, 20 bp, mouse
gagggggcgggggcggaact

SEQ ID NO: 650558 - DNA, 20 bp, mouse
gggcctggaagtcgctggtg

SEQ ID NO: 650559 - DNA, 20 bp, mouse
gaactacagggggcgggctt

SEQ ID NO: 650560 - DNA, 20 bp, mouse
gcatccctcttggattcggt

SEQ ID NO: 650561 - DNA, 20 bp, mouse
gcgagcatccctcttggatt

SEQ ID NO: 650562 - DNA, 20 bp, mouse
ggctccaagcagaaagacgg

SEQ ID NO: 650563 - DNA, 20 bp, mouse
gctggaagtcgctggtgcgg

SEQ ID NO: 650564 - DNA, 20 bp, mouse
gggtggccgcaaaagactgc

SEQ ID NO: 650565 - DNA, 20 bp, mouse
gtgtggaggtccttgagagg

SEQ ID NO: 650566 - DNA, 20 bp, mouse
gtgggcatgcaagatgatgc

SEQ ID NO: 650567 - DNA, 20 bp, mouse
gcagactgggtgaccgtagt

SEQ ID NO: 650568 - DNA, 20 bp, mouse
ggcctcaagttcgaattctg

SEQ ID NO: 650569 - DNA, 20 bp, mouse
gtgagtaggccttaagcatc

SEQ ID NO: 650570 - DNA, 20 bp, mouse
ggtgtgcaccactaggcaga

SEQ ID NO: 650571 - DNA, 20 bp, mouse
gcagatggtcccgatgctta

SEQ ID NO: 650572 - DNA, 20 bp, mouse
gggcctgtagatctatctaa

SEQ ID NO: 650573 - DNA, 20 bp, mouse
gacggtcacccagtctggct

SEQ ID NO: 650574 - DNA, 20 bp, mouse
gcttgcatgcccagccagac

SEQ ID NO: 650575 - DNA, 20 bp, mouse
ggcacacgtttgatgcttga

SEQ ID NO: 650576 - DNA, 20 bp, mouse
ggggccaagcaagtcagagt

SEQ ID NO: 650577 - DNA, 20 bp, mouse
ggggcaggataatcttaacc

SEQ ID NO: 650578 - DNA, 20 bp, mouse
gaagcaagtcagagtgggaa

SEQ ID NO: 650579 - DNA, 20 bp, mouse
gcaaccactatgtcatcttc

SEQ ID NO: 650580 - DNA, 20 bp, mouse
gagaagcactgttcttgacc

SEQ ID NO: 650581 - DNA, 20 bp, mouse
gtgcccggaagatgacatag

SEQ ID NO: 650582 - DNA, 20 bp, mouse
gcttagaatctgagagtaca

SEQ ID NO: 650583 - DNA, 20 bp, mouse
gtgacatagtggttgcattt

SEQ ID NO: 650584 - DNA, 20 bp, mouse
gtgtctgttacagaccctcg

SEQ ID NO: 650585 - DNA, 20 bp, mouse
gtgcttggcccagcctttta

SEQ ID NO: 650586 - DNA, 20 bp, mouse
gcacgcgtgcgcagtgaagg

SEQ ID NO: 650587 - DNA, 20 bp, mouse
gtgaaggtggtgggcgaaga

SEQ ID NO: 650588 - DNA, 20 bp, mouse
gtcactgcgcacgcgtgctg

SEQ ID NO: 650589 - DNA, 20 bp, mouse
gaaccccaagcaaaagagga

SEQ ID NO: 650590 - DNA, 20 bp, mouse
ggggctggggacatcgcgct

SEQ ID NO: 650591 - DNA, 20 bp, mouse
ggagctaggcacgtactgct

SEQ ID NO: 650592 - DNA, 20 bp, mouse
gaggccgtgggaacgctccc

SEQ ID NO: 650593 - DNA, 20 bp, mouse
gcccctgggtccgccctgtt

SEQ ID NO: 650594 - DNA, 20 bp, mouse
gctgggcagaaccaggccgt

SEQ ID NO: 650595 - DNA, 20 bp, mouse
gtcccaacagggcggaccca

SEQ ID NO: 650596 - DNA, 20 bp, mouse
gcacacctcaccactttcat

SEQ ID NO: 650597 - DNA, 20 bp, mouse
ggcgaggaggcgggactcga

SEQ ID NO: 650598 - DNA, 20 bp, mouse
ggggactcgaaggtcaacta

SEQ ID NO: 650599 - DNA, 20 bp, mouse
gctcctcccggggagctcaa

SEQ ID NO: 650600 - DNA, 20 bp, mouse
gtggcctggggcgaggaggc

SEQ ID NO: 650601 - DNA, 20 bp, mouse
gtggtcaacctgggacggag

SEQ ID NO: 650602 - DNA, 20 bp, mouse
gggaggggtgggcatttcgt

SEQ ID NO: 650603 - DNA, 20 bp, mouse
gaggcctcgcaggttcccca

SEQ ID NO: 650604 - DNA, 20 bp, mouse
gccgtggtagcaaagcagca

SEQ ID NO: 650605 - DNA, 20 bp, mouse
ggtgccctggggaacctgcg

SEQ ID NO: 650606 - DNA, 20 bp, mouse
gcacccggcagcttccagcg

SEQ ID NO: 650607 - DNA, 20 bp, mouse
gcacaggaatagttgcgagg

SEQ ID NO: 650608 - DNA, 20 bp, mouse
gcctgaggataaggcttttc

SEQ ID NO: 650609 - DNA, 20 bp, mouse
gcctccgaaggccggctccg

SEQ ID NO: 650610 - DNA, 20 bp, mouse
gaggaatagttgcgaggcgg

SEQ ID NO: 650611 - DNA, 20 bp, mouse
gagacacaggaatagttgcg

SEQ ID NO: 650612 - DNA, 20 bp, mouse
gccggcagcttccagcgagg

SEQ ID NO: 650613 - DNA, 20 bp, mouse
gggctctcaaacgacaatgt

SEQ ID NO: 650614 - DNA, 20 bp, mouse
gcgtcctgctgggtaaaaat

SEQ ID NO: 650615 - DNA, 20 bp, mouse
gacccagcaggacgggaaat

SEQ ID NO: 650616 - DNA, 20 bp, mouse
ggacgcgtgcataaaggata

SEQ ID NO: 650617 - DNA, 20 bp, mouse
ggtaccgagtggttttcggt

SEQ ID NO: 650618 - DNA, 20 bp, mouse
ggggcgatacccacgacagg

SEQ ID NO: 650619 - DNA, 20 bp, mouse
gcccgaaaaaggtgaaagga

SEQ ID NO: 650620 - DNA, 20 bp, mouse
gaaaccccgaaaaaggtgaa

SEQ ID NO: 650621 - DNA, 20 bp, mouse
gggaagtgacgcgtgcataa

SEQ ID NO: 650622 - DNA, 20 bp, mouse
ggtggaaagccgcgctgctc

SEQ ID NO: 650623 - DNA, 20 bp, mouse
ggcccccaaatggaggtccc

SEQ ID NO: 650624 - DNA, 20 bp, mouse
ggaaaaggccccatgagggc

SEQ ID NO: 650625 - DNA, 20 bp, mouse
gggacgaaaaggccccatga

SEQ ID NO: 650626 - DNA, 20 bp, mouse
gcggagcggggtgcaggtgt

SEQ ID NO: 650627 - DNA, 20 bp, mouse
gcggtggcgtgcgcgtgggt

SEQ ID NO: 650628 - DNA, 20 bp, mouse
ggggcggcaggaggcagcgt

SEQ ID NO: 650629 - DNA, 20 bp, mouse
gagcggggtgcaggtgtggg

SEQ ID NO: 650630 - DNA, 20 bp, mouse
gtcctcgcagccctcggccc

SEQ ID NO: 650631 - DNA, 20 bp, mouse
gaggagccagccgaaagggg

SEQ ID NO: 650632 - DNA, 20 bp, mouse
gtcctggcggagcggggtgc

SEQ ID NO: 650633 - DNA, 20 bp, mouse
gtgcctcctgccgcccgcgg

SEQ ID NO: 650634 - DNA, 20 bp, mouse
gcagcgcgcggtgatgtcag

SEQ ID NO: 650635 - DNA, 20 bp, mouse
gcgccaggagccagccgaaa

SEQ ID NO: 650636 - DNA, 20 bp, mouse
gtgactgggcgggaaggtca

SEQ ID NO: 650637 - DNA, 20 bp, mouse
gttcccccaaacaactagaa

SEQ ID NO: 650638 - DNA, 20 bp, mouse
gtgctctgatggtagtatga

SEQ ID NO: 650639 - DNA, 20 bp, mouse
ggtcagggacgtcaaagcga

SEQ ID NO: 650640 - DNA, 20 bp, mouse
gaactgtgctcgttccttgt

SEQ ID NO: 650641 - DNA, 20 bp, mouse
gccagtcagaacctgagcgc

SEQ ID NO: 650642 - DNA, 20 bp, mouse
gtccgcggttaccatggcga

SEQ ID NO: 650643 - DNA, 20 bp, mouse
ggcaaacgaggagaccaaca

SEQ ID NO: 650644 - DNA, 20 bp, mouse
gctcagggcccaggcttccg

SEQ ID NO: 650645 - DNA, 20 bp, mouse
gccaaaacagctcttagggt

SEQ ID NO: 650646 - DNA, 20 bp, mouse
gaggcgggaggctctcatgg

SEQ ID NO: 650647 - DNA, 20 bp, mouse
gacagaggtggagctcgcga

SEQ ID NO: 650648 - DNA, 20 bp, mouse
gggaggctctcatggcggtt

SEQ ID NO: 650649 - DNA, 20 bp, mouse
gtgcaggcgggaggctctca

SEQ ID NO: 650650 - DNA, 20 bp, mouse
gggggcgcggacgaccacag

SEQ ID NO: 650651 - DNA, 20 bp, mouse
gtctacttagttgagggaat

SEQ ID NO: 650652 - DNA, 20 bp, mouse
ggggtgaatgtgcgcgatgc

SEQ ID NO: 650653 - DNA, 20 bp, mouse
gggagctcgcgagggcagag

SEQ ID NO: 650654 - DNA, 20 bp, mouse
gccgcctgtcgccgctggag

SEQ ID NO: 650655 - DNA, 20 bp, mouse
gccctacagggtcatctggt

SEQ ID NO: 650656 - DNA, 20 bp, mouse
ggacttgtcagagtcgacca

SEQ ID NO: 650657 - DNA, 20 bp, mouse
ggctctcccgcgcctaattc

SEQ ID NO: 650658 - DNA, 20 bp, mouse
gtctgggagcggttttcttg

SEQ ID NO: 650659 - DNA, 20 bp, mouse
gcacccgcgggactccgagg

SEQ ID NO: 650660 - DNA, 20 bp, mouse
gcgaaggggcgaacccggaa

SEQ ID NO: 650661 - DNA, 20 bp, mouse
gcgagtgcgtggggccgtta

SEQ ID NO: 650662 - DNA, 20 bp, mouse
gagaaacctgaattaggcgc

SEQ ID NO: 650663 - DNA, 20 bp, mouse
gagcagcgaaggggcgaacc

SEQ ID NO: 650664 - DNA, 20 bp, mouse
gtgtgatgtcacgtcatcaa

SEQ ID NO: 650665 - DNA, 20 bp, mouse
gagtccgcctcggagtcccg

SEQ ID NO: 650666 - DNA, 20 bp, mouse
gcgggacgtgacctatagga

SEQ ID NO: 650667 - DNA, 20 bp, mouse
ggggaggggcggggtctatg

SEQ ID NO: 650668 - DNA, 20 bp, mouse
ggaggggcgtggtccttgag

SEQ ID NO: 650669 - DNA, 20 bp, mouse
gaggaccacgcccctcctat

SEQ ID NO: 650670 - DNA, 20 bp, mouse
gaggactggctgggcagatg

SEQ ID NO: 650671 - DNA, 20 bp, mouse
ggggcctgagaggactggct

SEQ ID NO: 650672 - DNA, 20 bp, mouse
gggcgtggcctgtgtgggga

SEQ ID NO: 650673 - DNA, 20 bp, mouse
gtgaagcgggtgactcagtg

SEQ ID NO: 650674 - DNA, 20 bp, mouse
gtatgcgggacgtgacctat

SEQ ID NO: 650675 - DNA, 20 bp, mouse
ggccacgaagccgagattgg

SEQ ID NO: 650676 - DNA, 20 bp, mouse
gggcccgaggggtctctcgc

SEQ ID NO: 650677 - DNA, 20 bp, mouse
gaacccgcgcgcggggtagg

SEQ ID NO: 650678 - DNA, 20 bp, mouse
gccctcgccccgcgccagga

SEQ ID NO: 650679 - DNA, 20 bp, mouse
gagacccgactccgtgccat

SEQ ID NO: 650680 - DNA, 20 bp, mouse
gccccgcgccaggacggcca

SEQ ID NO: 650681 - DNA, 20 bp, mouse
ggccctggccgtcctggcgc

SEQ ID NO: 650682 - DNA, 20 bp, mouse
gcggaacccgcgcgcggggt

SEQ ID NO: 650683 - DNA, 20 bp, mouse
gaggcccatggcacggagtc

SEQ ID NO: 650684 - DNA, 20 bp, mouse
gcgggccgccctggccgtcc

SEQ ID NO: 650685 - DNA, 20 bp, mouse
ggggtgctcgctgtccgcgc

SEQ ID NO: 650686 - DNA, 20 bp, mouse
gggaaggatagagagttcca

SEQ ID NO: 650687 - DNA, 20 bp, mouse
gcagcagcataatggagaac

SEQ ID NO: 650688 - DNA, 20 bp, mouse
gccactctgcttcttttcct

SEQ ID NO: 650689 - DNA, 20 bp, mouse
ggagaacaggtacgtcacac

SEQ ID NO: 650690 - DNA, 20 bp, mouse
gtgtgtcctgggaaaaccga

SEQ ID NO: 650691 - DNA, 20 bp, mouse
gtggaggatatgtgtgtcct

SEQ ID NO: 650692 - DNA, 20 bp, mouse
gcctccaaaagcacagggca

SEQ ID NO: 650693 - DNA, 20 bp, mouse
gttgcctcctagtgtctact

SEQ ID NO: 650694 - DNA, 20 bp, mouse
gttagtatgtggaattgcag

SEQ ID NO: 650695 - DNA, 20 bp, mouse
gtcttttcctgggaaacgga

SEQ ID NO: 650696 - DNA, 20 bp, mouse
ggtaaggaaggcagactaca

SEQ ID NO: 650697 - DNA, 20 bp, mouse
gacagccaatcaggtaagga

SEQ ID NO: 650698 - DNA, 20 bp, mouse
gcttcacagcacagccaatc

SEQ ID NO: 650699 - DNA, 20 bp, mouse
gtcggaccgcgccagagcaa

SEQ ID NO: 650700 - DNA, 20 bp, mouse
gcaaggcgaacactggtttt

SEQ ID NO: 650701 - DNA, 20 bp, mouse
gcagactacaaggcgaacac

SEQ ID NO: 650702 - DNA, 20 bp, mouse
gcgcccgcactctgttgctg

SEQ ID NO: 650703 - DNA, 20 bp, mouse
gatagctccggaaagacgaa

SEQ ID NO: 650704 - DNA, 20 bp, mouse
gttagccaatcaaggtaaga

SEQ ID NO: 650705 - DNA, 20 bp, mouse
gtggttttcggtagtatgac

SEQ ID NO: 650706 - DNA, 20 bp, mouse
gcgtgctggctgtttgttct

SEQ ID NO: 650707 - DNA, 20 bp, mouse
gtcagagagactttgagggt

SEQ ID NO: 650708 - DNA, 20 bp, mouse
gacaggaggaggtcactgca

SEQ ID NO: 650709 - DNA, 20 bp, mouse
gtagttatgcactgctgctg

SEQ ID NO: 650710 - DNA, 20 bp, mouse
gtggagtgagaactgcattt

SEQ ID NO: 650711 - DNA, 20 bp, mouse
gcagtgcataactactcagc

SEQ ID NO: 650712 - DNA, 20 bp, mouse
gaactactcagcagggcacg

SEQ ID NO: 650713 - DNA, 20 bp, mouse
gaggatgtaaatattgtagc

SEQ ID NO: 650714 - DNA, 20 bp, mouse
gaagtctctctgacaggagg

SEQ ID NO: 650715 - DNA, 20 bp, mouse
gagcacgcagtctgcgctgg

SEQ ID NO: 650716 - DNA, 20 bp, mouse
gcctccgggatgtgcggttc

SEQ ID NO: 650717 - DNA, 20 bp, mouse
ggggctacagcgccccgcag

SEQ ID NO: 650718 - DNA, 20 bp, mouse
ggtgtcctcccgctgctcgt

SEQ ID NO: 650719 - DNA, 20 bp, mouse
ggggtggggcgtggcccgag

SEQ ID NO: 650720 - DNA, 20 bp, mouse
gcccgcacctccgggatgtg

SEQ ID NO: 650721 - DNA, 20 bp, mouse
ggggcgtggcgtggagtatg

SEQ ID NO: 650722 - DNA, 20 bp, mouse
ggggacccacgagcagcggg

SEQ ID NO: 650723 - DNA, 20 bp, mouse
ggggaggacacccgcgctga

SEQ ID NO: 650724 - DNA, 20 bp, mouse
ggtgcggggtggctcccact

SEQ ID NO: 650725 - DNA, 20 bp, mouse
gccccacccggctgtccgca

SEQ ID NO: 650726 - DNA, 20 bp, mouse
gaggctggcgaggaccgcgg

SEQ ID NO: 650727 - DNA, 20 bp, mouse
gctggcgaggaccgcggagg

SEQ ID NO: 650728 - DNA, 20 bp, mouse
gtcccgggggccccaggcgg

SEQ ID NO: 650729 - DNA, 20 bp, mouse
gggcgcccctctcctgtccc

SEQ ID NO: 650730 - DNA, 20 bp, mouse
gggggcccccgggacaggag

SEQ ID NO: 650731 - DNA, 20 bp, mouse
gcgggggcggcgatgacgcg

SEQ ID NO: 650732 - DNA, 20 bp, mouse
gatgacgcgggccatgcgga

SEQ ID NO: 650733 - DNA, 20 bp, mouse
ggagcagtctccggaagcgc

SEQ ID NO: 650734 - DNA, 20 bp, mouse
gagacaagaggttccccaca

SEQ ID NO: 650735 - DNA, 20 bp, mouse
gcgtccgccgaaacggcagg

SEQ ID NO: 650736 - DNA, 20 bp, mouse
gaatgagggaacaaaatctc

SEQ ID NO: 650737 - DNA, 20 bp, mouse
gctcaagtgctcattcttgg

SEQ ID NO: 650738 - DNA, 20 bp, mouse
gttaccctggccagctcact

SEQ ID NO: 650739 - DNA, 20 bp, mouse
gggctggctccagtataaca

SEQ ID NO: 650740 - DNA, 20 bp, mouse
ggcatggcgagcgaggtcag

SEQ ID NO: 650741 - DNA, 20 bp, mouse
gacaccaaactggcacctta

SEQ ID NO: 650742 - DNA, 20 bp, mouse
gcactgaatccatgttatac

SEQ ID NO: 650743 - DNA, 20 bp, mouse
gaggaccaagtgagctggcc

SEQ ID NO: 650744 - DNA, 20 bp, mouse
gcccactgtgtagatcgtca

SEQ ID NO: 650745 - DNA, 20 bp, mouse
gtagccataaggtgccagtt

SEQ ID NO: 650746 - DNA, 20 bp, mouse
ggaagcagactgcaccttcg

SEQ ID NO: 650747 - DNA, 20 bp, mouse
gtgcaccttcggggcagaga

SEQ ID NO: 650748 - DNA, 20 bp, mouse
gtcaggggtctccatggcaa

SEQ ID NO: 650749 - DNA, 20 bp, mouse
gaagccaggtatctaggcgt

SEQ ID NO: 650750 - DNA, 20 bp, mouse
gaccgccgccgcattcccag

SEQ ID NO: 650751 - DNA, 20 bp, mouse
gtcgtggcccacgaaggggt

SEQ ID NO: 650752 - DNA, 20 bp, mouse
gtcccctgggaatgcggcgg

SEQ ID NO: 650753 - DNA, 20 bp, mouse
gcattcccaggggagcgcgg

SEQ ID NO: 650754 - DNA, 20 bp, mouse
ggggccacatgcacccggcg

SEQ ID NO: 650755 - DNA, 20 bp, mouse
gctgacccccaccccttcgt

SEQ ID NO: 650756 - DNA, 20 bp, mouse
ggggcctcagagataggcag

SEQ ID NO: 650757 - DNA, 20 bp, mouse
gggcccttcacacagttgtt

SEQ ID NO: 650758 - DNA, 20 bp, mouse
gtctcccaacaactgtgtga

SEQ ID NO: 650759 - DNA, 20 bp, mouse
gtctctgaggcccagcccac

SEQ ID NO: 650760 - DNA, 20 bp, mouse
gtgtagatgctacttcccaa

SEQ ID NO: 650761 - DNA, 20 bp, mouse
gtgaacttgtgagatccagt

SEQ ID NO: 650762 - DNA, 20 bp, mouse
ggaacagcagcccttccaag

SEQ ID NO: 650763 - DNA, 20 bp, mouse
ggctccagctatccaaagga

SEQ ID NO: 650764 - DNA, 20 bp, mouse
ggacggagactgtccaacaa

SEQ ID NO: 650765 - DNA, 20 bp, mouse
gttgtgagatccagtgggct

SEQ ID NO: 650766 - DNA, 20 bp, mouse
gcaacacttgctgagagcta

SEQ ID NO: 650767 - DNA, 20 bp, mouse
ggctgtacccacagcatctc

SEQ ID NO: 650768 - DNA, 20 bp, mouse
gtcactgatgcaggaaccta

SEQ ID NO: 650769 - DNA, 20 bp, mouse
ggccatcagtagttttgagt

SEQ ID NO: 650770 - DNA, 20 bp, mouse
gacctagggagcactaacta

SEQ ID NO: 650771 - DNA, 20 bp, mouse
gaaaagcaagtcactgatgc

SEQ ID NO: 650772 - DNA, 20 bp, mouse
gctaggggtgaaaagttaag

SEQ ID NO: 650773 - DNA, 20 bp, mouse
gatgaagggaactctgaaag

SEQ ID NO: 650774 - DNA, 20 bp, mouse
ggataattctgggtaagatg

SEQ ID NO: 650775 - DNA, 20 bp, mouse
gaaaccatactgaaagatga

SEQ ID NO: 650776 - DNA, 20 bp, mouse
gtacagggaaaggtggacaa

SEQ ID NO: 650777 - DNA, 20 bp, mouse
gaaatgggctatacactaat

SEQ ID NO: 650778 - DNA, 20 bp, mouse
gactgagctcaatgtatcta

SEQ ID NO: 650779 - DNA, 20 bp, mouse
gaacggcaagattgtgtatg

SEQ ID NO: 650780 - DNA, 20 bp, mouse
ggctaactggatcacaatca

SEQ ID NO: 650781 - DNA, 20 bp, mouse
gcaatgtgggttgaagaagg

SEQ ID NO: 650782 - DNA, 20 bp, mouse
gagttaaggtggaacatgag

SEQ ID NO: 650783 - DNA, 20 bp, mouse
gacacagagcatacagggaa

SEQ ID NO: 650784 - DNA, 20 bp, mouse
ggcaagcggagacaacacca

SEQ ID NO: 650785 - DNA, 20 bp, mouse
gcgatttcatccatccttga

SEQ ID NO: 650786 - DNA, 20 bp, mouse
gggcccccgccgctacccat

SEQ ID NO: 650787 - DNA, 20 bp, mouse
gaaacttgagggccccgagg

SEQ ID NO: 650788 - DNA, 20 bp, mouse
gagggacccgcggaaaactt

SEQ ID NO: 650789 - DNA, 20 bp, mouse
ggtgcagcgcgacgaccaat

SEQ ID NO: 650790 - DNA, 20 bp, mouse
gagggggcgggactctcaga

SEQ ID NO: 650791 - DNA, 20 bp, mouse
gtgagggccccgaggtggcg

SEQ ID NO: 650792 - DNA, 20 bp, mouse
gaaaacttcggagaaacttg

SEQ ID NO: 650793 - DNA, 20 bp, mouse
gcgcgacgaccaatgggtag

SEQ ID NO: 650794 - DNA, 20 bp, mouse
ggaccaatgggtagcggcgg

SEQ ID NO: 650795 - DNA, 20 bp, mouse
gaggcggggcgagtcccggc

SEQ ID NO: 650796 - DNA, 20 bp, mouse
gcgagccccgcccactaggt

SEQ ID NO: 650797 - DNA, 20 bp, mouse
ggcccccttgcccacctagt

SEQ ID NO: 650798 - DNA, 20 bp, mouse
ggacccgcccattcgccagg

SEQ ID NO: 650799 - DNA, 20 bp, mouse
gggaggggagcctcggtgtg

SEQ ID NO: 650800 - DNA, 20 bp, mouse
gccgcccactaggtgggcaa

SEQ ID NO: 650801 - DNA, 20 bp, mouse
ggcgccgagccccgcccact

SEQ ID NO: 650802 - DNA, 20 bp, mouse
ggggctcggcgccgccgtgc

SEQ ID NO: 650803 - DNA, 20 bp, mouse
ggacgcgtgacgccggatcc

SEQ ID NO: 650804 - DNA, 20 bp, mouse
gtgcaggtgagcccgcttgg

SEQ ID NO: 650805 - DNA, 20 bp, mouse
gggtgagcccgcttggcgga

SEQ ID NO: 650806 - DNA, 20 bp, mouse
ggagctcaaggagcgctctg

SEQ ID NO: 650807 - DNA, 20 bp, mouse
gcgtcctccccagagctaga

SEQ ID NO: 650808 - DNA, 20 bp, mouse
gcgctctgaggctgatgagg

SEQ ID NO: 650809 - DNA, 20 bp, mouse
gcccgccgggcgcggaaccc

SEQ ID NO: 650810 - DNA, 20 bp, mouse
gcgggctcggggcttacacg

SEQ ID NO: 650811 - DNA, 20 bp, mouse
ggagcgctctgaggctgatg

SEQ ID NO: 650812 - DNA, 20 bp, mouse
gccaccctataaggatgccc

SEQ ID NO: 650813 - DNA, 20 bp, mouse
gggtggggtgcgagcgggtg

SEQ ID NO: 650814 - DNA, 20 bp, mouse
gcccgggcgctgccgaggaa

SEQ ID NO: 650815 - DNA, 20 bp, mouse
gcccgcgggaaggaggcctc

SEQ ID NO: 650816 - DNA, 20 bp, mouse
gcgctcgggagccaatcctg

SEQ ID NO: 650817 - DNA, 20 bp, mouse
ggataccggcccattcgctc

SEQ ID NO: 650818 - DNA, 20 bp, mouse
gccggtatctgccatctcat

SEQ ID NO: 650819 - DNA, 20 bp, mouse
gcggagcggctgaggcaagt

SEQ ID NO: 650820 - DNA, 20 bp, mouse
ggcacggcgcagagcatccc

SEQ ID NO: 650821 - DNA, 20 bp, mouse
ggacccacccatcgtcgcgt

SEQ ID NO: 650822 - DNA, 20 bp, mouse
gtgagtacggccacccacgg

SEQ ID NO: 650823 - DNA, 20 bp, mouse
gggctcccgagcgaatgggc

SEQ ID NO: 650824 - DNA, 20 bp, mouse
ggacaaggcaagtgggcggg

SEQ ID NO: 650825 - DNA, 20 bp, mouse
gcgtgctagagccgagggga

SEQ ID NO: 650826 - DNA, 20 bp, mouse
gcacacctgtcaggcctcag

SEQ ID NO: 650827 - DNA, 20 bp, mouse
gtggacttgggcctttcctt

SEQ ID NO: 650828 - DNA, 20 bp, mouse
gccaggattgcaggtcttcc

SEQ ID NO: 650829 - DNA, 20 bp, mouse
gtgccatggttggtccccaa

SEQ ID NO: 650830 - DNA, 20 bp, mouse
ggacaggtgtgtcatgagtg

SEQ ID NO: 650831 - DNA, 20 bp, mouse
ggcaaggccggagtgaactt

SEQ ID NO: 650832 - DNA, 20 bp, mouse
gagggctggttaatcagtga

SEQ ID NO: 650833 - DNA, 20 bp, mouse
gggcccaagtccaggattgc

SEQ ID NO: 650834 - DNA, 20 bp, mouse
gactgattaaccagccctgt

SEQ ID NO: 650835 - DNA, 20 bp, mouse
ggattgcaggtcttcctggc

SEQ ID NO: 650836 - DNA, 20 bp, mouse
gtgaaatgcgggccggtctg

SEQ ID NO: 650837 - DNA, 20 bp, mouse
ggggctgctccggcaaacga

SEQ ID NO: 650838 - DNA, 20 bp, mouse
ggcgctccctaaacagtcgc

SEQ ID NO: 650839 - DNA, 20 bp, mouse
ggggagcgctagtgaaatgc

SEQ ID NO: 650840 - DNA, 20 bp, mouse
gggcccgcctcccgccttgg

SEQ ID NO: 650841 - DNA, 20 bp, mouse
gcgcctcccgccttggaggg

SEQ ID NO: 650842 - DNA, 20 bp, mouse
gggattcagtaggaacgaac

SEQ ID NO: 650843 - DNA, 20 bp, mouse
gcccagaggtcggattcagt

SEQ ID NO: 650844 - DNA, 20 bp, mouse
gcctccggggtcgcgcctga

SEQ ID NO: 650845 - DNA, 20 bp, mouse
gtacccatcaggcgcgaccc

SEQ ID NO: 650846 - DNA, 20 bp, mouse
gacagtgaatgacagacgga

SEQ ID NO: 650847 - DNA, 20 bp, mouse
gggtgacagtgaatgacaga

SEQ ID NO: 650848 - DNA, 20 bp, mouse
gtctggccaatgaaaaaagt

SEQ ID NO: 650849 - DNA, 20 bp, mouse
gcgcaggaaccgggatccag

SEQ ID NO: 650850 - DNA, 20 bp, mouse
ggccttccgtcctgccccct

SEQ ID NO: 650851 - DNA, 20 bp, mouse
gaaagtgggtggagacatgg

SEQ ID NO: 650852 - DNA, 20 bp, mouse
ggtggccaattcttagccca

SEQ ID NO: 650853 - DNA, 20 bp, mouse
ggtgtgctctacgtgatgag

SEQ ID NO: 650854 - DNA, 20 bp, mouse
gcaggacggaaggctgaagg

SEQ ID NO: 650855 - DNA, 20 bp, mouse
gctggggccgggcgaccctg

SEQ ID NO: 650856 - DNA, 20 bp, mouse
ggatgcggccaagttgggac

SEQ ID NO: 650857 - DNA, 20 bp, mouse
gtgacctagctcaggggcgg

SEQ ID NO: 650858 - DNA, 20 bp, mouse
gtgagctaggtcacgtgatg

SEQ ID NO: 650859 - DNA, 20 bp, mouse
gcgcgcatgcgtgtcgtccg

SEQ ID NO: 650860 - DNA, 20 bp, mouse
gagaaccgtctccacccaag

SEQ ID NO: 650861 - DNA, 20 bp, mouse
gcacgtgatgcggccaagtt

SEQ ID NO: 650862 - DNA, 20 bp, mouse
gcaaacaaagaactagtcac

SEQ ID NO: 650863 - DNA, 20 bp, mouse
gacgtgacctagctcagggg

SEQ ID NO: 650864 - DNA, 20 bp, mouse
ggacccgctacggcgtgcgt

SEQ ID NO: 650865 - DNA, 20 bp, mouse
gctctccctaggcagttcaa

SEQ ID NO: 650866 - DNA, 20 bp, mouse
gacccccggggcggagaact

SEQ ID NO: 650867 - DNA, 20 bp, mouse
ggagcagccttggacagggg

SEQ ID NO: 650868 - DNA, 20 bp, mouse
ggcagtggggggcgggaaca

SEQ ID NO: 650869 - DNA, 20 bp, mouse
gctggggccaagctagagtt

SEQ ID NO: 650870 - DNA, 20 bp, mouse
gtgtgagcctcccctgtcca

SEQ ID NO: 650871 - DNA, 20 bp, mouse
gggcacctcccatgcagtgg

SEQ ID NO: 650872 - DNA, 20 bp, mouse
gggtcctgcgggttagaggc

SEQ ID NO: 650873 - DNA, 20 bp, mouse
gccgccccccactgcatggg

SEQ ID NO: 650874 - DNA, 20 bp, mouse
gcaggggaggctcacagggt

SEQ ID NO: 650875 - DNA, 20 bp, mouse
gggtgaccccgtgacccccg

SEQ ID NO: 650876 - DNA, 20 bp, mouse
gtgtcagagtgaagcttcac

SEQ ID NO: 650877 - DNA, 20 bp, mouse
gggaaggggcggggccatga

SEQ ID NO: 650878 - DNA, 20 bp, mouse
ggggcgggatcaccgtgaaa

SEQ ID NO: 650879 - DNA, 20 bp, mouse
gtgtaagtcccgaggaaggg

SEQ ID NO: 650880 - DNA, 20 bp, mouse
ggggtggggccgcgacggaa

SEQ ID NO: 650881 - DNA, 20 bp, mouse
gtgaccctcgggagaggggt

SEQ ID NO: 650882 - DNA, 20 bp, mouse
gcggccccacccctctcccg

SEQ ID NO: 650883 - DNA, 20 bp, mouse
gtggctgaccctcgggagag

SEQ ID NO: 650884 - DNA, 20 bp, mouse
ggggccgcgacggaaggggc

SEQ ID NO: 650885 - DNA, 20 bp, mouse
gcggctgtcactcggcgtgg

SEQ ID NO: 650886 - DNA, 20 bp, mouse
gacacgctggggtcatgcat

SEQ ID NO: 650887 - DNA, 20 bp, mouse
gcatgaccccagcgtgtctc

SEQ ID NO: 650888 - DNA, 20 bp, mouse
gcagggaactgcccagggag

SEQ ID NO: 650889 - DNA, 20 bp, mouse
gcgtgcccgcccctcgccag

SEQ ID NO: 650890 - DNA, 20 bp, mouse
ggggctagtctctgcgaagg

SEQ ID NO: 650891 - DNA, 20 bp, mouse
gggagcgcagggaactgccc

SEQ ID NO: 650892 - DNA, 20 bp, mouse
gactagcccaacttccagaa

SEQ ID NO: 650893 - DNA, 20 bp, mouse
gaggaggcttcgctggggac

SEQ ID NO: 650894 - DNA, 20 bp, mouse
gtctgcgaaggaggagcgca

SEQ ID NO: 650895 - DNA, 20 bp, mouse
gaggctcctgagtggagtgg

SEQ ID NO: 650896 - DNA, 20 bp, mouse
gtgagggtgggtgttgtaag

SEQ ID NO: 650897 - DNA, 20 bp, mouse
gtgggagggcagtccgtggc

SEQ ID NO: 650898 - DNA, 20 bp, mouse
gcgtggccggctcccctcag

SEQ ID NO: 650899 - DNA, 20 bp, mouse
gaacgtgggagggcagtccg

SEQ ID NO: 650900 - DNA, 20 bp, mouse
ggtgcctgggtttgataagg

SEQ ID NO: 650901 - DNA, 20 bp, mouse
gtttctcagtgctgcagtga

SEQ ID NO: 650902 - DNA, 20 bp, mouse
gtgagaaacagccgggatgt

SEQ ID NO: 650903 - DNA, 20 bp, mouse
gctcatcgtcatagcaacgt

SEQ ID NO: 650904 - DNA, 20 bp, mouse
gtgcagcactgagaaacagc

SEQ ID NO: 650905 - DNA, 20 bp, mouse
ggtaaggggtttggtgcacg

SEQ ID NO: 650906 - DNA, 20 bp, mouse
gtgacaacagccccctggtt

SEQ ID NO: 650907 - DNA, 20 bp, mouse
gagcaagcaaatagagactg

SEQ ID NO: 650908 - DNA, 20 bp, mouse
ggccgcccctgcacccggtg

SEQ ID NO: 650909 - DNA, 20 bp, mouse
ggcaggggcggcatggggta

SEQ ID NO: 650910 - DNA, 20 bp, mouse
gtccccaccgggtgcagggg

SEQ ID NO: 650911 - DNA, 20 bp, mouse
gaacagaagtttggcaggat

SEQ ID NO: 650912 - DNA, 20 bp, mouse
gagtggcccacataactact

SEQ ID NO: 650913 - DNA, 20 bp, mouse
gcctgccaaacttctgttgc

SEQ ID NO: 650914 - DNA, 20 bp, mouse
gccaagactcacgtccactc

SEQ ID NO: 650915 - DNA, 20 bp, mouse
gcctgccagcaacagaagtt

SEQ ID NO: 650916 - DNA, 20 bp, mouse
gcggaaccgccaggagtctt

SEQ ID NO: 650917 - DNA, 20 bp, mouse
gggagaggaaatccagtcag

SEQ ID NO: 650918 - DNA, 20 bp, mouse
ggctcagggcgcctcgtcct

SEQ ID NO: 650919 - DNA, 20 bp, mouse
ggccctgagccgaagactcc

SEQ ID NO: 650920 - DNA, 20 bp, mouse
ggcccaggagcctgagaaga

SEQ ID NO: 650921 - DNA, 20 bp, mouse
gagtcaggccaagtaccacc

SEQ ID NO: 650922 - DNA, 20 bp, mouse
ggagcagcactatcactcaa

SEQ ID NO: 650923 - DNA, 20 bp, mouse
gcccgggaggcgccatgacc

SEQ ID NO: 650924 - DNA, 20 bp, mouse
gcgccaggagtcttcggctc

SEQ ID NO: 650925 - DNA, 20 bp, mouse
gttggctcctcacccgtcca

SEQ ID NO: 650926 - DNA, 20 bp, mouse
ggggagcgctgcagccgcag

SEQ ID NO: 650927 - DNA, 20 bp, mouse
gcggctgcagcgctccccgc

SEQ ID NO: 650928 - DNA, 20 bp, mouse
gtctcccggagaccgtcact

SEQ ID NO: 650929 - DNA, 20 bp, mouse
ggccccagatcaaaccgccc

SEQ ID NO: 650930 - DNA, 20 bp, mouse
gctcgtgagctcatagaagc

SEQ ID NO: 650931 - DNA, 20 bp, mouse
gagaagccggcctgcctctg

SEQ ID NO: 650932 - DNA, 20 bp, mouse
gagccggggcggtttgatct

SEQ ID NO: 650933 - DNA, 20 bp, mouse
gggagcggcggcgtccctct

SEQ ID NO: 650934 - DNA, 20 bp, mouse
gcaaggtgcccgcttagtgt

SEQ ID NO: 650935 - DNA, 20 bp, mouse
ggcagcgctccccgcaggcg

SEQ ID NO: 650936 - DNA, 20 bp, mouse
ggaagcccggcctgctgcca

SEQ ID NO: 650937 - DNA, 20 bp, mouse
gtaaacaaatagggtacctg

SEQ ID NO: 650938 - DNA, 20 bp, mouse
gacctgacaggggataccta

SEQ ID NO: 650939 - DNA, 20 bp, mouse
gtgggggtgaagcttcatgg

SEQ ID NO: 650940 - DNA, 20 bp, mouse
gcagggagatggtggttata

SEQ ID NO: 650941 - DNA, 20 bp, mouse
ggcaggccgggcttccataa

SEQ ID NO: 650942 - DNA, 20 bp, mouse
gtaaacagggccacctgaca

SEQ ID NO: 650943 - DNA, 20 bp, mouse
gcttccataagggaagtcca

SEQ ID NO: 650944 - DNA, 20 bp, mouse
ggcacctcgaatttgcatgt

SEQ ID NO: 650945 - DNA, 20 bp, mouse
gttgcatgtagggtgtgtga

SEQ ID NO: 650946 - DNA, 20 bp, mouse
gcggaagcagagatgaggcg

SEQ ID NO: 650947 - DNA, 20 bp, mouse
gaagcacggtagatccaagt

SEQ ID NO: 650948 - DNA, 20 bp, mouse
ggggtgcgagagggaggacc

SEQ ID NO: 650949 - DNA, 20 bp, mouse
gaaaacactcgggcggggac

SEQ ID NO: 650950 - DNA, 20 bp, mouse
gcacggtagatccaagtggg

SEQ ID NO: 650951 - DNA, 20 bp, mouse
ggatgggtaaacagactgaa

SEQ ID NO: 650952 - DNA, 20 bp, mouse
ggtagtaataagggttgtgt

SEQ ID NO: 650953 - DNA, 20 bp, mouse
gagcaagtggagcgcaggga

SEQ ID NO: 650954 - DNA, 20 bp, mouse
gtaaacagactgaagggctg

SEQ ID NO: 650955 - DNA, 20 bp, mouse
gtccaagtgggcgggcaaga

SEQ ID NO: 650956 - DNA, 20 bp, mouse
ggggtggcgggacactggaa

SEQ ID NO: 650957 - DNA, 20 bp, mouse
gcccaacaccttcttctcaa

SEQ ID NO: 650958 - DNA, 20 bp, mouse
gggactctaccttgcagcca

SEQ ID NO: 650959 - DNA, 20 bp, mouse
gtgttggggtggcgggacac

SEQ ID NO: 650960 - DNA, 20 bp, mouse
ggtaaggtggagccctctcc

SEQ ID NO: 650961 - DNA, 20 bp, mouse
gaccccgcttcgagagaaaa

SEQ ID NO: 650962 - DNA, 20 bp, mouse
gtaggcggggcaaatccaca

SEQ ID NO: 650963 - DNA, 20 bp, mouse
gcccggcttcaggacatcac

SEQ ID NO: 650964 - DNA, 20 bp, mouse
gtcgagagaaaatggcgaca

SEQ ID NO: 650965 - DNA, 20 bp, mouse
gacccttgagaagaaggtgt

SEQ ID NO: 650966 - DNA, 20 bp, mouse
ggcggggggcagggtccaat

SEQ ID NO: 650967 - DNA, 20 bp, mouse
gcctccctggcccgctgcgc

SEQ ID NO: 650968 - DNA, 20 bp, mouse
gccccagcgcgcaaccacca

SEQ ID NO: 650969 - DNA, 20 bp, mouse
ggtgcagccgcgctcctctt

SEQ ID NO: 650970 - DNA, 20 bp, mouse
gggcggccccggtatctaaa

SEQ ID NO: 650971 - DNA, 20 bp, mouse
gcagccgcgctcctcttcgg

SEQ ID NO: 650972 - DNA, 20 bp, mouse
ggccgtagaggcgggacctg

SEQ ID NO: 650973 - DNA, 20 bp, mouse
gcgccagccaatagtggtgg

SEQ ID NO: 650974 - DNA, 20 bp, mouse
gctccggcaccacagccaaa

SEQ ID NO: 650975 - DNA, 20 bp, mouse
gcaggtgcgtggacacggga

SEQ ID NO: 650976 - DNA, 20 bp, mouse
gtggccctcgggtcgcacgt

SEQ ID NO: 650977 - DNA, 20 bp, mouse
ggaggcgcgcgcgacccggg

SEQ ID NO: 650978 - DNA, 20 bp, mouse
gcagcccacgtgcgacccga

SEQ ID NO: 650979 - DNA, 20 bp, mouse
gggcacccgcgctctcctgg

SEQ ID NO: 650980 - DNA, 20 bp, mouse
gggggcgggggtcccggcac

SEQ ID NO: 650981 - DNA, 20 bp, mouse
ggagagcgcgggtgccggtg

SEQ ID NO: 650982 - DNA, 20 bp, mouse
gcagcctcgcgccttcttcc

SEQ ID NO: 650983 - DNA, 20 bp, mouse
gcgaaggctcaggcgaaatt

SEQ ID NO: 650984 - DNA, 20 bp, mouse
ggacttgggaggcgcacgga

SEQ ID NO: 650985 - DNA, 20 bp, mouse
gcgggcgccctcagaggctg

SEQ ID NO: 650986 - DNA, 20 bp, mouse
gtctcgcagcagccattgaa

SEQ ID NO: 650987 - DNA, 20 bp, mouse
gtggcggtgccgtgtcatgg

SEQ ID NO: 650988 - DNA, 20 bp, mouse
gaccaatcccgttgggaggt

SEQ ID NO: 650989 - DNA, 20 bp, mouse
gaggactcgaccaatcccgt

SEQ ID NO: 650990 - DNA, 20 bp, mouse
gccagaaactcagtgtctat

SEQ ID NO: 650991 - DNA, 20 bp, mouse
gggacaaccctctagcccaa

SEQ ID NO: 650992 - DNA, 20 bp, mouse
gttcgggaggatgtacgtcc

SEQ ID NO: 650993 - DNA, 20 bp, mouse
ggtgggtggagtgtaggcta

SEQ ID NO: 650994 - DNA, 20 bp, mouse
gacccacctcccaacgggat

SEQ ID NO: 650995 - DNA, 20 bp, mouse
gcagttaattccgataggtt

SEQ ID NO: 650996 - DNA, 20 bp, mouse
gcagagctggcttggggtaa

SEQ ID NO: 650997 - DNA, 20 bp, mouse
ggggaaatcagctagagcgg

SEQ ID NO: 650998 - DNA, 20 bp, mouse
gctggcttggggtaagggat

SEQ ID NO: 650999 - DNA, 20 bp, mouse
gcaggcgaaggtcactaggc

SEQ ID NO: 651000 - DNA, 20 bp, mouse
gttaaccagagctcaggcga

SEQ ID NO: 651001 - DNA, 20 bp, mouse
gagctcaggcgaaggtcact

SEQ ID NO: 651002 - DNA, 20 bp, mouse
gaaggtcactaggctggaca

SEQ ID NO: 651003 - DNA, 20 bp, mouse
ggggcccctggcatctgttg

SEQ ID NO: 651004 - DNA, 20 bp, mouse
gaggacagaggttagactca

SEQ ID NO: 651005 - DNA, 20 bp, mouse
gcgactgcaggtggcctgga

SEQ ID NO: 651006 - DNA, 20 bp, mouse
gcggcggcgcgaagtgtggg

SEQ ID NO: 651007 - DNA, 20 bp, mouse
gacagcggcggcgcgaagtg

SEQ ID NO: 651008 - DNA, 20 bp, mouse
gccaggggccgcaccgtcgg

SEQ ID NO: 651009 - DNA, 20 bp, mouse
ggggtgagggcgagaggtct

SEQ ID NO: 651010 - DNA, 20 bp, mouse
ggggccaggggccgcaccgt

SEQ ID NO: 651011 - DNA, 20 bp, mouse
gcgagacactgggacagcgg

SEQ ID NO: 651012 - DNA, 20 bp, mouse
gcaaacagccgctcccccga

SEQ ID NO: 651013 - DNA, 20 bp, mouse
gatgtggtgggcgagacact

SEQ ID NO: 651014 - DNA, 20 bp, mouse
gtgcagatgtctcccagatg

SEQ ID NO: 651015 - DNA, 20 bp, mouse
gagccgctcccccgacggtg

SEQ ID NO: 651016 - DNA, 20 bp, mouse
gccgccccagccaaggtcta

SEQ ID NO: 651017 - DNA, 20 bp, mouse
gcaagggcggcgaaaatgtt

SEQ ID NO: 651018 - DNA, 20 bp, mouse
gaccttggctggggcggaat

SEQ ID NO: 651019 - DNA, 20 bp, mouse
ggtcccctagaccttggctg

SEQ ID NO: 651020 - DNA, 20 bp, mouse
ggccgcccttggccacaaga

SEQ ID NO: 651021 - DNA, 20 bp, mouse
ggccgtggaaaagttaagaa

SEQ ID NO: 651022 - DNA, 20 bp, mouse
ggggtggggacttttggcag

SEQ ID NO: 651023 - DNA, 20 bp, mouse
gccaccgaatgtagttgttg

SEQ ID NO: 651024 - DNA, 20 bp, mouse
gggctggggcggaattgggt

SEQ ID NO: 651025 - DNA, 20 bp, mouse
ggaggatgaagacctggccg

SEQ ID NO: 651026 - DNA, 20 bp, mouse
ggcaggccgccgggcacctc

SEQ ID NO: 651027 - DNA, 20 bp, mouse
gtctgctcgtgcgagcccga

SEQ ID NO: 651028 - DNA, 20 bp, mouse
gtgtgcttgtgtggctcgtc

SEQ ID NO: 651029 - DNA, 20 bp, mouse
gaccctcaagtgtgcttgtg

SEQ ID NO: 651030 - DNA, 20 bp, mouse
gccgccgggcacctcaggcc

SEQ ID NO: 651031 - DNA, 20 bp, mouse
ggcggcgccaggttggggca

SEQ ID NO: 651032 - DNA, 20 bp, mouse
gactaacgcctgccagattt

SEQ ID NO: 651033 - DNA, 20 bp, mouse
gtgggcggtccgaggaagag

SEQ ID NO: 651034 - DNA, 20 bp, mouse
gggtgggagtgggcgctgac

SEQ ID NO: 651035 - DNA, 20 bp, mouse
gggggcgagcctctgcagcc

SEQ ID NO: 651036 - DNA, 20 bp, mouse
gaagaagggtgaaggcactg

SEQ ID NO: 651037 - DNA, 20 bp, mouse
ggtgaagaggctcagatcac

SEQ ID NO: 651038 - DNA, 20 bp, mouse
gagggagagaccacaggtta

SEQ ID NO: 651039 - DNA, 20 bp, mouse
ggcccactgatgctgtgaag

SEQ ID NO: 651040 - DNA, 20 bp, mouse
gtggtggtgtgatgtcataa

SEQ ID NO: 651041 - DNA, 20 bp, mouse
gaggttgtccagtttcagag

SEQ ID NO: 651042 - DNA, 20 bp, mouse
gggacaacctggtgaagctc

SEQ ID NO: 651043 - DNA, 20 bp, mouse
ggctcaggtgccacagggga

SEQ ID NO: 651044 - DNA, 20 bp, mouse
gcaggttctttgatgaagaa

SEQ ID NO: 651045 - DNA, 20 bp, mouse
gtggggaggtccccctggaa

SEQ ID NO: 651046 - DNA, 20 bp, mouse
gacctcagaaggaacagcag

SEQ ID NO: 651047 - DNA, 20 bp, mouse
ggaatggttcagtgcagtcg

SEQ ID NO: 651048 - DNA, 20 bp, mouse
gttctccttggttttgacca

SEQ ID NO: 651049 - DNA, 20 bp, mouse
gtcagccctggtcaaaacca

SEQ ID NO: 651050 - DNA, 20 bp, mouse
gagttctccaagataagaca

SEQ ID NO: 651051 - DNA, 20 bp, mouse
gctgaggttttattcctcac

SEQ ID NO: 651052 - DNA, 20 bp, mouse
gacagccagttactaacttc

SEQ ID NO: 651053 - DNA, 20 bp, mouse
gtgattcctgtttctttctg

SEQ ID NO: 651054 - DNA, 20 bp, mouse
gtgctctccctgtcttatct

SEQ ID NO: 651055 - DNA, 20 bp, mouse
gttactaacttctggttgct

SEQ ID NO: 651056 - DNA, 20 bp, mouse
gaacgcataagcaggaggtt

SEQ ID NO: 651057 - DNA, 20 bp, mouse
gaagcaggaggttgggctag

SEQ ID NO: 651058 - DNA, 20 bp, mouse
gtgtaaaagctgatgactca

SEQ ID NO: 651059 - DNA, 20 bp, mouse
gaaaccaacgcataagcagg

SEQ ID NO: 651060 - DNA, 20 bp, mouse
gctgcctgaccaaatatctc

SEQ ID NO: 651061 - DNA, 20 bp, mouse
gtggtttaaggaaatacatt

SEQ ID NO: 651062 - DNA, 20 bp, mouse
gttgcctgagatatttggtc

SEQ ID NO: 651063 - DNA, 20 bp, mouse
gaagctgatgactcatggaa

SEQ ID NO: 651064 - DNA, 20 bp, mouse
gtgattaggctctgagctca

SEQ ID NO: 651065 - DNA, 20 bp, mouse
gcttaaaccaacgcataagc

SEQ ID NO: 651066 - DNA, 20 bp, mouse
gcaaagccgctctagacctc

SEQ ID NO: 651067 - DNA, 20 bp, mouse
gagaatgtcctctcatcctg

SEQ ID NO: 651068 - DNA, 20 bp, mouse
ggggcggagccgcacgagat

SEQ ID NO: 651069 - DNA, 20 bp, mouse
gaggctccgcccatctcgtg

SEQ ID NO: 651070 - DNA, 20 bp, mouse
ggggaccacgcccacaggtg

SEQ ID NO: 651071 - DNA, 20 bp, mouse
gaagcgcaaccctcacctgt

SEQ ID NO: 651072 - DNA, 20 bp, mouse
gcgccccggggcgacaaacg

SEQ ID NO: 651073 - DNA, 20 bp, mouse
ggatgagaggacattctcgc

SEQ ID NO: 651074 - DNA, 20 bp, mouse
ggagatgggcggagcctctc

SEQ ID NO: 651075 - DNA, 20 bp, mouse
gcggagccgcacgagatggg

SEQ ID NO: 651076 - DNA, 20 bp, mouse
gtgaatacactgttggggat

SEQ ID NO: 651077 - DNA, 20 bp, mouse
gggttcgttccctgggtgta

SEQ ID NO: 651078 - DNA, 20 bp, mouse
gtccgagagaccgtacaccc

SEQ ID NO: 651079 - DNA, 20 bp, mouse
gctagctatgcacgctggac

SEQ ID NO: 651080 - DNA, 20 bp, mouse
gaagctccggttcgttccct

SEQ ID NO: 651081 - DNA, 20 bp, mouse
gccctgggtgtacggtctct

SEQ ID NO: 651082 - DNA, 20 bp, mouse
ggtgctctagctatgcacgc

SEQ ID NO: 651083 - DNA, 20 bp, mouse
gtacactgttggggatgggt

SEQ ID NO: 651084 - DNA, 20 bp, mouse
gctatgcacgctggacgggc

SEQ ID NO: 651085 - DNA, 20 bp, mouse
gggatttgaatacactgttg

SEQ ID NO: 651086 - DNA, 20 bp, mouse
ggcggtggagctgtcacgta

SEQ ID NO: 651087 - DNA, 20 bp, mouse
gaccccgggaggcacggaga

SEQ ID NO: 651088 - DNA, 20 bp, mouse
gaaatgggtggatacttgta

SEQ ID NO: 651089 - DNA, 20 bp, mouse
gggtgggaacaggccgggga

SEQ ID NO: 651090 - DNA, 20 bp, mouse
gagtaaggggatttgggcgg

SEQ ID NO: 651091 - DNA, 20 bp, mouse
gccgggctgctccgcttcaa

SEQ ID NO: 651092 - DNA, 20 bp, mouse
gaggagtaaggggatttggg

SEQ ID NO: 651093 - DNA, 20 bp, mouse
gggcctcgcgctgggaggat

SEQ ID NO: 651094 - DNA, 20 bp, mouse
gcggcgatggggaccccggg

SEQ ID NO: 651095 - DNA, 20 bp, mouse
ggggccgcgccccacttacc

SEQ ID NO: 651096 - DNA, 20 bp, mouse
gaggggagggcttgcgaggg

SEQ ID NO: 651097 - DNA, 20 bp, mouse
gggaaggggagggcttgcga

SEQ ID NO: 651098 - DNA, 20 bp, mouse
ggtggtgggtaggtcacgac

SEQ ID NO: 651099 - DNA, 20 bp, mouse
gcgaggggggcgtggtgggt

SEQ ID NO: 651100 - DNA, 20 bp, mouse
gagccaagccctaaaaggag

SEQ ID NO: 651101 - DNA, 20 bp, mouse
gcttgcgaggggggcgtggt

SEQ ID NO: 651102 - DNA, 20 bp, mouse
gagggcttgcgaggggggcg

SEQ ID NO: 651103 - DNA, 20 bp, mouse
ggcagtccgtgagtagaaac

SEQ ID NO: 651104 - DNA, 20 bp, mouse
gactggagcagagaggatcc

SEQ ID NO: 651105 - DNA, 20 bp, mouse
gccacttgcaagccggtcct

SEQ ID NO: 651106 - DNA, 20 bp, mouse
gctgtcctcagtggggttaa

SEQ ID NO: 651107 - DNA, 20 bp, mouse
ggcgaccccagcaggacgcg

SEQ ID NO: 651108 - DNA, 20 bp, mouse
gatcgcccccagcaccagga

SEQ ID NO: 651109 - DNA, 20 bp, mouse
gtggggtcgcacaacgtact

SEQ ID NO: 651110 - DNA, 20 bp, mouse
gtgggctcgctgtcctcagt

SEQ ID NO: 651111 - DNA, 20 bp, mouse
gtcggcctttaaccccactg

SEQ ID NO: 651112 - DNA, 20 bp, mouse
ggacgcgaggctgagaccct

SEQ ID NO: 651113 - DNA, 20 bp, mouse
ggaggacagcgagcccactc

SEQ ID NO: 651114 - DNA, 20 bp, mouse
gctcaggcccctcctggtgc

SEQ ID NO: 651115 - DNA, 20 bp, mouse
gcggggagggactttcctgt

SEQ ID NO: 651116 - DNA, 20 bp, mouse
ggggaggtggccatggtagg

SEQ ID NO: 651117 - DNA, 20 bp, mouse
gcgcaggcgcaggagcatag

SEQ ID NO: 651118 - DNA, 20 bp, mouse
gccgggctgggacctaatta

SEQ ID NO: 651119 - DNA, 20 bp, mouse
ggcagggcgtgtcctgatgg

SEQ ID NO: 651120 - DNA, 20 bp, mouse
gcccgggccgcgcccccatc

SEQ ID NO: 651121 - DNA, 20 bp, mouse
gaaaagccccacgcaggcgc

SEQ ID NO: 651122 - DNA, 20 bp, mouse
gggctgggacctaattaggg

SEQ ID NO: 651123 - DNA, 20 bp, mouse
gagggatgtggcagctgcct

SEQ ID NO: 651124 - DNA, 20 bp, mouse
ggaggaaagtaccgtatcca

SEQ ID NO: 651125 - DNA, 20 bp, mouse
ggtggcagctgcctgggaca

SEQ ID NO: 651126 - DNA, 20 bp, mouse
gcggctgcaggggaagggca

SEQ ID NO: 651127 - DNA, 20 bp, mouse
ggtcaccggctgcaggggaa

SEQ ID NO: 651128 - DNA, 20 bp, mouse
gaaaaagaagcactcggggt

SEQ ID NO: 651129 - DNA, 20 bp, mouse
gccctctggaggtgacgtca

SEQ ID NO: 651130 - DNA, 20 bp, mouse
gtgggggagggcgccctcgg

SEQ ID NO: 651131 - DNA, 20 bp, mouse
gcaggctgggcgcacggtgg

SEQ ID NO: 651132 - DNA, 20 bp, mouse
gtggaggtgacgtcagggct

SEQ ID NO: 651133 - DNA, 20 bp, mouse
gagggtaggggatttggcaa

SEQ ID NO: 651134 - DNA, 20 bp, mouse
gggcagcgagcgaatccgat

SEQ ID NO: 651135 - DNA, 20 bp, mouse
gactacgcctgtgacccgat

SEQ ID NO: 651136 - DNA, 20 bp, mouse
ggtggagccgcgcaagtggg

SEQ ID NO: 651137 - DNA, 20 bp, mouse
gggacgctgcgcccctcagg

SEQ ID NO: 651138 - DNA, 20 bp, mouse
gtgggtggagccgcgcaagt

SEQ ID NO: 651139 - DNA, 20 bp, mouse
gaggttctcaggatccccgg

SEQ ID NO: 651140 - DNA, 20 bp, mouse
gtagaaaggaactgcagctt

SEQ ID NO: 651141 - DNA, 20 bp, mouse
gcgcaagtgggcggagcaga

SEQ ID NO: 651142 - DNA, 20 bp, mouse
gatgggcagtaaggcaagaa

SEQ ID NO: 651143 - DNA, 20 bp, mouse
ggcgtcccgcccgagcttgg

SEQ ID NO: 651144 - DNA, 20 bp, mouse
ggcgggacgctgcgcccctc

SEQ ID NO: 651145 - DNA, 20 bp, mouse
ggaccgcccccaagctcggg

SEQ ID NO: 651146 - DNA, 20 bp, mouse
ggcagtgtctgggtggggtc

SEQ ID NO: 651147 - DNA, 20 bp, mouse
gggcccgggcagtgtctggg

SEQ ID NO: 651148 - DNA, 20 bp, mouse
gggcaggcccgggcagtgtc

SEQ ID NO: 651149 - DNA, 20 bp, mouse
gaagcggagcctgaggtgga

SEQ ID NO: 651150 - DNA, 20 bp, mouse
gcctgagaatgtttgggctg

SEQ ID NO: 651151 - DNA, 20 bp, mouse
gggcctgccctgagaatgtt

SEQ ID NO: 651152 - DNA, 20 bp, mouse
gggggtctgggagtcacagg

SEQ ID NO: 651153 - DNA, 20 bp, mouse
gaagatggcagtaagcagaa

SEQ ID NO: 651154 - DNA, 20 bp, mouse
gactgtgtaccaactctcat

SEQ ID NO: 651155 - DNA, 20 bp, mouse
gtcaggctccgcttggctct

SEQ ID NO: 651156 - DNA, 20 bp, mouse
ggggttcagggccagttcct

SEQ ID NO: 651157 - DNA, 20 bp, mouse
gtctggcccctcccagacgt

SEQ ID NO: 651158 - DNA, 20 bp, mouse
gttcagggccagttcctggg

SEQ ID NO: 651159 - DNA, 20 bp, mouse
gtcaagagacaaggtgtctg

SEQ ID NO: 651160 - DNA, 20 bp, mouse
ggagaggaccaggctgtaca

SEQ ID NO: 651161 - DNA, 20 bp, mouse
gcaacctggccccacaggga

SEQ ID NO: 651162 - DNA, 20 bp, mouse
gtcctctcccacgtctggga

SEQ ID NO: 651163 - DNA, 20 bp, mouse
ggggctggtcttcaagagag

SEQ ID NO: 651164 - DNA, 20 bp, mouse
ggggaggagagatgctaggc

SEQ ID NO: 651165 - DNA, 20 bp, mouse
ggttgagagttcacttgcgt

SEQ ID NO: 651166 - DNA, 20 bp, mouse
gtttgcccgaagcactctgt

SEQ ID NO: 651167 - DNA, 20 bp, mouse
gagcccttcagcaatcagat

SEQ ID NO: 651168 - DNA, 20 bp, mouse
gccgaagcactctgttggct

SEQ ID NO: 651169 - DNA, 20 bp, mouse
gtctaactggctgtatgtgt

SEQ ID NO: 651170 - DNA, 20 bp, mouse
gctgccaatctgattgctga

SEQ ID NO: 651171 - DNA, 20 bp, mouse
gagtgaccacatgaaccttg

SEQ ID NO: 651172 - DNA, 20 bp, mouse
ggtgcttcgggcaaacctca

SEQ ID NO: 651173 - DNA, 20 bp, mouse
gaaacagtacttccggcctc

SEQ ID NO: 651174 - DNA, 20 bp, mouse
ggcaaacctcaaggttcatg

SEQ ID NO: 651175 - DNA, 20 bp, mouse
gttgacagaaacagtacttc

SEQ ID NO: 651176 - DNA, 20 bp, mouse
ggcaccctagcacctgtcca

SEQ ID NO: 651177 - DNA, 20 bp, mouse
gcctccctggacaggtgcta

SEQ ID NO: 651178 - DNA, 20 bp, mouse
gacaggtgctagggtgctgc

SEQ ID NO: 651179 - DNA, 20 bp, mouse
gtggggacctatagcccatg

SEQ ID NO: 651180 - DNA, 20 bp, mouse
gtcaccctgtccctccctgt

SEQ ID NO: 651181 - DNA, 20 bp, mouse
ggtccagggaggatccccat

SEQ ID NO: 651182 - DNA, 20 bp, mouse
gaaggtggccacctattaaa

SEQ ID NO: 651183 - DNA, 20 bp, mouse
gtattaaaggggaaattaca

SEQ ID NO: 651184 - DNA, 20 bp, mouse
gggagggacagggtgagata

SEQ ID NO: 651185 - DNA, 20 bp, mouse
ggggctataggtccccagct

SEQ ID NO: 651186 - DNA, 20 bp, mouse
gacaaagccttgtatcctgg

SEQ ID NO: 651187 - DNA, 20 bp, mouse
gcctggtggaacagagggtt

SEQ ID NO: 651188 - DNA, 20 bp, mouse
ggctacaaagccttgtatcc

SEQ ID NO: 651189 - DNA, 20 bp, mouse
gaagtcagcaggagtataag

SEQ ID NO: 651190 - DNA, 20 bp, mouse
gcatttggggttcagttctt

SEQ ID NO: 651191 - DNA, 20 bp, mouse
ggtggcccaaggcagagata

SEQ ID NO: 651192 - DNA, 20 bp, mouse
gcaaggctttgtagcatttg

SEQ ID NO: 651193 - DNA, 20 bp, mouse
gaccagaaaggcacaaacat

SEQ ID NO: 651194 - DNA, 20 bp, mouse
gggaacgttttcctcaacca

SEQ ID NO: 651195 - DNA, 20 bp, mouse
gtctgttccaccaggataca

SEQ ID NO: 651196 - DNA, 20 bp, mouse
gcattggcagtcaaagttta

SEQ ID NO: 651197 - DNA, 20 bp, mouse
gagagcacaagacagaaaat

SEQ ID NO: 651198 - DNA, 20 bp, mouse
gggactaaactccaccctgt

SEQ ID NO: 651199 - DNA, 20 bp, mouse
gggagctgaactacctgaga

SEQ ID NO: 651200 - DNA, 20 bp, mouse
gcgtagtagttagtgaccat

SEQ ID NO: 651201 - DNA, 20 bp, mouse
ggcagtcaaagtttagggac

SEQ ID NO: 651202 - DNA, 20 bp, mouse
gcaggcactcattaggtccc

SEQ ID NO: 651203 - DNA, 20 bp, mouse
gtctctgactggatagagta

SEQ ID NO: 651204 - DNA, 20 bp, mouse
gacgtgtcatcatttagaac

SEQ ID NO: 651205 - DNA, 20 bp, mouse
gtatattcaggatgatggag

SEQ ID NO: 651206 - DNA, 20 bp, mouse
gtgggggagaagttagtctg

SEQ ID NO: 651207 - DNA, 20 bp, mouse
gtctgggtcagggttgggat

SEQ ID NO: 651208 - DNA, 20 bp, mouse
gttcataaggtgggagttgg

SEQ ID NO: 651209 - DNA, 20 bp, mouse
gagcactctgatttggaaac

SEQ ID NO: 651210 - DNA, 20 bp, mouse
gggaagccggagctagggtt

SEQ ID NO: 651211 - DNA, 20 bp, mouse
gcggagctagggttgggagg

SEQ ID NO: 651212 - DNA, 20 bp, mouse
ggaaacacccggccttcata

SEQ ID NO: 651213 - DNA, 20 bp, mouse
ggagggatctcgtctgtgta

SEQ ID NO: 651214 - DNA, 20 bp, mouse
gttgggaggcgggtctgagc

SEQ ID NO: 651215 - DNA, 20 bp, mouse
ggccttcataaggtgggagt

SEQ ID NO: 651216 - DNA, 20 bp, mouse
gtgcccgaggctacagggcg

SEQ ID NO: 651217 - DNA, 20 bp, mouse
ggatactagagcaatgactc

SEQ ID NO: 651218 - DNA, 20 bp, mouse
gctacagagtgtgccagcgt

SEQ ID NO: 651219 - DNA, 20 bp, mouse
gtagctgggcggccagcctc

SEQ ID NO: 651220 - DNA, 20 bp, mouse
gttaagggcgcaggactctt

SEQ ID NO: 651221 - DNA, 20 bp, mouse
gaacctagggagatatacta

SEQ ID NO: 651222 - DNA, 20 bp, mouse
gggaagagccaatgctgcag

SEQ ID NO: 651223 - DNA, 20 bp, mouse
gaagccccgccctgtagcct

SEQ ID NO: 651224 - DNA, 20 bp, mouse
gtgaatgggtattgaggggt

SEQ ID NO: 651225 - DNA, 20 bp, mouse
gtaaacaaacgagaggattc

SEQ ID NO: 651226 - DNA, 20 bp, mouse
gcaccctgccccagtcccaa

SEQ ID NO: 651227 - DNA, 20 bp, mouse
ggggcagggtgcagggtttg

SEQ ID NO: 651228 - DNA, 20 bp, mouse
gaactaagccggggtctcct

SEQ ID NO: 651229 - DNA, 20 bp, mouse
gcctcacctcccaccaacct

SEQ ID NO: 651230 - DNA, 20 bp, mouse
gaagcaagaaagacgtggaa

SEQ ID NO: 651231 - DNA, 20 bp, mouse
gacagagcaggtttaagctt

SEQ ID NO: 651232 - DNA, 20 bp, mouse
gtgtacagataggccgatgg

SEQ ID NO: 651233 - DNA, 20 bp, mouse
gcaaccttggctttgaaagc

SEQ ID NO: 651234 - DNA, 20 bp, mouse
gagacaagcaggggagattc

SEQ ID NO: 651235 - DNA, 20 bp, mouse
gtactcggtccctttgggac

SEQ ID NO: 651236 - DNA, 20 bp, mouse
gacgtggaagggatgccgat

SEQ ID NO: 651237 - DNA, 20 bp, mouse
gctctagtggctagcgcctg

SEQ ID NO: 651238 - DNA, 20 bp, mouse
gaacaagaaggcgctgttat

SEQ ID NO: 651239 - DNA, 20 bp, mouse
gtgagtccggagctggtgct

SEQ ID NO: 651240 - DNA, 20 bp, mouse
gggaaggttgggagcgatga

SEQ ID NO: 651241 - DNA, 20 bp, mouse
gctgttatcggtgacgtgga

SEQ ID NO: 651242 - DNA, 20 bp, mouse
gttgggagcgatgatgggca

SEQ ID NO: 651243 - DNA, 20 bp, mouse
ggcagtgaagagcagcccat

SEQ ID NO: 651244 - DNA, 20 bp, mouse
ggttggaaaacgccctctag

SEQ ID NO: 651245 - DNA, 20 bp, mouse
gagggcgttttccaacaaga

SEQ ID NO: 651246 - DNA, 20 bp, mouse
gcttagggaccactgttctt

SEQ ID NO: 651247 - DNA, 20 bp, mouse
gggtccctaagaagagactg

SEQ ID NO: 651248 - DNA, 20 bp, mouse
gaggagatcagacccaccct

SEQ ID NO: 651249 - DNA, 20 bp, mouse
gccaagtggttctagaacac

SEQ ID NO: 651250 - DNA, 20 bp, mouse
gtaaagatagatattagatg

SEQ ID NO: 651251 - DNA, 20 bp, mouse
gacatccccagtctcttctt

SEQ ID NO: 651252 - DNA, 20 bp, mouse
gtcctgaatacctcagaccc

SEQ ID NO: 651253 - DNA, 20 bp, mouse
gggtataagaatcctagggt

SEQ ID NO: 651254 - DNA, 20 bp, mouse
gctgtgaaatattcatgccc

SEQ ID NO: 651255 - DNA, 20 bp, mouse
gatgaggttgactctactct

SEQ ID NO: 651256 - DNA, 20 bp, mouse
gagacaggaatcactcgcgc

SEQ ID NO: 651257 - DNA, 20 bp, mouse
gctgcctgcctagcccacaa

SEQ ID NO: 651258 - DNA, 20 bp, mouse
gatgaaaatcgagtttcagg

SEQ ID NO: 651259 - DNA, 20 bp, mouse
gcgcgctggtgtggacagca

SEQ ID NO: 651260 - DNA, 20 bp, mouse
gggaatcactcgcgctggtg

SEQ ID NO: 651261 - DNA, 20 bp, mouse
gaaactggtttgttcatgtt

SEQ ID NO: 651262 - DNA, 20 bp, mouse
gaacgaacccgcctgtaaat

SEQ ID NO: 651263 - DNA, 20 bp, mouse
gaaggtaccgatttacaggc

SEQ ID NO: 651264 - DNA, 20 bp, mouse
gtgcctgtgttccacgggtg

SEQ ID NO: 651265 - DNA, 20 bp, mouse
ggtgtggctggtattcacgg

SEQ ID NO: 651266 - DNA, 20 bp, mouse
gcagccaagccggaatccag

SEQ ID NO: 651267 - DNA, 20 bp, mouse
gaggcgctgttctcggttgt

SEQ ID NO: 651268 - DNA, 20 bp, mouse
ggggagcccgggagcggcag

SEQ ID NO: 651269 - DNA, 20 bp, mouse
gagagagcagatccccgtct

SEQ ID NO: 651270 - DNA, 20 bp, mouse
gatccccactgcttgacagc

SEQ ID NO: 651271 - DNA, 20 bp, mouse
gtggcggctaccgcttccgg

SEQ ID NO: 651272 - DNA, 20 bp, mouse
gccgacccgctgctgcagaa

SEQ ID NO: 651273 - DNA, 20 bp, mouse
gcacgccccctgccgctccc

SEQ ID NO: 651274 - DNA, 20 bp, mouse
ggagaacagcgcctcctgcc

SEQ ID NO: 651275 - DNA, 20 bp, mouse
ggccgctcccgggctcccat

SEQ ID NO: 651276 - DNA, 20 bp, mouse
ggggccaagcggctaagttc

SEQ ID NO: 651277 - DNA, 20 bp, mouse
gagggtgcaacctggcggga

SEQ ID NO: 651278 - DNA, 20 bp, mouse
ggctggggacctgttgggcg

SEQ ID NO: 651279 - DNA, 20 bp, mouse
gggcctgtgtgggaagggcg

SEQ ID NO: 651280 - DNA, 20 bp, mouse
ggtcgagggtgcaacctggc

SEQ ID NO: 651281 - DNA, 20 bp, mouse
gtggacgcacaccccggggg

SEQ ID NO: 651282 - DNA, 20 bp, mouse
gggaggggctggggacctgt

SEQ ID NO: 651283 - DNA, 20 bp, mouse
gggcccgtgcgcggaacttc

SEQ ID NO: 651284 - DNA, 20 bp, mouse
gaagcggctaagttcaggct

SEQ ID NO: 651285 - DNA, 20 bp, mouse
gcggtggacgcacaccccgg

SEQ ID NO: 651286 - DNA, 20 bp, mouse
gtctcccttagggtgactct

SEQ ID NO: 651287 - DNA, 20 bp, mouse
gcatcccagagtcaccctaa

SEQ ID NO: 651288 - DNA, 20 bp, mouse
gttagaggaactctccctta

SEQ ID NO: 651289 - DNA, 20 bp, mouse
ggttgtctgagattacttag

SEQ ID NO: 651290 - DNA, 20 bp, mouse
ggactccctaaaccatctca

SEQ ID NO: 651291 - DNA, 20 bp, mouse
gaacagcaccaaagcattgt

SEQ ID NO: 651292 - DNA, 20 bp, mouse
ggttaccttgagatggttta

SEQ ID NO: 651293 - DNA, 20 bp, mouse
gcgcttctcccacaatgctt

SEQ ID NO: 651294 - DNA, 20 bp, mouse
gctcttgaagggtcacgtgt

SEQ ID NO: 651295 - DNA, 20 bp, mouse
gtggatgtatatgacaacct

SEQ ID NO: 651296 - DNA, 20 bp, mouse
gtctctgagtgccacctggt

SEQ ID NO: 651297 - DNA, 20 bp, mouse
gacgggaccccgcccctcta

SEQ ID NO: 651298 - DNA, 20 bp, mouse
ggggcggggtcccgtgatag

SEQ ID NO: 651299 - DNA, 20 bp, mouse
ggggtcccgtgatagaggcg

SEQ ID NO: 651300 - DNA, 20 bp, mouse
gcagggaggccctagagggg

SEQ ID NO: 651301 - DNA, 20 bp, mouse
ggggactgtcatctcctttg

SEQ ID NO: 651302 - DNA, 20 bp, mouse
gatgaaaagtgaggcccctg

SEQ ID NO: 651303 - DNA, 20 bp, mouse
gcaggccagggagtaaacag

SEQ ID NO: 651304 - DNA, 20 bp, mouse
gaagctctctgagtgccacc

SEQ ID NO: 651305 - DNA, 20 bp, mouse
gcctgggggagccacaatca

SEQ ID NO: 651306 - DNA, 20 bp, mouse
gcaaacgggccggaagtcag

SEQ ID NO: 651307 - DNA, 20 bp, mouse
gttccggcccgtttgagcta

SEQ ID NO: 651308 - DNA, 20 bp, mouse
ggtacctgaaggactagctg

SEQ ID NO: 651309 - DNA, 20 bp, mouse
gcctccaggccccgctcttc

SEQ ID NO: 651310 - DNA, 20 bp, mouse
gtgaagcccagtcagttgag

SEQ ID NO: 651311 - DNA, 20 bp, mouse
gaagtggaggggaagtgtct

SEQ ID NO: 651312 - DNA, 20 bp, mouse
gggcgagtcacagtcagtga

SEQ ID NO: 651313 - DNA, 20 bp, mouse
ggcgtggccttcctgaagag

SEQ ID NO: 651314 - DNA, 20 bp, mouse
gttacgcgcctgcgcacttg

SEQ ID NO: 651315 - DNA, 20 bp, mouse
gtgtgagaagacgctgaaag

SEQ ID NO: 651316 - DNA, 20 bp, mouse
gaggtgagaggcacggtcgg

SEQ ID NO: 651317 - DNA, 20 bp, mouse
gcgtgaatggatacatgggt

SEQ ID NO: 651318 - DNA, 20 bp, mouse
gaggcggatgcgaggatcga

SEQ ID NO: 651319 - DNA, 20 bp, mouse
gggagcgtgaatggatacat

SEQ ID NO: 651320 - DNA, 20 bp, mouse
gcggtcggcggcaaatgcca

SEQ ID NO: 651321 - DNA, 20 bp, mouse
gtgagacaggacagcagtcg

SEQ ID NO: 651322 - DNA, 20 bp, mouse
gagtggaagcggagcgtgaa

SEQ ID NO: 651323 - DNA, 20 bp, mouse
gcaggtgagcgcgtcttaaa

SEQ ID NO: 651324 - DNA, 20 bp, mouse
gcaggtgaatgcgtcttaaa

SEQ ID NO: 651325 - DNA, 20 bp, mouse
ggccaggtgagaggcacggt

SEQ ID NO: 651326 - DNA, 20 bp, mouse
gctggaggctgcaggatggt

SEQ ID NO: 651327 - DNA, 20 bp, mouse
gcctgcgcgccggatgagat

SEQ ID NO: 651328 - DNA, 20 bp, mouse
ggacccacccccatctcatc

SEQ ID NO: 651329 - DNA, 20 bp, mouse
gtggccggagagggacgcac

SEQ ID NO: 651330 - DNA, 20 bp, mouse
gcgccggatgagatgggggt

SEQ ID NO: 651331 - DNA, 20 bp, mouse
ggtcttggtgggttgattgg

SEQ ID NO: 651332 - DNA, 20 bp, mouse
ggaggggacggggacccgag

SEQ ID NO: 651333 - DNA, 20 bp, mouse
gggcttcaagcggagaggga

SEQ ID NO: 651334 - DNA, 20 bp, mouse
gagcccggtgcgtccctctc

SEQ ID NO: 651335 - DNA, 20 bp, mouse
ggcctcgccggctccaagca

SEQ ID NO: 651336 - DNA, 20 bp, mouse
gacagcgctcactctagagg

SEQ ID NO: 651337 - DNA, 20 bp, mouse
gtctccgctcgccgcagccc

SEQ ID NO: 651338 - DNA, 20 bp, mouse
gcgccctggaggctggacgg

SEQ ID NO: 651339 - DNA, 20 bp, mouse
gaccgcgcgccaagctgccg

SEQ ID NO: 651340 - DNA, 20 bp, mouse
gccgacagatcccgccctgg

SEQ ID NO: 651341 - DNA, 20 bp, mouse
ggtggcgagggccggaagtc

SEQ ID NO: 651342 - DNA, 20 bp, mouse
ggcgcgccaagctgccgagg

SEQ ID NO: 651343 - DNA, 20 bp, mouse
gggcgagcggagaggcggac

SEQ ID NO: 651344 - DNA, 20 bp, mouse
ggagccccatcaccctgcca

SEQ ID NO: 651345 - DNA, 20 bp, mouse
gcctcgccacgcctaccctg

SEQ ID NO: 651346 - DNA, 20 bp, mouse
gtggggctagcggtgatgag

SEQ ID NO: 651347 - DNA, 20 bp, mouse
ggcgaactgcggggtccccg

SEQ ID NO: 651348 - DNA, 20 bp, mouse
gggagagcaaaggaagaacc

SEQ ID NO: 651349 - DNA, 20 bp, mouse
gcagtctggccctacacctc

SEQ ID NO: 651350 - DNA, 20 bp, mouse
gaggggcgtggcgaactgcg

SEQ ID NO: 651351 - DNA, 20 bp, mouse
gtcaccgctagccccaccca

SEQ ID NO: 651352 - DNA, 20 bp, mouse
ggagtgagaaagggtaaaag

SEQ ID NO: 651353 - DNA, 20 bp, mouse
gcaaaggaagaaccaggggg

SEQ ID NO: 651354 - DNA, 20 bp, mouse
gcaggcgcggtcagcgcaga

SEQ ID NO: 651355 - DNA, 20 bp, mouse
gctgccctgggtggggctag

SEQ ID NO: 651356 - DNA, 20 bp, mouse
gaacaagtggcgtacgttcc

SEQ ID NO: 651357 - DNA, 20 bp, mouse
gcgtaggggcgggtctgagg

SEQ ID NO: 651358 - DNA, 20 bp, mouse
gtctgggaccgccccctgaa

SEQ ID NO: 651359 - DNA, 20 bp, mouse
gcgggtctgaggcggggcgt

SEQ ID NO: 651360 - DNA, 20 bp, mouse
gaaagacaccaggtgatgat

SEQ ID NO: 651361 - DNA, 20 bp, mouse
ggggagggcgggctagcggc

SEQ ID NO: 651362 - DNA, 20 bp, mouse
ggcgggcgttctattgtgag

SEQ ID NO: 651363 - DNA, 20 bp, mouse
gtcccggatgacaatccgta

SEQ ID NO: 651364 - DNA, 20 bp, mouse
gcagctccgcgccagtaggg

SEQ ID NO: 651365 - DNA, 20 bp, mouse
gcgttctattgtgagcggca

SEQ ID NO: 651366 - DNA, 20 bp, mouse
ggcgtggcgcgggatagagc

SEQ ID NO: 651367 - DNA, 20 bp, mouse
gagcgagatcggggctactc

SEQ ID NO: 651368 - DNA, 20 bp, mouse
gtcacccgtgagagcgagat

SEQ ID NO: 651369 - DNA, 20 bp, mouse
gtgagcctcgcgcccggcga

SEQ ID NO: 651370 - DNA, 20 bp, mouse
gtaggtcagtccaactgcca

SEQ ID NO: 651371 - DNA, 20 bp, mouse
ggggctactccggtatacat

SEQ ID NO: 651372 - DNA, 20 bp, mouse
gtcacacaggggtgtagggg

SEQ ID NO: 651373 - DNA, 20 bp, mouse
gtgcgcgctccgcacagctc

SEQ ID NO: 651374 - DNA, 20 bp, mouse
gagccccgatctcgctctca

SEQ ID NO: 651375 - DNA, 20 bp, mouse
gctcttgcaccgcccgtcgc

SEQ ID NO: 651376 - DNA, 20 bp, mouse
gtcgccgcctgacgtcatct

SEQ ID NO: 651377 - DNA, 20 bp, mouse
gggtgcgcgggagaaccaaa

SEQ ID NO: 651378 - DNA, 20 bp, mouse
gcgcgcacccagatgacgtc

SEQ ID NO: 651379 - DNA, 20 bp, mouse
ggtgtctgtcgcctcagcaa

SEQ ID NO: 651380 - DNA, 20 bp, mouse
gggagacggcgactcaaaga

SEQ ID NO: 651381 - DNA, 20 bp, mouse
ggaaaggtttccctgtctca

SEQ ID NO: 651382 - DNA, 20 bp, mouse
gggcagttgcctatacactc

SEQ ID NO: 651383 - DNA, 20 bp, mouse
gcctaagggcggggcaggaa

SEQ ID NO: 651384 - DNA, 20 bp, mouse
gggaaacctttccgttgctg

SEQ ID NO: 651385 - DNA, 20 bp, mouse
gtgtcgcctcagcaacggaa

SEQ ID NO: 651386 - DNA, 20 bp, mouse
ggacgtcttctctgtcttga

SEQ ID NO: 651387 - DNA, 20 bp, mouse
gcctgcgcgctcgcctccag

SEQ ID NO: 651388 - DNA, 20 bp, mouse
ggctgcgatcggggcggggt

SEQ ID NO: 651389 - DNA, 20 bp, mouse
gacgacacgtgttgcttgca

SEQ ID NO: 651390 - DNA, 20 bp, mouse
gggcgcagctgcgatcgggg

SEQ ID NO: 651391 - DNA, 20 bp, mouse
gcagtgaagcaaacaatggt

SEQ ID NO: 651392 - DNA, 20 bp, mouse
gaccccacttaactaggaac

SEQ ID NO: 651393 - DNA, 20 bp, mouse
gcgcaggcgcagctgcgatc

SEQ ID NO: 651394 - DNA, 20 bp, mouse
ggtgtcagcttgaaagctgc

SEQ ID NO: 651395 - DNA, 20 bp, mouse
gtctctgtcttgaaggctgt

SEQ ID NO: 651396 - DNA, 20 bp, mouse
gctgggaaggcgttagaccg

SEQ ID NO: 651397 - DNA, 20 bp, mouse
gtaaacgcacgcgttggcaa

SEQ ID NO: 651398 - DNA, 20 bp, mouse
ggggccgtgcccgagaagga

SEQ ID NO: 651399 - DNA, 20 bp, mouse
gaggtctcttgataggaaaa

SEQ ID NO: 651400 - DNA, 20 bp, mouse
gggcgactaggtctcttgat

SEQ ID NO: 651401 - DNA, 20 bp, mouse
ggcgagtaccaaatgcattg

SEQ ID NO: 651402 - DNA, 20 bp, mouse
gagaacccgccttccttctc

SEQ ID NO: 651403 - DNA, 20 bp, mouse
gccgtgcccgagaaggaagg

SEQ ID NO: 651404 - DNA, 20 bp, mouse
ggcgttggcaagggtggccc

SEQ ID NO: 651405 - DNA, 20 bp, mouse
ggacccacggcattgatctg

SEQ ID NO: 651406 - DNA, 20 bp, mouse
ggggcggaagccagcctcga

SEQ ID NO: 651407 - DNA, 20 bp, mouse
ggtcgcgctccgggtgttag

SEQ ID NO: 651408 - DNA, 20 bp, mouse
ggggtcagccggagagtcgt

SEQ ID NO: 651409 - DNA, 20 bp, mouse
gcgtgcgcactgtgtccgtg

SEQ ID NO: 651410 - DNA, 20 bp, mouse
gtacactcgggacccttaac

SEQ ID NO: 651411 - DNA, 20 bp, mouse
gaaccccagcttcctgttaa

SEQ ID NO: 651412 - DNA, 20 bp, mouse
gcaatctagcgcaccgggag

SEQ ID NO: 651413 - DNA, 20 bp, mouse
gcccggcagcccctaacacc

SEQ ID NO: 651414 - DNA, 20 bp, mouse
gctgccgggaagctacactc

SEQ ID NO: 651415 - DNA, 20 bp, mouse
ggcgctagattgtcgcgctc

SEQ ID NO: 651416 - DNA, 20 bp, mouse
gcacccatgcagtgagagag

SEQ ID NO: 651417 - DNA, 20 bp, mouse
gtgggtgggcgggtccgtgg

SEQ ID NO: 651418 - DNA, 20 bp, mouse
gggaggtcaggtgatcggga

SEQ ID NO: 651419 - DNA, 20 bp, mouse
gtccgtggaggtcaggtgat

SEQ ID NO: 651420 - DNA, 20 bp, mouse
ggaaagaaggccatactcgc

SEQ ID NO: 651421 - DNA, 20 bp, mouse
gcacccgcggagtgcagggt

SEQ ID NO: 651422 - DNA, 20 bp, mouse
gtccccctctctcactgcat

SEQ ID NO: 651423 - DNA, 20 bp, mouse
gagttctgagagattgggac

SEQ ID NO: 651424 - DNA, 20 bp, mouse
gctgatgactgtatagtctt

SEQ ID NO: 651425 - DNA, 20 bp, mouse
ggtgagagagggggacgtga

SEQ ID NO: 651426 - DNA, 20 bp, mouse
gaggctgcaaggcattgcag

SEQ ID NO: 651427 - DNA, 20 bp, mouse
gtgggctgctaggcgtcaaa

SEQ ID NO: 651428 - DNA, 20 bp, mouse
gcaaggcattgcagaggaag

SEQ ID NO: 651429 - DNA, 20 bp, mouse
gttcccttaggggcgtggtt

SEQ ID NO: 651430 - DNA, 20 bp, mouse
ggtcctaaccacgcccctaa

SEQ ID NO: 651431 - DNA, 20 bp, mouse
gggcgtggttaggacgtctg

SEQ ID NO: 651432 - DNA, 20 bp, mouse
ggctgctaggcgtcaaaggg

SEQ ID NO: 651433 - DNA, 20 bp, mouse
gcaaccacacgccacccaat

SEQ ID NO: 651434 - DNA, 20 bp, mouse
ggtgaggcggggcttccggg

SEQ ID NO: 651435 - DNA, 20 bp, mouse
gcagcacaaggcttggatgg

SEQ ID NO: 651436 - DNA, 20 bp, mouse
gcggaacggcgttcagtgag

SEQ ID NO: 651437 - DNA, 20 bp, mouse
gtactcaggggctgaaggaa

SEQ ID NO: 651438 - DNA, 20 bp, mouse
ggcggggcttagtggaaagg

SEQ ID NO: 651439 - DNA, 20 bp, mouse
gaggggctgaaggaacgggg

SEQ ID NO: 651440 - DNA, 20 bp, mouse
gcccaaacggagttaggctg

SEQ ID NO: 651441 - DNA, 20 bp, mouse
gagtgagccaaggcccacgt

SEQ ID NO: 651442 - DNA, 20 bp, mouse
gaggcaccaaggaggtcggc

SEQ ID NO: 651443 - DNA, 20 bp, mouse
gcgcgtagagccaatggtta

SEQ ID NO: 651444 - DNA, 20 bp, mouse
gggctggcgcagctggttgg

SEQ ID NO: 651445 - DNA, 20 bp, mouse
gtgagagctgccctacgtgg

SEQ ID NO: 651446 - DNA, 20 bp, mouse
gtgtcttcatcctccaatcg

SEQ ID NO: 651447 - DNA, 20 bp, mouse
gcccggaggccctttgtgac

SEQ ID NO: 651448 - DNA, 20 bp, mouse
gtgagactccaagccccgat

SEQ ID NO: 651449 - DNA, 20 bp, mouse
gctagagcctagcaagcgaa

SEQ ID NO: 651450 - DNA, 20 bp, mouse
gctaggctctagcatccgat

SEQ ID NO: 651451 - DNA, 20 bp, mouse
ggaaaggtaaaatgattccc

SEQ ID NO: 651452 - DNA, 20 bp, mouse
gtggccaatcaacgtgagag

SEQ ID NO: 651453 - DNA, 20 bp, mouse
ggactccaagccccgattgg

SEQ ID NO: 651454 - DNA, 20 bp, mouse
gtcagagctacaccaattga

SEQ ID NO: 651455 - DNA, 20 bp, mouse
gcaacgtgagagcggtgagg

SEQ ID NO: 651456 - DNA, 20 bp, mouse
gggccagccaactctccgga

SEQ ID NO: 651457 - DNA, 20 bp, mouse
gaactctccggaggggtacg

SEQ ID NO: 651458 - DNA, 20 bp, mouse
ggaagcgtcatgaaggaggt

SEQ ID NO: 651459 - DNA, 20 bp, mouse
gaggaaacggaagcgtcccg

SEQ ID NO: 651460 - DNA, 20 bp, mouse
gtgctcacggaggcgcgtca

SEQ ID NO: 651461 - DNA, 20 bp, mouse
ggacacaggaagcgtcatga

SEQ ID NO: 651462 - DNA, 20 bp, mouse
gagtgacgtagcagcgtgaa

SEQ ID NO: 651463 - DNA, 20 bp, mouse
gacaggaagcgtcatgaagg

SEQ ID NO: 651464 - DNA, 20 bp, mouse
gctagatagcgctccatact

SEQ ID NO: 651465 - DNA, 20 bp, mouse
gaaactgcagccgaggacgg

SEQ ID NO: 651466 - DNA, 20 bp, mouse
gaaagcgcgccgacctctca

SEQ ID NO: 651467 - DNA, 20 bp, mouse
gccaaggcgaccgtgctcct

SEQ ID NO: 651468 - DNA, 20 bp, mouse
ggccgctctggcaccctgag

SEQ ID NO: 651469 - DNA, 20 bp, mouse
gaggtcggcgcgctttcctg

SEQ ID NO: 651470 - DNA, 20 bp, mouse
gcaggcttggattcgttccc

SEQ ID NO: 651471 - DNA, 20 bp, mouse
gctaaagtgtcctgccgctc

SEQ ID NO: 651472 - DNA, 20 bp, mouse
gccaggatggaaccagaatg

SEQ ID NO: 651473 - DNA, 20 bp, mouse
ggacacggttggctccagga

SEQ ID NO: 651474 - DNA, 20 bp, mouse
ggctcccggaaacttagtct

SEQ ID NO: 651475 - DNA, 20 bp, mouse
gagcagccgcgccagtttga

SEQ ID NO: 651476 - DNA, 20 bp, mouse
ggatcggaaatcaactacta

SEQ ID NO: 651477 - DNA, 20 bp, mouse
gcctgcgccgagggggagaa

SEQ ID NO: 651478 - DNA, 20 bp, mouse
gagcgccgagcgcaggtccg

SEQ ID NO: 651479 - DNA, 20 bp, mouse
ggggaagggcgtccggaggt

SEQ ID NO: 651480 - DNA, 20 bp, mouse
ggcccaacgcggaagaagtc

SEQ ID NO: 651481 - DNA, 20 bp, mouse
gctgcgcgcctgcgccgagg

SEQ ID NO: 651482 - DNA, 20 bp, mouse
ggccgagggggagaatgggt

SEQ ID NO: 651483 - DNA, 20 bp, mouse
ggcgcgagctttgacaatgt

SEQ ID NO: 651484 - DNA, 20 bp, mouse
ggggggggggcaccgacctc

SEQ ID NO: 651485 - DNA, 20 bp, mouse
gcaaccgcgcgctggagctc

SEQ ID NO: 651486 - DNA, 20 bp, mouse
gcctgggggcgcacgagtct

SEQ ID NO: 651487 - DNA, 20 bp, mouse
gcacgagtctaggaggagag

SEQ ID NO: 651488 - DNA, 20 bp, mouse
ggacgagcaggatgaagttc

SEQ ID NO: 651489 - DNA, 20 bp, mouse
ggcacgaattcattaacctt

SEQ ID NO: 651490 - DNA, 20 bp, mouse
ggggggcgcacgagtctagg

SEQ ID NO: 651491 - DNA, 20 bp, mouse
gactataaagatggtaggtc

SEQ ID NO: 651492 - DNA, 20 bp, mouse
gacgccggaagtgactacgg

SEQ ID NO: 651493 - DNA, 20 bp, mouse
gaaaacgccggaagtgacta

SEQ ID NO: 651494 - DNA, 20 bp, mouse
ggcccccaggcggtgtttcc

SEQ ID NO: 651495 - DNA, 20 bp, mouse
gcatcctgctcgtcctgctc

SEQ ID NO: 651496 - DNA, 20 bp, mouse
gaacccgccaatcagatagg

SEQ ID NO: 651497 - DNA, 20 bp, mouse
ggtcacccatgtgacccgtg

SEQ ID NO: 651498 - DNA, 20 bp, mouse
gtgaatgacaaggggcttga

SEQ ID NO: 651499 - DNA, 20 bp, mouse
ggagaacccgccaatcagat

SEQ ID NO: 651500 - DNA, 20 bp, mouse
gtcagccgcacgggtcacat

SEQ ID NO: 651501 - DNA, 20 bp, mouse
gaaagattgccagatcctgg

SEQ ID NO: 651502 - DNA, 20 bp, mouse
gtgtccaacccgccaggatc

SEQ ID NO: 651503 - DNA, 20 bp, mouse
gtgggaaccccctatctgat

SEQ ID NO: 651504 - DNA, 20 bp, mouse
gagtctagattgaatgacaa

SEQ ID NO: 651505 - DNA, 20 bp, mouse
gatgacaaggggcttgaggg

SEQ ID NO: 651506 - DNA, 20 bp, mouse
gcaggtacttaaaggagttg

SEQ ID NO: 651507 - DNA, 20 bp, mouse
ggcaggacgccacatcggaa

SEQ ID NO: 651508 - DNA, 20 bp, mouse
gacttaaaggagttgaggat

SEQ ID NO: 651509 - DNA, 20 bp, mouse
ggaagcggcgtggctgtcaa

SEQ ID NO: 651510 - DNA, 20 bp, mouse
gcgcgtggcctcaccctcaa

SEQ ID NO: 651511 - DNA, 20 bp, mouse
gcggcatcgcaggtacttaa

SEQ ID NO: 651512 - DNA, 20 bp, mouse
ggcggtagcccgaagcggcg

SEQ ID NO: 651513 - DNA, 20 bp, mouse
ggggtgaggccacgcggaga

SEQ ID NO: 651514 - DNA, 20 bp, mouse
ggaaatccaagtgagtagag

SEQ ID NO: 651515 - DNA, 20 bp, mouse
gagggggcaggacgccacat

SEQ ID NO: 651516 - DNA, 20 bp, mouse
gtggcgggcgtggcaggcgg

SEQ ID NO: 651517 - DNA, 20 bp, mouse
gccggcaggtgccgactcgc

SEQ ID NO: 651518 - DNA, 20 bp, mouse
gtgggaacgcagttccatcg

SEQ ID NO: 651519 - DNA, 20 bp, mouse
gcctgcggcagtttcggggc

SEQ ID NO: 651520 - DNA, 20 bp, mouse
gcgtgcctgcggcagtttcg

SEQ ID NO: 651521 - DNA, 20 bp, mouse
gtggagcagaacagcggctt

SEQ ID NO: 651522 - DNA, 20 bp, mouse
ggggccaagcgcgcagtcac

SEQ ID NO: 651523 - DNA, 20 bp, mouse
gcgggacggggcgagcccgg

SEQ ID NO: 651524 - DNA, 20 bp, mouse
gtactcagacctggcgaaac

SEQ ID NO: 651525 - DNA, 20 bp, mouse
gctcccggtccgctccccga

SEQ ID NO: 651526 - DNA, 20 bp, mouse
gcgtgcgaggcggtgacaat

SEQ ID NO: 651527 - DNA, 20 bp, mouse
gcgcgcccggccgacttcgc

SEQ ID NO: 651528 - DNA, 20 bp, mouse
ggggccgccgtcccggaagt

SEQ ID NO: 651529 - DNA, 20 bp, mouse
ggccccacttccggcgtgcg

SEQ ID NO: 651530 - DNA, 20 bp, mouse
gcccggtcctcacacagcga

SEQ ID NO: 651531 - DNA, 20 bp, mouse
gccgggctgcgcaccgctgc

SEQ ID NO: 651532 - DNA, 20 bp, mouse
ggcgccgggaggcagctgac

SEQ ID NO: 651533 - DNA, 20 bp, mouse
gcccggccgacttcgcgggg

SEQ ID NO: 651534 - DNA, 20 bp, mouse
gccgtcgtggccatgccggc

SEQ ID NO: 651535 - DNA, 20 bp, mouse
gggcgggcgaaaggagcgag

SEQ ID NO: 651536 - DNA, 20 bp, mouse
gcgaggcagtgacgcaactg

SEQ ID NO: 651537 - DNA, 20 bp, mouse
gagcggcgcgctgaactctg

SEQ ID NO: 651538 - DNA, 20 bp, mouse
gcccccgcagccgaggggat

SEQ ID NO: 651539 - DNA, 20 bp, mouse
gaactggggcagatagtggg

SEQ ID NO: 651540 - DNA, 20 bp, mouse
gggaagtcgaggaccacgcc

SEQ ID NO: 651541 - DNA, 20 bp, mouse
gcgcaactggggcagatagt

SEQ ID NO: 651542 - DNA, 20 bp, mouse
gcagaagcgtgtacgtcctc

SEQ ID NO: 651543 - DNA, 20 bp, mouse
gtgcctcgcgcgggcagcag

SEQ ID NO: 651544 - DNA, 20 bp, mouse
gagggcgcccccgcagccga

SEQ ID NO: 651545 - DNA, 20 bp, mouse
gaggaccacgccgggaccac

SEQ ID NO: 651546 - DNA, 20 bp, mouse
gaatctggagcgctagctga

SEQ ID NO: 651547 - DNA, 20 bp, mouse
gctgccgcaggaccggaagc

SEQ ID NO: 651548 - DNA, 20 bp, mouse
gcgtcctggctggatcacgt

SEQ ID NO: 651549 - DNA, 20 bp, mouse
gcggtgccacaccacgtggg

SEQ ID NO: 651550 - DNA, 20 bp, mouse
gatggccctcccacgtggtg

SEQ ID NO: 651551 - DNA, 20 bp, mouse
gccaggagctaggcgggaac

SEQ ID NO: 651552 - DNA, 20 bp, mouse
gtggatcacgtgggagaatc

SEQ ID NO: 651553 - DNA, 20 bp, mouse
gcgcccacctgccgcaggac

SEQ ID NO: 651554 - DNA, 20 bp, mouse
gttccggtgccacaccacgt

SEQ ID NO: 651555 - DNA, 20 bp, mouse
gtaagaggtggggcgaaaga

SEQ ID NO: 651556 - DNA, 20 bp, mouse
ggagaggcgcgtagaggggg

SEQ ID NO: 651557 - DNA, 20 bp, mouse
ggtgcgcgcaggttgcggag

SEQ ID NO: 651558 - DNA, 20 bp, mouse
gttgcggagaggcgcgtaga

SEQ ID NO: 651559 - DNA, 20 bp, mouse
gctagctgggcgcgagcccg

SEQ ID NO: 651560 - DNA, 20 bp, mouse
gtcgcatgcgcggtggggtg

SEQ ID NO: 651561 - DNA, 20 bp, mouse
gagggcttgcggtcacgcgc

SEQ ID NO: 651562 - DNA, 20 bp, mouse
gatgcgagaacgctcaacca

SEQ ID NO: 651563 - DNA, 20 bp, mouse
gtgcgcgcacccgcgagctt

SEQ ID NO: 651564 - DNA, 20 bp, mouse
ggcgggagacccaagctcgc

SEQ ID NO: 651565 - DNA, 20 bp, mouse
gcagctagacgtggcactct

SEQ ID NO: 651566 - DNA, 20 bp, mouse
gcggctgcgactgacggcgg

SEQ ID NO: 651567 - DNA, 20 bp, mouse
gcgcgcacgcgggtgggcgt

SEQ ID NO: 651568 - DNA, 20 bp, mouse
gagggactcgcgcacagcta

SEQ ID NO: 651569 - DNA, 20 bp, mouse
gcctcccgcggggacacagg

SEQ ID NO: 651570 - DNA, 20 bp, mouse
ggggcggctgcgactgacgg

SEQ ID NO: 651571 - DNA, 20 bp, mouse
gccaggctctcggccacgag

SEQ ID NO: 651572 - DNA, 20 bp, mouse
gcggcgctgcgctcctcgag

SEQ ID NO: 651573 - DNA, 20 bp, mouse
ggccgggcggctgcgactga

SEQ ID NO: 651574 - DNA, 20 bp, mouse
ggggccggggatgagcgtta

SEQ ID NO: 651575 - DNA, 20 bp, mouse
gcgacgcgacagtccagctc

SEQ ID NO: 651576 - DNA, 20 bp, mouse
gcctcctgcgcccggccacg

SEQ ID NO: 651577 - DNA, 20 bp, mouse
gggggcggtcggtgtggcgg

SEQ ID NO: 651578 - DNA, 20 bp, mouse
gcggccctgcgtgtcgtgcg

SEQ ID NO: 651579 - DNA, 20 bp, mouse
gcgccgctatccagcttccc

SEQ ID NO: 651580 - DNA, 20 bp, mouse
gggagcgggggcggtcggtg

SEQ ID NO: 651581 - DNA, 20 bp, mouse
gcggcgtcaggggcagggtg

SEQ ID NO: 651582 - DNA, 20 bp, mouse
gacgccgcgcacgacacgca

SEQ ID NO: 651583 - DNA, 20 bp, mouse
ggacgagcccacctgggacc

SEQ ID NO: 651584 - DNA, 20 bp, mouse
gcaggaggagcgggggcggt

SEQ ID NO: 651585 - DNA, 20 bp, mouse
ggaacctgtgtgctcctcaa

SEQ ID NO: 651586 - DNA, 20 bp, mouse
gaatcccgagactacaagaa

SEQ ID NO: 651587 - DNA, 20 bp, mouse
gcctccgttcttgtagtctc

SEQ ID NO: 651588 - DNA, 20 bp, mouse
gtggagtgcaaaggaaaagt

SEQ ID NO: 651589 - DNA, 20 bp, mouse
gagtccgctctctctccttc

SEQ ID NO: 651590 - DNA, 20 bp, mouse
gaacggctgaggtaggacat

SEQ ID NO: 651591 - DNA, 20 bp, mouse
gacactggcgagtccccgga

SEQ ID NO: 651592 - DNA, 20 bp, mouse
gcatgggcagaaaccaggga

SEQ ID NO: 651593 - DNA, 20 bp, mouse
gaggagagagagcggactcg

SEQ ID NO: 651594 - DNA, 20 bp, mouse
gagtatagatagtagagctc

SEQ ID NO: 651595 - DNA, 20 bp, mouse
gtaggacatgggcagaaacc

SEQ ID NO: 651596 - DNA, 20 bp, mouse
gcagggcttgcgagggtcaa

SEQ ID NO: 651597 - DNA, 20 bp, mouse
gacaggaggcctgggacgca

SEQ ID NO: 651598 - DNA, 20 bp, mouse
gtgggacgcagggcttgcga

SEQ ID NO: 651599 - DNA, 20 bp, mouse
gccgtgcggggatagacagg

SEQ ID NO: 651600 - DNA, 20 bp, mouse
gcgtcggtgcaggaccgacg

SEQ ID NO: 651601 - DNA, 20 bp, mouse
gcgagggtcaagggtctgca

SEQ ID NO: 651602 - DNA, 20 bp, mouse
gtaggcgcgtctcccggcgt

SEQ ID NO: 651603 - DNA, 20 bp, mouse
gcgacgcggaggtgagtcca

SEQ ID NO: 651604 - DNA, 20 bp, mouse
ggggagacgcgcctagagca

SEQ ID NO: 651605 - DNA, 20 bp, mouse
ggagtctgatccgctaggga

SEQ ID NO: 651606 - DNA, 20 bp, mouse
gttgcggagccctttaggcg

SEQ ID NO: 651607 - DNA, 20 bp, mouse
gacaccaagccccgcctaaa

SEQ ID NO: 651608 - DNA, 20 bp, mouse
gaggcgaggacgtgggctca

SEQ ID NO: 651609 - DNA, 20 bp, mouse
gtaaacttgcggagcccttt

SEQ ID NO: 651610 - DNA, 20 bp, mouse
gtgaagggttagtgctcaag

SEQ ID NO: 651611 - DNA, 20 bp, mouse
gagagtctgcgccgccgggt

SEQ ID NO: 651612 - DNA, 20 bp, mouse
ggcaggaagtgttttcttcc

SEQ ID NO: 651613 - DNA, 20 bp, mouse
gggcctcgaggcgaggacgt

SEQ ID NO: 651614 - DNA, 20 bp, mouse
gttgagccctgcccacccgg

SEQ ID NO: 651615 - DNA, 20 bp, mouse
ggggttgagcctaagtgcac

SEQ ID NO: 651616 - DNA, 20 bp, mouse
ggcggcggctgcgcgaggaa

SEQ ID NO: 651617 - DNA, 20 bp, mouse
gccacctggaggggataccc

SEQ ID NO: 651618 - DNA, 20 bp, mouse
ggcgccagggtgacacccag

SEQ ID NO: 651619 - DNA, 20 bp, mouse
gaacccagcaaggcggggcc

SEQ ID NO: 651620 - DNA, 20 bp, mouse
ggagccgggcgaacccagca

SEQ ID NO: 651621 - DNA, 20 bp, mouse
gggcggaggccgcggcggaa

SEQ ID NO: 651622 - DNA, 20 bp, mouse
gccgccttgctgggttcgcc

SEQ ID NO: 651623 - DNA, 20 bp, mouse
ggacgctaggccacctggag

SEQ ID NO: 651624 - DNA, 20 bp, mouse
ggctccgcgaggcccgcgca

SEQ ID NO: 651625 - DNA, 20 bp, mouse
gtgcgcgaggaaaggcttgg

SEQ ID NO: 651626 - DNA, 20 bp, mouse
gtgcgcgtgcgcaacaagtt

SEQ ID NO: 651627 - DNA, 20 bp, mouse
gcacttccggggcatttcga

SEQ ID NO: 651628 - DNA, 20 bp, mouse
gtgcgcgcacgggtaaaggt

SEQ ID NO: 651629 - DNA, 20 bp, mouse
gcgtgcgcaacaagttcggc

SEQ ID NO: 651630 - DNA, 20 bp, mouse
ggcaaggcgtgtttgaatga

SEQ ID NO: 651631 - DNA, 20 bp, mouse
gccccgcctcctcagggcaa

SEQ ID NO: 651632 - DNA, 20 bp, mouse
gcacggcaaaagatcagatg

SEQ ID NO: 651633 - DNA, 20 bp, mouse
ggaggaaggcggggcgtttt

SEQ ID NO: 651634 - DNA, 20 bp, mouse
gcgtgtgcgcgcacgggtaa

SEQ ID NO: 651635 - DNA, 20 bp, mouse
gggcggggcgtttttggtga

SEQ ID NO: 651636 - DNA, 20 bp, mouse
ggtgagcaggttagagactc

SEQ ID NO: 651637 - DNA, 20 bp, mouse
gtcccgctgctccggaatga

SEQ ID NO: 651638 - DNA, 20 bp, mouse
gccaccaattgccacgtcct

SEQ ID NO: 651639 - DNA, 20 bp, mouse
gtaccgcagaggcagggcat

SEQ ID NO: 651640 - DNA, 20 bp, mouse
gtgcgcacgcgcgatgggag

SEQ ID NO: 651641 - DNA, 20 bp, mouse
gggccggcgtcccgctgctc

SEQ ID NO: 651642 - DNA, 20 bp, mouse
gctgctccggaatgagggat

SEQ ID NO: 651643 - DNA, 20 bp, mouse
gagaggacggacggctggag

SEQ ID NO: 651644 - DNA, 20 bp, mouse
gtagcccaggacgtggcaat

SEQ ID NO: 651645 - DNA, 20 bp, mouse
gcggtggagaagacagaaat

SEQ ID NO: 651646 - DNA, 20 bp, mouse
gagtccgcgtcaggctctct

SEQ ID NO: 651647 - DNA, 20 bp, mouse
ggcagtgcggtggagtcggg

SEQ ID NO: 651648 - DNA, 20 bp, mouse
gcgccctggtcagcatccag

SEQ ID NO: 651649 - DNA, 20 bp, mouse
gtgcaggctcctgactggaa

SEQ ID NO: 651650 - DNA, 20 bp, mouse
gagggtggaaagccccgcgc

SEQ ID NO: 651651 - DNA, 20 bp, mouse
gcaatctgcaggctcctgac

SEQ ID NO: 651652 - DNA, 20 bp, mouse
gactggaatggggagcgccc

SEQ ID NO: 651653 - DNA, 20 bp, mouse
gtcctctggacagtgcagtg

SEQ ID NO: 651654 - DNA, 20 bp, mouse
gtctggacagtgcagtgcgg

SEQ ID NO: 651655 - DNA, 20 bp, mouse
gggatgcaggatactgacgg

SEQ ID NO: 651656 - DNA, 20 bp, mouse
ggagaggaagctcctgagga

SEQ ID NO: 651657 - DNA, 20 bp, mouse
ggtgtcacctaagcagggga

SEQ ID NO: 651658 - DNA, 20 bp, mouse
gtcacccaggacatgggtag

SEQ ID NO: 651659 - DNA, 20 bp, mouse
gtcctgggtgacatcagggt

SEQ ID NO: 651660 - DNA, 20 bp, mouse
ggacgagaggatgctattgg

SEQ ID NO: 651661 - DNA, 20 bp, mouse
gcacaccccctcccctgctt

SEQ ID NO: 651662 - DNA, 20 bp, mouse
gtgggatgaagcctcaaggc

SEQ ID NO: 651663 - DNA, 20 bp, mouse
ggagcaggtgtcacctaagc

SEQ ID NO: 651664 - DNA, 20 bp, mouse
gctgatgtcacccaggacat

SEQ ID NO: 651665 - DNA, 20 bp, mouse
gctctcgtcctgaggcacgg

SEQ ID NO: 651666 - DNA, 20 bp, mouse
gggagcttaggggccgatgg

SEQ ID NO: 651667 - DNA, 20 bp, mouse
gggaagacgagctggtgcta

SEQ ID NO: 651668 - DNA, 20 bp, mouse
gggcctctgctggagcttag

SEQ ID NO: 651669 - DNA, 20 bp, mouse
gtaggggccgatgggggtga

SEQ ID NO: 651670 - DNA, 20 bp, mouse
gtcagcacgggtccctgccc

SEQ ID NO: 651671 - DNA, 20 bp, mouse
gcagggacccgtgctgaccg

SEQ ID NO: 651672 - DNA, 20 bp, mouse
gcgtgctgaccgtggagcat

SEQ ID NO: 651673 - DNA, 20 bp, mouse
gccctgccccgggttgctat

SEQ ID NO: 651674 - DNA, 20 bp, mouse
ggcgacagccaatagcaacc

SEQ ID NO: 651675 - DNA, 20 bp, mouse
gcactgcaagcgagcagggg

SEQ ID NO: 651676 - DNA, 20 bp, mouse
gctagggcagcggggagaag

SEQ ID NO: 651677 - DNA, 20 bp, mouse
ggaggggcggagtgtcaggg

SEQ ID NO: 651678 - DNA, 20 bp, mouse
gcaagcagaagggcgggcta

SEQ ID NO: 651679 - DNA, 20 bp, mouse
ggtaggaggagatatcaagg

SEQ ID NO: 651680 - DNA, 20 bp, mouse
ggcgcccaggcagacgggaa

SEQ ID NO: 651681 - DNA, 20 bp, mouse
gggggaggggcggagtgtca

SEQ ID NO: 651682 - DNA, 20 bp, mouse
gaagatgtggagatgcgccc

SEQ ID NO: 651683 - DNA, 20 bp, mouse
ggagatgcgcccaggcagac

SEQ ID NO: 651684 - DNA, 20 bp, mouse
ggaggagaagaccaaagagc

SEQ ID NO: 651685 - DNA, 20 bp, mouse
ggaggaggacgagaggcacc

SEQ ID NO: 651686 - DNA, 20 bp, mouse
gtaccttggatgacaatgaa

SEQ ID NO: 651687 - DNA, 20 bp, mouse
gctaattattagcagaacga

SEQ ID NO: 651688 - DNA, 20 bp, mouse
gaatgaaatctgggtcacag

SEQ ID NO: 651689 - DNA, 20 bp, mouse
gatagaacaagagaccaggt

SEQ ID NO: 651690 - DNA, 20 bp, mouse
gcttcccagcaatgaaatct

SEQ ID NO: 651691 - DNA, 20 bp, mouse
gtgacccagatttcattgct

SEQ ID NO: 651692 - DNA, 20 bp, mouse
ggaagagctgcaaatcttca

SEQ ID NO: 651693 - DNA, 20 bp, mouse
gcacccttcattgtcatcca

SEQ ID NO: 651694 - DNA, 20 bp, mouse
gtcttcttctaggaaagcac

SEQ ID NO: 651695 - DNA, 20 bp, mouse
gagaactcatgtgaccaacc

SEQ ID NO: 651696 - DNA, 20 bp, mouse
gggcctggatagtaagaagg

SEQ ID NO: 651697 - DNA, 20 bp, mouse
gctacgaaggagccgcccgg

SEQ ID NO: 651698 - DNA, 20 bp, mouse
gaaggagccgcccggagggg

SEQ ID NO: 651699 - DNA, 20 bp, mouse
ggggaggctccgaggagtga

SEQ ID NO: 651700 - DNA, 20 bp, mouse
gcggggcctggatagtaaga

SEQ ID NO: 651701 - DNA, 20 bp, mouse
gaagaaggcggggcctacga

SEQ ID NO: 651702 - DNA, 20 bp, mouse
gagctccggccagtcggcag

SEQ ID NO: 651703 - DNA, 20 bp, mouse
gggcctacgaaggagccgcc

SEQ ID NO: 651704 - DNA, 20 bp, mouse
gcgaagactaggcaagtggg

SEQ ID NO: 651705 - DNA, 20 bp, mouse
gttagagaggggaggctccg

SEQ ID NO: 651706 - DNA, 20 bp, mouse
gagtcccttcgcttggttct

SEQ ID NO: 651707 - DNA, 20 bp, mouse
ggtgtggtcacgtgattcga

SEQ ID NO: 651708 - DNA, 20 bp, mouse
ggtcactcggcctcacgacc

SEQ ID NO: 651709 - DNA, 20 bp, mouse
gggccccgggcaccggtgag

SEQ ID NO: 651710 - DNA, 20 bp, mouse
gaaccaagcgaagggacttt

SEQ ID NO: 651711 - DNA, 20 bp, mouse
gcacctcgtgacataacttc

SEQ ID NO: 651712 - DNA, 20 bp, mouse
gaatcaggggagtctggagt

SEQ ID NO: 651713 - DNA, 20 bp, mouse
gcttggttctgggttgttcg

SEQ ID NO: 651714 - DNA, 20 bp, mouse
gccgcggcgcacttacgtca

SEQ ID NO: 651715 - DNA, 20 bp, mouse
gacaacccagaaccaagcga

SEQ ID NO: 651716 - DNA, 20 bp, mouse
gtaggcgggagacggaacta

SEQ ID NO: 651717 - DNA, 20 bp, mouse
ggcgggagacggaactaagg

SEQ ID NO: 651718 - DNA, 20 bp, mouse
ggaactaaggtggaggctgt

SEQ ID NO: 651719 - DNA, 20 bp, mouse
ggagaggcgcgtctctggtt

SEQ ID NO: 651720 - DNA, 20 bp, mouse
gcctgcttgcgtcctgccgt

SEQ ID NO: 651721 - DNA, 20 bp, mouse
gtggaggctgtaggaaaacc

SEQ ID NO: 651722 - DNA, 20 bp, mouse
gagcatgcggccagaagaga

SEQ ID NO: 651723 - DNA, 20 bp, mouse
gggaaggtgagaacgcccgg

SEQ ID NO: 651724 - DNA, 20 bp, mouse
ggggaagagtaactggtgag

SEQ ID NO: 651725 - DNA, 20 bp, mouse
gaaaacctgggaagagtaac

SEQ ID NO: 651726 - DNA, 20 bp, mouse
gtggtggggcggaactgcag

SEQ ID NO: 651727 - DNA, 20 bp, mouse
gggagtggcttcagaagagt

SEQ ID NO: 651728 - DNA, 20 bp, mouse
gactagaggagctttgtcgg

SEQ ID NO: 651729 - DNA, 20 bp, mouse
gcactcccagcaccaagagg

SEQ ID NO: 651730 - DNA, 20 bp, mouse
gacccagagaagcatcctga

SEQ ID NO: 651731 - DNA, 20 bp, mouse
gaaggccaatgaatacttgg

SEQ ID NO: 651732 - DNA, 20 bp, mouse
gccaaggcgccagcgaaccc

SEQ ID NO: 651733 - DNA, 20 bp, mouse
gccaccctacctattactag

SEQ ID NO: 651734 - DNA, 20 bp, mouse
gaggcggggtcatggcggca

SEQ ID NO: 651735 - DNA, 20 bp, mouse
gccgggggtgggaattagat

SEQ ID NO: 651736 - DNA, 20 bp, mouse
gagagtggacggcagagcga

SEQ ID NO: 651737 - DNA, 20 bp, mouse
gaggcggagcccgtgaggcg

SEQ ID NO: 651738 - DNA, 20 bp, mouse
ggggactcgaggtgctccga

SEQ ID NO: 651739 - DNA, 20 bp, mouse
ggagatgccgagggcgggac

SEQ ID NO: 651740 - DNA, 20 bp, mouse
gtctccagaccccgcctcac

SEQ ID NO: 651741 - DNA, 20 bp, mouse
ggggctgggtggcgaggctc

SEQ ID NO: 651742 - DNA, 20 bp, mouse
gtggacggcagagcgagggt

SEQ ID NO: 651743 - DNA, 20 bp, mouse
gggacgaggcggagcccgtg

SEQ ID NO: 651744 - DNA, 20 bp, mouse
gcggtgctccgtcagagcag

SEQ ID NO: 651745 - DNA, 20 bp, mouse
gaggcaacaggagggagctt

SEQ ID NO: 651746 - DNA, 20 bp, mouse
ggggcgggacgtacgagagg

SEQ ID NO: 651747 - DNA, 20 bp, mouse
gtggccagaaaccgccccta

SEQ ID NO: 651748 - DNA, 20 bp, mouse
gtacgagaggcggtgcctta

SEQ ID NO: 651749 - DNA, 20 bp, mouse
gagaggcggtgccttagggg

SEQ ID NO: 651750 - DNA, 20 bp, mouse
gcgggctcgatcagagaagg

SEQ ID NO: 651751 - DNA, 20 bp, mouse
gcctctgcaaaaacaagccg

SEQ ID NO: 651752 - DNA, 20 bp, mouse
gcagtcgcagaggggtgtcc

SEQ ID NO: 651753 - DNA, 20 bp, mouse
ggcacaacggtcagtcgcag

SEQ ID NO: 651754 - DNA, 20 bp, mouse
gtgtgtcctgcaccgccccc

SEQ ID NO: 651755 - DNA, 20 bp, mouse
gttctggccaatcagagcct

SEQ ID NO: 651756 - DNA, 20 bp, mouse
gggtacgaaaagccgcgaga

SEQ ID NO: 651757 - DNA, 20 bp, mouse
gcgagaaggacttgaaggat

SEQ ID NO: 651758 - DNA, 20 bp, mouse
gagccgcgagaaggacttga

SEQ ID NO: 651759 - DNA, 20 bp, mouse
gggcaggcgaccctcgagct

SEQ ID NO: 651760 - DNA, 20 bp, mouse
ggcgacagatccccagctcg

SEQ ID NO: 651761 - DNA, 20 bp, mouse
gtcgtaccgccgagcggtag

SEQ ID NO: 651762 - DNA, 20 bp, mouse
ggtgactggtggcggcccgg

SEQ ID NO: 651763 - DNA, 20 bp, mouse
ggagactggcgcgtcgggag

SEQ ID NO: 651764 - DNA, 20 bp, mouse
gtacgcagagactggcgcgt

SEQ ID NO: 651765 - DNA, 20 bp, mouse
ggctgcgtgggatagctcgt

SEQ ID NO: 651766 - DNA, 20 bp, mouse
gtgcccgtgaaggttggagg

SEQ ID NO: 651767 - DNA, 20 bp, mouse
gcacgctccccgccttggac

SEQ ID NO: 651768 - DNA, 20 bp, mouse
gtgggcgtgcccgtgaaggt

SEQ ID NO: 651769 - DNA, 20 bp, mouse
gtccaggccccgccttgcat

SEQ ID NO: 651770 - DNA, 20 bp, mouse
gagccagtcccaggcttcga

SEQ ID NO: 651771 - DNA, 20 bp, mouse
gggggccagcccatgcaagg

SEQ ID NO: 651772 - DNA, 20 bp, mouse
gccgccgcagattctccaaa

SEQ ID NO: 651773 - DNA, 20 bp, mouse
ggcggcgcaaaccggccggt

SEQ ID NO: 651774 - DNA, 20 bp, mouse
gggagcgtgcgctgtgggcg

SEQ ID NO: 651775 - DNA, 20 bp, mouse
gacggctgctaaatcccaga

SEQ ID NO: 651776 - DNA, 20 bp, mouse
gtgtaagaacgtgcgtgaga

SEQ ID NO: 651777 - DNA, 20 bp, mouse
gcgcggaagggtcttagcgt

SEQ ID NO: 651778 - DNA, 20 bp, mouse
ggggcgcgcgcgggacagga

SEQ ID NO: 651779 - DNA, 20 bp, mouse
gcgcgcgcgggacaggaagg

SEQ ID NO: 651780 - DNA, 20 bp, mouse
ggccccctggcgacagctcg

SEQ ID NO: 651781 - DNA, 20 bp, mouse
gcttacagatgcttgaaccc

SEQ ID NO: 651782 - DNA, 20 bp, mouse
gtagcagtcactgagagcac

SEQ ID NO: 651783 - DNA, 20 bp, mouse
gttagcgttggtgtgacccg

SEQ ID NO: 651784 - DNA, 20 bp, mouse
gcctggcgacagctcgcgga

SEQ ID NO: 651785 - DNA, 20 bp, mouse
gtcggcgccgcccgtcgcag

SEQ ID NO: 651786 - DNA, 20 bp, mouse
gcccaagcacgaatcaacct

SEQ ID NO: 651787 - DNA, 20 bp, mouse
gacgtcaaggccttaggaga

SEQ ID NO: 651788 - DNA, 20 bp, mouse
ggggccacgggccagcactg

SEQ ID NO: 651789 - DNA, 20 bp, mouse
ggatgcgcgtattgccttct

SEQ ID NO: 651790 - DNA, 20 bp, mouse
gtcaggccaaccctctccta

SEQ ID NO: 651791 - DNA, 20 bp, mouse
gtacgcgcatctctgcgcct

SEQ ID NO: 651792 - DNA, 20 bp, mouse
gagttcctgacacctccctt

SEQ ID NO: 651793 - DNA, 20 bp, mouse
gtagagtagtgctgacgtca

SEQ ID NO: 651794 - DNA, 20 bp, mouse
gtggccctgtgacttcaaca

SEQ ID NO: 651795 - DNA, 20 bp, mouse
gcctcccttcggctcctttc

SEQ ID NO: 651796 - DNA, 20 bp, mouse
gcatgctgcagccctatcca

SEQ ID NO: 651797 - DNA, 20 bp, mouse
gctctctcgcgccctggata

SEQ ID NO: 651798 - DNA, 20 bp, mouse
ggcagcatgcttcccgggag

SEQ ID NO: 651799 - DNA, 20 bp, mouse
gtggtcattaggaggcgggg

SEQ ID NO: 651800 - DNA, 20 bp, mouse
ggccaggcaggcattgtccg

SEQ ID NO: 651801 - DNA, 20 bp, mouse
gacaacccacaactgctccc

SEQ ID NO: 651802 - DNA, 20 bp, mouse
gtggtcatgtggtcattagg

SEQ ID NO: 651803 - DNA, 20 bp, mouse
gagggctgcagcatgcttcc

SEQ ID NO: 651804 - DNA, 20 bp, mouse
gccccacaacaaaggccgag

SEQ ID NO: 651805 - DNA, 20 bp, mouse
gcaggtctctacaaaccctc

SEQ ID NO: 651806 - DNA, 20 bp, mouse
gaacaggagggtgaagactg

SEQ ID NO: 651807 - DNA, 20 bp, mouse
gaggagggagtgcagagttt

SEQ ID NO: 651808 - DNA, 20 bp, mouse
ggatactccccccatcccaa

SEQ ID NO: 651809 - DNA, 20 bp, mouse
gagggagtgcagagtttagg

SEQ ID NO: 651810 - DNA, 20 bp, mouse
ggaggggttagcctgggagt

SEQ ID NO: 651811 - DNA, 20 bp, mouse
gcactccagcctgttcactc

SEQ ID NO: 651812 - DNA, 20 bp, mouse
ggctggtagctgctagagag

SEQ ID NO: 651813 - DNA, 20 bp, mouse
gagactcactagagagggag

SEQ ID NO: 651814 - DNA, 20 bp, mouse
gaattgccccctacagtgct

SEQ ID NO: 651815 - DNA, 20 bp, mouse
ggaaaccagagtgaacaggc

SEQ ID NO: 651816 - DNA, 20 bp, mouse
gaggctccggaaccccggga

SEQ ID NO: 651817 - DNA, 20 bp, mouse
gtggagcaggctccctcccg

SEQ ID NO: 651818 - DNA, 20 bp, mouse
ggtgacacctggaatcttga

SEQ ID NO: 651819 - DNA, 20 bp, mouse
gagccgccacgctattgtcc

SEQ ID NO: 651820 - DNA, 20 bp, mouse
gctgagaggctccggaaccc

SEQ ID NO: 651821 - DNA, 20 bp, mouse
gaggctccctcccggggttc

SEQ ID NO: 651822 - DNA, 20 bp, mouse
gggagctcctgtcaccgctg

SEQ ID NO: 651823 - DNA, 20 bp, mouse
gtcaccgctggggccgggta

SEQ ID NO: 651824 - DNA, 20 bp, mouse
gggcggctctgcgcactgag

SEQ ID NO: 651825 - DNA, 20 bp, mouse
gcccagcccctcaagattcc

SEQ ID NO: 651826 - DNA, 20 bp, mouse
gagggggcacgcgctgggcg

SEQ ID NO: 651827 - DNA, 20 bp, mouse
gaaacaaggggaggtatctt

SEQ ID NO: 651828 - DNA, 20 bp, mouse
gccacgagggggcacgcgct

SEQ ID NO: 651829 - DNA, 20 bp, mouse
gttggggcggggccacgagg

SEQ ID NO: 651830 - DNA, 20 bp, mouse
gcggggctggccgtggcttg

SEQ ID NO: 651831 - DNA, 20 bp, mouse
gggggcgcaggagtcttcgc

SEQ ID NO: 651832 - DNA, 20 bp, mouse
gcccagcctcgggtccagag

SEQ ID NO: 651833 - DNA, 20 bp, mouse
gcctcccgccctgggaacag

SEQ ID NO: 651834 - DNA, 20 bp, mouse
ggacccgaggctgggggcgc

SEQ ID NO: 651835 - DNA, 20 bp, mouse
gcgcccccgctctggacccg

SEQ ID NO: 651836 - DNA, 20 bp, mouse
gcagctgtaggctggggcca

SEQ ID NO: 651837 - DNA, 20 bp, mouse
ggctgcaggcaaatggtgag

SEQ ID NO: 651838 - DNA, 20 bp, mouse
ggagccgagtctggatagtg

SEQ ID NO: 651839 - DNA, 20 bp, mouse
gagactcggctcactgaggg

SEQ ID NO: 651840 - DNA, 20 bp, mouse
gcagcctcactatccagact

SEQ ID NO: 651841 - DNA, 20 bp, mouse
gctggatagtgaggctgtag

SEQ ID NO: 651842 - DNA, 20 bp, mouse
gcgcccagcactcggacttg

SEQ ID NO: 651843 - DNA, 20 bp, mouse
gatccagactcggctcactg

SEQ ID NO: 651844 - DNA, 20 bp, mouse
gagcgccggagctgcaatgc

SEQ ID NO: 651845 - DNA, 20 bp, mouse
gaccatttgcctgcagctgt

SEQ ID NO: 651846 - DNA, 20 bp, mouse
gggcaaacaggaaactgcgg

SEQ ID NO: 651847 - DNA, 20 bp, mouse
ggaggctgggcaaacagagt

SEQ ID NO: 651848 - DNA, 20 bp, mouse
ggggatcaagggttcaggtg

SEQ ID NO: 651849 - DNA, 20 bp, mouse
ggagctgggatcaagggttc

SEQ ID NO: 651850 - DNA, 20 bp, mouse
gttgaagaagacatacacct

SEQ ID NO: 651851 - DNA, 20 bp, mouse
gtgcaactgccttacccctg

SEQ ID NO: 651852 - DNA, 20 bp, mouse
gggctgccgagctgggatca

SEQ ID NO: 651853 - DNA, 20 bp, mouse
gatgtggaacttagagttca

SEQ ID NO: 651854 - DNA, 20 bp, mouse
gaggatcagctctgttcctg

SEQ ID NO: 651855 - DNA, 20 bp, mouse
ggcaaacagagtgggcaaac

SEQ ID NO: 651856 - DNA, 20 bp, mouse
gagaacgcagggcggaacga

SEQ ID NO: 651857 - DNA, 20 bp, mouse
gggagcgaagcacatctgtt

SEQ ID NO: 651858 - DNA, 20 bp, mouse
gactctgcgacgccggggaa

SEQ ID NO: 651859 - DNA, 20 bp, mouse
gacgcagggcggaacgaagg

SEQ ID NO: 651860 - DNA, 20 bp, mouse
ggaaaggtgagaacgcaggg

SEQ ID NO: 651861 - DNA, 20 bp, mouse
gaacggacggttagatgcag

SEQ ID NO: 651862 - DNA, 20 bp, mouse
gcggggaaaggtgagaacgc

SEQ ID NO: 651863 - DNA, 20 bp, mouse
gagggcggaacgaaggtggg

SEQ ID NO: 651864 - DNA, 20 bp, mouse
gcaacagaactgcttcaaga

SEQ ID NO: 651865 - DNA, 20 bp, mouse
gcggttagatgcagaggctc

SEQ ID NO: 651866 - DNA, 20 bp, mouse
ggagaatggcaagtccagaa

SEQ ID NO: 651867 - DNA, 20 bp, mouse
ggacaaaaggacaagcaaaa

SEQ ID NO: 651868 - DNA, 20 bp, mouse
gcccaccccgtcaggtgata

SEQ ID NO: 651869 - DNA, 20 bp, mouse
gatcaggctggagtaaacaa

SEQ ID NO: 651870 - DNA, 20 bp, mouse
gaataaggtaaagatgacga

SEQ ID NO: 651871 - DNA, 20 bp, mouse
gtatgaaggggtgaagggtt

SEQ ID NO: 651872 - DNA, 20 bp, mouse
gagtaaacaagggttagaca

SEQ ID NO: 651873 - DNA, 20 bp, mouse
gggggcataaactctagtga

SEQ ID NO: 651874 - DNA, 20 bp, mouse
gactagagtttatgcccctg

SEQ ID NO: 651875 - DNA, 20 bp, mouse
gtagaatcctgattacctga

SEQ ID NO: 651876 - DNA, 20 bp, mouse
gtggctccaccctgtccaag

SEQ ID NO: 651877 - DNA, 20 bp, mouse
gccaccctgtccaagaggct

SEQ ID NO: 651878 - DNA, 20 bp, mouse
gtcagactggcacagaccca

SEQ ID NO: 651879 - DNA, 20 bp, mouse
ggtctcactggggtggaaag

SEQ ID NO: 651880 - DNA, 20 bp, mouse
gggaagcagtcttcttgagt

SEQ ID NO: 651881 - DNA, 20 bp, mouse
ggctgccaaccgggcctctg

SEQ ID NO: 651882 - DNA, 20 bp, mouse
gaaggatagccagaaacttc

SEQ ID NO: 651883 - DNA, 20 bp, mouse
gtggaaggtgacacactccc

SEQ ID NO: 651884 - DNA, 20 bp, mouse
gaggcccggttggcagccct

SEQ ID NO: 651885 - DNA, 20 bp, mouse
gccccagtgtgactccacgt

SEQ ID NO: 651886 - DNA, 20 bp, mouse
ggcgctggggagttaagtaa

SEQ ID NO: 651887 - DNA, 20 bp, mouse
ggtaagctccccagcctcag

SEQ ID NO: 651888 - DNA, 20 bp, mouse
gccaacagtgccaggagaag

SEQ ID NO: 651889 - DNA, 20 bp, mouse
gggctgccccagtagacaag

SEQ ID NO: 651890 - DNA, 20 bp, mouse
gccacgtggagggtcaaaga

SEQ ID NO: 651891 - DNA, 20 bp, mouse
ggggcagcccccctgaggct

SEQ ID NO: 651892 - DNA, 20 bp, mouse
ggggagccacttgtctactg

SEQ ID NO: 651893 - DNA, 20 bp, mouse
gtacatggcacagggatggt

SEQ ID NO: 651894 - DNA, 20 bp, mouse
gaggagagagctgcagatac

SEQ ID NO: 651895 - DNA, 20 bp, mouse
gctaaaaggggctcggaggc

SEQ ID NO: 651896 - DNA, 20 bp, mouse
ggaaagaaacacaagttcgg

SEQ ID NO: 651897 - DNA, 20 bp, mouse
gggtctcctggagaaagtca

SEQ ID NO: 651898 - DNA, 20 bp, mouse
gtggataagactggatctga

SEQ ID NO: 651899 - DNA, 20 bp, mouse
gaaagtcagggcatgctgac

SEQ ID NO: 651900 - DNA, 20 bp, mouse
gagctcccggggtccactgt

SEQ ID NO: 651901 - DNA, 20 bp, mouse
gtataggaggagctggctta

SEQ ID NO: 651902 - DNA, 20 bp, mouse
gatcgacctgcgaccccctg

SEQ ID NO: 651903 - DNA, 20 bp, mouse
gggtccaaagggcacggccc

SEQ ID NO: 651904 - DNA, 20 bp, mouse
gggttcaaacgccgccacct

SEQ ID NO: 651905 - DNA, 20 bp, mouse
ggaaacacaagttcgggggt

SEQ ID NO: 651906 - DNA, 20 bp, mouse
ggcactgctccgagggtcag

SEQ ID NO: 651907 - DNA, 20 bp, mouse
gtacccatctcaaggatttt

SEQ ID NO: 651908 - DNA, 20 bp, mouse
gggggggaagcggccgaatc

SEQ ID NO: 651909 - DNA, 20 bp, mouse
ggagatgggtaaatactaag

SEQ ID NO: 651910 - DNA, 20 bp, mouse
gtggacgcagcactgctccg

SEQ ID NO: 651911 - DNA, 20 bp, mouse
ggctgagagtcctgcactgc

SEQ ID NO: 651912 - DNA, 20 bp, mouse
gccatctcaaggattttcgg

SEQ ID NO: 651913 - DNA, 20 bp, mouse
gctcaaggattttcgggggg

SEQ ID NO: 651914 - DNA, 20 bp, mouse
gggggctttaccagcagtgc

SEQ ID NO: 651915 - DNA, 20 bp, mouse
gccaccagaaagcagaatac

SEQ ID NO: 651916 - DNA, 20 bp, mouse
gaggagagacggggtagaat

SEQ ID NO: 651917 - DNA, 20 bp, mouse
ggagtctgggtaaacgagag

SEQ ID NO: 651918 - DNA, 20 bp, mouse
gttccccccaacgtgggcgg

SEQ ID NO: 651919 - DNA, 20 bp, mouse
gctgcctgctgataaatagg

SEQ ID NO: 651920 - DNA, 20 bp, mouse
ggatgactgacagggtgaca

SEQ ID NO: 651921 - DNA, 20 bp, mouse
gcccacgttggggggaactc

SEQ ID NO: 651922 - DNA, 20 bp, mouse
gctcccccgcccacgttggg

SEQ ID NO: 651923 - DNA, 20 bp, mouse
gctaaaactcagtcgagtct

SEQ ID NO: 651924 - DNA, 20 bp, mouse
ggtgagagagctccaagggt

SEQ ID NO: 651925 - DNA, 20 bp, mouse
gtgctcgcccgtgagtgcat

SEQ ID NO: 651926 - DNA, 20 bp, mouse
gggccgctgtacagaggagc

SEQ ID NO: 651927 - DNA, 20 bp, mouse
gcccgcgggccgctgtacag

SEQ ID NO: 651928 - DNA, 20 bp, mouse
ggacgcctggggccaccctt

SEQ ID NO: 651929 - DNA, 20 bp, mouse
ggcggggatcgcaaagagaa

SEQ ID NO: 651930 - DNA, 20 bp, mouse
gctaggcgatcaagcccaga

SEQ ID NO: 651931 - DNA, 20 bp, mouse
ggacctgctcctctgtacag

SEQ ID NO: 651932 - DNA, 20 bp, mouse
ggccaagccaagggacaaag

SEQ ID NO: 651933 - DNA, 20 bp, mouse
gttggctgcaagctcggcac

SEQ ID NO: 651934 - DNA, 20 bp, mouse
gggtaggacagacgccccaa

SEQ ID NO: 651935 - DNA, 20 bp, mouse
gtcaacggggagcacaaaaa

SEQ ID NO: 651936 - DNA, 20 bp, mouse
gtggataaaagggtgatatc

SEQ ID NO: 651937 - DNA, 20 bp, mouse
gcaggcttagtgtgtggata

SEQ ID NO: 651938 - DNA, 20 bp, mouse
gagaatccaggcttagtgtg

SEQ ID NO: 651939 - DNA, 20 bp, mouse
gtattccagcctggataaaa

SEQ ID NO: 651940 - DNA, 20 bp, mouse
gtggcttcagctagagatga

SEQ ID NO: 651941 - DNA, 20 bp, mouse
gcacatgtagactagaatcc

SEQ ID NO: 651942 - DNA, 20 bp, mouse
gagtagctactgctaggata

SEQ ID NO: 651943 - DNA, 20 bp, mouse
gtagtgtgtggataaggttt

SEQ ID NO: 651944 - DNA, 20 bp, mouse
gaagtccctttgtggactta

SEQ ID NO: 651945 - DNA, 20 bp, mouse
gactgtaagaataaaacctc

SEQ ID NO: 651946 - DNA, 20 bp, mouse
ggtgctggggaggacttcgt

SEQ ID NO: 651947 - DNA, 20 bp, mouse
gtgcacctcccccctgctca

SEQ ID NO: 651948 - DNA, 20 bp, mouse
gagcaggggggaggtgcaca

SEQ ID NO: 651949 - DNA, 20 bp, mouse
ggtgcacatctggaactaaa

SEQ ID NO: 651950 - DNA, 20 bp, mouse
gcagaggatcgggccagaaa

SEQ ID NO: 651951 - DNA, 20 bp, mouse
gtcagactcgggtgcacatc

SEQ ID NO: 651952 - DNA, 20 bp, mouse
gaacaggagacctcagaatt

SEQ ID NO: 651953 - DNA, 20 bp, mouse
ggtccaggtgactcagactc

SEQ ID NO: 651954 - DNA, 20 bp, mouse
gtcccccatacccaattctg

SEQ ID NO: 651955 - DNA, 20 bp, mouse
gggatggcttaacagtgtcc

SEQ ID NO: 651956 - DNA, 20 bp, mouse
gtaggtggacacagagacaa

SEQ ID NO: 651957 - DNA, 20 bp, mouse
gtcaggaggcccatggcggt

SEQ ID NO: 651958 - DNA, 20 bp, mouse
ggaggcagacgcacgggtag

SEQ ID NO: 651959 - DNA, 20 bp, mouse
gaggtttaaccggttgggga

SEQ ID NO: 651960 - DNA, 20 bp, mouse
gtaggcccaaggctcgtcac

SEQ ID NO: 651961 - DNA, 20 bp, mouse
gcgggacagaatgtgagctg

SEQ ID NO: 651962 - DNA, 20 bp, mouse
ggattggggtggtgggatca

SEQ ID NO: 651963 - DNA, 20 bp, mouse
gtggggtggtgggatcatgg

SEQ ID NO: 651964 - DNA, 20 bp, mouse
ggggctggttgtgttggtgt

SEQ ID NO: 651965 - DNA, 20 bp, mouse
gggtggagatcaatgagatt

SEQ ID NO: 651966 - DNA, 20 bp, mouse
gtcaaagtggggctcccctg

SEQ ID NO: 651967 - DNA, 20 bp, mouse
gggcaggcctggaagggtaa

SEQ ID NO: 651968 - DNA, 20 bp, mouse
gcctgtcaggtcaaaccaca

SEQ ID NO: 651969 - DNA, 20 bp, mouse
gaacaaagccacaggggggt

SEQ ID NO: 651970 - DNA, 20 bp, mouse
gctggccaacaaagccacag

SEQ ID NO: 651971 - DNA, 20 bp, mouse
gtacagctctgcccagttta

SEQ ID NO: 651972 - DNA, 20 bp, mouse
gctgtcctaggccaaagtcc

SEQ ID NO: 651973 - DNA, 20 bp, mouse
gaacctcaagctctttcaga

SEQ ID NO: 651974 - DNA, 20 bp, mouse
gagcagctgcctgatatgga

SEQ ID NO: 651975 - DNA, 20 bp, mouse
ggagaaatcacccataaact

SEQ ID NO: 651976 - DNA, 20 bp, mouse
gagtgtggggaggtcacaag

SEQ ID NO: 651977 - DNA, 20 bp, mouse
ggtatccaggaaaactctgg

SEQ ID NO: 651978 - DNA, 20 bp, mouse
ggcacactgtttaggaaagg

SEQ ID NO: 651979 - DNA, 20 bp, mouse
ggtcttgtacaaggccaggg

SEQ ID NO: 651980 - DNA, 20 bp, mouse
gaagtcctgccaaggagtgt

SEQ ID NO: 651981 - DNA, 20 bp, mouse
ggggcttcgtgtcttgtaca

SEQ ID NO: 651982 - DNA, 20 bp, mouse
ggggtcacacccagctccac

SEQ ID NO: 651983 - DNA, 20 bp, mouse
ggtgtgtggagtcagtgttg

SEQ ID NO: 651984 - DNA, 20 bp, mouse
gggaactaggagtctaactc

SEQ ID NO: 651985 - DNA, 20 bp, mouse
gcctaaacagtgtgccgccc

SEQ ID NO: 651986 - DNA, 20 bp, mouse
gtacggcagaggagactgtt

SEQ ID NO: 651987 - DNA, 20 bp, mouse
ggatcccttggtggcggagg

SEQ ID NO: 651988 - DNA, 20 bp, mouse
ggggacaagccttggacctc

SEQ ID NO: 651989 - DNA, 20 bp, mouse
gctaccggctcacctagatg

SEQ ID NO: 651990 - DNA, 20 bp, mouse
gtagatgaggtcggtgagac

SEQ ID NO: 651991 - DNA, 20 bp, mouse
gctactggaaggctttcagg

SEQ ID NO: 651992 - DNA, 20 bp, mouse
gaggtggccgtgaaaagcat

SEQ ID NO: 651993 - DNA, 20 bp, mouse
gctgtgaaggagcctgtcac

SEQ ID NO: 651994 - DNA, 20 bp, mouse
gtggagcaacggaggaagtg

SEQ ID NO: 651995 - DNA, 20 bp, mouse
gccaccaagggatcagctac

SEQ ID NO: 651996 - DNA, 20 bp, mouse
gagtgtggggaggtcacaag

SEQ ID NO: 651997 - DNA, 20 bp, mouse
ggtatccaggaaaactctgg

SEQ ID NO: 651998 - DNA, 20 bp, mouse
ggcacactgtttaggaaagg

SEQ ID NO: 651999 - DNA, 20 bp, mouse
ggtcttgtacaaggccaggg

SEQ ID NO: 652000 - DNA, 20 bp, mouse
gaagtcctgccaaggagtgt

SEQ ID NO: 652001 - DNA, 20 bp, mouse
ggggcttcgtgtcttgtaca

SEQ ID NO: 652002 - DNA, 20 bp, mouse
ggggtcacacccagctccac

SEQ ID NO: 652003 - DNA, 20 bp, mouse
ggtgtgtggagtcagtgttg

SEQ ID NO: 652004 - DNA, 20 bp, mouse
gggaactaggagtctaactc

SEQ ID NO: 652005 - DNA, 20 bp, mouse
gcctaaacagtgtgccgccc

SEQ ID NO: 652006 - DNA, 20 bp, mouse
gtgtgaaggaaactaagtga

SEQ ID NO: 652007 - DNA, 20 bp, mouse
gggagcctataaagtgactt

SEQ ID NO: 652008 - DNA, 20 bp, mouse
gccacacccaccacagcttg

SEQ ID NO: 652009 - DNA, 20 bp, mouse
gcctgactatcaaagggcaa

SEQ ID NO: 652010 - DNA, 20 bp, mouse
gcaaagggcaagggcctgat

SEQ ID NO: 652011 - DNA, 20 bp, mouse
gtcctggccaggactacatg

SEQ ID NO: 652012 - DNA, 20 bp, mouse
gtggcatgcctgactatcaa

SEQ ID NO: 652013 - DNA, 20 bp, mouse
gactgcaccccatgtagtcc

SEQ ID NO: 652014 - DNA, 20 bp, mouse
gttgtaagttccagcaagaa

SEQ ID NO: 652015 - DNA, 20 bp, mouse
gaccacagcttgggggaaac

SEQ ID NO: 652016 - DNA, 20 bp, mouse
gcccccgccaacaaagggag

SEQ ID NO: 652017 - DNA, 20 bp, mouse
gcccctcccccgccaacaaa

SEQ ID NO: 652018 - DNA, 20 bp, mouse
ggtggaggaatcaacaacga

SEQ ID NO: 652019 - DNA, 20 bp, mouse
gtctcagtgccccagtacca

SEQ ID NO: 652020 - DNA, 20 bp, mouse
gcctctgccctgctgtgaag

SEQ ID NO: 652021 - DNA, 20 bp, mouse
gcccgccctagccctgagga

SEQ ID NO: 652022 - DNA, 20 bp, mouse
gcaccagaccccgcggggaa

SEQ ID NO: 652023 - DNA, 20 bp, mouse
gccagccccctgtcacgagg

SEQ ID NO: 652024 - DNA, 20 bp, mouse
gtgggctggggattcaccca

SEQ ID NO: 652025 - DNA, 20 bp, mouse
gagggaccttggtaggatgt

SEQ ID NO: 652026 - DNA, 20 bp, mouse
gaggggagtcatgcttggta

SEQ ID NO: 652027 - DNA, 20 bp, mouse
gcaactacatagatctagtg

SEQ ID NO: 652028 - DNA, 20 bp, mouse
ggcaagaggggagtcatgct

SEQ ID NO: 652029 - DNA, 20 bp, mouse
gatctagtgaggtatagatc

SEQ ID NO: 652030 - DNA, 20 bp, mouse
gagtgaggtatagatctgga

SEQ ID NO: 652031 - DNA, 20 bp, mouse
gaacaaaaggacaagtattt

SEQ ID NO: 652032 - DNA, 20 bp, mouse
gaaaggacgccggtttgtgg

SEQ ID NO: 652033 - DNA, 20 bp, mouse
gaagtatttaggcatcgtta

SEQ ID NO: 652034 - DNA, 20 bp, mouse
ggtagtcatatgctgtgtgt

SEQ ID NO: 652035 - DNA, 20 bp, mouse
gggcatgggccaccacaaac

SEQ ID NO: 652036 - DNA, 20 bp, mouse
gccaccaaagatttcacaac

SEQ ID NO: 652037 - DNA, 20 bp, mouse
gaaagcgctgcgctttggaa

SEQ ID NO: 652038 - DNA, 20 bp, mouse
gaggcccgttgtgaaatctt

SEQ ID NO: 652039 - DNA, 20 bp, mouse
gaagctaaagcgctgcgctt

SEQ ID NO: 652040 - DNA, 20 bp, mouse
gagtaccaggagcaatacct

SEQ ID NO: 652041 - DNA, 20 bp, mouse
ggcaatctaaggaagggaga

SEQ ID NO: 652042 - DNA, 20 bp, mouse
gctccaagcaatctaaggaa

SEQ ID NO: 652043 - DNA, 20 bp, mouse
gaaagaatcctgatgattac

SEQ ID NO: 652044 - DNA, 20 bp, mouse
gtctttggtgggtgcttctc

SEQ ID NO: 652045 - DNA, 20 bp, mouse
gtcattgaccacacttctcc

SEQ ID NO: 652046 - DNA, 20 bp, mouse
gggaccccatatagtagtat

SEQ ID NO: 652047 - DNA, 20 bp, mouse
gaggaggcggcgtcttacag

SEQ ID NO: 652048 - DNA, 20 bp, mouse
gtggaaggttactaggggtg

SEQ ID NO: 652049 - DNA, 20 bp, mouse
gggagacattcaagacacag

SEQ ID NO: 652050 - DNA, 20 bp, mouse
ggagagaattcaagccacga

SEQ ID NO: 652051 - DNA, 20 bp, mouse
gctctccaatactactatat

SEQ ID NO: 652052 - DNA, 20 bp, mouse
gaagagacagacgtgtaaga

SEQ ID NO: 652053 - DNA, 20 bp, mouse
gcacgatggattatgtaaac

SEQ ID NO: 652054 - DNA, 20 bp, mouse
gtaagacgccgcctcctaaa

SEQ ID NO: 652055 - DNA, 20 bp, mouse
gcatgtgtttgaacagctgg

SEQ ID NO: 652056 - DNA, 20 bp, mouse
gtggcaggcatcatgcccag

SEQ ID NO: 652057 - DNA, 20 bp, mouse
gtgagatggcaaaagatgct

SEQ ID NO: 652058 - DNA, 20 bp, mouse
gttcaggtggatttatggat

SEQ ID NO: 652059 - DNA, 20 bp, mouse
ggatgtggcaacaccttctc

SEQ ID NO: 652060 - DNA, 20 bp, mouse
gccaccctgctgatctacca

SEQ ID NO: 652061 - DNA, 20 bp, mouse
gagagagagagacactaggt

SEQ ID NO: 652062 - DNA, 20 bp, mouse
gctgctgatctaccatggaa

SEQ ID NO: 652063 - DNA, 20 bp, mouse
gccatggaaaggaactgatg

SEQ ID NO: 652064 - DNA, 20 bp, mouse
gcataataaaacaatccact

SEQ ID NO: 652065 - DNA, 20 bp, mouse
ggatgcttggtctctaaatg

SEQ ID NO: 652066 - DNA, 20 bp, mouse
gccctccctggatgctctga

SEQ ID NO: 652067 - DNA, 20 bp, mouse
gctgtccctgataaccagct

SEQ ID NO: 652068 - DNA, 20 bp, mouse
gtttccaaggacaggcacca

SEQ ID NO: 652069 - DNA, 20 bp, mouse
ggctctcgggaactggtttt

SEQ ID NO: 652070 - DNA, 20 bp, mouse
gcccctcagagcatccaggg

SEQ ID NO: 652071 - DNA, 20 bp, mouse
gtgcctgtgcacttcaacct

SEQ ID NO: 652072 - DNA, 20 bp, mouse
gcaaacatggtggggcatgc

SEQ ID NO: 652073 - DNA, 20 bp, mouse
ggtgctagtctcagtactac

SEQ ID NO: 652074 - DNA, 20 bp, mouse
gttcccgagagccccgtaaa

SEQ ID NO: 652075 - DNA, 20 bp, mouse
gacacaggtacgagcttgtg

SEQ ID NO: 652076 - DNA, 20 bp, mouse
gtactttgtcttaaaaaggg

SEQ ID NO: 652077 - DNA, 20 bp, mouse
gggaacttgatacatagacc

SEQ ID NO: 652078 - DNA, 20 bp, mouse
gagatactttgtcttaaaaa

SEQ ID NO: 652079 - DNA, 20 bp, mouse
gctcactatgtagttcttgt

SEQ ID NO: 652080 - DNA, 20 bp, mouse
gctatgtagttcttgttggc

SEQ ID NO: 652081 - DNA, 20 bp, mouse
gcagtggctcataggcatag

SEQ ID NO: 652082 - DNA, 20 bp, mouse
ggatgtgtcaagagcttctc

SEQ ID NO: 652083 - DNA, 20 bp, mouse
gctgctcatcagctctggac

SEQ ID NO: 652084 - DNA, 20 bp, mouse
gccaccctgctcatcagctc

SEQ ID NO: 652085 - DNA, 20 bp, mouse
gtggcaggcatcatgactgg

SEQ ID NO: 652086 - DNA, 20 bp, mouse
gatacttcgtcttaaaaaga

SEQ ID NO: 652087 - DNA, 20 bp, mouse
gggaacttgatacatagacc

SEQ ID NO: 652088 - DNA, 20 bp, mouse
gctcactatgtagttcttgt

SEQ ID NO: 652089 - DNA, 20 bp, mouse
gctatgtagttcttgttggc

SEQ ID NO: 652090 - DNA, 20 bp, mouse
gcagtggctcataggcttag

SEQ ID NO: 652091 - DNA, 20 bp, mouse
ggatgtgtcaagagcttctc

SEQ ID NO: 652092 - DNA, 20 bp, mouse
gctgctcatcagctctggac

SEQ ID NO: 652093 - DNA, 20 bp, mouse
gccaccctgctcatcagctc

SEQ ID NO: 652094 - DNA, 20 bp, mouse
gtggcaggcatcatgactgg

SEQ ID NO: 652095 - DNA, 20 bp, mouse
gaggcagcaggaagcaacag

SEQ ID NO: 652096 - DNA, 20 bp, mouse
gcacctcacagtgtgtgtaa

SEQ ID NO: 652097 - DNA, 20 bp, mouse
gtgggccaatggctggaatg

SEQ ID NO: 652098 - DNA, 20 bp, mouse
ggggaacggaattatgaaac

SEQ ID NO: 652099 - DNA, 20 bp, mouse
gggactgattggaggactct

SEQ ID NO: 652100 - DNA, 20 bp, mouse
gtgcctgctggactgattgg

SEQ ID NO: 652101 - DNA, 20 bp, mouse
gcccagcaaggtccctattc

SEQ ID NO: 652102 - DNA, 20 bp, mouse
gcccagaatagggaccttgc

SEQ ID NO: 652103 - DNA, 20 bp, mouse
gttaccctgagccacgccaa

SEQ ID NO: 652104 - DNA, 20 bp, mouse
gctctgagagacagcgggga

SEQ ID NO: 652105 - DNA, 20 bp, mouse
gggcactgtgaccagtatca

SEQ ID NO: 652106 - DNA, 20 bp, mouse
gtggttcaaggaataccgaa

SEQ ID NO: 652107 - DNA, 20 bp, mouse
gtgtgtgcgtgcctgcgtat

SEQ ID NO: 652108 - DNA, 20 bp, mouse
gtatggagctaagtgtgatc

SEQ ID NO: 652109 - DNA, 20 bp, mouse
gacacagtgaacctatacgc

SEQ ID NO: 652110 - DNA, 20 bp, mouse
gtgggtgctgcgccacctag

SEQ ID NO: 652111 - DNA, 20 bp, mouse
gcctagaggcaaaaactgtt

SEQ ID NO: 652112 - DNA, 20 bp, mouse
gtgttgtttaaactggttca

SEQ ID NO: 652113 - DNA, 20 bp, mouse
ggttagcatgttgtttaaac

SEQ ID NO: 652114 - DNA, 20 bp, mouse
gtttgaaatacacagctgta

SEQ ID NO: 652115 - DNA, 20 bp, mouse
ggttaggacacaaaaacttt

SEQ ID NO: 652116 - DNA, 20 bp, mouse
gaggaaacttgtggcttgct

SEQ ID NO: 652117 - DNA, 20 bp, mouse
gacactgcgcatggcatcct

SEQ ID NO: 652118 - DNA, 20 bp, mouse
gtaggctcctagaccttagt

SEQ ID NO: 652119 - DNA, 20 bp, mouse
gggctttctcttttctgctt

SEQ ID NO: 652120 - DNA, 20 bp, mouse
gtaggtctgaaggcctacta

SEQ ID NO: 652121 - DNA, 20 bp, mouse
ggacctgcctctacagacta

SEQ ID NO: 652122 - DNA, 20 bp, mouse
gttcctgctgacctactcaa

SEQ ID NO: 652123 - DNA, 20 bp, mouse
gggactgagcagagcccagg

SEQ ID NO: 652124 - DNA, 20 bp, mouse
gggctgcaggcaaggaaaga

SEQ ID NO: 652125 - DNA, 20 bp, mouse
gacaggaagtaatctgtgta

SEQ ID NO: 652126 - DNA, 20 bp, mouse
gaatagaacccaggaggtat

SEQ ID NO: 652127 - DNA, 20 bp, mouse
gtcaactggacccaggatat

SEQ ID NO: 652128 - DNA, 20 bp, mouse
gctggacccaggatatggga

SEQ ID NO: 652129 - DNA, 20 bp, mouse
ggtcagcagagagtgtggaa

SEQ ID NO: 652130 - DNA, 20 bp, mouse
gagggtctcctactctatag

SEQ ID NO: 652131 - DNA, 20 bp, mouse
gagagaaagccccatttcta

SEQ ID NO: 652132 - DNA, 20 bp, mouse
gcagagcagggaatcctgaa

SEQ ID NO: 652133 - DNA, 20 bp, mouse
gcagcaccatcccatatcct

SEQ ID NO: 652134 - DNA, 20 bp, mouse
gaaaggtcactctcttgagt

SEQ ID NO: 652135 - DNA, 20 bp, mouse
gagacctgcctctatagagt

SEQ ID NO: 652136 - DNA, 20 bp, mouse
gccggcgcgcagggcctcgt

SEQ ID NO: 652137 - DNA, 20 bp, mouse
gacgccggtaaggagatgga

SEQ ID NO: 652138 - DNA, 20 bp, mouse
gcacccgctgcgctgcacag

SEQ ID NO: 652139 - DNA, 20 bp, mouse
gggttgagccccaagagcag

SEQ ID NO: 652140 - DNA, 20 bp, mouse
gcgaggggacccacagttcg

SEQ ID NO: 652141 - DNA, 20 bp, mouse
gcggaccggaccctcctccc

SEQ ID NO: 652142 - DNA, 20 bp, mouse
ggacccctgagcatcttgag

SEQ ID NO: 652143 - DNA, 20 bp, mouse
gtgcgggaaaagtcctgagg

SEQ ID NO: 652144 - DNA, 20 bp, mouse
gcaagagcagaggcttatat

SEQ ID NO: 652145 - DNA, 20 bp, mouse
ggtgcagcctcaatccccgg

SEQ ID NO: 652146 - DNA, 20 bp, mouse
gacgctgcgcatggtatcct

SEQ ID NO: 652147 - DNA, 20 bp, mouse
gtaggtctgagggactacta

SEQ ID NO: 652148 - DNA, 20 bp, mouse
gacataaaaaatgaaaacaa

SEQ ID NO: 652149 - DNA, 20 bp, mouse
gctatgaacattgatggact

SEQ ID NO: 652150 - DNA, 20 bp, mouse
gaacgaaagagaaagcccca

SEQ ID NO: 652151 - DNA, 20 bp, mouse
gttgtttatggtgttacccc

SEQ ID NO: 652152 - DNA, 20 bp, mouse
gttcctgctgacctactcaa

SEQ ID NO: 652153 - DNA, 20 bp, mouse
ggacctgcctctacagacta

SEQ ID NO: 652154 - DNA, 20 bp, mouse
gggactgagcagagcccagg

SEQ ID NO: 652155 - DNA, 20 bp, mouse
gggctgcaggcaaggaaaga

SEQ ID NO: 652156 - DNA, 20 bp, mouse
gtgaaaccatcagaagggat

SEQ ID NO: 652157 - DNA, 20 bp, mouse
gtgccctgaaaccatcagaa

SEQ ID NO: 652158 - DNA, 20 bp, mouse
ggaagaagagggctcctatc

SEQ ID NO: 652159 - DNA, 20 bp, mouse
gccatcagaagggatggggt

SEQ ID NO: 652160 - DNA, 20 bp, mouse
ggggcatcctcagagcaggg

SEQ ID NO: 652161 - DNA, 20 bp, mouse
gggagactgcagtgggcttg

SEQ ID NO: 652162 - DNA, 20 bp, mouse
gtgaccctgagagatcatca

SEQ ID NO: 652163 - DNA, 20 bp, mouse
ggggtccttgatgatctctc

SEQ ID NO: 652164 - DNA, 20 bp, mouse
gatagaagcaggggctggtt

SEQ ID NO: 652165 - DNA, 20 bp, mouse
gactctgctcgggttccagc

SEQ ID NO: 652166 - DNA, 20 bp, mouse
gaggttagttaatgcatcat

SEQ ID NO: 652167 - DNA, 20 bp, mouse
gagaacctctctgtctccat

SEQ ID NO: 652168 - DNA, 20 bp, mouse
gcactggaatgggcatgtgt

SEQ ID NO: 652169 - DNA, 20 bp, mouse
gcaatgctggacgtgatcag

SEQ ID NO: 652170 - DNA, 20 bp, mouse
gactgaaagtctcacctccc

SEQ ID NO: 652171 - DNA, 20 bp, mouse
gccaatcaacacactggaat

SEQ ID NO: 652172 - DNA, 20 bp, mouse
ggattggtccatggctgccc

SEQ ID NO: 652173 - DNA, 20 bp, mouse
gaactcaaaagagtgacctc

SEQ ID NO: 652174 - DNA, 20 bp, mouse
gtcggcagagcaggcaatgc

SEQ ID NO: 652175 - DNA, 20 bp, mouse
gtatgctcccaactgggaaa

SEQ ID NO: 652176 - DNA, 20 bp, mouse
gaggttagttaatgcatcat

SEQ ID NO: 652177 - DNA, 20 bp, mouse
gtaactaacctgagaacccc

SEQ ID NO: 652178 - DNA, 20 bp, mouse
gagaacctctctgtctccgt

SEQ ID NO: 652179 - DNA, 20 bp, mouse
gactgaaagtctcacctccc

SEQ ID NO: 652180 - DNA, 20 bp, mouse
gcactggaatgggcatgtgt

SEQ ID NO: 652181 - DNA, 20 bp, mouse
gcaatgctggacgtgatcag

SEQ ID NO: 652182 - DNA, 20 bp, mouse
ggattggtccatggctgccc

SEQ ID NO: 652183 - DNA, 20 bp, mouse
gccaatcaacacactggaat

SEQ ID NO: 652184 - DNA, 20 bp, mouse
gagacagagaggttctcctg

SEQ ID NO: 652185 - DNA, 20 bp, mouse
gtatgctcccaactgggaaa

SEQ ID NO: 652186 - DNA, 20 bp, mouse
gggcgtcagtagctattctc

SEQ ID NO: 652187 - DNA, 20 bp, mouse
gaaaggcagggtatccccac

SEQ ID NO: 652188 - DNA, 20 bp, mouse
gacccctgctgccttcggcc

SEQ ID NO: 652189 - DNA, 20 bp, mouse
gaacgcaggaagagaaccac

SEQ ID NO: 652190 - DNA, 20 bp, mouse
gacacaggaggtctcaaaaa

SEQ ID NO: 652191 - DNA, 20 bp, mouse
gacagcacttgtttcaagtt

SEQ ID NO: 652192 - DNA, 20 bp, mouse
gtgggcagcctggggcatgt

SEQ ID NO: 652193 - DNA, 20 bp, mouse
ggaagcatgtgacccattaa

SEQ ID NO: 652194 - DNA, 20 bp, mouse
gcatgtgacccattaaggga

SEQ ID NO: 652195 - DNA, 20 bp, mouse
gcaagttggggaagagcctg

SEQ ID NO: 652196 - DNA, 20 bp, mouse
gtggttgcatccggaagagg

SEQ ID NO: 652197 - DNA, 20 bp, mouse
ggccctgctgcgatgagaag

SEQ ID NO: 652198 - DNA, 20 bp, mouse
gagactgggtttctactgta

SEQ ID NO: 652199 - DNA, 20 bp, mouse
ggagtcactgggtcatgccc

SEQ ID NO: 652200 - DNA, 20 bp, mouse
gtagcaggttaaagggtcaa

SEQ ID NO: 652201 - DNA, 20 bp, mouse
ggcatgacccagtgactctg

SEQ ID NO: 652202 - DNA, 20 bp, mouse
gaaatgcagcatggaagact

SEQ ID NO: 652203 - DNA, 20 bp, mouse
gaccactctacaatataccc

SEQ ID NO: 652204 - DNA, 20 bp, mouse
ggggtcaagggtcgaggcga

SEQ ID NO: 652205 - DNA, 20 bp, mouse
gcctaaggcctcagagtcac

SEQ ID NO: 652206 - DNA, 20 bp, mouse
ggagactggactatggtcta

SEQ ID NO: 652207 - DNA, 20 bp, mouse
gctctgtagcctctaggcag

SEQ ID NO: 652208 - DNA, 20 bp, mouse
gcaaccaggtgcagttgccg

SEQ ID NO: 652209 - DNA, 20 bp, mouse
ggagccttgcctgtcaggat

SEQ ID NO: 652210 - DNA, 20 bp, mouse
ggaccgcctagccacaaagg

SEQ ID NO: 652211 - DNA, 20 bp, mouse
gggctacagagactggacta

SEQ ID NO: 652212 - DNA, 20 bp, mouse
gccactataaccccagtacg

SEQ ID NO: 652213 - DNA, 20 bp, mouse
gccccagtacggggatttat

SEQ ID NO: 652214 - DNA, 20 bp, mouse
gtcccataaatccccgtact

SEQ ID NO: 652215 - DNA, 20 bp, mouse
gaggaggagccttgcctgtc

SEQ ID NO: 652216 - DNA, 20 bp, mouse
gacacgccacctagcggcgc

SEQ ID NO: 652217 - DNA, 20 bp, mouse
gcaaggaggcaggactgtct

SEQ ID NO: 652218 - DNA, 20 bp, mouse
gaaaggctgcaggtccgtgt

SEQ ID NO: 652219 - DNA, 20 bp, mouse
gcgctgtggtgagaagaagg

SEQ ID NO: 652220 - DNA, 20 bp, mouse
gtgagaagaaggcggttctc

SEQ ID NO: 652221 - DNA, 20 bp, mouse
gtgccaggctccggctgcga

SEQ ID NO: 652222 - DNA, 20 bp, mouse
ggcaaccgagaggcgcgcgc

SEQ ID NO: 652223 - DNA, 20 bp, mouse
gcgtgctcgctcgtggtcaa

SEQ ID NO: 652224 - DNA, 20 bp, mouse
gggaggcaggactgtctagg

SEQ ID NO: 652225 - DNA, 20 bp, mouse
gctcggcctgcgccgctagg

SEQ ID NO: 652226 - DNA, 20 bp, mouse
gctgagtgacagggataggt

SEQ ID NO: 652227 - DNA, 20 bp, mouse
gtccagttctggatgattgt

SEQ ID NO: 652228 - DNA, 20 bp, mouse
gagagtttgtcatacttctg

SEQ ID NO: 652229 - DNA, 20 bp, mouse
gtgataagccatatgagatc

SEQ ID NO: 652230 - DNA, 20 bp, mouse
gcctcacaggccatttctac

SEQ ID NO: 652231 - DNA, 20 bp, mouse
gtagctggggctggttagct

SEQ ID NO: 652232 - DNA, 20 bp, mouse
gatccctgtcactcagcaat

SEQ ID NO: 652233 - DNA, 20 bp, mouse
gtgacagatcaagaaccttg

SEQ ID NO: 652234 - DNA, 20 bp, mouse
gagcaactaaagttaatggc

SEQ ID NO: 652235 - DNA, 20 bp, mouse
gttctggatgattgtagggg

SEQ ID NO: 652236 - DNA, 20 bp, mouse
gtacaaaagcaatggcagga

SEQ ID NO: 652237 - DNA, 20 bp, mouse
gaggttagatgtatgaggac

SEQ ID NO: 652238 - DNA, 20 bp, mouse
gagcaaagggcctatctttg

SEQ ID NO: 652239 - DNA, 20 bp, mouse
gcttagaggttagatgtatg

SEQ ID NO: 652240 - DNA, 20 bp, mouse
gaaagcaatggcaggagggc

SEQ ID NO: 652241 - DNA, 20 bp, mouse
gtgtaggcgccaaagtcaat

SEQ ID NO: 652242 - DNA, 20 bp, mouse
gagcgggctcctagcgtaaa

SEQ ID NO: 652243 - DNA, 20 bp, mouse
ggctcctagcgtaaaggggc

SEQ ID NO: 652244 - DNA, 20 bp, mouse
gttggcgcctacaaaagcaa

SEQ ID NO: 652245 - DNA, 20 bp, mouse
ggcggggctatggtgacgca

SEQ ID NO: 652246 - DNA, 20 bp, mouse
gccgcccggcgtccgtccca

SEQ ID NO: 652247 - DNA, 20 bp, mouse
gcccgtcagcagtgagcccg

SEQ ID NO: 652248 - DNA, 20 bp, mouse
gaacgctgcggaagtgtagg

SEQ ID NO: 652249 - DNA, 20 bp, mouse
ggaggacggcgacaacgctg

SEQ ID NO: 652250 - DNA, 20 bp, mouse
ggagaggacaagttttcccc

SEQ ID NO: 652251 - DNA, 20 bp, mouse
ggctgcggaagtgtaggtgg

SEQ ID NO: 652252 - DNA, 20 bp, mouse
ggacaacgctgcggaagtgt

SEQ ID NO: 652253 - DNA, 20 bp, mouse
gcggtgccgctccccgtgaa

SEQ ID NO: 652254 - DNA, 20 bp, mouse
gccaggtgagcgtggggcga

SEQ ID NO: 652255 - DNA, 20 bp, mouse
gtgtaggtggcggggcgcga

SEQ ID NO: 652256 - DNA, 20 bp, mouse
gcccacaggtgcggcgtctt

SEQ ID NO: 652257 - DNA, 20 bp, mouse
ggggtctgggaaccaagttg

SEQ ID NO: 652258 - DNA, 20 bp, mouse
ggacccagagcccacaggtg

SEQ ID NO: 652259 - DNA, 20 bp, mouse
gtggggagtgatctgggtca

SEQ ID NO: 652260 - DNA, 20 bp, mouse
ggctccccgaggctccgcta

SEQ ID NO: 652261 - DNA, 20 bp, mouse
gacgccgcacctgtgggctc

SEQ ID NO: 652262 - DNA, 20 bp, mouse
gccgcgctcccgatggggtc

SEQ ID NO: 652263 - DNA, 20 bp, mouse
gtgggagaggcctgcggggt

SEQ ID NO: 652264 - DNA, 20 bp, mouse
ggggagccgcgctcccgatg

SEQ ID NO: 652265 - DNA, 20 bp, mouse
gtccgctaggggtctctgtc

SEQ ID NO: 652266 - DNA, 20 bp, mouse
gaaagagcgcggagcgtctg

SEQ ID NO: 652267 - DNA, 20 bp, mouse
gagacaccggggaagctggg

SEQ ID NO: 652268 - DNA, 20 bp, mouse
gacgcgcccgggaaggaatg

SEQ ID NO: 652269 - DNA, 20 bp, mouse
ggcggcaggcggaaaacttg

SEQ ID NO: 652270 - DNA, 20 bp, mouse
gaacttgcggagaaagagcg

SEQ ID NO: 652271 - DNA, 20 bp, mouse
gacgagacaccggggaagct

SEQ ID NO: 652272 - DNA, 20 bp, mouse
gttcctaaaggacgagacac

SEQ ID NO: 652273 - DNA, 20 bp, mouse
gaactaccgcccagcttccc

SEQ ID NO: 652274 - DNA, 20 bp, mouse
gcgcgccgacgcgcccggga

SEQ ID NO: 652275 - DNA, 20 bp, mouse
gcgggaaggaatgcggcagg

SEQ ID NO: 652276 - DNA, 20 bp, mouse
gtacgcgcgcccgacgacgg

SEQ ID NO: 652277 - DNA, 20 bp, mouse
ggcgacgtctgtcaccgcta

SEQ ID NO: 652278 - DNA, 20 bp, mouse
ggggctagtgggcctagggg

SEQ ID NO: 652279 - DNA, 20 bp, mouse
ggcccgcacggccactgctc

SEQ ID NO: 652280 - DNA, 20 bp, mouse
gcgtgcgggccgagcagtgt

SEQ ID NO: 652281 - DNA, 20 bp, mouse
ggcgtagttgaatacgtagg

SEQ ID NO: 652282 - DNA, 20 bp, mouse
gctggtagagaacccgcggt

SEQ ID NO: 652283 - DNA, 20 bp, mouse
gagacgtcgcggcgagccaa

SEQ ID NO: 652284 - DNA, 20 bp, mouse
gagcccggagtgaagaccgc

SEQ ID NO: 652285 - DNA, 20 bp, mouse
gccaatgggtgagctggagg

SEQ ID NO: 652286 - DNA, 20 bp, mouse
gcagcctcgagcaccgggga

SEQ ID NO: 652287 - DNA, 20 bp, mouse
gccgaagccccgggatcgga

SEQ ID NO: 652288 - DNA, 20 bp, mouse
ggggcccgaagccccgggat

SEQ ID NO: 652289 - DNA, 20 bp, mouse
gtgctgctgcgctggccgga

SEQ ID NO: 652290 - DNA, 20 bp, mouse
gggacaggacaccggaagtg

SEQ ID NO: 652291 - DNA, 20 bp, mouse
gcggaggggcccgaagcccc

SEQ ID NO: 652292 - DNA, 20 bp, mouse
gacagtccgggacaggacac

SEQ ID NO: 652293 - DNA, 20 bp, mouse
gccccgctgccgggatcaac

SEQ ID NO: 652294 - DNA, 20 bp, mouse
gggagggcagcctcgagcac

SEQ ID NO: 652295 - DNA, 20 bp, mouse
ggcctccagccggaacctcc

SEQ ID NO: 652296 - DNA, 20 bp, mouse
gctagcacgaggggcgggac

SEQ ID NO: 652297 - DNA, 20 bp, mouse
ggcctctgcgaggtgtgtgt

SEQ ID NO: 652298 - DNA, 20 bp, mouse
gggcgggacaggctgagagg

SEQ ID NO: 652299 - DNA, 20 bp, mouse
ggggtcttgcccaggtccgc

SEQ ID NO: 652300 - DNA, 20 bp, mouse
gctagagcgcaggggaaagc

SEQ ID NO: 652301 - DNA, 20 bp, mouse
gggagctgatggatagtctt

SEQ ID NO: 652302 - DNA, 20 bp, mouse
ggactgaaaaagcgtgtgtg

SEQ ID NO: 652303 - DNA, 20 bp, mouse
gttggtctagcacgaggggc

SEQ ID NO: 652304 - DNA, 20 bp, mouse
gagggcggagcgtcctcgat

SEQ ID NO: 652305 - DNA, 20 bp, mouse
ggcgggttggtctagcacga

SEQ ID NO: 652306 - DNA, 20 bp, mouse
gagcaaaggagctatcctca

SEQ ID NO: 652307 - DNA, 20 bp, mouse
gccggattcagacaaccggg

SEQ ID NO: 652308 - DNA, 20 bp, mouse
gaaaggagctatcctcacgg

SEQ ID NO: 652309 - DNA, 20 bp, mouse
gcctcacgggggacaactag

SEQ ID NO: 652310 - DNA, 20 bp, mouse
gttcagacagcagtcttctg

SEQ ID NO: 652311 - DNA, 20 bp, mouse
gaccgggaggctgcgagcaa

SEQ ID NO: 652312 - DNA, 20 bp, mouse
gcactgttctacctgggtat

SEQ ID NO: 652313 - DNA, 20 bp, mouse
gtagcgccactgttctacct

SEQ ID NO: 652314 - DNA, 20 bp, mouse
gtagagcagcgtgaagtttg

SEQ ID NO: 652315 - DNA, 20 bp, mouse
gctaacccagcaaactacga

SEQ ID NO: 652316 - DNA, 20 bp, mouse
gaggcgggtggagggagcaa

SEQ ID NO: 652317 - DNA, 20 bp, mouse
gaggaggctcgtgtggtgtg

SEQ ID NO: 652318 - DNA, 20 bp, mouse
ggctgcgatggatgcagaca

SEQ ID NO: 652319 - DNA, 20 bp, mouse
gctgcccagcgtaaggaggc

SEQ ID NO: 652320 - DNA, 20 bp, mouse
ggaggaaggaaaaagttggc

SEQ ID NO: 652321 - DNA, 20 bp, mouse
ggaggctggcactctagaag

SEQ ID NO: 652322 - DNA, 20 bp, mouse
gggccctgcccagcgtaagg

SEQ ID NO: 652323 - DNA, 20 bp, mouse
gtggcactctagaaggggtg

SEQ ID NO: 652324 - DNA, 20 bp, mouse
gggagggcaatgtccgtctg

SEQ ID NO: 652325 - DNA, 20 bp, mouse
gctcggccctgcccagcgta

SEQ ID NO: 652326 - DNA, 20 bp, mouse
gtgacctgagccggggaggg

SEQ ID NO: 652327 - DNA, 20 bp, mouse
ggggccctggccctgtgctg

SEQ ID NO: 652328 - DNA, 20 bp, mouse
gagggacagaggagcgtcgg

SEQ ID NO: 652329 - DNA, 20 bp, mouse
gcgcgtgcgcagtggtctcg

SEQ ID NO: 652330 - DNA, 20 bp, mouse
ggcacagcgcagccggggag

SEQ ID NO: 652331 - DNA, 20 bp, mouse
ggcggaaggcgggtgcgcgt

SEQ ID NO: 652332 - DNA, 20 bp, mouse
gcggcgagggagctgtccct

SEQ ID NO: 652333 - DNA, 20 bp, mouse
ggcactggcggaggggacaa

SEQ ID NO: 652334 - DNA, 20 bp, mouse
gcgcgtggcgcccgagctct

SEQ ID NO: 652335 - DNA, 20 bp, mouse
gtgtccctgggcactggcgg

SEQ ID NO: 652336 - DNA, 20 bp, mouse
gcctgcttggcgtcttcccc

SEQ ID NO: 652337 - DNA, 20 bp, mouse
gacccctcgctggtgagaga

SEQ ID NO: 652338 - DNA, 20 bp, mouse
gaggtccgtgacttaccccc

SEQ ID NO: 652339 - DNA, 20 bp, mouse
gggaagacgccaagcagggc

SEQ ID NO: 652340 - DNA, 20 bp, mouse
gttgcaaggaacacccacag

SEQ ID NO: 652341 - DNA, 20 bp, mouse
gctaagggcgcctcccaaga

SEQ ID NO: 652342 - DNA, 20 bp, mouse
gagcagggtacctcagcctg

SEQ ID NO: 652343 - DNA, 20 bp, mouse
gtaagtcacggacctcgtag

SEQ ID NO: 652344 - DNA, 20 bp, mouse
ggggacatggcacagttgca

SEQ ID NO: 652345 - DNA, 20 bp, mouse
gaccaatggtgtcacttgta

SEQ ID NO: 652346 - DNA, 20 bp, mouse
gcagctgtgaaagctaagat

SEQ ID NO: 652347 - DNA, 20 bp, mouse
gcctgctcctgcccacccga

SEQ ID NO: 652348 - DNA, 20 bp, mouse
gagccctgaggcagctccat

SEQ ID NO: 652349 - DNA, 20 bp, mouse
ggggtgataggccttcgggt

SEQ ID NO: 652350 - DNA, 20 bp, mouse
gtagacctgggcacgtgggg

SEQ ID NO: 652351 - DNA, 20 bp, mouse
gggtaactgaggaaaaaacg

SEQ ID NO: 652352 - DNA, 20 bp, mouse
gtatctggagtccattaatg

SEQ ID NO: 652353 - DNA, 20 bp, mouse
gtccgccatgggggagcaca

SEQ ID NO: 652354 - DNA, 20 bp, mouse
gtccggagaggctagactgt

SEQ ID NO: 652355 - DNA, 20 bp, mouse
gtagactgtgggcacttata

SEQ ID NO: 652356 - DNA, 20 bp, mouse
gacgcggggtgacagttgta

SEQ ID NO: 652357 - DNA, 20 bp, mouse
gcgcccccgcggggttccga

SEQ ID NO: 652358 - DNA, 20 bp, mouse
ggaggcgctggtggggacgc

SEQ ID NO: 652359 - DNA, 20 bp, mouse
gcaccctcggaaccccgcgg

SEQ ID NO: 652360 - DNA, 20 bp, mouse
ggactgggatactgtgaaaa

SEQ ID NO: 652361 - DNA, 20 bp, mouse
ggcgcctccaggctaggtgg

SEQ ID NO: 652362 - DNA, 20 bp, mouse
ggagtgagtgttgtactgag

SEQ ID NO: 652363 - DNA, 20 bp, mouse
gttggctctgcaggattctt

SEQ ID NO: 652364 - DNA, 20 bp, mouse
gcgtgagacgatgcccacaa

SEQ ID NO: 652365 - DNA, 20 bp, mouse
gtggagctttaagggtgggt

SEQ ID NO: 652366 - DNA, 20 bp, mouse
gtacactgggagtcagatta

SEQ ID NO: 652367 - DNA, 20 bp, mouse
gtgaagagaaattgcctcgt

SEQ ID NO: 652368 - DNA, 20 bp, mouse
gtacgggcacttgtctgatt

SEQ ID NO: 652369 - DNA, 20 bp, mouse
gtctataatgatcaggtaca

SEQ ID NO: 652370 - DNA, 20 bp, mouse
gtggattattccaatcacca

SEQ ID NO: 652371 - DNA, 20 bp, mouse
gggaaagattctgcaccatg

SEQ ID NO: 652372 - DNA, 20 bp, mouse
ggattgggtttttggagagt

SEQ ID NO: 652373 - DNA, 20 bp, mouse
gacaaccattttctaatggt

SEQ ID NO: 652374 - DNA, 20 bp, mouse
gtggttggtcagtttcaata

SEQ ID NO: 652375 - DNA, 20 bp, mouse
gacttgtctgattgggtttt

SEQ ID NO: 652376 - DNA, 20 bp, mouse
gccccccggccgcacagcgg

SEQ ID NO: 652377 - DNA, 20 bp, mouse
gccgggccacgtgacccacg

SEQ ID NO: 652378 - DNA, 20 bp, mouse
gcacagcggcggacccgccc

SEQ ID NO: 652379 - DNA, 20 bp, mouse
gcggccccggacgccggtaa

SEQ ID NO: 652380 - DNA, 20 bp, mouse
ggctgtgcggccggggggcc

SEQ ID NO: 652381 - DNA, 20 bp, mouse
gtagactggcccggcggtct

SEQ ID NO: 652382 - DNA, 20 bp, mouse
gggtccgccgctgtgcggcc

SEQ ID NO: 652383 - DNA, 20 bp, mouse
gcggggggccgggggtgcgc

SEQ ID NO: 652384 - DNA, 20 bp, mouse
gcggtcgcgcgagcccaagg

SEQ ID NO: 652385 - DNA, 20 bp, mouse
gcccggacgccggtaaaggc

SEQ ID NO: 652386 - DNA, 20 bp, mouse
gcggggctcacctgacagga

SEQ ID NO: 652387 - DNA, 20 bp, mouse
ggcactgagctggaacctcc

SEQ ID NO: 652388 - DNA, 20 bp, mouse
gggtctctaagctgacatta

SEQ ID NO: 652389 - DNA, 20 bp, mouse
gtgtcaggtgagccccgagc

SEQ ID NO: 652390 - DNA, 20 bp, mouse
ggccagtaaggaggaacact

SEQ ID NO: 652391 - DNA, 20 bp, mouse
gagcacaggggatcccccac

SEQ ID NO: 652392 - DNA, 20 bp, mouse
gggagggggccaggccagta

SEQ ID NO: 652393 - DNA, 20 bp, mouse
gtgcagcaggccttggatgt

SEQ ID NO: 652394 - DNA, 20 bp, mouse
ggaagtctagcctgggactt

SEQ ID NO: 652395 - DNA, 20 bp, mouse
gacaggggatcccccaccgg

SEQ ID NO: 652396 - DNA, 20 bp, mouse
gtccacctctgacctcacaa

SEQ ID NO: 652397 - DNA, 20 bp, mouse
gtccaggggagaggtcagta

SEQ ID NO: 652398 - DNA, 20 bp, mouse
ggggagaggtcagtagggca

SEQ ID NO: 652399 - DNA, 20 bp, mouse
ggacttggcttaagtggcat

SEQ ID NO: 652400 - DNA, 20 bp, mouse
gccatggagactgagttctg

SEQ ID NO: 652401 - DNA, 20 bp, mouse
gtcctcaggggtccccatct

SEQ ID NO: 652402 - DNA, 20 bp, mouse
gagcctgcagaaggccacag

SEQ ID NO: 652403 - DNA, 20 bp, mouse
gctgggcctcatagtcccag

SEQ ID NO: 652404 - DNA, 20 bp, mouse
gtcaggtggagggctctctg

SEQ ID NO: 652405 - DNA, 20 bp, mouse
gaacctctgtggccttctgc

SEQ ID NO: 652406 - DNA, 20 bp, mouse
gcgagtgtgtgagctgatga

SEQ ID NO: 652407 - DNA, 20 bp, mouse
gataaagcccgaatgggagg

SEQ ID NO: 652408 - DNA, 20 bp, mouse
gggaaagagacccacgagga

SEQ ID NO: 652409 - DNA, 20 bp, mouse
ggcctgaggaaggtcccagc

SEQ ID NO: 652410 - DNA, 20 bp, mouse
gtgtggaaaaggtcctgggt

SEQ ID NO: 652411 - DNA, 20 bp, mouse
ggacattccaccatcctcgt

SEQ ID NO: 652412 - DNA, 20 bp, mouse
gtcgctgggtcaggtgatca

SEQ ID NO: 652413 - DNA, 20 bp, mouse
gaaagcaataaagcccgaat

SEQ ID NO: 652414 - DNA, 20 bp, mouse
ggaggggtgcatctcactgg

SEQ ID NO: 652415 - DNA, 20 bp, mouse
gcgtgggatcaatgattgct

SEQ ID NO: 652416 - DNA, 20 bp, mouse
gagtgcctcggggagttcat

SEQ ID NO: 652417 - DNA, 20 bp, mouse
ggggttgccaaaccagagat

SEQ ID NO: 652418 - DNA, 20 bp, mouse
gaaggctgaagttgtgtaac

SEQ ID NO: 652419 - DNA, 20 bp, mouse
gcaaacaaatagcaatgagc

SEQ ID NO: 652420 - DNA, 20 bp, mouse
gaaactgcccacttccgaat

SEQ ID NO: 652421 - DNA, 20 bp, mouse
gagtgtaagggaaagagact

SEQ ID NO: 652422 - DNA, 20 bp, mouse
ggtaaatctcttctggacca

SEQ ID NO: 652423 - DNA, 20 bp, mouse
gaaatagcaatgagctggga

SEQ ID NO: 652424 - DNA, 20 bp, mouse
gtacaaaaagagtcattttg

SEQ ID NO: 652425 - DNA, 20 bp, mouse
gaagagatgctacgttggtt

SEQ ID NO: 652426 - DNA, 20 bp, mouse
ggcgtgtaggattgggtcat

SEQ ID NO: 652427 - DNA, 20 bp, mouse
gaacatacagcgtgtaggat

SEQ ID NO: 652428 - DNA, 20 bp, mouse
ggattgggtcatagggagag

SEQ ID NO: 652429 - DNA, 20 bp, mouse
gctagtgggcccggaagtca

SEQ ID NO: 652430 - DNA, 20 bp, mouse
ggaagcagaactagtgggcc

SEQ ID NO: 652431 - DNA, 20 bp, mouse
gtagggggcaataaagagac

SEQ ID NO: 652432 - DNA, 20 bp, mouse
gtgttgaatgtgattaataa

SEQ ID NO: 652433 - DNA, 20 bp, mouse
gaagataacatacagcgtgt

SEQ ID NO: 652434 - DNA, 20 bp, mouse
gaggtgggagttgaaagaat

SEQ ID NO: 652435 - DNA, 20 bp, mouse
gaaaaggggtgataggttga

SEQ ID NO: 652436 - DNA, 20 bp, mouse
gacaaactgtgtaagtagca

SEQ ID NO: 652437 - DNA, 20 bp, mouse
ggcccacctgcgggaagctc

SEQ ID NO: 652438 - DNA, 20 bp, mouse
gtgctcaaaccttgacggga

SEQ ID NO: 652439 - DNA, 20 bp, mouse
gggaagaaaacttgcaggag

SEQ ID NO: 652440 - DNA, 20 bp, mouse
gtgcgcgtgccttcctttac

SEQ ID NO: 652441 - DNA, 20 bp, mouse
gcttcagtggactttgaatt

SEQ ID NO: 652442 - DNA, 20 bp, mouse
gaaagatgctcaaaccttga

SEQ ID NO: 652443 - DNA, 20 bp, mouse
gaggaaggcacgcgcaagac

SEQ ID NO: 652444 - DNA, 20 bp, mouse
gaggtgcaggggcgagaacc

SEQ ID NO: 652445 - DNA, 20 bp, mouse
gtccggggaagaaaacttgc

SEQ ID NO: 652446 - DNA, 20 bp, mouse
gcctgcgcgccaatcaggac

SEQ ID NO: 652447 - DNA, 20 bp, mouse
gtaggaggggtgggctcaaa

SEQ ID NO: 652448 - DNA, 20 bp, mouse
gcccatcaagacagggccag

SEQ ID NO: 652449 - DNA, 20 bp, mouse
gaaaagcctagggacggtgg

SEQ ID NO: 652450 - DNA, 20 bp, mouse
gcggaatgtgggtcgtgttc

SEQ ID NO: 652451 - DNA, 20 bp, mouse
ggagcccacccctcctaatc

SEQ ID NO: 652452 - DNA, 20 bp, mouse
ggttccggattaggaggggt

SEQ ID NO: 652453 - DNA, 20 bp, mouse
gtccgctggccctgtcttga

SEQ ID NO: 652454 - DNA, 20 bp, mouse
gtcgtgttccggattaggag

SEQ ID NO: 652455 - DNA, 20 bp, mouse
ggcaaaaagcctagggacgg

SEQ ID NO: 652456 - DNA, 20 bp, mouse
gactgggctgggctgaactg

SEQ ID NO: 652457 - DNA, 20 bp, mouse
gtggggcctcatctagaatg

SEQ ID NO: 652458 - DNA, 20 bp, mouse
gcctccaagctgtcctatcc

SEQ ID NO: 652459 - DNA, 20 bp, mouse
ggcccagccctcccgaccaa

SEQ ID NO: 652460 - DNA, 20 bp, mouse
ggggctagactcagcctgcc

SEQ ID NO: 652461 - DNA, 20 bp, mouse
gcaagtcttagaccctgatc

SEQ ID NO: 652462 - DNA, 20 bp, mouse
gggcctaaaagccagaaggg

SEQ ID NO: 652463 - DNA, 20 bp, mouse
gaactgggggctggacgcct

SEQ ID NO: 652464 - DNA, 20 bp, mouse
ggtggtggctcccattggtc

SEQ ID NO: 652465 - DNA, 20 bp, mouse
ggaagggtggtggctcccat

SEQ ID NO: 652466 - DNA, 20 bp, mouse
gggaggaagtatctgtccca

SEQ ID NO: 652467 - DNA, 20 bp, mouse
gggtgctggcgtggcctgag

SEQ ID NO: 652468 - DNA, 20 bp, mouse
ggctggcgtggcctgagggg

SEQ ID NO: 652469 - DNA, 20 bp, mouse
gtatctgtcccaggggatta

SEQ ID NO: 652470 - DNA, 20 bp, mouse
ggcaccgtgcaaactaaaat

SEQ ID NO: 652471 - DNA, 20 bp, mouse
gtgggcctcttcagcaggtt

SEQ ID NO: 652472 - DNA, 20 bp, mouse
gtggtcccctgaggcctcac

SEQ ID NO: 652473 - DNA, 20 bp, mouse
gtaagggctagctagaatca

SEQ ID NO: 652474 - DNA, 20 bp, mouse
ggcaaaataggctccctgaa

SEQ ID NO: 652475 - DNA, 20 bp, mouse
gcctcacagggtatgtatcc

SEQ ID NO: 652476 - DNA, 20 bp, mouse
gcgcccccgccgttgagctc

SEQ ID NO: 652477 - DNA, 20 bp, mouse
gagggcgcgtccccccgggg

SEQ ID NO: 652478 - DNA, 20 bp, mouse
ggggggcggcccgagctcaa

SEQ ID NO: 652479 - DNA, 20 bp, mouse
gggcggcccgagctcaacgg

SEQ ID NO: 652480 - DNA, 20 bp, mouse
ggacctgggcgggtggccag

SEQ ID NO: 652481 - DNA, 20 bp, mouse
gcccagtggcgaccctggaa

SEQ ID NO: 652482 - DNA, 20 bp, mouse
gaacccagcgagggtctcag

SEQ ID NO: 652483 - DNA, 20 bp, mouse
gtgggcagacgcgctccagg

SEQ ID NO: 652484 - DNA, 20 bp, mouse
gtcggccgcgcctgccgccc

SEQ ID NO: 652485 - DNA, 20 bp, mouse
ggcggcggggcaggccgtcc

SEQ ID NO: 652486 - DNA, 20 bp, mouse
gtctggggaagggactaaga

SEQ ID NO: 652487 - DNA, 20 bp, mouse
gagcaaaggcggttgggtaa

SEQ ID NO: 652488 - DNA, 20 bp, mouse
ggctgaggggaacaagatgt

SEQ ID NO: 652489 - DNA, 20 bp, mouse
gccccgccccgacggctcga

SEQ ID NO: 652490 - DNA, 20 bp, mouse
ggggaagggactaagatgga

SEQ ID NO: 652491 - DNA, 20 bp, mouse
gcgcccgccttcaggtggtt

SEQ ID NO: 652492 - DNA, 20 bp, mouse
gaggggcccaaaccacctga

SEQ ID NO: 652493 - DNA, 20 bp, mouse
gctcagaaatgtctggggaa

SEQ ID NO: 652494 - DNA, 20 bp, mouse
gaaccgcctttgcttatcag

SEQ ID NO: 652495 - DNA, 20 bp, mouse
gagactgaggaagagcatgg

SEQ ID NO: 652496 - DNA, 20 bp, mouse
gagaggccacctaggaaaga

SEQ ID NO: 652497 - DNA, 20 bp, mouse
gccaactagtcccaatctgt

SEQ ID NO: 652498 - DNA, 20 bp, mouse
gggactagttggggccctct

SEQ ID NO: 652499 - DNA, 20 bp, mouse
ggaccaggaccccacagatt

SEQ ID NO: 652500 - DNA, 20 bp, mouse
gaagtctgaggatagacaat

SEQ ID NO: 652501 - DNA, 20 bp, mouse
gcctaggaaagagggctgag

SEQ ID NO: 652502 - DNA, 20 bp, mouse
gaccacagcaggcaggatgt

SEQ ID NO: 652503 - DNA, 20 bp, mouse
ggtggccaggctagagggac

SEQ ID NO: 652504 - DNA, 20 bp, mouse
ggatagacaataggtggaag

SEQ ID NO: 652505 - DNA, 20 bp, mouse
gtcttcacacatctgagtct

SEQ ID NO: 652506 - DNA, 20 bp, mouse
gagtcactcggggctgtgaa

SEQ ID NO: 652507 - DNA, 20 bp, mouse
gcttgagggcacccacggga

SEQ ID NO: 652508 - DNA, 20 bp, mouse
gcctactcgctcccctcccg

SEQ ID NO: 652509 - DNA, 20 bp, mouse
gggtccttgagggcacccac

SEQ ID NO: 652510 - DNA, 20 bp, mouse
gagagcacattagtcactcg

SEQ ID NO: 652511 - DNA, 20 bp, mouse
gccccaaaatccctcccggt

SEQ ID NO: 652512 - DNA, 20 bp, mouse
gtgcgcgcctcccaccggga

SEQ ID NO: 652513 - DNA, 20 bp, mouse
gactcggggctgtgaagggg

SEQ ID NO: 652514 - DNA, 20 bp, mouse
ggggagcgagtaggcgcgga

SEQ ID NO: 652515 - DNA, 20 bp, mouse
gcggtccccaaaatccctcc

SEQ ID NO: 652516 - DNA, 20 bp, mouse
ggacccgcgccgtttccggt

SEQ ID NO: 652517 - DNA, 20 bp, mouse
gcgcaggcgaagagaaagaa

SEQ ID NO: 652518 - DNA, 20 bp, mouse
gcggaaacggcgcgggtcaa

SEQ ID NO: 652519 - DNA, 20 bp, mouse
gggcgcgggtcaaagggcgg

SEQ ID NO: 652520 - DNA, 20 bp, mouse
gagcagcaccaaataaacgc

SEQ ID NO: 652521 - DNA, 20 bp, mouse
ggcaaatcctgggctaacag

SEQ ID NO: 652522 - DNA, 20 bp, mouse
gcccaagccacgtctccaac

SEQ ID NO: 652523 - DNA, 20 bp, mouse
gagccaaacctgcaaatcct

SEQ ID NO: 652524 - DNA, 20 bp, mouse
gcgggtcaaagggcgggggg

SEQ ID NO: 652525 - DNA, 20 bp, mouse
gctccaaccggaaacggcgc

SEQ ID NO: 652526 - DNA, 20 bp, mouse
gttaagttagagtggtgctg

SEQ ID NO: 652527 - DNA, 20 bp, mouse
gggctggtccgtgacgtcac

SEQ ID NO: 652528 - DNA, 20 bp, mouse
gaaaacccagctgacgcggg

SEQ ID NO: 652529 - DNA, 20 bp, mouse
gaacctcccgcctccaccca

SEQ ID NO: 652530 - DNA, 20 bp, mouse
ggatcgagccctgattacgc

SEQ ID NO: 652531 - DNA, 20 bp, mouse
ggacgtcacggaccagccct

SEQ ID NO: 652532 - DNA, 20 bp, mouse
gcacgggcggtggctccagc

SEQ ID NO: 652533 - DNA, 20 bp, mouse
gccaaaaacccagctgacgc

SEQ ID NO: 652534 - DNA, 20 bp, mouse
gacttaaaacacaacgcgag

SEQ ID NO: 652535 - DNA, 20 bp, mouse
gactttggtacttaatgtcc

SEQ ID NO: 652536 - DNA, 20 bp, mouse
gtgaacatggtgagcggagt

SEQ ID NO: 652537 - DNA, 20 bp, mouse
ggcggcgtgaacatggtgag

SEQ ID NO: 652538 - DNA, 20 bp, mouse
gtccggaagaaacaggagtg

SEQ ID NO: 652539 - DNA, 20 bp, mouse
gcgagtctatatctggccaa

SEQ ID NO: 652540 - DNA, 20 bp, mouse
ggtcgcgctgcgagcgattc

SEQ ID NO: 652541 - DNA, 20 bp, mouse
gagagttttggggagcaaac

SEQ ID NO: 652542 - DNA, 20 bp, mouse
gcggaggcggaagctacttt

SEQ ID NO: 652543 - DNA, 20 bp, mouse
ggaagcaccgagtctatatc

SEQ ID NO: 652544 - DNA, 20 bp, mouse
gccggcaaaggccaacccgg

SEQ ID NO: 652545 - DNA, 20 bp, mouse
ggagcgattccggaagaaac

SEQ ID NO: 652546 - DNA, 20 bp, mouse
ggggtcccgggctagcactc

SEQ ID NO: 652547 - DNA, 20 bp, mouse
gccggcactagaacgagcaa

SEQ ID NO: 652548 - DNA, 20 bp, mouse
gggagccagagtgctagccc

SEQ ID NO: 652549 - DNA, 20 bp, mouse
gaaggacattacacctccta

SEQ ID NO: 652550 - DNA, 20 bp, mouse
gtccggaaacagagcgacct

SEQ ID NO: 652551 - DNA, 20 bp, mouse
gactagaacgagcaagggtg

SEQ ID NO: 652552 - DNA, 20 bp, mouse
gggggcacgccgggggaaga

SEQ ID NO: 652553 - DNA, 20 bp, mouse
gaacccccgcatccgcggaa

SEQ ID NO: 652554 - DNA, 20 bp, mouse
ggctagcccgggacccgatc

SEQ ID NO: 652555 - DNA, 20 bp, mouse
gggccccgcccccacacgga

SEQ ID NO: 652556 - DNA, 20 bp, mouse
ggtaccgtcgcctaggtcgc

SEQ ID NO: 652557 - DNA, 20 bp, mouse
ggagacgcgggctgtagggg

SEQ ID NO: 652558 - DNA, 20 bp, mouse
gggcgcgtctctcccgaatg

SEQ ID NO: 652559 - DNA, 20 bp, mouse
ggcggccgctgtgaggaatt

SEQ ID NO: 652560 - DNA, 20 bp, mouse
gaagagttcccaggaggcgg

SEQ ID NO: 652561 - DNA, 20 bp, mouse
ggtcctgcccgctgacacgc

SEQ ID NO: 652562 - DNA, 20 bp, mouse
ggcggagacaggtgagacgc

SEQ ID NO: 652563 - DNA, 20 bp, mouse
gaccaatggaaatggcaata

SEQ ID NO: 652564 - DNA, 20 bp, mouse
gaatggcaataaggctggac

SEQ ID NO: 652565 - DNA, 20 bp, mouse
ggacacgctggaaactaacc

SEQ ID NO: 652566 - DNA, 20 bp, mouse
gaaggcacggcgtgtagagg

SEQ ID NO: 652567 - DNA, 20 bp, mouse
gcccacacaggcccccgcct

SEQ ID NO: 652568 - DNA, 20 bp, mouse
gcctggctgcgctggccaca

SEQ ID NO: 652569 - DNA, 20 bp, mouse
gggccacagggctcggacca

SEQ ID NO: 652570 - DNA, 20 bp, mouse
gctcgcgagacccatcacca

SEQ ID NO: 652571 - DNA, 20 bp, mouse
gccaggatgtggcaaggtcc

SEQ ID NO: 652572 - DNA, 20 bp, mouse
gagaagtgcgcggtagcgag

SEQ ID NO: 652573 - DNA, 20 bp, mouse
gtcccgagcagagcgagctc

SEQ ID NO: 652574 - DNA, 20 bp, mouse
gcggaaggcacggcgtgtag

SEQ ID NO: 652575 - DNA, 20 bp, mouse
gctcgcgcgatcgtggaggt

SEQ ID NO: 652576 - DNA, 20 bp, mouse
gacgtggagcccagcgaaga

SEQ ID NO: 652577 - DNA, 20 bp, mouse
gggagcccagcgaagacggt

SEQ ID NO: 652578 - DNA, 20 bp, mouse
gccaccgcgcctgcgcgcaa

SEQ ID NO: 652579 - DNA, 20 bp, mouse
ggcggcgcctgcaacgcagg

SEQ ID NO: 652580 - DNA, 20 bp, mouse
gcagcgaagacggttggcac

SEQ ID NO: 652581 - DNA, 20 bp, mouse
gacgccgacgtgcgaactac

SEQ ID NO: 652582 - DNA, 20 bp, mouse
ggctcaggcccattgcgcgc

SEQ ID NO: 652583 - DNA, 20 bp, mouse
gagttcgcacgtcggcgtag

SEQ ID NO: 652584 - DNA, 20 bp, mouse
gagatgcagcaaggactcat

SEQ ID NO: 652585 - DNA, 20 bp, mouse
gacgtgcgaactaccggacg

SEQ ID NO: 652586 - DNA, 20 bp, mouse
ggcggaagaactgaagtcta

SEQ ID NO: 652587 - DNA, 20 bp, mouse
gtggggaccagggcttggaa

SEQ ID NO: 652588 - DNA, 20 bp, mouse
ggggccggggcggacccgga

SEQ ID NO: 652589 - DNA, 20 bp, mouse
ggggacttgttctgggtctc

SEQ ID NO: 652590 - DNA, 20 bp, mouse
gttggaaggggacttgttct

SEQ ID NO: 652591 - DNA, 20 bp, mouse
ggggcggggccacgtgacgt

SEQ ID NO: 652592 - DNA, 20 bp, mouse
gcgcccctccgggtccgccc

SEQ ID NO: 652593 - DNA, 20 bp, mouse
gactctatcaaagtcttctc

SEQ ID NO: 652594 - DNA, 20 bp, mouse
ggggtccgcccgacgtcacg

SEQ ID NO: 652595 - DNA, 20 bp, mouse
gcgccccccaggcgcgtttg

SEQ ID NO: 652596 - DNA, 20 bp, mouse
gaggcgccggcgttgagccc

SEQ ID NO: 652597 - DNA, 20 bp, mouse
gagaccccgggtagagcgac

SEQ ID NO: 652598 - DNA, 20 bp, mouse
gggctcccggggctcaacgc

SEQ ID NO: 652599 - DNA, 20 bp, mouse
ggaacctgctggcgtggggc

SEQ ID NO: 652600 - DNA, 20 bp, mouse
gaggctggggagagcgggag

SEQ ID NO: 652601 - DNA, 20 bp, mouse
ggaagagcgcgacctctgaa

SEQ ID NO: 652602 - DNA, 20 bp, mouse
gcggggcacggatccaccga

SEQ ID NO: 652603 - DNA, 20 bp, mouse
gtccgtgccccgccttcgag

SEQ ID NO: 652604 - DNA, 20 bp, mouse
gcaccgagggcgggcttcgt

SEQ ID NO: 652605 - DNA, 20 bp, mouse
gggcgcctcgcggaacctgc

SEQ ID NO: 652606 - DNA, 20 bp, mouse
ggggcagcgcagatggatcc

SEQ ID NO: 652607 - DNA, 20 bp, mouse
gtatctccagcgggattcta

SEQ ID NO: 652608 - DNA, 20 bp, mouse
gtgccgcactgcccacgcag

SEQ ID NO: 652609 - DNA, 20 bp, mouse
gtgtgcgcgagcccgaggcg

SEQ ID NO: 652610 - DNA, 20 bp, mouse
ggctgctggcggctggtggg

SEQ ID NO: 652611 - DNA, 20 bp, mouse
ggctacgtcgcgctttgcaa

SEQ ID NO: 652612 - DNA, 20 bp, mouse
gcgggattctagggcgtcca

SEQ ID NO: 652613 - DNA, 20 bp, mouse
gtcgggctcgcgcacagagg

SEQ ID NO: 652614 - DNA, 20 bp, mouse
gtgcggcagggcagcgcaga

SEQ ID NO: 652615 - DNA, 20 bp, mouse
gcgggaagtcccttgttccc

SEQ ID NO: 652616 - DNA, 20 bp, mouse
gccgtcgcccgctcgggctg

SEQ ID NO: 652617 - DNA, 20 bp, mouse
gtgggccaatgaacgtcggg

SEQ ID NO: 652618 - DNA, 20 bp, mouse
gaggcccgtggtggagctcc

SEQ ID NO: 652619 - DNA, 20 bp, mouse
ggcagccgggagctccacca

SEQ ID NO: 652620 - DNA, 20 bp, mouse
gcagcgcggcgttcactctc

SEQ ID NO: 652621 - DNA, 20 bp, mouse
gggtccagcaggaactcgtg

SEQ ID NO: 652622 - DNA, 20 bp, mouse
gggaactcgtgaggaagttt

SEQ ID NO: 652623 - DNA, 20 bp, mouse
ggatctgggccaatgaacgt

SEQ ID NO: 652624 - DNA, 20 bp, mouse
gttcactctcaggcccgtgg

SEQ ID NO: 652625 - DNA, 20 bp, mouse
ggcccgctcgggctgcggat

SEQ ID NO: 652626 - DNA, 20 bp, mouse
ggctccctgcgcaaagcctg

SEQ ID NO: 652627 - DNA, 20 bp, mouse
gtggaacccggagaaaccag

SEQ ID NO: 652628 - DNA, 20 bp, mouse
gccgcgcccgacttcgaaat

SEQ ID NO: 652629 - DNA, 20 bp, mouse
ggagggacctcaccgagtga

SEQ ID NO: 652630 - DNA, 20 bp, mouse
gggcgcgtgcgcccgcttgt

SEQ ID NO: 652631 - DNA, 20 bp, mouse
gcccaggctccgcccacaag

SEQ ID NO: 652632 - DNA, 20 bp, mouse
gtctggggaaggtttgcgga

SEQ ID NO: 652633 - DNA, 20 bp, mouse
gactggccacgggccggcaa

SEQ ID NO: 652634 - DNA, 20 bp, mouse
ggggtcctgcagtgtgggat

SEQ ID NO: 652635 - DNA, 20 bp, mouse
gaacggtatgctggtgagtc

SEQ ID NO: 652636 - DNA, 20 bp, mouse
gcggagctgcaactctacgg

SEQ ID NO: 652637 - DNA, 20 bp, mouse
gacgccccacgctgccctgc

SEQ ID NO: 652638 - DNA, 20 bp, mouse
gccgagaggcaaggggcgga

SEQ ID NO: 652639 - DNA, 20 bp, mouse
ggagcacaggggcgctccca

SEQ ID NO: 652640 - DNA, 20 bp, mouse
gtgcaggcgaacgcgggagg

SEQ ID NO: 652641 - DNA, 20 bp, mouse
gcaactctacggcggcccgg

SEQ ID NO: 652642 - DNA, 20 bp, mouse
gggctactgggatgcgtgat

SEQ ID NO: 652643 - DNA, 20 bp, mouse
gcaggggcgctcccaaggcc

SEQ ID NO: 652644 - DNA, 20 bp, mouse
gctcccaaggccgggacgac

SEQ ID NO: 652645 - DNA, 20 bp, mouse
gaagcccgtgcacggtaggc

SEQ ID NO: 652646 - DNA, 20 bp, mouse
ggggcagtagacctgtggtg

SEQ ID NO: 652647 - DNA, 20 bp, mouse
gtggtggggcgtggtctgtt

SEQ ID NO: 652648 - DNA, 20 bp, mouse
ggaaagatgcaagtgatcgg

SEQ ID NO: 652649 - DNA, 20 bp, mouse
gggaccagcaccactcgcgt

SEQ ID NO: 652650 - DNA, 20 bp, mouse
gcggccggccccccaccctt

SEQ ID NO: 652651 - DNA, 20 bp, mouse
gggggtggagttctgtgggt

SEQ ID NO: 652652 - DNA, 20 bp, mouse
gctgtgaccccaagggtggg

SEQ ID NO: 652653 - DNA, 20 bp, mouse
gatggtcaatgactatgaag

SEQ ID NO: 652654 - DNA, 20 bp, mouse
gggtcaaagcctatagacat

SEQ ID NO: 652655 - DNA, 20 bp, mouse
ggagtggggtggagttctgt

SEQ ID NO: 652656 - DNA, 20 bp, mouse
gtgcgcgcgcgtctcccagg

SEQ ID NO: 652657 - DNA, 20 bp, mouse
ggggccccgccacgtctcta

SEQ ID NO: 652658 - DNA, 20 bp, mouse
gccgcggcccggggcggagt

SEQ ID NO: 652659 - DNA, 20 bp, mouse
gggcccggggcggagtcggg

SEQ ID NO: 652660 - DNA, 20 bp, mouse
gcgggtgcaagtgtcctcgg

SEQ ID NO: 652661 - DNA, 20 bp, mouse
gttcccggatgtagttcaca

SEQ ID NO: 652662 - DNA, 20 bp, mouse
gggtgcaagcgccggagacc

SEQ ID NO: 652663 - DNA, 20 bp, mouse
gctccccgcccccgaggcgt

SEQ ID NO: 652664 - DNA, 20 bp, mouse
gtaaccgggttgcagcgtag

SEQ ID NO: 652665 - DNA, 20 bp, mouse
gtggccgtagctcaccaccg

SEQ ID NO: 652666 - DNA, 20 bp, mouse
gccacgggcggaagtgacta

SEQ ID NO: 652667 - DNA, 20 bp, mouse
gtggcagggtggcgcggggt

SEQ ID NO: 652668 - DNA, 20 bp, mouse
gacgtcgcagagaaaaaggg

SEQ ID NO: 652669 - DNA, 20 bp, mouse
gcggggtggcagggtggcgc

SEQ ID NO: 652670 - DNA, 20 bp, mouse
ggctacgccttcaagctctt

SEQ ID NO: 652671 - DNA, 20 bp, mouse
gggtacacgcaagaacccga

SEQ ID NO: 652672 - DNA, 20 bp, mouse
gagagctctcagagtcgccc

SEQ ID NO: 652673 - DNA, 20 bp, mouse
gtgagagcgcagttgctctc

SEQ ID NO: 652674 - DNA, 20 bp, mouse
gcctgccaccccgccacggg

SEQ ID NO: 652675 - DNA, 20 bp, mouse
ggccacgtcgcagagaaaaa

SEQ ID NO: 652676 - DNA, 20 bp, mouse
gcggcgctcgcaggctagaa

SEQ ID NO: 652677 - DNA, 20 bp, mouse
gtgagcttggctggcgaggg

SEQ ID NO: 652678 - DNA, 20 bp, mouse
ggccgcccccaaaaccgcta

SEQ ID NO: 652679 - DNA, 20 bp, mouse
gcgggccgcagaggacgggg

SEQ ID NO: 652680 - DNA, 20 bp, mouse
gagggccgcggttccgccga

SEQ ID NO: 652681 - DNA, 20 bp, mouse
gcgagcgccggccggaggtg

SEQ ID NO: 652682 - DNA, 20 bp, mouse
ggtgacgtgcaggtccccct

SEQ ID NO: 652683 - DNA, 20 bp, mouse
gacgtgcaggtccccctcgg

SEQ ID NO: 652684 - DNA, 20 bp, mouse
gttgcgggccgcagaggacg

SEQ ID NO: 652685 - DNA, 20 bp, mouse
gctccggcggaagtgcccgg

SEQ ID NO: 652686 - DNA, 20 bp, mouse
gcggatgaataatgctcaga

SEQ ID NO: 652687 - DNA, 20 bp, mouse
gccagctggctttttcaaaa

SEQ ID NO: 652688 - DNA, 20 bp, mouse
gtggacttaaatcctggaaa

SEQ ID NO: 652689 - DNA, 20 bp, mouse
gaagcctagcacttcacatg

SEQ ID NO: 652690 - DNA, 20 bp, mouse
gttccggcctgggcacctca

SEQ ID NO: 652691 - DNA, 20 bp, mouse
gactggctccgcccaccgaa

SEQ ID NO: 652692 - DNA, 20 bp, mouse
gccccagtggacttaaatcc

SEQ ID NO: 652693 - DNA, 20 bp, mouse
ggctaaaacagcaagtgggg

SEQ ID NO: 652694 - DNA, 20 bp, mouse
gcataattgtcaattgtctg

SEQ ID NO: 652695 - DNA, 20 bp, mouse
gaccctgccctgaggtgccc

SEQ ID NO: 652696 - DNA, 20 bp, mouse
gccccggcgcaccttctcgg

SEQ ID NO: 652697 - DNA, 20 bp, mouse
gagcccccggcgcaccttct

SEQ ID NO: 652698 - DNA, 20 bp, mouse
gaaagagaggacaggtccaa

SEQ ID NO: 652699 - DNA, 20 bp, mouse
gcccgatgcctaagccacca

SEQ ID NO: 652700 - DNA, 20 bp, mouse
gggcggggggagcgtgtcca

SEQ ID NO: 652701 - DNA, 20 bp, mouse
gtccactgaggtctccaacc

SEQ ID NO: 652702 - DNA, 20 bp, mouse
gcaggtgccactctgatcag

SEQ ID NO: 652703 - DNA, 20 bp, mouse
ggtccagggaaagagaggac

SEQ ID NO: 652704 - DNA, 20 bp, mouse
gtgcgccgggggctggttgg

SEQ ID NO: 652705 - DNA, 20 bp, mouse
gggaggactacagctctcca

SEQ ID NO: 652706 - DNA, 20 bp, mouse
gctaggagggccggcgaatg

SEQ ID NO: 652707 - DNA, 20 bp, mouse
gcgcgctcggccgcattcgc

SEQ ID NO: 652708 - DNA, 20 bp, mouse
ggtgaaagttaaagacctga

SEQ ID NO: 652709 - DNA, 20 bp, mouse
gccacgaaaaccttaggagt

SEQ ID NO: 652710 - DNA, 20 bp, mouse
gaggataaggcccgagtaat

SEQ ID NO: 652711 - DNA, 20 bp, mouse
gccccctgacgacgtcgcct

SEQ ID NO: 652712 - DNA, 20 bp, mouse
gttctaggggctaaaattct

SEQ ID NO: 652713 - DNA, 20 bp, mouse
gcagaaggaccagttgtcca

SEQ ID NO: 652714 - DNA, 20 bp, mouse
ggggctcgtgccggcacgct

SEQ ID NO: 652715 - DNA, 20 bp, mouse
gaggactttcccaattactc

SEQ ID NO: 652716 - DNA, 20 bp, mouse
gaacccaactcactcacttt

SEQ ID NO: 652717 - DNA, 20 bp, mouse
gttgctgcccggaccaaaca

SEQ ID NO: 652718 - DNA, 20 bp, mouse
gagcgggcctctgaaatcct

SEQ ID NO: 652719 - DNA, 20 bp, mouse
gggcaccggagcaggatccc

SEQ ID NO: 652720 - DNA, 20 bp, mouse
gccggctccgagatgggaat

SEQ ID NO: 652721 - DNA, 20 bp, mouse
ggctgtggccatctagtcca

SEQ ID NO: 652722 - DNA, 20 bp, mouse
gttggtgctccgcccacttc

SEQ ID NO: 652723 - DNA, 20 bp, mouse
gtcaggtgattgccggaagt

SEQ ID NO: 652724 - DNA, 20 bp, mouse
gtgtcccacgatgaaggagg

SEQ ID NO: 652725 - DNA, 20 bp, mouse
gtccagatgcaggaaactag

SEQ ID NO: 652726 - DNA, 20 bp, mouse
gactgcgcgtggggaagaga

SEQ ID NO: 652727 - DNA, 20 bp, mouse
gcgcccgggcgggagagcag

SEQ ID NO: 652728 - DNA, 20 bp, mouse
gaggcgttcggggaagggca

SEQ ID NO: 652729 - DNA, 20 bp, mouse
gggaggggcgactgcgcgtg

SEQ ID NO: 652730 - DNA, 20 bp, mouse
gaggaagaggcgttcgggga

SEQ ID NO: 652731 - DNA, 20 bp, mouse
gggaccttgtgagccgagat

SEQ ID NO: 652732 - DNA, 20 bp, mouse
gccgctgcctcggaaggaag

SEQ ID NO: 652733 - DNA, 20 bp, mouse
ggggaggtgcaggcgtccgg

SEQ ID NO: 652734 - DNA, 20 bp, mouse
gcgggagagcaggggcgtgc

SEQ ID NO: 652735 - DNA, 20 bp, mouse
gcctgaccgaacgggatggt

SEQ ID NO: 652736 - DNA, 20 bp, mouse
gtgacggcggggaccagccc

SEQ ID NO: 652737 - DNA, 20 bp, mouse
gacagcgagcgttgagatca

SEQ ID NO: 652738 - DNA, 20 bp, mouse
gggccacaggcaaggctgat

SEQ ID NO: 652739 - DNA, 20 bp, mouse
gaaaggctgcgtgtgagacg

SEQ ID NO: 652740 - DNA, 20 bp, mouse
gtgcgtgtgagacggggtga

SEQ ID NO: 652741 - DNA, 20 bp, mouse
gttgccggaaccttttagac

SEQ ID NO: 652742 - DNA, 20 bp, mouse
gcaggagctgcctgtctaaa

SEQ ID NO: 652743 - DNA, 20 bp, mouse
ggaccagcccgggcagggac

SEQ ID NO: 652744 - DNA, 20 bp, mouse
gtcaacgctcgctgtgcttt

SEQ ID NO: 652745 - DNA, 20 bp, mouse
gggctgatgggctaggggaa

SEQ ID NO: 652746 - DNA, 20 bp, mouse
gtggcgagacgcttaagagg

SEQ ID NO: 652747 - DNA, 20 bp, mouse
ggtgtggcgagacgcttaag

SEQ ID NO: 652748 - DNA, 20 bp, mouse
ggacgcttaagagggggatt

SEQ ID NO: 652749 - DNA, 20 bp, mouse
ggggcggtgcgaaggaatta

SEQ ID NO: 652750 - DNA, 20 bp, mouse
gcaagcaggggcgggacatt

SEQ ID NO: 652751 - DNA, 20 bp, mouse
ggggtggggcaggcacaagc

SEQ ID NO: 652752 - DNA, 20 bp, mouse
gtgggagcacgtgacagaag

SEQ ID NO: 652753 - DNA, 20 bp, mouse
gtgagggagggtaagttcca

SEQ ID NO: 652754 - DNA, 20 bp, mouse
gagcacgtgacagaaggggc

SEQ ID NO: 652755 - DNA, 20 bp, mouse
gtagtcccggaatgccagat

SEQ ID NO: 652756 - DNA, 20 bp, mouse
gaactctaaggggaataatg

SEQ ID NO: 652757 - DNA, 20 bp, mouse
gtggttaactacatgtaccc

SEQ ID NO: 652758 - DNA, 20 bp, mouse
gctgtgcaaggcaaactcta

SEQ ID NO: 652759 - DNA, 20 bp, mouse
gactacatgtacccaggaag

SEQ ID NO: 652760 - DNA, 20 bp, mouse
gaactggctgtcaagaagag

SEQ ID NO: 652761 - DNA, 20 bp, mouse
gcgaacacaggcctcccctt

SEQ ID NO: 652762 - DNA, 20 bp, mouse
gaaaaaaaggcgggggcaaa

SEQ ID NO: 652763 - DNA, 20 bp, mouse
ggttgggtcaggggaggaac

SEQ ID NO: 652764 - DNA, 20 bp, mouse
gggttgggttgggtcagggg

SEQ ID NO: 652765 - DNA, 20 bp, mouse
gagtaaggtcacgtgtccta

SEQ ID NO: 652766 - DNA, 20 bp, mouse
gggcggagttaagtggttca

SEQ ID NO: 652767 - DNA, 20 bp, mouse
gcggacggacccaacatggg

SEQ ID NO: 652768 - DNA, 20 bp, mouse
ggtgcggacggacccaacat

SEQ ID NO: 652769 - DNA, 20 bp, mouse
gcccgcccctaccacgagtt

SEQ ID NO: 652770 - DNA, 20 bp, mouse
gcacctcggcgcggcctcat

SEQ ID NO: 652771 - DNA, 20 bp, mouse
gcgcacctgttccacctctc

SEQ ID NO: 652772 - DNA, 20 bp, mouse
gaacagggtcgaaactagat

SEQ ID NO: 652773 - DNA, 20 bp, mouse
ggaagtcaggcgtagctgga

SEQ ID NO: 652774 - DNA, 20 bp, mouse
gcaacatgggcggagttaag

SEQ ID NO: 652775 - DNA, 20 bp, mouse
gagagctgggcgaacttgag

SEQ ID NO: 652776 - DNA, 20 bp, mouse
ggcagcagcagcagttgtta

SEQ ID NO: 652777 - DNA, 20 bp, mouse
gagtagtaacacatggggaa

SEQ ID NO: 652778 - DNA, 20 bp, mouse
gcgctggcccggacagggga

SEQ ID NO: 652779 - DNA, 20 bp, mouse
ggtccgggccagcgattcac

SEQ ID NO: 652780 - DNA, 20 bp, mouse
gcaggtagtagtaacacatg

SEQ ID NO: 652781 - DNA, 20 bp, mouse
gcgaagcagcagaaataatc

SEQ ID NO: 652782 - DNA, 20 bp, mouse
gctctctccctgtgaatcgc

SEQ ID NO: 652783 - DNA, 20 bp, mouse
gcgaatgcctgaaggggtta

SEQ ID NO: 652784 - DNA, 20 bp, mouse
gggccagcccctcccctgtc

SEQ ID NO: 652785 - DNA, 20 bp, mouse
gagggggcctgaggaaaccg

SEQ ID NO: 652786 - DNA, 20 bp, mouse
ggtagcacagaaccaacgaa

SEQ ID NO: 652787 - DNA, 20 bp, mouse
gagaaactacatctcccggt

SEQ ID NO: 652788 - DNA, 20 bp, mouse
gctcccggtaggcctcgggc

SEQ ID NO: 652789 - DNA, 20 bp, mouse
gacacctgcccgaggcctac

SEQ ID NO: 652790 - DNA, 20 bp, mouse
gctagccaatctaagggcta

SEQ ID NO: 652791 - DNA, 20 bp, mouse
gcgccccttagcccttagat

SEQ ID NO: 652792 - DNA, 20 bp, mouse
gtacatctcccggtaggcct

SEQ ID NO: 652793 - DNA, 20 bp, mouse
gttgatccgcggaactacat

SEQ ID NO: 652794 - DNA, 20 bp, mouse
gcaggagaaacacctgcccg

SEQ ID NO: 652795 - DNA, 20 bp, mouse
gaaccgttccatgctactat

SEQ ID NO: 652796 - DNA, 20 bp, mouse
gaccttgcgaggtgcctccg

SEQ ID NO: 652797 - DNA, 20 bp, mouse
gaggcacctcgcaaggttag

SEQ ID NO: 652798 - DNA, 20 bp, mouse
ggaaagcttcgtacccgcgg

SEQ ID NO: 652799 - DNA, 20 bp, mouse
gcaggcgcgcggagctgcac

SEQ ID NO: 652800 - DNA, 20 bp, mouse
gagcgcggctcgctcgaagg

SEQ ID NO: 652801 - DNA, 20 bp, mouse
ggcgcgggaagggacgctgg

SEQ ID NO: 652802 - DNA, 20 bp, mouse
gtcgctcgaaggtggtgcag

SEQ ID NO: 652803 - DNA, 20 bp, mouse
gcccgcggaggcacctcgca

SEQ ID NO: 652804 - DNA, 20 bp, mouse
ggcggggctacgtggacggg

SEQ ID NO: 652805 - DNA, 20 bp, mouse
gcgccgcccgtgcacactgc

SEQ ID NO: 652806 - DNA, 20 bp, mouse
gcgggtgcccaggttgtagg

SEQ ID NO: 652807 - DNA, 20 bp, mouse
gggcgcgcgagctgcttccc

SEQ ID NO: 652808 - DNA, 20 bp, mouse
gccggagcgtcccccgggag

SEQ ID NO: 652809 - DNA, 20 bp, mouse
gccgggagccaagctagagg

SEQ ID NO: 652810 - DNA, 20 bp, mouse
gagcgtcccccgggagggga

SEQ ID NO: 652811 - DNA, 20 bp, mouse
ggccccgggagccaagctag

SEQ ID NO: 652812 - DNA, 20 bp, mouse
ggagaacgcgggttaagggt

SEQ ID NO: 652813 - DNA, 20 bp, mouse
gctccggggcgaggagtttt

SEQ ID NO: 652814 - DNA, 20 bp, mouse
ggaggaagacgggccgggac

SEQ ID NO: 652815 - DNA, 20 bp, mouse
gacctgccccggccagcctc

SEQ ID NO: 652816 - DNA, 20 bp, mouse
gcaagggctcggtgagccaa

SEQ ID NO: 652817 - DNA, 20 bp, mouse
gacaacatggagctaagtaa

SEQ ID NO: 652818 - DNA, 20 bp, mouse
gaagatgccagattcatcag

SEQ ID NO: 652819 - DNA, 20 bp, mouse
gggatctgagagcagacttg

SEQ ID NO: 652820 - DNA, 20 bp, mouse
gaagtgctggggtagacccc

SEQ ID NO: 652821 - DNA, 20 bp, mouse
gagtgacaactgcgtctcag

SEQ ID NO: 652822 - DNA, 20 bp, mouse
ggattcatcagcggaagcaa

SEQ ID NO: 652823 - DNA, 20 bp, mouse
gaaagctctgtcacatcctt

SEQ ID NO: 652824 - DNA, 20 bp, mouse
gtagctccatgttgttccct

SEQ ID NO: 652825 - DNA, 20 bp, mouse
gatggagaagtggtacccta

SEQ ID NO: 652826 - DNA, 20 bp, mouse
ggcggggcgggtctggtctg

SEQ ID NO: 652827 - DNA, 20 bp, mouse
gaccagagataaggtctcag

SEQ ID NO: 652828 - DNA, 20 bp, mouse
gggaatctacacggaccgtg

SEQ ID NO: 652829 - DNA, 20 bp, mouse
ggcggggcactgggaacaga

SEQ ID NO: 652830 - DNA, 20 bp, mouse
gcagaggggcgggactagaa

SEQ ID NO: 652831 - DNA, 20 bp, mouse
gcaggctcggttctgaccca

SEQ ID NO: 652832 - DNA, 20 bp, mouse
gtacacggaccgtggagcca

SEQ ID NO: 652833 - DNA, 20 bp, mouse
gtgagcacgaaagtggatga

SEQ ID NO: 652834 - DNA, 20 bp, mouse
ggagcgcctggtctggagtt

SEQ ID NO: 652835 - DNA, 20 bp, mouse
gtacccagatagaagttgat

SEQ ID NO: 652836 - DNA, 20 bp, mouse
ggacccaagcagcactggtg

SEQ ID NO: 652837 - DNA, 20 bp, mouse
gcgcccgcccagcattgctc

SEQ ID NO: 652838 - DNA, 20 bp, mouse
gcaccccaccagtgctgctt

SEQ ID NO: 652839 - DNA, 20 bp, mouse
gcaggcagtggtgtctgatg

SEQ ID NO: 652840 - DNA, 20 bp, mouse
gcgcgcataaccagtgtgtg

SEQ ID NO: 652841 - DNA, 20 bp, mouse
gaggctggaacaactgagtg

SEQ ID NO: 652842 - DNA, 20 bp, mouse
ggctcacagatctgtggcta

SEQ ID NO: 652843 - DNA, 20 bp, mouse
gtgcctgggccctctgcagt

SEQ ID NO: 652844 - DNA, 20 bp, mouse
gctcacctccagagcaatgc

SEQ ID NO: 652845 - DNA, 20 bp, mouse
gcagaggacccaagcagcac

SEQ ID NO: 652846 - DNA, 20 bp, mouse
ggagtcaaggaggcgaacac

SEQ ID NO: 652847 - DNA, 20 bp, mouse
ggaggcgaacacaggagtcc

SEQ ID NO: 652848 - DNA, 20 bp, mouse
gggcacatggcgagagcctt

SEQ ID NO: 652849 - DNA, 20 bp, mouse
gtccttgcgttttgaggaag

SEQ ID NO: 652850 - DNA, 20 bp, mouse
gccgccaaaatctggagtca

SEQ ID NO: 652851 - DNA, 20 bp, mouse
gcctccttgactccagattt

SEQ ID NO: 652852 - DNA, 20 bp, mouse
gcaagcaggtgtgaactatg

SEQ ID NO: 652853 - DNA, 20 bp, mouse
gaaagatgctgcccattctt

SEQ ID NO: 652854 - DNA, 20 bp, mouse
gtgggtagaaggtttccagc

SEQ ID NO: 652855 - DNA, 20 bp, mouse
gcggctaaaagaggccaggc

SEQ ID NO: 652856 - DNA, 20 bp, mouse
gggactccgcccctctcccc

SEQ ID NO: 652857 - DNA, 20 bp, mouse
gcgtcccctggcggccccgt

SEQ ID NO: 652858 - DNA, 20 bp, mouse
gcgacccacggggccgccag

SEQ ID NO: 652859 - DNA, 20 bp, mouse
gagggcagggcgtcccctgg

SEQ ID NO: 652860 - DNA, 20 bp, mouse
gtgcctcggcccgacccacg

SEQ ID NO: 652861 - DNA, 20 bp, mouse
gggcccggacgccggagggg

SEQ ID NO: 652862 - DNA, 20 bp, mouse
gttagagtcgcggaagggca

SEQ ID NO: 652863 - DNA, 20 bp, mouse
ggacgccggaggggcggctg

SEQ ID NO: 652864 - DNA, 20 bp, mouse
gtggtgctgcattctgtagt

SEQ ID NO: 652865 - DNA, 20 bp, mouse
gccttcagaaatatctgatt

SEQ ID NO: 652866 - DNA, 20 bp, mouse
gggaacagccagtggagtcc

SEQ ID NO: 652867 - DNA, 20 bp, mouse
gacaggggcagggtggtcgg

SEQ ID NO: 652868 - DNA, 20 bp, mouse
gatgaggctcagatggggac

SEQ ID NO: 652869 - DNA, 20 bp, mouse
ggctgatccaagctgtgtct

SEQ ID NO: 652870 - DNA, 20 bp, mouse
gcacgtgaacgatttggtag

SEQ ID NO: 652871 - DNA, 20 bp, mouse
gtggtcgagtgggaagacag

SEQ ID NO: 652872 - DNA, 20 bp, mouse
ggggctagcctggtgtactg

SEQ ID NO: 652873 - DNA, 20 bp, mouse
ggaaagaaactctgaggaga

SEQ ID NO: 652874 - DNA, 20 bp, mouse
gaggtccaggagggtgtgaa

SEQ ID NO: 652875 - DNA, 20 bp, mouse
gcagtgctccagtgacacat

SEQ ID NO: 652876 - DNA, 20 bp, mouse
ggggccacgcccacaaaaca

SEQ ID NO: 652877 - DNA, 20 bp, mouse
gcacgcccacagagtacacc

SEQ ID NO: 652878 - DNA, 20 bp, mouse
gcctagaagcagggatccgt

SEQ ID NO: 652879 - DNA, 20 bp, mouse
ggccccaaggctctgcgact

SEQ ID NO: 652880 - DNA, 20 bp, mouse
gtcggcccggtgtactctgt

SEQ ID NO: 652881 - DNA, 20 bp, mouse
ggcagattagcatacaacgc

SEQ ID NO: 652882 - DNA, 20 bp, mouse
gagaaaggctaggtctggaa

SEQ ID NO: 652883 - DNA, 20 bp, mouse
gtactctgtgggcgtgccct

SEQ ID NO: 652884 - DNA, 20 bp, mouse
gcgaggaggaggttgagaag

SEQ ID NO: 652885 - DNA, 20 bp, mouse
gaatctgccgctgtactctg

SEQ ID NO: 652886 - DNA, 20 bp, mouse
gcggggacagagcgcagaga

SEQ ID NO: 652887 - DNA, 20 bp, mouse
gggctcaaactcgcaggggc

SEQ ID NO: 652888 - DNA, 20 bp, mouse
gcattggctcaaactcgcag

SEQ ID NO: 652889 - DNA, 20 bp, mouse
gagcagcttctggtctgaca

SEQ ID NO: 652890 - DNA, 20 bp, mouse
ggagaaggtagaggagcccg

SEQ ID NO: 652891 - DNA, 20 bp, mouse
gcagagcgcagagaaggtag

SEQ ID NO: 652892 - DNA, 20 bp, mouse
gtggtgacagaagatgaaag

SEQ ID NO: 652893 - DNA, 20 bp, mouse
ggaagacgaaggctccactc

SEQ ID NO: 652894 - DNA, 20 bp, mouse
gctgacagactaccacaccc

SEQ ID NO: 652895 - DNA, 20 bp, mouse
gagccccagggggtgggctg

SEQ ID NO: 652896 - DNA, 20 bp, mouse
ggaaggggcgggtccataac

SEQ ID NO: 652897 - DNA, 20 bp, mouse
gaggcggggtcaccgctgaa

SEQ ID NO: 652898 - DNA, 20 bp, mouse
gggcgggtccataacaggtg

SEQ ID NO: 652899 - DNA, 20 bp, mouse
gaacaggtgcgggtggggca

SEQ ID NO: 652900 - DNA, 20 bp, mouse
gtcctagggcgcaggccaat

SEQ ID NO: 652901 - DNA, 20 bp, mouse
gaccccgcctcctagggcgc

SEQ ID NO: 652902 - DNA, 20 bp, mouse
gggcctgcgccctaggaggc

SEQ ID NO: 652903 - DNA, 20 bp, mouse
gggcgtgaagcgtgaggcgt

SEQ ID NO: 652904 - DNA, 20 bp, mouse
ggaggagggcgtgaagcgtg

SEQ ID NO: 652905 - DNA, 20 bp, mouse
gtatggacccgccccttcag

SEQ ID NO: 652906 - DNA, 20 bp, mouse
gtgcctggggtgtgagcagg

SEQ ID NO: 652907 - DNA, 20 bp, mouse
ggagctgcacaggacgagaa

SEQ ID NO: 652908 - DNA, 20 bp, mouse
ggaaggtgatgtcagaatct

SEQ ID NO: 652909 - DNA, 20 bp, mouse
ggaatctcggggtggagtaa

SEQ ID NO: 652910 - DNA, 20 bp, mouse
gtccacacggccctacctga

SEQ ID NO: 652911 - DNA, 20 bp, mouse
ggggtggagtaagggtgcct

SEQ ID NO: 652912 - DNA, 20 bp, mouse
ggcaaccacaggcctcgggt

SEQ ID NO: 652913 - DNA, 20 bp, mouse
gcctgtgagcacggcaggaa

SEQ ID NO: 652914 - DNA, 20 bp, mouse
gaagaacatacccagggtgg

SEQ ID NO: 652915 - DNA, 20 bp, mouse
gtgacctgaccaagatggca

SEQ ID NO: 652916 - DNA, 20 bp, mouse
gacggcgcaagggcgggcaa

SEQ ID NO: 652917 - DNA, 20 bp, mouse
ggggcaaggggacgtgatgc

SEQ ID NO: 652918 - DNA, 20 bp, mouse
ggaaaaaagggacggcgcaa

SEQ ID NO: 652919 - DNA, 20 bp, mouse
gggaaggaagtcagctccgg

SEQ ID NO: 652920 - DNA, 20 bp, mouse
ggctggaaggaagtcagctc

SEQ ID NO: 652921 - DNA, 20 bp, mouse
gaaggcagagcgcgggccta

SEQ ID NO: 652922 - DNA, 20 bp, mouse
gcggttaggggaccgccccg

SEQ ID NO: 652923 - DNA, 20 bp, mouse
ggcagtcgaaggaagtaagt

SEQ ID NO: 652924 - DNA, 20 bp, mouse
gagcacactcagccccgggg

SEQ ID NO: 652925 - DNA, 20 bp, mouse
ggcgccggactctgcaggga

SEQ ID NO: 652926 - DNA, 20 bp, mouse
gggagggtctaaggtatgac

SEQ ID NO: 652927 - DNA, 20 bp, mouse
gaaaaccagagccctaatca

SEQ ID NO: 652928 - DNA, 20 bp, mouse
ggaggcagtgggagggtcta

SEQ ID NO: 652929 - DNA, 20 bp, mouse
gactacagacaggaaacccc

SEQ ID NO: 652930 - DNA, 20 bp, mouse
gacacacctcacaattaata

SEQ ID NO: 652931 - DNA, 20 bp, mouse
gtgcagtgagtgtgtgcctg

SEQ ID NO: 652932 - DNA, 20 bp, mouse
gaatctggccacttgagcaa

SEQ ID NO: 652933 - DNA, 20 bp, mouse
ggggaagatatgcattgtct

SEQ ID NO: 652934 - DNA, 20 bp, mouse
gtggcagttatctgagtgga

SEQ ID NO: 652935 - DNA, 20 bp, mouse
gatcaccctgattagggctc

SEQ ID NO: 652936 - DNA, 20 bp, mouse
gccacaaggcggctgcttat

SEQ ID NO: 652937 - DNA, 20 bp, mouse
gtggcgctgtcaaacttcgg

SEQ ID NO: 652938 - DNA, 20 bp, mouse
gtgggcggggcgtagccctc

SEQ ID NO: 652939 - DNA, 20 bp, mouse
ggagcgaccgcgggaggaaa

SEQ ID NO: 652940 - DNA, 20 bp, mouse
ggcgcgcgccccatgagggg

SEQ ID NO: 652941 - DNA, 20 bp, mouse
gacgcggaggcccttctcat

SEQ ID NO: 652942 - DNA, 20 bp, mouse
gacccccccggcagccgtta

SEQ ID NO: 652943 - DNA, 20 bp, mouse
gggctccagttttggcctga

SEQ ID NO: 652944 - DNA, 20 bp, mouse
gcgctggcccgcccctcatg

SEQ ID NO: 652945 - DNA, 20 bp, mouse
gggggtgggactggagagac

SEQ ID NO: 652946 - DNA, 20 bp, mouse
gcccctcccgccggagggga

SEQ ID NO: 652947 - DNA, 20 bp, mouse
gaaaacatggaggtttctag

SEQ ID NO: 652948 - DNA, 20 bp, mouse
gggccagaggccctcccctc

SEQ ID NO: 652949 - DNA, 20 bp, mouse
gcagaggccctcccctccgg

SEQ ID NO: 652950 - DNA, 20 bp, mouse
gagaggccccctcccgccgg

SEQ ID NO: 652951 - DNA, 20 bp, mouse
gatgagaggccccctcccgc

SEQ ID NO: 652952 - DNA, 20 bp, mouse
ggccctcccctccggcggga

SEQ ID NO: 652953 - DNA, 20 bp, mouse
gccccttcccccaacgcaaa

SEQ ID NO: 652954 - DNA, 20 bp, mouse
gctgacaagcttgaggtgtc

SEQ ID NO: 652955 - DNA, 20 bp, mouse
gcacccagctctgagaatct

SEQ ID NO: 652956 - DNA, 20 bp, mouse
gggagccttgcctctgtcgg

SEQ ID NO: 652957 - DNA, 20 bp, mouse
gagcccctcgggagctccga

SEQ ID NO: 652958 - DNA, 20 bp, mouse
gaggggctgcgcggtggcgc

SEQ ID NO: 652959 - DNA, 20 bp, mouse
ggctccctcggagctcccga

SEQ ID NO: 652960 - DNA, 20 bp, mouse
gccggctagcgcggcatcgg

SEQ ID NO: 652961 - DNA, 20 bp, mouse
ggacccagacctccagaagt

SEQ ID NO: 652962 - DNA, 20 bp, mouse
gggggcctccgacagaggca

SEQ ID NO: 652963 - DNA, 20 bp, mouse
ggcggcgccaccatcctcgc

SEQ ID NO: 652964 - DNA, 20 bp, mouse
gggtacaggtgagagcggaa

SEQ ID NO: 652965 - DNA, 20 bp, mouse
ggggcgggtacaggtgagag

SEQ ID NO: 652966 - DNA, 20 bp, mouse
gggctcaaggcgttggagta

SEQ ID NO: 652967 - DNA, 20 bp, mouse
ggcttcaaacgcaccacctt

SEQ ID NO: 652968 - DNA, 20 bp, mouse
ggtggcacttagagataatt

SEQ ID NO: 652969 - DNA, 20 bp, mouse
gacagcgggcgaggagtcga

SEQ ID NO: 652970 - DNA, 20 bp, mouse
ggaacggggcgagactgtag

SEQ ID NO: 652971 - DNA, 20 bp, mouse
gcacacaagcatgtggaaca

SEQ ID NO: 652972 - DNA, 20 bp, mouse
ggagaatgaaccccggggta

SEQ ID NO: 652973 - DNA, 20 bp, mouse
gggactggggccaggatcct

SEQ ID NO: 652974 - DNA, 20 bp, mouse
gtggttgtgcagttcggagg

SEQ ID NO: 652975 - DNA, 20 bp, mouse
ggatggatcagcgcccaagg

SEQ ID NO: 652976 - DNA, 20 bp, mouse
gacacccccatattgaggtg

SEQ ID NO: 652977 - DNA, 20 bp, mouse
gctcacacatacctgcctgt

SEQ ID NO: 652978 - DNA, 20 bp, mouse
gccaagacacccccatattg

SEQ ID NO: 652979 - DNA, 20 bp, mouse
gacctgcctgtgggcggttc

SEQ ID NO: 652980 - DNA, 20 bp, mouse
gactcagcctcacctcaata

SEQ ID NO: 652981 - DNA, 20 bp, mouse
gcagcctcacctcaatatgg

SEQ ID NO: 652982 - DNA, 20 bp, mouse
gttcgctaccttctaacttc

SEQ ID NO: 652983 - DNA, 20 bp, mouse
gcttctaacttctggattat

SEQ ID NO: 652984 - DNA, 20 bp, mouse
ggactgaacttcaattcccc

SEQ ID NO: 652985 - DNA, 20 bp, mouse
ggttagaaggtagcgaaaga

SEQ ID NO: 652986 - DNA, 20 bp, mouse
gggcccagacggggacgggt

SEQ ID NO: 652987 - DNA, 20 bp, mouse
ggaccgggcggggacagcga

SEQ ID NO: 652988 - DNA, 20 bp, mouse
ggacgggtaggaatcgggtg

SEQ ID NO: 652989 - DNA, 20 bp, mouse
ggacggggacgggtaggaat

SEQ ID NO: 652990 - DNA, 20 bp, mouse
gagtgggcccagacggggac

SEQ ID NO: 652991 - DNA, 20 bp, mouse
gagggcctggcgctctcagt

SEQ ID NO: 652992 - DNA, 20 bp, mouse
gggtccccgcccggtccctg

SEQ ID NO: 652993 - DNA, 20 bp, mouse
ggcgcaccgcagggaccggg

SEQ ID NO: 652994 - DNA, 20 bp, mouse
gctctcagtgggcccagacg

SEQ ID NO: 652995 - DNA, 20 bp, mouse
gttcccgcaggggttaacgt

SEQ ID NO: 652996 - DNA, 20 bp, mouse
gcgaaccggggagtctccgc

SEQ ID NO: 652997 - DNA, 20 bp, mouse
gcaggcgcacggggaccacc

SEQ ID NO: 652998 - DNA, 20 bp, mouse
gccagcccggcgagcgaacc

SEQ ID NO: 652999 - DNA, 20 bp, mouse
gcaaactttggacagaggaa

SEQ ID NO: 653000 - DNA, 20 bp, mouse
gcctctgtccaaagtttgta

SEQ ID NO: 653001 - DNA, 20 bp, mouse
gtacagctggggctgaccgc

SEQ ID NO: 653002 - DNA, 20 bp, mouse
gtgcacggcgcattccgcac

SEQ ID NO: 653003 - DNA, 20 bp, mouse
gcattcgcttgagagaaaat

SEQ ID NO: 653004 - DNA, 20 bp, mouse
ggactccccggttcgctcgc

SEQ ID NO: 653005 - DNA, 20 bp, mouse
gactttggacagaggaaagg

SEQ ID NO: 653006 - DNA, 20 bp, mouse
ggcggggcgggggaattctg

SEQ ID NO: 653007 - DNA, 20 bp, mouse
ggctcccgggagacgagggc

SEQ ID NO: 653008 - DNA, 20 bp, mouse
gctcggctcccgggagacga

SEQ ID NO: 653009 - DNA, 20 bp, mouse
gcgaaccgggatcgcggctc

SEQ ID NO: 653010 - DNA, 20 bp, mouse
gctcgcgcgccccctccctc

SEQ ID NO: 653011 - DNA, 20 bp, mouse
gctccaggcccgctccccat

SEQ ID NO: 653012 - DNA, 20 bp, mouse
gcggggccgaaccgggatcg

SEQ ID NO: 653013 - DNA, 20 bp, mouse
gcggctcgggaggcgtctgg

SEQ ID NO: 653014 - DNA, 20 bp, mouse
gacccccggccgggtgtgtg

SEQ ID NO: 653015 - DNA, 20 bp, mouse
ggcggcaactcgcgcctcct

SEQ ID NO: 653016 - DNA, 20 bp, mouse
gaaaaaggcggggttgtggg

SEQ ID NO: 653017 - DNA, 20 bp, mouse
gggtctgacaccagtgggtg

SEQ ID NO: 653018 - DNA, 20 bp, mouse
ggctgcgggtctgacaccag

SEQ ID NO: 653019 - DNA, 20 bp, mouse
ggaccgcgagcccctggctt

SEQ ID NO: 653020 - DNA, 20 bp, mouse
gaacgcagggtctggagccg

SEQ ID NO: 653021 - DNA, 20 bp, mouse
ggaaaaaccgtccagagctg

SEQ ID NO: 653022 - DNA, 20 bp, mouse
gccggggcggagccagaagc

SEQ ID NO: 653023 - DNA, 20 bp, mouse
gcccccaagccaggggctcg

SEQ ID NO: 653024 - DNA, 20 bp, mouse
gaggtgaacagagcttggtc

SEQ ID NO: 653025 - DNA, 20 bp, mouse
gctctgatacccggcctcta

SEQ ID NO: 653026 - DNA, 20 bp, mouse
gcaaatgcgggtaaaagtga

SEQ ID NO: 653027 - DNA, 20 bp, mouse
gtctaggcgggagggagcta

SEQ ID NO: 653028 - DNA, 20 bp, mouse
gtgagggctagcagctgctg

SEQ ID NO: 653029 - DNA, 20 bp, mouse
gtgagatgcgcctggtgaga

SEQ ID NO: 653030 - DNA, 20 bp, mouse
gcagccgggagtccccaggg

SEQ ID NO: 653031 - DNA, 20 bp, mouse
ggggtgggcgggaccagggt

SEQ ID NO: 653032 - DNA, 20 bp, mouse
gggagggagctacgggacgc

SEQ ID NO: 653033 - DNA, 20 bp, mouse
gcgacaccccgacaccccaa

SEQ ID NO: 653034 - DNA, 20 bp, mouse
gaccaggcgcatctcaaatg

SEQ ID NO: 653035 - DNA, 20 bp, mouse
gcgcacagccgggagtcccc

SEQ ID NO: 653036 - DNA, 20 bp, mouse
ggctgcacataaggaggaag

SEQ ID NO: 653037 - DNA, 20 bp, mouse
gcctgatcctggatgttgaa

SEQ ID NO: 653038 - DNA, 20 bp, mouse
gagggctcccttcaacatcc

SEQ ID NO: 653039 - DNA, 20 bp, mouse
gaggcagtttgggtggtcac

SEQ ID NO: 653040 - DNA, 20 bp, mouse
gtacaggtgacaatgatgaa

SEQ ID NO: 653041 - DNA, 20 bp, mouse
gccctgagctgcacataagg

SEQ ID NO: 653042 - DNA, 20 bp, mouse
gcgccctaatgtgtcctaga

SEQ ID NO: 653043 - DNA, 20 bp, mouse
gggtcagaaagacctgatcc

SEQ ID NO: 653044 - DNA, 20 bp, mouse
gacatcaggtaacctcgaca

SEQ ID NO: 653045 - DNA, 20 bp, mouse
ggcctgtgtgagcttaaaaa

SEQ ID NO: 653046 - DNA, 20 bp, mouse
gagagactacgctagagcta

SEQ ID NO: 653047 - DNA, 20 bp, mouse
gtgtacactctctctttcac

SEQ ID NO: 653048 - DNA, 20 bp, mouse
gacaactgacaacagagtgg

SEQ ID NO: 653049 - DNA, 20 bp, mouse
gaaaggaagcggggcgagtt

SEQ ID NO: 653050 - DNA, 20 bp, mouse
ggggcgagttgggcctactg

SEQ ID NO: 653051 - DNA, 20 bp, mouse
gaaccccgccccagagctgc

SEQ ID NO: 653052 - DNA, 20 bp, mouse
gtgaactacaaaaggaagcg

SEQ ID NO: 653053 - DNA, 20 bp, mouse
ggcaacgtaggggatgagaa

SEQ ID NO: 653054 - DNA, 20 bp, mouse
gtctggggcggggttgcgtg

SEQ ID NO: 653055 - DNA, 20 bp, mouse
gttcctgcagctctggggcg

SEQ ID NO: 653056 - DNA, 20 bp, mouse
ggcgtcgcgcggccattctg

SEQ ID NO: 653057 - DNA, 20 bp, mouse
ggggccaggcacggcaatca

SEQ ID NO: 653058 - DNA, 20 bp, mouse
gcattcggcagaaggcgcga

SEQ ID NO: 653059 - DNA, 20 bp, mouse
gtggccgcgcgacgctgctc

SEQ ID NO: 653060 - DNA, 20 bp, mouse
gtgccgaatgccgggtgcga

SEQ ID NO: 653061 - DNA, 20 bp, mouse
ggcccgcagcaaaatggcga

SEQ ID NO: 653062 - DNA, 20 bp, mouse
ggcgccacgcgcccactcac

SEQ ID NO: 653063 - DNA, 20 bp, mouse
gcacgcgggacgcgcccacg

SEQ ID NO: 653064 - DNA, 20 bp, mouse
ggcgcggtgcagtgcgggag

SEQ ID NO: 653065 - DNA, 20 bp, mouse
ggcgcagcgcggtgcagtgc

SEQ ID NO: 653066 - DNA, 20 bp, mouse
gagacggctgatcggaagat

SEQ ID NO: 653067 - DNA, 20 bp, mouse
ggtcaagaatgctgctcaga

SEQ ID NO: 653068 - DNA, 20 bp, mouse
gaatctcggggagagacata

SEQ ID NO: 653069 - DNA, 20 bp, mouse
gtgaaagcacacacagctac

SEQ ID NO: 653070 - DNA, 20 bp, mouse
gtgagtgtgcatgctggggg

SEQ ID NO: 653071 - DNA, 20 bp, mouse
gtacttgacaaggaaaccct

SEQ ID NO: 653072 - DNA, 20 bp, mouse
ggtctaaaagccataatctc

SEQ ID NO: 653073 - DNA, 20 bp, mouse
gacaaacttctgctcctcta

SEQ ID NO: 653074 - DNA, 20 bp, mouse
gaacttgctggtaggaaatg

SEQ ID NO: 653075 - DNA, 20 bp, mouse
gtcatgcatctatgtcacat

SEQ ID NO: 653076 - DNA, 20 bp, mouse
gcccgcccaggggatcccgg

SEQ ID NO: 653077 - DNA, 20 bp, mouse
gaatgggagtccagggacgt

SEQ ID NO: 653078 - DNA, 20 bp, mouse
gcagggacgccaagtggaac

SEQ ID NO: 653079 - DNA, 20 bp, mouse
gtgcgccgcttgctgataat

SEQ ID NO: 653080 - DNA, 20 bp, mouse
gaagcggcgcaggacacacc

SEQ ID NO: 653081 - DNA, 20 bp, mouse
ggggacccgactccacgtgg

SEQ ID NO: 653082 - DNA, 20 bp, mouse
gtgggtaaaggggactcctg

SEQ ID NO: 653083 - DNA, 20 bp, mouse
gaggagacctagggatggaa

SEQ ID NO: 653084 - DNA, 20 bp, mouse
ggggcgcggcagggacgacc

SEQ ID NO: 653085 - DNA, 20 bp, mouse
gtgctgataatgggagtcca

SEQ ID NO: 653086 - DNA, 20 bp, mouse
ggggaaaggaggagccgcgc

SEQ ID NO: 653087 - DNA, 20 bp, mouse
ggggacgcgcccgcggggaa

SEQ ID NO: 653088 - DNA, 20 bp, mouse
gacgcgcccgcggggaaagg

SEQ ID NO: 653089 - DNA, 20 bp, mouse
ggaggcggacaaaggcgaag

SEQ ID NO: 653090 - DNA, 20 bp, mouse
ggccgcgcgggcggcgagaa

SEQ ID NO: 653091 - DNA, 20 bp, mouse
ggcaacagcagggagggcgg

SEQ ID NO: 653092 - DNA, 20 bp, mouse
gcggctcctcctttccccgc

SEQ ID NO: 653093 - DNA, 20 bp, mouse
gaaagagagagtaagggcca

SEQ ID NO: 653094 - DNA, 20 bp, mouse
gaaggcgaaggggagccggg

SEQ ID NO: 653095 - DNA, 20 bp, mouse
ggcaggagctgggcaacagc

SEQ ID NO: 653096 - DNA, 20 bp, mouse
gtggcccgatagggccgctc

SEQ ID NO: 653097 - DNA, 20 bp, mouse
ggacaggggcagtcgaaata

SEQ ID NO: 653098 - DNA, 20 bp, mouse
gcggaaacaagggtcctcca

SEQ ID NO: 653099 - DNA, 20 bp, mouse
ggccggagagcggtaggagg

SEQ ID NO: 653100 - DNA, 20 bp, mouse
gcgactctgcggcacgggtg

SEQ ID NO: 653101 - DNA, 20 bp, mouse
gcggccctatcgggccagcg

SEQ ID NO: 653102 - DNA, 20 bp, mouse
gaggaggagtggagttgccg

SEQ ID NO: 653103 - DNA, 20 bp, mouse
gcagaccagagcggccctat

SEQ ID NO: 653104 - DNA, 20 bp, mouse
gtattgcgatacccgccggc

SEQ ID NO: 653105 - DNA, 20 bp, mouse
ggcaactccactcctcctgc

SEQ ID NO: 653106 - DNA, 20 bp, mouse
ggccccgcgccgtgagtagg

SEQ ID NO: 653107 - DNA, 20 bp, mouse
ggggagaagcgtccactctg

SEQ ID NO: 653108 - DNA, 20 bp, mouse
gtggcctcgcaggaatgcgc

SEQ ID NO: 653109 - DNA, 20 bp, mouse
ggtcgggcgcggccgaggaa

SEQ ID NO: 653110 - DNA, 20 bp, mouse
gcaggaatgcgctggcgcga

SEQ ID NO: 653111 - DNA, 20 bp, mouse
gctggcgcgagggtcgggcg

SEQ ID NO: 653112 - DNA, 20 bp, mouse
ggcgcccccggggacagagg

SEQ ID NO: 653113 - DNA, 20 bp, mouse
gggcgcggggcgttaggctg

SEQ ID NO: 653114 - DNA, 20 bp, mouse
ggcgccagcgcattcctgcg

SEQ ID NO: 653115 - DNA, 20 bp, mouse
ggaggaacgggcaggaacgc

SEQ ID NO: 653116 - DNA, 20 bp, mouse
gcccctccaggatcactgtt

SEQ ID NO: 653117 - DNA, 20 bp, mouse
gtgccagatctggaaggcgg

SEQ ID NO: 653118 - DNA, 20 bp, mouse
gcggtgccagatctggaagg

SEQ ID NO: 653119 - DNA, 20 bp, mouse
ggagaggcgcagtggtgtag

SEQ ID NO: 653120 - DNA, 20 bp, mouse
ggggactccaggcgacacta

SEQ ID NO: 653121 - DNA, 20 bp, mouse
ggggctcccggtgccagatc

SEQ ID NO: 653122 - DNA, 20 bp, mouse
gagtttccctaagagggagg

SEQ ID NO: 653123 - DNA, 20 bp, mouse
gcccccaacagtgatcctgg

SEQ ID NO: 653124 - DNA, 20 bp, mouse
gaggctgcatccaacccctg

SEQ ID NO: 653125 - DNA, 20 bp, mouse
gtcccggtgccagatctgga

SEQ ID NO: 653126 - DNA, 20 bp, mouse
gggtgaaggcggaagactgg

SEQ ID NO: 653127 - DNA, 20 bp, mouse
gaggcccagggagttagcca

SEQ ID NO: 653128 - DNA, 20 bp, mouse
gggcgggcagagggtgaagg

SEQ ID NO: 653129 - DNA, 20 bp, mouse
gtctaccaccaggaagggtt

SEQ ID NO: 653130 - DNA, 20 bp, mouse
gtcagcctaacccttcctgg

SEQ ID NO: 653131 - DNA, 20 bp, mouse
gtgggccggtgcattggaca

SEQ ID NO: 653132 - DNA, 20 bp, mouse
gctaccctggctaactccct

SEQ ID NO: 653133 - DNA, 20 bp, mouse
ggagggtgaaggcggaagac

SEQ ID NO: 653134 - DNA, 20 bp, mouse
gggccctggcctctaccacc

SEQ ID NO: 653135 - DNA, 20 bp, mouse
gtggcctctaccaccaggaa

SEQ ID NO: 653136 - DNA, 20 bp, mouse
gggcgcgcggggctgtgaaa

SEQ ID NO: 653137 - DNA, 20 bp, mouse
gaggagccagcggccggccc

SEQ ID NO: 653138 - DNA, 20 bp, mouse
gtgggtgctcagaggggcga

SEQ ID NO: 653139 - DNA, 20 bp, mouse
gcctcgccacagccccgcca

SEQ ID NO: 653140 - DNA, 20 bp, mouse
gcgagcggagtccgccgtgg

SEQ ID NO: 653141 - DNA, 20 bp, mouse
gcgcggggctgtgaaagggc

SEQ ID NO: 653142 - DNA, 20 bp, mouse
ggaaacaaaggtcgagtctc

SEQ ID NO: 653143 - DNA, 20 bp, mouse
gcgccacagccccgccacgg

SEQ ID NO: 653144 - DNA, 20 bp, mouse
ggcgcggccagcggacactg

SEQ ID NO: 653145 - DNA, 20 bp, mouse
gggcgagggcacagctaaga

SEQ ID NO: 653146 - DNA, 20 bp, mouse
gggcccaaaaaagtcggcgg

SEQ ID NO: 653147 - DNA, 20 bp, mouse
ggagaagggcccaaaaaagt

SEQ ID NO: 653148 - DNA, 20 bp, mouse
gaagggcccaaaaaagtcgg

SEQ ID NO: 653149 - DNA, 20 bp, mouse
gggagcgcgcccagggtgga

SEQ ID NO: 653150 - DNA, 20 bp, mouse
gcgcgcgcgggttccggttc

SEQ ID NO: 653151 - DNA, 20 bp, mouse
ggcacctcgagagcattcga

SEQ ID NO: 653152 - DNA, 20 bp, mouse
gtgctgtcgcgggggataga

SEQ ID NO: 653153 - DNA, 20 bp, mouse
gtcgggaagccgcttcaccc

SEQ ID NO: 653154 - DNA, 20 bp, mouse
gtcccgaagtcccagggaga

SEQ ID NO: 653155 - DNA, 20 bp, mouse
gtccagtcgcgccgggccga

SEQ ID NO: 653156 - DNA, 20 bp, mouse
ggtactgctgcgtggcggga

SEQ ID NO: 653157 - DNA, 20 bp, mouse
gagggtgttcaaatgagggt

SEQ ID NO: 653158 - DNA, 20 bp, mouse
gagtacaggtgagggtgcat

SEQ ID NO: 653159 - DNA, 20 bp, mouse
gtgggagggtgttcaaatga

SEQ ID NO: 653160 - DNA, 20 bp, mouse
gccacgcagcagtacaggtg

SEQ ID NO: 653161 - DNA, 20 bp, mouse
ggcacgcaggtatgcagagg

SEQ ID NO: 653162 - DNA, 20 bp, mouse
ggggcagccctgggcaagct

SEQ ID NO: 653163 - DNA, 20 bp, mouse
gcctcagtgcaaagtgtggt

SEQ ID NO: 653164 - DNA, 20 bp, mouse
ggtggtgtccggttgggagg

SEQ ID NO: 653165 - DNA, 20 bp, mouse
gcatgcctccctcttagcta

SEQ ID NO: 653166 - DNA, 20 bp, mouse
gaggcccgggatttctccga

SEQ ID NO: 653167 - DNA, 20 bp, mouse
ggtggtgcagcaggtgccca

SEQ ID NO: 653168 - DNA, 20 bp, mouse
ggagggtagacagtacccga

SEQ ID NO: 653169 - DNA, 20 bp, mouse
gcccgcccgaaccaccagac

SEQ ID NO: 653170 - DNA, 20 bp, mouse
gaaggaagcgggcgtaggag

SEQ ID NO: 653171 - DNA, 20 bp, mouse
gaagccttcggagaaatccc

SEQ ID NO: 653172 - DNA, 20 bp, mouse
gagacgggtcacgtgaacgc

SEQ ID NO: 653173 - DNA, 20 bp, mouse
gcggccaggtgaggcggtgg

SEQ ID NO: 653174 - DNA, 20 bp, mouse
gagcgggcgtaggagcggga

SEQ ID NO: 653175 - DNA, 20 bp, mouse
gcagccggcgcggccaggtg

SEQ ID NO: 653176 - DNA, 20 bp, mouse
gaggctgggaacactgtggg

SEQ ID NO: 653177 - DNA, 20 bp, mouse
ggggcctggcgcccaaaaga

SEQ ID NO: 653178 - DNA, 20 bp, mouse
gtggggggagggaatcgggg

SEQ ID NO: 653179 - DNA, 20 bp, mouse
ggactccttcagatacccac

SEQ ID NO: 653180 - DNA, 20 bp, mouse
gcgcgaggctgggaacactg

SEQ ID NO: 653181 - DNA, 20 bp, mouse
gagtcggctgcgaaagccgc

SEQ ID NO: 653182 - DNA, 20 bp, mouse
gtcgcagccgactcccctag

SEQ ID NO: 653183 - DNA, 20 bp, mouse
gagagtgaggggcgggacat

SEQ ID NO: 653184 - DNA, 20 bp, mouse
ggggcccagggagacgtagg

SEQ ID NO: 653185 - DNA, 20 bp, mouse
gcgcgggctgatcctccctg

SEQ ID NO: 653186 - DNA, 20 bp, mouse
ggagggctgaagttgatata

SEQ ID NO: 653187 - DNA, 20 bp, mouse
gaggggcggggcccggaagg

SEQ ID NO: 653188 - DNA, 20 bp, mouse
gcgtgtgcccgcacacatac

SEQ ID NO: 653189 - DNA, 20 bp, mouse
gctgaagttgatataaggac

SEQ ID NO: 653190 - DNA, 20 bp, mouse
gaggccgtccccagaggggc

SEQ ID NO: 653191 - DNA, 20 bp, mouse
gtgagtaggccgtccccaga

SEQ ID NO: 653192 - DNA, 20 bp, mouse
gtgcaaagttctaaagtccc

SEQ ID NO: 653193 - DNA, 20 bp, mouse
gaggctcaaaagctagcagt

SEQ ID NO: 653194 - DNA, 20 bp, mouse
gggggcagagcctcggcaat

SEQ ID NO: 653195 - DNA, 20 bp, mouse
ggtagttcctccaagcacct

SEQ ID NO: 653196 - DNA, 20 bp, mouse
gggcaggccctgcacctccc

SEQ ID NO: 653197 - DNA, 20 bp, mouse
gctacccaggcaaccgcact

SEQ ID NO: 653198 - DNA, 20 bp, mouse
gagacctgcctgggagtgga

SEQ ID NO: 653199 - DNA, 20 bp, mouse
gtgcctgcgacggccgagtg

SEQ ID NO: 653200 - DNA, 20 bp, mouse
ggtgcagggcctgcctgcga

SEQ ID NO: 653201 - DNA, 20 bp, mouse
gcggttgcctgggtagggcg

SEQ ID NO: 653202 - DNA, 20 bp, mouse
gagcatgcccgggaggtgca

SEQ ID NO: 653203 - DNA, 20 bp, mouse
gcggtgtgctaagtccggga

SEQ ID NO: 653204 - DNA, 20 bp, mouse
ggagggtggggagtgactgt

SEQ ID NO: 653205 - DNA, 20 bp, mouse
ggggaggctggcaaatccac

SEQ ID NO: 653206 - DNA, 20 bp, mouse
gggccagtcaggtacaagag

SEQ ID NO: 653207 - DNA, 20 bp, mouse
ggtccctccgagcttctggg

SEQ ID NO: 653208 - DNA, 20 bp, mouse
ggtatgggcggggactttgt

SEQ ID NO: 653209 - DNA, 20 bp, mouse
gtgcctcccagaagctcgga

SEQ ID NO: 653210 - DNA, 20 bp, mouse
ggaggggtggcccacctcca

SEQ ID NO: 653211 - DNA, 20 bp, mouse
gactggccaaaccggttctg

SEQ ID NO: 653212 - DNA, 20 bp, mouse
gccaaaccggttctggggaa

SEQ ID NO: 653213 - DNA, 20 bp, mouse
gtgtacctgactggccaaac

SEQ ID NO: 653214 - DNA, 20 bp, mouse
gaagagggggctggaacaat

SEQ ID NO: 653215 - DNA, 20 bp, mouse
gcagacaactgcctaaagat

SEQ ID NO: 653216 - DNA, 20 bp, mouse
ggtgctgggtgcaggggcga

SEQ ID NO: 653217 - DNA, 20 bp, mouse
gctgctggacaggggtcctt

SEQ ID NO: 653218 - DNA, 20 bp, mouse
ggggtacccgcgcaccggac

SEQ ID NO: 653219 - DNA, 20 bp, mouse
ggatcctcgaacctgtccca

SEQ ID NO: 653220 - DNA, 20 bp, mouse
gggacaggggtccttgggac

SEQ ID NO: 653221 - DNA, 20 bp, mouse
gcggccggacggggtgggtg

SEQ ID NO: 653222 - DNA, 20 bp, mouse
ggagctaagggaggtcgctg

SEQ ID NO: 653223 - DNA, 20 bp, mouse
gcccgggtgtccagcaacgg

SEQ ID NO: 653224 - DNA, 20 bp, mouse
gcccacccgagctcaggaag

SEQ ID NO: 653225 - DNA, 20 bp, mouse
gctaaccccggcgtcccgtc

SEQ ID NO: 653226 - DNA, 20 bp, mouse
gccagaggagagtgactcct

SEQ ID NO: 653227 - DNA, 20 bp, mouse
gcaaacttctcaaaaggggt

SEQ ID NO: 653228 - DNA, 20 bp, mouse
gattaagaggggtttgtttg

SEQ ID NO: 653229 - DNA, 20 bp, mouse
gcaaagccctaggccacact

SEQ ID NO: 653230 - DNA, 20 bp, mouse
gtatccggtcagtgcggcca

SEQ ID NO: 653231 - DNA, 20 bp, mouse
gcaggggtggggcggtccgg

SEQ ID NO: 653232 - DNA, 20 bp, mouse
ggtggacccgctgaggagat

SEQ ID NO: 653233 - DNA, 20 bp, mouse
gggggcggagccgggcaggg

SEQ ID NO: 653234 - DNA, 20 bp, mouse
gcccacccccaccctgtccg

SEQ ID NO: 653235 - DNA, 20 bp, mouse
ggtgaggaggctccttatag

SEQ ID NO: 653236 - DNA, 20 bp, mouse
gctcctgcattcttgcactc

SEQ ID NO: 653237 - DNA, 20 bp, mouse
gagcgcactccgggaaggca

SEQ ID NO: 653238 - DNA, 20 bp, mouse
ggccctacgggccagctgga

SEQ ID NO: 653239 - DNA, 20 bp, mouse
ggccggggaagctcgcaccg

SEQ ID NO: 653240 - DNA, 20 bp, mouse
ggccccgccccagcacgccg

SEQ ID NO: 653241 - DNA, 20 bp, mouse
gtgcgctcagtgattgtaaa

SEQ ID NO: 653242 - DNA, 20 bp, mouse
ggcctcggtgcgagcttccc

SEQ ID NO: 653243 - DNA, 20 bp, mouse
gggcaggggcgggaactcct

SEQ ID NO: 653244 - DNA, 20 bp, mouse
gagcgcgggcggccgcccta

SEQ ID NO: 653245 - DNA, 20 bp, mouse
gcttccccggcgtgctgggg

SEQ ID NO: 653246 - DNA, 20 bp, mouse
gcgggcgcggccatgtgatg

SEQ ID NO: 653247 - DNA, 20 bp, mouse
gtgggcaggcggggaccagg

SEQ ID NO: 653248 - DNA, 20 bp, mouse
gtgcccacctctggccagcc

SEQ ID NO: 653249 - DNA, 20 bp, mouse
gccgccgccccgcgaaggga

SEQ ID NO: 653250 - DNA, 20 bp, mouse
ggtccccgcctgcccacctc

SEQ ID NO: 653251 - DNA, 20 bp, mouse
ggcgcggccatgtgatgagg

SEQ ID NO: 653252 - DNA, 20 bp, mouse
gcagcggagcggaggggcgt

SEQ ID NO: 653253 - DNA, 20 bp, mouse
ggacgagcccggctggccag

SEQ ID NO: 653254 - DNA, 20 bp, mouse
gctggccagaggtgggcagg

SEQ ID NO: 653255 - DNA, 20 bp, mouse
gccttcctccggcgccacta

SEQ ID NO: 653256 - DNA, 20 bp, mouse
gggacatctcacatgtctcg

SEQ ID NO: 653257 - DNA, 20 bp, mouse
ggcggggaggagttccctca

SEQ ID NO: 653258 - DNA, 20 bp, mouse
gaccaggcagagggagccct

SEQ ID NO: 653259 - DNA, 20 bp, mouse
gagaagcaagttgtgcttac

SEQ ID NO: 653260 - DNA, 20 bp, mouse
gcttctaaatgactggagat

SEQ ID NO: 653261 - DNA, 20 bp, mouse
gaaggaaactaccaggcaga

SEQ ID NO: 653262 - DNA, 20 bp, mouse
gagagcagctataaccggca

SEQ ID NO: 653263 - DNA, 20 bp, mouse
gtaaaaagaaagcagcggat

SEQ ID NO: 653264 - DNA, 20 bp, mouse
gtcctgtcatgcaacttaag

SEQ ID NO: 653265 - DNA, 20 bp, mouse
gcactaggagggatacggga

SEQ ID NO: 653266 - DNA, 20 bp, mouse
gctggcactagtaacttctt

SEQ ID NO: 653267 - DNA, 20 bp, mouse
gtgagtcttgcgtttctcga

SEQ ID NO: 653268 - DNA, 20 bp, mouse
ggaggcacacaccacttcag

SEQ ID NO: 653269 - DNA, 20 bp, mouse
gaaaactacaaggagagctt

SEQ ID NO: 653270 - DNA, 20 bp, mouse
gggagctgagtctgcttcca

SEQ ID NO: 653271 - DNA, 20 bp, mouse
gggtcagctaatcaagtgag

SEQ ID NO: 653272 - DNA, 20 bp, mouse
gtgtcgatccagaacatctg

SEQ ID NO: 653273 - DNA, 20 bp, mouse
gcacacaccacttcaggggg

SEQ ID NO: 653274 - DNA, 20 bp, mouse
gcagatgctgtcaggagcca

SEQ ID NO: 653275 - DNA, 20 bp, mouse
gtgaagtcctccccctgaag

SEQ ID NO: 653276 - DNA, 20 bp, mouse
gcctccgctggtcccggggc

SEQ ID NO: 653277 - DNA, 20 bp, mouse
gtcagcaggaaggcccacga

SEQ ID NO: 653278 - DNA, 20 bp, mouse
gtattggggtgaagtcccgc

SEQ ID NO: 653279 - DNA, 20 bp, mouse
ggggccttcctgctgacaat

SEQ ID NO: 653280 - DNA, 20 bp, mouse
ggggacttcaccccaatacc

SEQ ID NO: 653281 - DNA, 20 bp, mouse
ggatctgtcgccctggtatt

SEQ ID NO: 653282 - DNA, 20 bp, mouse
ggggtgcaagtgactccgga

SEQ ID NO: 653283 - DNA, 20 bp, mouse
gctgcccgccccgggaccag

SEQ ID NO: 653284 - DNA, 20 bp, mouse
ggggcgacagatcccctcgt

SEQ ID NO: 653285 - DNA, 20 bp, mouse
gaccagcggaggcgcggtct

SEQ ID NO: 653286 - DNA, 20 bp, mouse
ggggtgcgcaaggtgagaca

SEQ ID NO: 653287 - DNA, 20 bp, mouse
gagacctgctgcactgagtt

SEQ ID NO: 653288 - DNA, 20 bp, mouse
gtcagtgcagcaggtctctc

SEQ ID NO: 653289 - DNA, 20 bp, mouse
gtgcacctgcgcacgcccat

SEQ ID NO: 653290 - DNA, 20 bp, mouse
gaggtctctcgggtaacagg

SEQ ID NO: 653291 - DNA, 20 bp, mouse
gagcagaggaaagtcgccca

SEQ ID NO: 653292 - DNA, 20 bp, mouse
ggggcacacgttcaacccgc

SEQ ID NO: 653293 - DNA, 20 bp, mouse
ggggttgaacgtgtgcccat

SEQ ID NO: 653294 - DNA, 20 bp, mouse
gcgcccagggctcccagcgg

SEQ ID NO: 653295 - DNA, 20 bp, mouse
gattgtgtggggcaaggact

SEQ ID NO: 653296 - DNA, 20 bp, mouse
gcgacctcgcctagctggtg

SEQ ID NO: 653297 - DNA, 20 bp, mouse
gtagctggtggggcggacac

SEQ ID NO: 653298 - DNA, 20 bp, mouse
gagacgctaaagtgacacta

SEQ ID NO: 653299 - DNA, 20 bp, mouse
gtgacactacggtctgaaca

SEQ ID NO: 653300 - DNA, 20 bp, mouse
ggtcccaggtgtagtagcat

SEQ ID NO: 653301 - DNA, 20 bp, mouse
ggcgaggtcgtgcgagtccc

SEQ ID NO: 653302 - DNA, 20 bp, mouse
gacggtctgaacacggagac

SEQ ID NO: 653303 - DNA, 20 bp, mouse
ggcaccgatgctactacacc

SEQ ID NO: 653304 - DNA, 20 bp, mouse
gagacgagcccggccgctag

SEQ ID NO: 653305 - DNA, 20 bp, mouse
ggcgcagcatagagcatgcg

SEQ ID NO: 653306 - DNA, 20 bp, mouse
ggggtgaaggtgctgcagag

SEQ ID NO: 653307 - DNA, 20 bp, mouse
gcacactcagcgagctgtga

SEQ ID NO: 653308 - DNA, 20 bp, mouse
ggagctaggagggtgagcgc

SEQ ID NO: 653309 - DNA, 20 bp, mouse
gtaccctgggacttagactc

SEQ ID NO: 653310 - DNA, 20 bp, mouse
gccttccagggaagcaccct

SEQ ID NO: 653311 - DNA, 20 bp, mouse
gtgtgagggaggagctagga

SEQ ID NO: 653312 - DNA, 20 bp, mouse
gccaggctttaggggaagca

SEQ ID NO: 653313 - DNA, 20 bp, mouse
ggtcatctgtgtatctggtc

SEQ ID NO: 653314 - DNA, 20 bp, mouse
gaccccctccaggatttcca

SEQ ID NO: 653315 - DNA, 20 bp, mouse
gaccatggaaatcctggagg

SEQ ID NO: 653316 - DNA, 20 bp, mouse
gagggacgctcgctcctcaa

SEQ ID NO: 653317 - DNA, 20 bp, mouse
gaatgcgccctgctgtggag

SEQ ID NO: 653318 - DNA, 20 bp, mouse
gagaagaatgcgccctgctg

SEQ ID NO: 653319 - DNA, 20 bp, mouse
gcggccgcggtgaggactca

SEQ ID NO: 653320 - DNA, 20 bp, mouse
gccgccctgagtcctcaccg

SEQ ID NO: 653321 - DNA, 20 bp, mouse
gtgggtgcgccctcgtgcac

SEQ ID NO: 653322 - DNA, 20 bp, mouse
gcgcgcccccaggccagcgt

SEQ ID NO: 653323 - DNA, 20 bp, mouse
ggcccgcgcgccgaaggcag

SEQ ID NO: 653324 - DNA, 20 bp, mouse
ggtccccgcaggtaacacct

SEQ ID NO: 653325 - DNA, 20 bp, mouse
gcagacctggggcgcggacg

SEQ ID NO: 653326 - DNA, 20 bp, mouse
gcagacagccaggggagcgg

SEQ ID NO: 653327 - DNA, 20 bp, mouse
ggaggcgaggcttgtggcca

SEQ ID NO: 653328 - DNA, 20 bp, mouse
gtcagctgggcggttctcgg

SEQ ID NO: 653329 - DNA, 20 bp, mouse
gaacccggggcgtcctcagc

SEQ ID NO: 653330 - DNA, 20 bp, mouse
ggggctggcagcagacagcc

SEQ ID NO: 653331 - DNA, 20 bp, mouse
gccgccagggagggccgaga

SEQ ID NO: 653332 - DNA, 20 bp, mouse
gggagcggaggcgaggcttg

SEQ ID NO: 653333 - DNA, 20 bp, mouse
gctccctggcggggcccccg

SEQ ID NO: 653334 - DNA, 20 bp, mouse
gcggccgtctcggccctccc

SEQ ID NO: 653335 - DNA, 20 bp, mouse
gccgcagagcgaagaagacg

SEQ ID NO: 653336 - DNA, 20 bp, mouse
gagacacgcaggggagtcta

SEQ ID NO: 653337 - DNA, 20 bp, mouse
gacctgacgaggacccacgg

SEQ ID NO: 653338 - DNA, 20 bp, mouse
gccgtccaggggcagaaccc

SEQ ID NO: 653339 - DNA, 20 bp, mouse
gtgggaagagcgagctccgc

SEQ ID NO: 653340 - DNA, 20 bp, mouse
gagctgcccctcccccggga

SEQ ID NO: 653341 - DNA, 20 bp, mouse
gtgggtagagctcaatcccg

SEQ ID NO: 653342 - DNA, 20 bp, mouse
gggcagctccgggcagagct

SEQ ID NO: 653343 - DNA, 20 bp, mouse
gcccctgccgccggacggga

SEQ ID NO: 653344 - DNA, 20 bp, mouse
gccacggcctgccggtgctg

SEQ ID NO: 653345 - DNA, 20 bp, mouse
ggcaggccgtggccgtccag

SEQ ID NO: 653346 - DNA, 20 bp, mouse
gtctttaggtatgatctctg

SEQ ID NO: 653347 - DNA, 20 bp, mouse
gtctgacaacagaggaacgt

SEQ ID NO: 653348 - DNA, 20 bp, mouse
gcatacctaaagatatggaa

SEQ ID NO: 653349 - DNA, 20 bp, mouse
gagagctcaaacaaagactt

SEQ ID NO: 653350 - DNA, 20 bp, mouse
gtgcaagaagctgtaaggaa

SEQ ID NO: 653351 - DNA, 20 bp, mouse
gccagaagagcgctcataaa

SEQ ID NO: 653352 - DNA, 20 bp, mouse
gggaaaggaatgataaggaa

SEQ ID NO: 653353 - DNA, 20 bp, mouse
gcttgcggggcaaaggttta

SEQ ID NO: 653354 - DNA, 20 bp, mouse
gactcctgagagaacatcac

SEQ ID NO: 653355 - DNA, 20 bp, mouse
ggctgtaaggaaaggaagtg

SEQ ID NO: 653356 - DNA, 20 bp, mouse
gagcaaaagccgaggtgtaa

SEQ ID NO: 653357 - DNA, 20 bp, mouse
ggcactgtaaccctgatctt

SEQ ID NO: 653358 - DNA, 20 bp, mouse
ggcagcggcagtggttgtgg

SEQ ID NO: 653359 - DNA, 20 bp, mouse
gtaaccctgatcttgggaat

SEQ ID NO: 653360 - DNA, 20 bp, mouse
ggcagcagcggcagtggttg

SEQ ID NO: 653361 - DNA, 20 bp, mouse
ggtccctgagtctcatccca

SEQ ID NO: 653362 - DNA, 20 bp, mouse
gtaggaactggaagtgacag

SEQ ID NO: 653363 - DNA, 20 bp, mouse
ggactctagcattcccatta

SEQ ID NO: 653364 - DNA, 20 bp, mouse
ggcaccccagtagccaagga

SEQ ID NO: 653365 - DNA, 20 bp, mouse
gaaggaaggagcaaaagccg

SEQ ID NO: 653366 - DNA, 20 bp, mouse
gacgcgggcgcgatgctaag

SEQ ID NO: 653367 - DNA, 20 bp, mouse
gtagctcaagagagcattct

SEQ ID NO: 653368 - DNA, 20 bp, mouse
gcgtcgcccgatgacatcac

SEQ ID NO: 653369 - DNA, 20 bp, mouse
ggctgcgcgcctttgtgggt

SEQ ID NO: 653370 - DNA, 20 bp, mouse
ggcaaggccactggaggcgg

SEQ ID NO: 653371 - DNA, 20 bp, mouse
ggacgcccgcgccccgcagt

SEQ ID NO: 653372 - DNA, 20 bp, mouse
gcgcgcgcgagcccgcggag

SEQ ID NO: 653373 - DNA, 20 bp, mouse
gccatccccgccggctggcg

SEQ ID NO: 653374 - DNA, 20 bp, mouse
gtgagctagcccgccgactg

SEQ ID NO: 653375 - DNA, 20 bp, mouse
gccggggctgcgcgcctttg

SEQ ID NO: 653376 - DNA, 20 bp, mouse
gtagcgctgtggaggagggg

SEQ ID NO: 653377 - DNA, 20 bp, mouse
gccaccctgcagcttcccag

SEQ ID NO: 653378 - DNA, 20 bp, mouse
gccaaactgaaggctaggtc

SEQ ID NO: 653379 - DNA, 20 bp, mouse
gtgaaggctaggtcaggctg

SEQ ID NO: 653380 - DNA, 20 bp, mouse
gtccaaggcgtgcaaattga

SEQ ID NO: 653381 - DNA, 20 bp, mouse
ggctgtagcgctgtggagga

SEQ ID NO: 653382 - DNA, 20 bp, mouse
gtggatgcaggcgagaatat

SEQ ID NO: 653383 - DNA, 20 bp, mouse
gaaacacgcaactgggggag

SEQ ID NO: 653384 - DNA, 20 bp, mouse
ggcttcccagggggcttgac

SEQ ID NO: 653385 - DNA, 20 bp, mouse
gtgtcgcgggctgactggga

SEQ ID NO: 653386 - DNA, 20 bp, mouse
gcagctgcgcattcagtgcc

SEQ ID NO: 653387 - DNA, 20 bp, mouse
ggacccaacgctcacagagt

SEQ ID NO: 653388 - DNA, 20 bp, mouse
gagcaacgacagccaatcgg

SEQ ID NO: 653389 - DNA, 20 bp, mouse
gcaacctaccggctgaggtg

SEQ ID NO: 653390 - DNA, 20 bp, mouse
gggagagggcaagctaggaa

SEQ ID NO: 653391 - DNA, 20 bp, mouse
gctgcgcattcagtgcccgg

SEQ ID NO: 653392 - DNA, 20 bp, mouse
ggagccgactctgtgagcgt

SEQ ID NO: 653393 - DNA, 20 bp, mouse
gtgggggtgtggaacttgtg

SEQ ID NO: 653394 - DNA, 20 bp, mouse
gcacccccacctcagccggt

SEQ ID NO: 653395 - DNA, 20 bp, mouse
gcaaaagccagtttttacgt

SEQ ID NO: 653396 - DNA, 20 bp, mouse
ggggcgccgggaggcagagt

SEQ ID NO: 653397 - DNA, 20 bp, mouse
gagggcgcgcggcggcggac

SEQ ID NO: 653398 - DNA, 20 bp, mouse
gcagagtaggagcgctgctc

SEQ ID NO: 653399 - DNA, 20 bp, mouse
gagtaggagcgctgctctgg

SEQ ID NO: 653400 - DNA, 20 bp, mouse
ggcagcctcggcccgagccg

SEQ ID NO: 653401 - DNA, 20 bp, mouse
ggagcctcgtgtcggagtga

SEQ ID NO: 653402 - DNA, 20 bp, mouse
gggggactcggaggagagtg

SEQ ID NO: 653403 - DNA, 20 bp, mouse
gccgcctgaaaaaccaggac

SEQ ID NO: 653404 - DNA, 20 bp, mouse
gaggggggacccgggacggg

SEQ ID NO: 653405 - DNA, 20 bp, mouse
gcggcgcagccgagcgaaag

SEQ ID NO: 653406 - DNA, 20 bp, mouse
gccggctgtagcccggataa

SEQ ID NO: 653407 - DNA, 20 bp, mouse
gctgttggggtacccttcgt

SEQ ID NO: 653408 - DNA, 20 bp, mouse
ggctacagccggcccggcgc

SEQ ID NO: 653409 - DNA, 20 bp, mouse
ggacgcgccgcccaagatgg

SEQ ID NO: 653410 - DNA, 20 bp, mouse
gccggggccgccgctagcag

SEQ ID NO: 653411 - DNA, 20 bp, mouse
gccctgcagaactcccacga

SEQ ID NO: 653412 - DNA, 20 bp, mouse
ggcccggataatggttgtac

SEQ ID NO: 653413 - DNA, 20 bp, mouse
ggcgccaaggacagtgtcgc

SEQ ID NO: 653414 - DNA, 20 bp, mouse
gaatggttgtactggctgtt

SEQ ID NO: 653415 - DNA, 20 bp, mouse
ggcgctgcccctgctagcgg

SEQ ID NO: 653416 - DNA, 20 bp, mouse
ggcccggcccgggggagcga

SEQ ID NO: 653417 - DNA, 20 bp, mouse
ggagaccagccgggtgagcg

SEQ ID NO: 653418 - DNA, 20 bp, mouse
gcgggccctccgcgccaggc

SEQ ID NO: 653419 - DNA, 20 bp, mouse
ggggaagcaaagttgtctgt

SEQ ID NO: 653420 - DNA, 20 bp, mouse
gtcacccggctggtctcgcc

SEQ ID NO: 653421 - DNA, 20 bp, mouse
gtcgcccggcctggcgcgga

SEQ ID NO: 653422 - DNA, 20 bp, mouse
ggaaccggctgccggcgctc

SEQ ID NO: 653423 - DNA, 20 bp, mouse
gaggccgggcgagaccagcc

SEQ ID NO: 653424 - DNA, 20 bp, mouse
gagggagaccggaggcacga

SEQ ID NO: 653425 - DNA, 20 bp, mouse
gcgaggggaccgagcagctt

SEQ ID NO: 653426 - DNA, 20 bp, mouse
gaaactagaggggcaggcga

SEQ ID NO: 653427 - DNA, 20 bp, mouse
gaaacgggagcgaaactaga

SEQ ID NO: 653428 - DNA, 20 bp, mouse
gggccggcggcgctgagagg

SEQ ID NO: 653429 - DNA, 20 bp, mouse
gtagaggggcaggcgacggg

SEQ ID NO: 653430 - DNA, 20 bp, mouse
gggagcgaaactagaggggc

SEQ ID NO: 653431 - DNA, 20 bp, mouse
gtcagcgccgccggccctgg

SEQ ID NO: 653432 - DNA, 20 bp, mouse
gctgagaggcggcccagagc

SEQ ID NO: 653433 - DNA, 20 bp, mouse
ggggcgcacgagccgaccgg

SEQ ID NO: 653434 - DNA, 20 bp, mouse
ggggaggccagggggagcgc

SEQ ID NO: 653435 - DNA, 20 bp, mouse
gccgcccgggcccctcgcct

SEQ ID NO: 653436 - DNA, 20 bp, mouse
ggctgcgagagccccatcgc

SEQ ID NO: 653437 - DNA, 20 bp, mouse
gagagccgccacagagtgga

SEQ ID NO: 653438 - DNA, 20 bp, mouse
gtgcgcacggtccctaagat

SEQ ID NO: 653439 - DNA, 20 bp, mouse
ggcagaggccgcgagcggga

SEQ ID NO: 653440 - DNA, 20 bp, mouse
ggacgctccgcccccatctt

SEQ ID NO: 653441 - DNA, 20 bp, mouse
gggctaggctagatctgcgg

SEQ ID NO: 653442 - DNA, 20 bp, mouse
gtgcgcaaaagcaccgggtt

SEQ ID NO: 653443 - DNA, 20 bp, mouse
ggaatcccgaagagttaaaa

SEQ ID NO: 653444 - DNA, 20 bp, mouse
gagccccgccctcccgctcg

SEQ ID NO: 653445 - DNA, 20 bp, mouse
gtctgagcggaaagtcacct

SEQ ID NO: 653446 - DNA, 20 bp, mouse
gaggccggaagcagctaaaa

SEQ ID NO: 653447 - DNA, 20 bp, mouse
gctaaaaagggaacgaggtg

SEQ ID NO: 653448 - DNA, 20 bp, mouse
gggcggggccccacggtggg

SEQ ID NO: 653449 - DNA, 20 bp, mouse
ggggccccgccccccaccgt

SEQ ID NO: 653450 - DNA, 20 bp, mouse
ggggcccggccgtcagcccg

SEQ ID NO: 653451 - DNA, 20 bp, mouse
gaggggcggggccccacggt

SEQ ID NO: 653452 - DNA, 20 bp, mouse
gagcccggaacgctgcacat

SEQ ID NO: 653453 - DNA, 20 bp, mouse
gccggccgtcagcccggggc

SEQ ID NO: 653454 - DNA, 20 bp, mouse
ggggccccacggtggggggc

SEQ ID NO: 653455 - DNA, 20 bp, mouse
gcacggcttcaaccagaggg

SEQ ID NO: 653456 - DNA, 20 bp, mouse
gcgggagggcgcagcggaag

SEQ ID NO: 653457 - DNA, 20 bp, mouse
ggtgggagacacctgttggg

SEQ ID NO: 653458 - DNA, 20 bp, mouse
gccggcgcccccctcgaatc

SEQ ID NO: 653459 - DNA, 20 bp, mouse
gtcccaccagccagattcga

SEQ ID NO: 653460 - DNA, 20 bp, mouse
gtggctgcctgcggtcccgg

SEQ ID NO: 653461 - DNA, 20 bp, mouse
gagggcgcagcggaagaggc

SEQ ID NO: 653462 - DNA, 20 bp, mouse
gcaccagccagattcgaggg

SEQ ID NO: 653463 - DNA, 20 bp, mouse
gctatggggaaatcacgcgt

SEQ ID NO: 653464 - DNA, 20 bp, mouse
gggggcgccggagagctatg

SEQ ID NO: 653465 - DNA, 20 bp, mouse
gtgtgacaaggtgtgaacgg

SEQ ID NO: 653466 - DNA, 20 bp, mouse
gggtgcggaaaacagcaggt

SEQ ID NO: 653467 - DNA, 20 bp, mouse
gacgccgaatagcttcggat

SEQ ID NO: 653468 - DNA, 20 bp, mouse
gagcccaaaaatttgattgg

SEQ ID NO: 653469 - DNA, 20 bp, mouse
gcgaacacgcacgttattgg

SEQ ID NO: 653470 - DNA, 20 bp, mouse
ggtggcgtgtcccatggaaa

SEQ ID NO: 653471 - DNA, 20 bp, mouse
gaacactgattggagaacaa

SEQ ID NO: 653472 - DNA, 20 bp, mouse
ggaaacttccatgattggtg

SEQ ID NO: 653473 - DNA, 20 bp, mouse
gtgattggaggagccgactc

SEQ ID NO: 653474 - DNA, 20 bp, mouse
gtcatgacgccgaatagctt

SEQ ID NO: 653475 - DNA, 20 bp, mouse
gccaccgcccaatcctcgtg

SEQ ID NO: 653476 - DNA, 20 bp, mouse
gaggcatccgggaaagaggt

SEQ ID NO: 653477 - DNA, 20 bp, mouse
gaggcgcggccatgaggcag

SEQ ID NO: 653478 - DNA, 20 bp, mouse
gtccctccgggcagaagtcc

SEQ ID NO: 653479 - DNA, 20 bp, mouse
gcgttcgacgagagagggga

SEQ ID NO: 653480 - DNA, 20 bp, mouse
ggacgcctgcgcagtgtgat

SEQ ID NO: 653481 - DNA, 20 bp, mouse
ggggaggggcaaagggccga

SEQ ID NO: 653482 - DNA, 20 bp, mouse
gtgcctgcgttcgacgagag

SEQ ID NO: 653483 - DNA, 20 bp, mouse
gcatagaactggtgggtaaa

SEQ ID NO: 653484 - DNA, 20 bp, mouse
ggatgcctctcagacgacct

SEQ ID NO: 653485 - DNA, 20 bp, mouse
ggtcggccgccgtgttcctc

SEQ ID NO: 653486 - DNA, 20 bp, mouse
gacaactcccagacgtcctc

SEQ ID NO: 653487 - DNA, 20 bp, mouse
gtgcgcccactttgcagcta

SEQ ID NO: 653488 - DNA, 20 bp, mouse
gcagcccctagctgcaaagt

SEQ ID NO: 653489 - DNA, 20 bp, mouse
gcagacgtcctcgggtctaa

SEQ ID NO: 653490 - DNA, 20 bp, mouse
gtccatgggcgggtccgcgg

SEQ ID NO: 653491 - DNA, 20 bp, mouse
ggggtccatgggcgggtccg

SEQ ID NO: 653492 - DNA, 20 bp, mouse
ggtcctcgggtctaaggggg

SEQ ID NO: 653493 - DNA, 20 bp, mouse
gactgctgtcgcatgtctgt

SEQ ID NO: 653494 - DNA, 20 bp, mouse
gctgctccgctctagaaaat

SEQ ID NO: 653495 - DNA, 20 bp, mouse
gaacgagttgagggtgaatg

SEQ ID NO: 653496 - DNA, 20 bp, mouse
ggagtcttcgaggaaatatt

SEQ ID NO: 653497 - DNA, 20 bp, mouse
ggacctcggcgggaagagaa

SEQ ID NO: 653498 - DNA, 20 bp, mouse
gtgggtttgctgccaaagat

SEQ ID NO: 653499 - DNA, 20 bp, mouse
ggcgggaagagaatggatca

SEQ ID NO: 653500 - DNA, 20 bp, mouse
ggggctaagtccgacctcgg

SEQ ID NO: 653501 - DNA, 20 bp, mouse
gggttgatcaaattcgaaat

SEQ ID NO: 653502 - DNA, 20 bp, mouse
gaccctcattacttggtttt

SEQ ID NO: 653503 - DNA, 20 bp, mouse
gtcgtgtctgtgggtaacgt

SEQ ID NO: 653504 - DNA, 20 bp, mouse
ggatgaaaattgagtcttcg

SEQ ID NO: 653505 - DNA, 20 bp, mouse
gtcaatcattttggtgctga

SEQ ID NO: 653506 - DNA, 20 bp, mouse
ggcggtggcccggagacact

SEQ ID NO: 653507 - DNA, 20 bp, mouse
gcggtcgtggggaggagtct

SEQ ID NO: 653508 - DNA, 20 bp, mouse
ggcggagcggcgtctgactg

SEQ ID NO: 653509 - DNA, 20 bp, mouse
gggcccctgcgtagtatttg

SEQ ID NO: 653510 - DNA, 20 bp, mouse
gccgcgctacgtcatcgcgt

SEQ ID NO: 653511 - DNA, 20 bp, mouse
ggggccttccggtcgtgggg

SEQ ID NO: 653512 - DNA, 20 bp, mouse
gtgaggcccggaagcgagaa

SEQ ID NO: 653513 - DNA, 20 bp, mouse
ggtgacgcacgcccctttgt

SEQ ID NO: 653514 - DNA, 20 bp, mouse
gccgcgctcccgtcctgctc

SEQ ID NO: 653515 - DNA, 20 bp, mouse
gggccgagcctgagcaggac

SEQ ID NO: 653516 - DNA, 20 bp, mouse
gaggggctctcgctagagga

SEQ ID NO: 653517 - DNA, 20 bp, mouse
gctctcgctagaggatggtg

SEQ ID NO: 653518 - DNA, 20 bp, mouse
gaccgcaggtcgacccctac

SEQ ID NO: 653519 - DNA, 20 bp, mouse
gacgctcagtagttcctccc

SEQ ID NO: 653520 - DNA, 20 bp, mouse
gtcccaggggctctcgctag

SEQ ID NO: 653521 - DNA, 20 bp, mouse
gcgacctgcggtcgccctgg

SEQ ID NO: 653522 - DNA, 20 bp, mouse
gagaagcctgggagcctcca

SEQ ID NO: 653523 - DNA, 20 bp, mouse
gaacacttccggagctgcgg

SEQ ID NO: 653524 - DNA, 20 bp, mouse
gtccggtaggggtcgacctg

SEQ ID NO: 653525 - DNA, 20 bp, mouse
ggcgcggcgcagaacacttc

SEQ ID NO: 653526 - DNA, 20 bp, mouse
gtaaaagctcgataaagcga

SEQ ID NO: 653527 - DNA, 20 bp, mouse
gtcgcagtggcctttcgccc

SEQ ID NO: 653528 - DNA, 20 bp, mouse
gaagcgaaggcacagaatgc

SEQ ID NO: 653529 - DNA, 20 bp, mouse
ggaggtctgggcgtccgcgt

SEQ ID NO: 653530 - DNA, 20 bp, mouse
gtggtggtatgcagtgactg

SEQ ID NO: 653531 - DNA, 20 bp, mouse
gaggcacagaatgctggcgc

SEQ ID NO: 653532 - DNA, 20 bp, mouse
gcccggtggttgcacatctg

SEQ ID NO: 653533 - DNA, 20 bp, mouse
gtccgcagatgtgcaaccac

SEQ ID NO: 653534 - DNA, 20 bp, mouse
ggtccagcgcgcagtcgcag

SEQ ID NO: 653535 - DNA, 20 bp, mouse
gcgcgctggacacggaggtc

SEQ ID NO: 653536 - DNA, 20 bp, mouse
ggaaggctgcgcttgtattg

SEQ ID NO: 653537 - DNA, 20 bp, mouse
gacttctaccacactggtca

SEQ ID NO: 653538 - DNA, 20 bp, mouse
gcactgctcgctgccagcga

SEQ ID NO: 653539 - DNA, 20 bp, mouse
gcttgtattgcggtggggaa

SEQ ID NO: 653540 - DNA, 20 bp, mouse
gaaggggcactagggtggga

SEQ ID NO: 653541 - DNA, 20 bp, mouse
gccgagtaggggttcggtcc

SEQ ID NO: 653542 - DNA, 20 bp, mouse
ggctgcgcttgtattgcggt

SEQ ID NO: 653543 - DNA, 20 bp, mouse
ggggatgggctttccgagta

SEQ ID NO: 653544 - DNA, 20 bp, mouse
gggctttccgagtaggggtt

SEQ ID NO: 653545 - DNA, 20 bp, mouse
gttctctgaagggactcaac

SEQ ID NO: 653546 - DNA, 20 bp, mouse
gggcggggctccactaacaa

SEQ ID NO: 653547 - DNA, 20 bp, mouse
gagactggggaaactggtgc

SEQ ID NO: 653548 - DNA, 20 bp, mouse
gagggagatcacaggagtca

SEQ ID NO: 653549 - DNA, 20 bp, mouse
gtggggaaactggtgctggg

SEQ ID NO: 653550 - DNA, 20 bp, mouse
gtgtgaagtccctcagactg

SEQ ID NO: 653551 - DNA, 20 bp, mouse
gcctgcgcttcaggattccc

SEQ ID NO: 653552 - DNA, 20 bp, mouse
gaccagtttccccagtctga

SEQ ID NO: 653553 - DNA, 20 bp, mouse
gagacatcctcccatattgg

SEQ ID NO: 653554 - DNA, 20 bp, mouse
gtgccctaaccactcgagag

SEQ ID NO: 653555 - DNA, 20 bp, mouse
gacgggcagcagtggttttc

SEQ ID NO: 653556 - DNA, 20 bp, mouse
gagtacatatagaatgtact

SEQ ID NO: 653557 - DNA, 20 bp, mouse
ggttgctaagaactagcaag

SEQ ID NO: 653558 - DNA, 20 bp, mouse
ggcttcagagtctgtgtatt

SEQ ID NO: 653559 - DNA, 20 bp, mouse
gtgtgagattcaaggttcta

SEQ ID NO: 653560 - DNA, 20 bp, mouse
gactgcctaggtttgaattt

SEQ ID NO: 653561 - DNA, 20 bp, mouse
gattcttactgttcagagat

SEQ ID NO: 653562 - DNA, 20 bp, mouse
gaattatctataatcacaca

SEQ ID NO: 653563 - DNA, 20 bp, mouse
gcaaggaacagagatgtgtt

SEQ ID NO: 653564 - DNA, 20 bp, mouse
gtctttttaaaagtacagcc

SEQ ID NO: 653565 - DNA, 20 bp, mouse
gagataggttcacaaagctt

SEQ ID NO: 653566 - DNA, 20 bp, mouse
gtggagaagcgtgtggtagg

SEQ ID NO: 653567 - DNA, 20 bp, mouse
ggctccccgccccctgtcaa

SEQ ID NO: 653568 - DNA, 20 bp, mouse
ggcggggagcaaggagtctt

SEQ ID NO: 653569 - DNA, 20 bp, mouse
gggctgcagaactacgtccc

SEQ ID NO: 653570 - DNA, 20 bp, mouse
gcacacgcttctccaatcag

SEQ ID NO: 653571 - DNA, 20 bp, mouse
gtacgtcccgggcttctgag

SEQ ID NO: 653572 - DNA, 20 bp, mouse
gcggaaagaggaagtaggcg

SEQ ID NO: 653573 - DNA, 20 bp, mouse
gaggcggagctcctagaaaa

SEQ ID NO: 653574 - DNA, 20 bp, mouse
gcccgccccctgtcaaaggg

SEQ ID NO: 653575 - DNA, 20 bp, mouse
gcctgtcaaagggcggaaag

SEQ ID NO: 653576 - DNA, 20 bp, mouse
ggaggcctccggaggaggaa

SEQ ID NO: 653577 - DNA, 20 bp, mouse
ggaaaccgagaggacggcga

SEQ ID NO: 653578 - DNA, 20 bp, mouse
gctgggtgcgggggacaagg

SEQ ID NO: 653579 - DNA, 20 bp, mouse
ggccccgcgcagaaaccgag

SEQ ID NO: 653580 - DNA, 20 bp, mouse
gaagccagcccggaggcctc

SEQ ID NO: 653581 - DNA, 20 bp, mouse
gactgaagcaactcttgcgt

SEQ ID NO: 653582 - DNA, 20 bp, mouse
gcctccggaggaggaagggc

SEQ ID NO: 653583 - DNA, 20 bp, mouse
gagagcggaagccagcccgg

SEQ ID NO: 653584 - DNA, 20 bp, mouse
gtaactctcctccaggatta

SEQ ID NO: 653585 - DNA, 20 bp, mouse
gaattccccaacctcaggag

SEQ ID NO: 653586 - DNA, 20 bp, mouse
gggaaagttggggtacttag

SEQ ID NO: 653587 - DNA, 20 bp, mouse
gtgggcggtaggatgtgtga

SEQ ID NO: 653588 - DNA, 20 bp, mouse
gcttaggggtgctgggcggt

SEQ ID NO: 653589 - DNA, 20 bp, mouse
gatacgactagaaaagtact

SEQ ID NO: 653590 - DNA, 20 bp, mouse
gaggataattcacaattact

SEQ ID NO: 653591 - DNA, 20 bp, mouse
gaggtgaaagagttcttaat

SEQ ID NO: 653592 - DNA, 20 bp, mouse
gaacagatgaacagttaatg

SEQ ID NO: 653593 - DNA, 20 bp, mouse
gtgaactcagttgaagcaaa

SEQ ID NO: 653594 - DNA, 20 bp, mouse
gtggggtacttaggggtgct

SEQ ID NO: 653595 - DNA, 20 bp, mouse
gaattcacaattactgggga

SEQ ID NO: 653596 - DNA, 20 bp, mouse
gtggccggagtgtctataaa

SEQ ID NO: 653597 - DNA, 20 bp, mouse
gcggactagaggctgagagt

SEQ ID NO: 653598 - DNA, 20 bp, mouse
gagaagcgcgggacccggga

SEQ ID NO: 653599 - DNA, 20 bp, mouse
gacaccagggaagcgacgat

SEQ ID NO: 653600 - DNA, 20 bp, mouse
gggagggcagcagagaagcg

SEQ ID NO: 653601 - DNA, 20 bp, mouse
gcgggtctcgagcggactag

SEQ ID NO: 653602 - DNA, 20 bp, mouse
gtaaaaggcagtccccccgg

SEQ ID NO: 653603 - DNA, 20 bp, mouse
ggccgctgctcttcaatctc

SEQ ID NO: 653604 - DNA, 20 bp, mouse
gtctctgctgccctccaccg

SEQ ID NO: 653605 - DNA, 20 bp, mouse
gaacgcgctgcggccccggg

SEQ ID NO: 653606 - DNA, 20 bp, mouse
gtgcgcgagcagaaaaagaa

SEQ ID NO: 653607 - DNA, 20 bp, mouse
gggcgcgtcagctccgaaag

SEQ ID NO: 653608 - DNA, 20 bp, mouse
gttacctaggagacgctcga

SEQ ID NO: 653609 - DNA, 20 bp, mouse
gcgccccgagtcctgctcca

SEQ ID NO: 653610 - DNA, 20 bp, mouse
gcgccatggagcaggactcg

SEQ ID NO: 653611 - DNA, 20 bp, mouse
ggcaccttcgagcgtctcct

SEQ ID NO: 653612 - DNA, 20 bp, mouse
gaaaggcggaagcggaagtt

SEQ ID NO: 653613 - DNA, 20 bp, mouse
gaatgagcagcctggacgag

SEQ ID NO: 653614 - DNA, 20 bp, mouse
ggctcattggttagtcccaa

SEQ ID NO: 653615 - DNA, 20 bp, mouse
gctgacttggagctgacggg

SEQ ID NO: 653616 - DNA, 20 bp, mouse
gccgaccgaggcctcggagt

SEQ ID NO: 653617 - DNA, 20 bp, mouse
gtcgccccctagaggcgctg

SEQ ID NO: 653618 - DNA, 20 bp, mouse
gtcggtcggatgccagacag

SEQ ID NO: 653619 - DNA, 20 bp, mouse
gccgaggcctcggagtcgga

SEQ ID NO: 653620 - DNA, 20 bp, mouse
gcctcggagtcggaaggctt

SEQ ID NO: 653621 - DNA, 20 bp, mouse
gggtcacgtgacaacgaggg

SEQ ID NO: 653622 - DNA, 20 bp, mouse
ggcgttaacccttgtcggga

SEQ ID NO: 653623 - DNA, 20 bp, mouse
ggcagggcgtcgccccctag

SEQ ID NO: 653624 - DNA, 20 bp, mouse
gtgctgcgttaacccttgtc

SEQ ID NO: 653625 - DNA, 20 bp, mouse
gaggctggccaataggagac

SEQ ID NO: 653626 - DNA, 20 bp, mouse
ggcgtgagaccgggaacctg

SEQ ID NO: 653627 - DNA, 20 bp, mouse
ggggaacctgaggctgtgat

SEQ ID NO: 653628 - DNA, 20 bp, mouse
gctaggacaaactatgagag

SEQ ID NO: 653629 - DNA, 20 bp, mouse
gcgcgggtaaccatagtgac

SEQ ID NO: 653630 - DNA, 20 bp, mouse
gacttcttggaagtatggaa

SEQ ID NO: 653631 - DNA, 20 bp, mouse
gaccatagtgacaggaggcg

SEQ ID NO: 653632 - DNA, 20 bp, mouse
ggtctgccctaacacaccgg

SEQ ID NO: 653633 - DNA, 20 bp, mouse
ggaattggagccaagagcct

SEQ ID NO: 653634 - DNA, 20 bp, mouse
gaagggtccacggcattaag

SEQ ID NO: 653635 - DNA, 20 bp, mouse
gcagtcttctgcgtgagacc

SEQ ID NO: 653636 - DNA, 20 bp, mouse
gtgcgcaggcggtctcggga

SEQ ID NO: 653637 - DNA, 20 bp, mouse
gaagtgggggcgtagggcga

SEQ ID NO: 653638 - DNA, 20 bp, mouse
gcgcccgcccattgcgcagg

SEQ ID NO: 653639 - DNA, 20 bp, mouse
ggggctggtgagcgacccag

SEQ ID NO: 653640 - DNA, 20 bp, mouse
gccaccaggcgaagctgacc

SEQ ID NO: 653641 - DNA, 20 bp, mouse
gaggtgcaaagccgcccacg

SEQ ID NO: 653642 - DNA, 20 bp, mouse
gtgcgtgcgagggacgtcag

SEQ ID NO: 653643 - DNA, 20 bp, mouse
gccattgcgcaggcggtctc

SEQ ID NO: 653644 - DNA, 20 bp, mouse
gtccctcgcacgcacagcgg

SEQ ID NO: 653645 - DNA, 20 bp, mouse
gtggtcggaagtgggggcgt

SEQ ID NO: 653646 - DNA, 20 bp, mouse
gggcaacaggtggtgccgga

SEQ ID NO: 653647 - DNA, 20 bp, mouse
gccggcgccctaattggcaa

SEQ ID NO: 653648 - DNA, 20 bp, mouse
gaccacctgttgccctgagt

SEQ ID NO: 653649 - DNA, 20 bp, mouse
ggggccgctcccgccgcgta

SEQ ID NO: 653650 - DNA, 20 bp, mouse
ggagtggcgcggggtcatgt

SEQ ID NO: 653651 - DNA, 20 bp, mouse
gccgccggggagtctgtccc

SEQ ID NO: 653652 - DNA, 20 bp, mouse
gtcagggcaacaggtggtgc

SEQ ID NO: 653653 - DNA, 20 bp, mouse
gcccgccccggcgccctaat

SEQ ID NO: 653654 - DNA, 20 bp, mouse
gcggcagcgcagactccccc

SEQ ID NO: 653655 - DNA, 20 bp, mouse
gtcaccgtggcccatgctgc

SEQ ID NO: 653656 - DNA, 20 bp, mouse
gccggccgcgcgccgactgt

SEQ ID NO: 653657 - DNA, 20 bp, mouse
gccggcgggaagggtcgcct

SEQ ID NO: 653658 - DNA, 20 bp, mouse
gtgggcgagtttcgaacgat

SEQ ID NO: 653659 - DNA, 20 bp, mouse
gcaggcggggtcttctcggt

SEQ ID NO: 653660 - DNA, 20 bp, mouse
gcggtctcccggggtcaggc

SEQ ID NO: 653661 - DNA, 20 bp, mouse
ggggtcaggcggggtcttct

SEQ ID NO: 653662 - DNA, 20 bp, mouse
gcagcgactgcagagggcta

SEQ ID NO: 653663 - DNA, 20 bp, mouse
gcccgcggtctcccggggtc

SEQ ID NO: 653664 - DNA, 20 bp, mouse
gacgcgtcaccggattgggg

SEQ ID NO: 653665 - DNA, 20 bp, mouse
gcccgcagctggccgggcaa

SEQ ID NO: 653666 - DNA, 20 bp, mouse
gtgggacagactaaaggaac

SEQ ID NO: 653667 - DNA, 20 bp, mouse
ggctgcgcctgacgagagca

SEQ ID NO: 653668 - DNA, 20 bp, mouse
gactcattagggctgggagg

SEQ ID NO: 653669 - DNA, 20 bp, mouse
gtgcagccccagcctggaaa

SEQ ID NO: 653670 - DNA, 20 bp, mouse
gcagactaaaggaacaggcg

SEQ ID NO: 653671 - DNA, 20 bp, mouse
gggattgagggcaagtggat

SEQ ID NO: 653672 - DNA, 20 bp, mouse
gtaggtggaaggaaagtatg

SEQ ID NO: 653673 - DNA, 20 bp, mouse
ggggggggcagccggattga

SEQ ID NO: 653674 - DNA, 20 bp, mouse
gcctggaactcattagggct

SEQ ID NO: 653675 - DNA, 20 bp, mouse
gcacgagagggtttttaacg

SEQ ID NO: 653676 - DNA, 20 bp, mouse
gcggagggtcagtggaagga

SEQ ID NO: 653677 - DNA, 20 bp, mouse
gcaggcgccgtgcccggagg

SEQ ID NO: 653678 - DNA, 20 bp, mouse
gctgcggcgcggagggtcag

SEQ ID NO: 653679 - DNA, 20 bp, mouse
gagcgagggagctggaggcg

SEQ ID NO: 653680 - DNA, 20 bp, mouse
ggaggcctctgcggcgcgga

SEQ ID NO: 653681 - DNA, 20 bp, mouse
ggctgcttgtcagggaaaat

SEQ ID NO: 653682 - DNA, 20 bp, mouse
ggcggtggctcgggcagggg

SEQ ID NO: 653683 - DNA, 20 bp, mouse
gactgcgcaggcgccgtgcc

SEQ ID NO: 653684 - DNA, 20 bp, mouse
gcgccaatgtcggggatttg

SEQ ID NO: 653685 - DNA, 20 bp, mouse
gaacctcaaatccccgacat

SEQ ID NO: 653686 - DNA, 20 bp, mouse
gcgcacaccggaagtgtaca

SEQ ID NO: 653687 - DNA, 20 bp, mouse
ggaaggtcggcacgtgacgt

SEQ ID NO: 653688 - DNA, 20 bp, mouse
ggcccgggaccacccatcgc

SEQ ID NO: 653689 - DNA, 20 bp, mouse
gggtcctccctgtacacttc

SEQ ID NO: 653690 - DNA, 20 bp, mouse
ggatgggtggtcccgggcgt

SEQ ID NO: 653691 - DNA, 20 bp, mouse
gtcagcgggcgcctgggacg

SEQ ID NO: 653692 - DNA, 20 bp, mouse
ggtcggcgcgctgacgtcag

SEQ ID NO: 653693 - DNA, 20 bp, mouse
ggcggggtgtggccgatctg

SEQ ID NO: 653694 - DNA, 20 bp, mouse
ggggtggtcccgggcgtagg

SEQ ID NO: 653695 - DNA, 20 bp, mouse
ggggaccacccatcgccgga

SEQ ID NO: 653696 - DNA, 20 bp, mouse
gaagactaggtatttgtcta

SEQ ID NO: 653697 - DNA, 20 bp, mouse
gtgggattcccaggtctcga

SEQ ID NO: 653698 - DNA, 20 bp, mouse
gtcggtgctgagggtctgag

SEQ ID NO: 653699 - DNA, 20 bp, mouse
gagcgtccggtgggattccc

SEQ ID NO: 653700 - DNA, 20 bp, mouse
gccgagaaagagccagcgtc

SEQ ID NO: 653701 - DNA, 20 bp, mouse
gctaggggcaggaaagtgca

SEQ ID NO: 653702 - DNA, 20 bp, mouse
gaagctggaccgcccttgga

SEQ ID NO: 653703 - DNA, 20 bp, mouse
ggaaagagccagcgtccggt

SEQ ID NO: 653704 - DNA, 20 bp, mouse
ggtctcgagggtgacgcttg

SEQ ID NO: 653705 - DNA, 20 bp, mouse
gtctccaaaagccaccgctg

SEQ ID NO: 653706 - DNA, 20 bp, mouse
ggccccgcacgcctcccggc

SEQ ID NO: 653707 - DNA, 20 bp, mouse
gctcacgccgcccacgacga

SEQ ID NO: 653708 - DNA, 20 bp, mouse
gtgtgagcacggaagacacg

SEQ ID NO: 653709 - DNA, 20 bp, mouse
gacgccgcccacgacgaggg

SEQ ID NO: 653710 - DNA, 20 bp, mouse
gcactcggctcccaatgcag

SEQ ID NO: 653711 - DNA, 20 bp, mouse
gtcgtgggcggcgtgaggca

SEQ ID NO: 653712 - DNA, 20 bp, mouse
ggcgctaaccagaaccccgg

SEQ ID NO: 653713 - DNA, 20 bp, mouse
gccgtgctgctgggacgcaa

SEQ ID NO: 653714 - DNA, 20 bp, mouse
ggttagcgagagtgtgagca

SEQ ID NO: 653715 - DNA, 20 bp, mouse
gagaaaggagaacctgtggg

SEQ ID NO: 653716 - DNA, 20 bp, mouse
gcaggggtgtggccctcgag

SEQ ID NO: 653717 - DNA, 20 bp, mouse
ggggtgtggccctcgagagg

SEQ ID NO: 653718 - DNA, 20 bp, mouse
gggtgagagactaggtacgg

SEQ ID NO: 653719 - DNA, 20 bp, mouse
gcttccgctccgcctctcga

SEQ ID NO: 653720 - DNA, 20 bp, mouse
gtagagaggccccaggattt

SEQ ID NO: 653721 - DNA, 20 bp, mouse
ggaagagctagggactagag

SEQ ID NO: 653722 - DNA, 20 bp, mouse
gaggggagcgcttcattcgg

SEQ ID NO: 653723 - DNA, 20 bp, mouse
gctgaccaatcagagtgcag

SEQ ID NO: 653724 - DNA, 20 bp, mouse
gtgaggagcgagtttcgcga

SEQ ID NO: 653725 - DNA, 20 bp, mouse
gcatcccctgcgcagctgag

SEQ ID NO: 653726 - DNA, 20 bp, mouse
gaggagaagagagagcccgc

SEQ ID NO: 653727 - DNA, 20 bp, mouse
gccgtcccctgccaacgcgg

SEQ ID NO: 653728 - DNA, 20 bp, mouse
gagagagcccgcgggctcgc

SEQ ID NO: 653729 - DNA, 20 bp, mouse
ggctctgggttccgcctcta

SEQ ID NO: 653730 - DNA, 20 bp, mouse
gtctccgtgcacctccgcgt

SEQ ID NO: 653731 - DNA, 20 bp, mouse
gtgcacctccgcgttggcag

SEQ ID NO: 653732 - DNA, 20 bp, mouse
gtctcatgctagttagaggt

SEQ ID NO: 653733 - DNA, 20 bp, mouse
gacgccacctgcgagcccgc

SEQ ID NO: 653734 - DNA, 20 bp, mouse
gccgtcccggaagatcatcc

SEQ ID NO: 653735 - DNA, 20 bp, mouse
gcgaccgtcccctgccaacg

SEQ ID NO: 653736 - DNA, 20 bp, mouse
ggggctcagaaaattggctg

SEQ ID NO: 653737 - DNA, 20 bp, mouse
gtggtctgtctgtgattggc

SEQ ID NO: 653738 - DNA, 20 bp, mouse
ggacagcgggtccttcggat

SEQ ID NO: 653739 - DNA, 20 bp, mouse
gtggttctgcggttaaagca

SEQ ID NO: 653740 - DNA, 20 bp, mouse
gaatcccctacctaaactaa

SEQ ID NO: 653741 - DNA, 20 bp, mouse
gcccctacctaaactaaagg

SEQ ID NO: 653742 - DNA, 20 bp, mouse
gggcggcagcgacaaccagc

SEQ ID NO: 653743 - DNA, 20 bp, mouse
gtcagaaaattggctgcggg

SEQ ID NO: 653744 - DNA, 20 bp, mouse
gctgcggttaaagcacggca

SEQ ID NO: 653745 - DNA, 20 bp, mouse
ggttcagctgtcaatataag

SEQ ID NO: 653746 - DNA, 20 bp, mouse
gaccgcgcgcagaaccgtag

SEQ ID NO: 653747 - DNA, 20 bp, mouse
gcggaggcgcgaactgtatc

SEQ ID NO: 653748 - DNA, 20 bp, mouse
ggcgcgcccggcatagtgaa

SEQ ID NO: 653749 - DNA, 20 bp, mouse
gcctccggaagcggagtccc

SEQ ID NO: 653750 - DNA, 20 bp, mouse
gaatgagagtgttgtcgcgg

SEQ ID NO: 653751 - DNA, 20 bp, mouse
gcgtgcccacaggacccgaa

SEQ ID NO: 653752 - DNA, 20 bp, mouse
gtacccggggactccgcttc

SEQ ID NO: 653753 - DNA, 20 bp, mouse
gcgagggaggaagcgactgg

SEQ ID NO: 653754 - DNA, 20 bp, mouse
gtgcaagagcgggttacccg

SEQ ID NO: 653755 - DNA, 20 bp, mouse
gcgcgcgcgcggttgccctg

SEQ ID NO: 653756 - DNA, 20 bp, mouse
ggcggccgggaggagcgtga

SEQ ID NO: 653757 - DNA, 20 bp, mouse
gctaggccagcgcccgcggg

SEQ ID NO: 653758 - DNA, 20 bp, mouse
ggcgccgtggccacacccat

SEQ ID NO: 653759 - DNA, 20 bp, mouse
gcaccgttcaagccagaaag

SEQ ID NO: 653760 - DNA, 20 bp, mouse
gccagaaagcggtgcagtca

SEQ ID NO: 653761 - DNA, 20 bp, mouse
ggtcagggcggggcaaacga

SEQ ID NO: 653762 - DNA, 20 bp, mouse
gggcctaggccagcgcccgc

SEQ ID NO: 653763 - DNA, 20 bp, mouse
gcgcgctccagtctcgcgcg

SEQ ID NO: 653764 - DNA, 20 bp, mouse
gaaagcggtgcagtcagggc

SEQ ID NO: 653765 - DNA, 20 bp, mouse
gcctaggccgcgcgcgagac

SEQ ID NO: 653766 - DNA, 20 bp, mouse
gtggcaccaaggcgagggaa

SEQ ID NO: 653767 - DNA, 20 bp, mouse
gcggaagcgcacggaaagag

SEQ ID NO: 653768 - DNA, 20 bp, mouse
ggggagacccataatttggg

SEQ ID NO: 653769 - DNA, 20 bp, mouse
ggcgagggaagggtgtgtcg

SEQ ID NO: 653770 - DNA, 20 bp, mouse
gcggcgacatcgccacctga

SEQ ID NO: 653771 - DNA, 20 bp, mouse
gtgaattggcaccaaggcga

SEQ ID NO: 653772 - DNA, 20 bp, mouse
gcctgcgctgggccaggcgt

SEQ ID NO: 653773 - DNA, 20 bp, mouse
gaggtggcgatgtcgccgga

SEQ ID NO: 653774 - DNA, 20 bp, mouse
ggagggcgctgggagtctac

SEQ ID NO: 653775 - DNA, 20 bp, mouse
gacacacccttccctcgcct

SEQ ID NO: 653776 - DNA, 20 bp, mouse
gacaatacagactggctcag

SEQ ID NO: 653777 - DNA, 20 bp, mouse
gttaagctgacaatacagac

SEQ ID NO: 653778 - DNA, 20 bp, mouse
gaggctgggggattaggagt

SEQ ID NO: 653779 - DNA, 20 bp, mouse
gtctaggaaagataggctgg

SEQ ID NO: 653780 - DNA, 20 bp, mouse
gaaagataggctgggggatt

SEQ ID NO: 653781 - DNA, 20 bp, mouse
gcgtgaaggaccctgtggtt

SEQ ID NO: 653782 - DNA, 20 bp, mouse
gtgggtttgcgccctcctag

SEQ ID NO: 653783 - DNA, 20 bp, mouse
gagcggcaggcacatccgaa

SEQ ID NO: 653784 - DNA, 20 bp, mouse
gccgtgaaaaacaccctgga

SEQ ID NO: 653785 - DNA, 20 bp, mouse
ggagttcattgcttaagttc

SEQ ID NO: 653786 - DNA, 20 bp, mouse
gaggacccagaacactgaat

SEQ ID NO: 653787 - DNA, 20 bp, mouse
gtgtagtcgcggagccacga

SEQ ID NO: 653788 - DNA, 20 bp, mouse
gtccgcgactacaattccca

SEQ ID NO: 653789 - DNA, 20 bp, mouse
ggagctagaccggacctatg

SEQ ID NO: 653790 - DNA, 20 bp, mouse
gaggacacccaaccagaggc

SEQ ID NO: 653791 - DNA, 20 bp, mouse
gctcaaacctagtagctcat

SEQ ID NO: 653792 - DNA, 20 bp, mouse
gagaacatcccgcctctggt

SEQ ID NO: 653793 - DNA, 20 bp, mouse
gacgcacagacgtggatgaa

SEQ ID NO: 653794 - DNA, 20 bp, mouse
gagggttcccgcggcaggaa

SEQ ID NO: 653795 - DNA, 20 bp, mouse
gaccctgggaattgtagtcg

SEQ ID NO: 653796 - DNA, 20 bp, mouse
gcggggccgggtaaaatgag

SEQ ID NO: 653797 - DNA, 20 bp, mouse
ggagtgttggggcggagcta

SEQ ID NO: 653798 - DNA, 20 bp, mouse
gcggggcgagtgcagagagg

SEQ ID NO: 653799 - DNA, 20 bp, mouse
ggacgggagagtgagtgttg

SEQ ID NO: 653800 - DNA, 20 bp, mouse
gccgggtaaaatgagagggc

SEQ ID NO: 653801 - DNA, 20 bp, mouse
gtggaccaagaccgggactg

SEQ ID NO: 653802 - DNA, 20 bp, mouse
gggcaggacagtacaggccg

SEQ ID NO: 653803 - DNA, 20 bp, mouse
ggaaccgcagcacacagggt

SEQ ID NO: 653804 - DNA, 20 bp, mouse
gaaaaagctgcttgcactag

SEQ ID NO: 653805 - DNA, 20 bp, mouse
gtagcagggcggcttccgga

SEQ ID NO: 653806 - DNA, 20 bp, mouse
gaggcctcagagtggttcag

SEQ ID NO: 653807 - DNA, 20 bp, mouse
gactctaggggtagaaggga

SEQ ID NO: 653808 - DNA, 20 bp, mouse
gaagaagtcagagactctag

SEQ ID NO: 653809 - DNA, 20 bp, mouse
gctggcagggcccagaacca

SEQ ID NO: 653810 - DNA, 20 bp, mouse
gctcagagtggttcagagga

SEQ ID NO: 653811 - DNA, 20 bp, mouse
gttaggagatgacggggtcc

SEQ ID NO: 653812 - DNA, 20 bp, mouse
gaatcagcactaggcaacaa

SEQ ID NO: 653813 - DNA, 20 bp, mouse
gggagggaaggtgctacttt

SEQ ID NO: 653814 - DNA, 20 bp, mouse
ggtggaaaggctcatctctt

SEQ ID NO: 653815 - DNA, 20 bp, mouse
ggaaccactctgaggcctcc

SEQ ID NO: 653816 - DNA, 20 bp, mouse
gcgggcaggagcatacccac

SEQ ID NO: 653817 - DNA, 20 bp, mouse
gtggctagagggattggcgc

SEQ ID NO: 653818 - DNA, 20 bp, mouse
gagggcccgtgcgggagcgc

SEQ ID NO: 653819 - DNA, 20 bp, mouse
gcagcgtcgaggcgtggcga

SEQ ID NO: 653820 - DNA, 20 bp, mouse
gggggaaaggcaagaatggg

SEQ ID NO: 653821 - DNA, 20 bp, mouse
gcgtgcgtggctagagggat

SEQ ID NO: 653822 - DNA, 20 bp, mouse
ggagcatacccacaggggaa

SEQ ID NO: 653823 - DNA, 20 bp, mouse
ggcgtggcgagggcccgtgc

SEQ ID NO: 653824 - DNA, 20 bp, mouse
gctacgcgtgcgtggctaga

SEQ ID NO: 653825 - DNA, 20 bp, mouse
gcgcacgcgtagcagcgtcg

SEQ ID NO: 653826 - DNA, 20 bp, mouse
gtctgaagacgaggaaggga

SEQ ID NO: 653827 - DNA, 20 bp, mouse
gaatatctgaagacgaggaa

SEQ ID NO: 653828 - DNA, 20 bp, mouse
gatggggcggtgtacatcta

SEQ ID NO: 653829 - DNA, 20 bp, mouse
gtgccatggcaagtctaaca

SEQ ID NO: 653830 - DNA, 20 bp, mouse
gacttgccatggcacgattg

SEQ ID NO: 653831 - DNA, 20 bp, mouse
ggcacgattgtggttcctgc

SEQ ID NO: 653832 - DNA, 20 bp, mouse
ggaaggagccaattaactga

SEQ ID NO: 653833 - DNA, 20 bp, mouse
gaggatggctagggggcaga

SEQ ID NO: 653834 - DNA, 20 bp, mouse
gaggaaccacaatcgtgcca

SEQ ID NO: 653835 - DNA, 20 bp, mouse
ggaaagaatatctgaagacg

SEQ ID NO: 653836 - DNA, 20 bp, mouse
gcagctcagtctaggtactt

SEQ ID NO: 653837 - DNA, 20 bp, mouse
gcaggctgctggaagaatcc

SEQ ID NO: 653838 - DNA, 20 bp, mouse
ggctcatgccagctcagtct

SEQ ID NO: 653839 - DNA, 20 bp, mouse
ggcggcgggcgggtgtttac

SEQ ID NO: 653840 - DNA, 20 bp, mouse
gtctgagcagcagcgactag

SEQ ID NO: 653841 - DNA, 20 bp, mouse
gctggtgttttcaagatgca

SEQ ID NO: 653842 - DNA, 20 bp, mouse
gcacgggcatattttctcac

SEQ ID NO: 653843 - DNA, 20 bp, mouse
gagcagcagcgactagaggc

SEQ ID NO: 653844 - DNA, 20 bp, mouse
gatgagccctagggctctgc

SEQ ID NO: 653845 - DNA, 20 bp, mouse
gtatgcccgtgaaacatcac

SEQ ID NO: 653846 - DNA, 20 bp, mouse
ggcggctccagaagtgacca

SEQ ID NO: 653847 - DNA, 20 bp, mouse
gaccagggagaatctagatg

SEQ ID NO: 653848 - DNA, 20 bp, mouse
gttggagaacggggcactgg

SEQ ID NO: 653849 - DNA, 20 bp, mouse
gagggggcgctcatgtagcg

SEQ ID NO: 653850 - DNA, 20 bp, mouse
gggagccgcaagttccattg

SEQ ID NO: 653851 - DNA, 20 bp, mouse
gttggggactgcaggatcac

SEQ ID NO: 653852 - DNA, 20 bp, mouse
gtggaggccggtaccggaaa

SEQ ID NO: 653853 - DNA, 20 bp, mouse
ggtaagggcggtcacaccca

SEQ ID NO: 653854 - DNA, 20 bp, mouse
gtgttccggccgcgccagga

SEQ ID NO: 653855 - DNA, 20 bp, mouse
gtcggccgcaatggaacttg

SEQ ID NO: 653856 - DNA, 20 bp, mouse
gtcgccaggcggtggataag

SEQ ID NO: 653857 - DNA, 20 bp, mouse
ggcggcgctgcggaaaccgt

SEQ ID NO: 653858 - DNA, 20 bp, mouse
gtccccgcctcgccaggcgg

SEQ ID NO: 653859 - DNA, 20 bp, mouse
ggataaggggcccgaggcgg

SEQ ID NO: 653860 - DNA, 20 bp, mouse
ggcgcgctgctcacttctca

SEQ ID NO: 653861 - DNA, 20 bp, mouse
gcctgcgcgacgcggcgctg

SEQ ID NO: 653862 - DNA, 20 bp, mouse
ggtggataaggggcccgagg

SEQ ID NO: 653863 - DNA, 20 bp, mouse
ggcccgggccctggagacct

SEQ ID NO: 653864 - DNA, 20 bp, mouse
gatccaccgcctggcgaggc

SEQ ID NO: 653865 - DNA, 20 bp, mouse
gctgcgcgaaagagcgaaga

SEQ ID NO: 653866 - DNA, 20 bp, mouse
ggggatgcgtcgaaggagag

SEQ ID NO: 653867 - DNA, 20 bp, mouse
ggcggcggctgcgcagtgga

SEQ ID NO: 653868 - DNA, 20 bp, mouse
gcgcagcggggatgcgtcga

SEQ ID NO: 653869 - DNA, 20 bp, mouse
ggcgtcgaaggagagaggaa

SEQ ID NO: 653870 - DNA, 20 bp, mouse
gcaacccgggcgagacgctg

SEQ ID NO: 653871 - DNA, 20 bp, mouse
gaaacggagtgagcgggacc

SEQ ID NO: 653872 - DNA, 20 bp, mouse
gtggttactgggcgcctcct

SEQ ID NO: 653873 - DNA, 20 bp, mouse
gcggtgcagggagtgtggta

SEQ ID NO: 653874 - DNA, 20 bp, mouse
gtccagctctagaaatccgg

SEQ ID NO: 653875 - DNA, 20 bp, mouse
gctagccccgccccaggaaa

SEQ ID NO: 653876 - DNA, 20 bp, mouse
ggggctgggcagaagggcga

SEQ ID NO: 653877 - DNA, 20 bp, mouse
ggggcagaagggcgagggat

SEQ ID NO: 653878 - DNA, 20 bp, mouse
gcgtcgctcgagcaccgaag

SEQ ID NO: 653879 - DNA, 20 bp, mouse
gctggggcgcggtctgttct

SEQ ID NO: 653880 - DNA, 20 bp, mouse
gtactctcggctggggtcag

SEQ ID NO: 653881 - DNA, 20 bp, mouse
ggggaaaccgcgccggaccc

SEQ ID NO: 653882 - DNA, 20 bp, mouse
gagctcgtcgagccagggtg

SEQ ID NO: 653883 - DNA, 20 bp, mouse
gctcgagcaccgaaggggct

SEQ ID NO: 653884 - DNA, 20 bp, mouse
gagggattgggaaaccgcgc

SEQ ID NO: 653885 - DNA, 20 bp, mouse
gaggctccgccccccacccg

SEQ ID NO: 653886 - DNA, 20 bp, mouse
gcgtacaggcgtgtggcgtg

SEQ ID NO: 653887 - DNA, 20 bp, mouse
gttgctgggcgaagacgacg

SEQ ID NO: 653888 - DNA, 20 bp, mouse
gaccggaagtgaggccgtac

SEQ ID NO: 653889 - DNA, 20 bp, mouse
gtggtgctcggatcttacat

SEQ ID NO: 653890 - DNA, 20 bp, mouse
ggtggtgagtaccggaagtg

SEQ ID NO: 653891 - DNA, 20 bp, mouse
gtcccggaagactctgtcgt

SEQ ID NO: 653892 - DNA, 20 bp, mouse
gtaccatacgtggtgagtac

SEQ ID NO: 653893 - DNA, 20 bp, mouse
gcgactcggccaatcttgct

SEQ ID NO: 653894 - DNA, 20 bp, mouse
ggagtgggaggtaccatacg

SEQ ID NO: 653895 - DNA, 20 bp, mouse
ggaatcaaactcccttcgtc

SEQ ID NO: 653896 - DNA, 20 bp, mouse
gggacctggtgtggcgggga

SEQ ID NO: 653897 - DNA, 20 bp, mouse
ggtagaccagaattaggagg

SEQ ID NO: 653898 - DNA, 20 bp, mouse
gtaggcttcggctcacgtga

SEQ ID NO: 653899 - DNA, 20 bp, mouse
gggcaggacctggtgtggcg

SEQ ID NO: 653900 - DNA, 20 bp, mouse
gcaggctcttcccagttgaa

SEQ ID NO: 653901 - DNA, 20 bp, mouse
gctcctgctgcagtgttgat

SEQ ID NO: 653902 - DNA, 20 bp, mouse
gaaggtagaccagaattagg

SEQ ID NO: 653903 - DNA, 20 bp, mouse
gggtctgcacacgtaggctt

SEQ ID NO: 653904 - DNA, 20 bp, mouse
gcttcccagttgaaagggaa

SEQ ID NO: 653905 - DNA, 20 bp, mouse
gaaagaagctccttgcggtt

SEQ ID NO: 653906 - DNA, 20 bp, mouse
ggcaagggaaacggtgagta

SEQ ID NO: 653907 - DNA, 20 bp, mouse
gagggagaaggggctactta

SEQ ID NO: 653908 - DNA, 20 bp, mouse
ggagaaagaaggttcacaaa

SEQ ID NO: 653909 - DNA, 20 bp, mouse
ggggctacttagggcctcag

SEQ ID NO: 653910 - DNA, 20 bp, mouse
gggtaggagtagggtaaagg

SEQ ID NO: 653911 - DNA, 20 bp, mouse
gctggacgatggagaattga

SEQ ID NO: 653912 - DNA, 20 bp, mouse
gggtgggaagaggtaggagt

SEQ ID NO: 653913 - DNA, 20 bp, mouse
gtacaggagcagaaactcaa

SEQ ID NO: 653914 - DNA, 20 bp, mouse
gcccagttagcagagaaaga

SEQ ID NO: 653915 - DNA, 20 bp, mouse
gcaggtcctgtcaatcatgc

SEQ ID NO: 653916 - DNA, 20 bp, mouse
gggaaagtggggaaccgagt

SEQ ID NO: 653917 - DNA, 20 bp, mouse
gagtaacaaggcctagtatg

SEQ ID NO: 653918 - DNA, 20 bp, mouse
gcatcctcccctggggctaa

SEQ ID NO: 653919 - DNA, 20 bp, mouse
gtgacccttagccccagggg

SEQ ID NO: 653920 - DNA, 20 bp, mouse
gagcaagactagaggaagat

SEQ ID NO: 653921 - DNA, 20 bp, mouse
gaggacagcatcctcccctg

SEQ ID NO: 653922 - DNA, 20 bp, mouse
ggtcctgttttggtaattgg

SEQ ID NO: 653923 - DNA, 20 bp, mouse
gcgcctgcatgcaacttctg

SEQ ID NO: 653924 - DNA, 20 bp, mouse
gacaagtgacccttagcccc

SEQ ID NO: 653925 - DNA, 20 bp, mouse
gcaaggcctagtatggggga

SEQ ID NO: 653926 - DNA, 20 bp, mouse
gggtccctggttactaggaa

SEQ ID NO: 653927 - DNA, 20 bp, mouse
gtgcctgtgcgtacagaagg

SEQ ID NO: 653928 - DNA, 20 bp, mouse
gggcggggcgctctggggct

SEQ ID NO: 653929 - DNA, 20 bp, mouse
gagcgcagagatgagtgaca

SEQ ID NO: 653930 - DNA, 20 bp, mouse
gagatggtgatgacacttgt

SEQ ID NO: 653931 - DNA, 20 bp, mouse
ggacccccttctgtacgcac

SEQ ID NO: 653932 - DNA, 20 bp, mouse
gtgacagggcggggcgctct

SEQ ID NO: 653933 - DNA, 20 bp, mouse
gcagagatgagtgacagggc

SEQ ID NO: 653934 - DNA, 20 bp, mouse
gtggcgcacggacgcgagga

SEQ ID NO: 653935 - DNA, 20 bp, mouse
ggcagaaaaggctacagtcg

SEQ ID NO: 653936 - DNA, 20 bp, mouse
gaagcggagtgatactactg

SEQ ID NO: 653937 - DNA, 20 bp, mouse
gaggttctgatcccgaacta

SEQ ID NO: 653938 - DNA, 20 bp, mouse
ggcgcggttttccctagttc

SEQ ID NO: 653939 - DNA, 20 bp, mouse
gtggaaagacatgtctaaga

SEQ ID NO: 653940 - DNA, 20 bp, mouse
ggaagtgagctggttaggta

SEQ ID NO: 653941 - DNA, 20 bp, mouse
gggcgcacactgcgacactt

SEQ ID NO: 653942 - DNA, 20 bp, mouse
gcgcggctacgtcattacgg

SEQ ID NO: 653943 - DNA, 20 bp, mouse
ggtggcgtcagaagaaaaag

SEQ ID NO: 653944 - DNA, 20 bp, mouse
gcgccgggacgcactaggcg

SEQ ID NO: 653945 - DNA, 20 bp, mouse
gctaaccagctcacttcagt

SEQ ID NO: 653946 - DNA, 20 bp, mouse
ggtacctcccccaatacttg

SEQ ID NO: 653947 - DNA, 20 bp, mouse
gaacagggccccaagtattg

SEQ ID NO: 653948 - DNA, 20 bp, mouse
gggggaggtacagagcttac

SEQ ID NO: 653949 - DNA, 20 bp, mouse
gctcctgccgcactgcttgt

SEQ ID NO: 653950 - DNA, 20 bp, mouse
gtgtagcagaattgaagaga

SEQ ID NO: 653951 - DNA, 20 bp, mouse
gcagagactgaaaatagaga

SEQ ID NO: 653952 - DNA, 20 bp, mouse
ggcttgtgggagtggaaatt

SEQ ID NO: 653953 - DNA, 20 bp, mouse
gctagagcttactggtgacg

SEQ ID NO: 653954 - DNA, 20 bp, mouse
ggggatggaaattaaagaaa

SEQ ID NO: 653955 - DNA, 20 bp, mouse
gatagagaaaccgtaacttc

SEQ ID NO: 653956 - DNA, 20 bp, mouse
gctcgggtcaccggactcac

SEQ ID NO: 653957 - DNA, 20 bp, mouse
gacgccgagaaggccggatt

SEQ ID NO: 653958 - DNA, 20 bp, mouse
gcggtgacccgaggagtgct

SEQ ID NO: 653959 - DNA, 20 bp, mouse
gaggcttcctagcactcctc

SEQ ID NO: 653960 - DNA, 20 bp, mouse
ggtgactcggccagtgagtc

SEQ ID NO: 653961 - DNA, 20 bp, mouse
ggtcactagcccggcctcta

SEQ ID NO: 653962 - DNA, 20 bp, mouse
ggtaagtcgccatagaggcc

SEQ ID NO: 653963 - DNA, 20 bp, mouse
ggctaccgcggaatccaaga

SEQ ID NO: 653964 - DNA, 20 bp, mouse
gagtctccagacagcctccc

SEQ ID NO: 653965 - DNA, 20 bp, mouse
gcggtaaggtgcctaatctg

SEQ ID NO: 653966 - DNA, 20 bp, mouse
gcaccccagccgcaccacaa

SEQ ID NO: 653967 - DNA, 20 bp, mouse
gatacctggggaccctacta

SEQ ID NO: 653968 - DNA, 20 bp, mouse
ggaccctactagggcggata

SEQ ID NO: 653969 - DNA, 20 bp, mouse
gaggcgctgtcccctcgcgg

SEQ ID NO: 653970 - DNA, 20 bp, mouse
gccacaaaggctgaacccgg

SEQ ID NO: 653971 - DNA, 20 bp, mouse
gcacctgcgcggacccgagg

SEQ ID NO: 653972 - DNA, 20 bp, mouse
gcagaggaacggggagcgcg

SEQ ID NO: 653973 - DNA, 20 bp, mouse
ggggttcagcctttgtggtg

SEQ ID NO: 653974 - DNA, 20 bp, mouse
gctcccgggcaccctggcta

SEQ ID NO: 653975 - DNA, 20 bp, mouse
gcccgcgctcctcctttccc

SEQ ID NO: 653976 - DNA, 20 bp, mouse
ggcgcggctcctccattggt

SEQ ID NO: 653977 - DNA, 20 bp, mouse
gcggctcctccattggtggg

SEQ ID NO: 653978 - DNA, 20 bp, mouse
gagagcgaacggagttgtct

SEQ ID NO: 653979 - DNA, 20 bp, mouse
gcttccccgcccaccaatgg

SEQ ID NO: 653980 - DNA, 20 bp, mouse
gcgggaagaggcaggtatcc

SEQ ID NO: 653981 - DNA, 20 bp, mouse
gggctgcgcggctcctccat

SEQ ID NO: 653982 - DNA, 20 bp, mouse
gagcagaacgcgaattggtt

SEQ ID NO: 653983 - DNA, 20 bp, mouse
ggctgaggagcaggggacaa

SEQ ID NO: 653984 - DNA, 20 bp, mouse
ggaccaatggcaagacggca

SEQ ID NO: 653985 - DNA, 20 bp, mouse
ggttgggcacagcgattggt

SEQ ID NO: 653986 - DNA, 20 bp, mouse
gaggacggggagacccttca

SEQ ID NO: 653987 - DNA, 20 bp, mouse
gtgcaagaaagactggtctg

SEQ ID NO: 653988 - DNA, 20 bp, mouse
ggggcggttgtaaaaagaaa

SEQ ID NO: 653989 - DNA, 20 bp, mouse
gtgcgcttggggctctgctg

SEQ ID NO: 653990 - DNA, 20 bp, mouse
ggccctcagtggcgctggaa

SEQ ID NO: 653991 - DNA, 20 bp, mouse
gaaagcaagaggtggaggac

SEQ ID NO: 653992 - DNA, 20 bp, mouse
gagggacaaggcacccgcac

SEQ ID NO: 653993 - DNA, 20 bp, mouse
gcgggtgccttgtccctccc

SEQ ID NO: 653994 - DNA, 20 bp, mouse
gggaacgccctcagtggcgc

SEQ ID NO: 653995 - DNA, 20 bp, mouse
gccaagaggaacgccctcag

SEQ ID NO: 653996 - DNA, 20 bp, mouse
gcagccgctcgtcagcgcta

SEQ ID NO: 653997 - DNA, 20 bp, mouse
gacgccctagcgctgacgag

SEQ ID NO: 653998 - DNA, 20 bp, mouse
gcgtgcttgtggaactggat

SEQ ID NO: 653999 - DNA, 20 bp, mouse
ggggagaggctgacagatcc

SEQ ID NO: 654000 - DNA, 20 bp, mouse
gcggaggagggaggcctaga

SEQ ID NO: 654001 - DNA, 20 bp, mouse
gtagggcgtgcttgtggaac

SEQ ID NO: 654002 - DNA, 20 bp, mouse
ggccaagcgccagctgagag

SEQ ID NO: 654003 - DNA, 20 bp, mouse
ggcgtgttctgtctgaagag

SEQ ID NO: 654004 - DNA, 20 bp, mouse
gcagcgctagggcgtgcttg

SEQ ID NO: 654005 - DNA, 20 bp, mouse
gacgctgcacacttgggcca

SEQ ID NO: 654006 - DNA, 20 bp, mouse
gcggctgtggccagatctca

SEQ ID NO: 654007 - DNA, 20 bp, mouse
ggggcggcttagtaccccga

SEQ ID NO: 654008 - DNA, 20 bp, mouse
gagggcccgcccacccctcg

SEQ ID NO: 654009 - DNA, 20 bp, mouse
gagggcggaagcccgagatc

SEQ ID NO: 654010 - DNA, 20 bp, mouse
ggtcccgcccccggtccctg

SEQ ID NO: 654011 - DNA, 20 bp, mouse
ggccgcagccacttcctcgt

SEQ ID NO: 654012 - DNA, 20 bp, mouse
gcgatctccgaacgaattct

SEQ ID NO: 654013 - DNA, 20 bp, mouse
gagtaccccgaggggtgggc

SEQ ID NO: 654014 - DNA, 20 bp, mouse
ggacttaactgaggtccggg

SEQ ID NO: 654015 - DNA, 20 bp, mouse
gcgggcaaccaagaattcaa

SEQ ID NO: 654016 - DNA, 20 bp, mouse
gtgcacgcgcgaggtcgaag

SEQ ID NO: 654017 - DNA, 20 bp, mouse
ggggaatgacaggtgagcgt

SEQ ID NO: 654018 - DNA, 20 bp, mouse
gtgcgggcggcgagcggaag

SEQ ID NO: 654019 - DNA, 20 bp, mouse
gcaagcgcgtcccggtgagg

SEQ ID NO: 654020 - DNA, 20 bp, mouse
gcgcgaggtcgaagcggaaa

SEQ ID NO: 654021 - DNA, 20 bp, mouse
gctcgcccgcaagcgcgtcc

SEQ ID NO: 654022 - DNA, 20 bp, mouse
gggatcgtcaagtaaggcgg

SEQ ID NO: 654023 - DNA, 20 bp, mouse
gaaggggcaggtggattgta

SEQ ID NO: 654024 - DNA, 20 bp, mouse
gccgcaagcgcgtcccggtg

SEQ ID NO: 654025 - DNA, 20 bp, mouse
gggtgagcgtaggactctcc

SEQ ID NO: 654026 - DNA, 20 bp, mouse
gctgaccgcaagtgacgcca

SEQ ID NO: 654027 - DNA, 20 bp, mouse
gcagcgtgaggcgatgaccg

SEQ ID NO: 654028 - DNA, 20 bp, mouse
gaaagcacgttcagaataaa

SEQ ID NO: 654029 - DNA, 20 bp, mouse
ggattattaaccacttgcga

SEQ ID NO: 654030 - DNA, 20 bp, mouse
gcagggggcgcgtcagcgtg

SEQ ID NO: 654031 - DNA, 20 bp, mouse
gcgccccctggcgtcacttg

SEQ ID NO: 654032 - DNA, 20 bp, mouse
gcacttccggtgacttgctc

SEQ ID NO: 654033 - DNA, 20 bp, mouse
gcgcagccggagcaagtcac

SEQ ID NO: 654034 - DNA, 20 bp, mouse
gcatagcagaagggtaaatc

SEQ ID NO: 654035 - DNA, 20 bp, mouse
gtcaggcgactgagtggtac

SEQ ID NO: 654036 - DNA, 20 bp, mouse
gacctgctatgagacagtag

SEQ ID NO: 654037 - DNA, 20 bp, mouse
gcgcgatggtgagagaccag

SEQ ID NO: 654038 - DNA, 20 bp, mouse
gcggctgcgcctctctcgaa

SEQ ID NO: 654039 - DNA, 20 bp, mouse
ggaagtgctgtcggagactg

SEQ ID NO: 654040 - DNA, 20 bp, mouse
gccacctcccggagattcgt

SEQ ID NO: 654041 - DNA, 20 bp, mouse
ggaaccctacggttgcaaat

SEQ ID NO: 654042 - DNA, 20 bp, mouse
gcctctacaggcaaaacaca

SEQ ID NO: 654043 - DNA, 20 bp, mouse
gggaggagcccggagaggat

SEQ ID NO: 654044 - DNA, 20 bp, mouse
gtcgaaagggcaggcgtcgc

SEQ ID NO: 654045 - DNA, 20 bp, mouse
gtccggggcgatttcacact

SEQ ID NO: 654046 - DNA, 20 bp, mouse
gcgggagcgcgcgtcggcag

SEQ ID NO: 654047 - DNA, 20 bp, mouse
gcggagacgcgattggtcgc

SEQ ID NO: 654048 - DNA, 20 bp, mouse
ggacgccccagagcggaaga

SEQ ID NO: 654049 - DNA, 20 bp, mouse
gcgcgggcccgctgcaggaa

SEQ ID NO: 654050 - DNA, 20 bp, mouse
gggcgcacggtccgaatgga

SEQ ID NO: 654051 - DNA, 20 bp, mouse
ggccgagcccgctagcgcgc

SEQ ID NO: 654052 - DNA, 20 bp, mouse
gcggcgggtcgacagaaagc

SEQ ID NO: 654053 - DNA, 20 bp, mouse
ggcgcgctcccgggggacgc

SEQ ID NO: 654054 - DNA, 20 bp, mouse
ggcgtcggcaggggagcgcg

SEQ ID NO: 654055 - DNA, 20 bp, mouse
gccgctgcaggaaaggggcg

SEQ ID NO: 654056 - DNA, 20 bp, mouse
ggaactgcgccgtgggatcg

SEQ ID NO: 654057 - DNA, 20 bp, mouse
gtataccagcagcccggctt

SEQ ID NO: 654058 - DNA, 20 bp, mouse
gttcggagaggacagagtta

SEQ ID NO: 654059 - DNA, 20 bp, mouse
gcggaaccggaagctcttgt

SEQ ID NO: 654060 - DNA, 20 bp, mouse
gcagcagcccggcttcggag

SEQ ID NO: 654061 - DNA, 20 bp, mouse
ggtgggcggaactgcgccgt

SEQ ID NO: 654062 - DNA, 20 bp, mouse
gccagcgcttctgtccgctc

SEQ ID NO: 654063 - DNA, 20 bp, mouse
gtcgtggaatgctgatgaag

SEQ ID NO: 654064 - DNA, 20 bp, mouse
gccgtcgcccgcccacttcc

SEQ ID NO: 654065 - DNA, 20 bp, mouse
gtcccgcccccaagcggagc

SEQ ID NO: 654066 - DNA, 20 bp, mouse
gaggactaaataggaggtca

SEQ ID NO: 654067 - DNA, 20 bp, mouse
ggggaattgtagttggtctg

SEQ ID NO: 654068 - DNA, 20 bp, mouse
gaagcagaggactaaatagg

SEQ ID NO: 654069 - DNA, 20 bp, mouse
ggggttgtctggaaaggcgg

SEQ ID NO: 654070 - DNA, 20 bp, mouse
ggagcagtggtagcttgaag

SEQ ID NO: 654071 - DNA, 20 bp, mouse
gtggggttaaactgaagcag

SEQ ID NO: 654072 - DNA, 20 bp, mouse
gcatggacggaagtgaggtg

SEQ ID NO: 654073 - DNA, 20 bp, mouse
gaaaaggtggcgctgaggca

SEQ ID NO: 654074 - DNA, 20 bp, mouse
gagaagaaaaggtggcgctg

SEQ ID NO: 654075 - DNA, 20 bp, mouse
gagaggaagtaaagatggat

SEQ ID NO: 654076 - DNA, 20 bp, mouse
gtagctctgaccacataggt

SEQ ID NO: 654077 - DNA, 20 bp, mouse
ggtggtcagagctacagctg

SEQ ID NO: 654078 - DNA, 20 bp, mouse
gaggaggtccatgagatctg

SEQ ID NO: 654079 - DNA, 20 bp, mouse
ggaactaggagggagcatta

SEQ ID NO: 654080 - DNA, 20 bp, mouse
gggaagctgttgggccaggt

SEQ ID NO: 654081 - DNA, 20 bp, mouse
ggctcctgggtggatgtcct

SEQ ID NO: 654082 - DNA, 20 bp, mouse
ggctgtagctctgaccacat

SEQ ID NO: 654083 - DNA, 20 bp, mouse
gaggttgcctgctgagtcag

SEQ ID NO: 654084 - DNA, 20 bp, mouse
gggagcattaaggaggatag

SEQ ID NO: 654085 - DNA, 20 bp, mouse
gctccctcctagttcacagg

SEQ ID NO: 654086 - DNA, 20 bp, mouse
gccgggaagcggggatatta

SEQ ID NO: 654087 - DNA, 20 bp, mouse
gaacaggtttggggttaatg

SEQ ID NO: 654088 - DNA, 20 bp, mouse
gtcagagcggcacccacgca

SEQ ID NO: 654089 - DNA, 20 bp, mouse
gcctcctataatttggacaa

SEQ ID NO: 654090 - DNA, 20 bp, mouse
gacactgcctgcgaagtgaa

SEQ ID NO: 654091 - DNA, 20 bp, mouse
gagaatcaaaatcacctaca

SEQ ID NO: 654092 - DNA, 20 bp, mouse
gtgcgagatttcactaaaaa

SEQ ID NO: 654093 - DNA, 20 bp, mouse
gtggcagagttgtccctgcg

SEQ ID NO: 654094 - DNA, 20 bp, mouse
gaattgaagtgagtaatctt

SEQ ID NO: 654095 - DNA, 20 bp, mouse
gccgctctgacttgaacagc

SEQ ID NO: 654096 - DNA, 20 bp, mouse
ggtaacaatcagctgatccc

SEQ ID NO: 654097 - DNA, 20 bp, mouse
gagctcaggggccaagagtt

SEQ ID NO: 654098 - DNA, 20 bp, mouse
ggatcagctgattgttactg

SEQ ID NO: 654099 - DNA, 20 bp, mouse
gcatcagaatcccctagctc

SEQ ID NO: 654100 - DNA, 20 bp, mouse
gtagccagatgtatgtggaa

SEQ ID NO: 654101 - DNA, 20 bp, mouse
gagaggattgtggatataag

SEQ ID NO: 654102 - DNA, 20 bp, mouse
gactgctataattagctcag

SEQ ID NO: 654103 - DNA, 20 bp, mouse
gctctgaatgtgtagattag

SEQ ID NO: 654104 - DNA, 20 bp, mouse
gggaggtaggccagagctag

SEQ ID NO: 654105 - DNA, 20 bp, mouse
gaatctcctccactatactt

SEQ ID NO: 654106 - DNA, 20 bp, mouse
gtgtgcgcgcccagagagtg

SEQ ID NO: 654107 - DNA, 20 bp, mouse
gcacgcagagccgcgcacgg

SEQ ID NO: 654108 - DNA, 20 bp, mouse
gagagtgagggctgcgtggc

SEQ ID NO: 654109 - DNA, 20 bp, mouse
gcgctcccgtggaccagccg

SEQ ID NO: 654110 - DNA, 20 bp, mouse
gtgcgcgcgagcctgtcggg

SEQ ID NO: 654111 - DNA, 20 bp, mouse
gcgcgagcctgtcgggaggt

SEQ ID NO: 654112 - DNA, 20 bp, mouse
gagggctgcgtggccggccg

SEQ ID NO: 654113 - DNA, 20 bp, mouse
gcaggccgccgccaggggcg

SEQ ID NO: 654114 - DNA, 20 bp, mouse
ggccggccgcggctggtcca

SEQ ID NO: 654115 - DNA, 20 bp, mouse
gagcgcccaggccgccgcca

SEQ ID NO: 654116 - DNA, 20 bp, mouse
gggcggagccagctcgagga

SEQ ID NO: 654117 - DNA, 20 bp, mouse
gggagccagctcgaggaggg

SEQ ID NO: 654118 - DNA, 20 bp, mouse
gaaacggagggcggaggcgt

SEQ ID NO: 654119 - DNA, 20 bp, mouse
gcgcggggaggcttccccga

SEQ ID NO: 654120 - DNA, 20 bp, mouse
ggacccagaccgcgagggga

SEQ ID NO: 654121 - DNA, 20 bp, mouse
gcagcccgccctcctcgagc

SEQ ID NO: 654122 - DNA, 20 bp, mouse
gcttccccgagggaaacgga

SEQ ID NO: 654123 - DNA, 20 bp, mouse
ggaggcttccccgagggaaa

SEQ ID NO: 654124 - DNA, 20 bp, mouse
gtctgggtctcggggagccg

SEQ ID NO: 654125 - DNA, 20 bp, mouse
gggcggggagatcgggagta

SEQ ID NO: 654126 - DNA, 20 bp, mouse
gccaaggccggccttctcca

SEQ ID NO: 654127 - DNA, 20 bp, mouse
ggaggcgtgtcctcatccgt

SEQ ID NO: 654128 - DNA, 20 bp, mouse
gcgaagaccagccctggaga

SEQ ID NO: 654129 - DNA, 20 bp, mouse
gccggccttggatcagaaag

SEQ ID NO: 654130 - DNA, 20 bp, mouse
ggaggcaaagctagaaaaat

SEQ ID NO: 654131 - DNA, 20 bp, mouse
gcatccgtgggcgtgtcctc

SEQ ID NO: 654132 - DNA, 20 bp, mouse
gcagaaaggggcgggtcttt

SEQ ID NO: 654133 - DNA, 20 bp, mouse
gcgaccagaggacacgccca

SEQ ID NO: 654134 - DNA, 20 bp, mouse
ggggatgaggtgggtcttgg

SEQ ID NO: 654135 - DNA, 20 bp, mouse
gaaaaatgggcgtgtcctcg

SEQ ID NO: 654136 - DNA, 20 bp, mouse
gtaggccaatagcgcggcga

SEQ ID NO: 654137 - DNA, 20 bp, mouse
gaggagaaagccacaccttc

SEQ ID NO: 654138 - DNA, 20 bp, mouse
gcccccccctacaagggacc

SEQ ID NO: 654139 - DNA, 20 bp, mouse
gcaggccaatagcgtgtgaa

SEQ ID NO: 654140 - DNA, 20 bp, mouse
gtggtggagtcttctcctga

SEQ ID NO: 654141 - DNA, 20 bp, mouse
gaggagaagaccgcacctac

SEQ ID NO: 654142 - DNA, 20 bp, mouse
gcaatagcgcggcgaaggaa

SEQ ID NO: 654143 - DNA, 20 bp, mouse
gagaaagtcagtagcatcga

SEQ ID NO: 654144 - DNA, 20 bp, mouse
gggcctggtcccttgtaggg

SEQ ID NO: 654145 - DNA, 20 bp, mouse
ggcaccgagcccgtgttcca

SEQ ID NO: 654146 - DNA, 20 bp, mouse
ggctcccggtacagtaggtg

SEQ ID NO: 654147 - DNA, 20 bp, mouse
gcgcacgctcccggtacagt

SEQ ID NO: 654148 - DNA, 20 bp, mouse
ggcggcccatgcaccgaagt

SEQ ID NO: 654149 - DNA, 20 bp, mouse
ggcccatgcaccgaagtcgg

SEQ ID NO: 654150 - DNA, 20 bp, mouse
gcgggagggagcgcgctgga

SEQ ID NO: 654151 - DNA, 20 bp, mouse
gcgctccacacctactgtac

SEQ ID NO: 654152 - DNA, 20 bp, mouse
gggccgctgcgattggcagg

SEQ ID NO: 654153 - DNA, 20 bp, mouse
ggcccgcctgccaatcgcag

SEQ ID NO: 654154 - DNA, 20 bp, mouse
gcggcccaggcgcacactcc

SEQ ID NO: 654155 - DNA, 20 bp, mouse
gggctcttgccgcacgctcc

SEQ ID NO: 654156 - DNA, 20 bp, mouse
gcggtggtgcgtgatcagga

SEQ ID NO: 654157 - DNA, 20 bp, mouse
ggggagcaaggcacagtcct

SEQ ID NO: 654158 - DNA, 20 bp, mouse
ggtcctgtgcacgtgcacta

SEQ ID NO: 654159 - DNA, 20 bp, mouse
ggggccacagaccaatagtg

SEQ ID NO: 654160 - DNA, 20 bp, mouse
gaaacctgcttctttcccat

SEQ ID NO: 654161 - DNA, 20 bp, mouse
gggccacttagtcatttcat

SEQ ID NO: 654162 - DNA, 20 bp, mouse
gaggacggtggtgcgtgatc

SEQ ID NO: 654163 - DNA, 20 bp, mouse
ggccaatggcagtgctctgt

SEQ ID NO: 654164 - DNA, 20 bp, mouse
gcaggagggcttcaccaatc

SEQ ID NO: 654165 - DNA, 20 bp, mouse
ggccttgctcccaccaataa

SEQ ID NO: 654166 - DNA, 20 bp, mouse
gtatgctagaatcaggactg

SEQ ID NO: 654167 - DNA, 20 bp, mouse
gtactgcaacacagattgga

SEQ ID NO: 654168 - DNA, 20 bp, mouse
gggaatctggatgatactcg

SEQ ID NO: 654169 - DNA, 20 bp, mouse
gccacccaatgttccggaaa

SEQ ID NO: 654170 - DNA, 20 bp, mouse
gactggggtgtgggtggtcc

SEQ ID NO: 654171 - DNA, 20 bp, mouse
gagagcacctgtcccctttc

SEQ ID NO: 654172 - DNA, 20 bp, mouse
gtgcagaacccaggggaatc

SEQ ID NO: 654173 - DNA, 20 bp, mouse
gtggatgatactcgggggat

SEQ ID NO: 654174 - DNA, 20 bp, mouse
gaacacagattggagggttc

SEQ ID NO: 654175 - DNA, 20 bp, mouse
ggtcctagtatgctagaatc

SEQ ID NO: 654176 - DNA, 20 bp, mouse
gccacccggaaggttcccat

SEQ ID NO: 654177 - DNA, 20 bp, mouse
gctggggagccgagccaagc

SEQ ID NO: 654178 - DNA, 20 bp, mouse
gaccggggcgggatagggtg

SEQ ID NO: 654179 - DNA, 20 bp, mouse
gactgggcggtacagagtcg

SEQ ID NO: 654180 - DNA, 20 bp, mouse
gctgctgcggacctgggacc

SEQ ID NO: 654181 - DNA, 20 bp, mouse
gcccgcggtcacgtgacaat

SEQ ID NO: 654182 - DNA, 20 bp, mouse
gcagcacgggacaccccaac

SEQ ID NO: 654183 - DNA, 20 bp, mouse
gtgtgcctatgggaaccttc

SEQ ID NO: 654184 - DNA, 20 bp, mouse
gcgcaggagcaaagaacgta

SEQ ID NO: 654185 - DNA, 20 bp, mouse
ggtacagagtcggggctagg

SEQ ID NO: 654186 - DNA, 20 bp, mouse
gaactcagccggtccttcca

SEQ ID NO: 654187 - DNA, 20 bp, mouse
ggggaaggaagtggcttcat

SEQ ID NO: 654188 - DNA, 20 bp, mouse
gttcgcccgcgcgctctgtg

SEQ ID NO: 654189 - DNA, 20 bp, mouse
gcccagaagaaaccctgtaa

SEQ ID NO: 654190 - DNA, 20 bp, mouse
gtaagcaagtagacagtctt

SEQ ID NO: 654191 - DNA, 20 bp, mouse
ggctagatttaatcagataa

SEQ ID NO: 654192 - DNA, 20 bp, mouse
gtggggagggccggcgtcca

SEQ ID NO: 654193 - DNA, 20 bp, mouse
ggcgcgcgggcgaactcagc

SEQ ID NO: 654194 - DNA, 20 bp, mouse
gaggagccgcacagagcgcg

SEQ ID NO: 654195 - DNA, 20 bp, mouse
gcggtccttccaaggcccag

SEQ ID NO: 654196 - DNA, 20 bp, mouse
gaaggggccaggagtcacat

SEQ ID NO: 654197 - DNA, 20 bp, mouse
gggcaccagctgtccacatg

SEQ ID NO: 654198 - DNA, 20 bp, mouse
gctcccaggcactggatcgt

SEQ ID NO: 654199 - DNA, 20 bp, mouse
gtgtgctagcgctttaacct

SEQ ID NO: 654200 - DNA, 20 bp, mouse
gtaaagcgctagcacacatg

SEQ ID NO: 654201 - DNA, 20 bp, mouse
gcaccactttggtttgttct

SEQ ID NO: 654202 - DNA, 20 bp, mouse
ggtccacatgaggtcaaagg

SEQ ID NO: 654203 - DNA, 20 bp, mouse
gtaagtccccatgtgactcc

SEQ ID NO: 654204 - DNA, 20 bp, mouse
gacaaaccaaagtggtgcat

SEQ ID NO: 654205 - DNA, 20 bp, mouse
gcacatggggacttaccagg

SEQ ID NO: 654206 - DNA, 20 bp, mouse
ggctcccagcacatggtcgg

SEQ ID NO: 654207 - DNA, 20 bp, mouse
ggcggcacgcacggcccggg

SEQ ID NO: 654208 - DNA, 20 bp, mouse
gggcccgggaggaggcgaca

SEQ ID NO: 654209 - DNA, 20 bp, mouse
gccccgaggccggcggagac

SEQ ID NO: 654210 - DNA, 20 bp, mouse
ggggtggccgaggctggcgt

SEQ ID NO: 654211 - DNA, 20 bp, mouse
ggaggaggcgacagggttgg

SEQ ID NO: 654212 - DNA, 20 bp, mouse
gcgggaggaggcgacagggt

SEQ ID NO: 654213 - DNA, 20 bp, mouse
gcggggagcctggagtaccc

SEQ ID NO: 654214 - DNA, 20 bp, mouse
gcgcgcgggcccacgtggat

SEQ ID NO: 654215 - DNA, 20 bp, mouse
ggcagagagaagcggggccg

SEQ ID NO: 654216 - DNA, 20 bp, mouse
gaggcagcccagacccgctg

SEQ ID NO: 654217 - DNA, 20 bp, mouse
gggctgagaacccaggtgga

SEQ ID NO: 654218 - DNA, 20 bp, mouse
gggtctgggctgcctgcccg

SEQ ID NO: 654219 - DNA, 20 bp, mouse
ggggctgggcgggtctggga

SEQ ID NO: 654220 - DNA, 20 bp, mouse
gtagcggccacagcgggtct

SEQ ID NO: 654221 - DNA, 20 bp, mouse
gcgaaaaaggtcccgccccc

SEQ ID NO: 654222 - DNA, 20 bp, mouse
ggctgtggccgctagttcta

SEQ ID NO: 654223 - DNA, 20 bp, mouse
gggggtgggacgcccgaaaa

SEQ ID NO: 654224 - DNA, 20 bp, mouse
gtctgccgggctgagaaccc

SEQ ID NO: 654225 - DNA, 20 bp, mouse
ggcgtcccacccctccacct

SEQ ID NO: 654226 - DNA, 20 bp, mouse
ggacaaggggcatcgtctat

SEQ ID NO: 654227 - DNA, 20 bp, mouse
ggaaaaggatggacccgaga

SEQ ID NO: 654228 - DNA, 20 bp, mouse
gtgaaagaccatctttctgt

SEQ ID NO: 654229 - DNA, 20 bp, mouse
gcagcaaagccgcccttctc

SEQ ID NO: 654230 - DNA, 20 bp, mouse
gccgaaacgttggaagctac

SEQ ID NO: 654231 - DNA, 20 bp, mouse
ggagcgagtgagaagagagc

SEQ ID NO: 654232 - DNA, 20 bp, mouse
ggggcagacccacagaaaga

SEQ ID NO: 654233 - DNA, 20 bp, mouse
ggatggcacagaacactctg

SEQ ID NO: 654234 - DNA, 20 bp, mouse
gagcttccaacgtttcggga

SEQ ID NO: 654235 - DNA, 20 bp, mouse
gcttttcctcgcagaaagga

SEQ ID NO: 654236 - DNA, 20 bp, mouse
gctcactcaagcgatgtctg

SEQ ID NO: 654237 - DNA, 20 bp, mouse
gagcatgagcgtgatgttac

SEQ ID NO: 654238 - DNA, 20 bp, mouse
ggtggcagtcccacatgccc

SEQ ID NO: 654239 - DNA, 20 bp, mouse
gcagtcccacatgcccaggt

SEQ ID NO: 654240 - DNA, 20 bp, mouse
gaagcgatcagaacccacct

SEQ ID NO: 654241 - DNA, 20 bp, mouse
gctgcccttggcctgatggg

SEQ ID NO: 654242 - DNA, 20 bp, mouse
gacacctcccatcaggccaa

SEQ ID NO: 654243 - DNA, 20 bp, mouse
gggaggaaatacgatgaggg

SEQ ID NO: 654244 - DNA, 20 bp, mouse
gaacggaggaaatacgatga

SEQ ID NO: 654245 - DNA, 20 bp, mouse
gagaaactacacctcccatc

SEQ ID NO: 654246 - DNA, 20 bp, mouse
ggggctgcagccctctcacc

SEQ ID NO: 654247 - DNA, 20 bp, mouse
gcggcagctcttattgtttt

SEQ ID NO: 654248 - DNA, 20 bp, mouse
gtcaagctgtctccttgtca

SEQ ID NO: 654249 - DNA, 20 bp, mouse
ggtgtggagggcagtgttgg

SEQ ID NO: 654250 - DNA, 20 bp, mouse
ggctgccgaatacagaggtg

SEQ ID NO: 654251 - DNA, 20 bp, mouse
gccctccacacctctgtatt

SEQ ID NO: 654252 - DNA, 20 bp, mouse
gtgtgtggcgacagcaggag

SEQ ID NO: 654253 - DNA, 20 bp, mouse
gaggagagatgtgtggagtt

SEQ ID NO: 654254 - DNA, 20 bp, mouse
ggccgaatacagaggtgtgg

SEQ ID NO: 654255 - DNA, 20 bp, mouse
gcctcaccccagtgtgacct

SEQ ID NO: 654256 - DNA, 20 bp, mouse
gagccagtgtgcccatatga

SEQ ID NO: 654257 - DNA, 20 bp, mouse
gcagtgtctatgtcgcatcc

SEQ ID NO: 654258 - DNA, 20 bp, mouse
gtactcactatgttctatat

SEQ ID NO: 654259 - DNA, 20 bp, mouse
gttgggaagggaccaggtcc

SEQ ID NO: 654260 - DNA, 20 bp, mouse
gctatgttctatattggcta

SEQ ID NO: 654261 - DNA, 20 bp, mouse
gggtttcattaccttcatat

SEQ ID NO: 654262 - DNA, 20 bp, mouse
ggtaagggacccaagcagat

SEQ ID NO: 654263 - DNA, 20 bp, mouse
gagtcctgatatgccattct

SEQ ID NO: 654264 - DNA, 20 bp, mouse
gactcccagaatggcatatc

SEQ ID NO: 654265 - DNA, 20 bp, mouse
ggggtcccttaccagtgatg

SEQ ID NO: 654266 - DNA, 20 bp, mouse
gcggtcgccacactctgccc

SEQ ID NO: 654267 - DNA, 20 bp, mouse
gctccaaaggagtccagggc

SEQ ID NO: 654268 - DNA, 20 bp, mouse
gttaacactaagtctccaag

SEQ ID NO: 654269 - DNA, 20 bp, mouse
gtgagcatgctctgtggcgg

SEQ ID NO: 654270 - DNA, 20 bp, mouse
ggcagagtgtggcgaccgac

SEQ ID NO: 654271 - DNA, 20 bp, mouse
gtgtcaaaggctcagttgtt

SEQ ID NO: 654272 - DNA, 20 bp, mouse
gcactgccaagctaccacta

SEQ ID NO: 654273 - DNA, 20 bp, mouse
gcgaccggatataaatagca

SEQ ID NO: 654274 - DNA, 20 bp, mouse
gcactgctccaaaggagtcc

SEQ ID NO: 654275 - DNA, 20 bp, mouse
gctgccctgctatttatatc

SEQ ID NO: 654276 - DNA, 20 bp, mouse
ggagcccagatgggcagatt

SEQ ID NO: 654277 - DNA, 20 bp, mouse
gaagccaaatctgcccatct

SEQ ID NO: 654278 - DNA, 20 bp, mouse
gcagggactagagcccagat

SEQ ID NO: 654279 - DNA, 20 bp, mouse
ggaagaggtcatagaatcta

SEQ ID NO: 654280 - DNA, 20 bp, mouse
ggaagaatgttcttgaagcc

SEQ ID NO: 654281 - DNA, 20 bp, mouse
gtctccttctatttagagga

SEQ ID NO: 654282 - DNA, 20 bp, mouse
gcggtgctcacgacacctca

SEQ ID NO: 654283 - DNA, 20 bp, mouse
gacagcgtaagcatgcaggg

SEQ ID NO: 654284 - DNA, 20 bp, mouse
gttcttccaggataggtctt

SEQ ID NO: 654285 - DNA, 20 bp, mouse
ggcagatttggcttaagcca

SEQ ID NO: 654286 - DNA, 20 bp, mouse
ggggagatgcgatcttaagg

SEQ ID NO: 654287 - DNA, 20 bp, mouse
gggcacatgaagcgcagctg

SEQ ID NO: 654288 - DNA, 20 bp, mouse
gagtgctgatagccctgccc

SEQ ID NO: 654289 - DNA, 20 bp, mouse
gaaaagcctgtgctgctgga

SEQ ID NO: 654290 - DNA, 20 bp, mouse
gacagcccccgtctctgaac

SEQ ID NO: 654291 - DNA, 20 bp, mouse
ggcctggggctgcagataat

SEQ ID NO: 654292 - DNA, 20 bp, mouse
ggggcaatcattccagggca

SEQ ID NO: 654293 - DNA, 20 bp, mouse
gcttaaggtggacctgtgtc

SEQ ID NO: 654294 - DNA, 20 bp, mouse
gcatccccgttcagagacgg

SEQ ID NO: 654295 - DNA, 20 bp, mouse
gaaacatccccgttcagaga

SEQ ID NO: 654296 - DNA, 20 bp, mouse
gctggaaagggaatgtctga

SEQ ID NO: 654297 - DNA, 20 bp, mouse
gtaccccggcccttcggacc

SEQ ID NO: 654298 - DNA, 20 bp, mouse
gccgaagggccggggtagaa

SEQ ID NO: 654299 - DNA, 20 bp, mouse
ggggtgtggctgttcctgga

SEQ ID NO: 654300 - DNA, 20 bp, mouse
gaccctggtccgaagggccg

SEQ ID NO: 654301 - DNA, 20 bp, mouse
gccagggtaggagacaaaga

SEQ ID NO: 654302 - DNA, 20 bp, mouse
gtctcctaccctggtccgaa

SEQ ID NO: 654303 - DNA, 20 bp, mouse
ggggagaaggacccagcttg

SEQ ID NO: 654304 - DNA, 20 bp, mouse
gcttgcgggaaggtgaagga

SEQ ID NO: 654305 - DNA, 20 bp, mouse
gccagcttgcgggaaggtga

SEQ ID NO: 654306 - DNA, 20 bp, mouse
gagggagggcggcgaaggag

SEQ ID NO: 654307 - DNA, 20 bp, mouse
gtgaaggagagttccaactt

SEQ ID NO: 654308 - DNA, 20 bp, mouse
gagcggggaccggatccgga

SEQ ID NO: 654309 - DNA, 20 bp, mouse
gagcgacagggctctgcgtt

SEQ ID NO: 654310 - DNA, 20 bp, mouse
gtatcctcaagtggtgactc

SEQ ID NO: 654311 - DNA, 20 bp, mouse
ggaggcagagtagagatcgc

SEQ ID NO: 654312 - DNA, 20 bp, mouse
gagccagcggggaccggatc

SEQ ID NO: 654313 - DNA, 20 bp, mouse
gcggccaggtgagccctgaa

SEQ ID NO: 654314 - DNA, 20 bp, mouse
gaggcagctgaaccttctga

SEQ ID NO: 654315 - DNA, 20 bp, mouse
ggcagcgagacgctgaaact

SEQ ID NO: 654316 - DNA, 20 bp, mouse
gcctgcgccgtgcgggaaga

SEQ ID NO: 654317 - DNA, 20 bp, mouse
gcgcagccgcagtacccgct

SEQ ID NO: 654318 - DNA, 20 bp, mouse
gcaactcccagcgggtactg

SEQ ID NO: 654319 - DNA, 20 bp, mouse
gttcccgcacggcgcaggcg

SEQ ID NO: 654320 - DNA, 20 bp, mouse
gctgcccgccgcgggcaggt

SEQ ID NO: 654321 - DNA, 20 bp, mouse
ggcgcccacctgcccgcggc

SEQ ID NO: 654322 - DNA, 20 bp, mouse
gggccgcgcctgcgccgtgc

SEQ ID NO: 654323 - DNA, 20 bp, mouse
gtacccggagtgcggtgagt

SEQ ID NO: 654324 - DNA, 20 bp, mouse
gcggaccagtacccggagtg

SEQ ID NO: 654325 - DNA, 20 bp, mouse
ggcccgcggcgggcagagca

SEQ ID NO: 654326 - DNA, 20 bp, mouse
gtgggcgcgcccctcccgat

SEQ ID NO: 654327 - DNA, 20 bp, mouse
gctcctagcatcacacccta

SEQ ID NO: 654328 - DNA, 20 bp, mouse
gagtcccgccccagcctgtg

SEQ ID NO: 654329 - DNA, 20 bp, mouse
gaaccctagggtgtgatgct

SEQ ID NO: 654330 - DNA, 20 bp, mouse
gcaagtctcttggtgtgtgt

SEQ ID NO: 654331 - DNA, 20 bp, mouse
gaacgattgcccaagtctct

SEQ ID NO: 654332 - DNA, 20 bp, mouse
ggctccgccccccacaggct

SEQ ID NO: 654333 - DNA, 20 bp, mouse
gtgctaggagacaagacctg

SEQ ID NO: 654334 - DNA, 20 bp, mouse
gtgggtcaggtctactttgt

SEQ ID NO: 654335 - DNA, 20 bp, mouse
gaccagcagccaatcgggag

SEQ ID NO: 654336 - DNA, 20 bp, mouse
gacacctgcccggaatgctg

SEQ ID NO: 654337 - DNA, 20 bp, mouse
ggatggatgtgcagagattg

SEQ ID NO: 654338 - DNA, 20 bp, mouse
gcaactgcgaattttcccat

SEQ ID NO: 654339 - DNA, 20 bp, mouse
ggtcagggcctgctctgcta

SEQ ID NO: 654340 - DNA, 20 bp, mouse
gtctgctagggggccgacct

SEQ ID NO: 654341 - DNA, 20 bp, mouse
gccctcccggccatcttcag

SEQ ID NO: 654342 - DNA, 20 bp, mouse
ggcaacccgcaccgattgga

SEQ ID NO: 654343 - DNA, 20 bp, mouse
gccccgcaacccgcaccgat

SEQ ID NO: 654344 - DNA, 20 bp, mouse
gcacatccatccaatcggtg

SEQ ID NO: 654345 - DNA, 20 bp, mouse
gggcgcgtctctctaccaat

SEQ ID NO: 654346 - DNA, 20 bp, mouse
gtgggagcccgcaaccgagg

SEQ ID NO: 654347 - DNA, 20 bp, mouse
ggcgaactggatttcggaga

SEQ ID NO: 654348 - DNA, 20 bp, mouse
ggagaggggcctatgagtgt

SEQ ID NO: 654349 - DNA, 20 bp, mouse
ggacagaggccgggctgcgt

SEQ ID NO: 654350 - DNA, 20 bp, mouse
gaggtcctctggatagtgga

SEQ ID NO: 654351 - DNA, 20 bp, mouse
gagcccgcaaccgaggggga

SEQ ID NO: 654352 - DNA, 20 bp, mouse
gcaaagcgcgaactggattt

SEQ ID NO: 654353 - DNA, 20 bp, mouse
gacgagctccggctgaggtc

SEQ ID NO: 654354 - DNA, 20 bp, mouse
gggggcaggggattagcagc

SEQ ID NO: 654355 - DNA, 20 bp, mouse
ggaggtcaagacactgtcct

SEQ ID NO: 654356 - DNA, 20 bp, mouse
ggcggaggatcccagcaagg

SEQ ID NO: 654357 - DNA, 20 bp, mouse
gagggcggaggatcccagca

SEQ ID NO: 654358 - DNA, 20 bp, mouse
ggtcatgtcaccccccttgc

SEQ ID NO: 654359 - DNA, 20 bp, mouse
gggcagatgcagcagagtct

SEQ ID NO: 654360 - DNA, 20 bp, mouse
ggggggtgacatgacctgta

SEQ ID NO: 654361 - DNA, 20 bp, mouse
gttagcctagtgtgggggaa

SEQ ID NO: 654362 - DNA, 20 bp, mouse
gtcagcagacagtggttgta

SEQ ID NO: 654363 - DNA, 20 bp, mouse
gtggttgtagggttaactag

SEQ ID NO: 654364 - DNA, 20 bp, mouse
gagggggcaggcatcgtggg

SEQ ID NO: 654365 - DNA, 20 bp, mouse
gcctggctgaatgagcccag

SEQ ID NO: 654366 - DNA, 20 bp, mouse
gaggaccccagcaagtgggg

SEQ ID NO: 654367 - DNA, 20 bp, mouse
ggcggaggaccccagcaagt

SEQ ID NO: 654368 - DNA, 20 bp, mouse
gggcagatgcagcagagtct

SEQ ID NO: 654369 - DNA, 20 bp, mouse
ggccccccccccacttgctg

SEQ ID NO: 654370 - DNA, 20 bp, mouse
gaggattagcctagtgtggg

SEQ ID NO: 654371 - DNA, 20 bp, mouse
gggggggggcatgacctgta

SEQ ID NO: 654372 - DNA, 20 bp, mouse
gtcagcagacagtggttgta

SEQ ID NO: 654373 - DNA, 20 bp, mouse
gtggttgtagggttaactag

SEQ ID NO: 654374 - DNA, 20 bp, mouse
gagggggcaggcatcgtggg

SEQ ID NO: 654375 - DNA, 20 bp, mouse
ggggagggggcaggcatcgt

SEQ ID NO: 654376 - DNA, 20 bp, mouse
gaccaaggtgacagactcca

SEQ ID NO: 654377 - DNA, 20 bp, mouse
gtgagcccgtgggaaggcag

SEQ ID NO: 654378 - DNA, 20 bp, mouse
gtggggttgaaggtcggcca

SEQ ID NO: 654379 - DNA, 20 bp, mouse
gggaagcgctgtgagcccgt

SEQ ID NO: 654380 - DNA, 20 bp, mouse
ggctgaggggaatcctggac

SEQ ID NO: 654381 - DNA, 20 bp, mouse
gtggcagaacatccagttcg

SEQ ID NO: 654382 - DNA, 20 bp, mouse
gcccctggagtctgtcacct

SEQ ID NO: 654383 - DNA, 20 bp, mouse
gtagctaagaggcttccgta

SEQ ID NO: 654384 - DNA, 20 bp, mouse
gaatcctggacagggaatcc

SEQ ID NO: 654385 - DNA, 20 bp, mouse
gactcacgatctccacgtcc

SEQ ID NO: 654386 - DNA, 20 bp, mouse
gccgccccggggtgcggcta

SEQ ID NO: 654387 - DNA, 20 bp, mouse
gtccgcgcacagggccgaga

SEQ ID NO: 654388 - DNA, 20 bp, mouse
gggcccggcgcctctatctc

SEQ ID NO: 654389 - DNA, 20 bp, mouse
gccgggccgagtccctagag

SEQ ID NO: 654390 - DNA, 20 bp, mouse
ggctggacgaaaccactgcg

SEQ ID NO: 654391 - DNA, 20 bp, mouse
ggaagtcccgccccggggtg

SEQ ID NO: 654392 - DNA, 20 bp, mouse
gcccggggtgcggctaaggc

SEQ ID NO: 654393 - DNA, 20 bp, mouse
gggcggacgccgactgactc

SEQ ID NO: 654394 - DNA, 20 bp, mouse
gagagcggagtccgcgcaca

SEQ ID NO: 654395 - DNA, 20 bp, mouse
gcccctctcggccctgtgcg

SEQ ID NO: 654396 - DNA, 20 bp, mouse
gagtctaacaggccttctgc

SEQ ID NO: 654397 - DNA, 20 bp, mouse
gaatgaatgctgttggacat

SEQ ID NO: 654398 - DNA, 20 bp, mouse
gaggaatatgtcttactcgg

SEQ ID NO: 654399 - DNA, 20 bp, mouse
gggacatgggtgtgagttat

SEQ ID NO: 654400 - DNA, 20 bp, mouse
ggccacagaacttgtcatac

SEQ ID NO: 654401 - DNA, 20 bp, mouse
gagaaggcctgttagactaa

SEQ ID NO: 654402 - DNA, 20 bp, mouse
gcactgctctactctgaaat

SEQ ID NO: 654403 - DNA, 20 bp, mouse
gagattccatagtcaagtcc

SEQ ID NO: 654404 - DNA, 20 bp, mouse
gtcattatattccagatcac

SEQ ID NO: 654405 - DNA, 20 bp, mouse
gaataggaatatgtcttact

SEQ ID NO: 654406 - DNA, 20 bp, mouse
gaaggtgtcagccccactgt

SEQ ID NO: 654407 - DNA, 20 bp, mouse
gcacgtgtcactccccacag

SEQ ID NO: 654408 - DNA, 20 bp, mouse
ggctctgtgcaagactgttc

SEQ ID NO: 654409 - DNA, 20 bp, mouse
gagtgaccagtcagcatgtg

SEQ ID NO: 654410 - DNA, 20 bp, mouse
gtaggggagaagaagtgaca

SEQ ID NO: 654411 - DNA, 20 bp, mouse
gtgaactaacagtgtgtggc

SEQ ID NO: 654412 - DNA, 20 bp, mouse
gtggaggccaagccctcatt

SEQ ID NO: 654413 - DNA, 20 bp, mouse
gcacagagctgctctgatga

SEQ ID NO: 654414 - DNA, 20 bp, mouse
ggccagagcactcctaatga

SEQ ID NO: 654415 - DNA, 20 bp, mouse
ggcctccattggttggatat

SEQ ID NO: 654416 - DNA, 20 bp, mouse
ggaaccttggccttgaagtg

SEQ ID NO: 654417 - DNA, 20 bp, mouse
gggcccgccgggcacacttc

SEQ ID NO: 654418 - DNA, 20 bp, mouse
ggcagtgtaggagattcatg

SEQ ID NO: 654419 - DNA, 20 bp, mouse
gggcgaccatgtgccgagga

SEQ ID NO: 654420 - DNA, 20 bp, mouse
gtaaacgcggcgggagcccc

SEQ ID NO: 654421 - DNA, 20 bp, mouse
gcgggcacacttcagggcac

SEQ ID NO: 654422 - DNA, 20 bp, mouse
ggggccgggagtgcttagtc

SEQ ID NO: 654423 - DNA, 20 bp, mouse
gtgtaggagattcatggggt

SEQ ID NO: 654424 - DNA, 20 bp, mouse
gccgagcgggctcgagagag

SEQ ID NO: 654425 - DNA, 20 bp, mouse
gaagccccacttcaaggcca

SEQ ID NO: 654426 - DNA, 20 bp, mouse
ggaaccttggccttgaagtg

SEQ ID NO: 654427 - DNA, 20 bp, mouse
gggcccgccgggcacacttc

SEQ ID NO: 654428 - DNA, 20 bp, mouse
gtaaacgcggcgggagcccc

SEQ ID NO: 654429 - DNA, 20 bp, mouse
ggcctaggagaagacagtgc

SEQ ID NO: 654430 - DNA, 20 bp, mouse
ggcagtgtaggagattcatg

SEQ ID NO: 654431 - DNA, 20 bp, mouse
ggaaatccacggaaaggaac

SEQ ID NO: 654432 - DNA, 20 bp, mouse
gcgggcacacttcagggcac

SEQ ID NO: 654433 - DNA, 20 bp, mouse
gaagatagaaatccacggaa

SEQ ID NO: 654434 - DNA, 20 bp, mouse
ggggccgggagtgcttagtc

SEQ ID NO: 654435 - DNA, 20 bp, mouse
ggcgggccaagggttaaacg

SEQ ID NO: 654436 - DNA, 20 bp, mouse
gtgcgctcgggactggtcag

SEQ ID NO: 654437 - DNA, 20 bp, mouse
gagaggggcgggcccgacta

SEQ ID NO: 654438 - DNA, 20 bp, mouse
ggggcgggcccgactaggga

SEQ ID NO: 654439 - DNA, 20 bp, mouse
gtgcggcctcagcttctcgg

SEQ ID NO: 654440 - DNA, 20 bp, mouse
gcgagggcgcgccctttccc

SEQ ID NO: 654441 - DNA, 20 bp, mouse
gcttctcggcggcgcagtgg

SEQ ID NO: 654442 - DNA, 20 bp, mouse
gctgcgccgccgagaagctg

SEQ ID NO: 654443 - DNA, 20 bp, mouse
gaaggagggcgatgtgcgct

SEQ ID NO: 654444 - DNA, 20 bp, mouse
gccaccgccccctccctagt

SEQ ID NO: 654445 - DNA, 20 bp, mouse
gccgaggccaagggtggaat

SEQ ID NO: 654446 - DNA, 20 bp, mouse
ggaggtagacaagtggtctg

SEQ ID NO: 654447 - DNA, 20 bp, mouse
gggcgtggccggagagagaa

SEQ ID NO: 654448 - DNA, 20 bp, mouse
gtggccacgccccgactcgc

SEQ ID NO: 654449 - DNA, 20 bp, mouse
ggatgtggccggagagtgag

SEQ ID NO: 654450 - DNA, 20 bp, mouse
ggggagttaccagcgagtcg

SEQ ID NO: 654451 - DNA, 20 bp, mouse
gggaagaggatcggggacgg

SEQ ID NO: 654452 - DNA, 20 bp, mouse
ggcgtggcggagttagttag

SEQ ID NO: 654453 - DNA, 20 bp, mouse
gtaggggcgcggcttggatg

SEQ ID NO: 654454 - DNA, 20 bp, mouse
gtggggccaacgcgaggttg

SEQ ID NO: 654455 - DNA, 20 bp, mouse
gttaccagcgagtcggggcg

SEQ ID NO: 654456 - DNA, 20 bp, mouse
ggaccaaccaggagttcctg

SEQ ID NO: 654457 - DNA, 20 bp, mouse
ggtgctggggtctccacttc

SEQ ID NO: 654458 - DNA, 20 bp, mouse
ggacgtgggcgggaccgtta

SEQ ID NO: 654459 - DNA, 20 bp, mouse
gaagggtgttgagtgacgtg

SEQ ID NO: 654460 - DNA, 20 bp, mouse
gcccacgtcccgccctccag

SEQ ID NO: 654461 - DNA, 20 bp, mouse
gatagcggaccacagtccac

SEQ ID NO: 654462 - DNA, 20 bp, mouse
ggaccccagcaccctccgtc

SEQ ID NO: 654463 - DNA, 20 bp, mouse
gggaacagaatcgaccaacc

SEQ ID NO: 654464 - DNA, 20 bp, mouse
gggggtctccacttccggcc

SEQ ID NO: 654465 - DNA, 20 bp, mouse
gcggcaggtgggcgtgtcca

SEQ ID NO: 654466 - DNA, 20 bp, mouse
ggcagccaccagaggggtga

SEQ ID NO: 654467 - DNA, 20 bp, mouse
gaggggccaaacagtggggt

SEQ ID NO: 654468 - DNA, 20 bp, mouse
gcagcagcggtggtgaccca

SEQ ID NO: 654469 - DNA, 20 bp, mouse
gagggaggggccaaacagtg

SEQ ID NO: 654470 - DNA, 20 bp, mouse
gctgtccctcacccctctgg

SEQ ID NO: 654471 - DNA, 20 bp, mouse
gcgctggagcagccaccaga

SEQ ID NO: 654472 - DNA, 20 bp, mouse
gacagaggtcccaaggactc

SEQ ID NO: 654473 - DNA, 20 bp, mouse
ggaccaagatagaagtcatg

SEQ ID NO: 654474 - DNA, 20 bp, mouse
gcggctgaaaatctccacct

SEQ ID NO: 654475 - DNA, 20 bp, mouse
gctaggttgttgggaaagtt

SEQ ID NO: 654476 - DNA, 20 bp, mouse
gctaactctgacgtggtgac

SEQ ID NO: 654477 - DNA, 20 bp, mouse
gttagattagacagagttcg

SEQ ID NO: 654478 - DNA, 20 bp, mouse
ggtgccggtctggagagaag

SEQ ID NO: 654479 - DNA, 20 bp, mouse
gagacagagttcgtggtaac

SEQ ID NO: 654480 - DNA, 20 bp, mouse
gggacgtgacttcaagtaca

SEQ ID NO: 654481 - DNA, 20 bp, mouse
gcgtccacttctctccagac

SEQ ID NO: 654482 - DNA, 20 bp, mouse
ggaaacactcggtgccggtc

SEQ ID NO: 654483 - DNA, 20 bp, mouse
gacagggttgggaaagtaaa

SEQ ID NO: 654484 - DNA, 20 bp, mouse
gccgagtgtttcttagtaga

SEQ ID NO: 654485 - DNA, 20 bp, mouse
ggtctaatctaactctgacg

SEQ ID NO: 654486 - DNA, 20 bp, mouse
ggaagcagacagcattgagg

SEQ ID NO: 654487 - DNA, 20 bp, mouse
gaagtcccatactttgtaga

SEQ ID NO: 654488 - DNA, 20 bp, mouse
gaggggcaattctagcataa

SEQ ID NO: 654489 - DNA, 20 bp, mouse
gctgtctgcttcctccatga

SEQ ID NO: 654490 - DNA, 20 bp, mouse
gtagaattgccccttcatgg

SEQ ID NO: 654491 - DNA, 20 bp, mouse
gtgctagaattgccccttca

SEQ ID NO: 654492 - DNA, 20 bp, mouse
gactgccctctacaaagtat

SEQ ID NO: 654493 - DNA, 20 bp, mouse
gtagtgttcacaggggttcc

SEQ ID NO: 654494 - DNA, 20 bp, mouse
gagacagcagtaaaaaatga

SEQ ID NO: 654495 - DNA, 20 bp, mouse
gggtgccactgatgtataaa

SEQ ID NO: 654496 - DNA, 20 bp, mouse
ggccacagggtagtcccaga

SEQ ID NO: 654497 - DNA, 20 bp, mouse
gcccttctgggactaccctg

SEQ ID NO: 654498 - DNA, 20 bp, mouse
ggacagataggcatctggta

SEQ ID NO: 654499 - DNA, 20 bp, mouse
gggcaagataacacagtcaa

SEQ ID NO: 654500 - DNA, 20 bp, mouse
gaggaagtgagttaaagctg

SEQ ID NO: 654501 - DNA, 20 bp, mouse
gatcactcccagaatgtcac

SEQ ID NO: 654502 - DNA, 20 bp, mouse
ggaagggctgattgacagat

SEQ ID NO: 654503 - DNA, 20 bp, mouse
gtaaatgggttgcagcacgg

SEQ ID NO: 654504 - DNA, 20 bp, mouse
gagtgtcctagtgagcactg

SEQ ID NO: 654505 - DNA, 20 bp, mouse
gtgcagcacggaggaaggtg

SEQ ID NO: 654506 - DNA, 20 bp, mouse
gcacccttcagcagtgacag

SEQ ID NO: 654507 - DNA, 20 bp, mouse
gctccgctgtcactgctgaa

SEQ ID NO: 654508 - DNA, 20 bp, mouse
gcggagtggggacgctcagg

SEQ ID NO: 654509 - DNA, 20 bp, mouse
gcagcagtgacagcggagtg

SEQ ID NO: 654510 - DNA, 20 bp, mouse
gacgctcaggtggcacgcgg

SEQ ID NO: 654511 - DNA, 20 bp, mouse
gcagcggagtggggacgctc

SEQ ID NO: 654512 - DNA, 20 bp, mouse
gttaatggacgtatattcac

SEQ ID NO: 654513 - DNA, 20 bp, mouse
gcccagcggcctgcgctccg

SEQ ID NO: 654514 - DNA, 20 bp, mouse
gtgcgctccggggtaggtct

SEQ ID NO: 654515 - DNA, 20 bp, mouse
gcggggcctgattgctacca

SEQ ID NO: 654516 - DNA, 20 bp, mouse
gtcagccttcccagtagatg

SEQ ID NO: 654517 - DNA, 20 bp, mouse
ggctatgtccctaagtctaa

SEQ ID NO: 654518 - DNA, 20 bp, mouse
gcctagtagccccatctact

SEQ ID NO: 654519 - DNA, 20 bp, mouse
ggtagccccatctactggga

SEQ ID NO: 654520 - DNA, 20 bp, mouse
gtaaaagatttcgtcttcgt

SEQ ID NO: 654521 - DNA, 20 bp, mouse
gcggctacactgtgaatctg

SEQ ID NO: 654522 - DNA, 20 bp, mouse
ggtactggggatttaacctt

SEQ ID NO: 654523 - DNA, 20 bp, mouse
ggacttagggacatagccat

SEQ ID NO: 654524 - DNA, 20 bp, mouse
gcaggagctatattgctcag

SEQ ID NO: 654525 - DNA, 20 bp, mouse
gacctcttttcttcatggct

SEQ ID NO: 654526 - DNA, 20 bp, mouse
gcccaccgatgagggagacg

SEQ ID NO: 654527 - DNA, 20 bp, mouse
gcgtctctgcccaccgatga

SEQ ID NO: 654528 - DNA, 20 bp, mouse
gcgctggacgctgtcatggc

SEQ ID NO: 654529 - DNA, 20 bp, mouse
gctccagcgcacagccctct

SEQ ID NO: 654530 - DNA, 20 bp, mouse
ggattgagcgggcttgggaa

SEQ ID NO: 654531 - DNA, 20 bp, mouse
gacagggtgcgtagttgtgt

SEQ ID NO: 654532 - DNA, 20 bp, mouse
ggcagccgcgtctccctcat

SEQ ID NO: 654533 - DNA, 20 bp, mouse
gagggagacgcggctgccta

SEQ ID NO: 654534 - DNA, 20 bp, mouse
gggcagagacgctaagagga

SEQ ID NO: 654535 - DNA, 20 bp, mouse
gtcaccgtgatgctgcgaat

SEQ ID NO: 654536 - DNA, 20 bp, mouse
gagggtaccagcagggtcag

SEQ ID NO: 654537 - DNA, 20 bp, mouse
gggggtccaggagtgacctt

SEQ ID NO: 654538 - DNA, 20 bp, mouse
gggccagcctctgaccctgc

SEQ ID NO: 654539 - DNA, 20 bp, mouse
gaataggcccctcactgcat

SEQ ID NO: 654540 - DNA, 20 bp, mouse
ggccctgttgaccaacaaaa

SEQ ID NO: 654541 - DNA, 20 bp, mouse
gcctgctggtacccttttgt

SEQ ID NO: 654542 - DNA, 20 bp, mouse
gaggctcactccagagaagt

SEQ ID NO: 654543 - DNA, 20 bp, mouse
ggtcctgcccacccatctca

SEQ ID NO: 654544 - DNA, 20 bp, mouse
gttaccagccaatacttcag

SEQ ID NO: 654545 - DNA, 20 bp, mouse
gcaggagtgacctttggctg

SEQ ID NO: 654546 - DNA, 20 bp, mouse
gagcccgggtcagaaacctg

SEQ ID NO: 654547 - DNA, 20 bp, mouse
gtacgagggtgtcacgtgtg

SEQ ID NO: 654548 - DNA, 20 bp, mouse
ggtgcccctcatcagccaga

SEQ ID NO: 654549 - DNA, 20 bp, mouse
ggcagagccgtcatcagccc

SEQ ID NO: 654550 - DNA, 20 bp, mouse
gtcacgagctgtacctgact

SEQ ID NO: 654551 - DNA, 20 bp, mouse
gagggtgtcacgtgtgggga

SEQ ID NO: 654552 - DNA, 20 bp, mouse
gaaggatagcaatggcatgc

SEQ ID NO: 654553 - DNA, 20 bp, mouse
gacacgggaacgaaccagtg

SEQ ID NO: 654554 - DNA, 20 bp, mouse
gtggttcgttcccgtgtagg

SEQ ID NO: 654555 - DNA, 20 bp, mouse
gtagtcatgtgaccctagtc

SEQ ID NO: 654556 - DNA, 20 bp, mouse
gagcctgcacagtaaggccc

SEQ ID NO: 654557 - DNA, 20 bp, mouse
ggggttaccgtcagctggga

SEQ ID NO: 654558 - DNA, 20 bp, mouse
ggccctggaagaggcctcct

SEQ ID NO: 654559 - DNA, 20 bp, mouse
gcacagtaaggccctggaag

SEQ ID NO: 654560 - DNA, 20 bp, mouse
ggagctgagggggtaatctg

SEQ ID NO: 654561 - DNA, 20 bp, mouse
ggaggcctcctcggccctga

SEQ ID NO: 654562 - DNA, 20 bp, mouse
ggccgaggaggcctcttcca

SEQ ID NO: 654563 - DNA, 20 bp, mouse
gatggctataaatagaatca

SEQ ID NO: 654564 - DNA, 20 bp, mouse
gaactttgggcatgcattag

SEQ ID NO: 654565 - DNA, 20 bp, mouse
gccagctggtgacattgttg

SEQ ID NO: 654566 - DNA, 20 bp, mouse
gctgtctcccgtgccctcgg

SEQ ID NO: 654567 - DNA, 20 bp, mouse
ggtgccctcggaggagtgga

SEQ ID NO: 654568 - DNA, 20 bp, mouse
gccgccctccactcctccga

SEQ ID NO: 654569 - DNA, 20 bp, mouse
gggagtggagggcggaatca

SEQ ID NO: 654570 - DNA, 20 bp, mouse
gagcctgtctcccgtgccct

SEQ ID NO: 654571 - DNA, 20 bp, mouse
gtcccgtgccctcggaggag

SEQ ID NO: 654572 - DNA, 20 bp, mouse
gctggcccaccgcatgacca

SEQ ID NO: 654573 - DNA, 20 bp, mouse
gcacgtgagggccgaagccc

SEQ ID NO: 654574 - DNA, 20 bp, mouse
gaaggagagccctaaagtag

SEQ ID NO: 654575 - DNA, 20 bp, mouse
ggggtgaagccaaggaacac

SEQ ID NO: 654576 - DNA, 20 bp, mouse
gtggcaggcgtcaggatgaa

SEQ ID NO: 654577 - DNA, 20 bp, mouse
ggcacccttgtggttggctg

SEQ ID NO: 654578 - DNA, 20 bp, mouse
gagggtgcagatatgaagca

SEQ ID NO: 654579 - DNA, 20 bp, mouse
ggggctggagaagagattcc

SEQ ID NO: 654580 - DNA, 20 bp, mouse
gtcgctgggtggcaggcgtc

SEQ ID NO: 654581 - DNA, 20 bp, mouse
gcttgtggttggctggggag

SEQ ID NO: 654582 - DNA, 20 bp, mouse
ggccatggggggacctcagt

SEQ ID NO: 654583 - DNA, 20 bp, mouse
gtggggacccagtagtctag

SEQ ID NO: 654584 - DNA, 20 bp, mouse
gaaggtgacattcttcacca

SEQ ID NO: 654585 - DNA, 20 bp, mouse
ggatgtgagaagcggtcgct

SEQ ID NO: 654586 - DNA, 20 bp, mouse
gcgtctgcaaggagacgtgg

SEQ ID NO: 654587 - DNA, 20 bp, mouse
ggtggccccaagcccttgta

SEQ ID NO: 654588 - DNA, 20 bp, mouse
gagacgtggcggcggcggtt

SEQ ID NO: 654589 - DNA, 20 bp, mouse
gccaagcccttgtaaggcgg

SEQ ID NO: 654590 - DNA, 20 bp, mouse
ggccccaagcccttgtaagg

SEQ ID NO: 654591 - DNA, 20 bp, mouse
gagcccttgtaaggcggagg

SEQ ID NO: 654592 - DNA, 20 bp, mouse
ggtgctgcctgccccggaag

SEQ ID NO: 654593 - DNA, 20 bp, mouse
gagaaggctgcggctcgtga

SEQ ID NO: 654594 - DNA, 20 bp, mouse
gaggacgcggcaatggagga

SEQ ID NO: 654595 - DNA, 20 bp, mouse
gctgcaaggagacgtggcgg

SEQ ID NO: 654596 - DNA, 20 bp, mouse
gtaaactggagatacgtaag

SEQ ID NO: 654597 - DNA, 20 bp, mouse
ggggtcccttccgctctacg

SEQ ID NO: 654598 - DNA, 20 bp, mouse
ggtggagtcgataagcagga

SEQ ID NO: 654599 - DNA, 20 bp, mouse
ggactccacgtagagcggaa

SEQ ID NO: 654600 - DNA, 20 bp, mouse
gctacgtggagtcgataagc

SEQ ID NO: 654601 - DNA, 20 bp, mouse
gaactcagggagagtctggg

SEQ ID NO: 654602 - DNA, 20 bp, mouse
ggggcggggtagtgagatga

SEQ ID NO: 654603 - DNA, 20 bp, mouse
gtagtcagactaagatactg

SEQ ID NO: 654604 - DNA, 20 bp, mouse
gcggggtagtgagatgatgg

SEQ ID NO: 654605 - DNA, 20 bp, mouse
ggacccgttctatttatata

SEQ ID NO: 654606 - DNA, 20 bp, mouse
gtggtctgacaatattccat

SEQ ID NO: 654607 - DNA, 20 bp, mouse
gaggcttgcgaaacgtgatt

SEQ ID NO: 654608 - DNA, 20 bp, mouse
ggaaagccagaaccgaaaga

SEQ ID NO: 654609 - DNA, 20 bp, mouse
gatacaccctctttcggttc

SEQ ID NO: 654610 - DNA, 20 bp, mouse
gagctggtgaagaactttta

SEQ ID NO: 654611 - DNA, 20 bp, mouse
gcaactggtaatgatgtcta

SEQ ID NO: 654612 - DNA, 20 bp, mouse
gatactgagaatggaaagtc

SEQ ID NO: 654613 - DNA, 20 bp, mouse
ggccagacacagttgagact

SEQ ID NO: 654614 - DNA, 20 bp, mouse
gtcgaatattgaaataacta

SEQ ID NO: 654615 - DNA, 20 bp, mouse
gcttgaacagctggtccgaa

SEQ ID NO: 654616 - DNA, 20 bp, mouse
ggccgcgaggtcctccccgg

SEQ ID NO: 654617 - DNA, 20 bp, mouse
gtccccgcgaggccgctgaa

SEQ ID NO: 654618 - DNA, 20 bp, mouse
gctcgcggggaatttcagtg

SEQ ID NO: 654619 - DNA, 20 bp, mouse
ggcggggccgcatgccccgt

SEQ ID NO: 654620 - DNA, 20 bp, mouse
ggaactgcccccagcgtctg

SEQ ID NO: 654621 - DNA, 20 bp, mouse
gacactgccccctgccgccg

SEQ ID NO: 654622 - DNA, 20 bp, mouse
gaagggcgtctgagctccga

SEQ ID NO: 654623 - DNA, 20 bp, mouse
ggccgccggggaggacctcg

SEQ ID NO: 654624 - DNA, 20 bp, mouse
gatcgccgcgaggtcctccc

SEQ ID NO: 654625 - DNA, 20 bp, mouse
ggagctcagacgcccttcag

SEQ ID NO: 654626 - DNA, 20 bp, mouse
gccaccgcggatctggttta

SEQ ID NO: 654627 - DNA, 20 bp, mouse
ggattcgcgacagttagagg

SEQ ID NO: 654628 - DNA, 20 bp, mouse
gggagcctggagaaccgctg

SEQ ID NO: 654629 - DNA, 20 bp, mouse
gagaggaggcgggctaatag

SEQ ID NO: 654630 - DNA, 20 bp, mouse
gaagccgtaaaccagatccg

SEQ ID NO: 654631 - DNA, 20 bp, mouse
ggcagctgattggctgtcga

SEQ ID NO: 654632 - DNA, 20 bp, mouse
gggcagctttacgacagcca

SEQ ID NO: 654633 - DNA, 20 bp, mouse
ggggcatctgtgtgaggaga

SEQ ID NO: 654634 - DNA, 20 bp, mouse
gagacactgtactacgaatg

SEQ ID NO: 654635 - DNA, 20 bp, mouse
gcgcgacagttagaggaggc

SEQ ID NO: 654636 - DNA, 20 bp, mouse
ggtcctataagcagcgacag

SEQ ID NO: 654637 - DNA, 20 bp, mouse
gtgtcctggtccaatggtgg

SEQ ID NO: 654638 - DNA, 20 bp, mouse
ggcctcgtgtcctggtccaa

SEQ ID NO: 654639 - DNA, 20 bp, mouse
ggaccaggacacgaggccag

SEQ ID NO: 654640 - DNA, 20 bp, mouse
ggcagactgtggacgttggt

SEQ ID NO: 654641 - DNA, 20 bp, mouse
gttcccctgtcgctgcttat

SEQ ID NO: 654642 - DNA, 20 bp, mouse
gactctgggaggcagactaa

SEQ ID NO: 654643 - DNA, 20 bp, mouse
gagtgcgcctgcgcagactg

SEQ ID NO: 654644 - DNA, 20 bp, mouse
gtgcagatatagactctggg

SEQ ID NO: 654645 - DNA, 20 bp, mouse
ggcaagccggccgagtgcgt

SEQ ID NO: 654646 - DNA, 20 bp, mouse
gtagacgagccccagcatcc

SEQ ID NO: 654647 - DNA, 20 bp, mouse
gtaggaagaagatgttacag

SEQ ID NO: 654648 - DNA, 20 bp, mouse
gccacactttgtaacttttg

SEQ ID NO: 654649 - DNA, 20 bp, mouse
gcacctagcaggctggagac

SEQ ID NO: 654650 - DNA, 20 bp, mouse
gggcagctgagtagttgtgt

SEQ ID NO: 654651 - DNA, 20 bp, mouse
gcagacttgagacctggggg

SEQ ID NO: 654652 - DNA, 20 bp, mouse
gattggtctcagtgtagaaa

SEQ ID NO: 654653 - DNA, 20 bp, mouse
gacacaccactccacctagc

SEQ ID NO: 654654 - DNA, 20 bp, mouse
gtgtgcaggaagggcaaaat

SEQ ID NO: 654655 - DNA, 20 bp, mouse
gaccactccacctagcaggc

SEQ ID NO: 654656 - DNA, 20 bp, mouse
gcacccgcagcacctagctg

SEQ ID NO: 654657 - DNA, 20 bp, mouse
gcctacccaacaactcgggg

SEQ ID NO: 654658 - DNA, 20 bp, mouse
gggagccagcaccctaatcc

SEQ ID NO: 654659 - DNA, 20 bp, mouse
gatgaagaagctcgcgggag

SEQ ID NO: 654660 - DNA, 20 bp, mouse
ggcggtagctctttctaggt

SEQ ID NO: 654661 - DNA, 20 bp, mouse
gctaccgcagctaggtgctg

SEQ ID NO: 654662 - DNA, 20 bp, mouse
gcgactgagcatgcgtgggg

SEQ ID NO: 654663 - DNA, 20 bp, mouse
gcaggactaactgggagcgt

SEQ ID NO: 654664 - DNA, 20 bp, mouse
gccgcgccggccgtatgcaa

SEQ ID NO: 654665 - DNA, 20 bp, mouse
ggtgggatgaagaagctcgc

SEQ ID NO: 654666 - DNA, 20 bp, mouse
gcccccggcgccaactgtgg

SEQ ID NO: 654667 - DNA, 20 bp, mouse
ggggcggggtcgtctctgtg

SEQ ID NO: 654668 - DNA, 20 bp, mouse
ggaccctgaccactccctct

SEQ ID NO: 654669 - DNA, 20 bp, mouse
gcaggagggtggccaccaag

SEQ ID NO: 654670 - DNA, 20 bp, mouse
ggggaagctctcagaaatcc

SEQ ID NO: 654671 - DNA, 20 bp, mouse
gtcaaattcctgcgcctcca

SEQ ID NO: 654672 - DNA, 20 bp, mouse
gggcgccaactgtggaggtg

SEQ ID NO: 654673 - DNA, 20 bp, mouse
ggaaaactggtaactgagta

SEQ ID NO: 654674 - DNA, 20 bp, mouse
gccgcccccggcgccaactg

SEQ ID NO: 654675 - DNA, 20 bp, mouse
gttgccttaacccaggaggg

SEQ ID NO: 654676 - DNA, 20 bp, mouse
gccgacgccaacccccgcat

SEQ ID NO: 654677 - DNA, 20 bp, mouse
gctcggccccgcccatgcgg

SEQ ID NO: 654678 - DNA, 20 bp, mouse
ggccggagggaaccaagagt

SEQ ID NO: 654679 - DNA, 20 bp, mouse
ggggcggccgggtgctgacg

SEQ ID NO: 654680 - DNA, 20 bp, mouse
gcaagcggggattagggagt

SEQ ID NO: 654681 - DNA, 20 bp, mouse
gcacccgcgccgagcgacgg

SEQ ID NO: 654682 - DNA, 20 bp, mouse
ggccccgcccatgcgggggt

SEQ ID NO: 654683 - DNA, 20 bp, mouse
gcggggattagggagtcggc

SEQ ID NO: 654684 - DNA, 20 bp, mouse
ggccaacccccgcatgggcg

SEQ ID NO: 654685 - DNA, 20 bp, mouse
ggccctcggccccgcccatg

SEQ ID NO: 654686 - DNA, 20 bp, mouse
gggcgcgggcaactggaggg

SEQ ID NO: 654687 - DNA, 20 bp, mouse
gagcgggcgcgggcaactgg

SEQ ID NO: 654688 - DNA, 20 bp, mouse
gcgcactgcaacaacaaacc

SEQ ID NO: 654689 - DNA, 20 bp, mouse
gggggccagggctgcgcgtg

SEQ ID NO: 654690 - DNA, 20 bp, mouse
gcctaggtggaaagtctgga

SEQ ID NO: 654691 - DNA, 20 bp, mouse
gccggcgcgtgccggactcc

SEQ ID NO: 654692 - DNA, 20 bp, mouse
gaggagcgggcgcgggcaac

SEQ ID NO: 654693 - DNA, 20 bp, mouse
ggcgctcggggcggtggctc

SEQ ID NO: 654694 - DNA, 20 bp, mouse
ggcggtggctccgggagcca

SEQ ID NO: 654695 - DNA, 20 bp, mouse
ggggaactcttggaagtgga

SEQ ID NO: 654696 - DNA, 20 bp, mouse
gggaccgcgccaattgtcat

SEQ ID NO: 654697 - DNA, 20 bp, mouse
gtgccccttgagtgtgagaa

SEQ ID NO: 654698 - DNA, 20 bp, mouse
ggtcctatgccggggccaga

SEQ ID NO: 654699 - DNA, 20 bp, mouse
ggcgcgtggctccagagatg

SEQ ID NO: 654700 - DNA, 20 bp, mouse
gtgaggggctaaatgggtac

SEQ ID NO: 654701 - DNA, 20 bp, mouse
gtgtgcatgaggggctaaat

SEQ ID NO: 654702 - DNA, 20 bp, mouse
ggctcccgcctcctccgcca

SEQ ID NO: 654703 - DNA, 20 bp, mouse
gccagaaggaagcgtacgcc

SEQ ID NO: 654704 - DNA, 20 bp, mouse
ggaagcgtacgcctggcgcg

SEQ ID NO: 654705 - DNA, 20 bp, mouse
gaggcatggggtgtgcatga

SEQ ID NO: 654706 - DNA, 20 bp, mouse
gagtaagagcagtaccgaga

SEQ ID NO: 654707 - DNA, 20 bp, mouse
gaaaagcgccagctctccag

SEQ ID NO: 654708 - DNA, 20 bp, mouse
gtatgacaatctaagccgaa

SEQ ID NO: 654709 - DNA, 20 bp, mouse
gcactctgcaaagatcacgt

SEQ ID NO: 654710 - DNA, 20 bp, mouse
ggcttatgaaactagacacg

SEQ ID NO: 654711 - DNA, 20 bp, mouse
gattgtcatagctccatagt

SEQ ID NO: 654712 - DNA, 20 bp, mouse
gacagattcttttgtttaga

SEQ ID NO: 654713 - DNA, 20 bp, mouse
gcccattcatccggtttata

SEQ ID NO: 654714 - DNA, 20 bp, mouse
ggcttacagttaaacagaac

SEQ ID NO: 654715 - DNA, 20 bp, mouse
gtctcataatatgcaaatgt

SEQ ID NO: 654716 - DNA, 20 bp, mouse
gagaagaagcgctcatcaaa

SEQ ID NO: 654717 - DNA, 20 bp, mouse
gcttccccggaggtccaagg

SEQ ID NO: 654718 - DNA, 20 bp, mouse
gcgggagcccgaacttgttc

SEQ ID NO: 654719 - DNA, 20 bp, mouse
ggacggcagggcaagcagtc

SEQ ID NO: 654720 - DNA, 20 bp, mouse
gaagaaggggcaaagataga

SEQ ID NO: 654721 - DNA, 20 bp, mouse
gaaacctcgggcttccccgg

SEQ ID NO: 654722 - DNA, 20 bp, mouse
ggggcttccccggaggtcca

SEQ ID NO: 654723 - DNA, 20 bp, mouse
gcgtctccgcgcgcagtccg

SEQ ID NO: 654724 - DNA, 20 bp, mouse
ggcgtgcgctgtgtgaacga

SEQ ID NO: 654725 - DNA, 20 bp, mouse
gacagaccgggaagtctgga

SEQ ID NO: 654726 - DNA, 20 bp, mouse
gttaatgtgagtcatagctc

SEQ ID NO: 654727 - DNA, 20 bp, mouse
gagtccaagccaacccaaaa

SEQ ID NO: 654728 - DNA, 20 bp, mouse
gggggtgctgcgagttgcta

SEQ ID NO: 654729 - DNA, 20 bp, mouse
gctctgaaaggcctctgcac

SEQ ID NO: 654730 - DNA, 20 bp, mouse
gctctcagtccaggaggacc

SEQ ID NO: 654731 - DNA, 20 bp, mouse
ggaggctcgcagctagagcc

SEQ ID NO: 654732 - DNA, 20 bp, mouse
ggctcaacacatgtcaccgc

SEQ ID NO: 654733 - DNA, 20 bp, mouse
gtcacattgctagcactctg

SEQ ID NO: 654734 - DNA, 20 bp, mouse
gccagtgaggaacaagaatt

SEQ ID NO: 654735 - DNA, 20 bp, mouse
gaggaacaagaattgggcgc

SEQ ID NO: 654736 - DNA, 20 bp, mouse
gaacaaagtgagtggaatag

SEQ ID NO: 654737 - DNA, 20 bp, mouse
gccgcggcggcgagcaagat

SEQ ID NO: 654738 - DNA, 20 bp, mouse
gcggggccgcgccacacgtc

SEQ ID NO: 654739 - DNA, 20 bp, mouse
gctggtgcggaccaggacaa

SEQ ID NO: 654740 - DNA, 20 bp, mouse
gctcccgctcgcagaacgga

SEQ ID NO: 654741 - DNA, 20 bp, mouse
gtcactgcggctccacctgc

SEQ ID NO: 654742 - DNA, 20 bp, mouse
gccgccgcggccctcgctgg

SEQ ID NO: 654743 - DNA, 20 bp, mouse
gccacctgctggtgcggacc

SEQ ID NO: 654744 - DNA, 20 bp, mouse
ggaccctcctcctccagcga

SEQ ID NO: 654745 - DNA, 20 bp, mouse
gcgcggccacgcccgacgtg

SEQ ID NO: 654746 - DNA, 20 bp, mouse
gcctgaagacgcctcgagat

SEQ ID NO: 654747 - DNA, 20 bp, mouse
gctcctggggcccgtgaaga

SEQ ID NO: 654748 - DNA, 20 bp, mouse
gaatccctggagtctccgac

SEQ ID NO: 654749 - DNA, 20 bp, mouse
gtgccggtgcggtaaccctt

SEQ ID NO: 654750 - DNA, 20 bp, mouse
gagagaagctccctcttcac

SEQ ID NO: 654751 - DNA, 20 bp, mouse
gtctatcgggaaccaatccc

SEQ ID NO: 654752 - DNA, 20 bp, mouse
gattccagtcggagactcca

SEQ ID NO: 654753 - DNA, 20 bp, mouse
gaaagcggaacgaggggcgg

SEQ ID NO: 654754 - DNA, 20 bp, mouse
gggaaaagcggaacgagggg

SEQ ID NO: 654755 - DNA, 20 bp, mouse
gtaccggaaaagcggaacga

SEQ ID NO: 654756 - DNA, 20 bp, mouse
gaactggggaggtatagggg

SEQ ID NO: 654757 - DNA, 20 bp, mouse
gaggagtagacttggaactg

SEQ ID NO: 654758 - DNA, 20 bp, mouse
gaggggacagggtccatcca

SEQ ID NO: 654759 - DNA, 20 bp, mouse
gcttggaactggggaggtat

SEQ ID NO: 654760 - DNA, 20 bp, mouse
ggagtgagtcagtcaggtta

SEQ ID NO: 654761 - DNA, 20 bp, mouse
gaacctggcatcaccaacac

SEQ ID NO: 654762 - DNA, 20 bp, mouse
ggtgaagagccctgggcaat

SEQ ID NO: 654763 - DNA, 20 bp, mouse
gttgaaccataaacagaggt

SEQ ID NO: 654764 - DNA, 20 bp, mouse
gtctccaaatatccctgacc

SEQ ID NO: 654765 - DNA, 20 bp, mouse
gcctgggcaatgggagggga

SEQ ID NO: 654766 - DNA, 20 bp, mouse
gaccagagaagggagacagg

SEQ ID NO: 654767 - DNA, 20 bp, mouse
gagaaacgcagttggaactc

SEQ ID NO: 654768 - DNA, 20 bp, mouse
gataaccagagaagggagac

SEQ ID NO: 654769 - DNA, 20 bp, mouse
gtaaacctgggagacgggac

SEQ ID NO: 654770 - DNA, 20 bp, mouse
gactcaggcagtgagcagtg

SEQ ID NO: 654771 - DNA, 20 bp, mouse
ggaactgaaacaggggaggg

SEQ ID NO: 654772 - DNA, 20 bp, mouse
gagggaggaggggccaatct

SEQ ID NO: 654773 - DNA, 20 bp, mouse
gaccacctgtcccgtctccc

SEQ ID NO: 654774 - DNA, 20 bp, mouse
gacccagctcttgcctagat

SEQ ID NO: 654775 - DNA, 20 bp, mouse
gccaaagtcccaggggcagg

SEQ ID NO: 654776 - DNA, 20 bp, mouse
ggacccgcacacaccgccag

SEQ ID NO: 654777 - DNA, 20 bp, mouse
gcagccgctggcggtgtgtg

SEQ ID NO: 654778 - DNA, 20 bp, mouse
gacaggggatgcaatgatga

SEQ ID NO: 654779 - DNA, 20 bp, mouse
gacccaacgcgcagtcgccg

SEQ ID NO: 654780 - DNA, 20 bp, mouse
gagggcatccttcagacccg

SEQ ID NO: 654781 - DNA, 20 bp, mouse
gccgccagcggctggatccc

SEQ ID NO: 654782 - DNA, 20 bp, mouse
ggtgcccctccgctgggctg

SEQ ID NO: 654783 - DNA, 20 bp, mouse
ggggcacgcccgcgcagacg

SEQ ID NO: 654784 - DNA, 20 bp, mouse
ggtgggaggcgcacgttcga

SEQ ID NO: 654785 - DNA, 20 bp, mouse
gtggccagcctcgtctgcgc

SEQ ID NO: 654786 - DNA, 20 bp, mouse
gaaaggacagacctcctaag

SEQ ID NO: 654787 - DNA, 20 bp, mouse
gttgaagggagccacttagg

SEQ ID NO: 654788 - DNA, 20 bp, mouse
gggaaatcacggcacatatg

SEQ ID NO: 654789 - DNA, 20 bp, mouse
gacgcacggcgctcttaaag

SEQ ID NO: 654790 - DNA, 20 bp, mouse
gtgctccgcacagtgtaaag

SEQ ID NO: 654791 - DNA, 20 bp, mouse
gggcgcaactcggattgccc

SEQ ID NO: 654792 - DNA, 20 bp, mouse
gtgcgtccttcccaagtaag

SEQ ID NO: 654793 - DNA, 20 bp, mouse
gagcccgaggtagttgtggg

SEQ ID NO: 654794 - DNA, 20 bp, mouse
gaagtggctcccttcaaacc

SEQ ID NO: 654795 - DNA, 20 bp, mouse
gcaaaagccgcctggaaacg

SEQ ID NO: 654796 - DNA, 20 bp, mouse
gggagaggggaggcaggtga

SEQ ID NO: 654797 - DNA, 20 bp, mouse
gccagtgaggcaggttcggg

SEQ ID NO: 654798 - DNA, 20 bp, mouse
ggttgcaggtcaactgactc

SEQ ID NO: 654799 - DNA, 20 bp, mouse
ggaacctgcctcactggaat

SEQ ID NO: 654800 - DNA, 20 bp, mouse
gtacatagctggtcagccaa

SEQ ID NO: 654801 - DNA, 20 bp, mouse
gaggaagaagggaggtcaac

SEQ ID NO: 654802 - DNA, 20 bp, mouse
ggccaatggctggcaggaga

SEQ ID NO: 654803 - DNA, 20 bp, mouse
ggaggagaggttgcgaaaga

SEQ ID NO: 654804 - DNA, 20 bp, mouse
gtaagtgtggtggcactgtg

SEQ ID NO: 654805 - DNA, 20 bp, mouse
ggaatgcttccgggaggtgg

SEQ ID NO: 654806 - DNA, 20 bp, mouse
gcgtgtgcgcgcaggaagga

SEQ ID NO: 654807 - DNA, 20 bp, mouse
gcgaaggagacaacgtgggg

SEQ ID NO: 654808 - DNA, 20 bp, mouse
ggatccgaaggagacaacgt

SEQ ID NO: 654809 - DNA, 20 bp, mouse
gtgtgtgggtcacatgaagg

SEQ ID NO: 654810 - DNA, 20 bp, mouse
gggcccgggagcggaaccga

SEQ ID NO: 654811 - DNA, 20 bp, mouse
gcgcctacgagtgtctgcga

SEQ ID NO: 654812 - DNA, 20 bp, mouse
ggagtggcaaggtaagactc

SEQ ID NO: 654813 - DNA, 20 bp, mouse
gaaccgagggctccccccgc

SEQ ID NO: 654814 - DNA, 20 bp, mouse
gtgtctgcgagggtgtctct

SEQ ID NO: 654815 - DNA, 20 bp, mouse
gcggctccgggatccgaacg

SEQ ID NO: 654816 - DNA, 20 bp, mouse
gccaccgcactgcatcagcg

SEQ ID NO: 654817 - DNA, 20 bp, mouse
gaacacggggcattatgcgc

SEQ ID NO: 654818 - DNA, 20 bp, mouse
gcagccacgctgatgcagtg

SEQ ID NO: 654819 - DNA, 20 bp, mouse
gaatgccccgtgttaagcat

SEQ ID NO: 654820 - DNA, 20 bp, mouse
gccagggtcccatacatccc

SEQ ID NO: 654821 - DNA, 20 bp, mouse
ggccccgtgttaagcatggg

SEQ ID NO: 654822 - DNA, 20 bp, mouse
gtccccccatgcttaacacg

SEQ ID NO: 654823 - DNA, 20 bp, mouse
ggcattatgcgctggttaac

SEQ ID NO: 654824 - DNA, 20 bp, mouse
gtctagtggcgtgtgtaggg

SEQ ID NO: 654825 - DNA, 20 bp, mouse
gcagcgagaagcagcggcca

SEQ ID NO: 654826 - DNA, 20 bp, mouse
ggaccgctgtggtttcctcc

SEQ ID NO: 654827 - DNA, 20 bp, mouse
gaccctcaggtctgcattca

SEQ ID NO: 654828 - DNA, 20 bp, mouse
gaccacagcggtccatggta

SEQ ID NO: 654829 - DNA, 20 bp, mouse
gcgccaggaggaaaccacag

SEQ ID NO: 654830 - DNA, 20 bp, mouse
gcaagcggagcagtctgggg

SEQ ID NO: 654831 - DNA, 20 bp, mouse
gcaaaccccaatgtctatct

SEQ ID NO: 654832 - DNA, 20 bp, mouse
gggagcctaaaaggcctcaa

SEQ ID NO: 654833 - DNA, 20 bp, mouse
ggaaacccagatagacattg

SEQ ID NO: 654834 - DNA, 20 bp, mouse
gaggaaaccacagcggtcca

SEQ ID NO: 654835 - DNA, 20 bp, mouse
ggggaggtccctgggggcac

SEQ ID NO: 654836 - DNA, 20 bp, mouse
gagaagaagtggcaaggaat

SEQ ID NO: 654837 - DNA, 20 bp, mouse
gctcgcagggacacacgcag

SEQ ID NO: 654838 - DNA, 20 bp, mouse
gatcctggaatctccatcct

SEQ ID NO: 654839 - DNA, 20 bp, mouse
ggctgtgcgggtgctgataa

SEQ ID NO: 654840 - DNA, 20 bp, mouse
gtggcccccacgcttgacta

SEQ ID NO: 654841 - DNA, 20 bp, mouse
gctcccgtgccagtgcccga

SEQ ID NO: 654842 - DNA, 20 bp, mouse
ggggcactggcacgggaggc

SEQ ID NO: 654843 - DNA, 20 bp, mouse
gtcaccgtcgggcactggca

SEQ ID NO: 654844 - DNA, 20 bp, mouse
ggggtgtggtccagaagaag

SEQ ID NO: 654845 - DNA, 20 bp, mouse
gtcaacagcgtttcaccgtc

SEQ ID NO: 654846 - DNA, 20 bp, mouse
gtatccactggtatgatcag

SEQ ID NO: 654847 - DNA, 20 bp, mouse
gaaaagctgtgacctcacag

SEQ ID NO: 654848 - DNA, 20 bp, mouse
gcacggacagaaccagctat

SEQ ID NO: 654849 - DNA, 20 bp, mouse
ggctatgggcatttacagac

SEQ ID NO: 654850 - DNA, 20 bp, mouse
gtctgggttttaatctatca

SEQ ID NO: 654851 - DNA, 20 bp, mouse
gggtttcaattgtgctatct

SEQ ID NO: 654852 - DNA, 20 bp, mouse
gcgtgaagagactgtcacct

SEQ ID NO: 654853 - DNA, 20 bp, mouse
gacagattaagtgcttcatg

SEQ ID NO: 654854 - DNA, 20 bp, mouse
gatataaaatacagcactta

SEQ ID NO: 654855 - DNA, 20 bp, mouse
gttaaggttgtaaactgtag

SEQ ID NO: 654856 - DNA, 20 bp, mouse
gcatccctgcagcacccggg

SEQ ID NO: 654857 - DNA, 20 bp, mouse
gacaactagtgctgactccc

SEQ ID NO: 654858 - DNA, 20 bp, mouse
gtggaagagtagagccaatt

SEQ ID NO: 654859 - DNA, 20 bp, mouse
gcaggaagaggtgatttcca

SEQ ID NO: 654860 - DNA, 20 bp, mouse
gagagccaattgggagaggt

SEQ ID NO: 654861 - DNA, 20 bp, mouse
gtgaggtgaagacagacgac

SEQ ID NO: 654862 - DNA, 20 bp, mouse
ggtcagcactagttgtactg

SEQ ID NO: 654863 - DNA, 20 bp, mouse
ggaagattgctggaggttcc

SEQ ID NO: 654864 - DNA, 20 bp, mouse
ggctgaaacggttttgaaac

SEQ ID NO: 654865 - DNA, 20 bp, mouse
gttatgggcgggaccacctc

SEQ ID NO: 654866 - DNA, 20 bp, mouse
ggggacttgagcgtgactag

SEQ ID NO: 654867 - DNA, 20 bp, mouse
gaactgggtaactggaggac

SEQ ID NO: 654868 - DNA, 20 bp, mouse
gcagtgaagagcagtagtct

SEQ ID NO: 654869 - DNA, 20 bp, mouse
gcagacttccagcctgtaca

SEQ ID NO: 654870 - DNA, 20 bp, mouse
gtacgaacgaactggttatt

SEQ ID NO: 654871 - DNA, 20 bp, mouse
gaggtccaacacagaaagta

SEQ ID NO: 654872 - DNA, 20 bp, mouse
gcaatatgtccgcgagacag

SEQ ID NO: 654873 - DNA, 20 bp, mouse
gttgcgtgaagttagagcag

SEQ ID NO: 654874 - DNA, 20 bp, mouse
gaggaccggaagagatgttg

SEQ ID NO: 654875 - DNA, 20 bp, mouse
gaggtagctcttgattccat

SEQ ID NO: 654876 - DNA, 20 bp, mouse
gaaggcaaacgtgcatcctg

SEQ ID NO: 654877 - DNA, 20 bp, mouse
gggacccaacccgtgcgcag

SEQ ID NO: 654878 - DNA, 20 bp, mouse
gacctggcggcccgacctct

SEQ ID NO: 654879 - DNA, 20 bp, mouse
gaagcccggcgactctaagg

SEQ ID NO: 654880 - DNA, 20 bp, mouse
gcaggataagcccagaggtc

SEQ ID NO: 654881 - DNA, 20 bp, mouse
gcgagcgacgccaggcgggg

SEQ ID NO: 654882 - DNA, 20 bp, mouse
ggcagtgtcacagcacctta

SEQ ID NO: 654883 - DNA, 20 bp, mouse
gtaacataggaatacctaga

SEQ ID NO: 654884 - DNA, 20 bp, mouse
ggctgatgggacactggacc

SEQ ID NO: 654885 - DNA, 20 bp, mouse
gtaggagatctattgctgat

SEQ ID NO: 654886 - DNA, 20 bp, mouse
gtggctgcagaatctatgaa

SEQ ID NO: 654887 - DNA, 20 bp, mouse
ggtggcaagcgcgcgcgggg

SEQ ID NO: 654888 - DNA, 20 bp, mouse
gggtctgtatcgccccctag

SEQ ID NO: 654889 - DNA, 20 bp, mouse
gcgcgcgcttgccactgcgc

SEQ ID NO: 654890 - DNA, 20 bp, mouse
ggaaggggcggattcctgag

SEQ ID NO: 654891 - DNA, 20 bp, mouse
gtgtgcgcactccattggtc

SEQ ID NO: 654892 - DNA, 20 bp, mouse
ggcagaaaaccattttgcag

SEQ ID NO: 654893 - DNA, 20 bp, mouse
gggaagcctgggttccactc

SEQ ID NO: 654894 - DNA, 20 bp, mouse
ggctaaatgtaggtgtggct

SEQ ID NO: 654895 - DNA, 20 bp, mouse
gcattggtcggggtgccgga

SEQ ID NO: 654896 - DNA, 20 bp, mouse
gcaagggaggggttacagaa

SEQ ID NO: 654897 - DNA, 20 bp, mouse
ggagcccagtcatgataggg

SEQ ID NO: 654898 - DNA, 20 bp, mouse
gttaatccaaatatggtcaa

SEQ ID NO: 654899 - DNA, 20 bp, mouse
ggggaggattgggcttaatg

SEQ ID NO: 654900 - DNA, 20 bp, mouse
gcaagagcccagtcatgata

SEQ ID NO: 654901 - DNA, 20 bp, mouse
gaggagctgtgctgttcaag

SEQ ID NO: 654902 - DNA, 20 bp, mouse
gaaaccatattgttatattt

SEQ ID NO: 654903 - DNA, 20 bp, mouse
gtcacccaccctatcatgac

SEQ ID NO: 654904 - DNA, 20 bp, mouse
ggggtgggtgacatagagca

SEQ ID NO: 654905 - DNA, 20 bp, mouse
gagacaggatttttatagca

SEQ ID NO: 654906 - DNA, 20 bp, mouse
gcaggaggccgtggggtagt

SEQ ID NO: 654907 - DNA, 20 bp, mouse
gtgctggccagactgaggag

SEQ ID NO: 654908 - DNA, 20 bp, mouse
gagaatgtgggctgctcagg

SEQ ID NO: 654909 - DNA, 20 bp, mouse
gagatcaagaggtttgtaag

SEQ ID NO: 654910 - DNA, 20 bp, mouse
ggggagaatgtgggctgctc

SEQ ID NO: 654911 - DNA, 20 bp, mouse
gcctcagtggagagagtcag

SEQ ID NO: 654912 - DNA, 20 bp, mouse
gggctgctcaggaggccgtg

SEQ ID NO: 654913 - DNA, 20 bp, mouse
gcagcaggaatgggagaatg

SEQ ID NO: 654914 - DNA, 20 bp, mouse
gcgtggggtagtgggcacat

SEQ ID NO: 654915 - DNA, 20 bp, mouse
ggggcacatagggccatgca

SEQ ID NO: 654916 - DNA, 20 bp, mouse
ggcaggaagaatgtctgcta

SEQ ID NO: 654917 - DNA, 20 bp, mouse
gcaaggtaggctggacctcg

SEQ ID NO: 654918 - DNA, 20 bp, mouse
gagggatgggctgagaccat

SEQ ID NO: 654919 - DNA, 20 bp, mouse
gagggtggggcctcaaaaag

SEQ ID NO: 654920 - DNA, 20 bp, mouse
gacacttggactcttgtaaa

SEQ ID NO: 654921 - DNA, 20 bp, mouse
gcggaggggactgcagggtg

SEQ ID NO: 654922 - DNA, 20 bp, mouse
ggctggacctcggggtgtgg

SEQ ID NO: 654923 - DNA, 20 bp, mouse
gtcaccttcaaagtagagag

SEQ ID NO: 654924 - DNA, 20 bp, mouse
gactgcagggtggggcttac

SEQ ID NO: 654925 - DNA, 20 bp, mouse
gaaaaaggggcgggttttct

SEQ ID NO: 654926 - DNA, 20 bp, mouse
gccccctgccagcggtcctc

SEQ ID NO: 654927 - DNA, 20 bp, mouse
gagtgactgcaaagccccag

SEQ ID NO: 654928 - DNA, 20 bp, mouse
gtgccagcggtcctcgggat

SEQ ID NO: 654929 - DNA, 20 bp, mouse
ggggcagaggctggcgtggg

SEQ ID NO: 654930 - DNA, 20 bp, mouse
gacgcgcgcctgccctcctc

SEQ ID NO: 654931 - DNA, 20 bp, mouse
gctgccccgccccctgccag

SEQ ID NO: 654932 - DNA, 20 bp, mouse
gagaaagccacaagccgctg

SEQ ID NO: 654933 - DNA, 20 bp, mouse
gctctggaacgtggcaaacg

SEQ ID NO: 654934 - DNA, 20 bp, mouse
gagccaatcccgaggaccgc

SEQ ID NO: 654935 - DNA, 20 bp, mouse
gccaacacgagccaatcccg

SEQ ID NO: 654936 - DNA, 20 bp, mouse
gaaggcccgcggggaggtcc

SEQ ID NO: 654937 - DNA, 20 bp, mouse
gtggcagagccagtagatca

SEQ ID NO: 654938 - DNA, 20 bp, mouse
gagagccagtagatcacggg

SEQ ID NO: 654939 - DNA, 20 bp, mouse
ggctaccacccgtgatctac

SEQ ID NO: 654940 - DNA, 20 bp, mouse
gaggaaaatggggagtatcc

SEQ ID NO: 654941 - DNA, 20 bp, mouse
gccacctgagcttccataaa

SEQ ID NO: 654942 - DNA, 20 bp, mouse
ggggagctgtcctcgcgccc

SEQ ID NO: 654943 - DNA, 20 bp, mouse
gatggaagctcaggtgggat

SEQ ID NO: 654944 - DNA, 20 bp, mouse
gagggcactcgcttgctcag

SEQ ID NO: 654945 - DNA, 20 bp, mouse
gtcgcgcccaggtgctgaaa

SEQ ID NO: 654946 - DNA, 20 bp, mouse
gaggtgggacactgaatcag

SEQ ID NO: 654947 - DNA, 20 bp, mouse
gggcccacggggttatggaa

SEQ ID NO: 654948 - DNA, 20 bp, mouse
gcccaagcaatctgtaagtt

SEQ ID NO: 654949 - DNA, 20 bp, mouse
gcagctgcgaggtgacctag

SEQ ID NO: 654950 - DNA, 20 bp, mouse
gttacagattgcttgggaag

SEQ ID NO: 654951 - DNA, 20 bp, mouse
ggctctctggtctccatccc

SEQ ID NO: 654952 - DNA, 20 bp, mouse
gaggtcacctcgcagctgag

SEQ ID NO: 654953 - DNA, 20 bp, mouse
gactgaatcaggggcttgga

SEQ ID NO: 654954 - DNA, 20 bp, mouse
gatccagcctcaaacagcag

SEQ ID NO: 654955 - DNA, 20 bp, mouse
ggccttggcccacggggtta

SEQ ID NO: 654956 - DNA, 20 bp, mouse
gcgcctggccaatgaggaag

SEQ ID NO: 654957 - DNA, 20 bp, mouse
gaacgatggtggggttgtca

SEQ ID NO: 654958 - DNA, 20 bp, mouse
gcgaaagcgcctggccaatg

SEQ ID NO: 654959 - DNA, 20 bp, mouse
gcaaggcgccgcttcctcat

SEQ ID NO: 654960 - DNA, 20 bp, mouse
gtgggcgggtttctcctcgc

SEQ ID NO: 654961 - DNA, 20 bp, mouse
gtgaccggctcgtagagtcg

SEQ ID NO: 654962 - DNA, 20 bp, mouse
gcggcgccttgtttaaacga

SEQ ID NO: 654963 - DNA, 20 bp, mouse
gccttgtttaaacgatggtg

SEQ ID NO: 654964 - DNA, 20 bp, mouse
gggttggtgctgtagcgagg

SEQ ID NO: 654965 - DNA, 20 bp, mouse
gtcaggaccgcatgcagccg

SEQ ID NO: 654966 - DNA, 20 bp, mouse
gctaaactctagacgtctac

SEQ ID NO: 654967 - DNA, 20 bp, mouse
gacagtgactacagtttcaa

SEQ ID NO: 654968 - DNA, 20 bp, mouse
gcctgggcctgcgtctgttg

SEQ ID NO: 654969 - DNA, 20 bp, mouse
gtagctagaagttttggcta

SEQ ID NO: 654970 - DNA, 20 bp, mouse
gagacgtctactggaagatt

SEQ ID NO: 654971 - DNA, 20 bp, mouse
ggctatggtacaaacagtga

SEQ ID NO: 654972 - DNA, 20 bp, mouse
gtcgctcttcagtactaaca

SEQ ID NO: 654973 - DNA, 20 bp, mouse
gttgggtaaacatataatat

SEQ ID NO: 654974 - DNA, 20 bp, mouse
gtcccaaagaagtctattgt

SEQ ID NO: 654975 - DNA, 20 bp, mouse
gatgtctcaagcctttgggg

SEQ ID NO: 654976 - DNA, 20 bp, mouse
gagtaagacagcccgggtca

SEQ ID NO: 654977 - DNA, 20 bp, mouse
ggggctggcaggtgtcccgt

SEQ ID NO: 654978 - DNA, 20 bp, mouse
gaggctccatcccctgaccc

SEQ ID NO: 654979 - DNA, 20 bp, mouse
gtaggctggggagggtcccg

SEQ ID NO: 654980 - DNA, 20 bp, mouse
gtattctagggcataggctg

SEQ ID NO: 654981 - DNA, 20 bp, mouse
gactgcttggggcaaagaga

SEQ ID NO: 654982 - DNA, 20 bp, mouse
ggctgtcttactcactgggt

SEQ ID NO: 654983 - DNA, 20 bp, mouse
gccagtgagtaagacagccc

SEQ ID NO: 654984 - DNA, 20 bp, mouse
gatagcccagatgaggatac

SEQ ID NO: 654985 - DNA, 20 bp, mouse
gcctcatctgggctattcta

SEQ ID NO: 654986 - DNA, 20 bp, mouse
gcagcctgatggcgtcccga

SEQ ID NO: 654987 - DNA, 20 bp, mouse
ggggcggcgccacacggtga

SEQ ID NO: 654988 - DNA, 20 bp, mouse
gtcccgacggcgcggaccaa

SEQ ID NO: 654989 - DNA, 20 bp, mouse
gccggctgcggtcacgtgag

SEQ ID NO: 654990 - DNA, 20 bp, mouse
ggccggcccgggtggggaac

SEQ ID NO: 654991 - DNA, 20 bp, mouse
ggaaggagcacagttctgtc

SEQ ID NO: 654992 - DNA, 20 bp, mouse
gaccgcgtggctgtgcgtcc

SEQ ID NO: 654993 - DNA, 20 bp, mouse
ggggcccgcccccggcgctc

SEQ ID NO: 654994 - DNA, 20 bp, mouse
gggcgggcccggaagcgagt

SEQ ID NO: 654995 - DNA, 20 bp, mouse
gtcccaggaacacgtgcctc

SEQ ID NO: 654996 - DNA, 20 bp, mouse
gctagatctggagtcccgga

SEQ ID NO: 654997 - DNA, 20 bp, mouse
gagggtcccgcgtgctacta

SEQ ID NO: 654998 - DNA, 20 bp, mouse
gaggctggtgcgcagcgcta

SEQ ID NO: 654999 - DNA, 20 bp, mouse
ggcgctgcgcaccagccttc

SEQ ID NO: 655000 - DNA, 20 bp, mouse
ggttccgcgcttgcgcacga

SEQ ID NO: 655001 - DNA, 20 bp, mouse
gcgcagcgctagggaccccg

SEQ ID NO: 655002 - DNA, 20 bp, mouse
gttaagatggggaacttaaa

SEQ ID NO: 655003 - DNA, 20 bp, mouse
gagagcggttgcaggcggag

SEQ ID NO: 655004 - DNA, 20 bp, mouse
gctggcatccctagacttag

SEQ ID NO: 655005 - DNA, 20 bp, mouse
gggaaccgttgcctgcagag

SEQ ID NO: 655006 - DNA, 20 bp, mouse
gcccccgctccgagcctctc

SEQ ID NO: 655007 - DNA, 20 bp, mouse
gggcgcccgcaccacctccc

SEQ ID NO: 655008 - DNA, 20 bp, mouse
ggaggtggtgcgggcgccaa

SEQ ID NO: 655009 - DNA, 20 bp, mouse
ggcgcccccgggaggtggtg

SEQ ID NO: 655010 - DNA, 20 bp, mouse
gggaacccgcgtgactagca

SEQ ID NO: 655011 - DNA, 20 bp, mouse
gcaggcgccaccagcgggtc

SEQ ID NO: 655012 - DNA, 20 bp, mouse
gggtggcctcgagccctgag

SEQ ID NO: 655013 - DNA, 20 bp, mouse
gaacctgggacacgtgggga

SEQ ID NO: 655014 - DNA, 20 bp, mouse
gagggctcgaggccacctgc

SEQ ID NO: 655015 - DNA, 20 bp, mouse
ggccccgcgctctctcccgc

SEQ ID NO: 655016 - DNA, 20 bp, mouse
gaggcggccgcaagtgtgag

SEQ ID NO: 655017 - DNA, 20 bp, mouse
ggccgcaagtgtgagaggaa

SEQ ID NO: 655018 - DNA, 20 bp, mouse
gaggcgtggcgaagcgagca

SEQ ID NO: 655019 - DNA, 20 bp, mouse
ggggtccggcgcgcttccgt

SEQ ID NO: 655020 - DNA, 20 bp, mouse
ggcaggctggggacctgtaa

SEQ ID NO: 655021 - DNA, 20 bp, mouse
gaagcgcgccggacccttcg

SEQ ID NO: 655022 - DNA, 20 bp, mouse
gagaagctgagggctctccc

SEQ ID NO: 655023 - DNA, 20 bp, mouse
gtagagctcgctgcctcgga

SEQ ID NO: 655024 - DNA, 20 bp, mouse
ggggccgggtggtgggaact

SEQ ID NO: 655025 - DNA, 20 bp, mouse
ggcgagctctaggctgacgg

SEQ ID NO: 655026 - DNA, 20 bp, mouse
gcttaagccttgtgctccca

SEQ ID NO: 655027 - DNA, 20 bp, mouse
gacagggccgggaggaagtt

SEQ ID NO: 655028 - DNA, 20 bp, mouse
gcaagcagaaaccatgtcta

SEQ ID NO: 655029 - DNA, 20 bp, mouse
gagcacaaggcttaagcttt

SEQ ID NO: 655030 - DNA, 20 bp, mouse
gtgacacacacgtcacttcc

SEQ ID NO: 655031 - DNA, 20 bp, mouse
gaggcttaagctttgggtca

SEQ ID NO: 655032 - DNA, 20 bp, mouse
gtgacgtgtgtgtcatgtta

SEQ ID NO: 655033 - DNA, 20 bp, mouse
gcccaggtgctgtgtcactg

SEQ ID NO: 655034 - DNA, 20 bp, mouse
gctcttctgaggtggcataa

SEQ ID NO: 655035 - DNA, 20 bp, mouse
gtcctagcaccccagtggga

SEQ ID NO: 655036 - DNA, 20 bp, mouse
gtcccggagctgcttatctg

SEQ ID NO: 655037 - DNA, 20 bp, mouse
gctggggattctagggaatc

SEQ ID NO: 655038 - DNA, 20 bp, mouse
gagcatcatcaaccagctgg

SEQ ID NO: 655039 - DNA, 20 bp, mouse
gacctcagcgctggaaccta

SEQ ID NO: 655040 - DNA, 20 bp, mouse
gaaaggaaaggaaggatgtt

SEQ ID NO: 655041 - DNA, 20 bp, mouse
gtgtcgcagcagcatccaaa

SEQ ID NO: 655042 - DNA, 20 bp, mouse
gacacggagctcgagagccc

SEQ ID NO: 655043 - DNA, 20 bp, mouse
ggctctccagacctcagcgc

SEQ ID NO: 655044 - DNA, 20 bp, mouse
ggttaataaccaagagccct

SEQ ID NO: 655045 - DNA, 20 bp, mouse
ggccttaggttccagcgctg

SEQ ID NO: 655046 - DNA, 20 bp, mouse
gcggaccctgagcttttcgg

SEQ ID NO: 655047 - DNA, 20 bp, mouse
ggctccgcccggcttcgtac

SEQ ID NO: 655048 - DNA, 20 bp, mouse
gttaggggaaacctaagaaa

SEQ ID NO: 655049 - DNA, 20 bp, mouse
gaaaagctcagggtccgcca

SEQ ID NO: 655050 - DNA, 20 bp, mouse
gggacctgtacgaagccggg

SEQ ID NO: 655051 - DNA, 20 bp, mouse
ggggaaacctaagaaagggg

SEQ ID NO: 655052 - DNA, 20 bp, mouse
gcaggggagcgggcgaaggg

SEQ ID NO: 655053 - DNA, 20 bp, mouse
ggaaaggggagggagctact

SEQ ID NO: 655054 - DNA, 20 bp, mouse
gcggagcctccgaaaagctc

SEQ ID NO: 655055 - DNA, 20 bp, mouse
ggggcggtccagggctgatc

SEQ ID NO: 655056 - DNA, 20 bp, mouse
gccgtggcttagtactttgt

SEQ ID NO: 655057 - DNA, 20 bp, mouse
gttctggtccgcccgggatg

SEQ ID NO: 655058 - DNA, 20 bp, mouse
gaggccccacccccggtaaa

SEQ ID NO: 655059 - DNA, 20 bp, mouse
ggccttcgggaaccagcaga

SEQ ID NO: 655060 - DNA, 20 bp, mouse
gcagcggctgcgggtcgcgg

SEQ ID NO: 655061 - DNA, 20 bp, mouse
gcacacagcggcgggacgta

SEQ ID NO: 655062 - DNA, 20 bp, mouse
gtaccggcccggactggagg

SEQ ID NO: 655063 - DNA, 20 bp, mouse
gagctcccgagtggcaggaa

SEQ ID NO: 655064 - DNA, 20 bp, mouse
gtccctctgctggttcccga

SEQ ID NO: 655065 - DNA, 20 bp, mouse
gggatggggccgagacgagt

SEQ ID NO: 655066 - DNA, 20 bp, mouse
ggggtacggaagaaagtggg

SEQ ID NO: 655067 - DNA, 20 bp, mouse
ggcggggtacggaagaaagt

SEQ ID NO: 655068 - DNA, 20 bp, mouse
ggggcggaaaacaggagccc

SEQ ID NO: 655069 - DNA, 20 bp, mouse
gttcctggcctacccctctc

SEQ ID NO: 655070 - DNA, 20 bp, mouse
gaagaaagtgggcggaaaac

SEQ ID NO: 655071 - DNA, 20 bp, mouse
gacccctctccggaagaaaa

SEQ ID NO: 655072 - DNA, 20 bp, mouse
gcaggagcccggggcactcc

SEQ ID NO: 655073 - DNA, 20 bp, mouse
gcggggcactccgggaaatg

SEQ ID NO: 655074 - DNA, 20 bp, mouse
gtccaagcacggtaaagaag

SEQ ID NO: 655075 - DNA, 20 bp, mouse
gggaactagcggaggcctga

SEQ ID NO: 655076 - DNA, 20 bp, mouse
gcggagacaccggaagtgca

SEQ ID NO: 655077 - DNA, 20 bp, mouse
gcgtgcgcaagggctcgatg

SEQ ID NO: 655078 - DNA, 20 bp, mouse
gagcccttgcgcacgacgga

SEQ ID NO: 655079 - DNA, 20 bp, mouse
gcgccctccgtcgtgcgcaa

SEQ ID NO: 655080 - DNA, 20 bp, mouse
gagggcggcccatggtctgt

SEQ ID NO: 655081 - DNA, 20 bp, mouse
gcccagcctcggcgtcggac

SEQ ID NO: 655082 - DNA, 20 bp, mouse
gaatctgctcctttcgggaa

SEQ ID NO: 655083 - DNA, 20 bp, mouse
gggtctgtgggtcggatgtc

SEQ ID NO: 655084 - DNA, 20 bp, mouse
ggggctcgatgcggagacac

SEQ ID NO: 655085 - DNA, 20 bp, mouse
gcatccgacccacagaccat

SEQ ID NO: 655086 - DNA, 20 bp, mouse
gcacacggggcatgcacgtg

SEQ ID NO: 655087 - DNA, 20 bp, mouse
gcacacaaaggtctcgggag

SEQ ID NO: 655088 - DNA, 20 bp, mouse
gttggaaggcgtgtgcatgt

SEQ ID NO: 655089 - DNA, 20 bp, mouse
ggggcggcggctccggtcga

SEQ ID NO: 655090 - DNA, 20 bp, mouse
gaataactccgggaacagtc

SEQ ID NO: 655091 - DNA, 20 bp, mouse
ggggcggggcgggacgtacc

SEQ ID NO: 655092 - DNA, 20 bp, mouse
gagagctgaactcacaaacg

SEQ ID NO: 655093 - DNA, 20 bp, mouse
gtccgagtcggacacacacg

SEQ ID NO: 655094 - DNA, 20 bp, mouse
ggcccgggacacttcttcac

SEQ ID NO: 655095 - DNA, 20 bp, mouse
gagtggtaattgccacacaa

SEQ ID NO: 655096 - DNA, 20 bp, mouse
gatggggtcacatctcacga

SEQ ID NO: 655097 - DNA, 20 bp, mouse
gtggccttgcgcaagcgcct

SEQ ID NO: 655098 - DNA, 20 bp, mouse
ggtgtgaaaggccagctcgt

SEQ ID NO: 655099 - DNA, 20 bp, mouse
gcgcaagcgcctgggacctc

SEQ ID NO: 655100 - DNA, 20 bp, mouse
gtttcacaccggaacctgat

SEQ ID NO: 655101 - DNA, 20 bp, mouse
ggttggaagtaccacggaag

SEQ ID NO: 655102 - DNA, 20 bp, mouse
gcgcctgggacctctggcgc

SEQ ID NO: 655103 - DNA, 20 bp, mouse
gaaggccagctcgtgggcgg

SEQ ID NO: 655104 - DNA, 20 bp, mouse
gtggaacgagctaaatacga

SEQ ID NO: 655105 - DNA, 20 bp, mouse
gatgtgaccccatcaggttc

SEQ ID NO: 655106 - DNA, 20 bp, mouse
ggggccgataacattcagaa

SEQ ID NO: 655107 - DNA, 20 bp, mouse
gggtactaaggtgtaggttg

SEQ ID NO: 655108 - DNA, 20 bp, mouse
gccagcgggtactaaggtgt

SEQ ID NO: 655109 - DNA, 20 bp, mouse
gcggggagagaacgcttccg

SEQ ID NO: 655110 - DNA, 20 bp, mouse
gaaggcatggcgacgcagtg

SEQ ID NO: 655111 - DNA, 20 bp, mouse
gtacagctccagagtagcaa

SEQ ID NO: 655112 - DNA, 20 bp, mouse
ggaacagggtgctccccaaa

SEQ ID NO: 655113 - DNA, 20 bp, mouse
ggtaaaaggctcctctgtca

SEQ ID NO: 655114 - DNA, 20 bp, mouse
gtgcgcgatccctgccgagc

SEQ ID NO: 655115 - DNA, 20 bp, mouse
gatcggcccagcgggtacta

SEQ ID NO: 655116 - DNA, 20 bp, mouse
gctggcgcctcggttcgcgt

SEQ ID NO: 655117 - DNA, 20 bp, mouse
gtggaggcggaagggccctt

SEQ ID NO: 655118 - DNA, 20 bp, mouse
gctccggttcccgcgctctt

SEQ ID NO: 655119 - DNA, 20 bp, mouse
gcctcggttcgcgtcggctc

SEQ ID NO: 655120 - DNA, 20 bp, mouse
ggttcccgcgctcttcggat

SEQ ID NO: 655121 - DNA, 20 bp, mouse
gacgtcgcaaattcctgtga

SEQ ID NO: 655122 - DNA, 20 bp, mouse
gggagagccggaactacagc

SEQ ID NO: 655123 - DNA, 20 bp, mouse
gcccgcgctcttcggattgg

SEQ ID NO: 655124 - DNA, 20 bp, mouse
gtccggctctccgccctcag

SEQ ID NO: 655125 - DNA, 20 bp, mouse
gcgtctccttccactgaggg

SEQ ID NO: 655126 - DNA, 20 bp, mouse
ggacgtgacgtcagcatcgg

SEQ ID NO: 655127 - DNA, 20 bp, mouse
gctgacgtcacgtcgaggcg

SEQ ID NO: 655128 - DNA, 20 bp, mouse
ggcctgcggggaggcgctct

SEQ ID NO: 655129 - DNA, 20 bp, mouse
gcgaccaagcgcggagtaga

SEQ ID NO: 655130 - DNA, 20 bp, mouse
ggtcttggccaggcgttgaa

SEQ ID NO: 655131 - DNA, 20 bp, mouse
gaccgcaggggtctggaatc

SEQ ID NO: 655132 - DNA, 20 bp, mouse
ggggatgaatgcagagttca

SEQ ID NO: 655133 - DNA, 20 bp, mouse
gtgctgccctgtctagactg

SEQ ID NO: 655134 - DNA, 20 bp, mouse
gtccttgcagcgccccgcag

SEQ ID NO: 655135 - DNA, 20 bp, mouse
gcccatcccccagtctagac

SEQ ID NO: 655136 - DNA, 20 bp, mouse
ggggacgccagtggcgtcgg

SEQ ID NO: 655137 - DNA, 20 bp, mouse
gactggcgtccctatgtcag

SEQ ID NO: 655138 - DNA, 20 bp, mouse
gggagcaaagttttcgaggt

SEQ ID NO: 655139 - DNA, 20 bp, mouse
gatgtcagcggccaatccgg

SEQ ID NO: 655140 - DNA, 20 bp, mouse
gtccgcctccttagaaagct

SEQ ID NO: 655141 - DNA, 20 bp, mouse
gatagggacgccagtggcgt

SEQ ID NO: 655142 - DNA, 20 bp, mouse
gggacgacggaaacctagga

SEQ ID NO: 655143 - DNA, 20 bp, mouse
gagaacgtcttgaccctcct

SEQ ID NO: 655144 - DNA, 20 bp, mouse
gcggaactggacagagctcc

SEQ ID NO: 655145 - DNA, 20 bp, mouse
gcaactaagggcgaagtaat

SEQ ID NO: 655146 - DNA, 20 bp, mouse
gagcctacgaccgctgtcgg

SEQ ID NO: 655147 - DNA, 20 bp, mouse
gaagtggtggtgcacttgga

SEQ ID NO: 655148 - DNA, 20 bp, mouse
gcgcagacggtgagccgcga

SEQ ID NO: 655149 - DNA, 20 bp, mouse
gctgtcggaggctgcgcaga

SEQ ID NO: 655150 - DNA, 20 bp, mouse
gccgccccctgcgctccgga

SEQ ID NO: 655151 - DNA, 20 bp, mouse
gagcctccgacagcggtcgt

SEQ ID NO: 655152 - DNA, 20 bp, mouse
gccgccgtccggagcgcagg

SEQ ID NO: 655153 - DNA, 20 bp, mouse
gcggagcctacgaccgctgt

SEQ ID NO: 655154 - DNA, 20 bp, mouse
gaataagtcaaactttaaca

SEQ ID NO: 655155 - DNA, 20 bp, mouse
gaggctggcctccaagtgcc

SEQ ID NO: 655156 - DNA, 20 bp, mouse
gactccaaggggtgtgagac

SEQ ID NO: 655157 - DNA, 20 bp, mouse
gccctcccagtgaacagctg

SEQ ID NO: 655158 - DNA, 20 bp, mouse
gtggtctacccgcaactcca

SEQ ID NO: 655159 - DNA, 20 bp, mouse
gtctctaggacccgccccga

SEQ ID NO: 655160 - DNA, 20 bp, mouse
gggtgtgaagtctatgaggt

SEQ ID NO: 655161 - DNA, 20 bp, mouse
gtggttgccctggcatctca

SEQ ID NO: 655162 - DNA, 20 bp, mouse
gaggggcacagacctacaaa

SEQ ID NO: 655163 - DNA, 20 bp, mouse
gcccaaagggagtcaagaac

SEQ ID NO: 655164 - DNA, 20 bp, mouse
gccctcagctgttcactggg

SEQ ID NO: 655165 - DNA, 20 bp, mouse
gcactgtgaaaccatggtgg

SEQ ID NO: 655166 - DNA, 20 bp, mouse
ggatgctagaactgtctatc

SEQ ID NO: 655167 - DNA, 20 bp, mouse
gccctcaaagatggtttcaa

SEQ ID NO: 655168 - DNA, 20 bp, mouse
gtgcatcctcctctccccat

SEQ ID NO: 655169 - DNA, 20 bp, mouse
gcccccatcctgtaagagtt

SEQ ID NO: 655170 - DNA, 20 bp, mouse
gtcctgtaagagttaggcca

SEQ ID NO: 655171 - DNA, 20 bp, mouse
gtttgagggcaaagaaatgg

SEQ ID NO: 655172 - DNA, 20 bp, mouse
gtgttgggatgcagcgaacc

SEQ ID NO: 655173 - DNA, 20 bp, mouse
ggctttcgcctcagccaatg

SEQ ID NO: 655174 - DNA, 20 bp, mouse
gcagcttcctccactatctg

SEQ ID NO: 655175 - DNA, 20 bp, mouse
gccaggacaaggcagaatgt

SEQ ID NO: 655176 - DNA, 20 bp, mouse
gcagcccgggagcactcgag

SEQ ID NO: 655177 - DNA, 20 bp, mouse
ggggcggcgtcagtgacgta

SEQ ID NO: 655178 - DNA, 20 bp, mouse
gcggctgcccgcagtcaaca

SEQ ID NO: 655179 - DNA, 20 bp, mouse
gtaccccctagggagggcga

SEQ ID NO: 655180 - DNA, 20 bp, mouse
gtagccgcccctcacagagg

SEQ ID NO: 655181 - DNA, 20 bp, mouse
gcgcggggaacctcggggaa

SEQ ID NO: 655182 - DNA, 20 bp, mouse
gaagccactcgagtgctccc

SEQ ID NO: 655183 - DNA, 20 bp, mouse
ggaggaacggaactagcgga

SEQ ID NO: 655184 - DNA, 20 bp, mouse
gcagtggcctgaccggggat

SEQ ID NO: 655185 - DNA, 20 bp, mouse
gtggcctgaccggggatcgg

SEQ ID NO: 655186 - DNA, 20 bp, mouse
ggggcgggacagctgaccct

SEQ ID NO: 655187 - DNA, 20 bp, mouse
gccctagcagaaccttgcca

SEQ ID NO: 655188 - DNA, 20 bp, mouse
gctgtcccgcccgcgagaga

SEQ ID NO: 655189 - DNA, 20 bp, mouse
gaaacagagcaggtagccga

SEQ ID NO: 655190 - DNA, 20 bp, mouse
gggggagctccggggatctt

SEQ ID NO: 655191 - DNA, 20 bp, mouse
ggccgccacggggacgctgg

SEQ ID NO: 655192 - DNA, 20 bp, mouse
ggatcttggggcaatggcgc

SEQ ID NO: 655193 - DNA, 20 bp, mouse
gcccgcgagagagggaggtc

SEQ ID NO: 655194 - DNA, 20 bp, mouse
gtcccgcccgcgagagaggg

SEQ ID NO: 655195 - DNA, 20 bp, mouse
gtcccccagcgtccccgtgg

SEQ ID NO: 655196 - DNA, 20 bp, mouse
gaaagggcgggtcttcagga

SEQ ID NO: 655197 - DNA, 20 bp, mouse
ggcgggaagcaggtccaaag

SEQ ID NO: 655198 - DNA, 20 bp, mouse
ggggcgaaaagcacgaaagg

SEQ ID NO: 655199 - DNA, 20 bp, mouse
gaaggggcgtgtgcgtgaag

SEQ ID NO: 655200 - DNA, 20 bp, mouse
gaagacccgccctttttccg

SEQ ID NO: 655201 - DNA, 20 bp, mouse
gccgtcgtgcctcggaaaaa

SEQ ID NO: 655202 - DNA, 20 bp, mouse
ggaggggcgcaagaagaaag

SEQ ID NO: 655203 - DNA, 20 bp, mouse
gcccgcgggcgctccctcgg

SEQ ID NO: 655204 - DNA, 20 bp, mouse
gagaagctgcaccggatctg

SEQ ID NO: 655205 - DNA, 20 bp, mouse
gggcgtgtgcgtgaagggga

SEQ ID NO: 655206 - DNA, 20 bp, mouse
ggggctccctgccaacgcga

SEQ ID NO: 655207 - DNA, 20 bp, mouse
gggtgatgcaagtgcgagaa

SEQ ID NO: 655208 - DNA, 20 bp, mouse
gaaaaggtgggtggagaccg

SEQ ID NO: 655209 - DNA, 20 bp, mouse
gagcctgataaggagataga

SEQ ID NO: 655210 - DNA, 20 bp, mouse
gcgccctctatctccttatc

SEQ ID NO: 655211 - DNA, 20 bp, mouse
gccaacgcgagggctttaaa

SEQ ID NO: 655212 - DNA, 20 bp, mouse
gacgggggcggggcaaaagg

SEQ ID NO: 655213 - DNA, 20 bp, mouse
gatgcaagtgcgagaagggg

SEQ ID NO: 655214 - DNA, 20 bp, mouse
gagggagaactggccagagg

SEQ ID NO: 655215 - DNA, 20 bp, mouse
gcctccgctaggttggggaa

SEQ ID NO: 655216 - DNA, 20 bp, mouse
gcgagggcgtcagtgagagg

SEQ ID NO: 655217 - DNA, 20 bp, mouse
gccttctccgctgtgctcgg

SEQ ID NO: 655218 - DNA, 20 bp, mouse
ggcacagcggagaagggttg

SEQ ID NO: 655219 - DNA, 20 bp, mouse
ggggcgagggcgtcagtgag

SEQ ID NO: 655220 - DNA, 20 bp, mouse
ggcgctccggaaccagaccg

SEQ ID NO: 655221 - DNA, 20 bp, mouse
gagctcgacgcgcgctccga

SEQ ID NO: 655222 - DNA, 20 bp, mouse
ggaagggttggggcgggcga

SEQ ID NO: 655223 - DNA, 20 bp, mouse
gtgtgctcggggggtaactg

SEQ ID NO: 655224 - DNA, 20 bp, mouse
gaccagccgcggtctggttc

SEQ ID NO: 655225 - DNA, 20 bp, mouse
ggaaaagtgcactactttat

SEQ ID NO: 655226 - DNA, 20 bp, mouse
gccctcgcgcggccccgacg

SEQ ID NO: 655227 - DNA, 20 bp, mouse
gcgcatgcgcaacaggttgt

SEQ ID NO: 655228 - DNA, 20 bp, mouse
gtcgggtgtgaaagacacat

SEQ ID NO: 655229 - DNA, 20 bp, mouse
gcgggctcggtctcctgaat

SEQ ID NO: 655230 - DNA, 20 bp, mouse
gggcctggggacaaatatac

SEQ ID NO: 655231 - DNA, 20 bp, mouse
gggtcgccaccgccccgtcg

SEQ ID NO: 655232 - DNA, 20 bp, mouse
gaacgagacgagctggtttc

SEQ ID NO: 655233 - DNA, 20 bp, mouse
gccacccccggcctgaacta

SEQ ID NO: 655234 - DNA, 20 bp, mouse
gtcgcgcggccccgacgggg

SEQ ID NO: 655235 - DNA, 20 bp, mouse
gggcgtggcgggagcgttaa

SEQ ID NO: 655236 - DNA, 20 bp, mouse
gaaagtgctgaaatcctcgt

SEQ ID NO: 655237 - DNA, 20 bp, mouse
ggaactgggatccaaagcta

SEQ ID NO: 655238 - DNA, 20 bp, mouse
gtgaacgctgacacggacgg

SEQ ID NO: 655239 - DNA, 20 bp, mouse
gggtgagtaacctgaaacgg

SEQ ID NO: 655240 - DNA, 20 bp, mouse
ggacacggacggtggccggg

SEQ ID NO: 655241 - DNA, 20 bp, mouse
ggtcccgctgtggggttttg

SEQ ID NO: 655242 - DNA, 20 bp, mouse
gagctgaacgctgacacgga

SEQ ID NO: 655243 - DNA, 20 bp, mouse
ggagtaacctgaaacggcgg

SEQ ID NO: 655244 - DNA, 20 bp, mouse
gaaccacaaaaccccacagc

SEQ ID NO: 655245 - DNA, 20 bp, mouse
gcaaactatctcaccgcacg

SEQ ID NO: 655246 - DNA, 20 bp, mouse
gcatgccgggccaatggcac

SEQ ID NO: 655247 - DNA, 20 bp, mouse
gctcgcctggatcggtaaag

SEQ ID NO: 655248 - DNA, 20 bp, mouse
gactgtgcatgccgggccaa

SEQ ID NO: 655249 - DNA, 20 bp, mouse
gctagtttctggggcctgta

SEQ ID NO: 655250 - DNA, 20 bp, mouse
gctgacccgtgccattggcc

SEQ ID NO: 655251 - DNA, 20 bp, mouse
gaacactctagcccagatgc

SEQ ID NO: 655252 - DNA, 20 bp, mouse
gtggtgaacacgtgacacga

SEQ ID NO: 655253 - DNA, 20 bp, mouse
ggcgcacgcacagtctcgcc

SEQ ID NO: 655254 - DNA, 20 bp, mouse
gcgcacagtctcgcctggat

SEQ ID NO: 655255 - DNA, 20 bp, mouse
ggaccagtcagaggcttagt

SEQ ID NO: 655256 - DNA, 20 bp, mouse
ggggaagaaatggacaacta

SEQ ID NO: 655257 - DNA, 20 bp, mouse
gctaaaactcttgcctgcat

SEQ ID NO: 655258 - DNA, 20 bp, mouse
ggctactagttctgcattct

SEQ ID NO: 655259 - DNA, 20 bp, mouse
gtggactcatatttccttgc

SEQ ID NO: 655260 - DNA, 20 bp, mouse
gctgggagcatcttagctct

SEQ ID NO: 655261 - DNA, 20 bp, mouse
ggcagaactagtagcctgca

SEQ ID NO: 655262 - DNA, 20 bp, mouse
ggtggctgttttaatggaag

SEQ ID NO: 655263 - DNA, 20 bp, mouse
gctcatctcaaattctaggt

SEQ ID NO: 655264 - DNA, 20 bp, mouse
gactcttgcctgcattggtc

SEQ ID NO: 655265 - DNA, 20 bp, mouse
gtttgagatgagtaatgtgg

SEQ ID NO: 655266 - DNA, 20 bp, mouse
gttgcccaggtcactgcaaa

SEQ ID NO: 655267 - DNA, 20 bp, mouse
gcatgcagctaggacctcac

SEQ ID NO: 655268 - DNA, 20 bp, mouse
gacctcacgggcatgggaaa

SEQ ID NO: 655269 - DNA, 20 bp, mouse
gcaggtcactgcaaagggtt

SEQ ID NO: 655270 - DNA, 20 bp, mouse
ggcatgggaaacggttgccc

SEQ ID NO: 655271 - DNA, 20 bp, mouse
gctccccaagctcaacttgt

SEQ ID NO: 655272 - DNA, 20 bp, mouse
gttcccacaagttgagcttg

SEQ ID NO: 655273 - DNA, 20 bp, mouse
ggctaggacctcacgggcat

SEQ ID NO: 655274 - DNA, 20 bp, mouse
gaggacgtaaaataccgtaa

SEQ ID NO: 655275 - DNA, 20 bp, mouse
gagaaacactcctggtacag

SEQ ID NO: 655276 - DNA, 20 bp, mouse
gtgccacgcctccctcgcgc

SEQ ID NO: 655277 - DNA, 20 bp, mouse
gagggccaggcgactgaggc

SEQ ID NO: 655278 - DNA, 20 bp, mouse
gcgcccactgccactgtgat

SEQ ID NO: 655279 - DNA, 20 bp, mouse
gaaggccggcctcagtcgcc

SEQ ID NO: 655280 - DNA, 20 bp, mouse
gtggcctgaaactcagggcc

SEQ ID NO: 655281 - DNA, 20 bp, mouse
ggctccacagaagtcagtga

SEQ ID NO: 655282 - DNA, 20 bp, mouse
gcggggagcggcgcggctca

SEQ ID NO: 655283 - DNA, 20 bp, mouse
gctgaccttcgctctgtcat

SEQ ID NO: 655284 - DNA, 20 bp, mouse
gccagccaatgacagagcga

SEQ ID NO: 655285 - DNA, 20 bp, mouse
gagccagcgcgagggaggcg

SEQ ID NO: 655286 - DNA, 20 bp, mouse
gaatgactgcgtgtggggaa

SEQ ID NO: 655287 - DNA, 20 bp, mouse
gcgagagcaccaagcgggtt

SEQ ID NO: 655288 - DNA, 20 bp, mouse
gagagtgcgagccaggatga

SEQ ID NO: 655289 - DNA, 20 bp, mouse
gttaggctccgggaaagtga

SEQ ID NO: 655290 - DNA, 20 bp, mouse
gcaggggcaaccccgagcca

SEQ ID NO: 655291 - DNA, 20 bp, mouse
ggaagggagtgcagataccc

SEQ ID NO: 655292 - DNA, 20 bp, mouse
gggggctgcacggtgacgtc

SEQ ID NO: 655293 - DNA, 20 bp, mouse
gcaccaagcgggttaggctc

SEQ ID NO: 655294 - DNA, 20 bp, mouse
gcgagaccttcctgcaaccc

SEQ ID NO: 655295 - DNA, 20 bp, mouse
gtagacgcctggctataaac

SEQ ID NO: 655296 - DNA, 20 bp, mouse
gggccagccaactctccgga

SEQ ID NO: 655297 - DNA, 20 bp, mouse
ggcaggggcatactcacata

SEQ ID NO: 655298 - DNA, 20 bp, mouse
gaactctccggaggggtacg

SEQ ID NO: 655299 - DNA, 20 bp, mouse
gcggcgcgagggtcgttcgg

SEQ ID NO: 655300 - DNA, 20 bp, mouse
gagcgccgggcagcgcccag

SEQ ID NO: 655301 - DNA, 20 bp, mouse
gaggaaacggaagcgtcccg

SEQ ID NO: 655302 - DNA, 20 bp, mouse
ggaagcgtcatgaaggaggt

SEQ ID NO: 655303 - DNA, 20 bp, mouse
gctagatagcgctccatact

SEQ ID NO: 655304 - DNA, 20 bp, mouse
ggcgctcccgcgccgagggg

SEQ ID NO: 655305 - DNA, 20 bp, mouse
gtgctcacggaggcgcgtca

SEQ ID NO: 655306 - DNA, 20 bp, mouse
ggggcttcgtgtagaatgta

SEQ ID NO: 655307 - DNA, 20 bp, mouse
gtgacgcggaaggggaggtg

SEQ ID NO: 655308 - DNA, 20 bp, mouse
gcggctgttgcgcaccgtgg

SEQ ID NO: 655309 - DNA, 20 bp, mouse
gtcagagtcttcaagaaagg

SEQ ID NO: 655310 - DNA, 20 bp, mouse
gggcgctgacgcggaagggg

SEQ ID NO: 655311 - DNA, 20 bp, mouse
ggggccttcttcggccccga

SEQ ID NO: 655312 - DNA, 20 bp, mouse
gggccgaggtgctgatgacg

SEQ ID NO: 655313 - DNA, 20 bp, mouse
ggggaggtagagcgctacgg

SEQ ID NO: 655314 - DNA, 20 bp, mouse
gggcgggcgctgacgcggaa

SEQ ID NO: 655315 - DNA, 20 bp, mouse
gtccggaggcgggccttctt

SEQ ID NO: 655316 - DNA, 20 bp, mouse
ggcgcagccgccaaggagtg

SEQ ID NO: 655317 - DNA, 20 bp, mouse
gtgaaggccggggcgggaaa

SEQ ID NO: 655318 - DNA, 20 bp, mouse
ggctcagaggcggagaatct

SEQ ID NO: 655319 - DNA, 20 bp, mouse
gttgaactgcgcagccgcca

SEQ ID NO: 655320 - DNA, 20 bp, mouse
gtcgtttggcgccactccaa

SEQ ID NO: 655321 - DNA, 20 bp, mouse
ggccggggcgggaaaggggg

SEQ ID NO: 655322 - DNA, 20 bp, mouse
gaaggtgcgggaacagaaca

SEQ ID NO: 655323 - DNA, 20 bp, mouse
gaaactgcaaggagcaaggt

SEQ ID NO: 655324 - DNA, 20 bp, mouse
gggctgcgcagttcaaccct

SEQ ID NO: 655325 - DNA, 20 bp, mouse
gtacttcccacactccttgg

SEQ ID NO: 655326 - DNA, 20 bp, mouse
gctcccggccgagacttcgc

SEQ ID NO: 655327 - DNA, 20 bp, mouse
gcggaagcgtcggtgatgag

SEQ ID NO: 655328 - DNA, 20 bp, mouse
ggcgcgcggcctaggacgtc

SEQ ID NO: 655329 - DNA, 20 bp, mouse
ggggaggcaccctggcttcg

SEQ ID NO: 655330 - DNA, 20 bp, mouse
gcgtcccgcgaagtctcggc

SEQ ID NO: 655331 - DNA, 20 bp, mouse
gatgagaggcagccgctggg

SEQ ID NO: 655332 - DNA, 20 bp, mouse
ggcctccgggtgccctgtgt

SEQ ID NO: 655333 - DNA, 20 bp, mouse
gcagccgctgggaggcaccc

SEQ ID NO: 655334 - DNA, 20 bp, mouse
gcctcgtagcccgacgtcct

SEQ ID NO: 655335 - DNA, 20 bp, mouse
gtaggccgcgcgcaagctcc

SEQ ID NO: 655336 - DNA, 20 bp, mouse
ggacgcgcccacaggcgaca

SEQ ID NO: 655337 - DNA, 20 bp, mouse
gaggggagaccctaccacca

SEQ ID NO: 655338 - DNA, 20 bp, mouse
gtcgcctgtgggcgcgtcca

SEQ ID NO: 655339 - DNA, 20 bp, mouse
ggcagcagcggggaatcccc

SEQ ID NO: 655340 - DNA, 20 bp, mouse
gggacagaaacgcacacctc

SEQ ID NO: 655341 - DNA, 20 bp, mouse
gcaaaaaccctcagtcccag

SEQ ID NO: 655342 - DNA, 20 bp, mouse
ggcgcccacaggcgacaggg

SEQ ID NO: 655343 - DNA, 20 bp, mouse
gcgtccagggcggggcctca

SEQ ID NO: 655344 - DNA, 20 bp, mouse
ggggactgagggtttttgct

SEQ ID NO: 655345 - DNA, 20 bp, mouse
gaagcctccctgtcgcctgt

SEQ ID NO: 655346 - DNA, 20 bp, mouse
ggaagagcgaaaaagggact

SEQ ID NO: 655347 - DNA, 20 bp, mouse
ggagccttgaagagcgaaaa

SEQ ID NO: 655348 - DNA, 20 bp, mouse
gaagggcgaggcccactgat

SEQ ID NO: 655349 - DNA, 20 bp, mouse
gcctcccgcggccaatcagt

SEQ ID NO: 655350 - DNA, 20 bp, mouse
ggcaagcgtaaactacgatt

SEQ ID NO: 655351 - DNA, 20 bp, mouse
gggcacatgcgcactcttcc

SEQ ID NO: 655352 - DNA, 20 bp, mouse
gcggaaaggctgcaaccgta

SEQ ID NO: 655353 - DNA, 20 bp, mouse
gaggcccactgattggccgc

SEQ ID NO: 655354 - DNA, 20 bp, mouse
gcgcccttcgcaatgaccaa

SEQ ID NO: 655355 - DNA, 20 bp, mouse
gaccaatggcagcgagcgtg

SEQ ID NO: 655356 - DNA, 20 bp, mouse
gccggcggacgcccggacta

SEQ ID NO: 655357 - DNA, 20 bp, mouse
gcgaggaaggataagaacat

SEQ ID NO: 655358 - DNA, 20 bp, mouse
gactgctggggccaggatcg

SEQ ID NO: 655359 - DNA, 20 bp, mouse
gtgggcgctcgcaggtgagt

SEQ ID NO: 655360 - DNA, 20 bp, mouse
gcggccgcgactgcaaggtg

SEQ ID NO: 655361 - DNA, 20 bp, mouse
gggggccaggatcgcggcgc

SEQ ID NO: 655362 - DNA, 20 bp, mouse
gggtgccggcgccgcgatcc

SEQ ID NO: 655363 - DNA, 20 bp, mouse
gcctcgtccggagactgctg

SEQ ID NO: 655364 - DNA, 20 bp, mouse
gatgggcggggcaactgcgg

SEQ ID NO: 655365 - DNA, 20 bp, mouse
gcgctcgcaggtgagtgggc

SEQ ID NO: 655366 - DNA, 20 bp, mouse
gcaggctgctcttccctagc

SEQ ID NO: 655367 - DNA, 20 bp, mouse
gtagggaagagcagcctgag

SEQ ID NO: 655368 - DNA, 20 bp, mouse
ggacaaaaggaggcccgcgg

SEQ ID NO: 655369 - DNA, 20 bp, mouse
gcacgtgaggccttaggtgg

SEQ ID NO: 655370 - DNA, 20 bp, mouse
gaatgagcgcgcctgcgcaa

SEQ ID NO: 655371 - DNA, 20 bp, mouse
gtggtggggaaactatgagc

SEQ ID NO: 655372 - DNA, 20 bp, mouse
ggcctgcgcaatggccgctc

SEQ ID NO: 655373 - DNA, 20 bp, mouse
gccttctcacgctgccttcc

SEQ ID NO: 655374 - DNA, 20 bp, mouse
ggcccgccccccggaagcgc

SEQ ID NO: 655375 - DNA, 20 bp, mouse
ggtggctcgagcgtgttaag

SEQ ID NO: 655376 - DNA, 20 bp, mouse
gcggaacaggaaatgcgagt

SEQ ID NO: 655377 - DNA, 20 bp, mouse
gaggtcttgggaaggcgaaa

SEQ ID NO: 655378 - DNA, 20 bp, mouse
gcccagaagctccaggctat

SEQ ID NO: 655379 - DNA, 20 bp, mouse
ggggaagctggatgagttga

SEQ ID NO: 655380 - DNA, 20 bp, mouse
gcggggcttgagtttcacgg

SEQ ID NO: 655381 - DNA, 20 bp, mouse
ggaagctccaggctatgggc

SEQ ID NO: 655382 - DNA, 20 bp, mouse
gaggacccggaagccatgta

SEQ ID NO: 655383 - DNA, 20 bp, mouse
gttgggaaggcgaaatggag

SEQ ID NO: 655384 - DNA, 20 bp, mouse
ggggcggggcttgagtttca

SEQ ID NO: 655385 - DNA, 20 bp, mouse
gttaacccaaggctactaga

SEQ ID NO: 655386 - DNA, 20 bp, mouse
gccgccgcttcggaacaccc

SEQ ID NO: 655387 - DNA, 20 bp, mouse
gggcccgagctgcgctcctc

SEQ ID NO: 655388 - DNA, 20 bp, mouse
gtgtctgtacggaaagatgg

SEQ ID NO: 655389 - DNA, 20 bp, mouse
gggcgcgtgtggttcctaac

SEQ ID NO: 655390 - DNA, 20 bp, mouse
ggctcccgggtgttccgaag

SEQ ID NO: 655391 - DNA, 20 bp, mouse
gcccgctgcggccgcgacgc

SEQ ID NO: 655392 - DNA, 20 bp, mouse
ggcgacacagctcgggacgt

SEQ ID NO: 655393 - DNA, 20 bp, mouse
gtacggcggtgggcacgcgg

SEQ ID NO: 655394 - DNA, 20 bp, mouse
gtcgccatctcgccgtacgg

SEQ ID NO: 655395 - DNA, 20 bp, mouse
ggggccgcggccgagccgta

SEQ ID NO: 655396 - DNA, 20 bp, mouse
gcacgcacggtgagcgtctg

SEQ ID NO: 655397 - DNA, 20 bp, mouse
gtcggagaccctaagctccc

SEQ ID NO: 655398 - DNA, 20 bp, mouse
ggagcttagggtctccgaca

SEQ ID NO: 655399 - DNA, 20 bp, mouse
gccagtagttacagttacga

SEQ ID NO: 655400 - DNA, 20 bp, mouse
ggacgctcaccgtgcgtggc

SEQ ID NO: 655401 - DNA, 20 bp, mouse
gccaaggcaagctgtggtat

SEQ ID NO: 655402 - DNA, 20 bp, mouse
gccgcgggccgcacgtcctg

SEQ ID NO: 655403 - DNA, 20 bp, mouse
gtcggtgtgctgtgctacgg

SEQ ID NO: 655404 - DNA, 20 bp, mouse
gtctactccaaggcaagctg

SEQ ID NO: 655405 - DNA, 20 bp, mouse
gggtgagcgtctgcggtttc

SEQ ID NO: 655406 - DNA, 20 bp, mouse
gtaaatgggcgtggcttctc

SEQ ID NO: 655407 - DNA, 20 bp, mouse
gggtgtgcaaggcttgagaa

SEQ ID NO: 655408 - DNA, 20 bp, mouse
gggcccttatctcagaccaa

SEQ ID NO: 655409 - DNA, 20 bp, mouse
gacccattggtctgagataa

SEQ ID NO: 655410 - DNA, 20 bp, mouse
gcctgcgcggtgagattagg

SEQ ID NO: 655411 - DNA, 20 bp, mouse
gcaggcgcaagcgcgtccct

SEQ ID NO: 655412 - DNA, 20 bp, mouse
gcagaccaatgggtcagagc

SEQ ID NO: 655413 - DNA, 20 bp, mouse
gttctccggctctgacccat

SEQ ID NO: 655414 - DNA, 20 bp, mouse
ggttctgggtgcgatacatg

SEQ ID NO: 655415 - DNA, 20 bp, mouse
ggcgcctgcgcggtgagatt

SEQ ID NO: 655416 - DNA, 20 bp, mouse
gagcgccgggcgcccaccgt

SEQ ID NO: 655417 - DNA, 20 bp, mouse
gccgagggtgactggaccta

SEQ ID NO: 655418 - DNA, 20 bp, mouse
gtccgggcgccgagggtgac

SEQ ID NO: 655419 - DNA, 20 bp, mouse
gagggtgactggacctacgg

SEQ ID NO: 655420 - DNA, 20 bp, mouse
gccggcgctgcggttcactc

SEQ ID NO: 655421 - DNA, 20 bp, mouse
gaggttgggccgcgctcgga

SEQ ID NO: 655422 - DNA, 20 bp, mouse
gagcgcttgccacgtggtct

SEQ ID NO: 655423 - DNA, 20 bp, mouse
gttgggccgcgctcggaggg

SEQ ID NO: 655424 - DNA, 20 bp, mouse
gtgagcgtgcgcagacacac

SEQ ID NO: 655425 - DNA, 20 bp, mouse
gccacggcagccgatgtctc

SEQ ID NO: 655426 - DNA, 20 bp, mouse
gctaacctgtaagccttttg

SEQ ID NO: 655427 - DNA, 20 bp, mouse
ggtactgtagagtcactcgc

SEQ ID NO: 655428 - DNA, 20 bp, mouse
gaagccttttggggcttgta

SEQ ID NO: 655429 - DNA, 20 bp, mouse
gccccacaaccgcaataacg

SEQ ID NO: 655430 - DNA, 20 bp, mouse
gcaataacggggcgaaacta

SEQ ID NO: 655431 - DNA, 20 bp, mouse
gcagggtagtactagagtac

SEQ ID NO: 655432 - DNA, 20 bp, mouse
ggctatgtagtgtaaatatg

SEQ ID NO: 655433 - DNA, 20 bp, mouse
gcgcgcttccgcgtttgtgt

SEQ ID NO: 655434 - DNA, 20 bp, mouse
gcggctggggctgtggttgc

SEQ ID NO: 655435 - DNA, 20 bp, mouse
gcgccccgttattgcggttg

SEQ ID NO: 655436 - DNA, 20 bp, mouse
ggtgtgctctacgtgatgag

SEQ ID NO: 655437 - DNA, 20 bp, mouse
ggagggagggtcgagtgacg

SEQ ID NO: 655438 - DNA, 20 bp, mouse
gcggctacggagaggcgaag

SEQ ID NO: 655439 - DNA, 20 bp, mouse
ggctctcgggacattagggg

SEQ ID NO: 655440 - DNA, 20 bp, mouse
gacagtgaatgacagacgga

SEQ ID NO: 655441 - DNA, 20 bp, mouse
gatcacgtagagcacactat

SEQ ID NO: 655442 - DNA, 20 bp, mouse
gtggctgaagaagaaacgga

SEQ ID NO: 655443 - DNA, 20 bp, mouse
gcaggacggaaggctgaagg

SEQ ID NO: 655444 - DNA, 20 bp, mouse
gcaattcggcggctacggag

SEQ ID NO: 655445 - DNA, 20 bp, mouse
gtcggctctcgggacattag

SEQ ID NO: 655446 - DNA, 20 bp, mouse
ggactgaaagcagagatcat

SEQ ID NO: 655447 - DNA, 20 bp, mouse
gcaggggctcaagagctatt

SEQ ID NO: 655448 - DNA, 20 bp, mouse
gctaaactggtgtccgtccc

SEQ ID NO: 655449 - DNA, 20 bp, mouse
gtgatcacacaggtggctga

SEQ ID NO: 655450 - DNA, 20 bp, mouse
gactccttgcaaggcaacct

SEQ ID NO: 655451 - DNA, 20 bp, mouse
gcgtcccaggcatggggctt

SEQ ID NO: 655452 - DNA, 20 bp, mouse
gcagtcctcaagggcacaag

SEQ ID NO: 655453 - DNA, 20 bp, mouse
ggtgtgagtgatcacacagg

SEQ ID NO: 655454 - DNA, 20 bp, mouse
gtggtgtccgtcccaggcat

SEQ ID NO: 655455 - DNA, 20 bp, mouse
ggacaccagtttaggaggca

SEQ ID NO: 655456 - DNA, 20 bp, mouse
gagaccacgcaataggacta

SEQ ID NO: 655457 - DNA, 20 bp, mouse
gtggctctaagatgtatgca

SEQ ID NO: 655458 - DNA, 20 bp, mouse
gggaaactgtcatggttttg

SEQ ID NO: 655459 - DNA, 20 bp, mouse
gctaggggttagttgagctt

SEQ ID NO: 655460 - DNA, 20 bp, mouse
gcactgtagagtggtatctc

SEQ ID NO: 655461 - DNA, 20 bp, mouse
gggaaagtctgaaaagcatt

SEQ ID NO: 655462 - DNA, 20 bp, mouse
gtgggtgggacatacatggg

SEQ ID NO: 655463 - DNA, 20 bp, mouse
gaacccctagtcctattgcg

SEQ ID NO: 655464 - DNA, 20 bp, mouse
ggaaaggtcccgtgagctaa

SEQ ID NO: 655465 - DNA, 20 bp, mouse
gactaaacgtcactgtagag

SEQ ID NO: 655466 - DNA, 20 bp, mouse
ggcggctggagcactgattg

SEQ ID NO: 655467 - DNA, 20 bp, mouse
ggggacctcggggtcacgtg

SEQ ID NO: 655468 - DNA, 20 bp, mouse
ggcggggcggctgctaactc

SEQ ID NO: 655469 - DNA, 20 bp, mouse
gagctgcagcctagggtgga

SEQ ID NO: 655470 - DNA, 20 bp, mouse
gcagcggcgccttccaccct

SEQ ID NO: 655471 - DNA, 20 bp, mouse
gcgaacccagatctgggcgt

SEQ ID NO: 655472 - DNA, 20 bp, mouse
gaaggcgccgctgggcgggg

SEQ ID NO: 655473 - DNA, 20 bp, mouse
ggctgaggtcccgggaggtg

SEQ ID NO: 655474 - DNA, 20 bp, mouse
ggtcccgggaggtggggccg

SEQ ID NO: 655475 - DNA, 20 bp, mouse
ggctgctaactccggagcct

SEQ ID NO: 655476 - DNA, 20 bp, mouse
gggtggggaacgtggtgcgg

SEQ ID NO: 655477 - DNA, 20 bp, mouse
gtcaccgggagacacgttcg

SEQ ID NO: 655478 - DNA, 20 bp, mouse
ggggcctggcgggaccgacg

SEQ ID NO: 655479 - DNA, 20 bp, mouse
gccacccgcggctgcgtcac

SEQ ID NO: 655480 - DNA, 20 bp, mouse
gggcccgcggcctgcgttct

SEQ ID NO: 655481 - DNA, 20 bp, mouse
gcagccgcgggtggggaacg

SEQ ID NO: 655482 - DNA, 20 bp, mouse
gggccaggctcgatccgcgc

SEQ ID NO: 655483 - DNA, 20 bp, mouse
gactgtgcgcacggccgtct

SEQ ID NO: 655484 - DNA, 20 bp, mouse
ggcgggtggggaacgtggtg

SEQ ID NO: 655485 - DNA, 20 bp, mouse
gggcccagactgccgccctg

SEQ ID NO: 655486 - DNA, 20 bp, mouse
ggaggagcgagggcgctgat

SEQ ID NO: 655487 - DNA, 20 bp, mouse
gagagcgggaaggtagggac

SEQ ID NO: 655488 - DNA, 20 bp, mouse
gcgcccgggccaacctgccg

SEQ ID NO: 655489 - DNA, 20 bp, mouse
gtctgggccgcgcaagtcag

SEQ ID NO: 655490 - DNA, 20 bp, mouse
gccccgagagcgggaaggta

SEQ ID NO: 655491 - DNA, 20 bp, mouse
gcgccgccctctgacttgcg

SEQ ID NO: 655492 - DNA, 20 bp, mouse
gggcgctgatgggcgtggct

SEQ ID NO: 655493 - DNA, 20 bp, mouse
gggccgcgcaagtcagaggg

SEQ ID NO: 655494 - DNA, 20 bp, mouse
gtgagagctgcggagctccg

SEQ ID NO: 655495 - DNA, 20 bp, mouse
gtcccgggaggttgataaag

SEQ ID NO: 655496 - DNA, 20 bp, mouse
gcacgcgcaccgaacggtgg

SEQ ID NO: 655497 - DNA, 20 bp, mouse
gccggcgcacgcgcaccgaa

SEQ ID NO: 655498 - DNA, 20 bp, mouse
gacgccctgcgccatcggca

SEQ ID NO: 655499 - DNA, 20 bp, mouse
gggtacctgtgactgcgtac

SEQ ID NO: 655500 - DNA, 20 bp, mouse
gcggggcgtagaggaaacgg

SEQ ID NO: 655501 - DNA, 20 bp, mouse
gatccggggcgtagaggaaa

SEQ ID NO: 655502 - DNA, 20 bp, mouse
gatggcgcagggcgtgacga

SEQ ID NO: 655503 - DNA, 20 bp, mouse
ggccgagtcccgccaccgtt

SEQ ID NO: 655504 - DNA, 20 bp, mouse
ggcgcacgcgcaccgaacgg

SEQ ID NO: 655505 - DNA, 20 bp, mouse
gtgactgcgtactggaatgt

SEQ ID NO: 655506 - DNA, 20 bp, mouse
gcgcaagcgcagtcgtgcgg

SEQ ID NO: 655507 - DNA, 20 bp, mouse
gccggccaccaggtcctctc

SEQ ID NO: 655508 - DNA, 20 bp, mouse
gtgcgcaggcgcgtttcctc

SEQ ID NO: 655509 - DNA, 20 bp, mouse
gggccgggagactgttttga

SEQ ID NO: 655510 - DNA, 20 bp, mouse
ggtgccccaaaggaagaagt

SEQ ID NO: 655511 - DNA, 20 bp, mouse
ggagcgagggcaatcgccat

SEQ ID NO: 655512 - DNA, 20 bp, mouse
gtggccggctgtgggagcgt

SEQ ID NO: 655513 - DNA, 20 bp, mouse
gctcccgcaactccgcccag

SEQ ID NO: 655514 - DNA, 20 bp, mouse
ggcttccgcgggagacagaa

SEQ ID NO: 655515 - DNA, 20 bp, mouse
gtcccctcaaaacagtctcc

SEQ ID NO: 655516 - DNA, 20 bp, mouse
ggagaacaggtgaattggat

SEQ ID NO: 655517 - DNA, 20 bp, mouse
gcgcggcgagcgcgtgttgg

SEQ ID NO: 655518 - DNA, 20 bp, mouse
ggctgggagaacaggtgaat

SEQ ID NO: 655519 - DNA, 20 bp, mouse
gggggcgggcactgcgagag

SEQ ID NO: 655520 - DNA, 20 bp, mouse
gcggcgctgcggccaccgac

SEQ ID NO: 655521 - DNA, 20 bp, mouse
gcccccgccgcagccacttc

SEQ ID NO: 655522 - DNA, 20 bp, mouse
gcggatgctaatgagcccgg

SEQ ID NO: 655523 - DNA, 20 bp, mouse
gggccgcggcgagcgcgtgt

SEQ ID NO: 655524 - DNA, 20 bp, mouse
gcggctccccgcgtgctcgc

SEQ ID NO: 655525 - DNA, 20 bp, mouse
ggctgcggccaccgaccggc

SEQ ID NO: 655526 - DNA, 20 bp, mouse
ggggcccggaggagacgcga

SEQ ID NO: 655527 - DNA, 20 bp, mouse
gagggagcgcgcggcagtcg

SEQ ID NO: 655528 - DNA, 20 bp, mouse
gagggagcgcggaggaacgg

SEQ ID NO: 655529 - DNA, 20 bp, mouse
gaggagagagaggggcccgg

SEQ ID NO: 655530 - DNA, 20 bp, mouse
gcagtcggggggcggaggat

SEQ ID NO: 655531 - DNA, 20 bp, mouse
gccggaggagacgcgaggga

SEQ ID NO: 655532 - DNA, 20 bp, mouse
gcggcttcggccaactcgcc

SEQ ID NO: 655533 - DNA, 20 bp, mouse
gtgcgaaggcagacctgggg

SEQ ID NO: 655534 - DNA, 20 bp, mouse
gagttggccgaagccggccg

SEQ ID NO: 655535 - DNA, 20 bp, mouse
ggcctcgctgcgcagagcgt

SEQ ID NO: 655536 - DNA, 20 bp, mouse
gcccaggcgacctgagtgag

SEQ ID NO: 655537 - DNA, 20 bp, mouse
gtctgcccagtcaaagaagg

SEQ ID NO: 655538 - DNA, 20 bp, mouse
ggcacacagtaacttttcac

SEQ ID NO: 655539 - DNA, 20 bp, mouse
ggtgccgaggagttcagctc

SEQ ID NO: 655540 - DNA, 20 bp, mouse
gcgacctgagtgaggggaat

SEQ ID NO: 655541 - DNA, 20 bp, mouse
gcacgcgactggcgcaagga

SEQ ID NO: 655542 - DNA, 20 bp, mouse
gcccgcccccttctttgact

SEQ ID NO: 655543 - DNA, 20 bp, mouse
ggaaaagttactgtgtgccg

SEQ ID NO: 655544 - DNA, 20 bp, mouse
ggtgtctgcccagtcaaaga

SEQ ID NO: 655545 - DNA, 20 bp, mouse
gctggcgcaaggagggggct

SEQ ID NO: 655546 - DNA, 20 bp, mouse
gatgtcggacagagcgatga

SEQ ID NO: 655547 - DNA, 20 bp, mouse
gcctaccctgggaacggcag

SEQ ID NO: 655548 - DNA, 20 bp, mouse
gcaccttcctaccctgggaa

SEQ ID NO: 655549 - DNA, 20 bp, mouse
gtcggacagagcgatgaggg

SEQ ID NO: 655550 - DNA, 20 bp, mouse
gctcccgccggagggccgtg

SEQ ID NO: 655551 - DNA, 20 bp, mouse
gttagcgttggacatagctt

SEQ ID NO: 655552 - DNA, 20 bp, mouse
gtatagcccagggctcaagg

SEQ ID NO: 655553 - DNA, 20 bp, mouse
gcgagcggcgccgcatgcag

SEQ ID NO: 655554 - DNA, 20 bp, mouse
gcctgggaacggcagggggg

SEQ ID NO: 655555 - DNA, 20 bp, mouse
ggcggcagcgtggatgaagt

SEQ ID NO: 655556 - DNA, 20 bp, mouse
gagcacgcggacaaaggagg

SEQ ID NO: 655557 - DNA, 20 bp, mouse
gcccggggcagctgcgcctc

SEQ ID NO: 655558 - DNA, 20 bp, mouse
gcgcccccaacttgggtagg

SEQ ID NO: 655559 - DNA, 20 bp, mouse
ggacactctgagctctcccg

SEQ ID NO: 655560 - DNA, 20 bp, mouse
gggcacaaggcatgaggggt

SEQ ID NO: 655561 - DNA, 20 bp, mouse
ggcgggagctgcctcctctc

SEQ ID NO: 655562 - DNA, 20 bp, mouse
gcggctccgtgaagccttgg

SEQ ID NO: 655563 - DNA, 20 bp, mouse
gttggaggctgccggttccc

SEQ ID NO: 655564 - DNA, 20 bp, mouse
ggcgcagctgccccgggagt

SEQ ID NO: 655565 - DNA, 20 bp, mouse
gcgccgcccgcccggagagg

SEQ ID NO: 655566 - DNA, 20 bp, mouse
gaacctagctctaactggac

SEQ ID NO: 655567 - DNA, 20 bp, mouse
ggaaaggcacggtaagcaag

SEQ ID NO: 655568 - DNA, 20 bp, mouse
gcaagaggaggccagcccaa

SEQ ID NO: 655569 - DNA, 20 bp, mouse
gagctctaactggaccggaa

SEQ ID NO: 655570 - DNA, 20 bp, mouse
gtccggggctagcttcgtca

SEQ ID NO: 655571 - DNA, 20 bp, mouse
gtaactggaccggaagggac

SEQ ID NO: 655572 - DNA, 20 bp, mouse
ggaaaggccaggcttttttg

SEQ ID NO: 655573 - DNA, 20 bp, mouse
gggaggaacctagctctaac

SEQ ID NO: 655574 - DNA, 20 bp, mouse
gacgaagctagccccggaag

SEQ ID NO: 655575 - DNA, 20 bp, mouse
gttatgccccgcctcttccg

SEQ ID NO: 655576 - DNA, 20 bp, mouse
gtggcgggaggggactgcga

SEQ ID NO: 655577 - DNA, 20 bp, mouse
gcagcgcccagattcagatt

SEQ ID NO: 655578 - DNA, 20 bp, mouse
gcgcgggctaggaggggatg

SEQ ID NO: 655579 - DNA, 20 bp, mouse
gcgcccagattcagattggg

SEQ ID NO: 655580 - DNA, 20 bp, mouse
gtgaatctgggcgctgagtg

SEQ ID NO: 655581 - DNA, 20 bp, mouse
gagagcgcgcgggctaggag

SEQ ID NO: 655582 - DNA, 20 bp, mouse
gtatccgcccaatctgaatc

SEQ ID NO: 655583 - DNA, 20 bp, mouse
ggaaaccgcccaggccgcct

SEQ ID NO: 655584 - DNA, 20 bp, mouse
gcccgcgggcaggaggtcgc

SEQ ID NO: 655585 - DNA, 20 bp, mouse
gtagacctggaagtctggac

SEQ ID NO: 655586 - DNA, 20 bp, mouse
gtaggaaaggaagacacctg

SEQ ID NO: 655587 - DNA, 20 bp, mouse
gaccctggagtttacctctt

SEQ ID NO: 655588 - DNA, 20 bp, mouse
gtggatggctaagaatgtca

SEQ ID NO: 655589 - DNA, 20 bp, mouse
gaccctcaaaagagcttctt

SEQ ID NO: 655590 - DNA, 20 bp, mouse
gatgacgcctacattccagc

SEQ ID NO: 655591 - DNA, 20 bp, mouse
gtacacaggtgcactaatgc

SEQ ID NO: 655592 - DNA, 20 bp, mouse
gtgaaaagcagtagattgcc

SEQ ID NO: 655593 - DNA, 20 bp, mouse
gagcaggtggaggttcaaac

SEQ ID NO: 655594 - DNA, 20 bp, mouse
gagggtaattagatcatcac

SEQ ID NO: 655595 - DNA, 20 bp, mouse
gacccaagaggtaaactcca

SEQ ID NO: 655596 - DNA, 20 bp, mouse
gtccctgcgggactggggga

SEQ ID NO: 655597 - DNA, 20 bp, mouse
gcgcccccgcgtggctcgtc

SEQ ID NO: 655598 - DNA, 20 bp, mouse
gcacccgacgagccacgcgg

SEQ ID NO: 655599 - DNA, 20 bp, mouse
ggcactcgccatggagtcct

SEQ ID NO: 655600 - DNA, 20 bp, mouse
gggaggcggaagcaacaggg

SEQ ID NO: 655601 - DNA, 20 bp, mouse
gactccatggcgagtgccat

SEQ ID NO: 655602 - DNA, 20 bp, mouse
ggaagcctggctgtgagccc

SEQ ID NO: 655603 - DNA, 20 bp, mouse
ggggccccaggagtaggtag

SEQ ID NO: 655604 - DNA, 20 bp, mouse
gggtccctaggcctgcgggg

SEQ ID NO: 655605 - DNA, 20 bp, mouse
ggcgacgcgctagggagtcg

SEQ ID NO: 655606 - DNA, 20 bp, mouse
gtgcccgcccctttccgggg

SEQ ID NO: 655607 - DNA, 20 bp, mouse
gcccgcgcggaaacacggaa

SEQ ID NO: 655608 - DNA, 20 bp, mouse
gaagcgggcgggtccagagc

SEQ ID NO: 655609 - DNA, 20 bp, mouse
ggcaaacccgcgcggaaaca

SEQ ID NO: 655610 - DNA, 20 bp, mouse
gcgcggaaacacggaagggt

SEQ ID NO: 655611 - DNA, 20 bp, mouse
gtgagcgctgtcaggctcgc

SEQ ID NO: 655612 - DNA, 20 bp, mouse
gagggggaagatctgtgaca

SEQ ID NO: 655613 - DNA, 20 bp, mouse
ggcgacaaaccgccccggaa

SEQ ID NO: 655614 - DNA, 20 bp, mouse
ggagaggtaaagaagcgggc

SEQ ID NO: 655615 - DNA, 20 bp, mouse
gaaccgccccggaaaggggc

SEQ ID NO: 655616 - DNA, 20 bp, mouse
gcggtgctggggccagataa

SEQ ID NO: 655617 - DNA, 20 bp, mouse
gcccggcccgcccgcctcgg

SEQ ID NO: 655618 - DNA, 20 bp, mouse
gccagataaggggagcgacg

SEQ ID NO: 655619 - DNA, 20 bp, mouse
ggggcgcgcagaggcgagga

SEQ ID NO: 655620 - DNA, 20 bp, mouse
gcgccgggctcgctgcgagg

SEQ ID NO: 655621 - DNA, 20 bp, mouse
gcggcagcgggctggcgaca

SEQ ID NO: 655622 - DNA, 20 bp, mouse
gggcgccaacggacgagtta

SEQ ID NO: 655623 - DNA, 20 bp, mouse
ggacggggccgccgcccccg

SEQ ID NO: 655624 - DNA, 20 bp, mouse
gaggacgagcgtgaggcgcg

SEQ ID NO: 655625 - DNA, 20 bp, mouse
gcagcgagcccggcgcgcgg

SEQ ID NO: 655626 - DNA, 20 bp, mouse
ggatctgaggatcttaggtg

SEQ ID NO: 655627 - DNA, 20 bp, mouse
gaggacacgcaagcctgggt

SEQ ID NO: 655628 - DNA, 20 bp, mouse
gcggggtccgactgacagaa

SEQ ID NO: 655629 - DNA, 20 bp, mouse
gaggacgcggggtctgcctt

SEQ ID NO: 655630 - DNA, 20 bp, mouse
ggcggggtctgccttagggc

SEQ ID NO: 655631 - DNA, 20 bp, mouse
gcctccagccaggtatcaag

SEQ ID NO: 655632 - DNA, 20 bp, mouse
gtacctggctggaggacgcg

SEQ ID NO: 655633 - DNA, 20 bp, mouse
gtgcactggggacgcccctg

SEQ ID NO: 655634 - DNA, 20 bp, mouse
gactcctcttgatacctggc

SEQ ID NO: 655635 - DNA, 20 bp, mouse
ggcgacgcagctcactgcac

SEQ ID NO: 655636 - DNA, 20 bp, mouse
gggcgccgccatgacaaaga

SEQ ID NO: 655637 - DNA, 20 bp, mouse
gccggccgcaatcgcgaccc

SEQ ID NO: 655638 - DNA, 20 bp, mouse
gctggcggggcccgggacaa

SEQ ID NO: 655639 - DNA, 20 bp, mouse
gatgacaaagaaggtaccaa

SEQ ID NO: 655640 - DNA, 20 bp, mouse
gcctaggtaaaccgttaggt

SEQ ID NO: 655641 - DNA, 20 bp, mouse
gggccagcactcatagcgaa

SEQ ID NO: 655642 - DNA, 20 bp, mouse
ggaagcgccagccgccggta

SEQ ID NO: 655643 - DNA, 20 bp, mouse
gagcttgctaaggtcggccg

SEQ ID NO: 655644 - DNA, 20 bp, mouse
gggaagtaatagaccggaag

SEQ ID NO: 655645 - DNA, 20 bp, mouse
gcgccggtacggccacacgg

SEQ ID NO: 655646 - DNA, 20 bp, mouse
ggggtggaggcgcgagtcgg

SEQ ID NO: 655647 - DNA, 20 bp, mouse
ggacaggctgcgagacaggt

SEQ ID NO: 655648 - DNA, 20 bp, mouse
gatgctgtgggcagcgtggg

SEQ ID NO: 655649 - DNA, 20 bp, mouse
gttgatgctgtgggcagcgt

SEQ ID NO: 655650 - DNA, 20 bp, mouse
gctgtgggcagcgtgggtgg

SEQ ID NO: 655651 - DNA, 20 bp, mouse
gaggcgcgagtcgggggatg

SEQ ID NO: 655652 - DNA, 20 bp, mouse
gcgtgggtggaggcgcgagt

SEQ ID NO: 655653 - DNA, 20 bp, mouse
gtgggaagacacaagtggac

SEQ ID NO: 655654 - DNA, 20 bp, mouse
ggagatagacggaaaaggac

SEQ ID NO: 655655 - DNA, 20 bp, mouse
ggcagacagagggcgatgct

SEQ ID NO: 655656 - DNA, 20 bp, mouse
gtgcgggaggcgatcaactt

SEQ ID NO: 655657 - DNA, 20 bp, mouse
gaggaggtgggcgggaccgg

SEQ ID NO: 655658 - DNA, 20 bp, mouse
ggactacgatctcctcgcat

SEQ ID NO: 655659 - DNA, 20 bp, mouse
gggccccgtaggcgaggagg

SEQ ID NO: 655660 - DNA, 20 bp, mouse
gccgctagcagttctcgctt

SEQ ID NO: 655661 - DNA, 20 bp, mouse
ggtaagtgcaggcttgtcta

SEQ ID NO: 655662 - DNA, 20 bp, mouse
ggacgcctgtgctggcaagg

SEQ ID NO: 655663 - DNA, 20 bp, mouse
gtgctagcgggatgctgctc

SEQ ID NO: 655664 - DNA, 20 bp, mouse
ggaggcccagtggtaagtgc

SEQ ID NO: 655665 - DNA, 20 bp, mouse
gcagcgcggaggggccgtca

SEQ ID NO: 655666 - DNA, 20 bp, mouse
gtcaccgccctgcctcacag

SEQ ID NO: 655667 - DNA, 20 bp, mouse
ggcggtgagtaacacatcat

SEQ ID NO: 655668 - DNA, 20 bp, mouse
gcagaggcgggtacaaagga

SEQ ID NO: 655669 - DNA, 20 bp, mouse
gggccccgtttgaaagctat

SEQ ID NO: 655670 - DNA, 20 bp, mouse
ggttcaaggtcacatgtcct

SEQ ID NO: 655671 - DNA, 20 bp, mouse
gtgtgcaataagaactgagg

SEQ ID NO: 655672 - DNA, 20 bp, mouse
gctcacagaggcgggtacaa

SEQ ID NO: 655673 - DNA, 20 bp, mouse
gaattctgctcggtcatcac

SEQ ID NO: 655674 - DNA, 20 bp, mouse
gccgccctgcctcacagagg

SEQ ID NO: 655675 - DNA, 20 bp, mouse
gatgctgtagaactggaaag

SEQ ID NO: 655676 - DNA, 20 bp, mouse
gaaaaagatcggcatgggag

SEQ ID NO: 655677 - DNA, 20 bp, mouse
gggtacaaaaagatcggcat

SEQ ID NO: 655678 - DNA, 20 bp, mouse
gaagttgggtacaaaaagat

SEQ ID NO: 655679 - DNA, 20 bp, mouse
gacgctggcaggctgtgggc

SEQ ID NO: 655680 - DNA, 20 bp, mouse
gctggcacaaagtgccccgg

SEQ ID NO: 655681 - DNA, 20 bp, mouse
gcagcaagacaatgcggtgt

SEQ ID NO: 655682 - DNA, 20 bp, mouse
ggaagtggactcctcccccg

SEQ ID NO: 655683 - DNA, 20 bp, mouse
gccttacgctggcaggctgt

SEQ ID NO: 655684 - DNA, 20 bp, mouse
gctcctggcacaaagtgccc

SEQ ID NO: 655685 - DNA, 20 bp, mouse
ggcacaaagtgccccggggg

SEQ ID NO: 655686 - DNA, 20 bp, mouse
gtcttggcagggactaccat

SEQ ID NO: 655687 - DNA, 20 bp, mouse
gctcgccttggccacagtat

SEQ ID NO: 655688 - DNA, 20 bp, mouse
gtgaagtgcctccagaccaa

SEQ ID NO: 655689 - DNA, 20 bp, mouse
gactgaggagagcctcgcct

SEQ ID NO: 655690 - DNA, 20 bp, mouse
gccagaccaaaggaatgatg

SEQ ID NO: 655691 - DNA, 20 bp, mouse
gaatgaacagaccaatactg

SEQ ID NO: 655692 - DNA, 20 bp, mouse
gaattgtagggctgagacga

SEQ ID NO: 655693 - DNA, 20 bp, mouse
gggtagtccctgccaagaag

SEQ ID NO: 655694 - DNA, 20 bp, mouse
gagctcagtaaataaacatt

SEQ ID NO: 655695 - DNA, 20 bp, mouse
gtgagagtgttgatggaaac

SEQ ID NO: 655696 - DNA, 20 bp, mouse
gcccggctgggaggggttag

SEQ ID NO: 655697 - DNA, 20 bp, mouse
gggtctgggcccggctggga

SEQ ID NO: 655698 - DNA, 20 bp, mouse
gacacccgcgtcctgggcac

SEQ ID NO: 655699 - DNA, 20 bp, mouse
gcgggtgtctgggtctctca

SEQ ID NO: 655700 - DNA, 20 bp, mouse
gccctgggctcccggcagga

SEQ ID NO: 655701 - DNA, 20 bp, mouse
gcgctagcgcggtctgggcc

SEQ ID NO: 655702 - DNA, 20 bp, mouse
gacccagacacccgcgtcct

SEQ ID NO: 655703 - DNA, 20 bp, mouse
ggaggcacgggctcgagctg

SEQ ID NO: 655704 - DNA, 20 bp, mouse
ggcccaggacgcgggtgtct

SEQ ID NO: 655705 - DNA, 20 bp, mouse
ggcgcggtctgggcccggct

SEQ ID NO: 655706 - DNA, 20 bp, mouse
ggaaatgctaagaggagctg

SEQ ID NO: 655707 - DNA, 20 bp, mouse
ggggccagttgctaaagagg

SEQ ID NO: 655708 - DNA, 20 bp, mouse
ggacagaccggggacaaaac

SEQ ID NO: 655709 - DNA, 20 bp, mouse
ggatggtcctgttttgtccc

SEQ ID NO: 655710 - DNA, 20 bp, mouse
gagctgagggggacagaccg

SEQ ID NO: 655711 - DNA, 20 bp, mouse
gtgtagctgcccatgggatg

SEQ ID NO: 655712 - DNA, 20 bp, mouse
gggggaggggaggagtcctc

SEQ ID NO: 655713 - DNA, 20 bp, mouse
gagttgctaaagaggcggga

SEQ ID NO: 655714 - DNA, 20 bp, mouse
ggctgggccagttgctaaag

SEQ ID NO: 655715 - DNA, 20 bp, mouse
gtagcaactggcccagctga

SEQ ID NO: 655716 - DNA, 20 bp, mouse
gcgggcgcgggcatatgagg

SEQ ID NO: 655717 - DNA, 20 bp, mouse
gaccccccctcaatataggg

SEQ ID NO: 655718 - DNA, 20 bp, mouse
gtgggagtggggtagataca

SEQ ID NO: 655719 - DNA, 20 bp, mouse
gaggagcagtactgagcaga

SEQ ID NO: 655720 - DNA, 20 bp, mouse
gaggttggagcggtgagggg

SEQ ID NO: 655721 - DNA, 20 bp, mouse
gtctctgagtccccaccctg

SEQ ID NO: 655722 - DNA, 20 bp, mouse
gagtacagctgcagtactgg

SEQ ID NO: 655723 - DNA, 20 bp, mouse
gagtggggtagatacagggt

SEQ ID NO: 655724 - DNA, 20 bp, mouse
ggtgatcccggacatcccca

SEQ ID NO: 655725 - DNA, 20 bp, mouse
gaacaaggttggagcggtga

SEQ ID NO: 655726 - DNA, 20 bp, mouse
gtcaccctcacccaggtgga

SEQ ID NO: 655727 - DNA, 20 bp, mouse
gcatggtcttgtgacttctg

SEQ ID NO: 655728 - DNA, 20 bp, mouse
gctaggcctggcatcataat

SEQ ID NO: 655729 - DNA, 20 bp, mouse
gatagcacccagaggaccca

SEQ ID NO: 655730 - DNA, 20 bp, mouse
gccagtcaccctcacccagg

SEQ ID NO: 655731 - DNA, 20 bp, mouse
gtctactgaggcccagctac

SEQ ID NO: 655732 - DNA, 20 bp, mouse
gtagggacgacactccagtt

SEQ ID NO: 655733 - DNA, 20 bp, mouse
gtcccagccctgggtcctct

SEQ ID NO: 655734 - DNA, 20 bp, mouse
gccctcacccaggtggaggg

SEQ ID NO: 655735 - DNA, 20 bp, mouse
gggtgctatggcgacagcct

SEQ ID NO: 655736 - DNA, 20 bp, mouse
ggggccccgcacaaaggagc

SEQ ID NO: 655737 - DNA, 20 bp, mouse
gcgcagcaggggtgcggaga

SEQ ID NO: 655738 - DNA, 20 bp, mouse
gcccgcgcccgccccttcgg

SEQ ID NO: 655739 - DNA, 20 bp, mouse
gggagccggcaaagctaaag

SEQ ID NO: 655740 - DNA, 20 bp, mouse
gggcgcggggccccgcacaa

SEQ ID NO: 655741 - DNA, 20 bp, mouse
gaggacgaggaggattgtcc

SEQ ID NO: 655742 - DNA, 20 bp, mouse
gcccccgctcgccaatgctg

SEQ ID NO: 655743 - DNA, 20 bp, mouse
gcacagctcggggcagagag

SEQ ID NO: 655744 - DNA, 20 bp, mouse
gaggccaggagccgagaaat

SEQ ID NO: 655745 - DNA, 20 bp, mouse
ggacaaggagggaaagtcac

SEQ ID NO: 655746 - DNA, 20 bp, mouse
gaagaggcggggttcctgag

SEQ ID NO: 655747 - DNA, 20 bp, mouse
gaggcggggttcctgagggg

SEQ ID NO: 655748 - DNA, 20 bp, mouse
gtgtacctggggtctggggt

SEQ ID NO: 655749 - DNA, 20 bp, mouse
gtacagtactgaaacaagat

SEQ ID NO: 655750 - DNA, 20 bp, mouse
gagcgagcaacgaagaggcg

SEQ ID NO: 655751 - DNA, 20 bp, mouse
gcgaaagcctccggaacaga

SEQ ID NO: 655752 - DNA, 20 bp, mouse
ggggttcctgaggggtgggt

SEQ ID NO: 655753 - DNA, 20 bp, mouse
gggggtaggaagaacccgct

SEQ ID NO: 655754 - DNA, 20 bp, mouse
gagtactgtacctggggtct

SEQ ID NO: 655755 - DNA, 20 bp, mouse
gacagagggctgaatgtgag

SEQ ID NO: 655756 - DNA, 20 bp, mouse
ggccaaatgtctcacttcca

SEQ ID NO: 655757 - DNA, 20 bp, mouse
gttcttggaacgtgagtgtg

SEQ ID NO: 655758 - DNA, 20 bp, mouse
gaccttgggggaaggaatcc

SEQ ID NO: 655759 - DNA, 20 bp, mouse
gttgtaagctaggaggtggg

SEQ ID NO: 655760 - DNA, 20 bp, mouse
gtcgttgtaagctaggaggt

SEQ ID NO: 655761 - DNA, 20 bp, mouse
gtatgagcaacctgataatg

SEQ ID NO: 655762 - DNA, 20 bp, mouse
gctgcagggcatgggaagga

SEQ ID NO: 655763 - DNA, 20 bp, mouse
ggatggagtcgttgtaagct

SEQ ID NO: 655764 - DNA, 20 bp, mouse
gtgaactggcaggcacgttt

SEQ ID NO: 655765 - DNA, 20 bp, mouse
gtggggctagtccaggacct

SEQ ID NO: 655766 - DNA, 20 bp, mouse
gggcgtggctctggcgtcaa

SEQ ID NO: 655767 - DNA, 20 bp, mouse
gtgggcgtggcgtgttgtcg

SEQ ID NO: 655768 - DNA, 20 bp, mouse
gggggcaagtagcccggctg

SEQ ID NO: 655769 - DNA, 20 bp, mouse
gtagcccccgcccaggtgcg

SEQ ID NO: 655770 - DNA, 20 bp, mouse
gcacctgggcgggggctaca

SEQ ID NO: 655771 - DNA, 20 bp, mouse
ggaccttggagatgtgggcg

SEQ ID NO: 655772 - DNA, 20 bp, mouse
ggggggcggggtcatccggg

SEQ ID NO: 655773 - DNA, 20 bp, mouse
gcgggcggctctgggccttt

SEQ ID NO: 655774 - DNA, 20 bp, mouse
ggggcggaccttggagatgt

SEQ ID NO: 655775 - DNA, 20 bp, mouse
gcttcctcgcacctgggcgg

SEQ ID NO: 655776 - DNA, 20 bp, mouse
ggggtgggaaggcacatgaa

SEQ ID NO: 655777 - DNA, 20 bp, mouse
gcaagctcatcattacaggg

SEQ ID NO: 655778 - DNA, 20 bp, mouse
gacctctcgggtcctggaga

SEQ ID NO: 655779 - DNA, 20 bp, mouse
gccaggacccgagaggtgat

SEQ ID NO: 655780 - DNA, 20 bp, mouse
gagggagggggagatattct

SEQ ID NO: 655781 - DNA, 20 bp, mouse
gcgcacaaagggtggggcat

SEQ ID NO: 655782 - DNA, 20 bp, mouse
gcccttctccaggacccgag

SEQ ID NO: 655783 - DNA, 20 bp, mouse
gggagatattctgggtcacg

SEQ ID NO: 655784 - DNA, 20 bp, mouse
gcgcgtgcacgcacaaaggg

SEQ ID NO: 655785 - DNA, 20 bp, mouse
gcgagaggtgatgggctcaa

SEQ ID NO: 655786 - DNA, 20 bp, mouse
ggaaagatctgctcaggggt

SEQ ID NO: 655787 - DNA, 20 bp, mouse
gtcactcacaagggacgcaa

SEQ ID NO: 655788 - DNA, 20 bp, mouse
gaatccctgacctggaggaa

SEQ ID NO: 655789 - DNA, 20 bp, mouse
ggcctgaggtgtcactcaca

SEQ ID NO: 655790 - DNA, 20 bp, mouse
ggagaagttgaggcaactgg

SEQ ID NO: 655791 - DNA, 20 bp, mouse
gcccttgtgagtgacacctc

SEQ ID NO: 655792 - DNA, 20 bp, mouse
ggaccccagcaggaggggtc

SEQ ID NO: 655793 - DNA, 20 bp, mouse
gtatggaaagatctgctcag

SEQ ID NO: 655794 - DNA, 20 bp, mouse
gggtggccccagcctcagag

SEQ ID NO: 655795 - DNA, 20 bp, mouse
gctcacaagggacgcaaagg

SEQ ID NO: 655796 - DNA, 20 bp, mouse
ggccgcgcgcggcctcgatc

SEQ ID NO: 655797 - DNA, 20 bp, mouse
ggagcacagcgtggacgcag

SEQ ID NO: 655798 - DNA, 20 bp, mouse
gagagcccccagcgcggcgc

SEQ ID NO: 655799 - DNA, 20 bp, mouse
ggcctcgatccgggttcctg

SEQ ID NO: 655800 - DNA, 20 bp, mouse
gcggggcctgctggcggcgt

SEQ ID NO: 655801 - DNA, 20 bp, mouse
ggtcggggacggctccgcgg

SEQ ID NO: 655802 - DNA, 20 bp, mouse
gcccccaggaacccggatcg

SEQ ID NO: 655803 - DNA, 20 bp, mouse
ggcatgtggacgccgctcat

SEQ ID NO: 655804 - DNA, 20 bp, mouse
ggcgctgcggccaccggcgc

SEQ ID NO: 655805 - DNA, 20 bp, mouse
ggccgagagagcccccagcg

SEQ ID NO: 655806 - DNA, 20 bp, mouse
gggtcccccgccaccctcgg

SEQ ID NO: 655807 - DNA, 20 bp, mouse
gctagcttcagtatgtggac

SEQ ID NO: 655808 - DNA, 20 bp, mouse
gagccagggagcctcgaact

SEQ ID NO: 655809 - DNA, 20 bp, mouse
gcatactgaagctagagcca

SEQ ID NO: 655810 - DNA, 20 bp, mouse
ggagctcctaggacacagag

SEQ ID NO: 655811 - DNA, 20 bp, mouse
ggacccccagtgcactgcat

SEQ ID NO: 655812 - DNA, 20 bp, mouse
gaactcggtctgcaaagctg

SEQ ID NO: 655813 - DNA, 20 bp, mouse
gtctgtgcagaggtggagct

SEQ ID NO: 655814 - DNA, 20 bp, mouse
gcccgccccgccgagggtgg

SEQ ID NO: 655815 - DNA, 20 bp, mouse
gtgcccggggctccgtcctc

SEQ ID NO: 655816 - DNA, 20 bp, mouse
gcgcgcgcgcgcacgagcgg

SEQ ID NO: 655817 - DNA, 20 bp, mouse
ggcagcgcgcggtgtggaaa

SEQ ID NO: 655818 - DNA, 20 bp, mouse
gcccggagagggcgtttaag

SEQ ID NO: 655819 - DNA, 20 bp, mouse
ggggccgcgcgcccaggcac

SEQ ID NO: 655820 - DNA, 20 bp, mouse
gtgaccgcgcccagccaagg

SEQ ID NO: 655821 - DNA, 20 bp, mouse
ggccgcgcgagcatccgcag

SEQ ID NO: 655822 - DNA, 20 bp, mouse
gcggcccgcggggagcctga

SEQ ID NO: 655823 - DNA, 20 bp, mouse
ggtggcctgtagtgcggggc

SEQ ID NO: 655824 - DNA, 20 bp, mouse
gaggtagcgccgctcggacc

SEQ ID NO: 655825 - DNA, 20 bp, mouse
gccgccctcaggctccccgc

SEQ ID NO: 655826 - DNA, 20 bp, mouse
ggggaacgggcctctcccta

SEQ ID NO: 655827 - DNA, 20 bp, mouse
gcggccgcggatgcgtcccg

SEQ ID NO: 655828 - DNA, 20 bp, mouse
ggctctgggcatcgctccca

SEQ ID NO: 655829 - DNA, 20 bp, mouse
ggcacaggaggccgtgtcaa

SEQ ID NO: 655830 - DNA, 20 bp, mouse
gtcaagggcacgcgaagggg

SEQ ID NO: 655831 - DNA, 20 bp, mouse
gcaccccgcgcctgggagcg

SEQ ID NO: 655832 - DNA, 20 bp, mouse
gctcccacgggacgcatccg

SEQ ID NO: 655833 - DNA, 20 bp, mouse
gcctctccctagggctctgc

SEQ ID NO: 655834 - DNA, 20 bp, mouse
gcagcccaggacgagcaagg

SEQ ID NO: 655835 - DNA, 20 bp, mouse
ggacacggcctcctgtgcga

SEQ ID NO: 655836 - DNA, 20 bp, mouse
gtgagtggcggggcgagcga

SEQ ID NO: 655837 - DNA, 20 bp, mouse
ggaaacccgtgggtgactaa

SEQ ID NO: 655838 - DNA, 20 bp, mouse
gtccgagccgagttcgggga

SEQ ID NO: 655839 - DNA, 20 bp, mouse
gaccccccaaggaaacccgt

SEQ ID NO: 655840 - DNA, 20 bp, mouse
gtctcagtgaggggtgtctg

SEQ ID NO: 655841 - DNA, 20 bp, mouse
gggcgagcgagggcggtggg

SEQ ID NO: 655842 - DNA, 20 bp, mouse
ggccccgccactcacgcagg

SEQ ID NO: 655843 - DNA, 20 bp, mouse
gagagatggggaatgtttag

SEQ ID NO: 655844 - DNA, 20 bp, mouse
gactaagggtgaggtgtctg

SEQ ID NO: 655845 - DNA, 20 bp, mouse
ggcccacctgcgtgagtggc

SEQ ID NO: 655846 - DNA, 20 bp, mouse
ggggcagtgcactggcaaac

SEQ ID NO: 655847 - DNA, 20 bp, mouse
gacactggcagagtagtggt

SEQ ID NO: 655848 - DNA, 20 bp, mouse
gcagcagcagcagagaatag

SEQ ID NO: 655849 - DNA, 20 bp, mouse
ggggacagaagggcgcacac

SEQ ID NO: 655850 - DNA, 20 bp, mouse
gtgcactggcaaacaggctc

SEQ ID NO: 655851 - DNA, 20 bp, mouse
gagctctgagcgcggaggga

SEQ ID NO: 655852 - DNA, 20 bp, mouse
gtcgcatcctggggacagaa

SEQ ID NO: 655853 - DNA, 20 bp, mouse
ggaatagaggggcagtgcac

SEQ ID NO: 655854 - DNA, 20 bp, mouse
ggggtgtggttggaaagtgg

SEQ ID NO: 655855 - DNA, 20 bp, mouse
gagggcgcacaccgggcgca

SEQ ID NO: 655856 - DNA, 20 bp, mouse
gcccgccgcgccttgtactt

SEQ ID NO: 655857 - DNA, 20 bp, mouse
gacacgttcgggtcttaagg

SEQ ID NO: 655858 - DNA, 20 bp, mouse
gtcttaaggcggaatgggga

SEQ ID NO: 655859 - DNA, 20 bp, mouse
gcgggatgatgctacacgtt

SEQ ID NO: 655860 - DNA, 20 bp, mouse
gggcggaatggggaaggcta

SEQ ID NO: 655861 - DNA, 20 bp, mouse
gcgggtcttaaggcggaatg

SEQ ID NO: 655862 - DNA, 20 bp, mouse
gttaaggtggcccaagtaca

SEQ ID NO: 655863 - DNA, 20 bp, mouse
ggtggcccaagtacaaggcg

SEQ ID NO: 655864 - DNA, 20 bp, mouse
ggctacacgttcgggtctta

SEQ ID NO: 655865 - DNA, 20 bp, mouse
ggcccaagtacaaggcgcgg

SEQ ID NO: 655866 - DNA, 20 bp, mouse
gggtgagcggaagtgcagtg

SEQ ID NO: 655867 - DNA, 20 bp, mouse
gcccaggaccacgtccatta

SEQ ID NO: 655868 - DNA, 20 bp, mouse
ggcactccagctctcggcgc

SEQ ID NO: 655869 - DNA, 20 bp, mouse
gtgtggctggatacggggat

SEQ ID NO: 655870 - DNA, 20 bp, mouse
ggcgcctctccgggcggaag

SEQ ID NO: 655871 - DNA, 20 bp, mouse
gccgccgggtgtgtagaaag

SEQ ID NO: 655872 - DNA, 20 bp, mouse
ggccgcctcgacagaatgtg

SEQ ID NO: 655873 - DNA, 20 bp, mouse
gtggtagcgacaaagctcgg

SEQ ID NO: 655874 - DNA, 20 bp, mouse
gccgagcctgcgagccctaa

SEQ ID NO: 655875 - DNA, 20 bp, mouse
ggggcagtgcagggagcgcc

SEQ ID NO: 655876 - DNA, 20 bp, mouse
gcagccgcagcggctcagga

SEQ ID NO: 655877 - DNA, 20 bp, mouse
gcagcggctcaggaaggatc

SEQ ID NO: 655878 - DNA, 20 bp, mouse
ggggtcagccgcagcggctc

SEQ ID NO: 655879 - DNA, 20 bp, mouse
gcaggggcggagctcacctg

SEQ ID NO: 655880 - DNA, 20 bp, mouse
ggcggctgacccttggagtt

SEQ ID NO: 655881 - DNA, 20 bp, mouse
gctccaagggtcagccgcag

SEQ ID NO: 655882 - DNA, 20 bp, mouse
gtcaggcgattcttatgctc

SEQ ID NO: 655883 - DNA, 20 bp, mouse
gagctgctctatcccaggta

SEQ ID NO: 655884 - DNA, 20 bp, mouse
ggtaccctgtaacgcggaga

SEQ ID NO: 655885 - DNA, 20 bp, mouse
gcggggccagtcaaatcatc

SEQ ID NO: 655886 - DNA, 20 bp, mouse
ggccacctgtcactcagatc

SEQ ID NO: 655887 - DNA, 20 bp, mouse
ggtggcaatgggctttgaac

SEQ ID NO: 655888 - DNA, 20 bp, mouse
ggctccttgaggtaaccttc

SEQ ID NO: 655889 - DNA, 20 bp, mouse
gggttcctgatctgagtgac

SEQ ID NO: 655890 - DNA, 20 bp, mouse
ggcctcagagggtttctgga

SEQ ID NO: 655891 - DNA, 20 bp, mouse
gaggagtccccattacaggt

SEQ ID NO: 655892 - DNA, 20 bp, mouse
gcactcagatcaggaacccc

SEQ ID NO: 655893 - DNA, 20 bp, mouse
gtctgagtgacaggtggcaa

SEQ ID NO: 655894 - DNA, 20 bp, mouse
gttgctggcaatgtggcaag

SEQ ID NO: 655895 - DNA, 20 bp, mouse
ggaccaggcttgatataccc

SEQ ID NO: 655896 - DNA, 20 bp, mouse
gctgcctagggggtgtaagt

SEQ ID NO: 655897 - DNA, 20 bp, mouse
gaggcgtgatcaagtgtgac

SEQ ID NO: 655898 - DNA, 20 bp, mouse
gaaactgcgcacagtgggtg

SEQ ID NO: 655899 - DNA, 20 bp, mouse
ggagctggatcaagcttgga

SEQ ID NO: 655900 - DNA, 20 bp, mouse
gggcgtgcctagtcgcacat

SEQ ID NO: 655901 - DNA, 20 bp, mouse
gtgggtgggaactcgcatgt

SEQ ID NO: 655902 - DNA, 20 bp, mouse
ggacgggagtggttacacga

SEQ ID NO: 655903 - DNA, 20 bp, mouse
gagggatggaccaagaattg

SEQ ID NO: 655904 - DNA, 20 bp, mouse
ggtgcctagtcgcacatggg

SEQ ID NO: 655905 - DNA, 20 bp, mouse
gtggttctcggctctgccta

SEQ ID NO: 655906 - DNA, 20 bp, mouse
gtgacttctgggacagcgga

SEQ ID NO: 655907 - DNA, 20 bp, mouse
gtaccctgatgttagctgaa

SEQ ID NO: 655908 - DNA, 20 bp, mouse
gttcccttcagctaacatca

SEQ ID NO: 655909 - DNA, 20 bp, mouse
gcaggtgaggcacaacccag

SEQ ID NO: 655910 - DNA, 20 bp, mouse
ggcctctacaaacacaaggg

SEQ ID NO: 655911 - DNA, 20 bp, mouse
gaggccaaaggcatcagaac

SEQ ID NO: 655912 - DNA, 20 bp, mouse
gatagtagagaactgatagc

SEQ ID NO: 655913 - DNA, 20 bp, mouse
gatcgcctctacaaacacaa

SEQ ID NO: 655914 - DNA, 20 bp, mouse
gtccttggggtgcccttggc

SEQ ID NO: 655915 - DNA, 20 bp, mouse
gttggtccttggggtgccct

SEQ ID NO: 655916 - DNA, 20 bp, mouse
gaaaatgttgagtaccaggg

SEQ ID NO: 655917 - DNA, 20 bp, mouse
gcccaggcaggtgacgttca

SEQ ID NO: 655918 - DNA, 20 bp, mouse
ggctactcacgtggtctccc

SEQ ID NO: 655919 - DNA, 20 bp, mouse
gaacgtcacctgcctggggc

SEQ ID NO: 655920 - DNA, 20 bp, mouse
gcgtccggaggagcaggaga

SEQ ID NO: 655921 - DNA, 20 bp, mouse
gagtctaggcagcccgcccc

SEQ ID NO: 655922 - DNA, 20 bp, mouse
gatgttgagtaccagggagg

SEQ ID NO: 655923 - DNA, 20 bp, mouse
gaggactaaaaccctctggg

SEQ ID NO: 655924 - DNA, 20 bp, mouse
ggctgcctagactaagagct

SEQ ID NO: 655925 - DNA, 20 bp, mouse
gtccctgaacgtcacctgcc

SEQ ID NO: 655926 - DNA, 20 bp, mouse
gggcccatgggaacgtcagt

SEQ ID NO: 655927 - DNA, 20 bp, mouse
gccgccgtaggcacagtaat

SEQ ID NO: 655928 - DNA, 20 bp, mouse
gacgttcccatgggccaatt

SEQ ID NO: 655929 - DNA, 20 bp, mouse
ggccccagctgcaggaccgg

SEQ ID NO: 655930 - DNA, 20 bp, mouse
gcaccactaacgcttctata

SEQ ID NO: 655931 - DNA, 20 bp, mouse
gggtttcgaggcttagaggg

SEQ ID NO: 655932 - DNA, 20 bp, mouse
gctcctactgacgttcccat

SEQ ID NO: 655933 - DNA, 20 bp, mouse
gcgccgccactcaaccttag

SEQ ID NO: 655934 - DNA, 20 bp, mouse
ggcggggcaacctccgccgt

SEQ ID NO: 655935 - DNA, 20 bp, mouse
ggcctagtgcacaggttcaa

SEQ ID NO: 655936 - DNA, 20 bp, mouse
gctcgcccgcgagaacatgg

SEQ ID NO: 655937 - DNA, 20 bp, mouse
gggtggggccagggaactcg

SEQ ID NO: 655938 - DNA, 20 bp, mouse
gagggctccaagccgaggga

SEQ ID NO: 655939 - DNA, 20 bp, mouse
ggggagggatgcgggggctc

SEQ ID NO: 655940 - DNA, 20 bp, mouse
gcgcaatggtaggaccacat

SEQ ID NO: 655941 - DNA, 20 bp, mouse
gcccgctccgcctgcgtcct

SEQ ID NO: 655942 - DNA, 20 bp, mouse
ggcgacgaggtaagtgactc

SEQ ID NO: 655943 - DNA, 20 bp, mouse
gggagagggctccaagccga

SEQ ID NO: 655944 - DNA, 20 bp, mouse
gaagcggtcggaagcggaac

SEQ ID NO: 655945 - DNA, 20 bp, mouse
gactacaaagcggtcggaag

SEQ ID NO: 655946 - DNA, 20 bp, mouse
gactgcaaggggtggggcca

SEQ ID NO: 655947 - DNA, 20 bp, mouse
gtgcagtgatgcctagaagt

SEQ ID NO: 655948 - DNA, 20 bp, mouse
gcaaacgactctgggttctt

SEQ ID NO: 655949 - DNA, 20 bp, mouse
gaggcatcactgcaaggggt

SEQ ID NO: 655950 - DNA, 20 bp, mouse
gaagtgggatcctcctatgc

SEQ ID NO: 655951 - DNA, 20 bp, mouse
gcaaacgaacatattccctc

SEQ ID NO: 655952 - DNA, 20 bp, mouse
gatgacccacccggcatagg

SEQ ID NO: 655953 - DNA, 20 bp, mouse
gcgcgcacaggattctccga

SEQ ID NO: 655954 - DNA, 20 bp, mouse
ggaacatattccctcaggag

SEQ ID NO: 655955 - DNA, 20 bp, mouse
ggggatcctcctatgccggg

SEQ ID NO: 655956 - DNA, 20 bp, mouse
gcctgcccgcagcacctgga

SEQ ID NO: 655957 - DNA, 20 bp, mouse
gccggtcgcgccttgcccat

SEQ ID NO: 655958 - DNA, 20 bp, mouse
gctgagtagcggaaggggtg

SEQ ID NO: 655959 - DNA, 20 bp, mouse
gaagcgaggccgctgcatgc

SEQ ID NO: 655960 - DNA, 20 bp, mouse
gactcagagcgggctcgagg

SEQ ID NO: 655961 - DNA, 20 bp, mouse
ggaaggtgaccggcatgcag

SEQ ID NO: 655962 - DNA, 20 bp, mouse
ggcagcggcctcgctttccc

SEQ ID NO: 655963 - DNA, 20 bp, mouse
gtgtggccgtagagacacct

SEQ ID NO: 655964 - DNA, 20 bp, mouse
gcaggcctgagtagcggaag

SEQ ID NO: 655965 - DNA, 20 bp, mouse
gtctgcatgtacccatgccc

SEQ ID NO: 655966 - DNA, 20 bp, mouse
gccgctgcggggacaggaga

SEQ ID NO: 655967 - DNA, 20 bp, mouse
gacggaaaagcaggctggaa

SEQ ID NO: 655968 - DNA, 20 bp, mouse
gtctcgcgatagtggggagg

SEQ ID NO: 655969 - DNA, 20 bp, mouse
gcgcaaccgcccctctccga

SEQ ID NO: 655970 - DNA, 20 bp, mouse
gtccctccggcgccgagtca

SEQ ID NO: 655971 - DNA, 20 bp, mouse
ggagaggggcggttgcgcag

SEQ ID NO: 655972 - DNA, 20 bp, mouse
gggacaggagacggaaaagc

SEQ ID NO: 655973 - DNA, 20 bp, mouse
gaaaatcccgctgcggggac

SEQ ID NO: 655974 - DNA, 20 bp, mouse
gcagaggtacaccacgtgtg

SEQ ID NO: 655975 - DNA, 20 bp, mouse
gtcgacgagagaccctgact

SEQ ID NO: 655976 - DNA, 20 bp, mouse
gcccgcctccttgcggataa

SEQ ID NO: 655977 - DNA, 20 bp, mouse
gggtccaagcggccgaatga

SEQ ID NO: 655978 - DNA, 20 bp, mouse
gtggagagataacgaccaat

SEQ ID NO: 655979 - DNA, 20 bp, mouse
ggggactccgaacacgtggg

SEQ ID NO: 655980 - DNA, 20 bp, mouse
gggcaattcccgcctccttg

SEQ ID NO: 655981 - DNA, 20 bp, mouse
gctgaagaagaccaataaga

SEQ ID NO: 655982 - DNA, 20 bp, mouse
gtatctctccacgttccaat

SEQ ID NO: 655983 - DNA, 20 bp, mouse
gaattgccacgaagctcctg

SEQ ID NO: 655984 - DNA, 20 bp, mouse
ggctcccccacccacgtgtt

SEQ ID NO: 655985 - DNA, 20 bp, mouse
ggcaagctgacacgtgataa

SEQ ID NO: 655986 - DNA, 20 bp, mouse
ggctccctctgccaggttgg

SEQ ID NO: 655987 - DNA, 20 bp, mouse
gtggacacaagctagaggat

SEQ ID NO: 655988 - DNA, 20 bp, mouse
gactccacctggcgtccaac

SEQ ID NO: 655989 - DNA, 20 bp, mouse
gcggctcttccgtgcacggt

SEQ ID NO: 655990 - DNA, 20 bp, mouse
gacagctccctctgccaggt

SEQ ID NO: 655991 - DNA, 20 bp, mouse
ggatcccaggactcacaaaa

SEQ ID NO: 655992 - DNA, 20 bp, mouse
ggggggacaagcactccacc

SEQ ID NO: 655993 - DNA, 20 bp, mouse
gaaaaggagcccaccgtgca

SEQ ID NO: 655994 - DNA, 20 bp, mouse
gtcgagtcataagactgggg

SEQ ID NO: 655995 - DNA, 20 bp, mouse
gccccaagacaccaccaacc

SEQ ID NO: 655996 - DNA, 20 bp, mouse
ggacaggccccctccgtgac

SEQ ID NO: 655997 - DNA, 20 bp, mouse
ggccgccagccggtcacgga

SEQ ID NO: 655998 - DNA, 20 bp, mouse
gggccccctccgtgaccggc

SEQ ID NO: 655999 - DNA, 20 bp, mouse
gtattggtaactctcagagg

SEQ ID NO: 656000 - DNA, 20 bp, mouse
gaagaagctaactacttgga

SEQ ID NO: 656001 - DNA, 20 bp, mouse
gccctgggagaacccctgcc

SEQ ID NO: 656002 - DNA, 20 bp, mouse
gccgcgccgcagcacccgga

SEQ ID NO: 656003 - DNA, 20 bp, mouse
ggcacactgaagacgactct

SEQ ID NO: 656004 - DNA, 20 bp, mouse
ggggtcggcttgtagctccc

SEQ ID NO: 656005 - DNA, 20 bp, mouse
ggagctcagtatgtaagtta

SEQ ID NO: 656006 - DNA, 20 bp, mouse
ggggccggccgactcctcgg

SEQ ID NO: 656007 - DNA, 20 bp, mouse
gagccgggccggcccatcgg

SEQ ID NO: 656008 - DNA, 20 bp, mouse
ggccgggccggccgactcct

SEQ ID NO: 656009 - DNA, 20 bp, mouse
ggggcagcggcggcccaaga

SEQ ID NO: 656010 - DNA, 20 bp, mouse
ggggacgggagatcattctg

SEQ ID NO: 656011 - DNA, 20 bp, mouse
gcatcggcgggcgtggggca

SEQ ID NO: 656012 - DNA, 20 bp, mouse
gccggcccatcggcgggcgt

SEQ ID NO: 656013 - DNA, 20 bp, mouse
gtgtcgggcccgcagggcga

SEQ ID NO: 656014 - DNA, 20 bp, mouse
gcgggcccggacctccggag

SEQ ID NO: 656015 - DNA, 20 bp, mouse
gagggcggggcgcaccttgt

SEQ ID NO: 656016 - DNA, 20 bp, mouse
gggtactgctagtgcgggga

SEQ ID NO: 656017 - DNA, 20 bp, mouse
gcggacaggaagcgcctcga

SEQ ID NO: 656018 - DNA, 20 bp, mouse
ggggcgctcccgggtctctc

SEQ ID NO: 656019 - DNA, 20 bp, mouse
gccgaagggagcttgaacta

SEQ ID NO: 656020 - DNA, 20 bp, mouse
gaggctgtgcgggaagccga

SEQ ID NO: 656021 - DNA, 20 bp, mouse
gcgtcccgatccttggggtt

SEQ ID NO: 656022 - DNA, 20 bp, mouse
gatggcggagtcttagctga

SEQ ID NO: 656023 - DNA, 20 bp, mouse
gaagccgaggggaggggcgc

SEQ ID NO: 656024 - DNA, 20 bp, mouse
gctggaccgcgcccgtgcga

SEQ ID NO: 656025 - DNA, 20 bp, mouse
gagtgcggggatggctgact

SEQ ID NO: 656026 - DNA, 20 bp, mouse
ggggaagtagatcaccactt

SEQ ID NO: 656027 - DNA, 20 bp, mouse
gtaggggtgtggctcagtcc

SEQ ID NO: 656028 - DNA, 20 bp, mouse
gcagtgaatagcaagtaaaa

SEQ ID NO: 656029 - DNA, 20 bp, mouse
gagggcgcacgcacccctgc

SEQ ID NO: 656030 - DNA, 20 bp, mouse
gcatgaggaatgagaggctt

SEQ ID NO: 656031 - DNA, 20 bp, mouse
gtagaaggcaaaaagtcaaa

SEQ ID NO: 656032 - DNA, 20 bp, mouse
gcaagtaaaagggactgggg

SEQ ID NO: 656033 - DNA, 20 bp, mouse
ggagcctctgcttcccgctc

SEQ ID NO: 656034 - DNA, 20 bp, mouse
gtacttttggatctctcatg

SEQ ID NO: 656035 - DNA, 20 bp, mouse
gctatcccaggcggaagcaa

SEQ ID NO: 656036 - DNA, 20 bp, mouse
gatagccgagcgttcccacg

SEQ ID NO: 656037 - DNA, 20 bp, mouse
gcgccggtgctgaagtaacg

SEQ ID NO: 656038 - DNA, 20 bp, mouse
gagcctcgttacttcagcac

SEQ ID NO: 656039 - DNA, 20 bp, mouse
ggggctggttactactctcc

SEQ ID NO: 656040 - DNA, 20 bp, mouse
gctggtcagtcattacacgc

SEQ ID NO: 656041 - DNA, 20 bp, mouse
gcacacctggccgactccag

SEQ ID NO: 656042 - DNA, 20 bp, mouse
ggtgtaagctggcttcaaaa

SEQ ID NO: 656043 - DNA, 20 bp, mouse
gacagcctagacttcctacc

SEQ ID NO: 656044 - DNA, 20 bp, mouse
gtccagcggcccattgggtg

SEQ ID NO: 656045 - DNA, 20 bp, mouse
gtaagctggcttcaaaaggg

SEQ ID NO: 656046 - DNA, 20 bp, mouse
gtgaccttggaaatggggaa

SEQ ID NO: 656047 - DNA, 20 bp, mouse
gctgctccctgaggaatctc

SEQ ID NO: 656048 - DNA, 20 bp, mouse
gcggaagatcggtgaagtgg

SEQ ID NO: 656049 - DNA, 20 bp, mouse
gacagctattcatgttggtc

SEQ ID NO: 656050 - DNA, 20 bp, mouse
gcagggagcaggcattactt

SEQ ID NO: 656051 - DNA, 20 bp, mouse
gtaaaggcatagcaggtctg

SEQ ID NO: 656052 - DNA, 20 bp, mouse
gaaactgccgcaagctaatg

SEQ ID NO: 656053 - DNA, 20 bp, mouse
gttgggacagctattcatgt

SEQ ID NO: 656054 - DNA, 20 bp, mouse
gcagcctgaccttggaaatg

SEQ ID NO: 656055 - DNA, 20 bp, mouse
gtaatgagatgccacaaaca

SEQ ID NO: 656056 - DNA, 20 bp, mouse
gtcagtgtgttattgctctg

SEQ ID NO: 656057 - DNA, 20 bp, mouse
gcaggtgtagggtccttcca

SEQ ID NO: 656058 - DNA, 20 bp, mouse
gtgactaagacagtttgctg

SEQ ID NO: 656059 - DNA, 20 bp, mouse
ggtggaagaagtgtctcaca

SEQ ID NO: 656060 - DNA, 20 bp, mouse
gaacatatatacataaggaa

SEQ ID NO: 656061 - DNA, 20 bp, mouse
gggttaagtcaattaccatc

SEQ ID NO: 656062 - DNA, 20 bp, mouse
gtaggaagtggcatttaact

SEQ ID NO: 656063 - DNA, 20 bp, mouse
gagaagtgtctcacagggag

SEQ ID NO: 656064 - DNA, 20 bp, mouse
gttaaatgccacttcctaag

SEQ ID NO: 656065 - DNA, 20 bp, mouse
gagtggtaaaaagtaagaat

SEQ ID NO: 656066 - DNA, 20 bp, mouse
gagtccagccggaccgcggc

SEQ ID NO: 656067 - DNA, 20 bp, mouse
ggtacctgccgcggtccggc

SEQ ID NO: 656068 - DNA, 20 bp, mouse
gtccggctggactcgtgaac

SEQ ID NO: 656069 - DNA, 20 bp, mouse
gcgtcaggagcccgggagtg

SEQ ID NO: 656070 - DNA, 20 bp, mouse
gcacgagtccagccggaccg

SEQ ID NO: 656071 - DNA, 20 bp, mouse
gccaagaagtgcgcccgggt

SEQ ID NO: 656072 - DNA, 20 bp, mouse
gagagccaagaagtgcgccc

SEQ ID NO: 656073 - DNA, 20 bp, mouse
gaatgtacgcgtcaggagcc

SEQ ID NO: 656074 - DNA, 20 bp, mouse
gccacagaagcacacttggc

SEQ ID NO: 656075 - DNA, 20 bp, mouse
ggaaaattaagtctgaaatt

SEQ ID NO: 656076 - DNA, 20 bp, mouse
gccagcacccgcaacctgaa

SEQ ID NO: 656077 - DNA, 20 bp, mouse
gcgcctacgtagcgcagggt

SEQ ID NO: 656078 - DNA, 20 bp, mouse
ggctacgtaggcggtgtctg

SEQ ID NO: 656079 - DNA, 20 bp, mouse
ggcaacctgaacggactcta

SEQ ID NO: 656080 - DNA, 20 bp, mouse
ggtgcccgggctactgtgcg

SEQ ID NO: 656081 - DNA, 20 bp, mouse
gaatgagcgagcgccgtgga

SEQ ID NO: 656082 - DNA, 20 bp, mouse
gggccgaccctgcgctacgt

SEQ ID NO: 656083 - DNA, 20 bp, mouse
ggacaccgcctacgtagcgc

SEQ ID NO: 656084 - DNA, 20 bp, mouse
ggacagagacatcgagtcgg

SEQ ID NO: 656085 - DNA, 20 bp, mouse
ggcaaacgcgcgtgtttcat

SEQ ID NO: 656086 - DNA, 20 bp, mouse
gtccaccccacccccgagtg

SEQ ID NO: 656087 - DNA, 20 bp, mouse
ggaattgcgaccgcactcgg

SEQ ID NO: 656088 - DNA, 20 bp, mouse
gacaccaagggccacgcgtg

SEQ ID NO: 656089 - DNA, 20 bp, mouse
gccgcacgcgcgcctttaaa

SEQ ID NO: 656090 - DNA, 20 bp, mouse
gcgcttcctggacccagact

SEQ ID NO: 656091 - DNA, 20 bp, mouse
gcatctctacacctgcgccg

SEQ ID NO: 656092 - DNA, 20 bp, mouse
gtctcagcacacacacacgg

SEQ ID NO: 656093 - DNA, 20 bp, mouse
gcacgcgcgcctttaaaagg

SEQ ID NO: 656094 - DNA, 20 bp, mouse
gtgtagagatgagccgagtc

SEQ ID NO: 656095 - DNA, 20 bp, mouse
gatgagccgagtctgggtcc

SEQ ID NO: 656096 - DNA, 20 bp, mouse
gtgtgattgggccaagtgag

SEQ ID NO: 656097 - DNA, 20 bp, mouse
gaggcgggatcgagcgctac

SEQ ID NO: 656098 - DNA, 20 bp, mouse
gcataaggagcgtgcgcgac

SEQ ID NO: 656099 - DNA, 20 bp, mouse
gacgctccttatgagaaagg

SEQ ID NO: 656100 - DNA, 20 bp, mouse
ggcccctcccagatcgttga

SEQ ID NO: 656101 - DNA, 20 bp, mouse
ggtacagccaaccagcgaaa

SEQ ID NO: 656102 - DNA, 20 bp, mouse
ggccccgccctcaacgatct

SEQ ID NO: 656103 - DNA, 20 bp, mouse
gcacagacgagtatgtgaga

SEQ ID NO: 656104 - DNA, 20 bp, mouse
gcgccctcaacgatctggga

SEQ ID NO: 656105 - DNA, 20 bp, mouse
gctacttggttcagccagtc

SEQ ID NO: 656106 - DNA, 20 bp, mouse
gttccccaatagtgcatcct

SEQ ID NO: 656107 - DNA, 20 bp, mouse
ggcactattggggaaggtgg

SEQ ID NO: 656108 - DNA, 20 bp, mouse
gttcccaggatgcactattg

SEQ ID NO: 656109 - DNA, 20 bp, mouse
gttacgggaagttaccctat

SEQ ID NO: 656110 - DNA, 20 bp, mouse
gggaaagttcacattcaaca

SEQ ID NO: 656111 - DNA, 20 bp, mouse
gtgtgcagcagtcacccaat

SEQ ID NO: 656112 - DNA, 20 bp, mouse
gtgctgcacacacttaacta

SEQ ID NO: 656113 - DNA, 20 bp, mouse
gaggacacgtgtagaaacag

SEQ ID NO: 656114 - DNA, 20 bp, mouse
gtagctagtgagccctttac

SEQ ID NO: 656115 - DNA, 20 bp, mouse
gaaagtcatgcccggtggga

SEQ ID NO: 656116 - DNA, 20 bp, mouse
gtcgacgtcagcaattgggg

SEQ ID NO: 656117 - DNA, 20 bp, mouse
gtggtcgacgtcagcaattg

SEQ ID NO: 656118 - DNA, 20 bp, mouse
gtagcggcgtagttggcgat

SEQ ID NO: 656119 - DNA, 20 bp, mouse
gcggaggcgaacgtgatgaa

SEQ ID NO: 656120 - DNA, 20 bp, mouse
gcgggcgggaggtgcaagac

SEQ ID NO: 656121 - DNA, 20 bp, mouse
gacgtcagcaattggggcgg

SEQ ID NO: 656122 - DNA, 20 bp, mouse
ggggccacctgctctaaccg

SEQ ID NO: 656123 - DNA, 20 bp, mouse
gcccgccggcccacaacgac

SEQ ID NO: 656124 - DNA, 20 bp, mouse
gggtcacgagatgaagggta

SEQ ID NO: 656125 - DNA, 20 bp, mouse
gcacagtgaggcttactccc

SEQ ID NO: 656126 - DNA, 20 bp, mouse
gtgccgcagtgcagagtcta

SEQ ID NO: 656127 - DNA, 20 bp, mouse
gccccatagactctgcactg

SEQ ID NO: 656128 - DNA, 20 bp, mouse
gagagagaaaggattctgat

SEQ ID NO: 656129 - DNA, 20 bp, mouse
gtgcagagtctatggggctc

SEQ ID NO: 656130 - DNA, 20 bp, mouse
gtgagatgaaatcatctcgg

SEQ ID NO: 656131 - DNA, 20 bp, mouse
gggactcgacggtggcgtgg

SEQ ID NO: 656132 - DNA, 20 bp, mouse
ggggatagaaatcacaacgc

SEQ ID NO: 656133 - DNA, 20 bp, mouse
gcgggggcgggactcgacgg

SEQ ID NO: 656134 - DNA, 20 bp, mouse
gatggggctcgggcgagtcc

SEQ ID NO: 656135 - DNA, 20 bp, mouse
gccgaggataatagagagaa

SEQ ID NO: 656136 - DNA, 20 bp, mouse
ggcgcaggggtcacccaatt

SEQ ID NO: 656137 - DNA, 20 bp, mouse
gctgcctcttgtgtgcagat

SEQ ID NO: 656138 - DNA, 20 bp, mouse
ggaaccggaaccggctgcgg

SEQ ID NO: 656139 - DNA, 20 bp, mouse
gaggcaggatttccctaatt

SEQ ID NO: 656140 - DNA, 20 bp, mouse
ggcgtggcgggtggttgtgg

SEQ ID NO: 656141 - DNA, 20 bp, mouse
gccaccgccgcagccggttc

SEQ ID NO: 656142 - DNA, 20 bp, mouse
gtgcggtgggcggttccccg

SEQ ID NO: 656143 - DNA, 20 bp, mouse
ggcggaaccggaaccggctg

SEQ ID NO: 656144 - DNA, 20 bp, mouse
gacgcctacaatcctggtcc

SEQ ID NO: 656145 - DNA, 20 bp, mouse
gaaaagtagctggtcgtagt

SEQ ID NO: 656146 - DNA, 20 bp, mouse
gaggtgcaagtgtgcctgga

SEQ ID NO: 656147 - DNA, 20 bp, mouse
gcacacttgcacctgtgctt

SEQ ID NO: 656148 - DNA, 20 bp, mouse
gaacgtagactagtgtcctg

SEQ ID NO: 656149 - DNA, 20 bp, mouse
gagactagtgtcctggggac

SEQ ID NO: 656150 - DNA, 20 bp, mouse
gtggggactggcttggttac

SEQ ID NO: 656151 - DNA, 20 bp, mouse
ggagcaagagccctggtgtg

SEQ ID NO: 656152 - DNA, 20 bp, mouse
ggggaattactggttttggc

SEQ ID NO: 656153 - DNA, 20 bp, mouse
ggacactagtctacgttggc

SEQ ID NO: 656154 - DNA, 20 bp, mouse
gctaagaatccaggatgaaa

SEQ ID NO: 656155 - DNA, 20 bp, mouse
ggagccctggtgtggggaaa

SEQ ID NO: 656156 - DNA, 20 bp, mouse
ggacccccgcgcacagtggc

SEQ ID NO: 656157 - DNA, 20 bp, mouse
ggggagtccggtgggaagtt

SEQ ID NO: 656158 - DNA, 20 bp, mouse
gcggaaggatctgcagtgat

SEQ ID NO: 656159 - DNA, 20 bp, mouse
gggagagccagtacctgtca

SEQ ID NO: 656160 - DNA, 20 bp, mouse
ggttagggaaccagcagcgc

SEQ ID NO: 656161 - DNA, 20 bp, mouse
gcaagcagaaggaactaggc

SEQ ID NO: 656162 - DNA, 20 bp, mouse
gatgccgcggagcactgtgg

SEQ ID NO: 656163 - DNA, 20 bp, mouse
gagccagccactgtgcgcgg

SEQ ID NO: 656164 - DNA, 20 bp, mouse
gcaaccaccacagtgctccg

SEQ ID NO: 656165 - DNA, 20 bp, mouse
ggtggtggttgtagtttcgt

SEQ ID NO: 656166 - DNA, 20 bp, mouse
ggggccctggcaccagtcct

SEQ ID NO: 656167 - DNA, 20 bp, mouse
gcgcgggccagcgaagaccc

SEQ ID NO: 656168 - DNA, 20 bp, mouse
ggccagcgaagacccaggca

SEQ ID NO: 656169 - DNA, 20 bp, mouse
ggcgcagccgcagtgaaggt

SEQ ID NO: 656170 - DNA, 20 bp, mouse
gaacacgggtactcgaacac

SEQ ID NO: 656171 - DNA, 20 bp, mouse
gagggcccataaattgtcca

SEQ ID NO: 656172 - DNA, 20 bp, mouse
ggtggggcgtggtattcctg

SEQ ID NO: 656173 - DNA, 20 bp, mouse
gtatgctaatatgagcgcta

SEQ ID NO: 656174 - DNA, 20 bp, mouse
gggtgactacagaacaccta

SEQ ID NO: 656175 - DNA, 20 bp, mouse
gcaaagtggtacagcccgtg

SEQ ID NO: 656176 - DNA, 20 bp, mouse
gtggtggtgctaataccctc

SEQ ID NO: 656177 - DNA, 20 bp, mouse
gttactctggagtgcccgac

SEQ ID NO: 656178 - DNA, 20 bp, mouse
gagggcagttatagccggtc

SEQ ID NO: 656179 - DNA, 20 bp, mouse
gctctccgctaggcgctcca

SEQ ID NO: 656180 - DNA, 20 bp, mouse
ggtagggcctggctcttaaa

SEQ ID NO: 656181 - DNA, 20 bp, mouse
ggcgcctgcgcactaaggaa

SEQ ID NO: 656182 - DNA, 20 bp, mouse
gccgggagggcagttatagc

SEQ ID NO: 656183 - DNA, 20 bp, mouse
gcgcacgcaactagactccc

SEQ ID NO: 656184 - DNA, 20 bp, mouse
gggcccacctcgcatcctga

SEQ ID NO: 656185 - DNA, 20 bp, mouse
gcgccgcgtcagctgatccg

SEQ ID NO: 656186 - DNA, 20 bp, mouse
gtacaacaacctggtgtcac

SEQ ID NO: 656187 - DNA, 20 bp, mouse
ggcaaaactgggcatgacct

SEQ ID NO: 656188 - DNA, 20 bp, mouse
ggagagaatttgctgtcagg

SEQ ID NO: 656189 - DNA, 20 bp, mouse
gcaacagtgagtcagtccaa

SEQ ID NO: 656190 - DNA, 20 bp, mouse
gccctggtccgggaaagtgt

SEQ ID NO: 656191 - DNA, 20 bp, mouse
gctggtgtcactggcaaaac

SEQ ID NO: 656192 - DNA, 20 bp, mouse
gtgttgactgcctctgaaac

SEQ ID NO: 656193 - DNA, 20 bp, mouse
gctggatagcaactgaacac

SEQ ID NO: 656194 - DNA, 20 bp, mouse
gcatgaccttggactgtgca

SEQ ID NO: 656195 - DNA, 20 bp, mouse
gtccaatggtttgagtgcac

SEQ ID NO: 656196 - DNA, 20 bp, mouse
gagggcggggctctagtcta

SEQ ID NO: 656197 - DNA, 20 bp, mouse
ggaacctccagccaccgggg

SEQ ID NO: 656198 - DNA, 20 bp, mouse
gcacccggaagtgtcaacag

SEQ ID NO: 656199 - DNA, 20 bp, mouse
gtcccctccccggtggctgg

SEQ ID NO: 656200 - DNA, 20 bp, mouse
ggagactagccaggtaaggg

SEQ ID NO: 656201 - DNA, 20 bp, mouse
gctggctagtctcaaggctg

SEQ ID NO: 656202 - DNA, 20 bp, mouse
gctcaaggctgtggttccat

SEQ ID NO: 656203 - DNA, 20 bp, mouse
ggtgagtagttcatgggcta

SEQ ID NO: 656204 - DNA, 20 bp, mouse
gctagagccccgcccttacc

SEQ ID NO: 656205 - DNA, 20 bp, mouse
gggggctctagtctaagggg

SEQ ID NO: 656206 - DNA, 20 bp, mouse
gtggctggggacaggattgg

SEQ ID NO: 656207 - DNA, 20 bp, mouse
gaggtggctggggacaggat

SEQ ID NO: 656208 - DNA, 20 bp, mouse
gacccagccaatcaaaggaa

SEQ ID NO: 656209 - DNA, 20 bp, mouse
gaatcaaaggaaaggttcct

SEQ ID NO: 656210 - DNA, 20 bp, mouse
gcaggtgcaagtctcggcag

SEQ ID NO: 656211 - DNA, 20 bp, mouse
gtcccagcggacgatgttca

SEQ ID NO: 656212 - DNA, 20 bp, mouse
gaaagcctccgttctggtta

SEQ ID NO: 656213 - DNA, 20 bp, mouse
ggggctgtgcgcatgcgcaa

SEQ ID NO: 656214 - DNA, 20 bp, mouse
gcagaagctgggcatctcca

SEQ ID NO: 656215 - DNA, 20 bp, mouse
ggcagtgctcgggcagccca

SEQ ID NO: 656216 - DNA, 20 bp, mouse
ggacgctaagtcacgctcta

SEQ ID NO: 656217 - DNA, 20 bp, mouse
gcgtgacgggcgaggggaag

SEQ ID NO: 656218 - DNA, 20 bp, mouse
gttactggggccttagaggc

SEQ ID NO: 656219 - DNA, 20 bp, mouse
gcagaagacgaggatggcaa

SEQ ID NO: 656220 - DNA, 20 bp, mouse
gacagtacagaagacgagga

SEQ ID NO: 656221 - DNA, 20 bp, mouse
ggccatgagtcccgcctcta

SEQ ID NO: 656222 - DNA, 20 bp, mouse
gccgtcacgccgcgtctcgc

SEQ ID NO: 656223 - DNA, 20 bp, mouse
gggaccgccttggatgtgaa

SEQ ID NO: 656224 - DNA, 20 bp, mouse
gaactacagtacagaagacg

SEQ ID NO: 656225 - DNA, 20 bp, mouse
gacgcggcgtgacgggcgag

SEQ ID NO: 656226 - DNA, 20 bp, mouse
gccagctcccaaggtttctc

SEQ ID NO: 656227 - DNA, 20 bp, mouse
gtccctgtttacagtcaacc

SEQ ID NO: 656228 - DNA, 20 bp, mouse
gagaccaaggagtcatacag

SEQ ID NO: 656229 - DNA, 20 bp, mouse
gtggtatgcgccagctccca

SEQ ID NO: 656230 - DNA, 20 bp, mouse
gcaagctttcaggactgagt

SEQ ID NO: 656231 - DNA, 20 bp, mouse
gtgccaggttgactgtaaac

SEQ ID NO: 656232 - DNA, 20 bp, mouse
gtgcaatgaaggacggagca

SEQ ID NO: 656233 - DNA, 20 bp, mouse
ggagtgggggcagccactac

SEQ ID NO: 656234 - DNA, 20 bp, mouse
gactatggaaactgcactga

SEQ ID NO: 656235 - DNA, 20 bp, mouse
gctgccaggtacagggcatg

SEQ ID NO: 656236 - DNA, 20 bp, mouse
gtgctgggagcgcggatctg

SEQ ID NO: 656237 - DNA, 20 bp, mouse
gccgcccccagactcgtgac

SEQ ID NO: 656238 - DNA, 20 bp, mouse
gagctccagtcacgagtctg

SEQ ID NO: 656239 - DNA, 20 bp, mouse
ggggagctgaccagagtgct

SEQ ID NO: 656240 - DNA, 20 bp, mouse
gcgcgcatgctaggcgcata

SEQ ID NO: 656241 - DNA, 20 bp, mouse
gcatgcgcgcttcgaagctg

SEQ ID NO: 656242 - DNA, 20 bp, mouse
gcgtgactggagctctgcgg

SEQ ID NO: 656243 - DNA, 20 bp, mouse
gcgggaaaagagaagcgaaa

SEQ ID NO: 656244 - DNA, 20 bp, mouse
gggagcgcggatctgaggct

SEQ ID NO: 656245 - DNA, 20 bp, mouse
ggggcgccgccgagagggcg

SEQ ID NO: 656246 - DNA, 20 bp, mouse
ggccaggcctccggagaagg

SEQ ID NO: 656247 - DNA, 20 bp, mouse
gcctccagatgcacctgcgg

SEQ ID NO: 656248 - DNA, 20 bp, mouse
ggcagagcgggcttccgggt

SEQ ID NO: 656249 - DNA, 20 bp, mouse
gtcagccccgccttctccgg

SEQ ID NO: 656250 - DNA, 20 bp, mouse
ggctcctccagatgcacctg

SEQ ID NO: 656251 - DNA, 20 bp, mouse
gagcgcgcagagcgggcttc

SEQ ID NO: 656252 - DNA, 20 bp, mouse
gcaaccaccgcaggtgcatc

SEQ ID NO: 656253 - DNA, 20 bp, mouse
gactgcgcgcaatcacgatg

SEQ ID NO: 656254 - DNA, 20 bp, mouse
gagggtgggcgggaattttc

SEQ ID NO: 656255 - DNA, 20 bp, mouse
gccaccctaaaattacccac

SEQ ID NO: 656256 - DNA, 20 bp, mouse
ggatacaagtagatgcaggg

SEQ ID NO: 656257 - DNA, 20 bp, mouse
gacaccgacacggacatcaa

SEQ ID NO: 656258 - DNA, 20 bp, mouse
gtggacccaagctcaagctc

SEQ ID NO: 656259 - DNA, 20 bp, mouse
gtcccagctaccaccaactc

SEQ ID NO: 656260 - DNA, 20 bp, mouse
gccacgcgcagaagggatca

SEQ ID NO: 656261 - DNA, 20 bp, mouse
gctccggaaagacactatgc

SEQ ID NO: 656262 - DNA, 20 bp, mouse
ggccgcggtgaagtgggaat

SEQ ID NO: 656263 - DNA, 20 bp, mouse
gtgcggatggagatcgggtc

SEQ ID NO: 656264 - DNA, 20 bp, mouse
gcctcccttgatgtccgtgt

SEQ ID NO: 656265 - DNA, 20 bp, mouse
ggctaaacccacgcgcagaa

SEQ ID NO: 656266 - DNA, 20 bp, mouse
gcctccctccggcgagtcgc

SEQ ID NO: 656267 - DNA, 20 bp, mouse
gcccacttccggttcctgtt

SEQ ID NO: 656268 - DNA, 20 bp, mouse
gaggaaccggaagtgggaac

SEQ ID NO: 656269 - DNA, 20 bp, mouse
gggcacccagcacgctctga

SEQ ID NO: 656270 - DNA, 20 bp, mouse
ggtggagagacccggaattc

SEQ ID NO: 656271 - DNA, 20 bp, mouse
gcggggccggtcacctgaag

SEQ ID NO: 656272 - DNA, 20 bp, mouse
ggagacggaatgcccggatg

SEQ ID NO: 656273 - DNA, 20 bp, mouse
gacgctctgagggatgggtc

SEQ ID NO: 656274 - DNA, 20 bp, mouse
gtatgggcggtgtgaaccaa

SEQ ID NO: 656275 - DNA, 20 bp, mouse
gagggcgctgtgacgaatgg

SEQ ID NO: 656276 - DNA, 20 bp, mouse
gtgcgcatgcgcctgggaaa

SEQ ID NO: 656277 - DNA, 20 bp, mouse
gggcacagttctcgatctat

SEQ ID NO: 656278 - DNA, 20 bp, mouse
ggcccgcggaagttctgcct

SEQ ID NO: 656279 - DNA, 20 bp, mouse
gagccaaggcagaacttccg

SEQ ID NO: 656280 - DNA, 20 bp, mouse
gcccgcttccggttccggct

SEQ ID NO: 656281 - DNA, 20 bp, mouse
gtaaaccccgcttccggttc

SEQ ID NO: 656282 - DNA, 20 bp, mouse
gagatcgagaactgtgcccg

SEQ ID NO: 656283 - DNA, 20 bp, mouse
gacaaaaatccctagtcggg

SEQ ID NO: 656284 - DNA, 20 bp, mouse
gaaactgactcgtgactgct

SEQ ID NO: 656285 - DNA, 20 bp, mouse
ggttccggcttggtgaccaa

SEQ ID NO: 656286 - DNA, 20 bp, mouse
gagtccgagagagggttcct

SEQ ID NO: 656287 - DNA, 20 bp, mouse
gagctggccagccctccgaa

SEQ ID NO: 656288 - DNA, 20 bp, mouse
gagccagtctaccccttcgg

SEQ ID NO: 656289 - DNA, 20 bp, mouse
gacaagcccagccacagtcc

SEQ ID NO: 656290 - DNA, 20 bp, mouse
gccacaaagagtccgagaga

SEQ ID NO: 656291 - DNA, 20 bp, mouse
ggccctccgaaggggtagac

SEQ ID NO: 656292 - DNA, 20 bp, mouse
gctgccgtgctggtgggtca

SEQ ID NO: 656293 - DNA, 20 bp, mouse
gcagagccagtctacccctt

SEQ ID NO: 656294 - DNA, 20 bp, mouse
ggggaagcccaccccagagt

SEQ ID NO: 656295 - DNA, 20 bp, mouse
gggactctttgtggcagagc

SEQ ID NO: 656296 - DNA, 20 bp, mouse
ggggaactgcgcatgactga

SEQ ID NO: 656297 - DNA, 20 bp, mouse
gagcgtcacaggcctctctc

SEQ ID NO: 656298 - DNA, 20 bp, mouse
gtctgggagacgtagttctg

SEQ ID NO: 656299 - DNA, 20 bp, mouse
gactgcgcatgactgaaggg

SEQ ID NO: 656300 - DNA, 20 bp, mouse
gctaaatgcgcatgcccggg

SEQ ID NO: 656301 - DNA, 20 bp, mouse
gcaagagtacgcagattaag

SEQ ID NO: 656302 - DNA, 20 bp, mouse
gaatgcgcatgcccgggagg

SEQ ID NO: 656303 - DNA, 20 bp, mouse
gaagggcggggtctctgcgg

SEQ ID NO: 656304 - DNA, 20 bp, mouse
gtacactgcaagttcaagtc

SEQ ID NO: 656305 - DNA, 20 bp, mouse
gttcaagtccggcctgagat

SEQ ID NO: 656306 - DNA, 20 bp, mouse
ggggcggggcgggtgagacg

SEQ ID NO: 656307 - DNA, 20 bp, mouse
gtctcaatgcgcaggcgtag

SEQ ID NO: 656308 - DNA, 20 bp, mouse
gcgggtgagacggggcggcg

SEQ ID NO: 656309 - DNA, 20 bp, mouse
gacgcctgcgcattgagaga

SEQ ID NO: 656310 - DNA, 20 bp, mouse
gtgggcacactattaatttc

SEQ ID NO: 656311 - DNA, 20 bp, mouse
gtgggagtcaccggactcaa

SEQ ID NO: 656312 - DNA, 20 bp, mouse
gtagccatctctcaatgcgc

SEQ ID NO: 656313 - DNA, 20 bp, mouse
gagtctagctgggtgaagag

SEQ ID NO: 656314 - DNA, 20 bp, mouse
gaacccagcacacccgtgtc

SEQ ID NO: 656315 - DNA, 20 bp, mouse
gacgtgacaggactgccaca

SEQ ID NO: 656316 - DNA, 20 bp, mouse
ggggagcgctaagacccagt

SEQ ID NO: 656317 - DNA, 20 bp, mouse
gaagcggagggcagagtgtt

SEQ ID NO: 656318 - DNA, 20 bp, mouse
ggaggcgtggagacacagtt

SEQ ID NO: 656319 - DNA, 20 bp, mouse
ggggcctctccgtgtcacca

SEQ ID NO: 656320 - DNA, 20 bp, mouse
gggtgtgaggagatcttggt

SEQ ID NO: 656321 - DNA, 20 bp, mouse
gacagacacccacccggtgc

SEQ ID NO: 656322 - DNA, 20 bp, mouse
ggcaggagactgagtgaaaa

SEQ ID NO: 656323 - DNA, 20 bp, mouse
gtctgtggaccctggtgaca

SEQ ID NO: 656324 - DNA, 20 bp, mouse
ggccctcgggcggccgtttc

SEQ ID NO: 656325 - DNA, 20 bp, mouse
gggtctctgctgccctcggg

SEQ ID NO: 656326 - DNA, 20 bp, mouse
gtgagctcaaggaggaatcc

SEQ ID NO: 656327 - DNA, 20 bp, mouse
gggatgccaaggtgagctca

SEQ ID NO: 656328 - DNA, 20 bp, mouse
gtgccaaggtgagctcaagg

SEQ ID NO: 656329 - DNA, 20 bp, mouse
gtcagcaacaggtcagtatt

SEQ ID NO: 656330 - DNA, 20 bp, mouse
gcggtggaagctgggagata

SEQ ID NO: 656331 - DNA, 20 bp, mouse
gcaggtcagtattgggatgt

SEQ ID NO: 656332 - DNA, 20 bp, mouse
gtgaaaggcaattcagcaac

SEQ ID NO: 656333 - DNA, 20 bp, mouse
gtgttccaaacttgcctgat

SEQ ID NO: 656334 - DNA, 20 bp, mouse
gtagaaaaggaagaccatta

SEQ ID NO: 656335 - DNA, 20 bp, mouse
gaaataggtaggacatctct

SEQ ID NO: 656336 - DNA, 20 bp, mouse
ggcagagctcgccaccctgc

SEQ ID NO: 656337 - DNA, 20 bp, mouse
gttgaagtgaccaagttaag

SEQ ID NO: 656338 - DNA, 20 bp, mouse
gtaacttggtcacttcaaac

SEQ ID NO: 656339 - DNA, 20 bp, mouse
ggcaccaaatggcctttccc

SEQ ID NO: 656340 - DNA, 20 bp, mouse
gcgagagcgcccaaaactgc

SEQ ID NO: 656341 - DNA, 20 bp, mouse
gcggcttccgccctcagctg

SEQ ID NO: 656342 - DNA, 20 bp, mouse
gtttcccaggccacttaact

SEQ ID NO: 656343 - DNA, 20 bp, mouse
gttggcaccagtggcctgca

SEQ ID NO: 656344 - DNA, 20 bp, mouse
gcgcacgtgaccgcagctga

SEQ ID NO: 656345 - DNA, 20 bp, mouse
gacgtgaccgcagctgaggg

SEQ ID NO: 656346 - DNA, 20 bp, mouse
ggagggcggggcgactttgt

SEQ ID NO: 656347 - DNA, 20 bp, mouse
gtaggcgcttgcagtcgcct

SEQ ID NO: 656348 - DNA, 20 bp, mouse
gagaatgcatgcgtgcacca

SEQ ID NO: 656349 - DNA, 20 bp, mouse
gcccggaagctgggccgact

SEQ ID NO: 656350 - DNA, 20 bp, mouse
ggggctgggaaagccgtcga

SEQ ID NO: 656351 - DNA, 20 bp, mouse
gccctggcatcgcccggaag

SEQ ID NO: 656352 - DNA, 20 bp, mouse
ggcactggggttgggagcct

SEQ ID NO: 656353 - DNA, 20 bp, mouse
gacaaacgcaacaaaacgga

SEQ ID NO: 656354 - DNA, 20 bp, mouse
ggcggcagctcctccctcga

SEQ ID NO: 656355 - DNA, 20 bp, mouse
gcctccgaggcccccacttc

SEQ ID NO: 656356 - DNA, 20 bp, mouse
ggggctgggcgccctcaagg

SEQ ID NO: 656357 - DNA, 20 bp, mouse
gccgcggtgcgctgcagata

SEQ ID NO: 656358 - DNA, 20 bp, mouse
gcctcccattgggtcccaac

SEQ ID NO: 656359 - DNA, 20 bp, mouse
gtggtggcctgagctcacga

SEQ ID NO: 656360 - DNA, 20 bp, mouse
ggtggttcctggggaacaca

SEQ ID NO: 656361 - DNA, 20 bp, mouse
ggaaagagcggactctgtac

SEQ ID NO: 656362 - DNA, 20 bp, mouse
gacccaatgggaggtccggg

SEQ ID NO: 656363 - DNA, 20 bp, mouse
ggcagcggcgtggcccaagt

SEQ ID NO: 656364 - DNA, 20 bp, mouse
ggggacccaatgggaggtcc

SEQ ID NO: 656365 - DNA, 20 bp, mouse
gaccccgcgccccgctactg

SEQ ID NO: 656366 - DNA, 20 bp, mouse
gcctcaaggagggccgaggt

SEQ ID NO: 656367 - DNA, 20 bp, mouse
gtcggaccgtaccatccgcg

SEQ ID NO: 656368 - DNA, 20 bp, mouse
gcggatggtacggtccgaac

SEQ ID NO: 656369 - DNA, 20 bp, mouse
ggatcgaagtcccctccccg

SEQ ID NO: 656370 - DNA, 20 bp, mouse
gctccaggtcccgcccagtt

SEQ ID NO: 656371 - DNA, 20 bp, mouse
ggtcacccacagagtctcag

SEQ ID NO: 656372 - DNA, 20 bp, mouse
ggcagaggagcgggctcgag

SEQ ID NO: 656373 - DNA, 20 bp, mouse
ggacttcgatctagcattct

SEQ ID NO: 656374 - DNA, 20 bp, mouse
gtggtacggtccgaactggg

SEQ ID NO: 656375 - DNA, 20 bp, mouse
gacagggccgccgagcctcc

SEQ ID NO: 656376 - DNA, 20 bp, mouse
ggaaccttcgccacgaatcc

SEQ ID NO: 656377 - DNA, 20 bp, mouse
gacgaatccaggttgggatg

SEQ ID NO: 656378 - DNA, 20 bp, mouse
gccggcctcctgaaggtcca

SEQ ID NO: 656379 - DNA, 20 bp, mouse
gtggcagcccagagcgagat

SEQ ID NO: 656380 - DNA, 20 bp, mouse
ggggcctcacaggttcaggg

SEQ ID NO: 656381 - DNA, 20 bp, mouse
ggtggggcctcacaggttca

SEQ ID NO: 656382 - DNA, 20 bp, mouse
gggtccacccggcctcctga

SEQ ID NO: 656383 - DNA, 20 bp, mouse
ggccccgccgtggacctgtg

SEQ ID NO: 656384 - DNA, 20 bp, mouse
ggggcctcacaggtccacgg

SEQ ID NO: 656385 - DNA, 20 bp, mouse
ggctgcgagcaggctgcaag

SEQ ID NO: 656386 - DNA, 20 bp, mouse
gtccgtgcgcccttcctagg

SEQ ID NO: 656387 - DNA, 20 bp, mouse
ggaggcgagaggctcctccc

SEQ ID NO: 656388 - DNA, 20 bp, mouse
gccctcccccgggtggagag

SEQ ID NO: 656389 - DNA, 20 bp, mouse
gcgggcagagcggagggaaa

SEQ ID NO: 656390 - DNA, 20 bp, mouse
ggagtcgcggccaactggac

SEQ ID NO: 656391 - DNA, 20 bp, mouse
gctggcgcggtcaccgaccc

SEQ ID NO: 656392 - DNA, 20 bp, mouse
gtctgcccgaccggacaaac

SEQ ID NO: 656393 - DNA, 20 bp, mouse
gaggctgggccgccaggcct

SEQ ID NO: 656394 - DNA, 20 bp, mouse
gaaagatcggtcacagtcag

SEQ ID NO: 656395 - DNA, 20 bp, mouse
ggctgccagggggaggcgag

SEQ ID NO: 656396 - DNA, 20 bp, mouse
ggacacgcacacaatcggcg

SEQ ID NO: 656397 - DNA, 20 bp, mouse
gcctccccgaagatggtttc

SEQ ID NO: 656398 - DNA, 20 bp, mouse
gcggcgaggctggaggacgc

SEQ ID NO: 656399 - DNA, 20 bp, mouse
gcatcttggtgcgtagggaa

SEQ ID NO: 656400 - DNA, 20 bp, mouse
gtcaggctcctccccgaaga

SEQ ID NO: 656401 - DNA, 20 bp, mouse
gtcggggaggagcctgatgc

SEQ ID NO: 656402 - DNA, 20 bp, mouse
ggccgggacacgcacacaat

SEQ ID NO: 656403 - DNA, 20 bp, mouse
gacacaatcggcgaggctgg

SEQ ID NO: 656404 - DNA, 20 bp, mouse
ggctagagagaagtgtgcta

SEQ ID NO: 656405 - DNA, 20 bp, mouse
gcgtgtcccggctggagctt

SEQ ID NO: 656406 - DNA, 20 bp, mouse
ggcggtccgctctcccgcat

SEQ ID NO: 656407 - DNA, 20 bp, mouse
gggaaaccgaggactccggt

SEQ ID NO: 656408 - DNA, 20 bp, mouse
gcggaccgcccgcgttgtcc

SEQ ID NO: 656409 - DNA, 20 bp, mouse
gcccgcgttgtccaggacaa

SEQ ID NO: 656410 - DNA, 20 bp, mouse
gccgctctcccgcattggct

SEQ ID NO: 656411 - DNA, 20 bp, mouse
gctcccgcattggctgggag

SEQ ID NO: 656412 - DNA, 20 bp, mouse
gcgcgggaaaccgaggactc

SEQ ID NO: 656413 - DNA, 20 bp, mouse
gggaagaggaaggactagta

SEQ ID NO: 656414 - DNA, 20 bp, mouse
gaggcaagaagtgggtctct

SEQ ID NO: 656415 - DNA, 20 bp, mouse
gaagcctgccagtgccgcgt

SEQ ID NO: 656416 - DNA, 20 bp, mouse
ggggtgtggtcaggtctcgt

SEQ ID NO: 656417 - DNA, 20 bp, mouse
gggaccaggcgacaggggcg

SEQ ID NO: 656418 - DNA, 20 bp, mouse
gcagccacgcccacaactcc

SEQ ID NO: 656419 - DNA, 20 bp, mouse
ggggcggaggcatgagtcaa

SEQ ID NO: 656420 - DNA, 20 bp, mouse
gtggctgagtcttcggggtg

SEQ ID NO: 656421 - DNA, 20 bp, mouse
ggagtcttcggggtgtggtc

SEQ ID NO: 656422 - DNA, 20 bp, mouse
gcaggggcggggcctggaga

SEQ ID NO: 656423 - DNA, 20 bp, mouse
gcctagttgaatggcacaga

SEQ ID NO: 656424 - DNA, 20 bp, mouse
gttgaatggcacagagggta

SEQ ID NO: 656425 - DNA, 20 bp, mouse
ggggcggggcattgcgaagg

SEQ ID NO: 656426 - DNA, 20 bp, mouse
ggcactctagactgtatttg

SEQ ID NO: 656427 - DNA, 20 bp, mouse
gtccgagaggaacagtacca

SEQ ID NO: 656428 - DNA, 20 bp, mouse
gaccctggtactgttcctct

SEQ ID NO: 656429 - DNA, 20 bp, mouse
gggaacagtaccagggtttg

SEQ ID NO: 656430 - DNA, 20 bp, mouse
ggagtgccatcgactccgag

SEQ ID NO: 656431 - DNA, 20 bp, mouse
ggggtggggccgtggttaca

SEQ ID NO: 656432 - DNA, 20 bp, mouse
gcaggcatgtgtcagatatc

SEQ ID NO: 656433 - DNA, 20 bp, mouse
gacacataggaagtggcttg

SEQ ID NO: 656434 - DNA, 20 bp, mouse
gagggcccttcagcatgtgt

SEQ ID NO: 656435 - DNA, 20 bp, mouse
gttacatggctatacttata

SEQ ID NO: 656436 - DNA, 20 bp, mouse
gactgaaaggtagtgtggaa

SEQ ID NO: 656437 - DNA, 20 bp, mouse
ggatctgaggatttcatctc

SEQ ID NO: 656438 - DNA, 20 bp, mouse
gcatgcagttagcccctgga

SEQ ID NO: 656439 - DNA, 20 bp, mouse
gaatgaggggagaataacaa

SEQ ID NO: 656440 - DNA, 20 bp, mouse
ggctaactgcatgctaatga

SEQ ID NO: 656441 - DNA, 20 bp, mouse
ggagtcctaaatccctgaga

SEQ ID NO: 656442 - DNA, 20 bp, mouse
gtctgcagaaaggggcgtgg

SEQ ID NO: 656443 - DNA, 20 bp, mouse
gcgtgctgcccagagttggt

SEQ ID NO: 656444 - DNA, 20 bp, mouse
gtcaggacttggccatctca

SEQ ID NO: 656445 - DNA, 20 bp, mouse
gtcacctctgggaagccatc

SEQ ID NO: 656446 - DNA, 20 bp, mouse
gtggccgcggcgtggaggtg

SEQ ID NO: 656447 - DNA, 20 bp, mouse
gaggagagaatgcccggggt

SEQ ID NO: 656448 - DNA, 20 bp, mouse
gcgagcaggagagaatgccc

SEQ ID NO: 656449 - DNA, 20 bp, mouse
gctcgcgcgcacggacacgg

SEQ ID NO: 656450 - DNA, 20 bp, mouse
ggcgcaggttgcagcagagg

SEQ ID NO: 656451 - DNA, 20 bp, mouse
gcggggtggggtgagtgcgg

SEQ ID NO: 656452 - DNA, 20 bp, mouse
gctctcctgctcgctccgag

SEQ ID NO: 656453 - DNA, 20 bp, mouse
gggaccccagcgcgaggcgc

SEQ ID NO: 656454 - DNA, 20 bp, mouse
ggcgcgcacggacacggcgg

SEQ ID NO: 656455 - DNA, 20 bp, mouse
gcagccccaaggggtcggag

SEQ ID NO: 656456 - DNA, 20 bp, mouse
gaaggatcgttccggaggtg

SEQ ID NO: 656457 - DNA, 20 bp, mouse
gcccgcgcggcgccatctga

SEQ ID NO: 656458 - DNA, 20 bp, mouse
ggaacagcgaaggatcgttc

SEQ ID NO: 656459 - DNA, 20 bp, mouse
gggcaacgccaatggaggcg

SEQ ID NO: 656460 - DNA, 20 bp, mouse
gttgaaaagggaagtgctta

SEQ ID NO: 656461 - DNA, 20 bp, mouse
gcagcgaaggatcgttccgg

SEQ ID NO: 656462 - DNA, 20 bp, mouse
gccggaggtgtggctacgat

SEQ ID NO: 656463 - DNA, 20 bp, mouse
gggggcggggcgccgccctg

SEQ ID NO: 656464 - DNA, 20 bp, mouse
gtgtggatagatggtttgta

SEQ ID NO: 656465 - DNA, 20 bp, mouse
gtggcgtcacagaacagcga

SEQ ID NO: 656466 - DNA, 20 bp, mouse
gtgagcgcgcggaacctcgg

SEQ ID NO: 656467 - DNA, 20 bp, mouse
gtgaatcctggcagactccc

SEQ ID NO: 656468 - DNA, 20 bp, mouse
gtcgtggcgcgtctcctccc

SEQ ID NO: 656469 - DNA, 20 bp, mouse
gcgcagaggctgctggtcgg

SEQ ID NO: 656470 - DNA, 20 bp, mouse
ggctgctggtcgggggtagg

SEQ ID NO: 656471 - DNA, 20 bp, mouse
gcgggtgctggagtggagaa

SEQ ID NO: 656472 - DNA, 20 bp, mouse
gggacaacgacgcttcgggc

SEQ ID NO: 656473 - DNA, 20 bp, mouse
ggttctgcccacccgctcta

SEQ ID NO: 656474 - DNA, 20 bp, mouse
gcgctcaaggttccgggtgc

SEQ ID NO: 656475 - DNA, 20 bp, mouse
gtagggggtggggtgaatcc

SEQ ID NO: 656476 - DNA, 20 bp, mouse
gacgtggcgcagagcgcgaa

SEQ ID NO: 656477 - DNA, 20 bp, mouse
gggcggacagagaaagcacg

SEQ ID NO: 656478 - DNA, 20 bp, mouse
gaggcgggagcaagctcacg

SEQ ID NO: 656479 - DNA, 20 bp, mouse
gtgtacccgcgagggcaagt

SEQ ID NO: 656480 - DNA, 20 bp, mouse
gacgcggcgcttccgcccat

SEQ ID NO: 656481 - DNA, 20 bp, mouse
gcggcgcttccgcccattgg

SEQ ID NO: 656482 - DNA, 20 bp, mouse
ggggaagggagacccagctc

SEQ ID NO: 656483 - DNA, 20 bp, mouse
gtggcgcgggcgcgctggag

SEQ ID NO: 656484 - DNA, 20 bp, mouse
gcccctccatgccgcgccac

SEQ ID NO: 656485 - DNA, 20 bp, mouse
gtgcagcttccaattggcgc

SEQ ID NO: 656486 - DNA, 20 bp, mouse
gagcgcgctaactgcgaggg

SEQ ID NO: 656487 - DNA, 20 bp, mouse
gaaaccgcgaatcaggaggg

SEQ ID NO: 656488 - DNA, 20 bp, mouse
gcggaaaccgcgaatcagga

SEQ ID NO: 656489 - DNA, 20 bp, mouse
gcggggaggtgggacgagca

SEQ ID NO: 656490 - DNA, 20 bp, mouse
ggaactgccaatctagacgc

SEQ ID NO: 656491 - DNA, 20 bp, mouse
gagcacggaaaccgcgaatc

SEQ ID NO: 656492 - DNA, 20 bp, mouse
gtggacggaaattgtgcagt

SEQ ID NO: 656493 - DNA, 20 bp, mouse
gagaacctgcgccccgcgat

SEQ ID NO: 656494 - DNA, 20 bp, mouse
gctctaacgcatcatgaccc

SEQ ID NO: 656495 - DNA, 20 bp, mouse
gtacacgatggcaagcccta

SEQ ID NO: 656496 - DNA, 20 bp, mouse
gctaggatctgggtcggaga

SEQ ID NO: 656497 - DNA, 20 bp, mouse
gggagagggcggagcgtcga

SEQ ID NO: 656498 - DNA, 20 bp, mouse
ggggaaatcccagaggcgac

SEQ ID NO: 656499 - DNA, 20 bp, mouse
ggaagccgtaagctaggatc

SEQ ID NO: 656500 - DNA, 20 bp, mouse
gccgccctctccaccggagg

SEQ ID NO: 656501 - DNA, 20 bp, mouse
gatcccagaggcgacagggg

SEQ ID NO: 656502 - DNA, 20 bp, mouse
gaccgagagcggcttccggg

SEQ ID NO: 656503 - DNA, 20 bp, mouse
ggggcgggcacgtccgctgt

SEQ ID NO: 656504 - DNA, 20 bp, mouse
gcggaagccgctctcggttg

SEQ ID NO: 656505 - DNA, 20 bp, mouse
gactcgcctgggagggaaag

SEQ ID NO: 656506 - DNA, 20 bp, mouse
gccgcccggggcacgagccg

SEQ ID NO: 656507 - DNA, 20 bp, mouse
ggggcagggcgggtgtagga

SEQ ID NO: 656508 - DNA, 20 bp, mouse
ggcgagcagcccgaacctgc

SEQ ID NO: 656509 - DNA, 20 bp, mouse
ggcgtggcctggtccgcccg

SEQ ID NO: 656510 - DNA, 20 bp, mouse
gctggcgcgtgacacgctgg

SEQ ID NO: 656511 - DNA, 20 bp, mouse
gcatgaccctcagcccggtg

SEQ ID NO: 656512 - DNA, 20 bp, mouse
ggctgcccgggcgtccgcac

SEQ ID NO: 656513 - DNA, 20 bp, mouse
gtgcgggcaaattacgcctc

SEQ ID NO: 656514 - DNA, 20 bp, mouse
gctcgtgccccgggcggacc

SEQ ID NO: 656515 - DNA, 20 bp, mouse
gccgcgagcaagcgcaggac

SEQ ID NO: 656516 - DNA, 20 bp, mouse
gtgtctgggctcagtacgaa

SEQ ID NO: 656517 - DNA, 20 bp, mouse
gacacgcaggagcctgtccc

SEQ ID NO: 656518 - DNA, 20 bp, mouse
ggtactgagcccagacacgc

SEQ ID NO: 656519 - DNA, 20 bp, mouse
ggggagacgctggaaggcga

SEQ ID NO: 656520 - DNA, 20 bp, mouse
ggctgggaagagcagacttg

SEQ ID NO: 656521 - DNA, 20 bp, mouse
gaacgctgcctgcttctcta

SEQ ID NO: 656522 - DNA, 20 bp, mouse
gaaccgcctcaggtgtggtc

SEQ ID NO: 656523 - DNA, 20 bp, mouse
gtgccacggggaaccgcctc

SEQ ID NO: 656524 - DNA, 20 bp, mouse
gtgcccgaccacacctgagg

SEQ ID NO: 656525 - DNA, 20 bp, mouse
gtagtaccctggcatcaccg

SEQ ID NO: 656526 - DNA, 20 bp, mouse
ggcggggctggcatgcgcgg

SEQ ID NO: 656527 - DNA, 20 bp, mouse
gtgggcacgccggaagacca

SEQ ID NO: 656528 - DNA, 20 bp, mouse
gcggggctcccgctgtgcgt

SEQ ID NO: 656529 - DNA, 20 bp, mouse
gttcatccgcgctaagaccc

SEQ ID NO: 656530 - DNA, 20 bp, mouse
gctcccgctgtgcgtcgggc

SEQ ID NO: 656531 - DNA, 20 bp, mouse
ggctgtgcgtcgggcagggg

SEQ ID NO: 656532 - DNA, 20 bp, mouse
gaacatcgcctagtctacgg

SEQ ID NO: 656533 - DNA, 20 bp, mouse
gagccactgtaaggaggtac

SEQ ID NO: 656534 - DNA, 20 bp, mouse
gggcgggtccatatccaagg

SEQ ID NO: 656535 - DNA, 20 bp, mouse
ggagccaggcagccactgta

SEQ ID NO: 656536 - DNA, 20 bp, mouse
gcctccccgcgtgctcctgt

SEQ ID NO: 656537 - DNA, 20 bp, mouse
gcaggctgctgcggtatctc

SEQ ID NO: 656538 - DNA, 20 bp, mouse
gttggacgcgcccatctcgg

SEQ ID NO: 656539 - DNA, 20 bp, mouse
gcgcgcgggagcccccgaga

SEQ ID NO: 656540 - DNA, 20 bp, mouse
gactgtgtctggaggacgga

SEQ ID NO: 656541 - DNA, 20 bp, mouse
gaccgcgcccggaccgaggg

SEQ ID NO: 656542 - DNA, 20 bp, mouse
gcggccacagcaactgtgtc

SEQ ID NO: 656543 - DNA, 20 bp, mouse
gcgctccggaggggacccga

SEQ ID NO: 656544 - DNA, 20 bp, mouse
gagtcccaggtccccgtcag

SEQ ID NO: 656545 - DNA, 20 bp, mouse
gaggctagcaggagtaccgc

SEQ ID NO: 656546 - DNA, 20 bp, mouse
gggaccccactaagaagagg

SEQ ID NO: 656547 - DNA, 20 bp, mouse
gaggtcagcagtaactgaac

SEQ ID NO: 656548 - DNA, 20 bp, mouse
gccactaagaagaggtggag

SEQ ID NO: 656549 - DNA, 20 bp, mouse
gtgggagcctgttgctaagg

SEQ ID NO: 656550 - DNA, 20 bp, mouse
gcgtcgaccgccttagcaac

SEQ ID NO: 656551 - DNA, 20 bp, mouse
gtatgtggaagtagagaggt

SEQ ID NO: 656552 - DNA, 20 bp, mouse
gtgctgacctcaaagtgtca

SEQ ID NO: 656553 - DNA, 20 bp, mouse
gggaccaagagcgcattttc

SEQ ID NO: 656554 - DNA, 20 bp, mouse
gatacatccctgacactttg

SEQ ID NO: 656555 - DNA, 20 bp, mouse
gaagcctcggcccaacaaaa

SEQ ID NO: 656556 - DNA, 20 bp, mouse
gaagtcggatccttgagctg

SEQ ID NO: 656557 - DNA, 20 bp, mouse
gctcaaggatccgacttcat

SEQ ID NO: 656558 - DNA, 20 bp, mouse
gccagcccgggtgcatagaa

SEQ ID NO: 656559 - DNA, 20 bp, mouse
gcgggtgcatagaagggtta

SEQ ID NO: 656560 - DNA, 20 bp, mouse
ggatccttgagctgcggcgg

SEQ ID NO: 656561 - DNA, 20 bp, mouse
gcagccaactgctccatatt

SEQ ID NO: 656562 - DNA, 20 bp, mouse
gtgagtgcagggtgcaactc

SEQ ID NO: 656563 - DNA, 20 bp, mouse
gagcgcgagagagagcgcga

SEQ ID NO: 656564 - DNA, 20 bp, mouse
ggcgctcgccgtgctctgtg

SEQ ID NO: 656565 - DNA, 20 bp, mouse
gcgccgggccgcctgccaga

SEQ ID NO: 656566 - DNA, 20 bp, mouse
ggacagaatactgagatgaa

SEQ ID NO: 656567 - DNA, 20 bp, mouse
gaatactgagatgaaggggt

SEQ ID NO: 656568 - DNA, 20 bp, mouse
gggagtaaagaccccgtcag

SEQ ID NO: 656569 - DNA, 20 bp, mouse
gcctgcgtagggtgggatgg

SEQ ID NO: 656570 - DNA, 20 bp, mouse
gagcaagggccaccattggt

SEQ ID NO: 656571 - DNA, 20 bp, mouse
ggtcttcggtccccacggtg

SEQ ID NO: 656572 - DNA, 20 bp, mouse
gaagtcccgcctgaggggag

SEQ ID NO: 656573 - DNA, 20 bp, mouse
gggaagtcctgctcctgcgt

SEQ ID NO: 656574 - DNA, 20 bp, mouse
gagactagctggcttgcctc

SEQ ID NO: 656575 - DNA, 20 bp, mouse
gaggacaaggcgacgcggca

SEQ ID NO: 656576 - DNA, 20 bp, mouse
gaacgcctgtcccactgaat

SEQ ID NO: 656577 - DNA, 20 bp, mouse
gtgggcccagaccttttcaa

SEQ ID NO: 656578 - DNA, 20 bp, mouse
gggggggcgctgggtacgat

SEQ ID NO: 656579 - DNA, 20 bp, mouse
gtgggagtgggtgagcaata

SEQ ID NO: 656580 - DNA, 20 bp, mouse
gactccctggacccattcag

SEQ ID NO: 656581 - DNA, 20 bp, mouse
gcggagagatgacgtcaccc

SEQ ID NO: 656582 - DNA, 20 bp, mouse
ggaagggtcattgtagggtc

SEQ ID NO: 656583 - DNA, 20 bp, mouse
gggttggcttagtgaataca

SEQ ID NO: 656584 - DNA, 20 bp, mouse
gaggcggcgctcccaggcca

SEQ ID NO: 656585 - DNA, 20 bp, mouse
gacccagcgcccccctttgg

SEQ ID NO: 656586 - DNA, 20 bp, mouse
gtggacgaacgcatgggacc

SEQ ID NO: 656587 - DNA, 20 bp, mouse
gcgaaacagacccggggcgg

SEQ ID NO: 656588 - DNA, 20 bp, mouse
gcggcggtggacgaacgcat

SEQ ID NO: 656589 - DNA, 20 bp, mouse
ggagatgcgaaacagacccg

SEQ ID NO: 656590 - DNA, 20 bp, mouse
gggacccgggctggcggacg

SEQ ID NO: 656591 - DNA, 20 bp, mouse
gacgcggacggggttgacgc

SEQ ID NO: 656592 - DNA, 20 bp, mouse
ggggttgacgcgggcctgga

SEQ ID NO: 656593 - DNA, 20 bp, mouse
ggaccccgagccgcgccgcc

SEQ ID NO: 656594 - DNA, 20 bp, mouse
ggctcggggtcccccgccgc

SEQ ID NO: 656595 - DNA, 20 bp, mouse
gggggcgggggaggtgtcgg

SEQ ID NO: 656596 - DNA, 20 bp, mouse
gcggccgccagcatttaagg

SEQ ID NO: 656597 - DNA, 20 bp, mouse
ggccgcgaggcggaagggga

SEQ ID NO: 656598 - DNA, 20 bp, mouse
gcgcgtcgctggagaaggag

SEQ ID NO: 656599 - DNA, 20 bp, mouse
ggccgccaggcggttagttc

SEQ ID NO: 656600 - DNA, 20 bp, mouse
gcgggcggaagcgccggcgg

SEQ ID NO: 656601 - DNA, 20 bp, mouse
gaccggcctagcccctgggg

SEQ ID NO: 656602 - DNA, 20 bp, mouse
gagaggagaggctcgagccg

SEQ ID NO: 656603 - DNA, 20 bp, mouse
ggctaggccggtcggagcca

SEQ ID NO: 656604 - DNA, 20 bp, mouse
ggggccggtggacagcgaga

SEQ ID NO: 656605 - DNA, 20 bp, mouse
gtccgccccaggggctaggc

SEQ ID NO: 656606 - DNA, 20 bp, mouse
gcacgcgaacccgggagcac

SEQ ID NO: 656607 - DNA, 20 bp, mouse
ggggaggaccaacgccgccc

SEQ ID NO: 656608 - DNA, 20 bp, mouse
gagcacgggacacgtgacct

SEQ ID NO: 656609 - DNA, 20 bp, mouse
gtcacgaggcacgcgaaccc

SEQ ID NO: 656610 - DNA, 20 bp, mouse
ggcggcgttggtcctccccg

SEQ ID NO: 656611 - DNA, 20 bp, mouse
gactgcgggcgcacgtcacg

SEQ ID NO: 656612 - DNA, 20 bp, mouse
gggacaatcttgtgattcta

SEQ ID NO: 656613 - DNA, 20 bp, mouse
ggtcacgtgtcccgtgctcc

SEQ ID NO: 656614 - DNA, 20 bp, mouse
ggtgcgcccgcagtagtgat

SEQ ID NO: 656615 - DNA, 20 bp, mouse
gacgggacacgtgacctggg

SEQ ID NO: 656616 - DNA, 20 bp, mouse
gcgccctggctccactccgg

SEQ ID NO: 656617 - DNA, 20 bp, mouse
gcggcaggctcttccatagg

SEQ ID NO: 656618 - DNA, 20 bp, mouse
gagcccccggagtggagcca

SEQ ID NO: 656619 - DNA, 20 bp, mouse
gagtggagccagggcgaagt

SEQ ID NO: 656620 - DNA, 20 bp, mouse
gagagcctgccggtcggccc

SEQ ID NO: 656621 - DNA, 20 bp, mouse
ggaccggcaggctcttccat

SEQ ID NO: 656622 - DNA, 20 bp, mouse
gggcaccagcaattcgctct

SEQ ID NO: 656623 - DNA, 20 bp, mouse
gcgggaggctgcacagtagc

SEQ ID NO: 656624 - DNA, 20 bp, mouse
gaagcagcaggggctcgatg

SEQ ID NO: 656625 - DNA, 20 bp, mouse
gtcggaaacgcagccaccta

SEQ ID NO: 656626 - DNA, 20 bp, mouse
gaaaacagagcaacctgatt

SEQ ID NO: 656627 - DNA, 20 bp, mouse
gtgcagagtgtgcgacccga

SEQ ID NO: 656628 - DNA, 20 bp, mouse
gactgcagctgatcagcctt

SEQ ID NO: 656629 - DNA, 20 bp, mouse
gagttggcgtgtggaagcga

SEQ ID NO: 656630 - DNA, 20 bp, mouse
gagtcaaaacagttggcgtg

SEQ ID NO: 656631 - DNA, 20 bp, mouse
gctctgcagaatacccaatc

SEQ ID NO: 656632 - DNA, 20 bp, mouse
gagtttcaggtcctaccagt

SEQ ID NO: 656633 - DNA, 20 bp, mouse
gggtcagttctatgaacttc

SEQ ID NO: 656634 - DNA, 20 bp, mouse
ggctgcctcgtgcgagtgtt

SEQ ID NO: 656635 - DNA, 20 bp, mouse
gagaaaaaaattccgaaaca

SEQ ID NO: 656636 - DNA, 20 bp, mouse
ggggaagtgtagttgcggag

SEQ ID NO: 656637 - DNA, 20 bp, mouse
gcgggtatgcgcagtaagtt

SEQ ID NO: 656638 - DNA, 20 bp, mouse
gacaaaggacgtgtacggag

SEQ ID NO: 656639 - DNA, 20 bp, mouse
ggaggcgtgcccccggtcgg

SEQ ID NO: 656640 - DNA, 20 bp, mouse
gcacccctgtagatcgaata

SEQ ID NO: 656641 - DNA, 20 bp, mouse
gtgtacggaggggttgaaag

SEQ ID NO: 656642 - DNA, 20 bp, mouse
gagagtgaactggcaaggta

SEQ ID NO: 656643 - DNA, 20 bp, mouse
gtgggcgcagtgaatcagaa

SEQ ID NO: 656644 - DNA, 20 bp, mouse
ggtggcacaaaggacgtgta

SEQ ID NO: 656645 - DNA, 20 bp, mouse
gctggctggcgccccttcct

SEQ ID NO: 656646 - DNA, 20 bp, mouse
gggcgcgcgaaagcgaaagg

SEQ ID NO: 656647 - DNA, 20 bp, mouse
gaggcccaataggctcgagg

SEQ ID NO: 656648 - DNA, 20 bp, mouse
gtaccggcggacgggacctg

SEQ ID NO: 656649 - DNA, 20 bp, mouse
gactgctcgcgcctgctaga

SEQ ID NO: 656650 - DNA, 20 bp, mouse
gcgagggcggggtgttgagg

SEQ ID NO: 656651 - DNA, 20 bp, mouse
gccgccgtccaaagtaccgg

SEQ ID NO: 656652 - DNA, 20 bp, mouse
gagcaggcgcgagcagtcgc

SEQ ID NO: 656653 - DNA, 20 bp, mouse
ggggaagggcggggatgcct

SEQ ID NO: 656654 - DNA, 20 bp, mouse
gctgggcgcgcgaaagcgaa

SEQ ID NO: 656655 - DNA, 20 bp, mouse
gacgccgccgtccaaagtac

SEQ ID NO: 656656 - DNA, 20 bp, mouse
gcgagaggaagaggcccgaa

SEQ ID NO: 656657 - DNA, 20 bp, mouse
ggggctctggcgcagttcgc

SEQ ID NO: 656658 - DNA, 20 bp, mouse
gggcccagactgtcagcgag

SEQ ID NO: 656659 - DNA, 20 bp, mouse
ggcaccgggcggaagtgggg

SEQ ID NO: 656660 - DNA, 20 bp, mouse
gacagaccaacagtgctccc

SEQ ID NO: 656661 - DNA, 20 bp, mouse
ggaatgccagttgtcgccac

SEQ ID NO: 656662 - DNA, 20 bp, mouse
gcctgcgcactggctccgcg

SEQ ID NO: 656663 - DNA, 20 bp, mouse
ggcgcagcaccgggcggaag

SEQ ID NO: 656664 - DNA, 20 bp, mouse
gtggcgcagttcgctggcct

SEQ ID NO: 656665 - DNA, 20 bp, mouse
ggcgagccagtggcgacaac

SEQ ID NO: 656666 - DNA, 20 bp, mouse
gggaggggccagacaacgag

SEQ ID NO: 656667 - DNA, 20 bp, mouse
gcggacgccaaccgttctca

SEQ ID NO: 656668 - DNA, 20 bp, mouse
gaatgctacccgggcggccg

SEQ ID NO: 656669 - DNA, 20 bp, mouse
gtggaaacgcttaaatgaag

SEQ ID NO: 656670 - DNA, 20 bp, mouse
ggagaggcatctttaaagtg

SEQ ID NO: 656671 - DNA, 20 bp, mouse
gtgcgtgcgcggctccaagc

SEQ ID NO: 656672 - DNA, 20 bp, mouse
gactgaccatcccggaagga

SEQ ID NO: 656673 - DNA, 20 bp, mouse
gtgtgactgaccatcccgga

SEQ ID NO: 656674 - DNA, 20 bp, mouse
ggccgaggtaaagagtgcct

SEQ ID NO: 656675 - DNA, 20 bp, mouse
gggccccgcccctcgttgtc

SEQ ID NO: 656676 - DNA, 20 bp, mouse
gaggaagccgggcggttccc

SEQ ID NO: 656677 - DNA, 20 bp, mouse
gcaggaatgaagagcaaagc

SEQ ID NO: 656678 - DNA, 20 bp, mouse
gagagctcccgggaaccgcc

SEQ ID NO: 656679 - DNA, 20 bp, mouse
ggagggtgcagagtccacac

SEQ ID NO: 656680 - DNA, 20 bp, mouse
gcaaagcaggaagagctccc

SEQ ID NO: 656681 - DNA, 20 bp, mouse
gtgtaggtcactaccaagtt

SEQ ID NO: 656682 - DNA, 20 bp, mouse
gctgcaccctctgcatgtgt

SEQ ID NO: 656683 - DNA, 20 bp, mouse
gaaccacgcccagtgcgcta

SEQ ID NO: 656684 - DNA, 20 bp, mouse
gggcatgcgcgcatgagcat

SEQ ID NO: 656685 - DNA, 20 bp, mouse
gagtgacctacacatgcaga

SEQ ID NO: 656686 - DNA, 20 bp, mouse
gcgggcgaggagagtcgagg

SEQ ID NO: 656687 - DNA, 20 bp, mouse
gggagaggagcgcgtcctga

SEQ ID NO: 656688 - DNA, 20 bp, mouse
gaagcggtctaggagaagca

SEQ ID NO: 656689 - DNA, 20 bp, mouse
ggggaacgctagcccttccg

SEQ ID NO: 656690 - DNA, 20 bp, mouse
gtgtgagcgtgtgcgtatgc

SEQ ID NO: 656691 - DNA, 20 bp, mouse
gagaacccggcaagcggtct

SEQ ID NO: 656692 - DNA, 20 bp, mouse
gcgcccgccctactcagagg

SEQ ID NO: 656693 - DNA, 20 bp, mouse
ggggcgggcgaggagagtcg

SEQ ID NO: 656694 - DNA, 20 bp, mouse
gcggaggtcaggagctaaca

SEQ ID NO: 656695 - DNA, 20 bp, mouse
gggaccgcctctgagtaggg

SEQ ID NO: 656696 - DNA, 20 bp, mouse
gcccggaagtggtgcaccaa

SEQ ID NO: 656697 - DNA, 20 bp, mouse
gagaacggccgcagatcgga

SEQ ID NO: 656698 - DNA, 20 bp, mouse
ggaggtgattagttcggaga

SEQ ID NO: 656699 - DNA, 20 bp, mouse
gagaccgagaccctgatctg

SEQ ID NO: 656700 - DNA, 20 bp, mouse
gcaacggcccgtccgatctg

SEQ ID NO: 656701 - DNA, 20 bp, mouse
gcctgcgcccagctacggca

SEQ ID NO: 656702 - DNA, 20 bp, mouse
gcgcaggcgcactgagctgt

SEQ ID NO: 656703 - DNA, 20 bp, mouse
gagcacggcgggcgatagaa

SEQ ID NO: 656704 - DNA, 20 bp, mouse
gtgcgggtacggggtcaagg

SEQ ID NO: 656705 - DNA, 20 bp, mouse
ggggctagtgtggttggcta

SEQ ID NO: 656706 - DNA, 20 bp, mouse
ggcggtacccggaggctaac

SEQ ID NO: 656707 - DNA, 20 bp, mouse
ggggaagcgtcccctccaac

SEQ ID NO: 656708 - DNA, 20 bp, mouse
gggacaggggtgcaagacta

SEQ ID NO: 656709 - DNA, 20 bp, mouse
gcacgcagagagcactctcc

SEQ ID NO: 656710 - DNA, 20 bp, mouse
gtagcctccgggtaccgcca

SEQ ID NO: 656711 - DNA, 20 bp, mouse
gggaccgcggagcaggaaca

SEQ ID NO: 656712 - DNA, 20 bp, mouse
gggtccatggcggtacccgg

SEQ ID NO: 656713 - DNA, 20 bp, mouse
gcactctccgggattgtggt

SEQ ID NO: 656714 - DNA, 20 bp, mouse
gcgggattgtggtgggtgtc

SEQ ID NO: 656715 - DNA, 20 bp, mouse
gagggcgctgcgtaggacca

SEQ ID NO: 656716 - DNA, 20 bp, mouse
gaacgaaggtgtggcctaag

SEQ ID NO: 656717 - DNA, 20 bp, mouse
gccactcagcccactctcat

SEQ ID NO: 656718 - DNA, 20 bp, mouse
gaaaaggagcgtgcacatct

SEQ ID NO: 656719 - DNA, 20 bp, mouse
gaaacgtagccaatgagagt

SEQ ID NO: 656720 - DNA, 20 bp, mouse
gagtcattgaaacagaacga

SEQ ID NO: 656721 - DNA, 20 bp, mouse
gtcagccaatggacctagag

SEQ ID NO: 656722 - DNA, 20 bp, mouse
gtctcccgctctaggtccat

SEQ ID NO: 656723 - DNA, 20 bp, mouse
gtccgggtcgcggggtaaac

SEQ ID NO: 656724 - DNA, 20 bp, mouse
gcgggagattcgaaagcgtc

SEQ ID NO: 656725 - DNA, 20 bp, mouse
gttgaaacagaacgaaggtg

SEQ ID NO: 656726 - DNA, 20 bp, mouse
gaggaaagtaccatttgcgg

SEQ ID NO: 656727 - DNA, 20 bp, mouse
ggcttctctgtgtgcctatt

SEQ ID NO: 656728 - DNA, 20 bp, mouse
gtcctgctgacctccgcaaa

SEQ ID NO: 656729 - DNA, 20 bp, mouse
gagcagacactgaccattag

SEQ ID NO: 656730 - DNA, 20 bp, mouse
gctgtactgctatcccctaa

SEQ ID NO: 656731 - DNA, 20 bp, mouse
ggtcttgaaaaacgaagtat

SEQ ID NO: 656732 - DNA, 20 bp, mouse
ggggcactaggtgtttgtgt

SEQ ID NO: 656733 - DNA, 20 bp, mouse
gggtcctcgtggttgattga

SEQ ID NO: 656734 - DNA, 20 bp, mouse
ggcaaggaaagtaccatttg

SEQ ID NO: 656735 - DNA, 20 bp, mouse
ggtgcctaaaatcactagca

SEQ ID NO: 656736 - DNA, 20 bp, mouse
gagcgcgcgtgcgagagagg

SEQ ID NO: 656737 - DNA, 20 bp, mouse
ggcagagcgaggcgcgaaga

SEQ ID NO: 656738 - DNA, 20 bp, mouse
gtcgagcgcgcgtgcgagag

SEQ ID NO: 656739 - DNA, 20 bp, mouse
ggagtgaggcgtgaggggag

SEQ ID NO: 656740 - DNA, 20 bp, mouse
gctcccgaggaccgccctcc

SEQ ID NO: 656741 - DNA, 20 bp, mouse
gagccaggagggcggtcctc

SEQ ID NO: 656742 - DNA, 20 bp, mouse
ggcgccgagtgaggcgtgag

SEQ ID NO: 656743 - DNA, 20 bp, mouse
gagggccgccccttccactc

SEQ ID NO: 656744 - DNA, 20 bp, mouse
gcgaggcgtgagagattctc

SEQ ID NO: 656745 - DNA, 20 bp, mouse
gagggagacggcaagcgggc

SEQ ID NO: 656746 - DNA, 20 bp, mouse
gtggagggtccggtagggaa

SEQ ID NO: 656747 - DNA, 20 bp, mouse
gctcaagtgggtggagggtc

SEQ ID NO: 656748 - DNA, 20 bp, mouse
gtaaagtcaggatttaggaa

SEQ ID NO: 656749 - DNA, 20 bp, mouse
gggacagcggctcaagtggg

SEQ ID NO: 656750 - DNA, 20 bp, mouse
gcagcggctcaagtgggtgg

SEQ ID NO: 656751 - DNA, 20 bp, mouse
ggagcgccggccgtggtgat

SEQ ID NO: 656752 - DNA, 20 bp, mouse
gtctggacagcggctcaagt

SEQ ID NO: 656753 - DNA, 20 bp, mouse
gcggagagcgcaggccccac

SEQ ID NO: 656754 - DNA, 20 bp, mouse
ggtgggtggagggtccggta

SEQ ID NO: 656755 - DNA, 20 bp, mouse
ggagtcccaagtcacaggtc

SEQ ID NO: 656756 - DNA, 20 bp, mouse
gctgtgtgcctggacgttca

SEQ ID NO: 656757 - DNA, 20 bp, mouse
gtccatcaataattcagtga

SEQ ID NO: 656758 - DNA, 20 bp, mouse
gtaactccagctccacaccc

SEQ ID NO: 656759 - DNA, 20 bp, mouse
gtgttttcgctgttttgcat

SEQ ID NO: 656760 - DNA, 20 bp, mouse
gtccctcactgaattattga

SEQ ID NO: 656761 - DNA, 20 bp, mouse
gggagcctccaattccccca

SEQ ID NO: 656762 - DNA, 20 bp, mouse
gaaccacattctcctagctc

SEQ ID NO: 656763 - DNA, 20 bp, mouse
gtatgctgatgacaggagac

SEQ ID NO: 656764 - DNA, 20 bp, mouse
gtgacttattcaaaccagag

SEQ ID NO: 656765 - DNA, 20 bp, mouse
gctctcagccctgaacgtcc

SEQ ID NO: 656766 - DNA, 20 bp, mouse
gaggggaggggctgtataac

SEQ ID NO: 656767 - DNA, 20 bp, mouse
gaaggcgcggcctacacgac

SEQ ID NO: 656768 - DNA, 20 bp, mouse
gtgggcggagcctgatcagg

SEQ ID NO: 656769 - DNA, 20 bp, mouse
gtaggccgcgccttcagctg

SEQ ID NO: 656770 - DNA, 20 bp, mouse
gggggcgggtctaaaggaaa

SEQ ID NO: 656771 - DNA, 20 bp, mouse
ggcgcggcctacacgaccgg

SEQ ID NO: 656772 - DNA, 20 bp, mouse
ggggtctgaggcggcatggg

SEQ ID NO: 656773 - DNA, 20 bp, mouse
gagcgcggggcggtaccctg

SEQ ID NO: 656774 - DNA, 20 bp, mouse
gggctgtataacaggagagg

SEQ ID NO: 656775 - DNA, 20 bp, mouse
gggacccccagctgaaggcg

SEQ ID NO: 656776 - DNA, 20 bp, mouse
ggagccactgccacagtgat

SEQ ID NO: 656777 - DNA, 20 bp, mouse
gggcatctggggacacacgt

SEQ ID NO: 656778 - DNA, 20 bp, mouse
ggtggccggtgacagcctga

SEQ ID NO: 656779 - DNA, 20 bp, mouse
ggtgggcctgtcagtgcaga

SEQ ID NO: 656780 - DNA, 20 bp, mouse
gctgacagcttgggacctgt

SEQ ID NO: 656781 - DNA, 20 bp, mouse
gggtcagcaccagaaggggt

SEQ ID NO: 656782 - DNA, 20 bp, mouse
gccggtgacagcctgatggc

SEQ ID NO: 656783 - DNA, 20 bp, mouse
gcctggggagccactgggga

SEQ ID NO: 656784 - DNA, 20 bp, mouse
gaagctgtcagcagtgattc

SEQ ID NO: 656785 - DNA, 20 bp, mouse
gtcaccggccaccgtgtgac

SEQ ID NO: 656786 - DNA, 20 bp, mouse
gggactgacgtcaatcaagg

SEQ ID NO: 656787 - DNA, 20 bp, mouse
gcatctagggagtatcggcg

SEQ ID NO: 656788 - DNA, 20 bp, mouse
gccttgagtccaatcatcta

SEQ ID NO: 656789 - DNA, 20 bp, mouse
gggcgaggggcgtgtcctcc

SEQ ID NO: 656790 - DNA, 20 bp, mouse
gggactcgacccagagaaaa

SEQ ID NO: 656791 - DNA, 20 bp, mouse
gtccgcactgggtttggagg

SEQ ID NO: 656792 - DNA, 20 bp, mouse
ggcgggcacgggaaaaggga

SEQ ID NO: 656793 - DNA, 20 bp, mouse
gccgatactccctagatgat

SEQ ID NO: 656794 - DNA, 20 bp, mouse
gctccaggcgtggggagggc

SEQ ID NO: 656795 - DNA, 20 bp, mouse
gtccagccgcaccccgtgtc

SEQ ID NO: 656796 - DNA, 20 bp, mouse
gaaagcgcccggctctgcag

SEQ ID NO: 656797 - DNA, 20 bp, mouse
gcgaggagcccagagaagtt

SEQ ID NO: 656798 - DNA, 20 bp, mouse
gatccctagcctagccacta

SEQ ID NO: 656799 - DNA, 20 bp, mouse
gagggcctgggggcttggaa

SEQ ID NO: 656800 - DNA, 20 bp, mouse
gagccctagtggctaggcta

SEQ ID NO: 656801 - DNA, 20 bp, mouse
ggcgctgcatgactttaaat

SEQ ID NO: 656802 - DNA, 20 bp, mouse
gggaggctggagaaattccg

SEQ ID NO: 656803 - DNA, 20 bp, mouse
ggagaagtttggggcagatc

SEQ ID NO: 656804 - DNA, 20 bp, mouse
gcgccgggcagggaaacaca

SEQ ID NO: 656805 - DNA, 20 bp, mouse
gaactcagtgcgcctggatt

SEQ ID NO: 656806 - DNA, 20 bp, mouse
ggagctgggtgggactgtag

SEQ ID NO: 656807 - DNA, 20 bp, mouse
gagggtggagtgagactcag

SEQ ID NO: 656808 - DNA, 20 bp, mouse
gactgtagaggaggaggatc

SEQ ID NO: 656809 - DNA, 20 bp, mouse
gggtgggactgtagaggagg

SEQ ID NO: 656810 - DNA, 20 bp, mouse
gctgggtgggactgtagagg

SEQ ID NO: 656811 - DNA, 20 bp, mouse
ggagagttgagggatcagga

SEQ ID NO: 656812 - DNA, 20 bp, mouse
gtcagacagggggtactgag

SEQ ID NO: 656813 - DNA, 20 bp, mouse
gcagggggtactgaggggag

SEQ ID NO: 656814 - DNA, 20 bp, mouse
gtaacgagagttgagggatc

SEQ ID NO: 656815 - DNA, 20 bp, mouse
ggggatcaggatggcagtgt

SEQ ID NO: 656816 - DNA, 20 bp, mouse
gaaaggtgggcctgtggaat

SEQ ID NO: 656817 - DNA, 20 bp, mouse
gaggctaggaacttacttcc

SEQ ID NO: 656818 - DNA, 20 bp, mouse
gaggggaggtgtaaggctag

SEQ ID NO: 656819 - DNA, 20 bp, mouse
gggaggtgtaaggctagggg

SEQ ID NO: 656820 - DNA, 20 bp, mouse
gggtgagcagggtacagcct

SEQ ID NO: 656821 - DNA, 20 bp, mouse
ggtggtgcgtgagggaaagg

SEQ ID NO: 656822 - DNA, 20 bp, mouse
ggctgagttaagcttgggac

SEQ ID NO: 656823 - DNA, 20 bp, mouse
gttgctgctgagttaagctt

SEQ ID NO: 656824 - DNA, 20 bp, mouse
gcccgccccaaccagcctca

SEQ ID NO: 656825 - DNA, 20 bp, mouse
gggctaggggtggtgcgtga

SEQ ID NO: 656826 - DNA, 20 bp, mouse
gagaggggaaattctctcac

SEQ ID NO: 656827 - DNA, 20 bp, mouse
gggccccagtgctactgaac

SEQ ID NO: 656828 - DNA, 20 bp, mouse
gtgggcagggctagacctgt

SEQ ID NO: 656829 - DNA, 20 bp, mouse
gagcactggggcctgcccac

SEQ ID NO: 656830 - DNA, 20 bp, mouse
ggggtatctgccacttagac

SEQ ID NO: 656831 - DNA, 20 bp, mouse
ggactgtcatccagtctaag

SEQ ID NO: 656832 - DNA, 20 bp, mouse
gaacaggcctctgcagtggg

SEQ ID NO: 656833 - DNA, 20 bp, mouse
ggaggcctgttcagtagcac

SEQ ID NO: 656834 - DNA, 20 bp, mouse
ggagtcaaagggcagtgggc

SEQ ID NO: 656835 - DNA, 20 bp, mouse
gctgtgactatgaggacatc

SEQ ID NO: 656836 - DNA, 20 bp, mouse
gggtgtcacaatcccaactc

SEQ ID NO: 656837 - DNA, 20 bp, mouse
gccaaggccagtctgaaaat

SEQ ID NO: 656838 - DNA, 20 bp, mouse
gaggccctgcagtcttaggg

SEQ ID NO: 656839 - DNA, 20 bp, mouse
gggtaagagagcaactgcca

SEQ ID NO: 656840 - DNA, 20 bp, mouse
ggtcccaccctaagactgca

SEQ ID NO: 656841 - DNA, 20 bp, mouse
gtaggaggccctgcagtctt

SEQ ID NO: 656842 - DNA, 20 bp, mouse
gctgaaaataggggagctgt

SEQ ID NO: 656843 - DNA, 20 bp, mouse
gcagtcttagggtgggacaa

SEQ ID NO: 656844 - DNA, 20 bp, mouse
gagggatctatccactatcc

SEQ ID NO: 656845 - DNA, 20 bp, mouse
ggcggggagtatgcaacagt

SEQ ID NO: 656846 - DNA, 20 bp, mouse
ggatactgctgaggcagtct

SEQ ID NO: 656847 - DNA, 20 bp, mouse
gaaagcaggagtagctagaa

SEQ ID NO: 656848 - DNA, 20 bp, mouse
ggaaacacaggatactgctg

SEQ ID NO: 656849 - DNA, 20 bp, mouse
ggagtagctagaagggtgga

SEQ ID NO: 656850 - DNA, 20 bp, mouse
gaggaaagacaaacttttaa

SEQ ID NO: 656851 - DNA, 20 bp, mouse
gcctgtgtttctaacaagaa

SEQ ID NO: 656852 - DNA, 20 bp, mouse
ggcaggagtagctagaaggg

SEQ ID NO: 656853 - DNA, 20 bp, mouse
gagctgggctcctctgctag

SEQ ID NO: 656854 - DNA, 20 bp, mouse
gctgggaaactttaactccc

SEQ ID NO: 656855 - DNA, 20 bp, mouse
ggcagggcagtggaggggtt

SEQ ID NO: 656856 - DNA, 20 bp, mouse
gtctgcaagggcagggcccg

SEQ ID NO: 656857 - DNA, 20 bp, mouse
gggccctgcccttgcagaga

SEQ ID NO: 656858 - DNA, 20 bp, mouse
gctactgcaaatgcaaattg

SEQ ID NO: 656859 - DNA, 20 bp, mouse
gctgctcttgaatctgttca

SEQ ID NO: 656860 - DNA, 20 bp, mouse
gtatgagttctgaatccgcc

SEQ ID NO: 656861 - DNA, 20 bp, mouse
gtgtcactaagtttccctgg

SEQ ID NO: 656862 - DNA, 20 bp, mouse
gtgcggttcatcttagtgtc

SEQ ID NO: 656863 - DNA, 20 bp, mouse
gctatgccaacagtagctga

SEQ ID NO: 656864 - DNA, 20 bp, mouse
gttctcacctaggctaatgg

SEQ ID NO: 656865 - DNA, 20 bp, mouse
gtacatcaccctctctgcaa

SEQ ID NO: 656866 - DNA, 20 bp, mouse
ggggcccggggagtctctac

SEQ ID NO: 656867 - DNA, 20 bp, mouse
gtctgcaagggcagggcccg

SEQ ID NO: 656868 - DNA, 20 bp, mouse
gcgcaagcgcagacctgcgc

SEQ ID NO: 656869 - DNA, 20 bp, mouse
gcagtctgcacccggaagcg

SEQ ID NO: 656870 - DNA, 20 bp, mouse
gggccctgcccttgcagaga

SEQ ID NO: 656871 - DNA, 20 bp, mouse
gggcccgcaagttgctagga

SEQ ID NO: 656872 - DNA, 20 bp, mouse
gtgcgccggtagagactccc

SEQ ID NO: 656873 - DNA, 20 bp, mouse
gccgcaagttgctaggacgg

SEQ ID NO: 656874 - DNA, 20 bp, mouse
gtgttgtctcggaatgggat

SEQ ID NO: 656875 - DNA, 20 bp, mouse
gttgaatcgggttgttgtct

SEQ ID NO: 656876 - DNA, 20 bp, mouse
gagggctgaagcgtataaga

SEQ ID NO: 656877 - DNA, 20 bp, mouse
ggaaaactaggcctgggggt

SEQ ID NO: 656878 - DNA, 20 bp, mouse
gggaaccaagatgctgagac

SEQ ID NO: 656879 - DNA, 20 bp, mouse
gaacaaagctaaagtctcag

SEQ ID NO: 656880 - DNA, 20 bp, mouse
ggttgtggaaaactaggcct

SEQ ID NO: 656881 - DNA, 20 bp, mouse
ggaacacacgtttcttttag

SEQ ID NO: 656882 - DNA, 20 bp, mouse
gcttgggcacaattgttcaa

SEQ ID NO: 656883 - DNA, 20 bp, mouse
gcagtggaacttagaagctt

SEQ ID NO: 656884 - DNA, 20 bp, mouse
gtttgtattttgacatatca

SEQ ID NO: 656885 - DNA, 20 bp, mouse
gggattatctatgcacataa

SEQ ID NO: 656886 - DNA, 20 bp, mouse
gtccgaggacaagaagagta

SEQ ID NO: 656887 - DNA, 20 bp, mouse
ggggcggagcttctaacacg

SEQ ID NO: 656888 - DNA, 20 bp, mouse
gaggctgggtctcgttgtag

SEQ ID NO: 656889 - DNA, 20 bp, mouse
gccccattgggcatcctccg

SEQ ID NO: 656890 - DNA, 20 bp, mouse
gcggagcttctaacacgggg

SEQ ID NO: 656891 - DNA, 20 bp, mouse
ggaggcagaaccacggtgtg

SEQ ID NO: 656892 - DNA, 20 bp, mouse
ggcagaaccacggtgtgggg

SEQ ID NO: 656893 - DNA, 20 bp, mouse
ggggcagagtcttgagcgaa

SEQ ID NO: 656894 - DNA, 20 bp, mouse
gtgaaggcggggcgtgaact

SEQ ID NO: 656895 - DNA, 20 bp, mouse
gggagccaagcactgtcttg

SEQ ID NO: 656896 - DNA, 20 bp, mouse
gagcaggccggggtagtaga

SEQ ID NO: 656897 - DNA, 20 bp, mouse
gcgctccagcgccccttttg

SEQ ID NO: 656898 - DNA, 20 bp, mouse
gccggggtagtagaggggtg

SEQ ID NO: 656899 - DNA, 20 bp, mouse
ggcagacgagggccaaggaa

SEQ ID NO: 656900 - DNA, 20 bp, mouse
gctgtaaaaggtggggtcgg

SEQ ID NO: 656901 - DNA, 20 bp, mouse
gcgagccgagcgcacggtcc

SEQ ID NO: 656902 - DNA, 20 bp, mouse
gggcgcgcgctgtcccttta

SEQ ID NO: 656903 - DNA, 20 bp, mouse
ggccaaggaagggttaacgc

SEQ ID NO: 656904 - DNA, 20 bp, mouse
ggaggcgtccgcctccccaa

SEQ ID NO: 656905 - DNA, 20 bp, mouse
ggccccggggtgttctcggc

SEQ ID NO: 656906 - DNA, 20 bp, mouse
gggacttggaggggttaact

SEQ ID NO: 656907 - DNA, 20 bp, mouse
ggcgccttggagagaggctg

SEQ ID NO: 656908 - DNA, 20 bp, mouse
gccaaggctggggccctagt

SEQ ID NO: 656909 - DNA, 20 bp, mouse
gggtggctgaggccgatcct

SEQ ID NO: 656910 - DNA, 20 bp, mouse
gggggccactgggacttgga

SEQ ID NO: 656911 - DNA, 20 bp, mouse
gaggctggggccctagtggg

SEQ ID NO: 656912 - DNA, 20 bp, mouse
gctggggccctagtgggcgg

SEQ ID NO: 656913 - DNA, 20 bp, mouse
ggcctgggcgccttggagag

SEQ ID NO: 656914 - DNA, 20 bp, mouse
ggggatctgccttgtcttaa

SEQ ID NO: 656915 - DNA, 20 bp, mouse
gtggtggctcatggtggctg

SEQ ID NO: 656916 - DNA, 20 bp, mouse
gtgggagggaatctccctaa

SEQ ID NO: 656917 - DNA, 20 bp, mouse
ggagaggctgaagagggtag

SEQ ID NO: 656918 - DNA, 20 bp, mouse
gggctcagaaaatgctgccc

SEQ ID NO: 656919 - DNA, 20 bp, mouse
ggctctagctcagagccctt

SEQ ID NO: 656920 - DNA, 20 bp, mouse
ggccaagcccaatggcacgc

SEQ ID NO: 656921 - DNA, 20 bp, mouse
ggccatgcgtggcccacggt

SEQ ID NO: 656922 - DNA, 20 bp, mouse
gcttggccatgcgtggccca

SEQ ID NO: 656923 - DNA, 20 bp, mouse
ggccaaccgtgggccacgca

SEQ ID NO: 656924 - DNA, 20 bp, mouse
gtataccctagagcctgggc

SEQ ID NO: 656925 - DNA, 20 bp, mouse
gcttttataccctagagcct

SEQ ID NO: 656926 - DNA, 20 bp, mouse
gtgggcagaggtttgatcac

SEQ ID NO: 656927 - DNA, 20 bp, mouse
gcccctgctgacaccagggt

SEQ ID NO: 656928 - DNA, 20 bp, mouse
gtggaggtctgtatagtaag

SEQ ID NO: 656929 - DNA, 20 bp, mouse
gaggctcttgccttgaggtc

SEQ ID NO: 656930 - DNA, 20 bp, mouse
gtaagtggtagatgtctgaa

SEQ ID NO: 656931 - DNA, 20 bp, mouse
gaggtctggcatcctgcccg

SEQ ID NO: 656932 - DNA, 20 bp, mouse
gagagccacacaaacaggtt

SEQ ID NO: 656933 - DNA, 20 bp, mouse
ggctgtggaatcacctcccc

SEQ ID NO: 656934 - DNA, 20 bp, mouse
gtctgcccaacctgtttgtg

SEQ ID NO: 656935 - DNA, 20 bp, mouse
gccactggtatactttcata

SEQ ID NO: 656936 - DNA, 20 bp, mouse
ggagctgccgaaagccaaag

SEQ ID NO: 656937 - DNA, 20 bp, mouse
gcgggtcccggcaccctctg

SEQ ID NO: 656938 - DNA, 20 bp, mouse
ggctgcgcgggggcctcaga

SEQ ID NO: 656939 - DNA, 20 bp, mouse
ggtcctgtaagtcccggagt

SEQ ID NO: 656940 - DNA, 20 bp, mouse
gagccaaagtggagtggggc

SEQ ID NO: 656941 - DNA, 20 bp, mouse
ggcagaggggcggggcttta

SEQ ID NO: 656942 - DNA, 20 bp, mouse
ggacgcccgccctgatcttc

SEQ ID NO: 656943 - DNA, 20 bp, mouse
gccgaaagccaaagtggagt

SEQ ID NO: 656944 - DNA, 20 bp, mouse
gaaggcaccggagaggccca

SEQ ID NO: 656945 - DNA, 20 bp, mouse
gtaggctgtcctgtaagtcc

SEQ ID NO: 656946 - DNA, 20 bp, mouse
gggagctgagacagcgtcgc

SEQ ID NO: 656947 - DNA, 20 bp, mouse
gagcctctgcggtagggcag

SEQ ID NO: 656948 - DNA, 20 bp, mouse
ggtcgcgcccagccgcgggg

SEQ ID NO: 656949 - DNA, 20 bp, mouse
gacccgccgcggggaccact

SEQ ID NO: 656950 - DNA, 20 bp, mouse
ggggctgaggcgcgcgttca

SEQ ID NO: 656951 - DNA, 20 bp, mouse
gaatcccagttgccgctgag

SEQ ID NO: 656952 - DNA, 20 bp, mouse
gcccatgagcctctgcggta

SEQ ID NO: 656953 - DNA, 20 bp, mouse
gcgcgacacctcacccgccg

SEQ ID NO: 656954 - DNA, 20 bp, mouse
gtacgtactaccagtcccag

SEQ ID NO: 656955 - DNA, 20 bp, mouse
gcgagtcccgtgagcctccg

SEQ ID NO: 656956 - DNA, 20 bp, mouse
gaatgtgggaggggcggaag

SEQ ID NO: 656957 - DNA, 20 bp, mouse
gtgccgccggggaatgtggg

SEQ ID NO: 656958 - DNA, 20 bp, mouse
ggggctgctagtttcgtagg

SEQ ID NO: 656959 - DNA, 20 bp, mouse
gggctcacaaagcggatcgt

SEQ ID NO: 656960 - DNA, 20 bp, mouse
gctgtgccgccggggaatgt

SEQ ID NO: 656961 - DNA, 20 bp, mouse
gacagccttgtgcagttagg

SEQ ID NO: 656962 - DNA, 20 bp, mouse
gggccgaagggcgggaccac

SEQ ID NO: 656963 - DNA, 20 bp, mouse
ggcccggtggtcccgccctt

SEQ ID NO: 656964 - DNA, 20 bp, mouse
ggcaggcgccgcaagggcga

SEQ ID NO: 656965 - DNA, 20 bp, mouse
gtggcgcgcaggcgccgcaa

SEQ ID NO: 656966 - DNA, 20 bp, mouse
gccgccgccggccccgagtg

SEQ ID NO: 656967 - DNA, 20 bp, mouse
ggtgcgcgctccccctctgg

SEQ ID NO: 656968 - DNA, 20 bp, mouse
gcgcgctccccctctggcgg

SEQ ID NO: 656969 - DNA, 20 bp, mouse
gttcttgcgggcgggagagg

SEQ ID NO: 656970 - DNA, 20 bp, mouse
ggacagccgcggttgagcga

SEQ ID NO: 656971 - DNA, 20 bp, mouse
gggtccggcggcagcctgga

SEQ ID NO: 656972 - DNA, 20 bp, mouse
gcgcttgctacttgacaccg

SEQ ID NO: 656973 - DNA, 20 bp, mouse
ggcgccgaggtttccagaaa

SEQ ID NO: 656974 - DNA, 20 bp, mouse
gggaaagttgacctcactcg

SEQ ID NO: 656975 - DNA, 20 bp, mouse
gaggctggattcttgcgggc

SEQ ID NO: 656976 - DNA, 20 bp, mouse
gccgacctgtatgtttaggg

SEQ ID NO: 656977 - DNA, 20 bp, mouse
gaagaaccgagctcataagc

SEQ ID NO: 656978 - DNA, 20 bp, mouse
gaaaaagaacttaaattact

SEQ ID NO: 656979 - DNA, 20 bp, mouse
gaatctcacctccaatgctg

SEQ ID NO: 656980 - DNA, 20 bp, mouse
ggttcttccctcagcattgg

SEQ ID NO: 656981 - DNA, 20 bp, mouse
gcacccgacctgtatgttta

SEQ ID NO: 656982 - DNA, 20 bp, mouse
gacatgagagagggagatat

SEQ ID NO: 656983 - DNA, 20 bp, mouse
gaaagaaacgaagttacaat

SEQ ID NO: 656984 - DNA, 20 bp, mouse
gagtgagttgaagaatgcgc

SEQ ID NO: 656985 - DNA, 20 bp, mouse
gaagaaaaggaagaatgccc

SEQ ID NO: 656986 - DNA, 20 bp, mouse
gcacgctgccagtgaacttt

SEQ ID NO: 656987 - DNA, 20 bp, mouse
gcaggagcatacagtctgac

SEQ ID NO: 656988 - DNA, 20 bp, mouse
ggagagatcaatctgtagaa

SEQ ID NO: 656989 - DNA, 20 bp, mouse
ggcaggaatcagtagtgcag

SEQ ID NO: 656990 - DNA, 20 bp, mouse
ggctctccttagcccgtcac

SEQ ID NO: 656991 - DNA, 20 bp, mouse
gctccaagccaaaagttcac

SEQ ID NO: 656992 - DNA, 20 bp, mouse
gagacaggcaggcacctcac

SEQ ID NO: 656993 - DNA, 20 bp, mouse
gccatgctctctggcaataa

SEQ ID NO: 656994 - DNA, 20 bp, mouse
gaatctcatgcctagtcaga

SEQ ID NO: 656995 - DNA, 20 bp, mouse
ggctcacactggcctctaaa

SEQ ID NO: 656996 - DNA, 20 bp, mouse
gtgaagtggtattgcaggcg

SEQ ID NO: 656997 - DNA, 20 bp, mouse
gactcaacttcaccttgcta

SEQ ID NO: 656998 - DNA, 20 bp, mouse
gtctaactttgtctataata

SEQ ID NO: 656999 - DNA, 20 bp, mouse
gtatatctttgtccatagca

SEQ ID NO: 657000 - DNA, 20 bp, mouse
ggttgagtatattgttgtag

SEQ ID NO: 657001 - DNA, 20 bp, mouse
gatatacaagagctacagag

SEQ ID NO: 657002 - DNA, 20 bp, mouse
ggtggtgctacaccttctgc

SEQ ID NO: 657003 - DNA, 20 bp, mouse
gctgtctgaagtggtattgc

SEQ ID NO: 657004 - DNA, 20 bp, mouse
gaaaacaacattcttctttg

SEQ ID NO: 657005 - DNA, 20 bp, mouse
gagtgttccttaaagaagga

SEQ ID NO: 657006 - DNA, 20 bp, mouse
gcacctgtgatggttcttct

SEQ ID NO: 657007 - DNA, 20 bp, mouse
gctgcccgctttaagattta

SEQ ID NO: 657008 - DNA, 20 bp, mouse
gtttccttaaatcttaaagc

SEQ ID NO: 657009 - DNA, 20 bp, mouse
gtcagcaaaaggtgtggcac

SEQ ID NO: 657010 - DNA, 20 bp, mouse
gttaaggaaagtgctgggtg

SEQ ID NO: 657011 - DNA, 20 bp, mouse
gccaccaaacagaaaatcac

SEQ ID NO: 657012 - DNA, 20 bp, mouse
gtaggcttcagcaaaaggtg

SEQ ID NO: 657013 - DNA, 20 bp, mouse
gttgtcaggctgactctctc

SEQ ID NO: 657014 - DNA, 20 bp, mouse
gcacttctagtccagacttt

SEQ ID NO: 657015 - DNA, 20 bp, mouse
gacacctgtgattttctgtt

SEQ ID NO: 657016 - DNA, 20 bp, mouse
gactgtgtaatggttgggag

SEQ ID NO: 657017 - DNA, 20 bp, mouse
gtgatcagacactgaagcag

SEQ ID NO: 657018 - DNA, 20 bp, mouse
gggaaagattctgcccagac

SEQ ID NO: 657019 - DNA, 20 bp, mouse
gactgactagacaggcaata

SEQ ID NO: 657020 - DNA, 20 bp, mouse
gtgatcagcttttttccctt

SEQ ID NO: 657021 - DNA, 20 bp, mouse
gtgccaggaaagagagagtg

SEQ ID NO: 657022 - DNA, 20 bp, mouse
gcctagtttcagtttagcta

SEQ ID NO: 657023 - DNA, 20 bp, mouse
gaaggattttgccaccagtc

SEQ ID NO: 657024 - DNA, 20 bp, mouse
ggcaatagggaaaatgctaa

SEQ ID NO: 657025 - DNA, 20 bp, mouse
gaacttggggtgcctgtttt

SEQ ID NO: 657026 - DNA, 20 bp, mouse
ggtgtgttagcttcaacgtc

SEQ ID NO: 657027 - DNA, 20 bp, mouse
ggacagaggtacattctctc

SEQ ID NO: 657028 - DNA, 20 bp, mouse
gtggtgtcttatgctaggtg

SEQ ID NO: 657029 - DNA, 20 bp, mouse
gaagcttggtgtcttatgct

SEQ ID NO: 657030 - DNA, 20 bp, mouse
gaggtattatagacaaaacc

SEQ ID NO: 657031 - DNA, 20 bp, mouse
gaaagtcgaagactcaaagc

SEQ ID NO: 657032 - DNA, 20 bp, mouse
gagcacacgagtctagacag

SEQ ID NO: 657033 - DNA, 20 bp, mouse
gttagaggacacacctgcaa

SEQ ID NO: 657034 - DNA, 20 bp, mouse
gtctagactcgtgtgctgtg

SEQ ID NO: 657035 - DNA, 20 bp, mouse
gtgagacttggtggccagct

SEQ ID NO: 657036 - DNA, 20 bp, mouse
gagccggtgctaggaggcaa

SEQ ID NO: 657037 - DNA, 20 bp, mouse
gtgaccaagccggtgctagg

SEQ ID NO: 657038 - DNA, 20 bp, mouse
gtgacactcagcttcgcata

SEQ ID NO: 657039 - DNA, 20 bp, mouse
ggtaggaagactgcagtata

SEQ ID NO: 657040 - DNA, 20 bp, mouse
gttcgcatagggaggaaatc

SEQ ID NO: 657041 - DNA, 20 bp, mouse
ggcaagcaagataaatcacc

SEQ ID NO: 657042 - DNA, 20 bp, mouse
ggagatggggatgtgctact

SEQ ID NO: 657043 - DNA, 20 bp, mouse
gtgggcaaaggggcaggagt

SEQ ID NO: 657044 - DNA, 20 bp, mouse
gaggaatcctgtgtacataa

SEQ ID NO: 657045 - DNA, 20 bp, mouse
gaaggtatagctgacaggtt

SEQ ID NO: 657046 - DNA, 20 bp, mouse
gttaggactgagttgttgcg

SEQ ID NO: 657047 - DNA, 20 bp, mouse
ggctctgaccttgtaaaata

SEQ ID NO: 657048 - DNA, 20 bp, mouse
gtcagtcctaaccttattct

SEQ ID NO: 657049 - DNA, 20 bp, mouse
gaaatgattgggtggccact

SEQ ID NO: 657050 - DNA, 20 bp, mouse
gaagctaattgtgaatgcca

SEQ ID NO: 657051 - DNA, 20 bp, mouse
gatccaacatggaagaaggt

SEQ ID NO: 657052 - DNA, 20 bp, mouse
ggactagagtggtacactct

SEQ ID NO: 657053 - DNA, 20 bp, mouse
gatcacatcaaagactgagt

SEQ ID NO: 657054 - DNA, 20 bp, mouse
gcatcatccagcaacattga

SEQ ID NO: 657055 - DNA, 20 bp, mouse
ggaatcagaaagatccaaca

SEQ ID NO: 657056 - DNA, 20 bp, mouse
gtgccgaagggcttcgtggc

SEQ ID NO: 657057 - DNA, 20 bp, mouse
ggctgcccatggttgaacaa

SEQ ID NO: 657058 - DNA, 20 bp, mouse
gaagcccttcggcaccttgt

SEQ ID NO: 657059 - DNA, 20 bp, mouse
ggggcactgacaacagggaa

SEQ ID NO: 657060 - DNA, 20 bp, mouse
gcgatccaggctcccgtcca

SEQ ID NO: 657061 - DNA, 20 bp, mouse
ggcagcctttgttcaaccat

SEQ ID NO: 657062 - DNA, 20 bp, mouse
gatcccaacaaggtgccgaa

SEQ ID NO: 657063 - DNA, 20 bp, mouse
gatgcccaacgcatcgttgt

SEQ ID NO: 657064 - DNA, 20 bp, mouse
gaaggtgccgaagggcttcg

SEQ ID NO: 657065 - DNA, 20 bp, mouse
gttgctgggcactgacaaca

SEQ ID NO: 657066 - DNA, 20 bp, mouse
ggggtctgctggtctgtgat

SEQ ID NO: 657067 - DNA, 20 bp, mouse
gtcttcaggaagtttagctg

SEQ ID NO: 657068 - DNA, 20 bp, mouse
gcacggagcctcagagtcca

SEQ ID NO: 657069 - DNA, 20 bp, mouse
gcatctcctgagaatgccta

SEQ ID NO: 657070 - DNA, 20 bp, mouse
gatatcgtcactctaatctc

SEQ ID NO: 657071 - DNA, 20 bp, mouse
gtgaagagccaggtgccagc

SEQ ID NO: 657072 - DNA, 20 bp, mouse
gcctgagtgcagaaacattc

SEQ ID NO: 657073 - DNA, 20 bp, mouse
gctggagctggggggtctgc

SEQ ID NO: 657074 - DNA, 20 bp, mouse
gctaatctctggtttctccc

SEQ ID NO: 657075 - DNA, 20 bp, mouse
gtggttagccgtctgtggtg

SEQ ID NO: 657076 - DNA, 20 bp, mouse
gcagcttggacctattttag

SEQ ID NO: 657077 - DNA, 20 bp, mouse
gtccctgcagatggtaacag

SEQ ID NO: 657078 - DNA, 20 bp, mouse
gcccaggaatccgtgttcta

SEQ ID NO: 657079 - DNA, 20 bp, mouse
gctcaaagcaaggacgctct

SEQ ID NO: 657080 - DNA, 20 bp, mouse
gctacacagcccatagaaca

SEQ ID NO: 657081 - DNA, 20 bp, mouse
ggccagtccgccactaaaat

SEQ ID NO: 657082 - DNA, 20 bp, mouse
ggacacctcctgcccccgtt

SEQ ID NO: 657083 - DNA, 20 bp, mouse
gagtgtctgtgatttcctaa

SEQ ID NO: 657084 - DNA, 20 bp, mouse
gcttggacctattttagtgg

SEQ ID NO: 657085 - DNA, 20 bp, mouse
gctaagagatcctgtcctac

SEQ ID NO: 657086 - DNA, 20 bp, mouse
gtcctctggggaggtctaat

SEQ ID NO: 657087 - DNA, 20 bp, mouse
gagtgttggagtctgcacag

SEQ ID NO: 657088 - DNA, 20 bp, mouse
ggtcaatcttcagaactgag

SEQ ID NO: 657089 - DNA, 20 bp, mouse
gtaaccttttggtgttcaca

SEQ ID NO: 657090 - DNA, 20 bp, mouse
gcacccctgtgaacaccaaa

SEQ ID NO: 657091 - DNA, 20 bp, mouse
gagtcagaatgtctcctggc

SEQ ID NO: 657092 - DNA, 20 bp, mouse
gtaggacaatgattgatgag

SEQ ID NO: 657093 - DNA, 20 bp, mouse
ggattgacaagctaccctcg

SEQ ID NO: 657094 - DNA, 20 bp, mouse
gtaggagtttttaaagcccg

SEQ ID NO: 657095 - DNA, 20 bp, mouse
gtgagcggatatcatttgtt

SEQ ID NO: 657096 - DNA, 20 bp, mouse
gcaggcgcgcgcgaagcgga

SEQ ID NO: 657097 - DNA, 20 bp, mouse
gtcccgccaagatgagcgag

SEQ ID NO: 657098 - DNA, 20 bp, mouse
gagcgagcggatggtcggct

SEQ ID NO: 657099 - DNA, 20 bp, mouse
gaagactcattcattgtctg

SEQ ID NO: 657100 - DNA, 20 bp, mouse
gaggcggcgctcacattccg

SEQ ID NO: 657101 - DNA, 20 bp, mouse
ggtccggggccccgcggtga

SEQ ID NO: 657102 - DNA, 20 bp, mouse
gtcttcgcgcggcccgcgaa

SEQ ID NO: 657103 - DNA, 20 bp, mouse
ggaagaagccgccacagccc

SEQ ID NO: 657104 - DNA, 20 bp, mouse
gcgcctgcgcactccgttcg

SEQ ID NO: 657105 - DNA, 20 bp, mouse
gagatgagcgagcggatggt

SEQ ID NO: 657106 - DNA, 20 bp, mouse
ggctgtgcggggagacagaa

SEQ ID NO: 657107 - DNA, 20 bp, mouse
gagaccaagcttcaaatcca

SEQ ID NO: 657108 - DNA, 20 bp, mouse
gtcctccctggggctgtgcg

SEQ ID NO: 657109 - DNA, 20 bp, mouse
ggggtcaactgttcacatag

SEQ ID NO: 657110 - DNA, 20 bp, mouse
gtgagcagtgataggtgcag

SEQ ID NO: 657111 - DNA, 20 bp, mouse
gtcaactgttcacatagggg

SEQ ID NO: 657112 - DNA, 20 bp, mouse
gtactgagtgaggaaagctc

SEQ ID NO: 657113 - DNA, 20 bp, mouse
gcagtggtggttcctccctg

SEQ ID NO: 657114 - DNA, 20 bp, mouse
gaaaccgacaccaccgcacc

SEQ ID NO: 657115 - DNA, 20 bp, mouse
gggaaacaatagttttgttg

SEQ ID NO: 657116 - DNA, 20 bp, mouse
gcgcgtgcgacgcacctgtc

SEQ ID NO: 657117 - DNA, 20 bp, mouse
gcagccctgacccgctgaac

SEQ ID NO: 657118 - DNA, 20 bp, mouse
ggtgcctcccagtgcggccg

SEQ ID NO: 657119 - DNA, 20 bp, mouse
ggcaggagtcggagcccgac

SEQ ID NO: 657120 - DNA, 20 bp, mouse
gcgtggaagtgcttggacgg

SEQ ID NO: 657121 - DNA, 20 bp, mouse
gcacctctgcgcctattggt

SEQ ID NO: 657122 - DNA, 20 bp, mouse
ggtcagcgcgttgacgtgaa

SEQ ID NO: 657123 - DNA, 20 bp, mouse
gcctcctaggggagcctcga

SEQ ID NO: 657124 - DNA, 20 bp, mouse
gtggacggtgggacgccgag

SEQ ID NO: 657125 - DNA, 20 bp, mouse
ggcagaggtgcctcccagtg

SEQ ID NO: 657126 - DNA, 20 bp, mouse
gccgacgtggccgaggtggt

SEQ ID NO: 657127 - DNA, 20 bp, mouse
gcacgtgcgcctttggtctg

SEQ ID NO: 657128 - DNA, 20 bp, mouse
ggtggtgggctaccaggtag

SEQ ID NO: 657129 - DNA, 20 bp, mouse
ggagcccgacgtggccgagg

SEQ ID NO: 657130 - DNA, 20 bp, mouse
ggggcgctgcacgactgggg

SEQ ID NO: 657131 - DNA, 20 bp, mouse
ggctaccaggtaggggtcgc

SEQ ID NO: 657132 - DNA, 20 bp, mouse
ggcgcctttggtctggggta

SEQ ID NO: 657133 - DNA, 20 bp, mouse
ggacgcggctccagcttctc

SEQ ID NO: 657134 - DNA, 20 bp, mouse
ggaagaaggtggtgtcgaaa

SEQ ID NO: 657135 - DNA, 20 bp, mouse
gtctgggcgctgcacgactg

SEQ ID NO: 657136 - DNA, 20 bp, mouse
ggggaaactggtgaagtcag

SEQ ID NO: 657137 - DNA, 20 bp, mouse
gaagggaagttgaacgataa

SEQ ID NO: 657138 - DNA, 20 bp, mouse
gcctggctacagttctttta

SEQ ID NO: 657139 - DNA, 20 bp, mouse
gtatagacacagctggattt

SEQ ID NO: 657140 - DNA, 20 bp, mouse
gcaacaaatgttgctaagta

SEQ ID NO: 657141 - DNA, 20 bp, mouse
gaaaaggacaatacatacag

SEQ ID NO: 657142 - DNA, 20 bp, mouse
gatacatacagaggtctaag

SEQ ID NO: 657143 - DNA, 20 bp, mouse
gaaagacaatttgtcttgtg

SEQ ID NO: 657144 - DNA, 20 bp, mouse
gaaataattgctattttctc

SEQ ID NO: 657145 - DNA, 20 bp, mouse
gaatgacctatagacacagc

SEQ ID NO: 657146 - DNA, 20 bp, mouse
gagtggaccctggggttata

SEQ ID NO: 657147 - DNA, 20 bp, mouse
gtggcgtgtgagggcccctg

SEQ ID NO: 657148 - DNA, 20 bp, mouse
gtggggttatatggcgtgtg

SEQ ID NO: 657149 - DNA, 20 bp, mouse
ggtgtgtagagaaaacactg

SEQ ID NO: 657150 - DNA, 20 bp, mouse
gtctcagtcaagtctggttt

SEQ ID NO: 657151 - DNA, 20 bp, mouse
gacactctctcagtcaagtc

SEQ ID NO: 657152 - DNA, 20 bp, mouse
gttaacagagggttattcca

SEQ ID NO: 657153 - DNA, 20 bp, mouse
ggacattttgagtggaccct

SEQ ID NO: 657154 - DNA, 20 bp, mouse
gaatgctcgaatcaagaaac

SEQ ID NO: 657155 - DNA, 20 bp, mouse
gtgaatgtccttcctcccca

SEQ ID NO: 657156 - DNA, 20 bp, mouse
ggcacggggctaggatgact

SEQ ID NO: 657157 - DNA, 20 bp, mouse
ggggctaggatgactgggat

SEQ ID NO: 657158 - DNA, 20 bp, mouse
gtgaacaggggcacggggct

SEQ ID NO: 657159 - DNA, 20 bp, mouse
gccaccgagaaaagcatgtt

SEQ ID NO: 657160 - DNA, 20 bp, mouse
gaaagcatgttgggaaaggt

SEQ ID NO: 657161 - DNA, 20 bp, mouse
gagagatgaacaggggcacg

SEQ ID NO: 657162 - DNA, 20 bp, mouse
gtgcaggcaagcttaaagtt

SEQ ID NO: 657163 - DNA, 20 bp, mouse
gataaatacaggtagcaaag

SEQ ID NO: 657164 - DNA, 20 bp, mouse
gtttcccaacatgcttttct

SEQ ID NO: 657165 - DNA, 20 bp, mouse
ggaagtaaatattagtctga

SEQ ID NO: 657166 - DNA, 20 bp, mouse
gccaatgggcaagaaagtaa

SEQ ID NO: 657167 - DNA, 20 bp, mouse
gtctgcagagggaggcatga

SEQ ID NO: 657168 - DNA, 20 bp, mouse
gggcctgagcgaatgatcta

SEQ ID NO: 657169 - DNA, 20 bp, mouse
gtatcacgtctgtggatctt

SEQ ID NO: 657170 - DNA, 20 bp, mouse
gagcctgtttatcacgtctg

SEQ ID NO: 657171 - DNA, 20 bp, mouse
ggggacattccacaggtcgg

SEQ ID NO: 657172 - DNA, 20 bp, mouse
gatccacagacgtgataaac

SEQ ID NO: 657173 - DNA, 20 bp, mouse
gtctgcagatcccgggatct

SEQ ID NO: 657174 - DNA, 20 bp, mouse
gcttgtggctcgagagagtt

SEQ ID NO: 657175 - DNA, 20 bp, mouse
gagaggtcaagtaaggtcca

SEQ ID NO: 657176 - DNA, 20 bp, mouse
gaataaatgaaggcggtccc

SEQ ID NO: 657177 - DNA, 20 bp, mouse
gaatccggactcagatccgg

SEQ ID NO: 657178 - DNA, 20 bp, mouse
gagaacatgaaactgaaaat

SEQ ID NO: 657179 - DNA, 20 bp, mouse
gtagggtgtgctcttgagtt

SEQ ID NO: 657180 - DNA, 20 bp, mouse
gtaagagcgcgcgccctggc

SEQ ID NO: 657181 - DNA, 20 bp, mouse
gccttggtgccctactatct

SEQ ID NO: 657182 - DNA, 20 bp, mouse
gagagcacaccctagatagt

SEQ ID NO: 657183 - DNA, 20 bp, mouse
gaggctgtttgaaatatcac

SEQ ID NO: 657184 - DNA, 20 bp, mouse
gatgctgaactaggttacaa

SEQ ID NO: 657185 - DNA, 20 bp, mouse
gtagctgttgatgctgaact

SEQ ID NO: 657186 - DNA, 20 bp, mouse
gagagagccggggttggagg

SEQ ID NO: 657187 - DNA, 20 bp, mouse
ggcggcgataacagcgataa

SEQ ID NO: 657188 - DNA, 20 bp, mouse
gactaagtggagctgaccaa

SEQ ID NO: 657189 - DNA, 20 bp, mouse
gacttaggcgaagcctgcgg

SEQ ID NO: 657190 - DNA, 20 bp, mouse
gccagcatcacggccaccgc

SEQ ID NO: 657191 - DNA, 20 bp, mouse
gataacagcgataacggcgc

SEQ ID NO: 657192 - DNA, 20 bp, mouse
gggcacgaggcagagagccg

SEQ ID NO: 657193 - DNA, 20 bp, mouse
gtgatgctggcgcccgcccg

SEQ ID NO: 657194 - DNA, 20 bp, mouse
gcagctgccggcctctgccg

SEQ ID NO: 657195 - DNA, 20 bp, mouse
gcgcccgctcggcgtgcgtg

SEQ ID NO: 657196 - DNA, 20 bp, mouse
gcacgctcctgtctgccgga

SEQ ID NO: 657197 - DNA, 20 bp, mouse
gtgcagggacgcggactgaa

SEQ ID NO: 657198 - DNA, 20 bp, mouse
ggggacgcggactgaagggc

SEQ ID NO: 657199 - DNA, 20 bp, mouse
ggtacccgcctttactacag

SEQ ID NO: 657200 - DNA, 20 bp, mouse
gtgctgctacgcaacgctgg

SEQ ID NO: 657201 - DNA, 20 bp, mouse
gggctgggcgagagcgagga

SEQ ID NO: 657202 - DNA, 20 bp, mouse
gctgggaaacgtagtttctc

SEQ ID NO: 657203 - DNA, 20 bp, mouse
gagagcgaggagggctgaac

SEQ ID NO: 657204 - DNA, 20 bp, mouse
gctcctgtctgccggaaggg

SEQ ID NO: 657205 - DNA, 20 bp, mouse
ggcagcacgcatagctctct

SEQ ID NO: 657206 - DNA, 20 bp, mouse
gctgactgtcagctgctgac

SEQ ID NO: 657207 - DNA, 20 bp, mouse
gggagtgagcccctggatgc

SEQ ID NO: 657208 - DNA, 20 bp, mouse
ggactaagtaagttcaatcc

SEQ ID NO: 657209 - DNA, 20 bp, mouse
gtcctcctgccagcatccag

SEQ ID NO: 657210 - DNA, 20 bp, mouse
gaatggggccaacctgggag

SEQ ID NO: 657211 - DNA, 20 bp, mouse
gggcaaggatatctttgcat

SEQ ID NO: 657212 - DNA, 20 bp, mouse
gaaagaaatgacgcccttgt

SEQ ID NO: 657213 - DNA, 20 bp, mouse
gtagtcgatcacaaacaata

SEQ ID NO: 657214 - DNA, 20 bp, mouse
gcccaaccattagaagaatg

SEQ ID NO: 657215 - DNA, 20 bp, mouse
ggcccctggatgctggcagg

SEQ ID NO: 657216 - DNA, 20 bp, mouse
ggaagctaggaggttatttc

SEQ ID NO: 657217 - DNA, 20 bp, mouse
ggaccacgagcactggtgac

SEQ ID NO: 657218 - DNA, 20 bp, mouse
gtaaagaagcagaccctttg

SEQ ID NO: 657219 - DNA, 20 bp, mouse
gctccagtcaccagtgctcg

SEQ ID NO: 657220 - DNA, 20 bp, mouse
gcaagaatatgaaaatggct

SEQ ID NO: 657221 - DNA, 20 bp, mouse
gatacattgaccacgagcac

SEQ ID NO: 657222 - DNA, 20 bp, mouse
gcataaacaatttctgttca

SEQ ID NO: 657223 - DNA, 20 bp, mouse
gcaatttctgttcatgggag

SEQ ID NO: 657224 - DNA, 20 bp, mouse
gtgcttactttagtcattgc

SEQ ID NO: 657225 - DNA, 20 bp, mouse
gtgggagaggagaagctagg

SEQ ID NO: 657226 - DNA, 20 bp, mouse
gtgaacgcaaacaatcacgt

SEQ ID NO: 657227 - DNA, 20 bp, mouse
gttgactaaaaacccgaggt

SEQ ID NO: 657228 - DNA, 20 bp, mouse
gaagcattaggatgaaatgg

SEQ ID NO: 657229 - DNA, 20 bp, mouse
gcagaacaaatacaagcatt

SEQ ID NO: 657230 - DNA, 20 bp, mouse
gtaaatatttctgtgttgga

SEQ ID NO: 657231 - DNA, 20 bp, mouse
gctgcacagagcaaaaaagt

SEQ ID NO: 657232 - DNA, 20 bp, mouse
gtttatttgaacttatgcac

SEQ ID NO: 657233 - DNA, 20 bp, mouse
ggcagctgacttagataagc

SEQ ID NO: 657234 - DNA, 20 bp, mouse
gagaatttaacgtcactgct

SEQ ID NO: 657235 - DNA, 20 bp, mouse
gcgcaacatgaagtaagtgc

SEQ ID NO: 657236 - DNA, 20 bp, mouse
gtaggccggaagccgacaag

SEQ ID NO: 657237 - DNA, 20 bp, mouse
ggtaaagcacgcggaatacc

SEQ ID NO: 657238 - DNA, 20 bp, mouse
gagtagggacggaccgggaa

SEQ ID NO: 657239 - DNA, 20 bp, mouse
gttaggtgcagcaaactggg

SEQ ID NO: 657240 - DNA, 20 bp, mouse
ggggcggcaaccactgttaa

SEQ ID NO: 657241 - DNA, 20 bp, mouse
gcggcctagagaggcatgat

SEQ ID NO: 657242 - DNA, 20 bp, mouse
gaaactgagacggaggtcat

SEQ ID NO: 657243 - DNA, 20 bp, mouse
gattccgcgtgctttacagt

SEQ ID NO: 657244 - DNA, 20 bp, mouse
gccggtgttgaaaacctcca

SEQ ID NO: 657245 - DNA, 20 bp, mouse
gcacgccgcttgtcggcttc

SEQ ID NO: 657246 - DNA, 20 bp, mouse
ggagtcccgcagcgcagcag

SEQ ID NO: 657247 - DNA, 20 bp, mouse
gcggccggttagtcagagcc

SEQ ID NO: 657248 - DNA, 20 bp, mouse
gagcggccctagaggagctg

SEQ ID NO: 657249 - DNA, 20 bp, mouse
ggcagcagctcgctgctctg

SEQ ID NO: 657250 - DNA, 20 bp, mouse
gcagcccgcagcggccctag

SEQ ID NO: 657251 - DNA, 20 bp, mouse
ggctcgctgctctgtggtcc

SEQ ID NO: 657252 - DNA, 20 bp, mouse
gtggactggcatttgcaagt

SEQ ID NO: 657253 - DNA, 20 bp, mouse
gagcgcgcggcaatgcgctt

SEQ ID NO: 657254 - DNA, 20 bp, mouse
gcagcaggaaccggctgcca

SEQ ID NO: 657255 - DNA, 20 bp, mouse
ggactgtgataggtgcgcgg

SEQ ID NO: 657256 - DNA, 20 bp, mouse
gccgccctggatatcagctc

SEQ ID NO: 657257 - DNA, 20 bp, mouse
gggaaggctcggaggctgga

SEQ ID NO: 657258 - DNA, 20 bp, mouse
gactcggagactggaaggct

SEQ ID NO: 657259 - DNA, 20 bp, mouse
gcggagactggaaggctcgg

SEQ ID NO: 657260 - DNA, 20 bp, mouse
gtccccggagctgatatcca

SEQ ID NO: 657261 - DNA, 20 bp, mouse
gagggcggctttgaaggata

SEQ ID NO: 657262 - DNA, 20 bp, mouse
gcgcaggcgcggacgctgga

SEQ ID NO: 657263 - DNA, 20 bp, mouse
gcctctgcgaagcaaccaat

SEQ ID NO: 657264 - DNA, 20 bp, mouse
gcggttaggcctggtaacgt

SEQ ID NO: 657265 - DNA, 20 bp, mouse
gttaggcctggtaacgtggg

SEQ ID NO: 657266 - DNA, 20 bp, mouse
gctggaccgcgccctcctct

SEQ ID NO: 657267 - DNA, 20 bp, mouse
gccctctggcggccgggatc

SEQ ID NO: 657268 - DNA, 20 bp, mouse
gggaccacctacaaccgcgc

SEQ ID NO: 657269 - DNA, 20 bp, mouse
gtgtacgctcgcaaccggcg

SEQ ID NO: 657270 - DNA, 20 bp, mouse
gtgggaagcgaagggcatga

SEQ ID NO: 657271 - DNA, 20 bp, mouse
gcaaccggcgcggttgtagg

SEQ ID NO: 657272 - DNA, 20 bp, mouse
gtaagggtgatctactgcta

SEQ ID NO: 657273 - DNA, 20 bp, mouse
gagaagttctgggaagcgaa

SEQ ID NO: 657274 - DNA, 20 bp, mouse
gggggagcgcgagaagggtc

SEQ ID NO: 657275 - DNA, 20 bp, mouse
ggtgatctactgctagggat

SEQ ID NO: 657276 - DNA, 20 bp, mouse
gcggtccgtaccaacctcgc

SEQ ID NO: 657277 - DNA, 20 bp, mouse
gtcagcccgcgaggttggta

SEQ ID NO: 657278 - DNA, 20 bp, mouse
gcggcagctcgcgctcgcgg

SEQ ID NO: 657279 - DNA, 20 bp, mouse
ggataccaagctagaggagg

SEQ ID NO: 657280 - DNA, 20 bp, mouse
gcccagacgccccagaggga

SEQ ID NO: 657281 - DNA, 20 bp, mouse
gacctcgcgggctgaggcgg

SEQ ID NO: 657282 - DNA, 20 bp, mouse
gcggatgcgcggtgcggccg

SEQ ID NO: 657283 - DNA, 20 bp, mouse
ggcccagggcaccccagctt

SEQ ID NO: 657284 - DNA, 20 bp, mouse
gggaggtgataccaagctag

SEQ ID NO: 657285 - DNA, 20 bp, mouse
ggtgccctgggccccgcccg

SEQ ID NO: 657286 - DNA, 20 bp, mouse
gggcaccaggcgctgcctgc

SEQ ID NO: 657287 - DNA, 20 bp, mouse
ggcggaggcgggaagggcca

SEQ ID NO: 657288 - DNA, 20 bp, mouse
ggcgctgctactggcggaga

SEQ ID NO: 657289 - DNA, 20 bp, mouse
gggcagcgcctggtgccacc

SEQ ID NO: 657290 - DNA, 20 bp, mouse
gtctctgcggggtctgagcc

SEQ ID NO: 657291 - DNA, 20 bp, mouse
ggggttgcgcgacctctgcc

SEQ ID NO: 657292 - DNA, 20 bp, mouse
gagggccaaggctctctgcg

SEQ ID NO: 657293 - DNA, 20 bp, mouse
ggtcctcctagtgctccggt

SEQ ID NO: 657294 - DNA, 20 bp, mouse
gcagaccccgcagagagcct

SEQ ID NO: 657295 - DNA, 20 bp, mouse
gtctgcccgcaggcagcgcc

SEQ ID NO: 657296 - DNA, 20 bp, mouse
gcctcctggtaggccattca

SEQ ID NO: 657297 - DNA, 20 bp, mouse
ggccgcgccccgccttcccc

SEQ ID NO: 657298 - DNA, 20 bp, mouse
ggtggagcttgtgctcaatt

SEQ ID NO: 657299 - DNA, 20 bp, mouse
gtgggtcaagcggtcgtggc

SEQ ID NO: 657300 - DNA, 20 bp, mouse
gccgctgggtcaagcggtcg

SEQ ID NO: 657301 - DNA, 20 bp, mouse
gcgacacctgggaccacttc

SEQ ID NO: 657302 - DNA, 20 bp, mouse
gactagccggaagtggtccc

SEQ ID NO: 657303 - DNA, 20 bp, mouse
ggggaggatgccaaatcatg

SEQ ID NO: 657304 - DNA, 20 bp, mouse
gaggcggggtccaccgggac

SEQ ID NO: 657305 - DNA, 20 bp, mouse
ggaaaactcagtgacaaggg

SEQ ID NO: 657306 - DNA, 20 bp, mouse
gcggccgaggacccctggac

SEQ ID NO: 657307 - DNA, 20 bp, mouse
ggaggcgagcggatggtggg

SEQ ID NO: 657308 - DNA, 20 bp, mouse
gcggccgcgcgccgagaccg

SEQ ID NO: 657309 - DNA, 20 bp, mouse
gcatccgctcgcctccatgg

SEQ ID NO: 657310 - DNA, 20 bp, mouse
gagctcgccctctgtgagag

SEQ ID NO: 657311 - DNA, 20 bp, mouse
gctggcacgcgcctccatgg

SEQ ID NO: 657312 - DNA, 20 bp, mouse
ggggaggctgcggtaaatcc

SEQ ID NO: 657313 - DNA, 20 bp, mouse
ggtgggaggagctgcgcgta

SEQ ID NO: 657314 - DNA, 20 bp, mouse
gaaaccggtccaggggtcct

SEQ ID NO: 657315 - DNA, 20 bp, mouse
ggacgcgctaggactggggg

SEQ ID NO: 657316 - DNA, 20 bp, mouse
gggacctgggcgccaactgg

SEQ ID NO: 657317 - DNA, 20 bp, mouse
gccaccgcgcgcgtcaccgc

SEQ ID NO: 657318 - DNA, 20 bp, mouse
gggggcggagagctcgggaa

SEQ ID NO: 657319 - DNA, 20 bp, mouse
gtggcgggagggttcgagtt

SEQ ID NO: 657320 - DNA, 20 bp, mouse
gccgccccgtggcccaagtt

SEQ ID NO: 657321 - DNA, 20 bp, mouse
gcccgggggcgcagtcccag

SEQ ID NO: 657322 - DNA, 20 bp, mouse
gcgtggcccaagtttgggaa

SEQ ID NO: 657323 - DNA, 20 bp, mouse
gtgggcgccaactggcggga

SEQ ID NO: 657324 - DNA, 20 bp, mouse
gcggtggcgcggcgtgtgat

SEQ ID NO: 657325 - DNA, 20 bp, mouse
gttggcgcccaggtcccgct

SEQ ID NO: 657326 - DNA, 20 bp, mouse
gacgcagggtggcgcctaga

SEQ ID NO: 657327 - DNA, 20 bp, mouse
gagactcccaggggaggggt

SEQ ID NO: 657328 - DNA, 20 bp, mouse
gaggcaagaggctacagcag

SEQ ID NO: 657329 - DNA, 20 bp, mouse
gtggggctctaaatgaagga

SEQ ID NO: 657330 - DNA, 20 bp, mouse
gcagggtggcgcctagaggg

SEQ ID NO: 657331 - DNA, 20 bp, mouse
gaatagaggtccactggagg

SEQ ID NO: 657332 - DNA, 20 bp, mouse
gtgggcatggccaagaaaga

SEQ ID NO: 657333 - DNA, 20 bp, mouse
gaggaggaagaggtcaggtt

SEQ ID NO: 657334 - DNA, 20 bp, mouse
gggaggggtaggactggagg

SEQ ID NO: 657335 - DNA, 20 bp, mouse
gtccaggtagaaagacaggt

SEQ ID NO: 657336 - DNA, 20 bp, mouse
gaggcaggtaagggctggca

SEQ ID NO: 657337 - DNA, 20 bp, mouse
gtctccaggaaacacctctg

SEQ ID NO: 657338 - DNA, 20 bp, mouse
gtagctacaagccacatggg

SEQ ID NO: 657339 - DNA, 20 bp, mouse
gggcacgagccactccgcag

SEQ ID NO: 657340 - DNA, 20 bp, mouse
gtggctgtggattgaatgtc

SEQ ID NO: 657341 - DNA, 20 bp, mouse
ggaggtgagagacttgtcac

SEQ ID NO: 657342 - DNA, 20 bp, mouse
gtggtgggtcacagagcatg

SEQ ID NO: 657343 - DNA, 20 bp, mouse
gtcagagtcccaggcctctt

SEQ ID NO: 657344 - DNA, 20 bp, mouse
gatgttgagccctgccaaga

SEQ ID NO: 657345 - DNA, 20 bp, mouse
gggagagggaactgcacgac

SEQ ID NO: 657346 - DNA, 20 bp, mouse
gcccctaccccggtctgtga

SEQ ID NO: 657347 - DNA, 20 bp, mouse
gccaaaggaaagttcttgtt

SEQ ID NO: 657348 - DNA, 20 bp, mouse
gccctaaagtgctatctgtg

SEQ ID NO: 657349 - DNA, 20 bp, mouse
gcaccttcacagaccggggt

SEQ ID NO: 657350 - DNA, 20 bp, mouse
gacgtcaccttcacagaccg

SEQ ID NO: 657351 - DNA, 20 bp, mouse
ggagcctccagctgcttatt

SEQ ID NO: 657352 - DNA, 20 bp, mouse
gcggctagagccggctgaga

SEQ ID NO: 657353 - DNA, 20 bp, mouse
ggagcattcccgaggaagcc

SEQ ID NO: 657354 - DNA, 20 bp, mouse
gcgctggagccggctagagc

SEQ ID NO: 657355 - DNA, 20 bp, mouse
gtcctcacagatagcacttt

SEQ ID NO: 657356 - DNA, 20 bp, mouse
gctcctcaggggtagggtga

SEQ ID NO: 657357 - DNA, 20 bp, mouse
gctaccctgcttttgctggt

SEQ ID NO: 657358 - DNA, 20 bp, mouse
gtaaactaagccactctcac

SEQ ID NO: 657359 - DNA, 20 bp, mouse
gggagtggttctaatctagt

SEQ ID NO: 657360 - DNA, 20 bp, mouse
gcagcaaaagcagggtagac

SEQ ID NO: 657361 - DNA, 20 bp, mouse
gttaaagaatagtttcccag

SEQ ID NO: 657362 - DNA, 20 bp, mouse
gcatcctaccagcaaaagca

SEQ ID NO: 657363 - DNA, 20 bp, mouse
ggcagcttctatacccggag

SEQ ID NO: 657364 - DNA, 20 bp, mouse
ggaggagtgatggcctggat

SEQ ID NO: 657365 - DNA, 20 bp, mouse
gccatcactcctcctcctca

SEQ ID NO: 657366 - DNA, 20 bp, mouse
gcccgtggggcgtgcctctg

SEQ ID NO: 657367 - DNA, 20 bp, mouse
gcgccccacgggaacgcgaa

SEQ ID NO: 657368 - DNA, 20 bp, mouse
gtgtcccgaaggaggcgagg

SEQ ID NO: 657369 - DNA, 20 bp, mouse
gacgtccccacgtgtcccga

SEQ ID NO: 657370 - DNA, 20 bp, mouse
gaggccgctaggcgccgggt

SEQ ID NO: 657371 - DNA, 20 bp, mouse
gcagtgagccggggcacaaa

SEQ ID NO: 657372 - DNA, 20 bp, mouse
gttcccttcgcgttcccgtg

SEQ ID NO: 657373 - DNA, 20 bp, mouse
gcagcaactccgttcagccc

SEQ ID NO: 657374 - DNA, 20 bp, mouse
ggtggggcgtgcctctgagg

SEQ ID NO: 657375 - DNA, 20 bp, mouse
gccgtgaaggcccagcagcg

SEQ ID NO: 657376 - DNA, 20 bp, mouse
ggacgcgccctggcgagtta

SEQ ID NO: 657377 - DNA, 20 bp, mouse
gaggccaaggggctagttcg

SEQ ID NO: 657378 - DNA, 20 bp, mouse
gcagacagggagacgcgccc

SEQ ID NO: 657379 - DNA, 20 bp, mouse
gcccgcgctgcaagtctgga

SEQ ID NO: 657380 - DNA, 20 bp, mouse
gactgtgctgcgagcggggt

SEQ ID NO: 657381 - DNA, 20 bp, mouse
gcgggggaaaggtttagggg

SEQ ID NO: 657382 - DNA, 20 bp, mouse
gaaccagccctaactcgcca

SEQ ID NO: 657383 - DNA, 20 bp, mouse
gacggcgggggaaaggttta

SEQ ID NO: 657384 - DNA, 20 bp, mouse
gccaaagccgcggacctgtg

SEQ ID NO: 657385 - DNA, 20 bp, mouse
gggggccgcgagtgggtgga

SEQ ID NO: 657386 - DNA, 20 bp, mouse
gcccgtgagaggccctctca

SEQ ID NO: 657387 - DNA, 20 bp, mouse
ggagtgccatctctgactgt

SEQ ID NO: 657388 - DNA, 20 bp, mouse
gatgtcggggcgtacacagc

SEQ ID NO: 657389 - DNA, 20 bp, mouse
gtcggggcgtacacagctgg

SEQ ID NO: 657390 - DNA, 20 bp, mouse
gggcactccctgcaccaagg

SEQ ID NO: 657391 - DNA, 20 bp, mouse
gcactcaggcttaggggttg

SEQ ID NO: 657392 - DNA, 20 bp, mouse
gttaaagcactcaggcttag

SEQ ID NO: 657393 - DNA, 20 bp, mouse
gaagcagggcagagttcgga

SEQ ID NO: 657394 - DNA, 20 bp, mouse
gagcaagagtctcccgtgag

SEQ ID NO: 657395 - DNA, 20 bp, mouse
gggctcctgcttggtgaacc

SEQ ID NO: 657396 - DNA, 20 bp, mouse
ggcggcccgtcggtgttctc

SEQ ID NO: 657397 - DNA, 20 bp, mouse
ggggacttacgggtatggga

SEQ ID NO: 657398 - DNA, 20 bp, mouse
gctgctcccgccgagaacgg

SEQ ID NO: 657399 - DNA, 20 bp, mouse
gcccgtcggtgttctctgga

SEQ ID NO: 657400 - DNA, 20 bp, mouse
gccttcgagcagaatgctca

SEQ ID NO: 657401 - DNA, 20 bp, mouse
gagcagaatgctcagggagg

SEQ ID NO: 657402 - DNA, 20 bp, mouse
gcacgtcagtcagtaaggga

SEQ ID NO: 657403 - DNA, 20 bp, mouse
ggcgagccgccgttctcggc

SEQ ID NO: 657404 - DNA, 20 bp, mouse
gtggctcgctagggacttac

SEQ ID NO: 657405 - DNA, 20 bp, mouse
gcaggggcgcccacggactc

SEQ ID NO: 657406 - DNA, 20 bp, mouse
gtctcagccaggtaggggat

SEQ ID NO: 657407 - DNA, 20 bp, mouse
ggcgagaagggggaaggtgc

SEQ ID NO: 657408 - DNA, 20 bp, mouse
ggactgtcccatcccctacc

SEQ ID NO: 657409 - DNA, 20 bp, mouse
ggggccaagctgttctggac

SEQ ID NO: 657410 - DNA, 20 bp, mouse
gaactcccttggaagatgag

SEQ ID NO: 657411 - DNA, 20 bp, mouse
gcctccactgaaatcagtct

SEQ ID NO: 657412 - DNA, 20 bp, mouse
ggggaaaggatggcgagaag

SEQ ID NO: 657413 - DNA, 20 bp, mouse
ggtcccaagactgatttcag

SEQ ID NO: 657414 - DNA, 20 bp, mouse
gtctccaggagcggatctgt

SEQ ID NO: 657415 - DNA, 20 bp, mouse
gtcctcctctcatcttccaa

SEQ ID NO: 657416 - DNA, 20 bp, mouse
gccctgtgtgaattgttcag

SEQ ID NO: 657417 - DNA, 20 bp, mouse
ggggaaatgtgtctctggcc

SEQ ID NO: 657418 - DNA, 20 bp, mouse
gtggggtggtagcgggtaaa

SEQ ID NO: 657419 - DNA, 20 bp, mouse
gtggaccaagatgggaggtg

SEQ ID NO: 657420 - DNA, 20 bp, mouse
gcaggacaccccagaaaaga

SEQ ID NO: 657421 - DNA, 20 bp, mouse
gaagccaggttggaccaaga

SEQ ID NO: 657422 - DNA, 20 bp, mouse
gcaggttggaccaagatggg

SEQ ID NO: 657423 - DNA, 20 bp, mouse
gtcagaggcaggccctcggg

SEQ ID NO: 657424 - DNA, 20 bp, mouse
gacacagggaaatgtgtctc

SEQ ID NO: 657425 - DNA, 20 bp, mouse
gctgcctgagggcctcccga

SEQ ID NO: 657426 - DNA, 20 bp, mouse
gttaacaagtagtccttagg

SEQ ID NO: 657427 - DNA, 20 bp, mouse
gatggaaacgtgatgagctt

SEQ ID NO: 657428 - DNA, 20 bp, mouse
ggggcaggccgcctgaaact

SEQ ID NO: 657429 - DNA, 20 bp, mouse
gacgaaagctgggtgaccat

SEQ ID NO: 657430 - DNA, 20 bp, mouse
ggactgcttcacacgaaagc

SEQ ID NO: 657431 - DNA, 20 bp, mouse
gttcaggcccaacatctggt

SEQ ID NO: 657432 - DNA, 20 bp, mouse
ggacttacggaccaagtttc

SEQ ID NO: 657433 - DNA, 20 bp, mouse
gacaaaacctgatcaaagca

SEQ ID NO: 657434 - DNA, 20 bp, mouse
gtgagtgctactgaacctgc

SEQ ID NO: 657435 - DNA, 20 bp, mouse
gacgtttccatgctttgatc

SEQ ID NO: 657436 - DNA, 20 bp, mouse
gagcttggaagggcaaccca

SEQ ID NO: 657437 - DNA, 20 bp, mouse
ggggactgattacgattctg

SEQ ID NO: 657438 - DNA, 20 bp, mouse
gaggatgtctatgcaaagtt

SEQ ID NO: 657439 - DNA, 20 bp, mouse
gccttccaagctggcagaaa

SEQ ID NO: 657440 - DNA, 20 bp, mouse
gaagtattgcacatgtgaac

SEQ ID NO: 657441 - DNA, 20 bp, mouse
gactgatgccaatacagtgt

SEQ ID NO: 657442 - DNA, 20 bp, mouse
gctggcaccccacactgtat

SEQ ID NO: 657443 - DNA, 20 bp, mouse
ggaactatgaacagttgctc

SEQ ID NO: 657444 - DNA, 20 bp, mouse
ggtccaagaaaatcatatga

SEQ ID NO: 657445 - DNA, 20 bp, mouse
gctgtatcaaaggggagtct

SEQ ID NO: 657446 - DNA, 20 bp, mouse
ggtaggagggtctaacctga

SEQ ID NO: 657447 - DNA, 20 bp, mouse
gaggaagtggcggaactggc

SEQ ID NO: 657448 - DNA, 20 bp, mouse
ggtggcggaactggccgggg

SEQ ID NO: 657449 - DNA, 20 bp, mouse
gatgtggcatgttgggaaac

SEQ ID NO: 657450 - DNA, 20 bp, mouse
gttgggaaactgggtgtgtg

SEQ ID NO: 657451 - DNA, 20 bp, mouse
gctctgtcacctgccttctg

SEQ ID NO: 657452 - DNA, 20 bp, mouse
gagagctgagaacacccagg

SEQ ID NO: 657453 - DNA, 20 bp, mouse
gaggagagctgagaacaccc

SEQ ID NO: 657454 - DNA, 20 bp, mouse
gcccaagatgcacccacaga

SEQ ID NO: 657455 - DNA, 20 bp, mouse
ggacagagtcagaggccctt

SEQ ID NO: 657456 - DNA, 20 bp, mouse
ggacagcagtatgcccagta

SEQ ID NO: 657457 - DNA, 20 bp, mouse
gtccccaaactgcatgtggc

SEQ ID NO: 657458 - DNA, 20 bp, mouse
gagtgtccccaaactgcatg

SEQ ID NO: 657459 - DNA, 20 bp, mouse
gttaagagcagatctgctaa

SEQ ID NO: 657460 - DNA, 20 bp, mouse
gtccacggctgcctgcaact

SEQ ID NO: 657461 - DNA, 20 bp, mouse
gcaactgctcaggaccatac

SEQ ID NO: 657462 - DNA, 20 bp, mouse
gttagtagatgttttctaac

SEQ ID NO: 657463 - DNA, 20 bp, mouse
ggcagtcaacacttcctctg

SEQ ID NO: 657464 - DNA, 20 bp, mouse
gcctctcaaacttgcatcac

SEQ ID NO: 657465 - DNA, 20 bp, mouse
gtcaccagccacatgcagtt

SEQ ID NO: 657466 - DNA, 20 bp, mouse
ggacgcggagaagattgctt

SEQ ID NO: 657467 - DNA, 20 bp, mouse
gaccgcggtttggggacgaa

SEQ ID NO: 657468 - DNA, 20 bp, mouse
gtgaacgagtggggaaatgg

SEQ ID NO: 657469 - DNA, 20 bp, mouse
gctggctgcggcacaggctc

SEQ ID NO: 657470 - DNA, 20 bp, mouse
ggaaaaggggggaccttccc

SEQ ID NO: 657471 - DNA, 20 bp, mouse
gctgtgaacgagtggggaaa

SEQ ID NO: 657472 - DNA, 20 bp, mouse
gaacccaatcgcccttcctg

SEQ ID NO: 657473 - DNA, 20 bp, mouse
gtaggccggccattgagtaa

SEQ ID NO: 657474 - DNA, 20 bp, mouse
ggcacctggcgggtcaggga

SEQ ID NO: 657475 - DNA, 20 bp, mouse
gagggagcccgacagtgtcg

SEQ ID NO: 657476 - DNA, 20 bp, mouse
gtcccggtacatgatccctc

SEQ ID NO: 657477 - DNA, 20 bp, mouse
ggcgccaggagcctatgtcc

SEQ ID NO: 657478 - DNA, 20 bp, mouse
gcaccggagggatcatgtac

SEQ ID NO: 657479 - DNA, 20 bp, mouse
gctgggcgttggtcaccgga

SEQ ID NO: 657480 - DNA, 20 bp, mouse
gagccccgacgacagttctg

SEQ ID NO: 657481 - DNA, 20 bp, mouse
gaagcctgggcgttggtcac

SEQ ID NO: 657482 - DNA, 20 bp, mouse
gcgtccaggatgtgttccaa

SEQ ID NO: 657483 - DNA, 20 bp, mouse
gggatcatgtaccgggacat

SEQ ID NO: 657484 - DNA, 20 bp, mouse
gtggcgccgcacagccacag

SEQ ID NO: 657485 - DNA, 20 bp, mouse
gaggtccagcgcctgggcgg

SEQ ID NO: 657486 - DNA, 20 bp, mouse
gtggtccctggcgtactcac

SEQ ID NO: 657487 - DNA, 20 bp, mouse
gggtgtgtggggtgatgatg

SEQ ID NO: 657488 - DNA, 20 bp, mouse
gcccctagagaatgagggaa

SEQ ID NO: 657489 - DNA, 20 bp, mouse
gcggcttggagttatgtggg

SEQ ID NO: 657490 - DNA, 20 bp, mouse
gtcaccgtcaagatattcga

SEQ ID NO: 657491 - DNA, 20 bp, mouse
gcaagccggtgagtacgcca

SEQ ID NO: 657492 - DNA, 20 bp, mouse
gcccgccccctagagaatga

SEQ ID NO: 657493 - DNA, 20 bp, mouse
gcaccggcttggagttatgt

SEQ ID NO: 657494 - DNA, 20 bp, mouse
gggcgtgggcgggacaggta

SEQ ID NO: 657495 - DNA, 20 bp, mouse
gggcggggccaaggcgtggg

SEQ ID NO: 657496 - DNA, 20 bp, mouse
gcgcgcgtcgtgtggatcat

SEQ ID NO: 657497 - DNA, 20 bp, mouse
gcgcgcggccggcgaacacc

SEQ ID NO: 657498 - DNA, 20 bp, mouse
ggggaccgaatctgcggtga

SEQ ID NO: 657499 - DNA, 20 bp, mouse
ggtgtccctcaccgcagatt

SEQ ID NO: 657500 - DNA, 20 bp, mouse
gaccccgcctccgagcatca

SEQ ID NO: 657501 - DNA, 20 bp, mouse
gtgcccgagccaatcggccg

SEQ ID NO: 657502 - DNA, 20 bp, mouse
gggagcgtgagcagccggga

SEQ ID NO: 657503 - DNA, 20 bp, mouse
ggaggccatggcagggacga

SEQ ID NO: 657504 - DNA, 20 bp, mouse
gccgcgcgcccggggatgcg

SEQ ID NO: 657505 - DNA, 20 bp, mouse
gggaggcggggtggcgcgtt

SEQ ID NO: 657506 - DNA, 20 bp, mouse
ggggcggggcatgagggaca

SEQ ID NO: 657507 - DNA, 20 bp, mouse
gggggcggagtctaaggggt

SEQ ID NO: 657508 - DNA, 20 bp, mouse
gtgggggggcggagtctaag

SEQ ID NO: 657509 - DNA, 20 bp, mouse
ggagggacaaggctcggaga

SEQ ID NO: 657510 - DNA, 20 bp, mouse
gctagggcggggcctcaacc

SEQ ID NO: 657511 - DNA, 20 bp, mouse
gctgttcgcggaacctgggg

SEQ ID NO: 657512 - DNA, 20 bp, mouse
gtcaacccaaggctgcggtg

SEQ ID NO: 657513 - DNA, 20 bp, mouse
gggctcggagaggggactga

SEQ ID NO: 657514 - DNA, 20 bp, mouse
gcgagaggggcggggcatga

SEQ ID NO: 657515 - DNA, 20 bp, mouse
gcacaagcgcggatgagcag

SEQ ID NO: 657516 - DNA, 20 bp, mouse
gcagcggggaggtgcgtttg

SEQ ID NO: 657517 - DNA, 20 bp, mouse
gcgcgcagggccaacggcag

SEQ ID NO: 657518 - DNA, 20 bp, mouse
gtgagacccaggaaggacgc

SEQ ID NO: 657519 - DNA, 20 bp, mouse
gcgtgcgggcgcactggagg

SEQ ID NO: 657520 - DNA, 20 bp, mouse
gccgcgctacggctcctcgg

SEQ ID NO: 657521 - DNA, 20 bp, mouse
gcgcggcccagccagcgggg

SEQ ID NO: 657522 - DNA, 20 bp, mouse
gaaggacgcaggaatccatc

SEQ ID NO: 657523 - DNA, 20 bp, mouse
gagctgatggaggaacctga

SEQ ID NO: 657524 - DNA, 20 bp, mouse
gctgcgcggcccagccagcg

SEQ ID NO: 657525 - DNA, 20 bp, mouse
gcagggccaacggcaggggc

SEQ ID NO: 657526 - DNA, 20 bp, mouse
gaggagactgcgaagtcgag

SEQ ID NO: 657527 - DNA, 20 bp, mouse
gccacccatgtgcacctccg

SEQ ID NO: 657528 - DNA, 20 bp, mouse
gtgagcgatggaaccccgtt

SEQ ID NO: 657529 - DNA, 20 bp, mouse
gttggtggcccgcaccgcgg

SEQ ID NO: 657530 - DNA, 20 bp, mouse
ggacttcgcagtctcctaac

SEQ ID NO: 657531 - DNA, 20 bp, mouse
gcgaagtcgagaggaagcac

SEQ ID NO: 657532 - DNA, 20 bp, mouse
gcggtgcgggccaccaacta

SEQ ID NO: 657533 - DNA, 20 bp, mouse
gcttgccagtccttagttgg

SEQ ID NO: 657534 - DNA, 20 bp, mouse
ggcagagaagtctcaggtcc

SEQ ID NO: 657535 - DNA, 20 bp, mouse
gcgggccaccaactaaggac

SEQ ID NO: 657536 - DNA, 20 bp, mouse
gcgggagcttgagaattaaa

SEQ ID NO: 657537 - DNA, 20 bp, mouse
ggtactgaggataactagtt

SEQ ID NO: 657538 - DNA, 20 bp, mouse
gccatccccggggacatcac

SEQ ID NO: 657539 - DNA, 20 bp, mouse
gacctggtgcagcctccctc

SEQ ID NO: 657540 - DNA, 20 bp, mouse
gctgcagagccgcctcccgg

SEQ ID NO: 657541 - DNA, 20 bp, mouse
gaggataactagttaggctc

SEQ ID NO: 657542 - DNA, 20 bp, mouse
gtcgcgcgcagcgccatcga

SEQ ID NO: 657543 - DNA, 20 bp, mouse
gccgcagcgcgtggtgggat

SEQ ID NO: 657544 - DNA, 20 bp, mouse
gagctcccgcagcgcgtggt

SEQ ID NO: 657545 - DNA, 20 bp, mouse
gaggttccggtgatgtcccc

SEQ ID NO: 657546 - DNA, 20 bp, mouse
gtaagggcggggcctaaact

SEQ ID NO: 657547 - DNA, 20 bp, mouse
ggggcaagggccgcagtctg

SEQ ID NO: 657548 - DNA, 20 bp, mouse
ggacctgaggcaggcctgat

SEQ ID NO: 657549 - DNA, 20 bp, mouse
gagggcggggcctgatgtta

SEQ ID NO: 657550 - DNA, 20 bp, mouse
gggtccccgccggtgttctc

SEQ ID NO: 657551 - DNA, 20 bp, mouse
gggggcggggcctgttagga

SEQ ID NO: 657552 - DNA, 20 bp, mouse
ggcctgatggggaccgagta

SEQ ID NO: 657553 - DNA, 20 bp, mouse
ggatggggaccgagtaaggg

SEQ ID NO: 657554 - DNA, 20 bp, mouse
gtccgcgagcctgagaacac

SEQ ID NO: 657555 - DNA, 20 bp, mouse
gggggagggggataagggcg

SEQ ID NO: 657556 - DNA, 20 bp, mouse
gtgggaagcgctctgtacca

SEQ ID NO: 657557 - DNA, 20 bp, mouse
gccctcccggtcaccatccc

SEQ ID NO: 657558 - DNA, 20 bp, mouse
gaggacccgcggcgctccag

SEQ ID NO: 657559 - DNA, 20 bp, mouse
ggagggcggggcgacgtggg

SEQ ID NO: 657560 - DNA, 20 bp, mouse
ggagccttgcaggggtctcg

SEQ ID NO: 657561 - DNA, 20 bp, mouse
gtcaccatccctggtggacc

SEQ ID NO: 657562 - DNA, 20 bp, mouse
gtaccagggatgatgttcat

SEQ ID NO: 657563 - DNA, 20 bp, mouse
gtccaccagggatggtgacc

SEQ ID NO: 657564 - DNA, 20 bp, mouse
ggggcgacgtggggggatgc

SEQ ID NO: 657565 - DNA, 20 bp, mouse
gacagtccataaatccagga

SEQ ID NO: 657566 - DNA, 20 bp, mouse
gccaaccggagggacggact

SEQ ID NO: 657567 - DNA, 20 bp, mouse
gaggttctcactacatacaa

SEQ ID NO: 657568 - DNA, 20 bp, mouse
gtctctgctgggctgaccgt

SEQ ID NO: 657569 - DNA, 20 bp, mouse
gctcccatcacccaagtcaa

SEQ ID NO: 657570 - DNA, 20 bp, mouse
gtgcagccggcccaaccgga

SEQ ID NO: 657571 - DNA, 20 bp, mouse
gtccgtccctccggttgggc

SEQ ID NO: 657572 - DNA, 20 bp, mouse
gccactggatgtcacaagaa

SEQ ID NO: 657573 - DNA, 20 bp, mouse
gtaacagaacgtctgggata

SEQ ID NO: 657574 - DNA, 20 bp, mouse
gactacatacaagggcccac

SEQ ID NO: 657575 - DNA, 20 bp, mouse
gtgtctggagaaccgatggc

SEQ ID NO: 657576 - DNA, 20 bp, mouse
gaggggttcacccctaggaa

SEQ ID NO: 657577 - DNA, 20 bp, mouse
gtaaagaggggttcacccct

SEQ ID NO: 657578 - DNA, 20 bp, mouse
gcatgcgaggagatggagtg

SEQ ID NO: 657579 - DNA, 20 bp, mouse
ggggtgaacccctctttact

SEQ ID NO: 657580 - DNA, 20 bp, mouse
gcaggagtagtcactagcaa

SEQ ID NO: 657581 - DNA, 20 bp, mouse
gagaaaagagggtatcagtt

SEQ ID NO: 657582 - DNA, 20 bp, mouse
ggctgctaattggagataaa

SEQ ID NO: 657583 - DNA, 20 bp, mouse
gaagggaatgagcctttcct

SEQ ID NO: 657584 - DNA, 20 bp, mouse
ggtaccccagaagtgccaga

SEQ ID NO: 657585 - DNA, 20 bp, mouse
ggaagtgccagaaggagaaa

SEQ ID NO: 657586 - DNA, 20 bp, mouse
ggggaaggagcagctgaagg

SEQ ID NO: 657587 - DNA, 20 bp, mouse
gctcctccgcacagcatccg

SEQ ID NO: 657588 - DNA, 20 bp, mouse
gatgctgtgcggaggagccg

SEQ ID NO: 657589 - DNA, 20 bp, mouse
ggaaagggccgcggaccaat

SEQ ID NO: 657590 - DNA, 20 bp, mouse
ggcggcgcaccgggttgttt

SEQ ID NO: 657591 - DNA, 20 bp, mouse
ggccgcggaccaatgggcaa

SEQ ID NO: 657592 - DNA, 20 bp, mouse
ggggaggaggcctgtggtat

SEQ ID NO: 657593 - DNA, 20 bp, mouse
gaggagccggggctgcctag

SEQ ID NO: 657594 - DNA, 20 bp, mouse
gcccaatagcgcaaggtgat

SEQ ID NO: 657595 - DNA, 20 bp, mouse
gagccggggctgcctagggg

SEQ ID NO: 657596 - DNA, 20 bp, mouse
gcacctcagaagagagtcat

SEQ ID NO: 657597 - DNA, 20 bp, mouse
gagggatggctcacctgctt

SEQ ID NO: 657598 - DNA, 20 bp, mouse
gctaaggaacctctgagcag

SEQ ID NO: 657599 - DNA, 20 bp, mouse
gcactagctagccttttgtc

SEQ ID NO: 657600 - DNA, 20 bp, mouse
gcatgggcttcaggccccta

SEQ ID NO: 657601 - DNA, 20 bp, mouse
gatagtgtgcaagtagtcct

SEQ ID NO: 657602 - DNA, 20 bp, mouse
gagcccatgactctcttctg

SEQ ID NO: 657603 - DNA, 20 bp, mouse
gtctggctggcaacccaagc

SEQ ID NO: 657604 - DNA, 20 bp, mouse
gagggggcggagccggcctt

SEQ ID NO: 657605 - DNA, 20 bp, mouse
gcccctccggcgcgccccca

SEQ ID NO: 657606 - DNA, 20 bp, mouse
ggggactggacttgaaattt

SEQ ID NO: 657607 - DNA, 20 bp, mouse
gcaaaaccggttcccatcag

SEQ ID NO: 657608 - DNA, 20 bp, mouse
gacaacgttcaagtttactc

SEQ ID NO: 657609 - DNA, 20 bp, mouse
gtcaagtccagtcccctgat

SEQ ID NO: 657610 - DNA, 20 bp, mouse
gaaactagaagcatttaggc

SEQ ID NO: 657611 - DNA, 20 bp, mouse
gcggctttcgatgtgaaagt

SEQ ID NO: 657612 - DNA, 20 bp, mouse
gcacgtggttttgagtgagg

SEQ ID NO: 657613 - DNA, 20 bp, mouse
gaacgatggctggcttaaca

SEQ ID NO: 657614 - DNA, 20 bp, mouse
ggatcacgtggttttgagtg

SEQ ID NO: 657615 - DNA, 20 bp, mouse
gccggttcccatcaggggac

SEQ ID NO: 657616 - DNA, 20 bp, mouse
gtctcctagccatgcatcct

SEQ ID NO: 657617 - DNA, 20 bp, mouse
gaccactgatggcctgaatc

SEQ ID NO: 657618 - DNA, 20 bp, mouse
gccgcgcagcctaggatgca

SEQ ID NO: 657619 - DNA, 20 bp, mouse
ggccctgaaaggagcctcct

SEQ ID NO: 657620 - DNA, 20 bp, mouse
gcatggctaggagagtttag

SEQ ID NO: 657621 - DNA, 20 bp, mouse
gcagcctaggatgcatggct

SEQ ID NO: 657622 - DNA, 20 bp, mouse
gtcacctagtgcggtgaccc

SEQ ID NO: 657623 - DNA, 20 bp, mouse
gtctccggggtcaccgcact

SEQ ID NO: 657624 - DNA, 20 bp, mouse
ggcgcggatgtcacctagtg

SEQ ID NO: 657625 - DNA, 20 bp, mouse
gagggcagaggacgaaagga

SEQ ID NO: 657626 - DNA, 20 bp, mouse
gtcacccagcacattgtctc

SEQ ID NO: 657627 - DNA, 20 bp, mouse
gggaacctaacccccagggg

SEQ ID NO: 657628 - DNA, 20 bp, mouse
gtccgtggacccgcccctgg

SEQ ID NO: 657629 - DNA, 20 bp, mouse
ggcgcggaacctaaccccca

SEQ ID NO: 657630 - DNA, 20 bp, mouse
gaggttccgcgcgacagaca

SEQ ID NO: 657631 - DNA, 20 bp, mouse
gacggcaaagacgccatcgt

SEQ ID NO: 657632 - DNA, 20 bp, mouse
gcaaagacgccatcgttgga

SEQ ID NO: 657633 - DNA, 20 bp, mouse
gttccgcgcgacagacacgg

SEQ ID NO: 657634 - DNA, 20 bp, mouse
ggttggaaggcttggtgcgc

SEQ ID NO: 657635 - DNA, 20 bp, mouse
ggagtgaagtcacacagtgc

SEQ ID NO: 657636 - DNA, 20 bp, mouse
gctggggcgtaaggcgtcgc

SEQ ID NO: 657637 - DNA, 20 bp, mouse
gacgccttacgccccagagt

SEQ ID NO: 657638 - DNA, 20 bp, mouse
ggggcggggcgtagtcgtga

SEQ ID NO: 657639 - DNA, 20 bp, mouse
gcctcccactctggggcgta

SEQ ID NO: 657640 - DNA, 20 bp, mouse
ggagccagccgacactaaac

SEQ ID NO: 657641 - DNA, 20 bp, mouse
ggcgtgaagaagatatggag

SEQ ID NO: 657642 - DNA, 20 bp, mouse
gcgccctgcgtgctgatgat

SEQ ID NO: 657643 - DNA, 20 bp, mouse
gggtgctatagctgccctct

SEQ ID NO: 657644 - DNA, 20 bp, mouse
gggtgccccgactgttgctg

SEQ ID NO: 657645 - DNA, 20 bp, mouse
gcagcacgcagggcgggctc

SEQ ID NO: 657646 - DNA, 20 bp, mouse
gaacctagacgtgggaacaa

SEQ ID NO: 657647 - DNA, 20 bp, mouse
gtctacgtgaacctagacgt

SEQ ID NO: 657648 - DNA, 20 bp, mouse
ggccaacggggctttcgaga

SEQ ID NO: 657649 - DNA, 20 bp, mouse
ggactctgaagtcctgtcat

SEQ ID NO: 657650 - DNA, 20 bp, mouse
gagctgtggaggtccaccca

SEQ ID NO: 657651 - DNA, 20 bp, mouse
gccgaagccttggaaaccat

SEQ ID NO: 657652 - DNA, 20 bp, mouse
gtgtggagtcacgtgagctg

SEQ ID NO: 657653 - DNA, 20 bp, mouse
gtctaggttcacgtagagca

SEQ ID NO: 657654 - DNA, 20 bp, mouse
gggagtcacgtgagctgtgg

SEQ ID NO: 657655 - DNA, 20 bp, mouse
gcaaactcacatcagatgca

SEQ ID NO: 657656 - DNA, 20 bp, mouse
ggtaggctgctgtaggtcac

SEQ ID NO: 657657 - DNA, 20 bp, mouse
gaagtaaggcctcagcatca

SEQ ID NO: 657658 - DNA, 20 bp, mouse
gcaggctgttgctaaggtat

SEQ ID NO: 657659 - DNA, 20 bp, mouse
gttacttctgatggtaacac

SEQ ID NO: 657660 - DNA, 20 bp, mouse
ggatacaataatggcgcaaa

SEQ ID NO: 657661 - DNA, 20 bp, mouse
gcctacagcagcctacaaga

SEQ ID NO: 657662 - DNA, 20 bp, mouse
ggctgaggccttacttctga

SEQ ID NO: 657663 - DNA, 20 bp, mouse
gagatggactgatacaataa

SEQ ID NO: 657664 - DNA, 20 bp, mouse
gttgtatcagtccatcttgt

SEQ ID NO: 657665 - DNA, 20 bp, mouse
gatggaacctcaaacatcac

SEQ ID NO: 657666 - DNA, 20 bp, mouse
ggaagcgtcagaactattta

SEQ ID NO: 657667 - DNA, 20 bp, mouse
gcgtcagaactatttatgga

SEQ ID NO: 657668 - DNA, 20 bp, mouse
gtagttctgacgcttccttg

SEQ ID NO: 657669 - DNA, 20 bp, mouse
gtgtctttagaaacaccaca

SEQ ID NO: 657670 - DNA, 20 bp, mouse
gcctctgactcctgtgttct

SEQ ID NO: 657671 - DNA, 20 bp, mouse
gtgaactccggaccgtccca

SEQ ID NO: 657672 - DNA, 20 bp, mouse
gtagagttgcatcactatgg

SEQ ID NO: 657673 - DNA, 20 bp, mouse
gagaagtgtccagactggcc

SEQ ID NO: 657674 - DNA, 20 bp, mouse
gagttgcatcactatggagg

SEQ ID NO: 657675 - DNA, 20 bp, mouse
ggattagagttgcatcacta

SEQ ID NO: 657676 - DNA, 20 bp, mouse
gggcggttggaaagacgcgg

SEQ ID NO: 657677 - DNA, 20 bp, mouse
ggagacgtagcgggcgcctg

SEQ ID NO: 657678 - DNA, 20 bp, mouse
gcgggacgcgggctccaggt

SEQ ID NO: 657679 - DNA, 20 bp, mouse
gggaggagcgggagctggct

SEQ ID NO: 657680 - DNA, 20 bp, mouse
gtggaaagacgcggaggctc

SEQ ID NO: 657681 - DNA, 20 bp, mouse
gcccgcccgccacaagcacg

SEQ ID NO: 657682 - DNA, 20 bp, mouse
gcaaccgcccgcagactcac

SEQ ID NO: 657683 - DNA, 20 bp, mouse
gacgcacacccgcacctagg

SEQ ID NO: 657684 - DNA, 20 bp, mouse
gggcgcccgctacgtctcag

SEQ ID NO: 657685 - DNA, 20 bp, mouse
ggccacctcgtgcttgtggc

SEQ ID NO: 657686 - DNA, 20 bp, mouse
gtcctttatggatctgaaga

SEQ ID NO: 657687 - DNA, 20 bp, mouse
gcgtgcttttatgtatctga

SEQ ID NO: 657688 - DNA, 20 bp, mouse
gctatgatgataaccaatgt

SEQ ID NO: 657689 - DNA, 20 bp, mouse
ggagatgaaccaattaatat

SEQ ID NO: 657690 - DNA, 20 bp, mouse
ggtttctctccaatattaat

SEQ ID NO: 657691 - DNA, 20 bp, mouse
gtaaagactatttatctcac

SEQ ID NO: 657692 - DNA, 20 bp, mouse
gatgaatgtgttcaatatga

SEQ ID NO: 657693 - DNA, 20 bp, mouse
ggccatcttcagatccataa

SEQ ID NO: 657694 - DNA, 20 bp, mouse
gtccataaaggaacatatac

SEQ ID NO: 657695 - DNA, 20 bp, mouse
gtccagtatatgttccttta

SEQ ID NO: 657696 - DNA, 20 bp, mouse
gcggcctgagcgcgcgtaag

SEQ ID NO: 657697 - DNA, 20 bp, mouse
gtgccgtgacccatgacctc

SEQ ID NO: 657698 - DNA, 20 bp, mouse
gcggggcaccgttaagatcg

SEQ ID NO: 657699 - DNA, 20 bp, mouse
gagtctctggggctggaaac

SEQ ID NO: 657700 - DNA, 20 bp, mouse
ggtcccgccgcgggagtctc

SEQ ID NO: 657701 - DNA, 20 bp, mouse
gggcaccgttaagatcgtgg

SEQ ID NO: 657702 - DNA, 20 bp, mouse
gcacggcagggtgtctcgac

SEQ ID NO: 657703 - DNA, 20 bp, mouse
gagctcttctacccaagcga

SEQ ID NO: 657704 - DNA, 20 bp, mouse
ggtgcaggcctccctcgctt

SEQ ID NO: 657705 - DNA, 20 bp, mouse
gaacggtgccccgagagggg

SEQ ID NO: 657706 - DNA, 20 bp, mouse
ggcgccggatcaggtctcaa

SEQ ID NO: 657707 - DNA, 20 bp, mouse
gcctcgccctgatcactatc

SEQ ID NO: 657708 - DNA, 20 bp, mouse
ggagacctgatccggcgcgg

SEQ ID NO: 657709 - DNA, 20 bp, mouse
gatcagggcgaggccggaga

SEQ ID NO: 657710 - DNA, 20 bp, mouse
gcggatcaggtctcaatgga

SEQ ID NO: 657711 - DNA, 20 bp, mouse
gtcactatctggacgactta

SEQ ID NO: 657712 - DNA, 20 bp, mouse
gagtcgtccagatagtgatc

SEQ ID NO: 657713 - DNA, 20 bp, mouse
gtcgctagctcttccgtctc

SEQ ID NO: 657714 - DNA, 20 bp, mouse
gccctcccggacgatggtcc

SEQ ID NO: 657715 - DNA, 20 bp, mouse
gcctccacctagactatccc

SEQ ID NO: 657716 - DNA, 20 bp, mouse
ggggcgcggggcaaatctcg

SEQ ID NO: 657717 - DNA, 20 bp, mouse
gtagtgccatctggacgtca

SEQ ID NO: 657718 - DNA, 20 bp, mouse
ggaaaagctccttgcgcccc

SEQ ID NO: 657719 - DNA, 20 bp, mouse
gaacagatctggcgaggtcg

SEQ ID NO: 657720 - DNA, 20 bp, mouse
gaaggcgcagtagtgccatc

SEQ ID NO: 657721 - DNA, 20 bp, mouse
ggagtgagccaagtgtaaat

SEQ ID NO: 657722 - DNA, 20 bp, mouse
gccaggttccgaaacagatc

SEQ ID NO: 657723 - DNA, 20 bp, mouse
ggccggaagcaggaagttgt

SEQ ID NO: 657724 - DNA, 20 bp, mouse
gttccgaaacagatctggcg

SEQ ID NO: 657725 - DNA, 20 bp, mouse
gaaccagccaaacaggttta

SEQ ID NO: 657726 - DNA, 20 bp, mouse
gccccggacgctaccatctg

SEQ ID NO: 657727 - DNA, 20 bp, mouse
gcgcaggcgtagagcgctcg

SEQ ID NO: 657728 - DNA, 20 bp, mouse
gggcgggaaaagaagcgtga

SEQ ID NO: 657729 - DNA, 20 bp, mouse
gtcgtcatggagggcgtagg

SEQ ID NO: 657730 - DNA, 20 bp, mouse
ggacctggacagcctgacgg

SEQ ID NO: 657731 - DNA, 20 bp, mouse
gtctacgcctgcgcgcgccc

SEQ ID NO: 657732 - DNA, 20 bp, mouse
gatctgtggcaaaaactgaa

SEQ ID NO: 657733 - DNA, 20 bp, mouse
gaggcgtagagcgctcgggg

SEQ ID NO: 657734 - DNA, 20 bp, mouse
gcagcctgacggagggacag

SEQ ID NO: 657735 - DNA, 20 bp, mouse
gctcggggcggtgccgcgga

SEQ ID NO: 657736 - DNA, 20 bp, mouse
ggggtggggactgaggtcgt

SEQ ID NO: 657737 - DNA, 20 bp, mouse
gcgcacgcgcggccgcactt

SEQ ID NO: 657738 - DNA, 20 bp, mouse
ggaagtcaaggcatgagtta

SEQ ID NO: 657739 - DNA, 20 bp, mouse
gcccgccagcaaccgaagtg

SEQ ID NO: 657740 - DNA, 20 bp, mouse
gctgaggtgactgtgtgcac

SEQ ID NO: 657741 - DNA, 20 bp, mouse
gtcggctgacgtcactgcgg

SEQ ID NO: 657742 - DNA, 20 bp, mouse
gcactgcggagggacggcgg

SEQ ID NO: 657743 - DNA, 20 bp, mouse
ggccgcacttcggttgctgg

SEQ ID NO: 657744 - DNA, 20 bp, mouse
ggcacacagtcacctcagca

SEQ ID NO: 657745 - DNA, 20 bp, mouse
ggaaaatgatgtggttcaac

SEQ ID NO: 657746 - DNA, 20 bp, mouse
gcaagcatgccgggagtcgg

SEQ ID NO: 657747 - DNA, 20 bp, mouse
gggtgagcatggttactcga

SEQ ID NO: 657748 - DNA, 20 bp, mouse
gactcgatgggcgtggtcga

SEQ ID NO: 657749 - DNA, 20 bp, mouse
gcccggtaccgccctctagt

SEQ ID NO: 657750 - DNA, 20 bp, mouse
gtctgcgcgccggaagagag

SEQ ID NO: 657751 - DNA, 20 bp, mouse
ggggagtggccgtgctgctg

SEQ ID NO: 657752 - DNA, 20 bp, mouse
ggggcacgggagtcggtgat

SEQ ID NO: 657753 - DNA, 20 bp, mouse
gacggcaggtgagtttctga

SEQ ID NO: 657754 - DNA, 20 bp, mouse
gtggcctggcaaggcggagg

SEQ ID NO: 657755 - DNA, 20 bp, mouse
ggtagggccccgcctcagca

SEQ ID NO: 657756 - DNA, 20 bp, mouse
gaaggcacgcgcaaggggca

SEQ ID NO: 657757 - DNA, 20 bp, mouse
gccaaccccgcccccggctt

SEQ ID NO: 657758 - DNA, 20 bp, mouse
gggccctggtggttggacag

SEQ ID NO: 657759 - DNA, 20 bp, mouse
gctcgcgcaaggcgcacaga

SEQ ID NO: 657760 - DNA, 20 bp, mouse
gcgcgagcacggttgatctc

SEQ ID NO: 657761 - DNA, 20 bp, mouse
gccgcgggcacggaaggcgt

SEQ ID NO: 657762 - DNA, 20 bp, mouse
ggcgcggcgcagtgtgggga

SEQ ID NO: 657763 - DNA, 20 bp, mouse
gtgggagggacgcgaggccc

SEQ ID NO: 657764 - DNA, 20 bp, mouse
gccagggtccccgcgtggga

SEQ ID NO: 657765 - DNA, 20 bp, mouse
gggagcgcgcggcgcagtgt

SEQ ID NO: 657766 - DNA, 20 bp, mouse
gtaacaacatggaccatgat

SEQ ID NO: 657767 - DNA, 20 bp, mouse
gagattttatatgtcatcaa

SEQ ID NO: 657768 - DNA, 20 bp, mouse
ggtactcttgatgttgtggg

SEQ ID NO: 657769 - DNA, 20 bp, mouse
ggaaaggcattttccaatca

SEQ ID NO: 657770 - DNA, 20 bp, mouse
gataagatataagggtagtg

SEQ ID NO: 657771 - DNA, 20 bp, mouse
gtattgataataagatataa

SEQ ID NO: 657772 - DNA, 20 bp, mouse
gtcaatgtctactgaggtag

SEQ ID NO: 657773 - DNA, 20 bp, mouse
gaatataaaaattgaacatc

SEQ ID NO: 657774 - DNA, 20 bp, mouse
gaaagagagatatgagaaat

SEQ ID NO: 657775 - DNA, 20 bp, mouse
gtaagatgttgttaacaaca

SEQ ID NO: 657776 - DNA, 20 bp, mouse
ggggagggcaaagctagctc

SEQ ID NO: 657777 - DNA, 20 bp, mouse
ggtaggcggcgggatctaga

SEQ ID NO: 657778 - DNA, 20 bp, mouse
gcgcaggcgcagggggggga

SEQ ID NO: 657779 - DNA, 20 bp, mouse
gggcaaagctagctccggat

SEQ ID NO: 657780 - DNA, 20 bp, mouse
gtggacgacccagccttcct

SEQ ID NO: 657781 - DNA, 20 bp, mouse
gaaggctgggtcgtccaatc

SEQ ID NO: 657782 - DNA, 20 bp, mouse
gtacatctcgcgagaagcca

SEQ ID NO: 657783 - DNA, 20 bp, mouse
gtaggcgcaggcgcaggggg

SEQ ID NO: 657784 - DNA, 20 bp, mouse
gtctcgcgagatgtaggcgg

SEQ ID NO: 657785 - DNA, 20 bp, mouse
gggatctagaaggcgtgcac

SEQ ID NO: 657786 - DNA, 20 bp, mouse
gtctacctgccgcgcctggt

SEQ ID NO: 657787 - DNA, 20 bp, mouse
ggcgccagataggcctgcgg

SEQ ID NO: 657788 - DNA, 20 bp, mouse
gggagtgcttccactctctc

SEQ ID NO: 657789 - DNA, 20 bp, mouse
gagtggaagcactccggctt

SEQ ID NO: 657790 - DNA, 20 bp, mouse
gccagataggcctgcggtgg

SEQ ID NO: 657791 - DNA, 20 bp, mouse
gacctcgggcggcgccagat

SEQ ID NO: 657792 - DNA, 20 bp, mouse
ggcggcgccagataggcctg

SEQ ID NO: 657793 - DNA, 20 bp, mouse
gactgtggcaaggaagggat

SEQ ID NO: 657794 - DNA, 20 bp, mouse
gaggcgcggcaggtagacct

SEQ ID NO: 657795 - DNA, 20 bp, mouse
ggcagaccgcagaagctcac

SEQ ID NO: 657796 - DNA, 20 bp, mouse
gtggaccctaggagcaatat

SEQ ID NO: 657797 - DNA, 20 bp, mouse
gccttcctggggcacacccc

SEQ ID NO: 657798 - DNA, 20 bp, mouse
ggattggagttcagagtcaa

SEQ ID NO: 657799 - DNA, 20 bp, mouse
gggtccaaagaacgataggt

SEQ ID NO: 657800 - DNA, 20 bp, mouse
gggtaggtcaggtgcagtcc

SEQ ID NO: 657801 - DNA, 20 bp, mouse
gggcccctatattgctccta

SEQ ID NO: 657802 - DNA, 20 bp, mouse
gctgaactccaatcggaaga

SEQ ID NO: 657803 - DNA, 20 bp, mouse
gcctggggaaatagttgtgg

SEQ ID NO: 657804 - DNA, 20 bp, mouse
gaaaagcactgcgacggaga

SEQ ID NO: 657805 - DNA, 20 bp, mouse
gacaaaaaaaagcactgcga

SEQ ID NO: 657806 - DNA, 20 bp, mouse
gagctgggtgggaacctccc

SEQ ID NO: 657807 - DNA, 20 bp, mouse
gtggccaaggggctaaattc

SEQ ID NO: 657808 - DNA, 20 bp, mouse
gtgagtgattacgcagtcgg

SEQ ID NO: 657809 - DNA, 20 bp, mouse
gtccgggataagagctgggt

SEQ ID NO: 657810 - DNA, 20 bp, mouse
gcctggggagtgagtggatc

SEQ ID NO: 657811 - DNA, 20 bp, mouse
gggcgtggtttagaagcctg

SEQ ID NO: 657812 - DNA, 20 bp, mouse
gctcttatcccggaagtctg

SEQ ID NO: 657813 - DNA, 20 bp, mouse
gcagaagtccggaagttcga

SEQ ID NO: 657814 - DNA, 20 bp, mouse
gagtctgcggaacagaagtc

SEQ ID NO: 657815 - DNA, 20 bp, mouse
gtttgtgcttcacactcctg

SEQ ID NO: 657816 - DNA, 20 bp, mouse
gcgcctgcctggctaacaag

SEQ ID NO: 657817 - DNA, 20 bp, mouse
gcctggctaacaagaggctt

SEQ ID NO: 657818 - DNA, 20 bp, mouse
gcggggagttgtgatcatgt

SEQ ID NO: 657819 - DNA, 20 bp, mouse
gcagactccgtgatcgaggt

SEQ ID NO: 657820 - DNA, 20 bp, mouse
gcccaatggccccgcctgcc

SEQ ID NO: 657821 - DNA, 20 bp, mouse
gacgtgaagcagagattaga

SEQ ID NO: 657822 - DNA, 20 bp, mouse
gcggacaccgagatgaagtc

SEQ ID NO: 657823 - DNA, 20 bp, mouse
ggcttgggcccactccacac

SEQ ID NO: 657824 - DNA, 20 bp, mouse
gagttgtgatcatgtcgggg

SEQ ID NO: 657825 - DNA, 20 bp, mouse
gccactgggttatgcaaata

SEQ ID NO: 657826 - DNA, 20 bp, mouse
gtccccgtggagccggccta

SEQ ID NO: 657827 - DNA, 20 bp, mouse
gtcttccaagatgtgtccta

SEQ ID NO: 657828 - DNA, 20 bp, mouse
ggatctgcgggcagccccga

SEQ ID NO: 657829 - DNA, 20 bp, mouse
ggagagcggcgcagccccga

SEQ ID NO: 657830 - DNA, 20 bp, mouse
gaaagccttaggacacatct

SEQ ID NO: 657831 - DNA, 20 bp, mouse
gccagccccgccccccgtcg

SEQ ID NO: 657832 - DNA, 20 bp, mouse
gctacacagggcctgtaatg

SEQ ID NO: 657833 - DNA, 20 bp, mouse
gagcccagggcacttgagag

SEQ ID NO: 657834 - DNA, 20 bp, mouse
ggcatgccgaccaccgaagg

SEQ ID NO: 657835 - DNA, 20 bp, mouse
gtgcgggcagccccgacggg

SEQ ID NO: 657836 - DNA, 20 bp, mouse
ggggcagtgtgggatgtctg

SEQ ID NO: 657837 - DNA, 20 bp, mouse
gttaacacgcccaaaccact

SEQ ID NO: 657838 - DNA, 20 bp, mouse
gaggacttggtctgtttctg

SEQ ID NO: 657839 - DNA, 20 bp, mouse
gtggtttgggcgtgttaagt

SEQ ID NO: 657840 - DNA, 20 bp, mouse
gcggtttcttgtgtgctcag

SEQ ID NO: 657841 - DNA, 20 bp, mouse
ggctactggagttttgcaag

SEQ ID NO: 657842 - DNA, 20 bp, mouse
ggcagtgtcacctggagtga

SEQ ID NO: 657843 - DNA, 20 bp, mouse
gcagtgtgggatgtctgagg

SEQ ID NO: 657844 - DNA, 20 bp, mouse
ggagcacacaagaaaccgag

SEQ ID NO: 657845 - DNA, 20 bp, mouse
gtttgggcgtgttaagtggg

SEQ ID NO: 657846 - DNA, 20 bp, mouse
ggggctgtgcaagatgggtg

SEQ ID NO: 657847 - DNA, 20 bp, mouse
gatcagggacccagcttctt

SEQ ID NO: 657848 - DNA, 20 bp, mouse
gtctgccaaacggtcttctt

SEQ ID NO: 657849 - DNA, 20 bp, mouse
gtcttggctgggttgttctg

SEQ ID NO: 657850 - DNA, 20 bp, mouse
gcatctgtgtgcgcttacgt

SEQ ID NO: 657851 - DNA, 20 bp, mouse
gggacgcactggtaccctga

SEQ ID NO: 657852 - DNA, 20 bp, mouse
gaccttgggaagttacactt

SEQ ID NO: 657853 - DNA, 20 bp, mouse
gggaagggaatgtggttgcc

SEQ ID NO: 657854 - DNA, 20 bp, mouse
gcaacccagccaagaggctc

SEQ ID NO: 657855 - DNA, 20 bp, mouse
gcgcacacagatggacgcac

SEQ ID NO: 657856 - DNA, 20 bp, mouse
ggggccagagctagtgccaa

SEQ ID NO: 657857 - DNA, 20 bp, mouse
gctagggagggactaatgga

SEQ ID NO: 657858 - DNA, 20 bp, mouse
gaacccaggggtaacgaacc

SEQ ID NO: 657859 - DNA, 20 bp, mouse
ggcgggactggcactaggga

SEQ ID NO: 657860 - DNA, 20 bp, mouse
gaacgccaacctggcggaat

SEQ ID NO: 657861 - DNA, 20 bp, mouse
ggagggcgggactggcacta

SEQ ID NO: 657862 - DNA, 20 bp, mouse
gccgccgggttcgttacccc

SEQ ID NO: 657863 - DNA, 20 bp, mouse
gtggcggaatgggtttgctg

SEQ ID NO: 657864 - DNA, 20 bp, mouse
ggggcaccaggggtggaacc

SEQ ID NO: 657865 - DNA, 20 bp, mouse
ggtccccgaagggcggtcga

SEQ ID NO: 657866 - DNA, 20 bp, mouse
gcagtccgcagcaacataag

SEQ ID NO: 657867 - DNA, 20 bp, mouse
gcagcaacataagtggtagt

SEQ ID NO: 657868 - DNA, 20 bp, mouse
gccgccctacaaatatcggt

SEQ ID NO: 657869 - DNA, 20 bp, mouse
gtcccccgccctacaaatat

SEQ ID NO: 657870 - DNA, 20 bp, mouse
ggtcgggagaggatgggcat

SEQ ID NO: 657871 - DNA, 20 bp, mouse
gaacgcgcggcgctggttgc

SEQ ID NO: 657872 - DNA, 20 bp, mouse
gtggcagtggccttactcca

SEQ ID NO: 657873 - DNA, 20 bp, mouse
ggagaggatgggcatgggcg

SEQ ID NO: 657874 - DNA, 20 bp, mouse
gtgttggccacgccacacgg

SEQ ID NO: 657875 - DNA, 20 bp, mouse
ggctcccaccgatatttgta

SEQ ID NO: 657876 - DNA, 20 bp, mouse
ggaggggaacactgactggg

SEQ ID NO: 657877 - DNA, 20 bp, mouse
gaagaagaggggaacgtccg

SEQ ID NO: 657878 - DNA, 20 bp, mouse
gtgggtggatgtcataagga

SEQ ID NO: 657879 - DNA, 20 bp, mouse
gaagaggggaacgtccgggg

SEQ ID NO: 657880 - DNA, 20 bp, mouse
gggggaggggaacactgact

SEQ ID NO: 657881 - DNA, 20 bp, mouse
gtgactgggtggatgtcata

SEQ ID NO: 657882 - DNA, 20 bp, mouse
gctgacgagctggggcggag

SEQ ID NO: 657883 - DNA, 20 bp, mouse
gcaggaggttacattgatag

SEQ ID NO: 657884 - DNA, 20 bp, mouse
ggacaggtggccaaggtgac

SEQ ID NO: 657885 - DNA, 20 bp, mouse
gcgcatgcgcatcctagcta

SEQ ID NO: 657886 - DNA, 20 bp, mouse
gcatgtgagtggcctgtttg

SEQ ID NO: 657887 - DNA, 20 bp, mouse
gagccctacggccatgtgag

SEQ ID NO: 657888 - DNA, 20 bp, mouse
gtacccatcctcagacatgt

SEQ ID NO: 657889 - DNA, 20 bp, mouse
gggactgtgtggcaagtaag

SEQ ID NO: 657890 - DNA, 20 bp, mouse
gacacgtacaggaactgtgt

SEQ ID NO: 657891 - DNA, 20 bp, mouse
ggaaagggagctgctatcat

SEQ ID NO: 657892 - DNA, 20 bp, mouse
gtcccacccaagccccaaac

SEQ ID NO: 657893 - DNA, 20 bp, mouse
ggatagcagctccctttctt

SEQ ID NO: 657894 - DNA, 20 bp, mouse
gatgtctgaggatgggtaca

SEQ ID NO: 657895 - DNA, 20 bp, mouse
ggccaggaagtcttgggtaa

SEQ ID NO: 657896 - DNA, 20 bp, mouse
ggggactcgtagagcattct

SEQ ID NO: 657897 - DNA, 20 bp, mouse
gtgctaagggagagctagag

SEQ ID NO: 657898 - DNA, 20 bp, mouse
gctagctctcccttagcacg

SEQ ID NO: 657899 - DNA, 20 bp, mouse
gacgcgggttggagaagcgg

SEQ ID NO: 657900 - DNA, 20 bp, mouse
gcgtgcgcgaaaggcgtccc

SEQ ID NO: 657901 - DNA, 20 bp, mouse
gttcgcgcacgtggactaat

SEQ ID NO: 657902 - DNA, 20 bp, mouse
ggtaagaccggaattggaag

SEQ ID NO: 657903 - DNA, 20 bp, mouse
ggagaagcgggggcctgtgc

SEQ ID NO: 657904 - DNA, 20 bp, mouse
gtcggtgtgctccgcctgcc

SEQ ID NO: 657905 - DNA, 20 bp, mouse
gctctacgagtcccggcagg

SEQ ID NO: 657906 - DNA, 20 bp, mouse
gccccacacagctttcacca

SEQ ID NO: 657907 - DNA, 20 bp, mouse
gtggaaaggtcaatcagatg

SEQ ID NO: 657908 - DNA, 20 bp, mouse
gcctggtccgggaggaagta

SEQ ID NO: 657909 - DNA, 20 bp, mouse
gtgtgcctgcaacctggtcc

SEQ ID NO: 657910 - DNA, 20 bp, mouse
gtggggcgggaccattattc

SEQ ID NO: 657911 - DNA, 20 bp, mouse
gggattatgaaggaaacgct

SEQ ID NO: 657912 - DNA, 20 bp, mouse
gtaggatgtcagaagagcag

SEQ ID NO: 657913 - DNA, 20 bp, mouse
gttatgaaggaaacgctggg

SEQ ID NO: 657914 - DNA, 20 bp, mouse
ggcctgcaacctggtccggg

SEQ ID NO: 657915 - DNA, 20 bp, mouse
gccagctggattcctgaaaa

SEQ ID NO: 657916 - DNA, 20 bp, mouse
gtggtgggcggggttgggac

SEQ ID NO: 657917 - DNA, 20 bp, mouse
gagagccgcagggaatatga

SEQ ID NO: 657918 - DNA, 20 bp, mouse
gtgaggaaaactggcttggt

SEQ ID NO: 657919 - DNA, 20 bp, mouse
gaccggggctgtcaaaggag

SEQ ID NO: 657920 - DNA, 20 bp, mouse
gcagccccggtgaggaaaac

SEQ ID NO: 657921 - DNA, 20 bp, mouse
gcgattctgaagtccgctag

SEQ ID NO: 657922 - DNA, 20 bp, mouse
gaatcacattcgagcaaagg

SEQ ID NO: 657923 - DNA, 20 bp, mouse
gcccaatcacattcgagcaa

SEQ ID NO: 657924 - DNA, 20 bp, mouse
gttagtgtggaccaagtgat

SEQ ID NO: 657925 - DNA, 20 bp, mouse
gctcgaatgtgattgggtag

SEQ ID NO: 657926 - DNA, 20 bp, mouse
gcagccccacaccacttcta

SEQ ID NO: 657927 - DNA, 20 bp, mouse
gcaacccttgatctcttcgc

SEQ ID NO: 657928 - DNA, 20 bp, mouse
gagaaccagcgaagagatca

SEQ ID NO: 657929 - DNA, 20 bp, mouse
gaagggttgcacacactgtt

SEQ ID NO: 657930 - DNA, 20 bp, mouse
gtcccaggacgtgcctgctc

SEQ ID NO: 657931 - DNA, 20 bp, mouse
gtctaaccctagaagtggtg

SEQ ID NO: 657932 - DNA, 20 bp, mouse
gtctcaaagactcttaatct

SEQ ID NO: 657933 - DNA, 20 bp, mouse
ggagagcggaaaggcgtccc

SEQ ID NO: 657934 - DNA, 20 bp, mouse
gagctcttgtctgtctgtgc

SEQ ID NO: 657935 - DNA, 20 bp, mouse
gagctctggggagagcggaa

SEQ ID NO: 657936 - DNA, 20 bp, mouse
ggccgcctcgagggcgtcgt

SEQ ID NO: 657937 - DNA, 20 bp, mouse
gcaaacccagtgcgccgtga

SEQ ID NO: 657938 - DNA, 20 bp, mouse
gaggcggctccgagccctca

SEQ ID NO: 657939 - DNA, 20 bp, mouse
ggcgcgctgagtgacgtcac

SEQ ID NO: 657940 - DNA, 20 bp, mouse
ggggctcggagccgcctcga

SEQ ID NO: 657941 - DNA, 20 bp, mouse
gcgcctcctcaggagctcga

SEQ ID NO: 657942 - DNA, 20 bp, mouse
gggatcggggagccctcacc

SEQ ID NO: 657943 - DNA, 20 bp, mouse
gacagcggctcggactggga

SEQ ID NO: 657944 - DNA, 20 bp, mouse
gcgagccctcacggcgcact

SEQ ID NO: 657945 - DNA, 20 bp, mouse
gacctacgacgccctcgagg

SEQ ID NO: 657946 - DNA, 20 bp, mouse
gtcgggaagacgttgtggga

SEQ ID NO: 657947 - DNA, 20 bp, mouse
gcgttgtgggagggaaacga

SEQ ID NO: 657948 - DNA, 20 bp, mouse
gaagcacatgccagaataat

SEQ ID NO: 657949 - DNA, 20 bp, mouse
ggggcccagtctcagggatt

SEQ ID NO: 657950 - DNA, 20 bp, mouse
gggaaacgagggcttgctga

SEQ ID NO: 657951 - DNA, 20 bp, mouse
gaggctcgggaagacgttgt

SEQ ID NO: 657952 - DNA, 20 bp, mouse
gtctcagcatttactatctt

SEQ ID NO: 657953 - DNA, 20 bp, mouse
ggaacacgccgagtactgac

SEQ ID NO: 657954 - DNA, 20 bp, mouse
gcaaaccagctaaggggctc

SEQ ID NO: 657955 - DNA, 20 bp, mouse
gttccgaggggcccagtctc

SEQ ID NO: 657956 - DNA, 20 bp, mouse
gaacgtgttagagtattctg

SEQ ID NO: 657957 - DNA, 20 bp, mouse
gaggtgtggggcccgccccg

SEQ ID NO: 657958 - DNA, 20 bp, mouse
gcggggcgggccggaggtgt

SEQ ID NO: 657959 - DNA, 20 bp, mouse
gacggcccgttagacccgct

SEQ ID NO: 657960 - DNA, 20 bp, mouse
gccgttagacccgctgggaa

SEQ ID NO: 657961 - DNA, 20 bp, mouse
gagaaaatgacggtgataat

SEQ ID NO: 657962 - DNA, 20 bp, mouse
gtaaaaggctgggcctcact

SEQ ID NO: 657963 - DNA, 20 bp, mouse
gcgagtaagagttaaaaggc

SEQ ID NO: 657964 - DNA, 20 bp, mouse
gttactgatggatccgagtg

SEQ ID NO: 657965 - DNA, 20 bp, mouse
gggtggtcaagacaacctct

SEQ ID NO: 657966 - DNA, 20 bp, mouse
gaaggggcctggaaaatctg

SEQ ID NO: 657967 - DNA, 20 bp, mouse
ggtgtacagaagctgtcctg

SEQ ID NO: 657968 - DNA, 20 bp, mouse
ggtacacggccaggaagaaa

SEQ ID NO: 657969 - DNA, 20 bp, mouse
gtagctcaggtgtatcacag

SEQ ID NO: 657970 - DNA, 20 bp, mouse
gctggaaaatctgaggctga

SEQ ID NO: 657971 - DNA, 20 bp, mouse
gggcctggagtggggtgaga

SEQ ID NO: 657972 - DNA, 20 bp, mouse
ggaagctgtcctgaggctcc

SEQ ID NO: 657973 - DNA, 20 bp, mouse
ggaggctgaaggaggaagcc

SEQ ID NO: 657974 - DNA, 20 bp, mouse
gacaagcacttcattttccc

SEQ ID NO: 657975 - DNA, 20 bp, mouse
gtcatgggcctccaattaag

SEQ ID NO: 657976 - DNA, 20 bp, mouse
gcctgagcggacctaatcca

SEQ ID NO: 657977 - DNA, 20 bp, mouse
gtccaacaagggggttaagg

SEQ ID NO: 657978 - DNA, 20 bp, mouse
gcggacctaatccagggcta

SEQ ID NO: 657979 - DNA, 20 bp, mouse
gttaaggcctgcaagaagga

SEQ ID NO: 657980 - DNA, 20 bp, mouse
ggagaggagagggtgaactt

SEQ ID NO: 657981 - DNA, 20 bp, mouse
gaggggaggcggggtaagtg

SEQ ID NO: 657982 - DNA, 20 bp, mouse
gagggctacctgtgagggag

SEQ ID NO: 657983 - DNA, 20 bp, mouse
gtggagtgattcttctccca

SEQ ID NO: 657984 - DNA, 20 bp, mouse
ggcggagagttctgtcccct

SEQ ID NO: 657985 - DNA, 20 bp, mouse
gaaagatctacggagcgagt

SEQ ID NO: 657986 - DNA, 20 bp, mouse
gggggcgggaagcactcgga

SEQ ID NO: 657987 - DNA, 20 bp, mouse
gaggcgatgggcggtactca

SEQ ID NO: 657988 - DNA, 20 bp, mouse
ggtaccaggcattaagtaag

SEQ ID NO: 657989 - DNA, 20 bp, mouse
gggaacttctggtttctgga

SEQ ID NO: 657990 - DNA, 20 bp, mouse
ggggaagcactcggagggcg

SEQ ID NO: 657991 - DNA, 20 bp, mouse
gtcaaggttgacattgtttc

SEQ ID NO: 657992 - DNA, 20 bp, mouse
ggggcggggcgggaagcact

SEQ ID NO: 657993 - DNA, 20 bp, mouse
gtaagtaagaggctgactaa

SEQ ID NO: 657994 - DNA, 20 bp, mouse
ggacggaaggacgaggcgat

SEQ ID NO: 657995 - DNA, 20 bp, mouse
gtaagaggctgactaaaggg

SEQ ID NO: 657996 - DNA, 20 bp, mouse
gccgccaatcggaactgtcc

SEQ ID NO: 657997 - DNA, 20 bp, mouse
ggtgcccgatgcccgaagcg

SEQ ID NO: 657998 - DNA, 20 bp, mouse
gagcgtggctccttgcgatt

SEQ ID NO: 657999 - DNA, 20 bp, mouse
gaatcggaactgtccaggtg

SEQ ID NO: 658000 - DNA, 20 bp, mouse
gggtcccggggaaccacttc

SEQ ID NO: 658001 - DNA, 20 bp, mouse
ggcacccaatggagacgcat

SEQ ID NO: 658002 - DNA, 20 bp, mouse
ggggaccgcagcccgccaat

SEQ ID NO: 658003 - DNA, 20 bp, mouse
gccgcccggtcactcaccga

SEQ ID NO: 658004 - DNA, 20 bp, mouse
gaaaaccgtccaatgaacgt

SEQ ID NO: 658005 - DNA, 20 bp, mouse
gcccaatggagacgcatggg

SEQ ID NO: 658006 - DNA, 20 bp, mouse
gccggcgctcggggctgcta

SEQ ID NO: 658007 - DNA, 20 bp, mouse
gcggggctgctacggtggtt

SEQ ID NO: 658008 - DNA, 20 bp, mouse
gctgctacggtggttcgggt

SEQ ID NO: 658009 - DNA, 20 bp, mouse
gccctgcagagccttcccga

SEQ ID NO: 658010 - DNA, 20 bp, mouse
ggagagagaaagtggatgtc

SEQ ID NO: 658011 - DNA, 20 bp, mouse
gagccgacgccccctcggga

SEQ ID NO: 658012 - DNA, 20 bp, mouse
gaggccagaggtggcattcg

SEQ ID NO: 658013 - DNA, 20 bp, mouse
gcgtgtgactagagagtgag

SEQ ID NO: 658014 - DNA, 20 bp, mouse
gaaagtggatgtcaggttca

SEQ ID NO: 658015 - DNA, 20 bp, mouse
gcccgagagctgggattcgt

SEQ ID NO: 658016 - DNA, 20 bp, mouse
ggcagccagaggcaattgat

SEQ ID NO: 658017 - DNA, 20 bp, mouse
gagagctacacctgtctctc

SEQ ID NO: 658018 - DNA, 20 bp, mouse
ggagggcaggtctagcagtt

SEQ ID NO: 658019 - DNA, 20 bp, mouse
gtcctccccccagctattta

SEQ ID NO: 658020 - DNA, 20 bp, mouse
gtcgttgttgaacttcctta

SEQ ID NO: 658021 - DNA, 20 bp, mouse
gccaggactaggactatgta

SEQ ID NO: 658022 - DNA, 20 bp, mouse
gaaagacaaagcatgattag

SEQ ID NO: 658023 - DNA, 20 bp, mouse
gcctgggaggcaatgcaggc

SEQ ID NO: 658024 - DNA, 20 bp, mouse
gaatcgtccctaaatagctg

SEQ ID NO: 658025 - DNA, 20 bp, mouse
gctcgaacacagttaccata

SEQ ID NO: 658026 - DNA, 20 bp, mouse
gacaagaccagtcattactg

SEQ ID NO: 658027 - DNA, 20 bp, mouse
gtgattgtggtaagacttca

SEQ ID NO: 658028 - DNA, 20 bp, mouse
gtggtaagacttcaaggcag

SEQ ID NO: 658029 - DNA, 20 bp, mouse
ggggcagttaaaaaatgtgt

SEQ ID NO: 658030 - DNA, 20 bp, mouse
ggtaatgcagcatcagaggg

SEQ ID NO: 658031 - DNA, 20 bp, mouse
gctgatgggtctgtgtacac

SEQ ID NO: 658032 - DNA, 20 bp, mouse
gaaaatgtgttgggttagtg

SEQ ID NO: 658033 - DNA, 20 bp, mouse
gatgggtaatgcagcatcag

SEQ ID NO: 658034 - DNA, 20 bp, mouse
gaggaattgcttatgtaact

SEQ ID NO: 658035 - DNA, 20 bp, mouse
gatgctgacctaaagctgat

SEQ ID NO: 658036 - DNA, 20 bp, mouse
gcagaactatgtttggatag

SEQ ID NO: 658037 - DNA, 20 bp, mouse
gaccaggtcagaactatgtt

SEQ ID NO: 658038 - DNA, 20 bp, mouse
gaggaggctacagatgtcag

SEQ ID NO: 658039 - DNA, 20 bp, mouse
gctgcagaggagtgttctga

SEQ ID NO: 658040 - DNA, 20 bp, mouse
ggggagttgaacttgagttc

SEQ ID NO: 658041 - DNA, 20 bp, mouse
gtctaggcgacctgggaacc

SEQ ID NO: 658042 - DNA, 20 bp, mouse
ggacctggttatggtgtccc

SEQ ID NO: 658043 - DNA, 20 bp, mouse
gccttggaagccagcttgtc

SEQ ID NO: 658044 - DNA, 20 bp, mouse
gaagctgttcggggaagata

SEQ ID NO: 658045 - DNA, 20 bp, mouse
gtcctctgcaggcagcatct

SEQ ID NO: 658046 - DNA, 20 bp, mouse
gtggactagagggaccgctt

SEQ ID NO: 658047 - DNA, 20 bp, mouse
gccagccggctgccacgttc

SEQ ID NO: 658048 - DNA, 20 bp, mouse
gtggcagccggctggactag

SEQ ID NO: 658049 - DNA, 20 bp, mouse
ggcagcctgggctacacgat

SEQ ID NO: 658050 - DNA, 20 bp, mouse
gtcaaccagaacgtggcagc

SEQ ID NO: 658051 - DNA, 20 bp, mouse
ggatcggctgcgttctggtg

SEQ ID NO: 658052 - DNA, 20 bp, mouse
gtgccacgttctggttgaaa

SEQ ID NO: 658053 - DNA, 20 bp, mouse
ggccttaaagggaaaatcaa

SEQ ID NO: 658054 - DNA, 20 bp, mouse
gcttccgccgcagccttaaa

SEQ ID NO: 658055 - DNA, 20 bp, mouse
ggcggtccctctagtccagc

SEQ ID NO: 658056 - DNA, 20 bp, mouse
gaggaacgcaagcaacttag

SEQ ID NO: 658057 - DNA, 20 bp, mouse
gtgcttgcgttcctgctcat

SEQ ID NO: 658058 - DNA, 20 bp, mouse
gaagttaatgaattgaccac

SEQ ID NO: 658059 - DNA, 20 bp, mouse
ggctgggatgattagaattt

SEQ ID NO: 658060 - DNA, 20 bp, mouse
ggaaaacactgagaatatcc

SEQ ID NO: 658061 - DNA, 20 bp, mouse
ggggtagtgtttgctcgctc

SEQ ID NO: 658062 - DNA, 20 bp, mouse
gtccttgtgaaggatcgaca

SEQ ID NO: 658063 - DNA, 20 bp, mouse
ggcaaacactacccatgagc

SEQ ID NO: 658064 - DNA, 20 bp, mouse
ggcaggctatgaaaagtatt

SEQ ID NO: 658065 - DNA, 20 bp, mouse
gtcgacaaggaaccaggaag

SEQ ID NO: 658066 - DNA, 20 bp, mouse
gtgccagcggagctgttcgg

SEQ ID NO: 658067 - DNA, 20 bp, mouse
gagccaggaagggccggccc

SEQ ID NO: 658068 - DNA, 20 bp, mouse
gcgcccgggccggcccttcc

SEQ ID NO: 658069 - DNA, 20 bp, mouse
gctacgttctgcgcatccct

SEQ ID NO: 658070 - DNA, 20 bp, mouse
ggcccagggcgtcttggtgg

SEQ ID NO: 658071 - DNA, 20 bp, mouse
gcagcgcagctccggaagtg

SEQ ID NO: 658072 - DNA, 20 bp, mouse
gtccgcacttccgggaggcc

SEQ ID NO: 658073 - DNA, 20 bp, mouse
gatcccttggctgacgtata

SEQ ID NO: 658074 - DNA, 20 bp, mouse
gggagctggggctcgcgcag

SEQ ID NO: 658075 - DNA, 20 bp, mouse
gcggctcaacgcacagcgtc

SEQ ID NO: 658076 - DNA, 20 bp, mouse
gtaaccttggacatctgcta

SEQ ID NO: 658077 - DNA, 20 bp, mouse
gagtcagggaggccatgcgt

SEQ ID NO: 658078 - DNA, 20 bp, mouse
gcccccctagcagatgtcca

SEQ ID NO: 658079 - DNA, 20 bp, mouse
gggcccagatgcatcacctc

SEQ ID NO: 658080 - DNA, 20 bp, mouse
gcgtgggaagaccatctgtc

SEQ ID NO: 658081 - DNA, 20 bp, mouse
ggggcctgtgcccagacaga

SEQ ID NO: 658082 - DNA, 20 bp, mouse
ggcacccactagagccctca

SEQ ID NO: 658083 - DNA, 20 bp, mouse
gcatctgctaggggggggga

SEQ ID NO: 658084 - DNA, 20 bp, mouse
ggcaccgtgagggctctagt

SEQ ID NO: 658085 - DNA, 20 bp, mouse
ggtcctgaggtgatgcatct

SEQ ID NO: 658086 - DNA, 20 bp, mouse
gagtggctaaaagtcaagtc

SEQ ID NO: 658087 - DNA, 20 bp, mouse
gcagtgatgaagcaatggtc

SEQ ID NO: 658088 - DNA, 20 bp, mouse
gaagatcagtgatgaagcaa

SEQ ID NO: 658089 - DNA, 20 bp, mouse
gccactattttgtactagtt

SEQ ID NO: 658090 - DNA, 20 bp, mouse
gtcatcactgatcttataat

SEQ ID NO: 658091 - DNA, 20 bp, mouse
gttataatggggagaaacac

SEQ ID NO: 658092 - DNA, 20 bp, mouse
gctatgatcctagtgaatca

SEQ ID NO: 658093 - DNA, 20 bp, mouse
gaattgcctagtgagtgctt

SEQ ID NO: 658094 - DNA, 20 bp, mouse
gaagtcccaaagcactcact

SEQ ID NO: 658095 - DNA, 20 bp, mouse
gtcttattccctgattcact

SEQ ID NO: 658096 - DNA, 20 bp, mouse
gtaacaggccaaatgtccca

SEQ ID NO: 658097 - DNA, 20 bp, mouse
gaagaagcccttgggacatt

SEQ ID NO: 658098 - DNA, 20 bp, mouse
gcgaaagtaagctcatgcaa

SEQ ID NO: 658099 - DNA, 20 bp, mouse
ggcaaaggtcagagagctac

SEQ ID NO: 658100 - DNA, 20 bp, mouse
gcttactttcgggttagttt

SEQ ID NO: 658101 - DNA, 20 bp, mouse
gactttggggaagaagccct

SEQ ID NO: 658102 - DNA, 20 bp, mouse
gaagtgaatagtggcagttg

SEQ ID NO: 658103 - DNA, 20 bp, mouse
ggatgtggatgtccatgttg

SEQ ID NO: 658104 - DNA, 20 bp, mouse
ggttgggggtctcttcacaa

SEQ ID NO: 658105 - DNA, 20 bp, mouse
ggtctcttcacaaaggaaac

SEQ ID NO: 658106 - DNA, 20 bp, mouse
gagggagaggaatccaaagc

SEQ ID NO: 658107 - DNA, 20 bp, mouse
gcctttgcaaggcaagtgtt

SEQ ID NO: 658108 - DNA, 20 bp, mouse
gtctacagagcaagttcttc

SEQ ID NO: 658109 - DNA, 20 bp, mouse
gtctgtagaactctttatgc

SEQ ID NO: 658110 - DNA, 20 bp, mouse
gagacatgtgcaactatgac

SEQ ID NO: 658111 - DNA, 20 bp, mouse
gctttagaaacaaaatagta

SEQ ID NO: 658112 - DNA, 20 bp, mouse
gctattttgtttctaaagcg

SEQ ID NO: 658113 - DNA, 20 bp, mouse
gagaggaaatatgagagaga

SEQ ID NO: 658114 - DNA, 20 bp, mouse
gaggtttgtcttacttacaa

SEQ ID NO: 658115 - DNA, 20 bp, mouse
gagatctgcctgcctttgca

SEQ ID NO: 658116 - DNA, 20 bp, mouse
gtgagtcgaggggtgagtgc

SEQ ID NO: 658117 - DNA, 20 bp, mouse
gagtgcgggcgctgaatgac

SEQ ID NO: 658118 - DNA, 20 bp, mouse
gggcttcttggctgagtcga

SEQ ID NO: 658119 - DNA, 20 bp, mouse
gagcgcccgcactcctggtc

SEQ ID NO: 658120 - DNA, 20 bp, mouse
gagcgccagaccaggagtgc

SEQ ID NO: 658121 - DNA, 20 bp, mouse
gaaagcggaagcggaaggaa

SEQ ID NO: 658122 - DNA, 20 bp, mouse
ggggtgagtgcgggctgctg

SEQ ID NO: 658123 - DNA, 20 bp, mouse
gcataaaagggaagaagcgt

SEQ ID NO: 658124 - DNA, 20 bp, mouse
gcgtggcctccgaggcttct

SEQ ID NO: 658125 - DNA, 20 bp, mouse
ggtctggcgctgctgggtct

SEQ ID NO: 658126 - DNA, 20 bp, mouse
ggggcattgctctagatcaa

SEQ ID NO: 658127 - DNA, 20 bp, mouse
gtgtggccctgcacagcagc

SEQ ID NO: 658128 - DNA, 20 bp, mouse
gaggatcggggtccgaatcc

SEQ ID NO: 658129 - DNA, 20 bp, mouse
ggcaatagatgtcaggttcc

SEQ ID NO: 658130 - DNA, 20 bp, mouse
gtgagataatagcggggaca

SEQ ID NO: 658131 - DNA, 20 bp, mouse
gttgacccatgggataaagg

SEQ ID NO: 658132 - DNA, 20 bp, mouse
ggccttgacccatgggataa

SEQ ID NO: 658133 - DNA, 20 bp, mouse
ggggcatctccatggaacaa

SEQ ID NO: 658134 - DNA, 20 bp, mouse
gggcaatggcaatagatgtc

SEQ ID NO: 658135 - DNA, 20 bp, mouse
gcccgctattatctcagcca

SEQ ID NO: 658136 - DNA, 20 bp, mouse
gtctggaagctcaggttcct

SEQ ID NO: 658137 - DNA, 20 bp, mouse
gtggcggaggtgaaaggtgg

SEQ ID NO: 658138 - DNA, 20 bp, mouse
gtggcggcgggatgctcccg

SEQ ID NO: 658139 - DNA, 20 bp, mouse
gtgctcccggggctcgcaga

SEQ ID NO: 658140 - DNA, 20 bp, mouse
gtggctccgctgcaggtctc

SEQ ID NO: 658141 - DNA, 20 bp, mouse
ggggctcgcagagggcgtgg

SEQ ID NO: 658142 - DNA, 20 bp, mouse
ggcgtggcggaggtgaaagg

SEQ ID NO: 658143 - DNA, 20 bp, mouse
gggagggcaggagacgtccc

SEQ ID NO: 658144 - DNA, 20 bp, mouse
ggcctccaggggcctccgga

SEQ ID NO: 658145 - DNA, 20 bp, mouse
gagtgcgagcggagccacgt

SEQ ID NO: 658146 - DNA, 20 bp, mouse
ggtcagaatcttaaggatgc

SEQ ID NO: 658147 - DNA, 20 bp, mouse
ggggagccatagaaagtgat

SEQ ID NO: 658148 - DNA, 20 bp, mouse
gtctcctgagaaactcttaa

SEQ ID NO: 658149 - DNA, 20 bp, mouse
gtaagagcaaagcctagtaa

SEQ ID NO: 658150 - DNA, 20 bp, mouse
gtggagcagacttaaaggtg

SEQ ID NO: 658151 - DNA, 20 bp, mouse
gctatggggtcagaatctta

SEQ ID NO: 658152 - DNA, 20 bp, mouse
gtctcaggagattctgaact

SEQ ID NO: 658153 - DNA, 20 bp, mouse
ggagcaaagcctagtaatgg

SEQ ID NO: 658154 - DNA, 20 bp, mouse
ggattctgaactaggttact

SEQ ID NO: 658155 - DNA, 20 bp, mouse
gagagaagtggttctcagtc

SEQ ID NO: 658156 - DNA, 20 bp, mouse
gccgctgaccctctgaggtg

SEQ ID NO: 658157 - DNA, 20 bp, mouse
ggttcggctccccacctcag

SEQ ID NO: 658158 - DNA, 20 bp, mouse
gcatgtgtgaggaaatgcag

SEQ ID NO: 658159 - DNA, 20 bp, mouse
gctaccaaatggctcctgaa

SEQ ID NO: 658160 - DNA, 20 bp, mouse
gaagccaggtctccagggtt

SEQ ID NO: 658161 - DNA, 20 bp, mouse
gagacactgctgttgcttga

SEQ ID NO: 658162 - DNA, 20 bp, mouse
gtaattgtgcagtcacaatg

SEQ ID NO: 658163 - DNA, 20 bp, mouse
gggacctgatgaacctctaa

SEQ ID NO: 658164 - DNA, 20 bp, mouse
ggcactgtgtctatttcacg

SEQ ID NO: 658165 - DNA, 20 bp, mouse
ggaaatagacacagtgcgcc

SEQ ID NO: 658166 - DNA, 20 bp, mouse
gtggagtcggcagtgcaagt

SEQ ID NO: 658167 - DNA, 20 bp, mouse
gctacggagggagtaacact

SEQ ID NO: 658168 - DNA, 20 bp, mouse
gtcggcagtgcaagtcggac

SEQ ID NO: 658169 - DNA, 20 bp, mouse
gaaaccgataccccctggcg

SEQ ID NO: 658170 - DNA, 20 bp, mouse
gcagcagtgcagcctacgga

SEQ ID NO: 658171 - DNA, 20 bp, mouse
gtgtggagaatcgaaatcat

SEQ ID NO: 658172 - DNA, 20 bp, mouse
ggcagcagcagtgcagccta

SEQ ID NO: 658173 - DNA, 20 bp, mouse
gagagaaggtttgacagaga

SEQ ID NO: 658174 - DNA, 20 bp, mouse
gtgctgccgtcagccctgtg

SEQ ID NO: 658175 - DNA, 20 bp, mouse
ggcagtacagactcattgtt

SEQ ID NO: 658176 - DNA, 20 bp, mouse
gctcctgtcatgattgactt

SEQ ID NO: 658177 - DNA, 20 bp, mouse
ggctctgcacgtttgtacaa

SEQ ID NO: 658178 - DNA, 20 bp, mouse
gctccgaagtcaatcatgac

SEQ ID NO: 658179 - DNA, 20 bp, mouse
ggtcaatcatgacaggagct

SEQ ID NO: 658180 - DNA, 20 bp, mouse
gtcggagaagcaaggacaaa

SEQ ID NO: 658181 - DNA, 20 bp, mouse
gcaggagaaatgtcatgggg

SEQ ID NO: 658182 - DNA, 20 bp, mouse
gcagaagaatcggagaagca

SEQ ID NO: 658183 - DNA, 20 bp, mouse
ggaaatattaaagaccactt

SEQ ID NO: 658184 - DNA, 20 bp, mouse
ggtggtctttaatatttcat

SEQ ID NO: 658185 - DNA, 20 bp, mouse
gggtgaatgggcttacgtgg

SEQ ID NO: 658186 - DNA, 20 bp, mouse
ggtagaggattgaatggcgt

SEQ ID NO: 658187 - DNA, 20 bp, mouse
ggggcagctcagtattccct

SEQ ID NO: 658188 - DNA, 20 bp, mouse
gtgagctgcccacagtgtag

SEQ ID NO: 658189 - DNA, 20 bp, mouse
gtccctgttcaataacccga

SEQ ID NO: 658190 - DNA, 20 bp, mouse
gcacagtgtagaggattgaa

SEQ ID NO: 658191 - DNA, 20 bp, mouse
gagaatgtgtctggggattg

SEQ ID NO: 658192 - DNA, 20 bp, mouse
ggggttattgaacagggaac

SEQ ID NO: 658193 - DNA, 20 bp, mouse
gtgaggctgttcattgtgga

SEQ ID NO: 658194 - DNA, 20 bp, mouse
gaaggctttggccacatcct

SEQ ID NO: 658195 - DNA, 20 bp, mouse
gtcaaaatgtgctgagtggc

SEQ ID NO: 658196 - DNA, 20 bp, mouse
gaggagccaggcaatgagat

SEQ ID NO: 658197 - DNA, 20 bp, mouse
gtaggcaagtgggttgtttc

SEQ ID NO: 658198 - DNA, 20 bp, mouse
gccactgcaaagtacaactg

SEQ ID NO: 658199 - DNA, 20 bp, mouse
gcagcctgggagatctgcag

SEQ ID NO: 658200 - DNA, 20 bp, mouse
gccactgattgtgacctcag

SEQ ID NO: 658201 - DNA, 20 bp, mouse
ggtcacaatcagtggcaggg

SEQ ID NO: 658202 - DNA, 20 bp, mouse
gtggttcagactctcccaga

SEQ ID NO: 658203 - DNA, 20 bp, mouse
gtcaggagatgccaaagagt

SEQ ID NO: 658204 - DNA, 20 bp, mouse
ggtgaagcaaagacactatt

SEQ ID NO: 658205 - DNA, 20 bp, mouse
gcaggtctaccagcacagcc

SEQ ID NO: 658206 - DNA, 20 bp, mouse
gtggcgtccaggtaagtgaa

SEQ ID NO: 658207 - DNA, 20 bp, mouse
gagcctgagggctggcgtcc

SEQ ID NO: 658208 - DNA, 20 bp, mouse
gtacctggacgccagccctc

SEQ ID NO: 658209 - DNA, 20 bp, mouse
ggaggcacccttcacttacc

SEQ ID NO: 658210 - DNA, 20 bp, mouse
gccagggaagggcgaggaaa

SEQ ID NO: 658211 - DNA, 20 bp, mouse
ggagttcccgaggccaggga

SEQ ID NO: 658212 - DNA, 20 bp, mouse
gtcaaatgttgaaaggtggg

SEQ ID NO: 658213 - DNA, 20 bp, mouse
gacaaagtgctgagttcccg

SEQ ID NO: 658214 - DNA, 20 bp, mouse
gaaatggtgttgagacaaac

SEQ ID NO: 658215 - DNA, 20 bp, mouse
gggcactgatactcagaatc

SEQ ID NO: 658216 - DNA, 20 bp, mouse
gcaaacccttgcactggagc

SEQ ID NO: 658217 - DNA, 20 bp, mouse
gaggctctgcccagtttact

SEQ ID NO: 658218 - DNA, 20 bp, mouse
gcactgccaccaagtaaact

SEQ ID NO: 658219 - DNA, 20 bp, mouse
gctctgctgtgcatagctgt

SEQ ID NO: 658220 - DNA, 20 bp, mouse
gctctgcccagtttacttgg

SEQ ID NO: 658221 - DNA, 20 bp, mouse
gccacagatgctcctagctg

SEQ ID NO: 658222 - DNA, 20 bp, mouse
ggtgcatagctgtgggtcac

SEQ ID NO: 658223 - DNA, 20 bp, mouse
gggggacactgaagctgata

SEQ ID NO: 658224 - DNA, 20 bp, mouse
ggagcaggtggacatgctag

SEQ ID NO: 658225 - DNA, 20 bp, mouse
ggagacctgaaggagaacca

SEQ ID NO: 658226 - DNA, 20 bp, mouse
gaagccagggcccttcccat

SEQ ID NO: 658227 - DNA, 20 bp, mouse
gggtctgtgtacccatcacc

SEQ ID NO: 658228 - DNA, 20 bp, mouse
ggcggctgttgccaggtgat

SEQ ID NO: 658229 - DNA, 20 bp, mouse
ggggcacccctgggaagggt

SEQ ID NO: 658230 - DNA, 20 bp, mouse
ggggaactgtctttcggaga

SEQ ID NO: 658231 - DNA, 20 bp, mouse
gggcttcccttgatctcaga

SEQ ID NO: 658232 - DNA, 20 bp, mouse
gtccgaaagacagttcccag

SEQ ID NO: 658233 - DNA, 20 bp, mouse
ggctcttagcttattgagtt

SEQ ID NO: 658234 - DNA, 20 bp, mouse
ggctctgggaagaggttagc

SEQ ID NO: 658235 - DNA, 20 bp, mouse
gggttgctgaggccagtgac

SEQ ID NO: 658236 - DNA, 20 bp, mouse
gcgcccagcaaagctaacct

SEQ ID NO: 658237 - DNA, 20 bp, mouse
gggtccagctgacgctgcag

SEQ ID NO: 658238 - DNA, 20 bp, mouse
gtggtccagtgtaggagtca

SEQ ID NO: 658239 - DNA, 20 bp, mouse
gcagctggaccagatgcagc

SEQ ID NO: 658240 - DNA, 20 bp, mouse
gatcctagagctgaagaaag

SEQ ID NO: 658241 - DNA, 20 bp, mouse
gtctagaagtgtaggaaatc

SEQ ID NO: 658242 - DNA, 20 bp, mouse
gttctgacccagaaggagag

SEQ ID NO: 658243 - DNA, 20 bp, mouse
ggaggccaagtggtgctgac

SEQ ID NO: 658244 - DNA, 20 bp, mouse
ggtaggagtcagggaccacc

SEQ ID NO: 658245 - DNA, 20 bp, mouse
gggcctctttcttcagctct

SEQ ID NO: 658246 - DNA, 20 bp, mouse
gagggtgtgtggttgtctcc

SEQ ID NO: 658247 - DNA, 20 bp, mouse
gctggcaactgccaagatgg

SEQ ID NO: 658248 - DNA, 20 bp, mouse
ggtgtccagatgagggtgtg

SEQ ID NO: 658249 - DNA, 20 bp, mouse
ggggaagatgccatcgacga

SEQ ID NO: 658250 - DNA, 20 bp, mouse
ggcaggaagccctatgccca

SEQ ID NO: 658251 - DNA, 20 bp, mouse
gaagctgctgccgtcgtcga

SEQ ID NO: 658252 - DNA, 20 bp, mouse
gtgccagattggaatgaaca

SEQ ID NO: 658253 - DNA, 20 bp, mouse
gcggcagcagctttcatcac

SEQ ID NO: 658254 - DNA, 20 bp, mouse
gcctcacagaagatataacc

SEQ ID NO: 658255 - DNA, 20 bp, mouse
gttccctgttcattccaatc

SEQ ID NO: 658256 - DNA, 20 bp, mouse
gtgcttgaaccaaaatgcag

SEQ ID NO: 658257 - DNA, 20 bp, mouse
gtgttaatctcttgtgtggg

SEQ ID NO: 658258 - DNA, 20 bp, mouse
gcaccctgtagagcccatat

SEQ ID NO: 658259 - DNA, 20 bp, mouse
gtcagtgatgccccacagct

SEQ ID NO: 658260 - DNA, 20 bp, mouse
gactgtgtatctcagcactc

SEQ ID NO: 658261 - DNA, 20 bp, mouse
gtgccaatatgggctctaca

SEQ ID NO: 658262 - DNA, 20 bp, mouse
ggaaagttcaatgccaatat

SEQ ID NO: 658263 - DNA, 20 bp, mouse
gtcttgtcaaatcctagctg

SEQ ID NO: 658264 - DNA, 20 bp, mouse
gtctcttgtgtgggaggagt

SEQ ID NO: 658265 - DNA, 20 bp, mouse
gtttcaaaagaaatggaaga

SEQ ID NO: 658266 - DNA, 20 bp, mouse
gcaacccgaccggtccggtc

SEQ ID NO: 658267 - DNA, 20 bp, mouse
gcccgaggctggtttaagaa

SEQ ID NO: 658268 - DNA, 20 bp, mouse
gaggcctcctggagtggacc

SEQ ID NO: 658269 - DNA, 20 bp, mouse
ggacaaggtcaaaagaccat

SEQ ID NO: 658270 - DNA, 20 bp, mouse
gcggaccggaccggaccggt

SEQ ID NO: 658271 - DNA, 20 bp, mouse
gactgccgaaaccatagcga

SEQ ID NO: 658272 - DNA, 20 bp, mouse
gagcacaaacgcaacccgac

SEQ ID NO: 658273 - DNA, 20 bp, mouse
gtttgcaggcagaggcacta

SEQ ID NO: 658274 - DNA, 20 bp, mouse
ggcgtcaaaacgagagcccg

SEQ ID NO: 658275 - DNA, 20 bp, mouse
gaaacgcaacccgaccggtc

SEQ ID NO: 658276 - DNA, 20 bp, mouse
gttccgaggcggccagttat

SEQ ID NO: 658277 - DNA, 20 bp, mouse
gtgcgtagaaagtgcgtgtt

SEQ ID NO: 658278 - DNA, 20 bp, mouse
gcgcatgcgcaactcctctc

SEQ ID NO: 658279 - DNA, 20 bp, mouse
gtgcagggtcacatggtatc

SEQ ID NO: 658280 - DNA, 20 bp, mouse
gcatcgcatgccttccgagg

SEQ ID NO: 658281 - DNA, 20 bp, mouse
gacgcatcgcatgccttccg

SEQ ID NO: 658282 - DNA, 20 bp, mouse
gaagaccctcgaagtcccat

SEQ ID NO: 658283 - DNA, 20 bp, mouse
gagaaggatctgcagtggca

SEQ ID NO: 658284 - DNA, 20 bp, mouse
ggtctgactaaggtcaggat

SEQ ID NO: 658285 - DNA, 20 bp, mouse
ggaaagtgcgtgttcggcaa

SEQ ID NO: 658286 - DNA, 20 bp, mouse
ggcgctggagccacctgagg

SEQ ID NO: 658287 - DNA, 20 bp, mouse
ggccacctgaggaggttgta

SEQ ID NO: 658288 - DNA, 20 bp, mouse
ggatcgtgcaaggggacgag

SEQ ID NO: 658289 - DNA, 20 bp, mouse
gcccgcccacagatcgtgca

SEQ ID NO: 658290 - DNA, 20 bp, mouse
gggctggagaggaacgacgg

SEQ ID NO: 658291 - DNA, 20 bp, mouse
gttgtcggtgtctgtcgcag

SEQ ID NO: 658292 - DNA, 20 bp, mouse
gcccttgcacgatctgtggg

SEQ ID NO: 658293 - DNA, 20 bp, mouse
gatgcgcgctggctcggcgt

SEQ ID NO: 658294 - DNA, 20 bp, mouse
gagcggctggagaggaacga

SEQ ID NO: 658295 - DNA, 20 bp, mouse
gacgaggggtctgtgacgtc

SEQ ID NO: 658296 - DNA, 20 bp, mouse
gaggggagtcctatgagggt

SEQ ID NO: 658297 - DNA, 20 bp, mouse
gactctaggggagtcctatg

SEQ ID NO: 658298 - DNA, 20 bp, mouse
gtcgggaaacttgaagttgt

SEQ ID NO: 658299 - DNA, 20 bp, mouse
ggctacaacagggctcagga

SEQ ID NO: 658300 - DNA, 20 bp, mouse
gtagagtccctggagctaaa

SEQ ID NO: 658301 - DNA, 20 bp, mouse
ggagccagcaggctacaaca

SEQ ID NO: 658302 - DNA, 20 bp, mouse
ggagggtgaccggaagcatc

SEQ ID NO: 658303 - DNA, 20 bp, mouse
ggagccctgttgtagcctgc

SEQ ID NO: 658304 - DNA, 20 bp, mouse
gacctgcttggcaacttgcc

SEQ ID NO: 658305 - DNA, 20 bp, mouse
gctagcctcttgccttcact

SEQ ID NO: 658306 - DNA, 20 bp, mouse
gcatcagtgcaagtttctat

SEQ ID NO: 658307 - DNA, 20 bp, mouse
ggtagcccatgaatggagag

SEQ ID NO: 658308 - DNA, 20 bp, mouse
gtttccctctctccattcat

SEQ ID NO: 658309 - DNA, 20 bp, mouse
gccctcttccccatattcca

SEQ ID NO: 658310 - DNA, 20 bp, mouse
gtaagaaagtagcccatgaa

SEQ ID NO: 658311 - DNA, 20 bp, mouse
gataaaaatctgttaagata

SEQ ID NO: 658312 - DNA, 20 bp, mouse
gtttatggccttggaatatg

SEQ ID NO: 658313 - DNA, 20 bp, mouse
gacagagggccaagggttgc

SEQ ID NO: 658314 - DNA, 20 bp, mouse
ggccaatttgtggggtattt

SEQ ID NO: 658315 - DNA, 20 bp, mouse
gtgagtactttgtgtaactg

SEQ ID NO: 658316 - DNA, 20 bp, mouse
gcagtgagagtcagaaatca

SEQ ID NO: 658317 - DNA, 20 bp, mouse
gaagggtgataacaatctgt

SEQ ID NO: 658318 - DNA, 20 bp, mouse
gctgactctcactgagctac

SEQ ID NO: 658319 - DNA, 20 bp, mouse
gtgtcttggaagttaacttt

SEQ ID NO: 658320 - DNA, 20 bp, mouse
ggagtagttcagttcctgaa

SEQ ID NO: 658321 - DNA, 20 bp, mouse
gaaggagtgtacataaagac

SEQ ID NO: 658322 - DNA, 20 bp, mouse
ggtgataacaatctgttggt

SEQ ID NO: 658323 - DNA, 20 bp, mouse
gttggaagttaacttttgga

SEQ ID NO: 658324 - DNA, 20 bp, mouse
gttacactctgagcattgaa

SEQ ID NO: 658325 - DNA, 20 bp, mouse
gcaagctcgacacattcaag

SEQ ID NO: 658326 - DNA, 20 bp, mouse
gtgaagctgtgcgagagcaa

SEQ ID NO: 658327 - DNA, 20 bp, mouse
gcagcctcttgattggacca

SEQ ID NO: 658328 - DNA, 20 bp, mouse
gtgtcctaacagctttatgt

SEQ ID NO: 658329 - DNA, 20 bp, mouse
ggcgagagcaaaggaggtga

SEQ ID NO: 658330 - DNA, 20 bp, mouse
gctccaggagcagccatccc

SEQ ID NO: 658331 - DNA, 20 bp, mouse
gcatatcctagagctggaga

SEQ ID NO: 658332 - DNA, 20 bp, mouse
gattccctggtccaatcaag

SEQ ID NO: 658333 - DNA, 20 bp, mouse
ggctacgtcatcagttacca

SEQ ID NO: 658334 - DNA, 20 bp, mouse
gtcaaccaggctgcggagtt

SEQ ID NO: 658335 - DNA, 20 bp, mouse
ggagactcatatcctagagc

SEQ ID NO: 658336 - DNA, 20 bp, mouse
ggggaagttcctagaggtga

SEQ ID NO: 658337 - DNA, 20 bp, mouse
gaggcaagggaagttcctag

SEQ ID NO: 658338 - DNA, 20 bp, mouse
gaggggtatgaagattactg

SEQ ID NO: 658339 - DNA, 20 bp, mouse
gggtatgaagattactgggg

SEQ ID NO: 658340 - DNA, 20 bp, mouse
ggaagtgcaggtgttgaatc

SEQ ID NO: 658341 - DNA, 20 bp, mouse
ggaggtgacggtattaagtc

SEQ ID NO: 658342 - DNA, 20 bp, mouse
gcaaatgaagaataccaggg

SEQ ID NO: 658343 - DNA, 20 bp, mouse
gtgaaggctcttatctttat

SEQ ID NO: 658344 - DNA, 20 bp, mouse
gtaacagagtccagaagtgc

SEQ ID NO: 658345 - DNA, 20 bp, mouse
ggtagactaagcaccttctg

SEQ ID NO: 658346 - DNA, 20 bp, mouse
gggctagtggaattgttcct

SEQ ID NO: 658347 - DNA, 20 bp, mouse
gtcaacttcagcccgcgcca

SEQ ID NO: 658348 - DNA, 20 bp, mouse
gcacatccggcccaggtgta

SEQ ID NO: 658349 - DNA, 20 bp, mouse
gcagcagcgatttatgtcca

SEQ ID NO: 658350 - DNA, 20 bp, mouse
gctgctgacccagccaccgc

SEQ ID NO: 658351 - DNA, 20 bp, mouse
ggatgtgcacagcgtcacaa

SEQ ID NO: 658352 - DNA, 20 bp, mouse
gttccactagcccgtggcgc

SEQ ID NO: 658353 - DNA, 20 bp, mouse
ggctgcgaaacacgatgccg

SEQ ID NO: 658354 - DNA, 20 bp, mouse
gacagggcatgagtttctgg

SEQ ID NO: 658355 - DNA, 20 bp, mouse
ggcagtccaggagcctgcgg

SEQ ID NO: 658356 - DNA, 20 bp, mouse
gtgggtgtaggttgccttgg

SEQ ID NO: 658357 - DNA, 20 bp, mouse
gccttccccacaatccacca

SEQ ID NO: 658358 - DNA, 20 bp, mouse
gcccacctaaaccaattcca

SEQ ID NO: 658359 - DNA, 20 bp, mouse
gaggttgccttggtggattg

SEQ ID NO: 658360 - DNA, 20 bp, mouse
ggactgcacctccaggctgt

SEQ ID NO: 658361 - DNA, 20 bp, mouse
gagggaggagcaattgggca

SEQ ID NO: 658362 - DNA, 20 bp, mouse
gtgtcctggagccacagctt

SEQ ID NO: 658363 - DNA, 20 bp, mouse
gagactatccccaaacaggg

SEQ ID NO: 658364 - DNA, 20 bp, mouse
gttgctggcattggggaaaa

SEQ ID NO: 658365 - DNA, 20 bp, mouse
gggcttcttagaatctttag

SEQ ID NO: 658366 - DNA, 20 bp, mouse
gcggagacacgcagcgtccc

SEQ ID NO: 658367 - DNA, 20 bp, mouse
gtgctcagagcggcagaact

SEQ ID NO: 658368 - DNA, 20 bp, mouse
gcatccctgtgacccgaaac

SEQ ID NO: 658369 - DNA, 20 bp, mouse
gtagccgccatcttgggtaa

SEQ ID NO: 658370 - DNA, 20 bp, mouse
ggtacgcagccgccacttcc

SEQ ID NO: 658371 - DNA, 20 bp, mouse
gttgcccttacccaagatgg

SEQ ID NO: 658372 - DNA, 20 bp, mouse
gggcaactagccgccatctt

SEQ ID NO: 658373 - DNA, 20 bp, mouse
gaagtgctctggtggagcgc

SEQ ID NO: 658374 - DNA, 20 bp, mouse
ggtcccaggcttcacctccg

SEQ ID NO: 658375 - DNA, 20 bp, mouse
gtggaaacccggaagtgctc

SEQ ID NO: 658376 - DNA, 20 bp, mouse
gacaacactggcttttgaga

SEQ ID NO: 658377 - DNA, 20 bp, mouse
gtcacttgaagtgtgactat

SEQ ID NO: 658378 - DNA, 20 bp, mouse
gttgagatggctggaagtga

SEQ ID NO: 658379 - DNA, 20 bp, mouse
gtcaatgtacccaattactt

SEQ ID NO: 658380 - DNA, 20 bp, mouse
gtacattgatagtgtgcctt

SEQ ID NO: 658381 - DNA, 20 bp, mouse
ggaagaataagctatactcc

SEQ ID NO: 658382 - DNA, 20 bp, mouse
gtgaggattttcacacagct

SEQ ID NO: 658383 - DNA, 20 bp, mouse
gattcttctgtaaatgtaga

SEQ ID NO: 658384 - DNA, 20 bp, mouse
gaatatttctatgatgattg

SEQ ID NO: 658385 - DNA, 20 bp, mouse
gcaggagagcccaagtaatt

SEQ ID NO: 658386 - DNA, 20 bp, mouse
gtagccctgcaatagtagct

SEQ ID NO: 658387 - DNA, 20 bp, mouse
gaggatacctgttggagcga

SEQ ID NO: 658388 - DNA, 20 bp, mouse
ggggagagcgtgtgtttgat

SEQ ID NO: 658389 - DNA, 20 bp, mouse
gtaaccgccaggatacctgt

SEQ ID NO: 658390 - DNA, 20 bp, mouse
ggcgttctctcttgacgaac

SEQ ID NO: 658391 - DNA, 20 bp, mouse
ggcacccatgccaggcagtc

SEQ ID NO: 658392 - DNA, 20 bp, mouse
ggcaccccaggctgagtcag

SEQ ID NO: 658393 - DNA, 20 bp, mouse
gttaaggtgaccatcaggac

SEQ ID NO: 658394 - DNA, 20 bp, mouse
ggaccaatagtaaggatcaa

SEQ ID NO: 658395 - DNA, 20 bp, mouse
gccgggcctggcaaggagta

SEQ ID NO: 658396 - DNA, 20 bp, mouse
gtggcagcgcgcggtgtcaa

SEQ ID NO: 658397 - DNA, 20 bp, mouse
gaaaccccagggggatccta

SEQ ID NO: 658398 - DNA, 20 bp, mouse
gaagtgaatgataacgtcag

SEQ ID NO: 658399 - DNA, 20 bp, mouse
ggacctgcttcgtgacacgt

SEQ ID NO: 658400 - DNA, 20 bp, mouse
gtctcaggcaaggcagcatt

SEQ ID NO: 658401 - DNA, 20 bp, mouse
gctcccacgtgtcacgaagc

SEQ ID NO: 658402 - DNA, 20 bp, mouse
gagaccttaggatccccctg

SEQ ID NO: 658403 - DNA, 20 bp, mouse
gccaggaagggtctcaggca

SEQ ID NO: 658404 - DNA, 20 bp, mouse
gtgggagctctccagcgtgc

SEQ ID NO: 658405 - DNA, 20 bp, mouse
gcactctgagcagacactaa

SEQ ID NO: 658406 - DNA, 20 bp, mouse
gagacgacgcgtagtttcaa

SEQ ID NO: 658407 - DNA, 20 bp, mouse
gtcaaagtccccccggactg

SEQ ID NO: 658408 - DNA, 20 bp, mouse
gggctgaaggcgagtttctc

SEQ ID NO: 658409 - DNA, 20 bp, mouse
ggccagggcgaacaaactac

SEQ ID NO: 658410 - DNA, 20 bp, mouse
ggaaactcgccttcagccta

SEQ ID NO: 658411 - DNA, 20 bp, mouse
gcggggccctctctagctat

SEQ ID NO: 658412 - DNA, 20 bp, mouse
gtctcgttggtgttcgccgt

SEQ ID NO: 658413 - DNA, 20 bp, mouse
ggggacggcgttccaagctg

SEQ ID NO: 658414 - DNA, 20 bp, mouse
gcctctctatggtttggtgg

SEQ ID NO: 658415 - DNA, 20 bp, mouse
ggcgagagtgctcctctcta

SEQ ID NO: 658416 - DNA, 20 bp, mouse
gctggaaagtaggaagtcta

SEQ ID NO: 658417 - DNA, 20 bp, mouse
gacgcccgggaggaaggcga

SEQ ID NO: 658418 - DNA, 20 bp, mouse
gaaaaggccaaaacagttcc

SEQ ID NO: 658419 - DNA, 20 bp, mouse
gaaaacagttcctggaaagt

SEQ ID NO: 658420 - DNA, 20 bp, mouse
gacgactctcagccagaaaa

SEQ ID NO: 658421 - DNA, 20 bp, mouse
ggcaactactgcctgacgtg

SEQ ID NO: 658422 - DNA, 20 bp, mouse
gtccctccacccgagaccgg

SEQ ID NO: 658423 - DNA, 20 bp, mouse
gcaagtctctttgaaagctt

SEQ ID NO: 658424 - DNA, 20 bp, mouse
ggttcccaatagcagtgaga

SEQ ID NO: 658425 - DNA, 20 bp, mouse
gttacgggaccgccggtctc

SEQ ID NO: 658426 - DNA, 20 bp, mouse
ggccctgtgcaccgcctaca

SEQ ID NO: 658427 - DNA, 20 bp, mouse
gggactgtctcgagcaacac

SEQ ID NO: 658428 - DNA, 20 bp, mouse
gctgcagcgcgagcgggcta

SEQ ID NO: 658429 - DNA, 20 bp, mouse
gccgacccatccacgaggca

SEQ ID NO: 658430 - DNA, 20 bp, mouse
gcccaggcatgacatcacaa

SEQ ID NO: 658431 - DNA, 20 bp, mouse
gatgacatcacaatggtcga

SEQ ID NO: 658432 - DNA, 20 bp, mouse
gacagggaagtgacaaccga

SEQ ID NO: 658433 - DNA, 20 bp, mouse
ggttgctcgagacagtccgt

SEQ ID NO: 658434 - DNA, 20 bp, mouse
gtggtcgatggagtggtgga

SEQ ID NO: 658435 - DNA, 20 bp, mouse
gtcgggaaaaccctgcctcg

SEQ ID NO: 658436 - DNA, 20 bp, mouse
gtttcaggaatagttcacaa

SEQ ID NO: 658437 - DNA, 20 bp, mouse
gattgaagtatcattgtata

SEQ ID NO: 658438 - DNA, 20 bp, mouse
gatgatacttcaataatttt

SEQ ID NO: 658439 - DNA, 20 bp, mouse
gttttggttacatggtgtga

SEQ ID NO: 658440 - DNA, 20 bp, mouse
gactgacagttttggttaca

SEQ ID NO: 658441 - DNA, 20 bp, mouse
gcattcaaaactgacagttt

SEQ ID NO: 658442 - DNA, 20 bp, mouse
gaataatttttggtagaatg

SEQ ID NO: 658443 - DNA, 20 bp, mouse
gagctaaatattaaaaacta

SEQ ID NO: 658444 - DNA, 20 bp, mouse
gtggctggatacagactggg

SEQ ID NO: 658445 - DNA, 20 bp, mouse
gaaagatgggaatataaaag

SEQ ID NO: 658446 - DNA, 20 bp, mouse
gtatccatgaaaccttttgg

SEQ ID NO: 658447 - DNA, 20 bp, mouse
gtcttcctcacccccccaaa

SEQ ID NO: 658448 - DNA, 20 bp, mouse
gacccccccaaaaggtttca

SEQ ID NO: 658449 - DNA, 20 bp, mouse
gcaaaggtattctttttagc

SEQ ID NO: 658450 - DNA, 20 bp, mouse
ggagacataccataattcaa

SEQ ID NO: 658451 - DNA, 20 bp, mouse
gtattctttttagctggatt

SEQ ID NO: 658452 - DNA, 20 bp, mouse
gaaagaatacctttgaatta

SEQ ID NO: 658453 - DNA, 20 bp, mouse
gatttatccatgaaaccttt

SEQ ID NO: 658454 - DNA, 20 bp, mouse
gagttttcaatttgttccat

SEQ ID NO: 658455 - DNA, 20 bp, mouse
gggagggtgtggctaaaata

SEQ ID NO: 658456 - DNA, 20 bp, mouse
gcggctggagcgcacttgga

SEQ ID NO: 658457 - DNA, 20 bp, mouse
ggggaaaggaagtgccgacg

SEQ ID NO: 658458 - DNA, 20 bp, mouse
gaactctgggtcgtgaagac

SEQ ID NO: 658459 - DNA, 20 bp, mouse
gggcggctgtccaatcatct

SEQ ID NO: 658460 - DNA, 20 bp, mouse
gcgggagccctcactgaaga

SEQ ID NO: 658461 - DNA, 20 bp, mouse
gctagcacccgcctttactg

SEQ ID NO: 658462 - DNA, 20 bp, mouse
gaaaaaaaacccacggtcag

SEQ ID NO: 658463 - DNA, 20 bp, mouse
gggcagacacgtcaccctgg

SEQ ID NO: 658464 - DNA, 20 bp, mouse
gtggagcgcacttggagggc

SEQ ID NO: 658465 - DNA, 20 bp, mouse
ggctaggcggaaatgagcta

SEQ ID NO: 658466 - DNA, 20 bp, mouse
gctgtcactgaggtgaccag

SEQ ID NO: 658467 - DNA, 20 bp, mouse
gtccacggtcctgatgatga

SEQ ID NO: 658468 - DNA, 20 bp, mouse
gcctgcacacaggtcccctc

SEQ ID NO: 658469 - DNA, 20 bp, mouse
ggggacctgtgtgcaggaga

SEQ ID NO: 658470 - DNA, 20 bp, mouse
gtggaccccacgtgagaaga

SEQ ID NO: 658471 - DNA, 20 bp, mouse
gcccagtagaccaagtcctg

SEQ ID NO: 658472 - DNA, 20 bp, mouse
gcctcccagcaacgggcatc

SEQ ID NO: 658473 - DNA, 20 bp, mouse
gacggacactggcatgtaca

SEQ ID NO: 658474 - DNA, 20 bp, mouse
ggtccccatctcctgcacac

SEQ ID NO: 658475 - DNA, 20 bp, mouse
gaccctcatcatcaggaccg

SEQ ID NO: 658476 - DNA, 20 bp, mouse
gagccgagagcgtgccgaga

SEQ ID NO: 658477 - DNA, 20 bp, mouse
gaaaagaggcgcgcctccga

SEQ ID NO: 658478 - DNA, 20 bp, mouse
ggcacccgcacctccctcgg

SEQ ID NO: 658479 - DNA, 20 bp, mouse
gccgccccccagcttcgggt

SEQ ID NO: 658480 - DNA, 20 bp, mouse
gtctccaagtgctagagaag

SEQ ID NO: 658481 - DNA, 20 bp, mouse
ggcagcacccgcacctccct

SEQ ID NO: 658482 - DNA, 20 bp, mouse
ggcctcttctggggtattac

SEQ ID NO: 658483 - DNA, 20 bp, mouse
gcgcgcctccgagggaggtg

SEQ ID NO: 658484 - DNA, 20 bp, mouse
gagcaaccacagaactcgag

SEQ ID NO: 658485 - DNA, 20 bp, mouse
gaggaccagggcacacaaaa

SEQ ID NO: 658486 - DNA, 20 bp, mouse
gtagcggcgggtccttccga

SEQ ID NO: 658487 - DNA, 20 bp, mouse
ggaacagttgagacctgcgt

SEQ ID NO: 658488 - DNA, 20 bp, mouse
gtacctgaagccagcctcgt

SEQ ID NO: 658489 - DNA, 20 bp, mouse
ggagtgcgtcacgttagcgg

SEQ ID NO: 658490 - DNA, 20 bp, mouse
gaccgggaatcagaagtccc

SEQ ID NO: 658491 - DNA, 20 bp, mouse
gtccgatggccattaagcgc

SEQ ID NO: 658492 - DNA, 20 bp, mouse
gagaagtcccgggcacctaa

SEQ ID NO: 658493 - DNA, 20 bp, mouse
gttttcgggcggtgatttcg

SEQ ID NO: 658494 - DNA, 20 bp, mouse
gctccgaggtccaaaggccg

SEQ ID NO: 658495 - DNA, 20 bp, mouse
gaaagaggttgaagcacttg

SEQ ID NO: 658496 - DNA, 20 bp, mouse
gtgggtggggatagggacag

SEQ ID NO: 658497 - DNA, 20 bp, mouse
ggacaggggcggtgtctatt

SEQ ID NO: 658498 - DNA, 20 bp, mouse
ggggaagctctaggcagagt

SEQ ID NO: 658499 - DNA, 20 bp, mouse
gtgagtgtcagggtggcaat

SEQ ID NO: 658500 - DNA, 20 bp, mouse
gggcagagttggctcctgct

SEQ ID NO: 658501 - DNA, 20 bp, mouse
gggcagagatgcattgtccc

SEQ ID NO: 658502 - DNA, 20 bp, mouse
gagctaaacgcatgagtgtc

SEQ ID NO: 658503 - DNA, 20 bp, mouse
gaagcgccctcctagcgctg

SEQ ID NO: 658504 - DNA, 20 bp, mouse
ggggtgtgacctcctatcat

SEQ ID NO: 658505 - DNA, 20 bp, mouse
gggaatccccagcgctagga

SEQ ID NO: 658506 - DNA, 20 bp, mouse
gggactctggacaacaagtg

SEQ ID NO: 658507 - DNA, 20 bp, mouse
gtggacaacaagtgaggact

SEQ ID NO: 658508 - DNA, 20 bp, mouse
gtatggaagggtgacctcaa

SEQ ID NO: 658509 - DNA, 20 bp, mouse
ggcaggcctcaaatatggaa

SEQ ID NO: 658510 - DNA, 20 bp, mouse
gcaaaggaacacaaggtgtt

SEQ ID NO: 658511 - DNA, 20 bp, mouse
gaacacaaggtgttaggcct

SEQ ID NO: 658512 - DNA, 20 bp, mouse
gcagctcctgagaagataga

SEQ ID NO: 658513 - DNA, 20 bp, mouse
gggtctggggaatgtctgaa

SEQ ID NO: 658514 - DNA, 20 bp, mouse
ggtcttaaggagttgatgtc

SEQ ID NO: 658515 - DNA, 20 bp, mouse
gaaacccagtgccttccttc

SEQ ID NO: 658516 - DNA, 20 bp, mouse
gtgtatccaacaaactcaca

SEQ ID NO: 658517 - DNA, 20 bp, mouse
gtctaacaacattggtactc

SEQ ID NO: 658518 - DNA, 20 bp, mouse
gataaagatgaatccccaaa

SEQ ID NO: 658519 - DNA, 20 bp, mouse
gaatcctttctgcttacgtg

SEQ ID NO: 658520 - DNA, 20 bp, mouse
gccaatgttgttagaaacat

SEQ ID NO: 658521 - DNA, 20 bp, mouse
gctttctgcttacgtgaggt

SEQ ID NO: 658522 - DNA, 20 bp, mouse
gtgtcgagtttcagtctctg

SEQ ID NO: 658523 - DNA, 20 bp, mouse
gagtagtagtaacagaaaag

SEQ ID NO: 658524 - DNA, 20 bp, mouse
ggatacagagcttttatatt

SEQ ID NO: 658525 - DNA, 20 bp, mouse
ggactcccttgtgagtttgt

SEQ ID NO: 658526 - DNA, 20 bp, mouse
ggggagggctcaacatactg

SEQ ID NO: 658527 - DNA, 20 bp, mouse
gtgcaggcaggcgaccgcag

SEQ ID NO: 658528 - DNA, 20 bp, mouse
gtccagaccaagaactctga

SEQ ID NO: 658529 - DNA, 20 bp, mouse
ggggcggtgctgagttcctg

SEQ ID NO: 658530 - DNA, 20 bp, mouse
gcactggccctcagagttct

SEQ ID NO: 658531 - DNA, 20 bp, mouse
gagtgaaagcagaagtggac

SEQ ID NO: 658532 - DNA, 20 bp, mouse
gcaggccagtgtgccaggga

SEQ ID NO: 658533 - DNA, 20 bp, mouse
gcctgcgcccgggcgcgtgc

SEQ ID NO: 658534 - DNA, 20 bp, mouse
gagtggacaggcacccaccc

SEQ ID NO: 658535 - DNA, 20 bp, mouse
gttggtctggagtgccactg

SEQ ID NO: 658536 - DNA, 20 bp, mouse
ggtgctgtgacatcacctca

SEQ ID NO: 658537 - DNA, 20 bp, mouse
gatgctgccagtctgagggg

SEQ ID NO: 658538 - DNA, 20 bp, mouse
ggccctgtctggttaaccaa

SEQ ID NO: 658539 - DNA, 20 bp, mouse
gacagcagctggctggactc

SEQ ID NO: 658540 - DNA, 20 bp, mouse
ggaaagcagtctgtttgaag

SEQ ID NO: 658541 - DNA, 20 bp, mouse
gtggtccaagtggggtttca

SEQ ID NO: 658542 - DNA, 20 bp, mouse
ggcagcatcacgacctcctc

SEQ ID NO: 658543 - DNA, 20 bp, mouse
gtgctgtctctgcacgaaga

SEQ ID NO: 658544 - DNA, 20 bp, mouse
gtggactcgggcagagggta

SEQ ID NO: 658545 - DNA, 20 bp, mouse
gtcccttggttaaccagaca

SEQ ID NO: 658546 - DNA, 20 bp, mouse
gcttatctccgaaatatctg

SEQ ID NO: 658547 - DNA, 20 bp, mouse
gctagcctaatcacagtgtg

SEQ ID NO: 658548 - DNA, 20 bp, mouse
gtcagcctcacactgtgatt

SEQ ID NO: 658549 - DNA, 20 bp, mouse
ggtgaggctgaagacatcca

SEQ ID NO: 658550 - DNA, 20 bp, mouse
gcccattccctcagatattt

SEQ ID NO: 658551 - DNA, 20 bp, mouse
gtccgaaatatctgagggaa

SEQ ID NO: 658552 - DNA, 20 bp, mouse
gtgagcaagcatgtgtgccc

SEQ ID NO: 658553 - DNA, 20 bp, mouse
gtggcacagagactgcaggg

SEQ ID NO: 658554 - DNA, 20 bp, mouse
ggagttgggggtaaatgtgg

SEQ ID NO: 658555 - DNA, 20 bp, mouse
gttgggggtaaatgtggtgg

SEQ ID NO: 658556 - DNA, 20 bp, mouse
gcctgcgtccccgcacacgt

SEQ ID NO: 658557 - DNA, 20 bp, mouse
ggctcctactcccgcagcta

SEQ ID NO: 658558 - DNA, 20 bp, mouse
gaatacagacgctgcagtgt

SEQ ID NO: 658559 - DNA, 20 bp, mouse
ggcagcgtctgtattgtgta

SEQ ID NO: 658560 - DNA, 20 bp, mouse
ggatgtctgtcgcgggtcca

SEQ ID NO: 658561 - DNA, 20 bp, mouse
ggtctgaagaaggagtgcag

SEQ ID NO: 658562 - DNA, 20 bp, mouse
ggcgttgactcgcggagtga

SEQ ID NO: 658563 - DNA, 20 bp, mouse
gtcacccattggcacgggtt

SEQ ID NO: 658564 - DNA, 20 bp, mouse
gtgtgtaaggcgttgactcg

SEQ ID NO: 658565 - DNA, 20 bp, mouse
gtctgtcgcgggtccagggg

SEQ ID NO: 658566 - DNA, 20 bp, mouse
gcaacagcgcctgcaccctg

SEQ ID NO: 658567 - DNA, 20 bp, mouse
ggacgcgtaccttacgtcgc

SEQ ID NO: 658568 - DNA, 20 bp, mouse
gccacgcgcccggcgacgta

SEQ ID NO: 658569 - DNA, 20 bp, mouse
gggggcgggcagctcagtcc

SEQ ID NO: 658570 - DNA, 20 bp, mouse
ggcgcgggacccggcggaac

SEQ ID NO: 658571 - DNA, 20 bp, mouse
gcaagcaaggaattgattag

SEQ ID NO: 658572 - DNA, 20 bp, mouse
ggctcgccgtgatcgtatag

SEQ ID NO: 658573 - DNA, 20 bp, mouse
gagggccgcgcgggacccgg

SEQ ID NO: 658574 - DNA, 20 bp, mouse
gggcggaactggattgaccg

SEQ ID NO: 658575 - DNA, 20 bp, mouse
gcggacgccgagggccgcgc

SEQ ID NO: 658576 - DNA, 20 bp, mouse
ggttggaggtaaatgtggta

SEQ ID NO: 658577 - DNA, 20 bp, mouse
gtggtacaaagagtgtaggg

SEQ ID NO: 658578 - DNA, 20 bp, mouse
gtattggtacaaagagtgta

SEQ ID NO: 658579 - DNA, 20 bp, mouse
gagaatacctaataatatta

SEQ ID NO: 658580 - DNA, 20 bp, mouse
ggagataataaaattgtcta

SEQ ID NO: 658581 - DNA, 20 bp, mouse
gtaataaaattgtctatggt

SEQ ID NO: 658582 - DNA, 20 bp, mouse
gttattatctctatgaagtt

SEQ ID NO: 658583 - DNA, 20 bp, mouse
gtaacctgtgtttctaaata

SEQ ID NO: 658584 - DNA, 20 bp, mouse
gttatctctatgaagttggg

SEQ ID NO: 658585 - DNA, 20 bp, mouse
gtacctaataatattaaggc

SEQ ID NO: 658586 - DNA, 20 bp, mouse
gttgctagctaggagagaac

SEQ ID NO: 658587 - DNA, 20 bp, mouse
gtagctaggagagaacaggc

SEQ ID NO: 658588 - DNA, 20 bp, mouse
gcaaggaagctgtagtgcca

SEQ ID NO: 658589 - DNA, 20 bp, mouse
gggcctatataagaacacac

SEQ ID NO: 658590 - DNA, 20 bp, mouse
gggatttttgggacctgatt

SEQ ID NO: 658591 - DNA, 20 bp, mouse
ggtgtgttatctgcaatgtc

SEQ ID NO: 658592 - DNA, 20 bp, mouse
ggtcccaaaaatcctggaag

SEQ ID NO: 658593 - DNA, 20 bp, mouse
gaatccccttccaggatttt

SEQ ID NO: 658594 - DNA, 20 bp, mouse
gcacccaaccatgacactgt

SEQ ID NO: 658595 - DNA, 20 bp, mouse
gtcatggttgggtggggtca

SEQ ID NO: 658596 - DNA, 20 bp, mouse
gtctgagcccaggaggtcct

SEQ ID NO: 658597 - DNA, 20 bp, mouse
ggacctcctgggctcagaaa

SEQ ID NO: 658598 - DNA, 20 bp, mouse
gaccagccagtcttttgtat

SEQ ID NO: 658599 - DNA, 20 bp, mouse
gctacacttctgggtaacag

SEQ ID NO: 658600 - DNA, 20 bp, mouse
gacaacaggaagctgtaccc

SEQ ID NO: 658601 - DNA, 20 bp, mouse
gtacatatggcaacgatccc

SEQ ID NO: 658602 - DNA, 20 bp, mouse
gtgtagcctatacaaaagac

SEQ ID NO: 658603 - DNA, 20 bp, mouse
gaatctagaaaggttacata

SEQ ID NO: 658604 - DNA, 20 bp, mouse
gggctaaagagaggattgtg

SEQ ID NO: 658605 - DNA, 20 bp, mouse
gggccctttctgagcccagg

SEQ ID NO: 658606 - DNA, 20 bp, mouse
gctcctgtgtacccagaact

SEQ ID NO: 658607 - DNA, 20 bp, mouse
ggcaaaggacgtggtttcag

SEQ ID NO: 658608 - DNA, 20 bp, mouse
ggaaaggccctaacaaactc

SEQ ID NO: 658609 - DNA, 20 bp, mouse
gcacgtcctttgctggaatg

SEQ ID NO: 658610 - DNA, 20 bp, mouse
gtccctagttctgggtacac

SEQ ID NO: 658611 - DNA, 20 bp, mouse
gtcgggcttctagtgtggaa

SEQ ID NO: 658612 - DNA, 20 bp, mouse
gctctgccacattccagcaa

SEQ ID NO: 658613 - DNA, 20 bp, mouse
gaagcatcgggcttctagtg

SEQ ID NO: 658614 - DNA, 20 bp, mouse
gcaagggaatagaatcatct

SEQ ID NO: 658615 - DNA, 20 bp, mouse
gggttcagcctacttatatc

SEQ ID NO: 658616 - DNA, 20 bp, mouse
ggataggctgaggcgttctg

SEQ ID NO: 658617 - DNA, 20 bp, mouse
gctggaatggggctgaagat

SEQ ID NO: 658618 - DNA, 20 bp, mouse
gtcgggacatggaagctgat

SEQ ID NO: 658619 - DNA, 20 bp, mouse
ggggtgtggcttggagtggc

SEQ ID NO: 658620 - DNA, 20 bp, mouse
ggcgctgccgagacaccttc

SEQ ID NO: 658621 - DNA, 20 bp, mouse
gaacgcccgatcttcgtctc

SEQ ID NO: 658622 - DNA, 20 bp, mouse
gaaccatagcgtgattaaac

SEQ ID NO: 658623 - DNA, 20 bp, mouse
gtccgggtctctggagtgtt

SEQ ID NO: 658624 - DNA, 20 bp, mouse
gtggtggatagaagcaaaat

SEQ ID NO: 658625 - DNA, 20 bp, mouse
gagatgggtaatactgggag

SEQ ID NO: 658626 - DNA, 20 bp, mouse
gcactctgcaagaccctagc

SEQ ID NO: 658627 - DNA, 20 bp, mouse
gtccggagctgaaaggggtc

SEQ ID NO: 658628 - DNA, 20 bp, mouse
ggggatgccctctgccgaga

SEQ ID NO: 658629 - DNA, 20 bp, mouse
gcagcttccggagctgaaag

SEQ ID NO: 658630 - DNA, 20 bp, mouse
gcatgacagggtgcgcacgg

SEQ ID NO: 658631 - DNA, 20 bp, mouse
gtgtgcaggggtaaagtggc

SEQ ID NO: 658632 - DNA, 20 bp, mouse
ggggaaaagcaaaaaccctt

SEQ ID NO: 658633 - DNA, 20 bp, mouse
gtgcagagtgaactccatct

SEQ ID NO: 658634 - DNA, 20 bp, mouse
gtcttgctctgctagagcta

SEQ ID NO: 658635 - DNA, 20 bp, mouse
gggtgcgcacgggggtgtgg

SEQ ID NO: 658636 - DNA, 20 bp, mouse
ggggaggcggccgccagagg

SEQ ID NO: 658637 - DNA, 20 bp, mouse
gaggccctgcccctcctccg

SEQ ID NO: 658638 - DNA, 20 bp, mouse
gcccgggaggccacggctaa

SEQ ID NO: 658639 - DNA, 20 bp, mouse
gtgaccttggccacggagga

SEQ ID NO: 658640 - DNA, 20 bp, mouse
gacggctaacggatatgacg

SEQ ID NO: 658641 - DNA, 20 bp, mouse
gcgtggccaaggtcaaggat

SEQ ID NO: 658642 - DNA, 20 bp, mouse
ggaacgtgcccgggaggcca

SEQ ID NO: 658643 - DNA, 20 bp, mouse
gtccccggaacgtgcccggg

SEQ ID NO: 658644 - DNA, 20 bp, mouse
gcgcctcttccccgggaaac

SEQ ID NO: 658645 - DNA, 20 bp, mouse
gcaaggtcaaggatgggcgc

SEQ ID NO: 658646 - DNA, 20 bp, mouse
gcgcaggaggcgaaatagag

SEQ ID NO: 658647 - DNA, 20 bp, mouse
ggagggcgtggcctggaacg

SEQ ID NO: 658648 - DNA, 20 bp, mouse
gagggcttcagctacggggc

SEQ ID NO: 658649 - DNA, 20 bp, mouse
gtggagccacgccccgttcc

SEQ ID NO: 658650 - DNA, 20 bp, mouse
gcgagctccgtgtaacgttg

SEQ ID NO: 658651 - DNA, 20 bp, mouse
gcggggcccgggggcggaac

SEQ ID NO: 658652 - DNA, 20 bp, mouse
gcggcagggcttcagctacg

SEQ ID NO: 658653 - DNA, 20 bp, mouse
gggcccgggggcggaaccgg

SEQ ID NO: 658654 - DNA, 20 bp, mouse
gagaggctcttactagcgga

SEQ ID NO: 658655 - DNA, 20 bp, mouse
gggagaggaacggagcgcag

SEQ ID NO: 658656 - DNA, 20 bp, mouse
gccgctggggcgcggtacgc

SEQ ID NO: 658657 - DNA, 20 bp, mouse
gtggcgggcgcgcgcttcgc

SEQ ID NO: 658658 - DNA, 20 bp, mouse
gtaccgcgccccagcggccg

SEQ ID NO: 658659 - DNA, 20 bp, mouse
gtcgccggctggctcgggga

SEQ ID NO: 658660 - DNA, 20 bp, mouse
gcgcgccccagcggccgggg

SEQ ID NO: 658661 - DNA, 20 bp, mouse
gtcggcgaatggcgctctcg

SEQ ID NO: 658662 - DNA, 20 bp, mouse
gctaggaagtcatccgggcg

SEQ ID NO: 658663 - DNA, 20 bp, mouse
ggaagcgcgcgcccgccagc

SEQ ID NO: 658664 - DNA, 20 bp, mouse
gaaggccagtgtggcacgtg

SEQ ID NO: 658665 - DNA, 20 bp, mouse
ggtgactggcgtaagcttct

SEQ ID NO: 658666 - DNA, 20 bp, mouse
gggcctgcagacagaagcta

SEQ ID NO: 658667 - DNA, 20 bp, mouse
gccgaacgcgatgtggattt

SEQ ID NO: 658668 - DNA, 20 bp, mouse
gccgcacgcagcaagcacct

SEQ ID NO: 658669 - DNA, 20 bp, mouse
gcgtgtgcaggagccagcga

SEQ ID NO: 658670 - DNA, 20 bp, mouse
gccgcccgggtgcggaagaa

SEQ ID NO: 658671 - DNA, 20 bp, mouse
gggcgtgcccatatgggggg

SEQ ID NO: 658672 - DNA, 20 bp, mouse
gtcgttgccgccccccatat

SEQ ID NO: 658673 - DNA, 20 bp, mouse
ggggcctctgctgccaggat

SEQ ID NO: 658674 - DNA, 20 bp, mouse
gagctcccgaaatggcgcgg

SEQ ID NO: 658675 - DNA, 20 bp, mouse
ggggcacgccgaacgcgatg

SEQ ID NO: 658676 - DNA, 20 bp, mouse
gaaaagggatcgggagactc

SEQ ID NO: 658677 - DNA, 20 bp, mouse
ggagctgaaaacacggaaaa

SEQ ID NO: 658678 - DNA, 20 bp, mouse
gagtgggtggggcttagacg

SEQ ID NO: 658679 - DNA, 20 bp, mouse
gtgccttggcggagtgggtg

SEQ ID NO: 658680 - DNA, 20 bp, mouse
gaaaacacggaaaagggatc

SEQ ID NO: 658681 - DNA, 20 bp, mouse
gagaaggagcgcggagctct

SEQ ID NO: 658682 - DNA, 20 bp, mouse
gtgcgcctgcgcatggggtg

SEQ ID NO: 658683 - DNA, 20 bp, mouse
ggggcggaactggtgagtag

SEQ ID NO: 658684 - DNA, 20 bp, mouse
ggggcttatgaggagggata

SEQ ID NO: 658685 - DNA, 20 bp, mouse
gcggctgggcggatagggcg

SEQ ID NO: 658686 - DNA, 20 bp, mouse
gcccgagcctgcctggtcac

SEQ ID NO: 658687 - DNA, 20 bp, mouse
gccgcgggcacgccagggtg

SEQ ID NO: 658688 - DNA, 20 bp, mouse
gaggccgtgcggccaaacaa

SEQ ID NO: 658689 - DNA, 20 bp, mouse
gtcagcggcgcccgtggtga

SEQ ID NO: 658690 - DNA, 20 bp, mouse
ggggtgcagcccgtgagaag

SEQ ID NO: 658691 - DNA, 20 bp, mouse
gttcacagcaaggacgaagt

SEQ ID NO: 658692 - DNA, 20 bp, mouse
ggaccaggcaggctcgggag

SEQ ID NO: 658693 - DNA, 20 bp, mouse
gcgtccttgctgtgaaccgt

SEQ ID NO: 658694 - DNA, 20 bp, mouse
gcgcagccgcgggcacgcca

SEQ ID NO: 658695 - DNA, 20 bp, mouse
gggggcagggtcccccaccc

SEQ ID NO: 658696 - DNA, 20 bp, mouse
ggcggggcgggaccttggga

SEQ ID NO: 658697 - DNA, 20 bp, mouse
gcggcggccgccaagttctc

SEQ ID NO: 658698 - DNA, 20 bp, mouse
ggagctccgccctgagtcat

SEQ ID NO: 658699 - DNA, 20 bp, mouse
gggaccttgggagggatcgg

SEQ ID NO: 658700 - DNA, 20 bp, mouse
gacacacacaggacagggat

SEQ ID NO: 658701 - DNA, 20 bp, mouse
ggggaccagaagtttctagc

SEQ ID NO: 658702 - DNA, 20 bp, mouse
gtagctgccaaaggggaagg

SEQ ID NO: 658703 - DNA, 20 bp, mouse
ggggtagtctaggagaagga

SEQ ID NO: 658704 - DNA, 20 bp, mouse
gcccacgcggcacgaaagag

SEQ ID NO: 658705 - DNA, 20 bp, mouse
gtggtcccatccagagaact

SEQ ID NO: 658706 - DNA, 20 bp, mouse
gggtcgggaaagcgaggcga

SEQ ID NO: 658707 - DNA, 20 bp, mouse
ggaacggtcatggacggtac

SEQ ID NO: 658708 - DNA, 20 bp, mouse
gtcaatccgggcctcgggtc

SEQ ID NO: 658709 - DNA, 20 bp, mouse
gagcgcggaacggtcatgga

SEQ ID NO: 658710 - DNA, 20 bp, mouse
ggccgagcgcggaacggtca

SEQ ID NO: 658711 - DNA, 20 bp, mouse
ggaagtccaggtcggaaggg

SEQ ID NO: 658712 - DNA, 20 bp, mouse
gcaaggggcgggaccggctc

SEQ ID NO: 658713 - DNA, 20 bp, mouse
gggacggtacgggtcaatcc

SEQ ID NO: 658714 - DNA, 20 bp, mouse
gggcgggaccggctcgggat

SEQ ID NO: 658715 - DNA, 20 bp, mouse
gttcactgcactgactggag

SEQ ID NO: 658716 - DNA, 20 bp, mouse
gccgcccggcgtccgtccca

SEQ ID NO: 658717 - DNA, 20 bp, mouse
gtacggcaggatcgcgacag

SEQ ID NO: 658718 - DNA, 20 bp, mouse
ggccgccgccggagaaggac

SEQ ID NO: 658719 - DNA, 20 bp, mouse
gcaggatcgcgacagtggaa

SEQ ID NO: 658720 - DNA, 20 bp, mouse
gcggaagcagagcgcttcgc

SEQ ID NO: 658721 - DNA, 20 bp, mouse
gcgggtaagcgggacgccgg

SEQ ID NO: 658722 - DNA, 20 bp, mouse
gggagaggtgcaggcggcgt

SEQ ID NO: 658723 - DNA, 20 bp, mouse
gcctcgccgcgcgtcggctc

SEQ ID NO: 658724 - DNA, 20 bp, mouse
gggtcggcctcgccgcgcgt

SEQ ID NO: 658725 - DNA, 20 bp, mouse
gccgaccgtgcgcattccct

SEQ ID NO: 658726 - DNA, 20 bp, mouse
gcgccagagtgcaaccggac

SEQ ID NO: 658727 - DNA, 20 bp, mouse
ggtcccccgggcgacgacgg

SEQ ID NO: 658728 - DNA, 20 bp, mouse
gaggcgcagtgcggtccccc

SEQ ID NO: 658729 - DNA, 20 bp, mouse
ggggcccgggccggccgaga

SEQ ID NO: 658730 - DNA, 20 bp, mouse
ggagtgcaaccggaccgggg

SEQ ID NO: 658731 - DNA, 20 bp, mouse
gcccccagaaactcactgtt

SEQ ID NO: 658732 - DNA, 20 bp, mouse
gccccacgaaagtaaatcgg

SEQ ID NO: 658733 - DNA, 20 bp, mouse
gaacgcacatagccggaggg

SEQ ID NO: 658734 - DNA, 20 bp, mouse
ggggaagaaacgcacatagc

SEQ ID NO: 658735 - DNA, 20 bp, mouse
gcccgccaggaactagagtc

SEQ ID NO: 658736 - DNA, 20 bp, mouse
gggcccggcgccagcctatt

SEQ ID NO: 658737 - DNA, 20 bp, mouse
gaaggagctgcgcagtcgct

SEQ ID NO: 658738 - DNA, 20 bp, mouse
gcgtaaacaggcctcccaat

SEQ ID NO: 658739 - DNA, 20 bp, mouse
gggccagggagctgccaatc

SEQ ID NO: 658740 - DNA, 20 bp, mouse
gagccctgctgctccctgat

SEQ ID NO: 658741 - DNA, 20 bp, mouse
ggagctagggatagtgagaa

SEQ ID NO: 658742 - DNA, 20 bp, mouse
gacgagctcagggccgtgga

SEQ ID NO: 658743 - DNA, 20 bp, mouse
gcagtcgctgggcttgaatt

SEQ ID NO: 658744 - DNA, 20 bp, mouse
gaacgggtgtccgtgtccag

SEQ ID NO: 658745 - DNA, 20 bp, mouse
gtgccaatcagggagcagca

SEQ ID NO: 658746 - DNA, 20 bp, mouse
ggcagggcggggcggctgat

SEQ ID NO: 658747 - DNA, 20 bp, mouse
gggggagccgagggccggat

SEQ ID NO: 658748 - DNA, 20 bp, mouse
gcggggcgggcggacggcta

SEQ ID NO: 658749 - DNA, 20 bp, mouse
gaggcggtgcggggagtggt

SEQ ID NO: 658750 - DNA, 20 bp, mouse
gctggccccgccagccaatc

SEQ ID NO: 658751 - DNA, 20 bp, mouse
gtcgtgctgccccctgcgtc

SEQ ID NO: 658752 - DNA, 20 bp, mouse
gggctggcggggccagcgca

SEQ ID NO: 658753 - DNA, 20 bp, mouse
ggattggcggagcttgccga

SEQ ID NO: 658754 - DNA, 20 bp, mouse
gaccgacccacgattctgat

SEQ ID NO: 658755 - DNA, 20 bp, mouse
gacccacgattctgattggt

SEQ ID NO: 658756 - DNA, 20 bp, mouse
gtaggtagaggctgtcggga

SEQ ID NO: 658757 - DNA, 20 bp, mouse
gccaccgaccctgaccctga

SEQ ID NO: 658758 - DNA, 20 bp, mouse
ggaattgcggaggcgggtga

SEQ ID NO: 658759 - DNA, 20 bp, mouse
gagggtcggtggaattgcgg

SEQ ID NO: 658760 - DNA, 20 bp, mouse
gtgtcgggagggttgatgga

SEQ ID NO: 658761 - DNA, 20 bp, mouse
gcaggtagccatcagggtca

SEQ ID NO: 658762 - DNA, 20 bp, mouse
ggtcagggtcggtggaattg

SEQ ID NO: 658763 - DNA, 20 bp, mouse
gaatgtaggtagaggctgtc

SEQ ID NO: 658764 - DNA, 20 bp, mouse
gggcaggtgaatgtaggtag

SEQ ID NO: 658765 - DNA, 20 bp, mouse
gggaaggatgatgcatgcat

SEQ ID NO: 658766 - DNA, 20 bp, mouse
gccggcgcgggagaagccca

SEQ ID NO: 658767 - DNA, 20 bp, mouse
gcgcgccgcctcctgttaaa

SEQ ID NO: 658768 - DNA, 20 bp, mouse
gcaggcgccgcgtcccgcct

SEQ ID NO: 658769 - DNA, 20 bp, mouse
gcaccggcgatcagaggctg

SEQ ID NO: 658770 - DNA, 20 bp, mouse
gccaccgaaccggattcctc

SEQ ID NO: 658771 - DNA, 20 bp, mouse
gcgcgcgccgggccgagtga

SEQ ID NO: 658772 - DNA, 20 bp, mouse
gcggagcggccggaggaatc

SEQ ID NO: 658773 - DNA, 20 bp, mouse
gagggcgcgcttggctcggc

SEQ ID NO: 658774 - DNA, 20 bp, mouse
gggagccgcgggagaagggg

SEQ ID NO: 658775 - DNA, 20 bp, mouse
ggccacccgcgaataggagg

SEQ ID NO: 658776 - DNA, 20 bp, mouse
gtgggtgcgcgcgtccccgg

SEQ ID NO: 658777 - DNA, 20 bp, mouse
gctcccgcgcgcgtgctcgt

SEQ ID NO: 658778 - DNA, 20 bp, mouse
ggggaggccggactctggtc

SEQ ID NO: 658779 - DNA, 20 bp, mouse
gcacccacgagcacgcgcgc

SEQ ID NO: 658780 - DNA, 20 bp, mouse
gcgggagggttgcccagcgg

SEQ ID NO: 658781 - DNA, 20 bp, mouse
ggcgcgggagggttgcccag

SEQ ID NO: 658782 - DNA, 20 bp, mouse
gtccccgggctgcgcgcgaa

SEQ ID NO: 658783 - DNA, 20 bp, mouse
gctgcgcccggaccagagtc

SEQ ID NO: 658784 - DNA, 20 bp, mouse
gcgcggcgctcgctctcccc

SEQ ID NO: 658785 - DNA, 20 bp, mouse
gggcgggcgcgggctcctcg

SEQ ID NO: 658786 - DNA, 20 bp, mouse
gcctgcgccgtcttttctat

SEQ ID NO: 658787 - DNA, 20 bp, mouse
gagctagaggagggactcgg

SEQ ID NO: 658788 - DNA, 20 bp, mouse
gcggaggcggggtttttgtg

SEQ ID NO: 658789 - DNA, 20 bp, mouse
ggggcgaagggcggagctag

SEQ ID NO: 658790 - DNA, 20 bp, mouse
ggcgcccggatcaccgcccc

SEQ ID NO: 658791 - DNA, 20 bp, mouse
gagaaaagacggcgcaggag

SEQ ID NO: 658792 - DNA, 20 bp, mouse
gactcctgagggacccttga

SEQ ID NO: 658793 - DNA, 20 bp, mouse
gcgtggaggcggcactcggg

SEQ ID NO: 658794 - DNA, 20 bp, mouse
gccctgtcgcgcactcctga

SEQ ID NO: 658795 - DNA, 20 bp, mouse
gggcgggggcggacagccgg

SEQ ID NO: 658796 - DNA, 20 bp, mouse
ggccccgcccacctcaggtg

SEQ ID NO: 658797 - DNA, 20 bp, mouse
ggggccgtacggccagaggg

SEQ ID NO: 658798 - DNA, 20 bp, mouse
gcgcgcggagacagcctggt

SEQ ID NO: 658799 - DNA, 20 bp, mouse
gggcctaggggcttgctaag

SEQ ID NO: 658800 - DNA, 20 bp, mouse
gtactctagagtgggcgggg

SEQ ID NO: 658801 - DNA, 20 bp, mouse
gtgggagggtcgatcttttg

SEQ ID NO: 658802 - DNA, 20 bp, mouse
gcagctggggccaatcagtc

SEQ ID NO: 658803 - DNA, 20 bp, mouse
gctgaggcaggcaagggaat

SEQ ID NO: 658804 - DNA, 20 bp, mouse
ggagtactctagagtgggcg

SEQ ID NO: 658805 - DNA, 20 bp, mouse
ggcctcgcgcggagacagcc

SEQ ID NO: 658806 - DNA, 20 bp, mouse
gtaaccagaccctgcgggaa

SEQ ID NO: 658807 - DNA, 20 bp, mouse
ggggatgtcgatgtgatctg

SEQ ID NO: 658808 - DNA, 20 bp, mouse
ggcgtggggccttgggtagg

SEQ ID NO: 658809 - DNA, 20 bp, mouse
gggggcgtaaccagaccctg

SEQ ID NO: 658810 - DNA, 20 bp, mouse
gcctctgggcgtggactggt

SEQ ID NO: 658811 - DNA, 20 bp, mouse
gtacccaaggccccacgcct

SEQ ID NO: 658812 - DNA, 20 bp, mouse
gaggagcctgcctgcgtcac

SEQ ID NO: 658813 - DNA, 20 bp, mouse
gttaccctctgggcgtggac

SEQ ID NO: 658814 - DNA, 20 bp, mouse
gagggtgggcagggccatat

SEQ ID NO: 658815 - DNA, 20 bp, mouse
gtgggacccaacaccttgaa

SEQ ID NO: 658816 - DNA, 20 bp, mouse
gtccctcggggcaggagaag

SEQ ID NO: 658817 - DNA, 20 bp, mouse
ggcccagagcagggtctctc

SEQ ID NO: 658818 - DNA, 20 bp, mouse
gagaccctgctctgggcaca

SEQ ID NO: 658819 - DNA, 20 bp, mouse
gtacaggtgggtgcagggac

SEQ ID NO: 658820 - DNA, 20 bp, mouse
gcccccttctcctgccccga

SEQ ID NO: 658821 - DNA, 20 bp, mouse
gtaacctacaggtgggtgca

SEQ ID NO: 658822 - DNA, 20 bp, mouse
gtctctggccactaccgtgc

SEQ ID NO: 658823 - DNA, 20 bp, mouse
gggctcagtaacctacaggt

SEQ ID NO: 658824 - DNA, 20 bp, mouse
gagggggccttaggagaagt

SEQ ID NO: 658825 - DNA, 20 bp, mouse
ggtcacggggtctccttccc

SEQ ID NO: 658826 - DNA, 20 bp, mouse
gtaggggaaggtcctcggcc

SEQ ID NO: 658827 - DNA, 20 bp, mouse
ggaggctgctgcttagggga

SEQ ID NO: 658828 - DNA, 20 bp, mouse
gtccctctagaggaagttct

SEQ ID NO: 658829 - DNA, 20 bp, mouse
gctcagggaggctgctgctt

SEQ ID NO: 658830 - DNA, 20 bp, mouse
gctgcttaggggaaggtcct

SEQ ID NO: 658831 - DNA, 20 bp, mouse
gcggatgcaggcgctcaggg

SEQ ID NO: 658832 - DNA, 20 bp, mouse
gcctgccctgtcccagccaa

SEQ ID NO: 658833 - DNA, 20 bp, mouse
gtggctgaaggcagataggg

SEQ ID NO: 658834 - DNA, 20 bp, mouse
gctctagaggaagttctcgg

SEQ ID NO: 658835 - DNA, 20 bp, mouse
gaacagaacgcttttcccct

SEQ ID NO: 658836 - DNA, 20 bp, mouse
gcggggccagacgcgggcta

SEQ ID NO: 658837 - DNA, 20 bp, mouse
ggcgctggcaagtagcactg

SEQ ID NO: 658838 - DNA, 20 bp, mouse
gttcgcgcaggcgttcgcta

SEQ ID NO: 658839 - DNA, 20 bp, mouse
gagcgcccggcgcccagagt

SEQ ID NO: 658840 - DNA, 20 bp, mouse
gccccagggcccagccgcag

SEQ ID NO: 658841 - DNA, 20 bp, mouse
ggcaagtagcactgtggaca

SEQ ID NO: 658842 - DNA, 20 bp, mouse
gctaaggcagacaagccgcc

SEQ ID NO: 658843 - DNA, 20 bp, mouse
ggcgctctgcgacgcatatg

SEQ ID NO: 658844 - DNA, 20 bp, mouse
gccccctgcggctgggccct

SEQ ID NO: 658845 - DNA, 20 bp, mouse
ggccgggctcccgctggcgc

SEQ ID NO: 658846 - DNA, 20 bp, mouse
gccagccgcggcgcccacgg

SEQ ID NO: 658847 - DNA, 20 bp, mouse
gatggcttcttgagaggaac

SEQ ID NO: 658848 - DNA, 20 bp, mouse
gcagcggcccttccggtctg

SEQ ID NO: 658849 - DNA, 20 bp, mouse
gcacgggggtcgctgttttc

SEQ ID NO: 658850 - DNA, 20 bp, mouse
ggaaaacgcattctcctcgg

SEQ ID NO: 658851 - DNA, 20 bp, mouse
gtaaagggacggacgaagag

SEQ ID NO: 658852 - DNA, 20 bp, mouse
gtgccccgcactcggaactt

SEQ ID NO: 658853 - DNA, 20 bp, mouse
gtcgatcccacagaccggaa

SEQ ID NO: 658854 - DNA, 20 bp, mouse
gcgattgcgcgtcaactcta

SEQ ID NO: 658855 - DNA, 20 bp, mouse
gaaagccatcgaaagccgga

SEQ ID NO: 658856 - DNA, 20 bp, mouse
gccctcctgtcctaccctgt

SEQ ID NO: 658857 - DNA, 20 bp, mouse
gatgtcacacctggtctcac

SEQ ID NO: 658858 - DNA, 20 bp, mouse
gcacaggctggcgatctaca

SEQ ID NO: 658859 - DNA, 20 bp, mouse
gagaaagtgtgacaagttga

SEQ ID NO: 658860 - DNA, 20 bp, mouse
gtgagccaacagggtaggac

SEQ ID NO: 658861 - DNA, 20 bp, mouse
ggccaacagggtaggacagg

SEQ ID NO: 658862 - DNA, 20 bp, mouse
ggtgtggtcaaggattagaa

SEQ ID NO: 658863 - DNA, 20 bp, mouse
ggtacacattagtcagttgg

SEQ ID NO: 658864 - DNA, 20 bp, mouse
gtggacagtgcatattgcag

SEQ ID NO: 658865 - DNA, 20 bp, mouse
gcagtcccaagaccctgaat

SEQ ID NO: 658866 - DNA, 20 bp, mouse
gggctcaggccgcaaggcta

SEQ ID NO: 658867 - DNA, 20 bp, mouse
ggggggaagtgaaattgctc

SEQ ID NO: 658868 - DNA, 20 bp, mouse
gaaatgcagcccaggggctc

SEQ ID NO: 658869 - DNA, 20 bp, mouse
gcccaggggctcaggccgca

SEQ ID NO: 658870 - DNA, 20 bp, mouse
gaggcctaaccctagccttg

SEQ ID NO: 658871 - DNA, 20 bp, mouse
gttgccggaaatgcagccca

SEQ ID NO: 658872 - DNA, 20 bp, mouse
gagtttgagagagctgtctt

SEQ ID NO: 658873 - DNA, 20 bp, mouse
ggggccacaatccccagagt

SEQ ID NO: 658874 - DNA, 20 bp, mouse
gctgcagggccacagaccat

SEQ ID NO: 658875 - DNA, 20 bp, mouse
gcggaactaaaggtctgcag

SEQ ID NO: 658876 - DNA, 20 bp, mouse
gtcaactctcggagcagggg

SEQ ID NO: 658877 - DNA, 20 bp, mouse
ggggcggggccggtcgggaa

SEQ ID NO: 658878 - DNA, 20 bp, mouse
ggacaactgcgcatgctcgt

SEQ ID NO: 658879 - DNA, 20 bp, mouse
gccctgggctcccggctcaa

SEQ ID NO: 658880 - DNA, 20 bp, mouse
gcgccagaggcgcccagagc

SEQ ID NO: 658881 - DNA, 20 bp, mouse
gtgcgccccgccctcagcgc

SEQ ID NO: 658882 - DNA, 20 bp, mouse
ggagtcaactctcggagcag

SEQ ID NO: 658883 - DNA, 20 bp, mouse
gtgggctcccggctcaaggg

SEQ ID NO: 658884 - DNA, 20 bp, mouse
gacgtgagatggggaagtaa

SEQ ID NO: 658885 - DNA, 20 bp, mouse
gcgccgcgagcgcctcccca

SEQ ID NO: 658886 - DNA, 20 bp, mouse
gcgcgcgcgcgtcgaggcga

SEQ ID NO: 658887 - DNA, 20 bp, mouse
gcgagggcgcgcacgtgcgg

SEQ ID NO: 658888 - DNA, 20 bp, mouse
gccgcccggcaagggagccc

SEQ ID NO: 658889 - DNA, 20 bp, mouse
gaaggaggcgagcgtgctga

SEQ ID NO: 658890 - DNA, 20 bp, mouse
gccctcggcgacagctgggt

SEQ ID NO: 658891 - DNA, 20 bp, mouse
gaggcgagggcgcgcacgtg

SEQ ID NO: 658892 - DNA, 20 bp, mouse
gtgcacgcgcgcgcgcgtcg

SEQ ID NO: 658893 - DNA, 20 bp, mouse
gctcccttgccgggcggctg

SEQ ID NO: 658894 - DNA, 20 bp, mouse
gtccgccggccgaacggcgg

SEQ ID NO: 658895 - DNA, 20 bp, mouse
gcgccacagccgcccggcaa

SEQ ID NO: 658896 - DNA, 20 bp, mouse
gccaaggcgcggggttgagg

SEQ ID NO: 658897 - DNA, 20 bp, mouse
gcacgccctcaggaggtgta

SEQ ID NO: 658898 - DNA, 20 bp, mouse
ggggagccccgcctctttga

SEQ ID NO: 658899 - DNA, 20 bp, mouse
gcgcggggttgaggaggcgt

SEQ ID NO: 658900 - DNA, 20 bp, mouse
gaagaggcggggctccccat

SEQ ID NO: 658901 - DNA, 20 bp, mouse
ggtgccaaggcgcggggttg

SEQ ID NO: 658902 - DNA, 20 bp, mouse
ggccctcaggaggtgtaggg

SEQ ID NO: 658903 - DNA, 20 bp, mouse
gcttgagaggccacgccctc

SEQ ID NO: 658904 - DNA, 20 bp, mouse
ggtccgccctacacctcctg

SEQ ID NO: 658905 - DNA, 20 bp, mouse
gaccccgcgccttggcactt

SEQ ID NO: 658906 - DNA, 20 bp, mouse
gccagcccgcagctaggggc

SEQ ID NO: 658907 - DNA, 20 bp, mouse
gagcctgtgggcaccttgga

SEQ ID NO: 658908 - DNA, 20 bp, mouse
gaacggcccgaggatccctt

SEQ ID NO: 658909 - DNA, 20 bp, mouse
gtgggagtgtcaggaggaat

SEQ ID NO: 658910 - DNA, 20 bp, mouse
gggccccggccggttgctat

SEQ ID NO: 658911 - DNA, 20 bp, mouse
gacaggttgcagcttggcta

SEQ ID NO: 658912 - DNA, 20 bp, mouse
gggcggggctgcccgctcgg

SEQ ID NO: 658913 - DNA, 20 bp, mouse
gtggatgtaatgcgcagagg

SEQ ID NO: 658914 - DNA, 20 bp, mouse
gcaagcaaggggtccccctt

SEQ ID NO: 658915 - DNA, 20 bp, mouse
gcctagctgcgggctggcat

SEQ ID NO: 658916 - DNA, 20 bp, mouse
gagtacccggccagggagat

SEQ ID NO: 658917 - DNA, 20 bp, mouse
gccggcgtgccgggagccaa

SEQ ID NO: 658918 - DNA, 20 bp, mouse
gtggccaggagcgcgcccat

SEQ ID NO: 658919 - DNA, 20 bp, mouse
gaggcgcgctgctgacgggc

SEQ ID NO: 658920 - DNA, 20 bp, mouse
gtggcgcgcagcggccaatg

SEQ ID NO: 658921 - DNA, 20 bp, mouse
gctgcgggcgcaccgaggtt

SEQ ID NO: 658922 - DNA, 20 bp, mouse
gaaaagagcagcggggttcg

SEQ ID NO: 658923 - DNA, 20 bp, mouse
gcctactccaggggtccaag

SEQ ID NO: 658924 - DNA, 20 bp, mouse
gagcccaacgcctactccag

SEQ ID NO: 658925 - DNA, 20 bp, mouse
ggacccctggagtaggcgtt

SEQ ID NO: 658926 - DNA, 20 bp, mouse
ggggaaagagcccgggatag

SEQ ID NO: 658927 - DNA, 20 bp, mouse
ggctcgcaggccgggaccaa

SEQ ID NO: 658928 - DNA, 20 bp, mouse
ggcccgggataggggctcgc

SEQ ID NO: 658929 - DNA, 20 bp, mouse
gactaggcccagccggaggg

SEQ ID NO: 658930 - DNA, 20 bp, mouse
ggggctcggccagtcggacc

SEQ ID NO: 658931 - DNA, 20 bp, mouse
gacccactaggcccagccgg

SEQ ID NO: 658932 - DNA, 20 bp, mouse
ggcctgcgagcccctatccc

SEQ ID NO: 658933 - DNA, 20 bp, mouse
gggggcaaggcagtgacgcg

SEQ ID NO: 658934 - DNA, 20 bp, mouse
gcggggcggggacgcagtcc

SEQ ID NO: 658935 - DNA, 20 bp, mouse
gtccgcagtgtcctatcctc

SEQ ID NO: 658936 - DNA, 20 bp, mouse
ggggaggcagcgggcaagag

SEQ ID NO: 658937 - DNA, 20 bp, mouse
gagcgcgagccgaggggcgt

SEQ ID NO: 658938 - DNA, 20 bp, mouse
gccgcccctgcgcgcccgtg

SEQ ID NO: 658939 - DNA, 20 bp, mouse
ggtcagcaccccagccgcac

SEQ ID NO: 658940 - DNA, 20 bp, mouse
gcgctcgactctcggatcgg

SEQ ID NO: 658941 - DNA, 20 bp, mouse
gtcggatcggcgggaggcag

SEQ ID NO: 658942 - DNA, 20 bp, mouse
gggcgcgcgcctccttctcc

SEQ ID NO: 658943 - DNA, 20 bp, mouse
ggagcgctcgactctcggat

SEQ ID NO: 658944 - DNA, 20 bp, mouse
gggtcggacccggggtgcgc

SEQ ID NO: 658945 - DNA, 20 bp, mouse
gggcccagcggggacaagtg

SEQ ID NO: 658946 - DNA, 20 bp, mouse
gggcgcgaaaggagcgggag

SEQ ID NO: 658947 - DNA, 20 bp, mouse
gtggcggggcgcgaaaggag

SEQ ID NO: 658948 - DNA, 20 bp, mouse
gcgcgccccgccacccagga

SEQ ID NO: 658949 - DNA, 20 bp, mouse
gaaaggagcgggaggggtgc

SEQ ID NO: 658950 - DNA, 20 bp, mouse
gggaccccctcctgggtggc

SEQ ID NO: 658951 - DNA, 20 bp, mouse
gcgggaggggtgcgggccgc

SEQ ID NO: 658952 - DNA, 20 bp, mouse
gactgtgcgggtgtggtgac

SEQ ID NO: 658953 - DNA, 20 bp, mouse
ggggctgacagagactgttg

SEQ ID NO: 658954 - DNA, 20 bp, mouse
gggggggggcgctggatcac

SEQ ID NO: 658955 - DNA, 20 bp, mouse
gctggatcacggggcgtctc

SEQ ID NO: 658956 - DNA, 20 bp, mouse
gtgcctgccggaagatactg

SEQ ID NO: 658957 - DNA, 20 bp, mouse
gttccggcaggcagtttgaa

SEQ ID NO: 658958 - DNA, 20 bp, mouse
gaagctggaagtcacatggg

SEQ ID NO: 658959 - DNA, 20 bp, mouse
gacaaacccccagtatcttc

SEQ ID NO: 658960 - DNA, 20 bp, mouse
gacccccagtatcttccggc

SEQ ID NO: 658961 - DNA, 20 bp, mouse
gagagagaaaatacacatct

SEQ ID NO: 658962 - DNA, 20 bp, mouse
gtaccagaaaccacaagaga

SEQ ID NO: 658963 - DNA, 20 bp, mouse
gtgcctttcaaactgcctgc

SEQ ID NO: 658964 - DNA, 20 bp, mouse
ggggctagctgagagtctcg

SEQ ID NO: 658965 - DNA, 20 bp, mouse
ggcccaccgaactgtcctat

SEQ ID NO: 658966 - DNA, 20 bp, mouse
gcgtgagcgagcaagagcca

SEQ ID NO: 658967 - DNA, 20 bp, mouse
gcgctcacgctcactcacgt

SEQ ID NO: 658968 - DNA, 20 bp, mouse
ggagaaggggcctaaccgga

SEQ ID NO: 658969 - DNA, 20 bp, mouse
gctgggcagcccatggtttt

SEQ ID NO: 658970 - DNA, 20 bp, mouse
gatgggctgcccagaatccc

SEQ ID NO: 658971 - DNA, 20 bp, mouse
gtctagagaaggggcctaac

SEQ ID NO: 658972 - DNA, 20 bp, mouse
gtagaggaaaagcggggttg

SEQ ID NO: 658973 - DNA, 20 bp, mouse
gtcacgctcactcacgtggg

SEQ ID NO: 658974 - DNA, 20 bp, mouse
gcaagaccgtatcctggaga

SEQ ID NO: 658975 - DNA, 20 bp, mouse
gggaggggacagctgctgag

SEQ ID NO: 658976 - DNA, 20 bp, mouse
gggccatgctaaggtcccat

SEQ ID NO: 658977 - DNA, 20 bp, mouse
gctcacacattcaaaggtct

SEQ ID NO: 658978 - DNA, 20 bp, mouse
gagggcgaattctgatgggg

SEQ ID NO: 658979 - DNA, 20 bp, mouse
ggtctgggcaggccatgcta

SEQ ID NO: 658980 - DNA, 20 bp, mouse
ggggagggcgaattctgatg

SEQ ID NO: 658981 - DNA, 20 bp, mouse
gcggggggagcggcaaagag

SEQ ID NO: 658982 - DNA, 20 bp, mouse
gagcccatgggaccttagca

SEQ ID NO: 658983 - DNA, 20 bp, mouse
gggcgtctggtccagtggga

SEQ ID NO: 658984 - DNA, 20 bp, mouse
gtccatcctcacacattcaa

SEQ ID NO: 658985 - DNA, 20 bp, mouse
gtgaggatggacttcaagcg

SEQ ID NO: 658986 - DNA, 20 bp, mouse
gttgcggggcacccacgtga

SEQ ID NO: 658987 - DNA, 20 bp, mouse
ggggcggaggccatgttgcg

SEQ ID NO: 658988 - DNA, 20 bp, mouse
gtgggcatcagttcggatta

SEQ ID NO: 658989 - DNA, 20 bp, mouse
gtcttcttcccatagattca

SEQ ID NO: 658990 - DNA, 20 bp, mouse
ggggatgacaagcatatccc

SEQ ID NO: 658991 - DNA, 20 bp, mouse
ggggggaaacaaccaactct

SEQ ID NO: 658992 - DNA, 20 bp, mouse
gccaactctgggcatcagtt

SEQ ID NO: 658993 - DNA, 20 bp, mouse
gtggacgtgcggccctcacg

SEQ ID NO: 658994 - DNA, 20 bp, mouse
ggtgactgatcgtggacgtg

SEQ ID NO: 658995 - DNA, 20 bp, mouse
ggctctctaccatgaatcta

SEQ ID NO: 658996 - DNA, 20 bp, mouse
gtggccgataatctcaaaca

SEQ ID NO: 658997 - DNA, 20 bp, mouse
ggcttctgattcctcacgag

SEQ ID NO: 658998 - DNA, 20 bp, mouse
gaatggagcaacccctcgtg

SEQ ID NO: 658999 - DNA, 20 bp, mouse
gtacagcctgtcactgatac

SEQ ID NO: 659000 - DNA, 20 bp, mouse
ggcgctttccccagatcttc

SEQ ID NO: 659001 - DNA, 20 bp, mouse
gcagctattgagttgaaaag

SEQ ID NO: 659002 - DNA, 20 bp, mouse
gctagtgttccttaaacaca

SEQ ID NO: 659003 - DNA, 20 bp, mouse
gttatcggccagaagatctg

SEQ ID NO: 659004 - DNA, 20 bp, mouse
gctgggcgctggtggcccat

SEQ ID NO: 659005 - DNA, 20 bp, mouse
gccgataatctcaaacatgg

SEQ ID NO: 659006 - DNA, 20 bp, mouse
ggcgctgcaactcaacttcg

SEQ ID NO: 659007 - DNA, 20 bp, mouse
gaggtcgagtcccgccccct

SEQ ID NO: 659008 - DNA, 20 bp, mouse
gaggcccgcacgcccgtccc

SEQ ID NO: 659009 - DNA, 20 bp, mouse
gggcagtctgaaaaggtgaa

SEQ ID NO: 659010 - DNA, 20 bp, mouse
gtctccgtggcgccctgggg

SEQ ID NO: 659011 - DNA, 20 bp, mouse
gagcagagggcagtctgaaa

SEQ ID NO: 659012 - DNA, 20 bp, mouse
gttgagttgcagcgcagcag

SEQ ID NO: 659013 - DNA, 20 bp, mouse
gcgggcgtgcgggcctccag

SEQ ID NO: 659014 - DNA, 20 bp, mouse
gtatcggagcctccgcccca

SEQ ID NO: 659015 - DNA, 20 bp, mouse
gaaaagcggaagactcaaag

SEQ ID NO: 659016 - DNA, 20 bp, mouse
ggcgtagttggggacagcgg

SEQ ID NO: 659017 - DNA, 20 bp, mouse
ggacagcggtgggtctgaac

SEQ ID NO: 659018 - DNA, 20 bp, mouse
gtacagctgtagtacggata

SEQ ID NO: 659019 - DNA, 20 bp, mouse
ggaggacgagcgctcaggga

SEQ ID NO: 659020 - DNA, 20 bp, mouse
ggggtgaggacgagcgctca

SEQ ID NO: 659021 - DNA, 20 bp, mouse
ggggtcgtgaggctgatgca

SEQ ID NO: 659022 - DNA, 20 bp, mouse
ggtggaggccatccgtaaca

SEQ ID NO: 659023 - DNA, 20 bp, mouse
gaaaggggcaggagccaccc

SEQ ID NO: 659024 - DNA, 20 bp, mouse
gtcagggacggctgtcgcga

SEQ ID NO: 659025 - DNA, 20 bp, mouse
gggggggggcggcgcttaaa

SEQ ID NO: 659026 - DNA, 20 bp, mouse
gaagaagcagccccctccct

SEQ ID NO: 659027 - DNA, 20 bp, mouse
gagggcgcaaggcgatctca

SEQ ID NO: 659028 - DNA, 20 bp, mouse
gcaagtgacgtcaaccaaca

SEQ ID NO: 659029 - DNA, 20 bp, mouse
gtgaaagttgctgttaacaa

SEQ ID NO: 659030 - DNA, 20 bp, mouse
gctgataggtcatttattat

SEQ ID NO: 659031 - DNA, 20 bp, mouse
gcagcttcacttctaggcga

SEQ ID NO: 659032 - DNA, 20 bp, mouse
gagtttcttaactttttctt

SEQ ID NO: 659033 - DNA, 20 bp, mouse
gttaactttttcttgggacg

SEQ ID NO: 659034 - DNA, 20 bp, mouse
gaaacttaaacggactgtta

SEQ ID NO: 659035 - DNA, 20 bp, mouse
gggctccttttagagctgat

SEQ ID NO: 659036 - DNA, 20 bp, mouse
gcgcggctggggacaagtcg

SEQ ID NO: 659037 - DNA, 20 bp, mouse
gaaaccccccgcgccgaggt

SEQ ID NO: 659038 - DNA, 20 bp, mouse
ggggccctggcgtcacgcgg

SEQ ID NO: 659039 - DNA, 20 bp, mouse
gtggggacagcccagaccta

SEQ ID NO: 659040 - DNA, 20 bp, mouse
gtgtccggacaccctaggtc

SEQ ID NO: 659041 - DNA, 20 bp, mouse
ggacgccagggccccgcccg

SEQ ID NO: 659042 - DNA, 20 bp, mouse
gacaagtcggggcttgcagt

SEQ ID NO: 659043 - DNA, 20 bp, mouse
gccgcccccgcgtgacgcca

SEQ ID NO: 659044 - DNA, 20 bp, mouse
gtactcctcaggtgtgggtg

SEQ ID NO: 659045 - DNA, 20 bp, mouse
gcaggcaggaggagcagcgt

SEQ ID NO: 659046 - DNA, 20 bp, mouse
gagaccgcgcactgccgcgg

SEQ ID NO: 659047 - DNA, 20 bp, mouse
gcgagcctgggcattcgcta

SEQ ID NO: 659048 - DNA, 20 bp, mouse
gctagccagcggcgcccagt

SEQ ID NO: 659049 - DNA, 20 bp, mouse
gaatgcccaggctcgctcaa

SEQ ID NO: 659050 - DNA, 20 bp, mouse
ggggagaccgcgcactgccg

SEQ ID NO: 659051 - DNA, 20 bp, mouse
gtgccgcggaggaaaggaaa

SEQ ID NO: 659052 - DNA, 20 bp, mouse
ggcgcactgccgcggaggaa

SEQ ID NO: 659053 - DNA, 20 bp, mouse
gtagagaaacgactcccagt

SEQ ID NO: 659054 - DNA, 20 bp, mouse
gctgtggcggagctagccag

SEQ ID NO: 659055 - DNA, 20 bp, mouse
gtcaaccgtaacttccgact

SEQ ID NO: 659056 - DNA, 20 bp, mouse
gccggcatggggcgaactgt

SEQ ID NO: 659057 - DNA, 20 bp, mouse
gagaacaaaggtcccggcat

SEQ ID NO: 659058 - DNA, 20 bp, mouse
gagctgggactgaagttcaa

SEQ ID NO: 659059 - DNA, 20 bp, mouse
ggggaaaaccgctacgcaaa

SEQ ID NO: 659060 - DNA, 20 bp, mouse
gctcacgtgtttaaagtcct

SEQ ID NO: 659061 - DNA, 20 bp, mouse
gcaatactgcaagtggactc

SEQ ID NO: 659062 - DNA, 20 bp, mouse
gtattgtagagatcaggttc

SEQ ID NO: 659063 - DNA, 20 bp, mouse
gggtaatgcgacttagaaca

SEQ ID NO: 659064 - DNA, 20 bp, mouse
gttggtgttttagtgagccc

SEQ ID NO: 659065 - DNA, 20 bp, mouse
gacagaggcattttgtgagc

SEQ ID NO: 659066 - DNA, 20 bp, mouse
gtccccaggcctcaaagccc

SEQ ID NO: 659067 - DNA, 20 bp, mouse
gttccggggtaaaattgtcc

SEQ ID NO: 659068 - DNA, 20 bp, mouse
ggactgagaaacaaattaat

SEQ ID NO: 659069 - DNA, 20 bp, mouse
gtggggaggagcgcttttta

SEQ ID NO: 659070 - DNA, 20 bp, mouse
gcacaggaacaaaggttccg

SEQ ID NO: 659071 - DNA, 20 bp, mouse
ggcattaaagacaggggcct

SEQ ID NO: 659072 - DNA, 20 bp, mouse
gttagtgtgttacggttctt

SEQ ID NO: 659073 - DNA, 20 bp, mouse
ggtcaacattgcataggaca

SEQ ID NO: 659074 - DNA, 20 bp, mouse
gcggatgcccggattctatt

SEQ ID NO: 659075 - DNA, 20 bp, mouse
ggggcacactacatcacttt

SEQ ID NO: 659076 - DNA, 20 bp, mouse
gggcccgcgggacgtgaacc

SEQ ID NO: 659077 - DNA, 20 bp, mouse
ggtggagccccgccagcggt

SEQ ID NO: 659078 - DNA, 20 bp, mouse
gtctccgcccaccgctggcg

SEQ ID NO: 659079 - DNA, 20 bp, mouse
gcggtgggcggagactcgag

SEQ ID NO: 659080 - DNA, 20 bp, mouse
gggcggaagagcagtagctt

SEQ ID NO: 659081 - DNA, 20 bp, mouse
ggacgtgaaccaggaaagta

SEQ ID NO: 659082 - DNA, 20 bp, mouse
gcaaccgctaggtctctgca

SEQ ID NO: 659083 - DNA, 20 bp, mouse
gagctctatgcccctcggtg

SEQ ID NO: 659084 - DNA, 20 bp, mouse
gagaagggcggaaacggaag

SEQ ID NO: 659085 - DNA, 20 bp, mouse
ggaagaggcggggaaaacgg

SEQ ID NO: 659086 - DNA, 20 bp, mouse
gagcaaacgcgggccgcgga

SEQ ID NO: 659087 - DNA, 20 bp, mouse
gcgcctgtcgggagcaaacg

SEQ ID NO: 659088 - DNA, 20 bp, mouse
gcgggagcaaacgcgggccg

SEQ ID NO: 659089 - DNA, 20 bp, mouse
gccaacgcctgcagtctatg

SEQ ID NO: 659090 - DNA, 20 bp, mouse
gacacggaaggcagtaagct

SEQ ID NO: 659091 - DNA, 20 bp, mouse
gcgttggtggataaatggaa

SEQ ID NO: 659092 - DNA, 20 bp, mouse
ggcccgcgtttgctcccgac

SEQ ID NO: 659093 - DNA, 20 bp, mouse
ggctatagcaaccgcctgtc

SEQ ID NO: 659094 - DNA, 20 bp, mouse
ggacccatctctgttctccc

SEQ ID NO: 659095 - DNA, 20 bp, mouse
gatcacggaagctggtgggc

SEQ ID NO: 659096 - DNA, 20 bp, mouse
gcctgcgcggaccctcccag

SEQ ID NO: 659097 - DNA, 20 bp, mouse
ggcaaggcaagcagcttggc

SEQ ID NO: 659098 - DNA, 20 bp, mouse
ggagaatcctggggaggtac

SEQ ID NO: 659099 - DNA, 20 bp, mouse
gcagtggcgtcgtgcctggt

SEQ ID NO: 659100 - DNA, 20 bp, mouse
gaacgccacaggcccggcgc

SEQ ID NO: 659101 - DNA, 20 bp, mouse
gagctcctgcgactgcgcag

SEQ ID NO: 659102 - DNA, 20 bp, mouse
ggcgcagactagagcgcgat

SEQ ID NO: 659103 - DNA, 20 bp, mouse
gcaggactgcggaacgccac

SEQ ID NO: 659104 - DNA, 20 bp, mouse
gacggggcggatagttaagt

SEQ ID NO: 659105 - DNA, 20 bp, mouse
gctagcagcggatgaggagt

SEQ ID NO: 659106 - DNA, 20 bp, mouse
gggtctcagccacagatgga

SEQ ID NO: 659107 - DNA, 20 bp, mouse
gagctcggaaggaataggtg

SEQ ID NO: 659108 - DNA, 20 bp, mouse
gagcttagatagctctgcac

SEQ ID NO: 659109 - DNA, 20 bp, mouse
ggggctggacgaatttagag

SEQ ID NO: 659110 - DNA, 20 bp, mouse
gtggtcgcccgggaaacggt

SEQ ID NO: 659111 - DNA, 20 bp, mouse
ggcccctaaggagttgtgag

SEQ ID NO: 659112 - DNA, 20 bp, mouse
gagtggaaggtcaggctgtg

SEQ ID NO: 659113 - DNA, 20 bp, mouse
gcttccactcacaactcctt

SEQ ID NO: 659114 - DNA, 20 bp, mouse
gcagctggtcgcccgggaaa

SEQ ID NO: 659115 - DNA, 20 bp, mouse
gcggaagccgaccgtttccc

SEQ ID NO: 659116 - DNA, 20 bp, mouse
gcccacctcccataccctgg

SEQ ID NO: 659117 - DNA, 20 bp, mouse
gcggggcccaagcttccacc

SEQ ID NO: 659118 - DNA, 20 bp, mouse
gccctggtggcctggatctc

SEQ ID NO: 659119 - DNA, 20 bp, mouse
ggggcgccaaggcaacgcgc

SEQ ID NO: 659120 - DNA, 20 bp, mouse
ggatccaggccaccagggta

SEQ ID NO: 659121 - DNA, 20 bp, mouse
gcaaatgacgcaaacgggct

SEQ ID NO: 659122 - DNA, 20 bp, mouse
ggaaaagagcgcacactacc

SEQ ID NO: 659123 - DNA, 20 bp, mouse
gttggtcttgttgaggcggg

SEQ ID NO: 659124 - DNA, 20 bp, mouse
ggtagatgtcgtgacaaagc

SEQ ID NO: 659125 - DNA, 20 bp, mouse
gctcccataccctggtggcc

SEQ ID NO: 659126 - DNA, 20 bp, mouse
gtggcccagcggcccagagc

SEQ ID NO: 659127 - DNA, 20 bp, mouse
ggaagctccaagcagatcgc

SEQ ID NO: 659128 - DNA, 20 bp, mouse
gggaaaccggccagcgtctg

SEQ ID NO: 659129 - DNA, 20 bp, mouse
ggggaacggtcctcagacgc

SEQ ID NO: 659130 - DNA, 20 bp, mouse
gcagcggcgcccagcaacgc

SEQ ID NO: 659131 - DNA, 20 bp, mouse
ggggagctgcaccaggaaag

SEQ ID NO: 659132 - DNA, 20 bp, mouse
gccccggttgccttggaaac

SEQ ID NO: 659133 - DNA, 20 bp, mouse
ggatctgcttggagcttcgc

SEQ ID NO: 659134 - DNA, 20 bp, mouse
gggaggcagagaatgcgccc

SEQ ID NO: 659135 - DNA, 20 bp, mouse
gtctcccggggagctgcacc

SEQ ID NO: 659136 - DNA, 20 bp, mouse
ggagtagagtggctacgggg

SEQ ID NO: 659137 - DNA, 20 bp, mouse
gtccctcagggtatcggcgg

SEQ ID NO: 659138 - DNA, 20 bp, mouse
gataacacctaagcacagga

SEQ ID NO: 659139 - DNA, 20 bp, mouse
gtccgccgccgataccctga

SEQ ID NO: 659140 - DNA, 20 bp, mouse
ggtatggagtagagtggcta

SEQ ID NO: 659141 - DNA, 20 bp, mouse
ggtggctacggggcggggta

SEQ ID NO: 659142 - DNA, 20 bp, mouse
gcggaagtcccgcccctgtg

SEQ ID NO: 659143 - DNA, 20 bp, mouse
gctgtccctcagggtatcgg

SEQ ID NO: 659144 - DNA, 20 bp, mouse
gtatgacaacagggcgaagg

SEQ ID NO: 659145 - DNA, 20 bp, mouse
ggcctcagaaccacctaagc

SEQ ID NO: 659146 - DNA, 20 bp, mouse
gggcccgcgccgtgacggac

SEQ ID NO: 659147 - DNA, 20 bp, mouse
gacgggcggcgcagccaaac

SEQ ID NO: 659148 - DNA, 20 bp, mouse
ggtgaggcccagcagagtag

SEQ ID NO: 659149 - DNA, 20 bp, mouse
ggtagacagtgggcgaagac

SEQ ID NO: 659150 - DNA, 20 bp, mouse
ggggttgcatgtactgtatg

SEQ ID NO: 659151 - DNA, 20 bp, mouse
gccgtcacggcgcgggccaa

SEQ ID NO: 659152 - DNA, 20 bp, mouse
gcacggcgcgggccaatggc

SEQ ID NO: 659153 - DNA, 20 bp, mouse
gtatggaagtgaggagggat

SEQ ID NO: 659154 - DNA, 20 bp, mouse
ggttcgggacctgtagacag

SEQ ID NO: 659155 - DNA, 20 bp, mouse
gccgcccgtccgtcacggcg

SEQ ID NO: 659156 - DNA, 20 bp, mouse
gagggtgggaggtcctctca

SEQ ID NO: 659157 - DNA, 20 bp, mouse
ggggtcggtccccacggctg

SEQ ID NO: 659158 - DNA, 20 bp, mouse
gtggtcaggggcgtggtcag

SEQ ID NO: 659159 - DNA, 20 bp, mouse
gtccccgcgcgcgcgagggt

SEQ ID NO: 659160 - DNA, 20 bp, mouse
ggagagccgcaggcgtgggt

SEQ ID NO: 659161 - DNA, 20 bp, mouse
gggaggagagccgcaggcgt

SEQ ID NO: 659162 - DNA, 20 bp, mouse
gactggagggtcggtcccca

SEQ ID NO: 659163 - DNA, 20 bp, mouse
gcgggtccccgcgcgcgcga

SEQ ID NO: 659164 - DNA, 20 bp, mouse
ggccctgaagctggcagcgg

SEQ ID NO: 659165 - DNA, 20 bp, mouse
gcagctcgaggcttgactgg

SEQ ID NO: 659166 - DNA, 20 bp, mouse
gtagtcgcgcagaggatgga

SEQ ID NO: 659167 - DNA, 20 bp, mouse
gccaagacttgcagcgggga

SEQ ID NO: 659168 - DNA, 20 bp, mouse
gcccttgccgcccccgtggg

SEQ ID NO: 659169 - DNA, 20 bp, mouse
gaccgcgcagagccccccac

SEQ ID NO: 659170 - DNA, 20 bp, mouse
ggggagcccaagacttgcag

SEQ ID NO: 659171 - DNA, 20 bp, mouse
gcggggaaggcggggcgcgt

SEQ ID NO: 659172 - DNA, 20 bp, mouse
gcccggaacccgcacagaga

SEQ ID NO: 659173 - DNA, 20 bp, mouse
gggcgacagcgggcagaggg

SEQ ID NO: 659174 - DNA, 20 bp, mouse
gggagggagaggagcaccgg

SEQ ID NO: 659175 - DNA, 20 bp, mouse
gtgctcctctccctccccgg

SEQ ID NO: 659176 - DNA, 20 bp, mouse
gtgggctcggtatccccgga

SEQ ID NO: 659177 - DNA, 20 bp, mouse
gggccgaggctcctccacgt

SEQ ID NO: 659178 - DNA, 20 bp, mouse
ggggcacgcggagcgatcgg

SEQ ID NO: 659179 - DNA, 20 bp, mouse
gggagggctgatccccgatg

SEQ ID NO: 659180 - DNA, 20 bp, mouse
gcggggataccgagcccacg

SEQ ID NO: 659181 - DNA, 20 bp, mouse
ggccgcgcaccaggaaacaa

SEQ ID NO: 659182 - DNA, 20 bp, mouse
gcatccggcatcagccgcat

SEQ ID NO: 659183 - DNA, 20 bp, mouse
gggccccgcaggttcttccc

SEQ ID NO: 659184 - DNA, 20 bp, mouse
gtcccgcggcccttgtttcc

SEQ ID NO: 659185 - DNA, 20 bp, mouse
ggcggctgatgccggatgac

SEQ ID NO: 659186 - DNA, 20 bp, mouse
gcggggcgggaaacgacaat

SEQ ID NO: 659187 - DNA, 20 bp, mouse
gggtagggcgagaacggggt

SEQ ID NO: 659188 - DNA, 20 bp, mouse
gacaatgggcggagccgtta

SEQ ID NO: 659189 - DNA, 20 bp, mouse
gtggaggcgccttggcggga

SEQ ID NO: 659190 - DNA, 20 bp, mouse
gaggtctagaaaggaagtag

SEQ ID NO: 659191 - DNA, 20 bp, mouse
gaacaggccgcgcctaaggg

SEQ ID NO: 659192 - DNA, 20 bp, mouse
gcccgccccgcccttaggcg

SEQ ID NO: 659193 - DNA, 20 bp, mouse
gagtagaggctgacggttga

SEQ ID NO: 659194 - DNA, 20 bp, mouse
gggccccagccctcccgcca

SEQ ID NO: 659195 - DNA, 20 bp, mouse
gtgacacttcggacacgcag

SEQ ID NO: 659196 - DNA, 20 bp, mouse
gccgccgcgggccgcgttaa

SEQ ID NO: 659197 - DNA, 20 bp, mouse
gggaaggacgtgcaaggtgt

SEQ ID NO: 659198 - DNA, 20 bp, mouse
gtcggcacaactggtcgagg

SEQ ID NO: 659199 - DNA, 20 bp, mouse
gaccttgcacgtccttccaa

SEQ ID NO: 659200 - DNA, 20 bp, mouse
gacaactggtcgaggaggct

SEQ ID NO: 659201 - DNA, 20 bp, mouse
gaccccgggattttttctgt

SEQ ID NO: 659202 - DNA, 20 bp, mouse
gactgagggacgtgatgtga

SEQ ID NO: 659203 - DNA, 20 bp, mouse
gcggtccgcccacccggttc

SEQ ID NO: 659204 - DNA, 20 bp, mouse
gccgggtgggcggaccggat

SEQ ID NO: 659205 - DNA, 20 bp, mouse
gtccctcagtgcgggtccca

SEQ ID NO: 659206 - DNA, 20 bp, mouse
ggcaaatgagccgccgaggt

SEQ ID NO: 659207 - DNA, 20 bp, mouse
gaggcggggatgtccacaac

SEQ ID NO: 659208 - DNA, 20 bp, mouse
gcgggcggagcgaagtggac

SEQ ID NO: 659209 - DNA, 20 bp, mouse
gcgaggtgggcgtgtcgagc

SEQ ID NO: 659210 - DNA, 20 bp, mouse
ggccagcagccgcgagaggc

SEQ ID NO: 659211 - DNA, 20 bp, mouse
gggctgggcggcgtcttcta

SEQ ID NO: 659212 - DNA, 20 bp, mouse
gtggacatccccgcctctcg

SEQ ID NO: 659213 - DNA, 20 bp, mouse
gctgctggccctgctagcga

SEQ ID NO: 659214 - DNA, 20 bp, mouse
gaaaagaccagcatctggag

SEQ ID NO: 659215 - DNA, 20 bp, mouse
gctcggcggctcatttgcat

SEQ ID NO: 659216 - DNA, 20 bp, mouse
gttgaagtctagcttctcgg

SEQ ID NO: 659217 - DNA, 20 bp, mouse
gttctcgggggaagataagg

SEQ ID NO: 659218 - DNA, 20 bp, mouse
gcgcccgctctgcagacacc

SEQ ID NO: 659219 - DNA, 20 bp, mouse
ggggaggagtggattaggcg

SEQ ID NO: 659220 - DNA, 20 bp, mouse
gcaaaactctcaaatccggg

SEQ ID NO: 659221 - DNA, 20 bp, mouse
ggaatcggctgggcggggtg

SEQ ID NO: 659222 - DNA, 20 bp, mouse
gcgctctgcagacacctggc

SEQ ID NO: 659223 - DNA, 20 bp, mouse
ggtgaggttcagtaaggaag

SEQ ID NO: 659224 - DNA, 20 bp, mouse
gcccgcccagccgattcgcc

SEQ ID NO: 659225 - DNA, 20 bp, mouse
gtcagcccggcgaatcggct

SEQ ID NO: 659226 - DNA, 20 bp, mouse
ggaccaaggcacggattcat

SEQ ID NO: 659227 - DNA, 20 bp, mouse
gacaatggaggcccaggctg

SEQ ID NO: 659228 - DNA, 20 bp, mouse
gcgtcccggggaccaaggca

SEQ ID NO: 659229 - DNA, 20 bp, mouse
gccccgggacgtcctggtac

SEQ ID NO: 659230 - DNA, 20 bp, mouse
gcaggacgtcccggggacca

SEQ ID NO: 659231 - DNA, 20 bp, mouse
ggggtcaggaggtgtctact

SEQ ID NO: 659232 - DNA, 20 bp, mouse
gggcctgtaccaggacgtcc

SEQ ID NO: 659233 - DNA, 20 bp, mouse
ggaatccgtgccttggtccc

SEQ ID NO: 659234 - DNA, 20 bp, mouse
gatgccagcggaaagaatct

SEQ ID NO: 659235 - DNA, 20 bp, mouse
ggttctcaggcgctgcgctt

SEQ ID NO: 659236 - DNA, 20 bp, mouse
ggcaggtcacggtcagagca

SEQ ID NO: 659237 - DNA, 20 bp, mouse
gaacactgtgcaggtggacc

SEQ ID NO: 659238 - DNA, 20 bp, mouse
gcccgcccctgcctgcccta

SEQ ID NO: 659239 - DNA, 20 bp, mouse
ggggcggggaggactcctcc

SEQ ID NO: 659240 - DNA, 20 bp, mouse
gcatgaatgtaagagcactt

SEQ ID NO: 659241 - DNA, 20 bp, mouse
ggaagagacgcgtttccata

SEQ ID NO: 659242 - DNA, 20 bp, mouse
gggcctaacaaggaagcaaa

SEQ ID NO: 659243 - DNA, 20 bp, mouse
gaggacaaacacacgccagg

SEQ ID NO: 659244 - DNA, 20 bp, mouse
gagggaggacatgctctgtg

SEQ ID NO: 659245 - DNA, 20 bp, mouse
ggtttccatagggcaggcag

SEQ ID NO: 659246 - DNA, 20 bp, mouse
gacgccagcacgtgatgctt

SEQ ID NO: 659247 - DNA, 20 bp, mouse
gcgaaatgaggataaagcaa

SEQ ID NO: 659248 - DNA, 20 bp, mouse
ggggcagacttcggaagagg

SEQ ID NO: 659249 - DNA, 20 bp, mouse
ggtagggcagacttcggaag

SEQ ID NO: 659250 - DNA, 20 bp, mouse
ggcctttggggcttcgattc

SEQ ID NO: 659251 - DNA, 20 bp, mouse
gaagcctaagcatcacgtgc

SEQ ID NO: 659252 - DNA, 20 bp, mouse
gggggtgcctttctttgtat

SEQ ID NO: 659253 - DNA, 20 bp, mouse
gcatcacgtgctggcgtgcc

SEQ ID NO: 659254 - DNA, 20 bp, mouse
gacggcacccatacaaagaa

SEQ ID NO: 659255 - DNA, 20 bp, mouse
gaagaggtggttgctggact

SEQ ID NO: 659256 - DNA, 20 bp, mouse
ggaagcgggtgggtcaggtt

SEQ ID NO: 659257 - DNA, 20 bp, mouse
gtggcgaagctgacctccaa

SEQ ID NO: 659258 - DNA, 20 bp, mouse
gaaaaggcaggcgtgtctgc

SEQ ID NO: 659259 - DNA, 20 bp, mouse
gccggggccagtttgctcct

SEQ ID NO: 659260 - DNA, 20 bp, mouse
gccctccagccccagcggat

SEQ ID NO: 659261 - DNA, 20 bp, mouse
gcgggtgaagcgggtgggtc

SEQ ID NO: 659262 - DNA, 20 bp, mouse
gccaccaaggtgcctcttcc

SEQ ID NO: 659263 - DNA, 20 bp, mouse
gcggattggatggattctga

SEQ ID NO: 659264 - DNA, 20 bp, mouse
gcccggcgcggcaccgccct

SEQ ID NO: 659265 - DNA, 20 bp, mouse
gccagcgagtaggaaagagg

SEQ ID NO: 659266 - DNA, 20 bp, mouse
ggggacctgcatttgtgctt

SEQ ID NO: 659267 - DNA, 20 bp, mouse
gctactggcagggaacagcg

SEQ ID NO: 659268 - DNA, 20 bp, mouse
gagagccgaagcacaaatgc

SEQ ID NO: 659269 - DNA, 20 bp, mouse
gccctgctgcaaatccagat

SEQ ID NO: 659270 - DNA, 20 bp, mouse
gaggcagagtccacgtttcg

SEQ ID NO: 659271 - DNA, 20 bp, mouse
gggctgggcacgcgcataga

SEQ ID NO: 659272 - DNA, 20 bp, mouse
ggagcacccgcactttacta

SEQ ID NO: 659273 - DNA, 20 bp, mouse
gcgtatggtggttgcatcgg

SEQ ID NO: 659274 - DNA, 20 bp, mouse
ggcaaatccagatcggagag

SEQ ID NO: 659275 - DNA, 20 bp, mouse
gccaccccgcactaacagga

SEQ ID NO: 659276 - DNA, 20 bp, mouse
gcgacctctggctcactcca

SEQ ID NO: 659277 - DNA, 20 bp, mouse
gctagtacagcgtatgattg

SEQ ID NO: 659278 - DNA, 20 bp, mouse
gacagcgtatgattggggga

SEQ ID NO: 659279 - DNA, 20 bp, mouse
ggcgatacaaatcactggag

SEQ ID NO: 659280 - DNA, 20 bp, mouse
gagctgggcgcgctccgctg

SEQ ID NO: 659281 - DNA, 20 bp, mouse
gcgagctacagtccgacctc

SEQ ID NO: 659282 - DNA, 20 bp, mouse
gctcctgcgatacaaatcac

SEQ ID NO: 659283 - DNA, 20 bp, mouse
gtatgattgggggagggact

SEQ ID NO: 659284 - DNA, 20 bp, mouse
ggtggagcgtgagagcgaga

SEQ ID NO: 659285 - DNA, 20 bp, mouse
ggctagatggacagggacag

SEQ ID NO: 659286 - DNA, 20 bp, mouse
ggggtagggtggaggcgagg

SEQ ID NO: 659287 - DNA, 20 bp, mouse
ggggagagagtgcggcaggt

SEQ ID NO: 659288 - DNA, 20 bp, mouse
gtgaagatcctgcgcgggaa

SEQ ID NO: 659289 - DNA, 20 bp, mouse
gccaggccgtccttagttct

SEQ ID NO: 659290 - DNA, 20 bp, mouse
gtggggcgcggcctggtgaa

SEQ ID NO: 659291 - DNA, 20 bp, mouse
ggggaagcgctctaacccct

SEQ ID NO: 659292 - DNA, 20 bp, mouse
gcagcagccatctgcgggag

SEQ ID NO: 659293 - DNA, 20 bp, mouse
ggtcgggaccgttcccgcgc

SEQ ID NO: 659294 - DNA, 20 bp, mouse
gtcgacacagcagccatctg

SEQ ID NO: 659295 - DNA, 20 bp, mouse
gtggcttggaactaattagg

SEQ ID NO: 659296 - DNA, 20 bp, mouse
gggaaggaacgcagacggat

SEQ ID NO: 659297 - DNA, 20 bp, mouse
gccggcggaaggaacgcaga

SEQ ID NO: 659298 - DNA, 20 bp, mouse
gcacaggggcgtccaggcgc

SEQ ID NO: 659299 - DNA, 20 bp, mouse
gctaaattgcttcctccttg

SEQ ID NO: 659300 - DNA, 20 bp, mouse
gacacacagagggggagatt

SEQ ID NO: 659301 - DNA, 20 bp, mouse
ggggtctgaggtacgagcat

SEQ ID NO: 659302 - DNA, 20 bp, mouse
gtgctcgcacaggggcgtcc

SEQ ID NO: 659303 - DNA, 20 bp, mouse
gcggcgcgactagaaagctc

SEQ ID NO: 659304 - DNA, 20 bp, mouse
gctccggggttgagtcccac

SEQ ID NO: 659305 - DNA, 20 bp, mouse
gtaggcaatcggccccaagg

SEQ ID NO: 659306 - DNA, 20 bp, mouse
gaagtaagaggggacgatca

SEQ ID NO: 659307 - DNA, 20 bp, mouse
gggcaagtccgttaagtaag

SEQ ID NO: 659308 - DNA, 20 bp, mouse
ggacgatcacggcctccaat

SEQ ID NO: 659309 - DNA, 20 bp, mouse
gtgtgtgtggggcctgtgac

SEQ ID NO: 659310 - DNA, 20 bp, mouse
ggctttcggtatcctattgg

SEQ ID NO: 659311 - DNA, 20 bp, mouse
gagaccccagtgcctagtcg

SEQ ID NO: 659312 - DNA, 20 bp, mouse
gcccaacttgagttgaacct

SEQ ID NO: 659313 - DNA, 20 bp, mouse
gaccaaagcaaggagtttgt

SEQ ID NO: 659314 - DNA, 20 bp, mouse
ggataccgaaagccccgact

SEQ ID NO: 659315 - DNA, 20 bp, mouse
gagggtagaggtctgaaaga

SEQ ID NO: 659316 - DNA, 20 bp, mouse
gtcctgaagcctgcctgcaa

SEQ ID NO: 659317 - DNA, 20 bp, mouse
ggcggtgacttcttcagaga

SEQ ID NO: 659318 - DNA, 20 bp, mouse
gtgaagcctgcctgcaatgg

SEQ ID NO: 659319 - DNA, 20 bp, mouse
gtggcagcagcaacttgatc

SEQ ID NO: 659320 - DNA, 20 bp, mouse
gtgcgagcagatgtcagcct

SEQ ID NO: 659321 - DNA, 20 bp, mouse
gttcctccaccattgcaggc

SEQ ID NO: 659322 - DNA, 20 bp, mouse
gggtcttcctccaccattgc

SEQ ID NO: 659323 - DNA, 20 bp, mouse
gacttcttcagagagggttg

SEQ ID NO: 659324 - DNA, 20 bp, mouse
gaatgcagggtgtaaggggc

SEQ ID NO: 659325 - DNA, 20 bp, mouse
ggttgaaatgcagggtgtaa

SEQ ID NO: 659326 - DNA, 20 bp, mouse
gccggagccctgagcaaaat

SEQ ID NO: 659327 - DNA, 20 bp, mouse
ggcaactagaagcagacgac

SEQ ID NO: 659328 - DNA, 20 bp, mouse
gactgcagactggacttcgg

SEQ ID NO: 659329 - DNA, 20 bp, mouse
gccgcagcgcgcgtggtcag

SEQ ID NO: 659330 - DNA, 20 bp, mouse
gtggctatgccagaattggg

SEQ ID NO: 659331 - DNA, 20 bp, mouse
gcggtgctgctatttgaata

SEQ ID NO: 659332 - DNA, 20 bp, mouse
gcctaattcaggcaactaaa

SEQ ID NO: 659333 - DNA, 20 bp, mouse
gcgcgcgtggtcagcggcta

SEQ ID NO: 659334 - DNA, 20 bp, mouse
gcacctccacctcccaattc

SEQ ID NO: 659335 - DNA, 20 bp, mouse
gcgcatgcgcaataggtacg

SEQ ID NO: 659336 - DNA, 20 bp, mouse
ggacccagggaccacatctc

SEQ ID NO: 659337 - DNA, 20 bp, mouse
gacctggcggcccgcccaga

SEQ ID NO: 659338 - DNA, 20 bp, mouse
gcagcctgagatgtggtccc

SEQ ID NO: 659339 - DNA, 20 bp, mouse
gggagacggaagttcggggg

SEQ ID NO: 659340 - DNA, 20 bp, mouse
gcccacgctgccggcaggga

SEQ ID NO: 659341 - DNA, 20 bp, mouse
gatcggagacggaagttcgg

SEQ ID NO: 659342 - DNA, 20 bp, mouse
gcctgcagctgattttgggg

SEQ ID NO: 659343 - DNA, 20 bp, mouse
gggctgcaggggccttggta

SEQ ID NO: 659344 - DNA, 20 bp, mouse
ggcccctgcagcctgagatg

SEQ ID NO: 659345 - DNA, 20 bp, mouse
gccctcgaggctgcccaatg

SEQ ID NO: 659346 - DNA, 20 bp, mouse
gtgaaggcttaagggagaac

SEQ ID NO: 659347 - DNA, 20 bp, mouse
gttacagccggggagggcga

SEQ ID NO: 659348 - DNA, 20 bp, mouse
gagcacgtctgcatcctcga

SEQ ID NO: 659349 - DNA, 20 bp, mouse
gcccggctgtaacatcgcgc

SEQ ID NO: 659350 - DNA, 20 bp, mouse
ggcgggaggtggtggttgtg

SEQ ID NO: 659351 - DNA, 20 bp, mouse
gcacctcccgcgatacaatc

SEQ ID NO: 659352 - DNA, 20 bp, mouse
gctgccgagcgtccgccgga

SEQ ID NO: 659353 - DNA, 20 bp, mouse
gcgaacccgggcccagcgtc

SEQ ID NO: 659354 - DNA, 20 bp, mouse
gcacactcggggaagcgggt

SEQ ID NO: 659355 - DNA, 20 bp, mouse
gcgggctcggctagccgagc

SEQ ID NO: 659356 - DNA, 20 bp, mouse
ggaagcagagacgtaaccga

SEQ ID NO: 659357 - DNA, 20 bp, mouse
gacaagggggcgtggttaga

SEQ ID NO: 659358 - DNA, 20 bp, mouse
gaaccgagggtagtactgat

SEQ ID NO: 659359 - DNA, 20 bp, mouse
gtggctggcacgtaggtggg

SEQ ID NO: 659360 - DNA, 20 bp, mouse
gtaactcaggcaccaccctt

SEQ ID NO: 659361 - DNA, 20 bp, mouse
ggacccgcctcgccgaaggg

SEQ ID NO: 659362 - DNA, 20 bp, mouse
gccaaacgaggagtctgcga

SEQ ID NO: 659363 - DNA, 20 bp, mouse
gtacgtctctgcttccgcag

SEQ ID NO: 659364 - DNA, 20 bp, mouse
ggattggctggcacgtaggt

SEQ ID NO: 659365 - DNA, 20 bp, mouse
ggagggtagtactgattggc

SEQ ID NO: 659366 - DNA, 20 bp, mouse
gccaatggccagtgcggggc

SEQ ID NO: 659367 - DNA, 20 bp, mouse
ggtggcccggagagaagaaa

SEQ ID NO: 659368 - DNA, 20 bp, mouse
ggccagacgcggcccctggg

SEQ ID NO: 659369 - DNA, 20 bp, mouse
gaccaatggacacacatcag

SEQ ID NO: 659370 - DNA, 20 bp, mouse
gggcgccagacgcggcccct

SEQ ID NO: 659371 - DNA, 20 bp, mouse
ggctccgcaggcgccagacg

SEQ ID NO: 659372 - DNA, 20 bp, mouse
ggacaagccaatggccagtg

SEQ ID NO: 659373 - DNA, 20 bp, mouse
gaagaaaggggcggcggggt

SEQ ID NO: 659374 - DNA, 20 bp, mouse
gtccccccaggggccgcgtc

SEQ ID NO: 659375 - DNA, 20 bp, mouse
gaaggggaagctcacaccaa

SEQ ID NO: 659376 - DNA, 20 bp, mouse
ggcgagggagagatgcgcgg

SEQ ID NO: 659377 - DNA, 20 bp, mouse
gagggccccgcaacgtgcca

SEQ ID NO: 659378 - DNA, 20 bp, mouse
ggccccgcaacgtgccaggg

SEQ ID NO: 659379 - DNA, 20 bp, mouse
gacaagttccagggcccaga

SEQ ID NO: 659380 - DNA, 20 bp, mouse
gccgcaacgtgccagggcgg

SEQ ID NO: 659381 - DNA, 20 bp, mouse
ggcctctcccagcacacctc

SEQ ID NO: 659382 - DNA, 20 bp, mouse
gtcttttctgcatttgtcga

SEQ ID NO: 659383 - DNA, 20 bp, mouse
gcgagggaggggtgctcatt

SEQ ID NO: 659384 - DNA, 20 bp, mouse
gggaacttgtcacacacttc

SEQ ID NO: 659385 - DNA, 20 bp, mouse
gtctcccagcacacctcagg

SEQ ID NO: 659386 - DNA, 20 bp, mouse
gcagagagtcggagcactgg

SEQ ID NO: 659387 - DNA, 20 bp, mouse
gggagctctcggtctctctg

SEQ ID NO: 659388 - DNA, 20 bp, mouse
gcggtagcgcaaaagagggt

SEQ ID NO: 659389 - DNA, 20 bp, mouse
gcactgggggcgactagcgg

SEQ ID NO: 659390 - DNA, 20 bp, mouse
gacccagagagtcggagcac

SEQ ID NO: 659391 - DNA, 20 bp, mouse
gagccggactccctgagaaa

SEQ ID NO: 659392 - DNA, 20 bp, mouse
gacaaaaagacccagagagt

SEQ ID NO: 659393 - DNA, 20 bp, mouse
gtccacgcccgcaccgaccc

SEQ ID NO: 659394 - DNA, 20 bp, mouse
gagtgcgcccgggtcggtgc

SEQ ID NO: 659395 - DNA, 20 bp, mouse
gggctggaaaccacgggctg

SEQ ID NO: 659396 - DNA, 20 bp, mouse
gaggacgggccggggaggaa

SEQ ID NO: 659397 - DNA, 20 bp, mouse
gcggcggagaatgaagtaag

SEQ ID NO: 659398 - DNA, 20 bp, mouse
gtacaggaaaccaggcgctc

SEQ ID NO: 659399 - DNA, 20 bp, mouse
gaacccgggcggctggcggg

SEQ ID NO: 659400 - DNA, 20 bp, mouse
ggcggcgcctttaacccggg

SEQ ID NO: 659401 - DNA, 20 bp, mouse
gccacccaggccagcggccg

SEQ ID NO: 659402 - DNA, 20 bp, mouse
gcgccagccgcccgggttaa

SEQ ID NO: 659403 - DNA, 20 bp, mouse
ggacgtacgtacaggaaacc

SEQ ID NO: 659404 - DNA, 20 bp, mouse
gcgggcctcccgggcggcag

SEQ ID NO: 659405 - DNA, 20 bp, mouse
gcgggcggcagtggctcagt

SEQ ID NO: 659406 - DNA, 20 bp, mouse
gattcatttacttttttcgt

SEQ ID NO: 659407 - DNA, 20 bp, mouse
gcccacagaaccgagaagag

SEQ ID NO: 659408 - DNA, 20 bp, mouse
gtctcgtcacttatgtgcat

SEQ ID NO: 659409 - DNA, 20 bp, mouse
gcgtcacttatgtgcatggg

SEQ ID NO: 659410 - DNA, 20 bp, mouse
ggtagatagaccaggttaag

SEQ ID NO: 659411 - DNA, 20 bp, mouse
gactttgtctcctcttaacc

SEQ ID NO: 659412 - DNA, 20 bp, mouse
gaaagttcagactgtgaagg

SEQ ID NO: 659413 - DNA, 20 bp, mouse
ggccaaagttcagactgtga

SEQ ID NO: 659414 - DNA, 20 bp, mouse
gaaacaagatccctctaagt

SEQ ID NO: 659415 - DNA, 20 bp, mouse
gtagttcccacctacttaga

SEQ ID NO: 659416 - DNA, 20 bp, mouse
gattcgtttacttttttctt

SEQ ID NO: 659417 - DNA, 20 bp, mouse
gaaagttcagactgtgaagg

SEQ ID NO: 659418 - DNA, 20 bp, mouse
gaaacaagatccctctaagt

SEQ ID NO: 659419 - DNA, 20 bp, mouse
gtagttcccacctacttaga

SEQ ID NO: 659420 - DNA, 20 bp, mouse
ggccaaagttcagactgtga

SEQ ID NO: 659421 - DNA, 20 bp, mouse
gcccttagaacatgagtaag

SEQ ID NO: 659422 - DNA, 20 bp, mouse
gcaagatccctctaagtagg

SEQ ID NO: 659423 - DNA, 20 bp, mouse
gaacccacagaaccgagaag

SEQ ID NO: 659424 - DNA, 20 bp, mouse
ggcctcttactcatgttcta

SEQ ID NO: 659425 - DNA, 20 bp, mouse
gtaagcgctgagacgaaacc

SEQ ID NO: 659426 - DNA, 20 bp, mouse
gaaagttcggtccatgaagg

SEQ ID NO: 659427 - DNA, 20 bp, mouse
ggaaacaagatccctgtaag

SEQ ID NO: 659428 - DNA, 20 bp, mouse
ggccaaagttcggtccatga

SEQ ID NO: 659429 - DNA, 20 bp, mouse
gtagttcccagccacttaca

SEQ ID NO: 659430 - DNA, 20 bp, mouse
gcaagatccctgtaagtggc

SEQ ID NO: 659431 - DNA, 20 bp, mouse
gtacccacagaactgagaag

SEQ ID NO: 659432 - DNA, 20 bp, mouse
gaagacattttcctccttca

SEQ ID NO: 659433 - DNA, 20 bp, mouse
gcaccctcttctcagttctg

SEQ ID NO: 659434 - DNA, 20 bp, mouse
gactgagttgggtttaaagc

SEQ ID NO: 659435 - DNA, 20 bp, mouse
gcttaagaagtagatagacc

SEQ ID NO: 659436 - DNA, 20 bp, mouse
gcttgagaggtatatagacc

SEQ ID NO: 659437 - DNA, 20 bp, mouse
gtatgtactgagtttatagc

SEQ ID NO: 659438 - DNA, 20 bp, mouse
gaaagttcagactctgaagg

SEQ ID NO: 659439 - DNA, 20 bp, mouse
gtcgtctcagcgcttatacc

SEQ ID NO: 659440 - DNA, 20 bp, mouse
gattcgtttacttttttctt

SEQ ID NO: 659441 - DNA, 20 bp, mouse
gtggcagtagtacacttgag

SEQ ID NO: 659442 - DNA, 20 bp, mouse
gaaacaagatccctctaagt

SEQ ID NO: 659443 - DNA, 20 bp, mouse
gctaagtaggtgggaactag

SEQ ID NO: 659444 - DNA, 20 bp, mouse
gcccttagaacatgagtaag

SEQ ID NO: 659445 - DNA, 20 bp, mouse
ggccaaagttcagactctga

SEQ ID NO: 659446 - DNA, 20 bp, mouse
gaaggggcgtgctagagcga

SEQ ID NO: 659447 - DNA, 20 bp, mouse
gccgccctcgatctggtcga

SEQ ID NO: 659448 - DNA, 20 bp, mouse
gagagaggccgccctcgatc

SEQ ID NO: 659449 - DNA, 20 bp, mouse
gggagtcaggagaactctcc

SEQ ID NO: 659450 - DNA, 20 bp, mouse
ggtgctagagcgagggggtt

SEQ ID NO: 659451 - DNA, 20 bp, mouse
gaacctgccccctcacaacc

SEQ ID NO: 659452 - DNA, 20 bp, mouse
gagaactctcccggaggtat

SEQ ID NO: 659453 - DNA, 20 bp, mouse
gacactaaacccatacctcc

SEQ ID NO: 659454 - DNA, 20 bp, mouse
gccgcctcctactgggagtc

SEQ ID NO: 659455 - DNA, 20 bp, mouse
gtggctctccgcctcctact

SEQ ID NO: 659456 - DNA, 20 bp, mouse
gcaggcgcgtggaacgttta

SEQ ID NO: 659457 - DNA, 20 bp, mouse
ggatgaaggaactagattga

SEQ ID NO: 659458 - DNA, 20 bp, mouse
ggggactggcatcgagacat

SEQ ID NO: 659459 - DNA, 20 bp, mouse
gtcggtgtccaacatcgaac

SEQ ID NO: 659460 - DNA, 20 bp, mouse
gacccctggcgagcgatttg

SEQ ID NO: 659461 - DNA, 20 bp, mouse
gcgcgagcccgagacgcaaa

SEQ ID NO: 659462 - DNA, 20 bp, mouse
ggtgcgcgccagaaagggac

SEQ ID NO: 659463 - DNA, 20 bp, mouse
gaaggagtgcgcgccagaaa

SEQ ID NO: 659464 - DNA, 20 bp, mouse
gtcctcaaatcgctcgccag

SEQ ID NO: 659465 - DNA, 20 bp, mouse
gctgatacacagtcaatgaa

SEQ ID NO: 659466 - DNA, 20 bp, mouse
gggtacaaggagagcgtcat

SEQ ID NO: 659467 - DNA, 20 bp, mouse
ggtggggcaagcaggagcag

SEQ ID NO: 659468 - DNA, 20 bp, mouse
gaggagagcgtcatggggtg

SEQ ID NO: 659469 - DNA, 20 bp, mouse
gtgggggctggaactttcta

SEQ ID NO: 659470 - DNA, 20 bp, mouse
ggaccctcggattattgttg

SEQ ID NO: 659471 - DNA, 20 bp, mouse
gaacctcaacaataatccga

SEQ ID NO: 659472 - DNA, 20 bp, mouse
gctgacccacctggacattt

SEQ ID NO: 659473 - DNA, 20 bp, mouse
ggtcatggggtggggcaagc

SEQ ID NO: 659474 - DNA, 20 bp, mouse
gtctaggaggcattgctggt

SEQ ID NO: 659475 - DNA, 20 bp, mouse
ggttgaggtttaaatagatg

SEQ ID NO: 659476 - DNA, 20 bp, mouse
ggcaggctgcgacaggtagt

SEQ ID NO: 659477 - DNA, 20 bp, mouse
gcccgcaggccaagacacta

SEQ ID NO: 659478 - DNA, 20 bp, mouse
gggcgcgtgcaggctgcgac

SEQ ID NO: 659479 - DNA, 20 bp, mouse
gtcgcagagcggaacttagg

SEQ ID NO: 659480 - DNA, 20 bp, mouse
gcccccgcgcccaatcaccg

SEQ ID NO: 659481 - DNA, 20 bp, mouse
ggtaaacacgccggggtggg

SEQ ID NO: 659482 - DNA, 20 bp, mouse
gcgagcatgcagctgcccgc

SEQ ID NO: 659483 - DNA, 20 bp, mouse
gaactgcaggacagccggcg

SEQ ID NO: 659484 - DNA, 20 bp, mouse
ggccacgggcggacggggag

SEQ ID NO: 659485 - DNA, 20 bp, mouse
ggggggtggggcttaccttc

SEQ ID NO: 659486 - DNA, 20 bp, mouse
gactgcgcgcgggccaatgg

SEQ ID NO: 659487 - DNA, 20 bp, mouse
gtctgcccattggttacgat

SEQ ID NO: 659488 - DNA, 20 bp, mouse
ggtggccggcacagtctgag

SEQ ID NO: 659489 - DNA, 20 bp, mouse
gagccctgcgcccctggcgc

SEQ ID NO: 659490 - DNA, 20 bp, mouse
gccccaccgcctctgcccat

SEQ ID NO: 659491 - DNA, 20 bp, mouse
gggggcggcgcctacgggtc

SEQ ID NO: 659492 - DNA, 20 bp, mouse
gtggcctcgcggatctccga

SEQ ID NO: 659493 - DNA, 20 bp, mouse
gaaccaatgggcagaggcgg

SEQ ID NO: 659494 - DNA, 20 bp, mouse
gatggggagcgactgcgcgc

SEQ ID NO: 659495 - DNA, 20 bp, mouse
gtcaacaatcgccttgcctt

SEQ ID NO: 659496 - DNA, 20 bp, mouse
ggcaaccgccccaacgtcga

SEQ ID NO: 659497 - DNA, 20 bp, mouse
gggtgccagcagtggttttg

SEQ ID NO: 659498 - DNA, 20 bp, mouse
ggcgttcccagcatgcctgt

SEQ ID NO: 659499 - DNA, 20 bp, mouse
gcctcccctggtaggtaacg

SEQ ID NO: 659500 - DNA, 20 bp, mouse
gaggaagtcccagcgctcgg

SEQ ID NO: 659501 - DNA, 20 bp, mouse
gtaggcggaaggccaaaaaa

SEQ ID NO: 659502 - DNA, 20 bp, mouse
gtaacgcggaagagccggga

SEQ ID NO: 659503 - DNA, 20 bp, mouse
ggggcgcccaattcctcccc

SEQ ID NO: 659504 - DNA, 20 bp, mouse
gccgtgtcggcccagtgcgc

SEQ ID NO: 659505 - DNA, 20 bp, mouse
gaagggcatttgagggagtt

SEQ ID NO: 659506 - DNA, 20 bp, mouse
gcgcctgctcacccctgtgt

SEQ ID NO: 659507 - DNA, 20 bp, mouse
gctcctggaaagagaggcac

SEQ ID NO: 659508 - DNA, 20 bp, mouse
gcccgggcgtaatgccaagc

SEQ ID NO: 659509 - DNA, 20 bp, mouse
gccggtgctagttagggcga

SEQ ID NO: 659510 - DNA, 20 bp, mouse
gagccagcggctcggtcaac

SEQ ID NO: 659511 - DNA, 20 bp, mouse
gtgaccgagccgctggcttc

SEQ ID NO: 659512 - DNA, 20 bp, mouse
ggtcaactggaaacgaagca

SEQ ID NO: 659513 - DNA, 20 bp, mouse
ggtcaagactgcacttccta

SEQ ID NO: 659514 - DNA, 20 bp, mouse
gacaggggtgagcaggcgtg

SEQ ID NO: 659515 - DNA, 20 bp, mouse
gtcacggcggcgtaggggcg

SEQ ID NO: 659516 - DNA, 20 bp, mouse
gcggtggcagtgaaagtgtt

SEQ ID NO: 659517 - DNA, 20 bp, mouse
gacaggtggagctgtcttga

SEQ ID NO: 659518 - DNA, 20 bp, mouse
gctaaggtgtgcaccaacag

SEQ ID NO: 659519 - DNA, 20 bp, mouse
gactgccaccgggcacaaac

SEQ ID NO: 659520 - DNA, 20 bp, mouse
gttcccgaccagccaatccg

SEQ ID NO: 659521 - DNA, 20 bp, mouse
gtccacctgtttgtgcccgg

SEQ ID NO: 659522 - DNA, 20 bp, mouse
gcgaccagccaatccgtggc

SEQ ID NO: 659523 - DNA, 20 bp, mouse
gacaaaagggactaacggga

SEQ ID NO: 659524 - DNA, 20 bp, mouse
gtgtaccttgaataaggaat

SEQ ID NO: 659525 - DNA, 20 bp, mouse
gcagtgaaagtgtttggtga

SEQ ID NO: 659526 - DNA, 20 bp, mouse
gactccctgcagacatttac

SEQ ID NO: 659527 - DNA, 20 bp, mouse
gacgctacagacttttttga

SEQ ID NO: 659528 - DNA, 20 bp, mouse
gtctgtcaatgcagagaagt

SEQ ID NO: 659529 - DNA, 20 bp, mouse
gtatggaagtgggtggaaat

SEQ ID NO: 659530 - DNA, 20 bp, mouse
gttgactgccatatggaagt

SEQ ID NO: 659531 - DNA, 20 bp, mouse
gttgtcactgcctgctgtat

SEQ ID NO: 659532 - DNA, 20 bp, mouse
ggattcctgtaaatgtctgc

SEQ ID NO: 659533 - DNA, 20 bp, mouse
gtatacctaagacagttata

SEQ ID NO: 659534 - DNA, 20 bp, mouse
gtaacagttcggcagaacac

SEQ ID NO: 659535 - DNA, 20 bp, mouse
gactgccatatggaagtggg

SEQ ID NO: 659536 - DNA, 20 bp, mouse
gtactcttacatactggcaa

SEQ ID NO: 659537 - DNA, 20 bp, mouse
ggtaactgatgtaatttcaa

SEQ ID NO: 659538 - DNA, 20 bp, mouse
gccaaatgaaactgctcaaa

SEQ ID NO: 659539 - DNA, 20 bp, mouse
ggaacctggcaaaccagttg

SEQ ID NO: 659540 - DNA, 20 bp, mouse
gtagctgaaataaactgaag

SEQ ID NO: 659541 - DNA, 20 bp, mouse
gaagggaggtgagataccag

SEQ ID NO: 659542 - DNA, 20 bp, mouse
gttaggaagcaataagaggt

SEQ ID NO: 659543 - DNA, 20 bp, mouse
gagatacggtggatgaggag

SEQ ID NO: 659544 - DNA, 20 bp, mouse
gccaattaggaagcaataag

SEQ ID NO: 659545 - DNA, 20 bp, mouse
gttaagaaatacttcctgct

SEQ ID NO: 659546 - DNA, 20 bp, mouse
gtgggaagagccacaactcc

SEQ ID NO: 659547 - DNA, 20 bp, mouse
gcccggcgccgggtgatgat

SEQ ID NO: 659548 - DNA, 20 bp, mouse
gaggcccggtgtgtttctct

SEQ ID NO: 659549 - DNA, 20 bp, mouse
gcctctgaacagcccttcaa

SEQ ID NO: 659550 - DNA, 20 bp, mouse
gaggccatagtgacctgtgc

SEQ ID NO: 659551 - DNA, 20 bp, mouse
gaggaagagagggccattga

SEQ ID NO: 659552 - DNA, 20 bp, mouse
ggaagagcccactgcattaa

SEQ ID NO: 659553 - DNA, 20 bp, mouse
gcagccggcacaggtcacta

SEQ ID NO: 659554 - DNA, 20 bp, mouse
gtgtccccagagaaacacac

SEQ ID NO: 659555 - DNA, 20 bp, mouse
gaggttgttcccagcttaat

SEQ ID NO: 659556 - DNA, 20 bp, mouse
gtggacccgcgtctcggagg

SEQ ID NO: 659557 - DNA, 20 bp, mouse
gggcacaatgagcagagtgg

SEQ ID NO: 659558 - DNA, 20 bp, mouse
gtcctggacccgcgtctcgg

SEQ ID NO: 659559 - DNA, 20 bp, mouse
gaacccctggggcggacggg

SEQ ID NO: 659560 - DNA, 20 bp, mouse
gaatgagcagagtggcgggt

SEQ ID NO: 659561 - DNA, 20 bp, mouse
gactctgctcattgtgcctc

SEQ ID NO: 659562 - DNA, 20 bp, mouse
ggggccacccgtccgcccca

SEQ ID NO: 659563 - DNA, 20 bp, mouse
ggagctccgcctccgagacg

SEQ ID NO: 659564 - DNA, 20 bp, mouse
gggcggacgggtggccccgg

SEQ ID NO: 659565 - DNA, 20 bp, mouse
gagacagagctcccggccag

SEQ ID NO: 659566 - DNA, 20 bp, mouse
gccgccgcccggaacaccgg

SEQ ID NO: 659567 - DNA, 20 bp, mouse
gcgctcgccgccctatagtg

SEQ ID NO: 659568 - DNA, 20 bp, mouse
gtcgggacccccggtgttcc

SEQ ID NO: 659569 - DNA, 20 bp, mouse
gcggccccgaggcattctgc

SEQ ID NO: 659570 - DNA, 20 bp, mouse
gcgctccgccgccgtcacgt

SEQ ID NO: 659571 - DNA, 20 bp, mouse
ggcaccgccgcccggaacac

SEQ ID NO: 659572 - DNA, 20 bp, mouse
gacaccgggggtcccgaggc

SEQ ID NO: 659573 - DNA, 20 bp, mouse
gcggccggcagaatgcctcg

SEQ ID NO: 659574 - DNA, 20 bp, mouse
gggacccccggtgttccggg

SEQ ID NO: 659575 - DNA, 20 bp, mouse
gaaccacgatccgcactata

SEQ ID NO: 659576 - DNA, 20 bp, mouse
gaccaggcggggtaaggaga

SEQ ID NO: 659577 - DNA, 20 bp, mouse
ggggaggcttatgtcgtcga

SEQ ID NO: 659578 - DNA, 20 bp, mouse
gtctcggggtggtcgtatcg

SEQ ID NO: 659579 - DNA, 20 bp, mouse
ggagctgggacagcgagtat

SEQ ID NO: 659580 - DNA, 20 bp, mouse
gggggtggtcgtatcgtgga

SEQ ID NO: 659581 - DNA, 20 bp, mouse
gttagaattggggaggttag

SEQ ID NO: 659582 - DNA, 20 bp, mouse
gccgccccgggctcaccatc

SEQ ID NO: 659583 - DNA, 20 bp, mouse
gggggaggttagtggtgcgg

SEQ ID NO: 659584 - DNA, 20 bp, mouse
ggtgcggagggtggtaatat

SEQ ID NO: 659585 - DNA, 20 bp, mouse
gtctccagatggtgagcccg

SEQ ID NO: 659586 - DNA, 20 bp, mouse
gcggcagctgcacagagcga

SEQ ID NO: 659587 - DNA, 20 bp, mouse
gccccgaggctccccgggga

SEQ ID NO: 659588 - DNA, 20 bp, mouse
gaggccgcaggtgcgatggg

SEQ ID NO: 659589 - DNA, 20 bp, mouse
gaggtccccgaggctccccg

SEQ ID NO: 659590 - DNA, 20 bp, mouse
gagcctcggggacctcactc

SEQ ID NO: 659591 - DNA, 20 bp, mouse
ggggccccccatcgcacctg

SEQ ID NO: 659592 - DNA, 20 bp, mouse
gcccgcgtgctgggaggtcg

SEQ ID NO: 659593 - DNA, 20 bp, mouse
gcacccggaggccgcactgc

SEQ ID NO: 659594 - DNA, 20 bp, mouse
ggggtgccgccgccctcccc

SEQ ID NO: 659595 - DNA, 20 bp, mouse
gcagtgcgcaagcgccgggg

SEQ ID NO: 659596 - DNA, 20 bp, mouse
gaccacgtgcggacgacgat

SEQ ID NO: 659597 - DNA, 20 bp, mouse
gcaagagggcaaagggtctc

SEQ ID NO: 659598 - DNA, 20 bp, mouse
ggcctggcccacaccacgtg

SEQ ID NO: 659599 - DNA, 20 bp, mouse
ggggccaggcgaggctgcga

SEQ ID NO: 659600 - DNA, 20 bp, mouse
gtccgtgcgcgcgtgcgcga

SEQ ID NO: 659601 - DNA, 20 bp, mouse
ggccttgagggcccaagggg

SEQ ID NO: 659602 - DNA, 20 bp, mouse
gtctctggaggcgcacagca

SEQ ID NO: 659603 - DNA, 20 bp, mouse
ggcacagcagggacgccccc

SEQ ID NO: 659604 - DNA, 20 bp, mouse
gccaggcgaggctgcgaggg

SEQ ID NO: 659605 - DNA, 20 bp, mouse
gcaagcgcgctgaggccttg

SEQ ID NO: 659606 - DNA, 20 bp, mouse
gggaacgcaccgcctcgctc

SEQ ID NO: 659607 - DNA, 20 bp, mouse
ggggctcaggggtgcgcgag

SEQ ID NO: 659608 - DNA, 20 bp, mouse
gcctctgccagccacggaga

SEQ ID NO: 659609 - DNA, 20 bp, mouse
gcgtacttggcactgttcat

SEQ ID NO: 659610 - DNA, 20 bp, mouse
gtgcgcgagagggactgtcc

SEQ ID NO: 659611 - DNA, 20 bp, mouse
gcggaggcgttggggagcga

SEQ ID NO: 659612 - DNA, 20 bp, mouse
gccacggagagggagagctg

SEQ ID NO: 659613 - DNA, 20 bp, mouse
gcggtgcgttccggccacgt

SEQ ID NO: 659614 - DNA, 20 bp, mouse
gtccggccacgtgggctcag

SEQ ID NO: 659615 - DNA, 20 bp, mouse
gtcctggtgtgcgtccgcgg

SEQ ID NO: 659616 - DNA, 20 bp, mouse
ggccccgcctcggacgcgag

SEQ ID NO: 659617 - DNA, 20 bp, mouse
gggcccgcccggcggggaat

SEQ ID NO: 659618 - DNA, 20 bp, mouse
gcctccgctcgcgtccgagg

SEQ ID NO: 659619 - DNA, 20 bp, mouse
ggggcccgcggtacctttcg

SEQ ID NO: 659620 - DNA, 20 bp, mouse
gcggaggcgcgcccctcccc

SEQ ID NO: 659621 - DNA, 20 bp, mouse
gtcccccggcccgcccggcg

SEQ ID NO: 659622 - DNA, 20 bp, mouse
ggggacgggtgccattcccc

SEQ ID NO: 659623 - DNA, 20 bp, mouse
gccagggccccattccccgc

SEQ ID NO: 659624 - DNA, 20 bp, mouse
gggtaccgcgggccccgcct

SEQ ID NO: 659625 - DNA, 20 bp, mouse
gcctccccgaaggcgatcga

SEQ ID NO: 659626 - DNA, 20 bp, mouse
gagcaggagcagttggccct

SEQ ID NO: 659627 - DNA, 20 bp, mouse
gactcggtaaggcgcccgac

SEQ ID NO: 659628 - DNA, 20 bp, mouse
ggccaactgctcctgctagc

SEQ ID NO: 659629 - DNA, 20 bp, mouse
gaaggccccttccccgccca

SEQ ID NO: 659630 - DNA, 20 bp, mouse
gaccgagtcagaccactggg

SEQ ID NO: 659631 - DNA, 20 bp, mouse
gaggctgggggagccgggtt

SEQ ID NO: 659632 - DNA, 20 bp, mouse
gggagcagttggccctgggc

SEQ ID NO: 659633 - DNA, 20 bp, mouse
gaagggggagggtagctcga

SEQ ID NO: 659634 - DNA, 20 bp, mouse
gttggccctgggcggggaag

SEQ ID NO: 659635 - DNA, 20 bp, mouse
ggcctcccagtggtctgact

SEQ ID NO: 659636 - DNA, 20 bp, mouse
ggggtggggcgggccctgaa

SEQ ID NO: 659637 - DNA, 20 bp, mouse
ggaagccagccagcccttca

SEQ ID NO: 659638 - DNA, 20 bp, mouse
gccgacagggggtgggacaa

SEQ ID NO: 659639 - DNA, 20 bp, mouse
gggggcgggccctgaagggc

SEQ ID NO: 659640 - DNA, 20 bp, mouse
gacagcggctcggaagtcag

SEQ ID NO: 659641 - DNA, 20 bp, mouse
ggagccaggctcgctaacag

SEQ ID NO: 659642 - DNA, 20 bp, mouse
gtcgcgaggtgtagccgaca

SEQ ID NO: 659643 - DNA, 20 bp, mouse
gggaaggccacgccccaagt

SEQ ID NO: 659644 - DNA, 20 bp, mouse
gaggcgcgactggcgaaccg

SEQ ID NO: 659645 - DNA, 20 bp, mouse
gaggtgtagccgacaggggg

SEQ ID NO: 659646 - DNA, 20 bp, mouse
gtctcaggatgggctagctc

SEQ ID NO: 659647 - DNA, 20 bp, mouse
gtgagtcggaagagatgatt

SEQ ID NO: 659648 - DNA, 20 bp, mouse
gcatctcttccgactcagag

SEQ ID NO: 659649 - DNA, 20 bp, mouse
gtagcagtaacacatggctt

SEQ ID NO: 659650 - DNA, 20 bp, mouse
gagcaaaggctcttcaagcg

SEQ ID NO: 659651 - DNA, 20 bp, mouse
ggagttggaaaaacactaat

SEQ ID NO: 659652 - DNA, 20 bp, mouse
gctcagagcggagccttcct

SEQ ID NO: 659653 - DNA, 20 bp, mouse
gtgcatccagttctcaggat

SEQ ID NO: 659654 - DNA, 20 bp, mouse
gccgcactattgcaagttgt

SEQ ID NO: 659655 - DNA, 20 bp, mouse
ggaaatcagagcggaggagt

SEQ ID NO: 659656 - DNA, 20 bp, mouse
gtcaaaggttagagttggtt

SEQ ID NO: 659657 - DNA, 20 bp, mouse
gtccatggaaccagattcag

SEQ ID NO: 659658 - DNA, 20 bp, mouse
ggtgggggcaaattccaata

SEQ ID NO: 659659 - DNA, 20 bp, mouse
gtaaggagggaggctattat

SEQ ID NO: 659660 - DNA, 20 bp, mouse
gagatcaaatgggactggag

SEQ ID NO: 659661 - DNA, 20 bp, mouse
gaatgagcctgggttgtccc

SEQ ID NO: 659662 - DNA, 20 bp, mouse
gtggacttagcggcaggtgg

SEQ ID NO: 659663 - DNA, 20 bp, mouse
gtaacttagtctcagttcta

SEQ ID NO: 659664 - DNA, 20 bp, mouse
gggtccaattttaatgtcaa

SEQ ID NO: 659665 - DNA, 20 bp, mouse
gggcaaattccaataaggaa

SEQ ID NO: 659666 - DNA, 20 bp, mouse
gcgagcgctgcgcctgaggg

SEQ ID NO: 659667 - DNA, 20 bp, mouse
gcgtgagggccggggaaagt

SEQ ID NO: 659668 - DNA, 20 bp, mouse
gtcaaacttgcgagagctgg

SEQ ID NO: 659669 - DNA, 20 bp, mouse
gaggggaggcggctgttggg

SEQ ID NO: 659670 - DNA, 20 bp, mouse
gcgcggtggggtttcgggag

SEQ ID NO: 659671 - DNA, 20 bp, mouse
gctccgctgcggcgcctccg

SEQ ID NO: 659672 - DNA, 20 bp, mouse
gcgcctccgcggtggggttt

SEQ ID NO: 659673 - DNA, 20 bp, mouse
ggcggagggtgagcggagac

SEQ ID NO: 659674 - DNA, 20 bp, mouse
gaactcggccggagctggga

SEQ ID NO: 659675 - DNA, 20 bp, mouse
gacagagggcggtagagttg

SEQ ID NO: 659676 - DNA, 20 bp, mouse
gcagaatgcggccttggcga

SEQ ID NO: 659677 - DNA, 20 bp, mouse
gggagcaagcatgagaagga

SEQ ID NO: 659678 - DNA, 20 bp, mouse
gcaggcgccgcccgcgaaca

SEQ ID NO: 659679 - DNA, 20 bp, mouse
gaatgcggccttggcgaggg

SEQ ID NO: 659680 - DNA, 20 bp, mouse
ggccccggtgacactgggag

SEQ ID NO: 659681 - DNA, 20 bp, mouse
gaagcagccccggtgacact

SEQ ID NO: 659682 - DNA, 20 bp, mouse
ggccttggcgagggggggga

SEQ ID NO: 659683 - DNA, 20 bp, mouse
gtcccctcccagtgtcaccg

SEQ ID NO: 659684 - DNA, 20 bp, mouse
gccccttaggagggaggttg

SEQ ID NO: 659685 - DNA, 20 bp, mouse
gaactcccagaatgcggcct

SEQ ID NO: 659686 - DNA, 20 bp, mouse
ggggctcccggaggacacgt

SEQ ID NO: 659687 - DNA, 20 bp, mouse
gcggctgcccagcgaggttc

SEQ ID NO: 659688 - DNA, 20 bp, mouse
gcgaggttccggcttccctg

SEQ ID NO: 659689 - DNA, 20 bp, mouse
gtggagcggaggactggctg

SEQ ID NO: 659690 - DNA, 20 bp, mouse
gcactggccacggggaagaa

SEQ ID NO: 659691 - DNA, 20 bp, mouse
ggcagaccccgcactggcca

SEQ ID NO: 659692 - DNA, 20 bp, mouse
gcttccccgtggccagtgcg

SEQ ID NO: 659693 - DNA, 20 bp, mouse
ggggtgccgcaacgccgttc

SEQ ID NO: 659694 - DNA, 20 bp, mouse
gcttccctggggctggtagg

SEQ ID NO: 659695 - DNA, 20 bp, mouse
gccttcctggagcggaggac

SEQ ID NO: 659696 - DNA, 20 bp, mouse
ggcgcctctgtgtacagaag

SEQ ID NO: 659697 - DNA, 20 bp, mouse
ggtacagaaggggatcagac

SEQ ID NO: 659698 - DNA, 20 bp, mouse
gacccgggacggctgctaac

SEQ ID NO: 659699 - DNA, 20 bp, mouse
gggccctgctgggtgttcat

SEQ ID NO: 659700 - DNA, 20 bp, mouse
ggcgccgcgggaagagcgtt

SEQ ID NO: 659701 - DNA, 20 bp, mouse
gaccggttagcagccgtccc

SEQ ID NO: 659702 - DNA, 20 bp, mouse
gccttaaatcggacccggga

SEQ ID NO: 659703 - DNA, 20 bp, mouse
gtgagagtctccgtggtgaa

SEQ ID NO: 659704 - DNA, 20 bp, mouse
ggcttcgaatcacccggtct

SEQ ID NO: 659705 - DNA, 20 bp, mouse
gcgaagcgatcctttcacca

SEQ ID NO: 659706 - DNA, 20 bp, mouse
ggtggcaaggactccgtggt

SEQ ID NO: 659707 - DNA, 20 bp, mouse
gaagagtggcaaggactccg

SEQ ID NO: 659708 - DNA, 20 bp, mouse
ggagccactccagtcccagt

SEQ ID NO: 659709 - DNA, 20 bp, mouse
gggaaccatcgagaattgca

SEQ ID NO: 659710 - DNA, 20 bp, mouse
ggaagtagatgcagcagtcc

SEQ ID NO: 659711 - DNA, 20 bp, mouse
gctcccgccagcccacgggt

SEQ ID NO: 659712 - DNA, 20 bp, mouse
gagcgccgctagtcccgccc

SEQ ID NO: 659713 - DNA, 20 bp, mouse
gcaaggcccgtgctactcta

SEQ ID NO: 659714 - DNA, 20 bp, mouse
gggcgggagctgcatctcta

SEQ ID NO: 659715 - DNA, 20 bp, mouse
ggggtactcaaggacataga

SEQ ID NO: 659716 - DNA, 20 bp, mouse
ggagccagccgggataagga

SEQ ID NO: 659717 - DNA, 20 bp, mouse
gctggctctgctccagtcaa

SEQ ID NO: 659718 - DNA, 20 bp, mouse
gcatgagcaggtttacctcc

SEQ ID NO: 659719 - DNA, 20 bp, mouse
ggacagcgaggatctgtacc

SEQ ID NO: 659720 - DNA, 20 bp, mouse
gaggatggccctgcatgagc

SEQ ID NO: 659721 - DNA, 20 bp, mouse
gtgcgccgggcggggcccga

SEQ ID NO: 659722 - DNA, 20 bp, mouse
gccggggtgtctagagatta

SEQ ID NO: 659723 - DNA, 20 bp, mouse
gtaccaggcttggatcagga

SEQ ID NO: 659724 - DNA, 20 bp, mouse
gtccttagccctccttatcc

SEQ ID NO: 659725 - DNA, 20 bp, mouse
ggattatgggcacccttgac

SEQ ID NO: 659726 - DNA, 20 bp, mouse
gctggcaagcagaagatcaa

SEQ ID NO: 659727 - DNA, 20 bp, mouse
gagggtagacgctgcagcta

SEQ ID NO: 659728 - DNA, 20 bp, mouse
gtgccagagggtcaaattca

SEQ ID NO: 659729 - DNA, 20 bp, mouse
gaggaaagtaagcggatgtc

SEQ ID NO: 659730 - DNA, 20 bp, mouse
gataaggtacagtattaagc

SEQ ID NO: 659731 - DNA, 20 bp, mouse
gcatgctgggaaccccttgg

SEQ ID NO: 659732 - DNA, 20 bp, mouse
ggaccgtgaatttgaccctc

SEQ ID NO: 659733 - DNA, 20 bp, mouse
gggccttgctcagggttctc

SEQ ID NO: 659734 - DNA, 20 bp, mouse
gcatctcttagagttgtcac

SEQ ID NO: 659735 - DNA, 20 bp, mouse
gtctaagagatgcccccaag

SEQ ID NO: 659736 - DNA, 20 bp, mouse
ggctgctggaaaacacacaa

SEQ ID NO: 659737 - DNA, 20 bp, mouse
gccatctagtgatcagaacg

SEQ ID NO: 659738 - DNA, 20 bp, mouse
gttagcaaaaggactcggag

SEQ ID NO: 659739 - DNA, 20 bp, mouse
gaactgtgaacgccaaacaa

SEQ ID NO: 659740 - DNA, 20 bp, mouse
ggctcaggcccagtgcactc

SEQ ID NO: 659741 - DNA, 20 bp, mouse
gaaaacacacaagggacccg

SEQ ID NO: 659742 - DNA, 20 bp, mouse
gccttcctggccattggatc

SEQ ID NO: 659743 - DNA, 20 bp, mouse
gtccccgctcaaagcaatct

SEQ ID NO: 659744 - DNA, 20 bp, mouse
gcatctaaagtgcacggctg

SEQ ID NO: 659745 - DNA, 20 bp, mouse
gtgggtgtgctcctcggctc

SEQ ID NO: 659746 - DNA, 20 bp, mouse
gtacacaggcaaaacgggtc

SEQ ID NO: 659747 - DNA, 20 bp, mouse
gcactcccacaggcagagat

SEQ ID NO: 659748 - DNA, 20 bp, mouse
gcaaaacgggtcaggcgtgg

SEQ ID NO: 659749 - DNA, 20 bp, mouse
gtcagacagagcactcccac

SEQ ID NO: 659750 - DNA, 20 bp, mouse
gagctggagaaagcgcttat

SEQ ID NO: 659751 - DNA, 20 bp, mouse
ggatccctcttttaacctag

SEQ ID NO: 659752 - DNA, 20 bp, mouse
gagagggatctagtaggagc

SEQ ID NO: 659753 - DNA, 20 bp, mouse
gattgctggcacacaaactc

SEQ ID NO: 659754 - DNA, 20 bp, mouse
gtatgatggcagaccagaac

SEQ ID NO: 659755 - DNA, 20 bp, mouse
ggcttattggttaaaaattc

SEQ ID NO: 659756 - DNA, 20 bp, mouse
gctcgcttagggatagtagg

SEQ ID NO: 659757 - DNA, 20 bp, mouse
gtaagcgagcgagtgaaagg

SEQ ID NO: 659758 - DNA, 20 bp, mouse
gctggcgggatgttgagtga

SEQ ID NO: 659759 - DNA, 20 bp, mouse
ggcagctaggcaaactcaac

SEQ ID NO: 659760 - DNA, 20 bp, mouse
gtaatcccctgtgacatcat

SEQ ID NO: 659761 - DNA, 20 bp, mouse
gttgcctagctgctgtgtgt

SEQ ID NO: 659762 - DNA, 20 bp, mouse
ggggtgagccttgagagtat

SEQ ID NO: 659763 - DNA, 20 bp, mouse
gtctcaaggctcacccctgg

SEQ ID NO: 659764 - DNA, 20 bp, mouse
gtggagccaacggggaatca

SEQ ID NO: 659765 - DNA, 20 bp, mouse
gctgctgtgtgttggcaaac

SEQ ID NO: 659766 - DNA, 20 bp, mouse
ggccacaggttgtcccccgt

SEQ ID NO: 659767 - DNA, 20 bp, mouse
gaactgctgctgatcccgga

SEQ ID NO: 659768 - DNA, 20 bp, mouse
gaggctccgggacccgacca

SEQ ID NO: 659769 - DNA, 20 bp, mouse
ggatcagcagcagttcttag

SEQ ID NO: 659770 - DNA, 20 bp, mouse
gtagctgcggaggccaaatc

SEQ ID NO: 659771 - DNA, 20 bp, mouse
gccatggtctgcacccacgg

SEQ ID NO: 659772 - DNA, 20 bp, mouse
gtggccgtgcacaactccca

SEQ ID NO: 659773 - DNA, 20 bp, mouse
gtctagtccagatcagctcc

SEQ ID NO: 659774 - DNA, 20 bp, mouse
gacccacgggggacaacctg

SEQ ID NO: 659775 - DNA, 20 bp, mouse
gcagcagcagttcttagcgg

SEQ ID NO: 659776 - DNA, 20 bp, mouse
ggcgatcagggataccccga

SEQ ID NO: 659777 - DNA, 20 bp, mouse
gccaccgatacccattgggg

SEQ ID NO: 659778 - DNA, 20 bp, mouse
gaagccctcggaagccctcg

SEQ ID NO: 659779 - DNA, 20 bp, mouse
gataccccgagggcttccga

SEQ ID NO: 659780 - DNA, 20 bp, mouse
gtggcgcggcggagcaggga

SEQ ID NO: 659781 - DNA, 20 bp, mouse
gagccagtgcaaggcgatca

SEQ ID NO: 659782 - DNA, 20 bp, mouse
gcattggggtggctgcttaa

SEQ ID NO: 659783 - DNA, 20 bp, mouse
gagggcaggcacagagcttt

SEQ ID NO: 659784 - DNA, 20 bp, mouse
ggcgccaccgatacccattg

SEQ ID NO: 659785 - DNA, 20 bp, mouse
gaccctgcggagaccgcaga

SEQ ID NO: 659786 - DNA, 20 bp, mouse
gcggagtctgacgtcatcgt

SEQ ID NO: 659787 - DNA, 20 bp, mouse
ggaagcaatgcgtaatcatt

SEQ ID NO: 659788 - DNA, 20 bp, mouse
gcagagcgttgcagttgcta

SEQ ID NO: 659789 - DNA, 20 bp, mouse
gccgcgtcccggctcgcgaa

SEQ ID NO: 659790 - DNA, 20 bp, mouse
ggacgtcagactccgggcgc

SEQ ID NO: 659791 - DNA, 20 bp, mouse
gctgcaacgctctgtagctt

SEQ ID NO: 659792 - DNA, 20 bp, mouse
gcccggctcgcgaaaggcgc

SEQ ID NO: 659793 - DNA, 20 bp, mouse
gggaagcagctgaatcctcc

SEQ ID NO: 659794 - DNA, 20 bp, mouse
gttgcagttgctatggctcc

SEQ ID NO: 659795 - DNA, 20 bp, mouse
gctcggcatgcacactgcca

SEQ ID NO: 659796 - DNA, 20 bp, mouse
gcaccaggaggacttgtgaa

SEQ ID NO: 659797 - DNA, 20 bp, mouse
gggggaggccgagggatgta

SEQ ID NO: 659798 - DNA, 20 bp, mouse
ggggaggccggcacaccagg

SEQ ID NO: 659799 - DNA, 20 bp, mouse
ggggaaccagtggccttgac

SEQ ID NO: 659800 - DNA, 20 bp, mouse
ggtagggaggccggcacacc

SEQ ID NO: 659801 - DNA, 20 bp, mouse
gagccagaaaggttggacag

SEQ ID NO: 659802 - DNA, 20 bp, mouse
ggacagacacgtgcagagaa

SEQ ID NO: 659803 - DNA, 20 bp, mouse
ggctcctctgcccaaaccaa

SEQ ID NO: 659804 - DNA, 20 bp, mouse
ggcaaagtggggtgcataca

SEQ ID NO: 659805 - DNA, 20 bp, mouse
gccggcctccctacatccct

SEQ ID NO: 659806 - DNA, 20 bp, mouse
ggaagtgcagcagtgccgac

SEQ ID NO: 659807 - DNA, 20 bp, mouse
gtgcagcagtgccgacaggt

SEQ ID NO: 659808 - DNA, 20 bp, mouse
ggctccgagccgggtaaaca

SEQ ID NO: 659809 - DNA, 20 bp, mouse
gtaaacagggatctggagca

SEQ ID NO: 659810 - DNA, 20 bp, mouse
ggtctaaatcagaagagtgt

SEQ ID NO: 659811 - DNA, 20 bp, mouse
ggcgccatccaaaggccgag

SEQ ID NO: 659812 - DNA, 20 bp, mouse
gggaagtaacaaatcttgag

SEQ ID NO: 659813 - DNA, 20 bp, mouse
ggcagcttcggcccacctgt

SEQ ID NO: 659814 - DNA, 20 bp, mouse
gggctcggagcgccatccaa

SEQ ID NO: 659815 - DNA, 20 bp, mouse
gcacgacgggagctgacgca

SEQ ID NO: 659816 - DNA, 20 bp, mouse
gcgggcagggcgcacgtggt

SEQ ID NO: 659817 - DNA, 20 bp, mouse
gggtgggcgcggggcgcaca

SEQ ID NO: 659818 - DNA, 20 bp, mouse
gactgccaagtcagtccctg

SEQ ID NO: 659819 - DNA, 20 bp, mouse
gtggcggcgggcatgaatgg

SEQ ID NO: 659820 - DNA, 20 bp, mouse
ggggcgcacagggcgcggaa

SEQ ID NO: 659821 - DNA, 20 bp, mouse
gcgcacagggcgcggaatgg

SEQ ID NO: 659822 - DNA, 20 bp, mouse
ggtcccgcgcgcatgaatgg

SEQ ID NO: 659823 - DNA, 20 bp, mouse
ggaatggcggcgggcatgaa

SEQ ID NO: 659824 - DNA, 20 bp, mouse
gtgtcccgggccctgcttgg

SEQ ID NO: 659825 - DNA, 20 bp, mouse
gggaagcgccggagcagccg

SEQ ID NO: 659826 - DNA, 20 bp, mouse
gcgggcgtgagcgaccgcgg

SEQ ID NO: 659827 - DNA, 20 bp, mouse
gccgcggggcgctttcccgt

SEQ ID NO: 659828 - DNA, 20 bp, mouse
ggcacacgcgggaccagcgg

SEQ ID NO: 659829 - DNA, 20 bp, mouse
ggggagctggggcgcgctgc

SEQ ID NO: 659830 - DNA, 20 bp, mouse
gcacgcgggaccagcggcgg

SEQ ID NO: 659831 - DNA, 20 bp, mouse
gccgcccctccccctcagcg

SEQ ID NO: 659832 - DNA, 20 bp, mouse
gcccgcgtgtgccccgctga

SEQ ID NO: 659833 - DNA, 20 bp, mouse
gggctgccggcggaccaggg

SEQ ID NO: 659834 - DNA, 20 bp, mouse
gcccctcagcggggcacacg

SEQ ID NO: 659835 - DNA, 20 bp, mouse
ggcgccccagctccccgccg

SEQ ID NO: 659836 - DNA, 20 bp, mouse
ggcccgaggggacccggtgg

SEQ ID NO: 659837 - DNA, 20 bp, mouse
gcggggtcgccagagtgcaa

SEQ ID NO: 659838 - DNA, 20 bp, mouse
ggtcgccagagtgcaagggt

SEQ ID NO: 659839 - DNA, 20 bp, mouse
gaacctggagggcgtcccgg

SEQ ID NO: 659840 - DNA, 20 bp, mouse
ggtacctagaagttagggcg

SEQ ID NO: 659841 - DNA, 20 bp, mouse
gcccgtggcccgaggggacc

SEQ ID NO: 659842 - DNA, 20 bp, mouse
gagggcgtcccggtggggac

SEQ ID NO: 659843 - DNA, 20 bp, mouse
gctctcggagtgcacgaagg

SEQ ID NO: 659844 - DNA, 20 bp, mouse
gcggtggggacaggtggaag

SEQ ID NO: 659845 - DNA, 20 bp, mouse
gaggggacccggtgggggaa

SEQ ID NO: 659846 - DNA, 20 bp, mouse
gctcgcctgggcgcggaaaa

SEQ ID NO: 659847 - DNA, 20 bp, mouse
gagtgcgattgcagtaaggt

SEQ ID NO: 659848 - DNA, 20 bp, mouse
gaaagccccgctctgccaat

SEQ ID NO: 659849 - DNA, 20 bp, mouse
ggaggtggggacccctagag

SEQ ID NO: 659850 - DNA, 20 bp, mouse
gctgggcgcggaaaagggag

SEQ ID NO: 659851 - DNA, 20 bp, mouse
gagtggagagagccgggcga

SEQ ID NO: 659852 - DNA, 20 bp, mouse
gccggagtgcgattgcagta

SEQ ID NO: 659853 - DNA, 20 bp, mouse
gagcccgtggggcggtgcgg

SEQ ID NO: 659854 - DNA, 20 bp, mouse
ggagagagccgggcgagggg

SEQ ID NO: 659855 - DNA, 20 bp, mouse
gccaggcgagagcagccgat

SEQ ID NO: 659856 - DNA, 20 bp, mouse
gccggccccggaacgactga

SEQ ID NO: 659857 - DNA, 20 bp, mouse
ggagcccgagagctgcgcgc

SEQ ID NO: 659858 - DNA, 20 bp, mouse
ggaagccggcgcacgtgggg

SEQ ID NO: 659859 - DNA, 20 bp, mouse
gggcgcacgtggggcgggac

SEQ ID NO: 659860 - DNA, 20 bp, mouse
gtcctgaagccggcgcacgt

SEQ ID NO: 659861 - DNA, 20 bp, mouse
gggcctcggcgtcctgaagc

SEQ ID NO: 659862 - DNA, 20 bp, mouse
gagccggctgggagcatcat

SEQ ID NO: 659863 - DNA, 20 bp, mouse
gagccggcggggggctcggt

SEQ ID NO: 659864 - DNA, 20 bp, mouse
ggccccgcccgggacgcagc

SEQ ID NO: 659865 - DNA, 20 bp, mouse
gcacccaccgagccccccgc

SEQ ID NO: 659866 - DNA, 20 bp, mouse
ggcacggccgagtccagcag

SEQ ID NO: 659867 - DNA, 20 bp, mouse
gtcccccgggccgcgtccgc

SEQ ID NO: 659868 - DNA, 20 bp, mouse
gtaggggccgcgccgtcgaa

SEQ ID NO: 659869 - DNA, 20 bp, mouse
gccgagtccagcagtggcgg

SEQ ID NO: 659870 - DNA, 20 bp, mouse
gggggcagctccacgggccc

SEQ ID NO: 659871 - DNA, 20 bp, mouse
ggcggcgccgcccccttcga

SEQ ID NO: 659872 - DNA, 20 bp, mouse
gccaacggaaagttgggctg

SEQ ID NO: 659873 - DNA, 20 bp, mouse
gcccggccgccgccatcccc

SEQ ID NO: 659874 - DNA, 20 bp, mouse
gcgcctctcagacagagcga

SEQ ID NO: 659875 - DNA, 20 bp, mouse
ggccaaggagccacgatccc

SEQ ID NO: 659876 - DNA, 20 bp, mouse
ggcagtaagcagtaggccct

SEQ ID NO: 659877 - DNA, 20 bp, mouse
ggcagagggcagtaagcagt

SEQ ID NO: 659878 - DNA, 20 bp, mouse
ggataaggtgagacagggaa

SEQ ID NO: 659879 - DNA, 20 bp, mouse
gctagcccactctcctcctc

SEQ ID NO: 659880 - DNA, 20 bp, mouse
gtacctgcctggcaaaggtc

SEQ ID NO: 659881 - DNA, 20 bp, mouse
gtaagcagtaggccctgggc

SEQ ID NO: 659882 - DNA, 20 bp, mouse
gggtagaagaggaccagact

SEQ ID NO: 659883 - DNA, 20 bp, mouse
gaggcaccctatgcagaacc

SEQ ID NO: 659884 - DNA, 20 bp, mouse
ggaggaccagacttggcaga

SEQ ID NO: 659885 - DNA, 20 bp, mouse
gtggattaacacagctggac

SEQ ID NO: 659886 - DNA, 20 bp, mouse
gccctgcccaggagacaaac

SEQ ID NO: 659887 - DNA, 20 bp, mouse
gaactaaaggggatggactt

SEQ ID NO: 659888 - DNA, 20 bp, mouse
ggggctgaagccagactgtt

SEQ ID NO: 659889 - DNA, 20 bp, mouse
ggtaactcaactaaagggga

SEQ ID NO: 659890 - DNA, 20 bp, mouse
ggaagccagactgtttggga

SEQ ID NO: 659891 - DNA, 20 bp, mouse
gggagaaggtccaaggtatc

SEQ ID NO: 659892 - DNA, 20 bp, mouse
gtggccgtacagggacacaa

SEQ ID NO: 659893 - DNA, 20 bp, mouse
ggtgtcttcagtattgggtg

SEQ ID NO: 659894 - DNA, 20 bp, mouse
gtaaaggggatggacttggg

SEQ ID NO: 659895 - DNA, 20 bp, mouse
gggctgtaactcaactaaag

SEQ ID NO: 659896 - DNA, 20 bp, mouse
gaacaagaagtcagcggcgg

SEQ ID NO: 659897 - DNA, 20 bp, mouse
ggcggtggcgggaggatgct

SEQ ID NO: 659898 - DNA, 20 bp, mouse
gccgctgacttcttgttcaa

SEQ ID NO: 659899 - DNA, 20 bp, mouse
gttcaaaggggtactttggg

SEQ ID NO: 659900 - DNA, 20 bp, mouse
gcaactctggcctgggatca

SEQ ID NO: 659901 - DNA, 20 bp, mouse
gcttatggagccatacactg

SEQ ID NO: 659902 - DNA, 20 bp, mouse
gttgttcaaaggggtacttt

SEQ ID NO: 659903 - DNA, 20 bp, mouse
gaatcttaactggacttaaa

SEQ ID NO: 659904 - DNA, 20 bp, mouse
gagttgaaatgaatcttaac

SEQ ID NO: 659905 - DNA, 20 bp, mouse
gagtagccaaagaggggatt

SEQ ID NO: 659906 - DNA, 20 bp, mouse
gctggggcactgggtaagag

SEQ ID NO: 659907 - DNA, 20 bp, mouse
gagggcagcgacagctgctg

SEQ ID NO: 659908 - DNA, 20 bp, mouse
gatgggcggggcttccggaa

SEQ ID NO: 659909 - DNA, 20 bp, mouse
gtgggtaagaggggcgtggt

SEQ ID NO: 659910 - DNA, 20 bp, mouse
gacaatgcctggaatgggcg

SEQ ID NO: 659911 - DNA, 20 bp, mouse
gtcaaccatcatcccggcta

SEQ ID NO: 659912 - DNA, 20 bp, mouse
gcggaagccccgcccattcc

SEQ ID NO: 659913 - DNA, 20 bp, mouse
gtgggtgagcgggagtgcaa

SEQ ID NO: 659914 - DNA, 20 bp, mouse
gtcgtcactcggacacatat

SEQ ID NO: 659915 - DNA, 20 bp, mouse
gccactgggcaggatcagga

SEQ ID NO: 659916 - DNA, 20 bp, mouse
gcagacctggagtgcttctc

SEQ ID NO: 659917 - DNA, 20 bp, mouse
gccaccagcattcggaccca

SEQ ID NO: 659918 - DNA, 20 bp, mouse
gggggcctgccactgagtag

SEQ ID NO: 659919 - DNA, 20 bp, mouse
gcggctctgcccctactcag

SEQ ID NO: 659920 - DNA, 20 bp, mouse
gacccgaaagagactggtga

SEQ ID NO: 659921 - DNA, 20 bp, mouse
gaatccgtgggtccgaatgc

SEQ ID NO: 659922 - DNA, 20 bp, mouse
gccgggagaaggttctgaag

SEQ ID NO: 659923 - DNA, 20 bp, mouse
ggaagcggaagaaacagacc

SEQ ID NO: 659924 - DNA, 20 bp, mouse
gaggcggaaccggaagaccc

SEQ ID NO: 659925 - DNA, 20 bp, mouse
gcgggaatgtaaataaggga

SEQ ID NO: 659926 - DNA, 20 bp, mouse
gaggcacaacctgggaacag

SEQ ID NO: 659927 - DNA, 20 bp, mouse
ggaaaagttagtcaagaagt

SEQ ID NO: 659928 - DNA, 20 bp, mouse
gtacttccctaaagtatgtg

SEQ ID NO: 659929 - DNA, 20 bp, mouse
gtgtctccaagggaggggga

SEQ ID NO: 659930 - DNA, 20 bp, mouse
gtctgtagttcaggctgaac

SEQ ID NO: 659931 - DNA, 20 bp, mouse
gacttttccccacatacttt

SEQ ID NO: 659932 - DNA, 20 bp, mouse
gaacctgggaacagagggag

SEQ ID NO: 659933 - DNA, 20 bp, mouse
gaagaaaggaggcacaacct

SEQ ID NO: 659934 - DNA, 20 bp, mouse
gaaaccctgtctccaaggga

SEQ ID NO: 659935 - DNA, 20 bp, mouse
gccaggggacaacagaagaa

SEQ ID NO: 659936 - DNA, 20 bp, mouse
ggacttccaggatgagggtg

SEQ ID NO: 659937 - DNA, 20 bp, mouse
ggtgtggtgttgctgaacca

SEQ ID NO: 659938 - DNA, 20 bp, mouse
ggttgctgaaccaaggagca

SEQ ID NO: 659939 - DNA, 20 bp, mouse
gcaacaccacaccctcatcc

SEQ ID NO: 659940 - DNA, 20 bp, mouse
gaagagtgggccactagttc

SEQ ID NO: 659941 - DNA, 20 bp, mouse
gaggtctgagccagaactag

SEQ ID NO: 659942 - DNA, 20 bp, mouse
gtaaagagaaattaatagaa

SEQ ID NO: 659943 - DNA, 20 bp, mouse
gcagccaggatttcaagagt

SEQ ID NO: 659944 - DNA, 20 bp, mouse
ggaaatagggactcattcta

SEQ ID NO: 659945 - DNA, 20 bp, mouse
gtaggaaattcaccatggat

SEQ ID NO: 659946 - DNA, 20 bp, mouse
ggggaacagtagaattcttg

SEQ ID NO: 659947 - DNA, 20 bp, mouse
gcaagtgtgaagatgatagg

SEQ ID NO: 659948 - DNA, 20 bp, mouse
gctctctctgctccaaaacc

SEQ ID NO: 659949 - DNA, 20 bp, mouse
ggtgcaagtgtgaagatgat

SEQ ID NO: 659950 - DNA, 20 bp, mouse
gcagaattcaaatggagata

SEQ ID NO: 659951 - DNA, 20 bp, mouse
gaacacgtgtaaatgtcttt

SEQ ID NO: 659952 - DNA, 20 bp, mouse
gttcaaatggagataaggat

SEQ ID NO: 659953 - DNA, 20 bp, mouse
ggttttcagaatgctccttc

SEQ ID NO: 659954 - DNA, 20 bp, mouse
gagcagagagagcatccaga

SEQ ID NO: 659955 - DNA, 20 bp, mouse
gagcattctgaaaacagaga

SEQ ID NO: 659956 - DNA, 20 bp, mouse
gcatgtgcccatgttagtaa

SEQ ID NO: 659957 - DNA, 20 bp, mouse
gcccaagcccttactaacat

SEQ ID NO: 659958 - DNA, 20 bp, mouse
gccccactagctctgtctaa

SEQ ID NO: 659959 - DNA, 20 bp, mouse
gaagtggtatagctgggtag

SEQ ID NO: 659960 - DNA, 20 bp, mouse
gaccacattggtctccacag

SEQ ID NO: 659961 - DNA, 20 bp, mouse
gaagctgtttagctggacgg

SEQ ID NO: 659962 - DNA, 20 bp, mouse
gcggctgttcggcaaacttg

SEQ ID NO: 659963 - DNA, 20 bp, mouse
gagctgggtagtggtataac

SEQ ID NO: 659964 - DNA, 20 bp, mouse
gaacctttagacagagctag

SEQ ID NO: 659965 - DNA, 20 bp, mouse
ggcctctgtggagaccaatg

SEQ ID NO: 659966 - DNA, 20 bp, mouse
gtggctcggacgaaaaggaa

SEQ ID NO: 659967 - DNA, 20 bp, mouse
gaggaaggggcgggtcgcgt

SEQ ID NO: 659968 - DNA, 20 bp, mouse
gggaacctccagacctgggg

SEQ ID NO: 659969 - DNA, 20 bp, mouse
gcagctggaacctccagacc

SEQ ID NO: 659970 - DNA, 20 bp, mouse
gagggcacgtacatgtgaat

SEQ ID NO: 659971 - DNA, 20 bp, mouse
gcccctagagcagccgctct

SEQ ID NO: 659972 - DNA, 20 bp, mouse
gaggcagccggaggtcgcac

SEQ ID NO: 659973 - DNA, 20 bp, mouse
gggctgctctaggggcatgc

SEQ ID NO: 659974 - DNA, 20 bp, mouse
gtcggacgaaaaggaagggg

SEQ ID NO: 659975 - DNA, 20 bp, mouse
ggtgcttggctcggacgaaa

SEQ ID NO: 659976 - DNA, 20 bp, mouse
gtgactgcacggaggatcag

SEQ ID NO: 659977 - DNA, 20 bp, mouse
ggtggaaggggcatcgggca

SEQ ID NO: 659978 - DNA, 20 bp, mouse
gcatacagctcccgggtgga

SEQ ID NO: 659979 - DNA, 20 bp, mouse
gcccgggtggaaggggcatc

SEQ ID NO: 659980 - DNA, 20 bp, mouse
gaagccgcccatacagctcc

SEQ ID NO: 659981 - DNA, 20 bp, mouse
gggtgagagagcaacggtgt

SEQ ID NO: 659982 - DNA, 20 bp, mouse
gcaacaggcctccacaatgg

SEQ ID NO: 659983 - DNA, 20 bp, mouse
gcgtgcagtcacatagcaac

SEQ ID NO: 659984 - DNA, 20 bp, mouse
gcgcccatacagctcccggg

SEQ ID NO: 659985 - DNA, 20 bp, mouse
gcccgcggctcttcattgtt

SEQ ID NO: 659986 - DNA, 20 bp, mouse
gcgccccaccagcctgtgag

SEQ ID NO: 659987 - DNA, 20 bp, mouse
ggaggcccatgaccaggctg

SEQ ID NO: 659988 - DNA, 20 bp, mouse
gctagatgatccattcccac

SEQ ID NO: 659989 - DNA, 20 bp, mouse
gcagcctgtgagaggcacac

SEQ ID NO: 659990 - DNA, 20 bp, mouse
ggtgtagcagtgcagcctgt

SEQ ID NO: 659991 - DNA, 20 bp, mouse
gcccccaccccagaaaagtc

SEQ ID NO: 659992 - DNA, 20 bp, mouse
gccagaaaagtctggacggc

SEQ ID NO: 659993 - DNA, 20 bp, mouse
gtccagagaggcccatgacc

SEQ ID NO: 659994 - DNA, 20 bp, mouse
gtagacaaagaacacgggac

SEQ ID NO: 659995 - DNA, 20 bp, mouse
gcgtccagacttttctgggg

SEQ ID NO: 659996 - DNA, 20 bp, mouse
ggagcacacagtaggagtaa

SEQ ID NO: 659997 - DNA, 20 bp, mouse
gatcagagagcacagactag

SEQ ID NO: 659998 - DNA, 20 bp, mouse
ggtaggtgattgcggctgcc

SEQ ID NO: 659999 - DNA, 20 bp, mouse
gatgctgtggtaggtgattg

SEQ ID NO: 660000 - DNA, 20 bp, mouse
gctagagcatagcctagaca

SEQ ID NO: 660001 - DNA, 20 bp, mouse
gctctagggtgcttgtctct

SEQ ID NO: 660002 - DNA, 20 bp, mouse
gtgtgtgggggggagtgtcc

SEQ ID NO: 660003 - DNA, 20 bp, mouse
gagttttatgtcaacttgga

SEQ ID NO: 660004 - DNA, 20 bp, mouse
gcttgggccatgtcagaacc

SEQ ID NO: 660005 - DNA, 20 bp, mouse
gccacccagtgctccagctg

SEQ ID NO: 660006 - DNA, 20 bp, mouse
gcatagggttcttgtctcta

SEQ ID NO: 660007 - DNA, 20 bp, mouse
gcctatgcatagcctagaca

SEQ ID NO: 660008 - DNA, 20 bp, mouse
ggtgttgggggggagtgtcc

SEQ ID NO: 660009 - DNA, 20 bp, mouse
gagagagcacacagtaggag

SEQ ID NO: 660010 - DNA, 20 bp, mouse
ggagcacacagtaggagtgg

SEQ ID NO: 660011 - DNA, 20 bp, mouse
ggccctacaaccggatctta

SEQ ID NO: 660012 - DNA, 20 bp, mouse
gtccataagatccggttgta

SEQ ID NO: 660013 - DNA, 20 bp, mouse
gagttttatgtcaacttgga

SEQ ID NO: 660014 - DNA, 20 bp, mouse
ggcctggcagtctccgattg

SEQ ID NO: 660015 - DNA, 20 bp, mouse
gcgacccagtgctccagctg

SEQ ID NO: 660016 - DNA, 20 bp, mouse
gtccgtggacagggcagatg

SEQ ID NO: 660017 - DNA, 20 bp, mouse
ggcagctctcacaattgtcg

SEQ ID NO: 660018 - DNA, 20 bp, mouse
gatgccccttacctgtcctc

SEQ ID NO: 660019 - DNA, 20 bp, mouse
gcaatgttgtttgtctcccg

SEQ ID NO: 660020 - DNA, 20 bp, mouse
gcttttgcgggtgtgaaaac

SEQ ID NO: 660021 - DNA, 20 bp, mouse
gggacagggcagatggggca

SEQ ID NO: 660022 - DNA, 20 bp, mouse
gcagatggggcatggttcag

SEQ ID NO: 660023 - DNA, 20 bp, mouse
gtctccctgtctttacttat

SEQ ID NO: 660024 - DNA, 20 bp, mouse
gtctcccgaggacaggtaag

SEQ ID NO: 660025 - DNA, 20 bp, mouse
gctagagaagtagtcaatga

SEQ ID NO: 660026 - DNA, 20 bp, mouse
gagggtgtgaggagcggctg

SEQ ID NO: 660027 - DNA, 20 bp, mouse
ggagagaaagagcacatagt

SEQ ID NO: 660028 - DNA, 20 bp, mouse
gggcaaggccctgagagtta

SEQ ID NO: 660029 - DNA, 20 bp, mouse
gttagtcctagcagcatccc

SEQ ID NO: 660030 - DNA, 20 bp, mouse
gggccctgagagttaaggag

SEQ ID NO: 660031 - DNA, 20 bp, mouse
gaaagagcacatagtaggag

SEQ ID NO: 660032 - DNA, 20 bp, mouse
gatgtaagcaggagtggccg

SEQ ID NO: 660033 - DNA, 20 bp, mouse
gatgctgctaggactaattt

SEQ ID NO: 660034 - DNA, 20 bp, mouse
gtggcctctccttaactctc

SEQ ID NO: 660035 - DNA, 20 bp, mouse
gcgctggagggtgtgaggag

SEQ ID NO: 660036 - DNA, 20 bp, mouse
gccccccctggcagcttcaa

SEQ ID NO: 660037 - DNA, 20 bp, mouse
gggccgacagggaggggacg

SEQ ID NO: 660038 - DNA, 20 bp, mouse
gaggcaggggccagggtggg

SEQ ID NO: 660039 - DNA, 20 bp, mouse
gggaggggacggggcggaga

SEQ ID NO: 660040 - DNA, 20 bp, mouse
gcgggcgggccgacagggag

SEQ ID NO: 660041 - DNA, 20 bp, mouse
gctgggcgggcgggccgaca

SEQ ID NO: 660042 - DNA, 20 bp, mouse
gccagggtggggggcgtgag

SEQ ID NO: 660043 - DNA, 20 bp, mouse
ggcttcctttgaagctgcca

SEQ ID NO: 660044 - DNA, 20 bp, mouse
gctaggcagaagaaagtgag

SEQ ID NO: 660045 - DNA, 20 bp, mouse
ggaagcaattttcttgtaga

SEQ ID NO: 660046 - DNA, 20 bp, mouse
gtgttggtgagtagagtgta

SEQ ID NO: 660047 - DNA, 20 bp, mouse
gaaaacggggcaggcaacca

SEQ ID NO: 660048 - DNA, 20 bp, mouse
gccagggcctaaaacggggc

SEQ ID NO: 660049 - DNA, 20 bp, mouse
gaagaccagggcctaaaacg

SEQ ID NO: 660050 - DNA, 20 bp, mouse
gatctccatgagaccattaa

SEQ ID NO: 660051 - DNA, 20 bp, mouse
gcatcagtagcaagttcagg

SEQ ID NO: 660052 - DNA, 20 bp, mouse
gggcagtgatggcattacca

SEQ ID NO: 660053 - DNA, 20 bp, mouse
gagggctaaaggccttctca

SEQ ID NO: 660054 - DNA, 20 bp, mouse
gacaaatgaggttgggaaga

SEQ ID NO: 660055 - DNA, 20 bp, mouse
gtgaacctttaatggtctca

SEQ ID NO: 660056 - DNA, 20 bp, mouse
gagagcaggcgacctctctg

SEQ ID NO: 660057 - DNA, 20 bp, mouse
gagggaaggcgggtccgcac

SEQ ID NO: 660058 - DNA, 20 bp, mouse
gtcgctcagggaggtggatg

SEQ ID NO: 660059 - DNA, 20 bp, mouse
gcacgggtcctcagagcgag

SEQ ID NO: 660060 - DNA, 20 bp, mouse
gacccggatcgcatctggcc

SEQ ID NO: 660061 - DNA, 20 bp, mouse
ggggggacccggatcgcatc

SEQ ID NO: 660062 - DNA, 20 bp, mouse
gggccacgcccctcgctctg

SEQ ID NO: 660063 - DNA, 20 bp, mouse
ggcaggagctagcaacagat

SEQ ID NO: 660064 - DNA, 20 bp, mouse
gacctctctggggacttgcc

SEQ ID NO: 660065 - DNA, 20 bp, mouse
gccaccctgcatagtcttgc

SEQ ID NO: 660066 - DNA, 20 bp, mouse
gcgaacccggttgccggaga

SEQ ID NO: 660067 - DNA, 20 bp, mouse
ggtgctgcacggaccctctc

SEQ ID NO: 660068 - DNA, 20 bp, mouse
gggttgcagaaggatagcaa

SEQ ID NO: 660069 - DNA, 20 bp, mouse
gaaccgggctgaggattttg

SEQ ID NO: 660070 - DNA, 20 bp, mouse
gcgtgcagattcttgtacac

SEQ ID NO: 660071 - DNA, 20 bp, mouse
ggagcagatagggttgcaga

SEQ ID NO: 660072 - DNA, 20 bp, mouse
gcggaggctggcaggaattt

SEQ ID NO: 660073 - DNA, 20 bp, mouse
ggggcaggtaataaagcagg

SEQ ID NO: 660074 - DNA, 20 bp, mouse
gcaatgctccagttgtcaca

SEQ ID NO: 660075 - DNA, 20 bp, mouse
gggaaaccgaacccggttgc

SEQ ID NO: 660076 - DNA, 20 bp, mouse
gcaagcacagctcacctcga

SEQ ID NO: 660077 - DNA, 20 bp, mouse
gagaggtgggttgcacccgt

SEQ ID NO: 660078 - DNA, 20 bp, mouse
gtggtctggagatgtggaac

SEQ ID NO: 660079 - DNA, 20 bp, mouse
gggggactatggagagaagg

SEQ ID NO: 660080 - DNA, 20 bp, mouse
gggggtctgcagacgcctac

SEQ ID NO: 660081 - DNA, 20 bp, mouse
gtagcaagagatggagtgca

SEQ ID NO: 660082 - DNA, 20 bp, mouse
gaagctacgagagaactgaa

SEQ ID NO: 660083 - DNA, 20 bp, mouse
gagtgctcctgtacttcagt

SEQ ID NO: 660084 - DNA, 20 bp, mouse
gctgacgccagtagaaaggg

SEQ ID NO: 660085 - DNA, 20 bp, mouse
gactgaagggtagcaagaga

SEQ ID NO: 660086 - DNA, 20 bp, mouse
gcaagctaaaggcagttgtt

SEQ ID NO: 660087 - DNA, 20 bp, mouse
gaaggagcaaagaacatcct

SEQ ID NO: 660088 - DNA, 20 bp, mouse
gccagtgaagggtagtgtgt

SEQ ID NO: 660089 - DNA, 20 bp, mouse
gacatcctcggctctaagta

SEQ ID NO: 660090 - DNA, 20 bp, mouse
ggcaggcagaataatggagc

SEQ ID NO: 660091 - DNA, 20 bp, mouse
gaagcaagctgagacagtag

SEQ ID NO: 660092 - DNA, 20 bp, mouse
gcagttgttgggttactaac

SEQ ID NO: 660093 - DNA, 20 bp, mouse
gaaagccctacttagagccg

SEQ ID NO: 660094 - DNA, 20 bp, mouse
ggcagccagagctttataaa

SEQ ID NO: 660095 - DNA, 20 bp, mouse
gataggaaatggacagtgga

SEQ ID NO: 660096 - DNA, 20 bp, mouse
ggacccacgggcctgaagat

SEQ ID NO: 660097 - DNA, 20 bp, mouse
gaaagcgccctcaggttccg

SEQ ID NO: 660098 - DNA, 20 bp, mouse
gtgggagccgcggaacctga

SEQ ID NO: 660099 - DNA, 20 bp, mouse
gaagcaggcaaagcgccctc

SEQ ID NO: 660100 - DNA, 20 bp, mouse
gcggatggggtctcagaaca

SEQ ID NO: 660101 - DNA, 20 bp, mouse
gccgcatagagggtggagcg

SEQ ID NO: 660102 - DNA, 20 bp, mouse
gaaacaagaaatggcagttg

SEQ ID NO: 660103 - DNA, 20 bp, mouse
gctcccatcttcaggcccgt

SEQ ID NO: 660104 - DNA, 20 bp, mouse
gggacggcgtgaagtcccat

SEQ ID NO: 660105 - DNA, 20 bp, mouse
gtagagggtggagcggggct

SEQ ID NO: 660106 - DNA, 20 bp, mouse
ggggttaaatgggagcgagt

SEQ ID NO: 660107 - DNA, 20 bp, mouse
ggctgcgggctgggttaaat

SEQ ID NO: 660108 - DNA, 20 bp, mouse
gcgagccgaggagtaaggag

SEQ ID NO: 660109 - DNA, 20 bp, mouse
ggcagcctctccttactcct

SEQ ID NO: 660110 - DNA, 20 bp, mouse
gtaaggagaggctgcgggct

SEQ ID NO: 660111 - DNA, 20 bp, mouse
ggggaagggggggttgctca

SEQ ID NO: 660112 - DNA, 20 bp, mouse
gtgctggaggggacgagccg

SEQ ID NO: 660113 - DNA, 20 bp, mouse
gcagacgtgcttggagtcac

SEQ ID NO: 660114 - DNA, 20 bp, mouse
gttaaatgggagcgagtggg

SEQ ID NO: 660115 - DNA, 20 bp, mouse
gggggacgagccgaggagta

SEQ ID NO: 660116 - DNA, 20 bp, mouse
ggcgcctcggggaagacgaa

SEQ ID NO: 660117 - DNA, 20 bp, mouse
gcccgcgccctgcagcgcct

SEQ ID NO: 660118 - DNA, 20 bp, mouse
gggggcggggacacctgatt

SEQ ID NO: 660119 - DNA, 20 bp, mouse
ggggaagacgaacggctcgc

SEQ ID NO: 660120 - DNA, 20 bp, mouse
gccgcggtccagcccggagg

SEQ ID NO: 660121 - DNA, 20 bp, mouse
gggtccagcccggagggggg

SEQ ID NO: 660122 - DNA, 20 bp, mouse
ggagccgttcgtcttccccg

SEQ ID NO: 660123 - DNA, 20 bp, mouse
gcgcgcgcgggtgtgcgaga

SEQ ID NO: 660124 - DNA, 20 bp, mouse
gcatccgcggtccagcccgg

SEQ ID NO: 660125 - DNA, 20 bp, mouse
gtggagacctaccctgaaaa

SEQ ID NO: 660126 - DNA, 20 bp, mouse
gagcccctggcctaattcaa

SEQ ID NO: 660127 - DNA, 20 bp, mouse
gtagctgggaagctgcctgt

SEQ ID NO: 660128 - DNA, 20 bp, mouse
gtgggaggagaagtcgagat

SEQ ID NO: 660129 - DNA, 20 bp, mouse
gggcctctgaccttgatctg

SEQ ID NO: 660130 - DNA, 20 bp, mouse
ggaccccagatcaaggtcag

SEQ ID NO: 660131 - DNA, 20 bp, mouse
gtggcagcttaagtgggtca

SEQ ID NO: 660132 - DNA, 20 bp, mouse
gcgagattggtctcctagat

SEQ ID NO: 660133 - DNA, 20 bp, mouse
ggcccaccagcctttgaatt

SEQ ID NO: 660134 - DNA, 20 bp, mouse
ggatacctgaccccagatca

SEQ ID NO: 660135 - DNA, 20 bp, mouse
gcagcctttgaattaggcca

SEQ ID NO: 660136 - DNA, 20 bp, mouse
gcagccgcagcgcgcccggg

SEQ ID NO: 660137 - DNA, 20 bp, mouse
gcgggcggagcatggcgagg

SEQ ID NO: 660138 - DNA, 20 bp, mouse
ggggtactcacccttcccgg

SEQ ID NO: 660139 - DNA, 20 bp, mouse
gctccgctggcctccgggaa

SEQ ID NO: 660140 - DNA, 20 bp, mouse
gtacccgatggctgccgggt

SEQ ID NO: 660141 - DNA, 20 bp, mouse
ggatcccggccttaggaggg

SEQ ID NO: 660142 - DNA, 20 bp, mouse
ggctgcggggcctcgcgctg

SEQ ID NO: 660143 - DNA, 20 bp, mouse
gccggaggccagcggagctt

SEQ ID NO: 660144 - DNA, 20 bp, mouse
gcctctctacctccctccta

SEQ ID NO: 660145 - DNA, 20 bp, mouse
gccgcagccgcagcgcgccc

SEQ ID NO: 660146 - DNA, 20 bp, mouse
gcccgcccgctgctccccgt

SEQ ID NO: 660147 - DNA, 20 bp, mouse
gagcccgagggtccacgcga

SEQ ID NO: 660148 - DNA, 20 bp, mouse
gtaggctcgaactgggtgag

SEQ ID NO: 660149 - DNA, 20 bp, mouse
ggcctcgcgcgctcattggc

SEQ ID NO: 660150 - DNA, 20 bp, mouse
ggccgcgcggcgtgtggacg

SEQ ID NO: 660151 - DNA, 20 bp, mouse
gcaatgagcgcgcgaggcgg

SEQ ID NO: 660152 - DNA, 20 bp, mouse
gcggctctgtgcgctcggag

SEQ ID NO: 660153 - DNA, 20 bp, mouse
gggggagcagcgggcgggag

SEQ ID NO: 660154 - DNA, 20 bp, mouse
gtgctccccgtgggcctggc

SEQ ID NO: 660155 - DNA, 20 bp, mouse
gggtgcgtgtgagagggcgc

SEQ ID NO: 660156 - DNA, 20 bp, mouse
gaatgatgggagactacgga

SEQ ID NO: 660157 - DNA, 20 bp, mouse
gcacagccgactgctgaaga

SEQ ID NO: 660158 - DNA, 20 bp, mouse
gcgactgctgaagagggatg

SEQ ID NO: 660159 - DNA, 20 bp, mouse
gccgcgctgaggcggaatga

SEQ ID NO: 660160 - DNA, 20 bp, mouse
ggaggaatgatgggagacta

SEQ ID NO: 660161 - DNA, 20 bp, mouse
gagggggaaccgcgctgagg

SEQ ID NO: 660162 - DNA, 20 bp, mouse
gtgaggcggaatgaaggctg

SEQ ID NO: 660163 - DNA, 20 bp, mouse
ggggagactacggagggctg

SEQ ID NO: 660164 - DNA, 20 bp, mouse
ggaactagctgaggaatgat

SEQ ID NO: 660165 - DNA, 20 bp, mouse
gaggagggggaaccgcgctg

SEQ ID NO: 660166 - DNA, 20 bp, mouse
ggacgcgcgcggaacactgg

SEQ ID NO: 660167 - DNA, 20 bp, mouse
ggcgcccgccaatcaacgat

SEQ ID NO: 660168 - DNA, 20 bp, mouse
ggcggaccaggtgggcgcaa

SEQ ID NO: 660169 - DNA, 20 bp, mouse
gaaagcagtgagcgtaaaat

SEQ ID NO: 660170 - DNA, 20 bp, mouse
gctgccgggtccctgggctg

SEQ ID NO: 660171 - DNA, 20 bp, mouse
gaggagcagtgcggcggcgc

SEQ ID NO: 660172 - DNA, 20 bp, mouse
gaggcgggtacagagcacaa

SEQ ID NO: 660173 - DNA, 20 bp, mouse
gtacatctcccacaatgcta

SEQ ID NO: 660174 - DNA, 20 bp, mouse
gggctccaatcgttgattgg

SEQ ID NO: 660175 - DNA, 20 bp, mouse
ggctgggagcggaaggcttg

SEQ ID NO: 660176 - DNA, 20 bp, mouse
ggggtcctaccggctcgcta

SEQ ID NO: 660177 - DNA, 20 bp, mouse
gctcgctacgggggacagga

SEQ ID NO: 660178 - DNA, 20 bp, mouse
gcccgggcgagcacgaggaa

SEQ ID NO: 660179 - DNA, 20 bp, mouse
gggaaacccaagggtcctac

SEQ ID NO: 660180 - DNA, 20 bp, mouse
gggagggcggagcatccgga

SEQ ID NO: 660181 - DNA, 20 bp, mouse
gtcctaccggctcgctacgg

SEQ ID NO: 660182 - DNA, 20 bp, mouse
gcggagggcggggctatcac

SEQ ID NO: 660183 - DNA, 20 bp, mouse
gggcgagcacgaggaaaggt

SEQ ID NO: 660184 - DNA, 20 bp, mouse
ggagcacgaggaaaggtagg

SEQ ID NO: 660185 - DNA, 20 bp, mouse
gggcggggctatcacagggg

SEQ ID NO: 660186 - DNA, 20 bp, mouse
gctggcggggacacagtagc

SEQ ID NO: 660187 - DNA, 20 bp, mouse
gtaaaggggcgggacgggga

SEQ ID NO: 660188 - DNA, 20 bp, mouse
gcccggagggaggagttaaa

SEQ ID NO: 660189 - DNA, 20 bp, mouse
gagggcgcggccacctatca

SEQ ID NO: 660190 - DNA, 20 bp, mouse
ggacacagtagcaggtctac

SEQ ID NO: 660191 - DNA, 20 bp, mouse
ggcaggtctacaggcgacag

SEQ ID NO: 660192 - DNA, 20 bp, mouse
gctccggggctccaaatccc

SEQ ID NO: 660193 - DNA, 20 bp, mouse
ggggttctgtagctacttat

SEQ ID NO: 660194 - DNA, 20 bp, mouse
ggggagagctccctatacac

SEQ ID NO: 660195 - DNA, 20 bp, mouse
gagcacactcgcagacgcac

SEQ ID NO: 660196 - DNA, 20 bp, mouse
gcaggaggagggatcctgga

SEQ ID NO: 660197 - DNA, 20 bp, mouse
gtaaaaggcagtgtcgtgtc

SEQ ID NO: 660198 - DNA, 20 bp, mouse
gtgagcaacgcggggatcca

SEQ ID NO: 660199 - DNA, 20 bp, mouse
ggcaacgcggggatccaggg

SEQ ID NO: 660200 - DNA, 20 bp, mouse
gccagccgcgggcgggtcag

SEQ ID NO: 660201 - DNA, 20 bp, mouse
ggcagtgtcgtgtccggagg

SEQ ID NO: 660202 - DNA, 20 bp, mouse
gagaaaggaccagccgcggg

SEQ ID NO: 660203 - DNA, 20 bp, mouse
gtggggctaggcaaagagaa

SEQ ID NO: 660204 - DNA, 20 bp, mouse
ggaagtcgtaagcacgtccg

SEQ ID NO: 660205 - DNA, 20 bp, mouse
gacgcggtgacactgaattg

SEQ ID NO: 660206 - DNA, 20 bp, mouse
gcgggaatctgggtagtgat

SEQ ID NO: 660207 - DNA, 20 bp, mouse
ggggctgcagtggtcctctc

SEQ ID NO: 660208 - DNA, 20 bp, mouse
gcacccaatgccacctctcg

SEQ ID NO: 660209 - DNA, 20 bp, mouse
gggtcctcgagaggtggcat

SEQ ID NO: 660210 - DNA, 20 bp, mouse
gcaccactggccatcacggg

SEQ ID NO: 660211 - DNA, 20 bp, mouse
gggccccagtagttctctcg

SEQ ID NO: 660212 - DNA, 20 bp, mouse
ggccccagcaggaggctgta

SEQ ID NO: 660213 - DNA, 20 bp, mouse
gcactacccagattcccgag

SEQ ID NO: 660214 - DNA, 20 bp, mouse
ggggtcctagtcgtcctcct

SEQ ID NO: 660215 - DNA, 20 bp, mouse
gccgaccacgccccagcagg

SEQ ID NO: 660216 - DNA, 20 bp, mouse
gcgctccggccctgctttta

SEQ ID NO: 660217 - DNA, 20 bp, mouse
gagaaactgcagcccgtgat

SEQ ID NO: 660218 - DNA, 20 bp, mouse
gtgtgcgtagaacccatcac

SEQ ID NO: 660219 - DNA, 20 bp, mouse
gcacaagcggcgacagggga

SEQ ID NO: 660220 - DNA, 20 bp, mouse
ggcagtttctgtctgatatg

SEQ ID NO: 660221 - DNA, 20 bp, mouse
ggaacaaagtgttaacgcgt

SEQ ID NO: 660222 - DNA, 20 bp, mouse
ggggagaggtcatgagttcg

SEQ ID NO: 660223 - DNA, 20 bp, mouse
gccgcctcttccgggcataa

SEQ ID NO: 660224 - DNA, 20 bp, mouse
ggagacacaagcggcgacag

SEQ ID NO: 660225 - DNA, 20 bp, mouse
ggaggggacccaggtgatgt

SEQ ID NO: 660226 - DNA, 20 bp, mouse
gtaagtagactggttgggtg

SEQ ID NO: 660227 - DNA, 20 bp, mouse
gctttctaagtagactggtt

SEQ ID NO: 660228 - DNA, 20 bp, mouse
ggagaacatgaagactcttg

SEQ ID NO: 660229 - DNA, 20 bp, mouse
gtttgagaatgcttttgcag

SEQ ID NO: 660230 - DNA, 20 bp, mouse
ggaacaaacttgaaaatcgg

SEQ ID NO: 660231 - DNA, 20 bp, mouse
gggggccagtttttgacaaa

SEQ ID NO: 660232 - DNA, 20 bp, mouse
gctagaaatcagcccactca

SEQ ID NO: 660233 - DNA, 20 bp, mouse
gaagtcaatataacccaagc

SEQ ID NO: 660234 - DNA, 20 bp, mouse
gaaagttttaaaaccagctt

SEQ ID NO: 660235 - DNA, 20 bp, mouse
gagaccctttctaagtagac

SEQ ID NO: 660236 - DNA, 20 bp, mouse
ggggaagcgcggtgagggtg

SEQ ID NO: 660237 - DNA, 20 bp, mouse
gagggctccggggaactcca

SEQ ID NO: 660238 - DNA, 20 bp, mouse
gccctggaggaaagcaccgc

SEQ ID NO: 660239 - DNA, 20 bp, mouse
gagggtgggggcagtggcta

SEQ ID NO: 660240 - DNA, 20 bp, mouse
gcagccagggtggccaccaa

SEQ ID NO: 660241 - DNA, 20 bp, mouse
gagggtggccaccaagggtg

SEQ ID NO: 660242 - DNA, 20 bp, mouse
gtcgcctggcctgtggggtg

SEQ ID NO: 660243 - DNA, 20 bp, mouse
gggtctgagcagccctgagc

SEQ ID NO: 660244 - DNA, 20 bp, mouse
ggtggccaccaagggtgagg

SEQ ID NO: 660245 - DNA, 20 bp, mouse
gcaggagggaagcgcggtga

SEQ ID NO: 660246 - DNA, 20 bp, mouse
ggccaggcgcagatgggcgt

SEQ ID NO: 660247 - DNA, 20 bp, mouse
gcatctgcgcctggccttgt

SEQ ID NO: 660248 - DNA, 20 bp, mouse
ggctccccagaggacacgga

SEQ ID NO: 660249 - DNA, 20 bp, mouse
gccgccacgcccacaaggcc

SEQ ID NO: 660250 - DNA, 20 bp, mouse
gccccagaggacacggaggg

SEQ ID NO: 660251 - DNA, 20 bp, mouse
gaggacacggagggtggccg

SEQ ID NO: 660252 - DNA, 20 bp, mouse
gtgtgggcgtggcgggcgca

SEQ ID NO: 660253 - DNA, 20 bp, mouse
ggcgtggggcgggactttcc

SEQ ID NO: 660254 - DNA, 20 bp, mouse
ggtggccgagggcggtggac

SEQ ID NO: 660255 - DNA, 20 bp, mouse
gcgctggaaaagaaagtcaa

SEQ ID NO: 660256 - DNA, 20 bp, mouse
gggagagagggccgcaccaa

SEQ ID NO: 660257 - DNA, 20 bp, mouse
gggaacgtcgcccgccaggc

SEQ ID NO: 660258 - DNA, 20 bp, mouse
gagagggccgcaccaaagga

SEQ ID NO: 660259 - DNA, 20 bp, mouse
gaaggaggggccggagccca

SEQ ID NO: 660260 - DNA, 20 bp, mouse
gccaggccaagcgagctcgc

SEQ ID NO: 660261 - DNA, 20 bp, mouse
ggggcctcagaagaagaagg

SEQ ID NO: 660262 - DNA, 20 bp, mouse
gtcaagcgcctgcacgcaca

SEQ ID NO: 660263 - DNA, 20 bp, mouse
ggagcagagggaagctaata

SEQ ID NO: 660264 - DNA, 20 bp, mouse
gagagctcccagggcccggt

SEQ ID NO: 660265 - DNA, 20 bp, mouse
gttggcctggccggcctggc

SEQ ID NO: 660266 - DNA, 20 bp, mouse
gaaaaagcatctctcaatag

SEQ ID NO: 660267 - DNA, 20 bp, mouse
ggacccagacaggggcctgc

SEQ ID NO: 660268 - DNA, 20 bp, mouse
gcagtctagaggcaaatcaa

SEQ ID NO: 660269 - DNA, 20 bp, mouse
gacacttagggtctagttct

SEQ ID NO: 660270 - DNA, 20 bp, mouse
ggtggactgaccctgactca

SEQ ID NO: 660271 - DNA, 20 bp, mouse
ggctggcaggcacataacaa

SEQ ID NO: 660272 - DNA, 20 bp, mouse
ggtaggaagctaggctgtcc

SEQ ID NO: 660273 - DNA, 20 bp, mouse
gctgtgctgactgatgttca

SEQ ID NO: 660274 - DNA, 20 bp, mouse
ggcttaggggatgccattgg

SEQ ID NO: 660275 - DNA, 20 bp, mouse
gagagagattccagacactt

SEQ ID NO: 660276 - DNA, 20 bp, mouse
gtgggctaggccctccgctg

SEQ ID NO: 660277 - DNA, 20 bp, mouse
ggggcctagcccaggcactg

SEQ ID NO: 660278 - DNA, 20 bp, mouse
gcggtggcatgtccaggaga

SEQ ID NO: 660279 - DNA, 20 bp, mouse
gcagtgacggcgctacggag

SEQ ID NO: 660280 - DNA, 20 bp, mouse
gggagcgcaccgcagtgcct

SEQ ID NO: 660281 - DNA, 20 bp, mouse
gaagggacgaaagtagttgg

SEQ ID NO: 660282 - DNA, 20 bp, mouse
gggtcccggaactctggtgc

SEQ ID NO: 660283 - DNA, 20 bp, mouse
gtgggtaggtaggaggacgg

SEQ ID NO: 660284 - DNA, 20 bp, mouse
gtgacggcgctacggagagg

SEQ ID NO: 660285 - DNA, 20 bp, mouse
ggggaagggacgaaagtagt

SEQ ID NO: 660286 - DNA, 20 bp, mouse
gaccatgggccggaggttcg

SEQ ID NO: 660287 - DNA, 20 bp, mouse
gggagcggtccaaggacccc

SEQ ID NO: 660288 - DNA, 20 bp, mouse
gttaggcagccccgaacctc

SEQ ID NO: 660289 - DNA, 20 bp, mouse
gcagaaaggacatttcgtgg

SEQ ID NO: 660290 - DNA, 20 bp, mouse
gactcagaaaggacatttcg

SEQ ID NO: 660291 - DNA, 20 bp, mouse
gcatgaaggggaccatgggc

SEQ ID NO: 660292 - DNA, 20 bp, mouse
gtgcgcaagcgcagtgctag

SEQ ID NO: 660293 - DNA, 20 bp, mouse
gcgcctgaccaaatattcca

SEQ ID NO: 660294 - DNA, 20 bp, mouse
gatttcgtggcggatactga

SEQ ID NO: 660295 - DNA, 20 bp, mouse
ggaaggggaccatgggccgg

SEQ ID NO: 660296 - DNA, 20 bp, mouse
ggggccacctgtgggaacta

SEQ ID NO: 660297 - DNA, 20 bp, mouse
gacttcctggagatagttgg

SEQ ID NO: 660298 - DNA, 20 bp, mouse
gccgccctagttcccacagg

SEQ ID NO: 660299 - DNA, 20 bp, mouse
gaccctaacaaaccaaccaa

SEQ ID NO: 660300 - DNA, 20 bp, mouse
gctaatattagtggggtcac

SEQ ID NO: 660301 - DNA, 20 bp, mouse
gcaccccaaagttttctcat

SEQ ID NO: 660302 - DNA, 20 bp, mouse
gccaggaagtatttttcaga

SEQ ID NO: 660303 - DNA, 20 bp, mouse
gaaaactttggggtggcaga

SEQ ID NO: 660304 - DNA, 20 bp, mouse
gttcctcagaaacacctccg

SEQ ID NO: 660305 - DNA, 20 bp, mouse
gaccagcctggctgaaggtc

SEQ ID NO: 660306 - DNA, 20 bp, mouse
gaccgccccagcagctctag

SEQ ID NO: 660307 - DNA, 20 bp, mouse
gcccgcccctagagctgctg

SEQ ID NO: 660308 - DNA, 20 bp, mouse
gcggtcagctgcattcggat

SEQ ID NO: 660309 - DNA, 20 bp, mouse
gcgaatgcagctgaccggtc

SEQ ID NO: 660310 - DNA, 20 bp, mouse
ggccccagcagctctagggg

SEQ ID NO: 660311 - DNA, 20 bp, mouse
ggagccagaggccacggtat

SEQ ID NO: 660312 - DNA, 20 bp, mouse
ggggcgcaggagggccgtgt

SEQ ID NO: 660313 - DNA, 20 bp, mouse
ggtattggttagatccttca

SEQ ID NO: 660314 - DNA, 20 bp, mouse
gtgcggcgcggggcgcagga

SEQ ID NO: 660315 - DNA, 20 bp, mouse
gggctttagtagtacgtgct

SEQ ID NO: 660316 - DNA, 20 bp, mouse
gccgctcccgggccgaggtg

SEQ ID NO: 660317 - DNA, 20 bp, mouse
gcctcggcccgggagcggca

SEQ ID NO: 660318 - DNA, 20 bp, mouse
ggctagccccgcccggggga

SEQ ID NO: 660319 - DNA, 20 bp, mouse
ggcgggccccagagtctgaa

SEQ ID NO: 660320 - DNA, 20 bp, mouse
gtgggggctgcaatcgtggg

SEQ ID NO: 660321 - DNA, 20 bp, mouse
gcgggcggggctagccccga

SEQ ID NO: 660322 - DNA, 20 bp, mouse
gtctgaaaggccgcccctgt

SEQ ID NO: 660323 - DNA, 20 bp, mouse
gagggatcacagatggcgga

SEQ ID NO: 660324 - DNA, 20 bp, mouse
gggagggcgcccttgaagcc

SEQ ID NO: 660325 - DNA, 20 bp, mouse
gggagcttgggatcccggga

SEQ ID NO: 660326 - DNA, 20 bp, mouse
gtcggtagtgaaaccttatt

SEQ ID NO: 660327 - DNA, 20 bp, mouse
ggccaggctggctgactccc

SEQ ID NO: 660328 - DNA, 20 bp, mouse
gcataaaagagctactggaa

SEQ ID NO: 660329 - DNA, 20 bp, mouse
gctgtgcgttgtgtaaactt

SEQ ID NO: 660330 - DNA, 20 bp, mouse
gtaaaaacagggactaccta

SEQ ID NO: 660331 - DNA, 20 bp, mouse
ggcacagtaatcagccaggc

SEQ ID NO: 660332 - DNA, 20 bp, mouse
gagtcaccctgccacttctt

SEQ ID NO: 660333 - DNA, 20 bp, mouse
gtacgaggtcatgtgatcca

SEQ ID NO: 660334 - DNA, 20 bp, mouse
gctgatcataaaagagctac

SEQ ID NO: 660335 - DNA, 20 bp, mouse
ggtcaaggtcacttaggggt

SEQ ID NO: 660336 - DNA, 20 bp, mouse
gaaggagcgaagtggagggt

SEQ ID NO: 660337 - DNA, 20 bp, mouse
gctggctgtcgggttttgag

SEQ ID NO: 660338 - DNA, 20 bp, mouse
ggctaaaggagcgaagtgga

SEQ ID NO: 660339 - DNA, 20 bp, mouse
gttgccaggaggtaaggtga

SEQ ID NO: 660340 - DNA, 20 bp, mouse
gaagtgtagtggacagcatc

SEQ ID NO: 660341 - DNA, 20 bp, mouse
gccggcattgccaggaggta

SEQ ID NO: 660342 - DNA, 20 bp, mouse
gagtcagttttcacatgctc

SEQ ID NO: 660343 - DNA, 20 bp, mouse
gggtgagctgttcgctaatg

SEQ ID NO: 660344 - DNA, 20 bp, mouse
gctgggaatccactgagaat

SEQ ID NO: 660345 - DNA, 20 bp, mouse
gcctagtaacagaagtgtag

SEQ ID NO: 660346 - DNA, 20 bp, mouse
ggtactgtgatctcagtaac

SEQ ID NO: 660347 - DNA, 20 bp, mouse
ggacgaacgcattgccaacc

SEQ ID NO: 660348 - DNA, 20 bp, mouse
gacccaagacaggccgtggc

SEQ ID NO: 660349 - DNA, 20 bp, mouse
gttagctgacatgttatgat

SEQ ID NO: 660350 - DNA, 20 bp, mouse
ggccagccacggcctgtctt

SEQ ID NO: 660351 - DNA, 20 bp, mouse
gaagtgaccgttctagagtg

SEQ ID NO: 660352 - DNA, 20 bp, mouse
gcacaacccaagacaggccg

SEQ ID NO: 660353 - DNA, 20 bp, mouse
ggggcaagccgatcaaagca

SEQ ID NO: 660354 - DNA, 20 bp, mouse
ggtgctggtgtctggggagg

SEQ ID NO: 660355 - DNA, 20 bp, mouse
ggaagctgtgagcaagcggc

SEQ ID NO: 660356 - DNA, 20 bp, mouse
gaacagcgcggccaaggaag

SEQ ID NO: 660357 - DNA, 20 bp, mouse
gcacgcctggccaacgcttc

SEQ ID NO: 660358 - DNA, 20 bp, mouse
ggagtcttcggacatccaat

SEQ ID NO: 660359 - DNA, 20 bp, mouse
ggcacgccgtggcctcgggg

SEQ ID NO: 660360 - DNA, 20 bp, mouse
gggcctcggggtggagaagt

SEQ ID NO: 660361 - DNA, 20 bp, mouse
gtgtccgaagactcgggagc

SEQ ID NO: 660362 - DNA, 20 bp, mouse
gtacctcccgagctgaccaa

SEQ ID NO: 660363 - DNA, 20 bp, mouse
gcgaagactcgggagcaggg

SEQ ID NO: 660364 - DNA, 20 bp, mouse
gggccaaggaaggggctcgg

SEQ ID NO: 660365 - DNA, 20 bp, mouse
gaggcggcgtatggcggacg

SEQ ID NO: 660366 - DNA, 20 bp, mouse
gagcccgcagtgcttctggc

SEQ ID NO: 660367 - DNA, 20 bp, mouse
gctctgggcatgtggatagt

SEQ ID NO: 660368 - DNA, 20 bp, mouse
gagccagccagaagcactgc

SEQ ID NO: 660369 - DNA, 20 bp, mouse
gagagagcccgcagtgcttc

SEQ ID NO: 660370 - DNA, 20 bp, mouse
gagcctcactacaggaccct

SEQ ID NO: 660371 - DNA, 20 bp, mouse
ggtaggcttggctacttgtt

SEQ ID NO: 660372 - DNA, 20 bp, mouse
gaatcgtctgtcaccctctt

SEQ ID NO: 660373 - DNA, 20 bp, mouse
ggtaacctgctgtgacggta

SEQ ID NO: 660374 - DNA, 20 bp, mouse
ggagggtgacagacgattag

SEQ ID NO: 660375 - DNA, 20 bp, mouse
gtgagacagagcctcactac

SEQ ID NO: 660376 - DNA, 20 bp, mouse
gatgcggccatgctggatga

SEQ ID NO: 660377 - DNA, 20 bp, mouse
gagggcagatgatctgcgta

SEQ ID NO: 660378 - DNA, 20 bp, mouse
ggagtcgttgggttcgggga

SEQ ID NO: 660379 - DNA, 20 bp, mouse
ggccgcatcggctacactcc

SEQ ID NO: 660380 - DNA, 20 bp, mouse
ggtagccgatgcggccatgc

SEQ ID NO: 660381 - DNA, 20 bp, mouse
gacagggcgtcggagtcgtt

SEQ ID NO: 660382 - DNA, 20 bp, mouse
gcgtcggagtcgttgggttc

SEQ ID NO: 660383 - DNA, 20 bp, mouse
gtatcccatcctacgccggt

SEQ ID NO: 660384 - DNA, 20 bp, mouse
ggcgcaggcacggaccttta

SEQ ID NO: 660385 - DNA, 20 bp, mouse
ggccgggagtgtagccgatg

SEQ ID NO: 660386 - DNA, 20 bp, mouse
gaacccggaagagaggttag

SEQ ID NO: 660387 - DNA, 20 bp, mouse
gtgcgggttcggtttcacag

SEQ ID NO: 660388 - DNA, 20 bp, mouse
gctagggcgctgacacgggg

SEQ ID NO: 660389 - DNA, 20 bp, mouse
gcacacggaagtgacgaaag

SEQ ID NO: 660390 - DNA, 20 bp, mouse
gacgcgcacggctgcgccta

SEQ ID NO: 660391 - DNA, 20 bp, mouse
gcgcctagggcgctgacacg

SEQ ID NO: 660392 - DNA, 20 bp, mouse
gccggcggaacccggaagag

SEQ ID NO: 660393 - DNA, 20 bp, mouse
gggttcggtttcacagaggg

SEQ ID NO: 660394 - DNA, 20 bp, mouse
gcagaacgttactgcaagtc

SEQ ID NO: 660395 - DNA, 20 bp, mouse
gagcggcccgagttataaac

SEQ ID NO: 660396 - DNA, 20 bp, mouse
gagaagagggaggcatctga

SEQ ID NO: 660397 - DNA, 20 bp, mouse
gtagttgcatttggcgcgaa

SEQ ID NO: 660398 - DNA, 20 bp, mouse
ggggactcacgggaattgct

SEQ ID NO: 660399 - DNA, 20 bp, mouse
gtggctgtccagatggtagg

SEQ ID NO: 660400 - DNA, 20 bp, mouse
gaacagcctggtctcaccct

SEQ ID NO: 660401 - DNA, 20 bp, mouse
gagcgctgctaggattcgat

SEQ ID NO: 660402 - DNA, 20 bp, mouse
ggaaagtgtaccaagggtaa

SEQ ID NO: 660403 - DNA, 20 bp, mouse
gcatgggccgcgggactcac

SEQ ID NO: 660404 - DNA, 20 bp, mouse
ggtgagaccaggctgttcct

SEQ ID NO: 660405 - DNA, 20 bp, mouse
gcacgggaattgctcggtca

SEQ ID NO: 660406 - DNA, 20 bp, mouse
ggagcgaggtgctaactaca

SEQ ID NO: 660407 - DNA, 20 bp, mouse
gcagaagtaatcaacaacac

SEQ ID NO: 660408 - DNA, 20 bp, mouse
ggggaagaaaaagagtcaca

SEQ ID NO: 660409 - DNA, 20 bp, mouse
gtcttgagggcagtggaaaa

SEQ ID NO: 660410 - DNA, 20 bp, mouse
gactgcaagctgtgtgtgtc

SEQ ID NO: 660411 - DNA, 20 bp, mouse
gtaacaatgtgggagaaaac

SEQ ID NO: 660412 - DNA, 20 bp, mouse
gaccaacagaagtatgagcg

SEQ ID NO: 660413 - DNA, 20 bp, mouse
gtgtgcccagggctcccttt

SEQ ID NO: 660414 - DNA, 20 bp, mouse
gacctcgctcatacttctgt

SEQ ID NO: 660415 - DNA, 20 bp, mouse
ggctacagtccctccactgt

SEQ ID NO: 660416 - DNA, 20 bp, mouse
gtggaaagagcatgagtagg

SEQ ID NO: 660417 - DNA, 20 bp, mouse
gcagccccgcccactaaggg

SEQ ID NO: 660418 - DNA, 20 bp, mouse
gtctaagcgcctatcggaga

SEQ ID NO: 660419 - DNA, 20 bp, mouse
gaaagagcatgagtaggcgg

SEQ ID NO: 660420 - DNA, 20 bp, mouse
gcgctggaaagagcatgagt

SEQ ID NO: 660421 - DNA, 20 bp, mouse
gaagggtggctgtctctagt

SEQ ID NO: 660422 - DNA, 20 bp, mouse
gccagagccccttctccgat

SEQ ID NO: 660423 - DNA, 20 bp, mouse
gtcctcctcgacccagaagg

SEQ ID NO: 660424 - DNA, 20 bp, mouse
gtcagagcctgtctgtaagg

SEQ ID NO: 660425 - DNA, 20 bp, mouse
gccactcccttccctagaag

SEQ ID NO: 660426 - DNA, 20 bp, mouse
gcagacggaagtgaacgcgt

SEQ ID NO: 660427 - DNA, 20 bp, mouse
ggacagggtctactatgtat

SEQ ID NO: 660428 - DNA, 20 bp, mouse
ggaacgcgttggaacggaga

SEQ ID NO: 660429 - DNA, 20 bp, mouse
ggccccaggcgatgaggcaa

SEQ ID NO: 660430 - DNA, 20 bp, mouse
gggaagtgaacgcgttggaa

SEQ ID NO: 660431 - DNA, 20 bp, mouse
gagacgaagcagcttcgagg

SEQ ID NO: 660432 - DNA, 20 bp, mouse
ggaagctgcttcgtctccat

SEQ ID NO: 660433 - DNA, 20 bp, mouse
gtcttcgaagcagtggctgg

SEQ ID NO: 660434 - DNA, 20 bp, mouse
gcaagaaaaggggtgcgcag

SEQ ID NO: 660435 - DNA, 20 bp, mouse
gtaccaatagataatgcaag

SEQ ID NO: 660436 - DNA, 20 bp, mouse
gggactctctgtcgtttctg

SEQ ID NO: 660437 - DNA, 20 bp, mouse
ggccccttataatgtttcca

SEQ ID NO: 660438 - DNA, 20 bp, mouse
gcgcaattggagcgctgtag

SEQ ID NO: 660439 - DNA, 20 bp, mouse
ggctgtagagggtgaggatt

SEQ ID NO: 660440 - DNA, 20 bp, mouse
gctacctagtagaaaaccta

SEQ ID NO: 660441 - DNA, 20 bp, mouse
gggaggtccaagtctcaagc

SEQ ID NO: 660442 - DNA, 20 bp, mouse
ggctccaattgcgcttctga

SEQ ID NO: 660443 - DNA, 20 bp, mouse
gagtccctaggttttctact

SEQ ID NO: 660444 - DNA, 20 bp, mouse
gttcccttggaaacattata

SEQ ID NO: 660445 - DNA, 20 bp, mouse
ggtacattggtgattgtccc

SEQ ID NO: 660446 - DNA, 20 bp, mouse
gacaatggggaggttggcga

SEQ ID NO: 660447 - DNA, 20 bp, mouse
ggcggcgcgctgcgagggga

SEQ ID NO: 660448 - DNA, 20 bp, mouse
gagagatcgggagagacaat

SEQ ID NO: 660449 - DNA, 20 bp, mouse
gtacaccgacactaattccc

SEQ ID NO: 660450 - DNA, 20 bp, mouse
ggggcgccgagtgtgcttgc

SEQ ID NO: 660451 - DNA, 20 bp, mouse
gcagaagcaggagacatggt

SEQ ID NO: 660452 - DNA, 20 bp, mouse
ggaaaaaaatgcacggctga

SEQ ID NO: 660453 - DNA, 20 bp, mouse
ggggcccgcggaaacaacag

SEQ ID NO: 660454 - DNA, 20 bp, mouse
ggcggcctgggaattagtgt

SEQ ID NO: 660455 - DNA, 20 bp, mouse
gagagcggcgtgtggcgctg

SEQ ID NO: 660456 - DNA, 20 bp, mouse
gacggtcccggccccgaggg

SEQ ID NO: 660457 - DNA, 20 bp, mouse
gaaagggagcgaccgagagg

SEQ ID NO: 660458 - DNA, 20 bp, mouse
ggggaagcacgccagccggg

SEQ ID NO: 660459 - DNA, 20 bp, mouse
gagagagccgggccgagcgg

SEQ ID NO: 660460 - DNA, 20 bp, mouse
gcgtcccctcgccctcctct

SEQ ID NO: 660461 - DNA, 20 bp, mouse
ggagggcggcgagaaaagaa

SEQ ID NO: 660462 - DNA, 20 bp, mouse
gagcgctgaaggcgaagggg

SEQ ID NO: 660463 - DNA, 20 bp, mouse
ggggaaatgagctcgctgga

SEQ ID NO: 660464 - DNA, 20 bp, mouse
ggcccggccgagcacggtcc

SEQ ID NO: 660465 - DNA, 20 bp, mouse
gagcacggtcccggccccga

SEQ ID NO: 660466 - DNA, 20 bp, mouse
ggatagcaaaatcccctata

SEQ ID NO: 660467 - DNA, 20 bp, mouse
gtggtgtacaagtttacact

SEQ ID NO: 660468 - DNA, 20 bp, mouse
gagagaggctaggccctata

SEQ ID NO: 660469 - DNA, 20 bp, mouse
gcccctccccaccaaaagtc

SEQ ID NO: 660470 - DNA, 20 bp, mouse
gaaagtcaggttgcagtaat

SEQ ID NO: 660471 - DNA, 20 bp, mouse
gtctgacactggcgagagat

SEQ ID NO: 660472 - DNA, 20 bp, mouse
gtgtaaatgtcttgtgtcac

SEQ ID NO: 660473 - DNA, 20 bp, mouse
gactgcaacctgacttttgg

SEQ ID NO: 660474 - DNA, 20 bp, mouse
gactggacacgacacaagta

SEQ ID NO: 660475 - DNA, 20 bp, mouse
gggaagctaaatggagggaa

SEQ ID NO: 660476 - DNA, 20 bp, mouse
gaaatgtggtgaaacgacga

SEQ ID NO: 660477 - DNA, 20 bp, mouse
ggtggtgaaacgacgaggga

SEQ ID NO: 660478 - DNA, 20 bp, mouse
gtaaactgaaatctgcaaag

SEQ ID NO: 660479 - DNA, 20 bp, mouse
gagtggagtgaaataacatt

SEQ ID NO: 660480 - DNA, 20 bp, mouse
gccctcaatcaggccttaaa

SEQ ID NO: 660481 - DNA, 20 bp, mouse
ggaagcatttcacagaaatg

SEQ ID NO: 660482 - DNA, 20 bp, mouse
gtctcaacaggtactccaaa

SEQ ID NO: 660483 - DNA, 20 bp, mouse
gctacaagttggatgggaac

SEQ ID NO: 660484 - DNA, 20 bp, mouse
gtctctggatatcattcctg

SEQ ID NO: 660485 - DNA, 20 bp, mouse
ggtggggataaggtctcaac

SEQ ID NO: 660486 - DNA, 20 bp, mouse
gccgctaaggggtcgcgtcc

SEQ ID NO: 660487 - DNA, 20 bp, mouse
gcggcgcgcaggggtgtgga

SEQ ID NO: 660488 - DNA, 20 bp, mouse
gcgagcgcgcggccgctaag

SEQ ID NO: 660489 - DNA, 20 bp, mouse
gcctggggaggctacgtccg

SEQ ID NO: 660490 - DNA, 20 bp, mouse
ggcagcgcgccggggatccc

SEQ ID NO: 660491 - DNA, 20 bp, mouse
gcaagggcgcagcgaagatc

SEQ ID NO: 660492 - DNA, 20 bp, mouse
ggggcggccgcggtggagcg

SEQ ID NO: 660493 - DNA, 20 bp, mouse
ggcgccctacggggcggccg

SEQ ID NO: 660494 - DNA, 20 bp, mouse
gccacagctgcgggagacta

SEQ ID NO: 660495 - DNA, 20 bp, mouse
ggccccgccccgctccaccg

SEQ ID NO: 660496 - DNA, 20 bp, mouse
ggagctgcccgggaagaggg

SEQ ID NO: 660497 - DNA, 20 bp, mouse
gcgcaaggggcgggcggcat

SEQ ID NO: 660498 - DNA, 20 bp, mouse
ggccccttgcggctgttggg

SEQ ID NO: 660499 - DNA, 20 bp, mouse
gccgccggaagtgacggttc

SEQ ID NO: 660500 - DNA, 20 bp, mouse
gcgccccccaacagccgcaa

SEQ ID NO: 660501 - DNA, 20 bp, mouse
gggccgagctgcggtctcca

SEQ ID NO: 660502 - DNA, 20 bp, mouse
ggggccggaaccgtcacttc

SEQ ID NO: 660503 - DNA, 20 bp, mouse
ggcgcgagctgcccgggaag

SEQ ID NO: 660504 - DNA, 20 bp, mouse
gggaacgggcacatcgacgt

SEQ ID NO: 660505 - DNA, 20 bp, mouse
gcccgcagagccagcgggga

SEQ ID NO: 660506 - DNA, 20 bp, mouse
gcctcctagcaaaaaggcag

SEQ ID NO: 660507 - DNA, 20 bp, mouse
gtagggagggcgcacgggga

SEQ ID NO: 660508 - DNA, 20 bp, mouse
gggcgctggcgaggggagga

SEQ ID NO: 660509 - DNA, 20 bp, mouse
gggcaggtggcgctggcgag

SEQ ID NO: 660510 - DNA, 20 bp, mouse
gaggtggcgctggcgagggg

SEQ ID NO: 660511 - DNA, 20 bp, mouse
gagccagaaccagaagggta

SEQ ID NO: 660512 - DNA, 20 bp, mouse
gggtagggagagactaggga

SEQ ID NO: 660513 - DNA, 20 bp, mouse
ggggcccttccaagtgtccc

SEQ ID NO: 660514 - DNA, 20 bp, mouse
gggggaggggcaggtggcgc

SEQ ID NO: 660515 - DNA, 20 bp, mouse
gagcgcaggtgtctgggtac

SEQ ID NO: 660516 - DNA, 20 bp, mouse
gtggctggatgggaggatgt

SEQ ID NO: 660517 - DNA, 20 bp, mouse
gcgaggcgaggccccgtggc

SEQ ID NO: 660518 - DNA, 20 bp, mouse
gcgaggccccgtggctggat

SEQ ID NO: 660519 - DNA, 20 bp, mouse
gcagaaggggaggcgattaa

SEQ ID NO: 660520 - DNA, 20 bp, mouse
ggcctggcaaggcccgggtc

SEQ ID NO: 660521 - DNA, 20 bp, mouse
gcagccctcagttgccacct

SEQ ID NO: 660522 - DNA, 20 bp, mouse
gaaggggaggcgattaaggg

SEQ ID NO: 660523 - DNA, 20 bp, mouse
gcaggcgaggcgaggccccg

SEQ ID NO: 660524 - DNA, 20 bp, mouse
gccagccaaggtggcaactg

SEQ ID NO: 660525 - DNA, 20 bp, mouse
gggccccgtggctggatggg

SEQ ID NO: 660526 - DNA, 20 bp, mouse
gatggggtgtacgcgttcca

SEQ ID NO: 660527 - DNA, 20 bp, mouse
gaacagacaacagtgatcta

SEQ ID NO: 660528 - DNA, 20 bp, mouse
ggggtgtacgcgttccaggg

SEQ ID NO: 660529 - DNA, 20 bp, mouse
gcagcctgttacttgaaaac

SEQ ID NO: 660530 - DNA, 20 bp, mouse
gggccataaaattgcgaaaa

SEQ ID NO: 660531 - DNA, 20 bp, mouse
gaagccagttttcaagtaac

SEQ ID NO: 660532 - DNA, 20 bp, mouse
gctagaaataatctcaagta

SEQ ID NO: 660533 - DNA, 20 bp, mouse
ggcgaaaatggaggcttttc

SEQ ID NO: 660534 - DNA, 20 bp, mouse
gcacttctatattaagtctc

SEQ ID NO: 660535 - DNA, 20 bp, mouse
gcataaaattgcgaaaatgg

SEQ ID NO: 660536 - DNA, 20 bp, mouse
gaggcaaggccctgggagaa

SEQ ID NO: 660537 - DNA, 20 bp, mouse
gaggctaccagccaatggag

SEQ ID NO: 660538 - DNA, 20 bp, mouse
ggaggcatcaggagttgctt

SEQ ID NO: 660539 - DNA, 20 bp, mouse
ggcctctgcctagcgagcgt

SEQ ID NO: 660540 - DNA, 20 bp, mouse
ggccctgccctactcggtaa

SEQ ID NO: 660541 - DNA, 20 bp, mouse
ggccctactcggtaacggac

SEQ ID NO: 660542 - DNA, 20 bp, mouse
ggcatcaggagttgcttggg

SEQ ID NO: 660543 - DNA, 20 bp, mouse
gttgcttgggcgggtaagaa

SEQ ID NO: 660544 - DNA, 20 bp, mouse
gaggcaaagaggtcattgct

SEQ ID NO: 660545 - DNA, 20 bp, mouse
gtaggcgtttagcagacacg

SEQ ID NO: 660546 - DNA, 20 bp, mouse
gggcccgagcgcgatcagag

SEQ ID NO: 660547 - DNA, 20 bp, mouse
gcacgcgggagatcggaaag

SEQ ID NO: 660548 - DNA, 20 bp, mouse
gcgcgcagggcccttgtatt

SEQ ID NO: 660549 - DNA, 20 bp, mouse
gctcccgcgtgcccaataca

SEQ ID NO: 660550 - DNA, 20 bp, mouse
gtgcgagtcccgagagagct

SEQ ID NO: 660551 - DNA, 20 bp, mouse
gcccaactccggggctcccg

SEQ ID NO: 660552 - DNA, 20 bp, mouse
gccagtgccggacacccggt

SEQ ID NO: 660553 - DNA, 20 bp, mouse
gtattgggcacgcgggagat

SEQ ID NO: 660554 - DNA, 20 bp, mouse
gggcccttgtattgggcacg

SEQ ID NO: 660555 - DNA, 20 bp, mouse
gcgagcgcgatcagagcggg

SEQ ID NO: 660556 - DNA, 20 bp, mouse
gggtccccatccagcttccg

SEQ ID NO: 660557 - DNA, 20 bp, mouse
gcccgtaggtgggaacgaac

SEQ ID NO: 660558 - DNA, 20 bp, mouse
gccagccaatgggatcacgg

SEQ ID NO: 660559 - DNA, 20 bp, mouse
gcgcctggtgcacccgtagg

SEQ ID NO: 660560 - DNA, 20 bp, mouse
gggacccaagacacccttaa

SEQ ID NO: 660561 - DNA, 20 bp, mouse
gagccgcctggtgcacccgt

SEQ ID NO: 660562 - DNA, 20 bp, mouse
gcgagtgcggaaagacgcct

SEQ ID NO: 660563 - DNA, 20 bp, mouse
gtacttgtgcgcgaagtggt

SEQ ID NO: 660564 - DNA, 20 bp, mouse
gaggcctttaagggtgtctt

SEQ ID NO: 660565 - DNA, 20 bp, mouse
gggtgccagcagtgcagcga

SEQ ID NO: 660566 - DNA, 20 bp, mouse
ggggcccaggacacccatga

SEQ ID NO: 660567 - DNA, 20 bp, mouse
gcggagcccggagtgtgccc

SEQ ID NO: 660568 - DNA, 20 bp, mouse
ggggagcgagtgggacccgg

SEQ ID NO: 660569 - DNA, 20 bp, mouse
ggtcggggagaagccatcat

SEQ ID NO: 660570 - DNA, 20 bp, mouse
gagcgcggacacacgtctac

SEQ ID NO: 660571 - DNA, 20 bp, mouse
gacccggaggtaggtatcac

SEQ ID NO: 660572 - DNA, 20 bp, mouse
gtaccgctactactaaaggt

SEQ ID NO: 660573 - DNA, 20 bp, mouse
gcatctgcctgggcacactc

SEQ ID NO: 660574 - DNA, 20 bp, mouse
gaccggtgatacctacctcc

SEQ ID NO: 660575 - DNA, 20 bp, mouse
gagaacccggagcgcttcct

SEQ ID NO: 660576 - DNA, 20 bp, mouse
gcggcccagctctggcgcgg

SEQ ID NO: 660577 - DNA, 20 bp, mouse
gcctcctcccggcccagctc

SEQ ID NO: 660578 - DNA, 20 bp, mouse
gcaaaggcgggggactcacg

SEQ ID NO: 660579 - DNA, 20 bp, mouse
gtctggcgcggaggggctga

SEQ ID NO: 660580 - DNA, 20 bp, mouse
gccagcctcggccaatgcgg

SEQ ID NO: 660581 - DNA, 20 bp, mouse
gaatccgcagggtcgcacga

SEQ ID NO: 660582 - DNA, 20 bp, mouse
gggcgctgccggagcctgga

SEQ ID NO: 660583 - DNA, 20 bp, mouse
gtccctggcccgggcagctc

SEQ ID NO: 660584 - DNA, 20 bp, mouse
gcgggaccgaggggcgtact

SEQ ID NO: 660585 - DNA, 20 bp, mouse
gtgggggcgccccgggagga

SEQ ID NO: 660586 - DNA, 20 bp, mouse
gaacgagcgagcgtcctccg

SEQ ID NO: 660587 - DNA, 20 bp, mouse
gggcgcgcgcgcactgggaa

SEQ ID NO: 660588 - DNA, 20 bp, mouse
gcgggtgcgcgcagagctgg

SEQ ID NO: 660589 - DNA, 20 bp, mouse
gaggacgctcgctcgttcgc

SEQ ID NO: 660590 - DNA, 20 bp, mouse
ggaggggcgccgaactccac

SEQ ID NO: 660591 - DNA, 20 bp, mouse
gtctcggctcggttcgtgtc

SEQ ID NO: 660592 - DNA, 20 bp, mouse
ggggcctccttcccggcaga

SEQ ID NO: 660593 - DNA, 20 bp, mouse
gtcgggcgagcaagaggcgc

SEQ ID NO: 660594 - DNA, 20 bp, mouse
gcgagcgtcctccgcggctg

SEQ ID NO: 660595 - DNA, 20 bp, mouse
gccgaagggcccgtggagtt

SEQ ID NO: 660596 - DNA, 20 bp, mouse
ggcagccggacaaacgtccc

SEQ ID NO: 660597 - DNA, 20 bp, mouse
gctgaggacggctctggagg

SEQ ID NO: 660598 - DNA, 20 bp, mouse
gaatccctgcgctaagtgct

SEQ ID NO: 660599 - DNA, 20 bp, mouse
ggctctgaggacggctctgg

SEQ ID NO: 660600 - DNA, 20 bp, mouse
gacttagcgcagggattacg

SEQ ID NO: 660601 - DNA, 20 bp, mouse
ggcagtctgcagtcactagt

SEQ ID NO: 660602 - DNA, 20 bp, mouse
gttgtccggctgcagcgcca

SEQ ID NO: 660603 - DNA, 20 bp, mouse
gaggtggctgggaccgctcc

SEQ ID NO: 660604 - DNA, 20 bp, mouse
gagctgggaccgactccaaa

SEQ ID NO: 660605 - DNA, 20 bp, mouse
gtgaggggttagaaatcttg

SEQ ID NO: 660606 - DNA, 20 bp, mouse
ggcacagaggggcaattatg

SEQ ID NO: 660607 - DNA, 20 bp, mouse
gtggagagaagtaggctagg

SEQ ID NO: 660608 - DNA, 20 bp, mouse
gcccctctgtgcctgatttg

SEQ ID NO: 660609 - DNA, 20 bp, mouse
gtgtgcctgatttggggctc

SEQ ID NO: 660610 - DNA, 20 bp, mouse
gctttcctgagccccaaatc

SEQ ID NO: 660611 - DNA, 20 bp, mouse
gaatacagctttcctcaagc

SEQ ID NO: 660612 - DNA, 20 bp, mouse
gtgtaaagctggcagcgaaa

SEQ ID NO: 660613 - DNA, 20 bp, mouse
gagctgctcggacaaagcag

SEQ ID NO: 660614 - DNA, 20 bp, mouse
gccagctttacagatgctat

SEQ ID NO: 660615 - DNA, 20 bp, mouse
gccgaatgatagaaatgcat

SEQ ID NO: 660616 - DNA, 20 bp, mouse
ggggagggcggggactcgat

SEQ ID NO: 660617 - DNA, 20 bp, mouse
gggactcgatgggagcactg

SEQ ID NO: 660618 - DNA, 20 bp, mouse
ggtacggagcgatgctactc

SEQ ID NO: 660619 - DNA, 20 bp, mouse
gcggagcgatgctactccgg

SEQ ID NO: 660620 - DNA, 20 bp, mouse
gccctcgcgcgattgttccg

SEQ ID NO: 660621 - DNA, 20 bp, mouse
gcgccgggaagggcgaagcg

SEQ ID NO: 660622 - DNA, 20 bp, mouse
gccgtactccgaggacagtg

SEQ ID NO: 660623 - DNA, 20 bp, mouse
gagcatcgctccgtactccg

SEQ ID NO: 660624 - DNA, 20 bp, mouse
gagcccgggcgagcgacacg

SEQ ID NO: 660625 - DNA, 20 bp, mouse
ggctcccgcaagccatcgac

SEQ ID NO: 660626 - DNA, 20 bp, mouse
ggagagcccgactctcagag

SEQ ID NO: 660627 - DNA, 20 bp, mouse
gccggaagtaagctctgggt

SEQ ID NO: 660628 - DNA, 20 bp, mouse
gctctgaagccaggtcgcgc

SEQ ID NO: 660629 - DNA, 20 bp, mouse
gaaagccggaagtaagctct

SEQ ID NO: 660630 - DNA, 20 bp, mouse
gcccagccactctgagagtc

SEQ ID NO: 660631 - DNA, 20 bp, mouse
ggtaagctctgggttggctg

SEQ ID NO: 660632 - DNA, 20 bp, mouse
gcacggactgccctctcctt

SEQ ID NO: 660633 - DNA, 20 bp, mouse
ggctctcagccagcgcgacc

SEQ ID NO: 660634 - DNA, 20 bp, mouse
gacagggagcggtagcctag

SEQ ID NO: 660635 - DNA, 20 bp, mouse
gcagcccgcaagcacgacgc

SEQ ID NO: 660636 - DNA, 20 bp, mouse
ggggccttacacaatcccac

SEQ ID NO: 660637 - DNA, 20 bp, mouse
ggctctaatactgataactg

SEQ ID NO: 660638 - DNA, 20 bp, mouse
gtgcggctcctgcttttccc

SEQ ID NO: 660639 - DNA, 20 bp, mouse
gagaagtcagcgtcagaagt

SEQ ID NO: 660640 - DNA, 20 bp, mouse
gagagctgcctgggaaaagc

SEQ ID NO: 660641 - DNA, 20 bp, mouse
ggttgagcgtggtttcctgt

SEQ ID NO: 660642 - DNA, 20 bp, mouse
gatgtccccaagagctgcct

SEQ ID NO: 660643 - DNA, 20 bp, mouse
gtcgcacagaggccagagtc

SEQ ID NO: 660644 - DNA, 20 bp, mouse
gccagagtcaggaaatcatt

SEQ ID NO: 660645 - DNA, 20 bp, mouse
gggattgtgtaaggccctgc

SEQ ID NO: 660646 - DNA, 20 bp, mouse
gagtcactgggcgaacgaag

SEQ ID NO: 660647 - DNA, 20 bp, mouse
ggcgaacgaagaggactgag

SEQ ID NO: 660648 - DNA, 20 bp, mouse
gggaaatgagtgagagtatg

SEQ ID NO: 660649 - DNA, 20 bp, mouse
gtggagaggtagacactagc

SEQ ID NO: 660650 - DNA, 20 bp, mouse
gggtctccggctgcagcgga

SEQ ID NO: 660651 - DNA, 20 bp, mouse
gcctatagcccctctccgta

SEQ ID NO: 660652 - DNA, 20 bp, mouse
gtggcgcgatactttgagcg

SEQ ID NO: 660653 - DNA, 20 bp, mouse
gctccggctgcagcggaggg

SEQ ID NO: 660654 - DNA, 20 bp, mouse
gtgggaaggggagtggttcg

SEQ ID NO: 660655 - DNA, 20 bp, mouse
gtcgcgccaccttacggaga

SEQ ID NO: 660656 - DNA, 20 bp, mouse
gggctgcgggcgacgctcga

SEQ ID NO: 660657 - DNA, 20 bp, mouse
ggcccccggcggccggagta

SEQ ID NO: 660658 - DNA, 20 bp, mouse
gccgccccgcgcccctactc

SEQ ID NO: 660659 - DNA, 20 bp, mouse
gcggacgcgagggtgcacga

SEQ ID NO: 660660 - DNA, 20 bp, mouse
gcccctactccggccgccgg

SEQ ID NO: 660661 - DNA, 20 bp, mouse
ggggcgcggggcggacgcga

SEQ ID NO: 660662 - DNA, 20 bp, mouse
gcgcacagcggagacctcgg

SEQ ID NO: 660663 - DNA, 20 bp, mouse
gaggccacgcagagtcgcct

SEQ ID NO: 660664 - DNA, 20 bp, mouse
gccccctgcgcaggagaagt

SEQ ID NO: 660665 - DNA, 20 bp, mouse
ggggacccgaggcgcctccg

SEQ ID NO: 660666 - DNA, 20 bp, mouse
gagggagcgagcgcgaccct

SEQ ID NO: 660667 - DNA, 20 bp, mouse
ggccgagcggcgagctgagg

SEQ ID NO: 660668 - DNA, 20 bp, mouse
gaggggggctgctggcgagg

SEQ ID NO: 660669 - DNA, 20 bp, mouse
gggggagggagcaggccgag

SEQ ID NO: 660670 - DNA, 20 bp, mouse
gggaacggactgtccgggag

SEQ ID NO: 660671 - DNA, 20 bp, mouse
ggcgggacaactcggagcgc

SEQ ID NO: 660672 - DNA, 20 bp, mouse
gactcggagcgccggctcga

SEQ ID NO: 660673 - DNA, 20 bp, mouse
gcagtcacctgagcgccgag

SEQ ID NO: 660674 - DNA, 20 bp, mouse
ggggcgggtggggagtggcg

SEQ ID NO: 660675 - DNA, 20 bp, mouse
gggcgagctgaggcggccga

SEQ ID NO: 660676 - DNA, 20 bp, mouse
gagaacacgcacagcttctc

SEQ ID NO: 660677 - DNA, 20 bp, mouse
gaccccgtgtggatcaaacc

SEQ ID NO: 660678 - DNA, 20 bp, mouse
gggaggggaaaatacaactc

SEQ ID NO: 660679 - DNA, 20 bp, mouse
gacgtgacaagaaaagtttc

SEQ ID NO: 660680 - DNA, 20 bp, mouse
gcaaaaggtcactagaatag

SEQ ID NO: 660681 - DNA, 20 bp, mouse
gatacaactcaggtgatgat

SEQ ID NO: 660682 - DNA, 20 bp, mouse
gctcctactaaacggaaaag

SEQ ID NO: 660683 - DNA, 20 bp, mouse
ggtactgggaacaaacctga

SEQ ID NO: 660684 - DNA, 20 bp, mouse
gtgaagaaccattagagttg

SEQ ID NO: 660685 - DNA, 20 bp, mouse
gagaaccattagagttgggg

SEQ ID NO: 660686 - DNA, 20 bp, mouse
gttagctggcccgggacaga

SEQ ID NO: 660687 - DNA, 20 bp, mouse
gaggagggcgcagctttcta

SEQ ID NO: 660688 - DNA, 20 bp, mouse
ggaagcccgccgaggatttt

SEQ ID NO: 660689 - DNA, 20 bp, mouse
gggggcgtacgcactgaatc

SEQ ID NO: 660690 - DNA, 20 bp, mouse
gggcttgctgctggcgaggg

SEQ ID NO: 660691 - DNA, 20 bp, mouse
gccaaagccttagctggccc

SEQ ID NO: 660692 - DNA, 20 bp, mouse
gcccggcgccggtccggagg

SEQ ID NO: 660693 - DNA, 20 bp, mouse
gttgctgctggcgagggagg

SEQ ID NO: 660694 - DNA, 20 bp, mouse
gagcaagccaaagccttagc

SEQ ID NO: 660695 - DNA, 20 bp, mouse
ggcgcccggcgccggtccgg

SEQ ID NO: 660696 - DNA, 20 bp, mouse
gggggagcgtgtggcacgtg

SEQ ID NO: 660697 - DNA, 20 bp, mouse
gcgcgcacctcggagtccca

SEQ ID NO: 660698 - DNA, 20 bp, mouse
gtgcctgaggctggagtaac

SEQ ID NO: 660699 - DNA, 20 bp, mouse
gtaatgcagaagtggaccgg

SEQ ID NO: 660700 - DNA, 20 bp, mouse
ggcctgaggcaggagtgcgc

SEQ ID NO: 660701 - DNA, 20 bp, mouse
gggagtaactgggacctagg

SEQ ID NO: 660702 - DNA, 20 bp, mouse
gtgaggcaggagtgcgcggg

SEQ ID NO: 660703 - DNA, 20 bp, mouse
ggcgggtagggaagagtctg

SEQ ID NO: 660704 - DNA, 20 bp, mouse
gaggaacgcgggggagcgtg

SEQ ID NO: 660705 - DNA, 20 bp, mouse
ggcggcgcgtgcgccggcat

SEQ ID NO: 660706 - DNA, 20 bp, mouse
ggggtcggagcccaggatag

SEQ ID NO: 660707 - DNA, 20 bp, mouse
gtggtcacgccccctatcct

SEQ ID NO: 660708 - DNA, 20 bp, mouse
gtgcggaagtcgagctgata

SEQ ID NO: 660709 - DNA, 20 bp, mouse
gtcagtcgcaatagccggaa

SEQ ID NO: 660710 - DNA, 20 bp, mouse
gagggccctgacgtcacgaa

SEQ ID NO: 660711 - DNA, 20 bp, mouse
gtgctcgggacgtgcgggtg

SEQ ID NO: 660712 - DNA, 20 bp, mouse
gtggcattggattgagatta

SEQ ID NO: 660713 - DNA, 20 bp, mouse
gatagggggcgtgaccaggc

SEQ ID NO: 660714 - DNA, 20 bp, mouse
gcgagctgctcgggacgtgc

SEQ ID NO: 660715 - DNA, 20 bp, mouse
gtgagctaggaagttggcat

SEQ ID NO: 660716 - DNA, 20 bp, mouse
gctgcacaatactgtacttt

SEQ ID NO: 660717 - DNA, 20 bp, mouse
gcacttgcactcgggaatct

SEQ ID NO: 660718 - DNA, 20 bp, mouse
gggaccacaggaaaagaggg

SEQ ID NO: 660719 - DNA, 20 bp, mouse
ggagcattgtgcctgactgt

SEQ ID NO: 660720 - DNA, 20 bp, mouse
gccagtaagttgaatgatta

SEQ ID NO: 660721 - DNA, 20 bp, mouse
gaatatgacgaccaagagtg

SEQ ID NO: 660722 - DNA, 20 bp, mouse
gcaaaacgtacagattataa

SEQ ID NO: 660723 - DNA, 20 bp, mouse
gacgttttgaaagttcttat

SEQ ID NO: 660724 - DNA, 20 bp, mouse
gcaatgctcacacttgcact

SEQ ID NO: 660725 - DNA, 20 bp, mouse
gttttgtgaacttgattaat

SEQ ID NO: 660726 - DNA, 20 bp, mouse
gttgcccgctaaggagtgag

SEQ ID NO: 660727 - DNA, 20 bp, mouse
gtcccaggttataaagaatc

SEQ ID NO: 660728 - DNA, 20 bp, mouse
ggggcaagcccagcactctc

SEQ ID NO: 660729 - DNA, 20 bp, mouse
ggctccccagactaattcta

SEQ ID NO: 660730 - DNA, 20 bp, mouse
gacctcccctcactccttag

SEQ ID NO: 660731 - DNA, 20 bp, mouse
gaatccctagaattagtctg

SEQ ID NO: 660732 - DNA, 20 bp, mouse
gcgcccccacacaagaggct

SEQ ID NO: 660733 - DNA, 20 bp, mouse
gagcccagcctcttgtgtgg

SEQ ID NO: 660734 - DNA, 20 bp, mouse
gggcaaaacaaagggctccc

SEQ ID NO: 660735 - DNA, 20 bp, mouse
gtggggcaaacctgctcctt

SEQ ID NO: 660736 - DNA, 20 bp, mouse
gtaccgctcgaagaggggag

SEQ ID NO: 660737 - DNA, 20 bp, mouse
gcgtgggagaaaggcacttt

SEQ ID NO: 660738 - DNA, 20 bp, mouse
gtggccaagggaagggtcca

SEQ ID NO: 660739 - DNA, 20 bp, mouse
gacccccgcgcgtgggagaa

SEQ ID NO: 660740 - DNA, 20 bp, mouse
ggaccggcacccccgcgcgt

SEQ ID NO: 660741 - DNA, 20 bp, mouse
gcgggaaggaggggtagtgc

SEQ ID NO: 660742 - DNA, 20 bp, mouse
gcccctcttcgagcggtaat

SEQ ID NO: 660743 - DNA, 20 bp, mouse
ggtgccagcacgggaaggag

SEQ ID NO: 660744 - DNA, 20 bp, mouse
gcttgaaaaggaaactggag

SEQ ID NO: 660745 - DNA, 20 bp, mouse
gaacgcagtgcaaagaaagt

SEQ ID NO: 660746 - DNA, 20 bp, mouse
ggggacagcttgggcattgt

SEQ ID NO: 660747 - DNA, 20 bp, mouse
gtgacccggaggtctgattt

SEQ ID NO: 660748 - DNA, 20 bp, mouse
ggctataagaacataggtga

SEQ ID NO: 660749 - DNA, 20 bp, mouse
ggagcgactgtcaaaagcac

SEQ ID NO: 660750 - DNA, 20 bp, mouse
gccggaggtctgatttggga

SEQ ID NO: 660751 - DNA, 20 bp, mouse
gctagtttgcgggacagctt

SEQ ID NO: 660752 - DNA, 20 bp, mouse
gacacgggctataagaacat

SEQ ID NO: 660753 - DNA, 20 bp, mouse
gtgggagggctgccgtgact

SEQ ID NO: 660754 - DNA, 20 bp, mouse
ggggagatttggttaacaat

SEQ ID NO: 660755 - DNA, 20 bp, mouse
gagttctgcaggtgacccgg

SEQ ID NO: 660756 - DNA, 20 bp, mouse
gaggcgcgggcgccctcacg

SEQ ID NO: 660757 - DNA, 20 bp, mouse
gcgccctcacgaggctgaga

SEQ ID NO: 660758 - DNA, 20 bp, mouse
ggggcgggaacaagttgtgg

SEQ ID NO: 660759 - DNA, 20 bp, mouse
gggaggcaggagtgaagcgt

SEQ ID NO: 660760 - DNA, 20 bp, mouse
ggcctcgaggcggctggaat

SEQ ID NO: 660761 - DNA, 20 bp, mouse
ggggcgcccgcgcctcgagg

SEQ ID NO: 660762 - DNA, 20 bp, mouse
gcgggaacaagttgtggtgg

SEQ ID NO: 660763 - DNA, 20 bp, mouse
ggggagcgaaacagagagcc

SEQ ID NO: 660764 - DNA, 20 bp, mouse
gtctctgtttcgctccccgg

SEQ ID NO: 660765 - DNA, 20 bp, mouse
gtgagggcgcccgcgcctcg

SEQ ID NO: 660766 - DNA, 20 bp, mouse
gccagtctggcggcgttccc

SEQ ID NO: 660767 - DNA, 20 bp, mouse
gtgccgggacagctccagtc

SEQ ID NO: 660768 - DNA, 20 bp, mouse
gcgcctccctggtttaagaa

SEQ ID NO: 660769 - DNA, 20 bp, mouse
ggggcgagaagccaggctta

SEQ ID NO: 660770 - DNA, 20 bp, mouse
gaggaaacggcaacccccgg

SEQ ID NO: 660771 - DNA, 20 bp, mouse
gtgcgagcgcgcgggaagac

SEQ ID NO: 660772 - DNA, 20 bp, mouse
gtccccgcgggcgagaagcc

SEQ ID NO: 660773 - DNA, 20 bp, mouse
gctcgcgggtttgaatggaa

SEQ ID NO: 660774 - DNA, 20 bp, mouse
gggaacttggtgcgccccag

SEQ ID NO: 660775 - DNA, 20 bp, mouse
ggctctgcccaacgcctccc

SEQ ID NO: 660776 - DNA, 20 bp, mouse
gttaccggtcgggagaagca

SEQ ID NO: 660777 - DNA, 20 bp, mouse
gcccccgcgcgcttctgtgt

SEQ ID NO: 660778 - DNA, 20 bp, mouse
gcggtaaaatcctgcaaagt

SEQ ID NO: 660779 - DNA, 20 bp, mouse
gagtccctgcttctcccgac

SEQ ID NO: 660780 - DNA, 20 bp, mouse
ggaccttgctcaattcagag

SEQ ID NO: 660781 - DNA, 20 bp, mouse
ggatcaagaagctacaaatc

SEQ ID NO: 660782 - DNA, 20 bp, mouse
gaacgcctgccagacgcaac

SEQ ID NO: 660783 - DNA, 20 bp, mouse
gcaagttagtgcagctctta

SEQ ID NO: 660784 - DNA, 20 bp, mouse
ggacatttctagagtggtaa

SEQ ID NO: 660785 - DNA, 20 bp, mouse
gctcgctaggaaacgcagtc

SEQ ID NO: 660786 - DNA, 20 bp, mouse
gggacctcggacctcggaaa

SEQ ID NO: 660787 - DNA, 20 bp, mouse
gtggagggcagccagtcctg

SEQ ID NO: 660788 - DNA, 20 bp, mouse
gggtgtgcaagcggaaccgc

SEQ ID NO: 660789 - DNA, 20 bp, mouse
ggaccctggtaagaaggcgc

SEQ ID NO: 660790 - DNA, 20 bp, mouse
gccaagtgctgggaattcaa

SEQ ID NO: 660791 - DNA, 20 bp, mouse
gtagccaatccgagccggac

SEQ ID NO: 660792 - DNA, 20 bp, mouse
gcaatccgagccggactgga

SEQ ID NO: 660793 - DNA, 20 bp, mouse
gggcgaggaccctggtaaga

SEQ ID NO: 660794 - DNA, 20 bp, mouse
ggctgccctccagtccggct

SEQ ID NO: 660795 - DNA, 20 bp, mouse
gtaggaagggcggaagtgag

SEQ ID NO: 660796 - DNA, 20 bp, mouse
gaccctggggtgcacagaac

SEQ ID NO: 660797 - DNA, 20 bp, mouse
gtcctccgcagccagaaccc

SEQ ID NO: 660798 - DNA, 20 bp, mouse
gcggccgcacctgcaaacat

SEQ ID NO: 660799 - DNA, 20 bp, mouse
gtccccgtcctgccttggcc

SEQ ID NO: 660800 - DNA, 20 bp, mouse
ggccaggccaaggcaggacg

SEQ ID NO: 660801 - DNA, 20 bp, mouse
gggggaacgcccatgtttgc

SEQ ID NO: 660802 - DNA, 20 bp, mouse
gtgcgacctggggtatttag

SEQ ID NO: 660803 - DNA, 20 bp, mouse
gcccgccccctgccgtccgg

SEQ ID NO: 660804 - DNA, 20 bp, mouse
gactgggatgttcggggtga

SEQ ID NO: 660805 - DNA, 20 bp, mouse
gtgcaggtgcggccggttcc

SEQ ID NO: 660806 - DNA, 20 bp, mouse
gcggacggcggcgccctcga

SEQ ID NO: 660807 - DNA, 20 bp, mouse
gttaccaggctgcactggga

SEQ ID NO: 660808 - DNA, 20 bp, mouse
gcggggcgcggcacgttacc

SEQ ID NO: 660809 - DNA, 20 bp, mouse
gcaggccttgccccgggtcg

SEQ ID NO: 660810 - DNA, 20 bp, mouse
gctacgcgcgctgccctgtc

SEQ ID NO: 660811 - DNA, 20 bp, mouse
ggaaaagggcgagccgtcga

SEQ ID NO: 660812 - DNA, 20 bp, mouse
gtcaggcctgggcccggctg

SEQ ID NO: 660813 - DNA, 20 bp, mouse
gtccgggcgggaacacttga

SEQ ID NO: 660814 - DNA, 20 bp, mouse
ggccgggcccaggcctgaca

SEQ ID NO: 660815 - DNA, 20 bp, mouse
gcggggccgcggccttgcgt

SEQ ID NO: 660816 - DNA, 20 bp, mouse
gagggtgcggcgcaagggct

SEQ ID NO: 660817 - DNA, 20 bp, mouse
gaagtaggcaggggagatca

SEQ ID NO: 660818 - DNA, 20 bp, mouse
gcgcacagaggctacaggtc

SEQ ID NO: 660819 - DNA, 20 bp, mouse
gggcgtagggtgcggcgcaa

SEQ ID NO: 660820 - DNA, 20 bp, mouse
ggaccggcgcgctctcgcta

SEQ ID NO: 660821 - DNA, 20 bp, mouse
gagggctgggccggcaaagt

SEQ ID NO: 660822 - DNA, 20 bp, mouse
ggagcgcgccggtcgcaaga

SEQ ID NO: 660823 - DNA, 20 bp, mouse
ggccgcagccatcttgcgac

SEQ ID NO: 660824 - DNA, 20 bp, mouse
gcccacggccagatccatct

SEQ ID NO: 660825 - DNA, 20 bp, mouse
gctgggccggcaaagtaggc

SEQ ID NO: 660826 - DNA, 20 bp, mouse
gccagccaatggcgtcgagg

SEQ ID NO: 660827 - DNA, 20 bp, mouse
gcccccgccccggtgggaga

SEQ ID NO: 660828 - DNA, 20 bp, mouse
gccgtccgcgaaccagccaa

SEQ ID NO: 660829 - DNA, 20 bp, mouse
ggtccccgcgtcggcctcgg

SEQ ID NO: 660830 - DNA, 20 bp, mouse
ggacggcggtgggacgcgat

SEQ ID NO: 660831 - DNA, 20 bp, mouse
ggacgccattggctggttcg

SEQ ID NO: 660832 - DNA, 20 bp, mouse
gccggccgcctcgacgccat

SEQ ID NO: 660833 - DNA, 20 bp, mouse
gcgtgctctccggccaacca

SEQ ID NO: 660834 - DNA, 20 bp, mouse
gccctcgcaggataccgccg

SEQ ID NO: 660835 - DNA, 20 bp, mouse
gctcggcgctcggcgcgagg

SEQ ID NO: 660836 - DNA, 20 bp, mouse
gcaagtccctggggtaagaa

SEQ ID NO: 660837 - DNA, 20 bp, mouse
gtcgccggggcaatgtttgt

SEQ ID NO: 660838 - DNA, 20 bp, mouse
gtaagaagggaagctatgat

SEQ ID NO: 660839 - DNA, 20 bp, mouse
gaccagccggaggttctttc

SEQ ID NO: 660840 - DNA, 20 bp, mouse
gggtcgctggccagagggcg

SEQ ID NO: 660841 - DNA, 20 bp, mouse
gttgccccggcgatgctcag

SEQ ID NO: 660842 - DNA, 20 bp, mouse
gtccgaaactaccatcttat

SEQ ID NO: 660843 - DNA, 20 bp, mouse
gcacggatagaccaataaga

SEQ ID NO: 660844 - DNA, 20 bp, mouse
gtccggtttctcaagtccct

SEQ ID NO: 660845 - DNA, 20 bp, mouse
gaaccgatagcgctgggtat

SEQ ID NO: 660846 - DNA, 20 bp, mouse
gccaaggagtccaaggatat

SEQ ID NO: 660847 - DNA, 20 bp, mouse
gtccttgcttgcaactgcca

SEQ ID NO: 660848 - DNA, 20 bp, mouse
gtgtgctgccttcacctaaa

SEQ ID NO: 660849 - DNA, 20 bp, mouse
gtgtccaccctgagagagct

SEQ ID NO: 660850 - DNA, 20 bp, mouse
gtgggaagtgggacatagtc

SEQ ID NO: 660851 - DNA, 20 bp, mouse
ggcaactgccaaggagtcca

SEQ ID NO: 660852 - DNA, 20 bp, mouse
gagtcctagctctctcaggg

SEQ ID NO: 660853 - DNA, 20 bp, mouse
gtgagagagctaggactaga

SEQ ID NO: 660854 - DNA, 20 bp, mouse
gagcagagcgagctccagca

SEQ ID NO: 660855 - DNA, 20 bp, mouse
gaggcacagcgggccagggg

SEQ ID NO: 660856 - DNA, 20 bp, mouse
gtacccctgcagcctgggat

SEQ ID NO: 660857 - DNA, 20 bp, mouse
ggggataggaactagagaca

SEQ ID NO: 660858 - DNA, 20 bp, mouse
ggagacagggagtctccgtg

SEQ ID NO: 660859 - DNA, 20 bp, mouse
gaagctgggtggtgaccaca

SEQ ID NO: 660860 - DNA, 20 bp, mouse
gtagaggtctgtgcgagcat

SEQ ID NO: 660861 - DNA, 20 bp, mouse
gtactacggatacaaccaaa

SEQ ID NO: 660862 - DNA, 20 bp, mouse
ggcgaggaggacgcaagaaa

SEQ ID NO: 660863 - DNA, 20 bp, mouse
ggactggtccccaacgttga

SEQ ID NO: 660864 - DNA, 20 bp, mouse
gagaaaaggatggactgctt

SEQ ID NO: 660865 - DNA, 20 bp, mouse
gtaaggctttctttcaagct

SEQ ID NO: 660866 - DNA, 20 bp, mouse
gcacaagtggcgagaggatc

SEQ ID NO: 660867 - DNA, 20 bp, mouse
gcagttgggaaacttgatat

SEQ ID NO: 660868 - DNA, 20 bp, mouse
ggggtctgtcaagataggga

SEQ ID NO: 660869 - DNA, 20 bp, mouse
gaaacttgatattggatgat

SEQ ID NO: 660870 - DNA, 20 bp, mouse
gtctcgccacttgtgagcat

SEQ ID NO: 660871 - DNA, 20 bp, mouse
gtaaataagaacatttgaga

SEQ ID NO: 660872 - DNA, 20 bp, mouse
gaattgtcaatcatattaac

SEQ ID NO: 660873 - DNA, 20 bp, mouse
gaggctttctcaagacttca

SEQ ID NO: 660874 - DNA, 20 bp, mouse
gttaggggtctgtcaagata

SEQ ID NO: 660875 - DNA, 20 bp, mouse
gggagacccatgctcacaag

SEQ ID NO: 660876 - DNA, 20 bp, mouse
ggatgcttgggtgacagtga

SEQ ID NO: 660877 - DNA, 20 bp, mouse
gggacacgggtcaggtgcat

SEQ ID NO: 660878 - DNA, 20 bp, mouse
ggaagaatgttctgttgggt

SEQ ID NO: 660879 - DNA, 20 bp, mouse
gaaaggtcacccaggatgct

SEQ ID NO: 660880 - DNA, 20 bp, mouse
gaatggaagaatgttctgtt

SEQ ID NO: 660881 - DNA, 20 bp, mouse
gcgggtcaggtgcataggaa

SEQ ID NO: 660882 - DNA, 20 bp, mouse
gtgcataggaagggtggtct

SEQ ID NO: 660883 - DNA, 20 bp, mouse
gaacttgagactgccaacaa

SEQ ID NO: 660884 - DNA, 20 bp, mouse
gagaatcaagccctatttcc

SEQ ID NO: 660885 - DNA, 20 bp, mouse
gaagctcttggacacgggtc

SEQ ID NO: 660886 - DNA, 20 bp, mouse
gtatgcccaggatcagggag

SEQ ID NO: 660887 - DNA, 20 bp, mouse
gcaacacagcaaggtccaat

SEQ ID NO: 660888 - DNA, 20 bp, mouse
gtagcctgtagcttatgccc

SEQ ID NO: 660889 - DNA, 20 bp, mouse
gctacagggagatacaggag

SEQ ID NO: 660890 - DNA, 20 bp, mouse
ggatcctgggcataagctac

SEQ ID NO: 660891 - DNA, 20 bp, mouse
ggcttgctacagggagatac

SEQ ID NO: 660892 - DNA, 20 bp, mouse
gggctagtgactcttcagtg

SEQ ID NO: 660893 - DNA, 20 bp, mouse
ggacagcagatgcaaaggtc

SEQ ID NO: 660894 - DNA, 20 bp, mouse
gtcagtgagcgcagaaggac

SEQ ID NO: 660895 - DNA, 20 bp, mouse
gtgtgagctcactggaaagt

SEQ ID NO: 660896 - DNA, 20 bp, mouse
gcatgagtatcagggagatc

SEQ ID NO: 660897 - DNA, 20 bp, mouse
gcaatcggctcgtgtctctc

SEQ ID NO: 660898 - DNA, 20 bp, mouse
gaccagggaaggatgagacg

SEQ ID NO: 660899 - DNA, 20 bp, mouse
gtaagcaagaaaactcgata

SEQ ID NO: 660900 - DNA, 20 bp, mouse
gggtcccgtgcataaggctt

SEQ ID NO: 660901 - DNA, 20 bp, mouse
ggaaacgtgagattagatga

SEQ ID NO: 660902 - DNA, 20 bp, mouse
ggacttgactcatctgtgat

SEQ ID NO: 660903 - DNA, 20 bp, mouse
ggtatcagggagatcaggtt

SEQ ID NO: 660904 - DNA, 20 bp, mouse
gatcaggtttggaatgtgag

SEQ ID NO: 660905 - DNA, 20 bp, mouse
gccaacctaagccttatgca

SEQ ID NO: 660906 - DNA, 20 bp, mouse
gttggggaccagaggagaat

SEQ ID NO: 660907 - DNA, 20 bp, mouse
gcaggcagggttgtgccttg

SEQ ID NO: 660908 - DNA, 20 bp, mouse
gtgaacggctgttggaagat

SEQ ID NO: 660909 - DNA, 20 bp, mouse
gtttccgcatgtgtgattgg

SEQ ID NO: 660910 - DNA, 20 bp, mouse
gcagaggagaatgggaccat

SEQ ID NO: 660911 - DNA, 20 bp, mouse
gcatctgtgtgttcataggt

SEQ ID NO: 660912 - DNA, 20 bp, mouse
gtatgctgggagagagtttc

SEQ ID NO: 660913 - DNA, 20 bp, mouse
gcaacagccgttcaggtctc

SEQ ID NO: 660914 - DNA, 20 bp, mouse
ggtaggtagcccagtccgtg

SEQ ID NO: 660915 - DNA, 20 bp, mouse
gagtccgtgtggtcagaaac

SEQ ID NO: 660916 - DNA, 20 bp, mouse
gggccagcaggggtacacag

SEQ ID NO: 660917 - DNA, 20 bp, mouse
gccaggagaaagaggcacta

SEQ ID NO: 660918 - DNA, 20 bp, mouse
gtgggggagggcacactgga

SEQ ID NO: 660919 - DNA, 20 bp, mouse
gagaagtgggggactgatag

SEQ ID NO: 660920 - DNA, 20 bp, mouse
gagcagagctgcgtgaagag

SEQ ID NO: 660921 - DNA, 20 bp, mouse
gagagctgcgtgaagagggg

SEQ ID NO: 660922 - DNA, 20 bp, mouse
gaatgagtaaatgttagctc

SEQ ID NO: 660923 - DNA, 20 bp, mouse
gcgtgaagaggggcggaggt

SEQ ID NO: 660924 - DNA, 20 bp, mouse
gccctgtaaaggggtcatga

SEQ ID NO: 660925 - DNA, 20 bp, mouse
gttggcttgcctttgtctag

SEQ ID NO: 660926 - DNA, 20 bp, mouse
gagggacagagggagcacta

SEQ ID NO: 660927 - DNA, 20 bp, mouse
gtgggccaagacctcaggct

SEQ ID NO: 660928 - DNA, 20 bp, mouse
ggaatcagagagcccttgta

SEQ ID NO: 660929 - DNA, 20 bp, mouse
ggaggatccaagctggctgg

SEQ ID NO: 660930 - DNA, 20 bp, mouse
ggagcactaaggcatatggc

SEQ ID NO: 660931 - DNA, 20 bp, mouse
gcatgcagcaaaccttacaa

SEQ ID NO: 660932 - DNA, 20 bp, mouse
gactctggcttcctgaggtt

SEQ ID NO: 660933 - DNA, 20 bp, mouse
ggagaaaggaggatccaagc

SEQ ID NO: 660934 - DNA, 20 bp, mouse
gtcagcccagcctgaggtct

SEQ ID NO: 660935 - DNA, 20 bp, mouse
ggaagagagaggatccatgg

SEQ ID NO: 660936 - DNA, 20 bp, mouse
ggctgagagaccctggaact

SEQ ID NO: 660937 - DNA, 20 bp, mouse
ggggatggagacacttgaca

SEQ ID NO: 660938 - DNA, 20 bp, mouse
gcgtggcagatgcatcccac

SEQ ID NO: 660939 - DNA, 20 bp, mouse
gtggaaacagcccagttcca

SEQ ID NO: 660940 - DNA, 20 bp, mouse
ggtggcaaggatgtgagcat

SEQ ID NO: 660941 - DNA, 20 bp, mouse
ggcagccgtgcttgcatacg

SEQ ID NO: 660942 - DNA, 20 bp, mouse
gagagctacagatacttgag

SEQ ID NO: 660943 - DNA, 20 bp, mouse
gtgcctgggcctggatggta

SEQ ID NO: 660944 - DNA, 20 bp, mouse
gctggaaggagaactctctc

SEQ ID NO: 660945 - DNA, 20 bp, mouse
gcaggcaaggtccaagagca

SEQ ID NO: 660946 - DNA, 20 bp, mouse
ggggctggaagaaatgcata

SEQ ID NO: 660947 - DNA, 20 bp, mouse
gtggctgtgggggacctgaa

SEQ ID NO: 660948 - DNA, 20 bp, mouse
gggctggggtcagcgcccag

SEQ ID NO: 660949 - DNA, 20 bp, mouse
ggacctgaagggagctctct

SEQ ID NO: 660950 - DNA, 20 bp, mouse
gggggtcagcgcccaggggc

SEQ ID NO: 660951 - DNA, 20 bp, mouse
gggaccccgcattactggag

SEQ ID NO: 660952 - DNA, 20 bp, mouse
gaaggtggaccccgcattac

SEQ ID NO: 660953 - DNA, 20 bp, mouse
gccatcccagttgtggagaa

SEQ ID NO: 660954 - DNA, 20 bp, mouse
gaaatgcataggggccccag

SEQ ID NO: 660955 - DNA, 20 bp, mouse
gaaattgcggttttccccga

SEQ ID NO: 660956 - DNA, 20 bp, mouse
ggtgccggaagcatccagca

SEQ ID NO: 660957 - DNA, 20 bp, mouse
gcccccgtgggtgggagatt

SEQ ID NO: 660958 - DNA, 20 bp, mouse
gaatgcacagaatgagattc

SEQ ID NO: 660959 - DNA, 20 bp, mouse
ggaagctggacctagtctaa

SEQ ID NO: 660960 - DNA, 20 bp, mouse
gaacagatgcccccgtgggt

SEQ ID NO: 660961 - DNA, 20 bp, mouse
ggccccctgctggatgcttc

SEQ ID NO: 660962 - DNA, 20 bp, mouse
ggtcttcacaaaagattcag

SEQ ID NO: 660963 - DNA, 20 bp, mouse
gaatcctcaaacttcagcca

SEQ ID NO: 660964 - DNA, 20 bp, mouse
gtgcaaacagatgcccccgt

SEQ ID NO: 660965 - DNA, 20 bp, mouse
ggggaacttgctggttggtg

SEQ ID NO: 660966 - DNA, 20 bp, mouse
ggggcacagagtggggtcac

SEQ ID NO: 660967 - DNA, 20 bp, mouse
gggcatgctcaattcttcag

SEQ ID NO: 660968 - DNA, 20 bp, mouse
ggagagagctggatccataa

SEQ ID NO: 660969 - DNA, 20 bp, mouse
gtggaccccaaggaggaagt

SEQ ID NO: 660970 - DNA, 20 bp, mouse
ggggctgcgggcccctcgag

SEQ ID NO: 660971 - DNA, 20 bp, mouse
ggaagtgaagggtgggcaca

SEQ ID NO: 660972 - DNA, 20 bp, mouse
gagagcctgttactgaggca

SEQ ID NO: 660973 - DNA, 20 bp, mouse
gaggctgctaaagatgtgac

SEQ ID NO: 660974 - DNA, 20 bp, mouse
gagagcttaagtcctctcga

SEQ ID NO: 660975 - DNA, 20 bp, mouse
gagcatgccaagctctggcc

SEQ ID NO: 660976 - DNA, 20 bp, mouse
ggagcccaggggccacacta

SEQ ID NO: 660977 - DNA, 20 bp, mouse
gtagccgcttggataattaa

SEQ ID NO: 660978 - DNA, 20 bp, mouse
gcagaggcactgatgtcctc

SEQ ID NO: 660979 - DNA, 20 bp, mouse
gggaagatacgagttggaga

SEQ ID NO: 660980 - DNA, 20 bp, mouse
gtaaatagcacagaagatga

SEQ ID NO: 660981 - DNA, 20 bp, mouse
gccaaagtggaacacacagt

SEQ ID NO: 660982 - DNA, 20 bp, mouse
gatctagaggcgttgagaac

SEQ ID NO: 660983 - DNA, 20 bp, mouse
ggccacactaaggccagtgc

SEQ ID NO: 660984 - DNA, 20 bp, mouse
gtggccttagtgtggcccct

SEQ ID NO: 660985 - DNA, 20 bp, mouse
gaagcccttaattatccaag

SEQ ID NO: 660986 - DNA, 20 bp, mouse
gcccactggcatctcacttg

SEQ ID NO: 660987 - DNA, 20 bp, mouse
gagcagatcttttgatggca

SEQ ID NO: 660988 - DNA, 20 bp, mouse
ggtcagagcagatcttttga

SEQ ID NO: 660989 - DNA, 20 bp, mouse
gccttgaaaggtcatgatgg

SEQ ID NO: 660990 - DNA, 20 bp, mouse
gcagtgggcagtcctgtgag

SEQ ID NO: 660991 - DNA, 20 bp, mouse
gctgcctaccattctgttga

SEQ ID NO: 660992 - DNA, 20 bp, mouse
gtaaccatcaacagaatggt

SEQ ID NO: 660993 - DNA, 20 bp, mouse
ggatcttttgatggcagggc

SEQ ID NO: 660994 - DNA, 20 bp, mouse
ggccacaagtgagatgccag

SEQ ID NO: 660995 - DNA, 20 bp, mouse
gcttgtattcatgaggttgt

SEQ ID NO: 660996 - DNA, 20 bp, mouse
ggatcttgggatggcagagc

SEQ ID NO: 660997 - DNA, 20 bp, mouse
gaaaggtcacgatggaggaa

SEQ ID NO: 660998 - DNA, 20 bp, mouse
ggccacaagtgagatgccgt

SEQ ID NO: 660999 - DNA, 20 bp, mouse
ggccgtgggcatcctgtgag

SEQ ID NO: 661000 - DNA, 20 bp, mouse
gcctccatcgtgacctttaa

SEQ ID NO: 661001 - DNA, 20 bp, mouse
gaaccatcaacagaattggt

SEQ ID NO: 661002 - DNA, 20 bp, mouse
gccatcgtgacctttaaagg

SEQ ID NO: 661003 - DNA, 20 bp, mouse
gtcctctcacaggatgccca

SEQ ID NO: 661004 - DNA, 20 bp, mouse
gtgcctaccaattctgttga

SEQ ID NO: 661005 - DNA, 20 bp, mouse
gcttgtattcatgaggatct

SEQ ID NO: 661006 - DNA, 20 bp, mouse
gcctcactacaattactcaa

SEQ ID NO: 661007 - DNA, 20 bp, mouse
gctcctgagatgaacagaca

SEQ ID NO: 661008 - DNA, 20 bp, mouse
gatgacagtaatgattgcat

SEQ ID NO: 661009 - DNA, 20 bp, mouse
gagtagatcaggccaagcgg

SEQ ID NO: 661010 - DNA, 20 bp, mouse
ggtttcggcttctgcgctta

SEQ ID NO: 661011 - DNA, 20 bp, mouse
gcctgatctactttttaaga

SEQ ID NO: 661012 - DNA, 20 bp, mouse
gagccttgtctgttcatctc

SEQ ID NO: 661013 - DNA, 20 bp, mouse
gtgggacaggagctacagac

SEQ ID NO: 661014 - DNA, 20 bp, mouse
gtgaaggtgtcaaatccctt

SEQ ID NO: 661015 - DNA, 20 bp, mouse
gggcttctctgttttagctc

SEQ ID NO: 661016 - DNA, 20 bp, mouse
gcagcacccaggaacggcct

SEQ ID NO: 661017 - DNA, 20 bp, mouse
gtgcacaggtgccaccacgc

SEQ ID NO: 661018 - DNA, 20 bp, mouse
gatgccagaaaccagcaccc

SEQ ID NO: 661019 - DNA, 20 bp, mouse
ggcagtcgcagctaagttag

SEQ ID NO: 661020 - DNA, 20 bp, mouse
ggcgcgctcccggctgtcgg

SEQ ID NO: 661021 - DNA, 20 bp, mouse
gtgcgcagaacgctcagaaa

SEQ ID NO: 661022 - DNA, 20 bp, mouse
gaacttagctgcgactgcac

SEQ ID NO: 661023 - DNA, 20 bp, mouse
gcgtcagagcctgagttccc

SEQ ID NO: 661024 - DNA, 20 bp, mouse
ggagttcccaggccgttcct

SEQ ID NO: 661025 - DNA, 20 bp, mouse
gcccgcgcgctcccggctgt

SEQ ID NO: 661026 - DNA, 20 bp, mouse
gcccctgcgcggctgcacgg

SEQ ID NO: 661027 - DNA, 20 bp, mouse
gggcggcgcaggagcgagat

SEQ ID NO: 661028 - DNA, 20 bp, mouse
ggagcgagatgggtagcgtg

SEQ ID NO: 661029 - DNA, 20 bp, mouse
ggccgcgcaggggcgctccg

SEQ ID NO: 661030 - DNA, 20 bp, mouse
gcccctcagctgaggtctta

SEQ ID NO: 661031 - DNA, 20 bp, mouse
gtccctaagacctcagctga

SEQ ID NO: 661032 - DNA, 20 bp, mouse
ggctcccgcgctccccctag

SEQ ID NO: 661033 - DNA, 20 bp, mouse
gtagcgtggggtgtcccccc

SEQ ID NO: 661034 - DNA, 20 bp, mouse
gcgccgcctcgctctgtccc

SEQ ID NO: 661035 - DNA, 20 bp, mouse
gggggtgtccccccaggctg

SEQ ID NO: 661036 - DNA, 20 bp, mouse
gtagaaacgtgtgagcgcga

SEQ ID NO: 661037 - DNA, 20 bp, mouse
gagacgacgaggagtcgccg

SEQ ID NO: 661038 - DNA, 20 bp, mouse
gccggggcggaggccacctc

SEQ ID NO: 661039 - DNA, 20 bp, mouse
gggagggggcggagacgacg

SEQ ID NO: 661040 - DNA, 20 bp, mouse
gaacactcccctggcgacag

SEQ ID NO: 661041 - DNA, 20 bp, mouse
gcacctctggaacccgccgg

SEQ ID NO: 661042 - DNA, 20 bp, mouse
ggtgtgagcgcgagggtggt

SEQ ID NO: 661043 - DNA, 20 bp, mouse
gcctggcgacagcggcgcga

SEQ ID NO: 661044 - DNA, 20 bp, mouse
gccctcaggctcggctgcgc

SEQ ID NO: 661045 - DNA, 20 bp, mouse
gacgtcacgaccgtgacatg

SEQ ID NO: 661046 - DNA, 20 bp, mouse
gcgcacgcgcacgcggaaag

SEQ ID NO: 661047 - DNA, 20 bp, mouse
gaaggaggacaaacgtagag

SEQ ID NO: 661048 - DNA, 20 bp, mouse
gcagagcacgcaaagacgcc

SEQ ID NO: 661049 - DNA, 20 bp, mouse
ggaggggtcaaacgcaaaat

SEQ ID NO: 661050 - DNA, 20 bp, mouse
gagggctcaccgagagtcta

SEQ ID NO: 661051 - DNA, 20 bp, mouse
gtgcaggtatggcgaggggc

SEQ ID NO: 661052 - DNA, 20 bp, mouse
gcggaaaggggcgaggcccc

SEQ ID NO: 661053 - DNA, 20 bp, mouse
gcttggctgaccgtctggac

SEQ ID NO: 661054 - DNA, 20 bp, mouse
ggcgcacgcggaaaggggcg

SEQ ID NO: 661055 - DNA, 20 bp, mouse
ggcggaagcggaggttgttg

SEQ ID NO: 661056 - DNA, 20 bp, mouse
gaggggtggggcctcgttga

SEQ ID NO: 661057 - DNA, 20 bp, mouse
ggaggtggagccaattcccg

SEQ ID NO: 661058 - DNA, 20 bp, mouse
ggagcctggcccaacagcac

SEQ ID NO: 661059 - DNA, 20 bp, mouse
ggcggagtgagacttgaagc

SEQ ID NO: 661060 - DNA, 20 bp, mouse
gccgtcaggggcggtgtctg

SEQ ID NO: 661061 - DNA, 20 bp, mouse
gggagaggaacttccgtcag

SEQ ID NO: 661062 - DNA, 20 bp, mouse
ggaaacccgagcaacactga

SEQ ID NO: 661063 - DNA, 20 bp, mouse
ggggaggggtgtaaagagcg

SEQ ID NO: 661064 - DNA, 20 bp, mouse
ggtggagccaattcccgcgg

SEQ ID NO: 661065 - DNA, 20 bp, mouse
gacgtggtacagacttaggg

SEQ ID NO: 661066 - DNA, 20 bp, mouse
gacacgtcagcggaagggaa

SEQ ID NO: 661067 - DNA, 20 bp, mouse
ggggaagggaggagcgagtt

SEQ ID NO: 661068 - DNA, 20 bp, mouse
gaagggaggagcgagttggg

SEQ ID NO: 661069 - DNA, 20 bp, mouse
gcaagatccagacacgtcag

SEQ ID NO: 661070 - DNA, 20 bp, mouse
gtccagacacgtcagcggaa

SEQ ID NO: 661071 - DNA, 20 bp, mouse
ggggaatcgctccctgaggc

SEQ ID NO: 661072 - DNA, 20 bp, mouse
gtaagcaggcgtagatgcga

SEQ ID NO: 661073 - DNA, 20 bp, mouse
gcccgcgctctccgtcgcca

SEQ ID NO: 661074 - DNA, 20 bp, mouse
gctactgtgacgtaataagc

SEQ ID NO: 661075 - DNA, 20 bp, mouse
gtctccgtcgccaaggaaac

SEQ ID NO: 661076 - DNA, 20 bp, mouse
ggaagaaaggaattcggctg

SEQ ID NO: 661077 - DNA, 20 bp, mouse
ggacacacacacatatcgtg

SEQ ID NO: 661078 - DNA, 20 bp, mouse
gaaggaattcggctggggat

SEQ ID NO: 661079 - DNA, 20 bp, mouse
gacgcggcgcgagtgccacc

SEQ ID NO: 661080 - DNA, 20 bp, mouse
gtgggcgagcacatgctagc

SEQ ID NO: 661081 - DNA, 20 bp, mouse
ggcacatgctagccgggaac

SEQ ID NO: 661082 - DNA, 20 bp, mouse
ggcagagcgcgggcttttcg

SEQ ID NO: 661083 - DNA, 20 bp, mouse
gctgctcgctgacttcccgg

SEQ ID NO: 661084 - DNA, 20 bp, mouse
ggcgccgcgtccccgtcgcg

SEQ ID NO: 661085 - DNA, 20 bp, mouse
gcctgaagatagacttggaa

SEQ ID NO: 661086 - DNA, 20 bp, mouse
gtgcccgcctagcagcacct

SEQ ID NO: 661087 - DNA, 20 bp, mouse
gcccccgccggggcggacgt

SEQ ID NO: 661088 - DNA, 20 bp, mouse
gcagccctggaagaacagcg

SEQ ID NO: 661089 - DNA, 20 bp, mouse
gaacagcgcgggttccacag

SEQ ID NO: 661090 - DNA, 20 bp, mouse
gaccaacccgctcttctccc

SEQ ID NO: 661091 - DNA, 20 bp, mouse
ggggcggagcctcaagctaa

SEQ ID NO: 661092 - DNA, 20 bp, mouse
gaaagcattgggacgttggg

SEQ ID NO: 661093 - DNA, 20 bp, mouse
ggggtggtggctggcgaaag

SEQ ID NO: 661094 - DNA, 20 bp, mouse
gaggcggtgttcccccgccg

SEQ ID NO: 661095 - DNA, 20 bp, mouse
ggcgccgggctctcatcagc

SEQ ID NO: 661096 - DNA, 20 bp, mouse
gagggtggggatccggatgg

SEQ ID NO: 661097 - DNA, 20 bp, mouse
ggtgaccaggaagggtgtta

SEQ ID NO: 661098 - DNA, 20 bp, mouse
ggactaggaggagaattctg

SEQ ID NO: 661099 - DNA, 20 bp, mouse
ggcgccaagccgggataagg

SEQ ID NO: 661100 - DNA, 20 bp, mouse
ggggaggagtgctacaaaag

SEQ ID NO: 661101 - DNA, 20 bp, mouse
gcaaaagtggggtgactagg

SEQ ID NO: 661102 - DNA, 20 bp, mouse
ggccgcgccaagccgggata

SEQ ID NO: 661103 - DNA, 20 bp, mouse
gcgggacgcgaaggagagag

SEQ ID NO: 661104 - DNA, 20 bp, mouse
gagacaggctagggttcctg

SEQ ID NO: 661105 - DNA, 20 bp, mouse
gcccaccctaacacccttcc

SEQ ID NO: 661106 - DNA, 20 bp, mouse
gccccccgccgcggtgggga

SEQ ID NO: 661107 - DNA, 20 bp, mouse
ggggccacctcgttgagcga

SEQ ID NO: 661108 - DNA, 20 bp, mouse
gccaccgcggcggggggaat

SEQ ID NO: 661109 - DNA, 20 bp, mouse
ggctcaacgaggtggccccg

SEQ ID NO: 661110 - DNA, 20 bp, mouse
gcctcctgggaccacagcat

SEQ ID NO: 661111 - DNA, 20 bp, mouse
gactgcagggcgagcctccc

SEQ ID NO: 661112 - DNA, 20 bp, mouse
gcacccatcgctcaacgagg

SEQ ID NO: 661113 - DNA, 20 bp, mouse
gagcctccctggaacggtgg

SEQ ID NO: 661114 - DNA, 20 bp, mouse
gtccgcggggccccatgctg

SEQ ID NO: 661115 - DNA, 20 bp, mouse
gggggagagccgcggtgcgc

SEQ ID NO: 661116 - DNA, 20 bp, mouse
ggaggggcaggagccatttt

SEQ ID NO: 661117 - DNA, 20 bp, mouse
gcccaagacagcgtagggga

SEQ ID NO: 661118 - DNA, 20 bp, mouse
gaaccaccagccagttctca

SEQ ID NO: 661119 - DNA, 20 bp, mouse
gagcgagaggtgtgttctgg

SEQ ID NO: 661120 - DNA, 20 bp, mouse
gagccggacgcctccgagga

SEQ ID NO: 661121 - DNA, 20 bp, mouse
gaagacaggtgtgcacgtct

SEQ ID NO: 661122 - DNA, 20 bp, mouse
ggagtcccaagacagcgtag

SEQ ID NO: 661123 - DNA, 20 bp, mouse
gggcgagacagctcccaaaa

SEQ ID NO: 661124 - DNA, 20 bp, mouse
ggaccgaggttcgaggtcga

SEQ ID NO: 661125 - DNA, 20 bp, mouse
ggggagcgagaggtgtgttc

SEQ ID NO: 661126 - DNA, 20 bp, mouse
gcgccagggccgcccagggg

SEQ ID NO: 661127 - DNA, 20 bp, mouse
gcgccagcgggcccggccta

SEQ ID NO: 661128 - DNA, 20 bp, mouse
ggacgcgccggagctgtaca

SEQ ID NO: 661129 - DNA, 20 bp, mouse
gctcgcgccagggccgccca

SEQ ID NO: 661130 - DNA, 20 bp, mouse
gcgcctcggcctcccctggg

SEQ ID NO: 661131 - DNA, 20 bp, mouse
ggcagggaataagaactggt

SEQ ID NO: 661132 - DNA, 20 bp, mouse
ggcgcacggactacatgtcc

SEQ ID NO: 661133 - DNA, 20 bp, mouse
ggcacggcgtggcgccggcg

SEQ ID NO: 661134 - DNA, 20 bp, mouse
gcaggggaggccgaggcgca

SEQ ID NO: 661135 - DNA, 20 bp, mouse
gggccgcccaggggaggccg

SEQ ID NO: 661136 - DNA, 20 bp, mouse
gagactggctcccccgactg

SEQ ID NO: 661137 - DNA, 20 bp, mouse
gagtccttggaacacgatcg

SEQ ID NO: 661138 - DNA, 20 bp, mouse
gggcggcggttgtagaggtg

SEQ ID NO: 661139 - DNA, 20 bp, mouse
ggggcggcggcgatgacacg

SEQ ID NO: 661140 - DNA, 20 bp, mouse
gacacgatcgagggtctctg

SEQ ID NO: 661141 - DNA, 20 bp, mouse
gcagagggatacacagaaga

SEQ ID NO: 661142 - DNA, 20 bp, mouse
gcggttgtagaggtgaggac

SEQ ID NO: 661143 - DNA, 20 bp, mouse
gccctcctccccccagtcgg

SEQ ID NO: 661144 - DNA, 20 bp, mouse
gtgaggactgtgtaccccag

SEQ ID NO: 661145 - DNA, 20 bp, mouse
ggaagccgacacgcagactc

SEQ ID NO: 661146 - DNA, 20 bp, mouse
ggaaagcagggaagagcgtc

SEQ ID NO: 661147 - DNA, 20 bp, mouse
gtggcaggacccatattctt

SEQ ID NO: 661148 - DNA, 20 bp, mouse
gagagcccgcgccgcgaggc

SEQ ID NO: 661149 - DNA, 20 bp, mouse
gcgggcagacccaagaatat

SEQ ID NO: 661150 - DNA, 20 bp, mouse
gccgccgagcggacgggatg

SEQ ID NO: 661151 - DNA, 20 bp, mouse
gagagcgaacggagatcgtt

SEQ ID NO: 661152 - DNA, 20 bp, mouse
gcgagaggccggcaaaccag

SEQ ID NO: 661153 - DNA, 20 bp, mouse
ggcggcgctgcagcctgtgg

SEQ ID NO: 661154 - DNA, 20 bp, mouse
gaagcggcgccgcacggcct

SEQ ID NO: 661155 - DNA, 20 bp, mouse
ggagaccggaagtgaaggtg

SEQ ID NO: 661156 - DNA, 20 bp, mouse
gcggcgaggcagacagtctt

SEQ ID NO: 661157 - DNA, 20 bp, mouse
ggaacaaagctgttcctcgt

SEQ ID NO: 661158 - DNA, 20 bp, mouse
gccgcgcagcaagactcctg

SEQ ID NO: 661159 - DNA, 20 bp, mouse
gaggaacttcgcttctatta

SEQ ID NO: 661160 - DNA, 20 bp, mouse
ggacccaatcagcagaaggg

SEQ ID NO: 661161 - DNA, 20 bp, mouse
gtcttcgggtgagtgaagtt

SEQ ID NO: 661162 - DNA, 20 bp, mouse
gccaatcagcagaagggagg

SEQ ID NO: 661163 - DNA, 20 bp, mouse
gtgcgcgggtgggtagaagc

SEQ ID NO: 661164 - DNA, 20 bp, mouse
gagaccgtttgcttttaatg

SEQ ID NO: 661165 - DNA, 20 bp, mouse
ggcaagcagcagctgataac

SEQ ID NO: 661166 - DNA, 20 bp, mouse
ggcaaagcgccgagcggctc

SEQ ID NO: 661167 - DNA, 20 bp, mouse
ggatcctcctacatcggaga

SEQ ID NO: 661168 - DNA, 20 bp, mouse
gcggcagattcgaagctcgg

SEQ ID NO: 661169 - DNA, 20 bp, mouse
gcggagaaggctgtcgcaca

SEQ ID NO: 661170 - DNA, 20 bp, mouse
gcgacagccttctccgatgt

SEQ ID NO: 661171 - DNA, 20 bp, mouse
gtggggcggtgcgcagcgcg

SEQ ID NO: 661172 - DNA, 20 bp, mouse
gacccggaagcacttggcgg

SEQ ID NO: 661173 - DNA, 20 bp, mouse
gcgaagtggggccgtactga

SEQ ID NO: 661174 - DNA, 20 bp, mouse
gcgggcggcggaagtggatt

SEQ ID NO: 661175 - DNA, 20 bp, mouse
gggagccgagggaatgccgc

SEQ ID NO: 661176 - DNA, 20 bp, mouse
ggcaggcccacgccctccta

SEQ ID NO: 661177 - DNA, 20 bp, mouse
gcgtgggcctgcaagcacag

SEQ ID NO: 661178 - DNA, 20 bp, mouse
ggtgtgagtcaggtctgtgg

SEQ ID NO: 661179 - DNA, 20 bp, mouse
gccactccctaggagggcgt

SEQ ID NO: 661180 - DNA, 20 bp, mouse
gcgtgccgccactccctagg

SEQ ID NO: 661181 - DNA, 20 bp, mouse
gaagttaggctgcgtgggct

SEQ ID NO: 661182 - DNA, 20 bp, mouse
gtgcgcctcaaaccgcgcgg

SEQ ID NO: 661183 - DNA, 20 bp, mouse
gctccgtgccgccactccct

SEQ ID NO: 661184 - DNA, 20 bp, mouse
gccgcgcggaggtgtgagtc

SEQ ID NO: 661185 - DNA, 20 bp, mouse
ggatcactccaggtcacgga

SEQ ID NO: 661186 - DNA, 20 bp, mouse
ggggccctgtgcttgtgagg

SEQ ID NO: 661187 - DNA, 20 bp, mouse
ggggccgcagcgcaaggtct

SEQ ID NO: 661188 - DNA, 20 bp, mouse
gcgtccccgcgccgagaagc

SEQ ID NO: 661189 - DNA, 20 bp, mouse
gtgaaggttcccgggagctc

SEQ ID NO: 661190 - DNA, 20 bp, mouse
ggggcggcgtccctggttac

SEQ ID NO: 661191 - DNA, 20 bp, mouse
gtggaacgcccgcgtcgtta

SEQ ID NO: 661192 - DNA, 20 bp, mouse
ggcagcgcaaggtctcggga

SEQ ID NO: 661193 - DNA, 20 bp, mouse
ggcactaggccagagctccc

SEQ ID NO: 661194 - DNA, 20 bp, mouse
gagggatcaggactagccaa

SEQ ID NO: 661195 - DNA, 20 bp, mouse
ggccgagaagccggaagctg

SEQ ID NO: 661196 - DNA, 20 bp, mouse
ggcgcccgcgggaccgataa

SEQ ID NO: 661197 - DNA, 20 bp, mouse
gcggccgcccggaaggtcgg

SEQ ID NO: 661198 - DNA, 20 bp, mouse
gactggagggcgggcgagaa

SEQ ID NO: 661199 - DNA, 20 bp, mouse
gcacgcctgccgattcgtcg

SEQ ID NO: 661200 - DNA, 20 bp, mouse
ggcagcccgggacccgactc

SEQ ID NO: 661201 - DNA, 20 bp, mouse
gtaagcctcgcccctgtccc

SEQ ID NO: 661202 - DNA, 20 bp, mouse
gacccgactcgggccgtggg

SEQ ID NO: 661203 - DNA, 20 bp, mouse
gaaaggaactcaagaatcgt

SEQ ID NO: 661204 - DNA, 20 bp, mouse
ggggccaaaagccaacaacg

SEQ ID NO: 661205 - DNA, 20 bp, mouse
ggggcccggagtaggccggt

SEQ ID NO: 661206 - DNA, 20 bp, mouse
gggaagtggcgtactgccga

SEQ ID NO: 661207 - DNA, 20 bp, mouse
gtgggctacataagcatgat

SEQ ID NO: 661208 - DNA, 20 bp, mouse
gccacttccgatcccttctg

SEQ ID NO: 661209 - DNA, 20 bp, mouse
ggaacctccctttctaactc

SEQ ID NO: 661210 - DNA, 20 bp, mouse
gtctctgggtttttgtggtt

SEQ ID NO: 661211 - DNA, 20 bp, mouse
gtagaaacctgagttagaaa

SEQ ID NO: 661212 - DNA, 20 bp, mouse
gctccggccagctggccaat

SEQ ID NO: 661213 - DNA, 20 bp, mouse
gcggatgcaccatcctcctc

SEQ ID NO: 661214 - DNA, 20 bp, mouse
gacggcaacttagtgtgggg

SEQ ID NO: 661215 - DNA, 20 bp, mouse
gttctacccgagtccacaga

SEQ ID NO: 661216 - DNA, 20 bp, mouse
gcacaagatcggggtcacgt

SEQ ID NO: 661217 - DNA, 20 bp, mouse
gtgtggggcgggactgaacg

SEQ ID NO: 661218 - DNA, 20 bp, mouse
ggtgggcggggtttgggcga

SEQ ID NO: 661219 - DNA, 20 bp, mouse
gccgccagcggcagccgctg

SEQ ID NO: 661220 - DNA, 20 bp, mouse
gctcccgccggtcacaagat

SEQ ID NO: 661221 - DNA, 20 bp, mouse
ggaagtccaagatccattgt

SEQ ID NO: 661222 - DNA, 20 bp, mouse
gaagatcggggtcacgtggg

SEQ ID NO: 661223 - DNA, 20 bp, mouse
gaggaggccaggatcttgtt

SEQ ID NO: 661224 - DNA, 20 bp, mouse
gacgcctcagcggctgccgc

SEQ ID NO: 661225 - DNA, 20 bp, mouse
gcgtcttaaagacgcctcag

SEQ ID NO: 661226 - DNA, 20 bp, mouse
gtcccctaggggctgcgggt

SEQ ID NO: 661227 - DNA, 20 bp, mouse
gagcttcaagggtacagggg

SEQ ID NO: 661228 - DNA, 20 bp, mouse
gctcccacccgcagccccta

SEQ ID NO: 661229 - DNA, 20 bp, mouse
gaggcgtcccctaggggctg

SEQ ID NO: 661230 - DNA, 20 bp, mouse
gcaggggaggcgtcccctag

SEQ ID NO: 661231 - DNA, 20 bp, mouse
gcggggctgcaaggcggggc

SEQ ID NO: 661232 - DNA, 20 bp, mouse
ggatcctgtgcaagccccgc

SEQ ID NO: 661233 - DNA, 20 bp, mouse
ggagcctgcggggcttgcac

SEQ ID NO: 661234 - DNA, 20 bp, mouse
gacggcgcgcccacgcggtg

SEQ ID NO: 661235 - DNA, 20 bp, mouse
ggcacaggatcactcctgat

SEQ ID NO: 661236 - DNA, 20 bp, mouse
gctggtcactagtttgtctc

SEQ ID NO: 661237 - DNA, 20 bp, mouse
gtgtgcagaacatggggtct

SEQ ID NO: 661238 - DNA, 20 bp, mouse
ggaggcaggatatcagatac

SEQ ID NO: 661239 - DNA, 20 bp, mouse
gtgaccagcaatcacatgtg

SEQ ID NO: 661240 - DNA, 20 bp, mouse
ggtgggggagagggttgtcc

SEQ ID NO: 661241 - DNA, 20 bp, mouse
gcaatcacatgtgggggaga

SEQ ID NO: 661242 - DNA, 20 bp, mouse
gagtcagccagggaaacctc

SEQ ID NO: 661243 - DNA, 20 bp, mouse
gggaagcagtggggttggaa

SEQ ID NO: 661244 - DNA, 20 bp, mouse
ggagagggttgtcctggctg

SEQ ID NO: 661245 - DNA, 20 bp, mouse
gctagccaattctgacttca

SEQ ID NO: 661246 - DNA, 20 bp, mouse
ggtacgtcttcgggcgttgg

SEQ ID NO: 661247 - DNA, 20 bp, mouse
gagaagtggggccgcctgaa

SEQ ID NO: 661248 - DNA, 20 bp, mouse
ggggcagattgggtgggcaa

SEQ ID NO: 661249 - DNA, 20 bp, mouse
gaatgggggagagactgccg

SEQ ID NO: 661250 - DNA, 20 bp, mouse
gcggaggccgggctaggcag

SEQ ID NO: 661251 - DNA, 20 bp, mouse
gaggcggctggcgaatggag

SEQ ID NO: 661252 - DNA, 20 bp, mouse
ggcgccgcggtctccgggag

SEQ ID NO: 661253 - DNA, 20 bp, mouse
gctgaagggaggggcagatt

SEQ ID NO: 661254 - DNA, 20 bp, mouse
gcgaactgatctggcacagg

SEQ ID NO: 661255 - DNA, 20 bp, mouse
gagtggggccgcctgaaggg

SEQ ID NO: 661256 - DNA, 20 bp, mouse
gtggcaggaggcgggttctg

SEQ ID NO: 661257 - DNA, 20 bp, mouse
ggcctaccggcaatctcctt

SEQ ID NO: 661258 - DNA, 20 bp, mouse
gtgagattggagcgtgtcag

SEQ ID NO: 661259 - DNA, 20 bp, mouse
gcctccccgcagtaaggata

SEQ ID NO: 661260 - DNA, 20 bp, mouse
gtgccaggcttcacagccaa

SEQ ID NO: 661261 - DNA, 20 bp, mouse
gcctgcgccatactcaccac

SEQ ID NO: 661262 - DNA, 20 bp, mouse
gtcgcggctgcgtgtggcgt

SEQ ID NO: 661263 - DNA, 20 bp, mouse
ggaagaattggataaattcg

SEQ ID NO: 661264 - DNA, 20 bp, mouse
ggccaaaggagattgccggt

SEQ ID NO: 661265 - DNA, 20 bp, mouse
gtgaggaacaagaagtagac

SEQ ID NO: 661266 - DNA, 20 bp, mouse
gtgctagtgaaatgcactga

SEQ ID NO: 661267 - DNA, 20 bp, mouse
gagagcagcagcactgattt

SEQ ID NO: 661268 - DNA, 20 bp, mouse
gcccttgcagaaactgatcc

SEQ ID NO: 661269 - DNA, 20 bp, mouse
gtgaccaagaggctgatgat

SEQ ID NO: 661270 - DNA, 20 bp, mouse
gtatgcaaaaaaaatcgctg

SEQ ID NO: 661271 - DNA, 20 bp, mouse
gcactgggaatgttatcatt

SEQ ID NO: 661272 - DNA, 20 bp, mouse
gctacaagaagctagatgtt

SEQ ID NO: 661273 - DNA, 20 bp, mouse
gtgctctcctgaattctcat

SEQ ID NO: 661274 - DNA, 20 bp, mouse
gtagatcaatgcaatgggac

SEQ ID NO: 661275 - DNA, 20 bp, mouse
gagcgcttcggaaatcctgc

SEQ ID NO: 661276 - DNA, 20 bp, mouse
gaggacggaccaaactgaac

SEQ ID NO: 661277 - DNA, 20 bp, mouse
ggggaaagccctggaatctg

SEQ ID NO: 661278 - DNA, 20 bp, mouse
gacagcaggtagactagcgc

SEQ ID NO: 661279 - DNA, 20 bp, mouse
gtcacggacgctaatggccc

SEQ ID NO: 661280 - DNA, 20 bp, mouse
gtgagggacgccaagaggtg

SEQ ID NO: 661281 - DNA, 20 bp, mouse
gtgctgttgcgcaagggtgg

SEQ ID NO: 661282 - DNA, 20 bp, mouse
gctgaactggcacagacagc

SEQ ID NO: 661283 - DNA, 20 bp, mouse
gctaatggccctggcttgta

SEQ ID NO: 661284 - DNA, 20 bp, mouse
gaaagccctggaatctgagg

SEQ ID NO: 661285 - DNA, 20 bp, mouse
ggactactgctgttgcgcaa

SEQ ID NO: 661286 - DNA, 20 bp, mouse
gggtcccgccaagtactcga

SEQ ID NO: 661287 - DNA, 20 bp, mouse
gcaaccctcgagtacttggc

SEQ ID NO: 661288 - DNA, 20 bp, mouse
gagggttgattttacttcgc

SEQ ID NO: 661289 - DNA, 20 bp, mouse
gaggggcggtgctcgtcttc

SEQ ID NO: 661290 - DNA, 20 bp, mouse
gccaccccgcgaaaaagact

SEQ ID NO: 661291 - DNA, 20 bp, mouse
gcaacgctataccgcccaat

SEQ ID NO: 661292 - DNA, 20 bp, mouse
gttacttcgcgggctcccat

SEQ ID NO: 661293 - DNA, 20 bp, mouse
gcggaatagacgcacgccaa

SEQ ID NO: 661294 - DNA, 20 bp, mouse
gtccagtgacaggagaccgg

SEQ ID NO: 661295 - DNA, 20 bp, mouse
gtggctgactgggaaccgag

SEQ ID NO: 661296 - DNA, 20 bp, mouse
gtggttgcgtatctgaacgg

SEQ ID NO: 661297 - DNA, 20 bp, mouse
gagcccctggcgccaggctg

SEQ ID NO: 661298 - DNA, 20 bp, mouse
gagactctctaggcacacgg

SEQ ID NO: 661299 - DNA, 20 bp, mouse
gggcggcgaccaagagaaag

SEQ ID NO: 661300 - DNA, 20 bp, mouse
gggcggctcggtggtgacgg

SEQ ID NO: 661301 - DNA, 20 bp, mouse
ggaagcgagcgccttggagc

SEQ ID NO: 661302 - DNA, 20 bp, mouse
gttaactcacagcctaacgt

SEQ ID NO: 661303 - DNA, 20 bp, mouse
gaggtggttgcgtatctgaa

SEQ ID NO: 661304 - DNA, 20 bp, mouse
gacgcggcgaggcgagatgg

SEQ ID NO: 661305 - DNA, 20 bp, mouse
ggcgctcgcttccggtctcg

SEQ ID NO: 661306 - DNA, 20 bp, mouse
gagagcttggagcaaccctt

SEQ ID NO: 661307 - DNA, 20 bp, mouse
gggagccaagctagagcgca

SEQ ID NO: 661308 - DNA, 20 bp, mouse
gtagcttggctcccacgctg

SEQ ID NO: 661309 - DNA, 20 bp, mouse
ggcaacccttaggcggaggt

SEQ ID NO: 661310 - DNA, 20 bp, mouse
gggtgcttgtaaccggggac

SEQ ID NO: 661311 - DNA, 20 bp, mouse
ggctctgccagccctttctg

SEQ ID NO: 661312 - DNA, 20 bp, mouse
gaagatccgctagtggtcag

SEQ ID NO: 661313 - DNA, 20 bp, mouse
gtggagcaacccttaggcgg

SEQ ID NO: 661314 - DNA, 20 bp, mouse
gagtgttcgagccccagaaa

SEQ ID NO: 661315 - DNA, 20 bp, mouse
gtggaggcctgtagaggtcg

SEQ ID NO: 661316 - DNA, 20 bp, mouse
gtgaaggcctgggttactgg

SEQ ID NO: 661317 - DNA, 20 bp, mouse
gggagcaccgtgttagacgg

SEQ ID NO: 661318 - DNA, 20 bp, mouse
gttagacggcggtggaccca

SEQ ID NO: 661319 - DNA, 20 bp, mouse
gggtccaccgccgtctaaca

SEQ ID NO: 661320 - DNA, 20 bp, mouse
gcaggcatgccgggatacgg

SEQ ID NO: 661321 - DNA, 20 bp, mouse
gcatgccgggatacggcgga

SEQ ID NO: 661322 - DNA, 20 bp, mouse
ggcccaccacccctcggctt

SEQ ID NO: 661323 - DNA, 20 bp, mouse
gtaggacaggctgaaggcct

SEQ ID NO: 661324 - DNA, 20 bp, mouse
gtactgggggccagttgcta

SEQ ID NO: 661325 - DNA, 20 bp, mouse
gcctgtcctagcattgtggt

SEQ ID NO: 661326 - DNA, 20 bp, mouse
gcggccttccgctgtctgtc

SEQ ID NO: 661327 - DNA, 20 bp, mouse
gaaggccgcgccgtaatcac

SEQ ID NO: 661328 - DNA, 20 bp, mouse
gtgtcccggagctagaggcg

SEQ ID NO: 661329 - DNA, 20 bp, mouse
gcaagcgaacgattggttac

SEQ ID NO: 661330 - DNA, 20 bp, mouse
gcgagctctgccattggtca

SEQ ID NO: 661331 - DNA, 20 bp, mouse
gcagcgcaagcctgcgggtt

SEQ ID NO: 661332 - DNA, 20 bp, mouse
gccgggacagccttgaccaa

SEQ ID NO: 661333 - DNA, 20 bp, mouse
gccgaagtgagaagcgatta

SEQ ID NO: 661334 - DNA, 20 bp, mouse
gtacaattcccgacagacag

SEQ ID NO: 661335 - DNA, 20 bp, mouse
gacttcaagtcccacaaggc

SEQ ID NO: 661336 - DNA, 20 bp, mouse
gaggccgccccaatcctcgg

SEQ ID NO: 661337 - DNA, 20 bp, mouse
ggagacggagagaaccgacg

SEQ ID NO: 661338 - DNA, 20 bp, mouse
gcccgctgtcgcggccccgt

SEQ ID NO: 661339 - DNA, 20 bp, mouse
gaccgacggggccgcgacag

SEQ ID NO: 661340 - DNA, 20 bp, mouse
gccacgccccagttaggttg

SEQ ID NO: 661341 - DNA, 20 bp, mouse
gtggcggcccccgaggattg

SEQ ID NO: 661342 - DNA, 20 bp, mouse
ggggttcggtcccgctgtcg

SEQ ID NO: 661343 - DNA, 20 bp, mouse
gtgtctctgaggggcgggtt

SEQ ID NO: 661344 - DNA, 20 bp, mouse
gagagcaggcgtcacgtgac

SEQ ID NO: 661345 - DNA, 20 bp, mouse
gctaactggggcgtggcttg

SEQ ID NO: 661346 - DNA, 20 bp, mouse
gtcggtctgaaaaagatctc

SEQ ID NO: 661347 - DNA, 20 bp, mouse
ggtcaggggcggggcgacgt

SEQ ID NO: 661348 - DNA, 20 bp, mouse
ggcgtccgccagggtaaacg

SEQ ID NO: 661349 - DNA, 20 bp, mouse
ggagcttgagaccaacctgt

SEQ ID NO: 661350 - DNA, 20 bp, mouse
gactacggacaggcagcgcg

SEQ ID NO: 661351 - DNA, 20 bp, mouse
ggttcctcgccggtctactg

SEQ ID NO: 661352 - DNA, 20 bp, mouse
gcgggaggggcttgtgttta

SEQ ID NO: 661353 - DNA, 20 bp, mouse
ggatctctggacaccttaaa

SEQ ID NO: 661354 - DNA, 20 bp, mouse
gagcgcctccatgttctaag

SEQ ID NO: 661355 - DNA, 20 bp, mouse
gaggcccgcagatatggtca

SEQ ID NO: 661356 - DNA, 20 bp, mouse
gcgcgaaagcgcggggagac

SEQ ID NO: 661357 - DNA, 20 bp, mouse
ggagccgccgcacgcgaagc

SEQ ID NO: 661358 - DNA, 20 bp, mouse
gcggcggctcgatccgggga

SEQ ID NO: 661359 - DNA, 20 bp, mouse
gaagcgcggggagaccggag

SEQ ID NO: 661360 - DNA, 20 bp, mouse
gcgatccggggagggagtga

SEQ ID NO: 661361 - DNA, 20 bp, mouse
gcggcagcgccacctccacg

SEQ ID NO: 661362 - DNA, 20 bp, mouse
gcgggcgggggcatccgctc

SEQ ID NO: 661363 - DNA, 20 bp, mouse
gctccacggggcaccgtccc

SEQ ID NO: 661364 - DNA, 20 bp, mouse
gcgtgcggcggctcgatccg

SEQ ID NO: 661365 - DNA, 20 bp, mouse
gcggggagatgagcgcgaag

SEQ ID NO: 661366 - DNA, 20 bp, mouse
gaggagtagccggatgtctt

SEQ ID NO: 661367 - DNA, 20 bp, mouse
gaaaggggaaagcaggtaca

SEQ ID NO: 661368 - DNA, 20 bp, mouse
gactaaagggaaggagtagc

SEQ ID NO: 661369 - DNA, 20 bp, mouse
gctagtaatgaggtggtgtc

SEQ ID NO: 661370 - DNA, 20 bp, mouse
ggagggtggacgagtctcat

SEQ ID NO: 661371 - DNA, 20 bp, mouse
ggagacacagaaccactaaa

SEQ ID NO: 661372 - DNA, 20 bp, mouse
ggactacccaccctccaaag

SEQ ID NO: 661373 - DNA, 20 bp, mouse
gcctacgtctagtaatgagg

SEQ ID NO: 661374 - DNA, 20 bp, mouse
gtggagggtgggtagtcctt

SEQ ID NO: 661375 - DNA, 20 bp, mouse
gcacagaaccactaaaggga

SEQ ID NO: 661376 - DNA, 20 bp, mouse
gggcctggaagctggacgga

SEQ ID NO: 661377 - DNA, 20 bp, mouse
ggatgctgggatgtatggat

SEQ ID NO: 661378 - DNA, 20 bp, mouse
ggggaagatgctgggatgta

SEQ ID NO: 661379 - DNA, 20 bp, mouse
gggaagctggacggacgggg

SEQ ID NO: 661380 - DNA, 20 bp, mouse
gtccccctccccctccgaaa

SEQ ID NO: 661381 - DNA, 20 bp, mouse
ggaaggatgctgcaggagag

SEQ ID NO: 661382 - DNA, 20 bp, mouse
gagggccgggagtccccgga

SEQ ID NO: 661383 - DNA, 20 bp, mouse
ggtgccggagagaaaggacg

SEQ ID NO: 661384 - DNA, 20 bp, mouse
gaaccctttcggagggggag

SEQ ID NO: 661385 - DNA, 20 bp, mouse
gacgctgacatcaccatccg

SEQ ID NO: 661386 - DNA, 20 bp, mouse
ggggccaggaaaagcgagat

SEQ ID NO: 661387 - DNA, 20 bp, mouse
gggctcggaggcactcgaag

SEQ ID NO: 661388 - DNA, 20 bp, mouse
ggagcccgagcgagcgccac

SEQ ID NO: 661389 - DNA, 20 bp, mouse
gcagccggtggcgctcgctc

SEQ ID NO: 661390 - DNA, 20 bp, mouse
ggagactggcggggcggtcc

SEQ ID NO: 661391 - DNA, 20 bp, mouse
gcgagattggggtgttgttg

SEQ ID NO: 661392 - DNA, 20 bp, mouse
ggcttgcagctgtcaatcag

SEQ ID NO: 661393 - DNA, 20 bp, mouse
gtcggctgctcgtctgggct

SEQ ID NO: 661394 - DNA, 20 bp, mouse
gccagcgcgctcttagagac

SEQ ID NO: 661395 - DNA, 20 bp, mouse
gccaggcggaagacgctgat

SEQ ID NO: 661396 - DNA, 20 bp, mouse
gtcggcgtcctgtgcgtcgg

SEQ ID NO: 661397 - DNA, 20 bp, mouse
ggcgtggcacgacgcggatg

SEQ ID NO: 661398 - DNA, 20 bp, mouse
gccagccggggctgcgtccg

SEQ ID NO: 661399 - DNA, 20 bp, mouse
ggggcgtgaagcgcaaaagg

SEQ ID NO: 661400 - DNA, 20 bp, mouse
ggcctcggcgtcctgtgcgt

SEQ ID NO: 661401 - DNA, 20 bp, mouse
ggggctggggcgcgcgtggc

SEQ ID NO: 661402 - DNA, 20 bp, mouse
gtacggcgagctggagtgga

SEQ ID NO: 661403 - DNA, 20 bp, mouse
gcccaggtgaccgtcctccc

SEQ ID NO: 661404 - DNA, 20 bp, mouse
ggccgccggcctttgtgcgg

SEQ ID NO: 661405 - DNA, 20 bp, mouse
ggtggctgaacccagagcgg

SEQ ID NO: 661406 - DNA, 20 bp, mouse
ggggtggagccatagaaaga

SEQ ID NO: 661407 - DNA, 20 bp, mouse
ggagccgcttgcaaagctcc

SEQ ID NO: 661408 - DNA, 20 bp, mouse
gaggagctgaagtcgccgag

SEQ ID NO: 661409 - DNA, 20 bp, mouse
gtaactaggcaaccccaggc

SEQ ID NO: 661410 - DNA, 20 bp, mouse
ggcggccgccttagtgcctc

SEQ ID NO: 661411 - DNA, 20 bp, mouse
ggctgaagtcgccgaggggt

SEQ ID NO: 661412 - DNA, 20 bp, mouse
gtcaaactctgtggtggcgt

SEQ ID NO: 661413 - DNA, 20 bp, mouse
gtattctagcccaagagctg

SEQ ID NO: 661414 - DNA, 20 bp, mouse
gaggaagaggttctaaatgc

SEQ ID NO: 661415 - DNA, 20 bp, mouse
gcaatcttcgtcaaactctg

SEQ ID NO: 661416 - DNA, 20 bp, mouse
gaaggagtcccagactgcgt

SEQ ID NO: 661417 - DNA, 20 bp, mouse
gagacaggtggtaaaggtat

SEQ ID NO: 661418 - DNA, 20 bp, mouse
gctgcgttggagattataat

SEQ ID NO: 661419 - DNA, 20 bp, mouse
gataatctccaacgcagtct

SEQ ID NO: 661420 - DNA, 20 bp, mouse
gctgaaaagacaggtggtaa

SEQ ID NO: 661421 - DNA, 20 bp, mouse
ggagggttgtggttgaggcc

SEQ ID NO: 661422 - DNA, 20 bp, mouse
gggcctggaaaggaggacca

SEQ ID NO: 661423 - DNA, 20 bp, mouse
gcaactgtcaatcgcctaca

SEQ ID NO: 661424 - DNA, 20 bp, mouse
gaaaaactggagactgaaag

SEQ ID NO: 661425 - DNA, 20 bp, mouse
ggtgtaatgggcagagacac

SEQ ID NO: 661426 - DNA, 20 bp, mouse
gccctctcaaagtcagagtc

SEQ ID NO: 661427 - DNA, 20 bp, mouse
gggtccccagcgttcccaat

SEQ ID NO: 661428 - DNA, 20 bp, mouse
gcgatcctctggtcttaaaa

SEQ ID NO: 661429 - DNA, 20 bp, mouse
gcagccaatgcccaagatgg

SEQ ID NO: 661430 - DNA, 20 bp, mouse
gagaccaatcacggggagtg

SEQ ID NO: 661431 - DNA, 20 bp, mouse
ggccgagggtgctcttaaaa

SEQ ID NO: 661432 - DNA, 20 bp, mouse
gcatccccactccccgtgat

SEQ ID NO: 661433 - DNA, 20 bp, mouse
gcggcagccaatgcccaaga

SEQ ID NO: 661434 - DNA, 20 bp, mouse
gaagaccagaggatcgcata

SEQ ID NO: 661435 - DNA, 20 bp, mouse
ggagggtgctcttaaaatgg

SEQ ID NO: 661436 - DNA, 20 bp, mouse
gaaagctagcggctggttgg

SEQ ID NO: 661437 - DNA, 20 bp, mouse
ggtgccgtgtcggaagtcaa

SEQ ID NO: 661438 - DNA, 20 bp, mouse
gacaaatcgcatttgggaca

SEQ ID NO: 661439 - DNA, 20 bp, mouse
gctctgaactctcgatccaa

SEQ ID NO: 661440 - DNA, 20 bp, mouse
gggatcgagagttcagaggc

SEQ ID NO: 661441 - DNA, 20 bp, mouse
gcagacacattgatgtaggg

SEQ ID NO: 661442 - DNA, 20 bp, mouse
gaggccagacacattgatgt

SEQ ID NO: 661443 - DNA, 20 bp, mouse
gtgggacatggattggacaa

SEQ ID NO: 661444 - DNA, 20 bp, mouse
gggactaccgggaaagctag

SEQ ID NO: 661445 - DNA, 20 bp, mouse
gctaacgagcctgccgaaat

SEQ ID NO: 661446 - DNA, 20 bp, mouse
gtgacctggcatgacacagt

SEQ ID NO: 661447 - DNA, 20 bp, mouse
gaaaatgtgccagtcactag

SEQ ID NO: 661448 - DNA, 20 bp, mouse
gcatagcatcaaagagtcta

SEQ ID NO: 661449 - DNA, 20 bp, mouse
gctaagagggtgaagcatgt

SEQ ID NO: 661450 - DNA, 20 bp, mouse
gatgacacagtgggacaata

SEQ ID NO: 661451 - DNA, 20 bp, mouse
gttcagaggcccatctttaa

SEQ ID NO: 661452 - DNA, 20 bp, mouse
gtgtcccactgtgtcatgcc

SEQ ID NO: 661453 - DNA, 20 bp, mouse
gtgcacagtgcacaagggtg

SEQ ID NO: 661454 - DNA, 20 bp, mouse
gtgaggacaaagatcttcag

SEQ ID NO: 661455 - DNA, 20 bp, mouse
gtgccaggtcagaagtaggc

SEQ ID NO: 661456 - DNA, 20 bp, mouse
gcccgctcgcgctacaggag

SEQ ID NO: 661457 - DNA, 20 bp, mouse
gacacaggccacaccctcga

SEQ ID NO: 661458 - DNA, 20 bp, mouse
gcgcgcgcgcgcgagctcaa

SEQ ID NO: 661459 - DNA, 20 bp, mouse
gcctgtagcgcgagcgggag

SEQ ID NO: 661460 - DNA, 20 bp, mouse
gtcgcgctacaggagcggag

SEQ ID NO: 661461 - DNA, 20 bp, mouse
gggcggggcgccaggcacac

SEQ ID NO: 661462 - DNA, 20 bp, mouse
ggcgagctcaagggcagtcc

SEQ ID NO: 661463 - DNA, 20 bp, mouse
gagcgggagcggcggacgct

SEQ ID NO: 661464 - DNA, 20 bp, mouse
gcgcacgcggcgtcgcaggg

SEQ ID NO: 661465 - DNA, 20 bp, mouse
gtagagaagagcggggatag

SEQ ID NO: 661466 - DNA, 20 bp, mouse
gcaacacccgccggccgcgt

SEQ ID NO: 661467 - DNA, 20 bp, mouse
ggcgccctccgcagccaacg

SEQ ID NO: 661468 - DNA, 20 bp, mouse
ggccggcgggtgttgaatga

SEQ ID NO: 661469 - DNA, 20 bp, mouse
gcgaccccgaggctggtgcg

SEQ ID NO: 661470 - DNA, 20 bp, mouse
gcctccgcagccaacgcggc

SEQ ID NO: 661471 - DNA, 20 bp, mouse
ggtcgccgggaaaaggcctc

SEQ ID NO: 661472 - DNA, 20 bp, mouse
gcctcggggtcgccgggaaa

SEQ ID NO: 661473 - DNA, 20 bp, mouse
ggaaggccggcggcctcggg

SEQ ID NO: 661474 - DNA, 20 bp, mouse
gtgactggcattacagacgt

SEQ ID NO: 661475 - DNA, 20 bp, mouse
ggtggctggctgcaatctgc

SEQ ID NO: 661476 - DNA, 20 bp, mouse
ggaggcgggggaagtcacag

SEQ ID NO: 661477 - DNA, 20 bp, mouse
gcacccatgcctcccagaga

SEQ ID NO: 661478 - DNA, 20 bp, mouse
gcatgcctcccagagatggg

SEQ ID NO: 661479 - DNA, 20 bp, mouse
ggggaggtgcaaagcctgtc

SEQ ID NO: 661480 - DNA, 20 bp, mouse
gggcatgggtggggccacgg

SEQ ID NO: 661481 - DNA, 20 bp, mouse
gaatggagacatatctagga

SEQ ID NO: 661482 - DNA, 20 bp, mouse
gtgtctatgctgtcaggctg

SEQ ID NO: 661483 - DNA, 20 bp, mouse
gtccttgagaaggtgtcttt

SEQ ID NO: 661484 - DNA, 20 bp, mouse
gacaggggctgggccagtca

SEQ ID NO: 661485 - DNA, 20 bp, mouse
gagctctgaacatgggacag

SEQ ID NO: 661486 - DNA, 20 bp, mouse
ggtgtcatagtgttgtcttt

SEQ ID NO: 661487 - DNA, 20 bp, mouse
gtaggacaaagaattcactg

SEQ ID NO: 661488 - DNA, 20 bp, mouse
gcatctctctagagttactt

SEQ ID NO: 661489 - DNA, 20 bp, mouse
gatagtgttgtcttttgggg

SEQ ID NO: 661490 - DNA, 20 bp, mouse
gcataacaaagttttcagat

SEQ ID NO: 661491 - DNA, 20 bp, mouse
gttacattcggaacccaatt

SEQ ID NO: 661492 - DNA, 20 bp, mouse
gctctctagagttacttggg

SEQ ID NO: 661493 - DNA, 20 bp, mouse
gtcctggttttctatacata

SEQ ID NO: 661494 - DNA, 20 bp, mouse
gatttgagatcgtgctatga

SEQ ID NO: 661495 - DNA, 20 bp, mouse
gcttctgagttgctatttcc

SEQ ID NO: 661496 - DNA, 20 bp, mouse
ggatgcaggcggaaccagtg

SEQ ID NO: 661497 - DNA, 20 bp, mouse
gcgcgggcgcagcctgggag

SEQ ID NO: 661498 - DNA, 20 bp, mouse
gtggttccgcctgcatctgt

SEQ ID NO: 661499 - DNA, 20 bp, mouse
ggtaggctgtggttctttat

SEQ ID NO: 661500 - DNA, 20 bp, mouse
ggcgctgacccacaccacac

SEQ ID NO: 661501 - DNA, 20 bp, mouse
gcacctgtcgcaggtaccga

SEQ ID NO: 661502 - DNA, 20 bp, mouse
gaaccacagcctacagatgc

SEQ ID NO: 661503 - DNA, 20 bp, mouse
gggcggaaccagtgtggtgt

SEQ ID NO: 661504 - DNA, 20 bp, mouse
ggtggtgtgggtcagcgcgc

SEQ ID NO: 661505 - DNA, 20 bp, mouse
ggggcgaagccagagagggc

SEQ ID NO: 661506 - DNA, 20 bp, mouse
ggcaaaagacgcctcgtgga

SEQ ID NO: 661507 - DNA, 20 bp, mouse
gcctcgtggagggaccccaa

SEQ ID NO: 661508 - DNA, 20 bp, mouse
gtcaaattcccattcccttt

SEQ ID NO: 661509 - DNA, 20 bp, mouse
gcctggcaaaagacgcctcg

SEQ ID NO: 661510 - DNA, 20 bp, mouse
gaccgcctcctcagtggaag

SEQ ID NO: 661511 - DNA, 20 bp, mouse
gaggggaaccgcctcctcag

SEQ ID NO: 661512 - DNA, 20 bp, mouse
gggtgggctggcttggcatc

SEQ ID NO: 661513 - DNA, 20 bp, mouse
gcctgtgctccagaatccat

SEQ ID NO: 661514 - DNA, 20 bp, mouse
gacacctgccccatggattc

SEQ ID NO: 661515 - DNA, 20 bp, mouse
gtacgacagaaattaaactt

SEQ ID NO: 661516 - DNA, 20 bp, mouse
gcccacaggcaccaggtgac

SEQ ID NO: 661517 - DNA, 20 bp, mouse
gggcggctctagaattgcgt

SEQ ID NO: 661518 - DNA, 20 bp, mouse
gggcggggttatgctaataa

SEQ ID NO: 661519 - DNA, 20 bp, mouse
gacctggtgcctgtgggctt

SEQ ID NO: 661520 - DNA, 20 bp, mouse
ggcagagacaggccggttgt

SEQ ID NO: 661521 - DNA, 20 bp, mouse
gaaggggaactaagacttca

SEQ ID NO: 661522 - DNA, 20 bp, mouse
gttgcttctaggggcattcc

SEQ ID NO: 661523 - DNA, 20 bp, mouse
gttgggactcgacttaacag

SEQ ID NO: 661524 - DNA, 20 bp, mouse
ggggctcaggaaccctttcc

SEQ ID NO: 661525 - DNA, 20 bp, mouse
gctagcagtttgcaacccgg

SEQ ID NO: 661526 - DNA, 20 bp, mouse
gagcccaatgggttcctata

SEQ ID NO: 661527 - DNA, 20 bp, mouse
gcggggcggggatctgtccg

SEQ ID NO: 661528 - DNA, 20 bp, mouse
ggcaggagaggggtagaaac

SEQ ID NO: 661529 - DNA, 20 bp, mouse
gggagcccggcgaaccaata

SEQ ID NO: 661530 - DNA, 20 bp, mouse
gtggggtctagaaaccgtat

SEQ ID NO: 661531 - DNA, 20 bp, mouse
gaaaccgtataggaacccat

SEQ ID NO: 661532 - DNA, 20 bp, mouse
gtaaaaagacggaacacagg

SEQ ID NO: 661533 - DNA, 20 bp, mouse
ggcccggcgaaccaataggg

SEQ ID NO: 661534 - DNA, 20 bp, mouse
ggaatgcgtctggccaagca

SEQ ID NO: 661535 - DNA, 20 bp, mouse
gcacaggaggcagcgcttgc

SEQ ID NO: 661536 - DNA, 20 bp, mouse
gcgccccgcggcagtgggag

SEQ ID NO: 661537 - DNA, 20 bp, mouse
gtagcagcgccccgcggcag

SEQ ID NO: 661538 - DNA, 20 bp, mouse
gaacccgctcccactgccgc

SEQ ID NO: 661539 - DNA, 20 bp, mouse
gcgccggcagggagtgggga

SEQ ID NO: 661540 - DNA, 20 bp, mouse
gctagctgggtagtagggtc

SEQ ID NO: 661541 - DNA, 20 bp, mouse
gaagaaggaaacactgccga

SEQ ID NO: 661542 - DNA, 20 bp, mouse
ggggctggctagggtggtgc

SEQ ID NO: 661543 - DNA, 20 bp, mouse
gtctgcgtcagcagagagcg

SEQ ID NO: 661544 - DNA, 20 bp, mouse
gcgctcgccggcagggagtg

SEQ ID NO: 661545 - DNA, 20 bp, mouse
gggcccaggtcgcgatgctg

SEQ ID NO: 661546 - DNA, 20 bp, mouse
ggacctcgagggcacggcaa

SEQ ID NO: 661547 - DNA, 20 bp, mouse
gggagcgaggcgagcctgaa

SEQ ID NO: 661548 - DNA, 20 bp, mouse
gcggccgcgagagggttgag

SEQ ID NO: 661549 - DNA, 20 bp, mouse
gggagcctcgacagtcagaa

SEQ ID NO: 661550 - DNA, 20 bp, mouse
gcgcgccgcgctgattcctc

SEQ ID NO: 661551 - DNA, 20 bp, mouse
ggcagaggaactctctcaca

SEQ ID NO: 661552 - DNA, 20 bp, mouse
ggcggcctgaggaatcagcg

SEQ ID NO: 661553 - DNA, 20 bp, mouse
gggacgtggaaggacctcga

SEQ ID NO: 661554 - DNA, 20 bp, mouse
gaaccccaggcggagctgag

SEQ ID NO: 661555 - DNA, 20 bp, mouse
ggcctcccgctcctcccttc

SEQ ID NO: 661556 - DNA, 20 bp, mouse
gagcctgagtagtgtctccg

SEQ ID NO: 661557 - DNA, 20 bp, mouse
ggacaggaagcgtggagtga

SEQ ID NO: 661558 - DNA, 20 bp, mouse
ggaccgcggagacactactc

SEQ ID NO: 661559 - DNA, 20 bp, mouse
gcacagtaggcgtgtcaccg

SEQ ID NO: 661560 - DNA, 20 bp, mouse
gagcgctcgcggggaagcta

SEQ ID NO: 661561 - DNA, 20 bp, mouse
gacggagctcctcccacagt

SEQ ID NO: 661562 - DNA, 20 bp, mouse
gcgcgcagagaagcgctcgc

SEQ ID NO: 661563 - DNA, 20 bp, mouse
ggcactgccaaccgagaccg

SEQ ID NO: 661564 - DNA, 20 bp, mouse
gaaaagccggacggcgtctc

SEQ ID NO: 661565 - DNA, 20 bp, mouse
ggaagcgagttctcgcgcga

SEQ ID NO: 661566 - DNA, 20 bp, mouse
gaagaaaacgcaggagatga

SEQ ID NO: 661567 - DNA, 20 bp, mouse
gccagctctgacagcttgcc

SEQ ID NO: 661568 - DNA, 20 bp, mouse
gggcaggtggaagaaaacgc

SEQ ID NO: 661569 - DNA, 20 bp, mouse
gcatcctagttcctaaaacc

SEQ ID NO: 661570 - DNA, 20 bp, mouse
gtgctgctggaactattaaa

SEQ ID NO: 661571 - DNA, 20 bp, mouse
gtagctttacagatggcatt

SEQ ID NO: 661572 - DNA, 20 bp, mouse
ggggtggaaatgaaaccttg

SEQ ID NO: 661573 - DNA, 20 bp, mouse
gtgacagcttgccaggtttt

SEQ ID NO: 661574 - DNA, 20 bp, mouse
gtacagtgatactgaaagga

SEQ ID NO: 661575 - DNA, 20 bp, mouse
gggttcttaaaagaatagtt

SEQ ID NO: 661576 - DNA, 20 bp, mouse
gaccagggctgcagctagga

SEQ ID NO: 661577 - DNA, 20 bp, mouse
gccctggtcaaggcctgggg

SEQ ID NO: 661578 - DNA, 20 bp, mouse
ggaagagccaatggaatcgg

SEQ ID NO: 661579 - DNA, 20 bp, mouse
gaggggcggggccgcatgga

SEQ ID NO: 661580 - DNA, 20 bp, mouse
gcctgggggggcgtgtctga

SEQ ID NO: 661581 - DNA, 20 bp, mouse
gctagctgcagccctggtca

SEQ ID NO: 661582 - DNA, 20 bp, mouse
ggcccccccaggccttgacc

SEQ ID NO: 661583 - DNA, 20 bp, mouse
gtctgaggggcggggccgca

SEQ ID NO: 661584 - DNA, 20 bp, mouse
gtgcagctaggagggatccg

SEQ ID NO: 661585 - DNA, 20 bp, mouse
gggcgggcgcatgcaaagca

SEQ ID NO: 661586 - DNA, 20 bp, mouse
ggcttcaggctttctgctga

SEQ ID NO: 661587 - DNA, 20 bp, mouse
ggaccctaatgtctgtcaga

SEQ ID NO: 661588 - DNA, 20 bp, mouse
gtcactagcataaccatgcc

SEQ ID NO: 661589 - DNA, 20 bp, mouse
gtcgtggcactgggctagga

SEQ ID NO: 661590 - DNA, 20 bp, mouse
gtagcccagtgccacgatga

SEQ ID NO: 661591 - DNA, 20 bp, mouse
gggtacccacaactaccccc

SEQ ID NO: 661592 - DNA, 20 bp, mouse
gagagcagacagtgtgtatc

SEQ ID NO: 661593 - DNA, 20 bp, mouse
gagccctctgacagacatta

SEQ ID NO: 661594 - DNA, 20 bp, mouse
gtaacaccagaacccggaac

SEQ ID NO: 661595 - DNA, 20 bp, mouse
gggtatgggaagtgcggcaa

SEQ ID NO: 661596 - DNA, 20 bp, mouse
ggccaacacaatagcccctg

SEQ ID NO: 661597 - DNA, 20 bp, mouse
gcccccaaggggaacagatc

SEQ ID NO: 661598 - DNA, 20 bp, mouse
ggccccaggggctattgtgt

SEQ ID NO: 661599 - DNA, 20 bp, mouse
gccagagtgtggcagcccca

SEQ ID NO: 661600 - DNA, 20 bp, mouse
ggcagagactggtaggggga

SEQ ID NO: 661601 - DNA, 20 bp, mouse
ggtccggatctgttcccctt

SEQ ID NO: 661602 - DNA, 20 bp, mouse
gctgggttgtctgaagaggt

SEQ ID NO: 661603 - DNA, 20 bp, mouse
gtgttggcctgggcccccaa

SEQ ID NO: 661604 - DNA, 20 bp, mouse
gaccagcttcaaccaatcca

SEQ ID NO: 661605 - DNA, 20 bp, mouse
gccatggcagagactggtag

SEQ ID NO: 661606 - DNA, 20 bp, mouse
gcacgtgagtaggtcagcaa

SEQ ID NO: 661607 - DNA, 20 bp, mouse
ggggaggcctattggttcag

SEQ ID NO: 661608 - DNA, 20 bp, mouse
gaggtcccagacacgtgagt

SEQ ID NO: 661609 - DNA, 20 bp, mouse
gggttcagcgggaaggaccc

SEQ ID NO: 661610 - DNA, 20 bp, mouse
ggtgctgaagggaggcctat

SEQ ID NO: 661611 - DNA, 20 bp, mouse
gtccttcccgctgaaccaat

SEQ ID NO: 661612 - DNA, 20 bp, mouse
gtggacctgtgaattagagg

SEQ ID NO: 661613 - DNA, 20 bp, mouse
ggaaatgtttgtccttgttg

SEQ ID NO: 661614 - DNA, 20 bp, mouse
gttcagagctatgtgctgaa

SEQ ID NO: 661615 - DNA, 20 bp, mouse
gaggctagctaagggtgaag

SEQ ID NO: 661616 - DNA, 20 bp, mouse
ggccaacgggaggacgggaa

SEQ ID NO: 661617 - DNA, 20 bp, mouse
ggcaacaggaggggttgaat

SEQ ID NO: 661618 - DNA, 20 bp, mouse
gagaaagggcaaggctaggg

SEQ ID NO: 661619 - DNA, 20 bp, mouse
ggggctcaggagcattgtgt

SEQ ID NO: 661620 - DNA, 20 bp, mouse
ggaggagccaacgggaggac

SEQ ID NO: 661621 - DNA, 20 bp, mouse
gcctaaggcagagccgggat

SEQ ID NO: 661622 - DNA, 20 bp, mouse
gtggctaggttcaggggctc

SEQ ID NO: 661623 - DNA, 20 bp, mouse
gcatccctggattcgagcaa

SEQ ID NO: 661624 - DNA, 20 bp, mouse
gcgggattggctaggttcag

SEQ ID NO: 661625 - DNA, 20 bp, mouse
gattgtgagcgtagagagga

SEQ ID NO: 661626 - DNA, 20 bp, mouse
gtgaagccaccaatcaggat

SEQ ID NO: 661627 - DNA, 20 bp, mouse
gttaagcccagccacggcag

SEQ ID NO: 661628 - DNA, 20 bp, mouse
ggagctgtgcatgctacaat

SEQ ID NO: 661629 - DNA, 20 bp, mouse
gatagctgaagccaccaatc

SEQ ID NO: 661630 - DNA, 20 bp, mouse
gtaggaggaagattgttgcc

SEQ ID NO: 661631 - DNA, 20 bp, mouse
ggcaagtaaatgctgctagg

SEQ ID NO: 661632 - DNA, 20 bp, mouse
gtgcacagctctgatattaa

SEQ ID NO: 661633 - DNA, 20 bp, mouse
gtacaataggtgtcactgtt

SEQ ID NO: 661634 - DNA, 20 bp, mouse
ggctgtctgactccgtctgc

SEQ ID NO: 661635 - DNA, 20 bp, mouse
gaaagccattaacaaagaat

SEQ ID NO: 661636 - DNA, 20 bp, mouse
gtcagggcccgggaagggga

SEQ ID NO: 661637 - DNA, 20 bp, mouse
gggcggggactctggaagac

SEQ ID NO: 661638 - DNA, 20 bp, mouse
gtccccgcccactactctca

SEQ ID NO: 661639 - DNA, 20 bp, mouse
gactctcagggcccgggaag

SEQ ID NO: 661640 - DNA, 20 bp, mouse
gggaggctgccctggatacg

SEQ ID NO: 661641 - DNA, 20 bp, mouse
gggactctggaagactggct

SEQ ID NO: 661642 - DNA, 20 bp, mouse
gcacacccgagcgccaggag

SEQ ID NO: 661643 - DNA, 20 bp, mouse
ggccctgagagtagtgggcg

SEQ ID NO: 661644 - DNA, 20 bp, mouse
gctggctgggaaaactggag

SEQ ID NO: 661645 - DNA, 20 bp, mouse
gtgcgcatgccccgtatcca

SEQ ID NO: 661646 - DNA, 20 bp, mouse
gcccgggtgcccaggtttaa

SEQ ID NO: 661647 - DNA, 20 bp, mouse
gtcaacacctcccccagggg

SEQ ID NO: 661648 - DNA, 20 bp, mouse
gacaactcgcccttaaacct

SEQ ID NO: 661649 - DNA, 20 bp, mouse
gaggtgttgaagctccgccc

SEQ ID NO: 661650 - DNA, 20 bp, mouse
gggcgccgcagcagtgggta

SEQ ID NO: 661651 - DNA, 20 bp, mouse
gttccagggccccgcccctg

SEQ ID NO: 661652 - DNA, 20 bp, mouse
gccgcagcagtgggtacggg

SEQ ID NO: 661653 - DNA, 20 bp, mouse
gaagaaaagctagctgggtc

SEQ ID NO: 661654 - DNA, 20 bp, mouse
gtggagtagtcaacttagaa

SEQ ID NO: 661655 - DNA, 20 bp, mouse
ggaaatgagtctctaacgca

SEQ ID NO: 661656 - DNA, 20 bp, mouse
gtagggaggcgcgttcccag

SEQ ID NO: 661657 - DNA, 20 bp, mouse
gtgacccgacgtcggcgcgc

SEQ ID NO: 661658 - DNA, 20 bp, mouse
ggccccttcgcacctccctc

SEQ ID NO: 661659 - DNA, 20 bp, mouse
gtgcccgagggaggtgcgaa

SEQ ID NO: 661660 - DNA, 20 bp, mouse
gggcgcgttcccaggggctc

SEQ ID NO: 661661 - DNA, 20 bp, mouse
gtcggcgcgccggcttgggg

SEQ ID NO: 661662 - DNA, 20 bp, mouse
gcgcgccggcttggggagga

SEQ ID NO: 661663 - DNA, 20 bp, mouse
gacgtcgggtcacgtgacgt

SEQ ID NO: 661664 - DNA, 20 bp, mouse
gaagccggcgcgccgacgtc

SEQ ID NO: 661665 - DNA, 20 bp, mouse
ggacgtgggcgagccgacag

SEQ ID NO: 661666 - DNA, 20 bp, mouse
gtgaccgggcgctgctgcgc

SEQ ID NO: 661667 - DNA, 20 bp, mouse
gccctcctaactgacctgaa

SEQ ID NO: 661668 - DNA, 20 bp, mouse
gcgcccggtcacgtggctac

SEQ ID NO: 661669 - DNA, 20 bp, mouse
gcagccgaatccgccccgga

SEQ ID NO: 661670 - DNA, 20 bp, mouse
gagcccgtagccacgtgacc

SEQ ID NO: 661671 - DNA, 20 bp, mouse
ggctgcgcgctgttgggctc

SEQ ID NO: 661672 - DNA, 20 bp, mouse
ggcctggtccgcagcattta

SEQ ID NO: 661673 - DNA, 20 bp, mouse
gcagttaggagggcgcaaac

SEQ ID NO: 661674 - DNA, 20 bp, mouse
gggaccggctgcaaactagg

SEQ ID NO: 661675 - DNA, 20 bp, mouse
gtccctaaatgctgcggacc

SEQ ID NO: 661676 - DNA, 20 bp, mouse
gccactgcccctccagtact

SEQ ID NO: 661677 - DNA, 20 bp, mouse
gcgctggcgtcacttagcaa

SEQ ID NO: 661678 - DNA, 20 bp, mouse
gcccccgcctgaggcgacct

SEQ ID NO: 661679 - DNA, 20 bp, mouse
gcctcagggcccagtactgg

SEQ ID NO: 661680 - DNA, 20 bp, mouse
gcctgagccaggtgtcggca

SEQ ID NO: 661681 - DNA, 20 bp, mouse
ggggcagtggctccgacctg

SEQ ID NO: 661682 - DNA, 20 bp, mouse
ggccgcaagacccccgcctg

SEQ ID NO: 661683 - DNA, 20 bp, mouse
gtggccgccctgccgacacc

SEQ ID NO: 661684 - DNA, 20 bp, mouse
gccgtgggccagtagaaccc

SEQ ID NO: 661685 - DNA, 20 bp, mouse
gggccccaggtcgcctcagg

SEQ ID NO: 661686 - DNA, 20 bp, mouse
ggagacccagcagggggagt

SEQ ID NO: 661687 - DNA, 20 bp, mouse
gggccctctgagcgtgtcct

SEQ ID NO: 661688 - DNA, 20 bp, mouse
gtgggacaaaacaaggtaaa

SEQ ID NO: 661689 - DNA, 20 bp, mouse
gacccaaggacacgctcaga

SEQ ID NO: 661690 - DNA, 20 bp, mouse
gcctgctgggtctcacctga

SEQ ID NO: 661691 - DNA, 20 bp, mouse
ggacacgctcagagggccac

SEQ ID NO: 661692 - DNA, 20 bp, mouse
gaccaagtggtgtgcctctc

SEQ ID NO: 661693 - DNA, 20 bp, mouse
gaagtggtgtgcctctccgg

SEQ ID NO: 661694 - DNA, 20 bp, mouse
gaggctccaggataaatagg

SEQ ID NO: 661695 - DNA, 20 bp, mouse
gacccggggcgggcagccag

SEQ ID NO: 661696 - DNA, 20 bp, mouse
ggtcaccaacaacaactctt

SEQ ID NO: 661697 - DNA, 20 bp, mouse
gccctcctgtctgtcagaag

SEQ ID NO: 661698 - DNA, 20 bp, mouse
gtccacctaaagttacttca

SEQ ID NO: 661699 - DNA, 20 bp, mouse
ggaagcgaggagcaggtgtc

SEQ ID NO: 661700 - DNA, 20 bp, mouse
gacacccgcttctgacagac

SEQ ID NO: 661701 - DNA, 20 bp, mouse
gccagaaagtaactccgcag

SEQ ID NO: 661702 - DNA, 20 bp, mouse
gaccccccgggagggcaaga

SEQ ID NO: 661703 - DNA, 20 bp, mouse
ggggatgcggaatgagcaag

SEQ ID NO: 661704 - DNA, 20 bp, mouse
ggagggtagcgacagaagcg

SEQ ID NO: 661705 - DNA, 20 bp, mouse
ggggacaagaagtcagtcct

SEQ ID NO: 661706 - DNA, 20 bp, mouse
gaccgcgggtcccagctctc

SEQ ID NO: 661707 - DNA, 20 bp, mouse
ggacccgcggtcgccgtccg

SEQ ID NO: 661708 - DNA, 20 bp, mouse
gggaaaggccgcggatagat

SEQ ID NO: 661709 - DNA, 20 bp, mouse
gggtcgccgtccgcggtcct

SEQ ID NO: 661710 - DNA, 20 bp, mouse
ggccctacggggtggccaca

SEQ ID NO: 661711 - DNA, 20 bp, mouse
ggggagcagcaccggagagc

SEQ ID NO: 661712 - DNA, 20 bp, mouse
ggccctgtggccaccccgta

SEQ ID NO: 661713 - DNA, 20 bp, mouse
ggcggatagatcggacagtg

SEQ ID NO: 661714 - DNA, 20 bp, mouse
gaccggagagctgggacccg

SEQ ID NO: 661715 - DNA, 20 bp, mouse
gcggcccgccgctggacgaa

SEQ ID NO: 661716 - DNA, 20 bp, mouse
gcagaatagtgaggtgcgcg

SEQ ID NO: 661717 - DNA, 20 bp, mouse
ggaggtgcgcgaggcatgct

SEQ ID NO: 661718 - DNA, 20 bp, mouse
gcacggccccgcctcgaccg

SEQ ID NO: 661719 - DNA, 20 bp, mouse
gtggcggccgggctgcttcc

SEQ ID NO: 661720 - DNA, 20 bp, mouse
ggccgccaatcagaatagtg

SEQ ID NO: 661721 - DNA, 20 bp, mouse
gctccctcccgcggtcgagg

SEQ ID NO: 661722 - DNA, 20 bp, mouse
ggcggggccgtgcgtcacgt

SEQ ID NO: 661723 - DNA, 20 bp, mouse
gagacacaatgggacgccaa

SEQ ID NO: 661724 - DNA, 20 bp, mouse
gcgcacctcactattctgat

SEQ ID NO: 661725 - DNA, 20 bp, mouse
gggtggtgtggggtctagtt

SEQ ID NO: 661726 - DNA, 20 bp, mouse
gcccagaggccgggatgaga

SEQ ID NO: 661727 - DNA, 20 bp, mouse
ggcagcctgagactccggag

SEQ ID NO: 661728 - DNA, 20 bp, mouse
gtgtgacgcaggcagattcg

SEQ ID NO: 661729 - DNA, 20 bp, mouse
gagcccgctcggggactgga

SEQ ID NO: 661730 - DNA, 20 bp, mouse
gcgccagggggcgtgcccag

SEQ ID NO: 661731 - DNA, 20 bp, mouse
gaggcagattcggggctgga

SEQ ID NO: 661732 - DNA, 20 bp, mouse
gtctcaggctgccactcggg

SEQ ID NO: 661733 - DNA, 20 bp, mouse
gtggcgtacccggggcgtga

SEQ ID NO: 661734 - DNA, 20 bp, mouse
gcgtacccggggcgtgaggg

SEQ ID NO: 661735 - DNA, 20 bp, mouse
gacgcaggcagattcggggc

SEQ ID NO: 661736 - DNA, 20 bp, mouse
gctggcgggcggggcggaga

SEQ ID NO: 661737 - DNA, 20 bp, mouse
gcagctcgcccgcgcctccc

SEQ ID NO: 661738 - DNA, 20 bp, mouse
ggggagaggcgagacaccgg

SEQ ID NO: 661739 - DNA, 20 bp, mouse
ggggagagggccttggacct

SEQ ID NO: 661740 - DNA, 20 bp, mouse
gggaggcggggagccgtcgg

SEQ ID NO: 661741 - DNA, 20 bp, mouse
ggctcactgacgtcattatt

SEQ ID NO: 661742 - DNA, 20 bp, mouse
gggccgacgctggcggatgg

SEQ ID NO: 661743 - DNA, 20 bp, mouse
ggaggcgcgggcgagctggc

SEQ ID NO: 661744 - DNA, 20 bp, mouse
gggagaaataacatcggcga

SEQ ID NO: 661745 - DNA, 20 bp, mouse
gggctccccgcctccccgag

SEQ ID NO: 661746 - DNA, 20 bp, mouse
gcacgcgcaccggtggaggg

SEQ ID NO: 661747 - DNA, 20 bp, mouse
ggggccttgcctccctcagt

SEQ ID NO: 661748 - DNA, 20 bp, mouse
gcgcagagcctgggctccga

SEQ ID NO: 661749 - DNA, 20 bp, mouse
gccctcggggctcgcgcagg

SEQ ID NO: 661750 - DNA, 20 bp, mouse
gccggccgcgcgcagagcct

SEQ ID NO: 661751 - DNA, 20 bp, mouse
gtcgtgcagaggtgggtagg

SEQ ID NO: 661752 - DNA, 20 bp, mouse
ggagaggcgggcggatccaa

SEQ ID NO: 661753 - DNA, 20 bp, mouse
gctcgtgccagcacggccgt

SEQ ID NO: 661754 - DNA, 20 bp, mouse
gtctgcgcgcggccggaggc

SEQ ID NO: 661755 - DNA, 20 bp, mouse
gagcacggccgtcggagccc

SEQ ID NO: 661756 - DNA, 20 bp, mouse
gagtggatagcacctgtgtg

SEQ ID NO: 661757 - DNA, 20 bp, mouse
gtgtggggtgagcaaccaat

SEQ ID NO: 661758 - DNA, 20 bp, mouse
gcttaacaggcaggcatata

SEQ ID NO: 661759 - DNA, 20 bp, mouse
gggactcatctgattccccc

SEQ ID NO: 661760 - DNA, 20 bp, mouse
gcctgcctgttaaggccgat

SEQ ID NO: 661761 - DNA, 20 bp, mouse
gttggcaaagatgaaattat

SEQ ID NO: 661762 - DNA, 20 bp, mouse
gtacttaagtggtcttctaa

SEQ ID NO: 661763 - DNA, 20 bp, mouse
gtaatcacacagcttttcca

SEQ ID NO: 661764 - DNA, 20 bp, mouse
ggcaaccaatcggccttaac

SEQ ID NO: 661765 - DNA, 20 bp, mouse
gccagtatgtagtcaacata

SEQ ID NO: 661766 - DNA, 20 bp, mouse
gggtcccaggcaaatgtcgg

SEQ ID NO: 661767 - DNA, 20 bp, mouse
ggggaagagtctctcagagc

SEQ ID NO: 661768 - DNA, 20 bp, mouse
ggaactgagtggctgcgaaa

SEQ ID NO: 661769 - DNA, 20 bp, mouse
gcaggcaaatgtcggggggt

SEQ ID NO: 661770 - DNA, 20 bp, mouse
gactcaaccaccaccataat

SEQ ID NO: 661771 - DNA, 20 bp, mouse
ggagctctgcagctctcgat

SEQ ID NO: 661772 - DNA, 20 bp, mouse
ggagtggctgcgaaagggtg

SEQ ID NO: 661773 - DNA, 20 bp, mouse
ggaaaggtccgtgctctaga

SEQ ID NO: 661774 - DNA, 20 bp, mouse
gagtgcggtggggtggttat

SEQ ID NO: 661775 - DNA, 20 bp, mouse
gtggactcttgagtgtaaag

SEQ ID NO: 661776 - DNA, 20 bp, mouse
gcaaggttatgcaagaatgg

SEQ ID NO: 661777 - DNA, 20 bp, mouse
gacgtcagataagtcttcat

SEQ ID NO: 661778 - DNA, 20 bp, mouse
gagctgctttgcacatcaga

SEQ ID NO: 661779 - DNA, 20 bp, mouse
gtccccccatgctcccataa

SEQ ID NO: 661780 - DNA, 20 bp, mouse
gctaaattgttacagtcttt

SEQ ID NO: 661781 - DNA, 20 bp, mouse
gggcatctacagactgaaga

SEQ ID NO: 661782 - DNA, 20 bp, mouse
gttagattctgatcaaatca

SEQ ID NO: 661783 - DNA, 20 bp, mouse
gtgtgcctttatgggagcat

SEQ ID NO: 661784 - DNA, 20 bp, mouse
ggggcttgaaagagaacagc

SEQ ID NO: 661785 - DNA, 20 bp, mouse
gtatggagaaaatgactgac

SEQ ID NO: 661786 - DNA, 20 bp, mouse
ggtaccgaatatagggaatg

SEQ ID NO: 661787 - DNA, 20 bp, mouse
gcctccccccccatgaactt

SEQ ID NO: 661788 - DNA, 20 bp, mouse
gaagagctgtaccgaatata

SEQ ID NO: 661789 - DNA, 20 bp, mouse
ggccacagagttaaattcac

SEQ ID NO: 661790 - DNA, 20 bp, mouse
gagttaaattcacaggctga

SEQ ID NO: 661791 - DNA, 20 bp, mouse
gggactacagattagtggtc

SEQ ID NO: 661792 - DNA, 20 bp, mouse
ggtggccaagtgtatttatt

SEQ ID NO: 661793 - DNA, 20 bp, mouse
ggggggtcattgtaagttta

SEQ ID NO: 661794 - DNA, 20 bp, mouse
gatgcatatatcgttctctt

SEQ ID NO: 661795 - DNA, 20 bp, mouse
ggacttgcaagagctacata

SEQ ID NO: 661796 - DNA, 20 bp, mouse
gagaaaggggcacaagggaa

SEQ ID NO: 661797 - DNA, 20 bp, mouse
ggaagaaaggagcgcatgaa

SEQ ID NO: 661798 - DNA, 20 bp, mouse
gctagacataggaatactat

SEQ ID NO: 661799 - DNA, 20 bp, mouse
gctctcaagtgggaagaaga

SEQ ID NO: 661800 - DNA, 20 bp, mouse
gagggagccagatgcaatcc

SEQ ID NO: 661801 - DNA, 20 bp, mouse
gtgtgtgaagaagggagtaa

SEQ ID NO: 661802 - DNA, 20 bp, mouse
gactctaggacctctcaagt

SEQ ID NO: 661803 - DNA, 20 bp, mouse
gttgaagtgtgtgtgaagaa

SEQ ID NO: 661804 - DNA, 20 bp, mouse
gatgaaagggaagcaataag

SEQ ID NO: 661805 - DNA, 20 bp, mouse
gagcacacccggattgcatc

SEQ ID NO: 661806 - DNA, 20 bp, mouse
gagacctgagcgcttctccc

SEQ ID NO: 661807 - DNA, 20 bp, mouse
ggagaagcgctcaggtctgg

SEQ ID NO: 661808 - DNA, 20 bp, mouse
ggagccagggagaagcgctc

SEQ ID NO: 661809 - DNA, 20 bp, mouse
gggaggggtagaagcattct

SEQ ID NO: 661810 - DNA, 20 bp, mouse
gtcaggtctggtggtcagat

SEQ ID NO: 661811 - DNA, 20 bp, mouse
gggtctggtggtcagattgg

SEQ ID NO: 661812 - DNA, 20 bp, mouse
gggccagaagtcaatcattg

SEQ ID NO: 661813 - DNA, 20 bp, mouse
gcgcttctccctggctctgt

SEQ ID NO: 661814 - DNA, 20 bp, mouse
gtcccacaatgattgacttc

SEQ ID NO: 661815 - DNA, 20 bp, mouse
gtggacaaccagaacaacac

SEQ ID NO: 661816 - DNA, 20 bp, mouse
gaggggaggtggcctgtagg

SEQ ID NO: 661817 - DNA, 20 bp, mouse
gacgctgggatgagggataa

SEQ ID NO: 661818 - DNA, 20 bp, mouse
gaagggaaggcacggagatg

SEQ ID NO: 661819 - DNA, 20 bp, mouse
gtggcagctgggccaacttg

SEQ ID NO: 661820 - DNA, 20 bp, mouse
gctgaactccccaactccta

SEQ ID NO: 661821 - DNA, 20 bp, mouse
gtagccagccgtaggagttg

SEQ ID NO: 661822 - DNA, 20 bp, mouse
gccagctgccaccctcctac

SEQ ID NO: 661823 - DNA, 20 bp, mouse
ggataaagacgctgggatga

SEQ ID NO: 661824 - DNA, 20 bp, mouse
ggaggtggcctgtaggaggg

SEQ ID NO: 661825 - DNA, 20 bp, mouse
gaaaggcagcggcaccaacg

SEQ ID NO: 661826 - DNA, 20 bp, mouse
gcatgccctgtccagcaggt

SEQ ID NO: 661827 - DNA, 20 bp, mouse
gtaggccactgccagatgtc

SEQ ID NO: 661828 - DNA, 20 bp, mouse
ggtcacctacctgctggaca

SEQ ID NO: 661829 - DNA, 20 bp, mouse
gaggtaggtgacctgacatc

SEQ ID NO: 661830 - DNA, 20 bp, mouse
gagagagcttggccctagat

SEQ ID NO: 661831 - DNA, 20 bp, mouse
ggtgacctgacatctggcag

SEQ ID NO: 661832 - DNA, 20 bp, mouse
gtgtcaggtcacctacctgc

SEQ ID NO: 661833 - DNA, 20 bp, mouse
ggctggacagggcatggagc

SEQ ID NO: 661834 - DNA, 20 bp, mouse
gcgtgtgggtacaatgagca

SEQ ID NO: 661835 - DNA, 20 bp, mouse
gtagaaaaccaagtctagga

SEQ ID NO: 661836 - DNA, 20 bp, mouse
gctggactcctctcaaccct

SEQ ID NO: 661837 - DNA, 20 bp, mouse
gcagtctgcccagggttgag

SEQ ID NO: 661838 - DNA, 20 bp, mouse
gctcctgccctgagcaatgc

SEQ ID NO: 661839 - DNA, 20 bp, mouse
gctagctgcccagtctgccc

SEQ ID NO: 661840 - DNA, 20 bp, mouse
ggagcctatgactcttcctt

SEQ ID NO: 661841 - DNA, 20 bp, mouse
gggacacacaagtcatttcg

SEQ ID NO: 661842 - DNA, 20 bp, mouse
gctgatgtgtttcagtcctg

SEQ ID NO: 661843 - DNA, 20 bp, mouse
gtataattcggagtagagtt

SEQ ID NO: 661844 - DNA, 20 bp, mouse
gttgtggagccatagaatat

SEQ ID NO: 661845 - DNA, 20 bp, mouse
gcgggtccattctattccca

SEQ ID NO: 661846 - DNA, 20 bp, mouse
ggtaacctggaactgtggcg

SEQ ID NO: 661847 - DNA, 20 bp, mouse
gtgggtgtaacctggaactg

SEQ ID NO: 661848 - DNA, 20 bp, mouse
gcaggacagggatttgtgat

SEQ ID NO: 661849 - DNA, 20 bp, mouse
gaaaaccaaaagccaggaca

SEQ ID NO: 661850 - DNA, 20 bp, mouse
gccagccccgccacagttcc

SEQ ID NO: 661851 - DNA, 20 bp, mouse
gggcacttgagtgttgagga

SEQ ID NO: 661852 - DNA, 20 bp, mouse
ggttgaggagggaaagactc

SEQ ID NO: 661853 - DNA, 20 bp, mouse
gtcctctctgcttcttctac

SEQ ID NO: 661854 - DNA, 20 bp, mouse
gattttgtgtatactaagct

SEQ ID NO: 661855 - DNA, 20 bp, mouse
gaactgtggcggggctggtc

SEQ ID NO: 661856 - DNA, 20 bp, mouse
gactggagggtcattttcta

SEQ ID NO: 661857 - DNA, 20 bp, mouse
gtcaagctggatatccaggg

SEQ ID NO: 661858 - DNA, 20 bp, mouse
gccacgaggacgggatatga

SEQ ID NO: 661859 - DNA, 20 bp, mouse
gtatgtcctaaggtgaaagg

SEQ ID NO: 661860 - DNA, 20 bp, mouse
gtagaacaggctgcatctgc

SEQ ID NO: 661861 - DNA, 20 bp, mouse
gtctgcagggaaacacccgg

SEQ ID NO: 661862 - DNA, 20 bp, mouse
ggaccaccatccagcctccc

SEQ ID NO: 661863 - DNA, 20 bp, mouse
gaagctagaggggctggcct

SEQ ID NO: 661864 - DNA, 20 bp, mouse
gagatcaagctggatatcca

SEQ ID NO: 661865 - DNA, 20 bp, mouse
gaaagaggccaaaggtgcct

SEQ ID NO: 661866 - DNA, 20 bp, mouse
ggggtcactgcgtagagtcg

SEQ ID NO: 661867 - DNA, 20 bp, mouse
ggagagcccggaggggaagt

SEQ ID NO: 661868 - DNA, 20 bp, mouse
gactctacgcagtgacccgt

SEQ ID NO: 661869 - DNA, 20 bp, mouse
gcagagccgcggtcctcctc

SEQ ID NO: 661870 - DNA, 20 bp, mouse
gtacaagtcccgtgaggcag

SEQ ID NO: 661871 - DNA, 20 bp, mouse
gcggcgaacagcaactccca

SEQ ID NO: 661872 - DNA, 20 bp, mouse
gctctcgagtgctctacatt

SEQ ID NO: 661873 - DNA, 20 bp, mouse
gggcaaaaggcaaggctacg

SEQ ID NO: 661874 - DNA, 20 bp, mouse
ggctccagcggcaaaaggca

SEQ ID NO: 661875 - DNA, 20 bp, mouse
gtagccttgccttttgccgc

SEQ ID NO: 661876 - DNA, 20 bp, mouse
gtgcgggctagggacggagg

SEQ ID NO: 661877 - DNA, 20 bp, mouse
gtagcataggactcactaaa

SEQ ID NO: 661878 - DNA, 20 bp, mouse
ggagagctggccaatcgctg

SEQ ID NO: 661879 - DNA, 20 bp, mouse
gaactgcgggctagggacgg

SEQ ID NO: 661880 - DNA, 20 bp, mouse
ggggcagcgcgcctgactat

SEQ ID NO: 661881 - DNA, 20 bp, mouse
gaagaactgcgggctaggga

SEQ ID NO: 661882 - DNA, 20 bp, mouse
ggacccaagaggactcaaag

SEQ ID NO: 661883 - DNA, 20 bp, mouse
gaatcgctgcggccgttgct

SEQ ID NO: 661884 - DNA, 20 bp, mouse
ggcagcggagaccaatagtc

SEQ ID NO: 661885 - DNA, 20 bp, mouse
gctcagtcagcacctagcat

SEQ ID NO: 661886 - DNA, 20 bp, mouse
gtgtctctccctgggttcga

SEQ ID NO: 661887 - DNA, 20 bp, mouse
ggcgctgcgcaatgcacaat

SEQ ID NO: 661888 - DNA, 20 bp, mouse
gctcctcccaaagcattctg

SEQ ID NO: 661889 - DNA, 20 bp, mouse
ggcagtgctaggacaaccat

SEQ ID NO: 661890 - DNA, 20 bp, mouse
gctagcactgcagcgtgctc

SEQ ID NO: 661891 - DNA, 20 bp, mouse
ggcagcgcgtgcttaaaccc

SEQ ID NO: 661892 - DNA, 20 bp, mouse
gggggattgtagtgtatccc

SEQ ID NO: 661893 - DNA, 20 bp, mouse
gggacaggtgttaagacctg

SEQ ID NO: 661894 - DNA, 20 bp, mouse
gaagacaagccttcgaaccc

SEQ ID NO: 661895 - DNA, 20 bp, mouse
gtcgaaggcttgtcttagaa

SEQ ID NO: 661896 - DNA, 20 bp, mouse
gagacccggtgaacgggggg

SEQ ID NO: 661897 - DNA, 20 bp, mouse
gctcgcaggcaaagcggaga

SEQ ID NO: 661898 - DNA, 20 bp, mouse
gtactaagagacccggtgaa

SEQ ID NO: 661899 - DNA, 20 bp, mouse
gaagagacccggtgaacggg

SEQ ID NO: 661900 - DNA, 20 bp, mouse
gaacgccaacggctcgatct

SEQ ID NO: 661901 - DNA, 20 bp, mouse
gcttccctttgagccggaac

SEQ ID NO: 661902 - DNA, 20 bp, mouse
ggtggaggtactaagagacc

SEQ ID NO: 661903 - DNA, 20 bp, mouse
gtccggagcaggcctatcat

SEQ ID NO: 661904 - DNA, 20 bp, mouse
gagctccagagatgtaacct

SEQ ID NO: 661905 - DNA, 20 bp, mouse
gcatcctgttccggctcaaa

SEQ ID NO: 661906 - DNA, 20 bp, mouse
ggggagagtgcgtgcatctc

SEQ ID NO: 661907 - DNA, 20 bp, mouse
gttctcagctgagacagcgt

SEQ ID NO: 661908 - DNA, 20 bp, mouse
ggggtaggatcatgttacat

SEQ ID NO: 661909 - DNA, 20 bp, mouse
gcttcaacgcgaaacggtag

SEQ ID NO: 661910 - DNA, 20 bp, mouse
ggagccttaagaggctccag

SEQ ID NO: 661911 - DNA, 20 bp, mouse
gtctcccctggagcctctta

SEQ ID NO: 661912 - DNA, 20 bp, mouse
gtgcaccgattcgtcgtctc

SEQ ID NO: 661913 - DNA, 20 bp, mouse
gagaacacctgtatgaatgg

SEQ ID NO: 661914 - DNA, 20 bp, mouse
gagaagcggaagctttagga

SEQ ID NO: 661915 - DNA, 20 bp, mouse
gaaggtgagaaggtcagtac

SEQ ID NO: 661916 - DNA, 20 bp, mouse
gccgtgtgggccacccctac

SEQ ID NO: 661917 - DNA, 20 bp, mouse
gcacccctacaggaagtgag

SEQ ID NO: 661918 - DNA, 20 bp, mouse
gaggagacacgtagccgtgt

SEQ ID NO: 661919 - DNA, 20 bp, mouse
ggctacgtgtctcctcggac

SEQ ID NO: 661920 - DNA, 20 bp, mouse
ggccacggctgcgaggatct

SEQ ID NO: 661921 - DNA, 20 bp, mouse
gacagggacaccggggaacg

SEQ ID NO: 661922 - DNA, 20 bp, mouse
gtgggacctcacaccgaggc

SEQ ID NO: 661923 - DNA, 20 bp, mouse
gtgagaggaaaagggccgta

SEQ ID NO: 661924 - DNA, 20 bp, mouse
gacagcccggcctcggtgtg

SEQ ID NO: 661925 - DNA, 20 bp, mouse
ggccaggaatccgcgttccc

SEQ ID NO: 661926 - DNA, 20 bp, mouse
gcccccgctggaaagggcag

SEQ ID NO: 661927 - DNA, 20 bp, mouse
gggagtgaggacagacccct

SEQ ID NO: 661928 - DNA, 20 bp, mouse
ggggtcgccccccgctggaa

SEQ ID NO: 661929 - DNA, 20 bp, mouse
gcctcgggcaactctccgag

SEQ ID NO: 661930 - DNA, 20 bp, mouse
gctcccgcgcttccttgttt

SEQ ID NO: 661931 - DNA, 20 bp, mouse
ggacgcgggtcgccccccgc

SEQ ID NO: 661932 - DNA, 20 bp, mouse
ggggagcggggctccgcccg

SEQ ID NO: 661933 - DNA, 20 bp, mouse
gtggggacacgcgcggacgc

SEQ ID NO: 661934 - DNA, 20 bp, mouse
ggagttgcccgaggctcgga

SEQ ID NO: 661935 - DNA, 20 bp, mouse
gctagcttgtaggtgggatc

SEQ ID NO: 661936 - DNA, 20 bp, mouse
ggggtcgtgaaggtgtctgt

SEQ ID NO: 661937 - DNA, 20 bp, mouse
gcgcccccaaggcgtccaac

SEQ ID NO: 661938 - DNA, 20 bp, mouse
gccacagggagcgccatctc

SEQ ID NO: 661939 - DNA, 20 bp, mouse
ggggcactgtgatctctcag

SEQ ID NO: 661940 - DNA, 20 bp, mouse
gtcaacccgttggacgcctt

SEQ ID NO: 661941 - DNA, 20 bp, mouse
gtgtggtgacggagcatata

SEQ ID NO: 661942 - DNA, 20 bp, mouse
ggggcgtcctgtcaacccgt

SEQ ID NO: 661943 - DNA, 20 bp, mouse
gctggagtctctgagttcga

SEQ ID NO: 661944 - DNA, 20 bp, mouse
gccctgtgggcgtgtcgccg

SEQ ID NO: 661945 - DNA, 20 bp, mouse
gtgaagggcttctgtggtga

SEQ ID NO: 661946 - DNA, 20 bp, mouse
gacgatggagctggactggt

SEQ ID NO: 661947 - DNA, 20 bp, mouse
gatgaagaggccatgttggg

SEQ ID NO: 661948 - DNA, 20 bp, mouse
gtgagggtctgtggggtcaa

SEQ ID NO: 661949 - DNA, 20 bp, mouse
ggaaagagcaggttccttac

SEQ ID NO: 661950 - DNA, 20 bp, mouse
ggggatgaagaggccatgtt

SEQ ID NO: 661951 - DNA, 20 bp, mouse
gcagtccagctccatcgtca

SEQ ID NO: 661952 - DNA, 20 bp, mouse
gccctccggaccccccaaca

SEQ ID NO: 661953 - DNA, 20 bp, mouse
gtctaacctaccatccagta

SEQ ID NO: 661954 - DNA, 20 bp, mouse
gtcgggacagtggaaagagc

SEQ ID NO: 661955 - DNA, 20 bp, mouse
ggctggaccggcaggcaagc

SEQ ID NO: 661956 - DNA, 20 bp, mouse
ggcgcaggtaccagcgcggg

SEQ ID NO: 661957 - DNA, 20 bp, mouse
ggcggcgcaggtaccagcgc

SEQ ID NO: 661958 - DNA, 20 bp, mouse
gaacccccaggggtagggcg

SEQ ID NO: 661959 - DNA, 20 bp, mouse
ggcgccgcgccctacccctg

SEQ ID NO: 661960 - DNA, 20 bp, mouse
gcccgaaacccccaggggta

SEQ ID NO: 661961 - DNA, 20 bp, mouse
ggggtccccatcagagtatc

SEQ ID NO: 661962 - DNA, 20 bp, mouse
gggaaccccgaaacccccag

SEQ ID NO: 661963 - DNA, 20 bp, mouse
gtgagtgtgctcagatgcgg

SEQ ID NO: 661964 - DNA, 20 bp, mouse
gtggggcacaggcctgcgga

SEQ ID NO: 661965 - DNA, 20 bp, mouse
ggaggtgagcgcctgcgcaa

SEQ ID NO: 661966 - DNA, 20 bp, mouse
gcagcctggggctttagggt

SEQ ID NO: 661967 - DNA, 20 bp, mouse
ggggaggccggccgctgcgg

SEQ ID NO: 661968 - DNA, 20 bp, mouse
gggtgctcgtcccctgactg

SEQ ID NO: 661969 - DNA, 20 bp, mouse
ggcaccggctaacaccgcgg

SEQ ID NO: 661970 - DNA, 20 bp, mouse
ggtgggaagcggcccctcaa

SEQ ID NO: 661971 - DNA, 20 bp, mouse
gcggccggcctccccctctc

SEQ ID NO: 661972 - DNA, 20 bp, mouse
gagggggaggccggccgctg

SEQ ID NO: 661973 - DNA, 20 bp, mouse
ggggacgagcaccccttgca

SEQ ID NO: 661974 - DNA, 20 bp, mouse
gctaccctggtacaagagtc

SEQ ID NO: 661975 - DNA, 20 bp, mouse
gtgccctgactcttgtacca

SEQ ID NO: 661976 - DNA, 20 bp, mouse
ggcccacagaagtcactacc

SEQ ID NO: 661977 - DNA, 20 bp, mouse
gcattgggatgcagctagac

SEQ ID NO: 661978 - DNA, 20 bp, mouse
gtgcctggtagtgacttctg

SEQ ID NO: 661979 - DNA, 20 bp, mouse
gcccgaaccgcgccactctt

SEQ ID NO: 661980 - DNA, 20 bp, mouse
gcctcaatggccaggtcggg

SEQ ID NO: 661981 - DNA, 20 bp, mouse
gtgtccctgtacttcttaat

SEQ ID NO: 661982 - DNA, 20 bp, mouse
gtgaagtggcagagtcgcta

SEQ ID NO: 661983 - DNA, 20 bp, mouse
gtgggcacgtgcggaggcat

SEQ ID NO: 661984 - DNA, 20 bp, mouse
ggcaggaggcggagctacac

SEQ ID NO: 661985 - DNA, 20 bp, mouse
gaaggggcggggatagggcg

SEQ ID NO: 661986 - DNA, 20 bp, mouse
gagtgggtgggttgtagaga

SEQ ID NO: 661987 - DNA, 20 bp, mouse
gggggacagggatgtgaact

SEQ ID NO: 661988 - DNA, 20 bp, mouse
gtggttggtggtttagagta

SEQ ID NO: 661989 - DNA, 20 bp, mouse
gtgaactggggttttcagaa

SEQ ID NO: 661990 - DNA, 20 bp, mouse
ggggtgggttgtagagaagg

SEQ ID NO: 661991 - DNA, 20 bp, mouse
ggagatccttggtcctaaaa

SEQ ID NO: 661992 - DNA, 20 bp, mouse
gggttgtagagaagggggac

SEQ ID NO: 661993 - DNA, 20 bp, mouse
gtggggcattgagccttttt

SEQ ID NO: 661994 - DNA, 20 bp, mouse
ggagataaagagacaacatg

SEQ ID NO: 661995 - DNA, 20 bp, mouse
gaagaaggaaaactaaagta

SEQ ID NO: 661996 - DNA, 20 bp, mouse
gcctcgtacgtgtggctcga

SEQ ID NO: 661997 - DNA, 20 bp, mouse
gacgtacgagggagcgcctg

SEQ ID NO: 661998 - DNA, 20 bp, mouse
gcggcaacacgtgctcggag

SEQ ID NO: 661999 - DNA, 20 bp, mouse
gaggccgcgaggtcaaagga

SEQ ID NO: 662000 - DNA, 20 bp, mouse
ggggcgggggagtccacgtc

SEQ ID NO: 662001 - DNA, 20 bp, mouse
gcgtctggcagctacttccg

SEQ ID NO: 662002 - DNA, 20 bp, mouse
gcaacacgtgctcggagggg

SEQ ID NO: 662003 - DNA, 20 bp, mouse
gacttctgacaagggggcgg

SEQ ID NO: 662004 - DNA, 20 bp, mouse
gcggccacattcttccacac

SEQ ID NO: 662005 - DNA, 20 bp, mouse
ggagctgtctatcccgcccc

SEQ ID NO: 662006 - DNA, 20 bp, mouse
gaggggatctgtagtcccag

SEQ ID NO: 662007 - DNA, 20 bp, mouse
gttaagaatacttgcagggc

SEQ ID NO: 662008 - DNA, 20 bp, mouse
gtaacactgagctaattctc

SEQ ID NO: 662009 - DNA, 20 bp, mouse
gcagtgttaagaatacttgc

SEQ ID NO: 662010 - DNA, 20 bp, mouse
gactacagatcccctatgca

SEQ ID NO: 662011 - DNA, 20 bp, mouse
ggttacacaaccatgcatag

SEQ ID NO: 662012 - DNA, 20 bp, mouse
gggtacacatacacacgagc

SEQ ID NO: 662013 - DNA, 20 bp, mouse
gcagcttcaacactttttta

SEQ ID NO: 662014 - DNA, 20 bp, mouse
gcgagcaggcaaaaaaagcc

SEQ ID NO: 662015 - DNA, 20 bp, mouse
gagaggatcgagcacccacg

SEQ ID NO: 662016 - DNA, 20 bp, mouse
ggggaccaactgctccgcca

SEQ ID NO: 662017 - DNA, 20 bp, mouse
gccgccccaagctgacacgc

SEQ ID NO: 662018 - DNA, 20 bp, mouse
gcgccacggctcggtctctg

SEQ ID NO: 662019 - DNA, 20 bp, mouse
gacggccgcggtcacagggc

SEQ ID NO: 662020 - DNA, 20 bp, mouse
gaaccccagagaccgagccg

SEQ ID NO: 662021 - DNA, 20 bp, mouse
gggacagcgaattcctgcac

SEQ ID NO: 662022 - DNA, 20 bp, mouse
gtcccagcgccaagcgacaa

SEQ ID NO: 662023 - DNA, 20 bp, mouse
ggggctggagagttaggccc

SEQ ID NO: 662024 - DNA, 20 bp, mouse
gcagcccgcgtgtcagcttg

SEQ ID NO: 662025 - DNA, 20 bp, mouse
gcccgggtcgtgtggtctgg

SEQ ID NO: 662026 - DNA, 20 bp, mouse
gagtactgaattcacaagag

SEQ ID NO: 662027 - DNA, 20 bp, mouse
gaggaagttcagtaggctta

SEQ ID NO: 662028 - DNA, 20 bp, mouse
ggcctgccttaatgctggac

SEQ ID NO: 662029 - DNA, 20 bp, mouse
gtgaggcagtccttcttcac

SEQ ID NO: 662030 - DNA, 20 bp, mouse
gagtgtagcccctccccctg

SEQ ID NO: 662031 - DNA, 20 bp, mouse
gggaacgccttgtatagctg

SEQ ID NO: 662032 - DNA, 20 bp, mouse
ggtaaaccaggaagttcagt

SEQ ID NO: 662033 - DNA, 20 bp, mouse
gagaaaaagctgtacgatac

SEQ ID NO: 662034 - DNA, 20 bp, mouse
gacaagttgccacgcccctc

SEQ ID NO: 662035 - DNA, 20 bp, mouse
gcaaatgcctgccttaatgc

SEQ ID NO: 662036 - DNA, 20 bp, mouse
gcaacctgggccagcccatc

SEQ ID NO: 662037 - DNA, 20 bp, mouse
gggaactcccacaaagcaca

SEQ ID NO: 662038 - DNA, 20 bp, mouse
gcagggcgcagctgccagat

SEQ ID NO: 662039 - DNA, 20 bp, mouse
ggagagaagggcaccatccc

SEQ ID NO: 662040 - DNA, 20 bp, mouse
gctgccagatgggctggccc

SEQ ID NO: 662041 - DNA, 20 bp, mouse
ggaaccctgcagtgggtctc

SEQ ID NO: 662042 - DNA, 20 bp, mouse
gtaactgggtttcacccctg

SEQ ID NO: 662043 - DNA, 20 bp, mouse
ggtcggaagtagataacttc

SEQ ID NO: 662044 - DNA, 20 bp, mouse
gatatcccagcatgcaacct

SEQ ID NO: 662045 - DNA, 20 bp, mouse
gttcccaggcagcatagggt

SEQ ID NO: 662046 - DNA, 20 bp, mouse
ggggcgcgccaccccatccc

SEQ ID NO: 662047 - DNA, 20 bp, mouse
gtccccgccggggctcttgg

SEQ ID NO: 662048 - DNA, 20 bp, mouse
ggccgccggtggagctgcgc

SEQ ID NO: 662049 - DNA, 20 bp, mouse
gagggatggcggcgccccgg

SEQ ID NO: 662050 - DNA, 20 bp, mouse
gagccggctgaggaggatgg

SEQ ID NO: 662051 - DNA, 20 bp, mouse
gaagagccccggcggggaga

SEQ ID NO: 662052 - DNA, 20 bp, mouse
gcacgcgaggaacgcgtggg

SEQ ID NO: 662053 - DNA, 20 bp, mouse
gcggcggggagagggactta

SEQ ID NO: 662054 - DNA, 20 bp, mouse
gtggagctgcgcggggtgag

SEQ ID NO: 662055 - DNA, 20 bp, mouse
ggcgccaccccatcccgggg

SEQ ID NO: 662056 - DNA, 20 bp, mouse
gccgcggggcaggacgtcga

SEQ ID NO: 662057 - DNA, 20 bp, mouse
gctgacgcggggcggtccga

SEQ ID NO: 662058 - DNA, 20 bp, mouse
ggggcaggacgtcgagggct

SEQ ID NO: 662059 - DNA, 20 bp, mouse
gccgccccgcgtcagaacgc

SEQ ID NO: 662060 - DNA, 20 bp, mouse
gggagcctccccgcgccgtg

SEQ ID NO: 662061 - DNA, 20 bp, mouse
ggggaccgggatgaggcgac

SEQ ID NO: 662062 - DNA, 20 bp, mouse
gtcagcacgccgcacggcgc

SEQ ID NO: 662063 - DNA, 20 bp, mouse
ggacctggcgcgtggagctg

SEQ ID NO: 662064 - DNA, 20 bp, mouse
gggcccacttgcacgatccc

SEQ ID NO: 662065 - DNA, 20 bp, mouse
gagggctcgggacgccttgc

SEQ ID NO: 662066 - DNA, 20 bp, mouse
gcactgctggaacctctcaa

SEQ ID NO: 662067 - DNA, 20 bp, mouse
ggtgaagcggcgggaggctc

SEQ ID NO: 662068 - DNA, 20 bp, mouse
gaacccagtctgatcactgc

SEQ ID NO: 662069 - DNA, 20 bp, mouse
gcaggaagggagcacgtgaa

SEQ ID NO: 662070 - DNA, 20 bp, mouse
gttggtctacctctccgcag

SEQ ID NO: 662071 - DNA, 20 bp, mouse
ggagcacgtgaagggtgagg

SEQ ID NO: 662072 - DNA, 20 bp, mouse
ggtcctgcctagcttgggat

SEQ ID NO: 662073 - DNA, 20 bp, mouse
gtccgcagtggaacatagtg

SEQ ID NO: 662074 - DNA, 20 bp, mouse
gcattgcaatagtgaagcgg

SEQ ID NO: 662075 - DNA, 20 bp, mouse
ggttccagcagtgatcagac

SEQ ID NO: 662076 - DNA, 20 bp, mouse
gaagtggatcacagccagtc

SEQ ID NO: 662077 - DNA, 20 bp, mouse
ggaacaggtcccaagagtac

SEQ ID NO: 662078 - DNA, 20 bp, mouse
gtttgcatccctgtactctt

SEQ ID NO: 662079 - DNA, 20 bp, mouse
gtcttgggacctgttcctgc

SEQ ID NO: 662080 - DNA, 20 bp, mouse
ggtacaaattactaacctgc

SEQ ID NO: 662081 - DNA, 20 bp, mouse
gaacagaggcagagacaagg

SEQ ID NO: 662082 - DNA, 20 bp, mouse
gaggcagagacaaggtggct

SEQ ID NO: 662083 - DNA, 20 bp, mouse
ggctcagacctctgctgaag

SEQ ID NO: 662084 - DNA, 20 bp, mouse
gatttgtacctcttcagcag

SEQ ID NO: 662085 - DNA, 20 bp, mouse
gacaaggtggctagggacga

SEQ ID NO: 662086 - DNA, 20 bp, mouse
gccaggcaccgccccgctta

SEQ ID NO: 662087 - DNA, 20 bp, mouse
gctggctggttaggatagga

SEQ ID NO: 662088 - DNA, 20 bp, mouse
gaccgccccgcttagggtta

SEQ ID NO: 662089 - DNA, 20 bp, mouse
gaagggctcagagctgtcta

SEQ ID NO: 662090 - DNA, 20 bp, mouse
gctaaggaaagaaggtggaa

SEQ ID NO: 662091 - DNA, 20 bp, mouse
gcctctggggcagagactgg

SEQ ID NO: 662092 - DNA, 20 bp, mouse
gagaaggcagcaggagtccc

SEQ ID NO: 662093 - DNA, 20 bp, mouse
ggaagggtctgtttcagcga

SEQ ID NO: 662094 - DNA, 20 bp, mouse
gcccaagtccccagaaacct

SEQ ID NO: 662095 - DNA, 20 bp, mouse
ggccttctaaggaaagaagg

SEQ ID NO: 662096 - DNA, 20 bp, mouse
gaaagaggaagtcactatgt

SEQ ID NO: 662097 - DNA, 20 bp, mouse
ggtggataaaggtcctgact

SEQ ID NO: 662098 - DNA, 20 bp, mouse
gtcaaactcaggtcccagtc

SEQ ID NO: 662099 - DNA, 20 bp, mouse
gtgtgtaattgatcccattc

SEQ ID NO: 662100 - DNA, 20 bp, mouse
gatccactgaggcaacctgt

SEQ ID NO: 662101 - DNA, 20 bp, mouse
gtccatttgccacccagaat

SEQ ID NO: 662102 - DNA, 20 bp, mouse
gtcacagcatcctaccttca

SEQ ID NO: 662103 - DNA, 20 bp, mouse
gatgctgtgacgacaggcat

SEQ ID NO: 662104 - DNA, 20 bp, mouse
gcagaagtgagaaatcatct

SEQ ID NO: 662105 - DNA, 20 bp, mouse
gactaggtaaagtgaaaaag

SEQ ID NO: 662106 - DNA, 20 bp, mouse
gtcttgcaggctggggtcag

SEQ ID NO: 662107 - DNA, 20 bp, mouse
ggctgcatctcggggaaatg

SEQ ID NO: 662108 - DNA, 20 bp, mouse
gcgggcagcctcacagccga

SEQ ID NO: 662109 - DNA, 20 bp, mouse
gcccccagccccggagaccc

SEQ ID NO: 662110 - DNA, 20 bp, mouse
gcaaagttcccgtgaaccca

SEQ ID NO: 662111 - DNA, 20 bp, mouse
gccggagccaggctgcatct

SEQ ID NO: 662112 - DNA, 20 bp, mouse
gccgctgcaacccacatgcg

SEQ ID NO: 662113 - DNA, 20 bp, mouse
ggcagcagggaagtggttag

SEQ ID NO: 662114 - DNA, 20 bp, mouse
ggcccgcccggaccattcat

SEQ ID NO: 662115 - DNA, 20 bp, mouse
gtcggggaaatgaggcccgg

SEQ ID NO: 662116 - DNA, 20 bp, mouse
gaaagcccggggagccagga

SEQ ID NO: 662117 - DNA, 20 bp, mouse
gctccccgggcttttctgaa

SEQ ID NO: 662118 - DNA, 20 bp, mouse
gccggggagccaggaaggct

SEQ ID NO: 662119 - DNA, 20 bp, mouse
gagccgggaaacccaaaata

SEQ ID NO: 662120 - DNA, 20 bp, mouse
gggcctcagatcttgaaagg

SEQ ID NO: 662121 - DNA, 20 bp, mouse
ggttgcgcactcgggaaagg

SEQ ID NO: 662122 - DNA, 20 bp, mouse
gggcggtgtccctggaatgc

SEQ ID NO: 662123 - DNA, 20 bp, mouse
ggagtgacacccagcattcc

SEQ ID NO: 662124 - DNA, 20 bp, mouse
gtggtaaagcctccacttgg

SEQ ID NO: 662125 - DNA, 20 bp, mouse
gggtgagcaacctgcttctc

SEQ ID NO: 662126 - DNA, 20 bp, mouse
ggaccccgaggtaaccagac

SEQ ID NO: 662127 - DNA, 20 bp, mouse
ggggccttcactgcggtgga

SEQ ID NO: 662128 - DNA, 20 bp, mouse
gcagcgtcttacaaacaaga

SEQ ID NO: 662129 - DNA, 20 bp, mouse
gacaggcccagatcccatcc

SEQ ID NO: 662130 - DNA, 20 bp, mouse
gttgcaggtatcaactgctt

SEQ ID NO: 662131 - DNA, 20 bp, mouse
gtcttacaaacaagagggtg

SEQ ID NO: 662132 - DNA, 20 bp, mouse
gggccggaaccaagcctgga

SEQ ID NO: 662133 - DNA, 20 bp, mouse
gccaagcctggatgggatct

SEQ ID NO: 662134 - DNA, 20 bp, mouse
ggggcctgtctggttacctc

SEQ ID NO: 662135 - DNA, 20 bp, mouse
gagctgggccttcactgcgg

SEQ ID NO: 662136 - DNA, 20 bp, mouse
gcccgcttaaacacagtgtg

SEQ ID NO: 662137 - DNA, 20 bp, mouse
ggggagggaccttctgcgag

SEQ ID NO: 662138 - DNA, 20 bp, mouse
gctaaatgggcctatgtctg

SEQ ID NO: 662139 - DNA, 20 bp, mouse
gtgtgctggccactcgcaga

SEQ ID NO: 662140 - DNA, 20 bp, mouse
ggacctagaagaatctaaat

SEQ ID NO: 662141 - DNA, 20 bp, mouse
ggctcaggatgccatgatgc

SEQ ID NO: 662142 - DNA, 20 bp, mouse
gcctaaggaaaaacaggatt

SEQ ID NO: 662143 - DNA, 20 bp, mouse
ggtggcaaggttccatgcac

SEQ ID NO: 662144 - DNA, 20 bp, mouse
gttaaacacagtgtgtggtt

SEQ ID NO: 662145 - DNA, 20 bp, mouse
gaaccttgccacatggatga

SEQ ID NO: 662146 - DNA, 20 bp, mouse
gcaaagccatgccccagccc

SEQ ID NO: 662147 - DNA, 20 bp, mouse
ggggctgggaagtgcgcgga

SEQ ID NO: 662148 - DNA, 20 bp, mouse
gtggcgctgcgaggtttctg

SEQ ID NO: 662149 - DNA, 20 bp, mouse
ggcaggaggcggctctccag

SEQ ID NO: 662150 - DNA, 20 bp, mouse
gtatgggccacaactaccca

SEQ ID NO: 662151 - DNA, 20 bp, mouse
ggcggggttcagctccacta

SEQ ID NO: 662152 - DNA, 20 bp, mouse
gccactaaggtccagaaaac

SEQ ID NO: 662153 - DNA, 20 bp, mouse
gtgcagcaaagcacctaaca

SEQ ID NO: 662154 - DNA, 20 bp, mouse
gtgggaagtgcgcggagggg

SEQ ID NO: 662155 - DNA, 20 bp, mouse
gccaggggctgggaagtgcg

SEQ ID NO: 662156 - DNA, 20 bp, mouse
gttctgaatagcttggttca

SEQ ID NO: 662157 - DNA, 20 bp, mouse
gtccacccctcattgaactc

SEQ ID NO: 662158 - DNA, 20 bp, mouse
gtcctgagttcaatgagggg

SEQ ID NO: 662159 - DNA, 20 bp, mouse
ggggatacacttagggtatg

SEQ ID NO: 662160 - DNA, 20 bp, mouse
gtctgtcctgagttcaatga

SEQ ID NO: 662161 - DNA, 20 bp, mouse
gaggtcttaatctacagttc

SEQ ID NO: 662162 - DNA, 20 bp, mouse
gcttcccttagcagccaaat

SEQ ID NO: 662163 - DNA, 20 bp, mouse
gtcagaaggctgaagcaaca

SEQ ID NO: 662164 - DNA, 20 bp, mouse
gagcctgtggttggccaatt

SEQ ID NO: 662165 - DNA, 20 bp, mouse
gttggccaatttggctgcta

SEQ ID NO: 662166 - DNA, 20 bp, mouse
gcggtggggtccaggattac

SEQ ID NO: 662167 - DNA, 20 bp, mouse
gatcctggaccccaccgcat

SEQ ID NO: 662168 - DNA, 20 bp, mouse
gcacccatgcggtggggtcc

SEQ ID NO: 662169 - DNA, 20 bp, mouse
gaggtcgcagcacacccatg

SEQ ID NO: 662170 - DNA, 20 bp, mouse
gtcgcagcacacccatgcgg

SEQ ID NO: 662171 - DNA, 20 bp, mouse
gcgggcggagcgtggagcaa

SEQ ID NO: 662172 - DNA, 20 bp, mouse
gcagcagaaaccattgctca

SEQ ID NO: 662173 - DNA, 20 bp, mouse
gcgggcatttaaaactagca

SEQ ID NO: 662174 - DNA, 20 bp, mouse
ggggccggggcggtccgcag

SEQ ID NO: 662175 - DNA, 20 bp, mouse
gctggtgtggacatgttgac

SEQ ID NO: 662176 - DNA, 20 bp, mouse
gaggccccagatgcaagcat

SEQ ID NO: 662177 - DNA, 20 bp, mouse
gtatccaatgcttgcatctg

SEQ ID NO: 662178 - DNA, 20 bp, mouse
ggccagcatgaattagtctt

SEQ ID NO: 662179 - DNA, 20 bp, mouse
gtgttgaaatacatcaggtc

SEQ ID NO: 662180 - DNA, 20 bp, mouse
gataacatgtaattaaaatt

SEQ ID NO: 662181 - DNA, 20 bp, mouse
gtcctaagactaattcatgc

SEQ ID NO: 662182 - DNA, 20 bp, mouse
ggttcctgaatgtgactaca

SEQ ID NO: 662183 - DNA, 20 bp, mouse
gcatccttgtagtcacattc

SEQ ID NO: 662184 - DNA, 20 bp, mouse
gtattagtgtatattttgac

SEQ ID NO: 662185 - DNA, 20 bp, mouse
ggttaacaaactcatatgga

SEQ ID NO: 662186 - DNA, 20 bp, mouse
ggccccgcctctgtccatcc

SEQ ID NO: 662187 - DNA, 20 bp, mouse
gcagaggcggggcaagcctc

SEQ ID NO: 662188 - DNA, 20 bp, mouse
gggccccaataatgggggat

SEQ ID NO: 662189 - DNA, 20 bp, mouse
gactgggtgggggaccggga

SEQ ID NO: 662190 - DNA, 20 bp, mouse
gaagtgcgcacgcgcacgac

SEQ ID NO: 662191 - DNA, 20 bp, mouse
gggtcttgaggccccaataa

SEQ ID NO: 662192 - DNA, 20 bp, mouse
gaccgggagagacgcacggg

SEQ ID NO: 662193 - DNA, 20 bp, mouse
gaggaactgggtgggggacc

SEQ ID NO: 662194 - DNA, 20 bp, mouse
gacgaccgggagagacgcac

SEQ ID NO: 662195 - DNA, 20 bp, mouse
gttagctcctggatggacag

SEQ ID NO: 662196 - DNA, 20 bp, mouse
ggcggccaaacaggtgtctc

SEQ ID NO: 662197 - DNA, 20 bp, mouse
gcggacggggacgcggaccc

SEQ ID NO: 662198 - DNA, 20 bp, mouse
gggagccggggctgatgtca

SEQ ID NO: 662199 - DNA, 20 bp, mouse
gcgcgccggcgcggccaaac

SEQ ID NO: 662200 - DNA, 20 bp, mouse
ggccgcccgagacacctgtt

SEQ ID NO: 662201 - DNA, 20 bp, mouse
gcgccccgggcgcctcgggc

SEQ ID NO: 662202 - DNA, 20 bp, mouse
ggcagggcgactgagggttc

SEQ ID NO: 662203 - DNA, 20 bp, mouse
ggccggcggcagggcgactg

SEQ ID NO: 662204 - DNA, 20 bp, mouse
ggcccggcgtgtccggcccg

SEQ ID NO: 662205 - DNA, 20 bp, mouse
ggccaccctcgcgctctccg

SEQ ID NO: 662206 - DNA, 20 bp, mouse
gcccctcggggcatcccatt

SEQ ID NO: 662207 - DNA, 20 bp, mouse
gcacgcccgtaggcagaccg

SEQ ID NO: 662208 - DNA, 20 bp, mouse
ggctccgtgagactcggaaa

SEQ ID NO: 662209 - DNA, 20 bp, mouse
gcgagagctgggaacggcgt

SEQ ID NO: 662210 - DNA, 20 bp, mouse
ggggcgggctccgtgagact

SEQ ID NO: 662211 - DNA, 20 bp, mouse
gcgtggaaactgccggagtg

SEQ ID NO: 662212 - DNA, 20 bp, mouse
gcaacagaggaagctgacga

SEQ ID NO: 662213 - DNA, 20 bp, mouse
gccttcctcggtctgcctac

SEQ ID NO: 662214 - DNA, 20 bp, mouse
gaggaagctgacgagggtgg

SEQ ID NO: 662215 - DNA, 20 bp, mouse
gcggcagtttccacgcccgt

SEQ ID NO: 662216 - DNA, 20 bp, mouse
gtggccctggggaagttcag

SEQ ID NO: 662217 - DNA, 20 bp, mouse
ggggaggactctgaagatgg

SEQ ID NO: 662218 - DNA, 20 bp, mouse
gtcctgcccagccacagttg

SEQ ID NO: 662219 - DNA, 20 bp, mouse
gccctgtcccaaacgtgctg

SEQ ID NO: 662220 - DNA, 20 bp, mouse
gtaccccctgaacttcccca

SEQ ID NO: 662221 - DNA, 20 bp, mouse
ggtgggacacccgtcagcaa

SEQ ID NO: 662222 - DNA, 20 bp, mouse
gcacacacggaaattttaag

SEQ ID NO: 662223 - DNA, 20 bp, mouse
ggggaaagacacaagagctt

SEQ ID NO: 662224 - DNA, 20 bp, mouse
gggactctgaagatgggggt

SEQ ID NO: 662225 - DNA, 20 bp, mouse
gtcggaaaggatatgaaact

SEQ ID NO: 662226 - DNA, 20 bp, mouse
gttcctgagggcagcaggat

SEQ ID NO: 662227 - DNA, 20 bp, mouse
gcaactcagcacctgtggat

SEQ ID NO: 662228 - DNA, 20 bp, mouse
gcaccaccaaccccatccac

SEQ ID NO: 662229 - DNA, 20 bp, mouse
gttcgccaactcagcacctg

SEQ ID NO: 662230 - DNA, 20 bp, mouse
gtcccctcccaaggcccaac

SEQ ID NO: 662231 - DNA, 20 bp, mouse
gcagcacctgtggatggggt

SEQ ID NO: 662232 - DNA, 20 bp, mouse
ggtgctgagttggcgaaacc

SEQ ID NO: 662233 - DNA, 20 bp, mouse
ggagagagggtcagcctgtt

SEQ ID NO: 662234 - DNA, 20 bp, mouse
gggtcagcctgttgggcctt

SEQ ID NO: 662235 - DNA, 20 bp, mouse
ggctgccctcaggaagtttc

SEQ ID NO: 662236 - DNA, 20 bp, mouse
ggggagccgccagtgcagtc

SEQ ID NO: 662237 - DNA, 20 bp, mouse
ggccgccagtgcagtcgggg

SEQ ID NO: 662238 - DNA, 20 bp, mouse
gggtcaaggtagctgagtca

SEQ ID NO: 662239 - DNA, 20 bp, mouse
ggcctccccgactgcactgg

SEQ ID NO: 662240 - DNA, 20 bp, mouse
gaaggcctccccgactgcac

SEQ ID NO: 662241 - DNA, 20 bp, mouse
gccggaccgcgccctctgct

SEQ ID NO: 662242 - DNA, 20 bp, mouse
gggactgcagtcatccgggc

SEQ ID NO: 662243 - DNA, 20 bp, mouse
gggtgtggattgagaaaagc

SEQ ID NO: 662244 - DNA, 20 bp, mouse
gaaagcgcttccccgggcga

SEQ ID NO: 662245 - DNA, 20 bp, mouse
gtgggctttccagaattagt

SEQ ID NO: 662246 - DNA, 20 bp, mouse
gacctagggccagggaagga

SEQ ID NO: 662247 - DNA, 20 bp, mouse
ggggcagggtgatcattcta

SEQ ID NO: 662248 - DNA, 20 bp, mouse
ggtgggtagagatatcactg

SEQ ID NO: 662249 - DNA, 20 bp, mouse
gaatgatcaccctgccccta

SEQ ID NO: 662250 - DNA, 20 bp, mouse
gacagctgtgccctgggttc

SEQ ID NO: 662251 - DNA, 20 bp, mouse
gtagggttagggtgctgtgg

SEQ ID NO: 662252 - DNA, 20 bp, mouse
gctggtgttctcaggatgaa

SEQ ID NO: 662253 - DNA, 20 bp, mouse
gcagggaaaatttctggaaa

SEQ ID NO: 662254 - DNA, 20 bp, mouse
gagggcacagctgtccctag

SEQ ID NO: 662255 - DNA, 20 bp, mouse
gcatgacctagggccaggga

SEQ ID NO: 662256 - DNA, 20 bp, mouse
ggctccgcggggctcggaga

SEQ ID NO: 662257 - DNA, 20 bp, mouse
gagagtggtgggcatcacgg

SEQ ID NO: 662258 - DNA, 20 bp, mouse
gcaggcgcctaattgggccg

SEQ ID NO: 662259 - DNA, 20 bp, mouse
gcggggctcggagagggcga

SEQ ID NO: 662260 - DNA, 20 bp, mouse
gcggagggagctggagattg

SEQ ID NO: 662261 - DNA, 20 bp, mouse
ggggcggggcccaacggagg

SEQ ID NO: 662262 - DNA, 20 bp, mouse
ggcggggcaggcgcctaatt

SEQ ID NO: 662263 - DNA, 20 bp, mouse
ggccgcggaagcctcaaggt

SEQ ID NO: 662264 - DNA, 20 bp, mouse
gggtgggcggggcccaacgg

SEQ ID NO: 662265 - DNA, 20 bp, mouse
gcctcaaggtgggaggggca

SEQ ID NO: 662266 - DNA, 20 bp, mouse
gccgccagcaggcacatctc

SEQ ID NO: 662267 - DNA, 20 bp, mouse
gccagcaggcacatctccgg

SEQ ID NO: 662268 - DNA, 20 bp, mouse
gccggaggacgccgcgggat

SEQ ID NO: 662269 - DNA, 20 bp, mouse
ggctcccacttgtggctcct

SEQ ID NO: 662270 - DNA, 20 bp, mouse
gtctgtggagccccagctag

SEQ ID NO: 662271 - DNA, 20 bp, mouse
ggggcagcagcccctagctg

SEQ ID NO: 662272 - DNA, 20 bp, mouse
ggcgtgcgctgccatcactc

SEQ ID NO: 662273 - DNA, 20 bp, mouse
gggcgcccaggagccacaag

SEQ ID NO: 662274 - DNA, 20 bp, mouse
gacccacgcgcgcaatcagt

SEQ ID NO: 662275 - DNA, 20 bp, mouse
gtaagatcaggactgagcgg

SEQ ID NO: 662276 - DNA, 20 bp, mouse
gccctagctggtcatactag

SEQ ID NO: 662277 - DNA, 20 bp, mouse
gtagggcgctgccatcgtct

SEQ ID NO: 662278 - DNA, 20 bp, mouse
gcagctgcgcaactgctctc

SEQ ID NO: 662279 - DNA, 20 bp, mouse
gctctcccccctctcagcaa

SEQ ID NO: 662280 - DNA, 20 bp, mouse
ggcgcgccggagcaatttat

SEQ ID NO: 662281 - DNA, 20 bp, mouse
gttcatcccttgctgagagg

SEQ ID NO: 662282 - DNA, 20 bp, mouse
ggcactggggaaatagattt

SEQ ID NO: 662283 - DNA, 20 bp, mouse
gccatcgtctgggctagaca

SEQ ID NO: 662284 - DNA, 20 bp, mouse
ggctagacaaggaagtattc

SEQ ID NO: 662285 - DNA, 20 bp, mouse
gtgaacgcagaattctgcct

SEQ ID NO: 662286 - DNA, 20 bp, mouse
ggggccaaggacagcccttg

SEQ ID NO: 662287 - DNA, 20 bp, mouse
gaaccctcaagggctgtcct

SEQ ID NO: 662288 - DNA, 20 bp, mouse
ggagggtaatatcagactgt

SEQ ID NO: 662289 - DNA, 20 bp, mouse
gagatcgccaccctgacagg

SEQ ID NO: 662290 - DNA, 20 bp, mouse
ggggagatcgccaccctgac

SEQ ID NO: 662291 - DNA, 20 bp, mouse
gctccccgtgagctgggcca

SEQ ID NO: 662292 - DNA, 20 bp, mouse
gaaacctgcagcttcttgga

SEQ ID NO: 662293 - DNA, 20 bp, mouse
gttccccaaaccgcctgtca

SEQ ID NO: 662294 - DNA, 20 bp, mouse
gagaaagcaactgtctggag

SEQ ID NO: 662295 - DNA, 20 bp, mouse
ggacagctgtgcctggtccc

SEQ ID NO: 662296 - DNA, 20 bp, mouse
gccctggggcgtccagaagt

SEQ ID NO: 662297 - DNA, 20 bp, mouse
gggcacaggctagaagggga

SEQ ID NO: 662298 - DNA, 20 bp, mouse
gcatggaatatcctcgtcct

SEQ ID NO: 662299 - DNA, 20 bp, mouse
gtagcctgtgccagctccct

SEQ ID NO: 662300 - DNA, 20 bp, mouse
gtgggcaggcagcatctgga

SEQ ID NO: 662301 - DNA, 20 bp, mouse
gggcccagcaccacactcca

SEQ ID NO: 662302 - DNA, 20 bp, mouse
gaactgtgtgtgtgcccggc

SEQ ID NO: 662303 - DNA, 20 bp, mouse
ggatggcaagggtctcagat

SEQ ID NO: 662304 - DNA, 20 bp, mouse
gtcacagccaccttcacatc

SEQ ID NO: 662305 - DNA, 20 bp, mouse
gcacaactcacatctggctg

SEQ ID NO: 662306 - DNA, 20 bp, mouse
gttagcgatgggggcaactt

SEQ ID NO: 662307 - DNA, 20 bp, mouse
gccagcgcacgtgaccggga

SEQ ID NO: 662308 - DNA, 20 bp, mouse
gctcccgcccatgacgggat

SEQ ID NO: 662309 - DNA, 20 bp, mouse
ggctagccagcgcacgtgac

SEQ ID NO: 662310 - DNA, 20 bp, mouse
gaggcactcccgcccatgac

SEQ ID NO: 662311 - DNA, 20 bp, mouse
gcacgtgggcatttatctct

SEQ ID NO: 662312 - DNA, 20 bp, mouse
ggcactggacagtgattata

SEQ ID NO: 662313 - DNA, 20 bp, mouse
gcgcacgtgaccgggaagga

SEQ ID NO: 662314 - DNA, 20 bp, mouse
gttatctcttggtggatccg

SEQ ID NO: 662315 - DNA, 20 bp, mouse
ggcgggagtgccttccttcc

SEQ ID NO: 662316 - DNA, 20 bp, mouse
gtgtgtgcacggcgtccagt

SEQ ID NO: 662317 - DNA, 20 bp, mouse
ggcacggcgtccagttggtg

SEQ ID NO: 662318 - DNA, 20 bp, mouse
gtggagaaaatgtacacagc

SEQ ID NO: 662319 - DNA, 20 bp, mouse
ggcaagacagtctgtgtgca

SEQ ID NO: 662320 - DNA, 20 bp, mouse
ggcagcctacagatggtgac

SEQ ID NO: 662321 - DNA, 20 bp, mouse
gctgctgctggtatctggaa

SEQ ID NO: 662322 - DNA, 20 bp, mouse
gactgtcttgcctgcggtgc

SEQ ID NO: 662323 - DNA, 20 bp, mouse
gcagtctgagccgcattccc

SEQ ID NO: 662324 - DNA, 20 bp, mouse
gttcgtgattagacgtggaa

SEQ ID NO: 662325 - DNA, 20 bp, mouse
ggacctgagttcaagggtaa

SEQ ID NO: 662326 - DNA, 20 bp, mouse
gcacccggtgggtaacgctc

SEQ ID NO: 662327 - DNA, 20 bp, mouse
gaggggagagcggaggacga

SEQ ID NO: 662328 - DNA, 20 bp, mouse
gctgaagcggagaaacgcaa

SEQ ID NO: 662329 - DNA, 20 bp, mouse
gtgggtaacgctcaggatcc

SEQ ID NO: 662330 - DNA, 20 bp, mouse
gccgctagagaggccaccct

SEQ ID NO: 662331 - DNA, 20 bp, mouse
ggcgccgagcagttgggcct

SEQ ID NO: 662332 - DNA, 20 bp, mouse
ggaaaccgaggccgctagag

SEQ ID NO: 662333 - DNA, 20 bp, mouse
gaggaggtgagattttgtat

SEQ ID NO: 662334 - DNA, 20 bp, mouse
ggtggcctctctagcggcct

SEQ ID NO: 662335 - DNA, 20 bp, mouse
ggccttgggccaccctaggg

SEQ ID NO: 662336 - DNA, 20 bp, mouse
gggcggccggccaaaattgt

SEQ ID NO: 662337 - DNA, 20 bp, mouse
gaaaattgtggggatgtagg

SEQ ID NO: 662338 - DNA, 20 bp, mouse
gaactgtgaggcagacactt

SEQ ID NO: 662339 - DNA, 20 bp, mouse
gaccaagaggccgaactgtg

SEQ ID NO: 662340 - DNA, 20 bp, mouse
gggggcctggccactgtcta

SEQ ID NO: 662341 - DNA, 20 bp, mouse
gtcagaggccaagaactcca

SEQ ID NO: 662342 - DNA, 20 bp, mouse
gaactcgtggtgtcgcccgg

SEQ ID NO: 662343 - DNA, 20 bp, mouse
ggtggagaactggattagta

SEQ ID NO: 662344 - DNA, 20 bp, mouse
gaggccaagaactccagggc

SEQ ID NO: 662345 - DNA, 20 bp, mouse
gcaaaacccgtggtgggggt

SEQ ID NO: 662346 - DNA, 20 bp, mouse
ggctctgcctcggaggtact

SEQ ID NO: 662347 - DNA, 20 bp, mouse
gtgtggccctggcccagcgc

SEQ ID NO: 662348 - DNA, 20 bp, mouse
ggactgagctaggagggcgg

SEQ ID NO: 662349 - DNA, 20 bp, mouse
gggtccccagcgctgggcca

SEQ ID NO: 662350 - DNA, 20 bp, mouse
gtcggaggtactgggagact

SEQ ID NO: 662351 - DNA, 20 bp, mouse
gtaacatccttgggcatctg

SEQ ID NO: 662352 - DNA, 20 bp, mouse
ggcctggggctctgcctcgg

SEQ ID NO: 662353 - DNA, 20 bp, mouse
ggcctacgactgagctagga

SEQ ID NO: 662354 - DNA, 20 bp, mouse
ggcggggctctgcattactc

SEQ ID NO: 662355 - DNA, 20 bp, mouse
gagtcgtaggcctaggggtc

SEQ ID NO: 662356 - DNA, 20 bp, mouse
ggatgtgaagcaagggtctc

SEQ ID NO: 662357 - DNA, 20 bp, mouse
gcacacagtgcaaacagcga

SEQ ID NO: 662358 - DNA, 20 bp, mouse
gcggaggcagatgtgaagca

SEQ ID NO: 662359 - DNA, 20 bp, mouse
gagcaagggtctcgggtatc

SEQ ID NO: 662360 - DNA, 20 bp, mouse
gtatctggcaagttaggaaa

SEQ ID NO: 662361 - DNA, 20 bp, mouse
gcctgctgacacaattccac

SEQ ID NO: 662362 - DNA, 20 bp, mouse
ggcgatggctgcagagagac

SEQ ID NO: 662363 - DNA, 20 bp, mouse
gaggaaaagggctacaccgg

SEQ ID NO: 662364 - DNA, 20 bp, mouse
gttctgcaaaccccagacgg

SEQ ID NO: 662365 - DNA, 20 bp, mouse
gtatacactcgttaggaatg

SEQ ID NO: 662366 - DNA, 20 bp, mouse
gcctgggctgctgtgaaggg

SEQ ID NO: 662367 - DNA, 20 bp, mouse
ggtgccagcaggtggaatgt

SEQ ID NO: 662368 - DNA, 20 bp, mouse
gcaaaatagcaggaagggga

SEQ ID NO: 662369 - DNA, 20 bp, mouse
gagggaggcacaagatgtct

SEQ ID NO: 662370 - DNA, 20 bp, mouse
gtcggccttgagtccatcag

SEQ ID NO: 662371 - DNA, 20 bp, mouse
gaggaaagaagcctgtagtg

SEQ ID NO: 662372 - DNA, 20 bp, mouse
gggactcaaggccgaggaga

SEQ ID NO: 662373 - DNA, 20 bp, mouse
ggacaaagttgtccatacct

SEQ ID NO: 662374 - DNA, 20 bp, mouse
gtaagtgcaaaatagcagga

SEQ ID NO: 662375 - DNA, 20 bp, mouse
ggagagggctgttcacaata

SEQ ID NO: 662376 - DNA, 20 bp, mouse
gccatctggtggtccatttg

SEQ ID NO: 662377 - DNA, 20 bp, mouse
ggcctcagccattccccaaa

SEQ ID NO: 662378 - DNA, 20 bp, mouse
gccacaatctacgatgcctg

SEQ ID NO: 662379 - DNA, 20 bp, mouse
gggagggcaccgaggtgtac

SEQ ID NO: 662380 - DNA, 20 bp, mouse
gtcgagctgaccatatgtcc

SEQ ID NO: 662381 - DNA, 20 bp, mouse
gaataagaattgcaaaaaag

SEQ ID NO: 662382 - DNA, 20 bp, mouse
gcagagttcaaggatggagg

SEQ ID NO: 662383 - DNA, 20 bp, mouse
gttgcaaaaaaggggccaat

SEQ ID NO: 662384 - DNA, 20 bp, mouse
ggttgcttgctggtgccatc

SEQ ID NO: 662385 - DNA, 20 bp, mouse
gtatccacacctgtacacct

SEQ ID NO: 662386 - DNA, 20 bp, mouse
gtggtggtcaatgtggggaa

SEQ ID NO: 662387 - DNA, 20 bp, mouse
gttctgggagactttcccgg

SEQ ID NO: 662388 - DNA, 20 bp, mouse
gagactgcggagacacttaa

SEQ ID NO: 662389 - DNA, 20 bp, mouse
gaaaggctctgctttctcat

SEQ ID NO: 662390 - DNA, 20 bp, mouse
ggcaccggggtgtatggctg

SEQ ID NO: 662391 - DNA, 20 bp, mouse
gaggagggcaccggggtgta

SEQ ID NO: 662392 - DNA, 20 bp, mouse
gtcaagctgaccagaggtcc

SEQ ID NO: 662393 - DNA, 20 bp, mouse
gcgccatctggtggtcaatg

SEQ ID NO: 662394 - DNA, 20 bp, mouse
gccgcagtctgcgatgcctg

SEQ ID NO: 662395 - DNA, 20 bp, mouse
gaaaaggcgggagctcaaag

SEQ ID NO: 662396 - DNA, 20 bp, mouse
gtccactaatagcaagctgg

SEQ ID NO: 662397 - DNA, 20 bp, mouse
gggaaatgagttgagactct

SEQ ID NO: 662398 - DNA, 20 bp, mouse
ggaggctaaggcggcaggat

SEQ ID NO: 662399 - DNA, 20 bp, mouse
ggggctagaggaggcccttt

SEQ ID NO: 662400 - DNA, 20 bp, mouse
ggagttgagactctgggtgc

SEQ ID NO: 662401 - DNA, 20 bp, mouse
gcggcaggattggcatgatt

SEQ ID NO: 662402 - DNA, 20 bp, mouse
ggtcttgcaaaacctggact

SEQ ID NO: 662403 - DNA, 20 bp, mouse
ggcctccagcttgctattag

SEQ ID NO: 662404 - DNA, 20 bp, mouse
gtgccgccttagcctccaga

SEQ ID NO: 662405 - DNA, 20 bp, mouse
gcatatgtacacatgacctt

SEQ ID NO: 662406 - DNA, 20 bp, mouse
ggaactgcaccagctttgct

SEQ ID NO: 662407 - DNA, 20 bp, mouse
gcctctcagcccagcaaagc

SEQ ID NO: 662408 - DNA, 20 bp, mouse
gtgtgtgattcatgaatcaa

SEQ ID NO: 662409 - DNA, 20 bp, mouse
gtaaggagggaaggcttaac

SEQ ID NO: 662410 - DNA, 20 bp, mouse
gggagggaaggcttaacagg

SEQ ID NO: 662411 - DNA, 20 bp, mouse
gcagagcaaaaggggggaat

SEQ ID NO: 662412 - DNA, 20 bp, mouse
ggttcttgttttaaacgcag

SEQ ID NO: 662413 - DNA, 20 bp, mouse
gcatgaatcacacagagggt

SEQ ID NO: 662414 - DNA, 20 bp, mouse
gtccctgttccaaacagagg

SEQ ID NO: 662415 - DNA, 20 bp, mouse
gagagggcactctaagatca

SEQ ID NO: 662416 - DNA, 20 bp, mouse
gggcaaggggatggtaccag

SEQ ID NO: 662417 - DNA, 20 bp, mouse
gagtggcggggagtggcaag

SEQ ID NO: 662418 - DNA, 20 bp, mouse
gttccccagaatagcttctg

SEQ ID NO: 662419 - DNA, 20 bp, mouse
gctcgctcgctagaggggag

SEQ ID NO: 662420 - DNA, 20 bp, mouse
gcgctcgctcgctcgctaga

SEQ ID NO: 662421 - DNA, 20 bp, mouse
gaagagagagaaacccgcca

SEQ ID NO: 662422 - DNA, 20 bp, mouse
gtcgctagaggggagtggcg

SEQ ID NO: 662423 - DNA, 20 bp, mouse
gcagtggaccccaatgcatg

SEQ ID NO: 662424 - DNA, 20 bp, mouse
gggattctgaactcagcttt

SEQ ID NO: 662425 - DNA, 20 bp, mouse
gtgagttcagaatccctggc

SEQ ID NO: 662426 - DNA, 20 bp, mouse
gaaagccaaactacaggctc

SEQ ID NO: 662427 - DNA, 20 bp, mouse
gctatcctgagcctgtagtt

SEQ ID NO: 662428 - DNA, 20 bp, mouse
gcatagggaactagggagcc

SEQ ID NO: 662429 - DNA, 20 bp, mouse
gtggactgcaagtccgcata

SEQ ID NO: 662430 - DNA, 20 bp, mouse
ggaggagttgccttaatacc

SEQ ID NO: 662431 - DNA, 20 bp, mouse
gcaagtccgcatagggaact

SEQ ID NO: 662432 - DNA, 20 bp, mouse
gaaaggaactgatagctata

SEQ ID NO: 662433 - DNA, 20 bp, mouse
ggtctatgtccaattctttc

SEQ ID NO: 662434 - DNA, 20 bp, mouse
gttagagaatgaagttgcta

SEQ ID NO: 662435 - DNA, 20 bp, mouse
gtgtagtttggctttctccc

SEQ ID NO: 662436 - DNA, 20 bp, mouse
gtctcagcttgcttcctctc

SEQ ID NO: 662437 - DNA, 20 bp, mouse
ggtccgcgggagctaggctg

SEQ ID NO: 662438 - DNA, 20 bp, mouse
gtgggtgataggtaaaagat

SEQ ID NO: 662439 - DNA, 20 bp, mouse
gaggcgctggactagctgga

SEQ ID NO: 662440 - DNA, 20 bp, mouse
ggcggtcagaattttaaaga

SEQ ID NO: 662441 - DNA, 20 bp, mouse
gccccacagcctagctcccg

SEQ ID NO: 662442 - DNA, 20 bp, mouse
ggccctggccagcgttttat

SEQ ID NO: 662443 - DNA, 20 bp, mouse
gtgctcttgacaacccagca

SEQ ID NO: 662444 - DNA, 20 bp, mouse
gctcccgggctgtgggaacc

SEQ ID NO: 662445 - DNA, 20 bp, mouse
gctgggttgtcaagagcaac

SEQ ID NO: 662446 - DNA, 20 bp, mouse
gcggtcgcgggtgtgggtag

SEQ ID NO: 662447 - DNA, 20 bp, mouse
ggcaccaggccgtagcccgg

SEQ ID NO: 662448 - DNA, 20 bp, mouse
ggggtggaagttaggcgggt

SEQ ID NO: 662449 - DNA, 20 bp, mouse
gcccggaagccgtgagctgg

SEQ ID NO: 662450 - DNA, 20 bp, mouse
gggccctgtagagcggtcgc

SEQ ID NO: 662451 - DNA, 20 bp, mouse
gcacggctgctgcaaaccgc

SEQ ID NO: 662452 - DNA, 20 bp, mouse
gagtcccggaagccgtgagc

SEQ ID NO: 662453 - DNA, 20 bp, mouse
gggtagcactcgttcaaacg

SEQ ID NO: 662454 - DNA, 20 bp, mouse
ggtagagcggtcgcgggtgt

SEQ ID NO: 662455 - DNA, 20 bp, mouse
gtgtgcacccacgttcgtaa

SEQ ID NO: 662456 - DNA, 20 bp, mouse
gtgcccgcaccaaacctcgg

SEQ ID NO: 662457 - DNA, 20 bp, mouse
gtagagctcggagaccgccg

SEQ ID NO: 662458 - DNA, 20 bp, mouse
ggggctgggcggacggagag

SEQ ID NO: 662459 - DNA, 20 bp, mouse
gtgaagaagtgaagcggcaa

SEQ ID NO: 662460 - DNA, 20 bp, mouse
gagaccgccgaggtttggtg

SEQ ID NO: 662461 - DNA, 20 bp, mouse
ggcggggcggcgtgcagggt

SEQ ID NO: 662462 - DNA, 20 bp, mouse
gcgcggcggggcggcgtgca

SEQ ID NO: 662463 - DNA, 20 bp, mouse
ggctctactctcagccccat

SEQ ID NO: 662464 - DNA, 20 bp, mouse
ggcggtctgaagaagtgaag

SEQ ID NO: 662465 - DNA, 20 bp, mouse
ggagctagagaaagtctgat

SEQ ID NO: 662466 - DNA, 20 bp, mouse
ggaactgtgcgctggcgcgt

SEQ ID NO: 662467 - DNA, 20 bp, mouse
ggccccgagggccctcacgg

SEQ ID NO: 662468 - DNA, 20 bp, mouse
gcacccaccactcaaggtag

SEQ ID NO: 662469 - DNA, 20 bp, mouse
gcaccactcaaggtagtggc

SEQ ID NO: 662470 - DNA, 20 bp, mouse
gagggccctcggggccttta

SEQ ID NO: 662471 - DNA, 20 bp, mouse
ggccctcacggcggcgttaa

SEQ ID NO: 662472 - DNA, 20 bp, mouse
gaaggccccgagggccctca

SEQ ID NO: 662473 - DNA, 20 bp, mouse
ggtggtgggtgagaaggtgt

SEQ ID NO: 662474 - DNA, 20 bp, mouse
ggtagctgtcaccctaaagt

SEQ ID NO: 662475 - DNA, 20 bp, mouse
ggccgcgggcgggacaaccc

SEQ ID NO: 662476 - DNA, 20 bp, mouse
gtgcacacgtagaggattcc

SEQ ID NO: 662477 - DNA, 20 bp, mouse
ggccgctcagagctagagga

SEQ ID NO: 662478 - DNA, 20 bp, mouse
gcccttgcctggtactgaag

SEQ ID NO: 662479 - DNA, 20 bp, mouse
gaggattccgggatgagaat

SEQ ID NO: 662480 - DNA, 20 bp, mouse
gactccgcctattctcatcc

SEQ ID NO: 662481 - DNA, 20 bp, mouse
gggttgagttgcacacgtag

SEQ ID NO: 662482 - DNA, 20 bp, mouse
ggagccgcgccctcaccggg

SEQ ID NO: 662483 - DNA, 20 bp, mouse
gggtactgaaggggtgcaca

SEQ ID NO: 662484 - DNA, 20 bp, mouse
gacccgccgctcagagctag

SEQ ID NO: 662485 - DNA, 20 bp, mouse
gattccgggatgagaatagg

SEQ ID NO: 662486 - DNA, 20 bp, mouse
gtgcgcagatgcaggtgccc

SEQ ID NO: 662487 - DNA, 20 bp, mouse
gagaactcgacaaccctagc

SEQ ID NO: 662488 - DNA, 20 bp, mouse
gaactgggtaacggagtctg

SEQ ID NO: 662489 - DNA, 20 bp, mouse
gcccgctgccgggtagagga

SEQ ID NO: 662490 - DNA, 20 bp, mouse
gggtggaagcgctgcggcga

SEQ ID NO: 662491 - DNA, 20 bp, mouse
gggtccaacttggccaaggt

SEQ ID NO: 662492 - DNA, 20 bp, mouse
gggaaagcggtgccaaaaga

SEQ ID NO: 662493 - DNA, 20 bp, mouse
ggcccgttgccggggaacgc

SEQ ID NO: 662494 - DNA, 20 bp, mouse
gaagaggtctcttcctgcta

SEQ ID NO: 662495 - DNA, 20 bp, mouse
ggaacgcaggcgccgtggga

SEQ ID NO: 662496 - DNA, 20 bp, mouse
gttgcccatccgtcctcaca

SEQ ID NO: 662497 - DNA, 20 bp, mouse
gagtccttgtgaggacggat

SEQ ID NO: 662498 - DNA, 20 bp, mouse
gtgaggaaacaaactcgttc

SEQ ID NO: 662499 - DNA, 20 bp, mouse
gtggaaagaagccagaaatc

SEQ ID NO: 662500 - DNA, 20 bp, mouse
gcctgcagctagttctgctg

SEQ ID NO: 662501 - DNA, 20 bp, mouse
gcagctagttctgctgtggt

SEQ ID NO: 662502 - DNA, 20 bp, mouse
gcctcacaaggactgcgaca

SEQ ID NO: 662503 - DNA, 20 bp, mouse
gcagcaagaaggtgggagat

SEQ ID NO: 662504 - DNA, 20 bp, mouse
gggtccctctgccacgtgga

SEQ ID NO: 662505 - DNA, 20 bp, mouse
gggcaatgctggcagcaaga

SEQ ID NO: 662506 - DNA, 20 bp, mouse
ggtaaatggcgctccagcaa

SEQ ID NO: 662507 - DNA, 20 bp, mouse
gctggctctgggacttacat

SEQ ID NO: 662508 - DNA, 20 bp, mouse
ggacggctgaaaggcgggtt

SEQ ID NO: 662509 - DNA, 20 bp, mouse
gctagcagctggagatttag

SEQ ID NO: 662510 - DNA, 20 bp, mouse
gccaagaggccaatccgaag

SEQ ID NO: 662511 - DNA, 20 bp, mouse
gtgtcgcaggagctggctct

SEQ ID NO: 662512 - DNA, 20 bp, mouse
gctagctgtataggtgtcgc

SEQ ID NO: 662513 - DNA, 20 bp, mouse
ggtcacgcccaggctccaag

SEQ ID NO: 662514 - DNA, 20 bp, mouse
gctccagctgctagctgtat

SEQ ID NO: 662515 - DNA, 20 bp, mouse
ggttcggtctgttacctctt

SEQ ID NO: 662516 - DNA, 20 bp, mouse
gcgaactggcggggaatcgg

SEQ ID NO: 662517 - DNA, 20 bp, mouse
ggcggagctactggtaaata

SEQ ID NO: 662518 - DNA, 20 bp, mouse
gaggggggaggcggagctac

SEQ ID NO: 662519 - DNA, 20 bp, mouse
gaagaaggggcggagctggc

SEQ ID NO: 662520 - DNA, 20 bp, mouse
gtggatggggcattgcctcc

SEQ ID NO: 662521 - DNA, 20 bp, mouse
ggagctactggtaaataggg

SEQ ID NO: 662522 - DNA, 20 bp, mouse
gctgcctggtacagggtgga

SEQ ID NO: 662523 - DNA, 20 bp, mouse
ggatggagaaggtcatgtag

SEQ ID NO: 662524 - DNA, 20 bp, mouse
ggaccacaggctatacaagt

SEQ ID NO: 662525 - DNA, 20 bp, mouse
gaatagggcgggtctgcatg

SEQ ID NO: 662526 - DNA, 20 bp, mouse
gccccagtgcaggcccagga

SEQ ID NO: 662527 - DNA, 20 bp, mouse
gccacccccagtgcaggccc

SEQ ID NO: 662528 - DNA, 20 bp, mouse
ggatacgggctaggagtccc

SEQ ID NO: 662529 - DNA, 20 bp, mouse
gagaagctgcgactgcccat

SEQ ID NO: 662530 - DNA, 20 bp, mouse
gaaaaagagtggacagtagg

SEQ ID NO: 662531 - DNA, 20 bp, mouse
ggtaaagagtgcagaaccgt

SEQ ID NO: 662532 - DNA, 20 bp, mouse
gactgagccagatacgggct

SEQ ID NO: 662533 - DNA, 20 bp, mouse
gagctcagtgcacccctgcg

SEQ ID NO: 662534 - DNA, 20 bp, mouse
gggagtccctggcagactac

SEQ ID NO: 662535 - DNA, 20 bp, mouse
gctgcgactgcccataggta

SEQ ID NO: 662536 - DNA, 20 bp, mouse
gcatctacccagcctcgggt

SEQ ID NO: 662537 - DNA, 20 bp, mouse
gcctgcacctaaccgacccg

SEQ ID NO: 662538 - DNA, 20 bp, mouse
gggggcgcgcggagaggcgt

SEQ ID NO: 662539 - DNA, 20 bp, mouse
ggctctctgcagcacgtcag

SEQ ID NO: 662540 - DNA, 20 bp, mouse
gtcgcggggccatgggagag

SEQ ID NO: 662541 - DNA, 20 bp, mouse
gtccaaaaatggcggctcga

SEQ ID NO: 662542 - DNA, 20 bp, mouse
gctggccggcgcccttcctc

SEQ ID NO: 662543 - DNA, 20 bp, mouse
gggtgctctgccctgcggcg

SEQ ID NO: 662544 - DNA, 20 bp, mouse
gagcgcgcgccaactgacag

SEQ ID NO: 662545 - DNA, 20 bp, mouse
gggggccgatttgaattcgc

SEQ ID NO: 662546 - DNA, 20 bp, mouse
gacctggggcaacaagcctt

SEQ ID NO: 662547 - DNA, 20 bp, mouse
gcctggtgcaggaacaggga

SEQ ID NO: 662548 - DNA, 20 bp, mouse
gggtaatggaaatgtgccta

SEQ ID NO: 662549 - DNA, 20 bp, mouse
gaagggtggcaggttcagga

SEQ ID NO: 662550 - DNA, 20 bp, mouse
gcccagctaagtgtgggagg

SEQ ID NO: 662551 - DNA, 20 bp, mouse
ggagcttgaaagtacctgct

SEQ ID NO: 662552 - DNA, 20 bp, mouse
gccagatgctgaacctgggc

SEQ ID NO: 662553 - DNA, 20 bp, mouse
gggtgtaaccaagtacaaca

SEQ ID NO: 662554 - DNA, 20 bp, mouse
gcccagtaacccagcacttc

SEQ ID NO: 662555 - DNA, 20 bp, mouse
gagtccctggtgcaggaaca

SEQ ID NO: 662556 - DNA, 20 bp, mouse
gaacgcgtggaggacggggt

SEQ ID NO: 662557 - DNA, 20 bp, mouse
gtctgctgacgtcacctcaa

SEQ ID NO: 662558 - DNA, 20 bp, mouse
ggctgggactcggacgaata

SEQ ID NO: 662559 - DNA, 20 bp, mouse
gagcacgcaggcgcgagcgc

SEQ ID NO: 662560 - DNA, 20 bp, mouse
gcgcctgcgtgctcgggctt

SEQ ID NO: 662561 - DNA, 20 bp, mouse
ggggtgaggccggaaaatac

SEQ ID NO: 662562 - DNA, 20 bp, mouse
gaacgcccagcggaggcagt

SEQ ID NO: 662563 - DNA, 20 bp, mouse
gcagcggaggcagtggggca

SEQ ID NO: 662564 - DNA, 20 bp, mouse
gttccggcctcaccctgcaa

SEQ ID NO: 662565 - DNA, 20 bp, mouse
gaaggcaaacgtggcgtcat

SEQ ID NO: 662566 - DNA, 20 bp, mouse
gtacaagcgtgggaagggga

SEQ ID NO: 662567 - DNA, 20 bp, mouse
gcacatacaagcgtgggaag

SEQ ID NO: 662568 - DNA, 20 bp, mouse
gcccgctaaattgcagggag

SEQ ID NO: 662569 - DNA, 20 bp, mouse
ggaaagtcacatacaagcgt

SEQ ID NO: 662570 - DNA, 20 bp, mouse
gttagcgggatgggacgttc

SEQ ID NO: 662571 - DNA, 20 bp, mouse
gtaaattgcagggagaggcg

SEQ ID NO: 662572 - DNA, 20 bp, mouse
gcaccggattgattaacttc

SEQ ID NO: 662573 - DNA, 20 bp, mouse
gcccatcccgctaaattgca

SEQ ID NO: 662574 - DNA, 20 bp, mouse
gaaaagtatttcaaataaca

SEQ ID NO: 662575 - DNA, 20 bp, mouse
ggtatttcaaataacacgga

SEQ ID NO: 662576 - DNA, 20 bp, mouse
gcggccgcacccgactctga

SEQ ID NO: 662577 - DNA, 20 bp, mouse
gcggggaggcgggtctgcgg

SEQ ID NO: 662578 - DNA, 20 bp, mouse
ggaggcggggcgagactggg

SEQ ID NO: 662579 - DNA, 20 bp, mouse
gagtggaggtcgggcggctg

SEQ ID NO: 662580 - DNA, 20 bp, mouse
gccgcgggcgagtggaggtc

SEQ ID NO: 662581 - DNA, 20 bp, mouse
gggcgggtgctcgcaggccg

SEQ ID NO: 662582 - DNA, 20 bp, mouse
ggggccgggctgcgggtccg

SEQ ID NO: 662583 - DNA, 20 bp, mouse
ggcaggccgcgggcgagtgg

SEQ ID NO: 662584 - DNA, 20 bp, mouse
gggcgcttttatgtgtcggg

SEQ ID NO: 662585 - DNA, 20 bp, mouse
gcggacagtcccagtgtcgg

SEQ ID NO: 662586 - DNA, 20 bp, mouse
ggaacagaaaaggacctggg

SEQ ID NO: 662587 - DNA, 20 bp, mouse
ggcggcgcacggcggaagtg

SEQ ID NO: 662588 - DNA, 20 bp, mouse
ggcgcacggcggaagtgcgg

SEQ ID NO: 662589 - DNA, 20 bp, mouse
gcagttcagccccagcctaa

SEQ ID NO: 662590 - DNA, 20 bp, mouse
gggggctgaactgggttata

SEQ ID NO: 662591 - DNA, 20 bp, mouse
gcagcaggatccagcaaacc

SEQ ID NO: 662592 - DNA, 20 bp, mouse
gggaaggagcccaggcggca

SEQ ID NO: 662593 - DNA, 20 bp, mouse
gttcagccccagcctaaagg

SEQ ID NO: 662594 - DNA, 20 bp, mouse
ggggccggaagtgcggcgca

SEQ ID NO: 662595 - DNA, 20 bp, mouse
gacggcggaagtgcggcggg

SEQ ID NO: 662596 - DNA, 20 bp, mouse
gggtctgggtcaggtgtccg

SEQ ID NO: 662597 - DNA, 20 bp, mouse
gtctgctgctggtctgggtc

SEQ ID NO: 662598 - DNA, 20 bp, mouse
gaccagcagcagagtcctgc

SEQ ID NO: 662599 - DNA, 20 bp, mouse
gtatctgggagtcagtctaa

SEQ ID NO: 662600 - DNA, 20 bp, mouse
gagggagatcggccagagct

SEQ ID NO: 662601 - DNA, 20 bp, mouse
gaggaagaagctaccatcct

SEQ ID NO: 662602 - DNA, 20 bp, mouse
ggtccgaggtctgctcagga

SEQ ID NO: 662603 - DNA, 20 bp, mouse
gctctggccgatctccctct

SEQ ID NO: 662604 - DNA, 20 bp, mouse
gcccagataagcagaccaag

SEQ ID NO: 662605 - DNA, 20 bp, mouse
ggccagcaggactctgctgc

SEQ ID NO: 662606 - DNA, 20 bp, mouse
gccccgccgcagtccccctt

SEQ ID NO: 662607 - DNA, 20 bp, mouse
gtgggactgcagtcggtgat

SEQ ID NO: 662608 - DNA, 20 bp, mouse
ggccaggcgcaagaggggtg

SEQ ID NO: 662609 - DNA, 20 bp, mouse
gcccaggccgaggaaggccc

SEQ ID NO: 662610 - DNA, 20 bp, mouse
gcgccaaagggggactgcgg

SEQ ID NO: 662611 - DNA, 20 bp, mouse
gcccccacccccagcttcgg

SEQ ID NO: 662612 - DNA, 20 bp, mouse
gacctccagccgaaacctcg

SEQ ID NO: 662613 - DNA, 20 bp, mouse
gaccccagcgcctggaaccc

SEQ ID NO: 662614 - DNA, 20 bp, mouse
gtcgcggcctctccgccaaa

SEQ ID NO: 662615 - DNA, 20 bp, mouse
gaagctgccaggcgcaagag

SEQ ID NO: 662616 - DNA, 20 bp, mouse
ggacagaggagggcgggtgg

SEQ ID NO: 662617 - DNA, 20 bp, mouse
gcgggtggaggaggccgatc

SEQ ID NO: 662618 - DNA, 20 bp, mouse
ggactgctatctgactgcac

SEQ ID NO: 662619 - DNA, 20 bp, mouse
gtacgccggctaagtttaag

SEQ ID NO: 662620 - DNA, 20 bp, mouse
gccctgggtaaagggaactc

SEQ ID NO: 662621 - DNA, 20 bp, mouse
gtatgtacacacaaatgggg

SEQ ID NO: 662622 - DNA, 20 bp, mouse
gatctcgtagctaaggtgac

SEQ ID NO: 662623 - DNA, 20 bp, mouse
gaagtttaagaggtgactca

SEQ ID NO: 662624 - DNA, 20 bp, mouse
gtaaggtgacaggttcctgc

SEQ ID NO: 662625 - DNA, 20 bp, mouse
gtggaactggaacctaatgt

SEQ ID NO: 662626 - DNA, 20 bp, mouse
gaggggaagtccctggtact

SEQ ID NO: 662627 - DNA, 20 bp, mouse
gaatatgaggccatcgactg

SEQ ID NO: 662628 - DNA, 20 bp, mouse
gaagcaccagatcaattttg

SEQ ID NO: 662629 - DNA, 20 bp, mouse
gttcccggctcatggggcaa

SEQ ID NO: 662630 - DNA, 20 bp, mouse
gggctcatggggcaaaggga

SEQ ID NO: 662631 - DNA, 20 bp, mouse
gctgtgtgaagcccaacttg

SEQ ID NO: 662632 - DNA, 20 bp, mouse
gcttggccccaaaattgatc

SEQ ID NO: 662633 - DNA, 20 bp, mouse
ggaatgggttccccagtcga

SEQ ID NO: 662634 - DNA, 20 bp, mouse
gtacactctcaccccagaca

SEQ ID NO: 662635 - DNA, 20 bp, mouse
gtagagccataccaagcaga

SEQ ID NO: 662636 - DNA, 20 bp, mouse
gcaggactgcagacccactc

SEQ ID NO: 662637 - DNA, 20 bp, mouse
gcagacccactcagggacgt

SEQ ID NO: 662638 - DNA, 20 bp, mouse
gccaagtccccttctaactt

SEQ ID NO: 662639 - DNA, 20 bp, mouse
ggggtctgaactccaactca

SEQ ID NO: 662640 - DNA, 20 bp, mouse
ggagacagtctcctctgtcc

SEQ ID NO: 662641 - DNA, 20 bp, mouse
gcagttgagtatgacggaca

SEQ ID NO: 662642 - DNA, 20 bp, mouse
gagatccaacgtccctgagt

SEQ ID NO: 662643 - DNA, 20 bp, mouse
gcagcctaggaaccttgagt

SEQ ID NO: 662644 - DNA, 20 bp, mouse
gccttctaacttaggggaaa

SEQ ID NO: 662645 - DNA, 20 bp, mouse
gtagtctgttaatcattcac

SEQ ID NO: 662646 - DNA, 20 bp, mouse
gaagtggcacagatctaaac

SEQ ID NO: 662647 - DNA, 20 bp, mouse
gaatacacccggggcgtggg

SEQ ID NO: 662648 - DNA, 20 bp, mouse
gggggcgggaagaaacccac

SEQ ID NO: 662649 - DNA, 20 bp, mouse
gccacttcataagtactagt

SEQ ID NO: 662650 - DNA, 20 bp, mouse
gtccaagttctccctgtgaa

SEQ ID NO: 662651 - DNA, 20 bp, mouse
gaaacccacaggcaagccat

SEQ ID NO: 662652 - DNA, 20 bp, mouse
gcacaggcaagccattggac

SEQ ID NO: 662653 - DNA, 20 bp, mouse
gaagaatacacccggggcgt

SEQ ID NO: 662654 - DNA, 20 bp, mouse
gacagggagaacttggagca

SEQ ID NO: 662655 - DNA, 20 bp, mouse
gtgcttgaagaatacacccg

SEQ ID NO: 662656 - DNA, 20 bp, mouse
ggagccggttctgtggacca

SEQ ID NO: 662657 - DNA, 20 bp, mouse
ggaaccggctccattgtttt

SEQ ID NO: 662658 - DNA, 20 bp, mouse
gaacaatggagccggttctg

SEQ ID NO: 662659 - DNA, 20 bp, mouse
gtctccaggcaagtgtcagt

SEQ ID NO: 662660 - DNA, 20 bp, mouse
gccattacagagggcagagg

SEQ ID NO: 662661 - DNA, 20 bp, mouse
gggttcggacctgaaggctg

SEQ ID NO: 662662 - DNA, 20 bp, mouse
gcagcagataaatacctttg

SEQ ID NO: 662663 - DNA, 20 bp, mouse
gaaccctagctgtgacctca

SEQ ID NO: 662664 - DNA, 20 bp, mouse
gactccattacagagggcag

SEQ ID NO: 662665 - DNA, 20 bp, mouse
gaataccattccctgaccca

SEQ ID NO: 662666 - DNA, 20 bp, mouse
ggcgagaaaggcatccgcgg

SEQ ID NO: 662667 - DNA, 20 bp, mouse
gacctagctgagtccaagag

SEQ ID NO: 662668 - DNA, 20 bp, mouse
gctggcgagaaaggcatccg

SEQ ID NO: 662669 - DNA, 20 bp, mouse
gagaaaggcatccgcggagg

SEQ ID NO: 662670 - DNA, 20 bp, mouse
ggcggaggtggcagtcagtg

SEQ ID NO: 662671 - DNA, 20 bp, mouse
ggggtgggtgggtgcacaat

SEQ ID NO: 662672 - DNA, 20 bp, mouse
gcagtcagtgaggtccacat

SEQ ID NO: 662673 - DNA, 20 bp, mouse
gagctgagtccaagaggggc

SEQ ID NO: 662674 - DNA, 20 bp, mouse
gcaggaaagcaaagggccga

SEQ ID NO: 662675 - DNA, 20 bp, mouse
ggggggccaggccggtgtac

SEQ ID NO: 662676 - DNA, 20 bp, mouse
gcaggggagagatgtcaact

SEQ ID NO: 662677 - DNA, 20 bp, mouse
ggggtgtactgggtaagcac

SEQ ID NO: 662678 - DNA, 20 bp, mouse
gctggctggttggtactggg

SEQ ID NO: 662679 - DNA, 20 bp, mouse
gtcactgaccatcctagctg

SEQ ID NO: 662680 - DNA, 20 bp, mouse
ggagggagcctcagctagga

SEQ ID NO: 662681 - DNA, 20 bp, mouse
gaagtctctggccccagaag

SEQ ID NO: 662682 - DNA, 20 bp, mouse
gctgggtaagcaccggtgga

SEQ ID NO: 662683 - DNA, 20 bp, mouse
ggtctcctggaggtgctcat

SEQ ID NO: 662684 - DNA, 20 bp, mouse
gtcccctggctggttggtac

SEQ ID NO: 662685 - DNA, 20 bp, mouse
gtgtactgggtaagcaccgg

SEQ ID NO: 662686 - DNA, 20 bp, mouse
gtatgtcaacagggttggaa

SEQ ID NO: 662687 - DNA, 20 bp, mouse
gcaggggattgccaaatgtg

SEQ ID NO: 662688 - DNA, 20 bp, mouse
gggaatctgcttatgtcaac

SEQ ID NO: 662689 - DNA, 20 bp, mouse
gctgggagtcacctggggtg

SEQ ID NO: 662690 - DNA, 20 bp, mouse
ggttgagagacccccacccc

SEQ ID NO: 662691 - DNA, 20 bp, mouse
gaggaagtgggctgagagct

SEQ ID NO: 662692 - DNA, 20 bp, mouse
gccccaggtgactcccaggc

SEQ ID NO: 662693 - DNA, 20 bp, mouse
gaaggaattggacatacagc

SEQ ID NO: 662694 - DNA, 20 bp, mouse
gtgcttaaccctgacctgcc

SEQ ID NO: 662695 - DNA, 20 bp, mouse
gtgacataagcagattccac

SEQ ID NO: 662696 - DNA, 20 bp, mouse
gctaagtatagcagtttcta

SEQ ID NO: 662697 - DNA, 20 bp, mouse
gcggggttttggcaatcatg

SEQ ID NO: 662698 - DNA, 20 bp, mouse
gtagaagaagacctatgcac

SEQ ID NO: 662699 - DNA, 20 bp, mouse
ggggcttccaaggtattgac

SEQ ID NO: 662700 - DNA, 20 bp, mouse
gtacagtcccaaaaccctaa

SEQ ID NO: 662701 - DNA, 20 bp, mouse
gagaggtaattctagagata

SEQ ID NO: 662702 - DNA, 20 bp, mouse
gtctcactccacaggacaag

SEQ ID NO: 662703 - DNA, 20 bp, mouse
gattgcaacaactctcaatg

SEQ ID NO: 662704 - DNA, 20 bp, mouse
gcaggcccctgtcaatacct

SEQ ID NO: 662705 - DNA, 20 bp, mouse
gtgagtgtaacagaacagaa

SEQ ID NO: 662706 - DNA, 20 bp, mouse
gaggctctgactactgtaga

SEQ ID NO: 662707 - DNA, 20 bp, mouse
ggggacctagctggaaccgc

SEQ ID NO: 662708 - DNA, 20 bp, mouse
gccgcaggaccaacttctaa

SEQ ID NO: 662709 - DNA, 20 bp, mouse
ggaggagcgttgagcctgga

SEQ ID NO: 662710 - DNA, 20 bp, mouse
ggatgggggacgagcctgag

SEQ ID NO: 662711 - DNA, 20 bp, mouse
ggttgagcctggatggagcg

SEQ ID NO: 662712 - DNA, 20 bp, mouse
gtactgtagagggacctagc

SEQ ID NO: 662713 - DNA, 20 bp, mouse
gtagagggcggggtctgaca

SEQ ID NO: 662714 - DNA, 20 bp, mouse
gaggaccaacttctaaggga

SEQ ID NO: 662715 - DNA, 20 bp, mouse
gaacttctaagggaggggag

SEQ ID NO: 662716 - DNA, 20 bp, mouse
ggaaacgaacagatagagag

SEQ ID NO: 662717 - DNA, 20 bp, mouse
gggcagcgaccctgactgag

SEQ ID NO: 662718 - DNA, 20 bp, mouse
gtgacagctccgctcagtca

SEQ ID NO: 662719 - DNA, 20 bp, mouse
gctgaagaggggcaacacgg

SEQ ID NO: 662720 - DNA, 20 bp, mouse
gaactgagatgcttattgaa

SEQ ID NO: 662721 - DNA, 20 bp, mouse
ggaggactgcagttgaaact

SEQ ID NO: 662722 - DNA, 20 bp, mouse
ggccctgaagaggggcaaca

SEQ ID NO: 662723 - DNA, 20 bp, mouse
ggctgtcaacgagtctattt

SEQ ID NO: 662724 - DNA, 20 bp, mouse
gcagccttgtaagaaacggc

SEQ ID NO: 662725 - DNA, 20 bp, mouse
gctaccggccgtttcttaca

SEQ ID NO: 662726 - DNA, 20 bp, mouse
gtaaacaagctggcaggaac

SEQ ID NO: 662727 - DNA, 20 bp, mouse
gtgcagaataaggtcacgtg

SEQ ID NO: 662728 - DNA, 20 bp, mouse
gtcacgtgcggcccctcctg

SEQ ID NO: 662729 - DNA, 20 bp, mouse
ggctgtaggagttcccagag

SEQ ID NO: 662730 - DNA, 20 bp, mouse
gaactcctacagcgatacgc

SEQ ID NO: 662731 - DNA, 20 bp, mouse
gaaacagtaaacaagctggc

SEQ ID NO: 662732 - DNA, 20 bp, mouse
gcttgactgagaataaagga

SEQ ID NO: 662733 - DNA, 20 bp, mouse
ggggtgcagtagtgcccctc

SEQ ID NO: 662734 - DNA, 20 bp, mouse
gtgcccttgactgagaataa

SEQ ID NO: 662735 - DNA, 20 bp, mouse
gaaaactttaaccacaggag

SEQ ID NO: 662736 - DNA, 20 bp, mouse
ggcaaccagctgggaccatt

SEQ ID NO: 662737 - DNA, 20 bp, mouse
gaaaggagactgtaacataa

SEQ ID NO: 662738 - DNA, 20 bp, mouse
ggtaactgataaaatgcatc

SEQ ID NO: 662739 - DNA, 20 bp, mouse
ggaaatcacagatatgtttc

SEQ ID NO: 662740 - DNA, 20 bp, mouse
gccaagtgataccttgtgtc

SEQ ID NO: 662741 - DNA, 20 bp, mouse
ggacctttgctgcaaccagc

SEQ ID NO: 662742 - DNA, 20 bp, mouse
ggtagattaaagtagtaaaa

SEQ ID NO: 662743 - DNA, 20 bp, mouse
gcatatctgtgatttccaaa

SEQ ID NO: 662744 - DNA, 20 bp, mouse
gaactctcatagatattatg

SEQ ID NO: 662745 - DNA, 20 bp, mouse
gtaaaatgcatctggcatca

SEQ ID NO: 662746 - DNA, 20 bp, mouse
gcgaactgggagtgtcccca

SEQ ID NO: 662747 - DNA, 20 bp, mouse
gtactcccggcaccactgat

SEQ ID NO: 662748 - DNA, 20 bp, mouse
gaggtcaggggtcagccctg

SEQ ID NO: 662749 - DNA, 20 bp, mouse
gaggacctcccaagtcccga

SEQ ID NO: 662750 - DNA, 20 bp, mouse
gcactgacggcgaccgaact

SEQ ID NO: 662751 - DNA, 20 bp, mouse
gggctgacccctgacctcac

SEQ ID NO: 662752 - DNA, 20 bp, mouse
gcccccccgcgtagcactga

SEQ ID NO: 662753 - DNA, 20 bp, mouse
ggcagcgccgagcctatcag

SEQ ID NO: 662754 - DNA, 20 bp, mouse
gcgcgccgccgattggggat

SEQ ID NO: 662755 - DNA, 20 bp, mouse
gggtgccgggagtacctggg

SEQ ID NO: 662756 - DNA, 20 bp, mouse
gcccgccggccttgccccga

SEQ ID NO: 662757 - DNA, 20 bp, mouse
gaggtccggctgcagagtag

SEQ ID NO: 662758 - DNA, 20 bp, mouse
gagggtgttcgggattcgta

SEQ ID NO: 662759 - DNA, 20 bp, mouse
gctcgccctcggggcaaggc

SEQ ID NO: 662760 - DNA, 20 bp, mouse
gcagccggacctcgccctcg

SEQ ID NO: 662761 - DNA, 20 bp, mouse
gttgccccgagggcgaggtc

SEQ ID NO: 662762 - DNA, 20 bp, mouse
ggccctcggggcaaggccgg

SEQ ID NO: 662763 - DNA, 20 bp, mouse
gagaccctcgaggatcaagg

SEQ ID NO: 662764 - DNA, 20 bp, mouse
ggcgggcggggctcgagcgg

SEQ ID NO: 662765 - DNA, 20 bp, mouse
ggagacaccgggtgatccaa

SEQ ID NO: 662766 - DNA, 20 bp, mouse
gggtctccctggtctctcgg

SEQ ID NO: 662767 - DNA, 20 bp, mouse
gccacccctccgagagacca

SEQ ID NO: 662768 - DNA, 20 bp, mouse
ggccctgagcgctctgggta

SEQ ID NO: 662769 - DNA, 20 bp, mouse
gcccagctgcctgaatctca

SEQ ID NO: 662770 - DNA, 20 bp, mouse
ggtctctcggaggggtggag

SEQ ID NO: 662771 - DNA, 20 bp, mouse
gcagagcgctcagggcgggg

SEQ ID NO: 662772 - DNA, 20 bp, mouse
gagccctacccagagcgctc

SEQ ID NO: 662773 - DNA, 20 bp, mouse
gccacccccggcatgaccat

SEQ ID NO: 662774 - DNA, 20 bp, mouse
gggtagggctcagatggtcc

SEQ ID NO: 662775 - DNA, 20 bp, mouse
gggcgcccccagccccagtc

SEQ ID NO: 662776 - DNA, 20 bp, mouse
gcagaaaggtgcccagagtg

SEQ ID NO: 662777 - DNA, 20 bp, mouse
ggcaggggcaatagcgatgg

SEQ ID NO: 662778 - DNA, 20 bp, mouse
ggagcaggcagagcccgcag

SEQ ID NO: 662779 - DNA, 20 bp, mouse
gtctgggcacctttctgaat

SEQ ID NO: 662780 - DNA, 20 bp, mouse
gtgagccaagcagcccaggg

SEQ ID NO: 662781 - DNA, 20 bp, mouse
gtgcctctgcccattcagaa

SEQ ID NO: 662782 - DNA, 20 bp, mouse
gctctgagccaagcagccca

SEQ ID NO: 662783 - DNA, 20 bp, mouse
ggcccagagtggggctgcct

SEQ ID NO: 662784 - DNA, 20 bp, mouse
gatggcaggggcaatagcga

SEQ ID NO: 662785 - DNA, 20 bp, mouse
ggcagcccagggaggagaag

SEQ ID NO: 662786 - DNA, 20 bp, mouse
ggctacgcgatgtttctcgg

SEQ ID NO: 662787 - DNA, 20 bp, mouse
gccccacaggatcttctcta

SEQ ID NO: 662788 - DNA, 20 bp, mouse
gcaagcctggcgcgccggag

SEQ ID NO: 662789 - DNA, 20 bp, mouse
ggtttctcgggggtcctctg

SEQ ID NO: 662790 - DNA, 20 bp, mouse
gctggcgcgccggagaggtg

SEQ ID NO: 662791 - DNA, 20 bp, mouse
ggtgtccaggaccacgtcct

SEQ ID NO: 662792 - DNA, 20 bp, mouse
gtccctagagaagatcctgt

SEQ ID NO: 662793 - DNA, 20 bp, mouse
ggagaagatcctgtggggtt

SEQ ID NO: 662794 - DNA, 20 bp, mouse
gactgtgaacgcatccattt

SEQ ID NO: 662795 - DNA, 20 bp, mouse
ggtcctcggcatcgcacacg

SEQ ID NO: 662796 - DNA, 20 bp, mouse
ggtgttgatgccttaagatc

SEQ ID NO: 662797 - DNA, 20 bp, mouse
ggggggggatattctcttgg

SEQ ID NO: 662798 - DNA, 20 bp, mouse
ggaggtggaaatgcagatat

SEQ ID NO: 662799 - DNA, 20 bp, mouse
gtacttaaaggcactgaata

SEQ ID NO: 662800 - DNA, 20 bp, mouse
gtgtagaaaacagttggggt

SEQ ID NO: 662801 - DNA, 20 bp, mouse
gtgcagaacacctgatctta

SEQ ID NO: 662802 - DNA, 20 bp, mouse
ggagaaccctagatacgttg

SEQ ID NO: 662803 - DNA, 20 bp, mouse
gggggatattctcttggggg

SEQ ID NO: 662804 - DNA, 20 bp, mouse
gtgactctgtgaagctcttt

SEQ ID NO: 662805 - DNA, 20 bp, mouse
gagctggccccaggtcttaa

SEQ ID NO: 662806 - DNA, 20 bp, mouse
gtttataggtgttgttttat

SEQ ID NO: 662807 - DNA, 20 bp, mouse
gttcgttttgtttagtttat

SEQ ID NO: 662808 - DNA, 20 bp, mouse
gttccctttgagattagagt

SEQ ID NO: 662809 - DNA, 20 bp, mouse
gaaaccaactctaatctcaa

SEQ ID NO: 662810 - DNA, 20 bp, mouse
gatgttctgaaaaaagattt

SEQ ID NO: 662811 - DNA, 20 bp, mouse
gctgcgatttttttaactag

SEQ ID NO: 662812 - DNA, 20 bp, mouse
gcgatttttttaactagagg

SEQ ID NO: 662813 - DNA, 20 bp, mouse
gcttgaaaacacatatacac

SEQ ID NO: 662814 - DNA, 20 bp, mouse
gctttattctggtgccaaat

SEQ ID NO: 662815 - DNA, 20 bp, mouse
ggaacatgactactcctatt

SEQ ID NO: 662816 - DNA, 20 bp, mouse
gcaccggcggagcacggctt

SEQ ID NO: 662817 - DNA, 20 bp, mouse
gtgttcggggaactgcgtgt

SEQ ID NO: 662818 - DNA, 20 bp, mouse
ggcggagcacggcttagggt

SEQ ID NO: 662819 - DNA, 20 bp, mouse
ggggagaggccaagcaccgg

SEQ ID NO: 662820 - DNA, 20 bp, mouse
ggcaactctaggaatctcgt

SEQ ID NO: 662821 - DNA, 20 bp, mouse
gcagaggcggaaaaagtgtt

SEQ ID NO: 662822 - DNA, 20 bp, mouse
gggaagtgggcgttttgcgc

SEQ ID NO: 662823 - DNA, 20 bp, mouse
gaggagaagagacgcggcga

SEQ ID NO: 662824 - DNA, 20 bp, mouse
gaccaccgggaagcccttgc

SEQ ID NO: 662825 - DNA, 20 bp, mouse
gtccgctgaagtggcaccat

SEQ ID NO: 662826 - DNA, 20 bp, mouse
gttggatgatgtaggttaat

SEQ ID NO: 662827 - DNA, 20 bp, mouse
ggactacctggctgcacatc

SEQ ID NO: 662828 - DNA, 20 bp, mouse
gatgtccttgactatccatc

SEQ ID NO: 662829 - DNA, 20 bp, mouse
gcatttaagccaagtggttc

SEQ ID NO: 662830 - DNA, 20 bp, mouse
gttgaccagatggatagtca

SEQ ID NO: 662831 - DNA, 20 bp, mouse
gacaatccggatgtgcagcc

SEQ ID NO: 662832 - DNA, 20 bp, mouse
ggtttcagggtgtacgtaca

SEQ ID NO: 662833 - DNA, 20 bp, mouse
gacaaggtcctgtgggatac

SEQ ID NO: 662834 - DNA, 20 bp, mouse
gaaagcagaaccatggtggt

SEQ ID NO: 662835 - DNA, 20 bp, mouse
gggaagaatttttgaccaga

SEQ ID NO: 662836 - DNA, 20 bp, mouse
gagatgatgaccattatctt

SEQ ID NO: 662837 - DNA, 20 bp, mouse
gtctctgagttcaagactgc

SEQ ID NO: 662838 - DNA, 20 bp, mouse
gttaaagtccacacccacaa

SEQ ID NO: 662839 - DNA, 20 bp, mouse
gtaaagaaagttcgctacaa

SEQ ID NO: 662840 - DNA, 20 bp, mouse
gtagcgaactttctttattt

SEQ ID NO: 662841 - DNA, 20 bp, mouse
gagaagttgaagtaccattg

SEQ ID NO: 662842 - DNA, 20 bp, mouse
gtaatgtgagtaagggcata

SEQ ID NO: 662843 - DNA, 20 bp, mouse
gcttctacaaggtaagtcat

SEQ ID NO: 662844 - DNA, 20 bp, mouse
ggtgaatggagacacaatga

SEQ ID NO: 662845 - DNA, 20 bp, mouse
gttaaatagtgtaggtaaat

SEQ ID NO: 662846 - DNA, 20 bp, mouse
gtatccacatggctaaggaa

SEQ ID NO: 662847 - DNA, 20 bp, mouse
gtaaaagggctaaagggctt

SEQ ID NO: 662848 - DNA, 20 bp, mouse
gggagccactacaagacacc

SEQ ID NO: 662849 - DNA, 20 bp, mouse
gtagccaaacgccttcaaaa

SEQ ID NO: 662850 - DNA, 20 bp, mouse
ggcaaggcataaggctcatt

SEQ ID NO: 662851 - DNA, 20 bp, mouse
ggcatcctggtgtcttgtag

SEQ ID NO: 662852 - DNA, 20 bp, mouse
gcccagcctggatatatcta

SEQ ID NO: 662853 - DNA, 20 bp, mouse
ggggccattttgaaggcgtt

SEQ ID NO: 662854 - DNA, 20 bp, mouse
ggggcttggggccattttga

SEQ ID NO: 662855 - DNA, 20 bp, mouse
gaagagagtagcaaggcata

SEQ ID NO: 662856 - DNA, 20 bp, mouse
ggcaaggcctgaagacagat

SEQ ID NO: 662857 - DNA, 20 bp, mouse
gagagggggggattggtatg

SEQ ID NO: 662858 - DNA, 20 bp, mouse
ggacccctgcagcacaaccc

SEQ ID NO: 662859 - DNA, 20 bp, mouse
gccctctaaccctgagcatt

SEQ ID NO: 662860 - DNA, 20 bp, mouse
gagtgagaactgtgattcca

SEQ ID NO: 662861 - DNA, 20 bp, mouse
gcagccttacctgagtactt

SEQ ID NO: 662862 - DNA, 20 bp, mouse
gcaggtaaagtagtgagtgc

SEQ ID NO: 662863 - DNA, 20 bp, mouse
ggttgtgctgcaggggtcag

SEQ ID NO: 662864 - DNA, 20 bp, mouse
gactgtggtgtctaagtcct

SEQ ID NO: 662865 - DNA, 20 bp, mouse
gagggttagagggttaatac

SEQ ID NO: 662866 - DNA, 20 bp, mouse
ggggttaggggttcagtaat

SEQ ID NO: 662867 - DNA, 20 bp, mouse
gtcaaggctaggttctagga

SEQ ID NO: 662868 - DNA, 20 bp, mouse
ggaacccctaacccaagcca

SEQ ID NO: 662869 - DNA, 20 bp, mouse
gtgaccacaagtggaaatag

SEQ ID NO: 662870 - DNA, 20 bp, mouse
gagtggaaataggggtgcag

SEQ ID NO: 662871 - DNA, 20 bp, mouse
gtggaccctggcttgggtta

SEQ ID NO: 662872 - DNA, 20 bp, mouse
gcccagctcctatcaaggct

SEQ ID NO: 662873 - DNA, 20 bp, mouse
gcaatgcccagctcctatca

SEQ ID NO: 662874 - DNA, 20 bp, mouse
gcgcaggcgcaagacgggga

SEQ ID NO: 662875 - DNA, 20 bp, mouse
gcctatcaaggctaggttct

SEQ ID NO: 662876 - DNA, 20 bp, mouse
ggtggggaaaaattaggagc

SEQ ID NO: 662877 - DNA, 20 bp, mouse
gcctctgaaagtcagatatg

SEQ ID NO: 662878 - DNA, 20 bp, mouse
gacaatgaaagatgaggcat

SEQ ID NO: 662879 - DNA, 20 bp, mouse
gaagagagaggtataatttg

SEQ ID NO: 662880 - DNA, 20 bp, mouse
gaatttgtgggagagaccta

SEQ ID NO: 662881 - DNA, 20 bp, mouse
gtcccttccagagtctccca

SEQ ID NO: 662882 - DNA, 20 bp, mouse
gtcccaaggaaagaactgct

SEQ ID NO: 662883 - DNA, 20 bp, mouse
gacaatgactctccattggt

SEQ ID NO: 662884 - DNA, 20 bp, mouse
gttccttgggagactctgga

SEQ ID NO: 662885 - DNA, 20 bp, mouse
ggggttttgttcataggtgt

SEQ ID NO: 662886 - DNA, 20 bp, mouse
gcccaggtagggagctcgag

SEQ ID NO: 662887 - DNA, 20 bp, mouse
ggtagggagctcgaggggtg

SEQ ID NO: 662888 - DNA, 20 bp, mouse
ggcaaagcgagtatggcggg

SEQ ID NO: 662889 - DNA, 20 bp, mouse
ggggagggcaagatttcgcg

SEQ ID NO: 662890 - DNA, 20 bp, mouse
gacccggagtccgaattcag

SEQ ID NO: 662891 - DNA, 20 bp, mouse
gaattcagaggccccaggta

SEQ ID NO: 662892 - DNA, 20 bp, mouse
gagctgcaaagcgagtatgg

SEQ ID NO: 662893 - DNA, 20 bp, mouse
gaagctacggagtcccgcga

SEQ ID NO: 662894 - DNA, 20 bp, mouse
ggggaggaagctacgctgca

SEQ ID NO: 662895 - DNA, 20 bp, mouse
gggcctctgaattcggactc

SEQ ID NO: 662896 - DNA, 20 bp, mouse
gctgggaggagcatcatgcc

SEQ ID NO: 662897 - DNA, 20 bp, mouse
gggaggagcatcatgcctgg

SEQ ID NO: 662898 - DNA, 20 bp, mouse
gtaggcagatgtccatgcag

SEQ ID NO: 662899 - DNA, 20 bp, mouse
gagcatcatgcctgggggca

SEQ ID NO: 662900 - DNA, 20 bp, mouse
gcatgcctgggggcaaggag

SEQ ID NO: 662901 - DNA, 20 bp, mouse
gccacaggggaagtgtgtct

SEQ ID NO: 662902 - DNA, 20 bp, mouse
gagtgctcaaggctactgct

SEQ ID NO: 662903 - DNA, 20 bp, mouse
gccaatcacagaaaaggagg

SEQ ID NO: 662904 - DNA, 20 bp, mouse
ggctccaatcacagaaaagg

SEQ ID NO: 662905 - DNA, 20 bp, mouse
ggtggggtggtctgctatgt

SEQ ID NO: 662906 - DNA, 20 bp, mouse
ggccctgaaaggtgtcacag

SEQ ID NO: 662907 - DNA, 20 bp, mouse
gcacaggggtgtcacaactg

SEQ ID NO: 662908 - DNA, 20 bp, mouse
gaacgactggaggggaggac

SEQ ID NO: 662909 - DNA, 20 bp, mouse
gccaccagaagggcaggata

SEQ ID NO: 662910 - DNA, 20 bp, mouse
gtggcttggcaggctagaat

SEQ ID NO: 662911 - DNA, 20 bp, mouse
gctagaatgggctgattccc

SEQ ID NO: 662912 - DNA, 20 bp, mouse
ggtcacaactggggagtgct

SEQ ID NO: 662913 - DNA, 20 bp, mouse
gggcgggcagaatgacatct

SEQ ID NO: 662914 - DNA, 20 bp, mouse
ggggcctgggactcctttca

SEQ ID NO: 662915 - DNA, 20 bp, mouse
gacatctgggaacgactgga

SEQ ID NO: 662916 - DNA, 20 bp, mouse
gcaggctcgaagaaactctg

SEQ ID NO: 662917 - DNA, 20 bp, mouse
gcatcctggcagcatcactt

SEQ ID NO: 662918 - DNA, 20 bp, mouse
gtaaagaaatgctgagtaag

SEQ ID NO: 662919 - DNA, 20 bp, mouse
gcctcagtgccccagatact

SEQ ID NO: 662920 - DNA, 20 bp, mouse
gcatctgataataacactcc

SEQ ID NO: 662921 - DNA, 20 bp, mouse
ggtaagtggagctgttgacc

SEQ ID NO: 662922 - DNA, 20 bp, mouse
gtgttattatcagatgagag

SEQ ID NO: 662923 - DNA, 20 bp, mouse
gaatacacttggagttgctc

SEQ ID NO: 662924 - DNA, 20 bp, mouse
gcatcacttgggacatcacc

SEQ ID NO: 662925 - DNA, 20 bp, mouse
gtgggacatcaccaggataa

SEQ ID NO: 662926 - DNA, 20 bp, mouse
gaggttgtctggagtttaaa

SEQ ID NO: 662927 - DNA, 20 bp, mouse
gaaaaagcaaacagatccgt

SEQ ID NO: 662928 - DNA, 20 bp, mouse
gaatcaaacgagggaatcga

SEQ ID NO: 662929 - DNA, 20 bp, mouse
gacagcagcgccggccgcta

SEQ ID NO: 662930 - DNA, 20 bp, mouse
gtctcagcttacaagtacgt

SEQ ID NO: 662931 - DNA, 20 bp, mouse
gcgcgtagcttctggaggcg

SEQ ID NO: 662932 - DNA, 20 bp, mouse
gaagtctgcgacagcagcgc

SEQ ID NO: 662933 - DNA, 20 bp, mouse
ggccagctgctgaggttgtc

SEQ ID NO: 662934 - DNA, 20 bp, mouse
ggagtttaaaaggtgacgtg

SEQ ID NO: 662935 - DNA, 20 bp, mouse
gaatcgaaggtagaagaaat

SEQ ID NO: 662936 - DNA, 20 bp, mouse
gaaggctgagacaacctcag

SEQ ID NO: 662937 - DNA, 20 bp, mouse
gagtccgcccggccgtccgg

SEQ ID NO: 662938 - DNA, 20 bp, mouse
ggggcgcccgagtacgcaga

SEQ ID NO: 662939 - DNA, 20 bp, mouse
ggcaacgccctctgcgtact

SEQ ID NO: 662940 - DNA, 20 bp, mouse
gcggcaagttgaagagctgg

SEQ ID NO: 662941 - DNA, 20 bp, mouse
gactgcgcagccgccgaagg

SEQ ID NO: 662942 - DNA, 20 bp, mouse
ggctgcgctcggtagggctg

SEQ ID NO: 662943 - DNA, 20 bp, mouse
gccgcccgacgtcccgcctt

SEQ ID NO: 662944 - DNA, 20 bp, mouse
ggtactcgggcgcccccgga

SEQ ID NO: 662945 - DNA, 20 bp, mouse
gctcgggacgcctgagtcgc

SEQ ID NO: 662946 - DNA, 20 bp, mouse
gactgtgtggagctcccttg

SEQ ID NO: 662947 - DNA, 20 bp, mouse
gagagtctgcagtcccgagg

SEQ ID NO: 662948 - DNA, 20 bp, mouse
gtgagcgccgcaagacggtg

SEQ ID NO: 662949 - DNA, 20 bp, mouse
gcggggccgcggaaactgtg

SEQ ID NO: 662950 - DNA, 20 bp, mouse
gggggagacatcagccccaa

SEQ ID NO: 662951 - DNA, 20 bp, mouse
gggcggcttcacctcagcgg

SEQ ID NO: 662952 - DNA, 20 bp, mouse
gacccccgctactgagacag

SEQ ID NO: 662953 - DNA, 20 bp, mouse
gcaacccgctgtctcagtag

SEQ ID NO: 662954 - DNA, 20 bp, mouse
ggaaacgcgactgagagccc

SEQ ID NO: 662955 - DNA, 20 bp, mouse
ggagctccacacagtttccg

SEQ ID NO: 662956 - DNA, 20 bp, mouse
gccaaacagcctactccgat

SEQ ID NO: 662957 - DNA, 20 bp, mouse
gaactcgaccggcgtctcca

SEQ ID NO: 662958 - DNA, 20 bp, mouse
ggtcgagttccggggagcaa

SEQ ID NO: 662959 - DNA, 20 bp, mouse
gacagcgcacagcgaacccg

SEQ ID NO: 662960 - DNA, 20 bp, mouse
gctactccgattggctgata

SEQ ID NO: 662961 - DNA, 20 bp, mouse
ggcaagccggagtccgaagc

SEQ ID NO: 662962 - DNA, 20 bp, mouse
gcgcaggagtctgggagctc

SEQ ID NO: 662963 - DNA, 20 bp, mouse
gcgaactcgtggctatcctc

SEQ ID NO: 662964 - DNA, 20 bp, mouse
ggctgcgctccgctacctgc

SEQ ID NO: 662965 - DNA, 20 bp, mouse
ggctgtttgggcggacccac

SEQ ID NO: 662966 - DNA, 20 bp, mouse
gtcggcgcgtgtcagggcgg

SEQ ID NO: 662967 - DNA, 20 bp, mouse
ggcacgcggaagccaggtgc

SEQ ID NO: 662968 - DNA, 20 bp, mouse
gtgtcagggcgggggctcac

SEQ ID NO: 662969 - DNA, 20 bp, mouse
gcaggaggcggtgaaaaagg

SEQ ID NO: 662970 - DNA, 20 bp, mouse
gcgagcacaagcttgggctg

SEQ ID NO: 662971 - DNA, 20 bp, mouse
gtagctggaaccgtggggac

SEQ ID NO: 662972 - DNA, 20 bp, mouse
gggaaccgtggggaccggcc

SEQ ID NO: 662973 - DNA, 20 bp, mouse
gtctccgctcgaacgtacag

SEQ ID NO: 662974 - DNA, 20 bp, mouse
gaggaatagctggaaccgtg

SEQ ID NO: 662975 - DNA, 20 bp, mouse
gctcaccgggccggtcccca

SEQ ID NO: 662976 - DNA, 20 bp, mouse
ggcgccgcaaccaatggaca

SEQ ID NO: 662977 - DNA, 20 bp, mouse
gccaatgggcagctgcgcgg

SEQ ID NO: 662978 - DNA, 20 bp, mouse
ggcgcgcctgcatgcaaatg

SEQ ID NO: 662979 - DNA, 20 bp, mouse
gctcctctgagcccttcgat

SEQ ID NO: 662980 - DNA, 20 bp, mouse
gcggggtggtatttgcatac

SEQ ID NO: 662981 - DNA, 20 bp, mouse
gaaccaatagacaggaaccg

SEQ ID NO: 662982 - DNA, 20 bp, mouse
ggggccgggggccggacccg

SEQ ID NO: 662983 - DNA, 20 bp, mouse
gggctctggtggaacatgga

SEQ ID NO: 662984 - DNA, 20 bp, mouse
gttccgcggtccctgtccat

SEQ ID NO: 662985 - DNA, 20 bp, mouse
gaaccaatggacagggaccg

SEQ ID NO: 662986 - DNA, 20 bp, mouse
ggcactgaatgtgagcacga

SEQ ID NO: 662987 - DNA, 20 bp, mouse
ggggctccgccagtctcctt

SEQ ID NO: 662988 - DNA, 20 bp, mouse
gtaacctcccccaaggagac

SEQ ID NO: 662989 - DNA, 20 bp, mouse
gtgaatgtgagcacgaggga

SEQ ID NO: 662990 - DNA, 20 bp, mouse
gggctggctaacctccccca

SEQ ID NO: 662991 - DNA, 20 bp, mouse
gggggcgaccggccgatcct

SEQ ID NO: 662992 - DNA, 20 bp, mouse
gtgggcatggagggatcctc

SEQ ID NO: 662993 - DNA, 20 bp, mouse
gcaccagaggcgcccggaag

SEQ ID NO: 662994 - DNA, 20 bp, mouse
gatcctctgggcgtgataag

SEQ ID NO: 662995 - DNA, 20 bp, mouse
gcggcgctgcagatctgggg

SEQ ID NO: 662996 - DNA, 20 bp, mouse
gagcaagcaggatacggagc

SEQ ID NO: 662997 - DNA, 20 bp, mouse
gtaggccaagccaaagcaga

SEQ ID NO: 662998 - DNA, 20 bp, mouse
gatggagagcaagcaggata

SEQ ID NO: 662999 - DNA, 20 bp, mouse
ggcttgctctccatctgctt

SEQ ID NO: 663000 - DNA, 20 bp, mouse
gaggcaggatatgggactga

SEQ ID NO: 663001 - DNA, 20 bp, mouse
ggaaggaggccagccagcgt

SEQ ID NO: 663002 - DNA, 20 bp, mouse
gcagtactctcaggaccctc

SEQ ID NO: 663003 - DNA, 20 bp, mouse
ggtctaccaagacatagcat

SEQ ID NO: 663004 - DNA, 20 bp, mouse
gcaggatatgggactgaagg

SEQ ID NO: 663005 - DNA, 20 bp, mouse
gctcgctgatccaggtggcc

SEQ ID NO: 663006 - DNA, 20 bp, mouse
gccaccctggggcagagggc

SEQ ID NO: 663007 - DNA, 20 bp, mouse
ggtggcctggcagtaccaga

SEQ ID NO: 663008 - DNA, 20 bp, mouse
gagggcacagcagcttcaga

SEQ ID NO: 663009 - DNA, 20 bp, mouse
gggaggaggcatactggaaa

SEQ ID NO: 663010 - DNA, 20 bp, mouse
gaccctaatccgcctcactg

SEQ ID NO: 663011 - DNA, 20 bp, mouse
gaagctgcttatggccccct

SEQ ID NO: 663012 - DNA, 20 bp, mouse
gggattagggtaaatgagtc

SEQ ID NO: 663013 - DNA, 20 bp, mouse
ggagacttggaatgatgaac

SEQ ID NO: 663014 - DNA, 20 bp, mouse
ggcttctcctcggcaagaaa

SEQ ID NO: 663015 - DNA, 20 bp, mouse
gggcagtaccagatgggtct

SEQ ID NO: 663016 - DNA, 20 bp, mouse
gcactccagccataaatggg

SEQ ID NO: 663017 - DNA, 20 bp, mouse
gggggataaaagagtttcag

SEQ ID NO: 663018 - DNA, 20 bp, mouse
gccagccataaatgggaggt

SEQ ID NO: 663019 - DNA, 20 bp, mouse
gtgggagggggagccaatgt

SEQ ID NO: 663020 - DNA, 20 bp, mouse
gggaaacattaaggagtgga

SEQ ID NO: 663021 - DNA, 20 bp, mouse
ggatagtacattttgaaaga

SEQ ID NO: 663022 - DNA, 20 bp, mouse
gttaatctttcactcactaa

SEQ ID NO: 663023 - DNA, 20 bp, mouse
gctttcactcactaaaggtc

SEQ ID NO: 663024 - DNA, 20 bp, mouse
ggtactatccaattccattc

SEQ ID NO: 663025 - DNA, 20 bp, mouse
gcttgataccagaagatcac

SEQ ID NO: 663026 - DNA, 20 bp, mouse
gtggctgctaacgtggggtg

SEQ ID NO: 663027 - DNA, 20 bp, mouse
ggcagccagcaggacccggg

SEQ ID NO: 663028 - DNA, 20 bp, mouse
gaaccctcccccagcgagag

SEQ ID NO: 663029 - DNA, 20 bp, mouse
gcaggggccggcagcgggaa

SEQ ID NO: 663030 - DNA, 20 bp, mouse
gtcctgctggctgctaacgt

SEQ ID NO: 663031 - DNA, 20 bp, mouse
gccctcccgggcgccttctc

SEQ ID NO: 663032 - DNA, 20 bp, mouse
gagtcggggagaaccagaga

SEQ ID NO: 663033 - DNA, 20 bp, mouse
gaaggcgcccgggagggctt

SEQ ID NO: 663034 - DNA, 20 bp, mouse
gagaaccagagaaggcgccc

SEQ ID NO: 663035 - DNA, 20 bp, mouse
gcccgggtggtgtggaccag

SEQ ID NO: 663036 - DNA, 20 bp, mouse
gtaatgacaggggctcacca

SEQ ID NO: 663037 - DNA, 20 bp, mouse
ggcaccagcgccaggtcaga

SEQ ID NO: 663038 - DNA, 20 bp, mouse
gcagaaacagggtaaatcct

SEQ ID NO: 663039 - DNA, 20 bp, mouse
gcaacactccggatggttga

SEQ ID NO: 663040 - DNA, 20 bp, mouse
gatcacccaggtaatgacag

SEQ ID NO: 663041 - DNA, 20 bp, mouse
ggctctgcctccaataatac

SEQ ID NO: 663042 - DNA, 20 bp, mouse
gtacacttgtaagcagaaac

SEQ ID NO: 663043 - DNA, 20 bp, mouse
gacaccttctgacctggcgc

SEQ ID NO: 663044 - DNA, 20 bp, mouse
gtgagcccctgtcattacct

SEQ ID NO: 663045 - DNA, 20 bp, mouse
gctgaagcattggtcattat

SEQ ID NO: 663046 - DNA, 20 bp, mouse
gagggagccggagaggacaa

SEQ ID NO: 663047 - DNA, 20 bp, mouse
ggtcctctccggctccctat

SEQ ID NO: 663048 - DNA, 20 bp, mouse
gtcagccaacccagccaata

SEQ ID NO: 663049 - DNA, 20 bp, mouse
gaacccagccaatagggagc

SEQ ID NO: 663050 - DNA, 20 bp, mouse
ggacaaaaagctcggatctc

SEQ ID NO: 663051 - DNA, 20 bp, mouse
gcaggggtataaatagtcgg

SEQ ID NO: 663052 - DNA, 20 bp, mouse
gttggctgaagtcccagcaa

SEQ ID NO: 663053 - DNA, 20 bp, mouse
gaagtcccagcaagggggcg

SEQ ID NO: 663054 - DNA, 20 bp, mouse
gcaactctgaagataggacc

SEQ ID NO: 663055 - DNA, 20 bp, mouse
ggtcagttcaccttgaagga

SEQ ID NO: 663056 - DNA, 20 bp, mouse
ggcaaggcggagttccttgg

SEQ ID NO: 663057 - DNA, 20 bp, mouse
gggcccgcaggccatagccg

SEQ ID NO: 663058 - DNA, 20 bp, mouse
gcgcacctgctgggtggcaa

SEQ ID NO: 663059 - DNA, 20 bp, mouse
gtccccccgccccccggcta

SEQ ID NO: 663060 - DNA, 20 bp, mouse
gaaatggagtatagcataag

SEQ ID NO: 663061 - DNA, 20 bp, mouse
ggtaatgggcggcaggttat

SEQ ID NO: 663062 - DNA, 20 bp, mouse
gacgccctttgccacccagc

SEQ ID NO: 663063 - DNA, 20 bp, mouse
gtcacctaggacatcggaac

SEQ ID NO: 663064 - DNA, 20 bp, mouse
gcggatccagcgcacctgct

SEQ ID NO: 663065 - DNA, 20 bp, mouse
gaggtgcgctggatccggtc

SEQ ID NO: 663066 - DNA, 20 bp, mouse
gcggtcgcgtggccagctat

SEQ ID NO: 663067 - DNA, 20 bp, mouse
gggcccgtgcaggagatctc

SEQ ID NO: 663068 - DNA, 20 bp, mouse
gcgcgtggccagctatggga

SEQ ID NO: 663069 - DNA, 20 bp, mouse
gcgaggtcccccagtatccc

SEQ ID NO: 663070 - DNA, 20 bp, mouse
gcctgcacgggccgagtcag

SEQ ID NO: 663071 - DNA, 20 bp, mouse
gggcgtcgccccgtgcaagg

SEQ ID NO: 663072 - DNA, 20 bp, mouse
ggacccgagatctcctgcac

SEQ ID NO: 663073 - DNA, 20 bp, mouse
gacccttctggcctgagaag

SEQ ID NO: 663074 - DNA, 20 bp, mouse
ggcgacgccctgggacgctg

SEQ ID NO: 663075 - DNA, 20 bp, mouse
gctgggggcccgggatactg

SEQ ID NO: 663076 - DNA, 20 bp, mouse
ggatccccggccacccactc

SEQ ID NO: 663077 - DNA, 20 bp, mouse
ggcgcccggcctcagctcgg

SEQ ID NO: 663078 - DNA, 20 bp, mouse
gagcgcggctcgggacatgc

SEQ ID NO: 663079 - DNA, 20 bp, mouse
gggcgcggcaaaaataaccg

SEQ ID NO: 663080 - DNA, 20 bp, mouse
ggctcgggacatgccggcag

SEQ ID NO: 663081 - DNA, 20 bp, mouse
ggtgaccccgggcgggagga

SEQ ID NO: 663082 - DNA, 20 bp, mouse
gcgccgccgcccgatgggct

SEQ ID NO: 663083 - DNA, 20 bp, mouse
gctcccttggacgcagagac

SEQ ID NO: 663084 - DNA, 20 bp, mouse
gtcgtgagccccccgagctg

SEQ ID NO: 663085 - DNA, 20 bp, mouse
gggacggcccggccgagccg

SEQ ID NO: 663086 - DNA, 20 bp, mouse
gccgcccccgccggagtccg

SEQ ID NO: 663087 - DNA, 20 bp, mouse
ggcgccctgggggcacgcag

SEQ ID NO: 663088 - DNA, 20 bp, mouse
gggagtccgcggcggtcctc

SEQ ID NO: 663089 - DNA, 20 bp, mouse
gtgagcctctgcgtgccccc

SEQ ID NO: 663090 - DNA, 20 bp, mouse
gagggcgccgcccaaagctt

SEQ ID NO: 663091 - DNA, 20 bp, mouse
ggcggggtctgtggggttcg

SEQ ID NO: 663092 - DNA, 20 bp, mouse
gcccacgccacgccctataa

SEQ ID NO: 663093 - DNA, 20 bp, mouse
gaggagagcgagggtaccgg

SEQ ID NO: 663094 - DNA, 20 bp, mouse
ggccacgccctataaggggt

SEQ ID NO: 663095 - DNA, 20 bp, mouse
gcgcgggggcggggtctgtg

SEQ ID NO: 663096 - DNA, 20 bp, mouse
gaaccacgtatcagagccaa

SEQ ID NO: 663097 - DNA, 20 bp, mouse
gcacccttggctctgatacg

SEQ ID NO: 663098 - DNA, 20 bp, mouse
ggccaagggtgtagctctaa

SEQ ID NO: 663099 - DNA, 20 bp, mouse
gccctcgttcactactaaag

SEQ ID NO: 663100 - DNA, 20 bp, mouse
ggaaggagctatctcaccag

SEQ ID NO: 663101 - DNA, 20 bp, mouse
ggtattgttcagttctacca

SEQ ID NO: 663102 - DNA, 20 bp, mouse
gggtgagatagctccttcat

SEQ ID NO: 663103 - DNA, 20 bp, mouse
gagggtgcggtttccaatga

SEQ ID NO: 663104 - DNA, 20 bp, mouse
ggcctttagagctacaccct

SEQ ID NO: 663105 - DNA, 20 bp, mouse
gacagcctggagtttcagtt

SEQ ID NO: 663106 - DNA, 20 bp, mouse
gtcgcgcgccgtggagtccg

SEQ ID NO: 663107 - DNA, 20 bp, mouse
gggctggcgcggctgaccga

SEQ ID NO: 663108 - DNA, 20 bp, mouse
ggggacgccgtgtagaggag

SEQ ID NO: 663109 - DNA, 20 bp, mouse
gagcaggcacggggccccac

SEQ ID NO: 663110 - DNA, 20 bp, mouse
ggggcgcgtgggccgcaggc

SEQ ID NO: 663111 - DNA, 20 bp, mouse
ggccccgtgcctgctgctag

SEQ ID NO: 663112 - DNA, 20 bp, mouse
gcccaggtgtgagagtgcga

SEQ ID NO: 663113 - DNA, 20 bp, mouse
gggggcgcggcgcggccggt

SEQ ID NO: 663114 - DNA, 20 bp, mouse
gccagcccagcggaccccag

SEQ ID NO: 663115 - DNA, 20 bp, mouse
gacagcccggttaaccccct

SEQ ID NO: 663116 - DNA, 20 bp, mouse
gtggggtggtgttcagggac

SEQ ID NO: 663117 - DNA, 20 bp, mouse
gagggggtagggcttctaga

SEQ ID NO: 663118 - DNA, 20 bp, mouse
gtcccccaaaatgccagcgt

SEQ ID NO: 663119 - DNA, 20 bp, mouse
ggaggaatggagcttcgcag

SEQ ID NO: 663120 - DNA, 20 bp, mouse
gcaggggtccccagaggcgg

SEQ ID NO: 663121 - DNA, 20 bp, mouse
gggtgttcagggaccggaga

SEQ ID NO: 663122 - DNA, 20 bp, mouse
gttctggcacacgtaccacc

SEQ ID NO: 663123 - DNA, 20 bp, mouse
gttcagggaccggagagggg

SEQ ID NO: 663124 - DNA, 20 bp, mouse
gccctgcgcctgtgtggata

SEQ ID NO: 663125 - DNA, 20 bp, mouse
gaccccacgctggcattttg

SEQ ID NO: 663126 - DNA, 20 bp, mouse
ggggaaaaatggtgtcagtt

SEQ ID NO: 663127 - DNA, 20 bp, mouse
ggtcacggggcggggaaaaa

SEQ ID NO: 663128 - DNA, 20 bp, mouse
ggtaggtctgagattggcaa

SEQ ID NO: 663129 - DNA, 20 bp, mouse
gctgagattggcaaggggaa

SEQ ID NO: 663130 - DNA, 20 bp, mouse
ggagcaaatgggatatttgt

SEQ ID NO: 663131 - DNA, 20 bp, mouse
gcgtgaccttaatctctcta

SEQ ID NO: 663132 - DNA, 20 bp, mouse
gagagattaaggtcacgggg

SEQ ID NO: 663133 - DNA, 20 bp, mouse
ggtgaacagggggagcaaat

SEQ ID NO: 663134 - DNA, 20 bp, mouse
gcagttgggagggtgaacag

SEQ ID NO: 663135 - DNA, 20 bp, mouse
gcccagccttagagagatta

SEQ ID NO: 663136 - DNA, 20 bp, mouse
gccgccgtgccagtgcggga

SEQ ID NO: 663137 - DNA, 20 bp, mouse
gcggctgaccaatggaaggg

SEQ ID NO: 663138 - DNA, 20 bp, mouse
ggagagccacagctggaatc

SEQ ID NO: 663139 - DNA, 20 bp, mouse
gtggcacggcggctgaccaa

SEQ ID NO: 663140 - DNA, 20 bp, mouse
gcggcggctgaccaatggaa

SEQ ID NO: 663141 - DNA, 20 bp, mouse
ggaaaggcggtcgtggtttt

SEQ ID NO: 663142 - DNA, 20 bp, mouse
gcggggccgaggcttgaagt

SEQ ID NO: 663143 - DNA, 20 bp, mouse
ggtcagccgccgtgccagtg

SEQ ID NO: 663144 - DNA, 20 bp, mouse
ggtggcgccggcgacagcta

SEQ ID NO: 663145 - DNA, 20 bp, mouse
gccggcgacagctacggcaa

SEQ ID NO: 663146 - DNA, 20 bp, mouse
ggaccctcagggaccgagat

SEQ ID NO: 663147 - DNA, 20 bp, mouse
gtcgcccagtcctggacttg

SEQ ID NO: 663148 - DNA, 20 bp, mouse
gacggaccaagggatgttgt

SEQ ID NO: 663149 - DNA, 20 bp, mouse
gccgcgagacagtatggggc

SEQ ID NO: 663150 - DNA, 20 bp, mouse
gcacggagaaacacggacca

SEQ ID NO: 663151 - DNA, 20 bp, mouse
gctctcccgcgagacagtat

SEQ ID NO: 663152 - DNA, 20 bp, mouse
gcgggcagggggcgaccctc

SEQ ID NO: 663153 - DNA, 20 bp, mouse
gcagccccaagtccaggact

SEQ ID NO: 663154 - DNA, 20 bp, mouse
gcgcagggatgcttggacga

SEQ ID NO: 663155 - DNA, 20 bp, mouse
ggtaccggcacggagaaaca

SEQ ID NO: 663156 - DNA, 20 bp, mouse
gtagggtcgcaccgctgggg

SEQ ID NO: 663157 - DNA, 20 bp, mouse
gggctcccgcctctccggag

SEQ ID NO: 663158 - DNA, 20 bp, mouse
gcggagaggcgggagccccc

SEQ ID NO: 663159 - DNA, 20 bp, mouse
ggggtcaggaccctccccag

SEQ ID NO: 663160 - DNA, 20 bp, mouse
ggcccagggccaaaagggtc

SEQ ID NO: 663161 - DNA, 20 bp, mouse
ggcgaccctaaattgttagg

SEQ ID NO: 663162 - DNA, 20 bp, mouse
ggaggtggctgcactcccgg

SEQ ID NO: 663163 - DNA, 20 bp, mouse
gggtgcgaccctaaattgtt

SEQ ID NO: 663164 - DNA, 20 bp, mouse
gacctgggctgctcattcaa

SEQ ID NO: 663165 - DNA, 20 bp, mouse
gggaagcttggtgggaactt

SEQ ID NO: 663166 - DNA, 20 bp, mouse
gccagcccttgcctcctcgg

SEQ ID NO: 663167 - DNA, 20 bp, mouse
gggcaagggctgggtgtaaa

SEQ ID NO: 663168 - DNA, 20 bp, mouse
gagctggggcaatgagggtc

SEQ ID NO: 663169 - DNA, 20 bp, mouse
ggcctcctcgggggcagatg

SEQ ID NO: 663170 - DNA, 20 bp, mouse
gtccaggcttgagacggggt

SEQ ID NO: 663171 - DNA, 20 bp, mouse
gttcacagctggggcaatga

SEQ ID NO: 663172 - DNA, 20 bp, mouse
gagatggggatgtcaccggc

SEQ ID NO: 663173 - DNA, 20 bp, mouse
gggtcagggagaggaacccg

SEQ ID NO: 663174 - DNA, 20 bp, mouse
gtggacagagccacggagtt

SEQ ID NO: 663175 - DNA, 20 bp, mouse
gtgcctggccgcaggagcct

SEQ ID NO: 663176 - DNA, 20 bp, mouse
gggtggccggagcggggctc

SEQ ID NO: 663177 - DNA, 20 bp, mouse
gcgcccgggccgtccccgcc

SEQ ID NO: 663178 - DNA, 20 bp, mouse
ggtctcggggaggcggctgt

SEQ ID NO: 663179 - DNA, 20 bp, mouse
gacgcggcggctgcggggat

SEQ ID NO: 663180 - DNA, 20 bp, mouse
ggccggccggtggtccctcg

SEQ ID NO: 663181 - DNA, 20 bp, mouse
gcctccctgccttgtacgga

SEQ ID NO: 663182 - DNA, 20 bp, mouse
gaggaggcgagcaaagtgct

SEQ ID NO: 663183 - DNA, 20 bp, mouse
gcccgcccggctctgacgcc

SEQ ID NO: 663184 - DNA, 20 bp, mouse
ggggcgcagccctccgtaca

SEQ ID NO: 663185 - DNA, 20 bp, mouse
gcagccctccgtacaaggca

SEQ ID NO: 663186 - DNA, 20 bp, mouse
ggggcaggctccggggtgaa

SEQ ID NO: 663187 - DNA, 20 bp, mouse
gggcgctgggaccacggctg

SEQ ID NO: 663188 - DNA, 20 bp, mouse
gtctccgcgcggggcctccg

SEQ ID NO: 663189 - DNA, 20 bp, mouse
gcgcgagcttggattcggat

SEQ ID NO: 663190 - DNA, 20 bp, mouse
ggggccggccaaggagaggg

SEQ ID NO: 663191 - DNA, 20 bp, mouse
gcggggtgaacggggacgag

SEQ ID NO: 663192 - DNA, 20 bp, mouse
gaggcgggccggccaaggag

SEQ ID NO: 663193 - DNA, 20 bp, mouse
gagtcccccggtctgaggtg

SEQ ID NO: 663194 - DNA, 20 bp, mouse
gttgcgcgagccagtagggc

SEQ ID NO: 663195 - DNA, 20 bp, mouse
gcccccacacctcagaccgg

SEQ ID NO: 663196 - DNA, 20 bp, mouse
gggaagcagcggggtacggg

SEQ ID NO: 663197 - DNA, 20 bp, mouse
gagggcgggaggcgcctcgc

SEQ ID NO: 663198 - DNA, 20 bp, mouse
gctgcccagccccgcctcgg

SEQ ID NO: 663199 - DNA, 20 bp, mouse
gtccccggggccgccgaggc

SEQ ID NO: 663200 - DNA, 20 bp, mouse
gcagctgcccagccccgcct

SEQ ID NO: 663201 - DNA, 20 bp, mouse
gtcggcggccccggggagtc

SEQ ID NO: 663202 - DNA, 20 bp, mouse
ggcggctcgccggactcccc

SEQ ID NO: 663203 - DNA, 20 bp, mouse
gcgcgcgcccggctcacttg

SEQ ID NO: 663204 - DNA, 20 bp, mouse
ggggcagctgccgcggcaag

SEQ ID NO: 663205 - DNA, 20 bp, mouse
gccctcccgccgcggctcgc

SEQ ID NO: 663206 - DNA, 20 bp, mouse
gctgctcagagctggaatca

SEQ ID NO: 663207 - DNA, 20 bp, mouse
gcccaggtgatcaaagggga

SEQ ID NO: 663208 - DNA, 20 bp, mouse
gcctcctctgacaacaagaa

SEQ ID NO: 663209 - DNA, 20 bp, mouse
ggggctaccagtgtccttca

SEQ ID NO: 663210 - DNA, 20 bp, mouse
ggacagcctctgaacttggg

SEQ ID NO: 663211 - DNA, 20 bp, mouse
gaatcagggcaatcctgctg

SEQ ID NO: 663212 - DNA, 20 bp, mouse
gccaccccaggtgatcaaag

SEQ ID NO: 663213 - DNA, 20 bp, mouse
gtggcctctttggagcagaa

SEQ ID NO: 663214 - DNA, 20 bp, mouse
gcaaactcagtgaccagggt

SEQ ID NO: 663215 - DNA, 20 bp, mouse
gctcctacggaatgctcaaa

SEQ ID NO: 663216 - DNA, 20 bp, mouse
ggccctcatcccagtctaat

SEQ ID NO: 663217 - DNA, 20 bp, mouse
gtctgcgcgcagccggttga

SEQ ID NO: 663218 - DNA, 20 bp, mouse
gctggcctccagaacgtgga

SEQ ID NO: 663219 - DNA, 20 bp, mouse
gtgtgccaagcgttgatggg

SEQ ID NO: 663220 - DNA, 20 bp, mouse
ggagcccctccacgttctgg

SEQ ID NO: 663221 - DNA, 20 bp, mouse
gctcatcccagtctaatcgg

SEQ ID NO: 663222 - DNA, 20 bp, mouse
ggctgtcctccgattagact

SEQ ID NO: 663223 - DNA, 20 bp, mouse
gaccggctgcgcgcagacaa

SEQ ID NO: 663224 - DNA, 20 bp, mouse
gatcgagcccctccacgttc

SEQ ID NO: 663225 - DNA, 20 bp, mouse
gcccgctggcctccagaacg

SEQ ID NO: 663226 - DNA, 20 bp, mouse
gcctacccccagtaggtggc

SEQ ID NO: 663227 - DNA, 20 bp, mouse
gagtaggtggcgggagtggg

SEQ ID NO: 663228 - DNA, 20 bp, mouse
gcaagggcttagacccccac

SEQ ID NO: 663229 - DNA, 20 bp, mouse
gcactcccgccacctactgg

SEQ ID NO: 663230 - DNA, 20 bp, mouse
gctgacaagggggaaactga

SEQ ID NO: 663231 - DNA, 20 bp, mouse
gtttcccccttgtcagccaa

SEQ ID NO: 663232 - DNA, 20 bp, mouse
gttagctcagagatgtggca

SEQ ID NO: 663233 - DNA, 20 bp, mouse
gtctaagcccttggctgaca

SEQ ID NO: 663234 - DNA, 20 bp, mouse
gcagtgatagcatgcttctg

SEQ ID NO: 663235 - DNA, 20 bp, mouse
gtaggggtggcccacacagc

SEQ ID NO: 663236 - DNA, 20 bp, mouse
gagagccccagagggagaag

SEQ ID NO: 663237 - DNA, 20 bp, mouse
gcccagcagacttctgtctg

SEQ ID NO: 663238 - DNA, 20 bp, mouse
gtcagggcatagtggggttt

SEQ ID NO: 663239 - DNA, 20 bp, mouse
gaaggtgctaggattctcca

SEQ ID NO: 663240 - DNA, 20 bp, mouse
gatggagcatgcccagtgca

SEQ ID NO: 663241 - DNA, 20 bp, mouse
gctgggagtgagagccccag

SEQ ID NO: 663242 - DNA, 20 bp, mouse
gaaagtgtaaacagctggga

SEQ ID NO: 663243 - DNA, 20 bp, mouse
gtcctcagacagaagtctgc

SEQ ID NO: 663244 - DNA, 20 bp, mouse
gagaggggcttcttagagca

SEQ ID NO: 663245 - DNA, 20 bp, mouse
gtgtgtgttccctcttgaga

SEQ ID NO: 663246 - DNA, 20 bp, mouse
gaaacaaagggctggcgcgg

SEQ ID NO: 663247 - DNA, 20 bp, mouse
ggcccggtggagaatcgaga

SEQ ID NO: 663248 - DNA, 20 bp, mouse
gcaaccagacgcgagcccgg

SEQ ID NO: 663249 - DNA, 20 bp, mouse
gaacccaggaactgctccgc

SEQ ID NO: 663250 - DNA, 20 bp, mouse
gcaggcggggcggatcccgg

SEQ ID NO: 663251 - DNA, 20 bp, mouse
gtcccggcggagcagttcct

SEQ ID NO: 663252 - DNA, 20 bp, mouse
ggggaaacaaagggctggcg

SEQ ID NO: 663253 - DNA, 20 bp, mouse
gtgctccgccgggaaacaaa

SEQ ID NO: 663254 - DNA, 20 bp, mouse
gtctccaccgggctcgcgtc

SEQ ID NO: 663255 - DNA, 20 bp, mouse
gcagatggggaagaggtctc

SEQ ID NO: 663256 - DNA, 20 bp, mouse
gagtcaccctccactctctc

SEQ ID NO: 663257 - DNA, 20 bp, mouse
gaagcatctctgtgctgggt

SEQ ID NO: 663258 - DNA, 20 bp, mouse
gacacttagcagtagccaaa

SEQ ID NO: 663259 - DNA, 20 bp, mouse
gtaggaaagcggcctctgat

SEQ ID NO: 663260 - DNA, 20 bp, mouse
gagagcgttccctgagagag

SEQ ID NO: 663261 - DNA, 20 bp, mouse
gcagaggtgacttaagttaa

SEQ ID NO: 663262 - DNA, 20 bp, mouse
gggtgacagagctaggaaag

SEQ ID NO: 663263 - DNA, 20 bp, mouse
gctcttcagctgactgaagc

SEQ ID NO: 663264 - DNA, 20 bp, mouse
ggcaaagtacagatgttgga

SEQ ID NO: 663265 - DNA, 20 bp, mouse
ggctgtttcaatgtttagga

SEQ ID NO: 663266 - DNA, 20 bp, mouse
gccagagtgggctggccttg

SEQ ID NO: 663267 - DNA, 20 bp, mouse
gccccaccctgtcccggagg

SEQ ID NO: 663268 - DNA, 20 bp, mouse
ggtcactaggcgtggcactg

SEQ ID NO: 663269 - DNA, 20 bp, mouse
gagtggatacggatagtggt

SEQ ID NO: 663270 - DNA, 20 bp, mouse
gcaggcgtgtcatgggcctg

SEQ ID NO: 663271 - DNA, 20 bp, mouse
gaccccccaccctgtcccgg

SEQ ID NO: 663272 - DNA, 20 bp, mouse
gagagagtggatacggatag

SEQ ID NO: 663273 - DNA, 20 bp, mouse
ggccctgaaacctgagccga

SEQ ID NO: 663274 - DNA, 20 bp, mouse
ggtggcactgaggattcctt

SEQ ID NO: 663275 - DNA, 20 bp, mouse
gccctcctccgggacagggt

SEQ ID NO: 663276 - DNA, 20 bp, mouse
ggtgggaatctgactgtgat

SEQ ID NO: 663277 - DNA, 20 bp, mouse
ggaactggaagaaacaccaa

SEQ ID NO: 663278 - DNA, 20 bp, mouse
gggaatctgactgtgatggg

SEQ ID NO: 663279 - DNA, 20 bp, mouse
gtggaacccatgaatagggg

SEQ ID NO: 663280 - DNA, 20 bp, mouse
gaagtgtggaacccatgaat

SEQ ID NO: 663281 - DNA, 20 bp, mouse
gcctggaagagatcctggat

SEQ ID NO: 663282 - DNA, 20 bp, mouse
gaatgagaaggaggctgaac

SEQ ID NO: 663283 - DNA, 20 bp, mouse
gagctctgggcacgtagaga

SEQ ID NO: 663284 - DNA, 20 bp, mouse
ggtggctggtaactggggtt

SEQ ID NO: 663285 - DNA, 20 bp, mouse
ggcagctgattgaagttttg

SEQ ID NO: 663286 - DNA, 20 bp, mouse
gaggaacggtgcagcggcaa

SEQ ID NO: 663287 - DNA, 20 bp, mouse
gcacttgcgtcggagagctg

SEQ ID NO: 663288 - DNA, 20 bp, mouse
ggagaaaagggagagtcctg

SEQ ID NO: 663289 - DNA, 20 bp, mouse
gaaaaaatagctctgctggg

SEQ ID NO: 663290 - DNA, 20 bp, mouse
ggtgcgagcgcgtgtgctgg

SEQ ID NO: 663291 - DNA, 20 bp, mouse
gtggcaaaaaatagctctgc

SEQ ID NO: 663292 - DNA, 20 bp, mouse
ggggggccggccacttgcgt

SEQ ID NO: 663293 - DNA, 20 bp, mouse
gcgacccggccttgagaagt

SEQ ID NO: 663294 - DNA, 20 bp, mouse
gaccacgaggaacggtgcag

SEQ ID NO: 663295 - DNA, 20 bp, mouse
ggcaggcggagagctttcct

SEQ ID NO: 663296 - DNA, 20 bp, mouse
ggccgcccggcgcgctctct

SEQ ID NO: 663297 - DNA, 20 bp, mouse
ggcgcgcgtgagcgcaggga

SEQ ID NO: 663298 - DNA, 20 bp, mouse
gggagggcgcgggccaagag

SEQ ID NO: 663299 - DNA, 20 bp, mouse
gggcgcgggccaagagcgga

SEQ ID NO: 663300 - DNA, 20 bp, mouse
gcggtgggtggaggcgcgga

SEQ ID NO: 663301 - DNA, 20 bp, mouse
gccccgcgctcgctctccca

SEQ ID NO: 663302 - DNA, 20 bp, mouse
ggagggaaaatcccggccgt

SEQ ID NO: 663303 - DNA, 20 bp, mouse
gtcagagcgaaggaagccga

SEQ ID NO: 663304 - DNA, 20 bp, mouse
gtgtcccgggttggaaagag

SEQ ID NO: 663305 - DNA, 20 bp, mouse
gagccgagggaaagaaagat

SEQ ID NO: 663306 - DNA, 20 bp, mouse
gacccagaggagaacccttg

SEQ ID NO: 663307 - DNA, 20 bp, mouse
gtggggaagcgtcctcgtgg

SEQ ID NO: 663308 - DNA, 20 bp, mouse
ggggtggggaagcgtcctcg

SEQ ID NO: 663309 - DNA, 20 bp, mouse
gcagaggagaacccttgggg

SEQ ID NO: 663310 - DNA, 20 bp, mouse
gtggcggccgctgcagtcgg

SEQ ID NO: 663311 - DNA, 20 bp, mouse
gaggctgtaggtgaagactt

SEQ ID NO: 663312 - DNA, 20 bp, mouse
gtctccaccaccgactgcag

SEQ ID NO: 663313 - DNA, 20 bp, mouse
ggggggttgtcgtaggagaa

SEQ ID NO: 663314 - DNA, 20 bp, mouse
gcacccgcaactgactgcat

SEQ ID NO: 663315 - DNA, 20 bp, mouse
gggaacactggactagaaga

SEQ ID NO: 663316 - DNA, 20 bp, mouse
ggagcccaggtctcctacag

SEQ ID NO: 663317 - DNA, 20 bp, mouse
gggaccccactggaattcga

SEQ ID NO: 663318 - DNA, 20 bp, mouse
gactactcaaaaaagagccc

SEQ ID NO: 663319 - DNA, 20 bp, mouse
gaggtccagaaaaagaggct

SEQ ID NO: 663320 - DNA, 20 bp, mouse
ggggacacaggagttggaaa

SEQ ID NO: 663321 - DNA, 20 bp, mouse
gagggggtatgggcgagcca

SEQ ID NO: 663322 - DNA, 20 bp, mouse
gagtccccagcctctttttc

SEQ ID NO: 663323 - DNA, 20 bp, mouse
ggacccgtgcccgggagacc

SEQ ID NO: 663324 - DNA, 20 bp, mouse
gtaccccctcgaattccagt

SEQ ID NO: 663325 - DNA, 20 bp, mouse
gagcaaatctgggaccccac

SEQ ID NO: 663326 - DNA, 20 bp, mouse
ggggaccagcggccgctcat

SEQ ID NO: 663327 - DNA, 20 bp, mouse
gagggagaaggatgcagcga

SEQ ID NO: 663328 - DNA, 20 bp, mouse
ggctaatgcggaggagggga

SEQ ID NO: 663329 - DNA, 20 bp, mouse
gcgcccgcggcctcactcag

SEQ ID NO: 663330 - DNA, 20 bp, mouse
ggggaatgagatgagccttc

SEQ ID NO: 663331 - DNA, 20 bp, mouse
ggatgagccttcaggatggg

SEQ ID NO: 663332 - DNA, 20 bp, mouse
gcgtccgctgagtgaggccg

SEQ ID NO: 663333 - DNA, 20 bp, mouse
gcattggctaatgcggagga

SEQ ID NO: 663334 - DNA, 20 bp, mouse
gtgagccgctggagtggtgg

SEQ ID NO: 663335 - DNA, 20 bp, mouse
gcggctgcgtccgctgagtg

SEQ ID NO: 663336 - DNA, 20 bp, mouse
gtcacagaagaggaactcag

SEQ ID NO: 663337 - DNA, 20 bp, mouse
gacagaggtgatcacagaag

SEQ ID NO: 663338 - DNA, 20 bp, mouse
ggaagaggaactcaggggac

SEQ ID NO: 663339 - DNA, 20 bp, mouse
gggctctgaggagtgaacag

SEQ ID NO: 663340 - DNA, 20 bp, mouse
gttagcaggcaagcagtttt

SEQ ID NO: 663341 - DNA, 20 bp, mouse
gcttaggaggagatagcagt

SEQ ID NO: 663342 - DNA, 20 bp, mouse
gatgtgagagagttggtagt

SEQ ID NO: 663343 - DNA, 20 bp, mouse
gagcagtagggttggaattg

SEQ ID NO: 663344 - DNA, 20 bp, mouse
gtgagggctggcttcacaag

SEQ ID NO: 663345 - DNA, 20 bp, mouse
ggaggagatagcagtagggt

SEQ ID NO: 663346 - DNA, 20 bp, mouse
gggaacaggagtaagagata

SEQ ID NO: 663347 - DNA, 20 bp, mouse
gagagagagattgagaggat

SEQ ID NO: 663348 - DNA, 20 bp, mouse
ggaaggggtgatgaagaaat

SEQ ID NO: 663349 - DNA, 20 bp, mouse
gtgatgaagaaattggggat

SEQ ID NO: 663350 - DNA, 20 bp, mouse
ggattggggtgcgggtgaga

SEQ ID NO: 663351 - DNA, 20 bp, mouse
gatggggtctgggcaacgga

SEQ ID NO: 663352 - DNA, 20 bp, mouse
gttcctcagtgcacctgaaa

SEQ ID NO: 663353 - DNA, 20 bp, mouse
gggtagggatcaaggggatt

SEQ ID NO: 663354 - DNA, 20 bp, mouse
gctgaggaagtcagagatag

SEQ ID NO: 663355 - DNA, 20 bp, mouse
gctgggcaacggaagggaac

SEQ ID NO: 663356 - DNA, 20 bp, mouse
gctacgaggcggttgttcca

SEQ ID NO: 663357 - DNA, 20 bp, mouse
ggggacgccgttagaactag

SEQ ID NO: 663358 - DNA, 20 bp, mouse
ggggaggcggagctacgagg

SEQ ID NO: 663359 - DNA, 20 bp, mouse
gccctctaaccgggactcca

SEQ ID NO: 663360 - DNA, 20 bp, mouse
gccctcgcgccctaggtgac

SEQ ID NO: 663361 - DNA, 20 bp, mouse
ggggcggaggagtgcatatc

SEQ ID NO: 663362 - DNA, 20 bp, mouse
gagaaggaacgcaagaatgg

SEQ ID NO: 663363 - DNA, 20 bp, mouse
gtctccggagttctcaagct

SEQ ID NO: 663364 - DNA, 20 bp, mouse
gcacgcccagcgcaggtccc

SEQ ID NO: 663365 - DNA, 20 bp, mouse
gtgcatgggcagtgccctag

SEQ ID NO: 663366 - DNA, 20 bp, mouse
gtggtctaaactgatgggga

SEQ ID NO: 663367 - DNA, 20 bp, mouse
gaggaaggcacgtgatgcga

SEQ ID NO: 663368 - DNA, 20 bp, mouse
ggggcggggccagcgaatcc

SEQ ID NO: 663369 - DNA, 20 bp, mouse
ggagaaagctgggcgaaaag

SEQ ID NO: 663370 - DNA, 20 bp, mouse
gaggcacgtgatgcgaggga

SEQ ID NO: 663371 - DNA, 20 bp, mouse
gacacctggtctaaactgat

SEQ ID NO: 663372 - DNA, 20 bp, mouse
gtgtccagacccggattcgc

SEQ ID NO: 663373 - DNA, 20 bp, mouse
gtcaaggcgaatgcacccag

SEQ ID NO: 663374 - DNA, 20 bp, mouse
gaagctgggcgaaaaggggg

SEQ ID NO: 663375 - DNA, 20 bp, mouse
ggtatgaagggacactcaga

SEQ ID NO: 663376 - DNA, 20 bp, mouse
gccggcgctgcgacgctcgt

SEQ ID NO: 663377 - DNA, 20 bp, mouse
gaacgacgtctcaatcgctg

SEQ ID NO: 663378 - DNA, 20 bp, mouse
ggggcgggactagactcgga

SEQ ID NO: 663379 - DNA, 20 bp, mouse
ggggactagactcggagggg

SEQ ID NO: 663380 - DNA, 20 bp, mouse
gcctccgcacgagacggctc

SEQ ID NO: 663381 - DNA, 20 bp, mouse
gataggaagtgtctcgagaa

SEQ ID NO: 663382 - DNA, 20 bp, mouse
ggggccttgggaggctccgg

SEQ ID NO: 663383 - DNA, 20 bp, mouse
ggacgtctcaatcgctgggg

SEQ ID NO: 663384 - DNA, 20 bp, mouse
ggcccgccctccgcacgaga

SEQ ID NO: 663385 - DNA, 20 bp, mouse
gttgctaggcaaccagcctg

SEQ ID NO: 663386 - DNA, 20 bp, mouse
ggcggggccgggcacgtcag

SEQ ID NO: 663387 - DNA, 20 bp, mouse
gtccacagcagcaaccccgg

SEQ ID NO: 663388 - DNA, 20 bp, mouse
gacgtcaggggcgggaccat

SEQ ID NO: 663389 - DNA, 20 bp, mouse
ggggccgggcacgtcagggg

SEQ ID NO: 663390 - DNA, 20 bp, mouse
ggccccgcccctgacgttgc

SEQ ID NO: 663391 - DNA, 20 bp, mouse
gcaggggcgggaccatagga

SEQ ID NO: 663392 - DNA, 20 bp, mouse
gtgcgtgtttctagcttgac

SEQ ID NO: 663393 - DNA, 20 bp, mouse
gcagccggcaacgtcagggg

SEQ ID NO: 663394 - DNA, 20 bp, mouse
gcaagcagccggcaacgtca

SEQ ID NO: 663395 - DNA, 20 bp, mouse
gctagaaacacgcacaggta

SEQ ID NO: 663396 - DNA, 20 bp, mouse
gcgcccgcgccacctagggg

SEQ ID NO: 663397 - DNA, 20 bp, mouse
gcggccgaacgctagcgcca

SEQ ID NO: 663398 - DNA, 20 bp, mouse
gcgcgcgcccgcgccaccta

SEQ ID NO: 663399 - DNA, 20 bp, mouse
ggaacgctagcgccaggggg

SEQ ID NO: 663400 - DNA, 20 bp, mouse
ggccccgcccctaggtggcg

SEQ ID NO: 663401 - DNA, 20 bp, mouse
ggggggagggggctagttct

SEQ ID NO: 663402 - DNA, 20 bp, mouse
gtggcacctcgagcccaacc

SEQ ID NO: 663403 - DNA, 20 bp, mouse
gacctaggggcggggccgag

SEQ ID NO: 663404 - DNA, 20 bp, mouse
ggggttgcggcttcaggagg

SEQ ID NO: 663405 - DNA, 20 bp, mouse
gtacaggttctcctccttcg

SEQ ID NO: 663406 - DNA, 20 bp, mouse
gaccgggccaatgacagaga

SEQ ID NO: 663407 - DNA, 20 bp, mouse
gtcagagcttcctgcccgaa

SEQ ID NO: 663408 - DNA, 20 bp, mouse
ggtcctgagtgcgtgaaagg

SEQ ID NO: 663409 - DNA, 20 bp, mouse
gagcgccgggaaaaacaaac

SEQ ID NO: 663410 - DNA, 20 bp, mouse
gggtgtgttcctattggtca

SEQ ID NO: 663411 - DNA, 20 bp, mouse
gtagcacgtggccaccttta

SEQ ID NO: 663412 - DNA, 20 bp, mouse
ggctccaccccctgaccaat

SEQ ID NO: 663413 - DNA, 20 bp, mouse
gaggcttctcaaggaccctt

SEQ ID NO: 663414 - DNA, 20 bp, mouse
gcagccaatcgccaccgcga

SEQ ID NO: 663415 - DNA, 20 bp, mouse
gggccacgtgctaacttgca

SEQ ID NO: 663416 - DNA, 20 bp, mouse
gatgctggaggagctcccgg

SEQ ID NO: 663417 - DNA, 20 bp, mouse
gcgcacccctcttatgcttg

SEQ ID NO: 663418 - DNA, 20 bp, mouse
gagggagctgactcagaagt

SEQ ID NO: 663419 - DNA, 20 bp, mouse
gcataagaggggtgcgcatg

SEQ ID NO: 663420 - DNA, 20 bp, mouse
ggggaggtggacagggcggt

SEQ ID NO: 663421 - DNA, 20 bp, mouse
gcactcgggtgtggagcaaa

SEQ ID NO: 663422 - DNA, 20 bp, mouse
ggtggaggggtggtgacggg

SEQ ID NO: 663423 - DNA, 20 bp, mouse
gcaccacaaaagcgcggagg

SEQ ID NO: 663424 - DNA, 20 bp, mouse
gtccaccccaagcataagag

SEQ ID NO: 663425 - DNA, 20 bp, mouse
gaaaagcgcggagggggtgt

SEQ ID NO: 663426 - DNA, 20 bp, mouse
ggaagggcgcgcacgggggt

SEQ ID NO: 663427 - DNA, 20 bp, mouse
gaaggggcggggaccggacg

SEQ ID NO: 663428 - DNA, 20 bp, mouse
gggagagcggaaggtcgtga

SEQ ID NO: 663429 - DNA, 20 bp, mouse
ggaggggcccagacaatgcg

SEQ ID NO: 663430 - DNA, 20 bp, mouse
ggggcgtggcgtcagctaag

SEQ ID NO: 663431 - DNA, 20 bp, mouse
ggggcagggcgtgagcgtga

SEQ ID NO: 663432 - DNA, 20 bp, mouse
gggaggacgggagcgcggaa

SEQ ID NO: 663433 - DNA, 20 bp, mouse
ggcgtcgtgggagccagtgg

SEQ ID NO: 663434 - DNA, 20 bp, mouse
gcccagacaatgcggggaga

SEQ ID NO: 663435 - DNA, 20 bp, mouse
gcatgcggacccgggcgcga

SEQ ID NO: 663436 - DNA, 20 bp, mouse
ggcggagagggcgactgcaa

SEQ ID NO: 663437 - DNA, 20 bp, mouse
gcgactgcaaaggcctagag

SEQ ID NO: 663438 - DNA, 20 bp, mouse
gccagtgtccgcggcggaga

SEQ ID NO: 663439 - DNA, 20 bp, mouse
gcagggggcaaggaagactg

SEQ ID NO: 663440 - DNA, 20 bp, mouse
gaactctccagtgtccgcgg

SEQ ID NO: 663441 - DNA, 20 bp, mouse
ggtggtctaaataggacagg

SEQ ID NO: 663442 - DNA, 20 bp, mouse
ggagaggcatcttgccgatt

SEQ ID NO: 663443 - DNA, 20 bp, mouse
gcttaactctccagtgtccg

SEQ ID NO: 663444 - DNA, 20 bp, mouse
gggaagactggggggcatga

SEQ ID NO: 663445 - DNA, 20 bp, mouse
gaaagagaagtggtctaaat

SEQ ID NO: 663446 - DNA, 20 bp, mouse
gggaccgcgcgcccagcctc

SEQ ID NO: 663447 - DNA, 20 bp, mouse
gcgcgcgggctggacgcccg

SEQ ID NO: 663448 - DNA, 20 bp, mouse
gtcccgagcaacacgtggaa

SEQ ID NO: 663449 - DNA, 20 bp, mouse
ggcgcctcccgagcaacacg

SEQ ID NO: 663450 - DNA, 20 bp, mouse
gctggccgcggcaaacactc

SEQ ID NO: 663451 - DNA, 20 bp, mouse
gcacgtggaacggaatgtcg

SEQ ID NO: 663452 - DNA, 20 bp, mouse
ggggctggacgcccgaggct

SEQ ID NO: 663453 - DNA, 20 bp, mouse
gcgccaccgcctggaccggg

SEQ ID NO: 663454 - DNA, 20 bp, mouse
ggggtcgtctgtgctcgtct

SEQ ID NO: 663455 - DNA, 20 bp, mouse
gacaggttcctcacctgcgc

SEQ ID NO: 663456 - DNA, 20 bp, mouse
ggtcacgcgcatgctccctg

SEQ ID NO: 663457 - DNA, 20 bp, mouse
ggcaaccgccaggcccaaga

SEQ ID NO: 663458 - DNA, 20 bp, mouse
gaccggggtgtcaggataca

SEQ ID NO: 663459 - DNA, 20 bp, mouse
gccaaaccctagtgccctca

SEQ ID NO: 663460 - DNA, 20 bp, mouse
gagggcactagggtttggag

SEQ ID NO: 663461 - DNA, 20 bp, mouse
gcggaagtatgccaccagca

SEQ ID NO: 663462 - DNA, 20 bp, mouse
gcaggccggaagtgcaacgc

SEQ ID NO: 663463 - DNA, 20 bp, mouse
gtgggcctggcggttgccga

SEQ ID NO: 663464 - DNA, 20 bp, mouse
ggggagcatgcgcgtgacgg

SEQ ID NO: 663465 - DNA, 20 bp, mouse
ggcggcctcaggggcgccga

SEQ ID NO: 663466 - DNA, 20 bp, mouse
gctaggaagcagcaggtggt

SEQ ID NO: 663467 - DNA, 20 bp, mouse
gaaagcctccctgaacctgg

SEQ ID NO: 663468 - DNA, 20 bp, mouse
ggagaaatgagtctgagcaa

SEQ ID NO: 663469 - DNA, 20 bp, mouse
gtgggaagagagaaatcgga

SEQ ID NO: 663470 - DNA, 20 bp, mouse
ggagagaaatcggaggggag

SEQ ID NO: 663471 - DNA, 20 bp, mouse
gaggaggcgtggcccggcct

SEQ ID NO: 663472 - DNA, 20 bp, mouse
gacatcccccaggttcaggg

SEQ ID NO: 663473 - DNA, 20 bp, mouse
gggcgggagctaggaaaagg

SEQ ID NO: 663474 - DNA, 20 bp, mouse
ggtgaaagcctccctgaacc

SEQ ID NO: 663475 - DNA, 20 bp, mouse
gtccagctccagctatttcc

SEQ ID NO: 663476 - DNA, 20 bp, mouse
gtcccggtccccaggaaccc

SEQ ID NO: 663477 - DNA, 20 bp, mouse
gtacctgcggtgtccccgga

SEQ ID NO: 663478 - DNA, 20 bp, mouse
gtgtgctcaagatggacaga

SEQ ID NO: 663479 - DNA, 20 bp, mouse
gtaaatacctgcggtgtccc

SEQ ID NO: 663480 - DNA, 20 bp, mouse
gcgcggcgctgcacgggcgg

SEQ ID NO: 663481 - DNA, 20 bp, mouse
gaagggggcgcgcacactca

SEQ ID NO: 663482 - DNA, 20 bp, mouse
gtgccctccggggacaccgc

SEQ ID NO: 663483 - DNA, 20 bp, mouse
gcacactcagggaatcgcgc

SEQ ID NO: 663484 - DNA, 20 bp, mouse
gagacttctgggtgccctcc

SEQ ID NO: 663485 - DNA, 20 bp, mouse
gtgtgcgcgcccccttccgg

SEQ ID NO: 663486 - DNA, 20 bp, mouse
gaggtgacgcaatctgtctg

SEQ ID NO: 663487 - DNA, 20 bp, mouse
ggctccaggcagccaatagg

SEQ ID NO: 663488 - DNA, 20 bp, mouse
ggtgagtcgggaggggtctc

SEQ ID NO: 663489 - DNA, 20 bp, mouse
ggacccctcccgactcacca

SEQ ID NO: 663490 - DNA, 20 bp, mouse
gaggcagccaataggtggaa

SEQ ID NO: 663491 - DNA, 20 bp, mouse
gggggctccaggcagccaat

SEQ ID NO: 663492 - DNA, 20 bp, mouse
gtaggcacggacttaggtgg

SEQ ID NO: 663493 - DNA, 20 bp, mouse
gccgccgtggtgagtcggga

SEQ ID NO: 663494 - DNA, 20 bp, mouse
gttcccgctaattttaaggg

SEQ ID NO: 663495 - DNA, 20 bp, mouse
gatggggcccttccacctat

SEQ ID NO: 663496 - DNA, 20 bp, mouse
gctgaggaaccgggtaggag

SEQ ID NO: 663497 - DNA, 20 bp, mouse
gcggtcagagctctgattgg

SEQ ID NO: 663498 - DNA, 20 bp, mouse
gcattgctgaggaaccgggt

SEQ ID NO: 663499 - DNA, 20 bp, mouse
gagcaatgacctcaaagaca

SEQ ID NO: 663500 - DNA, 20 bp, mouse
ggggacctgaacctcgtagc

SEQ ID NO: 663501 - DNA, 20 bp, mouse
ggaggtcattgctgaggaac

SEQ ID NO: 663502 - DNA, 20 bp, mouse
ggtgggcagcaaaaggttgt

SEQ ID NO: 663503 - DNA, 20 bp, mouse
gacgaggttcaggtccccat

SEQ ID NO: 663504 - DNA, 20 bp, mouse
gttcaggtccccattggagt

SEQ ID NO: 663505 - DNA, 20 bp, mouse
gagctccagctatgacgtta

SEQ ID NO: 663506 - DNA, 20 bp, mouse
ggaagagggcggggcggtga

SEQ ID NO: 663507 - DNA, 20 bp, mouse
gccctcgcgcgcagcctcct

SEQ ID NO: 663508 - DNA, 20 bp, mouse
gagtgacgcgagagcttctg

SEQ ID NO: 663509 - DNA, 20 bp, mouse
gacaccctcctgaactgcct

SEQ ID NO: 663510 - DNA, 20 bp, mouse
gtccgactataggaggggag

SEQ ID NO: 663511 - DNA, 20 bp, mouse
gggttcgtagcatgcttagt

SEQ ID NO: 663512 - DNA, 20 bp, mouse
gggactcagcgtggcatccc

SEQ ID NO: 663513 - DNA, 20 bp, mouse
gaaagggcaggctgatctag

SEQ ID NO: 663514 - DNA, 20 bp, mouse
gcatgggccgtgaagtcctt

SEQ ID NO: 663515 - DNA, 20 bp, mouse
ggggcaggctgatctagtgg

SEQ ID NO: 663516 - DNA, 20 bp, mouse
gctgtcccgcggcaagggcg

SEQ ID NO: 663517 - DNA, 20 bp, mouse
gggcattgagagttcatcta

SEQ ID NO: 663518 - DNA, 20 bp, mouse
gcccagctgtcccgcggcaa

SEQ ID NO: 663519 - DNA, 20 bp, mouse
ggccatcggggtgataaaaa

SEQ ID NO: 663520 - DNA, 20 bp, mouse
gaactctcaatgccctttca

SEQ ID NO: 663521 - DNA, 20 bp, mouse
ggcggggtttgtgactcagt

SEQ ID NO: 663522 - DNA, 20 bp, mouse
gcaaaccccgcccttgccgc

SEQ ID NO: 663523 - DNA, 20 bp, mouse
ggccttttttatcaccccga

SEQ ID NO: 663524 - DNA, 20 bp, mouse
gtatcaccccgatggcaaac

SEQ ID NO: 663525 - DNA, 20 bp, mouse
gaaaaaccagtttgccatcg

SEQ ID NO: 663526 - DNA, 20 bp, mouse
gcctccctccgagggctgaa

SEQ ID NO: 663527 - DNA, 20 bp, mouse
gggtccggaggagcacggag

SEQ ID NO: 663528 - DNA, 20 bp, mouse
gagccccttcagccctcgga

SEQ ID NO: 663529 - DNA, 20 bp, mouse
gtgcagaccctctcccgctg

SEQ ID NO: 663530 - DNA, 20 bp, mouse
gcccaagccccagcgggaga

SEQ ID NO: 663531 - DNA, 20 bp, mouse
gctgacgcgcagggagggtc

SEQ ID NO: 663532 - DNA, 20 bp, mouse
gctgaaggggctgacgcgca

SEQ ID NO: 663533 - DNA, 20 bp, mouse
gcagccgctccgtgctcctc

SEQ ID NO: 663534 - DNA, 20 bp, mouse
gcccgctggggcttggggtc

SEQ ID NO: 663535 - DNA, 20 bp, mouse
gagctccgagcgctggggtg

SEQ ID NO: 663536 - DNA, 20 bp, mouse
gcggggcggggtgatgtaac

SEQ ID NO: 663537 - DNA, 20 bp, mouse
gcccgcctgcacttagtgtt

SEQ ID NO: 663538 - DNA, 20 bp, mouse
gagaactcagtctaggtgaa

SEQ ID NO: 663539 - DNA, 20 bp, mouse
ggctcttgtcagagtgagaa

SEQ ID NO: 663540 - DNA, 20 bp, mouse
gttctcaaatagcttacccc

SEQ ID NO: 663541 - DNA, 20 bp, mouse
gaaaggatctctgtctgttc

SEQ ID NO: 663542 - DNA, 20 bp, mouse
gtgggatttgaaggcgatct

SEQ ID NO: 663543 - DNA, 20 bp, mouse
ggtgactgataaattgttcc

SEQ ID NO: 663544 - DNA, 20 bp, mouse
ggtgggtgtgtgtcgaatta

SEQ ID NO: 663545 - DNA, 20 bp, mouse
gaaaggcagccagcttttgc

SEQ ID NO: 663546 - DNA, 20 bp, mouse
gttggctagggtgtcgtcat

SEQ ID NO: 663547 - DNA, 20 bp, mouse
ggacagcatcaccttggcta

SEQ ID NO: 663548 - DNA, 20 bp, mouse
gcgggcagacagcatcacct

SEQ ID NO: 663549 - DNA, 20 bp, mouse
gtgctgactgtaaacatagg

SEQ ID NO: 663550 - DNA, 20 bp, mouse
gagcatgcctagggaatgac

SEQ ID NO: 663551 - DNA, 20 bp, mouse
ggtcctgtagtttttctaat

SEQ ID NO: 663552 - DNA, 20 bp, mouse
gaaagcttgaaaccgtgagc

SEQ ID NO: 663553 - DNA, 20 bp, mouse
ggtttacagtcagcaggcgg

SEQ ID NO: 663554 - DNA, 20 bp, mouse
gcttccaggaggccctgctt

SEQ ID NO: 663555 - DNA, 20 bp, mouse
gacttacaggggtgaggctg

SEQ ID NO: 663556 - DNA, 20 bp, mouse
gagggtaataagtcgaactg

SEQ ID NO: 663557 - DNA, 20 bp, mouse
ggggctgtgagtacaagcag

SEQ ID NO: 663558 - DNA, 20 bp, mouse
gaatctgatgggcttctatt

SEQ ID NO: 663559 - DNA, 20 bp, mouse
ggttcaggtctaaatctgat

SEQ ID NO: 663560 - DNA, 20 bp, mouse
gtgtaggggctaggatgacg

SEQ ID NO: 663561 - DNA, 20 bp, mouse
ggggtggggaggagtagatt

SEQ ID NO: 663562 - DNA, 20 bp, mouse
gaggggccactgtttcccaa

SEQ ID NO: 663563 - DNA, 20 bp, mouse
gttgcaggctctaaattgct

SEQ ID NO: 663564 - DNA, 20 bp, mouse
gcaagtgctctgtatcgttc

SEQ ID NO: 663565 - DNA, 20 bp, mouse
gtctaaattgctgggctgta

SEQ ID NO: 663566 - DNA, 20 bp, mouse
gagaaggagggacacagtcc

SEQ ID NO: 663567 - DNA, 20 bp, mouse
ggagccttctaaacaggtgc

SEQ ID NO: 663568 - DNA, 20 bp, mouse
gcagtcctggctgtacccac

SEQ ID NO: 663569 - DNA, 20 bp, mouse
gctggctgtacccacaggat

SEQ ID NO: 663570 - DNA, 20 bp, mouse
gaggcatccacctcatgact

SEQ ID NO: 663571 - DNA, 20 bp, mouse
gctgccagcacctgtttaga

SEQ ID NO: 663572 - DNA, 20 bp, mouse
gcatgaggtggatgcctagt

SEQ ID NO: 663573 - DNA, 20 bp, mouse
ggcaggcagctggagagaag

SEQ ID NO: 663574 - DNA, 20 bp, mouse
gtttcaggagccttctaaac

SEQ ID NO: 663575 - DNA, 20 bp, mouse
gtgacctactggagctgtgt

SEQ ID NO: 663576 - DNA, 20 bp, mouse
gggcccccgaggggtgctca

SEQ ID NO: 663577 - DNA, 20 bp, mouse
ggggccatctgggaaggtct

SEQ ID NO: 663578 - DNA, 20 bp, mouse
gggtgctcagggtagagtca

SEQ ID NO: 663579 - DNA, 20 bp, mouse
gcccgcctctgggcccgctg

SEQ ID NO: 663580 - DNA, 20 bp, mouse
gtaccctgagcacccctcgg

SEQ ID NO: 663581 - DNA, 20 bp, mouse
gcacccctcgggggccatct

SEQ ID NO: 663582 - DNA, 20 bp, mouse
gttcccagatggcccccgag

SEQ ID NO: 663583 - DNA, 20 bp, mouse
gaggtgggtgtcaagtacgg

SEQ ID NO: 663584 - DNA, 20 bp, mouse
gctaggcaagatctccttga

SEQ ID NO: 663585 - DNA, 20 bp, mouse
gccagtagggccagccacag

SEQ ID NO: 663586 - DNA, 20 bp, mouse
gtggcacgccccaccgagga

SEQ ID NO: 663587 - DNA, 20 bp, mouse
gtaccactccctcctcggtg

SEQ ID NO: 663588 - DNA, 20 bp, mouse
gtcctccaacccagcctcta

SEQ ID NO: 663589 - DNA, 20 bp, mouse
gaggcaaatgggccctatca

SEQ ID NO: 663590 - DNA, 20 bp, mouse
gcatttgcctagtgatgctt

SEQ ID NO: 663591 - DNA, 20 bp, mouse
gacactcagggatggcccca

SEQ ID NO: 663592 - DNA, 20 bp, mouse
ggggctgcatggaaggtgag

SEQ ID NO: 663593 - DNA, 20 bp, mouse
gacggaggcttggacactca

SEQ ID NO: 663594 - DNA, 20 bp, mouse
gcggtggggcgtgccacact

SEQ ID NO: 663595 - DNA, 20 bp, mouse
ggacaggcaaattctgggtg

SEQ ID NO: 663596 - DNA, 20 bp, mouse
ggggacacacaggtgaagtg

SEQ ID NO: 663597 - DNA, 20 bp, mouse
gacgcgggcaggggtcactg

SEQ ID NO: 663598 - DNA, 20 bp, mouse
ggagtcggagacctgagcga

SEQ ID NO: 663599 - DNA, 20 bp, mouse
gtgacccctgcccgcgtaat

SEQ ID NO: 663600 - DNA, 20 bp, mouse
gcgcggcgggcccattacgc

SEQ ID NO: 663601 - DNA, 20 bp, mouse
gggagccttgcggtgaggtc

SEQ ID NO: 663602 - DNA, 20 bp, mouse
gcagaccagcaccctcgctc

SEQ ID NO: 663603 - DNA, 20 bp, mouse
gcgggcccattacgcgggca

SEQ ID NO: 663604 - DNA, 20 bp, mouse
gcccccaggcgcgcccggcg

SEQ ID NO: 663605 - DNA, 20 bp, mouse
gcctgcgtagcgaaatctgg

SEQ ID NO: 663606 - DNA, 20 bp, mouse
ggggtctcccggagagttgg

SEQ ID NO: 663607 - DNA, 20 bp, mouse
gagaagccgcaaccgcgttc

SEQ ID NO: 663608 - DNA, 20 bp, mouse
gccgcaaagtagctcctgcc

SEQ ID NO: 663609 - DNA, 20 bp, mouse
ggcgcggcgcgagcaagcaa

SEQ ID NO: 663610 - DNA, 20 bp, mouse
gagagaaagtgacgcattgc

SEQ ID NO: 663611 - DNA, 20 bp, mouse
gcggaggagcaccgcggtgg

SEQ ID NO: 663612 - DNA, 20 bp, mouse
gcagtgactgcggagaaagg

SEQ ID NO: 663613 - DNA, 20 bp, mouse
ggggggacggatgacgtaag

SEQ ID NO: 663614 - DNA, 20 bp, mouse
ggcgcggaggagcaccgcgg

SEQ ID NO: 663615 - DNA, 20 bp, mouse
gggttcccccggccttttaa

SEQ ID NO: 663616 - DNA, 20 bp, mouse
gggagcgcgcgagccgtctg

SEQ ID NO: 663617 - DNA, 20 bp, mouse
gaggggctaagacggaaaca

SEQ ID NO: 663618 - DNA, 20 bp, mouse
gcacgaggcgggtccaatag

SEQ ID NO: 663619 - DNA, 20 bp, mouse
gcgccccaacggtccctcaa

SEQ ID NO: 663620 - DNA, 20 bp, mouse
gctgacgcgaagggatccgt

SEQ ID NO: 663621 - DNA, 20 bp, mouse
gcgcacgagcctgacgcgaa

SEQ ID NO: 663622 - DNA, 20 bp, mouse
gcagggaaggccggaccaat

SEQ ID NO: 663623 - DNA, 20 bp, mouse
gtggagccgcgaggaataga

SEQ ID NO: 663624 - DNA, 20 bp, mouse
gagagcgaaagtagtccccg

SEQ ID NO: 663625 - DNA, 20 bp, mouse
ggcggaagggcaccggttta

SEQ ID NO: 663626 - DNA, 20 bp, mouse
gtagtgctgggcaagaaaag

SEQ ID NO: 663627 - DNA, 20 bp, mouse
gtgggcaagaaaagaggatg

SEQ ID NO: 663628 - DNA, 20 bp, mouse
ggaaggctataggtaaatct

SEQ ID NO: 663629 - DNA, 20 bp, mouse
gcgagtgcagtgaaggctat

SEQ ID NO: 663630 - DNA, 20 bp, mouse
ggcactagcgagtgcagtga

SEQ ID NO: 663631 - DNA, 20 bp, mouse
gaggtaaatctaggaagact

SEQ ID NO: 663632 - DNA, 20 bp, mouse
gtaggcagatgtctatgcag

SEQ ID NO: 663633 - DNA, 20 bp, mouse
gggaggagcatcatgcctga

SEQ ID NO: 663634 - DNA, 20 bp, mouse
gccctcctctccttgccctc

SEQ ID NO: 663635 - DNA, 20 bp, mouse
gccacaggggaagtgtgtct

SEQ ID NO: 663636 - DNA, 20 bp, mouse
gcctaccagaccaacgatgg

SEQ ID NO: 663637 - DNA, 20 bp, mouse
gtggccttcaggcaaccaca

SEQ ID NO: 663638 - DNA, 20 bp, mouse
gccaagagcagcaaccaggc

SEQ ID NO: 663639 - DNA, 20 bp, mouse
gcaggcaaccacaggggcgg

SEQ ID NO: 663640 - DNA, 20 bp, mouse
gcagggtcctcccccatcgt

SEQ ID NO: 663641 - DNA, 20 bp, mouse
ggagtccaagagcagcaacc

SEQ ID NO: 663642 - DNA, 20 bp, mouse
gtgaccgctgccggccctgc

SEQ ID NO: 663643 - DNA, 20 bp, mouse
gtcgttggtctggtaggatt

SEQ ID NO: 663644 - DNA, 20 bp, mouse
gtcctcccccatcgttggtc

SEQ ID NO: 663645 - DNA, 20 bp, mouse
gacaccagcagggccggcag

SEQ ID NO: 663646 - DNA, 20 bp, mouse
gtgcccccaccgtcctgaga

SEQ ID NO: 663647 - DNA, 20 bp, mouse
gcctgagaagggtgattgtg

SEQ ID NO: 663648 - DNA, 20 bp, mouse
gtggaggcccctgcccccgg

SEQ ID NO: 663649 - DNA, 20 bp, mouse
gcccctgcccccggaggctg

SEQ ID NO: 663650 - DNA, 20 bp, mouse
gtcacccttctcaggacggt

SEQ ID NO: 663651 - DNA, 20 bp, mouse
gctccaggagagtctgtaaa

SEQ ID NO: 663652 - DNA, 20 bp, mouse
ggcagagccccagcctccgg

SEQ ID NO: 663653 - DNA, 20 bp, mouse
gcgtgtgcgcgcgtgctatc

SEQ ID NO: 663654 - DNA, 20 bp, mouse
gtcaaattccggctgagtag

SEQ ID NO: 663655 - DNA, 20 bp, mouse
gaagcctaacttctgaaagg

SEQ ID NO: 663656 - DNA, 20 bp, mouse
ggaaaagataggactatcgt

SEQ ID NO: 663657 - DNA, 20 bp, mouse
ggaggggaccctgattaact

SEQ ID NO: 663658 - DNA, 20 bp, mouse
gccagccaacggagaggtgg

SEQ ID NO: 663659 - DNA, 20 bp, mouse
ggccaagggagtttgggcac

SEQ ID NO: 663660 - DNA, 20 bp, mouse
gtcagccaccacctctccgt

SEQ ID NO: 663661 - DNA, 20 bp, mouse
gcctgctgccaagggagttt

SEQ ID NO: 663662 - DNA, 20 bp, mouse
ggctcaggcggcaggccagg

SEQ ID NO: 663663 - DNA, 20 bp, mouse
gggaccagccaacggagagg

SEQ ID NO: 663664 - DNA, 20 bp, mouse
gcagtcatccaagttaatca

SEQ ID NO: 663665 - DNA, 20 bp, mouse
ggcctgccgcctgagctgca

SEQ ID NO: 663666 - DNA, 20 bp, mouse
ggggacgcgggatgagaggt

SEQ ID NO: 663667 - DNA, 20 bp, mouse
ggggactcaggtgtaaccgt

SEQ ID NO: 663668 - DNA, 20 bp, mouse
gggaagaaggagttaaggta

SEQ ID NO: 663669 - DNA, 20 bp, mouse
gggaggaggtgtcgacggaa

SEQ ID NO: 663670 - DNA, 20 bp, mouse
ggagtccccaaatgccatgg

SEQ ID NO: 663671 - DNA, 20 bp, mouse
gcgtagacatagcgaaggga

SEQ ID NO: 663672 - DNA, 20 bp, mouse
gcacaggcagacacacgcgg

SEQ ID NO: 663673 - DNA, 20 bp, mouse
gaattggcgaatgtgaacgt

SEQ ID NO: 663674 - DNA, 20 bp, mouse
gtctggggctctagggacgc

SEQ ID NO: 663675 - DNA, 20 bp, mouse
ggggacgggccacatgttct

SEQ ID NO: 663676 - DNA, 20 bp, mouse
gagggtcgaccacgcgttgt

SEQ ID NO: 663677 - DNA, 20 bp, mouse
gacgcgtggtcgaccctcat

SEQ ID NO: 663678 - DNA, 20 bp, mouse
gaactgggaagcaatggaaa

SEQ ID NO: 663679 - DNA, 20 bp, mouse
gacgccccctggtggggtgg

SEQ ID NO: 663680 - DNA, 20 bp, mouse
gactctcagcagcaagggcg

SEQ ID NO: 663681 - DNA, 20 bp, mouse
ggggcgtcccccacaacgcg

SEQ ID NO: 663682 - DNA, 20 bp, mouse
gccgctagcccactcaggca

SEQ ID NO: 663683 - DNA, 20 bp, mouse
gtcagcggctgtgtcaggtt

SEQ ID NO: 663684 - DNA, 20 bp, mouse
gaggctgtggctcggaacgc

SEQ ID NO: 663685 - DNA, 20 bp, mouse
gcagcagcaagggcggggtt

SEQ ID NO: 663686 - DNA, 20 bp, mouse
gcactggggcctatactttg

SEQ ID NO: 663687 - DNA, 20 bp, mouse
gatgacctggggacgctaat

SEQ ID NO: 663688 - DNA, 20 bp, mouse
gtactggtcccgtgacgccc

SEQ ID NO: 663689 - DNA, 20 bp, mouse
gcaactcaggtcacaatccc

SEQ ID NO: 663690 - DNA, 20 bp, mouse
gtgatcaagtgggttggcaa

SEQ ID NO: 663691 - DNA, 20 bp, mouse
gtcacaatcccgggcgtcac

SEQ ID NO: 663692 - DNA, 20 bp, mouse
ggacctcacagtgatcaagt

SEQ ID NO: 663693 - DNA, 20 bp, mouse
gtgtgacctgagttgctcat

SEQ ID NO: 663694 - DNA, 20 bp, mouse
gtagagactacatttcccgt

SEQ ID NO: 663695 - DNA, 20 bp, mouse
ggatggggcatgatccctta

SEQ ID NO: 663696 - DNA, 20 bp, mouse
gactcccacaacagagcact

SEQ ID NO: 663697 - DNA, 20 bp, mouse
gtgtcaaccctggccagcct

SEQ ID NO: 663698 - DNA, 20 bp, mouse
ggggcaacttgccaagtgcc

SEQ ID NO: 663699 - DNA, 20 bp, mouse
gataacttagaaggtaatat

SEQ ID NO: 663700 - DNA, 20 bp, mouse
ggtaatattggtggctatcc

SEQ ID NO: 663701 - DNA, 20 bp, mouse
gggaaggcttgcgtgtgttg

SEQ ID NO: 663702 - DNA, 20 bp, mouse
ggcgggaagactgtcaaccc

SEQ ID NO: 663703 - DNA, 20 bp, mouse
ggcctcccagtgctctgttg

SEQ ID NO: 663704 - DNA, 20 bp, mouse
gccaaggattgaactcagcc

SEQ ID NO: 663705 - DNA, 20 bp, mouse
gagctcactgtttttgagcc

SEQ ID NO: 663706 - DNA, 20 bp, mouse
gtggcagcttgagctagaag

SEQ ID NO: 663707 - DNA, 20 bp, mouse
gcagcagtcgaaaactgcaa

SEQ ID NO: 663708 - DNA, 20 bp, mouse
gggactgggcaccgagtgtt

SEQ ID NO: 663709 - DNA, 20 bp, mouse
ggagctgggccctgcgtgag

SEQ ID NO: 663710 - DNA, 20 bp, mouse
gtgggactcgggttggtccc

SEQ ID NO: 663711 - DNA, 20 bp, mouse
gaaggcaagcccaagcccat

SEQ ID NO: 663712 - DNA, 20 bp, mouse
gtgggcaccgagtgtttggg

SEQ ID NO: 663713 - DNA, 20 bp, mouse
gtcaagctgccaaatggctc

SEQ ID NO: 663714 - DNA, 20 bp, mouse
gaatgtgttttgctttggca

SEQ ID NO: 663715 - DNA, 20 bp, mouse
gctcactgccccataggtaa

SEQ ID NO: 663716 - DNA, 20 bp, mouse
gcgggctgggcaacccgagc

SEQ ID NO: 663717 - DNA, 20 bp, mouse
ggcaactcggcgcgctcgcg

SEQ ID NO: 663718 - DNA, 20 bp, mouse
gcccccatccgacttgtcgg

SEQ ID NO: 663719 - DNA, 20 bp, mouse
gacaatcgcgtggccgggat

SEQ ID NO: 663720 - DNA, 20 bp, mouse
gacccccgacaagtcggatg

SEQ ID NO: 663721 - DNA, 20 bp, mouse
gcacgcgattgtgagaccaa

SEQ ID NO: 663722 - DNA, 20 bp, mouse
gtcgggttgcccagcccgtg

SEQ ID NO: 663723 - DNA, 20 bp, mouse
gcggcgcgctcgcggggacg

SEQ ID NO: 663724 - DNA, 20 bp, mouse
ggtcagcagtgatcgtgccg

SEQ ID NO: 663725 - DNA, 20 bp, mouse
gcagtgatcgtgccggggat

SEQ ID NO: 663726 - DNA, 20 bp, mouse
gggggccagcatgtgtgcgt

SEQ ID NO: 663727 - DNA, 20 bp, mouse
gtgcagagatctgccgtggg

SEQ ID NO: 663728 - DNA, 20 bp, mouse
gggcctcacaccccctccca

SEQ ID NO: 663729 - DNA, 20 bp, mouse
gcagggatgcagtgtagatg

SEQ ID NO: 663730 - DNA, 20 bp, mouse
gacagtgcagagatctgccg

SEQ ID NO: 663731 - DNA, 20 bp, mouse
gacgcagtcgcgggaggaca

SEQ ID NO: 663732 - DNA, 20 bp, mouse
gcaccaggcggggcgggcta

SEQ ID NO: 663733 - DNA, 20 bp, mouse
ggcaatatgtgcgtatggga

SEQ ID NO: 663734 - DNA, 20 bp, mouse
gcaaccacagcctcgctctc

SEQ ID NO: 663735 - DNA, 20 bp, mouse
gtgctgcaggacgcagtcgc

SEQ ID NO: 663736 - DNA, 20 bp, mouse
ggggacgagcactctcggac

SEQ ID NO: 663737 - DNA, 20 bp, mouse
ggcagaggacctggggacta

SEQ ID NO: 663738 - DNA, 20 bp, mouse
ggaggaggagcctgcggcag

SEQ ID NO: 663739 - DNA, 20 bp, mouse
ggactagggacgagcactct

SEQ ID NO: 663740 - DNA, 20 bp, mouse
ggtctcctgctgacgaccaa

SEQ ID NO: 663741 - DNA, 20 bp, mouse
gactctcggactggagaagt

SEQ ID NO: 663742 - DNA, 20 bp, mouse
ggctctgatgtcaatggagg

SEQ ID NO: 663743 - DNA, 20 bp, mouse
ggggcacataagcatgctat

SEQ ID NO: 663744 - DNA, 20 bp, mouse
ggggcctgtaacagaacaac

SEQ ID NO: 663745 - DNA, 20 bp, mouse
gagagccgcaggcgggccga

SEQ ID NO: 663746 - DNA, 20 bp, mouse
ggctgccgggtgcactggga

SEQ ID NO: 663747 - DNA, 20 bp, mouse
ggggatgcagcacttgacca

SEQ ID NO: 663748 - DNA, 20 bp, mouse
gccgaaggccgcctcgcggg

SEQ ID NO: 663749 - DNA, 20 bp, mouse
ggagctccgtgcttgggcgc

SEQ ID NO: 663750 - DNA, 20 bp, mouse
gccccaggagctccgtgctt

SEQ ID NO: 663751 - DNA, 20 bp, mouse
ggacggcctgggagcgtgcg

SEQ ID NO: 663752 - DNA, 20 bp, mouse
gcccggggacccagggtgcg

SEQ ID NO: 663753 - DNA, 20 bp, mouse
gcgccctcgcccggggaccc

SEQ ID NO: 663754 - DNA, 20 bp, mouse
ggggaggctgccgggtgcac

SEQ ID NO: 663755 - DNA, 20 bp, mouse
gtccccgggcgagggcgggt

SEQ ID NO: 663756 - DNA, 20 bp, mouse
gtaaccaggcagccttaaag

SEQ ID NO: 663757 - DNA, 20 bp, mouse
gcagctactcgggcattaaa

SEQ ID NO: 663758 - DNA, 20 bp, mouse
gaggagaggcatcagagatt

SEQ ID NO: 663759 - DNA, 20 bp, mouse
ggctgcctggttacagtcct

SEQ ID NO: 663760 - DNA, 20 bp, mouse
gtttaattccctaggaggga

SEQ ID NO: 663761 - DNA, 20 bp, mouse
gacaacgtgagattaagttg

SEQ ID NO: 663762 - DNA, 20 bp, mouse
ggggagagaagcccctggtt

SEQ ID NO: 663763 - DNA, 20 bp, mouse
gataaacccaattaaagggg

SEQ ID NO: 663764 - DNA, 20 bp, mouse
gcagatacagatccgttcca

SEQ ID NO: 663765 - DNA, 20 bp, mouse
gctacttttactccccttta

SEQ ID NO: 663766 - DNA, 20 bp, mouse
gcccagggtgatgtactgag

SEQ ID NO: 663767 - DNA, 20 bp, mouse
ggggccctatagttggaggt

SEQ ID NO: 663768 - DNA, 20 bp, mouse
ggaaaggcaggcaggtgttg

SEQ ID NO: 663769 - DNA, 20 bp, mouse
ggaacagggcgtttcggagg

SEQ ID NO: 663770 - DNA, 20 bp, mouse
gacagggtccacttgctcct

SEQ ID NO: 663771 - DNA, 20 bp, mouse
gaaaagggccctatagttgg

SEQ ID NO: 663772 - DNA, 20 bp, mouse
ggttggggaggcagttaccg

SEQ ID NO: 663773 - DNA, 20 bp, mouse
gttaccggggcaacgggaac

SEQ ID NO: 663774 - DNA, 20 bp, mouse
gcaatactgcaggactgtgt

SEQ ID NO: 663775 - DNA, 20 bp, mouse
gatgctgacgaaggctcgcg

SEQ ID NO: 663776 - DNA, 20 bp, mouse
gcgtgtgtacggtgcgagtg

SEQ ID NO: 663777 - DNA, 20 bp, mouse
gtaggtgtgcggcgcgctcc

SEQ ID NO: 663778 - DNA, 20 bp, mouse
gcccgcgcctctgcgcgcgt

SEQ ID NO: 663779 - DNA, 20 bp, mouse
gagggtcagacgcagtgcgt

SEQ ID NO: 663780 - DNA, 20 bp, mouse
gaggcgcgtgcaaggggcgg

SEQ ID NO: 663781 - DNA, 20 bp, mouse
ggtgaggcgcgtgcaagggg

SEQ ID NO: 663782 - DNA, 20 bp, mouse
gctctgcgcgcgtaggtgtg

SEQ ID NO: 663783 - DNA, 20 bp, mouse
gcaggtacaaggcgcgggtg

SEQ ID NO: 663784 - DNA, 20 bp, mouse
ggcgagtgaggcgcgtgcaa

SEQ ID NO: 663785 - DNA, 20 bp, mouse
ggggcgctagtgcaggtaca

SEQ ID NO: 663786 - DNA, 20 bp, mouse
gtgcgggagagcagcccgaa

SEQ ID NO: 663787 - DNA, 20 bp, mouse
ggctctcccgcagccgtcta

SEQ ID NO: 663788 - DNA, 20 bp, mouse
gtcccttcggtctccctaga

SEQ ID NO: 663789 - DNA, 20 bp, mouse
gagccgtctagggagaccga

SEQ ID NO: 663790 - DNA, 20 bp, mouse
gagagcagcccgaagggacg

SEQ ID NO: 663791 - DNA, 20 bp, mouse
gggagcgcgcttaaggggac

SEQ ID NO: 663792 - DNA, 20 bp, mouse
ggagaccgaagggagatgcg

SEQ ID NO: 663793 - DNA, 20 bp, mouse
gggctggagtcgctagaggg

SEQ ID NO: 663794 - DNA, 20 bp, mouse
gcgcggctggagtcgctaga

SEQ ID NO: 663795 - DNA, 20 bp, mouse
ggaaccgcgcccagatgcaa

SEQ ID NO: 663796 - DNA, 20 bp, mouse
gcccaggagccgcccgaact

SEQ ID NO: 663797 - DNA, 20 bp, mouse
ggcggggcggggccgacggt

SEQ ID NO: 663798 - DNA, 20 bp, mouse
gcacccgagggccaaggacg

SEQ ID NO: 663799 - DNA, 20 bp, mouse
ggcagggggcccagttcggg

SEQ ID NO: 663800 - DNA, 20 bp, mouse
gggtgggaggcccctccccg

SEQ ID NO: 663801 - DNA, 20 bp, mouse
gccagtgggtggccgggagt

SEQ ID NO: 663802 - DNA, 20 bp, mouse
gccactgggaccgaccgaac

SEQ ID NO: 663803 - DNA, 20 bp, mouse
gagtggggaccccgcgtcct

SEQ ID NO: 663804 - DNA, 20 bp, mouse
ggcctctccccagacctcgg

SEQ ID NO: 663805 - DNA, 20 bp, mouse
gttaccggagagagcgaggg

SEQ ID NO: 663806 - DNA, 20 bp, mouse
gtcagcgcaggcgggacgga

SEQ ID NO: 663807 - DNA, 20 bp, mouse
gcggggcccctcagcgcagg

SEQ ID NO: 663808 - DNA, 20 bp, mouse
gggaacccgaagcagtggga

SEQ ID NO: 663809 - DNA, 20 bp, mouse
gggcgggacggagggaacgg

SEQ ID NO: 663810 - DNA, 20 bp, mouse
gcgcgcacaggctccgggtc

SEQ ID NO: 663811 - DNA, 20 bp, mouse
gaaagcgaggcgccagagga

SEQ ID NO: 663812 - DNA, 20 bp, mouse
ggagggaggaggggacccgt

SEQ ID NO: 663813 - DNA, 20 bp, mouse
gatagagggtcggagaagga

SEQ ID NO: 663814 - DNA, 20 bp, mouse
gcggctggctgtgactcccg

SEQ ID NO: 663815 - DNA, 20 bp, mouse
ggcaggcgggacggagggaa

SEQ ID NO: 663816 - DNA, 20 bp, mouse
gcgactgcggcagagaacgg

SEQ ID NO: 663817 - DNA, 20 bp, mouse
ggacgatgagcgcccgactg

SEQ ID NO: 663818 - DNA, 20 bp, mouse
ggcggggcccagcggttcga

SEQ ID NO: 663819 - DNA, 20 bp, mouse
ggggccccgcctctttccgc

SEQ ID NO: 663820 - DNA, 20 bp, mouse
ggggcccgggggaaccgcag

SEQ ID NO: 663821 - DNA, 20 bp, mouse
gggaaccggccagcggaaag

SEQ ID NO: 663822 - DNA, 20 bp, mouse
ggagggagtccggtgatccc

SEQ ID NO: 663823 - DNA, 20 bp, mouse
gcccacgtggcggccattcc

SEQ ID NO: 663824 - DNA, 20 bp, mouse
ggtggaggcggggcgggaac

SEQ ID NO: 663825 - DNA, 20 bp, mouse
ggcccgactgcggcagagaa

SEQ ID NO: 663826 - DNA, 20 bp, mouse
gcctccgcgctcgggagcga

SEQ ID NO: 663827 - DNA, 20 bp, mouse
gtgctctcccttccaggctg

SEQ ID NO: 663828 - DNA, 20 bp, mouse
gaggaggaagatgcacgcgg

SEQ ID NO: 663829 - DNA, 20 bp, mouse
ggctccgggttcccctgcgc

SEQ ID NO: 663830 - DNA, 20 bp, mouse
gtgcccgagaccgcgagcac

SEQ ID NO: 663831 - DNA, 20 bp, mouse
gcaggagccggcagcttaga

SEQ ID NO: 663832 - DNA, 20 bp, mouse
gcggaggcgagcaccaggag

SEQ ID NO: 663833 - DNA, 20 bp, mouse
ggggaccaacaaggggtgac

SEQ ID NO: 663834 - DNA, 20 bp, mouse
gcgcgctcgggagcgagggc

SEQ ID NO: 663835 - DNA, 20 bp, mouse
gacccggagccaccgccagc

SEQ ID NO: 663836 - DNA, 20 bp, mouse
gcgggaggggccctgcggat

SEQ ID NO: 663837 - DNA, 20 bp, mouse
gcgcgccggcccacgatcat

SEQ ID NO: 663838 - DNA, 20 bp, mouse
ggcgtcggggcccatccgca

SEQ ID NO: 663839 - DNA, 20 bp, mouse
ggtccctcaggccacgtcgt

SEQ ID NO: 663840 - DNA, 20 bp, mouse
gtacccctgggcgggaggac

SEQ ID NO: 663841 - DNA, 20 bp, mouse
gcgacgggatcgggaggagg

SEQ ID NO: 663842 - DNA, 20 bp, mouse
gccggcgcccgcagacaagc

SEQ ID NO: 663843 - DNA, 20 bp, mouse
gcggcacagccaatgatcgt

SEQ ID NO: 663844 - DNA, 20 bp, mouse
gcgcccaggggtagaggggg

SEQ ID NO: 663845 - DNA, 20 bp, mouse
gtctcgacgggatcgggagg

SEQ ID NO: 663846 - DNA, 20 bp, mouse
gcccgcggagacttaagtag

SEQ ID NO: 663847 - DNA, 20 bp, mouse
ggcggcgtggagcatctcgc

SEQ ID NO: 663848 - DNA, 20 bp, mouse
gaggccgcaagtttgggagt

SEQ ID NO: 663849 - DNA, 20 bp, mouse
gccgcgcgcgccgggtcccg

SEQ ID NO: 663850 - DNA, 20 bp, mouse
gtccacgctcagggacaaag

SEQ ID NO: 663851 - DNA, 20 bp, mouse
gggagacttaagtagcggcg

SEQ ID NO: 663852 - DNA, 20 bp, mouse
gcgcgtgcccgccgcagcct

SEQ ID NO: 663853 - DNA, 20 bp, mouse
ggactcgcgcaggggcgaac

SEQ ID NO: 663854 - DNA, 20 bp, mouse
gagacccactcccaaacttg

SEQ ID NO: 663855 - DNA, 20 bp, mouse
gaggggtggtggctgcggaa

SEQ ID NO: 663856 - DNA, 20 bp, mouse
gagggcgagccggagtggga

SEQ ID NO: 663857 - DNA, 20 bp, mouse
ggaaatgcggaattcgggga

SEQ ID NO: 663858 - DNA, 20 bp, mouse
gggctcgccctcacttaaga

SEQ ID NO: 663859 - DNA, 20 bp, mouse
gccacagtcccctcccactc

SEQ ID NO: 663860 - DNA, 20 bp, mouse
gagtgagggcgagccggagt

SEQ ID NO: 663861 - DNA, 20 bp, mouse
ggcgaaatgcgcttccctat

SEQ ID NO: 663862 - DNA, 20 bp, mouse
gtggtggccatcttaagtga

SEQ ID NO: 663863 - DNA, 20 bp, mouse
gaagacagctggacgagcga

SEQ ID NO: 663864 - DNA, 20 bp, mouse
gtccggtattagcgtctcct

SEQ ID NO: 663865 - DNA, 20 bp, mouse
ggtcctgacagggaagaagt

SEQ ID NO: 663866 - DNA, 20 bp, mouse
gagggagggcgcatgcaggt

SEQ ID NO: 663867 - DNA, 20 bp, mouse
gagactggaatcccactcga

SEQ ID NO: 663868 - DNA, 20 bp, mouse
gcatgcgccctccctcgagt

SEQ ID NO: 663869 - DNA, 20 bp, mouse
gtggaatcccactcgaggga

SEQ ID NO: 663870 - DNA, 20 bp, mouse
gagactcaaaacccagcaac

SEQ ID NO: 663871 - DNA, 20 bp, mouse
gccagtctccgggtctgcca

SEQ ID NO: 663872 - DNA, 20 bp, mouse
gcaaccctttggatcagggt

SEQ ID NO: 663873 - DNA, 20 bp, mouse
gaatcccgaagtaaggagtt

SEQ ID NO: 663874 - DNA, 20 bp, mouse
gacacctgctaggctcactt

SEQ ID NO: 663875 - DNA, 20 bp, mouse
gttccccaaccctgatccaa

SEQ ID NO: 663876 - DNA, 20 bp, mouse
gccaaggagcagagacgcgt

SEQ ID NO: 663877 - DNA, 20 bp, mouse
gcagctgtgaggtaacctgg

SEQ ID NO: 663878 - DNA, 20 bp, mouse
gctgccgccatgttcagtga

SEQ ID NO: 663879 - DNA, 20 bp, mouse
ggcgagccaacttaggaaga

SEQ ID NO: 663880 - DNA, 20 bp, mouse
ggagcactgcgagccaactt

SEQ ID NO: 663881 - DNA, 20 bp, mouse
gttgccctcactgaacatgg

SEQ ID NO: 663882 - DNA, 20 bp, mouse
gggcttgccctcactgaaca

SEQ ID NO: 663883 - DNA, 20 bp, mouse
gtgagggcaagcccagttca

SEQ ID NO: 663884 - DNA, 20 bp, mouse
gaatcccagggccacgctcc

SEQ ID NO: 663885 - DNA, 20 bp, mouse
gtgcgggtgcgacgctctcc

SEQ ID NO: 663886 - DNA, 20 bp, mouse
gctaaggaatagacagtcac

SEQ ID NO: 663887 - DNA, 20 bp, mouse
gtgccggccagggtgtgggg

SEQ ID NO: 663888 - DNA, 20 bp, mouse
gaaggccatctcaggaagat

SEQ ID NO: 663889 - DNA, 20 bp, mouse
gccattcaaggcctgttctc

SEQ ID NO: 663890 - DNA, 20 bp, mouse
ggatcctcagggcagttgaa

SEQ ID NO: 663891 - DNA, 20 bp, mouse
gggatatgatagtccctctg

SEQ ID NO: 663892 - DNA, 20 bp, mouse
gtggccggcagccaggggca

SEQ ID NO: 663893 - DNA, 20 bp, mouse
gaggatcggagccagagaac

SEQ ID NO: 663894 - DNA, 20 bp, mouse
gaaatctaggctcactccta

SEQ ID NO: 663895 - DNA, 20 bp, mouse
gcgctagcccccccacaccc

SEQ ID NO: 663896 - DNA, 20 bp, mouse
ggctactaaggacacggact

SEQ ID NO: 663897 - DNA, 20 bp, mouse
gtgcgcttgcggagaaaggt

SEQ ID NO: 663898 - DNA, 20 bp, mouse
gctgaagaaggggacaggta

SEQ ID NO: 663899 - DNA, 20 bp, mouse
ggagaaaggtggggctgcgg

SEQ ID NO: 663900 - DNA, 20 bp, mouse
gtacccagagcatctgaaga

SEQ ID NO: 663901 - DNA, 20 bp, mouse
gggcgagcgggcggtgttac

SEQ ID NO: 663902 - DNA, 20 bp, mouse
gggagccttcaggaggaggg

SEQ ID NO: 663903 - DNA, 20 bp, mouse
gggtgtgtccatagctacta

SEQ ID NO: 663904 - DNA, 20 bp, mouse
ggagcgggcggtgttacggg

SEQ ID NO: 663905 - DNA, 20 bp, mouse
gtgcctactctgcaggacca

SEQ ID NO: 663906 - DNA, 20 bp, mouse
ggacactgctggacgaggga

SEQ ID NO: 663907 - DNA, 20 bp, mouse
gtggcggcgcaagacagcgg

SEQ ID NO: 663908 - DNA, 20 bp, mouse
gcagctcagggccaaggcag

SEQ ID NO: 663909 - DNA, 20 bp, mouse
ggcgcggagcccatcgcggg

SEQ ID NO: 663910 - DNA, 20 bp, mouse
gcgggcactgtgctgattaa

SEQ ID NO: 663911 - DNA, 20 bp, mouse
gtgtgctgattaatggatag

SEQ ID NO: 663912 - DNA, 20 bp, mouse
gggggcgcggagcccatcgc

SEQ ID NO: 663913 - DNA, 20 bp, mouse
gaggcgtccggccacgggag

SEQ ID NO: 663914 - DNA, 20 bp, mouse
gaggggtagcggaaaatacg

SEQ ID NO: 663915 - DNA, 20 bp, mouse
gcctcgtccagcagtgtcgg

SEQ ID NO: 663916 - DNA, 20 bp, mouse
gctgcaaagggcggcagtga

SEQ ID NO: 663917 - DNA, 20 bp, mouse
ggtgatggcggatgagggaa

SEQ ID NO: 663918 - DNA, 20 bp, mouse
gctggctcctgggtccacat

SEQ ID NO: 663919 - DNA, 20 bp, mouse
gagaactgagtccaatctgg

SEQ ID NO: 663920 - DNA, 20 bp, mouse
gcggcagtgatggcggatga

SEQ ID NO: 663921 - DNA, 20 bp, mouse
gtggggacccatgtggaccc

SEQ ID NO: 663922 - DNA, 20 bp, mouse
gggaagctttaatgtcagtg

SEQ ID NO: 663923 - DNA, 20 bp, mouse
ggggtccctaagcctctcca

SEQ ID NO: 663924 - DNA, 20 bp, mouse
gatgtcagtggggacccatg

SEQ ID NO: 663925 - DNA, 20 bp, mouse
gcctgggttccgccttgggg

SEQ ID NO: 663926 - DNA, 20 bp, mouse
gggtgatcagccaatggaca

SEQ ID NO: 663927 - DNA, 20 bp, mouse
gtggtcgcgggagccgtgac

SEQ ID NO: 663928 - DNA, 20 bp, mouse
gggatggcccaatcaggatg

SEQ ID NO: 663929 - DNA, 20 bp, mouse
gcaggggtctcactactctc

SEQ ID NO: 663930 - DNA, 20 bp, mouse
gacccctggtgcggtccgat

SEQ ID NO: 663931 - DNA, 20 bp, mouse
gaccaatcggaccgcaccag

SEQ ID NO: 663932 - DNA, 20 bp, mouse
ggtgcggtccgattggtcgc

SEQ ID NO: 663933 - DNA, 20 bp, mouse
gcacggctcccgcgaccaat

SEQ ID NO: 663934 - DNA, 20 bp, mouse
gagtagtgagacccctggtg

SEQ ID NO: 663935 - DNA, 20 bp, mouse
gggtctcactactctccggg

SEQ ID NO: 663936 - DNA, 20 bp, mouse
ggggcgtgggcagaggtcca

SEQ ID NO: 663937 - DNA, 20 bp, mouse
ggagaaccgggatccggagg

SEQ ID NO: 663938 - DNA, 20 bp, mouse
gaacctggggtcagcacact

SEQ ID NO: 663939 - DNA, 20 bp, mouse
ggaggagaaccgggatccgg

SEQ ID NO: 663940 - DNA, 20 bp, mouse
gctcccaattaagggaacgg

SEQ ID NO: 663941 - DNA, 20 bp, mouse
ggggcggggcctcccaatta

SEQ ID NO: 663942 - DNA, 20 bp, mouse
ggcccacaagtcacgtcaat

SEQ ID NO: 663943 - DNA, 20 bp, mouse
gtgacgtgacttgtgggcgc

SEQ ID NO: 663944 - DNA, 20 bp, mouse
gtcagcacacttgggactct

SEQ ID NO: 663945 - DNA, 20 bp, mouse
ggctgaggagaaccgggatc

SEQ ID NO: 663946 - DNA, 20 bp, mouse
gtccccgcagcgccctgcgt

SEQ ID NO: 663947 - DNA, 20 bp, mouse
gacgctcccgttggcccggc

SEQ ID NO: 663948 - DNA, 20 bp, mouse
gcggctgtctgtcttcgcac

SEQ ID NO: 663949 - DNA, 20 bp, mouse
gagagtgcgccgggcagccc

SEQ ID NO: 663950 - DNA, 20 bp, mouse
gcccgccctcctagcgaagg

SEQ ID NO: 663951 - DNA, 20 bp, mouse
ggcggggtcggaggtcaccg

SEQ ID NO: 663952 - DNA, 20 bp, mouse
ggacgggcagtgagcgtcca

SEQ ID NO: 663953 - DNA, 20 bp, mouse
gcctccctgcgacattaaga

SEQ ID NO: 663954 - DNA, 20 bp, mouse
gttcgcacgggccgcctttc

SEQ ID NO: 663955 - DNA, 20 bp, mouse
gcggaatggcaacgcctcga

SEQ ID NO: 663956 - DNA, 20 bp, mouse
gagtcctgctcgggacagga

SEQ ID NO: 663957 - DNA, 20 bp, mouse
gtcaaggcacaatcgggaga

SEQ ID NO: 663958 - DNA, 20 bp, mouse
gtcgggagaaggcgtggtca

SEQ ID NO: 663959 - DNA, 20 bp, mouse
ggagaaggcgtggtcagggc

SEQ ID NO: 663960 - DNA, 20 bp, mouse
ggggtcttcaaggcacaatc

SEQ ID NO: 663961 - DNA, 20 bp, mouse
gcgttacttcagtcctgctc

SEQ ID NO: 663962 - DNA, 20 bp, mouse
gaggactgaagtaacgggcc

SEQ ID NO: 663963 - DNA, 20 bp, mouse
gctcatgcaaacagggacat

SEQ ID NO: 663964 - DNA, 20 bp, mouse
gcttcagtcctgctcgggac

SEQ ID NO: 663965 - DNA, 20 bp, mouse
gcaaagtcaaggggtcttca

SEQ ID NO: 663966 - DNA, 20 bp, mouse
gagactgggtgggcgagtag

SEQ ID NO: 663967 - DNA, 20 bp, mouse
ggcgcagagcagagactggg

SEQ ID NO: 663968 - DNA, 20 bp, mouse
gagcccggcgctcagtgcgc

SEQ ID NO: 663969 - DNA, 20 bp, mouse
ggcaaccgagagtgcggcgc

SEQ ID NO: 663970 - DNA, 20 bp, mouse
gggagcgcgcggccagagtg

SEQ ID NO: 663971 - DNA, 20 bp, mouse
gtcttcctgcgccgcactct

SEQ ID NO: 663972 - DNA, 20 bp, mouse
gaaaggctgccgggaagacg

SEQ ID NO: 663973 - DNA, 20 bp, mouse
ggcctacagccacgtcttcc

SEQ ID NO: 663974 - DNA, 20 bp, mouse
ggcgcctgcgcactgagcgc

SEQ ID NO: 663975 - DNA, 20 bp, mouse
gtccccccgaccttcgtctc

SEQ ID NO: 663976 - DNA, 20 bp, mouse
ggggaaggcgcttcgagcga

SEQ ID NO: 663977 - DNA, 20 bp, mouse
gtccgcccctcgttcctgag

SEQ ID NO: 663978 - DNA, 20 bp, mouse
gcccctagggctattcttcg

SEQ ID NO: 663979 - DNA, 20 bp, mouse
ggggtcgccctagtccctca

SEQ ID NO: 663980 - DNA, 20 bp, mouse
ggggccgtcaccaaacgggc

SEQ ID NO: 663981 - DNA, 20 bp, mouse
gcaggaagtggttgctgatt

SEQ ID NO: 663982 - DNA, 20 bp, mouse
gacacccgccctgagggact

SEQ ID NO: 663983 - DNA, 20 bp, mouse
gccttcccatacgcccccta

SEQ ID NO: 663984 - DNA, 20 bp, mouse
ggcgcccgcccgtttggtga

SEQ ID NO: 663985 - DNA, 20 bp, mouse
gagatcttgcgcaaaggggc

SEQ ID NO: 663986 - DNA, 20 bp, mouse
gcggagagagaatctggctt

SEQ ID NO: 663987 - DNA, 20 bp, mouse
gtcaaaggaagacagctgag

SEQ ID NO: 663988 - DNA, 20 bp, mouse
ggctccgcctccaagggagg

SEQ ID NO: 663989 - DNA, 20 bp, mouse
gtcgcggaggctaatagagt

SEQ ID NO: 663990 - DNA, 20 bp, mouse
gctccggtggcggggaatga

SEQ ID NO: 663991 - DNA, 20 bp, mouse
gccagtgagggcccggaagt

SEQ ID NO: 663992 - DNA, 20 bp, mouse
gcgccaccggagagagaatc

SEQ ID NO: 663993 - DNA, 20 bp, mouse
gcccgaggcccagaccaata

SEQ ID NO: 663994 - DNA, 20 bp, mouse
gggggtgccgcgcccagtga

SEQ ID NO: 663995 - DNA, 20 bp, mouse
gggaggaaaactcggggaag

SEQ ID NO: 663996 - DNA, 20 bp, mouse
gagcacccagccgagggcgg

SEQ ID NO: 663997 - DNA, 20 bp, mouse
ggccgggagcacccagccga

SEQ ID NO: 663998 - DNA, 20 bp, mouse
gggtccctgaagggggttgg

SEQ ID NO: 663999 - DNA, 20 bp, mouse
gaggagacacagatgggccg

SEQ ID NO: 664000 - DNA, 20 bp, mouse
gggagggcagaggcgatcgc

SEQ ID NO: 664001 - DNA, 20 bp, mouse
gtggagctgccggaagctgc

SEQ ID NO: 664002 - DNA, 20 bp, mouse
gggcagctccaaatacagac

SEQ ID NO: 664003 - DNA, 20 bp, mouse
ggtctggcggtccctgaagg

SEQ ID NO: 664004 - DNA, 20 bp, mouse
gatacagacgggcgcgggag

SEQ ID NO: 664005 - DNA, 20 bp, mouse
ggccacccccgccctcggct

SEQ ID NO: 664006 - DNA, 20 bp, mouse
gctctgccggggctagtgag

SEQ ID NO: 664007 - DNA, 20 bp, mouse
ggggcagcccagtggcgaag

SEQ ID NO: 664008 - DNA, 20 bp, mouse
gcagactcaggcctctgccg

SEQ ID NO: 664009 - DNA, 20 bp, mouse
gcaaggctgggccatgcgga

SEQ ID NO: 664010 - DNA, 20 bp, mouse
gagggccagtgacccaaccc

SEQ ID NO: 664011 - DNA, 20 bp, mouse
gccggggctagtgagtggaa

SEQ ID NO: 664012 - DNA, 20 bp, mouse
ggctgtgatgagacctagtc

SEQ ID NO: 664013 - DNA, 20 bp, mouse
ggcaatgagacaactagtca

SEQ ID NO: 664014 - DNA, 20 bp, mouse
ggagacaactagtcaggggg

SEQ ID NO: 664015 - DNA, 20 bp, mouse
gttaaagagtcagaccagca

SEQ ID NO: 664016 - DNA, 20 bp, mouse
ggccgaggggcggtggagga

SEQ ID NO: 664017 - DNA, 20 bp, mouse
ggggtaagagcctcgggcgt

SEQ ID NO: 664018 - DNA, 20 bp, mouse
gaggacctgcagatccccct

SEQ ID NO: 664019 - DNA, 20 bp, mouse
ggaggagccggtcgccggtc

SEQ ID NO: 664020 - DNA, 20 bp, mouse
gtcgccggtccgggtgagaa

SEQ ID NO: 664021 - DNA, 20 bp, mouse
ggcaccgccggccagagaga

SEQ ID NO: 664022 - DNA, 20 bp, mouse
gggcctgcgccctaaggtga

SEQ ID NO: 664023 - DNA, 20 bp, mouse
gtcgccctccgggaaggtac

SEQ ID NO: 664024 - DNA, 20 bp, mouse
gtaagagcctcgggcgtagg

SEQ ID NO: 664025 - DNA, 20 bp, mouse
gggagcggggtaagagcctc

SEQ ID NO: 664026 - DNA, 20 bp, mouse
gctgcagcgcagaaccgtgc

SEQ ID NO: 664027 - DNA, 20 bp, mouse
ggggaacggcgctgcatgct

SEQ ID NO: 664028 - DNA, 20 bp, mouse
gaggttctgctctcgcacga

SEQ ID NO: 664029 - DNA, 20 bp, mouse
gtggtggttgcgttgttctg

SEQ ID NO: 664030 - DNA, 20 bp, mouse
gtggtccccgcgtttctaac

SEQ ID NO: 664031 - DNA, 20 bp, mouse
gagaaccgtgcaggactggt

SEQ ID NO: 664032 - DNA, 20 bp, mouse
gcggaaggagcgaagcacgc

SEQ ID NO: 664033 - DNA, 20 bp, mouse
gcagcgacgtatgctgggaa

SEQ ID NO: 664034 - DNA, 20 bp, mouse
gggggaggcagaggtgtcac

SEQ ID NO: 664035 - DNA, 20 bp, mouse
gcaaccaccaccgcgacgga

SEQ ID NO: 664036 - DNA, 20 bp, mouse
gtaaggacaggcctggattc

SEQ ID NO: 664037 - DNA, 20 bp, mouse
gccaaccggggctgccatct

SEQ ID NO: 664038 - DNA, 20 bp, mouse
gggggacaagcacccaaccg

SEQ ID NO: 664039 - DNA, 20 bp, mouse
gggattctggcagatcagat

SEQ ID NO: 664040 - DNA, 20 bp, mouse
ggtcccagtaaggacaggcc

SEQ ID NO: 664041 - DNA, 20 bp, mouse
ggccagagcaaaagagccaa

SEQ ID NO: 664042 - DNA, 20 bp, mouse
gtcctttggctcttttgctc

SEQ ID NO: 664043 - DNA, 20 bp, mouse
gagaagtgaagctgtaacca

SEQ ID NO: 664044 - DNA, 20 bp, mouse
gccctgcattggagagttct

SEQ ID NO: 664045 - DNA, 20 bp, mouse
gaggatagaagtgcaggctg

SEQ ID NO: 664046 - DNA, 20 bp, mouse
gagcagggacgcttcttcag

SEQ ID NO: 664047 - DNA, 20 bp, mouse
gctaaactcgccacaactga

SEQ ID NO: 664048 - DNA, 20 bp, mouse
ggggaaggaggtcaacgtgg

SEQ ID NO: 664049 - DNA, 20 bp, mouse
gagggctccgtgccccaggg

SEQ ID NO: 664050 - DNA, 20 bp, mouse
gggcacggagccctcagttg

SEQ ID NO: 664051 - DNA, 20 bp, mouse
gaggcctaggaggaccagcc

SEQ ID NO: 664052 - DNA, 20 bp, mouse
gtaacctcctgagtcatggg

SEQ ID NO: 664053 - DNA, 20 bp, mouse
gggctctgggagtgccggga

SEQ ID NO: 664054 - DNA, 20 bp, mouse
gcatgactcaggaggttaaa

SEQ ID NO: 664055 - DNA, 20 bp, mouse
gtgggctgaggtatggcaac

SEQ ID NO: 664056 - DNA, 20 bp, mouse
gtctggggagacagaaacgg

SEQ ID NO: 664057 - DNA, 20 bp, mouse
gtcagaagtgaggtaggatc

SEQ ID NO: 664058 - DNA, 20 bp, mouse
gagtaggtgtgtcagaagtg

SEQ ID NO: 664059 - DNA, 20 bp, mouse
ggggatggagtcaaagagac

SEQ ID NO: 664060 - DNA, 20 bp, mouse
gaggcaggcaagaaatcagt

SEQ ID NO: 664061 - DNA, 20 bp, mouse
gggtgtgtcagaagtgaggt

SEQ ID NO: 664062 - DNA, 20 bp, mouse
gtcaaagagactggtaatct

SEQ ID NO: 664063 - DNA, 20 bp, mouse
gggttgtattagctttcaac

SEQ ID NO: 664064 - DNA, 20 bp, mouse
gtacaggaacaaagtaaaga

SEQ ID NO: 664065 - DNA, 20 bp, mouse
gagagtgaccactcctgcca

SEQ ID NO: 664066 - DNA, 20 bp, mouse
ggaacccggagccgggacta

SEQ ID NO: 664067 - DNA, 20 bp, mouse
gcgggactacggctcccaca

SEQ ID NO: 664068 - DNA, 20 bp, mouse
gcgaggctacagcgcgtcag

SEQ ID NO: 664069 - DNA, 20 bp, mouse
gtccgtgaactgagcgtctc

SEQ ID NO: 664070 - DNA, 20 bp, mouse
gcccacagggcagagcgacg

SEQ ID NO: 664071 - DNA, 20 bp, mouse
ggctggatccgggaagagaa

SEQ ID NO: 664072 - DNA, 20 bp, mouse
gttgggagggcgaaatctca

SEQ ID NO: 664073 - DNA, 20 bp, mouse
gagcccaaagcccatcttaa

SEQ ID NO: 664074 - DNA, 20 bp, mouse
ggggaattgtagtccatgaa

SEQ ID NO: 664075 - DNA, 20 bp, mouse
gttcgccctcccaacgtgac

SEQ ID NO: 664076 - DNA, 20 bp, mouse
gtggcgcggcccggtgggga

SEQ ID NO: 664077 - DNA, 20 bp, mouse
gcccgaccgtgaggactacg

SEQ ID NO: 664078 - DNA, 20 bp, mouse
gcatcccgagagccgtccga

SEQ ID NO: 664079 - DNA, 20 bp, mouse
gagggcgagcggggggtgtt

SEQ ID NO: 664080 - DNA, 20 bp, mouse
gcccgagagccgtccgaagg

SEQ ID NO: 664081 - DNA, 20 bp, mouse
ggggccgatgctgccacctt

SEQ ID NO: 664082 - DNA, 20 bp, mouse
ggggacgacaatcgcaagtt

SEQ ID NO: 664083 - DNA, 20 bp, mouse
ggccccgtagtcctcacggt

SEQ ID NO: 664084 - DNA, 20 bp, mouse
gcggcgccgggctccggacg

SEQ ID NO: 664085 - DNA, 20 bp, mouse
ggatgagtcaggagcggatg

SEQ ID NO: 664086 - DNA, 20 bp, mouse
gggtgcgtggctagactgag

SEQ ID NO: 664087 - DNA, 20 bp, mouse
gctagccacgcaccagtctg

SEQ ID NO: 664088 - DNA, 20 bp, mouse
gaaagccacagactggtgcg

SEQ ID NO: 664089 - DNA, 20 bp, mouse
gctagactgagtggtcgcga

SEQ ID NO: 664090 - DNA, 20 bp, mouse
gaaggactaggcagtcatgc

SEQ ID NO: 664091 - DNA, 20 bp, mouse
ggcaaagtgtgtaaaggact

SEQ ID NO: 664092 - DNA, 20 bp, mouse
gtcgcgaaggacctagctgg

SEQ ID NO: 664093 - DNA, 20 bp, mouse
ggcagcagccgctggataca

SEQ ID NO: 664094 - DNA, 20 bp, mouse
gaaatcagcaaagtgtgtaa

SEQ ID NO: 664095 - DNA, 20 bp, mouse
gtgcattgacattaagaact

SEQ ID NO: 664096 - DNA, 20 bp, mouse
gggagagcatcccgggacgt

SEQ ID NO: 664097 - DNA, 20 bp, mouse
ggcactggagtggggtttga

SEQ ID NO: 664098 - DNA, 20 bp, mouse
gctatcgggcggcctcaggg

SEQ ID NO: 664099 - DNA, 20 bp, mouse
gccaaggccaatggcgaggt

SEQ ID NO: 664100 - DNA, 20 bp, mouse
gtgctggctcgaaactgaaa

SEQ ID NO: 664101 - DNA, 20 bp, mouse
gcgggcggcctcagggaggg

SEQ ID NO: 664102 - DNA, 20 bp, mouse
gaggcgtggtctcccggggt

SEQ ID NO: 664103 - DNA, 20 bp, mouse
gttgcgcatgcgaactagag

SEQ ID NO: 664104 - DNA, 20 bp, mouse
ggacaggtctggacaggata

SEQ ID NO: 664105 - DNA, 20 bp, mouse
gggggcacgcaggtcctcca

SEQ ID NO: 664106 - DNA, 20 bp, mouse
gtgagtgctgggcggggcaa

SEQ ID NO: 664107 - DNA, 20 bp, mouse
ggccctgccagatgtgcaga

SEQ ID NO: 664108 - DNA, 20 bp, mouse
gaaactgatcctgagtcacg

SEQ ID NO: 664109 - DNA, 20 bp, mouse
gctgagtcacgaggaaaatc

SEQ ID NO: 664110 - DNA, 20 bp, mouse
gaagctctgctcacaggggg

SEQ ID NO: 664111 - DNA, 20 bp, mouse
ggtcacgaggaaaatctgga

SEQ ID NO: 664112 - DNA, 20 bp, mouse
gggctcctgaagttgctgtg

SEQ ID NO: 664113 - DNA, 20 bp, mouse
gtcccatctgcacatctggc

SEQ ID NO: 664114 - DNA, 20 bp, mouse
ggatccacccaccagtaaat

SEQ ID NO: 664115 - DNA, 20 bp, mouse
ggcatcaagtgggaatgaaa

SEQ ID NO: 664116 - DNA, 20 bp, mouse
gggctcaaggcgatcgtagg

SEQ ID NO: 664117 - DNA, 20 bp, mouse
gcggggctcaaggcgatcgt

SEQ ID NO: 664118 - DNA, 20 bp, mouse
gggccagaacaatgtccagt

SEQ ID NO: 664119 - DNA, 20 bp, mouse
gggtgccagggcgaagctga

SEQ ID NO: 664120 - DNA, 20 bp, mouse
gaggttgttggagagaatca

SEQ ID NO: 664121 - DNA, 20 bp, mouse
gcaaggcgatcgtaggtggg

SEQ ID NO: 664122 - DNA, 20 bp, mouse
ggcgcaggcgcagtcgaccc

SEQ ID NO: 664123 - DNA, 20 bp, mouse
gaatcaggggatggcttgaa

SEQ ID NO: 664124 - DNA, 20 bp, mouse
gggagcgctcccgccgaagc

SEQ ID NO: 664125 - DNA, 20 bp, mouse
ggggcggagcaaggacgcga

SEQ ID NO: 664126 - DNA, 20 bp, mouse
gaggagtctccaagttggat

SEQ ID NO: 664127 - DNA, 20 bp, mouse
ggtgaacagcaggagaaggt

SEQ ID NO: 664128 - DNA, 20 bp, mouse
gcctctccttacagagtctc

SEQ ID NO: 664129 - DNA, 20 bp, mouse
gggaaatgacttaggtctgt

SEQ ID NO: 664130 - DNA, 20 bp, mouse
gctcctgatagcctccattg

SEQ ID NO: 664131 - DNA, 20 bp, mouse
gctatcaggagtctccaagt

SEQ ID NO: 664132 - DNA, 20 bp, mouse
gtaaagggcagcatccccat

SEQ ID NO: 664133 - DNA, 20 bp, mouse
gctcctccagagactctgta

SEQ ID NO: 664134 - DNA, 20 bp, mouse
gttacaggccacacctcctt

SEQ ID NO: 664135 - DNA, 20 bp, mouse
gtctcctgctgttcactatt

SEQ ID NO: 664136 - DNA, 20 bp, mouse
gacaggtagggtcgcttcga

SEQ ID NO: 664137 - DNA, 20 bp, mouse
ggagatagggccctcccgga

SEQ ID NO: 664138 - DNA, 20 bp, mouse
ggctgagtctgatcagaggg

SEQ ID NO: 664139 - DNA, 20 bp, mouse
gcgagtggctggaacataga

SEQ ID NO: 664140 - DNA, 20 bp, mouse
gtatgctctaaagttgactc

SEQ ID NO: 664141 - DNA, 20 bp, mouse
gaaatgagatagggccctcc

SEQ ID NO: 664142 - DNA, 20 bp, mouse
ggagtccctgaaggacaggt

SEQ ID NO: 664143 - DNA, 20 bp, mouse
gtctgtagggaaggcttggt

SEQ ID NO: 664144 - DNA, 20 bp, mouse
gctccactgtgcatcaacag

SEQ ID NO: 664145 - DNA, 20 bp, mouse
gtgagaccattgcccactca

SEQ ID NO: 664146 - DNA, 20 bp, mouse
gcaggcgcagtctgcaatgg

SEQ ID NO: 664147 - DNA, 20 bp, mouse
gggaccgcgcagacgacggc

SEQ ID NO: 664148 - DNA, 20 bp, mouse
gcgcctgcgcgggagggtta

SEQ ID NO: 664149 - DNA, 20 bp, mouse
gcctcccgaaccggacacag

SEQ ID NO: 664150 - DNA, 20 bp, mouse
gcctccaggaactagataca

SEQ ID NO: 664151 - DNA, 20 bp, mouse
ggtgactcaggcagctactc

SEQ ID NO: 664152 - DNA, 20 bp, mouse
ggaactagatacagggtacc

SEQ ID NO: 664153 - DNA, 20 bp, mouse
ggcagacgacggctgggtgg

SEQ ID NO: 664154 - DNA, 20 bp, mouse
gtctaggaccgcgcagacga

SEQ ID NO: 664155 - DNA, 20 bp, mouse
gtattctaacgcccaggtac

SEQ ID NO: 664156 - DNA, 20 bp, mouse
gtgaagttgcagagttccgt

SEQ ID NO: 664157 - DNA, 20 bp, mouse
gaggtgaaacatctcctctt

SEQ ID NO: 664158 - DNA, 20 bp, mouse
gggaactctgcaacttcagt

SEQ ID NO: 664159 - DNA, 20 bp, mouse
ggcaactgtcatgttttcac

SEQ ID NO: 664160 - DNA, 20 bp, mouse
gttaaggtagcattctaatg

SEQ ID NO: 664161 - DNA, 20 bp, mouse
ggtgtggtacccttctagac

SEQ ID NO: 664162 - DNA, 20 bp, mouse
ggaagggtaccacacccaag

SEQ ID NO: 664163 - DNA, 20 bp, mouse
ggtgcactactctgactctg

SEQ ID NO: 664164 - DNA, 20 bp, mouse
gactctgcaacttcagttgg

SEQ ID NO: 664165 - DNA, 20 bp, mouse
gaatgctaccttaaatagaa

SEQ ID NO: 664166 - DNA, 20 bp, mouse
gcggccgccgtcaaccgcca

SEQ ID NO: 664167 - DNA, 20 bp, mouse
gcagcgctctgcaacgaggg

SEQ ID NO: 664168 - DNA, 20 bp, mouse
gcggcccggcgccccgctgg

SEQ ID NO: 664169 - DNA, 20 bp, mouse
gggacaaaggtcagggccag

SEQ ID NO: 664170 - DNA, 20 bp, mouse
gagggcaacggtccccatcg

SEQ ID NO: 664171 - DNA, 20 bp, mouse
ggggtcgcgcgcgtgcccgt

SEQ ID NO: 664172 - DNA, 20 bp, mouse
gcagggccaggggtggagaa

SEQ ID NO: 664173 - DNA, 20 bp, mouse
gccggcaggaaggggcccac

SEQ ID NO: 664174 - DNA, 20 bp, mouse
gggcaccaagctcgcgccgg

SEQ ID NO: 664175 - DNA, 20 bp, mouse
gcacgcgcgcgacccgccag

SEQ ID NO: 664176 - DNA, 20 bp, mouse
gggtcccgggtaccggaaaa

SEQ ID NO: 664177 - DNA, 20 bp, mouse
gcccgggtaccggaaaaggg

SEQ ID NO: 664178 - DNA, 20 bp, mouse
gtagcgcacgagaggggagt

SEQ ID NO: 664179 - DNA, 20 bp, mouse
ggcagagaggggcaccggaa

SEQ ID NO: 664180 - DNA, 20 bp, mouse
ggtggtctagcgcacgagag

SEQ ID NO: 664181 - DNA, 20 bp, mouse
gggcttgcagagaggggcac

SEQ ID NO: 664182 - DNA, 20 bp, mouse
gggaaaagggcggactgtgg

SEQ ID NO: 664183 - DNA, 20 bp, mouse
gaagcgcaggcttgcagaga

SEQ ID NO: 664184 - DNA, 20 bp, mouse
ggcacgcgagctcccctcgg

SEQ ID NO: 664185 - DNA, 20 bp, mouse
gggaaggcgaagcctccgag

SEQ ID NO: 664186 - DNA, 20 bp, mouse
gcctggcctggactacagta

SEQ ID NO: 664187 - DNA, 20 bp, mouse
gtaggggactcatgcacagc

SEQ ID NO: 664188 - DNA, 20 bp, mouse
gactagcagacaaacccacc

SEQ ID NO: 664189 - DNA, 20 bp, mouse
gttctcctcgaatatcaaat

SEQ ID NO: 664190 - DNA, 20 bp, mouse
gtgggtttgtctgctagtgt

SEQ ID NO: 664191 - DNA, 20 bp, mouse
gagtacagattcgggcccag

SEQ ID NO: 664192 - DNA, 20 bp, mouse
gcgaatatcaaattggactc

SEQ ID NO: 664193 - DNA, 20 bp, mouse
gaattggactctggacataa

SEQ ID NO: 664194 - DNA, 20 bp, mouse
ggggactttgactccacctc

SEQ ID NO: 664195 - DNA, 20 bp, mouse
gtctggctgcctctacagtc

SEQ ID NO: 664196 - DNA, 20 bp, mouse
gggagtgtaaacttgagaaa

SEQ ID NO: 664197 - DNA, 20 bp, mouse
ggcaaaggaagacaggtaag

SEQ ID NO: 664198 - DNA, 20 bp, mouse
gtgggatttcctaggtaacg

SEQ ID NO: 664199 - DNA, 20 bp, mouse
gacagtcactgggatttcct

SEQ ID NO: 664200 - DNA, 20 bp, mouse
ggagccgcctgaagcaagta

SEQ ID NO: 664201 - DNA, 20 bp, mouse
gccagaacaaacagcttgtt

SEQ ID NO: 664202 - DNA, 20 bp, mouse
ggctcccttctgactctaca

SEQ ID NO: 664203 - DNA, 20 bp, mouse
gagttctactggcaattgtt

SEQ ID NO: 664204 - DNA, 20 bp, mouse
gcagccttgtagagtcagaa

SEQ ID NO: 664205 - DNA, 20 bp, mouse
gagcaaagtcatgctctgat

SEQ ID NO: 664206 - DNA, 20 bp, mouse
ggcctgccggagccgcaaga

SEQ ID NO: 664207 - DNA, 20 bp, mouse
gggaaagagcggctgaaggc

SEQ ID NO: 664208 - DNA, 20 bp, mouse
ggcggacggagactacttcg

SEQ ID NO: 664209 - DNA, 20 bp, mouse
gcgctctgagggtcccgctg

SEQ ID NO: 664210 - DNA, 20 bp, mouse
gcggaagccgcgcgggccgt

SEQ ID NO: 664211 - DNA, 20 bp, mouse
gggagccgcaagatggcgga

SEQ ID NO: 664212 - DNA, 20 bp, mouse
gagggcggggaagcatctga

SEQ ID NO: 664213 - DNA, 20 bp, mouse
ggctacctagtcctctagga

SEQ ID NO: 664214 - DNA, 20 bp, mouse
gtgggcctgggcccgccgct

SEQ ID NO: 664215 - DNA, 20 bp, mouse
gaactggctggagatctgga

SEQ ID NO: 664216 - DNA, 20 bp, mouse
gctcccaggcgtgtgcgcag

SEQ ID NO: 664217 - DNA, 20 bp, mouse
gccccggagctccgcctccc

SEQ ID NO: 664218 - DNA, 20 bp, mouse
gctgaggaggcggagctccc

SEQ ID NO: 664219 - DNA, 20 bp, mouse
gtgcgcagcgcctccaaagt

SEQ ID NO: 664220 - DNA, 20 bp, mouse
gttggtgggaacaaagtcat

SEQ ID NO: 664221 - DNA, 20 bp, mouse
gagccactgcgcacacgcct

SEQ ID NO: 664222 - DNA, 20 bp, mouse
gaggccggcgctcaggggga

SEQ ID NO: 664223 - DNA, 20 bp, mouse
gggggagggaggcggagctc

SEQ ID NO: 664224 - DNA, 20 bp, mouse
gcgctcaggccggcgctcag

SEQ ID NO: 664225 - DNA, 20 bp, mouse
gagaaggcaccagacagagc

SEQ ID NO: 664226 - DNA, 20 bp, mouse
gggtggggcagctattctaa

SEQ ID NO: 664227 - DNA, 20 bp, mouse
gaatagctgccccaccctgg

SEQ ID NO: 664228 - DNA, 20 bp, mouse
gagctgaactccacactgtc

SEQ ID NO: 664229 - DNA, 20 bp, mouse
ggacaagttttcttcgaaag

SEQ ID NO: 664230 - DNA, 20 bp, mouse
gacaaaatgagatacaatga

SEQ ID NO: 664231 - DNA, 20 bp, mouse
gaagctgagtccaaacccca

SEQ ID NO: 664232 - DNA, 20 bp, mouse
gggtctcttcaactgtcata

SEQ ID NO: 664233 - DNA, 20 bp, mouse
ggcagtctagagatgttccc

SEQ ID NO: 664234 - DNA, 20 bp, mouse
gagtcaagctctgcagatcc

SEQ ID NO: 664235 - DNA, 20 bp, mouse
gtgatagtaacctgacagtg

SEQ ID NO: 664236 - DNA, 20 bp, mouse
ggccccgcgctctcattggt

SEQ ID NO: 664237 - DNA, 20 bp, mouse
ggcaggccctgtggtcgagt

SEQ ID NO: 664238 - DNA, 20 bp, mouse
ggacacgcccactcgaccac

SEQ ID NO: 664239 - DNA, 20 bp, mouse
gtgtcctgtctcaggagggg

SEQ ID NO: 664240 - DNA, 20 bp, mouse
gggcccgcccctcctgagac

SEQ ID NO: 664241 - DNA, 20 bp, mouse
gaagcgaggctgacagtcag

SEQ ID NO: 664242 - DNA, 20 bp, mouse
gtgcggccccgcgctctcat

SEQ ID NO: 664243 - DNA, 20 bp, mouse
ggggcgggtcgggctggccg

SEQ ID NO: 664244 - DNA, 20 bp, mouse
gcctgcagctgcgagaagcg

SEQ ID NO: 664245 - DNA, 20 bp, mouse
gcaagtatggagcgccgcgc

SEQ ID NO: 664246 - DNA, 20 bp, mouse
gtcttgttttcctatgcttg

SEQ ID NO: 664247 - DNA, 20 bp, mouse
gttaattatccataagacaa

SEQ ID NO: 664248 - DNA, 20 bp, mouse
ggtaaaatgtctattggggt

SEQ ID NO: 664249 - DNA, 20 bp, mouse
gtcacatcttccacaagcat

SEQ ID NO: 664250 - DNA, 20 bp, mouse
ggtattgtaaaatgtctatt

SEQ ID NO: 664251 - DNA, 20 bp, mouse
gtgaaacagtgaactattac

SEQ ID NO: 664252 - DNA, 20 bp, mouse
gaggacaataatagccagtc

SEQ ID NO: 664253 - DNA, 20 bp, mouse
gtcttctaatgtaaactctt

SEQ ID NO: 664254 - DNA, 20 bp, mouse
gtatgaataccattgtctta

SEQ ID NO: 664255 - DNA, 20 bp, mouse
gttcacactggaaagatctt

SEQ ID NO: 664256 - DNA, 20 bp, mouse
gtggccgccccgctgacgtg

SEQ ID NO: 664257 - DNA, 20 bp, mouse
gggagggcggcgaggacata

SEQ ID NO: 664258 - DNA, 20 bp, mouse
gaaagggctaggggtgaaca

SEQ ID NO: 664259 - DNA, 20 bp, mouse
gggaatgcagtgcggatgca

SEQ ID NO: 664260 - DNA, 20 bp, mouse
gagaaggtctagccctggaa

SEQ ID NO: 664261 - DNA, 20 bp, mouse
ggcggcctgggaatgcagtg

SEQ ID NO: 664262 - DNA, 20 bp, mouse
gccggactgctcgcctaaaa

SEQ ID NO: 664263 - DNA, 20 bp, mouse
gtgctcgcctaaaagggcta

SEQ ID NO: 664264 - DNA, 20 bp, mouse
gtctgcagaaggtctagccc

SEQ ID NO: 664265 - DNA, 20 bp, mouse
gaggtctagccctggaaggg

SEQ ID NO: 664266 - DNA, 20 bp, mouse
gagctggataagaatattag

SEQ ID NO: 664267 - DNA, 20 bp, mouse
gtgtcccgccccctcgcccg

SEQ ID NO: 664268 - DNA, 20 bp, mouse
gacttcgaagccccgggcga

SEQ ID NO: 664269 - DNA, 20 bp, mouse
gaacctcagcggctcaccat

SEQ ID NO: 664270 - DNA, 20 bp, mouse
ggtgagccgctgaggttcag

SEQ ID NO: 664271 - DNA, 20 bp, mouse
gcaggaataggacctgtcta

SEQ ID NO: 664272 - DNA, 20 bp, mouse
gagtgagtgcaaggaaagtg

SEQ ID NO: 664273 - DNA, 20 bp, mouse
gcgcctagggatatggggtc

SEQ ID NO: 664274 - DNA, 20 bp, mouse
gggacctgcacctgatcccg

SEQ ID NO: 664275 - DNA, 20 bp, mouse
gaagccccgggcgagggggc

SEQ ID NO: 664276 - DNA, 20 bp, mouse
ggggaaggcagagtcgaata

SEQ ID NO: 664277 - DNA, 20 bp, mouse
ggaagcaggaccagaggtga

SEQ ID NO: 664278 - DNA, 20 bp, mouse
ggaccagaggtgatggaaga

SEQ ID NO: 664279 - DNA, 20 bp, mouse
gcagtgggagcaagtgggtg

SEQ ID NO: 664280 - DNA, 20 bp, mouse
ggggtggggaagaagacgag

SEQ ID NO: 664281 - DNA, 20 bp, mouse
gaaggcagagtcgaataggg

SEQ ID NO: 664282 - DNA, 20 bp, mouse
ggcagagtcgaatagggagg

SEQ ID NO: 664283 - DNA, 20 bp, mouse
gggtgcggccctttctactg

SEQ ID NO: 664284 - DNA, 20 bp, mouse
gggagaggcagcgcagggtg

SEQ ID NO: 664285 - DNA, 20 bp, mouse
gaaagagggagaggcagcgc

SEQ ID NO: 664286 - DNA, 20 bp, mouse
gggctcccccaagtaacctg

SEQ ID NO: 664287 - DNA, 20 bp, mouse
gggcaggagccccaggtccg

SEQ ID NO: 664288 - DNA, 20 bp, mouse
gcctcagtggcccactgcgg

SEQ ID NO: 664289 - DNA, 20 bp, mouse
gagaaagcccagcctaccgg

SEQ ID NO: 664290 - DNA, 20 bp, mouse
ggcccactgcggcggtcctc

SEQ ID NO: 664291 - DNA, 20 bp, mouse
gggagccagttctcacaggg

SEQ ID NO: 664292 - DNA, 20 bp, mouse
gcatacctccctgtgagaac

SEQ ID NO: 664293 - DNA, 20 bp, mouse
gtgggccacaggttacttgg

SEQ ID NO: 664294 - DNA, 20 bp, mouse
gccaggtccgaggtgagttg

SEQ ID NO: 664295 - DNA, 20 bp, mouse
gactgaggaccacttaagtc

SEQ ID NO: 664296 - DNA, 20 bp, mouse
gggggcgcccgagtggggaa

SEQ ID NO: 664297 - DNA, 20 bp, mouse
ggggcacggtcgtcacccgc

SEQ ID NO: 664298 - DNA, 20 bp, mouse
gcccactcgggcgccccctg

SEQ ID NO: 664299 - DNA, 20 bp, mouse
gaacccgaaacccgagggca

SEQ ID NO: 664300 - DNA, 20 bp, mouse
gccgggaacccgaaacccga

SEQ ID NO: 664301 - DNA, 20 bp, mouse
gctggggtggacttctcaga

SEQ ID NO: 664302 - DNA, 20 bp, mouse
ggccgcccgcaccccgaacc

SEQ ID NO: 664303 - DNA, 20 bp, mouse
ggaaggcaggaaatccccat

SEQ ID NO: 664304 - DNA, 20 bp, mouse
ggaaatgcaggggaccttga

SEQ ID NO: 664305 - DNA, 20 bp, mouse
gggcgcccgcgccaaggagc

SEQ ID NO: 664306 - DNA, 20 bp, mouse
gagaacacggtgtcctggga

SEQ ID NO: 664307 - DNA, 20 bp, mouse
ggggtcctgagccaaggcca

SEQ ID NO: 664308 - DNA, 20 bp, mouse
gggaactctcggtcagggaa

SEQ ID NO: 664309 - DNA, 20 bp, mouse
gaaaggaagagctcactcca

SEQ ID NO: 664310 - DNA, 20 bp, mouse
gaaccggtgtacgtgaggag

SEQ ID NO: 664311 - DNA, 20 bp, mouse
gactccagggtcctgagcca

SEQ ID NO: 664312 - DNA, 20 bp, mouse
ggcggcagtgtaaatagcaa

SEQ ID NO: 664313 - DNA, 20 bp, mouse
gtgcctgtgtagcctggggt

SEQ ID NO: 664314 - DNA, 20 bp, mouse
gccctgaccgagagttccag

SEQ ID NO: 664315 - DNA, 20 bp, mouse
gaatgagaacacggtgtcct

SEQ ID NO: 664316 - DNA, 20 bp, mouse
ggtagagccactaggaatgg

SEQ ID NO: 664317 - DNA, 20 bp, mouse
gagccactaggaatggaggt

SEQ ID NO: 664318 - DNA, 20 bp, mouse
ggagcccaggtagagccact

SEQ ID NO: 664319 - DNA, 20 bp, mouse
ggaaatgccaacagttacac

SEQ ID NO: 664320 - DNA, 20 bp, mouse
gcagacgagcatcaatagga

SEQ ID NO: 664321 - DNA, 20 bp, mouse
gctacagtggctcaagtccc

SEQ ID NO: 664322 - DNA, 20 bp, mouse
gctgcagccagtgtaactgt

SEQ ID NO: 664323 - DNA, 20 bp, mouse
gtgttggcatttctcccgaa

SEQ ID NO: 664324 - DNA, 20 bp, mouse
gcaggtagagccactaggaa

SEQ ID NO: 664325 - DNA, 20 bp, mouse
gtcacctcagcatgtccaca

SEQ ID NO: 664326 - DNA, 20 bp, mouse
gggcccccgcaccttgcttg

SEQ ID NO: 664327 - DNA, 20 bp, mouse
gcggaggcctcggtgttcga

SEQ ID NO: 664328 - DNA, 20 bp, mouse
gccgccccaagcaaggtgcg

SEQ ID NO: 664329 - DNA, 20 bp, mouse
ggcccaggggagggaccgag

SEQ ID NO: 664330 - DNA, 20 bp, mouse
gaccgagtggacctgagcaa

SEQ ID NO: 664331 - DNA, 20 bp, mouse
gagcgggtcggacgcagaag

SEQ ID NO: 664332 - DNA, 20 bp, mouse
ggaagcggagagcagccgga

SEQ ID NO: 664333 - DNA, 20 bp, mouse
gaggcagaggtgacaggcgg

SEQ ID NO: 664334 - DNA, 20 bp, mouse
gggtgacaggcagaggtgac

SEQ ID NO: 664335 - DNA, 20 bp, mouse
gtgcgggcgggtgaccaggt

SEQ ID NO: 664336 - DNA, 20 bp, mouse
ggacagctgtccgggtgaga

SEQ ID NO: 664337 - DNA, 20 bp, mouse
ggtgaggcagggggctaaac

SEQ ID NO: 664338 - DNA, 20 bp, mouse
gtggagggaaccagccaaag

SEQ ID NO: 664339 - DNA, 20 bp, mouse
gggtgagagggtagcaggag

SEQ ID NO: 664340 - DNA, 20 bp, mouse
gcaagagctggacagctgtc

SEQ ID NO: 664341 - DNA, 20 bp, mouse
ggtactcagaaggccggggg

SEQ ID NO: 664342 - DNA, 20 bp, mouse
ggggctaaactggattgggg

SEQ ID NO: 664343 - DNA, 20 bp, mouse
gagggggctaaactggattg

SEQ ID NO: 664344 - DNA, 20 bp, mouse
gcccccaagtgcaggaaaac

SEQ ID NO: 664345 - DNA, 20 bp, mouse
gaggtcagcggtgaggcagg

SEQ ID NO: 664346 - DNA, 20 bp, mouse
gaagccctgaagatgcggag

SEQ ID NO: 664347 - DNA, 20 bp, mouse
gagcccggacggctagacgt

SEQ ID NO: 664348 - DNA, 20 bp, mouse
gggtagcaaggtagcaaggt

SEQ ID NO: 664349 - DNA, 20 bp, mouse
gagcaaggtagcaaggtagg

SEQ ID NO: 664350 - DNA, 20 bp, mouse
ggtctgggaagataccccgt

SEQ ID NO: 664351 - DNA, 20 bp, mouse
gtgaagatgcggagtgggtg

SEQ ID NO: 664352 - DNA, 20 bp, mouse
gagtcggctcctcctcctgg

SEQ ID NO: 664353 - DNA, 20 bp, mouse
gcatcttcagggcttagaag

SEQ ID NO: 664354 - DNA, 20 bp, mouse
gggaagataccccgtgggtc

SEQ ID NO: 664355 - DNA, 20 bp, mouse
gggagaccctgaacagttgg

SEQ ID NO: 664356 - DNA, 20 bp, mouse
gtcaagtttagcactctggc

SEQ ID NO: 664357 - DNA, 20 bp, mouse
gtcacagccccactcagcca

SEQ ID NO: 664358 - DNA, 20 bp, mouse
ggccactctggtcactgctt

SEQ ID NO: 664359 - DNA, 20 bp, mouse
gagagtgctaaacttgacat

SEQ ID NO: 664360 - DNA, 20 bp, mouse
gtgttggggacatgtagggc

SEQ ID NO: 664361 - DNA, 20 bp, mouse
ggggtggaggcacagtgcct

SEQ ID NO: 664362 - DNA, 20 bp, mouse
ggggacccagtggccttggc

SEQ ID NO: 664363 - DNA, 20 bp, mouse
gcagagctgtcacacaagac

SEQ ID NO: 664364 - DNA, 20 bp, mouse
gggctgggaacaggccactc

SEQ ID NO: 664365 - DNA, 20 bp, mouse
gcgggtgtcccgattgctga

SEQ ID NO: 664366 - DNA, 20 bp, mouse
ggcgtggcttaagttagaag

SEQ ID NO: 664367 - DNA, 20 bp, mouse
gaggcacgccaggtctaaat

SEQ ID NO: 664368 - DNA, 20 bp, mouse
gaggcgtggctcgggctgag

SEQ ID NO: 664369 - DNA, 20 bp, mouse
gtctaaatggggcgggatta

SEQ ID NO: 664370 - DNA, 20 bp, mouse
gccaaggggcgaggccttga

SEQ ID NO: 664371 - DNA, 20 bp, mouse
gaagttagaagtggtctgtt

SEQ ID NO: 664372 - DNA, 20 bp, mouse
gagttccttcagaacgggat

SEQ ID NO: 664373 - DNA, 20 bp, mouse
gcccccccatcccgttctga

SEQ ID NO: 664374 - DNA, 20 bp, mouse
ggaagggagcagggttgacc

SEQ ID NO: 664375 - DNA, 20 bp, mouse
gctctgagttccttcagaac

SEQ ID NO: 664376 - DNA, 20 bp, mouse
gatgttgaacaaccagacat

SEQ ID NO: 664377 - DNA, 20 bp, mouse
gcagaagggccattgtgggg

SEQ ID NO: 664378 - DNA, 20 bp, mouse
gtctggttgttcaacatctt

SEQ ID NO: 664379 - DNA, 20 bp, mouse
ggcacaggcaccaagtcaga

SEQ ID NO: 664380 - DNA, 20 bp, mouse
gtgctcagtgggcgcagcaa

SEQ ID NO: 664381 - DNA, 20 bp, mouse
ggcacagcgcacccggaagc

SEQ ID NO: 664382 - DNA, 20 bp, mouse
gaagtcagaagggccattgt

SEQ ID NO: 664383 - DNA, 20 bp, mouse
gccagctcgctcatcatcca

SEQ ID NO: 664384 - DNA, 20 bp, mouse
ggctatggtaatgccctggg

SEQ ID NO: 664385 - DNA, 20 bp, mouse
gggaggtgaggcacgtgcac

SEQ ID NO: 664386 - DNA, 20 bp, mouse
gcagcggggcagctctgagt

SEQ ID NO: 664387 - DNA, 20 bp, mouse
ggcgtgagaagcctcagaga

SEQ ID NO: 664388 - DNA, 20 bp, mouse
gtctaggtggaagacccatg

SEQ ID NO: 664389 - DNA, 20 bp, mouse
gtcacgcaggggcttctagg

SEQ ID NO: 664390 - DNA, 20 bp, mouse
gggggtggggctcaagtcca

SEQ ID NO: 664391 - DNA, 20 bp, mouse
gccttctggaaatagaagca

SEQ ID NO: 664392 - DNA, 20 bp, mouse
gccctgcaacaggaaagagt

SEQ ID NO: 664393 - DNA, 20 bp, mouse
gtctgaggcttctcacgcag

SEQ ID NO: 664394 - DNA, 20 bp, mouse
gagcagggcttccagaaggc

SEQ ID NO: 664395 - DNA, 20 bp, mouse
gttgcaggggatgatggcgt

SEQ ID NO: 664396 - DNA, 20 bp, mouse
gcactggccggtgaagtctc

SEQ ID NO: 664397 - DNA, 20 bp, mouse
gtgaagtctcaggtcgagat

SEQ ID NO: 664398 - DNA, 20 bp, mouse
gcgcccgccgccactttaag

SEQ ID NO: 664399 - DNA, 20 bp, mouse
gcccccacccgcccactggc

SEQ ID NO: 664400 - DNA, 20 bp, mouse
gccgatacgagatgaggaat

SEQ ID NO: 664401 - DNA, 20 bp, mouse
gccccccaacagagccgaaa

SEQ ID NO: 664402 - DNA, 20 bp, mouse
gagtctcaggtcgagatagg

SEQ ID NO: 664403 - DNA, 20 bp, mouse
gcgggaggagcggttcccca

SEQ ID NO: 664404 - DNA, 20 bp, mouse
gagggcaggaccagcctttt

SEQ ID NO: 664405 - DNA, 20 bp, mouse
ggtgatggacaagcctcggg

SEQ ID NO: 664406 - DNA, 20 bp, mouse
gagcctgcgaaaatcaaact

SEQ ID NO: 664407 - DNA, 20 bp, mouse
gctcaccccacaatcgggac

SEQ ID NO: 664408 - DNA, 20 bp, mouse
ggcttgcctgtcccgattgt

SEQ ID NO: 664409 - DNA, 20 bp, mouse
ggggaaaattgtttggagca

SEQ ID NO: 664410 - DNA, 20 bp, mouse
gtcgaccagggagtcttgtt

SEQ ID NO: 664411 - DNA, 20 bp, mouse
gtgggaacgggattgagacc

SEQ ID NO: 664412 - DNA, 20 bp, mouse
gtgaaagggtattaggactt

SEQ ID NO: 664413 - DNA, 20 bp, mouse
ggccccagtttgattttcgc

SEQ ID NO: 664414 - DNA, 20 bp, mouse
gtgtaggtgggagtgtaggg

SEQ ID NO: 664415 - DNA, 20 bp, mouse
gccccctctcaccccacaat

SEQ ID NO: 664416 - DNA, 20 bp, mouse
ggaggggcaggtgtgttcat

SEQ ID NO: 664417 - DNA, 20 bp, mouse
gtggacattggtgcggtaat

SEQ ID NO: 664418 - DNA, 20 bp, mouse
gcaggctttgatatcgggga

SEQ ID NO: 664419 - DNA, 20 bp, mouse
ggcaccacctggcactgtat

SEQ ID NO: 664420 - DNA, 20 bp, mouse
gcattggtgcggtaatgggt

SEQ ID NO: 664421 - DNA, 20 bp, mouse
gagcaagccttgaggggagc

SEQ ID NO: 664422 - DNA, 20 bp, mouse
gggaaataggagctgggtag

SEQ ID NO: 664423 - DNA, 20 bp, mouse
gtggctccatctctacaaaa

SEQ ID NO: 664424 - DNA, 20 bp, mouse
ggcggtaatgggtagggttg

SEQ ID NO: 664425 - DNA, 20 bp, mouse
gcccccgtggagttgggctg

SEQ ID NO: 664426 - DNA, 20 bp, mouse
ggacacctggggccagagta

SEQ ID NO: 664427 - DNA, 20 bp, mouse
gcacacgggtgaggtgtctg

SEQ ID NO: 664428 - DNA, 20 bp, mouse
ggggtggagtcaggacgctt

SEQ ID NO: 664429 - DNA, 20 bp, mouse
ggggccagagtagggtgcct

SEQ ID NO: 664430 - DNA, 20 bp, mouse
ggtctaccggggactgaaag

SEQ ID NO: 664431 - DNA, 20 bp, mouse
gtatgagctccagcctctcc

SEQ ID NO: 664432 - DNA, 20 bp, mouse
gcgggtgaggtgtctggggc

SEQ ID NO: 664433 - DNA, 20 bp, mouse
gtccaggcggatgtctaccg

SEQ ID NO: 664434 - DNA, 20 bp, mouse
gaggacctgggtccagtcta

SEQ ID NO: 664435 - DNA, 20 bp, mouse
ggcagaatgcggtgcgctcc

SEQ ID NO: 664436 - DNA, 20 bp, mouse
gcggccctcccacacctgcc

SEQ ID NO: 664437 - DNA, 20 bp, mouse
ggaccccgccaggactggcc

SEQ ID NO: 664438 - DNA, 20 bp, mouse
ggactggcccggagagccgg

SEQ ID NO: 664439 - DNA, 20 bp, mouse
gcggcgggaaacaggaagcg

SEQ ID NO: 664440 - DNA, 20 bp, mouse
gtggcggctccgccccgtcg

SEQ ID NO: 664441 - DNA, 20 bp, mouse
gacctgcccggcccccgacg

SEQ ID NO: 664442 - DNA, 20 bp, mouse
gctctccgggccagtcctgg

SEQ ID NO: 664443 - DNA, 20 bp, mouse
gcaggtgtgggagggccgtg

SEQ ID NO: 664444 - DNA, 20 bp, mouse
ggcggtggcgcgcggggtgt

SEQ ID NO: 664445 - DNA, 20 bp, mouse
gtgcgctccggtcgtcctcc

SEQ ID NO: 664446 - DNA, 20 bp, mouse
gggcctgggtgctgagtcca

SEQ ID NO: 664447 - DNA, 20 bp, mouse
gcctggctgtaatgagggaa

SEQ ID NO: 664448 - DNA, 20 bp, mouse
gtgggggcctggctgtaatg

SEQ ID NO: 664449 - DNA, 20 bp, mouse
ggccaggcccccaaagcctt

SEQ ID NO: 664450 - DNA, 20 bp, mouse
gtcccagtgtagacttagga

SEQ ID NO: 664451 - DNA, 20 bp, mouse
gaggccacctgctttaagtg

SEQ ID NO: 664452 - DNA, 20 bp, mouse
gtgtcataggctggtagggg

SEQ ID NO: 664453 - DNA, 20 bp, mouse
ggaggtcccagtgtagactt

SEQ ID NO: 664454 - DNA, 20 bp, mouse
gctgggtgctgagtccaagg

SEQ ID NO: 664455 - DNA, 20 bp, mouse
gggggggggcatatgtgcac

SEQ ID NO: 664456 - DNA, 20 bp, mouse
gcactgagggctgtgataga

SEQ ID NO: 664457 - DNA, 20 bp, mouse
ggaaggagggacggttctcc

SEQ ID NO: 664458 - DNA, 20 bp, mouse
gccctcctcttgggtctgat

SEQ ID NO: 664459 - DNA, 20 bp, mouse
ggctgtgatagagggtgtgg

SEQ ID NO: 664460 - DNA, 20 bp, mouse
ggtatctggtctccccactg

SEQ ID NO: 664461 - DNA, 20 bp, mouse
gtaaaggtcagcatgtcata

SEQ ID NO: 664462 - DNA, 20 bp, mouse
gcagcacattccctcctctt

SEQ ID NO: 664463 - DNA, 20 bp, mouse
gctcttggaaagaacctagg

SEQ ID NO: 664464 - DNA, 20 bp, mouse
gtgggtgcccgcacaccaga

SEQ ID NO: 664465 - DNA, 20 bp, mouse
ggagtagaggcaaatgaact

SEQ ID NO: 664466 - DNA, 20 bp, mouse
gccagaacctgcattctcta

SEQ ID NO: 664467 - DNA, 20 bp, mouse
gcgaagaagacatgagtcag

SEQ ID NO: 664468 - DNA, 20 bp, mouse
gccaaaggacctgtgagcgt

SEQ ID NO: 664469 - DNA, 20 bp, mouse
ggccaaagactatagcgagc

SEQ ID NO: 664470 - DNA, 20 bp, mouse
gagccccaccatgctagaga

SEQ ID NO: 664471 - DNA, 20 bp, mouse
gctagcatggtggggctctc

SEQ ID NO: 664472 - DNA, 20 bp, mouse
gcatgctagagagggtgagc

SEQ ID NO: 664473 - DNA, 20 bp, mouse
gtcaccctctctagcatggt

SEQ ID NO: 664474 - DNA, 20 bp, mouse
gggcgctggactttgagttt

SEQ ID NO: 664475 - DNA, 20 bp, mouse
gccgacaagcccacgctcac

SEQ ID NO: 664476 - DNA, 20 bp, mouse
gccggagcactctcggtctg

SEQ ID NO: 664477 - DNA, 20 bp, mouse
gtgaacccgggacctcctcc

SEQ ID NO: 664478 - DNA, 20 bp, mouse
gtcactaatactgggcagtg

SEQ ID NO: 664479 - DNA, 20 bp, mouse
gagtcagcccggagcactct

SEQ ID NO: 664480 - DNA, 20 bp, mouse
gtgtgtacacttgctgaggt

SEQ ID NO: 664481 - DNA, 20 bp, mouse
gagtggggaacatgccacaa

SEQ ID NO: 664482 - DNA, 20 bp, mouse
gcaacagagagtacaaacac

SEQ ID NO: 664483 - DNA, 20 bp, mouse
ggggctaggtatccctgctc

SEQ ID NO: 664484 - DNA, 20 bp, mouse
gaatgctggcatcagaggtg

SEQ ID NO: 664485 - DNA, 20 bp, mouse
gacatcctggaggaggtccc

SEQ ID NO: 664486 - DNA, 20 bp, mouse
gagggaagtagaagtactct

SEQ ID NO: 664487 - DNA, 20 bp, mouse
gaaggacagtggtgcagggt

SEQ ID NO: 664488 - DNA, 20 bp, mouse
gcctgctcatctgaactgga

SEQ ID NO: 664489 - DNA, 20 bp, mouse
ggggttccctaactggagaa

SEQ ID NO: 664490 - DNA, 20 bp, mouse
gcctgcctgctcatctgaac

SEQ ID NO: 664491 - DNA, 20 bp, mouse
gggacagtctaccttctgat

SEQ ID NO: 664492 - DNA, 20 bp, mouse
gccagccagtcctcccgcag

SEQ ID NO: 664493 - DNA, 20 bp, mouse
ggacggcagatgaggatatg

SEQ ID NO: 664494 - DNA, 20 bp, mouse
gcgtctaaggacagtggtgc

SEQ ID NO: 664495 - DNA, 20 bp, mouse
gccttctgattggcccatcc

SEQ ID NO: 664496 - DNA, 20 bp, mouse
ggaagggaactgggcgacgg

SEQ ID NO: 664497 - DNA, 20 bp, mouse
gaaaggagaacgagtcggaa

SEQ ID NO: 664498 - DNA, 20 bp, mouse
gctgttccaacagccaaatt

SEQ ID NO: 664499 - DNA, 20 bp, mouse
gtcgggaaaggagaacgagt

SEQ ID NO: 664500 - DNA, 20 bp, mouse
gggcttcagagcggaaactc

SEQ ID NO: 664501 - DNA, 20 bp, mouse
gcagagcggaaactcgggaa

SEQ ID NO: 664502 - DNA, 20 bp, mouse
gtcggaagggaactgggcga

SEQ ID NO: 664503 - DNA, 20 bp, mouse
gtgaaacgcgctcccttctg

SEQ ID NO: 664504 - DNA, 20 bp, mouse
gaacgagtcggaagggaact

SEQ ID NO: 664505 - DNA, 20 bp, mouse
gtacaactcccagtgttcag

SEQ ID NO: 664506 - DNA, 20 bp, mouse
gggagccggggactcggcag

SEQ ID NO: 664507 - DNA, 20 bp, mouse
gccagccgctgccgagtccc

SEQ ID NO: 664508 - DNA, 20 bp, mouse
gcccgcagacccgcgagtgg

SEQ ID NO: 664509 - DNA, 20 bp, mouse
gcccgcttatctcgagtcaa

SEQ ID NO: 664510 - DNA, 20 bp, mouse
ggcgcccgcagacccgcgag

SEQ ID NO: 664511 - DNA, 20 bp, mouse
gtggggccggacttgtgctg

SEQ ID NO: 664512 - DNA, 20 bp, mouse
gcgggcgcccagtgccggcc

SEQ ID NO: 664513 - DNA, 20 bp, mouse
gaccacgccccttggagctc

SEQ ID NO: 664514 - DNA, 20 bp, mouse
gggacgcgcggcccggacct

SEQ ID NO: 664515 - DNA, 20 bp, mouse
ggtctgcgggcgcccagtgc

SEQ ID NO: 664516 - DNA, 20 bp, mouse
ggtcaagcggagtaagcgga

SEQ ID NO: 664517 - DNA, 20 bp, mouse
ggggcagcacagctatggac

SEQ ID NO: 664518 - DNA, 20 bp, mouse
gccaccgccattggtcttct

SEQ ID NO: 664519 - DNA, 20 bp, mouse
ggctggtcaagcggagtaag

SEQ ID NO: 664520 - DNA, 20 bp, mouse
gaccagcgaggcacccaatc

SEQ ID NO: 664521 - DNA, 20 bp, mouse
ggtaagcggagggtaattga

SEQ ID NO: 664522 - DNA, 20 bp, mouse
gaccgccggaagcgtactcc

SEQ ID NO: 664523 - DNA, 20 bp, mouse
ggagcccagaagaccaatgg

SEQ ID NO: 664524 - DNA, 20 bp, mouse
gggacgctgaccctgggggt

SEQ ID NO: 664525 - DNA, 20 bp, mouse
gtgatggacgctgaccctgg

SEQ ID NO: 664526 - DNA, 20 bp, mouse
ggggcaccgcctcccaacgt

SEQ ID NO: 664527 - DNA, 20 bp, mouse
ggggcgagcgcaagcacgac

SEQ ID NO: 664528 - DNA, 20 bp, mouse
gtgaaggcgcctacgttggg

SEQ ID NO: 664529 - DNA, 20 bp, mouse
gtccctcaggcgccaggagg

SEQ ID NO: 664530 - DNA, 20 bp, mouse
gagcgcaagcacgacggggg

SEQ ID NO: 664531 - DNA, 20 bp, mouse
gccaccgagccggcccgtgg

SEQ ID NO: 664532 - DNA, 20 bp, mouse
gcgaccgttcccgcggggtg

SEQ ID NO: 664533 - DNA, 20 bp, mouse
ggggtgaaggcgcctacgtt

SEQ ID NO: 664534 - DNA, 20 bp, mouse
ggggccgcctgatcattccg

SEQ ID NO: 664535 - DNA, 20 bp, mouse
gcggccccaccccgcgggaa

SEQ ID NO: 664536 - DNA, 20 bp, mouse
gtcctccgcagcccaggctt

SEQ ID NO: 664537 - DNA, 20 bp, mouse
gtagtcctaggctctggttc

SEQ ID NO: 664538 - DNA, 20 bp, mouse
gagagggaaagctatggact

SEQ ID NO: 664539 - DNA, 20 bp, mouse
gctgggaggagcggcatggt

SEQ ID NO: 664540 - DNA, 20 bp, mouse
gtgtcctcatggtacctaac

SEQ ID NO: 664541 - DNA, 20 bp, mouse
gagcctggccatgcccgggg

SEQ ID NO: 664542 - DNA, 20 bp, mouse
ggcggctccagtaacatgct

SEQ ID NO: 664543 - DNA, 20 bp, mouse
gaagggacttgtgatccaga

SEQ ID NO: 664544 - DNA, 20 bp, mouse
gatcagatcccaacaccctc

SEQ ID NO: 664545 - DNA, 20 bp, mouse
gttgtcctaagcctgggctg

SEQ ID NO: 664546 - DNA, 20 bp, mouse
gtgtctaaggggtacttaga

SEQ ID NO: 664547 - DNA, 20 bp, mouse
gaagatgcacaggtgtctaa

SEQ ID NO: 664548 - DNA, 20 bp, mouse
ggggcctggatcttggcgta

SEQ ID NO: 664549 - DNA, 20 bp, mouse
ggaagccagggtaaccccaa

SEQ ID NO: 664550 - DNA, 20 bp, mouse
gttgaagtgcagggaaggtg

SEQ ID NO: 664551 - DNA, 20 bp, mouse
gtggcgtagggaagatgcac

SEQ ID NO: 664552 - DNA, 20 bp, mouse
gggtactcagcagagctcta

SEQ ID NO: 664553 - DNA, 20 bp, mouse
ggaactgcactgtggtcagg

SEQ ID NO: 664554 - DNA, 20 bp, mouse
gggtgtgtggcgtgggccgt

SEQ ID NO: 664555 - DNA, 20 bp, mouse
gaaagggttcttgaagtgca

SEQ ID NO: 664556 - DNA, 20 bp, mouse
gaaacccgggctgctgaaga

SEQ ID NO: 664557 - DNA, 20 bp, mouse
gctgctgaagagggctggga

SEQ ID NO: 664558 - DNA, 20 bp, mouse
ggggaggggcgggacgaaat

SEQ ID NO: 664559 - DNA, 20 bp, mouse
ggggcgaggagctgggtaga

SEQ ID NO: 664560 - DNA, 20 bp, mouse
gacagtgagaagcgcaaacc

SEQ ID NO: 664561 - DNA, 20 bp, mouse
ggcaaactgacgccgacgtg

SEQ ID NO: 664562 - DNA, 20 bp, mouse
ggggcaagggactcagcgac

SEQ ID NO: 664563 - DNA, 20 bp, mouse
gactcagcgactggaggaga

SEQ ID NO: 664564 - DNA, 20 bp, mouse
gcgccgacgtggggcatgat

SEQ ID NO: 664565 - DNA, 20 bp, mouse
ggacatgcccggaagacgac

SEQ ID NO: 664566 - DNA, 20 bp, mouse
gccaagttacccataaggaa

SEQ ID NO: 664567 - DNA, 20 bp, mouse
gaggagatctgcgctaaaat

SEQ ID NO: 664568 - DNA, 20 bp, mouse
gatctgcgctaaaatgggga

SEQ ID NO: 664569 - DNA, 20 bp, mouse
gaatgaggacatgatgaccg

SEQ ID NO: 664570 - DNA, 20 bp, mouse
gggagtggtgtgctgagatt

SEQ ID NO: 664571 - DNA, 20 bp, mouse
gcgagcccaagttacccata

SEQ ID NO: 664572 - DNA, 20 bp, mouse
gtctcctcgcctttccttat

SEQ ID NO: 664573 - DNA, 20 bp, mouse
gcacggtggcagcggaagag

SEQ ID NO: 664574 - DNA, 20 bp, mouse
ggcggagccccatgaggaac

SEQ ID NO: 664575 - DNA, 20 bp, mouse
ggcagagtgtagcctcttcc

SEQ ID NO: 664576 - DNA, 20 bp, mouse
ggcccctagggaagcttccc

SEQ ID NO: 664577 - DNA, 20 bp, mouse
gtgcgcagagcctcgttccc

SEQ ID NO: 664578 - DNA, 20 bp, mouse
gctccgggagcccgggaacg

SEQ ID NO: 664579 - DNA, 20 bp, mouse
ggggccagagctgaaactga

SEQ ID NO: 664580 - DNA, 20 bp, mouse
ggcggagcgctgcctacaga

SEQ ID NO: 664581 - DNA, 20 bp, mouse
gaactctggtgcatctacca

SEQ ID NO: 664582 - DNA, 20 bp, mouse
gcgggtgccgggaagaggga

SEQ ID NO: 664583 - DNA, 20 bp, mouse
ggcggggcggacagcgtttc

SEQ ID NO: 664584 - DNA, 20 bp, mouse
gcccgggtgtagcagcaaga

SEQ ID NO: 664585 - DNA, 20 bp, mouse
gcgaggctctgcgcacagat

SEQ ID NO: 664586 - DNA, 20 bp, mouse
gactacaggcagcagtgtat

SEQ ID NO: 664587 - DNA, 20 bp, mouse
gcggggcatcaggcggaaat

SEQ ID NO: 664588 - DNA, 20 bp, mouse
gaccgtctgccggaagtggg

SEQ ID NO: 664589 - DNA, 20 bp, mouse
gaacactgggagttgtgagt

SEQ ID NO: 664590 - DNA, 20 bp, mouse
gtaggtaaaagccgcgatgt

SEQ ID NO: 664591 - DNA, 20 bp, mouse
gatgtgggcgtaccttatgt

SEQ ID NO: 664592 - DNA, 20 bp, mouse
gcagcagtgtatgggactcg

SEQ ID NO: 664593 - DNA, 20 bp, mouse
gcgacttgggcagtactcac

SEQ ID NO: 664594 - DNA, 20 bp, mouse
gataaggtacgcccacatcg

SEQ ID NO: 664595 - DNA, 20 bp, mouse
ggcatcaggcggaaatgggc

SEQ ID NO: 664596 - DNA, 20 bp, mouse
ggacgtctgtcggtgatgta

SEQ ID NO: 664597 - DNA, 20 bp, mouse
ggggcggggcctgcaccctg

SEQ ID NO: 664598 - DNA, 20 bp, mouse
gcaccctgcggcacgttttc

SEQ ID NO: 664599 - DNA, 20 bp, mouse
gccgccggggctaggggtgt

SEQ ID NO: 664600 - DNA, 20 bp, mouse
gccccgccccgcggaaagaa

SEQ ID NO: 664601 - DNA, 20 bp, mouse
gcgtgcttcacgtccaggga

SEQ ID NO: 664602 - DNA, 20 bp, mouse
gagggccgcccttctttccg

SEQ ID NO: 664603 - DNA, 20 bp, mouse
gaaagaagggcggccctccc

SEQ ID NO: 664604 - DNA, 20 bp, mouse
gccagcgtgcttcacgtcca

SEQ ID NO: 664605 - DNA, 20 bp, mouse
gtgtggggaaataaagcgct

SEQ ID NO: 664606 - DNA, 20 bp, mouse
gtctcgcgagggttctctgg

SEQ ID NO: 664607 - DNA, 20 bp, mouse
gtcgcgcggcgtacctgggt

SEQ ID NO: 664608 - DNA, 20 bp, mouse
gggctcccgccgcagggaag

SEQ ID NO: 664609 - DNA, 20 bp, mouse
ggggtcgcgagtaccagcgc

SEQ ID NO: 664610 - DNA, 20 bp, mouse
gttgtctcgcgagggttctc

SEQ ID NO: 664611 - DNA, 20 bp, mouse
gttcctcggtccacgcccac

SEQ ID NO: 664612 - DNA, 20 bp, mouse
gacccgatgcctcaaggctg

SEQ ID NO: 664613 - DNA, 20 bp, mouse
gcggggacgcgagccggaag

SEQ ID NO: 664614 - DNA, 20 bp, mouse
gcgccccctccgagagtcga

SEQ ID NO: 664615 - DNA, 20 bp, mouse
ggcaccacgcacacccaccc

SEQ ID NO: 664616 - DNA, 20 bp, mouse
gagcatgcgcatcactaggg

SEQ ID NO: 664617 - DNA, 20 bp, mouse
gggtctggagccgaaggggt

SEQ ID NO: 664618 - DNA, 20 bp, mouse
gcgaaggggtggggtctgcg

SEQ ID NO: 664619 - DNA, 20 bp, mouse
gggccggtctggagccgaag

SEQ ID NO: 664620 - DNA, 20 bp, mouse
ggaaaagaagaaaaacccga

SEQ ID NO: 664621 - DNA, 20 bp, mouse
ggcaaacactcgaaagaaga

SEQ ID NO: 664622 - DNA, 20 bp, mouse
gctctgacttaagttccctc

SEQ ID NO: 664623 - DNA, 20 bp, mouse
gccagaagctagtttcttcc

SEQ ID NO: 664624 - DNA, 20 bp, mouse
ggcgctgtgacgcaatacca

SEQ ID NO: 664625 - DNA, 20 bp, mouse
ggagtaaacaatcgcactgt

SEQ ID NO: 664626 - DNA, 20 bp, mouse
gtgaccccggaggcccgtct

SEQ ID NO: 664627 - DNA, 20 bp, mouse
ggggcccagacgggcctccg

SEQ ID NO: 664628 - DNA, 20 bp, mouse
gagggcacggggaaggccgg

SEQ ID NO: 664629 - DNA, 20 bp, mouse
gcccgctgccgccagtgacc

SEQ ID NO: 664630 - DNA, 20 bp, mouse
gagtgacccggtgaccccgg

SEQ ID NO: 664631 - DNA, 20 bp, mouse
gcgggcggcgacggctgcac

SEQ ID NO: 664632 - DNA, 20 bp, mouse
ggggctatgcccaagtggac

SEQ ID NO: 664633 - DNA, 20 bp, mouse
gggcgcctggggcaccggca

SEQ ID NO: 664634 - DNA, 20 bp, mouse
gcgtctgggcccggtgaccc

SEQ ID NO: 664635 - DNA, 20 bp, mouse
ggcatccggacccccgtcac

SEQ ID NO: 664636 - DNA, 20 bp, mouse
gcgggcgcggggaatctaga

SEQ ID NO: 664637 - DNA, 20 bp, mouse
gcccgcccctccagcccgtt

SEQ ID NO: 664638 - DNA, 20 bp, mouse
gccgccctcccgagtgtggg

SEQ ID NO: 664639 - DNA, 20 bp, mouse
gccccctcccacactcggga

SEQ ID NO: 664640 - DNA, 20 bp, mouse
ggggaggcgtggaccgcgga

SEQ ID NO: 664641 - DNA, 20 bp, mouse
gcgggatgagcgttcagtgc

SEQ ID NO: 664642 - DNA, 20 bp, mouse
ggccgccgccctcccgagtg

SEQ ID NO: 664643 - DNA, 20 bp, mouse
gcgcggtccacgcctcccaa

SEQ ID NO: 664644 - DNA, 20 bp, mouse
ggatgagcgttcagtgcggg

SEQ ID NO: 664645 - DNA, 20 bp, mouse
ggggttgcagctgctgaggt

SEQ ID NO: 664646 - DNA, 20 bp, mouse
gccgccgtgccggtgctcgg

SEQ ID NO: 664647 - DNA, 20 bp, mouse
gtgggaagaaggtgtagttg

SEQ ID NO: 664648 - DNA, 20 bp, mouse
gacagaggacggtgcgcagg

SEQ ID NO: 664649 - DNA, 20 bp, mouse
ggaaccgaagacgacagcca

SEQ ID NO: 664650 - DNA, 20 bp, mouse
gtggccaccgagcaccggca

SEQ ID NO: 664651 - DNA, 20 bp, mouse
gtaggcctctgcggacagcg

SEQ ID NO: 664652 - DNA, 20 bp, mouse
gggggctggccaccgagcac

SEQ ID NO: 664653 - DNA, 20 bp, mouse
gtcgccgccgtgccggtgct

SEQ ID NO: 664654 - DNA, 20 bp, mouse
ggcctcgagaaacctctcct

SEQ ID NO: 664655 - DNA, 20 bp, mouse
gaccggtgccggccctccag

SEQ ID NO: 664656 - DNA, 20 bp, mouse
ggcggggcctagtgaagatg

SEQ ID NO: 664657 - DNA, 20 bp, mouse
gccaaccagtggctcggctc

SEQ ID NO: 664658 - DNA, 20 bp, mouse
gcgcgcaggtgaagctgctt

SEQ ID NO: 664659 - DNA, 20 bp, mouse
ggaagatggggcggggacca

SEQ ID NO: 664660 - DNA, 20 bp, mouse
gcatgcgctgatccaaccag

SEQ ID NO: 664661 - DNA, 20 bp, mouse
ggtgcggccaggacggtccc

SEQ ID NO: 664662 - DNA, 20 bp, mouse
gggcaacccgggaaaggatg

SEQ ID NO: 664663 - DNA, 20 bp, mouse
gtctctcgggatccccggac

SEQ ID NO: 664664 - DNA, 20 bp, mouse
gaagtggcgggtgagaggcg

SEQ ID NO: 664665 - DNA, 20 bp, mouse
gcagtggctcggctctggac

SEQ ID NO: 664666 - DNA, 20 bp, mouse
gtctgaaaaggattcaaccg

SEQ ID NO: 664667 - DNA, 20 bp, mouse
gcctgcagcagaaacacgtg

SEQ ID NO: 664668 - DNA, 20 bp, mouse
gggagtgcctgttgtagttg

SEQ ID NO: 664669 - DNA, 20 bp, mouse
gtgaagaagaatcatttccg

SEQ ID NO: 664670 - DNA, 20 bp, mouse
gacagcaggattggactcgg

SEQ ID NO: 664671 - DNA, 20 bp, mouse
gagggctgggcctgagactc

SEQ ID NO: 664672 - DNA, 20 bp, mouse
gggagaggaacaagtaggca

SEQ ID NO: 664673 - DNA, 20 bp, mouse
gttctggcttgtaagtctgt

SEQ ID NO: 664674 - DNA, 20 bp, mouse
ggagaaggtagagaatctgt

SEQ ID NO: 664675 - DNA, 20 bp, mouse
gtctaactctgcaacggaac

SEQ ID NO: 664676 - DNA, 20 bp, mouse
ggagccctggttgactttct

SEQ ID NO: 664677 - DNA, 20 bp, mouse
gttgactttacaaagtttat

SEQ ID NO: 664678 - DNA, 20 bp, mouse
ggcttataatagcagagccc

SEQ ID NO: 664679 - DNA, 20 bp, mouse
gagcaccattggtatgtttc

SEQ ID NO: 664680 - DNA, 20 bp, mouse
gtttcccagaaagtcaacca

SEQ ID NO: 664681 - DNA, 20 bp, mouse
gcttcccagaaacataccaa

SEQ ID NO: 664682 - DNA, 20 bp, mouse
gagcaggagaatttggcaag

SEQ ID NO: 664683 - DNA, 20 bp, mouse
ggaaacaagatgacgtacct

SEQ ID NO: 664684 - DNA, 20 bp, mouse
gacgtacctgggttttgaat

SEQ ID NO: 664685 - DNA, 20 bp, mouse
gggctgtaaaagttaaataa

SEQ ID NO: 664686 - DNA, 20 bp, mouse
gcacctcccggcctacctga

SEQ ID NO: 664687 - DNA, 20 bp, mouse
gaggccgggaggtggtgcag

SEQ ID NO: 664688 - DNA, 20 bp, mouse
gtggatgctctccctcaggt

SEQ ID NO: 664689 - DNA, 20 bp, mouse
ggacaagagagccacaccct

SEQ ID NO: 664690 - DNA, 20 bp, mouse
gaacccgggatagagagcag

SEQ ID NO: 664691 - DNA, 20 bp, mouse
gacacctgccgccaagggtg

SEQ ID NO: 664692 - DNA, 20 bp, mouse
ggagcagagtcaaacgccca

SEQ ID NO: 664693 - DNA, 20 bp, mouse
gcccctctgctctctatccc

SEQ ID NO: 664694 - DNA, 20 bp, mouse
gctcctacacctgccgccaa

SEQ ID NO: 664695 - DNA, 20 bp, mouse
ggaatgaacgaacgatggca

SEQ ID NO: 664696 - DNA, 20 bp, mouse
ggaggctcgcacagcccaat

SEQ ID NO: 664697 - DNA, 20 bp, mouse
ggcgctagaaggaacgggaa

SEQ ID NO: 664698 - DNA, 20 bp, mouse
gcttgcgcatgtcccggcgt

SEQ ID NO: 664699 - DNA, 20 bp, mouse
gaggaggcgctagaaggaac

SEQ ID NO: 664700 - DNA, 20 bp, mouse
gaggggcgggaaaagagcga

SEQ ID NO: 664701 - DNA, 20 bp, mouse
gaagcgcacactgctcgctg

SEQ ID NO: 664702 - DNA, 20 bp, mouse
gggaggggtcggaggaacca

SEQ ID NO: 664703 - DNA, 20 bp, mouse
gtaactacaagagaccaaag

SEQ ID NO: 664704 - DNA, 20 bp, mouse
ggtcggaggaaccaggggag

SEQ ID NO: 664705 - DNA, 20 bp, mouse
ggaagagaggaggcgctaga

SEQ ID NO: 664706 - DNA, 20 bp, mouse
ggggcctgcgctacgagacg

SEQ ID NO: 664707 - DNA, 20 bp, mouse
gacgagacggggctcagtcg

SEQ ID NO: 664708 - DNA, 20 bp, mouse
gcggggccctaggcttgccc

SEQ ID NO: 664709 - DNA, 20 bp, mouse
ggagccccgtctcgtagcgc

SEQ ID NO: 664710 - DNA, 20 bp, mouse
gggcgcaagtcggccggagg

SEQ ID NO: 664711 - DNA, 20 bp, mouse
gccaagatgggcgtctaggg

SEQ ID NO: 664712 - DNA, 20 bp, mouse
gcgcacacgccagtcgcgat

SEQ ID NO: 664713 - DNA, 20 bp, mouse
ggcgccaagatgggcgtcta

SEQ ID NO: 664714 - DNA, 20 bp, mouse
gtaggcttgccctgggtggg

SEQ ID NO: 664715 - DNA, 20 bp, mouse
gtgaaacccgcgcgaggggg

SEQ ID NO: 664716 - DNA, 20 bp, mouse
gagaaagtatcaactgctgt

SEQ ID NO: 664717 - DNA, 20 bp, mouse
gaagcagcactgtgtcttac

SEQ ID NO: 664718 - DNA, 20 bp, mouse
gtgggcatttccttagcata

SEQ ID NO: 664719 - DNA, 20 bp, mouse
gtgacgaagtgataaaattc

SEQ ID NO: 664720 - DNA, 20 bp, mouse
gtgcacccagggtggacaaa

SEQ ID NO: 664721 - DNA, 20 bp, mouse
gtgttcaagaggctacgaac

SEQ ID NO: 664722 - DNA, 20 bp, mouse
gcagctctttcaacatctcc

SEQ ID NO: 664723 - DNA, 20 bp, mouse
ggtagcctcttgaacaaata

SEQ ID NO: 664724 - DNA, 20 bp, mouse
gtaatgaaatgcacccaggg

SEQ ID NO: 664725 - DNA, 20 bp, mouse
gggccagttttatgagttac

SEQ ID NO: 664726 - DNA, 20 bp, mouse
gactgcccggggagcaagta

SEQ ID NO: 664727 - DNA, 20 bp, mouse
ggggaagagggcactgcccg

SEQ ID NO: 664728 - DNA, 20 bp, mouse
gtagggcaacttcacgtcca

SEQ ID NO: 664729 - DNA, 20 bp, mouse
gacaaagggcccagttgctt

SEQ ID NO: 664730 - DNA, 20 bp, mouse
ggcgttgcctgggtgacaaa

SEQ ID NO: 664731 - DNA, 20 bp, mouse
ggcgaagagcgattgtcggg

SEQ ID NO: 664732 - DNA, 20 bp, mouse
gaacactgagttcaccaccc

SEQ ID NO: 664733 - DNA, 20 bp, mouse
gcttcctcctgcacagagcc

SEQ ID NO: 664734 - DNA, 20 bp, mouse
ggtggcgaagagcgattgtc

SEQ ID NO: 664735 - DNA, 20 bp, mouse
gggggctggcaggaaacggg

SEQ ID NO: 664736 - DNA, 20 bp, mouse
gagggggggacgcagcacgt

SEQ ID NO: 664737 - DNA, 20 bp, mouse
ggggggacgcagcacgtggg

SEQ ID NO: 664738 - DNA, 20 bp, mouse
gcccgcgcgagcttctcccg

SEQ ID NO: 664739 - DNA, 20 bp, mouse
gtcgcccaaacgtcgcagag

SEQ ID NO: 664740 - DNA, 20 bp, mouse
gtggcaagcgtcaccggcac

SEQ ID NO: 664741 - DNA, 20 bp, mouse
gccctgcggctgcaggaact

SEQ ID NO: 664742 - DNA, 20 bp, mouse
gtccccccctctgcgacgtt

SEQ ID NO: 664743 - DNA, 20 bp, mouse
gcgaagttggcaagcgtcac

SEQ ID NO: 664744 - DNA, 20 bp, mouse
gctcgcgcgggaagctcgcg

SEQ ID NO: 664745 - DNA, 20 bp, mouse
gagagcccgccagttctgta

SEQ ID NO: 664746 - DNA, 20 bp, mouse
gcactctcggaggtagggac

SEQ ID NO: 664747 - DNA, 20 bp, mouse
ggaaatgtcagcactctcgg

SEQ ID NO: 664748 - DNA, 20 bp, mouse
ggtcagcactctcggaggta

SEQ ID NO: 664749 - DNA, 20 bp, mouse
gctacaggatatggggagga

SEQ ID NO: 664750 - DNA, 20 bp, mouse
ggctctggttccactgtctc

SEQ ID NO: 664751 - DNA, 20 bp, mouse
gcaggctatcccagagacag

SEQ ID NO: 664752 - DNA, 20 bp, mouse
gagggtttctgcgtgaaagg

SEQ ID NO: 664753 - DNA, 20 bp, mouse
gctagaaatgtcagcactct

SEQ ID NO: 664754 - DNA, 20 bp, mouse
gaaaggaggtgtggttggac

SEQ ID NO: 664755 - DNA, 20 bp, mouse
ggggaatcctacaggatatg

SEQ ID NO: 664756 - DNA, 20 bp, mouse
gctgggagacgctaatgaaa

SEQ ID NO: 664757 - DNA, 20 bp, mouse
gacggggcggggtttctccg

SEQ ID NO: 664758 - DNA, 20 bp, mouse
gacctcagtgacaacggggc

SEQ ID NO: 664759 - DNA, 20 bp, mouse
gtggaggctcctagctgttt

SEQ ID NO: 664760 - DNA, 20 bp, mouse
gcaccagagcggaagtgggg

SEQ ID NO: 664761 - DNA, 20 bp, mouse
gcgtcaccagagcggaagtg

SEQ ID NO: 664762 - DNA, 20 bp, mouse
gtgtggctccgaagggaagt

SEQ ID NO: 664763 - DNA, 20 bp, mouse
gagccagttcccgccattga

SEQ ID NO: 664764 - DNA, 20 bp, mouse
gcacggtaaggacgccaggg

SEQ ID NO: 664765 - DNA, 20 bp, mouse
gagcggaagtggggcgggtc

SEQ ID NO: 664766 - DNA, 20 bp, mouse
ggcgaagcagcgcggtcgta

SEQ ID NO: 664767 - DNA, 20 bp, mouse
gtccgtacggcgaagtgatg

SEQ ID NO: 664768 - DNA, 20 bp, mouse
gcctgagagcgcggcgttga

SEQ ID NO: 664769 - DNA, 20 bp, mouse
ggagcggagcccagtggacc

SEQ ID NO: 664770 - DNA, 20 bp, mouse
gcggggcgaaggaactcggt

SEQ ID NO: 664771 - DNA, 20 bp, mouse
gcggtcgtagggcgtggcga

SEQ ID NO: 664772 - DNA, 20 bp, mouse
gcccagtgagcgcgagtcac

SEQ ID NO: 664773 - DNA, 20 bp, mouse
ggagcgcgagtcacaggccg

SEQ ID NO: 664774 - DNA, 20 bp, mouse
gggagctgttttgattgcgg

SEQ ID NO: 664775 - DNA, 20 bp, mouse
gcgagtcacaggccgcgggg

SEQ ID NO: 664776 - DNA, 20 bp, mouse
ggggagggagcctagggaag

SEQ ID NO: 664777 - DNA, 20 bp, mouse
gagggatggataaccttctg

SEQ ID NO: 664778 - DNA, 20 bp, mouse
gaaggagtcctggacactgg

SEQ ID NO: 664779 - DNA, 20 bp, mouse
gcctagggaagaggtatagg

SEQ ID NO: 664780 - DNA, 20 bp, mouse
gtgcatggggccaggggcta

SEQ ID NO: 664781 - DNA, 20 bp, mouse
gctgtctaaatatgtctctg

SEQ ID NO: 664782 - DNA, 20 bp, mouse
ggccaggggctaaggagtcc

SEQ ID NO: 664783 - DNA, 20 bp, mouse
gagggggtgccagtttcaag

SEQ ID NO: 664784 - DNA, 20 bp, mouse
ggctgctgggagggagccta

SEQ ID NO: 664785 - DNA, 20 bp, mouse
ggggggatgtagggtatcca

SEQ ID NO: 664786 - DNA, 20 bp, mouse
gaggctgggagagctatgta

SEQ ID NO: 664787 - DNA, 20 bp, mouse
ggagctatgtaaggtatcta

SEQ ID NO: 664788 - DNA, 20 bp, mouse
gggagttcttaatgagacag

SEQ ID NO: 664789 - DNA, 20 bp, mouse
gcaagagccaggcacgggct

SEQ ID NO: 664790 - DNA, 20 bp, mouse
gtcagatatgacactgttga

SEQ ID NO: 664791 - DNA, 20 bp, mouse
gtgtccatgcagcgtgtcag

SEQ ID NO: 664792 - DNA, 20 bp, mouse
gagaaggaaactcgtgggga

SEQ ID NO: 664793 - DNA, 20 bp, mouse
gaaaggctgcaaggctgtcc

SEQ ID NO: 664794 - DNA, 20 bp, mouse
ggaaaagaaggaaactcgtg

SEQ ID NO: 664795 - DNA, 20 bp, mouse
gcttccaagaagacctagaa

SEQ ID NO: 664796 - DNA, 20 bp, mouse
gcctccctggagatggaaag

SEQ ID NO: 664797 - DNA, 20 bp, mouse
gtgtgtgctgcggggaagga

SEQ ID NO: 664798 - DNA, 20 bp, mouse
ggcgggaagcgtgtgtgctg

SEQ ID NO: 664799 - DNA, 20 bp, mouse
gctgctcctgctgttggtct

SEQ ID NO: 664800 - DNA, 20 bp, mouse
gagcgtgtgtgctgcgggga

SEQ ID NO: 664801 - DNA, 20 bp, mouse
gatgaggctctagccatccc

SEQ ID NO: 664802 - DNA, 20 bp, mouse
ggcaactgtgccagaggatg

SEQ ID NO: 664803 - DNA, 20 bp, mouse
gggagcaggatcggaagcct

SEQ ID NO: 664804 - DNA, 20 bp, mouse
ggactccagcgttgcttcag

SEQ ID NO: 664805 - DNA, 20 bp, mouse
gctggctcacagttgtgctc

SEQ ID NO: 664806 - DNA, 20 bp, mouse
gacagcaggcatggaggcgt

SEQ ID NO: 664807 - DNA, 20 bp, mouse
gtgggtgtggcctgaagctc

SEQ ID NO: 664808 - DNA, 20 bp, mouse
gcctccacttaccatgaagt

SEQ ID NO: 664809 - DNA, 20 bp, mouse
gtaccatgaagtgggacagc

SEQ ID NO: 664810 - DNA, 20 bp, mouse
gtcccaggagctggattcta

SEQ ID NO: 664811 - DNA, 20 bp, mouse
ggaggcggggccagagcttc

SEQ ID NO: 664812 - DNA, 20 bp, mouse
gagtcaaatgaaaggaacgg

SEQ ID NO: 664813 - DNA, 20 bp, mouse
gcaaatgaaaggaacggggg

SEQ ID NO: 664814 - DNA, 20 bp, mouse
ggaaaggaacgggggaggcg

SEQ ID NO: 664815 - DNA, 20 bp, mouse
gtgtcccacttcatggtaag

SEQ ID NO: 664816 - DNA, 20 bp, mouse
gaaccctagccctccattta

SEQ ID NO: 664817 - DNA, 20 bp, mouse
gctgccactccctaaatgga

SEQ ID NO: 664818 - DNA, 20 bp, mouse
gccaaagctaattaggaaag

SEQ ID NO: 664819 - DNA, 20 bp, mouse
ggcagctcgccacacccagg

SEQ ID NO: 664820 - DNA, 20 bp, mouse
gaatggagggctagggttgg

SEQ ID NO: 664821 - DNA, 20 bp, mouse
gtagccacctgcttgcccgc

SEQ ID NO: 664822 - DNA, 20 bp, mouse
gggtctggacaactccaccc

SEQ ID NO: 664823 - DNA, 20 bp, mouse
gtcagctgccactccctaaa

SEQ ID NO: 664824 - DNA, 20 bp, mouse
ggagctgccgcgccgcgact

SEQ ID NO: 664825 - DNA, 20 bp, mouse
gggagattgcagttcccggg

SEQ ID NO: 664826 - DNA, 20 bp, mouse
gaatgctagaggggaaggtc

SEQ ID NO: 664827 - DNA, 20 bp, mouse
gaaaacccgggccggatcgc

SEQ ID NO: 664828 - DNA, 20 bp, mouse
gggccgaacgggcgagtggg

SEQ ID NO: 664829 - DNA, 20 bp, mouse
ggggtgggaagaatgctaga

SEQ ID NO: 664830 - DNA, 20 bp, mouse
gcggagcccagccttggcgg

SEQ ID NO: 664831 - DNA, 20 bp, mouse
gcgcacgcggagcccagcct

SEQ ID NO: 664832 - DNA, 20 bp, mouse
gggaaggtctgggggtgtga

SEQ ID NO: 664833 - DNA, 20 bp, mouse
gggaagaatgctagagggga

SEQ ID NO: 664834 - DNA, 20 bp, mouse
gggagcccagccccgcgatc

SEQ ID NO: 664835 - DNA, 20 bp, mouse
gcgtgcgcgcgcggcgagat

SEQ ID NO: 664836 - DNA, 20 bp, mouse
gagggtggggcgagaagtgg

SEQ ID NO: 664837 - DNA, 20 bp, mouse
gctcccggaggtggaccccc

SEQ ID NO: 664838 - DNA, 20 bp, mouse
gagagactggggagacgggt

SEQ ID NO: 664839 - DNA, 20 bp, mouse
ggggacggccgcctcctgat

SEQ ID NO: 664840 - DNA, 20 bp, mouse
ggagaagtgggggctcccgg

SEQ ID NO: 664841 - DNA, 20 bp, mouse
gacgggattggaaggagggt

SEQ ID NO: 664842 - DNA, 20 bp, mouse
gcccccggataggaagagac

SEQ ID NO: 664843 - DNA, 20 bp, mouse
gcaggaggcggccgtcccaa

SEQ ID NO: 664844 - DNA, 20 bp, mouse
gggaggtggaccccccggat

SEQ ID NO: 664845 - DNA, 20 bp, mouse
gactctagaaaggacgggat

SEQ ID NO: 664846 - DNA, 20 bp, mouse
gacccccgaacccagcacta

SEQ ID NO: 664847 - DNA, 20 bp, mouse
gtccctagtgctgggttcgg

SEQ ID NO: 664848 - DNA, 20 bp, mouse
gccagcagaggcagtgttag

SEQ ID NO: 664849 - DNA, 20 bp, mouse
gaggtctcgctttacaaatg

SEQ ID NO: 664850 - DNA, 20 bp, mouse
gaggaaagttattagggtct

SEQ ID NO: 664851 - DNA, 20 bp, mouse
gttctgattttacaataaag

SEQ ID NO: 664852 - DNA, 20 bp, mouse
gcactgatgacatcatagaa

SEQ ID NO: 664853 - DNA, 20 bp, mouse
ggcctccctagtgctgggtt

SEQ ID NO: 664854 - DNA, 20 bp, mouse
gatctctgtgagctcaagtc

SEQ ID NO: 664855 - DNA, 20 bp, mouse
gaaaatcagaaaactgggct

SEQ ID NO: 664856 - DNA, 20 bp, mouse
gggccccgagcaggcctagg

SEQ ID NO: 664857 - DNA, 20 bp, mouse
ggggaccggagaaatgagat

SEQ ID NO: 664858 - DNA, 20 bp, mouse
gaggcggaggggtgaagtca

SEQ ID NO: 664859 - DNA, 20 bp, mouse
ggcggcgggtcgcggtcgga

SEQ ID NO: 664860 - DNA, 20 bp, mouse
ggccgaggtcccaaccccct

SEQ ID NO: 664861 - DNA, 20 bp, mouse
gacgcgcgagcgcaggcaag

SEQ ID NO: 664862 - DNA, 20 bp, mouse
gggcaagcggctgcagattg

SEQ ID NO: 664863 - DNA, 20 bp, mouse
gcccgccggtctggctgtgg

SEQ ID NO: 664864 - DNA, 20 bp, mouse
gggggtcggtgggaagtagg

SEQ ID NO: 664865 - DNA, 20 bp, mouse
gaggcctgctagatagtgga

SEQ ID NO: 664866 - DNA, 20 bp, mouse
gtgagtacctagcaaccctg

SEQ ID NO: 664867 - DNA, 20 bp, mouse
gataaggaatgctccagaga

SEQ ID NO: 664868 - DNA, 20 bp, mouse
gcaaagcgggcacatcatga

SEQ ID NO: 664869 - DNA, 20 bp, mouse
gagcaccagagatacctaga

SEQ ID NO: 664870 - DNA, 20 bp, mouse
gctggagcattccttatctc

SEQ ID NO: 664871 - DNA, 20 bp, mouse
gactagtaggcttgagaggg

SEQ ID NO: 664872 - DNA, 20 bp, mouse
gtagcaaccctggggaaagc

SEQ ID NO: 664873 - DNA, 20 bp, mouse
gcattctagctgtcactagt

SEQ ID NO: 664874 - DNA, 20 bp, mouse
ggttccttcttcctgagata

SEQ ID NO: 664875 - DNA, 20 bp, mouse
gcccacggacacacctgggg

SEQ ID NO: 664876 - DNA, 20 bp, mouse
gagtacctggatccagaaaa

SEQ ID NO: 664877 - DNA, 20 bp, mouse
ggatccaggtactcgaggtg

SEQ ID NO: 664878 - DNA, 20 bp, mouse
ggttagaggctggtgggaat

SEQ ID NO: 664879 - DNA, 20 bp, mouse
gcgaggtggggctgagtgaa

SEQ ID NO: 664880 - DNA, 20 bp, mouse
gccagggagcaaagtctact

SEQ ID NO: 664881 - DNA, 20 bp, mouse
ggaaccaagtattcagccaa

SEQ ID NO: 664882 - DNA, 20 bp, mouse
gtcagtggttagaggctggt

SEQ ID NO: 664883 - DNA, 20 bp, mouse
gaagcccttggctgaatact

SEQ ID NO: 664884 - DNA, 20 bp, mouse
gggcatcagtggacatgtag

SEQ ID NO: 664885 - DNA, 20 bp, mouse
gaggctggtgggaataggtc

SEQ ID NO: 664886 - DNA, 20 bp, mouse
gtaaagctaaggcagccatc

SEQ ID NO: 664887 - DNA, 20 bp, mouse
gcacacagggtgcaaagcct

SEQ ID NO: 664888 - DNA, 20 bp, mouse
gttgcaagtcattagctctt

SEQ ID NO: 664889 - DNA, 20 bp, mouse
ggtaccaaatagtcataaat

SEQ ID NO: 664890 - DNA, 20 bp, mouse
gttatgactatttggtactg

SEQ ID NO: 664891 - DNA, 20 bp, mouse
gtggagacagaatgaccctt

SEQ ID NO: 664892 - DNA, 20 bp, mouse
ggatatgaagctctccctga

SEQ ID NO: 664893 - DNA, 20 bp, mouse
ggggtgtgcagactcactaa

SEQ ID NO: 664894 - DNA, 20 bp, mouse
ggatgcttattgagtactta

SEQ ID NO: 664895 - DNA, 20 bp, mouse
ggaaaaccgtaacagccaaa

SEQ ID NO: 664896 - DNA, 20 bp, mouse
gcactagcatgagcacacgt

SEQ ID NO: 664897 - DNA, 20 bp, mouse
gggagtgggcatgcgcaata

SEQ ID NO: 664898 - DNA, 20 bp, mouse
gcccggttaggtctacgcag

SEQ ID NO: 664899 - DNA, 20 bp, mouse
gaggtctacgcagaggaaac

SEQ ID NO: 664900 - DNA, 20 bp, mouse
gggagccggagcatgcacac

SEQ ID NO: 664901 - DNA, 20 bp, mouse
ggaacctgggtgtaattttc

SEQ ID NO: 664902 - DNA, 20 bp, mouse
gaaacctgaaaattacaccc

SEQ ID NO: 664903 - DNA, 20 bp, mouse
ggacgtgtcggacaaaagcc

SEQ ID NO: 664904 - DNA, 20 bp, mouse
ggcacgcgcaccaggtaaga

SEQ ID NO: 664905 - DNA, 20 bp, mouse
ggagacccgtgtgcatgctc

SEQ ID NO: 664906 - DNA, 20 bp, mouse
ggtgggcgaggattcacgaa

SEQ ID NO: 664907 - DNA, 20 bp, mouse
gctagcgagttcggaggtgt

SEQ ID NO: 664908 - DNA, 20 bp, mouse
ggcaaagagcctagcgagtt

SEQ ID NO: 664909 - DNA, 20 bp, mouse
gtgggcggggaaccttttga

SEQ ID NO: 664910 - DNA, 20 bp, mouse
gaagagcctagcgagttcgg

SEQ ID NO: 664911 - DNA, 20 bp, mouse
ggtggcgaagagcagtgtgt

SEQ ID NO: 664912 - DNA, 20 bp, mouse
gggcaggagcgaaaagaaag

SEQ ID NO: 664913 - DNA, 20 bp, mouse
gctaccgcgacactccagac

SEQ ID NO: 664914 - DNA, 20 bp, mouse
gtgaaccaggaccagggtcg

SEQ ID NO: 664915 - DNA, 20 bp, mouse
ggggcctgaaccaggaccgg

SEQ ID NO: 664916 - DNA, 20 bp, mouse
gggcccaaggccttgagagc

SEQ ID NO: 664917 - DNA, 20 bp, mouse
gaaggccttgggcccgtgct

SEQ ID NO: 664918 - DNA, 20 bp, mouse
gggtgggcagatctggaagt

SEQ ID NO: 664919 - DNA, 20 bp, mouse
gatctggaggtgggcagatc

SEQ ID NO: 664920 - DNA, 20 bp, mouse
gatgacagggacataagttc

SEQ ID NO: 664921 - DNA, 20 bp, mouse
gttttcccagcacgggccca

SEQ ID NO: 664922 - DNA, 20 bp, mouse
ggccctgctctcaaggcctt

SEQ ID NO: 664923 - DNA, 20 bp, mouse
gtgctagagccctgctctca

SEQ ID NO: 664924 - DNA, 20 bp, mouse
gaggcaggaatctagcatta

SEQ ID NO: 664925 - DNA, 20 bp, mouse
gctagcattagggcatgata

SEQ ID NO: 664926 - DNA, 20 bp, mouse
ggcggagagaaggaatacag

SEQ ID NO: 664927 - DNA, 20 bp, mouse
gcataggtctggcggagaga

SEQ ID NO: 664928 - DNA, 20 bp, mouse
gagtcagggccgagagccgt

SEQ ID NO: 664929 - DNA, 20 bp, mouse
ggaccttaggacagtgttaa

SEQ ID NO: 664930 - DNA, 20 bp, mouse
gtgtggggtcataggtctgg

SEQ ID NO: 664931 - DNA, 20 bp, mouse
gggtgaggttgtggggtcat

SEQ ID NO: 664932 - DNA, 20 bp, mouse
ggtgcaaggaagaagcacgg

SEQ ID NO: 664933 - DNA, 20 bp, mouse
ggggacttcgccctgacccc

SEQ ID NO: 664934 - DNA, 20 bp, mouse
gagggaccacggagcaggtg

SEQ ID NO: 664935 - DNA, 20 bp, mouse
gaacccttaacactgtccta

SEQ ID NO: 664936 - DNA, 20 bp, mouse
ggggtctaggcacatcccca

SEQ ID NO: 664937 - DNA, 20 bp, mouse
gagggcggggagtgccggcg

SEQ ID NO: 664938 - DNA, 20 bp, mouse
gcctctgctgccagaacctt

SEQ ID NO: 664939 - DNA, 20 bp, mouse
gcccctggatgcctctctgt

SEQ ID NO: 664940 - DNA, 20 bp, mouse
gctgatgaaggctttctcac

SEQ ID NO: 664941 - DNA, 20 bp, mouse
gcctcttggctgttcgccag

SEQ ID NO: 664942 - DNA, 20 bp, mouse
gagacagatcagttctacgt

SEQ ID NO: 664943 - DNA, 20 bp, mouse
gcatcagagctaggcagttt

SEQ ID NO: 664944 - DNA, 20 bp, mouse
gcgtgctctgcgccgggtct

SEQ ID NO: 664945 - DNA, 20 bp, mouse
ggaaaacacgcgctctcccc

SEQ ID NO: 664946 - DNA, 20 bp, mouse
gcctccccgcaggcccggcg

SEQ ID NO: 664947 - DNA, 20 bp, mouse
gggctcgatgagtcatctcc

SEQ ID NO: 664948 - DNA, 20 bp, mouse
gcgggcaaagcagacctccc

SEQ ID NO: 664949 - DNA, 20 bp, mouse
gggcggggttcggccagcca

SEQ ID NO: 664950 - DNA, 20 bp, mouse
gaaggtctggaggtgctagg

SEQ ID NO: 664951 - DNA, 20 bp, mouse
gcaaggctgggagcgggaac

SEQ ID NO: 664952 - DNA, 20 bp, mouse
ggcaagccaagtggcccggg

SEQ ID NO: 664953 - DNA, 20 bp, mouse
gaggtgtgtgtactggaaga

SEQ ID NO: 664954 - DNA, 20 bp, mouse
gcccaaggagcccggggaac

SEQ ID NO: 664955 - DNA, 20 bp, mouse
gtagcctcgggctgcccggg

SEQ ID NO: 664956 - DNA, 20 bp, mouse
ggcagaacgctccttaaagg

SEQ ID NO: 664957 - DNA, 20 bp, mouse
gcctgggaggagcctgagta

SEQ ID NO: 664958 - DNA, 20 bp, mouse
gagcagctgcccaagaaggg

SEQ ID NO: 664959 - DNA, 20 bp, mouse
gtggccttcccggtactctg

SEQ ID NO: 664960 - DNA, 20 bp, mouse
gagcagagcggcaaattcca

SEQ ID NO: 664961 - DNA, 20 bp, mouse
gcccgcctccacagagtacc

SEQ ID NO: 664962 - DNA, 20 bp, mouse
ggtggctggcagggaatgcc

SEQ ID NO: 664963 - DNA, 20 bp, mouse
gccaggtctcctctcgcgtg

SEQ ID NO: 664964 - DNA, 20 bp, mouse
gccttcccggtactctgtgg

SEQ ID NO: 664965 - DNA, 20 bp, mouse
gaggccggctgaagttatgc

SEQ ID NO: 664966 - DNA, 20 bp, mouse
ggccacgcatagcgcgcggg

SEQ ID NO: 664967 - DNA, 20 bp, mouse
gacgcagcctggcgcggaag

SEQ ID NO: 664968 - DNA, 20 bp, mouse
gtctggagctcggagaaggg

SEQ ID NO: 664969 - DNA, 20 bp, mouse
gaagtctggagctcggagaa

SEQ ID NO: 664970 - DNA, 20 bp, mouse
gtgggcggcaacctaggaac

SEQ ID NO: 664971 - DNA, 20 bp, mouse
gggaaggggcgggccaggtc

SEQ ID NO: 664972 - DNA, 20 bp, mouse
gcagcctggcgcggaagggg

SEQ ID NO: 664973 - DNA, 20 bp, mouse
ggctgcgtcctatcctggag

SEQ ID NO: 664974 - DNA, 20 bp, mouse
gggcgggccaggtcaggagg

SEQ ID NO: 664975 - DNA, 20 bp, mouse
gaggggcgggccaggtcagg

SEQ ID NO: 664976 - DNA, 20 bp, mouse
ggggtccgactcaggacgta

SEQ ID NO: 664977 - DNA, 20 bp, mouse
ggaaccgggcctctctccgg

SEQ ID NO: 664978 - DNA, 20 bp, mouse
ggagcgagcgcgatgggcgt

SEQ ID NO: 664979 - DNA, 20 bp, mouse
ggcgccgggcgcacggaacc

SEQ ID NO: 664980 - DNA, 20 bp, mouse
gcgcgcgtgggacccccgta

SEQ ID NO: 664981 - DNA, 20 bp, mouse
gcgggagccgctctgggcat

SEQ ID NO: 664982 - DNA, 20 bp, mouse
gacggaaccgggcctctctc

SEQ ID NO: 664983 - DNA, 20 bp, mouse
gccacccgggcggtggaggc

SEQ ID NO: 664984 - DNA, 20 bp, mouse
gtggctatggggtccgactc

SEQ ID NO: 664985 - DNA, 20 bp, mouse
gcggccgccggagagaggcc

SEQ ID NO: 664986 - DNA, 20 bp, mouse
gtgtcacagtgataatgcgg

SEQ ID NO: 664987 - DNA, 20 bp, mouse
ggggataggaggaagttgtt

SEQ ID NO: 664988 - DNA, 20 bp, mouse
ggggttgtggccctggacgg

SEQ ID NO: 664989 - DNA, 20 bp, mouse
gcgggcttggggacagcatg

SEQ ID NO: 664990 - DNA, 20 bp, mouse
gaggcagatggttcctgacg

SEQ ID NO: 664991 - DNA, 20 bp, mouse
ggggctacaggcgggatagg

SEQ ID NO: 664992 - DNA, 20 bp, mouse
gttgggaagtcagaccggaa

SEQ ID NO: 664993 - DNA, 20 bp, mouse
gcacagtgataatgcggtgg

SEQ ID NO: 664994 - DNA, 20 bp, mouse
ggactcccaccctccgtcca

SEQ ID NO: 664995 - DNA, 20 bp, mouse
gctgtgtcacagtgataatg

SEQ ID NO: 664996 - DNA, 20 bp, mouse
gcgggtcgtggagttgtgaa

SEQ ID NO: 664997 - DNA, 20 bp, mouse
gggccccgcaagcgggtggg

SEQ ID NO: 664998 - DNA, 20 bp, mouse
ggaagcccgcggacaggcaa

SEQ ID NO: 664999 - DNA, 20 bp, mouse
gcgggtgggtggcgcatgcg

SEQ ID NO: 665000 - DNA, 20 bp, mouse
gaggcgggcggcggtagcgt

SEQ ID NO: 665001 - DNA, 20 bp, mouse
gcaacggctgaggcgggcgg

SEQ ID NO: 665002 - DNA, 20 bp, mouse
gcagcggccccgcaagcggg

SEQ ID NO: 665003 - DNA, 20 bp, mouse
gggcggcggtagcgtgggtt

SEQ ID NO: 665004 - DNA, 20 bp, mouse
gacccagcggccccgcaagc

SEQ ID NO: 665005 - DNA, 20 bp, mouse
gaagtggcggccgcagccgg

SEQ ID NO: 665006 - DNA, 20 bp, mouse
gtgggtcagggcgggagcag

SEQ ID NO: 665007 - DNA, 20 bp, mouse
gagcagtgggcgcggaaact

SEQ ID NO: 665008 - DNA, 20 bp, mouse
ggctcccgccctgacccact

SEQ ID NO: 665009 - DNA, 20 bp, mouse
ggggcgcggaaacttggtcg

SEQ ID NO: 665010 - DNA, 20 bp, mouse
gcaggggcgcgcctcagggc

SEQ ID NO: 665011 - DNA, 20 bp, mouse
gccgccccgcccgtcccagt

SEQ ID NO: 665012 - DNA, 20 bp, mouse
gctgaggcgcgcccctgcgc

SEQ ID NO: 665013 - DNA, 20 bp, mouse
gcgcctccctctcactccct

SEQ ID NO: 665014 - DNA, 20 bp, mouse
gcgtgcacccgcgtgccccg

SEQ ID NO: 665015 - DNA, 20 bp, mouse
gccgtcccagtgggtcaggg

SEQ ID NO: 665016 - DNA, 20 bp, mouse
gccccggagaccaaggcgtg

SEQ ID NO: 665017 - DNA, 20 bp, mouse
ggtggaggacgtggactggg

SEQ ID NO: 665018 - DNA, 20 bp, mouse
gggaggaggagaccactcac

SEQ ID NO: 665019 - DNA, 20 bp, mouse
gcccgggagggagcggactc

SEQ ID NO: 665020 - DNA, 20 bp, mouse
ggccggggagctaaccaatg

SEQ ID NO: 665021 - DNA, 20 bp, mouse
ggtcccgcgccacactcggg

SEQ ID NO: 665022 - DNA, 20 bp, mouse
ggtggactggggggtagcgc

SEQ ID NO: 665023 - DNA, 20 bp, mouse
gccacctgcgcacccctcat

SEQ ID NO: 665024 - DNA, 20 bp, mouse
gagcgtctcgtcccgcccat

SEQ ID NO: 665025 - DNA, 20 bp, mouse
gggcctcccgagtgtggcgc

SEQ ID NO: 665026 - DNA, 20 bp, mouse
gtggacgcctgtagagtctg

SEQ ID NO: 665027 - DNA, 20 bp, mouse
ggactgtaggtaaaaggggc

SEQ ID NO: 665028 - DNA, 20 bp, mouse
gaggggactgtaggtaaaag

SEQ ID NO: 665029 - DNA, 20 bp, mouse
ggccggcctggagagtctga

SEQ ID NO: 665030 - DNA, 20 bp, mouse
gtaggtaaaaggggccggcc

SEQ ID NO: 665031 - DNA, 20 bp, mouse
gcggggaaaggctccaggta

SEQ ID NO: 665032 - DNA, 20 bp, mouse
ggagggaggacggctgaagc

SEQ ID NO: 665033 - DNA, 20 bp, mouse
gtccctcagactctccaggc

SEQ ID NO: 665034 - DNA, 20 bp, mouse
gtcagccacaattcatgaaa

SEQ ID NO: 665035 - DNA, 20 bp, mouse
gggcaccctttcatgaattg

SEQ ID NO: 665036 - DNA, 20 bp, mouse
ggggaagagggggaacacga

SEQ ID NO: 665037 - DNA, 20 bp, mouse
ggagtcgggtgctacggcta

SEQ ID NO: 665038 - DNA, 20 bp, mouse
ggcgcccgaactgctctcac

SEQ ID NO: 665039 - DNA, 20 bp, mouse
gaccccagcgggcggagtaa

SEQ ID NO: 665040 - DNA, 20 bp, mouse
gaaggcctcgcgccgcaggg

SEQ ID NO: 665041 - DNA, 20 bp, mouse
gggactgaggcgggaagagg

SEQ ID NO: 665042 - DNA, 20 bp, mouse
gggaagctgtgttaggcgtc

SEQ ID NO: 665043 - DNA, 20 bp, mouse
gtcgccggagtcgggtgcta

SEQ ID NO: 665044 - DNA, 20 bp, mouse
gagggggaacacgagggttt

SEQ ID NO: 665045 - DNA, 20 bp, mouse
gtacacttctctacacccgg

SEQ ID NO: 665046 - DNA, 20 bp, mouse
gccggccgggagtcagacga

SEQ ID NO: 665047 - DNA, 20 bp, mouse
gcggggccgctcagagaggc

SEQ ID NO: 665048 - DNA, 20 bp, mouse
gcggctgcggagaactgtcc

SEQ ID NO: 665049 - DNA, 20 bp, mouse
gcgcgcggccacctgaccta

SEQ ID NO: 665050 - DNA, 20 bp, mouse
gacagcggcgggctggttaa

SEQ ID NO: 665051 - DNA, 20 bp, mouse
gctagggcgccgttgttatt

SEQ ID NO: 665052 - DNA, 20 bp, mouse
gtcgccgctcctaataacaa

SEQ ID NO: 665053 - DNA, 20 bp, mouse
gaacaacggcgccctaggtc

SEQ ID NO: 665054 - DNA, 20 bp, mouse
gaggtggccgcgcgcggaca

SEQ ID NO: 665055 - DNA, 20 bp, mouse
ggagcgcggtgcgtcgcgat

SEQ ID NO: 665056 - DNA, 20 bp, mouse
gctgctctgaaccccggggc

SEQ ID NO: 665057 - DNA, 20 bp, mouse
ggatgcgcaagcacggacga

SEQ ID NO: 665058 - DNA, 20 bp, mouse
gagggcgcctagttttaaga

SEQ ID NO: 665059 - DNA, 20 bp, mouse
ggacgaggggcgccacctat

SEQ ID NO: 665060 - DNA, 20 bp, mouse
gtgtctgctgctctgaaccc

SEQ ID NO: 665061 - DNA, 20 bp, mouse
gagacccggggagacacgcg

SEQ ID NO: 665062 - DNA, 20 bp, mouse
gggaaccccgcgtgtctccc

SEQ ID NO: 665063 - DNA, 20 bp, mouse
gggggagtacccagggacaa

SEQ ID NO: 665064 - DNA, 20 bp, mouse
gcgggtagcaagtaggttcc

SEQ ID NO: 665065 - DNA, 20 bp, mouse
ggcagcagacacataaaccc

SEQ ID NO: 665066 - DNA, 20 bp, mouse
ggtaaggccaggcagagctg

SEQ ID NO: 665067 - DNA, 20 bp, mouse
gagtgacagcagttgggccc

SEQ ID NO: 665068 - DNA, 20 bp, mouse
gtgggacacaaaaagataca

SEQ ID NO: 665069 - DNA, 20 bp, mouse
gcgcagagacagcagtagta

SEQ ID NO: 665070 - DNA, 20 bp, mouse
gactccatgctctgccaagg

SEQ ID NO: 665071 - DNA, 20 bp, mouse
ggacacaaaaagatacaggg

SEQ ID NO: 665072 - DNA, 20 bp, mouse
gccatggagaaagactgaaa

SEQ ID NO: 665073 - DNA, 20 bp, mouse
gtgacccggtaggccccgca

SEQ ID NO: 665074 - DNA, 20 bp, mouse
gtcaccaagtagatagagtt

SEQ ID NO: 665075 - DNA, 20 bp, mouse
ggccccgcaggggatgtgga

SEQ ID NO: 665076 - DNA, 20 bp, mouse
gtgaacgcacccggacagag

SEQ ID NO: 665077 - DNA, 20 bp, mouse
gtgcacctgccaggggtccg

SEQ ID NO: 665078 - DNA, 20 bp, mouse
ggacccgcagagggagttgt

SEQ ID NO: 665079 - DNA, 20 bp, mouse
gcaggtgagcatcatcctct

SEQ ID NO: 665080 - DNA, 20 bp, mouse
gagagggtgcagtactctcg

SEQ ID NO: 665081 - DNA, 20 bp, mouse
gcacctgcctgcacctgcca

SEQ ID NO: 665082 - DNA, 20 bp, mouse
ggctgctccgctggggtcaa

SEQ ID NO: 665083 - DNA, 20 bp, mouse
ggatccccggaaagcagaaa

SEQ ID NO: 665084 - DNA, 20 bp, mouse
gcgtgcgtcccgctctgtcc

SEQ ID NO: 665085 - DNA, 20 bp, mouse
gggacccacaactccctctg

SEQ ID NO: 665086 - DNA, 20 bp, mouse
gcacgccccccgtagggagg

SEQ ID NO: 665087 - DNA, 20 bp, mouse
gaaaaaacggagttcaggta

SEQ ID NO: 665088 - DNA, 20 bp, mouse
gtaagccccctccctacggg

SEQ ID NO: 665089 - DNA, 20 bp, mouse
gtggttcaagaccggttcac

SEQ ID NO: 665090 - DNA, 20 bp, mouse
gtacggggggcgtggctggt

SEQ ID NO: 665091 - DNA, 20 bp, mouse
gttcactggcggactgaaat

SEQ ID NO: 665092 - DNA, 20 bp, mouse
gtaccagccaggaaaaaaac

SEQ ID NO: 665093 - DNA, 20 bp, mouse
gtacacagcaatttgacaag

SEQ ID NO: 665094 - DNA, 20 bp, mouse
gacctggccggtttttttcc

SEQ ID NO: 665095 - DNA, 20 bp, mouse
gagccacgccccccgtaggg

SEQ ID NO: 665096 - DNA, 20 bp, mouse
gccaccctgtccaggcctgt

SEQ ID NO: 665097 - DNA, 20 bp, mouse
ggggtcatgccaccctgtcc

SEQ ID NO: 665098 - DNA, 20 bp, mouse
gggagccaacaggcctggac

SEQ ID NO: 665099 - DNA, 20 bp, mouse
gctgtgagagggactgacag

SEQ ID NO: 665100 - DNA, 20 bp, mouse
gagtgtggcccagtggtaca

SEQ ID NO: 665101 - DNA, 20 bp, mouse
gggtggggctaggagccaac

SEQ ID NO: 665102 - DNA, 20 bp, mouse
gcagttggatgccatatttg

SEQ ID NO: 665103 - DNA, 20 bp, mouse
gcatgacccgcttcctccaa

SEQ ID NO: 665104 - DNA, 20 bp, mouse
gtgggccacactcctaatct

SEQ ID NO: 665105 - DNA, 20 bp, mouse
ggggaactgccaatgctgag

SEQ ID NO: 665106 - DNA, 20 bp, mouse
ggcgctgctcccaaaggaag

SEQ ID NO: 665107 - DNA, 20 bp, mouse
ggggaggaggcggacccttc

SEQ ID NO: 665108 - DNA, 20 bp, mouse
gggacaagcgctgctcccaa

SEQ ID NO: 665109 - DNA, 20 bp, mouse
gccggccagtgtagagatcc

SEQ ID NO: 665110 - DNA, 20 bp, mouse
gggaaccaggatctctacac

SEQ ID NO: 665111 - DNA, 20 bp, mouse
gcgcccccacgtgggagaga

SEQ ID NO: 665112 - DNA, 20 bp, mouse
gcggacccttcgggaacaga

SEQ ID NO: 665113 - DNA, 20 bp, mouse
gaggagccgtctgttcccga

SEQ ID NO: 665114 - DNA, 20 bp, mouse
gtctcggtgcgcccccacgt

SEQ ID NO: 665115 - DNA, 20 bp, mouse
gcagacggctcctcctcaga

SEQ ID NO: 665116 - DNA, 20 bp, mouse
gtaccctcatagaactaacc

SEQ ID NO: 665117 - DNA, 20 bp, mouse
gactaaccaggcttgggaat

SEQ ID NO: 665118 - DNA, 20 bp, mouse
gaaagagcacaagccgtgtg

SEQ ID NO: 665119 - DNA, 20 bp, mouse
gagtgcacacggactcttcg

SEQ ID NO: 665120 - DNA, 20 bp, mouse
gaagcctggttagttctatg

SEQ ID NO: 665121 - DNA, 20 bp, mouse
gtgctggcatctacaggtat

SEQ ID NO: 665122 - DNA, 20 bp, mouse
ggatcagtcgaagagcgtgg

SEQ ID NO: 665123 - DNA, 20 bp, mouse
ggcgccttgttttgtggcct

SEQ ID NO: 665124 - DNA, 20 bp, mouse
ggttcactcatcactgttca

SEQ ID NO: 665125 - DNA, 20 bp, mouse
ggattagacgtcagtgcaca

SEQ ID NO: 665126 - DNA, 20 bp, mouse
gaacgtggagccgggttcta

SEQ ID NO: 665127 - DNA, 20 bp, mouse
ggatcccagctcagatccca

SEQ ID NO: 665128 - DNA, 20 bp, mouse
gtgagtgggaggccgttctg

SEQ ID NO: 665129 - DNA, 20 bp, mouse
gacaccccgctgtggaggcc

SEQ ID NO: 665130 - DNA, 20 bp, mouse
gagcttggcggagccagagt

SEQ ID NO: 665131 - DNA, 20 bp, mouse
gggccgacacccgccaatcc

SEQ ID NO: 665132 - DNA, 20 bp, mouse
gcccaactgggtcccgcaca

SEQ ID NO: 665133 - DNA, 20 bp, mouse
gtggctccgccaagctcggc

SEQ ID NO: 665134 - DNA, 20 bp, mouse
gcgccgaagcctgttgtgtg

SEQ ID NO: 665135 - DNA, 20 bp, mouse
gtccgagtctaggtgagctc

SEQ ID NO: 665136 - DNA, 20 bp, mouse
ggggcgtgtccactgtgcgt

SEQ ID NO: 665137 - DNA, 20 bp, mouse
gggtgtgtccctctctataa

SEQ ID NO: 665138 - DNA, 20 bp, mouse
gagcgtgcttcacacccggg

SEQ ID NO: 665139 - DNA, 20 bp, mouse
ggggcgggctggttcctcag

SEQ ID NO: 665140 - DNA, 20 bp, mouse
gggtgtgaagcacgctctag

SEQ ID NO: 665141 - DNA, 20 bp, mouse
ggacacgccccttatagaga

SEQ ID NO: 665142 - DNA, 20 bp, mouse
gggtgtatctatctctgcgt

SEQ ID NO: 665143 - DNA, 20 bp, mouse
ggggcgtgcctcccccggga

SEQ ID NO: 665144 - DNA, 20 bp, mouse
gcaaactagacacgccttcc

SEQ ID NO: 665145 - DNA, 20 bp, mouse
gcgtaggggcgtgcctcccc

SEQ ID NO: 665146 - DNA, 20 bp, mouse
gtacaaaagtaggacactgc

SEQ ID NO: 665147 - DNA, 20 bp, mouse
ggcgggccgcgcagagtgag

SEQ ID NO: 665148 - DNA, 20 bp, mouse
ggggcggcgcgggattcgcg

SEQ ID NO: 665149 - DNA, 20 bp, mouse
gctaggaaattgatgggtag

SEQ ID NO: 665150 - DNA, 20 bp, mouse
gcaaacggaccaaacatcaa

SEQ ID NO: 665151 - DNA, 20 bp, mouse
gacaggatacgcagcccagg

SEQ ID NO: 665152 - DNA, 20 bp, mouse
gcacgagttcgaagccacct

SEQ ID NO: 665153 - DNA, 20 bp, mouse
ggaaattgatgggtagtggt

SEQ ID NO: 665154 - DNA, 20 bp, mouse
gtccactttcaaggattgta

SEQ ID NO: 665155 - DNA, 20 bp, mouse
gttaatcccaaggtgccctg

SEQ ID NO: 665156 - DNA, 20 bp, mouse
ggcggggcgcgcattgttcg

SEQ ID NO: 665157 - DNA, 20 bp, mouse
ggcggcggggaccagtccgt

SEQ ID NO: 665158 - DNA, 20 bp, mouse
ggggaccagtccgtggggtt

SEQ ID NO: 665159 - DNA, 20 bp, mouse
gagcgcccaaccccacggac

SEQ ID NO: 665160 - DNA, 20 bp, mouse
ggcgtgctccgggaatcctg

SEQ ID NO: 665161 - DNA, 20 bp, mouse
ggctgcgggtagagcagcgc

SEQ ID NO: 665162 - DNA, 20 bp, mouse
gggcgcgcctattggcccgg

SEQ ID NO: 665163 - DNA, 20 bp, mouse
gcagcgcccctcactggcgg

SEQ ID NO: 665164 - DNA, 20 bp, mouse
gggccggaccccaggattcc

SEQ ID NO: 665165 - DNA, 20 bp, mouse
gtgtgtgcagcagtgagccg

SEQ ID NO: 665166 - DNA, 20 bp, mouse
gaagatccgggcaaggaggt

SEQ ID NO: 665167 - DNA, 20 bp, mouse
ggcgcaatgctcaccgtccg

SEQ ID NO: 665168 - DNA, 20 bp, mouse
gggatcccgcgcctagtgag

SEQ ID NO: 665169 - DNA, 20 bp, mouse
gtccccggccttcaagatcc

SEQ ID NO: 665170 - DNA, 20 bp, mouse
gccgcggcgtggcgcccagg

SEQ ID NO: 665171 - DNA, 20 bp, mouse
gccccagccaggagaccccc

SEQ ID NO: 665172 - DNA, 20 bp, mouse
gagacgcagagaggcctccg

SEQ ID NO: 665173 - DNA, 20 bp, mouse
gccaaggcttgtggcatccg

SEQ ID NO: 665174 - DNA, 20 bp, mouse
gcgtccgcggcgtggcgccc

SEQ ID NO: 665175 - DNA, 20 bp, mouse
gaccacctctcactaggcgc

SEQ ID NO: 665176 - DNA, 20 bp, mouse
gtacccgaggcccccggtct

SEQ ID NO: 665177 - DNA, 20 bp, mouse
gcgggagagtcccaagtgtc

SEQ ID NO: 665178 - DNA, 20 bp, mouse
ggcccccggtctgggcagca

SEQ ID NO: 665179 - DNA, 20 bp, mouse
gcggccccagctcactttcc

SEQ ID NO: 665180 - DNA, 20 bp, mouse
gagtcccaagtgtccggctg

SEQ ID NO: 665181 - DNA, 20 bp, mouse
gagagccgggaaagtgagct

SEQ ID NO: 665182 - DNA, 20 bp, mouse
gtccggctgcggatcagagt

SEQ ID NO: 665183 - DNA, 20 bp, mouse
ggcgcagcccggcctacccg

SEQ ID NO: 665184 - DNA, 20 bp, mouse
ggaaacagaggccgagggtg

SEQ ID NO: 665185 - DNA, 20 bp, mouse
gggcgggacgcgcctcggat

SEQ ID NO: 665186 - DNA, 20 bp, mouse
gcgcctgcgcaaccaatcct

SEQ ID NO: 665187 - DNA, 20 bp, mouse
gtgaaatggcgggcgggaga

SEQ ID NO: 665188 - DNA, 20 bp, mouse
gaaaaatggcgagttcacgc

SEQ ID NO: 665189 - DNA, 20 bp, mouse
ggggagagggttgtgaacct

SEQ ID NO: 665190 - DNA, 20 bp, mouse
ggcggaacatcgtagtgcgc

SEQ ID NO: 665191 - DNA, 20 bp, mouse
gctgcctggaacacgtgaaa

SEQ ID NO: 665192 - DNA, 20 bp, mouse
gaacacgtgaaatggcgggc

SEQ ID NO: 665193 - DNA, 20 bp, mouse
ggcgaggaggcgggataaaa

SEQ ID NO: 665194 - DNA, 20 bp, mouse
gcctgcgcaaaactggacgc

SEQ ID NO: 665195 - DNA, 20 bp, mouse
gcctggaacacgtgaaatgg

SEQ ID NO: 665196 - DNA, 20 bp, mouse
gtcccccggggcggttgcta

SEQ ID NO: 665197 - DNA, 20 bp, mouse
gtctcccgccaggactgcgg

SEQ ID NO: 665198 - DNA, 20 bp, mouse
gggcgcgcgaaggctcttaa

SEQ ID NO: 665199 - DNA, 20 bp, mouse
gagtcctggcgggagaccga

SEQ ID NO: 665200 - DNA, 20 bp, mouse
gtccctagcaaccgccccgg

SEQ ID NO: 665201 - DNA, 20 bp, mouse
ggggccgtcacgtgatgctc

SEQ ID NO: 665202 - DNA, 20 bp, mouse
ggagggggaggccctggcaa

SEQ ID NO: 665203 - DNA, 20 bp, mouse
gggcctgagcgccgttgcca

SEQ ID NO: 665204 - DNA, 20 bp, mouse
gggcccggagcatcacgtga

SEQ ID NO: 665205 - DNA, 20 bp, mouse
gctctcccccgcagtcctgg

SEQ ID NO: 665206 - DNA, 20 bp, mouse
ggcggcgtgagggaacacta

SEQ ID NO: 665207 - DNA, 20 bp, mouse
gcaggcggggttaaggagta

SEQ ID NO: 665208 - DNA, 20 bp, mouse
gcccgcctgctgaccaaatt

SEQ ID NO: 665209 - DNA, 20 bp, mouse
gcgcgcgcgcacccgctctc

SEQ ID NO: 665210 - DNA, 20 bp, mouse
gcacccgctctctggcgctg

SEQ ID NO: 665211 - DNA, 20 bp, mouse
gcggaccttctcagtcttta

SEQ ID NO: 665212 - DNA, 20 bp, mouse
gtggtcagcaggcggggtta

SEQ ID NO: 665213 - DNA, 20 bp, mouse
ggaccccgtcaggctcgtcc

SEQ ID NO: 665214 - DNA, 20 bp, mouse
gaccctctgggcgctttcag

SEQ ID NO: 665215 - DNA, 20 bp, mouse
gtcagtctttagggggactt

SEQ ID NO: 665216 - DNA, 20 bp, mouse
ggggtcacgtagcaacgcag

SEQ ID NO: 665217 - DNA, 20 bp, mouse
gcgtcctgggcccgttctgc

SEQ ID NO: 665218 - DNA, 20 bp, mouse
gtagcaacgcaggggagacg

SEQ ID NO: 665219 - DNA, 20 bp, mouse
ggcgggaggaagcgctggga

SEQ ID NO: 665220 - DNA, 20 bp, mouse
gagaacgggcccaggacgct

SEQ ID NO: 665221 - DNA, 20 bp, mouse
gggaggagaactgacgtcag

SEQ ID NO: 665222 - DNA, 20 bp, mouse
gagggggagcgagccgtcag

SEQ ID NO: 665223 - DNA, 20 bp, mouse
gacgcaggggagacggggag

SEQ ID NO: 665224 - DNA, 20 bp, mouse
ggaagtgacgccaagcgggg

SEQ ID NO: 665225 - DNA, 20 bp, mouse
gcctcctggctattggaacg

SEQ ID NO: 665226 - DNA, 20 bp, mouse
gagcccctgcggactctcta

SEQ ID NO: 665227 - DNA, 20 bp, mouse
gcgaagcagcggagcccctg

SEQ ID NO: 665228 - DNA, 20 bp, mouse
ggggctccgctgcttcgcgg

SEQ ID NO: 665229 - DNA, 20 bp, mouse
gtgcgcatgcgcagcctctc

SEQ ID NO: 665230 - DNA, 20 bp, mouse
ggcttcgcggaggctcgtct

SEQ ID NO: 665231 - DNA, 20 bp, mouse
gacgagcctccgcgaagcag

SEQ ID NO: 665232 - DNA, 20 bp, mouse
gcacacatgccttgtggcat

SEQ ID NO: 665233 - DNA, 20 bp, mouse
gaggctgcgcatgcgcacga

SEQ ID NO: 665234 - DNA, 20 bp, mouse
gcggaggctcgtctcggagc

SEQ ID NO: 665235 - DNA, 20 bp, mouse
gcgacggcggcgctgacccg

SEQ ID NO: 665236 - DNA, 20 bp, mouse
gtggagcacagtcaatgctc

SEQ ID NO: 665237 - DNA, 20 bp, mouse
gcaggcactgttctggggga

SEQ ID NO: 665238 - DNA, 20 bp, mouse
gaggcattgtgagtcacagc

SEQ ID NO: 665239 - DNA, 20 bp, mouse
gccagtcagtggcagcaggt

SEQ ID NO: 665240 - DNA, 20 bp, mouse
gctccctgccaggcctccta

SEQ ID NO: 665241 - DNA, 20 bp, mouse
gtcacagctggcagacaggt

SEQ ID NO: 665242 - DNA, 20 bp, mouse
gtctacaccacctctaccct

SEQ ID NO: 665243 - DNA, 20 bp, mouse
ggtgaagtgtgttcagttac

SEQ ID NO: 665244 - DNA, 20 bp, mouse
gtgctgccactgactggctc

SEQ ID NO: 665245 - DNA, 20 bp, mouse
ggccctggcagccttgaacc

SEQ ID NO: 665246 - DNA, 20 bp, mouse
gagaaggcggagcatgcgta

SEQ ID NO: 665247 - DNA, 20 bp, mouse
gcatgcgtaaggtgtgtagt

SEQ ID NO: 665248 - DNA, 20 bp, mouse
gctaacagaacgatgtgcgg

SEQ ID NO: 665249 - DNA, 20 bp, mouse
gcgcggcagtgtgacgtctg

SEQ ID NO: 665250 - DNA, 20 bp, mouse
gggaccgcgtggcaaactgg

SEQ ID NO: 665251 - DNA, 20 bp, mouse
gcatgcgcctagcataaagt

SEQ ID NO: 665252 - DNA, 20 bp, mouse
ggcgtggggcgtggcctcac

SEQ ID NO: 665253 - DNA, 20 bp, mouse
gcccggcagtcagagcgtgg

SEQ ID NO: 665254 - DNA, 20 bp, mouse
ggcgcggcggctggattcgt

SEQ ID NO: 665255 - DNA, 20 bp, mouse
gagctgcaggtgtgagggcg

SEQ ID NO: 665256 - DNA, 20 bp, mouse
gggagcaggtaacgcgatac

SEQ ID NO: 665257 - DNA, 20 bp, mouse
ggcggcagcgtcgtgaggtg

SEQ ID NO: 665258 - DNA, 20 bp, mouse
gcacaggtgacgccgagggt

SEQ ID NO: 665259 - DNA, 20 bp, mouse
gggctggcggcagcgtcgtg

SEQ ID NO: 665260 - DNA, 20 bp, mouse
gagaaactacggcaggaatg

SEQ ID NO: 665261 - DNA, 20 bp, mouse
gaatggggcacgcctaccgt

SEQ ID NO: 665262 - DNA, 20 bp, mouse
ggtgctgcgtccttcaccca

SEQ ID NO: 665263 - DNA, 20 bp, mouse
gaggcctctcggagaaacta

SEQ ID NO: 665264 - DNA, 20 bp, mouse
gtcgccgtgcgcatgtgcgc

SEQ ID NO: 665265 - DNA, 20 bp, mouse
gcgcgcaggcatcttggagc

SEQ ID NO: 665266 - DNA, 20 bp, mouse
gaggactcaggctctcagca

SEQ ID NO: 665267 - DNA, 20 bp, mouse
gcaacccagagacataaggc

SEQ ID NO: 665268 - DNA, 20 bp, mouse
gagacaaagggaaagcaact

SEQ ID NO: 665269 - DNA, 20 bp, mouse
gcgtgctgaagagagacaaa

SEQ ID NO: 665270 - DNA, 20 bp, mouse
gaaggtgttgataagtagag

SEQ ID NO: 665271 - DNA, 20 bp, mouse
gcccagggaaggtcactagg

SEQ ID NO: 665272 - DNA, 20 bp, mouse
gcaggaggggccatgttgtg

SEQ ID NO: 665273 - DNA, 20 bp, mouse
gactgggcagcctagcagag

SEQ ID NO: 665274 - DNA, 20 bp, mouse
ggccgcctagtgaccttccc

SEQ ID NO: 665275 - DNA, 20 bp, mouse
gtaggcagctccacacaaca

SEQ ID NO: 665276 - DNA, 20 bp, mouse
gtaccgcccaccatagtcta

SEQ ID NO: 665277 - DNA, 20 bp, mouse
gggccatagactatggtggg

SEQ ID NO: 665278 - DNA, 20 bp, mouse
ggatggccatagactatggt

SEQ ID NO: 665279 - DNA, 20 bp, mouse
gactcgggataggagaaaga

SEQ ID NO: 665280 - DNA, 20 bp, mouse
gttcctagacttgaagagac

SEQ ID NO: 665281 - DNA, 20 bp, mouse
ggactatggtgggcggtaga

SEQ ID NO: 665282 - DNA, 20 bp, mouse
gtccaggagtaagcccaaag

SEQ ID NO: 665283 - DNA, 20 bp, mouse
gctcttcaagtctaggaaaa

SEQ ID NO: 665284 - DNA, 20 bp, mouse
ggttgtcgggcttatagaga

SEQ ID NO: 665285 - DNA, 20 bp, mouse
gcatagtctatggccatcag

SEQ ID NO: 665286 - DNA, 20 bp, mouse
gtcccagggaaggacagcgt

SEQ ID NO: 665287 - DNA, 20 bp, mouse
gcccgcgagtgcgttcactg

SEQ ID NO: 665288 - DNA, 20 bp, mouse
gagagcgagcggcagtcacg

SEQ ID NO: 665289 - DNA, 20 bp, mouse
gcgcgtgcgcgaaaaaagtt

SEQ ID NO: 665290 - DNA, 20 bp, mouse
gtcccggttccgagaggaac

SEQ ID NO: 665291 - DNA, 20 bp, mouse
gggccaacgctgtccttccc

SEQ ID NO: 665292 - DNA, 20 bp, mouse
gagtcaaggtaacccggctg

SEQ ID NO: 665293 - DNA, 20 bp, mouse
ggagcggcagtcacgtggtc

SEQ ID NO: 665294 - DNA, 20 bp, mouse
gcagcgaagtcaaggtaacc

SEQ ID NO: 665295 - DNA, 20 bp, mouse
gacagcgttggcctcagagc

SEQ ID NO: 665296 - DNA, 20 bp, mouse
gtgccatcccgctccaactg

SEQ ID NO: 665297 - DNA, 20 bp, mouse
gaagagggaggtaccatatc

SEQ ID NO: 665298 - DNA, 20 bp, mouse
gcggcttccgaaggcattat

SEQ ID NO: 665299 - DNA, 20 bp, mouse
gcggaagagagaccactggt

SEQ ID NO: 665300 - DNA, 20 bp, mouse
ggggggaagggagaggtcga

SEQ ID NO: 665301 - DNA, 20 bp, mouse
gcgaaggcattatcggatct

SEQ ID NO: 665302 - DNA, 20 bp, mouse
ggagaggacaccaccgagct

SEQ ID NO: 665303 - DNA, 20 bp, mouse
gaggaggagcgtgcctactg

SEQ ID NO: 665304 - DNA, 20 bp, mouse
gtcccgctccaactgtggaa

SEQ ID NO: 665305 - DNA, 20 bp, mouse
gtccccttccttgtgtttgt

SEQ ID NO: 665306 - DNA, 20 bp, mouse
gctctcccaggggaggaaga

SEQ ID NO: 665307 - DNA, 20 bp, mouse
ggactccagcatactccctc

SEQ ID NO: 665308 - DNA, 20 bp, mouse
gtcaaacttggggccagagg

SEQ ID NO: 665309 - DNA, 20 bp, mouse
gggtgaaccgagcttgtcta

SEQ ID NO: 665310 - DNA, 20 bp, mouse
gacaagctgaacttgacttc

SEQ ID NO: 665311 - DNA, 20 bp, mouse
gaaccgagcttgtctaaggg

SEQ ID NO: 665312 - DNA, 20 bp, mouse
gacgtccagaagagattccc

SEQ ID NO: 665313 - DNA, 20 bp, mouse
ggcggccggagggagtatgc

SEQ ID NO: 665314 - DNA, 20 bp, mouse
gtccgccttgcgcggccgga

SEQ ID NO: 665315 - DNA, 20 bp, mouse
gtgcactgctctcccagggg

SEQ ID NO: 665316 - DNA, 20 bp, mouse
gcgcaggcagccctagtcct

SEQ ID NO: 665317 - DNA, 20 bp, mouse
gaacagcgggccttggtgag

SEQ ID NO: 665318 - DNA, 20 bp, mouse
gaaggtgcacgtgcgcggag

SEQ ID NO: 665319 - DNA, 20 bp, mouse
gccacggcgcgactggctgt

SEQ ID NO: 665320 - DNA, 20 bp, mouse
ggcagccctagtcctgggtc

SEQ ID NO: 665321 - DNA, 20 bp, mouse
gagtgggtcgagtatggaaa

SEQ ID NO: 665322 - DNA, 20 bp, mouse
gtcaccgagcgcaaatgctt

SEQ ID NO: 665323 - DNA, 20 bp, mouse
ggaggtcgggcccgcgtcat

SEQ ID NO: 665324 - DNA, 20 bp, mouse
gggcccgcgtcattggattc

SEQ ID NO: 665325 - DNA, 20 bp, mouse
gttggtgagtgggtcgagta

SEQ ID NO: 665326 - DNA, 20 bp, mouse
ggctcccaggctaggggaca

SEQ ID NO: 665327 - DNA, 20 bp, mouse
gacgccctgtcccctagcct

SEQ ID NO: 665328 - DNA, 20 bp, mouse
gggctccggtatcagggcta

SEQ ID NO: 665329 - DNA, 20 bp, mouse
gacaagaagctcccaggcta

SEQ ID NO: 665330 - DNA, 20 bp, mouse
ggcttcttgtgcactctcac

SEQ ID NO: 665331 - DNA, 20 bp, mouse
gcggttcgtggctctgacca

SEQ ID NO: 665332 - DNA, 20 bp, mouse
gaacacatagacaactacac

SEQ ID NO: 665333 - DNA, 20 bp, mouse
gctcctgattgtagaggagg

SEQ ID NO: 665334 - DNA, 20 bp, mouse
gcgtggctctgaccagggat

SEQ ID NO: 665335 - DNA, 20 bp, mouse
gtcacagggcgcgccacgat

SEQ ID NO: 665336 - DNA, 20 bp, mouse
gttcgcatgtgaaaggtgat

SEQ ID NO: 665337 - DNA, 20 bp, mouse
ggtcccgggctcagtcccta

SEQ ID NO: 665338 - DNA, 20 bp, mouse
ggcctcgcttcgcatgtgaa

SEQ ID NO: 665339 - DNA, 20 bp, mouse
gaagtacccggcatgcgcag

SEQ ID NO: 665340 - DNA, 20 bp, mouse
gacgtgctgcattgcactct

SEQ ID NO: 665341 - DNA, 20 bp, mouse
gcatccccaacaatctgatg

SEQ ID NO: 665342 - DNA, 20 bp, mouse
gaactgggcaggcatccaca

SEQ ID NO: 665343 - DNA, 20 bp, mouse
ggatgaggagggagggcccc

SEQ ID NO: 665344 - DNA, 20 bp, mouse
gcacgtcacagagaagtacc

SEQ ID NO: 665345 - DNA, 20 bp, mouse
gattaagtacatcaaagcac

SEQ ID NO: 665346 - DNA, 20 bp, mouse
gtgggcgggccaggggggtc

SEQ ID NO: 665347 - DNA, 20 bp, mouse
gcccaagcatggggtcgccc

SEQ ID NO: 665348 - DNA, 20 bp, mouse
gccctggcccgcccaagcat

SEQ ID NO: 665349 - DNA, 20 bp, mouse
gcccacgaggagcttcactt

SEQ ID NO: 665350 - DNA, 20 bp, mouse
gccaggcagccggacccccc

SEQ ID NO: 665351 - DNA, 20 bp, mouse
gcgtggggcgcggtttgctg

SEQ ID NO: 665352 - DNA, 20 bp, mouse
ggcaaaccgcgccccacgag

SEQ ID NO: 665353 - DNA, 20 bp, mouse
gggtctaggtgatccaggac

SEQ ID NO: 665354 - DNA, 20 bp, mouse
gcaggcaggatccgcgtcct

SEQ ID NO: 665355 - DNA, 20 bp, mouse
gttcccgccaaccacggtct

SEQ ID NO: 665356 - DNA, 20 bp, mouse
gtggccccggagacagaaat

SEQ ID NO: 665357 - DNA, 20 bp, mouse
gtcgccggaccgcctcgcct

SEQ ID NO: 665358 - DNA, 20 bp, mouse
gccggcgcccggcgctagga

SEQ ID NO: 665359 - DNA, 20 bp, mouse
gaggaccccgagcgcgtcgc

SEQ ID NO: 665360 - DNA, 20 bp, mouse
gaggccggaggattctgatc

SEQ ID NO: 665361 - DNA, 20 bp, mouse
ggaacagcttcgagaaattc

SEQ ID NO: 665362 - DNA, 20 bp, mouse
ggccttcgggccggtcacgt

SEQ ID NO: 665363 - DNA, 20 bp, mouse
gccggaccgcctcgcctcgg

SEQ ID NO: 665364 - DNA, 20 bp, mouse
gcggtccggcgacgcgctcg

SEQ ID NO: 665365 - DNA, 20 bp, mouse
gcgggctcaggcggcggacc

SEQ ID NO: 665366 - DNA, 20 bp, mouse
gcgcgcggcccgtctcaaaa

SEQ ID NO: 665367 - DNA, 20 bp, mouse
gactacgggccaatgagtgg

SEQ ID NO: 665368 - DNA, 20 bp, mouse
gagagcagacgcgcgggcat

SEQ ID NO: 665369 - DNA, 20 bp, mouse
gtgaaggcgtggcttccctg

SEQ ID NO: 665370 - DNA, 20 bp, mouse
gaggctgagagcagacgcgc

SEQ ID NO: 665371 - DNA, 20 bp, mouse
ggctctcagcctagcaacta

SEQ ID NO: 665372 - DNA, 20 bp, mouse
ggcaactacgggccaatgag

SEQ ID NO: 665373 - DNA, 20 bp, mouse
ggagagaaatatgctctgtg

SEQ ID NO: 665374 - DNA, 20 bp, mouse
gagtcctctggctcttaagt

SEQ ID NO: 665375 - DNA, 20 bp, mouse
ggggccgacagcacagtacc

SEQ ID NO: 665376 - DNA, 20 bp, mouse
gcataaaagcggctccctca

SEQ ID NO: 665377 - DNA, 20 bp, mouse
gccctggaacgcaatctcca

SEQ ID NO: 665378 - DNA, 20 bp, mouse
gtctactagtagatataggt

SEQ ID NO: 665379 - DNA, 20 bp, mouse
gcaccagtacatacaccctg

SEQ ID NO: 665380 - DNA, 20 bp, mouse
gccacggtgaggggagctct

SEQ ID NO: 665381 - DNA, 20 bp, mouse
gagattgcgttccaggggcg

SEQ ID NO: 665382 - DNA, 20 bp, mouse
ggtcctggttgccacggtga

SEQ ID NO: 665383 - DNA, 20 bp, mouse
gcaccacagggtgtatgtac

SEQ ID NO: 665384 - DNA, 20 bp, mouse
ggcaatctccatggttgtcc

SEQ ID NO: 665385 - DNA, 20 bp, mouse
ggggtgtatgtactggtgag

SEQ ID NO: 665386 - DNA, 20 bp, mouse
gcaaacggcgggcctcacct

SEQ ID NO: 665387 - DNA, 20 bp, mouse
gtgagtggctatgtgaccag

SEQ ID NO: 665388 - DNA, 20 bp, mouse
gggaaccgcatcagctgtgc

SEQ ID NO: 665389 - DNA, 20 bp, mouse
gggtcacatagccactcacc

SEQ ID NO: 665390 - DNA, 20 bp, mouse
gtgggccgagaaaagtcaga

SEQ ID NO: 665391 - DNA, 20 bp, mouse
gcgggggtcctccgggtgag

SEQ ID NO: 665392 - DNA, 20 bp, mouse
gaggcccgccgtttgcgcgg

SEQ ID NO: 665393 - DNA, 20 bp, mouse
gcagaaggtatgaggcagta

SEQ ID NO: 665394 - DNA, 20 bp, mouse
gcacatagccactcacccgg

SEQ ID NO: 665395 - DNA, 20 bp, mouse
gaggggctatcgcgcaagtg

SEQ ID NO: 665396 - DNA, 20 bp, mouse
ggccacgcccatctcaggat

SEQ ID NO: 665397 - DNA, 20 bp, mouse
ggagaccacgcctacatcgg

SEQ ID NO: 665398 - DNA, 20 bp, mouse
gaggcccagcgctggaacgc

SEQ ID NO: 665399 - DNA, 20 bp, mouse
gtaatgtaggaacgctaggt

SEQ ID NO: 665400 - DNA, 20 bp, mouse
gccaagaagcgacccctccg

SEQ ID NO: 665401 - DNA, 20 bp, mouse
gccctccggggcgagctgag

SEQ ID NO: 665402 - DNA, 20 bp, mouse
gggggctgagtcccttaagg

SEQ ID NO: 665403 - DNA, 20 bp, mouse
gtcgcctaggggaaagtccc

SEQ ID NO: 665404 - DNA, 20 bp, mouse
ggggaaagtccccggaccac

SEQ ID NO: 665405 - DNA, 20 bp, mouse
ggactcagcccccccgatgt

SEQ ID NO: 665406 - DNA, 20 bp, mouse
ggggttgccgtcgttgccat

SEQ ID NO: 665407 - DNA, 20 bp, mouse
gcccgagcgtcctgtatcta

SEQ ID NO: 665408 - DNA, 20 bp, mouse
gcggcaacccaaaagagcca

SEQ ID NO: 665409 - DNA, 20 bp, mouse
gtggtatcccatggcaacga

SEQ ID NO: 665410 - DNA, 20 bp, mouse
gtccgtagatacaggacgct

SEQ ID NO: 665411 - DNA, 20 bp, mouse
gagggagattaaatttgagc

SEQ ID NO: 665412 - DNA, 20 bp, mouse
gaatttgagcaggcattgac

SEQ ID NO: 665413 - DNA, 20 bp, mouse
gagcgtcttttggtatccca

SEQ ID NO: 665414 - DNA, 20 bp, mouse
gaggacaccatgaaaattgg

SEQ ID NO: 665415 - DNA, 20 bp, mouse
ggaaccatgtttaccttgtc

SEQ ID NO: 665416 - DNA, 20 bp, mouse
ggactggggcggcgacagga

SEQ ID NO: 665417 - DNA, 20 bp, mouse
ggccaggaccggaagtagtg

SEQ ID NO: 665418 - DNA, 20 bp, mouse
gctgtcgccgccccagtcgg

SEQ ID NO: 665419 - DNA, 20 bp, mouse
gctgcccgccccgccgactg

SEQ ID NO: 665420 - DNA, 20 bp, mouse
gggaacgcaggccgatgatt

SEQ ID NO: 665421 - DNA, 20 bp, mouse
gcgagtggcgaacttcttcc

SEQ ID NO: 665422 - DNA, 20 bp, mouse
gtcaaaacccaacagaagcc

SEQ ID NO: 665423 - DNA, 20 bp, mouse
gacgtcttgagaaaggaaag

SEQ ID NO: 665424 - DNA, 20 bp, mouse
gcaaaggagcgcaatttcca

SEQ ID NO: 665425 - DNA, 20 bp, mouse
gcgggctgggctatagcagc

SEQ ID NO: 665426 - DNA, 20 bp, mouse
ggctcccccaaaagatagat

SEQ ID NO: 665427 - DNA, 20 bp, mouse
ggttgggcaaggcttgatgg

SEQ ID NO: 665428 - DNA, 20 bp, mouse
ggcaaccagcactctgcgtc

SEQ ID NO: 665429 - DNA, 20 bp, mouse
gccccatcccatctatcttt

SEQ ID NO: 665430 - DNA, 20 bp, mouse
gcactctagcagcacgagga

SEQ ID NO: 665431 - DNA, 20 bp, mouse
gccccaaaagatagatggga

SEQ ID NO: 665432 - DNA, 20 bp, mouse
ggtacaaaatgtagcctcaa

SEQ ID NO: 665433 - DNA, 20 bp, mouse
gagacctaaaagtacgagaa

SEQ ID NO: 665434 - DNA, 20 bp, mouse
gtgaaggtgggcgggccaag

SEQ ID NO: 665435 - DNA, 20 bp, mouse
gtctagcagcacgaggaggg

SEQ ID NO: 665436 - DNA, 20 bp, mouse
gaaaaaggcgggtgcttccc

SEQ ID NO: 665437 - DNA, 20 bp, mouse
gactaggcaacgggatgctg

SEQ ID NO: 665438 - DNA, 20 bp, mouse
ggggatgctgcggctagaag

SEQ ID NO: 665439 - DNA, 20 bp, mouse
gctgatgcagacgatgtgat

SEQ ID NO: 665440 - DNA, 20 bp, mouse
gctagtaacggaggtcgggg

SEQ ID NO: 665441 - DNA, 20 bp, mouse
gtctgcatcagctccggaaa

SEQ ID NO: 665442 - DNA, 20 bp, mouse
ggcatcccgttgcctagtaa

SEQ ID NO: 665443 - DNA, 20 bp, mouse
gttgataaaacacttgaaaa

SEQ ID NO: 665444 - DNA, 20 bp, mouse
gtacacctggcttactttca

SEQ ID NO: 665445 - DNA, 20 bp, mouse
gcatcagctccggaaaaggg

SEQ ID NO: 665446 - DNA, 20 bp, mouse
ggggcctgcgctacgagacg

SEQ ID NO: 665447 - DNA, 20 bp, mouse
gacgagacggggctcagtcg

SEQ ID NO: 665448 - DNA, 20 bp, mouse
ggcgtggcgtggggcgtgac

SEQ ID NO: 665449 - DNA, 20 bp, mouse
gcgtgtgcgagatgaggtgt

SEQ ID NO: 665450 - DNA, 20 bp, mouse
ggggaaacgggcaatctggg

SEQ ID NO: 665451 - DNA, 20 bp, mouse
ggactggcgtgtgcgagatg

SEQ ID NO: 665452 - DNA, 20 bp, mouse
gaaaagagcgccagctccgg

SEQ ID NO: 665453 - DNA, 20 bp, mouse
gcgcacacgccagtcgcgat

SEQ ID NO: 665454 - DNA, 20 bp, mouse
ggagccccgtctcgtagcgc

SEQ ID NO: 665455 - DNA, 20 bp, mouse
gcggggccctaggcttgccc

SEQ ID NO: 665456 - DNA, 20 bp, mouse
ggggcggggccaaccggtga

SEQ ID NO: 665457 - DNA, 20 bp, mouse
gggtgggagcgcaagggatg

SEQ ID NO: 665458 - DNA, 20 bp, mouse
ggactctggtgggagcgcaa

SEQ ID NO: 665459 - DNA, 20 bp, mouse
gttaaaggcggggcttggga

SEQ ID NO: 665460 - DNA, 20 bp, mouse
gggtactgaaccttactgag

SEQ ID NO: 665461 - DNA, 20 bp, mouse
gcgaccccgcccagacctgg

SEQ ID NO: 665462 - DNA, 20 bp, mouse
ggaggggcaaggtggacacg

SEQ ID NO: 665463 - DNA, 20 bp, mouse
ggggcaaggtggacacgggg

SEQ ID NO: 665464 - DNA, 20 bp, mouse
gtaaggttcagtaccctcac

SEQ ID NO: 665465 - DNA, 20 bp, mouse
gtgccggggcgtggctgctg

SEQ ID NO: 665466 - DNA, 20 bp, mouse
gccaaggaccgagaagacat

SEQ ID NO: 665467 - DNA, 20 bp, mouse
ggaagtcacaacaacagctc

SEQ ID NO: 665468 - DNA, 20 bp, mouse
gatggattaggcatctgagt

SEQ ID NO: 665469 - DNA, 20 bp, mouse
gcctcctagccagaaaccgt

SEQ ID NO: 665470 - DNA, 20 bp, mouse
gccaccgcgaggtgcaaggg

SEQ ID NO: 665471 - DNA, 20 bp, mouse
gcagaacagtgagatggatt

SEQ ID NO: 665472 - DNA, 20 bp, mouse
ggcccctcccttgcacctcg

SEQ ID NO: 665473 - DNA, 20 bp, mouse
ggcaacgcgcctcagggtcg

SEQ ID NO: 665474 - DNA, 20 bp, mouse
gtctccaccgcgaggtgcaa

SEQ ID NO: 665475 - DNA, 20 bp, mouse
gacaactgaacgctgtttat

SEQ ID NO: 665476 - DNA, 20 bp, mouse
gaaagagccaggggagtcaa

SEQ ID NO: 665477 - DNA, 20 bp, mouse
gaggggctcggatgctataa

SEQ ID NO: 665478 - DNA, 20 bp, mouse
gccagaagacgggcctgagt

SEQ ID NO: 665479 - DNA, 20 bp, mouse
ggggagacaaggggccaata

SEQ ID NO: 665480 - DNA, 20 bp, mouse
ggcctgagtgggcgggggca

SEQ ID NO: 665481 - DNA, 20 bp, mouse
gaggggagtcaagggagtgg

SEQ ID NO: 665482 - DNA, 20 bp, mouse
gggagcataggtaggatcaa

SEQ ID NO: 665483 - DNA, 20 bp, mouse
gtaaggggcggggactagaa

SEQ ID NO: 665484 - DNA, 20 bp, mouse
gaagacgggcctgagtgggc

SEQ ID NO: 665485 - DNA, 20 bp, mouse
gactcccctggctctttcta

SEQ ID NO: 665486 - DNA, 20 bp, mouse
gtggccgcgcagtgattcgg

SEQ ID NO: 665487 - DNA, 20 bp, mouse
gaaagaaggggactacggga

SEQ ID NO: 665488 - DNA, 20 bp, mouse
gcaggcgctaatccgcgtcc

SEQ ID NO: 665489 - DNA, 20 bp, mouse
ggagcggcgctcatcatggt

SEQ ID NO: 665490 - DNA, 20 bp, mouse
gcgcgtcctggctggtgaca

SEQ ID NO: 665491 - DNA, 20 bp, mouse
gtaagatggggcactctgac

SEQ ID NO: 665492 - DNA, 20 bp, mouse
gcggaccttaacttgaatct

SEQ ID NO: 665493 - DNA, 20 bp, mouse
gcagcagcgccagaagagtt

SEQ ID NO: 665494 - DNA, 20 bp, mouse
ggctagcgaagagtaaaagc

SEQ ID NO: 665495 - DNA, 20 bp, mouse
gagtactgcccccctaaggg

SEQ ID NO: 665496 - DNA, 20 bp, mouse
gcagctaagtatagttcttg

SEQ ID NO: 665497 - DNA, 20 bp, mouse
gctccccgacacaatggttg

SEQ ID NO: 665498 - DNA, 20 bp, mouse
gcctcccccaaccattgtgt

SEQ ID NO: 665499 - DNA, 20 bp, mouse
ggacccagattcagacgtct

SEQ ID NO: 665500 - DNA, 20 bp, mouse
gcctggacctcccactccgt

SEQ ID NO: 665501 - DNA, 20 bp, mouse
gagcatcctaggatgctaag

SEQ ID NO: 665502 - DNA, 20 bp, mouse
gaaaaaaaatccaacgggtg

SEQ ID NO: 665503 - DNA, 20 bp, mouse
gttgggggaggggcccagat

SEQ ID NO: 665504 - DNA, 20 bp, mouse
gactagcctccccgacacaa

SEQ ID NO: 665505 - DNA, 20 bp, mouse
gatgaggagctggtgttgag

SEQ ID NO: 665506 - DNA, 20 bp, mouse
gggacgaattgcaggaggtc

SEQ ID NO: 665507 - DNA, 20 bp, mouse
gggtgtaccggacgaattgc

SEQ ID NO: 665508 - DNA, 20 bp, mouse
ggattgggtgtctgtcattc

SEQ ID NO: 665509 - DNA, 20 bp, mouse
ggtaccggacgaattgcagg

SEQ ID NO: 665510 - DNA, 20 bp, mouse
gcagctcaaacgttctgtat

SEQ ID NO: 665511 - DNA, 20 bp, mouse
gaaacgttctgtatagggat

SEQ ID NO: 665512 - DNA, 20 bp, mouse
gaggtcaggtcgccctcacc

SEQ ID NO: 665513 - DNA, 20 bp, mouse
gactacaggcaagatggccg

SEQ ID NO: 665514 - DNA, 20 bp, mouse
gtgactaagtagcatggtct

SEQ ID NO: 665515 - DNA, 20 bp, mouse
gccggcatgcctcacgacag

SEQ ID NO: 665516 - DNA, 20 bp, mouse
gccaagagggcagttaggag

SEQ ID NO: 665517 - DNA, 20 bp, mouse
gagtgagccggctgggttgt

SEQ ID NO: 665518 - DNA, 20 bp, mouse
gcctttgcccacaacccagc

SEQ ID NO: 665519 - DNA, 20 bp, mouse
gtacagcgagtgagccggct

SEQ ID NO: 665520 - DNA, 20 bp, mouse
gatggggtcgggttcagtct

SEQ ID NO: 665521 - DNA, 20 bp, mouse
gacaggtgctccagatcaag

SEQ ID NO: 665522 - DNA, 20 bp, mouse
gtgctccagatcaaggggcg

SEQ ID NO: 665523 - DNA, 20 bp, mouse
gtggcacaagtggataagga

SEQ ID NO: 665524 - DNA, 20 bp, mouse
gaaatagaatcagacctgag

SEQ ID NO: 665525 - DNA, 20 bp, mouse
gatgtcttacggccaatcca

SEQ ID NO: 665526 - DNA, 20 bp, mouse
ggatcagggcggctcaccta

SEQ ID NO: 665527 - DNA, 20 bp, mouse
gcgcacgcgcttttttgggg

SEQ ID NO: 665528 - DNA, 20 bp, mouse
gtgtgcgcacgcgctttttt

SEQ ID NO: 665529 - DNA, 20 bp, mouse
gaaggcttatccatagcatt

SEQ ID NO: 665530 - DNA, 20 bp, mouse
gatgatggaaggtcgttttg

SEQ ID NO: 665531 - DNA, 20 bp, mouse
gaacttgcaggtctaaccta

SEQ ID NO: 665532 - DNA, 20 bp, mouse
gcatttgggatattgtctta

SEQ ID NO: 665533 - DNA, 20 bp, mouse
gcttttgggaggcacgataa

SEQ ID NO: 665534 - DNA, 20 bp, mouse
gccaggaatgaagaagaagc

SEQ ID NO: 665535 - DNA, 20 bp, mouse
gaggcgccagcttgggtctt

SEQ ID NO: 665536 - DNA, 20 bp, mouse
gtgcctcggggagcccaata

SEQ ID NO: 665537 - DNA, 20 bp, mouse
gggcctggggatttgggcag

SEQ ID NO: 665538 - DNA, 20 bp, mouse
gggggagcccaatatggtca

SEQ ID NO: 665539 - DNA, 20 bp, mouse
gcggatatctaagagataac

SEQ ID NO: 665540 - DNA, 20 bp, mouse
gcgggcaggtaagggttaaa

SEQ ID NO: 665541 - DNA, 20 bp, mouse
gcctacaccccgggacatgg

SEQ ID NO: 665542 - DNA, 20 bp, mouse
gggtaaaggcccaacctacc

SEQ ID NO: 665543 - DNA, 20 bp, mouse
gaaccccatcctgtccaggt

SEQ ID NO: 665544 - DNA, 20 bp, mouse
gtgggggaccaggtgcctcg

SEQ ID NO: 665545 - DNA, 20 bp, mouse
gcaacctacctggacaggat

SEQ ID NO: 665546 - DNA, 20 bp, mouse
gcctcccttcataacgagga

SEQ ID NO: 665547 - DNA, 20 bp, mouse
gctaccctcctcgttatgaa

SEQ ID NO: 665548 - DNA, 20 bp, mouse
gagtgccaggaagtccagac

SEQ ID NO: 665549 - DNA, 20 bp, mouse
gaggcccggacttggaatcc

SEQ ID NO: 665550 - DNA, 20 bp, mouse
gcctcaccacgcagtgcatg

SEQ ID NO: 665551 - DNA, 20 bp, mouse
gggaagtcagagcaggtcag

SEQ ID NO: 665552 - DNA, 20 bp, mouse
gttcccaaggtttctccctc

SEQ ID NO: 665553 - DNA, 20 bp, mouse
gcaccagagggagaaacctt

SEQ ID NO: 665554 - DNA, 20 bp, mouse
gtggggagaaggcaattagc

SEQ ID NO: 665555 - DNA, 20 bp, mouse
ggggtcatcggtgctcatac

SEQ ID NO: 665556 - DNA, 20 bp, mouse
gcagccctgcggtgagtccc

SEQ ID NO: 665557 - DNA, 20 bp, mouse
ggaggcccggggacgcggtg

SEQ ID NO: 665558 - DNA, 20 bp, mouse
gcccggggacgcggtgaggc

SEQ ID NO: 665559 - DNA, 20 bp, mouse
gctcggcgctcgaaccccag

SEQ ID NO: 665560 - DNA, 20 bp, mouse
gggctcccaaagtcaccggc

SEQ ID NO: 665561 - DNA, 20 bp, mouse
gccgcccgggactcaccgca

SEQ ID NO: 665562 - DNA, 20 bp, mouse
gaaggcgccagtgccctacg

SEQ ID NO: 665563 - DNA, 20 bp, mouse
gccggccggccggtgacttt

SEQ ID NO: 665564 - DNA, 20 bp, mouse
ggcgtccccgggcctcccgg

SEQ ID NO: 665565 - DNA, 20 bp, mouse
gcggccgccgaggagagcgc

SEQ ID NO: 665566 - DNA, 20 bp, mouse
ggctgcccggagaaaagatg

SEQ ID NO: 665567 - DNA, 20 bp, mouse
gttcaagaataacacgttat

SEQ ID NO: 665568 - DNA, 20 bp, mouse
gcatcccggccgtcgccaca

SEQ ID NO: 665569 - DNA, 20 bp, mouse
gtggcacagcaaccacatcc

SEQ ID NO: 665570 - DNA, 20 bp, mouse
ggccaggcccgcaccccggg

SEQ ID NO: 665571 - DNA, 20 bp, mouse
gggtcagacggagtagaagt

SEQ ID NO: 665572 - DNA, 20 bp, mouse
gcaacactggtttagtattt

SEQ ID NO: 665573 - DNA, 20 bp, mouse
gcggccgtcgccacagggct

SEQ ID NO: 665574 - DNA, 20 bp, mouse
gtaaacgctaaactccataa

SEQ ID NO: 665575 - DNA, 20 bp, mouse
gggcgtcagtggcccacccg

SEQ ID NO: 665576 - DNA, 20 bp, mouse
gggagctggggttcccggag

SEQ ID NO: 665577 - DNA, 20 bp, mouse
gagagggagcgctgaagcac

SEQ ID NO: 665578 - DNA, 20 bp, mouse
gttcccggagaggtagatct

SEQ ID NO: 665579 - DNA, 20 bp, mouse
gcgctgaagcacaggcggag

SEQ ID NO: 665580 - DNA, 20 bp, mouse
ggggagcgctgaagcacagg

SEQ ID NO: 665581 - DNA, 20 bp, mouse
gcaaggtgagcgtcaataca

SEQ ID NO: 665582 - DNA, 20 bp, mouse
ggcgaggtagcacctgtgat

SEQ ID NO: 665583 - DNA, 20 bp, mouse
ggaggtagatctcggaacac

SEQ ID NO: 665584 - DNA, 20 bp, mouse
ggttccgagatctacctctc

SEQ ID NO: 665585 - DNA, 20 bp, mouse
gcctgtgataggaaaggagc

SEQ ID NO: 665586 - DNA, 20 bp, mouse
gggccctggccggagaatgg

SEQ ID NO: 665587 - DNA, 20 bp, mouse
gctagtggaaggtagatagt

SEQ ID NO: 665588 - DNA, 20 bp, mouse
gtcaccactagtggcgaata

SEQ ID NO: 665589 - DNA, 20 bp, mouse
gaaaccgggagtagcgtccc

SEQ ID NO: 665590 - DNA, 20 bp, mouse
gtactgcgcgcggcattgtg

SEQ ID NO: 665591 - DNA, 20 bp, mouse
gcacccggggacgctactcc

SEQ ID NO: 665592 - DNA, 20 bp, mouse
gccggagaatgggggaaggg

SEQ ID NO: 665593 - DNA, 20 bp, mouse
gcgagagcgctcggcacccg

SEQ ID NO: 665594 - DNA, 20 bp, mouse
gctgttggcccaggggctca

SEQ ID NO: 665595 - DNA, 20 bp, mouse
ggggaggcggagcggaaacc

SEQ ID NO: 665596 - DNA, 20 bp, mouse
gcaagcgcagtctgtcgctg

SEQ ID NO: 665597 - DNA, 20 bp, mouse
ggtcgctggggcttgcggga

SEQ ID NO: 665598 - DNA, 20 bp, mouse
ggggaaggcagacatggccg

SEQ ID NO: 665599 - DNA, 20 bp, mouse
gcggcgcttggcgttaactg

SEQ ID NO: 665600 - DNA, 20 bp, mouse
ggcttgcgggaaggcagaca

SEQ ID NO: 665601 - DNA, 20 bp, mouse
gcgcttggcgttaactgggg

SEQ ID NO: 665602 - DNA, 20 bp, mouse
gagactcaggccaactcggg

SEQ ID NO: 665603 - DNA, 20 bp, mouse
gcggggttggcgcagtttcg

SEQ ID NO: 665604 - DNA, 20 bp, mouse
ggccaactcgggtggaatcg

SEQ ID NO: 665605 - DNA, 20 bp, mouse
gcaggaggggcgtgttgcgc

SEQ ID NO: 665606 - DNA, 20 bp, mouse
ggcaccgaaagctagggaag

SEQ ID NO: 665607 - DNA, 20 bp, mouse
gacactgaaaagaggggacc

SEQ ID NO: 665608 - DNA, 20 bp, mouse
gcagcagtgagatctcactg

SEQ ID NO: 665609 - DNA, 20 bp, mouse
ggaaatgagtctaactaaag

SEQ ID NO: 665610 - DNA, 20 bp, mouse
gaaggagacactgaaaagag

SEQ ID NO: 665611 - DNA, 20 bp, mouse
gagagggtgaattcattcaa

SEQ ID NO: 665612 - DNA, 20 bp, mouse
gtccacgcccatttgttcta

SEQ ID NO: 665613 - DNA, 20 bp, mouse
gcatgctgcaccgaaagcta

SEQ ID NO: 665614 - DNA, 20 bp, mouse
gagcactaagacagtagaat

SEQ ID NO: 665615 - DNA, 20 bp, mouse
gagtctaactaaagaggttc

SEQ ID NO: 665616 - DNA, 20 bp, mouse
gcggtcgcgcgcgtctacgg

SEQ ID NO: 665617 - DNA, 20 bp, mouse
ggggccgagagagcctctaa

SEQ ID NO: 665618 - DNA, 20 bp, mouse
gggaagagtggaggcttcgt

SEQ ID NO: 665619 - DNA, 20 bp, mouse
gccggcgtcgggaagggcgg

SEQ ID NO: 665620 - DNA, 20 bp, mouse
gtgagcgtgctgaggggtcc

SEQ ID NO: 665621 - DNA, 20 bp, mouse
gcacatgccggcgtcgggaa

SEQ ID NO: 665622 - DNA, 20 bp, mouse
gtagacgcgcgcgaccgtgc

SEQ ID NO: 665623 - DNA, 20 bp, mouse
gctggtgtgtgcagttctgt

SEQ ID NO: 665624 - DNA, 20 bp, mouse
gccggagtgtattttattta

SEQ ID NO: 665625 - DNA, 20 bp, mouse
ggccttggcaaccgtcacca

SEQ ID NO: 665626 - DNA, 20 bp, mouse
gaaaacgcaaccgccaggga

SEQ ID NO: 665627 - DNA, 20 bp, mouse
gggaccactcccggtgggcg

SEQ ID NO: 665628 - DNA, 20 bp, mouse
gctggcggttgcgttttcga

SEQ ID NO: 665629 - DNA, 20 bp, mouse
ggggcttctaacggctagac

SEQ ID NO: 665630 - DNA, 20 bp, mouse
gcaattggaccactcccggt

SEQ ID NO: 665631 - DNA, 20 bp, mouse
gcctcccggaagatctactt

SEQ ID NO: 665632 - DNA, 20 bp, mouse
gggaggaagccatctccaat

SEQ ID NO: 665633 - DNA, 20 bp, mouse
ggtgccaaagtagatcttcc

SEQ ID NO: 665634 - DNA, 20 bp, mouse
gaccgcccagccctccctgg

SEQ ID NO: 665635 - DNA, 20 bp, mouse
ggcactttcgtcatcttgat

SEQ ID NO: 665636 - DNA, 20 bp, mouse
gaggcgaatacctatgactt

SEQ ID NO: 665637 - DNA, 20 bp, mouse
gcctggacttggaagagcgt

SEQ ID NO: 665638 - DNA, 20 bp, mouse
gctcttccaagtccaggtag

SEQ ID NO: 665639 - DNA, 20 bp, mouse
gcggctgcaatcaaaggagg

SEQ ID NO: 665640 - DNA, 20 bp, mouse
ggccagactacctaagtcat

SEQ ID NO: 665641 - DNA, 20 bp, mouse
gggtgtgccctgaggaaagt

SEQ ID NO: 665642 - DNA, 20 bp, mouse
gaagacaaggaatttcccag

SEQ ID NO: 665643 - DNA, 20 bp, mouse
gtcccgtcatgctcggggaa

SEQ ID NO: 665644 - DNA, 20 bp, mouse
gagagggcatcttgtcaaag

SEQ ID NO: 665645 - DNA, 20 bp, mouse
ggcagtcgcttcaatgaact

SEQ ID NO: 665646 - DNA, 20 bp, mouse
ggggccggaagtgaggtcag

SEQ ID NO: 665647 - DNA, 20 bp, mouse
gccgggcgacggcttctccc

SEQ ID NO: 665648 - DNA, 20 bp, mouse
gttctcccaggaccacgccg

SEQ ID NO: 665649 - DNA, 20 bp, mouse
gtaaaagcgccgggcagcaa

SEQ ID NO: 665650 - DNA, 20 bp, mouse
gcgccagagcacagcggggc

SEQ ID NO: 665651 - DNA, 20 bp, mouse
ggacacgcgccagagcacag

SEQ ID NO: 665652 - DNA, 20 bp, mouse
gacgctgatgatctcggttc

SEQ ID NO: 665653 - DNA, 20 bp, mouse
ggctcctgaccaatgagacc

SEQ ID NO: 665654 - DNA, 20 bp, mouse
ggctccgctgacctcacttc

SEQ ID NO: 665655 - DNA, 20 bp, mouse
gtggtcaggagcagcgcagt

SEQ ID NO: 665656 - DNA, 20 bp, mouse
gaccaccatagtgtgctgga

SEQ ID NO: 665657 - DNA, 20 bp, mouse
ggggagcaataattctctgg

SEQ ID NO: 665658 - DNA, 20 bp, mouse
gcaccaccaccatagtgtgc

SEQ ID NO: 665659 - DNA, 20 bp, mouse
gtctaccatccagcacacta

SEQ ID NO: 665660 - DNA, 20 bp, mouse
gagactggctggtatggtgc

SEQ ID NO: 665661 - DNA, 20 bp, mouse
gatcgggagcaataattctc

SEQ ID NO: 665662 - DNA, 20 bp, mouse
gaacagcggagggcaggccc

SEQ ID NO: 665663 - DNA, 20 bp, mouse
gggaactgattagaaggagt

SEQ ID NO: 665664 - DNA, 20 bp, mouse
gcgacctggtgcctgtagat

SEQ ID NO: 665665 - DNA, 20 bp, mouse
gtaatgctgcatttgacaac

SEQ ID NO: 665666 - DNA, 20 bp, mouse
gcgcccaaggagtgctagca

SEQ ID NO: 665667 - DNA, 20 bp, mouse
ggtctgctgcgcctgaaaag

SEQ ID NO: 665668 - DNA, 20 bp, mouse
gggcgtggcggacccagggt

SEQ ID NO: 665669 - DNA, 20 bp, mouse
gcctcaggggctagtcttga

SEQ ID NO: 665670 - DNA, 20 bp, mouse
gaagctgcctcggacgagcc

SEQ ID NO: 665671 - DNA, 20 bp, mouse
gagtgccccaggctcgtccg

SEQ ID NO: 665672 - DNA, 20 bp, mouse
gcctgggtccgccacgccta

SEQ ID NO: 665673 - DNA, 20 bp, mouse
gaccgggagcccggtgcgca

SEQ ID NO: 665674 - DNA, 20 bp, mouse
gctcactgggtctggagccg

SEQ ID NO: 665675 - DNA, 20 bp, mouse
gcacgtcactaaagtgcccc

SEQ ID NO: 665676 - DNA, 20 bp, mouse
ggaaaccccggctgcacgaa

SEQ ID NO: 665677 - DNA, 20 bp, mouse
gccgctgcagaccctgtccc

SEQ ID NO: 665678 - DNA, 20 bp, mouse
gcggccgccagtgccccaac

SEQ ID NO: 665679 - DNA, 20 bp, mouse
gcacaagcccgcggcctgag

SEQ ID NO: 665680 - DNA, 20 bp, mouse
ggcttcgcgcaacccggttg

SEQ ID NO: 665681 - DNA, 20 bp, mouse
gacccggcctccccgggaca

SEQ ID NO: 665682 - DNA, 20 bp, mouse
gtccccaagctccttggctc

SEQ ID NO: 665683 - DNA, 20 bp, mouse
gtgcagaccctgtcccgggg

SEQ ID NO: 665684 - DNA, 20 bp, mouse
ggaccctgtcccggggaggc

SEQ ID NO: 665685 - DNA, 20 bp, mouse
gctggcctgcctccccgaac

SEQ ID NO: 665686 - DNA, 20 bp, mouse
gggaactgagaaactctaag

SEQ ID NO: 665687 - DNA, 20 bp, mouse
ggacgccggaagccggtagg

SEQ ID NO: 665688 - DNA, 20 bp, mouse
gctaaggggcaaccgagaac

SEQ ID NO: 665689 - DNA, 20 bp, mouse
ggaggacgccggaagccggt

SEQ ID NO: 665690 - DNA, 20 bp, mouse
gtgccccgtggaggtgagat

SEQ ID NO: 665691 - DNA, 20 bp, mouse
gagccctgccttcctcgggg

SEQ ID NO: 665692 - DNA, 20 bp, mouse
gccccgaggacgccggaagc

SEQ ID NO: 665693 - DNA, 20 bp, mouse
gttatggcgggtaaaagact

SEQ ID NO: 665694 - DNA, 20 bp, mouse
gctaccatatcctgtcccgg

SEQ ID NO: 665695 - DNA, 20 bp, mouse
ggccgagccagcgctctcaa

SEQ ID NO: 665696 - DNA, 20 bp, mouse
gtgggcggggccttgcggga

SEQ ID NO: 665697 - DNA, 20 bp, mouse
gcggtagtcctttacccaat

SEQ ID NO: 665698 - DNA, 20 bp, mouse
gtaacctgaacagtgttcaa

SEQ ID NO: 665699 - DNA, 20 bp, mouse
gggcggggcgaggaactcgt

SEQ ID NO: 665700 - DNA, 20 bp, mouse
gctgctagcccattgggtaa

SEQ ID NO: 665701 - DNA, 20 bp, mouse
ggggacctgtagagacttag

SEQ ID NO: 665702 - DNA, 20 bp, mouse
gccagggcctgctagcccat

SEQ ID NO: 665703 - DNA, 20 bp, mouse
gtcttcaaactggttgaagt

SEQ ID NO: 665704 - DNA, 20 bp, mouse
ggcggggcctgatgtgggcg

SEQ ID NO: 665705 - DNA, 20 bp, mouse
gaggccaacagacggcccgg

SEQ ID NO: 665706 - DNA, 20 bp, mouse
gggagagagagttacactcg

SEQ ID NO: 665707 - DNA, 20 bp, mouse
gtgagcttatcgagagggag

SEQ ID NO: 665708 - DNA, 20 bp, mouse
ggagagagttacactcgcgg

SEQ ID NO: 665709 - DNA, 20 bp, mouse
gcctctcgataagctcaatg

SEQ ID NO: 665710 - DNA, 20 bp, mouse
ggagcaccacccccctagta

SEQ ID NO: 665711 - DNA, 20 bp, mouse
gttctgttaccatactaggg

SEQ ID NO: 665712 - DNA, 20 bp, mouse
gctatcagacatcagctgat

SEQ ID NO: 665713 - DNA, 20 bp, mouse
gaggctaccgggactctttc

SEQ ID NO: 665714 - DNA, 20 bp, mouse
gtgttaccatactagggggg

SEQ ID NO: 665715 - DNA, 20 bp, mouse
gagagttacactcgcggggg

SEQ ID NO: 665716 - DNA, 20 bp, mouse
gccgccgcaggacccccaga

SEQ ID NO: 665717 - DNA, 20 bp, mouse
gctgtagggagagtcaagct

SEQ ID NO: 665718 - DNA, 20 bp, mouse
gtgcaggaaggcggtacact

SEQ ID NO: 665719 - DNA, 20 bp, mouse
gacctcccgttaacggtgac

SEQ ID NO: 665720 - DNA, 20 bp, mouse
gcagcgccacctcccgttaa

SEQ ID NO: 665721 - DNA, 20 bp, mouse
gcccccagagggcagactgc

SEQ ID NO: 665722 - DNA, 20 bp, mouse
ggggccgggaaagagtaagt

SEQ ID NO: 665723 - DNA, 20 bp, mouse
ggctgatgctaaatgctgta

SEQ ID NO: 665724 - DNA, 20 bp, mouse
ggcggtctactacagaaaag

SEQ ID NO: 665725 - DNA, 20 bp, mouse
gtcctgtcaccgttaacggg

SEQ ID NO: 665726 - DNA, 20 bp, mouse
ggctaggcgcagagacctct

SEQ ID NO: 665727 - DNA, 20 bp, mouse
ggctgcaccctgtgttgcaa

SEQ ID NO: 665728 - DNA, 20 bp, mouse
gcgcagctcaagactcccag

SEQ ID NO: 665729 - DNA, 20 bp, mouse
ggcgtgcgttctgtggtctt

SEQ ID NO: 665730 - DNA, 20 bp, mouse
gttgagctgcgtgcgttctg

SEQ ID NO: 665731 - DNA, 20 bp, mouse
ggtgaatatttgtactaaca

SEQ ID NO: 665732 - DNA, 20 bp, mouse
ggtacaaatattcactgcat

SEQ ID NO: 665733 - DNA, 20 bp, mouse
gttgatccccttgcaacaca

SEQ ID NO: 665734 - DNA, 20 bp, mouse
gaaaagataagcatgtcact

SEQ ID NO: 665735 - DNA, 20 bp, mouse
gtaaaaacaagaaactgggc

SEQ ID NO: 665736 - DNA, 20 bp, mouse
gcgggggctcctctaccaat

SEQ ID NO: 665737 - DNA, 20 bp, mouse
gaacgggaaagcaacgaggg

SEQ ID NO: 665738 - DNA, 20 bp, mouse
gaccaataggaagagtagaa

SEQ ID NO: 665739 - DNA, 20 bp, mouse
gactgacagccgattggtag

SEQ ID NO: 665740 - DNA, 20 bp, mouse
gagcaacgaggggggagcgg

SEQ ID NO: 665741 - DNA, 20 bp, mouse
gacgaaggggacagcatgca

SEQ ID NO: 665742 - DNA, 20 bp, mouse
gagcaacgggaaagcaacga

SEQ ID NO: 665743 - DNA, 20 bp, mouse
gaactcagctgtggttactt

SEQ ID NO: 665744 - DNA, 20 bp, mouse
gacacagactgacagccgat

SEQ ID NO: 665745 - DNA, 20 bp, mouse
gtattcagcgcactgtctcc

SEQ ID NO: 665746 - DNA, 20 bp, mouse
gtgaatgcatagagctggga

SEQ ID NO: 665747 - DNA, 20 bp, mouse
gcactggtttcttgagtctg

SEQ ID NO: 665748 - DNA, 20 bp, mouse
ggattctgctatgcctctca

SEQ ID NO: 665749 - DNA, 20 bp, mouse
ggaaaggggcggagccccgt

SEQ ID NO: 665750 - DNA, 20 bp, mouse
gcaaagcacaggttcgaaag

SEQ ID NO: 665751 - DNA, 20 bp, mouse
gtctcaggggcacggttcct

SEQ ID NO: 665752 - DNA, 20 bp, mouse
gcactgtgaatgcatagagc

SEQ ID NO: 665753 - DNA, 20 bp, mouse
gagccccgtaggtcggtacc

SEQ ID NO: 665754 - DNA, 20 bp, mouse
ggccacgccccctgccgctg

SEQ ID NO: 665755 - DNA, 20 bp, mouse
gtgccgggtaccgacctacg

SEQ ID NO: 665756 - DNA, 20 bp, mouse
ggcagcgtgctgacgttccc

SEQ ID NO: 665757 - DNA, 20 bp, mouse
gtccttccgcccaatggggc

SEQ ID NO: 665758 - DNA, 20 bp, mouse
gagccctctagactgctcag

SEQ ID NO: 665759 - DNA, 20 bp, mouse
gcacgctgccgtccccagac

SEQ ID NO: 665760 - DNA, 20 bp, mouse
ggctccgcgcccgccccatt

SEQ ID NO: 665761 - DNA, 20 bp, mouse
gagcagtctagagggctccg

SEQ ID NO: 665762 - DNA, 20 bp, mouse
ggctgagtgcgcgtggacgc

SEQ ID NO: 665763 - DNA, 20 bp, mouse
gtgctgacgttcccgggtgc

SEQ ID NO: 665764 - DNA, 20 bp, mouse
gaacgagccaatgggagctg

SEQ ID NO: 665765 - DNA, 20 bp, mouse
gcccattgggcggaaggaga

SEQ ID NO: 665766 - DNA, 20 bp, mouse
gggagtctggggttatgtga

SEQ ID NO: 665767 - DNA, 20 bp, mouse
gcagctgtgtctcctaggga

SEQ ID NO: 665768 - DNA, 20 bp, mouse
gtggggtccccggggtgccg

SEQ ID NO: 665769 - DNA, 20 bp, mouse
gagcctccctccctcaccac

SEQ ID NO: 665770 - DNA, 20 bp, mouse
gtgtgtctcctagggaagga

SEQ ID NO: 665771 - DNA, 20 bp, mouse
gccggccccgagccactgta

SEQ ID NO: 665772 - DNA, 20 bp, mouse
ggtagaggcctgacctggca

SEQ ID NO: 665773 - DNA, 20 bp, mouse
gtgccagccgcggcaccccg

SEQ ID NO: 665774 - DNA, 20 bp, mouse
ggcctccacgtcagcctccg

SEQ ID NO: 665775 - DNA, 20 bp, mouse
gtggtggcctggggtccccg

SEQ ID NO: 665776 - DNA, 20 bp, mouse
gtagagcgggttgttgaatc

SEQ ID NO: 665777 - DNA, 20 bp, mouse
gccaagacgggtgacaaatg

SEQ ID NO: 665778 - DNA, 20 bp, mouse
gtcaccgctgaggaaatctc

SEQ ID NO: 665779 - DNA, 20 bp, mouse
gagcgccagtatccaaagag

SEQ ID NO: 665780 - DNA, 20 bp, mouse
gctagtcctccccaaccaaa

SEQ ID NO: 665781 - DNA, 20 bp, mouse
gcccagaggtagcgaccctt

SEQ ID NO: 665782 - DNA, 20 bp, mouse
gggttggggaggactagagc

SEQ ID NO: 665783 - DNA, 20 bp, mouse
gccggcagcgagcttagact

SEQ ID NO: 665784 - DNA, 20 bp, mouse
gtgtcacccgtcttgggctg

SEQ ID NO: 665785 - DNA, 20 bp, mouse
ggacaaatgcggaagaggca

SEQ ID NO: 665786 - DNA, 20 bp, mouse
gagggtgcgcctagtaatta

SEQ ID NO: 665787 - DNA, 20 bp, mouse
gccagcagggccctccactt

SEQ ID NO: 665788 - DNA, 20 bp, mouse
gagggccctccacttgggga

SEQ ID NO: 665789 - DNA, 20 bp, mouse
gcggaatccctcagtgctcc

SEQ ID NO: 665790 - DNA, 20 bp, mouse
gtgctgccctctcctcgatt

SEQ ID NO: 665791 - DNA, 20 bp, mouse
gaacgcgagaccacgtgacc

SEQ ID NO: 665792 - DNA, 20 bp, mouse
gattactaggcgcaccctgc

SEQ ID NO: 665793 - DNA, 20 bp, mouse
gggcaaagccgacccaatcg

SEQ ID NO: 665794 - DNA, 20 bp, mouse
gctagagagtagcgtctgcg

SEQ ID NO: 665795 - DNA, 20 bp, mouse
ggccctctcctcgattgggt

SEQ ID NO: 665796 - DNA, 20 bp, mouse
gaagagaggcgcgagcgtag

SEQ ID NO: 665797 - DNA, 20 bp, mouse
ggtgacgcctgcgtgttcgc

SEQ ID NO: 665798 - DNA, 20 bp, mouse
gtacactccactgctcttat

SEQ ID NO: 665799 - DNA, 20 bp, mouse
ggaagtgtagcgcttaatgg

SEQ ID NO: 665800 - DNA, 20 bp, mouse
gagagcagtggagtgtaacg

SEQ ID NO: 665801 - DNA, 20 bp, mouse
gtaacccgccactcccaaga

SEQ ID NO: 665802 - DNA, 20 bp, mouse
gtggctgactcggttcggag

SEQ ID NO: 665803 - DNA, 20 bp, mouse
gccactgccagcgaacacgc

SEQ ID NO: 665804 - DNA, 20 bp, mouse
ggtaacgcgggcggtttcct

SEQ ID NO: 665805 - DNA, 20 bp, mouse
ggcaaccgggagatgctaag

SEQ ID NO: 665806 - DNA, 20 bp, mouse
gacagtgattagtctggcag

SEQ ID NO: 665807 - DNA, 20 bp, mouse
gtaggaggatgtaaattggt

SEQ ID NO: 665808 - DNA, 20 bp, mouse
gaacggcggacccagaggtg

SEQ ID NO: 665809 - DNA, 20 bp, mouse
gcacctaggaggatgtaaat

SEQ ID NO: 665810 - DNA, 20 bp, mouse
ggctgaccggccaaggagaa

SEQ ID NO: 665811 - DNA, 20 bp, mouse
gtaaggtattctctaggaga

SEQ ID NO: 665812 - DNA, 20 bp, mouse
gaagcagggtcccccacctc

SEQ ID NO: 665813 - DNA, 20 bp, mouse
gaaaccactgggatgaatat

SEQ ID NO: 665814 - DNA, 20 bp, mouse
ggtaaattggtggggctcta

SEQ ID NO: 665815 - DNA, 20 bp, mouse
ggaccggccaaggagaacgg

SEQ ID NO: 665816 - DNA, 20 bp, mouse
gggaccaagaactgggatgt

SEQ ID NO: 665817 - DNA, 20 bp, mouse
gctcctaagcctcttcttta

SEQ ID NO: 665818 - DNA, 20 bp, mouse
gtctacacaggcactacctg

SEQ ID NO: 665819 - DNA, 20 bp, mouse
gtgggaaatgacatgtcatg

SEQ ID NO: 665820 - DNA, 20 bp, mouse
gcccaagtagattgagtcta

SEQ ID NO: 665821 - DNA, 20 bp, mouse
gagccctaaagaagaggctt

SEQ ID NO: 665822 - DNA, 20 bp, mouse
gtgagtctagggaggagcct

SEQ ID NO: 665823 - DNA, 20 bp, mouse
gtatcctagccctaaagaag

SEQ ID NO: 665824 - DNA, 20 bp, mouse
gctggaaaactcaggcaggt

SEQ ID NO: 665825 - DNA, 20 bp, mouse
gtggagagtctccagaccac

SEQ ID NO: 665826 - DNA, 20 bp, mouse
ggggaaggctgaaatcccag

SEQ ID NO: 665827 - DNA, 20 bp, mouse
gagagtctcccctggctcta

SEQ ID NO: 665828 - DNA, 20 bp, mouse
gggttatggccacagtgaag

SEQ ID NO: 665829 - DNA, 20 bp, mouse
gacccagtagccctagagcc

SEQ ID NO: 665830 - DNA, 20 bp, mouse
gaaatgggacacagatacag

SEQ ID NO: 665831 - DNA, 20 bp, mouse
gacagggcatatgagggttc

SEQ ID NO: 665832 - DNA, 20 bp, mouse
gtgcaagacagggcatatga

SEQ ID NO: 665833 - DNA, 20 bp, mouse
gggatcctgaaaagatttgg

SEQ ID NO: 665834 - DNA, 20 bp, mouse
gggaaaggtcctaggcaaat

SEQ ID NO: 665835 - DNA, 20 bp, mouse
ggagggtgacaccacagaat

SEQ ID NO: 665836 - DNA, 20 bp, mouse
gcaggagagagttcaaccga

SEQ ID NO: 665837 - DNA, 20 bp, mouse
gtgacaaaatagggccaagc

SEQ ID NO: 665838 - DNA, 20 bp, mouse
ggagtgcatgcgcactagtg

SEQ ID NO: 665839 - DNA, 20 bp, mouse
gggtgatggcgcgatattat

SEQ ID NO: 665840 - DNA, 20 bp, mouse
gtatcggcagctttcttctg

SEQ ID NO: 665841 - DNA, 20 bp, mouse
gctagtggggctagcggtga

SEQ ID NO: 665842 - DNA, 20 bp, mouse
gaatggagcggaagtgaggc

SEQ ID NO: 665843 - DNA, 20 bp, mouse
gggatgaacagggagtcctt

SEQ ID NO: 665844 - DNA, 20 bp, mouse
gtgggtacctattaatgcgg

SEQ ID NO: 665845 - DNA, 20 bp, mouse
gtccttctgcttgacaaaat

SEQ ID NO: 665846 - DNA, 20 bp, mouse
gctcccgcggcttctctctc

SEQ ID NO: 665847 - DNA, 20 bp, mouse
gcggggctggaagtgcgaaa

SEQ ID NO: 665848 - DNA, 20 bp, mouse
gggctgccagtccacctcgg

SEQ ID NO: 665849 - DNA, 20 bp, mouse
gggtaccgcctgcacgggtc

SEQ ID NO: 665850 - DNA, 20 bp, mouse
gccaccccgaaggacatgga

SEQ ID NO: 665851 - DNA, 20 bp, mouse
ggaagtgcgaaacggcgaga

SEQ ID NO: 665852 - DNA, 20 bp, mouse
gacccagagagagaagccgc

SEQ ID NO: 665853 - DNA, 20 bp, mouse
gcagggctgccagtccacct

SEQ ID NO: 665854 - DNA, 20 bp, mouse
gtgcatgactgcgacgctca

SEQ ID NO: 665855 - DNA, 20 bp, mouse
ggcaccggttgtcgccaccg

SEQ ID NO: 665856 - DNA, 20 bp, mouse
gagagagcgctgcccgtgag

SEQ ID NO: 665857 - DNA, 20 bp, mouse
gaggagggctggaccggaga

SEQ ID NO: 665858 - DNA, 20 bp, mouse
gggagcacgtagcagtccgg

SEQ ID NO: 665859 - DNA, 20 bp, mouse
ggaaaaggcggggcgtgagg

SEQ ID NO: 665860 - DNA, 20 bp, mouse
gcggggagcacgtagcagtc

SEQ ID NO: 665861 - DNA, 20 bp, mouse
ggtgaggaggagggctggac

SEQ ID NO: 665862 - DNA, 20 bp, mouse
ggcggggcgtaaggagggcg

SEQ ID NO: 665863 - DNA, 20 bp, mouse
gaaggctgaggtacgagaaa

SEQ ID NO: 665864 - DNA, 20 bp, mouse
gggcggggcgtgagagaagc

SEQ ID NO: 665865 - DNA, 20 bp, mouse
ggcctgccccgccccctcac

SEQ ID NO: 665866 - DNA, 20 bp, mouse
gcctaagtgggagagtccag

SEQ ID NO: 665867 - DNA, 20 bp, mouse
gcaactgggcaatccctaag

SEQ ID NO: 665868 - DNA, 20 bp, mouse
gccaacggtggggtcagatg

SEQ ID NO: 665869 - DNA, 20 bp, mouse
ggtgagagctgtgatctcat

SEQ ID NO: 665870 - DNA, 20 bp, mouse
gttggcttgcgggaatcaac

SEQ ID NO: 665871 - DNA, 20 bp, mouse
ggcgcctgagcggagtgaac

SEQ ID NO: 665872 - DNA, 20 bp, mouse
ggaagtccggagaggcgaga

SEQ ID NO: 665873 - DNA, 20 bp, mouse
gatcacagctctcactcctc

SEQ ID NO: 665874 - DNA, 20 bp, mouse
gtgcggggcggaagaaaacc

SEQ ID NO: 665875 - DNA, 20 bp, mouse
gaacgggcgtggcttatggg

SEQ ID NO: 665876 - DNA, 20 bp, mouse
gctagtcagggagtcaaggc

SEQ ID NO: 665877 - DNA, 20 bp, mouse
gcatgctcagtgctctggtc

SEQ ID NO: 665878 - DNA, 20 bp, mouse
gcccggtagggcggccactg

SEQ ID NO: 665879 - DNA, 20 bp, mouse
gtgaaggaaccggtcgctgc

SEQ ID NO: 665880 - DNA, 20 bp, mouse
ggggactattagactagatg

SEQ ID NO: 665881 - DNA, 20 bp, mouse
ggaccgggcactgaaggaac

SEQ ID NO: 665882 - DNA, 20 bp, mouse
gcttctgccaggcaagagat

SEQ ID NO: 665883 - DNA, 20 bp, mouse
gcgctgagtcagaataggaa

SEQ ID NO: 665884 - DNA, 20 bp, mouse
gaatagtcccagcggtgcat

SEQ ID NO: 665885 - DNA, 20 bp, mouse
gtaaagggaccgggcactga

SEQ ID NO: 665886 - DNA, 20 bp, mouse
gtgggctcccagctcctgga

SEQ ID NO: 665887 - DNA, 20 bp, mouse
gttcctggggctttcgggta

SEQ ID NO: 665888 - DNA, 20 bp, mouse
gtgggcctggctaactgcct

SEQ ID NO: 665889 - DNA, 20 bp, mouse
gtgccatacccgaaagcccc

SEQ ID NO: 665890 - DNA, 20 bp, mouse
ggtgaggacgcggttagtat

SEQ ID NO: 665891 - DNA, 20 bp, mouse
gtacatcagtcacatgggcc

SEQ ID NO: 665892 - DNA, 20 bp, mouse
gatgtactaaggcctcctgt

SEQ ID NO: 665893 - DNA, 20 bp, mouse
gttgctcctgacatcatctc

SEQ ID NO: 665894 - DNA, 20 bp, mouse
gccatgtgactgatgtacta

SEQ ID NO: 665895 - DNA, 20 bp, mouse
gttagaattctctgtctgat

SEQ ID NO: 665896 - DNA, 20 bp, mouse
ggactctgcacggtgcatct

SEQ ID NO: 665897 - DNA, 20 bp, mouse
gggactcaactgactctgca

SEQ ID NO: 665898 - DNA, 20 bp, mouse
gtgtatgcgtccatcagggc

SEQ ID NO: 665899 - DNA, 20 bp, mouse
ggtgtcccgacgagcttcac

SEQ ID NO: 665900 - DNA, 20 bp, mouse
gtcccgacgagcttcacggg

SEQ ID NO: 665901 - DNA, 20 bp, mouse
gggagtctcatagctaactt

SEQ ID NO: 665902 - DNA, 20 bp, mouse
gggcttgtatgcgtccatca

SEQ ID NO: 665903 - DNA, 20 bp, mouse
gacctcccgtgaagctcgtc

SEQ ID NO: 665904 - DNA, 20 bp, mouse
gtccagactcggttatgttt

SEQ ID NO: 665905 - DNA, 20 bp, mouse
gacacggagtcttccagact

SEQ ID NO: 665906 - DNA, 20 bp, mouse
gaggccgcccctcacaaaca

SEQ ID NO: 665907 - DNA, 20 bp, mouse
gtccctgcacatcttatacc

SEQ ID NO: 665908 - DNA, 20 bp, mouse
gtgccctgagggatgcaaga

SEQ ID NO: 665909 - DNA, 20 bp, mouse
gtccgggtataagatgtgca

SEQ ID NO: 665910 - DNA, 20 bp, mouse
ggggcagagcagttcaagtt

SEQ ID NO: 665911 - DNA, 20 bp, mouse
gcagcggccatgtttgtgag

SEQ ID NO: 665912 - DNA, 20 bp, mouse
ggacgcgccccttaacaaga

SEQ ID NO: 665913 - DNA, 20 bp, mouse
gtgtgcagggaagcagtttc

SEQ ID NO: 665914 - DNA, 20 bp, mouse
gcggtgcagggatgccctga

SEQ ID NO: 665915 - DNA, 20 bp, mouse
ggcgtcgccatcttgttaag

SEQ ID NO: 665916 - DNA, 20 bp, mouse
gggccctcttaggagctagg

SEQ ID NO: 665917 - DNA, 20 bp, mouse
gtagcccctgtgcaaggtca

SEQ ID NO: 665918 - DNA, 20 bp, mouse
gctagggggtcagaagaagt

SEQ ID NO: 665919 - DNA, 20 bp, mouse
gagccgtggcatgacgtcat

SEQ ID NO: 665920 - DNA, 20 bp, mouse
gtgggaaactgtctcggagc

SEQ ID NO: 665921 - DNA, 20 bp, mouse
gggatgttctgacaacccac

SEQ ID NO: 665922 - DNA, 20 bp, mouse
gcagaaccctgaccttgcac

SEQ ID NO: 665923 - DNA, 20 bp, mouse
gcatgtctacaggccctctt

SEQ ID NO: 665924 - DNA, 20 bp, mouse
ggggtgttgctcatgtctac

SEQ ID NO: 665925 - DNA, 20 bp, mouse
gcttaatccagcaaccctag

SEQ ID NO: 665926 - DNA, 20 bp, mouse
gacagcgtggcgggacccaa

SEQ ID NO: 665927 - DNA, 20 bp, mouse
gctgggccggcaactcaccg

SEQ ID NO: 665928 - DNA, 20 bp, mouse
gaagaggccaaccggacccg

SEQ ID NO: 665929 - DNA, 20 bp, mouse
ggggtcccgccacgctgtgg

SEQ ID NO: 665930 - DNA, 20 bp, mouse
gcgggcggggccttgggctc

SEQ ID NO: 665931 - DNA, 20 bp, mouse
gctcgcgctccaagtcgaat

SEQ ID NO: 665932 - DNA, 20 bp, mouse
gaactcaccgaggctgaagc

SEQ ID NO: 665933 - DNA, 20 bp, mouse
gaaaactgcaggacacccat

SEQ ID NO: 665934 - DNA, 20 bp, mouse
gggcggggtaatcctccctt

SEQ ID NO: 665935 - DNA, 20 bp, mouse
ggcgtggcgggacccaaggg

SEQ ID NO: 665936 - DNA, 20 bp, mouse
gagaactgggagacccgttg

SEQ ID NO: 665937 - DNA, 20 bp, mouse
ggggcagcgagtacaggctt

SEQ ID NO: 665938 - DNA, 20 bp, mouse
gtggccaaactcactgtaat

SEQ ID NO: 665939 - DNA, 20 bp, mouse
ggtggccaggcacattgccc

SEQ ID NO: 665940 - DNA, 20 bp, mouse
gtgcctatcagaggctaaat

SEQ ID NO: 665941 - DNA, 20 bp, mouse
gcaggcctgggcaatgtgcc

SEQ ID NO: 665942 - DNA, 20 bp, mouse
ggatgacagttgcctatcag

SEQ ID NO: 665943 - DNA, 20 bp, mouse
gtgcctggccacctttgggt

SEQ ID NO: 665944 - DNA, 20 bp, mouse
gaatgtgcctggccaccttt

SEQ ID NO: 665945 - DNA, 20 bp, mouse
gccacctttgggtggggccc

SEQ ID NO: 665946 - DNA, 20 bp, mouse
gctgtagaaccctatgaact

SEQ ID NO: 665947 - DNA, 20 bp, mouse
gccgtggggcaagggtacaa

SEQ ID NO: 665948 - DNA, 20 bp, mouse
ggacagattgctctcttact

SEQ ID NO: 665949 - DNA, 20 bp, mouse
ggattgctctcttactaggt

SEQ ID NO: 665950 - DNA, 20 bp, mouse
gctctcacttcccagttcat

SEQ ID NO: 665951 - DNA, 20 bp, mouse
gagtattgaccgtggggcaa

SEQ ID NO: 665952 - DNA, 20 bp, mouse
ggggatgccagtattgaccg

SEQ ID NO: 665953 - DNA, 20 bp, mouse
ggtgttcataacccagagga

SEQ ID NO: 665954 - DNA, 20 bp, mouse
gataatcctgaccttcagga

SEQ ID NO: 665955 - DNA, 20 bp, mouse
gggggcattgtattgtctct

SEQ ID NO: 665956 - DNA, 20 bp, mouse
gagagaacgcgggctcgcgc

SEQ ID NO: 665957 - DNA, 20 bp, mouse
ggggcgggacgctggggacg

SEQ ID NO: 665958 - DNA, 20 bp, mouse
ggggcccggaacacgcgacg

SEQ ID NO: 665959 - DNA, 20 bp, mouse
gcgtgcgcaaagcacacggg

SEQ ID NO: 665960 - DNA, 20 bp, mouse
gcgcgcgtatcctggagctg

SEQ ID NO: 665961 - DNA, 20 bp, mouse
gcgcgcgtactcagagaacg

SEQ ID NO: 665962 - DNA, 20 bp, mouse
ggctggggacgcggaggcga

SEQ ID NO: 665963 - DNA, 20 bp, mouse
gtacgcgtgcgcaaagcaca

SEQ ID NO: 665964 - DNA, 20 bp, mouse
ggcaaccgcgcgcgctcccg

SEQ ID NO: 665965 - DNA, 20 bp, mouse
ggggcggcgggcgggacgct

SEQ ID NO: 665966 - DNA, 20 bp, mouse
gtacgaaggaatgattacga

SEQ ID NO: 665967 - DNA, 20 bp, mouse
ggggtctgcgctcacgggtc

SEQ ID NO: 665968 - DNA, 20 bp, mouse
gctgcagggtctgcgctcac

SEQ ID NO: 665969 - DNA, 20 bp, mouse
ggggtctggggtctttctag

SEQ ID NO: 665970 - DNA, 20 bp, mouse
gctggtggggccagtctgca

SEQ ID NO: 665971 - DNA, 20 bp, mouse
gtgcaaagtcttatgctggg

SEQ ID NO: 665972 - DNA, 20 bp, mouse
gcagctacgggagcctggtg

SEQ ID NO: 665973 - DNA, 20 bp, mouse
gctcgcgagaagtcagctac

SEQ ID NO: 665974 - DNA, 20 bp, mouse
gaccaaggcttgattacaaa

SEQ ID NO: 665975 - DNA, 20 bp, mouse
gtgtgtgtcagagaccaaag

SEQ ID NO: 665976 - DNA, 20 bp, mouse
gcgtgcgcagtgcagagcag

SEQ ID NO: 665977 - DNA, 20 bp, mouse
gcaggaaggagccctgtccg

SEQ ID NO: 665978 - DNA, 20 bp, mouse
ggaaccgaggcccgaagccc

SEQ ID NO: 665979 - DNA, 20 bp, mouse
gagaaccaaccggccgacgc

SEQ ID NO: 665980 - DNA, 20 bp, mouse
gggtgtgcgagtcgaggccc

SEQ ID NO: 665981 - DNA, 20 bp, mouse
ggccggcgctagcagttcac

SEQ ID NO: 665982 - DNA, 20 bp, mouse
gccagcatcagcaccagcgt

SEQ ID NO: 665983 - DNA, 20 bp, mouse
gcgagtgagaaaagcggcag

SEQ ID NO: 665984 - DNA, 20 bp, mouse
ggtaaggcacgagaaccaac

SEQ ID NO: 665985 - DNA, 20 bp, mouse
gaggagccctcggtcccgct

SEQ ID NO: 665986 - DNA, 20 bp, mouse
ggtcgccgtctagagaagga

SEQ ID NO: 665987 - DNA, 20 bp, mouse
gaatgacgacgtagcgacta

SEQ ID NO: 665988 - DNA, 20 bp, mouse
ggtcattttgagaaggtcag

SEQ ID NO: 665989 - DNA, 20 bp, mouse
gggttggaattgatcgcaat

SEQ ID NO: 665990 - DNA, 20 bp, mouse
gcatactgacgctttcaaga

SEQ ID NO: 665991 - DNA, 20 bp, mouse
gccccacccggcagcagaac

SEQ ID NO: 665992 - DNA, 20 bp, mouse
gctacgtcgtcattttgaga

SEQ ID NO: 665993 - DNA, 20 bp, mouse
gcaacacacactatattgac

SEQ ID NO: 665994 - DNA, 20 bp, mouse
gtccggttctgctgccgggt

SEQ ID NO: 665995 - DNA, 20 bp, mouse
gtattgtcgccgtctagaga

SEQ ID NO: 665996 - DNA, 20 bp, mouse
ggattaagagagctactcta

SEQ ID NO: 665997 - DNA, 20 bp, mouse
gcaaaagctgtggtcctggt

SEQ ID NO: 665998 - DNA, 20 bp, mouse
gctgaggttggaacctcctt

SEQ ID NO: 665999 - DNA, 20 bp, mouse
ggagaggaacactgttgcca

SEQ ID NO: 666000 - DNA, 20 bp, mouse
ggctgtatagtcacccaacc

SEQ ID NO: 666001 - DNA, 20 bp, mouse
gcgtgcgcaggaacagaata

SEQ ID NO: 666002 - DNA, 20 bp, mouse
ggaggttccaacctcaggtg

SEQ ID NO: 666003 - DNA, 20 bp, mouse
gcgcttgtggcccccacctg

SEQ ID NO: 666004 - DNA, 20 bp, mouse
gagtgagtttccgaggtcac

SEQ ID NO: 666005 - DNA, 20 bp, mouse
gactgctttccgaaatcaca

SEQ ID NO: 666006 - DNA, 20 bp, mouse
gggggcgcgagacaagtcgt

SEQ ID NO: 666007 - DNA, 20 bp, mouse
gagcctcggcggcgctcccg

SEQ ID NO: 666008 - DNA, 20 bp, mouse
ggcgcgagacaagtcgtggg

SEQ ID NO: 666009 - DNA, 20 bp, mouse
gggagcccgcggaccctcgg

SEQ ID NO: 666010 - DNA, 20 bp, mouse
ggaggccgggagctcggcag

SEQ ID NO: 666011 - DNA, 20 bp, mouse
ggcgctcccggggttggagc

SEQ ID NO: 666012 - DNA, 20 bp, mouse
gagacagaagcgaggatgga

SEQ ID NO: 666013 - DNA, 20 bp, mouse
gcatcggagcggcgccagtg

SEQ ID NO: 666014 - DNA, 20 bp, mouse
gcgccccgcgcgcatcggag

SEQ ID NO: 666015 - DNA, 20 bp, mouse
ggcggcgggcgtccgcgcca

SEQ ID NO: 666016 - DNA, 20 bp, mouse
ggagacctgcggtaccttgg

SEQ ID NO: 666017 - DNA, 20 bp, mouse
gcctcctggtggccacttaa

SEQ ID NO: 666018 - DNA, 20 bp, mouse
ggagatggatgcagaggcga

SEQ ID NO: 666019 - DNA, 20 bp, mouse
gtgctcctggcgcctcctgg

SEQ ID NO: 666020 - DNA, 20 bp, mouse
gaggagcagcgagagacctg

SEQ ID NO: 666021 - DNA, 20 bp, mouse
gtctaccgccaaggtaccgc

SEQ ID NO: 666022 - DNA, 20 bp, mouse
gccttcattgtacccgccta

SEQ ID NO: 666023 - DNA, 20 bp, mouse
gtgcccaaagactagatttc

SEQ ID NO: 666024 - DNA, 20 bp, mouse
gtcaccagaaatctagtctt

SEQ ID NO: 666025 - DNA, 20 bp, mouse
ggctacctacccgggggagg

SEQ ID NO: 666026 - DNA, 20 bp, mouse
gagaaagtcgctggatggga

SEQ ID NO: 666027 - DNA, 20 bp, mouse
gtgcaaggaccgctaatcca

SEQ ID NO: 666028 - DNA, 20 bp, mouse
gagagagaaagtcgctggat

SEQ ID NO: 666029 - DNA, 20 bp, mouse
gccaacttgcttccccacga

SEQ ID NO: 666030 - DNA, 20 bp, mouse
gaggcaggcctaggggagta

SEQ ID NO: 666031 - DNA, 20 bp, mouse
gcctaggggagtagggagac

SEQ ID NO: 666032 - DNA, 20 bp, mouse
ggcaagttgggatggagcaa

SEQ ID NO: 666033 - DNA, 20 bp, mouse
gaagaagggctcatcatgca

SEQ ID NO: 666034 - DNA, 20 bp, mouse
ggcttccccacgaaggagaa

SEQ ID NO: 666035 - DNA, 20 bp, mouse
gactacgttgagcatctaag

SEQ ID NO: 666036 - DNA, 20 bp, mouse
gcccgggaggcgggtcccaa

SEQ ID NO: 666037 - DNA, 20 bp, mouse
gtacccccgccaacgttgat

SEQ ID NO: 666038 - DNA, 20 bp, mouse
gacaagtctggtgtgaagga

SEQ ID NO: 666039 - DNA, 20 bp, mouse
gcgaacgggagcggggcgca

SEQ ID NO: 666040 - DNA, 20 bp, mouse
gcacgcggggctctgcgaac

SEQ ID NO: 666041 - DNA, 20 bp, mouse
gtcgcagagccccgcgtggt

SEQ ID NO: 666042 - DNA, 20 bp, mouse
gcgacgggaaatgtagtccg

SEQ ID NO: 666043 - DNA, 20 bp, mouse
gcggcgtgccgtggtcacct

SEQ ID NO: 666044 - DNA, 20 bp, mouse
ggcatgccgggaaatgagtc

SEQ ID NO: 666045 - DNA, 20 bp, mouse
gaagccgaaaccgacaagtc

SEQ ID NO: 666046 - DNA, 20 bp, mouse
gaacacctgcgccttacatc

SEQ ID NO: 666047 - DNA, 20 bp, mouse
ggtaaggcgcaggtgttcgc

SEQ ID NO: 666048 - DNA, 20 bp, mouse
ggggtcttggaaacgctggc

SEQ ID NO: 666049 - DNA, 20 bp, mouse
gatcgcgcgcaggcgcagaa

SEQ ID NO: 666050 - DNA, 20 bp, mouse
gaaaggggatgcgagtcttc

SEQ ID NO: 666051 - DNA, 20 bp, mouse
ggaaacgctggccggatgta

SEQ ID NO: 666052 - DNA, 20 bp, mouse
gcctaccccgcctcagtagt

SEQ ID NO: 666053 - DNA, 20 bp, mouse
ggcggggtaggatcgcgcgc

SEQ ID NO: 666054 - DNA, 20 bp, mouse
gctggccggatgtaaggcgc

SEQ ID NO: 666055 - DNA, 20 bp, mouse
gcgcctctgaggccttcttc

SEQ ID NO: 666056 - DNA, 20 bp, mouse
gtagggcgggaaaaggttga

SEQ ID NO: 666057 - DNA, 20 bp, mouse
gagggtaaaaccaggatcct

SEQ ID NO: 666058 - DNA, 20 bp, mouse
gggtctgtgagggtaaaacc

SEQ ID NO: 666059 - DNA, 20 bp, mouse
gcctggttccagctactcta

SEQ ID NO: 666060 - DNA, 20 bp, mouse
gaagccaaagtggacatgat

SEQ ID NO: 666061 - DNA, 20 bp, mouse
gaacccggtagcggtaacca

SEQ ID NO: 666062 - DNA, 20 bp, mouse
ggctactctagggcgggaaa

SEQ ID NO: 666063 - DNA, 20 bp, mouse
gtctgaacctggcttgaact

SEQ ID NO: 666064 - DNA, 20 bp, mouse
gacgcccatcatgtccactt

SEQ ID NO: 666065 - DNA, 20 bp, mouse
gcatgatgggcgtatccaaa

SEQ ID NO: 666066 - DNA, 20 bp, mouse
gggctggggagttgagagac

SEQ ID NO: 666067 - DNA, 20 bp, mouse
gcggggtgtgaattacgtaa

SEQ ID NO: 666068 - DNA, 20 bp, mouse
gagtcccatggtctcctcca

SEQ ID NO: 666069 - DNA, 20 bp, mouse
gttcccttggaggagaccat

SEQ ID NO: 666070 - DNA, 20 bp, mouse
gcaggcagcggcgctggagg

SEQ ID NO: 666071 - DNA, 20 bp, mouse
gtgaggctagcaagacacgg

SEQ ID NO: 666072 - DNA, 20 bp, mouse
gtaaggagtgagcgttgcgc

SEQ ID NO: 666073 - DNA, 20 bp, mouse
ggacataattgctacgactg

SEQ ID NO: 666074 - DNA, 20 bp, mouse
ggtgagcgttgcgcaggcag

SEQ ID NO: 666075 - DNA, 20 bp, mouse
gaaaaaaaaggaaatgggct

SEQ ID NO: 666076 - DNA, 20 bp, mouse
ggcgggaggggcgggatcgg

SEQ ID NO: 666077 - DNA, 20 bp, mouse
ggcgggatcggaggcgagta

SEQ ID NO: 666078 - DNA, 20 bp, mouse
gatcggaggcgagtagggcg

SEQ ID NO: 666079 - DNA, 20 bp, mouse
gcacctgggcgtggccggag

SEQ ID NO: 666080 - DNA, 20 bp, mouse
gggcgtggccggagcgggag

SEQ ID NO: 666081 - DNA, 20 bp, mouse
gccgcgcagcgagcacacct

SEQ ID NO: 666082 - DNA, 20 bp, mouse
gcagcgagcacacctgggcg

SEQ ID NO: 666083 - DNA, 20 bp, mouse
gacaactgcaaggctttgaa

SEQ ID NO: 666084 - DNA, 20 bp, mouse
gcctgcgggaggggcacctc

SEQ ID NO: 666085 - DNA, 20 bp, mouse
gagtttctgggacaactgca

SEQ ID NO: 666086 - DNA, 20 bp, mouse
gggggcagggcctctttcga

SEQ ID NO: 666087 - DNA, 20 bp, mouse
gagcagacccttcagggtgt

SEQ ID NO: 666088 - DNA, 20 bp, mouse
gcaaggaccccacaccctga

SEQ ID NO: 666089 - DNA, 20 bp, mouse
gtgaagggtctgctcatagt

SEQ ID NO: 666090 - DNA, 20 bp, mouse
ggtatcgatgtcagccggaa

SEQ ID NO: 666091 - DNA, 20 bp, mouse
gtcagccggaagggcttggt

SEQ ID NO: 666092 - DNA, 20 bp, mouse
gcccctcccctcctaagagt

SEQ ID NO: 666093 - DNA, 20 bp, mouse
gtcccaggtgaccgactctt

SEQ ID NO: 666094 - DNA, 20 bp, mouse
gcacgcccaccaagcccttc

SEQ ID NO: 666095 - DNA, 20 bp, mouse
ggtgccctgggataagcaca

SEQ ID NO: 666096 - DNA, 20 bp, mouse
gcacgcatggagcccatatt

SEQ ID NO: 666097 - DNA, 20 bp, mouse
gcggaagagcaggtgtcccg

SEQ ID NO: 666098 - DNA, 20 bp, mouse
gagcccatattgggttgagt

SEQ ID NO: 666099 - DNA, 20 bp, mouse
gccttcgccaggactaaaga

SEQ ID NO: 666100 - DNA, 20 bp, mouse
gaggtgtcccggggattttg

SEQ ID NO: 666101 - DNA, 20 bp, mouse
gcggaatcctcaaaatcccc

SEQ ID NO: 666102 - DNA, 20 bp, mouse
gggacggcgttgtgacgcga

SEQ ID NO: 666103 - DNA, 20 bp, mouse
gttagtcctggcgaagggaa

SEQ ID NO: 666104 - DNA, 20 bp, mouse
gctcctcaggacacttccgg

SEQ ID NO: 666105 - DNA, 20 bp, mouse
gaaagatggcgctgacagga

SEQ ID NO: 666106 - DNA, 20 bp, mouse
gcccctcttgcagttgtcga

SEQ ID NO: 666107 - DNA, 20 bp, mouse
gaatgtcacaagagtaagag

SEQ ID NO: 666108 - DNA, 20 bp, mouse
ggagaggcggtctgacccca

SEQ ID NO: 666109 - DNA, 20 bp, mouse
ggtcacaagagtaagagagg

SEQ ID NO: 666110 - DNA, 20 bp, mouse
gcaccctcgacaactgcaag

SEQ ID NO: 666111 - DNA, 20 bp, mouse
ggacaggatgtctcattcca

SEQ ID NO: 666112 - DNA, 20 bp, mouse
gactgcaagagggggattcc

SEQ ID NO: 666113 - DNA, 20 bp, mouse
gacaggcttccaaggctccc

SEQ ID NO: 666114 - DNA, 20 bp, mouse
gagggggattcccggccctg

SEQ ID NO: 666115 - DNA, 20 bp, mouse
gttcctccaatttagggaaa

SEQ ID NO: 666116 - DNA, 20 bp, mouse
gccgctggagccatacctga

SEQ ID NO: 666117 - DNA, 20 bp, mouse
ggggcggtccttcaccgagg

SEQ ID NO: 666118 - DNA, 20 bp, mouse
ggagacgcgagcatcgctaa

SEQ ID NO: 666119 - DNA, 20 bp, mouse
gtggctggccgcttccggtg

SEQ ID NO: 666120 - DNA, 20 bp, mouse
ggaaaagccccgcctctccc

SEQ ID NO: 666121 - DNA, 20 bp, mouse
gggtatggctccagcggctg

SEQ ID NO: 666122 - DNA, 20 bp, mouse
gcatacctgaaggcggctat

SEQ ID NO: 666123 - DNA, 20 bp, mouse
gcggccagccacctcggtga

SEQ ID NO: 666124 - DNA, 20 bp, mouse
gcggaagcggccagccacct

SEQ ID NO: 666125 - DNA, 20 bp, mouse
gctgggaattgcagtgcatg

SEQ ID NO: 666126 - DNA, 20 bp, mouse
ggattccctgggagcggagc

SEQ ID NO: 666127 - DNA, 20 bp, mouse
gaggggaactgttaaatcga

SEQ ID NO: 666128 - DNA, 20 bp, mouse
gtacctcccacaagaactaa

SEQ ID NO: 666129 - DNA, 20 bp, mouse
gctcctttagttcttgtggg

SEQ ID NO: 666130 - DNA, 20 bp, mouse
ggctttgtttgcagcagggg

SEQ ID NO: 666131 - DNA, 20 bp, mouse
ggctcccagggaatccaaag

SEQ ID NO: 666132 - DNA, 20 bp, mouse
gaaaggcttaacagggtgct

SEQ ID NO: 666133 - DNA, 20 bp, mouse
gttcttgtgggaggtaggga

SEQ ID NO: 666134 - DNA, 20 bp, mouse
gaagtatacgggaaaatgag

SEQ ID NO: 666135 - DNA, 20 bp, mouse
gatcccttacaaaatggtgg

SEQ ID NO: 666136 - DNA, 20 bp, mouse
gagggctggctctttgagaa

SEQ ID NO: 666137 - DNA, 20 bp, mouse
gagaggaaggaaagcccaac

SEQ ID NO: 666138 - DNA, 20 bp, mouse
ggagcagggtggtttttcgt

SEQ ID NO: 666139 - DNA, 20 bp, mouse
gaacatccttctccccagag

SEQ ID NO: 666140 - DNA, 20 bp, mouse
ggagaaggatgttggcctgc

SEQ ID NO: 666141 - DNA, 20 bp, mouse
ggaaatgcagtcggagagga

SEQ ID NO: 666142 - DNA, 20 bp, mouse
gagccacgccttcaaggaga

SEQ ID NO: 666143 - DNA, 20 bp, mouse
gttcgtgggaggtgcttcgt

SEQ ID NO: 666144 - DNA, 20 bp, mouse
gagccagagccacgccttca

SEQ ID NO: 666145 - DNA, 20 bp, mouse
gatggtatggagccccacag

SEQ ID NO: 666146 - DNA, 20 bp, mouse
gcctcccgggagttctgcac

SEQ ID NO: 666147 - DNA, 20 bp, mouse
gacgggacgggcggagattg

SEQ ID NO: 666148 - DNA, 20 bp, mouse
ggggactccagggtgactag

SEQ ID NO: 666149 - DNA, 20 bp, mouse
ggggttcgtcccttcctccc

SEQ ID NO: 666150 - DNA, 20 bp, mouse
ggccccgccacgcttaaaaa

SEQ ID NO: 666151 - DNA, 20 bp, mouse
gccctgcgccctgggactcc

SEQ ID NO: 666152 - DNA, 20 bp, mouse
ggggtgcacggctagctctt

SEQ ID NO: 666153 - DNA, 20 bp, mouse
gtgggtgctacaaaccagtt

SEQ ID NO: 666154 - DNA, 20 bp, mouse
gggacgaacccctgcgccct

SEQ ID NO: 666155 - DNA, 20 bp, mouse
gggctcgcctgcacgcgctc

SEQ ID NO: 666156 - DNA, 20 bp, mouse
ggcggtctccggagccaatg

SEQ ID NO: 666157 - DNA, 20 bp, mouse
gagtggggttgccatgacag

SEQ ID NO: 666158 - DNA, 20 bp, mouse
ggaactacagactaccccat

SEQ ID NO: 666159 - DNA, 20 bp, mouse
gacgcgcaggcgcgacccgg

SEQ ID NO: 666160 - DNA, 20 bp, mouse
gacgctgtacactgttgtta

SEQ ID NO: 666161 - DNA, 20 bp, mouse
gtcatggcaaccccactcag

SEQ ID NO: 666162 - DNA, 20 bp, mouse
ggggccacccaaagcgtgca

SEQ ID NO: 666163 - DNA, 20 bp, mouse
ggaagagcaggtccgtcccc

SEQ ID NO: 666164 - DNA, 20 bp, mouse
gaaagcgtgcatggtctcca

SEQ ID NO: 666165 - DNA, 20 bp, mouse
gaccgcgcgaaggagctcac

SEQ ID NO: 666166 - DNA, 20 bp, mouse
ggggcggagtctctgagtga

SEQ ID NO: 666167 - DNA, 20 bp, mouse
gaatcggtgggcggaactag

SEQ ID NO: 666168 - DNA, 20 bp, mouse
gccctagccgagtctgggat

SEQ ID NO: 666169 - DNA, 20 bp, mouse
gcccagaggcgggcaatcgg

SEQ ID NO: 666170 - DNA, 20 bp, mouse
gagcctgcaaagaatcaatc

SEQ ID NO: 666171 - DNA, 20 bp, mouse
gagtggttgccaggaaacga

SEQ ID NO: 666172 - DNA, 20 bp, mouse
gcaagcaagggccgttggaa

SEQ ID NO: 666173 - DNA, 20 bp, mouse
gtggtgaaaagctggaactc

SEQ ID NO: 666174 - DNA, 20 bp, mouse
gggcttccctagccgagtct

SEQ ID NO: 666175 - DNA, 20 bp, mouse
gggcggaactagtggttgcc

SEQ ID NO: 666176 - DNA, 20 bp, mouse
gcagtacagcagggtggact

SEQ ID NO: 666177 - DNA, 20 bp, mouse
gctgctgtactgcatctgcg

SEQ ID NO: 666178 - DNA, 20 bp, mouse
gagtccctgctgtcctgttc

SEQ ID NO: 666179 - DNA, 20 bp, mouse
gctgctcaacacgcagttca

SEQ ID NO: 666180 - DNA, 20 bp, mouse
gcgcagttcaggggtaagag

SEQ ID NO: 666181 - DNA, 20 bp, mouse
gtaacactgtatgacatcac

SEQ ID NO: 666182 - DNA, 20 bp, mouse
gagccatagtcccccagaac

SEQ ID NO: 666183 - DNA, 20 bp, mouse
gcttctctgcgacatctctg

SEQ ID NO: 666184 - DNA, 20 bp, mouse
ggtcctgttctgggggacta

SEQ ID NO: 666185 - DNA, 20 bp, mouse
gacatctctgaggtagtgat

SEQ ID NO: 666186 - DNA, 20 bp, mouse
gaggaatgggcggacgactc

SEQ ID NO: 666187 - DNA, 20 bp, mouse
gcccgcaaggggctttgtct

SEQ ID NO: 666188 - DNA, 20 bp, mouse
gaaccttcctacctggactg

SEQ ID NO: 666189 - DNA, 20 bp, mouse
gttcctcagtccaggtagga

SEQ ID NO: 666190 - DNA, 20 bp, mouse
gtgacaacacggcctaaagc

SEQ ID NO: 666191 - DNA, 20 bp, mouse
ggacgcttgtagcccgcaag

SEQ ID NO: 666192 - DNA, 20 bp, mouse
gggcgcgcgcggagcctgct

SEQ ID NO: 666193 - DNA, 20 bp, mouse
gccacagcaaacacagtact

SEQ ID NO: 666194 - DNA, 20 bp, mouse
gctggcgctgattggtcgga

SEQ ID NO: 666195 - DNA, 20 bp, mouse
gacccccagtcgccaaggca

SEQ ID NO: 666196 - DNA, 20 bp, mouse
ggaggcagatgcatggggtt

SEQ ID NO: 666197 - DNA, 20 bp, mouse
gctcccacggattcttacaa

SEQ ID NO: 666198 - DNA, 20 bp, mouse
gaagttgaggcagatgcatg

SEQ ID NO: 666199 - DNA, 20 bp, mouse
gcttacaaaggcagtttgat

SEQ ID NO: 666200 - DNA, 20 bp, mouse
gaccgagaactcttcccact

SEQ ID NO: 666201 - DNA, 20 bp, mouse
gcagctgcaggtttcccagt

SEQ ID NO: 666202 - DNA, 20 bp, mouse
gtgcctttgtaagaatccgt

SEQ ID NO: 666203 - DNA, 20 bp, mouse
gtcccagtgggaagagttct

SEQ ID NO: 666204 - DNA, 20 bp, mouse
gatgggtgaagtcattcaga

SEQ ID NO: 666205 - DNA, 20 bp, mouse
gacagctacgagaaagagaa

SEQ ID NO: 666206 - DNA, 20 bp, mouse
gggtgtccaattttcacatc

SEQ ID NO: 666207 - DNA, 20 bp, mouse
gagagtaggtagcctcatgt

SEQ ID NO: 666208 - DNA, 20 bp, mouse
gcacctgcaatcttaacttt

SEQ ID NO: 666209 - DNA, 20 bp, mouse
gttgaataatatcctctgac

SEQ ID NO: 666210 - DNA, 20 bp, mouse
gctgcaatcttaactttagg

SEQ ID NO: 666211 - DNA, 20 bp, mouse
gtctggctcatagtacagtt

SEQ ID NO: 666212 - DNA, 20 bp, mouse
gaaacctccacaggtccctt

SEQ ID NO: 666213 - DNA, 20 bp, mouse
ggttcagcagttaataccac

SEQ ID NO: 666214 - DNA, 20 bp, mouse
ggtggagtttttcaccaatt

SEQ ID NO: 666215 - DNA, 20 bp, mouse
gtattattcaaccttgtgat

SEQ ID NO: 666216 - DNA, 20 bp, mouse
gagcagaagacacggactca

SEQ ID NO: 666217 - DNA, 20 bp, mouse
gaggcgggcccgggcacact

SEQ ID NO: 666218 - DNA, 20 bp, mouse
gggcaaacgtaccctgtccc

SEQ ID NO: 666219 - DNA, 20 bp, mouse
gactagaagcagagcgatcc

SEQ ID NO: 666220 - DNA, 20 bp, mouse
gaagccccggaggcgggccc

SEQ ID NO: 666221 - DNA, 20 bp, mouse
gtaccctgtccccgggttgc

SEQ ID NO: 666222 - DNA, 20 bp, mouse
gccaaggcaactattctcac

SEQ ID NO: 666223 - DNA, 20 bp, mouse
gaccctgcaacccggggaca

SEQ ID NO: 666224 - DNA, 20 bp, mouse
ggtcgctggcgccacccagt

SEQ ID NO: 666225 - DNA, 20 bp, mouse
gttgcagggttgcaacaacc

SEQ ID NO: 666226 - DNA, 20 bp, mouse
gctgacaggcgacaggggca

SEQ ID NO: 666227 - DNA, 20 bp, mouse
gcgtgtggtgtgagtgtgca

SEQ ID NO: 666228 - DNA, 20 bp, mouse
gacccgcagccaggctagga

SEQ ID NO: 666229 - DNA, 20 bp, mouse
gaagttgggcgaggtagatg

SEQ ID NO: 666230 - DNA, 20 bp, mouse
gtggccaagtgaagtgttgt

SEQ ID NO: 666231 - DNA, 20 bp, mouse
gcaccggaagtgatcaagtt

SEQ ID NO: 666232 - DNA, 20 bp, mouse
gttgcgctgacaggcgacag

SEQ ID NO: 666233 - DNA, 20 bp, mouse
gggcacggggcagaggctca

SEQ ID NO: 666234 - DNA, 20 bp, mouse
gagtgaagtgttgttgggaa

SEQ ID NO: 666235 - DNA, 20 bp, mouse
ggaagtgatcaagttgggcg

SEQ ID NO: 666236 - DNA, 20 bp, mouse
gccgcggaatacagacggtt

SEQ ID NO: 666237 - DNA, 20 bp, mouse
gggaccacaaagttcgggga

SEQ ID NO: 666238 - DNA, 20 bp, mouse
gtgcacgttttggaagtcct

SEQ ID NO: 666239 - DNA, 20 bp, mouse
gccagaggaccacaaagttc

SEQ ID NO: 666240 - DNA, 20 bp, mouse
gggaagctcgggtgctccag

SEQ ID NO: 666241 - DNA, 20 bp, mouse
gtggacgaccaccagattga

SEQ ID NO: 666242 - DNA, 20 bp, mouse
gacaggcaagcaaattctac

SEQ ID NO: 666243 - DNA, 20 bp, mouse
gtggtggactacaggatagc

SEQ ID NO: 666244 - DNA, 20 bp, mouse
gatggaaggcataggctcct

SEQ ID NO: 666245 - DNA, 20 bp, mouse
gcacaaagttcggggatgga

SEQ ID NO: 666246 - DNA, 20 bp, mouse
gcgggaaagtctgggacaca

SEQ ID NO: 666247 - DNA, 20 bp, mouse
ggcgcggcggggagggaata

SEQ ID NO: 666248 - DNA, 20 bp, mouse
gaagtccagccgggaaagtc

SEQ ID NO: 666249 - DNA, 20 bp, mouse
gccggtgcgtgcagattcca

SEQ ID NO: 666250 - DNA, 20 bp, mouse
gccggcccacagctccagac

SEQ ID NO: 666251 - DNA, 20 bp, mouse
gcatcatcagggtcactcta

SEQ ID NO: 666252 - DNA, 20 bp, mouse
ggcggggagggaatatggag

SEQ ID NO: 666253 - DNA, 20 bp, mouse
gtacgggaactaagtccagc

SEQ ID NO: 666254 - DNA, 20 bp, mouse
gtgtcccagactttcccggc

SEQ ID NO: 666255 - DNA, 20 bp, mouse
gcaaggggtgagcgcataca

SEQ ID NO: 666256 - DNA, 20 bp, mouse
gcgggcgggaacagaggtgg

SEQ ID NO: 666257 - DNA, 20 bp, mouse
gagcccgctcctctcaccaa

SEQ ID NO: 666258 - DNA, 20 bp, mouse
ggtgctgatgacgtaggacg

SEQ ID NO: 666259 - DNA, 20 bp, mouse
gcctgcctcgcgcctcgccg

SEQ ID NO: 666260 - DNA, 20 bp, mouse
gccacagggacgtcccagag

SEQ ID NO: 666261 - DNA, 20 bp, mouse
gcgcgtcccgagccccggcg

SEQ ID NO: 666262 - DNA, 20 bp, mouse
gcgcgcggtgctgatgacgt

SEQ ID NO: 666263 - DNA, 20 bp, mouse
gggtccgagccgttggtgag

SEQ ID NO: 666264 - DNA, 20 bp, mouse
gggacgcgcgcggtccgctc

SEQ ID NO: 666265 - DNA, 20 bp, mouse
gacaaggcgggcgggaacag

SEQ ID NO: 666266 - DNA, 20 bp, mouse
gtaacctcactcacttgagg

SEQ ID NO: 666267 - DNA, 20 bp, mouse
ggtggcctctctgttcccga

SEQ ID NO: 666268 - DNA, 20 bp, mouse
gaaccaggcagcttgttgct

SEQ ID NO: 666269 - DNA, 20 bp, mouse
gtcaagtgagtgaggttagc

SEQ ID NO: 666270 - DNA, 20 bp, mouse
gtacccggtaaaggagcaac

SEQ ID NO: 666271 - DNA, 20 bp, mouse
gagattgggtggcagatgga

SEQ ID NO: 666272 - DNA, 20 bp, mouse
ggttcccgagggcacctttc

SEQ ID NO: 666273 - DNA, 20 bp, mouse
ggtcaggctttcattctctg

SEQ ID NO: 666274 - DNA, 20 bp, mouse
gcctggttctgaggcaccca

SEQ ID NO: 666275 - DNA, 20 bp, mouse
gaggttagagggcaaaccgt

SEQ ID NO: 666276 - DNA, 20 bp, mouse
gtgggctatgccccagatgt

SEQ ID NO: 666277 - DNA, 20 bp, mouse
gaatctctgggattgaagct

SEQ ID NO: 666278 - DNA, 20 bp, mouse
gtgcaatcctcccacatctg

SEQ ID NO: 666279 - DNA, 20 bp, mouse
gtgtgggaggattgcacagc

SEQ ID NO: 666280 - DNA, 20 bp, mouse
gcgcatatcagaaccagctg

SEQ ID NO: 666281 - DNA, 20 bp, mouse
gtagggggtggttgggtaca

SEQ ID NO: 666282 - DNA, 20 bp, mouse
ggatagctctaggtagctcc

SEQ ID NO: 666283 - DNA, 20 bp, mouse
gcaaaattttaattcgataa

SEQ ID NO: 666284 - DNA, 20 bp, mouse
gtggaacattcttgatgtat

SEQ ID NO: 666285 - DNA, 20 bp, mouse
gggcttctcttgagtttata

SEQ ID NO: 666286 - DNA, 20 bp, mouse
gaggagctggatcgggtctc

SEQ ID NO: 666287 - DNA, 20 bp, mouse
gtggacaggacgtgggtcct

SEQ ID NO: 666288 - DNA, 20 bp, mouse
gctcctcctaatctcccgtg

SEQ ID NO: 666289 - DNA, 20 bp, mouse
ggctgctgtctgtccctgtc

SEQ ID NO: 666290 - DNA, 20 bp, mouse
gcttaggacacactcctgac

SEQ ID NO: 666291 - DNA, 20 bp, mouse
gagaggatagcttccctttc

SEQ ID NO: 666292 - DNA, 20 bp, mouse
gtcaatattttctttcccgg

SEQ ID NO: 666293 - DNA, 20 bp, mouse
ggcctccaaatttagattag

SEQ ID NO: 666294 - DNA, 20 bp, mouse
gtcctctaatctaaatttgg

SEQ ID NO: 666295 - DNA, 20 bp, mouse
gactgtacccagctgagaag

SEQ ID NO: 666296 - DNA, 20 bp, mouse
gggtgtaagcgtggtcgcat

SEQ ID NO: 666297 - DNA, 20 bp, mouse
gcgcgccgggctgtgatccg

SEQ ID NO: 666298 - DNA, 20 bp, mouse
gcatgggcacccaggaacac

SEQ ID NO: 666299 - DNA, 20 bp, mouse
gctcacctgccggtgttcct

SEQ ID NO: 666300 - DNA, 20 bp, mouse
gcggcaggtgagttttgaac

SEQ ID NO: 666301 - DNA, 20 bp, mouse
ggggtggaggatccctctcc

SEQ ID NO: 666302 - DNA, 20 bp, mouse
gcgtggtcgcatgggcaccc

SEQ ID NO: 666303 - DNA, 20 bp, mouse
gtgcgcccggcaggttcttg

SEQ ID NO: 666304 - DNA, 20 bp, mouse
gcagcgcgcatgcccggaga

SEQ ID NO: 666305 - DNA, 20 bp, mouse
ggatcacagcccggcgcgca

SEQ ID NO: 666306 - DNA, 20 bp, mouse
gaggctgcgtttctcccgta

SEQ ID NO: 666307 - DNA, 20 bp, mouse
gccgacggacggaaccctac

SEQ ID NO: 666308 - DNA, 20 bp, mouse
ggtaacccccagcgtcccct

SEQ ID NO: 666309 - DNA, 20 bp, mouse
ggggtagacgtcactttgat

SEQ ID NO: 666310 - DNA, 20 bp, mouse
gtaaaggtggccatagtcta

SEQ ID NO: 666311 - DNA, 20 bp, mouse
gtgtagcccaggggacgctg

SEQ ID NO: 666312 - DNA, 20 bp, mouse
gcaagtgctctaactagcgg

SEQ ID NO: 666313 - DNA, 20 bp, mouse
gcatccgcgcaaggcgagct

SEQ ID NO: 666314 - DNA, 20 bp, mouse
gcaaagtgacgtctacccga

SEQ ID NO: 666315 - DNA, 20 bp, mouse
ggtgacgtctacccgacgga

SEQ ID NO: 666316 - DNA, 20 bp, mouse
ggcggcaggcacataggcga

SEQ ID NO: 666317 - DNA, 20 bp, mouse
gcaccggagtccagtacgga

SEQ ID NO: 666318 - DNA, 20 bp, mouse
gagggagagaggtgccagaa

SEQ ID NO: 666319 - DNA, 20 bp, mouse
gtaggcgaggggaggcggtc

SEQ ID NO: 666320 - DNA, 20 bp, mouse
gctgggcgcggcaggcacat

SEQ ID NO: 666321 - DNA, 20 bp, mouse
gggtgccagaaaggcggcgg

SEQ ID NO: 666322 - DNA, 20 bp, mouse
gccacagctctgcggcctga

SEQ ID NO: 666323 - DNA, 20 bp, mouse
ggagagaggtgccagaaagg

SEQ ID NO: 666324 - DNA, 20 bp, mouse
gcccactaatcccagatata

SEQ ID NO: 666325 - DNA, 20 bp, mouse
gaaggctgcaccgcacgcag

SEQ ID NO: 666326 - DNA, 20 bp, mouse
gataggtgcggcataagcga

SEQ ID NO: 666327 - DNA, 20 bp, mouse
gcggatggatggggaaccat

SEQ ID NO: 666328 - DNA, 20 bp, mouse
gccaatcaggggccacgcat

SEQ ID NO: 666329 - DNA, 20 bp, mouse
gcaaggagatggacgaggtg

SEQ ID NO: 666330 - DNA, 20 bp, mouse
ggggggtgggacggatggat

SEQ ID NO: 666331 - DNA, 20 bp, mouse
ggaggccgggcgggcgctga

SEQ ID NO: 666332 - DNA, 20 bp, mouse
gcgggcgggcgctgagggta

SEQ ID NO: 666333 - DNA, 20 bp, mouse
gatggatggggaaccatggg

SEQ ID NO: 666334 - DNA, 20 bp, mouse
gaccatgggagggcgatcga

SEQ ID NO: 666335 - DNA, 20 bp, mouse
gaaggctatttggagatcgg

SEQ ID NO: 666336 - DNA, 20 bp, mouse
gggtgggagtggtggagtga

SEQ ID NO: 666337 - DNA, 20 bp, mouse
ggccccgaaggcaggaactt

SEQ ID NO: 666338 - DNA, 20 bp, mouse
gcagacgcagggttgggatg

SEQ ID NO: 666339 - DNA, 20 bp, mouse
ggggagacagacgcagggtt

SEQ ID NO: 666340 - DNA, 20 bp, mouse
gcgagtgttcaccattcaat

SEQ ID NO: 666341 - DNA, 20 bp, mouse
gggagtctgggctctctact

SEQ ID NO: 666342 - DNA, 20 bp, mouse
gacttctctagacttcacaa

SEQ ID NO: 666343 - DNA, 20 bp, mouse
gcgattgtaaaattgggccg

SEQ ID NO: 666344 - DNA, 20 bp, mouse
gcctgccttcggggcctttc

SEQ ID NO: 666345 - DNA, 20 bp, mouse
gctcatcagcagcttttccc

SEQ ID NO: 666346 - DNA, 20 bp, mouse
ggtgacatcacaatcagatg

SEQ ID NO: 666347 - DNA, 20 bp, mouse
gctaaaaagggttgcttcaa

SEQ ID NO: 666348 - DNA, 20 bp, mouse
ggtgatgtcacaatgaccac

SEQ ID NO: 666349 - DNA, 20 bp, mouse
gacaatcagatgaggatcac

SEQ ID NO: 666350 - DNA, 20 bp, mouse
ggttctcaaagtgtggcagt

SEQ ID NO: 666351 - DNA, 20 bp, mouse
gcagatgaggatcacaggaa

SEQ ID NO: 666352 - DNA, 20 bp, mouse
gtgagaactattgcctctga

SEQ ID NO: 666353 - DNA, 20 bp, mouse
gcatagtgatgcaaaaccct

SEQ ID NO: 666354 - DNA, 20 bp, mouse
ggcctggtccgtcttggcgt

SEQ ID NO: 666355 - DNA, 20 bp, mouse
ggaaatagtgacttagtagc

SEQ ID NO: 666356 - DNA, 20 bp, mouse
gcggtccacgagcctctctc

SEQ ID NO: 666357 - DNA, 20 bp, mouse
gccgggcaggcagtgagtga

SEQ ID NO: 666358 - DNA, 20 bp, mouse
gcagtgacgaggctcgtccc

SEQ ID NO: 666359 - DNA, 20 bp, mouse
ggaagtgcgcgtatacacgt

SEQ ID NO: 666360 - DNA, 20 bp, mouse
gaatccggaccgagtcggag

SEQ ID NO: 666361 - DNA, 20 bp, mouse
gtcttaaagtcagggcgggg

SEQ ID NO: 666362 - DNA, 20 bp, mouse
gggggggtggggaacctaag

SEQ ID NO: 666363 - DNA, 20 bp, mouse
gaggctcgtggaccgcgctc

SEQ ID NO: 666364 - DNA, 20 bp, mouse
gccgcgtcgaccaggtccag

SEQ ID NO: 666365 - DNA, 20 bp, mouse
gtgatggggaagttagggtc

SEQ ID NO: 666366 - DNA, 20 bp, mouse
ggggaccctcaggacagctg

SEQ ID NO: 666367 - DNA, 20 bp, mouse
gcactggctcgcactactca

SEQ ID NO: 666368 - DNA, 20 bp, mouse
gggtgtaggtccttgctcac

SEQ ID NO: 666369 - DNA, 20 bp, mouse
gccgaaggaagagacgcttg

SEQ ID NO: 666370 - DNA, 20 bp, mouse
gcctcccccagctgtcctga

SEQ ID NO: 666371 - DNA, 20 bp, mouse
ggaacctgcaagtcgtgggt

SEQ ID NO: 666372 - DNA, 20 bp, mouse
ggtaacgtggcccgcgctgt

SEQ ID NO: 666373 - DNA, 20 bp, mouse
gggtcccggtgcaccctgag

SEQ ID NO: 666374 - DNA, 20 bp, mouse
gacctgtgcgctggtaccga

SEQ ID NO: 666375 - DNA, 20 bp, mouse
gagcaaggacctacacctac

SEQ ID NO: 666376 - DNA, 20 bp, mouse
gtgcccgggcatgatgaagg

SEQ ID NO: 666377 - DNA, 20 bp, mouse
ggtggggtgctgtgcgtcgg

SEQ ID NO: 666378 - DNA, 20 bp, mouse
gaaactaacggcgtttgggg

SEQ ID NO: 666379 - DNA, 20 bp, mouse
gagcatcgggttgctaatga

SEQ ID NO: 666380 - DNA, 20 bp, mouse
gagaggaaaggcaaccgccc

SEQ ID NO: 666381 - DNA, 20 bp, mouse
gaagcgctgagtagtgtttt

SEQ ID NO: 666382 - DNA, 20 bp, mouse
gccgaagcccggacgccata

SEQ ID NO: 666383 - DNA, 20 bp, mouse
gtggcgctcaatgtcaccaa

SEQ ID NO: 666384 - DNA, 20 bp, mouse
gggacgtgcgcgacgagcgg

SEQ ID NO: 666385 - DNA, 20 bp, mouse
gccaagggcccgcgtgggga

SEQ ID NO: 666386 - DNA, 20 bp, mouse
gaggatgagcgtcatggcgg

SEQ ID NO: 666387 - DNA, 20 bp, mouse
gtgggcaggtccggggtcct

SEQ ID NO: 666388 - DNA, 20 bp, mouse
ggcttccggcggggaagaga

SEQ ID NO: 666389 - DNA, 20 bp, mouse
gccatgacgctcatcctccg

SEQ ID NO: 666390 - DNA, 20 bp, mouse
gtgcgcgctggaaatggcca

SEQ ID NO: 666391 - DNA, 20 bp, mouse
ggctgcaggtggcgccaaca

SEQ ID NO: 666392 - DNA, 20 bp, mouse
gccgccagcacgctctcagg

SEQ ID NO: 666393 - DNA, 20 bp, mouse
gagctcctgccagaccgact

SEQ ID NO: 666394 - DNA, 20 bp, mouse
ggcctgagccgcttccggcg

SEQ ID NO: 666395 - DNA, 20 bp, mouse
gcctcagcctgagccgcttc

SEQ ID NO: 666396 - DNA, 20 bp, mouse
gcacgtgctcccgccccgga

SEQ ID NO: 666397 - DNA, 20 bp, mouse
gcgcgcgtggatctccccca

SEQ ID NO: 666398 - DNA, 20 bp, mouse
gcgtggggtccgcctttctc

SEQ ID NO: 666399 - DNA, 20 bp, mouse
gtcgggcagtactgcagcgc

SEQ ID NO: 666400 - DNA, 20 bp, mouse
ggcggcggcggagaaagaga

SEQ ID NO: 666401 - DNA, 20 bp, mouse
ggcagaccgcgcttggggct

SEQ ID NO: 666402 - DNA, 20 bp, mouse
gctggggcccggggacgcag

SEQ ID NO: 666403 - DNA, 20 bp, mouse
gcggggcgggagcacgtgcg

SEQ ID NO: 666404 - DNA, 20 bp, mouse
ggtctgcacggggcaccctg

SEQ ID NO: 666405 - DNA, 20 bp, mouse
gcccaagcgcggtctgcacg

SEQ ID NO: 666406 - DNA, 20 bp, mouse
gcgcgcagacgcttcctcct

SEQ ID NO: 666407 - DNA, 20 bp, mouse
gcttctgggttgctggaaag

SEQ ID NO: 666408 - DNA, 20 bp, mouse
gcctcctcggccaggattgg

SEQ ID NO: 666409 - DNA, 20 bp, mouse
gacctggaccggaattcttc

SEQ ID NO: 666410 - DNA, 20 bp, mouse
gtctccaccaatcctggccg

SEQ ID NO: 666411 - DNA, 20 bp, mouse
gaggcgagtagagagaagac

SEQ ID NO: 666412 - DNA, 20 bp, mouse
ggccaggattggtggagacc

SEQ ID NO: 666413 - DNA, 20 bp, mouse
gcgaaagagtttggacaatg

SEQ ID NO: 666414 - DNA, 20 bp, mouse
gaggtgaaaccgactttgaa

SEQ ID NO: 666415 - DNA, 20 bp, mouse
ggattggtggagacctggac

SEQ ID NO: 666416 - DNA, 20 bp, mouse
gacgtgtggggagacctccg

SEQ ID NO: 666417 - DNA, 20 bp, mouse
gaagtgagaaggccggatgt

SEQ ID NO: 666418 - DNA, 20 bp, mouse
gggcggagctgaaacttcgg

SEQ ID NO: 666419 - DNA, 20 bp, mouse
ggggggcgggacagagtgac

SEQ ID NO: 666420 - DNA, 20 bp, mouse
gaacagactgtaaacctcgg

SEQ ID NO: 666421 - DNA, 20 bp, mouse
gggaaggcgggttctcccat

SEQ ID NO: 666422 - DNA, 20 bp, mouse
gaggcgttactaacacgtgt

SEQ ID NO: 666423 - DNA, 20 bp, mouse
gtgagaaggccggatgtggg

SEQ ID NO: 666424 - DNA, 20 bp, mouse
gcaggcctcgcccacagaga

SEQ ID NO: 666425 - DNA, 20 bp, mouse
gcactctgtcccgcccccat

SEQ ID NO: 666426 - DNA, 20 bp, mouse
ggaagccttcggcccctcta

SEQ ID NO: 666427 - DNA, 20 bp, mouse
gccggcgtgggaatgaatat

SEQ ID NO: 666428 - DNA, 20 bp, mouse
gggaaccttagaggggccga

SEQ ID NO: 666429 - DNA, 20 bp, mouse
ggacgctctgggaaccttag

SEQ ID NO: 666430 - DNA, 20 bp, mouse
gggccgaaggcttccggcgt

SEQ ID NO: 666431 - DNA, 20 bp, mouse
gcgcgcatgcgtagctctga

SEQ ID NO: 666432 - DNA, 20 bp, mouse
ggatcctgggtccctccctg

SEQ ID NO: 666433 - DNA, 20 bp, mouse
gggagggacccaggatcact

SEQ ID NO: 666434 - DNA, 20 bp, mouse
gtagtctgaagaaccgggcc

SEQ ID NO: 666435 - DNA, 20 bp, mouse
gtctgagggcgcgccgtcct

SEQ ID NO: 666436 - DNA, 20 bp, mouse
ggaagctggcttggtggcca

SEQ ID NO: 666437 - DNA, 20 bp, mouse
gtggccaaggtgtttgacac

SEQ ID NO: 666438 - DNA, 20 bp, mouse
ggacagggcaacgcattcct

SEQ ID NO: 666439 - DNA, 20 bp, mouse
gagaacccgcattttaccag

SEQ ID NO: 666440 - DNA, 20 bp, mouse
gcggcgactcgcgttctcta

SEQ ID NO: 666441 - DNA, 20 bp, mouse
gcacaaaggcgcgggttcca

SEQ ID NO: 666442 - DNA, 20 bp, mouse
gtgccctgtgtcaaacacct

SEQ ID NO: 666443 - DNA, 20 bp, mouse
ggagagtagtaacccaggga

SEQ ID NO: 666444 - DNA, 20 bp, mouse
ggaaagagagtagtaaccca

SEQ ID NO: 666445 - DNA, 20 bp, mouse
ggtaaaatgcgggttctccg

SEQ ID NO: 666446 - DNA, 20 bp, mouse
gggccggcgcctcacgggga

SEQ ID NO: 666447 - DNA, 20 bp, mouse
gcgcccgggacgcggacgac

SEQ ID NO: 666448 - DNA, 20 bp, mouse
gagaaggggagattgaagag

SEQ ID NO: 666449 - DNA, 20 bp, mouse
ggggaggagaagccgcgcta

SEQ ID NO: 666450 - DNA, 20 bp, mouse
gcaacagggcggctgaaccc

SEQ ID NO: 666451 - DNA, 20 bp, mouse
gagggctcgcggggacccgg

SEQ ID NO: 666452 - DNA, 20 bp, mouse
gctggcgcgcgcccgggacg

SEQ ID NO: 666453 - DNA, 20 bp, mouse
gggcggctgaaccccggccg

SEQ ID NO: 666454 - DNA, 20 bp, mouse
ggcgccgcgcccagggctcg

SEQ ID NO: 666455 - DNA, 20 bp, mouse
gacgagcgacgcagcgacag

SEQ ID NO: 666456 - DNA, 20 bp, mouse
gaatggctaggcactgtcaa

SEQ ID NO: 666457 - DNA, 20 bp, mouse
gtgggacgccccctggtggt

SEQ ID NO: 666458 - DNA, 20 bp, mouse
gcggtgccgcgggaggggtt

SEQ ID NO: 666459 - DNA, 20 bp, mouse
ggtaccccaaacaaagccgg

SEQ ID NO: 666460 - DNA, 20 bp, mouse
gcaagcttgcacaggtgagg

SEQ ID NO: 666461 - DNA, 20 bp, mouse
gcgccccctggtggtgggaa

SEQ ID NO: 666462 - DNA, 20 bp, mouse
ggggttgggacgccccctgg

SEQ ID NO: 666463 - DNA, 20 bp, mouse
gggcgtcccaacccctcccg

SEQ ID NO: 666464 - DNA, 20 bp, mouse
gctgtagatctgcacatagt

SEQ ID NO: 666465 - DNA, 20 bp, mouse
gcctggtggtgggaatggct

SEQ ID NO: 666466 - DNA, 20 bp, mouse
gagaccgcggggtgagaaat

SEQ ID NO: 666467 - DNA, 20 bp, mouse
gcggtcctccggcatgcagg

SEQ ID NO: 666468 - DNA, 20 bp, mouse
gacacacacgtggacaaacc

SEQ ID NO: 666469 - DNA, 20 bp, mouse
gcgcggggtgagaaataggg

SEQ ID NO: 666470 - DNA, 20 bp, mouse
gagcgccccctgcatgccgg

SEQ ID NO: 666471 - DNA, 20 bp, mouse
gggaccttcgctaagaccgc

SEQ ID NO: 666472 - DNA, 20 bp, mouse
gtacttaaaagaactgactg

SEQ ID NO: 666473 - DNA, 20 bp, mouse
gagaactgactgcggtcctc

SEQ ID NO: 666474 - DNA, 20 bp, mouse
gcaccccgcggtcttagcga

SEQ ID NO: 666475 - DNA, 20 bp, mouse
ggaggtactgccaagcccaa

SEQ ID NO: 666476 - DNA, 20 bp, mouse
gactctagatccctctccgg

SEQ ID NO: 666477 - DNA, 20 bp, mouse
gccctctccgggggcgtctg

SEQ ID NO: 666478 - DNA, 20 bp, mouse
gagggatctagagtccgggg

SEQ ID NO: 666479 - DNA, 20 bp, mouse
gcggactctagatccctctc

SEQ ID NO: 666480 - DNA, 20 bp, mouse
gcaaggcggctccccaaggt

SEQ ID NO: 666481 - DNA, 20 bp, mouse
gcgtgcttcccacaccttac

SEQ ID NO: 666482 - DNA, 20 bp, mouse
ggaaacctccattagagcca

SEQ ID NO: 666483 - DNA, 20 bp, mouse
gaagaaaccgcagacgcccc

SEQ ID NO: 666484 - DNA, 20 bp, mouse
ggccgccttggctctaatgg

SEQ ID NO: 666485 - DNA, 20 bp, mouse
gaccgcagacgcccccggag

SEQ ID NO: 666486 - DNA, 20 bp, mouse
gaaggacgcagcgaactgtg

SEQ ID NO: 666487 - DNA, 20 bp, mouse
gtcccagctggaagttacta

SEQ ID NO: 666488 - DNA, 20 bp, mouse
gggttgaggcccagtctctg

SEQ ID NO: 666489 - DNA, 20 bp, mouse
gtaggtggatcaggctgtat

SEQ ID NO: 666490 - DNA, 20 bp, mouse
gaggaagagaggggtttaaa

SEQ ID NO: 666491 - DNA, 20 bp, mouse
gggtgctaatacagtgacag

SEQ ID NO: 666492 - DNA, 20 bp, mouse
gacagcctgatccacctaac

SEQ ID NO: 666493 - DNA, 20 bp, mouse
gttccagctgggaattggtt

SEQ ID NO: 666494 - DNA, 20 bp, mouse
gcaggctgtattggggacaa

SEQ ID NO: 666495 - DNA, 20 bp, mouse
gagttaccgaggacccgggt

SEQ ID NO: 666496 - DNA, 20 bp, mouse
gggcgcctgtcccaggagaa

SEQ ID NO: 666497 - DNA, 20 bp, mouse
ggctctggctcagtagtcta

SEQ ID NO: 666498 - DNA, 20 bp, mouse
gaaaggatctagctgaggac

SEQ ID NO: 666499 - DNA, 20 bp, mouse
gaagaccagacaccgcccta

SEQ ID NO: 666500 - DNA, 20 bp, mouse
gaggctcctccccgaggtcg

SEQ ID NO: 666501 - DNA, 20 bp, mouse
gaggagaaaggatctagctg

SEQ ID NO: 666502 - DNA, 20 bp, mouse
gagatcctttctcctgggac

SEQ ID NO: 666503 - DNA, 20 bp, mouse
gagccagaggctcctccccg

SEQ ID NO: 666504 - DNA, 20 bp, mouse
gtcctgggacaggcgcctta

SEQ ID NO: 666505 - DNA, 20 bp, mouse
gtgggacaggcgccttaggg

SEQ ID NO: 666506 - DNA, 20 bp, mouse
ggaaccatctgtggctcctg

SEQ ID NO: 666507 - DNA, 20 bp, mouse
gccccggcctcaggtacttc

SEQ ID NO: 666508 - DNA, 20 bp, mouse
gcggggcaggagagatcccc

SEQ ID NO: 666509 - DNA, 20 bp, mouse
gggagccacagatggttctc

SEQ ID NO: 666510 - DNA, 20 bp, mouse
gtggctcaaagatgcctgtc

SEQ ID NO: 666511 - DNA, 20 bp, mouse
ggcctcaggtacttctggcg

SEQ ID NO: 666512 - DNA, 20 bp, mouse
gctgatgagaaagagctgag

SEQ ID NO: 666513 - DNA, 20 bp, mouse
ggagttgaaccatagttccc

SEQ ID NO: 666514 - DNA, 20 bp, mouse
gcaactccagacacccacat

SEQ ID NO: 666515 - DNA, 20 bp, mouse
gtcaccctcagtgccttcag

SEQ ID NO: 666516 - DNA, 20 bp, mouse
gtaaaggagagacgtaacat

SEQ ID NO: 666517 - DNA, 20 bp, mouse
gtggtgtctcagcattcagt

SEQ ID NO: 666518 - DNA, 20 bp, mouse
gtgttataatatacatggtg

SEQ ID NO: 666519 - DNA, 20 bp, mouse
gctagggcacaaagagctgg

SEQ ID NO: 666520 - DNA, 20 bp, mouse
ggagtcaagtgtgggtgcca

SEQ ID NO: 666521 - DNA, 20 bp, mouse
ggctacaaggagtcaagtgt

SEQ ID NO: 666522 - DNA, 20 bp, mouse
gctacagggcgtggcgcgtg

SEQ ID NO: 666523 - DNA, 20 bp, mouse
gcttgtagctgtagctgcta

SEQ ID NO: 666524 - DNA, 20 bp, mouse
gtctaggcttccatgatccg

SEQ ID NO: 666525 - DNA, 20 bp, mouse
gcaagccaacagagagcttg

SEQ ID NO: 666526 - DNA, 20 bp, mouse
gggtttggggaggggactaa

SEQ ID NO: 666527 - DNA, 20 bp, mouse
gagcctctcactcagactca

SEQ ID NO: 666528 - DNA, 20 bp, mouse
gcaagctatctaggggtttg

SEQ ID NO: 666529 - DNA, 20 bp, mouse
ggtgcctagcgatgacagac

SEQ ID NO: 666530 - DNA, 20 bp, mouse
gaagtctggaaggattggct

SEQ ID NO: 666531 - DNA, 20 bp, mouse
ggttagttcaagctatctag

SEQ ID NO: 666532 - DNA, 20 bp, mouse
gctccttacctaagtctgga

SEQ ID NO: 666533 - DNA, 20 bp, mouse
gcttcccaaagattctgtag

SEQ ID NO: 666534 - DNA, 20 bp, mouse
ggcatctccttacctaagtc

SEQ ID NO: 666535 - DNA, 20 bp, mouse
gatgctttgtctagaatctt

SEQ ID NO: 666536 - DNA, 20 bp, mouse
ggcaggttgagtacttcgga

SEQ ID NO: 666537 - DNA, 20 bp, mouse
gctcccatactggatcagat

SEQ ID NO: 666538 - DNA, 20 bp, mouse
gcggagcaggttgagtactt

SEQ ID NO: 666539 - DNA, 20 bp, mouse
gcatagaaggcaaaagtcac

SEQ ID NO: 666540 - DNA, 20 bp, mouse
gggagagttctaggggtcaa

SEQ ID NO: 666541 - DNA, 20 bp, mouse
ggggtcaagggtcaccaggc

SEQ ID NO: 666542 - DNA, 20 bp, mouse
gctggagggggtggcctcgg

SEQ ID NO: 666543 - DNA, 20 bp, mouse
gcggaagcacggtgtacttc

SEQ ID NO: 666544 - DNA, 20 bp, mouse
gtccgcccccagacttgggg

SEQ ID NO: 666545 - DNA, 20 bp, mouse
gtgctccgcccccagacttg

SEQ ID NO: 666546 - DNA, 20 bp, mouse
gcaccccggggctttgtcat

SEQ ID NO: 666547 - DNA, 20 bp, mouse
gtgaggggcggggactgatg

SEQ ID NO: 666548 - DNA, 20 bp, mouse
gcactcggagagcacccaat

SEQ ID NO: 666549 - DNA, 20 bp, mouse
gtcggagagcacccaatggg

SEQ ID NO: 666550 - DNA, 20 bp, mouse
gccgtccaatgacaaagccc

SEQ ID NO: 666551 - DNA, 20 bp, mouse
ggcggcgggcgcccaccccg

SEQ ID NO: 666552 - DNA, 20 bp, mouse
gtgggaggcggggactaagg

SEQ ID NO: 666553 - DNA, 20 bp, mouse
gccgtgggaggcggggacta

SEQ ID NO: 666554 - DNA, 20 bp, mouse
gaaaggctgagggcgaaagg

SEQ ID NO: 666555 - DNA, 20 bp, mouse
gccgcccctccccctcgggg

SEQ ID NO: 666556 - DNA, 20 bp, mouse
gataatacgcagggcggcag

SEQ ID NO: 666557 - DNA, 20 bp, mouse
gatacgcagggcggcagtgg

SEQ ID NO: 666558 - DNA, 20 bp, mouse
gccgcctccaaataatacgc

SEQ ID NO: 666559 - DNA, 20 bp, mouse
gaggcagatctccgttttcg

SEQ ID NO: 666560 - DNA, 20 bp, mouse
ggtgagtttcataacaaaca

SEQ ID NO: 666561 - DNA, 20 bp, mouse
ggaaaaccggaagcgccttt

SEQ ID NO: 666562 - DNA, 20 bp, mouse
gctccaaataatacgcaggg

SEQ ID NO: 666563 - DNA, 20 bp, mouse
ggaacgctgtaagaataaga

SEQ ID NO: 666564 - DNA, 20 bp, mouse
gccaaccagtgttattgatt

SEQ ID NO: 666565 - DNA, 20 bp, mouse
gggatgtaggtacaggtagg

SEQ ID NO: 666566 - DNA, 20 bp, mouse
ggagaccggacgtcgagtgc

SEQ ID NO: 666567 - DNA, 20 bp, mouse
gcgctggaagccggggaaat

SEQ ID NO: 666568 - DNA, 20 bp, mouse
ggagaccagcactcgacgtc

SEQ ID NO: 666569 - DNA, 20 bp, mouse
gccagactcttgaactggtc

SEQ ID NO: 666570 - DNA, 20 bp, mouse
gcggggaaatgggaagatcc

SEQ ID NO: 666571 - DNA, 20 bp, mouse
gttccagcgcttaagatccc

SEQ ID NO: 666572 - DNA, 20 bp, mouse
gcggcgcgccccgccctctc

SEQ ID NO: 666573 - DNA, 20 bp, mouse
gctcataagaactactgttc

SEQ ID NO: 666574 - DNA, 20 bp, mouse
gtgtgcggtgcgtgtgcctg

SEQ ID NO: 666575 - DNA, 20 bp, mouse
gtagcacccacatgagaagt

SEQ ID NO: 666576 - DNA, 20 bp, mouse
ggtgaggcgcaaggcaagat

SEQ ID NO: 666577 - DNA, 20 bp, mouse
gctcaccggcagaggttcct

SEQ ID NO: 666578 - DNA, 20 bp, mouse
gacagaatgcgtgtggaggg

SEQ ID NO: 666579 - DNA, 20 bp, mouse
ggggggaggtaagtatccct

SEQ ID NO: 666580 - DNA, 20 bp, mouse
gaagacagaatgcgtgtgga

SEQ ID NO: 666581 - DNA, 20 bp, mouse
ggggtgaacaaccgtcctat

SEQ ID NO: 666582 - DNA, 20 bp, mouse
gcaagatgggaagtactgct

SEQ ID NO: 666583 - DNA, 20 bp, mouse
gccttgcgcctcaccggcag

SEQ ID NO: 666584 - DNA, 20 bp, mouse
gcgcaaagacagaatgcgtg

SEQ ID NO: 666585 - DNA, 20 bp, mouse
gaggttgcacaccaatagga

SEQ ID NO: 666586 - DNA, 20 bp, mouse
gccagtgcggggacgtgaga

SEQ ID NO: 666587 - DNA, 20 bp, mouse
ggaggtgcacaagcgaggaa

SEQ ID NO: 666588 - DNA, 20 bp, mouse
gatgcgctgcggccccagtg

SEQ ID NO: 666589 - DNA, 20 bp, mouse
gcggggacgtgagagggctt

SEQ ID NO: 666590 - DNA, 20 bp, mouse
gggcctgaggtgcacaagcg

SEQ ID NO: 666591 - DNA, 20 bp, mouse
gcgaggaaaggcttggctga

SEQ ID NO: 666592 - DNA, 20 bp, mouse
gggcccggggggctacgcgg

SEQ ID NO: 666593 - DNA, 20 bp, mouse
gagcggctggcgctcctgtg

SEQ ID NO: 666594 - DNA, 20 bp, mouse
ggacgagaacgagtcctcac

SEQ ID NO: 666595 - DNA, 20 bp, mouse
gcaaacgagcggagggagag

SEQ ID NO: 666596 - DNA, 20 bp, mouse
ggcaaggcagtgtagtggtt

SEQ ID NO: 666597 - DNA, 20 bp, mouse
gttgcaggccggctggatca

SEQ ID NO: 666598 - DNA, 20 bp, mouse
gactacctctcctgcctaca

SEQ ID NO: 666599 - DNA, 20 bp, mouse
ggtgtagtggttaggaagag

SEQ ID NO: 666600 - DNA, 20 bp, mouse
gatcaaggagtgcatgacag

SEQ ID NO: 666601 - DNA, 20 bp, mouse
gacactatttgtctttatat

SEQ ID NO: 666602 - DNA, 20 bp, mouse
gctctcctgcctacacggaa

SEQ ID NO: 666603 - DNA, 20 bp, mouse
gctgcctacacggaagggca

SEQ ID NO: 666604 - DNA, 20 bp, mouse
gatgcactccttgatccagc

SEQ ID NO: 666605 - DNA, 20 bp, mouse
gggaaggttgagaacaccac

SEQ ID NO: 666606 - DNA, 20 bp, mouse
ggggcagaaggtgatcagtg

SEQ ID NO: 666607 - DNA, 20 bp, mouse
gggagaaagtgacatgatga

SEQ ID NO: 666608 - DNA, 20 bp, mouse
ggggatgccaggttttagat

SEQ ID NO: 666609 - DNA, 20 bp, mouse
ggcgtcaggcaaggtcaagg

SEQ ID NO: 666610 - DNA, 20 bp, mouse
gtaggacttgcgtctcggaa

SEQ ID NO: 666611 - DNA, 20 bp, mouse
ggatggctctacagctgcga

SEQ ID NO: 666612 - DNA, 20 bp, mouse
ggcagctgtagagccatcag

SEQ ID NO: 666613 - DNA, 20 bp, mouse
gcagccaggctcacatccgc

SEQ ID NO: 666614 - DNA, 20 bp, mouse
gcatctcccaacactcccat

SEQ ID NO: 666615 - DNA, 20 bp, mouse
gagagccatcagtgggcaga

SEQ ID NO: 666616 - DNA, 20 bp, mouse
gtggctgctagtcttgggga

SEQ ID NO: 666617 - DNA, 20 bp, mouse
gagaagcgatcggagctcgt

SEQ ID NO: 666618 - DNA, 20 bp, mouse
gtgaagagaaaattgtaggg

SEQ ID NO: 666619 - DNA, 20 bp, mouse
gtgcttgctacaactccgag

SEQ ID NO: 666620 - DNA, 20 bp, mouse
gcacttggctgctagtcttg

SEQ ID NO: 666621 - DNA, 20 bp, mouse
gagctcgtgggaccccaact

SEQ ID NO: 666622 - DNA, 20 bp, mouse
gtcaggaaacaagtccaagt

SEQ ID NO: 666623 - DNA, 20 bp, mouse
gtgggaccccaacttggagc

SEQ ID NO: 666624 - DNA, 20 bp, mouse
gtgaccttgcgctcagtctg

SEQ ID NO: 666625 - DNA, 20 bp, mouse
gccagcgtggacgctcgagt

SEQ ID NO: 666626 - DNA, 20 bp, mouse
gcccatggctcggtatggaa

SEQ ID NO: 666627 - DNA, 20 bp, mouse
gagccctgacatttctggga

SEQ ID NO: 666628 - DNA, 20 bp, mouse
gaagtgagcagctgtctcta

SEQ ID NO: 666629 - DNA, 20 bp, mouse
ggaagtagccctgacatttc

SEQ ID NO: 666630 - DNA, 20 bp, mouse
gagagtctgtgaacctggag

SEQ ID NO: 666631 - DNA, 20 bp, mouse
gcagatgaggaaaaaataga

SEQ ID NO: 666632 - DNA, 20 bp, mouse
gaaggtcccgccccatggct

SEQ ID NO: 666633 - DNA, 20 bp, mouse
gcatggagagtctgtgaacc

SEQ ID NO: 666634 - DNA, 20 bp, mouse
gtccatgtactgagagggga

SEQ ID NO: 666635 - DNA, 20 bp, mouse
gagaagcctgaatgtgaaaa

SEQ ID NO: 666636 - DNA, 20 bp, mouse
gtgctggccgacagcgatgt

SEQ ID NO: 666637 - DNA, 20 bp, mouse
gctacagatcagattctctt

SEQ ID NO: 666638 - DNA, 20 bp, mouse
gatccagagcaaatggtggt

SEQ ID NO: 666639 - DNA, 20 bp, mouse
ggctctggatgattacaata

SEQ ID NO: 666640 - DNA, 20 bp, mouse
gaaggctcgctcggttgcta

SEQ ID NO: 666641 - DNA, 20 bp, mouse
gtgagaagacctggccttga

SEQ ID NO: 666642 - DNA, 20 bp, mouse
gttgtggtgggagagcgtgc

SEQ ID NO: 666643 - DNA, 20 bp, mouse
gaatgacattctaaagtggc

SEQ ID NO: 666644 - DNA, 20 bp, mouse
ggaagacctggccttgaagg

SEQ ID NO: 666645 - DNA, 20 bp, mouse
gtcagatccgacatcgctgt

SEQ ID NO: 666646 - DNA, 20 bp, mouse
gaccctgttccggggcggga

SEQ ID NO: 666647 - DNA, 20 bp, mouse
gaacggagcggggtgagaca

SEQ ID NO: 666648 - DNA, 20 bp, mouse
gtgaggaagcgggaacggag

SEQ ID NO: 666649 - DNA, 20 bp, mouse
ggaaggaggcgggagcggaa

SEQ ID NO: 666650 - DNA, 20 bp, mouse
ggagcggggtgagacagggg

SEQ ID NO: 666651 - DNA, 20 bp, mouse
gctctgaccctgttccgggg

SEQ ID NO: 666652 - DNA, 20 bp, mouse
gctccttcccgccccggaac

SEQ ID NO: 666653 - DNA, 20 bp, mouse
gcctgggcgtaattcttaac

SEQ ID NO: 666654 - DNA, 20 bp, mouse
gcaagtctacgattgatgac

SEQ ID NO: 666655 - DNA, 20 bp, mouse
gagacaggggcggggcgggt

SEQ ID NO: 666656 - DNA, 20 bp, mouse
gagggcgtgtccgctgtagt

SEQ ID NO: 666657 - DNA, 20 bp, mouse
ggacccggatggggttggaa

SEQ ID NO: 666658 - DNA, 20 bp, mouse
gagcgggaagtgacccggat

SEQ ID NO: 666659 - DNA, 20 bp, mouse
gaaaacgctggagacgatac

SEQ ID NO: 666660 - DNA, 20 bp, mouse
gggttcctataaagttttgg

SEQ ID NO: 666661 - DNA, 20 bp, mouse
ggaagtgacccggatggggt

SEQ ID NO: 666662 - DNA, 20 bp, mouse
gccggatggggttggaaggg

SEQ ID NO: 666663 - DNA, 20 bp, mouse
gggagtgcatgcagaggtta

SEQ ID NO: 666664 - DNA, 20 bp, mouse
ggctccgagggaaaaaccag

SEQ ID NO: 666665 - DNA, 20 bp, mouse
gaaaacagcgggaagtgacc

SEQ ID NO: 666666 - DNA, 20 bp, mouse
gcaagctgccgggttttctg

SEQ ID NO: 666667 - DNA, 20 bp, mouse
gcacgcacccgcagaaaacc

SEQ ID NO: 666668 - DNA, 20 bp, mouse
gtctgcgggtgcgtgggagg

SEQ ID NO: 666669 - DNA, 20 bp, mouse
gatagcgcctactgcctcta

SEQ ID NO: 666670 - DNA, 20 bp, mouse
gcctgaaagtgtgcgatctg

SEQ ID NO: 666671 - DNA, 20 bp, mouse
gttttctgcgggtgcgtggg

SEQ ID NO: 666672 - DNA, 20 bp, mouse
gaggtctcagggaagctgga

SEQ ID NO: 666673 - DNA, 20 bp, mouse
gtgcgatctgaggtcctaac

SEQ ID NO: 666674 - DNA, 20 bp, mouse
gtgcgcggaatattcactcc

SEQ ID NO: 666675 - DNA, 20 bp, mouse
gccgccccgtccggcccgga

SEQ ID NO: 666676 - DNA, 20 bp, mouse
gcgcgccaccaagtgactat

SEQ ID NO: 666677 - DNA, 20 bp, mouse
gagtcagactagttcaggag

SEQ ID NO: 666678 - DNA, 20 bp, mouse
ggtgccgccagggcgttgag

SEQ ID NO: 666679 - DNA, 20 bp, mouse
gagagcacagggatgcgggt

SEQ ID NO: 666680 - DNA, 20 bp, mouse
gacagcctatagtcacttgg

SEQ ID NO: 666681 - DNA, 20 bp, mouse
gtggggctggagtcaagagc

SEQ ID NO: 666682 - DNA, 20 bp, mouse
gaggagctcagggtccggtt

SEQ ID NO: 666683 - DNA, 20 bp, mouse
gtctgacttgcagagatgga

SEQ ID NO: 666684 - DNA, 20 bp, mouse
ggggcagctgagtgccattc

SEQ ID NO: 666685 - DNA, 20 bp, mouse
gagcgcggttcccagagcac

SEQ ID NO: 666686 - DNA, 20 bp, mouse
ggtgacacccaggtccggag

SEQ ID NO: 666687 - DNA, 20 bp, mouse
gaaaagagagctacaggctt

SEQ ID NO: 666688 - DNA, 20 bp, mouse
ggggtcgtgacacccaggtc

SEQ ID NO: 666689 - DNA, 20 bp, mouse
gggcgagaaaagagagctac

SEQ ID NO: 666690 - DNA, 20 bp, mouse
gttctcgcccactccggacc

SEQ ID NO: 666691 - DNA, 20 bp, mouse
gcggagtgggaaggagtcaa

SEQ ID NO: 666692 - DNA, 20 bp, mouse
gagaaggtctctactgtttg

SEQ ID NO: 666693 - DNA, 20 bp, mouse
ggagatgaccatagaaggaa

SEQ ID NO: 666694 - DNA, 20 bp, mouse
gctggggtgggcacgaggca

SEQ ID NO: 666695 - DNA, 20 bp, mouse
gcgggacttgaaggcgttac

SEQ ID NO: 666696 - DNA, 20 bp, mouse
gcgggccggcgcaccgcgta

SEQ ID NO: 666697 - DNA, 20 bp, mouse
ggcaccgcgtagggggacct

SEQ ID NO: 666698 - DNA, 20 bp, mouse
gctgccccgcccaccccggg

SEQ ID NO: 666699 - DNA, 20 bp, mouse
gccgcgtagggggacctcgg

SEQ ID NO: 666700 - DNA, 20 bp, mouse
gcggaggcgtggcccaacgg

SEQ ID NO: 666701 - DNA, 20 bp, mouse
ggggaccggtgggaaaggta

SEQ ID NO: 666702 - DNA, 20 bp, mouse
gcgcggggaggctgaaaaga

SEQ ID NO: 666703 - DNA, 20 bp, mouse
gctgaccgcctccctttcgg

SEQ ID NO: 666704 - DNA, 20 bp, mouse
gttgggccacgcctccgaaa

SEQ ID NO: 666705 - DNA, 20 bp, mouse
gcccaccccgggcggagagg

SEQ ID NO: 666706 - DNA, 20 bp, mouse
gcggggatgaagtcggtccc

SEQ ID NO: 666707 - DNA, 20 bp, mouse
gaagtcggtcccgggaggct

SEQ ID NO: 666708 - DNA, 20 bp, mouse
gggatgaagtcggtcccggg

SEQ ID NO: 666709 - DNA, 20 bp, mouse
ggcggagccggggatgaagt

SEQ ID NO: 666710 - DNA, 20 bp, mouse
gcgggcaggaagcgcacttg

SEQ ID NO: 666711 - DNA, 20 bp, mouse
gtctactaagcccagcctcc

SEQ ID NO: 666712 - DNA, 20 bp, mouse
gagagagacccgtgggtagg

SEQ ID NO: 666713 - DNA, 20 bp, mouse
gttgcggtagagagacccgt

SEQ ID NO: 666714 - DNA, 20 bp, mouse
gggtagagagacccgtgggt

SEQ ID NO: 666715 - DNA, 20 bp, mouse
gcgagttcttgcaaggggat

SEQ ID NO: 666716 - DNA, 20 bp, mouse
gaggccgcaccgaaccggta

SEQ ID NO: 666717 - DNA, 20 bp, mouse
gccacaaagtagagttgtgt

SEQ ID NO: 666718 - DNA, 20 bp, mouse
gaggatggcttcgaagtcgg

SEQ ID NO: 666719 - DNA, 20 bp, mouse
gtctctggaccctaccggtt

SEQ ID NO: 666720 - DNA, 20 bp, mouse
ggggagcgcacgcgccaagg

SEQ ID NO: 666721 - DNA, 20 bp, mouse
gctagggagcgcacgcgcca

SEQ ID NO: 666722 - DNA, 20 bp, mouse
ggctaggatggcttcgaagt

SEQ ID NO: 666723 - DNA, 20 bp, mouse
gggaccctaccggttcggtg

SEQ ID NO: 666724 - DNA, 20 bp, mouse
gtgcctaggccgcaccgaac

SEQ ID NO: 666725 - DNA, 20 bp, mouse
gcaactctactttgtgggat

SEQ ID NO: 666726 - DNA, 20 bp, mouse
gcgggagggcggggagtcgg

SEQ ID NO: 666727 - DNA, 20 bp, mouse
gcagaggtagaggcgcggga

SEQ ID NO: 666728 - DNA, 20 bp, mouse
gagggcggggagtcggcgga

SEQ ID NO: 666729 - DNA, 20 bp, mouse
gggagtcggcggaaggatac

SEQ ID NO: 666730 - DNA, 20 bp, mouse
gaatccagaggtagaggcgc

SEQ ID NO: 666731 - DNA, 20 bp, mouse
ggatactggcgcggagggag

SEQ ID NO: 666732 - DNA, 20 bp, mouse
gcgggagcgcgctcttgcag

SEQ ID NO: 666733 - DNA, 20 bp, mouse
ggacggatgccagggtgtag

SEQ ID NO: 666734 - DNA, 20 bp, mouse
gcgcgcggacgatgcagctg

SEQ ID NO: 666735 - DNA, 20 bp, mouse
gctggcggagcgtggacgcg

SEQ ID NO: 666736 - DNA, 20 bp, mouse
gctgtaagttagctgagggg

SEQ ID NO: 666737 - DNA, 20 bp, mouse
gagctgaggggaggcctaca

SEQ ID NO: 666738 - DNA, 20 bp, mouse
gttaccttatctgagaccca

SEQ ID NO: 666739 - DNA, 20 bp, mouse
gcaaagctgtaagttagctg

SEQ ID NO: 666740 - DNA, 20 bp, mouse
gcggaagaaggaagctgtac

SEQ ID NO: 666741 - DNA, 20 bp, mouse
gatggagtcaggaaccctgt

SEQ ID NO: 666742 - DNA, 20 bp, mouse
gttagtgacgacagagtgcc

SEQ ID NO: 666743 - DNA, 20 bp, mouse
gcctgcagaaccccggaaga

SEQ ID NO: 666744 - DNA, 20 bp, mouse
gaaactgagtctggtaactg

SEQ ID NO: 666745 - DNA, 20 bp, mouse
gggaagaccttttctctcgt

SEQ ID NO: 666746 - DNA, 20 bp, mouse
gcggggagagcgagaggtgg

SEQ ID NO: 666747 - DNA, 20 bp, mouse
gacctgggcccgagaggaag

SEQ ID NO: 666748 - DNA, 20 bp, mouse
gcgggccgggtgcgcgttgg

SEQ ID NO: 666749 - DNA, 20 bp, mouse
ggggcgacgcggtccctcct

SEQ ID NO: 666750 - DNA, 20 bp, mouse
gcccgcccggggagagcgag

SEQ ID NO: 666751 - DNA, 20 bp, mouse
ggggcaccgggcgaccgagg

SEQ ID NO: 666752 - DNA, 20 bp, mouse
ggagaggagccgcaccgggc

SEQ ID NO: 666753 - DNA, 20 bp, mouse
gggtgccctgcgcagcctag

SEQ ID NO: 666754 - DNA, 20 bp, mouse
gctcgggccgccacgtgctg

SEQ ID NO: 666755 - DNA, 20 bp, mouse
gtagcggagaggagccgcac

SEQ ID NO: 666756 - DNA, 20 bp, mouse
gaacgcagtgaggtaatagg

SEQ ID NO: 666757 - DNA, 20 bp, mouse
gcagaacgcagtgaggtaat

SEQ ID NO: 666758 - DNA, 20 bp, mouse
ggacgcttggcactctccag

SEQ ID NO: 666759 - DNA, 20 bp, mouse
gaggcctgcagaacgcagtg

SEQ ID NO: 666760 - DNA, 20 bp, mouse
ggtgaactaagaactgtgat

SEQ ID NO: 666761 - DNA, 20 bp, mouse
gatgcgtagcctgaccagat

SEQ ID NO: 666762 - DNA, 20 bp, mouse
gaggcctgtccaccaattat

SEQ ID NO: 666763 - DNA, 20 bp, mouse
ggaggtaatagggggagttc

SEQ ID NO: 666764 - DNA, 20 bp, mouse
gcagtaaggagtcctataat

SEQ ID NO: 666765 - DNA, 20 bp, mouse
gtcgccatgggtgcacacaa

SEQ ID NO: 666766 - DNA, 20 bp, mouse
gtggactgggggcacgaggt

SEQ ID NO: 666767 - DNA, 20 bp, mouse
ggccaggggtggagctaagg

SEQ ID NO: 666768 - DNA, 20 bp, mouse
gaaagggtccgcacccgctc

SEQ ID NO: 666769 - DNA, 20 bp, mouse
ggggccggaagtgacgagtg

SEQ ID NO: 666770 - DNA, 20 bp, mouse
gtgaacgcgcgcggactggg

SEQ ID NO: 666771 - DNA, 20 bp, mouse
gccgggagctgtggacgcga

SEQ ID NO: 666772 - DNA, 20 bp, mouse
ggggcccggctcgggacgtt

SEQ ID NO: 666773 - DNA, 20 bp, mouse
gagcgcgcccggagagggcg

SEQ ID NO: 666774 - DNA, 20 bp, mouse
ggcctggtcgcccacgtgag

SEQ ID NO: 666775 - DNA, 20 bp, mouse
gctccgggacaggtgaccgg

SEQ ID NO: 666776 - DNA, 20 bp, mouse
gggaaaagggcgatgtgcta

SEQ ID NO: 666777 - DNA, 20 bp, mouse
gtggccctctggtgcactgg

SEQ ID NO: 666778 - DNA, 20 bp, mouse
gggtaaaggcgggaagagat

SEQ ID NO: 666779 - DNA, 20 bp, mouse
gctctgagtcgtgttaagtg

SEQ ID NO: 666780 - DNA, 20 bp, mouse
gcggtctgggaagcttgctg

SEQ ID NO: 666781 - DNA, 20 bp, mouse
gcgtagcagcatagcatcat

SEQ ID NO: 666782 - DNA, 20 bp, mouse
gccaagaccccgctttctta

SEQ ID NO: 666783 - DNA, 20 bp, mouse
gctaactcgccgcccgcaaa

SEQ ID NO: 666784 - DNA, 20 bp, mouse
ggctacgctggattcggtct

SEQ ID NO: 666785 - DNA, 20 bp, mouse
gccaggtggggcaatgactt

SEQ ID NO: 666786 - DNA, 20 bp, mouse
gggtcaggccagtgtatatc

SEQ ID NO: 666787 - DNA, 20 bp, mouse
gtcaggtcaatccacttcac

SEQ ID NO: 666788 - DNA, 20 bp, mouse
gagagacctgacctgtgaag

SEQ ID NO: 666789 - DNA, 20 bp, mouse
ggggtcatgtgatgcgcccg

SEQ ID NO: 666790 - DNA, 20 bp, mouse
gcagctgaatctctgttagg

SEQ ID NO: 666791 - DNA, 20 bp, mouse
gcggcgctccaggcatccgc

SEQ ID NO: 666792 - DNA, 20 bp, mouse
gcatcacatgaccccccaag

SEQ ID NO: 666793 - DNA, 20 bp, mouse
gagccagctgaatctctgtt

SEQ ID NO: 666794 - DNA, 20 bp, mouse
gcacatgaccccccaagagg

SEQ ID NO: 666795 - DNA, 20 bp, mouse
gggattgacctgatatacac

SEQ ID NO: 666796 - DNA, 20 bp, mouse
gcggttgcccggggtaacca

SEQ ID NO: 666797 - DNA, 20 bp, mouse
ggacgacgcgccactccctg

SEQ ID NO: 666798 - DNA, 20 bp, mouse
gttgcccggggtaaccaggg

SEQ ID NO: 666799 - DNA, 20 bp, mouse
gcagacgcctccgggaggat

SEQ ID NO: 666800 - DNA, 20 bp, mouse
gcgcacgcgcgttcccgctc

SEQ ID NO: 666801 - DNA, 20 bp, mouse
gcaagcgcactgctcaggtg

SEQ ID NO: 666802 - DNA, 20 bp, mouse
gcggatcgatgctctttctg

SEQ ID NO: 666803 - DNA, 20 bp, mouse
ggcggcggtctgctagtgat

SEQ ID NO: 666804 - DNA, 20 bp, mouse
gctcaggtgcggccgcactg

SEQ ID NO: 666805 - DNA, 20 bp, mouse
gactccctgcggctgcggca

SEQ ID NO: 666806 - DNA, 20 bp, mouse
gacagccagcactgctgggc

SEQ ID NO: 666807 - DNA, 20 bp, mouse
gcctcctctgaggggaggat

SEQ ID NO: 666808 - DNA, 20 bp, mouse
gaggggaggatcggttactc

SEQ ID NO: 666809 - DNA, 20 bp, mouse
gcagcacctcctctgagggg

SEQ ID NO: 666810 - DNA, 20 bp, mouse
gaaagaaaaagtaccttagg

SEQ ID NO: 666811 - DNA, 20 bp, mouse
ggttcagcacctcctctgag

SEQ ID NO: 666812 - DNA, 20 bp, mouse
gcaaggacagccagcactgc

SEQ ID NO: 666813 - DNA, 20 bp, mouse
ggaagggaccggcaaggaga

SEQ ID NO: 666814 - DNA, 20 bp, mouse
gacagcaggtcggagaaccg

SEQ ID NO: 666815 - DNA, 20 bp, mouse
gggggaacaaagtcatcctt

SEQ ID NO: 666816 - DNA, 20 bp, mouse
gcaactaccggcacccggaa

SEQ ID NO: 666817 - DNA, 20 bp, mouse
gaaacccgaaataaaggttc

SEQ ID NO: 666818 - DNA, 20 bp, mouse
ggtcccggaacctttatttc

SEQ ID NO: 666819 - DNA, 20 bp, mouse
ggtgcgcttccgttcccttc

SEQ ID NO: 666820 - DNA, 20 bp, mouse
gttaggaagtggcgacactg

SEQ ID NO: 666821 - DNA, 20 bp, mouse
gccaaccagtgagccggctt

SEQ ID NO: 666822 - DNA, 20 bp, mouse
gacacaggatccacatgtcc

SEQ ID NO: 666823 - DNA, 20 bp, mouse
gaccggcacccggaagggaa

SEQ ID NO: 666824 - DNA, 20 bp, mouse
gtagttgaaacccgaaataa

SEQ ID NO: 666825 - DNA, 20 bp, mouse
gcggaagcgcactcccgact

SEQ ID NO: 666826 - DNA, 20 bp, mouse
gaagatctgcgaacaggtga

SEQ ID NO: 666827 - DNA, 20 bp, mouse
gctcccgcggcctcatggac

SEQ ID NO: 666828 - DNA, 20 bp, mouse
gggcccgcacggcctacttc

SEQ ID NO: 666829 - DNA, 20 bp, mouse
gcgtgcgggccacgcctctc

SEQ ID NO: 666830 - DNA, 20 bp, mouse
gcggggcgcggaccggaagt

SEQ ID NO: 666831 - DNA, 20 bp, mouse
gggaggcgctaattggacgc

SEQ ID NO: 666832 - DNA, 20 bp, mouse
gcgatgcggcggggagacag

SEQ ID NO: 666833 - DNA, 20 bp, mouse
gccggctgacaggcttaggg

SEQ ID NO: 666834 - DNA, 20 bp, mouse
gggcgcctcccgcggcctca

SEQ ID NO: 666835 - DNA, 20 bp, mouse
gtctgcgaacaggtgaaggg

SEQ ID NO: 666836 - DNA, 20 bp, mouse
gctcgagggtctatgcgata

SEQ ID NO: 666837 - DNA, 20 bp, mouse
gagaaggcccgcctttgacc

SEQ ID NO: 666838 - DNA, 20 bp, mouse
gcccccagatgagacctgaa

SEQ ID NO: 666839 - DNA, 20 bp, mouse
ggatcttaaacctatcaaat

SEQ ID NO: 666840 - DNA, 20 bp, mouse
gctggaccctaggtacccgc

SEQ ID NO: 666841 - DNA, 20 bp, mouse
ggctggcatgagattaaatt

SEQ ID NO: 666842 - DNA, 20 bp, mouse
gcatcaaagttccgggtcaa

SEQ ID NO: 666843 - DNA, 20 bp, mouse
ggtagcgatcaaatgacaca

SEQ ID NO: 666844 - DNA, 20 bp, mouse
gggctggatgtgatgataga

SEQ ID NO: 666845 - DNA, 20 bp, mouse
gtcatcacatccagcctgta

SEQ ID NO: 666846 - DNA, 20 bp, mouse
gcacaccctggcaactttta

SEQ ID NO: 666847 - DNA, 20 bp, mouse
gaactcctgcgaatgttcat

SEQ ID NO: 666848 - DNA, 20 bp, mouse
ggcccccagccagtatttaa

SEQ ID NO: 666849 - DNA, 20 bp, mouse
ggacgcaaggggcacgcggg

SEQ ID NO: 666850 - DNA, 20 bp, mouse
gcgccctctgtgaggaggag

SEQ ID NO: 666851 - DNA, 20 bp, mouse
ggccttcatctcaacccgag

SEQ ID NO: 666852 - DNA, 20 bp, mouse
gaaacccctcctcctcacag

SEQ ID NO: 666853 - DNA, 20 bp, mouse
gtgggcaaccaaggacgcaa

SEQ ID NO: 666854 - DNA, 20 bp, mouse
gttcatgggatatctagttc

SEQ ID NO: 666855 - DNA, 20 bp, mouse
gcatcccctaaaagttgcca

SEQ ID NO: 666856 - DNA, 20 bp, mouse
gcgtgccggccaatcagaag

SEQ ID NO: 666857 - DNA, 20 bp, mouse
gagggcgcggagaaagtttg

SEQ ID NO: 666858 - DNA, 20 bp, mouse
gggaacccgggaaaacgtgc

SEQ ID NO: 666859 - DNA, 20 bp, mouse
gaggaggggccgtcagggcg

SEQ ID NO: 666860 - DNA, 20 bp, mouse
gaatcagaagtggcggagag

SEQ ID NO: 666861 - DNA, 20 bp, mouse
gcaaatgggtgcaactcaga

SEQ ID NO: 666862 - DNA, 20 bp, mouse
ggggctcgcgggcgcgaagt

SEQ ID NO: 666863 - DNA, 20 bp, mouse
gcgggcgcgaagtcggaccc

SEQ ID NO: 666864 - DNA, 20 bp, mouse
ggacccgggaattccgaagg

SEQ ID NO: 666865 - DNA, 20 bp, mouse
ggaagaagaaaggtgcaagc

SEQ ID NO: 666866 - DNA, 20 bp, mouse
gtcgccgggaatgttcgaac

SEQ ID NO: 666867 - DNA, 20 bp, mouse
gagagggtgacgtcatagaa

SEQ ID NO: 666868 - DNA, 20 bp, mouse
gccgaggactgtgacttgaa

SEQ ID NO: 666869 - DNA, 20 bp, mouse
ggttcgaactggtttgggtg

SEQ ID NO: 666870 - DNA, 20 bp, mouse
gactgtgacttgaaaggccc

SEQ ID NO: 666871 - DNA, 20 bp, mouse
ggggaatgttcgaactggtt

SEQ ID NO: 666872 - DNA, 20 bp, mouse
gtaactgcctctgtgacagg

SEQ ID NO: 666873 - DNA, 20 bp, mouse
gtgtggagagggaaaattta

SEQ ID NO: 666874 - DNA, 20 bp, mouse
gtggggccacggtgtccccc

SEQ ID NO: 666875 - DNA, 20 bp, mouse
gtcccacgcccactcctctc

SEQ ID NO: 666876 - DNA, 20 bp, mouse
ggcaaagtgcccccctggga

SEQ ID NO: 666877 - DNA, 20 bp, mouse
gggaagcgtcccagtgaatg

SEQ ID NO: 666878 - DNA, 20 bp, mouse
gaggatagcccctcccaggg

SEQ ID NO: 666879 - DNA, 20 bp, mouse
gaggggctatcctcattcac

SEQ ID NO: 666880 - DNA, 20 bp, mouse
gggagggccacatcaatcgg

SEQ ID NO: 666881 - DNA, 20 bp, mouse
gtgtggccctccggagagaa

SEQ ID NO: 666882 - DNA, 20 bp, mouse
gcagcaggacacgtgctcag

SEQ ID NO: 666883 - DNA, 20 bp, mouse
ggagggaccaccgattgatg

SEQ ID NO: 666884 - DNA, 20 bp, mouse
gtgcacaggcgccgaacagg

SEQ ID NO: 666885 - DNA, 20 bp, mouse
ggaaactgggggaccctcac

SEQ ID NO: 666886 - DNA, 20 bp, mouse
gagtctgaggccctgagcag

SEQ ID NO: 666887 - DNA, 20 bp, mouse
gtgtgtccccattctgggaa

SEQ ID NO: 666888 - DNA, 20 bp, mouse
gtgggaggggtgggcctgga

SEQ ID NO: 666889 - DNA, 20 bp, mouse
gagccaggctgccactgctc

SEQ ID NO: 666890 - DNA, 20 bp, mouse
gtgtagatgtgtccccattc

SEQ ID NO: 666891 - DNA, 20 bp, mouse
gtccccattctgattaacaa

SEQ ID NO: 666892 - DNA, 20 bp, mouse
gtattaacccttcccagaat

SEQ ID NO: 666893 - DNA, 20 bp, mouse
gcttcaccctgaatatgtct

SEQ ID NO: 666894 - DNA, 20 bp, mouse
gctgctccactccaccttcc

SEQ ID NO: 666895 - DNA, 20 bp, mouse
ggaagggttaatatgcagcc

SEQ ID NO: 666896 - DNA, 20 bp, mouse
ggccgcccagagcttgggac

SEQ ID NO: 666897 - DNA, 20 bp, mouse
gtgggaccggctgggtctaa

SEQ ID NO: 666898 - DNA, 20 bp, mouse
ggcgccaagagtcacctggt

SEQ ID NO: 666899 - DNA, 20 bp, mouse
ggagcgcgcgcacggaactc

SEQ ID NO: 666900 - DNA, 20 bp, mouse
ggggaccctgggactcaaac

SEQ ID NO: 666901 - DNA, 20 bp, mouse
ggactcttggcgcgcctcct

SEQ ID NO: 666902 - DNA, 20 bp, mouse
gtgtcccaccaggtgactct

SEQ ID NO: 666903 - DNA, 20 bp, mouse
gcaaaagccgcccagagctt

SEQ ID NO: 666904 - DNA, 20 bp, mouse
ggggctggcgatgtggtggg

SEQ ID NO: 666905 - DNA, 20 bp, mouse
gtcacccaggagcgcgcgca

SEQ ID NO: 666906 - DNA, 20 bp, mouse
gaatacgcccccctcctccc

SEQ ID NO: 666907 - DNA, 20 bp, mouse
ggagaagaggtgggagtccc

SEQ ID NO: 666908 - DNA, 20 bp, mouse
ggaggaggggggcgtattcg

SEQ ID NO: 666909 - DNA, 20 bp, mouse
gaaaaggaactcatacccaa

SEQ ID NO: 666910 - DNA, 20 bp, mouse
ggcacttggggaagttccca

SEQ ID NO: 666911 - DNA, 20 bp, mouse
gggtatctgcttctgcactt

SEQ ID NO: 666912 - DNA, 20 bp, mouse
ggactcccacctcttctcca

SEQ ID NO: 666913 - DNA, 20 bp, mouse
gggcgtattcgaggtatgtt

SEQ ID NO: 666914 - DNA, 20 bp, mouse
gcagaccatggagaagaggt

SEQ ID NO: 666915 - DNA, 20 bp, mouse
gttgtcaagaacgtaaagat

SEQ ID NO: 666916 - DNA, 20 bp, mouse
ggggacttggcatctgttaa

SEQ ID NO: 666917 - DNA, 20 bp, mouse
gaaggaggggtcttgagcag

SEQ ID NO: 666918 - DNA, 20 bp, mouse
gagaagaaacacaaaaccgt

SEQ ID NO: 666919 - DNA, 20 bp, mouse
gttggcatctgttaagggat

SEQ ID NO: 666920 - DNA, 20 bp, mouse
gcaaaaccgtgggagggact

SEQ ID NO: 666921 - DNA, 20 bp, mouse
ggcacaaggtcatgaaggag

SEQ ID NO: 666922 - DNA, 20 bp, mouse
gtgcctgcacaaggtcatga

SEQ ID NO: 666923 - DNA, 20 bp, mouse
ggcgactgatcattgtgcag

SEQ ID NO: 666924 - DNA, 20 bp, mouse
gagatgccaagtccctccca

SEQ ID NO: 666925 - DNA, 20 bp, mouse
gagaaacacaaaaccgtggg

SEQ ID NO: 666926 - DNA, 20 bp, mouse
gagtaagcactgagacccca

SEQ ID NO: 666927 - DNA, 20 bp, mouse
gtgagaggaaatcacccctg

SEQ ID NO: 666928 - DNA, 20 bp, mouse
gttagacagcgaaacagatg

SEQ ID NO: 666929 - DNA, 20 bp, mouse
gtagcctgacaccctccaaa

SEQ ID NO: 666930 - DNA, 20 bp, mouse
gcagtggcctggtgtaataa

SEQ ID NO: 666931 - DNA, 20 bp, mouse
gggcttctcagaactcagtt

SEQ ID NO: 666932 - DNA, 20 bp, mouse
gcttactcagcatagtcctg

SEQ ID NO: 666933 - DNA, 20 bp, mouse
gcctgacaggatcctacaga

SEQ ID NO: 666934 - DNA, 20 bp, mouse
gcaataggaagtgacttcac

SEQ ID NO: 666935 - DNA, 20 bp, mouse
gtgtacaatgcggtaacaga

SEQ ID NO: 666936 - DNA, 20 bp, mouse
gtcgactcgggacaggggag

SEQ ID NO: 666937 - DNA, 20 bp, mouse
gttcaccagtactaggacaa

SEQ ID NO: 666938 - DNA, 20 bp, mouse
ggggtctgtgtctggggtaa

SEQ ID NO: 666939 - DNA, 20 bp, mouse
ggtcactcgactcgggacag

SEQ ID NO: 666940 - DNA, 20 bp, mouse
gaggaggggacaggaagcgt

SEQ ID NO: 666941 - DNA, 20 bp, mouse
ggagaatggtcactcgactc

SEQ ID NO: 666942 - DNA, 20 bp, mouse
gggccagcctggggaaggac

SEQ ID NO: 666943 - DNA, 20 bp, mouse
gggaccaaacagagatcata

SEQ ID NO: 666944 - DNA, 20 bp, mouse
gacctccagagaggttaaat

SEQ ID NO: 666945 - DNA, 20 bp, mouse
gaaggattataggaggggac

SEQ ID NO: 666946 - DNA, 20 bp, mouse
gaggcctgggccctctcctt

SEQ ID NO: 666947 - DNA, 20 bp, mouse
gctggaagggaaggttccta

SEQ ID NO: 666948 - DNA, 20 bp, mouse
gtcacagggacctgagctgt

SEQ ID NO: 666949 - DNA, 20 bp, mouse
ggggaaggttcctaaggaga

SEQ ID NO: 666950 - DNA, 20 bp, mouse
gacctgagctgtgggctagg

SEQ ID NO: 666951 - DNA, 20 bp, mouse
ggttcctaaggagagggccc

SEQ ID NO: 666952 - DNA, 20 bp, mouse
gtccctgtgaatcagctacc

SEQ ID NO: 666953 - DNA, 20 bp, mouse
gtccaggtagctgattcaca

SEQ ID NO: 666954 - DNA, 20 bp, mouse
ggggacctgagctgtgggct

SEQ ID NO: 666955 - DNA, 20 bp, mouse
ggctgtgggctaggaggcct

SEQ ID NO: 666956 - DNA, 20 bp, mouse
ggggctctgcacttactcag

SEQ ID NO: 666957 - DNA, 20 bp, mouse
gtgaagctgcgcagggagta

SEQ ID NO: 666958 - DNA, 20 bp, mouse
gagtggaagagagaaactgt

SEQ ID NO: 666959 - DNA, 20 bp, mouse
gcatcaccctggataagtga

SEQ ID NO: 666960 - DNA, 20 bp, mouse
gaccacaagtgtgaatggag

SEQ ID NO: 666961 - DNA, 20 bp, mouse
gagagccctcgggtgtttcc

SEQ ID NO: 666962 - DNA, 20 bp, mouse
gggagcaaatgaagctgcgc

SEQ ID NO: 666963 - DNA, 20 bp, mouse
gccaaggagtagcatcaccc

SEQ ID NO: 666964 - DNA, 20 bp, mouse
gctgcctgactccacccccc

SEQ ID NO: 666965 - DNA, 20 bp, mouse
gcacttcctggaaacacccg

SEQ ID NO: 666966 - DNA, 20 bp, mouse
gaggtgtgaaggtcaggtgg

SEQ ID NO: 666967 - DNA, 20 bp, mouse
gtactgttgagaaggtgtga

SEQ ID NO: 666968 - DNA, 20 bp, mouse
gtccctgtgggttttctttg

SEQ ID NO: 666969 - DNA, 20 bp, mouse
ggggttttctttgtggtgac

SEQ ID NO: 666970 - DNA, 20 bp, mouse
gctcaacagtaggaaaaggc

SEQ ID NO: 666971 - DNA, 20 bp, mouse
gggaatcctgttaattcctc

SEQ ID NO: 666972 - DNA, 20 bp, mouse
gggcaggaagttttccctgt

SEQ ID NO: 666973 - DNA, 20 bp, mouse
gagaaggcgtgttctcaccc

SEQ ID NO: 666974 - DNA, 20 bp, mouse
gctggacaggtgccatttct

SEQ ID NO: 666975 - DNA, 20 bp, mouse
gtaattcctcaggatgtagg

SEQ ID NO: 666976 - DNA, 20 bp, mouse
gaaggcggggaactactcag

SEQ ID NO: 666977 - DNA, 20 bp, mouse
gcctccggagacccacagtt

SEQ ID NO: 666978 - DNA, 20 bp, mouse
gtgccagtggccactgaggt

SEQ ID NO: 666979 - DNA, 20 bp, mouse
gccccagcgggaggatccaa

SEQ ID NO: 666980 - DNA, 20 bp, mouse
ggacctcagccatatcacta

SEQ ID NO: 666981 - DNA, 20 bp, mouse
gaagaggtgcctgaactagt

SEQ ID NO: 666982 - DNA, 20 bp, mouse
gacccctagtgatatggctg

SEQ ID NO: 666983 - DNA, 20 bp, mouse
gcctcggtagagcaccgcta

SEQ ID NO: 666984 - DNA, 20 bp, mouse
gtgccactctcccaaactgt

SEQ ID NO: 666985 - DNA, 20 bp, mouse
gtcatggagaggaccttggt

SEQ ID NO: 666986 - DNA, 20 bp, mouse
gctgcctgggccacagccaa

SEQ ID NO: 666987 - DNA, 20 bp, mouse
gtatgcagctacaaaaactg

SEQ ID NO: 666988 - DNA, 20 bp, mouse
gtggagtcagcaattatttg

SEQ ID NO: 666989 - DNA, 20 bp, mouse
gactccactggacaagaaat

SEQ ID NO: 666990 - DNA, 20 bp, mouse
gggttctggcaagagaaagc

SEQ ID NO: 666991 - DNA, 20 bp, mouse
gaccagtgggagggagatcg

SEQ ID NO: 666992 - DNA, 20 bp, mouse
gaatgagtggacagaaggca

SEQ ID NO: 666993 - DNA, 20 bp, mouse
gtggatgataggcagatcaa

SEQ ID NO: 666994 - DNA, 20 bp, mouse
gggagggctgtcatcctgcc

SEQ ID NO: 666995 - DNA, 20 bp, mouse
gaggaagtccgtgggggaga

SEQ ID NO: 666996 - DNA, 20 bp, mouse
gggaggggatactgattgag

SEQ ID NO: 666997 - DNA, 20 bp, mouse
gagagggctgcggacagtat

SEQ ID NO: 666998 - DNA, 20 bp, mouse
gaaagtgcctcaaggttcat

SEQ ID NO: 666999 - DNA, 20 bp, mouse
gggggcaggtcactgcaggg

SEQ ID NO: 667000 - DNA, 20 bp, mouse
gggctgcataaagtgcctca

SEQ ID NO: 667001 - DNA, 20 bp, mouse
gtaggacttggtctatctga

SEQ ID NO: 667002 - DNA, 20 bp, mouse
gacctcacataataaggtat

SEQ ID NO: 667003 - DNA, 20 bp, mouse
gaaaaagatccgtgaggaga

SEQ ID NO: 667004 - DNA, 20 bp, mouse
gtaaaaagcttgtaagggag

SEQ ID NO: 667005 - DNA, 20 bp, mouse
gaaatcatggcgtatctgtg

SEQ ID NO: 667006 - DNA, 20 bp, mouse
ggagcgggtcgtgcgcgctg

SEQ ID NO: 667007 - DNA, 20 bp, mouse
gggcggcggcagagcggtag

SEQ ID NO: 667008 - DNA, 20 bp, mouse
gcgggtcgtgcgcgctgagg

SEQ ID NO: 667009 - DNA, 20 bp, mouse
ggcgggcggcgcggcgataa

SEQ ID NO: 667010 - DNA, 20 bp, mouse
ggagacgcgcgtgtgggccg

SEQ ID NO: 667011 - DNA, 20 bp, mouse
gggcagagcggtagcggtag

SEQ ID NO: 667012 - DNA, 20 bp, mouse
gagggggcgtgtctgggccg

SEQ ID NO: 667013 - DNA, 20 bp, mouse
gaacacgggcgggaaggccc

SEQ ID NO: 667014 - DNA, 20 bp, mouse
ggggccgcggctgggcgaat

SEQ ID NO: 667015 - DNA, 20 bp, mouse
ggcgcgcacgacccgctccc

SEQ ID NO: 667016 - DNA, 20 bp, mouse
gtacagagaggggactgtct

SEQ ID NO: 667017 - DNA, 20 bp, mouse
gacagcggcaaagtatgcgg

SEQ ID NO: 667018 - DNA, 20 bp, mouse
gtaggacatgagccaggtga

SEQ ID NO: 667019 - DNA, 20 bp, mouse
gtccacagcggcaaagtatg

SEQ ID NO: 667020 - DNA, 20 bp, mouse
gaggggactgtcttggctca

SEQ ID NO: 667021 - DNA, 20 bp, mouse
gtgactctgtgagtgcatga

SEQ ID NO: 667022 - DNA, 20 bp, mouse
gaaaggcagtttacagagag

SEQ ID NO: 667023 - DNA, 20 bp, mouse
gcatgataagaagtccacag

SEQ ID NO: 667024 - DNA, 20 bp, mouse
gacccatctagcccagtaag

SEQ ID NO: 667025 - DNA, 20 bp, mouse
gtccatccctgacaaattct

SEQ ID NO: 667026 - DNA, 20 bp, mouse
gctgaggtcattcaagaact

SEQ ID NO: 667027 - DNA, 20 bp, mouse
gtgtatttttgttgcttaag

SEQ ID NO: 667028 - DNA, 20 bp, mouse
gcactctagatgtccgtaca

SEQ ID NO: 667029 - DNA, 20 bp, mouse
gttttttttcacaccatgta

SEQ ID NO: 667030 - DNA, 20 bp, mouse
gaaaaaaaaattagatgatt

SEQ ID NO: 667031 - DNA, 20 bp, mouse
gaaattagatgatttggcca

SEQ ID NO: 667032 - DNA, 20 bp, mouse
gccttcgcattctatgggtg

SEQ ID NO: 667033 - DNA, 20 bp, mouse
gaattggcaaggtaaaagcc

SEQ ID NO: 667034 - DNA, 20 bp, mouse
gggtagactgtgaccttgat

SEQ ID NO: 667035 - DNA, 20 bp, mouse
ggtcattcaagaactgggca

SEQ ID NO: 667036 - DNA, 20 bp, mouse
ggggaggagaagatgaaggc

SEQ ID NO: 667037 - DNA, 20 bp, mouse
ggatgaaggcaggtcagtgc

SEQ ID NO: 667038 - DNA, 20 bp, mouse
ggtgggtaggaacagaaggc

SEQ ID NO: 667039 - DNA, 20 bp, mouse
ggtgagtgggtaggaacaga

SEQ ID NO: 667040 - DNA, 20 bp, mouse
gagtagggaggagaagatga

SEQ ID NO: 667041 - DNA, 20 bp, mouse
gaatgcaaatggattccagt

SEQ ID NO: 667042 - DNA, 20 bp, mouse
ggcagtccaggcaggggatt

SEQ ID NO: 667043 - DNA, 20 bp, mouse
gtggactgccatttccccat

SEQ ID NO: 667044 - DNA, 20 bp, mouse
gagctagcgaatagtatccg

SEQ ID NO: 667045 - DNA, 20 bp, mouse
ggggaaatggcagtccaggc

SEQ ID NO: 667046 - DNA, 20 bp, mouse
gaactctggagtgtagatgg

SEQ ID NO: 667047 - DNA, 20 bp, mouse
gtgctcctagcctagaactc

SEQ ID NO: 667048 - DNA, 20 bp, mouse
ggtgagagcctcccagggcg

SEQ ID NO: 667049 - DNA, 20 bp, mouse
gggcaaagtgagcacacggc

SEQ ID NO: 667050 - DNA, 20 bp, mouse
ggacctcatcagctggcaca

SEQ ID NO: 667051 - DNA, 20 bp, mouse
gttaatgccaggttccgggc

SEQ ID NO: 667052 - DNA, 20 bp, mouse
gtgatgaggtccttaagagt

SEQ ID NO: 667053 - DNA, 20 bp, mouse
gactcgggttgcagtcagaa

SEQ ID NO: 667054 - DNA, 20 bp, mouse
ggcccagaaacagcttaagt

SEQ ID NO: 667055 - DNA, 20 bp, mouse
gtgagtactaccaactctta

SEQ ID NO: 667056 - DNA, 20 bp, mouse
ggatgaggaaatggaatccg

SEQ ID NO: 667057 - DNA, 20 bp, mouse
gatggatattacacaaccca

SEQ ID NO: 667058 - DNA, 20 bp, mouse
ggggctacctataagagaag

SEQ ID NO: 667059 - DNA, 20 bp, mouse
gagaacggttctcatgagat

SEQ ID NO: 667060 - DNA, 20 bp, mouse
gccgttccatggcaaggaat

SEQ ID NO: 667061 - DNA, 20 bp, mouse
ggtaggacagtgtcaaccca

SEQ ID NO: 667062 - DNA, 20 bp, mouse
gcctcactgtggtggtagga

SEQ ID NO: 667063 - DNA, 20 bp, mouse
gtcgagcaatggggaagacg

SEQ ID NO: 667064 - DNA, 20 bp, mouse
gcacagcaatggtgtcatga

SEQ ID NO: 667065 - DNA, 20 bp, mouse
gctgtggtcactgtggaccc

SEQ ID NO: 667066 - DNA, 20 bp, mouse
gccccccagcagtgacatca

SEQ ID NO: 667067 - DNA, 20 bp, mouse
gggggggaagacagtctgtc

SEQ ID NO: 667068 - DNA, 20 bp, mouse
ggggcctaagacaagggttg

SEQ ID NO: 667069 - DNA, 20 bp, mouse
ggtgacatcacggaagagaa

SEQ ID NO: 667070 - DNA, 20 bp, mouse
ggtacaccaaagatagtgac

SEQ ID NO: 667071 - DNA, 20 bp, mouse
ggactctggggcctaagaca

SEQ ID NO: 667072 - DNA, 20 bp, mouse
gagtggggtgcatgttggag

SEQ ID NO: 667073 - DNA, 20 bp, mouse
gggttgtgaacccgagagga

SEQ ID NO: 667074 - DNA, 20 bp, mouse
gccagagtccctataaagag

SEQ ID NO: 667075 - DNA, 20 bp, mouse
gatgagtaaagatgatgtca

SEQ ID NO: 667076 - DNA, 20 bp, mouse
gtggactggagggcagttag

SEQ ID NO: 667077 - DNA, 20 bp, mouse
ggccagagagggagtcatcc

SEQ ID NO: 667078 - DNA, 20 bp, mouse
gtgggacggcagatctgagg

SEQ ID NO: 667079 - DNA, 20 bp, mouse
gagagggagtcatcctggac

SEQ ID NO: 667080 - DNA, 20 bp, mouse
ggagtgggacggcagatctg

SEQ ID NO: 667081 - DNA, 20 bp, mouse
gccccccagccccaggactt

SEQ ID NO: 667082 - DNA, 20 bp, mouse
gagggcctctccaggtagca

SEQ ID NO: 667083 - DNA, 20 bp, mouse
gaaggggtgctctgcagctc

SEQ ID NO: 667084 - DNA, 20 bp, mouse
gggcacttcctctgctaccc

SEQ ID NO: 667085 - DNA, 20 bp, mouse
gtctctggccaaatacagta

SEQ ID NO: 667086 - DNA, 20 bp, mouse
gcgagggcaaaggtcatggt

SEQ ID NO: 667087 - DNA, 20 bp, mouse
gggagggccaagaatgcaac

SEQ ID NO: 667088 - DNA, 20 bp, mouse
gcaacaggaagcgagggcaa

SEQ ID NO: 667089 - DNA, 20 bp, mouse
gaaatgcaacaggaagtgga

SEQ ID NO: 667090 - DNA, 20 bp, mouse
gggactacatagctagtaag

SEQ ID NO: 667091 - DNA, 20 bp, mouse
ggctagtaagtggtggaatt

SEQ ID NO: 667092 - DNA, 20 bp, mouse
gtagaaaaacaggggcaacg

SEQ ID NO: 667093 - DNA, 20 bp, mouse
gaacaggctagttctaaaag

SEQ ID NO: 667094 - DNA, 20 bp, mouse
gtggctacataatacacaac

SEQ ID NO: 667095 - DNA, 20 bp, mouse
gcatggtgggctagaaaaac

SEQ ID NO: 667096 - DNA, 20 bp, mouse
ggcagagatggcagagtcaa

SEQ ID NO: 667097 - DNA, 20 bp, mouse
gcggctgcctataaaagagg

SEQ ID NO: 667098 - DNA, 20 bp, mouse
gtccttgggatgttgctcga

SEQ ID NO: 667099 - DNA, 20 bp, mouse
gcctggtgttaaatggaaat

SEQ ID NO: 667100 - DNA, 20 bp, mouse
gtataggcagccgataggga

SEQ ID NO: 667101 - DNA, 20 bp, mouse
gaaagaagatccctccctat

SEQ ID NO: 667102 - DNA, 20 bp, mouse
gttccatttaacaccaggaa

SEQ ID NO: 667103 - DNA, 20 bp, mouse
gagcaacatcccaaggagct

SEQ ID NO: 667104 - DNA, 20 bp, mouse
gtctagactccaagctcctt

SEQ ID NO: 667105 - DNA, 20 bp, mouse
gtatcggctgcctataaaag

SEQ ID NO: 667106 - DNA, 20 bp, mouse
gaataagatgctaaaatctt

SEQ ID NO: 667107 - DNA, 20 bp, mouse
gaagcagtcccactggatca

SEQ ID NO: 667108 - DNA, 20 bp, mouse
gctaacctctctttactcca

SEQ ID NO: 667109 - DNA, 20 bp, mouse
gactgcttcctccatgctgc

SEQ ID NO: 667110 - DNA, 20 bp, mouse
gcagatagagttgtgcctaa

SEQ ID NO: 667111 - DNA, 20 bp, mouse
gccagagaaaggcctaagtc

SEQ ID NO: 667112 - DNA, 20 bp, mouse
gtgtaaaagggaccagactt

SEQ ID NO: 667113 - DNA, 20 bp, mouse
gtatgagacagaaactttga

SEQ ID NO: 667114 - DNA, 20 bp, mouse
gtgagtctatcatgttttca

SEQ ID NO: 667115 - DNA, 20 bp, mouse
ggcatctgaaaccagcagca

SEQ ID NO: 667116 - DNA, 20 bp, mouse
gcaagctaacctctcatcag

SEQ ID NO: 667117 - DNA, 20 bp, mouse
gctctcatcaggggtctaga

SEQ ID NO: 667118 - DNA, 20 bp, mouse
gttgggtgttatgtagtcaa

SEQ ID NO: 667119 - DNA, 20 bp, mouse
gaggttagcttggaggacgc

SEQ ID NO: 667120 - DNA, 20 bp, mouse
ggtggagggcaaaggtgact

SEQ ID NO: 667121 - DNA, 20 bp, mouse
gtctgaatcaatttgaactt

SEQ ID NO: 667122 - DNA, 20 bp, mouse
gaacatgctagttctaagag

SEQ ID NO: 667123 - DNA, 20 bp, mouse
ggcacagcactgcatgtatg

SEQ ID NO: 667124 - DNA, 20 bp, mouse
gataaaaggagaaatccttc

SEQ ID NO: 667125 - DNA, 20 bp, mouse
gcattatgagctgtacccca

SEQ ID NO: 667126 - DNA, 20 bp, mouse
ggcactcgctgggcccaagg

SEQ ID NO: 667127 - DNA, 20 bp, mouse
ggggcccagcgagtgcctct

SEQ ID NO: 667128 - DNA, 20 bp, mouse
gcggaagtgcgggagcgccg

SEQ ID NO: 667129 - DNA, 20 bp, mouse
gaaggagggcgataccaaga

SEQ ID NO: 667130 - DNA, 20 bp, mouse
gagcgccgaggcagtgggcg

SEQ ID NO: 667131 - DNA, 20 bp, mouse
gtgctcctcccgccctgagg

SEQ ID NO: 667132 - DNA, 20 bp, mouse
gccgcctagaggcactcgct

SEQ ID NO: 667133 - DNA, 20 bp, mouse
gtggcagcgcgcccagaacc

SEQ ID NO: 667134 - DNA, 20 bp, mouse
gctcccgcacttccgcctag

SEQ ID NO: 667135 - DNA, 20 bp, mouse
gggggcggggtctccggagt

SEQ ID NO: 667136 - DNA, 20 bp, mouse
ggaaccctgcaactgaaggg

SEQ ID NO: 667137 - DNA, 20 bp, mouse
ggaagggtgggagccaaaca

SEQ ID NO: 667138 - DNA, 20 bp, mouse
gcagatggagaacactgcct

SEQ ID NO: 667139 - DNA, 20 bp, mouse
ggccccttagacgccatgtt

SEQ ID NO: 667140 - DNA, 20 bp, mouse
gcccccaccatcagatggga

SEQ ID NO: 667141 - DNA, 20 bp, mouse
ggcccctcccatctgatggt

SEQ ID NO: 667142 - DNA, 20 bp, mouse
gatgggaggggcaggaactc

SEQ ID NO: 667143 - DNA, 20 bp, mouse
gggggcaggaactctggtac

SEQ ID NO: 667144 - DNA, 20 bp, mouse
gtaaggggctcggcacttgt

SEQ ID NO: 667145 - DNA, 20 bp, mouse
ggagccaaacatggcgtcta

SEQ ID NO: 667146 - DNA, 20 bp, mouse
gccgcccggcagcgccccgg

SEQ ID NO: 667147 - DNA, 20 bp, mouse
ggggccgtgcgcggagggag

SEQ ID NO: 667148 - DNA, 20 bp, mouse
gtggtcgatgtcaccaggga

SEQ ID NO: 667149 - DNA, 20 bp, mouse
ggtggcgagcgcactagccg

SEQ ID NO: 667150 - DNA, 20 bp, mouse
gcccgggggccgagcatcag

SEQ ID NO: 667151 - DNA, 20 bp, mouse
ggcttccatgccaaccgcgg

SEQ ID NO: 667152 - DNA, 20 bp, mouse
gggcgcacgcccgccgcggt

SEQ ID NO: 667153 - DNA, 20 bp, mouse
ggggccggttccagcagcct

SEQ ID NO: 667154 - DNA, 20 bp, mouse
ggagcccggggctgcgcggt

SEQ ID NO: 667155 - DNA, 20 bp, mouse
ggggtgcaagtggcgacgtg

SEQ ID NO: 667156 - DNA, 20 bp, mouse
ggacgcgcctgcgcagagga

SEQ ID NO: 667157 - DNA, 20 bp, mouse
ggctccggcaggatcctatg

SEQ ID NO: 667158 - DNA, 20 bp, mouse
gcgacgggaatcttacaggg

SEQ ID NO: 667159 - DNA, 20 bp, mouse
gggcccgacgggaatcttac

SEQ ID NO: 667160 - DNA, 20 bp, mouse
gcgacacctcgaggccccga

SEQ ID NO: 667161 - DNA, 20 bp, mouse
ggccccgccctcctctgcgc

SEQ ID NO: 667162 - DNA, 20 bp, mouse
gcggtccagacaagccctcg

SEQ ID NO: 667163 - DNA, 20 bp, mouse
gccgcgagcgaaggcccgac

SEQ ID NO: 667164 - DNA, 20 bp, mouse
gcaccccttagctgaggcga

SEQ ID NO: 667165 - DNA, 20 bp, mouse
gtagcctcataggatcctgc

SEQ ID NO: 667166 - DNA, 20 bp, mouse
gcccgcgatcccaagttcgg

SEQ ID NO: 667167 - DNA, 20 bp, mouse
gctagcccaggcgactccgt

SEQ ID NO: 667168 - DNA, 20 bp, mouse
ggccagcggcagcctcgctc

SEQ ID NO: 667169 - DNA, 20 bp, mouse
gatagagcctgacctcgcga

SEQ ID NO: 667170 - DNA, 20 bp, mouse
ggcctgacctcgcgaggggt

SEQ ID NO: 667171 - DNA, 20 bp, mouse
ggcaccgcccacccctcgcg

SEQ ID NO: 667172 - DNA, 20 bp, mouse
gccccacccccgccgaactt

SEQ ID NO: 667173 - DNA, 20 bp, mouse
ggctgccacctgccttaggt

SEQ ID NO: 667174 - DNA, 20 bp, mouse
ggcccacccctcgcgaggtc

SEQ ID NO: 667175 - DNA, 20 bp, mouse
ggatcccgcgatcccaagtt

SEQ ID NO: 667176 - DNA, 20 bp, mouse
gactggtgtagacagactaa

SEQ ID NO: 667177 - DNA, 20 bp, mouse
gggcgaacctcgttgagtcg

SEQ ID NO: 667178 - DNA, 20 bp, mouse
gtaagcaccttgtgaataac

SEQ ID NO: 667179 - DNA, 20 bp, mouse
ggaactcagtctagtagatc

SEQ ID NO: 667180 - DNA, 20 bp, mouse
gcagctctcagcatctgaga

SEQ ID NO: 667181 - DNA, 20 bp, mouse
ggggtgacctcgactcaacg

SEQ ID NO: 667182 - DNA, 20 bp, mouse
gaggcctgatgggtagcagg

SEQ ID NO: 667183 - DNA, 20 bp, mouse
gaggtcagtaagaactactg

SEQ ID NO: 667184 - DNA, 20 bp, mouse
gccgcctcctgctacccatc

SEQ ID NO: 667185 - DNA, 20 bp, mouse
gcgggatgatgggtagcgct

SEQ ID NO: 667186 - DNA, 20 bp, mouse
gcagggcgcgcgcaacccat

SEQ ID NO: 667187 - DNA, 20 bp, mouse
gctacccaatagtgcgtcag

SEQ ID NO: 667188 - DNA, 20 bp, mouse
gttctgggttaggtagaagt

SEQ ID NO: 667189 - DNA, 20 bp, mouse
ggcgccgctgacgcactatt

SEQ ID NO: 667190 - DNA, 20 bp, mouse
gcggcgcggtatttgaatcg

SEQ ID NO: 667191 - DNA, 20 bp, mouse
gcttgtcatagcaaccagcg

SEQ ID NO: 667192 - DNA, 20 bp, mouse
gcgcaacccattggctagac

SEQ ID NO: 667193 - DNA, 20 bp, mouse
gctgaacgacctggagacga

SEQ ID NO: 667194 - DNA, 20 bp, mouse
ggaaaataagactgtagaca

SEQ ID NO: 667195 - DNA, 20 bp, mouse
gtttctgcacgttgattggc

SEQ ID NO: 667196 - DNA, 20 bp, mouse
ggggtcaaaaaattatagta

SEQ ID NO: 667197 - DNA, 20 bp, mouse
gcctgccggtgaaaatggta

SEQ ID NO: 667198 - DNA, 20 bp, mouse
gcgggaatgggcaggtgtgg

SEQ ID NO: 667199 - DNA, 20 bp, mouse
gcggaccgtaccattttcac

SEQ ID NO: 667200 - DNA, 20 bp, mouse
gtagacagttggcagttggc

SEQ ID NO: 667201 - DNA, 20 bp, mouse
gccctgccaaactcagacaa

SEQ ID NO: 667202 - DNA, 20 bp, mouse
gtacaaagctctgtattcac

SEQ ID NO: 667203 - DNA, 20 bp, mouse
gtttcaccggcaggcagggg

SEQ ID NO: 667204 - DNA, 20 bp, mouse
ggcgctagacagttggcagt

SEQ ID NO: 667205 - DNA, 20 bp, mouse
gtggactttaaaccaaggga

SEQ ID NO: 667206 - DNA, 20 bp, mouse
gcaaccgcccgaccgccaat

SEQ ID NO: 667207 - DNA, 20 bp, mouse
gaaacacgggcggaggctcc

SEQ ID NO: 667208 - DNA, 20 bp, mouse
ggctaaggaaacacgggcgg

SEQ ID NO: 667209 - DNA, 20 bp, mouse
gtggcgagaggctctccccg

SEQ ID NO: 667210 - DNA, 20 bp, mouse
ggagcggcgtacaccggttc

SEQ ID NO: 667211 - DNA, 20 bp, mouse
gaagcccattggcggtcggg

SEQ ID NO: 667212 - DNA, 20 bp, mouse
gcggcccgccctagttgcgg

SEQ ID NO: 667213 - DNA, 20 bp, mouse
gcccgcctcaacaagcccat

SEQ ID NO: 667214 - DNA, 20 bp, mouse
gacccagtgtgtggacgctc

SEQ ID NO: 667215 - DNA, 20 bp, mouse
ggcgggagctaaggaaacac

SEQ ID NO: 667216 - DNA, 20 bp, mouse
ggggggctcgggagcagtga

SEQ ID NO: 667217 - DNA, 20 bp, mouse
gccgaggcgggtgcaggggg

SEQ ID NO: 667218 - DNA, 20 bp, mouse
gggtctcggaggaccctctt

SEQ ID NO: 667219 - DNA, 20 bp, mouse
gccacctccacaggtctcgg

SEQ ID NO: 667220 - DNA, 20 bp, mouse
gaccccacctccacaggtct

SEQ ID NO: 667221 - DNA, 20 bp, mouse
gggtcctccgagacctgtgg

SEQ ID NO: 667222 - DNA, 20 bp, mouse
gggagggccgaggcgggtgc

SEQ ID NO: 667223 - DNA, 20 bp, mouse
gctgggaaagagcggggcaa

SEQ ID NO: 667224 - DNA, 20 bp, mouse
gtgcatatctacgaaggctg

SEQ ID NO: 667225 - DNA, 20 bp, mouse
ggcgatttgcatatctacga

SEQ ID NO: 667226 - DNA, 20 bp, mouse
gagggacgctagaggagggg

SEQ ID NO: 667227 - DNA, 20 bp, mouse
gaggggagggacgctagagg

SEQ ID NO: 667228 - DNA, 20 bp, mouse
gctagcatgcggggctggat

SEQ ID NO: 667229 - DNA, 20 bp, mouse
gaggaggggagggacgctag

SEQ ID NO: 667230 - DNA, 20 bp, mouse
gcatgctaggggcctcggat

SEQ ID NO: 667231 - DNA, 20 bp, mouse
ggagggagggaaagattgaa

SEQ ID NO: 667232 - DNA, 20 bp, mouse
ggagagggcctcggagaagt

SEQ ID NO: 667233 - DNA, 20 bp, mouse
gccgaggcccctagcatgcg

SEQ ID NO: 667234 - DNA, 20 bp, mouse
ggcagtgacgcaagctggaa

SEQ ID NO: 667235 - DNA, 20 bp, mouse
ggtgtgctctctaacttcgg

SEQ ID NO: 667236 - DNA, 20 bp, mouse
gggtgagataacaggtgtcg

SEQ ID NO: 667237 - DNA, 20 bp, mouse
gagacccgatgaatagagta

SEQ ID NO: 667238 - DNA, 20 bp, mouse
gtatcacgtgggggagactg

SEQ ID NO: 667239 - DNA, 20 bp, mouse
ggggcccccagttatcacgt

SEQ ID NO: 667240 - DNA, 20 bp, mouse
gggtgtcagagaccagaccc

SEQ ID NO: 667241 - DNA, 20 bp, mouse
gttaggggtacacattgcag

SEQ ID NO: 667242 - DNA, 20 bp, mouse
gtctcccccacgtgataact

SEQ ID NO: 667243 - DNA, 20 bp, mouse
ggggttgctccgtcaggctt

SEQ ID NO: 667244 - DNA, 20 bp, mouse
gactgaggcacggtgaggtt

SEQ ID NO: 667245 - DNA, 20 bp, mouse
gtgagcaggaagtggggacg

SEQ ID NO: 667246 - DNA, 20 bp, mouse
gagtgggcaggtttccagtg

SEQ ID NO: 667247 - DNA, 20 bp, mouse
gtgggcgggtctctgggggt

SEQ ID NO: 667248 - DNA, 20 bp, mouse
gggccccgccgcagtacttc

SEQ ID NO: 667249 - DNA, 20 bp, mouse
gtctccaggccgggccagcg

SEQ ID NO: 667250 - DNA, 20 bp, mouse
gcggggtcgctacactgaga

SEQ ID NO: 667251 - DNA, 20 bp, mouse
ggaggcgtggacggatggcc

SEQ ID NO: 667252 - DNA, 20 bp, mouse
gggccgggccagcggggagt

SEQ ID NO: 667253 - DNA, 20 bp, mouse
gcccagagacccgcccactc

SEQ ID NO: 667254 - DNA, 20 bp, mouse
ggggacgcgctgtgtgttgc

SEQ ID NO: 667255 - DNA, 20 bp, mouse
gggggggaggcgtggacgga

SEQ ID NO: 667256 - DNA, 20 bp, mouse
gggtccgcgcggcgacgggg

SEQ ID NO: 667257 - DNA, 20 bp, mouse
gccagcgaggagctctggtg

SEQ ID NO: 667258 - DNA, 20 bp, mouse
gtggcatgcactaaaggggt

SEQ ID NO: 667259 - DNA, 20 bp, mouse
gggcccgccccgtcgccgcg

SEQ ID NO: 667260 - DNA, 20 bp, mouse
gggcggggtgcggacgtggt

SEQ ID NO: 667261 - DNA, 20 bp, mouse
ggggacgcgggagagtcgtc

SEQ ID NO: 667262 - DNA, 20 bp, mouse
gcgggcgtggcatgcactaa

SEQ ID NO: 667263 - DNA, 20 bp, mouse
gccctcggggcggggcgcga

SEQ ID NO: 667264 - DNA, 20 bp, mouse
ggcggaccagcgaggagctc

SEQ ID NO: 667265 - DNA, 20 bp, mouse
ggggccgggaggagcggcat

SEQ ID NO: 667266 - DNA, 20 bp, mouse
ggggcccggcgcgaactgga

SEQ ID NO: 667267 - DNA, 20 bp, mouse
gcgggcgccgagtggccgta

SEQ ID NO: 667268 - DNA, 20 bp, mouse
ggggcggaggagcacggtcc

SEQ ID NO: 667269 - DNA, 20 bp, mouse
gcgcaggtgaagcgccgaga

SEQ ID NO: 667270 - DNA, 20 bp, mouse
gagcccgtccgcgcgcactg

SEQ ID NO: 667271 - DNA, 20 bp, mouse
ggtccaggagggcagccgta

SEQ ID NO: 667272 - DNA, 20 bp, mouse
ggcgccgggccccctcacgg

SEQ ID NO: 667273 - DNA, 20 bp, mouse
gggaggagcacggtccagga

SEQ ID NO: 667274 - DNA, 20 bp, mouse
ggcgtgcgggagcctgtggt

SEQ ID NO: 667275 - DNA, 20 bp, mouse
gtccgcgcgcactgagggca

SEQ ID NO: 667276 - DNA, 20 bp, mouse
ggtcccccgcccagcggaga

SEQ ID NO: 667277 - DNA, 20 bp, mouse
gtcaaacgctggctgtctat

SEQ ID NO: 667278 - DNA, 20 bp, mouse
gcaggagaggctagtgatct

SEQ ID NO: 667279 - DNA, 20 bp, mouse
ggagaggctagtgatctggg

SEQ ID NO: 667280 - DNA, 20 bp, mouse
gggctctgggcatttgtgat

SEQ ID NO: 667281 - DNA, 20 bp, mouse
ggcccgcccggaggcagaga

SEQ ID NO: 667282 - DNA, 20 bp, mouse
gaggacgcgaattcaaacgc

SEQ ID NO: 667283 - DNA, 20 bp, mouse
gcgcgcctggggcaagtgca

SEQ ID NO: 667284 - DNA, 20 bp, mouse
gtctcctgccccgcaggctc

SEQ ID NO: 667285 - DNA, 20 bp, mouse
gacggtaggacaagtcttgg

SEQ ID NO: 667286 - DNA, 20 bp, mouse
ggtcgggcgtggctcgaaag

SEQ ID NO: 667287 - DNA, 20 bp, mouse
gaggctgcgagagtcgggcg

SEQ ID NO: 667288 - DNA, 20 bp, mouse
gggaaatgctccaatgagag

SEQ ID NO: 667289 - DNA, 20 bp, mouse
gctctcgcagcctctctcat

SEQ ID NO: 667290 - DNA, 20 bp, mouse
ggggcgtggctcgaaagggg

SEQ ID NO: 667291 - DNA, 20 bp, mouse
gggggaggagaattgaagtc

SEQ ID NO: 667292 - DNA, 20 bp, mouse
ggacctgcccgggcaagcct

SEQ ID NO: 667293 - DNA, 20 bp, mouse
gggaccagaatgtactgtga

SEQ ID NO: 667294 - DNA, 20 bp, mouse
gtccgctacccagaccaatc

SEQ ID NO: 667295 - DNA, 20 bp, mouse
gcagttccgcagcttaagga

SEQ ID NO: 667296 - DNA, 20 bp, mouse
ggtcttagacgtaatggaaa

SEQ ID NO: 667297 - DNA, 20 bp, mouse
gcctggctatctctgcattg

SEQ ID NO: 667298 - DNA, 20 bp, mouse
gcaccagctgaacaccctgt

SEQ ID NO: 667299 - DNA, 20 bp, mouse
ggtggggcagtatctatttg

SEQ ID NO: 667300 - DNA, 20 bp, mouse
gctgaacaccctgttggaac

SEQ ID NO: 667301 - DNA, 20 bp, mouse
gttcacgttgttaacatata

SEQ ID NO: 667302 - DNA, 20 bp, mouse
gttgtataggacataaacta

SEQ ID NO: 667303 - DNA, 20 bp, mouse
ggtcttcgtcttagacgtaa

SEQ ID NO: 667304 - DNA, 20 bp, mouse
gaatcgtatttctacttcat

SEQ ID NO: 667305 - DNA, 20 bp, mouse
gagtttgggtgtatcatgtg

SEQ ID NO: 667306 - DNA, 20 bp, mouse
ggaacagaaggggccaagag

SEQ ID NO: 667307 - DNA, 20 bp, mouse
ggaggagcaagatgcagccg

SEQ ID NO: 667308 - DNA, 20 bp, mouse
gggaactgaggctcggagca

SEQ ID NO: 667309 - DNA, 20 bp, mouse
ggcggcggggaggtcggatg

SEQ ID NO: 667310 - DNA, 20 bp, mouse
ggaaggggccaagagaggct

SEQ ID NO: 667311 - DNA, 20 bp, mouse
gctggctccgcaaggccaag

SEQ ID NO: 667312 - DNA, 20 bp, mouse
gtcctcgctcgctcgcccag

SEQ ID NO: 667313 - DNA, 20 bp, mouse
gaggtcggatgcgggtctcg

SEQ ID NO: 667314 - DNA, 20 bp, mouse
gaggaggtggcggtgcaggg

SEQ ID NO: 667315 - DNA, 20 bp, mouse
gcactccctaccatagatcc

SEQ ID NO: 667316 - DNA, 20 bp, mouse
ggggaggtgttccgcaacga

SEQ ID NO: 667317 - DNA, 20 bp, mouse
gccaaagcctgggagccccg

SEQ ID NO: 667318 - DNA, 20 bp, mouse
gctgaagggcgtgacccagg

SEQ ID NO: 667319 - DNA, 20 bp, mouse
gcccaggagggtcagaaagt

SEQ ID NO: 667320 - DNA, 20 bp, mouse
ggctccgccctccctcgttg

SEQ ID NO: 667321 - DNA, 20 bp, mouse
ggggctcccaggctttgggg

SEQ ID NO: 667322 - DNA, 20 bp, mouse
gagtctgaagggcgtgaccc

SEQ ID NO: 667323 - DNA, 20 bp, mouse
ggttgcggaacacctcccac

SEQ ID NO: 667324 - DNA, 20 bp, mouse
gaggtgttccgcaacgaggg

SEQ ID NO: 667325 - DNA, 20 bp, mouse
gagactcctccccaaagcct

SEQ ID NO: 667326 - DNA, 20 bp, mouse
gtggggaaggcgctgggact

SEQ ID NO: 667327 - DNA, 20 bp, mouse
ggccttccccaggtcgtctc

SEQ ID NO: 667328 - DNA, 20 bp, mouse
gtccggagacgacctgggga

SEQ ID NO: 667329 - DNA, 20 bp, mouse
gggccgaaatcagtccgcga

SEQ ID NO: 667330 - DNA, 20 bp, mouse
gcctgtgcgtccataagaca

SEQ ID NO: 667331 - DNA, 20 bp, mouse
ggcctgttcggtgacgtaag

SEQ ID NO: 667332 - DNA, 20 bp, mouse
gtgcgtccgtgggacaccgg

SEQ ID NO: 667333 - DNA, 20 bp, mouse
ggctgggactgggatgaaaa

SEQ ID NO: 667334 - DNA, 20 bp, mouse
gagcttccggagacgacctg

SEQ ID NO: 667335 - DNA, 20 bp, mouse
ggacgacctggggaaggcgc

SEQ ID NO: 667336 - DNA, 20 bp, mouse
ggggcgccgacagaccgcgg

SEQ ID NO: 667337 - DNA, 20 bp, mouse
gcggcaccgggcaggggccc

SEQ ID NO: 667338 - DNA, 20 bp, mouse
ggcccctgcccggtgccggg

SEQ ID NO: 667339 - DNA, 20 bp, mouse
gagaccgcccggcaccgggc

SEQ ID NO: 667340 - DNA, 20 bp, mouse
gctcgggcgccgacagaccg

SEQ ID NO: 667341 - DNA, 20 bp, mouse
ggagcgagaccgcccggcac

SEQ ID NO: 667342 - DNA, 20 bp, mouse
gctgccaagttttaatcccg

SEQ ID NO: 667343 - DNA, 20 bp, mouse
gcgcctcgccgtccaatcgg

SEQ ID NO: 667344 - DNA, 20 bp, mouse
gcccctcggaagtgagacag

SEQ ID NO: 667345 - DNA, 20 bp, mouse
ggctgcagagcgagaccgcc

SEQ ID NO: 667346 - DNA, 20 bp, mouse
gccccgcgctccaggatcaa

SEQ ID NO: 667347 - DNA, 20 bp, mouse
ggtgccgcgcgtggatccag

SEQ ID NO: 667348 - DNA, 20 bp, mouse
gtagctttctgcccgggcga

SEQ ID NO: 667349 - DNA, 20 bp, mouse
gggatcgcccccagagtccc

SEQ ID NO: 667350 - DNA, 20 bp, mouse
gcggaagtcagaactttctg

SEQ ID NO: 667351 - DNA, 20 bp, mouse
gcccccaattccccgagcga

SEQ ID NO: 667352 - DNA, 20 bp, mouse
gctccaggatcaagggggca

SEQ ID NO: 667353 - DNA, 20 bp, mouse
ggaccctgcccccttgatcc

SEQ ID NO: 667354 - DNA, 20 bp, mouse
gagctaggcttcaccttccc

SEQ ID NO: 667355 - DNA, 20 bp, mouse
gctccctcgctcggggaatt

SEQ ID NO: 667356 - DNA, 20 bp, mouse
gtggacatcagcaaccgggg

SEQ ID NO: 667357 - DNA, 20 bp, mouse
ggtggactgcggcccgtagg

SEQ ID NO: 667358 - DNA, 20 bp, mouse
gcacaaggccgcagggtagg

SEQ ID NO: 667359 - DNA, 20 bp, mouse
gggccgccgccgccgttcat

SEQ ID NO: 667360 - DNA, 20 bp, mouse
gctggcgggcggatgggcgg

SEQ ID NO: 667361 - DNA, 20 bp, mouse
ggggccgaagttccgttaac

SEQ ID NO: 667362 - DNA, 20 bp, mouse
gcgccgctccgcctaccctg

SEQ ID NO: 667363 - DNA, 20 bp, mouse
gtaggcggcggggctgtctc

SEQ ID NO: 667364 - DNA, 20 bp, mouse
gccgcagtccacaaggccgc

SEQ ID NO: 667365 - DNA, 20 bp, mouse
gactgcggcccgtaggggga

SEQ ID NO: 667366 - DNA, 20 bp, mouse
ggaagcgcggaggaactcgt

SEQ ID NO: 667367 - DNA, 20 bp, mouse
gcgggcggaggggtccggat

SEQ ID NO: 667368 - DNA, 20 bp, mouse
gagaccgtgcaggggtatcg

SEQ ID NO: 667369 - DNA, 20 bp, mouse
ggtcaccgaccgaagcgcgg

SEQ ID NO: 667370 - DNA, 20 bp, mouse
gcggaggggtccggatgggc

SEQ ID NO: 667371 - DNA, 20 bp, mouse
gcggaagcgcacgctgcgtg

SEQ ID NO: 667372 - DNA, 20 bp, mouse
ggacaccgggcggaggggtc

SEQ ID NO: 667373 - DNA, 20 bp, mouse
ggcagggtgctggcggctca

SEQ ID NO: 667374 - DNA, 20 bp, mouse
gagttcctccgcgcttcggt

SEQ ID NO: 667375 - DNA, 20 bp, mouse
ggcgcgcgcggggagtggag

SEQ ID NO: 667376 - DNA, 20 bp, mouse
gccaggccgcggagccaagt

SEQ ID NO: 667377 - DNA, 20 bp, mouse
gccggaagcacccacgggtg

SEQ ID NO: 667378 - DNA, 20 bp, mouse
gagcccgaggacggaaggga

SEQ ID NO: 667379 - DNA, 20 bp, mouse
gaactctagctgtagagaga

SEQ ID NO: 667380 - DNA, 20 bp, mouse
gaacgagcagccccacccgt

SEQ ID NO: 667381 - DNA, 20 bp, mouse
gggactggtcgtacggccaa

SEQ ID NO: 667382 - DNA, 20 bp, mouse
gtggcaaaaggggttctaga

SEQ ID NO: 667383 - DNA, 20 bp, mouse
gccgacgccggaagcaccca

SEQ ID NO: 667384 - DNA, 20 bp, mouse
ggtgcctgacgcgacactga

SEQ ID NO: 667385 - DNA, 20 bp, mouse
gcggctgctcgagacgatcg

SEQ ID NO: 667386 - DNA, 20 bp, mouse
gggcccccgcgctggttgca

SEQ ID NO: 667387 - DNA, 20 bp, mouse
gggcgccaggacccgggctg

SEQ ID NO: 667388 - DNA, 20 bp, mouse
gtgctcgcacgcgaggggtg

SEQ ID NO: 667389 - DNA, 20 bp, mouse
gacgggccgcgctttcccgg

SEQ ID NO: 667390 - DNA, 20 bp, mouse
gacccgggctgcggttgcca

SEQ ID NO: 667391 - DNA, 20 bp, mouse
gccccctgcaaccagcgcgg

SEQ ID NO: 667392 - DNA, 20 bp, mouse
gcctccccctgcaaccagcg

SEQ ID NO: 667393 - DNA, 20 bp, mouse
gcaacgcgtggcccccgcgc

SEQ ID NO: 667394 - DNA, 20 bp, mouse
gggcccatggctcccctagg

SEQ ID NO: 667395 - DNA, 20 bp, mouse
ggcgcggagcctgcagctga

SEQ ID NO: 667396 - DNA, 20 bp, mouse
gcgtctacggggtgtcggag

SEQ ID NO: 667397 - DNA, 20 bp, mouse
gcacctggcggtcacacgac

SEQ ID NO: 667398 - DNA, 20 bp, mouse
gctggctgtggattcgtcta

SEQ ID NO: 667399 - DNA, 20 bp, mouse
gcgaatccacagccagtccg

SEQ ID NO: 667400 - DNA, 20 bp, mouse
gcgcgcgagaactgcggtaa

SEQ ID NO: 667401 - DNA, 20 bp, mouse
gggtgtcggaggggtcattc

SEQ ID NO: 667402 - DNA, 20 bp, mouse
gtccgcggctaagaacggac

SEQ ID NO: 667403 - DNA, 20 bp, mouse
gctccaaggggcgaccaccg

SEQ ID NO: 667404 - DNA, 20 bp, mouse
gcggaagtgtgtcacaacct

SEQ ID NO: 667405 - DNA, 20 bp, mouse
gaagtcggcgctggaatctt

SEQ ID NO: 667406 - DNA, 20 bp, mouse
ggggagacgccgtaaagtgg

SEQ ID NO: 667407 - DNA, 20 bp, mouse
gcgtgcgcgtgggtagcagc

SEQ ID NO: 667408 - DNA, 20 bp, mouse
gactccgcgccaatgtgtcg

SEQ ID NO: 667409 - DNA, 20 bp, mouse
ggctctgcgcctcttgtcat

SEQ ID NO: 667410 - DNA, 20 bp, mouse
ggggcggggcctcgacacat

SEQ ID NO: 667411 - DNA, 20 bp, mouse
ggtcctgaggctgcctaata

SEQ ID NO: 667412 - DNA, 20 bp, mouse
gccagcgcgagccggcaggg

SEQ ID NO: 667413 - DNA, 20 bp, mouse
ggtagcagcaggcccggaaa

SEQ ID NO: 667414 - DNA, 20 bp, mouse
gtcccggaggcaggcgggga

SEQ ID NO: 667415 - DNA, 20 bp, mouse
gggcggggcgaacagggaag

SEQ ID NO: 667416 - DNA, 20 bp, mouse
gagggggcgcacactggagg

SEQ ID NO: 667417 - DNA, 20 bp, mouse
gcaaccgtggcgtgcggctg

SEQ ID NO: 667418 - DNA, 20 bp, mouse
gtgcgcgcggatacgcagac

SEQ ID NO: 667419 - DNA, 20 bp, mouse
gggccgacgcggccaggcgt

SEQ ID NO: 667420 - DNA, 20 bp, mouse
gggctccggcagccacaagg

SEQ ID NO: 667421 - DNA, 20 bp, mouse
ggcgtggcctagcagagagg

SEQ ID NO: 667422 - DNA, 20 bp, mouse
gcggacgctcccgctaactg

SEQ ID NO: 667423 - DNA, 20 bp, mouse
ggcacgacaaccgtggcgtg

SEQ ID NO: 667424 - DNA, 20 bp, mouse
ggccccacgcctggccgcgt

SEQ ID NO: 667425 - DNA, 20 bp, mouse
ggaaccccagccgcacgcca

SEQ ID NO: 667426 - DNA, 20 bp, mouse
gccgtaggcgggtgcgtgga

SEQ ID NO: 667427 - DNA, 20 bp, mouse
gcggcgcagctcgagatgaa

SEQ ID NO: 667428 - DNA, 20 bp, mouse
gcacgtgcctgggccgtagg

SEQ ID NO: 667429 - DNA, 20 bp, mouse
gagggaagtccgggtctgat

SEQ ID NO: 667430 - DNA, 20 bp, mouse
gctagcggccttcagttcgg

SEQ ID NO: 667431 - DNA, 20 bp, mouse
gaacgcgctccgcggtcacc

SEQ ID NO: 667432 - DNA, 20 bp, mouse
gcggggcccgccttgaaggg

SEQ ID NO: 667433 - DNA, 20 bp, mouse
gaaggcgggccccgaaggtc

SEQ ID NO: 667434 - DNA, 20 bp, mouse
ggcggccttcagttcggagg

SEQ ID NO: 667435 - DNA, 20 bp, mouse
gcggctagcggccttcagtt

SEQ ID NO: 667436 - DNA, 20 bp, mouse
ggccctgaggagactttcta

SEQ ID NO: 667437 - DNA, 20 bp, mouse
gcggaagtaccggccctgag

SEQ ID NO: 667438 - DNA, 20 bp, mouse
gaaacagccaccggaagtac

SEQ ID NO: 667439 - DNA, 20 bp, mouse
ggatgaccgcagtgcacttt

SEQ ID NO: 667440 - DNA, 20 bp, mouse
gagttgcggggaatatacag

SEQ ID NO: 667441 - DNA, 20 bp, mouse
ggcgggcagttgaagcggtt

SEQ ID NO: 667442 - DNA, 20 bp, mouse
ggtttggcgggcagttgaag

SEQ ID NO: 667443 - DNA, 20 bp, mouse
gaacttcccaggaacacttt

SEQ ID NO: 667444 - DNA, 20 bp, mouse
gctgaggggtggagttgagc

SEQ ID NO: 667445 - DNA, 20 bp, mouse
gaggggtggagttgagctgg

SEQ ID NO: 667446 - DNA, 20 bp, mouse
gagctggcaggagacgtagg

SEQ ID NO: 667447 - DNA, 20 bp, mouse
ggcgagctggcaggagacgt

SEQ ID NO: 667448 - DNA, 20 bp, mouse
ggggctgccacactggaaga

SEQ ID NO: 667449 - DNA, 20 bp, mouse
gcagcttccggtagcctcag

SEQ ID NO: 667450 - DNA, 20 bp, mouse
gttctggggaggaagacggt

SEQ ID NO: 667451 - DNA, 20 bp, mouse
ggggctcccacgcctgcagc

SEQ ID NO: 667452 - DNA, 20 bp, mouse
gggcaaccggctgcaggcgt

SEQ ID NO: 667453 - DNA, 20 bp, mouse
gcgtgggagcccggatgttg

SEQ ID NO: 667454 - DNA, 20 bp, mouse
gccggtagcctcaggggtgc

SEQ ID NO: 667455 - DNA, 20 bp, mouse
gaaagcaacagcaagacgat

SEQ ID NO: 667456 - DNA, 20 bp, mouse
gcaaagagaggggatgcctc

SEQ ID NO: 667457 - DNA, 20 bp, mouse
gtatagatctccaaagagag

SEQ ID NO: 667458 - DNA, 20 bp, mouse
gggagcagaagaaaggtatg

SEQ ID NO: 667459 - DNA, 20 bp, mouse
gaatgaatgaggacctccag

SEQ ID NO: 667460 - DNA, 20 bp, mouse
gagagaaaaacattccttga

SEQ ID NO: 667461 - DNA, 20 bp, mouse
gagagaggggatgcctctgg

SEQ ID NO: 667462 - DNA, 20 bp, mouse
gcattagccagatgattttg

SEQ ID NO: 667463 - DNA, 20 bp, mouse
gtggagcaattgatgtgtgt

SEQ ID NO: 667464 - DNA, 20 bp, mouse
ggtgtgggcgtgtaaatgta

SEQ ID NO: 667465 - DNA, 20 bp, mouse
ggctagtcatagagttcttg

SEQ ID NO: 667466 - DNA, 20 bp, mouse
gttacacagcgaaggctcag

SEQ ID NO: 667467 - DNA, 20 bp, mouse
gcgtgctcctggctcagtgc

SEQ ID NO: 667468 - DNA, 20 bp, mouse
gactgtactttacacagcga

SEQ ID NO: 667469 - DNA, 20 bp, mouse
ggatagaaatcgggcaaggt

SEQ ID NO: 667470 - DNA, 20 bp, mouse
gcctcagccctattacgaaa

SEQ ID NO: 667471 - DNA, 20 bp, mouse
gactagatagaaatcgggca

SEQ ID NO: 667472 - DNA, 20 bp, mouse
gccaaggctgacaaggactg

SEQ ID NO: 667473 - DNA, 20 bp, mouse
gaatacccccaattaaccca

SEQ ID NO: 667474 - DNA, 20 bp, mouse
gtgaaggtgaatcgtgctcc

SEQ ID NO: 667475 - DNA, 20 bp, mouse
gacacctagagatggaatga

SEQ ID NO: 667476 - DNA, 20 bp, mouse
gtggtttaatgtgggtagaa

SEQ ID NO: 667477 - DNA, 20 bp, mouse
gcagctaaagccctggaagg

SEQ ID NO: 667478 - DNA, 20 bp, mouse
gtgtgtaaggagaatgcaaa

SEQ ID NO: 667479 - DNA, 20 bp, mouse
gcacagaatggtgagaatga

SEQ ID NO: 667480 - DNA, 20 bp, mouse
gctaaaccctgaagttgaaa

SEQ ID NO: 667481 - DNA, 20 bp, mouse
gggaaagtccaaccattgta

SEQ ID NO: 667482 - DNA, 20 bp, mouse
gcactagtaaatagttcaat

SEQ ID NO: 667483 - DNA, 20 bp, mouse
gtgaattactggtttaatgt

SEQ ID NO: 667484 - DNA, 20 bp, mouse
gagtccagcagctaaagccc

SEQ ID NO: 667485 - DNA, 20 bp, mouse
gcagcagctaaagccctgga

SEQ ID NO: 667486 - DNA, 20 bp, mouse
gatactgaagcaggggtata

SEQ ID NO: 667487 - DNA, 20 bp, mouse
gggacctgagagtggatctt

SEQ ID NO: 667488 - DNA, 20 bp, mouse
ggcccaacatataacactcc

SEQ ID NO: 667489 - DNA, 20 bp, mouse
gctgaaatatactgaagcag

SEQ ID NO: 667490 - DNA, 20 bp, mouse
gagccaggagtgttatatgt

SEQ ID NO: 667491 - DNA, 20 bp, mouse
gagtgttatatgttgggctg

SEQ ID NO: 667492 - DNA, 20 bp, mouse
ggttgggctgaggtctttac

SEQ ID NO: 667493 - DNA, 20 bp, mouse
gaagaagaactgtagatctt

SEQ ID NO: 667494 - DNA, 20 bp, mouse
gaggtggtaagaacatctcg

SEQ ID NO: 667495 - DNA, 20 bp, mouse
gaaaaacgtgaactcattgc

SEQ ID NO: 667496 - DNA, 20 bp, mouse
gcggaagaactgtaacaagt

SEQ ID NO: 667497 - DNA, 20 bp, mouse
gctctctgttgagttatcta

SEQ ID NO: 667498 - DNA, 20 bp, mouse
gggaatttcctcttaaggaa

SEQ ID NO: 667499 - DNA, 20 bp, mouse
gtatgaggacaagcaagtaa

SEQ ID NO: 667500 - DNA, 20 bp, mouse
gactaggtgtccagcaaggc

SEQ ID NO: 667501 - DNA, 20 bp, mouse
ggactgtggaaaaacaatgt

SEQ ID NO: 667502 - DNA, 20 bp, mouse
gtgtgcagtaaataacaaaa

SEQ ID NO: 667503 - DNA, 20 bp, mouse
gtccatgagtcaatgattat

SEQ ID NO: 667504 - DNA, 20 bp, mouse
gcatttttttatgtatgata

SEQ ID NO: 667505 - DNA, 20 bp, mouse
gttaaaaaggctagcttctc

SEQ ID NO: 667506 - DNA, 20 bp, mouse
gggaggcaggcggtcatcct

SEQ ID NO: 667507 - DNA, 20 bp, mouse
gcccaaacgcaaagctaggc

SEQ ID NO: 667508 - DNA, 20 bp, mouse
gaagccctgggtctaatcgc

SEQ ID NO: 667509 - DNA, 20 bp, mouse
gagaagccccacatgggtga

SEQ ID NO: 667510 - DNA, 20 bp, mouse
gctctcccctcacccatgtg

SEQ ID NO: 667511 - DNA, 20 bp, mouse
gttgtcaagaagccccacat

SEQ ID NO: 667512 - DNA, 20 bp, mouse
ggcctcaaaaaagaatggat

SEQ ID NO: 667513 - DNA, 20 bp, mouse
gtgtagtttcttctgtggca

SEQ ID NO: 667514 - DNA, 20 bp, mouse
gggtcctgcgattagaccca

SEQ ID NO: 667515 - DNA, 20 bp, mouse
gaccagcctagctttgcgtt

SEQ ID NO: 667516 - DNA, 20 bp, mouse
gacgtagtgttcagggttgg

SEQ ID NO: 667517 - DNA, 20 bp, mouse
gactctcttgactcaaatgt

SEQ ID NO: 667518 - DNA, 20 bp, mouse
gctggactgaaagttttttg

SEQ ID NO: 667519 - DNA, 20 bp, mouse
gattacgtagtgttcagggt

SEQ ID NO: 667520 - DNA, 20 bp, mouse
gaggtattacgtagtgttca

SEQ ID NO: 667521 - DNA, 20 bp, mouse
gatccaactacacacttcgt

SEQ ID NO: 667522 - DNA, 20 bp, mouse
gctcactggtaaagccaaaa

SEQ ID NO: 667523 - DNA, 20 bp, mouse
gtgaaatgtaggacagcgag

SEQ ID NO: 667524 - DNA, 20 bp, mouse
gctcccatctcactttaaat

SEQ ID NO: 667525 - DNA, 20 bp, mouse
gcagtttcttgcagagaggg

SEQ ID NO: 667526 - DNA, 20 bp, mouse
gttgactccaagtcaggtga

SEQ ID NO: 667527 - DNA, 20 bp, mouse
gaggtggggaccactactat

SEQ ID NO: 667528 - DNA, 20 bp, mouse
gctccagcatcctcagtccc

SEQ ID NO: 667529 - DNA, 20 bp, mouse
gtacagcctgtaagttgaaa

SEQ ID NO: 667530 - DNA, 20 bp, mouse
gtggggcagcatcttgcttg

SEQ ID NO: 667531 - DNA, 20 bp, mouse
gtctacatgaggtgttgggg

SEQ ID NO: 667532 - DNA, 20 bp, mouse
gtcaacttacaggctgtaca

SEQ ID NO: 667533 - DNA, 20 bp, mouse
gggtccatatcaaagtctcc

SEQ ID NO: 667534 - DNA, 20 bp, mouse
gtaaataggaagtggtgagt

SEQ ID NO: 667535 - DNA, 20 bp, mouse
ggagaatgagcggtttgcac

SEQ ID NO: 667536 - DNA, 20 bp, mouse
gtcctccagtagcaaaaata

SEQ ID NO: 667537 - DNA, 20 bp, mouse
gctgactatagtccactagg

SEQ ID NO: 667538 - DNA, 20 bp, mouse
ggggtgacaacccaaggctc

SEQ ID NO: 667539 - DNA, 20 bp, mouse
gcaaacaaagactgtcctgg

SEQ ID NO: 667540 - DNA, 20 bp, mouse
gagccaaacaaagactgtcc

SEQ ID NO: 667541 - DNA, 20 bp, mouse
gaacaccagcgatttctggt

SEQ ID NO: 667542 - DNA, 20 bp, mouse
gactgtaaagttctttgaaa

SEQ ID NO: 667543 - DNA, 20 bp, mouse
ggcatgggtgccagagcctt

SEQ ID NO: 667544 - DNA, 20 bp, mouse
gcaaggtgggtgacaaccca

SEQ ID NO: 667545 - DNA, 20 bp, mouse
gtatagtccactaggtggac

SEQ ID NO: 667546 - DNA, 20 bp, mouse
gacgcctgggtggctgctgt

SEQ ID NO: 667547 - DNA, 20 bp, mouse
gtacaaggcactactaccag

SEQ ID NO: 667548 - DNA, 20 bp, mouse
ggctgcgcaggtgtatgtcg

SEQ ID NO: 667549 - DNA, 20 bp, mouse
gactaccaggggctttctga

SEQ ID NO: 667550 - DNA, 20 bp, mouse
gagtgccaagcacgcctggg

SEQ ID NO: 667551 - DNA, 20 bp, mouse
gcacctgcgcagccagggtg

SEQ ID NO: 667552 - DNA, 20 bp, mouse
gtcctccctgagtctctaca

SEQ ID NO: 667553 - DNA, 20 bp, mouse
ggccttgtagagactcaggg

SEQ ID NO: 667554 - DNA, 20 bp, mouse
ggcaaacgactcagtgattc

SEQ ID NO: 667555 - DNA, 20 bp, mouse
gagtgccttgtagagactca

SEQ ID NO: 667556 - DNA, 20 bp, mouse
gccaaacagcagaggggttg

SEQ ID NO: 667557 - DNA, 20 bp, mouse
gctggggcagagataagcag

SEQ ID NO: 667558 - DNA, 20 bp, mouse
gacagcgtgctatgcaacca

SEQ ID NO: 667559 - DNA, 20 bp, mouse
gactgagagtcaaggagccc

SEQ ID NO: 667560 - DNA, 20 bp, mouse
gctcccataccaccatccag

SEQ ID NO: 667561 - DNA, 20 bp, mouse
ggcacgctgttccattgctc

SEQ ID NO: 667562 - DNA, 20 bp, mouse
gcatgcctcagccaatccaa

SEQ ID NO: 667563 - DNA, 20 bp, mouse
gttcctctggatggtggtat

SEQ ID NO: 667564 - DNA, 20 bp, mouse
gagccacctgcctaggcctc

SEQ ID NO: 667565 - DNA, 20 bp, mouse
gaacaggaactaagagtaga

SEQ ID NO: 667566 - DNA, 20 bp, mouse
gtctccggctcctgtatcgg

SEQ ID NO: 667567 - DNA, 20 bp, mouse
gtacaggagccggagacatg

SEQ ID NO: 667568 - DNA, 20 bp, mouse
gactccgccagtgacaacac

SEQ ID NO: 667569 - DNA, 20 bp, mouse
gtggctggtagctatagaac

SEQ ID NO: 667570 - DNA, 20 bp, mouse
ggcggagtaacccagaaggg

SEQ ID NO: 667571 - DNA, 20 bp, mouse
gccagtgacaacacaggcag

SEQ ID NO: 667572 - DNA, 20 bp, mouse
gctaaggaccaccagggtta

SEQ ID NO: 667573 - DNA, 20 bp, mouse
gggtggctccccacccttct

SEQ ID NO: 667574 - DNA, 20 bp, mouse
gccggagacatggggagtcc

SEQ ID NO: 667575 - DNA, 20 bp, mouse
gaggcccccgatacaggagc

SEQ ID NO: 667576 - DNA, 20 bp, mouse
gtgggcttggaatcacagga

SEQ ID NO: 667577 - DNA, 20 bp, mouse
ggacctaggggagaaactgg

SEQ ID NO: 667578 - DNA, 20 bp, mouse
gtgaagacttagtttgggct

SEQ ID NO: 667579 - DNA, 20 bp, mouse
gtaccgttctggggtcagta

SEQ ID NO: 667580 - DNA, 20 bp, mouse
gagtttgggcttggaatcac

SEQ ID NO: 667581 - DNA, 20 bp, mouse
gcagaacggtacttggactt

SEQ ID NO: 667582 - DNA, 20 bp, mouse
gagttgaaacaccagtcaaa

SEQ ID NO: 667583 - DNA, 20 bp, mouse
gtagatgtgaagacttagtt

SEQ ID NO: 667584 - DNA, 20 bp, mouse
gaacccccagtttctcccct

SEQ ID NO: 667585 - DNA, 20 bp, mouse
gcggtcgggaacttaaattt

SEQ ID NO: 667586 - DNA, 20 bp, mouse
ggaagcaagtggtatcagtc

SEQ ID NO: 667587 - DNA, 20 bp, mouse
gatcagtcgggaaggaggtt

SEQ ID NO: 667588 - DNA, 20 bp, mouse
gcaagtggtatcagtcggga

SEQ ID NO: 667589 - DNA, 20 bp, mouse
ggaaggaagcagttgatgct

SEQ ID NO: 667590 - DNA, 20 bp, mouse
gtatcactggaagcaggcgt

SEQ ID NO: 667591 - DNA, 20 bp, mouse
gcgctcaggggaagccccgg

SEQ ID NO: 667592 - DNA, 20 bp, mouse
gtatggacacgtttgtactc

SEQ ID NO: 667593 - DNA, 20 bp, mouse
gactgtgaggaggggagact

SEQ ID NO: 667594 - DNA, 20 bp, mouse
gctccaggctgcctcggata

SEQ ID NO: 667595 - DNA, 20 bp, mouse
gtcaggtggactgtgaggag

SEQ ID NO: 667596 - DNA, 20 bp, mouse
gtccacaggctgggaatccc

SEQ ID NO: 667597 - DNA, 20 bp, mouse
gtagatctcccacggggcgg

SEQ ID NO: 667598 - DNA, 20 bp, mouse
gcgactgtagatctcccacg

SEQ ID NO: 667599 - DNA, 20 bp, mouse
gcggccgagaatggaccgtc

SEQ ID NO: 667600 - DNA, 20 bp, mouse
gagtcagacccggacagctc

SEQ ID NO: 667601 - DNA, 20 bp, mouse
gtccgcctctcgtgcctgag

SEQ ID NO: 667602 - DNA, 20 bp, mouse
gctgcaatgggagcgtccac

SEQ ID NO: 667603 - DNA, 20 bp, mouse
gtggagcccacagctcgggg

SEQ ID NO: 667604 - DNA, 20 bp, mouse
gggacagctccggccgagaa

SEQ ID NO: 667605 - DNA, 20 bp, mouse
gaccagggcgcagtcagacc

SEQ ID NO: 667606 - DNA, 20 bp, mouse
gtcagcaaccggtggtaaat

SEQ ID NO: 667607 - DNA, 20 bp, mouse
gcttgagaggggcgcttcgg

SEQ ID NO: 667608 - DNA, 20 bp, mouse
gaggaggcttcgccttgctg

SEQ ID NO: 667609 - DNA, 20 bp, mouse
gggacgccaaatggttacta

SEQ ID NO: 667610 - DNA, 20 bp, mouse
gagggcgtggcatcttgaga

SEQ ID NO: 667611 - DNA, 20 bp, mouse
gcgacagcggactcagcaac

SEQ ID NO: 667612 - DNA, 20 bp, mouse
gaagatggaaccacacagtc

SEQ ID NO: 667613 - DNA, 20 bp, mouse
gctgaggcctctgagctgtc

SEQ ID NO: 667614 - DNA, 20 bp, mouse
gcgctggcgaagctgaaagt

SEQ ID NO: 667615 - DNA, 20 bp, mouse
gccacaaagtagagttgtgt

SEQ ID NO: 667616 - DNA, 20 bp, mouse
gcggaggctggggcaaggag

SEQ ID NO: 667617 - DNA, 20 bp, mouse
gggtctccacctctaccgag

SEQ ID NO: 667618 - DNA, 20 bp, mouse
gggtctgctccactcggtag

SEQ ID NO: 667619 - DNA, 20 bp, mouse
gcccgctattacctgaacta

SEQ ID NO: 667620 - DNA, 20 bp, mouse
gctagcgggggcggagttcc

SEQ ID NO: 667621 - DNA, 20 bp, mouse
gagagggggcgggtctgtga

SEQ ID NO: 667622 - DNA, 20 bp, mouse
gccgccgcgcggttcaaacc

SEQ ID NO: 667623 - DNA, 20 bp, mouse
gcgggggcggagttccgggc

SEQ ID NO: 667624 - DNA, 20 bp, mouse
gtgggagagggcgttcctag

SEQ ID NO: 667625 - DNA, 20 bp, mouse
gggactcaaggtgacgggac

SEQ ID NO: 667626 - DNA, 20 bp, mouse
gcggtgggacgctgaagaat

SEQ ID NO: 667627 - DNA, 20 bp, mouse
gacacccgcggccgaatcgg

SEQ ID NO: 667628 - DNA, 20 bp, mouse
gccctcccccgattcggccg

SEQ ID NO: 667629 - DNA, 20 bp, mouse
gtgcgcggaagccagcgacg

SEQ ID NO: 667630 - DNA, 20 bp, mouse
gcggaagccagcgacgcggt

SEQ ID NO: 667631 - DNA, 20 bp, mouse
gcgtcggccaaccgcgtcgc

SEQ ID NO: 667632 - DNA, 20 bp, mouse
gcgagtcgccagggcagtaa

SEQ ID NO: 667633 - DNA, 20 bp, mouse
gcggggatctggcgctcggc

SEQ ID NO: 667634 - DNA, 20 bp, mouse
gggcagcccgagggcggcgt

SEQ ID NO: 667635 - DNA, 20 bp, mouse
gggcgacacgcgcacacccg

SEQ ID NO: 667636 - DNA, 20 bp, mouse
gggtaaaaaggcaaggtcag

SEQ ID NO: 667637 - DNA, 20 bp, mouse
ggcgcaggcgcgagtctcac

SEQ ID NO: 667638 - DNA, 20 bp, mouse
ggtagtgcgagggccctgga

SEQ ID NO: 667639 - DNA, 20 bp, mouse
gaggcaaggtcagtggatca

SEQ ID NO: 667640 - DNA, 20 bp, mouse
gtggactagaccccgcctcc

SEQ ID NO: 667641 - DNA, 20 bp, mouse
gcgaacggctggcgcgaggt

SEQ ID NO: 667642 - DNA, 20 bp, mouse
gcaaggtcagtggatcaggg

SEQ ID NO: 667643 - DNA, 20 bp, mouse
gtcccggtctgtccttgcgc

SEQ ID NO: 667644 - DNA, 20 bp, mouse
gcaggaaaagacctgagtca

SEQ ID NO: 667645 - DNA, 20 bp, mouse
ggagccggagctgacaggtt

SEQ ID NO: 667646 - DNA, 20 bp, mouse
ggtagcggctcgctggagaa

SEQ ID NO: 667647 - DNA, 20 bp, mouse
gcggaagcgtagcggctcgc

SEQ ID NO: 667648 - DNA, 20 bp, mouse
gaatcattgagctgtgggcg

SEQ ID NO: 667649 - DNA, 20 bp, mouse
ggaaggggcgggacctcagt

SEQ ID NO: 667650 - DNA, 20 bp, mouse
gggctgggccggaagcgtag

SEQ ID NO: 667651 - DNA, 20 bp, mouse
ggcgggacctcagttggtgg

SEQ ID NO: 667652 - DNA, 20 bp, mouse
gcagcccgccacgcaggagg

SEQ ID NO: 667653 - DNA, 20 bp, mouse
gggggcgggacctcagttgg

SEQ ID NO: 667654 - DNA, 20 bp, mouse
ggcggaaatcattgagctgt

SEQ ID NO: 667655 - DNA, 20 bp, mouse
gaggcggaaacccgtgcgtc

SEQ ID NO: 667656 - DNA, 20 bp, mouse
gatagagagggcatgatgta

SEQ ID NO: 667657 - DNA, 20 bp, mouse
gagggcatgatgtaggggac

SEQ ID NO: 667658 - DNA, 20 bp, mouse
gccagcacccaccctctagt

SEQ ID NO: 667659 - DNA, 20 bp, mouse
ggacgcaagcgcttgcgcac

SEQ ID NO: 667660 - DNA, 20 bp, mouse
gcctctacgcaagaaaggca

SEQ ID NO: 667661 - DNA, 20 bp, mouse
gggcgcttgcgcagacattc

SEQ ID NO: 667662 - DNA, 20 bp, mouse
gcgcatgagtacccactaga

SEQ ID NO: 667663 - DNA, 20 bp, mouse
gtgcgcaagcgccaaagcac

SEQ ID NO: 667664 - DNA, 20 bp, mouse
gcaaggcaagttagatagag

SEQ ID NO: 667665 - DNA, 20 bp, mouse
gtgagtacccactagagggt

SEQ ID NO: 667666 - DNA, 20 bp, mouse
gggcgcgggtgtgacgtcag

SEQ ID NO: 667667 - DNA, 20 bp, mouse
gaaacctcccgctccatctc

SEQ ID NO: 667668 - DNA, 20 bp, mouse
gaagctgcgcagccggcgtg

SEQ ID NO: 667669 - DNA, 20 bp, mouse
gggctcgggtccatctagaa

SEQ ID NO: 667670 - DNA, 20 bp, mouse
gtggctgtggccgttctaga

SEQ ID NO: 667671 - DNA, 20 bp, mouse
ggcgcgcggagatgtggcta

SEQ ID NO: 667672 - DNA, 20 bp, mouse
gtagcagaagctaaaggctc

SEQ ID NO: 667673 - DNA, 20 bp, mouse
ggacggatggacacggattc

SEQ ID NO: 667674 - DNA, 20 bp, mouse
ggaggaagctgtgacagctc

SEQ ID NO: 667675 - DNA, 20 bp, mouse
gcggctgcgcagcttgcgcg

SEQ ID NO: 667676 - DNA, 20 bp, mouse
ggattccagaagctactctg

SEQ ID NO: 667677 - DNA, 20 bp, mouse
gggggtgttcgaaacttaga

SEQ ID NO: 667678 - DNA, 20 bp, mouse
gaacgcgcgatggagcgagt

SEQ ID NO: 667679 - DNA, 20 bp, mouse
gttccacgaaccgagggggg

SEQ ID NO: 667680 - DNA, 20 bp, mouse
gcgcccgggctctaagacgt

SEQ ID NO: 667681 - DNA, 20 bp, mouse
gcccctcggttcgtggaaaa

SEQ ID NO: 667682 - DNA, 20 bp, mouse
gctctcgcgagagggaggtg

SEQ ID NO: 667683 - DNA, 20 bp, mouse
gaaacggacgttcccaacag

SEQ ID NO: 667684 - DNA, 20 bp, mouse
gtctggaatcggccgctgtt

SEQ ID NO: 667685 - DNA, 20 bp, mouse
gaagctccccgctgcaactc

SEQ ID NO: 667686 - DNA, 20 bp, mouse
gaaactggttctcccgtcat

SEQ ID NO: 667687 - DNA, 20 bp, mouse
gacgtcgcaactgggcgtgg

SEQ ID NO: 667688 - DNA, 20 bp, mouse
gcccacagagcacctccatt

SEQ ID NO: 667689 - DNA, 20 bp, mouse
ggagggtcgccacccaatgg

SEQ ID NO: 667690 - DNA, 20 bp, mouse
ggcgcaatgacgtcgcaact

SEQ ID NO: 667691 - DNA, 20 bp, mouse
gtgacaggaagcagaggcgt

SEQ ID NO: 667692 - DNA, 20 bp, mouse
ggattggcttaatccaacgc

SEQ ID NO: 667693 - DNA, 20 bp, mouse
gtctcccgtcatcggcactc

SEQ ID NO: 667694 - DNA, 20 bp, mouse
ggccgaaccgtgacgctggg

SEQ ID NO: 667695 - DNA, 20 bp, mouse
gtcggcctctgcactcgact

SEQ ID NO: 667696 - DNA, 20 bp, mouse
ggggaagcgagtggtgaatc

SEQ ID NO: 667697 - DNA, 20 bp, mouse
gcctgagcaccaaccggaag

SEQ ID NO: 667698 - DNA, 20 bp, mouse
gcgccaagtacaaccgtctg

SEQ ID NO: 667699 - DNA, 20 bp, mouse
gtgccccagacggttgtact

SEQ ID NO: 667700 - DNA, 20 bp, mouse
gtccacctctactcggactc

SEQ ID NO: 667701 - DNA, 20 bp, mouse
gggcccacactcaggagtgt

SEQ ID NO: 667702 - DNA, 20 bp, mouse
gactccggctgggaagcgag

SEQ ID NO: 667703 - DNA, 20 bp, mouse
gggtgaatcaggaagaactg

SEQ ID NO: 667704 - DNA, 20 bp, mouse
gacaggagctcgctcttgac

SEQ ID NO: 667705 - DNA, 20 bp, mouse
gagaactgaggcgcttgatg

SEQ ID NO: 667706 - DNA, 20 bp, mouse
gtagaggagtcggaggtcca

SEQ ID NO: 667707 - DNA, 20 bp, mouse
ggacctccgactcctctagc

SEQ ID NO: 667708 - DNA, 20 bp, mouse
gggagctaaccatagagtgg

SEQ ID NO: 667709 - DNA, 20 bp, mouse
gagccggctagaggagtcgg

SEQ ID NO: 667710 - DNA, 20 bp, mouse
gtcctctagccggctacctc

SEQ ID NO: 667711 - DNA, 20 bp, mouse
gggtagccggctagaggagt

SEQ ID NO: 667712 - DNA, 20 bp, mouse
ggggccgcgcacctgtgacc

SEQ ID NO: 667713 - DNA, 20 bp, mouse
gtcacggagctccctcgcca

SEQ ID NO: 667714 - DNA, 20 bp, mouse
ggaccacttccgccactcta

SEQ ID NO: 667715 - DNA, 20 bp, mouse
gcgagttcctagagcgtccc

SEQ ID NO: 667716 - DNA, 20 bp, mouse
gttaggacaagggacacgaa

SEQ ID NO: 667717 - DNA, 20 bp, mouse
gcggggcgaccggaagtagg

SEQ ID NO: 667718 - DNA, 20 bp, mouse
ggggcggggcgaccggaagt

SEQ ID NO: 667719 - DNA, 20 bp, mouse
ggaagggagcatgcacgctc

SEQ ID NO: 667720 - DNA, 20 bp, mouse
gtgccgattcccgatcaaag

SEQ ID NO: 667721 - DNA, 20 bp, mouse
gagcatgcacgctctgggtt

SEQ ID NO: 667722 - DNA, 20 bp, mouse
ggatcgggaatcggcagatc

SEQ ID NO: 667723 - DNA, 20 bp, mouse
gttggcttgtgatatttcgg

SEQ ID NO: 667724 - DNA, 20 bp, mouse
ggtccgctttgatcgggaat

SEQ ID NO: 667725 - DNA, 20 bp, mouse
gcagagacgctgcaggttga

SEQ ID NO: 667726 - DNA, 20 bp, mouse
gcaccaaagacagtcttcgt

SEQ ID NO: 667727 - DNA, 20 bp, mouse
gtcccaacgaagactgtctt

SEQ ID NO: 667728 - DNA, 20 bp, mouse
gtgttcttttggtgctacat

SEQ ID NO: 667729 - DNA, 20 bp, mouse
gttcaacagtaaagttattt

SEQ ID NO: 667730 - DNA, 20 bp, mouse
gttttgagggaactgacgtt

SEQ ID NO: 667731 - DNA, 20 bp, mouse
gaacagaagtaacctgctgg

SEQ ID NO: 667732 - DNA, 20 bp, mouse
gcaaaacagaagtaacctgc

SEQ ID NO: 667733 - DNA, 20 bp, mouse
gccatggtgtttggtgattt

SEQ ID NO: 667734 - DNA, 20 bp, mouse
gtataatacaatttgagttg

SEQ ID NO: 667735 - DNA, 20 bp, mouse
gggtttcattcctgctatca

SEQ ID NO: 667736 - DNA, 20 bp, mouse
gcacacggacctatcagaga

SEQ ID NO: 667737 - DNA, 20 bp, mouse
gcagttccctcgtgtttatt

SEQ ID NO: 667738 - DNA, 20 bp, mouse
ggggccgccggctagcgagg

SEQ ID NO: 667739 - DNA, 20 bp, mouse
ggaaatgtaacaatggattg

SEQ ID NO: 667740 - DNA, 20 bp, mouse
gtccagcccaataaacacga

SEQ ID NO: 667741 - DNA, 20 bp, mouse
gaattatatcagctctcagc

SEQ ID NO: 667742 - DNA, 20 bp, mouse
gcgagggaactggttccaca

SEQ ID NO: 667743 - DNA, 20 bp, mouse
gtcgagctcttccgggccgc

SEQ ID NO: 667744 - DNA, 20 bp, mouse
ggagagggactgggcactgc

SEQ ID NO: 667745 - DNA, 20 bp, mouse
gtccgggccgccggctagcg

SEQ ID NO: 667746 - DNA, 20 bp, mouse
ggggtctccttcatctgtat

SEQ ID NO: 667747 - DNA, 20 bp, mouse
ggggctcctcctgcctaaag

SEQ ID NO: 667748 - DNA, 20 bp, mouse
gtaaagaggaagctatggtg

SEQ ID NO: 667749 - DNA, 20 bp, mouse
gaggaaacccatacagatga

SEQ ID NO: 667750 - DNA, 20 bp, mouse
gccctggaatccatgaactc

SEQ ID NO: 667751 - DNA, 20 bp, mouse
gtctgcaaaggtctctcagt

SEQ ID NO: 667752 - DNA, 20 bp, mouse
ggcaggctgtctgaagtgtg

SEQ ID NO: 667753 - DNA, 20 bp, mouse
gccccatgaggtataaaaat

SEQ ID NO: 667754 - DNA, 20 bp, mouse
gatgcttcctccctcaagaa

SEQ ID NO: 667755 - DNA, 20 bp, mouse
gtttacagtcacttagactt

SEQ ID NO: 667756 - DNA, 20 bp, mouse
gagggcagctatgtgaactg

SEQ ID NO: 667757 - DNA, 20 bp, mouse
gaaccccaggttcccggtgg

SEQ ID NO: 667758 - DNA, 20 bp, mouse
gcctggggagcaggaaagtt

SEQ ID NO: 667759 - DNA, 20 bp, mouse
ggtcccgttgctgagaaaag

SEQ ID NO: 667760 - DNA, 20 bp, mouse
ggctccccagggagaacata

SEQ ID NO: 667761 - DNA, 20 bp, mouse
gcattgtgatgcagcgggat

SEQ ID NO: 667762 - DNA, 20 bp, mouse
gccccgccaccgggaacctg

SEQ ID NO: 667763 - DNA, 20 bp, mouse
gtaaacaaaccccaggttcc

SEQ ID NO: 667764 - DNA, 20 bp, mouse
ggccctggatgccgctcaca

SEQ ID NO: 667765 - DNA, 20 bp, mouse
gtattcactccgggcatccc

SEQ ID NO: 667766 - DNA, 20 bp, mouse
gttgcaacgaagtgtttttt

SEQ ID NO: 667767 - DNA, 20 bp, mouse
gtacgcaccagacaagtccg

SEQ ID NO: 667768 - DNA, 20 bp, mouse
gttaggaagggacgaaaaac

SEQ ID NO: 667769 - DNA, 20 bp, mouse
gggcgcataggtcatcctcc

SEQ ID NO: 667770 - DNA, 20 bp, mouse
gtatgcgccccggacttgtc

SEQ ID NO: 667771 - DNA, 20 bp, mouse
ggtctggtgcgtacaggaaa

SEQ ID NO: 667772 - DNA, 20 bp, mouse
gtagggcattctgtgccagg

SEQ ID NO: 667773 - DNA, 20 bp, mouse
gaaaatggaggtgaatcaat

SEQ ID NO: 667774 - DNA, 20 bp, mouse
gaagagctggatttgaacgg

SEQ ID NO: 667775 - DNA, 20 bp, mouse
gtgctagcaactaagactag

SEQ ID NO: 667776 - DNA, 20 bp, mouse
ggcgcgccagagagacctgt

SEQ ID NO: 667777 - DNA, 20 bp, mouse
gtagaccagaggtagaaccc

SEQ ID NO: 667778 - DNA, 20 bp, mouse
gccaactcgcccagagacag

SEQ ID NO: 667779 - DNA, 20 bp, mouse
gggtctagctcctctgtctc

SEQ ID NO: 667780 - DNA, 20 bp, mouse
gaggtggggagcgaagaggt

SEQ ID NO: 667781 - DNA, 20 bp, mouse
gcccacctgggttctacctc

SEQ ID NO: 667782 - DNA, 20 bp, mouse
gacccaggtggggagcgaag

SEQ ID NO: 667783 - DNA, 20 bp, mouse
gagaacctgcagctttagag

SEQ ID NO: 667784 - DNA, 20 bp, mouse
ggcgcagccccgcccacggc

SEQ ID NO: 667785 - DNA, 20 bp, mouse
ggtggcacctagcccaccag

SEQ ID NO: 667786 - DNA, 20 bp, mouse
gtagggcagggtgtgactag

SEQ ID NO: 667787 - DNA, 20 bp, mouse
gatcccacctgctaggtgaa

SEQ ID NO: 667788 - DNA, 20 bp, mouse
gacacactattgtctgactg

SEQ ID NO: 667789 - DNA, 20 bp, mouse
gggtgtgactaggggactcc

SEQ ID NO: 667790 - DNA, 20 bp, mouse
ggggccttgaggctctgccc

SEQ ID NO: 667791 - DNA, 20 bp, mouse
gtacagacctcggctgacgc

SEQ ID NO: 667792 - DNA, 20 bp, mouse
gacaatagtgtgtctagggc

SEQ ID NO: 667793 - DNA, 20 bp, mouse
gggcggcaggccaaagaaca

SEQ ID NO: 667794 - DNA, 20 bp, mouse
gaagcagaactgttagccag

SEQ ID NO: 667795 - DNA, 20 bp, mouse
gtaagcttctgtagttggag

SEQ ID NO: 667796 - DNA, 20 bp, mouse
gagagtaaaaactacagggg

SEQ ID NO: 667797 - DNA, 20 bp, mouse
ggtaaaaactacaggggcgg

SEQ ID NO: 667798 - DNA, 20 bp, mouse
ggagagagtaaaaactacag

SEQ ID NO: 667799 - DNA, 20 bp, mouse
ggtgaaaggccgagctgtga

SEQ ID NO: 667800 - DNA, 20 bp, mouse
ggccgagctgtgacggaagt

SEQ ID NO: 667801 - DNA, 20 bp, mouse
gaatgggtttttagcagcga

SEQ ID NO: 667802 - DNA, 20 bp, mouse
gtggaaatgaaggcgtgaga

SEQ ID NO: 667803 - DNA, 20 bp, mouse
gaccagaagacatgctctcg

SEQ ID NO: 667804 - DNA, 20 bp, mouse
gctgctaaaaacccattctg

SEQ ID NO: 667805 - DNA, 20 bp, mouse
gaaatgaaggcgtgagaagg

SEQ ID NO: 667806 - DNA, 20 bp, mouse
gagggaggagccaatcttaa

SEQ ID NO: 667807 - DNA, 20 bp, mouse
gtcacacctgcgttagttgg

SEQ ID NO: 667808 - DNA, 20 bp, mouse
gaggactctccctttaagat

SEQ ID NO: 667809 - DNA, 20 bp, mouse
gcctgagtggccctatgtaa

SEQ ID NO: 667810 - DNA, 20 bp, mouse
gtggatgagctcccagagta

SEQ ID NO: 667811 - DNA, 20 bp, mouse
ggtagggttcttatggtctc

SEQ ID NO: 667812 - DNA, 20 bp, mouse
ggaacccgtggtccgaggta

SEQ ID NO: 667813 - DNA, 20 bp, mouse
gttgttctgtgttccaaagt

SEQ ID NO: 667814 - DNA, 20 bp, mouse
gaaagaggataaaagaaata

SEQ ID NO: 667815 - DNA, 20 bp, mouse
gcatagatttccaaaaacta

SEQ ID NO: 667816 - DNA, 20 bp, mouse
gggaactctacaaatctcca

SEQ ID NO: 667817 - DNA, 20 bp, mouse
ggagtaggtgagtctctggt

SEQ ID NO: 667818 - DNA, 20 bp, mouse
ggtagagttccaattggaac

SEQ ID NO: 667819 - DNA, 20 bp, mouse
gtgtgctggtgataggttct

SEQ ID NO: 667820 - DNA, 20 bp, mouse
ggataactgtgtaagagctc

SEQ ID NO: 667821 - DNA, 20 bp, mouse
gttctgagtaggtgagtctc

SEQ ID NO: 667822 - DNA, 20 bp, mouse
gtgctgtgctgccctttctc

SEQ ID NO: 667823 - DNA, 20 bp, mouse
ggaagcatttcgtgcagcat

SEQ ID NO: 667824 - DNA, 20 bp, mouse
ggactcacctactcagaaga

SEQ ID NO: 667825 - DNA, 20 bp, mouse
gcttcagtggttatcagtat

SEQ ID NO: 667826 - DNA, 20 bp, mouse
gccactaggaagccggccgg

SEQ ID NO: 667827 - DNA, 20 bp, mouse
ggcggccgcggagacctcta

SEQ ID NO: 667828 - DNA, 20 bp, mouse
gcccgcggggcgggcttctc

SEQ ID NO: 667829 - DNA, 20 bp, mouse
gtgccgcgcgtgatcctccc

SEQ ID NO: 667830 - DNA, 20 bp, mouse
gggcggggggagatcatccg

SEQ ID NO: 667831 - DNA, 20 bp, mouse
gaaggacggcttgcgacgca

SEQ ID NO: 667832 - DNA, 20 bp, mouse
gcatccgtggtgcagatgtg

SEQ ID NO: 667833 - DNA, 20 bp, mouse
ggctgccctagaggtctccg

SEQ ID NO: 667834 - DNA, 20 bp, mouse
gggcgagaccactaggaagc

SEQ ID NO: 667835 - DNA, 20 bp, mouse
gagaccactaggaagccggc

SEQ ID NO: 667836 - DNA, 20 bp, mouse
ggggcctgaacaaaagggat

SEQ ID NO: 667837 - DNA, 20 bp, mouse
gaagctgcccctcagggacc

SEQ ID NO: 667838 - DNA, 20 bp, mouse
gaggcggggcctgaacaaaa

SEQ ID NO: 667839 - DNA, 20 bp, mouse
gctgaggggcagcttcaagg

SEQ ID NO: 667840 - DNA, 20 bp, mouse
gctgctgtgcgatttaaggc

SEQ ID NO: 667841 - DNA, 20 bp, mouse
gatgtcacctggtccctgag

SEQ ID NO: 667842 - DNA, 20 bp, mouse
gcataggtcgagttaggtga

SEQ ID NO: 667843 - DNA, 20 bp, mouse
gtctacctggaccctcccag

SEQ ID NO: 667844 - DNA, 20 bp, mouse
ggcctctagccacgcccaca

SEQ ID NO: 667845 - DNA, 20 bp, mouse
gttaaatcgcacagcagagc

SEQ ID NO: 667846 - DNA, 20 bp, mouse
gctgcatccgaggaacgctg

SEQ ID NO: 667847 - DNA, 20 bp, mouse
ggggtaaacactcttccctc

SEQ ID NO: 667848 - DNA, 20 bp, mouse
gcctcatcccctagaaacag

SEQ ID NO: 667849 - DNA, 20 bp, mouse
gccaggctcttcaagcctga

SEQ ID NO: 667850 - DNA, 20 bp, mouse
gggcagccccggaaatgggg

SEQ ID NO: 667851 - DNA, 20 bp, mouse
gtggttatgtacttttcagt

SEQ ID NO: 667852 - DNA, 20 bp, mouse
gccaaggcagccccggaaat

SEQ ID NO: 667853 - DNA, 20 bp, mouse
gatccgaggaacgctggggc

SEQ ID NO: 667854 - DNA, 20 bp, mouse
gtgtttacccctgtttctag

SEQ ID NO: 667855 - DNA, 20 bp, mouse
gagtgtgtgaagcgaagcag

SEQ ID NO: 667856 - DNA, 20 bp, mouse
gagtaggccatcatggggta

SEQ ID NO: 667857 - DNA, 20 bp, mouse
ggaaactggcttcaacgcag

SEQ ID NO: 667858 - DNA, 20 bp, mouse
gaaatgcagtaggccatcat

SEQ ID NO: 667859 - DNA, 20 bp, mouse
ggcgttgaagccagtttcaa

SEQ ID NO: 667860 - DNA, 20 bp, mouse
gcctgtgagtggttaggaga

SEQ ID NO: 667861 - DNA, 20 bp, mouse
gccccagtgtcaaagccctc

SEQ ID NO: 667862 - DNA, 20 bp, mouse
gttaggagaagggtagagca

SEQ ID NO: 667863 - DNA, 20 bp, mouse
gtagggctcttagttatttt

SEQ ID NO: 667864 - DNA, 20 bp, mouse
gagccagtttcaaggggttt

SEQ ID NO: 667865 - DNA, 20 bp, mouse
gtatttttggccaagatggt

SEQ ID NO: 667866 - DNA, 20 bp, mouse
gcaaatggaggcctaaccta

SEQ ID NO: 667867 - DNA, 20 bp, mouse
gtgggtgcaggcttaagtta

SEQ ID NO: 667868 - DNA, 20 bp, mouse
ggaaccatgggtgtctgtga

SEQ ID NO: 667869 - DNA, 20 bp, mouse
gagtccccgtatagaggaaa

SEQ ID NO: 667870 - DNA, 20 bp, mouse
gacacacttgggctaagtgc

SEQ ID NO: 667871 - DNA, 20 bp, mouse
gaaaggggtggtcacacctt

SEQ ID NO: 667872 - DNA, 20 bp, mouse
gctagtgggcaatgaaccat

SEQ ID NO: 667873 - DNA, 20 bp, mouse
ggggagggggacaagtgttg

SEQ ID NO: 667874 - DNA, 20 bp, mouse
gggtggtcacaccttaggtt

SEQ ID NO: 667875 - DNA, 20 bp, mouse
gcttctatatggtttggcat

SEQ ID NO: 667876 - DNA, 20 bp, mouse
gccccctggtagttgagggt

SEQ ID NO: 667877 - DNA, 20 bp, mouse
gcaaaccccctggtagttga

SEQ ID NO: 667878 - DNA, 20 bp, mouse
gttaaaagtggtttgcgtag

SEQ ID NO: 667879 - DNA, 20 bp, mouse
gggagtcggggacagccaga

SEQ ID NO: 667880 - DNA, 20 bp, mouse
gtccaaccctcaactaccag

SEQ ID NO: 667881 - DNA, 20 bp, mouse
gtgagaggataggactaggc

SEQ ID NO: 667882 - DNA, 20 bp, mouse
gtgcaaggggaaaaatagaa

SEQ ID NO: 667883 - DNA, 20 bp, mouse
gagaaaagaaaccagggtaa

SEQ ID NO: 667884 - DNA, 20 bp, mouse
gggtgctccatttacaagtt

SEQ ID NO: 667885 - DNA, 20 bp, mouse
ggtgcagagccagcaaaacc

SEQ ID NO: 667886 - DNA, 20 bp, mouse
gccccctggtacttgagagt

SEQ ID NO: 667887 - DNA, 20 bp, mouse
gagagcctgcctaacccgga

SEQ ID NO: 667888 - DNA, 20 bp, mouse
gggtgtgacgatggaatctc

SEQ ID NO: 667889 - DNA, 20 bp, mouse
ggcgtccttccgggttaggc

SEQ ID NO: 667890 - DNA, 20 bp, mouse
gaaaggctctgggggttttt

SEQ ID NO: 667891 - DNA, 20 bp, mouse
gtccaactctcaagtaccag

SEQ ID NO: 667892 - DNA, 20 bp, mouse
ggcgcagagcctgcctaacc

SEQ ID NO: 667893 - DNA, 20 bp, mouse
gcttgctttagatattgaga

SEQ ID NO: 667894 - DNA, 20 bp, mouse
ggatgagtgaacattttttt

SEQ ID NO: 667895 - DNA, 20 bp, mouse
gattctgactggtgtgacga

SEQ ID NO: 667896 - DNA, 20 bp, mouse
gctgctgttcacagtagggg

SEQ ID NO: 667897 - DNA, 20 bp, mouse
gacacctatttcggttaagg

SEQ ID NO: 667898 - DNA, 20 bp, mouse
gcagacacctatttcggtta

SEQ ID NO: 667899 - DNA, 20 bp, mouse
gctcaccggcaaaaggtcat

SEQ ID NO: 667900 - DNA, 20 bp, mouse
gtgcatgagtcgttttgata

SEQ ID NO: 667901 - DNA, 20 bp, mouse
ggtgacacagacacctattt

SEQ ID NO: 667902 - DNA, 20 bp, mouse
ggctacccttttgtaaacaa

SEQ ID NO: 667903 - DNA, 20 bp, mouse
gtaagcccttgtttacaaaa

SEQ ID NO: 667904 - DNA, 20 bp, mouse
gcatgaaagacacgtggttc

SEQ ID NO: 667905 - DNA, 20 bp, mouse
gtgccctccttaaccgaaat

SEQ ID NO: 667906 - DNA, 20 bp, mouse
gctagggatgaggttgtaga

SEQ ID NO: 667907 - DNA, 20 bp, mouse
gaaaggcgagaacctggcgg

SEQ ID NO: 667908 - DNA, 20 bp, mouse
gaggttgtagagggcgtggt

SEQ ID NO: 667909 - DNA, 20 bp, mouse
gtacagctcctctagtgtgg

SEQ ID NO: 667910 - DNA, 20 bp, mouse
ggtagagtctgcctgtgcag

SEQ ID NO: 667911 - DNA, 20 bp, mouse
ggatgaggttgtagagggcg

SEQ ID NO: 667912 - DNA, 20 bp, mouse
gggcgagaacctggcggggg

SEQ ID NO: 667913 - DNA, 20 bp, mouse
ggccatttggcacgggagag

SEQ ID NO: 667914 - DNA, 20 bp, mouse
ggtctcttcctccacactag

SEQ ID NO: 667915 - DNA, 20 bp, mouse
gtgtagagggcgtggttggt

SEQ ID NO: 667916 - DNA, 20 bp, mouse
gacagaggaagctgactgag

SEQ ID NO: 667917 - DNA, 20 bp, mouse
gagacacatccatctgtctt

SEQ ID NO: 667918 - DNA, 20 bp, mouse
gcctccattcaaaactgaag

SEQ ID NO: 667919 - DNA, 20 bp, mouse
gaaccgtgaagcaaagacag

SEQ ID NO: 667920 - DNA, 20 bp, mouse
gggagaagagaaagagccaa

SEQ ID NO: 667921 - DNA, 20 bp, mouse
gtattctgcattaaagactg

SEQ ID NO: 667922 - DNA, 20 bp, mouse
gtgctcccagcattatgtgt

SEQ ID NO: 667923 - DNA, 20 bp, mouse
gccagaaattcattgtggtt

SEQ ID NO: 667924 - DNA, 20 bp, mouse
gtgcattaaagactgaggaa

SEQ ID NO: 667925 - DNA, 20 bp, mouse
ggtgagattactatctagtc

SEQ ID NO: 667926 - DNA, 20 bp, mouse
gttgaggtcacacctttctg

SEQ ID NO: 667927 - DNA, 20 bp, mouse
gactctgaaggggattcatt

SEQ ID NO: 667928 - DNA, 20 bp, mouse
gggaggaaattgcagtattg

SEQ ID NO: 667929 - DNA, 20 bp, mouse
gcaatatggtatttctcata

SEQ ID NO: 667930 - DNA, 20 bp, mouse
ggtcacacctttctgagggc

SEQ ID NO: 667931 - DNA, 20 bp, mouse
gacagtttaggacacagttg

SEQ ID NO: 667932 - DNA, 20 bp, mouse
gtaaatgtaggtaggtcaac

SEQ ID NO: 667933 - DNA, 20 bp, mouse
gtgtaggtaggtcaacaggt

SEQ ID NO: 667934 - DNA, 20 bp, mouse
ggaaaactcacagtaaatgt

SEQ ID NO: 667935 - DNA, 20 bp, mouse
gactcacagtaaatgtaggt

SEQ ID NO: 667936 - DNA, 20 bp, mouse
gtattaagacattaagatac

SEQ ID NO: 667937 - DNA, 20 bp, mouse
gggcttagtcagccaactga

SEQ ID NO: 667938 - DNA, 20 bp, mouse
ggagatgaagataaagatag

SEQ ID NO: 667939 - DNA, 20 bp, mouse
gagaaaagtcactcctaagt

SEQ ID NO: 667940 - DNA, 20 bp, mouse
gaagcctgcacaggagaaaa

SEQ ID NO: 667941 - DNA, 20 bp, mouse
ggtctgccccagaatctctg

SEQ ID NO: 667942 - DNA, 20 bp, mouse
ggctgtggcaaagccctcca

SEQ ID NO: 667943 - DNA, 20 bp, mouse
ggcagaagccacagagattc

SEQ ID NO: 667944 - DNA, 20 bp, mouse
gctggggcagaccgcttttc

SEQ ID NO: 667945 - DNA, 20 bp, mouse
ggtgtccagcctgccctgga

SEQ ID NO: 667946 - DNA, 20 bp, mouse
gatgctgtccagccctcaaa

SEQ ID NO: 667947 - DNA, 20 bp, mouse
gcatgtggtcacaccctttg

SEQ ID NO: 667948 - DNA, 20 bp, mouse
gggtcacaccctttgagggc

SEQ ID NO: 667949 - DNA, 20 bp, mouse
gagagtttaggaaacagctg

SEQ ID NO: 667950 - DNA, 20 bp, mouse
gataagatgtcatgagaaat

SEQ ID NO: 667951 - DNA, 20 bp, mouse
gtaaatgtaggtaggtcaac

SEQ ID NO: 667952 - DNA, 20 bp, mouse
gtgtaggtaggtcaacaggt

SEQ ID NO: 667953 - DNA, 20 bp, mouse
gaacaggtaggaagaaagtc

SEQ ID NO: 667954 - DNA, 20 bp, mouse
gggggagtcattaggagcac

SEQ ID NO: 667955 - DNA, 20 bp, mouse
gcttgctttttaaaaactta

SEQ ID NO: 667956 - DNA, 20 bp, mouse
ggtggtagagtgctgactga

SEQ ID NO: 667957 - DNA, 20 bp, mouse
ggtgtaccagggaagaagtc

SEQ ID NO: 667958 - DNA, 20 bp, mouse
gagtcaaaaggatgaagctg

SEQ ID NO: 667959 - DNA, 20 bp, mouse
gcactgtcaaagtacataca

SEQ ID NO: 667960 - DNA, 20 bp, mouse
ggatgggcacactcagggtg

SEQ ID NO: 667961 - DNA, 20 bp, mouse
gagagtgctgactgagggat

SEQ ID NO: 667962 - DNA, 20 bp, mouse
gcctgggttgagctcttaga

SEQ ID NO: 667963 - DNA, 20 bp, mouse
gtacactcagggttaaggga

SEQ ID NO: 667964 - DNA, 20 bp, mouse
gttaaaatgtctgtgtacca

SEQ ID NO: 667965 - DNA, 20 bp, mouse
ggggaaatgagtcaaaaagc

SEQ ID NO: 667966 - DNA, 20 bp, mouse
ggagaagtgagtaatgacac

SEQ ID NO: 667967 - DNA, 20 bp, mouse
gacttctcagcagaaataga

SEQ ID NO: 667968 - DNA, 20 bp, mouse
gcactcctctctgaaatttc

SEQ ID NO: 667969 - DNA, 20 bp, mouse
gatgacaccggaagagtgag

SEQ ID NO: 667970 - DNA, 20 bp, mouse
gattccagagctgaccatac

SEQ ID NO: 667971 - DNA, 20 bp, mouse
gacaccaccctttttcatct

SEQ ID NO: 667972 - DNA, 20 bp, mouse
gtatttctgctgagaagtac

SEQ ID NO: 667973 - DNA, 20 bp, mouse
gggaaaatgtatctcctgcc

SEQ ID NO: 667974 - DNA, 20 bp, mouse
gagatggttcacttccagta

SEQ ID NO: 667975 - DNA, 20 bp, mouse
gtaagtaagattcaaggagg

SEQ ID NO: 667976 - DNA, 20 bp, mouse
ggcggaagagcctaggggag

SEQ ID NO: 667977 - DNA, 20 bp, mouse
gaggctcttccgcaatacat

SEQ ID NO: 667978 - DNA, 20 bp, mouse
ggatatatctggcaaaagat

SEQ ID NO: 667979 - DNA, 20 bp, mouse
ggtattgcggaagagcctag

SEQ ID NO: 667980 - DNA, 20 bp, mouse
gaaaggaagcccatgtattg

SEQ ID NO: 667981 - DNA, 20 bp, mouse
ggtcagaagggcagaggaac

SEQ ID NO: 667982 - DNA, 20 bp, mouse
gtcactccggaaggggaaaa

SEQ ID NO: 667983 - DNA, 20 bp, mouse
gtattgtattggctttgaaa

SEQ ID NO: 667984 - DNA, 20 bp, mouse
gtgaaatggcacccataatt

SEQ ID NO: 667985 - DNA, 20 bp, mouse
gtgtcctttcactccggaag

SEQ ID NO: 667986 - DNA, 20 bp, mouse
gaggaactgtaagatgtcaa

SEQ ID NO: 667987 - DNA, 20 bp, mouse
gcagagaggaccatgtttct

SEQ ID NO: 667988 - DNA, 20 bp, mouse
gggaatggatgagcatgtaa

SEQ ID NO: 667989 - DNA, 20 bp, mouse
gttcacacaaccagcattcc

SEQ ID NO: 667990 - DNA, 20 bp, mouse
ggtcaaaggaagatgataga

SEQ ID NO: 667991 - DNA, 20 bp, mouse
gcctgtgggcatgtccatcg

SEQ ID NO: 667992 - DNA, 20 bp, mouse
gaggagggagcaatagtgga

SEQ ID NO: 667993 - DNA, 20 bp, mouse
ggtgcagaaccacctatcta

SEQ ID NO: 667994 - DNA, 20 bp, mouse
gcaaaattaccagatcagag

SEQ ID NO: 667995 - DNA, 20 bp, mouse
gctacactgggttttcctgt

SEQ ID NO: 667996 - DNA, 20 bp, mouse
gcaaagtagacgtactctat

SEQ ID NO: 667997 - DNA, 20 bp, mouse
gcagagacgcatgagttagt

SEQ ID NO: 667998 - DNA, 20 bp, mouse
gcaacccaggaattttttta

SEQ ID NO: 667999 - DNA, 20 bp, mouse
gacaatgctgaagagttaga

SEQ ID NO: 668000 - DNA, 20 bp, mouse
gcaccagatgagctgtgtca

SEQ ID NO: 668001 - DNA, 20 bp, mouse
gtgaatagaccacatctttc

SEQ ID NO: 668002 - DNA, 20 bp, mouse
ggtactttccacttgtgcta

SEQ ID NO: 668003 - DNA, 20 bp, mouse
ggacgtactctataggctgt

SEQ ID NO: 668004 - DNA, 20 bp, mouse
gggcgaggtctgggaagact

SEQ ID NO: 668005 - DNA, 20 bp, mouse
gctcgccctaaaaaaattcc

SEQ ID NO: 668006 - DNA, 20 bp, mouse
gccagcaccggaaggggtag

SEQ ID NO: 668007 - DNA, 20 bp, mouse
gctagcagctactctttctt

SEQ ID NO: 668008 - DNA, 20 bp, mouse
gttagttccagcaccggaag

SEQ ID NO: 668009 - DNA, 20 bp, mouse
gaagagctctggttcactta

SEQ ID NO: 668010 - DNA, 20 bp, mouse
ggctaggaacgaggcacagt

SEQ ID NO: 668011 - DNA, 20 bp, mouse
gccagagctcttggctatgg

SEQ ID NO: 668012 - DNA, 20 bp, mouse
gtgtcctgtagctacaggtc

SEQ ID NO: 668013 - DNA, 20 bp, mouse
gagagtagctgctaggaacg

SEQ ID NO: 668014 - DNA, 20 bp, mouse
gcacagtgtcctgtagctac

SEQ ID NO: 668015 - DNA, 20 bp, mouse
gttcccaaactctatgatga

SEQ ID NO: 668016 - DNA, 20 bp, mouse
gatggagccctgaggaactg

SEQ ID NO: 668017 - DNA, 20 bp, mouse
gccaagctatatctagtaat

SEQ ID NO: 668018 - DNA, 20 bp, mouse
gagctaaaaaggtgccagtc

SEQ ID NO: 668019 - DNA, 20 bp, mouse
gtagcaagttagactgttag

SEQ ID NO: 668020 - DNA, 20 bp, mouse
gttgctttacacagctaaaa

SEQ ID NO: 668021 - DNA, 20 bp, mouse
ggtccatgctgtgaattttc

SEQ ID NO: 668022 - DNA, 20 bp, mouse
gtcagagccccagttcctca

SEQ ID NO: 668023 - DNA, 20 bp, mouse
gcaaaactcctggcccagac

SEQ ID NO: 668024 - DNA, 20 bp, mouse
gggtttactcagctgtgcaa

SEQ ID NO: 668025 - DNA, 20 bp, mouse
gtatatctagtaatgggagt

SEQ ID NO: 668026 - DNA, 20 bp, mouse
gagagcagagacaggagcta

SEQ ID NO: 668027 - DNA, 20 bp, mouse
gcctgcacatgtactgtaac

SEQ ID NO: 668028 - DNA, 20 bp, mouse
gaccttgcttagttgaggta

SEQ ID NO: 668029 - DNA, 20 bp, mouse
ggagaaagcgagcggagctc

SEQ ID NO: 668030 - DNA, 20 bp, mouse
gtagttagtagagcagagac

SEQ ID NO: 668031 - DNA, 20 bp, mouse
gggaactgtcttccaatgta

SEQ ID NO: 668032 - DNA, 20 bp, mouse
gcgagtacctgtacggagtg

SEQ ID NO: 668033 - DNA, 20 bp, mouse
gtgaggtagggaagtgctgt

SEQ ID NO: 668034 - DNA, 20 bp, mouse
gtacggagtgtggtttatag

SEQ ID NO: 668035 - DNA, 20 bp, mouse
ggatggtgcgagtacctgta

SEQ ID NO: 668036 - DNA, 20 bp, mouse
ggagaccagcagatatggtg

SEQ ID NO: 668037 - DNA, 20 bp, mouse
gtggtggagaacacaagttt

SEQ ID NO: 668038 - DNA, 20 bp, mouse
gtgcgagagaccagcagata

SEQ ID NO: 668039 - DNA, 20 bp, mouse
gcatggaaattcatcagaca

SEQ ID NO: 668040 - DNA, 20 bp, mouse
gtgtgtgttgtctggctcta

SEQ ID NO: 668041 - DNA, 20 bp, mouse
gtggtgtggatgagaggccg

SEQ ID NO: 668042 - DNA, 20 bp, mouse
gtgcagtcacgtgttggctt

SEQ ID NO: 668043 - DNA, 20 bp, mouse
gattctctgcagtcacgtgt

SEQ ID NO: 668044 - DNA, 20 bp, mouse
gggaagaagggttcctgaat

SEQ ID NO: 668045 - DNA, 20 bp, mouse
gctagagctcccagctggct

SEQ ID NO: 668046 - DNA, 20 bp, mouse
gtgtcacagacgatatgaca

SEQ ID NO: 668047 - DNA, 20 bp, mouse
gtacatggctcaattggtga

SEQ ID NO: 668048 - DNA, 20 bp, mouse
gactcagacctctggggatg

SEQ ID NO: 668049 - DNA, 20 bp, mouse
gttgcaccctgctttgactt

SEQ ID NO: 668050 - DNA, 20 bp, mouse
gccccagaggtctgagtaca

SEQ ID NO: 668051 - DNA, 20 bp, mouse
ggtgcatttctttgattggc

SEQ ID NO: 668052 - DNA, 20 bp, mouse
gagtacatttagtttcaatt

SEQ ID NO: 668053 - DNA, 20 bp, mouse
gctagaaacgtgtttagata

SEQ ID NO: 668054 - DNA, 20 bp, mouse
ggccatgtactcagacctct

SEQ ID NO: 668055 - DNA, 20 bp, mouse
gcgagtatgaaaagtgcatg

SEQ ID NO: 668056 - DNA, 20 bp, mouse
gcaatgtggaatacagagga

SEQ ID NO: 668057 - DNA, 20 bp, mouse
gtgtagctgggcaagaatca

SEQ ID NO: 668058 - DNA, 20 bp, mouse
ggttggtcacacagtgatga

SEQ ID NO: 668059 - DNA, 20 bp, mouse
ggcaaatgctaaggatttgg

SEQ ID NO: 668060 - DNA, 20 bp, mouse
gtcaaggctccctcccttaa

SEQ ID NO: 668061 - DNA, 20 bp, mouse
gatgtgctgcacaatgactt

SEQ ID NO: 668062 - DNA, 20 bp, mouse
gccagtcttccattaaggga

SEQ ID NO: 668063 - DNA, 20 bp, mouse
gtactcccagtcttccatta

SEQ ID NO: 668064 - DNA, 20 bp, mouse
gaacactgagctctctgttg

SEQ ID NO: 668065 - DNA, 20 bp, mouse
gtacaatggcactttcttcc

SEQ ID NO: 668066 - DNA, 20 bp, mouse
gagcctcagtccctccacgt

SEQ ID NO: 668067 - DNA, 20 bp, mouse
gtggaggcatcttagcttgt

SEQ ID NO: 668068 - DNA, 20 bp, mouse
gctaagatgcctccagtggg

SEQ ID NO: 668069 - DNA, 20 bp, mouse
gctgagtacccacccactgg

SEQ ID NO: 668070 - DNA, 20 bp, mouse
gctgaggaggaccaagggct

SEQ ID NO: 668071 - DNA, 20 bp, mouse
gcctggtgctgaattcttag

SEQ ID NO: 668072 - DNA, 20 bp, mouse
gcttgtgggaacccacgtgg

SEQ ID NO: 668073 - DNA, 20 bp, mouse
gtagcttgtgggaacccacg

SEQ ID NO: 668074 - DNA, 20 bp, mouse
gagagcatatggggtgatta

SEQ ID NO: 668075 - DNA, 20 bp, mouse
ggaggaaattgtggctggac

SEQ ID NO: 668076 - DNA, 20 bp, mouse
gcctgcctatgaatcgagag

SEQ ID NO: 668077 - DNA, 20 bp, mouse
gactccccctctcgattcat

SEQ ID NO: 668078 - DNA, 20 bp, mouse
gctggcaggtgctgtctcaa

SEQ ID NO: 668079 - DNA, 20 bp, mouse
gccacagtcctccacttcct

SEQ ID NO: 668080 - DNA, 20 bp, mouse
ggagtgagagggtgtcttgc

SEQ ID NO: 668081 - DNA, 20 bp, mouse
ggcaacttagatatatgcct

SEQ ID NO: 668082 - DNA, 20 bp, mouse
ggagagggtgtcttgctggc

SEQ ID NO: 668083 - DNA, 20 bp, mouse
gagataaagaagctgacgtc

SEQ ID NO: 668084 - DNA, 20 bp, mouse
gatactgtaatcttgacctg

SEQ ID NO: 668085 - DNA, 20 bp, mouse
gagtatgtgccaccaaaccg

SEQ ID NO: 668086 - DNA, 20 bp, mouse
ggcccccggggagctagcag

SEQ ID NO: 668087 - DNA, 20 bp, mouse
gctcccctgctagctccccg

SEQ ID NO: 668088 - DNA, 20 bp, mouse
gttctggggtgagaggcgaa

SEQ ID NO: 668089 - DNA, 20 bp, mouse
gaggggggaggtacaactaa

SEQ ID NO: 668090 - DNA, 20 bp, mouse
gctcacgccttgtaaggagt

SEQ ID NO: 668091 - DNA, 20 bp, mouse
ggttacagagctgagagtca

SEQ ID NO: 668092 - DNA, 20 bp, mouse
gtcctgctccagcagccccc

SEQ ID NO: 668093 - DNA, 20 bp, mouse
gagggatcaaggcctctggc

SEQ ID NO: 668094 - DNA, 20 bp, mouse
gcccccggccctcccgccag

SEQ ID NO: 668095 - DNA, 20 bp, mouse
ggctgctcttgacaggggga

SEQ ID NO: 668096 - DNA, 20 bp, mouse
gcaccggcccggggtgactt

SEQ ID NO: 668097 - DNA, 20 bp, mouse
ggcccagccgagcatactca

SEQ ID NO: 668098 - DNA, 20 bp, mouse
gagagccgcacaggagggtg

SEQ ID NO: 668099 - DNA, 20 bp, mouse
gggtgacttgggatgtcccg

SEQ ID NO: 668100 - DNA, 20 bp, mouse
gacggggcgggacattgcga

SEQ ID NO: 668101 - DNA, 20 bp, mouse
gaggctgcatgcacaggcgc

SEQ ID NO: 668102 - DNA, 20 bp, mouse
gccgggctctggcacagcta

SEQ ID NO: 668103 - DNA, 20 bp, mouse
ggtggtgcgcggggttggcg

SEQ ID NO: 668104 - DNA, 20 bp, mouse
gggcggccagcgcggcaggt

SEQ ID NO: 668105 - DNA, 20 bp, mouse
ggactcccacacgggacctg

SEQ ID NO: 668106 - DNA, 20 bp, mouse
gcggagtgcggaaaagagaa

SEQ ID NO: 668107 - DNA, 20 bp, mouse
gactgagagaggtgcccaag

SEQ ID NO: 668108 - DNA, 20 bp, mouse
gagccgccggacctgttgat

SEQ ID NO: 668109 - DNA, 20 bp, mouse
gtccctatcaacaggtccgg

SEQ ID NO: 668110 - DNA, 20 bp, mouse
gtatctggtcacctctggaa

SEQ ID NO: 668111 - DNA, 20 bp, mouse
gctccggagagactatgaag

SEQ ID NO: 668112 - DNA, 20 bp, mouse
gacttgccagggacagatga

SEQ ID NO: 668113 - DNA, 20 bp, mouse
gaaaacaccccattagaggt

SEQ ID NO: 668114 - DNA, 20 bp, mouse
gccatccctatcaacaggtc

SEQ ID NO: 668115 - DNA, 20 bp, mouse
gacagacatgtgcccccctt

SEQ ID NO: 668116 - DNA, 20 bp, mouse
gcaaccgggctgctactgag

SEQ ID NO: 668117 - DNA, 20 bp, mouse
ggagagagctccaagacaac

SEQ ID NO: 668118 - DNA, 20 bp, mouse
gtgtgcttggagatccacat

SEQ ID NO: 668119 - DNA, 20 bp, mouse
gggaacctgaggtcgggggt

SEQ ID NO: 668120 - DNA, 20 bp, mouse
gaggttggacaaggcttccg

SEQ ID NO: 668121 - DNA, 20 bp, mouse
gggcagcaggggcgcggatg

SEQ ID NO: 668122 - DNA, 20 bp, mouse
gcagctgcgagcccgaggtt

SEQ ID NO: 668123 - DNA, 20 bp, mouse
gaactcatgctcaaagggac

SEQ ID NO: 668124 - DNA, 20 bp, mouse
gcatgctcaaagggactggg

SEQ ID NO: 668125 - DNA, 20 bp, mouse
gagccggccagcgtggtcca

SEQ ID NO: 668126 - DNA, 20 bp, mouse
ggccctgcggcgagatccga

SEQ ID NO: 668127 - DNA, 20 bp, mouse
gtcggggcgggtccagaccc

SEQ ID NO: 668128 - DNA, 20 bp, mouse
gcccccgtcggggtccaaca

SEQ ID NO: 668129 - DNA, 20 bp, mouse
gccaacaagggtctgggtcg

SEQ ID NO: 668130 - DNA, 20 bp, mouse
gtgcgccccagaggctggat

SEQ ID NO: 668131 - DNA, 20 bp, mouse
gccgcccgggtgcgccccag

SEQ ID NO: 668132 - DNA, 20 bp, mouse
gcaagggtctgggtcggggc

SEQ ID NO: 668133 - DNA, 20 bp, mouse
gctgcccagcaggcgggctc

SEQ ID NO: 668134 - DNA, 20 bp, mouse
gcggggtccaacaagggtct

SEQ ID NO: 668135 - DNA, 20 bp, mouse
gggaagtgctaggatccgtg

SEQ ID NO: 668136 - DNA, 20 bp, mouse
gttacagggcacatgatcaa

SEQ ID NO: 668137 - DNA, 20 bp, mouse
gtcaagggactcaaaccaca

SEQ ID NO: 668138 - DNA, 20 bp, mouse
gaccaccagataatgtgctc

SEQ ID NO: 668139 - DNA, 20 bp, mouse
gggcagagagtcatagacct

SEQ ID NO: 668140 - DNA, 20 bp, mouse
ggtgccctgtaaagtggccc

SEQ ID NO: 668141 - DNA, 20 bp, mouse
gctctcctgagcacattatc

SEQ ID NO: 668142 - DNA, 20 bp, mouse
gagcccctcctctgtgagca

SEQ ID NO: 668143 - DNA, 20 bp, mouse
gtggaagcggttttcaaaat

SEQ ID NO: 668144 - DNA, 20 bp, mouse
gctgtgagcaaggcagagtg

SEQ ID NO: 668145 - DNA, 20 bp, mouse
gtcctgagcacattatctgg

SEQ ID NO: 668146 - DNA, 20 bp, mouse
gcgcagcccgccacacctgg

SEQ ID NO: 668147 - DNA, 20 bp, mouse
gcgggcacttggtctccctg

SEQ ID NO: 668148 - DNA, 20 bp, mouse
ggtgcggtgacgtcacgcgg

SEQ ID NO: 668149 - DNA, 20 bp, mouse
ggcgcgcgccaccatcctcc

SEQ ID NO: 668150 - DNA, 20 bp, mouse
gagctgtgtcgtacacccca

SEQ ID NO: 668151 - DNA, 20 bp, mouse
ggacccgcagggaactctgt

SEQ ID NO: 668152 - DNA, 20 bp, mouse
gcaccatcctccaggtgtgg

SEQ ID NO: 668153 - DNA, 20 bp, mouse
ggcgcgcgccacccaggctc

SEQ ID NO: 668154 - DNA, 20 bp, mouse
ggcccgcagcccgccacacc

SEQ ID NO: 668155 - DNA, 20 bp, mouse
gccacccaggctccggcagc

SEQ ID NO: 668156 - DNA, 20 bp, mouse
ggcgagtcggccttggctaa

SEQ ID NO: 668157 - DNA, 20 bp, mouse
gaagcccgggtgtctactga

SEQ ID NO: 668158 - DNA, 20 bp, mouse
ggcctcacgggacttgagga

SEQ ID NO: 668159 - DNA, 20 bp, mouse
gccggcataggacccggaag

SEQ ID NO: 668160 - DNA, 20 bp, mouse
ggccaaggccgactcgcggc

SEQ ID NO: 668161 - DNA, 20 bp, mouse
gtacagtgaggataaggacg

SEQ ID NO: 668162 - DNA, 20 bp, mouse
gtcctgccgcgagtcggcct

SEQ ID NO: 668163 - DNA, 20 bp, mouse
gaaggacgtggtgtgctaag

SEQ ID NO: 668164 - DNA, 20 bp, mouse
gtggccttcagtagacaccc

SEQ ID NO: 668165 - DNA, 20 bp, mouse
gtggagaccggcataggacc

SEQ ID NO: 668166 - DNA, 20 bp, mouse
gaggggtcatcaggctgtca

SEQ ID NO: 668167 - DNA, 20 bp, mouse
gagctgatgaaccccccgtg

SEQ ID NO: 668168 - DNA, 20 bp, mouse
ggagatcagagcctcacggg

SEQ ID NO: 668169 - DNA, 20 bp, mouse
gagtgggcaccacccaggca

SEQ ID NO: 668170 - DNA, 20 bp, mouse
gccccagcgggactgaaccg

SEQ ID NO: 668171 - DNA, 20 bp, mouse
gcgggagaaactaaaagaat

SEQ ID NO: 668172 - DNA, 20 bp, mouse
gtggagagcccctggtcaaa

SEQ ID NO: 668173 - DNA, 20 bp, mouse
ggcgtctggctcagggtgca

SEQ ID NO: 668174 - DNA, 20 bp, mouse
gaaagaatcggaaggagccg

SEQ ID NO: 668175 - DNA, 20 bp, mouse
gacccccaaaaattcctgaa

SEQ ID NO: 668176 - DNA, 20 bp, mouse
gagcccttgggtaaaggcta

SEQ ID NO: 668177 - DNA, 20 bp, mouse
gaacccacggctggggactg

SEQ ID NO: 668178 - DNA, 20 bp, mouse
gggtggaagcccttgggtaa

SEQ ID NO: 668179 - DNA, 20 bp, mouse
ggtaaaggctaggggacaga

SEQ ID NO: 668180 - DNA, 20 bp, mouse
gtcccctagcctttacccaa

SEQ ID NO: 668181 - DNA, 20 bp, mouse
gtgacaagccccttcctgag

SEQ ID NO: 668182 - DNA, 20 bp, mouse
gcaacaagtggggaaaccca

SEQ ID NO: 668183 - DNA, 20 bp, mouse
gagtggggaaacccacggct

SEQ ID NO: 668184 - DNA, 20 bp, mouse
gcaggagggtggaagccctt

SEQ ID NO: 668185 - DNA, 20 bp, mouse
gcccacttgttgggtgtggt

SEQ ID NO: 668186 - DNA, 20 bp, mouse
gaagggagctggagaaacaa

SEQ ID NO: 668187 - DNA, 20 bp, mouse
gaatcgcttcagagaatgaa

SEQ ID NO: 668188 - DNA, 20 bp, mouse
ggaagcagtggggatcaggc

SEQ ID NO: 668189 - DNA, 20 bp, mouse
gtcaggcaggtgtactagac

SEQ ID NO: 668190 - DNA, 20 bp, mouse
gcaggtgtactagacaggaa

SEQ ID NO: 668191 - DNA, 20 bp, mouse
gtgagtgcaggcccgtgcaa

SEQ ID NO: 668192 - DNA, 20 bp, mouse
gctggctttcctgaagcgtc

SEQ ID NO: 668193 - DNA, 20 bp, mouse
gcggagcagatccattgcac

SEQ ID NO: 668194 - DNA, 20 bp, mouse
gtgtcacagcctgacgcttc

SEQ ID NO: 668195 - DNA, 20 bp, mouse
gtttctgcccagttgatctc

SEQ ID NO: 668196 - DNA, 20 bp, mouse
gagggaagcctgtagaccag

SEQ ID NO: 668197 - DNA, 20 bp, mouse
gagtagaaacgaggaggcca

SEQ ID NO: 668198 - DNA, 20 bp, mouse
ggggtcactcagtagaaacg

SEQ ID NO: 668199 - DNA, 20 bp, mouse
ggaagcctgtagaccagtgg

SEQ ID NO: 668200 - DNA, 20 bp, mouse
ggaccagtggtggggaagtc

SEQ ID NO: 668201 - DNA, 20 bp, mouse
gtcactcagtagaaacgagg

SEQ ID NO: 668202 - DNA, 20 bp, mouse
ggtgctgagtaactgacggc

SEQ ID NO: 668203 - DNA, 20 bp, mouse
gacaatctggtcttgggtta

SEQ ID NO: 668204 - DNA, 20 bp, mouse
gagtctcagctcgtgttagt

SEQ ID NO: 668205 - DNA, 20 bp, mouse
gttccccaccactggtctac

SEQ ID NO: 668206 - DNA, 20 bp, mouse
gagtgacagccgggtgaaca

SEQ ID NO: 668207 - DNA, 20 bp, mouse
gctgagttgcaggggatcat

SEQ ID NO: 668208 - DNA, 20 bp, mouse
gtttgagacaaccaagtcac

SEQ ID NO: 668209 - DNA, 20 bp, mouse
ggggagaggagaacaaccaa

SEQ ID NO: 668210 - DNA, 20 bp, mouse
gactggaaaagagtgacagc

SEQ ID NO: 668211 - DNA, 20 bp, mouse
ggtagtagcaagagtgtaca

SEQ ID NO: 668212 - DNA, 20 bp, mouse
gctctaatgagtagatgcaa

SEQ ID NO: 668213 - DNA, 20 bp, mouse
gtgcaactcagttacttcct

SEQ ID NO: 668214 - DNA, 20 bp, mouse
gagaacaaccaaaggcatag

SEQ ID NO: 668215 - DNA, 20 bp, mouse
gactacagccactatgcctt

SEQ ID NO: 668216 - DNA, 20 bp, mouse
ggaacagagactggaatgga

SEQ ID NO: 668217 - DNA, 20 bp, mouse
ggacttctggaaagagaaca

SEQ ID NO: 668218 - DNA, 20 bp, mouse
gaagtgccgagtgagagtga

SEQ ID NO: 668219 - DNA, 20 bp, mouse
gtcagctccagactgacttc

SEQ ID NO: 668220 - DNA, 20 bp, mouse
gagcgcttcaataggttgaa

SEQ ID NO: 668221 - DNA, 20 bp, mouse
ggagcctgcacattcaaagc

SEQ ID NO: 668222 - DNA, 20 bp, mouse
ggtaatgagtgggagtgctg

SEQ ID NO: 668223 - DNA, 20 bp, mouse
gagaaggccagcgcttcaat

SEQ ID NO: 668224 - DNA, 20 bp, mouse
ggtgcttggcacccatgatg

SEQ ID NO: 668225 - DNA, 20 bp, mouse
ggagctatgtggtaaggtca

SEQ ID NO: 668226 - DNA, 20 bp, mouse
gtaggggctggagattgggt

SEQ ID NO: 668227 - DNA, 20 bp, mouse
ggtaactggcactgggtaga

SEQ ID NO: 668228 - DNA, 20 bp, mouse
gcacagattaaggctaagta

SEQ ID NO: 668229 - DNA, 20 bp, mouse
gtgggtgggtctgcaacctg

SEQ ID NO: 668230 - DNA, 20 bp, mouse
gacaggcaaatcacagatta

SEQ ID NO: 668231 - DNA, 20 bp, mouse
gaggaaaaacaatatatcag

SEQ ID NO: 668232 - DNA, 20 bp, mouse
gaaaagcagaaggccctcca

SEQ ID NO: 668233 - DNA, 20 bp, mouse
gacctgtggtaactggcact

SEQ ID NO: 668234 - DNA, 20 bp, mouse
ggtctgcaacctgtggtaac

SEQ ID NO: 668235 - DNA, 20 bp, mouse
gaggccatgatgaattacac

SEQ ID NO: 668236 - DNA, 20 bp, mouse
gaccaagtcaggacatgtga

SEQ ID NO: 668237 - DNA, 20 bp, mouse
gagggacagctgggtaaaca

SEQ ID NO: 668238 - DNA, 20 bp, mouse
gaggacatgtgagggacagc

SEQ ID NO: 668239 - DNA, 20 bp, mouse
gtccctcacatgtcctgact

SEQ ID NO: 668240 - DNA, 20 bp, mouse
gggcttgaggagacgtctca

SEQ ID NO: 668241 - DNA, 20 bp, mouse
ggagagagagtgtgggcttg

SEQ ID NO: 668242 - DNA, 20 bp, mouse
gagagcaaccaaaggcaggt

SEQ ID NO: 668243 - DNA, 20 bp, mouse
gcgtctcatggagcccaagc

SEQ ID NO: 668244 - DNA, 20 bp, mouse
gctactagggcctcaggcat

SEQ ID NO: 668245 - DNA, 20 bp, mouse
gatgcccctggcctgctctg

SEQ ID NO: 668246 - DNA, 20 bp, mouse
ggaagagaagttggagtctg

SEQ ID NO: 668247 - DNA, 20 bp, mouse
gggacgctcagatccccaag

SEQ ID NO: 668248 - DNA, 20 bp, mouse
gcgctcagatccccaagcgg

SEQ ID NO: 668249 - DNA, 20 bp, mouse
gcgtcccagcagtgcgaccc

SEQ ID NO: 668250 - DNA, 20 bp, mouse
ggagcccagggtcgcactgc

SEQ ID NO: 668251 - DNA, 20 bp, mouse
gcgacgcctcccactcgagg

SEQ ID NO: 668252 - DNA, 20 bp, mouse
gaaccaggacagagcattgg

SEQ ID NO: 668253 - DNA, 20 bp, mouse
gcgcctcccactcgaggcgg

SEQ ID NO: 668254 - DNA, 20 bp, mouse
gccactcccccgcctcgagt

SEQ ID NO: 668255 - DNA, 20 bp, mouse
ggcggtgtgtccgccgcttg

SEQ ID NO: 668256 - DNA, 20 bp, mouse
gtaactcccagatattctac

SEQ ID NO: 668257 - DNA, 20 bp, mouse
gccagatattctacaggctg

SEQ ID NO: 668258 - DNA, 20 bp, mouse
gctaatgtgtttggtgacct

SEQ ID NO: 668259 - DNA, 20 bp, mouse
gctcgcgcacgcgcacacaa

SEQ ID NO: 668260 - DNA, 20 bp, mouse
gcacttgcctagtagtattc

SEQ ID NO: 668261 - DNA, 20 bp, mouse
gcgtaagtacccgaatacaa

SEQ ID NO: 668262 - DNA, 20 bp, mouse
gatctgggagttacaggcct

SEQ ID NO: 668263 - DNA, 20 bp, mouse
ggagcctcctgaatactact

SEQ ID NO: 668264 - DNA, 20 bp, mouse
gaataaaaaacaggaattcg

SEQ ID NO: 668265 - DNA, 20 bp, mouse
gagccaacctaggctattaa

SEQ ID NO: 668266 - DNA, 20 bp, mouse
gtagcccaacatgtggaaag

SEQ ID NO: 668267 - DNA, 20 bp, mouse
gtcgaagactatggtgtcac

SEQ ID NO: 668268 - DNA, 20 bp, mouse
ggggtgagagtcgaagacta

SEQ ID NO: 668269 - DNA, 20 bp, mouse
ggggctcaaggggttaacag

SEQ ID NO: 668270 - DNA, 20 bp, mouse
gcctgtagggtgaagtatga

SEQ ID NO: 668271 - DNA, 20 bp, mouse
gagctccaatagcatatgtg

SEQ ID NO: 668272 - DNA, 20 bp, mouse
gagagacgggagccggaggt

SEQ ID NO: 668273 - DNA, 20 bp, mouse
gaggggggtgaattcctgta

SEQ ID NO: 668274 - DNA, 20 bp, mouse
gaccctacaaagaaatgagg

SEQ ID NO: 668275 - DNA, 20 bp, mouse
gactgagaagaacccacctc

SEQ ID NO: 668276 - DNA, 20 bp, mouse
ggaagtaggaactacgagag

SEQ ID NO: 668277 - DNA, 20 bp, mouse
gaggcagccaagatgacaca

SEQ ID NO: 668278 - DNA, 20 bp, mouse
gtaaactcaggcgtacacag

SEQ ID NO: 668279 - DNA, 20 bp, mouse
ggcctcaccaagacgcaaca

SEQ ID NO: 668280 - DNA, 20 bp, mouse
gccaccgtgactatctctaa

SEQ ID NO: 668281 - DNA, 20 bp, mouse
gcctgctccctgtccggagt

SEQ ID NO: 668282 - DNA, 20 bp, mouse
ggctccctgtccggagtggg

SEQ ID NO: 668283 - DNA, 20 bp, mouse
gtaggaactacgagaggggc

SEQ ID NO: 668284 - DNA, 20 bp, mouse
gcaccaagacgcaacaggga

SEQ ID NO: 668285 - DNA, 20 bp, mouse
gacacggttaaaagtgaagt

SEQ ID NO: 668286 - DNA, 20 bp, mouse
gaaggggcggctcaaatcag

SEQ ID NO: 668287 - DNA, 20 bp, mouse
ggggcggctcaaatcagggg

SEQ ID NO: 668288 - DNA, 20 bp, mouse
gtcagaggccagagaaccaa

SEQ ID NO: 668289 - DNA, 20 bp, mouse
ggcctctgacttacttggat

SEQ ID NO: 668290 - DNA, 20 bp, mouse
gctggagtgtagcagcaagg

SEQ ID NO: 668291 - DNA, 20 bp, mouse
ggctcacaagggtctatttc

SEQ ID NO: 668292 - DNA, 20 bp, mouse
gctgctagttaagctcacaa

SEQ ID NO: 668293 - DNA, 20 bp, mouse
ggcaagggggaagtaaatta

SEQ ID NO: 668294 - DNA, 20 bp, mouse
gtcccatccaagtaagtcag

SEQ ID NO: 668295 - DNA, 20 bp, mouse
gcggctcaaatcagttccgt

SEQ ID NO: 668296 - DNA, 20 bp, mouse
gggacccctggggaagtgaa

SEQ ID NO: 668297 - DNA, 20 bp, mouse
ggtgcgccctgcctgagcta

SEQ ID NO: 668298 - DNA, 20 bp, mouse
ggagtgcacagcagtacctg

SEQ ID NO: 668299 - DNA, 20 bp, mouse
gggtactgctgtgcactcga

SEQ ID NO: 668300 - DNA, 20 bp, mouse
gtgaggtcagagtgtctgtg

SEQ ID NO: 668301 - DNA, 20 bp, mouse
gacagtcccaggagtgagga

SEQ ID NO: 668302 - DNA, 20 bp, mouse
gcagaagatcacagggtgca

SEQ ID NO: 668303 - DNA, 20 bp, mouse
ggaaagaggaagttccgggg

SEQ ID NO: 668304 - DNA, 20 bp, mouse
gtgagctatggacacctgcg

SEQ ID NO: 668305 - DNA, 20 bp, mouse
gggccagggttggacccctg

SEQ ID NO: 668306 - DNA, 20 bp, mouse
ggagtctggaagtaagcagt

SEQ ID NO: 668307 - DNA, 20 bp, mouse
ggaactttggagcaggagta

SEQ ID NO: 668308 - DNA, 20 bp, mouse
gggaggtgactggactaata

SEQ ID NO: 668309 - DNA, 20 bp, mouse
gctgctccaaagttccacgg

SEQ ID NO: 668310 - DNA, 20 bp, mouse
gaggctcttgggttgtcaac

SEQ ID NO: 668311 - DNA, 20 bp, mouse
gctcctgctccaaagttcca

SEQ ID NO: 668312 - DNA, 20 bp, mouse
gtgtcaagtgtcaaggttgt

SEQ ID NO: 668313 - DNA, 20 bp, mouse
gctggactaataaggctctt

SEQ ID NO: 668314 - DNA, 20 bp, mouse
gagtgtcaaggttgttggtc

SEQ ID NO: 668315 - DNA, 20 bp, mouse
gcattcattgccaggcattt

SEQ ID NO: 668316 - DNA, 20 bp, mouse
gcaacagtgggctaggtgtg

SEQ ID NO: 668317 - DNA, 20 bp, mouse
gcctccgccaacagactcat

SEQ ID NO: 668318 - DNA, 20 bp, mouse
gtgtggggtaaaacacaaac

SEQ ID NO: 668319 - DNA, 20 bp, mouse
gagactgtcaaagcaacagt

SEQ ID NO: 668320 - DNA, 20 bp, mouse
gcggaggatagtgctaaccc

SEQ ID NO: 668321 - DNA, 20 bp, mouse
gtcccagagtgtcctgtgaa

SEQ ID NO: 668322 - DNA, 20 bp, mouse
gttacaccatcaaaggcaga

SEQ ID NO: 668323 - DNA, 20 bp, mouse
ggacccttcacaggacactc

SEQ ID NO: 668324 - DNA, 20 bp, mouse
ggtcaaagcaacagtgggct

SEQ ID NO: 668325 - DNA, 20 bp, mouse
gctcatgggtattcagaaaa

SEQ ID NO: 668326 - DNA, 20 bp, mouse
gttcccataaggatgaacaa

SEQ ID NO: 668327 - DNA, 20 bp, mouse
ggcctcacagccttcccata

SEQ ID NO: 668328 - DNA, 20 bp, mouse
ggctggaggggttatgcata

SEQ ID NO: 668329 - DNA, 20 bp, mouse
gcccccttgttcatccttat

SEQ ID NO: 668330 - DNA, 20 bp, mouse
gccaagggcaccataacaga

SEQ ID NO: 668331 - DNA, 20 bp, mouse
gtttttcacagcactctcgg

SEQ ID NO: 668332 - DNA, 20 bp, mouse
gtctgagcagcaggatggag

SEQ ID NO: 668333 - DNA, 20 bp, mouse
gcctccgccttggttaactg

SEQ ID NO: 668334 - DNA, 20 bp, mouse
gtgtggaggtgctttgcaca

SEQ ID NO: 668335 - DNA, 20 bp, mouse
gtcttcctgcctccgctgga

SEQ ID NO: 668336 - DNA, 20 bp, mouse
ggggaagcgggaaactgagg

SEQ ID NO: 668337 - DNA, 20 bp, mouse
gtgcccaccacgtggatcca

SEQ ID NO: 668338 - DNA, 20 bp, mouse
ggcaagctagctcggatcta

SEQ ID NO: 668339 - DNA, 20 bp, mouse
gacgtgagcaaagttgtcgg

SEQ ID NO: 668340 - DNA, 20 bp, mouse
ggaggagtctgcagagtcat

SEQ ID NO: 668341 - DNA, 20 bp, mouse
gggaagcatccaagtcctgt

SEQ ID NO: 668342 - DNA, 20 bp, mouse
ggaactgatttccccctgca

SEQ ID NO: 668343 - DNA, 20 bp, mouse
gcttgcgtttctgacgaaca

SEQ ID NO: 668344 - DNA, 20 bp, mouse
gttaagagtggaggttatcc

SEQ ID NO: 668345 - DNA, 20 bp, mouse
gtgcccctttaagacggtgt

SEQ ID NO: 668346 - DNA, 20 bp, mouse
gggtaaaggggtttccaagt

SEQ ID NO: 668347 - DNA, 20 bp, mouse
ggcccacactctacaggaga

SEQ ID NO: 668348 - DNA, 20 bp, mouse
gagaggttctagtggtaaag

SEQ ID NO: 668349 - DNA, 20 bp, mouse
gtgcaggatagcaggtggca

SEQ ID NO: 668350 - DNA, 20 bp, mouse
gcgccctctcctgtagagtg

SEQ ID NO: 668351 - DNA, 20 bp, mouse
gttaaggcttgcaggatagc

SEQ ID NO: 668352 - DNA, 20 bp, mouse
gagcatcaacacccctgctg

SEQ ID NO: 668353 - DNA, 20 bp, mouse
gtcccagctcaatgcatgct

SEQ ID NO: 668354 - DNA, 20 bp, mouse
gctgtagagtgtgggcagca

SEQ ID NO: 668355 - DNA, 20 bp, mouse
ggggcagcaggggccccagc

SEQ ID NO: 668356 - DNA, 20 bp, mouse
gctggaatgtcactattgtt

SEQ ID NO: 668357 - DNA, 20 bp, mouse
ggcctcacgttgacctaacc

SEQ ID NO: 668358 - DNA, 20 bp, mouse
gaggctgtttcagcttttta

SEQ ID NO: 668359 - DNA, 20 bp, mouse
gcggacgtaagccagccctc

SEQ ID NO: 668360 - DNA, 20 bp, mouse
ggcagaggagcctcacgacc

SEQ ID NO: 668361 - DNA, 20 bp, mouse
gtgcctgagcagaatcaagc

SEQ ID NO: 668362 - DNA, 20 bp, mouse
ggcagaatcaagctggagtc

SEQ ID NO: 668363 - DNA, 20 bp, mouse
ggaaacagcaagagtcaaca

SEQ ID NO: 668364 - DNA, 20 bp, mouse
ggcctggttaggtcaacgtg

SEQ ID NO: 668365 - DNA, 20 bp, mouse
gggcttacaggcacgggcac

SEQ ID NO: 668366 - DNA, 20 bp, mouse
ggaggagccagggtcccaaa

SEQ ID NO: 668367 - DNA, 20 bp, mouse
gtaagggatgggcaccaagg

SEQ ID NO: 668368 - DNA, 20 bp, mouse
gtggggacaatcagactcct

SEQ ID NO: 668369 - DNA, 20 bp, mouse
ggggactggggagcgccaca

SEQ ID NO: 668370 - DNA, 20 bp, mouse
gcctgctaggagtcccgccc

SEQ ID NO: 668371 - DNA, 20 bp, mouse
gcaagatagcagaggggtga

SEQ ID NO: 668372 - DNA, 20 bp, mouse
ggtcgggtaatgtaagaaaa

SEQ ID NO: 668373 - DNA, 20 bp, mouse
gaggtcctggatgcgaggag

SEQ ID NO: 668374 - DNA, 20 bp, mouse
gggatgggcaccaaggtggc

SEQ ID NO: 668375 - DNA, 20 bp, mouse
gggggtgaaggattactata

SEQ ID NO: 668376 - DNA, 20 bp, mouse
gagcctggaagtgaatgata

SEQ ID NO: 668377 - DNA, 20 bp, mouse
gcatgagaagactgtcaaag

SEQ ID NO: 668378 - DNA, 20 bp, mouse
gactaacaaaagggaaagcc

SEQ ID NO: 668379 - DNA, 20 bp, mouse
gcaaagtggccgccttactc

SEQ ID NO: 668380 - DNA, 20 bp, mouse
gcgtcgcaacccacacttcc

SEQ ID NO: 668381 - DNA, 20 bp, mouse
ggaacctggtataaagttaa

SEQ ID NO: 668382 - DNA, 20 bp, mouse
gactacgaagcacattttcc

SEQ ID NO: 668383 - DNA, 20 bp, mouse
gacccatatcattcacttcc

SEQ ID NO: 668384 - DNA, 20 bp, mouse
ggcaaaaaaagttacgtaaa

SEQ ID NO: 668385 - DNA, 20 bp, mouse
gcacattttccaggaagtgt

SEQ ID NO: 668386 - DNA, 20 bp, mouse
ggagtggccctggagaacgt

SEQ ID NO: 668387 - DNA, 20 bp, mouse
gggcagtagcgaaagcaggc

SEQ ID NO: 668388 - DNA, 20 bp, mouse
gaaggacacacccaaagcga

SEQ ID NO: 668389 - DNA, 20 bp, mouse
gcccaggcagcgcttctcat

SEQ ID NO: 668390 - DNA, 20 bp, mouse
gcgtgcgcccacgttctcca

SEQ ID NO: 668391 - DNA, 20 bp, mouse
gctcttctgtccaagagagc

SEQ ID NO: 668392 - DNA, 20 bp, mouse
gcaggggcagtagcgaaagc

SEQ ID NO: 668393 - DNA, 20 bp, mouse
ggaagcctgtggagtggccc

SEQ ID NO: 668394 - DNA, 20 bp, mouse
gcgtgggcgcacgggggctg

SEQ ID NO: 668395 - DNA, 20 bp, mouse
gagtgagtgacctaagaggg

SEQ ID NO: 668396 - DNA, 20 bp, mouse
gtggccaggccgctcctggc

SEQ ID NO: 668397 - DNA, 20 bp, mouse
gaatcggctggcagtaaggt

SEQ ID NO: 668398 - DNA, 20 bp, mouse
ggcacagcaaagtgggacaa

SEQ ID NO: 668399 - DNA, 20 bp, mouse
gggcccagccgcttgaactg

SEQ ID NO: 668400 - DNA, 20 bp, mouse
gtggcgggagcgcaacctca

SEQ ID NO: 668401 - DNA, 20 bp, mouse
gcgctcccgccaggaatttt

SEQ ID NO: 668402 - DNA, 20 bp, mouse
gttcaagcggctgggccatg

SEQ ID NO: 668403 - DNA, 20 bp, mouse
ggtgactggtagcgctagct

SEQ ID NO: 668404 - DNA, 20 bp, mouse
gtagcgctagctaggccaat

SEQ ID NO: 668405 - DNA, 20 bp, mouse
gtaacgcagctaggtaagga

SEQ ID NO: 668406 - DNA, 20 bp, mouse
gccatgtggtgtgatggtag

SEQ ID NO: 668407 - DNA, 20 bp, mouse
gctgttgcctgtggggagta

SEQ ID NO: 668408 - DNA, 20 bp, mouse
gaggaagcaaaacccaaaac

SEQ ID NO: 668409 - DNA, 20 bp, mouse
ggacagatgggcgttgctgg

SEQ ID NO: 668410 - DNA, 20 bp, mouse
ggggcagagggccatgtgaa

SEQ ID NO: 668411 - DNA, 20 bp, mouse
ggagaccaccagcgtcgcag

SEQ ID NO: 668412 - DNA, 20 bp, mouse
gcaaaaccggaagtcgtatg

SEQ ID NO: 668413 - DNA, 20 bp, mouse
ggggcgcctgcccttcaatc

SEQ ID NO: 668414 - DNA, 20 bp, mouse
ggcaggctgcatgcggaaca

SEQ ID NO: 668415 - DNA, 20 bp, mouse
gctcccctctgcgacgctgg

SEQ ID NO: 668416 - DNA, 20 bp, mouse
gcagaaccaggtgtccttgt

SEQ ID NO: 668417 - DNA, 20 bp, mouse
gtggggcaggtggtttcaca

SEQ ID NO: 668418 - DNA, 20 bp, mouse
gagggagggggcataaacag

SEQ ID NO: 668419 - DNA, 20 bp, mouse
gcacgaggtgcctggaactg

SEQ ID NO: 668420 - DNA, 20 bp, mouse
gtcaggcctccattctaatt

SEQ ID NO: 668421 - DNA, 20 bp, mouse
ggacagttcaacttcaaaca

SEQ ID NO: 668422 - DNA, 20 bp, mouse
gcataaacaggggtggaaag

SEQ ID NO: 668423 - DNA, 20 bp, mouse
gccccactcagaatcctgta

SEQ ID NO: 668424 - DNA, 20 bp, mouse
ggagaggtcgttctactctc

SEQ ID NO: 668425 - DNA, 20 bp, mouse
gtgggcactaccgcagttcc

SEQ ID NO: 668426 - DNA, 20 bp, mouse
gcagagcaacatggagacac

SEQ ID NO: 668427 - DNA, 20 bp, mouse
gaggaaggagggcctagggg

SEQ ID NO: 668428 - DNA, 20 bp, mouse
gcgggaggaaggagggccta

SEQ ID NO: 668429 - DNA, 20 bp, mouse
gtagtcagcagtgtgatgta

SEQ ID NO: 668430 - DNA, 20 bp, mouse
ggtggatgaaactagccttg

SEQ ID NO: 668431 - DNA, 20 bp, mouse
gggtctatgtcactctggat

SEQ ID NO: 668432 - DNA, 20 bp, mouse
ggaaaacaagattccttccc

SEQ ID NO: 668433 - DNA, 20 bp, mouse
gcagttctcaaaagaagcac

SEQ ID NO: 668434 - DNA, 20 bp, mouse
gctcatctacaggaacctca

SEQ ID NO: 668435 - DNA, 20 bp, mouse
ggctagtttcatccaccccc

SEQ ID NO: 668436 - DNA, 20 bp, mouse
gagactgagtgttctctctt

SEQ ID NO: 668437 - DNA, 20 bp, mouse
gaacccaagcgagaagagtg

SEQ ID NO: 668438 - DNA, 20 bp, mouse
gaaccagcttagaataggct

SEQ ID NO: 668439 - DNA, 20 bp, mouse
gccagaaaccagcttagaat

SEQ ID NO: 668440 - DNA, 20 bp, mouse
ggcaactacaaaatacccgt

SEQ ID NO: 668441 - DNA, 20 bp, mouse
gttcctcactcttctcgctt

SEQ ID NO: 668442 - DNA, 20 bp, mouse
gctcccagcctattctaagc

SEQ ID NO: 668443 - DNA, 20 bp, mouse
ggacacaccaatctgagttc

SEQ ID NO: 668444 - DNA, 20 bp, mouse
gagtttgtggtcaaacggtg

SEQ ID NO: 668445 - DNA, 20 bp, mouse
gacaatcatgctgtgacgac

SEQ ID NO: 668446 - DNA, 20 bp, mouse
gcacccgccctcattaatga

SEQ ID NO: 668447 - DNA, 20 bp, mouse
gtggcctctagcttcaccca

SEQ ID NO: 668448 - DNA, 20 bp, mouse
ggccccacccagggtgacga

SEQ ID NO: 668449 - DNA, 20 bp, mouse
gagtgctgacacagagtact

SEQ ID NO: 668450 - DNA, 20 bp, mouse
gggaacgccctcttgcacgc

SEQ ID NO: 668451 - DNA, 20 bp, mouse
ggccctcgtcaccctgggtg

SEQ ID NO: 668452 - DNA, 20 bp, mouse
gccactcccgccggacaact

SEQ ID NO: 668453 - DNA, 20 bp, mouse
gctacccacactcccaactc

SEQ ID NO: 668454 - DNA, 20 bp, mouse
ggtcccctgggtgaagctag

SEQ ID NO: 668455 - DNA, 20 bp, mouse
gtccggcgggagtggggtct

SEQ ID NO: 668456 - DNA, 20 bp, mouse
ggaaggcataggagcccagg

SEQ ID NO: 668457 - DNA, 20 bp, mouse
gggagcccagggggtgtggt

SEQ ID NO: 668458 - DNA, 20 bp, mouse
gaggagcaagccacgatgta

SEQ ID NO: 668459 - DNA, 20 bp, mouse
ggtgtctgaagagtatttgg

SEQ ID NO: 668460 - DNA, 20 bp, mouse
gtctgggcactagcaaacat

SEQ ID NO: 668461 - DNA, 20 bp, mouse
gcatgggcacaaaaacattg

SEQ ID NO: 668462 - DNA, 20 bp, mouse
gcaagccacgatgtatggcc

SEQ ID NO: 668463 - DNA, 20 bp, mouse
ggccttttagggtgttagtt

SEQ ID NO: 668464 - DNA, 20 bp, mouse
gctttccaggccatacatcg

SEQ ID NO: 668465 - DNA, 20 bp, mouse
gcaatgcaaaccaaatccac

SEQ ID NO: 668466 - DNA, 20 bp, mouse
gctgccaggaccagactctc

SEQ ID NO: 668467 - DNA, 20 bp, mouse
gctgactaggataccctaaa

SEQ ID NO: 668468 - DNA, 20 bp, mouse
gggcataggctcacaggggt

SEQ ID NO: 668469 - DNA, 20 bp, mouse
gctaggaggcataggctcac

SEQ ID NO: 668470 - DNA, 20 bp, mouse
gggtatcctagtcaggagta

SEQ ID NO: 668471 - DNA, 20 bp, mouse
gcatgggcacaaaaacagtt

SEQ ID NO: 668472 - DNA, 20 bp, mouse
gtgattccttactcctgact

SEQ ID NO: 668473 - DNA, 20 bp, mouse
gtattctgggatagcaagca

SEQ ID NO: 668474 - DNA, 20 bp, mouse
ggcacaaaaacagttaggaa

SEQ ID NO: 668475 - DNA, 20 bp, mouse
gtctgggtatctgggtattc

SEQ ID NO: 668476 - DNA, 20 bp, mouse
gccccacagaccctcaatgg

SEQ ID NO: 668477 - DNA, 20 bp, mouse
gctgaaaaaatgtgggtgga

SEQ ID NO: 668478 - DNA, 20 bp, mouse
gggggtatctaccttccctt

SEQ ID NO: 668479 - DNA, 20 bp, mouse
gtggaggctaaatatggtct

SEQ ID NO: 668480 - DNA, 20 bp, mouse
gaaacagtcttcctaaggga

SEQ ID NO: 668481 - DNA, 20 bp, mouse
ggatcctgaaaaaatgtggg

SEQ ID NO: 668482 - DNA, 20 bp, mouse
ggaccaaaggcccagggggt

SEQ ID NO: 668483 - DNA, 20 bp, mouse
gttgccccacagaccctcaa

SEQ ID NO: 668484 - DNA, 20 bp, mouse
gagcatggccagaggaaggg

SEQ ID NO: 668485 - DNA, 20 bp, mouse
gagcaagcagactatgtgtt

SEQ ID NO: 668486 - DNA, 20 bp, mouse
gaagccaggctgttgtaaca

SEQ ID NO: 668487 - DNA, 20 bp, mouse
ggtaacaggggtgctgttac

SEQ ID NO: 668488 - DNA, 20 bp, mouse
gagagctggattctgtggga

SEQ ID NO: 668489 - DNA, 20 bp, mouse
gcacccctgttacaacagcc

SEQ ID NO: 668490 - DNA, 20 bp, mouse
ggggatgcgttcattggaca

SEQ ID NO: 668491 - DNA, 20 bp, mouse
gtccaatgaacgcatccctg

SEQ ID NO: 668492 - DNA, 20 bp, mouse
ggtgctgttacagggctgtt

SEQ ID NO: 668493 - DNA, 20 bp, mouse
gagaggcgtgagacactcac

SEQ ID NO: 668494 - DNA, 20 bp, mouse
gcaggaggacagagtcttga

SEQ ID NO: 668495 - DNA, 20 bp, mouse
gtctttcttggaagaccctc

SEQ ID NO: 668496 - DNA, 20 bp, mouse
gacggcgcctgggttgcaga

SEQ ID NO: 668497 - DNA, 20 bp, mouse
gaaccctgaggtccggctcc

SEQ ID NO: 668498 - DNA, 20 bp, mouse
gtgagccccccgccaggaca

SEQ ID NO: 668499 - DNA, 20 bp, mouse
ggtggtgccagcacttgtgg

SEQ ID NO: 668500 - DNA, 20 bp, mouse
ggagtcaccaggctagcagg

SEQ ID NO: 668501 - DNA, 20 bp, mouse
gtggctcgggaatggggcgg

SEQ ID NO: 668502 - DNA, 20 bp, mouse
gtcaccaggctagcaggggg

SEQ ID NO: 668503 - DNA, 20 bp, mouse
gcggccacgtggccttgtcc

SEQ ID NO: 668504 - DNA, 20 bp, mouse
gctgctgcacggccccgccc

SEQ ID NO: 668505 - DNA, 20 bp, mouse
gaccctgattccaaagagat

SEQ ID NO: 668506 - DNA, 20 bp, mouse
gcggcctcctgtgctaggat

SEQ ID NO: 668507 - DNA, 20 bp, mouse
gcagctgcctcattctcacg

SEQ ID NO: 668508 - DNA, 20 bp, mouse
gtggcagtgacgttctcagt

SEQ ID NO: 668509 - DNA, 20 bp, mouse
gtctgagtcaggtttggggt

SEQ ID NO: 668510 - DNA, 20 bp, mouse
ggaggtgtctgagtcaggtt

SEQ ID NO: 668511 - DNA, 20 bp, mouse
gggccgaaggcagatgtaag

SEQ ID NO: 668512 - DNA, 20 bp, mouse
ggagtgggttgctaaagctg

SEQ ID NO: 668513 - DNA, 20 bp, mouse
gttcacaattaggctgtgat

SEQ ID NO: 668514 - DNA, 20 bp, mouse
gtaggtgtcaactcaccttg

SEQ ID NO: 668515 - DNA, 20 bp, mouse
gtgctaggattggagtgcat

SEQ ID NO: 668516 - DNA, 20 bp, mouse
gggctgagttgagtgagtac

SEQ ID NO: 668517 - DNA, 20 bp, mouse
gtgagtgagtacagggtagg

SEQ ID NO: 668518 - DNA, 20 bp, mouse
gtgagtacagggtaggagga

SEQ ID NO: 668519 - DNA, 20 bp, mouse
ggaaggatgtcttcgattct

SEQ ID NO: 668520 - DNA, 20 bp, mouse
gacttcaccgtgtgttgttg

SEQ ID NO: 668521 - DNA, 20 bp, mouse
gggagcctaatcgagtataa

SEQ ID NO: 668522 - DNA, 20 bp, mouse
gtcagcctttatactcgatt

SEQ ID NO: 668523 - DNA, 20 bp, mouse
gaagcacatttcagacagca

SEQ ID NO: 668524 - DNA, 20 bp, mouse
gtgttgttgtggtgagctgc

SEQ ID NO: 668525 - DNA, 20 bp, mouse
gggtgaagtgtctaggccgc

SEQ ID NO: 668526 - DNA, 20 bp, mouse
gtgggccagccaaccagcca

SEQ ID NO: 668527 - DNA, 20 bp, mouse
gtgaccccaactgtcctccc

SEQ ID NO: 668528 - DNA, 20 bp, mouse
ggtggtgaagctccgaggga

SEQ ID NO: 668529 - DNA, 20 bp, mouse
ggagggcttcctgaagatga

SEQ ID NO: 668530 - DNA, 20 bp, mouse
ggggaacacaacaagccagg

SEQ ID NO: 668531 - DNA, 20 bp, mouse
gtcaggtggcttcctccacc

SEQ ID NO: 668532 - DNA, 20 bp, mouse
gctactgggtatgctgtgtc

SEQ ID NO: 668533 - DNA, 20 bp, mouse
gaaggtggagcttggtgggc

SEQ ID NO: 668534 - DNA, 20 bp, mouse
gaaggcagattgctattgaa

SEQ ID NO: 668535 - DNA, 20 bp, mouse
gaaaaattagagggacttaa

SEQ ID NO: 668536 - DNA, 20 bp, mouse
gaactgggcctcttctcgga

SEQ ID NO: 668537 - DNA, 20 bp, mouse
gcctgcttcagtttgtctgt

SEQ ID NO: 668538 - DNA, 20 bp, mouse
gggagggcagggaaatcccc

SEQ ID NO: 668539 - DNA, 20 bp, mouse
gggacatccccgaggttcta

SEQ ID NO: 668540 - DNA, 20 bp, mouse
ggacctgcccttagaacctc

SEQ ID NO: 668541 - DNA, 20 bp, mouse
gtctccgggtgacatggatg

SEQ ID NO: 668542 - DNA, 20 bp, mouse
gtctaagggcaggtcaaggc

SEQ ID NO: 668543 - DNA, 20 bp, mouse
ggggaagcacaagggattcc

SEQ ID NO: 668544 - DNA, 20 bp, mouse
gtcggggatgtccgatgcag

SEQ ID NO: 668545 - DNA, 20 bp, mouse
gaaggtgccaaaagctccag

SEQ ID NO: 668546 - DNA, 20 bp, mouse
gacgctggggtccaaaatac

SEQ ID NO: 668547 - DNA, 20 bp, mouse
gctctggctggacaggagga

SEQ ID NO: 668548 - DNA, 20 bp, mouse
gaaaagaggaagtaggtctt

SEQ ID NO: 668549 - DNA, 20 bp, mouse
ggcaacctggagtagtgatt

SEQ ID NO: 668550 - DNA, 20 bp, mouse
ggggtctaggatgccggagg

SEQ ID NO: 668551 - DNA, 20 bp, mouse
gtctggctggacacaggtcc

SEQ ID NO: 668552 - DNA, 20 bp, mouse
gaggatcttaagcaccgagg

SEQ ID NO: 668553 - DNA, 20 bp, mouse
gaggccagagagggacgctg

SEQ ID NO: 668554 - DNA, 20 bp, mouse
gaggaggaagtggccaacca

SEQ ID NO: 668555 - DNA, 20 bp, mouse
ggtaggaaccccaaatctga

SEQ ID NO: 668556 - DNA, 20 bp, mouse
gtcactcaaagctgcctccc

SEQ ID NO: 668557 - DNA, 20 bp, mouse
gtgggcggagtgacctgctg

SEQ ID NO: 668558 - DNA, 20 bp, mouse
gaaggcctgcatgatcccat

SEQ ID NO: 668559 - DNA, 20 bp, mouse
gaagggggagttccctaaac

SEQ ID NO: 668560 - DNA, 20 bp, mouse
gcaggcctttctacctgttt

SEQ ID NO: 668561 - DNA, 20 bp, mouse
ggttccctaaacaggtagaa

SEQ ID NO: 668562 - DNA, 20 bp, mouse
gccagccaatgggatcatgc

SEQ ID NO: 668563 - DNA, 20 bp, mouse
ggggacatcagaccagagag

SEQ ID NO: 668564 - DNA, 20 bp, mouse
ggatagccctggccagccaa

SEQ ID NO: 668565 - DNA, 20 bp, mouse
gtgatcccattggctggcca

SEQ ID NO: 668566 - DNA, 20 bp, mouse
ggcactagagagagactcaa

SEQ ID NO: 668567 - DNA, 20 bp, mouse
gtcggggagagggtggttca

SEQ ID NO: 668568 - DNA, 20 bp, mouse
gaactgccctgcacctgggc

SEQ ID NO: 668569 - DNA, 20 bp, mouse
ggctgcaggcaggtccacag

SEQ ID NO: 668570 - DNA, 20 bp, mouse
gtctctagtgcgtggggtcg

SEQ ID NO: 668571 - DNA, 20 bp, mouse
gtggtgggttagaaagaaag

SEQ ID NO: 668572 - DNA, 20 bp, mouse
gagtctctctctagtgcgtg

SEQ ID NO: 668573 - DNA, 20 bp, mouse
gggatcagtggtgatgaacc

SEQ ID NO: 668574 - DNA, 20 bp, mouse
gctcgccaggatcctttctc

SEQ ID NO: 668575 - DNA, 20 bp, mouse
gtgtggccagcccaggtgca

SEQ ID NO: 668576 - DNA, 20 bp, mouse
gtggtctgctaggactcgaa

SEQ ID NO: 668577 - DNA, 20 bp, mouse
gctcccatagggtccctgga

SEQ ID NO: 668578 - DNA, 20 bp, mouse
gtctgctaggactcgaaggg

SEQ ID NO: 668579 - DNA, 20 bp, mouse
gcaggagcaaccccttccca

SEQ ID NO: 668580 - DNA, 20 bp, mouse
ggatgaagctgccctcccat

SEQ ID NO: 668581 - DNA, 20 bp, mouse
gaggagacaagctgcagccc

SEQ ID NO: 668582 - DNA, 20 bp, mouse
gatccctccagggaccctat

SEQ ID NO: 668583 - DNA, 20 bp, mouse
gtgagagaccccctgggaag

SEQ ID NO: 668584 - DNA, 20 bp, mouse
gggttcttgagagaccccct

SEQ ID NO: 668585 - DNA, 20 bp, mouse
gtgccctcccatagggtccc

SEQ ID NO: 668586 - DNA, 20 bp, mouse
gctcacccggtgctcagaac

SEQ ID NO: 668587 - DNA, 20 bp, mouse
gaaaaggattctgcttgcgg

SEQ ID NO: 668588 - DNA, 20 bp, mouse
gacactagaacacagtgagg

SEQ ID NO: 668589 - DNA, 20 bp, mouse
ggtccccagaactctagggg

SEQ ID NO: 668590 - DNA, 20 bp, mouse
gggtgaaaaagctgggtaaa

SEQ ID NO: 668591 - DNA, 20 bp, mouse
gagcaccgggtgagcacagc

SEQ ID NO: 668592 - DNA, 20 bp, mouse
ggttgtatgtgaaatggggt

SEQ ID NO: 668593 - DNA, 20 bp, mouse
gatgtgaaatggggttgggt

SEQ ID NO: 668594 - DNA, 20 bp, mouse
gcaaaggtccccagaactct

SEQ ID NO: 668595 - DNA, 20 bp, mouse
gacagctgggtgaaaaagct

SEQ ID NO: 668596 - DNA, 20 bp, mouse
gcggaccaggggtacttggg

SEQ ID NO: 668597 - DNA, 20 bp, mouse
gacccagaagcctgccccga

SEQ ID NO: 668598 - DNA, 20 bp, mouse
gtgcccggaccaggggtact

SEQ ID NO: 668599 - DNA, 20 bp, mouse
gccgcggggtgcccggacca

SEQ ID NO: 668600 - DNA, 20 bp, mouse
gcctccgaggccccgcccag

SEQ ID NO: 668601 - DNA, 20 bp, mouse
gcaccccgcgggcggaaggc

SEQ ID NO: 668602 - DNA, 20 bp, mouse
gtaccctccgggaaagtcca

SEQ ID NO: 668603 - DNA, 20 bp, mouse
ggggtggagcgtcctctggg

SEQ ID NO: 668604 - DNA, 20 bp, mouse
gcgggcggaaggcggggcca

SEQ ID NO: 668605 - DNA, 20 bp, mouse
ggtaccggaggaagtaagtg

SEQ ID NO: 668606 - DNA, 20 bp, mouse
ggcccagaggggaactgtat

SEQ ID NO: 668607 - DNA, 20 bp, mouse
gacctcccgcagggcccaga

SEQ ID NO: 668608 - DNA, 20 bp, mouse
ggagctggagggttggcaaa

SEQ ID NO: 668609 - DNA, 20 bp, mouse
gtgtatagggggcgtgtcaa

SEQ ID NO: 668610 - DNA, 20 bp, mouse
ggtgtcaagggcgtggtctt

SEQ ID NO: 668611 - DNA, 20 bp, mouse
gtccgcccaccacagcctcc

SEQ ID NO: 668612 - DNA, 20 bp, mouse
ggggtgagactccgcaaggc

SEQ ID NO: 668613 - DNA, 20 bp, mouse
gcctggtgctacctcccgca

SEQ ID NO: 668614 - DNA, 20 bp, mouse
ggggaaagtgatggactcaa

SEQ ID NO: 668615 - DNA, 20 bp, mouse
gaaggggaacaggctcgggg

SEQ ID NO: 668616 - DNA, 20 bp, mouse
ggggactccccagtcggagg

SEQ ID NO: 668617 - DNA, 20 bp, mouse
ggccccggggactccccagt

SEQ ID NO: 668618 - DNA, 20 bp, mouse
gccggggactccccagtcgg

SEQ ID NO: 668619 - DNA, 20 bp, mouse
gtacccgcctcctccgactg

SEQ ID NO: 668620 - DNA, 20 bp, mouse
ggaccctcaaacccatcgag

SEQ ID NO: 668621 - DNA, 20 bp, mouse
gacccactcgatgggtttga

SEQ ID NO: 668622 - DNA, 20 bp, mouse
ggggtcatgcagattcagat

SEQ ID NO: 668623 - DNA, 20 bp, mouse
gactccccagtcggaggagg

SEQ ID NO: 668624 - DNA, 20 bp, mouse
gcgcggcttccgaagcctca

SEQ ID NO: 668625 - DNA, 20 bp, mouse
gcagcagcaacgcggacttg

SEQ ID NO: 668626 - DNA, 20 bp, mouse
gatgcactgctgttgtataa

SEQ ID NO: 668627 - DNA, 20 bp, mouse
gtcaacatccatgatatgtc

SEQ ID NO: 668628 - DNA, 20 bp, mouse
gctccaggctagggtaagtt

SEQ ID NO: 668629 - DNA, 20 bp, mouse
gaatgtaactaggtgatggt

SEQ ID NO: 668630 - DNA, 20 bp, mouse
ggggtggaggcatctactcc

SEQ ID NO: 668631 - DNA, 20 bp, mouse
gaggcatctactccaggcta

SEQ ID NO: 668632 - DNA, 20 bp, mouse
gtgcagcaggaagaaatgca

SEQ ID NO: 668633 - DNA, 20 bp, mouse
gctaggtgatggtgggtcag

SEQ ID NO: 668634 - DNA, 20 bp, mouse
gctatgtgccagacatatca

SEQ ID NO: 668635 - DNA, 20 bp, mouse
gatggaaaacactagtaagt

SEQ ID NO: 668636 - DNA, 20 bp, mouse
gcgaaatgggaagccttata

SEQ ID NO: 668637 - DNA, 20 bp, mouse
gaagaaaaagtcaaccacca

SEQ ID NO: 668638 - DNA, 20 bp, mouse
gcaatgactgtgtaccctgg

SEQ ID NO: 668639 - DNA, 20 bp, mouse
ggggagtttctttggggagg

SEQ ID NO: 668640 - DNA, 20 bp, mouse
gagacataacctggcgaaat

SEQ ID NO: 668641 - DNA, 20 bp, mouse
gtcctcttttcttagacttg

SEQ ID NO: 668642 - DNA, 20 bp, mouse
gtctatcaagtggacaaagt

SEQ ID NO: 668643 - DNA, 20 bp, mouse
ggacaactatatcagataag

SEQ ID NO: 668644 - DNA, 20 bp, mouse
gaggttatgtctaaggacta

SEQ ID NO: 668645 - DNA, 20 bp, mouse
gagcacttctcagccctata

SEQ ID NO: 668646 - DNA, 20 bp, mouse
gttcccaggcccctaaaagg

SEQ ID NO: 668647 - DNA, 20 bp, mouse
ggggcccaggaacagggcgg

SEQ ID NO: 668648 - DNA, 20 bp, mouse
ggaggggcccaggaacaggg

SEQ ID NO: 668649 - DNA, 20 bp, mouse
ggagagtgacaggacatgaa

SEQ ID NO: 668650 - DNA, 20 bp, mouse
ggggggaggcgtgtagggtc

SEQ ID NO: 668651 - DNA, 20 bp, mouse
gggggaggggcccaggaaca

SEQ ID NO: 668652 - DNA, 20 bp, mouse
gagtgtcaaccaccttttag

SEQ ID NO: 668653 - DNA, 20 bp, mouse
gcaagctagggctctagggg

SEQ ID NO: 668654 - DNA, 20 bp, mouse
gaaaggtggttgacactctt

SEQ ID NO: 668655 - DNA, 20 bp, mouse
gagggcggaggaggtgcggt

SEQ ID NO: 668656 - DNA, 20 bp, mouse
gtaagagggcggggccacca

SEQ ID NO: 668657 - DNA, 20 bp, mouse
gcaaggctttgatgctgtat

SEQ ID NO: 668658 - DNA, 20 bp, mouse
ggggcggggccaccagggca

SEQ ID NO: 668659 - DNA, 20 bp, mouse
gtaagtgagctaagagggcg

SEQ ID NO: 668660 - DNA, 20 bp, mouse
gggggcaagaggcatcacac

SEQ ID NO: 668661 - DNA, 20 bp, mouse
gtaaagacgtgtctgaatta

SEQ ID NO: 668662 - DNA, 20 bp, mouse
gggaacgtaagtgagctaag

SEQ ID NO: 668663 - DNA, 20 bp, mouse
gctgtcccgagctcccccct

SEQ ID NO: 668664 - DNA, 20 bp, mouse
gcaccagaaaacaagagtcc

SEQ ID NO: 668665 - DNA, 20 bp, mouse
gctgtataggatgaagatga

SEQ ID NO: 668666 - DNA, 20 bp, mouse
gccccgagacggtgggaaga

SEQ ID NO: 668667 - DNA, 20 bp, mouse
ggtcccagaacctgggtctg

SEQ ID NO: 668668 - DNA, 20 bp, mouse
gaaaccagacggcaaaagtt

SEQ ID NO: 668669 - DNA, 20 bp, mouse
gtaaaagaagtcgggtacgg

SEQ ID NO: 668670 - DNA, 20 bp, mouse
ggaggggattagagcatggg

SEQ ID NO: 668671 - DNA, 20 bp, mouse
gctgctatgcgcatgtgcgg

SEQ ID NO: 668672 - DNA, 20 bp, mouse
ggcagagcccaggatgaact

SEQ ID NO: 668673 - DNA, 20 bp, mouse
gggaaagaccccgagacggt

SEQ ID NO: 668674 - DNA, 20 bp, mouse
gagagagagctctgcactga

SEQ ID NO: 668675 - DNA, 20 bp, mouse
gcctccccagacccaggttc

SEQ ID NO: 668676 - DNA, 20 bp, mouse
gacagaggatccaagagata

SEQ ID NO: 668677 - DNA, 20 bp, mouse
gccggtgagaaataagaagt

SEQ ID NO: 668678 - DNA, 20 bp, mouse
gttcacgtcctcctgaccca

SEQ ID NO: 668679 - DNA, 20 bp, mouse
gggagtcagaaggctattca

SEQ ID NO: 668680 - DNA, 20 bp, mouse
gcaccaggctgtgctctgaa

SEQ ID NO: 668681 - DNA, 20 bp, mouse
gaacaacaaaaccgtgatga

SEQ ID NO: 668682 - DNA, 20 bp, mouse
gactcctgttgccttcatca

SEQ ID NO: 668683 - DNA, 20 bp, mouse
gagagcacaggatgcgccct

SEQ ID NO: 668684 - DNA, 20 bp, mouse
gataagaagtaggagagcac

SEQ ID NO: 668685 - DNA, 20 bp, mouse
ggaacctggaccttgacacc

SEQ ID NO: 668686 - DNA, 20 bp, mouse
gtcaactctaccacagggtt

SEQ ID NO: 668687 - DNA, 20 bp, mouse
ggatcgcttggcaagtcccc

SEQ ID NO: 668688 - DNA, 20 bp, mouse
gtaaaggtgagacaggcgca

SEQ ID NO: 668689 - DNA, 20 bp, mouse
gatcaacagccccaaccctg

SEQ ID NO: 668690 - DNA, 20 bp, mouse
gaggagagaatcttgggata

SEQ ID NO: 668691 - DNA, 20 bp, mouse
gaaaacctcaactctaccac

SEQ ID NO: 668692 - DNA, 20 bp, mouse
gccccagggtgaaagaacaa

SEQ ID NO: 668693 - DNA, 20 bp, mouse
gaggtttttgagcacgaata

SEQ ID NO: 668694 - DNA, 20 bp, mouse
gctgtggaggggagaagtta

SEQ ID NO: 668695 - DNA, 20 bp, mouse
gtactcccagttattcttca

SEQ ID NO: 668696 - DNA, 20 bp, mouse
ggagctgggtggtgtggttc

SEQ ID NO: 668697 - DNA, 20 bp, mouse
gaccacccagctccccgcgg

SEQ ID NO: 668698 - DNA, 20 bp, mouse
ggcccccgcggggagctggg

SEQ ID NO: 668699 - DNA, 20 bp, mouse
gcgggcgcgcggcgcgccct

SEQ ID NO: 668700 - DNA, 20 bp, mouse
ggctccgacacccgcccccg

SEQ ID NO: 668701 - DNA, 20 bp, mouse
gcccacccgaacgatgtcct

SEQ ID NO: 668702 - DNA, 20 bp, mouse
gggacggggaccaggcacat

SEQ ID NO: 668703 - DNA, 20 bp, mouse
gcgccctgggtctgtttccc

SEQ ID NO: 668704 - DNA, 20 bp, mouse
gctccccgctggaaagtaac

SEQ ID NO: 668705 - DNA, 20 bp, mouse
gggaaaggcgagggtcgccc

SEQ ID NO: 668706 - DNA, 20 bp, mouse
ggcgacagcgggatgggaag

SEQ ID NO: 668707 - DNA, 20 bp, mouse
ggggtctcctgatctggatt

SEQ ID NO: 668708 - DNA, 20 bp, mouse
gggcgcgcctagatgcctgc

SEQ ID NO: 668709 - DNA, 20 bp, mouse
gccagatcaggagacccaat

SEQ ID NO: 668710 - DNA, 20 bp, mouse
gaggcgggacatggggaaga

SEQ ID NO: 668711 - DNA, 20 bp, mouse
ggacatggggaagagggcgg

SEQ ID NO: 668712 - DNA, 20 bp, mouse
gagtctgaaggcgggacatg

SEQ ID NO: 668713 - DNA, 20 bp, mouse
gcccatagcgacagcgggat

SEQ ID NO: 668714 - DNA, 20 bp, mouse
gtctcctgatctggattggg

SEQ ID NO: 668715 - DNA, 20 bp, mouse
gtctccccccgcaggcatct

SEQ ID NO: 668716 - DNA, 20 bp, mouse
gagggcgggtgccacctcag

SEQ ID NO: 668717 - DNA, 20 bp, mouse
ggcgcagggacacaccccgg

SEQ ID NO: 668718 - DNA, 20 bp, mouse
gggcgggagcccggaggata

SEQ ID NO: 668719 - DNA, 20 bp, mouse
gggtgtgtccctgcgctaga

SEQ ID NO: 668720 - DNA, 20 bp, mouse
gaggctggctcccaggctgg

SEQ ID NO: 668721 - DNA, 20 bp, mouse
gtcctccgggctcccgccct

SEQ ID NO: 668722 - DNA, 20 bp, mouse
gccacataccggtccaccgt

SEQ ID NO: 668723 - DNA, 20 bp, mouse
gcgggggtcccacggtggac

SEQ ID NO: 668724 - DNA, 20 bp, mouse
ggcgctagagggagacctgg

SEQ ID NO: 668725 - DNA, 20 bp, mouse
gtcccagggaggaggattct

SEQ ID NO: 668726 - DNA, 20 bp, mouse
ggaacccagccgtcagatgt

SEQ ID NO: 668727 - DNA, 20 bp, mouse
gtaagcgccggaagcgatgg

SEQ ID NO: 668728 - DNA, 20 bp, mouse
gaaccggagtgggcgaggtg

SEQ ID NO: 668729 - DNA, 20 bp, mouse
ggggatccgcccacatctga

SEQ ID NO: 668730 - DNA, 20 bp, mouse
gagagaggcgaacatagaac

SEQ ID NO: 668731 - DNA, 20 bp, mouse
gaggacgcttgaagttgtct

SEQ ID NO: 668732 - DNA, 20 bp, mouse
gggaggacttaaacagagag

SEQ ID NO: 668733 - DNA, 20 bp, mouse
ggcgaacatagaaccggagt

SEQ ID NO: 668734 - DNA, 20 bp, mouse
gaagcagaaccaaataccct

SEQ ID NO: 668735 - DNA, 20 bp, mouse
gttatgctactctgtgtagc

SEQ ID NO: 668736 - DNA, 20 bp, mouse
gtggctgggcagatcttccc

SEQ ID NO: 668737 - DNA, 20 bp, mouse
ggacccgccccgtcgtccaa

SEQ ID NO: 668738 - DNA, 20 bp, mouse
gccagccagccaggcctgca

SEQ ID NO: 668739 - DNA, 20 bp, mouse
ggggatcgaccgttggacga

SEQ ID NO: 668740 - DNA, 20 bp, mouse
gggggcgggtccttgagggg

SEQ ID NO: 668741 - DNA, 20 bp, mouse
ggacggggcgggtccttgag

SEQ ID NO: 668742 - DNA, 20 bp, mouse
gggcgaccgggatcgaccgt

SEQ ID NO: 668743 - DNA, 20 bp, mouse
ggacaggtgtctggtctcat

SEQ ID NO: 668744 - DNA, 20 bp, mouse
gcgaccgttggacgacgggg

SEQ ID NO: 668745 - DNA, 20 bp, mouse
gtgaactgcctgaggagacc

SEQ ID NO: 668746 - DNA, 20 bp, mouse
gagggcgcgagcacaaccga

SEQ ID NO: 668747 - DNA, 20 bp, mouse
ggtgtcttgcgcgtctgtgt

SEQ ID NO: 668748 - DNA, 20 bp, mouse
ggatccaggcggaccagcct

SEQ ID NO: 668749 - DNA, 20 bp, mouse
ggcggtggcgcctgattcta

SEQ ID NO: 668750 - DNA, 20 bp, mouse
gcacgaaagcgtagattttt

SEQ ID NO: 668751 - DNA, 20 bp, mouse
ggcgctagactctagagcca

SEQ ID NO: 668752 - DNA, 20 bp, mouse
gcgcgcggcgggctgtactc

SEQ ID NO: 668753 - DNA, 20 bp, mouse
ggaggcgccggtgtctctag

SEQ ID NO: 668754 - DNA, 20 bp, mouse
ggcgccaccgctagagacac

SEQ ID NO: 668755 - DNA, 20 bp, mouse
ggaaccctgcgcagcacttc

SEQ ID NO: 668756 - DNA, 20 bp, mouse
gccgaggccggctcagagaa

SEQ ID NO: 668757 - DNA, 20 bp, mouse
gtccgcggccatcccttaaa

SEQ ID NO: 668758 - DNA, 20 bp, mouse
ggagccgagctgtcccttta

SEQ ID NO: 668759 - DNA, 20 bp, mouse
ggcggggcgcctggtaactg

SEQ ID NO: 668760 - DNA, 20 bp, mouse
ggaaacttggccctctgcct

SEQ ID NO: 668761 - DNA, 20 bp, mouse
gggccgcggagtggtgaaag

SEQ ID NO: 668762 - DNA, 20 bp, mouse
ggcctcgggccccagttacc

SEQ ID NO: 668763 - DNA, 20 bp, mouse
gcgcggagtggtgaaagtgg

SEQ ID NO: 668764 - DNA, 20 bp, mouse
ggaagctgcgactgcctggc

SEQ ID NO: 668765 - DNA, 20 bp, mouse
gtgggggcggacctaagagg

SEQ ID NO: 668766 - DNA, 20 bp, mouse
gtagaggggtcccaccaagg

SEQ ID NO: 668767 - DNA, 20 bp, mouse
gtgctggcgacccccttggt

SEQ ID NO: 668768 - DNA, 20 bp, mouse
gagactcactcgaggaactg

SEQ ID NO: 668769 - DNA, 20 bp, mouse
gagccggtaggccccgagga

SEQ ID NO: 668770 - DNA, 20 bp, mouse
gatccgaagtggagttatta

SEQ ID NO: 668771 - DNA, 20 bp, mouse
ggaactcggagactcactcg

SEQ ID NO: 668772 - DNA, 20 bp, mouse
gaaccctcctcggggcctac

SEQ ID NO: 668773 - DNA, 20 bp, mouse
gagcacgctttctgcccgat

SEQ ID NO: 668774 - DNA, 20 bp, mouse
gacaagagacaaaagttaga

SEQ ID NO: 668775 - DNA, 20 bp, mouse
gtcaccgagtacctgcctgt

SEQ ID NO: 668776 - DNA, 20 bp, mouse
gaggtcagccgccctgcaga

SEQ ID NO: 668777 - DNA, 20 bp, mouse
gagaccagatgtcttgaaaa

SEQ ID NO: 668778 - DNA, 20 bp, mouse
gcccacgagcacacgcaact

SEQ ID NO: 668779 - DNA, 20 bp, mouse
ggggccagctcaaaaccggc

SEQ ID NO: 668780 - DNA, 20 bp, mouse
gtctggtcgcgcctgcccgt

SEQ ID NO: 668781 - DNA, 20 bp, mouse
gccaaactctaggacgtccc

SEQ ID NO: 668782 - DNA, 20 bp, mouse
gacgtccctggggcagccag

SEQ ID NO: 668783 - DNA, 20 bp, mouse
gcggctggccggtacgaccc

SEQ ID NO: 668784 - DNA, 20 bp, mouse
ggggccagtctcctgcaaaa

SEQ ID NO: 668785 - DNA, 20 bp, mouse
gcggccagccggttttgagc

SEQ ID NO: 668786 - DNA, 20 bp, mouse
gactccgtgccttccgggag

SEQ ID NO: 668787 - DNA, 20 bp, mouse
ggccacggaaccattagagt

SEQ ID NO: 668788 - DNA, 20 bp, mouse
gggacagctctggaccaccc

SEQ ID NO: 668789 - DNA, 20 bp, mouse
ggggtgtgtgcccactctaa

SEQ ID NO: 668790 - DNA, 20 bp, mouse
gagagtgggcacacacccga

SEQ ID NO: 668791 - DNA, 20 bp, mouse
gggacaaaggcgaacaggtt

SEQ ID NO: 668792 - DNA, 20 bp, mouse
gcgtctcttccactcccgga

SEQ ID NO: 668793 - DNA, 20 bp, mouse
ggcgggactccgtgccttcc

SEQ ID NO: 668794 - DNA, 20 bp, mouse
ggcaaaagcgttccccccgt

SEQ ID NO: 668795 - DNA, 20 bp, mouse
gctggcgcccaagatcgcca

SEQ ID NO: 668796 - DNA, 20 bp, mouse
gagcccgaatcggaacacgg

SEQ ID NO: 668797 - DNA, 20 bp, mouse
gccgattcgggcagggacga

SEQ ID NO: 668798 - DNA, 20 bp, mouse
ggaccaatcggcaagggcga

SEQ ID NO: 668799 - DNA, 20 bp, mouse
gcgcccccgtgttccgattc

SEQ ID NO: 668800 - DNA, 20 bp, mouse
ggtcccgcacagttagtcct

SEQ ID NO: 668801 - DNA, 20 bp, mouse
gtctctgccggccatctctc

SEQ ID NO: 668802 - DNA, 20 bp, mouse
gcccgaatcggagcccgaat

SEQ ID NO: 668803 - DNA, 20 bp, mouse
ggaaatcccgaacccatctc

SEQ ID NO: 668804 - DNA, 20 bp, mouse
gaggctcccagagatgggtt

SEQ ID NO: 668805 - DNA, 20 bp, mouse
gaaccgtcgcccttgccgat

SEQ ID NO: 668806 - DNA, 20 bp, mouse
gcccgcaggaggtgcggagt

SEQ ID NO: 668807 - DNA, 20 bp, mouse
gccgcactgggcctcccgag

SEQ ID NO: 668808 - DNA, 20 bp, mouse
gtgcgggggcgcgggtagga

SEQ ID NO: 668809 - DNA, 20 bp, mouse
gacgtcaagtctggggtgtc

SEQ ID NO: 668810 - DNA, 20 bp, mouse
gaggcccagtgcgggggcgc

SEQ ID NO: 668811 - DNA, 20 bp, mouse
gcgcggggcggcaatcaaag

SEQ ID NO: 668812 - DNA, 20 bp, mouse
gggtagagaagcggggtttt

SEQ ID NO: 668813 - DNA, 20 bp, mouse
gcctcgatgacgtcaagtct

SEQ ID NO: 668814 - DNA, 20 bp, mouse
gtcctgcccgagcccgcagg

SEQ ID NO: 668815 - DNA, 20 bp, mouse
ggggctcgggcaggaggctc

SEQ ID NO: 668816 - DNA, 20 bp, mouse
gttccgaaaaggcgatgggg

SEQ ID NO: 668817 - DNA, 20 bp, mouse
gtggcaagaactacttgggg

SEQ ID NO: 668818 - DNA, 20 bp, mouse
gttcccccccatcgcctttt

SEQ ID NO: 668819 - DNA, 20 bp, mouse
gcatcccagcataaaaaaga

SEQ ID NO: 668820 - DNA, 20 bp, mouse
gtacgaagaaggtttgtgat

SEQ ID NO: 668821 - DNA, 20 bp, mouse
gtaatgttccgaaaaggcga

SEQ ID NO: 668822 - DNA, 20 bp, mouse
ggaggggcgggcacggcctg

SEQ ID NO: 668823 - DNA, 20 bp, mouse
gtgattggcaagaactactt

SEQ ID NO: 668824 - DNA, 20 bp, mouse
ggagacagttagatcctgat

SEQ ID NO: 668825 - DNA, 20 bp, mouse
gtgattggttgcttcgtgca

SEQ ID NO: 668826 - DNA, 20 bp, mouse
gaggtcacgccctctctcgg

SEQ ID NO: 668827 - DNA, 20 bp, mouse
gaaaggaggaagcgtctcgt

SEQ ID NO: 668828 - DNA, 20 bp, mouse
gagagggcgtgacctcgagg

SEQ ID NO: 668829 - DNA, 20 bp, mouse
gtcacgccctctctcggtgg

SEQ ID NO: 668830 - DNA, 20 bp, mouse
ggggcccggcgcagcggagg

SEQ ID NO: 668831 - DNA, 20 bp, mouse
gcgtctcgtgggcctcctcg

SEQ ID NO: 668832 - DNA, 20 bp, mouse
ggggcgaagcctgaagagtt

SEQ ID NO: 668833 - DNA, 20 bp, mouse
gcgaagcctgaagagttggg

SEQ ID NO: 668834 - DNA, 20 bp, mouse
gagccggctacggagcaagg

SEQ ID NO: 668835 - DNA, 20 bp, mouse
gggcgctagtccctaccgaa

SEQ ID NO: 668836 - DNA, 20 bp, mouse
ggggccggggcggtacgtgt

SEQ ID NO: 668837 - DNA, 20 bp, mouse
gtctgctcgcctggcttctt

SEQ ID NO: 668838 - DNA, 20 bp, mouse
gtccgggagggcgggaccaa

SEQ ID NO: 668839 - DNA, 20 bp, mouse
gtactccctctgagggtaga

SEQ ID NO: 668840 - DNA, 20 bp, mouse
ggggcggtacgtgtggggca

SEQ ID NO: 668841 - DNA, 20 bp, mouse
gccgccagacgccaccaatg

SEQ ID NO: 668842 - DNA, 20 bp, mouse
gtggaacagggtttggaggt

SEQ ID NO: 668843 - DNA, 20 bp, mouse
gtagggtgactcggggagtt

SEQ ID NO: 668844 - DNA, 20 bp, mouse
gcccaggattctcgcgtcaa

SEQ ID NO: 668845 - DNA, 20 bp, mouse
gagggagtagtcatccccta

SEQ ID NO: 668846 - DNA, 20 bp, mouse
gtaaatcgcccggggttctt

SEQ ID NO: 668847 - DNA, 20 bp, mouse
ggggagagccaatatgtacc

SEQ ID NO: 668848 - DNA, 20 bp, mouse
gctagcaggagagtggtgat

SEQ ID NO: 668849 - DNA, 20 bp, mouse
gcagagagcctggtacatat

SEQ ID NO: 668850 - DNA, 20 bp, mouse
gaggaacagaagcgattctt

SEQ ID NO: 668851 - DNA, 20 bp, mouse
gcgaaaatagcgattggtta

SEQ ID NO: 668852 - DNA, 20 bp, mouse
gatgtaccaggctctctgta

SEQ ID NO: 668853 - DNA, 20 bp, mouse
gtaggtacgaaaatagcgat

SEQ ID NO: 668854 - DNA, 20 bp, mouse
gcagaatgacaagggatctg

SEQ ID NO: 668855 - DNA, 20 bp, mouse
gggcgagagaatttagtaca

SEQ ID NO: 668856 - DNA, 20 bp, mouse
gggaacccccggcctctcta

SEQ ID NO: 668857 - DNA, 20 bp, mouse
gcaaagtggaagtgcgtcac

SEQ ID NO: 668858 - DNA, 20 bp, mouse
gactacgtgcgaagtatctt

SEQ ID NO: 668859 - DNA, 20 bp, mouse
gcgcgggagaagaggagcat

SEQ ID NO: 668860 - DNA, 20 bp, mouse
gaccgtggaggaggctcgtg

SEQ ID NO: 668861 - DNA, 20 bp, mouse
gaaccgcgcgcctagcaaag

SEQ ID NO: 668862 - DNA, 20 bp, mouse
gagaggccgggggttcccgt

SEQ ID NO: 668863 - DNA, 20 bp, mouse
gtagaacgcggatttggcta

SEQ ID NO: 668864 - DNA, 20 bp, mouse
gtcctcacgagcctcctcca

SEQ ID NO: 668865 - DNA, 20 bp, mouse
gaaaggtcggctggagtcga

SEQ ID NO: 668866 - DNA, 20 bp, mouse
gaagagccgaggtgagtcgg

SEQ ID NO: 668867 - DNA, 20 bp, mouse
gggaaagagccgaggtgagt

SEQ ID NO: 668868 - DNA, 20 bp, mouse
gagccgaggtgagtcggcgg

SEQ ID NO: 668869 - DNA, 20 bp, mouse
gggaaaagcccgaaagaggt

SEQ ID NO: 668870 - DNA, 20 bp, mouse
ggcccaaagagcaaccggta

SEQ ID NO: 668871 - DNA, 20 bp, mouse
ggagtgctaccggaaactgt

SEQ ID NO: 668872 - DNA, 20 bp, mouse
gaggatggctgattgggcga

SEQ ID NO: 668873 - DNA, 20 bp, mouse
gaaagagcaaccggtagggt

SEQ ID NO: 668874 - DNA, 20 bp, mouse
gaagaggtcggaaagagccg

SEQ ID NO: 668875 - DNA, 20 bp, mouse
gcgcctccgccgactcacct

SEQ ID NO: 668876 - DNA, 20 bp, mouse
gcgggcgcgcagacacattc

SEQ ID NO: 668877 - DNA, 20 bp, mouse
ggggcccgaaggaggcacgc

SEQ ID NO: 668878 - DNA, 20 bp, mouse
gcgcctgcgcggcagggcgg

SEQ ID NO: 668879 - DNA, 20 bp, mouse
ggcagccgcactctaggccc

SEQ ID NO: 668880 - DNA, 20 bp, mouse
gcgcactctaggcccgggtg

SEQ ID NO: 668881 - DNA, 20 bp, mouse
gcacaggcgcattctagacc

SEQ ID NO: 668882 - DNA, 20 bp, mouse
gcccggtggaggcgtcgcac

SEQ ID NO: 668883 - DNA, 20 bp, mouse
ggcgcctgcgtgcctccttc

SEQ ID NO: 668884 - DNA, 20 bp, mouse
ggcgacgcctccaccgggtc

SEQ ID NO: 668885 - DNA, 20 bp, mouse
gtggcgcgcaggtgcatttc

SEQ ID NO: 668886 - DNA, 20 bp, mouse
gcaactcagtagattggtga

SEQ ID NO: 668887 - DNA, 20 bp, mouse
gtactgagttgcttagactc

SEQ ID NO: 668888 - DNA, 20 bp, mouse
gtctaagcaactcagtagat

SEQ ID NO: 668889 - DNA, 20 bp, mouse
gagagagcaagcccttaccc

SEQ ID NO: 668890 - DNA, 20 bp, mouse
gcttaagccccacaggttga

SEQ ID NO: 668891 - DNA, 20 bp, mouse
gaagggcttgctctctgttt

SEQ ID NO: 668892 - DNA, 20 bp, mouse
gctcaggcagcacttggtca

SEQ ID NO: 668893 - DNA, 20 bp, mouse
gaggtatgttatacctaggc

SEQ ID NO: 668894 - DNA, 20 bp, mouse
gaggacagcttaagccccac

SEQ ID NO: 668895 - DNA, 20 bp, mouse
gccaacatccctacaaactc

SEQ ID NO: 668896 - DNA, 20 bp, mouse
gagtcggcggcattggcaac

SEQ ID NO: 668897 - DNA, 20 bp, mouse
gcaacgggagtcggcggcat

SEQ ID NO: 668898 - DNA, 20 bp, mouse
gttcggcgggaacttccaga

SEQ ID NO: 668899 - DNA, 20 bp, mouse
gtccgcccagggcgccgcgc

SEQ ID NO: 668900 - DNA, 20 bp, mouse
gccttagcaacgggagtcgg

SEQ ID NO: 668901 - DNA, 20 bp, mouse
ggacggccccgccccagcgt

SEQ ID NO: 668902 - DNA, 20 bp, mouse
ggccctttaaagaagacctc

SEQ ID NO: 668903 - DNA, 20 bp, mouse
ggccctgggcggaagcggaa

SEQ ID NO: 668904 - DNA, 20 bp, mouse
gcgctgaacagggacccaca

SEQ ID NO: 668905 - DNA, 20 bp, mouse
gaggcctcaccacatactcc

SEQ ID NO: 668906 - DNA, 20 bp, mouse
gtccgccggcggcacagtcc

SEQ ID NO: 668907 - DNA, 20 bp, mouse
gggccgggacgtcatttccg

SEQ ID NO: 668908 - DNA, 20 bp, mouse
gctgcggaagaagaagtagc

SEQ ID NO: 668909 - DNA, 20 bp, mouse
ggaagaagaagtagccggcc

SEQ ID NO: 668910 - DNA, 20 bp, mouse
gcaggcctggactgtgccgc

SEQ ID NO: 668911 - DNA, 20 bp, mouse
ggcccccggaaatgacgtcc

SEQ ID NO: 668912 - DNA, 20 bp, mouse
gaatctaagtcggagtcgag

SEQ ID NO: 668913 - DNA, 20 bp, mouse
gcgtgtagagcaatctaagt

SEQ ID NO: 668914 - DNA, 20 bp, mouse
gcagtccaggcctgctccgg

SEQ ID NO: 668915 - DNA, 20 bp, mouse
gccaggggcagagggattct

SEQ ID NO: 668916 - DNA, 20 bp, mouse
ggtgctgggctcgggaatga

SEQ ID NO: 668917 - DNA, 20 bp, mouse
gccgggagtgaaggtcctcg

SEQ ID NO: 668918 - DNA, 20 bp, mouse
gtgcccacggacgggtaagt

SEQ ID NO: 668919 - DNA, 20 bp, mouse
ggaggcttcaaacacatctc

SEQ ID NO: 668920 - DNA, 20 bp, mouse
gtcctcgccgcactgtacgc

SEQ ID NO: 668921 - DNA, 20 bp, mouse
ggaggagctcgcggcaccat

SEQ ID NO: 668922 - DNA, 20 bp, mouse
gggcgcttccccctgtcctg

SEQ ID NO: 668923 - DNA, 20 bp, mouse
gtcactcccggcgtacagtg

SEQ ID NO: 668924 - DNA, 20 bp, mouse
ggggccggagagaacggtgc

SEQ ID NO: 668925 - DNA, 20 bp, mouse
gtgggggcggggtcgaaggc

SEQ ID NO: 668926 - DNA, 20 bp, mouse
gaaggggctgagggcggctc

SEQ ID NO: 668927 - DNA, 20 bp, mouse
gtcagcacgcaggggacgca

SEQ ID NO: 668928 - DNA, 20 bp, mouse
gcccgcgcgcgtgcgcgcca

SEQ ID NO: 668929 - DNA, 20 bp, mouse
ggagccaaccagagcatgca

SEQ ID NO: 668930 - DNA, 20 bp, mouse
gtcccctgcgtgctgacgtc

SEQ ID NO: 668931 - DNA, 20 bp, mouse
gggtgcccgcggaagtggga

SEQ ID NO: 668932 - DNA, 20 bp, mouse
ggcgcgtgcgcgccaagggg

SEQ ID NO: 668933 - DNA, 20 bp, mouse
ggttccttgcatgctctggt

SEQ ID NO: 668934 - DNA, 20 bp, mouse
gcacgcaggggacgcatggt

SEQ ID NO: 668935 - DNA, 20 bp, mouse
gtgcccctgtccggcagccg

SEQ ID NO: 668936 - DNA, 20 bp, mouse
ggggtcccccggggcgactc

SEQ ID NO: 668937 - DNA, 20 bp, mouse
gagcggcctcggggagccta

SEQ ID NO: 668938 - DNA, 20 bp, mouse
gggaccgtccggatccaaaa

SEQ ID NO: 668939 - DNA, 20 bp, mouse
ggcgtgggaaagccgaatgg

SEQ ID NO: 668940 - DNA, 20 bp, mouse
gccgcgccctaggctccccg

SEQ ID NO: 668941 - DNA, 20 bp, mouse
ggaagccgagggtacccttg

SEQ ID NO: 668942 - DNA, 20 bp, mouse
ggcggcgccgggagcggcct

SEQ ID NO: 668943 - DNA, 20 bp, mouse
gcccccgaccccgctggaag

SEQ ID NO: 668944 - DNA, 20 bp, mouse
gagggaagcggggtcccccg

SEQ ID NO: 668945 - DNA, 20 bp, mouse
gtcaccgcggggaccccggg

SEQ ID NO: 668946 - DNA, 20 bp, mouse
ggggcctcgcggttcgccgt

SEQ ID NO: 668947 - DNA, 20 bp, mouse
gagggtcggtcccgaggatc

SEQ ID NO: 668948 - DNA, 20 bp, mouse
ggcggcgcagccaaccaccg

SEQ ID NO: 668949 - DNA, 20 bp, mouse
gcgcgaggcccaaagagcgg

SEQ ID NO: 668950 - DNA, 20 bp, mouse
gtcgccgtagggacggtgtg

SEQ ID NO: 668951 - DNA, 20 bp, mouse
gccgccccacaccgtcccta

SEQ ID NO: 668952 - DNA, 20 bp, mouse
ggcggcgatcggccccgcgg

SEQ ID NO: 668953 - DNA, 20 bp, mouse
gacgccccgccctcggcccg

SEQ ID NO: 668954 - DNA, 20 bp, mouse
gagggcggggcgtcgcgctg

SEQ ID NO: 668955 - DNA, 20 bp, mouse
gcgccctgggtcccatagtt

SEQ ID NO: 668956 - DNA, 20 bp, mouse
gagccaggccagaggggcta

SEQ ID NO: 668957 - DNA, 20 bp, mouse
gggtggcgctgggactgggg

SEQ ID NO: 668958 - DNA, 20 bp, mouse
ggcacctgcccgtccgtcgg

SEQ ID NO: 668959 - DNA, 20 bp, mouse
gtcccgcgggaagttgcgct

SEQ ID NO: 668960 - DNA, 20 bp, mouse
gggtccgttggggtcgcaaa

SEQ ID NO: 668961 - DNA, 20 bp, mouse
ggcccctctggcctggctaa

SEQ ID NO: 668962 - DNA, 20 bp, mouse
gcgccggccaatgggagccg

SEQ ID NO: 668963 - DNA, 20 bp, mouse
ggggttggagggggtccgtt

SEQ ID NO: 668964 - DNA, 20 bp, mouse
gagcctagcgcaacttcccg

SEQ ID NO: 668965 - DNA, 20 bp, mouse
gcgcggctgaaggtgaaggt

SEQ ID NO: 668966 - DNA, 20 bp, mouse
ggactccccgaggtcatcta

SEQ ID NO: 668967 - DNA, 20 bp, mouse
gtcccgaggtcgccccgcct

SEQ ID NO: 668968 - DNA, 20 bp, mouse
gaggtcgccccgcctagggg

SEQ ID NO: 668969 - DNA, 20 bp, mouse
gtcgccccgcctaggggtgg

SEQ ID NO: 668970 - DNA, 20 bp, mouse
gaggtcatctaaggagcagt

SEQ ID NO: 668971 - DNA, 20 bp, mouse
gcgcgagcgctgcagtggcg

SEQ ID NO: 668972 - DNA, 20 bp, mouse
gcgcctaggggtggtgggca

SEQ ID NO: 668973 - DNA, 20 bp, mouse
gcccccgccccgggatctgg

SEQ ID NO: 668974 - DNA, 20 bp, mouse
gggctcggccgccagatccc

SEQ ID NO: 668975 - DNA, 20 bp, mouse
gacccgacggggcttgtatt

SEQ ID NO: 668976 - DNA, 20 bp, mouse
ggcggtgggcggggatgtgt

SEQ ID NO: 668977 - DNA, 20 bp, mouse
gtatcaccgaagggtaacaa

SEQ ID NO: 668978 - DNA, 20 bp, mouse
gaacctgggcggtgccgcgg

SEQ ID NO: 668979 - DNA, 20 bp, mouse
gggctgagggctatcaccga

SEQ ID NO: 668980 - DNA, 20 bp, mouse
gatagccctcagccgcccgg

SEQ ID NO: 668981 - DNA, 20 bp, mouse
gcaccgaagggtaacaaggg

SEQ ID NO: 668982 - DNA, 20 bp, mouse
gcaggttcttctttctgtaa

SEQ ID NO: 668983 - DNA, 20 bp, mouse
gaagaacctgggcggtgccg

SEQ ID NO: 668984 - DNA, 20 bp, mouse
gggttcgagaggagcggtcc

SEQ ID NO: 668985 - DNA, 20 bp, mouse
gttagcctccgggcggctga

SEQ ID NO: 668986 - DNA, 20 bp, mouse
ggcctcgcctccagtcctgc

SEQ ID NO: 668987 - DNA, 20 bp, mouse
gggaactgggaggtgacagt

SEQ ID NO: 668988 - DNA, 20 bp, mouse
gaggactggaggcgaggctg

SEQ ID NO: 668989 - DNA, 20 bp, mouse
gccaccacccccagacccgc

SEQ ID NO: 668990 - DNA, 20 bp, mouse
gacccgcaggactggaggcg

SEQ ID NO: 668991 - DNA, 20 bp, mouse
gtgggggacaggtacaacgg

SEQ ID NO: 668992 - DNA, 20 bp, mouse
gagaagccaccactgggaag

SEQ ID NO: 668993 - DNA, 20 bp, mouse
gcccagacccgcaggactgg

SEQ ID NO: 668994 - DNA, 20 bp, mouse
gtacaacggagggacggtcc

SEQ ID NO: 668995 - DNA, 20 bp, mouse
gacccccagacccgcaggac

SEQ ID NO: 668996 - DNA, 20 bp, mouse
gcccccacaagctcctagta

SEQ ID NO: 668997 - DNA, 20 bp, mouse
gactgccacggaactcaact

SEQ ID NO: 668998 - DNA, 20 bp, mouse
gagcttgtggggggcgtctc

SEQ ID NO: 668999 - DNA, 20 bp, mouse
gtaccctactaggagcttgt

SEQ ID NO: 669000 - DNA, 20 bp, mouse
gagcccccagtgctctgccg

SEQ ID NO: 669001 - DNA, 20 bp, mouse
gctgccgcggaaccgacgtg

SEQ ID NO: 669002 - DNA, 20 bp, mouse
gcagcagccaatgactgcca

SEQ ID NO: 669003 - DNA, 20 bp, mouse
gttccgcggcagagcactgg

SEQ ID NO: 669004 - DNA, 20 bp, mouse
gtccccttggttcctgggga

SEQ ID NO: 669005 - DNA, 20 bp, mouse
ggcagagcactgggggctgt

SEQ ID NO: 669006 - DNA, 20 bp, mouse
gactgagcgtagtggaagcg

SEQ ID NO: 669007 - DNA, 20 bp, mouse
ggaagcgggggtagagctag

SEQ ID NO: 669008 - DNA, 20 bp, mouse
ggccctttgaagggattgta

SEQ ID NO: 669009 - DNA, 20 bp, mouse
ggctgttaggggagtggcat

SEQ ID NO: 669010 - DNA, 20 bp, mouse
gctaaacagccagacttcac

SEQ ID NO: 669011 - DNA, 20 bp, mouse
gtcctgaaaccagtgaagtc

SEQ ID NO: 669012 - DNA, 20 bp, mouse
gcaagctggtctcttgtccc

SEQ ID NO: 669013 - DNA, 20 bp, mouse
gtaggggagtggcatggggt

SEQ ID NO: 669014 - DNA, 20 bp, mouse
gaaaccaggactgagcgtag

SEQ ID NO: 669015 - DNA, 20 bp, mouse
gaagggattgtagggacagg

SEQ ID NO: 669016 - DNA, 20 bp, mouse
ggcgtggcccgcggggacag

SEQ ID NO: 669017 - DNA, 20 bp, mouse
gacgcgattacgaaacccag

SEQ ID NO: 669018 - DNA, 20 bp, mouse
gcagactagcacagacagtt

SEQ ID NO: 669019 - DNA, 20 bp, mouse
gcagaggtggggctggcgga

SEQ ID NO: 669020 - DNA, 20 bp, mouse
gcaccgtagagcctctccgt

SEQ ID NO: 669021 - DNA, 20 bp, mouse
gtgcttgccgctgtccccgc

SEQ ID NO: 669022 - DNA, 20 bp, mouse
gacgccgtgcgccccgaagc

SEQ ID NO: 669023 - DNA, 20 bp, mouse
gcggcacggcggggagttga

SEQ ID NO: 669024 - DNA, 20 bp, mouse
gagcgctccgcccagcttcg

SEQ ID NO: 669025 - DNA, 20 bp, mouse
gccgcgctcggggacaaccg

SEQ ID NO: 669026 - DNA, 20 bp, mouse
gctaccagcccgcctactgg

SEQ ID NO: 669027 - DNA, 20 bp, mouse
ggtgaggccccgcccagtga

SEQ ID NO: 669028 - DNA, 20 bp, mouse
ggccccgcccagtgagggag

SEQ ID NO: 669029 - DNA, 20 bp, mouse
ggctcgcccgggcacgtcta

SEQ ID NO: 669030 - DNA, 20 bp, mouse
ggggtgggctacggggaaga

SEQ ID NO: 669031 - DNA, 20 bp, mouse
gcggctacgcccccactaca

SEQ ID NO: 669032 - DNA, 20 bp, mouse
ggagccacaagcggtgtgtg

SEQ ID NO: 669033 - DNA, 20 bp, mouse
gcagccgcacacaccgcttg

SEQ ID NO: 669034 - DNA, 20 bp, mouse
gcctgtccccccccagtagg

SEQ ID NO: 669035 - DNA, 20 bp, mouse
gcaaagagtgaccgctgggt

SEQ ID NO: 669036 - DNA, 20 bp, mouse
gtggacgttagcgtcaacac

SEQ ID NO: 669037 - DNA, 20 bp, mouse
gaggctgcgaaccttgttgc

SEQ ID NO: 669038 - DNA, 20 bp, mouse
gagaagagctgtgatttggc

SEQ ID NO: 669039 - DNA, 20 bp, mouse
gatgctctgctattcgcagc

SEQ ID NO: 669040 - DNA, 20 bp, mouse
gaccaatcagaaaggaggaa

SEQ ID NO: 669041 - DNA, 20 bp, mouse
gagcgtcaacaccggcaaca

SEQ ID NO: 669042 - DNA, 20 bp, mouse
gcagtaggaaccaatcagaa

SEQ ID NO: 669043 - DNA, 20 bp, mouse
gggagtcttgacgacctccg

SEQ ID NO: 669044 - DNA, 20 bp, mouse
gacccaaaaccacctatgtt

SEQ ID NO: 669045 - DNA, 20 bp, mouse
ggatgtctgccaaacatagg

SEQ ID NO: 669046 - DNA, 20 bp, mouse
ggactcagcgaagtcctcgt

SEQ ID NO: 669047 - DNA, 20 bp, mouse
gggtcctgacgtcacgcgga

SEQ ID NO: 669048 - DNA, 20 bp, mouse
gacgcggagggcagtgccgg

SEQ ID NO: 669049 - DNA, 20 bp, mouse
gtgaccgggaacgcagtgaa

SEQ ID NO: 669050 - DNA, 20 bp, mouse
gtcagcacgcttggtcccca

SEQ ID NO: 669051 - DNA, 20 bp, mouse
gggggtggggaataaatgtg

SEQ ID NO: 669052 - DNA, 20 bp, mouse
gcgaagtcctcgtcggtcgc

SEQ ID NO: 669053 - DNA, 20 bp, mouse
gagtccctcaggttagagtt

SEQ ID NO: 669054 - DNA, 20 bp, mouse
gaaggagagcgaacactttg

SEQ ID NO: 669055 - DNA, 20 bp, mouse
ggtcacgcggagggcagtgc

SEQ ID NO: 669056 - DNA, 20 bp, mouse
gagacctggggctgtcctat

SEQ ID NO: 669057 - DNA, 20 bp, mouse
gaagtcacacccactcgccc

SEQ ID NO: 669058 - DNA, 20 bp, mouse
gagtgggtgtgacttcgtgg

SEQ ID NO: 669059 - DNA, 20 bp, mouse
gaggacgttaggcaacggtg

SEQ ID NO: 669060 - DNA, 20 bp, mouse
gaacgcgcgcctttcctccg

SEQ ID NO: 669061 - DNA, 20 bp, mouse
gacgttaggcaacggtgggg

SEQ ID NO: 669062 - DNA, 20 bp, mouse
gttaacttttgagacctcgg

SEQ ID NO: 669063 - DNA, 20 bp, mouse
gcggaagtagatgtgcgtag

SEQ ID NO: 669064 - DNA, 20 bp, mouse
ggcgagtgggtgtgacttcg

SEQ ID NO: 669065 - DNA, 20 bp, mouse
gtgccggccgtcaccggcga

SEQ ID NO: 669066 - DNA, 20 bp, mouse
ggggctcgctaactcagcaa

SEQ ID NO: 669067 - DNA, 20 bp, mouse
gcaaggcggggcggtcggaa

SEQ ID NO: 669068 - DNA, 20 bp, mouse
gaggccgagagagaacgcta

SEQ ID NO: 669069 - DNA, 20 bp, mouse
gcgacgggacgaggaatccc

SEQ ID NO: 669070 - DNA, 20 bp, mouse
gtgcagcagagagggctcgg

SEQ ID NO: 669071 - DNA, 20 bp, mouse
gaacgctaaggaccgggcga

SEQ ID NO: 669072 - DNA, 20 bp, mouse
gctcctgagggaagcgaccg

SEQ ID NO: 669073 - DNA, 20 bp, mouse
gcctggcggcccggctcagt

SEQ ID NO: 669074 - DNA, 20 bp, mouse
ggcgagccccaggactaaaa

SEQ ID NO: 669075 - DNA, 20 bp, mouse
gcccctgccgtggacggtga

SEQ ID NO: 669076 - DNA, 20 bp, mouse
gtcttaggctatcaaattgg

SEQ ID NO: 669077 - DNA, 20 bp, mouse
gatagcattaagttctaaag

SEQ ID NO: 669078 - DNA, 20 bp, mouse
gaggaaaacaacatacaagg

SEQ ID NO: 669079 - DNA, 20 bp, mouse
gtcctcagtgactatctctt

SEQ ID NO: 669080 - DNA, 20 bp, mouse
ggcctaagagatagtcactg

SEQ ID NO: 669081 - DNA, 20 bp, mouse
gctgaggaaaacaacataca

SEQ ID NO: 669082 - DNA, 20 bp, mouse
gatctcttaggctatcaaat

SEQ ID NO: 669083 - DNA, 20 bp, mouse
gaaccaggactcaaggaata

SEQ ID NO: 669084 - DNA, 20 bp, mouse
ggaccatattccttgagtcc

SEQ ID NO: 669085 - DNA, 20 bp, mouse
gactgataatggacttttgt

SEQ ID NO: 669086 - DNA, 20 bp, mouse
gcacgagggtgaggcccgga

SEQ ID NO: 669087 - DNA, 20 bp, mouse
ggccaccccaaaccttggat

SEQ ID NO: 669088 - DNA, 20 bp, mouse
gtgggtgggtacagtagaag

SEQ ID NO: 669089 - DNA, 20 bp, mouse
ggggtgaggcccggagggag

SEQ ID NO: 669090 - DNA, 20 bp, mouse
gcgaggtaacggttggtatc

SEQ ID NO: 669091 - DNA, 20 bp, mouse
gcggcgcagggagacctccg

SEQ ID NO: 669092 - DNA, 20 bp, mouse
gtaacggttggtatcgggat

SEQ ID NO: 669093 - DNA, 20 bp, mouse
ggggagacctccgtggatcc

SEQ ID NO: 669094 - DNA, 20 bp, mouse
gttactgagcaggcgcacgt

SEQ ID NO: 669095 - DNA, 20 bp, mouse
gcgtggaccacgtgtgacgt

SEQ ID NO: 669096 - DNA, 20 bp, mouse
gctcacggagccaccaccgg

SEQ ID NO: 669097 - DNA, 20 bp, mouse
gctggcttgccctccggtgg

SEQ ID NO: 669098 - DNA, 20 bp, mouse
gtgacagcggtggacttgat

SEQ ID NO: 669099 - DNA, 20 bp, mouse
gctgaaggatgtctatcatg

SEQ ID NO: 669100 - DNA, 20 bp, mouse
gccccctgccccgaccctat

SEQ ID NO: 669101 - DNA, 20 bp, mouse
gggcctatgagagtctgctt

SEQ ID NO: 669102 - DNA, 20 bp, mouse
gtagccaatagggtcggggc

SEQ ID NO: 669103 - DNA, 20 bp, mouse
gagccgaagcagactctcat

SEQ ID NO: 669104 - DNA, 20 bp, mouse
gcagaaagccattggtctga

SEQ ID NO: 669105 - DNA, 20 bp, mouse
gttccggagcagaaagccat

SEQ ID NO: 669106 - DNA, 20 bp, mouse
gcggggagacttgggaacgg

SEQ ID NO: 669107 - DNA, 20 bp, mouse
gcgcgcgagcctaacggctg

SEQ ID NO: 669108 - DNA, 20 bp, mouse
ggcccagcgcgcgagcctaa

SEQ ID NO: 669109 - DNA, 20 bp, mouse
gtcgacaaacaagggatcgg

SEQ ID NO: 669110 - DNA, 20 bp, mouse
gacaaacaagggatcggggg

SEQ ID NO: 669111 - DNA, 20 bp, mouse
gaggagggccaggataacga

SEQ ID NO: 669112 - DNA, 20 bp, mouse
gtcgagccgtcgacaaacaa

SEQ ID NO: 669113 - DNA, 20 bp, mouse
gggcggggcgcggggagact

SEQ ID NO: 669114 - DNA, 20 bp, mouse
gcgccatggcgaccctttgt

SEQ ID NO: 669115 - DNA, 20 bp, mouse
ggggcgcggcaagcaccctg

SEQ ID NO: 669116 - DNA, 20 bp, mouse
gtggcagcggagggataatc

SEQ ID NO: 669117 - DNA, 20 bp, mouse
ggagctgcagctaccggagt

SEQ ID NO: 669118 - DNA, 20 bp, mouse
gcatcagcgtgcgccgcacc

SEQ ID NO: 669119 - DNA, 20 bp, mouse
gtaatcaggccggacctgaa

SEQ ID NO: 669120 - DNA, 20 bp, mouse
gggactgagctcaccaactc

SEQ ID NO: 669121 - DNA, 20 bp, mouse
gagcggagggataatcaggc

SEQ ID NO: 669122 - DNA, 20 bp, mouse
ggccgcacccggaagagacg

SEQ ID NO: 669123 - DNA, 20 bp, mouse
ggctccgctcccttcaggtc

SEQ ID NO: 669124 - DNA, 20 bp, mouse
gcccggaagagacgtggcag

SEQ ID NO: 669125 - DNA, 20 bp, mouse
ggatgacgccacagcgccgc

SEQ ID NO: 669126 - DNA, 20 bp, mouse
gacccgaagcgtcccagctc

SEQ ID NO: 669127 - DNA, 20 bp, mouse
gaaagtgtgaacgcagtaag

SEQ ID NO: 669128 - DNA, 20 bp, mouse
gggtggccccgcccctccgg

SEQ ID NO: 669129 - DNA, 20 bp, mouse
gaacccgagctccgggacag

SEQ ID NO: 669130 - DNA, 20 bp, mouse
ggctgccgaggtcctgagac

SEQ ID NO: 669131 - DNA, 20 bp, mouse
gctgggaagtggcgcgaaag

SEQ ID NO: 669132 - DNA, 20 bp, mouse
gaggacctgcgtcccggcgc

SEQ ID NO: 669133 - DNA, 20 bp, mouse
gcactccgccgccggagggg

SEQ ID NO: 669134 - DNA, 20 bp, mouse
gccgagctccgggacagagg

SEQ ID NO: 669135 - DNA, 20 bp, mouse
gggcgcgaaagtggctgccg

SEQ ID NO: 669136 - DNA, 20 bp, mouse
gcgctcccgcgccggcctta

SEQ ID NO: 669137 - DNA, 20 bp, mouse
gaccgcaggtggagaggccc

SEQ ID NO: 669138 - DNA, 20 bp, mouse
ggggccacgcgcccgcaccc

SEQ ID NO: 669139 - DNA, 20 bp, mouse
gttaaggcttggaccgcagg

SEQ ID NO: 669140 - DNA, 20 bp, mouse
gtctcccgcgcgaacctgag

SEQ ID NO: 669141 - DNA, 20 bp, mouse
gcccgcgcaaccaaacacgc

SEQ ID NO: 669142 - DNA, 20 bp, mouse
ggccttaaggcttggaccgc

SEQ ID NO: 669143 - DNA, 20 bp, mouse
gcgtccgctcaggttcgcgc

SEQ ID NO: 669144 - DNA, 20 bp, mouse
gctaccgcgcaggtccgcgg

SEQ ID NO: 669145 - DNA, 20 bp, mouse
gcgcaacctcgcacagcctc

SEQ ID NO: 669146 - DNA, 20 bp, mouse
gcgccagccaatcctcatgg

SEQ ID NO: 669147 - DNA, 20 bp, mouse
ggcaaatcgccgtcttagga

SEQ ID NO: 669148 - DNA, 20 bp, mouse
gctctggagtcgcgaaaaga

SEQ ID NO: 669149 - DNA, 20 bp, mouse
gatgaggattggctggcgga

SEQ ID NO: 669150 - DNA, 20 bp, mouse
ggtgctaactggaagtagag

SEQ ID NO: 669151 - DNA, 20 bp, mouse
ggtgtgccgcaatgacatct

SEQ ID NO: 669152 - DNA, 20 bp, mouse
gcttccagttagcacgactc

SEQ ID NO: 669153 - DNA, 20 bp, mouse
gactccagagtcgtgctaac

SEQ ID NO: 669154 - DNA, 20 bp, mouse
gaagaagctttattgtgatt

SEQ ID NO: 669155 - DNA, 20 bp, mouse
gcaatgcccagatgtcattg

SEQ ID NO: 669156 - DNA, 20 bp, mouse
ggagggtagtacctgagctg

SEQ ID NO: 669157 - DNA, 20 bp, mouse
ggtgacccacgcttcctctg

SEQ ID NO: 669158 - DNA, 20 bp, mouse
gcctcaaggccaccgggcaa

SEQ ID NO: 669159 - DNA, 20 bp, mouse
ggaggccacagaggaagcgt

SEQ ID NO: 669160 - DNA, 20 bp, mouse
gactaccctcccttgcccgg

SEQ ID NO: 669161 - DNA, 20 bp, mouse
ggggaagagctggtgaactc

SEQ ID NO: 669162 - DNA, 20 bp, mouse
gaaggccaccgggcaaggga

SEQ ID NO: 669163 - DNA, 20 bp, mouse
ggaactgaagcccgggaagg

SEQ ID NO: 669164 - DNA, 20 bp, mouse
gcggggacaaatttgcctca

SEQ ID NO: 669165 - DNA, 20 bp, mouse
gaaggaactgaagcccggga

SEQ ID NO: 669166 - DNA, 20 bp, mouse
gtgagtcagcccatcccacg

SEQ ID NO: 669167 - DNA, 20 bp, mouse
gacccctcaacctggcggta

SEQ ID NO: 669168 - DNA, 20 bp, mouse
gaatgcttgaaattctttac

SEQ ID NO: 669169 - DNA, 20 bp, mouse
ggccctaccgccaggttgag

SEQ ID NO: 669170 - DNA, 20 bp, mouse
gtccatgagccccagggatc

SEQ ID NO: 669171 - DNA, 20 bp, mouse
gttagaaataagggggtagg

SEQ ID NO: 669172 - DNA, 20 bp, mouse
ggcaacgattagaaataagg

SEQ ID NO: 669173 - DNA, 20 bp, mouse
gtcagcccatcccacggggg

SEQ ID NO: 669174 - DNA, 20 bp, mouse
gggcaaacagcactcaaagt

SEQ ID NO: 669175 - DNA, 20 bp, mouse
gggggggtacagatgtgtgg

SEQ ID NO: 669176 - DNA, 20 bp, mouse
ggaagctgggaagtcttcta

SEQ ID NO: 669177 - DNA, 20 bp, mouse
ggagtctagcagaagttctt

SEQ ID NO: 669178 - DNA, 20 bp, mouse
ggtcgaaggaaagtggtgtc

SEQ ID NO: 669179 - DNA, 20 bp, mouse
gtggcagccaaggaactgca

SEQ ID NO: 669180 - DNA, 20 bp, mouse
gggggcctgcctgtagaagg

SEQ ID NO: 669181 - DNA, 20 bp, mouse
gggcgcccgaggcgagggaa

SEQ ID NO: 669182 - DNA, 20 bp, mouse
gaggaggcgtggagcaggat

SEQ ID NO: 669183 - DNA, 20 bp, mouse
ggaccgtggaataggaagct

SEQ ID NO: 669184 - DNA, 20 bp, mouse
gcaaacactgagctcgggtg

SEQ ID NO: 669185 - DNA, 20 bp, mouse
gcgcccccggcgccgctgat

SEQ ID NO: 669186 - DNA, 20 bp, mouse
gggcgcaggcggattagatg

SEQ ID NO: 669187 - DNA, 20 bp, mouse
gagatggggccgattacctt

SEQ ID NO: 669188 - DNA, 20 bp, mouse
gtgcaagtgaatgcgaggga

SEQ ID NO: 669189 - DNA, 20 bp, mouse
ggagctgcagcactcgccat

SEQ ID NO: 669190 - DNA, 20 bp, mouse
gggagggagcatccgagagg

SEQ ID NO: 669191 - DNA, 20 bp, mouse
gattgtgttaggggcgcagg

SEQ ID NO: 669192 - DNA, 20 bp, mouse
ggagggagggagcatccgag

SEQ ID NO: 669193 - DNA, 20 bp, mouse
gtcgcagaatccgagtttct

SEQ ID NO: 669194 - DNA, 20 bp, mouse
gccatgggaaggttagagac

SEQ ID NO: 669195 - DNA, 20 bp, mouse
ggaaccaaagaaagcgggga

SEQ ID NO: 669196 - DNA, 20 bp, mouse
gctgctagacgccgagaatt

SEQ ID NO: 669197 - DNA, 20 bp, mouse
gggggggaggagcgccgaca

SEQ ID NO: 669198 - DNA, 20 bp, mouse
gagacgccgagaattgggcc

SEQ ID NO: 669199 - DNA, 20 bp, mouse
gcggcgctcctccccccctg

SEQ ID NO: 669200 - DNA, 20 bp, mouse
gggaggagcgccgacagggt

SEQ ID NO: 669201 - DNA, 20 bp, mouse
gccgacgctgggagggaaag

SEQ ID NO: 669202 - DNA, 20 bp, mouse
gtctcggcgtctagcagcct

SEQ ID NO: 669203 - DNA, 20 bp, mouse
ggatacacagccaatcagga

SEQ ID NO: 669204 - DNA, 20 bp, mouse
gcctgggtttggcatctctc

SEQ ID NO: 669205 - DNA, 20 bp, mouse
gcatctctcggggccccagg

SEQ ID NO: 669206 - DNA, 20 bp, mouse
gctggctccagggacatgac

SEQ ID NO: 669207 - DNA, 20 bp, mouse
gtgcgtgcaggcaaagcatg

SEQ ID NO: 669208 - DNA, 20 bp, mouse
ggcaggcaaagcatgcggag

SEQ ID NO: 669209 - DNA, 20 bp, mouse
gggagcattgcttgctaatc

SEQ ID NO: 669210 - DNA, 20 bp, mouse
gaaagcatgcggagaggttg

SEQ ID NO: 669211 - DNA, 20 bp, mouse
gaaagaccagtttcccaagt

SEQ ID NO: 669212 - DNA, 20 bp, mouse
ggggagactgaaaacagtac

SEQ ID NO: 669213 - DNA, 20 bp, mouse
gtgaataccgcctggctcca

SEQ ID NO: 669214 - DNA, 20 bp, mouse
ggagaggttgtgggtctcct

SEQ ID NO: 669215 - DNA, 20 bp, mouse
gaaaggaagcaagcccactt

SEQ ID NO: 669216 - DNA, 20 bp, mouse
ggtgccgcctccttgctcgg

SEQ ID NO: 669217 - DNA, 20 bp, mouse
gtcgcgaaagcattgggtag

SEQ ID NO: 669218 - DNA, 20 bp, mouse
gataggggcgagcacctcgc

SEQ ID NO: 669219 - DNA, 20 bp, mouse
gaggcagagcctctcctcaa

SEQ ID NO: 669220 - DNA, 20 bp, mouse
gccccctccgagcaaggagg

SEQ ID NO: 669221 - DNA, 20 bp, mouse
gggagagccccctccgagca

SEQ ID NO: 669222 - DNA, 20 bp, mouse
gggtgcaattccagttccta

SEQ ID NO: 669223 - DNA, 20 bp, mouse
ggtgcccagcctcacaaatc

SEQ ID NO: 669224 - DNA, 20 bp, mouse
gaaacgagggagcgttatga

SEQ ID NO: 669225 - DNA, 20 bp, mouse
gtatctgccatgcaaaacga

SEQ ID NO: 669226 - DNA, 20 bp, mouse
gagtgacagcacatgtaggt

SEQ ID NO: 669227 - DNA, 20 bp, mouse
gcggggtctgggcagggcta

SEQ ID NO: 669228 - DNA, 20 bp, mouse
gggactgcacgtgtgtggtg

SEQ ID NO: 669229 - DNA, 20 bp, mouse
gagcccaatgctctcagcgt

SEQ ID NO: 669230 - DNA, 20 bp, mouse
gagagccagagcaaagtgat

SEQ ID NO: 669231 - DNA, 20 bp, mouse
gagggctgagtgactgcatg

SEQ ID NO: 669232 - DNA, 20 bp, mouse
gccagggcggggtctgggca

SEQ ID NO: 669233 - DNA, 20 bp, mouse
gtgcttggggagcaggccaa

SEQ ID NO: 669234 - DNA, 20 bp, mouse
gtgcatggggggcagagtca

SEQ ID NO: 669235 - DNA, 20 bp, mouse
gtgagtgacagcatgtaggg

SEQ ID NO: 669236 - DNA, 20 bp, mouse
ggggccagcaagtgctcatt

SEQ ID NO: 669237 - DNA, 20 bp, mouse
gaagagctgcccacctccta

SEQ ID NO: 669238 - DNA, 20 bp, mouse
ggctcattgggctgtgtcaa

SEQ ID NO: 669239 - DNA, 20 bp, mouse
gcgtgactgccagccctagg

SEQ ID NO: 669240 - DNA, 20 bp, mouse
ggagcacttgctggccctct

SEQ ID NO: 669241 - DNA, 20 bp, mouse
ggggccaggcctgctcctgt

SEQ ID NO: 669242 - DNA, 20 bp, mouse
gcatccgtagaggcagttca

SEQ ID NO: 669243 - DNA, 20 bp, mouse
ggcaaggtggacacttgagc

SEQ ID NO: 669244 - DNA, 20 bp, mouse
gaaggtgggaagagcattcc

SEQ ID NO: 669245 - DNA, 20 bp, mouse
gggagtggaaaatgccaccg

SEQ ID NO: 669246 - DNA, 20 bp, mouse
gagtcactgggtatcataaa

SEQ ID NO: 669247 - DNA, 20 bp, mouse
ggttgctgagttgttggtgg

SEQ ID NO: 669248 - DNA, 20 bp, mouse
gaccaaacatgctttcaaac

SEQ ID NO: 669249 - DNA, 20 bp, mouse
ggtatcattacattcagtcc

SEQ ID NO: 669250 - DNA, 20 bp, mouse
gacttgtcagtgtctgtcag

SEQ ID NO: 669251 - DNA, 20 bp, mouse
ggttgaggaagtgtctctta

SEQ ID NO: 669252 - DNA, 20 bp, mouse
ggccatgctgaaagacacag

SEQ ID NO: 669253 - DNA, 20 bp, mouse
ggtgtgtatccaactatctc

SEQ ID NO: 669254 - DNA, 20 bp, mouse
ggtggttaatgtttgactgg

SEQ ID NO: 669255 - DNA, 20 bp, mouse
gctcacactccagagatagt

SEQ ID NO: 669256 - DNA, 20 bp, mouse
gcccaaaagtatgtacggtg

SEQ ID NO: 669257 - DNA, 20 bp, mouse
ggggagtagagggagagtca

SEQ ID NO: 669258 - DNA, 20 bp, mouse
gtcccgagcgcgtctctgat

SEQ ID NO: 669259 - DNA, 20 bp, mouse
gattggctggcagctcgtgt

SEQ ID NO: 669260 - DNA, 20 bp, mouse
ggcaggacgcaggacgactc

SEQ ID NO: 669261 - DNA, 20 bp, mouse
gtctgtgtgaccttgtctat

SEQ ID NO: 669262 - DNA, 20 bp, mouse
ggaccagcagtactctgcgg

SEQ ID NO: 669263 - DNA, 20 bp, mouse
gcgtcctgcgtcctgcatcc

SEQ ID NO: 669264 - DNA, 20 bp, mouse
gaatgggagtatacatcaga

SEQ ID NO: 669265 - DNA, 20 bp, mouse
gttagaccagcagtactctg

SEQ ID NO: 669266 - DNA, 20 bp, mouse
ggatgtccgttcttagtctg

SEQ ID NO: 669267 - DNA, 20 bp, mouse
gggacatcagaatgccctta

SEQ ID NO: 669268 - DNA, 20 bp, mouse
gaaaaggaagtactcacttg

SEQ ID NO: 669269 - DNA, 20 bp, mouse
gagggacaaaagttactgaa

SEQ ID NO: 669270 - DNA, 20 bp, mouse
ggaagtactcacttgaggtg

SEQ ID NO: 669271 - DNA, 20 bp, mouse
gtcttagtctgaggttaaaa

SEQ ID NO: 669272 - DNA, 20 bp, mouse
gcaaaacacgaaaaataaga

SEQ ID NO: 669273 - DNA, 20 bp, mouse
gtatgtaagagttgtgcaag

SEQ ID NO: 669274 - DNA, 20 bp, mouse
gaagagttgtgcaagtggag

SEQ ID NO: 669275 - DNA, 20 bp, mouse
gctggactaatctccaagca

SEQ ID NO: 669276 - DNA, 20 bp, mouse
ggggctcgaaagctcgcgtg

SEQ ID NO: 669277 - DNA, 20 bp, mouse
gaggtagcgggccggatccg

SEQ ID NO: 669278 - DNA, 20 bp, mouse
gggaggccaccgagctgcgg

SEQ ID NO: 669279 - DNA, 20 bp, mouse
gcagctcggtggcctcccat

SEQ ID NO: 669280 - DNA, 20 bp, mouse
gcgcccgcgtcgcggccaat

SEQ ID NO: 669281 - DNA, 20 bp, mouse
gggcagccccagagatgcgg

SEQ ID NO: 669282 - DNA, 20 bp, mouse
gtccatccgccgcatctctg

SEQ ID NO: 669283 - DNA, 20 bp, mouse
gagcgcagagcagcggagaa

SEQ ID NO: 669284 - DNA, 20 bp, mouse
gatggaggatacggaggtgg

SEQ ID NO: 669285 - DNA, 20 bp, mouse
gcccgtcattgcggatgtac

SEQ ID NO: 669286 - DNA, 20 bp, mouse
gaacccagagagggatgaaa

SEQ ID NO: 669287 - DNA, 20 bp, mouse
gcgggctagaaaacgcgcga

SEQ ID NO: 669288 - DNA, 20 bp, mouse
ggaccagcgaggggcaaaat

SEQ ID NO: 669289 - DNA, 20 bp, mouse
gagcggggaaacaagacccg

SEQ ID NO: 669290 - DNA, 20 bp, mouse
ggcgcgctggtcttaaagga

SEQ ID NO: 669291 - DNA, 20 bp, mouse
ggctagaaaacgcgcgaagg

SEQ ID NO: 669292 - DNA, 20 bp, mouse
gaaagcaattaaagtccggt

SEQ ID NO: 669293 - DNA, 20 bp, mouse
ggaagaaagcaattaaagtc

SEQ ID NO: 669294 - DNA, 20 bp, mouse
gccgtggtttagaccagcga

SEQ ID NO: 669295 - DNA, 20 bp, mouse
ggacccgcggtacacgcagg

SEQ ID NO: 669296 - DNA, 20 bp, mouse
ggggccccgcaggcgaggga

SEQ ID NO: 669297 - DNA, 20 bp, mouse
gcgagggaggggtgcggtcg

SEQ ID NO: 669298 - DNA, 20 bp, mouse
gtggaggagcgagagagcga

SEQ ID NO: 669299 - DNA, 20 bp, mouse
gagtgtgcgtgtctgactag

SEQ ID NO: 669300 - DNA, 20 bp, mouse
gagaaggagcactcccccgg

SEQ ID NO: 669301 - DNA, 20 bp, mouse
ggggaggggtgcggtcgggg

SEQ ID NO: 669302 - DNA, 20 bp, mouse
gaatgcagcgcccgccgggc

SEQ ID NO: 669303 - DNA, 20 bp, mouse
gccggcggccgcctgcggct

SEQ ID NO: 669304 - DNA, 20 bp, mouse
gctccgggccccgcaggcga

SEQ ID NO: 669305 - DNA, 20 bp, mouse
gcggaccccgcagccagccg

SEQ ID NO: 669306 - DNA, 20 bp, mouse
gggactggcgacggggaacg

SEQ ID NO: 669307 - DNA, 20 bp, mouse
gaaggtgcctgcactggccg

SEQ ID NO: 669308 - DNA, 20 bp, mouse
ggccgcggatgccatgacat

SEQ ID NO: 669309 - DNA, 20 bp, mouse
gcccagcagggagcccagat

SEQ ID NO: 669310 - DNA, 20 bp, mouse
gtgcaggcaccttcccatct

SEQ ID NO: 669311 - DNA, 20 bp, mouse
gcgacggggaacggggtccg

SEQ ID NO: 669312 - DNA, 20 bp, mouse
ggccccttgagggattccac

SEQ ID NO: 669313 - DNA, 20 bp, mouse
gagccagtggaatccctcaa

SEQ ID NO: 669314 - DNA, 20 bp, mouse
ggggctctgggtgagacgcg

SEQ ID NO: 669315 - DNA, 20 bp, mouse
gtctccctcctgccccttga

SEQ ID NO: 669316 - DNA, 20 bp, mouse
gcgcagcacggcaaggtaca

SEQ ID NO: 669317 - DNA, 20 bp, mouse
gccccgcccccgcggctccc

SEQ ID NO: 669318 - DNA, 20 bp, mouse
gggaggagactcaacacgat

SEQ ID NO: 669319 - DNA, 20 bp, mouse
gtgctgggcgcatacagatg

SEQ ID NO: 669320 - DNA, 20 bp, mouse
gacaggggaaagataacggt

SEQ ID NO: 669321 - DNA, 20 bp, mouse
ggaggagaggcggctcgcgc

SEQ ID NO: 669322 - DNA, 20 bp, mouse
ggggcgctgggagagcactg

SEQ ID NO: 669323 - DNA, 20 bp, mouse
gtccgcctgccgaggagagg

SEQ ID NO: 669324 - DNA, 20 bp, mouse
gctgcgggctggcccgggag

SEQ ID NO: 669325 - DNA, 20 bp, mouse
gaacaagggagcgagacgga

SEQ ID NO: 669326 - DNA, 20 bp, mouse
gagtccaataatccctctat

SEQ ID NO: 669327 - DNA, 20 bp, mouse
gtccctgggtataattgtgt

SEQ ID NO: 669328 - DNA, 20 bp, mouse
gagccctgtggccacagatg

SEQ ID NO: 669329 - DNA, 20 bp, mouse
gattgtgtgggattccactg

SEQ ID NO: 669330 - DNA, 20 bp, mouse
gtccctctataggcaattaa

SEQ ID NO: 669331 - DNA, 20 bp, mouse
gcctatcttcccataggccc

SEQ ID NO: 669332 - DNA, 20 bp, mouse
gtgtacacagaaaagtggct

SEQ ID NO: 669333 - DNA, 20 bp, mouse
gtggctgggcatccagcctt

SEQ ID NO: 669334 - DNA, 20 bp, mouse
gcaaaaccctatcttcccat

SEQ ID NO: 669335 - DNA, 20 bp, mouse
ggtgggagagcgtatggtgg

SEQ ID NO: 669336 - DNA, 20 bp, mouse
gcccctcgcaggtggggtcg

SEQ ID NO: 669337 - DNA, 20 bp, mouse
gagagcagggaggccggtgg

SEQ ID NO: 669338 - DNA, 20 bp, mouse
gtcgcagtctctggcttcga

SEQ ID NO: 669339 - DNA, 20 bp, mouse
gtcccgccccctcgcaggtg

SEQ ID NO: 669340 - DNA, 20 bp, mouse
gagggcttcgagagtgcctt

SEQ ID NO: 669341 - DNA, 20 bp, mouse
gccgtggctctcgcagtctc

SEQ ID NO: 669342 - DNA, 20 bp, mouse
gttgtcttcccgtgctgcag

SEQ ID NO: 669343 - DNA, 20 bp, mouse
ggtcgaggccagcctgccga

SEQ ID NO: 669344 - DNA, 20 bp, mouse
gggcaccagggaggaccttt

SEQ ID NO: 669345 - DNA, 20 bp, mouse
gagaagagcagggaggccgg

SEQ ID NO: 669346 - DNA, 20 bp, mouse
gagggcggcctcagtcccgt

SEQ ID NO: 669347 - DNA, 20 bp, mouse
gagtcccgtgggacaactag

SEQ ID NO: 669348 - DNA, 20 bp, mouse
gcaggcctctagttgtccca

SEQ ID NO: 669349 - DNA, 20 bp, mouse
gcctagaaacccagtctccc

SEQ ID NO: 669350 - DNA, 20 bp, mouse
ggcttggcctggttgctcgc

SEQ ID NO: 669351 - DNA, 20 bp, mouse
gtcaggcccggccggagggg

SEQ ID NO: 669352 - DNA, 20 bp, mouse
ggccctgccagcgagcaacc

SEQ ID NO: 669353 - DNA, 20 bp, mouse
ggggctggaggccatcacaa

SEQ ID NO: 669354 - DNA, 20 bp, mouse
gcctccggccgggcctgacg

SEQ ID NO: 669355 - DNA, 20 bp, mouse
gtgtatgagcagacgaagcc

SEQ ID NO: 669356 - DNA, 20 bp, mouse
gccaaggcttccacgggccc

SEQ ID NO: 669357 - DNA, 20 bp, mouse
ggataggcaagccctacggt

SEQ ID NO: 669358 - DNA, 20 bp, mouse
gagcccccacagctacccct

SEQ ID NO: 669359 - DNA, 20 bp, mouse
gaaccatcccgaggggaagt

SEQ ID NO: 669360 - DNA, 20 bp, mouse
ggctgaggccgcccaccgta

SEQ ID NO: 669361 - DNA, 20 bp, mouse
gaggcaagccctacggtggg

SEQ ID NO: 669362 - DNA, 20 bp, mouse
gcccgaggggaagtgggcca

SEQ ID NO: 669363 - DNA, 20 bp, mouse
gtaacaggaaaccatcccga

SEQ ID NO: 669364 - DNA, 20 bp, mouse
gaggggagccacacccaggc

SEQ ID NO: 669365 - DNA, 20 bp, mouse
ggccctggcccacttcccct

SEQ ID NO: 669366 - DNA, 20 bp, mouse
gactcccagtgtttgaagtc

SEQ ID NO: 669367 - DNA, 20 bp, mouse
gagtcattctgtcaagggga

SEQ ID NO: 669368 - DNA, 20 bp, mouse
gactgggagtcattctgtca

SEQ ID NO: 669369 - DNA, 20 bp, mouse
gtccagagagcgaactgctc

SEQ ID NO: 669370 - DNA, 20 bp, mouse
ggaggaggactttgttacag

SEQ ID NO: 669371 - DNA, 20 bp, mouse
ggcaagtgaatgaagtggga

SEQ ID NO: 669372 - DNA, 20 bp, mouse
gtccggagcagttcgctctc

SEQ ID NO: 669373 - DNA, 20 bp, mouse
ggacacgacatggtacggcg

SEQ ID NO: 669374 - DNA, 20 bp, mouse
gggcgctgtgagccagtttg

SEQ ID NO: 669375 - DNA, 20 bp, mouse
gcgctgctggtaattgaaca

SEQ ID NO: 669376 - DNA, 20 bp, mouse
gtccccgcggtgcgcagcga

SEQ ID NO: 669377 - DNA, 20 bp, mouse
gcgagggcgcgcttctgcga

SEQ ID NO: 669378 - DNA, 20 bp, mouse
gctaccctgccagcagcatc

SEQ ID NO: 669379 - DNA, 20 bp, mouse
ggtgcctgatgctgctggca

SEQ ID NO: 669380 - DNA, 20 bp, mouse
ggccctcgctgcgcaccgcg

SEQ ID NO: 669381 - DNA, 20 bp, mouse
gagcaaagagcgggagtagg

SEQ ID NO: 669382 - DNA, 20 bp, mouse
ggtgagcaaagagcgggagt

SEQ ID NO: 669383 - DNA, 20 bp, mouse
ggggggggagggtatccgtg

SEQ ID NO: 669384 - DNA, 20 bp, mouse
gtgtgtgcctcctttggggc

SEQ ID NO: 669385 - DNA, 20 bp, mouse
gttatctgtccggctccccg

SEQ ID NO: 669386 - DNA, 20 bp, mouse
gcactcttggtaggaggaaa

SEQ ID NO: 669387 - DNA, 20 bp, mouse
gcctccgccgccggagtcac

SEQ ID NO: 669388 - DNA, 20 bp, mouse
ggagagcgcaggggcaaggc

SEQ ID NO: 669389 - DNA, 20 bp, mouse
gtcccctgacggatctcatt

SEQ ID NO: 669390 - DNA, 20 bp, mouse
gcaagcgcgggagagcgcag

SEQ ID NO: 669391 - DNA, 20 bp, mouse
gtgtgcgcactcttggtagg

SEQ ID NO: 669392 - DNA, 20 bp, mouse
gctgcgcgcaaagcttggaa

SEQ ID NO: 669393 - DNA, 20 bp, mouse
gagtgcgcacaacttttcgc

SEQ ID NO: 669394 - DNA, 20 bp, mouse
gagggagtggaaaccaagcg

SEQ ID NO: 669395 - DNA, 20 bp, mouse
gagccgggtgcctcccctga

SEQ ID NO: 669396 - DNA, 20 bp, mouse
gttgtgaaaactgctggata

SEQ ID NO: 669397 - DNA, 20 bp, mouse
gttcggaaaaagaaagtgga

SEQ ID NO: 669398 - DNA, 20 bp, mouse
gtaaatatacctcactatta

SEQ ID NO: 669399 - DNA, 20 bp, mouse
ggaattagtaagtgtgtctc

SEQ ID NO: 669400 - DNA, 20 bp, mouse
gttgcagaatttcagtggtt

SEQ ID NO: 669401 - DNA, 20 bp, mouse
gtgttgaaaggatgcggtga

SEQ ID NO: 669402 - DNA, 20 bp, mouse
ggttataagccttaatagtg

SEQ ID NO: 669403 - DNA, 20 bp, mouse
gtattcaatctactcaaaat

SEQ ID NO: 669404 - DNA, 20 bp, mouse
gttaatttgcagaatttcag

SEQ ID NO: 669405 - DNA, 20 bp, mouse
gaaccaaagaaatgaaagta

SEQ ID NO: 669406 - DNA, 20 bp, mouse
gactgggcgtggtaggagag

SEQ ID NO: 669407 - DNA, 20 bp, mouse
gtgggaccagcttatagcgg

SEQ ID NO: 669408 - DNA, 20 bp, mouse
ggtggtgcgagggcgttaag

SEQ ID NO: 669409 - DNA, 20 bp, mouse
gagggcagactgggcgtggt

SEQ ID NO: 669410 - DNA, 20 bp, mouse
gtactgggaccagcttatag

SEQ ID NO: 669411 - DNA, 20 bp, mouse
gcagctggatggctccggtc

SEQ ID NO: 669412 - DNA, 20 bp, mouse
gataagctggtcccagtaat

SEQ ID NO: 669413 - DNA, 20 bp, mouse
gccaggagcaccaggtgcag

SEQ ID NO: 669414 - DNA, 20 bp, mouse
gcctcacagctggatggctc

SEQ ID NO: 669415 - DNA, 20 bp, mouse
gtgggttgctagggcagact

SEQ ID NO: 669416 - DNA, 20 bp, mouse
gaggcccagtgacagagaag

SEQ ID NO: 669417 - DNA, 20 bp, mouse
gcggtgtggggagatctctt

SEQ ID NO: 669418 - DNA, 20 bp, mouse
gccccgaggccggcatgaag

SEQ ID NO: 669419 - DNA, 20 bp, mouse
ggcttggcctgagggctcaa

SEQ ID NO: 669420 - DNA, 20 bp, mouse
ggggtctcactgcaagcaag

SEQ ID NO: 669421 - DNA, 20 bp, mouse
gcctgtagagaaagcggtgt

SEQ ID NO: 669422 - DNA, 20 bp, mouse
gtctcctggctcatcttcag

SEQ ID NO: 669423 - DNA, 20 bp, mouse
gaccagagcaggcaaaaccc

SEQ ID NO: 669424 - DNA, 20 bp, mouse
gggcaaaaccctggaggaat

SEQ ID NO: 669425 - DNA, 20 bp, mouse
gtccccactgaagatgagcc

SEQ ID NO: 669426 - DNA, 20 bp, mouse
ggcaagggctgcaaatgagg

SEQ ID NO: 669427 - DNA, 20 bp, mouse
ggacctggggctaactagga

SEQ ID NO: 669428 - DNA, 20 bp, mouse
gctacaacaggcttggttac

SEQ ID NO: 669429 - DNA, 20 bp, mouse
ggactttggggagagacctg

SEQ ID NO: 669430 - DNA, 20 bp, mouse
gaggctttggtggtaactaa

SEQ ID NO: 669431 - DNA, 20 bp, mouse
gtgcctgggcaaactacaac

SEQ ID NO: 669432 - DNA, 20 bp, mouse
ggagagacctggggctaact

SEQ ID NO: 669433 - DNA, 20 bp, mouse
gtaccaccaaagcctctgtt

SEQ ID NO: 669434 - DNA, 20 bp, mouse
gtggagagaaggttcagact

SEQ ID NO: 669435 - DNA, 20 bp, mouse
gatggtgcagggagtcatca

SEQ ID NO: 669436 - DNA, 20 bp, mouse
gtgaacgcgagccaaatcca

SEQ ID NO: 669437 - DNA, 20 bp, mouse
gtcagctgagagtgtagaga

SEQ ID NO: 669438 - DNA, 20 bp, mouse
gtctacactctcagctgacg

SEQ ID NO: 669439 - DNA, 20 bp, mouse
gaccaccgcacccctggatt

SEQ ID NO: 669440 - DNA, 20 bp, mouse
gatcgagtgggactaacctg

SEQ ID NO: 669441 - DNA, 20 bp, mouse
gcgtgcgcgcggtaaaccag

SEQ ID NO: 669442 - DNA, 20 bp, mouse
gcagggccggggcctttcaa

SEQ ID NO: 669443 - DNA, 20 bp, mouse
gggaatggccaggatcgagt

SEQ ID NO: 669444 - DNA, 20 bp, mouse
ggccaaatccaggggtgcgg

SEQ ID NO: 669445 - DNA, 20 bp, mouse
ggtcacaaaactgcaagtga

SEQ ID NO: 669446 - DNA, 20 bp, mouse
gccgctggccggcactaaca

SEQ ID NO: 669447 - DNA, 20 bp, mouse
gtggggccatagatctaagg

SEQ ID NO: 669448 - DNA, 20 bp, mouse
gtacagatggcctctatcaa

SEQ ID NO: 669449 - DNA, 20 bp, mouse
gaggagtggagaataggtgt

SEQ ID NO: 669450 - DNA, 20 bp, mouse
gggcactaacaggggacatg

SEQ ID NO: 669451 - DNA, 20 bp, mouse
gctctggggccatagatcta

SEQ ID NO: 669452 - DNA, 20 bp, mouse
gcccacgggaactacacata

SEQ ID NO: 669453 - DNA, 20 bp, mouse
ggaactggggcagggctgta

SEQ ID NO: 669454 - DNA, 20 bp, mouse
ggctgtagggagctgagtca

SEQ ID NO: 669455 - DNA, 20 bp, mouse
ggcaggggcgaaggtcgcca

SEQ ID NO: 669456 - DNA, 20 bp, mouse
gcccgcctcggcgtgtgaga

SEQ ID NO: 669457 - DNA, 20 bp, mouse
gaccgcgcggcgggtgaggg

SEQ ID NO: 669458 - DNA, 20 bp, mouse
gcgtgtgagaggggtccctt

SEQ ID NO: 669459 - DNA, 20 bp, mouse
gcccaccgcgcggcgggtga

SEQ ID NO: 669460 - DNA, 20 bp, mouse
gcccgcctcagggaatgctg

SEQ ID NO: 669461 - DNA, 20 bp, mouse
ggcagcgcttggccggtgag

SEQ ID NO: 669462 - DNA, 20 bp, mouse
gggacccctctcacacgccg

SEQ ID NO: 669463 - DNA, 20 bp, mouse
gtcggcgggctaggtcacgc

SEQ ID NO: 669464 - DNA, 20 bp, mouse
gccgccgcgcggtgggtgcc

SEQ ID NO: 669465 - DNA, 20 bp, mouse
ggcgggctaggtcacgcggg

SEQ ID NO: 669466 - DNA, 20 bp, mouse
gcgtaccaacgcacagggga

SEQ ID NO: 669467 - DNA, 20 bp, mouse
gactcgagagccagccgcaa

SEQ ID NO: 669468 - DNA, 20 bp, mouse
gggctcgtaccaacgcacag

SEQ ID NO: 669469 - DNA, 20 bp, mouse
gggtacgagccgaagcctag

SEQ ID NO: 669470 - DNA, 20 bp, mouse
ggcagcagaagagacctgag

SEQ ID NO: 669471 - DNA, 20 bp, mouse
gctgcgcctccccaagagat

SEQ ID NO: 669472 - DNA, 20 bp, mouse
gctagcgccgccctggtggt

SEQ ID NO: 669473 - DNA, 20 bp, mouse
ggaagcctaggggccccggc

SEQ ID NO: 669474 - DNA, 20 bp, mouse
gacgaggatcgcaagcgtcg

SEQ ID NO: 669475 - DNA, 20 bp, mouse
ggaagcaggccggccttaaa

SEQ ID NO: 669476 - DNA, 20 bp, mouse
gtgggagcgcagagcgcgaa

SEQ ID NO: 669477 - DNA, 20 bp, mouse
gcgcagagcgcgaaagggag

SEQ ID NO: 669478 - DNA, 20 bp, mouse
gggccagaggaattgcagga

SEQ ID NO: 669479 - DNA, 20 bp, mouse
gcgaaagggagcggaaaccg

SEQ ID NO: 669480 - DNA, 20 bp, mouse
gcgcttgggcggggctgcct

SEQ ID NO: 669481 - DNA, 20 bp, mouse
gagaggaattgcaggagggc

SEQ ID NO: 669482 - DNA, 20 bp, mouse
gagaaacaacaggacgatat

SEQ ID NO: 669483 - DNA, 20 bp, mouse
gtcgccgcggtaaagctccc

SEQ ID NO: 669484 - DNA, 20 bp, mouse
gccgcggccagaggaattgc

SEQ ID NO: 669485 - DNA, 20 bp, mouse
gacaacaggacgatattgga

SEQ ID NO: 669486 - DNA, 20 bp, mouse
gcaggcgcatgacgtacttc

SEQ ID NO: 669487 - DNA, 20 bp, mouse
gtctggaagggcagaaagca

SEQ ID NO: 669488 - DNA, 20 bp, mouse
ggaatccgctcggagcgcag

SEQ ID NO: 669489 - DNA, 20 bp, mouse
gaaagcatagctctcagcag

SEQ ID NO: 669490 - DNA, 20 bp, mouse
ggcgtaacgcccctcggcgc

SEQ ID NO: 669491 - DNA, 20 bp, mouse
gggaattggtctcacttaaa

SEQ ID NO: 669492 - DNA, 20 bp, mouse
gctagtgatggggacgaggt

SEQ ID NO: 669493 - DNA, 20 bp, mouse
gtgctcaaagtaccatctgt

SEQ ID NO: 669494 - DNA, 20 bp, mouse
gagaaagcacggctgatcgc

SEQ ID NO: 669495 - DNA, 20 bp, mouse
gtcagcagtggtggtctgga

SEQ ID NO: 669496 - DNA, 20 bp, mouse
gggtgcgcgcaaggtactgt

SEQ ID NO: 669497 - DNA, 20 bp, mouse
gggagccaactcacgatgta

SEQ ID NO: 669498 - DNA, 20 bp, mouse
gggctcctgccaacgacgcg

SEQ ID NO: 669499 - DNA, 20 bp, mouse
gcgcgcaaggtactgtgggg

SEQ ID NO: 669500 - DNA, 20 bp, mouse
gccgcccagcctcgcgtcgt

SEQ ID NO: 669501 - DNA, 20 bp, mouse
gcacgatgtaaggacacttc

SEQ ID NO: 669502 - DNA, 20 bp, mouse
gagagcgaaggtgcagcggg

SEQ ID NO: 669503 - DNA, 20 bp, mouse
gcagcgggaggcacggtttc

SEQ ID NO: 669504 - DNA, 20 bp, mouse
gcatctctcggagacacccc

SEQ ID NO: 669505 - DNA, 20 bp, mouse
gtagcgtctggtaacgtcct

SEQ ID NO: 669506 - DNA, 20 bp, mouse
ggggaagcgccaagtatcgc

SEQ ID NO: 669507 - DNA, 20 bp, mouse
gaggcggaggctagcgaagg

SEQ ID NO: 669508 - DNA, 20 bp, mouse
ggggcgaccgggtaggggaa

SEQ ID NO: 669509 - DNA, 20 bp, mouse
gggcctgcgtagtcctcccg

SEQ ID NO: 669510 - DNA, 20 bp, mouse
gcaggcacgagggacaaagg

SEQ ID NO: 669511 - DNA, 20 bp, mouse
gtgtgagtgagtctgggcga

SEQ ID NO: 669512 - DNA, 20 bp, mouse
gcgccctcctacatgaggtg

SEQ ID NO: 669513 - DNA, 20 bp, mouse
gaaaccgaaacggcactaga

SEQ ID NO: 669514 - DNA, 20 bp, mouse
gggctcgcgggcccgaatat

SEQ ID NO: 669515 - DNA, 20 bp, mouse
gagtatcgcgagaatctaac

SEQ ID NO: 669516 - DNA, 20 bp, mouse
gagtgggtggtgcgcggcga

SEQ ID NO: 669517 - DNA, 20 bp, mouse
gccgtcccgcagggagaacg

SEQ ID NO: 669518 - DNA, 20 bp, mouse
gcccgcagggagaacgcgga

SEQ ID NO: 669519 - DNA, 20 bp, mouse
gaaacccaacgctaggtcgg

SEQ ID NO: 669520 - DNA, 20 bp, mouse
gggacggcgacgcgactggc

SEQ ID NO: 669521 - DNA, 20 bp, mouse
gcgcacgctcgtcacgttcg

SEQ ID NO: 669522 - DNA, 20 bp, mouse
gagggagaacgcggagggca

SEQ ID NO: 669523 - DNA, 20 bp, mouse
ggaggaacgcggcgagtggg

SEQ ID NO: 669524 - DNA, 20 bp, mouse
ggcggcgagtgggtggtgcg

SEQ ID NO: 669525 - DNA, 20 bp, mouse
ggtcctccgcccctccacgc

SEQ ID NO: 669526 - DNA, 20 bp, mouse
gcggccgcggccggagatgg

SEQ ID NO: 669527 - DNA, 20 bp, mouse
gcggctcttgcttacaaagg

SEQ ID NO: 669528 - DNA, 20 bp, mouse
gcgcgcgggggcgtcttacg

SEQ ID NO: 669529 - DNA, 20 bp, mouse
gcaaaggagggaaaatgcgg

SEQ ID NO: 669530 - DNA, 20 bp, mouse
gcgcagcgctcgccaggctg

SEQ ID NO: 669531 - DNA, 20 bp, mouse
ggcgacgcgcagcgctcgcc

SEQ ID NO: 669532 - DNA, 20 bp, mouse
gacaagttccccagcccgag

SEQ ID NO: 669533 - DNA, 20 bp, mouse
gggcgtcttacgtggtgccg

SEQ ID NO: 669534 - DNA, 20 bp, mouse
gggcgccaggcctccggcga

SEQ ID NO: 669535 - DNA, 20 bp, mouse
ggaggcctgggagtcggagt

SEQ ID NO: 669536 - DNA, 20 bp, mouse
gcgggtgggaagaggttcaa

SEQ ID NO: 669537 - DNA, 20 bp, mouse
gtgcccagttgtattctctc

SEQ ID NO: 669538 - DNA, 20 bp, mouse
gtgcccgagagaatacaact

SEQ ID NO: 669539 - DNA, 20 bp, mouse
gttctctgtgactcacacga

SEQ ID NO: 669540 - DNA, 20 bp, mouse
gggtaggccaataaacacta

SEQ ID NO: 669541 - DNA, 20 bp, mouse
gcagccacaagtcagttctg

SEQ ID NO: 669542 - DNA, 20 bp, mouse
gacatgagcgctagctgctg

SEQ ID NO: 669543 - DNA, 20 bp, mouse
gtgcacactcaaaaacaagg

SEQ ID NO: 669544 - DNA, 20 bp, mouse
gaccactttagccccagggt

SEQ ID NO: 669545 - DNA, 20 bp, mouse
gggctaaagtggtcatgctg

SEQ ID NO: 669546 - DNA, 20 bp, mouse
gcatgcgcacgcacacgctg

SEQ ID NO: 669547 - DNA, 20 bp, mouse
ggcgtgcccagcagggaatg

SEQ ID NO: 669548 - DNA, 20 bp, mouse
ggagccttctgcagcgggag

SEQ ID NO: 669549 - DNA, 20 bp, mouse
gccagcagggaatgtggcgt

SEQ ID NO: 669550 - DNA, 20 bp, mouse
ggcctcccgaggcaccacaa

SEQ ID NO: 669551 - DNA, 20 bp, mouse
gcgcacgcacacgctggggg

SEQ ID NO: 669552 - DNA, 20 bp, mouse
gccgctgcagaaggctcttt

SEQ ID NO: 669553 - DNA, 20 bp, mouse
gttccctgctgggcacgcaa

SEQ ID NO: 669554 - DNA, 20 bp, mouse
gcggccattgcgtgcccagc

SEQ ID NO: 669555 - DNA, 20 bp, mouse
gtggccctggaacggcgcca

SEQ ID NO: 669556 - DNA, 20 bp, mouse
ggaaacgatccaaccagcgg

SEQ ID NO: 669557 - DNA, 20 bp, mouse
gtgccccaggcgagccgtgc

SEQ ID NO: 669558 - DNA, 20 bp, mouse
ggcgacggcggcatgcgggg

SEQ ID NO: 669559 - DNA, 20 bp, mouse
gggcggcggagaaaagcgac

SEQ ID NO: 669560 - DNA, 20 bp, mouse
ggcagcgcgacccctgccgg

SEQ ID NO: 669561 - DNA, 20 bp, mouse
gccaggcgagccgtgcaggc

SEQ ID NO: 669562 - DNA, 20 bp, mouse
gggggtggggcttatgactg

SEQ ID NO: 669563 - DNA, 20 bp, mouse
gtatgactggggcgtggtct

SEQ ID NO: 669564 - DNA, 20 bp, mouse
gtccccggagcgagcgagag

SEQ ID NO: 669565 - DNA, 20 bp, mouse
ggacgcctccgcctgttccc

SEQ ID NO: 669566 - DNA, 20 bp, mouse
gtcaccctgtacttagttta

SEQ ID NO: 669567 - DNA, 20 bp, mouse
gtggccctaaactaagtaca

SEQ ID NO: 669568 - DNA, 20 bp, mouse
ggggccggtccggacaaagg

SEQ ID NO: 669569 - DNA, 20 bp, mouse
gaattggcactcagcaggtt

SEQ ID NO: 669570 - DNA, 20 bp, mouse
gagcctggaccacaccggac

SEQ ID NO: 669571 - DNA, 20 bp, mouse
gagggattggcagtgactgt

SEQ ID NO: 669572 - DNA, 20 bp, mouse
gagttcccagagtgggagaa

SEQ ID NO: 669573 - DNA, 20 bp, mouse
gcggtgtggtccaggctaaa

SEQ ID NO: 669574 - DNA, 20 bp, mouse
gaggccttagttcccagagt

SEQ ID NO: 669575 - DNA, 20 bp, mouse
gaaagagaggagaataggcg

SEQ ID NO: 669576 - DNA, 20 bp, mouse
gcgcaggcgtacatgccttg

SEQ ID NO: 669577 - DNA, 20 bp, mouse
gccaaggtcgcgagccattc

SEQ ID NO: 669578 - DNA, 20 bp, mouse
gcaaaaggccccaggaactc

SEQ ID NO: 669579 - DNA, 20 bp, mouse
gtgtgctacctcctcgggag

SEQ ID NO: 669580 - DNA, 20 bp, mouse
gaacagcagtcgcgcgctga

SEQ ID NO: 669581 - DNA, 20 bp, mouse
ggcgtggcccaaaaggcccc

SEQ ID NO: 669582 - DNA, 20 bp, mouse
gtacatgccttgtggaggcg

SEQ ID NO: 669583 - DNA, 20 bp, mouse
gcccggccctgactgtcatt

SEQ ID NO: 669584 - DNA, 20 bp, mouse
gtcagcaagggactcctcgg

SEQ ID NO: 669585 - DNA, 20 bp, mouse
ggtgagttgtgctacctcct

SEQ ID NO: 669586 - DNA, 20 bp, mouse
ggagcctaaaccaggaactg

SEQ ID NO: 669587 - DNA, 20 bp, mouse
ggggcggggccagggaaacg

SEQ ID NO: 669588 - DNA, 20 bp, mouse
gtgacgtgaaccaatcggaa

SEQ ID NO: 669589 - DNA, 20 bp, mouse
gggcctgcggagcctaaacc

SEQ ID NO: 669590 - DNA, 20 bp, mouse
gaggctccgcaggccggaac

SEQ ID NO: 669591 - DNA, 20 bp, mouse
gcatcgcgctcccgcctcag

SEQ ID NO: 669592 - DNA, 20 bp, mouse
gggaaggaggggcggggtct

SEQ ID NO: 669593 - DNA, 20 bp, mouse
ggaaccaatcggaagggcgg

SEQ ID NO: 669594 - DNA, 20 bp, mouse
gcgattggttcacgtcacga

SEQ ID NO: 669595 - DNA, 20 bp, mouse
ggcggctcgcccgcccaggg

SEQ ID NO: 669596 - DNA, 20 bp, mouse
ggaggcctaaatgtagagag

SEQ ID NO: 669597 - DNA, 20 bp, mouse
gcgcccagaggcggagcctc

SEQ ID NO: 669598 - DNA, 20 bp, mouse
ggcagggctacgcatgtaaa

SEQ ID NO: 669599 - DNA, 20 bp, mouse
gggagcctctggtagggagg

SEQ ID NO: 669600 - DNA, 20 bp, mouse
gaaccagcaagagtatcagg

SEQ ID NO: 669601 - DNA, 20 bp, mouse
gctaccagaggctccgcctc

SEQ ID NO: 669602 - DNA, 20 bp, mouse
gacaagaaacgctggtgcgt

SEQ ID NO: 669603 - DNA, 20 bp, mouse
gagcaagagtatcaggtggc

SEQ ID NO: 669604 - DNA, 20 bp, mouse
gcggaaaggtgctgcctaga

SEQ ID NO: 669605 - DNA, 20 bp, mouse
gagatccacctccctaccag

SEQ ID NO: 669606 - DNA, 20 bp, mouse
gctgggatagagccagacgt

SEQ ID NO: 669607 - DNA, 20 bp, mouse
gcctcccgcgcgccgctcat

SEQ ID NO: 669608 - DNA, 20 bp, mouse
gggagaaaatggtggcgatt

SEQ ID NO: 669609 - DNA, 20 bp, mouse
ggcagggatggaaaattacc

SEQ ID NO: 669610 - DNA, 20 bp, mouse
gtaagaaaagaggaaggcgc

SEQ ID NO: 669611 - DNA, 20 bp, mouse
ggaaggcgcgggccaatgag

SEQ ID NO: 669612 - DNA, 20 bp, mouse
gtcagtctcaaaggcgtctt

SEQ ID NO: 669613 - DNA, 20 bp, mouse
ggggccaatgagcggcgcgc

SEQ ID NO: 669614 - DNA, 20 bp, mouse
gtcagtgtctcttgactgtg

SEQ ID NO: 669615 - DNA, 20 bp, mouse
gcattccagatgcccacgtc

SEQ ID NO: 669616 - DNA, 20 bp, mouse
ggcctggccggcagtggcag

SEQ ID NO: 669617 - DNA, 20 bp, mouse
ggggggggggggctctcggg

SEQ ID NO: 669618 - DNA, 20 bp, mouse
gctcgggcgggggaaggcgg

SEQ ID NO: 669619 - DNA, 20 bp, mouse
gaaagagcggcctgggcctg

SEQ ID NO: 669620 - DNA, 20 bp, mouse
gggcgtgagagatgatgaca

SEQ ID NO: 669621 - DNA, 20 bp, mouse
gtcactgagttgccaagctg

SEQ ID NO: 669622 - DNA, 20 bp, mouse
gctagggagaccagagacgt

SEQ ID NO: 669623 - DNA, 20 bp, mouse
gggaaggccgccagctcccc

SEQ ID NO: 669624 - DNA, 20 bp, mouse
gccagggcgccccaagtggc

SEQ ID NO: 669625 - DNA, 20 bp, mouse
ggcggccttcccgccacttg

SEQ ID NO: 669626 - DNA, 20 bp, mouse
gcacctgtctgccccggatt

SEQ ID NO: 669627 - DNA, 20 bp, mouse
ggtcactcgagcctcctcat

SEQ ID NO: 669628 - DNA, 20 bp, mouse
ggacaggtgcgaggtccgga

SEQ ID NO: 669629 - DNA, 20 bp, mouse
gactgtcaccgcccaatccg

SEQ ID NO: 669630 - DNA, 20 bp, mouse
gaggtgcgaggtccggaagg

SEQ ID NO: 669631 - DNA, 20 bp, mouse
ggccccgaactcgccaattg

SEQ ID NO: 669632 - DNA, 20 bp, mouse
gtgcgaggtccggaaggtgg

SEQ ID NO: 669633 - DNA, 20 bp, mouse
ggggcgcaaccgctgccgat

SEQ ID NO: 669634 - DNA, 20 bp, mouse
ggggcaagattcagccaatg

SEQ ID NO: 669635 - DNA, 20 bp, mouse
gccgaactcgccaattgagg

SEQ ID NO: 669636 - DNA, 20 bp, mouse
gcaaagtcaaggggtcacgt

SEQ ID NO: 669637 - DNA, 20 bp, mouse
ggggatagcaacaggtcacg

SEQ ID NO: 669638 - DNA, 20 bp, mouse
gcaacccgggctgctttgat

SEQ ID NO: 669639 - DNA, 20 bp, mouse
gcttcccagcgcaaagtcaa

SEQ ID NO: 669640 - DNA, 20 bp, mouse
gcgggttgcccactgcgcaa

SEQ ID NO: 669641 - DNA, 20 bp, mouse
gacgctgtgtggcacgtgac

SEQ ID NO: 669642 - DNA, 20 bp, mouse
ggggcgggcgccggacgttc

SEQ ID NO: 669643 - DNA, 20 bp, mouse
gcgggctgctttgatgggag

SEQ ID NO: 669644 - DNA, 20 bp, mouse
gcccctcggcagtcagggta

SEQ ID NO: 669645 - DNA, 20 bp, mouse
ggaagggggcggggccctga

SEQ ID NO: 669646 - DNA, 20 bp, mouse
gccgacacgcgatgcttcct

SEQ ID NO: 669647 - DNA, 20 bp, mouse
gtctgcagcgatcaactcca

SEQ ID NO: 669648 - DNA, 20 bp, mouse
ggtgtcgggcgtctccgcca

SEQ ID NO: 669649 - DNA, 20 bp, mouse
gggaacgcgtagtcccggag

SEQ ID NO: 669650 - DNA, 20 bp, mouse
gaacaagagcggggcacact

SEQ ID NO: 669651 - DNA, 20 bp, mouse
gcgcgatggaaacgagtccc

SEQ ID NO: 669652 - DNA, 20 bp, mouse
gtcctgggagttgaagttta

SEQ ID NO: 669653 - DNA, 20 bp, mouse
gttaaggtttgcctccgcga

SEQ ID NO: 669654 - DNA, 20 bp, mouse
gcgtctccgccaaggcgcgg

SEQ ID NO: 669655 - DNA, 20 bp, mouse
gctccgccacaggcattctt

SEQ ID NO: 669656 - DNA, 20 bp, mouse
gacctggcggcgagaccgag

SEQ ID NO: 669657 - DNA, 20 bp, mouse
gcgtgcgccgctcgcgctga

SEQ ID NO: 669658 - DNA, 20 bp, mouse
ggccttgcaagccgcctctc

SEQ ID NO: 669659 - DNA, 20 bp, mouse
ggacgcgagtggcggcgacc

SEQ ID NO: 669660 - DNA, 20 bp, mouse
gcgctgagggacgcgagtgg

SEQ ID NO: 669661 - DNA, 20 bp, mouse
gtcgcgctgagggacgcgag

SEQ ID NO: 669662 - DNA, 20 bp, mouse
ggcacggtggcgcctctagt

SEQ ID NO: 669663 - DNA, 20 bp, mouse
gccgcgccgtgtcccgtaat

SEQ ID NO: 669664 - DNA, 20 bp, mouse
gtggcccgggcgctggagaa

SEQ ID NO: 669665 - DNA, 20 bp, mouse
gagcccggcctcgtgagctc

SEQ ID NO: 669666 - DNA, 20 bp, mouse
gagggactgaagactccagg

SEQ ID NO: 669667 - DNA, 20 bp, mouse
ggactgaagactccaggcgg

SEQ ID NO: 669668 - DNA, 20 bp, mouse
gctccaggcggtgggtaagg

SEQ ID NO: 669669 - DNA, 20 bp, mouse
gccccctttgggaaaaggta

SEQ ID NO: 669670 - DNA, 20 bp, mouse
ggcgaaagaaggggcccaag

SEQ ID NO: 669671 - DNA, 20 bp, mouse
gtgagcagggggttgaagtg

SEQ ID NO: 669672 - DNA, 20 bp, mouse
gggcagctcctctaaccaat

SEQ ID NO: 669673 - DNA, 20 bp, mouse
gggcgcggcgtggcgaaaga

SEQ ID NO: 669674 - DNA, 20 bp, mouse
gcattcagacccatggtctt

SEQ ID NO: 669675 - DNA, 20 bp, mouse
gagcaagcggacatccagat

SEQ ID NO: 669676 - DNA, 20 bp, mouse
gttcgcccgcggtgttctaa

SEQ ID NO: 669677 - DNA, 20 bp, mouse
gagcggaggactcctgagaa

SEQ ID NO: 669678 - DNA, 20 bp, mouse
gccgcgggcgaaagtcacgg

SEQ ID NO: 669679 - DNA, 20 bp, mouse
gacgcctaggcgcgcagcgg

SEQ ID NO: 669680 - DNA, 20 bp, mouse
ggtaaagcttaaaaccaggt

SEQ ID NO: 669681 - DNA, 20 bp, mouse
gacaccgcgggcgaaagtca

SEQ ID NO: 669682 - DNA, 20 bp, mouse
gtaatggtagtgtttcctgc

SEQ ID NO: 669683 - DNA, 20 bp, mouse
gaaagaagtagtaggtctca

SEQ ID NO: 669684 - DNA, 20 bp, mouse
gtgcacgcctaggcgcgcag

SEQ ID NO: 669685 - DNA, 20 bp, mouse
gaagcttaaaaccaggtagg

SEQ ID NO: 669686 - DNA, 20 bp, mouse
gtttattcttacatctttat

SEQ ID NO: 669687 - DNA, 20 bp, mouse
gagtgatgcgccctaggcaa

SEQ ID NO: 669688 - DNA, 20 bp, mouse
gagagaacaaccattgccta

SEQ ID NO: 669689 - DNA, 20 bp, mouse
ggttctctttaaaatagaag

SEQ ID NO: 669690 - DNA, 20 bp, mouse
ggacatcctgtgttctaagt

SEQ ID NO: 669691 - DNA, 20 bp, mouse
ggaacgcgacgaataacaat

SEQ ID NO: 669692 - DNA, 20 bp, mouse
gactgcgaatcaaggttata

SEQ ID NO: 669693 - DNA, 20 bp, mouse
gtaaccttgattcgcagttc

SEQ ID NO: 669694 - DNA, 20 bp, mouse
ggaaccagaactgcgaatca

SEQ ID NO: 669695 - DNA, 20 bp, mouse
ggtttaccaacttagaacac

SEQ ID NO: 669696 - DNA, 20 bp, mouse
gcactccagcgtgcaacact

SEQ ID NO: 669697 - DNA, 20 bp, mouse
gtgccctcacccacgaaaca

SEQ ID NO: 669698 - DNA, 20 bp, mouse
gtggacgccatcttaactca

SEQ ID NO: 669699 - DNA, 20 bp, mouse
gaagcggtagccatgtttcg

SEQ ID NO: 669700 - DNA, 20 bp, mouse
gaaacaaggcggggtcaccc

SEQ ID NO: 669701 - DNA, 20 bp, mouse
ggggcaagaagagctttgcc

SEQ ID NO: 669702 - DNA, 20 bp, mouse
gccctgcaacgacccgaaac

SEQ ID NO: 669703 - DNA, 20 bp, mouse
gttctcctagtgttgcacgc

SEQ ID NO: 669704 - DNA, 20 bp, mouse
ggactccaaaatcgctcctt

SEQ ID NO: 669705 - DNA, 20 bp, mouse
gggcattcgggccgaagcca

SEQ ID NO: 669706 - DNA, 20 bp, mouse
gcccgcctctcgccttccat

SEQ ID NO: 669707 - DNA, 20 bp, mouse
gctccggccgggtgatctcc

SEQ ID NO: 669708 - DNA, 20 bp, mouse
gacagccaatggaaggcgag

SEQ ID NO: 669709 - DNA, 20 bp, mouse
gggccgggtgatctccagga

SEQ ID NO: 669710 - DNA, 20 bp, mouse
ggcggagcgtggtcttggat

SEQ ID NO: 669711 - DNA, 20 bp, mouse
ggagaatagctgacagccaa

SEQ ID NO: 669712 - DNA, 20 bp, mouse
gggcacccaagagccgtttt

SEQ ID NO: 669713 - DNA, 20 bp, mouse
gcagaacatcgtgatgggcg

SEQ ID NO: 669714 - DNA, 20 bp, mouse
gcccatcacgatgttctgat

SEQ ID NO: 669715 - DNA, 20 bp, mouse
gcaagtgtaacatcccttcc

SEQ ID NO: 669716 - DNA, 20 bp, mouse
gcagcggagaacaataatat

SEQ ID NO: 669717 - DNA, 20 bp, mouse
gccgttctgcggccccacgt

SEQ ID NO: 669718 - DNA, 20 bp, mouse
ggcctggtcgtgcagggtat

SEQ ID NO: 669719 - DNA, 20 bp, mouse
ggagccccaaccccgttctg

SEQ ID NO: 669720 - DNA, 20 bp, mouse
ggctcgtgcagtcttcacga

SEQ ID NO: 669721 - DNA, 20 bp, mouse
ggggaggtcctccgaatcgg

SEQ ID NO: 669722 - DNA, 20 bp, mouse
gctcctccctctactcgcac

SEQ ID NO: 669723 - DNA, 20 bp, mouse
gtgcagtcttcacgaaggag

SEQ ID NO: 669724 - DNA, 20 bp, mouse
ggcggcgcggcgactcggct

SEQ ID NO: 669725 - DNA, 20 bp, mouse
ggtgggagagcgaggggtcc

SEQ ID NO: 669726 - DNA, 20 bp, mouse
gtgcacgtggcagcggggaa

SEQ ID NO: 669727 - DNA, 20 bp, mouse
gcggggaagggcagggttcg

SEQ ID NO: 669728 - DNA, 20 bp, mouse
ggccacgtgcacacagtacc

SEQ ID NO: 669729 - DNA, 20 bp, mouse
ggtgggcggggccagtccta

SEQ ID NO: 669730 - DNA, 20 bp, mouse
gcccgcccacagcggaagta

SEQ ID NO: 669731 - DNA, 20 bp, mouse
gtacccgattggaggaagtg

SEQ ID NO: 669732 - DNA, 20 bp, mouse
gaaccctggcctatcatctt

SEQ ID NO: 669733 - DNA, 20 bp, mouse
gggcccaactcagcttccgt

SEQ ID NO: 669734 - DNA, 20 bp, mouse
gtactgtgtgcacgtggcag

SEQ ID NO: 669735 - DNA, 20 bp, mouse
gccacagcggaagtatgggc

SEQ ID NO: 669736 - DNA, 20 bp, mouse
gctgacgccggcaggcgaaa

SEQ ID NO: 669737 - DNA, 20 bp, mouse
gccggagtcgctcacaggtg

SEQ ID NO: 669738 - DNA, 20 bp, mouse
gctgccggcgtcagaagaga

SEQ ID NO: 669739 - DNA, 20 bp, mouse
gtcgctcacaggtggggcgg

SEQ ID NO: 669740 - DNA, 20 bp, mouse
ggtggggcggaggcagcgcg

SEQ ID NO: 669741 - DNA, 20 bp, mouse
gagtgcggccagaaactcca

SEQ ID NO: 669742 - DNA, 20 bp, mouse
gcaaggctcaagtgcacggg

SEQ ID NO: 669743 - DNA, 20 bp, mouse
gcagctccggagtcgctcac

SEQ ID NO: 669744 - DNA, 20 bp, mouse
gcagccgtctcttctgacgc

SEQ ID NO: 669745 - DNA, 20 bp, mouse
ggcgactgggttagtccacg

SEQ ID NO: 669746 - DNA, 20 bp, mouse
ggggccgccaacagcgctgg

SEQ ID NO: 669747 - DNA, 20 bp, mouse
gccgccgccagcgctgttgg

SEQ ID NO: 669748 - DNA, 20 bp, mouse
gagggggcgcgttataaagg

SEQ ID NO: 669749 - DNA, 20 bp, mouse
ggggacttgtagttcccggg

SEQ ID NO: 669750 - DNA, 20 bp, mouse
gtcggggccgccaacagcgc

SEQ ID NO: 669751 - DNA, 20 bp, mouse
gcggcccgaaagcccgggag

SEQ ID NO: 669752 - DNA, 20 bp, mouse
ggcaggaagccgtggcgctg

SEQ ID NO: 669753 - DNA, 20 bp, mouse
gacggcccgggccaatgcag

SEQ ID NO: 669754 - DNA, 20 bp, mouse
ggcggcaggtgcggctgcga

SEQ ID NO: 669755 - DNA, 20 bp, mouse
ggcggtgcgtcccgctgcat

SEQ ID NO: 669756 - DNA, 20 bp, mouse
gtaagctaacataatgaggt

SEQ ID NO: 669757 - DNA, 20 bp, mouse
gctgtgcaggacaagttata

SEQ ID NO: 669758 - DNA, 20 bp, mouse
gccgcgacggtagaccggag

SEQ ID NO: 669759 - DNA, 20 bp, mouse
gactccggaggtaattattc

SEQ ID NO: 669760 - DNA, 20 bp, mouse
gttgataagctaacataatg

SEQ ID NO: 669761 - DNA, 20 bp, mouse
gtactcattattcacaaaaa

SEQ ID NO: 669762 - DNA, 20 bp, mouse
gatgctccgcgacggtagac

SEQ ID NO: 669763 - DNA, 20 bp, mouse
gtgcacagtcactcattata

SEQ ID NO: 669764 - DNA, 20 bp, mouse
ggttaatctcttaactgtgc

SEQ ID NO: 669765 - DNA, 20 bp, mouse
gttaccagaataattacctc

SEQ ID NO: 669766 - DNA, 20 bp, mouse
gcctagcataggggatggaa

SEQ ID NO: 669767 - DNA, 20 bp, mouse
gccaaggagtggacgtaata

SEQ ID NO: 669768 - DNA, 20 bp, mouse
gcccgcgctgcaggtccaga

SEQ ID NO: 669769 - DNA, 20 bp, mouse
ggacctgcagcgcggggtca

SEQ ID NO: 669770 - DNA, 20 bp, mouse
ggctgtcctccggggttcac

SEQ ID NO: 669771 - DNA, 20 bp, mouse
gtacccgcagccacttggcc

SEQ ID NO: 669772 - DNA, 20 bp, mouse
gcctcgcctgtgaaccccgg

SEQ ID NO: 669773 - DNA, 20 bp, mouse
gtagcagcctgctcgggcta

SEQ ID NO: 669774 - DNA, 20 bp, mouse
gcggccccgcccaaccggcg

SEQ ID NO: 669775 - DNA, 20 bp, mouse
gaggcgaggaacggacacca

SEQ ID NO: 669776 - DNA, 20 bp, mouse
gcggctgggcggaacctccc

SEQ ID NO: 669777 - DNA, 20 bp, mouse
gggaccgcaggttgccccag

SEQ ID NO: 669778 - DNA, 20 bp, mouse
ggagcctccctgatcctgat

SEQ ID NO: 669779 - DNA, 20 bp, mouse
gtgacggttcgctgggactg

SEQ ID NO: 669780 - DNA, 20 bp, mouse
gtgtcgtcaggcgttgtgat

SEQ ID NO: 669781 - DNA, 20 bp, mouse
ggcgccgcgggcgggcaagc

SEQ ID NO: 669782 - DNA, 20 bp, mouse
gtgcggtcccctgagagcag

SEQ ID NO: 669783 - DNA, 20 bp, mouse
ggggcggaacctccccgggt

SEQ ID NO: 669784 - DNA, 20 bp, mouse
gccaccctagctgcaagggg

SEQ ID NO: 669785 - DNA, 20 bp, mouse
gcctggtagggaaagatttg

SEQ ID NO: 669786 - DNA, 20 bp, mouse
gggcccgcgtgcttgcaggt

SEQ ID NO: 669787 - DNA, 20 bp, mouse
gaagggaaagtgacacgaag

SEQ ID NO: 669788 - DNA, 20 bp, mouse
gtgccccgagccggcaaggt

SEQ ID NO: 669789 - DNA, 20 bp, mouse
ggaagcggaagatagaccca

SEQ ID NO: 669790 - DNA, 20 bp, mouse
ggaagggggagggacgtagg

SEQ ID NO: 669791 - DNA, 20 bp, mouse
gtagaaccgggcacaagtaa

SEQ ID NO: 669792 - DNA, 20 bp, mouse
gaggaggcccgcgtgcttgc

SEQ ID NO: 669793 - DNA, 20 bp, mouse
gcccccacctgcaagcacgc

SEQ ID NO: 669794 - DNA, 20 bp, mouse
gcagccggacgccctggcaa

SEQ ID NO: 669795 - DNA, 20 bp, mouse
gaagggaccagtaaccaccc

SEQ ID NO: 669796 - DNA, 20 bp, mouse
gggcacgtctccaccgaata

SEQ ID NO: 669797 - DNA, 20 bp, mouse
gttggctgaagccatgtacc

SEQ ID NO: 669798 - DNA, 20 bp, mouse
gtaccgtgaacttaccgtgc

SEQ ID NO: 669799 - DNA, 20 bp, mouse
ggggagatgaagactgaaaa

SEQ ID NO: 669800 - DNA, 20 bp, mouse
ggcagctcgggcagcctaaa

SEQ ID NO: 669801 - DNA, 20 bp, mouse
gaactctttggtggggaagt

SEQ ID NO: 669802 - DNA, 20 bp, mouse
gctcgggcagcctaaagggg

SEQ ID NO: 669803 - DNA, 20 bp, mouse
gaggctgtagcctccccttt

SEQ ID NO: 669804 - DNA, 20 bp, mouse
gggttcttgctggtcgaggg

SEQ ID NO: 669805 - DNA, 20 bp, mouse
gcgagggtggatgcgacaaa

SEQ ID NO: 669806 - DNA, 20 bp, mouse
ggggctaaggcgggacctag

SEQ ID NO: 669807 - DNA, 20 bp, mouse
ggggccaaatgggcagacgg

SEQ ID NO: 669808 - DNA, 20 bp, mouse
gagcgcgttcgtgtagtaga

SEQ ID NO: 669809 - DNA, 20 bp, mouse
gactcgagaacgagcggcgt

SEQ ID NO: 669810 - DNA, 20 bp, mouse
gagaacgagcggcgtgggcg

SEQ ID NO: 669811 - DNA, 20 bp, mouse
ggcggtgcgatcatcaaatt

SEQ ID NO: 669812 - DNA, 20 bp, mouse
gcgctcgcgatgctcctcct

SEQ ID NO: 669813 - DNA, 20 bp, mouse
gttggtaggcggggctaagg

SEQ ID NO: 669814 - DNA, 20 bp, mouse
gcgggacctagcggaatgag

SEQ ID NO: 669815 - DNA, 20 bp, mouse
gtctgcccatttggcccaat

SEQ ID NO: 669816 - DNA, 20 bp, mouse
gggttctagctgtctggcgc

SEQ ID NO: 669817 - DNA, 20 bp, mouse
ggagtccccgggatcggtga

SEQ ID NO: 669818 - DNA, 20 bp, mouse
gctggcccgccctcccctct

SEQ ID NO: 669819 - DNA, 20 bp, mouse
gagaaccggcgcgcgttaag

SEQ ID NO: 669820 - DNA, 20 bp, mouse
gcgtgacaagagaatagccc

SEQ ID NO: 669821 - DNA, 20 bp, mouse
ggcgggcttagattcccaga

SEQ ID NO: 669822 - DNA, 20 bp, mouse
gcccgggatcggtgaaggag

SEQ ID NO: 669823 - DNA, 20 bp, mouse
gcaagagaatagcccaggtg

SEQ ID NO: 669824 - DNA, 20 bp, mouse
gaccgatcccggggactcgc

SEQ ID NO: 669825 - DNA, 20 bp, mouse
gctgggccgacgctataagg

SEQ ID NO: 669826 - DNA, 20 bp, mouse
gtcctggcggcgctacgggg

SEQ ID NO: 669827 - DNA, 20 bp, mouse
gtggtcgcgtgactactcgg

SEQ ID NO: 669828 - DNA, 20 bp, mouse
gactgccaacaaacctgctc

SEQ ID NO: 669829 - DNA, 20 bp, mouse
gcgtagcgccgccaggacat

SEQ ID NO: 669830 - DNA, 20 bp, mouse
gggcgagcgcgctcttaagg

SEQ ID NO: 669831 - DNA, 20 bp, mouse
gggctggtcgcgtgactact

SEQ ID NO: 669832 - DNA, 20 bp, mouse
gccaaacggccggagagctg

SEQ ID NO: 669833 - DNA, 20 bp, mouse
ggcgccgggacctagatccc

SEQ ID NO: 669834 - DNA, 20 bp, mouse
gctcccggcgccgagaccaa

SEQ ID NO: 669835 - DNA, 20 bp, mouse
ggctggcgagcgcgctctta

SEQ ID NO: 669836 - DNA, 20 bp, mouse
ggcccccgcgccacgctcat

SEQ ID NO: 669837 - DNA, 20 bp, mouse
gcagccaatgagcgtggcgc

SEQ ID NO: 669838 - DNA, 20 bp, mouse
ggccgggcggggcgggtgac

SEQ ID NO: 669839 - DNA, 20 bp, mouse
ggctgcgcgcacacaccccc

SEQ ID NO: 669840 - DNA, 20 bp, mouse
gggcggggcgggtgacgggc

SEQ ID NO: 669841 - DNA, 20 bp, mouse
gagggcctctgtgggcgggg

SEQ ID NO: 669842 - DNA, 20 bp, mouse
gcgcacacacccccggggcc

SEQ ID NO: 669843 - DNA, 20 bp, mouse
gagcgggctgcgcgggacaa

SEQ ID NO: 669844 - DNA, 20 bp, mouse
gacgggcgggcgctgattgg

SEQ ID NO: 669845 - DNA, 20 bp, mouse
gggggccagcgcgtataaag

SEQ ID NO: 669846 - DNA, 20 bp, mouse
gcccgcgcgcgcctccccct

SEQ ID NO: 669847 - DNA, 20 bp, mouse
ggcgcgggaaagcttcccag

SEQ ID NO: 669848 - DNA, 20 bp, mouse
gcctccccctgggcgcctct

SEQ ID NO: 669849 - DNA, 20 bp, mouse
gcgcgcctgagggcggagat

SEQ ID NO: 669850 - DNA, 20 bp, mouse
ggcgctggctgtcaccgcga

SEQ ID NO: 669851 - DNA, 20 bp, mouse
ggggtggcgagcgaagcgag

SEQ ID NO: 669852 - DNA, 20 bp, mouse
ggcgggccctgccgcatccg

SEQ ID NO: 669853 - DNA, 20 bp, mouse
ggcgcggtccccagtcgcgc

SEQ ID NO: 669854 - DNA, 20 bp, mouse
gcgcgcgccttgggactcgg

SEQ ID NO: 669855 - DNA, 20 bp, mouse
gactggggaccgcgcgcctt

SEQ ID NO: 669856 - DNA, 20 bp, mouse
gtggctccacagcccgccat

SEQ ID NO: 669857 - DNA, 20 bp, mouse
ggacccactggtcacacgac

SEQ ID NO: 669858 - DNA, 20 bp, mouse
gccccccacaccatcctcag

SEQ ID NO: 669859 - DNA, 20 bp, mouse
gctccacagcccgccatagg

SEQ ID NO: 669860 - DNA, 20 bp, mouse
gaaggagcccagcgtgtcaa

SEQ ID NO: 669861 - DNA, 20 bp, mouse
ggttccccccacctccggat

SEQ ID NO: 669862 - DNA, 20 bp, mouse
ggaaggaaggagggacccac

SEQ ID NO: 669863 - DNA, 20 bp, mouse
gccctcccccatccggaggt

SEQ ID NO: 669864 - DNA, 20 bp, mouse
gcaaatagcgccacctatgg

SEQ ID NO: 669865 - DNA, 20 bp, mouse
gtgaaacagcgctaaaggat

SEQ ID NO: 669866 - DNA, 20 bp, mouse
ggcggcggcgaggttataaa

SEQ ID NO: 669867 - DNA, 20 bp, mouse
gactcgctcggcggtcgcgc

SEQ ID NO: 669868 - DNA, 20 bp, mouse
gggggccgaggcgacttcag

SEQ ID NO: 669869 - DNA, 20 bp, mouse
gcgaccgccgagcgagtcgc

SEQ ID NO: 669870 - DNA, 20 bp, mouse
gtcgccagcgactcgctcgg

SEQ ID NO: 669871 - DNA, 20 bp, mouse
gcgccctcggcgcctagggg

SEQ ID NO: 669872 - DNA, 20 bp, mouse
ggcgcggcgtcacaaagcgc

SEQ ID NO: 669873 - DNA, 20 bp, mouse
gggccgcccctaggcgccga

SEQ ID NO: 669874 - DNA, 20 bp, mouse
gcgccccagcggccgcccct

SEQ ID NO: 669875 - DNA, 20 bp, mouse
gtgcgaccgcgagcgtccga

SEQ ID NO: 669876 - DNA, 20 bp, mouse
ggggcgtgtcgggaaagcgg

SEQ ID NO: 669877 - DNA, 20 bp, mouse
gaggcccgccagcatagagc

SEQ ID NO: 669878 - DNA, 20 bp, mouse
ggaacgacccagggcaaaaa

SEQ ID NO: 669879 - DNA, 20 bp, mouse
gggcactgcagagtcccaat

SEQ ID NO: 669880 - DNA, 20 bp, mouse
gcgcacggctagagcgacca

SEQ ID NO: 669881 - DNA, 20 bp, mouse
gctagagcgaccacggctga

SEQ ID NO: 669882 - DNA, 20 bp, mouse
ggggacagccacagaactta

SEQ ID NO: 669883 - DNA, 20 bp, mouse
gtagtgcaacccagcgtgtg

SEQ ID NO: 669884 - DNA, 20 bp, mouse
gtatctggagcgccctcgcg

SEQ ID NO: 669885 - DNA, 20 bp, mouse
gcggctgagggcgagtgctc

SEQ ID NO: 669886 - DNA, 20 bp, mouse
gtggggtggtatctgagagt

SEQ ID NO: 669887 - DNA, 20 bp, mouse
ggaagcttaaagttctgcgc

SEQ ID NO: 669888 - DNA, 20 bp, mouse
gacgtcatgagacaaatagg

SEQ ID NO: 669889 - DNA, 20 bp, mouse
gaggggttagagagcaggcg

SEQ ID NO: 669890 - DNA, 20 bp, mouse
gatgagacaaataggcgggg

SEQ ID NO: 669891 - DNA, 20 bp, mouse
gatgacgtcaccaagtgtgg

SEQ ID NO: 669892 - DNA, 20 bp, mouse
gagagagcaggcgtggtctg

SEQ ID NO: 669893 - DNA, 20 bp, mouse
gcctagtctggaacttaccg

SEQ ID NO: 669894 - DNA, 20 bp, mouse
gaaaaatagccaaccggcca

SEQ ID NO: 669895 - DNA, 20 bp, mouse
gcaggcgtggtctgaggggg

SEQ ID NO: 669896 - DNA, 20 bp, mouse
ggaagggcgcagggccgcga

SEQ ID NO: 669897 - DNA, 20 bp, mouse
ggcccagcgcgggcagagaa

SEQ ID NO: 669898 - DNA, 20 bp, mouse
gccgcggcgccctaactcgg

SEQ ID NO: 669899 - DNA, 20 bp, mouse
gtaacggcagagttttaagg

SEQ ID NO: 669900 - DNA, 20 bp, mouse
gcaacgccctggcggcgcag

SEQ ID NO: 669901 - DNA, 20 bp, mouse
gcgggagcgccagcgaaccc

SEQ ID NO: 669902 - DNA, 20 bp, mouse
gaggaggctccgccgagtta

SEQ ID NO: 669903 - DNA, 20 bp, mouse
gaccccggtggtggtaacta

SEQ ID NO: 669904 - DNA, 20 bp, mouse
gctgatgaggtcggaaaaaa

SEQ ID NO: 669905 - DNA, 20 bp, mouse
gcacgccccgcccaacgccc

SEQ ID NO: 669906 - DNA, 20 bp, mouse
gaaagtgagcccattggaga

SEQ ID NO: 669907 - DNA, 20 bp, mouse
gtactatggacgtgagatgt

SEQ ID NO: 669908 - DNA, 20 bp, mouse
gtcagcaaaagtgagcccat

SEQ ID NO: 669909 - DNA, 20 bp, mouse
gcacgtgtgaatcgaggggc

SEQ ID NO: 669910 - DNA, 20 bp, mouse
gtcgccagaatccttcttag

SEQ ID NO: 669911 - DNA, 20 bp, mouse
gtaacccctaagaaggattc

SEQ ID NO: 669912 - DNA, 20 bp, mouse
gtggaaagtgagctctgcga

SEQ ID NO: 669913 - DNA, 20 bp, mouse
ggatgctgacgtgctcggga

SEQ ID NO: 669914 - DNA, 20 bp, mouse
gcactctggactaccccctt

SEQ ID NO: 669915 - DNA, 20 bp, mouse
gagttcttgattaattacta

SEQ ID NO: 669916 - DNA, 20 bp, mouse
gctggcggccagtacagtgc

SEQ ID NO: 669917 - DNA, 20 bp, mouse
ggagacccggcccaaggggc

SEQ ID NO: 669918 - DNA, 20 bp, mouse
gggcttgcctcgcccactag

SEQ ID NO: 669919 - DNA, 20 bp, mouse
gaaaacaagggcgctctggg

SEQ ID NO: 669920 - DNA, 20 bp, mouse
gccaaggggcgggcgccgaa

SEQ ID NO: 669921 - DNA, 20 bp, mouse
gctctgagccggcactgtac

SEQ ID NO: 669922 - DNA, 20 bp, mouse
ggcgagcgctggggtcgtac

SEQ ID NO: 669923 - DNA, 20 bp, mouse
gcgcccgcgcaaggaaagga

SEQ ID NO: 669924 - DNA, 20 bp, mouse
ggcccactagcggctgactc

SEQ ID NO: 669925 - DNA, 20 bp, mouse
gagcgctggggtcgtacggg

SEQ ID NO: 669926 - DNA, 20 bp, mouse
gtgaaccaatgagtagtcag

SEQ ID NO: 669927 - DNA, 20 bp, mouse
gtcagcctctgactactcat

SEQ ID NO: 669928 - DNA, 20 bp, mouse
gggtccgcccacgtaggagg

SEQ ID NO: 669929 - DNA, 20 bp, mouse
gccctcaactggcggagggg

SEQ ID NO: 669930 - DNA, 20 bp, mouse
gtgaaagacgcgcggaagga

SEQ ID NO: 669931 - DNA, 20 bp, mouse
gccacgccctcaactggcgg

SEQ ID NO: 669932 - DNA, 20 bp, mouse
gagggcgtggacgtggcgag

SEQ ID NO: 669933 - DNA, 20 bp, mouse
gttcgcgggcggtgtcctaa

SEQ ID NO: 669934 - DNA, 20 bp, mouse
gcggaccaatggactgacgg

SEQ ID NO: 669935 - DNA, 20 bp, mouse
gcgtccacgccctcaactgg

SEQ ID NO: 669936 - DNA, 20 bp, mouse
ggggagcccggcgtaaacgc

SEQ ID NO: 669937 - DNA, 20 bp, mouse
gaacccggagacagcttccc

SEQ ID NO: 669938 - DNA, 20 bp, mouse
gatgaacggcgctcaggaga

SEQ ID NO: 669939 - DNA, 20 bp, mouse
gaacggcgctcaggagaggg

SEQ ID NO: 669940 - DNA, 20 bp, mouse
ggcagcagaccggacgcagt

SEQ ID NO: 669941 - DNA, 20 bp, mouse
ggccgggctcccaaggagcg

SEQ ID NO: 669942 - DNA, 20 bp, mouse
gtcccattggctctgatgaa

SEQ ID NO: 669943 - DNA, 20 bp, mouse
gtcctcggaacaagcccatc

SEQ ID NO: 669944 - DNA, 20 bp, mouse
gaccggacgcagtaggcggg

SEQ ID NO: 669945 - DNA, 20 bp, mouse
ggcagaccggacgcagtagg

SEQ ID NO: 669946 - DNA, 20 bp, mouse
ggcaacagtggggcttctga

SEQ ID NO: 669947 - DNA, 20 bp, mouse
gaggaggcaagggcaacagt

SEQ ID NO: 669948 - DNA, 20 bp, mouse
gcggggagagacctgaggaa

SEQ ID NO: 669949 - DNA, 20 bp, mouse
gggtggggtcggaatgagat

SEQ ID NO: 669950 - DNA, 20 bp, mouse
gtgaggcggggagagacctg

SEQ ID NO: 669951 - DNA, 20 bp, mouse
gaagggggagaaatagcccg

SEQ ID NO: 669952 - DNA, 20 bp, mouse
gtcactccaccccctgaagg

SEQ ID NO: 669953 - DNA, 20 bp, mouse
gtcaccgcaagtaggaggca

SEQ ID NO: 669954 - DNA, 20 bp, mouse
ggaggctcaccgcaagtagg

SEQ ID NO: 669955 - DNA, 20 bp, mouse
gaaaccaagcccgggaggtg

SEQ ID NO: 669956 - DNA, 20 bp, mouse
gggcgcgggccggggagtcc

SEQ ID NO: 669957 - DNA, 20 bp, mouse
gcgcccggcaccagagccga

SEQ ID NO: 669958 - DNA, 20 bp, mouse
gagacggaggcgggccgcag

SEQ ID NO: 669959 - DNA, 20 bp, mouse
gcggggagtcctggcctctg

SEQ ID NO: 669960 - DNA, 20 bp, mouse
gtgcccgccgctgatctggc

SEQ ID NO: 669961 - DNA, 20 bp, mouse
ggcaccggcggagacggagg

SEQ ID NO: 669962 - DNA, 20 bp, mouse
ggccctgcccgccgctgatc

SEQ ID NO: 669963 - DNA, 20 bp, mouse
gcagcctgccagatcagcgg

SEQ ID NO: 669964 - DNA, 20 bp, mouse
gccggggcgagcgaaggtga

SEQ ID NO: 669965 - DNA, 20 bp, mouse
gggcccgcctccgtctccgc

SEQ ID NO: 669966 - DNA, 20 bp, mouse
ggcgccatgaggcaaaccgg

SEQ ID NO: 669967 - DNA, 20 bp, mouse
gtagtgtggcggagcttcag

SEQ ID NO: 669968 - DNA, 20 bp, mouse
gcacaaatgccatggatcga

SEQ ID NO: 669969 - DNA, 20 bp, mouse
gctccgccctagctcctctg

SEQ ID NO: 669970 - DNA, 20 bp, mouse
gcttcagcgggtgatgagat

SEQ ID NO: 669971 - DNA, 20 bp, mouse
gtataagctagcagcggaaa

SEQ ID NO: 669972 - DNA, 20 bp, mouse
ggaggcaaaccgggggaaac

SEQ ID NO: 669973 - DNA, 20 bp, mouse
gcaaaagagcgtccttgccg

SEQ ID NO: 669974 - DNA, 20 bp, mouse
gccacactaccggtttcccc

SEQ ID NO: 669975 - DNA, 20 bp, mouse
ggggccacgcaggcgctctg

SEQ ID NO: 669976 - DNA, 20 bp, mouse
gtggaaggacatggatttct

SEQ ID NO: 669977 - DNA, 20 bp, mouse
gctggaagatgtggagatgt

SEQ ID NO: 669978 - DNA, 20 bp, mouse
gctgggaagactgggattta

SEQ ID NO: 669979 - DNA, 20 bp, mouse
gtgggaagtcgtggattttt

SEQ ID NO: 669980 - DNA, 20 bp, mouse
gcacgaagacatggattttt

SEQ ID NO: 669981 - DNA, 20 bp, mouse
gaagtcttccagcatctcca

SEQ ID NO: 669982 - DNA, 20 bp, mouse
gtaggaagacttggattgtt

SEQ ID NO: 669983 - DNA, 20 bp, mouse
ggagatgctggaagacttgg

SEQ ID NO: 669984 - DNA, 20 bp, mouse
ggtggaaggcgtagattttt

SEQ ID NO: 669985 - DNA, 20 bp, mouse
gttggattgttaggaggaca

SEQ ID NO: 669986 - DNA, 20 bp, mouse
gaggcggggaaagacgaaga

SEQ ID NO: 669987 - DNA, 20 bp, mouse
ggggaaagacgaagagggtg

SEQ ID NO: 669988 - DNA, 20 bp, mouse
ggacgcagacaaaagaggag

SEQ ID NO: 669989 - DNA, 20 bp, mouse
gaaaaaaggtcgcgggtccg

SEQ ID NO: 669990 - DNA, 20 bp, mouse
gggactctggagtgtgaagt

SEQ ID NO: 669991 - DNA, 20 bp, mouse
gaagacgaagagggtgcggt

SEQ ID NO: 669992 - DNA, 20 bp, mouse
gactggagtgcactcaactg

SEQ ID NO: 669993 - DNA, 20 bp, mouse
ggacgcgacgcagacaaaag

SEQ ID NO: 669994 - DNA, 20 bp, mouse
gggcccgcatccgaaaccct

SEQ ID NO: 669995 - DNA, 20 bp, mouse
gcacctccacactccggaac

SEQ ID NO: 669996 - DNA, 20 bp, mouse
gaaaagacgtatgcaaataa

SEQ ID NO: 669997 - DNA, 20 bp, mouse
ggacgtatgcaaataagggg

SEQ ID NO: 669998 - DNA, 20 bp, mouse
ggggtcagcacgttctccgc

SEQ ID NO: 669999 - DNA, 20 bp, mouse
gaaataaggggcgggaccga

SEQ ID NO: 670000 - DNA, 20 bp, mouse
gaggggcgggaccgaaggca

SEQ ID NO: 670001 - DNA, 20 bp, mouse
gtctactaacgggagttagg

SEQ ID NO: 670002 - DNA, 20 bp, mouse
gccggaccaggacaccagga

SEQ ID NO: 670003 - DNA, 20 bp, mouse
ggatggacgtaaataaaagt

SEQ ID NO: 670004 - DNA, 20 bp, mouse
ggtcctggtccgggaattgc

SEQ ID NO: 670005 - DNA, 20 bp, mouse
gcgtaaataaaagtcggacg

SEQ ID NO: 670006 - DNA, 20 bp, mouse
gtccctgaggagaagattca

SEQ ID NO: 670007 - DNA, 20 bp, mouse
gggactctctgtctaggtca

SEQ ID NO: 670008 - DNA, 20 bp, mouse
gtctctgtctaggtcaagga

SEQ ID NO: 670009 - DNA, 20 bp, mouse
gcatctgtcacggtgagtag

SEQ ID NO: 670010 - DNA, 20 bp, mouse
gggagccagactatcatgta

SEQ ID NO: 670011 - DNA, 20 bp, mouse
gtctgaagacaagtgagtcc

SEQ ID NO: 670012 - DNA, 20 bp, mouse
gcagagaatgaagaagatac

SEQ ID NO: 670013 - DNA, 20 bp, mouse
gagtctgaacaccccgaatg

SEQ ID NO: 670014 - DNA, 20 bp, mouse
gtcattaaaggtgaatgtta

SEQ ID NO: 670015 - DNA, 20 bp, mouse
gcagactatcatgtagggtg

SEQ ID NO: 670016 - DNA, 20 bp, mouse
gagctcggcggcgggaaggt

SEQ ID NO: 670017 - DNA, 20 bp, mouse
gcgctgcgggagctcggcgg

SEQ ID NO: 670018 - DNA, 20 bp, mouse
gcggtcgcgaggcgcgaggg

SEQ ID NO: 670019 - DNA, 20 bp, mouse
gcaccgcagtgcagcgcgga

SEQ ID NO: 670020 - DNA, 20 bp, mouse
gcgggagctcggcggcggga

SEQ ID NO: 670021 - DNA, 20 bp, mouse
ggcacggaaaggtacgcgaa

SEQ ID NO: 670022 - DNA, 20 bp, mouse
gagggtgtgcggaccggcgc

SEQ ID NO: 670023 - DNA, 20 bp, mouse
gtccacgcactggccccagg

SEQ ID NO: 670024 - DNA, 20 bp, mouse
gggtccgcacaccctgccgg

SEQ ID NO: 670025 - DNA, 20 bp, mouse
gagggacgagccagggacgg

SEQ ID NO: 670026 - DNA, 20 bp, mouse
gaggcggggcagcctggcgg

SEQ ID NO: 670027 - DNA, 20 bp, mouse
gcgcgagtgctgggtccaga

SEQ ID NO: 670028 - DNA, 20 bp, mouse
gtggaaccccagacgccagg

SEQ ID NO: 670029 - DNA, 20 bp, mouse
gcggagttcgagacactcat

SEQ ID NO: 670030 - DNA, 20 bp, mouse
gggacaacagcgcctcgtag

SEQ ID NO: 670031 - DNA, 20 bp, mouse
gtaggacgcaaggaccccat

SEQ ID NO: 670032 - DNA, 20 bp, mouse
gacgaggcgctgttgtcccc

SEQ ID NO: 670033 - DNA, 20 bp, mouse
gtggctcgcagcttcccggg

SEQ ID NO: 670034 - DNA, 20 bp, mouse
gaaccccagacgccaggagg

SEQ ID NO: 670035 - DNA, 20 bp, mouse
gactcgcgcgcggggacttg

SEQ ID NO: 670036 - DNA, 20 bp, mouse
gtcagcagaagaggtgactg

SEQ ID NO: 670037 - DNA, 20 bp, mouse
gtgcctgagggaagttggtg

SEQ ID NO: 670038 - DNA, 20 bp, mouse
ggaagaggtgactgcggtgc

SEQ ID NO: 670039 - DNA, 20 bp, mouse
gcaggcagggtgcttctcag

SEQ ID NO: 670040 - DNA, 20 bp, mouse
ggtcacctcttctgctgagt

SEQ ID NO: 670041 - DNA, 20 bp, mouse
gaagctggccactctcgccc

SEQ ID NO: 670042 - DNA, 20 bp, mouse
gaaccaggtgctctgccccc

SEQ ID NO: 670043 - DNA, 20 bp, mouse
gaggagaagctgaggcaatc

SEQ ID NO: 670044 - DNA, 20 bp, mouse
gaaggaaggccagctggggt

SEQ ID NO: 670045 - DNA, 20 bp, mouse
gggtaggggctagtgcccag

SEQ ID NO: 670046 - DNA, 20 bp, mouse
gccccggccgctcccattct

SEQ ID NO: 670047 - DNA, 20 bp, mouse
gccggggcatgcgcgctagt

SEQ ID NO: 670048 - DNA, 20 bp, mouse
gaccacccccgcggcagctt

SEQ ID NO: 670049 - DNA, 20 bp, mouse
gcaatccaaagctgccgcgg

SEQ ID NO: 670050 - DNA, 20 bp, mouse
ggcagcccgcggaaaccacg

SEQ ID NO: 670051 - DNA, 20 bp, mouse
gtggattgaggaccgagaat

SEQ ID NO: 670052 - DNA, 20 bp, mouse
ggagacgcatgcgccatgcc

SEQ ID NO: 670053 - DNA, 20 bp, mouse
gtgccgcgggggtggtggcc

SEQ ID NO: 670054 - DNA, 20 bp, mouse
gagaactgtgcgtggtggta

SEQ ID NO: 670055 - DNA, 20 bp, mouse
gcctcaatccaaagctgccg

SEQ ID NO: 670056 - DNA, 20 bp, mouse
gctccgtccgggcatctgat

SEQ ID NO: 670057 - DNA, 20 bp, mouse
gcagggcaccgccccgtaga

SEQ ID NO: 670058 - DNA, 20 bp, mouse
gcggttccgcccgccgctgt

SEQ ID NO: 670059 - DNA, 20 bp, mouse
gcaccgccccgtagaaggaa

SEQ ID NO: 670060 - DNA, 20 bp, mouse
gcgtgcgggaggaagacgcg

SEQ ID NO: 670061 - DNA, 20 bp, mouse
ggcggggagaaagcgggtgt

SEQ ID NO: 670062 - DNA, 20 bp, mouse
gtatgggggcggggagaaag

SEQ ID NO: 670063 - DNA, 20 bp, mouse
gagccaatcagatgcccgga

SEQ ID NO: 670064 - DNA, 20 bp, mouse
gacggggcggtgccctgtat

SEQ ID NO: 670065 - DNA, 20 bp, mouse
gtcacctaagcgctccgtcc

SEQ ID NO: 670066 - DNA, 20 bp, mouse
gaggtccctgcgacccccga

SEQ ID NO: 670067 - DNA, 20 bp, mouse
gcgacccccgaaggaggagt

SEQ ID NO: 670068 - DNA, 20 bp, mouse
gcggggccgcgaatcaaagg

SEQ ID NO: 670069 - DNA, 20 bp, mouse
gtgccgccctaagcgggagg

SEQ ID NO: 670070 - DNA, 20 bp, mouse
ggccctaagcgggaggtgga

SEQ ID NO: 670071 - DNA, 20 bp, mouse
gtccctgcgacccccgaagg

SEQ ID NO: 670072 - DNA, 20 bp, mouse
gggggaagcccgtcgggcga

SEQ ID NO: 670073 - DNA, 20 bp, mouse
gcctcggggccgcgaatcaa

SEQ ID NO: 670074 - DNA, 20 bp, mouse
gacggtccggtcccagcttg

SEQ ID NO: 670075 - DNA, 20 bp, mouse
gaattgccgccctaagcggg

SEQ ID NO: 670076 - DNA, 20 bp, mouse
gccagtaagctgtagaggcg

SEQ ID NO: 670077 - DNA, 20 bp, mouse
gtccgcgagccaacctgcgg

SEQ ID NO: 670078 - DNA, 20 bp, mouse
ggggatgacccgccgcaggt

SEQ ID NO: 670079 - DNA, 20 bp, mouse
ggactccgcgagccaacctg

SEQ ID NO: 670080 - DNA, 20 bp, mouse
gggttggctcgcggagtccc

SEQ ID NO: 670081 - DNA, 20 bp, mouse
gtcagcccacggtgctccgt

SEQ ID NO: 670082 - DNA, 20 bp, mouse
ggaggggggcgctcctgaga

SEQ ID NO: 670083 - DNA, 20 bp, mouse
gggagccgacggagcaccgt

SEQ ID NO: 670084 - DNA, 20 bp, mouse
gggcggggatgacccgccgc

SEQ ID NO: 670085 - DNA, 20 bp, mouse
gttgggaagtccagaaaggc

SEQ ID NO: 670086 - DNA, 20 bp, mouse
gtccctgaagtggcgctgat

SEQ ID NO: 670087 - DNA, 20 bp, mouse
gaaggctgggctgacgtcaa

SEQ ID NO: 670088 - DNA, 20 bp, mouse
gctgatgggctaggagctag

SEQ ID NO: 670089 - DNA, 20 bp, mouse
ggcctccaaaagcgcaaaag

SEQ ID NO: 670090 - DNA, 20 bp, mouse
ggcccatcagcgccacttca

SEQ ID NO: 670091 - DNA, 20 bp, mouse
gaccagaagagtccctgaag

SEQ ID NO: 670092 - DNA, 20 bp, mouse
gaaaggcaggcctcagtgaa

SEQ ID NO: 670093 - DNA, 20 bp, mouse
gaggagggttaccaaaggct

SEQ ID NO: 670094 - DNA, 20 bp, mouse
gacagctggaaagtccatac

SEQ ID NO: 670095 - DNA, 20 bp, mouse
gatgggcagaggggaaaacc

SEQ ID NO: 670096 - DNA, 20 bp, mouse
gggagcaagccggcaggaag

SEQ ID NO: 670097 - DNA, 20 bp, mouse
gaccccggggagcgggactt

SEQ ID NO: 670098 - DNA, 20 bp, mouse
gctggcgcccaggcccggaa

SEQ ID NO: 670099 - DNA, 20 bp, mouse
gcggggccgcacattgtggt

SEQ ID NO: 670100 - DNA, 20 bp, mouse
ggggccagttggggtgggcg

SEQ ID NO: 670101 - DNA, 20 bp, mouse
ggaaggggaggagtcgggtg

SEQ ID NO: 670102 - DNA, 20 bp, mouse
ggtggtgggcggggccagtt

SEQ ID NO: 670103 - DNA, 20 bp, mouse
gggggcggccaaggggagta

SEQ ID NO: 670104 - DNA, 20 bp, mouse
gggagtacggactccgttcc

SEQ ID NO: 670105 - DNA, 20 bp, mouse
gtcgggccgccctcgcggga

SEQ ID NO: 670106 - DNA, 20 bp, mouse
gcacccggaatgacctgccc

SEQ ID NO: 670107 - DNA, 20 bp, mouse
ggggctggcgtaaccggcgg

SEQ ID NO: 670108 - DNA, 20 bp, mouse
ggcggggctggcgtaaccgg

SEQ ID NO: 670109 - DNA, 20 bp, mouse
ggcgccctgagcctcggacg

SEQ ID NO: 670110 - DNA, 20 bp, mouse
gcacctggccgggtactctg

SEQ ID NO: 670111 - DNA, 20 bp, mouse
gcctgtgcgcagaatcggag

SEQ ID NO: 670112 - DNA, 20 bp, mouse
gacctgcccgggctgcgaag

SEQ ID NO: 670113 - DNA, 20 bp, mouse
ggccgggccgggctcccggg

SEQ ID NO: 670114 - DNA, 20 bp, mouse
gagccgagcgctacagtcac

SEQ ID NO: 670115 - DNA, 20 bp, mouse
ggggctcgggagcggtaccc

SEQ ID NO: 670116 - DNA, 20 bp, mouse
gggcaccctccataggaagg

SEQ ID NO: 670117 - DNA, 20 bp, mouse
gcctggcaccctccatagga

SEQ ID NO: 670118 - DNA, 20 bp, mouse
gctttgtctcctcccagggg

SEQ ID NO: 670119 - DNA, 20 bp, mouse
ggaagctggggaggtctccc

SEQ ID NO: 670120 - DNA, 20 bp, mouse
gtctccctggcaccctccat

SEQ ID NO: 670121 - DNA, 20 bp, mouse
ggctgaactcctgtcagtgt

SEQ ID NO: 670122 - DNA, 20 bp, mouse
gtggccagcacaggaagctg

SEQ ID NO: 670123 - DNA, 20 bp, mouse
gccagcacaggaagctgggg

SEQ ID NO: 670124 - DNA, 20 bp, mouse
gtgctggccaaatgtgattc

SEQ ID NO: 670125 - DNA, 20 bp, mouse
ggcacctcccagatccacgt

SEQ ID NO: 670126 - DNA, 20 bp, mouse
gaagagcagggcagatacct

SEQ ID NO: 670127 - DNA, 20 bp, mouse
gttatctggagggttgggaa

SEQ ID NO: 670128 - DNA, 20 bp, mouse
gtggccagcacaggaagatg

SEQ ID NO: 670129 - DNA, 20 bp, mouse
gtctaggctatagaaagtac

SEQ ID NO: 670130 - DNA, 20 bp, mouse
ggctgttctcctgtcagtgc

SEQ ID NO: 670131 - DNA, 20 bp, mouse
gcaactctgctaagaagagc

SEQ ID NO: 670132 - DNA, 20 bp, mouse
gcttcctatggagggcgcca

SEQ ID NO: 670133 - DNA, 20 bp, mouse
gcctgatccatcgtcactga

SEQ ID NO: 670134 - DNA, 20 bp, mouse
gtctccctggcgccctccat

SEQ ID NO: 670135 - DNA, 20 bp, mouse
ggaagatggggaggtctccc

SEQ ID NO: 670136 - DNA, 20 bp, mouse
gggacaggagacagacgaaa

SEQ ID NO: 670137 - DNA, 20 bp, mouse
gtgtgcagtctggtggactg

SEQ ID NO: 670138 - DNA, 20 bp, mouse
gtccatataaggccatataa

SEQ ID NO: 670139 - DNA, 20 bp, mouse
gggcataatgagaggaaaga

SEQ ID NO: 670140 - DNA, 20 bp, mouse
gtgagcaataaagtctcctc

SEQ ID NO: 670141 - DNA, 20 bp, mouse
ggggaggagactgagataaa

SEQ ID NO: 670142 - DNA, 20 bp, mouse
gtataaggccatataagggc

SEQ ID NO: 670143 - DNA, 20 bp, mouse
ggtctcctccggcccttata

SEQ ID NO: 670144 - DNA, 20 bp, mouse
gtctaggaggggctccaacc

SEQ ID NO: 670145 - DNA, 20 bp, mouse
gaaggccatataagggccgg

SEQ ID NO: 670146 - DNA, 20 bp, mouse
gttcatataaggtcatgcga

SEQ ID NO: 670147 - DNA, 20 bp, mouse
ggggaaaggggaaaaacata

SEQ ID NO: 670148 - DNA, 20 bp, mouse
ggtggactgtgacataatga

SEQ ID NO: 670149 - DNA, 20 bp, mouse
gaaggtcatgcgagggcctg

SEQ ID NO: 670150 - DNA, 20 bp, mouse
gctaggaggaaatcctacct

SEQ ID NO: 670151 - DNA, 20 bp, mouse
gtgacataatgaggggaaag

SEQ ID NO: 670152 - DNA, 20 bp, mouse
gaggtcaattcaattcttga

SEQ ID NO: 670153 - DNA, 20 bp, mouse
gaggaggagattcagataaa

SEQ ID NO: 670154 - DNA, 20 bp, mouse
gggaggaaatcctacctagg

SEQ ID NO: 670155 - DNA, 20 bp, mouse
gaagagagcaaagaatttgc

SEQ ID NO: 670156 - DNA, 20 bp, mouse
gtgtagagaacaggagatag

SEQ ID NO: 670157 - DNA, 20 bp, mouse
gaatctggagtgaagaactg

SEQ ID NO: 670158 - DNA, 20 bp, mouse
gtccatataaggccaaatga

SEQ ID NO: 670159 - DNA, 20 bp, mouse
gggagaaaggtgtagagaac

SEQ ID NO: 670160 - DNA, 20 bp, mouse
gaaggccaaatgagggcccg

SEQ ID NO: 670161 - DNA, 20 bp, mouse
gtacaaccggaaaaccaagt

SEQ ID NO: 670162 - DNA, 20 bp, mouse
gccccaggccatataattct

SEQ ID NO: 670163 - DNA, 20 bp, mouse
gtctaggagggactcctacc

SEQ ID NO: 670164 - DNA, 20 bp, mouse
gggagactacaataaaagag

SEQ ID NO: 670165 - DNA, 20 bp, mouse
gatctcctcgggccctcatt

SEQ ID NO: 670166 - DNA, 20 bp, mouse
gggaaagggcctgagggtta

SEQ ID NO: 670167 - DNA, 20 bp, mouse
ggggcctgagggttatgggc

SEQ ID NO: 670168 - DNA, 20 bp, mouse
gcctctgtggacatatggtg

SEQ ID NO: 670169 - DNA, 20 bp, mouse
ggtggacatatggtgcggtg

SEQ ID NO: 670170 - DNA, 20 bp, mouse
gctaggatgagctcctacct

SEQ ID NO: 670171 - DNA, 20 bp, mouse
gaagctgataaagtcctctg

SEQ ID NO: 670172 - DNA, 20 bp, mouse
gcaccagctcatatgattct

SEQ ID NO: 670173 - DNA, 20 bp, mouse
gtctcctgcccataaccctc

SEQ ID NO: 670174 - DNA, 20 bp, mouse
gatgagaggaaagggcctga

SEQ ID NO: 670175 - DNA, 20 bp, mouse
gaactgagaaggtctttcac

SEQ ID NO: 670176 - DNA, 20 bp, mouse
gggagtaaatcttaaagaat

SEQ ID NO: 670177 - DNA, 20 bp, mouse
gctgggctacactaagttct

SEQ ID NO: 670178 - DNA, 20 bp, mouse
ggaagagttgacacagatca

SEQ ID NO: 670179 - DNA, 20 bp, mouse
gaaaataagtcgtgactgac

SEQ ID NO: 670180 - DNA, 20 bp, mouse
gcagaatgatgagttagaat

SEQ ID NO: 670181 - DNA, 20 bp, mouse
gttgacacagatcatggcct

SEQ ID NO: 670182 - DNA, 20 bp, mouse
gcacgcacattcgcgcacag

SEQ ID NO: 670183 - DNA, 20 bp, mouse
gcatcattctgattatcctg

SEQ ID NO: 670184 - DNA, 20 bp, mouse
ggatgagttagaatgggttc

SEQ ID NO: 670185 - DNA, 20 bp, mouse
gagtggttgaacttcaaaac

SEQ ID NO: 670186 - DNA, 20 bp, mouse
gaccaggtcgccagggagga

SEQ ID NO: 670187 - DNA, 20 bp, mouse
gcactccctggctgtcccga

SEQ ID NO: 670188 - DNA, 20 bp, mouse
ggcatagtggggtcactgag

SEQ ID NO: 670189 - DNA, 20 bp, mouse
gtatgcagcagagacatcac

SEQ ID NO: 670190 - DNA, 20 bp, mouse
ggaggagaaccaggtcgcca

SEQ ID NO: 670191 - DNA, 20 bp, mouse
ggtgaatggcacaactctgt

SEQ ID NO: 670192 - DNA, 20 bp, mouse
gtgtgccaaaggcccagatt

SEQ ID NO: 670193 - DNA, 20 bp, mouse
ggagaaccaggtcgccaggg

SEQ ID NO: 670194 - DNA, 20 bp, mouse
ggatgtctctgctgcatagt

SEQ ID NO: 670195 - DNA, 20 bp, mouse
ggcccagatttggtactgag

SEQ ID NO: 670196 - DNA, 20 bp, mouse
gaggaggagccacacgaaga

SEQ ID NO: 670197 - DNA, 20 bp, mouse
gggcagtgagggcagaccta

SEQ ID NO: 670198 - DNA, 20 bp, mouse
ggggcagagtcctttctagg

SEQ ID NO: 670199 - DNA, 20 bp, mouse
gcacacgaagaggggagggc

SEQ ID NO: 670200 - DNA, 20 bp, mouse
gacaaatgctgtttgtggtt

SEQ ID NO: 670201 - DNA, 20 bp, mouse
gcgtgtggctcctcctagaa

SEQ ID NO: 670202 - DNA, 20 bp, mouse
gttagctggcattcgtgttc

SEQ ID NO: 670203 - DNA, 20 bp, mouse
gaggatatgaaggagtatgt

SEQ ID NO: 670204 - DNA, 20 bp, mouse
gggagccacacgaagagggg

SEQ ID NO: 670205 - DNA, 20 bp, mouse
gtgtgtgacacacacgtgta

SEQ ID NO: 670206 - DNA, 20 bp, mouse
gtccccttggccagccacgc

SEQ ID NO: 670207 - DNA, 20 bp, mouse
gacgctgggtgggaagaaaa

SEQ ID NO: 670208 - DNA, 20 bp, mouse
gaggtagtagggtgcggtgg

SEQ ID NO: 670209 - DNA, 20 bp, mouse
ggggggtgttgctcaaacag

SEQ ID NO: 670210 - DNA, 20 bp, mouse
gacccagcgtggctggccaa

SEQ ID NO: 670211 - DNA, 20 bp, mouse
ggggtggagccctgaaaggc

SEQ ID NO: 670212 - DNA, 20 bp, mouse
ggtttctaggggaggtagta

SEQ ID NO: 670213 - DNA, 20 bp, mouse
gaggctgggagacagtggaa

SEQ ID NO: 670214 - DNA, 20 bp, mouse
gctgcctcactggttcccct

SEQ ID NO: 670215 - DNA, 20 bp, mouse
ggggaggtagtagggtgcgg

SEQ ID NO: 670216 - DNA, 20 bp, mouse
gagccccaaggccagggtat

SEQ ID NO: 670217 - DNA, 20 bp, mouse
gctgggaagagaggaataga

SEQ ID NO: 670218 - DNA, 20 bp, mouse
ggtgtcctataccctggcct

SEQ ID NO: 670219 - DNA, 20 bp, mouse
gtcttcctggcgccctctat

SEQ ID NO: 670220 - DNA, 20 bp, mouse
gagagtgacataaacctcag

SEQ ID NO: 670221 - DNA, 20 bp, mouse
gtcaaagtgtggtttactcc

SEQ ID NO: 670222 - DNA, 20 bp, mouse
gggaatgttacggagagcat

SEQ ID NO: 670223 - DNA, 20 bp, mouse
ggaagctggggaggtcttcc

SEQ ID NO: 670224 - DNA, 20 bp, mouse
gtcagtgctcactcaaagtg

SEQ ID NO: 670225 - DNA, 20 bp, mouse
gaatgctgttctgtcagtgc

SEQ ID NO: 670226 - DNA, 20 bp, mouse
gaccaggaactaagactgtt

SEQ ID NO: 670227 - DNA, 20 bp, mouse
gagccaggagagggactacc

SEQ ID NO: 670228 - DNA, 20 bp, mouse
ggccctctgaggatatggga

SEQ ID NO: 670229 - DNA, 20 bp, mouse
ggagggctctgcttccaaga

SEQ ID NO: 670230 - DNA, 20 bp, mouse
gagcatgaagacagctgtct

SEQ ID NO: 670231 - DNA, 20 bp, mouse
gccctggaacctcaaggacc

SEQ ID NO: 670232 - DNA, 20 bp, mouse
gttcctaagttcatagtaac

SEQ ID NO: 670233 - DNA, 20 bp, mouse
gtggctgctcatggctagcc

SEQ ID NO: 670234 - DNA, 20 bp, mouse
gaggagcataagagaatctt

SEQ ID NO: 670235 - DNA, 20 bp, mouse
gtcttagttcctggtccttg

SEQ ID NO: 670236 - DNA, 20 bp, mouse
gagaacaacggctcgtccca

SEQ ID NO: 670237 - DNA, 20 bp, mouse
gagtcctggacctctctcct

SEQ ID NO: 670238 - DNA, 20 bp, mouse
gagcatggaggctccctctt

SEQ ID NO: 670239 - DNA, 20 bp, mouse
gactcagcagatgtcagcct

SEQ ID NO: 670240 - DNA, 20 bp, mouse
ggagtctgtcatcaccaaag

SEQ ID NO: 670241 - DNA, 20 bp, mouse
gaggtgacagagatgtctga

SEQ ID NO: 670242 - DNA, 20 bp, mouse
ggacgagccgttgttctctg

SEQ ID NO: 670243 - DNA, 20 bp, mouse
ggtgtcctagaaaggactat

SEQ ID NO: 670244 - DNA, 20 bp, mouse
gtgtctgagggcagtttaaa

SEQ ID NO: 670245 - DNA, 20 bp, mouse
gccaacacacaatgctggaa

SEQ ID NO: 670246 - DNA, 20 bp, mouse
gatgtctctgagggcgataa

SEQ ID NO: 670247 - DNA, 20 bp, mouse
gagattcattcccagcaaga

SEQ ID NO: 670248 - DNA, 20 bp, mouse
gctgtgtccaaaggacacct

SEQ ID NO: 670249 - DNA, 20 bp, mouse
gtcacctagacaatggacat

SEQ ID NO: 670250 - DNA, 20 bp, mouse
ggtcttcagtgtatgagaaa

SEQ ID NO: 670251 - DNA, 20 bp, mouse
gagaagagcatagaggacat

SEQ ID NO: 670252 - DNA, 20 bp, mouse
gtgcttagtgtgcttcttgg

SEQ ID NO: 670253 - DNA, 20 bp, mouse
gtctttgtcaccttcttgct

SEQ ID NO: 670254 - DNA, 20 bp, mouse
gtgaccaaagaagagcatag

SEQ ID NO: 670255 - DNA, 20 bp, mouse
gttttgcttagtgtgcttct

SEQ ID NO: 670256 - DNA, 20 bp, mouse
gtttagagacagttggggtg

SEQ ID NO: 670257 - DNA, 20 bp, mouse
gaaaaccttaaagaatgaat

SEQ ID NO: 670258 - DNA, 20 bp, mouse
gactgcctgtgacacgggag

SEQ ID NO: 670259 - DNA, 20 bp, mouse
gcctcccactgcctgtgaca

SEQ ID NO: 670260 - DNA, 20 bp, mouse
gctgcgtcaactcttcttgc

SEQ ID NO: 670261 - DNA, 20 bp, mouse
ggggcaaatggcagccattc

SEQ ID NO: 670262 - DNA, 20 bp, mouse
gcacaggcagtgggaggaat

SEQ ID NO: 670263 - DNA, 20 bp, mouse
gtgggtctccatagcctgaa

SEQ ID NO: 670264 - DNA, 20 bp, mouse
gcgtcaactcttcttgctgg

SEQ ID NO: 670265 - DNA, 20 bp, mouse
gtaaacccattcattcttta

SEQ ID NO: 670266 - DNA, 20 bp, mouse
gttgcagcgcaggagtcagt

SEQ ID NO: 670267 - DNA, 20 bp, mouse
gctcccgggctccctagtgt

SEQ ID NO: 670268 - DNA, 20 bp, mouse
gctgcgctgcaaggcgaacc

SEQ ID NO: 670269 - DNA, 20 bp, mouse
gggcgacagcgccgccgggg

SEQ ID NO: 670270 - DNA, 20 bp, mouse
gcccgcacacacgtggtccg

SEQ ID NO: 670271 - DNA, 20 bp, mouse
gcaccgccttggaaagtcac

SEQ ID NO: 670272 - DNA, 20 bp, mouse
gtgctagtggagagagatcg

SEQ ID NO: 670273 - DNA, 20 bp, mouse
gcaaacgggtctcggatcga

SEQ ID NO: 670274 - DNA, 20 bp, mouse
ggcatctagaggccgagcga

SEQ ID NO: 670275 - DNA, 20 bp, mouse
ggtggggagcatagtgctag

SEQ ID NO: 670276 - DNA, 20 bp, mouse
ggggccatacatagggtgga

SEQ ID NO: 670277 - DNA, 20 bp, mouse
gggacagcgggcaggatccg

SEQ ID NO: 670278 - DNA, 20 bp, mouse
gcccgcgatggccacggacg

SEQ ID NO: 670279 - DNA, 20 bp, mouse
gcgctcctccgtgttcccga

SEQ ID NO: 670280 - DNA, 20 bp, mouse
gcggccacgggagcgcgaga

SEQ ID NO: 670281 - DNA, 20 bp, mouse
gcccctgctggaggacgcgg

SEQ ID NO: 670282 - DNA, 20 bp, mouse
gaggacatgcaccccgtgga

SEQ ID NO: 670283 - DNA, 20 bp, mouse
gcgtcccgccagccccgcga

SEQ ID NO: 670284 - DNA, 20 bp, mouse
gccgcccctcgggaacacgg

SEQ ID NO: 670285 - DNA, 20 bp, mouse
gctggcgtcacccgcgtccg

SEQ ID NO: 670286 - DNA, 20 bp, mouse
ggggcagggcacaccccgga

SEQ ID NO: 670287 - DNA, 20 bp, mouse
gtacccctggccctagtaca

SEQ ID NO: 670288 - DNA, 20 bp, mouse
gtgaactcgcagggcaaaaa

SEQ ID NO: 670289 - DNA, 20 bp, mouse
gctctccttggggtgactaa

SEQ ID NO: 670290 - DNA, 20 bp, mouse
gcacaggtctctttggaaat

SEQ ID NO: 670291 - DNA, 20 bp, mouse
gtccttggggtgactaaggg

SEQ ID NO: 670292 - DNA, 20 bp, mouse
gaactgacttaccccggggt

SEQ ID NO: 670293 - DNA, 20 bp, mouse
gagaatcccttgaactcgca

SEQ ID NO: 670294 - DNA, 20 bp, mouse
gaggtctctttggaaatcgg

SEQ ID NO: 670295 - DNA, 20 bp, mouse
gcagggcacaccccggaggg

SEQ ID NO: 670296 - DNA, 20 bp, mouse
ggcagcgcgcggacccgaag

SEQ ID NO: 670297 - DNA, 20 bp, mouse
gtggagctgcccatctctag

SEQ ID NO: 670298 - DNA, 20 bp, mouse
gccggcacacggcctgtgat

SEQ ID NO: 670299 - DNA, 20 bp, mouse
ggcggcggaacgggcgtggt

SEQ ID NO: 670300 - DNA, 20 bp, mouse
gagctccaccagccaatcac

SEQ ID NO: 670301 - DNA, 20 bp, mouse
gcccgcctctcgccggcaca

SEQ ID NO: 670302 - DNA, 20 bp, mouse
gcgcgctcgcctctagagat

SEQ ID NO: 670303 - DNA, 20 bp, mouse
gtggctggaggcgcgctcgg

SEQ ID NO: 670304 - DNA, 20 bp, mouse
gtgccaccaccgacagccta

SEQ ID NO: 670305 - DNA, 20 bp, mouse
gaggcggtggccctgagcct

SEQ ID NO: 670306 - DNA, 20 bp, mouse
gtggaggggcttgtagtcat

SEQ ID NO: 670307 - DNA, 20 bp, mouse
gcgggtgagagtccccttgc

SEQ ID NO: 670308 - DNA, 20 bp, mouse
ggagcctggcctcggggtgt

SEQ ID NO: 670309 - DNA, 20 bp, mouse
ggtgagcaacggagggacca

SEQ ID NO: 670310 - DNA, 20 bp, mouse
gaccaaggagccgcgccata

SEQ ID NO: 670311 - DNA, 20 bp, mouse
gaggggactctcacccgcgc

SEQ ID NO: 670312 - DNA, 20 bp, mouse
gtcaggacccgatggaggca

SEQ ID NO: 670313 - DNA, 20 bp, mouse
ggtccctccgttgctcacct

SEQ ID NO: 670314 - DNA, 20 bp, mouse
gccgcgccatacggtttcca

SEQ ID NO: 670315 - DNA, 20 bp, mouse
gccccaacgtcaggacccga

SEQ ID NO: 670316 - DNA, 20 bp, mouse
gcggacagctgcaccgaggg

SEQ ID NO: 670317 - DNA, 20 bp, mouse
gggccccgccccctcctcgt

SEQ ID NO: 670318 - DNA, 20 bp, mouse
gggcccctccgcgtcacggg

SEQ ID NO: 670319 - DNA, 20 bp, mouse
gaggggccgcccacgaggag

SEQ ID NO: 670320 - DNA, 20 bp, mouse
ggggccgcccgtgacgcgga

SEQ ID NO: 670321 - DNA, 20 bp, mouse
gacagctgcaccgagggcgg

SEQ ID NO: 670322 - DNA, 20 bp, mouse
ggcgagccgcgcccggggag

SEQ ID NO: 670323 - DNA, 20 bp, mouse
gggaggggccgcccgtgacg

SEQ ID NO: 670324 - DNA, 20 bp, mouse
ggcgcggacagctgcaccga

SEQ ID NO: 670325 - DNA, 20 bp, mouse
ggggggcccggcagaaacct

SEQ ID NO: 670326 - DNA, 20 bp, mouse
gcccgcgcagggcctctcgg

SEQ ID NO: 670327 - DNA, 20 bp, mouse
ggaccccaagtctcctctcg

SEQ ID NO: 670328 - DNA, 20 bp, mouse
gtctcctctcggggaagcga

SEQ ID NO: 670329 - DNA, 20 bp, mouse
gcgagcccgagctccacggt

SEQ ID NO: 670330 - DNA, 20 bp, mouse
gcgggctcgggttgcgagtt

SEQ ID NO: 670331 - DNA, 20 bp, mouse
gtcgggttgcgagttcggag

SEQ ID NO: 670332 - DNA, 20 bp, mouse
gtagtccgaccgtggagctc

SEQ ID NO: 670333 - DNA, 20 bp, mouse
ggactcgcggccacccgtgc

SEQ ID NO: 670334 - DNA, 20 bp, mouse
gttccccgagaggagacttg

SEQ ID NO: 670335 - DNA, 20 bp, mouse
gtggttgctcggctgtgcgt

SEQ ID NO: 670336 - DNA, 20 bp, mouse
gagagaggaggcgagaatag

SEQ ID NO: 670337 - DNA, 20 bp, mouse
ggaaaccaggactggattcg

SEQ ID NO: 670338 - DNA, 20 bp, mouse
ggggagccgagcagaccgcc

SEQ ID NO: 670339 - DNA, 20 bp, mouse
gaccgccgggaccggagagg

SEQ ID NO: 670340 - DNA, 20 bp, mouse
ggccgggaccggagaggcgg

SEQ ID NO: 670341 - DNA, 20 bp, mouse
gccgagcagaccgccgggac

SEQ ID NO: 670342 - DNA, 20 bp, mouse
gaactcgcacccgggtcggg

SEQ ID NO: 670343 - DNA, 20 bp, mouse
ggctggctggatcagcagga

SEQ ID NO: 670344 - DNA, 20 bp, mouse
ggcccccgcctctccggtcc

SEQ ID NO: 670345 - DNA, 20 bp, mouse
ggactggattcgagggagag

SEQ ID NO: 670346 - DNA, 20 bp, mouse
ggtggcatggatattgtcga

SEQ ID NO: 670347 - DNA, 20 bp, mouse
gtgcctcccagggccaactc

SEQ ID NO: 670348 - DNA, 20 bp, mouse
gtgcccacagtgcacctgtg

SEQ ID NO: 670349 - DNA, 20 bp, mouse
ggccccagctccataaatac

SEQ ID NO: 670350 - DNA, 20 bp, mouse
gactgcccacctgggagcag

SEQ ID NO: 670351 - DNA, 20 bp, mouse
gcggaacacccagccagagt

SEQ ID NO: 670352 - DNA, 20 bp, mouse
gacccacacaggtgcactgt

SEQ ID NO: 670353 - DNA, 20 bp, mouse
gtgcactgtgggcaccactc

SEQ ID NO: 670354 - DNA, 20 bp, mouse
ggtcgagggggtgcctccca

SEQ ID NO: 670355 - DNA, 20 bp, mouse
gtcccagggccaactctggc

SEQ ID NO: 670356 - DNA, 20 bp, mouse
ggggcagggccatgggtaga

SEQ ID NO: 670357 - DNA, 20 bp, mouse
gagaaggcagggaaaagcgc

SEQ ID NO: 670358 - DNA, 20 bp, mouse
ggataagaggcgtataaaga

SEQ ID NO: 670359 - DNA, 20 bp, mouse
gaggtcaactcagttgactt

SEQ ID NO: 670360 - DNA, 20 bp, mouse
ggcaggctgcgtctcaactg

SEQ ID NO: 670361 - DNA, 20 bp, mouse
gccttagcgggctttcgaga

SEQ ID NO: 670362 - DNA, 20 bp, mouse
gagttgcgaggattgaacgt

SEQ ID NO: 670363 - DNA, 20 bp, mouse
gaagcccgctaaggatttgc

SEQ ID NO: 670364 - DNA, 20 bp, mouse
gcagcaaagctgctgataag

SEQ ID NO: 670365 - DNA, 20 bp, mouse
gtcagttgacttgggttaag

SEQ ID NO: 670366 - DNA, 20 bp, mouse
gtgtacttctagaacgacaa

SEQ ID NO: 670367 - DNA, 20 bp, mouse
ggacgctggaggaatatgca

SEQ ID NO: 670368 - DNA, 20 bp, mouse
gccaaagtccagtgcaataa

SEQ ID NO: 670369 - DNA, 20 bp, mouse
gcatattcctccagcgtctc

SEQ ID NO: 670370 - DNA, 20 bp, mouse
gtatcagccagagacgctgg

SEQ ID NO: 670371 - DNA, 20 bp, mouse
ggaaacaatatgtgtggccc

SEQ ID NO: 670372 - DNA, 20 bp, mouse
ggataaggccactcataaaa

SEQ ID NO: 670373 - DNA, 20 bp, mouse
gcaggacttaagattatcca

SEQ ID NO: 670374 - DNA, 20 bp, mouse
ggctggaggaatatgcaagg

SEQ ID NO: 670375 - DNA, 20 bp, mouse
gttctagaacgacaagggaa

SEQ ID NO: 670376 - DNA, 20 bp, mouse
gcaacctgtgattgcacaag

SEQ ID NO: 670377 - DNA, 20 bp, mouse
gctaccacttgtgcaatcac

SEQ ID NO: 670378 - DNA, 20 bp, mouse
gccactgtagattagagagc

SEQ ID NO: 670379 - DNA, 20 bp, mouse
gtaagagagggacaggcaaa

SEQ ID NO: 670380 - DNA, 20 bp, mouse
gattagagagcaggagctga

SEQ ID NO: 670381 - DNA, 20 bp, mouse
gagagagcaggagctgaagg

SEQ ID NO: 670382 - DNA, 20 bp, mouse
gacaggttggaggaagtctg

SEQ ID NO: 670383 - DNA, 20 bp, mouse
gttgcacaagtggtagagaa

SEQ ID NO: 670384 - DNA, 20 bp, mouse
gtgttgtgggagtggggtct

SEQ ID NO: 670385 - DNA, 20 bp, mouse
gggcagactgtgagcagact

SEQ ID NO: 670386 - DNA, 20 bp, mouse
gccctccggccggggagtga

SEQ ID NO: 670387 - DNA, 20 bp, mouse
gcgagccgagcgccgcgcag

SEQ ID NO: 670388 - DNA, 20 bp, mouse
ggaaggggaacgtaccaccg

SEQ ID NO: 670389 - DNA, 20 bp, mouse
gccgagcgccgcgcaggggc

SEQ ID NO: 670390 - DNA, 20 bp, mouse
gcagtcgctctgaaaccctg

SEQ ID NO: 670391 - DNA, 20 bp, mouse
gtcagccctgggagctgtag

SEQ ID NO: 670392 - DNA, 20 bp, mouse
gggagggggcgctgcagcgc

SEQ ID NO: 670393 - DNA, 20 bp, mouse
gaaaccctgggggccgcggg

SEQ ID NO: 670394 - DNA, 20 bp, mouse
gggccctccccgccggtggt

SEQ ID NO: 670395 - DNA, 20 bp, mouse
gtgcactggagggaagaccc

SEQ ID NO: 670396 - DNA, 20 bp, mouse
ggctctgcactctgtgaggg

SEQ ID NO: 670397 - DNA, 20 bp, mouse
gctctgctctgcactctgtg

SEQ ID NO: 670398 - DNA, 20 bp, mouse
ggagaagcgcacaggcttaa

SEQ ID NO: 670399 - DNA, 20 bp, mouse
gagaggttctatctcagtca

SEQ ID NO: 670400 - DNA, 20 bp, mouse
gagcgcacaggcttaaagga

SEQ ID NO: 670401 - DNA, 20 bp, mouse
ggaacagcccactagctagg

SEQ ID NO: 670402 - DNA, 20 bp, mouse
ggagcagctttacccataca

SEQ ID NO: 670403 - DNA, 20 bp, mouse
gactgcaccgcctagctagt

SEQ ID NO: 670404 - DNA, 20 bp, mouse
gcccaacaatttgagagtta

SEQ ID NO: 670405 - DNA, 20 bp, mouse
gccatacatggttactgaaa

SEQ ID NO: 670406 - DNA, 20 bp, mouse
gcaccctgaagccctaactc

SEQ ID NO: 670407 - DNA, 20 bp, mouse
ggaaaaagggcggggaatgg

SEQ ID NO: 670408 - DNA, 20 bp, mouse
gcatctcagaacccaggctt

SEQ ID NO: 670409 - DNA, 20 bp, mouse
gagccagagttagggcttca

SEQ ID NO: 670410 - DNA, 20 bp, mouse
gagaaaaaatagtgggggtt

SEQ ID NO: 670411 - DNA, 20 bp, mouse
ggggcttcagggtgaaggac

SEQ ID NO: 670412 - DNA, 20 bp, mouse
ggactggccgcctgtcaccc

SEQ ID NO: 670413 - DNA, 20 bp, mouse
gtgctgttcagcatcgactc

SEQ ID NO: 670414 - DNA, 20 bp, mouse
ggcagctgcaagttaagtgc

SEQ ID NO: 670415 - DNA, 20 bp, mouse
gccatgccctgggtgacagg

SEQ ID NO: 670416 - DNA, 20 bp, mouse
gtggggcagaaagggagtca

SEQ ID NO: 670417 - DNA, 20 bp, mouse
gtgctcttctggggcagaaa

SEQ ID NO: 670418 - DNA, 20 bp, mouse
gaacaatggaccccacccta

SEQ ID NO: 670419 - DNA, 20 bp, mouse
gggtggggtccattgttccg

SEQ ID NO: 670420 - DNA, 20 bp, mouse
gttactccccaatcaggagt

SEQ ID NO: 670421 - DNA, 20 bp, mouse
gcatcagtgatgtcagtctc

SEQ ID NO: 670422 - DNA, 20 bp, mouse
ggtgatgtcagtctcagggg

SEQ ID NO: 670423 - DNA, 20 bp, mouse
gtctgccccagaagagcagc

SEQ ID NO: 670424 - DNA, 20 bp, mouse
ggttgggcaagagacgaaga

SEQ ID NO: 670425 - DNA, 20 bp, mouse
gatcagtcaggcaggttgaa

SEQ ID NO: 670426 - DNA, 20 bp, mouse
gagggcgcgcggtaggagga

SEQ ID NO: 670427 - DNA, 20 bp, mouse
gtccctgccagaccaggggt

SEQ ID NO: 670428 - DNA, 20 bp, mouse
gccccagcgcgcccactccc

SEQ ID NO: 670429 - DNA, 20 bp, mouse
gggcgagggcgcgcggtagg

SEQ ID NO: 670430 - DNA, 20 bp, mouse
gctcgcgcctcccccgtcgg

SEQ ID NO: 670431 - DNA, 20 bp, mouse
gagcgcgggggccagggagt

SEQ ID NO: 670432 - DNA, 20 bp, mouse
gtctggcagggaacttgaac

SEQ ID NO: 670433 - DNA, 20 bp, mouse
ggctccgcggggccgccgac

SEQ ID NO: 670434 - DNA, 20 bp, mouse
gaacaggcacccgctgcccg

SEQ ID NO: 670435 - DNA, 20 bp, mouse
gtcaagttccctgccagacc

SEQ ID NO: 670436 - DNA, 20 bp, mouse
gcgctggcgccgggaaactg

SEQ ID NO: 670437 - DNA, 20 bp, mouse
gcgaggctggcagagaaatg

SEQ ID NO: 670438 - DNA, 20 bp, mouse
ggggcggtgacacctaagga

SEQ ID NO: 670439 - DNA, 20 bp, mouse
ggccgcctcggctacttcag

SEQ ID NO: 670440 - DNA, 20 bp, mouse
gcccatcagaaagactgata

SEQ ID NO: 670441 - DNA, 20 bp, mouse
gccccctgaagtagccgagg

SEQ ID NO: 670442 - DNA, 20 bp, mouse
gtagccgaggcggccgccag

SEQ ID NO: 670443 - DNA, 20 bp, mouse
gtggacacatagggcaggac

SEQ ID NO: 670444 - DNA, 20 bp, mouse
ggtcagggcggtgacaccta

SEQ ID NO: 670445 - DNA, 20 bp, mouse
gccgccccctgaagtagccg

SEQ ID NO: 670446 - DNA, 20 bp, mouse
gtgaaaatgggcgtggtcga

SEQ ID NO: 670447 - DNA, 20 bp, mouse
gctggagcgcggggcgagaa

SEQ ID NO: 670448 - DNA, 20 bp, mouse
gggcggggcggactgaaaat

SEQ ID NO: 670449 - DNA, 20 bp, mouse
ggggcccagccgagagcgag

SEQ ID NO: 670450 - DNA, 20 bp, mouse
gcgcgccagggagagctctg

SEQ ID NO: 670451 - DNA, 20 bp, mouse
gcggggcccgcctacgagga

SEQ ID NO: 670452 - DNA, 20 bp, mouse
gggcccgcctacgaggacgg

SEQ ID NO: 670453 - DNA, 20 bp, mouse
gctgacgtcactaagctcgg

SEQ ID NO: 670454 - DNA, 20 bp, mouse
gtccccctcagagctctccc

SEQ ID NO: 670455 - DNA, 20 bp, mouse
gaatgggcgtggtcgagggc

SEQ ID NO: 670456 - DNA, 20 bp, mouse
ggggaggattacaatggttc

SEQ ID NO: 670457 - DNA, 20 bp, mouse
gcggcaacgagcacattgga

SEQ ID NO: 670458 - DNA, 20 bp, mouse
gagtaaccatggtaacaccc

SEQ ID NO: 670459 - DNA, 20 bp, mouse
gcacttgtggctatggtaac

SEQ ID NO: 670460 - DNA, 20 bp, mouse
ggtgggagggaggattacaa

SEQ ID NO: 670461 - DNA, 20 bp, mouse
gtgctcgttgccgagacaac

SEQ ID NO: 670462 - DNA, 20 bp, mouse
ggctccactaccagagaggg

SEQ ID NO: 670463 - DNA, 20 bp, mouse
ggtctcggcaacgagcacat

SEQ ID NO: 670464 - DNA, 20 bp, mouse
gggtgtgtcagagcctcggg

SEQ ID NO: 670465 - DNA, 20 bp, mouse
gactgcttctgcaccaatca

SEQ ID NO: 670466 - DNA, 20 bp, mouse
gcgcccgcagaccctggcga

SEQ ID NO: 670467 - DNA, 20 bp, mouse
ggaccctggcgacggattgc

SEQ ID NO: 670468 - DNA, 20 bp, mouse
gggggcgcgcacctcctggc

SEQ ID NO: 670469 - DNA, 20 bp, mouse
gaatccgtcgccagggtctg

SEQ ID NO: 670470 - DNA, 20 bp, mouse
gcgcgccccgatgatctcca

SEQ ID NO: 670471 - DNA, 20 bp, mouse
gtggaggccaggccccgcta

SEQ ID NO: 670472 - DNA, 20 bp, mouse
gcatcggggcgcgcacctcc

SEQ ID NO: 670473 - DNA, 20 bp, mouse
gcacgcccgcccagcagagt

SEQ ID NO: 670474 - DNA, 20 bp, mouse
gagccagcaatccgtcgcca

SEQ ID NO: 670475 - DNA, 20 bp, mouse
gtgaacaatgagccactggg

SEQ ID NO: 670476 - DNA, 20 bp, mouse
gccggggcgcgggtccccgg

SEQ ID NO: 670477 - DNA, 20 bp, mouse
gtaggatggggcagcaatga

SEQ ID NO: 670478 - DNA, 20 bp, mouse
gtaccggtcgccggggtccc

SEQ ID NO: 670479 - DNA, 20 bp, mouse
ggacgcccaacgcgccgagg

SEQ ID NO: 670480 - DNA, 20 bp, mouse
ggggcccgggccggagcgtg

SEQ ID NO: 670481 - DNA, 20 bp, mouse
gaggctccgcagacgcaggt

SEQ ID NO: 670482 - DNA, 20 bp, mouse
ggtctgcaggaggtgaccag

SEQ ID NO: 670483 - DNA, 20 bp, mouse
gactactgggagatcaagtg

SEQ ID NO: 670484 - DNA, 20 bp, mouse
gaggcgagggaacgcgggtc

SEQ ID NO: 670485 - DNA, 20 bp, mouse
ggcagcagcggcgttgggag

SEQ ID NO: 670486 - DNA, 20 bp, mouse
ggcgtcggggatgctgtggt

SEQ ID NO: 670487 - DNA, 20 bp, mouse
gcacgctggaatagcgcact

SEQ ID NO: 670488 - DNA, 20 bp, mouse
gagaccgctagtgactctcg

SEQ ID NO: 670489 - DNA, 20 bp, mouse
ggtggagcaaaccatcggag

SEQ ID NO: 670490 - DNA, 20 bp, mouse
ggcctcccgacgctccaaca

SEQ ID NO: 670491 - DNA, 20 bp, mouse
gtgctgcccacggtgctgaa

SEQ ID NO: 670492 - DNA, 20 bp, mouse
gtaaagggagacgagattct

SEQ ID NO: 670493 - DNA, 20 bp, mouse
gcaaaccaaaatgggtgtta

SEQ ID NO: 670494 - DNA, 20 bp, mouse
gcggaggtggagcaaaccat

SEQ ID NO: 670495 - DNA, 20 bp, mouse
gatagcgcactaggatgaga

SEQ ID NO: 670496 - DNA, 20 bp, mouse
gctacaccctgggaacccgg

SEQ ID NO: 670497 - DNA, 20 bp, mouse
gcctgggaacccggaggtag

SEQ ID NO: 670498 - DNA, 20 bp, mouse
ggccacgcctgctacaccct

SEQ ID NO: 670499 - DNA, 20 bp, mouse
gccggaggtagaggtgaagt

SEQ ID NO: 670500 - DNA, 20 bp, mouse
ggtgaattcggagtctgcaa

SEQ ID NO: 670501 - DNA, 20 bp, mouse
gctaaggagactcaaccgga

SEQ ID NO: 670502 - DNA, 20 bp, mouse
gaaagcctggctactgtcgc

SEQ ID NO: 670503 - DNA, 20 bp, mouse
gtgtgcttggatgggacggt

SEQ ID NO: 670504 - DNA, 20 bp, mouse
gaattcggagtctgcaaggg

SEQ ID NO: 670505 - DNA, 20 bp, mouse
ggagaattgaagctaggcat

SEQ ID NO: 670506 - DNA, 20 bp, mouse
gcggtcctgacgcgcacctt

SEQ ID NO: 670507 - DNA, 20 bp, mouse
gccaatgggtacttgaagac

SEQ ID NO: 670508 - DNA, 20 bp, mouse
gtacttgaagacgggaagga

SEQ ID NO: 670509 - DNA, 20 bp, mouse
gtcgcaaaccgcagacccca

SEQ ID NO: 670510 - DNA, 20 bp, mouse
gccaactttgtgactctcag

SEQ ID NO: 670511 - DNA, 20 bp, mouse
gaataaaggtctgaagccaa

SEQ ID NO: 670512 - DNA, 20 bp, mouse
gggcccatggctggcctcga

SEQ ID NO: 670513 - DNA, 20 bp, mouse
gtgggtacttgaagacggga

SEQ ID NO: 670514 - DNA, 20 bp, mouse
ggaccaagaaggcttaggga

SEQ ID NO: 670515 - DNA, 20 bp, mouse
gttcggcagcaggaccaaga

SEQ ID NO: 670516 - DNA, 20 bp, mouse
gcacgcgcgggaaaggtcat

SEQ ID NO: 670517 - DNA, 20 bp, mouse
gagcgcgcgcgggatctcgc

SEQ ID NO: 670518 - DNA, 20 bp, mouse
gggtccctgcgcatctgtcc

SEQ ID NO: 670519 - DNA, 20 bp, mouse
gcgggcctcagcgcccccgg

SEQ ID NO: 670520 - DNA, 20 bp, mouse
ggcctcagcgcccccggcgg

SEQ ID NO: 670521 - DNA, 20 bp, mouse
ggtggccgaggcgcacagtc

SEQ ID NO: 670522 - DNA, 20 bp, mouse
gtgcacaggctgctctcaag

SEQ ID NO: 670523 - DNA, 20 bp, mouse
ggggatctcgcgggaagcgg

SEQ ID NO: 670524 - DNA, 20 bp, mouse
ggacgctgggcgccgcctcc

SEQ ID NO: 670525 - DNA, 20 bp, mouse
gaggctgctctcaagaggtt

SEQ ID NO: 670526 - DNA, 20 bp, mouse
gaggcggggcgatgagtggg

SEQ ID NO: 670527 - DNA, 20 bp, mouse
gaggcgtggcgactggtgaa

SEQ ID NO: 670528 - DNA, 20 bp, mouse
ggagaggcggggcgatgagt

SEQ ID NO: 670529 - DNA, 20 bp, mouse
gctggtgaaaggcgtggcga

SEQ ID NO: 670530 - DNA, 20 bp, mouse
gcgtggcgacgggtgagagg

SEQ ID NO: 670531 - DNA, 20 bp, mouse
ggggcggggcgaactgagaa

SEQ ID NO: 670532 - DNA, 20 bp, mouse
ggagtgggaggttgagacgc

SEQ ID NO: 670533 - DNA, 20 bp, mouse
gcggacaagtcgaccggcga

SEQ ID NO: 670534 - DNA, 20 bp, mouse
ggggttgataggtgagtaac

SEQ ID NO: 670535 - DNA, 20 bp, mouse
gcggggcgaactgagaaagg

SEQ ID NO: 670536 - DNA, 20 bp, mouse
ggaaaggcggggcgagtcca

SEQ ID NO: 670537 - DNA, 20 bp, mouse
gcggggcgagtccatggatg

SEQ ID NO: 670538 - DNA, 20 bp, mouse
gcgggacagtccaagtgctg

SEQ ID NO: 670539 - DNA, 20 bp, mouse
ggcgagtccatggatgggga

SEQ ID NO: 670540 - DNA, 20 bp, mouse
gcggcgagtgggggttgcgg

SEQ ID NO: 670541 - DNA, 20 bp, mouse
gtccaagtgctgcggcgagt

SEQ ID NO: 670542 - DNA, 20 bp, mouse
gggttgcggggggaaaggcg

SEQ ID NO: 670543 - DNA, 20 bp, mouse
gggcggcccgggagctcggt

SEQ ID NO: 670544 - DNA, 20 bp, mouse
gccccactcgccgcagcact

SEQ ID NO: 670545 - DNA, 20 bp, mouse
ggagagcctcagaactcagc

SEQ ID NO: 670546 - DNA, 20 bp, mouse
ggcggagcctgcgcagacgt

SEQ ID NO: 670547 - DNA, 20 bp, mouse
gcgagaagccgggtgaggac

SEQ ID NO: 670548 - DNA, 20 bp, mouse
gaggcggctcaccgagaagc

SEQ ID NO: 670549 - DNA, 20 bp, mouse
gctcaccgagaagccgggtg

SEQ ID NO: 670550 - DNA, 20 bp, mouse
gtaaaaacaagcagagccgg

SEQ ID NO: 670551 - DNA, 20 bp, mouse
gaaaccctgagcggctgggc

SEQ ID NO: 670552 - DNA, 20 bp, mouse
gtgggcgggcttgaggagca

SEQ ID NO: 670553 - DNA, 20 bp, mouse
gtcggtgagccgcctctgat

SEQ ID NO: 670554 - DNA, 20 bp, mouse
gcactggcgttgcctagaga

SEQ ID NO: 670555 - DNA, 20 bp, mouse
gcggactgcgggtctgaatg

SEQ ID NO: 670556 - DNA, 20 bp, mouse
ggggcgggacccttccggaa

SEQ ID NO: 670557 - DNA, 20 bp, mouse
ggtgctgcgttccttttctg

SEQ ID NO: 670558 - DNA, 20 bp, mouse
gtccatctatccctacccac

SEQ ID NO: 670559 - DNA, 20 bp, mouse
gggtagggatagatggagac

SEQ ID NO: 670560 - DNA, 20 bp, mouse
gacaggccatcgaagcctgt

SEQ ID NO: 670561 - DNA, 20 bp, mouse
gccctacccacaggcttcga

SEQ ID NO: 670562 - DNA, 20 bp, mouse
gtggtgaaagtcttagctag

SEQ ID NO: 670563 - DNA, 20 bp, mouse
gcccttgcagcgggttgccg

SEQ ID NO: 670564 - DNA, 20 bp, mouse
gtcgtggcgggaagaactgc

SEQ ID NO: 670565 - DNA, 20 bp, mouse
gagttcctacccttccggaa

SEQ ID NO: 670566 - DNA, 20 bp, mouse
ggcgcgccgcaggcctacgt

SEQ ID NO: 670567 - DNA, 20 bp, mouse
gaggctggctccgcccacgt

SEQ ID NO: 670568 - DNA, 20 bp, mouse
gcggctctatgacgacgcag

SEQ ID NO: 670569 - DNA, 20 bp, mouse
gcggcgagcggaaagtgacg

SEQ ID NO: 670570 - DNA, 20 bp, mouse
gcgccgcaggcctacgtggg

SEQ ID NO: 670571 - DNA, 20 bp, mouse
gcgcccctgccagttgttcc

SEQ ID NO: 670572 - DNA, 20 bp, mouse
gaggtggcgcgcgcggcgag

SEQ ID NO: 670573 - DNA, 20 bp, mouse
gactccaggaacaactggca

SEQ ID NO: 670574 - DNA, 20 bp, mouse
ggccacctcccgctctagag

SEQ ID NO: 670575 - DNA, 20 bp, mouse
gaatgccgctctagagcggg

SEQ ID NO: 670576 - DNA, 20 bp, mouse
ggcaggggtcagatctcaat

SEQ ID NO: 670577 - DNA, 20 bp, mouse
gcatcccctagcaacgttta

SEQ ID NO: 670578 - DNA, 20 bp, mouse
gtatgcgcgctcttttgcgg

SEQ ID NO: 670579 - DNA, 20 bp, mouse
gaccgccataaacgttgcta

SEQ ID NO: 670580 - DNA, 20 bp, mouse
gtccgtgtgagcttgcgcgc

SEQ ID NO: 670581 - DNA, 20 bp, mouse
gggggccggtccaggaggcg

SEQ ID NO: 670582 - DNA, 20 bp, mouse
gagagccccgcctcctggac

SEQ ID NO: 670583 - DNA, 20 bp, mouse
gctctatgcgcgctcttttg

SEQ ID NO: 670584 - DNA, 20 bp, mouse
gcccctagcaacgtttatgg

SEQ ID NO: 670585 - DNA, 20 bp, mouse
gtgggcggggccggtccagg

SEQ ID NO: 670586 - DNA, 20 bp, mouse
gacgacatggcgaccgagag

SEQ ID NO: 670587 - DNA, 20 bp, mouse
gtgggagcgattcgcagctg

SEQ ID NO: 670588 - DNA, 20 bp, mouse
gagcccgcgagcaagctgga

SEQ ID NO: 670589 - DNA, 20 bp, mouse
ggaaggcgccgagacccaga

SEQ ID NO: 670590 - DNA, 20 bp, mouse
gcgagaaccggccctggcag

SEQ ID NO: 670591 - DNA, 20 bp, mouse
ggaactgagcgagcgagaac

SEQ ID NO: 670592 - DNA, 20 bp, mouse
ggccggaagcgctttttgat

SEQ ID NO: 670593 - DNA, 20 bp, mouse
gacggacaaaagctgcgccg

SEQ ID NO: 670594 - DNA, 20 bp, mouse
gaaaagctgcgccgcggctc

SEQ ID NO: 670595 - DNA, 20 bp, mouse
gagcgagcgagaaccggccc

SEQ ID NO: 670596 - DNA, 20 bp, mouse
ggaggcgccctcgtcctgat

SEQ ID NO: 670597 - DNA, 20 bp, mouse
gctgccgcccacaataaaca

SEQ ID NO: 670598 - DNA, 20 bp, mouse
gcgccgggcgtcagagggac

SEQ ID NO: 670599 - DNA, 20 bp, mouse
ggaacaacgcggcgcaatag

SEQ ID NO: 670600 - DNA, 20 bp, mouse
gactgagggcaaggcttgga

SEQ ID NO: 670601 - DNA, 20 bp, mouse
gacgcggcgcaataggggat

SEQ ID NO: 670602 - DNA, 20 bp, mouse
gatgcgggaaagtttcgcac

SEQ ID NO: 670603 - DNA, 20 bp, mouse
gccgcccacaataaacatgg

SEQ ID NO: 670604 - DNA, 20 bp, mouse
gcccacaataaacatggcgg

SEQ ID NO: 670605 - DNA, 20 bp, mouse
ggcgctcgccgggcgtcaga

SEQ ID NO: 670606 - DNA, 20 bp, mouse
gaagagtggcggttcctgcc

SEQ ID NO: 670607 - DNA, 20 bp, mouse
ggggcgcggtacgcatgtcc

SEQ ID NO: 670608 - DNA, 20 bp, mouse
gggcccgcctctctagtggg

SEQ ID NO: 670609 - DNA, 20 bp, mouse
gcaaggcccgcctctctagt

SEQ ID NO: 670610 - DNA, 20 bp, mouse
ggccccgcccactagagagg

SEQ ID NO: 670611 - DNA, 20 bp, mouse
gcgcgccccgcccactagag

SEQ ID NO: 670612 - DNA, 20 bp, mouse
gggactcatgtgagtggagg

SEQ ID NO: 670613 - DNA, 20 bp, mouse
gcggtacgcatgtccgggcg

SEQ ID NO: 670614 - DNA, 20 bp, mouse
ggaacaggctcttttaagag

SEQ ID NO: 670615 - DNA, 20 bp, mouse
gatcttgggagtggggagta

SEQ ID NO: 670616 - DNA, 20 bp, mouse
ggcagccgaagcagtgcgga

SEQ ID NO: 670617 - DNA, 20 bp, mouse
ggtccccgccgagccccggt

SEQ ID NO: 670618 - DNA, 20 bp, mouse
gagtcgctgtactcagagac

SEQ ID NO: 670619 - DNA, 20 bp, mouse
ggatctagggccatcccacc

SEQ ID NO: 670620 - DNA, 20 bp, mouse
gccatcccaccggggctcgg

SEQ ID NO: 670621 - DNA, 20 bp, mouse
ggggccatcccaccggggct

SEQ ID NO: 670622 - DNA, 20 bp, mouse
gtctgagtacagcgactctg

SEQ ID NO: 670623 - DNA, 20 bp, mouse
gcaagccctccgcactgctt

SEQ ID NO: 670624 - DNA, 20 bp, mouse
gtgggacagtggaccggtcc

SEQ ID NO: 670625 - DNA, 20 bp, mouse
gccatgctgagggggatcta

SEQ ID NO: 670626 - DNA, 20 bp, mouse
ggcgccggtgggccaggaaa

SEQ ID NO: 670627 - DNA, 20 bp, mouse
gataagctgccgtgtgcgga

SEQ ID NO: 670628 - DNA, 20 bp, mouse
gtccggccagtctgatgatc

SEQ ID NO: 670629 - DNA, 20 bp, mouse
gaagatggcatgctctgggg

SEQ ID NO: 670630 - DNA, 20 bp, mouse
ggcacacggcagcttatctc

SEQ ID NO: 670631 - DNA, 20 bp, mouse
ggtgaggcgtggggagtatc

SEQ ID NO: 670632 - DNA, 20 bp, mouse
gtggtctcgatgaaggtgca

SEQ ID NO: 670633 - DNA, 20 bp, mouse
gaggcgtggggagtatccgg

SEQ ID NO: 670634 - DNA, 20 bp, mouse
gcaaggtggttctcgaggtg

SEQ ID NO: 670635 - DNA, 20 bp, mouse
gctggggcgcatgcgcaagg

SEQ ID NO: 670636 - DNA, 20 bp, mouse
ggggatgggcggccgttgga

SEQ ID NO: 670637 - DNA, 20 bp, mouse
gtggcccagtggccgttaga

SEQ ID NO: 670638 - DNA, 20 bp, mouse
gggaacgaaccaactcgcag

SEQ ID NO: 670639 - DNA, 20 bp, mouse
gaaccaactcgcagaggcgg

SEQ ID NO: 670640 - DNA, 20 bp, mouse
ggaacgtcgtccgaggccgt

SEQ ID NO: 670641 - DNA, 20 bp, mouse
ggggcagccaggagacttca

SEQ ID NO: 670642 - DNA, 20 bp, mouse
ggagctcttacgtcaccgaa

SEQ ID NO: 670643 - DNA, 20 bp, mouse
gttcgcgggccgtcaggctc

SEQ ID NO: 670644 - DNA, 20 bp, mouse
gccccgccgcctctgcgagt

SEQ ID NO: 670645 - DNA, 20 bp, mouse
gtggagggtgacgtgcaatt

SEQ ID NO: 670646 - DNA, 20 bp, mouse
ggacgcgcgcccgcaatgtc

SEQ ID NO: 670647 - DNA, 20 bp, mouse
gtgaccccggcgtctgggtt

SEQ ID NO: 670648 - DNA, 20 bp, mouse
ggcgcccgcaatgtccggat

SEQ ID NO: 670649 - DNA, 20 bp, mouse
gggaaccggaagcgtcagtg

SEQ ID NO: 670650 - DNA, 20 bp, mouse
gcggcgagcgggtgtgaccc

SEQ ID NO: 670651 - DNA, 20 bp, mouse
ggaaccgaacccagacgccg

SEQ ID NO: 670652 - DNA, 20 bp, mouse
gcccgctcgccgcaggagct

SEQ ID NO: 670653 - DNA, 20 bp, mouse
gcgcaatgtccggattggat

SEQ ID NO: 670654 - DNA, 20 bp, mouse
gctcggcagccaatcaaatc

SEQ ID NO: 670655 - DNA, 20 bp, mouse
ggtgcgctgtggagcacgtc

SEQ ID NO: 670656 - DNA, 20 bp, mouse
gaactaggggactagaagta

SEQ ID NO: 670657 - DNA, 20 bp, mouse
ggctgcttgagcagttagga

SEQ ID NO: 670658 - DNA, 20 bp, mouse
gcggtctcatgttaaccctg

SEQ ID NO: 670659 - DNA, 20 bp, mouse
gttggactacagttcccgtg

SEQ ID NO: 670660 - DNA, 20 bp, mouse
ggacccggttccccagctgt

SEQ ID NO: 670661 - DNA, 20 bp, mouse
gagtccaacagctggggaac

SEQ ID NO: 670662 - DNA, 20 bp, mouse
gtgctgccacatggccccac

SEQ ID NO: 670663 - DNA, 20 bp, mouse
gggaactgtagtccaacagc

SEQ ID NO: 670664 - DNA, 20 bp, mouse
gaacctgaacccgtaaggaa

SEQ ID NO: 670665 - DNA, 20 bp, mouse
gagacttgactcaaaatagg

SEQ ID NO: 670666 - DNA, 20 bp, mouse
gaggcctgcgagcccggctg

SEQ ID NO: 670667 - DNA, 20 bp, mouse
gaacctgaaggccccggggg

SEQ ID NO: 670668 - DNA, 20 bp, mouse
gggggccggccgagcgctga

SEQ ID NO: 670669 - DNA, 20 bp, mouse
gggggccttcaggttgtcgg

SEQ ID NO: 670670 - DNA, 20 bp, mouse
gcaccacccccggggccttc

SEQ ID NO: 670671 - DNA, 20 bp, mouse
gcccgcctccgacaacctga

SEQ ID NO: 670672 - DNA, 20 bp, mouse
gcggccagggtctcttagtt

SEQ ID NO: 670673 - DNA, 20 bp, mouse
gtagaccctcagcgctcggc

SEQ ID NO: 670674 - DNA, 20 bp, mouse
gcgctcccggagcaggacta

SEQ ID NO: 670675 - DNA, 20 bp, mouse
ggggacgcgcatcggccggc

SEQ ID NO: 670676 - DNA, 20 bp, mouse
ggatggactcctcaggaaaa

SEQ ID NO: 670677 - DNA, 20 bp, mouse
gcaccggaagcgcaggctgg

SEQ ID NO: 670678 - DNA, 20 bp, mouse
ggactcttggttccatacaa

SEQ ID NO: 670679 - DNA, 20 bp, mouse
gagcacagaagggttttact

SEQ ID NO: 670680 - DNA, 20 bp, mouse
ggctggaggatggactcctc

SEQ ID NO: 670681 - DNA, 20 bp, mouse
gaccgcagcaccggaagcgc

SEQ ID NO: 670682 - DNA, 20 bp, mouse
gtaagggagggaacaatgaa

SEQ ID NO: 670683 - DNA, 20 bp, mouse
gaccactcggcggtgtgggg

SEQ ID NO: 670684 - DNA, 20 bp, mouse
gacagccgtgcgccgtccgg

SEQ ID NO: 670685 - DNA, 20 bp, mouse
ggcctccccacaccgccgag

SEQ ID NO: 670686 - DNA, 20 bp, mouse
gtccccagccagaatcctcg

SEQ ID NO: 670687 - DNA, 20 bp, mouse
ggagcaccgcgcacattgca

SEQ ID NO: 670688 - DNA, 20 bp, mouse
gaacttgcaggcgctatgta

SEQ ID NO: 670689 - DNA, 20 bp, mouse
ggccaggagctgctgcgtaa

SEQ ID NO: 670690 - DNA, 20 bp, mouse
ggaactgtggtgcgtagacg

SEQ ID NO: 670691 - DNA, 20 bp, mouse
gggcgcctgcgtgcgcatcc

SEQ ID NO: 670692 - DNA, 20 bp, mouse
gcaagaggatggaaatcgta

SEQ ID NO: 670693 - DNA, 20 bp, mouse
gaggatggaaatcgtagggg

SEQ ID NO: 670694 - DNA, 20 bp, mouse
gccgccgcgcagtgcttgcc

SEQ ID NO: 670695 - DNA, 20 bp, mouse
gtacaagtccagtgtcgcta

SEQ ID NO: 670696 - DNA, 20 bp, mouse
gtctgcgcgcgctcaatttg

SEQ ID NO: 670697 - DNA, 20 bp, mouse
gagcccgccaggttcatacc

SEQ ID NO: 670698 - DNA, 20 bp, mouse
gcacagactcggcgcccaga

SEQ ID NO: 670699 - DNA, 20 bp, mouse
gcagaggcggcaagggtggc

SEQ ID NO: 670700 - DNA, 20 bp, mouse
gaagcttccgggtatgaacc

SEQ ID NO: 670701 - DNA, 20 bp, mouse
gactagtggacgggacgggg

SEQ ID NO: 670702 - DNA, 20 bp, mouse
gcggactagtggacgggacg

SEQ ID NO: 670703 - DNA, 20 bp, mouse
gtcctccggttgttgcctta

SEQ ID NO: 670704 - DNA, 20 bp, mouse
gcttccgggtatgaacctgg

SEQ ID NO: 670705 - DNA, 20 bp, mouse
gagcgcgcgcagaggcggca

SEQ ID NO: 670706 - DNA, 20 bp, mouse
ggagggccaatcacacccaa

SEQ ID NO: 670707 - DNA, 20 bp, mouse
gaaacacaggaagctcccga

SEQ ID NO: 670708 - DNA, 20 bp, mouse
gaggcgctgggaagttactt

SEQ ID NO: 670709 - DNA, 20 bp, mouse
gtcccagcgcctcaaactat

SEQ ID NO: 670710 - DNA, 20 bp, mouse
gagaactgtgctgtggtatc

SEQ ID NO: 670711 - DNA, 20 bp, mouse
gggagtgatctttcagcctt

SEQ ID NO: 670712 - DNA, 20 bp, mouse
ggcctgaccacagagactgc

SEQ ID NO: 670713 - DNA, 20 bp, mouse
gccttcctaagagtgctgag

SEQ ID NO: 670714 - DNA, 20 bp, mouse
ggacaattgttcctctagct

SEQ ID NO: 670715 - DNA, 20 bp, mouse
gaccagcagtctctgtggtc

SEQ ID NO: 670716 - DNA, 20 bp, mouse
gagcatgcgaactgcccgaa

SEQ ID NO: 670717 - DNA, 20 bp, mouse
gactgctcctcaagtccgag

SEQ ID NO: 670718 - DNA, 20 bp, mouse
gcgggcagttcgcatgctaa

SEQ ID NO: 670719 - DNA, 20 bp, mouse
gtgctggcgccatttctcgg

SEQ ID NO: 670720 - DNA, 20 bp, mouse
ggtcccgccccctcgagctg

SEQ ID NO: 670721 - DNA, 20 bp, mouse
gctaacccggagcgtcgcca

SEQ ID NO: 670722 - DNA, 20 bp, mouse
gtcccgccccctcggacttg

SEQ ID NO: 670723 - DNA, 20 bp, mouse
gaatgccagccgcagctcga

SEQ ID NO: 670724 - DNA, 20 bp, mouse
gagcagtgacagacctaacc

SEQ ID NO: 670725 - DNA, 20 bp, mouse
ggggccgtccagcaaaccgg

SEQ ID NO: 670726 - DNA, 20 bp, mouse
gcaagagccccggggagacg

SEQ ID NO: 670727 - DNA, 20 bp, mouse
gctcttggaaagagcgtcaa

SEQ ID NO: 670728 - DNA, 20 bp, mouse
gcgcggcctgtgacccggga

SEQ ID NO: 670729 - DNA, 20 bp, mouse
gcttgcgcggcctgtgaccc

SEQ ID NO: 670730 - DNA, 20 bp, mouse
gtggtcgcaagcggaaaggc

SEQ ID NO: 670731 - DNA, 20 bp, mouse
gaatgcagccgcgtctcccc

SEQ ID NO: 670732 - DNA, 20 bp, mouse
gtggaaagagcgtcaaaggg

SEQ ID NO: 670733 - DNA, 20 bp, mouse
gctgctggtcgcaagcggaa

SEQ ID NO: 670734 - DNA, 20 bp, mouse
gacgctctttccaagagccc

SEQ ID NO: 670735 - DNA, 20 bp, mouse
gcccgcaggccgagagcccg

SEQ ID NO: 670736 - DNA, 20 bp, mouse
gttccgggaaaggcaagtag

SEQ ID NO: 670737 - DNA, 20 bp, mouse
gtgcctttcccggaagaaac

SEQ ID NO: 670738 - DNA, 20 bp, mouse
gtaagcggtctttacagacc

SEQ ID NO: 670739 - DNA, 20 bp, mouse
gagccagtttcttccgggaa

SEQ ID NO: 670740 - DNA, 20 bp, mouse
gcaggagtttgcggcttcac

SEQ ID NO: 670741 - DNA, 20 bp, mouse
gggcgcgtcttgtgctctag

SEQ ID NO: 670742 - DNA, 20 bp, mouse
gggccctgctcagagcatgc

SEQ ID NO: 670743 - DNA, 20 bp, mouse
gccggaagaaactggctaag

SEQ ID NO: 670744 - DNA, 20 bp, mouse
gaggacataacaagctagta

SEQ ID NO: 670745 - DNA, 20 bp, mouse
gaatggcttaaggcttggag

SEQ ID NO: 670746 - DNA, 20 bp, mouse
gcggggagcccgaacctctg

SEQ ID NO: 670747 - DNA, 20 bp, mouse
gcacctgtgaaaggtcattg

SEQ ID NO: 670748 - DNA, 20 bp, mouse
gcggtcgcggcccacaagga

SEQ ID NO: 670749 - DNA, 20 bp, mouse
gcgcgccggccgcccggaga

SEQ ID NO: 670750 - DNA, 20 bp, mouse
ggggagaaacgtaaacaagt

SEQ ID NO: 670751 - DNA, 20 bp, mouse
ggatcgccctgtcttccccc

SEQ ID NO: 670752 - DNA, 20 bp, mouse
gaggtcctcgggcaccgcag

SEQ ID NO: 670753 - DNA, 20 bp, mouse
gtgcccggaaacgtaacggc

SEQ ID NO: 670754 - DNA, 20 bp, mouse
gtaacggccggccgatgccg

SEQ ID NO: 670755 - DNA, 20 bp, mouse
gtgcaaggacagtgacatcc

SEQ ID NO: 670756 - DNA, 20 bp, mouse
gaacccgcctcccacaaggt

SEQ ID NO: 670757 - DNA, 20 bp, mouse
gacggctgggcggagctatg

SEQ ID NO: 670758 - DNA, 20 bp, mouse
gagagcgcggctgttcgaag

SEQ ID NO: 670759 - DNA, 20 bp, mouse
gaagagggcgccagtggcgg

SEQ ID NO: 670760 - DNA, 20 bp, mouse
gcggcggcgattggaggagg

SEQ ID NO: 670761 - DNA, 20 bp, mouse
gtcctagctaacctctggga

SEQ ID NO: 670762 - DNA, 20 bp, mouse
gtgttcgaagagggcgccag

SEQ ID NO: 670763 - DNA, 20 bp, mouse
ggagcagcggcggcgattgg

SEQ ID NO: 670764 - DNA, 20 bp, mouse
gacttctcaaccgaccttgt

SEQ ID NO: 670765 - DNA, 20 bp, mouse
gaatcgccgccgctgctcga

SEQ ID NO: 670766 - DNA, 20 bp, mouse
ggcaacgggcaaagcctcgt

SEQ ID NO: 670767 - DNA, 20 bp, mouse
gtgactgagagcgttggcat

SEQ ID NO: 670768 - DNA, 20 bp, mouse
gggtcgctgactgagagcgt

SEQ ID NO: 670769 - DNA, 20 bp, mouse
gggttaaaagagagacctga

SEQ ID NO: 670770 - DNA, 20 bp, mouse
gctctcagtcagcgacctat

SEQ ID NO: 670771 - DNA, 20 bp, mouse
gacctattggctcttggtag

SEQ ID NO: 670772 - DNA, 20 bp, mouse
gtcccactcccaccacaaag

SEQ ID NO: 670773 - DNA, 20 bp, mouse
gtcgctgcagggcaacaccc

SEQ ID NO: 670774 - DNA, 20 bp, mouse
gaacctctttgtggtgggag

SEQ ID NO: 670775 - DNA, 20 bp, mouse
ggataagagaatttctcccg

SEQ ID NO: 670776 - DNA, 20 bp, mouse
ggggcagctgcgagagcgtg

SEQ ID NO: 670777 - DNA, 20 bp, mouse
gtcgcagctgcccactgcgc

SEQ ID NO: 670778 - DNA, 20 bp, mouse
gtgcgcaggcgcctcgcaaa

SEQ ID NO: 670779 - DNA, 20 bp, mouse
gcgcgccaactccacgcgga

SEQ ID NO: 670780 - DNA, 20 bp, mouse
ggcagcgcgccaactccacg

SEQ ID NO: 670781 - DNA, 20 bp, mouse
gcaactccacgcggagggcg

SEQ ID NO: 670782 - DNA, 20 bp, mouse
gcagacccagacaatgaaag

SEQ ID NO: 670783 - DNA, 20 bp, mouse
ggtgaggcatcgctgggccc

SEQ ID NO: 670784 - DNA, 20 bp, mouse
gttgttcaagactgtcttga

SEQ ID NO: 670785 - DNA, 20 bp, mouse
gcagcgatgcctcactgcgc

SEQ ID NO: 670786 - DNA, 20 bp, mouse
ggggccgcgcgtaacctctg

SEQ ID NO: 670787 - DNA, 20 bp, mouse
gcgtcccggcgcaccggatc

SEQ ID NO: 670788 - DNA, 20 bp, mouse
gcgggtggacggaacgggag

SEQ ID NO: 670789 - DNA, 20 bp, mouse
ggagtccagctcacctgctg

SEQ ID NO: 670790 - DNA, 20 bp, mouse
gcgggacgggtggacggaac

SEQ ID NO: 670791 - DNA, 20 bp, mouse
gccccccggaaaccaggtta

SEQ ID NO: 670792 - DNA, 20 bp, mouse
gaacctctggggcggcgctg

SEQ ID NO: 670793 - DNA, 20 bp, mouse
gccgccccagaggttacgcg

SEQ ID NO: 670794 - DNA, 20 bp, mouse
ggggctcgggacaggatggt

SEQ ID NO: 670795 - DNA, 20 bp, mouse
ggtgtcgcggcagacgtcag

SEQ ID NO: 670796 - DNA, 20 bp, mouse
gccccggccgggatgacgag

SEQ ID NO: 670797 - DNA, 20 bp, mouse
ggagttgtagggagatccta

SEQ ID NO: 670798 - DNA, 20 bp, mouse
gggcaagctgcggtcaccga

SEQ ID NO: 670799 - DNA, 20 bp, mouse
gggagcccgacgcccgaaag

SEQ ID NO: 670800 - DNA, 20 bp, mouse
ggaccagccaggctgcccaa

SEQ ID NO: 670801 - DNA, 20 bp, mouse
ggggcgctcggggcaagctg

SEQ ID NO: 670802 - DNA, 20 bp, mouse
gcggttgtgggcaggaagcg

SEQ ID NO: 670803 - DNA, 20 bp, mouse
gacgcccgaaaggggcgctc

SEQ ID NO: 670804 - DNA, 20 bp, mouse
gcctaggtgggcccttggac

SEQ ID NO: 670805 - DNA, 20 bp, mouse
gggctggcctctccggaacc

SEQ ID NO: 670806 - DNA, 20 bp, mouse
gcgggattgggctaggctcg

SEQ ID NO: 670807 - DNA, 20 bp, mouse
ggcttcgggccttcaaatcc

SEQ ID NO: 670808 - DNA, 20 bp, mouse
ggctaggctcggggaagagg

SEQ ID NO: 670809 - DNA, 20 bp, mouse
gtctgagcccgcccgggatt

SEQ ID NO: 670810 - DNA, 20 bp, mouse
gggtaagaaccgcgtgttcc

SEQ ID NO: 670811 - DNA, 20 bp, mouse
gcacaacggcgcctacggga

SEQ ID NO: 670812 - DNA, 20 bp, mouse
gcgaagccgcgcagtttaga

SEQ ID NO: 670813 - DNA, 20 bp, mouse
gaatcccatggttttcacaa

SEQ ID NO: 670814 - DNA, 20 bp, mouse
gcgcgagctctccctccagt

SEQ ID NO: 670815 - DNA, 20 bp, mouse
ggcctagcccaatcccgggc

SEQ ID NO: 670816 - DNA, 20 bp, mouse
gtatccccccctttcctttt

SEQ ID NO: 670817 - DNA, 20 bp, mouse
gagcactgaacgttctgagg

SEQ ID NO: 670818 - DNA, 20 bp, mouse
gtctagcactgaacgttctg

SEQ ID NO: 670819 - DNA, 20 bp, mouse
gcaaactcccgccctttcgt

SEQ ID NO: 670820 - DNA, 20 bp, mouse
gtcccggcgctcggctggac

SEQ ID NO: 670821 - DNA, 20 bp, mouse
ggcccgtaagctcccgcctg

SEQ ID NO: 670822 - DNA, 20 bp, mouse
gttgggcttctctagtaagt

SEQ ID NO: 670823 - DNA, 20 bp, mouse
gtatggcgagaggtttgcag

SEQ ID NO: 670824 - DNA, 20 bp, mouse
gctctcgccatattaagtac

SEQ ID NO: 670825 - DNA, 20 bp, mouse
gcagtgctagaattcagaga

SEQ ID NO: 670826 - DNA, 20 bp, mouse
gtactgccctgctgcctgtg

SEQ ID NO: 670827 - DNA, 20 bp, mouse
ggaagccatccgtgcacaga

SEQ ID NO: 670828 - DNA, 20 bp, mouse
gcctaagaacagggctcagg

SEQ ID NO: 670829 - DNA, 20 bp, mouse
gagggaagaggaacgaagcc

SEQ ID NO: 670830 - DNA, 20 bp, mouse
gggcagtagctacactcttc

SEQ ID NO: 670831 - DNA, 20 bp, mouse
gaggatgcttacttgataca

SEQ ID NO: 670832 - DNA, 20 bp, mouse
gtctgctctctccctctcga

SEQ ID NO: 670833 - DNA, 20 bp, mouse
gtcaatgctggccctccctc

SEQ ID NO: 670834 - DNA, 20 bp, mouse
gaccctggaaaccctcgaga

SEQ ID NO: 670835 - DNA, 20 bp, mouse
gcgggcatgcaaacatcatg

SEQ ID NO: 670836 - DNA, 20 bp, mouse
gaactgcaaaacagatgcag

SEQ ID NO: 670837 - DNA, 20 bp, mouse
gatcgtatagcctgtgtcag

SEQ ID NO: 670838 - DNA, 20 bp, mouse
ggaatcaagctcaatcaggg

SEQ ID NO: 670839 - DNA, 20 bp, mouse
gtggtaccatcattgatggt

SEQ ID NO: 670840 - DNA, 20 bp, mouse
ggacaagagcgacagaggtc

SEQ ID NO: 670841 - DNA, 20 bp, mouse
ggacagaggtctggataggt

SEQ ID NO: 670842 - DNA, 20 bp, mouse
gcggtcttacttaactctct

SEQ ID NO: 670843 - DNA, 20 bp, mouse
gctgcagacaagagcgacag

SEQ ID NO: 670844 - DNA, 20 bp, mouse
gggggaactaattttcgtcg

SEQ ID NO: 670845 - DNA, 20 bp, mouse
ggcggaatcaagctcaatca

SEQ ID NO: 670846 - DNA, 20 bp, mouse
gaggcagggcgggagcagtc

SEQ ID NO: 670847 - DNA, 20 bp, mouse
gtccccgcatcctctagcct

SEQ ID NO: 670848 - DNA, 20 bp, mouse
gtgtccggagacggttccgc

SEQ ID NO: 670849 - DNA, 20 bp, mouse
gaggagcgcgatcggacccg

SEQ ID NO: 670850 - DNA, 20 bp, mouse
gctcctctgcggatagactc

SEQ ID NO: 670851 - DNA, 20 bp, mouse
gaggccagccatgttgagtg

SEQ ID NO: 670852 - DNA, 20 bp, mouse
gtctccggacagttctcgcg

SEQ ID NO: 670853 - DNA, 20 bp, mouse
gcggccacactcaacatggc

SEQ ID NO: 670854 - DNA, 20 bp, mouse
gacccagggttgcattcctg

SEQ ID NO: 670855 - DNA, 20 bp, mouse
gcatggctggccttcaccca

SEQ ID NO: 670856 - DNA, 20 bp, mouse
gtactgcttcggcccgggcg

SEQ ID NO: 670857 - DNA, 20 bp, mouse
gcccgggccgaagcagtaaa

SEQ ID NO: 670858 - DNA, 20 bp, mouse
gtgcgcagacctgagaaggg

SEQ ID NO: 670859 - DNA, 20 bp, mouse
gcgcctgcgcagacctgaga

SEQ ID NO: 670860 - DNA, 20 bp, mouse
gcccagctcctgcctgagcg

SEQ ID NO: 670861 - DNA, 20 bp, mouse
gaggatccaagctgcgctag

SEQ ID NO: 670862 - DNA, 20 bp, mouse
gcggaagagaggttacaggg

SEQ ID NO: 670863 - DNA, 20 bp, mouse
gcctgggcagccgagccaat

SEQ ID NO: 670864 - DNA, 20 bp, mouse
gacagggaggcggctgagtg

SEQ ID NO: 670865 - DNA, 20 bp, mouse
gggggggagggtctggcctc

SEQ ID NO: 670866 - DNA, 20 bp, mouse
gaagctgcgcgaacggagtg

SEQ ID NO: 670867 - DNA, 20 bp, mouse
gacttcgcgggagtctgggg

SEQ ID NO: 670868 - DNA, 20 bp, mouse
gcctgcagaagcccgagtgg

SEQ ID NO: 670869 - DNA, 20 bp, mouse
gttcgcgctggagaacacga

SEQ ID NO: 670870 - DNA, 20 bp, mouse
gcggcggcggtggagatccc

SEQ ID NO: 670871 - DNA, 20 bp, mouse
gcggaagtgacgtcgaggag

SEQ ID NO: 670872 - DNA, 20 bp, mouse
ggagaacacgatggctgcga

SEQ ID NO: 670873 - DNA, 20 bp, mouse
gcgactcggcctgtgggcgg

SEQ ID NO: 670874 - DNA, 20 bp, mouse
gctgcctgcagaagcccgag

SEQ ID NO: 670875 - DNA, 20 bp, mouse
gcagaggtgctgtgacttcg

SEQ ID NO: 670876 - DNA, 20 bp, mouse
ggggcctgcaatctgagtga

SEQ ID NO: 670877 - DNA, 20 bp, mouse
ggggtctgcaatctgaggaa

SEQ ID NO: 670878 - DNA, 20 bp, mouse
ggagcctgagggcggggcaa

SEQ ID NO: 670879 - DNA, 20 bp, mouse
gggctctggaatcagaggga

SEQ ID NO: 670880 - DNA, 20 bp, mouse
gtctgcaatcagaggacggg

SEQ ID NO: 670881 - DNA, 20 bp, mouse
ggggtctgcaatcagaggac

SEQ ID NO: 670882 - DNA, 20 bp, mouse
gcctgagggcggggcaaagg

SEQ ID NO: 670883 - DNA, 20 bp, mouse
gtagccgggcagacgggtag

SEQ ID NO: 670884 - DNA, 20 bp, mouse
ggagccaaggacagagtcgg

SEQ ID NO: 670885 - DNA, 20 bp, mouse
gtctgcaatctgaggaaagg

SEQ ID NO: 670886 - DNA, 20 bp, mouse
gctctgggagcgtctgaaaa

SEQ ID NO: 670887 - DNA, 20 bp, mouse
gcagacgttgccgttcccgc

SEQ ID NO: 670888 - DNA, 20 bp, mouse
gaagagcccgcctcctctct

SEQ ID NO: 670889 - DNA, 20 bp, mouse
gatcgcggagcctgcgggaa

SEQ ID NO: 670890 - DNA, 20 bp, mouse
gcaacgtctgagttgacaga

SEQ ID NO: 670891 - DNA, 20 bp, mouse
ggatgacggaagctgaataa

SEQ ID NO: 670892 - DNA, 20 bp, mouse
gaaaagaggacaacttctgg

SEQ ID NO: 670893 - DNA, 20 bp, mouse
ggtgacgtcaccgagagagg

SEQ ID NO: 670894 - DNA, 20 bp, mouse
gggcgagctgcgaaccctat

SEQ ID NO: 670895 - DNA, 20 bp, mouse
gtagcgcatcgcggagcctg

SEQ ID NO: 670896 - DNA, 20 bp, mouse
ggggccgatccccaccgacg

SEQ ID NO: 670897 - DNA, 20 bp, mouse
gcagccccgtcggtggggat

SEQ ID NO: 670898 - DNA, 20 bp, mouse
ggggcaggggcggctcccgg

SEQ ID NO: 670899 - DNA, 20 bp, mouse
gaaagcgcatgcgccctggc

SEQ ID NO: 670900 - DNA, 20 bp, mouse
ggagcatcggcgtaccccgg

SEQ ID NO: 670901 - DNA, 20 bp, mouse
gcagtggcgcgctggactcg

SEQ ID NO: 670902 - DNA, 20 bp, mouse
gagcagccggtcttagtcag

SEQ ID NO: 670903 - DNA, 20 bp, mouse
gggtactctgcccgagggcg

SEQ ID NO: 670904 - DNA, 20 bp, mouse
ggctcccggcggtcccgggc

SEQ ID NO: 670905 - DNA, 20 bp, mouse
ggacccgcaaagacagccat

SEQ ID NO: 670906 - DNA, 20 bp, mouse
gccgcggcccgggtttccga

SEQ ID NO: 670907 - DNA, 20 bp, mouse
ggacgcgcgcgcagtgggta

SEQ ID NO: 670908 - DNA, 20 bp, mouse
gggtagacgccggagttcga

SEQ ID NO: 670909 - DNA, 20 bp, mouse
gagtccaagcgctgcggcag

SEQ ID NO: 670910 - DNA, 20 bp, mouse
gacagcgtgcagtaaagaag

SEQ ID NO: 670911 - DNA, 20 bp, mouse
gaggtcgagcgtcgccatgg

SEQ ID NO: 670912 - DNA, 20 bp, mouse
gtgggtgagtccaagcgctg

SEQ ID NO: 670913 - DNA, 20 bp, mouse
ggtgacccagaagaagggcg

SEQ ID NO: 670914 - DNA, 20 bp, mouse
gcgctctcaagccccggatg

SEQ ID NO: 670915 - DNA, 20 bp, mouse
gcggcccgcgcctctggaag

SEQ ID NO: 670916 - DNA, 20 bp, mouse
gcgcgctctccgcggatcga

SEQ ID NO: 670917 - DNA, 20 bp, mouse
gcgcccttgccgcttctccg

SEQ ID NO: 670918 - DNA, 20 bp, mouse
ggagaagcggcaagggcgga

SEQ ID NO: 670919 - DNA, 20 bp, mouse
ggcagatacgagctgtggat

SEQ ID NO: 670920 - DNA, 20 bp, mouse
gggcgcccgcactcctgggg

SEQ ID NO: 670921 - DNA, 20 bp, mouse
gccatggcagatacgagctg

SEQ ID NO: 670922 - DNA, 20 bp, mouse
gcataggccagggtcctgca

SEQ ID NO: 670923 - DNA, 20 bp, mouse
gagaagctccggccacccat

SEQ ID NO: 670924 - DNA, 20 bp, mouse
gacagcggagaaagaagctc

SEQ ID NO: 670925 - DNA, 20 bp, mouse
gcgcgccttgctatccgcgt

SEQ ID NO: 670926 - DNA, 20 bp, mouse
gcagcaagtccgggtccggt

SEQ ID NO: 670927 - DNA, 20 bp, mouse
gcggagctaacgatagagcg

SEQ ID NO: 670928 - DNA, 20 bp, mouse
gagtccgggtccggtgggag

SEQ ID NO: 670929 - DNA, 20 bp, mouse
gagaagccccgccccgtggg

SEQ ID NO: 670930 - DNA, 20 bp, mouse
gaccacctggcgcgccggga

SEQ ID NO: 670931 - DNA, 20 bp, mouse
gtgactgagcgactatcagg

SEQ ID NO: 670932 - DNA, 20 bp, mouse
ggttagctccgcccacgggg

SEQ ID NO: 670933 - DNA, 20 bp, mouse
ggatggcctcccagcggggc

SEQ ID NO: 670934 - DNA, 20 bp, mouse
gacaacaccacctggcgcgc

SEQ ID NO: 670935 - DNA, 20 bp, mouse
ggctcgcagtcagggcgtga

SEQ ID NO: 670936 - DNA, 20 bp, mouse
gaacgcaatggggttgtcct

SEQ ID NO: 670937 - DNA, 20 bp, mouse
gcagcggattaggatggctt

SEQ ID NO: 670938 - DNA, 20 bp, mouse
gaaccccattgcgttcagtg

SEQ ID NO: 670939 - DNA, 20 bp, mouse
ggtgcaacctcaccctgctc

SEQ ID NO: 670940 - DNA, 20 bp, mouse
gggagtaggtgcgaatgccc

SEQ ID NO: 670941 - DNA, 20 bp, mouse
gcaatggggttgtcctgggg

SEQ ID NO: 670942 - DNA, 20 bp, mouse
gggaccaagcctgcaagggg

SEQ ID NO: 670943 - DNA, 20 bp, mouse
gaaaccgcactgaacgcaat

SEQ ID NO: 670944 - DNA, 20 bp, mouse
gggggagcatctcaggggct

SEQ ID NO: 670945 - DNA, 20 bp, mouse
gagaacttttggaagtgcgt

SEQ ID NO: 670946 - DNA, 20 bp, mouse
gactggcgacggaggacgtg

SEQ ID NO: 670947 - DNA, 20 bp, mouse
gctgcgcgcagggcagaacg

SEQ ID NO: 670948 - DNA, 20 bp, mouse
ggcgcagggcagaacgaggc

SEQ ID NO: 670949 - DNA, 20 bp, mouse
gatagcgaggccacctcctt

SEQ ID NO: 670950 - DNA, 20 bp, mouse
ggtggacggcgtcgatcagg

SEQ ID NO: 670951 - DNA, 20 bp, mouse
ggtaggtcgaggactggcga

SEQ ID NO: 670952 - DNA, 20 bp, mouse
ggggatccgcgaggacgagg

SEQ ID NO: 670953 - DNA, 20 bp, mouse
ggggggcgtaggtcgaggac

SEQ ID NO: 670954 - DNA, 20 bp, mouse
ggcggcgggtagcgctcccc

SEQ ID NO: 670955 - DNA, 20 bp, mouse
gcgcaactcgcgatcgtccg

SEQ ID NO: 670956 - DNA, 20 bp, mouse
gcctctgggtaccaaaagtg

SEQ ID NO: 670957 - DNA, 20 bp, mouse
ggagtgacgacctgagaacc

SEQ ID NO: 670958 - DNA, 20 bp, mouse
gccaacgcgccatcagctgg

SEQ ID NO: 670959 - DNA, 20 bp, mouse
gtaccaaaagtgaggtgcaa

SEQ ID NO: 670960 - DNA, 20 bp, mouse
ggggcgacgtgcgcatgcgt

SEQ ID NO: 670961 - DNA, 20 bp, mouse
gaacccgcttctcagttctc

SEQ ID NO: 670962 - DNA, 20 bp, mouse
gagctcgccggtgactagaa

SEQ ID NO: 670963 - DNA, 20 bp, mouse
gtcgctgtgcgtcagagcgc

SEQ ID NO: 670964 - DNA, 20 bp, mouse
ggacctgagaactgagaagc

SEQ ID NO: 670965 - DNA, 20 bp, mouse
gtggacgtagcgagcccggg

SEQ ID NO: 670966 - DNA, 20 bp, mouse
ggagcggcctgagtgtccat

SEQ ID NO: 670967 - DNA, 20 bp, mouse
ggcagagcgacgtaccggtc

SEQ ID NO: 670968 - DNA, 20 bp, mouse
gagggggcgggacacgagag

SEQ ID NO: 670969 - DNA, 20 bp, mouse
gggtccggaacctcctgcgc

SEQ ID NO: 670970 - DNA, 20 bp, mouse
gctggggcgtgcggcttgac

SEQ ID NO: 670971 - DNA, 20 bp, mouse
gcgctctgcgcatgacacag

SEQ ID NO: 670972 - DNA, 20 bp, mouse
gacctggtcccgccactcgg

SEQ ID NO: 670973 - DNA, 20 bp, mouse
ggggtggatccctgcgcagg

SEQ ID NO: 670974 - DNA, 20 bp, mouse
gacacagcgccaccgagtgg

SEQ ID NO: 670975 - DNA, 20 bp, mouse
gcatgcgcagagcgacgtac

SEQ ID NO: 670976 - DNA, 20 bp, mouse
ggtaacaggatggagaagta

SEQ ID NO: 670977 - DNA, 20 bp, mouse
gggccgggccaggacaggcg

SEQ ID NO: 670978 - DNA, 20 bp, mouse
gttaccttcaagctgagaga

SEQ ID NO: 670979 - DNA, 20 bp, mouse
gagagggcggggcctcaagg

SEQ ID NO: 670980 - DNA, 20 bp, mouse
gcagcttgaaggtaacagga

SEQ ID NO: 670981 - DNA, 20 bp, mouse
ggtccctgcaaccgcttcaa

SEQ ID NO: 670982 - DNA, 20 bp, mouse
gaggttctgccgggcggagg

SEQ ID NO: 670983 - DNA, 20 bp, mouse
gagactgcctccttgtacag

SEQ ID NO: 670984 - DNA, 20 bp, mouse
gcaaccgcttcaaggggctg

SEQ ID NO: 670985 - DNA, 20 bp, mouse
ggcccctagaaagcacgtat

SEQ ID NO: 670986 - DNA, 20 bp, mouse
gtctcagcttgcttcctctc

SEQ ID NO: 670987 - DNA, 20 bp, mouse
gtgggtgataggtaaaagat

SEQ ID NO: 670988 - DNA, 20 bp, mouse
ggcggtcagaattttaaaga

SEQ ID NO: 670989 - DNA, 20 bp, mouse
gccggggtctagaatctccg

SEQ ID NO: 670990 - DNA, 20 bp, mouse
ggtccgcgggagctaggctg

SEQ ID NO: 670991 - DNA, 20 bp, mouse
gctcccgggctgtgggaacc

SEQ ID NO: 670992 - DNA, 20 bp, mouse
ggccctggccagcgttttat

SEQ ID NO: 670993 - DNA, 20 bp, mouse
ggcagggaagctcactgcgc

SEQ ID NO: 670994 - DNA, 20 bp, mouse
gtgggaacccggaagtggca

SEQ ID NO: 670995 - DNA, 20 bp, mouse
gagtggcagggcctcaggtg

SEQ ID NO: 670996 - DNA, 20 bp, mouse
gccaacgcccccggggagat

SEQ ID NO: 670997 - DNA, 20 bp, mouse
ggaccgcggggaatggtatc

SEQ ID NO: 670998 - DNA, 20 bp, mouse
ggcccccggggagatcggcc

SEQ ID NO: 670999 - DNA, 20 bp, mouse
gcagcccggccgatctcccc

SEQ ID NO: 671000 - DNA, 20 bp, mouse
gggatcttgaccgcggggaa

SEQ ID NO: 671001 - DNA, 20 bp, mouse
gctccagataccattccccg

SEQ ID NO: 671002 - DNA, 20 bp, mouse
ggatctgagaacccgtaagc

SEQ ID NO: 671003 - DNA, 20 bp, mouse
gtcctcgcttggtctctcgg

SEQ ID NO: 671004 - DNA, 20 bp, mouse
ggcgctgaggcggcagtttg

SEQ ID NO: 671005 - DNA, 20 bp, mouse
gaagcgggatcttgaccgcg

SEQ ID NO: 671006 - DNA, 20 bp, mouse
gtcccatcagggagccaatt

SEQ ID NO: 671007 - DNA, 20 bp, mouse
ggacccaattggctccctga

SEQ ID NO: 671008 - DNA, 20 bp, mouse
gagcactcactcgacccaat

SEQ ID NO: 671009 - DNA, 20 bp, mouse
gggacttgctggctacaatg

SEQ ID NO: 671010 - DNA, 20 bp, mouse
gtagccagcaagtcccatca

SEQ ID NO: 671011 - DNA, 20 bp, mouse
gttgacacctaaagttgatc

SEQ ID NO: 671012 - DNA, 20 bp, mouse
gttgctggctacaatgtggg

SEQ ID NO: 671013 - DNA, 20 bp, mouse
gtcaactttaggtgtcaacc

SEQ ID NO: 671014 - DNA, 20 bp, mouse
ggctccctgatgggacttgc

SEQ ID NO: 671015 - DNA, 20 bp, mouse
gtgctcaccagatcaacttt

SEQ ID NO: 671016 - DNA, 20 bp, mouse
gccgcccaggctcctacagt

SEQ ID NO: 671017 - DNA, 20 bp, mouse
gcgcgcgcccgtgggaccaa

SEQ ID NO: 671018 - DNA, 20 bp, mouse
ggagctggctggtcggggac

SEQ ID NO: 671019 - DNA, 20 bp, mouse
gggctcgcgactctagtcgt

SEQ ID NO: 671020 - DNA, 20 bp, mouse
gtgggtgctgtgtcgaagtg

SEQ ID NO: 671021 - DNA, 20 bp, mouse
gcagcctcaaagtgcagaac

SEQ ID NO: 671022 - DNA, 20 bp, mouse
gaagaggggggactcagaaa

SEQ ID NO: 671023 - DNA, 20 bp, mouse
gaggcccactgtaggagcct

SEQ ID NO: 671024 - DNA, 20 bp, mouse
ggcgctcccgagtagctcgg

SEQ ID NO: 671025 - DNA, 20 bp, mouse
gggctggagctggctggtcg

SEQ ID NO: 671026 - DNA, 20 bp, mouse
ggggtctcgggctttcactg

SEQ ID NO: 671027 - DNA, 20 bp, mouse
gcaccagctaattaccccct

SEQ ID NO: 671028 - DNA, 20 bp, mouse
ggtgaaagcccgagacccag

SEQ ID NO: 671029 - DNA, 20 bp, mouse
ggacccagggggtaattagc

SEQ ID NO: 671030 - DNA, 20 bp, mouse
gagttggggtagaatagaca

SEQ ID NO: 671031 - DNA, 20 bp, mouse
ggttgtctgagatttaggag

SEQ ID NO: 671032 - DNA, 20 bp, mouse
gggggaggcaggtggtcagc

SEQ ID NO: 671033 - DNA, 20 bp, mouse
gtagctgttgtctgagattt

SEQ ID NO: 671034 - DNA, 20 bp, mouse
ggctacctgcctggtagcat

SEQ ID NO: 671035 - DNA, 20 bp, mouse
gcctccccatgctaccaggc

SEQ ID NO: 671036 - DNA, 20 bp, mouse
ggcgaagactgcagcctcca

SEQ ID NO: 671037 - DNA, 20 bp, mouse
gagagcaagcccaagcttgg

SEQ ID NO: 671038 - DNA, 20 bp, mouse
ggccctagaggtccagggtt

SEQ ID NO: 671039 - DNA, 20 bp, mouse
ggggcccctgcgcccctctt

SEQ ID NO: 671040 - DNA, 20 bp, mouse
gtccgaggtccacacggaga

SEQ ID NO: 671041 - DNA, 20 bp, mouse
gagggcgtctcagatggagc

SEQ ID NO: 671042 - DNA, 20 bp, mouse
gagcctgcggaggtgatgcg

SEQ ID NO: 671043 - DNA, 20 bp, mouse
gaggcgttggcacggaagga

SEQ ID NO: 671044 - DNA, 20 bp, mouse
gtgtggacctcggaaggcgt

SEQ ID NO: 671045 - DNA, 20 bp, mouse
ggcggaccccaggacgcgtc

SEQ ID NO: 671046 - DNA, 20 bp, mouse
gacccgggaggaggcgacca

SEQ ID NO: 671047 - DNA, 20 bp, mouse
ggacaggagaagctagactt

SEQ ID NO: 671048 - DNA, 20 bp, mouse
gggaggaggcgaccagggtg

SEQ ID NO: 671049 - DNA, 20 bp, mouse
ggtggggagggcggtcggag

SEQ ID NO: 671050 - DNA, 20 bp, mouse
gtgggtctgcacgagcgacg

SEQ ID NO: 671051 - DNA, 20 bp, mouse
gctgcacgagcgacggggta

SEQ ID NO: 671052 - DNA, 20 bp, mouse
ggggtcagaggaggggactg

SEQ ID NO: 671053 - DNA, 20 bp, mouse
ggagcagaaaaggcctagga

SEQ ID NO: 671054 - DNA, 20 bp, mouse
ggagggacctggctgtgggg

SEQ ID NO: 671055 - DNA, 20 bp, mouse
gagggctgcaaagggacggg

SEQ ID NO: 671056 - DNA, 20 bp, mouse
gtgggacaaggcccaggcag

SEQ ID NO: 671057 - DNA, 20 bp, mouse
gcctaagcaatccaatttgg

SEQ ID NO: 671058 - DNA, 20 bp, mouse
ggggatgcctggcaaactcc

SEQ ID NO: 671059 - DNA, 20 bp, mouse
gaccgcgtcaccatgttccg

SEQ ID NO: 671060 - DNA, 20 bp, mouse
ggaaggaaggcggggcggaa

SEQ ID NO: 671061 - DNA, 20 bp, mouse
ggcaaaagagaaagctcccg

SEQ ID NO: 671062 - DNA, 20 bp, mouse
gaggctctgtctatcttctc

SEQ ID NO: 671063 - DNA, 20 bp, mouse
gggagacgcaggagccgggt

SEQ ID NO: 671064 - DNA, 20 bp, mouse
gagagggccactgtcctctc

SEQ ID NO: 671065 - DNA, 20 bp, mouse
gggacagtggccctctctgg

SEQ ID NO: 671066 - DNA, 20 bp, mouse
gcagtcgcagacttgagtag

SEQ ID NO: 671067 - DNA, 20 bp, mouse
gggcccccccagagcaagaa

SEQ ID NO: 671068 - DNA, 20 bp, mouse
ggggtggtgctctgcataac

SEQ ID NO: 671069 - DNA, 20 bp, mouse
gagtctgcgactgccttctg

SEQ ID NO: 671070 - DNA, 20 bp, mouse
ggctgcggcgcgtgacgcga

SEQ ID NO: 671071 - DNA, 20 bp, mouse
ggccctgcattcagaccagt

SEQ ID NO: 671072 - DNA, 20 bp, mouse
gggcgcgcggcgactcggac

SEQ ID NO: 671073 - DNA, 20 bp, mouse
gggagctgacaaatggtagt

SEQ ID NO: 671074 - DNA, 20 bp, mouse
gagaatggggcgtggtctct

SEQ ID NO: 671075 - DNA, 20 bp, mouse
gccagagcaagaatggggcg

SEQ ID NO: 671076 - DNA, 20 bp, mouse
ggaaccctgcgctgcgccta

SEQ ID NO: 671077 - DNA, 20 bp, mouse
ggagcggaggagccccgacg

SEQ ID NO: 671078 - DNA, 20 bp, mouse
gcccaggccgagcccagtag

SEQ ID NO: 671079 - DNA, 20 bp, mouse
gcaacccgggggtaaatcat

SEQ ID NO: 671080 - DNA, 20 bp, mouse
gcccagtagcggagctgagt

SEQ ID NO: 671081 - DNA, 20 bp, mouse
gcccacccggacattggtca

SEQ ID NO: 671082 - DNA, 20 bp, mouse
ggggccgcggggttgggcag

SEQ ID NO: 671083 - DNA, 20 bp, mouse
gcacgtgccacccgccccgt

SEQ ID NO: 671084 - DNA, 20 bp, mouse
gctgcgctgcgcctatggag

SEQ ID NO: 671085 - DNA, 20 bp, mouse
gcggaggagccccgacgggg

SEQ ID NO: 671086 - DNA, 20 bp, mouse
ggcgaagccaggtcagtctg

SEQ ID NO: 671087 - DNA, 20 bp, mouse
ggcctcaccagcaccgccta

SEQ ID NO: 671088 - DNA, 20 bp, mouse
gcactgggagaagtaaaaac

SEQ ID NO: 671089 - DNA, 20 bp, mouse
gagtctgcctcagactgacc

SEQ ID NO: 671090 - DNA, 20 bp, mouse
ggtgaggcaaagctactgga

SEQ ID NO: 671091 - DNA, 20 bp, mouse
gcccagctggaagaacctga

SEQ ID NO: 671092 - DNA, 20 bp, mouse
gaatgcccgtgtaccctagg

SEQ ID NO: 671093 - DNA, 20 bp, mouse
ggcggtgctggtgaggcaat

SEQ ID NO: 671094 - DNA, 20 bp, mouse
gtcacgtgaggcaaagctac

SEQ ID NO: 671095 - DNA, 20 bp, mouse
gactaatgcccgtgtaccct

SEQ ID NO: 671096 - DNA, 20 bp, mouse
ggggaggggcctggtggcgt

SEQ ID NO: 671097 - DNA, 20 bp, mouse
gtggtctgagcaggggaaaa

SEQ ID NO: 671098 - DNA, 20 bp, mouse
gtcccaaggtgcaggattag

SEQ ID NO: 671099 - DNA, 20 bp, mouse
gactataaggtgggggtcta

SEQ ID NO: 671100 - DNA, 20 bp, mouse
gaggggctcagggcggggtc

SEQ ID NO: 671101 - DNA, 20 bp, mouse
gagacaaacgactataaggt

SEQ ID NO: 671102 - DNA, 20 bp, mouse
gataaggtgggggtctaggg

SEQ ID NO: 671103 - DNA, 20 bp, mouse
ggtgaggagtagcagaccag

SEQ ID NO: 671104 - DNA, 20 bp, mouse
gcgaggccaggccgccggtt

SEQ ID NO: 671105 - DNA, 20 bp, mouse
gtcctaaactgcccaaccgg

SEQ ID NO: 671106 - DNA, 20 bp, mouse
gaggccgggacccacatgag

SEQ ID NO: 671107 - DNA, 20 bp, mouse
ggggcgtgaccaggacaggt

SEQ ID NO: 671108 - DNA, 20 bp, mouse
gggctgctgcgacggagaag

SEQ ID NO: 671109 - DNA, 20 bp, mouse
gggggcctgggctgctgcga

SEQ ID NO: 671110 - DNA, 20 bp, mouse
ggtgggcgggaaggcgggat

SEQ ID NO: 671111 - DNA, 20 bp, mouse
gcccgcctctcccgcaagga

SEQ ID NO: 671112 - DNA, 20 bp, mouse
gcgggaaggcgggatgggcg

SEQ ID NO: 671113 - DNA, 20 bp, mouse
ggggcggctgggaggaccca

SEQ ID NO: 671114 - DNA, 20 bp, mouse
ggagaaactagcctgaggta

SEQ ID NO: 671115 - DNA, 20 bp, mouse
gggcgtggccaagaagaaat

SEQ ID NO: 671116 - DNA, 20 bp, mouse
gcctggccgcacgccctgat

SEQ ID NO: 671117 - DNA, 20 bp, mouse
ggcaccgaggcacacgcggc

SEQ ID NO: 671118 - DNA, 20 bp, mouse
ggcgggacgcgctccaggtg

SEQ ID NO: 671119 - DNA, 20 bp, mouse
gagagcgcagacactccagt

SEQ ID NO: 671120 - DNA, 20 bp, mouse
gtgcgacccaacttggggct

SEQ ID NO: 671121 - DNA, 20 bp, mouse
gggggctgggacagaggtgc

SEQ ID NO: 671122 - DNA, 20 bp, mouse
gcgggtccagagccagagcg

SEQ ID NO: 671123 - DNA, 20 bp, mouse
ggtgccaggaaggtcaagga

SEQ ID NO: 671124 - DNA, 20 bp, mouse
gtctggccgcgctgggaaaa

SEQ ID NO: 671125 - DNA, 20 bp, mouse
gtggaagctcggcccctgcc

SEQ ID NO: 671126 - DNA, 20 bp, mouse
gggtctgagaccctcagaaa

SEQ ID NO: 671127 - DNA, 20 bp, mouse
gtccaccttgagcttcccaa

SEQ ID NO: 671128 - DNA, 20 bp, mouse
gcatgcctttgggaagctca

SEQ ID NO: 671129 - DNA, 20 bp, mouse
gcaaaggcatgcacagcaaa

SEQ ID NO: 671130 - DNA, 20 bp, mouse
gcaaatggcatcttcaggca

SEQ ID NO: 671131 - DNA, 20 bp, mouse
ggacggaggttagagtgcca

SEQ ID NO: 671132 - DNA, 20 bp, mouse
gcagctccacagctgctgtc

SEQ ID NO: 671133 - DNA, 20 bp, mouse
gagctctccgagtctagagg

SEQ ID NO: 671134 - DNA, 20 bp, mouse
gaaatttccagccctttctg

SEQ ID NO: 671135 - DNA, 20 bp, mouse
gttacataagctctttcccg

SEQ ID NO: 671136 - DNA, 20 bp, mouse
gcaagcagatgcatgcagtc

SEQ ID NO: 671137 - DNA, 20 bp, mouse
gagctcccaaggtatttgtt

SEQ ID NO: 671138 - DNA, 20 bp, mouse
gaggtcctaacaaatacctt

SEQ ID NO: 671139 - DNA, 20 bp, mouse
ggaagagcaaagacatcata

SEQ ID NO: 671140 - DNA, 20 bp, mouse
gagaagtccccagtgttgct

SEQ ID NO: 671141 - DNA, 20 bp, mouse
gtcccagccgagcaacactg

SEQ ID NO: 671142 - DNA, 20 bp, mouse
gtccccagtgttgctcggct

SEQ ID NO: 671143 - DNA, 20 bp, mouse
gcttgggagctctttggaga

SEQ ID NO: 671144 - DNA, 20 bp, mouse
gttggcttgatatcagagag

SEQ ID NO: 671145 - DNA, 20 bp, mouse
gaaatagatgcatggcagct

SEQ ID NO: 671146 - DNA, 20 bp, mouse
gtcccagcagagaaacactg

SEQ ID NO: 671147 - DNA, 20 bp, mouse
gcaagcaaatgcatggaggc

SEQ ID NO: 671148 - DNA, 20 bp, mouse
gcccacactctgataccaaa

SEQ ID NO: 671149 - DNA, 20 bp, mouse
ggccaccaggcaaggatagt

SEQ ID NO: 671150 - DNA, 20 bp, mouse
ggccaactatccttgcctgg

SEQ ID NO: 671151 - DNA, 20 bp, mouse
gcgcttcaggccaccaggca

SEQ ID NO: 671152 - DNA, 20 bp, mouse
gaatagcagcccatggcagc

SEQ ID NO: 671153 - DNA, 20 bp, mouse
gactttgaacttctcaaggt

SEQ ID NO: 671154 - DNA, 20 bp, mouse
gatccccagtgtttctctgc

SEQ ID NO: 671155 - DNA, 20 bp, mouse
gtctaggaaatagcagccca

SEQ ID NO: 671156 - DNA, 20 bp, mouse
gggtaaactcctagtgggcg

SEQ ID NO: 671157 - DNA, 20 bp, mouse
gagctctctgggtgtcagtt

SEQ ID NO: 671158 - DNA, 20 bp, mouse
gtgacacccagagagctctt

SEQ ID NO: 671159 - DNA, 20 bp, mouse
gcctccaagccacgcccact

SEQ ID NO: 671160 - DNA, 20 bp, mouse
gaagtgggtaaactcctagt

SEQ ID NO: 671161 - DNA, 20 bp, mouse
gggttgagcaagacttaagg

SEQ ID NO: 671162 - DNA, 20 bp, mouse
ggctgctgtctgctcttgag

SEQ ID NO: 671163 - DNA, 20 bp, mouse
gaagctgttggatgggtttc

SEQ ID NO: 671164 - DNA, 20 bp, mouse
ggtcagggtgcactgaattg

SEQ ID NO: 671165 - DNA, 20 bp, mouse
gcatactctcgagttaggaa

SEQ ID NO: 671166 - DNA, 20 bp, mouse
gttaaaggagtctacagaac

SEQ ID NO: 671167 - DNA, 20 bp, mouse
gaggtgtgccctaacctctc

SEQ ID NO: 671168 - DNA, 20 bp, mouse
gtcaactgtgtggctgtgag

SEQ ID NO: 671169 - DNA, 20 bp, mouse
gggagtctacagaactggtt

SEQ ID NO: 671170 - DNA, 20 bp, mouse
gctcccagcaaagagaatct

SEQ ID NO: 671171 - DNA, 20 bp, mouse
ggactctacacttagattgc

SEQ ID NO: 671172 - DNA, 20 bp, mouse
gaaggtgactctttggtctt

SEQ ID NO: 671173 - DNA, 20 bp, mouse
gacacagttgaccaccagag

SEQ ID NO: 671174 - DNA, 20 bp, mouse
gaagttgtttgaccagtttg

SEQ ID NO: 671175 - DNA, 20 bp, mouse
gaaagagtcaccttacttaa

SEQ ID NO: 671176 - DNA, 20 bp, mouse
gcacaaggaaggggtgtgta

SEQ ID NO: 671177 - DNA, 20 bp, mouse
gcttggaagagctgtggcta

SEQ ID NO: 671178 - DNA, 20 bp, mouse
gtgagtgttcagataaagca

SEQ ID NO: 671179 - DNA, 20 bp, mouse
gggactcctgggaggttccc

SEQ ID NO: 671180 - DNA, 20 bp, mouse
gagataaagcagggtaaact

SEQ ID NO: 671181 - DNA, 20 bp, mouse
ggtaattgggctctgtgggc

SEQ ID NO: 671182 - DNA, 20 bp, mouse
gctgaagcgagagtgttaca

SEQ ID NO: 671183 - DNA, 20 bp, mouse
ggcagtgaaaagctttagtg

SEQ ID NO: 671184 - DNA, 20 bp, mouse
gttgtgtaattgggctctgt

SEQ ID NO: 671185 - DNA, 20 bp, mouse
gatataagacagctaatgct

SEQ ID NO: 671186 - DNA, 20 bp, mouse
ggacagctctcagataacag

SEQ ID NO: 671187 - DNA, 20 bp, mouse
gggaggccgacagaacactg

SEQ ID NO: 671188 - DNA, 20 bp, mouse
gtgttctgtcggcctcccaa

SEQ ID NO: 671189 - DNA, 20 bp, mouse
gttatctgagagctgtccaa

SEQ ID NO: 671190 - DNA, 20 bp, mouse
ggtgactaagaagtcccatt

SEQ ID NO: 671191 - DNA, 20 bp, mouse
ggaggtccataaactaacca

SEQ ID NO: 671192 - DNA, 20 bp, mouse
gaggcagagagtagcacagc

SEQ ID NO: 671193 - DNA, 20 bp, mouse
gtcctgactgagagctctct

SEQ ID NO: 671194 - DNA, 20 bp, mouse
gagaagacagagcacttgat

SEQ ID NO: 671195 - DNA, 20 bp, mouse
gcacagcaggccttcagaca

SEQ ID NO: 671196 - DNA, 20 bp, mouse
gtgtgcggagatgtagctta

SEQ ID NO: 671197 - DNA, 20 bp, mouse
gtcttcgaagaagttccctc

SEQ ID NO: 671198 - DNA, 20 bp, mouse
ggatcccacggagagcctga

SEQ ID NO: 671199 - DNA, 20 bp, mouse
ggttccctcaggctctccgt

SEQ ID NO: 671200 - DNA, 20 bp, mouse
gggaacttcttcgaagaggg

SEQ ID NO: 671201 - DNA, 20 bp, mouse
gaagccaggtgaaatctgtg

SEQ ID NO: 671202 - DNA, 20 bp, mouse
ggcacagaggcgagaatgtg

SEQ ID NO: 671203 - DNA, 20 bp, mouse
gatgtagcttagggatccca

SEQ ID NO: 671204 - DNA, 20 bp, mouse
gataaaagagggcaagatat

SEQ ID NO: 671205 - DNA, 20 bp, mouse
ggagggatttctgtcatcaa

SEQ ID NO: 671206 - DNA, 20 bp, mouse
gccacagggctcttgtcaat

SEQ ID NO: 671207 - DNA, 20 bp, mouse
gggtgttggtatgaagatca

SEQ ID NO: 671208 - DNA, 20 bp, mouse
gttcataccaacacctacat

SEQ ID NO: 671209 - DNA, 20 bp, mouse
gttagggtgcctgggaacgt

SEQ ID NO: 671210 - DNA, 20 bp, mouse
gtgcaacaggagaagccaca

SEQ ID NO: 671211 - DNA, 20 bp, mouse
ggttggctcttgtctccctg

SEQ ID NO: 671212 - DNA, 20 bp, mouse
gaggaatcatgattccatat

SEQ ID NO: 671213 - DNA, 20 bp, mouse
gggtggctttgcctgcttgt

SEQ ID NO: 671214 - DNA, 20 bp, mouse
gcacctacattgggatggtg

SEQ ID NO: 671215 - DNA, 20 bp, mouse
ggggagcagaaagctgcaac

SEQ ID NO: 671216 - DNA, 20 bp, mouse
gggagctcaactgggatacc

SEQ ID NO: 671217 - DNA, 20 bp, mouse
ggcagagtgcatagggactg

SEQ ID NO: 671218 - DNA, 20 bp, mouse
gtgtgaccggtcaaagttgt

SEQ ID NO: 671219 - DNA, 20 bp, mouse
gagtgactattccaggccat

SEQ ID NO: 671220 - DNA, 20 bp, mouse
gggccaaggaccatggaaac

SEQ ID NO: 671221 - DNA, 20 bp, mouse
gtagcagaagtgactattcc

SEQ ID NO: 671222 - DNA, 20 bp, mouse
gaacactgggatagagttcc

SEQ ID NO: 671223 - DNA, 20 bp, mouse
gttattagttaacaagtgac

SEQ ID NO: 671224 - DNA, 20 bp, mouse
gttggccagaaagctgtaat

SEQ ID NO: 671225 - DNA, 20 bp, mouse
gagcccgtttccatggtcct

SEQ ID NO: 671226 - DNA, 20 bp, mouse
gagccaatggccaggaggta

SEQ ID NO: 671227 - DNA, 20 bp, mouse
gctggccaggtgaggagaca

SEQ ID NO: 671228 - DNA, 20 bp, mouse
gggaacttgtctgggatacc

SEQ ID NO: 671229 - DNA, 20 bp, mouse
gaggtggggccattgtgtga

SEQ ID NO: 671230 - DNA, 20 bp, mouse
gtaaaccaaaagggtgtagg

SEQ ID NO: 671231 - DNA, 20 bp, mouse
gcacaggagtcttgaagctg

SEQ ID NO: 671232 - DNA, 20 bp, mouse
gataggagccaatggccagg

SEQ ID NO: 671233 - DNA, 20 bp, mouse
ggggactttcccctacctcc

SEQ ID NO: 671234 - DNA, 20 bp, mouse
ggggtgaaagttctcattgc

SEQ ID NO: 671235 - DNA, 20 bp, mouse
gtgaattctggaacttgtct

SEQ ID NO: 671236 - DNA, 20 bp, mouse
ggcggggaacttgttgtagt

SEQ ID NO: 671237 - DNA, 20 bp, mouse
gtcccctacctcctgaacat

SEQ ID NO: 671238 - DNA, 20 bp, mouse
gagccaatgttcaggaggta

SEQ ID NO: 671239 - DNA, 20 bp, mouse
gggaacttgttgtagtcggg

SEQ ID NO: 671240 - DNA, 20 bp, mouse
gctggctaggtaaggggaca

SEQ ID NO: 671241 - DNA, 20 bp, mouse
gggcagagacagaaacctga

SEQ ID NO: 671242 - DNA, 20 bp, mouse
ggagataggagccaatgttc

SEQ ID NO: 671243 - DNA, 20 bp, mouse
gataggagccaatgttcagg

SEQ ID NO: 671244 - DNA, 20 bp, mouse
gtgcaggctcctatgagaag

SEQ ID NO: 671245 - DNA, 20 bp, mouse
gggacaaaggaaactagggg

SEQ ID NO: 671246 - DNA, 20 bp, mouse
gagtacaaggacagtgatca

SEQ ID NO: 671247 - DNA, 20 bp, mouse
gggactccctgtgttacaga

SEQ ID NO: 671248 - DNA, 20 bp, mouse
gagccaggacacatgtggag

SEQ ID NO: 671249 - DNA, 20 bp, mouse
ggttacagaaggacttcaga

SEQ ID NO: 671250 - DNA, 20 bp, mouse
gaatctctattcctgctctt

SEQ ID NO: 671251 - DNA, 20 bp, mouse
ggaagtccttctgtaacaca

SEQ ID NO: 671252 - DNA, 20 bp, mouse
gtggcatgatatacctttct

SEQ ID NO: 671253 - DNA, 20 bp, mouse
ggacccctccacatgtgtcc

SEQ ID NO: 671254 - DNA, 20 bp, mouse
gtacagaggtggtgtgaata

SEQ ID NO: 671255 - DNA, 20 bp, mouse
gttcaagataagagagggga

SEQ ID NO: 671256 - DNA, 20 bp, mouse
gtgggacagtccgtggggtg

SEQ ID NO: 671257 - DNA, 20 bp, mouse
gttgcccagacaggaccaaa

SEQ ID NO: 671258 - DNA, 20 bp, mouse
gacagtggtcatggtggatc

SEQ ID NO: 671259 - DNA, 20 bp, mouse
gcctcttggggaggcacaga

SEQ ID NO: 671260 - DNA, 20 bp, mouse
ggtaggtgggacagtccgtg

SEQ ID NO: 671261 - DNA, 20 bp, mouse
gtgtaacaggagaaatcggg

SEQ ID NO: 671262 - DNA, 20 bp, mouse
gccagtgagcacaagaacag

SEQ ID NO: 671263 - DNA, 20 bp, mouse
gtctgctccttggcctcttg

SEQ ID NO: 671264 - DNA, 20 bp, mouse
ggcagttcttctgagatatc

SEQ ID NO: 671265 - DNA, 20 bp, mouse
gaggagacacagtatagaga

SEQ ID NO: 671266 - DNA, 20 bp, mouse
gtgccctgcctccaggccat

SEQ ID NO: 671267 - DNA, 20 bp, mouse
gcaaagtcgctgtatttatc

SEQ ID NO: 671268 - DNA, 20 bp, mouse
gtgagccaaaaagataaagg

SEQ ID NO: 671269 - DNA, 20 bp, mouse
gaggattttccagagtagca

SEQ ID NO: 671270 - DNA, 20 bp, mouse
ggcgactttgccctgcctcc

SEQ ID NO: 671271 - DNA, 20 bp, mouse
gtagaacaacttacaggcaa

SEQ ID NO: 671272 - DNA, 20 bp, mouse
gtctaatgccagttaaggac

SEQ ID NO: 671273 - DNA, 20 bp, mouse
gtgctccacctttatctttt

SEQ ID NO: 671274 - DNA, 20 bp, mouse
gctgtttagtcagaagtaac

SEQ ID NO: 671275 - DNA, 20 bp, mouse
gggaaactagatagaatatt

SEQ ID NO: 671276 - DNA, 20 bp, mouse
gctggcagggtgggtactgc

SEQ ID NO: 671277 - DNA, 20 bp, mouse
gagaacgactctgagcagac

SEQ ID NO: 671278 - DNA, 20 bp, mouse
gcgccacatagcaccttcag

SEQ ID NO: 671279 - DNA, 20 bp, mouse
gtgcaggtccctgtgtttaa

SEQ ID NO: 671280 - DNA, 20 bp, mouse
gccagaaggcaactgaggat

SEQ ID NO: 671281 - DNA, 20 bp, mouse
gctacagccccttaaacaca

SEQ ID NO: 671282 - DNA, 20 bp, mouse
gcatgacagtcacaggtgga

SEQ ID NO: 671283 - DNA, 20 bp, mouse
gctcctctgaaggtgctatg

SEQ ID NO: 671284 - DNA, 20 bp, mouse
gtgatgctagagaaatcgaa

SEQ ID NO: 671285 - DNA, 20 bp, mouse
gtttggaccctgcagagtgt

SEQ ID NO: 671286 - DNA, 20 bp, mouse
gaatgggtgaggaggatcct

SEQ ID NO: 671287 - DNA, 20 bp, mouse
gaaagggagcaggtgtgtga

SEQ ID NO: 671288 - DNA, 20 bp, mouse
ggtctgccctgattggttgg

SEQ ID NO: 671289 - DNA, 20 bp, mouse
gtcttgcactgagaaagtag

SEQ ID NO: 671290 - DNA, 20 bp, mouse
gtctgagcttggttaatgaa

SEQ ID NO: 671291 - DNA, 20 bp, mouse
ggaaaattatctatggagga

SEQ ID NO: 671292 - DNA, 20 bp, mouse
gttggtctgccctgattggt

SEQ ID NO: 671293 - DNA, 20 bp, mouse
gagggaggaaactgtgagag

SEQ ID NO: 671294 - DNA, 20 bp, mouse
gcatgagaatggaaatatgt

SEQ ID NO: 671295 - DNA, 20 bp, mouse
ggccatggtgcttcactctt

SEQ ID NO: 671296 - DNA, 20 bp, mouse
gtagaatcatccacagagga

SEQ ID NO: 671297 - DNA, 20 bp, mouse
ggggttggacagagttgagg

SEQ ID NO: 671298 - DNA, 20 bp, mouse
gcaggaccagcagagtcttc

SEQ ID NO: 671299 - DNA, 20 bp, mouse
gagcttagtgaatggagcga

SEQ ID NO: 671300 - DNA, 20 bp, mouse
gggtctgcccgattggttgg

SEQ ID NO: 671301 - DNA, 20 bp, mouse
gtgggacttgctggagaact

SEQ ID NO: 671302 - DNA, 20 bp, mouse
ggtcactcttacaactgcag

SEQ ID NO: 671303 - DNA, 20 bp, mouse
gttaacttggtctgcccgat

SEQ ID NO: 671304 - DNA, 20 bp, mouse
gattggttggaggccagctc

SEQ ID NO: 671305 - DNA, 20 bp, mouse
ggctgagactctgagcacct

SEQ ID NO: 671306 - DNA, 20 bp, mouse
gtccatggggagcatgtctg

SEQ ID NO: 671307 - DNA, 20 bp, mouse
ggagccttgtccctcctcct

SEQ ID NO: 671308 - DNA, 20 bp, mouse
ggattgcaggcaagccagtt

SEQ ID NO: 671309 - DNA, 20 bp, mouse
gcaaactgggcagggattgc

SEQ ID NO: 671310 - DNA, 20 bp, mouse
gccctcctccttggggtgat

SEQ ID NO: 671311 - DNA, 20 bp, mouse
gcaagcttcacccattgagt

SEQ ID NO: 671312 - DNA, 20 bp, mouse
gtttggctcttcaaccaaac

SEQ ID NO: 671313 - DNA, 20 bp, mouse
ggctttgtgcagattcttgt

SEQ ID NO: 671314 - DNA, 20 bp, mouse
gccagcgctcttcagtccat

SEQ ID NO: 671315 - DNA, 20 bp, mouse
gggtgataggtcacactgta

SEQ ID NO: 671316 - DNA, 20 bp, mouse
gacccacatggcatctgtgt

SEQ ID NO: 671317 - DNA, 20 bp, mouse
gagaacaggaaagtcccgtt

SEQ ID NO: 671318 - DNA, 20 bp, mouse
gcatctgtgtgggaaaactc

SEQ ID NO: 671319 - DNA, 20 bp, mouse
gctataaggcgccttttctc

SEQ ID NO: 671320 - DNA, 20 bp, mouse
gttcccacacagatgccatg

SEQ ID NO: 671321 - DNA, 20 bp, mouse
gtaacacttgtcctgagaaa

SEQ ID NO: 671322 - DNA, 20 bp, mouse
gtccgtatgtaaatcagaac

SEQ ID NO: 671323 - DNA, 20 bp, mouse
gctatgagttcaaatctata

SEQ ID NO: 671324 - DNA, 20 bp, mouse
gacttaggccaggtcattga

SEQ ID NO: 671325 - DNA, 20 bp, mouse
gtgggggaagtgattcactt

SEQ ID NO: 671326 - DNA, 20 bp, mouse
gggtgcaggcgcataggggc

SEQ ID NO: 671327 - DNA, 20 bp, mouse
gactgcagatgcctatgacc

SEQ ID NO: 671328 - DNA, 20 bp, mouse
gtggcgcaggcgcactagca

SEQ ID NO: 671329 - DNA, 20 bp, mouse
gggcgcaggtgcaggcgcat

SEQ ID NO: 671330 - DNA, 20 bp, mouse
gattaactgccagtaggcgc

SEQ ID NO: 671331 - DNA, 20 bp, mouse
gggggttggcgcaggcgcat

SEQ ID NO: 671332 - DNA, 20 bp, mouse
gtattgtctctataattctt

SEQ ID NO: 671333 - DNA, 20 bp, mouse
gacagcactttcttgccagt

SEQ ID NO: 671334 - DNA, 20 bp, mouse
gactggcagttaatacctac

SEQ ID NO: 671335 - DNA, 20 bp, mouse
gagatgagggtgaagtgttc

SEQ ID NO: 671336 - DNA, 20 bp, mouse
ggagcaagagggcggtgcgt

SEQ ID NO: 671337 - DNA, 20 bp, mouse
gtcgcccaagagcaagaggg

SEQ ID NO: 671338 - DNA, 20 bp, mouse
gcaagcccgcaactcttacc

SEQ ID NO: 671339 - DNA, 20 bp, mouse
gcgcacagcccgcttcccat

SEQ ID NO: 671340 - DNA, 20 bp, mouse
gaactcgcccaagagcaaga

SEQ ID NO: 671341 - DNA, 20 bp, mouse
gcacacgcagcagcctctaa

SEQ ID NO: 671342 - DNA, 20 bp, mouse
gcatatctatcagtagaaaa

SEQ ID NO: 671343 - DNA, 20 bp, mouse
gaaggaagctctgctgattg

SEQ ID NO: 671344 - DNA, 20 bp, mouse
ggagacctcgaaactggagt

SEQ ID NO: 671345 - DNA, 20 bp, mouse
gtgtgcgcgcgtggagcagt

SEQ ID NO: 671346 - DNA, 20 bp, mouse
gaatacgcgcgcaagggagt

SEQ ID NO: 671347 - DNA, 20 bp, mouse
gaacagccggcctattgggg

SEQ ID NO: 671348 - DNA, 20 bp, mouse
gaaagaacctggccaatcca

SEQ ID NO: 671349 - DNA, 20 bp, mouse
gcatgcacggcgtcgaccga

SEQ ID NO: 671350 - DNA, 20 bp, mouse
gttggccctggttgtcagtc

SEQ ID NO: 671351 - DNA, 20 bp, mouse
gacggcgtcgaccgagggaa

SEQ ID NO: 671352 - DNA, 20 bp, mouse
gaacgagggagcagtttatt

SEQ ID NO: 671353 - DNA, 20 bp, mouse
ggccgtgcatgtcacgcgtg

SEQ ID NO: 671354 - DNA, 20 bp, mouse
ggactctaatacgcgcgcaa

SEQ ID NO: 671355 - DNA, 20 bp, mouse
gtcagtctggctccctggat

SEQ ID NO: 671356 - DNA, 20 bp, mouse
gaggagggtcgtggacccta

SEQ ID NO: 671357 - DNA, 20 bp, mouse
ggatccgcgcgtggtgagga

SEQ ID NO: 671358 - DNA, 20 bp, mouse
gagtctggggacacgcgtga

SEQ ID NO: 671359 - DNA, 20 bp, mouse
gcaagcaggcgggactggct

SEQ ID NO: 671360 - DNA, 20 bp, mouse
ggcgctcaagcaggcgggac

SEQ ID NO: 671361 - DNA, 20 bp, mouse
gcggcggcatggagcccgag

SEQ ID NO: 671362 - DNA, 20 bp, mouse
gtgaccgcgctcaagcaggc

SEQ ID NO: 671363 - DNA, 20 bp, mouse
gtgcagatccgcgcgtggtg

SEQ ID NO: 671364 - DNA, 20 bp, mouse
gggtcgtggaccctaggggc

SEQ ID NO: 671365 - DNA, 20 bp, mouse
gtggagcccgagaggtgggt

SEQ ID NO: 671366 - DNA, 20 bp, mouse
gaggtcccggcacaatcctg

SEQ ID NO: 671367 - DNA, 20 bp, mouse
gcttcccggaacattcatga

SEQ ID NO: 671368 - DNA, 20 bp, mouse
gctcaccaggcccacctgga

SEQ ID NO: 671369 - DNA, 20 bp, mouse
gtgaatgttccgggaagcag

SEQ ID NO: 671370 - DNA, 20 bp, mouse
gtgcgcagggtaggctggcc

SEQ ID NO: 671371 - DNA, 20 bp, mouse
gccagctgaactgccaactg

SEQ ID NO: 671372 - DNA, 20 bp, mouse
gccagagcagattgcataaa

SEQ ID NO: 671373 - DNA, 20 bp, mouse
ggtggctgcgtgcgcagggt

SEQ ID NO: 671374 - DNA, 20 bp, mouse
gcccacccttgactgaccaa

SEQ ID NO: 671375 - DNA, 20 bp, mouse
gtaaaagatcagtctttcca

SEQ ID NO: 671376 - DNA, 20 bp, mouse
gtaagcgccccaggatgcag

SEQ ID NO: 671377 - DNA, 20 bp, mouse
gccaggatgcagaggctgcg

SEQ ID NO: 671378 - DNA, 20 bp, mouse
ggtccctaatggtttacttc

SEQ ID NO: 671379 - DNA, 20 bp, mouse
gctggtgctatttacagtat

SEQ ID NO: 671380 - DNA, 20 bp, mouse
gaatggtttacttcaggcat

SEQ ID NO: 671381 - DNA, 20 bp, mouse
ggcacagatgggtgggcttc

SEQ ID NO: 671382 - DNA, 20 bp, mouse
gggagaggggggctggtcag

SEQ ID NO: 671383 - DNA, 20 bp, mouse
gtcaacaaaccaaagagctt

SEQ ID NO: 671384 - DNA, 20 bp, mouse
ggggcagaggctccatgtgt

SEQ ID NO: 671385 - DNA, 20 bp, mouse
gttggcctgggagataaaaa

SEQ ID NO: 671386 - DNA, 20 bp, mouse
ggtcagggtgccatgcagga

SEQ ID NO: 671387 - DNA, 20 bp, mouse
gtgagagtgggcactggtca

SEQ ID NO: 671388 - DNA, 20 bp, mouse
gcacatcatctgtcccagaa

SEQ ID NO: 671389 - DNA, 20 bp, mouse
ggaaggggagtctgcacttt

SEQ ID NO: 671390 - DNA, 20 bp, mouse
gcagtgcccactctcaaggt

SEQ ID NO: 671391 - DNA, 20 bp, mouse
gtggctggaaggatactcac

SEQ ID NO: 671392 - DNA, 20 bp, mouse
gcagatgatgtgaacctgtg

SEQ ID NO: 671393 - DNA, 20 bp, mouse
ggtgggcagaaaaccaacta

SEQ ID NO: 671394 - DNA, 20 bp, mouse
ggtatgcctaccttgagagt

SEQ ID NO: 671395 - DNA, 20 bp, mouse
gaagaggagggagagatgat

SEQ ID NO: 671396 - DNA, 20 bp, mouse
gtcagaagcgatgcatgctg

SEQ ID NO: 671397 - DNA, 20 bp, mouse
gtggtcagagacgacacttc

SEQ ID NO: 671398 - DNA, 20 bp, mouse
gggggtccggaatcccacaa

SEQ ID NO: 671399 - DNA, 20 bp, mouse
gtggggcttgtagttttcaa

SEQ ID NO: 671400 - DNA, 20 bp, mouse
ggaggcgagcgcacatgcgc

SEQ ID NO: 671401 - DNA, 20 bp, mouse
gatggagaatggcttatctg

SEQ ID NO: 671402 - DNA, 20 bp, mouse
ggtgcgtccttaatggagaa

SEQ ID NO: 671403 - DNA, 20 bp, mouse
ggataagccattctccatta

SEQ ID NO: 671404 - DNA, 20 bp, mouse
gtacactcaccgggcccttg

SEQ ID NO: 671405 - DNA, 20 bp, mouse
gttggtcagtctacactcac

SEQ ID NO: 671406 - DNA, 20 bp, mouse
ggggaaagacttgcttcaaa

SEQ ID NO: 671407 - DNA, 20 bp, mouse
gaatccagcaggtcactgac

SEQ ID NO: 671408 - DNA, 20 bp, mouse
gtttctggaaatgtgagcaa

SEQ ID NO: 671409 - DNA, 20 bp, mouse
gcattgagagaacttcagtt

SEQ ID NO: 671410 - DNA, 20 bp, mouse
ggataaaacgcccatgctgc

SEQ ID NO: 671411 - DNA, 20 bp, mouse
ggtgaagcaactggtctgtg

SEQ ID NO: 671412 - DNA, 20 bp, mouse
gctttgcagaagttgctcat

SEQ ID NO: 671413 - DNA, 20 bp, mouse
gtttacaagaacaatccagc

SEQ ID NO: 671414 - DNA, 20 bp, mouse
ggctaatggatgttgattat

SEQ ID NO: 671415 - DNA, 20 bp, mouse
gacagtagaacacaatttaa

SEQ ID NO: 671416 - DNA, 20 bp, mouse
gtacggcaactgctagtcct

SEQ ID NO: 671417 - DNA, 20 bp, mouse
gcaactgctagtcctcggtt

SEQ ID NO: 671418 - DNA, 20 bp, mouse
gataggcaggatagttggtt

SEQ ID NO: 671419 - DNA, 20 bp, mouse
ggatagttggttaggactgt

SEQ ID NO: 671420 - DNA, 20 bp, mouse
ggactagcagttgccgtata

SEQ ID NO: 671421 - DNA, 20 bp, mouse
gatggtctttggaacatgga

SEQ ID NO: 671422 - DNA, 20 bp, mouse
gttcttataggcaggatagt

SEQ ID NO: 671423 - DNA, 20 bp, mouse
gtaaatatcaaagttcacaa

SEQ ID NO: 671424 - DNA, 20 bp, mouse
gttcagaacacatcttggtt

SEQ ID NO: 671425 - DNA, 20 bp, mouse
gtagttcagtttgattggct

SEQ ID NO: 671426 - DNA, 20 bp, mouse
gcataacaatgtgcctgaca

SEQ ID NO: 671427 - DNA, 20 bp, mouse
gagtgccaagtttccttgtc

SEQ ID NO: 671428 - DNA, 20 bp, mouse
gtgttctgaagattcctacc

SEQ ID NO: 671429 - DNA, 20 bp, mouse
gttgttatgctgaaagaaag

SEQ ID NO: 671430 - DNA, 20 bp, mouse
gaagagtgcttctcttgtca

SEQ ID NO: 671431 - DNA, 20 bp, mouse
gctacttatagtacaatgaa

SEQ ID NO: 671432 - DNA, 20 bp, mouse
gttgtgtattccataccaca

SEQ ID NO: 671433 - DNA, 20 bp, mouse
gatggaatgatcttcctctt

SEQ ID NO: 671434 - DNA, 20 bp, mouse
gttatagtacaatgaatggt

SEQ ID NO: 671435 - DNA, 20 bp, mouse
gaggactgttgtttgttaga

SEQ ID NO: 671436 - DNA, 20 bp, mouse
gcacagtatagctgtaaata

SEQ ID NO: 671437 - DNA, 20 bp, mouse
gtattgaacatgactctaaa

SEQ ID NO: 671438 - DNA, 20 bp, mouse
ggtgtgtgcacagaacctta

SEQ ID NO: 671439 - DNA, 20 bp, mouse
gttaatattgtaaatcctta

SEQ ID NO: 671440 - DNA, 20 bp, mouse
gacatgactctaaaaggaga

SEQ ID NO: 671441 - DNA, 20 bp, mouse
gttacagattatcagaactc

SEQ ID NO: 671442 - DNA, 20 bp, mouse
gcagataaagaaagtgagca

SEQ ID NO: 671443 - DNA, 20 bp, mouse
gtaagattatagattcattt

SEQ ID NO: 671444 - DNA, 20 bp, mouse
gaaaagaaaatacattatca

SEQ ID NO: 671445 - DNA, 20 bp, mouse
gttcatttacaaatgactaa

SEQ ID NO: 671446 - DNA, 20 bp, mouse
gtcgaactggggcattgtct

SEQ ID NO: 671447 - DNA, 20 bp, mouse
gctaatagccagagctttat

SEQ ID NO: 671448 - DNA, 20 bp, mouse
gtggagcaatctgcctcctc

SEQ ID NO: 671449 - DNA, 20 bp, mouse
gaaagtgttcacaccagagg

SEQ ID NO: 671450 - DNA, 20 bp, mouse
ggaggcagattgctccatat

SEQ ID NO: 671451 - DNA, 20 bp, mouse
gtactgggaaggctttggtt

SEQ ID NO: 671452 - DNA, 20 bp, mouse
ggcgctctggagaatgtgat

SEQ ID NO: 671453 - DNA, 20 bp, mouse
gtaaatggcaggagcgtagc

SEQ ID NO: 671454 - DNA, 20 bp, mouse
gtgccggtctgagtcctcta

SEQ ID NO: 671455 - DNA, 20 bp, mouse
ggcccctagaggactcagac

SEQ ID NO: 671456 - DNA, 20 bp, mouse
gtgaggcgcagagtaggcgg

SEQ ID NO: 671457 - DNA, 20 bp, mouse
gggcggaggccgagaggcgt

SEQ ID NO: 671458 - DNA, 20 bp, mouse
ggcttgaggcgcagagtagg

SEQ ID NO: 671459 - DNA, 20 bp, mouse
gtgcaacagcccacgcctct

SEQ ID NO: 671460 - DNA, 20 bp, mouse
gctctgcgcctcaagctctg

SEQ ID NO: 671461 - DNA, 20 bp, mouse
gagtgagcccattggtgcaa

SEQ ID NO: 671462 - DNA, 20 bp, mouse
ggcacggagagtgagcccat

SEQ ID NO: 671463 - DNA, 20 bp, mouse
ggtagcagctagttctattt

SEQ ID NO: 671464 - DNA, 20 bp, mouse
gcctcaagctctgcggaacc

SEQ ID NO: 671465 - DNA, 20 bp, mouse
gcgccccgcccctcattgtg

SEQ ID NO: 671466 - DNA, 20 bp, mouse
ggtcaggcggaggacagcgg

SEQ ID NO: 671467 - DNA, 20 bp, mouse
gcgggagccccgatgctgac

SEQ ID NO: 671468 - DNA, 20 bp, mouse
ggagctccggggtcaggcgg

SEQ ID NO: 671469 - DNA, 20 bp, mouse
gctggagctccggggtcagg

SEQ ID NO: 671470 - DNA, 20 bp, mouse
ggttctggagctccggggtc

SEQ ID NO: 671471 - DNA, 20 bp, mouse
gctcctggcgctgctctggg

SEQ ID NO: 671472 - DNA, 20 bp, mouse
ggggttgtgacgtgaggaaa

SEQ ID NO: 671473 - DNA, 20 bp, mouse
gaagaaggaggggtcggcgg

SEQ ID NO: 671474 - DNA, 20 bp, mouse
gctagcagaaccacgcgcag

SEQ ID NO: 671475 - DNA, 20 bp, mouse
gaccatccctgtcagcatcg

SEQ ID NO: 671476 - DNA, 20 bp, mouse
gctgcgagaaacccgggtgg

SEQ ID NO: 671477 - DNA, 20 bp, mouse
gccccatgctacttctctga

SEQ ID NO: 671478 - DNA, 20 bp, mouse
gcggaagttggcttcctctc

SEQ ID NO: 671479 - DNA, 20 bp, mouse
gaagctgcgagaaacccggg

SEQ ID NO: 671480 - DNA, 20 bp, mouse
ggggaaactaggttagcaag

SEQ ID NO: 671481 - DNA, 20 bp, mouse
gaagccaacttccgcctcta

SEQ ID NO: 671482 - DNA, 20 bp, mouse
ggggcgaaactgaccagtca

SEQ ID NO: 671483 - DNA, 20 bp, mouse
gcccgcccgcccccaaagct

SEQ ID NO: 671484 - DNA, 20 bp, mouse
gtccttcagagaagtagcat

SEQ ID NO: 671485 - DNA, 20 bp, mouse
gcgcccctagaggcggaagt

SEQ ID NO: 671486 - DNA, 20 bp, mouse
gcggcccaggatgcgagcca

SEQ ID NO: 671487 - DNA, 20 bp, mouse
ggaagcctacatgttcagac

SEQ ID NO: 671488 - DNA, 20 bp, mouse
gtctaccagtctgaacatgt

SEQ ID NO: 671489 - DNA, 20 bp, mouse
gcggctccaccggataaaaa

SEQ ID NO: 671490 - DNA, 20 bp, mouse
gtccactggagcggctccac

SEQ ID NO: 671491 - DNA, 20 bp, mouse
ggtctggagagaatgctttt

SEQ ID NO: 671492 - DNA, 20 bp, mouse
gggcctctatgctgactgct

SEQ ID NO: 671493 - DNA, 20 bp, mouse
ggcacacgcgtggttatcag

SEQ ID NO: 671494 - DNA, 20 bp, mouse
gtctcttggaggccttgtgg

SEQ ID NO: 671495 - DNA, 20 bp, mouse
ggggtttttagcaaagacaa

SEQ ID NO: 671496 - DNA, 20 bp, mouse
gactaacaaagcagcatcaa

SEQ ID NO: 671497 - DNA, 20 bp, mouse
ggctacaaggaaatggagaa

SEQ ID NO: 671498 - DNA, 20 bp, mouse
gggaggggcagagtgcacaa

SEQ ID NO: 671499 - DNA, 20 bp, mouse
gggtaaggtggggtattagg

SEQ ID NO: 671500 - DNA, 20 bp, mouse
gctgggtaaggtggggtatt

SEQ ID NO: 671501 - DNA, 20 bp, mouse
gcacctaggcgtgtgaacgt

SEQ ID NO: 671502 - DNA, 20 bp, mouse
gactaagtgatttctgggta

SEQ ID NO: 671503 - DNA, 20 bp, mouse
ggggtgacaaagcagctaca

SEQ ID NO: 671504 - DNA, 20 bp, mouse
gctggagaagggtgagatga

SEQ ID NO: 671505 - DNA, 20 bp, mouse
gctccagaaagaggaaccca

SEQ ID NO: 671506 - DNA, 20 bp, mouse
gcccccgcgtgcctaccttc

SEQ ID NO: 671507 - DNA, 20 bp, mouse
gcctgggcccgggtaaaccg

SEQ ID NO: 671508 - DNA, 20 bp, mouse
gagggcgggcgctaaggccg

SEQ ID NO: 671509 - DNA, 20 bp, mouse
ggccagggaaaaggtggcgc

SEQ ID NO: 671510 - DNA, 20 bp, mouse
ggtggagagcagcgactgtg

SEQ ID NO: 671511 - DNA, 20 bp, mouse
ggcacgcggggggatctgga

SEQ ID NO: 671512 - DNA, 20 bp, mouse
ggcgctaaggccgagggcca

SEQ ID NO: 671513 - DNA, 20 bp, mouse
ggcaacaccggctcagactg

SEQ ID NO: 671514 - DNA, 20 bp, mouse
gtcgggcccgcagtctgagc

SEQ ID NO: 671515 - DNA, 20 bp, mouse
gtgcctgaaggtaggcacgc

SEQ ID NO: 671516 - DNA, 20 bp, mouse
gtaaaaacaaaactgatctg

SEQ ID NO: 671517 - DNA, 20 bp, mouse
gcccagctgcacataagctc

SEQ ID NO: 671518 - DNA, 20 bp, mouse
ggtaaattctacccagtgat

SEQ ID NO: 671519 - DNA, 20 bp, mouse
gcacataagctcagggatca

SEQ ID NO: 671520 - DNA, 20 bp, mouse
gtcttcataagctgtccttg

SEQ ID NO: 671521 - DNA, 20 bp, mouse
gccaagtgccatccaatcac

SEQ ID NO: 671522 - DNA, 20 bp, mouse
gaaggtatgaggtgattctg

SEQ ID NO: 671523 - DNA, 20 bp, mouse
ggaggacagtagatatgtcc

SEQ ID NO: 671524 - DNA, 20 bp, mouse
gtgctggtataaaagacagt

SEQ ID NO: 671525 - DNA, 20 bp, mouse
ggggagactttattaactgc

SEQ ID NO: 671526 - DNA, 20 bp, mouse
gcgggcatgcctatgattgg

SEQ ID NO: 671527 - DNA, 20 bp, mouse
ggaaaactgggggcgtgggt

SEQ ID NO: 671528 - DNA, 20 bp, mouse
ggaaggacaccgccaatcat

SEQ ID NO: 671529 - DNA, 20 bp, mouse
ggcggcggagctcgctcggg

SEQ ID NO: 671530 - DNA, 20 bp, mouse
gcctccgccccagccggaca

SEQ ID NO: 671531 - DNA, 20 bp, mouse
gggcgcggcaggggacacgg

SEQ ID NO: 671532 - DNA, 20 bp, mouse
gtagccctgtccggctgggg

SEQ ID NO: 671533 - DNA, 20 bp, mouse
ggccgcggcggagctcgctc

SEQ ID NO: 671534 - DNA, 20 bp, mouse
gggagccggaagtagagccc

SEQ ID NO: 671535 - DNA, 20 bp, mouse
ggcaggggacacggcggccg

SEQ ID NO: 671536 - DNA, 20 bp, mouse
ggcggtggggtcacgtggac

SEQ ID NO: 671537 - DNA, 20 bp, mouse
gtggggtcacgtggactggt

SEQ ID NO: 671538 - DNA, 20 bp, mouse
gagggagctcagagctcgga

SEQ ID NO: 671539 - DNA, 20 bp, mouse
ggggctggggaccccggttc

SEQ ID NO: 671540 - DNA, 20 bp, mouse
gctcctggggagtaacaggt

SEQ ID NO: 671541 - DNA, 20 bp, mouse
gcggtggacgggaggggcgg

SEQ ID NO: 671542 - DNA, 20 bp, mouse
ggcccccaaaatggcctctt

SEQ ID NO: 671543 - DNA, 20 bp, mouse
gtagcgccagagcatcccct

SEQ ID NO: 671544 - DNA, 20 bp, mouse
gaccggggtccccagcccgg

SEQ ID NO: 671545 - DNA, 20 bp, mouse
gcccctcccgtccaccgggc

SEQ ID NO: 671546 - DNA, 20 bp, mouse
ggggtcctgggtcgctggga

SEQ ID NO: 671547 - DNA, 20 bp, mouse
gaggtctcagggcgcagatg

SEQ ID NO: 671548 - DNA, 20 bp, mouse
ggcccctcgcggacagtccc

SEQ ID NO: 671549 - DNA, 20 bp, mouse
gcgcccgggactgtccgcga

SEQ ID NO: 671550 - DNA, 20 bp, mouse
ggggaacggggtgctggtat

SEQ ID NO: 671551 - DNA, 20 bp, mouse
gcagatggggcagggtttca

SEQ ID NO: 671552 - DNA, 20 bp, mouse
gtcagggcgcagatggggca

SEQ ID NO: 671553 - DNA, 20 bp, mouse
gctggaggaggggttgtaag

SEQ ID NO: 671554 - DNA, 20 bp, mouse
gcccggcggaccgaggactg

SEQ ID NO: 671555 - DNA, 20 bp, mouse
gtcctcggtccgccgggtcc

SEQ ID NO: 671556 - DNA, 20 bp, mouse
ggcgagcgacagccacggga

SEQ ID NO: 671557 - DNA, 20 bp, mouse
gggacaggtctgcccaagga

SEQ ID NO: 671558 - DNA, 20 bp, mouse
gagggccaccgcccctcctt

SEQ ID NO: 671559 - DNA, 20 bp, mouse
gtgagtgtgacgagctggtg

SEQ ID NO: 671560 - DNA, 20 bp, mouse
gaggggcggtggccctcccg

SEQ ID NO: 671561 - DNA, 20 bp, mouse
gccgggagggcgacgtggaa

SEQ ID NO: 671562 - DNA, 20 bp, mouse
gcccaggcccgggcagagtc

SEQ ID NO: 671563 - DNA, 20 bp, mouse
gccggagcgagcgacagcca

SEQ ID NO: 671564 - DNA, 20 bp, mouse
gtctgcccaaggaggggcgg

SEQ ID NO: 671565 - DNA, 20 bp, mouse
gcacctggccttgttccatg

SEQ ID NO: 671566 - DNA, 20 bp, mouse
gcggctggcggaattctctc

SEQ ID NO: 671567 - DNA, 20 bp, mouse
gctctcaggccaccaatcct

SEQ ID NO: 671568 - DNA, 20 bp, mouse
gagtagtcgggaccagacga

SEQ ID NO: 671569 - DNA, 20 bp, mouse
gactggctacgtaacaggga

SEQ ID NO: 671570 - DNA, 20 bp, mouse
gagtcgggaccagacgaggg

SEQ ID NO: 671571 - DNA, 20 bp, mouse
ggccctgcgcccaggattgg

SEQ ID NO: 671572 - DNA, 20 bp, mouse
gcctgccctgcgcccaggat

SEQ ID NO: 671573 - DNA, 20 bp, mouse
gtccgccctgccctgcgccc

SEQ ID NO: 671574 - DNA, 20 bp, mouse
gagacggaatgccaatcaca

SEQ ID NO: 671575 - DNA, 20 bp, mouse
ggccacgcccctccctcgtc

SEQ ID NO: 671576 - DNA, 20 bp, mouse
ggggccgctgcttgcgtgaa

SEQ ID NO: 671577 - DNA, 20 bp, mouse
gaggtgggaaggagacggaa

SEQ ID NO: 671578 - DNA, 20 bp, mouse
gacggaagggtgacgtcact

SEQ ID NO: 671579 - DNA, 20 bp, mouse
ggtctgggaaagggctttaa

SEQ ID NO: 671580 - DNA, 20 bp, mouse
gctccccttcacgcaagcag

SEQ ID NO: 671581 - DNA, 20 bp, mouse
gcaaacagttctttacgtct

SEQ ID NO: 671582 - DNA, 20 bp, mouse
ggagagagcgattctgcctt

SEQ ID NO: 671583 - DNA, 20 bp, mouse
ggttctttacgtctgggaaa

SEQ ID NO: 671584 - DNA, 20 bp, mouse
ggcacactcagagtccccca

SEQ ID NO: 671585 - DNA, 20 bp, mouse
ggacagggattgagtcctgt

SEQ ID NO: 671586 - DNA, 20 bp, mouse
gagcacgcgcgttggccctg

SEQ ID NO: 671587 - DNA, 20 bp, mouse
gggtgcccgcgcccattcta

SEQ ID NO: 671588 - DNA, 20 bp, mouse
gtgctctggtacccactcgg

SEQ ID NO: 671589 - DNA, 20 bp, mouse
gcctggcaggagtgatgcaa

SEQ ID NO: 671590 - DNA, 20 bp, mouse
gctcccgtggcagacctggc

SEQ ID NO: 671591 - DNA, 20 bp, mouse
gcgcgcgttggccctggggc

SEQ ID NO: 671592 - DNA, 20 bp, mouse
gggccaacgcgcgtgctgat

SEQ ID NO: 671593 - DNA, 20 bp, mouse
gggctgctctggtacccact

SEQ ID NO: 671594 - DNA, 20 bp, mouse
gaaccgcgccgccctccgag

SEQ ID NO: 671595 - DNA, 20 bp, mouse
gttgctgcatgccagttctg

SEQ ID NO: 671596 - DNA, 20 bp, mouse
ggtgcggcgcaaagcacact

SEQ ID NO: 671597 - DNA, 20 bp, mouse
gttgtggtgccctataagac

SEQ ID NO: 671598 - DNA, 20 bp, mouse
gcagccagagtggcagatcc

SEQ ID NO: 671599 - DNA, 20 bp, mouse
gagcttctatggtgcgggag

SEQ ID NO: 671600 - DNA, 20 bp, mouse
gtctatggtgcgggaggggt

SEQ ID NO: 671601 - DNA, 20 bp, mouse
gggcaggactcctgtcttat

SEQ ID NO: 671602 - DNA, 20 bp, mouse
gtgggttttcagagcttcta

SEQ ID NO: 671603 - DNA, 20 bp, mouse
gaatgactacgtgctaattg

SEQ ID NO: 671604 - DNA, 20 bp, mouse
gtctggcttcgcctgatgtg

SEQ ID NO: 671605 - DNA, 20 bp, mouse
ggtaaaactctaaagaattg

SEQ ID NO: 671606 - DNA, 20 bp, mouse
ggatgcgtccccatcctcga

SEQ ID NO: 671607 - DNA, 20 bp, mouse
ggaggatggggacgcatctc

SEQ ID NO: 671608 - DNA, 20 bp, mouse
gagaccgtgtgtagggctga

SEQ ID NO: 671609 - DNA, 20 bp, mouse
gcgggaaggggttaaatcag

SEQ ID NO: 671610 - DNA, 20 bp, mouse
gaggtggggtggacggtgat

SEQ ID NO: 671611 - DNA, 20 bp, mouse
gcagcaggagaccgtgtgta

SEQ ID NO: 671612 - DNA, 20 bp, mouse
ggcccccagccatcgaggat

SEQ ID NO: 671613 - DNA, 20 bp, mouse
gtggaccaacaccccgaggt

SEQ ID NO: 671614 - DNA, 20 bp, mouse
gtccccatcctcgatggctg

SEQ ID NO: 671615 - DNA, 20 bp, mouse
gtcaaggctgccctataaat

SEQ ID NO: 671616 - DNA, 20 bp, mouse
gttccccagcctgtgggcag

SEQ ID NO: 671617 - DNA, 20 bp, mouse
gaccccctgcccacaggctg

SEQ ID NO: 671618 - DNA, 20 bp, mouse
gtggactggccggtgggcat

SEQ ID NO: 671619 - DNA, 20 bp, mouse
ggggaagccccagctcggct

SEQ ID NO: 671620 - DNA, 20 bp, mouse
gtggctcaggcctgagtcct

SEQ ID NO: 671621 - DNA, 20 bp, mouse
gcatgggtggcgatggagat

SEQ ID NO: 671622 - DNA, 20 bp, mouse
gccggccagtccaaggactc

SEQ ID NO: 671623 - DNA, 20 bp, mouse
gcagcacaggcttaacaacg

SEQ ID NO: 671624 - DNA, 20 bp, mouse
gtcctggctgccaagcccat

SEQ ID NO: 671625 - DNA, 20 bp, mouse
gcaggcctgagtccttggac

SEQ ID NO: 671626 - DNA, 20 bp, mouse
gcccgggcagcgcaggtcag

SEQ ID NO: 671627 - DNA, 20 bp, mouse
gcgaggccctggatacgctg

SEQ ID NO: 671628 - DNA, 20 bp, mouse
gcgcctgcgaggcgaggccc

SEQ ID NO: 671629 - DNA, 20 bp, mouse
ggctgcagggcaacccgctg

SEQ ID NO: 671630 - DNA, 20 bp, mouse
gcgtggcaggcgcaccacag

SEQ ID NO: 671631 - DNA, 20 bp, mouse
gcgacgcggcggcgggggac

SEQ ID NO: 671632 - DNA, 20 bp, mouse
gccccgccgccgcgtcgccc

SEQ ID NO: 671633 - DNA, 20 bp, mouse
ggagggccgcagcgtatcca

SEQ ID NO: 671634 - DNA, 20 bp, mouse
gggccggggacctgtagcgg

SEQ ID NO: 671635 - DNA, 20 bp, mouse
gtggttcccgcggaggtcga

SEQ ID NO: 671636 - DNA, 20 bp, mouse
gtgctagaaaatcccgcggg

SEQ ID NO: 671637 - DNA, 20 bp, mouse
gtacgtcctcgcgagaactt

SEQ ID NO: 671638 - DNA, 20 bp, mouse
gagtgcacctctttttccgg

SEQ ID NO: 671639 - DNA, 20 bp, mouse
gagctcctgaaccgccggaa

SEQ ID NO: 671640 - DNA, 20 bp, mouse
gtagccaataaaaggggtgt

SEQ ID NO: 671641 - DNA, 20 bp, mouse
gcggccgccgcgctcgtatt

SEQ ID NO: 671642 - DNA, 20 bp, mouse
gtcccgcgggaggcggatga

SEQ ID NO: 671643 - DNA, 20 bp, mouse
gggaaccgcggcaaccaccg

SEQ ID NO: 671644 - DNA, 20 bp, mouse
ggatgaaggctcctttccgg

SEQ ID NO: 671645 - DNA, 20 bp, mouse
gaacgcatatagccaataaa

SEQ ID NO: 671646 - DNA, 20 bp, mouse
gccaccggaagccaaggtgc

SEQ ID NO: 671647 - DNA, 20 bp, mouse
gagcccagagctccgcccac

SEQ ID NO: 671648 - DNA, 20 bp, mouse
gcgccccgaggaggcgtgac

SEQ ID NO: 671649 - DNA, 20 bp, mouse
gcccgaggaggcgtgaccgg

SEQ ID NO: 671650 - DNA, 20 bp, mouse
gctccgcccaccggaagcca

SEQ ID NO: 671651 - DNA, 20 bp, mouse
ggggctcttttctttctcgt

SEQ ID NO: 671652 - DNA, 20 bp, mouse
gttgctggccactgggagga

SEQ ID NO: 671653 - DNA, 20 bp, mouse
gctctgaatgggagggtcca

SEQ ID NO: 671654 - DNA, 20 bp, mouse
gacaagacaaagtctctgaa

SEQ ID NO: 671655 - DNA, 20 bp, mouse
gacactgacgcgtggtaggt

SEQ ID NO: 671656 - DNA, 20 bp, mouse
gggcccctaaggttcccagc

SEQ ID NO: 671657 - DNA, 20 bp, mouse
ggcgacccggaggcacgcga

SEQ ID NO: 671658 - DNA, 20 bp, mouse
ggcccagctgggaaccttag

SEQ ID NO: 671659 - DNA, 20 bp, mouse
gtcctccggcacagcccagc

SEQ ID NO: 671660 - DNA, 20 bp, mouse
ggcgagcgcgcggtacttcc

SEQ ID NO: 671661 - DNA, 20 bp, mouse
gcccagctgggctgtgccgg

SEQ ID NO: 671662 - DNA, 20 bp, mouse
gaagtaccgcgcgctcgcac

SEQ ID NO: 671663 - DNA, 20 bp, mouse
gtgtgcggcctcgggaatgg

SEQ ID NO: 671664 - DNA, 20 bp, mouse
gaggcacgcgacggcacttc

SEQ ID NO: 671665 - DNA, 20 bp, mouse
gggctgtgcggcctcgggaa

SEQ ID NO: 671666 - DNA, 20 bp, mouse
gaaacgcagggcagagtgtg

SEQ ID NO: 671667 - DNA, 20 bp, mouse
gccagtgcaggaactcatcc

SEQ ID NO: 671668 - DNA, 20 bp, mouse
gtgtcctagacaggttttga

SEQ ID NO: 671669 - DNA, 20 bp, mouse
gccgggaagctgtcctagac

SEQ ID NO: 671670 - DNA, 20 bp, mouse
gagacttaggccttggaaag

SEQ ID NO: 671671 - DNA, 20 bp, mouse
gcccaggagccggtgcggat

SEQ ID NO: 671672 - DNA, 20 bp, mouse
gctgccctcaaaacctgtct

SEQ ID NO: 671673 - DNA, 20 bp, mouse
ggggggagcagtggactgtg

SEQ ID NO: 671674 - DNA, 20 bp, mouse
gggtgcggatgggggagtat

SEQ ID NO: 671675 - DNA, 20 bp, mouse
ggttttgagggcagaaaaca

SEQ ID NO: 671676 - DNA, 20 bp, mouse
gcacactgggcccaacgcat

SEQ ID NO: 671677 - DNA, 20 bp, mouse
ggggcctcacgtgccatcta

SEQ ID NO: 671678 - DNA, 20 bp, mouse
ggatgccagtcagctgagat

SEQ ID NO: 671679 - DNA, 20 bp, mouse
gcgtgtgcagccctcccgga

SEQ ID NO: 671680 - DNA, 20 bp, mouse
gcagtctgtggactggaact

SEQ ID NO: 671681 - DNA, 20 bp, mouse
gtgaccctagatggcacgtg

SEQ ID NO: 671682 - DNA, 20 bp, mouse
gtcccgggtgggaagcccag

SEQ ID NO: 671683 - DNA, 20 bp, mouse
gttccagtccacagactgga

SEQ ID NO: 671684 - DNA, 20 bp, mouse
ggaagagttttgaccctaga

SEQ ID NO: 671685 - DNA, 20 bp, mouse
gggcactgttatctagtaag

SEQ ID NO: 671686 - DNA, 20 bp, mouse
gcggcagccgacagcaggtt

SEQ ID NO: 671687 - DNA, 20 bp, mouse
ggggacccggcaggattcag

SEQ ID NO: 671688 - DNA, 20 bp, mouse
gggaaggcgttggatcccgt

SEQ ID NO: 671689 - DNA, 20 bp, mouse
gcgggtcccgagcacgcaaa

SEQ ID NO: 671690 - DNA, 20 bp, mouse
gttcaggggccccgtgtccg

SEQ ID NO: 671691 - DNA, 20 bp, mouse
gggggcccctgaatcctgcc

SEQ ID NO: 671692 - DNA, 20 bp, mouse
gaagtggcagccgcggacac

SEQ ID NO: 671693 - DNA, 20 bp, mouse
gtgtcggctgccggcccgac

SEQ ID NO: 671694 - DNA, 20 bp, mouse
ggggctggagttaaggattt

SEQ ID NO: 671695 - DNA, 20 bp, mouse
ggattcgaaccccgtcgggc

SEQ ID NO: 671696 - DNA, 20 bp, mouse
ggctccggagccctaaatcc

SEQ ID NO: 671697 - DNA, 20 bp, mouse
gcggagctacgcgagtcctg

SEQ ID NO: 671698 - DNA, 20 bp, mouse
gttggcccctcccatttgga

SEQ ID NO: 671699 - DNA, 20 bp, mouse
gccctgcactgggatagctc

SEQ ID NO: 671700 - DNA, 20 bp, mouse
gccacgccctccaaatggga

SEQ ID NO: 671701 - DNA, 20 bp, mouse
gtggggacaccggtcagctt

SEQ ID NO: 671702 - DNA, 20 bp, mouse
gccaaggcttagttaggcac

SEQ ID NO: 671703 - DNA, 20 bp, mouse
gaactcaagcaatgcaatag

SEQ ID NO: 671704 - DNA, 20 bp, mouse
gccggagccctaaatccagg

SEQ ID NO: 671705 - DNA, 20 bp, mouse
ggttaggcacggggcagcga

SEQ ID NO: 671706 - DNA, 20 bp, mouse
gggcccggaagttacgaagt

SEQ ID NO: 671707 - DNA, 20 bp, mouse
gagcctggactcagcgtcct

SEQ ID NO: 671708 - DNA, 20 bp, mouse
gctaacctccaccattgaat

SEQ ID NO: 671709 - DNA, 20 bp, mouse
gcttactggggtctgctctt

SEQ ID NO: 671710 - DNA, 20 bp, mouse
gaggctaaccggaagttcct

SEQ ID NO: 671711 - DNA, 20 bp, mouse
gctgcgtgaccagtactagg

SEQ ID NO: 671712 - DNA, 20 bp, mouse
gcaggagacagtgaaaatca

SEQ ID NO: 671713 - DNA, 20 bp, mouse
gctcaagtaaactggattag

SEQ ID NO: 671714 - DNA, 20 bp, mouse
gggtggaggcggtacctcac

SEQ ID NO: 671715 - DNA, 20 bp, mouse
ggctctgctcccaacatgtc

SEQ ID NO: 671716 - DNA, 20 bp, mouse
gcaacaggtggtgcttaata

SEQ ID NO: 671717 - DNA, 20 bp, mouse
gaaggtgcactaggattggc

SEQ ID NO: 671718 - DNA, 20 bp, mouse
ggggaattgtagtctcgatc

SEQ ID NO: 671719 - DNA, 20 bp, mouse
gcctacttctggcacgtgac

SEQ ID NO: 671720 - DNA, 20 bp, mouse
gggattggctggattggacc

SEQ ID NO: 671721 - DNA, 20 bp, mouse
gagccctgaaggcctccttc

SEQ ID NO: 671722 - DNA, 20 bp, mouse
gcacctgttgccatagcatc

SEQ ID NO: 671723 - DNA, 20 bp, mouse
gcccaaaagcccgcctcctc

SEQ ID NO: 671724 - DNA, 20 bp, mouse
gacccggatgctatggcaac

SEQ ID NO: 671725 - DNA, 20 bp, mouse
gggcgggcagtttgcttctc

SEQ ID NO: 671726 - DNA, 20 bp, mouse
gtctagttggagaggcgcaa

SEQ ID NO: 671727 - DNA, 20 bp, mouse
gcgcacgcgcagacaacttg

SEQ ID NO: 671728 - DNA, 20 bp, mouse
gcaggcctgagaagcggcga

SEQ ID NO: 671729 - DNA, 20 bp, mouse
gtggcgaacgtgtcagacgt

SEQ ID NO: 671730 - DNA, 20 bp, mouse
gacaacttgaggcttaggca

SEQ ID NO: 671731 - DNA, 20 bp, mouse
ggcgcaccagtgaaatacag

SEQ ID NO: 671732 - DNA, 20 bp, mouse
gtgcgcgctgcaagatttct

SEQ ID NO: 671733 - DNA, 20 bp, mouse
gacgaccggaacgcagaata

SEQ ID NO: 671734 - DNA, 20 bp, mouse
gtctgcgcgtgcgcatctta

SEQ ID NO: 671735 - DNA, 20 bp, mouse
gcgcggcgggcaggcctgga

SEQ ID NO: 671736 - DNA, 20 bp, mouse
gcaggggcctcctcccggat

SEQ ID NO: 671737 - DNA, 20 bp, mouse
gggaccggaagtagttacag

SEQ ID NO: 671738 - DNA, 20 bp, mouse
gtcccggataggcagtgagg

SEQ ID NO: 671739 - DNA, 20 bp, mouse
gtcactgcctatccgggagg

SEQ ID NO: 671740 - DNA, 20 bp, mouse
ggggaaagtggcagcgcgag

SEQ ID NO: 671741 - DNA, 20 bp, mouse
gatgaaggttggaccaatgt

SEQ ID NO: 671742 - DNA, 20 bp, mouse
gggcagggacgctcgacgac

SEQ ID NO: 671743 - DNA, 20 bp, mouse
gaagcaggacacagccatga

SEQ ID NO: 671744 - DNA, 20 bp, mouse
gcgaccggaagagtgaggcc

SEQ ID NO: 671745 - DNA, 20 bp, mouse
gctcgacgaccggaagagtg

SEQ ID NO: 671746 - DNA, 20 bp, mouse
gggcgtggctctctgaggta

SEQ ID NO: 671747 - DNA, 20 bp, mouse
gtctgaggtaggggtacctg

SEQ ID NO: 671748 - DNA, 20 bp, mouse
ggggctggaaaattggacag

SEQ ID NO: 671749 - DNA, 20 bp, mouse
gctggcgcgcgttgccctgt

SEQ ID NO: 671750 - DNA, 20 bp, mouse
gagacgctgagacaaggtca

SEQ ID NO: 671751 - DNA, 20 bp, mouse
gccattaaaaagctctggaa

SEQ ID NO: 671752 - DNA, 20 bp, mouse
gcagcaacactgcgctctat

SEQ ID NO: 671753 - DNA, 20 bp, mouse
gtgcgctctattggctgctg

SEQ ID NO: 671754 - DNA, 20 bp, mouse
gtcaagcaggttacatgggg

SEQ ID NO: 671755 - DNA, 20 bp, mouse
gcggcctacgctcgtcactc

SEQ ID NO: 671756 - DNA, 20 bp, mouse
gagggctcaagcaggaggag

SEQ ID NO: 671757 - DNA, 20 bp, mouse
gaactctgtgaggttggggc

SEQ ID NO: 671758 - DNA, 20 bp, mouse
gaggcgcgcggaactctgtg

SEQ ID NO: 671759 - DNA, 20 bp, mouse
gtggtaagagcgatgctgaa

SEQ ID NO: 671760 - DNA, 20 bp, mouse
ggcggtgggcgcgacgtcgg

SEQ ID NO: 671761 - DNA, 20 bp, mouse
gtcgctccgcccccgggcag

SEQ ID NO: 671762 - DNA, 20 bp, mouse
ggcgggaggagggctcaagc

SEQ ID NO: 671763 - DNA, 20 bp, mouse
gaatctggcagcggcgtgcg

SEQ ID NO: 671764 - DNA, 20 bp, mouse
gcgcggaactctgtgaggtt

SEQ ID NO: 671765 - DNA, 20 bp, mouse
gtccgcccccgggcagcggg

SEQ ID NO: 671766 - DNA, 20 bp, mouse
ggagcctgggctggactcgg

SEQ ID NO: 671767 - DNA, 20 bp, mouse
ggctacccctggcgttcgtg

SEQ ID NO: 671768 - DNA, 20 bp, mouse
gcgaacgccaggggtagcgc

SEQ ID NO: 671769 - DNA, 20 bp, mouse
ggagtgcgaaggccgagcct

SEQ ID NO: 671770 - DNA, 20 bp, mouse
gcggagctgctgcgtcaccc

SEQ ID NO: 671771 - DNA, 20 bp, mouse
gcgggaaggggagtgaaccg

SEQ ID NO: 671772 - DNA, 20 bp, mouse
ggaaggggagtgaaccgagg

SEQ ID NO: 671773 - DNA, 20 bp, mouse
gggagccccacgaacgccag

SEQ ID NO: 671774 - DNA, 20 bp, mouse
gcggccttcgcactcgtaac

SEQ ID NO: 671775 - DNA, 20 bp, mouse
ggggatgggcgctctggtca

SEQ ID NO: 671776 - DNA, 20 bp, mouse
gaaaacatggaaagctgctc

SEQ ID NO: 671777 - DNA, 20 bp, mouse
gtacccaagcaacccaagtt

SEQ ID NO: 671778 - DNA, 20 bp, mouse
gctgcgtgctaaggaagcgt

SEQ ID NO: 671779 - DNA, 20 bp, mouse
gacaacgcaccgccgccaga

SEQ ID NO: 671780 - DNA, 20 bp, mouse
gcttccgcacctgcgtgcta

SEQ ID NO: 671781 - DNA, 20 bp, mouse
gtaagtgtgcgtctgcgact

SEQ ID NO: 671782 - DNA, 20 bp, mouse
gcttccttagcacgcaggtg

SEQ ID NO: 671783 - DNA, 20 bp, mouse
gacgcaggtgcggaagactc

SEQ ID NO: 671784 - DNA, 20 bp, mouse
gaagctctgactcctaactt

SEQ ID NO: 671785 - DNA, 20 bp, mouse
ggtgctaaggaagcgtggga

SEQ ID NO: 671786 - DNA, 20 bp, mouse
gccactccatcagagggagg

SEQ ID NO: 671787 - DNA, 20 bp, mouse
ggtcttctggctctcttgga

SEQ ID NO: 671788 - DNA, 20 bp, mouse
gtctgatggagtggtctgga

SEQ ID NO: 671789 - DNA, 20 bp, mouse
ggtacatcacctgagttgtg

SEQ ID NO: 671790 - DNA, 20 bp, mouse
gagaccactccatcagaggg

SEQ ID NO: 671791 - DNA, 20 bp, mouse
gagatgaaggggtgggtcta

SEQ ID NO: 671792 - DNA, 20 bp, mouse
gtgtggagttgggggtcttc

SEQ ID NO: 671793 - DNA, 20 bp, mouse
gagggcttcttaaccccctc

SEQ ID NO: 671794 - DNA, 20 bp, mouse
gaacaaattacatttctctc

SEQ ID NO: 671795 - DNA, 20 bp, mouse
gctctcttggatggagaatc

SEQ ID NO: 671796 - DNA, 20 bp, mouse
gcccccggggccggcgtctg

SEQ ID NO: 671797 - DNA, 20 bp, mouse
ggggccggcgtctgaggagg

SEQ ID NO: 671798 - DNA, 20 bp, mouse
gcgggggtgggtgttctgga

SEQ ID NO: 671799 - DNA, 20 bp, mouse
ggggtggcccgggggtttgg

SEQ ID NO: 671800 - DNA, 20 bp, mouse
ggccccgggggtgggtgttc

SEQ ID NO: 671801 - DNA, 20 bp, mouse
gtcctcagacgccggccccg

SEQ ID NO: 671802 - DNA, 20 bp, mouse
gcctcccaagagaacaagaa

SEQ ID NO: 671803 - DNA, 20 bp, mouse
gccacccccaaaaatgttct

SEQ ID NO: 671804 - DNA, 20 bp, mouse
gggggggtggcccgggggtt

SEQ ID NO: 671805 - DNA, 20 bp, mouse
gtttccaagaacatttttgg

SEQ ID NO: 671806 - DNA, 20 bp, mouse
gttgcccgggagacctaaag

SEQ ID NO: 671807 - DNA, 20 bp, mouse
gggagggtggcggtagtgga

SEQ ID NO: 671808 - DNA, 20 bp, mouse
ggcgcgcgcgcgctcgacgg

SEQ ID NO: 671809 - DNA, 20 bp, mouse
gcccgggagacctaaagagg

SEQ ID NO: 671810 - DNA, 20 bp, mouse
gtcgacgggggcgtggccaa

SEQ ID NO: 671811 - DNA, 20 bp, mouse
gccccgccccctcgtcgctc

SEQ ID NO: 671812 - DNA, 20 bp, mouse
gggttgcctgagcgacgagg

SEQ ID NO: 671813 - DNA, 20 bp, mouse
gaggaggtgggcggttgccc

SEQ ID NO: 671814 - DNA, 20 bp, mouse
ggagggggcgggggttgccc

SEQ ID NO: 671815 - DNA, 20 bp, mouse
gtcgtcgctcaggcaaccat

SEQ ID NO: 671816 - DNA, 20 bp, mouse
gctggcgtaacgatgggatg

SEQ ID NO: 671817 - DNA, 20 bp, mouse
gtaacagccgagaacaagtt

SEQ ID NO: 671818 - DNA, 20 bp, mouse
gagcttgcggggtcgaaacg

SEQ ID NO: 671819 - DNA, 20 bp, mouse
gcgaccgctggccctgtctg

SEQ ID NO: 671820 - DNA, 20 bp, mouse
gagctcggccgtcgtgtccc

SEQ ID NO: 671821 - DNA, 20 bp, mouse
gagtccccccaacttgttct

SEQ ID NO: 671822 - DNA, 20 bp, mouse
gcggccgtcgtgtcccgggt

SEQ ID NO: 671823 - DNA, 20 bp, mouse
ggtcgtgtcccgggtcgggc

SEQ ID NO: 671824 - DNA, 20 bp, mouse
gagtcgcgctggcgtaacga

SEQ ID NO: 671825 - DNA, 20 bp, mouse
gtcagtgagcgcgcagtggg

SEQ ID NO: 671826 - DNA, 20 bp, mouse
ggcttgcaggagcgagtgat

SEQ ID NO: 671827 - DNA, 20 bp, mouse
gctgcaaggcggggagatct

SEQ ID NO: 671828 - DNA, 20 bp, mouse
gcggccgcttcattccgggg

SEQ ID NO: 671829 - DNA, 20 bp, mouse
ggggagctgcgctgtctgca

SEQ ID NO: 671830 - DNA, 20 bp, mouse
ggcccggccgcttcattccg

SEQ ID NO: 671831 - DNA, 20 bp, mouse
gtgcatggatgtgatcgcag

SEQ ID NO: 671832 - DNA, 20 bp, mouse
gtctaggctgggaggcggag

SEQ ID NO: 671833 - DNA, 20 bp, mouse
gaggcggggagatctaggct

SEQ ID NO: 671834 - DNA, 20 bp, mouse
gggcggggcgctcacgtcgt

SEQ ID NO: 671835 - DNA, 20 bp, mouse
gccgcccccccggaatgaag

SEQ ID NO: 671836 - DNA, 20 bp, mouse
ggcgcccggcgggacgggaa

SEQ ID NO: 671837 - DNA, 20 bp, mouse
ggccaggcgcgcctgacgtc

SEQ ID NO: 671838 - DNA, 20 bp, mouse
gaattcggccggggtggcgg

SEQ ID NO: 671839 - DNA, 20 bp, mouse
gccggcgggacgggaagggg

SEQ ID NO: 671840 - DNA, 20 bp, mouse
gccgcggccggctctctccg

SEQ ID NO: 671841 - DNA, 20 bp, mouse
gaaggtgctgcgcggaaacg

SEQ ID NO: 671842 - DNA, 20 bp, mouse
ggctccgggaaggtgctgcg

SEQ ID NO: 671843 - DNA, 20 bp, mouse
gcgccggcgcccggcgggac

SEQ ID NO: 671844 - DNA, 20 bp, mouse
gcgcgccgccacctgacgtc

SEQ ID NO: 671845 - DNA, 20 bp, mouse
gccgcggagaggccgagaga

SEQ ID NO: 671846 - DNA, 20 bp, mouse
gaaacttcaagatgtggaga

SEQ ID NO: 671847 - DNA, 20 bp, mouse
gagatggaagagtctaaagg

SEQ ID NO: 671848 - DNA, 20 bp, mouse
gcaaaaacattcagcttgtt

SEQ ID NO: 671849 - DNA, 20 bp, mouse
gacttcaatgacaacttcta

SEQ ID NO: 671850 - DNA, 20 bp, mouse
ggacataagaggacaatatg

SEQ ID NO: 671851 - DNA, 20 bp, mouse
gatgcaaatggatattaagg

SEQ ID NO: 671852 - DNA, 20 bp, mouse
gaactttatagatggacaca

SEQ ID NO: 671853 - DNA, 20 bp, mouse
gagtcagaaacttcaagatg

SEQ ID NO: 671854 - DNA, 20 bp, mouse
gaagtttaatgtttttgggg

SEQ ID NO: 671855 - DNA, 20 bp, mouse
gttaatgcaaatggatatta

SEQ ID NO: 671856 - DNA, 20 bp, mouse
ggagaagccacgccagacta

SEQ ID NO: 671857 - DNA, 20 bp, mouse
ggcgtactgaaagctgacgg

SEQ ID NO: 671858 - DNA, 20 bp, mouse
gagggtggatcccaggtcag

SEQ ID NO: 671859 - DNA, 20 bp, mouse
ggatagggataggcatccct

SEQ ID NO: 671860 - DNA, 20 bp, mouse
gccctgccaggaaaatccca

SEQ ID NO: 671861 - DNA, 20 bp, mouse
gaacaccctgggagcatccg

SEQ ID NO: 671862 - DNA, 20 bp, mouse
gagggtgggaggtgacgtga

SEQ ID NO: 671863 - DNA, 20 bp, mouse
gtcaccccttggggagcgtg

SEQ ID NO: 671864 - DNA, 20 bp, mouse
gagggcgtactgaaagctga

SEQ ID NO: 671865 - DNA, 20 bp, mouse
ggcatcctcggatgctccca

SEQ ID NO: 671866 - DNA, 20 bp, mouse
ggagttaaccatcacttttc

SEQ ID NO: 671867 - DNA, 20 bp, mouse
gaacagtacagcagttaacg

SEQ ID NO: 671868 - DNA, 20 bp, mouse
gaagtgatggttaactctgc

SEQ ID NO: 671869 - DNA, 20 bp, mouse
gcttagtgattactaaaaac

SEQ ID NO: 671870 - DNA, 20 bp, mouse
gtttctgatgttgcagtaac

SEQ ID NO: 671871 - DNA, 20 bp, mouse
ggttggatagtagtgtacta

SEQ ID NO: 671872 - DNA, 20 bp, mouse
gtgctgtgtagagtatgttg

SEQ ID NO: 671873 - DNA, 20 bp, mouse
gtacacagcattctacaaaa

SEQ ID NO: 671874 - DNA, 20 bp, mouse
gtcataagtgaggacgcttt

SEQ ID NO: 671875 - DNA, 20 bp, mouse
gttactaaaaacaggagaaa

SEQ ID NO: 671876 - DNA, 20 bp, mouse
gctacccccgcgagccccga

SEQ ID NO: 671877 - DNA, 20 bp, mouse
ggccctgcccaagccggcgc

SEQ ID NO: 671878 - DNA, 20 bp, mouse
gtggtcccaagacagtaaag

SEQ ID NO: 671879 - DNA, 20 bp, mouse
gggggctcgcgggggtaggc

SEQ ID NO: 671880 - DNA, 20 bp, mouse
gggccgccttgtcgccctcg

SEQ ID NO: 671881 - DNA, 20 bp, mouse
gttgggcagggcggtactgt

SEQ ID NO: 671882 - DNA, 20 bp, mouse
gggcagggcggtactgtggg

SEQ ID NO: 671883 - DNA, 20 bp, mouse
gggcgcccgccgcagttctc

SEQ ID NO: 671884 - DNA, 20 bp, mouse
ggtcgccctcggggctcgcg

SEQ ID NO: 671885 - DNA, 20 bp, mouse
gagtaccgccctgcccaagc

SEQ ID NO: 671886 - DNA, 20 bp, mouse
gtcagccagtattagaagga

SEQ ID NO: 671887 - DNA, 20 bp, mouse
gggacccttccttctaatac

SEQ ID NO: 671888 - DNA, 20 bp, mouse
gagaaggaagggtccttgcg

SEQ ID NO: 671889 - DNA, 20 bp, mouse
gtcagcttgtgtcttaacta

SEQ ID NO: 671890 - DNA, 20 bp, mouse
gggtggcgcagtctggatgg

SEQ ID NO: 671891 - DNA, 20 bp, mouse
gccggcccgctttacggcag

SEQ ID NO: 671892 - DNA, 20 bp, mouse
gccagactgcgccaccagtt

SEQ ID NO: 671893 - DNA, 20 bp, mouse
gactggctgaaattctgatg

SEQ ID NO: 671894 - DNA, 20 bp, mouse
gcagtcgtcaataccaaatc

SEQ ID NO: 671895 - DNA, 20 bp, mouse
ggcgcgcgttgtcctatccc

SEQ ID NO: 671896 - DNA, 20 bp, mouse
gactgccgcgattagtctca

SEQ ID NO: 671897 - DNA, 20 bp, mouse
ggtagcaagacccgagggaa

SEQ ID NO: 671898 - DNA, 20 bp, mouse
gaggaggcgggattagccgc

SEQ ID NO: 671899 - DNA, 20 bp, mouse
gcgagcggccgtcccaatgt

SEQ ID NO: 671900 - DNA, 20 bp, mouse
gtcgacgtcttggtttcccg

SEQ ID NO: 671901 - DNA, 20 bp, mouse
ggggaggaaggctttttgat

SEQ ID NO: 671902 - DNA, 20 bp, mouse
ggggctccgcatccccacat

SEQ ID NO: 671903 - DNA, 20 bp, mouse
gcctaggtagcaagacccga

SEQ ID NO: 671904 - DNA, 20 bp, mouse
gcaagccttgagactaatcg

SEQ ID NO: 671905 - DNA, 20 bp, mouse
gaatcgcggcagtcatcttc

SEQ ID NO: 671906 - DNA, 20 bp, mouse
gccagcgcgtcggggaacag

SEQ ID NO: 671907 - DNA, 20 bp, mouse
gaaacaccggaagtgaagac

SEQ ID NO: 671908 - DNA, 20 bp, mouse
gtgcgtgaggactccagaga

SEQ ID NO: 671909 - DNA, 20 bp, mouse
gggcgggaagggactgcgtg

SEQ ID NO: 671910 - DNA, 20 bp, mouse
gggaagtgaagaccggagga

SEQ ID NO: 671911 - DNA, 20 bp, mouse
gggccgccgcatgcgcaaag

SEQ ID NO: 671912 - DNA, 20 bp, mouse
gcggccggaagtggcgcgaa

SEQ ID NO: 671913 - DNA, 20 bp, mouse
gcacgcgcatgcgtctcact

SEQ ID NO: 671914 - DNA, 20 bp, mouse
gcaccggaagtgaagaccgg

SEQ ID NO: 671915 - DNA, 20 bp, mouse
ggtgaaagacgcagaggcct

SEQ ID NO: 671916 - DNA, 20 bp, mouse
gccagaaaaggctatccgga

SEQ ID NO: 671917 - DNA, 20 bp, mouse
ggggggcggggcggagcgat

SEQ ID NO: 671918 - DNA, 20 bp, mouse
gcggccgccagccaatcaca

SEQ ID NO: 671919 - DNA, 20 bp, mouse
ggcctcccgtggatcagctg

SEQ ID NO: 671920 - DNA, 20 bp, mouse
ggagcggtacgccctgtgat

SEQ ID NO: 671921 - DNA, 20 bp, mouse
gaaaggctatccggaggggg

SEQ ID NO: 671922 - DNA, 20 bp, mouse
ggctagagcggtgccagaaa

SEQ ID NO: 671923 - DNA, 20 bp, mouse
gagcacggaagtagctgtgg

SEQ ID NO: 671924 - DNA, 20 bp, mouse
gccgtgcccaccgagagcga

SEQ ID NO: 671925 - DNA, 20 bp, mouse
gagcatcaaagatggcaaca

SEQ ID NO: 671926 - DNA, 20 bp, mouse
ggaccccgaaggtggggaaa

SEQ ID NO: 671927 - DNA, 20 bp, mouse
gtaaataggggaggaatccg

SEQ ID NO: 671928 - DNA, 20 bp, mouse
gggtacccggcttcagaagg

SEQ ID NO: 671929 - DNA, 20 bp, mouse
gggacgcacagcaagttggc

SEQ ID NO: 671930 - DNA, 20 bp, mouse
ggggcgggaccccgaaggtg

SEQ ID NO: 671931 - DNA, 20 bp, mouse
gggtggctgtaaagggtacc

SEQ ID NO: 671932 - DNA, 20 bp, mouse
gacccaggaaattacgtcat

SEQ ID NO: 671933 - DNA, 20 bp, mouse
gtacagccaccagatacaag

SEQ ID NO: 671934 - DNA, 20 bp, mouse
ggcagtctggagaggtaaat

SEQ ID NO: 671935 - DNA, 20 bp, mouse
gtgtatctggtggctgtaaa

SEQ ID NO: 671936 - DNA, 20 bp, mouse
ggtcccagcaggcacgggca

SEQ ID NO: 671937 - DNA, 20 bp, mouse
gcatccctgcccgtgcctgc

SEQ ID NO: 671938 - DNA, 20 bp, mouse
gtcacggagcagccccgagg

SEQ ID NO: 671939 - DNA, 20 bp, mouse
gagtgtgtgcggccttgcgc

SEQ ID NO: 671940 - DNA, 20 bp, mouse
gcaggcgcgacaatatgagc

SEQ ID NO: 671941 - DNA, 20 bp, mouse
gaggcggggtgcagtacccg

SEQ ID NO: 671942 - DNA, 20 bp, mouse
gccccaaactgcagcatcgg

SEQ ID NO: 671943 - DNA, 20 bp, mouse
gagccccgaggcggcgccag

SEQ ID NO: 671944 - DNA, 20 bp, mouse
gggggctgctccgtgacgtc

SEQ ID NO: 671945 - DNA, 20 bp, mouse
ggccaggtgctgtagatctc

SEQ ID NO: 671946 - DNA, 20 bp, mouse
gggaggcggggagtcacctg

SEQ ID NO: 671947 - DNA, 20 bp, mouse
gctggcaagaagcaagacgt

SEQ ID NO: 671948 - DNA, 20 bp, mouse
gcctccactggccagcaatt

SEQ ID NO: 671949 - DNA, 20 bp, mouse
gtactgcaagacttgcccca

SEQ ID NO: 671950 - DNA, 20 bp, mouse
gaagaagcaagacgtaggaa

SEQ ID NO: 671951 - DNA, 20 bp, mouse
gggtcatgggggtgataacc

SEQ ID NO: 671952 - DNA, 20 bp, mouse
gctgccagctgaagggtcat

SEQ ID NO: 671953 - DNA, 20 bp, mouse
gccggagctgccaggaaagc

SEQ ID NO: 671954 - DNA, 20 bp, mouse
gaggaaagctgggagactac

SEQ ID NO: 671955 - DNA, 20 bp, mouse
gacccccatgacccttcagc

SEQ ID NO: 671956 - DNA, 20 bp, mouse
gttaaacagggacttgaaga

SEQ ID NO: 671957 - DNA, 20 bp, mouse
gtctgccgctcccagtggtc

SEQ ID NO: 671958 - DNA, 20 bp, mouse
gccactgggagcggcagagg

SEQ ID NO: 671959 - DNA, 20 bp, mouse
gagggctggccccagaccac

SEQ ID NO: 671960 - DNA, 20 bp, mouse
gagaaggcgagcagacaccc

SEQ ID NO: 671961 - DNA, 20 bp, mouse
gttcagctgctattgcccaa

SEQ ID NO: 671962 - DNA, 20 bp, mouse
gtccagtccaggaaaagcaa

SEQ ID NO: 671963 - DNA, 20 bp, mouse
gggaggctttcaggaataaa

SEQ ID NO: 671964 - DNA, 20 bp, mouse
ggactggaatgaaggaccta

SEQ ID NO: 671965 - DNA, 20 bp, mouse
gttcaagtccctgtttaaga

SEQ ID NO: 671966 - DNA, 20 bp, mouse
ggccgggttatctattaagg

SEQ ID NO: 671967 - DNA, 20 bp, mouse
gggtgccgggttatctatta

SEQ ID NO: 671968 - DNA, 20 bp, mouse
gaactggtgataaaaggtgc

SEQ ID NO: 671969 - DNA, 20 bp, mouse
ggcccccttaatagataacc

SEQ ID NO: 671970 - DNA, 20 bp, mouse
gaattaaggtaactgaatga

SEQ ID NO: 671971 - DNA, 20 bp, mouse
ggaataattaaatggaatgt

SEQ ID NO: 671972 - DNA, 20 bp, mouse
gctctggacattgatcctgt

SEQ ID NO: 671973 - DNA, 20 bp, mouse
gatctttgaatggacagtct

SEQ ID NO: 671974 - DNA, 20 bp, mouse
gaaaatgggaagtttggaaa

SEQ ID NO: 671975 - DNA, 20 bp, mouse
gaataaacaagttgattcca

SEQ ID NO: 671976 - DNA, 20 bp, mouse
gaatgattgaatcctgtagg

SEQ ID NO: 671977 - DNA, 20 bp, mouse
gctccagtgtagccatcctt

SEQ ID NO: 671978 - DNA, 20 bp, mouse
gtgtgggatttccagcatat

SEQ ID NO: 671979 - DNA, 20 bp, mouse
gtatgatctccatgatccta

SEQ ID NO: 671980 - DNA, 20 bp, mouse
gttttactttctccccctac

SEQ ID NO: 671981 - DNA, 20 bp, mouse
gcacaattggagatacaaga

SEQ ID NO: 671982 - DNA, 20 bp, mouse
gggaaatgattgaatcctgt

SEQ ID NO: 671983 - DNA, 20 bp, mouse
gtggtaacctgtgtttatat

SEQ ID NO: 671984 - DNA, 20 bp, mouse
ggctccatggtccttccagt

SEQ ID NO: 671985 - DNA, 20 bp, mouse
gatcctaaggatggctacac

SEQ ID NO: 671986 - DNA, 20 bp, mouse
gaaccatcaccttttatcac

SEQ ID NO: 671987 - DNA, 20 bp, mouse
gtcaccttttatcaccggtt

SEQ ID NO: 671988 - DNA, 20 bp, mouse
gggtgatggttatatattaa

SEQ ID NO: 671989 - DNA, 20 bp, mouse
gtcagcatatctttggatac

SEQ ID NO: 671990 - DNA, 20 bp, mouse
gctgtggacactaatcctgt

SEQ ID NO: 671991 - DNA, 20 bp, mouse
gatctgaataagatttgctt

SEQ ID NO: 671992 - DNA, 20 bp, mouse
gaaaatggaaaatttggagc

SEQ ID NO: 671993 - DNA, 20 bp, mouse
gcaaaacattatgaaaatca

SEQ ID NO: 671994 - DNA, 20 bp, mouse
ggttttgaaaatggaaaatt

SEQ ID NO: 671995 - DNA, 20 bp, mouse
gattaaacaagttgattctg

SEQ ID NO: 671996 - DNA, 20 bp, mouse
gaaaaccacttcaaagatac

SEQ ID NO: 671997 - DNA, 20 bp, mouse
gttaactgaagtatctcaac

SEQ ID NO: 671998 - DNA, 20 bp, mouse
gcaacaggtgctgtgtgctt

SEQ ID NO: 671999 - DNA, 20 bp, mouse
ggtggcagtgaaataactaa

SEQ ID NO: 672000 - DNA, 20 bp, mouse
ggtggcaaaacaatgacata

SEQ ID NO: 672001 - DNA, 20 bp, mouse
gacaaaaaaatcggaaggaa

SEQ ID NO: 672002 - DNA, 20 bp, mouse
gtggtttaccacttatcaca

SEQ ID NO: 672003 - DNA, 20 bp, mouse
gtcagccagtatctttgaag

SEQ ID NO: 672004 - DNA, 20 bp, mouse
ggcacactcatttccttttt

SEQ ID NO: 672005 - DNA, 20 bp, mouse
gttataacaaaaaaatcgga

SEQ ID NO: 672006 - DNA, 20 bp, mouse
gaacaggtggttgtccacac

SEQ ID NO: 672007 - DNA, 20 bp, mouse
gggtctacatgaccttttga

SEQ ID NO: 672008 - DNA, 20 bp, mouse
gtaagcagccaaatctgcaa

SEQ ID NO: 672009 - DNA, 20 bp, mouse
gacaccgtgtctccttcaaa

SEQ ID NO: 672010 - DNA, 20 bp, mouse
ggcaggaaaggttatgacag

SEQ ID NO: 672011 - DNA, 20 bp, mouse
gaaatctgcaagggagatct

SEQ ID NO: 672012 - DNA, 20 bp, mouse
gagaacgctagtatatgaac

SEQ ID NO: 672013 - DNA, 20 bp, mouse
gtgaccttttgaaggagaca

SEQ ID NO: 672014 - DNA, 20 bp, mouse
gggtgttattttgtccatac

SEQ ID NO: 672015 - DNA, 20 bp, mouse
gtatcataagggtttctaag

SEQ ID NO: 672016 - DNA, 20 bp, mouse
gtgcgcgcctccaaggggag

SEQ ID NO: 672017 - DNA, 20 bp, mouse
gagggaccagggagtaaatt

SEQ ID NO: 672018 - DNA, 20 bp, mouse
gaggagacgcgcctgcgtgt

SEQ ID NO: 672019 - DNA, 20 bp, mouse
gcgcctgcgtgttgggtaga

SEQ ID NO: 672020 - DNA, 20 bp, mouse
gggggcggggaaagcgcttg

SEQ ID NO: 672021 - DNA, 20 bp, mouse
gtgttgggtagatggcgcgg

SEQ ID NO: 672022 - DNA, 20 bp, mouse
gtacgcttgcgcgcctccaa

SEQ ID NO: 672023 - DNA, 20 bp, mouse
ggtacaccgaatttactccc

SEQ ID NO: 672024 - DNA, 20 bp, mouse
ggttggaggcgggggcatga

SEQ ID NO: 672025 - DNA, 20 bp, mouse
gcgccatctacccaacacgc

SEQ ID NO: 672026 - DNA, 20 bp, mouse
gaggaagaggccggcgtccc

SEQ ID NO: 672027 - DNA, 20 bp, mouse
gaggcggcgtctgtgaggat

SEQ ID NO: 672028 - DNA, 20 bp, mouse
gtgaccctggagccggaggg

SEQ ID NO: 672029 - DNA, 20 bp, mouse
gcggcgtctgtgaggatcgg

SEQ ID NO: 672030 - DNA, 20 bp, mouse
gtggctctaggagtcgagtc

SEQ ID NO: 672031 - DNA, 20 bp, mouse
ggtagcccaaacaacgacag

SEQ ID NO: 672032 - DNA, 20 bp, mouse
ggggtcgctgaccctggagc

SEQ ID NO: 672033 - DNA, 20 bp, mouse
gccagggtcagcgacccgga

SEQ ID NO: 672034 - DNA, 20 bp, mouse
gccggaaggcggcgtctgtg

SEQ ID NO: 672035 - DNA, 20 bp, mouse
ggggtcagcgacccggaagg

SEQ ID NO: 672036 - DNA, 20 bp, mouse
gcgaccggcgagctggagaa

SEQ ID NO: 672037 - DNA, 20 bp, mouse
gggagcggaaacagcaccta

SEQ ID NO: 672038 - DNA, 20 bp, mouse
gggatggggcgggaccgaga

SEQ ID NO: 672039 - DNA, 20 bp, mouse
gcgcacggcacgctgggatg

SEQ ID NO: 672040 - DNA, 20 bp, mouse
gtggagggcggagttagagg

SEQ ID NO: 672041 - DNA, 20 bp, mouse
gcagtccctctattgatcaa

SEQ ID NO: 672042 - DNA, 20 bp, mouse
gggggcgggaccgagatggc

SEQ ID NO: 672043 - DNA, 20 bp, mouse
gggtggagcctcgtagcgac

SEQ ID NO: 672044 - DNA, 20 bp, mouse
gcagctcgccggtcgctacg

SEQ ID NO: 672045 - DNA, 20 bp, mouse
gcaggcccttgatcaataga

SEQ ID NO: 672046 - DNA, 20 bp, mouse
gaaactgtggtagtgtggat

SEQ ID NO: 672047 - DNA, 20 bp, mouse
gtggtagtgtggattggccc

SEQ ID NO: 672048 - DNA, 20 bp, mouse
gggatctgacatcttcagac

SEQ ID NO: 672049 - DNA, 20 bp, mouse
gtggtaaccgtgagctggat

SEQ ID NO: 672050 - DNA, 20 bp, mouse
gtggatggggtggcatactc

SEQ ID NO: 672051 - DNA, 20 bp, mouse
gaaccgtgagctggatgggg

SEQ ID NO: 672052 - DNA, 20 bp, mouse
gtagagtttgagaataacca

SEQ ID NO: 672053 - DNA, 20 bp, mouse
gctcaggacgtagcaacata

SEQ ID NO: 672054 - DNA, 20 bp, mouse
gaaaaaatagcagcagttag

SEQ ID NO: 672055 - DNA, 20 bp, mouse
gtttgtgagcattggttttt

SEQ ID NO: 672056 - DNA, 20 bp, mouse
gctgcggcacagcccctcct

SEQ ID NO: 672057 - DNA, 20 bp, mouse
gggtcgcgagggtcctgtaa

SEQ ID NO: 672058 - DNA, 20 bp, mouse
ggggggcggggccttgtcta

SEQ ID NO: 672059 - DNA, 20 bp, mouse
ggggctgtgccgcagccaat

SEQ ID NO: 672060 - DNA, 20 bp, mouse
ggtgagtccacgatgaggga

SEQ ID NO: 672061 - DNA, 20 bp, mouse
gggcggtgagtccacgatga

SEQ ID NO: 672062 - DNA, 20 bp, mouse
gagggaggggtcggcgcacc

SEQ ID NO: 672063 - DNA, 20 bp, mouse
gtgggaaagcggcgtggcga

SEQ ID NO: 672064 - DNA, 20 bp, mouse
gccttgtctaggggtcgcga

SEQ ID NO: 672065 - DNA, 20 bp, mouse
gctcaccgcctgagcctagg

SEQ ID NO: 672066 - DNA, 20 bp, mouse
ggacagttggggtaagtgaa

SEQ ID NO: 672067 - DNA, 20 bp, mouse
gaatggacgatggtagtttg

SEQ ID NO: 672068 - DNA, 20 bp, mouse
gctggccaatgaatggacga

SEQ ID NO: 672069 - DNA, 20 bp, mouse
gtgtgtgagacactctacta

SEQ ID NO: 672070 - DNA, 20 bp, mouse
gcgcccacggcgctcgggat

SEQ ID NO: 672071 - DNA, 20 bp, mouse
ggggaagagggagacgttaa

SEQ ID NO: 672072 - DNA, 20 bp, mouse
gggaaccaaggaagtgacgt

SEQ ID NO: 672073 - DNA, 20 bp, mouse
gtactcccggcaccactgat

SEQ ID NO: 672074 - DNA, 20 bp, mouse
gttaccccaactgtcaccac

SEQ ID NO: 672075 - DNA, 20 bp, mouse
gcccgagcgcgccccactca

SEQ ID NO: 672076 - DNA, 20 bp, mouse
gggaggtggaaggaaatcaa

SEQ ID NO: 672077 - DNA, 20 bp, mouse
ggggcagacgggatctctgt

SEQ ID NO: 672078 - DNA, 20 bp, mouse
gcctcaaagagttgactaaa

SEQ ID NO: 672079 - DNA, 20 bp, mouse
ggagaaggtaccagacagat

SEQ ID NO: 672080 - DNA, 20 bp, mouse
ggatctctgtgggcagatcg

SEQ ID NO: 672081 - DNA, 20 bp, mouse
gaaatcaagggcttgctcct

SEQ ID NO: 672082 - DNA, 20 bp, mouse
gcgcgtgccttacaagaaat

SEQ ID NO: 672083 - DNA, 20 bp, mouse
gtgggcaaggacggaaccca

SEQ ID NO: 672084 - DNA, 20 bp, mouse
gggatgtcaagaggcggctc

SEQ ID NO: 672085 - DNA, 20 bp, mouse
gcagatcggatgtcaagagg

SEQ ID NO: 672086 - DNA, 20 bp, mouse
gtagagacgcgggtgcaggt

SEQ ID NO: 672087 - DNA, 20 bp, mouse
ggcactccctaggtagaaag

SEQ ID NO: 672088 - DNA, 20 bp, mouse
gttgaacaaaggagtcattc

SEQ ID NO: 672089 - DNA, 20 bp, mouse
gcctcaagcaaggatgaatg

SEQ ID NO: 672090 - DNA, 20 bp, mouse
gaatttctaaggcactccct

SEQ ID NO: 672091 - DNA, 20 bp, mouse
gcaaacctctaggataaata

SEQ ID NO: 672092 - DNA, 20 bp, mouse
gaaatgaaaagagaggtctc

SEQ ID NO: 672093 - DNA, 20 bp, mouse
gtccctaggtagaaagcgga

SEQ ID NO: 672094 - DNA, 20 bp, mouse
gaaaatacaaacacactcta

SEQ ID NO: 672095 - DNA, 20 bp, mouse
gtttgcttggtaattgtcaa

SEQ ID NO: 672096 - DNA, 20 bp, mouse
gtaggttgagggctcttctg

SEQ ID NO: 672097 - DNA, 20 bp, mouse
gcacacgcatatgtgatgca

SEQ ID NO: 672098 - DNA, 20 bp, mouse
gtgaacaagtcaggctccag

SEQ ID NO: 672099 - DNA, 20 bp, mouse
gccgtatagatctaggttga

SEQ ID NO: 672100 - DNA, 20 bp, mouse
gttatctgagaatacgcaaa

SEQ ID NO: 672101 - DNA, 20 bp, mouse
gaagaacaccgtatagatct

SEQ ID NO: 672102 - DNA, 20 bp, mouse
ggtcaggcaacactgttgtg

SEQ ID NO: 672103 - DNA, 20 bp, mouse
gaacagtgttgcctgacttc

SEQ ID NO: 672104 - DNA, 20 bp, mouse
gggagcctgacttgttcatg

SEQ ID NO: 672105 - DNA, 20 bp, mouse
gaagtcaggctccagtggat

SEQ ID NO: 672106 - DNA, 20 bp, mouse
gagctcccggagcctagtgt

SEQ ID NO: 672107 - DNA, 20 bp, mouse
ggagcggcggggtcacctat

SEQ ID NO: 672108 - DNA, 20 bp, mouse
gcctccgtgcgggcgtccgc

SEQ ID NO: 672109 - DNA, 20 bp, mouse
ggctccagccgggcggcctc

SEQ ID NO: 672110 - DNA, 20 bp, mouse
ggcgaggcccgccctccgtg

SEQ ID NO: 672111 - DNA, 20 bp, mouse
gagaagatagctccggggcg

SEQ ID NO: 672112 - DNA, 20 bp, mouse
ggtgagtcggtcgggttaac

SEQ ID NO: 672113 - DNA, 20 bp, mouse
ggtgaccccgccgctccagc

SEQ ID NO: 672114 - DNA, 20 bp, mouse
gcctgggcggggctcaggca

SEQ ID NO: 672115 - DNA, 20 bp, mouse
gggccgcccggctggagcgg

SEQ ID NO: 672116 - DNA, 20 bp, mouse
gcgaaccgaggggttgtcgt

SEQ ID NO: 672117 - DNA, 20 bp, mouse
gcgagctgtgctcccgccat

SEQ ID NO: 672118 - DNA, 20 bp, mouse
ggcaggggctaccgaaccga

SEQ ID NO: 672119 - DNA, 20 bp, mouse
gggcgggagcacagctcgac

SEQ ID NO: 672120 - DNA, 20 bp, mouse
gcagcattcccggagagggt

SEQ ID NO: 672121 - DNA, 20 bp, mouse
ggcacctcagcagaaggtac

SEQ ID NO: 672122 - DNA, 20 bp, mouse
gactggctattcattctgga

SEQ ID NO: 672123 - DNA, 20 bp, mouse
ggagtctcaaggcttcggag

SEQ ID NO: 672124 - DNA, 20 bp, mouse
gccaaaagtgggtggagtat

SEQ ID NO: 672125 - DNA, 20 bp, mouse
gtagaggcgtgacccggaag

SEQ ID NO: 672126 - DNA, 20 bp, mouse
gcgggtcgcaacggaaagca

SEQ ID NO: 672127 - DNA, 20 bp, mouse
gtgaagtgagggcaccgctg

SEQ ID NO: 672128 - DNA, 20 bp, mouse
gaggtccggacgggtcgcaa

SEQ ID NO: 672129 - DNA, 20 bp, mouse
gagccttgccaacctaggtc

SEQ ID NO: 672130 - DNA, 20 bp, mouse
gcctaggttggcaaggctgg

SEQ ID NO: 672131 - DNA, 20 bp, mouse
ggctcccgagaacgcgtcct

SEQ ID NO: 672132 - DNA, 20 bp, mouse
ggacccgtccggacctaggt

SEQ ID NO: 672133 - DNA, 20 bp, mouse
gttgccaacctaggtccgga

SEQ ID NO: 672134 - DNA, 20 bp, mouse
gtgcgcctctgaagccgcag

SEQ ID NO: 672135 - DNA, 20 bp, mouse
gcaacctggaacaacaagga

SEQ ID NO: 672136 - DNA, 20 bp, mouse
gctgccgccgcgcccttctc

SEQ ID NO: 672137 - DNA, 20 bp, mouse
gcgcaggcgcagagttaagt

SEQ ID NO: 672138 - DNA, 20 bp, mouse
gaacccatccacaaatatct

SEQ ID NO: 672139 - DNA, 20 bp, mouse
ggggctagctgacaggtttt

SEQ ID NO: 672140 - DNA, 20 bp, mouse
ggcgcagagttaagttgggt

SEQ ID NO: 672141 - DNA, 20 bp, mouse
gtgtagatttgcagtctgtg

SEQ ID NO: 672142 - DNA, 20 bp, mouse
ggggctagtacgcacgcgcg

SEQ ID NO: 672143 - DNA, 20 bp, mouse
gacgggcagccgcctgggcg

SEQ ID NO: 672144 - DNA, 20 bp, mouse
gggaatcagacgcccagaga

SEQ ID NO: 672145 - DNA, 20 bp, mouse
gcgatgtcaagttttcgagt

SEQ ID NO: 672146 - DNA, 20 bp, mouse
gggtcctcccttagactcga

SEQ ID NO: 672147 - DNA, 20 bp, mouse
gcgcagcccctcgagtctaa

SEQ ID NO: 672148 - DNA, 20 bp, mouse
gagcccctcgagtctaaggg

SEQ ID NO: 672149 - DNA, 20 bp, mouse
ggccggaaaactcagactcc

SEQ ID NO: 672150 - DNA, 20 bp, mouse
gcagaggtcaaagggcaatg

SEQ ID NO: 672151 - DNA, 20 bp, mouse
gcccgggcccggccggcgtc

SEQ ID NO: 672152 - DNA, 20 bp, mouse
gcggctcccgcgcccactcc

SEQ ID NO: 672153 - DNA, 20 bp, mouse
gtagtctcgcagaggtcaaa

SEQ ID NO: 672154 - DNA, 20 bp, mouse
ggcaggccgggagtgggcgc

SEQ ID NO: 672155 - DNA, 20 bp, mouse
gcccgggcgtgggggcctgt

SEQ ID NO: 672156 - DNA, 20 bp, mouse
gctcccgggtagttattcga

SEQ ID NO: 672157 - DNA, 20 bp, mouse
gcaccgccctctgggagtca

SEQ ID NO: 672158 - DNA, 20 bp, mouse
gtcccagagggcggtggcgt

SEQ ID NO: 672159 - DNA, 20 bp, mouse
gaataactacccgggagggg

SEQ ID NO: 672160 - DNA, 20 bp, mouse
gtcagggaaccgagaaaagt

SEQ ID NO: 672161 - DNA, 20 bp, mouse
gttccctgactcccagaggg

SEQ ID NO: 672162 - DNA, 20 bp, mouse
gagccgacgccaccgccctc

SEQ ID NO: 672163 - DNA, 20 bp, mouse
gccgccctcgaataactacc

SEQ ID NO: 672164 - DNA, 20 bp, mouse
ggtgcccacaccgtcgtggt

SEQ ID NO: 672165 - DNA, 20 bp, mouse
ggaaccgagaaaagttggcc

SEQ ID NO: 672166 - DNA, 20 bp, mouse
gaaaagggatcgggagactc

SEQ ID NO: 672167 - DNA, 20 bp, mouse
ggggcggaactggtgagtag

SEQ ID NO: 672168 - DNA, 20 bp, mouse
ggagctgaaaacacggaaaa

SEQ ID NO: 672169 - DNA, 20 bp, mouse
gagaaggagcgcggagctct

SEQ ID NO: 672170 - DNA, 20 bp, mouse
gagtgggtggggcttagacg

SEQ ID NO: 672171 - DNA, 20 bp, mouse
gtgccttggcggagtgggtg

SEQ ID NO: 672172 - DNA, 20 bp, mouse
gaaaacacggaaaagggatc

SEQ ID NO: 672173 - DNA, 20 bp, mouse
ggaagcagggtcagttccga

SEQ ID NO: 672174 - DNA, 20 bp, mouse
gcggctgggcggatagggcg

SEQ ID NO: 672175 - DNA, 20 bp, mouse
gtctgaaggaggggcttatg

SEQ ID NO: 672176 - DNA, 20 bp, mouse
gccgaatggcaggtgaacgc

SEQ ID NO: 672177 - DNA, 20 bp, mouse
gacaggagtgagcctaaatc

SEQ ID NO: 672178 - DNA, 20 bp, mouse
gtactccgcccgacctacgg

SEQ ID NO: 672179 - DNA, 20 bp, mouse
gtgttctgcgccagcgggga

SEQ ID NO: 672180 - DNA, 20 bp, mouse
gcgcgcggccgccgtaggtc

SEQ ID NO: 672181 - DNA, 20 bp, mouse
ggaggggggcgtcggctggg

SEQ ID NO: 672182 - DNA, 20 bp, mouse
ggggacaagacactcatgag

SEQ ID NO: 672183 - DNA, 20 bp, mouse
gccagcggtgcgctgcgcta

SEQ ID NO: 672184 - DNA, 20 bp, mouse
gggcctttcagctaatcaga

SEQ ID NO: 672185 - DNA, 20 bp, mouse
gctgactcaacggtagccta

SEQ ID NO: 672186 - DNA, 20 bp, mouse
ggctgcagggcccaggaaat

SEQ ID NO: 672187 - DNA, 20 bp, mouse
gtggctgtgaccagtgggat

SEQ ID NO: 672188 - DNA, 20 bp, mouse
gaaggtgatggaggggctac

SEQ ID NO: 672189 - DNA, 20 bp, mouse
gcaccaggtaggtcttcgtg

SEQ ID NO: 672190 - DNA, 20 bp, mouse
gctagctggatctggatcgg

SEQ ID NO: 672191 - DNA, 20 bp, mouse
gagtctagctggatctggat

SEQ ID NO: 672192 - DNA, 20 bp, mouse
gggccccacgaagacctacc

SEQ ID NO: 672193 - DNA, 20 bp, mouse
gtcgagatgaaggtgatgga

SEQ ID NO: 672194 - DNA, 20 bp, mouse
gaggtcttcgtggggcctgg

SEQ ID NO: 672195 - DNA, 20 bp, mouse
gagctggggtaagagcttcc

SEQ ID NO: 672196 - DNA, 20 bp, mouse
ggcgtggcgcggcattcatt

SEQ ID NO: 672197 - DNA, 20 bp, mouse
gtacgcctcgccaaactcta

SEQ ID NO: 672198 - DNA, 20 bp, mouse
gcccgagagaggcagaacgc

SEQ ID NO: 672199 - DNA, 20 bp, mouse
gttggcgaggcgtactagag

SEQ ID NO: 672200 - DNA, 20 bp, mouse
gagaggcagaacgcaggcgc

SEQ ID NO: 672201 - DNA, 20 bp, mouse
ggggcgttctcgcccgagag

SEQ ID NO: 672202 - DNA, 20 bp, mouse
gggcggcggtggtgacgtga

SEQ ID NO: 672203 - DNA, 20 bp, mouse
gtaagcccgaaccacccggg

SEQ ID NO: 672204 - DNA, 20 bp, mouse
gcctgcgccctgaagacttg

SEQ ID NO: 672205 - DNA, 20 bp, mouse
gtgcacctcccgggtggttc

SEQ ID NO: 672206 - DNA, 20 bp, mouse
gcccaacaggcgcacccccg

SEQ ID NO: 672207 - DNA, 20 bp, mouse
ggggtgcgcctgttgggctt

SEQ ID NO: 672208 - DNA, 20 bp, mouse
gcgaggggctggcgggaatg

SEQ ID NO: 672209 - DNA, 20 bp, mouse
gaggggctccaccaacccaa

SEQ ID NO: 672210 - DNA, 20 bp, mouse
gcgctctggcaagatggcgt

SEQ ID NO: 672211 - DNA, 20 bp, mouse
ggcgacggcaacagccgccc

SEQ ID NO: 672212 - DNA, 20 bp, mouse
gactctaggcgcggcggatg

SEQ ID NO: 672213 - DNA, 20 bp, mouse
gcggccgggcggagcgacgg

SEQ ID NO: 672214 - DNA, 20 bp, mouse
gttcccgccagcccctcggg

SEQ ID NO: 672215 - DNA, 20 bp, mouse
ggctgttgccgtcgccccgg

SEQ ID NO: 672216 - DNA, 20 bp, mouse
ggcggcgtgcccaacacctc

SEQ ID NO: 672217 - DNA, 20 bp, mouse
ggctcccggcactgactcta

SEQ ID NO: 672218 - DNA, 20 bp, mouse
gcgcgcgcgcacacaaagga

SEQ ID NO: 672219 - DNA, 20 bp, mouse
ggggcacagcgaggccaagg

SEQ ID NO: 672220 - DNA, 20 bp, mouse
ggcgggcgtcgaggtggcag

SEQ ID NO: 672221 - DNA, 20 bp, mouse
gacagcggggacgccgagag

SEQ ID NO: 672222 - DNA, 20 bp, mouse
gcgagcggcccgggcaaagg

SEQ ID NO: 672223 - DNA, 20 bp, mouse
gcccgcagcggagtgcgccc

SEQ ID NO: 672224 - DNA, 20 bp, mouse
gggggaggctgcagaccaag

SEQ ID NO: 672225 - DNA, 20 bp, mouse
gaggatgggaccacctctct

SEQ ID NO: 672226 - DNA, 20 bp, mouse
gctgttggcaaatgggaagg

SEQ ID NO: 672227 - DNA, 20 bp, mouse
gagtctgttggcaaatggga

SEQ ID NO: 672228 - DNA, 20 bp, mouse
gaggaggagggactgctgac

SEQ ID NO: 672229 - DNA, 20 bp, mouse
gggctccggcttttagggga

SEQ ID NO: 672230 - DNA, 20 bp, mouse
gtggcccctcccctaaaagc

SEQ ID NO: 672231 - DNA, 20 bp, mouse
ggactggactcttttcaaag

SEQ ID NO: 672232 - DNA, 20 bp, mouse
ggccagatgctccacttggc

SEQ ID NO: 672233 - DNA, 20 bp, mouse
gagctaggggttggaacccc

SEQ ID NO: 672234 - DNA, 20 bp, mouse
gaaagtggctccggctttta

SEQ ID NO: 672235 - DNA, 20 bp, mouse
gtatctccgagaaaaccaaa

SEQ ID NO: 672236 - DNA, 20 bp, mouse
ggccacaggtgagcacagtc

SEQ ID NO: 672237 - DNA, 20 bp, mouse
gaaagcacgccgggagaatg

SEQ ID NO: 672238 - DNA, 20 bp, mouse
gacgccgggagaatgcgggg

SEQ ID NO: 672239 - DNA, 20 bp, mouse
ggagcacagtcgggtggatc

SEQ ID NO: 672240 - DNA, 20 bp, mouse
gaccctctggcaagcgaccg

SEQ ID NO: 672241 - DNA, 20 bp, mouse
gcgcggctgcgcagtgaact

SEQ ID NO: 672242 - DNA, 20 bp, mouse
gacaggtgagcacagtcggg

SEQ ID NO: 672243 - DNA, 20 bp, mouse
gatagatgagacaccagggg

SEQ ID NO: 672244 - DNA, 20 bp, mouse
gttgccagagggtaattgag

SEQ ID NO: 672245 - DNA, 20 bp, mouse
gaagacgggccagcgtcggg

SEQ ID NO: 672246 - DNA, 20 bp, mouse
gcctccgggctgattcattc

SEQ ID NO: 672247 - DNA, 20 bp, mouse
ggcgcggcctcgctcccgat

SEQ ID NO: 672248 - DNA, 20 bp, mouse
ggaggctgcgggagtccgaa

SEQ ID NO: 672249 - DNA, 20 bp, mouse
ggccccgccccgcggaacca

SEQ ID NO: 672250 - DNA, 20 bp, mouse
gggcggggcctgcttccctt

SEQ ID NO: 672251 - DNA, 20 bp, mouse
gggcccgacaccagccaatc

SEQ ID NO: 672252 - DNA, 20 bp, mouse
gcggctgccctggttccgcg

SEQ ID NO: 672253 - DNA, 20 bp, mouse
ggaaacaaggggtggagcgc

SEQ ID NO: 672254 - DNA, 20 bp, mouse
gctagggactgcacttaaaa

SEQ ID NO: 672255 - DNA, 20 bp, mouse
gttaagtccggcggctgccc

SEQ ID NO: 672256 - DNA, 20 bp, mouse
gcccggagtagcaggtcaga

SEQ ID NO: 672257 - DNA, 20 bp, mouse
gaggctgggcagcgatgcca

SEQ ID NO: 672258 - DNA, 20 bp, mouse
gtctggcgacctcaatctcc

SEQ ID NO: 672259 - DNA, 20 bp, mouse
gcacacaggcgtgaggaagg

SEQ ID NO: 672260 - DNA, 20 bp, mouse
ggcgaaaaacgcctagattc

SEQ ID NO: 672261 - DNA, 20 bp, mouse
gtaaactgagtgagcagcac

SEQ ID NO: 672262 - DNA, 20 bp, mouse
ggatctgggaggtcctgtgg

SEQ ID NO: 672263 - DNA, 20 bp, mouse
ggggagtgttgggagaaaac

SEQ ID NO: 672264 - DNA, 20 bp, mouse
gcgcctgccacctacaactc

SEQ ID NO: 672265 - DNA, 20 bp, mouse
ggccccagagccgaaggtca

SEQ ID NO: 672266 - DNA, 20 bp, mouse
gccggagaggcagacgccgg

SEQ ID NO: 672267 - DNA, 20 bp, mouse
gctagcggagagggacgaag

SEQ ID NO: 672268 - DNA, 20 bp, mouse
gacgaaggggaggaggttaa

SEQ ID NO: 672269 - DNA, 20 bp, mouse
gagggccccgcccccgaggt

SEQ ID NO: 672270 - DNA, 20 bp, mouse
gcgacccgcccggggattcc

SEQ ID NO: 672271 - DNA, 20 bp, mouse
ggcgcgcagtgctgctctaa

SEQ ID NO: 672272 - DNA, 20 bp, mouse
gcctctccggcgctgaggag

SEQ ID NO: 672273 - DNA, 20 bp, mouse
gtagcccgaggcggctccga

SEQ ID NO: 672274 - DNA, 20 bp, mouse
gacgcaccaaccacgcaggg

SEQ ID NO: 672275 - DNA, 20 bp, mouse
gtcgcgcccggctcggggaa

SEQ ID NO: 672276 - DNA, 20 bp, mouse
gcctctggattccaacgccc

SEQ ID NO: 672277 - DNA, 20 bp, mouse
gaacagggttgagatgaatt

SEQ ID NO: 672278 - DNA, 20 bp, mouse
gagcgactgtaaggagcgag

SEQ ID NO: 672279 - DNA, 20 bp, mouse
gggagcgtctctgtgcagac

SEQ ID NO: 672280 - DNA, 20 bp, mouse
gactgtaaggagcgaggggc

SEQ ID NO: 672281 - DNA, 20 bp, mouse
gaggagcgaggggccggatg

SEQ ID NO: 672282 - DNA, 20 bp, mouse
ggccctggctcctagcgcca

SEQ ID NO: 672283 - DNA, 20 bp, mouse
gaccgtggcgctaggagcca

SEQ ID NO: 672284 - DNA, 20 bp, mouse
gcagcggaagaggaagccga

SEQ ID NO: 672285 - DNA, 20 bp, mouse
gctactaggtaaaaggatga

SEQ ID NO: 672286 - DNA, 20 bp, mouse
ggacctgagtctgaaagcgc

SEQ ID NO: 672287 - DNA, 20 bp, mouse
ggcaaggccgggccacgggg

SEQ ID NO: 672288 - DNA, 20 bp, mouse
ggcctcagcgagctcgcggg

SEQ ID NO: 672289 - DNA, 20 bp, mouse
gggcggggcctcagtgagct

SEQ ID NO: 672290 - DNA, 20 bp, mouse
gggctgcttgacccctcccg

SEQ ID NO: 672291 - DNA, 20 bp, mouse
gaccgcccgcgagctcgctg

SEQ ID NO: 672292 - DNA, 20 bp, mouse
gggctctggacgccccggga

SEQ ID NO: 672293 - DNA, 20 bp, mouse
gtccagagccaagctcactg

SEQ ID NO: 672294 - DNA, 20 bp, mouse
ggtcacggaaacctgagcaa

SEQ ID NO: 672295 - DNA, 20 bp, mouse
gagcttggctctggacgccc

SEQ ID NO: 672296 - DNA, 20 bp, mouse
gcggccgcgcgaagcatcac

SEQ ID NO: 672297 - DNA, 20 bp, mouse
gtcccggaagaagcgctctc

SEQ ID NO: 672298 - DNA, 20 bp, mouse
gcgcctgagagcgcttcttc

SEQ ID NO: 672299 - DNA, 20 bp, mouse
gtgccccggcgtttccgaga

SEQ ID NO: 672300 - DNA, 20 bp, mouse
gcagacgctgtggagcgcgg

SEQ ID NO: 672301 - DNA, 20 bp, mouse
gggcgtccgagtgcttgctc

SEQ ID NO: 672302 - DNA, 20 bp, mouse
gggacaaatctgtgcagctc

SEQ ID NO: 672303 - DNA, 20 bp, mouse
gtacgcctcaagaaagacat

SEQ ID NO: 672304 - DNA, 20 bp, mouse
gcatctctccagtttttgaa

SEQ ID NO: 672305 - DNA, 20 bp, mouse
gatccctctcggaaacgccg

SEQ ID NO: 672306 - DNA, 20 bp, mouse
gggcgcctagggcactaaag

SEQ ID NO: 672307 - DNA, 20 bp, mouse
gctaaagtggagtacggccc

SEQ ID NO: 672308 - DNA, 20 bp, mouse
ggcctggcgcgggcataaaa

SEQ ID NO: 672309 - DNA, 20 bp, mouse
gcgtctcacagtcgcctggt

SEQ ID NO: 672310 - DNA, 20 bp, mouse
gagggggccggggccaggag

SEQ ID NO: 672311 - DNA, 20 bp, mouse
ggggccagagccggcgccta

SEQ ID NO: 672312 - DNA, 20 bp, mouse
gacaggctgggacccggcag

SEQ ID NO: 672313 - DNA, 20 bp, mouse
ggcctcctcttcagcaaacg

SEQ ID NO: 672314 - DNA, 20 bp, mouse
ggcccggccgggagccgacc

SEQ ID NO: 672315 - DNA, 20 bp, mouse
ggctgctgggccggaccccc

SEQ ID NO: 672316 - DNA, 20 bp, mouse
gaaggggtgcgtgtttgcag

SEQ ID NO: 672317 - DNA, 20 bp, mouse
gcgggtagccgggccaagta

SEQ ID NO: 672318 - DNA, 20 bp, mouse
gcaccgccctcgcaccacga

SEQ ID NO: 672319 - DNA, 20 bp, mouse
ggagccgcacactttctccc

SEQ ID NO: 672320 - DNA, 20 bp, mouse
gcgcctgtccgctccctact

SEQ ID NO: 672321 - DNA, 20 bp, mouse
gcccggtgctaggaccaaga

SEQ ID NO: 672322 - DNA, 20 bp, mouse
gaggctcgcttggctccagg

SEQ ID NO: 672323 - DNA, 20 bp, mouse
ggggaggggggactcaaaag

SEQ ID NO: 672324 - DNA, 20 bp, mouse
gtggcccggctacccggcgc

SEQ ID NO: 672325 - DNA, 20 bp, mouse
gctgctccctcgtggtgcga

SEQ ID NO: 672326 - DNA, 20 bp, mouse
gcagccctgcactaaagggg

SEQ ID NO: 672327 - DNA, 20 bp, mouse
ggcgccgagtggagacgagg

SEQ ID NO: 672328 - DNA, 20 bp, mouse
gccctgcactaaaggggagg

SEQ ID NO: 672329 - DNA, 20 bp, mouse
gggagccaggggttaaaacc

SEQ ID NO: 672330 - DNA, 20 bp, mouse
ggcaccgcgagctcgtggat

SEQ ID NO: 672331 - DNA, 20 bp, mouse
gctccaggcaaggcgccgag

SEQ ID NO: 672332 - DNA, 20 bp, mouse
gggcgccttgcctggagcga

SEQ ID NO: 672333 - DNA, 20 bp, mouse
gtcccagccctgcactaaag

SEQ ID NO: 672334 - DNA, 20 bp, mouse
gagtggggaaggtcatagta

SEQ ID NO: 672335 - DNA, 20 bp, mouse
gaaggcgccgagtggagacg

SEQ ID NO: 672336 - DNA, 20 bp, mouse
gtgtgtcggggcatgtgtgt

SEQ ID NO: 672337 - DNA, 20 bp, mouse
gagagtgtgcctttgtgaga

SEQ ID NO: 672338 - DNA, 20 bp, mouse
gaataatggggcatgtgtgt

SEQ ID NO: 672339 - DNA, 20 bp, mouse
gcgcgtgggcatgttcatgg

SEQ ID NO: 672340 - DNA, 20 bp, mouse
ggaagcaggcatgtgaataa

SEQ ID NO: 672341 - DNA, 20 bp, mouse
ggagagagaaggcggataca

SEQ ID NO: 672342 - DNA, 20 bp, mouse
gggggctttccggttgggtg

SEQ ID NO: 672343 - DNA, 20 bp, mouse
gagggctggctcacccaccc

SEQ ID NO: 672344 - DNA, 20 bp, mouse
gcacacacaccctctcacaa

SEQ ID NO: 672345 - DNA, 20 bp, mouse
ggacatggtgcacaggagtt

SEQ ID NO: 672346 - DNA, 20 bp, mouse
gtgggctccggggtcggaca

SEQ ID NO: 672347 - DNA, 20 bp, mouse
gcccccgcgtgcctgctccc

SEQ ID NO: 672348 - DNA, 20 bp, mouse
gagcgcagagaagatttcat

SEQ ID NO: 672349 - DNA, 20 bp, mouse
gcctgctgacatgggaccta

SEQ ID NO: 672350 - DNA, 20 bp, mouse
ggctctgctgctacacacag

SEQ ID NO: 672351 - DNA, 20 bp, mouse
gggcgaggagaccagttccc

SEQ ID NO: 672352 - DNA, 20 bp, mouse
ggagaactgggctccggggt

SEQ ID NO: 672353 - DNA, 20 bp, mouse
gcgtgcctgctcccgggaac

SEQ ID NO: 672354 - DNA, 20 bp, mouse
gctgctacacacagcgggtg

SEQ ID NO: 672355 - DNA, 20 bp, mouse
gtctctgcgctctgatttgg

SEQ ID NO: 672356 - DNA, 20 bp, mouse
ggggatgagtagacaagagt

SEQ ID NO: 672357 - DNA, 20 bp, mouse
gaacgaaaatgtagacaggc

SEQ ID NO: 672358 - DNA, 20 bp, mouse
gaaagatttttggggacaca

SEQ ID NO: 672359 - DNA, 20 bp, mouse
gagcctccagagctaggata

SEQ ID NO: 672360 - DNA, 20 bp, mouse
ggaggagtcaagggcatgtt

SEQ ID NO: 672361 - DNA, 20 bp, mouse
gtgtctacattttcgttctg

SEQ ID NO: 672362 - DNA, 20 bp, mouse
gaggaccgagtctaagtcct

SEQ ID NO: 672363 - DNA, 20 bp, mouse
gggctgtgcatcctacagtt

SEQ ID NO: 672364 - DNA, 20 bp, mouse
ggtgtgccttatcctagctc

SEQ ID NO: 672365 - DNA, 20 bp, mouse
gaaaagagaagagtggagtt

SEQ ID NO: 672366 - DNA, 20 bp, mouse
ggcaccgcccacagtcgcca

SEQ ID NO: 672367 - DNA, 20 bp, mouse
gggaagcagccaatcgtggt

SEQ ID NO: 672368 - DNA, 20 bp, mouse
gcctccctggcgactgtggg

SEQ ID NO: 672369 - DNA, 20 bp, mouse
ggggagatggcccgcaactc

SEQ ID NO: 672370 - DNA, 20 bp, mouse
gcccggggccggtcacccag

SEQ ID NO: 672371 - DNA, 20 bp, mouse
gacccagcggcgacgcgcgg

SEQ ID NO: 672372 - DNA, 20 bp, mouse
ggcgggccatctcccgggaa

SEQ ID NO: 672373 - DNA, 20 bp, mouse
gacgcgcgggggtcaccacc

SEQ ID NO: 672374 - DNA, 20 bp, mouse
gggtgcgtccccaccacgat

SEQ ID NO: 672375 - DNA, 20 bp, mouse
gggactaggcgccccctcgc

SEQ ID NO: 672376 - DNA, 20 bp, mouse
gaaggtaagtataaggtaga

SEQ ID NO: 672377 - DNA, 20 bp, mouse
gtgagagagggcaatgagac

SEQ ID NO: 672378 - DNA, 20 bp, mouse
gcatagtgttgaaatactta

SEQ ID NO: 672379 - DNA, 20 bp, mouse
ggatgaagaatggtttcagt

SEQ ID NO: 672380 - DNA, 20 bp, mouse
ggatggcctagcaatttcta

SEQ ID NO: 672381 - DNA, 20 bp, mouse
gttgtgtttcttccagatac

SEQ ID NO: 672382 - DNA, 20 bp, mouse
gaatttctatggatgaagaa

SEQ ID NO: 672383 - DNA, 20 bp, mouse
gtggtttcagtgggagaagc

SEQ ID NO: 672384 - DNA, 20 bp, mouse
gtcttctgcctaatgaattt

SEQ ID NO: 672385 - DNA, 20 bp, mouse
gttcatccatagaaattgct

SEQ ID NO: 672386 - DNA, 20 bp, mouse
ggttaagcaaggcacgtctg

SEQ ID NO: 672387 - DNA, 20 bp, mouse
gtacatagatcatgagtcag

SEQ ID NO: 672388 - DNA, 20 bp, mouse
gatagcgatcatgttaagca

SEQ ID NO: 672389 - DNA, 20 bp, mouse
gtgcccacagcctcaaagct

SEQ ID NO: 672390 - DNA, 20 bp, mouse
gagccagggtggagtaggac

SEQ ID NO: 672391 - DNA, 20 bp, mouse
gagctagcacgtgtgaagtc

SEQ ID NO: 672392 - DNA, 20 bp, mouse
gccccaagctttgaggctgt

SEQ ID NO: 672393 - DNA, 20 bp, mouse
gcctactccaccctggctta

SEQ ID NO: 672394 - DNA, 20 bp, mouse
gaacccctagtcttgtatat

SEQ ID NO: 672395 - DNA, 20 bp, mouse
gagaggcttgtcattgtgtt

SEQ ID NO: 672396 - DNA, 20 bp, mouse
gttggcatactggtgcccat

SEQ ID NO: 672397 - DNA, 20 bp, mouse
gtgtgtaactcagagtcctg

SEQ ID NO: 672398 - DNA, 20 bp, mouse
gtatgctctaaaggtatatg

SEQ ID NO: 672399 - DNA, 20 bp, mouse
gtaagctctgccgtcttcat

SEQ ID NO: 672400 - DNA, 20 bp, mouse
gaactgaaactgacacctga

SEQ ID NO: 672401 - DNA, 20 bp, mouse
gctaaaggtatatggggctg

SEQ ID NO: 672402 - DNA, 20 bp, mouse
gtactgcggacgggtgtgag

SEQ ID NO: 672403 - DNA, 20 bp, mouse
gactcagagtcctgggggtt

SEQ ID NO: 672404 - DNA, 20 bp, mouse
ggggtgtgaggggctgatca

SEQ ID NO: 672405 - DNA, 20 bp, mouse
ggtagggattagcagataaa

SEQ ID NO: 672406 - DNA, 20 bp, mouse
gagtcactatgtgttcccat

SEQ ID NO: 672407 - DNA, 20 bp, mouse
gcagtgccctgtgacccaat

SEQ ID NO: 672408 - DNA, 20 bp, mouse
gaggaggggggccaggcact

SEQ ID NO: 672409 - DNA, 20 bp, mouse
gaccctggagctatcagtta

SEQ ID NO: 672410 - DNA, 20 bp, mouse
ggcccccctcctcagtgttc

SEQ ID NO: 672411 - DNA, 20 bp, mouse
gagctccagggtgtgtttgg

SEQ ID NO: 672412 - DNA, 20 bp, mouse
gtgtgttcccattgggtcac

SEQ ID NO: 672413 - DNA, 20 bp, mouse
gatgacctacctcccagaac

SEQ ID NO: 672414 - DNA, 20 bp, mouse
ggatagctccagggtgtgtt

SEQ ID NO: 672415 - DNA, 20 bp, mouse
ggagctccagaacactgagg

SEQ ID NO: 672416 - DNA, 20 bp, mouse
gcaggagctgcgtccgtcgt

SEQ ID NO: 672417 - DNA, 20 bp, mouse
gtagagctggcacatgtgat

SEQ ID NO: 672418 - DNA, 20 bp, mouse
gtagaggtttcaagagtcca

SEQ ID NO: 672419 - DNA, 20 bp, mouse
gctacagaccagtcgggatc

SEQ ID NO: 672420 - DNA, 20 bp, mouse
ggacaatgcctgatcccgac

SEQ ID NO: 672421 - DNA, 20 bp, mouse
gtgggaggggcgtcgggcca

SEQ ID NO: 672422 - DNA, 20 bp, mouse
ggagctgcgtccgtcgtggg

SEQ ID NO: 672423 - DNA, 20 bp, mouse
gggcaggtacagctctgagg

SEQ ID NO: 672424 - DNA, 20 bp, mouse
gggctctgggcgaggcatcg

SEQ ID NO: 672425 - DNA, 20 bp, mouse
gtgtacctgccagaaagcca

SEQ ID NO: 672426 - DNA, 20 bp, mouse
ggggccccgagggtatgtgg

SEQ ID NO: 672427 - DNA, 20 bp, mouse
gccggcatgtcgggagcctc

SEQ ID NO: 672428 - DNA, 20 bp, mouse
gaccgggccccgagggtatg

SEQ ID NO: 672429 - DNA, 20 bp, mouse
gagggcgccctgttgggcac

SEQ ID NO: 672430 - DNA, 20 bp, mouse
gggctggagaccagggttag

SEQ ID NO: 672431 - DNA, 20 bp, mouse
gcacgctgccggcagggtta

SEQ ID NO: 672432 - DNA, 20 bp, mouse
gacggcctccacataccctc

SEQ ID NO: 672433 - DNA, 20 bp, mouse
gccggcagcgtgaagactgc

SEQ ID NO: 672434 - DNA, 20 bp, mouse
ggggactgtgcgcgcgagga

SEQ ID NO: 672435 - DNA, 20 bp, mouse
ggggttagggctggagacca

SEQ ID NO: 672436 - DNA, 20 bp, mouse
ggtagcaccaggtgtgggaa

SEQ ID NO: 672437 - DNA, 20 bp, mouse
gcttgcggaaggctgagaag

SEQ ID NO: 672438 - DNA, 20 bp, mouse
gacaaggtagcaccaggtgt

SEQ ID NO: 672439 - DNA, 20 bp, mouse
ggaaggcccgcggagctcga

SEQ ID NO: 672440 - DNA, 20 bp, mouse
ggggctgcgggccatagggg

SEQ ID NO: 672441 - DNA, 20 bp, mouse
gctgtcacaattcttgcgga

SEQ ID NO: 672442 - DNA, 20 bp, mouse
ggcacctgtcacaattcttg

SEQ ID NO: 672443 - DNA, 20 bp, mouse
gggcccgcggagctcgaggg

SEQ ID NO: 672444 - DNA, 20 bp, mouse
ggcaccaggtgtgggaaagg

SEQ ID NO: 672445 - DNA, 20 bp, mouse
gggggtgacaaggtagcacc

SEQ ID NO: 672446 - DNA, 20 bp, mouse
gaagactgcaggtctctcat

SEQ ID NO: 672447 - DNA, 20 bp, mouse
gcaccctagacctctgtgca

SEQ ID NO: 672448 - DNA, 20 bp, mouse
gcacagaggtctagggtgac

SEQ ID NO: 672449 - DNA, 20 bp, mouse
gccagccgagtgaagcagca

SEQ ID NO: 672450 - DNA, 20 bp, mouse
gttatccttgaggaataggg

SEQ ID NO: 672451 - DNA, 20 bp, mouse
ggaaccactgccctaagagt

SEQ ID NO: 672452 - DNA, 20 bp, mouse
gttgcctactcttagggcag

SEQ ID NO: 672453 - DNA, 20 bp, mouse
ggctgagacactaggcaaac

SEQ ID NO: 672454 - DNA, 20 bp, mouse
gtaagagtaggcaagactgc

SEQ ID NO: 672455 - DNA, 20 bp, mouse
gttccctgcacagaggtcta

SEQ ID NO: 672456 - DNA, 20 bp, mouse
gagcagggatgcagttcccg

SEQ ID NO: 672457 - DNA, 20 bp, mouse
gctggtaccagagagagtcc

SEQ ID NO: 672458 - DNA, 20 bp, mouse
ggcaagtagctcggggtcag

SEQ ID NO: 672459 - DNA, 20 bp, mouse
ggtaccagagagagtcctgg

SEQ ID NO: 672460 - DNA, 20 bp, mouse
gagcaggagcaagtagctcg

SEQ ID NO: 672461 - DNA, 20 bp, mouse
ggggcgcgctgtcacgtgtg

SEQ ID NO: 672462 - DNA, 20 bp, mouse
gggcgcgcgcagcgctttaa

SEQ ID NO: 672463 - DNA, 20 bp, mouse
ggggcggccacggagctgcg

SEQ ID NO: 672464 - DNA, 20 bp, mouse
gtcagagagcgctcgcgagg

SEQ ID NO: 672465 - DNA, 20 bp, mouse
gggctcagagagcgctcgcg

SEQ ID NO: 672466 - DNA, 20 bp, mouse
gggggatagaggtgctggat

SEQ ID NO: 672467 - DNA, 20 bp, mouse
gcaggtggggatagaggtgc

SEQ ID NO: 672468 - DNA, 20 bp, mouse
gagtaagcaggtggggatag

SEQ ID NO: 672469 - DNA, 20 bp, mouse
ggatagaggtgctggatggg

SEQ ID NO: 672470 - DNA, 20 bp, mouse
gccgcagcatccatgccagt

SEQ ID NO: 672471 - DNA, 20 bp, mouse
gtggatgctgcggagtaagc

SEQ ID NO: 672472 - DNA, 20 bp, mouse
gatgctgcggagtaagcagg

SEQ ID NO: 672473 - DNA, 20 bp, mouse
gtgccagtgggacaatggaa

SEQ ID NO: 672474 - DNA, 20 bp, mouse
gctagtcagtcttgtcattc

SEQ ID NO: 672475 - DNA, 20 bp, mouse
gctaacaaaacatggttcaa

SEQ ID NO: 672476 - DNA, 20 bp, mouse
gaatgtgcacctgttgtcgg

SEQ ID NO: 672477 - DNA, 20 bp, mouse
ggggcgggaccaagtcccga

SEQ ID NO: 672478 - DNA, 20 bp, mouse
ggcactgctctcaggggacg

SEQ ID NO: 672479 - DNA, 20 bp, mouse
gctcctggcactgctctcag

SEQ ID NO: 672480 - DNA, 20 bp, mouse
gggaccaagtcccgagggcg

SEQ ID NO: 672481 - DNA, 20 bp, mouse
gccgccccgccctcgggact

SEQ ID NO: 672482 - DNA, 20 bp, mouse
gagggcgactgcagttgctc

SEQ ID NO: 672483 - DNA, 20 bp, mouse
gtaggtggaaacgtctattg

SEQ ID NO: 672484 - DNA, 20 bp, mouse
ggggaagtgacgaggcgccc

SEQ ID NO: 672485 - DNA, 20 bp, mouse
gcgactgcagttgctccggg

SEQ ID NO: 672486 - DNA, 20 bp, mouse
gggtttgagcaagactggga

SEQ ID NO: 672487 - DNA, 20 bp, mouse
ggactgggcctgccgaggtg

SEQ ID NO: 672488 - DNA, 20 bp, mouse
gccgaggtggggtgtgcttg

SEQ ID NO: 672489 - DNA, 20 bp, mouse
gccacgtcatgccccaactt

SEQ ID NO: 672490 - DNA, 20 bp, mouse
gcctcggcaggcccagtcaa

SEQ ID NO: 672491 - DNA, 20 bp, mouse
ggcggaagcgcgggatccca

SEQ ID NO: 672492 - DNA, 20 bp, mouse
gtcaaggctctctggacatg

SEQ ID NO: 672493 - DNA, 20 bp, mouse
gcgggatcccagggaaaaaa

SEQ ID NO: 672494 - DNA, 20 bp, mouse
gtgtgaggggacctttgact

SEQ ID NO: 672495 - DNA, 20 bp, mouse
gaaaaaaggtggtccctgtg

SEQ ID NO: 672496 - DNA, 20 bp, mouse
gtgagctgtcaggtcttgtg

SEQ ID NO: 672497 - DNA, 20 bp, mouse
gtaccaccaggcacagaagt

SEQ ID NO: 672498 - DNA, 20 bp, mouse
gtatcatcatggctactagt

SEQ ID NO: 672499 - DNA, 20 bp, mouse
gacaggcattctcattacat

SEQ ID NO: 672500 - DNA, 20 bp, mouse
gtctgctgcagccaagacga

SEQ ID NO: 672501 - DNA, 20 bp, mouse
gtatgcacatggggcagggt

SEQ ID NO: 672502 - DNA, 20 bp, mouse
gaggctaaaaacatctctct

SEQ ID NO: 672503 - DNA, 20 bp, mouse
gttaaaaaacccacaccgac

SEQ ID NO: 672504 - DNA, 20 bp, mouse
ggtgccatcgaccatgaagg

SEQ ID NO: 672505 - DNA, 20 bp, mouse
gaccaggcacagaagttggc

SEQ ID NO: 672506 - DNA, 20 bp, mouse
gggtaagggagggtctgaga

SEQ ID NO: 672507 - DNA, 20 bp, mouse
ggaccacctaggagtgggaa

SEQ ID NO: 672508 - DNA, 20 bp, mouse
gttacccaaggcagtttaag

SEQ ID NO: 672509 - DNA, 20 bp, mouse
gtagtgcgtggcactcggga

SEQ ID NO: 672510 - DNA, 20 bp, mouse
gccagagcagggtgtgtctg

SEQ ID NO: 672511 - DNA, 20 bp, mouse
gaacctgtggctatggatga

SEQ ID NO: 672512 - DNA, 20 bp, mouse
gaaactgccttgggtaagcc

SEQ ID NO: 672513 - DNA, 20 bp, mouse
gagcgtggaccacctaggag

SEQ ID NO: 672514 - DNA, 20 bp, mouse
gtggagttacagggtaaggg

SEQ ID NO: 672515 - DNA, 20 bp, mouse
gtaagattaagatgggtgag

SEQ ID NO: 672516 - DNA, 20 bp, mouse
gagggattgtcacagattgt

SEQ ID NO: 672517 - DNA, 20 bp, mouse
gtggtggggtagggtggcag

SEQ ID NO: 672518 - DNA, 20 bp, mouse
gggcagaacgaaaagatccc

SEQ ID NO: 672519 - DNA, 20 bp, mouse
gacagattgttggtagggtg

SEQ ID NO: 672520 - DNA, 20 bp, mouse
gacaggtgctggtggtttag

SEQ ID NO: 672521 - DNA, 20 bp, mouse
ggggtggggtttgccagtta

SEQ ID NO: 672522 - DNA, 20 bp, mouse
gatgaggcaagcaaggggac

SEQ ID NO: 672523 - DNA, 20 bp, mouse
gcaagcaaggggacaggtgc

SEQ ID NO: 672524 - DNA, 20 bp, mouse
gcttgaaagctggtgatgag

SEQ ID NO: 672525 - DNA, 20 bp, mouse
gttgtcacagattgttggta

SEQ ID NO: 672526 - DNA, 20 bp, mouse
gacagatggtatatgcagaa

SEQ ID NO: 672527 - DNA, 20 bp, mouse
gaacgccaccagctgtgcgg

SEQ ID NO: 672528 - DNA, 20 bp, mouse
gcacccagaaggccacccta

SEQ ID NO: 672529 - DNA, 20 bp, mouse
gaccacctccgcacagctgg

SEQ ID NO: 672530 - DNA, 20 bp, mouse
ggcggccacagcaagttcca

SEQ ID NO: 672531 - DNA, 20 bp, mouse
gtctaataccctcacctcgg

SEQ ID NO: 672532 - DNA, 20 bp, mouse
gaatactggcatcgttgagg

SEQ ID NO: 672533 - DNA, 20 bp, mouse
ggccaccagctgtgcggagg

SEQ ID NO: 672534 - DNA, 20 bp, mouse
gaaggggattcccagcaatt

SEQ ID NO: 672535 - DNA, 20 bp, mouse
gcagctagtgccttgtttgt

SEQ ID NO: 672536 - DNA, 20 bp, mouse
gccagccaggggacgaaaga

SEQ ID NO: 672537 - DNA, 20 bp, mouse
gcagtggtcagacagctggt

SEQ ID NO: 672538 - DNA, 20 bp, mouse
gggaacagctgacaatgcag

SEQ ID NO: 672539 - DNA, 20 bp, mouse
gctggcagggttggctggga

SEQ ID NO: 672540 - DNA, 20 bp, mouse
gccaggatatgtacaatgct

SEQ ID NO: 672541 - DNA, 20 bp, mouse
gaaagtgtctcaacagagac

SEQ ID NO: 672542 - DNA, 20 bp, mouse
ggaatagtcccaccagagac

SEQ ID NO: 672543 - DNA, 20 bp, mouse
gccgaagcaactaagtttga

SEQ ID NO: 672544 - DNA, 20 bp, mouse
gtctgttgagacacttttga

SEQ ID NO: 672545 - DNA, 20 bp, mouse
gtagctctacaggcctgggg

SEQ ID NO: 672546 - DNA, 20 bp, mouse
gcccgccggtgggttggctc

SEQ ID NO: 672547 - DNA, 20 bp, mouse
gcctcggcccgccggtgggt

SEQ ID NO: 672548 - DNA, 20 bp, mouse
gggcgcgcgctgacggggtc

SEQ ID NO: 672549 - DNA, 20 bp, mouse
gtggggctgtagccagactt

SEQ ID NO: 672550 - DNA, 20 bp, mouse
gggctccggagccaacccac

SEQ ID NO: 672551 - DNA, 20 bp, mouse
ggctgcctcggcccgccggt

SEQ ID NO: 672552 - DNA, 20 bp, mouse
gcgggacacccccactagca

SEQ ID NO: 672553 - DNA, 20 bp, mouse
gccttcgctagggcgggtgt

SEQ ID NO: 672554 - DNA, 20 bp, mouse
gtgacggggtcgggcggaga

SEQ ID NO: 672555 - DNA, 20 bp, mouse
gaggacagcagcagcctcgg

SEQ ID NO: 672556 - DNA, 20 bp, mouse
gcaggcctcctggtccccat

SEQ ID NO: 672557 - DNA, 20 bp, mouse
gcgcgcgtgcacagcggtgg

SEQ ID NO: 672558 - DNA, 20 bp, mouse
gaccgcgcacccaccatccc

SEQ ID NO: 672559 - DNA, 20 bp, mouse
ggcgcgcgcgtccacgttgc

SEQ ID NO: 672560 - DNA, 20 bp, mouse
gtggagtccaacctgagctt

SEQ ID NO: 672561 - DNA, 20 bp, mouse
gcaccgcgcagaaaacacct

SEQ ID NO: 672562 - DNA, 20 bp, mouse
ggtaagcctgcactccattg

SEQ ID NO: 672563 - DNA, 20 bp, mouse
gggtcagatcgcttgagctt

SEQ ID NO: 672564 - DNA, 20 bp, mouse
gggcgacgacgcgcaggacc

SEQ ID NO: 672565 - DNA, 20 bp, mouse
ggttttctgcgcggtgcggc

SEQ ID NO: 672566 - DNA, 20 bp, mouse
ggagctgggccgctgtctcg

SEQ ID NO: 672567 - DNA, 20 bp, mouse
gaccacgtctcgggtagggg

SEQ ID NO: 672568 - DNA, 20 bp, mouse
gctggacgcgaccacgtctc

SEQ ID NO: 672569 - DNA, 20 bp, mouse
gagggcttttgggaccctgc

SEQ ID NO: 672570 - DNA, 20 bp, mouse
gggcgccctcccctcgccgg

SEQ ID NO: 672571 - DNA, 20 bp, mouse
ggggaggcgacgctccgccc

SEQ ID NO: 672572 - DNA, 20 bp, mouse
gtgcgcagcacgctcccgca

SEQ ID NO: 672573 - DNA, 20 bp, mouse
gggactccccgggaaacagc

SEQ ID NO: 672574 - DNA, 20 bp, mouse
gcccgcccctacccgagacg

SEQ ID NO: 672575 - DNA, 20 bp, mouse
gccccatcccggttgtgtca

SEQ ID NO: 672576 - DNA, 20 bp, mouse
gcaaaaggggcgggacgctc

SEQ ID NO: 672577 - DNA, 20 bp, mouse
gcgggacgctcagggatggt

SEQ ID NO: 672578 - DNA, 20 bp, mouse
gtggctggcgagggcaggaa

SEQ ID NO: 672579 - DNA, 20 bp, mouse
gtgcgcaagcgcatccagaa

SEQ ID NO: 672580 - DNA, 20 bp, mouse
gacgctcagggatggtgggt

SEQ ID NO: 672581 - DNA, 20 bp, mouse
ggctctcgcgagaggatgga

SEQ ID NO: 672582 - DNA, 20 bp, mouse
gacatggcactggctggcga

SEQ ID NO: 672583 - DNA, 20 bp, mouse
gtctcgcgagagctaacgag

SEQ ID NO: 672584 - DNA, 20 bp, mouse
gagcgggactacgcccgttc

SEQ ID NO: 672585 - DNA, 20 bp, mouse
gtgcagcaaccaatccggag

SEQ ID NO: 672586 - DNA, 20 bp, mouse
gtgggcgggccctaaactaa

SEQ ID NO: 672587 - DNA, 20 bp, mouse
gccgggcccaagtgctctac

SEQ ID NO: 672588 - DNA, 20 bp, mouse
gcgcgcctgactgacttaat

SEQ ID NO: 672589 - DNA, 20 bp, mouse
gtgggtaaagctgtaaccct

SEQ ID NO: 672590 - DNA, 20 bp, mouse
gagtgtaaagtagggaatcc

SEQ ID NO: 672591 - DNA, 20 bp, mouse
gggcccaagtgctctactgg

SEQ ID NO: 672592 - DNA, 20 bp, mouse
gcagttctgcccttagttta

SEQ ID NO: 672593 - DNA, 20 bp, mouse
gtactaggggttaaagccta

SEQ ID NO: 672594 - DNA, 20 bp, mouse
gcactgatgggaattggtag

SEQ ID NO: 672595 - DNA, 20 bp, mouse
ggaagctgcagctgaggtcc

SEQ ID NO: 672596 - DNA, 20 bp, mouse
gagggcgggcccacgttgtg

SEQ ID NO: 672597 - DNA, 20 bp, mouse
gcgccctcgcgcctgtatca

SEQ ID NO: 672598 - DNA, 20 bp, mouse
gggagagaactcatgagcct

SEQ ID NO: 672599 - DNA, 20 bp, mouse
gagtcctaggagctagttgc

SEQ ID NO: 672600 - DNA, 20 bp, mouse
ggggcgggtgcccgagtcct

SEQ ID NO: 672601 - DNA, 20 bp, mouse
gcgcaggcggaccctagccc

SEQ ID NO: 672602 - DNA, 20 bp, mouse
gcctcccgcaactagctcct

SEQ ID NO: 672603 - DNA, 20 bp, mouse
gctccctgatacaggcgcga

SEQ ID NO: 672604 - DNA, 20 bp, mouse
gacacgtgttaaagagacac

SEQ ID NO: 672605 - DNA, 20 bp, mouse
ggcgggcccacgttgtgggg

SEQ ID NO: 672606 - DNA, 20 bp, mouse
gagtctggaatgcaagatca

SEQ ID NO: 672607 - DNA, 20 bp, mouse
gacacacatcagctcgagtc

SEQ ID NO: 672608 - DNA, 20 bp, mouse
ggcgtgcgcgccctgctgag

SEQ ID NO: 672609 - DNA, 20 bp, mouse
gccgaaaccactcgcgtcag

SEQ ID NO: 672610 - DNA, 20 bp, mouse
gaaccgaaacctggtgtgtg

SEQ ID NO: 672611 - DNA, 20 bp, mouse
gtcagcccacagccgatcac

SEQ ID NO: 672612 - DNA, 20 bp, mouse
gtgtcagcgcgacatggggc

SEQ ID NO: 672613 - DNA, 20 bp, mouse
gactgcggcagtggtactcg

SEQ ID NO: 672614 - DNA, 20 bp, mouse
gaaggaaaggctccagtgat

SEQ ID NO: 672615 - DNA, 20 bp, mouse
gcctagctcttgggccctgt

SEQ ID NO: 672616 - DNA, 20 bp, mouse
ggaggaggggagcacggcga

SEQ ID NO: 672617 - DNA, 20 bp, mouse
gaggagggcgggtgtgggac

SEQ ID NO: 672618 - DNA, 20 bp, mouse
ggagccggggcgacagacgg

SEQ ID NO: 672619 - DNA, 20 bp, mouse
ggctgcgaggagggcgggtg

SEQ ID NO: 672620 - DNA, 20 bp, mouse
ggagtctggagctgcgagga

SEQ ID NO: 672621 - DNA, 20 bp, mouse
gtcccgccgccacctcctta

SEQ ID NO: 672622 - DNA, 20 bp, mouse
gtacagagaacccaagtctc

SEQ ID NO: 672623 - DNA, 20 bp, mouse
gcgagctgggaatcaggcgc

SEQ ID NO: 672624 - DNA, 20 bp, mouse
gtctggagctgcgaggaggg

SEQ ID NO: 672625 - DNA, 20 bp, mouse
ggatgcgacccggttcaagg

SEQ ID NO: 672626 - DNA, 20 bp, mouse
gcgtcccgggggactcgcca

SEQ ID NO: 672627 - DNA, 20 bp, mouse
ggggaacaaaggcccacgga

SEQ ID NO: 672628 - DNA, 20 bp, mouse
gggaggggtcgaggagagcg

SEQ ID NO: 672629 - DNA, 20 bp, mouse
gcccctgaactctcttcctt

SEQ ID NO: 672630 - DNA, 20 bp, mouse
gcagcctcgtcctcaagggt

SEQ ID NO: 672631 - DNA, 20 bp, mouse
ggcggaggactcagggagga

SEQ ID NO: 672632 - DNA, 20 bp, mouse
gtcgtcctcaagggtaggga

SEQ ID NO: 672633 - DNA, 20 bp, mouse
gctcccagcctcgtcctcaa

SEQ ID NO: 672634 - DNA, 20 bp, mouse
gcagccctggcgagtccccc

SEQ ID NO: 672635 - DNA, 20 bp, mouse
ggaggagagcgaggctccca

SEQ ID NO: 672636 - DNA, 20 bp, mouse
gcacccccgccttgcaagac

SEQ ID NO: 672637 - DNA, 20 bp, mouse
gggcagctggaatcccttga

SEQ ID NO: 672638 - DNA, 20 bp, mouse
gtctgcctccaggaaagctg

SEQ ID NO: 672639 - DNA, 20 bp, mouse
gtccaggaaagctgtggtac

SEQ ID NO: 672640 - DNA, 20 bp, mouse
gggaatcccttgagggttga

SEQ ID NO: 672641 - DNA, 20 bp, mouse
ggaggagcctccctgtaggt

SEQ ID NO: 672642 - DNA, 20 bp, mouse
ggggtaaggggtcgggtgaa

SEQ ID NO: 672643 - DNA, 20 bp, mouse
gaggggtcgggtgaagggtc

SEQ ID NO: 672644 - DNA, 20 bp, mouse
gggaggatggcagatgatac

SEQ ID NO: 672645 - DNA, 20 bp, mouse
gtaggcagccagaagggcat

SEQ ID NO: 672646 - DNA, 20 bp, mouse
gtgaccgccccccacggggt

SEQ ID NO: 672647 - DNA, 20 bp, mouse
gaacactgaccgccccccac

SEQ ID NO: 672648 - DNA, 20 bp, mouse
gggggggcggtcagtgttcc

SEQ ID NO: 672649 - DNA, 20 bp, mouse
ggaggcagccagttggccta

SEQ ID NO: 672650 - DNA, 20 bp, mouse
gtcccaggcgtgaccgtggt

SEQ ID NO: 672651 - DNA, 20 bp, mouse
gtagaggcgtgtacccgaag

SEQ ID NO: 672652 - DNA, 20 bp, mouse
gcatccaccccaccccgtgg

SEQ ID NO: 672653 - DNA, 20 bp, mouse
ggcccaccacggtcacgcct

SEQ ID NO: 672654 - DNA, 20 bp, mouse
gaccgtggtgggccacgccc

SEQ ID NO: 672655 - DNA, 20 bp, mouse
ggggccgccggcgggagcca

SEQ ID NO: 672656 - DNA, 20 bp, mouse
gacactcagtgcaccccaga

SEQ ID NO: 672657 - DNA, 20 bp, mouse
gccaggagcagagcgtaagt

SEQ ID NO: 672658 - DNA, 20 bp, mouse
ggagcagagcgtaagtgggc

SEQ ID NO: 672659 - DNA, 20 bp, mouse
gagtgggcggggagaagttt

SEQ ID NO: 672660 - DNA, 20 bp, mouse
ggccctgtccagctctagcc

SEQ ID NO: 672661 - DNA, 20 bp, mouse
ggggcctgcagctgctgaac

SEQ ID NO: 672662 - DNA, 20 bp, mouse
ggagaagtttcgggtaccat

SEQ ID NO: 672663 - DNA, 20 bp, mouse
gcccggcgttgagcaaaccc

SEQ ID NO: 672664 - DNA, 20 bp, mouse
ggggaatcatgtccagtcac

SEQ ID NO: 672665 - DNA, 20 bp, mouse
ggccaatgagcgctctcaag

SEQ ID NO: 672666 - DNA, 20 bp, mouse
ggaagccgcagagcgcgcgt

SEQ ID NO: 672667 - DNA, 20 bp, mouse
gcgcccgtgagctcccgaga

SEQ ID NO: 672668 - DNA, 20 bp, mouse
gacagagcgcgcggccagtg

SEQ ID NO: 672669 - DNA, 20 bp, mouse
ggggaagagacaggaccggg

SEQ ID NO: 672670 - DNA, 20 bp, mouse
gcagccctctcgggagctca

SEQ ID NO: 672671 - DNA, 20 bp, mouse
gtggaaagaggcgatcccgg

SEQ ID NO: 672672 - DNA, 20 bp, mouse
gtccgggccccgccccacgg

SEQ ID NO: 672673 - DNA, 20 bp, mouse
gcacgcccacgcgcgctctg

SEQ ID NO: 672674 - DNA, 20 bp, mouse
gggcaccgcggggaagagac

SEQ ID NO: 672675 - DNA, 20 bp, mouse
gagaggcgatcccggtggca

SEQ ID NO: 672676 - DNA, 20 bp, mouse
ggaactgggtgtcttatccg

SEQ ID NO: 672677 - DNA, 20 bp, mouse
gttaccctgtgctttattat

SEQ ID NO: 672678 - DNA, 20 bp, mouse
gaagaatgtcaagcgttcca

SEQ ID NO: 672679 - DNA, 20 bp, mouse
gtcacattgtaatggctaat

SEQ ID NO: 672680 - DNA, 20 bp, mouse
gcacagggtaacatttaatc

SEQ ID NO: 672681 - DNA, 20 bp, mouse
gttgcccataataaagcaca

SEQ ID NO: 672682 - DNA, 20 bp, mouse
gaatggattgacaaagaagg

SEQ ID NO: 672683 - DNA, 20 bp, mouse
gatagcaaatcctttcagaa

SEQ ID NO: 672684 - DNA, 20 bp, mouse
gttatgtcaccatgatgaga

SEQ ID NO: 672685 - DNA, 20 bp, mouse
gtgcaaccatgtttcaactc

SEQ ID NO: 672686 - DNA, 20 bp, mouse
gggtcggcccggggagggaa

SEQ ID NO: 672687 - DNA, 20 bp, mouse
gagtctgcggccaggcagga

SEQ ID NO: 672688 - DNA, 20 bp, mouse
ggcgtgccgtggcccctctc

SEQ ID NO: 672689 - DNA, 20 bp, mouse
gctgcctggccgcagactgc

SEQ ID NO: 672690 - DNA, 20 bp, mouse
ggcggctctcggggcatctg

SEQ ID NO: 672691 - DNA, 20 bp, mouse
gggccaggcaggaggggcgt

SEQ ID NO: 672692 - DNA, 20 bp, mouse
gttaagaagcggcccgccgg

SEQ ID NO: 672693 - DNA, 20 bp, mouse
gcgggaggtcggcccgggga

SEQ ID NO: 672694 - DNA, 20 bp, mouse
gctcccaatgctggcgacgg

SEQ ID NO: 672695 - DNA, 20 bp, mouse
gcgcggacggatcccgagag

SEQ ID NO: 672696 - DNA, 20 bp, mouse
ggcgtccaagagcgggtgat

SEQ ID NO: 672697 - DNA, 20 bp, mouse
ggggctcgggaccggtccga

SEQ ID NO: 672698 - DNA, 20 bp, mouse
gggaggagccacccgcgtcg

SEQ ID NO: 672699 - DNA, 20 bp, mouse
ggctggggggcgtccaagag

SEQ ID NO: 672700 - DNA, 20 bp, mouse
gggtggctcctccttcggac

SEQ ID NO: 672701 - DNA, 20 bp, mouse
gcacccgcgtcgtggctgcc

SEQ ID NO: 672702 - DNA, 20 bp, mouse
gccgggaagcggtgtctaga

SEQ ID NO: 672703 - DNA, 20 bp, mouse
gcacgggcgtcgtttccttc

SEQ ID NO: 672704 - DNA, 20 bp, mouse
ggccaggcgtggggaagcgc

SEQ ID NO: 672705 - DNA, 20 bp, mouse
gctcccgcccgcctgctgct

SEQ ID NO: 672706 - DNA, 20 bp, mouse
ggcggcgcgggaagttctga

SEQ ID NO: 672707 - DNA, 20 bp, mouse
ggggaggcggggaaataggt

SEQ ID NO: 672708 - DNA, 20 bp, mouse
gcgccattggccagcgggga

SEQ ID NO: 672709 - DNA, 20 bp, mouse
ggggtcttactcccagaggg

SEQ ID NO: 672710 - DNA, 20 bp, mouse
gcttactcccagagggcggg

SEQ ID NO: 672711 - DNA, 20 bp, mouse
ggatcaagaacgctttctat

SEQ ID NO: 672712 - DNA, 20 bp, mouse
gcaacagccgacgttcccag

SEQ ID NO: 672713 - DNA, 20 bp, mouse
ggggcgggtcttactcccag

SEQ ID NO: 672714 - DNA, 20 bp, mouse
gaacgtcggctgttgattgg

SEQ ID NO: 672715 - DNA, 20 bp, mouse
gcacggattacttactgtac

SEQ ID NO: 672716 - DNA, 20 bp, mouse
gagttcggggagaactccgg

SEQ ID NO: 672717 - DNA, 20 bp, mouse
gaaaacccactgttcggaag

SEQ ID NO: 672718 - DNA, 20 bp, mouse
gaaggggtgtggttcacctg

SEQ ID NO: 672719 - DNA, 20 bp, mouse
gaggccgcggggaacgaggc

SEQ ID NO: 672720 - DNA, 20 bp, mouse
gccgtcccggaagtactccg

SEQ ID NO: 672721 - DNA, 20 bp, mouse
gagtgcgcaggcaatgctcg

SEQ ID NO: 672722 - DNA, 20 bp, mouse
ggcggagagaagcgaggtcc

SEQ ID NO: 672723 - DNA, 20 bp, mouse
ggagaagcgaggtccggggt

SEQ ID NO: 672724 - DNA, 20 bp, mouse
gccactgttcggaaggggtg

SEQ ID NO: 672725 - DNA, 20 bp, mouse
gcccggcggtaggtgagttc

SEQ ID NO: 672726 - DNA, 20 bp, mouse
gtagaggtacttagcgatta

SEQ ID NO: 672727 - DNA, 20 bp, mouse
gtgtagtgctccgccttcgg

SEQ ID NO: 672728 - DNA, 20 bp, mouse
gtcagtgcgcgcgcaactag

SEQ ID NO: 672729 - DNA, 20 bp, mouse
gagcactacacgtaacttaa

SEQ ID NO: 672730 - DNA, 20 bp, mouse
gctggccacgcccccgaagg

SEQ ID NO: 672731 - DNA, 20 bp, mouse
ggggcataaacttgtccaga

SEQ ID NO: 672732 - DNA, 20 bp, mouse
gcgcactgacgcaagcccgt

SEQ ID NO: 672733 - DNA, 20 bp, mouse
ggcagcgtgaccggctaaaa

SEQ ID NO: 672734 - DNA, 20 bp, mouse
gttagccggtcacgctgcac

SEQ ID NO: 672735 - DNA, 20 bp, mouse
ggcgtggcaacatggtcctt

SEQ ID NO: 672736 - DNA, 20 bp, mouse
ggccggaaactgggcaccag

SEQ ID NO: 672737 - DNA, 20 bp, mouse
ggccgaccggcgagtgtggt

SEQ ID NO: 672738 - DNA, 20 bp, mouse
gggcaccagcggcttgccct

SEQ ID NO: 672739 - DNA, 20 bp, mouse
gttccggcagcaccaatccc

SEQ ID NO: 672740 - DNA, 20 bp, mouse
gcacgcacgatggtcctcgc

SEQ ID NO: 672741 - DNA, 20 bp, mouse
ggagctcctggaatcaccct

SEQ ID NO: 672742 - DNA, 20 bp, mouse
ggagtgtggtaggattcgag

SEQ ID NO: 672743 - DNA, 20 bp, mouse
gacgcagtctcgcgagacgg

SEQ ID NO: 672744 - DNA, 20 bp, mouse
gcacactcgccggtcggcac

SEQ ID NO: 672745 - DNA, 20 bp, mouse
ggggcaacttccaacctgcg

SEQ ID NO: 672746 - DNA, 20 bp, mouse
gcatagcaacggttgttagg

SEQ ID NO: 672747 - DNA, 20 bp, mouse
ggggtaaggagggtgcaccg

SEQ ID NO: 672748 - DNA, 20 bp, mouse
gactggactcaaaaatcttc

SEQ ID NO: 672749 - DNA, 20 bp, mouse
gcaggtattgaaaagatctg

SEQ ID NO: 672750 - DNA, 20 bp, mouse
gtcaaagaagtgtcgaaaag

SEQ ID NO: 672751 - DNA, 20 bp, mouse
gaaggagtaagctggtgttt

SEQ ID NO: 672752 - DNA, 20 bp, mouse
ggttaggcggtctccgggta

SEQ ID NO: 672753 - DNA, 20 bp, mouse
gaggagggtgcaccgaggac

SEQ ID NO: 672754 - DNA, 20 bp, mouse
ggcccatagcaacggttgtt

SEQ ID NO: 672755 - DNA, 20 bp, mouse
gggcggtctccgggtaagga

SEQ ID NO: 672756 - DNA, 20 bp, mouse
gaccctggccgatgcacttc

SEQ ID NO: 672757 - DNA, 20 bp, mouse
ggtgacgcgcacggagggca

SEQ ID NO: 672758 - DNA, 20 bp, mouse
ggaagcctcgcgggacagtc

SEQ ID NO: 672759 - DNA, 20 bp, mouse
gacacagtgacgcgcacgga

SEQ ID NO: 672760 - DNA, 20 bp, mouse
gtgttcttgcgcagggcatc

SEQ ID NO: 672761 - DNA, 20 bp, mouse
ggcgaggcttccagttacgg

SEQ ID NO: 672762 - DNA, 20 bp, mouse
gctactggcaaggggaccgg

SEQ ID NO: 672763 - DNA, 20 bp, mouse
gcccgcgaggcttccagtta

SEQ ID NO: 672764 - DNA, 20 bp, mouse
ggcaacgcccagacggaccc

SEQ ID NO: 672765 - DNA, 20 bp, mouse
ggcgcagggcatcagggtac

SEQ ID NO: 672766 - DNA, 20 bp, mouse
gcggccgaggacaccagaca

SEQ ID NO: 672767 - DNA, 20 bp, mouse
gcaggagcctccagcccaag

SEQ ID NO: 672768 - DNA, 20 bp, mouse
ggggcagcgtcacgcgtcag

SEQ ID NO: 672769 - DNA, 20 bp, mouse
gcctccagcccaagcggccg

SEQ ID NO: 672770 - DNA, 20 bp, mouse
gcacgcacgcacgctgaggg

SEQ ID NO: 672771 - DNA, 20 bp, mouse
gctagcaaggtaaagggcat

SEQ ID NO: 672772 - DNA, 20 bp, mouse
gtgggcacgcacgcacgctg

SEQ ID NO: 672773 - DNA, 20 bp, mouse
gcggctggctgtcacctcac

SEQ ID NO: 672774 - DNA, 20 bp, mouse
ggcggatctgggcttggcgt

SEQ ID NO: 672775 - DNA, 20 bp, mouse
gaggaaggtgaggacgctcg

SEQ ID NO: 672776 - DNA, 20 bp, mouse
gaagggtggcggggcactgt

SEQ ID NO: 672777 - DNA, 20 bp, mouse
gcacccttagcgccgctcag

SEQ ID NO: 672778 - DNA, 20 bp, mouse
gcccgcgggcccaggagagc

SEQ ID NO: 672779 - DNA, 20 bp, mouse
gggccccgccccgatgcgtc

SEQ ID NO: 672780 - DNA, 20 bp, mouse
ggggaggagccggacgcatc

SEQ ID NO: 672781 - DNA, 20 bp, mouse
gggagccggacgcatcgggg

SEQ ID NO: 672782 - DNA, 20 bp, mouse
ggagcggcgctaagggtggc

SEQ ID NO: 672783 - DNA, 20 bp, mouse
ggtggcggggcactgtaggc

SEQ ID NO: 672784 - DNA, 20 bp, mouse
gcggtgcccctctgcggata

SEQ ID NO: 672785 - DNA, 20 bp, mouse
ggggcggggcccaggcctcg

SEQ ID NO: 672786 - DNA, 20 bp, mouse
gctgctgcagcacactgagg

SEQ ID NO: 672787 - DNA, 20 bp, mouse
gccgagaggtgacttctccc

SEQ ID NO: 672788 - DNA, 20 bp, mouse
gttcagtgggaggggtgcag

SEQ ID NO: 672789 - DNA, 20 bp, mouse
ggggcggaggcgcagcctgg

SEQ ID NO: 672790 - DNA, 20 bp, mouse
gggaggcgcagcctggtgga

SEQ ID NO: 672791 - DNA, 20 bp, mouse
gcgggggcgggggccggatt

SEQ ID NO: 672792 - DNA, 20 bp, mouse
ggggctgggaggcaaaggcg

SEQ ID NO: 672793 - DNA, 20 bp, mouse
gcactgaggtggccaagcgg

SEQ ID NO: 672794 - DNA, 20 bp, mouse
gcccgctcccgggctggcaa

SEQ ID NO: 672795 - DNA, 20 bp, mouse
ggccaagcggtggcctcata

SEQ ID NO: 672796 - DNA, 20 bp, mouse
gcaagcttggggcaaccaac

SEQ ID NO: 672797 - DNA, 20 bp, mouse
gttggggcaaccaactggat

SEQ ID NO: 672798 - DNA, 20 bp, mouse
gacagcctgatgtcccaaac

SEQ ID NO: 672799 - DNA, 20 bp, mouse
gaaattacaggtggctcctc

SEQ ID NO: 672800 - DNA, 20 bp, mouse
gatgagcacgggtgctcccg

SEQ ID NO: 672801 - DNA, 20 bp, mouse
gcagccctgtttgggacatc

SEQ ID NO: 672802 - DNA, 20 bp, mouse
gaaagctaggatgtagactg

SEQ ID NO: 672803 - DNA, 20 bp, mouse
gaggtgggcaggtgacagcc

SEQ ID NO: 672804 - DNA, 20 bp, mouse
gtgtggaagaggtctgtgag

SEQ ID NO: 672805 - DNA, 20 bp, mouse
gaccaactggataggtgggc

SEQ ID NO: 672806 - DNA, 20 bp, mouse
gccaactcaggggcagaagg

SEQ ID NO: 672807 - DNA, 20 bp, mouse
gtccctgagtcaacatctca

SEQ ID NO: 672808 - DNA, 20 bp, mouse
gaggtcacacagtaagcacg

SEQ ID NO: 672809 - DNA, 20 bp, mouse
gagtaagcacgtggcagatc

SEQ ID NO: 672810 - DNA, 20 bp, mouse
gagagcaaaaagcaccacag

SEQ ID NO: 672811 - DNA, 20 bp, mouse
ggccttgagatgttgactca

SEQ ID NO: 672812 - DNA, 20 bp, mouse
gggagtcacgatgcctggga

SEQ ID NO: 672813 - DNA, 20 bp, mouse
gaacctgtttgccaactcag

SEQ ID NO: 672814 - DNA, 20 bp, mouse
gtcagggagtcacgatgcct

SEQ ID NO: 672815 - DNA, 20 bp, mouse
gaggttgtgtagcttgctcc

SEQ ID NO: 672816 - DNA, 20 bp, mouse
gccgacagccaatcatgcag

SEQ ID NO: 672817 - DNA, 20 bp, mouse
gccctcccccacgtggttgt

SEQ ID NO: 672818 - DNA, 20 bp, mouse
gtaagagagtagaaccggtg

SEQ ID NO: 672819 - DNA, 20 bp, mouse
gccagcaccaacaaccacgt

SEQ ID NO: 672820 - DNA, 20 bp, mouse
gggcggtgcaatgacctcac

SEQ ID NO: 672821 - DNA, 20 bp, mouse
gaaaccagagtagagaagtt

SEQ ID NO: 672822 - DNA, 20 bp, mouse
gcaatcagcaacggcagggg

SEQ ID NO: 672823 - DNA, 20 bp, mouse
gggggtgggtgtcacaccgg

SEQ ID NO: 672824 - DNA, 20 bp, mouse
gagccaatcagcaacggcag

SEQ ID NO: 672825 - DNA, 20 bp, mouse
gctgtcgggtggccggacta

SEQ ID NO: 672826 - DNA, 20 bp, mouse
gcgcctgctggactctgcga

SEQ ID NO: 672827 - DNA, 20 bp, mouse
gtggactctgcgagggagga

SEQ ID NO: 672828 - DNA, 20 bp, mouse
gttacccgccggagcttcga

SEQ ID NO: 672829 - DNA, 20 bp, mouse
gcccgccggagcttcgaggg

SEQ ID NO: 672830 - DNA, 20 bp, mouse
gctgctggactctgcgaggg

SEQ ID NO: 672831 - DNA, 20 bp, mouse
gcaagcgagccagcggagaa

SEQ ID NO: 672832 - DNA, 20 bp, mouse
gcgcgcgcgggggccgtcac

SEQ ID NO: 672833 - DNA, 20 bp, mouse
gctccggcgggtaacggctc

SEQ ID NO: 672834 - DNA, 20 bp, mouse
gggccccctcccttctccgc

SEQ ID NO: 672835 - DNA, 20 bp, mouse
gggccagagccgttacccgc

SEQ ID NO: 672836 - DNA, 20 bp, mouse
gcgtgcgcaaacggtaccga

SEQ ID NO: 672837 - DNA, 20 bp, mouse
gtgcgagcagcgaatagttc

SEQ ID NO: 672838 - DNA, 20 bp, mouse
ggcgagcggagtgtcctaac

SEQ ID NO: 672839 - DNA, 20 bp, mouse
ggtaccgtttgcgcacgaag

SEQ ID NO: 672840 - DNA, 20 bp, mouse
ggctccctggcctgggtccc

SEQ ID NO: 672841 - DNA, 20 bp, mouse
gacgccccttcgtgcgcaaa

SEQ ID NO: 672842 - DNA, 20 bp, mouse
gggcccaaaaccccaggatt

SEQ ID NO: 672843 - DNA, 20 bp, mouse
gtcgcggggcgtggctgata

SEQ ID NO: 672844 - DNA, 20 bp, mouse
gggagcgcagcctgtcgcca

SEQ ID NO: 672845 - DNA, 20 bp, mouse
gctggccagcgagttcccgg

SEQ ID NO: 672846 - DNA, 20 bp, mouse
gaggaggagcctatgtgaag

SEQ ID NO: 672847 - DNA, 20 bp, mouse
gggacaaagtcgaagagggt

SEQ ID NO: 672848 - DNA, 20 bp, mouse
gaagagggacaaagtcgaag

SEQ ID NO: 672849 - DNA, 20 bp, mouse
gtaggtggcggcagtcagca

SEQ ID NO: 672850 - DNA, 20 bp, mouse
gtctaaagagacacaaacgg

SEQ ID NO: 672851 - DNA, 20 bp, mouse
gcaaagtcgaagagggtagg

SEQ ID NO: 672852 - DNA, 20 bp, mouse
ggcagtcagcagggctcaca

SEQ ID NO: 672853 - DNA, 20 bp, mouse
gtgtctctttagagatgtga

SEQ ID NO: 672854 - DNA, 20 bp, mouse
gagacacaaacggcggactt

SEQ ID NO: 672855 - DNA, 20 bp, mouse
gtacttctaccacttcacat

SEQ ID NO: 672856 - DNA, 20 bp, mouse
gacacctcctggtgctgtga

SEQ ID NO: 672857 - DNA, 20 bp, mouse
gtggctgcccgtggagtttc

SEQ ID NO: 672858 - DNA, 20 bp, mouse
gggagggctctattgctcaa

SEQ ID NO: 672859 - DNA, 20 bp, mouse
gagggcccatggggcaaagc

SEQ ID NO: 672860 - DNA, 20 bp, mouse
gcaaagcaggctccaccgtc

SEQ ID NO: 672861 - DNA, 20 bp, mouse
gaactccacgggcagccaga

SEQ ID NO: 672862 - DNA, 20 bp, mouse
gccctcctgaggtttagtgc

SEQ ID NO: 672863 - DNA, 20 bp, mouse
ggagcaatagagccctcctg

SEQ ID NO: 672864 - DNA, 20 bp, mouse
gttggccagcactaaacctc

SEQ ID NO: 672865 - DNA, 20 bp, mouse
gggagcctgctttgccccat

SEQ ID NO: 672866 - DNA, 20 bp, mouse
gggagcatgggcaaattaga

SEQ ID NO: 672867 - DNA, 20 bp, mouse
gagctgaggtgcagcttctg

SEQ ID NO: 672868 - DNA, 20 bp, mouse
gccttcttgtgggccaaatt

SEQ ID NO: 672869 - DNA, 20 bp, mouse
gaagaagctgtggtggctaa

SEQ ID NO: 672870 - DNA, 20 bp, mouse
gcttctgtggtcacccaatt

SEQ ID NO: 672871 - DNA, 20 bp, mouse
gctaccttgggagtatgcac

SEQ ID NO: 672872 - DNA, 20 bp, mouse
gatgcactggagtctgatgc

SEQ ID NO: 672873 - DNA, 20 bp, mouse
gaggtagcaaagagctgtta

SEQ ID NO: 672874 - DNA, 20 bp, mouse
gctaaaggatggacggggat

SEQ ID NO: 672875 - DNA, 20 bp, mouse
gatgcaaagaaagcgagcaa

SEQ ID NO: 672876 - DNA, 20 bp, mouse
gggtggatatcacttttcag

SEQ ID NO: 672877 - DNA, 20 bp, mouse
gccagaggacccctccctac

SEQ ID NO: 672878 - DNA, 20 bp, mouse
gatcacttttcaggggagga

SEQ ID NO: 672879 - DNA, 20 bp, mouse
gactcagtccaagcaaactt

SEQ ID NO: 672880 - DNA, 20 bp, mouse
gagaggggcgtgggagtcag

SEQ ID NO: 672881 - DNA, 20 bp, mouse
gggcagctatctcacaaata

SEQ ID NO: 672882 - DNA, 20 bp, mouse
ggccaccaggggtgtagatg

SEQ ID NO: 672883 - DNA, 20 bp, mouse
gacctcatctacacccctgg

SEQ ID NO: 672884 - DNA, 20 bp, mouse
ggtagacagaaagtgaaagg

SEQ ID NO: 672885 - DNA, 20 bp, mouse
gcacaaatagggagtatctg

SEQ ID NO: 672886 - DNA, 20 bp, mouse
ggagcagtgatgacccaagt

SEQ ID NO: 672887 - DNA, 20 bp, mouse
gctctgaagtagactgtctg

SEQ ID NO: 672888 - DNA, 20 bp, mouse
gttgggtcatcactgctcag

SEQ ID NO: 672889 - DNA, 20 bp, mouse
gtcaagatccttagggatgt

SEQ ID NO: 672890 - DNA, 20 bp, mouse
gcccaagtgggccacagcct

SEQ ID NO: 672891 - DNA, 20 bp, mouse
ggtctacttcagagagacga

SEQ ID NO: 672892 - DNA, 20 bp, mouse
ggccgaggggaattctccat

SEQ ID NO: 672893 - DNA, 20 bp, mouse
gcagtcctgggaaagggccg

SEQ ID NO: 672894 - DNA, 20 bp, mouse
gtacatctccagcaattctc

SEQ ID NO: 672895 - DNA, 20 bp, mouse
gagaagggtggactcagtcc

SEQ ID NO: 672896 - DNA, 20 bp, mouse
gacacagcacgggacccagt

SEQ ID NO: 672897 - DNA, 20 bp, mouse
ggggtcccgtgctgtgtgcc

SEQ ID NO: 672898 - DNA, 20 bp, mouse
ggacccagttggagaaggag

SEQ ID NO: 672899 - DNA, 20 bp, mouse
gggagccaggcacacagcac

SEQ ID NO: 672900 - DNA, 20 bp, mouse
gccgggcaagggcagtctaa

SEQ ID NO: 672901 - DNA, 20 bp, mouse
gggcaagggcagtctaaggg

SEQ ID NO: 672902 - DNA, 20 bp, mouse
gaacgcaggacaccgggcaa

SEQ ID NO: 672903 - DNA, 20 bp, mouse
gaagggcagtctaagggcgg

SEQ ID NO: 672904 - DNA, 20 bp, mouse
ggagaacgtccagcatccta

SEQ ID NO: 672905 - DNA, 20 bp, mouse
gtctaagggcggaggtaccg

SEQ ID NO: 672906 - DNA, 20 bp, mouse
ggcggcgtcggggacgtcgg

SEQ ID NO: 672907 - DNA, 20 bp, mouse
gcacctcagccccgccaacc

SEQ ID NO: 672908 - DNA, 20 bp, mouse
gcctcccgcggcagcccctc

SEQ ID NO: 672909 - DNA, 20 bp, mouse
gagtagcagtgactccgcgg

SEQ ID NO: 672910 - DNA, 20 bp, mouse
ggatggactccgggccgcag

SEQ ID NO: 672911 - DNA, 20 bp, mouse
gtgccgcgggaggtgagttc

SEQ ID NO: 672912 - DNA, 20 bp, mouse
gtgtcctgaggggctgccgc

SEQ ID NO: 672913 - DNA, 20 bp, mouse
gagccccgccaacccggagg

SEQ ID NO: 672914 - DNA, 20 bp, mouse
ggaggaggcgggatggactc

SEQ ID NO: 672915 - DNA, 20 bp, mouse
ggcggcagagccacaagtgt

SEQ ID NO: 672916 - DNA, 20 bp, mouse
ggcgcagcagaggtaagctt

SEQ ID NO: 672917 - DNA, 20 bp, mouse
gagcgagcatcgcgcacagg

SEQ ID NO: 672918 - DNA, 20 bp, mouse
gcggtcagcccgaacaagcg

SEQ ID NO: 672919 - DNA, 20 bp, mouse
gtctgcggggtcgcgagcgg

SEQ ID NO: 672920 - DNA, 20 bp, mouse
ggcgcgatgctcgctctctg

SEQ ID NO: 672921 - DNA, 20 bp, mouse
ggagagcgagcatcgcgcac

SEQ ID NO: 672922 - DNA, 20 bp, mouse
gtggtaacaccaatcttccg

SEQ ID NO: 672923 - DNA, 20 bp, mouse
gactgccggaagagagcaag

SEQ ID NO: 672924 - DNA, 20 bp, mouse
gctggtggctgccgcggctt

SEQ ID NO: 672925 - DNA, 20 bp, mouse
gcggaagagagcaagagggg

SEQ ID NO: 672926 - DNA, 20 bp, mouse
gcggactagggcaaagccaa

SEQ ID NO: 672927 - DNA, 20 bp, mouse
gtggaggggcgggactccgt

SEQ ID NO: 672928 - DNA, 20 bp, mouse
gggggtgggggggaaaaatg

SEQ ID NO: 672929 - DNA, 20 bp, mouse
ggggtcgggaacgcggaagt

SEQ ID NO: 672930 - DNA, 20 bp, mouse
ggggacagctgatttggagg

SEQ ID NO: 672931 - DNA, 20 bp, mouse
gaggcgctgagtgttttgat

SEQ ID NO: 672932 - DNA, 20 bp, mouse
gagcgcctccgcgcggacta

SEQ ID NO: 672933 - DNA, 20 bp, mouse
gccgcccgctagcgactagg

SEQ ID NO: 672934 - DNA, 20 bp, mouse
ggcgtggtgggcgggttaag

SEQ ID NO: 672935 - DNA, 20 bp, mouse
gcatctgcgcctcggtggag

SEQ ID NO: 672936 - DNA, 20 bp, mouse
gtgctctgacggggatagga

SEQ ID NO: 672937 - DNA, 20 bp, mouse
gaatgtgcgcaatccaggag

SEQ ID NO: 672938 - DNA, 20 bp, mouse
ggcagcaggctgctctgacg

SEQ ID NO: 672939 - DNA, 20 bp, mouse
gcctcctgtgggcacattgt

SEQ ID NO: 672940 - DNA, 20 bp, mouse
ggattgcgcacattgaggga

SEQ ID NO: 672941 - DNA, 20 bp, mouse
gtggtccagcggtccctgca

SEQ ID NO: 672942 - DNA, 20 bp, mouse
gtaggggcccagcatgatcc

SEQ ID NO: 672943 - DNA, 20 bp, mouse
gcaccctgaagccgtatcca

SEQ ID NO: 672944 - DNA, 20 bp, mouse
ggaggggatcgtgccttgca

SEQ ID NO: 672945 - DNA, 20 bp, mouse
gcctggattgcgcacattga

SEQ ID NO: 672946 - DNA, 20 bp, mouse
gaggccgcggggaacgaggc

SEQ ID NO: 672947 - DNA, 20 bp, mouse
gagtgcgcaggcaatgctcg

SEQ ID NO: 672948 - DNA, 20 bp, mouse
ggcgacggcggcgggaggtt

SEQ ID NO: 672949 - DNA, 20 bp, mouse
gccgtcccggaagtactccg

SEQ ID NO: 672950 - DNA, 20 bp, mouse
gcccgcggcctgacctgcaa

SEQ ID NO: 672951 - DNA, 20 bp, mouse
gcggcgagagcgcggaggat

SEQ ID NO: 672952 - DNA, 20 bp, mouse
ggggaacgaggccggaggcg

SEQ ID NO: 672953 - DNA, 20 bp, mouse
ggcgcaggcaatgctcgcgg

SEQ ID NO: 672954 - DNA, 20 bp, mouse
gcaggcaatgctcgcggcgg

SEQ ID NO: 672955 - DNA, 20 bp, mouse
gcctccggcctcgttccccg

SEQ ID NO: 672956 - DNA, 20 bp, mouse
gggcgcctaaggctatcccg

SEQ ID NO: 672957 - DNA, 20 bp, mouse
gacaaccgcgggatagcctt

SEQ ID NO: 672958 - DNA, 20 bp, mouse
gctggataggctcgcccggg

SEQ ID NO: 672959 - DNA, 20 bp, mouse
gggtaaaacccggcctggat

SEQ ID NO: 672960 - DNA, 20 bp, mouse
gatagccttaggcgccaagg

SEQ ID NO: 672961 - DNA, 20 bp, mouse
gcaaaggatcggcaggccat

SEQ ID NO: 672962 - DNA, 20 bp, mouse
gccaggccgggttttaccgt

SEQ ID NO: 672963 - DNA, 20 bp, mouse
gcgggcgagcctatccaggc

SEQ ID NO: 672964 - DNA, 20 bp, mouse
gtgcgcatgcgcgactctac

SEQ ID NO: 672965 - DNA, 20 bp, mouse
gatgcgcagctggtccaacc

SEQ ID NO: 672966 - DNA, 20 bp, mouse
gtggatgaactcataaagga

SEQ ID NO: 672967 - DNA, 20 bp, mouse
gacggagcccggcctgtcct

SEQ ID NO: 672968 - DNA, 20 bp, mouse
gccgcttccgcagacgtcaa

SEQ ID NO: 672969 - DNA, 20 bp, mouse
gcaacgcagcgcccagcgta

SEQ ID NO: 672970 - DNA, 20 bp, mouse
ggcccggcctgtcctcggct

SEQ ID NO: 672971 - DNA, 20 bp, mouse
gccgcagccgagccgaggac

SEQ ID NO: 672972 - DNA, 20 bp, mouse
ggccgagccgaggacaggcc

SEQ ID NO: 672973 - DNA, 20 bp, mouse
ggcgcccagcgtacggagcc

SEQ ID NO: 672974 - DNA, 20 bp, mouse
gtgacgtgcgcgctgcggag

SEQ ID NO: 672975 - DNA, 20 bp, mouse
gaaggggagaagagaccaaa

SEQ ID NO: 672976 - DNA, 20 bp, mouse
gcggccgtgcccatcctgtg

SEQ ID NO: 672977 - DNA, 20 bp, mouse
gcctgggcggtgtcttcctt

SEQ ID NO: 672978 - DNA, 20 bp, mouse
ggtggcacctgccgactcca

SEQ ID NO: 672979 - DNA, 20 bp, mouse
ggcacctgccgactccaggg

SEQ ID NO: 672980 - DNA, 20 bp, mouse
ggagcggccatgcgcagcgt

SEQ ID NO: 672981 - DNA, 20 bp, mouse
gcttgggggcggagcggaga

SEQ ID NO: 672982 - DNA, 20 bp, mouse
gggcccgcacaggatgggca

SEQ ID NO: 672983 - DNA, 20 bp, mouse
gagggagatgggttcctaac

SEQ ID NO: 672984 - DNA, 20 bp, mouse
gtgcacagaatgtgcggtgc

SEQ ID NO: 672985 - DNA, 20 bp, mouse
gctaactggaggcccgaggg

SEQ ID NO: 672986 - DNA, 20 bp, mouse
gcggcggcccggaggggaac

SEQ ID NO: 672987 - DNA, 20 bp, mouse
gcccccgcgctgtagttcta

SEQ ID NO: 672988 - DNA, 20 bp, mouse
gtccctgcacttcaataggt

SEQ ID NO: 672989 - DNA, 20 bp, mouse
gcgggccgccgcaaagcccg

SEQ ID NO: 672990 - DNA, 20 bp, mouse
gcactcgggcacgtcagttc

SEQ ID NO: 672991 - DNA, 20 bp, mouse
gagctcccgcccagttttcc

SEQ ID NO: 672992 - DNA, 20 bp, mouse
gctgacgtgcccgagtgggg

SEQ ID NO: 672993 - DNA, 20 bp, mouse
gcggaggggaacgggggtgc

SEQ ID NO: 672994 - DNA, 20 bp, mouse
gagaaccgcgggctttgcgg

SEQ ID NO: 672995 - DNA, 20 bp, mouse
ggatacgattggtcaactct

SEQ ID NO: 672996 - DNA, 20 bp, mouse
ggacccgcccagatctcgga

SEQ ID NO: 672997 - DNA, 20 bp, mouse
ggggtcccctgcggagtctg

SEQ ID NO: 672998 - DNA, 20 bp, mouse
gaaggaatccaggcggggtt

SEQ ID NO: 672999 - DNA, 20 bp, mouse
gtctattggtcgctagtcaa

SEQ ID NO: 673000 - DNA, 20 bp, mouse
ggggctgggaagtttgaaat

SEQ ID NO: 673001 - DNA, 20 bp, mouse
gccaggacccgcccagatct

SEQ ID NO: 673002 - DNA, 20 bp, mouse
gagcgctcgccatctactga

SEQ ID NO: 673003 - DNA, 20 bp, mouse
gccagatctcggagggctag

SEQ ID NO: 673004 - DNA, 20 bp, mouse
gaagctgtgcggtacagctg

SEQ ID NO: 673005 - DNA, 20 bp, mouse
gtaaccccggcgcctacgtt

SEQ ID NO: 673006 - DNA, 20 bp, mouse
gtagctgcgtcgtgccccca

SEQ ID NO: 673007 - DNA, 20 bp, mouse
ggggcacgacgcagctactg

SEQ ID NO: 673008 - DNA, 20 bp, mouse
ggcccccagggctgagggac

SEQ ID NO: 673009 - DNA, 20 bp, mouse
gcacgacgcagctactgggg

SEQ ID NO: 673010 - DNA, 20 bp, mouse
ggaagtgcgctgccgagctg

SEQ ID NO: 673011 - DNA, 20 bp, mouse
ggtcgtgcccccagggctga

SEQ ID NO: 673012 - DNA, 20 bp, mouse
gtgggcaagtccatgcaggg

SEQ ID NO: 673013 - DNA, 20 bp, mouse
gcaagtccatgcagggtggt

SEQ ID NO: 673014 - DNA, 20 bp, mouse
gtgctcctcccacaacctat

SEQ ID NO: 673015 - DNA, 20 bp, mouse
gcgagctggtgcagtcaccg

SEQ ID NO: 673016 - DNA, 20 bp, mouse
ggcgccgcccagcaggtctc

SEQ ID NO: 673017 - DNA, 20 bp, mouse
gcggcagaggacccgatcca

SEQ ID NO: 673018 - DNA, 20 bp, mouse
ggggagatctagccagaagg

SEQ ID NO: 673019 - DNA, 20 bp, mouse
ggggagccagaaagccactt

SEQ ID NO: 673020 - DNA, 20 bp, mouse
gcacgtgcagcgcggactcg

SEQ ID NO: 673021 - DNA, 20 bp, mouse
gaagcatagccattcttcgt

SEQ ID NO: 673022 - DNA, 20 bp, mouse
gccgcgctgcacgtgcgcag

SEQ ID NO: 673023 - DNA, 20 bp, mouse
gaagccgggtgagcgagctg

SEQ ID NO: 673024 - DNA, 20 bp, mouse
gtagctccgtgtccctgagg

SEQ ID NO: 673025 - DNA, 20 bp, mouse
gccagaaagccacttcggtc

SEQ ID NO: 673026 - DNA, 20 bp, mouse
ggggcctgcaagggcgtccc

SEQ ID NO: 673027 - DNA, 20 bp, mouse
gcgaaagcctgggaaccctt

SEQ ID NO: 673028 - DNA, 20 bp, mouse
gacgcccttgcaggcccaaa

SEQ ID NO: 673029 - DNA, 20 bp, mouse
gagggcggagctctggtagg

SEQ ID NO: 673030 - DNA, 20 bp, mouse
gtaccagagctccgcccttt

SEQ ID NO: 673031 - DNA, 20 bp, mouse
gggtggttgacatttttctg

SEQ ID NO: 673032 - DNA, 20 bp, mouse
gaggatgcaggcactttggt

SEQ ID NO: 673033 - DNA, 20 bp, mouse
gcacgcccactctctgtcat

SEQ ID NO: 673034 - DNA, 20 bp, mouse
gaacctgtccaagaaggtat

SEQ ID NO: 673035 - DNA, 20 bp, mouse
gcatcctgggacgcccttgc

SEQ ID NO: 673036 - DNA, 20 bp, mouse
gaggcctccgcacctccaga

SEQ ID NO: 673037 - DNA, 20 bp, mouse
gagagcgccctctggaggtg

SEQ ID NO: 673038 - DNA, 20 bp, mouse
gcgcgcgcaggtcacgtcgc

SEQ ID NO: 673039 - DNA, 20 bp, mouse
ggtggctcccaggtgctatg

SEQ ID NO: 673040 - DNA, 20 bp, mouse
ggcaatcgctagagccgcgg

SEQ ID NO: 673041 - DNA, 20 bp, mouse
gggcctcagcgcggacgccg

SEQ ID NO: 673042 - DNA, 20 bp, mouse
gcgccgcggcgtccgcgctg

SEQ ID NO: 673043 - DNA, 20 bp, mouse
gggctctagcgattgcagat

SEQ ID NO: 673044 - DNA, 20 bp, mouse
gatgaggcgccgggcagcgt

SEQ ID NO: 673045 - DNA, 20 bp, mouse
gagcgattgcagattggtcg

SEQ ID NO: 673046 - DNA, 20 bp, mouse
gcggtcctttggcttcctct

SEQ ID NO: 673047 - DNA, 20 bp, mouse
gaggggcggggcccaggcga

SEQ ID NO: 673048 - DNA, 20 bp, mouse
gaggcgcgctcattaagcga

SEQ ID NO: 673049 - DNA, 20 bp, mouse
gctggtcctgctatatcctg

SEQ ID NO: 673050 - DNA, 20 bp, mouse
gtggatgacgccgttggagc

SEQ ID NO: 673051 - DNA, 20 bp, mouse
gtcgccggctgccaagtctc

SEQ ID NO: 673052 - DNA, 20 bp, mouse
gcaaagctctcccaactgga

SEQ ID NO: 673053 - DNA, 20 bp, mouse
gcggcgtcatccatccagtt

SEQ ID NO: 673054 - DNA, 20 bp, mouse
gggtgcgctccttagggata

SEQ ID NO: 673055 - DNA, 20 bp, mouse
gggcgccggcgtggattgaa

SEQ ID NO: 673056 - DNA, 20 bp, mouse
gcacctcagaggcaccgctg

SEQ ID NO: 673057 - DNA, 20 bp, mouse
gctcaggggaggtccccagt

SEQ ID NO: 673058 - DNA, 20 bp, mouse
gaatcgcagagcctcagggg

SEQ ID NO: 673059 - DNA, 20 bp, mouse
ggggagctggtgggtgatgc

SEQ ID NO: 673060 - DNA, 20 bp, mouse
gcggaagtgacctagccata

SEQ ID NO: 673061 - DNA, 20 bp, mouse
gtctccaatcgcagagcctc

SEQ ID NO: 673062 - DNA, 20 bp, mouse
ggacattcggcgattcccac

SEQ ID NO: 673063 - DNA, 20 bp, mouse
gtctgagaaggcccgcccta

SEQ ID NO: 673064 - DNA, 20 bp, mouse
gaagtgacctagccataggg

SEQ ID NO: 673065 - DNA, 20 bp, mouse
gacggagagggcgggataac

SEQ ID NO: 673066 - DNA, 20 bp, mouse
ggggtcgcagcgaagggagg

SEQ ID NO: 673067 - DNA, 20 bp, mouse
gtaccctcgagaggagtcag

SEQ ID NO: 673068 - DNA, 20 bp, mouse
ggggctccgcccgccctccg

SEQ ID NO: 673069 - DNA, 20 bp, mouse
gctccgcggggtcgcagcga

SEQ ID NO: 673070 - DNA, 20 bp, mouse
gcgaccccgcctcccgggaa

SEQ ID NO: 673071 - DNA, 20 bp, mouse
gcgagcgcctgccacgcaag

SEQ ID NO: 673072 - DNA, 20 bp, mouse
gtgccccggctaccctcgag

SEQ ID NO: 673073 - DNA, 20 bp, mouse
gggcgccgaccccgcctccc

SEQ ID NO: 673074 - DNA, 20 bp, mouse
gctgggcgcggctgcccgga

SEQ ID NO: 673075 - DNA, 20 bp, mouse
gtcggagcggccgggaacgt

SEQ ID NO: 673076 - DNA, 20 bp, mouse
gcgcgcagctgtgtttccca

SEQ ID NO: 673077 - DNA, 20 bp, mouse
gcgccgcctgcggccttaaa

SEQ ID NO: 673078 - DNA, 20 bp, mouse
gcggcccaagcggttttaaa

SEQ ID NO: 673079 - DNA, 20 bp, mouse
gtgacccggcagaggtgagt

SEQ ID NO: 673080 - DNA, 20 bp, mouse
ggctggaggaatggctacca

SEQ ID NO: 673081 - DNA, 20 bp, mouse
gctgccgggtcagaaccgag

SEQ ID NO: 673082 - DNA, 20 bp, mouse
gaggcccctcggttctgacc

SEQ ID NO: 673083 - DNA, 20 bp, mouse
ggctgtgtttcccagggctg

SEQ ID NO: 673084 - DNA, 20 bp, mouse
ggacactgcggggtgtgcgg

SEQ ID NO: 673085 - DNA, 20 bp, mouse
gtcaggtgcttgtcacccag

SEQ ID NO: 673086 - DNA, 20 bp, mouse
ggggtggccaaactgcgcag

SEQ ID NO: 673087 - DNA, 20 bp, mouse
ggcaccttgaggaaggtcgg

SEQ ID NO: 673088 - DNA, 20 bp, mouse
gaccctctctacaacgcagt

SEQ ID NO: 673089 - DNA, 20 bp, mouse
gcgcagcggggtcgagactt

SEQ ID NO: 673090 - DNA, 20 bp, mouse
gcgagacttggggaccgcta

SEQ ID NO: 673091 - DNA, 20 bp, mouse
gtgggccgctgggggtgtca

SEQ ID NO: 673092 - DNA, 20 bp, mouse
gtgtgcgagcaccaccgggg

SEQ ID NO: 673093 - DNA, 20 bp, mouse
gccccagcggcccaccctag

SEQ ID NO: 673094 - DNA, 20 bp, mouse
gcagcccttgacacccccag

SEQ ID NO: 673095 - DNA, 20 bp, mouse
gggctctggggtttcgtctt

SEQ ID NO: 673096 - DNA, 20 bp, mouse
gtctccacaggaaagctcca

SEQ ID NO: 673097 - DNA, 20 bp, mouse
gctcaaatggcgaagaggct

SEQ ID NO: 673098 - DNA, 20 bp, mouse
gacaggtgtcagcaagagtt

SEQ ID NO: 673099 - DNA, 20 bp, mouse
gctgccctggagctttcctg

SEQ ID NO: 673100 - DNA, 20 bp, mouse
ggctgaggaatgactagaca

SEQ ID NO: 673101 - DNA, 20 bp, mouse
gagatgctcaaatggcgaag

SEQ ID NO: 673102 - DNA, 20 bp, mouse
gaggaacttaagagaccagg

SEQ ID NO: 673103 - DNA, 20 bp, mouse
gccgcgctcaggccaagtcc

SEQ ID NO: 673104 - DNA, 20 bp, mouse
gactagcgcgggccgcccac

SEQ ID NO: 673105 - DNA, 20 bp, mouse
gaccaagggaaatcctaagg

SEQ ID NO: 673106 - DNA, 20 bp, mouse
gcagccccatggccttgtat

SEQ ID NO: 673107 - DNA, 20 bp, mouse
gactgagggcaggctgtaac

SEQ ID NO: 673108 - DNA, 20 bp, mouse
ggcacgcctgggtccggggt

SEQ ID NO: 673109 - DNA, 20 bp, mouse
ggggacagctggcccttcgc

SEQ ID NO: 673110 - DNA, 20 bp, mouse
gctggctagtcacaccctgt

SEQ ID NO: 673111 - DNA, 20 bp, mouse
gactctcaggggcccctccc

SEQ ID NO: 673112 - DNA, 20 bp, mouse
gagggtgtgactagccagga

SEQ ID NO: 673113 - DNA, 20 bp, mouse
gaaagctcatctactctcag

SEQ ID NO: 673114 - DNA, 20 bp, mouse
gaagtgctgagtctagctgg

SEQ ID NO: 673115 - DNA, 20 bp, mouse
ggtaacaggcttgggggcca

SEQ ID NO: 673116 - DNA, 20 bp, mouse
ggcctcagggagtaaatctc

SEQ ID NO: 673117 - DNA, 20 bp, mouse
gtgaccaccctcatccttgg

SEQ ID NO: 673118 - DNA, 20 bp, mouse
gaccggagatttactccctg

SEQ ID NO: 673119 - DNA, 20 bp, mouse
ggcgctaggtgtgcgggggt

SEQ ID NO: 673120 - DNA, 20 bp, mouse
gagacgcccaccaaggatga

SEQ ID NO: 673121 - DNA, 20 bp, mouse
gtgccaccgcgctaggtgtg

SEQ ID NO: 673122 - DNA, 20 bp, mouse
gtggagacagacgcccacca

SEQ ID NO: 673123 - DNA, 20 bp, mouse
gcaccgcgctaggtgtgcgg

SEQ ID NO: 673124 - DNA, 20 bp, mouse
gccccagccgcagtctccag

SEQ ID NO: 673125 - DNA, 20 bp, mouse
gagcgcggtggcaggcggga

SEQ ID NO: 673126 - DNA, 20 bp, mouse
gtggaggtctcatgagggat

SEQ ID NO: 673127 - DNA, 20 bp, mouse
gtcaaaggtctgcccgttca

SEQ ID NO: 673128 - DNA, 20 bp, mouse
gggtctgcccgttcagggag

SEQ ID NO: 673129 - DNA, 20 bp, mouse
gagggtacaagggtcagcaa

SEQ ID NO: 673130 - DNA, 20 bp, mouse
gaacgggcagacctttgact

SEQ ID NO: 673131 - DNA, 20 bp, mouse
gcccccagctgtgtccttga

SEQ ID NO: 673132 - DNA, 20 bp, mouse
ggccttcaaggacacagctg

SEQ ID NO: 673133 - DNA, 20 bp, mouse
ggacccttgtaccctaagct

SEQ ID NO: 673134 - DNA, 20 bp, mouse
ggctaggactggccccaacc

SEQ ID NO: 673135 - DNA, 20 bp, mouse
gttgacttggcttgccagtc

SEQ ID NO: 673136 - DNA, 20 bp, mouse
gaaagcagacgggtaaagga

SEQ ID NO: 673137 - DNA, 20 bp, mouse
gggtctctgcggccgaaggc

SEQ ID NO: 673138 - DNA, 20 bp, mouse
gaaaggagggacagcgaggt

SEQ ID NO: 673139 - DNA, 20 bp, mouse
gaaagcgaggccaaagaggg

SEQ ID NO: 673140 - DNA, 20 bp, mouse
gtaaatggagtgctgtgctc

SEQ ID NO: 673141 - DNA, 20 bp, mouse
gcgtctcttcaagtcgtaaa

SEQ ID NO: 673142 - DNA, 20 bp, mouse
gccaatcgaggacttcaaaa

SEQ ID NO: 673143 - DNA, 20 bp, mouse
ggtcaaactaggattctcat

SEQ ID NO: 673144 - DNA, 20 bp, mouse
gagcctgctggcgcagccat

SEQ ID NO: 673145 - DNA, 20 bp, mouse
gtcctgggagaggggttccg

SEQ ID NO: 673146 - DNA, 20 bp, mouse
gcgagggcgggagtaaggat

SEQ ID NO: 673147 - DNA, 20 bp, mouse
gacgctccgcgcagacctcg

SEQ ID NO: 673148 - DNA, 20 bp, mouse
gaccccaagagatattgaga

SEQ ID NO: 673149 - DNA, 20 bp, mouse
gggcagaaccgttgggtggt

SEQ ID NO: 673150 - DNA, 20 bp, mouse
gacacgagatgaggtatccg

SEQ ID NO: 673151 - DNA, 20 bp, mouse
gggtgggcggacacgagatg

SEQ ID NO: 673152 - DNA, 20 bp, mouse
gtgcctgggggcagaaccgt

SEQ ID NO: 673153 - DNA, 20 bp, mouse
gcctcgcagcgcgtgcgcag

SEQ ID NO: 673154 - DNA, 20 bp, mouse
ggcggagcgtgattggttgg

SEQ ID NO: 673155 - DNA, 20 bp, mouse
gggtctgcgcggagcgtgat

SEQ ID NO: 673156 - DNA, 20 bp, mouse
ggagaggaagccacctctct

SEQ ID NO: 673157 - DNA, 20 bp, mouse
ggggtcaaaggcaaaggcgg

SEQ ID NO: 673158 - DNA, 20 bp, mouse
ggctgggcgttaccatagag

SEQ ID NO: 673159 - DNA, 20 bp, mouse
ggggacctgaaacttcatgc

SEQ ID NO: 673160 - DNA, 20 bp, mouse
ggggtcgccattcgggtcaa

SEQ ID NO: 673161 - DNA, 20 bp, mouse
gcccggccggtggcggtaag

SEQ ID NO: 673162 - DNA, 20 bp, mouse
gctcgagcaagactaggaga

SEQ ID NO: 673163 - DNA, 20 bp, mouse
gccaacgcgctgtcagctac

SEQ ID NO: 673164 - DNA, 20 bp, mouse
gggtgaccaaggagaattta

SEQ ID NO: 673165 - DNA, 20 bp, mouse
gttcatgcgggccccagcgc

SEQ ID NO: 673166 - DNA, 20 bp, mouse
gtagctgcacatatgctgtt

SEQ ID NO: 673167 - DNA, 20 bp, mouse
ggggtccgctacaaaaacga

SEQ ID NO: 673168 - DNA, 20 bp, mouse
ggcattaaaagtccccgagt

SEQ ID NO: 673169 - DNA, 20 bp, mouse
gaaaaccctcgtttttgtag

SEQ ID NO: 673170 - DNA, 20 bp, mouse
gcgagtgggatgacatttat

SEQ ID NO: 673171 - DNA, 20 bp, mouse
ggctctgtgcacagacagta

SEQ ID NO: 673172 - DNA, 20 bp, mouse
gtttgtagcggaccctagca

SEQ ID NO: 673173 - DNA, 20 bp, mouse
gtctccttgtaacggatgcc

SEQ ID NO: 673174 - DNA, 20 bp, mouse
ggcacagagctgcctttgat

SEQ ID NO: 673175 - DNA, 20 bp, mouse
ggtcaaagccagcccatcaa

SEQ ID NO: 673176 - DNA, 20 bp, mouse
gtggctctcgcgattatggg

SEQ ID NO: 673177 - DNA, 20 bp, mouse
gtgcacaaaaggcacttccg

SEQ ID NO: 673178 - DNA, 20 bp, mouse
ggaagtgagaggttgagcga

SEQ ID NO: 673179 - DNA, 20 bp, mouse
gcttccgcggtcgagaggaa

SEQ ID NO: 673180 - DNA, 20 bp, mouse
gaaagtgagagcttaagtag

SEQ ID NO: 673181 - DNA, 20 bp, mouse
gaaaacgtgtctggaattct

SEQ ID NO: 673182 - DNA, 20 bp, mouse
ggtgacaatcgattgagaac

SEQ ID NO: 673183 - DNA, 20 bp, mouse
gagaggcggcgctgcacaaa

SEQ ID NO: 673184 - DNA, 20 bp, mouse
gggcgtggctctcgcgatta

SEQ ID NO: 673185 - DNA, 20 bp, mouse
gtgtgagccctatgtgagtg

SEQ ID NO: 673186 - DNA, 20 bp, mouse
gaaggcagctgtttctgttc

SEQ ID NO: 673187 - DNA, 20 bp, mouse
gtagctgcagctatgaactt

SEQ ID NO: 673188 - DNA, 20 bp, mouse
gcttctgggaagaatgttca

SEQ ID NO: 673189 - DNA, 20 bp, mouse
gcagggctcgcctgaaagga

SEQ ID NO: 673190 - DNA, 20 bp, mouse
gtacctgcattgctattctg

SEQ ID NO: 673191 - DNA, 20 bp, mouse
ggcaaatagccaaggtcttc

SEQ ID NO: 673192 - DNA, 20 bp, mouse
gggaaataaaaagggcaggg

SEQ ID NO: 673193 - DNA, 20 bp, mouse
gaaccccagaatagcaatgc

SEQ ID NO: 673194 - DNA, 20 bp, mouse
gtaaatgtcagtggggacta

SEQ ID NO: 673195 - DNA, 20 bp, mouse
gcaagcagggctcgcctgaa

SEQ ID NO: 673196 - DNA, 20 bp, mouse
gtgggaggatcttacagata

SEQ ID NO: 673197 - DNA, 20 bp, mouse
gtacaacagtgactcgggaa

SEQ ID NO: 673198 - DNA, 20 bp, mouse
gactccaagaaaaataatgt

SEQ ID NO: 673199 - DNA, 20 bp, mouse
gccaagaaaaataatgtggg

SEQ ID NO: 673200 - DNA, 20 bp, mouse
gtattccactgtgccagccc

SEQ ID NO: 673201 - DNA, 20 bp, mouse
gcagagtacaacagtgactc

SEQ ID NO: 673202 - DNA, 20 bp, mouse
ggataaggtacatcaagcct

SEQ ID NO: 673203 - DNA, 20 bp, mouse
gaggtacatcaagcctgggc

SEQ ID NO: 673204 - DNA, 20 bp, mouse
ggtaagaagatgtgttatgt

SEQ ID NO: 673205 - DNA, 20 bp, mouse
ggtggaatactgtcaacagt

SEQ ID NO: 673206 - DNA, 20 bp, mouse
ggcaccaggtgtttgagcaa

SEQ ID NO: 673207 - DNA, 20 bp, mouse
gctggaaaggtggggttcag

SEQ ID NO: 673208 - DNA, 20 bp, mouse
gagggtgggagatcctaatc

SEQ ID NO: 673209 - DNA, 20 bp, mouse
gttcaggggtggagatgggt

SEQ ID NO: 673210 - DNA, 20 bp, mouse
ggggaaagcaggttgtccat

SEQ ID NO: 673211 - DNA, 20 bp, mouse
gttaacctcttgaccctaaa

SEQ ID NO: 673212 - DNA, 20 bp, mouse
gcctcagaaacactcatcca

SEQ ID NO: 673213 - DNA, 20 bp, mouse
gcacacacacaaggtagatg

SEQ ID NO: 673214 - DNA, 20 bp, mouse
gccaggtgtttgagcaaggg

SEQ ID NO: 673215 - DNA, 20 bp, mouse
gcatcaatgtcaagctggaa

SEQ ID NO: 673216 - DNA, 20 bp, mouse
gggtgccttagaaagaacga

SEQ ID NO: 673217 - DNA, 20 bp, mouse
gacttcacaaagaatccgaa

SEQ ID NO: 673218 - DNA, 20 bp, mouse
gataaggatacagccccaca

SEQ ID NO: 673219 - DNA, 20 bp, mouse
gaccctgacatcagccctgt

SEQ ID NO: 673220 - DNA, 20 bp, mouse
gtaacggttaaatgttagtg

SEQ ID NO: 673221 - DNA, 20 bp, mouse
ggccccacagggctgatgtc

SEQ ID NO: 673222 - DNA, 20 bp, mouse
gtgtatccttatgatgatgg

SEQ ID NO: 673223 - DNA, 20 bp, mouse
gaaggtcaccaagaaatatg

SEQ ID NO: 673224 - DNA, 20 bp, mouse
gtaacagtcccctcttgaga

SEQ ID NO: 673225 - DNA, 20 bp, mouse
gagggtctgtttatagggcg

SEQ ID NO: 673226 - DNA, 20 bp, mouse
gtcctgcatcacagctggtc

SEQ ID NO: 673227 - DNA, 20 bp, mouse
gcttcctcctgcatcacagc

SEQ ID NO: 673228 - DNA, 20 bp, mouse
gcaaggcaatagtactcacc

SEQ ID NO: 673229 - DNA, 20 bp, mouse
gagggaaacagtactgatgg

SEQ ID NO: 673230 - DNA, 20 bp, mouse
gtggctttgtctcttctcaa

SEQ ID NO: 673231 - DNA, 20 bp, mouse
ggtctcttctcaagggaaaa

SEQ ID NO: 673232 - DNA, 20 bp, mouse
ggagaggaacttgtagagac

SEQ ID NO: 673233 - DNA, 20 bp, mouse
gtgcctgacccggggctcta

SEQ ID NO: 673234 - DNA, 20 bp, mouse
gggtgctgtgtgccccgtgg

SEQ ID NO: 673235 - DNA, 20 bp, mouse
gccctggggtggatctatct

SEQ ID NO: 673236 - DNA, 20 bp, mouse
gtcacctgttagctcattga

SEQ ID NO: 673237 - DNA, 20 bp, mouse
gctgttagctcattgaggga

SEQ ID NO: 673238 - DNA, 20 bp, mouse
gtgcaggcagggctctagaa

SEQ ID NO: 673239 - DNA, 20 bp, mouse
gaaaaaactgttatgtaacc

SEQ ID NO: 673240 - DNA, 20 bp, mouse
gaaagtctttgtgtatgctt

SEQ ID NO: 673241 - DNA, 20 bp, mouse
gcagaccatccctactatat

SEQ ID NO: 673242 - DNA, 20 bp, mouse
gtattcctatatagtaggga

SEQ ID NO: 673243 - DNA, 20 bp, mouse
gagttctattcctatatagt

SEQ ID NO: 673244 - DNA, 20 bp, mouse
ggtataggatacacatagcc

SEQ ID NO: 673245 - DNA, 20 bp, mouse
gaaggtcaatgttcatgtat

SEQ ID NO: 673246 - DNA, 20 bp, mouse
gaccgtctgaactgaactgg

SEQ ID NO: 673247 - DNA, 20 bp, mouse
gctcctctgctctgaagtaa

SEQ ID NO: 673248 - DNA, 20 bp, mouse
gcgggaaggccgcacagctg

SEQ ID NO: 673249 - DNA, 20 bp, mouse
gagttcagttcagacggtcg

SEQ ID NO: 673250 - DNA, 20 bp, mouse
gtcccgcgcgcgttgctgat

SEQ ID NO: 673251 - DNA, 20 bp, mouse
gacttcagagcagaggagcg

SEQ ID NO: 673252 - DNA, 20 bp, mouse
gttcagacggtcgtggctaa

SEQ ID NO: 673253 - DNA, 20 bp, mouse
gcgctcggcccgcagctgtg

SEQ ID NO: 673254 - DNA, 20 bp, mouse
gctgattggctgcgccgcgg

SEQ ID NO: 673255 - DNA, 20 bp, mouse
gagcccttacttcagagcag

SEQ ID NO: 673256 - DNA, 20 bp, mouse
gtagcagccctccccgggtg

SEQ ID NO: 673257 - DNA, 20 bp, mouse
gccccctcagtgttgtggga

SEQ ID NO: 673258 - DNA, 20 bp, mouse
gtcttccccccacccgggga

SEQ ID NO: 673259 - DNA, 20 bp, mouse
gctccctcccacaacactga

SEQ ID NO: 673260 - DNA, 20 bp, mouse
gggagggctgctacaatttg

SEQ ID NO: 673261 - DNA, 20 bp, mouse
gaggtgaggcaaggctgcga

SEQ ID NO: 673262 - DNA, 20 bp, mouse
gtcccccaggaggcctaggg

SEQ ID NO: 673263 - DNA, 20 bp, mouse
gaccccccccctcagtgttg

SEQ ID NO: 673264 - DNA, 20 bp, mouse
gaccaccctaggcctcctgg

SEQ ID NO: 673265 - DNA, 20 bp, mouse
gaattgtagcagccctcccc

SEQ ID NO: 673266 - DNA, 20 bp, mouse
gggcagagggaattccctgt

SEQ ID NO: 673267 - DNA, 20 bp, mouse
gggctaggatgagaacctgt

SEQ ID NO: 673268 - DNA, 20 bp, mouse
ggcactgttctgttcctaca

SEQ ID NO: 673269 - DNA, 20 bp, mouse
gctacaaggctcacagctcc

SEQ ID NO: 673270 - DNA, 20 bp, mouse
ggccacatctgatccttctg

SEQ ID NO: 673271 - DNA, 20 bp, mouse
gcacctgcttcgaccccaga

SEQ ID NO: 673272 - DNA, 20 bp, mouse
gaaggatcagatgtggcggg

SEQ ID NO: 673273 - DNA, 20 bp, mouse
gccacctttggcagactcaa

SEQ ID NO: 673274 - DNA, 20 bp, mouse
gaggcatcagctactctccc

SEQ ID NO: 673275 - DNA, 20 bp, mouse
gacagaacagtgctgctgcc

SEQ ID NO: 673276 - DNA, 20 bp, mouse
gcccggccggggtctgcatt

SEQ ID NO: 673277 - DNA, 20 bp, mouse
gcgccccggcccatctgcag

SEQ ID NO: 673278 - DNA, 20 bp, mouse
gagggcgctgggttaatccc

SEQ ID NO: 673279 - DNA, 20 bp, mouse
gggtctgctggcacgtggaa

SEQ ID NO: 673280 - DNA, 20 bp, mouse
ggtgtccggagaggcggcag

SEQ ID NO: 673281 - DNA, 20 bp, mouse
ggacgcccctgcagatgggc

SEQ ID NO: 673282 - DNA, 20 bp, mouse
gcccggcccccgcaccctca

SEQ ID NO: 673283 - DNA, 20 bp, mouse
gcagggacgcccctgcagat

SEQ ID NO: 673284 - DNA, 20 bp, mouse
gaggctgcccctgtccggtc

SEQ ID NO: 673285 - DNA, 20 bp, mouse
gcccgggcctccgtggcgaa

SEQ ID NO: 673286 - DNA, 20 bp, mouse
gaggatgcccgccatcgcga

SEQ ID NO: 673287 - DNA, 20 bp, mouse
gtgaccgaggtaagcggtgt

SEQ ID NO: 673288 - DNA, 20 bp, mouse
gcctgagggaggtaccgaga

SEQ ID NO: 673289 - DNA, 20 bp, mouse
gcgtggagaaaagtaagaca

SEQ ID NO: 673290 - DNA, 20 bp, mouse
gcggtgtcggggcggtagga

SEQ ID NO: 673291 - DNA, 20 bp, mouse
ggagcgcgcggccaccactg

SEQ ID NO: 673292 - DNA, 20 bp, mouse
ggaggtaagcggtgtcgggg

SEQ ID NO: 673293 - DNA, 20 bp, mouse
gaaggcaagaaatttgaccg

SEQ ID NO: 673294 - DNA, 20 bp, mouse
gcagagtaccgccccaaaag

SEQ ID NO: 673295 - DNA, 20 bp, mouse
ggctttcgtgcccttcgcga

SEQ ID NO: 673296 - DNA, 20 bp, mouse
gcacctctgcgcctattggt

SEQ ID NO: 673297 - DNA, 20 bp, mouse
gccgcccagcgtggccttcg

SEQ ID NO: 673298 - DNA, 20 bp, mouse
gaaagcgcttcggaagtgtg

SEQ ID NO: 673299 - DNA, 20 bp, mouse
ggtgcctcccagtgcggccg

SEQ ID NO: 673300 - DNA, 20 bp, mouse
gcctcctaggggagcctcga

SEQ ID NO: 673301 - DNA, 20 bp, mouse
gtggccttcgaggctcccct

SEQ ID NO: 673302 - DNA, 20 bp, mouse
gcgcgtgcgacgcacctgtc

SEQ ID NO: 673303 - DNA, 20 bp, mouse
gacgtcgctcacgttctccc

SEQ ID NO: 673304 - DNA, 20 bp, mouse
gggccgggagaagacctcct

SEQ ID NO: 673305 - DNA, 20 bp, mouse
gggagcgatgggcgtgacca

SEQ ID NO: 673306 - DNA, 20 bp, mouse
gatacttggcgcttagtcat

SEQ ID NO: 673307 - DNA, 20 bp, mouse
gcagcaggacctgattaaga

SEQ ID NO: 673308 - DNA, 20 bp, mouse
gagtcatcggcgtacacagc

SEQ ID NO: 673309 - DNA, 20 bp, mouse
gcaagtataacagacgaaac

SEQ ID NO: 673310 - DNA, 20 bp, mouse
gacaatctagcccggcttag

SEQ ID NO: 673311 - DNA, 20 bp, mouse
gcatgaaaagcatcattctc

SEQ ID NO: 673312 - DNA, 20 bp, mouse
gagaaacgtcagcactaaaa

SEQ ID NO: 673313 - DNA, 20 bp, mouse
gcagtggatgatgtcatcaa

SEQ ID NO: 673314 - DNA, 20 bp, mouse
gaagggaaattattgcagcc

SEQ ID NO: 673315 - DNA, 20 bp, mouse
gcgctgcctgcctctaagcc

SEQ ID NO: 673316 - DNA, 20 bp, mouse
ggcgggcggcggtgccaagt

SEQ ID NO: 673317 - DNA, 20 bp, mouse
gaaggggtcggagtctgaaa

SEQ ID NO: 673318 - DNA, 20 bp, mouse
gcgggcagcgaagtggccga

SEQ ID NO: 673319 - DNA, 20 bp, mouse
ggggaaagctgtcacgaggc

SEQ ID NO: 673320 - DNA, 20 bp, mouse
gggcggcggtgccaagtagg

SEQ ID NO: 673321 - DNA, 20 bp, mouse
gatggtgctgccacgacact

SEQ ID NO: 673322 - DNA, 20 bp, mouse
ggacactgagtgatttcctg

SEQ ID NO: 673323 - DNA, 20 bp, mouse
gaaaggggaaagctacgagg

SEQ ID NO: 673324 - DNA, 20 bp, mouse
gacacacagcgcctcgtagc

SEQ ID NO: 673325 - DNA, 20 bp, mouse
ggaagagaacaggcaggcga

SEQ ID NO: 673326 - DNA, 20 bp, mouse
gccatcaaatgggtaggggg

SEQ ID NO: 673327 - DNA, 20 bp, mouse
ggccaccaagctcacactag

SEQ ID NO: 673328 - DNA, 20 bp, mouse
gttggaccggccttggagaa

SEQ ID NO: 673329 - DNA, 20 bp, mouse
gagccaccagtgctcccggt

SEQ ID NO: 673330 - DNA, 20 bp, mouse
gtctggtcatgtgatctcat

SEQ ID NO: 673331 - DNA, 20 bp, mouse
gcaaatgccatcaaatgggt

SEQ ID NO: 673332 - DNA, 20 bp, mouse
gtggttctttctgctaaatg

SEQ ID NO: 673333 - DNA, 20 bp, mouse
gctaaacaaatgccatcaaa

SEQ ID NO: 673334 - DNA, 20 bp, mouse
ggaccaaccgggagcactgg

SEQ ID NO: 673335 - DNA, 20 bp, mouse
gggggaggctttgtcagctc

SEQ ID NO: 673336 - DNA, 20 bp, mouse
gggagtggctgcagacgggt

SEQ ID NO: 673337 - DNA, 20 bp, mouse
gcggaagtcccgccccaaca

SEQ ID NO: 673338 - DNA, 20 bp, mouse
gtccctagggctggcgaaga

SEQ ID NO: 673339 - DNA, 20 bp, mouse
gctgcagacgggtggggcga

SEQ ID NO: 673340 - DNA, 20 bp, mouse
gggccgcgcccagaggtctc

SEQ ID NO: 673341 - DNA, 20 bp, mouse
ggctggcgaagaaggcgggg

SEQ ID NO: 673342 - DNA, 20 bp, mouse
ggatccgcgcctcacgtgac

SEQ ID NO: 673343 - DNA, 20 bp, mouse
gcggagctgtcggttgctaa

SEQ ID NO: 673344 - DNA, 20 bp, mouse
gctaagggaaacaggacgag

SEQ ID NO: 673345 - DNA, 20 bp, mouse
gcgggtcccagaaggctgca

SEQ ID NO: 673346 - DNA, 20 bp, mouse
gaggactaggcgtgcatctc

SEQ ID NO: 673347 - DNA, 20 bp, mouse
ggaagccaacttagttgaga

SEQ ID NO: 673348 - DNA, 20 bp, mouse
gcctccgtcgtcagtcacgt

SEQ ID NO: 673349 - DNA, 20 bp, mouse
ggtctcacgtgatctatcat

SEQ ID NO: 673350 - DNA, 20 bp, mouse
gtctcgggctggttcttctc

SEQ ID NO: 673351 - DNA, 20 bp, mouse
ggctagggattttgagttct

SEQ ID NO: 673352 - DNA, 20 bp, mouse
ggtgaagacactaattgcta

SEQ ID NO: 673353 - DNA, 20 bp, mouse
gacggaggccggcaagatcc

SEQ ID NO: 673354 - DNA, 20 bp, mouse
gcaattagtgtcttcactga

SEQ ID NO: 673355 - DNA, 20 bp, mouse
gaggcctcctggaaccggtg

SEQ ID NO: 673356 - DNA, 20 bp, mouse
gaggtgaggaaggggtacag

SEQ ID NO: 673357 - DNA, 20 bp, mouse
ggaaggacgcagcgtctgag

SEQ ID NO: 673358 - DNA, 20 bp, mouse
gcgtctgagaggtgaggaag

SEQ ID NO: 673359 - DNA, 20 bp, mouse
gacgcagcgtctgagaggtg

SEQ ID NO: 673360 - DNA, 20 bp, mouse
gagtcctagcaacacagatg

SEQ ID NO: 673361 - DNA, 20 bp, mouse
gaggccgcccatggaggtgt

SEQ ID NO: 673362 - DNA, 20 bp, mouse
gtgcgtccttcgtggtctgt

SEQ ID NO: 673363 - DNA, 20 bp, mouse
gagcggctgtgcacccggac

SEQ ID NO: 673364 - DNA, 20 bp, mouse
gctgttggctggggtagttc

SEQ ID NO: 673365 - DNA, 20 bp, mouse
gcatgtgacagctgggcaga

SEQ ID NO: 673366 - DNA, 20 bp, mouse
ggcttccttaaccccaggag

SEQ ID NO: 673367 - DNA, 20 bp, mouse
gccccagggacctgcagcat

SEQ ID NO: 673368 - DNA, 20 bp, mouse
gttctcaaggacattctaaa

SEQ ID NO: 673369 - DNA, 20 bp, mouse
gtcccacacgagaaagcaag

SEQ ID NO: 673370 - DNA, 20 bp, mouse
gtaatcacggtcctttgcta

SEQ ID NO: 673371 - DNA, 20 bp, mouse
gcgagaaagcaagcggacta

SEQ ID NO: 673372 - DNA, 20 bp, mouse
ggtgctcagaacggccccaa

SEQ ID NO: 673373 - DNA, 20 bp, mouse
gtcagacccctggagtcccc

SEQ ID NO: 673374 - DNA, 20 bp, mouse
gctggtcagtctgtgagttc

SEQ ID NO: 673375 - DNA, 20 bp, mouse
gaactcctgtacacctggac

SEQ ID NO: 673376 - DNA, 20 bp, mouse
gacacgaagggaagaggtta

SEQ ID NO: 673377 - DNA, 20 bp, mouse
ggtggatgatgatgccccgt

SEQ ID NO: 673378 - DNA, 20 bp, mouse
gatgccccgtgggctacctg

SEQ ID NO: 673379 - DNA, 20 bp, mouse
ggggcgctgcatgccgggag

SEQ ID NO: 673380 - DNA, 20 bp, mouse
ggtgctaggagagacacgaa

SEQ ID NO: 673381 - DNA, 20 bp, mouse
gtccccacaaaggtcctcgc

SEQ ID NO: 673382 - DNA, 20 bp, mouse
gggaccatctgaagagaatc

SEQ ID NO: 673383 - DNA, 20 bp, mouse
gggcctgcgaggacctttgt

SEQ ID NO: 673384 - DNA, 20 bp, mouse
gggtccccaggtagcccacg

SEQ ID NO: 673385 - DNA, 20 bp, mouse
gcggccacgaaaccaccagg

SEQ ID NO: 673386 - DNA, 20 bp, mouse
gaggtcttggggtacctcct

SEQ ID NO: 673387 - DNA, 20 bp, mouse
gaggggagagcgctggtctg

SEQ ID NO: 673388 - DNA, 20 bp, mouse
gagagcgcgcggggaggtct

SEQ ID NO: 673389 - DNA, 20 bp, mouse
gagtgccctcaagtgcccag

SEQ ID NO: 673390 - DNA, 20 bp, mouse
gtcagggcacccagagcgcg

SEQ ID NO: 673391 - DNA, 20 bp, mouse
gccctcaagtgcccagtggg

SEQ ID NO: 673392 - DNA, 20 bp, mouse
ggggtagggctgagtcgggg

SEQ ID NO: 673393 - DNA, 20 bp, mouse
gtgcccagtgggcgggacgg

SEQ ID NO: 673394 - DNA, 20 bp, mouse
ggggcacttgagggcactgg

SEQ ID NO: 673395 - DNA, 20 bp, mouse
gtgggaacctcgggcccggg

SEQ ID NO: 673396 - DNA, 20 bp, mouse
gcactctgcgggtccctatc

SEQ ID NO: 673397 - DNA, 20 bp, mouse
gcttcggtgcgggtgtagaa

SEQ ID NO: 673398 - DNA, 20 bp, mouse
ggcaagccaggcttcggtgc

SEQ ID NO: 673399 - DNA, 20 bp, mouse
gaccgtgtgtcaccagccgt

SEQ ID NO: 673400 - DNA, 20 bp, mouse
gggcgcgtccagctcctgtt

SEQ ID NO: 673401 - DNA, 20 bp, mouse
gagggacccgcagagtgaag

SEQ ID NO: 673402 - DNA, 20 bp, mouse
gtgcgggtccctatcgggat

SEQ ID NO: 673403 - DNA, 20 bp, mouse
gccccacggctggtgacaca

SEQ ID NO: 673404 - DNA, 20 bp, mouse
gcgggccccggagtttaaag

SEQ ID NO: 673405 - DNA, 20 bp, mouse
gggggcagcaggctgcccca

SEQ ID NO: 673406 - DNA, 20 bp, mouse
gaaggtgcaagaggaaacga

SEQ ID NO: 673407 - DNA, 20 bp, mouse
ggtgcaagaggaaacgaggg

SEQ ID NO: 673408 - DNA, 20 bp, mouse
gggcgggacccggaagaagg

SEQ ID NO: 673409 - DNA, 20 bp, mouse
ggctccgctcgggaatacct

SEQ ID NO: 673410 - DNA, 20 bp, mouse
gctctcccctggctccgctc

SEQ ID NO: 673411 - DNA, 20 bp, mouse
gcgtaaacctatccctaata

SEQ ID NO: 673412 - DNA, 20 bp, mouse
gcccgcggccagcggcccga

SEQ ID NO: 673413 - DNA, 20 bp, mouse
gctctcaatcacacgcatga

SEQ ID NO: 673414 - DNA, 20 bp, mouse
gatccctaataaggtgcaag

SEQ ID NO: 673415 - DNA, 20 bp, mouse
gcagccaaggtattcccgag

SEQ ID NO: 673416 - DNA, 20 bp, mouse
gtcagttcctggtccttctc

SEQ ID NO: 673417 - DNA, 20 bp, mouse
gggagacacgaggcacttct

SEQ ID NO: 673418 - DNA, 20 bp, mouse
gagcctggagttggctaatg

SEQ ID NO: 673419 - DNA, 20 bp, mouse
ggccgtgaggtggagacacg

SEQ ID NO: 673420 - DNA, 20 bp, mouse
gaatcacattagcctggagt

SEQ ID NO: 673421 - DNA, 20 bp, mouse
gagcctcattagccaactcc

SEQ ID NO: 673422 - DNA, 20 bp, mouse
gtccacggttccagagttgg

SEQ ID NO: 673423 - DNA, 20 bp, mouse
gtaaacccaaggccgtgagg

SEQ ID NO: 673424 - DNA, 20 bp, mouse
gtcttggaggctctggcaga

SEQ ID NO: 673425 - DNA, 20 bp, mouse
gcagtctgtttcaccagata

SEQ ID NO: 673426 - DNA, 20 bp, mouse
gtggccagcagctgcggcaa

SEQ ID NO: 673427 - DNA, 20 bp, mouse
ggggccaaccatcaggtgga

SEQ ID NO: 673428 - DNA, 20 bp, mouse
gctacaaggtggccctgctg

SEQ ID NO: 673429 - DNA, 20 bp, mouse
gtctacacacggccgtctaa

SEQ ID NO: 673430 - DNA, 20 bp, mouse
ggccgtctaatgggtccctg

SEQ ID NO: 673431 - DNA, 20 bp, mouse
ggccacagggacccattaga

SEQ ID NO: 673432 - DNA, 20 bp, mouse
gagggctgtgagggaattct

SEQ ID NO: 673433 - DNA, 20 bp, mouse
ggggtcgtagcactgaatga

SEQ ID NO: 673434 - DNA, 20 bp, mouse
gaacgcagataggacatttc

SEQ ID NO: 673435 - DNA, 20 bp, mouse
gcaacagagccagagcaggg

SEQ ID NO: 673436 - DNA, 20 bp, mouse
gactccccgccctaggagtg

SEQ ID NO: 673437 - DNA, 20 bp, mouse
gtggggaggctggacttact

SEQ ID NO: 673438 - DNA, 20 bp, mouse
gggaggcattaggaatccag

SEQ ID NO: 673439 - DNA, 20 bp, mouse
gggacttactaggagactta

SEQ ID NO: 673440 - DNA, 20 bp, mouse
gtccagcctccccactccta

SEQ ID NO: 673441 - DNA, 20 bp, mouse
gccccgccctaggagtgggg

SEQ ID NO: 673442 - DNA, 20 bp, mouse
gagacttagggatacagcca

SEQ ID NO: 673443 - DNA, 20 bp, mouse
gagcccccaagggaggcatt

SEQ ID NO: 673444 - DNA, 20 bp, mouse
gaaggagcagcccccaaggg

SEQ ID NO: 673445 - DNA, 20 bp, mouse
ggattcctaatgcctccctt

SEQ ID NO: 673446 - DNA, 20 bp, mouse
gtgcctgcaagagggatgtg

SEQ ID NO: 673447 - DNA, 20 bp, mouse
gcctgccctggcttctgatt

SEQ ID NO: 673448 - DNA, 20 bp, mouse
gcccttggaaggtggctgta

SEQ ID NO: 673449 - DNA, 20 bp, mouse
gaggacggaggaaggatcct

SEQ ID NO: 673450 - DNA, 20 bp, mouse
ggctgcttctgccacgaacc

SEQ ID NO: 673451 - DNA, 20 bp, mouse
gtgttccagagcgagggtcg

SEQ ID NO: 673452 - DNA, 20 bp, mouse
gggaagacccgggcacatcc

SEQ ID NO: 673453 - DNA, 20 bp, mouse
gagaacagctccttatccca

SEQ ID NO: 673454 - DNA, 20 bp, mouse
ggtgaggaaacgtgaaagac

SEQ ID NO: 673455 - DNA, 20 bp, mouse
ggcctaaagtgcctgcaaga

SEQ ID NO: 673456 - DNA, 20 bp, mouse
gaacatgagaaatgctaaca

SEQ ID NO: 673457 - DNA, 20 bp, mouse
gttgacacttaattacagca

SEQ ID NO: 673458 - DNA, 20 bp, mouse
gtggctacattctcattggc

SEQ ID NO: 673459 - DNA, 20 bp, mouse
ggtacttcttggcgtatctt

SEQ ID NO: 673460 - DNA, 20 bp, mouse
gcatggaaggcagtacttct

SEQ ID NO: 673461 - DNA, 20 bp, mouse
gaattagtaatgcacaatag

SEQ ID NO: 673462 - DNA, 20 bp, mouse
gggaaaatctggtagagttt

SEQ ID NO: 673463 - DNA, 20 bp, mouse
gactaagactaggaatgctt

SEQ ID NO: 673464 - DNA, 20 bp, mouse
ggaggacatctactaagact

SEQ ID NO: 673465 - DNA, 20 bp, mouse
gggtagagtttcggcatctt

SEQ ID NO: 673466 - DNA, 20 bp, mouse
gagtgagtagagtgtacata

SEQ ID NO: 673467 - DNA, 20 bp, mouse
gggactcaccagcgccgcct

SEQ ID NO: 673468 - DNA, 20 bp, mouse
gagggtgagcaactgggggt

SEQ ID NO: 673469 - DNA, 20 bp, mouse
gtgtggaaattatctcgctt

SEQ ID NO: 673470 - DNA, 20 bp, mouse
ggactgacggtgtgatgggg

SEQ ID NO: 673471 - DNA, 20 bp, mouse
gaatggactgacggtgtgat

SEQ ID NO: 673472 - DNA, 20 bp, mouse
gggtggctgcttggaaggtg

SEQ ID NO: 673473 - DNA, 20 bp, mouse
gaggcaagcccaggcggcgc

SEQ ID NO: 673474 - DNA, 20 bp, mouse
gtgtggcatgttggtcgggg

SEQ ID NO: 673475 - DNA, 20 bp, mouse
ggaacagaaactcccttcaa

SEQ ID NO: 673476 - DNA, 20 bp, mouse
ggccccaagaggcacttgtc

SEQ ID NO: 673477 - DNA, 20 bp, mouse
gaaccagacaagtgcctctt

SEQ ID NO: 673478 - DNA, 20 bp, mouse
gagcccgggtggttggaacg

SEQ ID NO: 673479 - DNA, 20 bp, mouse
ggcccagaacgcactatcta

SEQ ID NO: 673480 - DNA, 20 bp, mouse
gctccacgttccaaccaccc

SEQ ID NO: 673481 - DNA, 20 bp, mouse
gaaaaccatgcccttgaagc

SEQ ID NO: 673482 - DNA, 20 bp, mouse
gagcgaaactgaactatcta

SEQ ID NO: 673483 - DNA, 20 bp, mouse
gcccctagatagtgcgttct

SEQ ID NO: 673484 - DNA, 20 bp, mouse
ggggcagaggcagagcccgg

SEQ ID NO: 673485 - DNA, 20 bp, mouse
gagtttcgctcctgcttcaa

SEQ ID NO: 673486 - DNA, 20 bp, mouse
gcctccctgtctcaatagta

SEQ ID NO: 673487 - DNA, 20 bp, mouse
gggcgaaaagagctctgctg

SEQ ID NO: 673488 - DNA, 20 bp, mouse
ggtaccccagcttggatcct

SEQ ID NO: 673489 - DNA, 20 bp, mouse
gtctgctggggactgtctgt

SEQ ID NO: 673490 - DNA, 20 bp, mouse
gactcctaaaggggtttccc

SEQ ID NO: 673491 - DNA, 20 bp, mouse
ggaacctaggatccaagctg

SEQ ID NO: 673492 - DNA, 20 bp, mouse
gtaaccagggaaaccccttt

SEQ ID NO: 673493 - DNA, 20 bp, mouse
gcactggaatcactcctaaa

SEQ ID NO: 673494 - DNA, 20 bp, mouse
gtcttttcgcccagtttctt

SEQ ID NO: 673495 - DNA, 20 bp, mouse
gtattgagacagggagggca

SEQ ID NO: 673496 - DNA, 20 bp, mouse
gcgcgccaggaacacctaat

SEQ ID NO: 673497 - DNA, 20 bp, mouse
gagtccaggagaaaccttgg

SEQ ID NO: 673498 - DNA, 20 bp, mouse
gttaactcactgtggttctt

SEQ ID NO: 673499 - DNA, 20 bp, mouse
gtagaacattcctgctttgg

SEQ ID NO: 673500 - DNA, 20 bp, mouse
gaaccagggcccaagtagcc

SEQ ID NO: 673501 - DNA, 20 bp, mouse
gcttgggccctggttcaccc

SEQ ID NO: 673502 - DNA, 20 bp, mouse
gtataggtagaatagggctc

SEQ ID NO: 673503 - DNA, 20 bp, mouse
ggtgttctgttctgcccatt

SEQ ID NO: 673504 - DNA, 20 bp, mouse
gtctgcccattaggtgttcc

SEQ ID NO: 673505 - DNA, 20 bp, mouse
gcttgggaagttgatcttat

SEQ ID NO: 673506 - DNA, 20 bp, mouse
ggatgctagtcagtgtgccc

SEQ ID NO: 673507 - DNA, 20 bp, mouse
gagacttcacaggggagcca

SEQ ID NO: 673508 - DNA, 20 bp, mouse
gggggctagcaatctgctga

SEQ ID NO: 673509 - DNA, 20 bp, mouse
gagaagcaaaattaggattg

SEQ ID NO: 673510 - DNA, 20 bp, mouse
gacccacataacaaaagcta

SEQ ID NO: 673511 - DNA, 20 bp, mouse
gagaggaggctgcgggctca

SEQ ID NO: 673512 - DNA, 20 bp, mouse
ggcgggctcatggtggactt

SEQ ID NO: 673513 - DNA, 20 bp, mouse
gggaggctgcgggctcatgg

SEQ ID NO: 673514 - DNA, 20 bp, mouse
gagcaaaggtaactgaaaaa

SEQ ID NO: 673515 - DNA, 20 bp, mouse
gtaacctgagtatgtctact

SEQ ID NO: 673516 - DNA, 20 bp, mouse
gctaagagccagccatgcta

SEQ ID NO: 673517 - DNA, 20 bp, mouse
gtagcgctgcctgacccaag

SEQ ID NO: 673518 - DNA, 20 bp, mouse
gagcccacagggcacaaaca

SEQ ID NO: 673519 - DNA, 20 bp, mouse
gggaacgctgggaacgtgaa

SEQ ID NO: 673520 - DNA, 20 bp, mouse
gatgctaaggagtggccccg

SEQ ID NO: 673521 - DNA, 20 bp, mouse
gagccagccatgctaaggag

SEQ ID NO: 673522 - DNA, 20 bp, mouse
gtagcacagcacaacgcggg

SEQ ID NO: 673523 - DNA, 20 bp, mouse
gggccactccttagcatggc

SEQ ID NO: 673524 - DNA, 20 bp, mouse
gtggactcaaacaatagatc

SEQ ID NO: 673525 - DNA, 20 bp, mouse
ggggcacaaacaaggccccg

SEQ ID NO: 673526 - DNA, 20 bp, mouse
gaggaggagcggctgggcta

SEQ ID NO: 673527 - DNA, 20 bp, mouse
gccccaaggccaaaccctac

SEQ ID NO: 673528 - DNA, 20 bp, mouse
gccgcccctcccacccggta

SEQ ID NO: 673529 - DNA, 20 bp, mouse
gaaaccctaccgggtgggag

SEQ ID NO: 673530 - DNA, 20 bp, mouse
gcgcccaggtgcggccccca

SEQ ID NO: 673531 - DNA, 20 bp, mouse
ggggaggggcgggagcgcca

SEQ ID NO: 673532 - DNA, 20 bp, mouse
ggaaaccgcgcgcccaggtg

SEQ ID NO: 673533 - DNA, 20 bp, mouse
gaggccaaaccctaccgggt

SEQ ID NO: 673534 - DNA, 20 bp, mouse
gagccctaaaccatccgggc

SEQ ID NO: 673535 - DNA, 20 bp, mouse
gaggcagtgcgagagagcga

SEQ ID NO: 673536 - DNA, 20 bp, mouse
gacgccactgtcaaccacaa

SEQ ID NO: 673537 - DNA, 20 bp, mouse
gctgcccagggtataagctt

SEQ ID NO: 673538 - DNA, 20 bp, mouse
gtgagctcgtgtgtaggtta

SEQ ID NO: 673539 - DNA, 20 bp, mouse
gtgtaggttaaggatgtctg

SEQ ID NO: 673540 - DNA, 20 bp, mouse
gagtctgaagatgaacaaag

SEQ ID NO: 673541 - DNA, 20 bp, mouse
gtgagttaggctctctgata

SEQ ID NO: 673542 - DNA, 20 bp, mouse
gtgttaaaaaactatgagtt

SEQ ID NO: 673543 - DNA, 20 bp, mouse
gtaggatctgccgtcccttg

SEQ ID NO: 673544 - DNA, 20 bp, mouse
gctgttgtacgttagggtga

SEQ ID NO: 673545 - DNA, 20 bp, mouse
gacagggtgagctcgtgtgt

SEQ ID NO: 673546 - DNA, 20 bp, mouse
gaggaggcgcggggagagta

SEQ ID NO: 673547 - DNA, 20 bp, mouse
gccaaagcggccctgggccg

SEQ ID NO: 673548 - DNA, 20 bp, mouse
ggtgggacttgtaggaatac

SEQ ID NO: 673549 - DNA, 20 bp, mouse
gaggaatactggaggagaag

SEQ ID NO: 673550 - DNA, 20 bp, mouse
gacgacgcgcgaggaattgt

SEQ ID NO: 673551 - DNA, 20 bp, mouse
gaccccaggccgggccaaag

SEQ ID NO: 673552 - DNA, 20 bp, mouse
gctgcagggaagtacgtcag

SEQ ID NO: 673553 - DNA, 20 bp, mouse
gttggcccggcctggggtgg

SEQ ID NO: 673554 - DNA, 20 bp, mouse
gcgtcaggcatgctctcctc

SEQ ID NO: 673555 - DNA, 20 bp, mouse
ggccgggccaaagcggccct

SEQ ID NO: 673556 - DNA, 20 bp, mouse
ggcagaggaaaattacttga

SEQ ID NO: 673557 - DNA, 20 bp, mouse
gaaggcggacttcagatact

SEQ ID NO: 673558 - DNA, 20 bp, mouse
gggcaatggtagaaatggtg

SEQ ID NO: 673559 - DNA, 20 bp, mouse
gcctcaggaggaggctttgc

SEQ ID NO: 673560 - DNA, 20 bp, mouse
gttggaatcaaaagcgcctc

SEQ ID NO: 673561 - DNA, 20 bp, mouse
ggtagtggtgatgtagatga

SEQ ID NO: 673562 - DNA, 20 bp, mouse
ggatgatggggtggcgggta

SEQ ID NO: 673563 - DNA, 20 bp, mouse
gggtgagggtgggatgacgg

SEQ ID NO: 673564 - DNA, 20 bp, mouse
gggctgactttctctaatct

SEQ ID NO: 673565 - DNA, 20 bp, mouse
ggacagagggaggtgccaag

SEQ ID NO: 673566 - DNA, 20 bp, mouse
gaggacggaccggactggac

SEQ ID NO: 673567 - DNA, 20 bp, mouse
gtggggaggacggaccggac

SEQ ID NO: 673568 - DNA, 20 bp, mouse
gggggttggggaggacggac

SEQ ID NO: 673569 - DNA, 20 bp, mouse
ggtgggagagtgtgtatcga

SEQ ID NO: 673570 - DNA, 20 bp, mouse
gcctctggacaacccggact

SEQ ID NO: 673571 - DNA, 20 bp, mouse
gctaaagaagacggaggtgg

SEQ ID NO: 673572 - DNA, 20 bp, mouse
gactgggaggacctaggtgg

SEQ ID NO: 673573 - DNA, 20 bp, mouse
gagtgtgtatcgaaggaggg

SEQ ID NO: 673574 - DNA, 20 bp, mouse
gagggtggagctcgctcttc

SEQ ID NO: 673575 - DNA, 20 bp, mouse
ggcgctaaagaagacggagg

SEQ ID NO: 673576 - DNA, 20 bp, mouse
ggactcaggggcccaggaca

SEQ ID NO: 673577 - DNA, 20 bp, mouse
gatactggcgggtgactcag

SEQ ID NO: 673578 - DNA, 20 bp, mouse
ggacctcagcgtgagcctgg

SEQ ID NO: 673579 - DNA, 20 bp, mouse
gagcccccaggctcacgctg

SEQ ID NO: 673580 - DNA, 20 bp, mouse
gccagagaaactggtcccga

SEQ ID NO: 673581 - DNA, 20 bp, mouse
gcctgagcttgggccaacaa

SEQ ID NO: 673582 - DNA, 20 bp, mouse
gagtcccggaggcctccctc

SEQ ID NO: 673583 - DNA, 20 bp, mouse
gtggtcccgagggaggcctc

SEQ ID NO: 673584 - DNA, 20 bp, mouse
gggccaacaaaggcgttcag

SEQ ID NO: 673585 - DNA, 20 bp, mouse
gggaggggtttcagtcccgg

SEQ ID NO: 673586 - DNA, 20 bp, mouse
ggttctgcagggtgcggttc

SEQ ID NO: 673587 - DNA, 20 bp, mouse
gtactaggacagaaactggt

SEQ ID NO: 673588 - DNA, 20 bp, mouse
gcgcccccgagacttcaaat

SEQ ID NO: 673589 - DNA, 20 bp, mouse
gggggtccgcgattggctgt

SEQ ID NO: 673590 - DNA, 20 bp, mouse
ggggtgcggttcgggtgagc

SEQ ID NO: 673591 - DNA, 20 bp, mouse
gtcagtaactgtagctgtca

SEQ ID NO: 673592 - DNA, 20 bp, mouse
gagtaggggctgatcttggc

SEQ ID NO: 673593 - DNA, 20 bp, mouse
gttcggcccacagccaatcg

SEQ ID NO: 673594 - DNA, 20 bp, mouse
gctacagttactgaaaccac

SEQ ID NO: 673595 - DNA, 20 bp, mouse
gtctcagactgcggttctgc

SEQ ID NO: 673596 - DNA, 20 bp, mouse
gctgctgagttcagtaacct

SEQ ID NO: 673597 - DNA, 20 bp, mouse
gtggggggcagggacggcgg

SEQ ID NO: 673598 - DNA, 20 bp, mouse
gtagttggtggccactccaa

SEQ ID NO: 673599 - DNA, 20 bp, mouse
gcattcgcaaagcgagaaac

SEQ ID NO: 673600 - DNA, 20 bp, mouse
gttggtggccactccaaggg

SEQ ID NO: 673601 - DNA, 20 bp, mouse
gtcactggaccacctctctt

SEQ ID NO: 673602 - DNA, 20 bp, mouse
gcaggtctgtatgttaccta

SEQ ID NO: 673603 - DNA, 20 bp, mouse
gtcgctttgcgaatgaagac

SEQ ID NO: 673604 - DNA, 20 bp, mouse
gccaccaactaagggaactt

SEQ ID NO: 673605 - DNA, 20 bp, mouse
ggcaggttccgcccttggag

SEQ ID NO: 673606 - DNA, 20 bp, mouse
gaagggacactcacctgaac

SEQ ID NO: 673607 - DNA, 20 bp, mouse
ggggtaggggccaagacttc

SEQ ID NO: 673608 - DNA, 20 bp, mouse
gcgacccaggcgcacctgta

SEQ ID NO: 673609 - DNA, 20 bp, mouse
gcaggcgcacctgtatggaa

SEQ ID NO: 673610 - DNA, 20 bp, mouse
ggcaacttgggcgggaccag

SEQ ID NO: 673611 - DNA, 20 bp, mouse
gcacccggagcgctgcaact

SEQ ID NO: 673612 - DNA, 20 bp, mouse
gaaatgaaggggcgtgaccc

SEQ ID NO: 673613 - DNA, 20 bp, mouse
gcctcctcgtccaggtgaag

SEQ ID NO: 673614 - DNA, 20 bp, mouse
gttagagccaggcaaatgaa

SEQ ID NO: 673615 - DNA, 20 bp, mouse
gcggagcgctgcaacttggg

SEQ ID NO: 673616 - DNA, 20 bp, mouse
ggcggggagcggaaaggact

SEQ ID NO: 673617 - DNA, 20 bp, mouse
ggggccccctagtccaaggc

SEQ ID NO: 673618 - DNA, 20 bp, mouse
gagcggaaaggacttggtgg

SEQ ID NO: 673619 - DNA, 20 bp, mouse
ggaaaccgttccaggtaggg

SEQ ID NO: 673620 - DNA, 20 bp, mouse
gaaaccttggcgccccgggc

SEQ ID NO: 673621 - DNA, 20 bp, mouse
gccaaagctaggacacgcgc

SEQ ID NO: 673622 - DNA, 20 bp, mouse
gacaggcggaccacggtcca

SEQ ID NO: 673623 - DNA, 20 bp, mouse
gcccactaacccctggaccg

SEQ ID NO: 673624 - DNA, 20 bp, mouse
gggcggggcggggagcggaa

SEQ ID NO: 673625 - DNA, 20 bp, mouse
gaaaggacttggtggcggga

SEQ ID NO: 673626 - DNA, 20 bp, mouse
gtaaaccaactcaggatacc

SEQ ID NO: 673627 - DNA, 20 bp, mouse
ggctcccatccccctcttat

SEQ ID NO: 673628 - DNA, 20 bp, mouse
gggtgtgtctaaaccaactc

SEQ ID NO: 673629 - DNA, 20 bp, mouse
gtagccaataagagggggat

SEQ ID NO: 673630 - DNA, 20 bp, mouse
gtaaacttgcaaatcaggtg

SEQ ID NO: 673631 - DNA, 20 bp, mouse
ggactctagggccaagttaa

SEQ ID NO: 673632 - DNA, 20 bp, mouse
gttggacagggatgactcta

SEQ ID NO: 673633 - DNA, 20 bp, mouse
ggggaaaccacattcttgtt

SEQ ID NO: 673634 - DNA, 20 bp, mouse
gtactgttggagccaaaggg

SEQ ID NO: 673635 - DNA, 20 bp, mouse
ggagcagtgcctcttttaac

SEQ ID NO: 673636 - DNA, 20 bp, mouse
ggggccctcggggttagtta

SEQ ID NO: 673637 - DNA, 20 bp, mouse
gagaccctaactaaccccga

SEQ ID NO: 673638 - DNA, 20 bp, mouse
gagcccagcaagagacctgg

SEQ ID NO: 673639 - DNA, 20 bp, mouse
gcaagacagagtgaattaga

SEQ ID NO: 673640 - DNA, 20 bp, mouse
gtggtgaaaaggggatggat

SEQ ID NO: 673641 - DNA, 20 bp, mouse
gtagaggggtggcaaagagg

SEQ ID NO: 673642 - DNA, 20 bp, mouse
ggggatggatgggggccctc

SEQ ID NO: 673643 - DNA, 20 bp, mouse
gccggagcaatggtgaaaag

SEQ ID NO: 673644 - DNA, 20 bp, mouse
gagacctggaggctgctatt

SEQ ID NO: 673645 - DNA, 20 bp, mouse
gaggggaggggatataatga

SEQ ID NO: 673646 - DNA, 20 bp, mouse
gtagccgtgggtggctttcc

SEQ ID NO: 673647 - DNA, 20 bp, mouse
gctgctaggggagaagattc

SEQ ID NO: 673648 - DNA, 20 bp, mouse
gcgagcaaacacacttctgg

SEQ ID NO: 673649 - DNA, 20 bp, mouse
gaggagtcactgcactcctc

SEQ ID NO: 673650 - DNA, 20 bp, mouse
gcaaacacacttctggggga

SEQ ID NO: 673651 - DNA, 20 bp, mouse
gaatcgagcaaacacacttc

SEQ ID NO: 673652 - DNA, 20 bp, mouse
ggggagggtatccatttaga

SEQ ID NO: 673653 - DNA, 20 bp, mouse
ggcctctatctcctggtccc

SEQ ID NO: 673654 - DNA, 20 bp, mouse
gctcctggtcccgggattat

SEQ ID NO: 673655 - DNA, 20 bp, mouse
gtcccgggaccaggagatag

SEQ ID NO: 673656 - DNA, 20 bp, mouse
gggtgcacgtgacaaggcta

SEQ ID NO: 673657 - DNA, 20 bp, mouse
gactctgcacttgtcctcaa

SEQ ID NO: 673658 - DNA, 20 bp, mouse
gaaggctatggggtggagtt

SEQ ID NO: 673659 - DNA, 20 bp, mouse
gtggtcgtagtcagatgatg

SEQ ID NO: 673660 - DNA, 20 bp, mouse
gatactgagcagatggtgat

SEQ ID NO: 673661 - DNA, 20 bp, mouse
gccccaacactcttaaaatg

SEQ ID NO: 673662 - DNA, 20 bp, mouse
gatggggtggagttgggttt

SEQ ID NO: 673663 - DNA, 20 bp, mouse
gcccatctgaaacagagtga

SEQ ID NO: 673664 - DNA, 20 bp, mouse
gtggggtgctcagattggag

SEQ ID NO: 673665 - DNA, 20 bp, mouse
gaactgcaagctgttctttt

SEQ ID NO: 673666 - DNA, 20 bp, mouse
gaggtctggaaagtggcaag

SEQ ID NO: 673667 - DNA, 20 bp, mouse
gagtgcttgtacttgcaaaa

SEQ ID NO: 673668 - DNA, 20 bp, mouse
gccaaggcgggatcaggctt

SEQ ID NO: 673669 - DNA, 20 bp, mouse
gggtgtgggtagacccaagg

SEQ ID NO: 673670 - DNA, 20 bp, mouse
gtctggaaagtggcaagggg

SEQ ID NO: 673671 - DNA, 20 bp, mouse
ggcaagtacaagcacttata

SEQ ID NO: 673672 - DNA, 20 bp, mouse
ggcctcctggaagccaatag

SEQ ID NO: 673673 - DNA, 20 bp, mouse
gtgtgccccctcctcaggaa

SEQ ID NO: 673674 - DNA, 20 bp, mouse
gtcaggctttggaacgttgg

SEQ ID NO: 673675 - DNA, 20 bp, mouse
gtcctggaagccaatagggg

SEQ ID NO: 673676 - DNA, 20 bp, mouse
gtgaggcaataaactgactg

SEQ ID NO: 673677 - DNA, 20 bp, mouse
gagggcatggtggtgcacca

SEQ ID NO: 673678 - DNA, 20 bp, mouse
gtgggaatgaaaaggactat

SEQ ID NO: 673679 - DNA, 20 bp, mouse
gctgcagctccaggtaaaaa

SEQ ID NO: 673680 - DNA, 20 bp, mouse
gaggttaacccagttctcag

SEQ ID NO: 673681 - DNA, 20 bp, mouse
gatgctgtttctgcactgtg

SEQ ID NO: 673682 - DNA, 20 bp, mouse
gctccacttgagcctgctca

SEQ ID NO: 673683 - DNA, 20 bp, mouse
gtcaaatctcaaatgctccc

SEQ ID NO: 673684 - DNA, 20 bp, mouse
gagacacatatttgagagtc

SEQ ID NO: 673685 - DNA, 20 bp, mouse
gaaccttgagcaggctcaag

SEQ ID NO: 673686 - DNA, 20 bp, mouse
gaaaaggaatggcctgaact

SEQ ID NO: 673687 - DNA, 20 bp, mouse
gtcctcacaaaggaacaata

SEQ ID NO: 673688 - DNA, 20 bp, mouse
gtgtaggcaagcaaacatta

SEQ ID NO: 673689 - DNA, 20 bp, mouse
ggtcaacgttctaattccta

SEQ ID NO: 673690 - DNA, 20 bp, mouse
gaaagcgcctgtccttgaaa

SEQ ID NO: 673691 - DNA, 20 bp, mouse
ggagttcagtaacgatcatg

SEQ ID NO: 673692 - DNA, 20 bp, mouse
gcctctctctgcttggtatc

SEQ ID NO: 673693 - DNA, 20 bp, mouse
ggacacactagatccaatac

SEQ ID NO: 673694 - DNA, 20 bp, mouse
gaaagacatagaactagtaa

SEQ ID NO: 673695 - DNA, 20 bp, mouse
gttcaggccattccttttca

SEQ ID NO: 673696 - DNA, 20 bp, mouse
ggaggggagggcacacatag

SEQ ID NO: 673697 - DNA, 20 bp, mouse
gagggctcaagagaggcgag

SEQ ID NO: 673698 - DNA, 20 bp, mouse
gttggccctgatttattcag

SEQ ID NO: 673699 - DNA, 20 bp, mouse
gcctcaacgctgggccaagg

SEQ ID NO: 673700 - DNA, 20 bp, mouse
gtagggaaagcagttggcca

SEQ ID NO: 673701 - DNA, 20 bp, mouse
gggccaagggagtgttgtgg

SEQ ID NO: 673702 - DNA, 20 bp, mouse
gttcagctgttggaggatga

SEQ ID NO: 673703 - DNA, 20 bp, mouse
ggggccaaaaagagcctggc

SEQ ID NO: 673704 - DNA, 20 bp, mouse
gacggcctagggaaagcagt

SEQ ID NO: 673705 - DNA, 20 bp, mouse
gtggtagaaagggctgtaga

SEQ ID NO: 673706 - DNA, 20 bp, mouse
ggactcgcgcgaccgtccag

SEQ ID NO: 673707 - DNA, 20 bp, mouse
gctgtcaaggtgggcggaaa

SEQ ID NO: 673708 - DNA, 20 bp, mouse
ggacgacaggactctgcgaa

SEQ ID NO: 673709 - DNA, 20 bp, mouse
gggctgggcactgtcaaggt

SEQ ID NO: 673710 - DNA, 20 bp, mouse
ggtaaagcgcggcggtcgaa

SEQ ID NO: 673711 - DNA, 20 bp, mouse
gccagaggaggcgggacaag

SEQ ID NO: 673712 - DNA, 20 bp, mouse
gcgcgaccgtccagaggagg

SEQ ID NO: 673713 - DNA, 20 bp, mouse
gactctgcgaacggactaca

SEQ ID NO: 673714 - DNA, 20 bp, mouse
gcggcgaggctcttgacgac

SEQ ID NO: 673715 - DNA, 20 bp, mouse
gtggtctccaattttagctg

SEQ ID NO: 673716 - DNA, 20 bp, mouse
gaggagtggaagctgtccat

SEQ ID NO: 673717 - DNA, 20 bp, mouse
gggcccctgctaatcattgt

SEQ ID NO: 673718 - DNA, 20 bp, mouse
ggtcgctaatcccacagccc

SEQ ID NO: 673719 - DNA, 20 bp, mouse
gcgctccgcaagaaaaagca

SEQ ID NO: 673720 - DNA, 20 bp, mouse
ggaaggaggcgtttagaaga

SEQ ID NO: 673721 - DNA, 20 bp, mouse
gtaagctgccagtcaaaagg

SEQ ID NO: 673722 - DNA, 20 bp, mouse
ggaagtcagtgcaccaagga

SEQ ID NO: 673723 - DNA, 20 bp, mouse
gcaatcagcagggtctttgg

SEQ ID NO: 673724 - DNA, 20 bp, mouse
gttggcctacagacattcca

SEQ ID NO: 673725 - DNA, 20 bp, mouse
gctccccatgactggggctg

SEQ ID NO: 673726 - DNA, 20 bp, mouse
gaggggaaatcgcgtgtttc

SEQ ID NO: 673727 - DNA, 20 bp, mouse
gaatacaggctcagagggga

SEQ ID NO: 673728 - DNA, 20 bp, mouse
ggtatctgagggtagacagg

SEQ ID NO: 673729 - DNA, 20 bp, mouse
gttgtaagcagatacacaca

SEQ ID NO: 673730 - DNA, 20 bp, mouse
gtcagaatgccaagttagtc

SEQ ID NO: 673731 - DNA, 20 bp, mouse
ggccaagttagtctggctga

SEQ ID NO: 673732 - DNA, 20 bp, mouse
gaacttggcattctgaatac

SEQ ID NO: 673733 - DNA, 20 bp, mouse
gaccttcagtgctactagga

SEQ ID NO: 673734 - DNA, 20 bp, mouse
ggcttcccttgctgcttgca

SEQ ID NO: 673735 - DNA, 20 bp, mouse
gtcacctgtacctttgggga

SEQ ID NO: 673736 - DNA, 20 bp, mouse
gaagggatgttccgtcctga

SEQ ID NO: 673737 - DNA, 20 bp, mouse
gtggtgaaagagtagatgcg

SEQ ID NO: 673738 - DNA, 20 bp, mouse
gacaggatactccctcagga

SEQ ID NO: 673739 - DNA, 20 bp, mouse
gcatggataaaggtaccagt

SEQ ID NO: 673740 - DNA, 20 bp, mouse
gtggatgttcagagatacgt

SEQ ID NO: 673741 - DNA, 20 bp, mouse
gcacgcttcatcttaaccct

SEQ ID NO: 673742 - DNA, 20 bp, mouse
gaaaaaaaactcatggataa

SEQ ID NO: 673743 - DNA, 20 bp, mouse
gagaagtgcgttctattgta

SEQ ID NO: 673744 - DNA, 20 bp, mouse
gtctaggactaagcaatctg

SEQ ID NO: 673745 - DNA, 20 bp, mouse
ggtgaactttgtcatttgac

SEQ ID NO: 673746 - DNA, 20 bp, mouse
gtctccagatggcgccagtg

SEQ ID NO: 673747 - DNA, 20 bp, mouse
ggggcctaacaaaatctcat

SEQ ID NO: 673748 - DNA, 20 bp, mouse
gttcccaatgagattttgtt

SEQ ID NO: 673749 - DNA, 20 bp, mouse
ggagccacactggcgccatc

SEQ ID NO: 673750 - DNA, 20 bp, mouse
gcacacgcttggttggctca

SEQ ID NO: 673751 - DNA, 20 bp, mouse
gcattgggaaacgcatttca

SEQ ID NO: 673752 - DNA, 20 bp, mouse
gggaaacgcatttcaaggtc

SEQ ID NO: 673753 - DNA, 20 bp, mouse
gtgaccttactgaggtcaca

SEQ ID NO: 673754 - DNA, 20 bp, mouse
gctgtacatacacacacgct

SEQ ID NO: 673755 - DNA, 20 bp, mouse
gaagtaaaccagaagcaaac

SEQ ID NO: 673756 - DNA, 20 bp, mouse
ggatgtgctcgggactgaga

SEQ ID NO: 673757 - DNA, 20 bp, mouse
gtgctgacaagtgatgtgct

SEQ ID NO: 673758 - DNA, 20 bp, mouse
gaaggagtgaatcacctgtc

SEQ ID NO: 673759 - DNA, 20 bp, mouse
gagcttgtaaagtccttatt

SEQ ID NO: 673760 - DNA, 20 bp, mouse
gagcacatacagtgtataaa

SEQ ID NO: 673761 - DNA, 20 bp, mouse
gtcttaaagaatcagtgtga

SEQ ID NO: 673762 - DNA, 20 bp, mouse
gttactgacaattgtgagga

SEQ ID NO: 673763 - DNA, 20 bp, mouse
gttgtcagtaattatgatat

SEQ ID NO: 673764 - DNA, 20 bp, mouse
gcaggatagagtcagattct

SEQ ID NO: 673765 - DNA, 20 bp, mouse
gttcaaaataactaactaac

SEQ ID NO: 673766 - DNA, 20 bp, mouse
ggggtatggatttggatcca

SEQ ID NO: 673767 - DNA, 20 bp, mouse
gggagctcgagctaccagat

SEQ ID NO: 673768 - DNA, 20 bp, mouse
gtcaacccaaccggccaatc

SEQ ID NO: 673769 - DNA, 20 bp, mouse
gctcgagctaccagattggc

SEQ ID NO: 673770 - DNA, 20 bp, mouse
gaaaggcatttattattata

SEQ ID NO: 673771 - DNA, 20 bp, mouse
ggctaccagattggccggtt

SEQ ID NO: 673772 - DNA, 20 bp, mouse
gttgatcaactcaacccaac

SEQ ID NO: 673773 - DNA, 20 bp, mouse
gacaaatttgcacaggaagg

SEQ ID NO: 673774 - DNA, 20 bp, mouse
gtgattatggggtatggatt

SEQ ID NO: 673775 - DNA, 20 bp, mouse
gggatgctgattatggggta

SEQ ID NO: 673776 - DNA, 20 bp, mouse
ggaagcacatacagtatata

SEQ ID NO: 673777 - DNA, 20 bp, mouse
gggcttgtaaagtccttgtt

SEQ ID NO: 673778 - DNA, 20 bp, mouse
gaaagaaccggtgataagta

SEQ ID NO: 673779 - DNA, 20 bp, mouse
gggggtctcacttgtacttc

SEQ ID NO: 673780 - DNA, 20 bp, mouse
ggattaatgaatcaccagtc

SEQ ID NO: 673781 - DNA, 20 bp, mouse
ggaaagatgctgttattaat

SEQ ID NO: 673782 - DNA, 20 bp, mouse
gcaggacggactcaaattct

SEQ ID NO: 673783 - DNA, 20 bp, mouse
gaatatcccttacttatcac

SEQ ID NO: 673784 - DNA, 20 bp, mouse
gagatgctgttattaattgg

SEQ ID NO: 673785 - DNA, 20 bp, mouse
ggaactatttattttgaaat

SEQ ID NO: 673786 - DNA, 20 bp, mouse
gaaaaactgcggcggggtgg

SEQ ID NO: 673787 - DNA, 20 bp, mouse
gtggaactgaaaaactgcgg

SEQ ID NO: 673788 - DNA, 20 bp, mouse
gtaggtaggcacccaatctc

SEQ ID NO: 673789 - DNA, 20 bp, mouse
gacagaggggaaaaaggggc

SEQ ID NO: 673790 - DNA, 20 bp, mouse
gatctggaactgaaaaactg

SEQ ID NO: 673791 - DNA, 20 bp, mouse
gttgataagctgccagagat

SEQ ID NO: 673792 - DNA, 20 bp, mouse
gctgaaaaactgcggcgggg

SEQ ID NO: 673793 - DNA, 20 bp, mouse
gttgggtgcctacctagatc

SEQ ID NO: 673794 - DNA, 20 bp, mouse
gagacatattttagatttca

SEQ ID NO: 673795 - DNA, 20 bp, mouse
gttcactgcagaagatcact

SEQ ID NO: 673796 - DNA, 20 bp, mouse
gagaaggccctggtctacaa

SEQ ID NO: 673797 - DNA, 20 bp, mouse
ggagtctgtacatctacaga

SEQ ID NO: 673798 - DNA, 20 bp, mouse
gtactgaaacaacctgctgt

SEQ ID NO: 673799 - DNA, 20 bp, mouse
gtgatgaatggtttttagac

SEQ ID NO: 673800 - DNA, 20 bp, mouse
gtaagtgtctgttgactgcg

SEQ ID NO: 673801 - DNA, 20 bp, mouse
gctgatagacaattgtaaag

SEQ ID NO: 673802 - DNA, 20 bp, mouse
gattttagcagaccgacagc

SEQ ID NO: 673803 - DNA, 20 bp, mouse
ggacacttaacagtgatgaa

SEQ ID NO: 673804 - DNA, 20 bp, mouse
gaccagggccttctctaaaa

SEQ ID NO: 673805 - DNA, 20 bp, mouse
ggggttggcagaagcctttc

SEQ ID NO: 673806 - DNA, 20 bp, mouse
gaggcagagaacaaggatgg

SEQ ID NO: 673807 - DNA, 20 bp, mouse
ggtggcggggccagtggcct

SEQ ID NO: 673808 - DNA, 20 bp, mouse
gcaaccccgccccgcggtcg

SEQ ID NO: 673809 - DNA, 20 bp, mouse
gtgctcctggggtgccttgg

SEQ ID NO: 673810 - DNA, 20 bp, mouse
gccctcgcagctgtgagcca

SEQ ID NO: 673811 - DNA, 20 bp, mouse
gctgagtcggggatgcggtg

SEQ ID NO: 673812 - DNA, 20 bp, mouse
gcggggaggaaagacagccc

SEQ ID NO: 673813 - DNA, 20 bp, mouse
gctgcgagggagccggtggc

SEQ ID NO: 673814 - DNA, 20 bp, mouse
gacagctgcgagggagccgg

SEQ ID NO: 673815 - DNA, 20 bp, mouse
gcagcgctgccatggtccaa

SEQ ID NO: 673816 - DNA, 20 bp, mouse
gtctgagaaggtaaatcact

SEQ ID NO: 673817 - DNA, 20 bp, mouse
ggaatctggagcccagcgtg

SEQ ID NO: 673818 - DNA, 20 bp, mouse
gagcgtgaggtgtaagaaca

SEQ ID NO: 673819 - DNA, 20 bp, mouse
gtataaaggagctgcagggt

SEQ ID NO: 673820 - DNA, 20 bp, mouse
gaagcctgctgacggaaggc

SEQ ID NO: 673821 - DNA, 20 bp, mouse
gagggggcctccttatgcca

SEQ ID NO: 673822 - DNA, 20 bp, mouse
gctggaagcctgctgacgga

SEQ ID NO: 673823 - DNA, 20 bp, mouse
gcttcagcgctttaaaacaa

SEQ ID NO: 673824 - DNA, 20 bp, mouse
gctggcagatgggaagacac

SEQ ID NO: 673825 - DNA, 20 bp, mouse
gctccagccatggcataagg

SEQ ID NO: 673826 - DNA, 20 bp, mouse
gcaagcctgccaaaggagaa

SEQ ID NO: 673827 - DNA, 20 bp, mouse
ggtccacagcagtgtagcta

SEQ ID NO: 673828 - DNA, 20 bp, mouse
gtcctgcgagagatgatcac

SEQ ID NO: 673829 - DNA, 20 bp, mouse
gtccctcaacaaaatgggaa

SEQ ID NO: 673830 - DNA, 20 bp, mouse
gagccatagctacactgctg

SEQ ID NO: 673831 - DNA, 20 bp, mouse
gctgccaaaggagaaaggct

SEQ ID NO: 673832 - DNA, 20 bp, mouse
ggagaaagtcagcatttcaa

SEQ ID NO: 673833 - DNA, 20 bp, mouse
ggccagattgggcctaacat

SEQ ID NO: 673834 - DNA, 20 bp, mouse
gtctcctggatgtgcagtga

SEQ ID NO: 673835 - DNA, 20 bp, mouse
gggaggcatagccaggaaag

SEQ ID NO: 673836 - DNA, 20 bp, mouse
gggacactgtggcctgaaca

SEQ ID NO: 673837 - DNA, 20 bp, mouse
gtgtggggatcagccctctg

SEQ ID NO: 673838 - DNA, 20 bp, mouse
ggctgagagcaccggtttca

SEQ ID NO: 673839 - DNA, 20 bp, mouse
ggtcaaggaccctcttagaa

SEQ ID NO: 673840 - DNA, 20 bp, mouse
gctaagagggtccttgacct

SEQ ID NO: 673841 - DNA, 20 bp, mouse
gggaactctctgggccacag

SEQ ID NO: 673842 - DNA, 20 bp, mouse
gcagagccatcccagggctt

SEQ ID NO: 673843 - DNA, 20 bp, mouse
ggagaagtttcccctgaaac

SEQ ID NO: 673844 - DNA, 20 bp, mouse
gaaatgcccaaactctgctg

SEQ ID NO: 673845 - DNA, 20 bp, mouse
gtgagctaaagctgcctata

SEQ ID NO: 673846 - DNA, 20 bp, mouse
gggaatccacacaatggtga

SEQ ID NO: 673847 - DNA, 20 bp, mouse
gttaaagcatgagctgagga

SEQ ID NO: 673848 - DNA, 20 bp, mouse
gtgaggagggctgggagtaa

SEQ ID NO: 673849 - DNA, 20 bp, mouse
gtggcagctgagaaaaaagt

SEQ ID NO: 673850 - DNA, 20 bp, mouse
gctgcagagtgttttacaac

SEQ ID NO: 673851 - DNA, 20 bp, mouse
gcaacataagcaaactctta

SEQ ID NO: 673852 - DNA, 20 bp, mouse
gtgtccagtagcaaagtgag

SEQ ID NO: 673853 - DNA, 20 bp, mouse
ggcaggtagttatgaatcta

SEQ ID NO: 673854 - DNA, 20 bp, mouse
gcagctctggatagtagcag

SEQ ID NO: 673855 - DNA, 20 bp, mouse
ggttatgaatctatggcagg

SEQ ID NO: 673856 - DNA, 20 bp, mouse
gaaaggaggcctgattgcgg

SEQ ID NO: 673857 - DNA, 20 bp, mouse
gggcacatgctgggtaaagg

SEQ ID NO: 673858 - DNA, 20 bp, mouse
gagagaagtcaaactcccta

SEQ ID NO: 673859 - DNA, 20 bp, mouse
gtgattgcggagggtgcctc

SEQ ID NO: 673860 - DNA, 20 bp, mouse
gggtaaaggaggcctgattg

SEQ ID NO: 673861 - DNA, 20 bp, mouse
ggtcagaatctcaactccgt

SEQ ID NO: 673862 - DNA, 20 bp, mouse
ggagactcaggaagacccac

SEQ ID NO: 673863 - DNA, 20 bp, mouse
gcactcccctggcctgcaaa

SEQ ID NO: 673864 - DNA, 20 bp, mouse
gtcagcttgcagcactcccc

SEQ ID NO: 673865 - DNA, 20 bp, mouse
gcgtgacagggacttgagtg

SEQ ID NO: 673866 - DNA, 20 bp, mouse
gccactcagcgaggtatgca

SEQ ID NO: 673867 - DNA, 20 bp, mouse
gccctcaaacccactcagcg

SEQ ID NO: 673868 - DNA, 20 bp, mouse
gccacagcacggaatcactc

SEQ ID NO: 673869 - DNA, 20 bp, mouse
gctgaagtgcgtggcagtga

SEQ ID NO: 673870 - DNA, 20 bp, mouse
gaacgcaggaatagagtata

SEQ ID NO: 673871 - DNA, 20 bp, mouse
gcttattttcttgtattaag

SEQ ID NO: 673872 - DNA, 20 bp, mouse
gagtgtttgcccattttgtc

SEQ ID NO: 673873 - DNA, 20 bp, mouse
ggggaagaaaagaaatagga

SEQ ID NO: 673874 - DNA, 20 bp, mouse
ggaatcactcaggtcacaca

SEQ ID NO: 673875 - DNA, 20 bp, mouse
gataggaaggagaagaaaag

SEQ ID NO: 673876 - DNA, 20 bp, mouse
ggaggaggttgactgagttc

SEQ ID NO: 673877 - DNA, 20 bp, mouse
gaatgggatggggtttcagt

SEQ ID NO: 673878 - DNA, 20 bp, mouse
ggtgaagaaacttctgtatt

SEQ ID NO: 673879 - DNA, 20 bp, mouse
gggtttcagtaggtgaaact

SEQ ID NO: 673880 - DNA, 20 bp, mouse
gggccttgtcagacaccgat

SEQ ID NO: 673881 - DNA, 20 bp, mouse
gatagccaatgctgtgcaaa

SEQ ID NO: 673882 - DNA, 20 bp, mouse
gtttagctcagagcatgagg

SEQ ID NO: 673883 - DNA, 20 bp, mouse
gtaatcttgtcagaggtttc

SEQ ID NO: 673884 - DNA, 20 bp, mouse
gtctaatgatttaaggatgt

SEQ ID NO: 673885 - DNA, 20 bp, mouse
ggctcggagtgtatatgctt

SEQ ID NO: 673886 - DNA, 20 bp, mouse
gacttgttgagttcctaatg

SEQ ID NO: 673887 - DNA, 20 bp, mouse
ggataaatttcttttgaagt

SEQ ID NO: 673888 - DNA, 20 bp, mouse
gtgggggagatttccacatt

SEQ ID NO: 673889 - DNA, 20 bp, mouse
gtgagagatgataaagcagt

SEQ ID NO: 673890 - DNA, 20 bp, mouse
ggtatattgaacggggttct

SEQ ID NO: 673891 - DNA, 20 bp, mouse
gtgaagaacaacaattagcc

SEQ ID NO: 673892 - DNA, 20 bp, mouse
gtgcagatacatgactgtaa

SEQ ID NO: 673893 - DNA, 20 bp, mouse
gttaattcgtatattgaacg

SEQ ID NO: 673894 - DNA, 20 bp, mouse
gagttttcaggaacaatgtc

SEQ ID NO: 673895 - DNA, 20 bp, mouse
gatcatctctcagcatatct

SEQ ID NO: 673896 - DNA, 20 bp, mouse
gttctcaggtaagtgaaagt

SEQ ID NO: 673897 - DNA, 20 bp, mouse
gggtagtttgaggtaaaatg

SEQ ID NO: 673898 - DNA, 20 bp, mouse
gctaactctagtgacctccc

SEQ ID NO: 673899 - DNA, 20 bp, mouse
gagtaggcttgttacggcaa

SEQ ID NO: 673900 - DNA, 20 bp, mouse
gctgtgttctagtacattag

SEQ ID NO: 673901 - DNA, 20 bp, mouse
gcacttctggaagtttttac

SEQ ID NO: 673902 - DNA, 20 bp, mouse
gggaagtttttactggcttt

SEQ ID NO: 673903 - DNA, 20 bp, mouse
gagtgaaagtaggcttgtta

SEQ ID NO: 673904 - DNA, 20 bp, mouse
gttagctaagttcgtaagtg

SEQ ID NO: 673905 - DNA, 20 bp, mouse
gaatgttgaaatctaatcag

SEQ ID NO: 673906 - DNA, 20 bp, mouse
gtcactccagaccacaaaag

SEQ ID NO: 673907 - DNA, 20 bp, mouse
gaattcagaatgtggtactg

SEQ ID NO: 673908 - DNA, 20 bp, mouse
ggtgggcagagataatttag

SEQ ID NO: 673909 - DNA, 20 bp, mouse
gctgaggcacatagtgccaa

SEQ ID NO: 673910 - DNA, 20 bp, mouse
gtgactcacaaaggcatgtg

SEQ ID NO: 673911 - DNA, 20 bp, mouse
gatagtgccaaaggaaaatc

SEQ ID NO: 673912 - DNA, 20 bp, mouse
gacaacaagaattcagaatg

SEQ ID NO: 673913 - DNA, 20 bp, mouse
gtctggagtgagaattggcg

SEQ ID NO: 673914 - DNA, 20 bp, mouse
gtggatagcatcttggtaaa

SEQ ID NO: 673915 - DNA, 20 bp, mouse
gacatttgttcacagacagg

SEQ ID NO: 673916 - DNA, 20 bp, mouse
gcacccaacccccttcagca

SEQ ID NO: 673917 - DNA, 20 bp, mouse
ggaggctggcatggagccag

SEQ ID NO: 673918 - DNA, 20 bp, mouse
gcctcctcttggagttacag

SEQ ID NO: 673919 - DNA, 20 bp, mouse
ggaggggccagtggtaacat

SEQ ID NO: 673920 - DNA, 20 bp, mouse
gcaggggaaacattcttgag

SEQ ID NO: 673921 - DNA, 20 bp, mouse
gagaccctgctgaagggggt

SEQ ID NO: 673922 - DNA, 20 bp, mouse
gtggcctctgtaactccaag

SEQ ID NO: 673923 - DNA, 20 bp, mouse
gttgcagaccctgctgaagg

SEQ ID NO: 673924 - DNA, 20 bp, mouse
gcctcaggagaacatagatc

SEQ ID NO: 673925 - DNA, 20 bp, mouse
gcagagggggaaagggctgt

SEQ ID NO: 673926 - DNA, 20 bp, mouse
ggcaaggctaggactgtgag

SEQ ID NO: 673927 - DNA, 20 bp, mouse
gtcagtcgcagtgctgggca

SEQ ID NO: 673928 - DNA, 20 bp, mouse
gtacaatgatcaagccacag

SEQ ID NO: 673929 - DNA, 20 bp, mouse
gactgcgactgaccattagc

SEQ ID NO: 673930 - DNA, 20 bp, mouse
gggcctcaatacttttgtgt

SEQ ID NO: 673931 - DNA, 20 bp, mouse
gaatggtcagtcgcagtgct

SEQ ID NO: 673932 - DNA, 20 bp, mouse
gtgcatgggtgctgtgttcc

SEQ ID NO: 673933 - DNA, 20 bp, mouse
gacagcacccatgcacagat

SEQ ID NO: 673934 - DNA, 20 bp, mouse
gcatcttttggtgtctatgg

SEQ ID NO: 673935 - DNA, 20 bp, mouse
gtcaggtgaatgtacattag

SEQ ID NO: 673936 - DNA, 20 bp, mouse
gtgagccagagataggacga

SEQ ID NO: 673937 - DNA, 20 bp, mouse
gccacccctcgtcctatctc

SEQ ID NO: 673938 - DNA, 20 bp, mouse
gtgcctggaacagctcactg

SEQ ID NO: 673939 - DNA, 20 bp, mouse
ggaaacaagggaatgtctgg

SEQ ID NO: 673940 - DNA, 20 bp, mouse
ggaggaatggacccagctga

SEQ ID NO: 673941 - DNA, 20 bp, mouse
gcttgctttagccaagtcct

SEQ ID NO: 673942 - DNA, 20 bp, mouse
gggaatttgacggatggtgt

SEQ ID NO: 673943 - DNA, 20 bp, mouse
gaagaccgggacttatgtat

SEQ ID NO: 673944 - DNA, 20 bp, mouse
gctcactgcggatgttctca

SEQ ID NO: 673945 - DNA, 20 bp, mouse
gtatagttgaggttaagacc

SEQ ID NO: 673946 - DNA, 20 bp, mouse
gtcggagatacttccacatt

SEQ ID NO: 673947 - DNA, 20 bp, mouse
ggtgacatacaagggtgttg

SEQ ID NO: 673948 - DNA, 20 bp, mouse
ggtggtattgtgacatacaa

SEQ ID NO: 673949 - DNA, 20 bp, mouse
gggattattcagttgatatg

SEQ ID NO: 673950 - DNA, 20 bp, mouse
gtcccatgtctttaaatcag

SEQ ID NO: 673951 - DNA, 20 bp, mouse
gttctttacaatacattatg

SEQ ID NO: 673952 - DNA, 20 bp, mouse
gacttctagatatccaaccc

SEQ ID NO: 673953 - DNA, 20 bp, mouse
gatggttagctgcttgtcct

SEQ ID NO: 673954 - DNA, 20 bp, mouse
gtgtgagtattagtcagaag

SEQ ID NO: 673955 - DNA, 20 bp, mouse
gttttggaatggaatcaagc

SEQ ID NO: 673956 - DNA, 20 bp, mouse
ggagcaggcggggcaaaaag

SEQ ID NO: 673957 - DNA, 20 bp, mouse
gagcacttagcattcatgag

SEQ ID NO: 673958 - DNA, 20 bp, mouse
ggaaccaccacacatatccc

SEQ ID NO: 673959 - DNA, 20 bp, mouse
gaaggaggaaggttcctttc

SEQ ID NO: 673960 - DNA, 20 bp, mouse
ggaaactttctggagggatt

SEQ ID NO: 673961 - DNA, 20 bp, mouse
gaagtctgtgctgaggcatg

SEQ ID NO: 673962 - DNA, 20 bp, mouse
gttgcttgtagcatgggatt

SEQ ID NO: 673963 - DNA, 20 bp, mouse
gaaagaaagttaacagatga

SEQ ID NO: 673964 - DNA, 20 bp, mouse
gcctttcaggggaaactttc

SEQ ID NO: 673965 - DNA, 20 bp, mouse
gggacaagcaaatggaggac

SEQ ID NO: 673966 - DNA, 20 bp, mouse
gtccagcatctgatactatg

SEQ ID NO: 673967 - DNA, 20 bp, mouse
gttcggttgtagttaggagt

SEQ ID NO: 673968 - DNA, 20 bp, mouse
gatgcagcgaataaagataa

SEQ ID NO: 673969 - DNA, 20 bp, mouse
gagtaggttggtacaagaaa

SEQ ID NO: 673970 - DNA, 20 bp, mouse
gttggagccatgatgggaaa

SEQ ID NO: 673971 - DNA, 20 bp, mouse
gcttcaaaagttccactttc

SEQ ID NO: 673972 - DNA, 20 bp, mouse
gaaaatgcaacagggattaa

SEQ ID NO: 673973 - DNA, 20 bp, mouse
gacagtggtaaaatgcaaca

SEQ ID NO: 673974 - DNA, 20 bp, mouse
gttgggagaactagtatctc

SEQ ID NO: 673975 - DNA, 20 bp, mouse
ggttgtagttaggagtaggt

SEQ ID NO: 673976 - DNA, 20 bp, mouse
gacccagcggccgcgcgcct

SEQ ID NO: 673977 - DNA, 20 bp, mouse
gaccttaattggttcccgga

SEQ ID NO: 673978 - DNA, 20 bp, mouse
gcggccgcgcgggaggatgc

SEQ ID NO: 673979 - DNA, 20 bp, mouse
gtccagagagggactgacgt

SEQ ID NO: 673980 - DNA, 20 bp, mouse
ggccgctgggtcccgagcgg

SEQ ID NO: 673981 - DNA, 20 bp, mouse
gtccaacgtcagtccctctc

SEQ ID NO: 673982 - DNA, 20 bp, mouse
gggaaggaccgcatcccccc

SEQ ID NO: 673983 - DNA, 20 bp, mouse
gcatctattcatcatccatc

SEQ ID NO: 673984 - DNA, 20 bp, mouse
gtcgcaccttaattggttcc

SEQ ID NO: 673985 - DNA, 20 bp, mouse
gaccgccgctcgggacccag

SEQ ID NO: 673986 - DNA, 20 bp, mouse
gtcgctctcacgggtgtcgt

SEQ ID NO: 673987 - DNA, 20 bp, mouse
gagcatacactcacccacga

SEQ ID NO: 673988 - DNA, 20 bp, mouse
gcagcgcgcaggcacgtgtg

SEQ ID NO: 673989 - DNA, 20 bp, mouse
ggcgctacgcgtcgctctca

SEQ ID NO: 673990 - DNA, 20 bp, mouse
gcacgtgtgtggccgcctaa

SEQ ID NO: 673991 - DNA, 20 bp, mouse
gatacactcacccacgatgg

SEQ ID NO: 673992 - DNA, 20 bp, mouse
gtgtgtggccgcctaagggg

SEQ ID NO: 673993 - DNA, 20 bp, mouse
gaacccgccctcaaacacta

SEQ ID NO: 673994 - DNA, 20 bp, mouse
ggcctaaggggcgggtcctt

SEQ ID NO: 673995 - DNA, 20 bp, mouse
ggccgaaggacccgcccctt

SEQ ID NO: 673996 - DNA, 20 bp, mouse
ggctccctgagctaaacagg

SEQ ID NO: 673997 - DNA, 20 bp, mouse
gtaaacaggagggaccgagg

SEQ ID NO: 673998 - DNA, 20 bp, mouse
ggaggggacacggggatcgt

SEQ ID NO: 673999 - DNA, 20 bp, mouse
ggacacggggatcgtgggag

SEQ ID NO: 674000 - DNA, 20 bp, mouse
gtccaacacggcttccccac

SEQ ID NO: 674001 - DNA, 20 bp, mouse
gtgttagaagggaagtccgg

SEQ ID NO: 674002 - DNA, 20 bp, mouse
gccagggataaggtgttaga

SEQ ID NO: 674003 - DNA, 20 bp, mouse
gaaagggtctgatcggactt

SEQ ID NO: 674004 - DNA, 20 bp, mouse
gggaccgaggtggagcagct

SEQ ID NO: 674005 - DNA, 20 bp, mouse
ggggatcgtgggagtgggtc

SEQ ID NO: 674006 - DNA, 20 bp, mouse
gtgaactgatcgctggaatg

SEQ ID NO: 674007 - DNA, 20 bp, mouse
gacaggaggcctgagtctca

SEQ ID NO: 674008 - DNA, 20 bp, mouse
gccgccccaaggagccacct

SEQ ID NO: 674009 - DNA, 20 bp, mouse
gtggctctggaggcaggcta

SEQ ID NO: 674010 - DNA, 20 bp, mouse
gaggtgtgagtatgggaagt

SEQ ID NO: 674011 - DNA, 20 bp, mouse
gagtgtggtgaacgcacact

SEQ ID NO: 674012 - DNA, 20 bp, mouse
gctgctgccgccggatgcct

SEQ ID NO: 674013 - DNA, 20 bp, mouse
gggacactctggtcttatac

SEQ ID NO: 674014 - DNA, 20 bp, mouse
gcagggccaggtgtgagtat

SEQ ID NO: 674015 - DNA, 20 bp, mouse
gtgggagccgaggcatccgg

SEQ ID NO: 674016 - DNA, 20 bp, mouse
gctccctagtggtcggtccg

SEQ ID NO: 674017 - DNA, 20 bp, mouse
ggaccactagggagcctgga

SEQ ID NO: 674018 - DNA, 20 bp, mouse
gcgccctccaggctccctag

SEQ ID NO: 674019 - DNA, 20 bp, mouse
ggccgccccgggaaccggag

SEQ ID NO: 674020 - DNA, 20 bp, mouse
ggggcggagccctatgggcg

SEQ ID NO: 674021 - DNA, 20 bp, mouse
gaggccgccgccccgggaac

SEQ ID NO: 674022 - DNA, 20 bp, mouse
gtccccgcccaccccctgag

SEQ ID NO: 674023 - DNA, 20 bp, mouse
gtaggctgggcagcgcggat

SEQ ID NO: 674024 - DNA, 20 bp, mouse
gccgaagccacgcccctcag

SEQ ID NO: 674025 - DNA, 20 bp, mouse
gaatgggcgggccacagctg

SEQ ID NO: 674026 - DNA, 20 bp, mouse
gtcgttgggcccagtcacat

SEQ ID NO: 674027 - DNA, 20 bp, mouse
gtctgagctcgtacactgag

SEQ ID NO: 674028 - DNA, 20 bp, mouse
gggcggggtcagtccgggcg

SEQ ID NO: 674029 - DNA, 20 bp, mouse
gccgcggggcggggtcagtc

SEQ ID NO: 674030 - DNA, 20 bp, mouse
gtgggaactcagcattcgtt

SEQ ID NO: 674031 - DNA, 20 bp, mouse
ggaggggtctcctatgtgac

SEQ ID NO: 674032 - DNA, 20 bp, mouse
gaatgttctgaaggtcatga

SEQ ID NO: 674033 - DNA, 20 bp, mouse
ggtgcgcccaaaatagacca

SEQ ID NO: 674034 - DNA, 20 bp, mouse
gtggagggagggggacaccc

SEQ ID NO: 674035 - DNA, 20 bp, mouse
gttgggcgcacccgcggcag

SEQ ID NO: 674036 - DNA, 20 bp, mouse
ggccacccaaagtggctagg

SEQ ID NO: 674037 - DNA, 20 bp, mouse
gtggttccctgcggtctcaa

SEQ ID NO: 674038 - DNA, 20 bp, mouse
gagccagttctcccctctta

SEQ ID NO: 674039 - DNA, 20 bp, mouse
ggttccagaaaacgctaaag

SEQ ID NO: 674040 - DNA, 20 bp, mouse
gttacctcacttcaccatga

SEQ ID NO: 674041 - DNA, 20 bp, mouse
gccctcttagggcttgggcg

SEQ ID NO: 674042 - DNA, 20 bp, mouse
gtgcttgttgaggtggtggg

SEQ ID NO: 674043 - DNA, 20 bp, mouse
gagttccaggaacctaaaga

SEQ ID NO: 674044 - DNA, 20 bp, mouse
gaggcgactctgatgctgag

SEQ ID NO: 674045 - DNA, 20 bp, mouse
gtatgtgaccgtgatttaaa

SEQ ID NO: 674046 - DNA, 20 bp, mouse
ggcgcccccggagcgtgaga

SEQ ID NO: 674047 - DNA, 20 bp, mouse
gcacgcggaggctgtgtcag

SEQ ID NO: 674048 - DNA, 20 bp, mouse
ggagagggctgagatcgctg

SEQ ID NO: 674049 - DNA, 20 bp, mouse
ggcgctgcgtggggcggaag

SEQ ID NO: 674050 - DNA, 20 bp, mouse
gcagccctctcacgctccgg

SEQ ID NO: 674051 - DNA, 20 bp, mouse
ggcaccggcgctgcgtgggg

SEQ ID NO: 674052 - DNA, 20 bp, mouse
gggctgagatcgctgcggtt

SEQ ID NO: 674053 - DNA, 20 bp, mouse
gtgtgatggcaatcacgcgg

SEQ ID NO: 674054 - DNA, 20 bp, mouse
gcgtctcgacgtgtcactgg

SEQ ID NO: 674055 - DNA, 20 bp, mouse
gagtccgcgccctgcgcccc

SEQ ID NO: 674056 - DNA, 20 bp, mouse
ggggcggcaggggagctcgc

SEQ ID NO: 674057 - DNA, 20 bp, mouse
gaggggctcgcaaggggagc

SEQ ID NO: 674058 - DNA, 20 bp, mouse
gataaggagcaagatgccgg

SEQ ID NO: 674059 - DNA, 20 bp, mouse
ggcagacaaaggggcggcag

SEQ ID NO: 674060 - DNA, 20 bp, mouse
gcggcaggggagctcgcggg

SEQ ID NO: 674061 - DNA, 20 bp, mouse
gccgaagggcctgcagacgc

SEQ ID NO: 674062 - DNA, 20 bp, mouse
gtgccgggggacggaccgaa

SEQ ID NO: 674063 - DNA, 20 bp, mouse
ggagcaggcagacaaagggg

SEQ ID NO: 674064 - DNA, 20 bp, mouse
gggcccttcggtccgtcccc

SEQ ID NO: 674065 - DNA, 20 bp, mouse
ggcggcagcggcccgggcac

SEQ ID NO: 674066 - DNA, 20 bp, mouse
gagatccgagccaaacgggg

SEQ ID NO: 674067 - DNA, 20 bp, mouse
ggggctcggctcaccttggc

SEQ ID NO: 674068 - DNA, 20 bp, mouse
ggggcgggcagagaagtctt

SEQ ID NO: 674069 - DNA, 20 bp, mouse
ggggaagatccgagccaaac

SEQ ID NO: 674070 - DNA, 20 bp, mouse
ggccagagagcgaacaaaag

SEQ ID NO: 674071 - DNA, 20 bp, mouse
gaaggcggggcccggagcgc

SEQ ID NO: 674072 - DNA, 20 bp, mouse
gcaaagactggggagcgggc

SEQ ID NO: 674073 - DNA, 20 bp, mouse
ggcccggtggagccctgcca

SEQ ID NO: 674074 - DNA, 20 bp, mouse
gtccgagccaaacggggcgg

SEQ ID NO: 674075 - DNA, 20 bp, mouse
gacccggagaccaggattgt

SEQ ID NO: 674076 - DNA, 20 bp, mouse
gacgctggaggccacgggaa

SEQ ID NO: 674077 - DNA, 20 bp, mouse
ggcgcagtgacaagacgcgg

SEQ ID NO: 674078 - DNA, 20 bp, mouse
gagagcgctgaggcagacgc

SEQ ID NO: 674079 - DNA, 20 bp, mouse
gagacactcgggatctccag

SEQ ID NO: 674080 - DNA, 20 bp, mouse
gatcggggtgtcagtgtcgg

SEQ ID NO: 674081 - DNA, 20 bp, mouse
gcatgcgcagtgacaagacg

SEQ ID NO: 674082 - DNA, 20 bp, mouse
gtgggagatagtcccctgga

SEQ ID NO: 674083 - DNA, 20 bp, mouse
gggacgagatgggggacgag

SEQ ID NO: 674084 - DNA, 20 bp, mouse
gagtgtctagccccttcccg

SEQ ID NO: 674085 - DNA, 20 bp, mouse
gacgcgggggaggagaagct

SEQ ID NO: 674086 - DNA, 20 bp, mouse
gggaggcctgagtggaaatc

SEQ ID NO: 674087 - DNA, 20 bp, mouse
gaaagggccaggcactaatt

SEQ ID NO: 674088 - DNA, 20 bp, mouse
gtggcttggggcactcaaag

SEQ ID NO: 674089 - DNA, 20 bp, mouse
gaagccagccaggtcaccac

SEQ ID NO: 674090 - DNA, 20 bp, mouse
gagggcttgtagagcttact

SEQ ID NO: 674091 - DNA, 20 bp, mouse
gtcagggtgattgatctctt

SEQ ID NO: 674092 - DNA, 20 bp, mouse
gtcagaaaagttgctgtgga

SEQ ID NO: 674093 - DNA, 20 bp, mouse
gagcccttcatttcacaaca

SEQ ID NO: 674094 - DNA, 20 bp, mouse
gctccgtggaattccctaca

SEQ ID NO: 674095 - DNA, 20 bp, mouse
ggcatgtcattgttaggcat

SEQ ID NO: 674096 - DNA, 20 bp, mouse
gtgtgtgtggtgtcctccga

SEQ ID NO: 674097 - DNA, 20 bp, mouse
gcatgaagacaagagtctgc

SEQ ID NO: 674098 - DNA, 20 bp, mouse
ggcacagtggagaactgggt

SEQ ID NO: 674099 - DNA, 20 bp, mouse
gtccaccatcccacacccct

SEQ ID NO: 674100 - DNA, 20 bp, mouse
gggtgggttaggcaagaatt

SEQ ID NO: 674101 - DNA, 20 bp, mouse
gtctgcagggaaagagaacc

SEQ ID NO: 674102 - DNA, 20 bp, mouse
gatgcttatccctccctcgg

SEQ ID NO: 674103 - DNA, 20 bp, mouse
gcagatgcttatccctccct

SEQ ID NO: 674104 - DNA, 20 bp, mouse
gacagggccaactaaaactc

SEQ ID NO: 674105 - DNA, 20 bp, mouse
gttgtcttcatgcactcttg

SEQ ID NO: 674106 - DNA, 20 bp, mouse
gccgctgcccaaatgggcga

SEQ ID NO: 674107 - DNA, 20 bp, mouse
gtgcccaaatgggcgaggga

SEQ ID NO: 674108 - DNA, 20 bp, mouse
gcgcgggcccgctgcccaaa

SEQ ID NO: 674109 - DNA, 20 bp, mouse
gaaaaactggtgacgtagat

SEQ ID NO: 674110 - DNA, 20 bp, mouse
gtacaccaacaaagtatctc

SEQ ID NO: 674111 - DNA, 20 bp, mouse
gagatgggcggggcctatac

SEQ ID NO: 674112 - DNA, 20 bp, mouse
ggcgcctgcgcactcaggac

SEQ ID NO: 674113 - DNA, 20 bp, mouse
gaactggtgacgtagatggg

SEQ ID NO: 674114 - DNA, 20 bp, mouse
ggaggatacttagacactac

SEQ ID NO: 674115 - DNA, 20 bp, mouse
ggcgcactcaggaccggtat

SEQ ID NO: 674116 - DNA, 20 bp, mouse
gagcaagaggaaggtgtcat

SEQ ID NO: 674117 - DNA, 20 bp, mouse
gtgggtgcgcctcttggttc

SEQ ID NO: 674118 - DNA, 20 bp, mouse
gtcacttcccagcctctgat

SEQ ID NO: 674119 - DNA, 20 bp, mouse
gcgaagggcccggtgtcggg

SEQ ID NO: 674120 - DNA, 20 bp, mouse
gcgtgcgtgctcgctcacgg

SEQ ID NO: 674121 - DNA, 20 bp, mouse
ggggctccgccccccgacac

SEQ ID NO: 674122 - DNA, 20 bp, mouse
gagaggctgggaagtgacgc

SEQ ID NO: 674123 - DNA, 20 bp, mouse
gccttccagagttagagaag

SEQ ID NO: 674124 - DNA, 20 bp, mouse
gcctcgagacccgaaccaag

SEQ ID NO: 674125 - DNA, 20 bp, mouse
gcgcaggggaagcggctcac

SEQ ID NO: 674126 - DNA, 20 bp, mouse
gtgggcgcgcatcccgtacg

SEQ ID NO: 674127 - DNA, 20 bp, mouse
gcgtcgcgcagccaagcggg

SEQ ID NO: 674128 - DNA, 20 bp, mouse
gggcgtggggcaattaggcg

SEQ ID NO: 674129 - DNA, 20 bp, mouse
gcgcgcatcccgtacgggga

SEQ ID NO: 674130 - DNA, 20 bp, mouse
gcagcctcgcggacctcgcg

SEQ ID NO: 674131 - DNA, 20 bp, mouse
gcggggacgctgtcaaagcg

SEQ ID NO: 674132 - DNA, 20 bp, mouse
ggcgcgtcgcgcagccaagc

SEQ ID NO: 674133 - DNA, 20 bp, mouse
gctgcggcggccggccaggg

SEQ ID NO: 674134 - DNA, 20 bp, mouse
gctaaagctatgccccgccc

SEQ ID NO: 674135 - DNA, 20 bp, mouse
ggcgcgcccaccaggtgctg

SEQ ID NO: 674136 - DNA, 20 bp, mouse
gtggaggcgcgggtaggacg

SEQ ID NO: 674137 - DNA, 20 bp, mouse
ggatcgtgcaaggggacgag

SEQ ID NO: 674138 - DNA, 20 bp, mouse
gcagcgctggaggcgcgggt

SEQ ID NO: 674139 - DNA, 20 bp, mouse
gacgaggggtctgtgacgtc

SEQ ID NO: 674140 - DNA, 20 bp, mouse
ggaagcccgccttaagtctg

SEQ ID NO: 674141 - DNA, 20 bp, mouse
gcccgcccacagatcgtgca

SEQ ID NO: 674142 - DNA, 20 bp, mouse
gctgcgcagcgctggaggcg

SEQ ID NO: 674143 - DNA, 20 bp, mouse
gcgcgccgcagacttaaggc

SEQ ID NO: 674144 - DNA, 20 bp, mouse
gtctgtgacgtcagggacgg

SEQ ID NO: 674145 - DNA, 20 bp, mouse
gttgaggggcgactggtaga

SEQ ID NO: 674146 - DNA, 20 bp, mouse
gcaacacccaccctgcgggt

SEQ ID NO: 674147 - DNA, 20 bp, mouse
gcgcgctcactgcccggcgg

SEQ ID NO: 674148 - DNA, 20 bp, mouse
gtcaagacatcacaatctat

SEQ ID NO: 674149 - DNA, 20 bp, mouse
gcgactagaagggacaggat

SEQ ID NO: 674150 - DNA, 20 bp, mouse
gctagcgcggggctggtggg

SEQ ID NO: 674151 - DNA, 20 bp, mouse
gaccatggaaagtgagtgat

SEQ ID NO: 674152 - DNA, 20 bp, mouse
ggggctggtgggcgggcgaa

SEQ ID NO: 674153 - DNA, 20 bp, mouse
gacaatgatgaggcacaggg

SEQ ID NO: 674154 - DNA, 20 bp, mouse
gggcctggtgacgcaagcca

SEQ ID NO: 674155 - DNA, 20 bp, mouse
gagaggtgggcggctagcgc

SEQ ID NO: 674156 - DNA, 20 bp, mouse
ggcggcccggggtgatcgag

SEQ ID NO: 674157 - DNA, 20 bp, mouse
gagggcgggagcgaagagaa

SEQ ID NO: 674158 - DNA, 20 bp, mouse
gcgaagagaagggagggcga

SEQ ID NO: 674159 - DNA, 20 bp, mouse
ggggccgcggccctccctcc

SEQ ID NO: 674160 - DNA, 20 bp, mouse
gcgcccccctcgatcacccc

SEQ ID NO: 674161 - DNA, 20 bp, mouse
ggcggccctccctcccgggt

SEQ ID NO: 674162 - DNA, 20 bp, mouse
gctaaccccaaacgcagaga

SEQ ID NO: 674163 - DNA, 20 bp, mouse
ggccctccctcccgggtggg

SEQ ID NO: 674164 - DNA, 20 bp, mouse
gcgctcggtgccaactgatg

SEQ ID NO: 674165 - DNA, 20 bp, mouse
ggagagaatccgcagcactt

SEQ ID NO: 674166 - DNA, 20 bp, mouse
ggggcggggtcaggcgggtg

SEQ ID NO: 674167 - DNA, 20 bp, mouse
gggagagttcgagagaacgc

SEQ ID NO: 674168 - DNA, 20 bp, mouse
gtaccccacccaacgtccca

SEQ ID NO: 674169 - DNA, 20 bp, mouse
gcacgtgatggaaggctcac

SEQ ID NO: 674170 - DNA, 20 bp, mouse
gtccgcgccatgactagtac

SEQ ID NO: 674171 - DNA, 20 bp, mouse
gaatctgccagtactagtca

SEQ ID NO: 674172 - DNA, 20 bp, mouse
gtgtccttgggacgttgggt

SEQ ID NO: 674173 - DNA, 20 bp, mouse
gtctagagcgccgcttttca

SEQ ID NO: 674174 - DNA, 20 bp, mouse
gtagtactggcagatttggt

SEQ ID NO: 674175 - DNA, 20 bp, mouse
gcaaggtagacgagcaggtt

SEQ ID NO: 674176 - DNA, 20 bp, mouse
gcgcacgcgcgctggaacag

SEQ ID NO: 674177 - DNA, 20 bp, mouse
gctaaaaagccctgtcctcc

SEQ ID NO: 674178 - DNA, 20 bp, mouse
gaagccctgtcctcccggaa

SEQ ID NO: 674179 - DNA, 20 bp, mouse
ggaacagaggcgccccgccc

SEQ ID NO: 674180 - DNA, 20 bp, mouse
gcctcccggaagggtgagac

SEQ ID NO: 674181 - DNA, 20 bp, mouse
gtcacccttccgggaggaca

SEQ ID NO: 674182 - DNA, 20 bp, mouse
gcccgccccggccgggacag

SEQ ID NO: 674183 - DNA, 20 bp, mouse
ggcctcccctgtcccggccg

SEQ ID NO: 674184 - DNA, 20 bp, mouse
gctggtgatggctgcgggga

SEQ ID NO: 674185 - DNA, 20 bp, mouse
gggcttggccgtgtgacctc

SEQ ID NO: 674186 - DNA, 20 bp, mouse
ggcttggggcaagaccggag

SEQ ID NO: 674187 - DNA, 20 bp, mouse
gtcggcgcccaacgcgggga

SEQ ID NO: 674188 - DNA, 20 bp, mouse
gtggggcaagaccggagagg

SEQ ID NO: 674189 - DNA, 20 bp, mouse
gaatgagagagcggaggtgg

SEQ ID NO: 674190 - DNA, 20 bp, mouse
ggaaagagcagggggagaac

SEQ ID NO: 674191 - DNA, 20 bp, mouse
gaagcgagcgcggggcccca

SEQ ID NO: 674192 - DNA, 20 bp, mouse
gagcctcggcgcccaacgcg

SEQ ID NO: 674193 - DNA, 20 bp, mouse
ggaagctggaggaaagagca

SEQ ID NO: 674194 - DNA, 20 bp, mouse
ggcagggggagaactggtga

SEQ ID NO: 674195 - DNA, 20 bp, mouse
gcacactccatcctcctctc

SEQ ID NO: 674196 - DNA, 20 bp, mouse
gctgaggcggggacacagat

SEQ ID NO: 674197 - DNA, 20 bp, mouse
gggagtgaaggggtgtacgt

SEQ ID NO: 674198 - DNA, 20 bp, mouse
gaaagcggggtgcccagctg

SEQ ID NO: 674199 - DNA, 20 bp, mouse
ggctaccaaggtagactcgg

SEQ ID NO: 674200 - DNA, 20 bp, mouse
gggtgctgggaccttaagag

SEQ ID NO: 674201 - DNA, 20 bp, mouse
gcctccctaggacgctacca

SEQ ID NO: 674202 - DNA, 20 bp, mouse
gaccttaagagtggtacgga

SEQ ID NO: 674203 - DNA, 20 bp, mouse
gggggggcacgagttggggt

SEQ ID NO: 674204 - DNA, 20 bp, mouse
ggatcgtggaaggtcagttg

SEQ ID NO: 674205 - DNA, 20 bp, mouse
ggtggaaggtcagttggggt

SEQ ID NO: 674206 - DNA, 20 bp, mouse
gactagctttgaaggtgtgg

SEQ ID NO: 674207 - DNA, 20 bp, mouse
gcatgtgtctgaggagctta

SEQ ID NO: 674208 - DNA, 20 bp, mouse
ggtgtctgaggagcttaggg

SEQ ID NO: 674209 - DNA, 20 bp, mouse
gctacgaggccaaactgccc

SEQ ID NO: 674210 - DNA, 20 bp, mouse
gagttcacaaagaggaagtc

SEQ ID NO: 674211 - DNA, 20 bp, mouse
ggacgcagaagagaagtggt

SEQ ID NO: 674212 - DNA, 20 bp, mouse
ggccaaactgcccaggtctg

SEQ ID NO: 674213 - DNA, 20 bp, mouse
gcccagacgcagaagagaag

SEQ ID NO: 674214 - DNA, 20 bp, mouse
gagtaccacagttcacaaag

SEQ ID NO: 674215 - DNA, 20 bp, mouse
gggtactagctttgaaggtg

SEQ ID NO: 674216 - DNA, 20 bp, mouse
gccttagaggagcgggaaag

SEQ ID NO: 674217 - DNA, 20 bp, mouse
gcccaggagtccctcgccga

SEQ ID NO: 674218 - DNA, 20 bp, mouse
gaaagccagccggctcgctg

SEQ ID NO: 674219 - DNA, 20 bp, mouse
gtagactcgtgcacccagcc

SEQ ID NO: 674220 - DNA, 20 bp, mouse
gatggggcgctcgatctctc

SEQ ID NO: 674221 - DNA, 20 bp, mouse
gcggcgacgtggggactaag

SEQ ID NO: 674222 - DNA, 20 bp, mouse
ggcacccagccgggagactt

SEQ ID NO: 674223 - DNA, 20 bp, mouse
gacgtggggactaagaggtc

SEQ ID NO: 674224 - DNA, 20 bp, mouse
gtgctcgtggcatgactcgt

SEQ ID NO: 674225 - DNA, 20 bp, mouse
gaggtccgcagcgagccggc

SEQ ID NO: 674226 - DNA, 20 bp, mouse
ggaaggcggccgcgagggga

SEQ ID NO: 674227 - DNA, 20 bp, mouse
gtcccggcctgcgaagggaa

SEQ ID NO: 674228 - DNA, 20 bp, mouse
gagccgcgcctggggatccc

SEQ ID NO: 674229 - DNA, 20 bp, mouse
gcgcccggcgcgctgaggga

SEQ ID NO: 674230 - DNA, 20 bp, mouse
gagccccgaagccgcgcctg

SEQ ID NO: 674231 - DNA, 20 bp, mouse
gtgagtgcgccccaccgggt

SEQ ID NO: 674232 - DNA, 20 bp, mouse
gcacgccggcctgcaagagt

SEQ ID NO: 674233 - DNA, 20 bp, mouse
gccgcctcccggcctgcgaa

SEQ ID NO: 674234 - DNA, 20 bp, mouse
gctcccggcgcatgcgtcgt

SEQ ID NO: 674235 - DNA, 20 bp, mouse
ggcttcggggctgcctaacg

SEQ ID NO: 674236 - DNA, 20 bp, mouse
gtgtgtgggaagacgaccgg

SEQ ID NO: 674237 - DNA, 20 bp, mouse
ggctgccccgcccacctccg

SEQ ID NO: 674238 - DNA, 20 bp, mouse
gaagacgaccggaggcggag

SEQ ID NO: 674239 - DNA, 20 bp, mouse
ggtgggaagacgaccggagg

SEQ ID NO: 674240 - DNA, 20 bp, mouse
gtgctgtccaggaaagctaa

SEQ ID NO: 674241 - DNA, 20 bp, mouse
gcgggagggaggtggttata

SEQ ID NO: 674242 - DNA, 20 bp, mouse
gcagcgccgtcactttgtgt

SEQ ID NO: 674243 - DNA, 20 bp, mouse
ggcgtcgccgcttggccctc

SEQ ID NO: 674244 - DNA, 20 bp, mouse
gcgatcgcgtgatgcatctt

SEQ ID NO: 674245 - DNA, 20 bp, mouse
gggcggagaggagaagttgc

SEQ ID NO: 674246 - DNA, 20 bp, mouse
gggactgcgcactacctcac

SEQ ID NO: 674247 - DNA, 20 bp, mouse
gccagctagagaaagatctg

SEQ ID NO: 674248 - DNA, 20 bp, mouse
ggcagaggggcgtggcaaaa

SEQ ID NO: 674249 - DNA, 20 bp, mouse
ggcaaaaaggaaaactctgg

SEQ ID NO: 674250 - DNA, 20 bp, mouse
gctggtggggcgtggcaatt

SEQ ID NO: 674251 - DNA, 20 bp, mouse
gtgaccgctgacagcggagc

SEQ ID NO: 674252 - DNA, 20 bp, mouse
gaagacgccgcttataaggt

SEQ ID NO: 674253 - DNA, 20 bp, mouse
gcagttcgggcagaggggcg

SEQ ID NO: 674254 - DNA, 20 bp, mouse
ggcaactcagaataaaagtg

SEQ ID NO: 674255 - DNA, 20 bp, mouse
gacaaactacatttccccga

SEQ ID NO: 674256 - DNA, 20 bp, mouse
gaaggcggggataagtctgt

SEQ ID NO: 674257 - DNA, 20 bp, mouse
gtgggtggggtcctcgttag

SEQ ID NO: 674258 - DNA, 20 bp, mouse
ggctgcgggacgatggtggt

SEQ ID NO: 674259 - DNA, 20 bp, mouse
gtcacggaggtgctcaccaa

SEQ ID NO: 674260 - DNA, 20 bp, mouse
gcgaacgcctacctctaacg

SEQ ID NO: 674261 - DNA, 20 bp, mouse
gtggggtcctcgttagaggt

SEQ ID NO: 674262 - DNA, 20 bp, mouse
gcgcgggaagaagctcacgg

SEQ ID NO: 674263 - DNA, 20 bp, mouse
ggcggggataagtctgtggg

SEQ ID NO: 674264 - DNA, 20 bp, mouse
gctcgtccgagaacttccat

SEQ ID NO: 674265 - DNA, 20 bp, mouse
gctcaccaaagggtgagaag

SEQ ID NO: 674266 - DNA, 20 bp, mouse
ggagctcataagcactgggt

SEQ ID NO: 674267 - DNA, 20 bp, mouse
gtgcacgtactccagttcat

SEQ ID NO: 674268 - DNA, 20 bp, mouse
gctgggggagggtcctgata

SEQ ID NO: 674269 - DNA, 20 bp, mouse
gggcgggtcatgtgtagata

SEQ ID NO: 674270 - DNA, 20 bp, mouse
gatacccagtagcacaaata

SEQ ID NO: 674271 - DNA, 20 bp, mouse
ggtagatagggcttctttaa

SEQ ID NO: 674272 - DNA, 20 bp, mouse
gtctacacatgacccgcctt

SEQ ID NO: 674273 - DNA, 20 bp, mouse
gactccagttcatgggacta

SEQ ID NO: 674274 - DNA, 20 bp, mouse
gcccagtagcacaaataagg

SEQ ID NO: 674275 - DNA, 20 bp, mouse
ggggtcatgttatcacacta

SEQ ID NO: 674276 - DNA, 20 bp, mouse
gagtgcatgtgggacaagga

SEQ ID NO: 674277 - DNA, 20 bp, mouse
gctccctccagcccatccag

SEQ ID NO: 674278 - DNA, 20 bp, mouse
gacaaggacggctgattccc

SEQ ID NO: 674279 - DNA, 20 bp, mouse
gtggcagcctctggatgggc

SEQ ID NO: 674280 - DNA, 20 bp, mouse
gagcctctggatgggctgga

SEQ ID NO: 674281 - DNA, 20 bp, mouse
gcgagtagcgagtttgaagg

SEQ ID NO: 674282 - DNA, 20 bp, mouse
gtccctgtcgctgtgggagt

SEQ ID NO: 674283 - DNA, 20 bp, mouse
gagtgggagccagccagcgt

SEQ ID NO: 674284 - DNA, 20 bp, mouse
ggaacccgcggaccttatac

SEQ ID NO: 674285 - DNA, 20 bp, mouse
ggataagtccctgtcgctgt

SEQ ID NO: 674286 - DNA, 20 bp, mouse
ggggcggacgtcgagtacgg

SEQ ID NO: 674287 - DNA, 20 bp, mouse
gaaggggcggacgtcgagta

SEQ ID NO: 674288 - DNA, 20 bp, mouse
ggaggcgctccattctgata

SEQ ID NO: 674289 - DNA, 20 bp, mouse
gcctagttggtccttcaaga

SEQ ID NO: 674290 - DNA, 20 bp, mouse
gctgatacggaagcctggtg

SEQ ID NO: 674291 - DNA, 20 bp, mouse
gaaccaaattgcggtgaaag

SEQ ID NO: 674292 - DNA, 20 bp, mouse
gtcaagccacgccctcttga

SEQ ID NO: 674293 - DNA, 20 bp, mouse
gtggttgttttggtctagca

SEQ ID NO: 674294 - DNA, 20 bp, mouse
gagccccgccccgtccccga

SEQ ID NO: 674295 - DNA, 20 bp, mouse
gaactgcggtggaattgctt

SEQ ID NO: 674296 - DNA, 20 bp, mouse
gcggtcgtgcggtcgtcgtg

SEQ ID NO: 674297 - DNA, 20 bp, mouse
gcgggtgccgccaaggttgg

SEQ ID NO: 674298 - DNA, 20 bp, mouse
gcggcggcgccccaggatga

SEQ ID NO: 674299 - DNA, 20 bp, mouse
ggtactcccggcatgcctgt

SEQ ID NO: 674300 - DNA, 20 bp, mouse
gcctggctcttcaaagtcta

SEQ ID NO: 674301 - DNA, 20 bp, mouse
gaaccgggtgccgccaaggt

SEQ ID NO: 674302 - DNA, 20 bp, mouse
ggccgggagtacggcgcaag

SEQ ID NO: 674303 - DNA, 20 bp, mouse
gtgaggttgcgagtgcgtgg

SEQ ID NO: 674304 - DNA, 20 bp, mouse
gggtccgccaccaaccttgg

SEQ ID NO: 674305 - DNA, 20 bp, mouse
ggccctgtgcagccttacgg

SEQ ID NO: 674306 - DNA, 20 bp, mouse
gcacgctccccggccggggt

SEQ ID NO: 674307 - DNA, 20 bp, mouse
gccggggtgggcggggaatg

SEQ ID NO: 674308 - DNA, 20 bp, mouse
gtaaactcacgcctcctcct

SEQ ID NO: 674309 - DNA, 20 bp, mouse
gcaagcgcgcgcacgctccc

SEQ ID NO: 674310 - DNA, 20 bp, mouse
gaacgtgattccagagaatg

SEQ ID NO: 674311 - DNA, 20 bp, mouse
gcttgcgtcctagacccagg

SEQ ID NO: 674312 - DNA, 20 bp, mouse
gtgcgccagcatagaaccga

SEQ ID NO: 674313 - DNA, 20 bp, mouse
gggcaccaatgagcgcgcta

SEQ ID NO: 674314 - DNA, 20 bp, mouse
gcgcgcgcacgctccccggc

SEQ ID NO: 674315 - DNA, 20 bp, mouse
gccggtgagtagaaggcggt

SEQ ID NO: 674316 - DNA, 20 bp, mouse
gagaatgggagctttggcac

SEQ ID NO: 674317 - DNA, 20 bp, mouse
gcaaagctcccattctccca

SEQ ID NO: 674318 - DNA, 20 bp, mouse
gctctcggccatgggagaat

SEQ ID NO: 674319 - DNA, 20 bp, mouse
gccaatcagacaacaggcta

SEQ ID NO: 674320 - DNA, 20 bp, mouse
gacaacaggctagggaagac

SEQ ID NO: 674321 - DNA, 20 bp, mouse
gaattgggggtgaagaggac

SEQ ID NO: 674322 - DNA, 20 bp, mouse
gtgtgggcgtggaagaattg

SEQ ID NO: 674323 - DNA, 20 bp, mouse
gtccacgcccacagtttcta

SEQ ID NO: 674324 - DNA, 20 bp, mouse
gggacaggcctgtatagctc

SEQ ID NO: 674325 - DNA, 20 bp, mouse
ggaagatcccagagctatac

SEQ ID NO: 674326 - DNA, 20 bp, mouse
gcagactagggtttcagcag

SEQ ID NO: 674327 - DNA, 20 bp, mouse
ggagctgttactaataccgt

SEQ ID NO: 674328 - DNA, 20 bp, mouse
gtatatctcccaacagacta

SEQ ID NO: 674329 - DNA, 20 bp, mouse
gaacacacgtgagcattaat

SEQ ID NO: 674330 - DNA, 20 bp, mouse
ggctatatcaagcaagcgga

SEQ ID NO: 674331 - DNA, 20 bp, mouse
gtgtgttagcaacaatgtgt

SEQ ID NO: 674332 - DNA, 20 bp, mouse
gtatttaagtaatcctgctg

SEQ ID NO: 674333 - DNA, 20 bp, mouse
gtgacccgtgtcagatgcca

SEQ ID NO: 674334 - DNA, 20 bp, mouse
ggctgaaaccctagtctgtt

SEQ ID NO: 674335 - DNA, 20 bp, mouse
gtagcagagtgtgttaccca

SEQ ID NO: 674336 - DNA, 20 bp, mouse
gaccccaaagggatagcata

SEQ ID NO: 674337 - DNA, 20 bp, mouse
gatccccaaagcaaacctca

SEQ ID NO: 674338 - DNA, 20 bp, mouse
gctgtgaagtggaaagagaa

SEQ ID NO: 674339 - DNA, 20 bp, mouse
gagtaagcataaaacttccc

SEQ ID NO: 674340 - DNA, 20 bp, mouse
ggatccctatgctatccctt

SEQ ID NO: 674341 - DNA, 20 bp, mouse
gttgtcaaggtcctgtgaag

SEQ ID NO: 674342 - DNA, 20 bp, mouse
gcagccaaccagcatgaaga

SEQ ID NO: 674343 - DNA, 20 bp, mouse
gagggctaggcaatcctttc

SEQ ID NO: 674344 - DNA, 20 bp, mouse
gaaaggctcactcttccttc

SEQ ID NO: 674345 - DNA, 20 bp, mouse
gaagccttgaggtttgcttt

SEQ ID NO: 674346 - DNA, 20 bp, mouse
ggtacaacgctcaaccttga

SEQ ID NO: 674347 - DNA, 20 bp, mouse
gggggtgtctgggggttctc

SEQ ID NO: 674348 - DNA, 20 bp, mouse
gtggcagggcgataggggtg

SEQ ID NO: 674349 - DNA, 20 bp, mouse
gagatctaggagtggctttg

SEQ ID NO: 674350 - DNA, 20 bp, mouse
ggaggcgcctcctgattggc

SEQ ID NO: 674351 - DNA, 20 bp, mouse
ggcgaagagatcccgcgcta

SEQ ID NO: 674352 - DNA, 20 bp, mouse
gcggcaaatgtaatttgcgt

SEQ ID NO: 674353 - DNA, 20 bp, mouse
ggctcttgtcaaacagatct

SEQ ID NO: 674354 - DNA, 20 bp, mouse
ggcgttggtttggcgggttg

SEQ ID NO: 674355 - DNA, 20 bp, mouse
gtcaatgcaggaagtgaact

SEQ ID NO: 674356 - DNA, 20 bp, mouse
ggggacgcgccgaggaagat

SEQ ID NO: 674357 - DNA, 20 bp, mouse
gcgcctgcggggacgcgccg

SEQ ID NO: 674358 - DNA, 20 bp, mouse
gggcccgggagcaaccggga

SEQ ID NO: 674359 - DNA, 20 bp, mouse
gttcctcggcgcgtccccgc

SEQ ID NO: 674360 - DNA, 20 bp, mouse
ggcgtccagcgggtccctcc

SEQ ID NO: 674361 - DNA, 20 bp, mouse
gcccggccgggtaccctcgc

SEQ ID NO: 674362 - DNA, 20 bp, mouse
gccccgcaggcgcgcaccca

SEQ ID NO: 674363 - DNA, 20 bp, mouse
gtccaggggcgcgcgcgagg

SEQ ID NO: 674364 - DNA, 20 bp, mouse
gggctcgcgcacccgcggag

SEQ ID NO: 674365 - DNA, 20 bp, mouse
gagccctgggtgcgcgcctg

SEQ ID NO: 674366 - DNA, 20 bp, mouse
gaaccggcgcctgaccgagt

SEQ ID NO: 674367 - DNA, 20 bp, mouse
gcacgcgagcgagcggcata

SEQ ID NO: 674368 - DNA, 20 bp, mouse
ggagcgagcggcatagggga

SEQ ID NO: 674369 - DNA, 20 bp, mouse
gccggcgggtggaacccatg

SEQ ID NO: 674370 - DNA, 20 bp, mouse
ggagacgcggacatcggcgc

SEQ ID NO: 674371 - DNA, 20 bp, mouse
gcccctggagcctcccgcat

SEQ ID NO: 674372 - DNA, 20 bp, mouse
ggctgtggaaagttgggggc

SEQ ID NO: 674373 - DNA, 20 bp, mouse
gggggggacgccaggcccta

SEQ ID NO: 674374 - DNA, 20 bp, mouse
gcaaagggcgcatcacagta

SEQ ID NO: 674375 - DNA, 20 bp, mouse
ggggttccacccgccggaac

SEQ ID NO: 674376 - DNA, 20 bp, mouse
ggggagcagaggaactgcgg

SEQ ID NO: 674377 - DNA, 20 bp, mouse
gggtagggaaccaatgcgac

SEQ ID NO: 674378 - DNA, 20 bp, mouse
gccctgctccccagtcgcat

SEQ ID NO: 674379 - DNA, 20 bp, mouse
gcagccaggcaaggattgat

SEQ ID NO: 674380 - DNA, 20 bp, mouse
gaggtgctgcaagggggggt

SEQ ID NO: 674381 - DNA, 20 bp, mouse
ggagtgggtagaagatacga

SEQ ID NO: 674382 - DNA, 20 bp, mouse
gtggccaattagaagactga

SEQ ID NO: 674383 - DNA, 20 bp, mouse
gagaggaagcaggaaagcca

SEQ ID NO: 674384 - DNA, 20 bp, mouse
ggtgccctcagtcttctaat

SEQ ID NO: 674385 - DNA, 20 bp, mouse
ggagacgtcaagagccttgg

SEQ ID NO: 674386 - DNA, 20 bp, mouse
gagcggaagtgccaccctag

SEQ ID NO: 674387 - DNA, 20 bp, mouse
gcgactcccagcttccccta

SEQ ID NO: 674388 - DNA, 20 bp, mouse
gcaatcagctggcaaagggg

SEQ ID NO: 674389 - DNA, 20 bp, mouse
gcagtcacgagttgtcccca

SEQ ID NO: 674390 - DNA, 20 bp, mouse
gtggcaaaggggaggagccc

SEQ ID NO: 674391 - DNA, 20 bp, mouse
gcactccagctcccgatgct

SEQ ID NO: 674392 - DNA, 20 bp, mouse
gactcgtgactgggagcaga

SEQ ID NO: 674393 - DNA, 20 bp, mouse
gcgggagctgcccaatcagc

SEQ ID NO: 674394 - DNA, 20 bp, mouse
ggtcgccgagcatcgggagc

SEQ ID NO: 674395 - DNA, 20 bp, mouse
gtggttgtgtgttgagtagt

SEQ ID NO: 674396 - DNA, 20 bp, mouse
gacgctctggagccgaaggt

SEQ ID NO: 674397 - DNA, 20 bp, mouse
gagctctgggagaaactttt

SEQ ID NO: 674398 - DNA, 20 bp, mouse
gcagtgctgctggcacgctc

SEQ ID NO: 674399 - DNA, 20 bp, mouse
gaggagtcgcggcgggaatg

SEQ ID NO: 674400 - DNA, 20 bp, mouse
gagccgaaggtgggcttcgg

SEQ ID NO: 674401 - DNA, 20 bp, mouse
gcggtgacgtcagcggccga

SEQ ID NO: 674402 - DNA, 20 bp, mouse
gtggcacgctctggagccga

SEQ ID NO: 674403 - DNA, 20 bp, mouse
gggtgccagcccagtgctgc

SEQ ID NO: 674404 - DNA, 20 bp, mouse
ggcggcgggaggagtcgcgg

SEQ ID NO: 674405 - DNA, 20 bp, mouse
gaagagtactcttcctgcgt

SEQ ID NO: 674406 - DNA, 20 bp, mouse
ggcggcgcggcgtctgtgga

SEQ ID NO: 674407 - DNA, 20 bp, mouse
gcggtcgggcgtagggattc

SEQ ID NO: 674408 - DNA, 20 bp, mouse
gtgggtgccgcggtgactaa

SEQ ID NO: 674409 - DNA, 20 bp, mouse
gtgcggctgcggggaaacag

SEQ ID NO: 674410 - DNA, 20 bp, mouse
gacggcgtgaggagactggg

SEQ ID NO: 674411 - DNA, 20 bp, mouse
gggagcgctcttcgctgatg

SEQ ID NO: 674412 - DNA, 20 bp, mouse
gcggggaaacagaggaaccg

SEQ ID NO: 674413 - DNA, 20 bp, mouse
gcggacggcgtgaggagact

SEQ ID NO: 674414 - DNA, 20 bp, mouse
gtgaaggctgccagagtgga

SEQ ID NO: 674415 - DNA, 20 bp, mouse
gccgcgccgcggtcgggcgt

SEQ ID NO: 674416 - DNA, 20 bp, mouse
gcacccagcggggggcacca

SEQ ID NO: 674417 - DNA, 20 bp, mouse
gtaagaggcgcagcacccag

SEQ ID NO: 674418 - DNA, 20 bp, mouse
gaggcgcagcacccagcggg

SEQ ID NO: 674419 - DNA, 20 bp, mouse
gtctggaagcctagaggtgg

SEQ ID NO: 674420 - DNA, 20 bp, mouse
ggaccgcattggttgctgta

SEQ ID NO: 674421 - DNA, 20 bp, mouse
ggcctcttacccccacctct

SEQ ID NO: 674422 - DNA, 20 bp, mouse
gtgctgtagggcccctaaat

SEQ ID NO: 674423 - DNA, 20 bp, mouse
gctcaagtacaccccctttg

SEQ ID NO: 674424 - DNA, 20 bp, mouse
gttgcagccagccccaaagg

SEQ ID NO: 674425 - DNA, 20 bp, mouse
gggggcaccagggggcgcat

SEQ ID NO: 674426 - DNA, 20 bp, mouse
ggaggtccttggccctggtg

SEQ ID NO: 674427 - DNA, 20 bp, mouse
gcctggctgccaactaccct

SEQ ID NO: 674428 - DNA, 20 bp, mouse
gctgatgcacccagggtagt

SEQ ID NO: 674429 - DNA, 20 bp, mouse
ggcaaatggtagtcaatcaa

SEQ ID NO: 674430 - DNA, 20 bp, mouse
gggagaaaatacgccacaat

SEQ ID NO: 674431 - DNA, 20 bp, mouse
ggggtgcatcagccccacca

SEQ ID NO: 674432 - DNA, 20 bp, mouse
gtactagataaggaggtcct

SEQ ID NO: 674433 - DNA, 20 bp, mouse
gtggaggctggcctactgcc

SEQ ID NO: 674434 - DNA, 20 bp, mouse
gccgagacgtctgatcccac

SEQ ID NO: 674435 - DNA, 20 bp, mouse
gagtgtagagggaaggcagc

SEQ ID NO: 674436 - DNA, 20 bp, mouse
gaggtaatgagagttccaac

SEQ ID NO: 674437 - DNA, 20 bp, mouse
gcaggacaggaagcgaagag

SEQ ID NO: 674438 - DNA, 20 bp, mouse
gcgtgcggaccaggccaaac

SEQ ID NO: 674439 - DNA, 20 bp, mouse
ggagtctgggcgccaatttc

SEQ ID NO: 674440 - DNA, 20 bp, mouse
gaacgaagataccctaccct

SEQ ID NO: 674441 - DNA, 20 bp, mouse
ggacaggaagcgaagagggg

SEQ ID NO: 674442 - DNA, 20 bp, mouse
gaaggagactcggtcacaaa

SEQ ID NO: 674443 - DNA, 20 bp, mouse
gggtgcttggcgccacctgt

SEQ ID NO: 674444 - DNA, 20 bp, mouse
gcgccaatttccggcttgtc

SEQ ID NO: 674445 - DNA, 20 bp, mouse
ggggtggtgagcgcaagcgc

SEQ ID NO: 674446 - DNA, 20 bp, mouse
gtgcccacggcagacgacga

SEQ ID NO: 674447 - DNA, 20 bp, mouse
gcggaagccccgcctcacca

SEQ ID NO: 674448 - DNA, 20 bp, mouse
gaggcctcggccccctggtg

SEQ ID NO: 674449 - DNA, 20 bp, mouse
ggggcgggcgccgtgacctt

SEQ ID NO: 674450 - DNA, 20 bp, mouse
gaacgcgtccgggctcaaag

SEQ ID NO: 674451 - DNA, 20 bp, mouse
gggagcggcggcggggtcaa

SEQ ID NO: 674452 - DNA, 20 bp, mouse
gcccggacgcgttgccttta

SEQ ID NO: 674453 - DNA, 20 bp, mouse
gtcggccccctggtgaggcg

SEQ ID NO: 674454 - DNA, 20 bp, mouse
ggcgggaaggacggagtcac

SEQ ID NO: 674455 - DNA, 20 bp, mouse
ggctaaagcgcgcaccacgt

SEQ ID NO: 674456 - DNA, 20 bp, mouse
ggtaaagcaccatatgtcta

SEQ ID NO: 674457 - DNA, 20 bp, mouse
gtaggacccaggggaaagcc

SEQ ID NO: 674458 - DNA, 20 bp, mouse
ggggtcctaaatgcctccgc

SEQ ID NO: 674459 - DNA, 20 bp, mouse
ggctgcatggggctgtgatt

SEQ ID NO: 674460 - DNA, 20 bp, mouse
gcaactaggacaaaaagtac

SEQ ID NO: 674461 - DNA, 20 bp, mouse
gaatgggtgagtccaacctg

SEQ ID NO: 674462 - DNA, 20 bp, mouse
gccaagcctggctttcccct

SEQ ID NO: 674463 - DNA, 20 bp, mouse
ggggtgagtccaacctgcgg

SEQ ID NO: 674464 - DNA, 20 bp, mouse
gaaagagtctgctttaaatg

SEQ ID NO: 674465 - DNA, 20 bp, mouse
ggaaaatgggctgttggaaa

SEQ ID NO: 674466 - DNA, 20 bp, mouse
ggccagcctgtcagcaggaa

SEQ ID NO: 674467 - DNA, 20 bp, mouse
gggacggtgcaagtccacta

SEQ ID NO: 674468 - DNA, 20 bp, mouse
gtccttggatgaggtcgtcg

SEQ ID NO: 674469 - DNA, 20 bp, mouse
gtctactcctctcagaggga

SEQ ID NO: 674470 - DNA, 20 bp, mouse
gtgctccctggtgaatcctc

SEQ ID NO: 674471 - DNA, 20 bp, mouse
gccccacccttcctgctgac

SEQ ID NO: 674472 - DNA, 20 bp, mouse
gtctcagagggatggagcag

SEQ ID NO: 674473 - DNA, 20 bp, mouse
gccgcgccgtgctaccgctt

SEQ ID NO: 674474 - DNA, 20 bp, mouse
gcagcgaggtcctagctctg

SEQ ID NO: 674475 - DNA, 20 bp, mouse
gccctggtgaatcctcaggc

SEQ ID NO: 674476 - DNA, 20 bp, mouse
gcgcagggctcgcagaggat

SEQ ID NO: 674477 - DNA, 20 bp, mouse
gcctccgcgcagagccgcgc

SEQ ID NO: 674478 - DNA, 20 bp, mouse
gcagaagcgggcggagcatt

SEQ ID NO: 674479 - DNA, 20 bp, mouse
gcggctctgcgcggaggctt

SEQ ID NO: 674480 - DNA, 20 bp, mouse
gacccgcaggcattgggaag

SEQ ID NO: 674481 - DNA, 20 bp, mouse
gagccctgcgcggctctgcg

SEQ ID NO: 674482 - DNA, 20 bp, mouse
gggaaagagaagcgttgcat

SEQ ID NO: 674483 - DNA, 20 bp, mouse
gtggagtggctaacgagggc

SEQ ID NO: 674484 - DNA, 20 bp, mouse
gaggattggagtggctaacg

SEQ ID NO: 674485 - DNA, 20 bp, mouse
gagcaaggtggggctgagtc

SEQ ID NO: 674486 - DNA, 20 bp, mouse
gtgtcaggacggaatatgaa

SEQ ID NO: 674487 - DNA, 20 bp, mouse
gtgggttaggagtgtcagga

SEQ ID NO: 674488 - DNA, 20 bp, mouse
gtatagatccctagaatctt

SEQ ID NO: 674489 - DNA, 20 bp, mouse
gatcctctacccaagattct

SEQ ID NO: 674490 - DNA, 20 bp, mouse
gtgtgtgggttaggagtgtc

SEQ ID NO: 674491 - DNA, 20 bp, mouse
gggatcccagatactcagat

SEQ ID NO: 674492 - DNA, 20 bp, mouse
gaaactgaagcctggactct

SEQ ID NO: 674493 - DNA, 20 bp, mouse
gtccctagaatcttgggtag

SEQ ID NO: 674494 - DNA, 20 bp, mouse
gggatcttaccttcctagtt

SEQ ID NO: 674495 - DNA, 20 bp, mouse
gcaagttgccctaactagga

SEQ ID NO: 674496 - DNA, 20 bp, mouse
ggggtggggcctaactggag

SEQ ID NO: 674497 - DNA, 20 bp, mouse
gatagcttccaggtcttcgt

SEQ ID NO: 674498 - DNA, 20 bp, mouse
gaggaagagatcaccatatg

SEQ ID NO: 674499 - DNA, 20 bp, mouse
gaggactgcccacgaagacc

SEQ ID NO: 674500 - DNA, 20 bp, mouse
gtgtgccaaacagccctcca

SEQ ID NO: 674501 - DNA, 20 bp, mouse
gttcttagctcctatccctg

SEQ ID NO: 674502 - DNA, 20 bp, mouse
gcagctgggtggggcctaac

SEQ ID NO: 674503 - DNA, 20 bp, mouse
gtagcactggggcaaggcag

SEQ ID NO: 674504 - DNA, 20 bp, mouse
gggtgtgtcctcacctcata

SEQ ID NO: 674505 - DNA, 20 bp, mouse
gctgagaatcatgaatgaag

SEQ ID NO: 674506 - DNA, 20 bp, mouse
gagtaagggatggatccaga

SEQ ID NO: 674507 - DNA, 20 bp, mouse
gcaggacttgaactccctct

SEQ ID NO: 674508 - DNA, 20 bp, mouse
gtcttcagttcagctttctc

SEQ ID NO: 674509 - DNA, 20 bp, mouse
ggaggtcagaccaagtagta

SEQ ID NO: 674510 - DNA, 20 bp, mouse
gagggatgtccacgtgtaaa

SEQ ID NO: 674511 - DNA, 20 bp, mouse
gcaggggaggaaactaccaa

SEQ ID NO: 674512 - DNA, 20 bp, mouse
ggagttctagctgaccctgc

SEQ ID NO: 674513 - DNA, 20 bp, mouse
gacactgggtagaagctgga

SEQ ID NO: 674514 - DNA, 20 bp, mouse
gagaaggcttggccaaccag

SEQ ID NO: 674515 - DNA, 20 bp, mouse
ggggaaggcagccagctaag

SEQ ID NO: 674516 - DNA, 20 bp, mouse
gcggccccactgcagggtga

SEQ ID NO: 674517 - DNA, 20 bp, mouse
gccactgcagggtgacggcg

SEQ ID NO: 674518 - DNA, 20 bp, mouse
ggccggccaggtgagctcag

SEQ ID NO: 674519 - DNA, 20 bp, mouse
gtcccagcgtgccccggggc

SEQ ID NO: 674520 - DNA, 20 bp, mouse
ggtaccgagtggagtcggcg

SEQ ID NO: 674521 - DNA, 20 bp, mouse
gacctggccggccccactgc

SEQ ID NO: 674522 - DNA, 20 bp, mouse
ggggcggtaccgagtggagt

SEQ ID NO: 674523 - DNA, 20 bp, mouse
gcaaagcgccattcaactag

SEQ ID NO: 674524 - DNA, 20 bp, mouse
gcggtaccgcccgcctgctg

SEQ ID NO: 674525 - DNA, 20 bp, mouse
gaggctcctctgagctcacc

SEQ ID NO: 674526 - DNA, 20 bp, mouse
gtccgcaaggaccgcgagaa

SEQ ID NO: 674527 - DNA, 20 bp, mouse
gaggaagagtggtgatagga

SEQ ID NO: 674528 - DNA, 20 bp, mouse
gcggatggaagcaagaaggc

SEQ ID NO: 674529 - DNA, 20 bp, mouse
ggggaaacagaggcctaaag

SEQ ID NO: 674530 - DNA, 20 bp, mouse
gctcccggatggaagcaaga

SEQ ID NO: 674531 - DNA, 20 bp, mouse
ggggtaggaagagtggtgat

SEQ ID NO: 674532 - DNA, 20 bp, mouse
gctggatcctggctcccgga

SEQ ID NO: 674533 - DNA, 20 bp, mouse
gcgggaagtggacactgctg

SEQ ID NO: 674534 - DNA, 20 bp, mouse
gctgccctgggcctgtctac

SEQ ID NO: 674535 - DNA, 20 bp, mouse
gcgtcccagtagacaggccc

SEQ ID NO: 674536 - DNA, 20 bp, mouse
gccctctcccggaatcctga

SEQ ID NO: 674537 - DNA, 20 bp, mouse
gaagtaggaacaagggacgt

SEQ ID NO: 674538 - DNA, 20 bp, mouse
gggagagggcagtcgggcgc

SEQ ID NO: 674539 - DNA, 20 bp, mouse
gtggccagttctcactgcag

SEQ ID NO: 674540 - DNA, 20 bp, mouse
gcaaaccggaagtaggaaca

SEQ ID NO: 674541 - DNA, 20 bp, mouse
gcgacctctgcagtgagaac

SEQ ID NO: 674542 - DNA, 20 bp, mouse
gtgcgcgcgcagcccagcgc

SEQ ID NO: 674543 - DNA, 20 bp, mouse
gaacccgtcccctttccatc

SEQ ID NO: 674544 - DNA, 20 bp, mouse
gaaggggacgggtttccgca

SEQ ID NO: 674545 - DNA, 20 bp, mouse
ggggtttccgcagggaatga

SEQ ID NO: 674546 - DNA, 20 bp, mouse
ggcagccgaagcagtgcgga

SEQ ID NO: 674547 - DNA, 20 bp, mouse
gggaaccgctgcagagacgg

SEQ ID NO: 674548 - DNA, 20 bp, mouse
gagtcgctgtactcagagac

SEQ ID NO: 674549 - DNA, 20 bp, mouse
ggggcccgagcggccattgg

SEQ ID NO: 674550 - DNA, 20 bp, mouse
ggtccccgccgagccccggt

SEQ ID NO: 674551 - DNA, 20 bp, mouse
gtctgagtacagcgactctg

SEQ ID NO: 674552 - DNA, 20 bp, mouse
gccatcccaccggggctcgg

SEQ ID NO: 674553 - DNA, 20 bp, mouse
ggatctagggccatcccacc

SEQ ID NO: 674554 - DNA, 20 bp, mouse
gcaagccctccgcactgctt

SEQ ID NO: 674555 - DNA, 20 bp, mouse
ggggccatcccaccggggct

SEQ ID NO: 674556 - DNA, 20 bp, mouse
gggcgggcggagtccgggat

SEQ ID NO: 674557 - DNA, 20 bp, mouse
gccggctgccggggagattg

SEQ ID NO: 674558 - DNA, 20 bp, mouse
ggccccgggcggggacttgg

SEQ ID NO: 674559 - DNA, 20 bp, mouse
gaatgtgggtagtgttcgag

SEQ ID NO: 674560 - DNA, 20 bp, mouse
gcccggggcccggcccatcc

SEQ ID NO: 674561 - DNA, 20 bp, mouse
gacgtcaatggcggcaacag

SEQ ID NO: 674562 - DNA, 20 bp, mouse
ggcggggcgcagagaggatc

SEQ ID NO: 674563 - DNA, 20 bp, mouse
ggcgccgcgccccggaatgt

SEQ ID NO: 674564 - DNA, 20 bp, mouse
gtccaccaagtccccgcccg

SEQ ID NO: 674565 - DNA, 20 bp, mouse
gcgggccccgggcggggact

SEQ ID NO: 674566 - DNA, 20 bp, mouse
gaatgacccgccccttgtct

SEQ ID NO: 674567 - DNA, 20 bp, mouse
gcagttgtgcgcccagacaa

SEQ ID NO: 674568 - DNA, 20 bp, mouse
ggcaggcgaagcctcctctg

SEQ ID NO: 674569 - DNA, 20 bp, mouse
ggggacggtagcaagcccta

SEQ ID NO: 674570 - DNA, 20 bp, mouse
gcccgccactcccccagagg

SEQ ID NO: 674571 - DNA, 20 bp, mouse
gaggggcgggtcattcctag

SEQ ID NO: 674572 - DNA, 20 bp, mouse
ggaaacagctggagcgggga

SEQ ID NO: 674573 - DNA, 20 bp, mouse
gcaaatggagccttgaaacc

SEQ ID NO: 674574 - DNA, 20 bp, mouse
gtagtgggccgttaccaccc

SEQ ID NO: 674575 - DNA, 20 bp, mouse
gcagcaggcaagaggccata

SEQ ID NO: 674576 - DNA, 20 bp, mouse
gagagagctaagtttcctag

SEQ ID NO: 674577 - DNA, 20 bp, mouse
ggaggcgcccagtttccggt

SEQ ID NO: 674578 - DNA, 20 bp, mouse
ggatgcgggcgtaggatgca

SEQ ID NO: 674579 - DNA, 20 bp, mouse
gaggggacgatcttctgatg

SEQ ID NO: 674580 - DNA, 20 bp, mouse
gtccgcagggaaagagcaac

SEQ ID NO: 674581 - DNA, 20 bp, mouse
gagcacgcccaccggaaact

SEQ ID NO: 674582 - DNA, 20 bp, mouse
gcgtgctcctggctctaaaa

SEQ ID NO: 674583 - DNA, 20 bp, mouse
gcgccgaggcgcccagtttc

SEQ ID NO: 674584 - DNA, 20 bp, mouse
gaaacttagctctctacttc

SEQ ID NO: 674585 - DNA, 20 bp, mouse
gtcaggagcgcggctcggga

SEQ ID NO: 674586 - DNA, 20 bp, mouse
gcatgtctgctagtctggaa

SEQ ID NO: 674587 - DNA, 20 bp, mouse
gcatgggagggtgttgtttc

SEQ ID NO: 674588 - DNA, 20 bp, mouse
ggatcacatgtctgctagtc

SEQ ID NO: 674589 - DNA, 20 bp, mouse
gtagcagacatgtgatctgc

SEQ ID NO: 674590 - DNA, 20 bp, mouse
gcactttattggctgactcc

SEQ ID NO: 674591 - DNA, 20 bp, mouse
gcctggacaatcataaacca

SEQ ID NO: 674592 - DNA, 20 bp, mouse
gtcagttatgaaggaggggg

SEQ ID NO: 674593 - DNA, 20 bp, mouse
gtgttccggagccatacacg

SEQ ID NO: 674594 - DNA, 20 bp, mouse
ggaaaaaaacctgtctccat

SEQ ID NO: 674595 - DNA, 20 bp, mouse
gtaggaaatcccatggagac

SEQ ID NO: 674596 - DNA, 20 bp, mouse
gctccctccctcagccagaa

SEQ ID NO: 674597 - DNA, 20 bp, mouse
ggtgtgcgtcatcacaagtg

SEQ ID NO: 674598 - DNA, 20 bp, mouse
gtgctaagggcgctactggc

SEQ ID NO: 674599 - DNA, 20 bp, mouse
gattgcaaaagcaattgcta

SEQ ID NO: 674600 - DNA, 20 bp, mouse
gcaattgctaagggcgctac

SEQ ID NO: 674601 - DNA, 20 bp, mouse
gcttgtgctaatcgttccaa

SEQ ID NO: 674602 - DNA, 20 bp, mouse
gaagggcaggttgtcttctt

SEQ ID NO: 674603 - DNA, 20 bp, mouse
ggaagtctctactaacctgc

SEQ ID NO: 674604 - DNA, 20 bp, mouse
gcaagagcgtcgggaagggc

SEQ ID NO: 674605 - DNA, 20 bp, mouse
gaaagcaagagcgtcgggaa

SEQ ID NO: 674606 - DNA, 20 bp, mouse
gctcctgcacttgagatagg

SEQ ID NO: 674607 - DNA, 20 bp, mouse
gaggctcctgcacttgagat

SEQ ID NO: 674608 - DNA, 20 bp, mouse
ggagtcaagtagatgggctg

SEQ ID NO: 674609 - DNA, 20 bp, mouse
ggctgtggagaggaacattc

SEQ ID NO: 674610 - DNA, 20 bp, mouse
ggggtgtctctctaagtctg

SEQ ID NO: 674611 - DNA, 20 bp, mouse
gatggtgcattagtcttctt

SEQ ID NO: 674612 - DNA, 20 bp, mouse
gtgtgttgatgaaactacca

SEQ ID NO: 674613 - DNA, 20 bp, mouse
ggaagtaagcgaagaccacc

SEQ ID NO: 674614 - DNA, 20 bp, mouse
gcacctcctatctcaagtgc

SEQ ID NO: 674615 - DNA, 20 bp, mouse
gcacccgggaagggacaagg

SEQ ID NO: 674616 - DNA, 20 bp, mouse
ggctttgggaagaccctcat

SEQ ID NO: 674617 - DNA, 20 bp, mouse
gacgcagcctggcacctcat

SEQ ID NO: 674618 - DNA, 20 bp, mouse
gtgtgtgatgtggtgggatc

SEQ ID NO: 674619 - DNA, 20 bp, mouse
ggatgtgcataggggagcac

SEQ ID NO: 674620 - DNA, 20 bp, mouse
gaatcaccataggattaacg

SEQ ID NO: 674621 - DNA, 20 bp, mouse
gaagggctgggatatgatag

SEQ ID NO: 674622 - DNA, 20 bp, mouse
gctcccctatgcacatctgc

SEQ ID NO: 674623 - DNA, 20 bp, mouse
gagcacagggcacctcagca

SEQ ID NO: 674624 - DNA, 20 bp, mouse
gagccagccaatgaggtgcc

SEQ ID NO: 674625 - DNA, 20 bp, mouse
gggcacatgtagccttgctg

SEQ ID NO: 674626 - DNA, 20 bp, mouse
gagaagcggcctaaccgaag

SEQ ID NO: 674627 - DNA, 20 bp, mouse
gccggccgccgtgacaggaa

SEQ ID NO: 674628 - DNA, 20 bp, mouse
gaacaacggcattgttggga

SEQ ID NO: 674629 - DNA, 20 bp, mouse
gcggttaggccgcttctctt

SEQ ID NO: 674630 - DNA, 20 bp, mouse
gaagctggcgcagcgcacgg

SEQ ID NO: 674631 - DNA, 20 bp, mouse
gagctgccggccgccgtgac

SEQ ID NO: 674632 - DNA, 20 bp, mouse
ggttccggttcttcctaacg

SEQ ID NO: 674633 - DNA, 20 bp, mouse
ggtgacccgccaagagagaa

SEQ ID NO: 674634 - DNA, 20 bp, mouse
gcgccgtgacaggaaggggc

SEQ ID NO: 674635 - DNA, 20 bp, mouse
gtctgcctaaacgtcaatcc

SEQ ID NO: 674636 - DNA, 20 bp, mouse
ggtggctgagacctccagtg

SEQ ID NO: 674637 - DNA, 20 bp, mouse
gctgaggaatcagctttgtc

SEQ ID NO: 674638 - DNA, 20 bp, mouse
ggtctggcttggttctgtag

SEQ ID NO: 674639 - DNA, 20 bp, mouse
gagtagctcggccacactgg

SEQ ID NO: 674640 - DNA, 20 bp, mouse
gcaagagcaggcgttgccag

SEQ ID NO: 674641 - DNA, 20 bp, mouse
gctggagacagaggcgcaaa

SEQ ID NO: 674642 - DNA, 20 bp, mouse
gtgagcaaagggcaccctgg

SEQ ID NO: 674643 - DNA, 20 bp, mouse
gcgggttgctaacactggtg

SEQ ID NO: 674644 - DNA, 20 bp, mouse
gtaacactggtgtggtcccc

SEQ ID NO: 674645 - DNA, 20 bp, mouse
ggcctgctcttgagaattcc

SEQ ID NO: 674646 - DNA, 20 bp, mouse
gaggctcagacgttcaagat

SEQ ID NO: 674647 - DNA, 20 bp, mouse
gcccctggctgccgcagctg

SEQ ID NO: 674648 - DNA, 20 bp, mouse
gacaagaaaagagttaccat

SEQ ID NO: 674649 - DNA, 20 bp, mouse
gcccccagctgcggcagcca

SEQ ID NO: 674650 - DNA, 20 bp, mouse
gaaaagagttaccatcggtt

SEQ ID NO: 674651 - DNA, 20 bp, mouse
gacgtcatctccagtggcgc

SEQ ID NO: 674652 - DNA, 20 bp, mouse
gtctgtgacgtcatctccag

SEQ ID NO: 674653 - DNA, 20 bp, mouse
gcgccacgcccccccagctg

SEQ ID NO: 674654 - DNA, 20 bp, mouse
ggggaggagacccgagcacg

SEQ ID NO: 674655 - DNA, 20 bp, mouse
gaaagagcttgcaccgcggg

SEQ ID NO: 674656 - DNA, 20 bp, mouse
gatggcttggggctggaatc

SEQ ID NO: 674657 - DNA, 20 bp, mouse
gggttctggggttatttggg

SEQ ID NO: 674658 - DNA, 20 bp, mouse
gtgtgagctcggaagatttc

SEQ ID NO: 674659 - DNA, 20 bp, mouse
gctgctggtcgagtgcagca

SEQ ID NO: 674660 - DNA, 20 bp, mouse
gcatatgcagtgaggcctgc

SEQ ID NO: 674661 - DNA, 20 bp, mouse
gcagcagccatcaaaaaaac

SEQ ID NO: 674662 - DNA, 20 bp, mouse
gtatgtaggggacagcccct

SEQ ID NO: 674663 - DNA, 20 bp, mouse
gggcctcactgcatatggct

SEQ ID NO: 674664 - DNA, 20 bp, mouse
gatcttccgagctcacacat

SEQ ID NO: 674665 - DNA, 20 bp, mouse
ggcaatgacaaagatcaact

SEQ ID NO: 674666 - DNA, 20 bp, mouse
gatggcttggggctggaatc

SEQ ID NO: 674667 - DNA, 20 bp, mouse
gggttctggggttatttggg

SEQ ID NO: 674668 - DNA, 20 bp, mouse
gtgtgagctcggaagatttc

SEQ ID NO: 674669 - DNA, 20 bp, mouse
gctgctggtcgagtgcagca

SEQ ID NO: 674670 - DNA, 20 bp, mouse
gcatatgcagtgaggcctgc

SEQ ID NO: 674671 - DNA, 20 bp, mouse
gcagcagccatcaaaaaaac

SEQ ID NO: 674672 - DNA, 20 bp, mouse
gtatgtaggggacagcccct

SEQ ID NO: 674673 - DNA, 20 bp, mouse
gggcctcactgcatatggct

SEQ ID NO: 674674 - DNA, 20 bp, mouse
gatcttccgagctcacacat

SEQ ID NO: 674675 - DNA, 20 bp, mouse
gcgtgcacctgtttttttga

SEQ ID NO: 674676 - DNA, 20 bp, mouse
gtacgtgagtgtgaccttaa

SEQ ID NO: 674677 - DNA, 20 bp, mouse
gggtggggctcagtgaatgc

SEQ ID NO: 674678 - DNA, 20 bp, mouse
ggggcagcttgtggagcaag

SEQ ID NO: 674679 - DNA, 20 bp, mouse
gacctgggactcctttttga

SEQ ID NO: 674680 - DNA, 20 bp, mouse
gaggtcacactcacgtacgt

SEQ ID NO: 674681 - DNA, 20 bp, mouse
gaacgcgcgacttttacaga

SEQ ID NO: 674682 - DNA, 20 bp, mouse
gacgtcacccagccctccgc

SEQ ID NO: 674683 - DNA, 20 bp, mouse
gaacctccaggggcagcttg

SEQ ID NO: 674684 - DNA, 20 bp, mouse
gcatagaagccgtgccttta

SEQ ID NO: 674685 - DNA, 20 bp, mouse
ggagtgtgaccttaaaggca

SEQ ID NO: 674686 - DNA, 20 bp, mouse
gtggctctcaactgaccact

SEQ ID NO: 674687 - DNA, 20 bp, mouse
gtagaattccgcagtcccag

SEQ ID NO: 674688 - DNA, 20 bp, mouse
gtggtcacactcacatacgt

SEQ ID NO: 674689 - DNA, 20 bp, mouse
gtgagtgtgaccaaaaggca

SEQ ID NO: 674690 - DNA, 20 bp, mouse
gaacgcgtgacttttgcaga

SEQ ID NO: 674691 - DNA, 20 bp, mouse
ggtatgtgagtgtgaccaaa

SEQ ID NO: 674692 - DNA, 20 bp, mouse
gcattgcctcttgctccaca

SEQ ID NO: 674693 - DNA, 20 bp, mouse
gtccacaaggctgcccctgg

SEQ ID NO: 674694 - DNA, 20 bp, mouse
gcaactgaccactgggactg

SEQ ID NO: 674695 - DNA, 20 bp, mouse
gtgctccacaaggctgcccc

SEQ ID NO: 674696 - DNA, 20 bp, mouse
gtgcgtagagaatggtcgga

SEQ ID NO: 674697 - DNA, 20 bp, mouse
gggaggatccacaggacgga

SEQ ID NO: 674698 - DNA, 20 bp, mouse
gtcgaggggcagttgtgggt

SEQ ID NO: 674699 - DNA, 20 bp, mouse
gcagcgtccacggaacacgg

SEQ ID NO: 674700 - DNA, 20 bp, mouse
ggggttcgaggggcagttgt

SEQ ID NO: 674701 - DNA, 20 bp, mouse
ggggcgggacaggatcgagg

SEQ ID NO: 674702 - DNA, 20 bp, mouse
gtccacaggacggatgggta

SEQ ID NO: 674703 - DNA, 20 bp, mouse
gatgggtaaggcagcgtcca

SEQ ID NO: 674704 - DNA, 20 bp, mouse
ggtagagaatggtcggaggg

SEQ ID NO: 674705 - DNA, 20 bp, mouse
gcaggatatgggcaggacgt

SEQ ID NO: 674706 - DNA, 20 bp, mouse
gccagacgcccagcaggtga

SEQ ID NO: 674707 - DNA, 20 bp, mouse
gaggaggggcgttgcaggtt

SEQ ID NO: 674708 - DNA, 20 bp, mouse
ggggagaggaggggcgttgc

SEQ ID NO: 674709 - DNA, 20 bp, mouse
gcgtgactaaggctcctcac

SEQ ID NO: 674710 - DNA, 20 bp, mouse
ggctgggggcggggggtcgt

SEQ ID NO: 674711 - DNA, 20 bp, mouse
ggggcgttgcaggttggggc

SEQ ID NO: 674712 - DNA, 20 bp, mouse
gcggcggcccttgcaaggaa

SEQ ID NO: 674713 - DNA, 20 bp, mouse
gtctggcccagactccgggg

SEQ ID NO: 674714 - DNA, 20 bp, mouse
gcgtggtgggggcgtgacta

SEQ ID NO: 674715 - DNA, 20 bp, mouse
ggggcgtctggcccagactc

SEQ ID NO: 674716 - DNA, 20 bp, mouse
gcccctaggaggcatgggga

SEQ ID NO: 674717 - DNA, 20 bp, mouse
gcccttcttcagggtgggtt

SEQ ID NO: 674718 - DNA, 20 bp, mouse
gccccagcaaccaaagcctg

SEQ ID NO: 674719 - DNA, 20 bp, mouse
gtcagggtgggttaggctgg

SEQ ID NO: 674720 - DNA, 20 bp, mouse
ggccagggaagaggcactct

SEQ ID NO: 674721 - DNA, 20 bp, mouse
gggaagaaaccagaggaatt

SEQ ID NO: 674722 - DNA, 20 bp, mouse
gcatccgggcaagccttccc

SEQ ID NO: 674723 - DNA, 20 bp, mouse
gcagggcccctaggaggcat

SEQ ID NO: 674724 - DNA, 20 bp, mouse
ggtccagcagggtactgcct

SEQ ID NO: 674725 - DNA, 20 bp, mouse
ggagggttaaggttatggga

SEQ ID NO: 674726 - DNA, 20 bp, mouse
ggaggcgcggcaaaccatgg

SEQ ID NO: 674727 - DNA, 20 bp, mouse
gcaaagggagagaaattcta

SEQ ID NO: 674728 - DNA, 20 bp, mouse
ggaggggtgtggcgaacaag

SEQ ID NO: 674729 - DNA, 20 bp, mouse
ggcgtgacgaggcgtgagga

SEQ ID NO: 674730 - DNA, 20 bp, mouse
gtgaggagggcggagttgac

SEQ ID NO: 674731 - DNA, 20 bp, mouse
gggagagaaattctatgggc

SEQ ID NO: 674732 - DNA, 20 bp, mouse
gcaagcgagggggcgtgacg

SEQ ID NO: 674733 - DNA, 20 bp, mouse
ggtagggggcgtcacttcct

SEQ ID NO: 674734 - DNA, 20 bp, mouse
gaagaaggagcgttgtgctg

SEQ ID NO: 674735 - DNA, 20 bp, mouse
ggcggcaaaccatgggggcg

SEQ ID NO: 674736 - DNA, 20 bp, mouse
gccggacccggagaggactc

SEQ ID NO: 674737 - DNA, 20 bp, mouse
gagacacgcggaagttggac

SEQ ID NO: 674738 - DNA, 20 bp, mouse
ggcaccgcccaggtcacagc

SEQ ID NO: 674739 - DNA, 20 bp, mouse
gactaggtactgacacgagt

SEQ ID NO: 674740 - DNA, 20 bp, mouse
gcggtgaagctgggacggga

SEQ ID NO: 674741 - DNA, 20 bp, mouse
gacctgggcggtgcgctcct

SEQ ID NO: 674742 - DNA, 20 bp, mouse
gcaacttccgcgtgtctaga

SEQ ID NO: 674743 - DNA, 20 bp, mouse
ggcggaagttggactggcgt

SEQ ID NO: 674744 - DNA, 20 bp, mouse
gggccagggccccaggcgtc

SEQ ID NO: 674745 - DNA, 20 bp, mouse
gccacacaaaaaatccctgg

SEQ ID NO: 674746 - DNA, 20 bp, mouse
ggacgcgtaccggatcgcta

SEQ ID NO: 674747 - DNA, 20 bp, mouse
gtagaaggagtgtgaccagg

SEQ ID NO: 674748 - DNA, 20 bp, mouse
gggtgggcggagcctaattg

SEQ ID NO: 674749 - DNA, 20 bp, mouse
gaggaggggcgtagactggg

SEQ ID NO: 674750 - DNA, 20 bp, mouse
ggaagctggtccaagtctgg

SEQ ID NO: 674751 - DNA, 20 bp, mouse
gggggtgcagggacgcgtac

SEQ ID NO: 674752 - DNA, 20 bp, mouse
ggggcctcttaaggaaactc

SEQ ID NO: 674753 - DNA, 20 bp, mouse
gccaggactacaggcggttg

SEQ ID NO: 674754 - DNA, 20 bp, mouse
gaagtctggtggccctaggt

SEQ ID NO: 674755 - DNA, 20 bp, mouse
gctccaggacctcccctcgg

SEQ ID NO: 674756 - DNA, 20 bp, mouse
gggggaccgcgaaagaatgg

SEQ ID NO: 674757 - DNA, 20 bp, mouse
gttagggcgagagtagacaa

SEQ ID NO: 674758 - DNA, 20 bp, mouse
gccgaggcgcctgcgcggaa

SEQ ID NO: 674759 - DNA, 20 bp, mouse
gcgacctgggcagttcccca

SEQ ID NO: 674760 - DNA, 20 bp, mouse
gcctgcgcgctgtgcgacct

SEQ ID NO: 674761 - DNA, 20 bp, mouse
gtggccctggggaactgccc

SEQ ID NO: 674762 - DNA, 20 bp, mouse
gctactctcgccctaaagaa

SEQ ID NO: 674763 - DNA, 20 bp, mouse
gggctcgtgacgttatcaag

SEQ ID NO: 674764 - DNA, 20 bp, mouse
gaggaaaacgaaagtgaggg

SEQ ID NO: 674765 - DNA, 20 bp, mouse
gaagggggaccgcgaaagaa

SEQ ID NO: 674766 - DNA, 20 bp, mouse
ggggtcgcggacaaagagga

SEQ ID NO: 674767 - DNA, 20 bp, mouse
gggaaggcgcctgtgcagtg

SEQ ID NO: 674768 - DNA, 20 bp, mouse
gtgcacaggcgccttccggg

SEQ ID NO: 674769 - DNA, 20 bp, mouse
gacccccggaagctgttccc

SEQ ID NO: 674770 - DNA, 20 bp, mouse
gtcagagcctcgcagccggt

SEQ ID NO: 674771 - DNA, 20 bp, mouse
gcacgcccccaccggctgcg

SEQ ID NO: 674772 - DNA, 20 bp, mouse
gtctgacagccacactgcac

SEQ ID NO: 674773 - DNA, 20 bp, mouse
gagccggtgggggcgtggtc

SEQ ID NO: 674774 - DNA, 20 bp, mouse
ggcatcgacgtcactcggga

SEQ ID NO: 674775 - DNA, 20 bp, mouse
gctccagaccacgcccccac

SEQ ID NO: 674776 - DNA, 20 bp, mouse
gccaacttccccgcccgttt

SEQ ID NO: 674777 - DNA, 20 bp, mouse
gacgggcggggaagttggca

SEQ ID NO: 674778 - DNA, 20 bp, mouse
gtggcagggactggaaccag

SEQ ID NO: 674779 - DNA, 20 bp, mouse
ggaagatctgccaaaacggg

SEQ ID NO: 674780 - DNA, 20 bp, mouse
gcggggaagttggcagggac

SEQ ID NO: 674781 - DNA, 20 bp, mouse
gaggccactagatggaaggc

SEQ ID NO: 674782 - DNA, 20 bp, mouse
gcaccaggccactagatgga

SEQ ID NO: 674783 - DNA, 20 bp, mouse
gagcccagccttccatctag

SEQ ID NO: 674784 - DNA, 20 bp, mouse
gtccagagaagataacgtta

SEQ ID NO: 674785 - DNA, 20 bp, mouse
ggatggaaggctgggctggt

SEQ ID NO: 674786 - DNA, 20 bp, mouse
gcaggctggatgatctccgg

SEQ ID NO: 674787 - DNA, 20 bp, mouse
gtgggcttggcctatcagag

SEQ ID NO: 674788 - DNA, 20 bp, mouse
gggatgatctccggaggtgg

SEQ ID NO: 674789 - DNA, 20 bp, mouse
gtggaccatgaaggttcttg

SEQ ID NO: 674790 - DNA, 20 bp, mouse
ggaaccctcaagaaccttca

SEQ ID NO: 674791 - DNA, 20 bp, mouse
ggctggatgatctccggagg

SEQ ID NO: 674792 - DNA, 20 bp, mouse
gttacatcagaagattctgt

SEQ ID NO: 674793 - DNA, 20 bp, mouse
gctatcagagtggaccatga

SEQ ID NO: 674794 - DNA, 20 bp, mouse
gtacaactactgtgcaaggc

SEQ ID NO: 674795 - DNA, 20 bp, mouse
gtgatgtaagaattaggtgt

SEQ ID NO: 674796 - DNA, 20 bp, mouse
gcgggacgcggactcaggac

SEQ ID NO: 674797 - DNA, 20 bp, mouse
ggcctcgcctgcgtctgcac

SEQ ID NO: 674798 - DNA, 20 bp, mouse
gccggactgcgaaacaaagg

SEQ ID NO: 674799 - DNA, 20 bp, mouse
gcccgggccctgcccttcag

SEQ ID NO: 674800 - DNA, 20 bp, mouse
gcaccggaaggaggtaacag

SEQ ID NO: 674801 - DNA, 20 bp, mouse
ggccggggagctcccggaat

SEQ ID NO: 674802 - DNA, 20 bp, mouse
ggacggggccgcacagtcgc

SEQ ID NO: 674803 - DNA, 20 bp, mouse
gagggcccgggcaccccagc

SEQ ID NO: 674804 - DNA, 20 bp, mouse
ggacccgcgaagctcctcgg

SEQ ID NO: 674805 - DNA, 20 bp, mouse
ggccctctgttacctccttc

SEQ ID NO: 674806 - DNA, 20 bp, mouse
gtagacacggaacccaggta

SEQ ID NO: 674807 - DNA, 20 bp, mouse
gaacccaggtacgggcggga

SEQ ID NO: 674808 - DNA, 20 bp, mouse
gctgcgggccggaagaggct

SEQ ID NO: 674809 - DNA, 20 bp, mouse
gagaaccagcaaaggttcga

SEQ ID NO: 674810 - DNA, 20 bp, mouse
gggaaggccgcgagcgctgc

SEQ ID NO: 674811 - DNA, 20 bp, mouse
gggagcgcggcctcgcgcga

SEQ ID NO: 674812 - DNA, 20 bp, mouse
gacggaacccaggtacgggc

SEQ ID NO: 674813 - DNA, 20 bp, mouse
gcccagcgggcgattctgat

SEQ ID NO: 674814 - DNA, 20 bp, mouse
ggcctcccctaagcctggtg

SEQ ID NO: 674815 - DNA, 20 bp, mouse
gcctcgcgcgagggcggcag

SEQ ID NO: 674816 - DNA, 20 bp, mouse
gaccagcagaacagggtcca

SEQ ID NO: 674817 - DNA, 20 bp, mouse
gtccaaggatccctgaagag

SEQ ID NO: 674818 - DNA, 20 bp, mouse
gacccagggggcagttaagg

SEQ ID NO: 674819 - DNA, 20 bp, mouse
gggtcacactgttagctcat

SEQ ID NO: 674820 - DNA, 20 bp, mouse
gagggagggcggctccttga

SEQ ID NO: 674821 - DNA, 20 bp, mouse
gccgccctccctcaagatga

SEQ ID NO: 674822 - DNA, 20 bp, mouse
gctgccttcatcttgaggga

SEQ ID NO: 674823 - DNA, 20 bp, mouse
gcccgccttaactgccccct

SEQ ID NO: 674824 - DNA, 20 bp, mouse
ggtgaggagcaaagctcctc

SEQ ID NO: 674825 - DNA, 20 bp, mouse
gtaaggcggggcctccttca

SEQ ID NO: 674826 - DNA, 20 bp, mouse
gccactggggccctcctctt

SEQ ID NO: 674827 - DNA, 20 bp, mouse
ggagcttaggagccaatcgg

SEQ ID NO: 674828 - DNA, 20 bp, mouse
gatcaatctaagcctccgat

SEQ ID NO: 674829 - DNA, 20 bp, mouse
gaggaagtgactgcacttca

SEQ ID NO: 674830 - DNA, 20 bp, mouse
gcaagagcttaggagccaat

SEQ ID NO: 674831 - DNA, 20 bp, mouse
gacttcagggccaagagctt

SEQ ID NO: 674832 - DNA, 20 bp, mouse
ggtcaaagcagaaagttcca

SEQ ID NO: 674833 - DNA, 20 bp, mouse
gacttatcacaggactcccc

SEQ ID NO: 674834 - DNA, 20 bp, mouse
gtgcgacacacacttatcac

SEQ ID NO: 674835 - DNA, 20 bp, mouse
gcatctctagctctgttggt

SEQ ID NO: 674836 - DNA, 20 bp, mouse
gagagggcggggctatcccg

SEQ ID NO: 674837 - DNA, 20 bp, mouse
gcgggcgctttgtatagcga

SEQ ID NO: 674838 - DNA, 20 bp, mouse
ggggtgcgccagccgaggag

SEQ ID NO: 674839 - DNA, 20 bp, mouse
gcggtctattgcttcaaagt

SEQ ID NO: 674840 - DNA, 20 bp, mouse
gtatagcgagggacatgaaa

SEQ ID NO: 674841 - DNA, 20 bp, mouse
gagaccgtcggtaagagggc

SEQ ID NO: 674842 - DNA, 20 bp, mouse
gagccccgccctcttaccga

SEQ ID NO: 674843 - DNA, 20 bp, mouse
gggcgtggccacggccggca

SEQ ID NO: 674844 - DNA, 20 bp, mouse
gagcgtcgtcagggcgggtc

SEQ ID NO: 674845 - DNA, 20 bp, mouse
gggggcggggagcgtcgtca

SEQ ID NO: 674846 - DNA, 20 bp, mouse
gtgggcggtgccaaacggag

SEQ ID NO: 674847 - DNA, 20 bp, mouse
gccgagaatagcgagcagct

SEQ ID NO: 674848 - DNA, 20 bp, mouse
gccagcgctagatgttcaac

SEQ ID NO: 674849 - DNA, 20 bp, mouse
gtctagcgctgggttcccga

SEQ ID NO: 674850 - DNA, 20 bp, mouse
gaactaaactagttttctat

SEQ ID NO: 674851 - DNA, 20 bp, mouse
ggaaaactagtttagttgag

SEQ ID NO: 674852 - DNA, 20 bp, mouse
gtgagcgcccactaacttct

SEQ ID NO: 674853 - DNA, 20 bp, mouse
gatactgcccagaagttagt

SEQ ID NO: 674854 - DNA, 20 bp, mouse
gtgggagttggcgctgtcgg

SEQ ID NO: 674855 - DNA, 20 bp, mouse
ggagggcagggatagattgg

SEQ ID NO: 674856 - DNA, 20 bp, mouse
gacccagggcaggggagata

SEQ ID NO: 674857 - DNA, 20 bp, mouse
gagggaggatggaaaatcca

SEQ ID NO: 674858 - DNA, 20 bp, mouse
gctgagagatgagacaagag

SEQ ID NO: 674859 - DNA, 20 bp, mouse
gaagatgagtgactggagat

SEQ ID NO: 674860 - DNA, 20 bp, mouse
gtcagagatggagaatgtac

SEQ ID NO: 674861 - DNA, 20 bp, mouse
gaaaactgcaagatctggag

SEQ ID NO: 674862 - DNA, 20 bp, mouse
gcggaggcatggggtcagtg

SEQ ID NO: 674863 - DNA, 20 bp, mouse
ggtacaggaagaaggagact

SEQ ID NO: 674864 - DNA, 20 bp, mouse
ggatgccaagggagactagc

SEQ ID NO: 674865 - DNA, 20 bp, mouse
gactggagatgggaattgag

SEQ ID NO: 674866 - DNA, 20 bp, mouse
gtgtctgaaagtaagccaaa

SEQ ID NO: 674867 - DNA, 20 bp, mouse
gaaaatgagacactgcaatg

SEQ ID NO: 674868 - DNA, 20 bp, mouse
ggaacaccctgcccagcgtt

SEQ ID NO: 674869 - DNA, 20 bp, mouse
gttcagacaggttaggcgac

SEQ ID NO: 674870 - DNA, 20 bp, mouse
gaggcgaccggctttgagaa

SEQ ID NO: 674871 - DNA, 20 bp, mouse
gcaaaaggaatactgcctag

SEQ ID NO: 674872 - DNA, 20 bp, mouse
gactgcaatgtggctatctg

SEQ ID NO: 674873 - DNA, 20 bp, mouse
gtgcggctgttaaaagttat

SEQ ID NO: 674874 - DNA, 20 bp, mouse
gtgtggaagtctccaaacgc

SEQ ID NO: 674875 - DNA, 20 bp, mouse
gttatagtattataaccctg

SEQ ID NO: 674876 - DNA, 20 bp, mouse
gatttagcctccagtaaggt

SEQ ID NO: 674877 - DNA, 20 bp, mouse
gccagagaggggaaattcaa

SEQ ID NO: 674878 - DNA, 20 bp, mouse
gtagcagccggggtaagaag

SEQ ID NO: 674879 - DNA, 20 bp, mouse
ggtgcaagggagagtccctt

SEQ ID NO: 674880 - DNA, 20 bp, mouse
gtgtcagcactttaaggcag

SEQ ID NO: 674881 - DNA, 20 bp, mouse
gggagtggaaggcatagggt

SEQ ID NO: 674882 - DNA, 20 bp, mouse
gtctcttgaaaaggagtcaa

SEQ ID NO: 674883 - DNA, 20 bp, mouse
ggaaaatagagtgggttgtg

SEQ ID NO: 674884 - DNA, 20 bp, mouse
gcttactggaggctaaatca

SEQ ID NO: 674885 - DNA, 20 bp, mouse
gaaagagaaaccagccagag

SEQ ID NO: 674886 - DNA, 20 bp, mouse
gcacacttgcttgtattcag

SEQ ID NO: 674887 - DNA, 20 bp, mouse
gagtgaggacagtaaagatc

SEQ ID NO: 674888 - DNA, 20 bp, mouse
ggaggacagtaaagatcggg

SEQ ID NO: 674889 - DNA, 20 bp, mouse
gcctagaaagacaaagagtc

SEQ ID NO: 674890 - DNA, 20 bp, mouse
gggctactggaagttgtctg

SEQ ID NO: 674891 - DNA, 20 bp, mouse
gtcgggaggcttgaagttta

SEQ ID NO: 674892 - DNA, 20 bp, mouse
gcagtagcccacactaagtg

SEQ ID NO: 674893 - DNA, 20 bp, mouse
gccagaaggcttagtggcta

SEQ ID NO: 674894 - DNA, 20 bp, mouse
gtgacagggtaaggactcaa

SEQ ID NO: 674895 - DNA, 20 bp, mouse
gaaagtccaaagttgacagc

SEQ ID NO: 674896 - DNA, 20 bp, mouse
gggcgctgggcatgagaaat

SEQ ID NO: 674897 - DNA, 20 bp, mouse
gcctccggggacctcattaa

SEQ ID NO: 674898 - DNA, 20 bp, mouse
gccaagcctgctggaaatgt

SEQ ID NO: 674899 - DNA, 20 bp, mouse
gtgaggtccccggaggtggt

SEQ ID NO: 674900 - DNA, 20 bp, mouse
gcagctaaacacctttaatg

SEQ ID NO: 674901 - DNA, 20 bp, mouse
ggtaaaccagcctgggtcct

SEQ ID NO: 674902 - DNA, 20 bp, mouse
gtcaaaccgacatttccagc

SEQ ID NO: 674903 - DNA, 20 bp, mouse
gtgtctcccaggacccaggc

SEQ ID NO: 674904 - DNA, 20 bp, mouse
gacacctttaatgaggtccc

SEQ ID NO: 674905 - DNA, 20 bp, mouse
ggaaaacacctctaagtgag

SEQ ID NO: 674906 - DNA, 20 bp, mouse
gggttcctgtcaccttgagg

SEQ ID NO: 674907 - DNA, 20 bp, mouse
gggactcagtaggatatctg

SEQ ID NO: 674908 - DNA, 20 bp, mouse
gggacactgctggacccgtg

SEQ ID NO: 674909 - DNA, 20 bp, mouse
gaagcaagcagcaaccccca

SEQ ID NO: 674910 - DNA, 20 bp, mouse
gtggctttgtcacattctgt

SEQ ID NO: 674911 - DNA, 20 bp, mouse
gggagcctcctcaaggtgac

SEQ ID NO: 674912 - DNA, 20 bp, mouse
gagggccctttgagttacta

SEQ ID NO: 674913 - DNA, 20 bp, mouse
gaacccatcagctcagtctg

SEQ ID NO: 674914 - DNA, 20 bp, mouse
gaggttccctagtaactcaa

SEQ ID NO: 674915 - DNA, 20 bp, mouse
gcagcagtgtcctagacata

SEQ ID NO: 674916 - DNA, 20 bp, mouse
gtgaagctggggatagacat

SEQ ID NO: 674917 - DNA, 20 bp, mouse
gtctctgcaaagctggccaa

SEQ ID NO: 674918 - DNA, 20 bp, mouse
gggctgggctgttactgtct

SEQ ID NO: 674919 - DNA, 20 bp, mouse
ggaactgcaggaacactcca

SEQ ID NO: 674920 - DNA, 20 bp, mouse
gggtccccacctgacctccc

SEQ ID NO: 674921 - DNA, 20 bp, mouse
gaggtggggaccatgggcca

SEQ ID NO: 674922 - DNA, 20 bp, mouse
gcactccagggaggtcaggt

SEQ ID NO: 674923 - DNA, 20 bp, mouse
ggcgaccatctgtgttacca

SEQ ID NO: 674924 - DNA, 20 bp, mouse
gctgcagagacagggttgct

SEQ ID NO: 674925 - DNA, 20 bp, mouse
ggctggggatagacatgggc

SEQ ID NO: 674926 - DNA, 20 bp, mouse
gggtaggtgagcaattagaa

SEQ ID NO: 674927 - DNA, 20 bp, mouse
gagatacagggtcatataat

SEQ ID NO: 674928 - DNA, 20 bp, mouse
gctcgtcttaaattattcac

SEQ ID NO: 674929 - DNA, 20 bp, mouse
gtctctgtttggatgttaac

SEQ ID NO: 674930 - DNA, 20 bp, mouse
gatgaccctgtatctcgaag

SEQ ID NO: 674931 - DNA, 20 bp, mouse
gaggaaaataacaagtcaat

SEQ ID NO: 674932 - DNA, 20 bp, mouse
gatggacctgtgactctcaa

SEQ ID NO: 674933 - DNA, 20 bp, mouse
gactagtgaaacatgtgtga

SEQ ID NO: 674934 - DNA, 20 bp, mouse
gtttaaaattaggcacaggt

SEQ ID NO: 674935 - DNA, 20 bp, mouse
gtcctgattaaacagctaat

SEQ ID NO: 674936 - DNA, 20 bp, mouse
gcctcctggaagctaatctg

SEQ ID NO: 674937 - DNA, 20 bp, mouse
gcatcagggggtgctcgcgc

SEQ ID NO: 674938 - DNA, 20 bp, mouse
gaaaggtcacccggccctcc

SEQ ID NO: 674939 - DNA, 20 bp, mouse
ggcgagcaccccctgatggt

SEQ ID NO: 674940 - DNA, 20 bp, mouse
gcaaacacaagactagtctc

SEQ ID NO: 674941 - DNA, 20 bp, mouse
gataagtgcaggaaaagaga

SEQ ID NO: 674942 - DNA, 20 bp, mouse
gggatctgttagtggaactt

SEQ ID NO: 674943 - DNA, 20 bp, mouse
gaaaggaaaacgttgtgtct

SEQ ID NO: 674944 - DNA, 20 bp, mouse
gcgcaaactccgaccatcag

SEQ ID NO: 674945 - DNA, 20 bp, mouse
gaagggagtgctggcgatac

SEQ ID NO: 674946 - DNA, 20 bp, mouse
gtggctgtgctgggctgatg

SEQ ID NO: 674947 - DNA, 20 bp, mouse
gtggggtgagtggctgtgct

SEQ ID NO: 674948 - DNA, 20 bp, mouse
gtgtgctgggctgatgaggc

SEQ ID NO: 674949 - DNA, 20 bp, mouse
gtccgccccgccggcttcgc

SEQ ID NO: 674950 - DNA, 20 bp, mouse
gttcgcgggctggagagcga

SEQ ID NO: 674951 - DNA, 20 bp, mouse
ggggcggggccgccgtgcag

SEQ ID NO: 674952 - DNA, 20 bp, mouse
gcacaaacactgggctcatt

SEQ ID NO: 674953 - DNA, 20 bp, mouse
gcatggcccaccggactcta

SEQ ID NO: 674954 - DNA, 20 bp, mouse
ggctgatgaggctggcggag

SEQ ID NO: 674955 - DNA, 20 bp, mouse
gaccagggccacgaggccgt

SEQ ID NO: 674956 - DNA, 20 bp, mouse
ggtgctcgcccgcctctcgt

SEQ ID NO: 674957 - DNA, 20 bp, mouse
gcagggaagtgagggatcga

SEQ ID NO: 674958 - DNA, 20 bp, mouse
gcgcggaggcgggaggggca

SEQ ID NO: 674959 - DNA, 20 bp, mouse
gcacgtgcgcccggagagag

SEQ ID NO: 674960 - DNA, 20 bp, mouse
gagcgcgccctccccgcggg

SEQ ID NO: 674961 - DNA, 20 bp, mouse
gcgcgcgcgcggaggcggga

SEQ ID NO: 674962 - DNA, 20 bp, mouse
gctgctctggtgtgctccaa

SEQ ID NO: 674963 - DNA, 20 bp, mouse
gggagggcgcgctctggagc

SEQ ID NO: 674964 - DNA, 20 bp, mouse
gcgcgctctggagccggcga

SEQ ID NO: 674965 - DNA, 20 bp, mouse
ggtgggaaggcggaaggcta

SEQ ID NO: 674966 - DNA, 20 bp, mouse
gccgcgacgcgatgcatgat

SEQ ID NO: 674967 - DNA, 20 bp, mouse
gagacagaaaatttcataca

SEQ ID NO: 674968 - DNA, 20 bp, mouse
ggccgcgccgctgggatagg

SEQ ID NO: 674969 - DNA, 20 bp, mouse
gatgcagtggatactaaatg

SEQ ID NO: 674970 - DNA, 20 bp, mouse
gtccacctgctatgctccct

SEQ ID NO: 674971 - DNA, 20 bp, mouse
gaaaccaacaatgataggca

SEQ ID NO: 674972 - DNA, 20 bp, mouse
gtgaagttcactagtgccca

SEQ ID NO: 674973 - DNA, 20 bp, mouse
gacagaaaatttcatatgat

SEQ ID NO: 674974 - DNA, 20 bp, mouse
ggcaaagagacccaagttag

SEQ ID NO: 674975 - DNA, 20 bp, mouse
gcttccttgcctatcattgt

SEQ ID NO: 674976 - DNA, 20 bp, mouse
gaagacaggcggtggaccaa

SEQ ID NO: 674977 - DNA, 20 bp, mouse
gctgcccctctggcatccta

SEQ ID NO: 674978 - DNA, 20 bp, mouse
gaccacggggacccggggat

SEQ ID NO: 674979 - DNA, 20 bp, mouse
gaaagccctaggatgccaga

SEQ ID NO: 674980 - DNA, 20 bp, mouse
gcggctaacgtcaaacttat

SEQ ID NO: 674981 - DNA, 20 bp, mouse
gctggcctcaccaaggaggg

SEQ ID NO: 674982 - DNA, 20 bp, mouse
ggcctagttgccaaagccct

SEQ ID NO: 674983 - DNA, 20 bp, mouse
ggactcaggcagtccggaac

SEQ ID NO: 674984 - DNA, 20 bp, mouse
gaaactggcctcaccaagga

SEQ ID NO: 674985 - DNA, 20 bp, mouse
gccacgtggccaaccaggta

SEQ ID NO: 674986 - DNA, 20 bp, mouse
gcaccggctgccggccctgg

SEQ ID NO: 674987 - DNA, 20 bp, mouse
ggagtctgctagaagtcggg

SEQ ID NO: 674988 - DNA, 20 bp, mouse
ggcccggcggaaatgacgag

SEQ ID NO: 674989 - DNA, 20 bp, mouse
gcgagtgcgacccccggggc

SEQ ID NO: 674990 - DNA, 20 bp, mouse
gagactcgcgggccaggtgt

SEQ ID NO: 674991 - DNA, 20 bp, mouse
gcggccgagtgcgacccccg

SEQ ID NO: 674992 - DNA, 20 bp, mouse
ggggctgcggagagatattt

SEQ ID NO: 674993 - DNA, 20 bp, mouse
ggcacagggctcgcgcgcac

SEQ ID NO: 674994 - DNA, 20 bp, mouse
gctggcccacgcacgcgcac

SEQ ID NO: 674995 - DNA, 20 bp, mouse
gggaccgcgcggcggcgagc

SEQ ID NO: 674996 - DNA, 20 bp, mouse
gtccggagctgggacgtagg

SEQ ID NO: 674997 - DNA, 20 bp, mouse
gagcgggagcaacacgtgag

SEQ ID NO: 674998 - DNA, 20 bp, mouse
ggtcccagctccggacgcca

SEQ ID NO: 674999 - DNA, 20 bp, mouse
gtccagcccaccccttgaag

SEQ ID NO: 675000 - DNA, 20 bp, mouse
ggctgccggaataagagagg

SEQ ID NO: 675001 - DNA, 20 bp, mouse
ggccgcgatgacgtagactc

SEQ ID NO: 675002 - DNA, 20 bp, mouse
gcgaagaggtcccagcttag

SEQ ID NO: 675003 - DNA, 20 bp, mouse
ggatccctggcgtccggagc

SEQ ID NO: 675004 - DNA, 20 bp, mouse
gccctcctacgtcccagctc

SEQ ID NO: 675005 - DNA, 20 bp, mouse
ggcgtccggagctgggacgt

SEQ ID NO: 675006 - DNA, 20 bp, mouse
gagaagggtggaaaaggggt

SEQ ID NO: 675007 - DNA, 20 bp, mouse
gtggcaccccacacatactc

SEQ ID NO: 675008 - DNA, 20 bp, mouse
gcccccgtggccaatgggac

SEQ ID NO: 675009 - DNA, 20 bp, mouse
ggggctgaatgccttattct

SEQ ID NO: 675010 - DNA, 20 bp, mouse
gaggggaaggctctgtgtag

SEQ ID NO: 675011 - DNA, 20 bp, mouse
gatgtcagagccttggtatt

SEQ ID NO: 675012 - DNA, 20 bp, mouse
gacagttggcatggggagaa

SEQ ID NO: 675013 - DNA, 20 bp, mouse
ggggtggccagagtatgtgt

SEQ ID NO: 675014 - DNA, 20 bp, mouse
gcagtcagctcccaatacca

SEQ ID NO: 675015 - DNA, 20 bp, mouse
gggtgcagcggttctgtctt

SEQ ID NO: 675016 - DNA, 20 bp, mouse
ggggtcccggcggccgaggg

SEQ ID NO: 675017 - DNA, 20 bp, mouse
gacggcgggcccctcctgat

SEQ ID NO: 675018 - DNA, 20 bp, mouse
gctgatcggccgggatgcta

SEQ ID NO: 675019 - DNA, 20 bp, mouse
gtggaagcgccgaattcctg

SEQ ID NO: 675020 - DNA, 20 bp, mouse
gcgggcccctcctgatcggc

SEQ ID NO: 675021 - DNA, 20 bp, mouse
gcatcccggccgatcaggag

SEQ ID NO: 675022 - DNA, 20 bp, mouse
gcgggatgctagggtggctc

SEQ ID NO: 675023 - DNA, 20 bp, mouse
gtgctctgccagccaatcgg

SEQ ID NO: 675024 - DNA, 20 bp, mouse
ggatgctagggtggctccgg

SEQ ID NO: 675025 - DNA, 20 bp, mouse
gttgtagttgcgggaaactg

SEQ ID NO: 675026 - DNA, 20 bp, mouse
ggggctgggaccccgcggga

SEQ ID NO: 675027 - DNA, 20 bp, mouse
ggtcctaggtggcgtgaggg

SEQ ID NO: 675028 - DNA, 20 bp, mouse
gcctcctccccgctggtcag

SEQ ID NO: 675029 - DNA, 20 bp, mouse
ggaggtcctaggtggcgtga

SEQ ID NO: 675030 - DNA, 20 bp, mouse
ggtcgcagcccgctgaccag

SEQ ID NO: 675031 - DNA, 20 bp, mouse
gggggcgccgaggtcctagg

SEQ ID NO: 675032 - DNA, 20 bp, mouse
ggcgcggcgctccctcccgc

SEQ ID NO: 675033 - DNA, 20 bp, mouse
gaagcccctaggcgccgggg

SEQ ID NO: 675034 - DNA, 20 bp, mouse
gtagcccgggaggagacgga

SEQ ID NO: 675035 - DNA, 20 bp, mouse
gcggccaatggcagcgcggc

SEQ ID NO: 675036 - DNA, 20 bp, mouse
gcgcgcaaggggagcacacg

SEQ ID NO: 675037 - DNA, 20 bp, mouse
gggagtggtaggaacccgcc

SEQ ID NO: 675038 - DNA, 20 bp, mouse
gtgcgcgcgtgggctggagg

SEQ ID NO: 675039 - DNA, 20 bp, mouse
ggtgctccccttgcgcgcgt

SEQ ID NO: 675040 - DNA, 20 bp, mouse
gtccagcccacgcgcgcaag

SEQ ID NO: 675041 - DNA, 20 bp, mouse
gaagccgagcgcgagctgga

SEQ ID NO: 675042 - DNA, 20 bp, mouse
ggaggaggaactacagatgt

SEQ ID NO: 675043 - DNA, 20 bp, mouse
gcctccctccagctcgcgct

SEQ ID NO: 675044 - DNA, 20 bp, mouse
ggaaggctgggtttggagca

SEQ ID NO: 675045 - DNA, 20 bp, mouse
gcctgcctggggctggattc

SEQ ID NO: 675046 - DNA, 20 bp, mouse
ggaggaacccccgggctcga

SEQ ID NO: 675047 - DNA, 20 bp, mouse
gcaccaatggcacgggaggt

SEQ ID NO: 675048 - DNA, 20 bp, mouse
gcgtgccgcaccaatggcac

SEQ ID NO: 675049 - DNA, 20 bp, mouse
gatgagcgctgtagggatgg

SEQ ID NO: 675050 - DNA, 20 bp, mouse
gcgggtgcggcgctccctgt

SEQ ID NO: 675051 - DNA, 20 bp, mouse
ggaacccccgggctcgaggg

SEQ ID NO: 675052 - DNA, 20 bp, mouse
gaatggcacgggaggtgggc

SEQ ID NO: 675053 - DNA, 20 bp, mouse
gagtcggcgtgccgcaccaa

SEQ ID NO: 675054 - DNA, 20 bp, mouse
ggcgggcacccgctcttgat

SEQ ID NO: 675055 - DNA, 20 bp, mouse
ggtgcccgccttcccagcca

SEQ ID NO: 675056 - DNA, 20 bp, mouse
ggggcgagccggaggggcgt

SEQ ID NO: 675057 - DNA, 20 bp, mouse
gcgtggggctccgcaggcaa

SEQ ID NO: 675058 - DNA, 20 bp, mouse
ggcggggcggctgtctggga

SEQ ID NO: 675059 - DNA, 20 bp, mouse
gggctgcaacaacagaggcg

SEQ ID NO: 675060 - DNA, 20 bp, mouse
gccgcgtcctcccttgcctg

SEQ ID NO: 675061 - DNA, 20 bp, mouse
ggtaaacaagcggcgcgggg

SEQ ID NO: 675062 - DNA, 20 bp, mouse
ggggagtaaacaagcggcgc

SEQ ID NO: 675063 - DNA, 20 bp, mouse
gggacgcggggcggctgtct

SEQ ID NO: 675064 - DNA, 20 bp, mouse
gcggctgtctgggacggcct

SEQ ID NO: 675065 - DNA, 20 bp, mouse
gagaaccagggactgggcac

SEQ ID NO: 675066 - DNA, 20 bp, mouse
gtggccgctctgcatgatgc

SEQ ID NO: 675067 - DNA, 20 bp, mouse
gcctacagcgacctcagcaa

SEQ ID NO: 675068 - DNA, 20 bp, mouse
gctgaagtctaggacagtgc

SEQ ID NO: 675069 - DNA, 20 bp, mouse
gctgcgctcccggaccgtgg

SEQ ID NO: 675070 - DNA, 20 bp, mouse
gggcgaggacgctgaagtct

SEQ ID NO: 675071 - DNA, 20 bp, mouse
ggtgctgcgctcccggaccg

SEQ ID NO: 675072 - DNA, 20 bp, mouse
gagcgcggccggggcgtctg

SEQ ID NO: 675073 - DNA, 20 bp, mouse
gtgctggagctggcgcgcgg

SEQ ID NO: 675074 - DNA, 20 bp, mouse
gggcgtgagcacgtcctcca

SEQ ID NO: 675075 - DNA, 20 bp, mouse
ggctctgcatgatgctggcg

SEQ ID NO: 675076 - DNA, 20 bp, mouse
gccgcgccgttctaccttaa

SEQ ID NO: 675077 - DNA, 20 bp, mouse
gaacggagcgacagagtgca

SEQ ID NO: 675078 - DNA, 20 bp, mouse
ggctgggcgcacccccgctg

SEQ ID NO: 675079 - DNA, 20 bp, mouse
gggctcgcgcgcccggctta

SEQ ID NO: 675080 - DNA, 20 bp, mouse
ggctccctaaggaggagcgc

SEQ ID NO: 675081 - DNA, 20 bp, mouse
ggaggagcgcgggagaagcc

SEQ ID NO: 675082 - DNA, 20 bp, mouse
gggaagcaaccgagcgcgtg

SEQ ID NO: 675083 - DNA, 20 bp, mouse
gcgcgagccgtgggtagggg

SEQ ID NO: 675084 - DNA, 20 bp, mouse
gggagaagcccggtgccgcg

SEQ ID NO: 675085 - DNA, 20 bp, mouse
ggccgcgcggaagcttggct

SEQ ID NO: 675086 - DNA, 20 bp, mouse
ggggcagcgaatggtgaaat

SEQ ID NO: 675087 - DNA, 20 bp, mouse
gcagactcggacccagtccc

SEQ ID NO: 675088 - DNA, 20 bp, mouse
gggcctgagccccgcaaact

SEQ ID NO: 675089 - DNA, 20 bp, mouse
gaggctgtgcgggttcccag

SEQ ID NO: 675090 - DNA, 20 bp, mouse
gggccgcgcgctgaccgcaa

SEQ ID NO: 675091 - DNA, 20 bp, mouse
gcgcgcgctgaccgcaacgg

SEQ ID NO: 675092 - DNA, 20 bp, mouse
gtctgggcgcctgcgcaccc

SEQ ID NO: 675093 - DNA, 20 bp, mouse
ggccccgcaaactaggagtc

SEQ ID NO: 675094 - DNA, 20 bp, mouse
gcgagtgattagtgtgtgat

SEQ ID NO: 675095 - DNA, 20 bp, mouse
gggccctagcgcccagccaa

SEQ ID NO: 675096 - DNA, 20 bp, mouse
gcagctgggcgtgggaatta

SEQ ID NO: 675097 - DNA, 20 bp, mouse
gaagggagacgctacttccg

SEQ ID NO: 675098 - DNA, 20 bp, mouse
gacgggacggaagctgtgga

SEQ ID NO: 675099 - DNA, 20 bp, mouse
gggagacgctacttccgggg

SEQ ID NO: 675100 - DNA, 20 bp, mouse
gtgggcgtgggaattagggc

SEQ ID NO: 675101 - DNA, 20 bp, mouse
gggcggggccagctgggcgt

SEQ ID NO: 675102 - DNA, 20 bp, mouse
ggaaaacagccctgcaccgg

SEQ ID NO: 675103 - DNA, 20 bp, mouse
gcacagcttccgtcccgtag

SEQ ID NO: 675104 - DNA, 20 bp, mouse
gcccggaagtacactagtgt

SEQ ID NO: 675105 - DNA, 20 bp, mouse
ggcagaaggacgcgcttccg

SEQ ID NO: 675106 - DNA, 20 bp, mouse
gtccgctcggccagcgtcgt

SEQ ID NO: 675107 - DNA, 20 bp, mouse
ggggcgccgtgtccggaagg

SEQ ID NO: 675108 - DNA, 20 bp, mouse
gcgagcggaacggagacaca

SEQ ID NO: 675109 - DNA, 20 bp, mouse
gaggttccggagacgcgagt

SEQ ID NO: 675110 - DNA, 20 bp, mouse
gagtgcctaagtcagacgag

SEQ ID NO: 675111 - DNA, 20 bp, mouse
ggcggggcgccgtgtccgga

SEQ ID NO: 675112 - DNA, 20 bp, mouse
ggtgggcggggcgccgtgtc

SEQ ID NO: 675113 - DNA, 20 bp, mouse
ggccagcgtcgtcggtctgt

SEQ ID NO: 675114 - DNA, 20 bp, mouse
gaccgacgacgctggccgag

SEQ ID NO: 675115 - DNA, 20 bp, mouse
gttccggagacgcgagtggg

SEQ ID NO: 675116 - DNA, 20 bp, mouse
gcgggcgagcgcggcctcgg

SEQ ID NO: 675117 - DNA, 20 bp, mouse
gaggcggcggaagcccggga

SEQ ID NO: 675118 - DNA, 20 bp, mouse
gacgctgcgcgtcccccggt

SEQ ID NO: 675119 - DNA, 20 bp, mouse
gaaggtgcggcgctgtcttg

SEQ ID NO: 675120 - DNA, 20 bp, mouse
ggcgtgcggcgggtgtctgg

SEQ ID NO: 675121 - DNA, 20 bp, mouse
ggagaagccgagggtggcgt

SEQ ID NO: 675122 - DNA, 20 bp, mouse
ggcagctcccggcgtggcgg

SEQ ID NO: 675123 - DNA, 20 bp, mouse
gacctcctgcgggctgtccc

SEQ ID NO: 675124 - DNA, 20 bp, mouse
ggcccgcaggaggtgctcgg

SEQ ID NO: 675125 - DNA, 20 bp, mouse
gcgcccccgagcacctcctg

SEQ ID NO: 675126 - DNA, 20 bp, mouse
gggcgcagagcgacgtactg

SEQ ID NO: 675127 - DNA, 20 bp, mouse
ggacacccaggtcctcgcgc

SEQ ID NO: 675128 - DNA, 20 bp, mouse
ggggcgggccggcgccagag

SEQ ID NO: 675129 - DNA, 20 bp, mouse
gcgaccgagtaggggattca

SEQ ID NO: 675130 - DNA, 20 bp, mouse
ggggcgcgaaagccggaagt

SEQ ID NO: 675131 - DNA, 20 bp, mouse
ggaacgggcccggtccaaga

SEQ ID NO: 675132 - DNA, 20 bp, mouse
gcgggcccgttcagcttccg

SEQ ID NO: 675133 - DNA, 20 bp, mouse
gcgggcgctatcgcgataag

SEQ ID NO: 675134 - DNA, 20 bp, mouse
gaccaatggggcgcgcctaa

SEQ ID NO: 675135 - DNA, 20 bp, mouse
gtcaaggaaaggcccggcag

SEQ ID NO: 675136 - DNA, 20 bp, mouse
gccggggcggttactatcgg

SEQ ID NO: 675137 - DNA, 20 bp, mouse
ggccccggggcggttactat

SEQ ID NO: 675138 - DNA, 20 bp, mouse
gggcgagtgggaggttgcgg

SEQ ID NO: 675139 - DNA, 20 bp, mouse
ggcgcaggcgcatgccgatc

SEQ ID NO: 675140 - DNA, 20 bp, mouse
gccgccccgcccagccggat

SEQ ID NO: 675141 - DNA, 20 bp, mouse
ggcgggcgagtgggaggttg

SEQ ID NO: 675142 - DNA, 20 bp, mouse
ggactggtccactgcaccct

SEQ ID NO: 675143 - DNA, 20 bp, mouse
gtaaccgccccggggcaggc

SEQ ID NO: 675144 - DNA, 20 bp, mouse
gacacagtagccacacacgc

SEQ ID NO: 675145 - DNA, 20 bp, mouse
ggggcgggacaagcggcagg

SEQ ID NO: 675146 - DNA, 20 bp, mouse
gcggacggggctaaagcgtc

SEQ ID NO: 675147 - DNA, 20 bp, mouse
gcaacatcccggcttctcat

SEQ ID NO: 675148 - DNA, 20 bp, mouse
gtcactgctccgagaccggg

SEQ ID NO: 675149 - DNA, 20 bp, mouse
gactatcccgcgtcgtgcgg

SEQ ID NO: 675150 - DNA, 20 bp, mouse
gagaagccgggatgttggag

SEQ ID NO: 675151 - DNA, 20 bp, mouse
gagaaggcgcggagaaggaa

SEQ ID NO: 675152 - DNA, 20 bp, mouse
gaccggggggaacgcggacg

SEQ ID NO: 675153 - DNA, 20 bp, mouse
gtccgcgttccccccggtct

SEQ ID NO: 675154 - DNA, 20 bp, mouse
ggccccgtccgcgttccccc

SEQ ID NO: 675155 - DNA, 20 bp, mouse
ggtccacccccgcacgacgc

SEQ ID NO: 675156 - DNA, 20 bp, mouse
gactccccggcgccgagggg

SEQ ID NO: 675157 - DNA, 20 bp, mouse
ggccccggcgcgccgcgctt

SEQ ID NO: 675158 - DNA, 20 bp, mouse
ggcgggagtcagtcactccc

SEQ ID NO: 675159 - DNA, 20 bp, mouse
gcgtacgattagcagaacct

SEQ ID NO: 675160 - DNA, 20 bp, mouse
gctaatcgtacgagtcttct

SEQ ID NO: 675161 - DNA, 20 bp, mouse
gtgcagagagtgcgaggagg

SEQ ID NO: 675162 - DNA, 20 bp, mouse
gtcgccctcgctggtgtttt

SEQ ID NO: 675163 - DNA, 20 bp, mouse
gcccgaagcgcggcgcgccg

SEQ ID NO: 675164 - DNA, 20 bp, mouse
gagtcactccccggcgccga

SEQ ID NO: 675165 - DNA, 20 bp, mouse
gcgcgggacggccaagcgcc

SEQ ID NO: 675166 - DNA, 20 bp, mouse
ggatggtggggagtatcaga

SEQ ID NO: 675167 - DNA, 20 bp, mouse
gaacactgaccctgtaaatc

SEQ ID NO: 675168 - DNA, 20 bp, mouse
gccatctactgcctaataac

SEQ ID NO: 675169 - DNA, 20 bp, mouse
gcagatgaacaatgcctaga

SEQ ID NO: 675170 - DNA, 20 bp, mouse
gaaggacagatggaaatcgc

SEQ ID NO: 675171 - DNA, 20 bp, mouse
gtttcccagtcattgaagac

SEQ ID NO: 675172 - DNA, 20 bp, mouse
ggacagatggaaatcgctgg

SEQ ID NO: 675173 - DNA, 20 bp, mouse
gtattaggcagtagatggtg

SEQ ID NO: 675174 - DNA, 20 bp, mouse
gaaaaagctcaatagggtgg

SEQ ID NO: 675175 - DNA, 20 bp, mouse
gagaaggagccaaaaatgaa

SEQ ID NO: 675176 - DNA, 20 bp, mouse
gaccccggggtcagttagct

SEQ ID NO: 675177 - DNA, 20 bp, mouse
gctaactgaccccggggtgg

SEQ ID NO: 675178 - DNA, 20 bp, mouse
gctggagaagggcgactcgt

SEQ ID NO: 675179 - DNA, 20 bp, mouse
gcggaaccccggtgtgctcc

SEQ ID NO: 675180 - DNA, 20 bp, mouse
ggcccctgggcaccccgtcc

SEQ ID NO: 675181 - DNA, 20 bp, mouse
ggtgacgaacgccccggcgt

SEQ ID NO: 675182 - DNA, 20 bp, mouse
ggcccccgccggatctactt

SEQ ID NO: 675183 - DNA, 20 bp, mouse
ggtgggcggggccctccctc

SEQ ID NO: 675184 - DNA, 20 bp, mouse
gtgcccgccccgcctcctga

SEQ ID NO: 675185 - DNA, 20 bp, mouse
gcgatcgagcacggcccgga

SEQ ID NO: 675186 - DNA, 20 bp, mouse
ggagagtaggcgagtcggga

SEQ ID NO: 675187 - DNA, 20 bp, mouse
gcgcccagagcggccgacga

SEQ ID NO: 675188 - DNA, 20 bp, mouse
ggggacggagccgagaccgg

SEQ ID NO: 675189 - DNA, 20 bp, mouse
gcaggcgtgcgcggtcccgc

SEQ ID NO: 675190 - DNA, 20 bp, mouse
gggcgcagagcgagaaagtt

SEQ ID NO: 675191 - DNA, 20 bp, mouse
gtgcgcggtcccgccggtct

SEQ ID NO: 675192 - DNA, 20 bp, mouse
gctggagtgacgcggagagt

SEQ ID NO: 675193 - DNA, 20 bp, mouse
gagggcgcgtgcgtaaaacg

SEQ ID NO: 675194 - DNA, 20 bp, mouse
ggtagagtggtgcaacctct

SEQ ID NO: 675195 - DNA, 20 bp, mouse
gagaaagttgggtttggcgg

SEQ ID NO: 675196 - DNA, 20 bp, mouse
ggggccgcccgcctgcgtga

SEQ ID NO: 675197 - DNA, 20 bp, mouse
gggcgcgtgcgcagaggctc

SEQ ID NO: 675198 - DNA, 20 bp, mouse
ggaagcagcggtctgagcct

SEQ ID NO: 675199 - DNA, 20 bp, mouse
ggcggtgcgcccactcatca

SEQ ID NO: 675200 - DNA, 20 bp, mouse
ggggacaatggtcccacaga

SEQ ID NO: 675201 - DNA, 20 bp, mouse
gccgcccccaggctatgaaa

SEQ ID NO: 675202 - DNA, 20 bp, mouse
gtgagggacacgggcgtctc

SEQ ID NO: 675203 - DNA, 20 bp, mouse
gaaagggaccctgcgtgggg

SEQ ID NO: 675204 - DNA, 20 bp, mouse
gcccccaatctgtaggatta

SEQ ID NO: 675205 - DNA, 20 bp, mouse
gtatgaaagggaccctgcgt

SEQ ID NO: 675206 - DNA, 20 bp, mouse
gcgggctcgggcagcggctg

SEQ ID NO: 675207 - DNA, 20 bp, mouse
ggggggcgcgtcagacggaa

SEQ ID NO: 675208 - DNA, 20 bp, mouse
gtcctcgcgggctcgggcag

SEQ ID NO: 675209 - DNA, 20 bp, mouse
gagcggctgcggcgcggtga

SEQ ID NO: 675210 - DNA, 20 bp, mouse
gccgagcccgcgaggagcca

SEQ ID NO: 675211 - DNA, 20 bp, mouse
gccgtctgacgcgcccccgg

SEQ ID NO: 675212 - DNA, 20 bp, mouse
gcgcagccctggctcctcgc

SEQ ID NO: 675213 - DNA, 20 bp, mouse
gccggcgcgggtggcacctc

SEQ ID NO: 675214 - DNA, 20 bp, mouse
gcacgcgcgggcgtcccatc

SEQ ID NO: 675215 - DNA, 20 bp, mouse
gcggtgatggcgagcagcgg

SEQ ID NO: 675216 - DNA, 20 bp, mouse
gcgcctagcgaacgcggcac

SEQ ID NO: 675217 - DNA, 20 bp, mouse
ggccgggcgcgcagactcgt

SEQ ID NO: 675218 - DNA, 20 bp, mouse
gggcgaaccaggaggtacga

SEQ ID NO: 675219 - DNA, 20 bp, mouse
gtgagcgccgcgcctgtcgt

SEQ ID NO: 675220 - DNA, 20 bp, mouse
gcctcccggcgcccgacgac

SEQ ID NO: 675221 - DNA, 20 bp, mouse
gtctccggagctatgagcac

SEQ ID NO: 675222 - DNA, 20 bp, mouse
gggcgctcaccaggcgaacc

SEQ ID NO: 675223 - DNA, 20 bp, mouse
gcacgggctgagaacactgc

SEQ ID NO: 675224 - DNA, 20 bp, mouse
gtataaacgcctagcgaacg

SEQ ID NO: 675225 - DNA, 20 bp, mouse
gagacccggagctctcaggt

SEQ ID NO: 675226 - DNA, 20 bp, mouse
ggcagtcgttggcaccggaa

SEQ ID NO: 675227 - DNA, 20 bp, mouse
gcgcgctcggggcgcacaaa

SEQ ID NO: 675228 - DNA, 20 bp, mouse
gcatgacaactgcgctgaaa

SEQ ID NO: 675229 - DNA, 20 bp, mouse
gccagatggcggggaaacgt

SEQ ID NO: 675230 - DNA, 20 bp, mouse
gcgtgcctggggtcggttcc

SEQ ID NO: 675231 - DNA, 20 bp, mouse
gatcagggagtgttcctctc

SEQ ID NO: 675232 - DNA, 20 bp, mouse
gtccaccaggaaccgacccc

SEQ ID NO: 675233 - DNA, 20 bp, mouse
ggctgcatgacaaatgaact

SEQ ID NO: 675234 - DNA, 20 bp, mouse
gtaaagtgcgtgcctggggt

SEQ ID NO: 675235 - DNA, 20 bp, mouse
gttcacactgcgtgtgaaag

SEQ ID NO: 675236 - DNA, 20 bp, mouse
gtaggtgcctagttaagtgc

SEQ ID NO: 675237 - DNA, 20 bp, mouse
ggcacctaagcggagatctg

SEQ ID NO: 675238 - DNA, 20 bp, mouse
gggcttagggtcagtttcgg

SEQ ID NO: 675239 - DNA, 20 bp, mouse
gctcgcgcgagagtttggag

SEQ ID NO: 675240 - DNA, 20 bp, mouse
gcgaggcagcgaggacccct

SEQ ID NO: 675241 - DNA, 20 bp, mouse
gcagctggctgggaaaaacg

SEQ ID NO: 675242 - DNA, 20 bp, mouse
ggggtcctcaagtcttccaa

SEQ ID NO: 675243 - DNA, 20 bp, mouse
gagtttggaggggcgggctt

SEQ ID NO: 675244 - DNA, 20 bp, mouse
gcagcttcccgcacttaact

SEQ ID NO: 675245 - DNA, 20 bp, mouse
ggggaaaaacggggctgtcc

SEQ ID NO: 675246 - DNA, 20 bp, mouse
gcgcgggcgacgcaaccaat

SEQ ID NO: 675247 - DNA, 20 bp, mouse
gagagagcggatggtggctt

SEQ ID NO: 675248 - DNA, 20 bp, mouse
gcacgcccggtagcctctag

SEQ ID NO: 675249 - DNA, 20 bp, mouse
gaaagatagtccgttatcca

SEQ ID NO: 675250 - DNA, 20 bp, mouse
gcgaaaccgaccaaggcccg

SEQ ID NO: 675251 - DNA, 20 bp, mouse
ggtcgcccgcgggccttggt

SEQ ID NO: 675252 - DNA, 20 bp, mouse
ggctccgcgcgcgctgccgg

SEQ ID NO: 675253 - DNA, 20 bp, mouse
ggacccggcggcgcttcctc

SEQ ID NO: 675254 - DNA, 20 bp, mouse
gggactgcgcacgtgcctct

SEQ ID NO: 675255 - DNA, 20 bp, mouse
gcagtcccggaagcggccgg

SEQ ID NO: 675256 - DNA, 20 bp, mouse
gtcagagccagcccgaaagt

SEQ ID NO: 675257 - DNA, 20 bp, mouse
ggctccacccactttcgggc

SEQ ID NO: 675258 - DNA, 20 bp, mouse
gccctgacaggagtaggtcc

SEQ ID NO: 675259 - DNA, 20 bp, mouse
ggagccagcccgaaagtggg

SEQ ID NO: 675260 - DNA, 20 bp, mouse
ggctggcgggggaaagtctg

SEQ ID NO: 675261 - DNA, 20 bp, mouse
gcgtgactgcactggaagga

SEQ ID NO: 675262 - DNA, 20 bp, mouse
gaaagggcccatgtgaggac

SEQ ID NO: 675263 - DNA, 20 bp, mouse
gaccctgtgcgtgactgcac

SEQ ID NO: 675264 - DNA, 20 bp, mouse
ggcgtgatggctcagttttg

SEQ ID NO: 675265 - DNA, 20 bp, mouse
gcgtgaggagaccctttgaa

SEQ ID NO: 675266 - DNA, 20 bp, mouse
ggggctaggagggacggccc

SEQ ID NO: 675267 - DNA, 20 bp, mouse
ggaggccgcggggtcgttgg

SEQ ID NO: 675268 - DNA, 20 bp, mouse
gagagtgaggatgacacagt

SEQ ID NO: 675269 - DNA, 20 bp, mouse
gcctccccgcgcagatccct

SEQ ID NO: 675270 - DNA, 20 bp, mouse
gcaccctggcgtggccaaag

SEQ ID NO: 675271 - DNA, 20 bp, mouse
gtggccacgccagggtggga

SEQ ID NO: 675272 - DNA, 20 bp, mouse
gccgccgcggcgctggcccg

SEQ ID NO: 675273 - DNA, 20 bp, mouse
ggcccgggggctaggaggga

SEQ ID NO: 675274 - DNA, 20 bp, mouse
gtccgccaagggatctgcgc

SEQ ID NO: 675275 - DNA, 20 bp, mouse
gcggcgcagaggggagggtc

SEQ ID NO: 675276 - DNA, 20 bp, mouse
gtctggccaggggagggcat

SEQ ID NO: 675277 - DNA, 20 bp, mouse
gccagaggggaagtggtaac

SEQ ID NO: 675278 - DNA, 20 bp, mouse
ggcaggacagcatacacccg

SEQ ID NO: 675279 - DNA, 20 bp, mouse
gaaagctctgggcgagaggg

SEQ ID NO: 675280 - DNA, 20 bp, mouse
gccgcagggcaagaacactg

SEQ ID NO: 675281 - DNA, 20 bp, mouse
gtcctaggaactctggccag

SEQ ID NO: 675282 - DNA, 20 bp, mouse
ggaagagagaattcaaccgc

SEQ ID NO: 675283 - DNA, 20 bp, mouse
gtctctcttcctaggaactc

SEQ ID NO: 675284 - DNA, 20 bp, mouse
gagaaacttgggttctaatc

SEQ ID NO: 675285 - DNA, 20 bp, mouse
ggagatctggccttccgtac

SEQ ID NO: 675286 - DNA, 20 bp, mouse
gcacacagcaacaggaagcc

SEQ ID NO: 675287 - DNA, 20 bp, mouse
gataccctctgcaagtcaca

SEQ ID NO: 675288 - DNA, 20 bp, mouse
ggcacccatgtgacttgcag

SEQ ID NO: 675289 - DNA, 20 bp, mouse
gggacagtaacagtcgtctg

SEQ ID NO: 675290 - DNA, 20 bp, mouse
gtggcctccttaagaatggg

SEQ ID NO: 675291 - DNA, 20 bp, mouse
gtctagaagacctatttcta

SEQ ID NO: 675292 - DNA, 20 bp, mouse
gacaggatgcacacagcaac

SEQ ID NO: 675293 - DNA, 20 bp, mouse
gacatccttgccctagaaat

SEQ ID NO: 675294 - DNA, 20 bp, mouse
gcgcttggcctccttaagaa

SEQ ID NO: 675295 - DNA, 20 bp, mouse
gcccccccccattcttaagg

SEQ ID NO: 675296 - DNA, 20 bp, mouse
ggggccctgcacgcacgcga

SEQ ID NO: 675297 - DNA, 20 bp, mouse
gaacagcaccggatgcgagg

SEQ ID NO: 675298 - DNA, 20 bp, mouse
gaccggatgcgaggaggatg

SEQ ID NO: 675299 - DNA, 20 bp, mouse
gtgcgtgcagggccctgcgt

SEQ ID NO: 675300 - DNA, 20 bp, mouse
gtagaacagcaccggatgcg

SEQ ID NO: 675301 - DNA, 20 bp, mouse
ggggctcgcagtgactggac

SEQ ID NO: 675302 - DNA, 20 bp, mouse
gccccagagtctaggcccta

SEQ ID NO: 675303 - DNA, 20 bp, mouse
gcatccggtgctgttctagg

SEQ ID NO: 675304 - DNA, 20 bp, mouse
gcagggccctgcgtggggag

SEQ ID NO: 675305 - DNA, 20 bp, mouse
ggaggcaagtggcaggaaac

SEQ ID NO: 675306 - DNA, 20 bp, mouse
ggctagagaggaagtgcgga

SEQ ID NO: 675307 - DNA, 20 bp, mouse
gcggaagtaaacattacgaa

SEQ ID NO: 675308 - DNA, 20 bp, mouse
gagcggaagcgagtgagcaa

SEQ ID NO: 675309 - DNA, 20 bp, mouse
gtccctctgcgcaaccctcc

SEQ ID NO: 675310 - DNA, 20 bp, mouse
gtccacgcacaggagcctgg

SEQ ID NO: 675311 - DNA, 20 bp, mouse
gcgcggctagagaggaagtg

SEQ ID NO: 675312 - DNA, 20 bp, mouse
gacccggagagtccacgcac

SEQ ID NO: 675313 - DNA, 20 bp, mouse
gagagaggaagtgcggaggg

SEQ ID NO: 675314 - DNA, 20 bp, mouse
gtccgcccggcctagtgtgg

SEQ ID NO: 675315 - DNA, 20 bp, mouse
ggcgagtgagcaaaggactg

SEQ ID NO: 675316 - DNA, 20 bp, mouse
gcgccctaagccgtcaagcc

SEQ ID NO: 675317 - DNA, 20 bp, mouse
ggtctctccgccctagagga

SEQ ID NO: 675318 - DNA, 20 bp, mouse
ggtagtctttgacttcagca

SEQ ID NO: 675319 - DNA, 20 bp, mouse
ggtcaagcccggaactcgcc

SEQ ID NO: 675320 - DNA, 20 bp, mouse
gttagggcggagcagcaaca

SEQ ID NO: 675321 - DNA, 20 bp, mouse
gtcagcgcatcgacccgtcg

SEQ ID NO: 675322 - DNA, 20 bp, mouse
gggacccggaacatcatgac

SEQ ID NO: 675323 - DNA, 20 bp, mouse
gagtccacgtggagttttct

SEQ ID NO: 675324 - DNA, 20 bp, mouse
gacaattcctggcgagttcc

SEQ ID NO: 675325 - DNA, 20 bp, mouse
gctttcctgtccctcctcta

SEQ ID NO: 675326 - DNA, 20 bp, mouse
gagtgctaagtactgagtgg

SEQ ID NO: 675327 - DNA, 20 bp, mouse
gatgaaggcagacgcttcga

SEQ ID NO: 675328 - DNA, 20 bp, mouse
gacaagtgctaagtactgag

SEQ ID NO: 675329 - DNA, 20 bp, mouse
gctactgggcattctctaat

SEQ ID NO: 675330 - DNA, 20 bp, mouse
gtgggctgaacattagtctt

SEQ ID NO: 675331 - DNA, 20 bp, mouse
gagactacattaggcagggg

SEQ ID NO: 675332 - DNA, 20 bp, mouse
gttgtgcctgtggaatcaaa

SEQ ID NO: 675333 - DNA, 20 bp, mouse
ggcccagtagatttagtctg

SEQ ID NO: 675334 - DNA, 20 bp, mouse
gttgctgccacctctgagtc

SEQ ID NO: 675335 - DNA, 20 bp, mouse
gactagactacattaggcag

SEQ ID NO: 675336 - DNA, 20 bp, mouse
gcgggcgcccgcggtcacat

SEQ ID NO: 675337 - DNA, 20 bp, mouse
gcggggagacaaggcgagag

SEQ ID NO: 675338 - DNA, 20 bp, mouse
gcccccgcgcgcctccgctt

SEQ ID NO: 675339 - DNA, 20 bp, mouse
ggggtcgtggtgcgcggcag

SEQ ID NO: 675340 - DNA, 20 bp, mouse
gcccgcggtcacatgggcga

SEQ ID NO: 675341 - DNA, 20 bp, mouse
gtgcgcggcagcggaggcgc

SEQ ID NO: 675342 - DNA, 20 bp, mouse
gtcgtggtgcgcggcagcgg

SEQ ID NO: 675343 - DNA, 20 bp, mouse
ggcggggcgagtgggagtgg

SEQ ID NO: 675344 - DNA, 20 bp, mouse
gacgcgcggcacgctctcgg

SEQ ID NO: 675345 - DNA, 20 bp, mouse
gcacatgggcgagggaagga

SEQ ID NO: 675346 - DNA, 20 bp, mouse
gcctggaccaggtcaggttc

SEQ ID NO: 675347 - DNA, 20 bp, mouse
gggtaggcctggaccaggtc

SEQ ID NO: 675348 - DNA, 20 bp, mouse
gacacacacaaacgacacca

SEQ ID NO: 675349 - DNA, 20 bp, mouse
gcacgtagtctcatcagcat

SEQ ID NO: 675350 - DNA, 20 bp, mouse
gctcacaccggtctggggac

SEQ ID NO: 675351 - DNA, 20 bp, mouse
gggaccaggtcaggttctgg

SEQ ID NO: 675352 - DNA, 20 bp, mouse
gtacgtgctcacaccggtct

SEQ ID NO: 675353 - DNA, 20 bp, mouse
gactcctccagaacctgacc

SEQ ID NO: 675354 - DNA, 20 bp, mouse
gctgatggtaggcctggacc

SEQ ID NO: 675355 - DNA, 20 bp, mouse
ggtctttctgtgctgatggt

SEQ ID NO: 675356 - DNA, 20 bp, mouse
ggcccagctccgagcgcggg

SEQ ID NO: 675357 - DNA, 20 bp, mouse
gggcgatcgcggttcctagt

SEQ ID NO: 675358 - DNA, 20 bp, mouse
gcgggcccagctccgagcgc

SEQ ID NO: 675359 - DNA, 20 bp, mouse
gccgcctggtccggcgatcg

SEQ ID NO: 675360 - DNA, 20 bp, mouse
gggcccgcggcaagcccact

SEQ ID NO: 675361 - DNA, 20 bp, mouse
gtaggccctcggcggagcta

SEQ ID NO: 675362 - DNA, 20 bp, mouse
gcgaccagcaagttcattgc

SEQ ID NO: 675363 - DNA, 20 bp, mouse
gcacagttctggatcactgg

SEQ ID NO: 675364 - DNA, 20 bp, mouse
gaacgccctagctccgccga

SEQ ID NO: 675365 - DNA, 20 bp, mouse
gaagtcaggcacttcggact

SEQ ID NO: 675366 - DNA, 20 bp, mouse
ggaagagtccttgtagtccg

SEQ ID NO: 675367 - DNA, 20 bp, mouse
gacaaggactcttcgctggt

SEQ ID NO: 675368 - DNA, 20 bp, mouse
ggactacaaggactcttcgc

SEQ ID NO: 675369 - DNA, 20 bp, mouse
gcaaccaggggcaccagcag

SEQ ID NO: 675370 - DNA, 20 bp, mouse
gctcaactctagggtttctg

SEQ ID NO: 675371 - DNA, 20 bp, mouse
ggatgtcattctcaactcta

SEQ ID NO: 675372 - DNA, 20 bp, mouse
gttaaaggttccaagaggga

SEQ ID NO: 675373 - DNA, 20 bp, mouse
ggtcagagggcctctgagaa

SEQ ID NO: 675374 - DNA, 20 bp, mouse
gcctcagagtgcagttattg

SEQ ID NO: 675375 - DNA, 20 bp, mouse
gtgcccctggttgaatctcc

SEQ ID NO: 675376 - DNA, 20 bp, mouse
gcggagctggccaagcttga

SEQ ID NO: 675377 - DNA, 20 bp, mouse
gatggaagacggcagcgctc

SEQ ID NO: 675378 - DNA, 20 bp, mouse
ggccccgcacagcaaattgg

SEQ ID NO: 675379 - DNA, 20 bp, mouse
gtccggccgagcgttggctg

SEQ ID NO: 675380 - DNA, 20 bp, mouse
gcccgccgtccccaccctcc

SEQ ID NO: 675381 - DNA, 20 bp, mouse
ggcccagcccaaagctgcag

SEQ ID NO: 675382 - DNA, 20 bp, mouse
ggccaacgctcggccggaga

SEQ ID NO: 675383 - DNA, 20 bp, mouse
ggaggggaccgggataatgg

SEQ ID NO: 675384 - DNA, 20 bp, mouse
gagccgagccagccagtgag

SEQ ID NO: 675385 - DNA, 20 bp, mouse
gagtgagcggagcctgcgag

SEQ ID NO: 675386 - DNA, 20 bp, mouse
gaacagtatgtgcaactgat

SEQ ID NO: 675387 - DNA, 20 bp, mouse
gaatatccgaatccatgacc

SEQ ID NO: 675388 - DNA, 20 bp, mouse
gaacagttttgtaaaactaa

SEQ ID NO: 675389 - DNA, 20 bp, mouse
ggtttgcctggtcatggatt

SEQ ID NO: 675390 - DNA, 20 bp, mouse
gttatttgtttgcctggtca

SEQ ID NO: 675391 - DNA, 20 bp, mouse
gttgtatttatttgtttgcc

SEQ ID NO: 675392 - DNA, 20 bp, mouse
gacacaggaaccttgtacaa

SEQ ID NO: 675393 - DNA, 20 bp, mouse
gaaaagatttgtttaatcta

SEQ ID NO: 675394 - DNA, 20 bp, mouse
gtgtctgaaacatgtcagaa

SEQ ID NO: 675395 - DNA, 20 bp, mouse
ggaagaaactctctctttaa

SEQ ID NO: 675396 - DNA, 20 bp, mouse
ggcaccgccctgccctgggg

SEQ ID NO: 675397 - DNA, 20 bp, mouse
gtcctggagagggacataaa

SEQ ID NO: 675398 - DNA, 20 bp, mouse
ggggtcgcctccccagggca

SEQ ID NO: 675399 - DNA, 20 bp, mouse
gcacgcgggacactggtaaa

SEQ ID NO: 675400 - DNA, 20 bp, mouse
ggtgcaggtgctacgcctaa

SEQ ID NO: 675401 - DNA, 20 bp, mouse
gtgtcccgcgtgggtactcg

SEQ ID NO: 675402 - DNA, 20 bp, mouse
ggcgaccccgagtacccacg

SEQ ID NO: 675403 - DNA, 20 bp, mouse
gcctaagggtccactgcctc

SEQ ID NO: 675404 - DNA, 20 bp, mouse
gcactagcggaagactcata

SEQ ID NO: 675405 - DNA, 20 bp, mouse
gaaagggtgtgtttgtgcta

SEQ ID NO: 675406 - DNA, 20 bp, mouse
gtgacagcgcggagcgggag

SEQ ID NO: 675407 - DNA, 20 bp, mouse
ggccgcgcgccctgactggc

SEQ ID NO: 675408 - DNA, 20 bp, mouse
gccgcgccgcgcgccctgac

SEQ ID NO: 675409 - DNA, 20 bp, mouse
gggaggggcgcgggccactc

SEQ ID NO: 675410 - DNA, 20 bp, mouse
ggcggggcgcgtggacgcat

SEQ ID NO: 675411 - DNA, 20 bp, mouse
ggggagagacccagccagtc

SEQ ID NO: 675412 - DNA, 20 bp, mouse
ggaggcatacagtcttttac

SEQ ID NO: 675413 - DNA, 20 bp, mouse
ggacggtgacagcgcggagc

SEQ ID NO: 675414 - DNA, 20 bp, mouse
gcctggcgacggtgacagcg

SEQ ID NO: 675415 - DNA, 20 bp, mouse
ggacagtggcaggccaaggg

SEQ ID NO: 675416 - DNA, 20 bp, mouse
ggtcaggaatgcagcaggag

SEQ ID NO: 675417 - DNA, 20 bp, mouse
gcatgtgcaaagctcccgtt

SEQ ID NO: 675418 - DNA, 20 bp, mouse
gtaattgtctaggttccgtc

SEQ ID NO: 675419 - DNA, 20 bp, mouse
gagctgcctgagtctgtgaa

SEQ ID NO: 675420 - DNA, 20 bp, mouse
gtctagtcaaagaatgaggg

SEQ ID NO: 675421 - DNA, 20 bp, mouse
gcctcaagaactaattgtct

SEQ ID NO: 675422 - DNA, 20 bp, mouse
ggttccgtcaggaatgcagc

SEQ ID NO: 675423 - DNA, 20 bp, mouse
gggagccacgcaatactcag

SEQ ID NO: 675424 - DNA, 20 bp, mouse
gcaaggattaagccggtcaa

SEQ ID NO: 675425 - DNA, 20 bp, mouse
gtcccgtttggaatattcaa

SEQ ID NO: 675426 - DNA, 20 bp, mouse
gaacgtgcgtgccaggagaa

SEQ ID NO: 675427 - DNA, 20 bp, mouse
gcctcagccctattacgaaa

SEQ ID NO: 675428 - DNA, 20 bp, mouse
gaatacccccaattaaccca

SEQ ID NO: 675429 - DNA, 20 bp, mouse
gtcagccttgggttaattgg

SEQ ID NO: 675430 - DNA, 20 bp, mouse
gccaaggctgacaaggactg

SEQ ID NO: 675431 - DNA, 20 bp, mouse
gaccccgccctttcgtaata

SEQ ID NO: 675432 - DNA, 20 bp, mouse
ggacaaggactggggctaca

SEQ ID NO: 675433 - DNA, 20 bp, mouse
gctgaggcatgcgcttgcgc

SEQ ID NO: 675434 - DNA, 20 bp, mouse
gggggtagacaacctgccgt

SEQ ID NO: 675435 - DNA, 20 bp, mouse
ggcgtgccaggagaaaggct

SEQ ID NO: 675436 - DNA, 20 bp, mouse
gactcagaggggtttccagt

SEQ ID NO: 675437 - DNA, 20 bp, mouse
gtgggcagcgcgactcagag

SEQ ID NO: 675438 - DNA, 20 bp, mouse
gccactgcgggcgatcgctt

SEQ ID NO: 675439 - DNA, 20 bp, mouse
gtgaggccgagcgtgtacgg

SEQ ID NO: 675440 - DNA, 20 bp, mouse
gggaaagaaccgagagcgat

SEQ ID NO: 675441 - DNA, 20 bp, mouse
gcgatcgcccgcagtggcaa

SEQ ID NO: 675442 - DNA, 20 bp, mouse
gcagtaggctgttagctccc

SEQ ID NO: 675443 - DNA, 20 bp, mouse
ggtggcaaaggcagcatcac

SEQ ID NO: 675444 - DNA, 20 bp, mouse
gaaaccgagaaggaatagga

SEQ ID NO: 675445 - DNA, 20 bp, mouse
gacggggcgagcctgtggaa

SEQ ID NO: 675446 - DNA, 20 bp, mouse
gcacgcgcagcgcggggatc

SEQ ID NO: 675447 - DNA, 20 bp, mouse
gagccagggctcgtacctct

SEQ ID NO: 675448 - DNA, 20 bp, mouse
ggtcccagaggtacgagccc

SEQ ID NO: 675449 - DNA, 20 bp, mouse
gggtagggagtcacatagtc

SEQ ID NO: 675450 - DNA, 20 bp, mouse
gtccccgcgctgcgcgtgta

SEQ ID NO: 675451 - DNA, 20 bp, mouse
gtcccaacttaagtccctga

SEQ ID NO: 675452 - DNA, 20 bp, mouse
ggagtcacatagtctggagc

SEQ ID NO: 675453 - DNA, 20 bp, mouse
gcaccttcagggacttaagt

SEQ ID NO: 675454 - DNA, 20 bp, mouse
gtggagaggctgtcgtcgca

SEQ ID NO: 675455 - DNA, 20 bp, mouse
gggctgtcgtcgcaaggtgg

SEQ ID NO: 675456 - DNA, 20 bp, mouse
gagagcgcgcgcgtgagagg

SEQ ID NO: 675457 - DNA, 20 bp, mouse
gaggggagggagccccgagg

SEQ ID NO: 675458 - DNA, 20 bp, mouse
gggaaccagtactgagggca

SEQ ID NO: 675459 - DNA, 20 bp, mouse
gctgtgaggaaccagtactg

SEQ ID NO: 675460 - DNA, 20 bp, mouse
ggcgcgcgtgagaggaggga

SEQ ID NO: 675461 - DNA, 20 bp, mouse
ggagagagcgcgcgcgtgag

SEQ ID NO: 675462 - DNA, 20 bp, mouse
gtctcccctgccctcagtac

SEQ ID NO: 675463 - DNA, 20 bp, mouse
gccatcacctgcagccgctg

SEQ ID NO: 675464 - DNA, 20 bp, mouse
gtattggagaatagagggga

SEQ ID NO: 675465 - DNA, 20 bp, mouse
gaggaaatagctcactatgt

SEQ ID NO: 675466 - DNA, 20 bp, mouse
gacacactggtccataaaag

SEQ ID NO: 675467 - DNA, 20 bp, mouse
gtgaaagagaaggggtattt

SEQ ID NO: 675468 - DNA, 20 bp, mouse
gtaaatgcctgtaattgggt

SEQ ID NO: 675469 - DNA, 20 bp, mouse
gcctacttgctggtaagcaa

SEQ ID NO: 675470 - DNA, 20 bp, mouse
gagggacatcctagcgacca

SEQ ID NO: 675471 - DNA, 20 bp, mouse
gcacagcagagcctctgcta

SEQ ID NO: 675472 - DNA, 20 bp, mouse
gtccgcccaggccactttta

SEQ ID NO: 675473 - DNA, 20 bp, mouse
gaaggggtatttagggatgc

SEQ ID NO: 675474 - DNA, 20 bp, mouse
gagcgaccaaggatccgccc

SEQ ID NO: 675475 - DNA, 20 bp, mouse
gtgcgcacaaggcgcctata

SEQ ID NO: 675476 - DNA, 20 bp, mouse
gaaggggagaggtagacgga

SEQ ID NO: 675477 - DNA, 20 bp, mouse
gagtcacaggagcgtctgtg

SEQ ID NO: 675478 - DNA, 20 bp, mouse
gacgctcctgtgactcgctt

SEQ ID NO: 675479 - DNA, 20 bp, mouse
gagtagcctaagcgagtcac

SEQ ID NO: 675480 - DNA, 20 bp, mouse
gagcaaccaaggaccgccca

SEQ ID NO: 675481 - DNA, 20 bp, mouse
gactcgcttaggctacttgc

SEQ ID NO: 675482 - DNA, 20 bp, mouse
gcggtgccgctcagaatgtg

SEQ ID NO: 675483 - DNA, 20 bp, mouse
gtcgcctatcagagtgccct

SEQ ID NO: 675484 - DNA, 20 bp, mouse
gcgagctcgcttctaggcag

SEQ ID NO: 675485 - DNA, 20 bp, mouse
gctcgcttctaggcaggggg

SEQ ID NO: 675486 - DNA, 20 bp, mouse
ggcagggcgggctcgactgg

SEQ ID NO: 675487 - DNA, 20 bp, mouse
ggagaggaagctggggaaaa

SEQ ID NO: 675488 - DNA, 20 bp, mouse
gacccgcccaggccagcgca

SEQ ID NO: 675489 - DNA, 20 bp, mouse
gagtcgagcccgccctgcgc

SEQ ID NO: 675490 - DNA, 20 bp, mouse
gacttgccaaggacccgccc

SEQ ID NO: 675491 - DNA, 20 bp, mouse
ggtgctctgatgacttgctg

SEQ ID NO: 675492 - DNA, 20 bp, mouse
gcgcccaggccagcgcaggg

SEQ ID NO: 675493 - DNA, 20 bp, mouse
gggaagcagagctgtctgcc

SEQ ID NO: 675494 - DNA, 20 bp, mouse
ggggggcggggccgtacaga

SEQ ID NO: 675495 - DNA, 20 bp, mouse
gagcccgccctgcgctggcc

SEQ ID NO: 675496 - DNA, 20 bp, mouse
ggagtctagtaagactatcg

SEQ ID NO: 675497 - DNA, 20 bp, mouse
gcgcgcggcatcggcgacca

SEQ ID NO: 675498 - DNA, 20 bp, mouse
gcatgcgtgcccacgttccc

SEQ ID NO: 675499 - DNA, 20 bp, mouse
gttcagaggcccgggaacgt

SEQ ID NO: 675500 - DNA, 20 bp, mouse
gagcccagctgggtcgtaag

SEQ ID NO: 675501 - DNA, 20 bp, mouse
gccctcctgaagccaatccg

SEQ ID NO: 675502 - DNA, 20 bp, mouse
gggcatcggcgaccacggat

SEQ ID NO: 675503 - DNA, 20 bp, mouse
gtctagtaagactatcgggg

SEQ ID NO: 675504 - DNA, 20 bp, mouse
gcaagctccccgcacatcac

SEQ ID NO: 675505 - DNA, 20 bp, mouse
ggcacgcatgcgcgcggcat

SEQ ID NO: 675506 - DNA, 20 bp, mouse
gtcagggagacccggatcgt

SEQ ID NO: 675507 - DNA, 20 bp, mouse
gcgagggcaaacatatagaa

SEQ ID NO: 675508 - DNA, 20 bp, mouse
ggtctctccgccctagagga

SEQ ID NO: 675509 - DNA, 20 bp, mouse
gaagcgccctgctttctgat

SEQ ID NO: 675510 - DNA, 20 bp, mouse
gctttcctgtccctcctcta

SEQ ID NO: 675511 - DNA, 20 bp, mouse
gtcaccagcctgggcctcaa

SEQ ID NO: 675512 - DNA, 20 bp, mouse
gaaggaggctgcgggacgga

SEQ ID NO: 675513 - DNA, 20 bp, mouse
gaacgagcaagccgtgaagg

SEQ ID NO: 675514 - DNA, 20 bp, mouse
gggagtacttggacagttta

SEQ ID NO: 675515 - DNA, 20 bp, mouse
gtgtccaccacggcttcgaa

SEQ ID NO: 675516 - DNA, 20 bp, mouse
gtcttccgggaaagggcgga

SEQ ID NO: 675517 - DNA, 20 bp, mouse
gggagaccggatcctaggga

SEQ ID NO: 675518 - DNA, 20 bp, mouse
gcacctgagagtgacggagg

SEQ ID NO: 675519 - DNA, 20 bp, mouse
gggagcggaccaatggagac

SEQ ID NO: 675520 - DNA, 20 bp, mouse
gcgcctcctccgtcactctc

SEQ ID NO: 675521 - DNA, 20 bp, mouse
gggcggaaggagcggaccaa

SEQ ID NO: 675522 - DNA, 20 bp, mouse
gagcccgcctcttccgggaa

SEQ ID NO: 675523 - DNA, 20 bp, mouse
gccaggccacctgagagtga

SEQ ID NO: 675524 - DNA, 20 bp, mouse
gggccacctgagagtgacgg

SEQ ID NO: 675525 - DNA, 20 bp, mouse
gcaatggagaccggatccta

SEQ ID NO: 675526 - DNA, 20 bp, mouse
gcaagtgcgggctacgtagc

SEQ ID NO: 675527 - DNA, 20 bp, mouse
ggcccaggacgaggcctcga

SEQ ID NO: 675528 - DNA, 20 bp, mouse
ggcgggctacgtagcgggaa

SEQ ID NO: 675529 - DNA, 20 bp, mouse
gggaaggtggcggtagtccc

SEQ ID NO: 675530 - DNA, 20 bp, mouse
ggccctcgaggcctcgtcct

SEQ ID NO: 675531 - DNA, 20 bp, mouse
ggactaccgccaccttccca

SEQ ID NO: 675532 - DNA, 20 bp, mouse
ggaggcctcgtcctgggccc

SEQ ID NO: 675533 - DNA, 20 bp, mouse
gcgtctcagcggctgggcga

SEQ ID NO: 675534 - DNA, 20 bp, mouse
gagggtatgcgcacgcgtgg

SEQ ID NO: 675535 - DNA, 20 bp, mouse
gctcggctgccctgggaagg

SEQ ID NO: 675536 - DNA, 20 bp, mouse
ggtaccgccctctgtagctg

SEQ ID NO: 675537 - DNA, 20 bp, mouse
gtagctgcggctgccctgat

SEQ ID NO: 675538 - DNA, 20 bp, mouse
gcaggggcgtggcctatggg

SEQ ID NO: 675539 - DNA, 20 bp, mouse
gtgagaacggagcttggtgc

SEQ ID NO: 675540 - DNA, 20 bp, mouse
ggacccggaattggcggagg

SEQ ID NO: 675541 - DNA, 20 bp, mouse
gcggccgcctccgccaattc

SEQ ID NO: 675542 - DNA, 20 bp, mouse
gacccagagtcggcgctctc

SEQ ID NO: 675543 - DNA, 20 bp, mouse
gctgaagagggacccggaat

SEQ ID NO: 675544 - DNA, 20 bp, mouse
gagggacccggaattggcgg

SEQ ID NO: 675545 - DNA, 20 bp, mouse
gtgccctgattggctgaaga

SEQ ID NO: 675546 - DNA, 20 bp, mouse
gaggtggcaaagccaggatc

SEQ ID NO: 675547 - DNA, 20 bp, mouse
gcatcgccgagagactcctg

SEQ ID NO: 675548 - DNA, 20 bp, mouse
gagccaggatcgggaacagt

SEQ ID NO: 675549 - DNA, 20 bp, mouse
ggtagcatcgctgggaacat

SEQ ID NO: 675550 - DNA, 20 bp, mouse
gggaagaagcaaacaacact

SEQ ID NO: 675551 - DNA, 20 bp, mouse
gtctgctcgcttcgtctaag

SEQ ID NO: 675552 - DNA, 20 bp, mouse
gagctgcaaagcccttttcg

SEQ ID NO: 675553 - DNA, 20 bp, mouse
gtggctttgccacctcctcc

SEQ ID NO: 675554 - DNA, 20 bp, mouse
gccgagagactcctggggcg

SEQ ID NO: 675555 - DNA, 20 bp, mouse
gcactgggaatccgcgaaaa

SEQ ID NO: 675556 - DNA, 20 bp, mouse
gccgcccaggtgtgctccgg

SEQ ID NO: 675557 - DNA, 20 bp, mouse
gccggctggaggaactaagc

SEQ ID NO: 675558 - DNA, 20 bp, mouse
gtgcccgccggagcacacct

SEQ ID NO: 675559 - DNA, 20 bp, mouse
ggctgcgagaaccgacttga

SEQ ID NO: 675560 - DNA, 20 bp, mouse
gggggcgcgcgccccgcggt

SEQ ID NO: 675561 - DNA, 20 bp, mouse
gggggcgaggcgggccgact

SEQ ID NO: 675562 - DNA, 20 bp, mouse
gtgactcggtgcccaccgcg

SEQ ID NO: 675563 - DNA, 20 bp, mouse
gaccgagtcacctgcccagc

SEQ ID NO: 675564 - DNA, 20 bp, mouse
gtggccacctgtggctgcgc

SEQ ID NO: 675565 - DNA, 20 bp, mouse
gtggtccaaaatgaggtcct

SEQ ID NO: 675566 - DNA, 20 bp, mouse
gcccgagggcgccgcgacga

SEQ ID NO: 675567 - DNA, 20 bp, mouse
gccctcgggcagggaccgac

SEQ ID NO: 675568 - DNA, 20 bp, mouse
ggcagcccgggctgtgaagg

SEQ ID NO: 675569 - DNA, 20 bp, mouse
gaggcggcgcgtcactgcta

SEQ ID NO: 675570 - DNA, 20 bp, mouse
gtggaagcgccccggggagg

SEQ ID NO: 675571 - DNA, 20 bp, mouse
ggtcgcggcgccctcgggca

SEQ ID NO: 675572 - DNA, 20 bp, mouse
gccgccccttcgcccgggac

SEQ ID NO: 675573 - DNA, 20 bp, mouse
ggcggcagcccgggctgtga

SEQ ID NO: 675574 - DNA, 20 bp, mouse
gccggggcgcttccacctgc

SEQ ID NO: 675575 - DNA, 20 bp, mouse
ggggaggacccaagctgtag

SEQ ID NO: 675576 - DNA, 20 bp, mouse
gctcccccggggaccgtcgg

SEQ ID NO: 675577 - DNA, 20 bp, mouse
gggcctcccccggggaccgt

SEQ ID NO: 675578 - DNA, 20 bp, mouse
gcccccccgacggtccccgg

SEQ ID NO: 675579 - DNA, 20 bp, mouse
gggaagaggcgccagtccgc

SEQ ID NO: 675580 - DNA, 20 bp, mouse
gggtccccgggggaggccag

SEQ ID NO: 675581 - DNA, 20 bp, mouse
gaaccccacaccgcaggaag

SEQ ID NO: 675582 - DNA, 20 bp, mouse
ggccggccaccgccctacgg

SEQ ID NO: 675583 - DNA, 20 bp, mouse
ggttctctggggaggcgtga

SEQ ID NO: 675584 - DNA, 20 bp, mouse
ggaggcgtgaaggtcgcctg

SEQ ID NO: 675585 - DNA, 20 bp, mouse
gaaacgcctagggacactta

SEQ ID NO: 675586 - DNA, 20 bp, mouse
gcacctacatagggtgagaa

SEQ ID NO: 675587 - DNA, 20 bp, mouse
gcgggagcctcggtggtccc

SEQ ID NO: 675588 - DNA, 20 bp, mouse
gctcccgccatcatggatgg

SEQ ID NO: 675589 - DNA, 20 bp, mouse
ggcacgtactccacctacat

SEQ ID NO: 675590 - DNA, 20 bp, mouse
ggagagcagcactgccaccg

SEQ ID NO: 675591 - DNA, 20 bp, mouse
gcccagggactgagcctcgg

SEQ ID NO: 675592 - DNA, 20 bp, mouse
gtcagtccctgggaccaccg

SEQ ID NO: 675593 - DNA, 20 bp, mouse
gaccaccgaggctcccgacc

SEQ ID NO: 675594 - DNA, 20 bp, mouse
ggccaccgaggctcagtccc

SEQ ID NO: 675595 - DNA, 20 bp, mouse
gcggggctggcaggcggaag

SEQ ID NO: 675596 - DNA, 20 bp, mouse
gtaccacgctcgactcccgg

SEQ ID NO: 675597 - DNA, 20 bp, mouse
gtcccggaggcagtagcgcc

SEQ ID NO: 675598 - DNA, 20 bp, mouse
gaagagcggcgccctcgagc

SEQ ID NO: 675599 - DNA, 20 bp, mouse
gcagcctcacgcatgcaccg

SEQ ID NO: 675600 - DNA, 20 bp, mouse
ggcactgttggtgataagag

SEQ ID NO: 675601 - DNA, 20 bp, mouse
gtgcccttaaagatggtcag

SEQ ID NO: 675602 - DNA, 20 bp, mouse
gaatagacgagcgtcgcggg

SEQ ID NO: 675603 - DNA, 20 bp, mouse
ggagccggaagctcccagcc

SEQ ID NO: 675604 - DNA, 20 bp, mouse
gctgggagcttccggctcga

SEQ ID NO: 675605 - DNA, 20 bp, mouse
gggaggcagtagcgccaggc

SEQ ID NO: 675606 - DNA, 20 bp, mouse
ggacggaggccaaacagttc

SEQ ID NO: 675607 - DNA, 20 bp, mouse
ggtacctcaagccagagggt

SEQ ID NO: 675608 - DNA, 20 bp, mouse
gggcccgagcgccctgaccc

SEQ ID NO: 675609 - DNA, 20 bp, mouse
ggaccccggaaacgcttccc

SEQ ID NO: 675610 - DNA, 20 bp, mouse
ggagggtaggagacaagaat

SEQ ID NO: 675611 - DNA, 20 bp, mouse
ggaggtgtacctcaagccag

SEQ ID NO: 675612 - DNA, 20 bp, mouse
ggcttgaggtacacctcaac

SEQ ID NO: 675613 - DNA, 20 bp, mouse
ggaaacgcttccccggcgtg

SEQ ID NO: 675614 - DNA, 20 bp, mouse
gaccgaggccaaaacagacg

SEQ ID NO: 675615 - DNA, 20 bp, mouse
gcggtcccgcccccacgccg

SEQ ID NO: 675616 - DNA, 20 bp, mouse
ggtgccgcgcgacgggaaaa

SEQ ID NO: 675617 - DNA, 20 bp, mouse
gagctcctccgccaccggag

SEQ ID NO: 675618 - DNA, 20 bp, mouse
gcgcccaccgggagccaaga

SEQ ID NO: 675619 - DNA, 20 bp, mouse
ggctcccggtgggcgcttcc

SEQ ID NO: 675620 - DNA, 20 bp, mouse
gacccgaaggcccgtcttga

SEQ ID NO: 675621 - DNA, 20 bp, mouse
gtgcgaggtcccctctgcgt

SEQ ID NO: 675622 - DNA, 20 bp, mouse
ggtcaccgcgccaacgcaga

SEQ ID NO: 675623 - DNA, 20 bp, mouse
gcaagcccggaagcgcccac

SEQ ID NO: 675624 - DNA, 20 bp, mouse
ggacgccggcggatcggcag

SEQ ID NO: 675625 - DNA, 20 bp, mouse
gcgttggcgcggtgaccttt

SEQ ID NO: 675626 - DNA, 20 bp, mouse
ggctgcgtccggagcggaat

SEQ ID NO: 675627 - DNA, 20 bp, mouse
ggggcctgagaactccggcg

SEQ ID NO: 675628 - DNA, 20 bp, mouse
ggcggaatgggagaaggccc

SEQ ID NO: 675629 - DNA, 20 bp, mouse
ggcggtggctgcgtccggag

SEQ ID NO: 675630 - DNA, 20 bp, mouse
ggaatgggagaaggccccgg

SEQ ID NO: 675631 - DNA, 20 bp, mouse
gtccggagcggaatgggaga

SEQ ID NO: 675632 - DNA, 20 bp, mouse
gtccaggcggggactaggta

SEQ ID NO: 675633 - DNA, 20 bp, mouse
gtagcaggcagtatatgctg

SEQ ID NO: 675634 - DNA, 20 bp, mouse
gccctcctcgcccaacacgt

SEQ ID NO: 675635 - DNA, 20 bp, mouse
ggatctccaacgcaagtatt

SEQ ID NO: 675636 - DNA, 20 bp, mouse
gcacgctcagaagagattgg

SEQ ID NO: 675637 - DNA, 20 bp, mouse
gggacacgctcagaagagat

SEQ ID NO: 675638 - DNA, 20 bp, mouse
gccgagacgctctacctgcc

SEQ ID NO: 675639 - DNA, 20 bp, mouse
gggtagagcgtctcggatcg

SEQ ID NO: 675640 - DNA, 20 bp, mouse
gaaacaagacagtaaacaga

SEQ ID NO: 675641 - DNA, 20 bp, mouse
gcaggattttaaagtaaacc

SEQ ID NO: 675642 - DNA, 20 bp, mouse
ggcatgccagctactggttt

SEQ ID NO: 675643 - DNA, 20 bp, mouse
gtttaaaatcctgggaggcg

SEQ ID NO: 675644 - DNA, 20 bp, mouse
gatatgccgaaaccagtagc

SEQ ID NO: 675645 - DNA, 20 bp, mouse
gactcgcgcatgcgcacacc

SEQ ID NO: 675646 - DNA, 20 bp, mouse
gcgaagctcgctgctctaac

SEQ ID NO: 675647 - DNA, 20 bp, mouse
ggaagattgacgtctgagaa

SEQ ID NO: 675648 - DNA, 20 bp, mouse
gacgaactgtcgtacctgtc

SEQ ID NO: 675649 - DNA, 20 bp, mouse
gctgctgtatgcatttagtg

SEQ ID NO: 675650 - DNA, 20 bp, mouse
ggaagtacggcgcgcgacga

SEQ ID NO: 675651 - DNA, 20 bp, mouse
gcagcgagcttcgcgcagtc

SEQ ID NO: 675652 - DNA, 20 bp, mouse
gagcttcgcgcagtccggac

SEQ ID NO: 675653 - DNA, 20 bp, mouse
gccgacttccggaagaagta

SEQ ID NO: 675654 - DNA, 20 bp, mouse
gcgtcaatcttctagtcttg

SEQ ID NO: 675655 - DNA, 20 bp, mouse
gtaaatgcatacagcagttt

SEQ ID NO: 675656 - DNA, 20 bp, mouse
gggcggctgcgcaaagatca

SEQ ID NO: 675657 - DNA, 20 bp, mouse
gagtccgccacggtaggcgg

SEQ ID NO: 675658 - DNA, 20 bp, mouse
gttcgtggaccccaggaagt

SEQ ID NO: 675659 - DNA, 20 bp, mouse
gggtccccggaagtccgcca

SEQ ID NO: 675660 - DNA, 20 bp, mouse
gacttccggggaccgaaagc

SEQ ID NO: 675661 - DNA, 20 bp, mouse
gctaccgtggcggacttccg

SEQ ID NO: 675662 - DNA, 20 bp, mouse
ggaagtagtaagaactggag

SEQ ID NO: 675663 - DNA, 20 bp, mouse
gctagagagacacgcgttcg

SEQ ID NO: 675664 - DNA, 20 bp, mouse
gacacgcgttcgtggacccc

SEQ ID NO: 675665 - DNA, 20 bp, mouse
gctccggggcgggacggtcc

SEQ ID NO: 675666 - DNA, 20 bp, mouse
ggggcgcaagtaggtctgta

SEQ ID NO: 675667 - DNA, 20 bp, mouse
gtattacaggggttcgagtc

SEQ ID NO: 675668 - DNA, 20 bp, mouse
gaagaatggggagctcgcga

SEQ ID NO: 675669 - DNA, 20 bp, mouse
gaggatagctgctacgatat

SEQ ID NO: 675670 - DNA, 20 bp, mouse
ggccgcctgggggcgcaagt

SEQ ID NO: 675671 - DNA, 20 bp, mouse
ggagctccccattctttctc

SEQ ID NO: 675672 - DNA, 20 bp, mouse
gtcagccctgagaaagaatg

SEQ ID NO: 675673 - DNA, 20 bp, mouse
gtacatgcaagttgactgtc

SEQ ID NO: 675674 - DNA, 20 bp, mouse
gcgcacgctagctgctgctg

SEQ ID NO: 675675 - DNA, 20 bp, mouse
ggttccaagggctttcgcag

SEQ ID NO: 675676 - DNA, 20 bp, mouse
ggggcaagaagcactaatta

SEQ ID NO: 675677 - DNA, 20 bp, mouse
gtatggtgggaagtcctaac

SEQ ID NO: 675678 - DNA, 20 bp, mouse
ggtgggaagtcctaacgggc

SEQ ID NO: 675679 - DNA, 20 bp, mouse
gcgggcaggcgtacaaaatc

SEQ ID NO: 675680 - DNA, 20 bp, mouse
gagaggaggagcttcggctc

SEQ ID NO: 675681 - DNA, 20 bp, mouse
gcccctgagaggaggagctt

SEQ ID NO: 675682 - DNA, 20 bp, mouse
ggcttcttgcccctgagagg

SEQ ID NO: 675683 - DNA, 20 bp, mouse
ggccgaagctcctcctctca

SEQ ID NO: 675684 - DNA, 20 bp, mouse
gaagaagcactaattatggt

SEQ ID NO: 675685 - DNA, 20 bp, mouse
gcgaagctattaatatataa

SEQ ID NO: 675686 - DNA, 20 bp, mouse
gaacccgcccagtctctccc

SEQ ID NO: 675687 - DNA, 20 bp, mouse
ggagagactgggcgggttca

SEQ ID NO: 675688 - DNA, 20 bp, mouse
gcgggttcaaggctgcgggg

SEQ ID NO: 675689 - DNA, 20 bp, mouse
gcacaggaggcgggaggagt

SEQ ID NO: 675690 - DNA, 20 bp, mouse
gctgcggggaggcctgtgat

SEQ ID NO: 675691 - DNA, 20 bp, mouse
gaagatgaagggtggctggt

SEQ ID NO: 675692 - DNA, 20 bp, mouse
gaaactgacaagccgactga

SEQ ID NO: 675693 - DNA, 20 bp, mouse
ggaaggtcatacccaatcac

SEQ ID NO: 675694 - DNA, 20 bp, mouse
ggggcgggttcaaggctgcg

SEQ ID NO: 675695 - DNA, 20 bp, mouse
gttctcgggcacacaggagg

SEQ ID NO: 675696 - DNA, 20 bp, mouse
ggtacacccctactcctgga

SEQ ID NO: 675697 - DNA, 20 bp, mouse
ggcagctgccgtggtgtgaa

SEQ ID NO: 675698 - DNA, 20 bp, mouse
ggtaggggtgtaccattcca

SEQ ID NO: 675699 - DNA, 20 bp, mouse
gagcccctatgaagagtccg

SEQ ID NO: 675700 - DNA, 20 bp, mouse
gtcactcgctagccctggaa

SEQ ID NO: 675701 - DNA, 20 bp, mouse
gcctgcccaggtggagatcg

SEQ ID NO: 675702 - DNA, 20 bp, mouse
ggagctggacctaggggcgg

SEQ ID NO: 675703 - DNA, 20 bp, mouse
gtggagagctgattacgagt

SEQ ID NO: 675704 - DNA, 20 bp, mouse
gcgcccgcccacagccacca

SEQ ID NO: 675705 - DNA, 20 bp, mouse
ggaggcgggagctggaccta

SEQ ID NO: 675706 - DNA, 20 bp, mouse
gccccctagcccgccccaag

SEQ ID NO: 675707 - DNA, 20 bp, mouse
ggatcgccacctcacgccga

SEQ ID NO: 675708 - DNA, 20 bp, mouse
gagtagcaatgcccctccgg

SEQ ID NO: 675709 - DNA, 20 bp, mouse
gcctcccttggcagggaacc

SEQ ID NO: 675710 - DNA, 20 bp, mouse
gttggcagggaacccggctg

SEQ ID NO: 675711 - DNA, 20 bp, mouse
gaaacgcctgagaaggtgga

SEQ ID NO: 675712 - DNA, 20 bp, mouse
gcatacttcgagcattcctt

SEQ ID NO: 675713 - DNA, 20 bp, mouse
gtccctgccaagggaggccg

SEQ ID NO: 675714 - DNA, 20 bp, mouse
gaaagaaactcgttgggtta

SEQ ID NO: 675715 - DNA, 20 bp, mouse
gacgggtgatgtatgctcct

SEQ ID NO: 675716 - DNA, 20 bp, mouse
ggacctcggtagcccccgtc

SEQ ID NO: 675717 - DNA, 20 bp, mouse
gggcaccaggagccccggac

SEQ ID NO: 675718 - DNA, 20 bp, mouse
ggacacttggggttatttat

SEQ ID NO: 675719 - DNA, 20 bp, mouse
gcaaagggcaccaggagccc

SEQ ID NO: 675720 - DNA, 20 bp, mouse
gcgggggctaccgaggtcgg

SEQ ID NO: 675721 - DNA, 20 bp, mouse
ggccctgggtagaaatggtg

SEQ ID NO: 675722 - DNA, 20 bp, mouse
gtgcggggccccgccgacct

SEQ ID NO: 675723 - DNA, 20 bp, mouse
ggggcgcaggagattagttt

SEQ ID NO: 675724 - DNA, 20 bp, mouse
gcacccaggccctaggaaag

SEQ ID NO: 675725 - DNA, 20 bp, mouse
gaaagaggagtgctgtggtg

SEQ ID NO: 675726 - DNA, 20 bp, mouse
gctgccacgcgcacctgggt

SEQ ID NO: 675727 - DNA, 20 bp, mouse
gcggggcggggatgctagag

SEQ ID NO: 675728 - DNA, 20 bp, mouse
gcagtccttgggctgaactt

SEQ ID NO: 675729 - DNA, 20 bp, mouse
gggctcctctgcaactcgag

SEQ ID NO: 675730 - DNA, 20 bp, mouse
gtccttgggctgaacttggg

SEQ ID NO: 675731 - DNA, 20 bp, mouse
gcgccccgctcgagttgcag

SEQ ID NO: 675732 - DNA, 20 bp, mouse
gggaccagcacagtcgccaa

SEQ ID NO: 675733 - DNA, 20 bp, mouse
gtgactcgggggttctgatg

SEQ ID NO: 675734 - DNA, 20 bp, mouse
gtgggtcggctgccagtcct

SEQ ID NO: 675735 - DNA, 20 bp, mouse
gataaagccaaaggtggtgg

SEQ ID NO: 675736 - DNA, 20 bp, mouse
ggggccggctgggatcgctg

SEQ ID NO: 675737 - DNA, 20 bp, mouse
ggggcatgcaagtgggatct

SEQ ID NO: 675738 - DNA, 20 bp, mouse
gaggactttgaaggactcgt

SEQ ID NO: 675739 - DNA, 20 bp, mouse
ggaggcgcagcggggaccgg

SEQ ID NO: 675740 - DNA, 20 bp, mouse
gtgccccagagtaacacggt

SEQ ID NO: 675741 - DNA, 20 bp, mouse
gccacaacccagggccggct

SEQ ID NO: 675742 - DNA, 20 bp, mouse
gtaggctattgagattcaga

SEQ ID NO: 675743 - DNA, 20 bp, mouse
gtgggtgtggcacagcaacc

SEQ ID NO: 675744 - DNA, 20 bp, mouse
gtccccaccgtgttactctg

SEQ ID NO: 675745 - DNA, 20 bp, mouse
gacgcagagctccacaaccc

SEQ ID NO: 675746 - DNA, 20 bp, mouse
gaggaggagggagaccgcga

SEQ ID NO: 675747 - DNA, 20 bp, mouse
gccgccaggctggaggagga

SEQ ID NO: 675748 - DNA, 20 bp, mouse
ggccctggaaggggcgcctg

SEQ ID NO: 675749 - DNA, 20 bp, mouse
gggaagagggcggttccagg

SEQ ID NO: 675750 - DNA, 20 bp, mouse
gctgcggaggcactggccat

SEQ ID NO: 675751 - DNA, 20 bp, mouse
ggagggagaccgcgagggtt

SEQ ID NO: 675752 - DNA, 20 bp, mouse
gcgggtgagcggagcaaggc

SEQ ID NO: 675753 - DNA, 20 bp, mouse
gcgcgagggttcggcggctg

SEQ ID NO: 675754 - DNA, 20 bp, mouse
ggcgcggcggtgcaggccaa

SEQ ID NO: 675755 - DNA, 20 bp, mouse
gacccgcaggctcacctggc

SEQ ID NO: 675756 - DNA, 20 bp, mouse
gggaacaaaaggctgaccca

SEQ ID NO: 675757 - DNA, 20 bp, mouse
gtatagacctgcgggaaaag

SEQ ID NO: 675758 - DNA, 20 bp, mouse
ggcgggaaaaggggaacaaa

SEQ ID NO: 675759 - DNA, 20 bp, mouse
gtagatgcctgagactgaag

SEQ ID NO: 675760 - DNA, 20 bp, mouse
ggtactctgtactgccagta

SEQ ID NO: 675761 - DNA, 20 bp, mouse
gcacgtgggggctgagactc

SEQ ID NO: 675762 - DNA, 20 bp, mouse
gtagtcttcagctgtgaggg

SEQ ID NO: 675763 - DNA, 20 bp, mouse
ggatgttactggacacgtgg

SEQ ID NO: 675764 - DNA, 20 bp, mouse
gaattgctgggttatggtta

SEQ ID NO: 675765 - DNA, 20 bp, mouse
gtgtgaagggtatttcccat

SEQ ID NO: 675766 - DNA, 20 bp, mouse
gacttccgggtgttctccaa

SEQ ID NO: 675767 - DNA, 20 bp, mouse
gggagaacacccggaagtcc

SEQ ID NO: 675768 - DNA, 20 bp, mouse
gaaaccgcgccccagatcct

SEQ ID NO: 675769 - DNA, 20 bp, mouse
ggctgagtctctgctgagag

SEQ ID NO: 675770 - DNA, 20 bp, mouse
gggcctggccagggtcctcg

SEQ ID NO: 675771 - DNA, 20 bp, mouse
gggccctaggatctggggcg

SEQ ID NO: 675772 - DNA, 20 bp, mouse
gcaatggaggccctaggatc

SEQ ID NO: 675773 - DNA, 20 bp, mouse
gttaccccatctttctgctc

SEQ ID NO: 675774 - DNA, 20 bp, mouse
gtgggcaggtaggagggctg

SEQ ID NO: 675775 - DNA, 20 bp, mouse
gaaaactagtggactcttgg

SEQ ID NO: 675776 - DNA, 20 bp, mouse
gcatagcggcaatgacagtt

SEQ ID NO: 675777 - DNA, 20 bp, mouse
gcacactgaagggacgaata

SEQ ID NO: 675778 - DNA, 20 bp, mouse
gtcctccgtgctcaccgagt

SEQ ID NO: 675779 - DNA, 20 bp, mouse
gcctcagccaactcatgccc

SEQ ID NO: 675780 - DNA, 20 bp, mouse
ggtgtcctcaaagtacggtg

SEQ ID NO: 675781 - DNA, 20 bp, mouse
ggtgcgtggtatacattcac

SEQ ID NO: 675782 - DNA, 20 bp, mouse
gtcagtgtgaccctcccact

SEQ ID NO: 675783 - DNA, 20 bp, mouse
gtccgtgctcaccgagtggg

SEQ ID NO: 675784 - DNA, 20 bp, mouse
gtccttgatcacacagagct

SEQ ID NO: 675785 - DNA, 20 bp, mouse
gtgcaccgcaccgtactttg

SEQ ID NO: 675786 - DNA, 20 bp, mouse
ggggcggcagagttgcggga

SEQ ID NO: 675787 - DNA, 20 bp, mouse
gcgggccaggcagttctgat

SEQ ID NO: 675788 - DNA, 20 bp, mouse
gaggtgctgtcactggagtg

SEQ ID NO: 675789 - DNA, 20 bp, mouse
ggcaagggcggcagagttgc

SEQ ID NO: 675790 - DNA, 20 bp, mouse
gccccaatttggaacgaaga

SEQ ID NO: 675791 - DNA, 20 bp, mouse
gccctcagtatactgagtgt

SEQ ID NO: 675792 - DNA, 20 bp, mouse
gggcagagttgcgggagggg

SEQ ID NO: 675793 - DNA, 20 bp, mouse
gaaccctgcctctcggagag

SEQ ID NO: 675794 - DNA, 20 bp, mouse
gcctctggcccatgtagatc

SEQ ID NO: 675795 - DNA, 20 bp, mouse
gttgccccccagatctacat

SEQ ID NO: 675796 - DNA, 20 bp, mouse
gggcggggctacaatgtgga

SEQ ID NO: 675797 - DNA, 20 bp, mouse
gaatgggcggggctacaatg

SEQ ID NO: 675798 - DNA, 20 bp, mouse
gctgccccgggaaaggaggt

SEQ ID NO: 675799 - DNA, 20 bp, mouse
gcaggtggggcggaatgggc

SEQ ID NO: 675800 - DNA, 20 bp, mouse
ggagcccccacctactgcgt

SEQ ID NO: 675801 - DNA, 20 bp, mouse
gtgcgcggagacaggaggcg

SEQ ID NO: 675802 - DNA, 20 bp, mouse
gggctcctacgcagtaggtg

SEQ ID NO: 675803 - DNA, 20 bp, mouse
gtcctttcccggggcaggtg

SEQ ID NO: 675804 - DNA, 20 bp, mouse
gcggggcaggtggggcggaa

SEQ ID NO: 675805 - DNA, 20 bp, mouse
gagaaggggaaattcagccc

SEQ ID NO: 675806 - DNA, 20 bp, mouse
ggagcaggggagggagccga

SEQ ID NO: 675807 - DNA, 20 bp, mouse
ggggcccgggactcagtgct

SEQ ID NO: 675808 - DNA, 20 bp, mouse
gtgctgggaggagactgcgg

SEQ ID NO: 675809 - DNA, 20 bp, mouse
gggggagggacgtggctacg

SEQ ID NO: 675810 - DNA, 20 bp, mouse
gtccaccaatgggagggcta

SEQ ID NO: 675811 - DNA, 20 bp, mouse
gagccgaggggggagggacg

SEQ ID NO: 675812 - DNA, 20 bp, mouse
gagggcggaggtatgcagac

SEQ ID NO: 675813 - DNA, 20 bp, mouse
gaggagactgcgggggagca

SEQ ID NO: 675814 - DNA, 20 bp, mouse
ggctacggggcttcttaaat

SEQ ID NO: 675815 - DNA, 20 bp, mouse
ggggtggagccaacccatga

SEQ ID NO: 675816 - DNA, 20 bp, mouse
gacagtaggggatactaaca

SEQ ID NO: 675817 - DNA, 20 bp, mouse
ggaccacagcctgacagtag

SEQ ID NO: 675818 - DNA, 20 bp, mouse
ggacgtggatctcagagcgt

SEQ ID NO: 675819 - DNA, 20 bp, mouse
gcaggctgtggtcaggaggg

SEQ ID NO: 675820 - DNA, 20 bp, mouse
ggatctcagagcgtggggat

SEQ ID NO: 675821 - DNA, 20 bp, mouse
gctgtcaggctgtggtcagg

SEQ ID NO: 675822 - DNA, 20 bp, mouse
gagggaggtgagcaggctcc

SEQ ID NO: 675823 - DNA, 20 bp, mouse
gtgacccatgcaggctggaa

SEQ ID NO: 675824 - DNA, 20 bp, mouse
gtgggagtaacaatttaagt

SEQ ID NO: 675825 - DNA, 20 bp, mouse
gtacagggaaagcagaaccg

SEQ ID NO: 675826 - DNA, 20 bp, mouse
ggggtcgtgaacacgggctg

SEQ ID NO: 675827 - DNA, 20 bp, mouse
gtgggcggggtcgtgaacac

SEQ ID NO: 675828 - DNA, 20 bp, mouse
gtacactctgaaggaggtca

SEQ ID NO: 675829 - DNA, 20 bp, mouse
gccgccctctagacacccaa

SEQ ID NO: 675830 - DNA, 20 bp, mouse
ggtcagggccacgacagaga

SEQ ID NO: 675831 - DNA, 20 bp, mouse
gagggcggggcctaggctga

SEQ ID NO: 675832 - DNA, 20 bp, mouse
gcctagaggatacactctga

SEQ ID NO: 675833 - DNA, 20 bp, mouse
ggaggagccgggagtgggcg

SEQ ID NO: 675834 - DNA, 20 bp, mouse
gggccacgacagagaagggg

SEQ ID NO: 675835 - DNA, 20 bp, mouse
gcaggggaggagccgggagt

SEQ ID NO: 675836 - DNA, 20 bp, mouse
gccacccgaggcaccctatg

SEQ ID NO: 675837 - DNA, 20 bp, mouse
gtccgggacccgctaggcga

SEQ ID NO: 675838 - DNA, 20 bp, mouse
gaggagcggccggacgggga

SEQ ID NO: 675839 - DNA, 20 bp, mouse
gtggcaccggcggggtacag

SEQ ID NO: 675840 - DNA, 20 bp, mouse
gagggtgcctcgggtggcac

SEQ ID NO: 675841 - DNA, 20 bp, mouse
gaaggcgcggggacccaccc

SEQ ID NO: 675842 - DNA, 20 bp, mouse
ggagccgagcccggccgcat

SEQ ID NO: 675843 - DNA, 20 bp, mouse
gcggccgcatagggtgcctc

SEQ ID NO: 675844 - DNA, 20 bp, mouse
ggacccgctaggcgagggcc

SEQ ID NO: 675845 - DNA, 20 bp, mouse
gagtccgggccctcgcctag

SEQ ID NO: 675846 - DNA, 20 bp, mouse
ggcagctctggggtggaaga

SEQ ID NO: 675847 - DNA, 20 bp, mouse
gactgcaggcgcttgactgc

SEQ ID NO: 675848 - DNA, 20 bp, mouse
gcccacttgggaaatcaagt

SEQ ID NO: 675849 - DNA, 20 bp, mouse
gcagcctgaccctgctaggt

SEQ ID NO: 675850 - DNA, 20 bp, mouse
gaacaccagccggatttact

SEQ ID NO: 675851 - DNA, 20 bp, mouse
gaaggagatgaaagtagggg

SEQ ID NO: 675852 - DNA, 20 bp, mouse
gcaagcacacacacccactt

SEQ ID NO: 675853 - DNA, 20 bp, mouse
gggaagtgggtacatctcaa

SEQ ID NO: 675854 - DNA, 20 bp, mouse
ggcaatgacgtcactaaaca

SEQ ID NO: 675855 - DNA, 20 bp, mouse
gaatgagaacccactggtac

SEQ ID NO: 675856 - DNA, 20 bp, mouse
gcccgcctggacccacgaag

SEQ ID NO: 675857 - DNA, 20 bp, mouse
gctagccaggggccgaattg

SEQ ID NO: 675858 - DNA, 20 bp, mouse
gcgcgctcccgccccttcgt

SEQ ID NO: 675859 - DNA, 20 bp, mouse
gggacgctgaagttactcgg

SEQ ID NO: 675860 - DNA, 20 bp, mouse
gcctggacccacgaaggggc

SEQ ID NO: 675861 - DNA, 20 bp, mouse
gagctcctctccaatcacag

SEQ ID NO: 675862 - DNA, 20 bp, mouse
gctacagcaaccactgtgat

SEQ ID NO: 675863 - DNA, 20 bp, mouse
ggggggacgctgaagttact

SEQ ID NO: 675864 - DNA, 20 bp, mouse
ggtccaggcgggctgggcga

SEQ ID NO: 675865 - DNA, 20 bp, mouse
ggcaaccactgtgattggag

SEQ ID NO: 675866 - DNA, 20 bp, mouse
ggggctctgcgcagtcgaag

SEQ ID NO: 675867 - DNA, 20 bp, mouse
ggaggtggctaccaagccgg

SEQ ID NO: 675868 - DNA, 20 bp, mouse
ggtgtccctgggggtacccc

SEQ ID NO: 675869 - DNA, 20 bp, mouse
gtgaaaaggcggccctggag

SEQ ID NO: 675870 - DNA, 20 bp, mouse
ggtagccacctcctcagtcc

SEQ ID NO: 675871 - DNA, 20 bp, mouse
gcagcggtccaggactgagg

SEQ ID NO: 675872 - DNA, 20 bp, mouse
gcaagccgggggtaccccca

SEQ ID NO: 675873 - DNA, 20 bp, mouse
gcaaagactgggtactgaga

SEQ ID NO: 675874 - DNA, 20 bp, mouse
ggggcgcccacgcctctcca

SEQ ID NO: 675875 - DNA, 20 bp, mouse
ggaggaggtggctaccaagc

SEQ ID NO: 675876 - DNA, 20 bp, mouse
ggcagcaagggatgcagcat

SEQ ID NO: 675877 - DNA, 20 bp, mouse
gtgggatgtccccctcagga

SEQ ID NO: 675878 - DNA, 20 bp, mouse
gtgtccccctcaggatggat

SEQ ID NO: 675879 - DNA, 20 bp, mouse
gccccctcaggatggatagg

SEQ ID NO: 675880 - DNA, 20 bp, mouse
gcccctgccggacgcagcaa

SEQ ID NO: 675881 - DNA, 20 bp, mouse
gggcagcagttggcagcaga

SEQ ID NO: 675882 - DNA, 20 bp, mouse
gtacccacagcggtcttcca

SEQ ID NO: 675883 - DNA, 20 bp, mouse
gtgggattccggggagtctc

SEQ ID NO: 675884 - DNA, 20 bp, mouse
gagaaggtggagagctgcgg

SEQ ID NO: 675885 - DNA, 20 bp, mouse
gctgcatcccttgctgcgtc

SEQ ID NO: 675886 - DNA, 20 bp, mouse
gcccaagtcggagtggggga

SEQ ID NO: 675887 - DNA, 20 bp, mouse
gctgtacgaggcatcctgca

SEQ ID NO: 675888 - DNA, 20 bp, mouse
gggctccgccgagctgtacg

SEQ ID NO: 675889 - DNA, 20 bp, mouse
ggaaaagtcccaagtcggag

SEQ ID NO: 675890 - DNA, 20 bp, mouse
ggatgcctcgtacagctcgg

SEQ ID NO: 675891 - DNA, 20 bp, mouse
gaagtcccaagtcggagtgg

SEQ ID NO: 675892 - DNA, 20 bp, mouse
ggcagggggcagagcacccg

SEQ ID NO: 675893 - DNA, 20 bp, mouse
ggaagcactcagactggagg

SEQ ID NO: 675894 - DNA, 20 bp, mouse
gcccagcggagacttcaaaa

SEQ ID NO: 675895 - DNA, 20 bp, mouse
gcaccgtcaagcaaggtgtc

SEQ ID NO: 675896 - DNA, 20 bp, mouse
gaagaacgaggggttctttg

SEQ ID NO: 675897 - DNA, 20 bp, mouse
gaactctatagaaagaacga

SEQ ID NO: 675898 - DNA, 20 bp, mouse
gtatactacttctaacaaga

SEQ ID NO: 675899 - DNA, 20 bp, mouse
gtatcagtcatggtagcact

SEQ ID NO: 675900 - DNA, 20 bp, mouse
gccatagggaacagcaggtt

SEQ ID NO: 675901 - DNA, 20 bp, mouse
gcaattactcaacttgtatg

SEQ ID NO: 675902 - DNA, 20 bp, mouse
gtcactcaaaattgtgtgtc

SEQ ID NO: 675903 - DNA, 20 bp, mouse
gttactttctatccctttac

SEQ ID NO: 675904 - DNA, 20 bp, mouse
gcctgctgttccctatggtc

SEQ ID NO: 675905 - DNA, 20 bp, mouse
gggatgtaagattactttag

SEQ ID NO: 675906 - DNA, 20 bp, mouse
gggaagctgggctcacgaaa

SEQ ID NO: 675907 - DNA, 20 bp, mouse
gccactgggcacattggggg

SEQ ID NO: 675908 - DNA, 20 bp, mouse
gaggccactgggcacattgg

SEQ ID NO: 675909 - DNA, 20 bp, mouse
gccgccccctagccccccgc

SEQ ID NO: 675910 - DNA, 20 bp, mouse
ggcagtgtggcagtcccaag

SEQ ID NO: 675911 - DNA, 20 bp, mouse
gaaccacaggcgggaagggg

SEQ ID NO: 675912 - DNA, 20 bp, mouse
gagttctgctggggttagaa

SEQ ID NO: 675913 - DNA, 20 bp, mouse
ggcaggtgtgggctctggtc

SEQ ID NO: 675914 - DNA, 20 bp, mouse
gggctcacgaaaggggcgac

SEQ ID NO: 675915 - DNA, 20 bp, mouse
gcctccggtcgcccccactt

SEQ ID NO: 675916 - DNA, 20 bp, mouse
ggacacagaaacagcacatc

SEQ ID NO: 675917 - DNA, 20 bp, mouse
gggttgtgtcctctacacac

SEQ ID NO: 675918 - DNA, 20 bp, mouse
gatttggaatgcagagtggg

SEQ ID NO: 675919 - DNA, 20 bp, mouse
gcagagtgggtggtgagttc

SEQ ID NO: 675920 - DNA, 20 bp, mouse
gataaaggaaaatcctctga

SEQ ID NO: 675921 - DNA, 20 bp, mouse
gtgttttgactcccattctc

SEQ ID NO: 675922 - DNA, 20 bp, mouse
gaatgaccatgccggagaat

SEQ ID NO: 675923 - DNA, 20 bp, mouse
gtcatatttcagaaaggggc

SEQ ID NO: 675924 - DNA, 20 bp, mouse
gtcattgcttttactgctga

SEQ ID NO: 675925 - DNA, 20 bp, mouse
gattgagtcaggatggactc

SEQ ID NO: 675926 - DNA, 20 bp, mouse
gccaaggggctcgtggaatc

SEQ ID NO: 675927 - DNA, 20 bp, mouse
gcggcgcgggtaagaggcgg

SEQ ID NO: 675928 - DNA, 20 bp, mouse
gaccctgcggcgcgggtaag

SEQ ID NO: 675929 - DNA, 20 bp, mouse
gcacgccggggccgagagtc

SEQ ID NO: 675930 - DNA, 20 bp, mouse
gcgcgggcggcgtctccaag

SEQ ID NO: 675931 - DNA, 20 bp, mouse
gctgcggcgcgggtaagagg

SEQ ID NO: 675932 - DNA, 20 bp, mouse
ggcagggagtccgaacgccg

SEQ ID NO: 675933 - DNA, 20 bp, mouse
gtcggggcgcgggaggagct

SEQ ID NO: 675934 - DNA, 20 bp, mouse
gcggcctggctctgctccgt

SEQ ID NO: 675935 - DNA, 20 bp, mouse
ggctcgggacttggtgtcgc

SEQ ID NO: 675936 - DNA, 20 bp, mouse
ggagccctgctcaccgtccc

SEQ ID NO: 675937 - DNA, 20 bp, mouse
gctgctcaccgtcccgggtg

SEQ ID NO: 675938 - DNA, 20 bp, mouse
ggcgaggtgctcagtctcgg

SEQ ID NO: 675939 - DNA, 20 bp, mouse
gacggcgaggtgctcagtct

SEQ ID NO: 675940 - DNA, 20 bp, mouse
gccacccgcggtaccctcga

SEQ ID NO: 675941 - DNA, 20 bp, mouse
gaccctgcggcgcgggtaag

SEQ ID NO: 675942 - DNA, 20 bp, mouse
gcggcgcgggtaagaggcgg

SEQ ID NO: 675943 - DNA, 20 bp, mouse
gcgcgggcggcgtctccaag

SEQ ID NO: 675944 - DNA, 20 bp, mouse
ggccgcccgcgcactgccga

SEQ ID NO: 675945 - DNA, 20 bp, mouse
ggccgtggcccacgggaact

SEQ ID NO: 675946 - DNA, 20 bp, mouse
gttgcccaggaagtgagaaa

SEQ ID NO: 675947 - DNA, 20 bp, mouse
gcaggtgggcgcagctccag

SEQ ID NO: 675948 - DNA, 20 bp, mouse
gcgggagtctgcaactccgg

SEQ ID NO: 675949 - DNA, 20 bp, mouse
gtgggagggagaggggacga

SEQ ID NO: 675950 - DNA, 20 bp, mouse
gcgcccacctgcctgctctg

SEQ ID NO: 675951 - DNA, 20 bp, mouse
gcgcccgcagagcaggcagg

SEQ ID NO: 675952 - DNA, 20 bp, mouse
gaccgaagtcccaggatctc

SEQ ID NO: 675953 - DNA, 20 bp, mouse
gtcaaccgggcatcttgccc

SEQ ID NO: 675954 - DNA, 20 bp, mouse
gcgctaggcaccgaagtccc

SEQ ID NO: 675955 - DNA, 20 bp, mouse
ggcgcgggagtctgcaactc

SEQ ID NO: 675956 - DNA, 20 bp, mouse
gggccctcccgggtgacgac

SEQ ID NO: 675957 - DNA, 20 bp, mouse
gtgacgacgggtagggaagg

SEQ ID NO: 675958 - DNA, 20 bp, mouse
gtacccgtcgtcacccggga

SEQ ID NO: 675959 - DNA, 20 bp, mouse
gcccgggagggccggaggta

SEQ ID NO: 675960 - DNA, 20 bp, mouse
gcgtcacccgggagggccgg

SEQ ID NO: 675961 - DNA, 20 bp, mouse
gcgccccgggcccctcccgg

SEQ ID NO: 675962 - DNA, 20 bp, mouse
gagccgctgcgctgcattct

SEQ ID NO: 675963 - DNA, 20 bp, mouse
gaagccaggctggacggaaa

SEQ ID NO: 675964 - DNA, 20 bp, mouse
gttcccagaatgcagcgcag

SEQ ID NO: 675965 - DNA, 20 bp, mouse
gcctaaaggctggttgccta

SEQ ID NO: 675966 - DNA, 20 bp, mouse
gcaggtgggcgcagctccag

SEQ ID NO: 675967 - DNA, 20 bp, mouse
gtgggagggagaggggacga

SEQ ID NO: 675968 - DNA, 20 bp, mouse
gttgcccaggaagtgagaaa

SEQ ID NO: 675969 - DNA, 20 bp, mouse
gcgctaggcaccgaagtccc

SEQ ID NO: 675970 - DNA, 20 bp, mouse
gaccgaagtcccaggatctc

SEQ ID NO: 675971 - DNA, 20 bp, mouse
gcgggagtctgcaactccgg

SEQ ID NO: 675972 - DNA, 20 bp, mouse
gaatttaggggtgtgcggta

SEQ ID NO: 675973 - DNA, 20 bp, mouse
gcgcccacctgcctgctctg

SEQ ID NO: 675974 - DNA, 20 bp, mouse
gagtgcctggcgaactggga

SEQ ID NO: 675975 - DNA, 20 bp, mouse
gcgcccgcagagcaggcagg

SEQ ID NO: 675976 - DNA, 20 bp, mouse
gagtgacgctcagttatttg

SEQ ID NO: 675977 - DNA, 20 bp, mouse
gtcactccctcgcaggttgc

SEQ ID NO: 675978 - DNA, 20 bp, mouse
gtccccagcgccagcgggga

SEQ ID NO: 675979 - DNA, 20 bp, mouse
ggtgcagtgggaagcactgg

SEQ ID NO: 675980 - DNA, 20 bp, mouse
gactgcaccggcaacctgcg

SEQ ID NO: 675981 - DNA, 20 bp, mouse
ggctttgatgcagacatctg

SEQ ID NO: 675982 - DNA, 20 bp, mouse
gaacaaacgagaaatctttt

SEQ ID NO: 675983 - DNA, 20 bp, mouse
gacgctcagttatttgaggg

SEQ ID NO: 675984 - DNA, 20 bp, mouse
gcagacatctgagggaaagc

SEQ ID NO: 675985 - DNA, 20 bp, mouse
ggctcaggtctgtttgtcaa

SEQ ID NO: 675986 - DNA, 20 bp, mouse
ggggtgcactactactacat

SEQ ID NO: 675987 - DNA, 20 bp, mouse
gtgcatagattcttgtgtat

SEQ ID NO: 675988 - DNA, 20 bp, mouse
gcacaagaatctatgcaagt

SEQ ID NO: 675989 - DNA, 20 bp, mouse
gaagcagcttcccaaggtag

SEQ ID NO: 675990 - DNA, 20 bp, mouse
gtgtgcatgaaactttggaa

SEQ ID NO: 675991 - DNA, 20 bp, mouse
gcttgtgcaaggtctctttc

SEQ ID NO: 675992 - DNA, 20 bp, mouse
gaaagagaagcagcttccca

SEQ ID NO: 675993 - DNA, 20 bp, mouse
gaaacccagtaaaactgagg

SEQ ID NO: 675994 - DNA, 20 bp, mouse
gttggaacggttatgtgcag

SEQ ID NO: 675995 - DNA, 20 bp, mouse
gaataagagtctgcacactt

SEQ ID NO: 675996 - DNA, 20 bp, mouse
gggcgagtcgcggcgaggaa

SEQ ID NO: 675997 - DNA, 20 bp, mouse
gcactgggcgccgagggcga

SEQ ID NO: 675998 - DNA, 20 bp, mouse
gccggtccccgcctcccact

SEQ ID NO: 675999 - DNA, 20 bp, mouse
gctgctggcagacaacgcgg

SEQ ID NO: 676000 - DNA, 20 bp, mouse
gccggggcgggagcggacgt

SEQ ID NO: 676001 - DNA, 20 bp, mouse
gatccccaccccctcgccct

SEQ ID NO: 676002 - DNA, 20 bp, mouse
gtcggcgcccagtgggaggc

SEQ ID NO: 676003 - DNA, 20 bp, mouse
gggcgggagcggacgtggga

SEQ ID NO: 676004 - DNA, 20 bp, mouse
gagcggacgtgggacggggc

SEQ ID NO: 676005 - DNA, 20 bp, mouse
ggcgagggggtggggatagc

SEQ ID NO: 676006 - DNA, 20 bp, mouse
gagcctgaacaagctgaaag

SEQ ID NO: 676007 - DNA, 20 bp, mouse
gttgcttggcagacactgga

SEQ ID NO: 676008 - DNA, 20 bp, mouse
gagaggcgcgcgctctgatt

SEQ ID NO: 676009 - DNA, 20 bp, mouse
gcaagcaaccgtctgattga

SEQ ID NO: 676010 - DNA, 20 bp, mouse
gctgaaaactcaagtcgcag

SEQ ID NO: 676011 - DNA, 20 bp, mouse
gggatcagactccttctaat

SEQ ID NO: 676012 - DNA, 20 bp, mouse
gacggttgcttggcagacac

SEQ ID NO: 676013 - DNA, 20 bp, mouse
gagtcagtgggtgtgtgtct

SEQ ID NO: 676014 - DNA, 20 bp, mouse
gtgcccctttcagcttgttc

SEQ ID NO: 676015 - DNA, 20 bp, mouse
ggagggaggaggatgaaaat

SEQ ID NO: 676016 - DNA, 20 bp, mouse
gtgggcgtggcccatcgtct

SEQ ID NO: 676017 - DNA, 20 bp, mouse
gtgctgatgtccggcaagaa

SEQ ID NO: 676018 - DNA, 20 bp, mouse
gcagtgcgagaggcattcta

SEQ ID NO: 676019 - DNA, 20 bp, mouse
gcggggcccggacgagaggg

SEQ ID NO: 676020 - DNA, 20 bp, mouse
ggggcggggcccggacgaga

SEQ ID NO: 676021 - DNA, 20 bp, mouse
gagatcagggccattcttgc

SEQ ID NO: 676022 - DNA, 20 bp, mouse
gtgaggttgaaggtttgatc

SEQ ID NO: 676023 - DNA, 20 bp, mouse
gacatcagcaccgagacgat

SEQ ID NO: 676024 - DNA, 20 bp, mouse
gtccgggccccgcccggcaa

SEQ ID NO: 676025 - DNA, 20 bp, mouse
gttgagaaagtcagtgcgag

SEQ ID NO: 676026 - DNA, 20 bp, mouse
gtggacagttgactctgagt

SEQ ID NO: 676027 - DNA, 20 bp, mouse
gccacagcccaggagtgtcc

SEQ ID NO: 676028 - DNA, 20 bp, mouse
gctggtgcctagtacccgag

SEQ ID NO: 676029 - DNA, 20 bp, mouse
gagcatcagcatcgggtctc

SEQ ID NO: 676030 - DNA, 20 bp, mouse
gaacaggaagtccacagccc

SEQ ID NO: 676031 - DNA, 20 bp, mouse
ggaaaaaggccctctcctct

SEQ ID NO: 676032 - DNA, 20 bp, mouse
gagggaggtgcaaagagggg

SEQ ID NO: 676033 - DNA, 20 bp, mouse
gctgggctgcatagtcccaa

SEQ ID NO: 676034 - DNA, 20 bp, mouse
gcctagtacccgagaggaga

SEQ ID NO: 676035 - DNA, 20 bp, mouse
gctggagaaagccacgtttg

SEQ ID NO: 676036 - DNA, 20 bp, mouse
gatgggcggggtcagcgggt

SEQ ID NO: 676037 - DNA, 20 bp, mouse
ggcgcggcccgggactgaac

SEQ ID NO: 676038 - DNA, 20 bp, mouse
ggcgctgcggccccgcggat

SEQ ID NO: 676039 - DNA, 20 bp, mouse
gtgaagctggggaatgagct

SEQ ID NO: 676040 - DNA, 20 bp, mouse
ggggccctgaattggtattg

SEQ ID NO: 676041 - DNA, 20 bp, mouse
gaggctcctggaagttgata

SEQ ID NO: 676042 - DNA, 20 bp, mouse
gacggactaagatgaagctg

SEQ ID NO: 676043 - DNA, 20 bp, mouse
gagcgggtggggctgctgga

SEQ ID NO: 676044 - DNA, 20 bp, mouse
gcggcccgggactgaacggg

SEQ ID NO: 676045 - DNA, 20 bp, mouse
gaattcggggcagttctcaa

SEQ ID NO: 676046 - DNA, 20 bp, mouse
gtaaatgaaaaccagacctg

SEQ ID NO: 676047 - DNA, 20 bp, mouse
gtctgtcctatggcagggag

SEQ ID NO: 676048 - DNA, 20 bp, mouse
gagcaacagagccccaggtc

SEQ ID NO: 676049 - DNA, 20 bp, mouse
gacagtttgggtctgtccta

SEQ ID NO: 676050 - DNA, 20 bp, mouse
gaactccagctctaagaagg

SEQ ID NO: 676051 - DNA, 20 bp, mouse
gaggcaaagacggccttcat

SEQ ID NO: 676052 - DNA, 20 bp, mouse
ggtccagctaaatgcttgta

SEQ ID NO: 676053 - DNA, 20 bp, mouse
gtgtgggttgtgaccctgat

SEQ ID NO: 676054 - DNA, 20 bp, mouse
gttgggtctgtcctatggca

SEQ ID NO: 676055 - DNA, 20 bp, mouse
ggaagccctgactgtacccc

SEQ ID NO: 676056 - DNA, 20 bp, mouse
gtctccgaaaaataataatg

SEQ ID NO: 676057 - DNA, 20 bp, mouse
gtctccagagaggggcggag

SEQ ID NO: 676058 - DNA, 20 bp, mouse
gattcgccaaaaatggtcat

SEQ ID NO: 676059 - DNA, 20 bp, mouse
gtgaatacacaaaataccag

SEQ ID NO: 676060 - DNA, 20 bp, mouse
gcataggattctttgctaga

SEQ ID NO: 676061 - DNA, 20 bp, mouse
gtttcggagactgtttcccc

SEQ ID NO: 676062 - DNA, 20 bp, mouse
gtctggagagcattaaatgc

SEQ ID NO: 676063 - DNA, 20 bp, mouse
gaaaaagtttcgagacttcc

SEQ ID NO: 676064 - DNA, 20 bp, mouse
gtagagggtatgtgggtaaa

SEQ ID NO: 676065 - DNA, 20 bp, mouse
gttcccccattattattttt

SEQ ID NO: 676066 - DNA, 20 bp, mouse
gcagccagctgagatggtcg

SEQ ID NO: 676067 - DNA, 20 bp, mouse
gtccctaagaccggtacagt

SEQ ID NO: 676068 - DNA, 20 bp, mouse
gaatccacgaccatctcagc

SEQ ID NO: 676069 - DNA, 20 bp, mouse
ggcccactgtaccggtctta

SEQ ID NO: 676070 - DNA, 20 bp, mouse
gcatgcggcttccctaagac

SEQ ID NO: 676071 - DNA, 20 bp, mouse
gttggcttggcccactgtac

SEQ ID NO: 676072 - DNA, 20 bp, mouse
gctaggagggccatgcccta

SEQ ID NO: 676073 - DNA, 20 bp, mouse
ggaagcccggccaagggcgc

SEQ ID NO: 676074 - DNA, 20 bp, mouse
gccgccctgcgcccttggcc

SEQ ID NO: 676075 - DNA, 20 bp, mouse
gtagggaagccgcatgaact

SEQ ID NO: 676076 - DNA, 20 bp, mouse
ggaccctgggggaaagtgga

SEQ ID NO: 676077 - DNA, 20 bp, mouse
gtggaccgcccccaaactcc

SEQ ID NO: 676078 - DNA, 20 bp, mouse
gtgcagtgaggtagtctaag

SEQ ID NO: 676079 - DNA, 20 bp, mouse
gcacgccctggtggccccca

SEQ ID NO: 676080 - DNA, 20 bp, mouse
gtgctgctcaagccttggga

SEQ ID NO: 676081 - DNA, 20 bp, mouse
ggctccagcgcagagagtga

SEQ ID NO: 676082 - DNA, 20 bp, mouse
ggcagcccgcgggaccccag

SEQ ID NO: 676083 - DNA, 20 bp, mouse
gcaccctccactttccccca

SEQ ID NO: 676084 - DNA, 20 bp, mouse
gtggcctgggcacctactca

SEQ ID NO: 676085 - DNA, 20 bp, mouse
gagtactaaccgctcaggag

SEQ ID NO: 676086 - DNA, 20 bp, mouse
gggaaccctaagtaaggttg

SEQ ID NO: 676087 - DNA, 20 bp, mouse
gagtgatactcgaaagtctt

SEQ ID NO: 676088 - DNA, 20 bp, mouse
gcatcaggctgctaccccta

SEQ ID NO: 676089 - DNA, 20 bp, mouse
gaagcgacctctggggaggt

SEQ ID NO: 676090 - DNA, 20 bp, mouse
gagcaccccaaccttactta

SEQ ID NO: 676091 - DNA, 20 bp, mouse
ggactttcgagtatcactca

SEQ ID NO: 676092 - DNA, 20 bp, mouse
gcttaagtccaggagaagtg

SEQ ID NO: 676093 - DNA, 20 bp, mouse
gtgggcaccccatggggtta

SEQ ID NO: 676094 - DNA, 20 bp, mouse
ggactcacccctaaccccat

SEQ ID NO: 676095 - DNA, 20 bp, mouse
gcgcacttaagggcaaggtc

SEQ ID NO: 676096 - DNA, 20 bp, mouse
gtggacacttgtctggggag

SEQ ID NO: 676097 - DNA, 20 bp, mouse
gcaggagtggagacgaatga

SEQ ID NO: 676098 - DNA, 20 bp, mouse
gggcggcggagtaaatagac

SEQ ID NO: 676099 - DNA, 20 bp, mouse
gggagctggacacttgtctg

SEQ ID NO: 676100 - DNA, 20 bp, mouse
gtaggtgggcagggattgag

SEQ ID NO: 676101 - DNA, 20 bp, mouse
gcaagtgtccagctccacgg

SEQ ID NO: 676102 - DNA, 20 bp, mouse
ggttggggaagaaatgaatg

SEQ ID NO: 676103 - DNA, 20 bp, mouse
ggggtagagcccgagttttt

SEQ ID NO: 676104 - DNA, 20 bp, mouse
ggggaagctaaagtaaaggt

SEQ ID NO: 676105 - DNA, 20 bp, mouse
gaggtagaggcgaggaagat

SEQ ID NO: 676106 - DNA, 20 bp, mouse
gcgtctagggcaggggtccg

SEQ ID NO: 676107 - DNA, 20 bp, mouse
gagcccgctgcgctgcggac

SEQ ID NO: 676108 - DNA, 20 bp, mouse
ggggcgcgcacccttggctg

SEQ ID NO: 676109 - DNA, 20 bp, mouse
ggacaacggcgctgcaaaga

SEQ ID NO: 676110 - DNA, 20 bp, mouse
gtgtctcctgcagccgtcta

SEQ ID NO: 676111 - DNA, 20 bp, mouse
gcgcccgtccgcagcgcagc

SEQ ID NO: 676112 - DNA, 20 bp, mouse
ggggagtcttgagtcttatg

SEQ ID NO: 676113 - DNA, 20 bp, mouse
gcaacctaggtcaccgtgtc

SEQ ID NO: 676114 - DNA, 20 bp, mouse
gcgggcggggcgcgcaccct

SEQ ID NO: 676115 - DNA, 20 bp, mouse
ggcgcacggagtggtccatg

SEQ ID NO: 676116 - DNA, 20 bp, mouse
gaggctagactaagaaatgt

SEQ ID NO: 676117 - DNA, 20 bp, mouse
gggtctgtgccctacagggg

SEQ ID NO: 676118 - DNA, 20 bp, mouse
gtgtccccagagtctgccaa

SEQ ID NO: 676119 - DNA, 20 bp, mouse
gagactctggggacagccag

SEQ ID NO: 676120 - DNA, 20 bp, mouse
gaagggtctgtgccctacag

SEQ ID NO: 676121 - DNA, 20 bp, mouse
gcgccctgaagagggtcctg

SEQ ID NO: 676122 - DNA, 20 bp, mouse
gtctgcaggaatactggggt

SEQ ID NO: 676123 - DNA, 20 bp, mouse
gtgtctctgcaggaatactg

SEQ ID NO: 676124 - DNA, 20 bp, mouse
gtggtgcagatgccaggaaa

SEQ ID NO: 676125 - DNA, 20 bp, mouse
gaatccccaggaccctcttc

SEQ ID NO: 676126 - DNA, 20 bp, mouse
gtccagctccgcccggtcag

SEQ ID NO: 676127 - DNA, 20 bp, mouse
gcttgcccggggaaaggatg

SEQ ID NO: 676128 - DNA, 20 bp, mouse
gcccagctgggaagtcccgg

SEQ ID NO: 676129 - DNA, 20 bp, mouse
gaagtcccgggggcatctcg

SEQ ID NO: 676130 - DNA, 20 bp, mouse
gcagaatgcagacccagggt

SEQ ID NO: 676131 - DNA, 20 bp, mouse
ggcccccgggacttcccagc

SEQ ID NO: 676132 - DNA, 20 bp, mouse
gcgccccagctgggaagtcc

SEQ ID NO: 676133 - DNA, 20 bp, mouse
gagctccgcccggtcagggg

SEQ ID NO: 676134 - DNA, 20 bp, mouse
ggacccagacaagcttgccc

SEQ ID NO: 676135 - DNA, 20 bp, mouse
ggatggggctgagggccagg

SEQ ID NO: 676136 - DNA, 20 bp, mouse
gaagccctggctcgcctgat

SEQ ID NO: 676137 - DNA, 20 bp, mouse
gcaggcgagccagggcttaa

SEQ ID NO: 676138 - DNA, 20 bp, mouse
gggagtgtggggtatctgcg

SEQ ID NO: 676139 - DNA, 20 bp, mouse
ggggccaatcaggcgagcca

SEQ ID NO: 676140 - DNA, 20 bp, mouse
ggtaagcagggtacctgagc

SEQ ID NO: 676141 - DNA, 20 bp, mouse
gttggccctgaaatcagagg

SEQ ID NO: 676142 - DNA, 20 bp, mouse
gaaaggagagaaggtaagca

SEQ ID NO: 676143 - DNA, 20 bp, mouse
gcagggtacctgagcgggac

SEQ ID NO: 676144 - DNA, 20 bp, mouse
gggaggagtcaggatgcgga

SEQ ID NO: 676145 - DNA, 20 bp, mouse
gcctgagcgggacaggagtg

SEQ ID NO: 676146 - DNA, 20 bp, mouse
ggcgccccgccggctcaggt

SEQ ID NO: 676147 - DNA, 20 bp, mouse
gcagccgggcccacctgagc

SEQ ID NO: 676148 - DNA, 20 bp, mouse
ggtgggcccggctgaatgag

SEQ ID NO: 676149 - DNA, 20 bp, mouse
gtacccacagggatcctcct

SEQ ID NO: 676150 - DNA, 20 bp, mouse
ggggcccacctgagccggcg

SEQ ID NO: 676151 - DNA, 20 bp, mouse
gtgaatgaggggcttgtgcg

SEQ ID NO: 676152 - DNA, 20 bp, mouse
gaaggtgcgtgtgtaacgcg

SEQ ID NO: 676153 - DNA, 20 bp, mouse
gaagccgcccaaatcctagg

SEQ ID NO: 676154 - DNA, 20 bp, mouse
gcacaagcccctcattcagc

SEQ ID NO: 676155 - DNA, 20 bp, mouse
gtctagagaaagggccgggg

SEQ ID NO: 676156 - DNA, 20 bp, mouse
ggctgcaaaggcaagcaagg

SEQ ID NO: 676157 - DNA, 20 bp, mouse
gaattctgggagtgatgggg

SEQ ID NO: 676158 - DNA, 20 bp, mouse
gttcaataaactgttgtcat

SEQ ID NO: 676159 - DNA, 20 bp, mouse
gtgagaaagtaaacaaccaa

SEQ ID NO: 676160 - DNA, 20 bp, mouse
gaagcaaggaggcattccct

SEQ ID NO: 676161 - DNA, 20 bp, mouse
gggacaatgtatggtccatt

SEQ ID NO: 676162 - DNA, 20 bp, mouse
ggctacaaactaaaacaagg

SEQ ID NO: 676163 - DNA, 20 bp, mouse
gactaaaacaaggaggtatc

SEQ ID NO: 676164 - DNA, 20 bp, mouse
gagttgaattctgggagtga

SEQ ID NO: 676165 - DNA, 20 bp, mouse
gtggtgcttagacctccagc

SEQ ID NO: 676166 - DNA, 20 bp, mouse
ggctgccaaaggggtgtctg

SEQ ID NO: 676167 - DNA, 20 bp, mouse
gcagcctccagcagattcgc

SEQ ID NO: 676168 - DNA, 20 bp, mouse
gtcggcccctgctgccaaag

SEQ ID NO: 676169 - DNA, 20 bp, mouse
gacagctgatggtttcaggc

SEQ ID NO: 676170 - DNA, 20 bp, mouse
ggacacccctttggcagcag

SEQ ID NO: 676171 - DNA, 20 bp, mouse
gagcccagcgaatctgctgg

SEQ ID NO: 676172 - DNA, 20 bp, mouse
gtgcagggccctgtggagtg

SEQ ID NO: 676173 - DNA, 20 bp, mouse
gggctccccagacacccctt

SEQ ID NO: 676174 - DNA, 20 bp, mouse
gcaggaagctcttgcagata

SEQ ID NO: 676175 - DNA, 20 bp, mouse
gtgagagagaatgtttgggg

SEQ ID NO: 676176 - DNA, 20 bp, mouse
gggtgcggggcggcctcgga

SEQ ID NO: 676177 - DNA, 20 bp, mouse
ggagaaagagggacccacga

SEQ ID NO: 676178 - DNA, 20 bp, mouse
gggccgccccgcaccctcgt

SEQ ID NO: 676179 - DNA, 20 bp, mouse
gcggagcgaaggttgcggag

SEQ ID NO: 676180 - DNA, 20 bp, mouse
ggacccacgagggtgcgggg

SEQ ID NO: 676181 - DNA, 20 bp, mouse
gccgctctcccggccctccg

SEQ ID NO: 676182 - DNA, 20 bp, mouse
gccgccctcggccgctctcc

SEQ ID NO: 676183 - DNA, 20 bp, mouse
ggaaggttgcggaggggcgt

SEQ ID NO: 676184 - DNA, 20 bp, mouse
ggcggccgagggcggagcga

SEQ ID NO: 676185 - DNA, 20 bp, mouse
ggagggcggagcgaaggttg

SEQ ID NO: 676186 - DNA, 20 bp, mouse
gccctgacacgctccttaaa

SEQ ID NO: 676187 - DNA, 20 bp, mouse
gcctggagagaggcatgaca

SEQ ID NO: 676188 - DNA, 20 bp, mouse
gtccgccgaccgcaataacc

SEQ ID NO: 676189 - DNA, 20 bp, mouse
gtgcggtcggcggaaagcag

SEQ ID NO: 676190 - DNA, 20 bp, mouse
gtaaggagcgtgtcaggggt

SEQ ID NO: 676191 - DNA, 20 bp, mouse
gtaaagctcgagctaggggc

SEQ ID NO: 676192 - DNA, 20 bp, mouse
ggtcacttgcggggaggttc

SEQ ID NO: 676193 - DNA, 20 bp, mouse
ggacgagggccgcgccttaa

SEQ ID NO: 676194 - DNA, 20 bp, mouse
ggcaagtgacgtcttgtgac

SEQ ID NO: 676195 - DNA, 20 bp, mouse
gagccaccgcgtgagattag

SEQ ID NO: 676196 - DNA, 20 bp, mouse
gtgtgaagaacttcagactg

SEQ ID NO: 676197 - DNA, 20 bp, mouse
gcagtgacgcgatgtatcca

SEQ ID NO: 676198 - DNA, 20 bp, mouse
gagaactctaatctgtcaat

SEQ ID NO: 676199 - DNA, 20 bp, mouse
gtgtggccctgtctgccaat

SEQ ID NO: 676200 - DNA, 20 bp, mouse
gtcacagtcctgggtggttg

SEQ ID NO: 676201 - DNA, 20 bp, mouse
gttcagaagttgtatgtcta

SEQ ID NO: 676202 - DNA, 20 bp, mouse
gtaggtgcattataaagccc

SEQ ID NO: 676203 - DNA, 20 bp, mouse
gaatgttataacatctacag

SEQ ID NO: 676204 - DNA, 20 bp, mouse
gcactctcccattggcagac

SEQ ID NO: 676205 - DNA, 20 bp, mouse
gacattgtttctcacagtcc

SEQ ID NO: 676206 - DNA, 20 bp, mouse
gtacctgtcaccaccctcaa

SEQ ID NO: 676207 - DNA, 20 bp, mouse
ggcaagcaaggaggaagtcg

SEQ ID NO: 676208 - DNA, 20 bp, mouse
gggtggtgacaggtaaactt

SEQ ID NO: 676209 - DNA, 20 bp, mouse
ggagacccatctgcccttga

SEQ ID NO: 676210 - DNA, 20 bp, mouse
gagactaaggtaagcagcta

SEQ ID NO: 676211 - DNA, 20 bp, mouse
gtgagataaatataaccctg

SEQ ID NO: 676212 - DNA, 20 bp, mouse
gctcccggaggacaagctcc

SEQ ID NO: 676213 - DNA, 20 bp, mouse
ggagaaggtttaatgggaca

SEQ ID NO: 676214 - DNA, 20 bp, mouse
gagtacagagaaggtttaat

SEQ ID NO: 676215 - DNA, 20 bp, mouse
gacccatctgcccttgaggg

SEQ ID NO: 676216 - DNA, 20 bp, mouse
gagggtggcaagtccctgag

SEQ ID NO: 676217 - DNA, 20 bp, mouse
ggagctccggtccgctacgg

SEQ ID NO: 676218 - DNA, 20 bp, mouse
gaacccggcatcgcgttccg

SEQ ID NO: 676219 - DNA, 20 bp, mouse
gacacccgagtgtccgtgaa

SEQ ID NO: 676220 - DNA, 20 bp, mouse
gcactcaaaggaacgatcgc

SEQ ID NO: 676221 - DNA, 20 bp, mouse
gccgctacgggggccgagaa

SEQ ID NO: 676222 - DNA, 20 bp, mouse
gtgagtgcgcatttgcacat

SEQ ID NO: 676223 - DNA, 20 bp, mouse
gttggctgtggtggaagtag

SEQ ID NO: 676224 - DNA, 20 bp, mouse
gccatggcgggcgatctgga

SEQ ID NO: 676225 - DNA, 20 bp, mouse
gagatcgcccgccatggcta

SEQ ID NO: 676226 - DNA, 20 bp, mouse
gcgaaggcttgtgcgtggtc

SEQ ID NO: 676227 - DNA, 20 bp, mouse
gtcgaggtctcaaacctgcc

SEQ ID NO: 676228 - DNA, 20 bp, mouse
gctgtgcgtttaatttccga

SEQ ID NO: 676229 - DNA, 20 bp, mouse
gggcgcgcctgacggaaacc

SEQ ID NO: 676230 - DNA, 20 bp, mouse
ggcttgtgcgtggtccggaa

SEQ ID NO: 676231 - DNA, 20 bp, mouse
ggcctgacggaaacccggaa

SEQ ID NO: 676232 - DNA, 20 bp, mouse
gaggtctcaaacctgcccgg

SEQ ID NO: 676233 - DNA, 20 bp, mouse
gaagggccaagtctcgccgc

SEQ ID NO: 676234 - DNA, 20 bp, mouse
gcacggtcagaatggtagaa

SEQ ID NO: 676235 - DNA, 20 bp, mouse
ggtacagcctcggtttcaca

SEQ ID NO: 676236 - DNA, 20 bp, mouse
gcaaccggaacccaaagcat

SEQ ID NO: 676237 - DNA, 20 bp, mouse
gactctataggagtgaaggt

SEQ ID NO: 676238 - DNA, 20 bp, mouse
gctaggagcacggtatcgtc

SEQ ID NO: 676239 - DNA, 20 bp, mouse
gaggatggctcatgaatgag

SEQ ID NO: 676240 - DNA, 20 bp, mouse
ggaaggtaggcagtgaacgc

SEQ ID NO: 676241 - DNA, 20 bp, mouse
gccaaaactagagttagtga

SEQ ID NO: 676242 - DNA, 20 bp, mouse
gcagaggtcggaagtggtga

SEQ ID NO: 676243 - DNA, 20 bp, mouse
ggctggcagtcctaggagca

SEQ ID NO: 676244 - DNA, 20 bp, mouse
gatcgtccggttcactctat

SEQ ID NO: 676245 - DNA, 20 bp, mouse
ggttcactctataggagtga

SEQ ID NO: 676246 - DNA, 20 bp, mouse
ggctcggggaggttcggcga

SEQ ID NO: 676247 - DNA, 20 bp, mouse
ggggaggttcgggagggttc

SEQ ID NO: 676248 - DNA, 20 bp, mouse
gggcgcgcgcccagctgatc

SEQ ID NO: 676249 - DNA, 20 bp, mouse
gggctcgggacggttcggag

SEQ ID NO: 676250 - DNA, 20 bp, mouse
gccggcctctcgcacggtct

SEQ ID NO: 676251 - DNA, 20 bp, mouse
gcgacgcctcggggaggttc

SEQ ID NO: 676252 - DNA, 20 bp, mouse
gcgtcccgcccgaggcccgc

SEQ ID NO: 676253 - DNA, 20 bp, mouse
gcgggcgcgcgcacccgcgg

SEQ ID NO: 676254 - DNA, 20 bp, mouse
gtcgggtgaagctcgggcgg

SEQ ID NO: 676255 - DNA, 20 bp, mouse
ggcgacggctcgggacggtt

SEQ ID NO: 676256 - DNA, 20 bp, mouse
gtatctaaacagaaggggat

SEQ ID NO: 676257 - DNA, 20 bp, mouse
ggaacccacttcaatactcg

SEQ ID NO: 676258 - DNA, 20 bp, mouse
gaatcccggtgaaacgctag

SEQ ID NO: 676259 - DNA, 20 bp, mouse
gctaaacagaaggggatggg

SEQ ID NO: 676260 - DNA, 20 bp, mouse
gcgggattatctaaacagaa

SEQ ID NO: 676261 - DNA, 20 bp, mouse
gccattaattacttggaggg

SEQ ID NO: 676262 - DNA, 20 bp, mouse
gttcaatactcgtggatcat

SEQ ID NO: 676263 - DNA, 20 bp, mouse
ggatccacgagtattgaagt

SEQ ID NO: 676264 - DNA, 20 bp, mouse
gcagcctctagcgtttcacc

SEQ ID NO: 676265 - DNA, 20 bp, mouse
ggctagaggctgcttgttcc

SEQ ID NO: 676266 - DNA, 20 bp, mouse
gcggcccggaagtgtctaag

SEQ ID NO: 676267 - DNA, 20 bp, mouse
gtgccttctaacagtgtttt

SEQ ID NO: 676268 - DNA, 20 bp, mouse
gagaatccatgcatcccaca

SEQ ID NO: 676269 - DNA, 20 bp, mouse
gtcttcacatggggctgcac

SEQ ID NO: 676270 - DNA, 20 bp, mouse
gtgctcggattaaaagacgt

SEQ ID NO: 676271 - DNA, 20 bp, mouse
gaccgggcggcgcatgcgct

SEQ ID NO: 676272 - DNA, 20 bp, mouse
gttcccaaaacactgttaga

SEQ ID NO: 676273 - DNA, 20 bp, mouse
gtgggatgcatggattctgc

SEQ ID NO: 676274 - DNA, 20 bp, mouse
gtagaaggcaagcgaccggg

SEQ ID NO: 676275 - DNA, 20 bp, mouse
gctctaggaaagcgcgaccg

SEQ ID NO: 676276 - DNA, 20 bp, mouse
gtgcctgcagtgacaccaat

SEQ ID NO: 676277 - DNA, 20 bp, mouse
gccatcgtagggcaagaagt

SEQ ID NO: 676278 - DNA, 20 bp, mouse
gtggaggactcgtgacatcc

SEQ ID NO: 676279 - DNA, 20 bp, mouse
gacacccctagtgtggactc

SEQ ID NO: 676280 - DNA, 20 bp, mouse
gtccctgggaccgagttcac

SEQ ID NO: 676281 - DNA, 20 bp, mouse
ggaaaggtccagagacgtgc

SEQ ID NO: 676282 - DNA, 20 bp, mouse
gggtgtggccacaagccgat

SEQ ID NO: 676283 - DNA, 20 bp, mouse
gcagagacgtgcaggaaacc

SEQ ID NO: 676284 - DNA, 20 bp, mouse
gcacaccagagtccacacta

SEQ ID NO: 676285 - DNA, 20 bp, mouse
gagtgggcggggcctaggtc

SEQ ID NO: 676286 - DNA, 20 bp, mouse
gcggaagcgcagcgagaccc

SEQ ID NO: 676287 - DNA, 20 bp, mouse
gtgcgctgtcacgagaaccg

SEQ ID NO: 676288 - DNA, 20 bp, mouse
gaagcgcagcgagacccggg

SEQ ID NO: 676289 - DNA, 20 bp, mouse
gacagcgcacgcgcgaccgc

SEQ ID NO: 676290 - DNA, 20 bp, mouse
gcgcagcgagacccgggtgg

SEQ ID NO: 676291 - DNA, 20 bp, mouse
gggacaagtgctttatattc

SEQ ID NO: 676292 - DNA, 20 bp, mouse
gagcggttcctggaacccgg

SEQ ID NO: 676293 - DNA, 20 bp, mouse
gtgtggaagacctgtgctcc

SEQ ID NO: 676294 - DNA, 20 bp, mouse
gaggccaagcactgataaca

SEQ ID NO: 676295 - DNA, 20 bp, mouse
gctctgagctcaaaagtttg

SEQ ID NO: 676296 - DNA, 20 bp, mouse
gaggggcggtcgagactgag

SEQ ID NO: 676297 - DNA, 20 bp, mouse
gaggccctgggttcaaatac

SEQ ID NO: 676298 - DNA, 20 bp, mouse
gccttcagcagcaagcggat

SEQ ID NO: 676299 - DNA, 20 bp, mouse
gcgtccacgtgactttctgg

SEQ ID NO: 676300 - DNA, 20 bp, mouse
ggaaagtcacgtggacgaat

SEQ ID NO: 676301 - DNA, 20 bp, mouse
ggaatcggagcgtaagccta

SEQ ID NO: 676302 - DNA, 20 bp, mouse
gacaggtatctctacttctc

SEQ ID NO: 676303 - DNA, 20 bp, mouse
gcgccctccagaaagtcacg

SEQ ID NO: 676304 - DNA, 20 bp, mouse
gcgtgacaggcctgaacctt

SEQ ID NO: 676305 - DNA, 20 bp, mouse
gacagcctgtatttgaaccc

SEQ ID NO: 676306 - DNA, 20 bp, mouse
gactaagctcaaagaccaga

SEQ ID NO: 676307 - DNA, 20 bp, mouse
ggaacggcgtgcaaagaacc

SEQ ID NO: 676308 - DNA, 20 bp, mouse
gtggctggacatcctaggtc

SEQ ID NO: 676309 - DNA, 20 bp, mouse
gtgtccagccagttgttccc

SEQ ID NO: 676310 - DNA, 20 bp, mouse
gtcagccagcctacccagag

SEQ ID NO: 676311 - DNA, 20 bp, mouse
gagcctacccagaggggcaa

SEQ ID NO: 676312 - DNA, 20 bp, mouse
gacaactggctggacatcct

SEQ ID NO: 676313 - DNA, 20 bp, mouse
gtcccagcatgtcctgcgag

SEQ ID NO: 676314 - DNA, 20 bp, mouse
ggtgcctcgtgacccctcgc

SEQ ID NO: 676315 - DNA, 20 bp, mouse
gtgtcctgcgaggggtcacg

SEQ ID NO: 676316 - DNA, 20 bp, mouse
gacccggcgcggggataaat

SEQ ID NO: 676317 - DNA, 20 bp, mouse
gagctgatcagtatatggtg

SEQ ID NO: 676318 - DNA, 20 bp, mouse
ggagccttgaagagtaaatt

SEQ ID NO: 676319 - DNA, 20 bp, mouse
gagctgcgggtcatcccgca

SEQ ID NO: 676320 - DNA, 20 bp, mouse
ggggtccgggacagcccccg

SEQ ID NO: 676321 - DNA, 20 bp, mouse
gggagtgtgggagccagagt

SEQ ID NO: 676322 - DNA, 20 bp, mouse
ggctctgggcagggccgcgg

SEQ ID NO: 676323 - DNA, 20 bp, mouse
gagcccgccacaaggtaaac

SEQ ID NO: 676324 - DNA, 20 bp, mouse
gcgcggggataaataggccg

SEQ ID NO: 676325 - DNA, 20 bp, mouse
gtgtccccgtagatagcatt

SEQ ID NO: 676326 - DNA, 20 bp, mouse
gcccctgtggacactcgcac

SEQ ID NO: 676327 - DNA, 20 bp, mouse
ggcgagtgcagcgggaggta

SEQ ID NO: 676328 - DNA, 20 bp, mouse
ggacacgggctctgacacgc

SEQ ID NO: 676329 - DNA, 20 bp, mouse
gtgggcggtgcacgcggaga

SEQ ID NO: 676330 - DNA, 20 bp, mouse
ggggaggtagggtggggtcg

SEQ ID NO: 676331 - DNA, 20 bp, mouse
gtcctggaacgtgtccgcgt

SEQ ID NO: 676332 - DNA, 20 bp, mouse
ggctctgacacgcgggacaa

SEQ ID NO: 676333 - DNA, 20 bp, mouse
gcgcttccggccgcggacac

SEQ ID NO: 676334 - DNA, 20 bp, mouse
ggtgtcagagcccgtgtccg

SEQ ID NO: 676335 - DNA, 20 bp, mouse
gacaggccagggttctgatt

SEQ ID NO: 676336 - DNA, 20 bp, mouse
gagaacatctcgccacccgg

SEQ ID NO: 676337 - DNA, 20 bp, mouse
ggctgcatgcggaactgcgt

SEQ ID NO: 676338 - DNA, 20 bp, mouse
gcccatgctcacaagagccc

SEQ ID NO: 676339 - DNA, 20 bp, mouse
gagaggggataaagtgagtg

SEQ ID NO: 676340 - DNA, 20 bp, mouse
gggaggggtgcccaagttaa

SEQ ID NO: 676341 - DNA, 20 bp, mouse
gcagatggtgcccgaggacg

SEQ ID NO: 676342 - DNA, 20 bp, mouse
gggcaccatctggtgacaca

SEQ ID NO: 676343 - DNA, 20 bp, mouse
gtccgcatgcagccaccggg

SEQ ID NO: 676344 - DNA, 20 bp, mouse
ggaggaatccaaagagactc

SEQ ID NO: 676345 - DNA, 20 bp, mouse
gcccgaggacgcggctctgt

SEQ ID NO: 676346 - DNA, 20 bp, mouse
ggggcctgacccaggaagtc

SEQ ID NO: 676347 - DNA, 20 bp, mouse
gaggccgctacgagtctgga

SEQ ID NO: 676348 - DNA, 20 bp, mouse
gcgagtctggaagggacctg

SEQ ID NO: 676349 - DNA, 20 bp, mouse
ggcaagatggctacgactag

SEQ ID NO: 676350 - DNA, 20 bp, mouse
ggtcccttccagactcgtag

SEQ ID NO: 676351 - DNA, 20 bp, mouse
gagagaggccgctacgagtc

SEQ ID NO: 676352 - DNA, 20 bp, mouse
ggaccccgacttcctgggtc

SEQ ID NO: 676353 - DNA, 20 bp, mouse
gctacgactaggggcggctc

SEQ ID NO: 676354 - DNA, 20 bp, mouse
gagtgcaggcaatgcccttc

SEQ ID NO: 676355 - DNA, 20 bp, mouse
gagatggctacgactagggg

SEQ ID NO: 676356 - DNA, 20 bp, mouse
ggcgcagctcagggcggaag

SEQ ID NO: 676357 - DNA, 20 bp, mouse
gtccgccctgagctgcgccc

SEQ ID NO: 676358 - DNA, 20 bp, mouse
gagaagacaacacacttcca

SEQ ID NO: 676359 - DNA, 20 bp, mouse
gagtcagctcccaactcgct

SEQ ID NO: 676360 - DNA, 20 bp, mouse
ggacggctccaccaagtcct

SEQ ID NO: 676361 - DNA, 20 bp, mouse
gccttggctgacgtggaagg

SEQ ID NO: 676362 - DNA, 20 bp, mouse
gggagctgacttaagcgctg

SEQ ID NO: 676363 - DNA, 20 bp, mouse
gtccagggcgcagctcaggg

SEQ ID NO: 676364 - DNA, 20 bp, mouse
gttagttttcccagcgagtt

SEQ ID NO: 676365 - DNA, 20 bp, mouse
gcacttccagggcgcagctc

SEQ ID NO: 676366 - DNA, 20 bp, mouse
gcctgcgcacaccctccgta

SEQ ID NO: 676367 - DNA, 20 bp, mouse
gagagttgggcggtgactag

SEQ ID NO: 676368 - DNA, 20 bp, mouse
gtattgctgtggccagagtt

SEQ ID NO: 676369 - DNA, 20 bp, mouse
gcccggaagttccacgtcag

SEQ ID NO: 676370 - DNA, 20 bp, mouse
ggttgggcggtgactagcgg

SEQ ID NO: 676371 - DNA, 20 bp, mouse
gtgaacgtcggcagcagtgg

SEQ ID NO: 676372 - DNA, 20 bp, mouse
gcggtgactagcggcggtct

SEQ ID NO: 676373 - DNA, 20 bp, mouse
ggttacctaggaaactgggg

SEQ ID NO: 676374 - DNA, 20 bp, mouse
gcctttctgaaactgaccga

SEQ ID NO: 676375 - DNA, 20 bp, mouse
gctgatggagtgtattgctg

SEQ ID NO: 676376 - DNA, 20 bp, mouse
gcaaagctcggattggttga

SEQ ID NO: 676377 - DNA, 20 bp, mouse
gcacccgagctgcaccggcg

SEQ ID NO: 676378 - DNA, 20 bp, mouse
ggcggaggaatgtgacgtca

SEQ ID NO: 676379 - DNA, 20 bp, mouse
gtggaacccaagtggggcta

SEQ ID NO: 676380 - DNA, 20 bp, mouse
gagaacagtgtcgacagctg

SEQ ID NO: 676381 - DNA, 20 bp, mouse
gaaaagttgtgagaggacgt

SEQ ID NO: 676382 - DNA, 20 bp, mouse
gctgaaaagcggtcaaagct

SEQ ID NO: 676383 - DNA, 20 bp, mouse
ggcccacgccggtgcagctc

SEQ ID NO: 676384 - DNA, 20 bp, mouse
gtgagatcgggttgtcgtcg

SEQ ID NO: 676385 - DNA, 20 bp, mouse
ggccggaagcactcatttct

SEQ ID NO: 676386 - DNA, 20 bp, mouse
ggggtgagacccaggaaagt

SEQ ID NO: 676387 - DNA, 20 bp, mouse
gcacccgcaaccgcaggtct

SEQ ID NO: 676388 - DNA, 20 bp, mouse
gccaaaacctaggtggaaga

SEQ ID NO: 676389 - DNA, 20 bp, mouse
gcgtggctagacactggagg

SEQ ID NO: 676390 - DNA, 20 bp, mouse
gtagccacgcccactttcct

SEQ ID NO: 676391 - DNA, 20 bp, mouse
ggggcgtggctagacactgg

SEQ ID NO: 676392 - DNA, 20 bp, mouse
ggagcctagacctgcggttg

SEQ ID NO: 676393 - DNA, 20 bp, mouse
gcgccctgagcactgcacta

SEQ ID NO: 676394 - DNA, 20 bp, mouse
gagtagcagggaacatgtat

SEQ ID NO: 676395 - DNA, 20 bp, mouse
gtaaagggcattctgatggg

SEQ ID NO: 676396 - DNA, 20 bp, mouse
ggctccgcccactgccgcac

SEQ ID NO: 676397 - DNA, 20 bp, mouse
gcggccgcccttgcccccta

SEQ ID NO: 676398 - DNA, 20 bp, mouse
ggcgtgcctgcgtccctagg

SEQ ID NO: 676399 - DNA, 20 bp, mouse
gaggtctgagacaacaaaca

SEQ ID NO: 676400 - DNA, 20 bp, mouse
ggtggccagaatctgcccgg

SEQ ID NO: 676401 - DNA, 20 bp, mouse
gcgtccctagggggcaaggg

SEQ ID NO: 676402 - DNA, 20 bp, mouse
gcctcactctccaagaactg

SEQ ID NO: 676403 - DNA, 20 bp, mouse
gcacgcccccgtgcggcagt

SEQ ID NO: 676404 - DNA, 20 bp, mouse
gcaaccggtgcgagaaccca

SEQ ID NO: 676405 - DNA, 20 bp, mouse
gcggccgcggaggcccgagg

SEQ ID NO: 676406 - DNA, 20 bp, mouse
gaagccccgtgtggctggga

SEQ ID NO: 676407 - DNA, 20 bp, mouse
ggggctgcggacaagccaat

SEQ ID NO: 676408 - DNA, 20 bp, mouse
gcggtcccgcacaacaacgc

SEQ ID NO: 676409 - DNA, 20 bp, mouse
ggcagtaggaaagccccgtg

SEQ ID NO: 676410 - DNA, 20 bp, mouse
ggggcggcgcggcgaccgag

SEQ ID NO: 676411 - DNA, 20 bp, mouse
gcccacctgcgttgttgtgc

SEQ ID NO: 676412 - DNA, 20 bp, mouse
gcggacaagccaatcggcgt

SEQ ID NO: 676413 - DNA, 20 bp, mouse
gtcgagccttaggcctgatt

SEQ ID NO: 676414 - DNA, 20 bp, mouse
ggaaaagtgatggagcccat

SEQ ID NO: 676415 - DNA, 20 bp, mouse
ggggacgctccggcacgtga

SEQ ID NO: 676416 - DNA, 20 bp, mouse
gaccctgagatgatttacta

SEQ ID NO: 676417 - DNA, 20 bp, mouse
gaagacacaaactgtcgctc

SEQ ID NO: 676418 - DNA, 20 bp, mouse
ggttgcgggtcctatctgag

SEQ ID NO: 676419 - DNA, 20 bp, mouse
gccggctgtgccctcccttt

SEQ ID NO: 676420 - DNA, 20 bp, mouse
gtagctgtatccagcgtcct

SEQ ID NO: 676421 - DNA, 20 bp, mouse
ggggtcgagcgctttagttc

SEQ ID NO: 676422 - DNA, 20 bp, mouse
gtatccagcgtcctaggtga

SEQ ID NO: 676423 - DNA, 20 bp, mouse
gaccggaagacgaggagact

SEQ ID NO: 676424 - DNA, 20 bp, mouse
gcatgcccgacctatctgaa

SEQ ID NO: 676425 - DNA, 20 bp, mouse
gactgtcgctcaggaagagc

SEQ ID NO: 676426 - DNA, 20 bp, mouse
ggagccgtgtcggaagtatg

SEQ ID NO: 676427 - DNA, 20 bp, mouse
ggcactacaatgaaaggcga

SEQ ID NO: 676428 - DNA, 20 bp, mouse
gacaatgaaaggcgagggag

SEQ ID NO: 676429 - DNA, 20 bp, mouse
gccgctagtcgccggaagtc

SEQ ID NO: 676430 - DNA, 20 bp, mouse
gaaacagttccgctagtcgc

SEQ ID NO: 676431 - DNA, 20 bp, mouse
gactagcggaactgtttcca

SEQ ID NO: 676432 - DNA, 20 bp, mouse
gagtggcaatggagccgtgt

SEQ ID NO: 676433 - DNA, 20 bp, mouse
gagcgccgcgagatcttacc

SEQ ID NO: 676434 - DNA, 20 bp, mouse
gccaagtgcactacaatgaa

SEQ ID NO: 676435 - DNA, 20 bp, mouse
ggctctctagtgacatgttc

SEQ ID NO: 676436 - DNA, 20 bp, mouse
gtgggccagagcgccggata

SEQ ID NO: 676437 - DNA, 20 bp, mouse
gacctgggcggtcctcaaac

SEQ ID NO: 676438 - DNA, 20 bp, mouse
gtgggcggtcctcaaaccgg

SEQ ID NO: 676439 - DNA, 20 bp, mouse
gaaaccggaggagaggagtc

SEQ ID NO: 676440 - DNA, 20 bp, mouse
gtaaaggcccggcaagtcaa

SEQ ID NO: 676441 - DNA, 20 bp, mouse
gtggtgtcactcaactcgga

SEQ ID NO: 676442 - DNA, 20 bp, mouse
gcaggtctcccgagagacgc

SEQ ID NO: 676443 - DNA, 20 bp, mouse
gggtcctcaaaccggaggag

SEQ ID NO: 676444 - DNA, 20 bp, mouse
gagtctggtgtcactcaact

SEQ ID NO: 676445 - DNA, 20 bp, mouse
gcgtgagcgcctgcgtctct

SEQ ID NO: 676446 - DNA, 20 bp, mouse
gggacgcaaagcctcggtgt

SEQ ID NO: 676447 - DNA, 20 bp, mouse
gcggtgaaacgagaacatgc

SEQ ID NO: 676448 - DNA, 20 bp, mouse
gcggccgactccttcctggc

SEQ ID NO: 676449 - DNA, 20 bp, mouse
gccgagccgagccaacccta

SEQ ID NO: 676450 - DNA, 20 bp, mouse
gcaaagcctcggtgtgggaa

SEQ ID NO: 676451 - DNA, 20 bp, mouse
gtgcgagggacgcaaagcct

SEQ ID NO: 676452 - DNA, 20 bp, mouse
gccccagcgcgcgaatggtc

SEQ ID NO: 676453 - DNA, 20 bp, mouse
gcggctaagatcagtcttgc

SEQ ID NO: 676454 - DNA, 20 bp, mouse
ggagccggccgactccttcc

SEQ ID NO: 676455 - DNA, 20 bp, mouse
gccgttcgtgtgaactgcga

SEQ ID NO: 676456 - DNA, 20 bp, mouse
gaggaggaaaggctgtaaaa

SEQ ID NO: 676457 - DNA, 20 bp, mouse
gagcatgcaccgctccccga

SEQ ID NO: 676458 - DNA, 20 bp, mouse
ggcgggcgcggggaaaatgg

SEQ ID NO: 676459 - DNA, 20 bp, mouse
gcggaagccgagaaggaaag

SEQ ID NO: 676460 - DNA, 20 bp, mouse
gtccttctcggcttccgtcg

SEQ ID NO: 676461 - DNA, 20 bp, mouse
gtgccagtacttagtagctc

SEQ ID NO: 676462 - DNA, 20 bp, mouse
ggaaaggggcgggccgtggc

SEQ ID NO: 676463 - DNA, 20 bp, mouse
gactaatagccctccttggg

SEQ ID NO: 676464 - DNA, 20 bp, mouse
gaccctgagctactaagtac

SEQ ID NO: 676465 - DNA, 20 bp, mouse
ggaaaggctgtaaaagggaa

SEQ ID NO: 676466 - DNA, 20 bp, mouse
gcacggacagagcggaagat

SEQ ID NO: 676467 - DNA, 20 bp, mouse
ggcctcccgcggtccggaaa

SEQ ID NO: 676468 - DNA, 20 bp, mouse
gtgcgagagcggtgaatgca

SEQ ID NO: 676469 - DNA, 20 bp, mouse
gggaacccgcctcccgagag

SEQ ID NO: 676470 - DNA, 20 bp, mouse
gtggcggccccgagttcctg

SEQ ID NO: 676471 - DNA, 20 bp, mouse
ggggagctgcaggacaaggc

SEQ ID NO: 676472 - DNA, 20 bp, mouse
ggccgctctcgcgcctcccg

SEQ ID NO: 676473 - DNA, 20 bp, mouse
ggctccgtcacctccggcag

SEQ ID NO: 676474 - DNA, 20 bp, mouse
gaccgcgggaggcgcgagag

SEQ ID NO: 676475 - DNA, 20 bp, mouse
gcagggtgcggagaggacct

SEQ ID NO: 676476 - DNA, 20 bp, mouse
gccacctcccacctagattg

SEQ ID NO: 676477 - DNA, 20 bp, mouse
gtccggagctgcaaccctga

SEQ ID NO: 676478 - DNA, 20 bp, mouse
gaggagaagagggtcccctc

SEQ ID NO: 676479 - DNA, 20 bp, mouse
gcccctcagggttgcagctc

SEQ ID NO: 676480 - DNA, 20 bp, mouse
ggcaaagcaagtaaaacatg

SEQ ID NO: 676481 - DNA, 20 bp, mouse
ggggagccgctgttgcctga

SEQ ID NO: 676482 - DNA, 20 bp, mouse
gcggaactcgagtgcagcag

SEQ ID NO: 676483 - DNA, 20 bp, mouse
ggggttgcagctccggaaac

SEQ ID NO: 676484 - DNA, 20 bp, mouse
gaacagcaccggtgacgggt

SEQ ID NO: 676485 - DNA, 20 bp, mouse
gggcaacagcggctcccctg

SEQ ID NO: 676486 - DNA, 20 bp, mouse
gcggggacggagagcgtcag

SEQ ID NO: 676487 - DNA, 20 bp, mouse
gctcctctgggacaaactct

SEQ ID NO: 676488 - DNA, 20 bp, mouse
gcagcggcttcgctcgggga

SEQ ID NO: 676489 - DNA, 20 bp, mouse
gtgtgcccggcaacaagagc

SEQ ID NO: 676490 - DNA, 20 bp, mouse
gcactagtggtctgagacta

SEQ ID NO: 676491 - DNA, 20 bp, mouse
gtggcaggctgcactgtaca

SEQ ID NO: 676492 - DNA, 20 bp, mouse
ggccaaggctggcttgtcat

SEQ ID NO: 676493 - DNA, 20 bp, mouse
gaggccccgcggagccagcg

SEQ ID NO: 676494 - DNA, 20 bp, mouse
gacaagccagccttggcgat

SEQ ID NO: 676495 - DNA, 20 bp, mouse
gcgggagctccacgactaga

SEQ ID NO: 676496 - DNA, 20 bp, mouse
gatccggaagggttcggctg

SEQ ID NO: 676497 - DNA, 20 bp, mouse
gacgccgtagcggaatacaa

SEQ ID NO: 676498 - DNA, 20 bp, mouse
gcgcacggggaaatgataac

SEQ ID NO: 676499 - DNA, 20 bp, mouse
gcgaacccttccggatcgca

SEQ ID NO: 676500 - DNA, 20 bp, mouse
ggcgctctgccccaacgtct

SEQ ID NO: 676501 - DNA, 20 bp, mouse
ggctctggaggacccgcccc

SEQ ID NO: 676502 - DNA, 20 bp, mouse
gagagccctgcgatccggaa

SEQ ID NO: 676503 - DNA, 20 bp, mouse
gagccgcagccgaacccttc

SEQ ID NO: 676504 - DNA, 20 bp, mouse
gccccaacgtctcggtgctc

SEQ ID NO: 676505 - DNA, 20 bp, mouse
ggccccaggctaggacgaac

SEQ ID NO: 676506 - DNA, 20 bp, mouse
gctgactggtcaagacgcga

SEQ ID NO: 676507 - DNA, 20 bp, mouse
gtatagcgagtgcgaattgg

SEQ ID NO: 676508 - DNA, 20 bp, mouse
gggggcgggaggatcattga

SEQ ID NO: 676509 - DNA, 20 bp, mouse
gggaggctgacagaatcacg

SEQ ID NO: 676510 - DNA, 20 bp, mouse
ggggacctagcgaagactca

SEQ ID NO: 676511 - DNA, 20 bp, mouse
gccaaaacctcagcactgaa

SEQ ID NO: 676512 - DNA, 20 bp, mouse
ggtgttgtttccatggggaa

SEQ ID NO: 676513 - DNA, 20 bp, mouse
ggggaatctgtattcgggta

SEQ ID NO: 676514 - DNA, 20 bp, mouse
ggggcggtgttgtttccatg

SEQ ID NO: 676515 - DNA, 20 bp, mouse
gtggctgcctatagctaact

SEQ ID NO: 676516 - DNA, 20 bp, mouse
gggaagaaaagagtaggctc

SEQ ID NO: 676517 - DNA, 20 bp, mouse
gaggttctgcaacgacgtgg

SEQ ID NO: 676518 - DNA, 20 bp, mouse
gggccagaagaggcagtaag

SEQ ID NO: 676519 - DNA, 20 bp, mouse
gcggaggggcggcgtcgcgg

SEQ ID NO: 676520 - DNA, 20 bp, mouse
gaaagctcgcccagagagag

SEQ ID NO: 676521 - DNA, 20 bp, mouse
gaggcgccctaggccagaag

SEQ ID NO: 676522 - DNA, 20 bp, mouse
gcacgcaggactgggcggag

SEQ ID NO: 676523 - DNA, 20 bp, mouse
gtgtgtgcgtcctctctctc

SEQ ID NO: 676524 - DNA, 20 bp, mouse
ggtgcacctcccagtctttc

SEQ ID NO: 676525 - DNA, 20 bp, mouse
ggttcacctgaaagactggg

SEQ ID NO: 676526 - DNA, 20 bp, mouse
ggcaaagctcgaatcaatgt

SEQ ID NO: 676527 - DNA, 20 bp, mouse
gcctgacaaaggaaatgtgc

SEQ ID NO: 676528 - DNA, 20 bp, mouse
ggggagctttaacccagcgt

SEQ ID NO: 676529 - DNA, 20 bp, mouse
gtagactcagagtcaagacg

SEQ ID NO: 676530 - DNA, 20 bp, mouse
gcttgctcttgcacccgtct

SEQ ID NO: 676531 - DNA, 20 bp, mouse
gagaaagagattagcctaga

SEQ ID NO: 676532 - DNA, 20 bp, mouse
ggagcttgctctgtgacagt

SEQ ID NO: 676533 - DNA, 20 bp, mouse
gttcgagctttgcctgacaa

SEQ ID NO: 676534 - DNA, 20 bp, mouse
gagctctgctttccctacgc

SEQ ID NO: 676535 - DNA, 20 bp, mouse
ggttctctccatgggggcgg

SEQ ID NO: 676536 - DNA, 20 bp, mouse
ggctcagagggctcccggat

SEQ ID NO: 676537 - DNA, 20 bp, mouse
gagcgtcagcgtggcgtcat

SEQ ID NO: 676538 - DNA, 20 bp, mouse
gagcgtggcgtcatggggtt

SEQ ID NO: 676539 - DNA, 20 bp, mouse
ggccccgattggctgtcccg

SEQ ID NO: 676540 - DNA, 20 bp, mouse
gcacgtgtccagtgccgcct

SEQ ID NO: 676541 - DNA, 20 bp, mouse
gcaatcggggcgcggatctc

SEQ ID NO: 676542 - DNA, 20 bp, mouse
gccgattggctgtcccgagg

SEQ ID NO: 676543 - DNA, 20 bp, mouse
ggccctcaggccggcctgga

SEQ ID NO: 676544 - DNA, 20 bp, mouse
ggcgcaggagccgtccctcc

SEQ ID NO: 676545 - DNA, 20 bp, mouse
ggtcacgaagattacataag

SEQ ID NO: 676546 - DNA, 20 bp, mouse
gcggtcggtggcgtcatcca

SEQ ID NO: 676547 - DNA, 20 bp, mouse
gatggcgccaggctggacgc

SEQ ID NO: 676548 - DNA, 20 bp, mouse
gcatccagggcgacgggccg

SEQ ID NO: 676549 - DNA, 20 bp, mouse
gtcaccttctaacactaaaa

SEQ ID NO: 676550 - DNA, 20 bp, mouse
gtggcgtcatccagggcgac

SEQ ID NO: 676551 - DNA, 20 bp, mouse
gcaggctggacgccggtcgg

SEQ ID NO: 676552 - DNA, 20 bp, mouse
gcgccaggctggacgccggt

SEQ ID NO: 676553 - DNA, 20 bp, mouse
gcactgcgcatgcctgcccg

SEQ ID NO: 676554 - DNA, 20 bp, mouse
ggcgcgcgcgctcctggaac

SEQ ID NO: 676555 - DNA, 20 bp, mouse
ggcttcttaatgaactcaaa

SEQ ID NO: 676556 - DNA, 20 bp, mouse
gacagcacggcgtgactcgt

SEQ ID NO: 676557 - DNA, 20 bp, mouse
gactcgtaggacgagaaggt

SEQ ID NO: 676558 - DNA, 20 bp, mouse
gcatccgcgagtgtaggagg

SEQ ID NO: 676559 - DNA, 20 bp, mouse
gcgtgactcgtaggacgaga

SEQ ID NO: 676560 - DNA, 20 bp, mouse
gatagaggagctcgagttaa

SEQ ID NO: 676561 - DNA, 20 bp, mouse
gaggcggaacccttccgctg

SEQ ID NO: 676562 - DNA, 20 bp, mouse
gccgctggggatttgttgtg

SEQ ID NO: 676563 - DNA, 20 bp, mouse
gcggcatccgcgagtgtagg

SEQ ID NO: 676564 - DNA, 20 bp, mouse
ggttccgcctcctacactcg

SEQ ID NO: 676565 - DNA, 20 bp, mouse
gaagagatgttcctaataaa

SEQ ID NO: 676566 - DNA, 20 bp, mouse
gtggttaggcggggctccgc

SEQ ID NO: 676567 - DNA, 20 bp, mouse
gggctccgcaggtactacgg

SEQ ID NO: 676568 - DNA, 20 bp, mouse
gcggggctccgcaggtacta

SEQ ID NO: 676569 - DNA, 20 bp, mouse
gcctccaggtttcaaatgct

SEQ ID NO: 676570 - DNA, 20 bp, mouse
gcgggcctccgtagtacctg

SEQ ID NO: 676571 - DNA, 20 bp, mouse
ggacgtccgcgtggttaggc

SEQ ID NO: 676572 - DNA, 20 bp, mouse
ggatcggagatgttgtaata

SEQ ID NO: 676573 - DNA, 20 bp, mouse
gtatggacaggagcatgaga

SEQ ID NO: 676574 - DNA, 20 bp, mouse
ggtgacgagtaattcacatc

SEQ ID NO: 676575 - DNA, 20 bp, mouse
gcaacccagcatttgaaacc

SEQ ID NO: 676576 - DNA, 20 bp, mouse
gctaggactaaagactacta

SEQ ID NO: 676577 - DNA, 20 bp, mouse
gtaaactctagattcagtca

SEQ ID NO: 676578 - DNA, 20 bp, mouse
gtgcgtcaccagccgggtga

SEQ ID NO: 676579 - DNA, 20 bp, mouse
ggtcaccagccgggtgacgg

SEQ ID NO: 676580 - DNA, 20 bp, mouse
gccactaatgtgtctcctgt

SEQ ID NO: 676581 - DNA, 20 bp, mouse
gataagcagaattcagacag

SEQ ID NO: 676582 - DNA, 20 bp, mouse
gtaaaaaaacaggcgtttgg

SEQ ID NO: 676583 - DNA, 20 bp, mouse
gcaaaagttgcagggcatga

SEQ ID NO: 676584 - DNA, 20 bp, mouse
gcaggaactgggtgaaattg

SEQ ID NO: 676585 - DNA, 20 bp, mouse
gagattcagtcagggaacac

SEQ ID NO: 676586 - DNA, 20 bp, mouse
gcaaggctaaagccatgaag

SEQ ID NO: 676587 - DNA, 20 bp, mouse
gggcggaacagactaaagac

SEQ ID NO: 676588 - DNA, 20 bp, mouse
gtaggaagatgactgtgggg

SEQ ID NO: 676589 - DNA, 20 bp, mouse
gaagactggaagccaatcca

SEQ ID NO: 676590 - DNA, 20 bp, mouse
gcatggctttagccttggat

SEQ ID NO: 676591 - DNA, 20 bp, mouse
gtcaggggcgtgtcatcaaa

SEQ ID NO: 676592 - DNA, 20 bp, mouse
gaggtcctgagtgcgccgag

SEQ ID NO: 676593 - DNA, 20 bp, mouse
gctaaagccatgaaggggcg

SEQ ID NO: 676594 - DNA, 20 bp, mouse
gggcaagagcgtcttctgat

SEQ ID NO: 676595 - DNA, 20 bp, mouse
gacgctcttgcctcattggg

SEQ ID NO: 676596 - DNA, 20 bp, mouse
gggcgcccggtcggctctta

SEQ ID NO: 676597 - DNA, 20 bp, mouse
gtcaaccctaagagccgacc

SEQ ID NO: 676598 - DNA, 20 bp, mouse
gaggaaacgcccctaggccc

SEQ ID NO: 676599 - DNA, 20 bp, mouse
gaacctaaaatgcctctcca

SEQ ID NO: 676600 - DNA, 20 bp, mouse
gtgccctggagaggcatttt

SEQ ID NO: 676601 - DNA, 20 bp, mouse
ggagaaggaacggaaagtaa

SEQ ID NO: 676602 - DNA, 20 bp, mouse
gtcttggaaaggcgacccgc

SEQ ID NO: 676603 - DNA, 20 bp, mouse
gatgcagagctgccctggag

SEQ ID NO: 676604 - DNA, 20 bp, mouse
ggtaacgtcgtgaaggcgcc

SEQ ID NO: 676605 - DNA, 20 bp, mouse
ggggtgtaatccagggccta

SEQ ID NO: 676606 - DNA, 20 bp, mouse
gaggaaggtgaggacgctcg

SEQ ID NO: 676607 - DNA, 20 bp, mouse
gccgccgcggcccctcaccc

SEQ ID NO: 676608 - DNA, 20 bp, mouse
ggcggccggggccctgcacg

SEQ ID NO: 676609 - DNA, 20 bp, mouse
ggggcagcgtcacgcgtcag

SEQ ID NO: 676610 - DNA, 20 bp, mouse
gctcaccccggcttccccaa

SEQ ID NO: 676611 - DNA, 20 bp, mouse
ggtccgcggagcgggttttc

SEQ ID NO: 676612 - DNA, 20 bp, mouse
ggtcgctcgagcatctgagc

SEQ ID NO: 676613 - DNA, 20 bp, mouse
gaccagagtggcccctagga

SEQ ID NO: 676614 - DNA, 20 bp, mouse
gccccaaggggtgacaatga

SEQ ID NO: 676615 - DNA, 20 bp, mouse
ggaagccgaagcgagagcac

SEQ ID NO: 676616 - DNA, 20 bp, mouse
gggagtgaagttatactcag

SEQ ID NO: 676617 - DNA, 20 bp, mouse
gcgagctgacgccccaaaga

SEQ ID NO: 676618 - DNA, 20 bp, mouse
gacccagagacgtgagtgaa

SEQ ID NO: 676619 - DNA, 20 bp, mouse
ggaagggagggagtggtctg

SEQ ID NO: 676620 - DNA, 20 bp, mouse
gtcctccggagcaagggcgg

SEQ ID NO: 676621 - DNA, 20 bp, mouse
gctcggcggctgtactcctc

SEQ ID NO: 676622 - DNA, 20 bp, mouse
gggtggcacccgatgaaagg

SEQ ID NO: 676623 - DNA, 20 bp, mouse
gtactcctccggagcaaggg

SEQ ID NO: 676624 - DNA, 20 bp, mouse
gctgctgccccatagttgaa

SEQ ID NO: 676625 - DNA, 20 bp, mouse
ggcccagcagacaaaatatg

SEQ ID NO: 676626 - DNA, 20 bp, mouse
gcgcgtcagcatctgttcgg

SEQ ID NO: 676627 - DNA, 20 bp, mouse
gaggcccggcccttcgctcc

SEQ ID NO: 676628 - DNA, 20 bp, mouse
ggggttggagctgacagcat

SEQ ID NO: 676629 - DNA, 20 bp, mouse
ggggcgctaccacccggagg

SEQ ID NO: 676630 - DNA, 20 bp, mouse
gccaaaggggcgctaccacc

SEQ ID NO: 676631 - DNA, 20 bp, mouse
gcgctccagggctgcaagac

SEQ ID NO: 676632 - DNA, 20 bp, mouse
gcctcccagaaatccatttg

SEQ ID NO: 676633 - DNA, 20 bp, mouse
gaaggggcgctaccacccgg

SEQ ID NO: 676634 - DNA, 20 bp, mouse
gggcccgagagctctctaga

SEQ ID NO: 676635 - DNA, 20 bp, mouse
gcccacccaggtaccaagcc

SEQ ID NO: 676636 - DNA, 20 bp, mouse
gtgtacccgcggctccaagc

SEQ ID NO: 676637 - DNA, 20 bp, mouse
gtgtgcgagtctcttgaggt

SEQ ID NO: 676638 - DNA, 20 bp, mouse
gccctgggctgcttgttgaa

SEQ ID NO: 676639 - DNA, 20 bp, mouse
gaggcctagtcgccaggccc

SEQ ID NO: 676640 - DNA, 20 bp, mouse
gggtagggaaatcagagggc

SEQ ID NO: 676641 - DNA, 20 bp, mouse
gaatacttttgggtagaact

SEQ ID NO: 676642 - DNA, 20 bp, mouse
ggggcaaggtcacgcgcaga

SEQ ID NO: 676643 - DNA, 20 bp, mouse
gagactgtgcgagtctcttg

SEQ ID NO: 676644 - DNA, 20 bp, mouse
gaggtcacgcgcagaaggcg

SEQ ID NO: 676645 - DNA, 20 bp, mouse
gcgactaggccttgccccgt

SEQ ID NO: 676646 - DNA, 20 bp, mouse
gcctccccgcgccaccacag

SEQ ID NO: 676647 - DNA, 20 bp, mouse
gtgccccggaaagcgggcgt

SEQ ID NO: 676648 - DNA, 20 bp, mouse
ggagagccgggcatctaacc

SEQ ID NO: 676649 - DNA, 20 bp, mouse
gcccgcgcgcgcgaaggcct

SEQ ID NO: 676650 - DNA, 20 bp, mouse
ggtggtgaagcgtggttcgg

SEQ ID NO: 676651 - DNA, 20 bp, mouse
ggggcgctctaaggagagcc

SEQ ID NO: 676652 - DNA, 20 bp, mouse
gcaccacagggggcgctcta

SEQ ID NO: 676653 - DNA, 20 bp, mouse
gggggctggaaggagcccgt

SEQ ID NO: 676654 - DNA, 20 bp, mouse
gagaggctctgcagggccgt

SEQ ID NO: 676655 - DNA, 20 bp, mouse
gcccaccgagtccgtgagca

SEQ ID NO: 676656 - DNA, 20 bp, mouse
gacagtctccatctcagcaa

SEQ ID NO: 676657 - DNA, 20 bp, mouse
gtgcggcgagagcgtgtcgg

SEQ ID NO: 676658 - DNA, 20 bp, mouse
gaggcgagagtgtgtgcacg

SEQ ID NO: 676659 - DNA, 20 bp, mouse
ggggagaactggagagcgga

SEQ ID NO: 676660 - DNA, 20 bp, mouse
gtggacgcagcgccccctaa

SEQ ID NO: 676661 - DNA, 20 bp, mouse
gacgctctcgccgcaggctt

SEQ ID NO: 676662 - DNA, 20 bp, mouse
gagaactggagagcggaggg

SEQ ID NO: 676663 - DNA, 20 bp, mouse
gatcgcgcctgcctcccaga

SEQ ID NO: 676664 - DNA, 20 bp, mouse
gtgagcacccggctgaaaga

SEQ ID NO: 676665 - DNA, 20 bp, mouse
gctcgccgcaggctttgggt

SEQ ID NO: 676666 - DNA, 20 bp, mouse
gcgtccaggcgctgccccct

SEQ ID NO: 676667 - DNA, 20 bp, mouse
gcacctgcggccggggccgt

SEQ ID NO: 676668 - DNA, 20 bp, mouse
ggggcagcgcctggacgcgc

SEQ ID NO: 676669 - DNA, 20 bp, mouse
gccaacgcggcaccgaaggc

SEQ ID NO: 676670 - DNA, 20 bp, mouse
ggggtccccgcccacggccc

SEQ ID NO: 676671 - DNA, 20 bp, mouse
ggcaggtgccaggagcccga

SEQ ID NO: 676672 - DNA, 20 bp, mouse
gcgggcgcccggagccaacg

SEQ ID NO: 676673 - DNA, 20 bp, mouse
gcggccggagatgccttccc

SEQ ID NO: 676674 - DNA, 20 bp, mouse
gggctcctggcacctgcggc

SEQ ID NO: 676675 - DNA, 20 bp, mouse
gggccccggccgcaggtgcc

SEQ ID NO: 676676 - DNA, 20 bp, mouse
gccagcgcgcgaaagtccgg

SEQ ID NO: 676677 - DNA, 20 bp, mouse
gagggacggtggcagacacg

SEQ ID NO: 676678 - DNA, 20 bp, mouse
gctcccgaacctgtatgcga

SEQ ID NO: 676679 - DNA, 20 bp, mouse
gcgaacctgtatgcgaggga

SEQ ID NO: 676680 - DNA, 20 bp, mouse
gggacagggcgtagccgctc

SEQ ID NO: 676681 - DNA, 20 bp, mouse
gacctgtatgcgagggacgg

SEQ ID NO: 676682 - DNA, 20 bp, mouse
ggctgctgccatcaacctga

SEQ ID NO: 676683 - DNA, 20 bp, mouse
gggagccaccgcgcgagatc

SEQ ID NO: 676684 - DNA, 20 bp, mouse
gctcaactccgctgtaaaaa

SEQ ID NO: 676685 - DNA, 20 bp, mouse
gaaagtaagtgtgcgtgcgc

SEQ ID NO: 676686 - DNA, 20 bp, mouse
gcatcagggcgtgacttctc

SEQ ID NO: 676687 - DNA, 20 bp, mouse
gggactactgcactggtcgg

SEQ ID NO: 676688 - DNA, 20 bp, mouse
gaggccgtcgcgctgaagaa

SEQ ID NO: 676689 - DNA, 20 bp, mouse
gaagtcacgccctgatgcct

SEQ ID NO: 676690 - DNA, 20 bp, mouse
gtccttcggtaggacagctg

SEQ ID NO: 676691 - DNA, 20 bp, mouse
gctgaagaagggtgacgtgg

SEQ ID NO: 676692 - DNA, 20 bp, mouse
gtcagccccgccttcttcag

SEQ ID NO: 676693 - DNA, 20 bp, mouse
ggaagtgtggttccttcggt

SEQ ID NO: 676694 - DNA, 20 bp, mouse
gctggcctctgaagaaggcg

SEQ ID NO: 676695 - DNA, 20 bp, mouse
ggcgctgaagaagggtgacg

SEQ ID NO: 676696 - DNA, 20 bp, mouse
gtcaccgcgtgagtgtggag

SEQ ID NO: 676697 - DNA, 20 bp, mouse
gtgagtgtggagaggcgtgt

SEQ ID NO: 676698 - DNA, 20 bp, mouse
gccaggagaagcaagactgc

SEQ ID NO: 676699 - DNA, 20 bp, mouse
gaaagcaggcatgtctgaat

SEQ ID NO: 676700 - DNA, 20 bp, mouse
gcatccccggagctaaaagc

SEQ ID NO: 676701 - DNA, 20 bp, mouse
gtcccgagtctttaattaag

SEQ ID NO: 676702 - DNA, 20 bp, mouse
gaccgtggtaggcacgtgct

SEQ ID NO: 676703 - DNA, 20 bp, mouse
gcacgcggtgacgcacaagc

SEQ ID NO: 676704 - DNA, 20 bp, mouse
gacgcctctccacactcacg

SEQ ID NO: 676705 - DNA, 20 bp, mouse
ggcagattcactccaaacac

SEQ ID NO: 676706 - DNA, 20 bp, mouse
ggggctggggcccacggagt

SEQ ID NO: 676707 - DNA, 20 bp, mouse
gcggccaatcccagtctgtg

SEQ ID NO: 676708 - DNA, 20 bp, mouse
ggggcgtctcgcacatccgg

SEQ ID NO: 676709 - DNA, 20 bp, mouse
ggcggggcgtctcgcacatc

SEQ ID NO: 676710 - DNA, 20 bp, mouse
gaaggtggtggaagaagcga

SEQ ID NO: 676711 - DNA, 20 bp, mouse
gaacggcgtaagggaaggag

SEQ ID NO: 676712 - DNA, 20 bp, mouse
gggattgcgcaactccgcgg

SEQ ID NO: 676713 - DNA, 20 bp, mouse
ggagaaggcgaacaaggtag

SEQ ID NO: 676714 - DNA, 20 bp, mouse
gagaacaacggcgtaaggga

SEQ ID NO: 676715 - DNA, 20 bp, mouse
gggaggaaggagagcgagat

SEQ ID NO: 676716 - DNA, 20 bp, mouse
gcccgggagggacagatcgt

SEQ ID NO: 676717 - DNA, 20 bp, mouse
gggcggaaggcgagtcgtgg

SEQ ID NO: 676718 - DNA, 20 bp, mouse
gtctacatctggagcgtctg

SEQ ID NO: 676719 - DNA, 20 bp, mouse
ggcgagtcgtggcggggtta

SEQ ID NO: 676720 - DNA, 20 bp, mouse
ggggagccggaagtgacaag

SEQ ID NO: 676721 - DNA, 20 bp, mouse
gagctcacctagtctacatc

SEQ ID NO: 676722 - DNA, 20 bp, mouse
gtagcggagcttataaagat

SEQ ID NO: 676723 - DNA, 20 bp, mouse
gtccgacgatctgtccctcc

SEQ ID NO: 676724 - DNA, 20 bp, mouse
ggacgctccagatgtagact

SEQ ID NO: 676725 - DNA, 20 bp, mouse
gagcctgcgcaagatcagcc

SEQ ID NO: 676726 - DNA, 20 bp, mouse
gaggccgggtggcccgaaga

SEQ ID NO: 676727 - DNA, 20 bp, mouse
ggcgtgcaagctcctcactg

SEQ ID NO: 676728 - DNA, 20 bp, mouse
gggccgctaggtcgagacaa

SEQ ID NO: 676729 - DNA, 20 bp, mouse
ggtagtcaaggcagcagcgg

SEQ ID NO: 676730 - DNA, 20 bp, mouse
ggccgcggggctctcacttg

SEQ ID NO: 676731 - DNA, 20 bp, mouse
gacaaaggctggcgaagttt

SEQ ID NO: 676732 - DNA, 20 bp, mouse
ggtagcgccactgctaactg

SEQ ID NO: 676733 - DNA, 20 bp, mouse
ggttagcagtggcgctacgg

SEQ ID NO: 676734 - DNA, 20 bp, mouse
gcactgctaactgtggaatc

SEQ ID NO: 676735 - DNA, 20 bp, mouse
gtggcgaagtttggggagat

SEQ ID NO: 676736 - DNA, 20 bp, mouse
gcctccggatcaccctgtaa

SEQ ID NO: 676737 - DNA, 20 bp, mouse
gcgtcactgaacttagactg

SEQ ID NO: 676738 - DNA, 20 bp, mouse
gaggccacagaatgggtgta

SEQ ID NO: 676739 - DNA, 20 bp, mouse
gggggcgctaggcccatcgc

SEQ ID NO: 676740 - DNA, 20 bp, mouse
gccatcgctggagaattccg

SEQ ID NO: 676741 - DNA, 20 bp, mouse
gggaaaggcccattgaattc

SEQ ID NO: 676742 - DNA, 20 bp, mouse
ggcctggagcggccctttac

SEQ ID NO: 676743 - DNA, 20 bp, mouse
gggtagaagccggaagttca

SEQ ID NO: 676744 - DNA, 20 bp, mouse
ggggccgctccaggcggtag

SEQ ID NO: 676745 - DNA, 20 bp, mouse
gtggctgaggagctgcgcgt

SEQ ID NO: 676746 - DNA, 20 bp, mouse
ggccgcgcgagcgacggagg

SEQ ID NO: 676747 - DNA, 20 bp, mouse
ggggactcagtggaaaccga

SEQ ID NO: 676748 - DNA, 20 bp, mouse
ggcgggaagcatgaagaaag

SEQ ID NO: 676749 - DNA, 20 bp, mouse
gcgcggccgcggggactcag

SEQ ID NO: 676750 - DNA, 20 bp, mouse
gggaaaccgaaggcgagcga

SEQ ID NO: 676751 - DNA, 20 bp, mouse
gcgtgcacgcacgactccct

SEQ ID NO: 676752 - DNA, 20 bp, mouse
gcgtgcccggcagcctccca

SEQ ID NO: 676753 - DNA, 20 bp, mouse
gtcgtcggggaaggcgggtg

SEQ ID NO: 676754 - DNA, 20 bp, mouse
gcccgcggccgcgcgagcga

SEQ ID NO: 676755 - DNA, 20 bp, mouse
ggcgagcgagggaggaacgc

SEQ ID NO: 676756 - DNA, 20 bp, mouse
gaggaagcagaagtgcgtta

SEQ ID NO: 676757 - DNA, 20 bp, mouse
ggaaactcagataaagggcg

SEQ ID NO: 676758 - DNA, 20 bp, mouse
gcagaagcctcgacttccgg

SEQ ID NO: 676759 - DNA, 20 bp, mouse
gagagtaaggagtaggatag

SEQ ID NO: 676760 - DNA, 20 bp, mouse
gctcaagaaactcagataaa

SEQ ID NO: 676761 - DNA, 20 bp, mouse
gggagcagaaaccgggacgg

SEQ ID NO: 676762 - DNA, 20 bp, mouse
ggcaattgggtttttcgatt

SEQ ID NO: 676763 - DNA, 20 bp, mouse
gctaatgcacaagtagcacc

SEQ ID NO: 676764 - DNA, 20 bp, mouse
gttgcacccggcgtatcctg

SEQ ID NO: 676765 - DNA, 20 bp, mouse
ggctcagaagcctcgacttc

SEQ ID NO: 676766 - DNA, 20 bp, mouse
ggtacaaggcctcgctccaa

SEQ ID NO: 676767 - DNA, 20 bp, mouse
gagcgcgtgcgcaaaagaag

SEQ ID NO: 676768 - DNA, 20 bp, mouse
gcacttccgcagtcaatcga

SEQ ID NO: 676769 - DNA, 20 bp, mouse
gcgctggcgcaaaggttaaa

SEQ ID NO: 676770 - DNA, 20 bp, mouse
gacaggaagtcccgcctctc

SEQ ID NO: 676771 - DNA, 20 bp, mouse
ggcgcaaaagaagtggtaca

SEQ ID NO: 676772 - DNA, 20 bp, mouse
gggcgtcagcgctggcgcaa

SEQ ID NO: 676773 - DNA, 20 bp, mouse
gagcgctgacgccacgccct

SEQ ID NO: 676774 - DNA, 20 bp, mouse
gaggcctcgctccaagggcg

SEQ ID NO: 676775 - DNA, 20 bp, mouse
gacagacggctcagggtagt

SEQ ID NO: 676776 - DNA, 20 bp, mouse
gggaactgcaggggtaggcg

SEQ ID NO: 676777 - DNA, 20 bp, mouse
ggagttaagagagcctcaag

SEQ ID NO: 676778 - DNA, 20 bp, mouse
ggcgggaaccggaactgcag

SEQ ID NO: 676779 - DNA, 20 bp, mouse
ggaaccggaactgcaggggt

SEQ ID NO: 676780 - DNA, 20 bp, mouse
ggctcattgccgcgtgggaa

SEQ ID NO: 676781 - DNA, 20 bp, mouse
gcattgccgcgtgggaaagg

SEQ ID NO: 676782 - DNA, 20 bp, mouse
gtctagcgcgacactggaca

SEQ ID NO: 676783 - DNA, 20 bp, mouse
gaagcggctcattgccgcgt

SEQ ID NO: 676784 - DNA, 20 bp, mouse
gtggagttcagagcgggaac

SEQ ID NO: 676785 - DNA, 20 bp, mouse
gagactccgcctttcccacg

SEQ ID NO: 676786 - DNA, 20 bp, mouse
ggggctagataggtgaggcg

SEQ ID NO: 676787 - DNA, 20 bp, mouse
gaggtgaggcggggcttggt

SEQ ID NO: 676788 - DNA, 20 bp, mouse
gaagcgtcgagctagtcgag

SEQ ID NO: 676789 - DNA, 20 bp, mouse
ggggcggggctagataggtg

SEQ ID NO: 676790 - DNA, 20 bp, mouse
ggggtgggatgaagatcccg

SEQ ID NO: 676791 - DNA, 20 bp, mouse
gtggagcctgggtggactcg

SEQ ID NO: 676792 - DNA, 20 bp, mouse
gggcttggtgggtggagcct

SEQ ID NO: 676793 - DNA, 20 bp, mouse
gaagcacactaaaggagggg

SEQ ID NO: 676794 - DNA, 20 bp, mouse
ggcgctgtctacaggtgtga

SEQ ID NO: 676795 - DNA, 20 bp, mouse
gccccctaagcgctgtctac

SEQ ID NO: 676796 - DNA, 20 bp, mouse
gtccccgtgctgggcgctga

SEQ ID NO: 676797 - DNA, 20 bp, mouse
gcccgcgacgggagcaacac

SEQ ID NO: 676798 - DNA, 20 bp, mouse
gtgcgggttggaaaacagtg

SEQ ID NO: 676799 - DNA, 20 bp, mouse
gctgcctgcgagacaggaac

SEQ ID NO: 676800 - DNA, 20 bp, mouse
gggttggaaaacagtgtggc

SEQ ID NO: 676801 - DNA, 20 bp, mouse
ggccaccctgcctgcgagac

SEQ ID NO: 676802 - DNA, 20 bp, mouse
ggaaccggtggcgcttctct

SEQ ID NO: 676803 - DNA, 20 bp, mouse
gcgttcctcatggtcggttg

SEQ ID NO: 676804 - DNA, 20 bp, mouse
gcactcgcgttcctcatggt

SEQ ID NO: 676805 - DNA, 20 bp, mouse
ggctgtccggaagcccgccc

SEQ ID NO: 676806 - DNA, 20 bp, mouse
ggggcggtaactgtcgcgaa

SEQ ID NO: 676807 - DNA, 20 bp, mouse
gcccgcgctctgaaacggac

SEQ ID NO: 676808 - DNA, 20 bp, mouse
ggcctcccgcctcagccggt

SEQ ID NO: 676809 - DNA, 20 bp, mouse
gcggaggtgcgagagcgtca

SEQ ID NO: 676810 - DNA, 20 bp, mouse
gccagcgtgccgtggaagag

SEQ ID NO: 676811 - DNA, 20 bp, mouse
gcccgccccgcgctctgaaa

SEQ ID NO: 676812 - DNA, 20 bp, mouse
ggtgcagcggagggtcgtgg

SEQ ID NO: 676813 - DNA, 20 bp, mouse
ggcggaggaccgcggtgcgt

SEQ ID NO: 676814 - DNA, 20 bp, mouse
gagagcgtcacggcgtgcag

SEQ ID NO: 676815 - DNA, 20 bp, mouse
gcgtcacggcgtgcagcgga

SEQ ID NO: 676816 - DNA, 20 bp, mouse
gtctgctgaggtccctactc

SEQ ID NO: 676817 - DNA, 20 bp, mouse
gaggcgggatgttcccacgt

SEQ ID NO: 676818 - DNA, 20 bp, mouse
gctaagaggggtgcagtaag

SEQ ID NO: 676819 - DNA, 20 bp, mouse
gccccagccgacagaagaac

SEQ ID NO: 676820 - DNA, 20 bp, mouse
ggggccctccaccctaagag

SEQ ID NO: 676821 - DNA, 20 bp, mouse
gtggcggcaagaggtagctc

SEQ ID NO: 676822 - DNA, 20 bp, mouse
gggaacatcccgcctcgcct

SEQ ID NO: 676823 - DNA, 20 bp, mouse
ggctgcctggggcggaaggc

SEQ ID NO: 676824 - DNA, 20 bp, mouse
gaaggactgcggtttcccgc

SEQ ID NO: 676825 - DNA, 20 bp, mouse
gtgcagagccatgtccccag

SEQ ID NO: 676826 - DNA, 20 bp, mouse
gtggggcgccatgcggtcgc

SEQ ID NO: 676827 - DNA, 20 bp, mouse
ggctgggcggagcataaggc

SEQ ID NO: 676828 - DNA, 20 bp, mouse
gaaagctggtccgatgaccc

SEQ ID NO: 676829 - DNA, 20 bp, mouse
gcacgcaggaatgttcacta

SEQ ID NO: 676830 - DNA, 20 bp, mouse
ggcgccccacccgcttccgt

SEQ ID NO: 676831 - DNA, 20 bp, mouse
gcgcgcctacggaagcgggt

SEQ ID NO: 676832 - DNA, 20 bp, mouse
gagctcgcgcctacggaagc

SEQ ID NO: 676833 - DNA, 20 bp, mouse
ggtagccgccggcgaccgca

SEQ ID NO: 676834 - DNA, 20 bp, mouse
gaagcgggtggggcgccatg

SEQ ID NO: 676835 - DNA, 20 bp, mouse
gcgtggaggacaaaccacgt

SEQ ID NO: 676836 - DNA, 20 bp, mouse
gccgaagttcccgcagtcaa

SEQ ID NO: 676837 - DNA, 20 bp, mouse
gaggcagaactgcgcatgtg

SEQ ID NO: 676838 - DNA, 20 bp, mouse
gcgcgaacactcaagcggac

SEQ ID NO: 676839 - DNA, 20 bp, mouse
gcgaaagccgctagctgtca

SEQ ID NO: 676840 - DNA, 20 bp, mouse
gggctggtcggggcaggaag

SEQ ID NO: 676841 - DNA, 20 bp, mouse
gcagtcaccctgacagctag

SEQ ID NO: 676842 - DNA, 20 bp, mouse
gacaagaactactatgtggc

SEQ ID NO: 676843 - DNA, 20 bp, mouse
ggtctgcgcggcccacgaag

SEQ ID NO: 676844 - DNA, 20 bp, mouse
gcactacaagaactactatg

SEQ ID NO: 676845 - DNA, 20 bp, mouse
gtctacttttagcgctgctt

SEQ ID NO: 676846 - DNA, 20 bp, mouse
gacaaggacagggctgtcga

SEQ ID NO: 676847 - DNA, 20 bp, mouse
ggagatggggcacaggaacg

SEQ ID NO: 676848 - DNA, 20 bp, mouse
gaagcagggagatggggcac

SEQ ID NO: 676849 - DNA, 20 bp, mouse
gtccgcggacatcctcacct

SEQ ID NO: 676850 - DNA, 20 bp, mouse
ggcggtgctgtcagcgtctc

SEQ ID NO: 676851 - DNA, 20 bp, mouse
gtccctgcttgtcagcgcct

SEQ ID NO: 676852 - DNA, 20 bp, mouse
gtacccgggggctctcggat

SEQ ID NO: 676853 - DNA, 20 bp, mouse
gtgaggcggcccatgtcgag

SEQ ID NO: 676854 - DNA, 20 bp, mouse
ggatgggcgtggggtctcgg

SEQ ID NO: 676855 - DNA, 20 bp, mouse
gcgcgccggaagcggaaatg

SEQ ID NO: 676856 - DNA, 20 bp, mouse
gtgcgggctcaacaggtgat

SEQ ID NO: 676857 - DNA, 20 bp, mouse
gctggcaggagatcctcttc

SEQ ID NO: 676858 - DNA, 20 bp, mouse
ggggaggagagcctctcgac

SEQ ID NO: 676859 - DNA, 20 bp, mouse
gcacctgttgagcccgcaca

SEQ ID NO: 676860 - DNA, 20 bp, mouse
gtctccttcacccagtcgag

SEQ ID NO: 676861 - DNA, 20 bp, mouse
gcaggtgattggctctgaga

SEQ ID NO: 676862 - DNA, 20 bp, mouse
gaaagtgggtcttgactggc

SEQ ID NO: 676863 - DNA, 20 bp, mouse
gcacatggatggctattttt

SEQ ID NO: 676864 - DNA, 20 bp, mouse
gtgttgagcccgcacatgga

SEQ ID NO: 676865 - DNA, 20 bp, mouse
ggacattatgggtacttggt

SEQ ID NO: 676866 - DNA, 20 bp, mouse
ggggctgctagattggcctc

SEQ ID NO: 676867 - DNA, 20 bp, mouse
gctgctagattggcctcggg

SEQ ID NO: 676868 - DNA, 20 bp, mouse
ggcgtgcccagaaaccgctt

SEQ ID NO: 676869 - DNA, 20 bp, mouse
ggtcgggcttcttcggaagt

SEQ ID NO: 676870 - DNA, 20 bp, mouse
gataggaggtcgggcttctt

SEQ ID NO: 676871 - DNA, 20 bp, mouse
gcagcccggaggactcagct

SEQ ID NO: 676872 - DNA, 20 bp, mouse
gtctgcttattattgttgct

SEQ ID NO: 676873 - DNA, 20 bp, mouse
gagcagaaatttagctcaat

SEQ ID NO: 676874 - DNA, 20 bp, mouse
gggcacctgacgttcaatta

SEQ ID NO: 676875 - DNA, 20 bp, mouse
gggccaatctagcagcccgg

SEQ ID NO: 676876 - DNA, 20 bp, mouse
gggactgcctacaagaacca

SEQ ID NO: 676877 - DNA, 20 bp, mouse
gcctcccccttggttcttgt

SEQ ID NO: 676878 - DNA, 20 bp, mouse
gtgtgcgcggttctcacaag

SEQ ID NO: 676879 - DNA, 20 bp, mouse
gggagctgtctgtaatgcgg

SEQ ID NO: 676880 - DNA, 20 bp, mouse
ggggagaagctcaactttgt

SEQ ID NO: 676881 - DNA, 20 bp, mouse
gagaacaccgagtgtggtcg

SEQ ID NO: 676882 - DNA, 20 bp, mouse
gaatgcgggggtgggatcag

SEQ ID NO: 676883 - DNA, 20 bp, mouse
gataaaggagtgggtgtcag

SEQ ID NO: 676884 - DNA, 20 bp, mouse
gtgtggtcgcggagggtgga

SEQ ID NO: 676885 - DNA, 20 bp, mouse
ggtgctgagaacaccgagtg

SEQ ID NO: 676886 - DNA, 20 bp, mouse
ggagtcctgactacctacaa

SEQ ID NO: 676887 - DNA, 20 bp, mouse
gtcgatggaggacccggcga

SEQ ID NO: 676888 - DNA, 20 bp, mouse
gacccggcgacggtggccta

SEQ ID NO: 676889 - DNA, 20 bp, mouse
gcaagagtcgatggaggacc

SEQ ID NO: 676890 - DNA, 20 bp, mouse
gtagtcaggactcgttttca

SEQ ID NO: 676891 - DNA, 20 bp, mouse
ggaaacctttgtaggtagtc

SEQ ID NO: 676892 - DNA, 20 bp, mouse
ggagaaaaggcatatcttgg

SEQ ID NO: 676893 - DNA, 20 bp, mouse
gaaaaaagacatagtgtaac

SEQ ID NO: 676894 - DNA, 20 bp, mouse
gcttgagaaaaggcatatct

SEQ ID NO: 676895 - DNA, 20 bp, mouse
ggttttcaaggtcctgttta

SEQ ID NO: 676896 - DNA, 20 bp, mouse
ggggttgaccccaatgacag

SEQ ID NO: 676897 - DNA, 20 bp, mouse
ggtccctgagccactgtcat

SEQ ID NO: 676898 - DNA, 20 bp, mouse
gactccctggctgttatcta

SEQ ID NO: 676899 - DNA, 20 bp, mouse
gataatctgggagccagtga

SEQ ID NO: 676900 - DNA, 20 bp, mouse
gaccccaatgacagtggctc

SEQ ID NO: 676901 - DNA, 20 bp, mouse
gtggtcacgccccaccagtc

SEQ ID NO: 676902 - DNA, 20 bp, mouse
gggccctgaggaaacaaata

SEQ ID NO: 676903 - DNA, 20 bp, mouse
gcactgactcccagactggt

SEQ ID NO: 676904 - DNA, 20 bp, mouse
gggctcccagattatcagca

SEQ ID NO: 676905 - DNA, 20 bp, mouse
ggtggcttgggattccctta

SEQ ID NO: 676906 - DNA, 20 bp, mouse
gagggcggagccaagtggta

SEQ ID NO: 676907 - DNA, 20 bp, mouse
gccgctgcgagaagtcgctc

SEQ ID NO: 676908 - DNA, 20 bp, mouse
ggccggacccagaatcacaa

SEQ ID NO: 676909 - DNA, 20 bp, mouse
ggtggtaaggatagcttcgg

SEQ ID NO: 676910 - DNA, 20 bp, mouse
gtcaccagagcgtatgaaga

SEQ ID NO: 676911 - DNA, 20 bp, mouse
gcgctcccgaccatagagag

SEQ ID NO: 676912 - DNA, 20 bp, mouse
gcaagtggtaaggatagctt

SEQ ID NO: 676913 - DNA, 20 bp, mouse
ggatagcttcggaggtccgg

SEQ ID NO: 676914 - DNA, 20 bp, mouse
gcagcggcccgtctagcctc

SEQ ID NO: 676915 - DNA, 20 bp, mouse
ggagcaagagggctcgttcc

SEQ ID NO: 676916 - DNA, 20 bp, mouse
ggcctcctacgcaacgtcgg

SEQ ID NO: 676917 - DNA, 20 bp, mouse
gcggctgagagcgacacagt

SEQ ID NO: 676918 - DNA, 20 bp, mouse
ggacgcttgcgcacctgtca

SEQ ID NO: 676919 - DNA, 20 bp, mouse
gccccccgacgttgcgtagg

SEQ ID NO: 676920 - DNA, 20 bp, mouse
gtgggcggggcctagagcgg

SEQ ID NO: 676921 - DNA, 20 bp, mouse
ggagaccccacccacgtcct

SEQ ID NO: 676922 - DNA, 20 bp, mouse
gggcgggcccaggacgtggg

SEQ ID NO: 676923 - DNA, 20 bp, mouse
gggtcagagcgagttctggg

SEQ ID NO: 676924 - DNA, 20 bp, mouse
gctgcccacatccaagtgag

SEQ ID NO: 676925 - DNA, 20 bp, mouse
gaggaccttaatccaaaatg

SEQ ID NO: 676926 - DNA, 20 bp, mouse
gctagttcctgcgaggaaat

SEQ ID NO: 676927 - DNA, 20 bp, mouse
gctggtgccttatgtaaggt

SEQ ID NO: 676928 - DNA, 20 bp, mouse
gagcagggaggttaactctt

SEQ ID NO: 676929 - DNA, 20 bp, mouse
ggagatgtcgcgagatttag

SEQ ID NO: 676930 - DNA, 20 bp, mouse
ggatgctggtgccttatgta

SEQ ID NO: 676931 - DNA, 20 bp, mouse
ggagacaccgaccttacata

SEQ ID NO: 676932 - DNA, 20 bp, mouse
gactctttggacaaaggttt

SEQ ID NO: 676933 - DNA, 20 bp, mouse
gaaggtttcggactctacaa

SEQ ID NO: 676934 - DNA, 20 bp, mouse
gaatgtagtttcaagcttga

SEQ ID NO: 676935 - DNA, 20 bp, mouse
gtagtatttactaagcaggg

SEQ ID NO: 676936 - DNA, 20 bp, mouse
gggcttgtcagagagtgctg

SEQ ID NO: 676937 - DNA, 20 bp, mouse
gccgccctagaggaaaggaa

SEQ ID NO: 676938 - DNA, 20 bp, mouse
gaggaaaggaaggggcgtga

SEQ ID NO: 676939 - DNA, 20 bp, mouse
gagaagaaatgatgcactgg

SEQ ID NO: 676940 - DNA, 20 bp, mouse
gaccgccacaggaagtacca

SEQ ID NO: 676941 - DNA, 20 bp, mouse
gtaccaaggagactggcctt

SEQ ID NO: 676942 - DNA, 20 bp, mouse
gctcctaaggccagtctcct

SEQ ID NO: 676943 - DNA, 20 bp, mouse
gtcactgcggggttattgac

SEQ ID NO: 676944 - DNA, 20 bp, mouse
ggtcagagagtgctgtggtt

SEQ ID NO: 676945 - DNA, 20 bp, mouse
gaacgtaagagaaagcccgt

SEQ ID NO: 676946 - DNA, 20 bp, mouse
gtgaactcataggacagctc

SEQ ID NO: 676947 - DNA, 20 bp, mouse
gatcctagatctgaactcat

SEQ ID NO: 676948 - DNA, 20 bp, mouse
gggtcccattgaatcactaa

SEQ ID NO: 676949 - DNA, 20 bp, mouse
ggtaagttatcacttggtgc

SEQ ID NO: 676950 - DNA, 20 bp, mouse
gggcgccatatcggctccga

SEQ ID NO: 676951 - DNA, 20 bp, mouse
gataataccgggcgccatat

SEQ ID NO: 676952 - DNA, 20 bp, mouse
ggtcctatgagttcagatct

SEQ ID NO: 676953 - DNA, 20 bp, mouse
gactcaaccggcgggctctg

SEQ ID NO: 676954 - DNA, 20 bp, mouse
gatgcgcagcatgattaggt

SEQ ID NO: 676955 - DNA, 20 bp, mouse
gggcgggctctgaggtttgt

SEQ ID NO: 676956 - DNA, 20 bp, mouse
gcatctgtgtaggatgatgt

SEQ ID NO: 676957 - DNA, 20 bp, mouse
gtctcgaagaaagtggaggt

SEQ ID NO: 676958 - DNA, 20 bp, mouse
gagcgcgccaaaaacagccc

SEQ ID NO: 676959 - DNA, 20 bp, mouse
gcaagccccctcgcccgcct

SEQ ID NO: 676960 - DNA, 20 bp, mouse
gggagtcactagtacagtgc

SEQ ID NO: 676961 - DNA, 20 bp, mouse
ggacttgtagcttgtgtgat

SEQ ID NO: 676962 - DNA, 20 bp, mouse
gtgtgtaggatgatgtcggt

SEQ ID NO: 676963 - DNA, 20 bp, mouse
ggcgccaaaaacagcccagg

SEQ ID NO: 676964 - DNA, 20 bp, mouse
gatgtcggttggttgtttcg

SEQ ID NO: 676965 - DNA, 20 bp, mouse
gtcactctcgaagaaagtgg

SEQ ID NO: 676966 - DNA, 20 bp, mouse
gaagggccctacacgttgag

SEQ ID NO: 676967 - DNA, 20 bp, mouse
ggtgagcccctcaacgtgta

SEQ ID NO: 676968 - DNA, 20 bp, mouse
gacgttgaggggctcacagc

SEQ ID NO: 676969 - DNA, 20 bp, mouse
gaaaggtggctgctggtaac

SEQ ID NO: 676970 - DNA, 20 bp, mouse
ggtgggcaggaactatgtct

SEQ ID NO: 676971 - DNA, 20 bp, mouse
gtgcagagagagacttcaat

SEQ ID NO: 676972 - DNA, 20 bp, mouse
ggtgccttgactggggacaa

SEQ ID NO: 676973 - DNA, 20 bp, mouse
gccccagctggctacctaag

SEQ ID NO: 676974 - DNA, 20 bp, mouse
gagctggggctttttatagc

SEQ ID NO: 676975 - DNA, 20 bp, mouse
gcagcctggtgccttgactg

SEQ ID NO: 676976 - DNA, 20 bp, mouse
ggacttgtgaggacataggt

SEQ ID NO: 676977 - DNA, 20 bp, mouse
ggaggacataggtgggaaga

SEQ ID NO: 676978 - DNA, 20 bp, mouse
gagggccaaaacacatacag

SEQ ID NO: 676979 - DNA, 20 bp, mouse
gtggtccctcaccttgtgtt

SEQ ID NO: 676980 - DNA, 20 bp, mouse
ggctggacttgtgaggacat

SEQ ID NO: 676981 - DNA, 20 bp, mouse
gtccatgcaaagggcttgag

SEQ ID NO: 676982 - DNA, 20 bp, mouse
gtggcaaagagtttgggaga

SEQ ID NO: 676983 - DNA, 20 bp, mouse
ggagcaatagctatagatgt

SEQ ID NO: 676984 - DNA, 20 bp, mouse
gtaggtttggcaaagagttt

SEQ ID NO: 676985 - DNA, 20 bp, mouse
gagctcaaattccatgcaaa

SEQ ID NO: 676986 - DNA, 20 bp, mouse
gcatcgtgtaaattccagga

SEQ ID NO: 676987 - DNA, 20 bp, mouse
gtgggtgaggtgtagtgcct

SEQ ID NO: 676988 - DNA, 20 bp, mouse
gtaaaaactggctctgggtg

SEQ ID NO: 676989 - DNA, 20 bp, mouse
gaacacagttccctgtggcc

SEQ ID NO: 676990 - DNA, 20 bp, mouse
gtggttctggtaaaccacga

SEQ ID NO: 676991 - DNA, 20 bp, mouse
gggattgctagaagaacaaa

SEQ ID NO: 676992 - DNA, 20 bp, mouse
gctggaatttacacgatgaa

SEQ ID NO: 676993 - DNA, 20 bp, mouse
gtaccagaaccaatctgagt

SEQ ID NO: 676994 - DNA, 20 bp, mouse
gcaaagggagcatttagaga

SEQ ID NO: 676995 - DNA, 20 bp, mouse
gagcattttccaactcagat

SEQ ID NO: 676996 - DNA, 20 bp, mouse
gcagctgaccccatggtcaa

SEQ ID NO: 676997 - DNA, 20 bp, mouse
gtcccagctgggagacctca

SEQ ID NO: 676998 - DNA, 20 bp, mouse
gcatctggatcaagtctcat

SEQ ID NO: 676999 - DNA, 20 bp, mouse
gtatcagggaacaaggcagg

SEQ ID NO: 677000 - DNA, 20 bp, mouse
gcgaatgagtagtcccagct

SEQ ID NO: 677001 - DNA, 20 bp, mouse
gtggatcaagtctcatgggg

SEQ ID NO: 677002 - DNA, 20 bp, mouse
gaggcaggagttccaaactg

SEQ ID NO: 677003 - DNA, 20 bp, mouse
ggcaggtggagagataagcc

SEQ ID NO: 677004 - DNA, 20 bp, mouse
ggagacttgatccagatgtg

SEQ ID NO: 677005 - DNA, 20 bp, mouse
gccaacaacaaatgtatctg

SEQ ID NO: 677006 - DNA, 20 bp, mouse
gtaagtgctgctagccctgc

SEQ ID NO: 677007 - DNA, 20 bp, mouse
gcgggccgggccacatctcc

SEQ ID NO: 677008 - DNA, 20 bp, mouse
gaccttgagaacttcacaag

SEQ ID NO: 677009 - DNA, 20 bp, mouse
gatagcgtgctctggtatct

SEQ ID NO: 677010 - DNA, 20 bp, mouse
gttcacaagcggtgagaatt

SEQ ID NO: 677011 - DNA, 20 bp, mouse
gaatgaatgagcaaagtaat

SEQ ID NO: 677012 - DNA, 20 bp, mouse
ggtgagataacagatttcaa

SEQ ID NO: 677013 - DNA, 20 bp, mouse
gaaaacaactgatttgccct

SEQ ID NO: 677014 - DNA, 20 bp, mouse
gtggcttctatcacccagca

SEQ ID NO: 677015 - DNA, 20 bp, mouse
gagtaatgggatatgatgga

SEQ ID NO: 677016 - DNA, 20 bp, mouse
ggtagtgtgttcaaggtgat

SEQ ID NO: 677017 - DNA, 20 bp, mouse
gcaactgaaaaaatatgagg

SEQ ID NO: 677018 - DNA, 20 bp, mouse
gtttcagttgagagggggca

SEQ ID NO: 677019 - DNA, 20 bp, mouse
gtgaaaaaatatgaggtgga

SEQ ID NO: 677020 - DNA, 20 bp, mouse
gtcagcaagtagtgtgttca

SEQ ID NO: 677021 - DNA, 20 bp, mouse
gcctattaataagaaagtag

SEQ ID NO: 677022 - DNA, 20 bp, mouse
gttcgtcgagataaaagctg

SEQ ID NO: 677023 - DNA, 20 bp, mouse
gaatgtctctaaaaaagatt

SEQ ID NO: 677024 - DNA, 20 bp, mouse
gggaaggactgttcatcccc

SEQ ID NO: 677025 - DNA, 20 bp, mouse
gcaggaagcttcaattaaat

SEQ ID NO: 677026 - DNA, 20 bp, mouse
gaaggctgggccttcatcac

SEQ ID NO: 677027 - DNA, 20 bp, mouse
gaggcaggaacttgctccgc

SEQ ID NO: 677028 - DNA, 20 bp, mouse
gtcctgccttgcaaatggaa

SEQ ID NO: 677029 - DNA, 20 bp, mouse
gtgccaagtgatgaacaatg

SEQ ID NO: 677030 - DNA, 20 bp, mouse
gggaacttgctccgcaggct

SEQ ID NO: 677031 - DNA, 20 bp, mouse
gggctgggaatgtcttaccc

SEQ ID NO: 677032 - DNA, 20 bp, mouse
gcaagttcctgccttgcaaa

SEQ ID NO: 677033 - DNA, 20 bp, mouse
ggtaagacattcccagcctg

SEQ ID NO: 677034 - DNA, 20 bp, mouse
ggatgaacaatgaggcatcc

SEQ ID NO: 677035 - DNA, 20 bp, mouse
gcaaccttaagccaactcca

SEQ ID NO: 677036 - DNA, 20 bp, mouse
ggtgtcaaggggccagttga

SEQ ID NO: 677037 - DNA, 20 bp, mouse
gtcagacggcagagttcaat

SEQ ID NO: 677038 - DNA, 20 bp, mouse
ggctatgctagtctgagggt

SEQ ID NO: 677039 - DNA, 20 bp, mouse
gtgaactctgccgtctgaaa

SEQ ID NO: 677040 - DNA, 20 bp, mouse
gggccagttgatggtcctgt

SEQ ID NO: 677041 - DNA, 20 bp, mouse
gcatttctcaggtgtgtcaa

SEQ ID NO: 677042 - DNA, 20 bp, mouse
gctatcccgcatcatccaac

SEQ ID NO: 677043 - DNA, 20 bp, mouse
gaatgtaagtaaccccatgt

SEQ ID NO: 677044 - DNA, 20 bp, mouse
gggtagacattccctacatg

SEQ ID NO: 677045 - DNA, 20 bp, mouse
gatccaacaggaccatcaac

SEQ ID NO: 677046 - DNA, 20 bp, mouse
gccagagaagggttacccac

SEQ ID NO: 677047 - DNA, 20 bp, mouse
gcaggggccgatcctaaatc

SEQ ID NO: 677048 - DNA, 20 bp, mouse
gactcacaggcagactttgc

SEQ ID NO: 677049 - DNA, 20 bp, mouse
gtctgcctgtgagtcagctc

SEQ ID NO: 677050 - DNA, 20 bp, mouse
gggtaacccttctctggttt

SEQ ID NO: 677051 - DNA, 20 bp, mouse
gtaaatcaggctctcctgaa

SEQ ID NO: 677052 - DNA, 20 bp, mouse
gaggctctcctgaaggggct

SEQ ID NO: 677053 - DNA, 20 bp, mouse
gcccagcccagcctggaagc

SEQ ID NO: 677054 - DNA, 20 bp, mouse
gaataccgagagctcctagc

SEQ ID NO: 677055 - DNA, 20 bp, mouse
gaagctggcagacacattcc

SEQ ID NO: 677056 - DNA, 20 bp, mouse
gaacctagaatcattagtgt

SEQ ID NO: 677057 - DNA, 20 bp, mouse
gaatgattctaggttaaatg

SEQ ID NO: 677058 - DNA, 20 bp, mouse
gtttcctggcacagttattt

SEQ ID NO: 677059 - DNA, 20 bp, mouse
gctggcacagttattttggt

SEQ ID NO: 677060 - DNA, 20 bp, mouse
gtaccaatggaacttaagct

SEQ ID NO: 677061 - DNA, 20 bp, mouse
gcccccacactaatgattct

SEQ ID NO: 677062 - DNA, 20 bp, mouse
gtagtggccttttttcagag

SEQ ID NO: 677063 - DNA, 20 bp, mouse
gaatagaagtcattacacaa

SEQ ID NO: 677064 - DNA, 20 bp, mouse
ggatcatttgctctttctac

SEQ ID NO: 677065 - DNA, 20 bp, mouse
ggcctttgttaattaatcca

SEQ ID NO: 677066 - DNA, 20 bp, mouse
gaaggcaacatgtgagtcag

SEQ ID NO: 677067 - DNA, 20 bp, mouse
gtctgtgtttagggtcacta

SEQ ID NO: 677068 - DNA, 20 bp, mouse
gctgaggggcatgagtaaga

SEQ ID NO: 677069 - DNA, 20 bp, mouse
ggtatgtgacatatgggccc

SEQ ID NO: 677070 - DNA, 20 bp, mouse
ggacctcaataaaagtcaaa

SEQ ID NO: 677071 - DNA, 20 bp, mouse
ggtatcaatcacaaaaagtg

SEQ ID NO: 677072 - DNA, 20 bp, mouse
ggagtaagatggaatcttcc

SEQ ID NO: 677073 - DNA, 20 bp, mouse
ggcccaaggctctgatgtct

SEQ ID NO: 677074 - DNA, 20 bp, mouse
gacgttgcttatcaataccc

SEQ ID NO: 677075 - DNA, 20 bp, mouse
gtgtgagtatattctttccc

SEQ ID NO: 677076 - DNA, 20 bp, mouse
gcatacacgtacaattagtt

SEQ ID NO: 677077 - DNA, 20 bp, mouse
gctggttaaagtgtaacagt

SEQ ID NO: 677078 - DNA, 20 bp, mouse
ggctacaatgcatttataag

SEQ ID NO: 677079 - DNA, 20 bp, mouse
ggctcagtaaactgagctgc

SEQ ID NO: 677080 - DNA, 20 bp, mouse
gttttagactgtgggagtgg

SEQ ID NO: 677081 - DNA, 20 bp, mouse
gcttaggcaattagttacct

SEQ ID NO: 677082 - DNA, 20 bp, mouse
ggtgtgcaaagaaggctctt

SEQ ID NO: 677083 - DNA, 20 bp, mouse
gtaaatttctgattttgctt

SEQ ID NO: 677084 - DNA, 20 bp, mouse
gatttagacaattttaatcc

SEQ ID NO: 677085 - DNA, 20 bp, mouse
gtgtaacagtgggctccctc

SEQ ID NO: 677086 - DNA, 20 bp, mouse
gaaagcgactaaagtcccta

SEQ ID NO: 677087 - DNA, 20 bp, mouse
gacagagggtagaaccttag

SEQ ID NO: 677088 - DNA, 20 bp, mouse
ggagtggagacacgcccaga

SEQ ID NO: 677089 - DNA, 20 bp, mouse
ggactaaagtccctaaggac

SEQ ID NO: 677090 - DNA, 20 bp, mouse
gagggaggcgggaagacaga

SEQ ID NO: 677091 - DNA, 20 bp, mouse
gaatgcttgggtgtcactct

SEQ ID NO: 677092 - DNA, 20 bp, mouse
gtaaggctggaaggcgggat

SEQ ID NO: 677093 - DNA, 20 bp, mouse
gaagtccctaaggactggag

SEQ ID NO: 677094 - DNA, 20 bp, mouse
ggctaggcgcggaggggatc

SEQ ID NO: 677095 - DNA, 20 bp, mouse
gggcggggctttccttaaag

SEQ ID NO: 677096 - DNA, 20 bp, mouse
ggggcccgggcagacaaaag

SEQ ID NO: 677097 - DNA, 20 bp, mouse
ggcgccagggaccacgcagg

SEQ ID NO: 677098 - DNA, 20 bp, mouse
gcacaggcgaagcagccgcc

SEQ ID NO: 677099 - DNA, 20 bp, mouse
gacagctaagaccttgactt

SEQ ID NO: 677100 - DNA, 20 bp, mouse
gatggcgccagggaccacgc

SEQ ID NO: 677101 - DNA, 20 bp, mouse
gagcagccgccagggatgtt

SEQ ID NO: 677102 - DNA, 20 bp, mouse
ggccatttggcttttgacgt

SEQ ID NO: 677103 - DNA, 20 bp, mouse
gcgcaccgttcattgagcgg

SEQ ID NO: 677104 - DNA, 20 bp, mouse
gcgcgctgcactacccgccc

SEQ ID NO: 677105 - DNA, 20 bp, mouse
gataaacccaacatccctgg

SEQ ID NO: 677106 - DNA, 20 bp, mouse
gcccgagcccagtttctgaa

SEQ ID NO: 677107 - DNA, 20 bp, mouse
gtagctggaaactagaggaa

SEQ ID NO: 677108 - DNA, 20 bp, mouse
gagaccagggaaggcggaga

SEQ ID NO: 677109 - DNA, 20 bp, mouse
ggcgtgttggtgccacagga

SEQ ID NO: 677110 - DNA, 20 bp, mouse
ggggaaataagccactaggt

SEQ ID NO: 677111 - DNA, 20 bp, mouse
ggaagcccaagcgagcgcag

SEQ ID NO: 677112 - DNA, 20 bp, mouse
gtccgcctctgcgctcgctt

SEQ ID NO: 677113 - DNA, 20 bp, mouse
ggagggaggaatgcactgag

SEQ ID NO: 677114 - DNA, 20 bp, mouse
ggaggcggagatggcattcc

SEQ ID NO: 677115 - DNA, 20 bp, mouse
gggctgcagaccagggaagg

SEQ ID NO: 677116 - DNA, 20 bp, mouse
gcccccgagagcggcctcgt

SEQ ID NO: 677117 - DNA, 20 bp, mouse
gcggccgccgcccccgagag

SEQ ID NO: 677118 - DNA, 20 bp, mouse
ggcaggatgagctactgctc

SEQ ID NO: 677119 - DNA, 20 bp, mouse
gcccggcggcggcacgaacg

SEQ ID NO: 677120 - DNA, 20 bp, mouse
gtggctggggagctgctctg

SEQ ID NO: 677121 - DNA, 20 bp, mouse
gtggccgcgccgccgcccga

SEQ ID NO: 677122 - DNA, 20 bp, mouse
gaggaggggtggtgcagact

SEQ ID NO: 677123 - DNA, 20 bp, mouse
gcgcccgaggggatggcgaa

SEQ ID NO: 677124 - DNA, 20 bp, mouse
ggccgccgggcgaggatcgt

SEQ ID NO: 677125 - DNA, 20 bp, mouse
gccgccgccggggtggtggc

SEQ ID NO: 677126 - DNA, 20 bp, mouse
ggccccggcggtccatggac

SEQ ID NO: 677127 - DNA, 20 bp, mouse
gtcggcgccccggcggtcca

SEQ ID NO: 677128 - DNA, 20 bp, mouse
gtcgcggcccgggttcctgc

SEQ ID NO: 677129 - DNA, 20 bp, mouse
gcagcagctcggcgccccgg

SEQ ID NO: 677130 - DNA, 20 bp, mouse
gaccccggcgcgcacggagg

SEQ ID NO: 677131 - DNA, 20 bp, mouse
gaggctgtgtggcgggtccg

SEQ ID NO: 677132 - DNA, 20 bp, mouse
ggtccatggaccggaaccct

SEQ ID NO: 677133 - DNA, 20 bp, mouse
ggttcctgccggtccgccca

SEQ ID NO: 677134 - DNA, 20 bp, mouse
ggaaccctgggcggaccggc

SEQ ID NO: 677135 - DNA, 20 bp, mouse
gcgcgccggggtcacgacgc

SEQ ID NO: 677136 - DNA, 20 bp, mouse
gctcgtaaatacagattcca

SEQ ID NO: 677137 - DNA, 20 bp, mouse
gaagggggagagtttgtgcc

SEQ ID NO: 677138 - DNA, 20 bp, mouse
gggcttcagcacgttcagtc

SEQ ID NO: 677139 - DNA, 20 bp, mouse
gaggaagcgataatataatc

SEQ ID NO: 677140 - DNA, 20 bp, mouse
gcacgttcagtcaggaaagg

SEQ ID NO: 677141 - DNA, 20 bp, mouse
ggagttgttgaaataaaaga

SEQ ID NO: 677142 - DNA, 20 bp, mouse
gggggctgaagtccttcaca

SEQ ID NO: 677143 - DNA, 20 bp, mouse
gccagcagagctaccttaaa

SEQ ID NO: 677144 - DNA, 20 bp, mouse
ggaggcagagtaccgtgtga

SEQ ID NO: 677145 - DNA, 20 bp, mouse
gaacaactcctgatttatgt

SEQ ID NO: 677146 - DNA, 20 bp, mouse
gcttcctgggtggagctctg

SEQ ID NO: 677147 - DNA, 20 bp, mouse
gcagcctcagagctccaccc

SEQ ID NO: 677148 - DNA, 20 bp, mouse
gtctgcgcacccagtgcaag

SEQ ID NO: 677149 - DNA, 20 bp, mouse
gcgcccagcggggccggcgt

SEQ ID NO: 677150 - DNA, 20 bp, mouse
ggcggtgcaccgcttgcact

SEQ ID NO: 677151 - DNA, 20 bp, mouse
gcgacaccacaatcccgact

SEQ ID NO: 677152 - DNA, 20 bp, mouse
ggcgcctcgcccagcggggc

SEQ ID NO: 677153 - DNA, 20 bp, mouse
gagactgaagggaatccctc

SEQ ID NO: 677154 - DNA, 20 bp, mouse
gtgggaggcgtggcctagtc

SEQ ID NO: 677155 - DNA, 20 bp, mouse
gcactgggtgcgcagacccg

SEQ ID NO: 677156 - DNA, 20 bp, mouse
gttctgccccagcaaagggt

SEQ ID NO: 677157 - DNA, 20 bp, mouse
gggggcagaaacttataacg

SEQ ID NO: 677158 - DNA, 20 bp, mouse
gaggtagccacgttccaagt

SEQ ID NO: 677159 - DNA, 20 bp, mouse
gcacgttccaagttgggata

SEQ ID NO: 677160 - DNA, 20 bp, mouse
gggtaggctactaatgtgca

SEQ ID NO: 677161 - DNA, 20 bp, mouse
gtcggcctgggtggcagcga

SEQ ID NO: 677162 - DNA, 20 bp, mouse
gccacccaggccgagcgggg

SEQ ID NO: 677163 - DNA, 20 bp, mouse
ggcggggcggagctaaacta

SEQ ID NO: 677164 - DNA, 20 bp, mouse
gtaattctgcgggtctggat

SEQ ID NO: 677165 - DNA, 20 bp, mouse
gtggcacccatatcccaact

SEQ ID NO: 677166 - DNA, 20 bp, mouse
gctgagagagagccgggtgg

SEQ ID NO: 677167 - DNA, 20 bp, mouse
ggtagcttggaattacaggt

SEQ ID NO: 677168 - DNA, 20 bp, mouse
gcaagaggctgagagagagc

SEQ ID NO: 677169 - DNA, 20 bp, mouse
gtaattccaagctactcaag

SEQ ID NO: 677170 - DNA, 20 bp, mouse
ggaattacaggtgggagcat

SEQ ID NO: 677171 - DNA, 20 bp, mouse
gaggctgagagagagccggg

SEQ ID NO: 677172 - DNA, 20 bp, mouse
gcctccaccaggatcacctt

SEQ ID NO: 677173 - DNA, 20 bp, mouse
gctgccctctggtctaggtg

SEQ ID NO: 677174 - DNA, 20 bp, mouse
ggatagcacagaaactcaat

SEQ ID NO: 677175 - DNA, 20 bp, mouse
gggcccacaacattcaataa

SEQ ID NO: 677176 - DNA, 20 bp, mouse
gctgagagagagccgggtgg

SEQ ID NO: 677177 - DNA, 20 bp, mouse
ggtagcttggaattacaggt

SEQ ID NO: 677178 - DNA, 20 bp, mouse
gcaagaggctgagagagagc

SEQ ID NO: 677179 - DNA, 20 bp, mouse
gtaattccaagctactcaag

SEQ ID NO: 677180 - DNA, 20 bp, mouse
ggaattacaggtgggagcat

SEQ ID NO: 677181 - DNA, 20 bp, mouse
gaggctgagagagagccggg

SEQ ID NO: 677182 - DNA, 20 bp, mouse
gcctccaccaggatcacctt

SEQ ID NO: 677183 - DNA, 20 bp, mouse
gctgccctctggtctaggtg

SEQ ID NO: 677184 - DNA, 20 bp, mouse
ggatagcacagaaactcaat

SEQ ID NO: 677185 - DNA, 20 bp, mouse
gggcccacaacattcaataa

SEQ ID NO: 677186 - DNA, 20 bp, mouse
gcctccaccaggatcacctt

SEQ ID NO: 677187 - DNA, 20 bp, mouse
ggggtggggtgcttagggtg

SEQ ID NO: 677188 - DNA, 20 bp, mouse
ggtgcctaaggtgatcctgg

SEQ ID NO: 677189 - DNA, 20 bp, mouse
gggtgtgcctaaggtgatcc

SEQ ID NO: 677190 - DNA, 20 bp, mouse
gtcaccttaggcacacctac

SEQ ID NO: 677191 - DNA, 20 bp, mouse
gggtgcttagggtgtggctg

SEQ ID NO: 677192 - DNA, 20 bp, mouse
ggagggtttggctgggtcaa

SEQ ID NO: 677193 - DNA, 20 bp, mouse
gctgccctctggtctaggtg

SEQ ID NO: 677194 - DNA, 20 bp, mouse
ggatagcacagaaactcaat

SEQ ID NO: 677195 - DNA, 20 bp, mouse
gggcccacaacattcaataa

SEQ ID NO: 677196 - DNA, 20 bp, mouse
gctgagagagagccgggtgg

SEQ ID NO: 677197 - DNA, 20 bp, mouse
ggtagcttggaattacaggt

SEQ ID NO: 677198 - DNA, 20 bp, mouse
gcaagaggctgagagagagc

SEQ ID NO: 677199 - DNA, 20 bp, mouse
gtaattccaagctactcaag

SEQ ID NO: 677200 - DNA, 20 bp, mouse
ggaattacaggtgggagcat

SEQ ID NO: 677201 - DNA, 20 bp, mouse
gaggctgagagagagccggg

SEQ ID NO: 677202 - DNA, 20 bp, mouse
gcctccaccaggatcacctt

SEQ ID NO: 677203 - DNA, 20 bp, mouse
gctgccctctggtctaggtg

SEQ ID NO: 677204 - DNA, 20 bp, mouse
ggatagcacagaaactcaat

SEQ ID NO: 677205 - DNA, 20 bp, mouse
gggcccacaacattcaataa

SEQ ID NO: 677206 - DNA, 20 bp, mouse
gaggagggcgcgtcactcag

SEQ ID NO: 677207 - DNA, 20 bp, mouse
gtgggccactctctccacac

SEQ ID NO: 677208 - DNA, 20 bp, mouse
gacccccgatcgagcaagat

SEQ ID NO: 677209 - DNA, 20 bp, mouse
ggggctcggcggaggtaggg

SEQ ID NO: 677210 - DNA, 20 bp, mouse
gagagtggcccaggccaaag

SEQ ID NO: 677211 - DNA, 20 bp, mouse
gttcaggagggtctccaagc

SEQ ID NO: 677212 - DNA, 20 bp, mouse
ggcggggctcggcggaggta

SEQ ID NO: 677213 - DNA, 20 bp, mouse
gggaaggggcggcctagagg

SEQ ID NO: 677214 - DNA, 20 bp, mouse
gcggagaagcctggatgtgt

SEQ ID NO: 677215 - DNA, 20 bp, mouse
gcaggccaggatctgggaac

SEQ ID NO: 677216 - DNA, 20 bp, mouse
ggctgaggggcgtgattgga

SEQ ID NO: 677217 - DNA, 20 bp, mouse
gcctggctgaggggcgtgat

SEQ ID NO: 677218 - DNA, 20 bp, mouse
ggcgtcagggcctggctgag

SEQ ID NO: 677219 - DNA, 20 bp, mouse
gagcttgtggttcttgaaca

SEQ ID NO: 677220 - DNA, 20 bp, mouse
ggcctcggccccagcttgcc

SEQ ID NO: 677221 - DNA, 20 bp, mouse
gtcaagaaccacaagctcga

SEQ ID NO: 677222 - DNA, 20 bp, mouse
ggagaagctgtacggcgtca

SEQ ID NO: 677223 - DNA, 20 bp, mouse
gccgcccgcggcagcagcct

SEQ ID NO: 677224 - DNA, 20 bp, mouse
ggctgtacggcgtcagggcc

SEQ ID NO: 677225 - DNA, 20 bp, mouse
gtgaaactggggctccttta

SEQ ID NO: 677226 - DNA, 20 bp, mouse
gtactgctgacagctgatta

SEQ ID NO: 677227 - DNA, 20 bp, mouse
gcagcgcagccccttctccc

SEQ ID NO: 677228 - DNA, 20 bp, mouse
gaaaggcgggagtgaggagc

SEQ ID NO: 677229 - DNA, 20 bp, mouse
gaggagcaggcacgtggttc

SEQ ID NO: 677230 - DNA, 20 bp, mouse
ggtgcgggggggcatgcacg

SEQ ID NO: 677231 - DNA, 20 bp, mouse
gtcagtagagtggaggtggg

SEQ ID NO: 677232 - DNA, 20 bp, mouse
gggcgctaaagaaggcacgt

SEQ ID NO: 677233 - DNA, 20 bp, mouse
gcgtgggaaaggcgggagtg

SEQ ID NO: 677234 - DNA, 20 bp, mouse
gagcgccagcaaagcactgc

SEQ ID NO: 677235 - DNA, 20 bp, mouse
gcagccccttctcccagggc

SEQ ID NO: 677236 - DNA, 20 bp, mouse
gaggagaacagggcagagat

SEQ ID NO: 677237 - DNA, 20 bp, mouse
ggagctggagattgagagaa

SEQ ID NO: 677238 - DNA, 20 bp, mouse
ggggcgaactcttagtgcag

SEQ ID NO: 677239 - DNA, 20 bp, mouse
gacactcagctaatttcacg

SEQ ID NO: 677240 - DNA, 20 bp, mouse
gaagcaaaacaaaatttcga

SEQ ID NO: 677241 - DNA, 20 bp, mouse
gttcgaaggctaaggagaac

SEQ ID NO: 677242 - DNA, 20 bp, mouse
gcaggggggttgagtctcac

SEQ ID NO: 677243 - DNA, 20 bp, mouse
ggaccgtgggttttagtaat

SEQ ID NO: 677244 - DNA, 20 bp, mouse
ggctgagtgtattaatcata

SEQ ID NO: 677245 - DNA, 20 bp, mouse
gagtcgtaagctggattaga

SEQ ID NO: 677246 - DNA, 20 bp, mouse
gcaggccccacgtccaacac

SEQ ID NO: 677247 - DNA, 20 bp, mouse
gccgccccacggggcgggag

SEQ ID NO: 677248 - DNA, 20 bp, mouse
gagcgagcctggtgggcggt

SEQ ID NO: 677249 - DNA, 20 bp, mouse
ggacagcgagcgagcctggt

SEQ ID NO: 677250 - DNA, 20 bp, mouse
ggcggagcgggcgtgttggt

SEQ ID NO: 677251 - DNA, 20 bp, mouse
ggacctgtcggagcccgtgt

SEQ ID NO: 677252 - DNA, 20 bp, mouse
gcacgttgtcctgggagcta

SEQ ID NO: 677253 - DNA, 20 bp, mouse
gctgtcctcaataccctgca

SEQ ID NO: 677254 - DNA, 20 bp, mouse
gcggagcccgtgttggacgt

SEQ ID NO: 677255 - DNA, 20 bp, mouse
ggatctccgccctagctccc

SEQ ID NO: 677256 - DNA, 20 bp, mouse
ggaggtggggacgggttaaa

SEQ ID NO: 677257 - DNA, 20 bp, mouse
gaaaagcccctgggaatcaa

SEQ ID NO: 677258 - DNA, 20 bp, mouse
gcaggggcttttaagagagt

SEQ ID NO: 677259 - DNA, 20 bp, mouse
gtcgtgcttcagaacgaggt

SEQ ID NO: 677260 - DNA, 20 bp, mouse
ggatagccacaataccctcc

SEQ ID NO: 677261 - DNA, 20 bp, mouse
ggcgccgaatccttccaaaa

SEQ ID NO: 677262 - DNA, 20 bp, mouse
gtagaagcagctgtttcttg

SEQ ID NO: 677263 - DNA, 20 bp, mouse
gggcgcatccccactttgag

SEQ ID NO: 677264 - DNA, 20 bp, mouse
gctaaccctttgattcccag

SEQ ID NO: 677265 - DNA, 20 bp, mouse
gggcttccagatttaggagg

SEQ ID NO: 677266 - DNA, 20 bp, mouse
gccaactgagactgtaggtt

SEQ ID NO: 677267 - DNA, 20 bp, mouse
gtccttgtgaacataagtgt

SEQ ID NO: 677268 - DNA, 20 bp, mouse
gctacagtctcagttggatt

SEQ ID NO: 677269 - DNA, 20 bp, mouse
gaatgggctagtggatactt

SEQ ID NO: 677270 - DNA, 20 bp, mouse
gtggattaggcatctgtcta

SEQ ID NO: 677271 - DNA, 20 bp, mouse
gtgttcccggaatgtcacca

SEQ ID NO: 677272 - DNA, 20 bp, mouse
gagtcgatccccatgagggg

SEQ ID NO: 677273 - DNA, 20 bp, mouse
gcatggggatcgactgttcc

SEQ ID NO: 677274 - DNA, 20 bp, mouse
gaatgtcaccaaggtcactt

SEQ ID NO: 677275 - DNA, 20 bp, mouse
ggctgaccaaagtcctgaga

SEQ ID NO: 677276 - DNA, 20 bp, mouse
gcaggcgcgctgaggatttg

SEQ ID NO: 677277 - DNA, 20 bp, mouse
gcggaagttgcaggtatttg

SEQ ID NO: 677278 - DNA, 20 bp, mouse
ggctgccgacgtcacctgat

SEQ ID NO: 677279 - DNA, 20 bp, mouse
ggtcacctgatgggagacgc

SEQ ID NO: 677280 - DNA, 20 bp, mouse
gcgcgcctgcgtctcccatc

SEQ ID NO: 677281 - DNA, 20 bp, mouse
ggcggcgccccgcctactcc

SEQ ID NO: 677282 - DNA, 20 bp, mouse
ggtctcccatcaggtgacgt

SEQ ID NO: 677283 - DNA, 20 bp, mouse
gtcactgcagaactgtcttg

SEQ ID NO: 677284 - DNA, 20 bp, mouse
gcccgcctactccgggaacg

SEQ ID NO: 677285 - DNA, 20 bp, mouse
ggcaaaagctcggaagttgc

SEQ ID NO: 677286 - DNA, 20 bp, mouse
gcgggccaccagccgggagc

SEQ ID NO: 677287 - DNA, 20 bp, mouse
gtcaagatgcggggacccgg

SEQ ID NO: 677288 - DNA, 20 bp, mouse
gccggagcctgtcccgctcc

SEQ ID NO: 677289 - DNA, 20 bp, mouse
gctccagtcgagggaggatg

SEQ ID NO: 677290 - DNA, 20 bp, mouse
gacgcccagagcggcgggcc

SEQ ID NO: 677291 - DNA, 20 bp, mouse
ggaggcgggcgcttcctgga

SEQ ID NO: 677292 - DNA, 20 bp, mouse
ggctgcatccaggtcctcgc

SEQ ID NO: 677293 - DNA, 20 bp, mouse
ggggtccccgcatcttgaac

SEQ ID NO: 677294 - DNA, 20 bp, mouse
gcccgggcgagcgcacgagt

SEQ ID NO: 677295 - DNA, 20 bp, mouse
gtgcctgacgcccagagcgg

SEQ ID NO: 677296 - DNA, 20 bp, mouse
ggaaaactgggagtgaaaat

SEQ ID NO: 677297 - DNA, 20 bp, mouse
ggaggcgcagcaaagaaaac

SEQ ID NO: 677298 - DNA, 20 bp, mouse
gcctccgcggtccagccctc

SEQ ID NO: 677299 - DNA, 20 bp, mouse
gagtgaaaatgggttgaaat

SEQ ID NO: 677300 - DNA, 20 bp, mouse
ggggcgagggcggagcttgt

SEQ ID NO: 677301 - DNA, 20 bp, mouse
gcgagggcggagcttgtggg

SEQ ID NO: 677302 - DNA, 20 bp, mouse
gaaaatgggttgaaatgggt

SEQ ID NO: 677303 - DNA, 20 bp, mouse
ggaacctgagggctggaccg

SEQ ID NO: 677304 - DNA, 20 bp, mouse
ggggctcgtgggcggagtcc

SEQ ID NO: 677305 - DNA, 20 bp, mouse
gggcggagtcccggagcgga

SEQ ID NO: 677306 - DNA, 20 bp, mouse
ggagtccccggaacccccca

SEQ ID NO: 677307 - DNA, 20 bp, mouse
gagcgccagggccgcgacca

SEQ ID NO: 677308 - DNA, 20 bp, mouse
gcggggcgtcgctgagtccc

SEQ ID NO: 677309 - DNA, 20 bp, mouse
ggctgggctgctgggcgcaa

SEQ ID NO: 677310 - DNA, 20 bp, mouse
gcccccagggggcgctcgag

SEQ ID NO: 677311 - DNA, 20 bp, mouse
gcgccccctggggggttccg

SEQ ID NO: 677312 - DNA, 20 bp, mouse
ggccagggccgcgaccaggg

SEQ ID NO: 677313 - DNA, 20 bp, mouse
gagcagggaatcagggctga

SEQ ID NO: 677314 - DNA, 20 bp, mouse
gcgacgccccgccctggtcg

SEQ ID NO: 677315 - DNA, 20 bp, mouse
gtaagaactagtatcttgct

SEQ ID NO: 677316 - DNA, 20 bp, mouse
gcgcgccctgggaccgtctc

SEQ ID NO: 677317 - DNA, 20 bp, mouse
ggctccggatgacggggaca

SEQ ID NO: 677318 - DNA, 20 bp, mouse
ggggacgcggctccggatga

SEQ ID NO: 677319 - DNA, 20 bp, mouse
gaacccaggcgcagcgggga

SEQ ID NO: 677320 - DNA, 20 bp, mouse
ggaccccggctggacaagtg

SEQ ID NO: 677321 - DNA, 20 bp, mouse
gacagccagagacggtccca

SEQ ID NO: 677322 - DNA, 20 bp, mouse
gcacgcgcgtggcaggcgtg

SEQ ID NO: 677323 - DNA, 20 bp, mouse
gggcgtggggactcggggat

SEQ ID NO: 677324 - DNA, 20 bp, mouse
gcggctggacaagtggggtg

SEQ ID NO: 677325 - DNA, 20 bp, mouse
gaggcggggttcggggaaga

SEQ ID NO: 677326 - DNA, 20 bp, mouse
gggagggagccacagtacta

SEQ ID NO: 677327 - DNA, 20 bp, mouse
ggggagccacagtactaggg

SEQ ID NO: 677328 - DNA, 20 bp, mouse
gtatgtcactgtgtctgcgg

SEQ ID NO: 677329 - DNA, 20 bp, mouse
gagggacagggacactgcct

SEQ ID NO: 677330 - DNA, 20 bp, mouse
ggccacagtactagggagga

SEQ ID NO: 677331 - DNA, 20 bp, mouse
gctagggaggagggcgggct

SEQ ID NO: 677332 - DNA, 20 bp, mouse
gctgggggcaggcccaaagc

SEQ ID NO: 677333 - DNA, 20 bp, mouse
gcagccagtctgtgcagggg

SEQ ID NO: 677334 - DNA, 20 bp, mouse
gacagggacactgcctggga

SEQ ID NO: 677335 - DNA, 20 bp, mouse
gcacggcacccacgactcac

SEQ ID NO: 677336 - DNA, 20 bp, mouse
gggcggcgatgcagcgggga

SEQ ID NO: 677337 - DNA, 20 bp, mouse
gggagcggagagatagggtc

SEQ ID NO: 677338 - DNA, 20 bp, mouse
ggtagggcggcgatgcagcg

SEQ ID NO: 677339 - DNA, 20 bp, mouse
ggatcgaaacccctcttcaa

SEQ ID NO: 677340 - DNA, 20 bp, mouse
gcgggcacacgtgtctcggg

SEQ ID NO: 677341 - DNA, 20 bp, mouse
gtcactggagcggagagata

SEQ ID NO: 677342 - DNA, 20 bp, mouse
ggaaacccctcttcaagggg

SEQ ID NO: 677343 - DNA, 20 bp, mouse
ggggatggaggggaccgcga

SEQ ID NO: 677344 - DNA, 20 bp, mouse
ggggcggccgccacagagcg

SEQ ID NO: 677345 - DNA, 20 bp, mouse
gtggctagtgcctctctcgg

SEQ ID NO: 677346 - DNA, 20 bp, mouse
gccgccctggggcagccccc

SEQ ID NO: 677347 - DNA, 20 bp, mouse
ggtggggagcatatcagctg

SEQ ID NO: 677348 - DNA, 20 bp, mouse
gagacccagtcaccgcccgg

SEQ ID NO: 677349 - DNA, 20 bp, mouse
gcgtagggcgcagagacagt

SEQ ID NO: 677350 - DNA, 20 bp, mouse
gcagcccccgggcggtgact

SEQ ID NO: 677351 - DNA, 20 bp, mouse
ggcagcccggagcgccactt

SEQ ID NO: 677352 - DNA, 20 bp, mouse
ggtctcccaagtggcgctcc

SEQ ID NO: 677353 - DNA, 20 bp, mouse
gaggggcgtgccaatatatg

SEQ ID NO: 677354 - DNA, 20 bp, mouse
gagacggcgcggtgtctgtc

SEQ ID NO: 677355 - DNA, 20 bp, mouse
gagctccgcaccgacgggaa

SEQ ID NO: 677356 - DNA, 20 bp, mouse
ggatgagcgctgctcagaat

SEQ ID NO: 677357 - DNA, 20 bp, mouse
ggagcagcctggagctagtc

SEQ ID NO: 677358 - DNA, 20 bp, mouse
gaggaccatggatagttcta

SEQ ID NO: 677359 - DNA, 20 bp, mouse
gcctgccagcccaatatttc

SEQ ID NO: 677360 - DNA, 20 bp, mouse
gcagccccgcccggccctgc

SEQ ID NO: 677361 - DNA, 20 bp, mouse
ggctccaggctgctccaatg

SEQ ID NO: 677362 - DNA, 20 bp, mouse
gcaggctgctccaatggggc

SEQ ID NO: 677363 - DNA, 20 bp, mouse
gccagagatcaagatgggtc

SEQ ID NO: 677364 - DNA, 20 bp, mouse
gtccatggtcctgaaatatt

SEQ ID NO: 677365 - DNA, 20 bp, mouse
ggctctggggaacagttcat

SEQ ID NO: 677366 - DNA, 20 bp, mouse
ggggcctcctgtgctgccag

SEQ ID NO: 677367 - DNA, 20 bp, mouse
gaggacccacctctgtgcgc

SEQ ID NO: 677368 - DNA, 20 bp, mouse
gtgcaccctgcgcacagagg

SEQ ID NO: 677369 - DNA, 20 bp, mouse
gggtcctgctgctcgcacgc

SEQ ID NO: 677370 - DNA, 20 bp, mouse
gacagccaggacgaagacaa

SEQ ID NO: 677371 - DNA, 20 bp, mouse
ggagcgagcagggcaatcca

SEQ ID NO: 677372 - DNA, 20 bp, mouse
gaggcccgcgtgcgagcagc

SEQ ID NO: 677373 - DNA, 20 bp, mouse
gtagaaggctgacgacaaac

SEQ ID NO: 677374 - DNA, 20 bp, mouse
gggcgagtgcaggaggcgat

SEQ ID NO: 677375 - DNA, 20 bp, mouse
gcacccacagtgagcaaaag

SEQ ID NO: 677376 - DNA, 20 bp, mouse
gcccgcccggccctcctgga

SEQ ID NO: 677377 - DNA, 20 bp, mouse
gccccgggaggatcccacta

SEQ ID NO: 677378 - DNA, 20 bp, mouse
gggtgctgctagtactgcct

SEQ ID NO: 677379 - DNA, 20 bp, mouse
ggggaggatcccactagggg

SEQ ID NO: 677380 - DNA, 20 bp, mouse
ggtcaggatccaactttcac

SEQ ID NO: 677381 - DNA, 20 bp, mouse
gggagattgccacccctagt

SEQ ID NO: 677382 - DNA, 20 bp, mouse
gaaagttggatcctgacccc

SEQ ID NO: 677383 - DNA, 20 bp, mouse
ggtactagcagcacccagag

SEQ ID NO: 677384 - DNA, 20 bp, mouse
gccgccccgcccggccctcc

SEQ ID NO: 677385 - DNA, 20 bp, mouse
gtggaacctgccctccagga

SEQ ID NO: 677386 - DNA, 20 bp, mouse
gggagccctccctggccggt

SEQ ID NO: 677387 - DNA, 20 bp, mouse
gtgtctccgcccaccggcca

SEQ ID NO: 677388 - DNA, 20 bp, mouse
gtgggctttaactgagactg

SEQ ID NO: 677389 - DNA, 20 bp, mouse
gaaggcaagtagggtcccca

SEQ ID NO: 677390 - DNA, 20 bp, mouse
gacagctgtggagccctccc

SEQ ID NO: 677391 - DNA, 20 bp, mouse
gaaagcccaggcctcgggcc

SEQ ID NO: 677392 - DNA, 20 bp, mouse
ggggctccgggctgttcctg

SEQ ID NO: 677393 - DNA, 20 bp, mouse
ggccctccctggccggtggg

SEQ ID NO: 677394 - DNA, 20 bp, mouse
gaccctacttgccttaagtc

SEQ ID NO: 677395 - DNA, 20 bp, mouse
ggagggctccacagctgtcc

SEQ ID NO: 677396 - DNA, 20 bp, mouse
gtgaagaaggagtacaccta

SEQ ID NO: 677397 - DNA, 20 bp, mouse
gtagctgaataacatgaccc

SEQ ID NO: 677398 - DNA, 20 bp, mouse
gaggaggggctaaggaaagg

SEQ ID NO: 677399 - DNA, 20 bp, mouse
gatgtccattggaacatctc

SEQ ID NO: 677400 - DNA, 20 bp, mouse
gcaagcaagctagccatcaa

SEQ ID NO: 677401 - DNA, 20 bp, mouse
gatgtccagagatgttccaa

SEQ ID NO: 677402 - DNA, 20 bp, mouse
gggacatcagcttgggagga

SEQ ID NO: 677403 - DNA, 20 bp, mouse
ggcagtatcatgatttccac

SEQ ID NO: 677404 - DNA, 20 bp, mouse
gcaaattgcaacataacaag

SEQ ID NO: 677405 - DNA, 20 bp, mouse
gacataagcaactcctttga

SEQ ID NO: 677406 - DNA, 20 bp, mouse
gcgtggctgcgagcgaagag

SEQ ID NO: 677407 - DNA, 20 bp, mouse
gaactgacgagcaagcgtgg

SEQ ID NO: 677408 - DNA, 20 bp, mouse
ggctcgcagccacggcgcgc

SEQ ID NO: 677409 - DNA, 20 bp, mouse
gtatcaagctaggccactag

SEQ ID NO: 677410 - DNA, 20 bp, mouse
ggcagtacttcggaacccgg

SEQ ID NO: 677411 - DNA, 20 bp, mouse
gaagcgcaggcgcagtactt

SEQ ID NO: 677412 - DNA, 20 bp, mouse
ggacggcagcggactcggtc

SEQ ID NO: 677413 - DNA, 20 bp, mouse
ggcgcagatgcgaagcggcc

SEQ ID NO: 677414 - DNA, 20 bp, mouse
ggcccggaccgccttctaag

SEQ ID NO: 677415 - DNA, 20 bp, mouse
gtcctcttagaaggcggtcc

SEQ ID NO: 677416 - DNA, 20 bp, mouse
gcgcgccagccctgatgaga

SEQ ID NO: 677417 - DNA, 20 bp, mouse
gtgtaggggtggtgacgaac

SEQ ID NO: 677418 - DNA, 20 bp, mouse
gcgggcgacaccatctgtag

SEQ ID NO: 677419 - DNA, 20 bp, mouse
gggcctgagcagagcggctg

SEQ ID NO: 677420 - DNA, 20 bp, mouse
ggcgacaccatctgtagggg

SEQ ID NO: 677421 - DNA, 20 bp, mouse
gagcgcgcaggggtcaccga

SEQ ID NO: 677422 - DNA, 20 bp, mouse
gggagctaggccactggcgc

SEQ ID NO: 677423 - DNA, 20 bp, mouse
gttgaataagacgtggatcc

SEQ ID NO: 677424 - DNA, 20 bp, mouse
gcgggattcgcgcgtgagaa

SEQ ID NO: 677425 - DNA, 20 bp, mouse
gacgtggatccaggctgaca

SEQ ID NO: 677426 - DNA, 20 bp, mouse
gtggcccagcggaccagggc

SEQ ID NO: 677427 - DNA, 20 bp, mouse
gcggaccagggcaggaaaac

SEQ ID NO: 677428 - DNA, 20 bp, mouse
ggcgaccggggaacgagccg

SEQ ID NO: 677429 - DNA, 20 bp, mouse
gcctgcgcatgataggggcg

SEQ ID NO: 677430 - DNA, 20 bp, mouse
gaccggggaacgagccgagg

SEQ ID NO: 677431 - DNA, 20 bp, mouse
gactgcgcctgcgcatgata

SEQ ID NO: 677432 - DNA, 20 bp, mouse
gtcagccgggccagagggtg

SEQ ID NO: 677433 - DNA, 20 bp, mouse
ggggcgtggcccagcggacc

SEQ ID NO: 677434 - DNA, 20 bp, mouse
gcggtcgccccggtctcgcg

SEQ ID NO: 677435 - DNA, 20 bp, mouse
gggtgcggttaaggaactgg

SEQ ID NO: 677436 - DNA, 20 bp, mouse
gcggggcagaggctggactt

SEQ ID NO: 677437 - DNA, 20 bp, mouse
gggatgatcagcaaccaatt

SEQ ID NO: 677438 - DNA, 20 bp, mouse
gcagaggccagcgatgggga

SEQ ID NO: 677439 - DNA, 20 bp, mouse
gatggctggcggggcagcgg

SEQ ID NO: 677440 - DNA, 20 bp, mouse
gctgccgcctggttcacgtc

SEQ ID NO: 677441 - DNA, 20 bp, mouse
gccccgccagccatcccaat

SEQ ID NO: 677442 - DNA, 20 bp, mouse
gcgcaggctccgagcttgag

SEQ ID NO: 677443 - DNA, 20 bp, mouse
ggatcagcaaccaattggga

SEQ ID NO: 677444 - DNA, 20 bp, mouse
gagcttgaggggaaagcatg

SEQ ID NO: 677445 - DNA, 20 bp, mouse
ggggacagcaaacaggccga

SEQ ID NO: 677446 - DNA, 20 bp, mouse
ggaaacaggcgatcggtcgg

SEQ ID NO: 677447 - DNA, 20 bp, mouse
ggagacgtcctcagagtcga

SEQ ID NO: 677448 - DNA, 20 bp, mouse
gagggcaggaacgctgtctc

SEQ ID NO: 677449 - DNA, 20 bp, mouse
gcggtggcggcaagcgagaa

SEQ ID NO: 677450 - DNA, 20 bp, mouse
gctgccctcagcacagacta

SEQ ID NO: 677451 - DNA, 20 bp, mouse
gccgcggtccctcgactctg

SEQ ID NO: 677452 - DNA, 20 bp, mouse
gtctgaggacgtctcactag

SEQ ID NO: 677453 - DNA, 20 bp, mouse
gccggaagccgggtggaaat

SEQ ID NO: 677454 - DNA, 20 bp, mouse
gatctccgtagtctgtgctg

SEQ ID NO: 677455 - DNA, 20 bp, mouse
ggatcggtcggcggctagtc

SEQ ID NO: 677456 - DNA, 20 bp, mouse
gaacggctctgttctgtgat

SEQ ID NO: 677457 - DNA, 20 bp, mouse
gcaacccccatcctcagctg

SEQ ID NO: 677458 - DNA, 20 bp, mouse
gtgggacactggtttggcaa

SEQ ID NO: 677459 - DNA, 20 bp, mouse
gcccaggtgttgggtggagt

SEQ ID NO: 677460 - DNA, 20 bp, mouse
gtctgtggaggctgagtcaa

SEQ ID NO: 677461 - DNA, 20 bp, mouse
ggtggactggggccgccaag

SEQ ID NO: 677462 - DNA, 20 bp, mouse
ggaggggccagcatcagata

SEQ ID NO: 677463 - DNA, 20 bp, mouse
ggggccgccaaggggctgag

SEQ ID NO: 677464 - DNA, 20 bp, mouse
gcccttccccagctgaggat

SEQ ID NO: 677465 - DNA, 20 bp, mouse
gtggctgagtgtacccccag

SEQ ID NO: 677466 - DNA, 20 bp, mouse
gtgtgtgcaggattaagccg

SEQ ID NO: 677467 - DNA, 20 bp, mouse
gaaccgccgcggaccttcgg

SEQ ID NO: 677468 - DNA, 20 bp, mouse
ggcgccctacgtcacttccg

SEQ ID NO: 677469 - DNA, 20 bp, mouse
gggaccccgccgaaggtccg

SEQ ID NO: 677470 - DNA, 20 bp, mouse
ggaggcagcagcagcggatc

SEQ ID NO: 677471 - DNA, 20 bp, mouse
gtgaaaacaagcgggttcca

SEQ ID NO: 677472 - DNA, 20 bp, mouse
gttaagccgcggctggggca

SEQ ID NO: 677473 - DNA, 20 bp, mouse
ggcggcccgctgctggtgac

SEQ ID NO: 677474 - DNA, 20 bp, mouse
ggcccctcggaagtgacgta

SEQ ID NO: 677475 - DNA, 20 bp, mouse
gggttccatggcatgcggta

SEQ ID NO: 677476 - DNA, 20 bp, mouse
ggatctgaggacttcagcgg

SEQ ID NO: 677477 - DNA, 20 bp, mouse
gcacttccgggaattccggg

SEQ ID NO: 677478 - DNA, 20 bp, mouse
gctggcgcgggtgagagagc

SEQ ID NO: 677479 - DNA, 20 bp, mouse
gcgcgccagcgtcgggatca

SEQ ID NO: 677480 - DNA, 20 bp, mouse
gctgcagcccgccccgaacc

SEQ ID NO: 677481 - DNA, 20 bp, mouse
ggggccacttccgggaattc

SEQ ID NO: 677482 - DNA, 20 bp, mouse
ggagagagccgggttcgggg

SEQ ID NO: 677483 - DNA, 20 bp, mouse
gggtgagagagccgggttcg

SEQ ID NO: 677484 - DNA, 20 bp, mouse
gtctgtgccgtggagactgt

SEQ ID NO: 677485 - DNA, 20 bp, mouse
ggtcgatctgaggacttcag

SEQ ID NO: 677486 - DNA, 20 bp, mouse
ggacgcgcgccgcgggtgat

SEQ ID NO: 677487 - DNA, 20 bp, mouse
ggggttgcagagaagtttac

SEQ ID NO: 677488 - DNA, 20 bp, mouse
gaactgaggctctcagggta

SEQ ID NO: 677489 - DNA, 20 bp, mouse
gtaagtcccgagcttgccaa

SEQ ID NO: 677490 - DNA, 20 bp, mouse
ggggtaaggaatgttgtcct

SEQ ID NO: 677491 - DNA, 20 bp, mouse
gttgcagagaagtttacggg

SEQ ID NO: 677492 - DNA, 20 bp, mouse
gcagcgcgggcaggacgggg

SEQ ID NO: 677493 - DNA, 20 bp, mouse
ggcttgccaacggcagacct

SEQ ID NO: 677494 - DNA, 20 bp, mouse
ggctgcagcgcgggcaggac

SEQ ID NO: 677495 - DNA, 20 bp, mouse
ggtctgccgttggcaagctc

SEQ ID NO: 677496 - DNA, 20 bp, mouse
ggctggaaggtctgggactg

SEQ ID NO: 677497 - DNA, 20 bp, mouse
ggacacccactcccaaattg

SEQ ID NO: 677498 - DNA, 20 bp, mouse
ggggagcgcctagggagggt

SEQ ID NO: 677499 - DNA, 20 bp, mouse
ggagcagcagtggtccctga

SEQ ID NO: 677500 - DNA, 20 bp, mouse
gttgggggagcgcctaggga

SEQ ID NO: 677501 - DNA, 20 bp, mouse
gttcccacaaggttgctgga

SEQ ID NO: 677502 - DNA, 20 bp, mouse
ggaccttccagcaaccttgt

SEQ ID NO: 677503 - DNA, 20 bp, mouse
gtcccagtgaggacagggcg

SEQ ID NO: 677504 - DNA, 20 bp, mouse
gaggcgctcccccaaaagga

SEQ ID NO: 677505 - DNA, 20 bp, mouse
gggccccgccctgtcctcac

SEQ ID NO: 677506 - DNA, 20 bp, mouse
gaacgcggagggatcggagg

SEQ ID NO: 677507 - DNA, 20 bp, mouse
gggcggggagagaatgcgga

SEQ ID NO: 677508 - DNA, 20 bp, mouse
gagcagggacagaacgcgga

SEQ ID NO: 677509 - DNA, 20 bp, mouse
gggacgctaggactccaagg

SEQ ID NO: 677510 - DNA, 20 bp, mouse
ggaggcggggataaaaccta

SEQ ID NO: 677511 - DNA, 20 bp, mouse
ggggccagaacacccagttc

SEQ ID NO: 677512 - DNA, 20 bp, mouse
gcagagggacggtgcaagat

SEQ ID NO: 677513 - DNA, 20 bp, mouse
gggtaagagggttggacgct

SEQ ID NO: 677514 - DNA, 20 bp, mouse
gtagtacctaaaagagggca

SEQ ID NO: 677515 - DNA, 20 bp, mouse
ggcctcagtctgtactgctg

SEQ ID NO: 677516 - DNA, 20 bp, mouse
ggtgggcgtggccgcctctt

SEQ ID NO: 677517 - DNA, 20 bp, mouse
gtgcccggaagtgcccctgt

SEQ ID NO: 677518 - DNA, 20 bp, mouse
gccagcttcttgcccgaagg

SEQ ID NO: 677519 - DNA, 20 bp, mouse
ggcgtggccacgatgtgggc

SEQ ID NO: 677520 - DNA, 20 bp, mouse
gcgcccacctgggccggaag

SEQ ID NO: 677521 - DNA, 20 bp, mouse
ggaccgcttccggcccaggt

SEQ ID NO: 677522 - DNA, 20 bp, mouse
gccagagcccgcccacatcg

SEQ ID NO: 677523 - DNA, 20 bp, mouse
gtccgggcaccgataggcgg

SEQ ID NO: 677524 - DNA, 20 bp, mouse
gcatcgtggccacgcccaag

SEQ ID NO: 677525 - DNA, 20 bp, mouse
gcgtggccgcctcttgggcg

SEQ ID NO: 677526 - DNA, 20 bp, mouse
gaagttctgtggctgtaggt

SEQ ID NO: 677527 - DNA, 20 bp, mouse
gtacagccacagaacttcag

SEQ ID NO: 677528 - DNA, 20 bp, mouse
gaacttcagaggctcaacgt

SEQ ID NO: 677529 - DNA, 20 bp, mouse
gcttgggataaaagtgagga

SEQ ID NO: 677530 - DNA, 20 bp, mouse
gctcaacgtggggttttcct

SEQ ID NO: 677531 - DNA, 20 bp, mouse
gtggggccgagactcgaagc

SEQ ID NO: 677532 - DNA, 20 bp, mouse
gcaaacgtgtgtgccattga

SEQ ID NO: 677533 - DNA, 20 bp, mouse
gaccagatacaaatactata

SEQ ID NO: 677534 - DNA, 20 bp, mouse
gttttccttggtaacttaga

SEQ ID NO: 677535 - DNA, 20 bp, mouse
gttggtaacttagaaggctt

SEQ ID NO: 677536 - DNA, 20 bp, mouse
gttaaaaatgataaggtcac

SEQ ID NO: 677537 - DNA, 20 bp, mouse
gggaaaattaagattggagg

SEQ ID NO: 677538 - DNA, 20 bp, mouse
gcacatctagaggagatttc

SEQ ID NO: 677539 - DNA, 20 bp, mouse
gtcaggttgccattttaaat

SEQ ID NO: 677540 - DNA, 20 bp, mouse
gtggggaaaattaagattgg

SEQ ID NO: 677541 - DNA, 20 bp, mouse
gttgctatgtggcttcatca

SEQ ID NO: 677542 - DNA, 20 bp, mouse
gtcttggggaaaattaagat

SEQ ID NO: 677543 - DNA, 20 bp, mouse
gataacatatgttttcacca

SEQ ID NO: 677544 - DNA, 20 bp, mouse
ggatctagaaaatctacatt

SEQ ID NO: 677545 - DNA, 20 bp, mouse
gcagtaccagctttgctatg

SEQ ID NO: 677546 - DNA, 20 bp, mouse
gcgacaccctaggaggggga

SEQ ID NO: 677547 - DNA, 20 bp, mouse
ggaaccgcgaggacccccgg

SEQ ID NO: 677548 - DNA, 20 bp, mouse
gagagccgcgacatcccccg

SEQ ID NO: 677549 - DNA, 20 bp, mouse
gccgcccccgggggatgtcg

SEQ ID NO: 677550 - DNA, 20 bp, mouse
gaatccgacaccctaggagg

SEQ ID NO: 677551 - DNA, 20 bp, mouse
ggtagggccggacaccggtg

SEQ ID NO: 677552 - DNA, 20 bp, mouse
gtggaatccgacaccctagg

SEQ ID NO: 677553 - DNA, 20 bp, mouse
gccccgggggcggctgactc

SEQ ID NO: 677554 - DNA, 20 bp, mouse
gcgcagccctccccctccta

SEQ ID NO: 677555 - DNA, 20 bp, mouse
gggtgtcggattccagagag

SEQ ID NO: 677556 - DNA, 20 bp, mouse
gaggccctgggcgggtagga

SEQ ID NO: 677557 - DNA, 20 bp, mouse
gcccaggagaggctaggcgc

SEQ ID NO: 677558 - DNA, 20 bp, mouse
gcctgggcgggtaggaggga

SEQ ID NO: 677559 - DNA, 20 bp, mouse
gcctctccagcaggtgttga

SEQ ID NO: 677560 - DNA, 20 bp, mouse
gctctgcagaaggggtgccc

SEQ ID NO: 677561 - DNA, 20 bp, mouse
gcggcccagccccgcccgtc

SEQ ID NO: 677562 - DNA, 20 bp, mouse
gcaccccttctgcagaggta

SEQ ID NO: 677563 - DNA, 20 bp, mouse
ggcggggctgggccggagtg

SEQ ID NO: 677564 - DNA, 20 bp, mouse
ggcccaggaggacaaaatat

SEQ ID NO: 677565 - DNA, 20 bp, mouse
gtgcagaaggggtgcccagg

SEQ ID NO: 677566 - DNA, 20 bp, mouse
gactggagaagggattctaa

SEQ ID NO: 677567 - DNA, 20 bp, mouse
gaggaggcggagttcctgga

SEQ ID NO: 677568 - DNA, 20 bp, mouse
gagaagggattctaacgggg

SEQ ID NO: 677569 - DNA, 20 bp, mouse
gctgctgggcccttcggctg

SEQ ID NO: 677570 - DNA, 20 bp, mouse
ggagttcctggagggttagg

SEQ ID NO: 677571 - DNA, 20 bp, mouse
gagggcaagtccctttcttt

SEQ ID NO: 677572 - DNA, 20 bp, mouse
gagggattctaacggggagg

SEQ ID NO: 677573 - DNA, 20 bp, mouse
ggaggagcgggctcaggagt

SEQ ID NO: 677574 - DNA, 20 bp, mouse
gcccagagcctcccataaga

SEQ ID NO: 677575 - DNA, 20 bp, mouse
ggattctaacggggaggagg

SEQ ID NO: 677576 - DNA, 20 bp, mouse
gtgaccctggaacaatgata

SEQ ID NO: 677577 - DNA, 20 bp, mouse
gtgaccatatcattgttcca

SEQ ID NO: 677578 - DNA, 20 bp, mouse
ggctggaaacaaaaaatgaa

SEQ ID NO: 677579 - DNA, 20 bp, mouse
gaaactgcttccatgaaatt

SEQ ID NO: 677580 - DNA, 20 bp, mouse
ggaagcttttctataggctc

SEQ ID NO: 677581 - DNA, 20 bp, mouse
gcagagaaagtcacaaatta

SEQ ID NO: 677582 - DNA, 20 bp, mouse
gaggctcaggatgactctaa

SEQ ID NO: 677583 - DNA, 20 bp, mouse
gtacatccgaattcatcata

SEQ ID NO: 677584 - DNA, 20 bp, mouse
gctctcatcttaaaaggatt

SEQ ID NO: 677585 - DNA, 20 bp, mouse
gactgttgcagattagggtt

SEQ ID NO: 677586 - DNA, 20 bp, mouse
gcacaactgcaggtgactag

SEQ ID NO: 677587 - DNA, 20 bp, mouse
gaggtgactaggggcggaag

SEQ ID NO: 677588 - DNA, 20 bp, mouse
gggaagtctgcttttggttc

SEQ ID NO: 677589 - DNA, 20 bp, mouse
gcggagccgatgctatttaa

SEQ ID NO: 677590 - DNA, 20 bp, mouse
gtccccgggaagtctgcttt

SEQ ID NO: 677591 - DNA, 20 bp, mouse
gtctgcttttggttcaggct

SEQ ID NO: 677592 - DNA, 20 bp, mouse
gagtacccagcgccaccgcg

SEQ ID NO: 677593 - DNA, 20 bp, mouse
gtcttgtttcagatgtaggg

SEQ ID NO: 677594 - DNA, 20 bp, mouse
gacgagaaagttaatgtact

SEQ ID NO: 677595 - DNA, 20 bp, mouse
ggtttcagatgtaggggggt

SEQ ID NO: 677596 - DNA, 20 bp, mouse
gagaagatgaggaatggtga

SEQ ID NO: 677597 - DNA, 20 bp, mouse
gttccaagttgcatcactag

SEQ ID NO: 677598 - DNA, 20 bp, mouse
gaatggtgaggggcgcctta

SEQ ID NO: 677599 - DNA, 20 bp, mouse
ggccctgcgtgcacgagggg

SEQ ID NO: 677600 - DNA, 20 bp, mouse
gcctgccctgcgtgcacgag

SEQ ID NO: 677601 - DNA, 20 bp, mouse
gggtgaggggcgccttaggg

SEQ ID NO: 677602 - DNA, 20 bp, mouse
gcccgggataagcaagggta

SEQ ID NO: 677603 - DNA, 20 bp, mouse
ggagtcgggctcacccctcg

SEQ ID NO: 677604 - DNA, 20 bp, mouse
ggcggggggtggcccacgag

SEQ ID NO: 677605 - DNA, 20 bp, mouse
ggagggcggggccccagaag

SEQ ID NO: 677606 - DNA, 20 bp, mouse
gaacaggagggattccggaa

SEQ ID NO: 677607 - DNA, 20 bp, mouse
gacagagcagggcccccagg

SEQ ID NO: 677608 - DNA, 20 bp, mouse
gcggaccgagaagcgtcaga

SEQ ID NO: 677609 - DNA, 20 bp, mouse
gatgcgggagaagggtatct

SEQ ID NO: 677610 - DNA, 20 bp, mouse
gagaaatgtgggtgggtcca

SEQ ID NO: 677611 - DNA, 20 bp, mouse
gcttgcgctagtggggtctc

SEQ ID NO: 677612 - DNA, 20 bp, mouse
gggcccccaggtggtgtgga

SEQ ID NO: 677613 - DNA, 20 bp, mouse
gagggattccggaaaggatg

SEQ ID NO: 677614 - DNA, 20 bp, mouse
ggcgtcagaaggcaagaacg

SEQ ID NO: 677615 - DNA, 20 bp, mouse
gccgccttccacaccacctg

SEQ ID NO: 677616 - DNA, 20 bp, mouse
gtggcggaagatcgcgagca

SEQ ID NO: 677617 - DNA, 20 bp, mouse
gccccgggagagccgcgcag

SEQ ID NO: 677618 - DNA, 20 bp, mouse
ggttgagggcgcaagacgtc

SEQ ID NO: 677619 - DNA, 20 bp, mouse
gcagctgaaagccgtggttg

SEQ ID NO: 677620 - DNA, 20 bp, mouse
gcgcaggggcgatgtcgcca

SEQ ID NO: 677621 - DNA, 20 bp, mouse
gcgaaccccggtccagcccc

SEQ ID NO: 677622 - DNA, 20 bp, mouse
gtggaccggggttcgggtgg

SEQ ID NO: 677623 - DNA, 20 bp, mouse
gtggcaggtgaggagggcgt

SEQ ID NO: 677624 - DNA, 20 bp, mouse
ggtcccgcttgtgtgggctg

SEQ ID NO: 677625 - DNA, 20 bp, mouse
gccgcagactgtcctctcgg

SEQ ID NO: 677626 - DNA, 20 bp, mouse
gaacgtggggcgtgttgtga

SEQ ID NO: 677627 - DNA, 20 bp, mouse
gcgggcgcgcccaaccagct

SEQ ID NO: 677628 - DNA, 20 bp, mouse
gcgcgcccgcacgatgtaca

SEQ ID NO: 677629 - DNA, 20 bp, mouse
gcccgcacgatgtacagggg

SEQ ID NO: 677630 - DNA, 20 bp, mouse
gaggggcgggcccgcaacgt

SEQ ID NO: 677631 - DNA, 20 bp, mouse
gtcagcgtgctggctgtgat

SEQ ID NO: 677632 - DNA, 20 bp, mouse
gacaacacgccccacgttgc

SEQ ID NO: 677633 - DNA, 20 bp, mouse
gcccgcccctgtacatcgtg

SEQ ID NO: 677634 - DNA, 20 bp, mouse
gcaaccagctaggctgccat

SEQ ID NO: 677635 - DNA, 20 bp, mouse
ggagccaaggggataaccag

SEQ ID NO: 677636 - DNA, 20 bp, mouse
gcagctaaggtggctttcgg

SEQ ID NO: 677637 - DNA, 20 bp, mouse
gggcgctgggctcccgtcac

SEQ ID NO: 677638 - DNA, 20 bp, mouse
gagggcggggcttgcggaga

SEQ ID NO: 677639 - DNA, 20 bp, mouse
gtcccgtcacggggtcacaa

SEQ ID NO: 677640 - DNA, 20 bp, mouse
gctaaggtggctttcggagg

SEQ ID NO: 677641 - DNA, 20 bp, mouse
gaccgcctcgacagctaagg

SEQ ID NO: 677642 - DNA, 20 bp, mouse
ggtcacggggtcacaacggt

SEQ ID NO: 677643 - DNA, 20 bp, mouse
ggccgctcgccccgatctcg

SEQ ID NO: 677644 - DNA, 20 bp, mouse
gagaacacaactgttgactg

SEQ ID NO: 677645 - DNA, 20 bp, mouse
gtgggcccaccccgagatcg

SEQ ID NO: 677646 - DNA, 20 bp, mouse
gctactgaactgtcattgta

SEQ ID NO: 677647 - DNA, 20 bp, mouse
gttccaggaggcattgttca

SEQ ID NO: 677648 - DNA, 20 bp, mouse
gcctggaaaggctttgtttt

SEQ ID NO: 677649 - DNA, 20 bp, mouse
gtctctattaggagcaatca

SEQ ID NO: 677650 - DNA, 20 bp, mouse
gttccgtgaacaatgcctcc

SEQ ID NO: 677651 - DNA, 20 bp, mouse
gccttacaggcacaggaaga

SEQ ID NO: 677652 - DNA, 20 bp, mouse
gggggacacgaatccaatcc

SEQ ID NO: 677653 - DNA, 20 bp, mouse
ggcacgtgattattctgatg

SEQ ID NO: 677654 - DNA, 20 bp, mouse
gttggattcgtgtccccctc

SEQ ID NO: 677655 - DNA, 20 bp, mouse
gagtgcttttgctgttgata

SEQ ID NO: 677656 - DNA, 20 bp, mouse
gtggagctgaggcctccgaa

SEQ ID NO: 677657 - DNA, 20 bp, mouse
gcctccgggaggatcctgtc

SEQ ID NO: 677658 - DNA, 20 bp, mouse
gactggaccgcctggcaaga

SEQ ID NO: 677659 - DNA, 20 bp, mouse
gcacaagccctcttgccagg

SEQ ID NO: 677660 - DNA, 20 bp, mouse
ggaaggggctggtgtttgtg

SEQ ID NO: 677661 - DNA, 20 bp, mouse
gcaaacaccagccccttcgg

SEQ ID NO: 677662 - DNA, 20 bp, mouse
ggcccagggccttgcctgga

SEQ ID NO: 677663 - DNA, 20 bp, mouse
gtgcactgagacccagggtc

SEQ ID NO: 677664 - DNA, 20 bp, mouse
gtggctgggtaggacctagt

SEQ ID NO: 677665 - DNA, 20 bp, mouse
ggggaggatcctgtccgggg

SEQ ID NO: 677666 - DNA, 20 bp, mouse
ggcgacccggagcaccgcag

SEQ ID NO: 677667 - DNA, 20 bp, mouse
gccgccagagcacctgtaac

SEQ ID NO: 677668 - DNA, 20 bp, mouse
gtgggcaaagagcgcacttc

SEQ ID NO: 677669 - DNA, 20 bp, mouse
gacgctggagtcaggtaggg

SEQ ID NO: 677670 - DNA, 20 bp, mouse
gtccgccctctgcggtgctc

SEQ ID NO: 677671 - DNA, 20 bp, mouse
gggagcgaccgggtgaagga

SEQ ID NO: 677672 - DNA, 20 bp, mouse
gccagctgggaacccgggat

SEQ ID NO: 677673 - DNA, 20 bp, mouse
ggcaatggggttcccgttac

SEQ ID NO: 677674 - DNA, 20 bp, mouse
gtctgagagggacttcgctc

SEQ ID NO: 677675 - DNA, 20 bp, mouse
gaatgagcaggtgtaagcac

SEQ ID NO: 677676 - DNA, 20 bp, mouse
gccccctggcggctccaacg

SEQ ID NO: 677677 - DNA, 20 bp, mouse
ggtaacttgtgtggggtcag

SEQ ID NO: 677678 - DNA, 20 bp, mouse
gacagcggagccaaatgaag

SEQ ID NO: 677679 - DNA, 20 bp, mouse
ggagctgtgtaacttgtgtg

SEQ ID NO: 677680 - DNA, 20 bp, mouse
gaagaggaccatctttaagg

SEQ ID NO: 677681 - DNA, 20 bp, mouse
gcgagccgagagcggcacag

SEQ ID NO: 677682 - DNA, 20 bp, mouse
gcaacgaggcgagccgagag

SEQ ID NO: 677683 - DNA, 20 bp, mouse
gcgcctcgttggagccgcca

SEQ ID NO: 677684 - DNA, 20 bp, mouse
gcaaaagaggatgctgtata

SEQ ID NO: 677685 - DNA, 20 bp, mouse
gatgaagaggaccatcttta

SEQ ID NO: 677686 - DNA, 20 bp, mouse
gagccagtatgaccggttta

SEQ ID NO: 677687 - DNA, 20 bp, mouse
gggaccgccggggtgcatgc

SEQ ID NO: 677688 - DNA, 20 bp, mouse
ggcgtgccccgcagcgatcc

SEQ ID NO: 677689 - DNA, 20 bp, mouse
gaggcacgctgggaccgccg

SEQ ID NO: 677690 - DNA, 20 bp, mouse
ggtgcatgccgggatcgctg

SEQ ID NO: 677691 - DNA, 20 bp, mouse
gagggattttaatgcggcca

SEQ ID NO: 677692 - DNA, 20 bp, mouse
gatccctaaaccggtcatac

SEQ ID NO: 677693 - DNA, 20 bp, mouse
gaggtatgagccagtatgac

SEQ ID NO: 677694 - DNA, 20 bp, mouse
gatcccggcatgcaccccgg

SEQ ID NO: 677695 - DNA, 20 bp, mouse
gctgaaattagaccaggata

SEQ ID NO: 677696 - DNA, 20 bp, mouse
gccaacaagtccaggtcctt

SEQ ID NO: 677697 - DNA, 20 bp, mouse
gagaggtgccaggattgctg

SEQ ID NO: 677698 - DNA, 20 bp, mouse
gggggggggggggtcaaatg

SEQ ID NO: 677699 - DNA, 20 bp, mouse
gactcagatagcactgtagg

SEQ ID NO: 677700 - DNA, 20 bp, mouse
gtcaaatgaggagaggtccg

SEQ ID NO: 677701 - DNA, 20 bp, mouse
gcaaccaagtcacttcacag

SEQ ID NO: 677702 - DNA, 20 bp, mouse
gcccagctatgaacagtatc

SEQ ID NO: 677703 - DNA, 20 bp, mouse
gggctgtatgtgcttagaga

SEQ ID NO: 677704 - DNA, 20 bp, mouse
gagcatgtctgttgagaaat

SEQ ID NO: 677705 - DNA, 20 bp, mouse
ggggatggaaatcacaacgg

SEQ ID NO: 677706 - DNA, 20 bp, mouse
ggctgcgaaggggttgaccg

SEQ ID NO: 677707 - DNA, 20 bp, mouse
gacttcccggcgctgcgaag

SEQ ID NO: 677708 - DNA, 20 bp, mouse
gaaggccttcggctacttcc

SEQ ID NO: 677709 - DNA, 20 bp, mouse
gcacgatccgagcctcactg

SEQ ID NO: 677710 - DNA, 20 bp, mouse
ggacgccagctgaggagatt

SEQ ID NO: 677711 - DNA, 20 bp, mouse
gcccgcgcggtctgatcctg

SEQ ID NO: 677712 - DNA, 20 bp, mouse
gagcgccgggaagtagccga

SEQ ID NO: 677713 - DNA, 20 bp, mouse
gtcggatcgtgcctccagag

SEQ ID NO: 677714 - DNA, 20 bp, mouse
gcacccgccacagtgaggct

SEQ ID NO: 677715 - DNA, 20 bp, mouse
ggggggcggggcctgtcgag

SEQ ID NO: 677716 - DNA, 20 bp, mouse
gaatccccgccctggggcgt

SEQ ID NO: 677717 - DNA, 20 bp, mouse
gccccagggcggggattctg

SEQ ID NO: 677718 - DNA, 20 bp, mouse
ggggctgcgccacgtcccgg

SEQ ID NO: 677719 - DNA, 20 bp, mouse
gtcaagcttcccacgcccca

SEQ ID NO: 677720 - DNA, 20 bp, mouse
gggcccgcgctctatggtag

SEQ ID NO: 677721 - DNA, 20 bp, mouse
gcaactcggaagtggctcct

SEQ ID NO: 677722 - DNA, 20 bp, mouse
gtggccgagagtgtgtcgaa

SEQ ID NO: 677723 - DNA, 20 bp, mouse
gagactgcaggaagctgctc

SEQ ID NO: 677724 - DNA, 20 bp, mouse
gctcgcttcctgctggggag

SEQ ID NO: 677725 - DNA, 20 bp, mouse
gaagcgagcgtgcagagctc

SEQ ID NO: 677726 - DNA, 20 bp, mouse
gctctctgagtgctcaaata

SEQ ID NO: 677727 - DNA, 20 bp, mouse
ggagtcgcagagatctctct

SEQ ID NO: 677728 - DNA, 20 bp, mouse
gaaagagacgtgtgtctgtt

SEQ ID NO: 677729 - DNA, 20 bp, mouse
gtctgagtgctcaaataagg

SEQ ID NO: 677730 - DNA, 20 bp, mouse
gcggcagccacccatcctcg

SEQ ID NO: 677731 - DNA, 20 bp, mouse
gggagctcaatgctcccccg

SEQ ID NO: 677732 - DNA, 20 bp, mouse
ggcgccccgggaggagcagg

SEQ ID NO: 677733 - DNA, 20 bp, mouse
gtcaatgctcccccgaggat

SEQ ID NO: 677734 - DNA, 20 bp, mouse
gaatgagtagagggcgtggc

SEQ ID NO: 677735 - DNA, 20 bp, mouse
gagtctgaaactgggaaccc

SEQ ID NO: 677736 - DNA, 20 bp, mouse
gcgggcgttcgattggtcac

SEQ ID NO: 677737 - DNA, 20 bp, mouse
ggaagtctccgcctagtcct

SEQ ID NO: 677738 - DNA, 20 bp, mouse
gtcgcgcgactctccctctg

SEQ ID NO: 677739 - DNA, 20 bp, mouse
gcgcctagtcctcggaatgt

SEQ ID NO: 677740 - DNA, 20 bp, mouse
gcctctccgcccacattccg

SEQ ID NO: 677741 - DNA, 20 bp, mouse
ggagaaagggacttttgata

SEQ ID NO: 677742 - DNA, 20 bp, mouse
ggcgtcgcaatggaccaata

SEQ ID NO: 677743 - DNA, 20 bp, mouse
gctagaccctagcaccctat

SEQ ID NO: 677744 - DNA, 20 bp, mouse
gctagtcctcggaatgtggg

SEQ ID NO: 677745 - DNA, 20 bp, mouse
gtggtcactggcctggaagg

SEQ ID NO: 677746 - DNA, 20 bp, mouse
gagagcaaagtctggggtgt

SEQ ID NO: 677747 - DNA, 20 bp, mouse
gaaacagtagctgtaagtag

SEQ ID NO: 677748 - DNA, 20 bp, mouse
gagtggccgtggcaggggga

SEQ ID NO: 677749 - DNA, 20 bp, mouse
gcccagctcctgctgttgac

SEQ ID NO: 677750 - DNA, 20 bp, mouse
gcagggcgggtgattccaga

SEQ ID NO: 677751 - DNA, 20 bp, mouse
gaaacccagggtccttgggt

SEQ ID NO: 677752 - DNA, 20 bp, mouse
ggtagctgtaagtaggggag

SEQ ID NO: 677753 - DNA, 20 bp, mouse
gaggcaggaccgcggaccaa

SEQ ID NO: 677754 - DNA, 20 bp, mouse
ggccactcaccattggtccg

SEQ ID NO: 677755 - DNA, 20 bp, mouse
gtgccacggccactcaccat

SEQ ID NO: 677756 - DNA, 20 bp, mouse
gcaaagctgggagatgagta

SEQ ID NO: 677757 - DNA, 20 bp, mouse
gtgaccagggtacaagaaca

SEQ ID NO: 677758 - DNA, 20 bp, mouse
ggaggagcccgtagcttcag

SEQ ID NO: 677759 - DNA, 20 bp, mouse
gtcaaaggtcccggtgacca

SEQ ID NO: 677760 - DNA, 20 bp, mouse
gagaacaggggctgcaaagc

SEQ ID NO: 677761 - DNA, 20 bp, mouse
ggtcgagaagatatcttctg

SEQ ID NO: 677762 - DNA, 20 bp, mouse
ggtagtgggcggggcctgat

SEQ ID NO: 677763 - DNA, 20 bp, mouse
gtgagtaggggctgtagccc

SEQ ID NO: 677764 - DNA, 20 bp, mouse
gcaggctgttcaatggaagt

SEQ ID NO: 677765 - DNA, 20 bp, mouse
gcccaattaggattcaccag

SEQ ID NO: 677766 - DNA, 20 bp, mouse
gagagcagggcgctaaagaa

SEQ ID NO: 677767 - DNA, 20 bp, mouse
gaaacagtgcagcctgggga

SEQ ID NO: 677768 - DNA, 20 bp, mouse
gaaggccctgagcctggaac

SEQ ID NO: 677769 - DNA, 20 bp, mouse
ggcagctgtaggccatcccc

SEQ ID NO: 677770 - DNA, 20 bp, mouse
gcagccccaggcccagttcc

SEQ ID NO: 677771 - DNA, 20 bp, mouse
gtcttggcctggaatcaaat

SEQ ID NO: 677772 - DNA, 20 bp, mouse
gaagggcgattgcaccgcga

SEQ ID NO: 677773 - DNA, 20 bp, mouse
ggagctcagagtgggacccc

SEQ ID NO: 677774 - DNA, 20 bp, mouse
gggcctggaatcaaatggga

SEQ ID NO: 677775 - DNA, 20 bp, mouse
gtccaggctcagggccttcg

SEQ ID NO: 677776 - DNA, 20 bp, mouse
gcggatccgcgacaagatgg

SEQ ID NO: 677777 - DNA, 20 bp, mouse
ggggtgcgcgggcggttgtg

SEQ ID NO: 677778 - DNA, 20 bp, mouse
gtactcggccccgccggtcc

SEQ ID NO: 677779 - DNA, 20 bp, mouse
ggcggcggcggcacggggtg

SEQ ID NO: 677780 - DNA, 20 bp, mouse
gcggccctcggcgcccgccc

SEQ ID NO: 677781 - DNA, 20 bp, mouse
gcgcgggcgaattcattaag

SEQ ID NO: 677782 - DNA, 20 bp, mouse
ggcttcgagcgcgatctact

SEQ ID NO: 677783 - DNA, 20 bp, mouse
gtccagagcctgaacgggga

SEQ ID NO: 677784 - DNA, 20 bp, mouse
gccaggcggagcggggtgcg

SEQ ID NO: 677785 - DNA, 20 bp, mouse
gcccgcggccggacgaccgg

SEQ ID NO: 677786 - DNA, 20 bp, mouse
ggcaagcggcccaacccgag

SEQ ID NO: 677787 - DNA, 20 bp, mouse
gaggcgggcctgaatcaaga

SEQ ID NO: 677788 - DNA, 20 bp, mouse
ggccccgcccccctcgggtt

SEQ ID NO: 677789 - DNA, 20 bp, mouse
gcggcccaacccgagggggg

SEQ ID NO: 677790 - DNA, 20 bp, mouse
gcacgccgggagcctgtcat

SEQ ID NO: 677791 - DNA, 20 bp, mouse
gtcgcttagagaacacgcaa

SEQ ID NO: 677792 - DNA, 20 bp, mouse
gtgtactatggcggccgagg

SEQ ID NO: 677793 - DNA, 20 bp, mouse
gggccacaggaaaacagccc

SEQ ID NO: 677794 - DNA, 20 bp, mouse
ggccgagcggggaggtgcct

SEQ ID NO: 677795 - DNA, 20 bp, mouse
ggacggcccgcggtaaagtg

SEQ ID NO: 677796 - DNA, 20 bp, mouse
gctgaagtctggccaatcag

SEQ ID NO: 677797 - DNA, 20 bp, mouse
gccctctggtgtcacgtgac

SEQ ID NO: 677798 - DNA, 20 bp, mouse
gcacgtgacaccagaggggc

SEQ ID NO: 677799 - DNA, 20 bp, mouse
gcgggttgctggggaaaacc

SEQ ID NO: 677800 - DNA, 20 bp, mouse
ggcccggccgagcctctgat

SEQ ID NO: 677801 - DNA, 20 bp, mouse
ggcccgtcacgtgacaccag

SEQ ID NO: 677802 - DNA, 20 bp, mouse
gtcgccgcggcccacgtgag

SEQ ID NO: 677803 - DNA, 20 bp, mouse
gggaagagagggcggagcgg

SEQ ID NO: 677804 - DNA, 20 bp, mouse
gtgactcgcccccctcacgt

SEQ ID NO: 677805 - DNA, 20 bp, mouse
gccagaggggcgggttgctg

SEQ ID NO: 677806 - DNA, 20 bp, mouse
ggggtagtaccgatgagtgg

SEQ ID NO: 677807 - DNA, 20 bp, mouse
gtagtaccgatgagtggggg

SEQ ID NO: 677808 - DNA, 20 bp, mouse
ggagcgaagcgcgtttttgt

SEQ ID NO: 677809 - DNA, 20 bp, mouse
gaatctcgcgatactctggc

SEQ ID NO: 677810 - DNA, 20 bp, mouse
gcaaccccccgcacgaggcg

SEQ ID NO: 677811 - DNA, 20 bp, mouse
gaccgggtagtaccgatgag

SEQ ID NO: 677812 - DNA, 20 bp, mouse
gggccgcgccacccagacag

SEQ ID NO: 677813 - DNA, 20 bp, mouse
gtcggaatctcgcgatactc

SEQ ID NO: 677814 - DNA, 20 bp, mouse
ggagattccgagtgctttcg

SEQ ID NO: 677815 - DNA, 20 bp, mouse
gttccccccgcctcgtgcgg

SEQ ID NO: 677816 - DNA, 20 bp, mouse
gcagagatgagcaggcaaga

SEQ ID NO: 677817 - DNA, 20 bp, mouse
gctcggaggggcggaacaac

SEQ ID NO: 677818 - DNA, 20 bp, mouse
gctctgattggctttctcgg

SEQ ID NO: 677819 - DNA, 20 bp, mouse
gttgcctgctcatctctgat

SEQ ID NO: 677820 - DNA, 20 bp, mouse
gtctggaaactgggttgcac

SEQ ID NO: 677821 - DNA, 20 bp, mouse
gaagccaatcagagatgagc

SEQ ID NO: 677822 - DNA, 20 bp, mouse
gtctgtactgtactacatat

SEQ ID NO: 677823 - DNA, 20 bp, mouse
ggaggggcggaacaacgggc

SEQ ID NO: 677824 - DNA, 20 bp, mouse
gcatctctgattggctttct

SEQ ID NO: 677825 - DNA, 20 bp, mouse
gttttctagcactgtgactt

SEQ ID NO: 677826 - DNA, 20 bp, mouse
gcagcagcggcggtggacgc

SEQ ID NO: 677827 - DNA, 20 bp, mouse
gtcgcacagctgacgagcgg

SEQ ID NO: 677828 - DNA, 20 bp, mouse
ggagtcgcacagctgacgag

SEQ ID NO: 677829 - DNA, 20 bp, mouse
ggggtgggcgttcacagctc

SEQ ID NO: 677830 - DNA, 20 bp, mouse
gtgagggtctccaatcagtc

SEQ ID NO: 677831 - DNA, 20 bp, mouse
gtggactctgcgcccagcag

SEQ ID NO: 677832 - DNA, 20 bp, mouse
ggataggattcccgggttga

SEQ ID NO: 677833 - DNA, 20 bp, mouse
gtacgggagtgtaaggcaat

SEQ ID NO: 677834 - DNA, 20 bp, mouse
gcggtggacgcaggggactc

SEQ ID NO: 677835 - DNA, 20 bp, mouse
gagcagacttcgcttcttac

SEQ ID NO: 677836 - DNA, 20 bp, mouse
gggactgcggcgttgaagaa

SEQ ID NO: 677837 - DNA, 20 bp, mouse
gcctccgccccgggcgctgt

SEQ ID NO: 677838 - DNA, 20 bp, mouse
gactcggcccacagcgcccg

SEQ ID NO: 677839 - DNA, 20 bp, mouse
ggcccggagccgcttctggt

SEQ ID NO: 677840 - DNA, 20 bp, mouse
ggggttaaaggctctgttag

SEQ ID NO: 677841 - DNA, 20 bp, mouse
gtaaagggcagcggggttaa

SEQ ID NO: 677842 - DNA, 20 bp, mouse
gtacactagccaaccagaag

SEQ ID NO: 677843 - DNA, 20 bp, mouse
gtggaggcacagcctgaaac

SEQ ID NO: 677844 - DNA, 20 bp, mouse
gggaaagccggcagctgcga

SEQ ID NO: 677845 - DNA, 20 bp, mouse
gttcaacgccgcagtccgga

SEQ ID NO: 677846 - DNA, 20 bp, mouse
ggggacccgatagaagatta

SEQ ID NO: 677847 - DNA, 20 bp, mouse
gtcagcgtcccgcgagaatg

SEQ ID NO: 677848 - DNA, 20 bp, mouse
gagcgcgcggggtgaaaggt

SEQ ID NO: 677849 - DNA, 20 bp, mouse
gcccgggttgaggaactcaa

SEQ ID NO: 677850 - DNA, 20 bp, mouse
gctcgcgggacgctgacccg

SEQ ID NO: 677851 - DNA, 20 bp, mouse
ggcctgatgtggaccaattg

SEQ ID NO: 677852 - DNA, 20 bp, mouse
gcgcgcgccggccgttcccc

SEQ ID NO: 677853 - DNA, 20 bp, mouse
gcccggggccttctcattgg

SEQ ID NO: 677854 - DNA, 20 bp, mouse
gactccgccgcagttctcgg

SEQ ID NO: 677855 - DNA, 20 bp, mouse
gcggtcgccagcctgggcaa

SEQ ID NO: 677856 - DNA, 20 bp, mouse
gactaggaagagctaagggg

SEQ ID NO: 677857 - DNA, 20 bp, mouse
gtacactccagacctaacgg

SEQ ID NO: 677858 - DNA, 20 bp, mouse
gggacggggcgtattggagg

SEQ ID NO: 677859 - DNA, 20 bp, mouse
gagcgcctagcacgcgcctc

SEQ ID NO: 677860 - DNA, 20 bp, mouse
gggaggaggacgccttgttg

SEQ ID NO: 677861 - DNA, 20 bp, mouse
gtgaagccggggaactcggc

SEQ ID NO: 677862 - DNA, 20 bp, mouse
gtctaccgagaaggcaggct

SEQ ID NO: 677863 - DNA, 20 bp, mouse
ggggcggagccttggggacg

SEQ ID NO: 677864 - DNA, 20 bp, mouse
gtggggacggggcgtattgg

SEQ ID NO: 677865 - DNA, 20 bp, mouse
ggatgactaggaagagctaa

SEQ ID NO: 677866 - DNA, 20 bp, mouse
gaagctagatcatttaccag

SEQ ID NO: 677867 - DNA, 20 bp, mouse
gaattcgatctaagctagcc

SEQ ID NO: 677868 - DNA, 20 bp, mouse
gtagatcatttaccagtggg

SEQ ID NO: 677869 - DNA, 20 bp, mouse
gtgaaatatatagaccaggg

SEQ ID NO: 677870 - DNA, 20 bp, mouse
gttaaagacagtcgtttgag

SEQ ID NO: 677871 - DNA, 20 bp, mouse
ggatctgaaatatatagacc

SEQ ID NO: 677872 - DNA, 20 bp, mouse
gcccctggagctggcgtagc

SEQ ID NO: 677873 - DNA, 20 bp, mouse
gtatatatttcagatcaccc

SEQ ID NO: 677874 - DNA, 20 bp, mouse
gtcatttcagcctttaattc

SEQ ID NO: 677875 - DNA, 20 bp, mouse
gaagctagccagggctgtat

SEQ ID NO: 677876 - DNA, 20 bp, mouse
ggggccctgccaaggagcga

SEQ ID NO: 677877 - DNA, 20 bp, mouse
gaacgagcccgaaaatggaa

SEQ ID NO: 677878 - DNA, 20 bp, mouse
ggggctcgttgacgtcacca

SEQ ID NO: 677879 - DNA, 20 bp, mouse
gacgtcaacgagcccgaaaa

SEQ ID NO: 677880 - DNA, 20 bp, mouse
ggctgcgtgctttctgaaga

SEQ ID NO: 677881 - DNA, 20 bp, mouse
gctgacagaagagttaggtg

SEQ ID NO: 677882 - DNA, 20 bp, mouse
gtactatgataggccagata

SEQ ID NO: 677883 - DNA, 20 bp, mouse
gaaggtagttaccattaaag

SEQ ID NO: 677884 - DNA, 20 bp, mouse
gacaacctgacagaagagtt

SEQ ID NO: 677885 - DNA, 20 bp, mouse
gtgtccctcgctccttggca

SEQ ID NO: 677886 - DNA, 20 bp, mouse
gggccatgctgaaatatttg

SEQ ID NO: 677887 - DNA, 20 bp, mouse
gttatagagcagtagagggg

SEQ ID NO: 677888 - DNA, 20 bp, mouse
gtaagctcagatcagttaag

SEQ ID NO: 677889 - DNA, 20 bp, mouse
gtcagtgtgggcgaaggtgt

SEQ ID NO: 677890 - DNA, 20 bp, mouse
gaaaatgcgtggcaatgacg

SEQ ID NO: 677891 - DNA, 20 bp, mouse
gtgagagctcaaagcagcga

SEQ ID NO: 677892 - DNA, 20 bp, mouse
ggagctctcagtgtgggcga

SEQ ID NO: 677893 - DNA, 20 bp, mouse
gacgcatagccgaaagaatg

SEQ ID NO: 677894 - DNA, 20 bp, mouse
ggccacgcattttgtcaccg

SEQ ID NO: 677895 - DNA, 20 bp, mouse
gtcactcttgatgaataatg

SEQ ID NO: 677896 - DNA, 20 bp, mouse
gggagcctgcagccagcgga

SEQ ID NO: 677897 - DNA, 20 bp, mouse
gggatcccggggtacttgtg

SEQ ID NO: 677898 - DNA, 20 bp, mouse
gccagcggaggggcgaggag

SEQ ID NO: 677899 - DNA, 20 bp, mouse
gagaggcaggcggaccgtgg

SEQ ID NO: 677900 - DNA, 20 bp, mouse
gtcagcacggccagggtgcg

SEQ ID NO: 677901 - DNA, 20 bp, mouse
gactgccgcaagccggggtg

SEQ ID NO: 677902 - DNA, 20 bp, mouse
gccactgcccaaccccggcc

SEQ ID NO: 677903 - DNA, 20 bp, mouse
gagggggttcagcacggcca

SEQ ID NO: 677904 - DNA, 20 bp, mouse
gcggccagggtgcggggatc

SEQ ID NO: 677905 - DNA, 20 bp, mouse
gtcggtccactgcccaaccc

SEQ ID NO: 677906 - DNA, 20 bp, mouse
gagggcccgaggattcatgg

SEQ ID NO: 677907 - DNA, 20 bp, mouse
gcccgaggattcatgggggt

SEQ ID NO: 677908 - DNA, 20 bp, mouse
gcagccccagcaatactggt

SEQ ID NO: 677909 - DNA, 20 bp, mouse
gcttcccaccagtattgctg

SEQ ID NO: 677910 - DNA, 20 bp, mouse
gtgggattgctcaaacaagt

SEQ ID NO: 677911 - DNA, 20 bp, mouse
gggaactggagtttgtcccc

SEQ ID NO: 677912 - DNA, 20 bp, mouse
ggctacagccccagcaatac

SEQ ID NO: 677913 - DNA, 20 bp, mouse
gtggtgtagctcacatgggg

SEQ ID NO: 677914 - DNA, 20 bp, mouse
gatgaatcctcgggccctcc

SEQ ID NO: 677915 - DNA, 20 bp, mouse
ggagcagggcttagtgtgta

SEQ ID NO: 677916 - DNA, 20 bp, mouse
ggggccggggcagccccgga

SEQ ID NO: 677917 - DNA, 20 bp, mouse
gggccggccggcccgagggt

SEQ ID NO: 677918 - DNA, 20 bp, mouse
gtaggctgcagcaacagctc

SEQ ID NO: 677919 - DNA, 20 bp, mouse
gccgcagcccggcaccgagt

SEQ ID NO: 677920 - DNA, 20 bp, mouse
gggggggaatgaggtaggat

SEQ ID NO: 677921 - DNA, 20 bp, mouse
gcggggccgggccccgagcc

SEQ ID NO: 677922 - DNA, 20 bp, mouse
ggccctgctgccgatcatcc

SEQ ID NO: 677923 - DNA, 20 bp, mouse
gggccccgagcccggatgat

SEQ ID NO: 677924 - DNA, 20 bp, mouse
gcgccggcaccgggccacga

SEQ ID NO: 677925 - DNA, 20 bp, mouse
gagccctcgtggcccggtgc

SEQ ID NO: 677926 - DNA, 20 bp, mouse
gcaggggtgcggagtcttcc

SEQ ID NO: 677927 - DNA, 20 bp, mouse
ggctgggcttagagggtccc

SEQ ID NO: 677928 - DNA, 20 bp, mouse
gaacgctgatccaggccgac

SEQ ID NO: 677929 - DNA, 20 bp, mouse
gggtccaagtcccggactga

SEQ ID NO: 677930 - DNA, 20 bp, mouse
gctggccaagggccatgcag

SEQ ID NO: 677931 - DNA, 20 bp, mouse
gggccagtttatcttgccgg

SEQ ID NO: 677932 - DNA, 20 bp, mouse
gcccctgggaacgctgatcc

SEQ ID NO: 677933 - DNA, 20 bp, mouse
gcaagtctccggtcttgaat

SEQ ID NO: 677934 - DNA, 20 bp, mouse
gaagactccgcacccctgca

SEQ ID NO: 677935 - DNA, 20 bp, mouse
gcaggccgactggccaagaa

SEQ ID NO: 677936 - DNA, 20 bp, mouse
ggcacctgccagggtcggaa

SEQ ID NO: 677937 - DNA, 20 bp, mouse
gtggacgccacctcactccg

SEQ ID NO: 677938 - DNA, 20 bp, mouse
ggccccgtcagagcctgctc

SEQ ID NO: 677939 - DNA, 20 bp, mouse
ggggcccttccgaccctggc

SEQ ID NO: 677940 - DNA, 20 bp, mouse
gggcgccgcggtcctgtctg

SEQ ID NO: 677941 - DNA, 20 bp, mouse
gcaggcggggcgcacctgcc

SEQ ID NO: 677942 - DNA, 20 bp, mouse
gccacctcactccggggtag

SEQ ID NO: 677943 - DNA, 20 bp, mouse
gcgccccctaccccggagtg

SEQ ID NO: 677944 - DNA, 20 bp, mouse
gacctcgagacctaaagctg

SEQ ID NO: 677945 - DNA, 20 bp, mouse
gaatcctcgggcgatccctg

SEQ ID NO: 677946 - DNA, 20 bp, mouse
ggggctcaaagctgaatagt

SEQ ID NO: 677947 - DNA, 20 bp, mouse
ggaggggcggggcatatcag

SEQ ID NO: 677948 - DNA, 20 bp, mouse
gcaaagctgaatagtgggca

SEQ ID NO: 677949 - DNA, 20 bp, mouse
gacacacaaacttagaactg

SEQ ID NO: 677950 - DNA, 20 bp, mouse
gcggaagcaagggaatgtga

SEQ ID NO: 677951 - DNA, 20 bp, mouse
gcaaagtgggatacagactt

SEQ ID NO: 677952 - DNA, 20 bp, mouse
gggaggagggccggaagcaa

SEQ ID NO: 677953 - DNA, 20 bp, mouse
gctgagttcaatggcctctc

SEQ ID NO: 677954 - DNA, 20 bp, mouse
gttccggccctcctccacta

SEQ ID NO: 677955 - DNA, 20 bp, mouse
ggtcagtgagaagcaagaaa

SEQ ID NO: 677956 - DNA, 20 bp, mouse
gccgcccgccgaagggaagg

SEQ ID NO: 677957 - DNA, 20 bp, mouse
gataaacgcgagctgatggg

SEQ ID NO: 677958 - DNA, 20 bp, mouse
gtcccaccctcaggtgctac

SEQ ID NO: 677959 - DNA, 20 bp, mouse
ggggataaacgcgagctgat

SEQ ID NO: 677960 - DNA, 20 bp, mouse
gctcccgcccgccgaaggga

SEQ ID NO: 677961 - DNA, 20 bp, mouse
gcccgtacctagaaagtcgc

SEQ ID NO: 677962 - DNA, 20 bp, mouse
gggcgcagaccagaaagcga

SEQ ID NO: 677963 - DNA, 20 bp, mouse
gctggcatggcccctggcgc

SEQ ID NO: 677964 - DNA, 20 bp, mouse
ggtgtcccccttcccttcgg

SEQ ID NO: 677965 - DNA, 20 bp, mouse
ggggctgagagtccggaagc

SEQ ID NO: 677966 - DNA, 20 bp, mouse
gacaaatcctgtgtcatacc

SEQ ID NO: 677967 - DNA, 20 bp, mouse
ggcttgtaactgcaggggat

SEQ ID NO: 677968 - DNA, 20 bp, mouse
gtcttttaaaggggctacaa

SEQ ID NO: 677969 - DNA, 20 bp, mouse
gaggggctacaaaggtgact

SEQ ID NO: 677970 - DNA, 20 bp, mouse
gacaatctgcttgtgcaagc

SEQ ID NO: 677971 - DNA, 20 bp, mouse
gtctaattgcttttgagtaa

SEQ ID NO: 677972 - DNA, 20 bp, mouse
gtgtttcttctagctatgta

SEQ ID NO: 677973 - DNA, 20 bp, mouse
gagtctacactcattcttaa

SEQ ID NO: 677974 - DNA, 20 bp, mouse
gttaaaaattgtgcatgtat

SEQ ID NO: 677975 - DNA, 20 bp, mouse
gaagtttttgaagcatttaa

SEQ ID NO: 677976 - DNA, 20 bp, mouse
ggcctccagccgccacgtgg

SEQ ID NO: 677977 - DNA, 20 bp, mouse
gtgacaccgcccccacgtgg

SEQ ID NO: 677978 - DNA, 20 bp, mouse
gctctcagtcaccgctgtgt

SEQ ID NO: 677979 - DNA, 20 bp, mouse
gaccgctgtgtaggatgcca

SEQ ID NO: 677980 - DNA, 20 bp, mouse
gtataaaagaagttctcccg

SEQ ID NO: 677981 - DNA, 20 bp, mouse
gacgtgggggcggtgtcacg

SEQ ID NO: 677982 - DNA, 20 bp, mouse
gcttctctatccacgtccct

SEQ ID NO: 677983 - DNA, 20 bp, mouse
gtgttttcgccatttgtgag

SEQ ID NO: 677984 - DNA, 20 bp, mouse
gtcgttgctcaccgagggga

SEQ ID NO: 677985 - DNA, 20 bp, mouse
gaccgcctccagccgccacg

SEQ ID NO: 677986 - DNA, 20 bp, mouse
gtgagcataactttactcaa

SEQ ID NO: 677987 - DNA, 20 bp, mouse
ggggggctacaaagataact

SEQ ID NO: 677988 - DNA, 20 bp, mouse
gaagtttttgaagcatttcc

SEQ ID NO: 677989 - DNA, 20 bp, mouse
gatttcacactcattcctaa

SEQ ID NO: 677990 - DNA, 20 bp, mouse
gtcaaatcctgtgtcatact

SEQ ID NO: 677991 - DNA, 20 bp, mouse
gtaacactaattgtcccttt

SEQ ID NO: 677992 - DNA, 20 bp, mouse
ggattttttttcttttaagg

SEQ ID NO: 677993 - DNA, 20 bp, mouse
ggaggattttttttctttta

SEQ ID NO: 677994 - DNA, 20 bp, mouse
gatgtatgtatatatttgcc

SEQ ID NO: 677995 - DNA, 20 bp, mouse
gtgcttatgcaaactggtct

SEQ ID NO: 677996 - DNA, 20 bp, mouse
gaatggaggccagatgtcga

SEQ ID NO: 677997 - DNA, 20 bp, mouse
ggaactgcttcagcagatca

SEQ ID NO: 677998 - DNA, 20 bp, mouse
gaacgctgataaagttgtct

SEQ ID NO: 677999 - DNA, 20 bp, mouse
gcaatgaggcaattagtaca

SEQ ID NO: 678000 - DNA, 20 bp, mouse
gtcctgaaagtctcaatagt

SEQ ID NO: 678001 - DNA, 20 bp, mouse
gaaagtctcaatagtgggaa

SEQ ID NO: 678002 - DNA, 20 bp, mouse
gaactgtaaaacttagctgc

SEQ ID NO: 678003 - DNA, 20 bp, mouse
ggatgtcgagggtcaatgta

SEQ ID NO: 678004 - DNA, 20 bp, mouse
gatgaggtgaggagcaatta

SEQ ID NO: 678005 - DNA, 20 bp, mouse
gaaggaggatatgctcaatg

SEQ ID NO: 678006 - DNA, 20 bp, mouse
gacggcaaggtctggaccct

SEQ ID NO: 678007 - DNA, 20 bp, mouse
ggcacgcccacaaaagatcc

SEQ ID NO: 678008 - DNA, 20 bp, mouse
gtgccgtcctccactcacaa

SEQ ID NO: 678009 - DNA, 20 bp, mouse
ggctgcaagtcgactcccac

SEQ ID NO: 678010 - DNA, 20 bp, mouse
gccatcagagagaatcttag

SEQ ID NO: 678011 - DNA, 20 bp, mouse
ggagctagccccagaacttg

SEQ ID NO: 678012 - DNA, 20 bp, mouse
gttgaggtgaggactctcaa

SEQ ID NO: 678013 - DNA, 20 bp, mouse
gccacccagttctggcctgt

SEQ ID NO: 678014 - DNA, 20 bp, mouse
ggtcaggaaacatgcggtgt

SEQ ID NO: 678015 - DNA, 20 bp, mouse
gcccagaacttgaggtaagt

SEQ ID NO: 678016 - DNA, 20 bp, mouse
gtccacaggcagcgctgatt

SEQ ID NO: 678017 - DNA, 20 bp, mouse
gggcacccccagacagtccg

SEQ ID NO: 678018 - DNA, 20 bp, mouse
ggggtggggtccacaggcca

SEQ ID NO: 678019 - DNA, 20 bp, mouse
gggccccgcctcctgttttc

SEQ ID NO: 678020 - DNA, 20 bp, mouse
gcccgcctcctgttttcggg

SEQ ID NO: 678021 - DNA, 20 bp, mouse
gcaaactaggaggatctcgg

SEQ ID NO: 678022 - DNA, 20 bp, mouse
gcgggagggtggaggcactg

SEQ ID NO: 678023 - DNA, 20 bp, mouse
gcctccaccctcccgaaaac

SEQ ID NO: 678024 - DNA, 20 bp, mouse
gcgctgcctgtggacttggg

SEQ ID NO: 678025 - DNA, 20 bp, mouse
gccacgccccccaagtccac

SEQ ID NO: 678026 - DNA, 20 bp, mouse
gaaatcccgggaatgaagtg

SEQ ID NO: 678027 - DNA, 20 bp, mouse
gtcacccaggcgtctgtaac

SEQ ID NO: 678028 - DNA, 20 bp, mouse
gtgggtgagcagcagacagc

SEQ ID NO: 678029 - DNA, 20 bp, mouse
gcatcccgttacagacgcct

SEQ ID NO: 678030 - DNA, 20 bp, mouse
gtggggagttggagtgacgg

SEQ ID NO: 678031 - DNA, 20 bp, mouse
ggagggccagcacctagatg

SEQ ID NO: 678032 - DNA, 20 bp, mouse
gatgtggggagttggagtga

SEQ ID NO: 678033 - DNA, 20 bp, mouse
ggatctcagtgatccaggct

SEQ ID NO: 678034 - DNA, 20 bp, mouse
gcagtgatccaggctgggca

SEQ ID NO: 678035 - DNA, 20 bp, mouse
gagcagcagacagcgggcgg

SEQ ID NO: 678036 - DNA, 20 bp, mouse
gccaaccgcggaggatgggg

SEQ ID NO: 678037 - DNA, 20 bp, mouse
gagtgcgcatgcggcgtcct

SEQ ID NO: 678038 - DNA, 20 bp, mouse
ggacgcccgccattgggaga

SEQ ID NO: 678039 - DNA, 20 bp, mouse
gaggcggagtctaggtctaa

SEQ ID NO: 678040 - DNA, 20 bp, mouse
ggaccccaaccgcggaggat

SEQ ID NO: 678041 - DNA, 20 bp, mouse
ggggcctggcggcgacgccc

SEQ ID NO: 678042 - DNA, 20 bp, mouse
ggggaccgacgcccgccatt

SEQ ID NO: 678043 - DNA, 20 bp, mouse
gcgtcctgggcgtcgccgcc

SEQ ID NO: 678044 - DNA, 20 bp, mouse
gaagggaaacggagtccttg

SEQ ID NO: 678045 - DNA, 20 bp, mouse
ggacgccgcatgcgcactga

SEQ ID NO: 678046 - DNA, 20 bp, mouse
ggaagggcctccgcggtgga

SEQ ID NO: 678047 - DNA, 20 bp, mouse
ggcgcgggctcccgcgttcc

SEQ ID NO: 678048 - DNA, 20 bp, mouse
gcccagtgacgtcaaaggaa

SEQ ID NO: 678049 - DNA, 20 bp, mouse
gtcactgggcgctgccaatc

SEQ ID NO: 678050 - DNA, 20 bp, mouse
gcgcgcgagtggctcacgct

SEQ ID NO: 678051 - DNA, 20 bp, mouse
ggctgctttgcggtccagga

SEQ ID NO: 678052 - DNA, 20 bp, mouse
gaatcaggagtgcgttcgcg

SEQ ID NO: 678053 - DNA, 20 bp, mouse
ggctcccgcgttccgggagg

SEQ ID NO: 678054 - DNA, 20 bp, mouse
gcagcgcccagtgacgtcaa

SEQ ID NO: 678055 - DNA, 20 bp, mouse
gaaaggaagggcctccgcgg

SEQ ID NO: 678056 - DNA, 20 bp, mouse
gaggatgggacgttcaggag

SEQ ID NO: 678057 - DNA, 20 bp, mouse
ggggctggtggggaaagagt

SEQ ID NO: 678058 - DNA, 20 bp, mouse
gccagagagggaggtcccac

SEQ ID NO: 678059 - DNA, 20 bp, mouse
ggtacaggatcccagatgag

SEQ ID NO: 678060 - DNA, 20 bp, mouse
ggggcttcgcgcaggaggat

SEQ ID NO: 678061 - DNA, 20 bp, mouse
ggggggggggggttgatcgt

SEQ ID NO: 678062 - DNA, 20 bp, mouse
gggcggtgggaaggccggtg

SEQ ID NO: 678063 - DNA, 20 bp, mouse
gttcaggagtggtaactggg

SEQ ID NO: 678064 - DNA, 20 bp, mouse
gcggggcgcgcggtgcccgc

SEQ ID NO: 678065 - DNA, 20 bp, mouse
ggtgcccgcgggcggtggga

SEQ ID NO: 678066 - DNA, 20 bp, mouse
ggccgcgaggggcgtggtcg

SEQ ID NO: 678067 - DNA, 20 bp, mouse
ggggcagattagatgggcgg

SEQ ID NO: 678068 - DNA, 20 bp, mouse
gggcgtggtcggggcgcacg

SEQ ID NO: 678069 - DNA, 20 bp, mouse
gggcggggacaggccgcgag

SEQ ID NO: 678070 - DNA, 20 bp, mouse
gcacccggatagggggaagc

SEQ ID NO: 678071 - DNA, 20 bp, mouse
gagagccgggcagattagat

SEQ ID NO: 678072 - DNA, 20 bp, mouse
gggcggggccttggaggttt

SEQ ID NO: 678073 - DNA, 20 bp, mouse
ggcggggccacggcaataaa

SEQ ID NO: 678074 - DNA, 20 bp, mouse
gtgcggcgactcaccgacat

SEQ ID NO: 678075 - DNA, 20 bp, mouse
gccctatccgggtgattgat

SEQ ID NO: 678076 - DNA, 20 bp, mouse
ggggcggggcgtgaaggaca

SEQ ID NO: 678077 - DNA, 20 bp, mouse
gcccgcctggacacttcctc

SEQ ID NO: 678078 - DNA, 20 bp, mouse
ggcagcaaagaggccggagg

SEQ ID NO: 678079 - DNA, 20 bp, mouse
ggggcgtgaaggacagggca

SEQ ID NO: 678080 - DNA, 20 bp, mouse
gggggggacacaggcactaa

SEQ ID NO: 678081 - DNA, 20 bp, mouse
gcccgagcggcctcgcgcag

SEQ ID NO: 678082 - DNA, 20 bp, mouse
gtgacagacgccggggggtg

SEQ ID NO: 678083 - DNA, 20 bp, mouse
gtcccgcgagcgaccccgag

SEQ ID NO: 678084 - DNA, 20 bp, mouse
gaggaagtggagggacacag

SEQ ID NO: 678085 - DNA, 20 bp, mouse
gtcctgaggaagtgtccagg

SEQ ID NO: 678086 - DNA, 20 bp, mouse
gctaagaagaatgacaggta

SEQ ID NO: 678087 - DNA, 20 bp, mouse
gcggcgagcacgaacagcta

SEQ ID NO: 678088 - DNA, 20 bp, mouse
gcaggcaggcctgatataag

SEQ ID NO: 678089 - DNA, 20 bp, mouse
gggggcgccggtgagcagag

SEQ ID NO: 678090 - DNA, 20 bp, mouse
gacgaacagctaaggcccgc

SEQ ID NO: 678091 - DNA, 20 bp, mouse
gcagctaaggcccgcaggtt

SEQ ID NO: 678092 - DNA, 20 bp, mouse
ggggccacttggcatcaggc

SEQ ID NO: 678093 - DNA, 20 bp, mouse
ggcaggctaagaagaatgac

SEQ ID NO: 678094 - DNA, 20 bp, mouse
gtagagccgctagtgcctgc

SEQ ID NO: 678095 - DNA, 20 bp, mouse
gacccagccgctctgctcac

SEQ ID NO: 678096 - DNA, 20 bp, mouse
gcggagtaggggaatcggaa

SEQ ID NO: 678097 - DNA, 20 bp, mouse
gttaagcgagggcgcggggc

SEQ ID NO: 678098 - DNA, 20 bp, mouse
ggggcctcgctcacgccact

SEQ ID NO: 678099 - DNA, 20 bp, mouse
ggagccgaaaggggcgaatc

SEQ ID NO: 678100 - DNA, 20 bp, mouse
gaggtgaaggccctggggat

SEQ ID NO: 678101 - DNA, 20 bp, mouse
gccggtggcggcagcagaac

SEQ ID NO: 678102 - DNA, 20 bp, mouse
ggacacgggggcaaaagctg

SEQ ID NO: 678103 - DNA, 20 bp, mouse
gccggcttaagcgagggcgc

SEQ ID NO: 678104 - DNA, 20 bp, mouse
gcaaaagcatattctcctag

SEQ ID NO: 678105 - DNA, 20 bp, mouse
ggaaccggattcgccccttt

SEQ ID NO: 678106 - DNA, 20 bp, mouse
gggagagccgggtgcgtgga

SEQ ID NO: 678107 - DNA, 20 bp, mouse
gccgcccgccctccgcgctg

SEQ ID NO: 678108 - DNA, 20 bp, mouse
gcgccctgcgctccttctag

SEQ ID NO: 678109 - DNA, 20 bp, mouse
gaccgtggaggcggggacag

SEQ ID NO: 678110 - DNA, 20 bp, mouse
gacaaaggaccgtggaggcg

SEQ ID NO: 678111 - DNA, 20 bp, mouse
ggcagtagccgcagcgcgga

SEQ ID NO: 678112 - DNA, 20 bp, mouse
ggggtgcgtggagggcactg

SEQ ID NO: 678113 - DNA, 20 bp, mouse
gccggggcgtggcccgcgag

SEQ ID NO: 678114 - DNA, 20 bp, mouse
gcgcgggcagagacggggtg

SEQ ID NO: 678115 - DNA, 20 bp, mouse
gcagctacaaaggaccgtgg

SEQ ID NO: 678116 - DNA, 20 bp, mouse
ggctgcgccgcagggatata

SEQ ID NO: 678117 - DNA, 20 bp, mouse
ggctgcgggtgaggtgggta

SEQ ID NO: 678118 - DNA, 20 bp, mouse
gtatagggctctggcggcga

SEQ ID NO: 678119 - DNA, 20 bp, mouse
gccagaatgcaccgctgccc

SEQ ID NO: 678120 - DNA, 20 bp, mouse
gccgcagggatatagggctc

SEQ ID NO: 678121 - DNA, 20 bp, mouse
gtggcggcgagggctcatcc

SEQ ID NO: 678122 - DNA, 20 bp, mouse
gctggagctgcgggtgaggt

SEQ ID NO: 678123 - DNA, 20 bp, mouse
gcagggatatagggctctgg

SEQ ID NO: 678124 - DNA, 20 bp, mouse
gttcaggtgtagaaactccg

SEQ ID NO: 678125 - DNA, 20 bp, mouse
ggaaaccctgcaagcagcct

SEQ ID NO: 678126 - DNA, 20 bp, mouse
ggagcccagctcattagaaa

SEQ ID NO: 678127 - DNA, 20 bp, mouse
ggggtctcctagtcataagg

SEQ ID NO: 678128 - DNA, 20 bp, mouse
gaaagcagtcttgggtcaga

SEQ ID NO: 678129 - DNA, 20 bp, mouse
gagaaagggcttgtaattag

SEQ ID NO: 678130 - DNA, 20 bp, mouse
gagcaggcttgattcatcca

SEQ ID NO: 678131 - DNA, 20 bp, mouse
gaaggtgaactgaagaaaaa

SEQ ID NO: 678132 - DNA, 20 bp, mouse
gaaggggtctcctagtcata

SEQ ID NO: 678133 - DNA, 20 bp, mouse
gatgtctccaccctacaagc

SEQ ID NO: 678134 - DNA, 20 bp, mouse
gtgcacaggcctgagatccc

SEQ ID NO: 678135 - DNA, 20 bp, mouse
gagctccaaatgtggtagaa

SEQ ID NO: 678136 - DNA, 20 bp, mouse
ggcttaggagacgactccaa

SEQ ID NO: 678137 - DNA, 20 bp, mouse
gccgcggaggcctttctctt

SEQ ID NO: 678138 - DNA, 20 bp, mouse
ggggtggaaaaggcagtact

SEQ ID NO: 678139 - DNA, 20 bp, mouse
gcctccgcggcgcagggttg

SEQ ID NO: 678140 - DNA, 20 bp, mouse
ggcgaagcaaagcgcccgcg

SEQ ID NO: 678141 - DNA, 20 bp, mouse
gacgggcgagagcgggaccg

SEQ ID NO: 678142 - DNA, 20 bp, mouse
ggcgtggcaacgtagaaggc

SEQ ID NO: 678143 - DNA, 20 bp, mouse
gcgactccaacgggcgagag

SEQ ID NO: 678144 - DNA, 20 bp, mouse
gggaaaaggcagtactgggc

SEQ ID NO: 678145 - DNA, 20 bp, mouse
ggcctcctgctggagaaaag

SEQ ID NO: 678146 - DNA, 20 bp, mouse
gagtgcccacagactgggga

SEQ ID NO: 678147 - DNA, 20 bp, mouse
ggaagagcagcaggaatcag

SEQ ID NO: 678148 - DNA, 20 bp, mouse
ggaggagaccatgaatggta

SEQ ID NO: 678149 - DNA, 20 bp, mouse
ggcccagacagcactcaggg

SEQ ID NO: 678150 - DNA, 20 bp, mouse
gcccctgcgtagtcacgtgg

SEQ ID NO: 678151 - DNA, 20 bp, mouse
gctagcagcaggctgtaaat

SEQ ID NO: 678152 - DNA, 20 bp, mouse
ggaagatgctctgtgagcta

SEQ ID NO: 678153 - DNA, 20 bp, mouse
gtcgggcagccgggcttgta

SEQ ID NO: 678154 - DNA, 20 bp, mouse
gcggaacgggcgagctcacg

SEQ ID NO: 678155 - DNA, 20 bp, mouse
gtgcccccacgtgactacgc

SEQ ID NO: 678156 - DNA, 20 bp, mouse
gtggaaggggtgggctgtcg

SEQ ID NO: 678157 - DNA, 20 bp, mouse
gaccccgcgctggaaggggt

SEQ ID NO: 678158 - DNA, 20 bp, mouse
gccgcccccgccgggttctc

SEQ ID NO: 678159 - DNA, 20 bp, mouse
gcggaaggaagctgctgtag

SEQ ID NO: 678160 - DNA, 20 bp, mouse
gcctgtgcgcgtcggggaac

SEQ ID NO: 678161 - DNA, 20 bp, mouse
gtgggtagatctctggacgg

SEQ ID NO: 678162 - DNA, 20 bp, mouse
gttcccggggtctgcagcct

SEQ ID NO: 678163 - DNA, 20 bp, mouse
gcgggctctggtggcgtcct

SEQ ID NO: 678164 - DNA, 20 bp, mouse
gagagcccgagaacccggcg

SEQ ID NO: 678165 - DNA, 20 bp, mouse
ggtcccaccccgcgctggaa

SEQ ID NO: 678166 - DNA, 20 bp, mouse
gacagaagctggtgattcag

SEQ ID NO: 678167 - DNA, 20 bp, mouse
gataactatagcagatggag

SEQ ID NO: 678168 - DNA, 20 bp, mouse
gggggtaaacgtcagaccac

SEQ ID NO: 678169 - DNA, 20 bp, mouse
gctaggccaagtggagcctt

SEQ ID NO: 678170 - DNA, 20 bp, mouse
gtagaacagagaaatcaatg

SEQ ID NO: 678171 - DNA, 20 bp, mouse
gaagctgctcttttccatat

SEQ ID NO: 678172 - DNA, 20 bp, mouse
gtcagtagagctaggccaag

SEQ ID NO: 678173 - DNA, 20 bp, mouse
ggtctgacgtttaccccaag

SEQ ID NO: 678174 - DNA, 20 bp, mouse
gtgctatagttataaatctg

SEQ ID NO: 678175 - DNA, 20 bp, mouse
gagcttcccaaggctccact

SEQ ID NO: 678176 - DNA, 20 bp, mouse
gggagcccgaggagccgggt

SEQ ID NO: 678177 - DNA, 20 bp, mouse
gccggctcctaaatcagcgc

SEQ ID NO: 678178 - DNA, 20 bp, mouse
ggggcgcggcagagcacggg

SEQ ID NO: 678179 - DNA, 20 bp, mouse
ggcgcggcgggcattggggt

SEQ ID NO: 678180 - DNA, 20 bp, mouse
ggagccggggcccaagcttg

SEQ ID NO: 678181 - DNA, 20 bp, mouse
gggcctggcgagtggggaga

SEQ ID NO: 678182 - DNA, 20 bp, mouse
gcgggcattggggtgggcgg

SEQ ID NO: 678183 - DNA, 20 bp, mouse
gaggccccgctgcctcctga

SEQ ID NO: 678184 - DNA, 20 bp, mouse
ggccgcgccgcgtaaccttc

SEQ ID NO: 678185 - DNA, 20 bp, mouse
gcggtccccagcgtccctca

SEQ ID NO: 678186 - DNA, 20 bp, mouse
gcctcctggtggaacatctt

SEQ ID NO: 678187 - DNA, 20 bp, mouse
gggggcagctaactaaaagg

SEQ ID NO: 678188 - DNA, 20 bp, mouse
gcccctaaaacacctcctgg

SEQ ID NO: 678189 - DNA, 20 bp, mouse
gacacctctccacaatggat

SEQ ID NO: 678190 - DNA, 20 bp, mouse
gtccaccaggaggtgtttta

SEQ ID NO: 678191 - DNA, 20 bp, mouse
gcgttcacacctctccacaa

SEQ ID NO: 678192 - DNA, 20 bp, mouse
ggaacatcttggggaaccac

SEQ ID NO: 678193 - DNA, 20 bp, mouse
gtgatgacatgagattctgg

SEQ ID NO: 678194 - DNA, 20 bp, mouse
gacaggtgtcctatccattg

SEQ ID NO: 678195 - DNA, 20 bp, mouse
gttccccaagatgttccacc

SEQ ID NO: 678196 - DNA, 20 bp, mouse
ggctggggcctctatgtgta

SEQ ID NO: 678197 - DNA, 20 bp, mouse
gtggctggagcacagcatgc

SEQ ID NO: 678198 - DNA, 20 bp, mouse
gaatctacgaccagaaaaat

SEQ ID NO: 678199 - DNA, 20 bp, mouse
gaggcagtagctctgagatt

SEQ ID NO: 678200 - DNA, 20 bp, mouse
ggcgcatttcctatggaaat

SEQ ID NO: 678201 - DNA, 20 bp, mouse
ggaaaaatgggccaatgata

SEQ ID NO: 678202 - DNA, 20 bp, mouse
gtatggaagcgcatttccta

SEQ ID NO: 678203 - DNA, 20 bp, mouse
gaaatgcgcttccatatcat

SEQ ID NO: 678204 - DNA, 20 bp, mouse
gtggcagatgggcaagcagc

SEQ ID NO: 678205 - DNA, 20 bp, mouse
ggaaaatatccatatgcaga

SEQ ID NO: 678206 - DNA, 20 bp, mouse
gctcgccgggggaccgagat

SEQ ID NO: 678207 - DNA, 20 bp, mouse
gatgtggtgaaccagaaatt

SEQ ID NO: 678208 - DNA, 20 bp, mouse
gccggcagacctcctcgccg

SEQ ID NO: 678209 - DNA, 20 bp, mouse
gcacgcccatctcggtcccc

SEQ ID NO: 678210 - DNA, 20 bp, mouse
gggccgtggcccgccccgtc

SEQ ID NO: 678211 - DNA, 20 bp, mouse
gtggaactcccatctttgac

SEQ ID NO: 678212 - DNA, 20 bp, mouse
gggaccgagatgggcgtgcc

SEQ ID NO: 678213 - DNA, 20 bp, mouse
gagttccacgcaccgcaggc

SEQ ID NO: 678214 - DNA, 20 bp, mouse
gtgggagttccacgcaccgc

SEQ ID NO: 678215 - DNA, 20 bp, mouse
ggaactatagtgggagttta

SEQ ID NO: 678216 - DNA, 20 bp, mouse
gcgggagaggcgtgtggcgt

SEQ ID NO: 678217 - DNA, 20 bp, mouse
gcgtgcctgggcaacgcgtc

SEQ ID NO: 678218 - DNA, 20 bp, mouse
ggcgttgcccaggcacgcgc

SEQ ID NO: 678219 - DNA, 20 bp, mouse
gtgcgcctgcgcgttctctc

SEQ ID NO: 678220 - DNA, 20 bp, mouse
gaacacgcctgcgcgtgcct

SEQ ID NO: 678221 - DNA, 20 bp, mouse
gacggcccagagcgtggcgc

SEQ ID NO: 678222 - DNA, 20 bp, mouse
gcggtggctcccgagagtgg

SEQ ID NO: 678223 - DNA, 20 bp, mouse
ggggaggggcgtgcctacgc

SEQ ID NO: 678224 - DNA, 20 bp, mouse
gggcaacgcgtcgggagcct

SEQ ID NO: 678225 - DNA, 20 bp, mouse
gacttgagtggcagaggaca

SEQ ID NO: 678226 - DNA, 20 bp, mouse
ggtgcgccgggagtaggtga

SEQ ID NO: 678227 - DNA, 20 bp, mouse
gtcccggcgcacagcaagcc

SEQ ID NO: 678228 - DNA, 20 bp, mouse
ggccctccctgcgtgtctga

SEQ ID NO: 678229 - DNA, 20 bp, mouse
gcccagcagtcgtgtgaccc

SEQ ID NO: 678230 - DNA, 20 bp, mouse
gacgcagggagggcaggaag

SEQ ID NO: 678231 - DNA, 20 bp, mouse
gcgtgcgtgcctgcctcccg

SEQ ID NO: 678232 - DNA, 20 bp, mouse
gcgccctcagacacgcaggg

SEQ ID NO: 678233 - DNA, 20 bp, mouse
gggaagctgaagaaaaaacg

SEQ ID NO: 678234 - DNA, 20 bp, mouse
gtgcgtccggagtctggagt

SEQ ID NO: 678235 - DNA, 20 bp, mouse
gccgagcctacgaacgggaa

SEQ ID NO: 678236 - DNA, 20 bp, mouse
gcctccggcgagccgaccga

SEQ ID NO: 678237 - DNA, 20 bp, mouse
gcgccggaggtcgagctccc

SEQ ID NO: 678238 - DNA, 20 bp, mouse
ggaagcaggctggggaccgt

SEQ ID NO: 678239 - DNA, 20 bp, mouse
gcagccctcggtcggctcgc

SEQ ID NO: 678240 - DNA, 20 bp, mouse
ggtgtgagaagtcccgaagc

SEQ ID NO: 678241 - DNA, 20 bp, mouse
gagccggggagctcgacctc

SEQ ID NO: 678242 - DNA, 20 bp, mouse
gagaagtcccgaagcaggct

SEQ ID NO: 678243 - DNA, 20 bp, mouse
ggccgggcgggccgcgccga

SEQ ID NO: 678244 - DNA, 20 bp, mouse
gtgggtaccactgcccagtg

SEQ ID NO: 678245 - DNA, 20 bp, mouse
ggctgggaggccgggcttcg

SEQ ID NO: 678246 - DNA, 20 bp, mouse
gagggttgatgaagaaggga

SEQ ID NO: 678247 - DNA, 20 bp, mouse
gggtaatcccagggaaggtg

SEQ ID NO: 678248 - DNA, 20 bp, mouse
gggaaggtgggggactcact

SEQ ID NO: 678249 - DNA, 20 bp, mouse
gagtgacatcttggcaatta

SEQ ID NO: 678250 - DNA, 20 bp, mouse
gcacccccacagtgacatct

SEQ ID NO: 678251 - DNA, 20 bp, mouse
ggatctggaagggtaatccc

SEQ ID NO: 678252 - DNA, 20 bp, mouse
gcaggaggtgacattggctg

SEQ ID NO: 678253 - DNA, 20 bp, mouse
gggagtgatgtcatctattg

SEQ ID NO: 678254 - DNA, 20 bp, mouse
gacggggcgactttaagcct

SEQ ID NO: 678255 - DNA, 20 bp, mouse
gattgccaagatgtcactgt

SEQ ID NO: 678256 - DNA, 20 bp, mouse
ggggacctggggatacttgg

SEQ ID NO: 678257 - DNA, 20 bp, mouse
gttcagtgggacactgatga

SEQ ID NO: 678258 - DNA, 20 bp, mouse
ggctcccagaaccaccaggg

SEQ ID NO: 678259 - DNA, 20 bp, mouse
gagactgactggaatagatg

SEQ ID NO: 678260 - DNA, 20 bp, mouse
ggatgaggaaacctccctgg

SEQ ID NO: 678261 - DNA, 20 bp, mouse
ggcctggcacttgtgttcag

SEQ ID NO: 678262 - DNA, 20 bp, mouse
gagagctagggtgatcctga

SEQ ID NO: 678263 - DNA, 20 bp, mouse
ggaaacctccctggtggttc

SEQ ID NO: 678264 - DNA, 20 bp, mouse
gcccactgaacacaagtgcc

SEQ ID NO: 678265 - DNA, 20 bp, mouse
ggtggttctgggagctccta

SEQ ID NO: 678266 - DNA, 20 bp, mouse
ggcgcccggtgcttcgggac

SEQ ID NO: 678267 - DNA, 20 bp, mouse
gccgccgcgcccggtgcttc

SEQ ID NO: 678268 - DNA, 20 bp, mouse
gccgcccccggcttctcatt

SEQ ID NO: 678269 - DNA, 20 bp, mouse
ggggccacaggccgcgagaa

SEQ ID NO: 678270 - DNA, 20 bp, mouse
gagcgcccagcgatcgcaac

SEQ ID NO: 678271 - DNA, 20 bp, mouse
ggcaaccggtcccgaagcac

SEQ ID NO: 678272 - DNA, 20 bp, mouse
gccgcccaatgagaagccgg

SEQ ID NO: 678273 - DNA, 20 bp, mouse
gagccccaggccgctcgcgg

SEQ ID NO: 678274 - DNA, 20 bp, mouse
ggggaccggttgcgatcgct

SEQ ID NO: 678275 - DNA, 20 bp, mouse
ggaggtgccggtggtcacgt

SEQ ID NO: 678276 - DNA, 20 bp, mouse
gaagcgggaccacacatggt

SEQ ID NO: 678277 - DNA, 20 bp, mouse
gacacatggtgggaacgtga

SEQ ID NO: 678278 - DNA, 20 bp, mouse
gcgccgacgctgctgaccaa

SEQ ID NO: 678279 - DNA, 20 bp, mouse
gcgcggtcctgcgtcaccgg

SEQ ID NO: 678280 - DNA, 20 bp, mouse
gcgctgcgtccgccccgcgt

SEQ ID NO: 678281 - DNA, 20 bp, mouse
gcagcgcggtcctgcgtcac

SEQ ID NO: 678282 - DNA, 20 bp, mouse
ggaaatgcgtaggagatccg

SEQ ID NO: 678283 - DNA, 20 bp, mouse
gctgctgaccaatggaacag

SEQ ID NO: 678284 - DNA, 20 bp, mouse
gagactcagcccacgcgggg

SEQ ID NO: 678285 - DNA, 20 bp, mouse
ggtcctgcgtcaccggcggg

SEQ ID NO: 678286 - DNA, 20 bp, mouse
gagggtgcctcagtacaatg

SEQ ID NO: 678287 - DNA, 20 bp, mouse
gtgtgcaggcatatataggg

SEQ ID NO: 678288 - DNA, 20 bp, mouse
gtcccttggctcaaaggata

SEQ ID NO: 678289 - DNA, 20 bp, mouse
gaggctgcaccgtcagcagc

SEQ ID NO: 678290 - DNA, 20 bp, mouse
gcagtccctgccggtcgcag

SEQ ID NO: 678291 - DNA, 20 bp, mouse
gagatcccctgcgaccggca

SEQ ID NO: 678292 - DNA, 20 bp, mouse
ggaggtaggcacagattagc

SEQ ID NO: 678293 - DNA, 20 bp, mouse
ggtgatgtcccttggctcaa

SEQ ID NO: 678294 - DNA, 20 bp, mouse
gttgtactgaggcaccctcc

SEQ ID NO: 678295 - DNA, 20 bp, mouse
gtcctccaaaggaggccagg

SEQ ID NO: 678296 - DNA, 20 bp, mouse
gggcccaccagcagctgctt

SEQ ID NO: 678297 - DNA, 20 bp, mouse
gccagctcaccgccagttca

SEQ ID NO: 678298 - DNA, 20 bp, mouse
gccaccccatccttgttctc

SEQ ID NO: 678299 - DNA, 20 bp, mouse
gagcagctgcttgggattcc

SEQ ID NO: 678300 - DNA, 20 bp, mouse
gagacttgtgatcagggatt

SEQ ID NO: 678301 - DNA, 20 bp, mouse
gacaagtctccatgaactgg

SEQ ID NO: 678302 - DNA, 20 bp, mouse
ggtcctagctccagagaaca

SEQ ID NO: 678303 - DNA, 20 bp, mouse
gggatggggtgggtgccact

SEQ ID NO: 678304 - DNA, 20 bp, mouse
gtgtgatcagggatttggca

SEQ ID NO: 678305 - DNA, 20 bp, mouse
gtcttagctcagtgagtacc

SEQ ID NO: 678306 - DNA, 20 bp, mouse
ggtccctcagagctttgttt

SEQ ID NO: 678307 - DNA, 20 bp, mouse
gtcagagcagctgggagcta

SEQ ID NO: 678308 - DNA, 20 bp, mouse
gtaaagctctggggatcagg

SEQ ID NO: 678309 - DNA, 20 bp, mouse
ggtgcaggggccctactgtt

SEQ ID NO: 678310 - DNA, 20 bp, mouse
ggagggacacctcccccaat

SEQ ID NO: 678311 - DNA, 20 bp, mouse
ggtcccaggtggaacaggat

SEQ ID NO: 678312 - DNA, 20 bp, mouse
gctctgagaagcccaacagt

SEQ ID NO: 678313 - DNA, 20 bp, mouse
gagccgctggccatcatctg

SEQ ID NO: 678314 - DNA, 20 bp, mouse
gggtaggtcccaggtggaac

SEQ ID NO: 678315 - DNA, 20 bp, mouse
gtagggttccagaagtgcag

SEQ ID NO: 678316 - DNA, 20 bp, mouse
gtctccctgtggaatccggg

SEQ ID NO: 678317 - DNA, 20 bp, mouse
gtaggctaggagtctctacc

SEQ ID NO: 678318 - DNA, 20 bp, mouse
gggcagcggagtcaccgatc

SEQ ID NO: 678319 - DNA, 20 bp, mouse
gcagcccgcatgcatgacaa

SEQ ID NO: 678320 - DNA, 20 bp, mouse
gctctggtctgcataggcag

SEQ ID NO: 678321 - DNA, 20 bp, mouse
gggcaggctttggccagctc

SEQ ID NO: 678322 - DNA, 20 bp, mouse
gcaccccacccggattccac

SEQ ID NO: 678323 - DNA, 20 bp, mouse
gatgacaacggaaagtgctg

SEQ ID NO: 678324 - DNA, 20 bp, mouse
gaggcgcacatcgtgtctgc

SEQ ID NO: 678325 - DNA, 20 bp, mouse
gtcagcttgcacaccccacc

SEQ ID NO: 678326 - DNA, 20 bp, mouse
ggctctgcctttagtgggga

SEQ ID NO: 678327 - DNA, 20 bp, mouse
ggtcagcactagggaatatg

SEQ ID NO: 678328 - DNA, 20 bp, mouse
gtcctggccaaggcccagag

SEQ ID NO: 678329 - DNA, 20 bp, mouse
gccaccatcaagatgatgtt

SEQ ID NO: 678330 - DNA, 20 bp, mouse
gaccagtccttccccactaa

SEQ ID NO: 678331 - DNA, 20 bp, mouse
gaaaggaacaggggccccaa

SEQ ID NO: 678332 - DNA, 20 bp, mouse
gtgggtccctagtcctggac

SEQ ID NO: 678333 - DNA, 20 bp, mouse
gtcagcagctctgcctttag

SEQ ID NO: 678334 - DNA, 20 bp, mouse
gggacccaacatcatcttga

SEQ ID NO: 678335 - DNA, 20 bp, mouse
ggcctttagtggggaaggac

SEQ ID NO: 678336 - DNA, 20 bp, mouse
gggtgagcaaggtggaccgt

SEQ ID NO: 678337 - DNA, 20 bp, mouse
gaaggtggaccgtgggatcc

SEQ ID NO: 678338 - DNA, 20 bp, mouse
ggccaggtgggtgagcaagg

SEQ ID NO: 678339 - DNA, 20 bp, mouse
gcatgcctccagggccaggt

SEQ ID NO: 678340 - DNA, 20 bp, mouse
gctcacccacctggccctgg

SEQ ID NO: 678341 - DNA, 20 bp, mouse
gcaagggtggggaccaactc

SEQ ID NO: 678342 - DNA, 20 bp, mouse
gtatgcctgccctagcattg

SEQ ID NO: 678343 - DNA, 20 bp, mouse
gattgtgtgccaggactcaa

SEQ ID NO: 678344 - DNA, 20 bp, mouse
gtgtgctgtccaggatccca

SEQ ID NO: 678345 - DNA, 20 bp, mouse
gacaagatctcgcaagaccc

SEQ ID NO: 678346 - DNA, 20 bp, mouse
gccggccatgggccccatcc

SEQ ID NO: 678347 - DNA, 20 bp, mouse
gtgccagcctagactaggga

SEQ ID NO: 678348 - DNA, 20 bp, mouse
gtggctgccagcctagacta

SEQ ID NO: 678349 - DNA, 20 bp, mouse
gaggtagagaagccatacgg

SEQ ID NO: 678350 - DNA, 20 bp, mouse
ggtaaactgagaccccctag

SEQ ID NO: 678351 - DNA, 20 bp, mouse
gccccttccctagtctaggc

SEQ ID NO: 678352 - DNA, 20 bp, mouse
ggcagctgggtcagcaaacc

SEQ ID NO: 678353 - DNA, 20 bp, mouse
gtcagagcagggttagggcc

SEQ ID NO: 678354 - DNA, 20 bp, mouse
ggaagcagcctgactgaggc

SEQ ID NO: 678355 - DNA, 20 bp, mouse
gtgggtcagcaaacctggat

SEQ ID NO: 678356 - DNA, 20 bp, mouse
ggaaagcggggtgagaatga

SEQ ID NO: 678357 - DNA, 20 bp, mouse
gtcggctgcgccagtgtgtc

SEQ ID NO: 678358 - DNA, 20 bp, mouse
ggggagctggtgccaagatg

SEQ ID NO: 678359 - DNA, 20 bp, mouse
gcctctgcctactgtgcccc

SEQ ID NO: 678360 - DNA, 20 bp, mouse
gtaagccgacaccaaagccc

SEQ ID NO: 678361 - DNA, 20 bp, mouse
gcggggccatgccaggttca

SEQ ID NO: 678362 - DNA, 20 bp, mouse
gacctggcatggccccgtcc

SEQ ID NO: 678363 - DNA, 20 bp, mouse
gacgcagcggtcccccatct

SEQ ID NO: 678364 - DNA, 20 bp, mouse
gctgcgtccctgcagaaagc

SEQ ID NO: 678365 - DNA, 20 bp, mouse
gagccgtccccatgccagga

SEQ ID NO: 678366 - DNA, 20 bp, mouse
gaaatggcccggacaggatc

SEQ ID NO: 678367 - DNA, 20 bp, mouse
gtgtccgggaaggcccccta

SEQ ID NO: 678368 - DNA, 20 bp, mouse
gccttcccggacacaccatt

SEQ ID NO: 678369 - DNA, 20 bp, mouse
gacaagtctgatgacttcct

SEQ ID NO: 678370 - DNA, 20 bp, mouse
ggacttgtgcaagaggtgac

SEQ ID NO: 678371 - DNA, 20 bp, mouse
ggcaaaggccatcggttccc

SEQ ID NO: 678372 - DNA, 20 bp, mouse
ggacccccaagtaactgatg

SEQ ID NO: 678373 - DNA, 20 bp, mouse
gaggccacatcagttacttg

SEQ ID NO: 678374 - DNA, 20 bp, mouse
gatgagactgtgtttgaaag

SEQ ID NO: 678375 - DNA, 20 bp, mouse
gcggacaggatcgggtggac

SEQ ID NO: 678376 - DNA, 20 bp, mouse
ggggccagtcagtgggactg

SEQ ID NO: 678377 - DNA, 20 bp, mouse
gtggcccaaagcaggtgtcc

SEQ ID NO: 678378 - DNA, 20 bp, mouse
ggggaagaaaggacttaaac

SEQ ID NO: 678379 - DNA, 20 bp, mouse
gaagggctgggtatctctat

SEQ ID NO: 678380 - DNA, 20 bp, mouse
gcagatgcgtggcccaaagc

SEQ ID NO: 678381 - DNA, 20 bp, mouse
gtgtcctgaggtccagtcct

SEQ ID NO: 678382 - DNA, 20 bp, mouse
gcccacccaaacagcactga

SEQ ID NO: 678383 - DNA, 20 bp, mouse
gattccccagtcccactgac

SEQ ID NO: 678384 - DNA, 20 bp, mouse
gacgcatctgggccagtcag

SEQ ID NO: 678385 - DNA, 20 bp, mouse
gtaaactggtctttcattac

SEQ ID NO: 678386 - DNA, 20 bp, mouse
gtccgtgttcaggaccatgc

SEQ ID NO: 678387 - DNA, 20 bp, mouse
gagacggggaccagatttgg

SEQ ID NO: 678388 - DNA, 20 bp, mouse
gagactgagtccgtatgtgg

SEQ ID NO: 678389 - DNA, 20 bp, mouse
ggggagaattccaagttcta

SEQ ID NO: 678390 - DNA, 20 bp, mouse
gggcagactgagtccgtatg

SEQ ID NO: 678391 - DNA, 20 bp, mouse
gcggactcagtctgcctgca

SEQ ID NO: 678392 - DNA, 20 bp, mouse
ggctgcagactggaggtcgt

SEQ ID NO: 678393 - DNA, 20 bp, mouse
gaatctggtccccgtctctg

SEQ ID NO: 678394 - DNA, 20 bp, mouse
ggtctctgaggagtgagtcc

SEQ ID NO: 678395 - DNA, 20 bp, mouse
gcacggaaatacttggacac

SEQ ID NO: 678396 - DNA, 20 bp, mouse
gtcctcgcgctttgtcattt

SEQ ID NO: 678397 - DNA, 20 bp, mouse
gcatttcgagcgcgctgcat

SEQ ID NO: 678398 - DNA, 20 bp, mouse
gcccccaggccccttttgtg

SEQ ID NO: 678399 - DNA, 20 bp, mouse
gcatttgggatcatggggta

SEQ ID NO: 678400 - DNA, 20 bp, mouse
gagcgcgccctttgtctcca

SEQ ID NO: 678401 - DNA, 20 bp, mouse
gctttgtcatttgggatcat

SEQ ID NO: 678402 - DNA, 20 bp, mouse
ggggtggggcctccatttgt

SEQ ID NO: 678403 - DNA, 20 bp, mouse
gcctatagaaactgctgagg

SEQ ID NO: 678404 - DNA, 20 bp, mouse
gttgcctatagaaactgctg

SEQ ID NO: 678405 - DNA, 20 bp, mouse
gtcctttcactgagatagtg

SEQ ID NO: 678406 - DNA, 20 bp, mouse
gtccctctgctcattggggt

SEQ ID NO: 678407 - DNA, 20 bp, mouse
gtccctccctctgctcattg

SEQ ID NO: 678408 - DNA, 20 bp, mouse
gagccaaccccaatgagcag

SEQ ID NO: 678409 - DNA, 20 bp, mouse
gcacacaaaggggcccattt

SEQ ID NO: 678410 - DNA, 20 bp, mouse
gctcattggggttggctgaa

SEQ ID NO: 678411 - DNA, 20 bp, mouse
ggggcccatttcggtgagta

SEQ ID NO: 678412 - DNA, 20 bp, mouse
gggtttactctcattctttc

SEQ ID NO: 678413 - DNA, 20 bp, mouse
gtcggctcaattgacttctc

SEQ ID NO: 678414 - DNA, 20 bp, mouse
gcacaggaaatcacacaaag

SEQ ID NO: 678415 - DNA, 20 bp, mouse
gcattctttctggtaggttc

SEQ ID NO: 678416 - DNA, 20 bp, mouse
gagctcatctaggacagcgt

SEQ ID NO: 678417 - DNA, 20 bp, mouse
gtggaacacaccagagaacc

SEQ ID NO: 678418 - DNA, 20 bp, mouse
ggtagattcgcctggttctc

SEQ ID NO: 678419 - DNA, 20 bp, mouse
gaacactgagcagctcatct

SEQ ID NO: 678420 - DNA, 20 bp, mouse
gttagcggaactgcacaaaa

SEQ ID NO: 678421 - DNA, 20 bp, mouse
gctgcacaaaaggggccctc

SEQ ID NO: 678422 - DNA, 20 bp, mouse
gtcgggctgagggaatttca

SEQ ID NO: 678423 - DNA, 20 bp, mouse
gaggagggttgctgcgttag

SEQ ID NO: 678424 - DNA, 20 bp, mouse
gtcggtgtagggcacaaatc

SEQ ID NO: 678425 - DNA, 20 bp, mouse
gtccagccttctcaacccca

SEQ ID NO: 678426 - DNA, 20 bp, mouse
gaacgtgccctgcccccacg

SEQ ID NO: 678427 - DNA, 20 bp, mouse
gagcccacaatgaatcccgt

SEQ ID NO: 678428 - DNA, 20 bp, mouse
ggcacaaaagaggcccgcgt

SEQ ID NO: 678429 - DNA, 20 bp, mouse
gtattcactctggagtattc

SEQ ID NO: 678430 - DNA, 20 bp, mouse
gatgtggtctatcgatgaaa

SEQ ID NO: 678431 - DNA, 20 bp, mouse
gtagcccacgggattcattg

SEQ ID NO: 678432 - DNA, 20 bp, mouse
gaacagacaacgtcttaatg

SEQ ID NO: 678433 - DNA, 20 bp, mouse
gaccctgagcatggattaat

SEQ ID NO: 678434 - DNA, 20 bp, mouse
ggttcagtggatcttacaga

SEQ ID NO: 678435 - DNA, 20 bp, mouse
gaaaacaaaaacgtgtaatt

SEQ ID NO: 678436 - DNA, 20 bp, mouse
gctaagagggtcacttgacg

SEQ ID NO: 678437 - DNA, 20 bp, mouse
gggatgacgaatcactgacc

SEQ ID NO: 678438 - DNA, 20 bp, mouse
gcacaaaaggggcccgcggg

SEQ ID NO: 678439 - DNA, 20 bp, mouse
gggcaggcgggagattaaat

SEQ ID NO: 678440 - DNA, 20 bp, mouse
gaatcactgacccggctaag

SEQ ID NO: 678441 - DNA, 20 bp, mouse
gtggaagatgggggcgacag

SEQ ID NO: 678442 - DNA, 20 bp, mouse
gcggcacaaaaggggcccgc

SEQ ID NO: 678443 - DNA, 20 bp, mouse
ggtgagtgtaccttctccac

SEQ ID NO: 678444 - DNA, 20 bp, mouse
gggatgatgagagtccaaaa

SEQ ID NO: 678445 - DNA, 20 bp, mouse
gaaaatgccctgtccccccg

SEQ ID NO: 678446 - DNA, 20 bp, mouse
gcacaaaaggggcccgcagt

SEQ ID NO: 678447 - DNA, 20 bp, mouse
gaaggggcccgcagtgggac

SEQ ID NO: 678448 - DNA, 20 bp, mouse
gaatgggaggtaggcaacag

SEQ ID NO: 678449 - DNA, 20 bp, mouse
gtgctgacccaaggagattg

SEQ ID NO: 678450 - DNA, 20 bp, mouse
gcctttaaatgatgcctgtc

SEQ ID NO: 678451 - DNA, 20 bp, mouse
gaatcactgacctgattaaa

SEQ ID NO: 678452 - DNA, 20 bp, mouse
gctaaaagcctcaatctcct

SEQ ID NO: 678453 - DNA, 20 bp, mouse
gtgctgaaagaatggaaggc

SEQ ID NO: 678454 - DNA, 20 bp, mouse
ggcaacagaggtgaattgcc

SEQ ID NO: 678455 - DNA, 20 bp, mouse
ggggtcacttgatgtagctt

SEQ ID NO: 678456 - DNA, 20 bp, mouse
gaggggcggcgggtgggtca

SEQ ID NO: 678457 - DNA, 20 bp, mouse
gtgtcagagcacagtctggg

SEQ ID NO: 678458 - DNA, 20 bp, mouse
ggtctgggaggccacagcta

SEQ ID NO: 678459 - DNA, 20 bp, mouse
gtcaagaggcattgaggact

SEQ ID NO: 678460 - DNA, 20 bp, mouse
gagggcagcaagcaacgagc

SEQ ID NO: 678461 - DNA, 20 bp, mouse
gtaacacaggggcggcgggt

SEQ ID NO: 678462 - DNA, 20 bp, mouse
gggcgggtgggtcagggcac

SEQ ID NO: 678463 - DNA, 20 bp, mouse
gagcaagcaacgagctggac

SEQ ID NO: 678464 - DNA, 20 bp, mouse
gcaggaaggatcaggtcaag

SEQ ID NO: 678465 - DNA, 20 bp, mouse
gcccgagccctgactcagca

SEQ ID NO: 678466 - DNA, 20 bp, mouse
gagcacccgagcacgcccga

SEQ ID NO: 678467 - DNA, 20 bp, mouse
ggggcgtgctcgggtgctca

SEQ ID NO: 678468 - DNA, 20 bp, mouse
ggactccctcgggcgtgctc

SEQ ID NO: 678469 - DNA, 20 bp, mouse
ggagctgtctgcaagcagaa

SEQ ID NO: 678470 - DNA, 20 bp, mouse
gctaagggagctaggaagtc

SEQ ID NO: 678471 - DNA, 20 bp, mouse
gcaggcctgcctgcaccaga

SEQ ID NO: 678472 - DNA, 20 bp, mouse
ggaactgcctaggcacatcg

SEQ ID NO: 678473 - DNA, 20 bp, mouse
gtaggcacatcgcgggaggg

SEQ ID NO: 678474 - DNA, 20 bp, mouse
gtgcctaggcacatcgcggg

SEQ ID NO: 678475 - DNA, 20 bp, mouse
ggactgagtaggaactgcct

SEQ ID NO: 678476 - DNA, 20 bp, mouse
ggggctgggcgagcattaca

SEQ ID NO: 678477 - DNA, 20 bp, mouse
gggaatgtccaagaggtcat

SEQ ID NO: 678478 - DNA, 20 bp, mouse
gtgtaggctctgctgaatca

SEQ ID NO: 678479 - DNA, 20 bp, mouse
ggcagagcctacaatgcagt

SEQ ID NO: 678480 - DNA, 20 bp, mouse
gaagggtcatgagtgctcat

SEQ ID NO: 678481 - DNA, 20 bp, mouse
gtaaacgtttggctgggttt

SEQ ID NO: 678482 - DNA, 20 bp, mouse
gaactgcacagagaaaatct

SEQ ID NO: 678483 - DNA, 20 bp, mouse
gtctgcttagtcatgagaat

SEQ ID NO: 678484 - DNA, 20 bp, mouse
gtggttgctagaaaaacaat

SEQ ID NO: 678485 - DNA, 20 bp, mouse
gagaaatcaaggatggtctt

SEQ ID NO: 678486 - DNA, 20 bp, mouse
ggggacggtggatgcaaaca

SEQ ID NO: 678487 - DNA, 20 bp, mouse
gagcaccggggagcgtggga

SEQ ID NO: 678488 - DNA, 20 bp, mouse
gaccggggagcgtgggacgg

SEQ ID NO: 678489 - DNA, 20 bp, mouse
gaggagaggcggagccctcg

SEQ ID NO: 678490 - DNA, 20 bp, mouse
gtcctgaagtctctccccga

SEQ ID NO: 678491 - DNA, 20 bp, mouse
ggctgacaagctccggggag

SEQ ID NO: 678492 - DNA, 20 bp, mouse
gctctagcaccggggagcgt

SEQ ID NO: 678493 - DNA, 20 bp, mouse
gccactgggctctagcaccg

SEQ ID NO: 678494 - DNA, 20 bp, mouse
gctcatgaggactatcccat

SEQ ID NO: 678495 - DNA, 20 bp, mouse
gaagctccggggaggggcca

SEQ ID NO: 678496 - DNA, 20 bp, mouse
gacccccaggggatctggtg

SEQ ID NO: 678497 - DNA, 20 bp, mouse
gggaatcaaggcggcaggct

SEQ ID NO: 678498 - DNA, 20 bp, mouse
gcctaagattggaatcaagg

SEQ ID NO: 678499 - DNA, 20 bp, mouse
gagattggaatcaaggcggc

SEQ ID NO: 678500 - DNA, 20 bp, mouse
gccctggaatccaaggagtt

SEQ ID NO: 678501 - DNA, 20 bp, mouse
ggagttggggtgggcggcag

SEQ ID NO: 678502 - DNA, 20 bp, mouse
gcggcaggggcgcggcccga

SEQ ID NO: 678503 - DNA, 20 bp, mouse
gaagtctcagacaagggtaa

SEQ ID NO: 678504 - DNA, 20 bp, mouse
ggtggtgtgggaaggagatt

SEQ ID NO: 678505 - DNA, 20 bp, mouse
gttagccaactgacattcct

SEQ ID NO: 678506 - DNA, 20 bp, mouse
gcgagcgagcgagctggggt

SEQ ID NO: 678507 - DNA, 20 bp, mouse
gggccaccgtggcggcaata

SEQ ID NO: 678508 - DNA, 20 bp, mouse
gaaggcgcagagtctgagca

SEQ ID NO: 678509 - DNA, 20 bp, mouse
gaatgcgccttcttctccat

SEQ ID NO: 678510 - DNA, 20 bp, mouse
gcgcaagggcagtgtggacg

SEQ ID NO: 678511 - DNA, 20 bp, mouse
ggggcctcaccccgtccaga

SEQ ID NO: 678512 - DNA, 20 bp, mouse
gcctcaccccgtccagaagg

SEQ ID NO: 678513 - DNA, 20 bp, mouse
gtcctctccggccaccgtgg

SEQ ID NO: 678514 - DNA, 20 bp, mouse
ggcggagttcggccggtgga

SEQ ID NO: 678515 - DNA, 20 bp, mouse
ggaggaccaaagttccccat

SEQ ID NO: 678516 - DNA, 20 bp, mouse
ggcggcgactcgtctctcta

SEQ ID NO: 678517 - DNA, 20 bp, mouse
gccgcaggatgaccgatctg

SEQ ID NO: 678518 - DNA, 20 bp, mouse
gccagggaccaccaataaat

SEQ ID NO: 678519 - DNA, 20 bp, mouse
gaggggttacggttggaatg

SEQ ID NO: 678520 - DNA, 20 bp, mouse
gcatctatgggtggggcgga

SEQ ID NO: 678521 - DNA, 20 bp, mouse
gtctacgggaagcagcatgc

SEQ ID NO: 678522 - DNA, 20 bp, mouse
gtaaccgcctgccaatcgga

SEQ ID NO: 678523 - DNA, 20 bp, mouse
gcgcaagggagcatcccgag

SEQ ID NO: 678524 - DNA, 20 bp, mouse
gtgagggagcgaaggagcga

SEQ ID NO: 678525 - DNA, 20 bp, mouse
gcaagggacgagacaaggat

SEQ ID NO: 678526 - DNA, 20 bp, mouse
gcccctccggcgacccaccc

SEQ ID NO: 678527 - DNA, 20 bp, mouse
gccgcgataacatctgtcaa

SEQ ID NO: 678528 - DNA, 20 bp, mouse
gaggctaattaggagtgggt

SEQ ID NO: 678529 - DNA, 20 bp, mouse
ggggcctcgccgaggaccct

SEQ ID NO: 678530 - DNA, 20 bp, mouse
gccaccccggcctcgaccat

SEQ ID NO: 678531 - DNA, 20 bp, mouse
gggattggaccgtacggatt

SEQ ID NO: 678532 - DNA, 20 bp, mouse
gcggggaggattggaccgta

SEQ ID NO: 678533 - DNA, 20 bp, mouse
gtgggccaatggtcgaggcc

SEQ ID NO: 678534 - DNA, 20 bp, mouse
gctcgaccattggcccaaaa

SEQ ID NO: 678535 - DNA, 20 bp, mouse
gattggcccaaaatggaaga

SEQ ID NO: 678536 - DNA, 20 bp, mouse
gggccctccgaaaaggggtg

SEQ ID NO: 678537 - DNA, 20 bp, mouse
gagggggggccctccgaaaa

SEQ ID NO: 678538 - DNA, 20 bp, mouse
gccggagccgggacaggagg

SEQ ID NO: 678539 - DNA, 20 bp, mouse
gggacggagaagtgcttccg

SEQ ID NO: 678540 - DNA, 20 bp, mouse
gcggctccggagcccggaag

SEQ ID NO: 678541 - DNA, 20 bp, mouse
gggcccggaggaccggagga

SEQ ID NO: 678542 - DNA, 20 bp, mouse
gcggagcccggaagtggatg

SEQ ID NO: 678543 - DNA, 20 bp, mouse
gaacccggggcccgtttccc

SEQ ID NO: 678544 - DNA, 20 bp, mouse
gcggaggagggtggtgcgaa

SEQ ID NO: 678545 - DNA, 20 bp, mouse
gcagcctcaccccttttcgg

SEQ ID NO: 678546 - DNA, 20 bp, mouse
gtcagaggatgggagaagac

SEQ ID NO: 678547 - DNA, 20 bp, mouse
ggtgccccgccctgctctgt

SEQ ID NO: 678548 - DNA, 20 bp, mouse
gaatctaagcgctcagagga

SEQ ID NO: 678549 - DNA, 20 bp, mouse
ggcggggcacgagaagcagg

SEQ ID NO: 678550 - DNA, 20 bp, mouse
gtgtgaatctaagcgctcag

SEQ ID NO: 678551 - DNA, 20 bp, mouse
gaatgagccactgggcatag

SEQ ID NO: 678552 - DNA, 20 bp, mouse
gggggtgtcttgcacatctc

SEQ ID NO: 678553 - DNA, 20 bp, mouse
gagggcggggcacgagaagc

SEQ ID NO: 678554 - DNA, 20 bp, mouse
ggagcgcttagattcacagt

SEQ ID NO: 678555 - DNA, 20 bp, mouse
gctggaaagtctcagttgtg

SEQ ID NO: 678556 - DNA, 20 bp, mouse
gactcacccagcacttggcc

SEQ ID NO: 678557 - DNA, 20 bp, mouse
gtagccactcacccagcact

SEQ ID NO: 678558 - DNA, 20 bp, mouse
gtggctcacaaggtggtgtc

SEQ ID NO: 678559 - DNA, 20 bp, mouse
gctgctggggagtaagaggc

SEQ ID NO: 678560 - DNA, 20 bp, mouse
gaacctggcttgttcccaga

SEQ ID NO: 678561 - DNA, 20 bp, mouse
gcatcctgacgtcagcagga

SEQ ID NO: 678562 - DNA, 20 bp, mouse
ggtgagccaggccaagtgct

SEQ ID NO: 678563 - DNA, 20 bp, mouse
ggggtgccagggagtgttta

SEQ ID NO: 678564 - DNA, 20 bp, mouse
gggaacaagccaggttccta

SEQ ID NO: 678565 - DNA, 20 bp, mouse
gagggtgggaggatgtattc

SEQ ID NO: 678566 - DNA, 20 bp, mouse
gcgcgtgcacgggaaggtgg

SEQ ID NO: 678567 - DNA, 20 bp, mouse
ggtggctaaacgcaggtcag

SEQ ID NO: 678568 - DNA, 20 bp, mouse
gcggggcgaagggtgaattt

SEQ ID NO: 678569 - DNA, 20 bp, mouse
gtgcttctggcactacccag

SEQ ID NO: 678570 - DNA, 20 bp, mouse
gttagtacgcttgcgcgcga

SEQ ID NO: 678571 - DNA, 20 bp, mouse
gtccgagcgcgtgcacggga

SEQ ID NO: 678572 - DNA, 20 bp, mouse
ggactctgctgcgacgctgg

SEQ ID NO: 678573 - DNA, 20 bp, mouse
gagagtcaccggcttgcgtg

SEQ ID NO: 678574 - DNA, 20 bp, mouse
gtaggaaggccttatgaagt

SEQ ID NO: 678575 - DNA, 20 bp, mouse
gcttgcgtgtggctaaacgc

SEQ ID NO: 678576 - DNA, 20 bp, mouse
gtcaccgcagacccgagcaa

SEQ ID NO: 678577 - DNA, 20 bp, mouse
gccactcgcagaacctgcta

SEQ ID NO: 678578 - DNA, 20 bp, mouse
gggccccaccccggctgcga

SEQ ID NO: 678579 - DNA, 20 bp, mouse
gccaatcggaaccattgctc

SEQ ID NO: 678580 - DNA, 20 bp, mouse
gagaccgtgccttttgacgc

SEQ ID NO: 678581 - DNA, 20 bp, mouse
gaagcctgcgtcaaaaggca

SEQ ID NO: 678582 - DNA, 20 bp, mouse
gttgacgcaggcttctgttt

SEQ ID NO: 678583 - DNA, 20 bp, mouse
gcagaacctgctagggtctg

SEQ ID NO: 678584 - DNA, 20 bp, mouse
gggtggggccaaagcattcc

SEQ ID NO: 678585 - DNA, 20 bp, mouse
gcccggctgcgagggccaat

SEQ ID NO: 678586 - DNA, 20 bp, mouse
gcgacggggaagagagctag

SEQ ID NO: 678587 - DNA, 20 bp, mouse
gagagctagcggggacgacc

SEQ ID NO: 678588 - DNA, 20 bp, mouse
gacgaccaggcggcccgctt

SEQ ID NO: 678589 - DNA, 20 bp, mouse
ggcacagccacagagcgacg

SEQ ID NO: 678590 - DNA, 20 bp, mouse
gaggcggcccgcttggggga

SEQ ID NO: 678591 - DNA, 20 bp, mouse
gggggagggcggtggagccc

SEQ ID NO: 678592 - DNA, 20 bp, mouse
ggtccagagctcgagaaggg

SEQ ID NO: 678593 - DNA, 20 bp, mouse
ggctagcggggacgaccagg

SEQ ID NO: 678594 - DNA, 20 bp, mouse
gtggagcccgggttactttg

SEQ ID NO: 678595 - DNA, 20 bp, mouse
gagctgcagcagagaggcgt

SEQ ID NO: 678596 - DNA, 20 bp, mouse
gaacctgacctctctcagcc

SEQ ID NO: 678597 - DNA, 20 bp, mouse
gccaggctcactgctcatct

SEQ ID NO: 678598 - DNA, 20 bp, mouse
gaccacctctaaggacactt

SEQ ID NO: 678599 - DNA, 20 bp, mouse
gacttaggaaaccacctcta

SEQ ID NO: 678600 - DNA, 20 bp, mouse
gagcctggctgagagaggtc

SEQ ID NO: 678601 - DNA, 20 bp, mouse
gtgatcctgaagggagatga

SEQ ID NO: 678602 - DNA, 20 bp, mouse
ggtgaccgctctcacctagg

SEQ ID NO: 678603 - DNA, 20 bp, mouse
gtagggggataatgtcatca

SEQ ID NO: 678604 - DNA, 20 bp, mouse
ggatggagtttgagagactt

SEQ ID NO: 678605 - DNA, 20 bp, mouse
gaactccatcatctcccttc

SEQ ID NO: 678606 - DNA, 20 bp, mouse
ggggctgccagttcttggaa

SEQ ID NO: 678607 - DNA, 20 bp, mouse
gagccttcccccaggttgtc

SEQ ID NO: 678608 - DNA, 20 bp, mouse
gaggctgggtcagactgccc

SEQ ID NO: 678609 - DNA, 20 bp, mouse
gtcagactgcccaggcaggg

SEQ ID NO: 678610 - DNA, 20 bp, mouse
ggggtcagactgcccaggca

SEQ ID NO: 678611 - DNA, 20 bp, mouse
gagcctgacaacctggggga

SEQ ID NO: 678612 - DNA, 20 bp, mouse
gaaaaggagaggctagccag

SEQ ID NO: 678613 - DNA, 20 bp, mouse
ggccccatgtatagctgata

SEQ ID NO: 678614 - DNA, 20 bp, mouse
gcaggtgggctgccagttct

SEQ ID NO: 678615 - DNA, 20 bp, mouse
gtggaatgagccaccagagt

SEQ ID NO: 678616 - DNA, 20 bp, mouse
ggggtccgagtgtcccgtgc

SEQ ID NO: 678617 - DNA, 20 bp, mouse
ggggacgtgagcctactgtg

SEQ ID NO: 678618 - DNA, 20 bp, mouse
gtgcagtggggcagcacacc

SEQ ID NO: 678619 - DNA, 20 bp, mouse
gtgtgctgccccactgcacg

SEQ ID NO: 678620 - DNA, 20 bp, mouse
ggggcccggtgacgtcaccg

SEQ ID NO: 678621 - DNA, 20 bp, mouse
ggcccgaacagccacacagt

SEQ ID NO: 678622 - DNA, 20 bp, mouse
ggcaggttgggaaacctaga

SEQ ID NO: 678623 - DNA, 20 bp, mouse
gtgacatcatgctgcctgca

SEQ ID NO: 678624 - DNA, 20 bp, mouse
gacacagcgggccaaccgcc

SEQ ID NO: 678625 - DNA, 20 bp, mouse
gagtatacgcgccaggcggt

SEQ ID NO: 678626 - DNA, 20 bp, mouse
ggtgtggaggagaccatttc

SEQ ID NO: 678627 - DNA, 20 bp, mouse
gaggcgaagctgcttgcgaa

SEQ ID NO: 678628 - DNA, 20 bp, mouse
gtgggcacatgcttgcaggg

SEQ ID NO: 678629 - DNA, 20 bp, mouse
gccctccctgactcctctgg

SEQ ID NO: 678630 - DNA, 20 bp, mouse
gggtgtctcaagacttgaag

SEQ ID NO: 678631 - DNA, 20 bp, mouse
ggctctgggcacatgcttgc

SEQ ID NO: 678632 - DNA, 20 bp, mouse
gacaagatgggaagaaaaca

SEQ ID NO: 678633 - DNA, 20 bp, mouse
ggtccacaattctgagaatc

SEQ ID NO: 678634 - DNA, 20 bp, mouse
gggtcctccccagctctgcc

SEQ ID NO: 678635 - DNA, 20 bp, mouse
gtgagggtatgccattgaca

SEQ ID NO: 678636 - DNA, 20 bp, mouse
gagagctgatgtggagatgg

SEQ ID NO: 678637 - DNA, 20 bp, mouse
ggctctgggcacacactcgc

SEQ ID NO: 678638 - DNA, 20 bp, mouse
ggggcacatgagagctgatg

SEQ ID NO: 678639 - DNA, 20 bp, mouse
gtgggcacacactcgcaggg

SEQ ID NO: 678640 - DNA, 20 bp, mouse
gacctccctgacttctctgg

SEQ ID NO: 678641 - DNA, 20 bp, mouse
gtctagggcaggacagagaa

SEQ ID NO: 678642 - DNA, 20 bp, mouse
gaagcaaagctgcttgtgaa

SEQ ID NO: 678643 - DNA, 20 bp, mouse
gggtagagctggggtggact

SEQ ID NO: 678644 - DNA, 20 bp, mouse
ggagttcccaaggctttatg

SEQ ID NO: 678645 - DNA, 20 bp, mouse
gaggtggcctcataaagcct

SEQ ID NO: 678646 - DNA, 20 bp, mouse
gggggacaagacgtcaagga

SEQ ID NO: 678647 - DNA, 20 bp, mouse
ggcaaggaactcagaccctg

SEQ ID NO: 678648 - DNA, 20 bp, mouse
gatagctcaggacaatgcag

SEQ ID NO: 678649 - DNA, 20 bp, mouse
gcaacaccctgcagcgattc

SEQ ID NO: 678650 - DNA, 20 bp, mouse
gagggggggacaagacgtca

SEQ ID NO: 678651 - DNA, 20 bp, mouse
gcctggggctggggcaactc

SEQ ID NO: 678652 - DNA, 20 bp, mouse
gcgctgcagggtgttggatc

SEQ ID NO: 678653 - DNA, 20 bp, mouse
gccccgggaggaaattacct

SEQ ID NO: 678654 - DNA, 20 bp, mouse
gagcgattcaggcctgggtg

SEQ ID NO: 678655 - DNA, 20 bp, mouse
gcctgcagcgattcaggcct

SEQ ID NO: 678656 - DNA, 20 bp, mouse
gcctctcaggaaggaggttg

SEQ ID NO: 678657 - DNA, 20 bp, mouse
gctgcctcaggggtcttaga

SEQ ID NO: 678658 - DNA, 20 bp, mouse
gtgagccttcacccttgggg

SEQ ID NO: 678659 - DNA, 20 bp, mouse
ggaaatccggagagaaggga

SEQ ID NO: 678660 - DNA, 20 bp, mouse
gcctccttcctgagaggaag

SEQ ID NO: 678661 - DNA, 20 bp, mouse
gtctatgtcccccaccccaa

SEQ ID NO: 678662 - DNA, 20 bp, mouse
ggaaggaggttgagggaaac

SEQ ID NO: 678663 - DNA, 20 bp, mouse
gtagccccgtcgttaatgac

SEQ ID NO: 678664 - DNA, 20 bp, mouse
gcagaattgcgacaccttcc

SEQ ID NO: 678665 - DNA, 20 bp, mouse
gcttggccctgtcttgtctc

SEQ ID NO: 678666 - DNA, 20 bp, mouse
gtcagggctggggtcgtgta

SEQ ID NO: 678667 - DNA, 20 bp, mouse
ggggagcgcgggctgaacag

SEQ ID NO: 678668 - DNA, 20 bp, mouse
gcacagcgccggcctccgag

SEQ ID NO: 678669 - DNA, 20 bp, mouse
gtcctcgggctcccactcgg

SEQ ID NO: 678670 - DNA, 20 bp, mouse
gacccggagcagtaggggga

SEQ ID NO: 678671 - DNA, 20 bp, mouse
gggctcctcgggctcccact

SEQ ID NO: 678672 - DNA, 20 bp, mouse
ggtagcgtgggcctcagggc

SEQ ID NO: 678673 - DNA, 20 bp, mouse
gcgaggagccgagagctgag

SEQ ID NO: 678674 - DNA, 20 bp, mouse
gacgcactgcagactggccc

SEQ ID NO: 678675 - DNA, 20 bp, mouse
gcagggacccggagcagtag

SEQ ID NO: 678676 - DNA, 20 bp, mouse
gggcgcgcgcgaggaaatga

SEQ ID NO: 678677 - DNA, 20 bp, mouse
gtcctcgcgcgcgccggaag

SEQ ID NO: 678678 - DNA, 20 bp, mouse
ggggcggggcctgaccgcgg

SEQ ID NO: 678679 - DNA, 20 bp, mouse
ggcgggacttggcagtgtgg

SEQ ID NO: 678680 - DNA, 20 bp, mouse
gtgccaagtcccgccctcca

SEQ ID NO: 678681 - DNA, 20 bp, mouse
gaagtggcggtgctccgcgg

SEQ ID NO: 678682 - DNA, 20 bp, mouse
gcggaagtggcggtgctccg

SEQ ID NO: 678683 - DNA, 20 bp, mouse
gggcggagtctggctgtgga

SEQ ID NO: 678684 - DNA, 20 bp, mouse
ggcagggcacaggacagaag

SEQ ID NO: 678685 - DNA, 20 bp, mouse
ggcagagctgactagcgggg

SEQ ID NO: 678686 - DNA, 20 bp, mouse
gcgggcgagcagcggggcgt

SEQ ID NO: 678687 - DNA, 20 bp, mouse
gggaccttggaggaaatgcg

SEQ ID NO: 678688 - DNA, 20 bp, mouse
gcgagcagcggggcgtgggt

SEQ ID NO: 678689 - DNA, 20 bp, mouse
gcgcgaaggccagcaagtgg

SEQ ID NO: 678690 - DNA, 20 bp, mouse
gcggggaatcccaccggggt

SEQ ID NO: 678691 - DNA, 20 bp, mouse
ggccctctgaaaggaccttc

SEQ ID NO: 678692 - DNA, 20 bp, mouse
gctagaggaagctgagaggt

SEQ ID NO: 678693 - DNA, 20 bp, mouse
gtgggggcagggcgtagacg

SEQ ID NO: 678694 - DNA, 20 bp, mouse
gcctgcgagcttcctcccat

SEQ ID NO: 678695 - DNA, 20 bp, mouse
gccttcgcgaaggctcccga

SEQ ID NO: 678696 - DNA, 20 bp, mouse
ggtaaccgcaacctatgtgg

SEQ ID NO: 678697 - DNA, 20 bp, mouse
gtgcgcgtggcctctcattc

SEQ ID NO: 678698 - DNA, 20 bp, mouse
gtaaaccgccacataggttg

SEQ ID NO: 678699 - DNA, 20 bp, mouse
gagactgcatccggaatgag

SEQ ID NO: 678700 - DNA, 20 bp, mouse
gggggtaaccgcaacctatg

SEQ ID NO: 678701 - DNA, 20 bp, mouse
gaagttctaaaccgccacat

SEQ ID NO: 678702 - DNA, 20 bp, mouse
gccacatggtagactgcatc

SEQ ID NO: 678703 - DNA, 20 bp, mouse
gtaaaagaggggaaagttgg

SEQ ID NO: 678704 - DNA, 20 bp, mouse
gctggacagtagtggtaaag

SEQ ID NO: 678705 - DNA, 20 bp, mouse
gcattcgtacttatagacta

SEQ ID NO: 678706 - DNA, 20 bp, mouse
ggggagcgagcgccgaagac

SEQ ID NO: 678707 - DNA, 20 bp, mouse
ggccacgcgagcgagcccga

SEQ ID NO: 678708 - DNA, 20 bp, mouse
gcctgcgggagcactagcag

SEQ ID NO: 678709 - DNA, 20 bp, mouse
gacccaccgagaggggaagg

SEQ ID NO: 678710 - DNA, 20 bp, mouse
gcccctctcggtgggtagga

SEQ ID NO: 678711 - DNA, 20 bp, mouse
gccgaggccaggctgagtcc

SEQ ID NO: 678712 - DNA, 20 bp, mouse
gcaaggagccgctgccgtgg

SEQ ID NO: 678713 - DNA, 20 bp, mouse
gtggagcacggagacttgtt

SEQ ID NO: 678714 - DNA, 20 bp, mouse
gagcctccttcccctctcgg

SEQ ID NO: 678715 - DNA, 20 bp, mouse
ggctggagcgggaggaaggc

SEQ ID NO: 678716 - DNA, 20 bp, mouse
ggtcccctggctgggttgaa

SEQ ID NO: 678717 - DNA, 20 bp, mouse
ggaagccctcagtcaagtga

SEQ ID NO: 678718 - DNA, 20 bp, mouse
gggacacaatgcaccacatg

SEQ ID NO: 678719 - DNA, 20 bp, mouse
gcataagctgtcatcttata

SEQ ID NO: 678720 - DNA, 20 bp, mouse
gcaatgcaccacatggggac

SEQ ID NO: 678721 - DNA, 20 bp, mouse
gaggctgggtaccaatccca

SEQ ID NO: 678722 - DNA, 20 bp, mouse
gagaaccatcacttgactga

SEQ ID NO: 678723 - DNA, 20 bp, mouse
gggcaacaggaggtttgaga

SEQ ID NO: 678724 - DNA, 20 bp, mouse
gcaatcccagggcagctcat

SEQ ID NO: 678725 - DNA, 20 bp, mouse
gtgaagtgaggaaaccccag

SEQ ID NO: 678726 - DNA, 20 bp, mouse
gtcaaccatctctccaacgg

SEQ ID NO: 678727 - DNA, 20 bp, mouse
gctagggacgtgggcatcga

SEQ ID NO: 678728 - DNA, 20 bp, mouse
ggatgcccacgtccctagaa

SEQ ID NO: 678729 - DNA, 20 bp, mouse
gttgtaaggagcaagattta

SEQ ID NO: 678730 - DNA, 20 bp, mouse
gtgtgcccccgttggagaga

SEQ ID NO: 678731 - DNA, 20 bp, mouse
gggagactctgtgcccccgt

SEQ ID NO: 678732 - DNA, 20 bp, mouse
gcactagtgctttctggtgt

SEQ ID NO: 678733 - DNA, 20 bp, mouse
ggcagaattgatctattcgg

SEQ ID NO: 678734 - DNA, 20 bp, mouse
gcacagagtctccgctactc

SEQ ID NO: 678735 - DNA, 20 bp, mouse
gcaggcagaattgatctatt

SEQ ID NO: 678736 - DNA, 20 bp, mouse
gactttactcagaatttccc

SEQ ID NO: 678737 - DNA, 20 bp, mouse
gtgagtaaagtctttaacaa

SEQ ID NO: 678738 - DNA, 20 bp, mouse
gttctgcccaatacctctcc

SEQ ID NO: 678739 - DNA, 20 bp, mouse
gttactacatgaaatccttg

SEQ ID NO: 678740 - DNA, 20 bp, mouse
gtctaagaattgttacaaat

SEQ ID NO: 678741 - DNA, 20 bp, mouse
gactcagaatttcccaggag

SEQ ID NO: 678742 - DNA, 20 bp, mouse
gcatgaaatgcaaattttgt

SEQ ID NO: 678743 - DNA, 20 bp, mouse
gtagggccttattttcctca

SEQ ID NO: 678744 - DNA, 20 bp, mouse
gtaaatgtaaatttggtggg

SEQ ID NO: 678745 - DNA, 20 bp, mouse
ggaaatccttgaggaaaata

SEQ ID NO: 678746 - DNA, 20 bp, mouse
ggataaagggagatgtgtga

SEQ ID NO: 678747 - DNA, 20 bp, mouse
gaaggactccttagaatctg

SEQ ID NO: 678748 - DNA, 20 bp, mouse
gctttgttccacagattcta

SEQ ID NO: 678749 - DNA, 20 bp, mouse
gctgtggaacaaagaccaga

SEQ ID NO: 678750 - DNA, 20 bp, mouse
gttctcaatcaaactgttta

SEQ ID NO: 678751 - DNA, 20 bp, mouse
ggttaattgtatttgcttga

SEQ ID NO: 678752 - DNA, 20 bp, mouse
gcttcacaatctaataataa

SEQ ID NO: 678753 - DNA, 20 bp, mouse
gagaatatgatgataaaaca

SEQ ID NO: 678754 - DNA, 20 bp, mouse
gtttgaaaacactagaatta

SEQ ID NO: 678755 - DNA, 20 bp, mouse
gtgaaggttcctgcatgcac

SEQ ID NO: 678756 - DNA, 20 bp, mouse
ggaatgatgcagccagtaca

SEQ ID NO: 678757 - DNA, 20 bp, mouse
gagacatcaaagcaccttca

SEQ ID NO: 678758 - DNA, 20 bp, mouse
ggctgcatcattcactagat

SEQ ID NO: 678759 - DNA, 20 bp, mouse
gtgttctaaatcatcctaag

SEQ ID NO: 678760 - DNA, 20 bp, mouse
ggctcatgcttgccttgtac

SEQ ID NO: 678761 - DNA, 20 bp, mouse
gtatttgtatcacttattcc

SEQ ID NO: 678762 - DNA, 20 bp, mouse
gttgccatatcagatagaaa

SEQ ID NO: 678763 - DNA, 20 bp, mouse
gatctgatatggcaactgtg

SEQ ID NO: 678764 - DNA, 20 bp, mouse
gatggaagtagctaacatga

SEQ ID NO: 678765 - DNA, 20 bp, mouse
gccatatcagatagaaaagg

SEQ ID NO: 678766 - DNA, 20 bp, mouse
gccaagtgagaggaccgggg

SEQ ID NO: 678767 - DNA, 20 bp, mouse
gcagccaagtgagaggaccg

SEQ ID NO: 678768 - DNA, 20 bp, mouse
gtctttcccaagaaattcta

SEQ ID NO: 678769 - DNA, 20 bp, mouse
gagtctacgtgattagaaaa

SEQ ID NO: 678770 - DNA, 20 bp, mouse
gtaaagccccccactaggct

SEQ ID NO: 678771 - DNA, 20 bp, mouse
ggaggttaaagccccccact

SEQ ID NO: 678772 - DNA, 20 bp, mouse
gaaggcagcaattcagaagc

SEQ ID NO: 678773 - DNA, 20 bp, mouse
ggcaattcagaagctggtta

SEQ ID NO: 678774 - DNA, 20 bp, mouse
ggttcctccagccaagtgag

SEQ ID NO: 678775 - DNA, 20 bp, mouse
gtctaatcacgtagacttct

SEQ ID NO: 678776 - DNA, 20 bp, mouse
gtatgactcacatctgtttc

SEQ ID NO: 678777 - DNA, 20 bp, mouse
gggaaatgagatctgactac

SEQ ID NO: 678778 - DNA, 20 bp, mouse
gctattgggtgaaaagtagg

SEQ ID NO: 678779 - DNA, 20 bp, mouse
gcaactagatgaaatgatag

SEQ ID NO: 678780 - DNA, 20 bp, mouse
gctgactaagactgacctgc

SEQ ID NO: 678781 - DNA, 20 bp, mouse
gaattacagggtattagtac

SEQ ID NO: 678782 - DNA, 20 bp, mouse
gatcctattgggtgaaaagt

SEQ ID NO: 678783 - DNA, 20 bp, mouse
gagtctccgttatttatctt

SEQ ID NO: 678784 - DNA, 20 bp, mouse
gagggactttatatttagta

SEQ ID NO: 678785 - DNA, 20 bp, mouse
gaataacggagactaattac

SEQ ID NO: 678786 - DNA, 20 bp, mouse
gtgggctgacaaggggaggg

SEQ ID NO: 678787 - DNA, 20 bp, mouse
ggggcgtgactgggtgacgc

SEQ ID NO: 678788 - DNA, 20 bp, mouse
gcggaagtggaagtgagccc

SEQ ID NO: 678789 - DNA, 20 bp, mouse
gctcgggcgctctctccgta

SEQ ID NO: 678790 - DNA, 20 bp, mouse
gtggaagtgagcccgggcgg

SEQ ID NO: 678791 - DNA, 20 bp, mouse
gaggcgcagctgggcgtgac

SEQ ID NO: 678792 - DNA, 20 bp, mouse
gtgggtgacgccgggagcgt

SEQ ID NO: 678793 - DNA, 20 bp, mouse
gggcgctctctccgtagggt

SEQ ID NO: 678794 - DNA, 20 bp, mouse
gagccaccgccggccggaag

SEQ ID NO: 678795 - DNA, 20 bp, mouse
gcgtagggtgggctgacaag

SEQ ID NO: 678796 - DNA, 20 bp, mouse
gtcagcgcctcaatacgggg

SEQ ID NO: 678797 - DNA, 20 bp, mouse
gagggcgagcggggccggca

SEQ ID NO: 678798 - DNA, 20 bp, mouse
gcgctctcagcgcctcaata

SEQ ID NO: 678799 - DNA, 20 bp, mouse
gtccatccgcggcggggaga

SEQ ID NO: 678800 - DNA, 20 bp, mouse
gctgcgggaacggtggacac

SEQ ID NO: 678801 - DNA, 20 bp, mouse
gtggagtcatcctgcgggaa

SEQ ID NO: 678802 - DNA, 20 bp, mouse
gccgcccccttgggttgcta

SEQ ID NO: 678803 - DNA, 20 bp, mouse
gtccccgccgcggatggact

SEQ ID NO: 678804 - DNA, 20 bp, mouse
ggatccgagtccatccgcgg

SEQ ID NO: 678805 - DNA, 20 bp, mouse
ggcggggcttggctacttga

SEQ ID NO: 678806 - DNA, 20 bp, mouse
gccgccccggaggatttaaa

SEQ ID NO: 678807 - DNA, 20 bp, mouse
ggacgctgccaccctgggtg

SEQ ID NO: 678808 - DNA, 20 bp, mouse
gagtctcagctgattctctc

SEQ ID NO: 678809 - DNA, 20 bp, mouse
gggcgggcccggggctcaat

SEQ ID NO: 678810 - DNA, 20 bp, mouse
gcgtcagaacacgctctccg

SEQ ID NO: 678811 - DNA, 20 bp, mouse
ggcactgcaaaagagattta

SEQ ID NO: 678812 - DNA, 20 bp, mouse
ggggccctttaaatcctccg

SEQ ID NO: 678813 - DNA, 20 bp, mouse
gtagggcaaggcctgagtat

SEQ ID NO: 678814 - DNA, 20 bp, mouse
ggggcgggggatgacatcag

SEQ ID NO: 678815 - DNA, 20 bp, mouse
ggggctcaatgggaaccgcg

SEQ ID NO: 678816 - DNA, 20 bp, mouse
ggggaagaccagttgagggg

SEQ ID NO: 678817 - DNA, 20 bp, mouse
gccctccttagcaacagcgt

SEQ ID NO: 678818 - DNA, 20 bp, mouse
gcaaccccacgctgttgcta

SEQ ID NO: 678819 - DNA, 20 bp, mouse
gacagcgtggggttgctaag

SEQ ID NO: 678820 - DNA, 20 bp, mouse
gagtccccgaagaaatgggg

SEQ ID NO: 678821 - DNA, 20 bp, mouse
gtcggggactgttggtaagt

SEQ ID NO: 678822 - DNA, 20 bp, mouse
gcaacagtccccgaagaaat

SEQ ID NO: 678823 - DNA, 20 bp, mouse
gggccgcagcattaacgacc

SEQ ID NO: 678824 - DNA, 20 bp, mouse
gggacctgcattagtacttc

SEQ ID NO: 678825 - DNA, 20 bp, mouse
gaatttcacagcgacgacag

SEQ ID NO: 678826 - DNA, 20 bp, mouse
ggacagtgtgggtacggtat

SEQ ID NO: 678827 - DNA, 20 bp, mouse
gagctgtggctctgaggcga

SEQ ID NO: 678828 - DNA, 20 bp, mouse
gggagcgcggcgctttacga

SEQ ID NO: 678829 - DNA, 20 bp, mouse
gtgtgggtacggtattggag

SEQ ID NO: 678830 - DNA, 20 bp, mouse
gagaacgcgcacgcctctcg

SEQ ID NO: 678831 - DNA, 20 bp, mouse
gaggtaggggagtggcctag

SEQ ID NO: 678832 - DNA, 20 bp, mouse
gtttacgacggtcggagctg

SEQ ID NO: 678833 - DNA, 20 bp, mouse
gggccttaaggaacggaacg

SEQ ID NO: 678834 - DNA, 20 bp, mouse
gcgcggcgctttacgacggt

SEQ ID NO: 678835 - DNA, 20 bp, mouse
gtaccacaatagggtgtagg

SEQ ID NO: 678836 - DNA, 20 bp, mouse
gaaaggagcccgatcagaaa

SEQ ID NO: 678837 - DNA, 20 bp, mouse
gtagacctggcacccgccta

SEQ ID NO: 678838 - DNA, 20 bp, mouse
gcccacaaggatgatggcaa

SEQ ID NO: 678839 - DNA, 20 bp, mouse
gagacagctggagaaatctg

SEQ ID NO: 678840 - DNA, 20 bp, mouse
gtgaccctgcttgtcccctt

SEQ ID NO: 678841 - DNA, 20 bp, mouse
ggcaccagcccctttctgat

SEQ ID NO: 678842 - DNA, 20 bp, mouse
gcgggtgccaggtctagcct

SEQ ID NO: 678843 - DNA, 20 bp, mouse
gttagtgatgtcacagtccc

SEQ ID NO: 678844 - DNA, 20 bp, mouse
ggacgtcactggcagttccc

SEQ ID NO: 678845 - DNA, 20 bp, mouse
gggcccagctgtagcacacg

SEQ ID NO: 678846 - DNA, 20 bp, mouse
gcacgagcagcccgcgagag

SEQ ID NO: 678847 - DNA, 20 bp, mouse
gacaaccgctcccctctcgc

SEQ ID NO: 678848 - DNA, 20 bp, mouse
gcgggctgctcgtgcgaagg

SEQ ID NO: 678849 - DNA, 20 bp, mouse
ggctcgtgcgaaggcgggat

SEQ ID NO: 678850 - DNA, 20 bp, mouse
gaagcaggccacgcgctcat

SEQ ID NO: 678851 - DNA, 20 bp, mouse
gtcgcgggctgctcgtgcga

SEQ ID NO: 678852 - DNA, 20 bp, mouse
gggagcggttgtaaggtccc

SEQ ID NO: 678853 - DNA, 20 bp, mouse
ggggcgagacttcgactttc

SEQ ID NO: 678854 - DNA, 20 bp, mouse
gaatcggccggtgtcatctt

SEQ ID NO: 678855 - DNA, 20 bp, mouse
gagagccgaccaatccgaat

SEQ ID NO: 678856 - DNA, 20 bp, mouse
ggaaacctaagcctagacta

SEQ ID NO: 678857 - DNA, 20 bp, mouse
ggaaagttgggtaccgtaga

SEQ ID NO: 678858 - DNA, 20 bp, mouse
gtctagagtcacgccctcta

SEQ ID NO: 678859 - DNA, 20 bp, mouse
gtaagcctagactaggggtc

SEQ ID NO: 678860 - DNA, 20 bp, mouse
gatgcccggacccctagtct

SEQ ID NO: 678861 - DNA, 20 bp, mouse
gggaaaagagcgcaagagtg

SEQ ID NO: 678862 - DNA, 20 bp, mouse
ggcaggaaacacgccatctt

SEQ ID NO: 678863 - DNA, 20 bp, mouse
gctttcgcgcgaagcatcct

SEQ ID NO: 678864 - DNA, 20 bp, mouse
gtagcgagagagcgaccagc

SEQ ID NO: 678865 - DNA, 20 bp, mouse
gtggggccttgttctctcga

SEQ ID NO: 678866 - DNA, 20 bp, mouse
gtaagcgcggcggcagtcaa

SEQ ID NO: 678867 - DNA, 20 bp, mouse
gaccctccaagcaatgtggc

SEQ ID NO: 678868 - DNA, 20 bp, mouse
gaaaggtagagacttctggg

SEQ ID NO: 678869 - DNA, 20 bp, mouse
gagggtggcgagctcgctga

SEQ ID NO: 678870 - DNA, 20 bp, mouse
gagtccccccgcactgtagg

SEQ ID NO: 678871 - DNA, 20 bp, mouse
gtgggtggacacgaggtgac

SEQ ID NO: 678872 - DNA, 20 bp, mouse
ggcgccccctacagtgcggg

SEQ ID NO: 678873 - DNA, 20 bp, mouse
gcgccaccctccaagcaatg

SEQ ID NO: 678874 - DNA, 20 bp, mouse
gcaatatgggaggtcgtggt

SEQ ID NO: 678875 - DNA, 20 bp, mouse
ggggtggcctgcagttgggc

SEQ ID NO: 678876 - DNA, 20 bp, mouse
gcccgcgcatgactctctaa

SEQ ID NO: 678877 - DNA, 20 bp, mouse
gccccaggcggcttcctcta

SEQ ID NO: 678878 - DNA, 20 bp, mouse
gtggcctggcacagggaaga

SEQ ID NO: 678879 - DNA, 20 bp, mouse
gcccgagcgcactctgtcgc

SEQ ID NO: 678880 - DNA, 20 bp, mouse
ggagagaaactgacgaaatg

SEQ ID NO: 678881 - DNA, 20 bp, mouse
ggtcatgcgcgggtcctctt

SEQ ID NO: 678882 - DNA, 20 bp, mouse
gacagagtgcgctcgggctc

SEQ ID NO: 678883 - DNA, 20 bp, mouse
gggttcgccccgcccccagg

SEQ ID NO: 678884 - DNA, 20 bp, mouse
ggacccaagggggagcctgt

SEQ ID NO: 678885 - DNA, 20 bp, mouse
ggtagcgcgaggacccaagg

SEQ ID NO: 678886 - DNA, 20 bp, mouse
ggaccaaaggcggtctaatg

SEQ ID NO: 678887 - DNA, 20 bp, mouse
ggaactcagggctttttgac

SEQ ID NO: 678888 - DNA, 20 bp, mouse
gatctggactacaccttcct

SEQ ID NO: 678889 - DNA, 20 bp, mouse
ggtagtccagatgatattca

SEQ ID NO: 678890 - DNA, 20 bp, mouse
gtgctggaaatcaccttcac

SEQ ID NO: 678891 - DNA, 20 bp, mouse
ggtgaatgatggcgaactca

SEQ ID NO: 678892 - DNA, 20 bp, mouse
gtcgctttgattagattcca

SEQ ID NO: 678893 - DNA, 20 bp, mouse
ggacttgtggtgagacaaag

SEQ ID NO: 678894 - DNA, 20 bp, mouse
ggaaggtgtcgttgagcatg

SEQ ID NO: 678895 - DNA, 20 bp, mouse
ggagtccaaggatttccaag

SEQ ID NO: 678896 - DNA, 20 bp, mouse
ggacccatgccccattttaa

SEQ ID NO: 678897 - DNA, 20 bp, mouse
gaacccttaaaatggggcat

SEQ ID NO: 678898 - DNA, 20 bp, mouse
ggtcccaaacccttaaaatg

SEQ ID NO: 678899 - DNA, 20 bp, mouse
gaacccctacatcaccgcaa

SEQ ID NO: 678900 - DNA, 20 bp, mouse
gggacaggatctcttgagaa

SEQ ID NO: 678901 - DNA, 20 bp, mouse
gcgtgctgggctcttgctcc

SEQ ID NO: 678902 - DNA, 20 bp, mouse
gtgggctcttgctcctggtt

SEQ ID NO: 678903 - DNA, 20 bp, mouse
gcccccagaactctgtggac

SEQ ID NO: 678904 - DNA, 20 bp, mouse
gtgcccttgcggtgatgtag

SEQ ID NO: 678905 - DNA, 20 bp, mouse
gaacccagagccctgcctag

SEQ ID NO: 678906 - DNA, 20 bp, mouse
ggggtccggaagatgaggca

SEQ ID NO: 678907 - DNA, 20 bp, mouse
ggggcggggtccggaagatg

SEQ ID NO: 678908 - DNA, 20 bp, mouse
gagtctgcgagacgaggtca

SEQ ID NO: 678909 - DNA, 20 bp, mouse
gaggggcggggtctgatcgg

SEQ ID NO: 678910 - DNA, 20 bp, mouse
ggaggaggagaggacctgta

SEQ ID NO: 678911 - DNA, 20 bp, mouse
gagactgcgggtgctatttg

SEQ ID NO: 678912 - DNA, 20 bp, mouse
gggtaggggcggggtctgat

SEQ ID NO: 678913 - DNA, 20 bp, mouse
ggtgccccgcccccttgtca

SEQ ID NO: 678914 - DNA, 20 bp, mouse
gacctcgtctcgcagactgc

SEQ ID NO: 678915 - DNA, 20 bp, mouse
ggcaaggatgagccaaagtt

SEQ ID NO: 678916 - DNA, 20 bp, mouse
gcgtgactggagaccgtcct

SEQ ID NO: 678917 - DNA, 20 bp, mouse
ggcacccgctgctgcgccca

SEQ ID NO: 678918 - DNA, 20 bp, mouse
gcctccgccagcagcccgag

SEQ ID NO: 678919 - DNA, 20 bp, mouse
gggcgcagcagcgggtgcac

SEQ ID NO: 678920 - DNA, 20 bp, mouse
ggatggctgggatttagcct

SEQ ID NO: 678921 - DNA, 20 bp, mouse
gggtgcaccgggtggcctcc

SEQ ID NO: 678922 - DNA, 20 bp, mouse
gcagcagcgggtgcaccggg

SEQ ID NO: 678923 - DNA, 20 bp, mouse
gggtctccagtcacgaagtg

SEQ ID NO: 678924 - DNA, 20 bp, mouse
gctgaaatgtgaccactccc

SEQ ID NO: 678925 - DNA, 20 bp, mouse
ggcgcctggccgttggtgga

SEQ ID NO: 678926 - DNA, 20 bp, mouse
gccctcccccgggtgtagta

SEQ ID NO: 678927 - DNA, 20 bp, mouse
gctaaatggcaccgagggtg

SEQ ID NO: 678928 - DNA, 20 bp, mouse
gacctccctactacacccgg

SEQ ID NO: 678929 - DNA, 20 bp, mouse
gggggagaatggaatcctga

SEQ ID NO: 678930 - DNA, 20 bp, mouse
gagaatggaatcctgagggt

SEQ ID NO: 678931 - DNA, 20 bp, mouse
gaatgcagcgggagcggggc

SEQ ID NO: 678932 - DNA, 20 bp, mouse
ggtacacagaagctgccggg

SEQ ID NO: 678933 - DNA, 20 bp, mouse
ggtcacctccctactacacc

SEQ ID NO: 678934 - DNA, 20 bp, mouse
gtcagcctgccctttatctg

SEQ ID NO: 678935 - DNA, 20 bp, mouse
ggagggtcgagcttccacga

SEQ ID NO: 678936 - DNA, 20 bp, mouse
gcaccctggaacattcgcgg

SEQ ID NO: 678937 - DNA, 20 bp, mouse
gaatgttccagggtgggcga

SEQ ID NO: 678938 - DNA, 20 bp, mouse
ggcccaccctggaacattcg

SEQ ID NO: 678939 - DNA, 20 bp, mouse
gacgcgccggcgcctataag

SEQ ID NO: 678940 - DNA, 20 bp, mouse
gaccccggagagcgcctgta

SEQ ID NO: 678941 - DNA, 20 bp, mouse
ggccctacaggcgctctccg

SEQ ID NO: 678942 - DNA, 20 bp, mouse
gaaggcatgccgggagttgg

SEQ ID NO: 678943 - DNA, 20 bp, mouse
gggtccgccgcgaatgttcc

SEQ ID NO: 678944 - DNA, 20 bp, mouse
ggcccgtcgcgtggctctcg

SEQ ID NO: 678945 - DNA, 20 bp, mouse
gcccggcatgccttgggtgt

SEQ ID NO: 678946 - DNA, 20 bp, mouse
gtggtctaactgaagtgtca

SEQ ID NO: 678947 - DNA, 20 bp, mouse
gtgctttgtggtatgttcaa

SEQ ID NO: 678948 - DNA, 20 bp, mouse
gcagatttggtgacggtcgg

SEQ ID NO: 678949 - DNA, 20 bp, mouse
gagttatttcttaacgacat

SEQ ID NO: 678950 - DNA, 20 bp, mouse
gggttcttcacagaatttca

SEQ ID NO: 678951 - DNA, 20 bp, mouse
gttgtcaacaaaaagactaa

SEQ ID NO: 678952 - DNA, 20 bp, mouse
gttgcagtgtttcttctaga

SEQ ID NO: 678953 - DNA, 20 bp, mouse
gtgactttaaatgtgtgagc

SEQ ID NO: 678954 - DNA, 20 bp, mouse
gacagtaatcatttcagatt

SEQ ID NO: 678955 - DNA, 20 bp, mouse
gcttctagagggattttgca

SEQ ID NO: 678956 - DNA, 20 bp, mouse
ggtagagtgcctaatgtaaa

SEQ ID NO: 678957 - DNA, 20 bp, mouse
gtatgcgtaatcagacatat

SEQ ID NO: 678958 - DNA, 20 bp, mouse
gaaagacaggcatttctatg

SEQ ID NO: 678959 - DNA, 20 bp, mouse
ggctcaccgctcaaattcat

SEQ ID NO: 678960 - DNA, 20 bp, mouse
gtaccctttaaaggcatcct

SEQ ID NO: 678961 - DNA, 20 bp, mouse
gtgtaaagattttacgtccc

SEQ ID NO: 678962 - DNA, 20 bp, mouse
gtagagatcatcatctaaaa

SEQ ID NO: 678963 - DNA, 20 bp, mouse
ggcagcgactctggtaacca

SEQ ID NO: 678964 - DNA, 20 bp, mouse
gcgtcccaggatgcctttaa

SEQ ID NO: 678965 - DNA, 20 bp, mouse
gtcactgctctaccctttaa

SEQ ID NO: 678966 - DNA, 20 bp, mouse
gcatataggcagcctggctg

SEQ ID NO: 678967 - DNA, 20 bp, mouse
ggctccatgtgatcacatat

SEQ ID NO: 678968 - DNA, 20 bp, mouse
ggtgaagtcagaagcaaggc

SEQ ID NO: 678969 - DNA, 20 bp, mouse
gagcctctggccttttagtg

SEQ ID NO: 678970 - DNA, 20 bp, mouse
gcgcgcttcattaatgtctt

SEQ ID NO: 678971 - DNA, 20 bp, mouse
ggtaatgagtctttgtgcga

SEQ ID NO: 678972 - DNA, 20 bp, mouse
gcacagtgaagtcagaagca

SEQ ID NO: 678973 - DNA, 20 bp, mouse
gtgatcacatataggcagcc

SEQ ID NO: 678974 - DNA, 20 bp, mouse
ggtaccagcaataaaacacg

SEQ ID NO: 678975 - DNA, 20 bp, mouse
gctgcctatatgtgatcaca

SEQ ID NO: 678976 - DNA, 20 bp, mouse
gtgcccccagagatcgccat

SEQ ID NO: 678977 - DNA, 20 bp, mouse
gcaaagagaagtcacggctg

SEQ ID NO: 678978 - DNA, 20 bp, mouse
ggaccctaggttttggatgg

SEQ ID NO: 678979 - DNA, 20 bp, mouse
gtgccaccgagatgtgatgg

SEQ ID NO: 678980 - DNA, 20 bp, mouse
gtggggcggcagccacgccc

SEQ ID NO: 678981 - DNA, 20 bp, mouse
gtgcacactgcaccacaaca

SEQ ID NO: 678982 - DNA, 20 bp, mouse
gaacctagggtcgggagccc

SEQ ID NO: 678983 - DNA, 20 bp, mouse
gcaccctatggcgatctctg

SEQ ID NO: 678984 - DNA, 20 bp, mouse
gcgggaaacgccttccggag

SEQ ID NO: 678985 - DNA, 20 bp, mouse
gcgtgacatcagccctgttg

SEQ ID NO: 678986 - DNA, 20 bp, mouse
gaggagcagccggagacggt

SEQ ID NO: 678987 - DNA, 20 bp, mouse
ggggcgacaccggatctcgc

SEQ ID NO: 678988 - DNA, 20 bp, mouse
gagatccggtgtcgccccgt

SEQ ID NO: 678989 - DNA, 20 bp, mouse
ggaatcccacggggcgacac

SEQ ID NO: 678990 - DNA, 20 bp, mouse
gccgagtctcccaccgtctc

SEQ ID NO: 678991 - DNA, 20 bp, mouse
ggctccggacgtcccgggac

SEQ ID NO: 678992 - DNA, 20 bp, mouse
gcggacgcgcgggaagccgc

SEQ ID NO: 678993 - DNA, 20 bp, mouse
ggggaagccgcaggaagagg

SEQ ID NO: 678994 - DNA, 20 bp, mouse
gtggccccgagacaaaagac

SEQ ID NO: 678995 - DNA, 20 bp, mouse
gcgtccggagcactcaggat

SEQ ID NO: 678996 - DNA, 20 bp, mouse
ggcccgcttcgctgcttctt

SEQ ID NO: 678997 - DNA, 20 bp, mouse
ggggccctggctttcctatt

SEQ ID NO: 678998 - DNA, 20 bp, mouse
gggctgctttggagtcgcga

SEQ ID NO: 678999 - DNA, 20 bp, mouse
gtcctccgtacatactccac

SEQ ID NO: 679000 - DNA, 20 bp, mouse
gaccaggaagtcgcagtgct

SEQ ID NO: 679001 - DNA, 20 bp, mouse
gtcgcagtgctgggctgctt

SEQ ID NO: 679002 - DNA, 20 bp, mouse
gaggacatctggtcgctatg

SEQ ID NO: 679003 - DNA, 20 bp, mouse
gaagcagcgaagcgggccag

SEQ ID NO: 679004 - DNA, 20 bp, mouse
ggagcgccgagcgtaacccc

SEQ ID NO: 679005 - DNA, 20 bp, mouse
gaggcaacaaggtgtagccg

SEQ ID NO: 679006 - DNA, 20 bp, mouse
gggggtggggaacacaacta

SEQ ID NO: 679007 - DNA, 20 bp, mouse
gggctcccggctggcatggg

SEQ ID NO: 679008 - DNA, 20 bp, mouse
gccggagaacaatatcagtt

SEQ ID NO: 679009 - DNA, 20 bp, mouse
ggggaggctcccggctggca

SEQ ID NO: 679010 - DNA, 20 bp, mouse
gtagaggctgtcaccagtct

SEQ ID NO: 679011 - DNA, 20 bp, mouse
gtcttcaaggagggcgtgtg

SEQ ID NO: 679012 - DNA, 20 bp, mouse
gggaacacaactaagggctt

SEQ ID NO: 679013 - DNA, 20 bp, mouse
gttgttctccgggaggctcc

SEQ ID NO: 679014 - DNA, 20 bp, mouse
gaactaagggctttggtcac

SEQ ID NO: 679015 - DNA, 20 bp, mouse
ggtcttggctcgctgaggga

SEQ ID NO: 679016 - DNA, 20 bp, mouse
ggtgagttgaacgtcaacat

SEQ ID NO: 679017 - DNA, 20 bp, mouse
gggcatcagtatgggagcac

SEQ ID NO: 679018 - DNA, 20 bp, mouse
ggaaaccaactgttcaggta

SEQ ID NO: 679019 - DNA, 20 bp, mouse
gctgttgaaaccaactgttc

SEQ ID NO: 679020 - DNA, 20 bp, mouse
gcctggaagggttactggtc

SEQ ID NO: 679021 - DNA, 20 bp, mouse
ggctgagacaaagttctcat

SEQ ID NO: 679022 - DNA, 20 bp, mouse
gaaattgccactgatgtgaa

SEQ ID NO: 679023 - DNA, 20 bp, mouse
gtactgcagtgtctgctcca

SEQ ID NO: 679024 - DNA, 20 bp, mouse
gacctgcctggaagggttac

SEQ ID NO: 679025 - DNA, 20 bp, mouse
ggtgaaaggttctagagcac

SEQ ID NO: 679026 - DNA, 20 bp, mouse
gggaagaagttgtgagtcag

SEQ ID NO: 679027 - DNA, 20 bp, mouse
gtggaacaaggaggatctag

SEQ ID NO: 679028 - DNA, 20 bp, mouse
ggaactaagtgctaatggaa

SEQ ID NO: 679029 - DNA, 20 bp, mouse
gacaaggaggatctaggggt

SEQ ID NO: 679030 - DNA, 20 bp, mouse
gactcctgttgtagagtcca

SEQ ID NO: 679031 - DNA, 20 bp, mouse
gagtagggcagtatggaaca

SEQ ID NO: 679032 - DNA, 20 bp, mouse
gaacaggagtctcacccttc

SEQ ID NO: 679033 - DNA, 20 bp, mouse
gcagaagaactaagtgctaa

SEQ ID NO: 679034 - DNA, 20 bp, mouse
gagggcagtatggaacaagg

SEQ ID NO: 679035 - DNA, 20 bp, mouse
ggttgtgagtcagtggagta

SEQ ID NO: 679036 - DNA, 20 bp, mouse
gggaaaagagaggcgaactg

SEQ ID NO: 679037 - DNA, 20 bp, mouse
ggtctctgggtcaggcttaa

SEQ ID NO: 679038 - DNA, 20 bp, mouse
gatgcaaaaagattgatagt

SEQ ID NO: 679039 - DNA, 20 bp, mouse
ggttcctagagtaggcaggt

SEQ ID NO: 679040 - DNA, 20 bp, mouse
ggaggagaagcttatcagga

SEQ ID NO: 679041 - DNA, 20 bp, mouse
gtgcaaagtgttcctagagt

SEQ ID NO: 679042 - DNA, 20 bp, mouse
ggcctgacccagagacactg

SEQ ID NO: 679043 - DNA, 20 bp, mouse
gaggaacactttgcaatcac

SEQ ID NO: 679044 - DNA, 20 bp, mouse
gaccacagtgtctctgggtc

SEQ ID NO: 679045 - DNA, 20 bp, mouse
gagcttatgtacatcacgag

SEQ ID NO: 679046 - DNA, 20 bp, mouse
gcaaggtggaggagtagaga

SEQ ID NO: 679047 - DNA, 20 bp, mouse
gttagatgaaggatgggtca

SEQ ID NO: 679048 - DNA, 20 bp, mouse
gccctgcccaccagaggccc

SEQ ID NO: 679049 - DNA, 20 bp, mouse
gctgggagatgcacaagcag

SEQ ID NO: 679050 - DNA, 20 bp, mouse
ggatgaaggatgggtcaagg

SEQ ID NO: 679051 - DNA, 20 bp, mouse
gaaatgccctagtcaaaatg

SEQ ID NO: 679052 - DNA, 20 bp, mouse
ggccttctgcttttagatga

SEQ ID NO: 679053 - DNA, 20 bp, mouse
gtctgcttttagatgaagga

SEQ ID NO: 679054 - DNA, 20 bp, mouse
gctgagagctgagagtacat

SEQ ID NO: 679055 - DNA, 20 bp, mouse
gtgaggctcttaacactcca

SEQ ID NO: 679056 - DNA, 20 bp, mouse
ggatgcaggcatgactacct

SEQ ID NO: 679057 - DNA, 20 bp, mouse
ggggctccttggagaaatat

SEQ ID NO: 679058 - DNA, 20 bp, mouse
ggaggcagtgatttttactg

SEQ ID NO: 679059 - DNA, 20 bp, mouse
gatgactacctgggaggaga

SEQ ID NO: 679060 - DNA, 20 bp, mouse
gaatgcataccatcccagat

SEQ ID NO: 679061 - DNA, 20 bp, mouse
gtacctcacaaaggggatgc

SEQ ID NO: 679062 - DNA, 20 bp, mouse
gtagtctggatacctcagat

SEQ ID NO: 679063 - DNA, 20 bp, mouse
gcttggagaaatataggtga

SEQ ID NO: 679064 - DNA, 20 bp, mouse
ggcaggcatgactacctggg

SEQ ID NO: 679065 - DNA, 20 bp, mouse
gggctgataggacctatctg

SEQ ID NO: 679066 - DNA, 20 bp, mouse
ggggcggggccgttcggaag

SEQ ID NO: 679067 - DNA, 20 bp, mouse
gcggggccgttcggaagagg

SEQ ID NO: 679068 - DNA, 20 bp, mouse
gaggaggcggggcccgctag

SEQ ID NO: 679069 - DNA, 20 bp, mouse
gtcagcagggaatgggaatc

SEQ ID NO: 679070 - DNA, 20 bp, mouse
gctagggggcagacggaaaa

SEQ ID NO: 679071 - DNA, 20 bp, mouse
ggagagcagggtcactatgt

SEQ ID NO: 679072 - DNA, 20 bp, mouse
gggagggtggccgccggaaa

SEQ ID NO: 679073 - DNA, 20 bp, mouse
ggagggagggcggggccgtt

SEQ ID NO: 679074 - DNA, 20 bp, mouse
ggtggaaaagggcacagaag

SEQ ID NO: 679075 - DNA, 20 bp, mouse
gggggcagacggaaaaggga

SEQ ID NO: 679076 - DNA, 20 bp, mouse
ggggacctgtgtgccatctc

SEQ ID NO: 679077 - DNA, 20 bp, mouse
gtacactgcgtaggtagggg

SEQ ID NO: 679078 - DNA, 20 bp, mouse
gggccgggaggggcccgcga

SEQ ID NO: 679079 - DNA, 20 bp, mouse
gccagcatctctacacgtag

SEQ ID NO: 679080 - DNA, 20 bp, mouse
gtctggttcttacactgcgt

SEQ ID NO: 679081 - DNA, 20 bp, mouse
gggcacctgcaagctggtcc

SEQ ID NO: 679082 - DNA, 20 bp, mouse
gtctctacacgtagaggttc

SEQ ID NO: 679083 - DNA, 20 bp, mouse
ggaaacaagcaggcgttggg

SEQ ID NO: 679084 - DNA, 20 bp, mouse
gtctctccctcctgggagat

SEQ ID NO: 679085 - DNA, 20 bp, mouse
ggggaggtgcacccgcctcc

SEQ ID NO: 679086 - DNA, 20 bp, mouse
gcctctctccttcccagggt

SEQ ID NO: 679087 - DNA, 20 bp, mouse
gagagagggtgctgcgctcg

SEQ ID NO: 679088 - DNA, 20 bp, mouse
gtggtggggtagcttcagtg

SEQ ID NO: 679089 - DNA, 20 bp, mouse
gaagctgtgatcatttgcag

SEQ ID NO: 679090 - DNA, 20 bp, mouse
gcatcagcatcccccgtgtg

SEQ ID NO: 679091 - DNA, 20 bp, mouse
gatcccccgtgtgtggtgaa

SEQ ID NO: 679092 - DNA, 20 bp, mouse
gtaccattcaccacacacgg

SEQ ID NO: 679093 - DNA, 20 bp, mouse
gagagctgagatactgatca

SEQ ID NO: 679094 - DNA, 20 bp, mouse
gaaggctttgagcccagagt

SEQ ID NO: 679095 - DNA, 20 bp, mouse
ggaaacttctttaaaggaag

SEQ ID NO: 679096 - DNA, 20 bp, mouse
gtgggtccaagctcttcaga

SEQ ID NO: 679097 - DNA, 20 bp, mouse
gaagagtactactatgaggt

SEQ ID NO: 679098 - DNA, 20 bp, mouse
gggcaagcaccttccaactg

SEQ ID NO: 679099 - DNA, 20 bp, mouse
ggatctggtagaagagtaga

SEQ ID NO: 679100 - DNA, 20 bp, mouse
gtactcttctaccagatcta

SEQ ID NO: 679101 - DNA, 20 bp, mouse
gacagttgtttggtagagtg

SEQ ID NO: 679102 - DNA, 20 bp, mouse
ggatgaagagtactactatg

SEQ ID NO: 679103 - DNA, 20 bp, mouse
gcctaagcataaaagcccag

SEQ ID NO: 679104 - DNA, 20 bp, mouse
gcatgaattccccagttgga

SEQ ID NO: 679105 - DNA, 20 bp, mouse
gaagtcaccaactaacccag

SEQ ID NO: 679106 - DNA, 20 bp, mouse
gttagtggggagagcatctg

SEQ ID NO: 679107 - DNA, 20 bp, mouse
gcttgggcagcaatgaaaaa

SEQ ID NO: 679108 - DNA, 20 bp, mouse
ggggacgtttggaagatgct

SEQ ID NO: 679109 - DNA, 20 bp, mouse
gcatcttccaaacgtcccta

SEQ ID NO: 679110 - DNA, 20 bp, mouse
gcagcaatgaaaaatggtgt

SEQ ID NO: 679111 - DNA, 20 bp, mouse
gtgatcaggtaccattgcta

SEQ ID NO: 679112 - DNA, 20 bp, mouse
gctccccactaaatatgatc

SEQ ID NO: 679113 - DNA, 20 bp, mouse
gtacctgatcatatttagtg

SEQ ID NO: 679114 - DNA, 20 bp, mouse
gagctgaagagattatgtgt

SEQ ID NO: 679115 - DNA, 20 bp, mouse
gactcccacaggagtctatc

SEQ ID NO: 679116 - DNA, 20 bp, mouse
gtgatcaagaaggtgtgccc

SEQ ID NO: 679117 - DNA, 20 bp, mouse
gaagttgaaaagaaatgagg

SEQ ID NO: 679118 - DNA, 20 bp, mouse
gtggtgattagacatttcat

SEQ ID NO: 679119 - DNA, 20 bp, mouse
gcctgcactctgtgtgaata

SEQ ID NO: 679120 - DNA, 20 bp, mouse
gatgtcaaggctggttgctc

SEQ ID NO: 679121 - DNA, 20 bp, mouse
gaggtttaacatattgatgc

SEQ ID NO: 679122 - DNA, 20 bp, mouse
gtgattagacatttcatagg

SEQ ID NO: 679123 - DNA, 20 bp, mouse
ggtggtggacttgatcaaga

SEQ ID NO: 679124 - DNA, 20 bp, mouse
gttgaaaagaaatgaggtgg

SEQ ID NO: 679125 - DNA, 20 bp, mouse
gagaatacttaataatgtca

SEQ ID NO: 679126 - DNA, 20 bp, mouse
gcctgctcgcgcctggctgg

SEQ ID NO: 679127 - DNA, 20 bp, mouse
gcagcagcggggcttcgtcc

SEQ ID NO: 679128 - DNA, 20 bp, mouse
gctgcctgctcgcgcctggc

SEQ ID NO: 679129 - DNA, 20 bp, mouse
gcctggccggcccttagctg

SEQ ID NO: 679130 - DNA, 20 bp, mouse
gacgggagagaagatggctt

SEQ ID NO: 679131 - DNA, 20 bp, mouse
gtcggccctgtgcagcagcg

SEQ ID NO: 679132 - DNA, 20 bp, mouse
ggcctggagaggttgcggca

SEQ ID NO: 679133 - DNA, 20 bp, mouse
gcacagggccgaggcgtcct

SEQ ID NO: 679134 - DNA, 20 bp, mouse
gctccaaagcaaggacaaaa

SEQ ID NO: 679135 - DNA, 20 bp, mouse
gcgaagccccgctgctgcac

SEQ ID NO: 679136 - DNA, 20 bp, mouse
ggacccaggctgggcgtggg

SEQ ID NO: 679137 - DNA, 20 bp, mouse
gagtcctgattgcccctcaa

SEQ ID NO: 679138 - DNA, 20 bp, mouse
gttagcgtccgttcagggaa

SEQ ID NO: 679139 - DNA, 20 bp, mouse
gcctgaacggacgctaagaa

SEQ ID NO: 679140 - DNA, 20 bp, mouse
gtgactctgcctggaacgga

SEQ ID NO: 679141 - DNA, 20 bp, mouse
ggacccggaagcccctaagc

SEQ ID NO: 679142 - DNA, 20 bp, mouse
gcctccgcccacgcccagcc

SEQ ID NO: 679143 - DNA, 20 bp, mouse
gacgtgctacgggtccgggg

SEQ ID NO: 679144 - DNA, 20 bp, mouse
ggtaaagagagcgagcgaga

SEQ ID NO: 679145 - DNA, 20 bp, mouse
gctaagaagggtttggaggc

SEQ ID NO: 679146 - DNA, 20 bp, mouse
ggaggtgattagttcggaga

SEQ ID NO: 679147 - DNA, 20 bp, mouse
gcccggaagtggtgcaccaa

SEQ ID NO: 679148 - DNA, 20 bp, mouse
gagaacggccgcagatcgga

SEQ ID NO: 679149 - DNA, 20 bp, mouse
gtggatgctgcaaacggata

SEQ ID NO: 679150 - DNA, 20 bp, mouse
gcaacggcccgtccgatctg

SEQ ID NO: 679151 - DNA, 20 bp, mouse
gagcacggcgggcgatagaa

SEQ ID NO: 679152 - DNA, 20 bp, mouse
gcctgcgcccagctacggca

SEQ ID NO: 679153 - DNA, 20 bp, mouse
gtggcgaacgcctgatcctg

SEQ ID NO: 679154 - DNA, 20 bp, mouse
ggtcgcggaggtgattagtt

SEQ ID NO: 679155 - DNA, 20 bp, mouse
gcgcaggcgcactgagctgt

SEQ ID NO: 679156 - DNA, 20 bp, mouse
gccgccaggcggctcggccc

SEQ ID NO: 679157 - DNA, 20 bp, mouse
gcgcctggcgggaacgaccg

SEQ ID NO: 679158 - DNA, 20 bp, mouse
gggcaacaggctgcaggaaa

SEQ ID NO: 679159 - DNA, 20 bp, mouse
ggcccgagacgacgtcataa

SEQ ID NO: 679160 - DNA, 20 bp, mouse
ggggaggggcaacaggctgc

SEQ ID NO: 679161 - DNA, 20 bp, mouse
ggcggctcggccccggggga

SEQ ID NO: 679162 - DNA, 20 bp, mouse
gtcaggagaagcggcgtgag

SEQ ID NO: 679163 - DNA, 20 bp, mouse
gccccttatgacgtcgtctc

SEQ ID NO: 679164 - DNA, 20 bp, mouse
gggcggaggctcaggagaag

SEQ ID NO: 679165 - DNA, 20 bp, mouse
gccggccgcgcgcctcaccg

SEQ ID NO: 679166 - DNA, 20 bp, mouse
gacaaccgagctcacggccc

SEQ ID NO: 679167 - DNA, 20 bp, mouse
gccgccccgggccgtgagct

SEQ ID NO: 679168 - DNA, 20 bp, mouse
gcgggcttccatggggtaac

SEQ ID NO: 679169 - DNA, 20 bp, mouse
gctgtgcccgcaggaagcgg

SEQ ID NO: 679170 - DNA, 20 bp, mouse
gtatctaacgccttccgccc

SEQ ID NO: 679171 - DNA, 20 bp, mouse
gtaccccatggaagcccgat

SEQ ID NO: 679172 - DNA, 20 bp, mouse
ggaccaataggaccatggaa

SEQ ID NO: 679173 - DNA, 20 bp, mouse
gcaagccggaagctgattta

SEQ ID NO: 679174 - DNA, 20 bp, mouse
gcggaagtgtggttcgccag

SEQ ID NO: 679175 - DNA, 20 bp, mouse
gccgggaaaactcgaccaat

SEQ ID NO: 679176 - DNA, 20 bp, mouse
gttaactcccggattattgg

SEQ ID NO: 679177 - DNA, 20 bp, mouse
gagcgcagagcgctcccaga

SEQ ID NO: 679178 - DNA, 20 bp, mouse
gacagcggcgtcatcagttc

SEQ ID NO: 679179 - DNA, 20 bp, mouse
ggcagagcgctcccagaggg

SEQ ID NO: 679180 - DNA, 20 bp, mouse
ggctgcgccccagccggcag

SEQ ID NO: 679181 - DNA, 20 bp, mouse
ggcctcggaaatctggacag

SEQ ID NO: 679182 - DNA, 20 bp, mouse
gtcagccccgcccactgtcc

SEQ ID NO: 679183 - DNA, 20 bp, mouse
gagctcccaggccaatcggg

SEQ ID NO: 679184 - DNA, 20 bp, mouse
gggggctgaggcttaactcc

SEQ ID NO: 679185 - DNA, 20 bp, mouse
gtggcagtcaggcttcagca

SEQ ID NO: 679186 - DNA, 20 bp, mouse
gtgctgggggcaaaacatta

SEQ ID NO: 679187 - DNA, 20 bp, mouse
gagctctgctgggtcataac

SEQ ID NO: 679188 - DNA, 20 bp, mouse
gacttcacatggggagcttg

SEQ ID NO: 679189 - DNA, 20 bp, mouse
gagtgctgaggatctaagct

SEQ ID NO: 679190 - DNA, 20 bp, mouse
gggtcataacaggattacaa

SEQ ID NO: 679191 - DNA, 20 bp, mouse
gactcctggctgacttcaca

SEQ ID NO: 679192 - DNA, 20 bp, mouse
gcaaatatgggtgggtccca

SEQ ID NO: 679193 - DNA, 20 bp, mouse
gaatttctgagtaagactcc

SEQ ID NO: 679194 - DNA, 20 bp, mouse
gtggacaaaatgctaagtct

SEQ ID NO: 679195 - DNA, 20 bp, mouse
gaagagaatcaacaaagcct

SEQ ID NO: 679196 - DNA, 20 bp, mouse
gtcacagtgcccctgaaaac

SEQ ID NO: 679197 - DNA, 20 bp, mouse
ggcactgtgaccctcacaat

SEQ ID NO: 679198 - DNA, 20 bp, mouse
ggaaaagatatcacaagatt

SEQ ID NO: 679199 - DNA, 20 bp, mouse
gtcaactgttgctaagtgag

SEQ ID NO: 679200 - DNA, 20 bp, mouse
gtggggccctttgtttgaaa

SEQ ID NO: 679201 - DNA, 20 bp, mouse
gtcgcgagatcctgttttca

SEQ ID NO: 679202 - DNA, 20 bp, mouse
gacaaagggccccattgtga

SEQ ID NO: 679203 - DNA, 20 bp, mouse
ggagtgggtggtagtattat

SEQ ID NO: 679204 - DNA, 20 bp, mouse
gttagcaacagttgagtggg

SEQ ID NO: 679205 - DNA, 20 bp, mouse
gaaaagatctttacttgagt

SEQ ID NO: 679206 - DNA, 20 bp, mouse
gggagctcgtgcagtagaag

SEQ ID NO: 679207 - DNA, 20 bp, mouse
ggcgccggcgagaccaaggc

SEQ ID NO: 679208 - DNA, 20 bp, mouse
gaggccggggagcggtgcgt

SEQ ID NO: 679209 - DNA, 20 bp, mouse
gtccccccgcagggccgcag

SEQ ID NO: 679210 - DNA, 20 bp, mouse
ggctccccggcctccaactt

SEQ ID NO: 679211 - DNA, 20 bp, mouse
ggggccgcagtggtatgcgc

SEQ ID NO: 679212 - DNA, 20 bp, mouse
gcggctgccgccttccaccc

SEQ ID NO: 679213 - DNA, 20 bp, mouse
gggccctttaaggtcgagcg

SEQ ID NO: 679214 - DNA, 20 bp, mouse
ggcggtgcgtgggcccttta

SEQ ID NO: 679215 - DNA, 20 bp, mouse
ggtgctccgaagttggaggc

SEQ ID NO: 679216 - DNA, 20 bp, mouse
gcagcctgggaggggcgctg

SEQ ID NO: 679217 - DNA, 20 bp, mouse
gcgggggcgggtacagctgg

SEQ ID NO: 679218 - DNA, 20 bp, mouse
gctgggggcgtgtccaggaa

SEQ ID NO: 679219 - DNA, 20 bp, mouse
gcaggggcccagctgcccgc

SEQ ID NO: 679220 - DNA, 20 bp, mouse
gtacagctgggggcgtgtcc

SEQ ID NO: 679221 - DNA, 20 bp, mouse
gcccctgccactccttggcg

SEQ ID NO: 679222 - DNA, 20 bp, mouse
ggcggcgcgctggacgtacg

SEQ ID NO: 679223 - DNA, 20 bp, mouse
gcgcgctggacgtacgcggg

SEQ ID NO: 679224 - DNA, 20 bp, mouse
gccaggctggattcccttcc

SEQ ID NO: 679225 - DNA, 20 bp, mouse
gccggggtacgcgcagggga

SEQ ID NO: 679226 - DNA, 20 bp, mouse
gacagccagcatcctctcgg

SEQ ID NO: 679227 - DNA, 20 bp, mouse
ggggctggcaagaaggcgcg

SEQ ID NO: 679228 - DNA, 20 bp, mouse
ggaagtaggaagaggctcgg

SEQ ID NO: 679229 - DNA, 20 bp, mouse
gcgcgcggccaggacgaggg

SEQ ID NO: 679230 - DNA, 20 bp, mouse
ggagccggtgggcgggggaa

SEQ ID NO: 679231 - DNA, 20 bp, mouse
ggtagtgagaagtatctgta

SEQ ID NO: 679232 - DNA, 20 bp, mouse
gggcgtgccccacgtggaag

SEQ ID NO: 679233 - DNA, 20 bp, mouse
ggctcggcggcgacgggagg

SEQ ID NO: 679234 - DNA, 20 bp, mouse
gccatgtggggttgtgtcat

SEQ ID NO: 679235 - DNA, 20 bp, mouse
gaggcgcgcggccaggacga

SEQ ID NO: 679236 - DNA, 20 bp, mouse
ggggtgggatcccagtcaat

SEQ ID NO: 679237 - DNA, 20 bp, mouse
gaggtgggccctagaaggcg

SEQ ID NO: 679238 - DNA, 20 bp, mouse
ggtagtgcccccagcagccg

SEQ ID NO: 679239 - DNA, 20 bp, mouse
ggacttgcagccaattgact

SEQ ID NO: 679240 - DNA, 20 bp, mouse
gttggtaggtgggccctaga

SEQ ID NO: 679241 - DNA, 20 bp, mouse
gggcgtggcctgatgctaaa

SEQ ID NO: 679242 - DNA, 20 bp, mouse
ggtcctatgggcaggcgggg

SEQ ID NO: 679243 - DNA, 20 bp, mouse
gtacactccagtgctaggaa

SEQ ID NO: 679244 - DNA, 20 bp, mouse
ggcgggccctgatgtcctat

SEQ ID NO: 679245 - DNA, 20 bp, mouse
gatcccaccccggctgctgg

SEQ ID NO: 679246 - DNA, 20 bp, mouse
ggacgcgccgtcactataga

SEQ ID NO: 679247 - DNA, 20 bp, mouse
ggggcgtcagggaccttttg

SEQ ID NO: 679248 - DNA, 20 bp, mouse
gccaccccacgtgaaacact

SEQ ID NO: 679249 - DNA, 20 bp, mouse
ggtaccctggtggatgcaga

SEQ ID NO: 679250 - DNA, 20 bp, mouse
gtttaggagtcagaagcgga

SEQ ID NO: 679251 - DNA, 20 bp, mouse
gggcgcaagtgctcacggga

SEQ ID NO: 679252 - DNA, 20 bp, mouse
gaaggccagtaggctcctta

SEQ ID NO: 679253 - DNA, 20 bp, mouse
gcacgtgaaacactaggatc

SEQ ID NO: 679254 - DNA, 20 bp, mouse
gtccgggcgcaagtgctcac

SEQ ID NO: 679255 - DNA, 20 bp, mouse
gcgatatcccatctagtctg

SEQ ID NO: 679256 - DNA, 20 bp, mouse
ggggccgcgggtgctgataa

SEQ ID NO: 679257 - DNA, 20 bp, mouse
gcggccggcggcgacgaggg

SEQ ID NO: 679258 - DNA, 20 bp, mouse
ggaggggaggggttggcgca

SEQ ID NO: 679259 - DNA, 20 bp, mouse
ggccccggcagcgccgacgc

SEQ ID NO: 679260 - DNA, 20 bp, mouse
gaggcggcctggttcccatt

SEQ ID NO: 679261 - DNA, 20 bp, mouse
gataagggaagagtcgggtg

SEQ ID NO: 679262 - DNA, 20 bp, mouse
ggcagcatgggaggcggccc

SEQ ID NO: 679263 - DNA, 20 bp, mouse
gtgctgataagggaagagtc

SEQ ID NO: 679264 - DNA, 20 bp, mouse
gccccgtgacgccatcgcgc

SEQ ID NO: 679265 - DNA, 20 bp, mouse
gccgcccttcgcagcttgga

SEQ ID NO: 679266 - DNA, 20 bp, mouse
ggacagagttgtggagtctt

SEQ ID NO: 679267 - DNA, 20 bp, mouse
gggggcgctggagtcctcgg

SEQ ID NO: 679268 - DNA, 20 bp, mouse
ggtggggcactgtaatcctg

SEQ ID NO: 679269 - DNA, 20 bp, mouse
gactctgtccctcatccttc

SEQ ID NO: 679270 - DNA, 20 bp, mouse
ggggcgctcgagttttccgg

SEQ ID NO: 679271 - DNA, 20 bp, mouse
ggaagaaaagatggaatcct

SEQ ID NO: 679272 - DNA, 20 bp, mouse
gagggggcgctcgagttttc

SEQ ID NO: 679273 - DNA, 20 bp, mouse
ggaggcatggcagtggatga

SEQ ID NO: 679274 - DNA, 20 bp, mouse
ggtaatcctggggcagatga

SEQ ID NO: 679275 - DNA, 20 bp, mouse
gtctgtccatcatctgcccc

SEQ ID NO: 679276 - DNA, 20 bp, mouse
ggggccgcggcgattctcgg

SEQ ID NO: 679277 - DNA, 20 bp, mouse
gtgcgtaacgctgcaccccg

SEQ ID NO: 679278 - DNA, 20 bp, mouse
ggagggaaacagcaatcccg

SEQ ID NO: 679279 - DNA, 20 bp, mouse
gcacgcgcactaggttactg

SEQ ID NO: 679280 - DNA, 20 bp, mouse
ggggcccccgagaatcgccg

SEQ ID NO: 679281 - DNA, 20 bp, mouse
gctaccggaagtaatgtcag

SEQ ID NO: 679282 - DNA, 20 bp, mouse
ggatcctgacctcggggagg

SEQ ID NO: 679283 - DNA, 20 bp, mouse
gctgcagccccgctcctcag

SEQ ID NO: 679284 - DNA, 20 bp, mouse
ggagaagccaggcgccgtgt

SEQ ID NO: 679285 - DNA, 20 bp, mouse
gggactgtgtacagagactc

SEQ ID NO: 679286 - DNA, 20 bp, mouse
gccacggaccggtgctccgt

SEQ ID NO: 679287 - DNA, 20 bp, mouse
ggatgcgtcaggactagcag

SEQ ID NO: 679288 - DNA, 20 bp, mouse
gggcaaacactcggccctcg

SEQ ID NO: 679289 - DNA, 20 bp, mouse
ggatccgcgtgacatggctg

SEQ ID NO: 679290 - DNA, 20 bp, mouse
ggggcgtgctgcgtcacgga

SEQ ID NO: 679291 - DNA, 20 bp, mouse
ggcgggtgacagaaaacttg

SEQ ID NO: 679292 - DNA, 20 bp, mouse
gagaccacagccatgtcacg

SEQ ID NO: 679293 - DNA, 20 bp, mouse
gggctgtggtctcaacacca

SEQ ID NO: 679294 - DNA, 20 bp, mouse
gggcagcgatccgcgtgaca

SEQ ID NO: 679295 - DNA, 20 bp, mouse
gcggaattcgcagtgtacga

SEQ ID NO: 679296 - DNA, 20 bp, mouse
gggtccggccagcacaccgc

SEQ ID NO: 679297 - DNA, 20 bp, mouse
ggggttgctgcggagatcca

SEQ ID NO: 679298 - DNA, 20 bp, mouse
ggggcgggcctcaagtcccg

SEQ ID NO: 679299 - DNA, 20 bp, mouse
gaaagctgcggcggagtccc

SEQ ID NO: 679300 - DNA, 20 bp, mouse
gagccgcagaacgctcggtc

SEQ ID NO: 679301 - DNA, 20 bp, mouse
ggaagagaggcgacgccccc

SEQ ID NO: 679302 - DNA, 20 bp, mouse
gggcccgcagcggcgggtta

SEQ ID NO: 679303 - DNA, 20 bp, mouse
gctcaagtcccggggctcgg

SEQ ID NO: 679304 - DNA, 20 bp, mouse
gatcacttctggggcccggc

SEQ ID NO: 679305 - DNA, 20 bp, mouse
gtcctcgggcactccccgac

SEQ ID NO: 679306 - DNA, 20 bp, mouse
gtggcccgctcgcagaaagg

SEQ ID NO: 679307 - DNA, 20 bp, mouse
ggtcccggggcctaggacgc

SEQ ID NO: 679308 - DNA, 20 bp, mouse
gcccgctgctcgccggagga

SEQ ID NO: 679309 - DNA, 20 bp, mouse
gggcccccgctgctcgccgg

SEQ ID NO: 679310 - DNA, 20 bp, mouse
gcaagcggggagtggcccgg

SEQ ID NO: 679311 - DNA, 20 bp, mouse
gaccctcctccggcgagcag

SEQ ID NO: 679312 - DNA, 20 bp, mouse
gagaggccggcccaagatct

SEQ ID NO: 679313 - DNA, 20 bp, mouse
gggcctggagcggaacgcgc

SEQ ID NO: 679314 - DNA, 20 bp, mouse
gagcgggccaatcggagtgc

SEQ ID NO: 679315 - DNA, 20 bp, mouse
gcaaacctctgcagggtccg

SEQ ID NO: 679316 - DNA, 20 bp, mouse
gccgccgcccgccggggaga

SEQ ID NO: 679317 - DNA, 20 bp, mouse
gcgcgcgtgcggggcacaga

SEQ ID NO: 679318 - DNA, 20 bp, mouse
gtcggggggcacagcgtgcg

SEQ ID NO: 679319 - DNA, 20 bp, mouse
gggtgcggggccgagtcggg

SEQ ID NO: 679320 - DNA, 20 bp, mouse
gagcgtgcggggtgtggtct

SEQ ID NO: 679321 - DNA, 20 bp, mouse
gcacccctctccccggcggg

SEQ ID NO: 679322 - DNA, 20 bp, mouse
ggactggcctccaccgccgc

SEQ ID NO: 679323 - DNA, 20 bp, mouse
gcgggagagagggagcgcga

SEQ ID NO: 679324 - DNA, 20 bp, mouse
gggaaggaggaaagcgagga

SEQ ID NO: 679325 - DNA, 20 bp, mouse
gcccgcacccctctccccgg

SEQ ID NO: 679326 - DNA, 20 bp, mouse
gacgctccgagccccatcgg

SEQ ID NO: 679327 - DNA, 20 bp, mouse
ggggagggaaggaatgcggg

SEQ ID NO: 679328 - DNA, 20 bp, mouse
gcgggaggcctgggcggcag

SEQ ID NO: 679329 - DNA, 20 bp, mouse
gcgctctggtgagttcccta

SEQ ID NO: 679330 - DNA, 20 bp, mouse
ggggctgcggggtggtcgca

SEQ ID NO: 679331 - DNA, 20 bp, mouse
gaccaccccgcagcccgcta

SEQ ID NO: 679332 - DNA, 20 bp, mouse
gtgggtggagccggcgggaa

SEQ ID NO: 679333 - DNA, 20 bp, mouse
gcatcgggagcgcaaggcac

SEQ ID NO: 679334 - DNA, 20 bp, mouse
gaaagcgttagcagcggagg

SEQ ID NO: 679335 - DNA, 20 bp, mouse
gaggaaagcgttagcagcgg

SEQ ID NO: 679336 - DNA, 20 bp, mouse
gtggcccagagctcagtaac

SEQ ID NO: 679337 - DNA, 20 bp, mouse
gggaaggggccagaattggg

SEQ ID NO: 679338 - DNA, 20 bp, mouse
gccctcctcctcccccggag

SEQ ID NO: 679339 - DNA, 20 bp, mouse
gactgggaaggggccagaat

SEQ ID NO: 679340 - DNA, 20 bp, mouse
gtgcgtgcgagggtctctaa

SEQ ID NO: 679341 - DNA, 20 bp, mouse
gttggggtctgaactatgat

SEQ ID NO: 679342 - DNA, 20 bp, mouse
gaagccggttactgagctct

SEQ ID NO: 679343 - DNA, 20 bp, mouse
gaaaaagggggaaagggcta

SEQ ID NO: 679344 - DNA, 20 bp, mouse
gtaggggcgtggctcgggct

SEQ ID NO: 679345 - DNA, 20 bp, mouse
gccagtctaagctcacaagc

SEQ ID NO: 679346 - DNA, 20 bp, mouse
gaatgacacagacccagcta

SEQ ID NO: 679347 - DNA, 20 bp, mouse
gttgggagggaccaagatga

SEQ ID NO: 679348 - DNA, 20 bp, mouse
gcaagggcgggagaggatta

SEQ ID NO: 679349 - DNA, 20 bp, mouse
ggggaggggagctagtccct

SEQ ID NO: 679350 - DNA, 20 bp, mouse
ggctagaaatagccagcgaa

SEQ ID NO: 679351 - DNA, 20 bp, mouse
gctgggtctgtgtcattctc

SEQ ID NO: 679352 - DNA, 20 bp, mouse
ggcatagaatagagagtttt

SEQ ID NO: 679353 - DNA, 20 bp, mouse
gagctcccctccctcctggg

SEQ ID NO: 679354 - DNA, 20 bp, mouse
gtgggggccttaggggtcta

SEQ ID NO: 679355 - DNA, 20 bp, mouse
gccagtacctgggtccccat

SEQ ID NO: 679356 - DNA, 20 bp, mouse
ggaggaatgtggagtgtcaa

SEQ ID NO: 679357 - DNA, 20 bp, mouse
gcaaggggtcaggatcaatc

SEQ ID NO: 679358 - DNA, 20 bp, mouse
gctgcctcatcaactcacac

SEQ ID NO: 679359 - DNA, 20 bp, mouse
gaatccggtgtgagttgatg

SEQ ID NO: 679360 - DNA, 20 bp, mouse
gggctcgccaaagaactgaa

SEQ ID NO: 679361 - DNA, 20 bp, mouse
gtgccagctttttcagacgg

SEQ ID NO: 679362 - DNA, 20 bp, mouse
gtgtggagtgtcaaggggtc

SEQ ID NO: 679363 - DNA, 20 bp, mouse
gttcctccgtctgaaaaagc

SEQ ID NO: 679364 - DNA, 20 bp, mouse
gagagctgtgtgagactagg

SEQ ID NO: 679365 - DNA, 20 bp, mouse
gaatggagtcctacacaaac

SEQ ID NO: 679366 - DNA, 20 bp, mouse
gaggcggggcaggaacgatc

SEQ ID NO: 679367 - DNA, 20 bp, mouse
ggtgctgaggtgtcccacgt

SEQ ID NO: 679368 - DNA, 20 bp, mouse
ggcacagagcagtgcccacg

SEQ ID NO: 679369 - DNA, 20 bp, mouse
ggacccttgccggaactctg

SEQ ID NO: 679370 - DNA, 20 bp, mouse
gggaactctggggccacgcg

SEQ ID NO: 679371 - DNA, 20 bp, mouse
gagcgcccgcgtctctactc

SEQ ID NO: 679372 - DNA, 20 bp, mouse
gggccccagagttccggcaa

SEQ ID NO: 679373 - DNA, 20 bp, mouse
gccctatcctgcagacaaag

SEQ ID NO: 679374 - DNA, 20 bp, mouse
ggtgctgcacctcagtgctg

SEQ ID NO: 679375 - DNA, 20 bp, mouse
gaggcagcggccctgcttat

SEQ ID NO: 679376 - DNA, 20 bp, mouse
ggggtgctgcagaaccagag

SEQ ID NO: 679377 - DNA, 20 bp, mouse
gaggaatgcagagaccaggc

SEQ ID NO: 679378 - DNA, 20 bp, mouse
gccgcccgcccagacccccg

SEQ ID NO: 679379 - DNA, 20 bp, mouse
ggttctgcagcaccccgcgg

SEQ ID NO: 679380 - DNA, 20 bp, mouse
gaggaggggcgggctagacc

SEQ ID NO: 679381 - DNA, 20 bp, mouse
gagaccaggcaggttgacag

SEQ ID NO: 679382 - DNA, 20 bp, mouse
gcgggctagacccgggaccc

SEQ ID NO: 679383 - DNA, 20 bp, mouse
gaacacgaaggtgattcctg

SEQ ID NO: 679384 - DNA, 20 bp, mouse
ggagggcggcgctcagtgaa

SEQ ID NO: 679385 - DNA, 20 bp, mouse
gcaagctccgggcgtccagg

SEQ ID NO: 679386 - DNA, 20 bp, mouse
gcagttccccggcttccccc

SEQ ID NO: 679387 - DNA, 20 bp, mouse
gagggccccgctaatgcaag

SEQ ID NO: 679388 - DNA, 20 bp, mouse
gcggtgggggacagaactga

SEQ ID NO: 679389 - DNA, 20 bp, mouse
gttagcggggccctccgcgg

SEQ ID NO: 679390 - DNA, 20 bp, mouse
gctggagagctgggaacccg

SEQ ID NO: 679391 - DNA, 20 bp, mouse
ggggacagaactgagggcta

SEQ ID NO: 679392 - DNA, 20 bp, mouse
gtagcaacactactctgtcc

SEQ ID NO: 679393 - DNA, 20 bp, mouse
gtgggaacccgggggaagcc

SEQ ID NO: 679394 - DNA, 20 bp, mouse
gaatgtaggagagtgacgtc

SEQ ID NO: 679395 - DNA, 20 bp, mouse
gccgccatcctaggaaagaa

SEQ ID NO: 679396 - DNA, 20 bp, mouse
gctgatcagacccaaggaac

SEQ ID NO: 679397 - DNA, 20 bp, mouse
gaggaggctggtggtacttg

SEQ ID NO: 679398 - DNA, 20 bp, mouse
gtagagactgatcagaccca

SEQ ID NO: 679399 - DNA, 20 bp, mouse
gcaggctgagtcatacagca

SEQ ID NO: 679400 - DNA, 20 bp, mouse
gctagtgagttattacagac

SEQ ID NO: 679401 - DNA, 20 bp, mouse
gtatgactcagcctgttcct

SEQ ID NO: 679402 - DNA, 20 bp, mouse
gaccgtggacaacaaaatga

SEQ ID NO: 679403 - DNA, 20 bp, mouse
gaataactcactagcgaagc

SEQ ID NO: 679404 - DNA, 20 bp, mouse
gctgacagaagcaccttgag

SEQ ID NO: 679405 - DNA, 20 bp, mouse
gagttgctcttcagagaccg

SEQ ID NO: 679406 - DNA, 20 bp, mouse
gctgaccagacgcaaggact

SEQ ID NO: 679407 - DNA, 20 bp, mouse
gggactaggctgagtcatac

SEQ ID NO: 679408 - DNA, 20 bp, mouse
gtcagcctagtccttgcgtc

SEQ ID NO: 679409 - DNA, 20 bp, mouse
gtagagactgaccagacgca

SEQ ID NO: 679410 - DNA, 20 bp, mouse
gcagcttcacaactacagac

SEQ ID NO: 679411 - DNA, 20 bp, mouse
gaatgtcagtgtctcaactc

SEQ ID NO: 679412 - DNA, 20 bp, mouse
ggaaacactcatcacttacc

SEQ ID NO: 679413 - DNA, 20 bp, mouse
gcaaagctctatggcctgca

SEQ ID NO: 679414 - DNA, 20 bp, mouse
gagactactctgtctatgag

SEQ ID NO: 679415 - DNA, 20 bp, mouse
gatagagctttgtatgcatc

SEQ ID NO: 679416 - DNA, 20 bp, mouse
gcacgtctccaggtcctcag

SEQ ID NO: 679417 - DNA, 20 bp, mouse
gggacgctaagtaagagtac

SEQ ID NO: 679418 - DNA, 20 bp, mouse
gaagcttcgagtcacctctg

SEQ ID NO: 679419 - DNA, 20 bp, mouse
ggacgtaacagctaaaccca

SEQ ID NO: 679420 - DNA, 20 bp, mouse
gagcccctcagtacacaaaa

SEQ ID NO: 679421 - DNA, 20 bp, mouse
gacctggagacgtggagtct

SEQ ID NO: 679422 - DNA, 20 bp, mouse
gtccaagactccacgtctcc

SEQ ID NO: 679423 - DNA, 20 bp, mouse
gttacgagaaaggaagccgt

SEQ ID NO: 679424 - DNA, 20 bp, mouse
gacaaaaaggctctctgttc

SEQ ID NO: 679425 - DNA, 20 bp, mouse
gcagatgactggataaagtt

SEQ ID NO: 679426 - DNA, 20 bp, mouse
gcaaaccaaaaggacttctg

SEQ ID NO: 679427 - DNA, 20 bp, mouse
ggcgcagccggcgctttcta

SEQ ID NO: 679428 - DNA, 20 bp, mouse
gcggagggaggtgccgggaa

SEQ ID NO: 679429 - DNA, 20 bp, mouse
ggagttgccaggctaccttc

SEQ ID NO: 679430 - DNA, 20 bp, mouse
gggagagcctcccacccgga

SEQ ID NO: 679431 - DNA, 20 bp, mouse
gctagggagagcctcccacc

SEQ ID NO: 679432 - DNA, 20 bp, mouse
gagactcagggaacagcctg

SEQ ID NO: 679433 - DNA, 20 bp, mouse
gacccgaacccacgagggga

SEQ ID NO: 679434 - DNA, 20 bp, mouse
ggccaggctaccttccgggt

SEQ ID NO: 679435 - DNA, 20 bp, mouse
gaccggcggtatggaggccg

SEQ ID NO: 679436 - DNA, 20 bp, mouse
gagcgccggaggggagggac

SEQ ID NO: 679437 - DNA, 20 bp, mouse
gctgcccaagcgagcggcag

SEQ ID NO: 679438 - DNA, 20 bp, mouse
gccgcccgggagcgccggag

SEQ ID NO: 679439 - DNA, 20 bp, mouse
gtagcagcccgggcgagtcg

SEQ ID NO: 679440 - DNA, 20 bp, mouse
ggcccgggctgctaaaggat

SEQ ID NO: 679441 - DNA, 20 bp, mouse
ggctcccgggcggcgctccc

SEQ ID NO: 679442 - DNA, 20 bp, mouse
gacggcacctgcgccctctg

SEQ ID NO: 679443 - DNA, 20 bp, mouse
ggcggcccggatcgccgcta

SEQ ID NO: 679444 - DNA, 20 bp, mouse
gcccggatcgccgctagggg

SEQ ID NO: 679445 - DNA, 20 bp, mouse
gtcgtgcccgcgactcgccc

SEQ ID NO: 679446 - DNA, 20 bp, mouse
gcggggagatacaagagtcc

SEQ ID NO: 679447 - DNA, 20 bp, mouse
ggtgggtggtatctaatcct

SEQ ID NO: 679448 - DNA, 20 bp, mouse
gagcttccgaagaagtatgg

SEQ ID NO: 679449 - DNA, 20 bp, mouse
gaagaagtatggaggtctct

SEQ ID NO: 679450 - DNA, 20 bp, mouse
gtagagcttccgaagaagta

SEQ ID NO: 679451 - DNA, 20 bp, mouse
gaaaggggaggttacaagcc

SEQ ID NO: 679452 - DNA, 20 bp, mouse
gcggttccttgttttggatg

SEQ ID NO: 679453 - DNA, 20 bp, mouse
ggaggttacaagccaggggt

SEQ ID NO: 679454 - DNA, 20 bp, mouse
gcagcaacaagttgtcagtg

SEQ ID NO: 679455 - DNA, 20 bp, mouse
gtctagggaatgtatgtgtc

SEQ ID NO: 679456 - DNA, 20 bp, mouse
gtcagtgggcgggacgtaga

SEQ ID NO: 679457 - DNA, 20 bp, mouse
gtggggccgcccaggtatta

SEQ ID NO: 679458 - DNA, 20 bp, mouse
gggtccgcggggtgggacta

SEQ ID NO: 679459 - DNA, 20 bp, mouse
gagaactagctagagttggg

SEQ ID NO: 679460 - DNA, 20 bp, mouse
gtgggactatggcagtggat

SEQ ID NO: 679461 - DNA, 20 bp, mouse
ggggcgtgccaccctagagg

SEQ ID NO: 679462 - DNA, 20 bp, mouse
ggtggggcgtgccaccctag

SEQ ID NO: 679463 - DNA, 20 bp, mouse
gggcagaactagctagagtt

SEQ ID NO: 679464 - DNA, 20 bp, mouse
gcagactatgggtcagtggg

SEQ ID NO: 679465 - DNA, 20 bp, mouse
ggaggcggcgggcaacccgg

SEQ ID NO: 679466 - DNA, 20 bp, mouse
gccggctcggcccctcccgg

SEQ ID NO: 679467 - DNA, 20 bp, mouse
gcgcgcagagcgactcggac

SEQ ID NO: 679468 - DNA, 20 bp, mouse
gtgcgcgtgcgccgccggga

SEQ ID NO: 679469 - DNA, 20 bp, mouse
gcgtccagacgccgctccat

SEQ ID NO: 679470 - DNA, 20 bp, mouse
ggcgcacgcgcagagcgact

SEQ ID NO: 679471 - DNA, 20 bp, mouse
gtccgccgcgcgaggacgag

SEQ ID NO: 679472 - DNA, 20 bp, mouse
gtggacgccccgccccggct

SEQ ID NO: 679473 - DNA, 20 bp, mouse
gagagcgactcggactggcg

SEQ ID NO: 679474 - DNA, 20 bp, mouse
gtggcggggactactttccc

SEQ ID NO: 679475 - DNA, 20 bp, mouse
gctcggacggcgcaggttcg

SEQ ID NO: 679476 - DNA, 20 bp, mouse
gagggaggtaccctgagggg

SEQ ID NO: 679477 - DNA, 20 bp, mouse
ggtgactcacggagaggcgg

SEQ ID NO: 679478 - DNA, 20 bp, mouse
gggagcccctagagcgggaa

SEQ ID NO: 679479 - DNA, 20 bp, mouse
gctcagggtacctccctctg

SEQ ID NO: 679480 - DNA, 20 bp, mouse
ggcgccgaccacgccccaga

SEQ ID NO: 679481 - DNA, 20 bp, mouse
gcctagagcgggaaaggaac

SEQ ID NO: 679482 - DNA, 20 bp, mouse
gagcaagcagcccgccccaa

SEQ ID NO: 679483 - DNA, 20 bp, mouse
gcgtgggcggggtctcgcgg

SEQ ID NO: 679484 - DNA, 20 bp, mouse
gcctccgccggtccctcctc

SEQ ID NO: 679485 - DNA, 20 bp, mouse
gggggtggagcccctagagc

SEQ ID NO: 679486 - DNA, 20 bp, mouse
ggaaaggggcggatacttag

SEQ ID NO: 679487 - DNA, 20 bp, mouse
gaacctgaaggggcggggaa

SEQ ID NO: 679488 - DNA, 20 bp, mouse
gcgcctgtaacctgaagggg

SEQ ID NO: 679489 - DNA, 20 bp, mouse
gcccgccacactgccgtaaa

SEQ ID NO: 679490 - DNA, 20 bp, mouse
gccccgccccttcaggttac

SEQ ID NO: 679491 - DNA, 20 bp, mouse
ggcttccgcctgtaacctga

SEQ ID NO: 679492 - DNA, 20 bp, mouse
gaagcagaattgtcaaaacg

SEQ ID NO: 679493 - DNA, 20 bp, mouse
gacggcagcgcgtcctttta

SEQ ID NO: 679494 - DNA, 20 bp, mouse
gaactcaaaacatatgcctg

SEQ ID NO: 679495 - DNA, 20 bp, mouse
gctgctctactcttggataa

SEQ ID NO: 679496 - DNA, 20 bp, mouse
gaggaaccaggcataaatca

SEQ ID NO: 679497 - DNA, 20 bp, mouse
gacttaggaaagctagggta

SEQ ID NO: 679498 - DNA, 20 bp, mouse
gaggaattactgcagatctg

SEQ ID NO: 679499 - DNA, 20 bp, mouse
gtcctattggaagctcgcag

SEQ ID NO: 679500 - DNA, 20 bp, mouse
gggagctgaccttatccaat

SEQ ID NO: 679501 - DNA, 20 bp, mouse
gggagactatacaatctctg

SEQ ID NO: 679502 - DNA, 20 bp, mouse
gacatcacttaggaaagcta

SEQ ID NO: 679503 - DNA, 20 bp, mouse
ggcccctgcgagcttccaat

SEQ ID NO: 679504 - DNA, 20 bp, mouse
gcaataggaaactttattat

SEQ ID NO: 679505 - DNA, 20 bp, mouse
gtctgttttcccacccagat

SEQ ID NO: 679506 - DNA, 20 bp, mouse
gaggcgccgcgctctctcgg

SEQ ID NO: 679507 - DNA, 20 bp, mouse
gccaccaccgaaacctgccc

SEQ ID NO: 679508 - DNA, 20 bp, mouse
gcacccggggcaggtttcgg

SEQ ID NO: 679509 - DNA, 20 bp, mouse
gggaggaggcggctcaggtt

SEQ ID NO: 679510 - DNA, 20 bp, mouse
gagatgggaggaggcggctc

SEQ ID NO: 679511 - DNA, 20 bp, mouse
gtgggcatgctccgcacccg

SEQ ID NO: 679512 - DNA, 20 bp, mouse
gtcgggtgctgtctgttccc

SEQ ID NO: 679513 - DNA, 20 bp, mouse
gcatgctccgcacccggggc

SEQ ID NO: 679514 - DNA, 20 bp, mouse
gggcggctcaggttgggaga

SEQ ID NO: 679515 - DNA, 20 bp, mouse
gcagtgccgccgagagagcg

SEQ ID NO: 679516 - DNA, 20 bp, mouse
gtggaagggcggaagagcat

SEQ ID NO: 679517 - DNA, 20 bp, mouse
ggacaggggctcggatgtga

SEQ ID NO: 679518 - DNA, 20 bp, mouse
gtaacgcttggtaggggtga

SEQ ID NO: 679519 - DNA, 20 bp, mouse
gggtcccagggtcttcacca

SEQ ID NO: 679520 - DNA, 20 bp, mouse
gcggaagagcataggcacct

SEQ ID NO: 679521 - DNA, 20 bp, mouse
gcaggaggataacgcttggt

SEQ ID NO: 679522 - DNA, 20 bp, mouse
ggtggagagacgacagaagg

SEQ ID NO: 679523 - DNA, 20 bp, mouse
ggcttcaagtcaggtggttc

SEQ ID NO: 679524 - DNA, 20 bp, mouse
gggcgatctagtctcttgta

SEQ ID NO: 679525 - DNA, 20 bp, mouse
gtcactctggagggcagtaa

SEQ ID NO: 679526 - DNA, 20 bp, mouse
gctggtgactcgcatctaac

SEQ ID NO: 679527 - DNA, 20 bp, mouse
gccaggggagggtggggcta

SEQ ID NO: 679528 - DNA, 20 bp, mouse
gagcctgagggaaggcggat

SEQ ID NO: 679529 - DNA, 20 bp, mouse
gtaggcggtgcgcacgcaga

SEQ ID NO: 679530 - DNA, 20 bp, mouse
gccaagcggcccggcctaag

SEQ ID NO: 679531 - DNA, 20 bp, mouse
ggcaaaggccctcagggttc

SEQ ID NO: 679532 - DNA, 20 bp, mouse
gctcgccgcagcttgttgag

SEQ ID NO: 679533 - DNA, 20 bp, mouse
ggcgagagcacgagatgatt

SEQ ID NO: 679534 - DNA, 20 bp, mouse
gaccagcatcctctagacct

SEQ ID NO: 679535 - DNA, 20 bp, mouse
gcccgaggtctagaggatgc

SEQ ID NO: 679536 - DNA, 20 bp, mouse
gaaggggctaggctagtcgt

SEQ ID NO: 679537 - DNA, 20 bp, mouse
gaagctagctaaccacagga

SEQ ID NO: 679538 - DNA, 20 bp, mouse
gctagctaaccacaggaggg

SEQ ID NO: 679539 - DNA, 20 bp, mouse
ggaggggccggcccatactg

SEQ ID NO: 679540 - DNA, 20 bp, mouse
gtaggctagtcgtggggtgg

SEQ ID NO: 679541 - DNA, 20 bp, mouse
gtgggggttcagagcagtcc

SEQ ID NO: 679542 - DNA, 20 bp, mouse
gggcgggagaatccaagcaa

SEQ ID NO: 679543 - DNA, 20 bp, mouse
ggcttcaggccagcccctga

SEQ ID NO: 679544 - DNA, 20 bp, mouse
ggtccaccaccgcaaaaggt

SEQ ID NO: 679545 - DNA, 20 bp, mouse
gtaccaatgaacatgtagat

SEQ ID NO: 679546 - DNA, 20 bp, mouse
ggaaggcgctcggtcaccta

SEQ ID NO: 679547 - DNA, 20 bp, mouse
gcccggaagcactaccagta

SEQ ID NO: 679548 - DNA, 20 bp, mouse
ggcagatgccgcgttcccga

SEQ ID NO: 679549 - DNA, 20 bp, mouse
ggctctgatgcgtccttctt

SEQ ID NO: 679550 - DNA, 20 bp, mouse
gaacgcggcatctgccgcta

SEQ ID NO: 679551 - DNA, 20 bp, mouse
gaccactccccgctccggcg

SEQ ID NO: 679552 - DNA, 20 bp, mouse
gacagacccgcgccggagcg

SEQ ID NO: 679553 - DNA, 20 bp, mouse
gaggcgggcggagctcgcgt

SEQ ID NO: 679554 - DNA, 20 bp, mouse
gccgcgttcccgaaggcgct

SEQ ID NO: 679555 - DNA, 20 bp, mouse
gaaaccacgcctctatgggc

SEQ ID NO: 679556 - DNA, 20 bp, mouse
gggccactaccaatgttcat

SEQ ID NO: 679557 - DNA, 20 bp, mouse
ggtagtggccagcatcccca

SEQ ID NO: 679558 - DNA, 20 bp, mouse
gtctctggataacagggagg

SEQ ID NO: 679559 - DNA, 20 bp, mouse
gcctgcattgcccaacccat

SEQ ID NO: 679560 - DNA, 20 bp, mouse
gggaggcccaagtgagttga

SEQ ID NO: 679561 - DNA, 20 bp, mouse
gtaacagtgcccatgaacat

SEQ ID NO: 679562 - DNA, 20 bp, mouse
gtgcccatgaacattggtag

SEQ ID NO: 679563 - DNA, 20 bp, mouse
ggcggggcttgaggacccta

SEQ ID NO: 679564 - DNA, 20 bp, mouse
gctcttgcccacagagccct

SEQ ID NO: 679565 - DNA, 20 bp, mouse
gagccaacaagacagtgata

SEQ ID NO: 679566 - DNA, 20 bp, mouse
gaagcatggggtttccaagg

SEQ ID NO: 679567 - DNA, 20 bp, mouse
gcatgtggaactgaactcca

SEQ ID NO: 679568 - DNA, 20 bp, mouse
gatgctctgacagaaaaagg

SEQ ID NO: 679569 - DNA, 20 bp, mouse
gggaaaggccttgtccggac

SEQ ID NO: 679570 - DNA, 20 bp, mouse
ggttagggaaaggccttgtc

SEQ ID NO: 679571 - DNA, 20 bp, mouse
gtataggcatccgagacagg

SEQ ID NO: 679572 - DNA, 20 bp, mouse
gggctgaatgcactccacct

SEQ ID NO: 679573 - DNA, 20 bp, mouse
ggtggttggctagaagcatg

SEQ ID NO: 679574 - DNA, 20 bp, mouse
ggtggcctcacctcctgtct

SEQ ID NO: 679575 - DNA, 20 bp, mouse
gcaaggcctttccctaacct

SEQ ID NO: 679576 - DNA, 20 bp, mouse
gaagccaaggtttggaaaga

SEQ ID NO: 679577 - DNA, 20 bp, mouse
gggtgattcagaaagtcaat

SEQ ID NO: 679578 - DNA, 20 bp, mouse
gactgggtaccaaggacata

SEQ ID NO: 679579 - DNA, 20 bp, mouse
gacccagtggtcaacacttg

SEQ ID NO: 679580 - DNA, 20 bp, mouse
gagtggtcaacacttgaggt

SEQ ID NO: 679581 - DNA, 20 bp, mouse
gtcaatgggaagccaaggtt

SEQ ID NO: 679582 - DNA, 20 bp, mouse
gaagtcttgggcctgagact

SEQ ID NO: 679583 - DNA, 20 bp, mouse
gtctgccaggaaggccaggg

SEQ ID NO: 679584 - DNA, 20 bp, mouse
gagcatgggggtgttatgac

SEQ ID NO: 679585 - DNA, 20 bp, mouse
gaagtgagaacctcacacct

SEQ ID NO: 679586 - DNA, 20 bp, mouse
gcatatggtacttgtcccaa

SEQ ID NO: 679587 - DNA, 20 bp, mouse
gcccaggtgtgtgttctcct

SEQ ID NO: 679588 - DNA, 20 bp, mouse
ggctgtgcaatgatgtgatt

SEQ ID NO: 679589 - DNA, 20 bp, mouse
gaaaagccagacagtttaag

SEQ ID NO: 679590 - DNA, 20 bp, mouse
gaatttgataggaatcttta

SEQ ID NO: 679591 - DNA, 20 bp, mouse
gtataaagagttgttggccc

SEQ ID NO: 679592 - DNA, 20 bp, mouse
gaatgatgtgattaggcttc

SEQ ID NO: 679593 - DNA, 20 bp, mouse
gttataatgaaatgaggtat

SEQ ID NO: 679594 - DNA, 20 bp, mouse
gtcctaggagaacacacacc

SEQ ID NO: 679595 - DNA, 20 bp, mouse
gtaaaatggagaagttcttg

SEQ ID NO: 679596 - DNA, 20 bp, mouse
gttagtttgtgctaatgggg

SEQ ID NO: 679597 - DNA, 20 bp, mouse
gcaccagccagcaaaatgtt

SEQ ID NO: 679598 - DNA, 20 bp, mouse
gttaggtataatgtgatcca

SEQ ID NO: 679599 - DNA, 20 bp, mouse
ggtgcaacctctgtgtacag

SEQ ID NO: 679600 - DNA, 20 bp, mouse
gactaagaggggggaataaa

SEQ ID NO: 679601 - DNA, 20 bp, mouse
gtgaagttgaagactaagag

SEQ ID NO: 679602 - DNA, 20 bp, mouse
gccaaggttcgttttctcac

SEQ ID NO: 679603 - DNA, 20 bp, mouse
gtggttactgaaccttacat

SEQ ID NO: 679604 - DNA, 20 bp, mouse
gggattaggcccccaggcta

SEQ ID NO: 679605 - DNA, 20 bp, mouse
gtggtcccatttcttagtcc

SEQ ID NO: 679606 - DNA, 20 bp, mouse
gtgatcttacctatcctgga

SEQ ID NO: 679607 - DNA, 20 bp, mouse
gaggaaaaggttgatgaggt

SEQ ID NO: 679608 - DNA, 20 bp, mouse
gtatcctggaggggtggatg

SEQ ID NO: 679609 - DNA, 20 bp, mouse
gagcccacatccacccctcc

SEQ ID NO: 679610 - DNA, 20 bp, mouse
gcttacctatcctggagggg

SEQ ID NO: 679611 - DNA, 20 bp, mouse
gggcttcctttagtgtaatg

SEQ ID NO: 679612 - DNA, 20 bp, mouse
gtctgtaatgttctctgtga

SEQ ID NO: 679613 - DNA, 20 bp, mouse
ggccaattggtagaaggaaa

SEQ ID NO: 679614 - DNA, 20 bp, mouse
gcagaaacacctttaggcta

SEQ ID NO: 679615 - DNA, 20 bp, mouse
gctataagggtcactggatc

SEQ ID NO: 679616 - DNA, 20 bp, mouse
gatcctgaagggttgagtgt

SEQ ID NO: 679617 - DNA, 20 bp, mouse
gtgatcccatctatcctgaa

SEQ ID NO: 679618 - DNA, 20 bp, mouse
gtgaccctgtggattgtaac

SEQ ID NO: 679619 - DNA, 20 bp, mouse
gtagcttgaagctgaccctg

SEQ ID NO: 679620 - DNA, 20 bp, mouse
gtcaacccttcaggatagat

SEQ ID NO: 679621 - DNA, 20 bp, mouse
ggatcctgttacaatccaca

SEQ ID NO: 679622 - DNA, 20 bp, mouse
gtgcactatcatgtgatacg

SEQ ID NO: 679623 - DNA, 20 bp, mouse
gcaattgcaaatcagaggaa

SEQ ID NO: 679624 - DNA, 20 bp, mouse
gcaggacaggagcgcaagta

SEQ ID NO: 679625 - DNA, 20 bp, mouse
gcaattgtggtgactggatt

SEQ ID NO: 679626 - DNA, 20 bp, mouse
ggccctgaaggttattagtc

SEQ ID NO: 679627 - DNA, 20 bp, mouse
gaaggggtccccaggagcct

SEQ ID NO: 679628 - DNA, 20 bp, mouse
ggctcctggggaccccttac

SEQ ID NO: 679629 - DNA, 20 bp, mouse
gccaggcgggcccacagcca

SEQ ID NO: 679630 - DNA, 20 bp, mouse
ggaaccagaaggtcactcca

SEQ ID NO: 679631 - DNA, 20 bp, mouse
gagggtgtctcagtcaacta

SEQ ID NO: 679632 - DNA, 20 bp, mouse
gaccaagatcacctgatctc

SEQ ID NO: 679633 - DNA, 20 bp, mouse
gagtcagggtgccagagatc

SEQ ID NO: 679634 - DNA, 20 bp, mouse
gcacccctggagtgaccttc

SEQ ID NO: 679635 - DNA, 20 bp, mouse
gccacccagtcctacgtgtt

SEQ ID NO: 679636 - DNA, 20 bp, mouse
gagccagcggggccttcccg

SEQ ID NO: 679637 - DNA, 20 bp, mouse
gcagctccgccctccgctgg

SEQ ID NO: 679638 - DNA, 20 bp, mouse
gcgcacagagatgctctcca

SEQ ID NO: 679639 - DNA, 20 bp, mouse
gcggagctgcgcgggtactt

SEQ ID NO: 679640 - DNA, 20 bp, mouse
gcagagtcccgggatgaagg

SEQ ID NO: 679641 - DNA, 20 bp, mouse
gacacagcttgcagagtccc

SEQ ID NO: 679642 - DNA, 20 bp, mouse
gtctgcaggtaccctgcact

SEQ ID NO: 679643 - DNA, 20 bp, mouse
gggaaggccccgctggctcg

SEQ ID NO: 679644 - DNA, 20 bp, mouse
gagagcatctctgtgcgaaa

SEQ ID NO: 679645 - DNA, 20 bp, mouse
gcaaaccaccagtttctttt

SEQ ID NO: 679646 - DNA, 20 bp, mouse
gtaggtgaggcagcacgagg

SEQ ID NO: 679647 - DNA, 20 bp, mouse
gcgtggagtgactgagatgt

SEQ ID NO: 679648 - DNA, 20 bp, mouse
gcggcgaggctgtgaggacg

SEQ ID NO: 679649 - DNA, 20 bp, mouse
gggtgagaacagaatgaggt

SEQ ID NO: 679650 - DNA, 20 bp, mouse
gagtgactgagatgtaggga

SEQ ID NO: 679651 - DNA, 20 bp, mouse
ggaaaggcagaggtccccaa

SEQ ID NO: 679652 - DNA, 20 bp, mouse
ggacagggtgtgactaggtg

SEQ ID NO: 679653 - DNA, 20 bp, mouse
gggcaccactaggaggaaga

SEQ ID NO: 679654 - DNA, 20 bp, mouse
ggtccgcggggcggggttac

SEQ ID NO: 679655 - DNA, 20 bp, mouse
gaaacccagggtccgcgggg

SEQ ID NO: 679656 - DNA, 20 bp, mouse
gcgcaggcgtgccctactcc

SEQ ID NO: 679657 - DNA, 20 bp, mouse
ggttcccgagagccgtgcgt

SEQ ID NO: 679658 - DNA, 20 bp, mouse
gactggatacaggtcacgtg

SEQ ID NO: 679659 - DNA, 20 bp, mouse
gcaggcccggaagcatccag

SEQ ID NO: 679660 - DNA, 20 bp, mouse
gtgcgcccgggcagtgttgg

SEQ ID NO: 679661 - DNA, 20 bp, mouse
gcgcgcccgcccactttcct

SEQ ID NO: 679662 - DNA, 20 bp, mouse
gcccgggcagtgttggaggc

SEQ ID NO: 679663 - DNA, 20 bp, mouse
gaacgggtcacgtgagacgc

SEQ ID NO: 679664 - DNA, 20 bp, mouse
ggtagggcacgcctgcgccc

SEQ ID NO: 679665 - DNA, 20 bp, mouse
ggtgagacgcgggcgagggg

SEQ ID NO: 679666 - DNA, 20 bp, mouse
ggggacccaggggcagacaa

SEQ ID NO: 679667 - DNA, 20 bp, mouse
ggctccccaagcataagaaa

SEQ ID NO: 679668 - DNA, 20 bp, mouse
ggactccagaccttatcatt

SEQ ID NO: 679669 - DNA, 20 bp, mouse
gacgtcccttgtctgcccct

SEQ ID NO: 679670 - DNA, 20 bp, mouse
gcttatgcttggggagctaa

SEQ ID NO: 679671 - DNA, 20 bp, mouse
ggtctgaggacccaatgata

SEQ ID NO: 679672 - DNA, 20 bp, mouse
gaggacccaatgataaggtc

SEQ ID NO: 679673 - DNA, 20 bp, mouse
gagcataagaaagggaccca

SEQ ID NO: 679674 - DNA, 20 bp, mouse
gagactgggcagggcaggtc

SEQ ID NO: 679675 - DNA, 20 bp, mouse
gacctgtggtgagcaagcac

SEQ ID NO: 679676 - DNA, 20 bp, mouse
gaagtcaagtaaaggaaggt

SEQ ID NO: 679677 - DNA, 20 bp, mouse
gacaaatgaagttgtgagac

SEQ ID NO: 679678 - DNA, 20 bp, mouse
gccctgtgtgactccagaag

SEQ ID NO: 679679 - DNA, 20 bp, mouse
gcagggcatctgcagttctg

SEQ ID NO: 679680 - DNA, 20 bp, mouse
gaccgcttctggagtcacac

SEQ ID NO: 679681 - DNA, 20 bp, mouse
gtctaattcccctgtgtgag

SEQ ID NO: 679682 - DNA, 20 bp, mouse
gtcagctacatactgactcg

SEQ ID NO: 679683 - DNA, 20 bp, mouse
gcggttagaaagatcaggcg

SEQ ID NO: 679684 - DNA, 20 bp, mouse
gagacgggcatacagttttt

SEQ ID NO: 679685 - DNA, 20 bp, mouse
gacagttttttggcacttac

SEQ ID NO: 679686 - DNA, 20 bp, mouse
gacggggtgcgggatgcggg

SEQ ID NO: 679687 - DNA, 20 bp, mouse
gcacgtggaccacggggtgc

SEQ ID NO: 679688 - DNA, 20 bp, mouse
ggaacgccggggcggccaat

SEQ ID NO: 679689 - DNA, 20 bp, mouse
ggaccacggggtgcgggatg

SEQ ID NO: 679690 - DNA, 20 bp, mouse
gacgcgaggcacgtggacca

SEQ ID NO: 679691 - DNA, 20 bp, mouse
gtaaccatggcagacctgtg

SEQ ID NO: 679692 - DNA, 20 bp, mouse
gtacagatgactctgataag

SEQ ID NO: 679693 - DNA, 20 bp, mouse
gtgacctcacaggtctgcca

SEQ ID NO: 679694 - DNA, 20 bp, mouse
ggcgcgcaagcgccaggaat

SEQ ID NO: 679695 - DNA, 20 bp, mouse
ggccaggaatcggtgcccat

SEQ ID NO: 679696 - DNA, 20 bp, mouse
gtgccagtgatcggggagaa

SEQ ID NO: 679697 - DNA, 20 bp, mouse
gtgggacaccacatgggcgt

SEQ ID NO: 679698 - DNA, 20 bp, mouse
gaaggacacggcaactgtgt

SEQ ID NO: 679699 - DNA, 20 bp, mouse
gctccccgatcactggcagt

SEQ ID NO: 679700 - DNA, 20 bp, mouse
gtccttgctgacagcaaaat

SEQ ID NO: 679701 - DNA, 20 bp, mouse
gactgcgtgtacggtgaact

SEQ ID NO: 679702 - DNA, 20 bp, mouse
gccaggggaggataaaagtc

SEQ ID NO: 679703 - DNA, 20 bp, mouse
gcaccaactgccagtgatcg

SEQ ID NO: 679704 - DNA, 20 bp, mouse
gcaaagacctcactcttcgc

SEQ ID NO: 679705 - DNA, 20 bp, mouse
gctcccttctccccgatcac

SEQ ID NO: 679706 - DNA, 20 bp, mouse
gttgggaagaagggttctca

SEQ ID NO: 679707 - DNA, 20 bp, mouse
gagacggagttaccagagat

SEQ ID NO: 679708 - DNA, 20 bp, mouse
gggggacagacaggaaactg

SEQ ID NO: 679709 - DNA, 20 bp, mouse
gcccaagagcaggagtgtaa

SEQ ID NO: 679710 - DNA, 20 bp, mouse
gcaagctatagggaaggcca

SEQ ID NO: 679711 - DNA, 20 bp, mouse
gctcctgctcttgggaagaa

SEQ ID NO: 679712 - DNA, 20 bp, mouse
gttggcagggactagccttc

SEQ ID NO: 679713 - DNA, 20 bp, mouse
gctagtccctgccaagtggg

SEQ ID NO: 679714 - DNA, 20 bp, mouse
gagggaaggccagggagcta

SEQ ID NO: 679715 - DNA, 20 bp, mouse
gaggctagtccctgccaagt

SEQ ID NO: 679716 - DNA, 20 bp, mouse
gtagctccccactgtcaaca

SEQ ID NO: 679717 - DNA, 20 bp, mouse
ggggccctgtccacatgctt

SEQ ID NO: 679718 - DNA, 20 bp, mouse
gagaaggttgagcttgacgc

SEQ ID NO: 679719 - DNA, 20 bp, mouse
gatacaaagagcaggactga

SEQ ID NO: 679720 - DNA, 20 bp, mouse
gaggttgaccctgttgacag

SEQ ID NO: 679721 - DNA, 20 bp, mouse
gaacatgatccaagacctag

SEQ ID NO: 679722 - DNA, 20 bp, mouse
gccggggaacacaacatccc

SEQ ID NO: 679723 - DNA, 20 bp, mouse
gggttgagcttgacgctgga

SEQ ID NO: 679724 - DNA, 20 bp, mouse
gtgtcagggtgtaacaatgc

SEQ ID NO: 679725 - DNA, 20 bp, mouse
gctcaagtcccagtgcctgg

SEQ ID NO: 679726 - DNA, 20 bp, mouse
gtggctggaaaatctggata

SEQ ID NO: 679727 - DNA, 20 bp, mouse
gaggaagaatggagacaact

SEQ ID NO: 679728 - DNA, 20 bp, mouse
gagtcagggataggatgaaa

SEQ ID NO: 679729 - DNA, 20 bp, mouse
gtatggctgtacatcaaggg

SEQ ID NO: 679730 - DNA, 20 bp, mouse
gcagggataggatgaaaagg

SEQ ID NO: 679731 - DNA, 20 bp, mouse
gacttagcagctatccacac

SEQ ID NO: 679732 - DNA, 20 bp, mouse
gtggaaaatctggataaggg

SEQ ID NO: 679733 - DNA, 20 bp, mouse
gcagcagtggctggaaaatc

SEQ ID NO: 679734 - DNA, 20 bp, mouse
gcggaagtcaactccagcag

SEQ ID NO: 679735 - DNA, 20 bp, mouse
gttggaaatggtgcagagta

SEQ ID NO: 679736 - DNA, 20 bp, mouse
gtggtgcaagccttggggcg

SEQ ID NO: 679737 - DNA, 20 bp, mouse
ggggcgaggctgatccactt

SEQ ID NO: 679738 - DNA, 20 bp, mouse
gcacgcgcccggactcccgc

SEQ ID NO: 679739 - DNA, 20 bp, mouse
ggaggctgatccactttgga

SEQ ID NO: 679740 - DNA, 20 bp, mouse
gtccgggcgcgtgacgccgc

SEQ ID NO: 679741 - DNA, 20 bp, mouse
gaaaaggaaaggtatggctg

SEQ ID NO: 679742 - DNA, 20 bp, mouse
gcccgcccccgccccgtcat

SEQ ID NO: 679743 - DNA, 20 bp, mouse
ggtggatcagcctcgcccca

SEQ ID NO: 679744 - DNA, 20 bp, mouse
gaggacaggttacgacccgg

SEQ ID NO: 679745 - DNA, 20 bp, mouse
gcagaaccaaggcaccacgc

SEQ ID NO: 679746 - DNA, 20 bp, mouse
gcagggaggaacaactgagc

SEQ ID NO: 679747 - DNA, 20 bp, mouse
gcattgggtgtaagctttct

SEQ ID NO: 679748 - DNA, 20 bp, mouse
gtctatggggaagcagggtt

SEQ ID NO: 679749 - DNA, 20 bp, mouse
gtgctcacccagtcaaatgc

SEQ ID NO: 679750 - DNA, 20 bp, mouse
gtatcctggagccacagttt

SEQ ID NO: 679751 - DNA, 20 bp, mouse
gcacccagtcaaatgcaggg

SEQ ID NO: 679752 - DNA, 20 bp, mouse
ggactcatactttcctaaac

SEQ ID NO: 679753 - DNA, 20 bp, mouse
gtgagaaagtgctctcacag

SEQ ID NO: 679754 - DNA, 20 bp, mouse
ggctttcttggtggactgtg

SEQ ID NO: 679755 - DNA, 20 bp, mouse
gctctactctatggggaagc

SEQ ID NO: 679756 - DNA, 20 bp, mouse
gatatgctacttgtcccgaa

SEQ ID NO: 679757 - DNA, 20 bp, mouse
gtctgctacaccttgagggc

SEQ ID NO: 679758 - DNA, 20 bp, mouse
gatcctagaaaaacacacct

SEQ ID NO: 679759 - DNA, 20 bp, mouse
gtaaatggagagtctattgt

SEQ ID NO: 679760 - DNA, 20 bp, mouse
gtgtgcaatgattagccttc

SEQ ID NO: 679761 - DNA, 20 bp, mouse
gtccaagttgttgatttatc

SEQ ID NO: 679762 - DNA, 20 bp, mouse
gtttatcaggaatgtggtat

SEQ ID NO: 679763 - DNA, 20 bp, mouse
gttagggaactccgagaact

SEQ ID NO: 679764 - DNA, 20 bp, mouse
gctttgataggaatctatat

SEQ ID NO: 679765 - DNA, 20 bp, mouse
gtgactgagcagagagttgc

SEQ ID NO: 679766 - DNA, 20 bp, mouse
ggagcttttgtgctgttatt

SEQ ID NO: 679767 - DNA, 20 bp, mouse
ggtgcacaggacacaggcag

SEQ ID NO: 679768 - DNA, 20 bp, mouse
gtctgcttctgggcgtgcac

SEQ ID NO: 679769 - DNA, 20 bp, mouse
gtgtgctgttattgggcatc

SEQ ID NO: 679770 - DNA, 20 bp, mouse
gaagaaaccgaaagagaaag

SEQ ID NO: 679771 - DNA, 20 bp, mouse
gctctttcttattaagtaag

SEQ ID NO: 679772 - DNA, 20 bp, mouse
gtgtgtaaattgaactcagc

SEQ ID NO: 679773 - DNA, 20 bp, mouse
ggtgaaacaaagaaaagcac

SEQ ID NO: 679774 - DNA, 20 bp, mouse
gtcattacaaacttcggaag

SEQ ID NO: 679775 - DNA, 20 bp, mouse
gagaactgcacaatatcttg

SEQ ID NO: 679776 - DNA, 20 bp, mouse
gtagcctacagctatgtcaa

SEQ ID NO: 679777 - DNA, 20 bp, mouse
ggtccctttgacatagctgt

SEQ ID NO: 679778 - DNA, 20 bp, mouse
gtgatccaaggcctacagga

SEQ ID NO: 679779 - DNA, 20 bp, mouse
gacccgcccctacttttgat

SEQ ID NO: 679780 - DNA, 20 bp, mouse
gataaatctgaagtatctgt

SEQ ID NO: 679781 - DNA, 20 bp, mouse
gctgaagtcccagtgcctag

SEQ ID NO: 679782 - DNA, 20 bp, mouse
gagccaatcaaaagtagggg

SEQ ID NO: 679783 - DNA, 20 bp, mouse
gtctagtatattgtgatcca

SEQ ID NO: 679784 - DNA, 20 bp, mouse
gaagtagatagccatcctgt

SEQ ID NO: 679785 - DNA, 20 bp, mouse
gtttacaggaaacccaatca

SEQ ID NO: 679786 - DNA, 20 bp, mouse
gtcagactgtatctctggag

SEQ ID NO: 679787 - DNA, 20 bp, mouse
gccaaaagaggccagagttg

SEQ ID NO: 679788 - DNA, 20 bp, mouse
gtactgactaagtccaaacc

SEQ ID NO: 679789 - DNA, 20 bp, mouse
gcccccgattataaagtgta

SEQ ID NO: 679790 - DNA, 20 bp, mouse
gactctggcctcttttggat

SEQ ID NO: 679791 - DNA, 20 bp, mouse
gaatgtttcaaagtccacag

SEQ ID NO: 679792 - DNA, 20 bp, mouse
gcttcaggcactcctacctc

SEQ ID NO: 679793 - DNA, 20 bp, mouse
gttaccctacactttataat

SEQ ID NO: 679794 - DNA, 20 bp, mouse
gaacacagccaatccaaaag

SEQ ID NO: 679795 - DNA, 20 bp, mouse
gcttacaaagtctactgtat

SEQ ID NO: 679796 - DNA, 20 bp, mouse
gccagagggctccatggtag

SEQ ID NO: 679797 - DNA, 20 bp, mouse
ggccctctccttctcacctt

SEQ ID NO: 679798 - DNA, 20 bp, mouse
gggaccaccaaaatgacaca

SEQ ID NO: 679799 - DNA, 20 bp, mouse
ggataagacagggcttccta

SEQ ID NO: 679800 - DNA, 20 bp, mouse
gcaccaaaatgacacagggt

SEQ ID NO: 679801 - DNA, 20 bp, mouse
ggctgaggtcattctattga

SEQ ID NO: 679802 - DNA, 20 bp, mouse
gatcaggcgcctcaaatctc

SEQ ID NO: 679803 - DNA, 20 bp, mouse
gacatgaagcatccacaatg

SEQ ID NO: 679804 - DNA, 20 bp, mouse
gagaaccgatgtgaataaaa

SEQ ID NO: 679805 - DNA, 20 bp, mouse
gattcacatcggttctgaga

SEQ ID NO: 679806 - DNA, 20 bp, mouse
ggggctggagaaaccacgag

SEQ ID NO: 679807 - DNA, 20 bp, mouse
gcaggctccaaactattctg

SEQ ID NO: 679808 - DNA, 20 bp, mouse
gacagggagccaaatctcag

SEQ ID NO: 679809 - DNA, 20 bp, mouse
ggctgctttcgaaaagaaat

SEQ ID NO: 679810 - DNA, 20 bp, mouse
gcccgccccacattcccgaa

SEQ ID NO: 679811 - DNA, 20 bp, mouse
gggggaaaccaggcttaggg

SEQ ID NO: 679812 - DNA, 20 bp, mouse
ggtatccagacagtgatgag

SEQ ID NO: 679813 - DNA, 20 bp, mouse
gaaaccacgagggggaaacc

SEQ ID NO: 679814 - DNA, 20 bp, mouse
gaaagcagctcttggctgtc

SEQ ID NO: 679815 - DNA, 20 bp, mouse
gtagactaagctggaaaggg

SEQ ID NO: 679816 - DNA, 20 bp, mouse
gacgccccgcccggtccttt

SEQ ID NO: 679817 - DNA, 20 bp, mouse
ggaggcagattatctcctgg

SEQ ID NO: 679818 - DNA, 20 bp, mouse
gggtcgggtcaagaggtcga

SEQ ID NO: 679819 - DNA, 20 bp, mouse
gaaccggatcagcagaacct

SEQ ID NO: 679820 - DNA, 20 bp, mouse
gctcggggtgtgtccaactt

SEQ ID NO: 679821 - DNA, 20 bp, mouse
gggggaaggccccgccctcg

SEQ ID NO: 679822 - DNA, 20 bp, mouse
gcccgcaggcccacgcgctc

SEQ ID NO: 679823 - DNA, 20 bp, mouse
gcggggcgtcccgagcgcgt

SEQ ID NO: 679824 - DNA, 20 bp, mouse
gtggtggcactgtcaggtct

SEQ ID NO: 679825 - DNA, 20 bp, mouse
gtcagtccgtgttatcacaa

SEQ ID NO: 679826 - DNA, 20 bp, mouse
ggggcagaaggacagattgg

SEQ ID NO: 679827 - DNA, 20 bp, mouse
gccgagctgcctatgagtcc

SEQ ID NO: 679828 - DNA, 20 bp, mouse
gggtgggtagaagattgaca

SEQ ID NO: 679829 - DNA, 20 bp, mouse
gacacagttccaggactcat

SEQ ID NO: 679830 - DNA, 20 bp, mouse
ggggacggcctggaataggg

SEQ ID NO: 679831 - DNA, 20 bp, mouse
gtggatacatggttggaagc

SEQ ID NO: 679832 - DNA, 20 bp, mouse
ggctgtgtagatccatgcgt

SEQ ID NO: 679833 - DNA, 20 bp, mouse
gggcggggacggcctggaat

SEQ ID NO: 679834 - DNA, 20 bp, mouse
ggctagatgagtgggtgtat

SEQ ID NO: 679835 - DNA, 20 bp, mouse
gtgcagggtggatacatggt

SEQ ID NO: 679836 - DNA, 20 bp, mouse
gatagaagtgtgcactgcaa

SEQ ID NO: 679837 - DNA, 20 bp, mouse
ggcttccaggaatggggaca

SEQ ID NO: 679838 - DNA, 20 bp, mouse
gtcctgggcgcctgctctac

SEQ ID NO: 679839 - DNA, 20 bp, mouse
ggcagatgagaataaggccc

SEQ ID NO: 679840 - DNA, 20 bp, mouse
gacagtcttcgcaccagcca

SEQ ID NO: 679841 - DNA, 20 bp, mouse
gatgagaataaggccctggc

SEQ ID NO: 679842 - DNA, 20 bp, mouse
gcctgtgactccctggatca

SEQ ID NO: 679843 - DNA, 20 bp, mouse
gcccagtagagcaggcgccc

SEQ ID NO: 679844 - DNA, 20 bp, mouse
ggggcatgcttccaggaatg

SEQ ID NO: 679845 - DNA, 20 bp, mouse
gcaagagaacaaaccacgat

SEQ ID NO: 679846 - DNA, 20 bp, mouse
gtcgaggggaccaaacaccg

SEQ ID NO: 679847 - DNA, 20 bp, mouse
gcggcctcgcgctggtgtcg

SEQ ID NO: 679848 - DNA, 20 bp, mouse
gtggtcccgtgggagcgact

SEQ ID NO: 679849 - DNA, 20 bp, mouse
gggccagcccgtcgcctcga

SEQ ID NO: 679850 - DNA, 20 bp, mouse
gagggggcggccgagctccc

SEQ ID NO: 679851 - DNA, 20 bp, mouse
ggagatgcgcggcctcgcgc

SEQ ID NO: 679852 - DNA, 20 bp, mouse
gagcgactgggctagcgggt

SEQ ID NO: 679853 - DNA, 20 bp, mouse
gcagggttaagcggcagggg

SEQ ID NO: 679854 - DNA, 20 bp, mouse
gcagcccgtcgcctcgaggg

SEQ ID NO: 679855 - DNA, 20 bp, mouse
gctagcccagtcgctcccac

SEQ ID NO: 679856 - DNA, 20 bp, mouse
gacccgccggcggcagtgac

SEQ ID NO: 679857 - DNA, 20 bp, mouse
gccaccacaaggtgttccca

SEQ ID NO: 679858 - DNA, 20 bp, mouse
gaaaagttgcagaacccggg

SEQ ID NO: 679859 - DNA, 20 bp, mouse
gggaggagccgggatgactt

SEQ ID NO: 679860 - DNA, 20 bp, mouse
gccaaacaaaagggatcttg

SEQ ID NO: 679861 - DNA, 20 bp, mouse
ggtaaagctatgattggcga

SEQ ID NO: 679862 - DNA, 20 bp, mouse
gaatcatagctttacccttg

SEQ ID NO: 679863 - DNA, 20 bp, mouse
gagctggcgtcacttccggg

SEQ ID NO: 679864 - DNA, 20 bp, mouse
gctcgctctggtctccgccc

SEQ ID NO: 679865 - DNA, 20 bp, mouse
ggtcatcccggctcctcctg

SEQ ID NO: 679866 - DNA, 20 bp, mouse
gcccacgggccgactctgta

SEQ ID NO: 679867 - DNA, 20 bp, mouse
gggtgtgcgccctacagagt

SEQ ID NO: 679868 - DNA, 20 bp, mouse
gtggggaggcatttggcaga

SEQ ID NO: 679869 - DNA, 20 bp, mouse
gagggcgcacaccagggcct

SEQ ID NO: 679870 - DNA, 20 bp, mouse
gcggcccgtggggaggcatt

SEQ ID NO: 679871 - DNA, 20 bp, mouse
gcggacaacatcaggattct

SEQ ID NO: 679872 - DNA, 20 bp, mouse
ggcaacgcgaggtcaccaga

SEQ ID NO: 679873 - DNA, 20 bp, mouse
gcaagctgctgtagagttac

SEQ ID NO: 679874 - DNA, 20 bp, mouse
gaacatcaggattctgggct

SEQ ID NO: 679875 - DNA, 20 bp, mouse
ggattctgggctcggttccc

SEQ ID NO: 679876 - DNA, 20 bp, mouse
gggcccgcgggcggcgacag

SEQ ID NO: 679877 - DNA, 20 bp, mouse
ggggtctgccggcctggata

SEQ ID NO: 679878 - DNA, 20 bp, mouse
gcggaacatcgccatccccg

SEQ ID NO: 679879 - DNA, 20 bp, mouse
gctgcctggaggtgtaccat

SEQ ID NO: 679880 - DNA, 20 bp, mouse
ggcagtgacgccgggtctgc

SEQ ID NO: 679881 - DNA, 20 bp, mouse
ggacgcaacccggggaggtg

SEQ ID NO: 679882 - DNA, 20 bp, mouse
gccgtcgcggcagtgacgcc

SEQ ID NO: 679883 - DNA, 20 bp, mouse
gcggccgccagccacgaccc

SEQ ID NO: 679884 - DNA, 20 bp, mouse
ggcggcggcggcctgccccg

SEQ ID NO: 679885 - DNA, 20 bp, mouse
gtgccggcctggataggggg

SEQ ID NO: 679886 - DNA, 20 bp, mouse
gccccggcctgcctatcgga

SEQ ID NO: 679887 - DNA, 20 bp, mouse
ggggttgcccgggaagaata

SEQ ID NO: 679888 - DNA, 20 bp, mouse
gcccgccccggcctgcctat

SEQ ID NO: 679889 - DNA, 20 bp, mouse
gtctgggctggcacagcggt

SEQ ID NO: 679890 - DNA, 20 bp, mouse
gaatacggatacagacaccg

SEQ ID NO: 679891 - DNA, 20 bp, mouse
gtgggcttgtgaccccgccc

SEQ ID NO: 679892 - DNA, 20 bp, mouse
gcagacaccgaggttaggag

SEQ ID NO: 679893 - DNA, 20 bp, mouse
gggctggcacagcggtggga

SEQ ID NO: 679894 - DNA, 20 bp, mouse
gttgaattcggggttcccta

SEQ ID NO: 679895 - DNA, 20 bp, mouse
gagggggtggtggctgtgtt

SEQ ID NO: 679896 - DNA, 20 bp, mouse
ggatgtgaaagcaacgaggt

SEQ ID NO: 679897 - DNA, 20 bp, mouse
gaggacctgcgtggagtcac

SEQ ID NO: 679898 - DNA, 20 bp, mouse
gcgtggagtcacaggaccgt

SEQ ID NO: 679899 - DNA, 20 bp, mouse
gcccgtgcgcgagtgtttgc

SEQ ID NO: 679900 - DNA, 20 bp, mouse
gtcgcgcacgggtccttccg

SEQ ID NO: 679901 - DNA, 20 bp, mouse
gcgaggtgggacgtgagata

SEQ ID NO: 679902 - DNA, 20 bp, mouse
gtgagtggaaacagcagtcc

SEQ ID NO: 679903 - DNA, 20 bp, mouse
gaacctgccaacaagtctac

SEQ ID NO: 679904 - DNA, 20 bp, mouse
ggccaggaaagcgctaccca

SEQ ID NO: 679905 - DNA, 20 bp, mouse
gtgtaaataatgtctgtgtc

SEQ ID NO: 679906 - DNA, 20 bp, mouse
gaatagaggagacgcagcat

SEQ ID NO: 679907 - DNA, 20 bp, mouse
gctaaagctggttgtctgca

SEQ ID NO: 679908 - DNA, 20 bp, mouse
gccctaaaaagtctttccat

SEQ ID NO: 679909 - DNA, 20 bp, mouse
ggggcagtcaaagttgtctg

SEQ ID NO: 679910 - DNA, 20 bp, mouse
gtgcaggggagcgcatcacc

SEQ ID NO: 679911 - DNA, 20 bp, mouse
gcggttgcagactcactgag

SEQ ID NO: 679912 - DNA, 20 bp, mouse
gctgacactgttcctgttaa

SEQ ID NO: 679913 - DNA, 20 bp, mouse
gctaattgatatcccttaac

SEQ ID NO: 679914 - DNA, 20 bp, mouse
ggaaaacagcatccatgggg

SEQ ID NO: 679915 - DNA, 20 bp, mouse
gaagggtatcgcaaagcatt

SEQ ID NO: 679916 - DNA, 20 bp, mouse
gtaagcaaggattccttcag

SEQ ID NO: 679917 - DNA, 20 bp, mouse
gaaacagtaaccagcggctc

SEQ ID NO: 679918 - DNA, 20 bp, mouse
gccgctggttactgtttcaa

SEQ ID NO: 679919 - DNA, 20 bp, mouse
gctccggaatcatccactga

SEQ ID NO: 679920 - DNA, 20 bp, mouse
gagtactgttcaacttgtga

SEQ ID NO: 679921 - DNA, 20 bp, mouse
ggctgagagcctcctaagca

SEQ ID NO: 679922 - DNA, 20 bp, mouse
gttaagttgtgcataactta

SEQ ID NO: 679923 - DNA, 20 bp, mouse
gggccctgaaccacaaaagt

SEQ ID NO: 679924 - DNA, 20 bp, mouse
ggggatcagcttacatcagt

SEQ ID NO: 679925 - DNA, 20 bp, mouse
gtgcctaggtgaacatggtg

SEQ ID NO: 679926 - DNA, 20 bp, mouse
gtgccggcggggccacaagt

SEQ ID NO: 679927 - DNA, 20 bp, mouse
gacccccagaccctctcccc

SEQ ID NO: 679928 - DNA, 20 bp, mouse
gagtcctggggagagggtct

SEQ ID NO: 679929 - DNA, 20 bp, mouse
ggggccacaagtggggcgcg

SEQ ID NO: 679930 - DNA, 20 bp, mouse
gtccctgcgaagctgccggc

SEQ ID NO: 679931 - DNA, 20 bp, mouse
ggccccgccggcagcttcgc

SEQ ID NO: 679932 - DNA, 20 bp, mouse
gagggatcccgaggccaatg

SEQ ID NO: 679933 - DNA, 20 bp, mouse
gtccccgcgcgccccacttg

SEQ ID NO: 679934 - DNA, 20 bp, mouse
ggagcccaagcgcatcacac

SEQ ID NO: 679935 - DNA, 20 bp, mouse
gggagagggataaggggcaa

SEQ ID NO: 679936 - DNA, 20 bp, mouse
ggcccagagcagttcccttc

SEQ ID NO: 679937 - DNA, 20 bp, mouse
gaggcgggcagggatatcct

SEQ ID NO: 679938 - DNA, 20 bp, mouse
gaggaaggaccggaaagaca

SEQ ID NO: 679939 - DNA, 20 bp, mouse
ggacctctagcggacaaaaa

SEQ ID NO: 679940 - DNA, 20 bp, mouse
gggagccgatccaaaacgca

SEQ ID NO: 679941 - DNA, 20 bp, mouse
ggccccaccaacgagatcaa

SEQ ID NO: 679942 - DNA, 20 bp, mouse
gaccacggcgtcctccagaa

SEQ ID NO: 679943 - DNA, 20 bp, mouse
gctaagggctgacagtgaca

SEQ ID NO: 679944 - DNA, 20 bp, mouse
ggtggtggccatttttgaga

SEQ ID NO: 679945 - DNA, 20 bp, mouse
gagaggaaataaggcgggca

SEQ ID NO: 679946 - DNA, 20 bp, mouse
gagagccggtgaagccggga

SEQ ID NO: 679947 - DNA, 20 bp, mouse
gcccgccctcccggcttcac

SEQ ID NO: 679948 - DNA, 20 bp, mouse
gggcccggcgatggcggcga

SEQ ID NO: 679949 - DNA, 20 bp, mouse
gaccgcggggcgaagccgtg

SEQ ID NO: 679950 - DNA, 20 bp, mouse
gcggcggagggacggcgaga

SEQ ID NO: 679951 - DNA, 20 bp, mouse
gcgcgggaggggcacggaaa

SEQ ID NO: 679952 - DNA, 20 bp, mouse
ggccgccgcaggcccggcga

SEQ ID NO: 679953 - DNA, 20 bp, mouse
ggggcggcgggaaaacctgg

SEQ ID NO: 679954 - DNA, 20 bp, mouse
gtcgccagagccggtgaagc

SEQ ID NO: 679955 - DNA, 20 bp, mouse
ggccacgaagcgggtgacca

SEQ ID NO: 679956 - DNA, 20 bp, mouse
gccaggcgcgaggaggtcaa

SEQ ID NO: 679957 - DNA, 20 bp, mouse
ggcaaagcccagagctccgg

SEQ ID NO: 679958 - DNA, 20 bp, mouse
gggcgcgaggaggtcaaggg

SEQ ID NO: 679959 - DNA, 20 bp, mouse
gcggggaggctgtcgtcctc

SEQ ID NO: 679960 - DNA, 20 bp, mouse
ggcgaggaggtcaagggagg

SEQ ID NO: 679961 - DNA, 20 bp, mouse
ggcaggtagctggctcgggg

SEQ ID NO: 679962 - DNA, 20 bp, mouse
gaggaggacgggcaggtagc

SEQ ID NO: 679963 - DNA, 20 bp, mouse
gacgggcaggtagctggctc

SEQ ID NO: 679964 - DNA, 20 bp, mouse
gcccgcaaagcccagagctc

SEQ ID NO: 679965 - DNA, 20 bp, mouse
gaccgccccagggccacggg

SEQ ID NO: 679966 - DNA, 20 bp, mouse
ggcggggtggggcgaagccc

SEQ ID NO: 679967 - DNA, 20 bp, mouse
ggtggggcgaagcccgggaa

SEQ ID NO: 679968 - DNA, 20 bp, mouse
gggtctgaacgtggtgggga

SEQ ID NO: 679969 - DNA, 20 bp, mouse
ggagaagtggggtctgaacg

SEQ ID NO: 679970 - DNA, 20 bp, mouse
gcgaaggtggtgggtcacgt

SEQ ID NO: 679971 - DNA, 20 bp, mouse
ggaggggtggattaaggaat

SEQ ID NO: 679972 - DNA, 20 bp, mouse
ggagcgtcggagaccccagt

SEQ ID NO: 679973 - DNA, 20 bp, mouse
gagacgagatccggcccaga

SEQ ID NO: 679974 - DNA, 20 bp, mouse
gagtggggtctgaacgtggt

SEQ ID NO: 679975 - DNA, 20 bp, mouse
ggatctcgcgagatcggggc

SEQ ID NO: 679976 - DNA, 20 bp, mouse
gggcgcgcaccggaacgatc

SEQ ID NO: 679977 - DNA, 20 bp, mouse
gccgccccacgtcacgtcga

SEQ ID NO: 679978 - DNA, 20 bp, mouse
gaggaggagccggatcgttc

SEQ ID NO: 679979 - DNA, 20 bp, mouse
gcgcgaactccgcccaagga

SEQ ID NO: 679980 - DNA, 20 bp, mouse
gcccggccgcgagcagaaag

SEQ ID NO: 679981 - DNA, 20 bp, mouse
ggagtccccgagccctcctt

SEQ ID NO: 679982 - DNA, 20 bp, mouse
ggcgtccggcccagccatgg

SEQ ID NO: 679983 - DNA, 20 bp, mouse
gtggggcaccccagataaat

SEQ ID NO: 679984 - DNA, 20 bp, mouse
gacaacgaatgctcgcgaga

SEQ ID NO: 679985 - DNA, 20 bp, mouse
gggcggagttcgcgcatagg

SEQ ID NO: 679986 - DNA, 20 bp, mouse
ggggcggggtaaactatctg

SEQ ID NO: 679987 - DNA, 20 bp, mouse
gaagcgggaagcctccggtg

SEQ ID NO: 679988 - DNA, 20 bp, mouse
gtgcggagggcgggcagata

SEQ ID NO: 679989 - DNA, 20 bp, mouse
ggagggcgggcagatagggt

SEQ ID NO: 679990 - DNA, 20 bp, mouse
gtgcccgccctccgcaggtt

SEQ ID NO: 679991 - DNA, 20 bp, mouse
gagcccggtggggagggtgc

SEQ ID NO: 679992 - DNA, 20 bp, mouse
gggaacacggggggtaaaag

SEQ ID NO: 679993 - DNA, 20 bp, mouse
ggaggcagagtaggtggtgc

SEQ ID NO: 679994 - DNA, 20 bp, mouse
gtccggtgaggcagagtagg

SEQ ID NO: 679995 - DNA, 20 bp, mouse
gtcggccacccgatccttaa

SEQ ID NO: 679996 - DNA, 20 bp, mouse
gggtcccgaggcccgcgcgg

SEQ ID NO: 679997 - DNA, 20 bp, mouse
gcaagcgggtgcaagcccag

SEQ ID NO: 679998 - DNA, 20 bp, mouse
gggaaatgctgactgagaga

SEQ ID NO: 679999 - DNA, 20 bp, mouse
gatctggggcgagcgcgtga

SEQ ID NO: 680000 - DNA, 20 bp, mouse
gagcccagcggcagaagcga

SEQ ID NO: 680001 - DNA, 20 bp, mouse
ggagcggcgaatggtgggaa

SEQ ID NO: 680002 - DNA, 20 bp, mouse
gcgctcgccccagatcggaa

SEQ ID NO: 680003 - DNA, 20 bp, mouse
ggacgccgccacggaccctg

SEQ ID NO: 680004 - DNA, 20 bp, mouse
ggacgcgagcggcgaatggt

SEQ ID NO: 680005 - DNA, 20 bp, mouse
gcagcagtaagaagccttcc

SEQ ID NO: 680006 - DNA, 20 bp, mouse
ggcagggtggagcctagtcc

SEQ ID NO: 680007 - DNA, 20 bp, mouse
gagcgcctggagcaccagcc

SEQ ID NO: 680008 - DNA, 20 bp, mouse
ggggtctaggcgcagaggag

SEQ ID NO: 680009 - DNA, 20 bp, mouse
gggaaagggcggtgcaggac

SEQ ID NO: 680010 - DNA, 20 bp, mouse
gtagtcctggctggtgctcc

SEQ ID NO: 680011 - DNA, 20 bp, mouse
gagggcggtgcaggactgga

SEQ ID NO: 680012 - DNA, 20 bp, mouse
gagcaggaaggaggactaag

SEQ ID NO: 680013 - DNA, 20 bp, mouse
ggggagggcgcggtacagaa

SEQ ID NO: 680014 - DNA, 20 bp, mouse
gcagagggcgtgaccagcag

SEQ ID NO: 680015 - DNA, 20 bp, mouse
gcggagtagcgggtgccacc

SEQ ID NO: 680016 - DNA, 20 bp, mouse
gtggcaaagcggcgcgtgag

SEQ ID NO: 680017 - DNA, 20 bp, mouse
gaatgcggagatgattgctg

SEQ ID NO: 680018 - DNA, 20 bp, mouse
gggagcatgcgtattagccg

SEQ ID NO: 680019 - DNA, 20 bp, mouse
ggcgactacgggtcctacgg

SEQ ID NO: 680020 - DNA, 20 bp, mouse
gcacaccggactacctggga

SEQ ID NO: 680021 - DNA, 20 bp, mouse
gcactgcgagcgtggcaaag

SEQ ID NO: 680022 - DNA, 20 bp, mouse
ggagaggaagatggacccgg

SEQ ID NO: 680023 - DNA, 20 bp, mouse
ggccgggcgcacgcacgacc

SEQ ID NO: 680024 - DNA, 20 bp, mouse
gcactggttgctgactccct

SEQ ID NO: 680025 - DNA, 20 bp, mouse
ggcggagatgattgctgtgg

SEQ ID NO: 680026 - DNA, 20 bp, mouse
gtaacggggcacaaagtctg

SEQ ID NO: 680027 - DNA, 20 bp, mouse
gtggtacagggcaacagctg

SEQ ID NO: 680028 - DNA, 20 bp, mouse
gcgcgggctcagagctgttc

SEQ ID NO: 680029 - DNA, 20 bp, mouse
gtctgaggccctccaggctg

SEQ ID NO: 680030 - DNA, 20 bp, mouse
ggaaggggaggagatggtac

SEQ ID NO: 680031 - DNA, 20 bp, mouse
gccagagtgaaggctgcccg

SEQ ID NO: 680032 - DNA, 20 bp, mouse
gacaaagtctgaggccctcc

SEQ ID NO: 680033 - DNA, 20 bp, mouse
gacgtgagcagccgtgagga

SEQ ID NO: 680034 - DNA, 20 bp, mouse
gttgatagagactacagtaa

SEQ ID NO: 680035 - DNA, 20 bp, mouse
gcccacaccggcacctactc

SEQ ID NO: 680036 - DNA, 20 bp, mouse
gtagccccgccctcttaagt

SEQ ID NO: 680037 - DNA, 20 bp, mouse
gaaagctgccgattggtcgg

SEQ ID NO: 680038 - DNA, 20 bp, mouse
ggggctaccgggccacttga

SEQ ID NO: 680039 - DNA, 20 bp, mouse
gcaatcggcagctttatctg

SEQ ID NO: 680040 - DNA, 20 bp, mouse
gacgccacgcccacttaaga

SEQ ID NO: 680041 - DNA, 20 bp, mouse
ggacccgccgtcacgtgatg

SEQ ID NO: 680042 - DNA, 20 bp, mouse
gccctgccagcaaccggttg

SEQ ID NO: 680043 - DNA, 20 bp, mouse
ggtcacgtggaccgcgaggc

SEQ ID NO: 680044 - DNA, 20 bp, mouse
ggacaggcctcatcacgtga

SEQ ID NO: 680045 - DNA, 20 bp, mouse
gcggcgccgcctgaaaggac

SEQ ID NO: 680046 - DNA, 20 bp, mouse
gcggaagaggtgttaactag

SEQ ID NO: 680047 - DNA, 20 bp, mouse
gcagcagcgggtcagcaggc

SEQ ID NO: 680048 - DNA, 20 bp, mouse
gtggccagcagcgggtcagc

SEQ ID NO: 680049 - DNA, 20 bp, mouse
gaagaggtgttaactagtgg

SEQ ID NO: 680050 - DNA, 20 bp, mouse
gtagctctgaaaagtaagct

SEQ ID NO: 680051 - DNA, 20 bp, mouse
gacagcctcaggtagggtgc

SEQ ID NO: 680052 - DNA, 20 bp, mouse
gtgaactacagcctcaggta

SEQ ID NO: 680053 - DNA, 20 bp, mouse
gcccgctgggaggggcaagc

SEQ ID NO: 680054 - DNA, 20 bp, mouse
gcgctgctggccagccccgc

SEQ ID NO: 680055 - DNA, 20 bp, mouse
gggcaagctggatagtgtcc

SEQ ID NO: 680056 - DNA, 20 bp, mouse
ggaccaggagcccgacattg

SEQ ID NO: 680057 - DNA, 20 bp, mouse
ggacggggagccgcaatgtc

SEQ ID NO: 680058 - DNA, 20 bp, mouse
gcggaagtgcttgttctttc

SEQ ID NO: 680059 - DNA, 20 bp, mouse
gggagtgggtacctgtgttc

SEQ ID NO: 680060 - DNA, 20 bp, mouse
ggcagctcgctggggcgctc

SEQ ID NO: 680061 - DNA, 20 bp, mouse
gcaaggccctcagggacgga

SEQ ID NO: 680062 - DNA, 20 bp, mouse
ggaagcggaccgcagctcgc

SEQ ID NO: 680063 - DNA, 20 bp, mouse
gggctcggatcacggaagcc

SEQ ID NO: 680064 - DNA, 20 bp, mouse
gcgctggggcgctccggcag

SEQ ID NO: 680065 - DNA, 20 bp, mouse
ggtcgggctcctggtcccta

SEQ ID NO: 680066 - DNA, 20 bp, mouse
gccgccgccgcgtttccctc

SEQ ID NO: 680067 - DNA, 20 bp, mouse
ggccgccaccgcctcagcca

SEQ ID NO: 680068 - DNA, 20 bp, mouse
gaggaaggagtccgcgtccg

SEQ ID NO: 680069 - DNA, 20 bp, mouse
ggccccggatgcccgcgctc

SEQ ID NO: 680070 - DNA, 20 bp, mouse
gcgcgcgggaaaaagggtga

SEQ ID NO: 680071 - DNA, 20 bp, mouse
ggactccatggctgaggcgg

SEQ ID NO: 680072 - DNA, 20 bp, mouse
gaagcctgagggaaacgcgg

SEQ ID NO: 680073 - DNA, 20 bp, mouse
gaaagggtgaggggtcgcga

SEQ ID NO: 680074 - DNA, 20 bp, mouse
gcggcggcggcgccgtgagg

SEQ ID NO: 680075 - DNA, 20 bp, mouse
gccgccgtagggtcgcagcg

SEQ ID NO: 680076 - DNA, 20 bp, mouse
gcaacctggccagcagttcc

SEQ ID NO: 680077 - DNA, 20 bp, mouse
ggccctgtgcagaatcgggc

SEQ ID NO: 680078 - DNA, 20 bp, mouse
gtgacccaaggggtagggga

SEQ ID NO: 680079 - DNA, 20 bp, mouse
gagccagcccgattctgcac

SEQ ID NO: 680080 - DNA, 20 bp, mouse
gaatgaaggagcaatgcacc

SEQ ID NO: 680081 - DNA, 20 bp, mouse
gcctacaggaggctgaccca

SEQ ID NO: 680082 - DNA, 20 bp, mouse
gcagctgaggagctgcaacc

SEQ ID NO: 680083 - DNA, 20 bp, mouse
gctgtgcaggtcatgaatga

SEQ ID NO: 680084 - DNA, 20 bp, mouse
ggtacaagctcagtgcctga

SEQ ID NO: 680085 - DNA, 20 bp, mouse
gccaagagtttgctatgccc

SEQ ID NO: 680086 - DNA, 20 bp, mouse
gccacacccggaagcaattc

SEQ ID NO: 680087 - DNA, 20 bp, mouse
gttcgcacttccaatggctg

SEQ ID NO: 680088 - DNA, 20 bp, mouse
gaaaaccttcgcacttccaa

SEQ ID NO: 680089 - DNA, 20 bp, mouse
gcaactccggaattgcttcc

SEQ ID NO: 680090 - DNA, 20 bp, mouse
ggcagcgaacgagtctggga

SEQ ID NO: 680091 - DNA, 20 bp, mouse
gggcggagccaaggcagctt

SEQ ID NO: 680092 - DNA, 20 bp, mouse
gcaaagacacgggaaaaaga

SEQ ID NO: 680093 - DNA, 20 bp, mouse
ggaaccgcagcgaacgagtc

SEQ ID NO: 680094 - DNA, 20 bp, mouse
gcaggggctcggttgagacc

SEQ ID NO: 680095 - DNA, 20 bp, mouse
ggagcccctggtgtaaaaac

SEQ ID NO: 680096 - DNA, 20 bp, mouse
ggacggaaatgagttgtagt

SEQ ID NO: 680097 - DNA, 20 bp, mouse
gacgggaattgtagttcgtt

SEQ ID NO: 680098 - DNA, 20 bp, mouse
gcatgctctggcagcgcgga

SEQ ID NO: 680099 - DNA, 20 bp, mouse
ggaatgacagtgttactagc

SEQ ID NO: 680100 - DNA, 20 bp, mouse
gaattgtagttcgttcggat

SEQ ID NO: 680101 - DNA, 20 bp, mouse
gttggaccgcagtgcatgac

SEQ ID NO: 680102 - DNA, 20 bp, mouse
gtacaaagtccagcatgctc

SEQ ID NO: 680103 - DNA, 20 bp, mouse
gctggactttgtagttcact

SEQ ID NO: 680104 - DNA, 20 bp, mouse
gtgtagttcgttcggatagg

SEQ ID NO: 680105 - DNA, 20 bp, mouse
ggatacgattaatgataatg

SEQ ID NO: 680106 - DNA, 20 bp, mouse
gggggccaggggcttacgtg

SEQ ID NO: 680107 - DNA, 20 bp, mouse
gggccaccaaaactgacgga

SEQ ID NO: 680108 - DNA, 20 bp, mouse
gaagaggccaccaaaactga

SEQ ID NO: 680109 - DNA, 20 bp, mouse
gagggagctggccgaaaagc

SEQ ID NO: 680110 - DNA, 20 bp, mouse
gctagctcgcacttccgggg

SEQ ID NO: 680111 - DNA, 20 bp, mouse
gacgtgaggcaaccaaaaag

SEQ ID NO: 680112 - DNA, 20 bp, mouse
gttgccttggcaacgcatca

SEQ ID NO: 680113 - DNA, 20 bp, mouse
gatggggaggcggcctaagt

SEQ ID NO: 680114 - DNA, 20 bp, mouse
gtatggcttttcaacagttg

SEQ ID NO: 680115 - DNA, 20 bp, mouse
gcggaagtgcgagctagagc

SEQ ID NO: 680116 - DNA, 20 bp, mouse
gggccaatccgtaaatcccg

SEQ ID NO: 680117 - DNA, 20 bp, mouse
gctcccgaagcgggccgaaa

SEQ ID NO: 680118 - DNA, 20 bp, mouse
gaaggcccgatgcacatcta

SEQ ID NO: 680119 - DNA, 20 bp, mouse
gccggggctgcgtccaggtc

SEQ ID NO: 680120 - DNA, 20 bp, mouse
gtagggttggcggaactaag

SEQ ID NO: 680121 - DNA, 20 bp, mouse
gccggccactacaacttcac

SEQ ID NO: 680122 - DNA, 20 bp, mouse
gaggacagcgcattcccaaa

SEQ ID NO: 680123 - DNA, 20 bp, mouse
gagcactcacctcccgaagc

SEQ ID NO: 680124 - DNA, 20 bp, mouse
ggacgcagccccgggattta

SEQ ID NO: 680125 - DNA, 20 bp, mouse
gaaccatttcggcccgcttc

SEQ ID NO: 680126 - DNA, 20 bp, mouse
gtagctatggggcgtgtaga

SEQ ID NO: 680127 - DNA, 20 bp, mouse
gtaagagcgctagcagtcat

SEQ ID NO: 680128 - DNA, 20 bp, mouse
ggggatccatacaaactcgc

SEQ ID NO: 680129 - DNA, 20 bp, mouse
gaaaggtaactggagtgaaa

SEQ ID NO: 680130 - DNA, 20 bp, mouse
ggaacgctgggattccccgt

SEQ ID NO: 680131 - DNA, 20 bp, mouse
gcgttcaggaagcagaatta

SEQ ID NO: 680132 - DNA, 20 bp, mouse
ggctcaaggttggaacgccg

SEQ ID NO: 680133 - DNA, 20 bp, mouse
gatagctaggtgatttctat

SEQ ID NO: 680134 - DNA, 20 bp, mouse
gactggagtgaaaaggatgg

SEQ ID NO: 680135 - DNA, 20 bp, mouse
gcagaattaggggatctttt

SEQ ID NO: 680136 - DNA, 20 bp, mouse
gtcgcctgtgaaaggttcag

SEQ ID NO: 680137 - DNA, 20 bp, mouse
ggtaaaccgaggtttcccga

SEQ ID NO: 680138 - DNA, 20 bp, mouse
gcaggttgatgcacagtcac

SEQ ID NO: 680139 - DNA, 20 bp, mouse
gcagaaagtcagaacgtggg

SEQ ID NO: 680140 - DNA, 20 bp, mouse
gttctgatcaggttcccttc

SEQ ID NO: 680141 - DNA, 20 bp, mouse
gcacaggaagtcaggcaaga

SEQ ID NO: 680142 - DNA, 20 bp, mouse
gcgaatgtttcgcctgtgaa

SEQ ID NO: 680143 - DNA, 20 bp, mouse
ggctcttaagaatcagtata

SEQ ID NO: 680144 - DNA, 20 bp, mouse
ggactgtgcatcaacctgaa

SEQ ID NO: 680145 - DNA, 20 bp, mouse
ggatcagaaagtcagaacgt

SEQ ID NO: 680146 - DNA, 20 bp, mouse
gaacgcaggctgcactaggg

SEQ ID NO: 680147 - DNA, 20 bp, mouse
gctcttagcgggtagagggt

SEQ ID NO: 680148 - DNA, 20 bp, mouse
ggagcctgcagacttcattc

SEQ ID NO: 680149 - DNA, 20 bp, mouse
gtggcaggtttggagaacgc

SEQ ID NO: 680150 - DNA, 20 bp, mouse
gcagcccgaatgaagtctgc

SEQ ID NO: 680151 - DNA, 20 bp, mouse
gccagcagcgctgaaggcat

SEQ ID NO: 680152 - DNA, 20 bp, mouse
ggggttgttcccttcctccg

SEQ ID NO: 680153 - DNA, 20 bp, mouse
gttctctcttagcgggtaga

SEQ ID NO: 680154 - DNA, 20 bp, mouse
gagaggatgaacccaaagtc

SEQ ID NO: 680155 - DNA, 20 bp, mouse
ggtgctgcatagacatgctg

SEQ ID NO: 680156 - DNA, 20 bp, mouse
gacaagacctaggttctcca

SEQ ID NO: 680157 - DNA, 20 bp, mouse
gggttccctggcaacctggg

SEQ ID NO: 680158 - DNA, 20 bp, mouse
gcctgcgctgggctccgctg

SEQ ID NO: 680159 - DNA, 20 bp, mouse
ggagcggcgcgatgggaacc

SEQ ID NO: 680160 - DNA, 20 bp, mouse
ggtaaccctgctaacccacc

SEQ ID NO: 680161 - DNA, 20 bp, mouse
gggcgcgatgggaacctggt

SEQ ID NO: 680162 - DNA, 20 bp, mouse
ggcccgcagtaggaggcggt

SEQ ID NO: 680163 - DNA, 20 bp, mouse
gctgggctccgctgcgggag

SEQ ID NO: 680164 - DNA, 20 bp, mouse
gcatcgcgccgctcccgcag

SEQ ID NO: 680165 - DNA, 20 bp, mouse
gccccggcgcccgcagtagg

SEQ ID NO: 680166 - DNA, 20 bp, mouse
gtcaacgggctcaacgctcc

SEQ ID NO: 680167 - DNA, 20 bp, mouse
gggactgctggggactactg

SEQ ID NO: 680168 - DNA, 20 bp, mouse
ggcaaacctggagattgctg

SEQ ID NO: 680169 - DNA, 20 bp, mouse
gactactggggactgttggg

SEQ ID NO: 680170 - DNA, 20 bp, mouse
gtgaaatgcaggctctcttg

SEQ ID NO: 680171 - DNA, 20 bp, mouse
gtaaagatagggtaccacac

SEQ ID NO: 680172 - DNA, 20 bp, mouse
gctgtgacaagcaagctcaa

SEQ ID NO: 680173 - DNA, 20 bp, mouse
gggggactactggggactgt

SEQ ID NO: 680174 - DNA, 20 bp, mouse
ggctgcacagggggtaccag

SEQ ID NO: 680175 - DNA, 20 bp, mouse
ggagacctaaggtttacagg

SEQ ID NO: 680176 - DNA, 20 bp, mouse
gggactggaaggttccttag

SEQ ID NO: 680177 - DNA, 20 bp, mouse
gcaagaccgctgggactgga

SEQ ID NO: 680178 - DNA, 20 bp, mouse
gaggttccttagaggggagt

SEQ ID NO: 680179 - DNA, 20 bp, mouse
ggtacagcgcgcaagaccgc

SEQ ID NO: 680180 - DNA, 20 bp, mouse
ggggctgatcccagtttcca

SEQ ID NO: 680181 - DNA, 20 bp, mouse
gtagggagagggagcaattc

SEQ ID NO: 680182 - DNA, 20 bp, mouse
gcccagggcgccaacactgt

SEQ ID NO: 680183 - DNA, 20 bp, mouse
gcaccgcatcctgtggtcag

SEQ ID NO: 680184 - DNA, 20 bp, mouse
gcgcgcaagaccgctgggac

SEQ ID NO: 680185 - DNA, 20 bp, mouse
gcacaggatgcggtgactgc

SEQ ID NO: 680186 - DNA, 20 bp, mouse
gagggagtgacgtgcttcgc

SEQ ID NO: 680187 - DNA, 20 bp, mouse
gcctcccctttgggactttg

SEQ ID NO: 680188 - DNA, 20 bp, mouse
gccttgggagtggagcaagg

SEQ ID NO: 680189 - DNA, 20 bp, mouse
gtggacaagtgacggctggg

SEQ ID NO: 680190 - DNA, 20 bp, mouse
gatcccagagtctaatcctt

SEQ ID NO: 680191 - DNA, 20 bp, mouse
gcacgtcactccctcccctt

SEQ ID NO: 680192 - DNA, 20 bp, mouse
gaatccttgggagtggagca

SEQ ID NO: 680193 - DNA, 20 bp, mouse
gtgcttcgctggacaagtga

SEQ ID NO: 680194 - DNA, 20 bp, mouse
gtcagagtctccagtgctca

SEQ ID NO: 680195 - DNA, 20 bp, mouse
gtcgctggacaagtgacggc

SEQ ID NO: 680196 - DNA, 20 bp, mouse
gtaaacacaagcaatgccct

SEQ ID NO: 680197 - DNA, 20 bp, mouse
ggaagtcccctgtaaaccga

SEQ ID NO: 680198 - DNA, 20 bp, mouse
ggcaaggctccgcaacccga

SEQ ID NO: 680199 - DNA, 20 bp, mouse
gtctcaaacagctcacgctt

SEQ ID NO: 680200 - DNA, 20 bp, mouse
gattaaaaggagcacaagag

SEQ ID NO: 680201 - DNA, 20 bp, mouse
ggcaatgccctcggtttaca

SEQ ID NO: 680202 - DNA, 20 bp, mouse
ggtgccttgcagaataagtc

SEQ ID NO: 680203 - DNA, 20 bp, mouse
ggtcagccaatcaggactca

SEQ ID NO: 680204 - DNA, 20 bp, mouse
gtgcagaataagtctggaaa

SEQ ID NO: 680205 - DNA, 20 bp, mouse
gggggacttccctcgggttg

SEQ ID NO: 680206 - DNA, 20 bp, mouse
gacactgagggcgccaagaa

SEQ ID NO: 680207 - DNA, 20 bp, mouse
gttggcgccctcagtgtccg

SEQ ID NO: 680208 - DNA, 20 bp, mouse
ggcggggcggggctcatcaa

SEQ ID NO: 680209 - DNA, 20 bp, mouse
gaatgactgtagtgagactt

SEQ ID NO: 680210 - DNA, 20 bp, mouse
ggcggggctcatcaaggggc

SEQ ID NO: 680211 - DNA, 20 bp, mouse
gcgagagaataggggtacag

SEQ ID NO: 680212 - DNA, 20 bp, mouse
gcccgcccaagttggggact

SEQ ID NO: 680213 - DNA, 20 bp, mouse
ggcggagccgcggacactga

SEQ ID NO: 680214 - DNA, 20 bp, mouse
gaagggcggctgctccgcag

SEQ ID NO: 680215 - DNA, 20 bp, mouse
ggggtaggtagggaactgga

SEQ ID NO: 680216 - DNA, 20 bp, mouse
gtggcctggcaggggttcag

SEQ ID NO: 680217 - DNA, 20 bp, mouse
gaaaaagaggagaactctca

SEQ ID NO: 680218 - DNA, 20 bp, mouse
gaacccctgccaggccacta

SEQ ID NO: 680219 - DNA, 20 bp, mouse
gggatgctgtggagatttga

SEQ ID NO: 680220 - DNA, 20 bp, mouse
gctggctggtataaataaat

SEQ ID NO: 680221 - DNA, 20 bp, mouse
gaaagagagggtcagtggga

SEQ ID NO: 680222 - DNA, 20 bp, mouse
gcaaacccaggttctagaat

SEQ ID NO: 680223 - DNA, 20 bp, mouse
gttatactaacagtgctcca

SEQ ID NO: 680224 - DNA, 20 bp, mouse
gcagctgacctaagaaagag

SEQ ID NO: 680225 - DNA, 20 bp, mouse
gggccactaaggtactcttt

SEQ ID NO: 680226 - DNA, 20 bp, mouse
gctgtggagcgagagggtag

SEQ ID NO: 680227 - DNA, 20 bp, mouse
gtgcgccgctgggatcgcga

SEQ ID NO: 680228 - DNA, 20 bp, mouse
gtccggggcgggcggcaggg

SEQ ID NO: 680229 - DNA, 20 bp, mouse
ggatcgcgatgggtccgggg

SEQ ID NO: 680230 - DNA, 20 bp, mouse
gtgggatcgcgatgggtccg

SEQ ID NO: 680231 - DNA, 20 bp, mouse
ggggagcacggcctgctgaa

SEQ ID NO: 680232 - DNA, 20 bp, mouse
ggatcccagcggcgcacact

SEQ ID NO: 680233 - DNA, 20 bp, mouse
gcccgcctgaccttcttcca

SEQ ID NO: 680234 - DNA, 20 bp, mouse
gggtgtgcaagcgtaaaggc

SEQ ID NO: 680235 - DNA, 20 bp, mouse
gtaaaagaggccagggtggg

SEQ ID NO: 680236 - DNA, 20 bp, mouse
gacttcacaagcccagaagg

SEQ ID NO: 680237 - DNA, 20 bp, mouse
gaagagaaagaaaatctccg

SEQ ID NO: 680238 - DNA, 20 bp, mouse
gcccactgaagaaggaaaag

SEQ ID NO: 680239 - DNA, 20 bp, mouse
gccactctccccactgaaga

SEQ ID NO: 680240 - DNA, 20 bp, mouse
gtaattaagaagttgagagc

SEQ ID NO: 680241 - DNA, 20 bp, mouse
ggagatgaactcgaggcata

SEQ ID NO: 680242 - DNA, 20 bp, mouse
ggcaggttgagatgaactcg

SEQ ID NO: 680243 - DNA, 20 bp, mouse
ggccacttcacaagcccaga

SEQ ID NO: 680244 - DNA, 20 bp, mouse
gttgttgtcgttgatgaatg

SEQ ID NO: 680245 - DNA, 20 bp, mouse
gcacaagcccagaaggaggc

SEQ ID NO: 680246 - DNA, 20 bp, mouse
gacccaaccgagtcattctt

SEQ ID NO: 680247 - DNA, 20 bp, mouse
gagggcgtgggcattcctac

SEQ ID NO: 680248 - DNA, 20 bp, mouse
gtggtggcggctgtaggtac

SEQ ID NO: 680249 - DNA, 20 bp, mouse
ggacagatgacttctcaaga

SEQ ID NO: 680250 - DNA, 20 bp, mouse
gaatccgagtgagcaagctg

SEQ ID NO: 680251 - DNA, 20 bp, mouse
gtcccgaagaatgactcggt

SEQ ID NO: 680252 - DNA, 20 bp, mouse
gtggttcccgaagaatgact

SEQ ID NO: 680253 - DNA, 20 bp, mouse
gagccagaggaaggatctag

SEQ ID NO: 680254 - DNA, 20 bp, mouse
gaatgactcggttgggttcg

SEQ ID NO: 680255 - DNA, 20 bp, mouse
gaccctctagatccttcctc

SEQ ID NO: 680256 - DNA, 20 bp, mouse
gaaaccccccacagtggggg

SEQ ID NO: 680257 - DNA, 20 bp, mouse
gactgcaggctgacaaagag

SEQ ID NO: 680258 - DNA, 20 bp, mouse
gaagagcaggaaggcggtgc

SEQ ID NO: 680259 - DNA, 20 bp, mouse
gggaatgtgggaggtaaaac

SEQ ID NO: 680260 - DNA, 20 bp, mouse
gatgaaaccccccacagtgg

SEQ ID NO: 680261 - DNA, 20 bp, mouse
gagaatgaaaccccccacag

SEQ ID NO: 680262 - DNA, 20 bp, mouse
gcagcactggaggctgaaga

SEQ ID NO: 680263 - DNA, 20 bp, mouse
gcctgctcttgatttcccaa

SEQ ID NO: 680264 - DNA, 20 bp, mouse
gggtcagtttagtaccagat

SEQ ID NO: 680265 - DNA, 20 bp, mouse
ggagtgtggtttcttttgtt

SEQ ID NO: 680266 - DNA, 20 bp, mouse
gccagggtcccatagtggaa

SEQ ID NO: 680267 - DNA, 20 bp, mouse
gggtcccatagtggaagggc

SEQ ID NO: 680268 - DNA, 20 bp, mouse
gctgccctgcccttccacta

SEQ ID NO: 680269 - DNA, 20 bp, mouse
gccccgcccctaagctgagt

SEQ ID NO: 680270 - DNA, 20 bp, mouse
gcagggcagtagaatgaggc

SEQ ID NO: 680271 - DNA, 20 bp, mouse
gccctaagctgagtgggttg

SEQ ID NO: 680272 - DNA, 20 bp, mouse
gtactgagctatgtcatcag

SEQ ID NO: 680273 - DNA, 20 bp, mouse
gttcaagcgtgaacgcgcgg

SEQ ID NO: 680274 - DNA, 20 bp, mouse
gtggaaaagcccggggacca

SEQ ID NO: 680275 - DNA, 20 bp, mouse
gacccactcagcttaggggc

SEQ ID NO: 680276 - DNA, 20 bp, mouse
gtgggcaagaagcgaaggaa

SEQ ID NO: 680277 - DNA, 20 bp, mouse
gcacagtgggcaagaagcga

SEQ ID NO: 680278 - DNA, 20 bp, mouse
gaagatagggccccaccccc

SEQ ID NO: 680279 - DNA, 20 bp, mouse
ggctcttgatgagtgtgtag

SEQ ID NO: 680280 - DNA, 20 bp, mouse
gttgagacaggactcatctc

SEQ ID NO: 680281 - DNA, 20 bp, mouse
gcgctggagaaacatcctgt

SEQ ID NO: 680282 - DNA, 20 bp, mouse
ggaggacacacgtgtgctac

SEQ ID NO: 680283 - DNA, 20 bp, mouse
ggcaagagggaagaggttga

SEQ ID NO: 680284 - DNA, 20 bp, mouse
gacactcatcaagagcccgg

SEQ ID NO: 680285 - DNA, 20 bp, mouse
gcctgtctcagaaggaagat

SEQ ID NO: 680286 - DNA, 20 bp, mouse
ggaacagaaggctgctgctc

SEQ ID NO: 680287 - DNA, 20 bp, mouse
gtggacttggagttaggagg

SEQ ID NO: 680288 - DNA, 20 bp, mouse
gttggggcgggaggatggct

SEQ ID NO: 680289 - DNA, 20 bp, mouse
gctcagaggggctgggcaat

SEQ ID NO: 680290 - DNA, 20 bp, mouse
ggtcctgccccgggaacaga

SEQ ID NO: 680291 - DNA, 20 bp, mouse
gcagcagccttctgttcccg

SEQ ID NO: 680292 - DNA, 20 bp, mouse
gtggctctttgccaaatcgg

SEQ ID NO: 680293 - DNA, 20 bp, mouse
gtgggtggggagccaaaccc

SEQ ID NO: 680294 - DNA, 20 bp, mouse
gctagccctgacctaggaga

SEQ ID NO: 680295 - DNA, 20 bp, mouse
gaatgcttgtagtcctgccc

SEQ ID NO: 680296 - DNA, 20 bp, mouse
gaacggggagtttatagtaa

SEQ ID NO: 680297 - DNA, 20 bp, mouse
gtgagagtagggttttcccc

SEQ ID NO: 680298 - DNA, 20 bp, mouse
gagaacatgcagaaattccc

SEQ ID NO: 680299 - DNA, 20 bp, mouse
gcaaagttgctacctggatg

SEQ ID NO: 680300 - DNA, 20 bp, mouse
gagaccagccaatcagagac

SEQ ID NO: 680301 - DNA, 20 bp, mouse
gccaggtagcaactttgcct

SEQ ID NO: 680302 - DNA, 20 bp, mouse
gttccctgggatctgagagt

SEQ ID NO: 680303 - DNA, 20 bp, mouse
gggaaaaggtagcagggaac

SEQ ID NO: 680304 - DNA, 20 bp, mouse
gagttcttctaggtcagctg

SEQ ID NO: 680305 - DNA, 20 bp, mouse
gccccaggacgatcaatttg

SEQ ID NO: 680306 - DNA, 20 bp, mouse
gtgggcggggctctaggggg

SEQ ID NO: 680307 - DNA, 20 bp, mouse
gagaagtgatcatctatgga

SEQ ID NO: 680308 - DNA, 20 bp, mouse
gtggtagaagtgatcatcta

SEQ ID NO: 680309 - DNA, 20 bp, mouse
ggatgtgggcggggctctag

SEQ ID NO: 680310 - DNA, 20 bp, mouse
gcccgcccacatctgcattt

SEQ ID NO: 680311 - DNA, 20 bp, mouse
gccacggtgggaaagactta

SEQ ID NO: 680312 - DNA, 20 bp, mouse
gtgtacccaaatgcagatgt

SEQ ID NO: 680313 - DNA, 20 bp, mouse
gcagggtgaccctgcagtta

SEQ ID NO: 680314 - DNA, 20 bp, mouse
gaaagacttagggagtctaa

SEQ ID NO: 680315 - DNA, 20 bp, mouse
gcagatgaagtcatggggcc

SEQ ID NO: 680316 - DNA, 20 bp, mouse
gtcctctagaagccatcaga

SEQ ID NO: 680317 - DNA, 20 bp, mouse
ggaggagcctgccaatctga

SEQ ID NO: 680318 - DNA, 20 bp, mouse
gagggagaagggctaagttc

SEQ ID NO: 680319 - DNA, 20 bp, mouse
gcctgccaatctgaaggtag

SEQ ID NO: 680320 - DNA, 20 bp, mouse
ggaggtgtcctatagaggaa

SEQ ID NO: 680321 - DNA, 20 bp, mouse
gtcagccaggtccatctgca

SEQ ID NO: 680322 - DNA, 20 bp, mouse
gctgacctctaccttcagat

SEQ ID NO: 680323 - DNA, 20 bp, mouse
ggctaccgatggggaagtcc

SEQ ID NO: 680324 - DNA, 20 bp, mouse
gcaagggaggtgtcctatag

SEQ ID NO: 680325 - DNA, 20 bp, mouse
ggcctccaggacttccccat

SEQ ID NO: 680326 - DNA, 20 bp, mouse
gcaggtgaatacacttagaa

SEQ ID NO: 680327 - DNA, 20 bp, mouse
gtataccagccctccgcaga

SEQ ID NO: 680328 - DNA, 20 bp, mouse
gacagaaaagccctctgcgg

SEQ ID NO: 680329 - DNA, 20 bp, mouse
ggggaacttgcagtgaacag

SEQ ID NO: 680330 - DNA, 20 bp, mouse
gcacttagaaggggctagcc

SEQ ID NO: 680331 - DNA, 20 bp, mouse
gaagacagaaaagccctctg

SEQ ID NO: 680332 - DNA, 20 bp, mouse
gtgtaacagtcccaagttcc

SEQ ID NO: 680333 - DNA, 20 bp, mouse
gcagcacagcctcttccaaa

SEQ ID NO: 680334 - DNA, 20 bp, mouse
gactgggattggagtctcac

SEQ ID NO: 680335 - DNA, 20 bp, mouse
gagtgagtctaggagcaggc

SEQ ID NO: 680336 - DNA, 20 bp, mouse
gggcgggaggagactggcgg

SEQ ID NO: 680337 - DNA, 20 bp, mouse
ggcgacccgcagaaacaccc

SEQ ID NO: 680338 - DNA, 20 bp, mouse
gcgcatgcgcagctcggacg

SEQ ID NO: 680339 - DNA, 20 bp, mouse
gtgcgcagctcggacggggc

SEQ ID NO: 680340 - DNA, 20 bp, mouse
gtagacctggagtttacggg

SEQ ID NO: 680341 - DNA, 20 bp, mouse
gttgagacaagactggggat

SEQ ID NO: 680342 - DNA, 20 bp, mouse
gccagccagggtgtttctgc

SEQ ID NO: 680343 - DNA, 20 bp, mouse
gagcctgcctaaccagtagg

SEQ ID NO: 680344 - DNA, 20 bp, mouse
gtctaaaattctatccacgt

SEQ ID NO: 680345 - DNA, 20 bp, mouse
ggataatgttctcagagttg

SEQ ID NO: 680346 - DNA, 20 bp, mouse
gagccatgtgcggtctcctg

SEQ ID NO: 680347 - DNA, 20 bp, mouse
gcacaccagaaaagactcag

SEQ ID NO: 680348 - DNA, 20 bp, mouse
gggccccaggagaccgcaca

SEQ ID NO: 680349 - DNA, 20 bp, mouse
gaaaaaagagatgagtcgag

SEQ ID NO: 680350 - DNA, 20 bp, mouse
gcggtctcctggggccagtg

SEQ ID NO: 680351 - DNA, 20 bp, mouse
ggcaagcagcaagccctcac

SEQ ID NO: 680352 - DNA, 20 bp, mouse
gtaaacaaatgagccatgtg

SEQ ID NO: 680353 - DNA, 20 bp, mouse
gtgcgtagtactgactctgt

SEQ ID NO: 680354 - DNA, 20 bp, mouse
gagggatgcatatagacttg

SEQ ID NO: 680355 - DNA, 20 bp, mouse
ggctcactggatctctatga

SEQ ID NO: 680356 - DNA, 20 bp, mouse
gggggcaggtctctagctga

SEQ ID NO: 680357 - DNA, 20 bp, mouse
gctactttctgctccccttt

SEQ ID NO: 680358 - DNA, 20 bp, mouse
gggaacaggttgcttctagg

SEQ ID NO: 680359 - DNA, 20 bp, mouse
ggcccccgtctctatcccat

SEQ ID NO: 680360 - DNA, 20 bp, mouse
ggcctatgggatagagacgg

SEQ ID NO: 680361 - DNA, 20 bp, mouse
gcatagcatgggctttgtgt

SEQ ID NO: 680362 - DNA, 20 bp, mouse
gaaagcccatgctatggatt

SEQ ID NO: 680363 - DNA, 20 bp, mouse
gtctgcctatgggatagaga

SEQ ID NO: 680364 - DNA, 20 bp, mouse
gtactggtcacacatgtctt

SEQ ID NO: 680365 - DNA, 20 bp, mouse
gcattaatgctctcctaaag

SEQ ID NO: 680366 - DNA, 20 bp, mouse
gtccaagagaagcattaata

SEQ ID NO: 680367 - DNA, 20 bp, mouse
ggtgcccaagactttcacca

SEQ ID NO: 680368 - DNA, 20 bp, mouse
gcgtgcccaaggtctcggga

SEQ ID NO: 680369 - DNA, 20 bp, mouse
ggcagcgactataactcgaa

SEQ ID NO: 680370 - DNA, 20 bp, mouse
ggaggcgtgcccaaggtctc

SEQ ID NO: 680371 - DNA, 20 bp, mouse
gtccaaggtacactccccta

SEQ ID NO: 680372 - DNA, 20 bp, mouse
gatagtgatctcagcccaca

SEQ ID NO: 680373 - DNA, 20 bp, mouse
gggcccaatgtcccgctcaa

SEQ ID NO: 680374 - DNA, 20 bp, mouse
ggaagcattaatagggttag

SEQ ID NO: 680375 - DNA, 20 bp, mouse
gggtgtgtaggggcgatcac

SEQ ID NO: 680376 - DNA, 20 bp, mouse
gcgaaccaggagaatgttta

SEQ ID NO: 680377 - DNA, 20 bp, mouse
gaagaggagggacttgtgct

SEQ ID NO: 680378 - DNA, 20 bp, mouse
gcaggagaatgtttaagggg

SEQ ID NO: 680379 - DNA, 20 bp, mouse
gtgcgcattgggtagcacta

SEQ ID NO: 680380 - DNA, 20 bp, mouse
gcgtgtttctggggcgaacc

SEQ ID NO: 680381 - DNA, 20 bp, mouse
gcttgtgctaggatgattgt

SEQ ID NO: 680382 - DNA, 20 bp, mouse
gtgctaggatgattgtgggt

SEQ ID NO: 680383 - DNA, 20 bp, mouse
gcaatgcgcaggcgtgtttc

SEQ ID NO: 680384 - DNA, 20 bp, mouse
gagcagcaccacagaaaaac

SEQ ID NO: 680385 - DNA, 20 bp, mouse
gagcaacccctgatatacta

SEQ ID NO: 680386 - DNA, 20 bp, mouse
gtccaagagaagcattaata

SEQ ID NO: 680387 - DNA, 20 bp, mouse
ggtgcccaagactttcacca

SEQ ID NO: 680388 - DNA, 20 bp, mouse
gcgtgcccaaggtctcggga

SEQ ID NO: 680389 - DNA, 20 bp, mouse
ggcagcgactataactcgaa

SEQ ID NO: 680390 - DNA, 20 bp, mouse
ggaggcgtgcccaaggtctc

SEQ ID NO: 680391 - DNA, 20 bp, mouse
gtccaaggtacactccccta

SEQ ID NO: 680392 - DNA, 20 bp, mouse
gatagtgatctcagcccaca

SEQ ID NO: 680393 - DNA, 20 bp, mouse
gggcccaatgtcccgctcaa

SEQ ID NO: 680394 - DNA, 20 bp, mouse
ggaagcattaatagggttag

SEQ ID NO: 680395 - DNA, 20 bp, mouse
gggtgtgtaggggcgatcac

SEQ ID NO: 680396 - DNA, 20 bp, mouse
gcgaaccaggagaatgttta

SEQ ID NO: 680397 - DNA, 20 bp, mouse
gaagaggagggacttgtgct

SEQ ID NO: 680398 - DNA, 20 bp, mouse
gcaggagaatgtttaagggg

SEQ ID NO: 680399 - DNA, 20 bp, mouse
gtgcgcattgggtagcacta

SEQ ID NO: 680400 - DNA, 20 bp, mouse
gcgtgtttctggggcgaacc

SEQ ID NO: 680401 - DNA, 20 bp, mouse
gcttgtgctaggatgattgt

SEQ ID NO: 680402 - DNA, 20 bp, mouse
gtgctaggatgattgtgggt

SEQ ID NO: 680403 - DNA, 20 bp, mouse
gcaatgcgcaggcgtgtttc

SEQ ID NO: 680404 - DNA, 20 bp, mouse
gagcagcaccacagaaaaac

SEQ ID NO: 680405 - DNA, 20 bp, mouse
gagcaacccctgatatacta

SEQ ID NO: 680406 - DNA, 20 bp, mouse
ggggccgaagagaatgcttc

SEQ ID NO: 680407 - DNA, 20 bp, mouse
gccacagggtctaaaaacct

SEQ ID NO: 680408 - DNA, 20 bp, mouse
gcgggggggcgctcttctaa

SEQ ID NO: 680409 - DNA, 20 bp, mouse
gtagctgaaagtgcagagga

SEQ ID NO: 680410 - DNA, 20 bp, mouse
gtacacaaaggcgacaacca

SEQ ID NO: 680411 - DNA, 20 bp, mouse
gaagcttgggtcccacccac

SEQ ID NO: 680412 - DNA, 20 bp, mouse
gaggatgctggactcctagc

SEQ ID NO: 680413 - DNA, 20 bp, mouse
gtttttagaccctgtggcat

SEQ ID NO: 680414 - DNA, 20 bp, mouse
gctttgtgtaggcatagctc

SEQ ID NO: 680415 - DNA, 20 bp, mouse
gagccaggatgcaaagcaca

SEQ ID NO: 680416 - DNA, 20 bp, mouse
gtccgcctgatgacgctcag

SEQ ID NO: 680417 - DNA, 20 bp, mouse
gtggccgccagagggcaata

SEQ ID NO: 680418 - DNA, 20 bp, mouse
gcccttcggaagccgcgatc

SEQ ID NO: 680419 - DNA, 20 bp, mouse
gggcggccaccgtacggact

SEQ ID NO: 680420 - DNA, 20 bp, mouse
ggggatgccaggcctccgga

SEQ ID NO: 680421 - DNA, 20 bp, mouse
gcggccatattgccctctgg

SEQ ID NO: 680422 - DNA, 20 bp, mouse
gccctctggcggccaccgta

SEQ ID NO: 680423 - DNA, 20 bp, mouse
gtaggcgcggccatgcttcc

SEQ ID NO: 680424 - DNA, 20 bp, mouse
ggacttggctgacaaggtgg

SEQ ID NO: 680425 - DNA, 20 bp, mouse
gtccgtacggtggccgccag

SEQ ID NO: 680426 - DNA, 20 bp, mouse
gccgaggtgagcaggacgca

SEQ ID NO: 680427 - DNA, 20 bp, mouse
gtggccgcgccggcgagctg

SEQ ID NO: 680428 - DNA, 20 bp, mouse
gccggcgcggccacgtttcc

SEQ ID NO: 680429 - DNA, 20 bp, mouse
ggggaggcggtgcggagccg

SEQ ID NO: 680430 - DNA, 20 bp, mouse
ggggaggggagcgcggagaa

SEQ ID NO: 680431 - DNA, 20 bp, mouse
ggggagcgcggagaaaggcg

SEQ ID NO: 680432 - DNA, 20 bp, mouse
ggcagagagcgagggcgcga

SEQ ID NO: 680433 - DNA, 20 bp, mouse
gcggaggctggcggggtggc

SEQ ID NO: 680434 - DNA, 20 bp, mouse
gtgtgcgtgtgtgcggtggc

SEQ ID NO: 680435 - DNA, 20 bp, mouse
gacacaaacagagcgagggg

SEQ ID NO: 680436 - DNA, 20 bp, mouse
gtggccaaagctgatctggg

SEQ ID NO: 680437 - DNA, 20 bp, mouse
gcggggatcttgaggcgcaa

SEQ ID NO: 680438 - DNA, 20 bp, mouse
ggtcctggcgaggtcctccc

SEQ ID NO: 680439 - DNA, 20 bp, mouse
gggaggagggagggaatccg

SEQ ID NO: 680440 - DNA, 20 bp, mouse
gctccctcccagatcagctt

SEQ ID NO: 680441 - DNA, 20 bp, mouse
gaggacctcgccaggacgcg

SEQ ID NO: 680442 - DNA, 20 bp, mouse
gccaggacgcggggatcttg

SEQ ID NO: 680443 - DNA, 20 bp, mouse
gaaaacccggaccggactag

SEQ ID NO: 680444 - DNA, 20 bp, mouse
gagagcctgcggcgtccaag

SEQ ID NO: 680445 - DNA, 20 bp, mouse
gggagggagggaatccgagg

SEQ ID NO: 680446 - DNA, 20 bp, mouse
gaacaccacgcgccgggctg

SEQ ID NO: 680447 - DNA, 20 bp, mouse
ggggccctgtgcccagaacc

SEQ ID NO: 680448 - DNA, 20 bp, mouse
gcacgcgccgggctgtggtg

SEQ ID NO: 680449 - DNA, 20 bp, mouse
gaaactgggcacagaccaca

SEQ ID NO: 680450 - DNA, 20 bp, mouse
ggagggcggtgcctcaaact

SEQ ID NO: 680451 - DNA, 20 bp, mouse
ggtggagctgggaatgtccc

SEQ ID NO: 680452 - DNA, 20 bp, mouse
gatggccgggcagtcagaca

SEQ ID NO: 680453 - DNA, 20 bp, mouse
gaaccgcctccccacccaaa

SEQ ID NO: 680454 - DNA, 20 bp, mouse
gacagaccacaaggcctctt

SEQ ID NO: 680455 - DNA, 20 bp, mouse
gcacagggcccggtggagct

SEQ ID NO: 680456 - DNA, 20 bp, mouse
gcaggcgccggcactcggta

SEQ ID NO: 680457 - DNA, 20 bp, mouse
gagcgcgcgcgaggaggcga

SEQ ID NO: 680458 - DNA, 20 bp, mouse
ggctacaccgacccgcactc

SEQ ID NO: 680459 - DNA, 20 bp, mouse
gggaacctgccgagcgtccg

SEQ ID NO: 680460 - DNA, 20 bp, mouse
gctggtgtgcagatgcggaa

SEQ ID NO: 680461 - DNA, 20 bp, mouse
gctggagtggaaaaaatggg

SEQ ID NO: 680462 - DNA, 20 bp, mouse
gggctggaagaggtgaccct

SEQ ID NO: 680463 - DNA, 20 bp, mouse
gaggcgacggtcacctgcgc

SEQ ID NO: 680464 - DNA, 20 bp, mouse
gcccgaagctgctggagttc

SEQ ID NO: 680465 - DNA, 20 bp, mouse
gggttcggcgcccgggttcc

SEQ ID NO: 680466 - DNA, 20 bp, mouse
ggggtctgtggttagagaca

SEQ ID NO: 680467 - DNA, 20 bp, mouse
gctggggcgtctgggaaatg

SEQ ID NO: 680468 - DNA, 20 bp, mouse
gcctgagcggtccgattcct

SEQ ID NO: 680469 - DNA, 20 bp, mouse
gacgcagcgctcctaggaat

SEQ ID NO: 680470 - DNA, 20 bp, mouse
gaaccgacgtcggttgtcat

SEQ ID NO: 680471 - DNA, 20 bp, mouse
ggagggccgaccctagcgtg

SEQ ID NO: 680472 - DNA, 20 bp, mouse
gcacctcaaggaaccgacgt

SEQ ID NO: 680473 - DNA, 20 bp, mouse
gacagaccccgtccagagac

SEQ ID NO: 680474 - DNA, 20 bp, mouse
ggatgctggggatcatagag

SEQ ID NO: 680475 - DNA, 20 bp, mouse
gctggggatcatagagtggc

SEQ ID NO: 680476 - DNA, 20 bp, mouse
ggggagctcgattaggtcag

SEQ ID NO: 680477 - DNA, 20 bp, mouse
gggaaccagacctacctcca

SEQ ID NO: 680478 - DNA, 20 bp, mouse
ggcggcggcggctacaggag

SEQ ID NO: 680479 - DNA, 20 bp, mouse
ggaagcgcctcggccccaaa

SEQ ID NO: 680480 - DNA, 20 bp, mouse
gcggccccgcagcttccccg

SEQ ID NO: 680481 - DNA, 20 bp, mouse
ggcgccctctgtagagtggg

SEQ ID NO: 680482 - DNA, 20 bp, mouse
gagctcgattaggtcagtgg

SEQ ID NO: 680483 - DNA, 20 bp, mouse
ggcgcctcggccccaaaggg

SEQ ID NO: 680484 - DNA, 20 bp, mouse
gacaaagatagaatgaaggt

SEQ ID NO: 680485 - DNA, 20 bp, mouse
gggagccgagactgacccgc

SEQ ID NO: 680486 - DNA, 20 bp, mouse
gaggcccgggtaggtcacac

SEQ ID NO: 680487 - DNA, 20 bp, mouse
ggcaggcgctgttgagttga

SEQ ID NO: 680488 - DNA, 20 bp, mouse
ggtcccaggaagtctcgggt

SEQ ID NO: 680489 - DNA, 20 bp, mouse
gcctgcgcagggcgactcag

SEQ ID NO: 680490 - DNA, 20 bp, mouse
gggcgtggttgccgctggat

SEQ ID NO: 680491 - DNA, 20 bp, mouse
gtgaggagggcaaaattcta

SEQ ID NO: 680492 - DNA, 20 bp, mouse
ggatccccacacgaaaaaca

SEQ ID NO: 680493 - DNA, 20 bp, mouse
gggtgggtagacatcgcacc

SEQ ID NO: 680494 - DNA, 20 bp, mouse
gaagtgaagctactccgtaa

SEQ ID NO: 680495 - DNA, 20 bp, mouse
gaagctactccgtaacggag

SEQ ID NO: 680496 - DNA, 20 bp, mouse
gtctgattggcaaggttgga

SEQ ID NO: 680497 - DNA, 20 bp, mouse
gttggaccagcgcctaaacg

SEQ ID NO: 680498 - DNA, 20 bp, mouse
ggaaaagagacgctggaaac

SEQ ID NO: 680499 - DNA, 20 bp, mouse
gaggacagcagttggggcaa

SEQ ID NO: 680500 - DNA, 20 bp, mouse
ggggggctgcaattctggat

SEQ ID NO: 680501 - DNA, 20 bp, mouse
gttctggatgggaagatcaa

SEQ ID NO: 680502 - DNA, 20 bp, mouse
gctctgggcaaggaaggtag

SEQ ID NO: 680503 - DNA, 20 bp, mouse
gaggaagggaaaagagacgc

SEQ ID NO: 680504 - DNA, 20 bp, mouse
gttcggggacccagggtggc

SEQ ID NO: 680505 - DNA, 20 bp, mouse
gaccccgggggctgcaattc

SEQ ID NO: 680506 - DNA, 20 bp, mouse
gccagcgccggggttagcgt

SEQ ID NO: 680507 - DNA, 20 bp, mouse
gaggtccctacatgcctact

SEQ ID NO: 680508 - DNA, 20 bp, mouse
gagatctgcagtggcggaac

SEQ ID NO: 680509 - DNA, 20 bp, mouse
gtaggctcgaagccggaatc

SEQ ID NO: 680510 - DNA, 20 bp, mouse
gaggtcccagggccaatggc

SEQ ID NO: 680511 - DNA, 20 bp, mouse
gagcagtcggggagcgacac

SEQ ID NO: 680512 - DNA, 20 bp, mouse
ggtagcccagtaggcatgta

SEQ ID NO: 680513 - DNA, 20 bp, mouse
gtctgcagtggcggaaccgg

SEQ ID NO: 680514 - DNA, 20 bp, mouse
gaatctcgcgagatctgcag

SEQ ID NO: 680515 - DNA, 20 bp, mouse
gcagctccggccattggccc

SEQ ID NO: 680516 - DNA, 20 bp, mouse
ggtgaagcgtggagcagaaa

SEQ ID NO: 680517 - DNA, 20 bp, mouse
gcggcggccgcagggggtga

SEQ ID NO: 680518 - DNA, 20 bp, mouse
ggcgaggcctgatgtcgcaa

SEQ ID NO: 680519 - DNA, 20 bp, mouse
gtcgcaacggagccgtcaag

SEQ ID NO: 680520 - DNA, 20 bp, mouse
gcccgcccgccaggagctgt

SEQ ID NO: 680521 - DNA, 20 bp, mouse
gcagcggcggcagtgacttc

SEQ ID NO: 680522 - DNA, 20 bp, mouse
ggcccgccaggagctgtcgg

SEQ ID NO: 680523 - DNA, 20 bp, mouse
gctggagcccacatcaagat

SEQ ID NO: 680524 - DNA, 20 bp, mouse
gggttccaggagtgcagcgg

SEQ ID NO: 680525 - DNA, 20 bp, mouse
gagacggatacgttaacggg

SEQ ID NO: 680526 - DNA, 20 bp, mouse
gctctccggggcgtggtcta

SEQ ID NO: 680527 - DNA, 20 bp, mouse
ggtaggtggtccaagggcgt

SEQ ID NO: 680528 - DNA, 20 bp, mouse
gagagaagaaagctctcaaa

SEQ ID NO: 680529 - DNA, 20 bp, mouse
gtactccgcacggaagaggg

SEQ ID NO: 680530 - DNA, 20 bp, mouse
gctgactgaggcaggactag

SEQ ID NO: 680531 - DNA, 20 bp, mouse
gcaacttagacctaccccaa

SEQ ID NO: 680532 - DNA, 20 bp, mouse
ggtgcggagtaggtggtcca

SEQ ID NO: 680533 - DNA, 20 bp, mouse
gtgggtatcttggccgtctc

SEQ ID NO: 680534 - DNA, 20 bp, mouse
gggggcgtggtctatggagg

SEQ ID NO: 680535 - DNA, 20 bp, mouse
ggaagaaagctctcaaaagg

SEQ ID NO: 680536 - DNA, 20 bp, mouse
gagcagagggatccctgcat

SEQ ID NO: 680537 - DNA, 20 bp, mouse
gcttctgcagctggccgggt

SEQ ID NO: 680538 - DNA, 20 bp, mouse
ggactcctgccccatagcga

SEQ ID NO: 680539 - DNA, 20 bp, mouse
gcagctggccgggtgggaat

SEQ ID NO: 680540 - DNA, 20 bp, mouse
gtggcgcttctgcagctggc

SEQ ID NO: 680541 - DNA, 20 bp, mouse
gcctgcaaacacttggtcct

SEQ ID NO: 680542 - DNA, 20 bp, mouse
gggctcttaacaagctgggg

SEQ ID NO: 680543 - DNA, 20 bp, mouse
gagcctggcaagatgaagga

SEQ ID NO: 680544 - DNA, 20 bp, mouse
ggcaggagtcagctcctcag

SEQ ID NO: 680545 - DNA, 20 bp, mouse
gccggtctcccactaaagac

SEQ ID NO: 680546 - DNA, 20 bp, mouse
gtgacggcgctgcacggaag

SEQ ID NO: 680547 - DNA, 20 bp, mouse
gaagaggctcggcgagagac

SEQ ID NO: 680548 - DNA, 20 bp, mouse
ggcgcggaggtgggcggata

SEQ ID NO: 680549 - DNA, 20 bp, mouse
gcacttccgcttgtgaagac

SEQ ID NO: 680550 - DNA, 20 bp, mouse
gggaagtgggcggggacact

SEQ ID NO: 680551 - DNA, 20 bp, mouse
ggaggtgggcggataggggg

SEQ ID NO: 680552 - DNA, 20 bp, mouse
gacgccctgcggagccagtc

SEQ ID NO: 680553 - DNA, 20 bp, mouse
gggcgagagactggctactg

SEQ ID NO: 680554 - DNA, 20 bp, mouse
gcagtcaggagcgcggaggt

SEQ ID NO: 680555 - DNA, 20 bp, mouse
ggcgctgcacggaagaggct

SEQ ID NO: 680556 - DNA, 20 bp, mouse
gcggtcgcccggcttgggaa

SEQ ID NO: 680557 - DNA, 20 bp, mouse
gcgcatgctcagttactctt

SEQ ID NO: 680558 - DNA, 20 bp, mouse
ggaaagctgtcatttccttg

SEQ ID NO: 680559 - DNA, 20 bp, mouse
gacgctcacgagaggcgggg

SEQ ID NO: 680560 - DNA, 20 bp, mouse
gtcggcctctatcagcacca

SEQ ID NO: 680561 - DNA, 20 bp, mouse
gtcacgacgcgcctgacccc

SEQ ID NO: 680562 - DNA, 20 bp, mouse
gtgagcccggtcgcccggct

SEQ ID NO: 680563 - DNA, 20 bp, mouse
gagcagaggctgcttgagtt

SEQ ID NO: 680564 - DNA, 20 bp, mouse
ggggtggctgtgcgggggtt

SEQ ID NO: 680565 - DNA, 20 bp, mouse
gccagccctggtgctgatag

SEQ ID NO: 680566 - DNA, 20 bp, mouse
gcctgcacgggcaaagatgg

SEQ ID NO: 680567 - DNA, 20 bp, mouse
gagtgcccgcagagcgggcc

SEQ ID NO: 680568 - DNA, 20 bp, mouse
ggtccctgcacgggcaaaga

SEQ ID NO: 680569 - DNA, 20 bp, mouse
gaggatgggaactgcctgag

SEQ ID NO: 680570 - DNA, 20 bp, mouse
gacagggtgtacgagatccc

SEQ ID NO: 680571 - DNA, 20 bp, mouse
gaacgtggggcgtatgagtg

SEQ ID NO: 680572 - DNA, 20 bp, mouse
ggctcccagcagtccctgca

SEQ ID NO: 680573 - DNA, 20 bp, mouse
gtgcccgtgcagggactgct

SEQ ID NO: 680574 - DNA, 20 bp, mouse
ggcgtccgggcccgctctgc

SEQ ID NO: 680575 - DNA, 20 bp, mouse
gccgctctgcgggcactcgc

SEQ ID NO: 680576 - DNA, 20 bp, mouse
gccaccaaggctcaaaggga

SEQ ID NO: 680577 - DNA, 20 bp, mouse
gctggagagagaggtcgatg

SEQ ID NO: 680578 - DNA, 20 bp, mouse
gtaggggaccatagtgtgca

SEQ ID NO: 680579 - DNA, 20 bp, mouse
ggggcacagcccgacagggc

SEQ ID NO: 680580 - DNA, 20 bp, mouse
gtatgctggggtatgactta

SEQ ID NO: 680581 - DNA, 20 bp, mouse
gaagcagtcacaagtggccc

SEQ ID NO: 680582 - DNA, 20 bp, mouse
ggtcacgtgactacggggtg

SEQ ID NO: 680583 - DNA, 20 bp, mouse
gtctccagctggaaagtacc

SEQ ID NO: 680584 - DNA, 20 bp, mouse
gacctgccccagctcacagt

SEQ ID NO: 680585 - DNA, 20 bp, mouse
gtgctcaggccccgccctgt

SEQ ID NO: 680586 - DNA, 20 bp, mouse
gcagtcacaagtaaatacac

SEQ ID NO: 680587 - DNA, 20 bp, mouse
gaactcagagacgatttgtc

SEQ ID NO: 680588 - DNA, 20 bp, mouse
gagtgatagatgttagttat

SEQ ID NO: 680589 - DNA, 20 bp, mouse
gaaacacatgttcttctcac

SEQ ID NO: 680590 - DNA, 20 bp, mouse
gtcagaaattagctaatcat

SEQ ID NO: 680591 - DNA, 20 bp, mouse
gacagcagctttggggcaat

SEQ ID NO: 680592 - DNA, 20 bp, mouse
ggaagttttaaatttgttat

SEQ ID NO: 680593 - DNA, 20 bp, mouse
gaacaatactgattctcatt

SEQ ID NO: 680594 - DNA, 20 bp, mouse
gtcattgggtaaagttaaaa

SEQ ID NO: 680595 - DNA, 20 bp, mouse
gtggatataggtacctaaaa

SEQ ID NO: 680596 - DNA, 20 bp, mouse
gggtgcagccgcgtgatcgg

SEQ ID NO: 680597 - DNA, 20 bp, mouse
gaggctgtggggcctcccgg

SEQ ID NO: 680598 - DNA, 20 bp, mouse
ggcggctgcaccgtgagctc

SEQ ID NO: 680599 - DNA, 20 bp, mouse
ggcagccgcgtgatcggggg

SEQ ID NO: 680600 - DNA, 20 bp, mouse
gccgtctccgcccgtgggga

SEQ ID NO: 680601 - DNA, 20 bp, mouse
gcgtgatcgggggtggagga

SEQ ID NO: 680602 - DNA, 20 bp, mouse
gcctgggcgctgtcttggtg

SEQ ID NO: 680603 - DNA, 20 bp, mouse
gtggcccggcggtggggccg

SEQ ID NO: 680604 - DNA, 20 bp, mouse
gcacggtgcagccgcgtgat

SEQ ID NO: 680605 - DNA, 20 bp, mouse
gagagttgaagcaaagtggt

SEQ ID NO: 680606 - DNA, 20 bp, mouse
gcacgcgagagcaacacagt

SEQ ID NO: 680607 - DNA, 20 bp, mouse
gaactggagggcgtgattcg

SEQ ID NO: 680608 - DNA, 20 bp, mouse
ggacctaggcggagctgggt

SEQ ID NO: 680609 - DNA, 20 bp, mouse
gacggcggccgcactaaagg

SEQ ID NO: 680610 - DNA, 20 bp, mouse
ggactagaggagccgggcaa

SEQ ID NO: 680611 - DNA, 20 bp, mouse
gccgcaggggccgacgggaa

SEQ ID NO: 680612 - DNA, 20 bp, mouse
gagctctcgtcggcccgcag

SEQ ID NO: 680613 - DNA, 20 bp, mouse
gcaacccggactagaggagc

SEQ ID NO: 680614 - DNA, 20 bp, mouse
gcaggctcaacccggactag

SEQ ID NO: 680615 - DNA, 20 bp, mouse
gcaacacagtgggcggacct

SEQ ID NO: 680616 - DNA, 20 bp, mouse
gctcccttgggatccgggtg

SEQ ID NO: 680617 - DNA, 20 bp, mouse
gatggcgagggcaagtagcg

SEQ ID NO: 680618 - DNA, 20 bp, mouse
gcaccctctggcctgcgaga

SEQ ID NO: 680619 - DNA, 20 bp, mouse
gctggcctgcgagatggcga

SEQ ID NO: 680620 - DNA, 20 bp, mouse
gagccacacccggatcccaa

SEQ ID NO: 680621 - DNA, 20 bp, mouse
gcagtctcagcactccccgt

SEQ ID NO: 680622 - DNA, 20 bp, mouse
gcccggccctaggactcctt

SEQ ID NO: 680623 - DNA, 20 bp, mouse
gggaggccgaaggagtccta

SEQ ID NO: 680624 - DNA, 20 bp, mouse
ggtgctggcgacctttaccc

SEQ ID NO: 680625 - DNA, 20 bp, mouse
ggcggggccgatgctccctt

SEQ ID NO: 680626 - DNA, 20 bp, mouse
gggactcccaactctcgcag

SEQ ID NO: 680627 - DNA, 20 bp, mouse
gccagggagagttaaagagt

SEQ ID NO: 680628 - DNA, 20 bp, mouse
gtacacactgtaagtgtaca

SEQ ID NO: 680629 - DNA, 20 bp, mouse
gccaactctcgcagaggctg

SEQ ID NO: 680630 - DNA, 20 bp, mouse
gaacagtttaggtctttgtg

SEQ ID NO: 680631 - DNA, 20 bp, mouse
ggggagagttaaagagtcgg

SEQ ID NO: 680632 - DNA, 20 bp, mouse
gctccatcctcgctgctgat

SEQ ID NO: 680633 - DNA, 20 bp, mouse
gaggtctttgtgtggctaaa

SEQ ID NO: 680634 - DNA, 20 bp, mouse
gtagtgcagcaactcttgaa

SEQ ID NO: 680635 - DNA, 20 bp, mouse
gaattcatgaacagttggga

SEQ ID NO: 680636 - DNA, 20 bp, mouse
gggcaggcggggctacggta

SEQ ID NO: 680637 - DNA, 20 bp, mouse
gctacggtacgggagacttg

SEQ ID NO: 680638 - DNA, 20 bp, mouse
gtcccagccggcttgacggg

SEQ ID NO: 680639 - DNA, 20 bp, mouse
gaaatcagggaaaactcttg

SEQ ID NO: 680640 - DNA, 20 bp, mouse
gcaagcggcaggcggggcta

SEQ ID NO: 680641 - DNA, 20 bp, mouse
gccgctggctgccttgggtc

SEQ ID NO: 680642 - DNA, 20 bp, mouse
gtgggctccacccgtcaagc

SEQ ID NO: 680643 - DNA, 20 bp, mouse
gggcccacacccaattgctg

SEQ ID NO: 680644 - DNA, 20 bp, mouse
gtccacccgtcaagccggct

SEQ ID NO: 680645 - DNA, 20 bp, mouse
gcgggctggcctagaggagc

SEQ ID NO: 680646 - DNA, 20 bp, mouse
ggtgcccagccccttcgccg

SEQ ID NO: 680647 - DNA, 20 bp, mouse
gctaccgcagggccccgcgc

SEQ ID NO: 680648 - DNA, 20 bp, mouse
gtcaggaggttgcaggtcag

SEQ ID NO: 680649 - DNA, 20 bp, mouse
gctctaaggctggaaggtat

SEQ ID NO: 680650 - DNA, 20 bp, mouse
gaggctggatactctaaggc

SEQ ID NO: 680651 - DNA, 20 bp, mouse
gtggctcggtggcaggtcca

SEQ ID NO: 680652 - DNA, 20 bp, mouse
gccggaaatggctgcggcga

SEQ ID NO: 680653 - DNA, 20 bp, mouse
gcagccgcggcgaaggggct

SEQ ID NO: 680654 - DNA, 20 bp, mouse
gtcacacaaagagccggaaa

SEQ ID NO: 680655 - DNA, 20 bp, mouse
gtgcaggtcaggggtgcgca

SEQ ID NO: 680656 - DNA, 20 bp, mouse
gagcaaggccaccgcggtcc

SEQ ID NO: 680657 - DNA, 20 bp, mouse
gtgaaggttaggcgggatgg

SEQ ID NO: 680658 - DNA, 20 bp, mouse
gaccgcggtggccttgctaa

SEQ ID NO: 680659 - DNA, 20 bp, mouse
gtgtggccaatgtgcagaag

SEQ ID NO: 680660 - DNA, 20 bp, mouse
gaggccaccgcggtcccggc

SEQ ID NO: 680661 - DNA, 20 bp, mouse
gggtgtgcagggtatatgtg

SEQ ID NO: 680662 - DNA, 20 bp, mouse
ggggcgggggactgcgagct

SEQ ID NO: 680663 - DNA, 20 bp, mouse
gctcccagccgggaccgcgg

SEQ ID NO: 680664 - DNA, 20 bp, mouse
ggggatgggggtgtcacggc

SEQ ID NO: 680665 - DNA, 20 bp, mouse
gtgctaacgggtgggtggtc

SEQ ID NO: 680666 - DNA, 20 bp, mouse
gagagcccacccaccctcga

SEQ ID NO: 680667 - DNA, 20 bp, mouse
gcccttctgttcaccttcga

SEQ ID NO: 680668 - DNA, 20 bp, mouse
ggggatccggagaagggcgg

SEQ ID NO: 680669 - DNA, 20 bp, mouse
gcgcgcgagcgcgacatggg

SEQ ID NO: 680670 - DNA, 20 bp, mouse
ggaggggatccggagaaggg

SEQ ID NO: 680671 - DNA, 20 bp, mouse
gagggggtggggtccaggag

SEQ ID NO: 680672 - DNA, 20 bp, mouse
gcacgtgatcaggagggcga

SEQ ID NO: 680673 - DNA, 20 bp, mouse
gaccctcgaaggtgaacaga

SEQ ID NO: 680674 - DNA, 20 bp, mouse
ggagggccaagacgacgcgg

SEQ ID NO: 680675 - DNA, 20 bp, mouse
gcgcgagggccaagacgacg

SEQ ID NO: 680676 - DNA, 20 bp, mouse
gtagatgtattagtataggg

SEQ ID NO: 680677 - DNA, 20 bp, mouse
gattagttgtttttccaaca

SEQ ID NO: 680678 - DNA, 20 bp, mouse
gcccagctacaaaaatttaa

SEQ ID NO: 680679 - DNA, 20 bp, mouse
gaatttagatgtattagtat

SEQ ID NO: 680680 - DNA, 20 bp, mouse
gctttctctagtatcatctt

SEQ ID NO: 680681 - DNA, 20 bp, mouse
gaatgaacactaattttgag

SEQ ID NO: 680682 - DNA, 20 bp, mouse
gccctttaaatttttgtagc

SEQ ID NO: 680683 - DNA, 20 bp, mouse
gaattttgagtggacatatg

SEQ ID NO: 680684 - DNA, 20 bp, mouse
gttagttgattctaccttgt

SEQ ID NO: 680685 - DNA, 20 bp, mouse
gaaatttgtaatcaatttct

SEQ ID NO: 680686 - DNA, 20 bp, mouse
gaagaaccctgtgacataag

SEQ ID NO: 680687 - DNA, 20 bp, mouse
gtgaagaagtgtggatttga

SEQ ID NO: 680688 - DNA, 20 bp, mouse
gagaattccccttatgtcac

SEQ ID NO: 680689 - DNA, 20 bp, mouse
gagtgtggatttgaggggtg

SEQ ID NO: 680690 - DNA, 20 bp, mouse
gtacagtcagggacattgta

SEQ ID NO: 680691 - DNA, 20 bp, mouse
gtaaaaaggcttggctccca

SEQ ID NO: 680692 - DNA, 20 bp, mouse
gactgaacctactacagtca

SEQ ID NO: 680693 - DNA, 20 bp, mouse
gcagaaaatccaagcataag

SEQ ID NO: 680694 - DNA, 20 bp, mouse
gcaatgtccctgactgtagt

SEQ ID NO: 680695 - DNA, 20 bp, mouse
gagccaagcctttttataaa

SEQ ID NO: 680696 - DNA, 20 bp, mouse
gtcaagctcggtggaggcaa

SEQ ID NO: 680697 - DNA, 20 bp, mouse
gtccgctcggtcaagctcgg

SEQ ID NO: 680698 - DNA, 20 bp, mouse
gtccgaactgcccgcgggga

SEQ ID NO: 680699 - DNA, 20 bp, mouse
ggtaacagaccttcctccaa

SEQ ID NO: 680700 - DNA, 20 bp, mouse
ggctcggtcaagctcggtgg

SEQ ID NO: 680701 - DNA, 20 bp, mouse
ggcaccctgccagcagccat

SEQ ID NO: 680702 - DNA, 20 bp, mouse
gccgcctccgaactgcccgc

SEQ ID NO: 680703 - DNA, 20 bp, mouse
gaagggaaagcgaaggggcg

SEQ ID NO: 680704 - DNA, 20 bp, mouse
ggcagccgaacctgctacct

SEQ ID NO: 680705 - DNA, 20 bp, mouse
gcgaggagcgatggctgatt

SEQ ID NO: 680706 - DNA, 20 bp, mouse
gaaggagccccgctctataa

SEQ ID NO: 680707 - DNA, 20 bp, mouse
gcccacctgcgttagctcag

SEQ ID NO: 680708 - DNA, 20 bp, mouse
gtaaagacttcaacgttgaa

SEQ ID NO: 680709 - DNA, 20 bp, mouse
gtcaacgttgaagggtacac

SEQ ID NO: 680710 - DNA, 20 bp, mouse
gagctgggaaaagtcaacac

SEQ ID NO: 680711 - DNA, 20 bp, mouse
gtcttatcagtgtgggtctt

SEQ ID NO: 680712 - DNA, 20 bp, mouse
gaacgttgaagtctttagaa

SEQ ID NO: 680713 - DNA, 20 bp, mouse
gcagaggtcccgtttagagg

SEQ ID NO: 680714 - DNA, 20 bp, mouse
ggggacctctgagctaacgc

SEQ ID NO: 680715 - DNA, 20 bp, mouse
gaggcccactcgggtgtaca

SEQ ID NO: 680716 - DNA, 20 bp, mouse
ggggtggacactgaggttag

SEQ ID NO: 680717 - DNA, 20 bp, mouse
gcataaaggggcaggagctg

SEQ ID NO: 680718 - DNA, 20 bp, mouse
ggtggtcttagggacccata

SEQ ID NO: 680719 - DNA, 20 bp, mouse
gaacctcagtgtccacccta

SEQ ID NO: 680720 - DNA, 20 bp, mouse
gccccccttcctcctccaga

SEQ ID NO: 680721 - DNA, 20 bp, mouse
gaacactggcaggcagctcc

SEQ ID NO: 680722 - DNA, 20 bp, mouse
gctgaaggatagtggtctta

SEQ ID NO: 680723 - DNA, 20 bp, mouse
ggagctggtggttataagtg

SEQ ID NO: 680724 - DNA, 20 bp, mouse
gctttctctgagtttgggag

SEQ ID NO: 680725 - DNA, 20 bp, mouse
gctgaggttgagacccaagg

SEQ ID NO: 680726 - DNA, 20 bp, mouse
ggcaatgcctgctgctgggt

SEQ ID NO: 680727 - DNA, 20 bp, mouse
gcattgcagaggcaggacca

SEQ ID NO: 680728 - DNA, 20 bp, mouse
gaaggaggtggccttctccc

SEQ ID NO: 680729 - DNA, 20 bp, mouse
gatggctctgctgaaggtag

SEQ ID NO: 680730 - DNA, 20 bp, mouse
gtcactggaggatatgtccc

SEQ ID NO: 680731 - DNA, 20 bp, mouse
gcatctgatggctctcaccc

SEQ ID NO: 680732 - DNA, 20 bp, mouse
gggtgagaggatgacttaat

SEQ ID NO: 680733 - DNA, 20 bp, mouse
ggaaatgtattcggtgctga

SEQ ID NO: 680734 - DNA, 20 bp, mouse
ggcaaaatatgagcatctga

SEQ ID NO: 680735 - DNA, 20 bp, mouse
gcttgccctagaaatgtatt

SEQ ID NO: 680736 - DNA, 20 bp, mouse
gtgggctctggtcatgactg

SEQ ID NO: 680737 - DNA, 20 bp, mouse
gggcaacccaatctcctatg

SEQ ID NO: 680738 - DNA, 20 bp, mouse
gtaggagattgggttgcctg

SEQ ID NO: 680739 - DNA, 20 bp, mouse
gcgtccccctagatggaaaa

SEQ ID NO: 680740 - DNA, 20 bp, mouse
gcacctgcacagcctgctag

SEQ ID NO: 680741 - DNA, 20 bp, mouse
ggtggttagaaactgagagc

SEQ ID NO: 680742 - DNA, 20 bp, mouse
gaatgtctcagacaagtcca

SEQ ID NO: 680743 - DNA, 20 bp, mouse
gtgggttgcctgaggtagag

SEQ ID NO: 680744 - DNA, 20 bp, mouse
gactctctcgtccccctaga

SEQ ID NO: 680745 - DNA, 20 bp, mouse
gaaccactagcaggctgtgc

SEQ ID NO: 680746 - DNA, 20 bp, mouse
ggggaatttggcctccacaa

SEQ ID NO: 680747 - DNA, 20 bp, mouse
gtgagtcctcacccagaaaa

SEQ ID NO: 680748 - DNA, 20 bp, mouse
gaaggacgaactcctggagg

SEQ ID NO: 680749 - DNA, 20 bp, mouse
gtggctaaagagcagagagt

SEQ ID NO: 680750 - DNA, 20 bp, mouse
ggcgctatggatcctcccag

SEQ ID NO: 680751 - DNA, 20 bp, mouse
gcctcacccagaaaagggag

SEQ ID NO: 680752 - DNA, 20 bp, mouse
gattaaggacgaactcctgg

SEQ ID NO: 680753 - DNA, 20 bp, mouse
gcaagggctggctcagatta

SEQ ID NO: 680754 - DNA, 20 bp, mouse
gccctggggcttctgcgcta

SEQ ID NO: 680755 - DNA, 20 bp, mouse
gagagagttggtcatctccc

SEQ ID NO: 680756 - DNA, 20 bp, mouse
gcgtcactctactaactcaa

SEQ ID NO: 680757 - DNA, 20 bp, mouse
gactcaagggcgagatgata

SEQ ID NO: 680758 - DNA, 20 bp, mouse
gtcaggttctgttcaacagt

SEQ ID NO: 680759 - DNA, 20 bp, mouse
gtctctgaagttcattccag

SEQ ID NO: 680760 - DNA, 20 bp, mouse
gaggttgttagacttgggta

SEQ ID NO: 680761 - DNA, 20 bp, mouse
gacaaatcatgagcaggaaa

SEQ ID NO: 680762 - DNA, 20 bp, mouse
ggtggttacaagtcaaaaca

SEQ ID NO: 680763 - DNA, 20 bp, mouse
gaacaaaacaaatcatgagc

SEQ ID NO: 680764 - DNA, 20 bp, mouse
gggatgaccttgggaggctc

SEQ ID NO: 680765 - DNA, 20 bp, mouse
gtctgtagaagggtacagtc

SEQ ID NO: 680766 - DNA, 20 bp, mouse
gcagtggtgggaccgaggga

SEQ ID NO: 680767 - DNA, 20 bp, mouse
gggagcaccttgaaagtgtg

SEQ ID NO: 680768 - DNA, 20 bp, mouse
ggataggcaagaagccatac

SEQ ID NO: 680769 - DNA, 20 bp, mouse
gtgtacctacatcaggtatc

SEQ ID NO: 680770 - DNA, 20 bp, mouse
ggctctaggcaggggggagg

SEQ ID NO: 680771 - DNA, 20 bp, mouse
gcgagggagggacagcctta

SEQ ID NO: 680772 - DNA, 20 bp, mouse
gagggagtgctctaggcagg

SEQ ID NO: 680773 - DNA, 20 bp, mouse
gaaaaggaatccctatgacc

SEQ ID NO: 680774 - DNA, 20 bp, mouse
ggagcccagtggtgggaccg

SEQ ID NO: 680775 - DNA, 20 bp, mouse
gccaccactgggctcagata

SEQ ID NO: 680776 - DNA, 20 bp, mouse
gtaggcccgtccattctcat

SEQ ID NO: 680777 - DNA, 20 bp, mouse
gttggggtcagaagtggctt

SEQ ID NO: 680778 - DNA, 20 bp, mouse
gacttctgaccccaagtgaa

SEQ ID NO: 680779 - DNA, 20 bp, mouse
gcagctcatgctctccacgg

SEQ ID NO: 680780 - DNA, 20 bp, mouse
gaggtggaactgaggagcca

SEQ ID NO: 680781 - DNA, 20 bp, mouse
gtgggccagtccagagtggg

SEQ ID NO: 680782 - DNA, 20 bp, mouse
gagaagtggcttggggtcca

SEQ ID NO: 680783 - DNA, 20 bp, mouse
gggttcagggtgtaaaaatt

SEQ ID NO: 680784 - DNA, 20 bp, mouse
gacctgggccagtccagagt

SEQ ID NO: 680785 - DNA, 20 bp, mouse
gggtcacttgatatcatagc

SEQ ID NO: 680786 - DNA, 20 bp, mouse
ggtgacccagggtggtccag

SEQ ID NO: 680787 - DNA, 20 bp, mouse
gaaaccccggagtagaggga

SEQ ID NO: 680788 - DNA, 20 bp, mouse
gtcaggagggtcccagccag

SEQ ID NO: 680789 - DNA, 20 bp, mouse
gcgtgcttagtgacccaggg

SEQ ID NO: 680790 - DNA, 20 bp, mouse
gtggaggaagcgggacctta

SEQ ID NO: 680791 - DNA, 20 bp, mouse
ggacaagcccttgtcgccaa

SEQ ID NO: 680792 - DNA, 20 bp, mouse
gaaagcgtgggggtcttgac

SEQ ID NO: 680793 - DNA, 20 bp, mouse
gagaggcgcggatttcccac

SEQ ID NO: 680794 - DNA, 20 bp, mouse
ggccagctattgtttcagga

SEQ ID NO: 680795 - DNA, 20 bp, mouse
gtcggttctgaggaaagcgt

SEQ ID NO: 680796 - DNA, 20 bp, mouse
ggggcctggaggtttccttg

SEQ ID NO: 680797 - DNA, 20 bp, mouse
gccaggcccgggtcccaccc

SEQ ID NO: 680798 - DNA, 20 bp, mouse
gcaagggtgacgcccagcac

SEQ ID NO: 680799 - DNA, 20 bp, mouse
gtggtctgctggcgactcac

SEQ ID NO: 680800 - DNA, 20 bp, mouse
ggtccaggtgagactggctt

SEQ ID NO: 680801 - DNA, 20 bp, mouse
gcttgattctagccaggcca

SEQ ID NO: 680802 - DNA, 20 bp, mouse
gggtcggcgaataggagccg

SEQ ID NO: 680803 - DNA, 20 bp, mouse
ggccaggccagggtgggacc

SEQ ID NO: 680804 - DNA, 20 bp, mouse
gtggcgcccgcagctgggga

SEQ ID NO: 680805 - DNA, 20 bp, mouse
gaaccgaagccagtctcacc

SEQ ID NO: 680806 - DNA, 20 bp, mouse
gtctgcccaatacgcctttt

SEQ ID NO: 680807 - DNA, 20 bp, mouse
gctaggactgtggatgcagc

SEQ ID NO: 680808 - DNA, 20 bp, mouse
gtggtttgatgtctgggtag

SEQ ID NO: 680809 - DNA, 20 bp, mouse
gttgatgtctgggtaggggt

SEQ ID NO: 680810 - DNA, 20 bp, mouse
gtccctttggtttgatgtct

SEQ ID NO: 680811 - DNA, 20 bp, mouse
gtaccctgggcaacttagtg

SEQ ID NO: 680812 - DNA, 20 bp, mouse
gtaggggtggggcatggcag

SEQ ID NO: 680813 - DNA, 20 bp, mouse
gagcctcactaagttgccca

SEQ ID NO: 680814 - DNA, 20 bp, mouse
gataaaatataatacccaaa

SEQ ID NO: 680815 - DNA, 20 bp, mouse
gggtgagttcaaggtaccct

SEQ ID NO: 680816 - DNA, 20 bp, mouse
ggagtcagcgaggtgagtga

SEQ ID NO: 680817 - DNA, 20 bp, mouse
gaggggtcaaggagggtcga

SEQ ID NO: 680818 - DNA, 20 bp, mouse
gagctcggggaggcacaagg

SEQ ID NO: 680819 - DNA, 20 bp, mouse
ggggaccgactggcaaggat

SEQ ID NO: 680820 - DNA, 20 bp, mouse
gccgactggcaaggatggga

SEQ ID NO: 680821 - DNA, 20 bp, mouse
gtccggggtggagtccacca

SEQ ID NO: 680822 - DNA, 20 bp, mouse
gtggcccggcggacgcaccg

SEQ ID NO: 680823 - DNA, 20 bp, mouse
gtgtcggtcacccgaggccc

SEQ ID NO: 680824 - DNA, 20 bp, mouse
gacgctgaataagggcggag

SEQ ID NO: 680825 - DNA, 20 bp, mouse
gtccctaagcccgggagctc

SEQ ID NO: 680826 - DNA, 20 bp, mouse
gcccaggaggcgcgctcaga

SEQ ID NO: 680827 - DNA, 20 bp, mouse
gggcagaggcggcgcactgg

SEQ ID NO: 680828 - DNA, 20 bp, mouse
ggtaacgtgggcagtaacct

SEQ ID NO: 680829 - DNA, 20 bp, mouse
gaagccgcaccgtggtaact

SEQ ID NO: 680830 - DNA, 20 bp, mouse
gttgggcagcgcctcgaggg

SEQ ID NO: 680831 - DNA, 20 bp, mouse
gctagtcccgcacccccagg

SEQ ID NO: 680832 - DNA, 20 bp, mouse
gtgcctcggcgcggaacaaa

SEQ ID NO: 680833 - DNA, 20 bp, mouse
gacacctaggacaaggaaag

SEQ ID NO: 680834 - DNA, 20 bp, mouse
gcccacgaggcgcctgtgaa

SEQ ID NO: 680835 - DNA, 20 bp, mouse
gttccgcgccgaggcagagg

SEQ ID NO: 680836 - DNA, 20 bp, mouse
ggggaggcgtggtgagaggc

SEQ ID NO: 680837 - DNA, 20 bp, mouse
gccgccggggacccacttgt

SEQ ID NO: 680838 - DNA, 20 bp, mouse
gggctctggagttgctgtta

SEQ ID NO: 680839 - DNA, 20 bp, mouse
ggcgcctacaagtgggtccc

SEQ ID NO: 680840 - DNA, 20 bp, mouse
ggcggcgggagggaggggta

SEQ ID NO: 680841 - DNA, 20 bp, mouse
gccgcccggggctctgtcgc

SEQ ID NO: 680842 - DNA, 20 bp, mouse
gaagcgggaggcgtggtgag

SEQ ID NO: 680843 - DNA, 20 bp, mouse
gagaaggaagagaaggcgcg

SEQ ID NO: 680844 - DNA, 20 bp, mouse
gcgagtccagcaccttcaaa

SEQ ID NO: 680845 - DNA, 20 bp, mouse
gcgcgtccagcaccccccct

SEQ ID NO: 680846 - DNA, 20 bp, mouse
gtccgcacaaggatgtgcat

SEQ ID NO: 680847 - DNA, 20 bp, mouse
gccactccctatttggatgt

SEQ ID NO: 680848 - DNA, 20 bp, mouse
gcaaatagggagtggcatct

SEQ ID NO: 680849 - DNA, 20 bp, mouse
gtctcacgctggcactctgg

SEQ ID NO: 680850 - DNA, 20 bp, mouse
gtagggagtggcatctgggc

SEQ ID NO: 680851 - DNA, 20 bp, mouse
gtcacgtgggcttctcacgc

SEQ ID NO: 680852 - DNA, 20 bp, mouse
ggcatctgggcgggagctgg

SEQ ID NO: 680853 - DNA, 20 bp, mouse
gagtaatgattggaagcagt

SEQ ID NO: 680854 - DNA, 20 bp, mouse
ggttcaccgacatccaaata

SEQ ID NO: 680855 - DNA, 20 bp, mouse
gtgggggtactcaaggaggg

SEQ ID NO: 680856 - DNA, 20 bp, mouse
gaggtggacaagatgaacta

SEQ ID NO: 680857 - DNA, 20 bp, mouse
gggactctcaagaacttcgc

SEQ ID NO: 680858 - DNA, 20 bp, mouse
gtgcaagacctctactaaga

SEQ ID NO: 680859 - DNA, 20 bp, mouse
gtgagagtccgtggatgagg

SEQ ID NO: 680860 - DNA, 20 bp, mouse
gcgggccatctggaaagtga

SEQ ID NO: 680861 - DNA, 20 bp, mouse
gtcccggggcgggccaatag

SEQ ID NO: 680862 - DNA, 20 bp, mouse
gagacctctactaagaaggc

SEQ ID NO: 680863 - DNA, 20 bp, mouse
gaaggcaagcctagctgggt

SEQ ID NO: 680864 - DNA, 20 bp, mouse
gggacagatcctgattggaa

SEQ ID NO: 680865 - DNA, 20 bp, mouse
gctggctctcagtcgtgaga

SEQ ID NO: 680866 - DNA, 20 bp, mouse
gacaacagtaggcagggcta

SEQ ID NO: 680867 - DNA, 20 bp, mouse
ggagcacaagacatctggtg

SEQ ID NO: 680868 - DNA, 20 bp, mouse
gggtgtggagctgttgtcac

SEQ ID NO: 680869 - DNA, 20 bp, mouse
gaagaggagcacaagacatc

SEQ ID NO: 680870 - DNA, 20 bp, mouse
gagaccacttgcaaagggat

SEQ ID NO: 680871 - DNA, 20 bp, mouse
ggcagcctaaaggtcttcct

SEQ ID NO: 680872 - DNA, 20 bp, mouse
gtcttcacctccaggaccaa

SEQ ID NO: 680873 - DNA, 20 bp, mouse
gagcacccacaacagtaggc

SEQ ID NO: 680874 - DNA, 20 bp, mouse
gcagggagtgacaatttcca

SEQ ID NO: 680875 - DNA, 20 bp, mouse
ggcagggctagggctgactc

SEQ ID NO: 680876 - DNA, 20 bp, mouse
gggatatgatggagtcaaag

SEQ ID NO: 680877 - DNA, 20 bp, mouse
gaggaagtcctctgggtgtt

SEQ ID NO: 680878 - DNA, 20 bp, mouse
gatactcccagggacagaag

SEQ ID NO: 680879 - DNA, 20 bp, mouse
gtctgtgcacccatcagtgg

SEQ ID NO: 680880 - DNA, 20 bp, mouse
ggctgggttgtcgtgctcca

SEQ ID NO: 680881 - DNA, 20 bp, mouse
gccatgttaggagataggat

SEQ ID NO: 680882 - DNA, 20 bp, mouse
gaactctgtgcacccatcag

SEQ ID NO: 680883 - DNA, 20 bp, mouse
gttcctgcctatgtatggct

SEQ ID NO: 680884 - DNA, 20 bp, mouse
gccttttccaagccatacat

SEQ ID NO: 680885 - DNA, 20 bp, mouse
gagagtccatgttaggagat

SEQ ID NO: 680886 - DNA, 20 bp, mouse
gaggcaatgagcctctcgaa

SEQ ID NO: 680887 - DNA, 20 bp, mouse
gatacgcccagggacagaat

SEQ ID NO: 680888 - DNA, 20 bp, mouse
ggttgtggtgccccttcgag

SEQ ID NO: 680889 - DNA, 20 bp, mouse
gggcatgtgccaccactaat

SEQ ID NO: 680890 - DNA, 20 bp, mouse
ggcaattctatctccttaca

SEQ ID NO: 680891 - DNA, 20 bp, mouse
gaggaagacctctgggtgct

SEQ ID NO: 680892 - DNA, 20 bp, mouse
gggacagaatgggcagaaga

SEQ ID NO: 680893 - DNA, 20 bp, mouse
gtctgtgcacccattagtgg

SEQ ID NO: 680894 - DNA, 20 bp, mouse
gggcaaagaggaagacctct

SEQ ID NO: 680895 - DNA, 20 bp, mouse
gtctgtccctgggcgtataa

SEQ ID NO: 680896 - DNA, 20 bp, mouse
gaaacttggtgcacaatagt

SEQ ID NO: 680897 - DNA, 20 bp, mouse
ggggtcgggtgtggtagtat

SEQ ID NO: 680898 - DNA, 20 bp, mouse
gtgaaagactcccaagggtc

SEQ ID NO: 680899 - DNA, 20 bp, mouse
gactaccacacccgaccctt

SEQ ID NO: 680900 - DNA, 20 bp, mouse
gttcattgaaagactcccaa

SEQ ID NO: 680901 - DNA, 20 bp, mouse
ggactcccaagggtcgggtg

SEQ ID NO: 680902 - DNA, 20 bp, mouse
gcataatcaagaccaaagtc

SEQ ID NO: 680903 - DNA, 20 bp, mouse
gtgcacaatagtgggtagtc

SEQ ID NO: 680904 - DNA, 20 bp, mouse
gagaaggggcccaaatgata

SEQ ID NO: 680905 - DNA, 20 bp, mouse
gagggagtagactgaatctg

SEQ ID NO: 680906 - DNA, 20 bp, mouse
gtctagtatccatgttatga

SEQ ID NO: 680907 - DNA, 20 bp, mouse
ggggtcgggtgtggtagtat

SEQ ID NO: 680908 - DNA, 20 bp, mouse
gtgaaagactcccaagggtc

SEQ ID NO: 680909 - DNA, 20 bp, mouse
gactaccacacccgaccctt

SEQ ID NO: 680910 - DNA, 20 bp, mouse
gttcattgaaagactcccaa

SEQ ID NO: 680911 - DNA, 20 bp, mouse
ggactcccaagggtcgggtg

SEQ ID NO: 680912 - DNA, 20 bp, mouse
gtgcacaatagtggatagtc

SEQ ID NO: 680913 - DNA, 20 bp, mouse
gagaaggggcccaaatgata

SEQ ID NO: 680914 - DNA, 20 bp, mouse
gagggagtagactgaatctg

SEQ ID NO: 680915 - DNA, 20 bp, mouse
ggggacattgccaacactgg

SEQ ID NO: 680916 - DNA, 20 bp, mouse
ggaagtgagcataaacccag

SEQ ID NO: 680917 - DNA, 20 bp, mouse
gagggcgtgtcctgaaaccc

SEQ ID NO: 680918 - DNA, 20 bp, mouse
gacgccctgtgcatgctgct

SEQ ID NO: 680919 - DNA, 20 bp, mouse
gagagttccagtcctgaaaa

SEQ ID NO: 680920 - DNA, 20 bp, mouse
gtatgctcacttcccttttc

SEQ ID NO: 680921 - DNA, 20 bp, mouse
gtaagagccaataaggataa

SEQ ID NO: 680922 - DNA, 20 bp, mouse
gggaactctgcctgggtttc

SEQ ID NO: 680923 - DNA, 20 bp, mouse
ggcactgaattgctgttggt

SEQ ID NO: 680924 - DNA, 20 bp, mouse
gctagaagacatcgtttctt

SEQ ID NO: 680925 - DNA, 20 bp, mouse
gcaagtcatttgcttgtgtt

SEQ ID NO: 680926 - DNA, 20 bp, mouse
gtactgggacaagagactgc

SEQ ID NO: 680927 - DNA, 20 bp, mouse
gttaccctcactgtagatgt

SEQ ID NO: 680928 - DNA, 20 bp, mouse
gaggagtgagcagccaaagc

SEQ ID NO: 680929 - DNA, 20 bp, mouse
gttgccaacatctacagtga

SEQ ID NO: 680930 - DNA, 20 bp, mouse
ggctatggctcctcacgctc

SEQ ID NO: 680931 - DNA, 20 bp, mouse
gctggacaatgagagacagg

SEQ ID NO: 680932 - DNA, 20 bp, mouse
ggatgcttcttgttttatgg

SEQ ID NO: 680933 - DNA, 20 bp, mouse
gtctcattgtccagagcgtg

SEQ ID NO: 680934 - DNA, 20 bp, mouse
gagtgatgcttcttgtttta

SEQ ID NO: 680935 - DNA, 20 bp, mouse
gcctggatcagggaatgaac

SEQ ID NO: 680936 - DNA, 20 bp, mouse
gtgaaatgtgccagatgagg

SEQ ID NO: 680937 - DNA, 20 bp, mouse
gacaggcataccacctcatc

SEQ ID NO: 680938 - DNA, 20 bp, mouse
ggaatgaaatgtgccagatg

SEQ ID NO: 680939 - DNA, 20 bp, mouse
gcttagtactggaattacac

SEQ ID NO: 680940 - DNA, 20 bp, mouse
gggcagatacatgcgagaat

SEQ ID NO: 680941 - DNA, 20 bp, mouse
gtccttgccaaagtctaggg

SEQ ID NO: 680942 - DNA, 20 bp, mouse
ggcagcccaggtaggaacta

SEQ ID NO: 680943 - DNA, 20 bp, mouse
gtagactttggcaaggacat

SEQ ID NO: 680944 - DNA, 20 bp, mouse
gagcaggtcaccagcagccc

SEQ ID NO: 680945 - DNA, 20 bp, mouse
gccacctcccagatatcaac

SEQ ID NO: 680946 - DNA, 20 bp, mouse
gagcacccatacttcctgtt

SEQ ID NO: 680947 - DNA, 20 bp, mouse
gcagcccaaacaggaagtat

SEQ ID NO: 680948 - DNA, 20 bp, mouse
gatgtcattgccaacatcta

SEQ ID NO: 680949 - DNA, 20 bp, mouse
gaaaggaatggggagtgagc

SEQ ID NO: 680950 - DNA, 20 bp, mouse
gtggagttgcataagtgagt

SEQ ID NO: 680951 - DNA, 20 bp, mouse
gttaccccaaccctagatgt

SEQ ID NO: 680952 - DNA, 20 bp, mouse
ggagatggaaagttgagtgg

SEQ ID NO: 680953 - DNA, 20 bp, mouse
gcaaggagaaggcattgatc

SEQ ID NO: 680954 - DNA, 20 bp, mouse
gattgccaacatctagggtt

SEQ ID NO: 680955 - DNA, 20 bp, mouse
ggataggctgatacctagtg

SEQ ID NO: 680956 - DNA, 20 bp, mouse
gagtgtgtgggcaatagaat

SEQ ID NO: 680957 - DNA, 20 bp, mouse
gcacctggacagtgagagac

SEQ ID NO: 680958 - DNA, 20 bp, mouse
gattgcccacacactgtcat

SEQ ID NO: 680959 - DNA, 20 bp, mouse
gagcaccatacttcgtgttt

SEQ ID NO: 680960 - DNA, 20 bp, mouse
ggggagtgatgcctttgttt

SEQ ID NO: 680961 - DNA, 20 bp, mouse
gagtgatgcctttgtttcgg

SEQ ID NO: 680962 - DNA, 20 bp, mouse
gaatagaatagggagtaagc

SEQ ID NO: 680963 - DNA, 20 bp, mouse
ggacagtgagagacaggatg

SEQ ID NO: 680964 - DNA, 20 bp, mouse
gtgcacatgtgttattacat

SEQ ID NO: 680965 - DNA, 20 bp, mouse
gcataggacaaaagaacact

SEQ ID NO: 680966 - DNA, 20 bp, mouse
ggaatgaaatgtgctagatg

SEQ ID NO: 680967 - DNA, 20 bp, mouse
gggaacccactacatatctt

SEQ ID NO: 680968 - DNA, 20 bp, mouse
gttggtaaacagaaatacag

SEQ ID NO: 680969 - DNA, 20 bp, mouse
gtgttgaggagatcaatagc

SEQ ID NO: 680970 - DNA, 20 bp, mouse
gtgaaatgtgctagatgagg

SEQ ID NO: 680971 - DNA, 20 bp, mouse
ggtctgttgccttcccctat

SEQ ID NO: 680972 - DNA, 20 bp, mouse
gtctgtttaccaatagggga

SEQ ID NO: 680973 - DNA, 20 bp, mouse
ggtggatttcaactatgttg

SEQ ID NO: 680974 - DNA, 20 bp, mouse
gtaacatagtgttcatactt

SEQ ID NO: 680975 - DNA, 20 bp, mouse
gcttagtactggaattacac

SEQ ID NO: 680976 - DNA, 20 bp, mouse
gggcactctgtaaaggtcaa

SEQ ID NO: 680977 - DNA, 20 bp, mouse
gtcaaatgggcactctgtaa

SEQ ID NO: 680978 - DNA, 20 bp, mouse
gtctggttaacagtacagac

SEQ ID NO: 680979 - DNA, 20 bp, mouse
gtgccaacccaagtatataa

SEQ ID NO: 680980 - DNA, 20 bp, mouse
gtagtcaatgatgctcaaag

SEQ ID NO: 680981 - DNA, 20 bp, mouse
ggagtgcccatttgaatttc

SEQ ID NO: 680982 - DNA, 20 bp, mouse
gtaagtcatatatgactata

SEQ ID NO: 680983 - DNA, 20 bp, mouse
gaagtcatactgtataacat

SEQ ID NO: 680984 - DNA, 20 bp, mouse
gcatcattgactaatccatt

SEQ ID NO: 680985 - DNA, 20 bp, mouse
ggagattaaatatttcctaa

SEQ ID NO: 680986 - DNA, 20 bp, mouse
ggggtgccgcataaaaagca

SEQ ID NO: 680987 - DNA, 20 bp, mouse
gttaaggcaaagtctcttat

SEQ ID NO: 680988 - DNA, 20 bp, mouse
gttaaagggaaaaaaggtca

SEQ ID NO: 680989 - DNA, 20 bp, mouse
gttataaataggagagtttt

SEQ ID NO: 680990 - DNA, 20 bp, mouse
gaccaattgttctctatctt

SEQ ID NO: 680991 - DNA, 20 bp, mouse
ggtatataacaactgttaaa

SEQ ID NO: 680992 - DNA, 20 bp, mouse
gctgtataatggtgattgtt

SEQ ID NO: 680993 - DNA, 20 bp, mouse
gacccaagatagagaacaat

SEQ ID NO: 680994 - DNA, 20 bp, mouse
ggcatgctaaatctgtataa

SEQ ID NO: 680995 - DNA, 20 bp, mouse
gaaaataaagaattataaat

SEQ ID NO: 680996 - DNA, 20 bp, mouse
gggcaccatataatgttcaa

SEQ ID NO: 680997 - DNA, 20 bp, mouse
gtggtgcccatttgaatatc

SEQ ID NO: 680998 - DNA, 20 bp, mouse
ggtaaataacatctctatca

SEQ ID NO: 680999 - DNA, 20 bp, mouse
gacatatcagcttagtgaac

SEQ ID NO: 681000 - DNA, 20 bp, mouse
gtatcagcttagtgaacagg

SEQ ID NO: 681001 - DNA, 20 bp, mouse
gatagcagaaaaattgttag

SEQ ID NO: 681002 - DNA, 20 bp, mouse
gatgtcatatgatataacat

SEQ ID NO: 681003 - DNA, 20 bp, mouse
gcatatgatataacataggg

SEQ ID NO: 681004 - DNA, 20 bp, mouse
gatgttggcatgtttaataa

SEQ ID NO: 681005 - DNA, 20 bp, mouse
gaatatatttctagctatcg

SEQ ID NO: 681006 - DNA, 20 bp, mouse
gactatctggttaacagtac

SEQ ID NO: 681007 - DNA, 20 bp, mouse
gcggagcccatttgactatc

SEQ ID NO: 681008 - DNA, 20 bp, mouse
gcagaagaactgttagttag

SEQ ID NO: 681009 - DNA, 20 bp, mouse
gtgttaaccagatagtcaaa

SEQ ID NO: 681010 - DNA, 20 bp, mouse
gaagtcataggatataagat

SEQ ID NO: 681011 - DNA, 20 bp, mouse
gcataggatataagataggt

SEQ ID NO: 681012 - DNA, 20 bp, mouse
gatgttggcatgttcaatat

SEQ ID NO: 681013 - DNA, 20 bp, mouse
ggctgtttaattgctataaa

SEQ ID NO: 681014 - DNA, 20 bp, mouse
gggctccgtgaaatggtcaa

SEQ ID NO: 681015 - DNA, 20 bp, mouse
gtcaaatgggctccgtgaaa

SEQ ID NO: 681016 - DNA, 20 bp, mouse
gatcagagggtggacgaggg

SEQ ID NO: 681017 - DNA, 20 bp, mouse
gcacctaaccctcaaaggac

SEQ ID NO: 681018 - DNA, 20 bp, mouse
gggggactccagtcctttga

SEQ ID NO: 681019 - DNA, 20 bp, mouse
gccccacccctgtcaccacg

SEQ ID NO: 681020 - DNA, 20 bp, mouse
gctccagtcctttgagggtt

SEQ ID NO: 681021 - DNA, 20 bp, mouse
ggagtgcctgtaagacatct

SEQ ID NO: 681022 - DNA, 20 bp, mouse
gggaggtggtgatatccacg

SEQ ID NO: 681023 - DNA, 20 bp, mouse
ggtgatatccacgtggtgac

SEQ ID NO: 681024 - DNA, 20 bp, mouse
ggttatcagagggtggacga

SEQ ID NO: 681025 - DNA, 20 bp, mouse
gtgttgaactctcttccaaa

SEQ ID NO: 681026 - DNA, 20 bp, mouse
gctggagcctgagatcaaga

SEQ ID NO: 681027 - DNA, 20 bp, mouse
gcatgcgcacattattatgt

SEQ ID NO: 681028 - DNA, 20 bp, mouse
gtggggttgagtttgtttgc

SEQ ID NO: 681029 - DNA, 20 bp, mouse
gggtgctcgggtgacaagat

SEQ ID NO: 681030 - DNA, 20 bp, mouse
gtgctcagagttttggactt

SEQ ID NO: 681031 - DNA, 20 bp, mouse
ggctcgggtgacaagatggg

SEQ ID NO: 681032 - DNA, 20 bp, mouse
gcaaaggctgctcagagttt

SEQ ID NO: 681033 - DNA, 20 bp, mouse
gaggtgggcgttccctgcct

SEQ ID NO: 681034 - DNA, 20 bp, mouse
gttaagccccaataatcggt

SEQ ID NO: 681035 - DNA, 20 bp, mouse
gcgagaaaatacaagagcta

SEQ ID NO: 681036 - DNA, 20 bp, mouse
ggggtaccgcataaagaaca

SEQ ID NO: 681037 - DNA, 20 bp, mouse
gagaatgttccaaagtgcaa

SEQ ID NO: 681038 - DNA, 20 bp, mouse
gggaaaactcaaacaggtca

SEQ ID NO: 681039 - DNA, 20 bp, mouse
gattaaggtaagatctctta

SEQ ID NO: 681040 - DNA, 20 bp, mouse
gtaataaatagaatgtggta

SEQ ID NO: 681041 - DNA, 20 bp, mouse
gaaagtgcaatggattgatc

SEQ ID NO: 681042 - DNA, 20 bp, mouse
gtatcatctatctatgtatc

SEQ ID NO: 681043 - DNA, 20 bp, mouse
gcacgtagaagtccttaaaa

SEQ ID NO: 681044 - DNA, 20 bp, mouse
gttttaccttgttctttatg

SEQ ID NO: 681045 - DNA, 20 bp, mouse
ggtatctggattttattaca

SEQ ID NO: 681046 - DNA, 20 bp, mouse
ggggcaacacataaagaaca

SEQ ID NO: 681047 - DNA, 20 bp, mouse
gttaaggcaaaatgtcttat

SEQ ID NO: 681048 - DNA, 20 bp, mouse
gtatttatcatatatgatgt

SEQ ID NO: 681049 - DNA, 20 bp, mouse
gcctcaaggatatgggcaaa

SEQ ID NO: 681050 - DNA, 20 bp, mouse
ggtcacttgtattttgacaa

SEQ ID NO: 681051 - DNA, 20 bp, mouse
gataaatatgattgcaatat

SEQ ID NO: 681052 - DNA, 20 bp, mouse
gggacagtatcttcgacaaa

SEQ ID NO: 681053 - DNA, 20 bp, mouse
gggaaaagcctcaaggatat

SEQ ID NO: 681054 - DNA, 20 bp, mouse
gctcaagtctaagaggatca

SEQ ID NO: 681055 - DNA, 20 bp, mouse
gagatcaagaatcaacaagt

SEQ ID NO: 681056 - DNA, 20 bp, mouse
ggatgtaactggaactatga

SEQ ID NO: 681057 - DNA, 20 bp, mouse
gtcaggcttcaagatgtaac

SEQ ID NO: 681058 - DNA, 20 bp, mouse
gcagactagctcaccatggt

SEQ ID NO: 681059 - DNA, 20 bp, mouse
gtggtgagctagtctggagt

SEQ ID NO: 681060 - DNA, 20 bp, mouse
gaagactcataacaatatct

SEQ ID NO: 681061 - DNA, 20 bp, mouse
gttatcttctgaatggactc

SEQ ID NO: 681062 - DNA, 20 bp, mouse
ggaggctagagatcgacttt

SEQ ID NO: 681063 - DNA, 20 bp, mouse
ggaggagattttaccaacca

SEQ ID NO: 681064 - DNA, 20 bp, mouse
gaagatctcttgcttcactg

SEQ ID NO: 681065 - DNA, 20 bp, mouse
gaaaactgcacataactgat

SEQ ID NO: 681066 - DNA, 20 bp, mouse
gtggaacaaagtccactggg

SEQ ID NO: 681067 - DNA, 20 bp, mouse
gattgtggattacttataat

SEQ ID NO: 681068 - DNA, 20 bp, mouse
gggattacttataatgggtt

SEQ ID NO: 681069 - DNA, 20 bp, mouse
gatgttggaacaaagtccac

SEQ ID NO: 681070 - DNA, 20 bp, mouse
gagtactttaatcacgatgt

SEQ ID NO: 681071 - DNA, 20 bp, mouse
gcagcatatcctgtagattg

SEQ ID NO: 681072 - DNA, 20 bp, mouse
gtaagtaatccacaatctac

SEQ ID NO: 681073 - DNA, 20 bp, mouse
ggtacttcatgttagaaaat

SEQ ID NO: 681074 - DNA, 20 bp, mouse
ggttttgtatcagagaatca

SEQ ID NO: 681075 - DNA, 20 bp, mouse
gggttgggtttgaaaaatta

SEQ ID NO: 681076 - DNA, 20 bp, mouse
gcaacagcatatccttataa

SEQ ID NO: 681077 - DNA, 20 bp, mouse
gtcaaacccaatccattata

SEQ ID NO: 681078 - DNA, 20 bp, mouse
gtggaacaaagtcccctgcg

SEQ ID NO: 681079 - DNA, 20 bp, mouse
gacacttaatctctcctcgc

SEQ ID NO: 681080 - DNA, 20 bp, mouse
ggattgggtttgaaaaattt

SEQ ID NO: 681081 - DNA, 20 bp, mouse
ggtacttcatgacagaaaat

SEQ ID NO: 681082 - DNA, 20 bp, mouse
gaacatagtgattaaagtgc

SEQ ID NO: 681083 - DNA, 20 bp, mouse
gttaatttaatgaacactag

SEQ ID NO: 681084 - DNA, 20 bp, mouse
gcatatccttataatggatt

SEQ ID NO: 681085 - DNA, 20 bp, mouse
ggaagttgtaaaaaattcag

SEQ ID NO: 681086 - DNA, 20 bp, mouse
gggggtctccagtcccttga

SEQ ID NO: 681087 - DNA, 20 bp, mouse
gacgagggggagataaagta

SEQ ID NO: 681088 - DNA, 20 bp, mouse
gggagtttaaagttcaggtg

SEQ ID NO: 681089 - DNA, 20 bp, mouse
gatgatgcacctaaccctca

SEQ ID NO: 681090 - DNA, 20 bp, mouse
gcccagggagtttaaagttc

SEQ ID NO: 681091 - DNA, 20 bp, mouse
gtgtttaatttgcttccaaa

SEQ ID NO: 681092 - DNA, 20 bp, mouse
gggagacaggggtcgggagg

SEQ ID NO: 681093 - DNA, 20 bp, mouse
gttatcagagggtggacgag

SEQ ID NO: 681094 - DNA, 20 bp, mouse
gcgtggagacaggggtcggg

SEQ ID NO: 681095 - DNA, 20 bp, mouse
gtgttgagttgtaacaagta

SEQ ID NO: 681096 - DNA, 20 bp, mouse
gtaaaacccacatgtcttac

SEQ ID NO: 681097 - DNA, 20 bp, mouse
gtgggatgtggattatcgga

SEQ ID NO: 681098 - DNA, 20 bp, mouse
gagcgtgcctgtaagacatg

SEQ ID NO: 681099 - DNA, 20 bp, mouse
ggatgtggattatcggaggg

SEQ ID NO: 681100 - DNA, 20 bp, mouse
ggtcaggtggggtagggctc

SEQ ID NO: 681101 - DNA, 20 bp, mouse
gcaagggactagagaatcca

SEQ ID NO: 681102 - DNA, 20 bp, mouse
gaatatgggatgtggattat

SEQ ID NO: 681103 - DNA, 20 bp, mouse
gttattcactttctaacaca

SEQ ID NO: 681104 - DNA, 20 bp, mouse
gagggctcgggatatccatg

SEQ ID NO: 681105 - DNA, 20 bp, mouse
gcaggggtcgggaggaaata

SEQ ID NO: 681106 - DNA, 20 bp, mouse
gggtcaggtgtgtggaggtg

SEQ ID NO: 681107 - DNA, 20 bp, mouse
ggggttatcagagggtggat

SEQ ID NO: 681108 - DNA, 20 bp, mouse
gggggactccagtcccttga

SEQ ID NO: 681109 - DNA, 20 bp, mouse
gttagaggtcaggtgtgtgg

SEQ ID NO: 681110 - DNA, 20 bp, mouse
gatgatgcacctaaccctca

SEQ ID NO: 681111 - DNA, 20 bp, mouse
gagtttagaggtcaggtgtg

SEQ ID NO: 681112 - DNA, 20 bp, mouse
gtgttgagttgtgaccagta

SEQ ID NO: 681113 - DNA, 20 bp, mouse
ggggatattcacgtggtgac

SEQ ID NO: 681114 - DNA, 20 bp, mouse
gttatcagagggtggatggg

SEQ ID NO: 681115 - DNA, 20 bp, mouse
gtcacgtggtgacaggggtg

SEQ ID NO: 681116 - DNA, 20 bp, mouse
gaggagagatgatgttgtgg

SEQ ID NO: 681117 - DNA, 20 bp, mouse
gcatactgccctctaaagaa

SEQ ID NO: 681118 - DNA, 20 bp, mouse
gctgggaggcatggaaagaa

SEQ ID NO: 681119 - DNA, 20 bp, mouse
gtgactctcccttctttaga

SEQ ID NO: 681120 - DNA, 20 bp, mouse
gatggggcaacccactaata

SEQ ID NO: 681121 - DNA, 20 bp, mouse
ggcaacccactaatagggaa

SEQ ID NO: 681122 - DNA, 20 bp, mouse
gagcaaagggcagatctctc

SEQ ID NO: 681123 - DNA, 20 bp, mouse
gtccgaaagtacacagagtt

SEQ ID NO: 681124 - DNA, 20 bp, mouse
gggatcctttccctattagt

SEQ ID NO: 681125 - DNA, 20 bp, mouse
gtccaaactctgtgtacttt

SEQ ID NO: 681126 - DNA, 20 bp, mouse
gatggtaggcagatatctcg

SEQ ID NO: 681127 - DNA, 20 bp, mouse
gagaacattcgtcctgaagc

SEQ ID NO: 681128 - DNA, 20 bp, mouse
gggaagtgaaaggtagtggt

SEQ ID NO: 681129 - DNA, 20 bp, mouse
gtactcatgcaaatcttaga

SEQ ID NO: 681130 - DNA, 20 bp, mouse
ggacaaacaaaacacagtgt

SEQ ID NO: 681131 - DNA, 20 bp, mouse
ggggcaaaagcagggcagtc

SEQ ID NO: 681132 - DNA, 20 bp, mouse
gaaggctctgctggtaagtg

SEQ ID NO: 681133 - DNA, 20 bp, mouse
ggtgatgttcagttcctttc

SEQ ID NO: 681134 - DNA, 20 bp, mouse
gaaagcagggcagtcgggaa

SEQ ID NO: 681135 - DNA, 20 bp, mouse
gggcgagtgagggccagtag

SEQ ID NO: 681136 - DNA, 20 bp, mouse
gactgggtcctccctatccc

SEQ ID NO: 681137 - DNA, 20 bp, mouse
gggaaggaactgaatatcac

SEQ ID NO: 681138 - DNA, 20 bp, mouse
gcccgggccaaaaaaaacac

SEQ ID NO: 681139 - DNA, 20 bp, mouse
gttttttttggcccgggata

SEQ ID NO: 681140 - DNA, 20 bp, mouse
gaaggcatatagagcccctg

SEQ ID NO: 681141 - DNA, 20 bp, mouse
gtaaagtggaagttactggt

SEQ ID NO: 681142 - DNA, 20 bp, mouse
gttgactgccatcctgtgaa

SEQ ID NO: 681143 - DNA, 20 bp, mouse
gtagagcccctgtggtaaag

SEQ ID NO: 681144 - DNA, 20 bp, mouse
ggtaacttccactttaccac

SEQ ID NO: 681145 - DNA, 20 bp, mouse
ggtggaagttactggtggga

SEQ ID NO: 681146 - DNA, 20 bp, mouse
ggagacaaatgggggttctg

SEQ ID NO: 681147 - DNA, 20 bp, mouse
ggggtggcatataaagcaag

SEQ ID NO: 681148 - DNA, 20 bp, mouse
gcaaacaaaacactgggttg

SEQ ID NO: 681149 - DNA, 20 bp, mouse
gagaggcagtagtaggtaac

SEQ ID NO: 681150 - DNA, 20 bp, mouse
gctggttggtcagacatgga

SEQ ID NO: 681151 - DNA, 20 bp, mouse
ggtgaacaagaggcagtagt

SEQ ID NO: 681152 - DNA, 20 bp, mouse
gcaaaacactgggttggggc

SEQ ID NO: 681153 - DNA, 20 bp, mouse
gtttgagggcttgaggtgtt

SEQ ID NO: 681154 - DNA, 20 bp, mouse
ggggagtgctgagacaaatg

SEQ ID NO: 681155 - DNA, 20 bp, mouse
gtcacactatccaccaagct

SEQ ID NO: 681156 - DNA, 20 bp, mouse
gaggaggcggatccactccc

SEQ ID NO: 681157 - DNA, 20 bp, mouse
gcaaatcggtctcacctccc

SEQ ID NO: 681158 - DNA, 20 bp, mouse
ggaggaggcgggagaggaat

SEQ ID NO: 681159 - DNA, 20 bp, mouse
gaggagggcacgttctgacg

SEQ ID NO: 681160 - DNA, 20 bp, mouse
gcggtctcacctcccgggag

SEQ ID NO: 681161 - DNA, 20 bp, mouse
gagggcacgttctgacgggg

SEQ ID NO: 681162 - DNA, 20 bp, mouse
gaggcactgcaacgaggagg

SEQ ID NO: 681163 - DNA, 20 bp, mouse
gaggaggcactgcaacgagg

SEQ ID NO: 681164 - DNA, 20 bp, mouse
gaggcggatccactcccggg

SEQ ID NO: 681165 - DNA, 20 bp, mouse
ggaggaggatgatacattct

SEQ ID NO: 681166 - DNA, 20 bp, mouse
gaagggaaagtcaacatcag

SEQ ID NO: 681167 - DNA, 20 bp, mouse
gtcccctggataagcaccac

SEQ ID NO: 681168 - DNA, 20 bp, mouse
gtggtcccttataaagaggg

SEQ ID NO: 681169 - DNA, 20 bp, mouse
gcaccctgaggcagggtcca

SEQ ID NO: 681170 - DNA, 20 bp, mouse
gagagcctatatgggggaag

SEQ ID NO: 681171 - DNA, 20 bp, mouse
gacacccccttcccccatat

SEQ ID NO: 681172 - DNA, 20 bp, mouse
gaacacagctacttggctca

SEQ ID NO: 681173 - DNA, 20 bp, mouse
gttcctgtggtgcttatcca

SEQ ID NO: 681174 - DNA, 20 bp, mouse
gaccactatgcaattctctg

SEQ ID NO: 681175 - DNA, 20 bp, mouse
gaccgttgcaccctgaggca

SEQ ID NO: 681176 - DNA, 20 bp, mouse
gggaagggactgaacaacag

SEQ ID NO: 681177 - DNA, 20 bp, mouse
ggtagaggccctatgggaaa

SEQ ID NO: 681178 - DNA, 20 bp, mouse
gggtggtagtagaggacaaa

SEQ ID NO: 681179 - DNA, 20 bp, mouse
gagtgaagatcagtgaggaa

SEQ ID NO: 681180 - DNA, 20 bp, mouse
gacttggccaagcaaaacaa

SEQ ID NO: 681181 - DNA, 20 bp, mouse
gttttgcttggccaagtgta

SEQ ID NO: 681182 - DNA, 20 bp, mouse
gggggggcatgagggttgat

SEQ ID NO: 681183 - DNA, 20 bp, mouse
gaaggcaggtagaggcccta

SEQ ID NO: 681184 - DNA, 20 bp, mouse
gagcggcccctccctacact

SEQ ID NO: 681185 - DNA, 20 bp, mouse
gttcatggagcactttgttg

SEQ ID NO: 681186 - DNA, 20 bp, mouse
gtgcaatagcaaagatgttg

SEQ ID NO: 681187 - DNA, 20 bp, mouse
gaggagcttgccaggcaagt

SEQ ID NO: 681188 - DNA, 20 bp, mouse
gtcaatgtatacacgatttg

SEQ ID NO: 681189 - DNA, 20 bp, mouse
gagcctgaaggctagaacta

SEQ ID NO: 681190 - DNA, 20 bp, mouse
gagaggctggaaaccaagac

SEQ ID NO: 681191 - DNA, 20 bp, mouse
gagagatggtcagagggtag

SEQ ID NO: 681192 - DNA, 20 bp, mouse
gtaaggaggactcaggtgat

SEQ ID NO: 681193 - DNA, 20 bp, mouse
gtcatgaaagtcatgtggtt

SEQ ID NO: 681194 - DNA, 20 bp, mouse
gcttctagaagctgagaccc

SEQ ID NO: 681195 - DNA, 20 bp, mouse
gaataggcctgtgtctatca

SEQ ID NO: 681196 - DNA, 20 bp, mouse
gctgctaggctaaatatggt

SEQ ID NO: 681197 - DNA, 20 bp, mouse
gaaaacacaggattggggtt

SEQ ID NO: 681198 - DNA, 20 bp, mouse
ggattctgctaggctaaata

SEQ ID NO: 681199 - DNA, 20 bp, mouse
gacccacagacgccactgac

SEQ ID NO: 681200 - DNA, 20 bp, mouse
ggagctgtcttctacagttg

SEQ ID NO: 681201 - DNA, 20 bp, mouse
gttgagtggcatccagtcag

SEQ ID NO: 681202 - DNA, 20 bp, mouse
gctttgttgagaggacacaa

SEQ ID NO: 681203 - DNA, 20 bp, mouse
gtcaacaaagtgttctgtga

SEQ ID NO: 681204 - DNA, 20 bp, mouse
ggaggtctcatttttctctg

SEQ ID NO: 681205 - DNA, 20 bp, mouse
gggcattggaagagcattgg

SEQ ID NO: 681206 - DNA, 20 bp, mouse
gagaggacccctcttcaaga

SEQ ID NO: 681207 - DNA, 20 bp, mouse
ggatcatccatcttgaagag

SEQ ID NO: 681208 - DNA, 20 bp, mouse
gcccaaatatgtgtttgttt

SEQ ID NO: 681209 - DNA, 20 bp, mouse
gcactggctcctccctattc

SEQ ID NO: 681210 - DNA, 20 bp, mouse
gtttgttttggcccggaata

SEQ ID NO: 681211 - DNA, 20 bp, mouse
gccgctcaaacatgcacaga

SEQ ID NO: 681212 - DNA, 20 bp, mouse
ggttttggcccggaataggg

SEQ ID NO: 681213 - DNA, 20 bp, mouse
ggccaaaacaaacacatatt

SEQ ID NO: 681214 - DNA, 20 bp, mouse
ggtgatgttcagttcctacc

SEQ ID NO: 681215 - DNA, 20 bp, mouse
gaaggcatatagagcccctg

SEQ ID NO: 681216 - DNA, 20 bp, mouse
gtactgatctgacaaggatg

SEQ ID NO: 681217 - DNA, 20 bp, mouse
gtactcaccagcaccctgac

SEQ ID NO: 681218 - DNA, 20 bp, mouse
gggtgctggtgagtacatgt

SEQ ID NO: 681219 - DNA, 20 bp, mouse
gctgggccctgccaatcctc

SEQ ID NO: 681220 - DNA, 20 bp, mouse
gctaagaggcaatggctcca

SEQ ID NO: 681221 - DNA, 20 bp, mouse
ggtgccagcaaccagaggat

SEQ ID NO: 681222 - DNA, 20 bp, mouse
gtggttgctggcacctgtca

SEQ ID NO: 681223 - DNA, 20 bp, mouse
ggatctgacaaggatgaggc

SEQ ID NO: 681224 - DNA, 20 bp, mouse
gtgcatctactgatctgaca

SEQ ID NO: 681225 - DNA, 20 bp, mouse
gagtagatgcaacttctaag

SEQ ID NO: 681226 - DNA, 20 bp, mouse
gagacccagtcaagtgacag

SEQ ID NO: 681227 - DNA, 20 bp, mouse
gagcccaaggtctatagaca

SEQ ID NO: 681228 - DNA, 20 bp, mouse
gccagctggctaagagccca

SEQ ID NO: 681229 - DNA, 20 bp, mouse
gtggcatggtggggtaaatg

SEQ ID NO: 681230 - DNA, 20 bp, mouse
gcaaggtatgctaggatggt

SEQ ID NO: 681231 - DNA, 20 bp, mouse
ggacccggttcttgaggaga

SEQ ID NO: 681232 - DNA, 20 bp, mouse
gaaccctctgtcacttgact

SEQ ID NO: 681233 - DNA, 20 bp, mouse
gtcacttgactgggtcttcc

SEQ ID NO: 681234 - DNA, 20 bp, mouse
gtaccttgtctatagacctt

SEQ ID NO: 681235 - DNA, 20 bp, mouse
ggaacagaagagctcaaact

SEQ ID NO: 681236 - DNA, 20 bp, mouse
gagaggaaagttcacacagc

SEQ ID NO: 681237 - DNA, 20 bp, mouse
gactatgaagaaaggagata

SEQ ID NO: 681238 - DNA, 20 bp, mouse
gcacaaagactatgaagctg

SEQ ID NO: 681239 - DNA, 20 bp, mouse
gaaaaacaaaagtctaagag

SEQ ID NO: 681240 - DNA, 20 bp, mouse
gaggtatattgatttcatgc

SEQ ID NO: 681241 - DNA, 20 bp, mouse
gtaatatctcacctgcgcag

SEQ ID NO: 681242 - DNA, 20 bp, mouse
gaatcaatatacctctgcgc

SEQ ID NO: 681243 - DNA, 20 bp, mouse
ggatctcctagaagctattt

SEQ ID NO: 681244 - DNA, 20 bp, mouse
gttgatggcataatactggt

SEQ ID NO: 681245 - DNA, 20 bp, mouse
gacaaattgcttggtaggtg

SEQ ID NO: 681246 - DNA, 20 bp, mouse
gcactggcggggagcaaaga

SEQ ID NO: 681247 - DNA, 20 bp, mouse
gagtgtctggcatatagggg

SEQ ID NO: 681248 - DNA, 20 bp, mouse
gctgcagacagggatgactt

SEQ ID NO: 681249 - DNA, 20 bp, mouse
ggcacaccacgataaagctt

SEQ ID NO: 681250 - DNA, 20 bp, mouse
gcggggagcaaagaggggtg

SEQ ID NO: 681251 - DNA, 20 bp, mouse
gaacacagtacctgcagaca

SEQ ID NO: 681252 - DNA, 20 bp, mouse
ggccctcctaagctttatcg

SEQ ID NO: 681253 - DNA, 20 bp, mouse
gaccacgataaagcttagga

SEQ ID NO: 681254 - DNA, 20 bp, mouse
gagtttggataaaggttcca

SEQ ID NO: 681255 - DNA, 20 bp, mouse
gacatagtgtctggcatata

SEQ ID NO: 681256 - DNA, 20 bp, mouse
gtggaagcctccagggatat

SEQ ID NO: 681257 - DNA, 20 bp, mouse
gccgcaggtggagcacacca

SEQ ID NO: 681258 - DNA, 20 bp, mouse
gggaaaagcttatgagggcg

SEQ ID NO: 681259 - DNA, 20 bp, mouse
gctcaccaaaagtggttaaa

SEQ ID NO: 681260 - DNA, 20 bp, mouse
gtcatcagcacccatatccc

SEQ ID NO: 681261 - DNA, 20 bp, mouse
gagctctgtggaagcctcca

SEQ ID NO: 681262 - DNA, 20 bp, mouse
gcaccaaggaaaagcttatg

SEQ ID NO: 681263 - DNA, 20 bp, mouse
ggatatgggtgctgatgaac

SEQ ID NO: 681264 - DNA, 20 bp, mouse
gtacagagagcacagagacg

SEQ ID NO: 681265 - DNA, 20 bp, mouse
ggattggattaagtgcaaag

SEQ ID NO: 681266 - DNA, 20 bp, mouse
ggggctgtctaattagaggt

SEQ ID NO: 681267 - DNA, 20 bp, mouse
gggggcgaggggtgctgtga

SEQ ID NO: 681268 - DNA, 20 bp, mouse
gagagtggctaagacctaag

SEQ ID NO: 681269 - DNA, 20 bp, mouse
gcactgggctgtctaattag

SEQ ID NO: 681270 - DNA, 20 bp, mouse
gctgtgctaacaggaaagag

SEQ ID NO: 681271 - DNA, 20 bp, mouse
gggaggcatgccaagggact

SEQ ID NO: 681272 - DNA, 20 bp, mouse
gttactgcctctaggtctca

SEQ ID NO: 681273 - DNA, 20 bp, mouse
gtgggccagctctctaggag

SEQ ID NO: 681274 - DNA, 20 bp, mouse
gctggcccacagaaactaag

SEQ ID NO: 681275 - DNA, 20 bp, mouse
gttagctgagagccctgcaa

SEQ ID NO: 681276 - DNA, 20 bp, mouse
gaaacagcaggtcaaagact

SEQ ID NO: 681277 - DNA, 20 bp, mouse
gccaagtacaagccctgctg

SEQ ID NO: 681278 - DNA, 20 bp, mouse
ggtacttggaagatcatcaa

SEQ ID NO: 681279 - DNA, 20 bp, mouse
gaggctgcttcacccaacag

SEQ ID NO: 681280 - DNA, 20 bp, mouse
ggtgggaatagaccacactg

SEQ ID NO: 681281 - DNA, 20 bp, mouse
gaagaactgttttggatgac

SEQ ID NO: 681282 - DNA, 20 bp, mouse
gccaggcaggttatggtcac

SEQ ID NO: 681283 - DNA, 20 bp, mouse
gtaagcaatttccctcagtg

SEQ ID NO: 681284 - DNA, 20 bp, mouse
ggaaatcgtcaatatcgggt

SEQ ID NO: 681285 - DNA, 20 bp, mouse
ggcttggattacccactgtt

SEQ ID NO: 681286 - DNA, 20 bp, mouse
gaatgggtaaaagctctaag

SEQ ID NO: 681287 - DNA, 20 bp, mouse
ggcaaagcatggcagggcat

SEQ ID NO: 681288 - DNA, 20 bp, mouse
gcaggggttctcctgttctc

SEQ ID NO: 681289 - DNA, 20 bp, mouse
gcctggagctgggctctcgc

SEQ ID NO: 681290 - DNA, 20 bp, mouse
ggcccagactgcttctatag

SEQ ID NO: 681291 - DNA, 20 bp, mouse
ggaagtaagtggggagacaa

SEQ ID NO: 681292 - DNA, 20 bp, mouse
gagctctgtgcacgtgatca

SEQ ID NO: 681293 - DNA, 20 bp, mouse
gggcagagcaaagcatggca

SEQ ID NO: 681294 - DNA, 20 bp, mouse
ggggtaaaagctctaagggg

SEQ ID NO: 681295 - DNA, 20 bp, mouse
ggaggggaccggttttagaa

SEQ ID NO: 681296 - DNA, 20 bp, mouse
gtaaaggtgaagaggagcag

SEQ ID NO: 681297 - DNA, 20 bp, mouse
gagagggggtggggccaata

SEQ ID NO: 681298 - DNA, 20 bp, mouse
ggacctagtggtagggaata

SEQ ID NO: 681299 - DNA, 20 bp, mouse
gtgtccaggacctagtggta

SEQ ID NO: 681300 - DNA, 20 bp, mouse
gagtttggctaaaggtgaag

SEQ ID NO: 681301 - DNA, 20 bp, mouse
ggcttagtaagcaaggaaca

SEQ ID NO: 681302 - DNA, 20 bp, mouse
ggaatgccatgacaagactt

SEQ ID NO: 681303 - DNA, 20 bp, mouse
gcagcaatgaataatacagg

SEQ ID NO: 681304 - DNA, 20 bp, mouse
gtattcattgctgaggatag

SEQ ID NO: 681305 - DNA, 20 bp, mouse
gaggacaggcttagtaagca

SEQ ID NO: 681306 - DNA, 20 bp, mouse
gggcagggctaatagggata

SEQ ID NO: 681307 - DNA, 20 bp, mouse
ggcagggcacagagtagttt

SEQ ID NO: 681308 - DNA, 20 bp, mouse
gagacacagtacctgcagat

SEQ ID NO: 681309 - DNA, 20 bp, mouse
gagtttgggtaaaggtgcac

SEQ ID NO: 681310 - DNA, 20 bp, mouse
gcctgcagatgggcatgact

SEQ ID NO: 681311 - DNA, 20 bp, mouse
gagaggaggcagggctaata

SEQ ID NO: 681312 - DNA, 20 bp, mouse
ggtgtctgtaatataggagt

SEQ ID NO: 681313 - DNA, 20 bp, mouse
gaacaaaactttagagtgca

SEQ ID NO: 681314 - DNA, 20 bp, mouse
gatggtcttactgcaggcaa

SEQ ID NO: 681315 - DNA, 20 bp, mouse
gtgcaggcaagggccaatca

SEQ ID NO: 681316 - DNA, 20 bp, mouse
ggcgtgcagcccagaaacat

SEQ ID NO: 681317 - DNA, 20 bp, mouse
gaagacttggaacttggaga

SEQ ID NO: 681318 - DNA, 20 bp, mouse
gtctgcaggcgacagattgg

SEQ ID NO: 681319 - DNA, 20 bp, mouse
gggtaaaagtgaaagagctc

SEQ ID NO: 681320 - DNA, 20 bp, mouse
gagtcttgaggcggggccaa

SEQ ID NO: 681321 - DNA, 20 bp, mouse
ggcggggccaaggggatgtt

SEQ ID NO: 681322 - DNA, 20 bp, mouse
ggacggagagtcttgaggcg

SEQ ID NO: 681323 - DNA, 20 bp, mouse
gggcgtgacggagagtcttg

SEQ ID NO: 681324 - DNA, 20 bp, mouse
ggggaagcagataaacaagg

SEQ ID NO: 681325 - DNA, 20 bp, mouse
gaggggatgtttgggtcctt

SEQ ID NO: 681326 - DNA, 20 bp, mouse
ggggctccgtgcccgttatg

SEQ ID NO: 681327 - DNA, 20 bp, mouse
ggagccctagggcccttttc

SEQ ID NO: 681328 - DNA, 20 bp, mouse
gacggcccgccttatctcta

SEQ ID NO: 681329 - DNA, 20 bp, mouse
gactctgagcaaagcagatc

SEQ ID NO: 681330 - DNA, 20 bp, mouse
gagagccaagccaaacccaa

SEQ ID NO: 681331 - DNA, 20 bp, mouse
gctggagctggctaacccaa

SEQ ID NO: 681332 - DNA, 20 bp, mouse
gagtccgtttgtaaaccttt

SEQ ID NO: 681333 - DNA, 20 bp, mouse
gcgccgggccaatgggagtg

SEQ ID NO: 681334 - DNA, 20 bp, mouse
gcgcccctgcctcctcgctc

SEQ ID NO: 681335 - DNA, 20 bp, mouse
gagccctgccgcactcccat

SEQ ID NO: 681336 - DNA, 20 bp, mouse
ggggagcgacgccttgcagg

SEQ ID NO: 681337 - DNA, 20 bp, mouse
gaacaagaggaacctgggag

SEQ ID NO: 681338 - DNA, 20 bp, mouse
gagggcggaggcagtacctt

SEQ ID NO: 681339 - DNA, 20 bp, mouse
ggcggcaaggagcttctagg

SEQ ID NO: 681340 - DNA, 20 bp, mouse
ggggagcgggagaccttgac

SEQ ID NO: 681341 - DNA, 20 bp, mouse
ggtaccttgggccctaggtg

SEQ ID NO: 681342 - DNA, 20 bp, mouse
ggtcacaggcgcgcgaggtg

SEQ ID NO: 681343 - DNA, 20 bp, mouse
ggtgagacttctggcgacag

SEQ ID NO: 681344 - DNA, 20 bp, mouse
gtcgcgcgaatgtatctccc

SEQ ID NO: 681345 - DNA, 20 bp, mouse
gctagttaggggagggaacg

SEQ ID NO: 681346 - DNA, 20 bp, mouse
gtataggtacaggggacttg

SEQ ID NO: 681347 - DNA, 20 bp, mouse
gtgagagttagaagctgagt

SEQ ID NO: 681348 - DNA, 20 bp, mouse
ggggcggagactagtgtggg

SEQ ID NO: 681349 - DNA, 20 bp, mouse
ggactaagaacaggtcttat

SEQ ID NO: 681350 - DNA, 20 bp, mouse
ggcagggcggagactagtgt

SEQ ID NO: 681351 - DNA, 20 bp, mouse
gaacaggtcttataggtaca

SEQ ID NO: 681352 - DNA, 20 bp, mouse
ggaagctgagtggggatgta

SEQ ID NO: 681353 - DNA, 20 bp, mouse
gagtcccccagctgtttctg

SEQ ID NO: 681354 - DNA, 20 bp, mouse
ggaattgacaggggatttaa

SEQ ID NO: 681355 - DNA, 20 bp, mouse
gtgtttctgggggactgttc

SEQ ID NO: 681356 - DNA, 20 bp, mouse
ggcggcgcagccaatcggaa

SEQ ID NO: 681357 - DNA, 20 bp, mouse
ggacggctggtggtgacgag

SEQ ID NO: 681358 - DNA, 20 bp, mouse
gtgactggaggatcccgaga

SEQ ID NO: 681359 - DNA, 20 bp, mouse
gtgcgccgcgtgcccctctc

SEQ ID NO: 681360 - DNA, 20 bp, mouse
gggcgggacgtcctacggga

SEQ ID NO: 681361 - DNA, 20 bp, mouse
gcaaggcacgcccttccgat

SEQ ID NO: 681362 - DNA, 20 bp, mouse
gtcaccaccagccgtcccgt

SEQ ID NO: 681363 - DNA, 20 bp, mouse
gtgggggcgggacgtcctac

SEQ ID NO: 681364 - DNA, 20 bp, mouse
gtagccggctacatgactca

SEQ ID NO: 681365 - DNA, 20 bp, mouse
gcagctgctcctgcataagg

SEQ ID NO: 681366 - DNA, 20 bp, mouse
ggggctgaaaggacctctgt

SEQ ID NO: 681367 - DNA, 20 bp, mouse
gcccaggccccctgccacag

SEQ ID NO: 681368 - DNA, 20 bp, mouse
ggggtctcctctgtggcagg

SEQ ID NO: 681369 - DNA, 20 bp, mouse
gggaacctgaggagacatgg

SEQ ID NO: 681370 - DNA, 20 bp, mouse
gaggatggctataaggcaga

SEQ ID NO: 681371 - DNA, 20 bp, mouse
gctacaggttatgtggaatg

SEQ ID NO: 681372 - DNA, 20 bp, mouse
ggtgccggcacgccctgggg

SEQ ID NO: 681373 - DNA, 20 bp, mouse
gttgcaggagacagcccaac

SEQ ID NO: 681374 - DNA, 20 bp, mouse
ggacatggagggatggatgt

SEQ ID NO: 681375 - DNA, 20 bp, mouse
gcctggggaggatggctata

SEQ ID NO: 681376 - DNA, 20 bp, mouse
ggaggcgggaacacatcctg

SEQ ID NO: 681377 - DNA, 20 bp, mouse
gggaacacatcctgaggcgg

SEQ ID NO: 681378 - DNA, 20 bp, mouse
ggcgggaacacatcctgagg

SEQ ID NO: 681379 - DNA, 20 bp, mouse
gggcagggtggcaggttccc

SEQ ID NO: 681380 - DNA, 20 bp, mouse
gggaccggtccggcggcctc

SEQ ID NO: 681381 - DNA, 20 bp, mouse
gtcctgacctgacctctctc

SEQ ID NO: 681382 - DNA, 20 bp, mouse
gtttgaaagccgtgggaagg

SEQ ID NO: 681383 - DNA, 20 bp, mouse
gtaaactagctgtttgcagc

SEQ ID NO: 681384 - DNA, 20 bp, mouse
gaaacaaagccgcacccaag

SEQ ID NO: 681385 - DNA, 20 bp, mouse
gactcgagctccgccgcctc

SEQ ID NO: 681386 - DNA, 20 bp, mouse
gagtaggtcaagttgggctg

SEQ ID NO: 681387 - DNA, 20 bp, mouse
ggctcaaagtaggtcaagtt

SEQ ID NO: 681388 - DNA, 20 bp, mouse
gcagaatgttagctcaaagt

SEQ ID NO: 681389 - DNA, 20 bp, mouse
gcagggatcaagccagtaga

SEQ ID NO: 681390 - DNA, 20 bp, mouse
gccagatgggtaaaagttct

SEQ ID NO: 681391 - DNA, 20 bp, mouse
ggcaaaggtgatccatctac

SEQ ID NO: 681392 - DNA, 20 bp, mouse
ggggagaatgggcggcacca

SEQ ID NO: 681393 - DNA, 20 bp, mouse
ggaagccagccttggtgaga

SEQ ID NO: 681394 - DNA, 20 bp, mouse
gtgagacaagcattggataa

SEQ ID NO: 681395 - DNA, 20 bp, mouse
gccaaagtccagtgatgcaa

SEQ ID NO: 681396 - DNA, 20 bp, mouse
ggattctttgccaactgcta

SEQ ID NO: 681397 - DNA, 20 bp, mouse
gataacactggcctcagttt

SEQ ID NO: 681398 - DNA, 20 bp, mouse
ggcagttggcaaagaatcat

SEQ ID NO: 681399 - DNA, 20 bp, mouse
gtactctccaccctagcagt

SEQ ID NO: 681400 - DNA, 20 bp, mouse
ggaactgtaggtctgttcat

SEQ ID NO: 681401 - DNA, 20 bp, mouse
gaacttaagtacagggaaag

SEQ ID NO: 681402 - DNA, 20 bp, mouse
ggaaactcaggtgaaatcat

SEQ ID NO: 681403 - DNA, 20 bp, mouse
gggaagcattagttagctgt

SEQ ID NO: 681404 - DNA, 20 bp, mouse
ggaaatatcgaccaaaactg

SEQ ID NO: 681405 - DNA, 20 bp, mouse
gtgaattcaaagattcaagt

SEQ ID NO: 681406 - DNA, 20 bp, mouse
gacacagaatgttaccttaa

SEQ ID NO: 681407 - DNA, 20 bp, mouse
gactgctgcctattgagaga

SEQ ID NO: 681408 - DNA, 20 bp, mouse
gctcaataggcagcagtgag

SEQ ID NO: 681409 - DNA, 20 bp, mouse
gaattcttccctctctcaat

SEQ ID NO: 681410 - DNA, 20 bp, mouse
ggttgtgatccacttgtgac

SEQ ID NO: 681411 - DNA, 20 bp, mouse
gagcttatataaactgtcca

SEQ ID NO: 681412 - DNA, 20 bp, mouse
gcctatgttgacttccttta

SEQ ID NO: 681413 - DNA, 20 bp, mouse
gcaagccagtcttggtgagg

SEQ ID NO: 681414 - DNA, 20 bp, mouse
gataggcagcagtgagtggc

SEQ ID NO: 681415 - DNA, 20 bp, mouse
gtatatgctgggaaggtggg

SEQ ID NO: 681416 - DNA, 20 bp, mouse
gcgaacttgtaggtctggtg

SEQ ID NO: 681417 - DNA, 20 bp, mouse
ggcacaatgctcgaacttgt

SEQ ID NO: 681418 - DNA, 20 bp, mouse
gatgctcgaacttgtaggtc

SEQ ID NO: 681419 - DNA, 20 bp, mouse
gacaactgagttgtgagcca

SEQ ID NO: 681420 - DNA, 20 bp, mouse
ggtatcaaccttcctatcca

SEQ ID NO: 681421 - DNA, 20 bp, mouse
gagttcgagcattgtgcaag

SEQ ID NO: 681422 - DNA, 20 bp, mouse
gggttctctgtgccttggat

SEQ ID NO: 681423 - DNA, 20 bp, mouse
gcacatcttccagaaccagc

SEQ ID NO: 681424 - DNA, 20 bp, mouse
gaaggcacagagaaccctgc

SEQ ID NO: 681425 - DNA, 20 bp, mouse
gataaagctcctgctggttc

SEQ ID NO: 681426 - DNA, 20 bp, mouse
gactgctgcctattgagaga

SEQ ID NO: 681427 - DNA, 20 bp, mouse
gctcaataggcagcagtgag

SEQ ID NO: 681428 - DNA, 20 bp, mouse
gaattcttccctctctcaat

SEQ ID NO: 681429 - DNA, 20 bp, mouse
ggttgtgatccacttgtgac

SEQ ID NO: 681430 - DNA, 20 bp, mouse
gacacagaacggtaccttaa

SEQ ID NO: 681431 - DNA, 20 bp, mouse
gttactgatgtcacacagaa

SEQ ID NO: 681432 - DNA, 20 bp, mouse
gaacttatataaagtgtcca

SEQ ID NO: 681433 - DNA, 20 bp, mouse
gataggcagcagtgagtggc

SEQ ID NO: 681434 - DNA, 20 bp, mouse
gcaggaagatgggtggcacc

SEQ ID NO: 681435 - DNA, 20 bp, mouse
ggttcattcataccctatgt

SEQ ID NO: 681436 - DNA, 20 bp, mouse
gactgctgcctattgagaga

SEQ ID NO: 681437 - DNA, 20 bp, mouse
gctcaataggcagcagtgag

SEQ ID NO: 681438 - DNA, 20 bp, mouse
gaattcttccctctctcaat

SEQ ID NO: 681439 - DNA, 20 bp, mouse
ggttgtgatccacttgtgac

SEQ ID NO: 681440 - DNA, 20 bp, mouse
gctggtgccacccatcttcc

SEQ ID NO: 681441 - DNA, 20 bp, mouse
gacacagaacggtaccttaa

SEQ ID NO: 681442 - DNA, 20 bp, mouse
gttactgatgtcacacagaa

SEQ ID NO: 681443 - DNA, 20 bp, mouse
gaacttatataaagtgtcca

SEQ ID NO: 681444 - DNA, 20 bp, mouse
gataggcagcagtgagtggc

SEQ ID NO: 681445 - DNA, 20 bp, mouse
ggttcattcataccctatgt

SEQ ID NO: 681446 - DNA, 20 bp, mouse
gacacagatcgttaccttaa

SEQ ID NO: 681447 - DNA, 20 bp, mouse
gctgcctattgagagaggga

SEQ ID NO: 681448 - DNA, 20 bp, mouse
gaaagatacgaccaaagtac

SEQ ID NO: 681449 - DNA, 20 bp, mouse
gcactgctgcctattgagag

SEQ ID NO: 681450 - DNA, 20 bp, mouse
gctcaataggcagcagtgag

SEQ ID NO: 681451 - DNA, 20 bp, mouse
gaatccttccctctctcaat

SEQ ID NO: 681452 - DNA, 20 bp, mouse
ggttgtgatccacttgtgac

SEQ ID NO: 681453 - DNA, 20 bp, mouse
gcagatcgttaccttaaagg

SEQ ID NO: 681454 - DNA, 20 bp, mouse
gtatatgctgggaagatggg

SEQ ID NO: 681455 - DNA, 20 bp, mouse
gactacagtcaaggaataac

SEQ ID NO: 681456 - DNA, 20 bp, mouse
gaagctcaaaggtcagagta

SEQ ID NO: 681457 - DNA, 20 bp, mouse
ggggaaatgcatgacctttt

SEQ ID NO: 681458 - DNA, 20 bp, mouse
gttggcaaagggcctcgaat

SEQ ID NO: 681459 - DNA, 20 bp, mouse
gacaccagaactaccagttt

SEQ ID NO: 681460 - DNA, 20 bp, mouse
gctgcccaaactggtagttc

SEQ ID NO: 681461 - DNA, 20 bp, mouse
gaacccagcaagaaaggtgg

SEQ ID NO: 681462 - DNA, 20 bp, mouse
gagggatatagcctgtacaa

SEQ ID NO: 681463 - DNA, 20 bp, mouse
gtagataaaagtagtgcaag

SEQ ID NO: 681464 - DNA, 20 bp, mouse
gagtttgggcagtgtgtaag

SEQ ID NO: 681465 - DNA, 20 bp, mouse
gtcagggaacccagcaagaa

SEQ ID NO: 681466 - DNA, 20 bp, mouse
gcacaccagaactacaaatt

SEQ ID NO: 681467 - DNA, 20 bp, mouse
gaatttgggcagtgtgcaag

SEQ ID NO: 681468 - DNA, 20 bp, mouse
gctctgagctttggatagga

SEQ ID NO: 681469 - DNA, 20 bp, mouse
ggtctttctctgtagtcttt

SEQ ID NO: 681470 - DNA, 20 bp, mouse
gggttctctgagctttggat

SEQ ID NO: 681471 - DNA, 20 bp, mouse
gctgcccaaatttgtagttc

SEQ ID NO: 681472 - DNA, 20 bp, mouse
gtgcagggttctctgagctt

SEQ ID NO: 681473 - DNA, 20 bp, mouse
gataaagcttctgctggctc

SEQ ID NO: 681474 - DNA, 20 bp, mouse
gttcccccatctttcctgca

SEQ ID NO: 681475 - DNA, 20 bp, mouse
gtgtgtgtacttgttctctc

SEQ ID NO: 681476 - DNA, 20 bp, mouse
ggggcgggtcctgagagcta

SEQ ID NO: 681477 - DNA, 20 bp, mouse
ggctctgggcgggaacggcg

SEQ ID NO: 681478 - DNA, 20 bp, mouse
gctggaggcggagacgtggt

SEQ ID NO: 681479 - DNA, 20 bp, mouse
gtctgggcggggcgacttcg

SEQ ID NO: 681480 - DNA, 20 bp, mouse
gagagggcgtggccgtgcgg

SEQ ID NO: 681481 - DNA, 20 bp, mouse
gctgggcgggaacggcgtgg

SEQ ID NO: 681482 - DNA, 20 bp, mouse
ggggcggggcgacttcgggg

SEQ ID NO: 681483 - DNA, 20 bp, mouse
gtcctgagagctagggctgg

SEQ ID NO: 681484 - DNA, 20 bp, mouse
gtgagagctagggctggagg

SEQ ID NO: 681485 - DNA, 20 bp, mouse
ggaggcggagacgtggttgg

SEQ ID NO: 681486 - DNA, 20 bp, mouse
gtatgcatgcagtacaggtg

SEQ ID NO: 681487 - DNA, 20 bp, mouse
gtgttcttgactcgcacgag

SEQ ID NO: 681488 - DNA, 20 bp, mouse
ggctccatagcttaagtctg

SEQ ID NO: 681489 - DNA, 20 bp, mouse
ggttcagttggttaaataac

SEQ ID NO: 681490 - DNA, 20 bp, mouse
gtaaggggatcctcacacac

SEQ ID NO: 681491 - DNA, 20 bp, mouse
gtaatttatgcatgcagtac

SEQ ID NO: 681492 - DNA, 20 bp, mouse
gttagatacttggtctgaca

SEQ ID NO: 681493 - DNA, 20 bp, mouse
gaaaaaaactattagatact

SEQ ID NO: 681494 - DNA, 20 bp, mouse
ggggaaagagccagtgtgtg

SEQ ID NO: 681495 - DNA, 20 bp, mouse
gaagccacagacttaagcta

SEQ ID NO: 681496 - DNA, 20 bp, mouse
gggtgaatgcaacaagacca

SEQ ID NO: 681497 - DNA, 20 bp, mouse
ggtgagagatgcattgaaat

SEQ ID NO: 681498 - DNA, 20 bp, mouse
gtgataaataagtaaattga

SEQ ID NO: 681499 - DNA, 20 bp, mouse
gtatgtagtgaagctgacat

SEQ ID NO: 681500 - DNA, 20 bp, mouse
gtatctaataatatatgctg

SEQ ID NO: 681501 - DNA, 20 bp, mouse
ggtggaatttgtttaacagt

SEQ ID NO: 681502 - DNA, 20 bp, mouse
gcaaatatttgtgaactgtt

SEQ ID NO: 681503 - DNA, 20 bp, mouse
gtattattagatatctagaa

SEQ ID NO: 681504 - DNA, 20 bp, mouse
gaccctctgacatacccccc

SEQ ID NO: 681505 - DNA, 20 bp, mouse
ggaatgcaacaagaccaggg

SEQ ID NO: 681506 - DNA, 20 bp, mouse
gtccccaaaggaggctgttc

SEQ ID NO: 681507 - DNA, 20 bp, mouse
ggtgaaagatgcattgaact

SEQ ID NO: 681508 - DNA, 20 bp, mouse
gtcatttcattgctccccaa

SEQ ID NO: 681509 - DNA, 20 bp, mouse
gcaaatatttttgaactggg

SEQ ID NO: 681510 - DNA, 20 bp, mouse
gtgataaatagttaaattga

SEQ ID NO: 681511 - DNA, 20 bp, mouse
gtttcattgctccccaaagg

SEQ ID NO: 681512 - DNA, 20 bp, mouse
gtgacttacagtgattgtgc

SEQ ID NO: 681513 - DNA, 20 bp, mouse
gtacacaaatatttttgaac

SEQ ID NO: 681514 - DNA, 20 bp, mouse
gacctgaacagcctcctttg

SEQ ID NO: 681515 - DNA, 20 bp, mouse
gtatttagtgaagctgacat

SEQ ID NO: 681516 - DNA, 20 bp, mouse
ggacacacctacttgtggga

SEQ ID NO: 681517 - DNA, 20 bp, mouse
gagttcagagaaatgggaat

SEQ ID NO: 681518 - DNA, 20 bp, mouse
ggtgagtagttcagagaaat

SEQ ID NO: 681519 - DNA, 20 bp, mouse
gtcacactccagattgatcc

SEQ ID NO: 681520 - DNA, 20 bp, mouse
gcagatgcaaagatgactat

SEQ ID NO: 681521 - DNA, 20 bp, mouse
ggctacacctattacatgtt

SEQ ID NO: 681522 - DNA, 20 bp, mouse
gggtagacacacctacttgt

SEQ ID NO: 681523 - DNA, 20 bp, mouse
gcatccatcctggatcaatc

SEQ ID NO: 681524 - DNA, 20 bp, mouse
gcctgctggcacatccatcc

SEQ ID NO: 681525 - DNA, 20 bp, mouse
gcatggactagacattaacc

SEQ ID NO: 681526 - DNA, 20 bp, mouse
gtacctgtgggagaatggtg

SEQ ID NO: 681527 - DNA, 20 bp, mouse
ggaagtcccgtgtgatatgg

SEQ ID NO: 681528 - DNA, 20 bp, mouse
ggttcttgactcgcacagag

SEQ ID NO: 681529 - DNA, 20 bp, mouse
gccattctcccacaggtagg

SEQ ID NO: 681530 - DNA, 20 bp, mouse
gtatttgctgtctaaactta

SEQ ID NO: 681531 - DNA, 20 bp, mouse
ggcttatgtgtgcagtacct

SEQ ID NO: 681532 - DNA, 20 bp, mouse
gcaatgaaaagaaagtaaaa

SEQ ID NO: 681533 - DNA, 20 bp, mouse
ggagaaagagccagtttgtg

SEQ ID NO: 681534 - DNA, 20 bp, mouse
gaaacaacaaataaagctat

SEQ ID NO: 681535 - DNA, 20 bp, mouse
gtgagttacttgggtttcca

SEQ ID NO: 681536 - DNA, 20 bp, mouse
gcgcacaacgaaaggaaagt

SEQ ID NO: 681537 - DNA, 20 bp, mouse
gaaggaaagtgggcagaggt

SEQ ID NO: 681538 - DNA, 20 bp, mouse
ggacagcgaatacaatgaaa

SEQ ID NO: 681539 - DNA, 20 bp, mouse
gtcttgactcgcacaacgaa

SEQ ID NO: 681540 - DNA, 20 bp, mouse
gatttatgcgtgcagtaccc

SEQ ID NO: 681541 - DNA, 20 bp, mouse
gacgaaaggaaagtgggcag

SEQ ID NO: 681542 - DNA, 20 bp, mouse
ggagaaagagccagtttgtg

SEQ ID NO: 681543 - DNA, 20 bp, mouse
gatgttgtcactgattttca

SEQ ID NO: 681544 - DNA, 20 bp, mouse
gaaacaacaaataaagctat

SEQ ID NO: 681545 - DNA, 20 bp, mouse
gtatggggatcctcacaaac

SEQ ID NO: 681546 - DNA, 20 bp, mouse
gaactgggccgagtgccata

SEQ ID NO: 681547 - DNA, 20 bp, mouse
ggctagcagcagcttaaact

SEQ ID NO: 681548 - DNA, 20 bp, mouse
gtgggccgagtgccataggg

SEQ ID NO: 681549 - DNA, 20 bp, mouse
gatctggtttctgttaggtc

SEQ ID NO: 681550 - DNA, 20 bp, mouse
gatctccgccctatggcact

SEQ ID NO: 681551 - DNA, 20 bp, mouse
gaggacctatgacctctttg

SEQ ID NO: 681552 - DNA, 20 bp, mouse
ggtctcttggagcagagaac

SEQ ID NO: 681553 - DNA, 20 bp, mouse
gaggtgggatgttcatgatc

SEQ ID NO: 681554 - DNA, 20 bp, mouse
gtgaatcatactctgtcctt

SEQ ID NO: 681555 - DNA, 20 bp, mouse
gtaagctgctgctagctgtt

SEQ ID NO: 681556 - DNA, 20 bp, mouse
ggaactagactgagagtcat

SEQ ID NO: 681557 - DNA, 20 bp, mouse
gggggcgggtccaaccttaa

SEQ ID NO: 681558 - DNA, 20 bp, mouse
gagagtcataggcttaggtg

SEQ ID NO: 681559 - DNA, 20 bp, mouse
gaggcagccaaggccagtgg

SEQ ID NO: 681560 - DNA, 20 bp, mouse
gccaccccttagcccttgga

SEQ ID NO: 681561 - DNA, 20 bp, mouse
ggctgcctgcccaggcttgg

SEQ ID NO: 681562 - DNA, 20 bp, mouse
ggactgagagtcataggctt

SEQ ID NO: 681563 - DNA, 20 bp, mouse
ggcagaaaggttaaacgctg

SEQ ID NO: 681564 - DNA, 20 bp, mouse
gctgcccaggcttggaggtt

SEQ ID NO: 681565 - DNA, 20 bp, mouse
gctgtgcagctgttgggcgt

SEQ ID NO: 681566 - DNA, 20 bp, mouse
gcgcaaaggagaattgtcat

SEQ ID NO: 681567 - DNA, 20 bp, mouse
gaggctaggcagggattggc

SEQ ID NO: 681568 - DNA, 20 bp, mouse
ggtgagacaaggttggctct

SEQ ID NO: 681569 - DNA, 20 bp, mouse
gttaggactatggtgagaca

SEQ ID NO: 681570 - DNA, 20 bp, mouse
gaggaggaggcatccaggct

SEQ ID NO: 681571 - DNA, 20 bp, mouse
gtaggatcagcctgccgcaa

SEQ ID NO: 681572 - DNA, 20 bp, mouse
gagggataaaagagtcccag

SEQ ID NO: 681573 - DNA, 20 bp, mouse
ggacaattctcctttgcggc

SEQ ID NO: 681574 - DNA, 20 bp, mouse
gactttcccaggcaaggagg

SEQ ID NO: 681575 - DNA, 20 bp, mouse
ggtagatgcctgttcctgag

SEQ ID NO: 681576 - DNA, 20 bp, mouse
gtgagagggaacaagttcta

SEQ ID NO: 681577 - DNA, 20 bp, mouse
gggaacaagttctaaggctc

SEQ ID NO: 681578 - DNA, 20 bp, mouse
ggcagaaggccaaaaggagg

SEQ ID NO: 681579 - DNA, 20 bp, mouse
gcctcccccatgatgtgaga

SEQ ID NO: 681580 - DNA, 20 bp, mouse
gggagggggttgggtcagca

SEQ ID NO: 681581 - DNA, 20 bp, mouse
gggggcagaaggccaaaagg

SEQ ID NO: 681582 - DNA, 20 bp, mouse
gtacagagtgaaatcaattc

SEQ ID NO: 681583 - DNA, 20 bp, mouse
gagttgggcctgtgaaggat

SEQ ID NO: 681584 - DNA, 20 bp, mouse
gaaaactctgaggttagcag

SEQ ID NO: 681585 - DNA, 20 bp, mouse
ggtgtcagccaatccttcac

SEQ ID NO: 681586 - DNA, 20 bp, mouse
gggccccgcccaacttgttt

SEQ ID NO: 681587 - DNA, 20 bp, mouse
gggccaaaacaagttgggcg

SEQ ID NO: 681588 - DNA, 20 bp, mouse
gaggaggaagtacaggtgcc

SEQ ID NO: 681589 - DNA, 20 bp, mouse
ggagtggaggggaaagactc

SEQ ID NO: 681590 - DNA, 20 bp, mouse
gactgaagagatagatgtcc

SEQ ID NO: 681591 - DNA, 20 bp, mouse
gctctgcacatctcactggt

SEQ ID NO: 681592 - DNA, 20 bp, mouse
gctggctgggaaaatacacc

SEQ ID NO: 681593 - DNA, 20 bp, mouse
gtatctcttcagtctgacca

SEQ ID NO: 681594 - DNA, 20 bp, mouse
gctaaagggtcagagttcag

SEQ ID NO: 681595 - DNA, 20 bp, mouse
gaatacacctggcaactaaa

SEQ ID NO: 681596 - DNA, 20 bp, mouse
gggaacctggattacttgga

SEQ ID NO: 681597 - DNA, 20 bp, mouse
gaatccagggtcacatgtcc

SEQ ID NO: 681598 - DNA, 20 bp, mouse
gctgcggagcctagtgagaa

SEQ ID NO: 681599 - DNA, 20 bp, mouse
ggggacagattgtaaacttt

SEQ ID NO: 681600 - DNA, 20 bp, mouse
ggagggctctgggccaccga

SEQ ID NO: 681601 - DNA, 20 bp, mouse
gttgcctggacatgtgaccc

SEQ ID NO: 681602 - DNA, 20 bp, mouse
gggctccaattgcttcgggt

SEQ ID NO: 681603 - DNA, 20 bp, mouse
gttgtcttggttcagatgga

SEQ ID NO: 681604 - DNA, 20 bp, mouse
gggggccaacccgaagcaat

SEQ ID NO: 681605 - DNA, 20 bp, mouse
ggattggctccaattgcttc

SEQ ID NO: 681606 - DNA, 20 bp, mouse
ggataggtggccatcatgtg

SEQ ID NO: 681607 - DNA, 20 bp, mouse
ggcacaggaggcataattta

SEQ ID NO: 681608 - DNA, 20 bp, mouse
gcaaggggtgtgaagtcccg

SEQ ID NO: 681609 - DNA, 20 bp, mouse
ggaggcagctgggcctgcaa

SEQ ID NO: 681610 - DNA, 20 bp, mouse
gagctgggcctgcaagggat

SEQ ID NO: 681611 - DNA, 20 bp, mouse
gaggactttggaggaagcgg

SEQ ID NO: 681612 - DNA, 20 bp, mouse
gcctccaaagtccttacaca

SEQ ID NO: 681613 - DNA, 20 bp, mouse
ggtcacaaagagtgagtacc

SEQ ID NO: 681614 - DNA, 20 bp, mouse
ggtcttgctctgcttcaaat

SEQ ID NO: 681615 - DNA, 20 bp, mouse
gctttggaggaagcggtgga

SEQ ID NO: 681616 - DNA, 20 bp, mouse
gagagcttaacagacaaaga

SEQ ID NO: 681617 - DNA, 20 bp, mouse
gatgcaaacctgagacaagg

SEQ ID NO: 681618 - DNA, 20 bp, mouse
ggagccccgcctcacaactc

SEQ ID NO: 681619 - DNA, 20 bp, mouse
gcggcccaggagggcaggta

SEQ ID NO: 681620 - DNA, 20 bp, mouse
ggccccggagttgtgaggcg

SEQ ID NO: 681621 - DNA, 20 bp, mouse
gcaagaccagggagtcggaa

SEQ ID NO: 681622 - DNA, 20 bp, mouse
gtcagcccgaagcttgtaaa

SEQ ID NO: 681623 - DNA, 20 bp, mouse
ggcccggttgcttgcaagtc

SEQ ID NO: 681624 - DNA, 20 bp, mouse
gtccggggccacgcccatac

SEQ ID NO: 681625 - DNA, 20 bp, mouse
gggagatgagtgacccagag

SEQ ID NO: 681626 - DNA, 20 bp, mouse
gaagacccggtgttgcatgg

SEQ ID NO: 681627 - DNA, 20 bp, mouse
gcaggaggggcaataaaggt

SEQ ID NO: 681628 - DNA, 20 bp, mouse
gtgggaggagttaagtcctg

SEQ ID NO: 681629 - DNA, 20 bp, mouse
gggaggagataagactggta

SEQ ID NO: 681630 - DNA, 20 bp, mouse
gatgagggaggagataagac

SEQ ID NO: 681631 - DNA, 20 bp, mouse
gccggtgttgcatggaggta

SEQ ID NO: 681632 - DNA, 20 bp, mouse
gcttaactcctcccacatga

SEQ ID NO: 681633 - DNA, 20 bp, mouse
gctaggatatggagtgagga

SEQ ID NO: 681634 - DNA, 20 bp, mouse
ggtgagagcaaggctaagat

SEQ ID NO: 681635 - DNA, 20 bp, mouse
gataagactggtatggccaa

SEQ ID NO: 681636 - DNA, 20 bp, mouse
gtactacgcgccagccactg

SEQ ID NO: 681637 - DNA, 20 bp, mouse
gcacgtgaaagctcacggtg

SEQ ID NO: 681638 - DNA, 20 bp, mouse
ggcggaggaagtcgaattta

SEQ ID NO: 681639 - DNA, 20 bp, mouse
gctcacggtgtggaaagatg

SEQ ID NO: 681640 - DNA, 20 bp, mouse
gcgccagccactggggttca

SEQ ID NO: 681641 - DNA, 20 bp, mouse
ggccagttccggacacccta

SEQ ID NO: 681642 - DNA, 20 bp, mouse
gtagccggccctagggtgtc

SEQ ID NO: 681643 - DNA, 20 bp, mouse
ggggcggggaaagctcccgc

SEQ ID NO: 681644 - DNA, 20 bp, mouse
gcaaggcgaaagcgaaagac

SEQ ID NO: 681645 - DNA, 20 bp, mouse
gaccctagggccggctaatg

SEQ ID NO: 681646 - DNA, 20 bp, mouse
gctggtgcacgcttggattc

SEQ ID NO: 681647 - DNA, 20 bp, mouse
gggcagacagacttcgttcg

SEQ ID NO: 681648 - DNA, 20 bp, mouse
gccccacctcagttacacca

SEQ ID NO: 681649 - DNA, 20 bp, mouse
gggctcccacctagttcctg

SEQ ID NO: 681650 - DNA, 20 bp, mouse
ggggtggttcacgccagctc

SEQ ID NO: 681651 - DNA, 20 bp, mouse
gctgcctgggaagaagatgc

SEQ ID NO: 681652 - DNA, 20 bp, mouse
gagcagccacaggaactagg

SEQ ID NO: 681653 - DNA, 20 bp, mouse
gccaagcgtgcaccagcgaa

SEQ ID NO: 681654 - DNA, 20 bp, mouse
gaggccacactgcacatgta

SEQ ID NO: 681655 - DNA, 20 bp, mouse
gaaatcgggatgaagaacaa

SEQ ID NO: 681656 - DNA, 20 bp, mouse
gctaccgtggcacttggact

SEQ ID NO: 681657 - DNA, 20 bp, mouse
ggtggtgcagggctcacgaa

SEQ ID NO: 681658 - DNA, 20 bp, mouse
gaatccccgcacctagacgg

SEQ ID NO: 681659 - DNA, 20 bp, mouse
gagcctggcggagggatctc

SEQ ID NO: 681660 - DNA, 20 bp, mouse
gagctctgctgacgccacat

SEQ ID NO: 681661 - DNA, 20 bp, mouse
gtggcgcgcgagctgtctgt

SEQ ID NO: 681662 - DNA, 20 bp, mouse
ggaggcgggcgccccacgga

SEQ ID NO: 681663 - DNA, 20 bp, mouse
gcacggacgagcctggcgga

SEQ ID NO: 681664 - DNA, 20 bp, mouse
gccgctgtccgccaccaatc

SEQ ID NO: 681665 - DNA, 20 bp, mouse
gaggacgtcacagacggggc

SEQ ID NO: 681666 - DNA, 20 bp, mouse
gagaagatggacttagttca

SEQ ID NO: 681667 - DNA, 20 bp, mouse
gctaaaggatgtgaacggtg

SEQ ID NO: 681668 - DNA, 20 bp, mouse
ggcaatagtcgataagccga

SEQ ID NO: 681669 - DNA, 20 bp, mouse
gaagtccatcttctcagaag

SEQ ID NO: 681670 - DNA, 20 bp, mouse
ggatccaataacttgaactt

SEQ ID NO: 681671 - DNA, 20 bp, mouse
gtcacccaagttcaagttat

SEQ ID NO: 681672 - DNA, 20 bp, mouse
gtgcagctctctgcttgttc

SEQ ID NO: 681673 - DNA, 20 bp, mouse
gacaacacactccacatctt

SEQ ID NO: 681674 - DNA, 20 bp, mouse
gggagcctcttctgagaaga

SEQ ID NO: 681675 - DNA, 20 bp, mouse
gagctcacctaccaaagatg

SEQ ID NO: 681676 - DNA, 20 bp, mouse
gtaagcacagtggacactgg

SEQ ID NO: 681677 - DNA, 20 bp, mouse
ggccacagggccactttcta

SEQ ID NO: 681678 - DNA, 20 bp, mouse
gtccgctccgctccggtgac

SEQ ID NO: 681679 - DNA, 20 bp, mouse
gaggcggaacgcttgggtca

SEQ ID NO: 681680 - DNA, 20 bp, mouse
ggcttctgtggctccatctg

SEQ ID NO: 681681 - DNA, 20 bp, mouse
gccacagaagcctgggggtt

SEQ ID NO: 681682 - DNA, 20 bp, mouse
gggtgcgaggcggaacgctt

SEQ ID NO: 681683 - DNA, 20 bp, mouse
gagcgggaggcggtgcgagg

SEQ ID NO: 681684 - DNA, 20 bp, mouse
gttggcagggttcctgtcac

SEQ ID NO: 681685 - DNA, 20 bp, mouse
ggtccactgtgcttagattg

SEQ ID NO: 681686 - DNA, 20 bp, mouse
gggccaggtaaaaggaggaa

SEQ ID NO: 681687 - DNA, 20 bp, mouse
gagcctctgagcaaagtcca

SEQ ID NO: 681688 - DNA, 20 bp, mouse
gcagagtttggccaggtaaa

SEQ ID NO: 681689 - DNA, 20 bp, mouse
gctagttagctggcacaggg

SEQ ID NO: 681690 - DNA, 20 bp, mouse
gggaatgtgagcagtcggtg

SEQ ID NO: 681691 - DNA, 20 bp, mouse
gttgctcagaggctcggacg

SEQ ID NO: 681692 - DNA, 20 bp, mouse
gactctagttagctggcaca

SEQ ID NO: 681693 - DNA, 20 bp, mouse
gagtttggccaggtaaaagg

SEQ ID NO: 681694 - DNA, 20 bp, mouse
gacagctggcacacaacctg

SEQ ID NO: 681695 - DNA, 20 bp, mouse
gtactgttcaggttcagctc

SEQ ID NO: 681696 - DNA, 20 bp, mouse
ggcaaagctctcccagccaa

SEQ ID NO: 681697 - DNA, 20 bp, mouse
gagtctaacagtataagaga

SEQ ID NO: 681698 - DNA, 20 bp, mouse
gggaggcttacttaaacctc

SEQ ID NO: 681699 - DNA, 20 bp, mouse
gagtaagcctcctattttca

SEQ ID NO: 681700 - DNA, 20 bp, mouse
gaaatacaatgagaataata

SEQ ID NO: 681701 - DNA, 20 bp, mouse
gattctcaggcagtcttatc

SEQ ID NO: 681702 - DNA, 20 bp, mouse
gtagtctccttgaaaatagg

SEQ ID NO: 681703 - DNA, 20 bp, mouse
gttatgagtacattgatatg

SEQ ID NO: 681704 - DNA, 20 bp, mouse
gtgaccactttgagcttgaa

SEQ ID NO: 681705 - DNA, 20 bp, mouse
gactcccttcaagctcaaag

SEQ ID NO: 681706 - DNA, 20 bp, mouse
gagtggctgagacctcacaa

SEQ ID NO: 681707 - DNA, 20 bp, mouse
ggcctacccaatggcagcta

SEQ ID NO: 681708 - DNA, 20 bp, mouse
ggcactgcagctatctggaa

SEQ ID NO: 681709 - DNA, 20 bp, mouse
gtggtcatgttatctcaaga

SEQ ID NO: 681710 - DNA, 20 bp, mouse
gtaatgtgtacctactgcca

SEQ ID NO: 681711 - DNA, 20 bp, mouse
gaacatagtttcaaggacca

SEQ ID NO: 681712 - DNA, 20 bp, mouse
gatgaatgaacatagtttca

SEQ ID NO: 681713 - DNA, 20 bp, mouse
gtttcaaggaccatggcagt

SEQ ID NO: 681714 - DNA, 20 bp, mouse
gattatggtttcaaagttag

SEQ ID NO: 681715 - DNA, 20 bp, mouse
gatggggggggggcacggaa

SEQ ID NO: 681716 - DNA, 20 bp, mouse
gtgaccagtgaaagatttaa

SEQ ID NO: 681717 - DNA, 20 bp, mouse
ggtgaaagatttaaaggaat

SEQ ID NO: 681718 - DNA, 20 bp, mouse
gatagagaataacttaaagt

SEQ ID NO: 681719 - DNA, 20 bp, mouse
gcaaaattgcagctaagaag

SEQ ID NO: 681720 - DNA, 20 bp, mouse
gaagtgcttcaaaacatacc

SEQ ID NO: 681721 - DNA, 20 bp, mouse
gtgtgtgcataaaatcacca

SEQ ID NO: 681722 - DNA, 20 bp, mouse
gtcttagctgcaattttgta

SEQ ID NO: 681723 - DNA, 20 bp, mouse
gactaagacagagtgacaat

SEQ ID NO: 681724 - DNA, 20 bp, mouse
gtgttgacaaaacaaagctg

SEQ ID NO: 681725 - DNA, 20 bp, mouse
gagcatagtttcaagcacca

SEQ ID NO: 681726 - DNA, 20 bp, mouse
gtgaccagtgcaagttttaa

SEQ ID NO: 681727 - DNA, 20 bp, mouse
ggtgcaagttttaaaggact

SEQ ID NO: 681728 - DNA, 20 bp, mouse
gatagagaataacttaaagt

SEQ ID NO: 681729 - DNA, 20 bp, mouse
gaaagcatcagtatattttg

SEQ ID NO: 681730 - DNA, 20 bp, mouse
gcaaaattgcagctaagaag

SEQ ID NO: 681731 - DNA, 20 bp, mouse
gaagtgcttcaaaacatacc

SEQ ID NO: 681732 - DNA, 20 bp, mouse
gtcttagctgcaattttgta

SEQ ID NO: 681733 - DNA, 20 bp, mouse
gactaagacagagtgacaat

SEQ ID NO: 681734 - DNA, 20 bp, mouse
gtgtgtgcataaaatcacca

SEQ ID NO: 681735 - DNA, 20 bp, mouse
gagcatagtttcaagcacca

SEQ ID NO: 681736 - DNA, 20 bp, mouse
gttactttgagtagtgatta

SEQ ID NO: 681737 - DNA, 20 bp, mouse
gtgacactttctgatgaata

SEQ ID NO: 681738 - DNA, 20 bp, mouse
gaagtctcattgaaaatagg

SEQ ID NO: 681739 - DNA, 20 bp, mouse
gctttcatacactttcttgg

SEQ ID NO: 681740 - DNA, 20 bp, mouse
gattctcaggcagtgtgatc

SEQ ID NO: 681741 - DNA, 20 bp, mouse
gacaaagtctcattgaaaat

SEQ ID NO: 681742 - DNA, 20 bp, mouse
gctaacttagtataagaaga

SEQ ID NO: 681743 - DNA, 20 bp, mouse
gttatgagtacattgatatg

SEQ ID NO: 681744 - DNA, 20 bp, mouse
gtgaccactttgagcttgaa

SEQ ID NO: 681745 - DNA, 20 bp, mouse
gactcccttcaagctcaaag

SEQ ID NO: 681746 - DNA, 20 bp, mouse
gaggttagatatcttcaaaa

SEQ ID NO: 681747 - DNA, 20 bp, mouse
ggatcgataagcatagatta

SEQ ID NO: 681748 - DNA, 20 bp, mouse
gcaaacttttacactatacc

SEQ ID NO: 681749 - DNA, 20 bp, mouse
gtatctaacctatgccagcc

SEQ ID NO: 681750 - DNA, 20 bp, mouse
gcactatacctggctggcat

SEQ ID NO: 681751 - DNA, 20 bp, mouse
ggctaagactgatcagcaat

SEQ ID NO: 681752 - DNA, 20 bp, mouse
gtacagaatatcttagatta

SEQ ID NO: 681753 - DNA, 20 bp, mouse
ggcagcaggcacacattgca

SEQ ID NO: 681754 - DNA, 20 bp, mouse
gattaaggggccatggcagc

SEQ ID NO: 681755 - DNA, 20 bp, mouse
gagcatagattaaggggcca

SEQ ID NO: 681756 - DNA, 20 bp, mouse
gctcaaggtggtcagagata

SEQ ID NO: 681757 - DNA, 20 bp, mouse
gtgaccaccttgagtatgaa

SEQ ID NO: 681758 - DNA, 20 bp, mouse
gacaaagtcttgttgaaaat

SEQ ID NO: 681759 - DNA, 20 bp, mouse
gtctgacaggtagataacca

SEQ ID NO: 681760 - DNA, 20 bp, mouse
gtgtaagcaaaagtagagta

SEQ ID NO: 681761 - DNA, 20 bp, mouse
gcctagaaagtgtatgaaag

SEQ ID NO: 681762 - DNA, 20 bp, mouse
gactcccttcatactcaagg

SEQ ID NO: 681763 - DNA, 20 bp, mouse
gtggactcccttcatactca

SEQ ID NO: 681764 - DNA, 20 bp, mouse
gattctcaggcagtctgatc

SEQ ID NO: 681765 - DNA, 20 bp, mouse
gaagtcttgttgaaaatagg

SEQ ID NO: 681766 - DNA, 20 bp, mouse
gtgctgccaagcacctcccc

SEQ ID NO: 681767 - DNA, 20 bp, mouse
gcctaggcaggcattataaa

SEQ ID NO: 681768 - DNA, 20 bp, mouse
gtggggagggcgggatgctt

SEQ ID NO: 681769 - DNA, 20 bp, mouse
gaaaaggtgcaacggagcca

SEQ ID NO: 681770 - DNA, 20 bp, mouse
ggtctaggcaaagatctgaa

SEQ ID NO: 681771 - DNA, 20 bp, mouse
gtctgatggatctgagaaga

SEQ ID NO: 681772 - DNA, 20 bp, mouse
gcaggaatgttggttggcgc

SEQ ID NO: 681773 - DNA, 20 bp, mouse
ggaggggggaaaaggtgcaa

SEQ ID NO: 681774 - DNA, 20 bp, mouse
gggagacagaggaacaaaag

SEQ ID NO: 681775 - DNA, 20 bp, mouse
gggtgcaacggagccagggg

SEQ ID NO: 681776 - DNA, 20 bp, mouse
gtccctggacagggactcga

SEQ ID NO: 681777 - DNA, 20 bp, mouse
ggacagggactcgagggtag

SEQ ID NO: 681778 - DNA, 20 bp, mouse
ggtaccagaggccctgggca

SEQ ID NO: 681779 - DNA, 20 bp, mouse
ggaggagaagactctggagt

SEQ ID NO: 681780 - DNA, 20 bp, mouse
gggcgtgtgacttcctggga

SEQ ID NO: 681781 - DNA, 20 bp, mouse
gcggccagaggaactccaat

SEQ ID NO: 681782 - DNA, 20 bp, mouse
gaccctcgagtccctgtcca

SEQ ID NO: 681783 - DNA, 20 bp, mouse
gcgaccccccggcccggaca

SEQ ID NO: 681784 - DNA, 20 bp, mouse
ggaagggcgtgtccctggac

SEQ ID NO: 681785 - DNA, 20 bp, mouse
ggagtgggcgtgtgacttcc

SEQ ID NO: 681786 - DNA, 20 bp, mouse
ggggtgcttaggctatttgt

SEQ ID NO: 681787 - DNA, 20 bp, mouse
gtgctctgaggtgggaagta

SEQ ID NO: 681788 - DNA, 20 bp, mouse
gaactctggcggggttgaag

SEQ ID NO: 681789 - DNA, 20 bp, mouse
ggggaagccaaactctggcg

SEQ ID NO: 681790 - DNA, 20 bp, mouse
gacacacatacagcctgtga

SEQ ID NO: 681791 - DNA, 20 bp, mouse
ggcagctgcatgacttcctg

SEQ ID NO: 681792 - DNA, 20 bp, mouse
gctactgcaatagaatcctc

SEQ ID NO: 681793 - DNA, 20 bp, mouse
gacaaatgagtgtttatctc

SEQ ID NO: 681794 - DNA, 20 bp, mouse
gtgcttaggctatttgtagg

SEQ ID NO: 681795 - DNA, 20 bp, mouse
gaaccagggaagccaaactc

SEQ ID NO: 681796 - DNA, 20 bp, mouse
gtagcggcagggcaattcta

SEQ ID NO: 681797 - DNA, 20 bp, mouse
ggcaaggcgagaagtcactt

SEQ ID NO: 681798 - DNA, 20 bp, mouse
ggcactgatgggttgggcat

SEQ ID NO: 681799 - DNA, 20 bp, mouse
ggatcccgatggaaaggggg

SEQ ID NO: 681800 - DNA, 20 bp, mouse
gttctagggtgacttgaaag

SEQ ID NO: 681801 - DNA, 20 bp, mouse
gaaaaccaatcattagcggc

SEQ ID NO: 681802 - DNA, 20 bp, mouse
gcaaaagatcccgatggaaa

SEQ ID NO: 681803 - DNA, 20 bp, mouse
gagcgctgcactgatgggtt

SEQ ID NO: 681804 - DNA, 20 bp, mouse
gagctttgtggcactgtcat

SEQ ID NO: 681805 - DNA, 20 bp, mouse
gctacagagcgctgcactga

SEQ ID NO: 681806 - DNA, 20 bp, mouse
gagggggcggcaccaagcga

SEQ ID NO: 681807 - DNA, 20 bp, mouse
ggggcggcaccaagcgaggg

SEQ ID NO: 681808 - DNA, 20 bp, mouse
gcacccggccccacgtcgct

SEQ ID NO: 681809 - DNA, 20 bp, mouse
gatacagatcggggaccaca

SEQ ID NO: 681810 - DNA, 20 bp, mouse
gagggagatcaggtgactcc

SEQ ID NO: 681811 - DNA, 20 bp, mouse
gccgggtgctcgcaaggacc

SEQ ID NO: 681812 - DNA, 20 bp, mouse
gaaactatagatacagatcg

SEQ ID NO: 681813 - DNA, 20 bp, mouse
gggaccggagattgggaaaa

SEQ ID NO: 681814 - DNA, 20 bp, mouse
ggtggggccgggtgctcgca

SEQ ID NO: 681815 - DNA, 20 bp, mouse
ggacgtcaggcgcgccgctg

SEQ ID NO: 681816 - DNA, 20 bp, mouse
gaaactaaagaggtcctcaa

SEQ ID NO: 681817 - DNA, 20 bp, mouse
gtgggggcggagtcatagat

SEQ ID NO: 681818 - DNA, 20 bp, mouse
ggagagagggcgtgacttgg

SEQ ID NO: 681819 - DNA, 20 bp, mouse
ggggcggtacctaaggagag

SEQ ID NO: 681820 - DNA, 20 bp, mouse
gcaaggggacggggcctaga

SEQ ID NO: 681821 - DNA, 20 bp, mouse
ggtcacgggtataacccgaa

SEQ ID NO: 681822 - DNA, 20 bp, mouse
gccgcccgaggcaccgcccc

SEQ ID NO: 681823 - DNA, 20 bp, mouse
gaaagaggtcctcaagggga

SEQ ID NO: 681824 - DNA, 20 bp, mouse
gcgcacgcgcgttttggctg

SEQ ID NO: 681825 - DNA, 20 bp, mouse
gggtaccgccccctctcctc

SEQ ID NO: 681826 - DNA, 20 bp, mouse
ggggagacccgcagcagatt

SEQ ID NO: 681827 - DNA, 20 bp, mouse
gacccacagtccgattggtc

SEQ ID NO: 681828 - DNA, 20 bp, mouse
gacactacccacagtccgat

SEQ ID NO: 681829 - DNA, 20 bp, mouse
ggactgctagcctgaccaat

SEQ ID NO: 681830 - DNA, 20 bp, mouse
gagacccgcagcagattggg

SEQ ID NO: 681831 - DNA, 20 bp, mouse
gctccgccccctagccccac

SEQ ID NO: 681832 - DNA, 20 bp, mouse
gggactgtgggtagtgtgct

SEQ ID NO: 681833 - DNA, 20 bp, mouse
gggtcccgcccccgaaacaa

SEQ ID NO: 681834 - DNA, 20 bp, mouse
gagcctgaccaatcggactg

SEQ ID NO: 681835 - DNA, 20 bp, mouse
gccccaccggccgggcggtt

SEQ ID NO: 681836 - DNA, 20 bp, mouse
ggctccgcccacaccgacag

SEQ ID NO: 681837 - DNA, 20 bp, mouse
gcacaccgacaggggaggcg

SEQ ID NO: 681838 - DNA, 20 bp, mouse
gtctccaggatgctctagag

SEQ ID NO: 681839 - DNA, 20 bp, mouse
gccgcccacaccgacagggg

SEQ ID NO: 681840 - DNA, 20 bp, mouse
gagaggaagccgggtctatc

SEQ ID NO: 681841 - DNA, 20 bp, mouse
gaaggccgggcggagtctgg

SEQ ID NO: 681842 - DNA, 20 bp, mouse
gcagctactgcaaggccggg

SEQ ID NO: 681843 - DNA, 20 bp, mouse
gccgggcggagtctggtggg

SEQ ID NO: 681844 - DNA, 20 bp, mouse
gctcgcaaatgcatagagta

SEQ ID NO: 681845 - DNA, 20 bp, mouse
ggggcggagcctcactgctc

SEQ ID NO: 681846 - DNA, 20 bp, mouse
gaggaagtgcgctctgtgtc

SEQ ID NO: 681847 - DNA, 20 bp, mouse
gcccccacaagctcagtcac

SEQ ID NO: 681848 - DNA, 20 bp, mouse
ggggaagaaggtcctaacga

SEQ ID NO: 681849 - DNA, 20 bp, mouse
ggccacaggggtctgtgcgc

SEQ ID NO: 681850 - DNA, 20 bp, mouse
gagacagacaggtggattat

SEQ ID NO: 681851 - DNA, 20 bp, mouse
gcccgcccagaccctgtggg

SEQ ID NO: 681852 - DNA, 20 bp, mouse
gtgccccgcccagaccctgt

SEQ ID NO: 681853 - DNA, 20 bp, mouse
ggcctgcgcacagacccctg

SEQ ID NO: 681854 - DNA, 20 bp, mouse
gtgccagggtctgagctaac

SEQ ID NO: 681855 - DNA, 20 bp, mouse
gcctaacgatggaccttctc

SEQ ID NO: 681856 - DNA, 20 bp, mouse
gtaggagtgacctcctctat

SEQ ID NO: 681857 - DNA, 20 bp, mouse
gagtatcaaactctatgttc

SEQ ID NO: 681858 - DNA, 20 bp, mouse
gtcaaacggctacagctcta

SEQ ID NO: 681859 - DNA, 20 bp, mouse
gctatgttccggctgtttga

SEQ ID NO: 681860 - DNA, 20 bp, mouse
gaagcggcataaaggcaatt

SEQ ID NO: 681861 - DNA, 20 bp, mouse
gcacagtctgttaagtgcac

SEQ ID NO: 681862 - DNA, 20 bp, mouse
gcatagagtttgatactcta

SEQ ID NO: 681863 - DNA, 20 bp, mouse
gtgttgcacaaagcctatag

SEQ ID NO: 681864 - DNA, 20 bp, mouse
gattaaatgagcaaacgggt

SEQ ID NO: 681865 - DNA, 20 bp, mouse
gctaatattaaatgagcaaa

SEQ ID NO: 681866 - DNA, 20 bp, mouse
gagggccaggcatccaagga

SEQ ID NO: 681867 - DNA, 20 bp, mouse
ggcgacacgcccatagggtc

SEQ ID NO: 681868 - DNA, 20 bp, mouse
gggggcgggtgcatagttgg

SEQ ID NO: 681869 - DNA, 20 bp, mouse
gtccaaggagggtggaacta

SEQ ID NO: 681870 - DNA, 20 bp, mouse
ggccaggcatccaaggaggg

SEQ ID NO: 681871 - DNA, 20 bp, mouse
gtcagtgtcccagaccctat

SEQ ID NO: 681872 - DNA, 20 bp, mouse
ggctgttgaggggatatcga

SEQ ID NO: 681873 - DNA, 20 bp, mouse
ggggccccacaggaaaaagg

SEQ ID NO: 681874 - DNA, 20 bp, mouse
ggagggggcgggtgcatagt

SEQ ID NO: 681875 - DNA, 20 bp, mouse
ggaaagaagctgtaatgagg

SEQ ID NO: 681876 - DNA, 20 bp, mouse
gagagaggacaatagacctg

SEQ ID NO: 681877 - DNA, 20 bp, mouse
gaggaaaactcagcgaagtg

SEQ ID NO: 681878 - DNA, 20 bp, mouse
gggagtgttgtggcccagag

SEQ ID NO: 681879 - DNA, 20 bp, mouse
ggcaccctgccattctatag

SEQ ID NO: 681880 - DNA, 20 bp, mouse
gaaaactcagcgaagtgggg

SEQ ID NO: 681881 - DNA, 20 bp, mouse
gggtggcaccaaagtcggat

SEQ ID NO: 681882 - DNA, 20 bp, mouse
gacctgtggaaccagggggt

SEQ ID NO: 681883 - DNA, 20 bp, mouse
gaaggaacttctgagttgtt

SEQ ID NO: 681884 - DNA, 20 bp, mouse
gacaatagacctgtggaacc

SEQ ID NO: 681885 - DNA, 20 bp, mouse
gatagacctgtggaaccagg

SEQ ID NO: 681886 - DNA, 20 bp, mouse
gcgccctcgccgtgcagccg

SEQ ID NO: 681887 - DNA, 20 bp, mouse
ggcagccgcgggtcgctgag

SEQ ID NO: 681888 - DNA, 20 bp, mouse
ggaaacccctcagcgacccg

SEQ ID NO: 681889 - DNA, 20 bp, mouse
gaccgggtgagcactgaaga

SEQ ID NO: 681890 - DNA, 20 bp, mouse
gctcggagaagccatccccg

SEQ ID NO: 681891 - DNA, 20 bp, mouse
gcacggcgagggcggctcac

SEQ ID NO: 681892 - DNA, 20 bp, mouse
ggaagaggggatagggctgg

SEQ ID NO: 681893 - DNA, 20 bp, mouse
ggcagctgctgggttcgggg

SEQ ID NO: 681894 - DNA, 20 bp, mouse
ggacccgcggctgcacggcg

SEQ ID NO: 681895 - DNA, 20 bp, mouse
ggggaggctcgcagaggccg

SEQ ID NO: 681896 - DNA, 20 bp, mouse
gcctgcccgagtcctcgctt

SEQ ID NO: 681897 - DNA, 20 bp, mouse
ggaaggaggccgctaccccc

SEQ ID NO: 681898 - DNA, 20 bp, mouse
gcggaagtgcgccctctgag

SEQ ID NO: 681899 - DNA, 20 bp, mouse
gtcctcgcttggggaccgag

SEQ ID NO: 681900 - DNA, 20 bp, mouse
gcagcacagccgctggttgg

SEQ ID NO: 681901 - DNA, 20 bp, mouse
gggcgcacttccggccgcaa

SEQ ID NO: 681902 - DNA, 20 bp, mouse
gtcaaaagaaggccgccagg

SEQ ID NO: 681903 - DNA, 20 bp, mouse
gcacagccgctggttggtgg

SEQ ID NO: 681904 - DNA, 20 bp, mouse
gcccctgtgtgtgcgcctct

SEQ ID NO: 681905 - DNA, 20 bp, mouse
gtccggccgcaagggcgctc

SEQ ID NO: 681906 - DNA, 20 bp, mouse
gcgatccatgctctgggtta

SEQ ID NO: 681907 - DNA, 20 bp, mouse
ggtcatgtataacctagttc

SEQ ID NO: 681908 - DNA, 20 bp, mouse
gcctaaataaatgtaaactg

SEQ ID NO: 681909 - DNA, 20 bp, mouse
gctaccatgaaaagtcacta

SEQ ID NO: 681910 - DNA, 20 bp, mouse
gcccagagcatggatcgcta

SEQ ID NO: 681911 - DNA, 20 bp, mouse
gaacacaatacaccatggac

SEQ ID NO: 681912 - DNA, 20 bp, mouse
gagaataacacaatacacca

SEQ ID NO: 681913 - DNA, 20 bp, mouse
gtacaccatggactgggtgc

SEQ ID NO: 681914 - DNA, 20 bp, mouse
gagactgtgtaattcgtgta

SEQ ID NO: 681915 - DNA, 20 bp, mouse
gtagttatcagtcctgaact

SEQ ID NO: 681916 - DNA, 20 bp, mouse
ggatctcggtgatttcccta

SEQ ID NO: 681917 - DNA, 20 bp, mouse
gaccagcaggggaacccggg

SEQ ID NO: 681918 - DNA, 20 bp, mouse
gctcaccagcaggggaaccc

SEQ ID NO: 681919 - DNA, 20 bp, mouse
gatccaaaggtggggatctg

SEQ ID NO: 681920 - DNA, 20 bp, mouse
gtggacgttaggtagacggc

SEQ ID NO: 681921 - DNA, 20 bp, mouse
gctaacgtccaagaggacct

SEQ ID NO: 681922 - DNA, 20 bp, mouse
gcgccggcccagcaggtgat

SEQ ID NO: 681923 - DNA, 20 bp, mouse
gaaaggtggggatctgtggc

SEQ ID NO: 681924 - DNA, 20 bp, mouse
gagcgggtgtgattcatcag

SEQ ID NO: 681925 - DNA, 20 bp, mouse
ggcctcccgggttcccctgc

SEQ ID NO: 681926 - DNA, 20 bp, mouse
gcggtctcttaggtgagggg

SEQ ID NO: 681927 - DNA, 20 bp, mouse
gcaaccggtctcttaggtga

SEQ ID NO: 681928 - DNA, 20 bp, mouse
gccctcccgctagtcctcca

SEQ ID NO: 681929 - DNA, 20 bp, mouse
ggggcgtgtcctgagatctg

SEQ ID NO: 681930 - DNA, 20 bp, mouse
ggcgcctgcgcagtgaccga

SEQ ID NO: 681931 - DNA, 20 bp, mouse
gaacccagcacctttttccc

SEQ ID NO: 681932 - DNA, 20 bp, mouse
gcactggccctctccagaaa

SEQ ID NO: 681933 - DNA, 20 bp, mouse
gtccctggaggactagcggg

SEQ ID NO: 681934 - DNA, 20 bp, mouse
gcagaccgggccgctcaaca

SEQ ID NO: 681935 - DNA, 20 bp, mouse
gtccagccaaccggtctctt

SEQ ID NO: 681936 - DNA, 20 bp, mouse
gccccgcttccggttcccgt

SEQ ID NO: 681937 - DNA, 20 bp, mouse
gacaaggcaccacactgcgt

SEQ ID NO: 681938 - DNA, 20 bp, mouse
gggagactagggctagactt

SEQ ID NO: 681939 - DNA, 20 bp, mouse
gacaataaaggaggagacta

SEQ ID NO: 681940 - DNA, 20 bp, mouse
gggaggtgggcggtgactta

SEQ ID NO: 681941 - DNA, 20 bp, mouse
gactagggctagacttgggc

SEQ ID NO: 681942 - DNA, 20 bp, mouse
gacttgggctggggtagact

SEQ ID NO: 681943 - DNA, 20 bp, mouse
gtataggaaggcacggggaa

SEQ ID NO: 681944 - DNA, 20 bp, mouse
ggacccacgggaaccggaag

SEQ ID NO: 681945 - DNA, 20 bp, mouse
gcgctgcggatgcacgtgtc

SEQ ID NO: 681946 - DNA, 20 bp, mouse
gggaagaggcgggtcccaga

SEQ ID NO: 681947 - DNA, 20 bp, mouse
ggccccggacacctaaacgg

SEQ ID NO: 681948 - DNA, 20 bp, mouse
ggctgccccggacacctaaa

SEQ ID NO: 681949 - DNA, 20 bp, mouse
gtcccagagggaagactgac

SEQ ID NO: 681950 - DNA, 20 bp, mouse
gtccgccccaggtgagggaa

SEQ ID NO: 681951 - DNA, 20 bp, mouse
ggcctgttcaaaaacaaaac

SEQ ID NO: 681952 - DNA, 20 bp, mouse
gtctgcgttaagcctctcta

SEQ ID NO: 681953 - DNA, 20 bp, mouse
gcacaggctcaggggtcctc

SEQ ID NO: 681954 - DNA, 20 bp, mouse
gttcctgcgtgcgcggtgat

SEQ ID NO: 681955 - DNA, 20 bp, mouse
gcgggcgctgagtccccctc

SEQ ID NO: 681956 - DNA, 20 bp, mouse
gcgggaaaggtctggccttg

SEQ ID NO: 681957 - DNA, 20 bp, mouse
gtccgcctcaagggtctgat

SEQ ID NO: 681958 - DNA, 20 bp, mouse
gcggaagggtgaatggttgg

SEQ ID NO: 681959 - DNA, 20 bp, mouse
gggtgaatggttggaggcag

SEQ ID NO: 681960 - DNA, 20 bp, mouse
ggactggaggtccgcctcaa

SEQ ID NO: 681961 - DNA, 20 bp, mouse
gtgagtgcagaaaggcggaa

SEQ ID NO: 681962 - DNA, 20 bp, mouse
gatgcttagaggatgcagaa

SEQ ID NO: 681963 - DNA, 20 bp, mouse
gtgcatatccgggaaaggtc

SEQ ID NO: 681964 - DNA, 20 bp, mouse
ggttgctgagtgcagaaagg

SEQ ID NO: 681965 - DNA, 20 bp, mouse
gagagctgatatcaacccca

SEQ ID NO: 681966 - DNA, 20 bp, mouse
ggcaggaaaggggtgggcga

SEQ ID NO: 681967 - DNA, 20 bp, mouse
ggcggcgcaggccatcccta

SEQ ID NO: 681968 - DNA, 20 bp, mouse
gaactgttgaggggatagac

SEQ ID NO: 681969 - DNA, 20 bp, mouse
gcagagcagggaagcaacgg

SEQ ID NO: 681970 - DNA, 20 bp, mouse
gcatggttctgaactgttga

SEQ ID NO: 681971 - DNA, 20 bp, mouse
gcagaaccatggcaggaaag

SEQ ID NO: 681972 - DNA, 20 bp, mouse
ggcacacacgcccctaggga

SEQ ID NO: 681973 - DNA, 20 bp, mouse
gtagaaaaatgctccacccg

SEQ ID NO: 681974 - DNA, 20 bp, mouse
gcggaggcccctctgcttag

SEQ ID NO: 681975 - DNA, 20 bp, mouse
gcaagcagtgcttgcttccc

SEQ ID NO: 681976 - DNA, 20 bp, mouse
gtgaagaagcgtaggtatcc

SEQ ID NO: 681977 - DNA, 20 bp, mouse
gtcaactcccagtactgtat

SEQ ID NO: 681978 - DNA, 20 bp, mouse
ggtggaaagtgaagaagcgt

SEQ ID NO: 681979 - DNA, 20 bp, mouse
gacagcatggacctcagtga

SEQ ID NO: 681980 - DNA, 20 bp, mouse
ggatgtctgctcacttggct

SEQ ID NO: 681981 - DNA, 20 bp, mouse
gctccagctaaaatcctgtc

SEQ ID NO: 681982 - DNA, 20 bp, mouse
gccttgacgccagatcatcc

SEQ ID NO: 681983 - DNA, 20 bp, mouse
gcaggagttaagaaagattc

SEQ ID NO: 681984 - DNA, 20 bp, mouse
gctggaaaaaccgaccagac

SEQ ID NO: 681985 - DNA, 20 bp, mouse
gattcggggctgctcactag

SEQ ID NO: 681986 - DNA, 20 bp, mouse
gaagcaacaagcaggatcct

SEQ ID NO: 681987 - DNA, 20 bp, mouse
gcgacctctgcgggaatagc

SEQ ID NO: 681988 - DNA, 20 bp, mouse
gaaacacgccaccagatgtg

SEQ ID NO: 681989 - DNA, 20 bp, mouse
gccggaacgcggggacggga

SEQ ID NO: 681990 - DNA, 20 bp, mouse
gggttcccgccgagacccgg

SEQ ID NO: 681991 - DNA, 20 bp, mouse
gccccattggaaagctccgg

SEQ ID NO: 681992 - DNA, 20 bp, mouse
gttaacgccaagcaacaagc

SEQ ID NO: 681993 - DNA, 20 bp, mouse
ggcccaccggagctttccaa

SEQ ID NO: 681994 - DNA, 20 bp, mouse
gcctctgcgggaatagctgg

SEQ ID NO: 681995 - DNA, 20 bp, mouse
ggagttgcggtgatgcccac

SEQ ID NO: 681996 - DNA, 20 bp, mouse
gtaccggaggagttgtacag

SEQ ID NO: 681997 - DNA, 20 bp, mouse
ggacacttggttaaaacagt

SEQ ID NO: 681998 - DNA, 20 bp, mouse
ggggcacagtgttacgctgc

SEQ ID NO: 681999 - DNA, 20 bp, mouse
gactcatagaacaacctgtg

SEQ ID NO: 682000 - DNA, 20 bp, mouse
gcagtcttcaggcactaaac

SEQ ID NO: 682001 - DNA, 20 bp, mouse
ggaccactgtacaactcctc

SEQ ID NO: 682002 - DNA, 20 bp, mouse
gccccaagtgcaagcatata

SEQ ID NO: 682003 - DNA, 20 bp, mouse
gagcatatatggcagtcttc

SEQ ID NO: 682004 - DNA, 20 bp, mouse
gtggatagttcacaaacaat

SEQ ID NO: 682005 - DNA, 20 bp, mouse
gagcaacaacgcaaagaagc

SEQ ID NO: 682006 - DNA, 20 bp, mouse
ggtcaaagcccttcttcata

SEQ ID NO: 682007 - DNA, 20 bp, mouse
gcttggctgtcagcaggtcc

SEQ ID NO: 682008 - DNA, 20 bp, mouse
gcagagaatccatatgaaga

SEQ ID NO: 682009 - DNA, 20 bp, mouse
ggcagtactcgcctcaaact

SEQ ID NO: 682010 - DNA, 20 bp, mouse
gcacgtgtactcttgggccc

SEQ ID NO: 682011 - DNA, 20 bp, mouse
gctcgcacaccccgagtttg

SEQ ID NO: 682012 - DNA, 20 bp, mouse
gctcttgggccctggccact

SEQ ID NO: 682013 - DNA, 20 bp, mouse
gcctggccactaggcaacct

SEQ ID NO: 682014 - DNA, 20 bp, mouse
gctgacagccaagaagaacg

SEQ ID NO: 682015 - DNA, 20 bp, mouse
gctggagcggggaccaatga

SEQ ID NO: 682016 - DNA, 20 bp, mouse
gcagagagaccgttccagga

SEQ ID NO: 682017 - DNA, 20 bp, mouse
gactgcagagagaccgttcc

SEQ ID NO: 682018 - DNA, 20 bp, mouse
gatgccgagcccgccaaaag

SEQ ID NO: 682019 - DNA, 20 bp, mouse
gtgggcttggcagcattctg

SEQ ID NO: 682020 - DNA, 20 bp, mouse
gggtctctctgcagtcgcgg

SEQ ID NO: 682021 - DNA, 20 bp, mouse
ggaggagagtgccacgcccg

SEQ ID NO: 682022 - DNA, 20 bp, mouse
ggtcaaacgcagtgcggaga

SEQ ID NO: 682023 - DNA, 20 bp, mouse
gtgctcgcgtcgggcccggg

SEQ ID NO: 682024 - DNA, 20 bp, mouse
gggcccgacgcgagcacgtt

SEQ ID NO: 682025 - DNA, 20 bp, mouse
gctacccaacgtgctcgcgt

SEQ ID NO: 682026 - DNA, 20 bp, mouse
gcagccgcgcctgcgcattg

SEQ ID NO: 682027 - DNA, 20 bp, mouse
gaaacccagaggtgcagacc

SEQ ID NO: 682028 - DNA, 20 bp, mouse
gcgcggctggctgggctcgg

SEQ ID NO: 682029 - DNA, 20 bp, mouse
gctgcgcattggggtgacag

SEQ ID NO: 682030 - DNA, 20 bp, mouse
gtggttgaacggtgcgagga

SEQ ID NO: 682031 - DNA, 20 bp, mouse
gtgcgcaggcgcggctggct

SEQ ID NO: 682032 - DNA, 20 bp, mouse
gatacagcgaatgcttggaa

SEQ ID NO: 682033 - DNA, 20 bp, mouse
gcagtgagcggaagtgacgt

SEQ ID NO: 682034 - DNA, 20 bp, mouse
gtgaacggtgcgaggaaggc

SEQ ID NO: 682035 - DNA, 20 bp, mouse
gccccccgcacgtggttgaa

SEQ ID NO: 682036 - DNA, 20 bp, mouse
gcggccgctctccccgtggg

SEQ ID NO: 682037 - DNA, 20 bp, mouse
ggggccctggggctgtgggc

SEQ ID NO: 682038 - DNA, 20 bp, mouse
gggcgcaagaggatgcgcac

SEQ ID NO: 682039 - DNA, 20 bp, mouse
gtacactccctgcgctaggg

SEQ ID NO: 682040 - DNA, 20 bp, mouse
gagcgagatgctctccgcgg

SEQ ID NO: 682041 - DNA, 20 bp, mouse
ggggagcgagatgctctccg

SEQ ID NO: 682042 - DNA, 20 bp, mouse
gcgggccagcccacagcccc

SEQ ID NO: 682043 - DNA, 20 bp, mouse
ggcccggccgctctccccgt

SEQ ID NO: 682044 - DNA, 20 bp, mouse
gtccatgtgcgccacgcgga

SEQ ID NO: 682045 - DNA, 20 bp, mouse
gacgtggccaccctagcgca

SEQ ID NO: 682046 - DNA, 20 bp, mouse
gcggagctccgcaacccgtg

SEQ ID NO: 682047 - DNA, 20 bp, mouse
gctagcgcaggcgtagagag

SEQ ID NO: 682048 - DNA, 20 bp, mouse
gccccgcgattcactagcgc

SEQ ID NO: 682049 - DNA, 20 bp, mouse
gagcccggaagcagctgtac

SEQ ID NO: 682050 - DNA, 20 bp, mouse
gagctccgcaacccgtgagg

SEQ ID NO: 682051 - DNA, 20 bp, mouse
ggtgctcagggtctggtctt

SEQ ID NO: 682052 - DNA, 20 bp, mouse
gagaccctgagcacgaaccc

SEQ ID NO: 682053 - DNA, 20 bp, mouse
gcgcctgcgctagtgaatcg

SEQ ID NO: 682054 - DNA, 20 bp, mouse
ggaacccgggttcgtgctca

SEQ ID NO: 682055 - DNA, 20 bp, mouse
ggggcccagcgtccggggag

SEQ ID NO: 682056 - DNA, 20 bp, mouse
gtgtgcgtgcgcgatcccga

SEQ ID NO: 682057 - DNA, 20 bp, mouse
gaacgtgcgctgtcacaaag

SEQ ID NO: 682058 - DNA, 20 bp, mouse
gggctcgtgcagcacggaga

SEQ ID NO: 682059 - DNA, 20 bp, mouse
ggggccgcgcacggaccctc

SEQ ID NO: 682060 - DNA, 20 bp, mouse
gctgccggacgggtcaagca

SEQ ID NO: 682061 - DNA, 20 bp, mouse
gggtcaagcaggggccagag

SEQ ID NO: 682062 - DNA, 20 bp, mouse
gccctgcgaggacccgagtc

SEQ ID NO: 682063 - DNA, 20 bp, mouse
gcgcgtgccgggacgagcct

SEQ ID NO: 682064 - DNA, 20 bp, mouse
gctcccgctgcgggagaacg

SEQ ID NO: 682065 - DNA, 20 bp, mouse
ggggtcccgcctcctcctct

SEQ ID NO: 682066 - DNA, 20 bp, mouse
ggacgctcgcggatgcctgg

SEQ ID NO: 682067 - DNA, 20 bp, mouse
gaacgtggagtgacacgcgc

SEQ ID NO: 682068 - DNA, 20 bp, mouse
gcccaccatggcagccaaat

SEQ ID NO: 682069 - DNA, 20 bp, mouse
gcaagacgaagtcgccctcc

SEQ ID NO: 682070 - DNA, 20 bp, mouse
ggggctcccggactcacttc

SEQ ID NO: 682071 - DNA, 20 bp, mouse
gactcacttcaggacaacat

SEQ ID NO: 682072 - DNA, 20 bp, mouse
gggtggggcgggactcgact

SEQ ID NO: 682073 - DNA, 20 bp, mouse
ggggcgacgttgtcaccgtt

SEQ ID NO: 682074 - DNA, 20 bp, mouse
gcgcctctgattgacgctcg

SEQ ID NO: 682075 - DNA, 20 bp, mouse
gaacgtcgccccgcccgatt

SEQ ID NO: 682076 - DNA, 20 bp, mouse
gcgggctttcgggagaggaa

SEQ ID NO: 682077 - DNA, 20 bp, mouse
gggaaagagcggatactggg

SEQ ID NO: 682078 - DNA, 20 bp, mouse
ggactcctcccacgcagtgt

SEQ ID NO: 682079 - DNA, 20 bp, mouse
gtcaccgcgacagagcggag

SEQ ID NO: 682080 - DNA, 20 bp, mouse
gagcgaccccacccatgctc

SEQ ID NO: 682081 - DNA, 20 bp, mouse
gtcactgaaggcgggctttc

SEQ ID NO: 682082 - DNA, 20 bp, mouse
gtgacctcaccgcgacagag

SEQ ID NO: 682083 - DNA, 20 bp, mouse
gttatgacgtcactgaaggc

SEQ ID NO: 682084 - DNA, 20 bp, mouse
ggcggtgcacgcttagtctc

SEQ ID NO: 682085 - DNA, 20 bp, mouse
ggaaggcgggctttcgggag

SEQ ID NO: 682086 - DNA, 20 bp, mouse
gcccgtggaagacgagtccg

SEQ ID NO: 682087 - DNA, 20 bp, mouse
gacgggacggatcccttcga

SEQ ID NO: 682088 - DNA, 20 bp, mouse
gacgagaggtgtggcgaaaa

SEQ ID NO: 682089 - DNA, 20 bp, mouse
gccacacctctcgtctgaga

SEQ ID NO: 682090 - DNA, 20 bp, mouse
gacaatcagcggatccgggg

SEQ ID NO: 682091 - DNA, 20 bp, mouse
ggagagggctgcatgagttt

SEQ ID NO: 682092 - DNA, 20 bp, mouse
gggaagacgagtccgtggct

SEQ ID NO: 682093 - DNA, 20 bp, mouse
gacgacgcgggttctcgcga

SEQ ID NO: 682094 - DNA, 20 bp, mouse
ggcggggcagaacgcggaag

SEQ ID NO: 682095 - DNA, 20 bp, mouse
gcgtcctggtactggggtca

SEQ ID NO: 682096 - DNA, 20 bp, mouse
gaggggtggcgaggaagcga

SEQ ID NO: 682097 - DNA, 20 bp, mouse
gcagaacggccgcagccgat

SEQ ID NO: 682098 - DNA, 20 bp, mouse
gtgttggcggggttctaaga

SEQ ID NO: 682099 - DNA, 20 bp, mouse
gaaatcgcttggttaaagtg

SEQ ID NO: 682100 - DNA, 20 bp, mouse
ggctggggagaggggtggcg

SEQ ID NO: 682101 - DNA, 20 bp, mouse
gcaacatcgtgtcttctgat

SEQ ID NO: 682102 - DNA, 20 bp, mouse
ggatgcccacctgagttcaa

SEQ ID NO: 682103 - DNA, 20 bp, mouse
gggtcgcccagggaacagcc

SEQ ID NO: 682104 - DNA, 20 bp, mouse
gagaagacacgatgttggcg

SEQ ID NO: 682105 - DNA, 20 bp, mouse
gcctaaacgcctctgctaag

SEQ ID NO: 682106 - DNA, 20 bp, mouse
gcgtgagagcgcagaaccgg

SEQ ID NO: 682107 - DNA, 20 bp, mouse
gccaacgtaccggtcgtcca

SEQ ID NO: 682108 - DNA, 20 bp, mouse
gcggcgtgagagcgcagaac

SEQ ID NO: 682109 - DNA, 20 bp, mouse
gagagcagcgggtacccggc

SEQ ID NO: 682110 - DNA, 20 bp, mouse
gaggctgttgcggggacggg

SEQ ID NO: 682111 - DNA, 20 bp, mouse
ggggagcggcccgcattgtc

SEQ ID NO: 682112 - DNA, 20 bp, mouse
gcgtgcgagcctggcgcagg

SEQ ID NO: 682113 - DNA, 20 bp, mouse
gtgggagagcagcgggtacc

SEQ ID NO: 682114 - DNA, 20 bp, mouse
gccagccgagcgtgcgagcc

SEQ ID NO: 682115 - DNA, 20 bp, mouse
gggtacccggctggctccgc

SEQ ID NO: 682116 - DNA, 20 bp, mouse
gtggggtcggggaggtaaag

SEQ ID NO: 682117 - DNA, 20 bp, mouse
gggtctgggcaattgtgggg

SEQ ID NO: 682118 - DNA, 20 bp, mouse
gcggggtctgggcaattgtg

SEQ ID NO: 682119 - DNA, 20 bp, mouse
gaacctgttgaccaggtgga

SEQ ID NO: 682120 - DNA, 20 bp, mouse
gaaggggcggttggtggcca

SEQ ID NO: 682121 - DNA, 20 bp, mouse
gcgcttggaggccatggaaa

SEQ ID NO: 682122 - DNA, 20 bp, mouse
gaaagggcactgatgactgg

SEQ ID NO: 682123 - DNA, 20 bp, mouse
gtggggtggccccctccacc

SEQ ID NO: 682124 - DNA, 20 bp, mouse
gccactccacgggacacctg

SEQ ID NO: 682125 - DNA, 20 bp, mouse
ggggccctgtgaccgcatcg

SEQ ID NO: 682126 - DNA, 20 bp, mouse
ggggctaaatcatgaaggcg

SEQ ID NO: 682127 - DNA, 20 bp, mouse
ggggccgtaaagcgtggcaa

SEQ ID NO: 682128 - DNA, 20 bp, mouse
gagacccgcgcgggtagagc

SEQ ID NO: 682129 - DNA, 20 bp, mouse
gtggtgcgctgtgcagtttc

SEQ ID NO: 682130 - DNA, 20 bp, mouse
gtcagaggccagacccgcgc

SEQ ID NO: 682131 - DNA, 20 bp, mouse
gaggcggggctaaatcatga

SEQ ID NO: 682132 - DNA, 20 bp, mouse
ggcagctgctttagaactta

SEQ ID NO: 682133 - DNA, 20 bp, mouse
gtgtgcagtttcaggacctc

SEQ ID NO: 682134 - DNA, 20 bp, mouse
ggtcgcgcacgcgcaaactc

SEQ ID NO: 682135 - DNA, 20 bp, mouse
ggttcctagtgcagattagt

SEQ ID NO: 682136 - DNA, 20 bp, mouse
ggaaacgccacgtgcgagtg

SEQ ID NO: 682137 - DNA, 20 bp, mouse
gacgccacgtgcgagtgcgg

SEQ ID NO: 682138 - DNA, 20 bp, mouse
gaggaagcgtccgtgtggtc

SEQ ID NO: 682139 - DNA, 20 bp, mouse
gacgctgtccgaacccagta

SEQ ID NO: 682140 - DNA, 20 bp, mouse
ggcggcacatgagccttact

SEQ ID NO: 682141 - DNA, 20 bp, mouse
gagaggcccagcggagagtg

SEQ ID NO: 682142 - DNA, 20 bp, mouse
gtaactggcaggcgcgcggt

SEQ ID NO: 682143 - DNA, 20 bp, mouse
ggacacgccccactctccgc

SEQ ID NO: 682144 - DNA, 20 bp, mouse
gcggaagaggcgaggctaac

SEQ ID NO: 682145 - DNA, 20 bp, mouse
gctccgctgggcctctgatt

SEQ ID NO: 682146 - DNA, 20 bp, mouse
ggggaagagaggagcttcta

SEQ ID NO: 682147 - DNA, 20 bp, mouse
gtgccccccaggtcccaaag

SEQ ID NO: 682148 - DNA, 20 bp, mouse
ggggcggggcacactcagca

SEQ ID NO: 682149 - DNA, 20 bp, mouse
gaaggccgaaggtctgggaa

SEQ ID NO: 682150 - DNA, 20 bp, mouse
gggaacataaacaaggccga

SEQ ID NO: 682151 - DNA, 20 bp, mouse
gcgccactttgggacctggg

SEQ ID NO: 682152 - DNA, 20 bp, mouse
ggaccacaatgaggccagtt

SEQ ID NO: 682153 - DNA, 20 bp, mouse
ggaagagggcagagattcgt

SEQ ID NO: 682154 - DNA, 20 bp, mouse
gcgaaggtctgggaagggcg

SEQ ID NO: 682155 - DNA, 20 bp, mouse
gtgggaaaagtgcgtggagt

SEQ ID NO: 682156 - DNA, 20 bp, mouse
ggggacgctctcaggacatc

SEQ ID NO: 682157 - DNA, 20 bp, mouse
gaggacatccggagcgctgg

SEQ ID NO: 682158 - DNA, 20 bp, mouse
gcggagcgctggtggaggat

SEQ ID NO: 682159 - DNA, 20 bp, mouse
ggtggctcccgcacggtgga

SEQ ID NO: 682160 - DNA, 20 bp, mouse
gacatccggagcgctggtgg

SEQ ID NO: 682161 - DNA, 20 bp, mouse
gtccccaggaaagcgcgggg

SEQ ID NO: 682162 - DNA, 20 bp, mouse
ggatcctggcctgcccactc

SEQ ID NO: 682163 - DNA, 20 bp, mouse
gtcgacaagcccaggtcccc

SEQ ID NO: 682164 - DNA, 20 bp, mouse
ggctctgtcccgcgaggctg

SEQ ID NO: 682165 - DNA, 20 bp, mouse
gcaagccgagggcaaagttg

SEQ ID NO: 682166 - DNA, 20 bp, mouse
gggaggggaagcacgggcat

SEQ ID NO: 682167 - DNA, 20 bp, mouse
gggcgggaaagctgatgcgc

SEQ ID NO: 682168 - DNA, 20 bp, mouse
gtaggggctcaaagcacagg

SEQ ID NO: 682169 - DNA, 20 bp, mouse
gcaaagctgttggcacggac

SEQ ID NO: 682170 - DNA, 20 bp, mouse
ggggaggagagaagcgttgg

SEQ ID NO: 682171 - DNA, 20 bp, mouse
gcatgggaggagagaagcgt

SEQ ID NO: 682172 - DNA, 20 bp, mouse
ggacagccgcgcaaagctgt

SEQ ID NO: 682173 - DNA, 20 bp, mouse
gtctcaaagtctcaaaatag

SEQ ID NO: 682174 - DNA, 20 bp, mouse
gaggagagaagcgttggggg

SEQ ID NO: 682175 - DNA, 20 bp, mouse
gcctactaaactccatctga

SEQ ID NO: 682176 - DNA, 20 bp, mouse
gtaggggaccttgtgagacc

SEQ ID NO: 682177 - DNA, 20 bp, mouse
ggcaagaggaaccccaggta

SEQ ID NO: 682178 - DNA, 20 bp, mouse
gtcacaaggtcccctacctg

SEQ ID NO: 682179 - DNA, 20 bp, mouse
ggagcccagggagagtggca

SEQ ID NO: 682180 - DNA, 20 bp, mouse
gcctccctgccactctccct

SEQ ID NO: 682181 - DNA, 20 bp, mouse
gttctgtagaagcaaggctg

SEQ ID NO: 682182 - DNA, 20 bp, mouse
ggtcaaaaatagggaagagt

SEQ ID NO: 682183 - DNA, 20 bp, mouse
ggagcttgacgtcaaaaata

SEQ ID NO: 682184 - DNA, 20 bp, mouse
gctccaccgcccaagccgtg

SEQ ID NO: 682185 - DNA, 20 bp, mouse
gcaagtcacctggtctcaca

SEQ ID NO: 682186 - DNA, 20 bp, mouse
gggccccagcactaccctat

SEQ ID NO: 682187 - DNA, 20 bp, mouse
gggtagtgctggggcctgat

SEQ ID NO: 682188 - DNA, 20 bp, mouse
gcagcccatagggtagtgct

SEQ ID NO: 682189 - DNA, 20 bp, mouse
gtgctggggcctgatggggc

SEQ ID NO: 682190 - DNA, 20 bp, mouse
gaatgggaatgattcctcta

SEQ ID NO: 682191 - DNA, 20 bp, mouse
gggctgaaatgacaagtttt

SEQ ID NO: 682192 - DNA, 20 bp, mouse
gtcaccatcgtgctgctgat

SEQ ID NO: 682193 - DNA, 20 bp, mouse
ggaagagacccagcctgagg

SEQ ID NO: 682194 - DNA, 20 bp, mouse
gcgtttagacagggtagagg

SEQ ID NO: 682195 - DNA, 20 bp, mouse
gcgaatcagacgtttagaca

SEQ ID NO: 682196 - DNA, 20 bp, mouse
gggacccggccggacgagaa

SEQ ID NO: 682197 - DNA, 20 bp, mouse
gcggctgaggggcgacgcca

SEQ ID NO: 682198 - DNA, 20 bp, mouse
ggcaccgctttcaaagtcgc

SEQ ID NO: 682199 - DNA, 20 bp, mouse
ggtccctgaggccgcgttgg

SEQ ID NO: 682200 - DNA, 20 bp, mouse
gtgggcggcagcgtccccgc

SEQ ID NO: 682201 - DNA, 20 bp, mouse
ggcccagccaggcgcgtcgc

SEQ ID NO: 682202 - DNA, 20 bp, mouse
gcgtcaccgtctccaaggaa

SEQ ID NO: 682203 - DNA, 20 bp, mouse
gggtgccccagaccgttcct

SEQ ID NO: 682204 - DNA, 20 bp, mouse
ggggacgctgccgcccagcc

SEQ ID NO: 682205 - DNA, 20 bp, mouse
gcacctgcctgcgcctgaga

SEQ ID NO: 682206 - DNA, 20 bp, mouse
ggagtcaagtgccctgggaa

SEQ ID NO: 682207 - DNA, 20 bp, mouse
ggaggactgctagaaatcaa

SEQ ID NO: 682208 - DNA, 20 bp, mouse
ggcccctctgggtacctctg

SEQ ID NO: 682209 - DNA, 20 bp, mouse
ggcgagccagctggggcgat

SEQ ID NO: 682210 - DNA, 20 bp, mouse
gagccagccagggcgctgag

SEQ ID NO: 682211 - DNA, 20 bp, mouse
ggggctggagtcaagtgccc

SEQ ID NO: 682212 - DNA, 20 bp, mouse
gctgctagaaatcaagggtc

SEQ ID NO: 682213 - DNA, 20 bp, mouse
gtgggagtggtcacgtggag

SEQ ID NO: 682214 - DNA, 20 bp, mouse
gtctctaccctggccaaatg

SEQ ID NO: 682215 - DNA, 20 bp, mouse
gctggcttggcccgccctcg

SEQ ID NO: 682216 - DNA, 20 bp, mouse
gtagccctctgaccggagaa

SEQ ID NO: 682217 - DNA, 20 bp, mouse
gctggcgaggtcctcgttga

SEQ ID NO: 682218 - DNA, 20 bp, mouse
gacgatctgggaaccctggg

SEQ ID NO: 682219 - DNA, 20 bp, mouse
gatctgggaaccctgggcgg

SEQ ID NO: 682220 - DNA, 20 bp, mouse
ggctgggatagccctctgac

SEQ ID NO: 682221 - DNA, 20 bp, mouse
gctctgaccggagaagggac

SEQ ID NO: 682222 - DNA, 20 bp, mouse
ggggttcccagatcgtgaga

SEQ ID NO: 682223 - DNA, 20 bp, mouse
gacctcgccagcgcagggca

SEQ ID NO: 682224 - DNA, 20 bp, mouse
gcccagatcgtgagaaggaa

SEQ ID NO: 682225 - DNA, 20 bp, mouse
ggctgaaccctgccctgcgc

SEQ ID NO: 682226 - DNA, 20 bp, mouse
gtacagcgatccgaggccta

SEQ ID NO: 682227 - DNA, 20 bp, mouse
ggacgcgctcgagtcgttgt

SEQ ID NO: 682228 - DNA, 20 bp, mouse
ggtgacgtcacgctacccga

SEQ ID NO: 682229 - DNA, 20 bp, mouse
ggcctcggatcgctgtacgc

SEQ ID NO: 682230 - DNA, 20 bp, mouse
gggcctagggaggactgatg

SEQ ID NO: 682231 - DNA, 20 bp, mouse
gcacctcgccgccgaggcca

SEQ ID NO: 682232 - DNA, 20 bp, mouse
gtggccctggaggggctcga

SEQ ID NO: 682233 - DNA, 20 bp, mouse
gaggccgtcgagcccctcca

SEQ ID NO: 682234 - DNA, 20 bp, mouse
gaacgactcgagcgcgtcca

SEQ ID NO: 682235 - DNA, 20 bp, mouse
gggaactgcaaacactgtca

SEQ ID NO: 682236 - DNA, 20 bp, mouse
gcccggatgtagaaggcggg

SEQ ID NO: 682237 - DNA, 20 bp, mouse
gcacagacatccgtgcgaaa

SEQ ID NO: 682238 - DNA, 20 bp, mouse
gtccaatcgccaagcgatgt

SEQ ID NO: 682239 - DNA, 20 bp, mouse
gcccgtgcctcggtcgtccc

SEQ ID NO: 682240 - DNA, 20 bp, mouse
gcaaaatacccggatgtaga

SEQ ID NO: 682241 - DNA, 20 bp, mouse
gttggcgattggacgagagt

SEQ ID NO: 682242 - DNA, 20 bp, mouse
gacgcgcatgcgtgtctcca

SEQ ID NO: 682243 - DNA, 20 bp, mouse
gatacccggatgtagaaggc

SEQ ID NO: 682244 - DNA, 20 bp, mouse
gggggacgacacatgacccg

SEQ ID NO: 682245 - DNA, 20 bp, mouse
gcccgcccgccttctacatc

SEQ ID NO: 682246 - DNA, 20 bp, mouse
gttgcattgtgagacattat

SEQ ID NO: 682247 - DNA, 20 bp, mouse
gttgcttgatatttttgggg

SEQ ID NO: 682248 - DNA, 20 bp, mouse
gagatcagagctggtttgcc

SEQ ID NO: 682249 - DNA, 20 bp, mouse
gaacaaaacaaatgaaaacc

SEQ ID NO: 682250 - DNA, 20 bp, mouse
gttgtttgcttgatattttt

SEQ ID NO: 682251 - DNA, 20 bp, mouse
gcttgtgggtggatctgtgg

SEQ ID NO: 682252 - DNA, 20 bp, mouse
gactaagggctgctgagtga

SEQ ID NO: 682253 - DNA, 20 bp, mouse
gaaaaattgcagttaactaa

SEQ ID NO: 682254 - DNA, 20 bp, mouse
gaggaactccacttctcccc

SEQ ID NO: 682255 - DNA, 20 bp, mouse
gtgtgtatgtgtattgttac

SEQ ID NO: 682256 - DNA, 20 bp, mouse
gaggccgacctgaggatccg

SEQ ID NO: 682257 - DNA, 20 bp, mouse
gacaccacgaggccgacctg

SEQ ID NO: 682258 - DNA, 20 bp, mouse
gcgcgcaggactggattctg

SEQ ID NO: 682259 - DNA, 20 bp, mouse
gtcgtggtgtcaggatcttc

SEQ ID NO: 682260 - DNA, 20 bp, mouse
gagcagcaggcgcgcaggac

SEQ ID NO: 682261 - DNA, 20 bp, mouse
ggctccgccctcgtgctgtg

SEQ ID NO: 682262 - DNA, 20 bp, mouse
gccaggacatggcgaagagg

SEQ ID NO: 682263 - DNA, 20 bp, mouse
ggccctcgtgctgtgtgggt

SEQ ID NO: 682264 - DNA, 20 bp, mouse
ggcggacaggtgtaacgcgg

SEQ ID NO: 682265 - DNA, 20 bp, mouse
gggcgcggacaggtgtaacg

SEQ ID NO: 682266 - DNA, 20 bp, mouse
gcctccctggacacaccaca

SEQ ID NO: 682267 - DNA, 20 bp, mouse
gaggaggaaagacctctcgg

SEQ ID NO: 682268 - DNA, 20 bp, mouse
gcctccctgtggtgtgtcca

SEQ ID NO: 682269 - DNA, 20 bp, mouse
gtcgttctggaggcgtccag

SEQ ID NO: 682270 - DNA, 20 bp, mouse
gacaccgaaacggttcgttc

SEQ ID NO: 682271 - DNA, 20 bp, mouse
ggagggggaaagtgcctccc

SEQ ID NO: 682272 - DNA, 20 bp, mouse
gctaaccggtgttaaatagg

SEQ ID NO: 682273 - DNA, 20 bp, mouse
gagtctaaccggtgttaaat

SEQ ID NO: 682274 - DNA, 20 bp, mouse
gcctccagaacgaaccgttt

SEQ ID NO: 682275 - DNA, 20 bp, mouse
gtccccctcctatttaacac

SEQ ID NO: 682276 - DNA, 20 bp, mouse
gggtgacaggagcccgacgt

SEQ ID NO: 682277 - DNA, 20 bp, mouse
gaggccaccggaacagtcta

SEQ ID NO: 682278 - DNA, 20 bp, mouse
ggtgcggagtggaccaacgt

SEQ ID NO: 682279 - DNA, 20 bp, mouse
ggggctcctgtcacccgcag

SEQ ID NO: 682280 - DNA, 20 bp, mouse
gaagaggcgggccaccccgt

SEQ ID NO: 682281 - DNA, 20 bp, mouse
gaagccagcagtcctgggtg

SEQ ID NO: 682282 - DNA, 20 bp, mouse
gcacccctagactgttccgg

SEQ ID NO: 682283 - DNA, 20 bp, mouse
gacaagaagccagcagtcct

SEQ ID NO: 682284 - DNA, 20 bp, mouse
gctgaggaggcgaaaagggg

SEQ ID NO: 682285 - DNA, 20 bp, mouse
gtgttccggtggcctcggca

SEQ ID NO: 682286 - DNA, 20 bp, mouse
gactcacccctcagccgtga

SEQ ID NO: 682287 - DNA, 20 bp, mouse
ggggaaggaagcctcagact

SEQ ID NO: 682288 - DNA, 20 bp, mouse
gtctgagtaaagagaagcta

SEQ ID NO: 682289 - DNA, 20 bp, mouse
gcccctcagccgtgatggga

SEQ ID NO: 682290 - DNA, 20 bp, mouse
gtccttcccatcacggctga

SEQ ID NO: 682291 - DNA, 20 bp, mouse
gaggacatctcttggcagag

SEQ ID NO: 682292 - DNA, 20 bp, mouse
gctcgtaagcaggaagcgac

SEQ ID NO: 682293 - DNA, 20 bp, mouse
gtcactgggttctgcagcga

SEQ ID NO: 682294 - DNA, 20 bp, mouse
gcgactggattctgtcactt

SEQ ID NO: 682295 - DNA, 20 bp, mouse
gcactgcagctgaaatactt

SEQ ID NO: 682296 - DNA, 20 bp, mouse
gtgtaggcatcaaaacaagt

SEQ ID NO: 682297 - DNA, 20 bp, mouse
gaaacatgcagtcataaaaa

SEQ ID NO: 682298 - DNA, 20 bp, mouse
gctaactcgttccaaggtag

SEQ ID NO: 682299 - DNA, 20 bp, mouse
gacagagagtagcgaaacgt

SEQ ID NO: 682300 - DNA, 20 bp, mouse
ggcagtcataaaaacggaag

SEQ ID NO: 682301 - DNA, 20 bp, mouse
gggtgcatgcacacatttgt

SEQ ID NO: 682302 - DNA, 20 bp, mouse
gctgttagtgtaagaagaac

SEQ ID NO: 682303 - DNA, 20 bp, mouse
gaatgttctaactcgttcca

SEQ ID NO: 682304 - DNA, 20 bp, mouse
ggtgctaaatgttacacaaa

SEQ ID NO: 682305 - DNA, 20 bp, mouse
gttcgctactctctgtgaag

SEQ ID NO: 682306 - DNA, 20 bp, mouse
gcagatgggcacaaggttca

SEQ ID NO: 682307 - DNA, 20 bp, mouse
gtcgaaggacaagtgtcaga

SEQ ID NO: 682308 - DNA, 20 bp, mouse
ggcacatgtgtggctgtcga

SEQ ID NO: 682309 - DNA, 20 bp, mouse
gtcagaggggatgtggatta

SEQ ID NO: 682310 - DNA, 20 bp, mouse
gaagaggtctgaattctgga

SEQ ID NO: 682311 - DNA, 20 bp, mouse
gagggtcaagggatatcatg

SEQ ID NO: 682312 - DNA, 20 bp, mouse
gtgtaggtgtgcatgaacca

SEQ ID NO: 682313 - DNA, 20 bp, mouse
gctagaacttgctgggtaag

SEQ ID NO: 682314 - DNA, 20 bp, mouse
gataccagtcatggagtttg

SEQ ID NO: 682315 - DNA, 20 bp, mouse
gttctaggcagaaagtgatc

SEQ ID NO: 682316 - DNA, 20 bp, mouse
gagcctgcacccagcgaggt

SEQ ID NO: 682317 - DNA, 20 bp, mouse
ggagacctgtcccacctcgc

SEQ ID NO: 682318 - DNA, 20 bp, mouse
ggactcctgtagtgtctgag

SEQ ID NO: 682319 - DNA, 20 bp, mouse
gagcactggatgccactgtg

SEQ ID NO: 682320 - DNA, 20 bp, mouse
gtgagccgtgctgagacagc

SEQ ID NO: 682321 - DNA, 20 bp, mouse
gtacgttcacagcctcctgg

SEQ ID NO: 682322 - DNA, 20 bp, mouse
gcagcacggctcacacagtg

SEQ ID NO: 682323 - DNA, 20 bp, mouse
gcagatgatagtgtgaatac

SEQ ID NO: 682324 - DNA, 20 bp, mouse
gtaccccacagcttagaggg

SEQ ID NO: 682325 - DNA, 20 bp, mouse
ggtgccaccctctaagctgt

SEQ ID NO: 682326 - DNA, 20 bp, mouse
gggctgaggcgagactgaaa

SEQ ID NO: 682327 - DNA, 20 bp, mouse
gataatgagcagtgtcagga

SEQ ID NO: 682328 - DNA, 20 bp, mouse
gtgattggatggtgaggttg

SEQ ID NO: 682329 - DNA, 20 bp, mouse
gataacgggaggtgattgga

SEQ ID NO: 682330 - DNA, 20 bp, mouse
gccagcctttcaataacggg

SEQ ID NO: 682331 - DNA, 20 bp, mouse
gatcacctcccgttattgaa

SEQ ID NO: 682332 - DNA, 20 bp, mouse
ggggcaggcacgtttcttct

SEQ ID NO: 682333 - DNA, 20 bp, mouse
gagaaataatgagcagtgtc

SEQ ID NO: 682334 - DNA, 20 bp, mouse
gccaaggacagtggtctcta

SEQ ID NO: 682335 - DNA, 20 bp, mouse
gcaggcatggctaaataacc

SEQ ID NO: 682336 - DNA, 20 bp, mouse
gtatctgagaggtgtgctgg

SEQ ID NO: 682337 - DNA, 20 bp, mouse
gtctgcaacttcaaaagctg

SEQ ID NO: 682338 - DNA, 20 bp, mouse
gtcaaagaggtggggttggc

SEQ ID NO: 682339 - DNA, 20 bp, mouse
gaggtcaccctaaggtttga

SEQ ID NO: 682340 - DNA, 20 bp, mouse
gtgagggtgcacgtagctgt

SEQ ID NO: 682341 - DNA, 20 bp, mouse
ggcagagcagggatagatca

SEQ ID NO: 682342 - DNA, 20 bp, mouse
gagggtgaccttgtacacat

SEQ ID NO: 682343 - DNA, 20 bp, mouse
gtagtcaaggtagttcactg

SEQ ID NO: 682344 - DNA, 20 bp, mouse
gcttgcagagcaatgggtag

SEQ ID NO: 682345 - DNA, 20 bp, mouse
ggaaaaagccaagaccacaa

SEQ ID NO: 682346 - DNA, 20 bp, mouse
gcctccagaccaggcacccg

SEQ ID NO: 682347 - DNA, 20 bp, mouse
gccaactaatgacctggcat

SEQ ID NO: 682348 - DNA, 20 bp, mouse
gcaggtcattagttggggtt

SEQ ID NO: 682349 - DNA, 20 bp, mouse
ggggccttggatccaggggt

SEQ ID NO: 682350 - DNA, 20 bp, mouse
gctgggcactggtccaacac

SEQ ID NO: 682351 - DNA, 20 bp, mouse
gtaacctcccagcccggact

SEQ ID NO: 682352 - DNA, 20 bp, mouse
gtgtatgtgggggctagtgt

SEQ ID NO: 682353 - DNA, 20 bp, mouse
gggttccctggctgcgtgcc

SEQ ID NO: 682354 - DNA, 20 bp, mouse
gtgacctctccaagacccag

SEQ ID NO: 682355 - DNA, 20 bp, mouse
gttctggggccttggatcca

SEQ ID NO: 682356 - DNA, 20 bp, mouse
ggccgtgcgttgcccggcag

SEQ ID NO: 682357 - DNA, 20 bp, mouse
gccggcccggcgcctgcctg

SEQ ID NO: 682358 - DNA, 20 bp, mouse
gagaggcgggtcctgtggga

SEQ ID NO: 682359 - DNA, 20 bp, mouse
gcggctgcgaggctcgggag

SEQ ID NO: 682360 - DNA, 20 bp, mouse
ggcaacgcacggccccgcgc

SEQ ID NO: 682361 - DNA, 20 bp, mouse
gcgggcgccctcctgagagg

SEQ ID NO: 682362 - DNA, 20 bp, mouse
gcgcacccccggggccctag

SEQ ID NO: 682363 - DNA, 20 bp, mouse
gtcccgggcgccctcctgag

SEQ ID NO: 682364 - DNA, 20 bp, mouse
ggggccggatccgcggactg

SEQ ID NO: 682365 - DNA, 20 bp, mouse
gtgcggggcggcgccgtccc

SEQ ID NO: 682366 - DNA, 20 bp, mouse
ggctgtgagtcacatgactc

SEQ ID NO: 682367 - DNA, 20 bp, mouse
ggaaaactgctcaccagatt

SEQ ID NO: 682368 - DNA, 20 bp, mouse
gagccagcacagaggtttta

SEQ ID NO: 682369 - DNA, 20 bp, mouse
gacacacacaccaacaggat

SEQ ID NO: 682370 - DNA, 20 bp, mouse
ggctgcagccttgcccaatc

SEQ ID NO: 682371 - DNA, 20 bp, mouse
gaaggtaccgtgaaatcctc

SEQ ID NO: 682372 - DNA, 20 bp, mouse
gtttaggggacaactccaag

SEQ ID NO: 682373 - DNA, 20 bp, mouse
gctgtgagcatggaggacgg

SEQ ID NO: 682374 - DNA, 20 bp, mouse
gctgctcaccagattgggca

SEQ ID NO: 682375 - DNA, 20 bp, mouse
gctcaagagacacggtcatc

SEQ ID NO: 682376 - DNA, 20 bp, mouse
gcgcctgcgtgctgaagaga

SEQ ID NO: 682377 - DNA, 20 bp, mouse
gaggaaggacggggacgatg

SEQ ID NO: 682378 - DNA, 20 bp, mouse
gtcccgcggggcagagagga

SEQ ID NO: 682379 - DNA, 20 bp, mouse
ggcaggcgagcggtgattgg

SEQ ID NO: 682380 - DNA, 20 bp, mouse
gaccgctcgcctgcctgagg

SEQ ID NO: 682381 - DNA, 20 bp, mouse
gtggcccgggcacgccatcc

SEQ ID NO: 682382 - DNA, 20 bp, mouse
gttaaaaataactggaacaa

SEQ ID NO: 682383 - DNA, 20 bp, mouse
gcaggcaggcgagcggtgat

SEQ ID NO: 682384 - DNA, 20 bp, mouse
gggccacggtgtgtgtgcgc

SEQ ID NO: 682385 - DNA, 20 bp, mouse
ggggcgtggagcgcgacgtc

SEQ ID NO: 682386 - DNA, 20 bp, mouse
gagggaaaatactgctgtag

SEQ ID NO: 682387 - DNA, 20 bp, mouse
gctgctgtagtgggggagaa

SEQ ID NO: 682388 - DNA, 20 bp, mouse
gatctgcggtcacttgtctc

SEQ ID NO: 682389 - DNA, 20 bp, mouse
gccgtatttcctttagataa

SEQ ID NO: 682390 - DNA, 20 bp, mouse
gtatgttcactttctagctc

SEQ ID NO: 682391 - DNA, 20 bp, mouse
gagttcagaaggcttttaag

SEQ ID NO: 682392 - DNA, 20 bp, mouse
ggctccaagtgtattacatc

SEQ ID NO: 682393 - DNA, 20 bp, mouse
ggcgaaaacgagcagtatcg

SEQ ID NO: 682394 - DNA, 20 bp, mouse
gctgggagaggtgatatgga

SEQ ID NO: 682395 - DNA, 20 bp, mouse
gcacagttctgagatgaacc

SEQ ID NO: 682396 - DNA, 20 bp, mouse
gtaaagatacatgactcacc

SEQ ID NO: 682397 - DNA, 20 bp, mouse
gatggcccttccttaagtag

SEQ ID NO: 682398 - DNA, 20 bp, mouse
gggtatgttgccagtgtggg

SEQ ID NO: 682399 - DNA, 20 bp, mouse
gtactttgagatttgcttct

SEQ ID NO: 682400 - DNA, 20 bp, mouse
gtactgatggtaagattacc

SEQ ID NO: 682401 - DNA, 20 bp, mouse
ggctgcctgaggacatcttt

SEQ ID NO: 682402 - DNA, 20 bp, mouse
gtagaaagtcctaaacaatc

SEQ ID NO: 682403 - DNA, 20 bp, mouse
ggctgtgagtggtactatca

SEQ ID NO: 682404 - DNA, 20 bp, mouse
gtttagtgccacctgaaaca

SEQ ID NO: 682405 - DNA, 20 bp, mouse
gtttccctctacttaaggaa

SEQ ID NO: 682406 - DNA, 20 bp, mouse
gtaaagatacatgactcacc

SEQ ID NO: 682407 - DNA, 20 bp, mouse
gatggcccttccttaagtag

SEQ ID NO: 682408 - DNA, 20 bp, mouse
gggtatgttgccagtgtggg

SEQ ID NO: 682409 - DNA, 20 bp, mouse
gtactttgagatttgcttct

SEQ ID NO: 682410 - DNA, 20 bp, mouse
gtactgatggtaagattacc

SEQ ID NO: 682411 - DNA, 20 bp, mouse
ggctgcctgaggacatcttt

SEQ ID NO: 682412 - DNA, 20 bp, mouse
gtagaaagtcctaaacaatc

SEQ ID NO: 682413 - DNA, 20 bp, mouse
ggctgtgagtggtactatca

SEQ ID NO: 682414 - DNA, 20 bp, mouse
gtttagtgccacctgaaaca

SEQ ID NO: 682415 - DNA, 20 bp, mouse
gtttccctctacttaaggaa

SEQ ID NO: 682416 - DNA, 20 bp, mouse
gtgtttaaaggcttcctgta

SEQ ID NO: 682417 - DNA, 20 bp, mouse
gcgagaacgtagggacaggt

SEQ ID NO: 682418 - DNA, 20 bp, mouse
gttacctagcaaccaggttg

SEQ ID NO: 682419 - DNA, 20 bp, mouse
ggagacaagcagtggccttg

SEQ ID NO: 682420 - DNA, 20 bp, mouse
gtcagttggatcagggtgga

SEQ ID NO: 682421 - DNA, 20 bp, mouse
gaatacgagaacgtagggac

SEQ ID NO: 682422 - DNA, 20 bp, mouse
gtttcaagagaattgtttaa

SEQ ID NO: 682423 - DNA, 20 bp, mouse
gatgtctaactgttccctac

SEQ ID NO: 682424 - DNA, 20 bp, mouse
gagtgaaatacgagaacgta

SEQ ID NO: 682425 - DNA, 20 bp, mouse
gtgcttgtctccactaattt

SEQ ID NO: 682426 - DNA, 20 bp, mouse
ggtgcagcctagcaggaaaa

SEQ ID NO: 682427 - DNA, 20 bp, mouse
ggaaaagggcctctagagag

SEQ ID NO: 682428 - DNA, 20 bp, mouse
gctgcacaatctgaaaaggt

SEQ ID NO: 682429 - DNA, 20 bp, mouse
gtaggctgcacaatctgaaa

SEQ ID NO: 682430 - DNA, 20 bp, mouse
gtcaaggtctggctgtttgg

SEQ ID NO: 682431 - DNA, 20 bp, mouse
gaagatagtgctctgcagaa

SEQ ID NO: 682432 - DNA, 20 bp, mouse
gtcagattgtgcagcctagc

SEQ ID NO: 682433 - DNA, 20 bp, mouse
gcagcagagtacctggaacc

SEQ ID NO: 682434 - DNA, 20 bp, mouse
gaaacaaaactcaagtgtat

SEQ ID NO: 682435 - DNA, 20 bp, mouse
gtagaggcccttttcctgct

SEQ ID NO: 682436 - DNA, 20 bp, mouse
gacccaggttacagctatga

SEQ ID NO: 682437 - DNA, 20 bp, mouse
gctactaagtggtgattcag

SEQ ID NO: 682438 - DNA, 20 bp, mouse
gtcccctcatagctgtaacc

SEQ ID NO: 682439 - DNA, 20 bp, mouse
gtggacccttccttgttagc

SEQ ID NO: 682440 - DNA, 20 bp, mouse
gtgaaagacaccaactccag

SEQ ID NO: 682441 - DNA, 20 bp, mouse
gtgctggaacttcctcgaga

SEQ ID NO: 682442 - DNA, 20 bp, mouse
gaagccttggcattaaacac

SEQ ID NO: 682443 - DNA, 20 bp, mouse
gacttcctcgagagggccag

SEQ ID NO: 682444 - DNA, 20 bp, mouse
gagggggcagctctactaag

SEQ ID NO: 682445 - DNA, 20 bp, mouse
gtagaaggtcccagccaccc

SEQ ID NO: 682446 - DNA, 20 bp, mouse
gacctgaggaaggaactccg

SEQ ID NO: 682447 - DNA, 20 bp, mouse
gcaacagtggccaagacctg

SEQ ID NO: 682448 - DNA, 20 bp, mouse
gtcctcggagttccttcctc

SEQ ID NO: 682449 - DNA, 20 bp, mouse
gagtggccaagacctgagga

SEQ ID NO: 682450 - DNA, 20 bp, mouse
gttgactctaattttagttg

SEQ ID NO: 682451 - DNA, 20 bp, mouse
ggaaggaactccgaggaagc

SEQ ID NO: 682452 - DNA, 20 bp, mouse
gctaaaattagagtcaacag

SEQ ID NO: 682453 - DNA, 20 bp, mouse
gttctctcacttttataagg

SEQ ID NO: 682454 - DNA, 20 bp, mouse
gacatatagtcactattacc

SEQ ID NO: 682455 - DNA, 20 bp, mouse
gaattttagttgtggcaagt

SEQ ID NO: 682456 - DNA, 20 bp, mouse
gggaacctggaatgccactc

SEQ ID NO: 682457 - DNA, 20 bp, mouse
gcaaacttggtatgggtagt

SEQ ID NO: 682458 - DNA, 20 bp, mouse
gcaaaccaggccacacaaga

SEQ ID NO: 682459 - DNA, 20 bp, mouse
ggggagtgaactatcctagg

SEQ ID NO: 682460 - DNA, 20 bp, mouse
gtgtccctggaggtcacttg

SEQ ID NO: 682461 - DNA, 20 bp, mouse
gctcaggccaaacttggtat

SEQ ID NO: 682462 - DNA, 20 bp, mouse
ggctctgtcctcagggaacc

SEQ ID NO: 682463 - DNA, 20 bp, mouse
gcctggttctcaagctcttg

SEQ ID NO: 682464 - DNA, 20 bp, mouse
gtgggtagtgggggctcatg

SEQ ID NO: 682465 - DNA, 20 bp, mouse
gggtcaggtccaagagacaa

SEQ ID NO: 682466 - DNA, 20 bp, mouse
gctcaggagaggcgaccacc

SEQ ID NO: 682467 - DNA, 20 bp, mouse
gaggtgcttgggagcggccc

SEQ ID NO: 682468 - DNA, 20 bp, mouse
gaggctgtgctttgcacccc

SEQ ID NO: 682469 - DNA, 20 bp, mouse
gtgcttttattcattttcta

SEQ ID NO: 682470 - DNA, 20 bp, mouse
ggctacaggcacccgtggca

SEQ ID NO: 682471 - DNA, 20 bp, mouse
gtgtctggctgggctgtctg

SEQ ID NO: 682472 - DNA, 20 bp, mouse
ggcagctgagatgtctggct

SEQ ID NO: 682473 - DNA, 20 bp, mouse
ggctgccagaataggtgctt

SEQ ID NO: 682474 - DNA, 20 bp, mouse
gttctggcagctgagatgtc

SEQ ID NO: 682475 - DNA, 20 bp, mouse
gcgctcccaagcacctattc

SEQ ID NO: 682476 - DNA, 20 bp, mouse
ggcaatgacccagtctttaa

SEQ ID NO: 682477 - DNA, 20 bp, mouse
ggctcctttgcagagatctt

SEQ ID NO: 682478 - DNA, 20 bp, mouse
gatcgtgcgcatggctgcgg

SEQ ID NO: 682479 - DNA, 20 bp, mouse
gagttctgacccttaaagac

SEQ ID NO: 682480 - DNA, 20 bp, mouse
gtaatgcaggaagcccttaa

SEQ ID NO: 682481 - DNA, 20 bp, mouse
gtgcggccggagtgtcgcag

SEQ ID NO: 682482 - DNA, 20 bp, mouse
ggaacactgtataatttctc

SEQ ID NO: 682483 - DNA, 20 bp, mouse
gctccggttgccccgcagag

SEQ ID NO: 682484 - DNA, 20 bp, mouse
gtaagccaggaccaactatt

SEQ ID NO: 682485 - DNA, 20 bp, mouse
gtgggtcattgccatggtca

SEQ ID NO: 682486 - DNA, 20 bp, mouse
gcagtgagagtggccctggt

SEQ ID NO: 682487 - DNA, 20 bp, mouse
gcaagagaggacaggatatt

SEQ ID NO: 682488 - DNA, 20 bp, mouse
gtcagcagtgagagtggccc

SEQ ID NO: 682489 - DNA, 20 bp, mouse
gtgcctgtgctgtgctatgg

SEQ ID NO: 682490 - DNA, 20 bp, mouse
gactctcactgctgactagg

SEQ ID NO: 682491 - DNA, 20 bp, mouse
gcagcaaaggggaccccttg

SEQ ID NO: 682492 - DNA, 20 bp, mouse
gaggcactgtgtcctcacct

SEQ ID NO: 682493 - DNA, 20 bp, mouse
gggcagctgaagagacggga

SEQ ID NO: 682494 - DNA, 20 bp, mouse
ggagagtggccctggtgggt

SEQ ID NO: 682495 - DNA, 20 bp, mouse
gaggacaggatattgggggt

SEQ ID NO: 682496 - DNA, 20 bp, mouse
gactgtgttgtcactgggat

SEQ ID NO: 682497 - DNA, 20 bp, mouse
gcagcccgagaggaggtgca

SEQ ID NO: 682498 - DNA, 20 bp, mouse
gaggaatgctcgctgggcac

SEQ ID NO: 682499 - DNA, 20 bp, mouse
gagacaagaggaatcgggga

SEQ ID NO: 682500 - DNA, 20 bp, mouse
gcgagaggaggtgcaaggcc

SEQ ID NO: 682501 - DNA, 20 bp, mouse
gtcgcctggggcttccaaat

SEQ ID NO: 682502 - DNA, 20 bp, mouse
ggggaagacaagaggaatcg

SEQ ID NO: 682503 - DNA, 20 bp, mouse
gggaaggcagcgagagaaac

SEQ ID NO: 682504 - DNA, 20 bp, mouse
gggtcagggtcccgcctcaa

SEQ ID NO: 682505 - DNA, 20 bp, mouse
gtctcgggctgcagaagtgg

SEQ ID NO: 682506 - DNA, 20 bp, mouse
gtaagtgcgccgctctgtgt

SEQ ID NO: 682507 - DNA, 20 bp, mouse
gcggaagtcgaagacgtcat

SEQ ID NO: 682508 - DNA, 20 bp, mouse
gggcctcacccgacacagag

SEQ ID NO: 682509 - DNA, 20 bp, mouse
ggaaccgctgtctaaaaagt

SEQ ID NO: 682510 - DNA, 20 bp, mouse
ggtggtcccacccctgaaaa

SEQ ID NO: 682511 - DNA, 20 bp, mouse
gcgctgtctaaaaagttgga

SEQ ID NO: 682512 - DNA, 20 bp, mouse
gtccgggttgcggtagaaca

SEQ ID NO: 682513 - DNA, 20 bp, mouse
gtgactgcttgtgcttggag

SEQ ID NO: 682514 - DNA, 20 bp, mouse
gttgcggtagaacatggcgc

SEQ ID NO: 682515 - DNA, 20 bp, mouse
gttctaccgcaacccggaag

SEQ ID NO: 682516 - DNA, 20 bp, mouse
gtctaggggcgccaaggctc

SEQ ID NO: 682517 - DNA, 20 bp, mouse
ggagctggggacgctctggg

SEQ ID NO: 682518 - DNA, 20 bp, mouse
ggcgcggtgcggagttccta

SEQ ID NO: 682519 - DNA, 20 bp, mouse
gcgtccccagtccaggaggg

SEQ ID NO: 682520 - DNA, 20 bp, mouse
gatcgcccgccctcctggac

SEQ ID NO: 682521 - DNA, 20 bp, mouse
gtgctcgtccccagtccagg

SEQ ID NO: 682522 - DNA, 20 bp, mouse
ggcagcggcaaggactgcgg

SEQ ID NO: 682523 - DNA, 20 bp, mouse
gctagggtcggctgggtgga

SEQ ID NO: 682524 - DNA, 20 bp, mouse
gggcgccaaggctcgggctg

SEQ ID NO: 682525 - DNA, 20 bp, mouse
gtggggacgagcagagtggc

SEQ ID NO: 682526 - DNA, 20 bp, mouse
gacgcccaacaaggggtctg

SEQ ID NO: 682527 - DNA, 20 bp, mouse
gaggaggggtccggaatcta

SEQ ID NO: 682528 - DNA, 20 bp, mouse
gcaaggggtctggggaatct

SEQ ID NO: 682529 - DNA, 20 bp, mouse
gcggacccctcctctggaga

SEQ ID NO: 682530 - DNA, 20 bp, mouse
ggaccccctctcccactaat

SEQ ID NO: 682531 - DNA, 20 bp, mouse
gggacatgctgcaaacattg

SEQ ID NO: 682532 - DNA, 20 bp, mouse
gatgtcccctgcctggaatt

SEQ ID NO: 682533 - DNA, 20 bp, mouse
gagactggttagaataccgt

SEQ ID NO: 682534 - DNA, 20 bp, mouse
gattccccagaccccttgtt

SEQ ID NO: 682535 - DNA, 20 bp, mouse
ggtgaaaaacgcccaacaag

SEQ ID NO: 682536 - DNA, 20 bp, mouse
ggatagaaggggatggaacg

SEQ ID NO: 682537 - DNA, 20 bp, mouse
gggggcgggcccaacagcgg

SEQ ID NO: 682538 - DNA, 20 bp, mouse
ggtgtgctccgcagatagaa

SEQ ID NO: 682539 - DNA, 20 bp, mouse
gcccccagagtcaagcttct

SEQ ID NO: 682540 - DNA, 20 bp, mouse
gggcccgcccccgcagctgt

SEQ ID NO: 682541 - DNA, 20 bp, mouse
gttccatccccttctatctg

SEQ ID NO: 682542 - DNA, 20 bp, mouse
gagaaggggatggaacgcgg

SEQ ID NO: 682543 - DNA, 20 bp, mouse
gacacgcgctcgggagcaag

SEQ ID NO: 682544 - DNA, 20 bp, mouse
ggggcccgccccccgctgtt

SEQ ID NO: 682545 - DNA, 20 bp, mouse
gtcgggagcaagcggcgcgc

SEQ ID NO: 682546 - DNA, 20 bp, mouse
gtggctcagtagctgaaaag

SEQ ID NO: 682547 - DNA, 20 bp, mouse
ggacaaggagaagtactcaa

SEQ ID NO: 682548 - DNA, 20 bp, mouse
ggctccgcccatcgctgtgt

SEQ ID NO: 682549 - DNA, 20 bp, mouse
gtgaggacgaagtttagggg

SEQ ID NO: 682550 - DNA, 20 bp, mouse
gaaaactccactgataacgg

SEQ ID NO: 682551 - DNA, 20 bp, mouse
gaagggtctgggaagaaata

SEQ ID NO: 682552 - DNA, 20 bp, mouse
gcaactccgcaaaatcccat

SEQ ID NO: 682553 - DNA, 20 bp, mouse
gcatcggggacacagacgca

SEQ ID NO: 682554 - DNA, 20 bp, mouse
gaaccggcctccgttatcag

SEQ ID NO: 682555 - DNA, 20 bp, mouse
gtcctcacctacacagcgat

SEQ ID NO: 682556 - DNA, 20 bp, mouse
ggggctacgctctcctgcca

SEQ ID NO: 682557 - DNA, 20 bp, mouse
ggagcccccccccagaaaag

SEQ ID NO: 682558 - DNA, 20 bp, mouse
gtagatgtacccaggactaa

SEQ ID NO: 682559 - DNA, 20 bp, mouse
gagggcataccccttttctg

SEQ ID NO: 682560 - DNA, 20 bp, mouse
ggccgcagccaaaaggaagt

SEQ ID NO: 682561 - DNA, 20 bp, mouse
gctctcctgccaaggctgag

SEQ ID NO: 682562 - DNA, 20 bp, mouse
gcgaccaggctgtgacatgg

SEQ ID NO: 682563 - DNA, 20 bp, mouse
gtcgccgctatcgaccgacc

SEQ ID NO: 682564 - DNA, 20 bp, mouse
gagctgggaccccttagtcc

SEQ ID NO: 682565 - DNA, 20 bp, mouse
gcagcctggtcggtcgatag

SEQ ID NO: 682566 - DNA, 20 bp, mouse
gcgctggccccagagacgga

SEQ ID NO: 682567 - DNA, 20 bp, mouse
gggcgggcaaaggacgcact

SEQ ID NO: 682568 - DNA, 20 bp, mouse
gcggggctcaggtcgctcgg

SEQ ID NO: 682569 - DNA, 20 bp, mouse
gcagcccggcccccggatgt

SEQ ID NO: 682570 - DNA, 20 bp, mouse
ggagccggatcggcgggcaa

SEQ ID NO: 682571 - DNA, 20 bp, mouse
ggaacgcgcgggagccggat

SEQ ID NO: 682572 - DNA, 20 bp, mouse
gcgtccgctggccccagaga

SEQ ID NO: 682573 - DNA, 20 bp, mouse
ggctggctccgtgaatccta

SEQ ID NO: 682574 - DNA, 20 bp, mouse
ggggtcgctgaggtcgttct

SEQ ID NO: 682575 - DNA, 20 bp, mouse
gcccggcccccggatgtggg

SEQ ID NO: 682576 - DNA, 20 bp, mouse
ggaacagtgaataaatagtg

SEQ ID NO: 682577 - DNA, 20 bp, mouse
gactgttcattgtggaagat

SEQ ID NO: 682578 - DNA, 20 bp, mouse
gatttattcactgttcattg

SEQ ID NO: 682579 - DNA, 20 bp, mouse
ggatgcagagacactaagga

SEQ ID NO: 682580 - DNA, 20 bp, mouse
gcagctgtgaggaccctcga

SEQ ID NO: 682581 - DNA, 20 bp, mouse
ggaccctcgagggcaagagg

SEQ ID NO: 682582 - DNA, 20 bp, mouse
gaggctgaggccagtgagaa

SEQ ID NO: 682583 - DNA, 20 bp, mouse
gaggggaagagggtcttccc

SEQ ID NO: 682584 - DNA, 20 bp, mouse
gctggccctgggctcatcac

SEQ ID NO: 682585 - DNA, 20 bp, mouse
gtcgggatgcagagacacta

SEQ ID NO: 682586 - DNA, 20 bp, mouse
ggggagggggcgggtctggg

SEQ ID NO: 682587 - DNA, 20 bp, mouse
gtcaaagcgtccatgcgcag

SEQ ID NO: 682588 - DNA, 20 bp, mouse
gcggctctgtctgtaggact

SEQ ID NO: 682589 - DNA, 20 bp, mouse
ggggtaggctgcaggaccaa

SEQ ID NO: 682590 - DNA, 20 bp, mouse
ggggagggggctggcacaga

SEQ ID NO: 682591 - DNA, 20 bp, mouse
gcctaggggcataatgtttg

SEQ ID NO: 682592 - DNA, 20 bp, mouse
gcaccctcgtctcctctgat

SEQ ID NO: 682593 - DNA, 20 bp, mouse
ggatcagaggtcaagtcaaa

SEQ ID NO: 682594 - DNA, 20 bp, mouse
gtgtcctatcagaggagacg

SEQ ID NO: 682595 - DNA, 20 bp, mouse
ggttctgctaaactggaggg

SEQ ID NO: 682596 - DNA, 20 bp, mouse
gtggtcctgctgtgtaccgg

SEQ ID NO: 682597 - DNA, 20 bp, mouse
ggatccgatggcagcaactt

SEQ ID NO: 682598 - DNA, 20 bp, mouse
gaagaggcagcccccaagaa

SEQ ID NO: 682599 - DNA, 20 bp, mouse
gttggagctagggatattta

SEQ ID NO: 682600 - DNA, 20 bp, mouse
gcccgccccgctctgacgtc

SEQ ID NO: 682601 - DNA, 20 bp, mouse
gcccctaggtgctgatccga

SEQ ID NO: 682602 - DNA, 20 bp, mouse
gacagccaccggtacacagc

SEQ ID NO: 682603 - DNA, 20 bp, mouse
gtcctctgctagttggccag

SEQ ID NO: 682604 - DNA, 20 bp, mouse
ggtcaggcgtcttggagcta

SEQ ID NO: 682605 - DNA, 20 bp, mouse
ggactctggctttttcccct

SEQ ID NO: 682606 - DNA, 20 bp, mouse
gagagggagccggcgaggaa

SEQ ID NO: 682607 - DNA, 20 bp, mouse
gtcgccgcggcgccgacgaa

SEQ ID NO: 682608 - DNA, 20 bp, mouse
ggtcccaagcccttcctcgc

SEQ ID NO: 682609 - DNA, 20 bp, mouse
gagagcgccctggcgggaga

SEQ ID NO: 682610 - DNA, 20 bp, mouse
gaagggcttgggacgctcag

SEQ ID NO: 682611 - DNA, 20 bp, mouse
gccggctccctctcccgcca

SEQ ID NO: 682612 - DNA, 20 bp, mouse
gacgctcagtggcaggtgag

SEQ ID NO: 682613 - DNA, 20 bp, mouse
ggggcgcgcgtcagagcagg

SEQ ID NO: 682614 - DNA, 20 bp, mouse
gagggcgctctgttcgccgc

SEQ ID NO: 682615 - DNA, 20 bp, mouse
ggagctgggtccatcctccc

SEQ ID NO: 682616 - DNA, 20 bp, mouse
ggtgaatcagcatagttcag

SEQ ID NO: 682617 - DNA, 20 bp, mouse
gcaccttgcttggccatcct

SEQ ID NO: 682618 - DNA, 20 bp, mouse
gtagcagaattgaaagaaca

SEQ ID NO: 682619 - DNA, 20 bp, mouse
gtcacccactattggagagt

SEQ ID NO: 682620 - DNA, 20 bp, mouse
ggtgctgggcatccttgtag

SEQ ID NO: 682621 - DNA, 20 bp, mouse
gaattctgctacatagtatt

SEQ ID NO: 682622 - DNA, 20 bp, mouse
gcagagacctggaaggacaa

SEQ ID NO: 682623 - DNA, 20 bp, mouse
gtggccagttcacccactat

SEQ ID NO: 682624 - DNA, 20 bp, mouse
gattggagagtgggttgtat

SEQ ID NO: 682625 - DNA, 20 bp, mouse
gtctccaatagtgggtgaac

SEQ ID NO: 682626 - DNA, 20 bp, mouse
gccggtctgcaagaacttaa

SEQ ID NO: 682627 - DNA, 20 bp, mouse
gctcgtgtagagactataaa

SEQ ID NO: 682628 - DNA, 20 bp, mouse
gagccgatgtctgacgtctg

SEQ ID NO: 682629 - DNA, 20 bp, mouse
gctaatctgatcatgactca

SEQ ID NO: 682630 - DNA, 20 bp, mouse
ggtagagactataaatggga

SEQ ID NO: 682631 - DNA, 20 bp, mouse
gtacccactgggaccaatca

SEQ ID NO: 682632 - DNA, 20 bp, mouse
gagtctctgttagaagccta

SEQ ID NO: 682633 - DNA, 20 bp, mouse
gcaccgcagacgtcagacat

SEQ ID NO: 682634 - DNA, 20 bp, mouse
gcactctaatcctacccact

SEQ ID NO: 682635 - DNA, 20 bp, mouse
ggagcgaagcaggcaatgct

SEQ ID NO: 682636 - DNA, 20 bp, mouse
gagcgcgagaccgaggaaag

SEQ ID NO: 682637 - DNA, 20 bp, mouse
ggggagggtacggaggaaaa

SEQ ID NO: 682638 - DNA, 20 bp, mouse
gctagtgagtgaggttttcg

SEQ ID NO: 682639 - DNA, 20 bp, mouse
gtgtgctccgagttcctggt

SEQ ID NO: 682640 - DNA, 20 bp, mouse
ggaggtggcaggggatgtaa

SEQ ID NO: 682641 - DNA, 20 bp, mouse
gttgggccccggcttttcta

SEQ ID NO: 682642 - DNA, 20 bp, mouse
ggggatcgcgggctgctctt

SEQ ID NO: 682643 - DNA, 20 bp, mouse
gagctgaaagtgcaggctgc

SEQ ID NO: 682644 - DNA, 20 bp, mouse
ggggtagaaaacgggagtgg

SEQ ID NO: 682645 - DNA, 20 bp, mouse
gaagagtggtgctcagagag

SEQ ID NO: 682646 - DNA, 20 bp, mouse
gaatggctgccgccagctag

SEQ ID NO: 682647 - DNA, 20 bp, mouse
gtgggactttcggtgaatgg

SEQ ID NO: 682648 - DNA, 20 bp, mouse
ggtcccacacggcttcaggt

SEQ ID NO: 682649 - DNA, 20 bp, mouse
gagcgcccgagcccgcagaa

SEQ ID NO: 682650 - DNA, 20 bp, mouse
gctgcgggctcgggcgctga

SEQ ID NO: 682651 - DNA, 20 bp, mouse
ggcagccattctgcgggctc

SEQ ID NO: 682652 - DNA, 20 bp, mouse
gcctaagtggaggattagaa

SEQ ID NO: 682653 - DNA, 20 bp, mouse
gtgcctacctgaagccgtgt

SEQ ID NO: 682654 - DNA, 20 bp, mouse
ggcgctgccagtctcgggag

SEQ ID NO: 682655 - DNA, 20 bp, mouse
ggaaagtcccacacggcttc

SEQ ID NO: 682656 - DNA, 20 bp, mouse
ggtgccgcaggaccgaaaaa

SEQ ID NO: 682657 - DNA, 20 bp, mouse
gggcggccccggcgcctgac

SEQ ID NO: 682658 - DNA, 20 bp, mouse
gagccccgagggccggtccg

SEQ ID NO: 682659 - DNA, 20 bp, mouse
ggcggcgatcagctcctgtc

SEQ ID NO: 682660 - DNA, 20 bp, mouse
ggcgagcaggcggggtgtcg

SEQ ID NO: 682661 - DNA, 20 bp, mouse
gttgttacagccagccccga

SEQ ID NO: 682662 - DNA, 20 bp, mouse
gcgcccgcggaccggccctc

SEQ ID NO: 682663 - DNA, 20 bp, mouse
gcggtcccctcggcgccgat

SEQ ID NO: 682664 - DNA, 20 bp, mouse
gagcgtggacacgtgaggaa

SEQ ID NO: 682665 - DNA, 20 bp, mouse
ggagatggagccgagccaat

SEQ ID NO: 682666 - DNA, 20 bp, mouse
ggggcgcaggggttgggcga

SEQ ID NO: 682667 - DNA, 20 bp, mouse
gagggcgcggccggtcgacg

SEQ ID NO: 682668 - DNA, 20 bp, mouse
ggcgacgcccgaggtcacag

SEQ ID NO: 682669 - DNA, 20 bp, mouse
ggggcggccgctgtgacctc

SEQ ID NO: 682670 - DNA, 20 bp, mouse
gtccacaggaggccgctggg

SEQ ID NO: 682671 - DNA, 20 bp, mouse
gcatgctcagagccccccag

SEQ ID NO: 682672 - DNA, 20 bp, mouse
ggggggcgactgagagtgtg

SEQ ID NO: 682673 - DNA, 20 bp, mouse
ggtagcttgcagtgattcct

SEQ ID NO: 682674 - DNA, 20 bp, mouse
gcgcggccggtcgacggggc

SEQ ID NO: 682675 - DNA, 20 bp, mouse
gccggtcgacggggcgggca

SEQ ID NO: 682676 - DNA, 20 bp, mouse
gcggagccctgcgtcacgga

SEQ ID NO: 682677 - DNA, 20 bp, mouse
gtacccccgtaggtagtcct

SEQ ID NO: 682678 - DNA, 20 bp, mouse
gtggtcatgtagatgaggcg

SEQ ID NO: 682679 - DNA, 20 bp, mouse
gcatgcccaggactacctac

SEQ ID NO: 682680 - DNA, 20 bp, mouse
gggcgcctatgcagatgaga

SEQ ID NO: 682681 - DNA, 20 bp, mouse
gggggcggagccctgcgtca

SEQ ID NO: 682682 - DNA, 20 bp, mouse
gagccagcgctcgcccgcaa

SEQ ID NO: 682683 - DNA, 20 bp, mouse
ggggcgtggtcatgtagatg

SEQ ID NO: 682684 - DNA, 20 bp, mouse
gccaggatcgccgcacaaag

SEQ ID NO: 682685 - DNA, 20 bp, mouse
ggcgagtctgatacccccgt

SEQ ID NO: 682686 - DNA, 20 bp, mouse
gggggagataggccctgcgc

SEQ ID NO: 682687 - DNA, 20 bp, mouse
gcaaacgcagggcggaaata

SEQ ID NO: 682688 - DNA, 20 bp, mouse
gaaggggagaggtttaacag

SEQ ID NO: 682689 - DNA, 20 bp, mouse
gctatagtacacgtctccag

SEQ ID NO: 682690 - DNA, 20 bp, mouse
gaaagagagccggaactctc

SEQ ID NO: 682691 - DNA, 20 bp, mouse
gtcgtcgccagagcaacaga

SEQ ID NO: 682692 - DNA, 20 bp, mouse
gccggcgggccaattggctc

SEQ ID NO: 682693 - DNA, 20 bp, mouse
gtagccacgcccacaccggc

SEQ ID NO: 682694 - DNA, 20 bp, mouse
gccaattggcccgccggtgt

SEQ ID NO: 682695 - DNA, 20 bp, mouse
gagagggcgtcaacaaacgc

SEQ ID NO: 682696 - DNA, 20 bp, mouse
gctcccgccctcattaacga

SEQ ID NO: 682697 - DNA, 20 bp, mouse
gtggcctccagtttcaccca

SEQ ID NO: 682698 - DNA, 20 bp, mouse
gcacgcgggctgcctcacct

SEQ ID NO: 682699 - DNA, 20 bp, mouse
gcggggatcatagccccagg

SEQ ID NO: 682700 - DNA, 20 bp, mouse
gaacgccccctcttgcacgc

SEQ ID NO: 682701 - DNA, 20 bp, mouse
ggtcccctgggtgaaactgg

SEQ ID NO: 682702 - DNA, 20 bp, mouse
gctgggccctgacattctag

SEQ ID NO: 682703 - DNA, 20 bp, mouse
gtcccagaccccacttccaa

SEQ ID NO: 682704 - DNA, 20 bp, mouse
gactttagtccattggaagt

SEQ ID NO: 682705 - DNA, 20 bp, mouse
gtttgtgagactcctttaga

SEQ ID NO: 682706 - DNA, 20 bp, mouse
ggggcagagaggtgcgggac

SEQ ID NO: 682707 - DNA, 20 bp, mouse
ggctgcggggctagcgacgc

SEQ ID NO: 682708 - DNA, 20 bp, mouse
gacggggcggggcctgtgcg

SEQ ID NO: 682709 - DNA, 20 bp, mouse
gcccacttggtcgacttcgg

SEQ ID NO: 682710 - DNA, 20 bp, mouse
ggaagcgggccgcgcgctga

SEQ ID NO: 682711 - DNA, 20 bp, mouse
gagtcggcgccgctccgagt

SEQ ID NO: 682712 - DNA, 20 bp, mouse
gagtgccgcagccaatccca

SEQ ID NO: 682713 - DNA, 20 bp, mouse
ggccgctccgagtcggccgt

SEQ ID NO: 682714 - DNA, 20 bp, mouse
gtcccacggccgactcggag

SEQ ID NO: 682715 - DNA, 20 bp, mouse
ggggcggggcctctacgtcg

SEQ ID NO: 682716 - DNA, 20 bp, mouse
gcgccccctagcgccaggga

SEQ ID NO: 682717 - DNA, 20 bp, mouse
gtctcccctccctggcgcta

SEQ ID NO: 682718 - DNA, 20 bp, mouse
gacgaaaggggttggaccgt

SEQ ID NO: 682719 - DNA, 20 bp, mouse
ggttccgtgggcagacgaaa

SEQ ID NO: 682720 - DNA, 20 bp, mouse
gcccccacgcgcggggatcc

SEQ ID NO: 682721 - DNA, 20 bp, mouse
ggcgcgcaggcccgaggtgg

SEQ ID NO: 682722 - DNA, 20 bp, mouse
gccgccgccagcggtgacca

SEQ ID NO: 682723 - DNA, 20 bp, mouse
ggccctggatccccgcgcgt

SEQ ID NO: 682724 - DNA, 20 bp, mouse
gtcgccatggtcaccgctgg

SEQ ID NO: 682725 - DNA, 20 bp, mouse
gcccaccgcccccacgcgcg

SEQ ID NO: 682726 - DNA, 20 bp, mouse
gaatagtgaagctaggacgt

SEQ ID NO: 682727 - DNA, 20 bp, mouse
ggacacgcgcggagtcagaa

SEQ ID NO: 682728 - DNA, 20 bp, mouse
gcatgcgcgggtctttacgt

SEQ ID NO: 682729 - DNA, 20 bp, mouse
ggacttcatacgccaccgac

SEQ ID NO: 682730 - DNA, 20 bp, mouse
gtgcgcctccggcccgagtc

SEQ ID NO: 682731 - DNA, 20 bp, mouse
gcagctgacttccgggtcag

SEQ ID NO: 682732 - DNA, 20 bp, mouse
ggaagctaggacgtaggtct

SEQ ID NO: 682733 - DNA, 20 bp, mouse
gcaaagtgcgcgtctcttgt

SEQ ID NO: 682734 - DNA, 20 bp, mouse
gactccgcgcgtgtctggag

SEQ ID NO: 682735 - DNA, 20 bp, mouse
ggctgttaagtgccggtcgg

SEQ ID NO: 682736 - DNA, 20 bp, mouse
gctagtgtggccagccagaa

SEQ ID NO: 682737 - DNA, 20 bp, mouse
gtggccagccagaaaggtaa

SEQ ID NO: 682738 - DNA, 20 bp, mouse
gtaagtgggggtgtgaactt

SEQ ID NO: 682739 - DNA, 20 bp, mouse
gtcgtgggctaggaatggag

SEQ ID NO: 682740 - DNA, 20 bp, mouse
gagtccaaactctagttcgt

SEQ ID NO: 682741 - DNA, 20 bp, mouse
gactgccttctggctaagtg

SEQ ID NO: 682742 - DNA, 20 bp, mouse
gctagttcgtgggctaggaa

SEQ ID NO: 682743 - DNA, 20 bp, mouse
gacacccccacttagccaga

SEQ ID NO: 682744 - DNA, 20 bp, mouse
gtggcactcgacttgactct

SEQ ID NO: 682745 - DNA, 20 bp, mouse
ggggaaactggttgactaag

SEQ ID NO: 682746 - DNA, 20 bp, mouse
ggaggcagcagccacggagt

SEQ ID NO: 682747 - DNA, 20 bp, mouse
gctggcctgcaacgtgtctc

SEQ ID NO: 682748 - DNA, 20 bp, mouse
ggccaggcgcagaggatcac

SEQ ID NO: 682749 - DNA, 20 bp, mouse
gcctcacgcagccaactccg

SEQ ID NO: 682750 - DNA, 20 bp, mouse
gctgcaacgtgtctcagggg

SEQ ID NO: 682751 - DNA, 20 bp, mouse
gcaacgtgtctcaggggcgg

SEQ ID NO: 682752 - DNA, 20 bp, mouse
gtagagcgacgatagagaga

SEQ ID NO: 682753 - DNA, 20 bp, mouse
ggcggcgggagcaaaaactt

SEQ ID NO: 682754 - DNA, 20 bp, mouse
ggtcgctctaggcgccccac

SEQ ID NO: 682755 - DNA, 20 bp, mouse
ggagttggctgcgtgagggt

SEQ ID NO: 682756 - DNA, 20 bp, mouse
ggagggagagctggaggcgt

SEQ ID NO: 682757 - DNA, 20 bp, mouse
gacaggaaaggccatcggga

SEQ ID NO: 682758 - DNA, 20 bp, mouse
gggacctcccggaagctcta

SEQ ID NO: 682759 - DNA, 20 bp, mouse
gggtagaatgtaagctcact

SEQ ID NO: 682760 - DNA, 20 bp, mouse
gctccagctctccctcccga

SEQ ID NO: 682761 - DNA, 20 bp, mouse
gccctcaaatttggaggtta

SEQ ID NO: 682762 - DNA, 20 bp, mouse
gttggcatgctcgatcgctc

SEQ ID NO: 682763 - DNA, 20 bp, mouse
ggcacgagacgaaatgtcaa

SEQ ID NO: 682764 - DNA, 20 bp, mouse
gtatccgtagagcttccggg

SEQ ID NO: 682765 - DNA, 20 bp, mouse
ggggctcatgaatacaggaa

SEQ ID NO: 682766 - DNA, 20 bp, mouse
ggcggggtcagcaggttctc

SEQ ID NO: 682767 - DNA, 20 bp, mouse
ggaacctgctgaccccgcga

SEQ ID NO: 682768 - DNA, 20 bp, mouse
gcgggggcgcacggtagctg

SEQ ID NO: 682769 - DNA, 20 bp, mouse
ggaactgcttggccacatag

SEQ ID NO: 682770 - DNA, 20 bp, mouse
ggcggagtggctatctcctg

SEQ ID NO: 682771 - DNA, 20 bp, mouse
gtgcgcggcggaaacaccgg

SEQ ID NO: 682772 - DNA, 20 bp, mouse
gccaactcgcgcagctgctc

SEQ ID NO: 682773 - DNA, 20 bp, mouse
gggtctggcgagtggggccc

SEQ ID NO: 682774 - DNA, 20 bp, mouse
gtatctcctgcggctctctg

SEQ ID NO: 682775 - DNA, 20 bp, mouse
gcgcgcagctgctctggggt

SEQ ID NO: 682776 - DNA, 20 bp, mouse
gatcccaagcccctgtggac

SEQ ID NO: 682777 - DNA, 20 bp, mouse
gggcctgtccacaggggctt

SEQ ID NO: 682778 - DNA, 20 bp, mouse
gaagtcttcggcaatggagg

SEQ ID NO: 682779 - DNA, 20 bp, mouse
gctctgctggggtgcagcaa

SEQ ID NO: 682780 - DNA, 20 bp, mouse
gcagcaaggggcgggtgttg

SEQ ID NO: 682781 - DNA, 20 bp, mouse
gtgggccaaaggcacaggac

SEQ ID NO: 682782 - DNA, 20 bp, mouse
gcaggctgctcactagagcg

SEQ ID NO: 682783 - DNA, 20 bp, mouse
gaaggaaggagcaggatccc

SEQ ID NO: 682784 - DNA, 20 bp, mouse
gccagactgagtcctacttc

SEQ ID NO: 682785 - DNA, 20 bp, mouse
gactgtgttcctccagaagt

SEQ ID NO: 682786 - DNA, 20 bp, mouse
ggcggccctgcgaccagcga

SEQ ID NO: 682787 - DNA, 20 bp, mouse
ggaggcggctcacagagttc

SEQ ID NO: 682788 - DNA, 20 bp, mouse
gagggcgcgtgtgtacgtga

SEQ ID NO: 682789 - DNA, 20 bp, mouse
gcgcgtgtgtacgtgaaggg

SEQ ID NO: 682790 - DNA, 20 bp, mouse
gcggctcacagagttcgggt

SEQ ID NO: 682791 - DNA, 20 bp, mouse
ggcgcatgctccacaaggac

SEQ ID NO: 682792 - DNA, 20 bp, mouse
gcatgctccacaaggacggg

SEQ ID NO: 682793 - DNA, 20 bp, mouse
gccaaggctattgtatggga

SEQ ID NO: 682794 - DNA, 20 bp, mouse
gcagcgaggggctggacccg

SEQ ID NO: 682795 - DNA, 20 bp, mouse
gctcgccccgcccgtccttg

SEQ ID NO: 682796 - DNA, 20 bp, mouse
ggtgggaggcgcacgttcga

SEQ ID NO: 682797 - DNA, 20 bp, mouse
ggggcacgcccgcgcagacg

SEQ ID NO: 682798 - DNA, 20 bp, mouse
gccaaggaaggtacgcgtga

SEQ ID NO: 682799 - DNA, 20 bp, mouse
gtggccagcctcgtctgcgc

SEQ ID NO: 682800 - DNA, 20 bp, mouse
gcgcccgcacgcttccgagt

SEQ ID NO: 682801 - DNA, 20 bp, mouse
gacgggccaccgcgacgccg

SEQ ID NO: 682802 - DNA, 20 bp, mouse
gcgaggctggccacggtgac

SEQ ID NO: 682803 - DNA, 20 bp, mouse
gagagcgagcgaaggtacct

SEQ ID NO: 682804 - DNA, 20 bp, mouse
gtacctaggcgcggacctcc

SEQ ID NO: 682805 - DNA, 20 bp, mouse
gacgcccgcgcagacgaggc

SEQ ID NO: 682806 - DNA, 20 bp, mouse
ggtggggcgcgcgctcggtg

SEQ ID NO: 682807 - DNA, 20 bp, mouse
ggggcgccgagtcacaggtg

SEQ ID NO: 682808 - DNA, 20 bp, mouse
gcagccgggcgccgagtcac

SEQ ID NO: 682809 - DNA, 20 bp, mouse
gtgaacccaaggatccgtgt

SEQ ID NO: 682810 - DNA, 20 bp, mouse
gcgagcgcagcggaggagga

SEQ ID NO: 682811 - DNA, 20 bp, mouse
ggaagcgacagctgcgggac

SEQ ID NO: 682812 - DNA, 20 bp, mouse
ggcgctcggtgcgggcgagt

SEQ ID NO: 682813 - DNA, 20 bp, mouse
gctggcccacacggatcctt

SEQ ID NO: 682814 - DNA, 20 bp, mouse
gcgcccgacgcaaggagcgg

SEQ ID NO: 682815 - DNA, 20 bp, mouse
gcctccggcttcttcgaagc

SEQ ID NO: 682816 - DNA, 20 bp, mouse
gccccctgctggaacccccg

SEQ ID NO: 682817 - DNA, 20 bp, mouse
gccgccccgaggtgaggact

SEQ ID NO: 682818 - DNA, 20 bp, mouse
gggcacagcatgtgagagac

SEQ ID NO: 682819 - DNA, 20 bp, mouse
ggtgcgtgggtggggacgaa

SEQ ID NO: 682820 - DNA, 20 bp, mouse
ggtgagagacagggcgggaa

SEQ ID NO: 682821 - DNA, 20 bp, mouse
ggatcagtcagggtgtgcgt

SEQ ID NO: 682822 - DNA, 20 bp, mouse
gacctcggggcggtcccgcg

SEQ ID NO: 682823 - DNA, 20 bp, mouse
gcatccaagtcctcacctcg

SEQ ID NO: 682824 - DNA, 20 bp, mouse
gacactcggcccggagctcg

SEQ ID NO: 682825 - DNA, 20 bp, mouse
gcccgcgggggttccagcag

SEQ ID NO: 682826 - DNA, 20 bp, mouse
ggcaccgggcggggactcga

SEQ ID NO: 682827 - DNA, 20 bp, mouse
gcatgcgtagatgccgtctc

SEQ ID NO: 682828 - DNA, 20 bp, mouse
gaggcccccgcgagaacctc

SEQ ID NO: 682829 - DNA, 20 bp, mouse
ggggtcccaacacaacgtcc

SEQ ID NO: 682830 - DNA, 20 bp, mouse
gacgttgtgttgggacccaa

SEQ ID NO: 682831 - DNA, 20 bp, mouse
ggcgacgagggcgggagcga

SEQ ID NO: 682832 - DNA, 20 bp, mouse
gaggggagggaacccgcgag

SEQ ID NO: 682833 - DNA, 20 bp, mouse
ggcctcgctggcaccgggcg

SEQ ID NO: 682834 - DNA, 20 bp, mouse
gggctgaggacggtacgaat

SEQ ID NO: 682835 - DNA, 20 bp, mouse
gttagcatctgacctctcag

SEQ ID NO: 682836 - DNA, 20 bp, mouse
gcaaagagactcaggttcca

SEQ ID NO: 682837 - DNA, 20 bp, mouse
gaagccaggtagatgtttac

SEQ ID NO: 682838 - DNA, 20 bp, mouse
ggacacccctggacgtgaca

SEQ ID NO: 682839 - DNA, 20 bp, mouse
gttgtccattgtgacacccc

SEQ ID NO: 682840 - DNA, 20 bp, mouse
gaggctaacgaaagaagaga

SEQ ID NO: 682841 - DNA, 20 bp, mouse
gcgtgacaaggacctcacac

SEQ ID NO: 682842 - DNA, 20 bp, mouse
ggaggtccttgtcacgtcca

SEQ ID NO: 682843 - DNA, 20 bp, mouse
gagggggcggggccccttga

SEQ ID NO: 682844 - DNA, 20 bp, mouse
gatgtttacaggacagagtg

SEQ ID NO: 682845 - DNA, 20 bp, mouse
gaggcttgccaaagagactc

SEQ ID NO: 682846 - DNA, 20 bp, mouse
gaccacccgcccaaccagga

SEQ ID NO: 682847 - DNA, 20 bp, mouse
gtgggcctgaggcataggca

SEQ ID NO: 682848 - DNA, 20 bp, mouse
gtgacctaatcgccccatcc

SEQ ID NO: 682849 - DNA, 20 bp, mouse
gctaatcgccccatcctggt

SEQ ID NO: 682850 - DNA, 20 bp, mouse
gaaggaccacccgcccaacc

SEQ ID NO: 682851 - DNA, 20 bp, mouse
gacactgcctctgccaccgt

SEQ ID NO: 682852 - DNA, 20 bp, mouse
gctacaggcaaaccctggta

SEQ ID NO: 682853 - DNA, 20 bp, mouse
gccaaactacaggcaaaccc

SEQ ID NO: 682854 - DNA, 20 bp, mouse
gtcgccccatcctggttggg

SEQ ID NO: 682855 - DNA, 20 bp, mouse
gttgtgccgctgtgtgaggt

SEQ ID NO: 682856 - DNA, 20 bp, mouse
gacacggtgaggtccacaaa

SEQ ID NO: 682857 - DNA, 20 bp, mouse
gtcaggaaacgaacacggtg

SEQ ID NO: 682858 - DNA, 20 bp, mouse
gagcatcgggcaccatcctg

SEQ ID NO: 682859 - DNA, 20 bp, mouse
gtaagaagcctgtgggtgtg

SEQ ID NO: 682860 - DNA, 20 bp, mouse
gaaggaaggatgaggggcca

SEQ ID NO: 682861 - DNA, 20 bp, mouse
gaaagggggaattttcccaa

SEQ ID NO: 682862 - DNA, 20 bp, mouse
gtgacctcaggaaacgaaca

SEQ ID NO: 682863 - DNA, 20 bp, mouse
ggggcttcctgttttgaagt

SEQ ID NO: 682864 - DNA, 20 bp, mouse
gtgcgtggcagcacgagtag

SEQ ID NO: 682865 - DNA, 20 bp, mouse
gccctgtttggggggaaggt

SEQ ID NO: 682866 - DNA, 20 bp, mouse
gtatgtcaagaggctctgca

SEQ ID NO: 682867 - DNA, 20 bp, mouse
gtggggcgtggcccagaagt

SEQ ID NO: 682868 - DNA, 20 bp, mouse
gccacgggagtcatggggcg

SEQ ID NO: 682869 - DNA, 20 bp, mouse
gcccgcccacgggagtcatg

SEQ ID NO: 682870 - DNA, 20 bp, mouse
gactcccgtgggcggggcag

SEQ ID NO: 682871 - DNA, 20 bp, mouse
gggcgcgcgagagctcgctg

SEQ ID NO: 682872 - DNA, 20 bp, mouse
gagagggtaggtatgtcaag

SEQ ID NO: 682873 - DNA, 20 bp, mouse
gctctgcagggaagattcct

SEQ ID NO: 682874 - DNA, 20 bp, mouse
ggaagtgggtgtggtctcgc

SEQ ID NO: 682875 - DNA, 20 bp, mouse
ggaatgaagttagaccaaga

SEQ ID NO: 682876 - DNA, 20 bp, mouse
ggaacaacgcggcgcaatag

SEQ ID NO: 682877 - DNA, 20 bp, mouse
gacgcggcgcaataggggat

SEQ ID NO: 682878 - DNA, 20 bp, mouse
gctgccgcccacaataaaca

SEQ ID NO: 682879 - DNA, 20 bp, mouse
gactgagggcaaggcttgga

SEQ ID NO: 682880 - DNA, 20 bp, mouse
ggggactccctgtttttcgt

SEQ ID NO: 682881 - DNA, 20 bp, mouse
gatgcgggaaagtttcgcac

SEQ ID NO: 682882 - DNA, 20 bp, mouse
ggaggcgccctcgtcctgat

SEQ ID NO: 682883 - DNA, 20 bp, mouse
gcgccgggcgtcagagggac

SEQ ID NO: 682884 - DNA, 20 bp, mouse
gggagctctccggggatcaa

SEQ ID NO: 682885 - DNA, 20 bp, mouse
gcctccgccatgtttattgt

SEQ ID NO: 682886 - DNA, 20 bp, mouse
gagcttgctacagcaagcta

SEQ ID NO: 682887 - DNA, 20 bp, mouse
gcgggtacaggggagcccag

SEQ ID NO: 682888 - DNA, 20 bp, mouse
gtgtcaaaactgggacacac

SEQ ID NO: 682889 - DNA, 20 bp, mouse
ggtggaccaatgtcaaaact

SEQ ID NO: 682890 - DNA, 20 bp, mouse
gctaagataatcagtcgatt

SEQ ID NO: 682891 - DNA, 20 bp, mouse
ggcgcgtgcgcaagtttttc

SEQ ID NO: 682892 - DNA, 20 bp, mouse
ggtgataaaaagagtagttg

SEQ ID NO: 682893 - DNA, 20 bp, mouse
gattccagagacatgagcaa

SEQ ID NO: 682894 - DNA, 20 bp, mouse
gtttttctgggcgggtacag

SEQ ID NO: 682895 - DNA, 20 bp, mouse
ggtgcgcaagtttttctggg

SEQ ID NO: 682896 - DNA, 20 bp, mouse
ggggacgcggaggctcgacg

SEQ ID NO: 682897 - DNA, 20 bp, mouse
ggacccaggccgcttagagc

SEQ ID NO: 682898 - DNA, 20 bp, mouse
gcccaccgaggccaccgctc

SEQ ID NO: 682899 - DNA, 20 bp, mouse
gagcctccgcgtccccggag

SEQ ID NO: 682900 - DNA, 20 bp, mouse
gcggtccctccaccctagga

SEQ ID NO: 682901 - DNA, 20 bp, mouse
ggggttgtggggcaggtctg

SEQ ID NO: 682902 - DNA, 20 bp, mouse
ggctccaggcggaagcgcta

SEQ ID NO: 682903 - DNA, 20 bp, mouse
ggccaggcggtggaactcca

SEQ ID NO: 682904 - DNA, 20 bp, mouse
gggcggaggaccaggtagat

SEQ ID NO: 682905 - DNA, 20 bp, mouse
gccatcgcgtggagtcgcat

SEQ ID NO: 682906 - DNA, 20 bp, mouse
gtgcgtgcccgcttgcgaga

SEQ ID NO: 682907 - DNA, 20 bp, mouse
gctcccgcacggggcctccg

SEQ ID NO: 682908 - DNA, 20 bp, mouse
gagggcggaaacgcatgtct

SEQ ID NO: 682909 - DNA, 20 bp, mouse
gagaaggattagattcgaca

SEQ ID NO: 682910 - DNA, 20 bp, mouse
ggctctgcgcctgcgcaaca

SEQ ID NO: 682911 - DNA, 20 bp, mouse
gccttcagaaggcgcgcgga

SEQ ID NO: 682912 - DNA, 20 bp, mouse
ggaatcttggtcttgcgtgg

SEQ ID NO: 682913 - DNA, 20 bp, mouse
gtacgcgtgcatgcggcgcc

SEQ ID NO: 682914 - DNA, 20 bp, mouse
gcgcgcgcaggcgcagacgc

SEQ ID NO: 682915 - DNA, 20 bp, mouse
gcctccgccctgcgcacgcc

SEQ ID NO: 682916 - DNA, 20 bp, mouse
gagggcggggcaattagtga

SEQ ID NO: 682917 - DNA, 20 bp, mouse
gaacgcggggagagcgagga

SEQ ID NO: 682918 - DNA, 20 bp, mouse
gcccgcgcgctctgccctca

SEQ ID NO: 682919 - DNA, 20 bp, mouse
ggggccgcgcagagagagca

SEQ ID NO: 682920 - DNA, 20 bp, mouse
gcggccagtcgcggcaagga

SEQ ID NO: 682921 - DNA, 20 bp, mouse
gcagagagagcaaggaacgc

SEQ ID NO: 682922 - DNA, 20 bp, mouse
gaaggagtggctcgtgataa

SEQ ID NO: 682923 - DNA, 20 bp, mouse
gaggcctggaaggaccagaa

SEQ ID NO: 682924 - DNA, 20 bp, mouse
gaggagcgcgcggtgaggga

SEQ ID NO: 682925 - DNA, 20 bp, mouse
gagagcaaggaccgcggtga

SEQ ID NO: 682926 - DNA, 20 bp, mouse
gcgcccacggagtgcgtgag

SEQ ID NO: 682927 - DNA, 20 bp, mouse
gcacccctcacgcactccgt

SEQ ID NO: 682928 - DNA, 20 bp, mouse
gagtgcgtgaggggtgcgca

SEQ ID NO: 682929 - DNA, 20 bp, mouse
ggggctgcccgaggtcccca

SEQ ID NO: 682930 - DNA, 20 bp, mouse
gacggggcagctacgtgagg

SEQ ID NO: 682931 - DNA, 20 bp, mouse
ggggcaccgcggcccaaagg

SEQ ID NO: 682932 - DNA, 20 bp, mouse
gaccctcagcacgctcgctt

SEQ ID NO: 682933 - DNA, 20 bp, mouse
gcccacggccacggagacag

SEQ ID NO: 682934 - DNA, 20 bp, mouse
ggggcttcggacacggtcct

SEQ ID NO: 682935 - DNA, 20 bp, mouse
gcagcgctagggcctcgcaa

SEQ ID NO: 682936 - DNA, 20 bp, mouse
ggccggccccggcgtaggaa

SEQ ID NO: 682937 - DNA, 20 bp, mouse
ggggcgtggtcagcatccgg

SEQ ID NO: 682938 - DNA, 20 bp, mouse
gggcccgcggggcgcgaggc

SEQ ID NO: 682939 - DNA, 20 bp, mouse
gcggaactcgaggaggacgc

SEQ ID NO: 682940 - DNA, 20 bp, mouse
gcgggggcgtggtcagcatc

SEQ ID NO: 682941 - DNA, 20 bp, mouse
gtggacgcggttagcctcgg

SEQ ID NO: 682942 - DNA, 20 bp, mouse
gaaaacgcgtcacgcgaccg

SEQ ID NO: 682943 - DNA, 20 bp, mouse
gcggccccgcgtcccacaca

SEQ ID NO: 682944 - DNA, 20 bp, mouse
ggcgaggccggccccggcgt

SEQ ID NO: 682945 - DNA, 20 bp, mouse
ggggctgcgagagtcggatc

SEQ ID NO: 682946 - DNA, 20 bp, mouse
ggggagatgtgtttgcccca

SEQ ID NO: 682947 - DNA, 20 bp, mouse
ggccctgcggagggcctcat

SEQ ID NO: 682948 - DNA, 20 bp, mouse
gccccagggcatggactggt

SEQ ID NO: 682949 - DNA, 20 bp, mouse
ggtggagaggacctggtatc

SEQ ID NO: 682950 - DNA, 20 bp, mouse
gcaaacacatctcccctaat

SEQ ID NO: 682951 - DNA, 20 bp, mouse
gtctgcagacataggtccta

SEQ ID NO: 682952 - DNA, 20 bp, mouse
ggtggggaattgaattgtct

SEQ ID NO: 682953 - DNA, 20 bp, mouse
gggcgtcagagatttgttgg

SEQ ID NO: 682954 - DNA, 20 bp, mouse
gcggctgctacagaaggagt

SEQ ID NO: 682955 - DNA, 20 bp, mouse
ggagagtagctgtttccaac

SEQ ID NO: 682956 - DNA, 20 bp, mouse
gaggagccgcggggcacgtt

SEQ ID NO: 682957 - DNA, 20 bp, mouse
gtccctcttgggtccgggaa

SEQ ID NO: 682958 - DNA, 20 bp, mouse
gaggccggaagttgcatcgc

SEQ ID NO: 682959 - DNA, 20 bp, mouse
gctgctcccaacgtgccccg

SEQ ID NO: 682960 - DNA, 20 bp, mouse
gaacccttcccggacccaag

SEQ ID NO: 682961 - DNA, 20 bp, mouse
gaagtcggatctgctttcgg

SEQ ID NO: 682962 - DNA, 20 bp, mouse
gtgcgcaataaactccctct

SEQ ID NO: 682963 - DNA, 20 bp, mouse
gataaactccctcttgggtc

SEQ ID NO: 682964 - DNA, 20 bp, mouse
gtgaaatggggtgctgcggg

SEQ ID NO: 682965 - DNA, 20 bp, mouse
ggcactgagaacgcgtgaaa

SEQ ID NO: 682966 - DNA, 20 bp, mouse
gcggcccaggggccggagta

SEQ ID NO: 682967 - DNA, 20 bp, mouse
ggggaacccacctaggtcca

SEQ ID NO: 682968 - DNA, 20 bp, mouse
gaacccacctaggtccatgg

SEQ ID NO: 682969 - DNA, 20 bp, mouse
ggggaagtgggaacccacct

SEQ ID NO: 682970 - DNA, 20 bp, mouse
gtcgccgccatggacctagg

SEQ ID NO: 682971 - DNA, 20 bp, mouse
gacactacgaaggacggagg

SEQ ID NO: 682972 - DNA, 20 bp, mouse
ggcgtcgccgccatggacct

SEQ ID NO: 682973 - DNA, 20 bp, mouse
gccagcctcccgagcaccgt

SEQ ID NO: 682974 - DNA, 20 bp, mouse
gcctgcccaggaggtgcttt

SEQ ID NO: 682975 - DNA, 20 bp, mouse
gtcgcggccttggactagga

SEQ ID NO: 682976 - DNA, 20 bp, mouse
gggacgccccggggcaaact

SEQ ID NO: 682977 - DNA, 20 bp, mouse
ggccccggggcaaactggga

SEQ ID NO: 682978 - DNA, 20 bp, mouse
ggtgctggccagcagggtga

SEQ ID NO: 682979 - DNA, 20 bp, mouse
gtccgcccggctcactccct

SEQ ID NO: 682980 - DNA, 20 bp, mouse
ggaggacaagacaggtgcat

SEQ ID NO: 682981 - DNA, 20 bp, mouse
gagcttccgctctgctccca

SEQ ID NO: 682982 - DNA, 20 bp, mouse
gctaggaccgagcgagccga

SEQ ID NO: 682983 - DNA, 20 bp, mouse
gagagcggaagctcagtgtc

SEQ ID NO: 682984 - DNA, 20 bp, mouse
ggatggagagggatgaatct

SEQ ID NO: 682985 - DNA, 20 bp, mouse
gttggggacgaggacaagac

SEQ ID NO: 682986 - DNA, 20 bp, mouse
gggaagctagctgaagtcgg

SEQ ID NO: 682987 - DNA, 20 bp, mouse
ggaagtcggaggtccgcaaa

SEQ ID NO: 682988 - DNA, 20 bp, mouse
ggctcagtgcgcaggagcca

SEQ ID NO: 682989 - DNA, 20 bp, mouse
gagggggcgcgcgaggagca

SEQ ID NO: 682990 - DNA, 20 bp, mouse
gcatcggggcagcagctaag

SEQ ID NO: 682991 - DNA, 20 bp, mouse
gggagcctggcaaaagagtt

SEQ ID NO: 682992 - DNA, 20 bp, mouse
gctggctgctggagatgggg

SEQ ID NO: 682993 - DNA, 20 bp, mouse
gctacgtccctgcagaaggg

SEQ ID NO: 682994 - DNA, 20 bp, mouse
gagaggaggtgccacaagaa

SEQ ID NO: 682995 - DNA, 20 bp, mouse
gcagggaagctagctgaagt

SEQ ID NO: 682996 - DNA, 20 bp, mouse
gggtgcgcgcagcctcgcgc

SEQ ID NO: 682997 - DNA, 20 bp, mouse
gctgctgcgggcacacgcgc

SEQ ID NO: 682998 - DNA, 20 bp, mouse
gggggcggggcgggcactcg

SEQ ID NO: 682999 - DNA, 20 bp, mouse
gcgaggctgcgcgcaccccg

SEQ ID NO: 683000 - DNA, 20 bp, mouse
ggagcgaggagggatgcgtg

SEQ ID NO: 683001 - DNA, 20 bp, mouse
ggcgctgacccgtagggcga

SEQ ID NO: 683002 - DNA, 20 bp, mouse
gtcgcgcgggcggagcgagg

SEQ ID NO: 683003 - DNA, 20 bp, mouse
ggagagcatcaagtgtgcgt

SEQ ID NO: 683004 - DNA, 20 bp, mouse
gtccgggtcccggcgtttag

SEQ ID NO: 683005 - DNA, 20 bp, mouse
ggaccggcggccctgggagc

SEQ ID NO: 683006 - DNA, 20 bp, mouse
gtaggctgagggtaaagttg

SEQ ID NO: 683007 - DNA, 20 bp, mouse
gagaaggcgagctaggctga

SEQ ID NO: 683008 - DNA, 20 bp, mouse
gcggacgaacgaggacctac

SEQ ID NO: 683009 - DNA, 20 bp, mouse
ggctgagggtaaagttgagg

SEQ ID NO: 683010 - DNA, 20 bp, mouse
ggcgcccaagaggccggaag

SEQ ID NO: 683011 - DNA, 20 bp, mouse
gagcccacgccctgcagatg

SEQ ID NO: 683012 - DNA, 20 bp, mouse
gagtggagagaaggcgagct

SEQ ID NO: 683013 - DNA, 20 bp, mouse
gtaaagttgaggcggggtgc

SEQ ID NO: 683014 - DNA, 20 bp, mouse
gctgcagatgcggacgaacg

SEQ ID NO: 683015 - DNA, 20 bp, mouse
gaatgaagatccacgagagg

SEQ ID NO: 683016 - DNA, 20 bp, mouse
gcatggcccaagtggaggga

SEQ ID NO: 683017 - DNA, 20 bp, mouse
gagagcgcgcgcccctcctc

SEQ ID NO: 683018 - DNA, 20 bp, mouse
ggggtgcatggcccaagtgg

SEQ ID NO: 683019 - DNA, 20 bp, mouse
ggggccccctccctccactt

SEQ ID NO: 683020 - DNA, 20 bp, mouse
gggtgtgcacccaggggcgg

SEQ ID NO: 683021 - DNA, 20 bp, mouse
gcccctgggtgcacacctct

SEQ ID NO: 683022 - DNA, 20 bp, mouse
gtgcacccaggggcggagga

SEQ ID NO: 683023 - DNA, 20 bp, mouse
ggaccctggaggcgcgtgag

SEQ ID NO: 683024 - DNA, 20 bp, mouse
gggaggaggtggcagccttg

SEQ ID NO: 683025 - DNA, 20 bp, mouse
gggttcttgccagaagccgg

SEQ ID NO: 683026 - DNA, 20 bp, mouse
gtggggaaactaggtgccaa

SEQ ID NO: 683027 - DNA, 20 bp, mouse
gggtgtggaaatcctgctaa

SEQ ID NO: 683028 - DNA, 20 bp, mouse
gttactgataaaattgactg

SEQ ID NO: 683029 - DNA, 20 bp, mouse
gggacaaaaacctcagaccc

SEQ ID NO: 683030 - DNA, 20 bp, mouse
ggagtgagacgtctgaatcc

SEQ ID NO: 683031 - DNA, 20 bp, mouse
ggactcaaagattagtgtta

SEQ ID NO: 683032 - DNA, 20 bp, mouse
gcgtctgaatccagggtctg

SEQ ID NO: 683033 - DNA, 20 bp, mouse
ggtctgaggtttttgtccta

SEQ ID NO: 683034 - DNA, 20 bp, mouse
gaatcctgctaagggcttac

SEQ ID NO: 683035 - DNA, 20 bp, mouse
gacaccacccctgcactgct

SEQ ID NO: 683036 - DNA, 20 bp, mouse
ggggaagggcccggtcaagc

SEQ ID NO: 683037 - DNA, 20 bp, mouse
gtgcgtgctagcaatctagt

SEQ ID NO: 683038 - DNA, 20 bp, mouse
gagggcccggtcaagccgga

SEQ ID NO: 683039 - DNA, 20 bp, mouse
ggcccggtcaagccggaggg

SEQ ID NO: 683040 - DNA, 20 bp, mouse
ggaagccggaagttacataa

SEQ ID NO: 683041 - DNA, 20 bp, mouse
ggccaacaccaaccgagccg

SEQ ID NO: 683042 - DNA, 20 bp, mouse
gagagggaacgggaagggcc

SEQ ID NO: 683043 - DNA, 20 bp, mouse
gagtctcgcgagagagggaa

SEQ ID NO: 683044 - DNA, 20 bp, mouse
gaggactcgaaactcagccg

SEQ ID NO: 683045 - DNA, 20 bp, mouse
gttccaagtctcgcgagaga

SEQ ID NO: 683046 - DNA, 20 bp, mouse
ggggcagccaaccagggcga

SEQ ID NO: 683047 - DNA, 20 bp, mouse
gtcccaccgggcagccaacc

SEQ ID NO: 683048 - DNA, 20 bp, mouse
ggagaggtgtaaaagaattg

SEQ ID NO: 683049 - DNA, 20 bp, mouse
gaaggaacgagcctcccacc

SEQ ID NO: 683050 - DNA, 20 bp, mouse
gggagggagaaggtagactt

SEQ ID NO: 683051 - DNA, 20 bp, mouse
gttaggggctgcagaaactt

SEQ ID NO: 683052 - DNA, 20 bp, mouse
ggagcggccaataggagaga

SEQ ID NO: 683053 - DNA, 20 bp, mouse
ggctcagggaggtgcgtctc

SEQ ID NO: 683054 - DNA, 20 bp, mouse
gacctccctgagcggccaat

SEQ ID NO: 683055 - DNA, 20 bp, mouse
ggcgtctcgggtctggggat

SEQ ID NO: 683056 - DNA, 20 bp, mouse
gaggctccaggctctctgat

SEQ ID NO: 683057 - DNA, 20 bp, mouse
gtaagcatggccctcacaat

SEQ ID NO: 683058 - DNA, 20 bp, mouse
gcatcaacgctgtgcatcga

SEQ ID NO: 683059 - DNA, 20 bp, mouse
gcaggctctctgattggttc

SEQ ID NO: 683060 - DNA, 20 bp, mouse
gcatggccctcacaatgggg

SEQ ID NO: 683061 - DNA, 20 bp, mouse
ggcacagcgttgatgagcgc

SEQ ID NO: 683062 - DNA, 20 bp, mouse
gatggggcggcaacaaaggc

SEQ ID NO: 683063 - DNA, 20 bp, mouse
gcccgcgaatgaagcccgag

SEQ ID NO: 683064 - DNA, 20 bp, mouse
gcacaatggggcggcaacaa

SEQ ID NO: 683065 - DNA, 20 bp, mouse
gtccactcgggcttcattcg

SEQ ID NO: 683066 - DNA, 20 bp, mouse
gggcgtggaggggacggaaa

SEQ ID NO: 683067 - DNA, 20 bp, mouse
gcgaccaagtacatgtaccc

SEQ ID NO: 683068 - DNA, 20 bp, mouse
gagagtctgggctccagcga

SEQ ID NO: 683069 - DNA, 20 bp, mouse
gctgaagcgtggttgtcatc

SEQ ID NO: 683070 - DNA, 20 bp, mouse
ggtacttggtcgctgaagcg

SEQ ID NO: 683071 - DNA, 20 bp, mouse
gagcagggtcaaggcttggc

SEQ ID NO: 683072 - DNA, 20 bp, mouse
gtgggctccagcgaggggag

SEQ ID NO: 683073 - DNA, 20 bp, mouse
gcaaggcttggcaggcagag

SEQ ID NO: 683074 - DNA, 20 bp, mouse
ggaggggactcttgctgagg

SEQ ID NO: 683075 - DNA, 20 bp, mouse
gaagagtcccctcccctcgc

SEQ ID NO: 683076 - DNA, 20 bp, mouse
ggggtgcgccacaacctagg

SEQ ID NO: 683077 - DNA, 20 bp, mouse
ggccgggtgcgccacaacct

SEQ ID NO: 683078 - DNA, 20 bp, mouse
ggccctgtgtgtgcaatgta

SEQ ID NO: 683079 - DNA, 20 bp, mouse
gagcccgggcggggacgaga

SEQ ID NO: 683080 - DNA, 20 bp, mouse
gtgccggggacgtaaaagca

SEQ ID NO: 683081 - DNA, 20 bp, mouse
gctctctgctggttgtagtc

SEQ ID NO: 683082 - DNA, 20 bp, mouse
gggacagcggcccggaatag

SEQ ID NO: 683083 - DNA, 20 bp, mouse
gctaggaggactgtgaagtc

SEQ ID NO: 683084 - DNA, 20 bp, mouse
gtaatccgacccagtctggt

SEQ ID NO: 683085 - DNA, 20 bp, mouse
ggcagagggcagcctagcgg

SEQ ID NO: 683086 - DNA, 20 bp, mouse
gacgactaaacgcccctctt

SEQ ID NO: 683087 - DNA, 20 bp, mouse
gagtcgtagcggactggaat

SEQ ID NO: 683088 - DNA, 20 bp, mouse
gggtaagcgtgtacacagca

SEQ ID NO: 683089 - DNA, 20 bp, mouse
gtctgcgaggtggtccctta

SEQ ID NO: 683090 - DNA, 20 bp, mouse
gcccggggcgagcatgtgac

SEQ ID NO: 683091 - DNA, 20 bp, mouse
gaggggaaaacggttgaact

SEQ ID NO: 683092 - DNA, 20 bp, mouse
ggggacggccgcggcactta

SEQ ID NO: 683093 - DNA, 20 bp, mouse
ggagacctgtgattgatagg

SEQ ID NO: 683094 - DNA, 20 bp, mouse
gcgcactaaggcaaccggaa

SEQ ID NO: 683095 - DNA, 20 bp, mouse
ggaggggcgtttagtcgtag

SEQ ID NO: 683096 - DNA, 20 bp, mouse
gggtctgggcggtgtctccg

SEQ ID NO: 683097 - DNA, 20 bp, mouse
gggcaagcggaagttctccg

SEQ ID NO: 683098 - DNA, 20 bp, mouse
ggccaatggcggttaagctg

SEQ ID NO: 683099 - DNA, 20 bp, mouse
gtgcggctgcgcaggagtga

SEQ ID NO: 683100 - DNA, 20 bp, mouse
ggcggttaagctgtggccaa

SEQ ID NO: 683101 - DNA, 20 bp, mouse
gaaactgggcgaacagatga

SEQ ID NO: 683102 - DNA, 20 bp, mouse
ggacaccgcccagaccagca

SEQ ID NO: 683103 - DNA, 20 bp, mouse
gaagtcccgccctgctggtc

SEQ ID NO: 683104 - DNA, 20 bp, mouse
gtgacggggcgcgggcgagt

SEQ ID NO: 683105 - DNA, 20 bp, mouse
gtcggaaatgtcccgacaga

SEQ ID NO: 683106 - DNA, 20 bp, mouse
gaagactaggggcgggtggg

SEQ ID NO: 683107 - DNA, 20 bp, mouse
ggcggctctgagggtggtgt

SEQ ID NO: 683108 - DNA, 20 bp, mouse
gcgggtgggaggcggctctg

SEQ ID NO: 683109 - DNA, 20 bp, mouse
gccgttggagataaagacta

SEQ ID NO: 683110 - DNA, 20 bp, mouse
gggcgctgaggccgaaggtg

SEQ ID NO: 683111 - DNA, 20 bp, mouse
gtggagataaagactagggg

SEQ ID NO: 683112 - DNA, 20 bp, mouse
gtgggaggcggctctgaggg

SEQ ID NO: 683113 - DNA, 20 bp, mouse
ggccaaccagctcaggagtg

SEQ ID NO: 683114 - DNA, 20 bp, mouse
gataaagactaggggcgggt

SEQ ID NO: 683115 - DNA, 20 bp, mouse
gcgagcgagctcgggaggat

SEQ ID NO: 683116 - DNA, 20 bp, mouse
gaaggctgtgtggaaactct

SEQ ID NO: 683117 - DNA, 20 bp, mouse
gtgggaggggctgttggccg

SEQ ID NO: 683118 - DNA, 20 bp, mouse
ggcagaggggatgggcgcgg

SEQ ID NO: 683119 - DNA, 20 bp, mouse
gactctggggagattcctag

SEQ ID NO: 683120 - DNA, 20 bp, mouse
gagcacaggccagtctgagt

SEQ ID NO: 683121 - DNA, 20 bp, mouse
gttgggagctgctgtgagac

SEQ ID NO: 683122 - DNA, 20 bp, mouse
gtaagagacctgaggttgag

SEQ ID NO: 683123 - DNA, 20 bp, mouse
gtcagaggacacttcgacta

SEQ ID NO: 683124 - DNA, 20 bp, mouse
gtaaaacgcaatctgcagag

SEQ ID NO: 683125 - DNA, 20 bp, mouse
gagtcaagcaagggatcaaa

SEQ ID NO: 683126 - DNA, 20 bp, mouse
ggctgcgcgcgctcgccctc

SEQ ID NO: 683127 - DNA, 20 bp, mouse
gagcgcgcgcagctgtgggc

SEQ ID NO: 683128 - DNA, 20 bp, mouse
ggacgtggggcgtgatgtag

SEQ ID NO: 683129 - DNA, 20 bp, mouse
gggcgagcgcgcgcagctgt

SEQ ID NO: 683130 - DNA, 20 bp, mouse
ggcccggggcctggaaccgc

SEQ ID NO: 683131 - DNA, 20 bp, mouse
gttgcctgcagcagcgtccc

SEQ ID NO: 683132 - DNA, 20 bp, mouse
gcgctcgcgtcttgacccga

SEQ ID NO: 683133 - DNA, 20 bp, mouse
gccgcggcaaagcggggagt

SEQ ID NO: 683134 - DNA, 20 bp, mouse
gaggacgcgagcccacttcc

SEQ ID NO: 683135 - DNA, 20 bp, mouse
ggtccagcgccgccgacgtg

SEQ ID NO: 683136 - DNA, 20 bp, mouse
ggggaagcgacaaggaatgc

SEQ ID NO: 683137 - DNA, 20 bp, mouse
gtggccgaggagcgccaaag

SEQ ID NO: 683138 - DNA, 20 bp, mouse
gcgccaaagtggtttctgag

SEQ ID NO: 683139 - DNA, 20 bp, mouse
gcggccgcagtaaggagaaa

SEQ ID NO: 683140 - DNA, 20 bp, mouse
ggaaaccactggccgtccag

SEQ ID NO: 683141 - DNA, 20 bp, mouse
gtccacggaaacccactcag

SEQ ID NO: 683142 - DNA, 20 bp, mouse
ggagcatccctgggcagcta

SEQ ID NO: 683143 - DNA, 20 bp, mouse
gggacggccagtggtttcca

SEQ ID NO: 683144 - DNA, 20 bp, mouse
gctgcccagggatgctcctc

SEQ ID NO: 683145 - DNA, 20 bp, mouse
gccgcccacaggccgctgga

SEQ ID NO: 683146 - DNA, 20 bp, mouse
gttcccgtcaggcagagcga

SEQ ID NO: 683147 - DNA, 20 bp, mouse
gggcgggctaggggcaggga

SEQ ID NO: 683148 - DNA, 20 bp, mouse
gcctacggcgcagcctatta

SEQ ID NO: 683149 - DNA, 20 bp, mouse
gttaccgcgtgcagcccgga

SEQ ID NO: 683150 - DNA, 20 bp, mouse
gtagggctgcgcagtgggtc

SEQ ID NO: 683151 - DNA, 20 bp, mouse
ggggctgcacgcggtaaacc

SEQ ID NO: 683152 - DNA, 20 bp, mouse
gcccacgaccagggcagaaa

SEQ ID NO: 683153 - DNA, 20 bp, mouse
ggtgaagcgacaccaccagg

SEQ ID NO: 683154 - DNA, 20 bp, mouse
gccttgcagggccaaaggag

SEQ ID NO: 683155 - DNA, 20 bp, mouse
ggggccaggagaggcgggct

SEQ ID NO: 683156 - DNA, 20 bp, mouse
gtcagtaggggcggtcttta

SEQ ID NO: 683157 - DNA, 20 bp, mouse
gtaggggcggtctttacgga

SEQ ID NO: 683158 - DNA, 20 bp, mouse
ggcttggcacgcttaggggc

SEQ ID NO: 683159 - DNA, 20 bp, mouse
gggcacgctcgaccaggaca

SEQ ID NO: 683160 - DNA, 20 bp, mouse
gcccgggcttggcacgctta

SEQ ID NO: 683161 - DNA, 20 bp, mouse
gcgcccctactgacatggac

SEQ ID NO: 683162 - DNA, 20 bp, mouse
gaccgcctcctcagagtccc

SEQ ID NO: 683163 - DNA, 20 bp, mouse
gtgcctgtccatgtcagtag

SEQ ID NO: 683164 - DNA, 20 bp, mouse
ggatatgatccgcagtaaga

SEQ ID NO: 683165 - DNA, 20 bp, mouse
gacgctcgaccaggacaagg

SEQ ID NO: 683166 - DNA, 20 bp, mouse
gcccgccaggggagtcacag

SEQ ID NO: 683167 - DNA, 20 bp, mouse
gagaagagacgtgaccaggc

SEQ ID NO: 683168 - DNA, 20 bp, mouse
gctagagaagagacgtgacc

SEQ ID NO: 683169 - DNA, 20 bp, mouse
ggggtgtcttggaaagacat

SEQ ID NO: 683170 - DNA, 20 bp, mouse
gtaggagcagataaaggcgt

SEQ ID NO: 683171 - DNA, 20 bp, mouse
gagtggtgggaggggacgtt

SEQ ID NO: 683172 - DNA, 20 bp, mouse
ggatgaggtggacatctggg

SEQ ID NO: 683173 - DNA, 20 bp, mouse
gggattacactgtcagtggt

SEQ ID NO: 683174 - DNA, 20 bp, mouse
ggctctctgaaagcccgcca

SEQ ID NO: 683175 - DNA, 20 bp, mouse
gaagagcaagaatttgtgcc

SEQ ID NO: 683176 - DNA, 20 bp, mouse
gtccgggcagccgtccgcgg

SEQ ID NO: 683177 - DNA, 20 bp, mouse
gagctggcgcccgcgttctc

SEQ ID NO: 683178 - DNA, 20 bp, mouse
ggctgcccggagatggcggg

SEQ ID NO: 683179 - DNA, 20 bp, mouse
ggcccggagatggcgggcgg

SEQ ID NO: 683180 - DNA, 20 bp, mouse
gacggctgcccggagatggc

SEQ ID NO: 683181 - DNA, 20 bp, mouse
ggaccgcgccgaaccacggt

SEQ ID NO: 683182 - DNA, 20 bp, mouse
gcccgcgttctccggcccgg

SEQ ID NO: 683183 - DNA, 20 bp, mouse
gcggtgcggggctcttccgc

SEQ ID NO: 683184 - DNA, 20 bp, mouse
gcggtcgcgcttccgcggtg

SEQ ID NO: 683185 - DNA, 20 bp, mouse
gagccgccgcccgccatctc

SEQ ID NO: 683186 - DNA, 20 bp, mouse
gccctcaagctcctctccta

SEQ ID NO: 683187 - DNA, 20 bp, mouse
gctcgcgagaggatgcacac

SEQ ID NO: 683188 - DNA, 20 bp, mouse
ggcgtggtctagggaggaga

SEQ ID NO: 683189 - DNA, 20 bp, mouse
ggtgagcaagacaacctcag

SEQ ID NO: 683190 - DNA, 20 bp, mouse
ggtgcatcctctcgcgagaa

SEQ ID NO: 683191 - DNA, 20 bp, mouse
gaccctaggagaggagcttg

SEQ ID NO: 683192 - DNA, 20 bp, mouse
ggtccagcctcccgactgct

SEQ ID NO: 683193 - DNA, 20 bp, mouse
gctcgcgagaagggccggga

SEQ ID NO: 683194 - DNA, 20 bp, mouse
gtcacgattgccctcaccct

SEQ ID NO: 683195 - DNA, 20 bp, mouse
ggggcaatcgtgacgcacag

SEQ ID NO: 683196 - DNA, 20 bp, mouse
gaagccacgcgaccccgcag

SEQ ID NO: 683197 - DNA, 20 bp, mouse
gccggcccgccctctcggaa

SEQ ID NO: 683198 - DNA, 20 bp, mouse
gcccgcgccctccttactat

SEQ ID NO: 683199 - DNA, 20 bp, mouse
gatgtcagtcaaggggataa

SEQ ID NO: 683200 - DNA, 20 bp, mouse
gtccccttgactgacatctt

SEQ ID NO: 683201 - DNA, 20 bp, mouse
gacggcgcagtgcgggtgaa

SEQ ID NO: 683202 - DNA, 20 bp, mouse
gtacccaagatgtcagtcaa

SEQ ID NO: 683203 - DNA, 20 bp, mouse
gggcgggccggcatcccaaa

SEQ ID NO: 683204 - DNA, 20 bp, mouse
gccgcccagctcctggaggc

SEQ ID NO: 683205 - DNA, 20 bp, mouse
gggccggcatcccaaacgga

SEQ ID NO: 683206 - DNA, 20 bp, mouse
ggggccaaccgaagccgcga

SEQ ID NO: 683207 - DNA, 20 bp, mouse
gcacgcgcccctcgcggctt

SEQ ID NO: 683208 - DNA, 20 bp, mouse
gccggtggccgcacaagggg

SEQ ID NO: 683209 - DNA, 20 bp, mouse
gccttgtgcggccaccggga

SEQ ID NO: 683210 - DNA, 20 bp, mouse
gtctgggctcccaaccctcc

SEQ ID NO: 683211 - DNA, 20 bp, mouse
gtgcggccaccgggagggtt

SEQ ID NO: 683212 - DNA, 20 bp, mouse
gcaggcgcggagacccgaga

SEQ ID NO: 683213 - DNA, 20 bp, mouse
gcgaggctccgccccttgtg

SEQ ID NO: 683214 - DNA, 20 bp, mouse
gaacctcattccaaaggctc

SEQ ID NO: 683215 - DNA, 20 bp, mouse
gggaggagactgagcgagag

SEQ ID NO: 683216 - DNA, 20 bp, mouse
gggaaggcggggcagagtgc

SEQ ID NO: 683217 - DNA, 20 bp, mouse
gcggccgcgtgcaggagatg

SEQ ID NO: 683218 - DNA, 20 bp, mouse
ggggcgtccagccagcggaa

SEQ ID NO: 683219 - DNA, 20 bp, mouse
gccgcgtgcaggagatgagg

SEQ ID NO: 683220 - DNA, 20 bp, mouse
gtccagccagcggaaggggc

SEQ ID NO: 683221 - DNA, 20 bp, mouse
ggcgtggccgggccgaggtt

SEQ ID NO: 683222 - DNA, 20 bp, mouse
gcgaccgggcgtccagccag

SEQ ID NO: 683223 - DNA, 20 bp, mouse
gagctctccaaacctcggcc

SEQ ID NO: 683224 - DNA, 20 bp, mouse
ggtgcgccaccaccgctcac

SEQ ID NO: 683225 - DNA, 20 bp, mouse
gtaagacagcctgtgagcgg

SEQ ID NO: 683226 - DNA, 20 bp, mouse
ggaggagcgggcagcaattc

SEQ ID NO: 683227 - DNA, 20 bp, mouse
ggccccgcgaccaccctata

SEQ ID NO: 683228 - DNA, 20 bp, mouse
gaggagccctccatgtagcg

SEQ ID NO: 683229 - DNA, 20 bp, mouse
gagagggcggccgaacctag

SEQ ID NO: 683230 - DNA, 20 bp, mouse
gccgcgccccgctacatgga

SEQ ID NO: 683231 - DNA, 20 bp, mouse
gacagcgcccttcgtctcag

SEQ ID NO: 683232 - DNA, 20 bp, mouse
gctctcgcaacccaagatgg

SEQ ID NO: 683233 - DNA, 20 bp, mouse
gcggccgccctctgagacga

SEQ ID NO: 683234 - DNA, 20 bp, mouse
gcgcccttcgtctcagaggg

SEQ ID NO: 683235 - DNA, 20 bp, mouse
gaaaacccagaaatcatgaa

SEQ ID NO: 683236 - DNA, 20 bp, mouse
gcgcaccaccggtctcccaa

SEQ ID NO: 683237 - DNA, 20 bp, mouse
ggaaactgggcgcccccctt

SEQ ID NO: 683238 - DNA, 20 bp, mouse
ggccccccttgggagaccgg

SEQ ID NO: 683239 - DNA, 20 bp, mouse
gaccaccggtctcccaaggg

SEQ ID NO: 683240 - DNA, 20 bp, mouse
gggtgcggctgatcaccccg

SEQ ID NO: 683241 - DNA, 20 bp, mouse
gcggctgatcaccccgggga

SEQ ID NO: 683242 - DNA, 20 bp, mouse
gccgggccgggccgcgaagg

SEQ ID NO: 683243 - DNA, 20 bp, mouse
gcgggcgcgggccgcccaga

SEQ ID NO: 683244 - DNA, 20 bp, mouse
gccttggcagaccagctcta

SEQ ID NO: 683245 - DNA, 20 bp, mouse
gaaggcatctgaaatctgat

SEQ ID NO: 683246 - DNA, 20 bp, mouse
gggcagacgcggatgagggg

SEQ ID NO: 683247 - DNA, 20 bp, mouse
ggggggcgaacccggatcga

SEQ ID NO: 683248 - DNA, 20 bp, mouse
gaacccggatcgagggaggc

SEQ ID NO: 683249 - DNA, 20 bp, mouse
ggagcagacggcgtgatgat

SEQ ID NO: 683250 - DNA, 20 bp, mouse
gagacggcgtgatgattgga

SEQ ID NO: 683251 - DNA, 20 bp, mouse
gaacaggtcgacagagcaga

SEQ ID NO: 683252 - DNA, 20 bp, mouse
gcccagaggtccagggcgat

SEQ ID NO: 683253 - DNA, 20 bp, mouse
gggcgaacccggatcgaggg

SEQ ID NO: 683254 - DNA, 20 bp, mouse
gtggacggcacggaaggagc

SEQ ID NO: 683255 - DNA, 20 bp, mouse
gcgggttcgcccccaagccg

SEQ ID NO: 683256 - DNA, 20 bp, mouse
ggggcctagcgaagcttagg

SEQ ID NO: 683257 - DNA, 20 bp, mouse
gggaaaaacgcggacggagg

SEQ ID NO: 683258 - DNA, 20 bp, mouse
gcgggggcctagcgaagctt

SEQ ID NO: 683259 - DNA, 20 bp, mouse
gggaaaatgtggagaccgga

SEQ ID NO: 683260 - DNA, 20 bp, mouse
gccctctgtgggcaaagcgt

SEQ ID NO: 683261 - DNA, 20 bp, mouse
gagggggggaaaaacgcgga

SEQ ID NO: 683262 - DNA, 20 bp, mouse
gactccacgcaatggggggc

SEQ ID NO: 683263 - DNA, 20 bp, mouse
ggggaagtcacttttgtcaa

SEQ ID NO: 683264 - DNA, 20 bp, mouse
gagaccggagggaaacgaac

SEQ ID NO: 683265 - DNA, 20 bp, mouse
ggggggaaaaacgcggacgg

SEQ ID NO: 683266 - DNA, 20 bp, mouse
ggggacaggagggacagcgg

SEQ ID NO: 683267 - DNA, 20 bp, mouse
gcaggggtttaaagcccgag

SEQ ID NO: 683268 - DNA, 20 bp, mouse
gacggccaatcagcgctcgc

SEQ ID NO: 683269 - DNA, 20 bp, mouse
gctgggaacccacgccgctc

SEQ ID NO: 683270 - DNA, 20 bp, mouse
gacacctggatgcttcgggg

SEQ ID NO: 683271 - DNA, 20 bp, mouse
gtgcacacctggatgcttcg

SEQ ID NO: 683272 - DNA, 20 bp, mouse
gtttaaagcccgagcggcgt

SEQ ID NO: 683273 - DNA, 20 bp, mouse
gggttcccagactgcacacc

SEQ ID NO: 683274 - DNA, 20 bp, mouse
gttaaacccctgcgcgagcc

SEQ ID NO: 683275 - DNA, 20 bp, mouse
gcctgtcccggctcgcgcag

SEQ ID NO: 683276 - DNA, 20 bp, mouse
gtccagggtggtctgatcac

SEQ ID NO: 683277 - DNA, 20 bp, mouse
gacctcagggcctcaggagc

SEQ ID NO: 683278 - DNA, 20 bp, mouse
gggagcatttccctgacctc

SEQ ID NO: 683279 - DNA, 20 bp, mouse
ggagatgtccatcttctcca

SEQ ID NO: 683280 - DNA, 20 bp, mouse
ggccctgctcgctggttctg

SEQ ID NO: 683281 - DNA, 20 bp, mouse
gatggacatctccctctcac

SEQ ID NO: 683282 - DNA, 20 bp, mouse
gccccagcccttgtccaggg

SEQ ID NO: 683283 - DNA, 20 bp, mouse
ggggctgggagttgtgccaa

SEQ ID NO: 683284 - DNA, 20 bp, mouse
gggaaatgctcccatgcaag

SEQ ID NO: 683285 - DNA, 20 bp, mouse
gcagggcctcaggagcaggt

SEQ ID NO: 683286 - DNA, 20 bp, mouse
gtgactgggcgggcaggaga

SEQ ID NO: 683287 - DNA, 20 bp, mouse
gaggacaggggtgactgatc

SEQ ID NO: 683288 - DNA, 20 bp, mouse
gttcaggggcgattgtgact

SEQ ID NO: 683289 - DNA, 20 bp, mouse
gaggggcgattgtgactggg

SEQ ID NO: 683290 - DNA, 20 bp, mouse
gcagcacacgctgacgttca

SEQ ID NO: 683291 - DNA, 20 bp, mouse
gagaggggtgacagaaagac

SEQ ID NO: 683292 - DNA, 20 bp, mouse
gtgactgatcagggacatga

SEQ ID NO: 683293 - DNA, 20 bp, mouse
ggaggcgcccagcacaccca

SEQ ID NO: 683294 - DNA, 20 bp, mouse
gactgggctgcctggctaat

SEQ ID NO: 683295 - DNA, 20 bp, mouse
gcaagtgaggacataaatct

SEQ ID NO: 683296 - DNA, 20 bp, mouse
ggcctggggccgggaagtgg

SEQ ID NO: 683297 - DNA, 20 bp, mouse
ggggacgggacgaaaggatc

SEQ ID NO: 683298 - DNA, 20 bp, mouse
ggcggcgctggggcgggatc

SEQ ID NO: 683299 - DNA, 20 bp, mouse
gaagagagaccgggagaagt

SEQ ID NO: 683300 - DNA, 20 bp, mouse
ggggcagaagcggaccatgg

SEQ ID NO: 683301 - DNA, 20 bp, mouse
ggggttaccgcgcggaggga

SEQ ID NO: 683302 - DNA, 20 bp, mouse
gaagcggaccatggcggagt

SEQ ID NO: 683303 - DNA, 20 bp, mouse
ggaccgcggcagcgcgggtg

SEQ ID NO: 683304 - DNA, 20 bp, mouse
gaagggacggcgcggcgctg

SEQ ID NO: 683305 - DNA, 20 bp, mouse
ggagaggacggggtgatgaa

SEQ ID NO: 683306 - DNA, 20 bp, mouse
gagggcgaggcgtatagggt

SEQ ID NO: 683307 - DNA, 20 bp, mouse
gcgtcccaggagcgcagggt

SEQ ID NO: 683308 - DNA, 20 bp, mouse
gcagtcgcccggctctctca

SEQ ID NO: 683309 - DNA, 20 bp, mouse
ggggcctgcgggatgagcag

SEQ ID NO: 683310 - DNA, 20 bp, mouse
gccgcgagggcgaggcgtat

SEQ ID NO: 683311 - DNA, 20 bp, mouse
gaagcctgacaggatcccaa

SEQ ID NO: 683312 - DNA, 20 bp, mouse
gacgagctgtgagccggagg

SEQ ID NO: 683313 - DNA, 20 bp, mouse
ggcgcaatgagctcattcga

SEQ ID NO: 683314 - DNA, 20 bp, mouse
ggtgggagtcggggccgtca

SEQ ID NO: 683315 - DNA, 20 bp, mouse
gaagcgcctagggaagagta

SEQ ID NO: 683316 - DNA, 20 bp, mouse
gtggcagggcgcgcccaccg

SEQ ID NO: 683317 - DNA, 20 bp, mouse
gcgcgccctgccaaggaggg

SEQ ID NO: 683318 - DNA, 20 bp, mouse
ggggaggcttgggagcggag

SEQ ID NO: 683319 - DNA, 20 bp, mouse
gccctgccaaggagggcgga

SEQ ID NO: 683320 - DNA, 20 bp, mouse
gaggacttgccagaggatgg

SEQ ID NO: 683321 - DNA, 20 bp, mouse
gaccctggactcagccacgg

SEQ ID NO: 683322 - DNA, 20 bp, mouse
ggcccaccgtggctgagtcc

SEQ ID NO: 683323 - DNA, 20 bp, mouse
gtctctcccgaggagggcgg

SEQ ID NO: 683324 - DNA, 20 bp, mouse
ggccctccgccctccttggc

SEQ ID NO: 683325 - DNA, 20 bp, mouse
gtgggagcggaggggtgtcc

SEQ ID NO: 683326 - DNA, 20 bp, mouse
gacaaaggaaggagactcaa

SEQ ID NO: 683327 - DNA, 20 bp, mouse
ggcgcgctccacaagcgcgg

SEQ ID NO: 683328 - DNA, 20 bp, mouse
ggcgcagcgcggtcacgccc

SEQ ID NO: 683329 - DNA, 20 bp, mouse
gcgagagcgcggatgcccgt

SEQ ID NO: 683330 - DNA, 20 bp, mouse
ggcctcctggggaaaaaccg

SEQ ID NO: 683331 - DNA, 20 bp, mouse
gtgcccgcgcgctacttgtg

SEQ ID NO: 683332 - DNA, 20 bp, mouse
ggctgcgcgctccacaagcg

SEQ ID NO: 683333 - DNA, 20 bp, mouse
gcgctctcggccgcctgtca

SEQ ID NO: 683334 - DNA, 20 bp, mouse
gcgcagctccggtagcccgg

SEQ ID NO: 683335 - DNA, 20 bp, mouse
gcctgtcagggcctggaccc

SEQ ID NO: 683336 - DNA, 20 bp, mouse
gtgagcaagcagggcgctcc

SEQ ID NO: 683337 - DNA, 20 bp, mouse
gtggacagccagtaccccac

SEQ ID NO: 683338 - DNA, 20 bp, mouse
gctcgccctaggccacccgg

SEQ ID NO: 683339 - DNA, 20 bp, mouse
gggtgactcccaagtcaagg

SEQ ID NO: 683340 - DNA, 20 bp, mouse
ggagagagaagagatcctgt

SEQ ID NO: 683341 - DNA, 20 bp, mouse
ggggtggcctagggcgaggc

SEQ ID NO: 683342 - DNA, 20 bp, mouse
gaccgcccccgggtggccta

SEQ ID NO: 683343 - DNA, 20 bp, mouse
gcagccttggcagagggaat

SEQ ID NO: 683344 - DNA, 20 bp, mouse
ggcgctccaggagagctagc

SEQ ID NO: 683345 - DNA, 20 bp, mouse
gcctcgccccgcctcgccct

SEQ ID NO: 683346 - DNA, 20 bp, mouse
gtgtcactgccgtgccgaat

SEQ ID NO: 683347 - DNA, 20 bp, mouse
gtcggcacggcagtgacagt

SEQ ID NO: 683348 - DNA, 20 bp, mouse
gaaggtaaagcaaccctcgg

SEQ ID NO: 683349 - DNA, 20 bp, mouse
gccgccaagaaagactcgaa

SEQ ID NO: 683350 - DNA, 20 bp, mouse
ggacacggggaaggctgcta

SEQ ID NO: 683351 - DNA, 20 bp, mouse
ggcggcccggaacctggaag

SEQ ID NO: 683352 - DNA, 20 bp, mouse
gaagactcgaaaggtaaaga

SEQ ID NO: 683353 - DNA, 20 bp, mouse
gaaaaaaagagtctcctccg

SEQ ID NO: 683354 - DNA, 20 bp, mouse
ggcccggaacctggaagggg

SEQ ID NO: 683355 - DNA, 20 bp, mouse
ggagatcagccgattcggca

SEQ ID NO: 683356 - DNA, 20 bp, mouse
gcctgcgccgagggggagaa

SEQ ID NO: 683357 - DNA, 20 bp, mouse
gagcgccgagcgcaggtccg

SEQ ID NO: 683358 - DNA, 20 bp, mouse
ggatcggaaatcaactacta

SEQ ID NO: 683359 - DNA, 20 bp, mouse
ggggaagggcgtccggaggt

SEQ ID NO: 683360 - DNA, 20 bp, mouse
gaatctagtcccagtggccg

SEQ ID NO: 683361 - DNA, 20 bp, mouse
gctgcgcgcctgcgccgagg

SEQ ID NO: 683362 - DNA, 20 bp, mouse
ggccgagggggagaatgggt

SEQ ID NO: 683363 - DNA, 20 bp, mouse
ggggggggggcaccgacctc

SEQ ID NO: 683364 - DNA, 20 bp, mouse
gctagcacagcctcctccct

SEQ ID NO: 683365 - DNA, 20 bp, mouse
gtctccgggcggctcctgaa

SEQ ID NO: 683366 - DNA, 20 bp, mouse
gggctccgcccctacctcaa

SEQ ID NO: 683367 - DNA, 20 bp, mouse
gaggtaggggcggagccaat

SEQ ID NO: 683368 - DNA, 20 bp, mouse
ggcaccgcctacccataggc

SEQ ID NO: 683369 - DNA, 20 bp, mouse
gttaaaccaagggacttggg

SEQ ID NO: 683370 - DNA, 20 bp, mouse
gcaaaggacccttgaggtag

SEQ ID NO: 683371 - DNA, 20 bp, mouse
gaggacccttgaggtagggg

SEQ ID NO: 683372 - DNA, 20 bp, mouse
gtgaccctgggcgccacttc

SEQ ID NO: 683373 - DNA, 20 bp, mouse
gtctgtggaggaaccaaggc

SEQ ID NO: 683374 - DNA, 20 bp, mouse
gctgcgcaccgcctacccat

SEQ ID NO: 683375 - DNA, 20 bp, mouse
ggatctgcccgcatctgtgg

SEQ ID NO: 683376 - DNA, 20 bp, mouse
gaatgctgggcggatgcaaa

SEQ ID NO: 683377 - DNA, 20 bp, mouse
gctagactacaaaagcagtt

SEQ ID NO: 683378 - DNA, 20 bp, mouse
ggactggaaagggtggagac

SEQ ID NO: 683379 - DNA, 20 bp, mouse
gagggggccgataaagtttc

SEQ ID NO: 683380 - DNA, 20 bp, mouse
gaaaagcagtttggaatgct

SEQ ID NO: 683381 - DNA, 20 bp, mouse
gcttacaaacaagactggaa

SEQ ID NO: 683382 - DNA, 20 bp, mouse
gatctaatgtgggtgtcagc

SEQ ID NO: 683383 - DNA, 20 bp, mouse
gacacccacattagatcata

SEQ ID NO: 683384 - DNA, 20 bp, mouse
gccttgctttggagatgtgt

SEQ ID NO: 683385 - DNA, 20 bp, mouse
gcttccatagaattactcct

SEQ ID NO: 683386 - DNA, 20 bp, mouse
ggccggtaggcggaagtgga

SEQ ID NO: 683387 - DNA, 20 bp, mouse
ggacgcggcccgaagaaaat

SEQ ID NO: 683388 - DNA, 20 bp, mouse
gaacctgactcctgccgggg

SEQ ID NO: 683389 - DNA, 20 bp, mouse
gcacctggcggggtgtgaac

SEQ ID NO: 683390 - DNA, 20 bp, mouse
gccgaagaaaatcggaacca

SEQ ID NO: 683391 - DNA, 20 bp, mouse
ggagccgtgagctgatagtc

SEQ ID NO: 683392 - DNA, 20 bp, mouse
gcgcgggggcctgtctcttc

SEQ ID NO: 683393 - DNA, 20 bp, mouse
gcgcgtctgccggaagagac

SEQ ID NO: 683394 - DNA, 20 bp, mouse
ggagacctctctcacctggc

SEQ ID NO: 683395 - DNA, 20 bp, mouse
gtcctgtgcgccaggagccc

SEQ ID NO: 683396 - DNA, 20 bp, mouse
gaagagctctgcaaaggcgt

SEQ ID NO: 683397 - DNA, 20 bp, mouse
gtggccgggtcctctcgcgg

SEQ ID NO: 683398 - DNA, 20 bp, mouse
gccaaagaagagctctgcaa

SEQ ID NO: 683399 - DNA, 20 bp, mouse
gcgatggccgggtcctctcg

SEQ ID NO: 683400 - DNA, 20 bp, mouse
ggctaggcttcgctaatcga

SEQ ID NO: 683401 - DNA, 20 bp, mouse
ggctcggcggtcgattgagg

SEQ ID NO: 683402 - DNA, 20 bp, mouse
ggcgtgggccgtattcaaga

SEQ ID NO: 683403 - DNA, 20 bp, mouse
ggattagcgaagcctagccc

SEQ ID NO: 683404 - DNA, 20 bp, mouse
gaaaacgggcttccttgagc

SEQ ID NO: 683405 - DNA, 20 bp, mouse
gcacagcggcaagaatacac

SEQ ID NO: 683406 - DNA, 20 bp, mouse
gccggcgtgcactcagtcaa

SEQ ID NO: 683407 - DNA, 20 bp, mouse
gaagcctgattggagcccac

SEQ ID NO: 683408 - DNA, 20 bp, mouse
gtggcccgtgggctccaatc

SEQ ID NO: 683409 - DNA, 20 bp, mouse
gtgcactcagtcaaaggcgg

SEQ ID NO: 683410 - DNA, 20 bp, mouse
ggaaaggcccaatgtcaagc

SEQ ID NO: 683411 - DNA, 20 bp, mouse
gagatgctggggcgtgtatg

SEQ ID NO: 683412 - DNA, 20 bp, mouse
gacgcaggcgcaaacacacc

SEQ ID NO: 683413 - DNA, 20 bp, mouse
ggggcgtgtatgtggaagag

SEQ ID NO: 683414 - DNA, 20 bp, mouse
gggcgaggggcggagccctg

SEQ ID NO: 683415 - DNA, 20 bp, mouse
ggcgtgcactcagtcaaagg

SEQ ID NO: 683416 - DNA, 20 bp, mouse
gtgcttgaagaacaaagaag

SEQ ID NO: 683417 - DNA, 20 bp, mouse
ggttcttcaagcagggtaga

SEQ ID NO: 683418 - DNA, 20 bp, mouse
gtcagcagccctgttgacgt

SEQ ID NO: 683419 - DNA, 20 bp, mouse
gttggcaaacacagagtgtc

SEQ ID NO: 683420 - DNA, 20 bp, mouse
gcactacagcctacgtcaac

SEQ ID NO: 683421 - DNA, 20 bp, mouse
gcctaggcatgtccttagtc

SEQ ID NO: 683422 - DNA, 20 bp, mouse
gcactctgtgtttgccaact

SEQ ID NO: 683423 - DNA, 20 bp, mouse
gtgtgaagtgtgccagacta

SEQ ID NO: 683424 - DNA, 20 bp, mouse
gagacaggaaggagctggta

SEQ ID NO: 683425 - DNA, 20 bp, mouse
ggtaggctgtagtgccaagt

SEQ ID NO: 683426 - DNA, 20 bp, mouse
gtcagcagccatgtagacgt

SEQ ID NO: 683427 - DNA, 20 bp, mouse
gcttggcaaaacagtgtgtc

SEQ ID NO: 683428 - DNA, 20 bp, mouse
gtttctttaaacagggtaga

SEQ ID NO: 683429 - DNA, 20 bp, mouse
gtgcgaagtgtgccagacca

SEQ ID NO: 683430 - DNA, 20 bp, mouse
gtcttcttttttctttaaac

SEQ ID NO: 683431 - DNA, 20 bp, mouse
gactacagcctacgtctaca

SEQ ID NO: 683432 - DNA, 20 bp, mouse
ggtaggctgtagtgccaact

SEQ ID NO: 683433 - DNA, 20 bp, mouse
gcctaggcaggtccttggtc

SEQ ID NO: 683434 - DNA, 20 bp, mouse
gttgactttagaagttggag

SEQ ID NO: 683435 - DNA, 20 bp, mouse
gaggggcctaggcaggtcct

SEQ ID NO: 683436 - DNA, 20 bp, mouse
gtgcttgaagaacaaagaag

SEQ ID NO: 683437 - DNA, 20 bp, mouse
ggttcttcaagcagggtaga

SEQ ID NO: 683438 - DNA, 20 bp, mouse
gttggcaaatacagagtgtc

SEQ ID NO: 683439 - DNA, 20 bp, mouse
ggtaggctatagtgccaagt

SEQ ID NO: 683440 - DNA, 20 bp, mouse
gtcagcagccctgttgacgt

SEQ ID NO: 683441 - DNA, 20 bp, mouse
gcactatagcctacgtcaac

SEQ ID NO: 683442 - DNA, 20 bp, mouse
gcactctgtatttgccaact

SEQ ID NO: 683443 - DNA, 20 bp, mouse
gtgtgaagtgtgccagacta

SEQ ID NO: 683444 - DNA, 20 bp, mouse
gagacaggaaggagctggtg

SEQ ID NO: 683445 - DNA, 20 bp, mouse
gaggccccagaagcatataa

SEQ ID NO: 683446 - DNA, 20 bp, mouse
gcctagaaggcgatgaggaa

SEQ ID NO: 683447 - DNA, 20 bp, mouse
gaaccagcgaggtcctaacg

SEQ ID NO: 683448 - DNA, 20 bp, mouse
gtcctaacgaggtggagtag

SEQ ID NO: 683449 - DNA, 20 bp, mouse
gccttctaggcaaaagtcat

SEQ ID NO: 683450 - DNA, 20 bp, mouse
gttagcccagctcctgggat

SEQ ID NO: 683451 - DNA, 20 bp, mouse
gcacctcgttaggacctcgc

SEQ ID NO: 683452 - DNA, 20 bp, mouse
gctaggcaaaagtcattgga

SEQ ID NO: 683453 - DNA, 20 bp, mouse
ggaaggaccgcaaggggcgt

SEQ ID NO: 683454 - DNA, 20 bp, mouse
gtgcctgcgcggagcatgcc

SEQ ID NO: 683455 - DNA, 20 bp, mouse
gggaaaccgaaaacactttt

SEQ ID NO: 683456 - DNA, 20 bp, mouse
gaggagaaggtccagaagtc

SEQ ID NO: 683457 - DNA, 20 bp, mouse
gcaggcagcaagggtcccta

SEQ ID NO: 683458 - DNA, 20 bp, mouse
gccaccctccagtgtcgtgt

SEQ ID NO: 683459 - DNA, 20 bp, mouse
gccagccgggtgtccacctg

SEQ ID NO: 683460 - DNA, 20 bp, mouse
ggccccgacacgacactgga

SEQ ID NO: 683461 - DNA, 20 bp, mouse
ggggccccgtggaaggacaa

SEQ ID NO: 683462 - DNA, 20 bp, mouse
gagaaggtccagaagtcagg

SEQ ID NO: 683463 - DNA, 20 bp, mouse
ggggaagccagcgttaggat

SEQ ID NO: 683464 - DNA, 20 bp, mouse
ggtggacacccggctgggta

SEQ ID NO: 683465 - DNA, 20 bp, mouse
gtggctccaagtgaatgatt

SEQ ID NO: 683466 - DNA, 20 bp, mouse
ggaggggtccagcacggcac

SEQ ID NO: 683467 - DNA, 20 bp, mouse
gggtaaagccacaggtacta

SEQ ID NO: 683468 - DNA, 20 bp, mouse
gtctaggagcccaaaggcgg

SEQ ID NO: 683469 - DNA, 20 bp, mouse
gagcccaaaggcggtggcca

SEQ ID NO: 683470 - DNA, 20 bp, mouse
ggggaaggacacagcccctt

SEQ ID NO: 683471 - DNA, 20 bp, mouse
gaaaacatcagcgttgacta

SEQ ID NO: 683472 - DNA, 20 bp, mouse
gagctctaggagcccaaagg

SEQ ID NO: 683473 - DNA, 20 bp, mouse
ggtacctgtggctttaccgt

SEQ ID NO: 683474 - DNA, 20 bp, mouse
gggtcaccaggcagccaaag

SEQ ID NO: 683475 - DNA, 20 bp, mouse
gaccacggcccgtgccgtgc

SEQ ID NO: 683476 - DNA, 20 bp, mouse
gttcctagggttaatgtcta

SEQ ID NO: 683477 - DNA, 20 bp, mouse
gaggggaactggacatgaga

SEQ ID NO: 683478 - DNA, 20 bp, mouse
gtggacatgagaaggtaggt

SEQ ID NO: 683479 - DNA, 20 bp, mouse
gaaatgagaagattgattca

SEQ ID NO: 683480 - DNA, 20 bp, mouse
gaatctgccctccccatggc

SEQ ID NO: 683481 - DNA, 20 bp, mouse
gctagtagcttcagagctat

SEQ ID NO: 683482 - DNA, 20 bp, mouse
gagctgaaaagtcagatttc

SEQ ID NO: 683483 - DNA, 20 bp, mouse
gcttaatataggtcagggaa

SEQ ID NO: 683484 - DNA, 20 bp, mouse
gtgtcatcaagggtaaaaac

SEQ ID NO: 683485 - DNA, 20 bp, mouse
ggcagattggtcttgccctc

SEQ ID NO: 683486 - DNA, 20 bp, mouse
ggggagaagccatcattaag

SEQ ID NO: 683487 - DNA, 20 bp, mouse
gaagccacggggccctggtg

SEQ ID NO: 683488 - DNA, 20 bp, mouse
gacacatgagcccaataaag

SEQ ID NO: 683489 - DNA, 20 bp, mouse
gaagtctgaggtcacaagct

SEQ ID NO: 683490 - DNA, 20 bp, mouse
gggccctggtggggcacggg

SEQ ID NO: 683491 - DNA, 20 bp, mouse
gtcaaggcaattaaggtcaa

SEQ ID NO: 683492 - DNA, 20 bp, mouse
ggggtcatgtgctaacaaag

SEQ ID NO: 683493 - DNA, 20 bp, mouse
gccccccccgtgccccacca

SEQ ID NO: 683494 - DNA, 20 bp, mouse
gcaattaaggtcaagggcta

SEQ ID NO: 683495 - DNA, 20 bp, mouse
gtcgccaagccacggggccc

SEQ ID NO: 683496 - DNA, 20 bp, mouse
gccccctgcgggataagctc

SEQ ID NO: 683497 - DNA, 20 bp, mouse
gagcccatgcctgcaccaat

SEQ ID NO: 683498 - DNA, 20 bp, mouse
gtcccagtgaggtttgtcct

SEQ ID NO: 683499 - DNA, 20 bp, mouse
ggagccagagcttatcccgc

SEQ ID NO: 683500 - DNA, 20 bp, mouse
gcccccattggtgcaggcat

SEQ ID NO: 683501 - DNA, 20 bp, mouse
ggacactgaggtccccctgc

SEQ ID NO: 683502 - DNA, 20 bp, mouse
ggcccaggacaaacctcact

SEQ ID NO: 683503 - DNA, 20 bp, mouse
gtggtgcaggcatgggctca

SEQ ID NO: 683504 - DNA, 20 bp, mouse
gaagttggtgatggattgag

SEQ ID NO: 683505 - DNA, 20 bp, mouse
gttaggcccgtgggtgggtg

SEQ ID NO: 683506 - DNA, 20 bp, mouse
ggcactgagctagacacctg

SEQ ID NO: 683507 - DNA, 20 bp, mouse
gcggggcagcaagtccggag

SEQ ID NO: 683508 - DNA, 20 bp, mouse
gctgctggaggaggatctta

SEQ ID NO: 683509 - DNA, 20 bp, mouse
gtcagctagggcgaggcagc

SEQ ID NO: 683510 - DNA, 20 bp, mouse
gtacgtctgggaagtggatt

SEQ ID NO: 683511 - DNA, 20 bp, mouse
gcggggtgaacgccctctgc

SEQ ID NO: 683512 - DNA, 20 bp, mouse
ggacaaggtctcgccaagcg

SEQ ID NO: 683513 - DNA, 20 bp, mouse
ggcgcgcagggcagtccgtg

SEQ ID NO: 683514 - DNA, 20 bp, mouse
gggtgaacgccctctgctgg

SEQ ID NO: 683515 - DNA, 20 bp, mouse
gggcgagaccttgtcagcta

SEQ ID NO: 683516 - DNA, 20 bp, mouse
ggcgacagggaatgaggtaa

SEQ ID NO: 683517 - DNA, 20 bp, mouse
gatgtagtcccggtcttctg

SEQ ID NO: 683518 - DNA, 20 bp, mouse
gcccctggacaggctgggat

SEQ ID NO: 683519 - DNA, 20 bp, mouse
gagggaatgaggtaatggcg

SEQ ID NO: 683520 - DNA, 20 bp, mouse
gagacgccgcctagcattgt

SEQ ID NO: 683521 - DNA, 20 bp, mouse
gcaaaagtcgcgaggacagc

SEQ ID NO: 683522 - DNA, 20 bp, mouse
ggtgagagcgacagggaatg

SEQ ID NO: 683523 - DNA, 20 bp, mouse
ggggattggtgagagcgaca

SEQ ID NO: 683524 - DNA, 20 bp, mouse
gcagccggctaccacacccc

SEQ ID NO: 683525 - DNA, 20 bp, mouse
gacgataaggggagcggcgg

SEQ ID NO: 683526 - DNA, 20 bp, mouse
gaggacccagaacgttacct

SEQ ID NO: 683527 - DNA, 20 bp, mouse
ggttacctaggtaacgttct

SEQ ID NO: 683528 - DNA, 20 bp, mouse
gtggaaaccagggtagaact

SEQ ID NO: 683529 - DNA, 20 bp, mouse
gctgggtcctagttctaccc

SEQ ID NO: 683530 - DNA, 20 bp, mouse
gaagctgcctactgatctat

SEQ ID NO: 683531 - DNA, 20 bp, mouse
gaaccgatgtcaaagcaatc

SEQ ID NO: 683532 - DNA, 20 bp, mouse
gtcccaccctcaggctgttc

SEQ ID NO: 683533 - DNA, 20 bp, mouse
gcgtgacggtgctctcggat

SEQ ID NO: 683534 - DNA, 20 bp, mouse
gtccgcctaaataagaagac

SEQ ID NO: 683535 - DNA, 20 bp, mouse
gcaaagcaatctggttacct

SEQ ID NO: 683536 - DNA, 20 bp, mouse
gctccaggaaacgaggagtg

SEQ ID NO: 683537 - DNA, 20 bp, mouse
ggccaaggctccaggaaacg

SEQ ID NO: 683538 - DNA, 20 bp, mouse
gtgcgcagagcaccccagga

SEQ ID NO: 683539 - DNA, 20 bp, mouse
ggacgcggggagggaagcgc

SEQ ID NO: 683540 - DNA, 20 bp, mouse
gtaaaaggcgtaggggacgc

SEQ ID NO: 683541 - DNA, 20 bp, mouse
ggggtctgtggcaaggtcgt

SEQ ID NO: 683542 - DNA, 20 bp, mouse
gtccaagtccaagtccagac

SEQ ID NO: 683543 - DNA, 20 bp, mouse
gccgggctgtgtcacgtgac

SEQ ID NO: 683544 - DNA, 20 bp, mouse
ggacttgcgcagagcacccc

SEQ ID NO: 683545 - DNA, 20 bp, mouse
gccgcaacgtcctgctgggt

SEQ ID NO: 683546 - DNA, 20 bp, mouse
gtggctcggcaggaacatag

SEQ ID NO: 683547 - DNA, 20 bp, mouse
gctagcgcgcggaacctgtg

SEQ ID NO: 683548 - DNA, 20 bp, mouse
gggtcacggggacccagcca

SEQ ID NO: 683549 - DNA, 20 bp, mouse
gggaacctgtgtggctcggc

SEQ ID NO: 683550 - DNA, 20 bp, mouse
gaggtccccgttcttcccag

SEQ ID NO: 683551 - DNA, 20 bp, mouse
gctcggcaggaacatagtgg

SEQ ID NO: 683552 - DNA, 20 bp, mouse
gagagtcgaatgagagtcca

SEQ ID NO: 683553 - DNA, 20 bp, mouse
gagcgaacagaggttttaat

SEQ ID NO: 683554 - DNA, 20 bp, mouse
gtgttcctgccgagccacac

SEQ ID NO: 683555 - DNA, 20 bp, mouse
ggctgggtccccgtgaccac

SEQ ID NO: 683556 - DNA, 20 bp, mouse
ggatggggttaggatagact

SEQ ID NO: 683557 - DNA, 20 bp, mouse
gagagcgatgatctctgcat

SEQ ID NO: 683558 - DNA, 20 bp, mouse
gaacttaacgataaggatca

SEQ ID NO: 683559 - DNA, 20 bp, mouse
ggatcagggctgatggggtt

SEQ ID NO: 683560 - DNA, 20 bp, mouse
gatggtttgcttttcggggt

SEQ ID NO: 683561 - DNA, 20 bp, mouse
ggcagagcctggcacggcct

SEQ ID NO: 683562 - DNA, 20 bp, mouse
gagcagaaggcgggtctctc

SEQ ID NO: 683563 - DNA, 20 bp, mouse
ggaggatggtttgcttttcg

SEQ ID NO: 683564 - DNA, 20 bp, mouse
gggttcgcgcttgcgtgctg

SEQ ID NO: 683565 - DNA, 20 bp, mouse
ggaaaaaacgactttccagg

SEQ ID NO: 683566 - DNA, 20 bp, mouse
gcctgggcggaagaactcga

SEQ ID NO: 683567 - DNA, 20 bp, mouse
gctacggcccgccccttctc

SEQ ID NO: 683568 - DNA, 20 bp, mouse
gcggcctgaaccaatctgaa

SEQ ID NO: 683569 - DNA, 20 bp, mouse
gaagaactcgagggcacaga

SEQ ID NO: 683570 - DNA, 20 bp, mouse
gtctcagtgcgttcccgggg

SEQ ID NO: 683571 - DNA, 20 bp, mouse
gactcccttcagattggttc

SEQ ID NO: 683572 - DNA, 20 bp, mouse
gcctttaagaagtttcgcct

SEQ ID NO: 683573 - DNA, 20 bp, mouse
ggacaggtacaaattcaatc

SEQ ID NO: 683574 - DNA, 20 bp, mouse
gaagcaagtcacgtcgcatt

SEQ ID NO: 683575 - DNA, 20 bp, mouse
gagatggcgccaaagtgaaa

SEQ ID NO: 683576 - DNA, 20 bp, mouse
gacgagggcgccctgagtgg

SEQ ID NO: 683577 - DNA, 20 bp, mouse
gggcggccgcgggcacagtg

SEQ ID NO: 683578 - DNA, 20 bp, mouse
gcgcccggccgctcgtgcca

SEQ ID NO: 683579 - DNA, 20 bp, mouse
gcacgctgagacccgcgcgg

SEQ ID NO: 683580 - DNA, 20 bp, mouse
gcaggacgcggccgtgacga

SEQ ID NO: 683581 - DNA, 20 bp, mouse
gccggcatccgtggcacgag

SEQ ID NO: 683582 - DNA, 20 bp, mouse
gcatccgtggcacgagcggc

SEQ ID NO: 683583 - DNA, 20 bp, mouse
gcacagtgaggacgaagcgc

SEQ ID NO: 683584 - DNA, 20 bp, mouse
gacacacgctgagacccgcg

SEQ ID NO: 683585 - DNA, 20 bp, mouse
ggtgacgagggcgccctgag

SEQ ID NO: 683586 - DNA, 20 bp, mouse
gagcccccccagtcacctga

SEQ ID NO: 683587 - DNA, 20 bp, mouse
gggggggctcgctccgtctt

SEQ ID NO: 683588 - DNA, 20 bp, mouse
gcgcgccgcgcgaaggacga

SEQ ID NO: 683589 - DNA, 20 bp, mouse
gtcccttcaggtgactgggg

SEQ ID NO: 683590 - DNA, 20 bp, mouse
gggacgacggagctgtccat

SEQ ID NO: 683591 - DNA, 20 bp, mouse
gagctccgaggcacagcgtt

SEQ ID NO: 683592 - DNA, 20 bp, mouse
ggcgtcggggaactctcgat

SEQ ID NO: 683593 - DNA, 20 bp, mouse
gcgcctgcgcagaggaagag

SEQ ID NO: 683594 - DNA, 20 bp, mouse
gcgcagctggaaagtaggtg

SEQ ID NO: 683595 - DNA, 20 bp, mouse
gcgtgcatcgcgccgcgcga

SEQ ID NO: 683596 - DNA, 20 bp, mouse
ggctcgaggagggagagaat

SEQ ID NO: 683597 - DNA, 20 bp, mouse
gccggccgctggctcgagga

SEQ ID NO: 683598 - DNA, 20 bp, mouse
ggggcaaggggataacgaaa

SEQ ID NO: 683599 - DNA, 20 bp, mouse
gaggggcggggacaggaacg

SEQ ID NO: 683600 - DNA, 20 bp, mouse
gcgaagccgtctccaagtaa

SEQ ID NO: 683601 - DNA, 20 bp, mouse
ggcggccgcggtggcagaaa

SEQ ID NO: 683602 - DNA, 20 bp, mouse
gccgtctccaagtaagggca

SEQ ID NO: 683603 - DNA, 20 bp, mouse
gcagcggccggcggggttac

SEQ ID NO: 683604 - DNA, 20 bp, mouse
gcggtgggctgcagatgagg

SEQ ID NO: 683605 - DNA, 20 bp, mouse
gtccaagtaagggcaaggcg

SEQ ID NO: 683606 - DNA, 20 bp, mouse
ggggtccgaaagcgcgtgga

SEQ ID NO: 683607 - DNA, 20 bp, mouse
gggcgcaaccagcacttctt

SEQ ID NO: 683608 - DNA, 20 bp, mouse
gagccgttgggtccaacctg

SEQ ID NO: 683609 - DNA, 20 bp, mouse
gccgggggaccgcccctctt

SEQ ID NO: 683610 - DNA, 20 bp, mouse
gccgaacagtggcctccacc

SEQ ID NO: 683611 - DNA, 20 bp, mouse
gagccgcaggttggacccaa

SEQ ID NO: 683612 - DNA, 20 bp, mouse
gccctagactgcaacgtgat

SEQ ID NO: 683613 - DNA, 20 bp, mouse
ggcgccgcctgcagctggca

SEQ ID NO: 683614 - DNA, 20 bp, mouse
gcagtggcctccaccagggg

SEQ ID NO: 683615 - DNA, 20 bp, mouse
gaacctgcggctccgaacag

SEQ ID NO: 683616 - DNA, 20 bp, mouse
gcctgcagaggcataaacag

SEQ ID NO: 683617 - DNA, 20 bp, mouse
gaggtgggagctgtagtctc

SEQ ID NO: 683618 - DNA, 20 bp, mouse
gagccccactcccaactcca

SEQ ID NO: 683619 - DNA, 20 bp, mouse
gtggagctgtggcacgttag

SEQ ID NO: 683620 - DNA, 20 bp, mouse
gacaagcttcatcaagagtt

SEQ ID NO: 683621 - DNA, 20 bp, mouse
gagctcctggggttgccgtg

SEQ ID NO: 683622 - DNA, 20 bp, mouse
ggacaaaggggatggaacga

SEQ ID NO: 683623 - DNA, 20 bp, mouse
gtcagggaaaaggcagtcgt

SEQ ID NO: 683624 - DNA, 20 bp, mouse
gagaaccaagacaaagggga

SEQ ID NO: 683625 - DNA, 20 bp, mouse
gtcacatgctccttggagtt

SEQ ID NO: 683626 - DNA, 20 bp, mouse
ggctggcgagcgaagtaatc

SEQ ID NO: 683627 - DNA, 20 bp, mouse
gacacccgaaaaaactggag

SEQ ID NO: 683628 - DNA, 20 bp, mouse
gtctccggagattttctggc

SEQ ID NO: 683629 - DNA, 20 bp, mouse
gcatgagggagaaaaggaca

SEQ ID NO: 683630 - DNA, 20 bp, mouse
gagaaaatctccggagattc

SEQ ID NO: 683631 - DNA, 20 bp, mouse
gtctagaaaggacttcccgc

SEQ ID NO: 683632 - DNA, 20 bp, mouse
gacccggaagcggatggctc

SEQ ID NO: 683633 - DNA, 20 bp, mouse
ggaccggaagtgacgtagaa

SEQ ID NO: 683634 - DNA, 20 bp, mouse
ggcggttgcacgtcaggagt

SEQ ID NO: 683635 - DNA, 20 bp, mouse
gaaacccgccagaaaatctc

SEQ ID NO: 683636 - DNA, 20 bp, mouse
gcctgcattaacagctagaa

SEQ ID NO: 683637 - DNA, 20 bp, mouse
gataacgcacaggaaattgc

SEQ ID NO: 683638 - DNA, 20 bp, mouse
gcaaggcactaggacctaga

SEQ ID NO: 683639 - DNA, 20 bp, mouse
gtaattaatcataggaggtt

SEQ ID NO: 683640 - DNA, 20 bp, mouse
gaaagcatgtaattaatcat

SEQ ID NO: 683641 - DNA, 20 bp, mouse
gcaagaaattcctgccaggg

SEQ ID NO: 683642 - DNA, 20 bp, mouse
gaacaaaggcatagagagat

SEQ ID NO: 683643 - DNA, 20 bp, mouse
gactcgaaagccccactcac

SEQ ID NO: 683644 - DNA, 20 bp, mouse
gccactcaccggttttctgc

SEQ ID NO: 683645 - DNA, 20 bp, mouse
gagtccagccactaggcaga

SEQ ID NO: 683646 - DNA, 20 bp, mouse
gagtgggcgtgaccgaggca

SEQ ID NO: 683647 - DNA, 20 bp, mouse
ggcaaggctgtcctaaccaa

SEQ ID NO: 683648 - DNA, 20 bp, mouse
gaaaataaaagtgccttctg

SEQ ID NO: 683649 - DNA, 20 bp, mouse
gagactgacccaactataga

SEQ ID NO: 683650 - DNA, 20 bp, mouse
gtgattggctgaatgggagt

SEQ ID NO: 683651 - DNA, 20 bp, mouse
gatgggctgtgtcttgaaaa

SEQ ID NO: 683652 - DNA, 20 bp, mouse
gtggtgctgattggctgaat

SEQ ID NO: 683653 - DNA, 20 bp, mouse
ggattctgccctctatagtt

SEQ ID NO: 683654 - DNA, 20 bp, mouse
gcaagatggacctggagttc

SEQ ID NO: 683655 - DNA, 20 bp, mouse
gctatccccaggcccgggag

SEQ ID NO: 683656 - DNA, 20 bp, mouse
gcaaccgaactcgacgacga

SEQ ID NO: 683657 - DNA, 20 bp, mouse
ggacccgcgcgatgcgtcct

SEQ ID NO: 683658 - DNA, 20 bp, mouse
ggcgggtcgccacccacgtc

SEQ ID NO: 683659 - DNA, 20 bp, mouse
gaagggcggggccaccacgc

SEQ ID NO: 683660 - DNA, 20 bp, mouse
ggaagtaagaacttgagatc

SEQ ID NO: 683661 - DNA, 20 bp, mouse
ggcgcccgacgcgctcccat

SEQ ID NO: 683662 - DNA, 20 bp, mouse
gccgccttcgtcgtcgagtt

SEQ ID NO: 683663 - DNA, 20 bp, mouse
gcagagccctgccgcatcgc

SEQ ID NO: 683664 - DNA, 20 bp, mouse
ggccgcgcagctcactccga

SEQ ID NO: 683665 - DNA, 20 bp, mouse
gcgggcgcggccgccgtgaa

SEQ ID NO: 683666 - DNA, 20 bp, mouse
gtcctcatggggaccatgtg

SEQ ID NO: 683667 - DNA, 20 bp, mouse
gcccgcagcagcacattcat

SEQ ID NO: 683668 - DNA, 20 bp, mouse
gtgggtcaatcgggatgcgg

SEQ ID NO: 683669 - DNA, 20 bp, mouse
ggtgaggcgtgcacctgcgg

SEQ ID NO: 683670 - DNA, 20 bp, mouse
gagaccggcctgggtcaatc

SEQ ID NO: 683671 - DNA, 20 bp, mouse
gcggtgggatacacacacca

SEQ ID NO: 683672 - DNA, 20 bp, mouse
gggccggcgcccggagctct

SEQ ID NO: 683673 - DNA, 20 bp, mouse
gcggcagatgcggagagcat

SEQ ID NO: 683674 - DNA, 20 bp, mouse
gatgcggagagcataggaat

SEQ ID NO: 683675 - DNA, 20 bp, mouse
gtgggatacacacaccacgg

SEQ ID NO: 683676 - DNA, 20 bp, mouse
ggggctagcaggatcagggt

SEQ ID NO: 683677 - DNA, 20 bp, mouse
gggccgcgcccattcctcca

SEQ ID NO: 683678 - DNA, 20 bp, mouse
gcggcctagcagggcggaat

SEQ ID NO: 683679 - DNA, 20 bp, mouse
gcggtgcctgagttcaggga

SEQ ID NO: 683680 - DNA, 20 bp, mouse
ggggctccaaatgaagagaa

SEQ ID NO: 683681 - DNA, 20 bp, mouse
ggcctgagttcagggaaggg

SEQ ID NO: 683682 - DNA, 20 bp, mouse
gcctgctagccctggctgtg

SEQ ID NO: 683683 - DNA, 20 bp, mouse
gcgggggcgcgatggtctgg

SEQ ID NO: 683684 - DNA, 20 bp, mouse
gcacgtacgacgatggggcg

SEQ ID NO: 683685 - DNA, 20 bp, mouse
ggattgtaaccccacagcca

SEQ ID NO: 683686 - DNA, 20 bp, mouse
gcgggtactgcgacctctgg

SEQ ID NO: 683687 - DNA, 20 bp, mouse
gagggcgtagcagaccaaag

SEQ ID NO: 683688 - DNA, 20 bp, mouse
gaggagaaggcgggacctca

SEQ ID NO: 683689 - DNA, 20 bp, mouse
gtgaggaaggggcgcggatc

SEQ ID NO: 683690 - DNA, 20 bp, mouse
ggccaggcgcagaggatcac

SEQ ID NO: 683691 - DNA, 20 bp, mouse
gagcgagagtaccggtacgc

SEQ ID NO: 683692 - DNA, 20 bp, mouse
ggaggcagcagccacggagt

SEQ ID NO: 683693 - DNA, 20 bp, mouse
gctggcctgcaacgtgtctc

SEQ ID NO: 683694 - DNA, 20 bp, mouse
ggggcggggcctcgcttggt

SEQ ID NO: 683695 - DNA, 20 bp, mouse
gtggtctgctacgccctaag

SEQ ID NO: 683696 - DNA, 20 bp, mouse
ggcagtccggggcagttccg

SEQ ID NO: 683697 - DNA, 20 bp, mouse
ggggccgtgcccgaggggtt

SEQ ID NO: 683698 - DNA, 20 bp, mouse
gcggactgccccaacccctc

SEQ ID NO: 683699 - DNA, 20 bp, mouse
gtcgggattgccacagtagg

SEQ ID NO: 683700 - DNA, 20 bp, mouse
gtgagctgcacacgttactc

SEQ ID NO: 683701 - DNA, 20 bp, mouse
ggtaacgtgtgcagctcaca

SEQ ID NO: 683702 - DNA, 20 bp, mouse
ggggggcgggccgtgcccga

SEQ ID NO: 683703 - DNA, 20 bp, mouse
ggcacacgttactccggaag

SEQ ID NO: 683704 - DNA, 20 bp, mouse
gtgccccaacccctcgggca

SEQ ID NO: 683705 - DNA, 20 bp, mouse
ggcaagacagccccctactg

SEQ ID NO: 683706 - DNA, 20 bp, mouse
gtcactgggtgagatttctt

SEQ ID NO: 683707 - DNA, 20 bp, mouse
gagaaagagccaagctgtca

SEQ ID NO: 683708 - DNA, 20 bp, mouse
gaaggcgtgtagcccttctt

SEQ ID NO: 683709 - DNA, 20 bp, mouse
gtctgctggtataaaggtca

SEQ ID NO: 683710 - DNA, 20 bp, mouse
gtgttgtgaatcaagctcac

SEQ ID NO: 683711 - DNA, 20 bp, mouse
gacagcctttgcccaacaca

SEQ ID NO: 683712 - DNA, 20 bp, mouse
gacactaagtgtatgaaatc

SEQ ID NO: 683713 - DNA, 20 bp, mouse
gcaacccctgtgttgggcaa

SEQ ID NO: 683714 - DNA, 20 bp, mouse
gtgtgtgagaaagcattaga

SEQ ID NO: 683715 - DNA, 20 bp, mouse
ggtctctagggccagacaat

SEQ ID NO: 683716 - DNA, 20 bp, mouse
gccagtggatggaatccctg

SEQ ID NO: 683717 - DNA, 20 bp, mouse
ggaacccagactaaagacca

SEQ ID NO: 683718 - DNA, 20 bp, mouse
gcctgcggatggatgaagca

SEQ ID NO: 683719 - DNA, 20 bp, mouse
ggtggagcaggaggcataca

SEQ ID NO: 683720 - DNA, 20 bp, mouse
gtaaagaccagggctcctaa

SEQ ID NO: 683721 - DNA, 20 bp, mouse
gctggagagaggcccagaag

SEQ ID NO: 683722 - DNA, 20 bp, mouse
gcactggaattctgatacag

SEQ ID NO: 683723 - DNA, 20 bp, mouse
gggagccctggtctttagtc

SEQ ID NO: 683724 - DNA, 20 bp, mouse
ggaggcccagaagtgggtcc

SEQ ID NO: 683725 - DNA, 20 bp, mouse
ggcaggaggcatacagggag

SEQ ID NO: 683726 - DNA, 20 bp, mouse
gcaggggcgtggaagcgagg

SEQ ID NO: 683727 - DNA, 20 bp, mouse
gtgacccccgcttccaggcg

SEQ ID NO: 683728 - DNA, 20 bp, mouse
ggggtcagacggggtcgcgg

SEQ ID NO: 683729 - DNA, 20 bp, mouse
gccagccgcgcgcgcctccc

SEQ ID NO: 683730 - DNA, 20 bp, mouse
ggcagggctgcgtaacaatg

SEQ ID NO: 683731 - DNA, 20 bp, mouse
gcctggaagcgggggtcaga

SEQ ID NO: 683732 - DNA, 20 bp, mouse
ggggctgcgtaacaatgggg

SEQ ID NO: 683733 - DNA, 20 bp, mouse
gtcactgcggctggcatcca

SEQ ID NO: 683734 - DNA, 20 bp, mouse
gcgtcgaaagtcgtgaggca

SEQ ID NO: 683735 - DNA, 20 bp, mouse
gggagctcccgtttggcgct

SEQ ID NO: 683736 - DNA, 20 bp, mouse
gaaccccggtgggcaggact

SEQ ID NO: 683737 - DNA, 20 bp, mouse
ggggttgccgggacccatga

SEQ ID NO: 683738 - DNA, 20 bp, mouse
ggggcacgcgctaggggcgt

SEQ ID NO: 683739 - DNA, 20 bp, mouse
gggaccttctgacccctcat

SEQ ID NO: 683740 - DNA, 20 bp, mouse
gcctcctgcgggcagacgtc

SEQ ID NO: 683741 - DNA, 20 bp, mouse
gtgcgctgaggctttgaagg

SEQ ID NO: 683742 - DNA, 20 bp, mouse
gcacgcgccgggcacgcgct

SEQ ID NO: 683743 - DNA, 20 bp, mouse
ggggtcccggcaaccccggt

SEQ ID NO: 683744 - DNA, 20 bp, mouse
ggagatgtgcggtgaggact

SEQ ID NO: 683745 - DNA, 20 bp, mouse
gctcctcagcgctccagcgg

SEQ ID NO: 683746 - DNA, 20 bp, mouse
ggaaaaaggatgtagaatac

SEQ ID NO: 683747 - DNA, 20 bp, mouse
gcacacaggtacaccagttt

SEQ ID NO: 683748 - DNA, 20 bp, mouse
ggccatgctgcatcctcagt

SEQ ID NO: 683749 - DNA, 20 bp, mouse
gaggtacaccagtttgggta

SEQ ID NO: 683750 - DNA, 20 bp, mouse
gtgtaactttcacagttcaa

SEQ ID NO: 683751 - DNA, 20 bp, mouse
gatgtagaatacaggccaac

SEQ ID NO: 683752 - DNA, 20 bp, mouse
gcctgcccttgaagacacac

SEQ ID NO: 683753 - DNA, 20 bp, mouse
gatgttaatgtctagcctgt

SEQ ID NO: 683754 - DNA, 20 bp, mouse
gaaaagagactcgagacata

SEQ ID NO: 683755 - DNA, 20 bp, mouse
gtaaataccacagaggttgt

SEQ ID NO: 683756 - DNA, 20 bp, mouse
gccacagcctagcgtcgcga

SEQ ID NO: 683757 - DNA, 20 bp, mouse
gagctcaagcattaaatcgt

SEQ ID NO: 683758 - DNA, 20 bp, mouse
gtcgcacagtaggtccccgt

SEQ ID NO: 683759 - DNA, 20 bp, mouse
gccccgttggatgactaact

SEQ ID NO: 683760 - DNA, 20 bp, mouse
gccgccccgtcgcaacgcca

SEQ ID NO: 683761 - DNA, 20 bp, mouse
ggggcggcccgcgagcttga

SEQ ID NO: 683762 - DNA, 20 bp, mouse
gcgacgctaggctgtggggc

SEQ ID NO: 683763 - DNA, 20 bp, mouse
gcggccgcgctggctgccga

SEQ ID NO: 683764 - DNA, 20 bp, mouse
gcccgcgagcttgacggcag

SEQ ID NO: 683765 - DNA, 20 bp, mouse
gactcactcgctcccgccct

SEQ ID NO: 683766 - DNA, 20 bp, mouse
gcacgcgcaggggacgtcga

SEQ ID NO: 683767 - DNA, 20 bp, mouse
ggggccgtgagactcctgag

SEQ ID NO: 683768 - DNA, 20 bp, mouse
ggggtcacgcggcttcgcgg

SEQ ID NO: 683769 - DNA, 20 bp, mouse
gaggggacgtcgatggtggt

SEQ ID NO: 683770 - DNA, 20 bp, mouse
ggcggaggagagcgcggcga

SEQ ID NO: 683771 - DNA, 20 bp, mouse
gaagccagagggcgcgatgg

SEQ ID NO: 683772 - DNA, 20 bp, mouse
gcgcgtgcgcgcgcggacac

SEQ ID NO: 683773 - DNA, 20 bp, mouse
gtcctgagtggcggatgtaa

SEQ ID NO: 683774 - DNA, 20 bp, mouse
ggcgcaggggacgtcgatgg

SEQ ID NO: 683775 - DNA, 20 bp, mouse
gaggtgcgggaggggggcta

SEQ ID NO: 683776 - DNA, 20 bp, mouse
gaagctaaggcgaggggaga

SEQ ID NO: 683777 - DNA, 20 bp, mouse
gacactcccgggtctcgatt

SEQ ID NO: 683778 - DNA, 20 bp, mouse
gttcggccgggagcgttctg

SEQ ID NO: 683779 - DNA, 20 bp, mouse
ggtggccgaagctaaggcga

SEQ ID NO: 683780 - DNA, 20 bp, mouse
gagggcgctcgcggtagggg

SEQ ID NO: 683781 - DNA, 20 bp, mouse
ggcgttctggggctccgtgg

SEQ ID NO: 683782 - DNA, 20 bp, mouse
gaggggagaggggttcggcc

SEQ ID NO: 683783 - DNA, 20 bp, mouse
gaggtgcgagagggttcgaa

SEQ ID NO: 683784 - DNA, 20 bp, mouse
gtcgcagcccaatcgagacc

SEQ ID NO: 683785 - DNA, 20 bp, mouse
ggccgcgccacggtcccatg

SEQ ID NO: 683786 - DNA, 20 bp, mouse
ggctgatcaccaactcccag

SEQ ID NO: 683787 - DNA, 20 bp, mouse
gcaggcaagcccctgggagt

SEQ ID NO: 683788 - DNA, 20 bp, mouse
gccacctgcgccactcgctc

SEQ ID NO: 683789 - DNA, 20 bp, mouse
ggccccggcccgcccctgca

SEQ ID NO: 683790 - DNA, 20 bp, mouse
gcaggtgtccgcccaaggcg

SEQ ID NO: 683791 - DNA, 20 bp, mouse
ggtgaccagtggccaactca

SEQ ID NO: 683792 - DNA, 20 bp, mouse
gagggagatgctctttagga

SEQ ID NO: 683793 - DNA, 20 bp, mouse
gtggtgatcagcctcgcctt

SEQ ID NO: 683794 - DNA, 20 bp, mouse
gagcagcaggtgtccgccca

SEQ ID NO: 683795 - DNA, 20 bp, mouse
gaatctaggttagtggccga

SEQ ID NO: 683796 - DNA, 20 bp, mouse
gcccactcgcaggtcccatt

SEQ ID NO: 683797 - DNA, 20 bp, mouse
gggaaggggcgtccaatccc

SEQ ID NO: 683798 - DNA, 20 bp, mouse
gggggcggccgtgcacatgg

SEQ ID NO: 683799 - DNA, 20 bp, mouse
gcaggtcccccaagcctaat

SEQ ID NO: 683800 - DNA, 20 bp, mouse
gtcgggaaggatgaagaaat

SEQ ID NO: 683801 - DNA, 20 bp, mouse
gtgtgcacggccgccccctg

SEQ ID NO: 683802 - DNA, 20 bp, mouse
gagcgcggagccgtccacgg

SEQ ID NO: 683803 - DNA, 20 bp, mouse
gaatcccaggccccaggggg

SEQ ID NO: 683804 - DNA, 20 bp, mouse
gagcagcgcggagccgtcca

SEQ ID NO: 683805 - DNA, 20 bp, mouse
gagagagagcactggtggtc

SEQ ID NO: 683806 - DNA, 20 bp, mouse
gacactgtggcatggaccaa

SEQ ID NO: 683807 - DNA, 20 bp, mouse
ggaggcacgtgtaagctctg

SEQ ID NO: 683808 - DNA, 20 bp, mouse
gtacacgtgcctctctcctg

SEQ ID NO: 683809 - DNA, 20 bp, mouse
gcctctctgccaagcctgca

SEQ ID NO: 683810 - DNA, 20 bp, mouse
gtgtggcatggaccaatgga

SEQ ID NO: 683811 - DNA, 20 bp, mouse
gagacaaagacaggtcatag

SEQ ID NO: 683812 - DNA, 20 bp, mouse
gactctgaacaatgcggcag

SEQ ID NO: 683813 - DNA, 20 bp, mouse
gagaggcagacactgtggca

SEQ ID NO: 683814 - DNA, 20 bp, mouse
gtgtttgcatggcaaataaa

SEQ ID NO: 683815 - DNA, 20 bp, mouse
gagccggagaaactccaggc

SEQ ID NO: 683816 - DNA, 20 bp, mouse
gaccggaagtggccctccgg

SEQ ID NO: 683817 - DNA, 20 bp, mouse
gcggggacggaccaagaagc

SEQ ID NO: 683818 - DNA, 20 bp, mouse
gggcgcccggctttgttgat

SEQ ID NO: 683819 - DNA, 20 bp, mouse
gtacccggaccgcttccaag

SEQ ID NO: 683820 - DNA, 20 bp, mouse
gaagaagcagggaacgccac

SEQ ID NO: 683821 - DNA, 20 bp, mouse
gtcttggtccgtccccgcag

SEQ ID NO: 683822 - DNA, 20 bp, mouse
gcaggccagcacctgggcac

SEQ ID NO: 683823 - DNA, 20 bp, mouse
gcagggaacgccaccggaag

SEQ ID NO: 683824 - DNA, 20 bp, mouse
gaagcggtccgggtactccg

SEQ ID NO: 683825 - DNA, 20 bp, mouse
ggcggagtaccacttggaag

SEQ ID NO: 683826 - DNA, 20 bp, mouse
gccaccgcgcggggtcccta

SEQ ID NO: 683827 - DNA, 20 bp, mouse
gcgcactaggagaggagcga

SEQ ID NO: 683828 - DNA, 20 bp, mouse
gggcgccggggcgggagtac

SEQ ID NO: 683829 - DNA, 20 bp, mouse
ggaaccgagcccagaaaaag

SEQ ID NO: 683830 - DNA, 20 bp, mouse
gtaccccagcatcggggtgg

SEQ ID NO: 683831 - DNA, 20 bp, mouse
ggcagggcgggtaccgcact

SEQ ID NO: 683832 - DNA, 20 bp, mouse
gcgtgcggatcacctagtgg

SEQ ID NO: 683833 - DNA, 20 bp, mouse
gggaccccgcgcggtggctc

SEQ ID NO: 683834 - DNA, 20 bp, mouse
gtagtggaggctacgcgctg

SEQ ID NO: 683835 - DNA, 20 bp, mouse
ggggcgtgcggatcacctag

SEQ ID NO: 683836 - DNA, 20 bp, mouse
ggtcccctccctctctgcgg

SEQ ID NO: 683837 - DNA, 20 bp, mouse
ggaggggaggctgagaacta

SEQ ID NO: 683838 - DNA, 20 bp, mouse
gcagcccccgcagagaggga

SEQ ID NO: 683839 - DNA, 20 bp, mouse
gaactatggaacgggaccaa

SEQ ID NO: 683840 - DNA, 20 bp, mouse
gcctctcagcccccgcagag

SEQ ID NO: 683841 - DNA, 20 bp, mouse
gcagacaaaagccactgagg

SEQ ID NO: 683842 - DNA, 20 bp, mouse
gtcagcgaggggagcagagc

SEQ ID NO: 683843 - DNA, 20 bp, mouse
gcagctgccctggccagctg

SEQ ID NO: 683844 - DNA, 20 bp, mouse
gggtcgaaagcagcgttcgc

SEQ ID NO: 683845 - DNA, 20 bp, mouse
ggaccgggcctcctcctcag

SEQ ID NO: 683846 - DNA, 20 bp, mouse
gtaccacggggctccttcac

SEQ ID NO: 683847 - DNA, 20 bp, mouse
gcatggtggcaagaaggcaa

SEQ ID NO: 683848 - DNA, 20 bp, mouse
ggcaggagaaaggcaccgag

SEQ ID NO: 683849 - DNA, 20 bp, mouse
gaatgtgaggtctctctcaa

SEQ ID NO: 683850 - DNA, 20 bp, mouse
gagagagacctcacattctg

SEQ ID NO: 683851 - DNA, 20 bp, mouse
ggagactcgagtcccatcat

SEQ ID NO: 683852 - DNA, 20 bp, mouse
gaagctataagcacaacgtc

SEQ ID NO: 683853 - DNA, 20 bp, mouse
gtggatgtatgcctaccacg

SEQ ID NO: 683854 - DNA, 20 bp, mouse
gcgagtaagaaaaatgaggt

SEQ ID NO: 683855 - DNA, 20 bp, mouse
gaactgcaaacagctctgat

SEQ ID NO: 683856 - DNA, 20 bp, mouse
gtgctcgggaagtggagact

SEQ ID NO: 683857 - DNA, 20 bp, mouse
gaggaggtgccgccgtccca

SEQ ID NO: 683858 - DNA, 20 bp, mouse
ggggcagggcggacggtagt

SEQ ID NO: 683859 - DNA, 20 bp, mouse
gtggctatatggcaacatgg

SEQ ID NO: 683860 - DNA, 20 bp, mouse
ggggactcttcagttaactg

SEQ ID NO: 683861 - DNA, 20 bp, mouse
ggggccctgggtgtatctgg

SEQ ID NO: 683862 - DNA, 20 bp, mouse
ggtggggccctgggtgtatc

SEQ ID NO: 683863 - DNA, 20 bp, mouse
ggcaagcaaatgtggcatca

SEQ ID NO: 683864 - DNA, 20 bp, mouse
gactcgagagggtctgaaga

SEQ ID NO: 683865 - DNA, 20 bp, mouse
gtcctccagccctgggacgg

SEQ ID NO: 683866 - DNA, 20 bp, mouse
gtctgatagccaatctagaa

SEQ ID NO: 683867 - DNA, 20 bp, mouse
gagactcggcccttctagat

SEQ ID NO: 683868 - DNA, 20 bp, mouse
ggcacacgtgacagcggaag

SEQ ID NO: 683869 - DNA, 20 bp, mouse
gagggtcggcgagaacttgt

SEQ ID NO: 683870 - DNA, 20 bp, mouse
gtcaacgaatggcatgttag

SEQ ID NO: 683871 - DNA, 20 bp, mouse
gagaacttgtgggctagggt

SEQ ID NO: 683872 - DNA, 20 bp, mouse
ggaccctcactcacgtcttc

SEQ ID NO: 683873 - DNA, 20 bp, mouse
gagccacctgccgactggga

SEQ ID NO: 683874 - DNA, 20 bp, mouse
gtgccgactgggagggccaa

SEQ ID NO: 683875 - DNA, 20 bp, mouse
gcggctagccgcatacccgc

SEQ ID NO: 683876 - DNA, 20 bp, mouse
gaagatggatatcaataaca

SEQ ID NO: 683877 - DNA, 20 bp, mouse
gccctccgggtggttcactc

SEQ ID NO: 683878 - DNA, 20 bp, mouse
gacccaggagaaaggttccg

SEQ ID NO: 683879 - DNA, 20 bp, mouse
gtaacagggcttggctatta

SEQ ID NO: 683880 - DNA, 20 bp, mouse
gtcctcggaacctttctcct

SEQ ID NO: 683881 - DNA, 20 bp, mouse
gcggacgaggatacagaccc

SEQ ID NO: 683882 - DNA, 20 bp, mouse
gtacatcgtaactctgaaga

SEQ ID NO: 683883 - DNA, 20 bp, mouse
gccctgagtgaaccacccgg

SEQ ID NO: 683884 - DNA, 20 bp, mouse
gcgaggacgaaaagaccctc

SEQ ID NO: 683885 - DNA, 20 bp, mouse
ggagcagagccaagcagttt

SEQ ID NO: 683886 - DNA, 20 bp, mouse
gcccccaagctggggagagt

SEQ ID NO: 683887 - DNA, 20 bp, mouse
gcaggggaaagcgtgcacgg

SEQ ID NO: 683888 - DNA, 20 bp, mouse
gcgccaggggaaagcgtgca

SEQ ID NO: 683889 - DNA, 20 bp, mouse
gaaagcgtgcacggaggaac

SEQ ID NO: 683890 - DNA, 20 bp, mouse
gcggacgatgattggtgatt

SEQ ID NO: 683891 - DNA, 20 bp, mouse
ggggcgatcttaagacgcca

SEQ ID NO: 683892 - DNA, 20 bp, mouse
gggaacccgcccccaagctg

SEQ ID NO: 683893 - DNA, 20 bp, mouse
ggcaatgcgcggacgatgat

SEQ ID NO: 683894 - DNA, 20 bp, mouse
gcggaagccccaagcactct

SEQ ID NO: 683895 - DNA, 20 bp, mouse
gaatgacgacaggcaatgcg

SEQ ID NO: 683896 - DNA, 20 bp, mouse
gcgcaggcgcagtggctcgg

SEQ ID NO: 683897 - DNA, 20 bp, mouse
gcacaaggcccgcggttgag

SEQ ID NO: 683898 - DNA, 20 bp, mouse
gctggctcacagccatcttt

SEQ ID NO: 683899 - DNA, 20 bp, mouse
gcgcgctgccgctcaaccgc

SEQ ID NO: 683900 - DNA, 20 bp, mouse
gacaaaaaaactaatatgga

SEQ ID NO: 683901 - DNA, 20 bp, mouse
gtattgaagcacaaggcccg

SEQ ID NO: 683902 - DNA, 20 bp, mouse
gcgggggcgtggccacgtgg

SEQ ID NO: 683903 - DNA, 20 bp, mouse
gcatccgcaattgcccgaag

SEQ ID NO: 683904 - DNA, 20 bp, mouse
ggcgcagtggctcgggggcg

SEQ ID NO: 683905 - DNA, 20 bp, mouse
gtaaaaagcgcaatatttct

SEQ ID NO: 683906 - DNA, 20 bp, mouse
gttacgtcggtgacggagat

SEQ ID NO: 683907 - DNA, 20 bp, mouse
gaatgtgcgcaaccggcgta

SEQ ID NO: 683908 - DNA, 20 bp, mouse
gagctctagaacgttggctg

SEQ ID NO: 683909 - DNA, 20 bp, mouse
gaccgccagctctagaacgt

SEQ ID NO: 683910 - DNA, 20 bp, mouse
gctgacccgcaatagtgggc

SEQ ID NO: 683911 - DNA, 20 bp, mouse
gccagcgcggcgaaaagcga

SEQ ID NO: 683912 - DNA, 20 bp, mouse
gtacgtaaacagcgtctgga

SEQ ID NO: 683913 - DNA, 20 bp, mouse
gggtcggcccaccttaaaca

SEQ ID NO: 683914 - DNA, 20 bp, mouse
gcggcacgacgtcacagtgt

SEQ ID NO: 683915 - DNA, 20 bp, mouse
ggcgacgccacggacattct

SEQ ID NO: 683916 - DNA, 20 bp, mouse
gagtcgtcctccagtcgcca

SEQ ID NO: 683917 - DNA, 20 bp, mouse
gtggaagacggaattccttg

SEQ ID NO: 683918 - DNA, 20 bp, mouse
gagcgccccctggcgactgg

SEQ ID NO: 683919 - DNA, 20 bp, mouse
gggcacctctctagcagtga

SEQ ID NO: 683920 - DNA, 20 bp, mouse
ggggccattagcaaggcgaa

SEQ ID NO: 683921 - DNA, 20 bp, mouse
ggtgagagctgggttccctt

SEQ ID NO: 683922 - DNA, 20 bp, mouse
gaacccgttcgccttgctaa

SEQ ID NO: 683923 - DNA, 20 bp, mouse
gggggcggaaatgcttcggg

SEQ ID NO: 683924 - DNA, 20 bp, mouse
ggcacaataaaaaagccgat

SEQ ID NO: 683925 - DNA, 20 bp, mouse
gaggaaattcggtctccaaa

SEQ ID NO: 683926 - DNA, 20 bp, mouse
gccccaggaagataagcatg

SEQ ID NO: 683927 - DNA, 20 bp, mouse
gtccgcatgcttatcttcct

SEQ ID NO: 683928 - DNA, 20 bp, mouse
gcctgggggcggagcgtggg

SEQ ID NO: 683929 - DNA, 20 bp, mouse
ggaagacggacgcgcggggc

SEQ ID NO: 683930 - DNA, 20 bp, mouse
gtgggtggaagacggacgcg

SEQ ID NO: 683931 - DNA, 20 bp, mouse
gaaggaggaaaccgagttca

SEQ ID NO: 683932 - DNA, 20 bp, mouse
gcgaacgctctctctcgaga

SEQ ID NO: 683933 - DNA, 20 bp, mouse
gtaggtgttggagattatta

SEQ ID NO: 683934 - DNA, 20 bp, mouse
gtcgaaatgctaaaaagagg

SEQ ID NO: 683935 - DNA, 20 bp, mouse
ggtctcgaaatgctaaaaag

SEQ ID NO: 683936 - DNA, 20 bp, mouse
ggatctgcagcgaagggtga

SEQ ID NO: 683937 - DNA, 20 bp, mouse
gaacccgaagaggacagtag

SEQ ID NO: 683938 - DNA, 20 bp, mouse
gtcgtcctacaacccaactg

SEQ ID NO: 683939 - DNA, 20 bp, mouse
ggcagcgaagggtgatgggt

SEQ ID NO: 683940 - DNA, 20 bp, mouse
ggctacctcagttgggttgt

SEQ ID NO: 683941 - DNA, 20 bp, mouse
ggatgggtgggaacccgaag

SEQ ID NO: 683942 - DNA, 20 bp, mouse
gtccgcgcccctaaggtccg

SEQ ID NO: 683943 - DNA, 20 bp, mouse
ggtaggacgatctgcagcga

SEQ ID NO: 683944 - DNA, 20 bp, mouse
gtaatgctggctacctcagt

SEQ ID NO: 683945 - DNA, 20 bp, mouse
gctggatccccggaccttag

SEQ ID NO: 683946 - DNA, 20 bp, mouse
gaaagaggcgggaagagcga

SEQ ID NO: 683947 - DNA, 20 bp, mouse
gggaggctgtcactctagga

SEQ ID NO: 683948 - DNA, 20 bp, mouse
gagcgggcggcgcccaccaa

SEQ ID NO: 683949 - DNA, 20 bp, mouse
gggggaagaacggaagtcgg

SEQ ID NO: 683950 - DNA, 20 bp, mouse
ggacacgcctggaagcggag

SEQ ID NO: 683951 - DNA, 20 bp, mouse
ggccgcaggcggcaacacac

SEQ ID NO: 683952 - DNA, 20 bp, mouse
gacacggacacgcctggaag

SEQ ID NO: 683953 - DNA, 20 bp, mouse
gcgagggaagatgaggctac

SEQ ID NO: 683954 - DNA, 20 bp, mouse
gggcgccgcgtgcccttggt

SEQ ID NO: 683955 - DNA, 20 bp, mouse
gagtcggaggctgtcactct

SEQ ID NO: 683956 - DNA, 20 bp, mouse
gtgggtgagacccgtgtgtg

SEQ ID NO: 683957 - DNA, 20 bp, mouse
gtcggcaagcggaggcagca

SEQ ID NO: 683958 - DNA, 20 bp, mouse
gaacgacagcgggatcgcca

SEQ ID NO: 683959 - DNA, 20 bp, mouse
gaataggcccggctgagggg

SEQ ID NO: 683960 - DNA, 20 bp, mouse
gctgcgcggtctaacgacag

SEQ ID NO: 683961 - DNA, 20 bp, mouse
gggcagcagggtaagattca

SEQ ID NO: 683962 - DNA, 20 bp, mouse
gacacatcgcagcttttcat

SEQ ID NO: 683963 - DNA, 20 bp, mouse
gcggcggaagtagcgtgtac

SEQ ID NO: 683964 - DNA, 20 bp, mouse
ggctgcggttcgcgcggctt

SEQ ID NO: 683965 - DNA, 20 bp, mouse
gggatcgccacggctagact

SEQ ID NO: 683966 - DNA, 20 bp, mouse
gccctcgcgccgtgcattct

SEQ ID NO: 683967 - DNA, 20 bp, mouse
ggggtaatgtggtttgccaa

SEQ ID NO: 683968 - DNA, 20 bp, mouse
gccaggccgtaaggtcttct

SEQ ID NO: 683969 - DNA, 20 bp, mouse
gaccacgcgagctgacgaat

SEQ ID NO: 683970 - DNA, 20 bp, mouse
ggagggccggccaggccgta

SEQ ID NO: 683971 - DNA, 20 bp, mouse
ggccgggaaagggagttcct

SEQ ID NO: 683972 - DNA, 20 bp, mouse
ggattccagaaagactgctg

SEQ ID NO: 683973 - DNA, 20 bp, mouse
ggcccaggaactccctttcc

SEQ ID NO: 683974 - DNA, 20 bp, mouse
gctgggattggtagttttca

SEQ ID NO: 683975 - DNA, 20 bp, mouse
gcctacaaacaccgaacctt

SEQ ID NO: 683976 - DNA, 20 bp, mouse
gcacgcgtgcgcgctaagga

SEQ ID NO: 683977 - DNA, 20 bp, mouse
gcgcccgggtaatcgctgtc

SEQ ID NO: 683978 - DNA, 20 bp, mouse
gagctccttcctggacgcta

SEQ ID NO: 683979 - DNA, 20 bp, mouse
gctggggggcgggccctgtg

SEQ ID NO: 683980 - DNA, 20 bp, mouse
gcgctccctagcgtccagga

SEQ ID NO: 683981 - DNA, 20 bp, mouse
gactcggaggactgagctgg

SEQ ID NO: 683982 - DNA, 20 bp, mouse
ggactttggctggaactcgg

SEQ ID NO: 683983 - DNA, 20 bp, mouse
gcaggactttggctggaact

SEQ ID NO: 683984 - DNA, 20 bp, mouse
gtggcactctctcaggactt

SEQ ID NO: 683985 - DNA, 20 bp, mouse
gctagggagcgcaagcgccc

SEQ ID NO: 683986 - DNA, 20 bp, mouse
gtgtgaggttgcacagtgga

SEQ ID NO: 683987 - DNA, 20 bp, mouse
ggtgcggggcgcagctgtgc

SEQ ID NO: 683988 - DNA, 20 bp, mouse
gtggtcaaacggaaagctcg

SEQ ID NO: 683989 - DNA, 20 bp, mouse
gtctcccgacagccccgctt

SEQ ID NO: 683990 - DNA, 20 bp, mouse
ggatgcccaagcggggctgt

SEQ ID NO: 683991 - DNA, 20 bp, mouse
ggagagatgggcttgaccag

SEQ ID NO: 683992 - DNA, 20 bp, mouse
ggcggagggagagaggtgcg

SEQ ID NO: 683993 - DNA, 20 bp, mouse
gcactgcgccgcgccacggg

SEQ ID NO: 683994 - DNA, 20 bp, mouse
gcaggtgtgaggttgcacag

SEQ ID NO: 683995 - DNA, 20 bp, mouse
gggtcccggagcctgaccat

SEQ ID NO: 683996 - DNA, 20 bp, mouse
gaagcttgagggttgtagtt

SEQ ID NO: 683997 - DNA, 20 bp, mouse
gcatgctggaggtaaggggc

SEQ ID NO: 683998 - DNA, 20 bp, mouse
ggggacttgggccaagcttg

SEQ ID NO: 683999 - DNA, 20 bp, mouse
gtgactagaacacacgccat

SEQ ID NO: 684000 - DNA, 20 bp, mouse
gaacccatgctggaggtaag

SEQ ID NO: 684001 - DNA, 20 bp, mouse
gcattagatgactgggtaaa

SEQ ID NO: 684002 - DNA, 20 bp, mouse
gaccaaacaaattaccctaa

SEQ ID NO: 684003 - DNA, 20 bp, mouse
gaggaagagggactaatcta

SEQ ID NO: 684004 - DNA, 20 bp, mouse
gtcaaagatggtaattcgaa

SEQ ID NO: 684005 - DNA, 20 bp, mouse
gtagatgactgggtaaaggg

SEQ ID NO: 684006 - DNA, 20 bp, mouse
gcggcactttgagacttcgc

SEQ ID NO: 684007 - DNA, 20 bp, mouse
gtcaaagtgccgcccccgag

SEQ ID NO: 684008 - DNA, 20 bp, mouse
gcggaaaaggcgggtcgtgt

SEQ ID NO: 684009 - DNA, 20 bp, mouse
ggccgagcgggtcgcggaaa

SEQ ID NO: 684010 - DNA, 20 bp, mouse
gaacaacaaaatggtagtca

SEQ ID NO: 684011 - DNA, 20 bp, mouse
gtgggaacttaacaacaaaa

SEQ ID NO: 684012 - DNA, 20 bp, mouse
ggcgatcccggtacctacaa

SEQ ID NO: 684013 - DNA, 20 bp, mouse
ggagacttcgcgggcctgcg

SEQ ID NO: 684014 - DNA, 20 bp, mouse
gagcgggtcgcggaaaaggc

SEQ ID NO: 684015 - DNA, 20 bp, mouse
gagggggctggattcctgga

SEQ ID NO: 684016 - DNA, 20 bp, mouse
gtggacatcgccatgccggg

SEQ ID NO: 684017 - DNA, 20 bp, mouse
ggcagcaccggctggaagga

SEQ ID NO: 684018 - DNA, 20 bp, mouse
gtccagattggagtcatctt

SEQ ID NO: 684019 - DNA, 20 bp, mouse
gtggctcaaggaatcgagtg

SEQ ID NO: 684020 - DNA, 20 bp, mouse
gaggtctgtaggtttccacc

SEQ ID NO: 684021 - DNA, 20 bp, mouse
gcagtggctgcgaggtctgt

SEQ ID NO: 684022 - DNA, 20 bp, mouse
gtggctggcgcggatcaggg

SEQ ID NO: 684023 - DNA, 20 bp, mouse
ggcgtgtggcgctgcagcac

SEQ ID NO: 684024 - DNA, 20 bp, mouse
gaatgggagtccgcagtagg

SEQ ID NO: 684025 - DNA, 20 bp, mouse
gtttggggaagggtactcgg

SEQ ID NO: 684026 - DNA, 20 bp, mouse
gtggaaagtgcgctccggta

SEQ ID NO: 684027 - DNA, 20 bp, mouse
gagggcgctgggagaggccg

SEQ ID NO: 684028 - DNA, 20 bp, mouse
gtcggccttgggccccacca

SEQ ID NO: 684029 - DNA, 20 bp, mouse
ggggagtgaacgggcgcgga

SEQ ID NO: 684030 - DNA, 20 bp, mouse
gcgcctcgggtcagccctac

SEQ ID NO: 684031 - DNA, 20 bp, mouse
ggagcgccgcccacccagca

SEQ ID NO: 684032 - DNA, 20 bp, mouse
gctccggtagggctgacccg

SEQ ID NO: 684033 - DNA, 20 bp, mouse
gtcgccgcccgcagaggaga

SEQ ID NO: 684034 - DNA, 20 bp, mouse
gacgggagagtgagcctccg

SEQ ID NO: 684035 - DNA, 20 bp, mouse
gagcgaggaggtcgggttac

SEQ ID NO: 684036 - DNA, 20 bp, mouse
gtacctagactcaggttcat

SEQ ID NO: 684037 - DNA, 20 bp, mouse
ggtaaagtaggcgtgtccaa

SEQ ID NO: 684038 - DNA, 20 bp, mouse
gtctaggtacgcccaatagc

SEQ ID NO: 684039 - DNA, 20 bp, mouse
gttaactcatctcacgtgac

SEQ ID NO: 684040 - DNA, 20 bp, mouse
ggcccaatgaacctgagtct

SEQ ID NO: 684041 - DNA, 20 bp, mouse
gcattgggcagtcgtaaagt

SEQ ID NO: 684042 - DNA, 20 bp, mouse
gattgggcgtacctagactc

SEQ ID NO: 684043 - DNA, 20 bp, mouse
gctggcttatcactcaacag

SEQ ID NO: 684044 - DNA, 20 bp, mouse
gacgctgtcgaccggctatt

SEQ ID NO: 684045 - DNA, 20 bp, mouse
gtacacgcgcaattaacgtg

SEQ ID NO: 684046 - DNA, 20 bp, mouse
gaaaatggagagctctgcgg

SEQ ID NO: 684047 - DNA, 20 bp, mouse
gtgctactggcgaccggagg

SEQ ID NO: 684048 - DNA, 20 bp, mouse
gtcttgctactggcgaccgg

SEQ ID NO: 684049 - DNA, 20 bp, mouse
gcgcggcgaaagcctgcttc

SEQ ID NO: 684050 - DNA, 20 bp, mouse
gcgcgcaaggagccggaagc

SEQ ID NO: 684051 - DNA, 20 bp, mouse
gagcctggaaccggaagtga

SEQ ID NO: 684052 - DNA, 20 bp, mouse
gtgcgccctggcggccggga

SEQ ID NO: 684053 - DNA, 20 bp, mouse
gcttcagacgacgcctcctc

SEQ ID NO: 684054 - DNA, 20 bp, mouse
gctaaagtagagccgaccgt

SEQ ID NO: 684055 - DNA, 20 bp, mouse
gcccgccttcccggccgcca

SEQ ID NO: 684056 - DNA, 20 bp, mouse
gtccacgcccggggacggag

SEQ ID NO: 684057 - DNA, 20 bp, mouse
gagccctggctctgcgtgga

SEQ ID NO: 684058 - DNA, 20 bp, mouse
gcagttacccgcgtcctcgt

SEQ ID NO: 684059 - DNA, 20 bp, mouse
ggggccttaaggctagagga

SEQ ID NO: 684060 - DNA, 20 bp, mouse
gggacgggaaaactgcggga

SEQ ID NO: 684061 - DNA, 20 bp, mouse
ggcggccggccactgccgtt

SEQ ID NO: 684062 - DNA, 20 bp, mouse
ggcccggggacggagaggaa

SEQ ID NO: 684063 - DNA, 20 bp, mouse
ggactgattaggaaatctca

SEQ ID NO: 684064 - DNA, 20 bp, mouse
gtccctgctcagatggactc

SEQ ID NO: 684065 - DNA, 20 bp, mouse
gaaaactgggtacacagggg

SEQ ID NO: 684066 - DNA, 20 bp, mouse
gaccaccggcagttaaatag

SEQ ID NO: 684067 - DNA, 20 bp, mouse
gcaaactcgtcagtacgttt

SEQ ID NO: 684068 - DNA, 20 bp, mouse
gtccaagtttagataatctt

SEQ ID NO: 684069 - DNA, 20 bp, mouse
gaaaacaaggagatttcttt

SEQ ID NO: 684070 - DNA, 20 bp, mouse
gtttggacagcagcagcggt

SEQ ID NO: 684071 - DNA, 20 bp, mouse
gaaaggagctattagaaaaa

SEQ ID NO: 684072 - DNA, 20 bp, mouse
gggagccactatttaactgc

SEQ ID NO: 684073 - DNA, 20 bp, mouse
gcacagttcagccagtctta

SEQ ID NO: 684074 - DNA, 20 bp, mouse
gccgtgaggaaacaggtcta

SEQ ID NO: 684075 - DNA, 20 bp, mouse
gttaactagagtttaagtaa

SEQ ID NO: 684076 - DNA, 20 bp, mouse
gtcggcctcggcctcaacaa

SEQ ID NO: 684077 - DNA, 20 bp, mouse
gttcccgccccatggacgga

SEQ ID NO: 684078 - DNA, 20 bp, mouse
gaggccgtccgtccatgggg

SEQ ID NO: 684079 - DNA, 20 bp, mouse
ggggacgccgactgcgtcat

SEQ ID NO: 684080 - DNA, 20 bp, mouse
ggggagtgagctgatccccg

SEQ ID NO: 684081 - DNA, 20 bp, mouse
ggcgcaggccgtccgtccat

SEQ ID NO: 684082 - DNA, 20 bp, mouse
ggggatcagctcactcccac

SEQ ID NO: 684083 - DNA, 20 bp, mouse
gcgacttcccgccccatgga

SEQ ID NO: 684084 - DNA, 20 bp, mouse
gggcctccctgcctcggcct

SEQ ID NO: 684085 - DNA, 20 bp, mouse
gagaaacgggatgtcgtgcg

SEQ ID NO: 684086 - DNA, 20 bp, mouse
ggggtctggcgaagccttgt

SEQ ID NO: 684087 - DNA, 20 bp, mouse
gacgcgcagcggagccaatt

SEQ ID NO: 684088 - DNA, 20 bp, mouse
gggaaaggacagcgtgcgga

SEQ ID NO: 684089 - DNA, 20 bp, mouse
gaagccttgtgggtagcggg

SEQ ID NO: 684090 - DNA, 20 bp, mouse
gcagcggagccaattgggtc

SEQ ID NO: 684091 - DNA, 20 bp, mouse
gggagcgttgtgccctctgg

SEQ ID NO: 684092 - DNA, 20 bp, mouse
gtgcgggaaaggacagcgtg

SEQ ID NO: 684093 - DNA, 20 bp, mouse
gccccgggagcgtgcgggaa

SEQ ID NO: 684094 - DNA, 20 bp, mouse
ggcgaagccttgtgggtagc

SEQ ID NO: 684095 - DNA, 20 bp, mouse
gaggcttcgccagacccaat

SEQ ID NO: 684096 - DNA, 20 bp, mouse
gcggacgggaatctggtcct

SEQ ID NO: 684097 - DNA, 20 bp, mouse
ggtgtctgggtcgtgtagtg

SEQ ID NO: 684098 - DNA, 20 bp, mouse
gataactacgtcacacaccc

SEQ ID NO: 684099 - DNA, 20 bp, mouse
ggggcggttccccatcgccg

SEQ ID NO: 684100 - DNA, 20 bp, mouse
gaatgccgctcttccgattc

SEQ ID NO: 684101 - DNA, 20 bp, mouse
gtggggctacggctgccgaa

SEQ ID NO: 684102 - DNA, 20 bp, mouse
gagagcgcgagccgaagggt

SEQ ID NO: 684103 - DNA, 20 bp, mouse
gtcagcaacgggccgtgagg

SEQ ID NO: 684104 - DNA, 20 bp, mouse
gatgaagagagccgcggcga

SEQ ID NO: 684105 - DNA, 20 bp, mouse
gtggcaagggacaagagcta

SEQ ID NO: 684106 - DNA, 20 bp, mouse
gtgcccggctagtgtctggc

SEQ ID NO: 684107 - DNA, 20 bp, mouse
ggccgggcaaataggggtcc

SEQ ID NO: 684108 - DNA, 20 bp, mouse
gtatttgcccggctagtgtc

SEQ ID NO: 684109 - DNA, 20 bp, mouse
gacagtgcgtctccgtgcca

SEQ ID NO: 684110 - DNA, 20 bp, mouse
gttcccagccagacactagc

SEQ ID NO: 684111 - DNA, 20 bp, mouse
ggcggccaatgagcgcgcag

SEQ ID NO: 684112 - DNA, 20 bp, mouse
gcctggctggcctgaccaat

SEQ ID NO: 684113 - DNA, 20 bp, mouse
ggtattggggagtgtagata

SEQ ID NO: 684114 - DNA, 20 bp, mouse
gcttgagatctggggcagga

SEQ ID NO: 684115 - DNA, 20 bp, mouse
ggactggcgggcgagctcgc

SEQ ID NO: 684116 - DNA, 20 bp, mouse
ggctgcattaggttcctcgg

SEQ ID NO: 684117 - DNA, 20 bp, mouse
ggcaaggctgacctggctga

SEQ ID NO: 684118 - DNA, 20 bp, mouse
gcactccatagcgccaaaaa

SEQ ID NO: 684119 - DNA, 20 bp, mouse
gaggagcgggcggaaggaag

SEQ ID NO: 684120 - DNA, 20 bp, mouse
ggcaaacagacacactccct

SEQ ID NO: 684121 - DNA, 20 bp, mouse
ggtgccggggtgcggaagga

SEQ ID NO: 684122 - DNA, 20 bp, mouse
gatagcgccaaaaagggctg

SEQ ID NO: 684123 - DNA, 20 bp, mouse
ggagcgtggccaacgaaaac

SEQ ID NO: 684124 - DNA, 20 bp, mouse
ggaaggaaggagcgggcgga

SEQ ID NO: 684125 - DNA, 20 bp, mouse
gagccaggtcagccttgcaa

SEQ ID NO: 684126 - DNA, 20 bp, mouse
gtggcagcgccccacacagg

SEQ ID NO: 684127 - DNA, 20 bp, mouse
ggcgtggcagcgccccacac

SEQ ID NO: 684128 - DNA, 20 bp, mouse
ggccccacacaggagggact

SEQ ID NO: 684129 - DNA, 20 bp, mouse
ggggatcgtctcagttcctt

SEQ ID NO: 684130 - DNA, 20 bp, mouse
gctggaagcctgtgtgccta

SEQ ID NO: 684131 - DNA, 20 bp, mouse
gaaatagggcagatacccaa

SEQ ID NO: 684132 - DNA, 20 bp, mouse
gcttccaagtccctcctgtg

SEQ ID NO: 684133 - DNA, 20 bp, mouse
gccacgccagacccgccagc

SEQ ID NO: 684134 - DNA, 20 bp, mouse
gtcccttcttgctgcccttt

SEQ ID NO: 684135 - DNA, 20 bp, mouse
gctgcaacttcggccttcca

SEQ ID NO: 684136 - DNA, 20 bp, mouse
gcaaagctcggattggttga

SEQ ID NO: 684137 - DNA, 20 bp, mouse
gagaccgcgccaggaaccgg

SEQ ID NO: 684138 - DNA, 20 bp, mouse
ggcggaggaatgtgacgtca

SEQ ID NO: 684139 - DNA, 20 bp, mouse
gctgaaaagcggtcaaagct

SEQ ID NO: 684140 - DNA, 20 bp, mouse
gtccccgtcgtcaggaactc

SEQ ID NO: 684141 - DNA, 20 bp, mouse
gaaaagttgtgagaggacgt

SEQ ID NO: 684142 - DNA, 20 bp, mouse
gaagcggtcaaagctcggat

SEQ ID NO: 684143 - DNA, 20 bp, mouse
ggtctctggcggctccggag

SEQ ID NO: 684144 - DNA, 20 bp, mouse
ggaagcaggtccccgtcgtc

SEQ ID NO: 684145 - DNA, 20 bp, mouse
gttggttgaaggatctggag

SEQ ID NO: 684146 - DNA, 20 bp, mouse
ggggaggggcgagaacatgg

SEQ ID NO: 684147 - DNA, 20 bp, mouse
gagggagcgcccgcccgcgg

SEQ ID NO: 684148 - DNA, 20 bp, mouse
gtcggggcgaggcattctag

SEQ ID NO: 684149 - DNA, 20 bp, mouse
gaataaacgggcgccgggga

SEQ ID NO: 684150 - DNA, 20 bp, mouse
gtcgtgaagcgagtaataaa

SEQ ID NO: 684151 - DNA, 20 bp, mouse
gccaacgcccccggggagat

SEQ ID NO: 684152 - DNA, 20 bp, mouse
ggtgtcgccaaaagggcgtc

SEQ ID NO: 684153 - DNA, 20 bp, mouse
gcccccacgcccataaccga

SEQ ID NO: 684154 - DNA, 20 bp, mouse
gaggccaagctccgcctccc

SEQ ID NO: 684155 - DNA, 20 bp, mouse
ggcccccggggagatcggcc

SEQ ID NO: 684156 - DNA, 20 bp, mouse
gaaaacctgagtggccccga

SEQ ID NO: 684157 - DNA, 20 bp, mouse
ggggctgcgcgagcgttgca

SEQ ID NO: 684158 - DNA, 20 bp, mouse
gcacgggccaatctccagga

SEQ ID NO: 684159 - DNA, 20 bp, mouse
ggggccactcaggttttcat

SEQ ID NO: 684160 - DNA, 20 bp, mouse
ggggcccatcggggccactc

SEQ ID NO: 684161 - DNA, 20 bp, mouse
ggcccacggtctgaagtgac

SEQ ID NO: 684162 - DNA, 20 bp, mouse
gaccgtgggcgggcccatcg

SEQ ID NO: 684163 - DNA, 20 bp, mouse
gctccccgccgcctgcgagg

SEQ ID NO: 684164 - DNA, 20 bp, mouse
ggggctgacgcgcgacgcag

SEQ ID NO: 684165 - DNA, 20 bp, mouse
gcgtgggcaagcacgagctg

SEQ ID NO: 684166 - DNA, 20 bp, mouse
ggaaccgggagcagcatcgg

SEQ ID NO: 684167 - DNA, 20 bp, mouse
gaggtcagtgggagtcgcga

SEQ ID NO: 684168 - DNA, 20 bp, mouse
gaggcagtgctgacgagtcg

SEQ ID NO: 684169 - DNA, 20 bp, mouse
ggggccgagcgtcaccttgt

SEQ ID NO: 684170 - DNA, 20 bp, mouse
ggcccccaggtccgcccctg

SEQ ID NO: 684171 - DNA, 20 bp, mouse
gcgtcagcactgcctccagg

SEQ ID NO: 684172 - DNA, 20 bp, mouse
gaggcggccgagctcttgcc

SEQ ID NO: 684173 - DNA, 20 bp, mouse
gagcccgaggaaatcgagga

SEQ ID NO: 684174 - DNA, 20 bp, mouse
ggaggctcgggtgacgtcac

SEQ ID NO: 684175 - DNA, 20 bp, mouse
ggccccgcgacctagaggct

SEQ ID NO: 684176 - DNA, 20 bp, mouse
gagcagtcgcggatagaaag

SEQ ID NO: 684177 - DNA, 20 bp, mouse
gagcctggctgtgataggcg

SEQ ID NO: 684178 - DNA, 20 bp, mouse
ggcacaagaagcgtcgattt

SEQ ID NO: 684179 - DNA, 20 bp, mouse
gcctggagcgacttccgcta

SEQ ID NO: 684180 - DNA, 20 bp, mouse
ggaaaatggaaagcatcgtg

SEQ ID NO: 684181 - DNA, 20 bp, mouse
gacatgggaacagcattcca

SEQ ID NO: 684182 - DNA, 20 bp, mouse
gatcgacgcttcttgtgcgt

SEQ ID NO: 684183 - DNA, 20 bp, mouse
ggcgtggaaaacgtgtgagc

SEQ ID NO: 684184 - DNA, 20 bp, mouse
gaatgctgttcccatgtctt

SEQ ID NO: 684185 - DNA, 20 bp, mouse
gacttccgctacggcctgtg

SEQ ID NO: 684186 - DNA, 20 bp, mouse
gcaggggcggagcgtcaaca

SEQ ID NO: 684187 - DNA, 20 bp, mouse
ggggacataccaactggtgg

SEQ ID NO: 684188 - DNA, 20 bp, mouse
gaatgggcgaagccagaagg

SEQ ID NO: 684189 - DNA, 20 bp, mouse
gagcctgtgagacgcaagag

SEQ ID NO: 684190 - DNA, 20 bp, mouse
gccgccctacgggtgaaacc

SEQ ID NO: 684191 - DNA, 20 bp, mouse
gccgcccctgcgaagttggt

SEQ ID NO: 684192 - DNA, 20 bp, mouse
gcccggctggtacaccactt

SEQ ID NO: 684193 - DNA, 20 bp, mouse
gggaaaccaaccaacttcgc

SEQ ID NO: 684194 - DNA, 20 bp, mouse
gaaggaggaaccaacagaac

SEQ ID NO: 684195 - DNA, 20 bp, mouse
gagcgcgagggcggggtata

SEQ ID NO: 684196 - DNA, 20 bp, mouse
ggaagggcgctggaagtgac

SEQ ID NO: 684197 - DNA, 20 bp, mouse
gaggaccgaggtcgcccaga

SEQ ID NO: 684198 - DNA, 20 bp, mouse
ggggcgctggaagtgacggg

SEQ ID NO: 684199 - DNA, 20 bp, mouse
gaccgaggtcgcccagaagg

SEQ ID NO: 684200 - DNA, 20 bp, mouse
ggacgggaggcgccacgccc

SEQ ID NO: 684201 - DNA, 20 bp, mouse
gcgactgaaggcgtgggaag

SEQ ID NO: 684202 - DNA, 20 bp, mouse
gaggtcgcccagaaggcgga

SEQ ID NO: 684203 - DNA, 20 bp, mouse
gggacatcgcggccaagcga

SEQ ID NO: 684204 - DNA, 20 bp, mouse
gccagaaggcggaagggcgc

SEQ ID NO: 684205 - DNA, 20 bp, mouse
ggcccgggaccccaacaaac

SEQ ID NO: 684206 - DNA, 20 bp, mouse
gcacgtcactctgtgggtca

SEQ ID NO: 684207 - DNA, 20 bp, mouse
gcctgcccacgtcactctgt

SEQ ID NO: 684208 - DNA, 20 bp, mouse
gcaagcggcgtggagtacag

SEQ ID NO: 684209 - DNA, 20 bp, mouse
gcacatgcgcaaaggaatta

SEQ ID NO: 684210 - DNA, 20 bp, mouse
gcctggaagtactttctcct

SEQ ID NO: 684211 - DNA, 20 bp, mouse
ggaggcatccacaattcgga

SEQ ID NO: 684212 - DNA, 20 bp, mouse
gacagcgtggagtcacgcca

SEQ ID NO: 684213 - DNA, 20 bp, mouse
gcaattcggagggcgttcaa

SEQ ID NO: 684214 - DNA, 20 bp, mouse
ggggttctgtgggtaaccag

SEQ ID NO: 684215 - DNA, 20 bp, mouse
gtcagtgcgcacgcgtaggg

SEQ ID NO: 684216 - DNA, 20 bp, mouse
gggaaattgcctttaagttg

SEQ ID NO: 684217 - DNA, 20 bp, mouse
gctgggtccttgcggttcag

SEQ ID NO: 684218 - DNA, 20 bp, mouse
gaagctgcgccccaacttaa

SEQ ID NO: 684219 - DNA, 20 bp, mouse
gtgatctgtggaagaggtaa

SEQ ID NO: 684220 - DNA, 20 bp, mouse
gtggggcgcagcttttcgcg

SEQ ID NO: 684221 - DNA, 20 bp, mouse
gaggcctaaagaagagttga

SEQ ID NO: 684222 - DNA, 20 bp, mouse
gcgaaactgcctcagggcgc

SEQ ID NO: 684223 - DNA, 20 bp, mouse
gacctcttccacagatcagc

SEQ ID NO: 684224 - DNA, 20 bp, mouse
gaccgaagcagggacgattt

SEQ ID NO: 684225 - DNA, 20 bp, mouse
gtagagaaaccctgccccga

SEQ ID NO: 684226 - DNA, 20 bp, mouse
ggggcggtgcacagggtagc

SEQ ID NO: 684227 - DNA, 20 bp, mouse
gccgcagcgcgtcaccgcga

SEQ ID NO: 684228 - DNA, 20 bp, mouse
gaaaggattgccaggaaggg

SEQ ID NO: 684229 - DNA, 20 bp, mouse
ggccctccacgcttagaaag

SEQ ID NO: 684230 - DNA, 20 bp, mouse
gggaactagggagactttga

SEQ ID NO: 684231 - DNA, 20 bp, mouse
gtggagtaggctggtgagaa

SEQ ID NO: 684232 - DNA, 20 bp, mouse
ggaaagtgggaagtttgagt

SEQ ID NO: 684233 - DNA, 20 bp, mouse
ggctgcggagggcggtgcac

SEQ ID NO: 684234 - DNA, 20 bp, mouse
gaaggccacccgttggaact

SEQ ID NO: 684235 - DNA, 20 bp, mouse
gcatgctagagccttccaaa

SEQ ID NO: 684236 - DNA, 20 bp, mouse
gcggccgccgccatgcggag

SEQ ID NO: 684237 - DNA, 20 bp, mouse
gccaggaagccgtgacgccg

SEQ ID NO: 684238 - DNA, 20 bp, mouse
gtgcagccgccgcggcgtca

SEQ ID NO: 684239 - DNA, 20 bp, mouse
gggcgccggccgaggtagtg

SEQ ID NO: 684240 - DNA, 20 bp, mouse
gctctcgccatcttgtgtgg

SEQ ID NO: 684241 - DNA, 20 bp, mouse
gggcgagggtcgggagagac

SEQ ID NO: 684242 - DNA, 20 bp, mouse
gccggcggcggcgacatcgg

SEQ ID NO: 684243 - DNA, 20 bp, mouse
ggggagagaccggcctttga

SEQ ID NO: 684244 - DNA, 20 bp, mouse
ggagctctcgccatcttgtg

SEQ ID NO: 684245 - DNA, 20 bp, mouse
ggatggacggacgggcgaga

SEQ ID NO: 684246 - DNA, 20 bp, mouse
ggtaaggaggaggatttgac

SEQ ID NO: 684247 - DNA, 20 bp, mouse
ggattcttgaggtaaggagg

SEQ ID NO: 684248 - DNA, 20 bp, mouse
gtgggattcttgaggtaagg

SEQ ID NO: 684249 - DNA, 20 bp, mouse
gaagcaaggcaacattggag

SEQ ID NO: 684250 - DNA, 20 bp, mouse
gagaggctttgggattcttg

SEQ ID NO: 684251 - DNA, 20 bp, mouse
gggtaaagttagtactgtta

SEQ ID NO: 684252 - DNA, 20 bp, mouse
ggttaaggtaggaaaaccag

SEQ ID NO: 684253 - DNA, 20 bp, mouse
gctttgggattcttgaggta

SEQ ID NO: 684254 - DNA, 20 bp, mouse
gctgctgtcgttagcacagt

SEQ ID NO: 684255 - DNA, 20 bp, mouse
gtataagtgaaggatagttt

SEQ ID NO: 684256 - DNA, 20 bp, mouse
ggcccgagcagcgaccgaag

SEQ ID NO: 684257 - DNA, 20 bp, mouse
gcgaagaggccgcccgagtt

SEQ ID NO: 684258 - DNA, 20 bp, mouse
gtcggctctgcgggcagctt

SEQ ID NO: 684259 - DNA, 20 bp, mouse
gtctgcgggcagcttcggct

SEQ ID NO: 684260 - DNA, 20 bp, mouse
gcagcttcggctcggttcgg

SEQ ID NO: 684261 - DNA, 20 bp, mouse
ggggcgtcagactgcctctt

SEQ ID NO: 684262 - DNA, 20 bp, mouse
gcccgaagcggggcccgaag

SEQ ID NO: 684263 - DNA, 20 bp, mouse
gggcctcggcccaactcggg

SEQ ID NO: 684264 - DNA, 20 bp, mouse
ggggcagcttcggctcggtt

SEQ ID NO: 684265 - DNA, 20 bp, mouse
gtccgcccgaaggcgctgtc

SEQ ID NO: 684266 - DNA, 20 bp, mouse
gtgctcgcgcgtccaatcac

SEQ ID NO: 684267 - DNA, 20 bp, mouse
gcgggggcgtcacctgtgat

SEQ ID NO: 684268 - DNA, 20 bp, mouse
gagtctatgacgctactctg

SEQ ID NO: 684269 - DNA, 20 bp, mouse
gtcagcagcgcgcgactcgg

SEQ ID NO: 684270 - DNA, 20 bp, mouse
gtgagccactcgaaatgggg

SEQ ID NO: 684271 - DNA, 20 bp, mouse
gcgtatcaggccggggtcag

SEQ ID NO: 684272 - DNA, 20 bp, mouse
gacgctgattgggtgcgacg

SEQ ID NO: 684273 - DNA, 20 bp, mouse
gtagtacagtgggaactgag

SEQ ID NO: 684274 - DNA, 20 bp, mouse
gaactagaagggtttgggac

SEQ ID NO: 684275 - DNA, 20 bp, mouse
gacaccgccccgcgtggagg

SEQ ID NO: 684276 - DNA, 20 bp, mouse
gaccccggacagtctagcct

SEQ ID NO: 684277 - DNA, 20 bp, mouse
ggtccagaggggaacgggtt

SEQ ID NO: 684278 - DNA, 20 bp, mouse
ggaactgcaaggagcaggcg

SEQ ID NO: 684279 - DNA, 20 bp, mouse
gcgaccgatcgaaaggcatt

SEQ ID NO: 684280 - DNA, 20 bp, mouse
gacaaaattctcccttgaga

SEQ ID NO: 684281 - DNA, 20 bp, mouse
ggcccggaagtctcagttca

SEQ ID NO: 684282 - DNA, 20 bp, mouse
gcggaagtctcagttcaggg

SEQ ID NO: 684283 - DNA, 20 bp, mouse
gatgaaaagccgtgatccat

SEQ ID NO: 684284 - DNA, 20 bp, mouse
gccgggcgaggctgtgaccc

SEQ ID NO: 684285 - DNA, 20 bp, mouse
gtcccgaacccgttcccctc

SEQ ID NO: 684286 - DNA, 20 bp, mouse
ggaggctgggagttgcggga

SEQ ID NO: 684287 - DNA, 20 bp, mouse
gggaggaggcactgatacag

SEQ ID NO: 684288 - DNA, 20 bp, mouse
gtaactggctggagcgtctc

SEQ ID NO: 684289 - DNA, 20 bp, mouse
ggcctgctgggactgagaat

SEQ ID NO: 684290 - DNA, 20 bp, mouse
gcgagggcggggtgtccgcc

SEQ ID NO: 684291 - DNA, 20 bp, mouse
gtccgcctggtcgagtggga

SEQ ID NO: 684292 - DNA, 20 bp, mouse
gcagcccttcccactcgacc

SEQ ID NO: 684293 - DNA, 20 bp, mouse
gggctgcgcgccaccgaggg

SEQ ID NO: 684294 - DNA, 20 bp, mouse
ggcaggctgcgcgccaccga

SEQ ID NO: 684295 - DNA, 20 bp, mouse
gggtgtccgcctggtcgagt

SEQ ID NO: 684296 - DNA, 20 bp, mouse
gaggctgccctcacctagta

SEQ ID NO: 684297 - DNA, 20 bp, mouse
ggaacctggccggttagtgt

SEQ ID NO: 684298 - DNA, 20 bp, mouse
gtaaccggccaggttccggg

SEQ ID NO: 684299 - DNA, 20 bp, mouse
ggaggagccatactaggtga

SEQ ID NO: 684300 - DNA, 20 bp, mouse
gggagtgggtagcttcacgt

SEQ ID NO: 684301 - DNA, 20 bp, mouse
gcataacgaggcatgagcgg

SEQ ID NO: 684302 - DNA, 20 bp, mouse
gctggcagcggcattaagcg

SEQ ID NO: 684303 - DNA, 20 bp, mouse
ggcgcctcccggaacctggc

SEQ ID NO: 684304 - DNA, 20 bp, mouse
ggcggggaggttctaagaag

SEQ ID NO: 684305 - DNA, 20 bp, mouse
gaagccgacactaaccggcc

SEQ ID NO: 684306 - DNA, 20 bp, mouse
gagcgcagcaagggagagtc

SEQ ID NO: 684307 - DNA, 20 bp, mouse
gagggagagtccggacgctt

SEQ ID NO: 684308 - DNA, 20 bp, mouse
gggaggaagaggtagtctgt

SEQ ID NO: 684309 - DNA, 20 bp, mouse
gagtccggacgcttgggtta

SEQ ID NO: 684310 - DNA, 20 bp, mouse
gggatctggagtcctggaag

SEQ ID NO: 684311 - DNA, 20 bp, mouse
gcaaagtaaaccagtcacga

SEQ ID NO: 684312 - DNA, 20 bp, mouse
gcgcccctaacccaagcgtc

SEQ ID NO: 684313 - DNA, 20 bp, mouse
ggagtcgggaccctcgtgac

SEQ ID NO: 684314 - DNA, 20 bp, mouse
gtgtctaggacgtgatcagg

SEQ ID NO: 684315 - DNA, 20 bp, mouse
gcttgggttaggggcggatc

SEQ ID NO: 684316 - DNA, 20 bp, mouse
ggaagcaagagggaacaggc

SEQ ID NO: 684317 - DNA, 20 bp, mouse
ggagggctccagctctggga

SEQ ID NO: 684318 - DNA, 20 bp, mouse
gagagcagctggctaggccc

SEQ ID NO: 684319 - DNA, 20 bp, mouse
gtgtccctccaagtctggaa

SEQ ID NO: 684320 - DNA, 20 bp, mouse
gctaggccctggaagcaaga

SEQ ID NO: 684321 - DNA, 20 bp, mouse
gaaagtgactatctgtgctg

SEQ ID NO: 684322 - DNA, 20 bp, mouse
gagagcgtggcgagagcagc

SEQ ID NO: 684323 - DNA, 20 bp, mouse
ggcccgccccggcccagggg

SEQ ID NO: 684324 - DNA, 20 bp, mouse
ggctctgggagggtcagccc

SEQ ID NO: 684325 - DNA, 20 bp, mouse
ggtggcgagagcagctggct

SEQ ID NO: 684326 - DNA, 20 bp, mouse
gagccggtacagtgtatcag

SEQ ID NO: 684327 - DNA, 20 bp, mouse
gaatgcaattactaaggcgt

SEQ ID NO: 684328 - DNA, 20 bp, mouse
gcccttgaatgcaattacta

SEQ ID NO: 684329 - DNA, 20 bp, mouse
ggcaaaggtaatggactcta

SEQ ID NO: 684330 - DNA, 20 bp, mouse
gagactcagggcaaaggtaa

SEQ ID NO: 684331 - DNA, 20 bp, mouse
ggtctctgtaggtgtcgggg

SEQ ID NO: 684332 - DNA, 20 bp, mouse
gtctcgatggtggtgtcctg

SEQ ID NO: 684333 - DNA, 20 bp, mouse
gactcaggagaaaagactca

SEQ ID NO: 684334 - DNA, 20 bp, mouse
gcggtacagtgtatcagcgg

SEQ ID NO: 684335 - DNA, 20 bp, mouse
gtgggtcagaagcccgatcc

SEQ ID NO: 684336 - DNA, 20 bp, mouse
gtacttgggaccctcatgct

SEQ ID NO: 684337 - DNA, 20 bp, mouse
gaacacatggaacaatagtg

SEQ ID NO: 684338 - DNA, 20 bp, mouse
gtggaacaatagtgtggtcc

SEQ ID NO: 684339 - DNA, 20 bp, mouse
gcaggagcatctccatactt

SEQ ID NO: 684340 - DNA, 20 bp, mouse
gttcatgattatcagtgtca

SEQ ID NO: 684341 - DNA, 20 bp, mouse
gtccatgtgttcagacactt

SEQ ID NO: 684342 - DNA, 20 bp, mouse
ggccaaagtgtctgaacaca

SEQ ID NO: 684343 - DNA, 20 bp, mouse
gcacattgttacccctcatg

SEQ ID NO: 684344 - DNA, 20 bp, mouse
gtctcttaaactcaattcac

SEQ ID NO: 684345 - DNA, 20 bp, mouse
gaattcactgggccaaaatg

SEQ ID NO: 684346 - DNA, 20 bp, mouse
gtaacctgaggggtcctggt

SEQ ID NO: 684347 - DNA, 20 bp, mouse
gccaacctgagagtcagaac

SEQ ID NO: 684348 - DNA, 20 bp, mouse
gaggacccctcaggttagat

SEQ ID NO: 684349 - DNA, 20 bp, mouse
gggaaacaggtatctggtgt

SEQ ID NO: 684350 - DNA, 20 bp, mouse
gggaggaaggtctggataca

SEQ ID NO: 684351 - DNA, 20 bp, mouse
ggcaatgtgcccacaggact

SEQ ID NO: 684352 - DNA, 20 bp, mouse
ggaaaatggaaacaggtatc

SEQ ID NO: 684353 - DNA, 20 bp, mouse
ggaatcgctgggcttcttac

SEQ ID NO: 684354 - DNA, 20 bp, mouse
gcagcctggaaaatggaaac

SEQ ID NO: 684355 - DNA, 20 bp, mouse
gtgaacctatctaacctgag

SEQ ID NO: 684356 - DNA, 20 bp, mouse
gtggattgctgaaactttca

SEQ ID NO: 684357 - DNA, 20 bp, mouse
gctctcttatgccccttgcc

SEQ ID NO: 684358 - DNA, 20 bp, mouse
gcatctgctagtatcattct

SEQ ID NO: 684359 - DNA, 20 bp, mouse
gagggttgcctgcccctgag

SEQ ID NO: 684360 - DNA, 20 bp, mouse
gagctaccctgtaagaactg

SEQ ID NO: 684361 - DNA, 20 bp, mouse
ggacaagagaagggggattg

SEQ ID NO: 684362 - DNA, 20 bp, mouse
ggacagcccacagttcttac

SEQ ID NO: 684363 - DNA, 20 bp, mouse
gttggggagggtaatttgga

SEQ ID NO: 684364 - DNA, 20 bp, mouse
ggagcttccccctcaggggc

SEQ ID NO: 684365 - DNA, 20 bp, mouse
gcctcctgctgtttgtcttg

SEQ ID NO: 684366 - DNA, 20 bp, mouse
gagctaccatgtaggaacat

SEQ ID NO: 684367 - DNA, 20 bp, mouse
ggaacccctctcttaagaga

SEQ ID NO: 684368 - DNA, 20 bp, mouse
gttaccttctcttaagagag

SEQ ID NO: 684369 - DNA, 20 bp, mouse
ggtagcaagtttaggtggga

SEQ ID NO: 684370 - DNA, 20 bp, mouse
gttggtagggtgttgctggg

SEQ ID NO: 684371 - DNA, 20 bp, mouse
gttacagcaatacatgcttg

SEQ ID NO: 684372 - DNA, 20 bp, mouse
gcaagggtagcaagtttagg

SEQ ID NO: 684373 - DNA, 20 bp, mouse
gtgactgattatcccaaggc

SEQ ID NO: 684374 - DNA, 20 bp, mouse
ggatttggtagggtgttgct

SEQ ID NO: 684375 - DNA, 20 bp, mouse
ggagaaaatgaaatccccct

SEQ ID NO: 684376 - DNA, 20 bp, mouse
gggttaggcatggagaagta

SEQ ID NO: 684377 - DNA, 20 bp, mouse
gagattcctgcagtagaagt

SEQ ID NO: 684378 - DNA, 20 bp, mouse
gtccccaggacaagctacaa

SEQ ID NO: 684379 - DNA, 20 bp, mouse
gtgcctttgtagcttgtcct

SEQ ID NO: 684380 - DNA, 20 bp, mouse
gagtgcttccagagctattg

SEQ ID NO: 684381 - DNA, 20 bp, mouse
ggtaaggctttgcaggctca

SEQ ID NO: 684382 - DNA, 20 bp, mouse
ggaaatcatactggatcccc

SEQ ID NO: 684383 - DNA, 20 bp, mouse
gtccagtatgatttcaactc

SEQ ID NO: 684384 - DNA, 20 bp, mouse
gtcctgagttgaaatcatac

SEQ ID NO: 684385 - DNA, 20 bp, mouse
gaattgttcagcagaacgtg

SEQ ID NO: 684386 - DNA, 20 bp, mouse
gtggcccactcgtcactcaa

SEQ ID NO: 684387 - DNA, 20 bp, mouse
gcctggagatggaacatgaa

SEQ ID NO: 684388 - DNA, 20 bp, mouse
ggagagacgcctaagaagaa

SEQ ID NO: 684389 - DNA, 20 bp, mouse
ggaaaggggtggatagttgt

SEQ ID NO: 684390 - DNA, 20 bp, mouse
gtactagaggaagaaagggg

SEQ ID NO: 684391 - DNA, 20 bp, mouse
gaaaggaaacagaatattcc

SEQ ID NO: 684392 - DNA, 20 bp, mouse
gacttagacaaaaggtcgat

SEQ ID NO: 684393 - DNA, 20 bp, mouse
ggctccattgagtgacgagt

SEQ ID NO: 684394 - DNA, 20 bp, mouse
gcagaatattccaggcaaaa

SEQ ID NO: 684395 - DNA, 20 bp, mouse
gctaagtcttattagaggca

SEQ ID NO: 684396 - DNA, 20 bp, mouse
gtgtagagatagaactgata

SEQ ID NO: 684397 - DNA, 20 bp, mouse
gtggaaacatgcccaggacc

SEQ ID NO: 684398 - DNA, 20 bp, mouse
ggccccaggacatgtaactt

SEQ ID NO: 684399 - DNA, 20 bp, mouse
gaagtttgactacacccctc

SEQ ID NO: 684400 - DNA, 20 bp, mouse
gcaggcatttgcaagcctga

SEQ ID NO: 684401 - DNA, 20 bp, mouse
gagaacacacatactcactc

SEQ ID NO: 684402 - DNA, 20 bp, mouse
ggacactggaaagacacgtc

SEQ ID NO: 684403 - DNA, 20 bp, mouse
gatggcttaccttgttatat

SEQ ID NO: 684404 - DNA, 20 bp, mouse
gtgtaatgtcaccatgatga

SEQ ID NO: 684405 - DNA, 20 bp, mouse
ggtcccaagttacatgtcct

SEQ ID NO: 684406 - DNA, 20 bp, mouse
gaagagcgtagagccggggt

SEQ ID NO: 684407 - DNA, 20 bp, mouse
gaggcaagagcgtagagccg

SEQ ID NO: 684408 - DNA, 20 bp, mouse
gggtctgaagccactaggga

SEQ ID NO: 684409 - DNA, 20 bp, mouse
gcctagtggcttcagaccac

SEQ ID NO: 684410 - DNA, 20 bp, mouse
ggacacccactgaggcgggt

SEQ ID NO: 684411 - DNA, 20 bp, mouse
gtacactcccactatacccg

SEQ ID NO: 684412 - DNA, 20 bp, mouse
ggtgaggattagcagtgtaa

SEQ ID NO: 684413 - DNA, 20 bp, mouse
gtcagagtccacctgaccac

SEQ ID NO: 684414 - DNA, 20 bp, mouse
gcgggtgggctccatgtggc

SEQ ID NO: 684415 - DNA, 20 bp, mouse
gttcagaccacgggtatagt

SEQ ID NO: 684416 - DNA, 20 bp, mouse
gtgaaaatgaattcatgtct

SEQ ID NO: 684417 - DNA, 20 bp, mouse
gcagacaaagaaagagtcga

SEQ ID NO: 684418 - DNA, 20 bp, mouse
gacaaagaaagagtcgaggg

SEQ ID NO: 684419 - DNA, 20 bp, mouse
gtagtttaaactaattacca

SEQ ID NO: 684420 - DNA, 20 bp, mouse
gttgattaattatgcctttc

SEQ ID NO: 684421 - DNA, 20 bp, mouse
gttataccttccacatatga

SEQ ID NO: 684422 - DNA, 20 bp, mouse
gaggcataattaatcaaaat

SEQ ID NO: 684423 - DNA, 20 bp, mouse
gaagaagtttaaagttccct

SEQ ID NO: 684424 - DNA, 20 bp, mouse
gtattaccttcatatgtgga

SEQ ID NO: 684425 - DNA, 20 bp, mouse
ggcactaaaatagtaaaaca

SEQ ID NO: 684426 - DNA, 20 bp, mouse
ggctggccagacatgacctc

SEQ ID NO: 684427 - DNA, 20 bp, mouse
gaaacgagagtgaaggaaag

SEQ ID NO: 684428 - DNA, 20 bp, mouse
gcagccctgctgataaaagg

SEQ ID NO: 684429 - DNA, 20 bp, mouse
gaggtgacttggagcagagg

SEQ ID NO: 684430 - DNA, 20 bp, mouse
gcagcacaaaacgagagtga

SEQ ID NO: 684431 - DNA, 20 bp, mouse
gttcctcgacacgtatccta

SEQ ID NO: 684432 - DNA, 20 bp, mouse
gcagacatgacctccggcct

SEQ ID NO: 684433 - DNA, 20 bp, mouse
ggacccatgttaattacctt

SEQ ID NO: 684434 - DNA, 20 bp, mouse
gacaaggtcagccagtccga

SEQ ID NO: 684435 - DNA, 20 bp, mouse
ggccttggtgtggaacatac

SEQ ID NO: 684436 - DNA, 20 bp, mouse
gcagaagataagctgatcca

SEQ ID NO: 684437 - DNA, 20 bp, mouse
gacagcctagagttcctatg

SEQ ID NO: 684438 - DNA, 20 bp, mouse
gtacagatgagctaccccat

SEQ ID NO: 684439 - DNA, 20 bp, mouse
gggggcaacagctgctacta

SEQ ID NO: 684440 - DNA, 20 bp, mouse
gggtctggatgagagtagag

SEQ ID NO: 684441 - DNA, 20 bp, mouse
ggctaccccataggaactct

SEQ ID NO: 684442 - DNA, 20 bp, mouse
gaaggaagaactctaaaccc

SEQ ID NO: 684443 - DNA, 20 bp, mouse
gctcatctgtaagcactctc

SEQ ID NO: 684444 - DNA, 20 bp, mouse
gtccctttctctgaggacga

SEQ ID NO: 684445 - DNA, 20 bp, mouse
ggtatatgctaatatcattc

SEQ ID NO: 684446 - DNA, 20 bp, mouse
gtgagtgagaggcataggga

SEQ ID NO: 684447 - DNA, 20 bp, mouse
gctgtcagcccacttgggtc

SEQ ID NO: 684448 - DNA, 20 bp, mouse
gcccaagtgggctgacagcc

SEQ ID NO: 684449 - DNA, 20 bp, mouse
gaaccaaacctgacccaagt

SEQ ID NO: 684450 - DNA, 20 bp, mouse
gtgtaggtggggttggactt

SEQ ID NO: 684451 - DNA, 20 bp, mouse
gagcccacttgggtcaggtt

SEQ ID NO: 684452 - DNA, 20 bp, mouse
gctgctgtgctctctccacc

SEQ ID NO: 684453 - DNA, 20 bp, mouse
gtggagtaggtgggaaacgt

SEQ ID NO: 684454 - DNA, 20 bp, mouse
gtcctccctaactgatgcac

SEQ ID NO: 684455 - DNA, 20 bp, mouse
gaaaaaaaaatggagtaggt

SEQ ID NO: 684456 - DNA, 20 bp, mouse
gtctactgtaaccactgagg

SEQ ID NO: 684457 - DNA, 20 bp, mouse
gagatgcagtgtgaattcag

SEQ ID NO: 684458 - DNA, 20 bp, mouse
gcagaatgcgctggagatcg

SEQ ID NO: 684459 - DNA, 20 bp, mouse
gaattcaattgtgaccttgg

SEQ ID NO: 684460 - DNA, 20 bp, mouse
ggagcagcacttagaggatt

SEQ ID NO: 684461 - DNA, 20 bp, mouse
gcagtagaaaaagatggtca

SEQ ID NO: 684462 - DNA, 20 bp, mouse
gccagaagagggcgtgagat

SEQ ID NO: 684463 - DNA, 20 bp, mouse
gtggttacagtagaaaaaga

SEQ ID NO: 684464 - DNA, 20 bp, mouse
gatgcgctggagatcggggc

SEQ ID NO: 684465 - DNA, 20 bp, mouse
gcacgactaaatctgaagtc

SEQ ID NO: 684466 - DNA, 20 bp, mouse
gtgcactagccatgccttca

SEQ ID NO: 684467 - DNA, 20 bp, mouse
gagccttcctacttccctga

SEQ ID NO: 684468 - DNA, 20 bp, mouse
gcagtagagcagaagaataa

SEQ ID NO: 684469 - DNA, 20 bp, mouse
ggccatgccttcagggaagt

SEQ ID NO: 684470 - DNA, 20 bp, mouse
gttgagaaagcaccacccag

SEQ ID NO: 684471 - DNA, 20 bp, mouse
gtgccttcagggaagtagga

SEQ ID NO: 684472 - DNA, 20 bp, mouse
ggctggagagttacacccga

SEQ ID NO: 684473 - DNA, 20 bp, mouse
ggagcaggtgaccccctctg

SEQ ID NO: 684474 - DNA, 20 bp, mouse
ggtgagctctattaaagcac

SEQ ID NO: 684475 - DNA, 20 bp, mouse
gtacaggcaagaactgtagg

SEQ ID NO: 684476 - DNA, 20 bp, mouse
gcagtgaagtgcagccaagg

SEQ ID NO: 684477 - DNA, 20 bp, mouse
ggtggaacacaatatatcta

SEQ ID NO: 684478 - DNA, 20 bp, mouse
ggccatgaagaggccaataa

SEQ ID NO: 684479 - DNA, 20 bp, mouse
gctgttatcaagcagaatca

SEQ ID NO: 684480 - DNA, 20 bp, mouse
gggtgtgagtggcccaattt

SEQ ID NO: 684481 - DNA, 20 bp, mouse
gtgttattttttgtctgggg

SEQ ID NO: 684482 - DNA, 20 bp, mouse
gattgcccaaggccatgaag

SEQ ID NO: 684483 - DNA, 20 bp, mouse
gcttcactgctcattgccca

SEQ ID NO: 684484 - DNA, 20 bp, mouse
gctcttacctaggttaaaag

SEQ ID NO: 684485 - DNA, 20 bp, mouse
gtctcagcctctccagtcaa

SEQ ID NO: 684486 - DNA, 20 bp, mouse
gaggctgtgcaaggcgttgg

SEQ ID NO: 684487 - DNA, 20 bp, mouse
gtgtgcaaggcgttgggggg

SEQ ID NO: 684488 - DNA, 20 bp, mouse
gcagaggctgtgcaaggcgt

SEQ ID NO: 684489 - DNA, 20 bp, mouse
ggcacagcctctgggggatt

SEQ ID NO: 684490 - DNA, 20 bp, mouse
gagtcagccaaatcccccag

SEQ ID NO: 684491 - DNA, 20 bp, mouse
ggtgaggccacgtggtccca

SEQ ID NO: 684492 - DNA, 20 bp, mouse
gtccatgcagaggtagccat

SEQ ID NO: 684493 - DNA, 20 bp, mouse
gggctgactagtccatgcag

SEQ ID NO: 684494 - DNA, 20 bp, mouse
gtcagtattgaccatcgcat

SEQ ID NO: 684495 - DNA, 20 bp, mouse
gcagagagatgaagagaata

SEQ ID NO: 684496 - DNA, 20 bp, mouse
gtaaccctggatgggttgat

SEQ ID NO: 684497 - DNA, 20 bp, mouse
gttgagggcaacttcctctt

SEQ ID NO: 684498 - DNA, 20 bp, mouse
gcttcccatcaacccatcca

SEQ ID NO: 684499 - DNA, 20 bp, mouse
gtgcctctatgccagaccag

SEQ ID NO: 684500 - DNA, 20 bp, mouse
gactgagtcatgcaaatggt

SEQ ID NO: 684501 - DNA, 20 bp, mouse
gagaagaaagtgaccccact

SEQ ID NO: 684502 - DNA, 20 bp, mouse
ggatgggaagagctcccaag

SEQ ID NO: 684503 - DNA, 20 bp, mouse
gagttgccctcaaacccagt

SEQ ID NO: 684504 - DNA, 20 bp, mouse
ggtgaccccactgggtttga

SEQ ID NO: 684505 - DNA, 20 bp, mouse
gtaaaggagaacaaagcttt

SEQ ID NO: 684506 - DNA, 20 bp, mouse
gggacaagaagactccttgg

SEQ ID NO: 684507 - DNA, 20 bp, mouse
ggagggacaagaagactcct

SEQ ID NO: 684508 - DNA, 20 bp, mouse
gaaggccaagggccctctgc

SEQ ID NO: 684509 - DNA, 20 bp, mouse
gtaaggtagggcctagtcat

SEQ ID NO: 684510 - DNA, 20 bp, mouse
gcagcctgtttgcacctgca

SEQ ID NO: 684511 - DNA, 20 bp, mouse
gagcagctcgttccagtgtt

SEQ ID NO: 684512 - DNA, 20 bp, mouse
gtgcccagagcgtgtagcgc

SEQ ID NO: 684513 - DNA, 20 bp, mouse
gaggctcacagttgtccttg

SEQ ID NO: 684514 - DNA, 20 bp, mouse
gagtgcagatctagccccca

SEQ ID NO: 684515 - DNA, 20 bp, mouse
ggtcatgggtaataaatctg

SEQ ID NO: 684516 - DNA, 20 bp, mouse
gcaaaggagtccgaccttcc

SEQ ID NO: 684517 - DNA, 20 bp, mouse
ggcctcagaggtcccagctg

SEQ ID NO: 684518 - DNA, 20 bp, mouse
ggaagggtgcaatgcctcag

SEQ ID NO: 684519 - DNA, 20 bp, mouse
ggactgagggaatggatcag

SEQ ID NO: 684520 - DNA, 20 bp, mouse
gccagcaacactcacagcaa

SEQ ID NO: 684521 - DNA, 20 bp, mouse
gccggcacagcacccccagc

SEQ ID NO: 684522 - DNA, 20 bp, mouse
gtgaggttaaccaagcagaa

SEQ ID NO: 684523 - DNA, 20 bp, mouse
ggggggtgctgtgccggggc

SEQ ID NO: 684524 - DNA, 20 bp, mouse
gttagaggcagtgaactgaa

SEQ ID NO: 684525 - DNA, 20 bp, mouse
gcctctgtcaggtttggaaa

SEQ ID NO: 684526 - DNA, 20 bp, mouse
gtactacagtggagtcagat

SEQ ID NO: 684527 - DNA, 20 bp, mouse
gcagtgtcgaaatctaccca

SEQ ID NO: 684528 - DNA, 20 bp, mouse
gtgggtccagctaagatgta

SEQ ID NO: 684529 - DNA, 20 bp, mouse
gggtcactccttgacaagag

SEQ ID NO: 684530 - DNA, 20 bp, mouse
gtgtcctgggacattcttac

SEQ ID NO: 684531 - DNA, 20 bp, mouse
gtaaccagtaagaatgtccc

SEQ ID NO: 684532 - DNA, 20 bp, mouse
gtccagctaagatgtaaggc

SEQ ID NO: 684533 - DNA, 20 bp, mouse
gggatcctcacatttgcata

SEQ ID NO: 684534 - DNA, 20 bp, mouse
gtggggaaatctatgaaatg

SEQ ID NO: 684535 - DNA, 20 bp, mouse
gcaccttacctctcttgtca

SEQ ID NO: 684536 - DNA, 20 bp, mouse
gcccaggagggcttagaacg

SEQ ID NO: 684537 - DNA, 20 bp, mouse
gtgcgtggctagtgaacctt

SEQ ID NO: 684538 - DNA, 20 bp, mouse
gtctgtctagcgcacatcat

SEQ ID NO: 684539 - DNA, 20 bp, mouse
gacactaggcatctgttaaa

SEQ ID NO: 684540 - DNA, 20 bp, mouse
gcttagaacgaggctgtata

SEQ ID NO: 684541 - DNA, 20 bp, mouse
gacccattcaaaactcggat

SEQ ID NO: 684542 - DNA, 20 bp, mouse
gaagtcctctgcatcgtaac

SEQ ID NO: 684543 - DNA, 20 bp, mouse
gtcccatccgagttttgaat

SEQ ID NO: 684544 - DNA, 20 bp, mouse
ggcctcgttctaagccctcc

SEQ ID NO: 684545 - DNA, 20 bp, mouse
gagagctcccccaaagagtg

SEQ ID NO: 684546 - DNA, 20 bp, mouse
ggggcggggagagtcacaat

SEQ ID NO: 684547 - DNA, 20 bp, mouse
gagcagagacatcaaggagg

SEQ ID NO: 684548 - DNA, 20 bp, mouse
gttactagacggtctcataa

SEQ ID NO: 684549 - DNA, 20 bp, mouse
ggctgacaatccacgaaagc

SEQ ID NO: 684550 - DNA, 20 bp, mouse
gagcatgtggcaacctgcac

SEQ ID NO: 684551 - DNA, 20 bp, mouse
gggtaagaggacacgcttta

SEQ ID NO: 684552 - DNA, 20 bp, mouse
gggcaggtgggggttgacgg

SEQ ID NO: 684553 - DNA, 20 bp, mouse
gttgtccttgtgaattgaat

SEQ ID NO: 684554 - DNA, 20 bp, mouse
gtgggggttgacggtggtgg

SEQ ID NO: 684555 - DNA, 20 bp, mouse
gaggtgggggttgacggtgg

SEQ ID NO: 684556 - DNA, 20 bp, mouse
gtagtcagcagggtcatagt

SEQ ID NO: 684557 - DNA, 20 bp, mouse
gtagtagccgaggggtaaca

SEQ ID NO: 684558 - DNA, 20 bp, mouse
ggacaaaggaagtgtggctt

SEQ ID NO: 684559 - DNA, 20 bp, mouse
gcagtgaaatagcttgaaac

SEQ ID NO: 684560 - DNA, 20 bp, mouse
gcaggaaaaccatgtgcaga

SEQ ID NO: 684561 - DNA, 20 bp, mouse
ggcaatgcatagtagccgag

SEQ ID NO: 684562 - DNA, 20 bp, mouse
gtcaggtctgactagtcagc

SEQ ID NO: 684563 - DNA, 20 bp, mouse
ggaaatcactgagaggagct

SEQ ID NO: 684564 - DNA, 20 bp, mouse
ggagtgtatgaatataaaga

SEQ ID NO: 684565 - DNA, 20 bp, mouse
gcctggggcctgtcaagcat

SEQ ID NO: 684566 - DNA, 20 bp, mouse
gcaccccatgccctgattca

SEQ ID NO: 684567 - DNA, 20 bp, mouse
gggttgagcaacacccactg

SEQ ID NO: 684568 - DNA, 20 bp, mouse
ggctccatgaatcagggcat

SEQ ID NO: 684569 - DNA, 20 bp, mouse
gcaggtgggctccatgaatc

SEQ ID NO: 684570 - DNA, 20 bp, mouse
gggtctgaagccactagaaa

SEQ ID NO: 684571 - DNA, 20 bp, mouse
gcgcttctccagagcaaaca

SEQ ID NO: 684572 - DNA, 20 bp, mouse
gatcaaggccctgtttgctc

SEQ ID NO: 684573 - DNA, 20 bp, mouse
gaattagcaatgcagaggac

SEQ ID NO: 684574 - DNA, 20 bp, mouse
gttcagaccacagctatagt

SEQ ID NO: 684575 - DNA, 20 bp, mouse
gccagttcttcactgtaaca

SEQ ID NO: 684576 - DNA, 20 bp, mouse
gcaagaggtaaagtcttgga

SEQ ID NO: 684577 - DNA, 20 bp, mouse
gtctatgctcaagaattagg

SEQ ID NO: 684578 - DNA, 20 bp, mouse
gttatctatgctcaagaatt

SEQ ID NO: 684579 - DNA, 20 bp, mouse
ggtagtgcacacatgcggag

SEQ ID NO: 684580 - DNA, 20 bp, mouse
gcgggagtagtgcacacatg

SEQ ID NO: 684581 - DNA, 20 bp, mouse
gtgtgtgcactactcccgtt

SEQ ID NO: 684582 - DNA, 20 bp, mouse
gtaaagtcttggagggtcac

SEQ ID NO: 684583 - DNA, 20 bp, mouse
ggataaccaaccttcagggg

SEQ ID NO: 684584 - DNA, 20 bp, mouse
gaaaacggcacctcccctga

SEQ ID NO: 684585 - DNA, 20 bp, mouse
gcatagataaccaaccttca

SEQ ID NO: 684586 - DNA, 20 bp, mouse
gtatccaaggaaccacaagg

SEQ ID NO: 684587 - DNA, 20 bp, mouse
gaggagggtgagatcatcca

SEQ ID NO: 684588 - DNA, 20 bp, mouse
gtgtgcgtggcgcccccttg

SEQ ID NO: 684589 - DNA, 20 bp, mouse
gggtacgggactgttcccgt

SEQ ID NO: 684590 - DNA, 20 bp, mouse
gcaaagggatgctgtggact

SEQ ID NO: 684591 - DNA, 20 bp, mouse
ggggatgctgtggactcggt

SEQ ID NO: 684592 - DNA, 20 bp, mouse
ggggcggagccccttcctca

SEQ ID NO: 684593 - DNA, 20 bp, mouse
gtaatgagacgcagagctgt

SEQ ID NO: 684594 - DNA, 20 bp, mouse
gtgagatcatccaaggtcca

SEQ ID NO: 684595 - DNA, 20 bp, mouse
gtggggttccagacaggaca

SEQ ID NO: 684596 - DNA, 20 bp, mouse
gtgggatgggagcaaaacgt

SEQ ID NO: 684597 - DNA, 20 bp, mouse
gcaggtgtctcaaaccctga

SEQ ID NO: 684598 - DNA, 20 bp, mouse
ggggagcaaaacgtaggcac

SEQ ID NO: 684599 - DNA, 20 bp, mouse
gctgtcctgtaattatacca

SEQ ID NO: 684600 - DNA, 20 bp, mouse
gtaaagaaagaacgccctca

SEQ ID NO: 684601 - DNA, 20 bp, mouse
gtacaggacaggatatggat

SEQ ID NO: 684602 - DNA, 20 bp, mouse
gttgaccattacaagagagg

SEQ ID NO: 684603 - DNA, 20 bp, mouse
gggttccctggtataattac

SEQ ID NO: 684604 - DNA, 20 bp, mouse
gagaggtaattaacatttct

SEQ ID NO: 684605 - DNA, 20 bp, mouse
gtctgtaataatagagaggc

SEQ ID NO: 684606 - DNA, 20 bp, mouse
gacctctgagaggtgacata

SEQ ID NO: 684607 - DNA, 20 bp, mouse
gagtgcaaggcatggatagg

SEQ ID NO: 684608 - DNA, 20 bp, mouse
gtctgagaggtgacataagg

SEQ ID NO: 684609 - DNA, 20 bp, mouse
gcctctggataaacactgtg

SEQ ID NO: 684610 - DNA, 20 bp, mouse
ggaaaacaaaatctaggtcc

SEQ ID NO: 684611 - DNA, 20 bp, mouse
gggaataagtaacctctgag

SEQ ID NO: 684612 - DNA, 20 bp, mouse
ggaggaaagtcaaatcctga

SEQ ID NO: 684613 - DNA, 20 bp, mouse
gcagtacgaaaacaaaatct

SEQ ID NO: 684614 - DNA, 20 bp, mouse
ggtcaaccaaatgtgtgact

SEQ ID NO: 684615 - DNA, 20 bp, mouse
gctggtttccaccctttagt

SEQ ID NO: 684616 - DNA, 20 bp, mouse
gggtggggaattatgaactc

SEQ ID NO: 684617 - DNA, 20 bp, mouse
gagagcaaaatctaggccca

SEQ ID NO: 684618 - DNA, 20 bp, mouse
gacctctgagacgaggcata

SEQ ID NO: 684619 - DNA, 20 bp, mouse
gggctgccccggtgcaggga

SEQ ID NO: 684620 - DNA, 20 bp, mouse
ggtaagtaacctctgagacg

SEQ ID NO: 684621 - DNA, 20 bp, mouse
gtctgagacgaggcataggg

SEQ ID NO: 684622 - DNA, 20 bp, mouse
gcaaaatctaggcccagggt

SEQ ID NO: 684623 - DNA, 20 bp, mouse
gcaaagtataggtactccca

SEQ ID NO: 684624 - DNA, 20 bp, mouse
gagaatttgggtgtctccaa

SEQ ID NO: 684625 - DNA, 20 bp, mouse
ggttcataattccccaccct

SEQ ID NO: 684626 - DNA, 20 bp, mouse
gttctgctctacttcttagg

SEQ ID NO: 684627 - DNA, 20 bp, mouse
gactggggttctagtcagtg

SEQ ID NO: 684628 - DNA, 20 bp, mouse
gccactccttgacaagagac

SEQ ID NO: 684629 - DNA, 20 bp, mouse
gactccatgtccatcacatt

SEQ ID NO: 684630 - DNA, 20 bp, mouse
gctcaagactagagagatct

SEQ ID NO: 684631 - DNA, 20 bp, mouse
gagtgtggattccaatgcag

SEQ ID NO: 684632 - DNA, 20 bp, mouse
gcaggtgctgccccctgcat

SEQ ID NO: 684633 - DNA, 20 bp, mouse
ggagcacctgtctcttgtca

SEQ ID NO: 684634 - DNA, 20 bp, mouse
gtttcacaatagtaattact

SEQ ID NO: 684635 - DNA, 20 bp, mouse
gctttttgagggtagtacat

SEQ ID NO: 684636 - DNA, 20 bp, mouse
gagtggcacttagcattttc

SEQ ID NO: 684637 - DNA, 20 bp, mouse
ggctctacagcgcttatcca

SEQ ID NO: 684638 - DNA, 20 bp, mouse
gcctgatcagagtcaactac

SEQ ID NO: 684639 - DNA, 20 bp, mouse
gatcagagtcaactacagga

SEQ ID NO: 684640 - DNA, 20 bp, mouse
gacctcgaagttgagcttta

SEQ ID NO: 684641 - DNA, 20 bp, mouse
gatcgtaattacacattgga

SEQ ID NO: 684642 - DNA, 20 bp, mouse
gtgttttacagtgctggaca

SEQ ID NO: 684643 - DNA, 20 bp, mouse
gtccttaaagctcaacttcg

SEQ ID NO: 684644 - DNA, 20 bp, mouse
ggttgagctttaaggagaga

SEQ ID NO: 684645 - DNA, 20 bp, mouse
gtagacatggacatttttta

SEQ ID NO: 684646 - DNA, 20 bp, mouse
gtagaaggaatcacccacac

SEQ ID NO: 684647 - DNA, 20 bp, mouse
gcctaattagattaatgtta

SEQ ID NO: 684648 - DNA, 20 bp, mouse
gtgcaagcttcagtagttaa

SEQ ID NO: 684649 - DNA, 20 bp, mouse
gcatggggtaaaataactag

SEQ ID NO: 684650 - DNA, 20 bp, mouse
gtaattcagtgttgtctctc

SEQ ID NO: 684651 - DNA, 20 bp, mouse
gccacacaggcaaataattt

SEQ ID NO: 684652 - DNA, 20 bp, mouse
gtagaatagaaacaaatcac

SEQ ID NO: 684653 - DNA, 20 bp, mouse
gctattcactgatgattata

SEQ ID NO: 684654 - DNA, 20 bp, mouse
gtcatgtagctgtattttaa

SEQ ID NO: 684655 - DNA, 20 bp, mouse
gtcagtgaatagggaattcc

SEQ ID NO: 684656 - DNA, 20 bp, mouse
ggaactgaacagtagttctc

SEQ ID NO: 684657 - DNA, 20 bp, mouse
gccaaggagtgtgggcctaa

SEQ ID NO: 684658 - DNA, 20 bp, mouse
ggaggtaaggatgtggcctt

SEQ ID NO: 684659 - DNA, 20 bp, mouse
gttgagggccgcaggcaaga

SEQ ID NO: 684660 - DNA, 20 bp, mouse
gttctctggaggtaaggatg

SEQ ID NO: 684661 - DNA, 20 bp, mouse
gactctgctttctcatggga

SEQ ID NO: 684662 - DNA, 20 bp, mouse
ggtcagatgcctagatccag

SEQ ID NO: 684663 - DNA, 20 bp, mouse
ggccctcaagagacccagat

SEQ ID NO: 684664 - DNA, 20 bp, mouse
gttactgccccaaggagtgt

SEQ ID NO: 684665 - DNA, 20 bp, mouse
gagatgcctagatccagagg

SEQ ID NO: 684666 - DNA, 20 bp, mouse
gcagcatgatgtcacatcaa

SEQ ID NO: 684667 - DNA, 20 bp, mouse
gcagatggtgaacacagagc

SEQ ID NO: 684668 - DNA, 20 bp, mouse
gtatgtctcctcaccttctc

SEQ ID NO: 684669 - DNA, 20 bp, mouse
gggctgggtgtgggctcaga

SEQ ID NO: 684670 - DNA, 20 bp, mouse
gtcctggttcaaagcctcat

SEQ ID NO: 684671 - DNA, 20 bp, mouse
gacatctctgtgttccaatg

SEQ ID NO: 684672 - DNA, 20 bp, mouse
gaccaggaggtagcatgcaa

SEQ ID NO: 684673 - DNA, 20 bp, mouse
gaacaacctgtgtcttttca

SEQ ID NO: 684674 - DNA, 20 bp, mouse
gatgtaacactggctgggtg

SEQ ID NO: 684675 - DNA, 20 bp, mouse
ggaaaggttcaataaccatg

SEQ ID NO: 684676 - DNA, 20 bp, mouse
ggcactgaccacacactcct

SEQ ID NO: 684677 - DNA, 20 bp, mouse
gagtgtgtggtcagtgctgt

SEQ ID NO: 684678 - DNA, 20 bp, mouse
gctaagtcctacaatggcca

SEQ ID NO: 684679 - DNA, 20 bp, mouse
gggagacagactgtacccgt

SEQ ID NO: 684680 - DNA, 20 bp, mouse
gaataaaggagtgtcagcct

SEQ ID NO: 684681 - DNA, 20 bp, mouse
ggtgaacagcatctcagtta

SEQ ID NO: 684682 - DNA, 20 bp, mouse
ggctccagagtagaggattc

SEQ ID NO: 684683 - DNA, 20 bp, mouse
gagcatagacaatctgtcag

SEQ ID NO: 684684 - DNA, 20 bp, mouse
gctgtacccgtgggcctcgg

SEQ ID NO: 684685 - DNA, 20 bp, mouse
ggtgtcagcctaggagtgtg

SEQ ID NO: 684686 - DNA, 20 bp, mouse
gagtgtggaaatctatccag

SEQ ID NO: 684687 - DNA, 20 bp, mouse
gaataggcttaggtctcaat

SEQ ID NO: 684688 - DNA, 20 bp, mouse
gtcccctcatctaagatgta

SEQ ID NO: 684689 - DNA, 20 bp, mouse
ggccctacatcttagatgag

SEQ ID NO: 684690 - DNA, 20 bp, mouse
gctccatgagaagagaagta

SEQ ID NO: 684691 - DNA, 20 bp, mouse
ggggttacacatttgcataa

SEQ ID NO: 684692 - DNA, 20 bp, mouse
gtgcccaaacagaaggatct

SEQ ID NO: 684693 - DNA, 20 bp, mouse
gaggtgctcacactaacccc

SEQ ID NO: 684694 - DNA, 20 bp, mouse
gcagtgccttagataggacc

SEQ ID NO: 684695 - DNA, 20 bp, mouse
gcaccaagatccttctgttt

SEQ ID NO: 684696 - DNA, 20 bp, mouse
gagaactggctgacggtgaa

SEQ ID NO: 684697 - DNA, 20 bp, mouse
gggtgaaactgagaacacac

SEQ ID NO: 684698 - DNA, 20 bp, mouse
gggagtatttccaaacctta

SEQ ID NO: 684699 - DNA, 20 bp, mouse
gctaataatagagaaccaga

SEQ ID NO: 684700 - DNA, 20 bp, mouse
ggtaatcagctccatgtaca

SEQ ID NO: 684701 - DNA, 20 bp, mouse
gcggtgaacggtagtaccac

SEQ ID NO: 684702 - DNA, 20 bp, mouse
gagtgcttggccatgtttga

SEQ ID NO: 684703 - DNA, 20 bp, mouse
gggcatgtaatggtcaaatt

SEQ ID NO: 684704 - DNA, 20 bp, mouse
gcactggtcaggaggaacca

SEQ ID NO: 684705 - DNA, 20 bp, mouse
gaggttaagcttcactggtc

SEQ ID NO: 684706 - DNA, 20 bp, mouse
gaagtgtggcaataatgcaa

SEQ ID NO: 684707 - DNA, 20 bp, mouse
gatagccaatacaattgata

SEQ ID NO: 684708 - DNA, 20 bp, mouse
gacacaagtggacataagtg

SEQ ID NO: 684709 - DNA, 20 bp, mouse
gtgtgtctgaagatttcctg

SEQ ID NO: 684710 - DNA, 20 bp, mouse
gaaaaccaaagataactcaa

SEQ ID NO: 684711 - DNA, 20 bp, mouse
gagaataagttattctctgt

SEQ ID NO: 684712 - DNA, 20 bp, mouse
gtttcccttatcaattgtat

SEQ ID NO: 684713 - DNA, 20 bp, mouse
gtcaattgtattggctattt

SEQ ID NO: 684714 - DNA, 20 bp, mouse
gttatattatagtaaggtat

SEQ ID NO: 684715 - DNA, 20 bp, mouse
gttttccattgagttatctt

SEQ ID NO: 684716 - DNA, 20 bp, mouse
gtgcaggaggaactcctctg

SEQ ID NO: 684717 - DNA, 20 bp, mouse
gcagcagcccaaatgactct

SEQ ID NO: 684718 - DNA, 20 bp, mouse
gtgaccaagtcaaatatctg

SEQ ID NO: 684719 - DNA, 20 bp, mouse
ggaaaagcttggggaacgtt

SEQ ID NO: 684720 - DNA, 20 bp, mouse
ggccctacttcttaggtgag

SEQ ID NO: 684721 - DNA, 20 bp, mouse
gtgggtgtatggtgagtttc

SEQ ID NO: 684722 - DNA, 20 bp, mouse
ggccttatgtccatcacatt

SEQ ID NO: 684723 - DNA, 20 bp, mouse
gttaggattttacactgact

SEQ ID NO: 684724 - DNA, 20 bp, mouse
gtatgtgctacctcctcgtt

SEQ ID NO: 684725 - DNA, 20 bp, mouse
ggtgtaaaatcctaacgagg

SEQ ID NO: 684726 - DNA, 20 bp, mouse
gctagagtagggagttctaa

SEQ ID NO: 684727 - DNA, 20 bp, mouse
gtctcaagacaaatggtcac

SEQ ID NO: 684728 - DNA, 20 bp, mouse
ggactcagaaagcctatgga

SEQ ID NO: 684729 - DNA, 20 bp, mouse
gcagctggagtttgtgctcc

SEQ ID NO: 684730 - DNA, 20 bp, mouse
gggagatctctcaagacaaa

SEQ ID NO: 684731 - DNA, 20 bp, mouse
ggtgtgatgcctccctccat

SEQ ID NO: 684732 - DNA, 20 bp, mouse
gaggagctaatctagattga

SEQ ID NO: 684733 - DNA, 20 bp, mouse
gctactctagaaaacacaac

SEQ ID NO: 684734 - DNA, 20 bp, mouse
gtgagagatctccaatactg

SEQ ID NO: 684735 - DNA, 20 bp, mouse
gcaacaggatctaagatttc

SEQ ID NO: 684736 - DNA, 20 bp, mouse
gtacaggaagaaatcttctg

SEQ ID NO: 684737 - DNA, 20 bp, mouse
gaaagaagaaacatcccctt

SEQ ID NO: 684738 - DNA, 20 bp, mouse
gctgaaggccagccccaaag

SEQ ID NO: 684739 - DNA, 20 bp, mouse
gaagagctacctgacgctga

SEQ ID NO: 684740 - DNA, 20 bp, mouse
gtatctctctagtgaggggg

SEQ ID NO: 684741 - DNA, 20 bp, mouse
gcaccttatctctctagtga

SEQ ID NO: 684742 - DNA, 20 bp, mouse
gtcatctgcctgaagaagaa

SEQ ID NO: 684743 - DNA, 20 bp, mouse
gggggctggccttcagcgtc

SEQ ID NO: 684744 - DNA, 20 bp, mouse
gtcttcttgctaaacaatac

SEQ ID NO: 684745 - DNA, 20 bp, mouse
gctacacaggagaaagtacc

SEQ ID NO: 684746 - DNA, 20 bp, mouse
gctactgcagaggcagcacc

SEQ ID NO: 684747 - DNA, 20 bp, mouse
ggtgtagaatcctactgcag

SEQ ID NO: 684748 - DNA, 20 bp, mouse
gtgggggggggggcatatgg

SEQ ID NO: 684749 - DNA, 20 bp, mouse
ggggacttttgagatgacat

SEQ ID NO: 684750 - DNA, 20 bp, mouse
ggacattggaaatgtagttg

SEQ ID NO: 684751 - DNA, 20 bp, mouse
gtctcttctcaaagtgacct

SEQ ID NO: 684752 - DNA, 20 bp, mouse
gttttataattgtaattcct

SEQ ID NO: 684753 - DNA, 20 bp, mouse
gctacactgacttaaatcca

SEQ ID NO: 684754 - DNA, 20 bp, mouse
gcactttgagaagagagata

SEQ ID NO: 684755 - DNA, 20 bp, mouse
ggattgggggggggggcata

SEQ ID NO: 684756 - DNA, 20 bp, mouse
gtgtctcttatgcaactgtg

SEQ ID NO: 684757 - DNA, 20 bp, mouse
gacagggacccatgctgttc

SEQ ID NO: 684758 - DNA, 20 bp, mouse
gcaggtgctgcctcctggat

SEQ ID NO: 684759 - DNA, 20 bp, mouse
gtctcttgttaaaatgacct

SEQ ID NO: 684760 - DNA, 20 bp, mouse
ggggcacactaagttgctgg

SEQ ID NO: 684761 - DNA, 20 bp, mouse
gcactgttgagcagtcactt

SEQ ID NO: 684762 - DNA, 20 bp, mouse
ggtcacctaagaagtaaggc

SEQ ID NO: 684763 - DNA, 20 bp, mouse
gccaagcccaaatggatcta

SEQ ID NO: 684764 - DNA, 20 bp, mouse
gaaagtctctaaacaggatt

SEQ ID NO: 684765 - DNA, 20 bp, mouse
ggtgtagaatcctatccagg

SEQ ID NO: 684766 - DNA, 20 bp, mouse
ggaatgcctgggtgaagaag

SEQ ID NO: 684767 - DNA, 20 bp, mouse
gtgagggttgcctgcagctg

SEQ ID NO: 684768 - DNA, 20 bp, mouse
gccccagagtttgtgtctct

SEQ ID NO: 684769 - DNA, 20 bp, mouse
gtaggggagcaggtgggggg

SEQ ID NO: 684770 - DNA, 20 bp, mouse
gcacctagagacacaaactc

SEQ ID NO: 684771 - DNA, 20 bp, mouse
gcatttccagtgctgttgat

SEQ ID NO: 684772 - DNA, 20 bp, mouse
ggatatagctatctctagtg

SEQ ID NO: 684773 - DNA, 20 bp, mouse
ggtgcatatgtagcagaaaa

SEQ ID NO: 684774 - DNA, 20 bp, mouse
ggagcttcaccctcagctgc

SEQ ID NO: 684775 - DNA, 20 bp, mouse
gggacctctcttccgaatga

SEQ ID NO: 684776 - DNA, 20 bp, mouse
gcggcagccaagaaccttgt

SEQ ID NO: 684777 - DNA, 20 bp, mouse
gtcagtgggtggagtacatg

SEQ ID NO: 684778 - DNA, 20 bp, mouse
gcaatgaccacgcccctcgt

SEQ ID NO: 684779 - DNA, 20 bp, mouse
gcgtgagcctacaaggttct

SEQ ID NO: 684780 - DNA, 20 bp, mouse
gcaaacatatggggcgggag

SEQ ID NO: 684781 - DNA, 20 bp, mouse
ggaggggcgtggtcattgcg

SEQ ID NO: 684782 - DNA, 20 bp, mouse
gtcccgagaggagttcgaat

SEQ ID NO: 684783 - DNA, 20 bp, mouse
gtccttgcgccgggcggcgt

SEQ ID NO: 684784 - DNA, 20 bp, mouse
gcccggcgcaaggagatctt

SEQ ID NO: 684785 - DNA, 20 bp, mouse
gcgatgggcgggacctgggt

SEQ ID NO: 684786 - DNA, 20 bp, mouse
gtggtcccctggaacccaag

SEQ ID NO: 684787 - DNA, 20 bp, mouse
gtgaggctaagtctcctcgt

SEQ ID NO: 684788 - DNA, 20 bp, mouse
gtccccacaggggagtaagt

SEQ ID NO: 684789 - DNA, 20 bp, mouse
gcaggggccgccagtaatct

SEQ ID NO: 684790 - DNA, 20 bp, mouse
gtgaccgcatctcccaaccc

SEQ ID NO: 684791 - DNA, 20 bp, mouse
gtctcccaacccaggccact

SEQ ID NO: 684792 - DNA, 20 bp, mouse
gaacccaagtggcctgggtt

SEQ ID NO: 684793 - DNA, 20 bp, mouse
gaggaatccaagattactgg

SEQ ID NO: 684794 - DNA, 20 bp, mouse
gcctggaacccaagtggcct

SEQ ID NO: 684795 - DNA, 20 bp, mouse
ggcgggtcgcggtggtcccc

SEQ ID NO: 684796 - DNA, 20 bp, mouse
ggggcggcggcgtctctcgc

SEQ ID NO: 684797 - DNA, 20 bp, mouse
gtgcccgggcggggtctcgg

SEQ ID NO: 684798 - DNA, 20 bp, mouse
gctctcgcgggctgcccggg

SEQ ID NO: 684799 - DNA, 20 bp, mouse
gcacccacccagccacccgc

SEQ ID NO: 684800 - DNA, 20 bp, mouse
gggtcgcggcgtccggcggg

SEQ ID NO: 684801 - DNA, 20 bp, mouse
gcgtctctcgcgggctgccc

SEQ ID NO: 684802 - DNA, 20 bp, mouse
gggctgcccgggcggggtct

SEQ ID NO: 684803 - DNA, 20 bp, mouse
gtgaacggttggacgctagg

SEQ ID NO: 684804 - DNA, 20 bp, mouse
gggcctccgcgctgaacggt

SEQ ID NO: 684805 - DNA, 20 bp, mouse
gcgggaggctggaagctcgc

SEQ ID NO: 684806 - DNA, 20 bp, mouse
ggaagcgcgcagcaggacag

SEQ ID NO: 684807 - DNA, 20 bp, mouse
gcgcgtgagggtggccccgg

SEQ ID NO: 684808 - DNA, 20 bp, mouse
gggtctacccgaaaggtctg

SEQ ID NO: 684809 - DNA, 20 bp, mouse
gggacagtggtctacccgaa

SEQ ID NO: 684810 - DNA, 20 bp, mouse
gcccgcgccgctgaccgcgg

SEQ ID NO: 684811 - DNA, 20 bp, mouse
ggcggtgtgagagacggagg

SEQ ID NO: 684812 - DNA, 20 bp, mouse
gcgggcgggcccctgcctga

SEQ ID NO: 684813 - DNA, 20 bp, mouse
gggggcggcggtgtgagaga

SEQ ID NO: 684814 - DNA, 20 bp, mouse
ggcagctgctgtcgcctccc

SEQ ID NO: 684815 - DNA, 20 bp, mouse
ggcggcggtgtgagagacgg

SEQ ID NO: 684816 - DNA, 20 bp, mouse
gaaccaggaagtcggcggga

SEQ ID NO: 684817 - DNA, 20 bp, mouse
gccgcgaaccaggaagtcgg

SEQ ID NO: 684818 - DNA, 20 bp, mouse
gcacctggccgcgcgggctc

SEQ ID NO: 684819 - DNA, 20 bp, mouse
gagtcgtgatgtgggaaccc

SEQ ID NO: 684820 - DNA, 20 bp, mouse
gaggccgcggagggcgccgt

SEQ ID NO: 684821 - DNA, 20 bp, mouse
ggctgtgcgtccggtgtctg

SEQ ID NO: 684822 - DNA, 20 bp, mouse
gttcccaggccggggatcgc

SEQ ID NO: 684823 - DNA, 20 bp, mouse
gctcctgctgtcctgggcac

SEQ ID NO: 684824 - DNA, 20 bp, mouse
gggccccggtagtgctctct

SEQ ID NO: 684825 - DNA, 20 bp, mouse
gggaaagcacttctgccccg

SEQ ID NO: 684826 - DNA, 20 bp, mouse
ggtggccatggggaccataa

SEQ ID NO: 684827 - DNA, 20 bp, mouse
gaagtctagcttcaccctta

SEQ ID NO: 684828 - DNA, 20 bp, mouse
gtcacagcctaggtggggac

SEQ ID NO: 684829 - DNA, 20 bp, mouse
gctgcactgaagagcaaaag

SEQ ID NO: 684830 - DNA, 20 bp, mouse
gaggtggggacagggtctat

SEQ ID NO: 684831 - DNA, 20 bp, mouse
ggcaacacagggaaatgatg

SEQ ID NO: 684832 - DNA, 20 bp, mouse
gacgcctgagttcctcacag

SEQ ID NO: 684833 - DNA, 20 bp, mouse
gactcagaaagaaagggcct

SEQ ID NO: 684834 - DNA, 20 bp, mouse
gccaggggactcagaaagaa

SEQ ID NO: 684835 - DNA, 20 bp, mouse
gaggaaactgagcagatcag

SEQ ID NO: 684836 - DNA, 20 bp, mouse
gccgccgccgaggggagcca

SEQ ID NO: 684837 - DNA, 20 bp, mouse
ggcggcgggccctgggagag

SEQ ID NO: 684838 - DNA, 20 bp, mouse
ggaggggagccacggtaaac

SEQ ID NO: 684839 - DNA, 20 bp, mouse
gtcccagggcccgccgccga

SEQ ID NO: 684840 - DNA, 20 bp, mouse
gccacccctcgaaaggcgag

SEQ ID NO: 684841 - DNA, 20 bp, mouse
gccacagcaaccactctccc

SEQ ID NO: 684842 - DNA, 20 bp, mouse
gtcgccccctcgcctttcga

SEQ ID NO: 684843 - DNA, 20 bp, mouse
gctcactggagccgcgggat

SEQ ID NO: 684844 - DNA, 20 bp, mouse
gtggagccgcgggatgggtc

SEQ ID NO: 684845 - DNA, 20 bp, mouse
gcagctgcggattagctcac

SEQ ID NO: 684846 - DNA, 20 bp, mouse
gcggagagaccgcctggcgt

SEQ ID NO: 684847 - DNA, 20 bp, mouse
gcccccgagctcacccagta

SEQ ID NO: 684848 - DNA, 20 bp, mouse
gcacactggtaccccagcgc

SEQ ID NO: 684849 - DNA, 20 bp, mouse
gctgcaccgcgctggttcca

SEQ ID NO: 684850 - DNA, 20 bp, mouse
ggctcggaacccacgccagg

SEQ ID NO: 684851 - DNA, 20 bp, mouse
gactggtaccccagcgctgg

SEQ ID NO: 684852 - DNA, 20 bp, mouse
gccggggccaggtgcgttat

SEQ ID NO: 684853 - DNA, 20 bp, mouse
gaggctctgccttgctgtaa

SEQ ID NO: 684854 - DNA, 20 bp, mouse
gggggactgcggaacctgtg

SEQ ID NO: 684855 - DNA, 20 bp, mouse
gacacaaggtcggatggagt

SEQ ID NO: 684856 - DNA, 20 bp, mouse
ggcctcgtggggcacagcac

SEQ ID NO: 684857 - DNA, 20 bp, mouse
gcgtgagcagtggaggatga

SEQ ID NO: 684858 - DNA, 20 bp, mouse
ggcctgtgaagatcagacta

SEQ ID NO: 684859 - DNA, 20 bp, mouse
gttacaaacccaggcagcga

SEQ ID NO: 684860 - DNA, 20 bp, mouse
gccacgaggcagcttagtgt

SEQ ID NO: 684861 - DNA, 20 bp, mouse
gcaggcatccctcgctgcct

SEQ ID NO: 684862 - DNA, 20 bp, mouse
gtccatagtctgatcttcac

SEQ ID NO: 684863 - DNA, 20 bp, mouse
gggagctgcaaagtcccacc

SEQ ID NO: 684864 - DNA, 20 bp, mouse
gcacagctgcttctgggcca

SEQ ID NO: 684865 - DNA, 20 bp, mouse
gcactggaattgaaagccct

SEQ ID NO: 684866 - DNA, 20 bp, mouse
gggcaggggcaggacttcta

SEQ ID NO: 684867 - DNA, 20 bp, mouse
gtgtctggccggacctgcgt

SEQ ID NO: 684868 - DNA, 20 bp, mouse
gaggggccaaacccgcagag

SEQ ID NO: 684869 - DNA, 20 bp, mouse
gccctgccaaatcacagacc

SEQ ID NO: 684870 - DNA, 20 bp, mouse
gcaaacccgcagaggggctt

SEQ ID NO: 684871 - DNA, 20 bp, mouse
gaggggcaggacttctatgg

SEQ ID NO: 684872 - DNA, 20 bp, mouse
gaagcctccccgcctctctt

SEQ ID NO: 684873 - DNA, 20 bp, mouse
gcgtgggtgtggcctcttcg

SEQ ID NO: 684874 - DNA, 20 bp, mouse
gggtgtggcctcttcggggt

SEQ ID NO: 684875 - DNA, 20 bp, mouse
ggcaaccagcccaagagagg

SEQ ID NO: 684876 - DNA, 20 bp, mouse
gtgacccgaggggcaggaat

SEQ ID NO: 684877 - DNA, 20 bp, mouse
gctagggggtgggtcgtggg

SEQ ID NO: 684878 - DNA, 20 bp, mouse
gaggccgaatctgacccgag

SEQ ID NO: 684879 - DNA, 20 bp, mouse
gctgcccctcgggtcagatt

SEQ ID NO: 684880 - DNA, 20 bp, mouse
gccggccgcggcgggttcgg

SEQ ID NO: 684881 - DNA, 20 bp, mouse
ggcaggaatgggccgagcta

SEQ ID NO: 684882 - DNA, 20 bp, mouse
gggagtgacggtaaagacat

SEQ ID NO: 684883 - DNA, 20 bp, mouse
ggagctagggggtgggtcgt

SEQ ID NO: 684884 - DNA, 20 bp, mouse
gccagccgccgaacccgccg

SEQ ID NO: 684885 - DNA, 20 bp, mouse
gacggtaaagacatgggggc

SEQ ID NO: 684886 - DNA, 20 bp, mouse
gccactaagggtcctgtgca

SEQ ID NO: 684887 - DNA, 20 bp, mouse
gtaagggtcctgtgcaaggc

SEQ ID NO: 684888 - DNA, 20 bp, mouse
gtatgggtgtgtggtatcgc

SEQ ID NO: 684889 - DNA, 20 bp, mouse
gaacgcagacctcccactaa

SEQ ID NO: 684890 - DNA, 20 bp, mouse
gttggggcatgtgtgtccag

SEQ ID NO: 684891 - DNA, 20 bp, mouse
gggtgtgtggtatcgctggg

SEQ ID NO: 684892 - DNA, 20 bp, mouse
ggccaggttgagaagacagt

SEQ ID NO: 684893 - DNA, 20 bp, mouse
ggttgagaagacagtcggtt

SEQ ID NO: 684894 - DNA, 20 bp, mouse
ggggaggctacttcctgaaa

SEQ ID NO: 684895 - DNA, 20 bp, mouse
gtcctgaaatggctgcgaag

SEQ ID NO: 684896 - DNA, 20 bp, mouse
gcctgcagtgcgacccctgg

SEQ ID NO: 684897 - DNA, 20 bp, mouse
gagggccccctgcaaccaag

SEQ ID NO: 684898 - DNA, 20 bp, mouse
ggggcctgcggccgtgaccc

SEQ ID NO: 684899 - DNA, 20 bp, mouse
gctgacttcggggccatctg

SEQ ID NO: 684900 - DNA, 20 bp, mouse
ggggttctaaacgtggaagt

SEQ ID NO: 684901 - DNA, 20 bp, mouse
gggggggggcagaatagcgg

SEQ ID NO: 684902 - DNA, 20 bp, mouse
gcaagcggattcccaccacc

SEQ ID NO: 684903 - DNA, 20 bp, mouse
gccgcctgcagtgcgacccc

SEQ ID NO: 684904 - DNA, 20 bp, mouse
gcgcaggcccgggtgtgtgg

SEQ ID NO: 684905 - DNA, 20 bp, mouse
gatggccccgaagtcagagt

SEQ ID NO: 684906 - DNA, 20 bp, mouse
ggggtggagcccaaccacag

SEQ ID NO: 684907 - DNA, 20 bp, mouse
ggggcacaagcgcagaggcg

SEQ ID NO: 684908 - DNA, 20 bp, mouse
gcacaggggcgtggctctag

SEQ ID NO: 684909 - DNA, 20 bp, mouse
gggggcgtgggtcaacctct

SEQ ID NO: 684910 - DNA, 20 bp, mouse
gaggcttggtaggagtctgg

SEQ ID NO: 684911 - DNA, 20 bp, mouse
gtggaaaagagcggaaggaa

SEQ ID NO: 684912 - DNA, 20 bp, mouse
gagggcaactgccgaccgaa

SEQ ID NO: 684913 - DNA, 20 bp, mouse
gcctcctggcagaattctgg

SEQ ID NO: 684914 - DNA, 20 bp, mouse
ggggaaggcaaaaaagaata

SEQ ID NO: 684915 - DNA, 20 bp, mouse
gcttcggcgtcgggattcta

SEQ ID NO: 684916 - DNA, 20 bp, mouse
gtggaggtggctgcagtcgc

SEQ ID NO: 684917 - DNA, 20 bp, mouse
gaccgctggccactctgtgg

SEQ ID NO: 684918 - DNA, 20 bp, mouse
gtgcgcacgcgcggtcgggg

SEQ ID NO: 684919 - DNA, 20 bp, mouse
ggtcggggaggggcggtcgt

SEQ ID NO: 684920 - DNA, 20 bp, mouse
ggggcggtcgtcgggcgcaa

SEQ ID NO: 684921 - DNA, 20 bp, mouse
ggggtgtcgcagtcgcgtgg

SEQ ID NO: 684922 - DNA, 20 bp, mouse
gtggccagcggtcagctgct

SEQ ID NO: 684923 - DNA, 20 bp, mouse
gctggaagcccaggcccccg

SEQ ID NO: 684924 - DNA, 20 bp, mouse
gtgtcgcagtcgcgtggagg

SEQ ID NO: 684925 - DNA, 20 bp, mouse
gtataggagcaggattcggt

SEQ ID NO: 684926 - DNA, 20 bp, mouse
ggggctgcaccgtgcaagag

SEQ ID NO: 684927 - DNA, 20 bp, mouse
gccgccgcggctgcgcccgc

SEQ ID NO: 684928 - DNA, 20 bp, mouse
gcccacccgcggtaatattg

SEQ ID NO: 684929 - DNA, 20 bp, mouse
gagtgagctcggaggatcgg

SEQ ID NO: 684930 - DNA, 20 bp, mouse
gcgcgcgccaccgagctctg

SEQ ID NO: 684931 - DNA, 20 bp, mouse
ggagcgcccgcagagctcgg

SEQ ID NO: 684932 - DNA, 20 bp, mouse
ggcgcggttcagttgacccg

SEQ ID NO: 684933 - DNA, 20 bp, mouse
gcgtgctcaaccgactgttg

SEQ ID NO: 684934 - DNA, 20 bp, mouse
gcgcgcaccagtgagctcgg

SEQ ID NO: 684935 - DNA, 20 bp, mouse
gcccgctggagcgcagcgtc

SEQ ID NO: 684936 - DNA, 20 bp, mouse
gcgagcagcagagatagccg

SEQ ID NO: 684937 - DNA, 20 bp, mouse
gaggcacgtgaccctgggag

SEQ ID NO: 684938 - DNA, 20 bp, mouse
gccacgaggcacgtgaccct

SEQ ID NO: 684939 - DNA, 20 bp, mouse
gcacgtgaccctgggagcgg

SEQ ID NO: 684940 - DNA, 20 bp, mouse
ggactcccggaataggggcg

SEQ ID NO: 684941 - DNA, 20 bp, mouse
gctctgctgctcgctcagac

SEQ ID NO: 684942 - DNA, 20 bp, mouse
ggagatagccgcggcttgta

SEQ ID NO: 684943 - DNA, 20 bp, mouse
gtaaactcaaacagtggctc

SEQ ID NO: 684944 - DNA, 20 bp, mouse
ggctccggactcccggaata

SEQ ID NO: 684945 - DNA, 20 bp, mouse
gactgaaccccccgctccca

SEQ ID NO: 684946 - DNA, 20 bp, mouse
gaggccccagccggttagaa

SEQ ID NO: 684947 - DNA, 20 bp, mouse
gacccgggtcggccagtagg

SEQ ID NO: 684948 - DNA, 20 bp, mouse
gtagaagggtctagagatgg

SEQ ID NO: 684949 - DNA, 20 bp, mouse
gcggctggggcctttctcgc

SEQ ID NO: 684950 - DNA, 20 bp, mouse
gggccacactagccacctac

SEQ ID NO: 684951 - DNA, 20 bp, mouse
gctgcctggcgtatggattg

SEQ ID NO: 684952 - DNA, 20 bp, mouse
ggagattgcgtgacccgggt

SEQ ID NO: 684953 - DNA, 20 bp, mouse
gtcacgcaatctccattatc

SEQ ID NO: 684954 - DNA, 20 bp, mouse
gtacgttaggcgacactcta

SEQ ID NO: 684955 - DNA, 20 bp, mouse
ggggtatccaacccggccga

SEQ ID NO: 684956 - DNA, 20 bp, mouse
gggtgggcggggcccaaaaa

SEQ ID NO: 684957 - DNA, 20 bp, mouse
gtcccccgggctccacgcat

SEQ ID NO: 684958 - DNA, 20 bp, mouse
ggggcggggcccaaaaaggg

SEQ ID NO: 684959 - DNA, 20 bp, mouse
ggccggggatatcgcgataa

SEQ ID NO: 684960 - DNA, 20 bp, mouse
gtagaggcggccggacggta

SEQ ID NO: 684961 - DNA, 20 bp, mouse
gcggccgcctctacgcaact

SEQ ID NO: 684962 - DNA, 20 bp, mouse
gcgcccatgcgtggagcccg

SEQ ID NO: 684963 - DNA, 20 bp, mouse
ggcgtggagcccgggggaag

SEQ ID NO: 684964 - DNA, 20 bp, mouse
ggacgccaccgtgccggggt

SEQ ID NO: 684965 - DNA, 20 bp, mouse
gtcgcgagacgccaccgtgc

SEQ ID NO: 684966 - DNA, 20 bp, mouse
ggagcccctagaatcaagaa

SEQ ID NO: 684967 - DNA, 20 bp, mouse
gtccgagcgaagctgattgg

SEQ ID NO: 684968 - DNA, 20 bp, mouse
gcgagcacagcttgtctggg

SEQ ID NO: 684969 - DNA, 20 bp, mouse
gactctcccttcttgattct

SEQ ID NO: 684970 - DNA, 20 bp, mouse
gacacaccgaggtcttttag

SEQ ID NO: 684971 - DNA, 20 bp, mouse
gtcacatgatgctacacgga

SEQ ID NO: 684972 - DNA, 20 bp, mouse
gcgattgtatagctaaagaa

SEQ ID NO: 684973 - DNA, 20 bp, mouse
ggtcttttaggggtagtgtc

SEQ ID NO: 684974 - DNA, 20 bp, mouse
ggtagcatcatgtgactcaa

SEQ ID NO: 684975 - DNA, 20 bp, mouse
gtttagctatacaatcgctt

SEQ ID NO: 684976 - DNA, 20 bp, mouse
ggcgctgcccaaaacctacc

SEQ ID NO: 684977 - DNA, 20 bp, mouse
ggtgctggaggcgcaacccc

SEQ ID NO: 684978 - DNA, 20 bp, mouse
gtgcgcctccagcacctagg

SEQ ID NO: 684979 - DNA, 20 bp, mouse
gaccccgggtagtgaaatcc

SEQ ID NO: 684980 - DNA, 20 bp, mouse
gacaggaactgtgtggtggg

SEQ ID NO: 684981 - DNA, 20 bp, mouse
ggtgacaggaactgtgtggt

SEQ ID NO: 684982 - DNA, 20 bp, mouse
gcggcagggacagtcccggt

SEQ ID NO: 684983 - DNA, 20 bp, mouse
gcaagcatccgagcgcccat

SEQ ID NO: 684984 - DNA, 20 bp, mouse
gactgtgtgccggcggtacg

SEQ ID NO: 684985 - DNA, 20 bp, mouse
gcgttgcgagggcacgtgac

SEQ ID NO: 684986 - DNA, 20 bp, mouse
gcgggcagccctgtagacgg

SEQ ID NO: 684987 - DNA, 20 bp, mouse
gcagccctgtagacggtggc

SEQ ID NO: 684988 - DNA, 20 bp, mouse
ggaaacgaaggtcttggctg

SEQ ID NO: 684989 - DNA, 20 bp, mouse
ggggctatgtagcaagaaaa

SEQ ID NO: 684990 - DNA, 20 bp, mouse
gggaaacgccaacgggaact

SEQ ID NO: 684991 - DNA, 20 bp, mouse
gtggcgcggccaccgagacg

SEQ ID NO: 684992 - DNA, 20 bp, mouse
gggccaccgagacgaggcgg

SEQ ID NO: 684993 - DNA, 20 bp, mouse
gtccggggctgcggggaggt

SEQ ID NO: 684994 - DNA, 20 bp, mouse
gcgcgccacttcctcctccg

SEQ ID NO: 684995 - DNA, 20 bp, mouse
gagcctccgcctcgtctcgg

SEQ ID NO: 684996 - DNA, 20 bp, mouse
gactcagcgggtctagcccc

SEQ ID NO: 684997 - DNA, 20 bp, mouse
gaagactccggttggagcga

SEQ ID NO: 684998 - DNA, 20 bp, mouse
gagtcccaaggtgtccctcc

SEQ ID NO: 684999 - DNA, 20 bp, mouse
ggtccaggtagaaagtactt

SEQ ID NO: 685000 - DNA, 20 bp, mouse
ggggacaccttgggactcag

SEQ ID NO: 685001 - DNA, 20 bp, mouse
gacctggagcaataagactc

SEQ ID NO: 685002 - DNA, 20 bp, mouse
gctagacccgctgagtccca

SEQ ID NO: 685003 - DNA, 20 bp, mouse
ggatcctggagggacacctt

SEQ ID NO: 685004 - DNA, 20 bp, mouse
gctccccgggagttaacccg

SEQ ID NO: 685005 - DNA, 20 bp, mouse
gggggcgttttggagcgcag

SEQ ID NO: 685006 - DNA, 20 bp, mouse
gtgggctctctcatggtcgg

SEQ ID NO: 685007 - DNA, 20 bp, mouse
ggagtccgggtctggaactt

SEQ ID NO: 685008 - DNA, 20 bp, mouse
gaggagaagtcggcgagtcc

SEQ ID NO: 685009 - DNA, 20 bp, mouse
gaagtcggcgagtccgggtc

SEQ ID NO: 685010 - DNA, 20 bp, mouse
ggggtctggaacttcggctt

SEQ ID NO: 685011 - DNA, 20 bp, mouse
ggccgtggctcagacgcgat

SEQ ID NO: 685012 - DNA, 20 bp, mouse
gagacgcgattggctggtga

SEQ ID NO: 685013 - DNA, 20 bp, mouse
ggcgggtaagcaggagaagt

SEQ ID NO: 685014 - DNA, 20 bp, mouse
gaaaaataaaaacatcgggg

SEQ ID NO: 685015 - DNA, 20 bp, mouse
gggaatccctgcgggtaagc

SEQ ID NO: 685016 - DNA, 20 bp, mouse
gaacaggtagggtgatgacc

SEQ ID NO: 685017 - DNA, 20 bp, mouse
ggaaagacagggaacaggta

SEQ ID NO: 685018 - DNA, 20 bp, mouse
ggggctccaagcccaggagc

SEQ ID NO: 685019 - DNA, 20 bp, mouse
gtgggagacttctggagctg

SEQ ID NO: 685020 - DNA, 20 bp, mouse
gacctggaaagacagggaac

SEQ ID NO: 685021 - DNA, 20 bp, mouse
gtaccaaagccacgcctctt

SEQ ID NO: 685022 - DNA, 20 bp, mouse
gtggtagggcgttgcaaaag

SEQ ID NO: 685023 - DNA, 20 bp, mouse
gaagtggtacaggaccgaag

SEQ ID NO: 685024 - DNA, 20 bp, mouse
ggtagggtgatgacctggct

SEQ ID NO: 685025 - DNA, 20 bp, mouse
ggaccgaagaggcgtggctt

SEQ ID NO: 685026 - DNA, 20 bp, mouse
ggtgaccagaagtgtcccgg

SEQ ID NO: 685027 - DNA, 20 bp, mouse
gacaactccggggagaacta

SEQ ID NO: 685028 - DNA, 20 bp, mouse
gtaagccgccgggacacttc

SEQ ID NO: 685029 - DNA, 20 bp, mouse
gaggagaggcggggcgacga

SEQ ID NO: 685030 - DNA, 20 bp, mouse
gtggaccgcggccaccggaa

SEQ ID NO: 685031 - DNA, 20 bp, mouse
gtaccgggactcgacgtcct

SEQ ID NO: 685032 - DNA, 20 bp, mouse
gaccccaggacgtcgagtcc

SEQ ID NO: 685033 - DNA, 20 bp, mouse
gttctccccggagttgtaat

SEQ ID NO: 685034 - DNA, 20 bp, mouse
gcgacgacggcaaggctagt

SEQ ID NO: 685035 - DNA, 20 bp, mouse
gagtgtcccggcggcttaaa

SEQ ID NO: 685036 - DNA, 20 bp, mouse
gccgccgcctggcatactgg

SEQ ID NO: 685037 - DNA, 20 bp, mouse
gaggcgcaactcttgattgg

SEQ ID NO: 685038 - DNA, 20 bp, mouse
gcagaggcgcaactcttgat

SEQ ID NO: 685039 - DNA, 20 bp, mouse
gaagagttgcgcctctgcgt

SEQ ID NO: 685040 - DNA, 20 bp, mouse
ggccccaaggcgccagcgat

SEQ ID NO: 685041 - DNA, 20 bp, mouse
gccaaggcgccagcgattgg

SEQ ID NO: 685042 - DNA, 20 bp, mouse
gccaggccggccagaccgga

SEQ ID NO: 685043 - DNA, 20 bp, mouse
gaaaaggaaggcgacaagga

SEQ ID NO: 685044 - DNA, 20 bp, mouse
gaaggagggaaagctagctg

SEQ ID NO: 685045 - DNA, 20 bp, mouse
gagccactgcgattggtaaa

SEQ ID NO: 685046 - DNA, 20 bp, mouse
gggacggccaggtgtatccg

SEQ ID NO: 685047 - DNA, 20 bp, mouse
gccgaggcggctagccaatg

SEQ ID NO: 685048 - DNA, 20 bp, mouse
gggggcggggctatgaaaag

SEQ ID NO: 685049 - DNA, 20 bp, mouse
gcggccaggtgtatccgagg

SEQ ID NO: 685050 - DNA, 20 bp, mouse
gtaccgtgggacttccccat

SEQ ID NO: 685051 - DNA, 20 bp, mouse
gtagccgcctcggatacacc

SEQ ID NO: 685052 - DNA, 20 bp, mouse
ggcggggaggaccaggttga

SEQ ID NO: 685053 - DNA, 20 bp, mouse
ggtggctgctatggaggcgt

SEQ ID NO: 685054 - DNA, 20 bp, mouse
ggtccgaggagccgagcctg

SEQ ID NO: 685055 - DNA, 20 bp, mouse
ggctgctatggaggcgtggg

SEQ ID NO: 685056 - DNA, 20 bp, mouse
gtggggctgtccaggggcgc

SEQ ID NO: 685057 - DNA, 20 bp, mouse
gaaagggcggccacaggcga

SEQ ID NO: 685058 - DNA, 20 bp, mouse
gaggccagctcccccgcaag

SEQ ID NO: 685059 - DNA, 20 bp, mouse
gaggcctgctgggtttcaca

SEQ ID NO: 685060 - DNA, 20 bp, mouse
gggcgccggggggtgatgtc

SEQ ID NO: 685061 - DNA, 20 bp, mouse
gtcctcttggggctgtccag

SEQ ID NO: 685062 - DNA, 20 bp, mouse
ggggcgcaggcctcttgcgg

SEQ ID NO: 685063 - DNA, 20 bp, mouse
gccggggggtgatgtcagga

SEQ ID NO: 685064 - DNA, 20 bp, mouse
ggaaaaaaaggggccggccg

SEQ ID NO: 685065 - DNA, 20 bp, mouse
gagggatcctgcagctgtca

SEQ ID NO: 685066 - DNA, 20 bp, mouse
gtgcccgcttgaagggtcga

SEQ ID NO: 685067 - DNA, 20 bp, mouse
gcggtgctgacgggtttcgg

SEQ ID NO: 685068 - DNA, 20 bp, mouse
gggaagcgggaaatgcgagt

SEQ ID NO: 685069 - DNA, 20 bp, mouse
gcgttccagtttagggaaca

SEQ ID NO: 685070 - DNA, 20 bp, mouse
gcactgggacagcagaaggt

SEQ ID NO: 685071 - DNA, 20 bp, mouse
ggggcggagcttcaagcgag

SEQ ID NO: 685072 - DNA, 20 bp, mouse
gatgacgcaacgtcgctgat

SEQ ID NO: 685073 - DNA, 20 bp, mouse
ggccgcaagcgttccagttt

SEQ ID NO: 685074 - DNA, 20 bp, mouse
ggagcttcaagcgaggggcg

SEQ ID NO: 685075 - DNA, 20 bp, mouse
gctgctccgtggtgaggcca

SEQ ID NO: 685076 - DNA, 20 bp, mouse
gcctgcgcgttgaggctctc

SEQ ID NO: 685077 - DNA, 20 bp, mouse
gtgagcccgcctgcgcgttg

SEQ ID NO: 685078 - DNA, 20 bp, mouse
gcgggctcatccctggatcc

SEQ ID NO: 685079 - DNA, 20 bp, mouse
gcctgcgaagagtttgtcag

SEQ ID NO: 685080 - DNA, 20 bp, mouse
gcgccaaggacgaacagcga

SEQ ID NO: 685081 - DNA, 20 bp, mouse
ggaagtgaggcaataaaggg

SEQ ID NO: 685082 - DNA, 20 bp, mouse
gactcttcgcaggactttct

SEQ ID NO: 685083 - DNA, 20 bp, mouse
gtctcctttaaccctcaaaa

SEQ ID NO: 685084 - DNA, 20 bp, mouse
gatggagtctctgctcgcca

SEQ ID NO: 685085 - DNA, 20 bp, mouse
gtatagaagtgaggcaataa

SEQ ID NO: 685086 - DNA, 20 bp, mouse
gggagagatcgagaccatag

SEQ ID NO: 685087 - DNA, 20 bp, mouse
gaagcgctgcgcagcgagaa

SEQ ID NO: 685088 - DNA, 20 bp, mouse
gccccggaccaagtgatcca

SEQ ID NO: 685089 - DNA, 20 bp, mouse
gagatcgagaccatagaggc

SEQ ID NO: 685090 - DNA, 20 bp, mouse
gacgccatgcagctaaggag

SEQ ID NO: 685091 - DNA, 20 bp, mouse
gcgcagcgcaccctggcgtc

SEQ ID NO: 685092 - DNA, 20 bp, mouse
gagcgcaccctggcgtccgg

SEQ ID NO: 685093 - DNA, 20 bp, mouse
gtgccgacgccggggtcccg

SEQ ID NO: 685094 - DNA, 20 bp, mouse
gggggcttatccagcctcta

SEQ ID NO: 685095 - DNA, 20 bp, mouse
gatctctcctccggacgcca

SEQ ID NO: 685096 - DNA, 20 bp, mouse
gcagctcaagccaataaacg

SEQ ID NO: 685097 - DNA, 20 bp, mouse
gtagactgcatctcgaactt

SEQ ID NO: 685098 - DNA, 20 bp, mouse
ggagactggagcacctccca

SEQ ID NO: 685099 - DNA, 20 bp, mouse
gtgagctagccaataaatac

SEQ ID NO: 685100 - DNA, 20 bp, mouse
ggaagcccagagcgacttgg

SEQ ID NO: 685101 - DNA, 20 bp, mouse
gccacccggcatcattttaa

SEQ ID NO: 685102 - DNA, 20 bp, mouse
gtattggcttgagctgtccg

SEQ ID NO: 685103 - DNA, 20 bp, mouse
gcatgctcgcccgtatttat

SEQ ID NO: 685104 - DNA, 20 bp, mouse
gagaagagcaacttagagac

SEQ ID NO: 685105 - DNA, 20 bp, mouse
gggcttgagctgtccggggg

SEQ ID NO: 685106 - DNA, 20 bp, mouse
gaaaaggaggggaaggtaac

SEQ ID NO: 685107 - DNA, 20 bp, mouse
ggaggggaaggtaacagggt

SEQ ID NO: 685108 - DNA, 20 bp, mouse
ggcgggggggattcagttta

SEQ ID NO: 685109 - DNA, 20 bp, mouse
gaaacccggggtctcatgta

SEQ ID NO: 685110 - DNA, 20 bp, mouse
ggggcgttccagggcacgac

SEQ ID NO: 685111 - DNA, 20 bp, mouse
ggggattcagtttagggaag

SEQ ID NO: 685112 - DNA, 20 bp, mouse
ggctaatcacgggcgttcca

SEQ ID NO: 685113 - DNA, 20 bp, mouse
gttcaaagccaggggcgggg

SEQ ID NO: 685114 - DNA, 20 bp, mouse
ggggttcaaagccaggggcg

SEQ ID NO: 685115 - DNA, 20 bp, mouse
ggacgggaattgtagtttct

SEQ ID NO: 685116 - DNA, 20 bp, mouse
gcagctgcggcccgggccct

SEQ ID NO: 685117 - DNA, 20 bp, mouse
gtccccagccagaatcctcg

SEQ ID NO: 685118 - DNA, 20 bp, mouse
gggcgcctgcgtgcgcatcc

SEQ ID NO: 685119 - DNA, 20 bp, mouse
gtggccgcgcagtccctcca

SEQ ID NO: 685120 - DNA, 20 bp, mouse
gacccctccgaagatagcgg

SEQ ID NO: 685121 - DNA, 20 bp, mouse
gacgcgcaggcgtaccgcgc

SEQ ID NO: 685122 - DNA, 20 bp, mouse
gctcctcagaggcccggggt

SEQ ID NO: 685123 - DNA, 20 bp, mouse
gtgctatgggagcgcagctg

SEQ ID NO: 685124 - DNA, 20 bp, mouse
gcggcctccgctatcttcgg

SEQ ID NO: 685125 - DNA, 20 bp, mouse
gcctccaaggccaggtgtca

SEQ ID NO: 685126 - DNA, 20 bp, mouse
gtcagccggtccacaagcta

SEQ ID NO: 685127 - DNA, 20 bp, mouse
ggacctggcagcagagttaa

SEQ ID NO: 685128 - DNA, 20 bp, mouse
gagccagagactgacccgga

SEQ ID NO: 685129 - DNA, 20 bp, mouse
ggctccacaggaggaagatg

SEQ ID NO: 685130 - DNA, 20 bp, mouse
gcggggctgaacccgggagc

SEQ ID NO: 685131 - DNA, 20 bp, mouse
gggaccggctgaggcatcca

SEQ ID NO: 685132 - DNA, 20 bp, mouse
gcatcccttagcttgtggac

SEQ ID NO: 685133 - DNA, 20 bp, mouse
gtctggttagaagtagtctc

SEQ ID NO: 685134 - DNA, 20 bp, mouse
gggagagccagagactgacc

SEQ ID NO: 685135 - DNA, 20 bp, mouse
gagctaagggatggcgccgg

SEQ ID NO: 685136 - DNA, 20 bp, mouse
ggaaactcggggaaccgaag

SEQ ID NO: 685137 - DNA, 20 bp, mouse
gcgctcagaagctttggaag

SEQ ID NO: 685138 - DNA, 20 bp, mouse
ggagcccgaggaacgggaaa

SEQ ID NO: 685139 - DNA, 20 bp, mouse
ggggacatgcaatggaggcg

SEQ ID NO: 685140 - DNA, 20 bp, mouse
ggccgggcgctcagaagctt

SEQ ID NO: 685141 - DNA, 20 bp, mouse
ggagcccggactggcagaga

SEQ ID NO: 685142 - DNA, 20 bp, mouse
gaatggaggcggggcctaga

SEQ ID NO: 685143 - DNA, 20 bp, mouse
gggcctagaagggtgagggg

SEQ ID NO: 685144 - DNA, 20 bp, mouse
ggggaggcgcctgcagaggc

SEQ ID NO: 685145 - DNA, 20 bp, mouse
gggctgggaagagcccggac

SEQ ID NO: 685146 - DNA, 20 bp, mouse
ggggaaagccctttcaactg

SEQ ID NO: 685147 - DNA, 20 bp, mouse
gcaactggctcattgctggg

SEQ ID NO: 685148 - DNA, 20 bp, mouse
ggaggagaccacagttgaaa

SEQ ID NO: 685149 - DNA, 20 bp, mouse
gtgggctctaatctaacatt

SEQ ID NO: 685150 - DNA, 20 bp, mouse
gcacagcaaacggtgcaagt

SEQ ID NO: 685151 - DNA, 20 bp, mouse
gtacccgagttcatgaaggg

SEQ ID NO: 685152 - DNA, 20 bp, mouse
ggtggtctcctcaaggactt

SEQ ID NO: 685153 - DNA, 20 bp, mouse
ggaaggaggctcacagcaaa

SEQ ID NO: 685154 - DNA, 20 bp, mouse
gcagcaatgagccagttgga

SEQ ID NO: 685155 - DNA, 20 bp, mouse
ggccactgcagatcatatcc

SEQ ID NO: 685156 - DNA, 20 bp, mouse
gatgctgcggagcagctgac

SEQ ID NO: 685157 - DNA, 20 bp, mouse
ggcttggctgtgaacttcgg

SEQ ID NO: 685158 - DNA, 20 bp, mouse
gggagcacgctgggagtcgc

SEQ ID NO: 685159 - DNA, 20 bp, mouse
gctctgggaattgcagtcac

SEQ ID NO: 685160 - DNA, 20 bp, mouse
ggggaattgcagtcacaggc

SEQ ID NO: 685161 - DNA, 20 bp, mouse
gcgaagacgcggagcacgct

SEQ ID NO: 685162 - DNA, 20 bp, mouse
gcgctgctggggatgacgaa

SEQ ID NO: 685163 - DNA, 20 bp, mouse
gtcctgggagttgaaggcac

SEQ ID NO: 685164 - DNA, 20 bp, mouse
gaggaagtgcgtagctgcca

SEQ ID NO: 685165 - DNA, 20 bp, mouse
gaggtagtcgtgcgctgcgc

SEQ ID NO: 685166 - DNA, 20 bp, mouse
gaatgacaaggcggtcgctg

SEQ ID NO: 685167 - DNA, 20 bp, mouse
ggggtcgtgacgctataggg

SEQ ID NO: 685168 - DNA, 20 bp, mouse
gctgtgccatgttcttgtag

SEQ ID NO: 685169 - DNA, 20 bp, mouse
gggtccagcagctggaacgt

SEQ ID NO: 685170 - DNA, 20 bp, mouse
gactctgaaccgtacagttc

SEQ ID NO: 685171 - DNA, 20 bp, mouse
ggggcgggtcgtgacgctat

SEQ ID NO: 685172 - DNA, 20 bp, mouse
gtctgtgcatagtttatcgc

SEQ ID NO: 685173 - DNA, 20 bp, mouse
gaagaacatggcacagtccg

SEQ ID NO: 685174 - DNA, 20 bp, mouse
gaacatggcacagtccgggg

SEQ ID NO: 685175 - DNA, 20 bp, mouse
gtataacctcacaacggggc

SEQ ID NO: 685176 - DNA, 20 bp, mouse
gaaggagctggagtggccac

SEQ ID NO: 685177 - DNA, 20 bp, mouse
gtggggtggggccagaaaac

SEQ ID NO: 685178 - DNA, 20 bp, mouse
ggtgtgtaggaagttggggt

SEQ ID NO: 685179 - DNA, 20 bp, mouse
gggtagctttagctgtcggg

SEQ ID NO: 685180 - DNA, 20 bp, mouse
gccaacttcctacacacata

SEQ ID NO: 685181 - DNA, 20 bp, mouse
gaattttgatgagtcagcag

SEQ ID NO: 685182 - DNA, 20 bp, mouse
ggtgggtagctttagctgtc

SEQ ID NO: 685183 - DNA, 20 bp, mouse
gcagaggcacaaagaggaat

SEQ ID NO: 685184 - DNA, 20 bp, mouse
ggtactgatctagaagccct

SEQ ID NO: 685185 - DNA, 20 bp, mouse
gatgagaagagataagagca

SEQ ID NO: 685186 - DNA, 20 bp, mouse
gggcatgagcaacgcgggtg

SEQ ID NO: 685187 - DNA, 20 bp, mouse
gtagatgggcatgagcaacg

SEQ ID NO: 685188 - DNA, 20 bp, mouse
gctagactatgatcactagg

SEQ ID NO: 685189 - DNA, 20 bp, mouse
gggcgctccaatgatgtcac

SEQ ID NO: 685190 - DNA, 20 bp, mouse
ggcgctcccagtgacatcat

SEQ ID NO: 685191 - DNA, 20 bp, mouse
gtagtgatcatagtctagat

SEQ ID NO: 685192 - DNA, 20 bp, mouse
gaagcccatcctggcagaca

SEQ ID NO: 685193 - DNA, 20 bp, mouse
gcgctccaacagccagccaa

SEQ ID NO: 685194 - DNA, 20 bp, mouse
gctaagggagatcatgaatt

SEQ ID NO: 685195 - DNA, 20 bp, mouse
gacttttaacagagggactg

SEQ ID NO: 685196 - DNA, 20 bp, mouse
ggcggggctagcaggaaatg

SEQ ID NO: 685197 - DNA, 20 bp, mouse
gcatgagcacgagaggccta

SEQ ID NO: 685198 - DNA, 20 bp, mouse
gaggacccgagctccagacg

SEQ ID NO: 685199 - DNA, 20 bp, mouse
gccgagctccagacgcgggg

SEQ ID NO: 685200 - DNA, 20 bp, mouse
gggcggggcatgagcacgag

SEQ ID NO: 685201 - DNA, 20 bp, mouse
ggcctagggaatgagcgagt

SEQ ID NO: 685202 - DNA, 20 bp, mouse
gtggcagcgaggtaccaaaa

SEQ ID NO: 685203 - DNA, 20 bp, mouse
gtagggaatgagcgagtggg

SEQ ID NO: 685204 - DNA, 20 bp, mouse
gaaggctgcgtcccacctct

SEQ ID NO: 685205 - DNA, 20 bp, mouse
gggggtccctagtgctggta

SEQ ID NO: 685206 - DNA, 20 bp, mouse
gtacaagcagtctccctggt

SEQ ID NO: 685207 - DNA, 20 bp, mouse
gaagacgcgctccacccacc

SEQ ID NO: 685208 - DNA, 20 bp, mouse
gccctgggcgcgcacctcca

SEQ ID NO: 685209 - DNA, 20 bp, mouse
gggaagctggacactcccag

SEQ ID NO: 685210 - DNA, 20 bp, mouse
gcgcttacaagcagtctccc

SEQ ID NO: 685211 - DNA, 20 bp, mouse
gagaccgagtagaggggcgg

SEQ ID NO: 685212 - DNA, 20 bp, mouse
gtgaacggccggagaccgac

SEQ ID NO: 685213 - DNA, 20 bp, mouse
ggcgctggagaatgacgtga

SEQ ID NO: 685214 - DNA, 20 bp, mouse
gcttgtaagcgctttgtcct

SEQ ID NO: 685215 - DNA, 20 bp, mouse
gggccggagaccgaccggag

SEQ ID NO: 685216 - DNA, 20 bp, mouse
ggcgaggcgctatggagacc

SEQ ID NO: 685217 - DNA, 20 bp, mouse
gcgcgcgcggcccaattgcg

SEQ ID NO: 685218 - DNA, 20 bp, mouse
gggggagcgcgggagtgcga

SEQ ID NO: 685219 - DNA, 20 bp, mouse
ggcgctatggagaccgggat

SEQ ID NO: 685220 - DNA, 20 bp, mouse
gccgggagagaggcgcgtag

SEQ ID NO: 685221 - DNA, 20 bp, mouse
ggcctcgcgctgccgattgg

SEQ ID NO: 685222 - DNA, 20 bp, mouse
gcattgggggagccgggagc

SEQ ID NO: 685223 - DNA, 20 bp, mouse
gggctgaggcggccgccaat

SEQ ID NO: 685224 - DNA, 20 bp, mouse
ggcccaattgcgaggcgcta

SEQ ID NO: 685225 - DNA, 20 bp, mouse
ggaaggcgggccttggcgga

SEQ ID NO: 685226 - DNA, 20 bp, mouse
gagccctggagatactctga

SEQ ID NO: 685227 - DNA, 20 bp, mouse
gggcccggagcagattgtgt

SEQ ID NO: 685228 - DNA, 20 bp, mouse
gaaagccaaggtaggggtca

SEQ ID NO: 685229 - DNA, 20 bp, mouse
gggagggcaggctgggtcgg

SEQ ID NO: 685230 - DNA, 20 bp, mouse
ggtagagctgccccaggcat

SEQ ID NO: 685231 - DNA, 20 bp, mouse
gagagtgtgcgagtggcacg

SEQ ID NO: 685232 - DNA, 20 bp, mouse
ggcagattgtgttggaaagc

SEQ ID NO: 685233 - DNA, 20 bp, mouse
ggggcgggcagtgtgtcgtc

SEQ ID NO: 685234 - DNA, 20 bp, mouse
gagagcgcacggtcagagca

SEQ ID NO: 685235 - DNA, 20 bp, mouse
ggaagacagaagcgtaggag

SEQ ID NO: 685236 - DNA, 20 bp, mouse
gaggtggcctcggcagggga

SEQ ID NO: 685237 - DNA, 20 bp, mouse
gtgcaactcaaaaacagcgg

SEQ ID NO: 685238 - DNA, 20 bp, mouse
gagcctgtgcggactaccag

SEQ ID NO: 685239 - DNA, 20 bp, mouse
gcacaggctaggtatcgctt

SEQ ID NO: 685240 - DNA, 20 bp, mouse
gtcggcaggggagggtgaag

SEQ ID NO: 685241 - DNA, 20 bp, mouse
ggtgggaggagtgagatgtg

SEQ ID NO: 685242 - DNA, 20 bp, mouse
gggaactagtgactgaaaga

SEQ ID NO: 685243 - DNA, 20 bp, mouse
ggggccgtgtgttctggaag

SEQ ID NO: 685244 - DNA, 20 bp, mouse
ggaggccacctccagtcctc

SEQ ID NO: 685245 - DNA, 20 bp, mouse
ggtcctctggtagtccgcac

SEQ ID NO: 685246 - DNA, 20 bp, mouse
gaggcagtgggcgcagacgt

SEQ ID NO: 685247 - DNA, 20 bp, mouse
gagaaggaaagagatgggtc

SEQ ID NO: 685248 - DNA, 20 bp, mouse
gtctgcgcccactgcctatg

SEQ ID NO: 685249 - DNA, 20 bp, mouse
gaccgcgcccccataggcag

SEQ ID NO: 685250 - DNA, 20 bp, mouse
gaaccggggaaccgtgttgt

SEQ ID NO: 685251 - DNA, 20 bp, mouse
gggcgcagacgtaggcttgc

SEQ ID NO: 685252 - DNA, 20 bp, mouse
gaggcttgccgggcccttgc

SEQ ID NO: 685253 - DNA, 20 bp, mouse
gaaacaacccagcaagggcc

SEQ ID NO: 685254 - DNA, 20 bp, mouse
gaacgacagaagacatcaga

SEQ ID NO: 685255 - DNA, 20 bp, mouse
gcccactgcctatgggggcg

SEQ ID NO: 685256 - DNA, 20 bp, mouse
gccggccggcagctcggcga

SEQ ID NO: 685257 - DNA, 20 bp, mouse
gcaggggcggagtaagtaca

SEQ ID NO: 685258 - DNA, 20 bp, mouse
ggtaggcgggaccaggtgta

SEQ ID NO: 685259 - DNA, 20 bp, mouse
ggaaagttgaaagacttcaa

SEQ ID NO: 685260 - DNA, 20 bp, mouse
gctggccccgcccaagttgt

SEQ ID NO: 685261 - DNA, 20 bp, mouse
gtcgcggcggcgctcccctt

SEQ ID NO: 685262 - DNA, 20 bp, mouse
gcgggaccaggtgtagggcg

SEQ ID NO: 685263 - DNA, 20 bp, mouse
gcggcggcgctccccttggg

SEQ ID NO: 685264 - DNA, 20 bp, mouse
gggtctggaccatctaggaa

SEQ ID NO: 685265 - DNA, 20 bp, mouse
ggggcgtggcggaggctaag

SEQ ID NO: 685266 - DNA, 20 bp, mouse
gcgcacacccacggatgcgt

SEQ ID NO: 685267 - DNA, 20 bp, mouse
gtacatgatcagggcactcc

SEQ ID NO: 685268 - DNA, 20 bp, mouse
gcccggggcgccaaccctgg

SEQ ID NO: 685269 - DNA, 20 bp, mouse
gccagctgccactctcgctg

SEQ ID NO: 685270 - DNA, 20 bp, mouse
gtcccacccaacgcatccgt

SEQ ID NO: 685271 - DNA, 20 bp, mouse
gtggacttgcgatgctgcga

SEQ ID NO: 685272 - DNA, 20 bp, mouse
ggcgcacactcgcacaccca

SEQ ID NO: 685273 - DNA, 20 bp, mouse
gcagagccgcagtgccgtag

SEQ ID NO: 685274 - DNA, 20 bp, mouse
gtgcgatgctgcgagggaca

SEQ ID NO: 685275 - DNA, 20 bp, mouse
gtcccggtgcagccctctct

SEQ ID NO: 685276 - DNA, 20 bp, mouse
ggccactgtctgacctgctg

SEQ ID NO: 685277 - DNA, 20 bp, mouse
ggccgcagcaggtcagacag

SEQ ID NO: 685278 - DNA, 20 bp, mouse
ggtaagggggaggtcgttcg

SEQ ID NO: 685279 - DNA, 20 bp, mouse
gcacgcagaggtctcggcag

SEQ ID NO: 685280 - DNA, 20 bp, mouse
gagaaggctcctgcggggaa

SEQ ID NO: 685281 - DNA, 20 bp, mouse
gcaggggcggcgcgtgatcc

SEQ ID NO: 685282 - DNA, 20 bp, mouse
ggtgaagcacgcagaggtct

SEQ ID NO: 685283 - DNA, 20 bp, mouse
gtgaggagaaggctcctgcg

SEQ ID NO: 685284 - DNA, 20 bp, mouse
ggtgcaccccagggcatagg

SEQ ID NO: 685285 - DNA, 20 bp, mouse
gccagaccctaggaggagta

SEQ ID NO: 685286 - DNA, 20 bp, mouse
gtgcaggcaatggatcgcag

SEQ ID NO: 685287 - DNA, 20 bp, mouse
gagtgcccagggaaacttgg

SEQ ID NO: 685288 - DNA, 20 bp, mouse
gtggagggagccggctggtc

SEQ ID NO: 685289 - DNA, 20 bp, mouse
ggcaccgcaccggggcattg

SEQ ID NO: 685290 - DNA, 20 bp, mouse
gcctctgattggttggggag

SEQ ID NO: 685291 - DNA, 20 bp, mouse
gaaacactggtcatcaagaa

SEQ ID NO: 685292 - DNA, 20 bp, mouse
gtcagtcccggcttttgctc

SEQ ID NO: 685293 - DNA, 20 bp, mouse
gaggtggcctctgattggtt

SEQ ID NO: 685294 - DNA, 20 bp, mouse
gtcggcctcgcccgaccagc

SEQ ID NO: 685295 - DNA, 20 bp, mouse
gtaaccagggcgcggcaacc

SEQ ID NO: 685296 - DNA, 20 bp, mouse
gcattgcagcacaccgtctg

SEQ ID NO: 685297 - DNA, 20 bp, mouse
ggctctgaggtctaacccag

SEQ ID NO: 685298 - DNA, 20 bp, mouse
gctgcaaagggatgtcagat

SEQ ID NO: 685299 - DNA, 20 bp, mouse
gcggggtccctaagcttaga

SEQ ID NO: 685300 - DNA, 20 bp, mouse
gagggatgtcagataggagt

SEQ ID NO: 685301 - DNA, 20 bp, mouse
ggacggtgtgctgcaatgga

SEQ ID NO: 685302 - DNA, 20 bp, mouse
gtggacggtgtagattacgg

SEQ ID NO: 685303 - DNA, 20 bp, mouse
ggcgaagcgggtgcaaagtt

SEQ ID NO: 685304 - DNA, 20 bp, mouse
ggggctaaagagcccttggg

SEQ ID NO: 685305 - DNA, 20 bp, mouse
ggagtgggtggaccgcccaa

SEQ ID NO: 685306 - DNA, 20 bp, mouse
gcgcgcgcgcgtagaattag

SEQ ID NO: 685307 - DNA, 20 bp, mouse
gggtcagaacaaatcctctt

SEQ ID NO: 685308 - DNA, 20 bp, mouse
gtgtgtggagaatctggcgc

SEQ ID NO: 685309 - DNA, 20 bp, mouse
gctaacgcgcaggctcacgt

SEQ ID NO: 685310 - DNA, 20 bp, mouse
gactggagagggcctcctga

SEQ ID NO: 685311 - DNA, 20 bp, mouse
gtatagaagcagggcccttg

SEQ ID NO: 685312 - DNA, 20 bp, mouse
gaggggcatggtggcccaag

SEQ ID NO: 685313 - DNA, 20 bp, mouse
gcctatgcttatacgagcaa

SEQ ID NO: 685314 - DNA, 20 bp, mouse
gtggactagacagaggggca

SEQ ID NO: 685315 - DNA, 20 bp, mouse
ggagagggcctcctgagggg

SEQ ID NO: 685316 - DNA, 20 bp, mouse
ggggcgccgtggggcgagtg

SEQ ID NO: 685317 - DNA, 20 bp, mouse
gaagtcagtcccatccaggc

SEQ ID NO: 685318 - DNA, 20 bp, mouse
gaggcccggccagctatgcg

SEQ ID NO: 685319 - DNA, 20 bp, mouse
ggggtgaggatcatacatct

SEQ ID NO: 685320 - DNA, 20 bp, mouse
gggaccccgcatagctggcc

SEQ ID NO: 685321 - DNA, 20 bp, mouse
gggaacagtttgagcggctc

SEQ ID NO: 685322 - DNA, 20 bp, mouse
gatgcggggtcctgcggccg

SEQ ID NO: 685323 - DNA, 20 bp, mouse
gccacgtcgcaaggccgtcg

SEQ ID NO: 685324 - DNA, 20 bp, mouse
gcgcccccaggcctcctcga

SEQ ID NO: 685325 - DNA, 20 bp, mouse
gcgccgtggggcgagtgcgg

SEQ ID NO: 685326 - DNA, 20 bp, mouse
gcaggcaggcagcaggcggt

SEQ ID NO: 685327 - DNA, 20 bp, mouse
gcaggcagcaggcggtgggt

SEQ ID NO: 685328 - DNA, 20 bp, mouse
gaaacctgtcccatggacat

SEQ ID NO: 685329 - DNA, 20 bp, mouse
gtggctcctggccctatagc

SEQ ID NO: 685330 - DNA, 20 bp, mouse
ggaaggaaagagtgtattga

SEQ ID NO: 685331 - DNA, 20 bp, mouse
gcaggagccaccactgggag

SEQ ID NO: 685332 - DNA, 20 bp, mouse
gcaggggagatggggtatat

SEQ ID NO: 685333 - DNA, 20 bp, mouse
gttgggacgacgtgggagag

SEQ ID NO: 685334 - DNA, 20 bp, mouse
gtgggctggcctgttactga

SEQ ID NO: 685335 - DNA, 20 bp, mouse
gggagatggggtatatagga

SEQ ID NO: 685336 - DNA, 20 bp, mouse
gtgtctcggtgttgtggtgt

SEQ ID NO: 685337 - DNA, 20 bp, mouse
gtcggtgttgtggtgtagga

SEQ ID NO: 685338 - DNA, 20 bp, mouse
gacatttgcagggacgatgt

SEQ ID NO: 685339 - DNA, 20 bp, mouse
gtgggagtgtctcggtgttg

SEQ ID NO: 685340 - DNA, 20 bp, mouse
gtgcccgccttgctcggctt

SEQ ID NO: 685341 - DNA, 20 bp, mouse
gtgttctcgcgacatttgca

SEQ ID NO: 685342 - DNA, 20 bp, mouse
gcaggcggaagtgctctcgg

SEQ ID NO: 685343 - DNA, 20 bp, mouse
gtaaaacgatgagagggcta

SEQ ID NO: 685344 - DNA, 20 bp, mouse
ggtgtgctgaagtagagttc

SEQ ID NO: 685345 - DNA, 20 bp, mouse
gttgctcggcttgggtagga

SEQ ID NO: 685346 - DNA, 20 bp, mouse
gcacgccgactagaagaggg

SEQ ID NO: 685347 - DNA, 20 bp, mouse
gctagtcggcgtgcgaggag

SEQ ID NO: 685348 - DNA, 20 bp, mouse
gcgcgccggggatcggacca

SEQ ID NO: 685349 - DNA, 20 bp, mouse
gcacccaaggaggagatcaa

SEQ ID NO: 685350 - DNA, 20 bp, mouse
gggtgagccgcgccggggat

SEQ ID NO: 685351 - DNA, 20 bp, mouse
gggctccctggtccgatccc

SEQ ID NO: 685352 - DNA, 20 bp, mouse
gtcgcacgccgactagaaga

SEQ ID NO: 685353 - DNA, 20 bp, mouse
gccgctgcgttcattggctg

SEQ ID NO: 685354 - DNA, 20 bp, mouse
ggggcccgccgcctcgcgat

SEQ ID NO: 685355 - DNA, 20 bp, mouse
gccccggcgcggctcaccat

SEQ ID NO: 685356 - DNA, 20 bp, mouse
gcaggcccgccagtcggcgg

SEQ ID NO: 685357 - DNA, 20 bp, mouse
gccgccgaccccaggggcgt

SEQ ID NO: 685358 - DNA, 20 bp, mouse
gactgccgccgccgactggc

SEQ ID NO: 685359 - DNA, 20 bp, mouse
ggagtcagaccgccgacccc

SEQ ID NO: 685360 - DNA, 20 bp, mouse
ggcgagctgcgtcctgtgat

SEQ ID NO: 685361 - DNA, 20 bp, mouse
gagtgtggattctgcggcgc

SEQ ID NO: 685362 - DNA, 20 bp, mouse
gtctgactccgcttggtggg

SEQ ID NO: 685363 - DNA, 20 bp, mouse
gacgccccgcccacgcccct

SEQ ID NO: 685364 - DNA, 20 bp, mouse
gagtaaaatgaggcacggta

SEQ ID NO: 685365 - DNA, 20 bp, mouse
gcggtctgactccgcttggt

SEQ ID NO: 685366 - DNA, 20 bp, mouse
gggggcggggtctcacggaa

SEQ ID NO: 685367 - DNA, 20 bp, mouse
gtgtggagggcgaaaggacg

SEQ ID NO: 685368 - DNA, 20 bp, mouse
gtgcagaagctgggctatga

SEQ ID NO: 685369 - DNA, 20 bp, mouse
gtgcgccggcgcagttctgg

SEQ ID NO: 685370 - DNA, 20 bp, mouse
gggggcttccgggtaagaca

SEQ ID NO: 685371 - DNA, 20 bp, mouse
gaccgcctccagaactgcgc

SEQ ID NO: 685372 - DNA, 20 bp, mouse
gtatggcgagccgtggggag

SEQ ID NO: 685373 - DNA, 20 bp, mouse
gtggaggcggtgcagaagct

SEQ ID NO: 685374 - DNA, 20 bp, mouse
gggctgggacggtgtaataa

SEQ ID NO: 685375 - DNA, 20 bp, mouse
gcgcactgcgaaagtgagaa

SEQ ID NO: 685376 - DNA, 20 bp, mouse
gtcaactcgcctaacgtgca

SEQ ID NO: 685377 - DNA, 20 bp, mouse
ggggccgcccctgcgtactc

SEQ ID NO: 685378 - DNA, 20 bp, mouse
gacccaagaggtaggagtat

SEQ ID NO: 685379 - DNA, 20 bp, mouse
gaataggagacccaagaggt

SEQ ID NO: 685380 - DNA, 20 bp, mouse
gaacagcgcctgggaggccg

SEQ ID NO: 685381 - DNA, 20 bp, mouse
ggggcgtggaaacagcgcct

SEQ ID NO: 685382 - DNA, 20 bp, mouse
ggaacacatctcgatccctc

SEQ ID NO: 685383 - DNA, 20 bp, mouse
gaacgtgcagggcttgcaat

SEQ ID NO: 685384 - DNA, 20 bp, mouse
gtttccacgccccgcgagag

SEQ ID NO: 685385 - DNA, 20 bp, mouse
gcgcccaccacggacggagg

SEQ ID NO: 685386 - DNA, 20 bp, mouse
gaccctcaggacacgacctc

SEQ ID NO: 685387 - DNA, 20 bp, mouse
ggccagcttgggcaagagtt

SEQ ID NO: 685388 - DNA, 20 bp, mouse
ggcaacttgaaagacaggca

SEQ ID NO: 685389 - DNA, 20 bp, mouse
gttgcagcgcggggtggcgt

SEQ ID NO: 685390 - DNA, 20 bp, mouse
ggtcgtgtcctgagggtcaa

SEQ ID NO: 685391 - DNA, 20 bp, mouse
gagtctgtggggcccgggcg

SEQ ID NO: 685392 - DNA, 20 bp, mouse
gtccttgagtgcagcaatac

SEQ ID NO: 685393 - DNA, 20 bp, mouse
gaaaaggcaacttgaaagac

SEQ ID NO: 685394 - DNA, 20 bp, mouse
ggcctaactcttgcccaagc

SEQ ID NO: 685395 - DNA, 20 bp, mouse
ggcctgtattgctgcactca

SEQ ID NO: 685396 - DNA, 20 bp, mouse
gcccaaggccggtcccgcac

SEQ ID NO: 685397 - DNA, 20 bp, mouse
ggccggtcccgcacaggttg

SEQ ID NO: 685398 - DNA, 20 bp, mouse
gcgcacgcctcaacctgtgc

SEQ ID NO: 685399 - DNA, 20 bp, mouse
gccccgcgggaaatccgcgt

SEQ ID NO: 685400 - DNA, 20 bp, mouse
gtaaggctccgcccctacca

SEQ ID NO: 685401 - DNA, 20 bp, mouse
ggggacggggcggagctaga

SEQ ID NO: 685402 - DNA, 20 bp, mouse
ggggtggggccggaccgcta

SEQ ID NO: 685403 - DNA, 20 bp, mouse
ggcgcaggcgcgagaaagtg

SEQ ID NO: 685404 - DNA, 20 bp, mouse
gttgcagtgtgcagaagagc

SEQ ID NO: 685405 - DNA, 20 bp, mouse
gtcccgacgcggatttcccg

SEQ ID NO: 685406 - DNA, 20 bp, mouse
gccgccccctcccacccggg

SEQ ID NO: 685407 - DNA, 20 bp, mouse
gcagtggagtaatggaacag

SEQ ID NO: 685408 - DNA, 20 bp, mouse
ggggatctagcagtcacaac

SEQ ID NO: 685409 - DNA, 20 bp, mouse
gacacacttcagtggagtaa

SEQ ID NO: 685410 - DNA, 20 bp, mouse
gcggggcccgggaccactta

SEQ ID NO: 685411 - DNA, 20 bp, mouse
gcgccccccgcccttctctc

SEQ ID NO: 685412 - DNA, 20 bp, mouse
gggcccgggaccacttaagg

SEQ ID NO: 685413 - DNA, 20 bp, mouse
gatcccccgcccgggtggga

SEQ ID NO: 685414 - DNA, 20 bp, mouse
gaccacttaaggcggagtca

SEQ ID NO: 685415 - DNA, 20 bp, mouse
ggcgtgccagggtagacttt

SEQ ID NO: 685416 - DNA, 20 bp, mouse
ggtgcgctctgcccggagtc

SEQ ID NO: 685417 - DNA, 20 bp, mouse
gaagtcgcgcacccttcctt

SEQ ID NO: 685418 - DNA, 20 bp, mouse
gtcgctgtcgcgcctcctaa

SEQ ID NO: 685419 - DNA, 20 bp, mouse
gcttccggaagtctcgagtg

SEQ ID NO: 685420 - DNA, 20 bp, mouse
ggcagcccgaaggttccgca

SEQ ID NO: 685421 - DNA, 20 bp, mouse
gacaaccgtgcggaaccttc

SEQ ID NO: 685422 - DNA, 20 bp, mouse
gcagggacagggaagcatta

SEQ ID NO: 685423 - DNA, 20 bp, mouse
gaggggcgggccggctggtg

SEQ ID NO: 685424 - DNA, 20 bp, mouse
gcgccacggagcctgactcc

SEQ ID NO: 685425 - DNA, 20 bp, mouse
ggctgtccaatcaacgtcta

SEQ ID NO: 685426 - DNA, 20 bp, mouse
gagctcctggaccacatgta

SEQ ID NO: 685427 - DNA, 20 bp, mouse
gaaacaatcacttcgctcat

SEQ ID NO: 685428 - DNA, 20 bp, mouse
ggaacacagggataaaatgg

SEQ ID NO: 685429 - DNA, 20 bp, mouse
gttactgagcttcaagcata

SEQ ID NO: 685430 - DNA, 20 bp, mouse
gtgtccttgaacacgactta

SEQ ID NO: 685431 - DNA, 20 bp, mouse
ggggcgtggggcgacgaaac

SEQ ID NO: 685432 - DNA, 20 bp, mouse
ggagcgaagtgattgtttct

SEQ ID NO: 685433 - DNA, 20 bp, mouse
gaccacatgtacggaacaca

SEQ ID NO: 685434 - DNA, 20 bp, mouse
gacggaacacagggataaaa

SEQ ID NO: 685435 - DNA, 20 bp, mouse
gtgttccgtacatgtggtcc

SEQ ID NO: 685436 - DNA, 20 bp, mouse
gggagtccgcaaatggggaa

SEQ ID NO: 685437 - DNA, 20 bp, mouse
gggcgcgctccggacgcacg

SEQ ID NO: 685438 - DNA, 20 bp, mouse
gcagccggggataaccatcg

SEQ ID NO: 685439 - DNA, 20 bp, mouse
gggacgtcatgagtctgcga

SEQ ID NO: 685440 - DNA, 20 bp, mouse
gccggccggcacccgagaac

SEQ ID NO: 685441 - DNA, 20 bp, mouse
gtgcaaccgggaagcgtgaa

SEQ ID NO: 685442 - DNA, 20 bp, mouse
gcggccgcgatggttatccc

SEQ ID NO: 685443 - DNA, 20 bp, mouse
gtggggtggagtccgcaaat

SEQ ID NO: 685444 - DNA, 20 bp, mouse
gttgcagctcccacaaccgc

SEQ ID NO: 685445 - DNA, 20 bp, mouse
ggggtcataaataaaccgtt

SEQ ID NO: 685446 - DNA, 20 bp, mouse
gtgggcgtgtccggaaaagg

SEQ ID NO: 685447 - DNA, 20 bp, mouse
ggggccacatggcgtccgag

SEQ ID NO: 685448 - DNA, 20 bp, mouse
ggaaggacgggctcgtgcgc

SEQ ID NO: 685449 - DNA, 20 bp, mouse
gaggggcccaccgcggaagt

SEQ ID NO: 685450 - DNA, 20 bp, mouse
gcggtgggcccctatcctca

SEQ ID NO: 685451 - DNA, 20 bp, mouse
gccgcctgtcgcgggaagga

SEQ ID NO: 685452 - DNA, 20 bp, mouse
gtccgagtggccaccttttc

SEQ ID NO: 685453 - DNA, 20 bp, mouse
gacggtaaaagcaactccac

SEQ ID NO: 685454 - DNA, 20 bp, mouse
gctgtcaggccccacttccg

SEQ ID NO: 685455 - DNA, 20 bp, mouse
gcggaggccgggccaatagt

SEQ ID NO: 685456 - DNA, 20 bp, mouse
gagtcctgggagcgccctct

SEQ ID NO: 685457 - DNA, 20 bp, mouse
gcccggaaacatctgcctga

SEQ ID NO: 685458 - DNA, 20 bp, mouse
gagcctgagcggagatctca

SEQ ID NO: 685459 - DNA, 20 bp, mouse
gcatctgcctgagggacggg

SEQ ID NO: 685460 - DNA, 20 bp, mouse
gggccctgagatctccgctc

SEQ ID NO: 685461 - DNA, 20 bp, mouse
gcacgcaggcgcacgcctag

SEQ ID NO: 685462 - DNA, 20 bp, mouse
gacacacccacccgtccctc

SEQ ID NO: 685463 - DNA, 20 bp, mouse
gaagcctagagggcgctccc

SEQ ID NO: 685464 - DNA, 20 bp, mouse
gagcacgcccaaagcctgag

SEQ ID NO: 685465 - DNA, 20 bp, mouse
ggggagttcgcaagcctaga

SEQ ID NO: 685466 - DNA, 20 bp, mouse
gcccatctggggccatagaa

SEQ ID NO: 685467 - DNA, 20 bp, mouse
gtgaccctgaggtagttcta

SEQ ID NO: 685468 - DNA, 20 bp, mouse
gatagaagggtgtgcctcag

SEQ ID NO: 685469 - DNA, 20 bp, mouse
gacagcgtgagtcatcaaaa

SEQ ID NO: 685470 - DNA, 20 bp, mouse
gggcgactgagaagcgagag

SEQ ID NO: 685471 - DNA, 20 bp, mouse
gactgagaagcgagagagga

SEQ ID NO: 685472 - DNA, 20 bp, mouse
gtgagtcatcaaaagggttt

SEQ ID NO: 685473 - DNA, 20 bp, mouse
gtccctagtaacagaagatt

SEQ ID NO: 685474 - DNA, 20 bp, mouse
gataagcagggtgatcttaa

SEQ ID NO: 685475 - DNA, 20 bp, mouse
gagcagggtgatcttaaggg

SEQ ID NO: 685476 - DNA, 20 bp, mouse
ggccccgcggacgaagtaat

SEQ ID NO: 685477 - DNA, 20 bp, mouse
gcccaagaatagcaatgagt

SEQ ID NO: 685478 - DNA, 20 bp, mouse
gcagcccgggctgcaagaga

SEQ ID NO: 685479 - DNA, 20 bp, mouse
gaatagggcggtgcagacta

SEQ ID NO: 685480 - DNA, 20 bp, mouse
gcccgggctgcaagagaggg

SEQ ID NO: 685481 - DNA, 20 bp, mouse
gttcgtccgcggggcagctg

SEQ ID NO: 685482 - DNA, 20 bp, mouse
gcgcggacgaagtaataggg

SEQ ID NO: 685483 - DNA, 20 bp, mouse
gcgcgcgcgcccgctctctc

SEQ ID NO: 685484 - DNA, 20 bp, mouse
gagtacgggcccgaccaagt

SEQ ID NO: 685485 - DNA, 20 bp, mouse
gcgagcggcaactcccagcc

SEQ ID NO: 685486 - DNA, 20 bp, mouse
gggagcgctcgcaaccgccg

SEQ ID NO: 685487 - DNA, 20 bp, mouse
gcgacggcccgggactaggc

SEQ ID NO: 685488 - DNA, 20 bp, mouse
gagagccggtcctagaagag

SEQ ID NO: 685489 - DNA, 20 bp, mouse
gcgggactaggcgggagccg

SEQ ID NO: 685490 - DNA, 20 bp, mouse
gaccggctctgcgacggccc

SEQ ID NO: 685491 - DNA, 20 bp, mouse
gccggtcctagaagaggggc

SEQ ID NO: 685492 - DNA, 20 bp, mouse
gtctgcgacggcccgggact

SEQ ID NO: 685493 - DNA, 20 bp, mouse
gtctggtagaagaggtgtgg

SEQ ID NO: 685494 - DNA, 20 bp, mouse
gggttgcgagcgctccctgc

SEQ ID NO: 685495 - DNA, 20 bp, mouse
gggggtcttaggagagtcgt

SEQ ID NO: 685496 - DNA, 20 bp, mouse
gccgcctagcgagtccccga

SEQ ID NO: 685497 - DNA, 20 bp, mouse
ggggacgcgcagagacgccg

SEQ ID NO: 685498 - DNA, 20 bp, mouse
gctactgcgtgcaagactgc

SEQ ID NO: 685499 - DNA, 20 bp, mouse
gtgtgtcccgggctgcacca

SEQ ID NO: 685500 - DNA, 20 bp, mouse
ggtgcagcccgggacacaga

SEQ ID NO: 685501 - DNA, 20 bp, mouse
gagacgccgtggtgcagccc

SEQ ID NO: 685502 - DNA, 20 bp, mouse
gctagcgagtccccgaaggt

SEQ ID NO: 685503 - DNA, 20 bp, mouse
gggggcctcggggtcggagc

SEQ ID NO: 685504 - DNA, 20 bp, mouse
gatagaaggcatggaatctt

SEQ ID NO: 685505 - DNA, 20 bp, mouse
gcgcggcgggtcacaacccg

SEQ ID NO: 685506 - DNA, 20 bp, mouse
gctgaagatgcgcccaacag

SEQ ID NO: 685507 - DNA, 20 bp, mouse
gtataccgtaaatcttccgg

SEQ ID NO: 685508 - DNA, 20 bp, mouse
gggaggaaaattctaagtag

SEQ ID NO: 685509 - DNA, 20 bp, mouse
gacaaggtcccctttgggct

SEQ ID NO: 685510 - DNA, 20 bp, mouse
gcgagtacttgagaaatgaa

SEQ ID NO: 685511 - DNA, 20 bp, mouse
ggaggcagctcaggaataca

SEQ ID NO: 685512 - DNA, 20 bp, mouse
gcaacttcatgctcccgcct

SEQ ID NO: 685513 - DNA, 20 bp, mouse
gggaatacaaggtccccttt

SEQ ID NO: 685514 - DNA, 20 bp, mouse
ggctaaactctacctctgtt

SEQ ID NO: 685515 - DNA, 20 bp, mouse
ggcttcccgagtattgtgat

SEQ ID NO: 685516 - DNA, 20 bp, mouse
gtgggccgggagtcgatgcc

SEQ ID NO: 685517 - DNA, 20 bp, mouse
ggtcgatgccaggaactcct

SEQ ID NO: 685518 - DNA, 20 bp, mouse
gactattagagtttcctctc

SEQ ID NO: 685519 - DNA, 20 bp, mouse
gagcaaggaaagctggtctg

SEQ ID NO: 685520 - DNA, 20 bp, mouse
gatcgactcccggcccaagc

SEQ ID NO: 685521 - DNA, 20 bp, mouse
gagagtttcctctccggctt

SEQ ID NO: 685522 - DNA, 20 bp, mouse
gcaggtggttcggtcctagg

SEQ ID NO: 685523 - DNA, 20 bp, mouse
gagttcctggcatcgactcc

SEQ ID NO: 685524 - DNA, 20 bp, mouse
ggctggccgggtctgatttc

SEQ ID NO: 685525 - DNA, 20 bp, mouse
gctcccggcccaagccggag

SEQ ID NO: 685526 - DNA, 20 bp, mouse
gcggggagattgtaggtcac

SEQ ID NO: 685527 - DNA, 20 bp, mouse
gctatcttgaccaaaggagg

SEQ ID NO: 685528 - DNA, 20 bp, mouse
gtctctcctccgtggatgga

SEQ ID NO: 685529 - DNA, 20 bp, mouse
ggtaggtcacaggtttccaa

SEQ ID NO: 685530 - DNA, 20 bp, mouse
gtggagggcggggagattgt

SEQ ID NO: 685531 - DNA, 20 bp, mouse
gccccgccctccatccacgg

SEQ ID NO: 685532 - DNA, 20 bp, mouse
gtgactaagtctctcctccg

SEQ ID NO: 685533 - DNA, 20 bp, mouse
gtaagtctctcctccgtgga

SEQ ID NO: 685534 - DNA, 20 bp, mouse
gtggcaagctgcagggaagg

SEQ ID NO: 685535 - DNA, 20 bp, mouse
gctcatgctatcttgaccaa

SEQ ID NO: 685536 - DNA, 20 bp, mouse
gatacaggctggtaggtttg

SEQ ID NO: 685537 - DNA, 20 bp, mouse
gagagggtgactattaaggc

SEQ ID NO: 685538 - DNA, 20 bp, mouse
gaggctggaatctgaggagt

SEQ ID NO: 685539 - DNA, 20 bp, mouse
ggtaggcacgccttgtatac

SEQ ID NO: 685540 - DNA, 20 bp, mouse
ggtcaagaggcgggcctctc

SEQ ID NO: 685541 - DNA, 20 bp, mouse
gagagaagaggggagaatac

SEQ ID NO: 685542 - DNA, 20 bp, mouse
ggccttgtatacaggctggt

SEQ ID NO: 685543 - DNA, 20 bp, mouse
gaaactacgcggctgtactc

SEQ ID NO: 685544 - DNA, 20 bp, mouse
ggggtcgccagccttgcacg

SEQ ID NO: 685545 - DNA, 20 bp, mouse
ggagtctgaggacccgtccc

SEQ ID NO: 685546 - DNA, 20 bp, mouse
ggggaaagggaggagcccgc

SEQ ID NO: 685547 - DNA, 20 bp, mouse
gagctctcagagagacgcga

SEQ ID NO: 685548 - DNA, 20 bp, mouse
ggtcccgcccgctgtgcgat

SEQ ID NO: 685549 - DNA, 20 bp, mouse
ggctgtgcgattggctgaaa

SEQ ID NO: 685550 - DNA, 20 bp, mouse
gcgcgcacgccgtccggagg

SEQ ID NO: 685551 - DNA, 20 bp, mouse
ggggagttcccgcctccgga

SEQ ID NO: 685552 - DNA, 20 bp, mouse
gcagagagacgcgaggggaa

SEQ ID NO: 685553 - DNA, 20 bp, mouse
gttgccgcctggagttcgtt

SEQ ID NO: 685554 - DNA, 20 bp, mouse
gaatggctctgagttcccgc

SEQ ID NO: 685555 - DNA, 20 bp, mouse
gcagccaatcgcacagcggg

SEQ ID NO: 685556 - DNA, 20 bp, mouse
gcacccgcgcacagatcatt

SEQ ID NO: 685557 - DNA, 20 bp, mouse
gtccggccagggatcgacgg

SEQ ID NO: 685558 - DNA, 20 bp, mouse
gcccctaatgatctgtgcgc

SEQ ID NO: 685559 - DNA, 20 bp, mouse
gtcttccggccagggatcga

SEQ ID NO: 685560 - DNA, 20 bp, mouse
ggcacttagcgtcgggaaag

SEQ ID NO: 685561 - DNA, 20 bp, mouse
gtcccgacgctaagtgcaag

SEQ ID NO: 685562 - DNA, 20 bp, mouse
gtggagatatacgtggttgt

SEQ ID NO: 685563 - DNA, 20 bp, mouse
gtgtggaattggagtctcta

SEQ ID NO: 685564 - DNA, 20 bp, mouse
gagcctcttgcacttagcgt

SEQ ID NO: 685565 - DNA, 20 bp, mouse
gtatacgtggttgttggtga

SEQ ID NO: 685566 - DNA, 20 bp, mouse
gaggcggagtctgaggacac

SEQ ID NO: 685567 - DNA, 20 bp, mouse
gtacggtcgcggggcctctt

SEQ ID NO: 685568 - DNA, 20 bp, mouse
gtcactgtagggtacggtcg

SEQ ID NO: 685569 - DNA, 20 bp, mouse
gggcaggacccagactagaa

SEQ ID NO: 685570 - DNA, 20 bp, mouse
gtgaactgccggactcgcag

SEQ ID NO: 685571 - DNA, 20 bp, mouse
ggccgaatggggggactcga

SEQ ID NO: 685572 - DNA, 20 bp, mouse
gctgccggactcgcagtggt

SEQ ID NO: 685573 - DNA, 20 bp, mouse
gtcggcgtcactgtagggta

SEQ ID NO: 685574 - DNA, 20 bp, mouse
ggaatggggggactcgacgg

SEQ ID NO: 685575 - DNA, 20 bp, mouse
gcgcggagcccggatggagg

SEQ ID NO: 685576 - DNA, 20 bp, mouse
gctgccttggggctcgcgat

SEQ ID NO: 685577 - DNA, 20 bp, mouse
gcggctgtagccccagacac

SEQ ID NO: 685578 - DNA, 20 bp, mouse
gtgcgcctgcacccgggcac

SEQ ID NO: 685579 - DNA, 20 bp, mouse
gactgactgtctcgcgctgt

SEQ ID NO: 685580 - DNA, 20 bp, mouse
gttggggctcgcgatgggtt

SEQ ID NO: 685581 - DNA, 20 bp, mouse
gctgcggccccggctctgtt

SEQ ID NO: 685582 - DNA, 20 bp, mouse
ggaagtcccgcctgtgtctg

SEQ ID NO: 685583 - DNA, 20 bp, mouse
gctccctccagccagtgccc

SEQ ID NO: 685584 - DNA, 20 bp, mouse
ggccccggctctgttcggcc

SEQ ID NO: 685585 - DNA, 20 bp, mouse
ggaagtcccacctgcggccc

SEQ ID NO: 685586 - DNA, 20 bp, mouse
gctagcccgccgcttactgt

SEQ ID NO: 685587 - DNA, 20 bp, mouse
ggagccccacagtaagcggc

SEQ ID NO: 685588 - DNA, 20 bp, mouse
gtaggagggcggcgccgcca

SEQ ID NO: 685589 - DNA, 20 bp, mouse
gacgaagacaggcgttagga

SEQ ID NO: 685590 - DNA, 20 bp, mouse
gaagacaggcgttaggaggg

SEQ ID NO: 685591 - DNA, 20 bp, mouse
gcatggagccccacagtaag

SEQ ID NO: 685592 - DNA, 20 bp, mouse
ggggcccggcggacggcgag

SEQ ID NO: 685593 - DNA, 20 bp, mouse
gtgccctgacaaccggggat

SEQ ID NO: 685594 - DNA, 20 bp, mouse
ggggccaggtctcgaaccct

SEQ ID NO: 685595 - DNA, 20 bp, mouse
gaagcggcgggctagggcct

SEQ ID NO: 685596 - DNA, 20 bp, mouse
gacggcccgagtaacaacag

SEQ ID NO: 685597 - DNA, 20 bp, mouse
ggaggcggctgtgaggtcat

SEQ ID NO: 685598 - DNA, 20 bp, mouse
gcgcctgcacgtggcgagaa

SEQ ID NO: 685599 - DNA, 20 bp, mouse
ggcggctgtgaggtcatcgg

SEQ ID NO: 685600 - DNA, 20 bp, mouse
gcatcctgtgagagcaaggt

SEQ ID NO: 685601 - DNA, 20 bp, mouse
gcctccgaccttgctctcac

SEQ ID NO: 685602 - DNA, 20 bp, mouse
gacaggggacgatagctgtg

SEQ ID NO: 685603 - DNA, 20 bp, mouse
gcccggccggaatctcttag

SEQ ID NO: 685604 - DNA, 20 bp, mouse
gggtcctcccgacatgccgg

SEQ ID NO: 685605 - DNA, 20 bp, mouse
gcctcctccggcatgtcggg

SEQ ID NO: 685606 - DNA, 20 bp, mouse
gccctcctctggcctctaga

SEQ ID NO: 685607 - DNA, 20 bp, mouse
gaggccagaggaggggttat

SEQ ID NO: 685608 - DNA, 20 bp, mouse
gaagcccaatagggagtagc

SEQ ID NO: 685609 - DNA, 20 bp, mouse
gtgtggagaggacacggcta

SEQ ID NO: 685610 - DNA, 20 bp, mouse
gttacctataacccctcctc

SEQ ID NO: 685611 - DNA, 20 bp, mouse
gcatcgcacaaagcgctctt

SEQ ID NO: 685612 - DNA, 20 bp, mouse
gcaaaacactgcctgaagcc

SEQ ID NO: 685613 - DNA, 20 bp, mouse
gcccaatagggagtagcggg

SEQ ID NO: 685614 - DNA, 20 bp, mouse
gagaggacacggctagggac

SEQ ID NO: 685615 - DNA, 20 bp, mouse
gcgtacaatgaagcccaata

SEQ ID NO: 685616 - DNA, 20 bp, mouse
gtactcatgaacatctggtc

SEQ ID NO: 685617 - DNA, 20 bp, mouse
ggggcggggaggtcagtcct

SEQ ID NO: 685618 - DNA, 20 bp, mouse
ggctgaggcagggaaatcat

SEQ ID NO: 685619 - DNA, 20 bp, mouse
gagccctcaagtgagcctgc

SEQ ID NO: 685620 - DNA, 20 bp, mouse
gctctggaagctgcagaagt

SEQ ID NO: 685621 - DNA, 20 bp, mouse
gtcacttgagggctagcatg

SEQ ID NO: 685622 - DNA, 20 bp, mouse
gtgagtaagagctgttccca

SEQ ID NO: 685623 - DNA, 20 bp, mouse
ggggcacagaactcaagtct

SEQ ID NO: 685624 - DNA, 20 bp, mouse
gtcaggcacagatggttcac

SEQ ID NO: 685625 - DNA, 20 bp, mouse
gcacagccttgggaggtatg

SEQ ID NO: 685626 - DNA, 20 bp, mouse
gtggccgcgcggcatcacgt

SEQ ID NO: 685627 - DNA, 20 bp, mouse
gcacgtgatccatagtgggg

SEQ ID NO: 685628 - DNA, 20 bp, mouse
gcatcacgtgggccaaggag

SEQ ID NO: 685629 - DNA, 20 bp, mouse
gagcccggagggactcgcgc

SEQ ID NO: 685630 - DNA, 20 bp, mouse
ggactcgcgcgggtctagag

SEQ ID NO: 685631 - DNA, 20 bp, mouse
gggcccgccagcagcctccg

SEQ ID NO: 685632 - DNA, 20 bp, mouse
ggccaaggagaggccctcaa

SEQ ID NO: 685633 - DNA, 20 bp, mouse
gctaccctgcttggacactc

SEQ ID NO: 685634 - DNA, 20 bp, mouse
ggaaaagaagccacgccttc

SEQ ID NO: 685635 - DNA, 20 bp, mouse
gcgatcacgtgatccatagt

SEQ ID NO: 685636 - DNA, 20 bp, mouse
gctggccagaacacgaaccg

SEQ ID NO: 685637 - DNA, 20 bp, mouse
ggaaccgcggctcacaccgc

SEQ ID NO: 685638 - DNA, 20 bp, mouse
gctcctgggtgggcgtcctt

SEQ ID NO: 685639 - DNA, 20 bp, mouse
gtgggtgggcgtccttcgga

SEQ ID NO: 685640 - DNA, 20 bp, mouse
ggcgccagcggtgtgagccg

SEQ ID NO: 685641 - DNA, 20 bp, mouse
gggcgccggaagcaaagcag

SEQ ID NO: 685642 - DNA, 20 bp, mouse
gacgtcacggacggcgccag

SEQ ID NO: 685643 - DNA, 20 bp, mouse
ggcccggacgccattttcag

SEQ ID NO: 685644 - DNA, 20 bp, mouse
gttccggcgcccagcgcgag

SEQ ID NO: 685645 - DNA, 20 bp, mouse
ggtgggcgtccttcggatgg

SEQ ID NO: 685646 - DNA, 20 bp, mouse
gccggaaagggaggtcgtag

SEQ ID NO: 685647 - DNA, 20 bp, mouse
gaggcccgacgcgccggaaa

SEQ ID NO: 685648 - DNA, 20 bp, mouse
gggccggcgtactctgtctg

SEQ ID NO: 685649 - DNA, 20 bp, mouse
gaactggaggcccgacgcgc

SEQ ID NO: 685650 - DNA, 20 bp, mouse
gaggtcgtagcggaaaaggc

SEQ ID NO: 685651 - DNA, 20 bp, mouse
gggtccttatgtaaataagg

SEQ ID NO: 685652 - DNA, 20 bp, mouse
gggcgtactctgtctgtggg

SEQ ID NO: 685653 - DNA, 20 bp, mouse
gcggcccccttatttacata

SEQ ID NO: 685654 - DNA, 20 bp, mouse
ggtctcagatcatatctggc

SEQ ID NO: 685655 - DNA, 20 bp, mouse
gagggaggtcgtagcggaaa

SEQ ID NO: 685656 - DNA, 20 bp, mouse
gctggctcgggggtgtgcaa

SEQ ID NO: 685657 - DNA, 20 bp, mouse
ggctcgggggtgtgcaaggg

SEQ ID NO: 685658 - DNA, 20 bp, mouse
gaacaccccgcctctggctc

SEQ ID NO: 685659 - DNA, 20 bp, mouse
gcacacccccgagccagagg

SEQ ID NO: 685660 - DNA, 20 bp, mouse
gagggaggacaacacgagac

SEQ ID NO: 685661 - DNA, 20 bp, mouse
ggctcggaaggcctgttcgc

SEQ ID NO: 685662 - DNA, 20 bp, mouse
gtgttcgcggggttgcactc

SEQ ID NO: 685663 - DNA, 20 bp, mouse
ggctggcggccagtgcaaag

SEQ ID NO: 685664 - DNA, 20 bp, mouse
gtgcactggccgccagcgac

SEQ ID NO: 685665 - DNA, 20 bp, mouse
gagagtcaacaccccgcctc

SEQ ID NO: 685666 - DNA, 20 bp, mouse
gcacgggcccgcgctcctgg

SEQ ID NO: 685667 - DNA, 20 bp, mouse
gtcggggcccccaggagcgc

SEQ ID NO: 685668 - DNA, 20 bp, mouse
gcccgtgcgcgtccaagcag

SEQ ID NO: 685669 - DNA, 20 bp, mouse
ggaggcacgtggcgatgggc

SEQ ID NO: 685670 - DNA, 20 bp, mouse
gggagataggcaagacttgt

SEQ ID NO: 685671 - DNA, 20 bp, mouse
gtggcggaggcacgtggcga

SEQ ID NO: 685672 - DNA, 20 bp, mouse
gccccgaggcaccaccccca

SEQ ID NO: 685673 - DNA, 20 bp, mouse
ggggatgctgtggtgactaa

SEQ ID NO: 685674 - DNA, 20 bp, mouse
gtgttcaggtgtgacttcgc

SEQ ID NO: 685675 - DNA, 20 bp, mouse
gtcaactggtatctggagat

SEQ ID NO: 685676 - DNA, 20 bp, mouse
gaggaagcgcactcacttga

SEQ ID NO: 685677 - DNA, 20 bp, mouse
gggcaccgacagcccggcgt

SEQ ID NO: 685678 - DNA, 20 bp, mouse
ggcacccagggtcggggtcc

SEQ ID NO: 685679 - DNA, 20 bp, mouse
gagccgcagcatccactctg

SEQ ID NO: 685680 - DNA, 20 bp, mouse
gcgcccaggtgtcttctgat

SEQ ID NO: 685681 - DNA, 20 bp, mouse
gctgcgggtgaggtccaaga

SEQ ID NO: 685682 - DNA, 20 bp, mouse
gcatccactctggggtggag

SEQ ID NO: 685683 - DNA, 20 bp, mouse
gcgtgggcccccgagtctgt

SEQ ID NO: 685684 - DNA, 20 bp, mouse
gagtgagtgcgcttcctctc

SEQ ID NO: 685685 - DNA, 20 bp, mouse
gtggtcctgcctgtcagccc

SEQ ID NO: 685686 - DNA, 20 bp, mouse
ggacccctgcaatatatagt

SEQ ID NO: 685687 - DNA, 20 bp, mouse
ggctgacagtcactgctcct

SEQ ID NO: 685688 - DNA, 20 bp, mouse
gtatagtggggtgatggacc

SEQ ID NO: 685689 - DNA, 20 bp, mouse
ggcagtaaccctgtccatct

SEQ ID NO: 685690 - DNA, 20 bp, mouse
gagcctgtctcccctgcaaa

SEQ ID NO: 685691 - DNA, 20 bp, mouse
gtgccaactgaaaacagatg

SEQ ID NO: 685692 - DNA, 20 bp, mouse
ggactcctggtccaggaaac

SEQ ID NO: 685693 - DNA, 20 bp, mouse
gcaccccactatatattgca

SEQ ID NO: 685694 - DNA, 20 bp, mouse
gctggaagttattgaagcag

SEQ ID NO: 685695 - DNA, 20 bp, mouse
gaggaaataggcaggcatta

SEQ ID NO: 685696 - DNA, 20 bp, mouse
gagtgcgtctggcccgtctg

SEQ ID NO: 685697 - DNA, 20 bp, mouse
gtacgctgttcgttcagtgg

SEQ ID NO: 685698 - DNA, 20 bp, mouse
gcagtggcggcctctagcgg

SEQ ID NO: 685699 - DNA, 20 bp, mouse
gctctgctgacggatcacag

SEQ ID NO: 685700 - DNA, 20 bp, mouse
gtgtaaggatcagcgagatc

SEQ ID NO: 685701 - DNA, 20 bp, mouse
ggagtcttcccccccgctag

SEQ ID NO: 685702 - DNA, 20 bp, mouse
gagttacgctgttcgttcag

SEQ ID NO: 685703 - DNA, 20 bp, mouse
ggcaggaagttcccacagac

SEQ ID NO: 685704 - DNA, 20 bp, mouse
gacgagcgccgacccggaag

SEQ ID NO: 685705 - DNA, 20 bp, mouse
ggcgcctcggaaaagcaagt

SEQ ID NO: 685706 - DNA, 20 bp, mouse
ggagccagcacgccccgagg

SEQ ID NO: 685707 - DNA, 20 bp, mouse
ggcgactgacaggaaattat

SEQ ID NO: 685708 - DNA, 20 bp, mouse
gcggggcttgaaccacttcc

SEQ ID NO: 685709 - DNA, 20 bp, mouse
ggcaagtggactgcgttaag

SEQ ID NO: 685710 - DNA, 20 bp, mouse
ggtggactgcgttaagtggt

SEQ ID NO: 685711 - DNA, 20 bp, mouse
gaagctggttagcgactgac

SEQ ID NO: 685712 - DNA, 20 bp, mouse
ggaggtcgcgcgagatctgc

SEQ ID NO: 685713 - DNA, 20 bp, mouse
ggcgcgagatctgctggcct

SEQ ID NO: 685714 - DNA, 20 bp, mouse
gcgactcgcgcctgcgcggt

SEQ ID NO: 685715 - DNA, 20 bp, mouse
gtctcgcgcgacctcaggtt

SEQ ID NO: 685716 - DNA, 20 bp, mouse
gcactggagcctgcggggac

SEQ ID NO: 685717 - DNA, 20 bp, mouse
ggcaaccgcgtcctcctctg

SEQ ID NO: 685718 - DNA, 20 bp, mouse
gcggggaccggcgacgaagt

SEQ ID NO: 685719 - DNA, 20 bp, mouse
gaccggcgacgaagtcggag

SEQ ID NO: 685720 - DNA, 20 bp, mouse
gtggacaaacggagtgggcg

SEQ ID NO: 685721 - DNA, 20 bp, mouse
gcgcgtggaagcgtcccgcc

SEQ ID NO: 685722 - DNA, 20 bp, mouse
gtcggtccgccgcgggatgg

SEQ ID NO: 685723 - DNA, 20 bp, mouse
ggcggggccgctcctggaaa

SEQ ID NO: 685724 - DNA, 20 bp, mouse
ggatggcggctctgagaagt

SEQ ID NO: 685725 - DNA, 20 bp, mouse
gacgcccccagaggaggacg

SEQ ID NO: 685726 - DNA, 20 bp, mouse
ggggtgagatagagagtggg

SEQ ID NO: 685727 - DNA, 20 bp, mouse
gcattcggacccacgtgtgg

SEQ ID NO: 685728 - DNA, 20 bp, mouse
gccgcagcccctaccaatgg

SEQ ID NO: 685729 - DNA, 20 bp, mouse
ggacccgcagcccctaccaa

SEQ ID NO: 685730 - DNA, 20 bp, mouse
gcctaccaatgggggaaggg

SEQ ID NO: 685731 - DNA, 20 bp, mouse
gccccctggcggttggaaca

SEQ ID NO: 685732 - DNA, 20 bp, mouse
gaagcgcgctacctgcccgg

SEQ ID NO: 685733 - DNA, 20 bp, mouse
gcccggcgggcctaaccatt

SEQ ID NO: 685734 - DNA, 20 bp, mouse
gtggaacagggtagaccttt

SEQ ID NO: 685735 - DNA, 20 bp, mouse
gcgggcggaagtggggcagg

SEQ ID NO: 685736 - DNA, 20 bp, mouse
gtgcccgctgtcggtcgccc

SEQ ID NO: 685737 - DNA, 20 bp, mouse
ggagccgcctgggctaagac

SEQ ID NO: 685738 - DNA, 20 bp, mouse
ggccctcggggcggcgttta

SEQ ID NO: 685739 - DNA, 20 bp, mouse
gcagctccacgagtaggaag

SEQ ID NO: 685740 - DNA, 20 bp, mouse
gcgcccgggcgaccgacagc

SEQ ID NO: 685741 - DNA, 20 bp, mouse
gctcggggcggcgtttaggg

SEQ ID NO: 685742 - DNA, 20 bp, mouse
ggaaagccgcttcctactcg

SEQ ID NO: 685743 - DNA, 20 bp, mouse
ggaggccgtcttaaagagat

SEQ ID NO: 685744 - DNA, 20 bp, mouse
gtgatgaatcacgtgtgtcg

SEQ ID NO: 685745 - DNA, 20 bp, mouse
ggctccagtcttagcccagg

SEQ ID NO: 685746 - DNA, 20 bp, mouse
gaagggccccgccttttccg

SEQ ID NO: 685747 - DNA, 20 bp, mouse
gggcgagaagcgcgatggac

SEQ ID NO: 685748 - DNA, 20 bp, mouse
gtccggggatgccaaagcct

SEQ ID NO: 685749 - DNA, 20 bp, mouse
gatggtacatagtaaggaac

SEQ ID NO: 685750 - DNA, 20 bp, mouse
gagtaaggaacgggtttgga

SEQ ID NO: 685751 - DNA, 20 bp, mouse
ggcgcgatggacaggccgaa

SEQ ID NO: 685752 - DNA, 20 bp, mouse
gctaaagagagtctctaaca

SEQ ID NO: 685753 - DNA, 20 bp, mouse
gcagagggcgagaagcgcga

SEQ ID NO: 685754 - DNA, 20 bp, mouse
gggcggggcccttgcgtcac

SEQ ID NO: 685755 - DNA, 20 bp, mouse
gaggttccgcggcgcgggat

SEQ ID NO: 685756 - DNA, 20 bp, mouse
gagacagcagactcgggccg

SEQ ID NO: 685757 - DNA, 20 bp, mouse
gcccccagccactcagaagc

SEQ ID NO: 685758 - DNA, 20 bp, mouse
ggcccgagtctgctgtctcc

SEQ ID NO: 685759 - DNA, 20 bp, mouse
ggccgggagacagcagactc

SEQ ID NO: 685760 - DNA, 20 bp, mouse
ggacggagcgcggaggtgaa

SEQ ID NO: 685761 - DNA, 20 bp, mouse
gccgcggcgacggcgcacag

SEQ ID NO: 685762 - DNA, 20 bp, mouse
gcgcgctcggcccgcggcga

SEQ ID NO: 685763 - DNA, 20 bp, mouse
gtagccccagcggcgcgttc

SEQ ID NO: 685764 - DNA, 20 bp, mouse
ggtgcagcggggcttgcgga

SEQ ID NO: 685765 - DNA, 20 bp, mouse
gaatcctgaacgcgccgctg

SEQ ID NO: 685766 - DNA, 20 bp, mouse
gcgtgcccggccaaccaggc

SEQ ID NO: 685767 - DNA, 20 bp, mouse
gctggcgctccggggaaccc

SEQ ID NO: 685768 - DNA, 20 bp, mouse
gtcccgcgtcccgaactaag

SEQ ID NO: 685769 - DNA, 20 bp, mouse
ggtggcgcatgcgtgcaaga

SEQ ID NO: 685770 - DNA, 20 bp, mouse
gcaaccaggctggcgctccg

SEQ ID NO: 685771 - DNA, 20 bp, mouse
gcaagcgtgcccggccaacc

SEQ ID NO: 685772 - DNA, 20 bp, mouse
gagctacggcgaggctagag

SEQ ID NO: 685773 - DNA, 20 bp, mouse
gagcgccagcctggttggcc

SEQ ID NO: 685774 - DNA, 20 bp, mouse
gcgcatgcgtgcaagaaggg

SEQ ID NO: 685775 - DNA, 20 bp, mouse
ggggagccaatgccactaaa

SEQ ID NO: 685776 - DNA, 20 bp, mouse
gctcctagggctgcagggac

SEQ ID NO: 685777 - DNA, 20 bp, mouse
gtgctagaggcgctccggca

SEQ ID NO: 685778 - DNA, 20 bp, mouse
gatcggaacaccagctccta

SEQ ID NO: 685779 - DNA, 20 bp, mouse
gcggagcgcctctagcacat

SEQ ID NO: 685780 - DNA, 20 bp, mouse
ggggcagtatagcgaccaga

SEQ ID NO: 685781 - DNA, 20 bp, mouse
gcagggactggctgtctttc

SEQ ID NO: 685782 - DNA, 20 bp, mouse
gactggctgtctttccggga

SEQ ID NO: 685783 - DNA, 20 bp, mouse
gctgtctttccgggatggag

SEQ ID NO: 685784 - DNA, 20 bp, mouse
ggtgtctacgcatgcgtgat

SEQ ID NO: 685785 - DNA, 20 bp, mouse
gcgacaggcgttacaccctc

SEQ ID NO: 685786 - DNA, 20 bp, mouse
ggggaattgtagtctcttat

SEQ ID NO: 685787 - DNA, 20 bp, mouse
gggctcctcccgcggcaagg

SEQ ID NO: 685788 - DNA, 20 bp, mouse
gtcaggcaggcagttaggat

SEQ ID NO: 685789 - DNA, 20 bp, mouse
ggagccagccttgcctccgg

SEQ ID NO: 685790 - DNA, 20 bp, mouse
gcaccgacccacccagtcag

SEQ ID NO: 685791 - DNA, 20 bp, mouse
gcaggcagttaggattggtt

SEQ ID NO: 685792 - DNA, 20 bp, mouse
gctggagccagccttgcctc

SEQ ID NO: 685793 - DNA, 20 bp, mouse
gtctgtctggtgagctcctc

SEQ ID NO: 685794 - DNA, 20 bp, mouse
gtctcagcccacaacctgca

SEQ ID NO: 685795 - DNA, 20 bp, mouse
gggcctgccgctgactgggt

SEQ ID NO: 685796 - DNA, 20 bp, mouse
gtggagctggacaaaggtgc

SEQ ID NO: 685797 - DNA, 20 bp, mouse
gagagagagctctgtgccct

SEQ ID NO: 685798 - DNA, 20 bp, mouse
gcatggttggtcctcttgtc

SEQ ID NO: 685799 - DNA, 20 bp, mouse
gggtaacaaagaatccggga

SEQ ID NO: 685800 - DNA, 20 bp, mouse
ggccccagccagacagcact

SEQ ID NO: 685801 - DNA, 20 bp, mouse
gccacccagtgctgtctggc

SEQ ID NO: 685802 - DNA, 20 bp, mouse
gtgccttgctgtcaatcggg

SEQ ID NO: 685803 - DNA, 20 bp, mouse
gttccacccgattgacagca

SEQ ID NO: 685804 - DNA, 20 bp, mouse
gagacagcactgggtggagc

SEQ ID NO: 685805 - DNA, 20 bp, mouse
gcaagaggaccaaccatgcc

SEQ ID NO: 685806 - DNA, 20 bp, mouse
gggaatgtataaaaggcttc

SEQ ID NO: 685807 - DNA, 20 bp, mouse
gctattgcagcaattagcca

SEQ ID NO: 685808 - DNA, 20 bp, mouse
ggcaaagagggaaacgccag

SEQ ID NO: 685809 - DNA, 20 bp, mouse
gagaggcactctgcagccag

SEQ ID NO: 685810 - DNA, 20 bp, mouse
gtgagaaagagggcttactt

SEQ ID NO: 685811 - DNA, 20 bp, mouse
gggcagaggacagccgctcc

SEQ ID NO: 685812 - DNA, 20 bp, mouse
gtctccaggttctccaggag

SEQ ID NO: 685813 - DNA, 20 bp, mouse
gaaagcgaaagcgtgaacat

SEQ ID NO: 685814 - DNA, 20 bp, mouse
gtttttaaaaggagaggtgg

SEQ ID NO: 685815 - DNA, 20 bp, mouse
gagagggaaacgccagaggg

SEQ ID NO: 685816 - DNA, 20 bp, mouse
ggcgggcgcaggctggtcga

SEQ ID NO: 685817 - DNA, 20 bp, mouse
gggcgcaggctggtcgaggg

SEQ ID NO: 685818 - DNA, 20 bp, mouse
ggggtggagcggtgcgtccc

SEQ ID NO: 685819 - DNA, 20 bp, mouse
gggtcccccgcccctgagag

SEQ ID NO: 685820 - DNA, 20 bp, mouse
gtcccgcagcccgctctcag

SEQ ID NO: 685821 - DNA, 20 bp, mouse
gtccctggacacagcggctt

SEQ ID NO: 685822 - DNA, 20 bp, mouse
gaggctggtcgagggtggag

SEQ ID NO: 685823 - DNA, 20 bp, mouse
gtgcgtcccggggctggcag

SEQ ID NO: 685824 - DNA, 20 bp, mouse
gagagcgggctgcgggactc

SEQ ID NO: 685825 - DNA, 20 bp, mouse
gccccagaaatcttgggtcg

SEQ ID NO: 685826 - DNA, 20 bp, mouse
gctgctccggcgtgtcttat

SEQ ID NO: 685827 - DNA, 20 bp, mouse
gccgaagcggagtaaagctc

SEQ ID NO: 685828 - DNA, 20 bp, mouse
ggtaaagctccgggctgctc

SEQ ID NO: 685829 - DNA, 20 bp, mouse
ggggcggggcaacgcttgcg

SEQ ID NO: 685830 - DNA, 20 bp, mouse
gaagaaggtggggatcccgg

SEQ ID NO: 685831 - DNA, 20 bp, mouse
ggacgtgcgaccccaccgaa

SEQ ID NO: 685832 - DNA, 20 bp, mouse
ggacgcgcgtgcgcggctga

SEQ ID NO: 685833 - DNA, 20 bp, mouse
gtggggtcgcacgtctcccg

SEQ ID NO: 685834 - DNA, 20 bp, mouse
gtcccggaggagggtcacct

SEQ ID NO: 685835 - DNA, 20 bp, mouse
gagctggacagaggcgcctc

SEQ ID NO: 685836 - DNA, 20 bp, mouse
gccccctctggcatagttaa

SEQ ID NO: 685837 - DNA, 20 bp, mouse
ggggcaggtcaatgtttgca

SEQ ID NO: 685838 - DNA, 20 bp, mouse
gtagttgcagtgacgtcggg

SEQ ID NO: 685839 - DNA, 20 bp, mouse
gaggtagttgcagtgacgtc

SEQ ID NO: 685840 - DNA, 20 bp, mouse
gatacggtactgacagtaaa

SEQ ID NO: 685841 - DNA, 20 bp, mouse
gaccatcagctgtatccata

SEQ ID NO: 685842 - DNA, 20 bp, mouse
gtagttaaaggcatgcacaa

SEQ ID NO: 685843 - DNA, 20 bp, mouse
gcagagacattttctaggag

SEQ ID NO: 685844 - DNA, 20 bp, mouse
gcatgcacaaaggatccaac

SEQ ID NO: 685845 - DNA, 20 bp, mouse
gactccctagcatctaccaa

SEQ ID NO: 685846 - DNA, 20 bp, mouse
gccacggcggcgcgcgctca

SEQ ID NO: 685847 - DNA, 20 bp, mouse
ggcgctctcgaagtactcgc

SEQ ID NO: 685848 - DNA, 20 bp, mouse
gggagcgcgcggacgtgcca

SEQ ID NO: 685849 - DNA, 20 bp, mouse
gttgggaagaccccctccta

SEQ ID NO: 685850 - DNA, 20 bp, mouse
gggagcctaactaagcctca

SEQ ID NO: 685851 - DNA, 20 bp, mouse
gcgcgcaccgggcaacaaga

SEQ ID NO: 685852 - DNA, 20 bp, mouse
gcggcggcgcgcgctcaggg

SEQ ID NO: 685853 - DNA, 20 bp, mouse
gcggcgcgcgctcagggggg

SEQ ID NO: 685854 - DNA, 20 bp, mouse
ggagcagctcgagagccctg

SEQ ID NO: 685855 - DNA, 20 bp, mouse
gcgcggccgccctgccccgg

SEQ ID NO: 685856 - DNA, 20 bp, mouse
gtgacagggcccatcgtgtg

SEQ ID NO: 685857 - DNA, 20 bp, mouse
gggaacgcgggtgggtgaca

SEQ ID NO: 685858 - DNA, 20 bp, mouse
gtcaccgccaagcccgccct

SEQ ID NO: 685859 - DNA, 20 bp, mouse
gcgggggcatgcagagctct

SEQ ID NO: 685860 - DNA, 20 bp, mouse
ggtcgccccaactgcaaaaa

SEQ ID NO: 685861 - DNA, 20 bp, mouse
gcacacccacgcataccacg

SEQ ID NO: 685862 - DNA, 20 bp, mouse
ggtagccacgtggtatgcgt

SEQ ID NO: 685863 - DNA, 20 bp, mouse
gggtgtccatcagcaaccgg

SEQ ID NO: 685864 - DNA, 20 bp, mouse
ggcggggcggagcgcagctg

SEQ ID NO: 685865 - DNA, 20 bp, mouse
ggggcagagtgatccagcga

SEQ ID NO: 685866 - DNA, 20 bp, mouse
ggagccagagagcaccgcgt

SEQ ID NO: 685867 - DNA, 20 bp, mouse
gcgggtgcataaggcagaga

SEQ ID NO: 685868 - DNA, 20 bp, mouse
gccagagagcaccgcgtggg

SEQ ID NO: 685869 - DNA, 20 bp, mouse
ggccctctaccgaaagcttc

SEQ ID NO: 685870 - DNA, 20 bp, mouse
gaaggctcccggtgaaaagc

SEQ ID NO: 685871 - DNA, 20 bp, mouse
gcgcgcgtgcgggcggtgca

SEQ ID NO: 685872 - DNA, 20 bp, mouse
ggcggtggcctgcttttcac

SEQ ID NO: 685873 - DNA, 20 bp, mouse
gttcggtagagggcagctga

SEQ ID NO: 685874 - DNA, 20 bp, mouse
ggagctcgggcgggtgcata

SEQ ID NO: 685875 - DNA, 20 bp, mouse
ggctgtgcagagagctcggg

SEQ ID NO: 685876 - DNA, 20 bp, mouse
gtgggagactggagcgaagt

SEQ ID NO: 685877 - DNA, 20 bp, mouse
ggggaccctacgagtggaaa

SEQ ID NO: 685878 - DNA, 20 bp, mouse
gaagcccgggaccctacgag

SEQ ID NO: 685879 - DNA, 20 bp, mouse
gtcactcgcgggttgcttgg

SEQ ID NO: 685880 - DNA, 20 bp, mouse
gggctgagtcagtcactcgc

SEQ ID NO: 685881 - DNA, 20 bp, mouse
gaatgccccggggagaagcc

SEQ ID NO: 685882 - DNA, 20 bp, mouse
gtggaaagggtagaagatcg

SEQ ID NO: 685883 - DNA, 20 bp, mouse
gaagggtagaagatcgcggc

SEQ ID NO: 685884 - DNA, 20 bp, mouse
gaggcacgtgatgtaaactt

SEQ ID NO: 685885 - DNA, 20 bp, mouse
gcattgggataagtgacccg

SEQ ID NO: 685886 - DNA, 20 bp, mouse
gagccagtcggaagcggtgc

SEQ ID NO: 685887 - DNA, 20 bp, mouse
gggtgggcggggctttcctc

SEQ ID NO: 685888 - DNA, 20 bp, mouse
gcccggaagccagtcggaag

SEQ ID NO: 685889 - DNA, 20 bp, mouse
gaagaagtcggaagaacctg

SEQ ID NO: 685890 - DNA, 20 bp, mouse
gtccgggaaggagtgagctt

SEQ ID NO: 685891 - DNA, 20 bp, mouse
ggctgggagctgtagtccag

SEQ ID NO: 685892 - DNA, 20 bp, mouse
ggccgtgccccagaagaagt

SEQ ID NO: 685893 - DNA, 20 bp, mouse
gagcctgcaccgcttccgac

SEQ ID NO: 685894 - DNA, 20 bp, mouse
gacccctcaacaggtatctc

SEQ ID NO: 685895 - DNA, 20 bp, mouse
ggcctcgcggcgtgggatcc

SEQ ID NO: 685896 - DNA, 20 bp, mouse
gaccgggagcgacctagcca

SEQ ID NO: 685897 - DNA, 20 bp, mouse
gaaaaggcgcgagtaggact

SEQ ID NO: 685898 - DNA, 20 bp, mouse
gaatcctcgggtgtgaaggt

SEQ ID NO: 685899 - DNA, 20 bp, mouse
gtcccgcccggggacaacta

SEQ ID NO: 685900 - DNA, 20 bp, mouse
gccagggctgagaatcctcc

SEQ ID NO: 685901 - DNA, 20 bp, mouse
gaggaataaaaggcgcgagt

SEQ ID NO: 685902 - DNA, 20 bp, mouse
gtcgctcccggtagcggtag

SEQ ID NO: 685903 - DNA, 20 bp, mouse
gtcacacccgaggattcttc

SEQ ID NO: 685904 - DNA, 20 bp, mouse
ggctaggtcgctcccggtag

SEQ ID NO: 685905 - DNA, 20 bp, mouse
gccctcgggcctggtcgggc

SEQ ID NO: 685906 - DNA, 20 bp, mouse
gggaacctgcaacgtgacaa

SEQ ID NO: 685907 - DNA, 20 bp, mouse
gagagggaccccagtcagaa

SEQ ID NO: 685908 - DNA, 20 bp, mouse
ggaagcgcggggctagtggg

SEQ ID NO: 685909 - DNA, 20 bp, mouse
gtacgaggctcatcccgcgt

SEQ ID NO: 685910 - DNA, 20 bp, mouse
gagaaaggctgctgtcgcta

SEQ ID NO: 685911 - DNA, 20 bp, mouse
gcacgggattgaatgagggg

SEQ ID NO: 685912 - DNA, 20 bp, mouse
ggaccacgggattgaatgag

SEQ ID NO: 685913 - DNA, 20 bp, mouse
gttgaatgaggggcggtacg

SEQ ID NO: 685914 - DNA, 20 bp, mouse
ggtggtcgctgcaggaccac

SEQ ID NO: 685915 - DNA, 20 bp, mouse
ggaggctcatcccgcgtggg

SEQ ID NO: 685916 - DNA, 20 bp, mouse
gaccctgggagtaaaaggcg

SEQ ID NO: 685917 - DNA, 20 bp, mouse
gtgggcgcttcccagaccct

SEQ ID NO: 685918 - DNA, 20 bp, mouse
gtgatggggcagtgtggcca

SEQ ID NO: 685919 - DNA, 20 bp, mouse
gccaaggaggggaagtgtga

SEQ ID NO: 685920 - DNA, 20 bp, mouse
gaggcggggtggtcaagaga

SEQ ID NO: 685921 - DNA, 20 bp, mouse
gtgacagatgacaggtcggg

SEQ ID NO: 685922 - DNA, 20 bp, mouse
gccacccacagtcaggtctc

SEQ ID NO: 685923 - DNA, 20 bp, mouse
gctgggagtaaaaggcgggg

SEQ ID NO: 685924 - DNA, 20 bp, mouse
gcaagtcgcggtgaagccga

SEQ ID NO: 685925 - DNA, 20 bp, mouse
gatctctggcagcacggggc

SEQ ID NO: 685926 - DNA, 20 bp, mouse
gcggtctcagagtcatctag

SEQ ID NO: 685927 - DNA, 20 bp, mouse
ggacctctgagcccacattc

SEQ ID NO: 685928 - DNA, 20 bp, mouse
gtggcccagcatttgtagac

SEQ ID NO: 685929 - DNA, 20 bp, mouse
gaaccagaatgtgggctcag

SEQ ID NO: 685930 - DNA, 20 bp, mouse
gataactagacagtgtgtca

SEQ ID NO: 685931 - DNA, 20 bp, mouse
gagccgctgcagctgggctg

SEQ ID NO: 685932 - DNA, 20 bp, mouse
gggctaagtgacagctaaga

SEQ ID NO: 685933 - DNA, 20 bp, mouse
gtgacagctaagacggagac

SEQ ID NO: 685934 - DNA, 20 bp, mouse
ggaaacaagaaaatggtaga

SEQ ID NO: 685935 - DNA, 20 bp, mouse
gtagccagtctacaaatgct

SEQ ID NO: 685936 - DNA, 20 bp, mouse
gctctgaatgggcaagtcag

SEQ ID NO: 685937 - DNA, 20 bp, mouse
gccagctgttgccattatta

SEQ ID NO: 685938 - DNA, 20 bp, mouse
gtgaggcagagccttaataa

SEQ ID NO: 685939 - DNA, 20 bp, mouse
gtgcagggaaattgcagcga

SEQ ID NO: 685940 - DNA, 20 bp, mouse
gtcaactacttaaccccttg

SEQ ID NO: 685941 - DNA, 20 bp, mouse
gacatgtcaccttcatatcc

SEQ ID NO: 685942 - DNA, 20 bp, mouse
ggtcaccttcatatcctggc

SEQ ID NO: 685943 - DNA, 20 bp, mouse
gggacttgatctgagcactg

SEQ ID NO: 685944 - DNA, 20 bp, mouse
gcggtagattaaagccatgt

SEQ ID NO: 685945 - DNA, 20 bp, mouse
gactcacttttctgacacat

SEQ ID NO: 685946 - DNA, 20 bp, mouse
ggagacagggacacgagctg

SEQ ID NO: 685947 - DNA, 20 bp, mouse
gggcagagccgcagcatggg

SEQ ID NO: 685948 - DNA, 20 bp, mouse
gaggttgtaggctgcagtac

SEQ ID NO: 685949 - DNA, 20 bp, mouse
gtcgttgtcacgaaggttgt

SEQ ID NO: 685950 - DNA, 20 bp, mouse
ggaaatccgccaatggacag

SEQ ID NO: 685951 - DNA, 20 bp, mouse
gcggtctggccatattacta

SEQ ID NO: 685952 - DNA, 20 bp, mouse
gtcagagccaggtccaaaat

SEQ ID NO: 685953 - DNA, 20 bp, mouse
gccgccaatggacagagggc

SEQ ID NO: 685954 - DNA, 20 bp, mouse
gcaatgatgagagctggtca

SEQ ID NO: 685955 - DNA, 20 bp, mouse
gtgggggttcgttgtcacga

SEQ ID NO: 685956 - DNA, 20 bp, mouse
gaggcagccccgggtctcca

SEQ ID NO: 685957 - DNA, 20 bp, mouse
gcgcactccctggagacccg

SEQ ID NO: 685958 - DNA, 20 bp, mouse
gtatgtgcgtgcacacgctc

SEQ ID NO: 685959 - DNA, 20 bp, mouse
gcgcgctgcgcacaggcaag

SEQ ID NO: 685960 - DNA, 20 bp, mouse
gaagccgtgggcgcgcacgc

SEQ ID NO: 685961 - DNA, 20 bp, mouse
gctcgttgcgagcacccgtg

SEQ ID NO: 685962 - DNA, 20 bp, mouse
gcgcgcacgcaggctccgca

SEQ ID NO: 685963 - DNA, 20 bp, mouse
ggaggggcccggcgctgtgc

SEQ ID NO: 685964 - DNA, 20 bp, mouse
gtagacccgagccaaactag

SEQ ID NO: 685965 - DNA, 20 bp, mouse
gctcgcgcgcgggctgcagc

SEQ ID NO: 685966 - DNA, 20 bp, mouse
gaggacaggacggggtacgg

SEQ ID NO: 685967 - DNA, 20 bp, mouse
gggattgagtagacagtccg

SEQ ID NO: 685968 - DNA, 20 bp, mouse
gaaaaagggacgtagagaag

SEQ ID NO: 685969 - DNA, 20 bp, mouse
gaagcctggccaaggttcca

SEQ ID NO: 685970 - DNA, 20 bp, mouse
gaggaggacaggacggggta

SEQ ID NO: 685971 - DNA, 20 bp, mouse
gctgaagctagactggagga

SEQ ID NO: 685972 - DNA, 20 bp, mouse
gctaggggcggtgcaacggt

SEQ ID NO: 685973 - DNA, 20 bp, mouse
ggccaagggttggcagtgtg

SEQ ID NO: 685974 - DNA, 20 bp, mouse
gccattggctgattcggcca

SEQ ID NO: 685975 - DNA, 20 bp, mouse
gcaagctaggggcggtgcaa

SEQ ID NO: 685976 - DNA, 20 bp, mouse
ggggaccacagtgcaaggga

SEQ ID NO: 685977 - DNA, 20 bp, mouse
gtctagtgacccacactcta

SEQ ID NO: 685978 - DNA, 20 bp, mouse
ggaaagcgagggtactcata

SEQ ID NO: 685979 - DNA, 20 bp, mouse
gacagtgcaagggaggggcg

SEQ ID NO: 685980 - DNA, 20 bp, mouse
gccagctcaccttagagtgt

SEQ ID NO: 685981 - DNA, 20 bp, mouse
ggctgggagcctgagtataa

SEQ ID NO: 685982 - DNA, 20 bp, mouse
gtgtttgtgtgtcggaagca

SEQ ID NO: 685983 - DNA, 20 bp, mouse
gaagacaacaaagccgggat

SEQ ID NO: 685984 - DNA, 20 bp, mouse
gctctaaggtgagctggaca

SEQ ID NO: 685985 - DNA, 20 bp, mouse
gcaaagctttgggaggagct

SEQ ID NO: 685986 - DNA, 20 bp, mouse
gcaagcgggagcgtggggtg

SEQ ID NO: 685987 - DNA, 20 bp, mouse
ggggaggcaagcgggagcgt

SEQ ID NO: 685988 - DNA, 20 bp, mouse
gccagcaggcgctctttctg

SEQ ID NO: 685989 - DNA, 20 bp, mouse
gagagcgcctgctgggggaa

SEQ ID NO: 685990 - DNA, 20 bp, mouse
gctggaggctgaagctgggt

SEQ ID NO: 685991 - DNA, 20 bp, mouse
gtgaatgggagtttggaaac

SEQ ID NO: 685992 - DNA, 20 bp, mouse
gccgagagtgaatgggagtt

SEQ ID NO: 685993 - DNA, 20 bp, mouse
gggcggaggaaaacccactg

SEQ ID NO: 685994 - DNA, 20 bp, mouse
ggggggggggagatgaacaa

SEQ ID NO: 685995 - DNA, 20 bp, mouse
gaggagcgctggaaaagctc

SEQ ID NO: 685996 - DNA, 20 bp, mouse
gtgggggcttagagtgcaga

SEQ ID NO: 685997 - DNA, 20 bp, mouse
gcggaggcgtggtggactgg

SEQ ID NO: 685998 - DNA, 20 bp, mouse
gctaccttgtaatggctgag

SEQ ID NO: 685999 - DNA, 20 bp, mouse
gccaggctggagaggagtag

SEQ ID NO: 686000 - DNA, 20 bp, mouse
ggggctatcgcggaggtagg

SEQ ID NO: 686001 - DNA, 20 bp, mouse
gtgggtactagaacggggtt

SEQ ID NO: 686002 - DNA, 20 bp, mouse
gtcttcctgggtactagaac

SEQ ID NO: 686003 - DNA, 20 bp, mouse
ggagggcacccaggctggag

SEQ ID NO: 686004 - DNA, 20 bp, mouse
gcgcccctcccgccgggcgg

SEQ ID NO: 686005 - DNA, 20 bp, mouse
ggggcggaggcgtggtggac

SEQ ID NO: 686006 - DNA, 20 bp, mouse
gaagagggattcccgcctgg

SEQ ID NO: 686007 - DNA, 20 bp, mouse
gccacagaggctgttcctcc

SEQ ID NO: 686008 - DNA, 20 bp, mouse
gcctcctcccacaggattga

SEQ ID NO: 686009 - DNA, 20 bp, mouse
ggaacagcctctgtggcctc

SEQ ID NO: 686010 - DNA, 20 bp, mouse
gaaagggctcccagcaaaga

SEQ ID NO: 686011 - DNA, 20 bp, mouse
gcgaccctcaatcctgtggg

SEQ ID NO: 686012 - DNA, 20 bp, mouse
gttccgaccctcaatcctgt

SEQ ID NO: 686013 - DNA, 20 bp, mouse
gagaaggatgttggtatcaa

SEQ ID NO: 686014 - DNA, 20 bp, mouse
gtagcctgtgtggggtaaaa

SEQ ID NO: 686015 - DNA, 20 bp, mouse
gtgatatgcggtaattaaga

SEQ ID NO: 686016 - DNA, 20 bp, mouse
gctaggcgaccgtgtgtgga

SEQ ID NO: 686017 - DNA, 20 bp, mouse
gacccgatggtggagtagtg

SEQ ID NO: 686018 - DNA, 20 bp, mouse
ggggcgtggtgagacaatta

SEQ ID NO: 686019 - DNA, 20 bp, mouse
gacgaggagtatggcttaag

SEQ ID NO: 686020 - DNA, 20 bp, mouse
gtggccatccacgaggagta

SEQ ID NO: 686021 - DNA, 20 bp, mouse
gtactccaccatcgggtctc

SEQ ID NO: 686022 - DNA, 20 bp, mouse
gtatgccagagacccgatgg

SEQ ID NO: 686023 - DNA, 20 bp, mouse
ggatcctaggcgaccgtgtg

SEQ ID NO: 686024 - DNA, 20 bp, mouse
gtaggtaggtcagtgggcgg

SEQ ID NO: 686025 - DNA, 20 bp, mouse
gggcgtggtcaggaaaaaga

SEQ ID NO: 686026 - DNA, 20 bp, mouse
ggcgtcggagacacccgaga

SEQ ID NO: 686027 - DNA, 20 bp, mouse
ggcagcctcccgtccctctc

SEQ ID NO: 686028 - DNA, 20 bp, mouse
gcctaggagaggtgtcgcag

SEQ ID NO: 686029 - DNA, 20 bp, mouse
gaggatgggaagtacggacc

SEQ ID NO: 686030 - DNA, 20 bp, mouse
ggacacccgagagggacggg

SEQ ID NO: 686031 - DNA, 20 bp, mouse
gtccgtgcccctctgcgggg

SEQ ID NO: 686032 - DNA, 20 bp, mouse
gcgtcaccgcagatcctaag

SEQ ID NO: 686033 - DNA, 20 bp, mouse
ggcgctgcgaggcagtgcgg

SEQ ID NO: 686034 - DNA, 20 bp, mouse
gggacgggaggctgccgctt

SEQ ID NO: 686035 - DNA, 20 bp, mouse
gcggaccggctgcagcctga

SEQ ID NO: 686036 - DNA, 20 bp, mouse
ggaccctgggaaaacattcc

SEQ ID NO: 686037 - DNA, 20 bp, mouse
gtaggaaggcgcggccccta

SEQ ID NO: 686038 - DNA, 20 bp, mouse
ggcggggcctggtgtgcggt

SEQ ID NO: 686039 - DNA, 20 bp, mouse
gtaccccagaggccagtagt

SEQ ID NO: 686040 - DNA, 20 bp, mouse
gttgggcggggcctggtgtg

SEQ ID NO: 686041 - DNA, 20 bp, mouse
ggaaagggggaaggaggcgt

SEQ ID NO: 686042 - DNA, 20 bp, mouse
gttcctggaatgttttccca

SEQ ID NO: 686043 - DNA, 20 bp, mouse
gcctgggcgagctttgggcg

SEQ ID NO: 686044 - DNA, 20 bp, mouse
gggaaattgagcacgaggcc

SEQ ID NO: 686045 - DNA, 20 bp, mouse
gacgtgaatcccgcccccgg

SEQ ID NO: 686046 - DNA, 20 bp, mouse
gtcgtcgtgcgctgtcgtga

SEQ ID NO: 686047 - DNA, 20 bp, mouse
gcgattggcccgaaaggcag

SEQ ID NO: 686048 - DNA, 20 bp, mouse
gtttgtggcagctggggaat

SEQ ID NO: 686049 - DNA, 20 bp, mouse
ggcagcgcgattggcccgaa

SEQ ID NO: 686050 - DNA, 20 bp, mouse
gcgccgaggagcagcgcgat

SEQ ID NO: 686051 - DNA, 20 bp, mouse
gtgaagggcgctgcgctttg

SEQ ID NO: 686052 - DNA, 20 bp, mouse
ggcgcagggtggggagacct

SEQ ID NO: 686053 - DNA, 20 bp, mouse
ggaactgttgctcaaatgac

SEQ ID NO: 686054 - DNA, 20 bp, mouse
gctgcgctttgtggcagctg

SEQ ID NO: 686055 - DNA, 20 bp, mouse
gggttgtgctagatattcgt

SEQ ID NO: 686056 - DNA, 20 bp, mouse
gcctcccgagggctggacat

SEQ ID NO: 686057 - DNA, 20 bp, mouse
gctcctccttagcctcccga

SEQ ID NO: 686058 - DNA, 20 bp, mouse
gtctgaaaagggtgatgctg

SEQ ID NO: 686059 - DNA, 20 bp, mouse
gtcgcctatgtccagccctc

SEQ ID NO: 686060 - DNA, 20 bp, mouse
gtagacggaagaggcggagc

SEQ ID NO: 686061 - DNA, 20 bp, mouse
ggcggagccggaagaagaag

SEQ ID NO: 686062 - DNA, 20 bp, mouse
gaataagcccgtctctgaaa

SEQ ID NO: 686063 - DNA, 20 bp, mouse
ggattacctagctggacgtt

SEQ ID NO: 686064 - DNA, 20 bp, mouse
gctggtcccctggttcttaa

SEQ ID NO: 686065 - DNA, 20 bp, mouse
gaggaaaagctagacggaag

SEQ ID NO: 686066 - DNA, 20 bp, mouse
gctgcctggcagtgaatgca

SEQ ID NO: 686067 - DNA, 20 bp, mouse
gtgaatgcaggggcaagtgc

SEQ ID NO: 686068 - DNA, 20 bp, mouse
gtgcccctgcattcactgcc

SEQ ID NO: 686069 - DNA, 20 bp, mouse
ggggcgggccacacacgctg

SEQ ID NO: 686070 - DNA, 20 bp, mouse
gccaccaaagccctgagagg

SEQ ID NO: 686071 - DNA, 20 bp, mouse
ggaagggggcggggtatctg

SEQ ID NO: 686072 - DNA, 20 bp, mouse
gtaaggcagtgaaggcccat

SEQ ID NO: 686073 - DNA, 20 bp, mouse
gcgctcaccgagcaggctcc

SEQ ID NO: 686074 - DNA, 20 bp, mouse
gtccccaccaaagccctgag

SEQ ID NO: 686075 - DNA, 20 bp, mouse
gcttccgcctctcagggctt

SEQ ID NO: 686076 - DNA, 20 bp, mouse
gtgctaccggggttggagaa

SEQ ID NO: 686077 - DNA, 20 bp, mouse
ggctccgggcgctgctaccg

SEQ ID NO: 686078 - DNA, 20 bp, mouse
gtcggggaaagcagtcacgt

SEQ ID NO: 686079 - DNA, 20 bp, mouse
ggggctggagtactggaagg

SEQ ID NO: 686080 - DNA, 20 bp, mouse
gccgcctcctcacttctcat

SEQ ID NO: 686081 - DNA, 20 bp, mouse
gtccgcaaggcgcttccctg

SEQ ID NO: 686082 - DNA, 20 bp, mouse
gagggggctggagtactgga

SEQ ID NO: 686083 - DNA, 20 bp, mouse
gcttccctgtggatgcttaa

SEQ ID NO: 686084 - DNA, 20 bp, mouse
gtgccctagcccacctccgg

SEQ ID NO: 686085 - DNA, 20 bp, mouse
gggccaccggaggtgggcta

SEQ ID NO: 686086 - DNA, 20 bp, mouse
gccctggtaaagtatctaat

SEQ ID NO: 686087 - DNA, 20 bp, mouse
gtctgccagatgcaatcccc

SEQ ID NO: 686088 - DNA, 20 bp, mouse
gtggcagactgtggttgaag

SEQ ID NO: 686089 - DNA, 20 bp, mouse
ggattgcatctggcagactg

SEQ ID NO: 686090 - DNA, 20 bp, mouse
gttaggctacaaagggaaaa

SEQ ID NO: 686091 - DNA, 20 bp, mouse
gtgagctcactcaggaagga

SEQ ID NO: 686092 - DNA, 20 bp, mouse
gtttaccaggggattgcatc

SEQ ID NO: 686093 - DNA, 20 bp, mouse
gcaactgaggttctaacttt

SEQ ID NO: 686094 - DNA, 20 bp, mouse
gggggggaatgagctcactc

SEQ ID NO: 686095 - DNA, 20 bp, mouse
gacaaaacgacatgtcttga

SEQ ID NO: 686096 - DNA, 20 bp, mouse
ggaggaggtgaactgtacga

SEQ ID NO: 686097 - DNA, 20 bp, mouse
gcgccctccgcctgggtcag

SEQ ID NO: 686098 - DNA, 20 bp, mouse
gcgcccgtcgccctccgcct

SEQ ID NO: 686099 - DNA, 20 bp, mouse
gggtcagagggcggggcgta

SEQ ID NO: 686100 - DNA, 20 bp, mouse
ggagacgccagaggcgagag

SEQ ID NO: 686101 - DNA, 20 bp, mouse
gagagggcggggcgtacggc

SEQ ID NO: 686102 - DNA, 20 bp, mouse
ggcaccaatggttgtccagc

SEQ ID NO: 686103 - DNA, 20 bp, mouse
ggccgcgctcggcgcaccaa

SEQ ID NO: 686104 - DNA, 20 bp, mouse
gcagccagctggacaaccat

SEQ ID NO: 686105 - DNA, 20 bp, mouse
gctccgcctgggtcagaggg

SEQ ID NO: 686106 - DNA, 20 bp, mouse
gctaaacagcggcttcttaa

SEQ ID NO: 686107 - DNA, 20 bp, mouse
gagagcgcagagtcaggcag

SEQ ID NO: 686108 - DNA, 20 bp, mouse
ggggagatgtgtctgagtcc

SEQ ID NO: 686109 - DNA, 20 bp, mouse
gcagagtcaggcagcggcag

SEQ ID NO: 686110 - DNA, 20 bp, mouse
gatctcagccacctagacta

SEQ ID NO: 686111 - DNA, 20 bp, mouse
gctggcaaccctagtctagg

SEQ ID NO: 686112 - DNA, 20 bp, mouse
gcaactccctcttgccagtg

SEQ ID NO: 686113 - DNA, 20 bp, mouse
gccagtaactccacagaata

SEQ ID NO: 686114 - DNA, 20 bp, mouse
gcagcaggaatgctaaacag

SEQ ID NO: 686115 - DNA, 20 bp, mouse
gacacatctcccctattctg

SEQ ID NO: 686116 - DNA, 20 bp, mouse
gcacaagcagagaggcccta

SEQ ID NO: 686117 - DNA, 20 bp, mouse
gggaacccggataatgggaa

SEQ ID NO: 686118 - DNA, 20 bp, mouse
gctcctgcactcaaccaagg

SEQ ID NO: 686119 - DNA, 20 bp, mouse
gaggccatagcgtggggtaa

SEQ ID NO: 686120 - DNA, 20 bp, mouse
ggcgtggggtaaggggttga

SEQ ID NO: 686121 - DNA, 20 bp, mouse
gagaggccctacggcaaaca

SEQ ID NO: 686122 - DNA, 20 bp, mouse
gtggcaggaacccggataat

SEQ ID NO: 686123 - DNA, 20 bp, mouse
ggctaggagccagaatgggg

SEQ ID NO: 686124 - DNA, 20 bp, mouse
gagggagctaggagccagaa

SEQ ID NO: 686125 - DNA, 20 bp, mouse
ggctggcagtagagaatctt

SEQ ID NO: 686126 - DNA, 20 bp, mouse
gtctgtagaggggtcgaaac

SEQ ID NO: 686127 - DNA, 20 bp, mouse
gctgggaagtagaagacggt

SEQ ID NO: 686128 - DNA, 20 bp, mouse
gtactcctagggtacagggg

SEQ ID NO: 686129 - DNA, 20 bp, mouse
ggtacgggagagcgtcatga

SEQ ID NO: 686130 - DNA, 20 bp, mouse
gtggcgaattaggtgaaata

SEQ ID NO: 686131 - DNA, 20 bp, mouse
gcgaaacaggagtataccct

SEQ ID NO: 686132 - DNA, 20 bp, mouse
gacgctctcccgtactgcgc

SEQ ID NO: 686133 - DNA, 20 bp, mouse
ggctgcctcccctgtaccct

SEQ ID NO: 686134 - DNA, 20 bp, mouse
ggtaaaaaggcttagggtgg

SEQ ID NO: 686135 - DNA, 20 bp, mouse
gagcgtcatgatgggagaga

SEQ ID NO: 686136 - DNA, 20 bp, mouse
gcggcggtgtgggagctcgg

SEQ ID NO: 686137 - DNA, 20 bp, mouse
gtgggcgaaggggaagggtc

SEQ ID NO: 686138 - DNA, 20 bp, mouse
gctaggggcagtatgtgaac

SEQ ID NO: 686139 - DNA, 20 bp, mouse
gcggcgatcgcagtgtgcgg

SEQ ID NO: 686140 - DNA, 20 bp, mouse
ggagccgggccggagccgtc

SEQ ID NO: 686141 - DNA, 20 bp, mouse
gcccgccttcggcctggagg

SEQ ID NO: 686142 - DNA, 20 bp, mouse
gaacactgggcgaaggggaa

SEQ ID NO: 686143 - DNA, 20 bp, mouse
gctcctccccggcccgcctt

SEQ ID NO: 686144 - DNA, 20 bp, mouse
ggcacactgcgatcgccgcg

SEQ ID NO: 686145 - DNA, 20 bp, mouse
gggaagggtccggaccccac

SEQ ID NO: 686146 - DNA, 20 bp, mouse
gcaggcgctcccacccgctc

SEQ ID NO: 686147 - DNA, 20 bp, mouse
gcccgccggctcccgtggtt

SEQ ID NO: 686148 - DNA, 20 bp, mouse
gggtggcggcccctggctcc

SEQ ID NO: 686149 - DNA, 20 bp, mouse
ggcccgggacgcccgtgcct

SEQ ID NO: 686150 - DNA, 20 bp, mouse
gctggcgtccgctcccggga

SEQ ID NO: 686151 - DNA, 20 bp, mouse
gcgggcgcgagcgcaccctc

SEQ ID NO: 686152 - DNA, 20 bp, mouse
gtgggtgcatgttaatacgg

SEQ ID NO: 686153 - DNA, 20 bp, mouse
gtggccgctggccttggtcc

SEQ ID NO: 686154 - DNA, 20 bp, mouse
gtccgcccaaccacgggagc

SEQ ID NO: 686155 - DNA, 20 bp, mouse
gggcgctggcggctcccgga

SEQ ID NO: 686156 - DNA, 20 bp, mouse
gggtaagcaaccttccccag

SEQ ID NO: 686157 - DNA, 20 bp, mouse
ggataggaaagcctaagatg

SEQ ID NO: 686158 - DNA, 20 bp, mouse
gtggccgggcctcagatgat

SEQ ID NO: 686159 - DNA, 20 bp, mouse
ggagactgagaacagcaata

SEQ ID NO: 686160 - DNA, 20 bp, mouse
gtccccagggggagaaaaca

SEQ ID NO: 686161 - DNA, 20 bp, mouse
gtgaggaatggatagaaatg

SEQ ID NO: 686162 - DNA, 20 bp, mouse
gtgaagtgggcctggactgt

SEQ ID NO: 686163 - DNA, 20 bp, mouse
gtagggacttgccacactaa

SEQ ID NO: 686164 - DNA, 20 bp, mouse
ggtgaaatcacgtggtacta

SEQ ID NO: 686165 - DNA, 20 bp, mouse
gtaaccccggacaacactga

SEQ ID NO: 686166 - DNA, 20 bp, mouse
ggacagtgatggttcccgga

SEQ ID NO: 686167 - DNA, 20 bp, mouse
gtcggcgcccggggaggcac

SEQ ID NO: 686168 - DNA, 20 bp, mouse
gacacggagcacacgcggtg

SEQ ID NO: 686169 - DNA, 20 bp, mouse
gcccgggagcccgcgcacag

SEQ ID NO: 686170 - DNA, 20 bp, mouse
ggacctctccgctccccctc

SEQ ID NO: 686171 - DNA, 20 bp, mouse
gcgtgcgccgggctcgaacg

SEQ ID NO: 686172 - DNA, 20 bp, mouse
ggaggcaccggcgcactggg

SEQ ID NO: 686173 - DNA, 20 bp, mouse
ggtgggatctgcagacgcat

SEQ ID NO: 686174 - DNA, 20 bp, mouse
gctgttgcgcgcagagcgtt

SEQ ID NO: 686175 - DNA, 20 bp, mouse
gcgtggctccatctgaggaa

SEQ ID NO: 686176 - DNA, 20 bp, mouse
gcaggagcccgcgacaggga

SEQ ID NO: 686177 - DNA, 20 bp, mouse
gcctcgcggggccgctgcgg

SEQ ID NO: 686178 - DNA, 20 bp, mouse
gcgagccaggagcccgcgac

SEQ ID NO: 686179 - DNA, 20 bp, mouse
gcgctcctccgggaccgcgg

SEQ ID NO: 686180 - DNA, 20 bp, mouse
gccggggaggcccagctcgg

SEQ ID NO: 686181 - DNA, 20 bp, mouse
gtgcccgccggctgcgacct

SEQ ID NO: 686182 - DNA, 20 bp, mouse
gtggctcggccgccctgcgc

SEQ ID NO: 686183 - DNA, 20 bp, mouse
gtgcccaggtctgctgtgcg

SEQ ID NO: 686184 - DNA, 20 bp, mouse
gctgcgacctcggtcctcgc

SEQ ID NO: 686185 - DNA, 20 bp, mouse
gcagctcgggggtgcgaatg

SEQ ID NO: 686186 - DNA, 20 bp, mouse
gagccatgggcaaagaggta

SEQ ID NO: 686187 - DNA, 20 bp, mouse
gggaagaagagagtctgaga

SEQ ID NO: 686188 - DNA, 20 bp, mouse
ggggagctgagttacaaatg

SEQ ID NO: 686189 - DNA, 20 bp, mouse
gcacatataccgcagcccac

SEQ ID NO: 686190 - DNA, 20 bp, mouse
gtgtgtttgcctgtgggctg

SEQ ID NO: 686191 - DNA, 20 bp, mouse
gcgcacaggtttgatttctt

SEQ ID NO: 686192 - DNA, 20 bp, mouse
gtgggtgccttatgtgcaga

SEQ ID NO: 686193 - DNA, 20 bp, mouse
gcctctcccatctgcacata

SEQ ID NO: 686194 - DNA, 20 bp, mouse
ggaagaagggctaatgggaa

SEQ ID NO: 686195 - DNA, 20 bp, mouse
gtaaggcacccaagaaatct

SEQ ID NO: 686196 - DNA, 20 bp, mouse
gtggccggccggtcttgaaa

SEQ ID NO: 686197 - DNA, 20 bp, mouse
gcgcgtcgcccgggattccg

SEQ ID NO: 686198 - DNA, 20 bp, mouse
gcctctcgggcgtacaaaac

SEQ ID NO: 686199 - DNA, 20 bp, mouse
ggcggggcggttcgagaggg

SEQ ID NO: 686200 - DNA, 20 bp, mouse
gagcgcgcacgcgtaccgcg

SEQ ID NO: 686201 - DNA, 20 bp, mouse
ggggacagaaagcccacggt

SEQ ID NO: 686202 - DNA, 20 bp, mouse
gctcgcgcatgcccgagtga

SEQ ID NO: 686203 - DNA, 20 bp, mouse
ggtgagcccgcagggacgga

SEQ ID NO: 686204 - DNA, 20 bp, mouse
ggcgacgcctcgctgtaggt

SEQ ID NO: 686205 - DNA, 20 bp, mouse
gcgggattccggggccgcca

SEQ ID NO: 686206 - DNA, 20 bp, mouse
gcaaagggttgggagcggga

SEQ ID NO: 686207 - DNA, 20 bp, mouse
gaacgaggcttgcgataggt

SEQ ID NO: 686208 - DNA, 20 bp, mouse
gacacactataaactcagtg

SEQ ID NO: 686209 - DNA, 20 bp, mouse
gcctgaagagccaacaagtg

SEQ ID NO: 686210 - DNA, 20 bp, mouse
ggggaggcggtaaacccgct

SEQ ID NO: 686211 - DNA, 20 bp, mouse
gaagcctcgttcgaggggaa

SEQ ID NO: 686212 - DNA, 20 bp, mouse
gtatcgcaagcctcgttcga

SEQ ID NO: 686213 - DNA, 20 bp, mouse
gcgccccttcccctcgaacg

SEQ ID NO: 686214 - DNA, 20 bp, mouse
gcaaaagtccctccaatcag

SEQ ID NO: 686215 - DNA, 20 bp, mouse
gtgtcgctgccacgcctagc

SEQ ID NO: 686216 - DNA, 20 bp, mouse
ggggccgccccccagcgccg

SEQ ID NO: 686217 - DNA, 20 bp, mouse
gagcacgcggccgcactctt

SEQ ID NO: 686218 - DNA, 20 bp, mouse
gcggaagcggctcgagcacg

SEQ ID NO: 686219 - DNA, 20 bp, mouse
gcccgtctagccaaagagtg

SEQ ID NO: 686220 - DNA, 20 bp, mouse
ggggcacgcggtccgcacac

SEQ ID NO: 686221 - DNA, 20 bp, mouse
gctggggggcggccccgcca

SEQ ID NO: 686222 - DNA, 20 bp, mouse
gccgccagggggtgggtcac

SEQ ID NO: 686223 - DNA, 20 bp, mouse
gccccgtgcgcgcgaggcgt

SEQ ID NO: 686224 - DNA, 20 bp, mouse
ggggcggccccgccaggggg

SEQ ID NO: 686225 - DNA, 20 bp, mouse
gccgcgtgctgtcctgtgtg

SEQ ID NO: 686226 - DNA, 20 bp, mouse
gaggcaggctacccaaaggt

SEQ ID NO: 686227 - DNA, 20 bp, mouse
gtggagctgtgaacggatgt

SEQ ID NO: 686228 - DNA, 20 bp, mouse
gggaacgggctgtgaaaact

SEQ ID NO: 686229 - DNA, 20 bp, mouse
gctgcaagccggggaggcgt

SEQ ID NO: 686230 - DNA, 20 bp, mouse
gttcagtggcaggaacttgt

SEQ ID NO: 686231 - DNA, 20 bp, mouse
gtcaccagcccacgcctccc

SEQ ID NO: 686232 - DNA, 20 bp, mouse
ggatgggaggaaagaacagc

SEQ ID NO: 686233 - DNA, 20 bp, mouse
gagacaggggcgtgcagagt

SEQ ID NO: 686234 - DNA, 20 bp, mouse
gcccaaaggtgggcttggaa

SEQ ID NO: 686235 - DNA, 20 bp, mouse
gaaggctctgcaagccgggg

SEQ ID NO: 686236 - DNA, 20 bp, mouse
gtggcgatccattgagagga

SEQ ID NO: 686237 - DNA, 20 bp, mouse
ggagggaggcgaaggggcga

SEQ ID NO: 686238 - DNA, 20 bp, mouse
gtcacgggagagcaccggtg

SEQ ID NO: 686239 - DNA, 20 bp, mouse
ggacctgccctggtcagaca

SEQ ID NO: 686240 - DNA, 20 bp, mouse
gggaggcagagaggactagg

SEQ ID NO: 686241 - DNA, 20 bp, mouse
gggtaaccgcgggtgcacgc

SEQ ID NO: 686242 - DNA, 20 bp, mouse
ggagcagagcggttcgtctc

SEQ ID NO: 686243 - DNA, 20 bp, mouse
gagcggccggcaggatttaa

SEQ ID NO: 686244 - DNA, 20 bp, mouse
ggggaggctccgtgccgcac

SEQ ID NO: 686245 - DNA, 20 bp, mouse
gccggaggccgaagcgtggg

SEQ ID NO: 686246 - DNA, 20 bp, mouse
gatactgtgcgtactgaagt

SEQ ID NO: 686247 - DNA, 20 bp, mouse
gggcgcatgcaatcacactc

SEQ ID NO: 686248 - DNA, 20 bp, mouse
gccggccgagaggggtccca

SEQ ID NO: 686249 - DNA, 20 bp, mouse
gacccctgccgctttcagat

SEQ ID NO: 686250 - DNA, 20 bp, mouse
gggatacagtaactctatgt

SEQ ID NO: 686251 - DNA, 20 bp, mouse
gctatgtgggcgacttggtg

SEQ ID NO: 686252 - DNA, 20 bp, mouse
gcggccggtagctaaaagac

SEQ ID NO: 686253 - DNA, 20 bp, mouse
ggcatgcgccaatctgaaag

SEQ ID NO: 686254 - DNA, 20 bp, mouse
gtaactctatgtgggcgact

SEQ ID NO: 686255 - DNA, 20 bp, mouse
ggggaggcccctccaagacc

SEQ ID NO: 686256 - DNA, 20 bp, mouse
ggcggcacgtgcgtggaggg

SEQ ID NO: 686257 - DNA, 20 bp, mouse
gcctgtgcgctgggcttcgg

SEQ ID NO: 686258 - DNA, 20 bp, mouse
gcctgcgcgcccggctacat

SEQ ID NO: 686259 - DNA, 20 bp, mouse
gccgcgctgcgagcacgacc

SEQ ID NO: 686260 - DNA, 20 bp, mouse
ggccgcgcctgtgccaacgg

SEQ ID NO: 686261 - DNA, 20 bp, mouse
gccggccgcgcctgtgccaa

SEQ ID NO: 686262 - DNA, 20 bp, mouse
gcaacgcgtggcccaggtcc

SEQ ID NO: 686263 - DNA, 20 bp, mouse
ggctcctgtgcgctgggctt

SEQ ID NO: 686264 - DNA, 20 bp, mouse
ggccaacggcggcacgtgcg

SEQ ID NO: 686265 - DNA, 20 bp, mouse
gacggcggcacgtgcgtgga

SEQ ID NO: 686266 - DNA, 20 bp, mouse
gggacctgcgccctactggc

SEQ ID NO: 686267 - DNA, 20 bp, mouse
gagcccagaagttggaagag

SEQ ID NO: 686268 - DNA, 20 bp, mouse
gccagaagttggaagagggg

SEQ ID NO: 686269 - DNA, 20 bp, mouse
ggccccctccggtgggtgct

SEQ ID NO: 686270 - DNA, 20 bp, mouse
gtcccagcacccaccggagg

SEQ ID NO: 686271 - DNA, 20 bp, mouse
ggggctaccctcctatcctc

SEQ ID NO: 686272 - DNA, 20 bp, mouse
gcagtcccagcacccaccgg

SEQ ID NO: 686273 - DNA, 20 bp, mouse
gcagccagccagtagggcgc

SEQ ID NO: 686274 - DNA, 20 bp, mouse
gggcggaggccccctccggt

SEQ ID NO: 686275 - DNA, 20 bp, mouse
gccctgtcagccagccagta

SEQ ID NO: 686276 - DNA, 20 bp, mouse
gccccgcgctgggaccgcta

SEQ ID NO: 686277 - DNA, 20 bp, mouse
gctgtggcgctgtcaagaga

SEQ ID NO: 686278 - DNA, 20 bp, mouse
ggtgccgggcggtgtgagcc

SEQ ID NO: 686279 - DNA, 20 bp, mouse
gcggcacccagcacggttag

SEQ ID NO: 686280 - DNA, 20 bp, mouse
gaccgctaaggatgcgagcc

SEQ ID NO: 686281 - DNA, 20 bp, mouse
gggcaccagccaagcggcga

SEQ ID NO: 686282 - DNA, 20 bp, mouse
ggtcaagagaaggccaactt

SEQ ID NO: 686283 - DNA, 20 bp, mouse
gagggaaggcttgaacccgg

SEQ ID NO: 686284 - DNA, 20 bp, mouse
gtgctgccgggccctgtatc

SEQ ID NO: 686285 - DNA, 20 bp, mouse
gccaagcggcgaggggtgtt

SEQ ID NO: 686286 - DNA, 20 bp, mouse
ggcccggcctggggagaatc

SEQ ID NO: 686287 - DNA, 20 bp, mouse
ggggctcggctggactagag

SEQ ID NO: 686288 - DNA, 20 bp, mouse
ggagccccggccgggacgtg

SEQ ID NO: 686289 - DNA, 20 bp, mouse
ggcggagcgggacgcacaat

SEQ ID NO: 686290 - DNA, 20 bp, mouse
gccggccgggacgtgtggac

SEQ ID NO: 686291 - DNA, 20 bp, mouse
gagggcccgcagtcgcctgg

SEQ ID NO: 686292 - DNA, 20 bp, mouse
gtggccagaccccaggaggt

SEQ ID NO: 686293 - DNA, 20 bp, mouse
gcgggacgcacaatgggctg

SEQ ID NO: 686294 - DNA, 20 bp, mouse
gagcccggggctcgtggctc

SEQ ID NO: 686295 - DNA, 20 bp, mouse
gctctcttgcataatcaccg

SEQ ID NO: 686296 - DNA, 20 bp, mouse
gccgggacccgcgtgtcacg

SEQ ID NO: 686297 - DNA, 20 bp, mouse
gggcgccgggagtccgcgac

SEQ ID NO: 686298 - DNA, 20 bp, mouse
gtgcccgccacgtgacacgc

SEQ ID NO: 686299 - DNA, 20 bp, mouse
gtggcccgcaacaggacata

SEQ ID NO: 686300 - DNA, 20 bp, mouse
gggacccgcgtgtcacgtgg

SEQ ID NO: 686301 - DNA, 20 bp, mouse
gtcccggggccgcccggtcg

SEQ ID NO: 686302 - DNA, 20 bp, mouse
ggtggcgggcaaggcggccg

SEQ ID NO: 686303 - DNA, 20 bp, mouse
gtctggagctggatagggtg

SEQ ID NO: 686304 - DNA, 20 bp, mouse
gagctggatagggtgcggga

SEQ ID NO: 686305 - DNA, 20 bp, mouse
gccgcccggtcgcggactcc

SEQ ID NO: 686306 - DNA, 20 bp, mouse
gttaggggtaacaacaaaga

SEQ ID NO: 686307 - DNA, 20 bp, mouse
gaggaacacagtggcgctgg

SEQ ID NO: 686308 - DNA, 20 bp, mouse
gcacgctcgcgctttctcac

SEQ ID NO: 686309 - DNA, 20 bp, mouse
ggcccccaggatctactaat

SEQ ID NO: 686310 - DNA, 20 bp, mouse
gaacaacaaagagggttgag

SEQ ID NO: 686311 - DNA, 20 bp, mouse
gagcgcgcaggagcctccct

SEQ ID NO: 686312 - DNA, 20 bp, mouse
gaacccctccgcacatttgg

SEQ ID NO: 686313 - DNA, 20 bp, mouse
gggtgggcttaggtgagatg

SEQ ID NO: 686314 - DNA, 20 bp, mouse
gcatttgggggatttatcgg

SEQ ID NO: 686315 - DNA, 20 bp, mouse
gaggaggaacacagtggcgc

SEQ ID NO: 686316 - DNA, 20 bp, mouse
gaaaaggcggggctcggtac

SEQ ID NO: 686317 - DNA, 20 bp, mouse
gttccctccagcagcctcaa

SEQ ID NO: 686318 - DNA, 20 bp, mouse
gaggaactggggcaaaatct

SEQ ID NO: 686319 - DNA, 20 bp, mouse
gggcccttgaggctgctgga

SEQ ID NO: 686320 - DNA, 20 bp, mouse
gggaagcggaagcttgcatt

SEQ ID NO: 686321 - DNA, 20 bp, mouse
gcgtgcaccgggaaacggga

SEQ ID NO: 686322 - DNA, 20 bp, mouse
gctgcaaaatgtagcctccc

SEQ ID NO: 686323 - DNA, 20 bp, mouse
gcagagtgccagaaaaggcg

SEQ ID NO: 686324 - DNA, 20 bp, mouse
gtgcacgctaacacgagggg

SEQ ID NO: 686325 - DNA, 20 bp, mouse
gtgccagaaaaggcggggct

SEQ ID NO: 686326 - DNA, 20 bp, mouse
gtctcccgcaggctgactgc

SEQ ID NO: 686327 - DNA, 20 bp, mouse
gtacgcacagcggggtggat

SEQ ID NO: 686328 - DNA, 20 bp, mouse
gaggaggctgggagtcgtgg

SEQ ID NO: 686329 - DNA, 20 bp, mouse
gagagagagagaggcgtaca

SEQ ID NO: 686330 - DNA, 20 bp, mouse
gtcagccagcagtcagcctg

SEQ ID NO: 686331 - DNA, 20 bp, mouse
ggatcgggttccattggcca

SEQ ID NO: 686332 - DNA, 20 bp, mouse
gtggaggctctgtctcccgc

SEQ ID NO: 686333 - DNA, 20 bp, mouse
gaaaactagttggacgagtt

SEQ ID NO: 686334 - DNA, 20 bp, mouse
gaatatgagttgttccctgt

SEQ ID NO: 686335 - DNA, 20 bp, mouse
ggtgcgtaagcgcgcaatta

SEQ ID NO: 686336 - DNA, 20 bp, mouse
ggggccgcccggagctaaag

SEQ ID NO: 686337 - DNA, 20 bp, mouse
gggtgcgcctgtgacgtcag

SEQ ID NO: 686338 - DNA, 20 bp, mouse
gggccccaggttgcacctct

SEQ ID NO: 686339 - DNA, 20 bp, mouse
gagctaaaggggagcagcgg

SEQ ID NO: 686340 - DNA, 20 bp, mouse
gaaaggggagcagcggtgga

SEQ ID NO: 686341 - DNA, 20 bp, mouse
ggtggagggaggcgcccggt

SEQ ID NO: 686342 - DNA, 20 bp, mouse
ggctccaagcccttgtttcc

SEQ ID NO: 686343 - DNA, 20 bp, mouse
gtcagcccagaggtgcaacc

SEQ ID NO: 686344 - DNA, 20 bp, mouse
ggatgcgtctgcagcctacc

SEQ ID NO: 686345 - DNA, 20 bp, mouse
ggggcgactgaccaatagga

SEQ ID NO: 686346 - DNA, 20 bp, mouse
gtcgcctcgcgcggattcct

SEQ ID NO: 686347 - DNA, 20 bp, mouse
gaatccgcgcgaggcgatgc

SEQ ID NO: 686348 - DNA, 20 bp, mouse
gtgcccggtagcttgcacac

SEQ ID NO: 686349 - DNA, 20 bp, mouse
ggaggacagtgtgaccgtaa

SEQ ID NO: 686350 - DNA, 20 bp, mouse
gccgaccggaagtgtttcta

SEQ ID NO: 686351 - DNA, 20 bp, mouse
gcaactcccgctccaagtgg

SEQ ID NO: 686352 - DNA, 20 bp, mouse
gacccagtgtgcaagctacc

SEQ ID NO: 686353 - DNA, 20 bp, mouse
gcccgcgcaggtgtccctta

SEQ ID NO: 686354 - DNA, 20 bp, mouse
ggactcaggtgtggctcccc

SEQ ID NO: 686355 - DNA, 20 bp, mouse
gacgaggcagcacccaaacc

SEQ ID NO: 686356 - DNA, 20 bp, mouse
gaatccgtgggaacaaggtt

SEQ ID NO: 686357 - DNA, 20 bp, mouse
gggctgttgcccaatgtaga

SEQ ID NO: 686358 - DNA, 20 bp, mouse
gtgactaatccgtgggaaca

SEQ ID NO: 686359 - DNA, 20 bp, mouse
ggaagtcaggccttctacat

SEQ ID NO: 686360 - DNA, 20 bp, mouse
ggaaagaggtgtgccctctt

SEQ ID NO: 686361 - DNA, 20 bp, mouse
gaatcaatatgacggaagtg

SEQ ID NO: 686362 - DNA, 20 bp, mouse
ggctgggcaaataagagaca

SEQ ID NO: 686363 - DNA, 20 bp, mouse
gccctcaagagctaactagg

SEQ ID NO: 686364 - DNA, 20 bp, mouse
gaaggggaaggcatatgttc

SEQ ID NO: 686365 - DNA, 20 bp, mouse
gaagcaggatgtgggctgct

SEQ ID NO: 686366 - DNA, 20 bp, mouse
gtcctctaaaggtttgaccc

SEQ ID NO: 686367 - DNA, 20 bp, mouse
gcagagcaccccaaggtcaa

SEQ ID NO: 686368 - DNA, 20 bp, mouse
ggggtccctagttcctctaa

SEQ ID NO: 686369 - DNA, 20 bp, mouse
gatgacggaacgatattctc

SEQ ID NO: 686370 - DNA, 20 bp, mouse
gggcgagagtggcgtgtgat

SEQ ID NO: 686371 - DNA, 20 bp, mouse
ggaaatgatggacgctgccg

SEQ ID NO: 686372 - DNA, 20 bp, mouse
ggctgcgtagatgttccaga

SEQ ID NO: 686373 - DNA, 20 bp, mouse
ggctggctctggatcttggg

SEQ ID NO: 686374 - DNA, 20 bp, mouse
ggccttgcgcccgggaaacg

SEQ ID NO: 686375 - DNA, 20 bp, mouse
gggaacatctacgcagctca

SEQ ID NO: 686376 - DNA, 20 bp, mouse
gtgggcggggctcaggttgt

SEQ ID NO: 686377 - DNA, 20 bp, mouse
gtagcacaaaggagagcgga

SEQ ID NO: 686378 - DNA, 20 bp, mouse
gctcccagcagccctcacta

SEQ ID NO: 686379 - DNA, 20 bp, mouse
ggggtctccgaggttagcga

SEQ ID NO: 686380 - DNA, 20 bp, mouse
gaaggctccctgcgggtcat

SEQ ID NO: 686381 - DNA, 20 bp, mouse
gcaggccccgcccatcaagg

SEQ ID NO: 686382 - DNA, 20 bp, mouse
gcaaaggagagcggagggtg

SEQ ID NO: 686383 - DNA, 20 bp, mouse
ggggagcaagcccccttgat

SEQ ID NO: 686384 - DNA, 20 bp, mouse
ggactctgaggagagaggtt

SEQ ID NO: 686385 - DNA, 20 bp, mouse
gtgctgggaggatgcgggag

SEQ ID NO: 686386 - DNA, 20 bp, mouse
gtccctgtgctattctggtt

SEQ ID NO: 686387 - DNA, 20 bp, mouse
gccatgggcagtcctattat

SEQ ID NO: 686388 - DNA, 20 bp, mouse
gtgagttccctgtgctattc

SEQ ID NO: 686389 - DNA, 20 bp, mouse
ggggtcacttgcttgtgcgc

SEQ ID NO: 686390 - DNA, 20 bp, mouse
ggccttatatgtagtgtcca

SEQ ID NO: 686391 - DNA, 20 bp, mouse
ggcaacttgagagaaaaggc

SEQ ID NO: 686392 - DNA, 20 bp, mouse
gctcacagagcttgccattc

SEQ ID NO: 686393 - DNA, 20 bp, mouse
gcaagggtaaaaattaattt

SEQ ID NO: 686394 - DNA, 20 bp, mouse
gtggaatttgaaatatccag

SEQ ID NO: 686395 - DNA, 20 bp, mouse
gcaacatagtaactgatgcc

SEQ ID NO: 686396 - DNA, 20 bp, mouse
ggggacccgcgcctgtacag

SEQ ID NO: 686397 - DNA, 20 bp, mouse
gacccgcgcctgtacagcgg

SEQ ID NO: 686398 - DNA, 20 bp, mouse
ggtacaggcgcgggtcccgg

SEQ ID NO: 686399 - DNA, 20 bp, mouse
gggaagcactcgagccaaga

SEQ ID NO: 686400 - DNA, 20 bp, mouse
ggtcccggtggcaccggtcc

SEQ ID NO: 686401 - DNA, 20 bp, mouse
gcctccaggaccggtgccac

SEQ ID NO: 686402 - DNA, 20 bp, mouse
gagcgcagcgcctccaggac

SEQ ID NO: 686403 - DNA, 20 bp, mouse
ggaggggatgggtcatccca

SEQ ID NO: 686404 - DNA, 20 bp, mouse
ggggatgggtcatcccacgg

SEQ ID NO: 686405 - DNA, 20 bp, mouse
ggggtcatcccacggagggg

SEQ ID NO: 686406 - DNA, 20 bp, mouse
gggccctgagtcactggagg

SEQ ID NO: 686407 - DNA, 20 bp, mouse
gtggataggccctgagtcac

SEQ ID NO: 686408 - DNA, 20 bp, mouse
gtgggggtacttaggaagca

SEQ ID NO: 686409 - DNA, 20 bp, mouse
gccctcccgatggcctgctc

SEQ ID NO: 686410 - DNA, 20 bp, mouse
gctctccggagcaggccatc

SEQ ID NO: 686411 - DNA, 20 bp, mouse
ggccccaaattcctgaggtt

SEQ ID NO: 686412 - DNA, 20 bp, mouse
gtgcacaggggcacgaagac

SEQ ID NO: 686413 - DNA, 20 bp, mouse
ggggcacgaagactggaaag

SEQ ID NO: 686414 - DNA, 20 bp, mouse
gtccggagcaggccatcggg

SEQ ID NO: 686415 - DNA, 20 bp, mouse
gtccctcctccagtgactca

SEQ ID NO: 686416 - DNA, 20 bp, mouse
gtgccagctggaggaagtgt

SEQ ID NO: 686417 - DNA, 20 bp, mouse
gtcttctgggatctgttagt

SEQ ID NO: 686418 - DNA, 20 bp, mouse
gggaaaggcgagtcagaggc

SEQ ID NO: 686419 - DNA, 20 bp, mouse
ggatgggaaaggcgagtcag

SEQ ID NO: 686420 - DNA, 20 bp, mouse
gtcctccagctggcagaagt

SEQ ID NO: 686421 - DNA, 20 bp, mouse
gcacaagagctttttagaga

SEQ ID NO: 686422 - DNA, 20 bp, mouse
gccaatgagcctcaggctcg

SEQ ID NO: 686423 - DNA, 20 bp, mouse
gtctgggatctgttagtggg

SEQ ID NO: 686424 - DNA, 20 bp, mouse
gtgacatcacaggtgtcacc

SEQ ID NO: 686425 - DNA, 20 bp, mouse
gctcagagccaatgagcctc

SEQ ID NO: 686426 - DNA, 20 bp, mouse
gagcacagggagttacaggt

SEQ ID NO: 686427 - DNA, 20 bp, mouse
ggggacagagtaatactcca

SEQ ID NO: 686428 - DNA, 20 bp, mouse
gggctctgaagagttttgag

SEQ ID NO: 686429 - DNA, 20 bp, mouse
gggccctggaagaagggagt

SEQ ID NO: 686430 - DNA, 20 bp, mouse
gcttcagagcccaatgtcag

SEQ ID NO: 686431 - DNA, 20 bp, mouse
gtactctgtcccctgacatt

SEQ ID NO: 686432 - DNA, 20 bp, mouse
gtgggtgggtagagtcaatg

SEQ ID NO: 686433 - DNA, 20 bp, mouse
gcctgggcaacagggggtga

SEQ ID NO: 686434 - DNA, 20 bp, mouse
gtggggtgttggctcaggag

SEQ ID NO: 686435 - DNA, 20 bp, mouse
gttgaggggccctggaagaa

SEQ ID NO: 686436 - DNA, 20 bp, mouse
gggtgcgctgcacacggctg

SEQ ID NO: 686437 - DNA, 20 bp, mouse
ggaagcgcagtggatggagt

SEQ ID NO: 686438 - DNA, 20 bp, mouse
gcgcccacgcaatcctcgga

SEQ ID NO: 686439 - DNA, 20 bp, mouse
gagcgccaatggttgcttgg

SEQ ID NO: 686440 - DNA, 20 bp, mouse
gcagagagagttcctcgtgc

SEQ ID NO: 686441 - DNA, 20 bp, mouse
ggccaatggttgcttggagg

SEQ ID NO: 686442 - DNA, 20 bp, mouse
gaacgcccatagaggcctct

SEQ ID NO: 686443 - DNA, 20 bp, mouse
gggagctagtcgaccacaca

SEQ ID NO: 686444 - DNA, 20 bp, mouse
gttagccaagaggcctctat

SEQ ID NO: 686445 - DNA, 20 bp, mouse
gagctcaattccttggagct

SEQ ID NO: 686446 - DNA, 20 bp, mouse
gaggacgcagagctcggggt

SEQ ID NO: 686447 - DNA, 20 bp, mouse
gctaaagggaagcttccact

SEQ ID NO: 686448 - DNA, 20 bp, mouse
gagggacccggctgcagcga

SEQ ID NO: 686449 - DNA, 20 bp, mouse
gaaggctggcgggtggactc

SEQ ID NO: 686450 - DNA, 20 bp, mouse
ggctggcgggtggactccgg

SEQ ID NO: 686451 - DNA, 20 bp, mouse
gccgattggccggagcacta

SEQ ID NO: 686452 - DNA, 20 bp, mouse
gcggctgcagcgaaggctgg

SEQ ID NO: 686453 - DNA, 20 bp, mouse
gtctcgagaaggtaactaag

SEQ ID NO: 686454 - DNA, 20 bp, mouse
gacccggctgcagcgaaggc

SEQ ID NO: 686455 - DNA, 20 bp, mouse
gtgcagcgaaggctggcggg

SEQ ID NO: 686456 - DNA, 20 bp, mouse
ggtgaggtgcaggaacccga

SEQ ID NO: 686457 - DNA, 20 bp, mouse
gaacccgaggggtgcctgcc

SEQ ID NO: 686458 - DNA, 20 bp, mouse
gcgctcccgcggtaccgcag

SEQ ID NO: 686459 - DNA, 20 bp, mouse
gaggctgggaccccgattgg

SEQ ID NO: 686460 - DNA, 20 bp, mouse
gacagagcgcttggcagagg

SEQ ID NO: 686461 - DNA, 20 bp, mouse
gtccctggcaggcacccctc

SEQ ID NO: 686462 - DNA, 20 bp, mouse
ggtccctcccggctcaggaa

SEQ ID NO: 686463 - DNA, 20 bp, mouse
gtgggaaggaaagcggtcta

SEQ ID NO: 686464 - DNA, 20 bp, mouse
gaaagcgcgtggggagcgca

SEQ ID NO: 686465 - DNA, 20 bp, mouse
ggggcggaccgggtgtgggg

SEQ ID NO: 686466 - DNA, 20 bp, mouse
ggagagtgggactttctggg

SEQ ID NO: 686467 - DNA, 20 bp, mouse
gaggacctagggcggagagt

SEQ ID NO: 686468 - DNA, 20 bp, mouse
ggcggagagtgggactttct

SEQ ID NO: 686469 - DNA, 20 bp, mouse
ggccaccccgcccactgggt

SEQ ID NO: 686470 - DNA, 20 bp, mouse
gtgggtaggctggccaagga

SEQ ID NO: 686471 - DNA, 20 bp, mouse
gccactgggtaggctggcca

SEQ ID NO: 686472 - DNA, 20 bp, mouse
gagtgggactttctgggagg

SEQ ID NO: 686473 - DNA, 20 bp, mouse
ggtaggctggccaaggaagg

SEQ ID NO: 686474 - DNA, 20 bp, mouse
ggtgtccagatcagactgaa

SEQ ID NO: 686475 - DNA, 20 bp, mouse
gcagtctcctgagcctagaa

SEQ ID NO: 686476 - DNA, 20 bp, mouse
gagtgcctgcgggatgggag

SEQ ID NO: 686477 - DNA, 20 bp, mouse
gccaagggagagtggctcag

SEQ ID NO: 686478 - DNA, 20 bp, mouse
gaggcactcagcagagcgtg

SEQ ID NO: 686479 - DNA, 20 bp, mouse
gtcggacactgtagaatgag

SEQ ID NO: 686480 - DNA, 20 bp, mouse
gcggagaggcgcaccggaca

SEQ ID NO: 686481 - DNA, 20 bp, mouse
gtgctgagtgcctgcgggat

SEQ ID NO: 686482 - DNA, 20 bp, mouse
gagggaaggagtgcgcgagg

SEQ ID NO: 686483 - DNA, 20 bp, mouse
gtctacgcggagaggcgcac

SEQ ID NO: 686484 - DNA, 20 bp, mouse
ggtagaatgaggggctcccc

SEQ ID NO: 686485 - DNA, 20 bp, mouse
gagacagtcggcgctctgat

SEQ ID NO: 686486 - DNA, 20 bp, mouse
gcggtcgcgcagtcccccgg

SEQ ID NO: 686487 - DNA, 20 bp, mouse
ggcccctggtccaggctgga

SEQ ID NO: 686488 - DNA, 20 bp, mouse
gagcctggaccaggggcccc

SEQ ID NO: 686489 - DNA, 20 bp, mouse
ggcactggcaggtgctgatc

SEQ ID NO: 686490 - DNA, 20 bp, mouse
ggcactggcacgggccgcac

SEQ ID NO: 686491 - DNA, 20 bp, mouse
ggggcagccacgcggaggaa

SEQ ID NO: 686492 - DNA, 20 bp, mouse
gctggaaggtgctggggccc

SEQ ID NO: 686493 - DNA, 20 bp, mouse
ggcggcccgtgccagtgcca

SEQ ID NO: 686494 - DNA, 20 bp, mouse
gtgggcccaagtggccgccc

SEQ ID NO: 686495 - DNA, 20 bp, mouse
gtccaggctggaaggtgctg

SEQ ID NO: 686496 - DNA, 20 bp, mouse
ggagagacataaaaggacta

SEQ ID NO: 686497 - DNA, 20 bp, mouse
ggtggggtaactgaacttgt

SEQ ID NO: 686498 - DNA, 20 bp, mouse
gcctggttgagagacataaa

SEQ ID NO: 686499 - DNA, 20 bp, mouse
gaccccattaaagagacgcc

SEQ ID NO: 686500 - DNA, 20 bp, mouse
gaaccaggcgtctctttaat

SEQ ID NO: 686501 - DNA, 20 bp, mouse
ggcagtaagtgtctttcact

SEQ ID NO: 686502 - DNA, 20 bp, mouse
ggtgaccacctccaagaagg

SEQ ID NO: 686503 - DNA, 20 bp, mouse
gcctgtgaccacctccaaga

SEQ ID NO: 686504 - DNA, 20 bp, mouse
gcgaggttccctaaagtaga

SEQ ID NO: 686505 - DNA, 20 bp, mouse
gcaggagaaaagtccttacg

SEQ ID NO: 686506 - DNA, 20 bp, mouse
ggggctgagagctaaggacg

SEQ ID NO: 686507 - DNA, 20 bp, mouse
gagggaggaaccaggtgatt

SEQ ID NO: 686508 - DNA, 20 bp, mouse
ggctctcagccccaatcacc

SEQ ID NO: 686509 - DNA, 20 bp, mouse
gctgagagctaaggacgggg

SEQ ID NO: 686510 - DNA, 20 bp, mouse
ggaagaccctccagggggct

SEQ ID NO: 686511 - DNA, 20 bp, mouse
gagggggctggggtttgaac

SEQ ID NO: 686512 - DNA, 20 bp, mouse
ggagcaatcacacaggctgt

SEQ ID NO: 686513 - DNA, 20 bp, mouse
ggctggggtttgaacagggc

SEQ ID NO: 686514 - DNA, 20 bp, mouse
gtgattggggctgagagcta

SEQ ID NO: 686515 - DNA, 20 bp, mouse
ggacttacctgcccagaagg

SEQ ID NO: 686516 - DNA, 20 bp, mouse
gtgtctgctaggaaacaagt

SEQ ID NO: 686517 - DNA, 20 bp, mouse
ggacagacatggtgtctgct

SEQ ID NO: 686518 - DNA, 20 bp, mouse
gcaccatgtctgtcttgctt

SEQ ID NO: 686519 - DNA, 20 bp, mouse
gctccaaagcaagacagaca

SEQ ID NO: 686520 - DNA, 20 bp, mouse
ggtgtggggtgcggggtgca

SEQ ID NO: 686521 - DNA, 20 bp, mouse
gttggaggcgacatggtgtg

SEQ ID NO: 686522 - DNA, 20 bp, mouse
gtccgcaaccggcctccatt

SEQ ID NO: 686523 - DNA, 20 bp, mouse
gggctgctgagtgagacaac

SEQ ID NO: 686524 - DNA, 20 bp, mouse
gagtgcaggcaggaccattt

SEQ ID NO: 686525 - DNA, 20 bp, mouse
ggcaaccggcctccatttgg

SEQ ID NO: 686526 - DNA, 20 bp, mouse
gtggggagagaaggaatgtg

SEQ ID NO: 686527 - DNA, 20 bp, mouse
ggtgaggaaaacttgaatgg

SEQ ID NO: 686528 - DNA, 20 bp, mouse
gcaagcactcagtagtctca

SEQ ID NO: 686529 - DNA, 20 bp, mouse
ggaaagaaacaactgagcac

SEQ ID NO: 686530 - DNA, 20 bp, mouse
gtggaggagtggaggctagc

SEQ ID NO: 686531 - DNA, 20 bp, mouse
gtggggaacacaaaggaaat

SEQ ID NO: 686532 - DNA, 20 bp, mouse
gcggtggaaaggcggagcaa

SEQ ID NO: 686533 - DNA, 20 bp, mouse
gaagggaataattaagtctg

SEQ ID NO: 686534 - DNA, 20 bp, mouse
gcagtagtctcagggacgac

SEQ ID NO: 686535 - DNA, 20 bp, mouse
gggaacacaaaggaaatcgg

SEQ ID NO: 686536 - DNA, 20 bp, mouse
gtggaggaggccaaagtccc

SEQ ID NO: 686537 - DNA, 20 bp, mouse
gcaccagcgggcttcccttg

SEQ ID NO: 686538 - DNA, 20 bp, mouse
gagggaagcccgctggtgat

SEQ ID NO: 686539 - DNA, 20 bp, mouse
gacccctggtggcgcgagga

SEQ ID NO: 686540 - DNA, 20 bp, mouse
gggcactggagcaggacaga

SEQ ID NO: 686541 - DNA, 20 bp, mouse
gagggcccgcggggactgga

SEQ ID NO: 686542 - DNA, 20 bp, mouse
gcccgctggtgataggaaac

SEQ ID NO: 686543 - DNA, 20 bp, mouse
gagaaaggctcaggagaaga

SEQ ID NO: 686544 - DNA, 20 bp, mouse
gataggaaacgggacagagg

SEQ ID NO: 686545 - DNA, 20 bp, mouse
gagacggttgctccctgaag

SEQ ID NO: 686546 - DNA, 20 bp, mouse
ggtgtctgctaggaaacaag

SEQ ID NO: 686547 - DNA, 20 bp, mouse
gtctgctaggaaacaagtgg

SEQ ID NO: 686548 - DNA, 20 bp, mouse
ggacagacatggtgtctgct

SEQ ID NO: 686549 - DNA, 20 bp, mouse
gcaccatgtctgtcttgctt

SEQ ID NO: 686550 - DNA, 20 bp, mouse
gctccaaagcaagacagaca

SEQ ID NO: 686551 - DNA, 20 bp, mouse
gttggaggcgacatggtgtg

SEQ ID NO: 686552 - DNA, 20 bp, mouse
gtccgcaaccggcctccatt

SEQ ID NO: 686553 - DNA, 20 bp, mouse
gggctgctgagtgagacaac

SEQ ID NO: 686554 - DNA, 20 bp, mouse
gagtgcaggcaggaccattt

SEQ ID NO: 686555 - DNA, 20 bp, mouse
ggcaaccggcctccatttgg

SEQ ID NO: 686556 - DNA, 20 bp, mouse
gcggcgccgcgcagccaata

SEQ ID NO: 686557 - DNA, 20 bp, mouse
gcgggtaggcaagaaagggg

SEQ ID NO: 686558 - DNA, 20 bp, mouse
gaagcgggtaggcaagaaag

SEQ ID NO: 686559 - DNA, 20 bp, mouse
gttgccgcggagaagcgggt

SEQ ID NO: 686560 - DNA, 20 bp, mouse
gagaaaggggcgggccatcg

SEQ ID NO: 686561 - DNA, 20 bp, mouse
gaggtcattcgacgccccat

SEQ ID NO: 686562 - DNA, 20 bp, mouse
gactcaactcgacgcgctat

SEQ ID NO: 686563 - DNA, 20 bp, mouse
gttgcctacccgcttctccg

SEQ ID NO: 686564 - DNA, 20 bp, mouse
gcagtctggtgaggtaaagg

SEQ ID NO: 686565 - DNA, 20 bp, mouse
gggacgattgcaaaccctat

SEQ ID NO: 686566 - DNA, 20 bp, mouse
gggtcgccgtcgagctgtgg

SEQ ID NO: 686567 - DNA, 20 bp, mouse
gtctcagcgagcgatagggt

SEQ ID NO: 686568 - DNA, 20 bp, mouse
ggcactgggcggagcggctg

SEQ ID NO: 686569 - DNA, 20 bp, mouse
gtctgcgtcggcaagctgat

SEQ ID NO: 686570 - DNA, 20 bp, mouse
gcgagccgaggagaaatggt

SEQ ID NO: 686571 - DNA, 20 bp, mouse
ggcaagctgatgggttgctg

SEQ ID NO: 686572 - DNA, 20 bp, mouse
gacgtcacttccgtctgcgt

SEQ ID NO: 686573 - DNA, 20 bp, mouse
gtggcgggtgatagacgtaa

SEQ ID NO: 686574 - DNA, 20 bp, mouse
gggaaaacacggggaggagt

SEQ ID NO: 686575 - DNA, 20 bp, mouse
gtgagccccctcggctgcgt

SEQ ID NO: 686576 - DNA, 20 bp, mouse
gaacttgaactctgctggag

SEQ ID NO: 686577 - DNA, 20 bp, mouse
ggggcgggcaggacgaggag

SEQ ID NO: 686578 - DNA, 20 bp, mouse
gagtgtggatattgcagagc

SEQ ID NO: 686579 - DNA, 20 bp, mouse
gaaacaaggggctcattcgc

SEQ ID NO: 686580 - DNA, 20 bp, mouse
ggagctggggagtccgagtc

SEQ ID NO: 686581 - DNA, 20 bp, mouse
gaggacgaggagcggtctct

SEQ ID NO: 686582 - DNA, 20 bp, mouse
gcatcatgacgaagcagaat

SEQ ID NO: 686583 - DNA, 20 bp, mouse
ggcccgccactatcagttgt

SEQ ID NO: 686584 - DNA, 20 bp, mouse
gccccaccaacaactgatag

SEQ ID NO: 686585 - DNA, 20 bp, mouse
gactgatagtggcgggcccc

SEQ ID NO: 686586 - DNA, 20 bp, mouse
ggtgggcggaggcaatatgt

SEQ ID NO: 686587 - DNA, 20 bp, mouse
ggaagccgagacagttgctg

SEQ ID NO: 686588 - DNA, 20 bp, mouse
ggtaacggttctggggctgt

SEQ ID NO: 686589 - DNA, 20 bp, mouse
gcccccagccggaagttgag

SEQ ID NO: 686590 - DNA, 20 bp, mouse
gcgtagccaaccaaacgcga

SEQ ID NO: 686591 - DNA, 20 bp, mouse
gtcccagggcgctgttgtta

SEQ ID NO: 686592 - DNA, 20 bp, mouse
gacagaccctcgcgtttggt

SEQ ID NO: 686593 - DNA, 20 bp, mouse
gcggaggcaatatgtgggtg

SEQ ID NO: 686594 - DNA, 20 bp, mouse
gtgctgaggtaacggttctg

SEQ ID NO: 686595 - DNA, 20 bp, mouse
gggcacccagagccggaggc

SEQ ID NO: 686596 - DNA, 20 bp, mouse
ggaggcttgtggaggagccc

SEQ ID NO: 686597 - DNA, 20 bp, mouse
ggggggaagtggtgcatctt

SEQ ID NO: 686598 - DNA, 20 bp, mouse
gcgtgagtgagccaatcccg

SEQ ID NO: 686599 - DNA, 20 bp, mouse
gctaggctcaaagtgagcct

SEQ ID NO: 686600 - DNA, 20 bp, mouse
gtatcgcgagaagtccttca

SEQ ID NO: 686601 - DNA, 20 bp, mouse
gacggctcccgaatggccag

SEQ ID NO: 686602 - DNA, 20 bp, mouse
gtacgtttgcgcctcgggat

SEQ ID NO: 686603 - DNA, 20 bp, mouse
gttcaactgtgaggaggtgc

SEQ ID NO: 686604 - DNA, 20 bp, mouse
ggtcttacagtgtttacact

SEQ ID NO: 686605 - DNA, 20 bp, mouse
gcgagctgtgcttcgggtaa

SEQ ID NO: 686606 - DNA, 20 bp, mouse
ggctcccagggaactcccgc

SEQ ID NO: 686607 - DNA, 20 bp, mouse
gcgcaagcggggcgcgtgcg

SEQ ID NO: 686608 - DNA, 20 bp, mouse
ggcggcgcgcgcagttgtcc

SEQ ID NO: 686609 - DNA, 20 bp, mouse
gcagacctgcgggagttccc

SEQ ID NO: 686610 - DNA, 20 bp, mouse
gacgcgcggaccctctgtgc

SEQ ID NO: 686611 - DNA, 20 bp, mouse
ggccccgcttgcgcgctctc

SEQ ID NO: 686612 - DNA, 20 bp, mouse
gccggcctctccctggcgcg

SEQ ID NO: 686613 - DNA, 20 bp, mouse
gcaaaagaacgcgctcacac

SEQ ID NO: 686614 - DNA, 20 bp, mouse
gccggggcccagacctccag

SEQ ID NO: 686615 - DNA, 20 bp, mouse
ggcgccggagagcgcgcaag

SEQ ID NO: 686616 - DNA, 20 bp, mouse
ggggaagcacagcgccggac

SEQ ID NO: 686617 - DNA, 20 bp, mouse
gcaggcatccggtcctggag

SEQ ID NO: 686618 - DNA, 20 bp, mouse
ggcgccgggaagcacagcgc

SEQ ID NO: 686619 - DNA, 20 bp, mouse
gaagcacagcgccggaccgg

SEQ ID NO: 686620 - DNA, 20 bp, mouse
gggtcctggagtggagacgg

SEQ ID NO: 686621 - DNA, 20 bp, mouse
gcagcccagcaggttcatgc

SEQ ID NO: 686622 - DNA, 20 bp, mouse
ggctcccgcgctctccgcgc

SEQ ID NO: 686623 - DNA, 20 bp, mouse
gtctgaaaagcccgagacgg

SEQ ID NO: 686624 - DNA, 20 bp, mouse
gatgcctgcatgaacctgct

SEQ ID NO: 686625 - DNA, 20 bp, mouse
gtcatgcaggcatccggtcc

SEQ ID NO: 686626 - DNA, 20 bp, mouse
ggacctgcggtggtgtcccg

SEQ ID NO: 686627 - DNA, 20 bp, mouse
ggacggaagcggggcgcgag

SEQ ID NO: 686628 - DNA, 20 bp, mouse
gcgccccgggacaccaccgc

SEQ ID NO: 686629 - DNA, 20 bp, mouse
gcacgtgggtagcggacctg

SEQ ID NO: 686630 - DNA, 20 bp, mouse
gggggggagggcgttcccga

SEQ ID NO: 686631 - DNA, 20 bp, mouse
gcgcgggcagcgggcgggac

SEQ ID NO: 686632 - DNA, 20 bp, mouse
gcccgagggtcggggtccag

SEQ ID NO: 686633 - DNA, 20 bp, mouse
gggcgcgtgcgcggatcacg

SEQ ID NO: 686634 - DNA, 20 bp, mouse
gcggggcgcgaggggcgtga

SEQ ID NO: 686635 - DNA, 20 bp, mouse
gttcccccgtggccccccct

SEQ ID NO: 686636 - DNA, 20 bp, mouse
ggggaggaggggcagcgatc

SEQ ID NO: 686637 - DNA, 20 bp, mouse
gagacacagcgctgaagatg

SEQ ID NO: 686638 - DNA, 20 bp, mouse
gtgtcctgatcaatttcctt

SEQ ID NO: 686639 - DNA, 20 bp, mouse
gtgtactttgcagtctattg

SEQ ID NO: 686640 - DNA, 20 bp, mouse
gtagtaacgcctgggaggag

SEQ ID NO: 686641 - DNA, 20 bp, mouse
gagactacagagtcaatcta

SEQ ID NO: 686642 - DNA, 20 bp, mouse
gctgggagacaactataagg

SEQ ID NO: 686643 - DNA, 20 bp, mouse
gaagagagtcagataaagtt

SEQ ID NO: 686644 - DNA, 20 bp, mouse
gtttctgggagacaactata

SEQ ID NO: 686645 - DNA, 20 bp, mouse
gtgccatagtaacgcctggg

SEQ ID NO: 686646 - DNA, 20 bp, mouse
gccgggagatggctgcggtg

SEQ ID NO: 686647 - DNA, 20 bp, mouse
gcaggcaccctactctggtc

SEQ ID NO: 686648 - DNA, 20 bp, mouse
gtgaaactggacaccggacg

SEQ ID NO: 686649 - DNA, 20 bp, mouse
gctgcggtgtggtctgaaac

SEQ ID NO: 686650 - DNA, 20 bp, mouse
ggtggtctgaaactggacac

SEQ ID NO: 686651 - DNA, 20 bp, mouse
gacgacagccggaccagagt

SEQ ID NO: 686652 - DNA, 20 bp, mouse
gcaaaaccacctgctcccat

SEQ ID NO: 686653 - DNA, 20 bp, mouse
gtcgttatgacaaccgcgtc

SEQ ID NO: 686654 - DNA, 20 bp, mouse
gcatctcccggagcttctat

SEQ ID NO: 686655 - DNA, 20 bp, mouse
ggaaagcaggcaccctactc

SEQ ID NO: 686656 - DNA, 20 bp, mouse
gactgttagaggactctaaa

SEQ ID NO: 686657 - DNA, 20 bp, mouse
gcaccggtccggtctgtagg

SEQ ID NO: 686658 - DNA, 20 bp, mouse
gtagacgcccacctacagac

SEQ ID NO: 686659 - DNA, 20 bp, mouse
gagatcacgctgcaccggtc

SEQ ID NO: 686660 - DNA, 20 bp, mouse
gagggtggggtgagcggtcc

SEQ ID NO: 686661 - DNA, 20 bp, mouse
gccctcgcccccaagaggtc

SEQ ID NO: 686662 - DNA, 20 bp, mouse
gtcctggggaagttggtagc

SEQ ID NO: 686663 - DNA, 20 bp, mouse
gggtctggttctttaagcag

SEQ ID NO: 686664 - DNA, 20 bp, mouse
gcaccgcgggcagaagcttc

SEQ ID NO: 686665 - DNA, 20 bp, mouse
ggacactgagtccgttgcga

SEQ ID NO: 686666 - DNA, 20 bp, mouse
gaggactagaagcaggaaac

SEQ ID NO: 686667 - DNA, 20 bp, mouse
gagggccctagtctgctgtc

SEQ ID NO: 686668 - DNA, 20 bp, mouse
ggcaacggggacctgggcaa

SEQ ID NO: 686669 - DNA, 20 bp, mouse
gtctgctgtcaggaaagcta

SEQ ID NO: 686670 - DNA, 20 bp, mouse
ggggccctcctacattaatc

SEQ ID NO: 686671 - DNA, 20 bp, mouse
ggggcgggcgtccgtggcaa

SEQ ID NO: 686672 - DNA, 20 bp, mouse
ggggcaacggcgccagcgcg

SEQ ID NO: 686673 - DNA, 20 bp, mouse
gaactaaggcccacctgtga

SEQ ID NO: 686674 - DNA, 20 bp, mouse
ggcccaggtccccgttgcta

SEQ ID NO: 686675 - DNA, 20 bp, mouse
gagaattggtaactgagaca

SEQ ID NO: 686676 - DNA, 20 bp, mouse
ggggtcgcccggtagctctc

SEQ ID NO: 686677 - DNA, 20 bp, mouse
gagggaggagcgagagtctt

SEQ ID NO: 686678 - DNA, 20 bp, mouse
gtcctcccctgggcatcttg

SEQ ID NO: 686679 - DNA, 20 bp, mouse
gcgtcccgttgccagggaga

SEQ ID NO: 686680 - DNA, 20 bp, mouse
ggggatcccagaaatgttcc

SEQ ID NO: 686681 - DNA, 20 bp, mouse
gccgccccgtcccgggagtg

SEQ ID NO: 686682 - DNA, 20 bp, mouse
gcccgtcccgggagtgaggg

SEQ ID NO: 686683 - DNA, 20 bp, mouse
gtctctgcctgagagctacc

SEQ ID NO: 686684 - DNA, 20 bp, mouse
gcagagccgctaactagtcc

SEQ ID NO: 686685 - DNA, 20 bp, mouse
gtcctccctcactcccggga

SEQ ID NO: 686686 - DNA, 20 bp, mouse
gaggctaccctcaaactcgc

SEQ ID NO: 686687 - DNA, 20 bp, mouse
gaatcagaggcatcagagac

SEQ ID NO: 686688 - DNA, 20 bp, mouse
gtgtatcatgtgagacacct

SEQ ID NO: 686689 - DNA, 20 bp, mouse
ggctcaacttcgttattact

SEQ ID NO: 686690 - DNA, 20 bp, mouse
ggcagatcctgcgagtttga

SEQ ID NO: 686691 - DNA, 20 bp, mouse
gacatgatacagattttcag

SEQ ID NO: 686692 - DNA, 20 bp, mouse
gaaagacaagatcattcacc

SEQ ID NO: 686693 - DNA, 20 bp, mouse
gcacgctagagatgtcgtca

SEQ ID NO: 686694 - DNA, 20 bp, mouse
gggcaaacaccaccttcacc

SEQ ID NO: 686695 - DNA, 20 bp, mouse
gtctgatgcctctgattgct

SEQ ID NO: 686696 - DNA, 20 bp, mouse
gagagccacccaaggactta

SEQ ID NO: 686697 - DNA, 20 bp, mouse
gtcagagctcggctcagtca

SEQ ID NO: 686698 - DNA, 20 bp, mouse
ggctgcatccctaagtcctt

SEQ ID NO: 686699 - DNA, 20 bp, mouse
gaatgaacctcgtatgtcat

SEQ ID NO: 686700 - DNA, 20 bp, mouse
ggtgtaggcaagtcccactg

SEQ ID NO: 686701 - DNA, 20 bp, mouse
gaagtgaccaatgacatacg

SEQ ID NO: 686702 - DNA, 20 bp, mouse
gtaccctgggctggtaaatt

SEQ ID NO: 686703 - DNA, 20 bp, mouse
gtggggattctttgtaccct

SEQ ID NO: 686704 - DNA, 20 bp, mouse
gtccatgacgaaaaatgctg

SEQ ID NO: 686705 - DNA, 20 bp, mouse
gtccacagcatttttcgtca

SEQ ID NO: 686706 - DNA, 20 bp, mouse
gcaaaccacactggtgaaag

SEQ ID NO: 686707 - DNA, 20 bp, mouse
gagctgggaaagaagatagg

SEQ ID NO: 686708 - DNA, 20 bp, mouse
gagggtctgtgtagttctaa

SEQ ID NO: 686709 - DNA, 20 bp, mouse
gaccacaaaagtaagtgagc

SEQ ID NO: 686710 - DNA, 20 bp, mouse
gacctgatgaccctgcacca

SEQ ID NO: 686711 - DNA, 20 bp, mouse
gggtggggcacaaaaagggg

SEQ ID NO: 686712 - DNA, 20 bp, mouse
gaaagaagataggtggacac

SEQ ID NO: 686713 - DNA, 20 bp, mouse
gtgtggtcataacaacccag

SEQ ID NO: 686714 - DNA, 20 bp, mouse
gggaaatggctgtatcagtg

SEQ ID NO: 686715 - DNA, 20 bp, mouse
ggcagggtcatcaggtaaac

SEQ ID NO: 686716 - DNA, 20 bp, mouse
gaagccccgggcaggctaga

SEQ ID NO: 686717 - DNA, 20 bp, mouse
gagcatacccaatagaacct

SEQ ID NO: 686718 - DNA, 20 bp, mouse
gccactgagctgtgaccctt

SEQ ID NO: 686719 - DNA, 20 bp, mouse
gagggaacatgtgtacctgg

SEQ ID NO: 686720 - DNA, 20 bp, mouse
gggaagaagagaggcctcca

SEQ ID NO: 686721 - DNA, 20 bp, mouse
gaatgtgtatacaaggccct

SEQ ID NO: 686722 - DNA, 20 bp, mouse
gtatgctccgagggtacagc

SEQ ID NO: 686723 - DNA, 20 bp, mouse
gtacctggaggctgggttag

SEQ ID NO: 686724 - DNA, 20 bp, mouse
gaagagtttgggttatccca

SEQ ID NO: 686725 - DNA, 20 bp, mouse
gttctattgggtatgctccg

SEQ ID NO: 686726 - DNA, 20 bp, mouse
ggatgtggggagccggggtg

SEQ ID NO: 686727 - DNA, 20 bp, mouse
gcattggcccgagttctctt

SEQ ID NO: 686728 - DNA, 20 bp, mouse
gcaccaccccaaggggactg

SEQ ID NO: 686729 - DNA, 20 bp, mouse
ggccccctgaggctgctcgt

SEQ ID NO: 686730 - DNA, 20 bp, mouse
gggctgtggctgattgatga

SEQ ID NO: 686731 - DNA, 20 bp, mouse
gccatgacaagaagaactga

SEQ ID NO: 686732 - DNA, 20 bp, mouse
gagggcttccaaagagaact

SEQ ID NO: 686733 - DNA, 20 bp, mouse
gaggaagcccgtgcgcacga

SEQ ID NO: 686734 - DNA, 20 bp, mouse
gggaaaccgaagccccaccc

SEQ ID NO: 686735 - DNA, 20 bp, mouse
ggcactgactggtggggtgg

SEQ ID NO: 686736 - DNA, 20 bp, mouse
gggcgaggagtggggactag

SEQ ID NO: 686737 - DNA, 20 bp, mouse
gaagaaatacggcgaggagt

SEQ ID NO: 686738 - DNA, 20 bp, mouse
gactcccaggggtgttattt

SEQ ID NO: 686739 - DNA, 20 bp, mouse
gaagaagaagaaatacggcg

SEQ ID NO: 686740 - DNA, 20 bp, mouse
gagagagttccctggcagaa

SEQ ID NO: 686741 - DNA, 20 bp, mouse
gtttctgaggtcatagactc

SEQ ID NO: 686742 - DNA, 20 bp, mouse
gagcttgcacccagacccag

SEQ ID NO: 686743 - DNA, 20 bp, mouse
gagtgacaaaagggagttgg

SEQ ID NO: 686744 - DNA, 20 bp, mouse
gcacactgaagtctctgaaa

SEQ ID NO: 686745 - DNA, 20 bp, mouse
ggaggaggacttgctgcaga

SEQ ID NO: 686746 - DNA, 20 bp, mouse
gcttattgttgggcagtgta

SEQ ID NO: 686747 - DNA, 20 bp, mouse
gtaaacctgatcaaagcaga

SEQ ID NO: 686748 - DNA, 20 bp, mouse
gcccatccgtcggtgcggag

SEQ ID NO: 686749 - DNA, 20 bp, mouse
gacgaaggaccacagaatcg

SEQ ID NO: 686750 - DNA, 20 bp, mouse
ggaggaagatctagatgttt

SEQ ID NO: 686751 - DNA, 20 bp, mouse
gggcagacaagtcacagctc

SEQ ID NO: 686752 - DNA, 20 bp, mouse
gattaagaggcgtgcttaaa

SEQ ID NO: 686753 - DNA, 20 bp, mouse
gttgactcaaagcttattgt

SEQ ID NO: 686754 - DNA, 20 bp, mouse
ggttgctaaacatgattaag

SEQ ID NO: 686755 - DNA, 20 bp, mouse
gcttgggcggccgtgtgaac

SEQ ID NO: 686756 - DNA, 20 bp, mouse
ggagagcagctcctcgagac

SEQ ID NO: 686757 - DNA, 20 bp, mouse
ggggagcaggccccacccgg

SEQ ID NO: 686758 - DNA, 20 bp, mouse
ggacgcttactgcactaagg

SEQ ID NO: 686759 - DNA, 20 bp, mouse
gtcgctgccagccagtctcg

SEQ ID NO: 686760 - DNA, 20 bp, mouse
gtcagggagcaggccccacc

SEQ ID NO: 686761 - DNA, 20 bp, mouse
gagcttgggcaagcaggcat

SEQ ID NO: 686762 - DNA, 20 bp, mouse
gctggctggcagcgactgac

SEQ ID NO: 686763 - DNA, 20 bp, mouse
gaaagcaggaatcctccggg

SEQ ID NO: 686764 - DNA, 20 bp, mouse
gccaaggcacggttagaaag

SEQ ID NO: 686765 - DNA, 20 bp, mouse
gatggatcgtccagaaacga

SEQ ID NO: 686766 - DNA, 20 bp, mouse
gcgtctgcatctgcgagatg

SEQ ID NO: 686767 - DNA, 20 bp, mouse
ggaccccttgatgtctaagt

SEQ ID NO: 686768 - DNA, 20 bp, mouse
gccctcactccactttacag

SEQ ID NO: 686769 - DNA, 20 bp, mouse
gtgaaagatgcagtaacttg

SEQ ID NO: 686770 - DNA, 20 bp, mouse
gggacccacttagacatcaa

SEQ ID NO: 686771 - DNA, 20 bp, mouse
gaactggcggattctacttc

SEQ ID NO: 686772 - DNA, 20 bp, mouse
gccctctgtaaagtggagtg

SEQ ID NO: 686773 - DNA, 20 bp, mouse
gagtggagtgagggctgtgt

SEQ ID NO: 686774 - DNA, 20 bp, mouse
gataggcttgggtgaccgta

SEQ ID NO: 686775 - DNA, 20 bp, mouse
gtgtgccaagacagtccctc

SEQ ID NO: 686776 - DNA, 20 bp, mouse
gccacccttaaggagggtga

SEQ ID NO: 686777 - DNA, 20 bp, mouse
gtgccacccacccttaagga

SEQ ID NO: 686778 - DNA, 20 bp, mouse
gtggccccttctcttcttca

SEQ ID NO: 686779 - DNA, 20 bp, mouse
gggggccaggccttgggtac

SEQ ID NO: 686780 - DNA, 20 bp, mouse
gaactgtgctcctgtaccca

SEQ ID NO: 686781 - DNA, 20 bp, mouse
gcggtcccatgaagaagaga

SEQ ID NO: 686782 - DNA, 20 bp, mouse
gaggagggtgagggctgggt

SEQ ID NO: 686783 - DNA, 20 bp, mouse
gtgctcctgtacccaaggcc

SEQ ID NO: 686784 - DNA, 20 bp, mouse
gcatctgcatctgcgagatt

SEQ ID NO: 686785 - DNA, 20 bp, mouse
gtccctctacagaatattgc

SEQ ID NO: 686786 - DNA, 20 bp, mouse
gaatcagaaaaaaatgcagt

SEQ ID NO: 686787 - DNA, 20 bp, mouse
ggacgtgtgtcaccgcagat

SEQ ID NO: 686788 - DNA, 20 bp, mouse
gagagtcgctgtggtcacat

SEQ ID NO: 686789 - DNA, 20 bp, mouse
gactataatgggctaaatct

SEQ ID NO: 686790 - DNA, 20 bp, mouse
ggtcatggcaggaagcgcac

SEQ ID NO: 686791 - DNA, 20 bp, mouse
ggcctggcaaagcccatctg

SEQ ID NO: 686792 - DNA, 20 bp, mouse
gcgcacaggcagacgtgtgc

SEQ ID NO: 686793 - DNA, 20 bp, mouse
ggtgctggagtgagtgatag

SEQ ID NO: 686794 - DNA, 20 bp, mouse
gtctgccactgccttagtta

SEQ ID NO: 686795 - DNA, 20 bp, mouse
gaatcacaagatctttaata

SEQ ID NO: 686796 - DNA, 20 bp, mouse
gagtgactggggataggctg

SEQ ID NO: 686797 - DNA, 20 bp, mouse
gagcagagatgggaattgtg

SEQ ID NO: 686798 - DNA, 20 bp, mouse
ggcctcgggtgcctcgctat

SEQ ID NO: 686799 - DNA, 20 bp, mouse
gcgggcgcgcagcatcttgc

SEQ ID NO: 686800 - DNA, 20 bp, mouse
gaggcacccgaggcacccgc

SEQ ID NO: 686801 - DNA, 20 bp, mouse
gactctgggcacagcagaga

SEQ ID NO: 686802 - DNA, 20 bp, mouse
gccccatagcgaggcacccg

SEQ ID NO: 686803 - DNA, 20 bp, mouse
gagatgggaattgtgagggt

SEQ ID NO: 686804 - DNA, 20 bp, mouse
ggcgcgcccgcgggtgcctc

SEQ ID NO: 686805 - DNA, 20 bp, mouse
gttgcaggagccagcgcgtg

SEQ ID NO: 686806 - DNA, 20 bp, mouse
ggggtcgcgtcgttgttgct

SEQ ID NO: 686807 - DNA, 20 bp, mouse
gaagttaataaggtaggcag

SEQ ID NO: 686808 - DNA, 20 bp, mouse
gtctcacatccaagctggtc

SEQ ID NO: 686809 - DNA, 20 bp, mouse
gtacaggcacaggcttgcgt

SEQ ID NO: 686810 - DNA, 20 bp, mouse
ggacgtgctctgaagactac

SEQ ID NO: 686811 - DNA, 20 bp, mouse
gcgtgggattcttttgtcta

SEQ ID NO: 686812 - DNA, 20 bp, mouse
gccgccccactaagttaata

SEQ ID NO: 686813 - DNA, 20 bp, mouse
gcctggcatccccgtcgcta

SEQ ID NO: 686814 - DNA, 20 bp, mouse
gcccactaagttaataaggt

SEQ ID NO: 686815 - DNA, 20 bp, mouse
gcctctgctctccttatatt

SEQ ID NO: 686816 - DNA, 20 bp, mouse
gctagcgccccctccggaca

SEQ ID NO: 686817 - DNA, 20 bp, mouse
ggagctcccgcaagtgggaa

SEQ ID NO: 686818 - DNA, 20 bp, mouse
gtgggcgcgcagggatcctc

SEQ ID NO: 686819 - DNA, 20 bp, mouse
gcggggaggaggcggaactt

SEQ ID NO: 686820 - DNA, 20 bp, mouse
ggccccctccggacacgggg

SEQ ID NO: 686821 - DNA, 20 bp, mouse
gccctccggacacggggagg

SEQ ID NO: 686822 - DNA, 20 bp, mouse
gaggccgccctggaccggtc

SEQ ID NO: 686823 - DNA, 20 bp, mouse
ggcaaggagctcccgcaagt

SEQ ID NO: 686824 - DNA, 20 bp, mouse
gtatccgcccgaccggtcca

SEQ ID NO: 686825 - DNA, 20 bp, mouse
ggcctcctccccgtgtccgg

SEQ ID NO: 686826 - DNA, 20 bp, mouse
gaggtctgcggaagaggtgg

SEQ ID NO: 686827 - DNA, 20 bp, mouse
ggagacgccggcagttcgga

SEQ ID NO: 686828 - DNA, 20 bp, mouse
ggggtatagactgtagactt

SEQ ID NO: 686829 - DNA, 20 bp, mouse
gcagaagggtggtggtgcaa

SEQ ID NO: 686830 - DNA, 20 bp, mouse
ggacctcctccagagaagga

SEQ ID NO: 686831 - DNA, 20 bp, mouse
gatagactgtagacttgggt

SEQ ID NO: 686832 - DNA, 20 bp, mouse
gtgactctggtcccgctagt

SEQ ID NO: 686833 - DNA, 20 bp, mouse
gttgcctagcaaccctggcc

SEQ ID NO: 686834 - DNA, 20 bp, mouse
ggtcactttgattgcgtttt

SEQ ID NO: 686835 - DNA, 20 bp, mouse
gcgcagacctcctccagaga

SEQ ID NO: 686836 - DNA, 20 bp, mouse
ggcgcccaagggccttgtgg

SEQ ID NO: 686837 - DNA, 20 bp, mouse
gtcccagagcccgtaagccg

SEQ ID NO: 686838 - DNA, 20 bp, mouse
gccgttgcccaggtaaccga

SEQ ID NO: 686839 - DNA, 20 bp, mouse
gctacgaggctcgggaaccc

SEQ ID NO: 686840 - DNA, 20 bp, mouse
gcggggctcggctacaaaag

SEQ ID NO: 686841 - DNA, 20 bp, mouse
ggggaagtggctgcgcccaa

SEQ ID NO: 686842 - DNA, 20 bp, mouse
gcgcctgaagcactcgtccc

SEQ ID NO: 686843 - DNA, 20 bp, mouse
gtgggggtggactcaagccc

SEQ ID NO: 686844 - DNA, 20 bp, mouse
gccagagtgcggaagtcttg

SEQ ID NO: 686845 - DNA, 20 bp, mouse
gtacctgggcaacggcgcgg

SEQ ID NO: 686846 - DNA, 20 bp, mouse
gaggcctgagggaaagaagc

SEQ ID NO: 686847 - DNA, 20 bp, mouse
gcgtgacgcgcgagcgaccg

SEQ ID NO: 686848 - DNA, 20 bp, mouse
gggccccaccagccgctctc

SEQ ID NO: 686849 - DNA, 20 bp, mouse
gacggagcggcgacaggaaa

SEQ ID NO: 686850 - DNA, 20 bp, mouse
gtcgctcgcgcgtcacggag

SEQ ID NO: 686851 - DNA, 20 bp, mouse
ggagcgaccgcggagtggag

SEQ ID NO: 686852 - DNA, 20 bp, mouse
ggggccttgtggcgacgtca

SEQ ID NO: 686853 - DNA, 20 bp, mouse
gagtggaggggagcggtgtg

SEQ ID NO: 686854 - DNA, 20 bp, mouse
gagccggcgtggaatcctca

SEQ ID NO: 686855 - DNA, 20 bp, mouse
gcaggccgaggagacggcgc

SEQ ID NO: 686856 - DNA, 20 bp, mouse
gcgcctgcgcagaccgtcac

SEQ ID NO: 686857 - DNA, 20 bp, mouse
gtctccgaacggtagaacct

SEQ ID NO: 686858 - DNA, 20 bp, mouse
ggtacaagtgctagactatg

SEQ ID NO: 686859 - DNA, 20 bp, mouse
gtgcgcaggcgcagtgtccc

SEQ ID NO: 686860 - DNA, 20 bp, mouse
gggtggcagtggggactccc

SEQ ID NO: 686861 - DNA, 20 bp, mouse
gcagtgtccccgggccaaaa

SEQ ID NO: 686862 - DNA, 20 bp, mouse
gggccagtgacggtctgcgc

SEQ ID NO: 686863 - DNA, 20 bp, mouse
gggcaaggctcgctagatta

SEQ ID NO: 686864 - DNA, 20 bp, mouse
gcggcgaggcgggccagtga

SEQ ID NO: 686865 - DNA, 20 bp, mouse
gtggcctaggttctaccgtt

SEQ ID NO: 686866 - DNA, 20 bp, mouse
gaggcccagaacgttcgcgg

SEQ ID NO: 686867 - DNA, 20 bp, mouse
gaggaggcgtgacgccacat

SEQ ID NO: 686868 - DNA, 20 bp, mouse
gcggccggaggaccgagccc

SEQ ID NO: 686869 - DNA, 20 bp, mouse
gccgtggcggcagtcagaac

SEQ ID NO: 686870 - DNA, 20 bp, mouse
gctcggggcggcgtgacaat

SEQ ID NO: 686871 - DNA, 20 bp, mouse
gaactggagctccggggagt

SEQ ID NO: 686872 - DNA, 20 bp, mouse
gagcaccccaacatggcccg

SEQ ID NO: 686873 - DNA, 20 bp, mouse
gcggacccacgcaagggcaa

SEQ ID NO: 686874 - DNA, 20 bp, mouse
ggccatgttggggtgctcgg

SEQ ID NO: 686875 - DNA, 20 bp, mouse
gagtcagaactggagctccg

SEQ ID NO: 686876 - DNA, 20 bp, mouse
ggccccgcgcggaaagccgt

SEQ ID NO: 686877 - DNA, 20 bp, mouse
ggaccagagtagagagggaa

SEQ ID NO: 686878 - DNA, 20 bp, mouse
gccgtgacgcagcacatccg

SEQ ID NO: 686879 - DNA, 20 bp, mouse
gcggcgcgcgcgcccgagga

SEQ ID NO: 686880 - DNA, 20 bp, mouse
gtggcagccgggtcccaccc

SEQ ID NO: 686881 - DNA, 20 bp, mouse
ggcacatccggggtgggacc

SEQ ID NO: 686882 - DNA, 20 bp, mouse
gtgacgcagcacatccgggg

SEQ ID NO: 686883 - DNA, 20 bp, mouse
ggcgttgaccagagtagaga

SEQ ID NO: 686884 - DNA, 20 bp, mouse
gcgacaccggccaatcgctg

SEQ ID NO: 686885 - DNA, 20 bp, mouse
gccgatgcgccgcacgacac

SEQ ID NO: 686886 - DNA, 20 bp, mouse
gggttcgcgccgcccggaag

SEQ ID NO: 686887 - DNA, 20 bp, mouse
gcccggaagcggctgagaac

SEQ ID NO: 686888 - DNA, 20 bp, mouse
gcggccgcgtgtgatgtccc

SEQ ID NO: 686889 - DNA, 20 bp, mouse
gccggcgagcagccaggcgt

SEQ ID NO: 686890 - DNA, 20 bp, mouse
gactccgcagccaatcagcg

SEQ ID NO: 686891 - DNA, 20 bp, mouse
gcattggccggcggacacga

SEQ ID NO: 686892 - DNA, 20 bp, mouse
gtgggaagagaaaacgtcag

SEQ ID NO: 686893 - DNA, 20 bp, mouse
gctgagaaccggagagagtt

SEQ ID NO: 686894 - DNA, 20 bp, mouse
ggtacacttcacctccgagg

SEQ ID NO: 686895 - DNA, 20 bp, mouse
ggaacagccgtcgtgtccgc

SEQ ID NO: 686896 - DNA, 20 bp, mouse
gtgtacgattcacagatagt

SEQ ID NO: 686897 - DNA, 20 bp, mouse
gcggaggcgctagaacgcgc

SEQ ID NO: 686898 - DNA, 20 bp, mouse
gaaaggggcgttcggttcgg

SEQ ID NO: 686899 - DNA, 20 bp, mouse
ggacagcagcgtctgacaat

SEQ ID NO: 686900 - DNA, 20 bp, mouse
ggggaggccgggcgagcgaa

SEQ ID NO: 686901 - DNA, 20 bp, mouse
gaaccgaacgcccctttctt

SEQ ID NO: 686902 - DNA, 20 bp, mouse
gagtgagggttgaacccggg

SEQ ID NO: 686903 - DNA, 20 bp, mouse
gtggggagaagtcaagtaaa

SEQ ID NO: 686904 - DNA, 20 bp, mouse
gggcctgccccgcgacgcgc

SEQ ID NO: 686905 - DNA, 20 bp, mouse
gcggggcaggccggcgcgga

SEQ ID NO: 686906 - DNA, 20 bp, mouse
ggtcctggggcgctcataac

SEQ ID NO: 686907 - DNA, 20 bp, mouse
gggttccgtgatcccgaaaa

SEQ ID NO: 686908 - DNA, 20 bp, mouse
ggagctgtgtgacctttttc

SEQ ID NO: 686909 - DNA, 20 bp, mouse
gggaaagactacaattccca

SEQ ID NO: 686910 - DNA, 20 bp, mouse
gggtgccactcgtggttgtc

SEQ ID NO: 686911 - DNA, 20 bp, mouse
gcaaccacgagtggcaccct

SEQ ID NO: 686912 - DNA, 20 bp, mouse
gaataagcaaaaaggcgctc

SEQ ID NO: 686913 - DNA, 20 bp, mouse
gtgctcctgacaaccacgag

SEQ ID NO: 686914 - DNA, 20 bp, mouse
gacagaacgcaaactaacag

SEQ ID NO: 686915 - DNA, 20 bp, mouse
gaccgagtcggcgtatctct

SEQ ID NO: 686916 - DNA, 20 bp, mouse
gaggagggcggggaggccgt

SEQ ID NO: 686917 - DNA, 20 bp, mouse
gcgccccggcccctaggctc

SEQ ID NO: 686918 - DNA, 20 bp, mouse
gcggcccctaggctccggtg

SEQ ID NO: 686919 - DNA, 20 bp, mouse
gacgcggtaacccgggagga

SEQ ID NO: 686920 - DNA, 20 bp, mouse
ggggcggggaggccgtgggt

SEQ ID NO: 686921 - DNA, 20 bp, mouse
gcggggaggccgtgggttgg

SEQ ID NO: 686922 - DNA, 20 bp, mouse
gaaagccgacgcggtaaccc

SEQ ID NO: 686923 - DNA, 20 bp, mouse
gcccgccttccgcgccaccg

SEQ ID NO: 686924 - DNA, 20 bp, mouse
gcgccagccgcgtccctccc

SEQ ID NO: 686925 - DNA, 20 bp, mouse
gccttccgcgccaccggggt

SEQ ID NO: 686926 - DNA, 20 bp, mouse
gttcccaggtgggacttagg

SEQ ID NO: 686927 - DNA, 20 bp, mouse
ggggtcccctgtcctgtcgc

SEQ ID NO: 686928 - DNA, 20 bp, mouse
ggggacccgcacctagcttg

SEQ ID NO: 686929 - DNA, 20 bp, mouse
gcggtccgcaagctaggtgc

SEQ ID NO: 686930 - DNA, 20 bp, mouse
gagcctcctaagtcccacct

SEQ ID NO: 686931 - DNA, 20 bp, mouse
gggctcggccggtcacacga

SEQ ID NO: 686932 - DNA, 20 bp, mouse
ggacgcagtctctcaaacac

SEQ ID NO: 686933 - DNA, 20 bp, mouse
gcccaggcgacgtcattccc

SEQ ID NO: 686934 - DNA, 20 bp, mouse
gaggcgacgtcattcccagg

SEQ ID NO: 686935 - DNA, 20 bp, mouse
ggagtctctagtagtttcca

SEQ ID NO: 686936 - DNA, 20 bp, mouse
ggggagagaggctttgactc

SEQ ID NO: 686937 - DNA, 20 bp, mouse
ggcgaacaaaggacgactta

SEQ ID NO: 686938 - DNA, 20 bp, mouse
gtatcagaatggagggccca

SEQ ID NO: 686939 - DNA, 20 bp, mouse
ggaaggcgaaggtgcgggga

SEQ ID NO: 686940 - DNA, 20 bp, mouse
gtgacgcaaacgtctctcat

SEQ ID NO: 686941 - DNA, 20 bp, mouse
gtacacagccggggagagaa

SEQ ID NO: 686942 - DNA, 20 bp, mouse
gcctcagcctatcagaatgg

SEQ ID NO: 686943 - DNA, 20 bp, mouse
gtgggagcacaacggatccc

SEQ ID NO: 686944 - DNA, 20 bp, mouse
gtatccttgcagtggtgatt

SEQ ID NO: 686945 - DNA, 20 bp, mouse
gcaacccaatcaccactgca

SEQ ID NO: 686946 - DNA, 20 bp, mouse
gtagttgcggcattctgtgc

SEQ ID NO: 686947 - DNA, 20 bp, mouse
gacagctaggacgaaggaaa

SEQ ID NO: 686948 - DNA, 20 bp, mouse
ggttaatcgtggaggaggag

SEQ ID NO: 686949 - DNA, 20 bp, mouse
gagggaatagttaatcgtgg

SEQ ID NO: 686950 - DNA, 20 bp, mouse
ggaaagggaatagttaatcg

SEQ ID NO: 686951 - DNA, 20 bp, mouse
gacacgtagttgaagtggga

SEQ ID NO: 686952 - DNA, 20 bp, mouse
gcaggacgtcactttcccag

SEQ ID NO: 686953 - DNA, 20 bp, mouse
ggaaataaaagggtacagct

SEQ ID NO: 686954 - DNA, 20 bp, mouse
ggcgaacgaacgaacgctac

SEQ ID NO: 686955 - DNA, 20 bp, mouse
gaagggtacagctaggacga

SEQ ID NO: 686956 - DNA, 20 bp, mouse
gctgacgcgcgattggcggg

SEQ ID NO: 686957 - DNA, 20 bp, mouse
ggccgtaaaggggcggagac

SEQ ID NO: 686958 - DNA, 20 bp, mouse
gccatcgtgccgtaaagggg

SEQ ID NO: 686959 - DNA, 20 bp, mouse
ggcagcgtgtgctgtagcgt

SEQ ID NO: 686960 - DNA, 20 bp, mouse
gcgaccatcgtgccgtaaag

SEQ ID NO: 686961 - DNA, 20 bp, mouse
gaagaagatggcggccgtcg

SEQ ID NO: 686962 - DNA, 20 bp, mouse
ggcctccctccgcgaggaaa

SEQ ID NO: 686963 - DNA, 20 bp, mouse
gcgccagccgagccagacga

SEQ ID NO: 686964 - DNA, 20 bp, mouse
gcagccgagccagacgacgg

SEQ ID NO: 686965 - DNA, 20 bp, mouse
gcgtcagcgctgaaacatcg

SEQ ID NO: 686966 - DNA, 20 bp, mouse
gcctccccgcccatctgcgg

SEQ ID NO: 686967 - DNA, 20 bp, mouse
ggacaggggcggagaagagg

SEQ ID NO: 686968 - DNA, 20 bp, mouse
gagaagaggtggctatcacc

SEQ ID NO: 686969 - DNA, 20 bp, mouse
ggcgtgtggccgggtgacag

SEQ ID NO: 686970 - DNA, 20 bp, mouse
gaatgtgtgcgcgtgtggcc

SEQ ID NO: 686971 - DNA, 20 bp, mouse
gcacccggacgctcgttgag

SEQ ID NO: 686972 - DNA, 20 bp, mouse
gcccggaatgtgtgcgcgtg

SEQ ID NO: 686973 - DNA, 20 bp, mouse
gcgcagctcctcaccggtga

SEQ ID NO: 686974 - DNA, 20 bp, mouse
ggctgatagaaggaccgcgg

SEQ ID NO: 686975 - DNA, 20 bp, mouse
gcggccgcagacagcgggac

SEQ ID NO: 686976 - DNA, 20 bp, mouse
gaggacggtgggattctgga

SEQ ID NO: 686977 - DNA, 20 bp, mouse
gtaggcgaaggtggctgaat

SEQ ID NO: 686978 - DNA, 20 bp, mouse
gtctcggagctgaggacggt

SEQ ID NO: 686979 - DNA, 20 bp, mouse
gaggcacagagcttgcgcaa

SEQ ID NO: 686980 - DNA, 20 bp, mouse
gcgaaggtggctgaataggg

SEQ ID NO: 686981 - DNA, 20 bp, mouse
ggctgaggacggtgggattc

SEQ ID NO: 686982 - DNA, 20 bp, mouse
gtccgaatccactgtgtcag

SEQ ID NO: 686983 - DNA, 20 bp, mouse
gcagcagcctccgtgcgcgt

SEQ ID NO: 686984 - DNA, 20 bp, mouse
gcggaagattctcggagctg

SEQ ID NO: 686985 - DNA, 20 bp, mouse
gggagggtttacataggcga

SEQ ID NO: 686986 - DNA, 20 bp, mouse
gagatcgcacagaatgactt

SEQ ID NO: 686987 - DNA, 20 bp, mouse
gtaactaaggctcagtaatc

SEQ ID NO: 686988 - DNA, 20 bp, mouse
gtcatactgggctagagcta

SEQ ID NO: 686989 - DNA, 20 bp, mouse
gctgcattatggtgtcatac

SEQ ID NO: 686990 - DNA, 20 bp, mouse
gctaaggctcagtaatctgg

SEQ ID NO: 686991 - DNA, 20 bp, mouse
gctgggctagagctagggat

SEQ ID NO: 686992 - DNA, 20 bp, mouse
gctgtgcgatctatagctaa

SEQ ID NO: 686993 - DNA, 20 bp, mouse
gtagttactgcatagttcta

SEQ ID NO: 686994 - DNA, 20 bp, mouse
gcttgagggttcagattgtg

SEQ ID NO: 686995 - DNA, 20 bp, mouse
gcatagaagccaggtaatag

SEQ ID NO: 686996 - DNA, 20 bp, mouse
gcgaccccgcctctcctctt

SEQ ID NO: 686997 - DNA, 20 bp, mouse
gcggggtcgggtcagcgaca

SEQ ID NO: 686998 - DNA, 20 bp, mouse
ggtggtgaggctgatcactg

SEQ ID NO: 686999 - DNA, 20 bp, mouse
gtggggcagtggtcaacaca

SEQ ID NO: 687000 - DNA, 20 bp, mouse
gcgggtcagcgacagggttg

SEQ ID NO: 687001 - DNA, 20 bp, mouse
ggggaaggacacaggaacct

SEQ ID NO: 687002 - DNA, 20 bp, mouse
gccctggccccagcttggaa

SEQ ID NO: 687003 - DNA, 20 bp, mouse
ggtgaggctgatcactgtgg

SEQ ID NO: 687004 - DNA, 20 bp, mouse
gcatctcttgagttgagtct

SEQ ID NO: 687005 - DNA, 20 bp, mouse
ggagtcagtgacaccaaagt

SEQ ID NO: 687006 - DNA, 20 bp, mouse
ggcccctcggagggtggcga

SEQ ID NO: 687007 - DNA, 20 bp, mouse
ggggccggcgggagccaatg

SEQ ID NO: 687008 - DNA, 20 bp, mouse
ggtgccaaggtgtgcggaag

SEQ ID NO: 687009 - DNA, 20 bp, mouse
gcggagagccctgtcctcta

SEQ ID NO: 687010 - DNA, 20 bp, mouse
ggcgcgatgcgccccaggga

SEQ ID NO: 687011 - DNA, 20 bp, mouse
gggcaccgcccctcggaggg

SEQ ID NO: 687012 - DNA, 20 bp, mouse
gcgtccccgccctagaggac

SEQ ID NO: 687013 - DNA, 20 bp, mouse
gcaacagcgaagctttctgc

SEQ ID NO: 687014 - DNA, 20 bp, mouse
gccttggcaccgcccctcgg

SEQ ID NO: 687015 - DNA, 20 bp, mouse
gcgcgcgcaggcgctttaga

SEQ ID NO: 687016 - DNA, 20 bp, mouse
gtctcctagcaactgtgggg

SEQ ID NO: 687017 - DNA, 20 bp, mouse
gccggggcgagggtctagag

SEQ ID NO: 687018 - DNA, 20 bp, mouse
gtgtcagcgctggctaaaag

SEQ ID NO: 687019 - DNA, 20 bp, mouse
gacgtctcctagcaactgtg

SEQ ID NO: 687020 - DNA, 20 bp, mouse
gcctagcaactgtggggcgg

SEQ ID NO: 687021 - DNA, 20 bp, mouse
gcaacaatcgcggacctcct

SEQ ID NO: 687022 - DNA, 20 bp, mouse
gggcacccaagcggccgtgt

SEQ ID NO: 687023 - DNA, 20 bp, mouse
gtgttcctaggccggggcga

SEQ ID NO: 687024 - DNA, 20 bp, mouse
gcttaggaaggcaaggtaga

SEQ ID NO: 687025 - DNA, 20 bp, mouse
ggtaggaacgccaggcgctc

SEQ ID NO: 687026 - DNA, 20 bp, mouse
ggggacgggtgggaccgccg

SEQ ID NO: 687027 - DNA, 20 bp, mouse
gcgggatgcttccctatctc

SEQ ID NO: 687028 - DNA, 20 bp, mouse
ggacgggtggccagcaggga

SEQ ID NO: 687029 - DNA, 20 bp, mouse
gtcaaccgctggcggaagga

SEQ ID NO: 687030 - DNA, 20 bp, mouse
gaaacccgggtggagagatc

SEQ ID NO: 687031 - DNA, 20 bp, mouse
gaaggccacgtcagcctcgg

SEQ ID NO: 687032 - DNA, 20 bp, mouse
ggggaccgccgaggctgacg

SEQ ID NO: 687033 - DNA, 20 bp, mouse
gagggtgggtatccttgaaa

SEQ ID NO: 687034 - DNA, 20 bp, mouse
gacggccgcaagatgcctgt

SEQ ID NO: 687035 - DNA, 20 bp, mouse
ggccttctgtgtggctgcgg

SEQ ID NO: 687036 - DNA, 20 bp, mouse
ggtgcgcaggcgcgtcccaa

SEQ ID NO: 687037 - DNA, 20 bp, mouse
gtccggcctcggccgcgcgg

SEQ ID NO: 687038 - DNA, 20 bp, mouse
ggagccgcacagcagccctt

SEQ ID NO: 687039 - DNA, 20 bp, mouse
ggggaagcgctacgcagcgc

SEQ ID NO: 687040 - DNA, 20 bp, mouse
ggcggccgaggccggaagct

SEQ ID NO: 687041 - DNA, 20 bp, mouse
gtgcgcactgcgcccccgcg

SEQ ID NO: 687042 - DNA, 20 bp, mouse
gcctcccgcccacgtcacag

SEQ ID NO: 687043 - DNA, 20 bp, mouse
ggccaggggccgctgtgacg

SEQ ID NO: 687044 - DNA, 20 bp, mouse
ggggccgctgtgacgtgggc

SEQ ID NO: 687045 - DNA, 20 bp, mouse
gtggggtggggtgtatgagt

SEQ ID NO: 687046 - DNA, 20 bp, mouse
gtgctgggatctgtagtttg

SEQ ID NO: 687047 - DNA, 20 bp, mouse
gttgacgtctgggtgctcgc

SEQ ID NO: 687048 - DNA, 20 bp, mouse
gcccagcagccccgcatggc

SEQ ID NO: 687049 - DNA, 20 bp, mouse
ggcatggcaggctcgatcct

SEQ ID NO: 687050 - DNA, 20 bp, mouse
gtctcattggctgtttgccc

SEQ ID NO: 687051 - DNA, 20 bp, mouse
gaaaaaaaaaggcgagatgt

SEQ ID NO: 687052 - DNA, 20 bp, mouse
gaagggctggcttgacgtct

SEQ ID NO: 687053 - DNA, 20 bp, mouse
gagatcccagcagccccgca

SEQ ID NO: 687054 - DNA, 20 bp, mouse
ggcctgccatgcggggctgc

SEQ ID NO: 687055 - DNA, 20 bp, mouse
gaagctctttacatttcagc

SEQ ID NO: 687056 - DNA, 20 bp, mouse
gcgcacgcgtacttcccgag

SEQ ID NO: 687057 - DNA, 20 bp, mouse
gcgaatgggccaccgaggga

SEQ ID NO: 687058 - DNA, 20 bp, mouse
gacggcgaatgggccaccga

SEQ ID NO: 687059 - DNA, 20 bp, mouse
gccccctggagcggtccgag

SEQ ID NO: 687060 - DNA, 20 bp, mouse
gtcgccttctgcttgggcca

SEQ ID NO: 687061 - DNA, 20 bp, mouse
gtacttcccgagaggcggaa

SEQ ID NO: 687062 - DNA, 20 bp, mouse
ggctgagaggcgtgtctcca

SEQ ID NO: 687063 - DNA, 20 bp, mouse
gggcgcctcgccttctgctt

SEQ ID NO: 687064 - DNA, 20 bp, mouse
gactgtgctccctccctcgg

SEQ ID NO: 687065 - DNA, 20 bp, mouse
gttcccgagaggcggaacgg

SEQ ID NO: 687066 - DNA, 20 bp, mouse
gggggggaaaaggtcgcgaa

SEQ ID NO: 687067 - DNA, 20 bp, mouse
gggcgcggagtcaatcgagg

SEQ ID NO: 687068 - DNA, 20 bp, mouse
ggaggcggagggccctttaa

SEQ ID NO: 687069 - DNA, 20 bp, mouse
gccgaagcacacaccgtctt

SEQ ID NO: 687070 - DNA, 20 bp, mouse
ggccgcgcaagtgagagcct

SEQ ID NO: 687071 - DNA, 20 bp, mouse
gtaagcggccgtggcgggga

SEQ ID NO: 687072 - DNA, 20 bp, mouse
ggcggagtcaatcgaggagg

SEQ ID NO: 687073 - DNA, 20 bp, mouse
gtacggcgggacctgcgtgg

SEQ ID NO: 687074 - DNA, 20 bp, mouse
ggcgggcgcggagtcaatcg

SEQ ID NO: 687075 - DNA, 20 bp, mouse
gtccacttccggggtcaccg

SEQ ID NO: 687076 - DNA, 20 bp, mouse
ggggacaaattagtgcggac

SEQ ID NO: 687077 - DNA, 20 bp, mouse
gaacaaacaaggctctgtaa

SEQ ID NO: 687078 - DNA, 20 bp, mouse
gtctgaccccgggctttgac

SEQ ID NO: 687079 - DNA, 20 bp, mouse
ggaagaggcggggccttctt

SEQ ID NO: 687080 - DNA, 20 bp, mouse
ggacgcactgagttgtctac

SEQ ID NO: 687081 - DNA, 20 bp, mouse
gccgcggggacaaattagtg

SEQ ID NO: 687082 - DNA, 20 bp, mouse
gactgaccctgtcaaagccc

SEQ ID NO: 687083 - DNA, 20 bp, mouse
gagacaactcagtgcgtcct

SEQ ID NO: 687084 - DNA, 20 bp, mouse
gggcttggttgttatagtgg

SEQ ID NO: 687085 - DNA, 20 bp, mouse
gagggtcagtttatcggaga

SEQ ID NO: 687086 - DNA, 20 bp, mouse
gtgaccgtcaaggccaaaat

SEQ ID NO: 687087 - DNA, 20 bp, mouse
gcggagtcgctatgcatcac

SEQ ID NO: 687088 - DNA, 20 bp, mouse
gaccggggaggggtttccac

SEQ ID NO: 687089 - DNA, 20 bp, mouse
gaggaacggagagcgctctc

SEQ ID NO: 687090 - DNA, 20 bp, mouse
gagacctcccggaaccgggg

SEQ ID NO: 687091 - DNA, 20 bp, mouse
ggaagagggcgtggtgaata

SEQ ID NO: 687092 - DNA, 20 bp, mouse
gcggtctgtgcgcgcgtcgc

SEQ ID NO: 687093 - DNA, 20 bp, mouse
gggaaacccctccccggttc

SEQ ID NO: 687094 - DNA, 20 bp, mouse
ggatctggcgcagttgctat

SEQ ID NO: 687095 - DNA, 20 bp, mouse
ggtgcctacggtgaccgtca

SEQ ID NO: 687096 - DNA, 20 bp, mouse
gcaccaaggcggggcggcag

SEQ ID NO: 687097 - DNA, 20 bp, mouse
gacgcccatcggcgctgtcc

SEQ ID NO: 687098 - DNA, 20 bp, mouse
ggctgtggaggagcgcgctg

SEQ ID NO: 687099 - DNA, 20 bp, mouse
gcgcccctggacagcgccga

SEQ ID NO: 687100 - DNA, 20 bp, mouse
gcctaccctgcgctggtgag

SEQ ID NO: 687101 - DNA, 20 bp, mouse
gaatcggaaggcatcatccc

SEQ ID NO: 687102 - DNA, 20 bp, mouse
gtgcactcaccaaggcgggg

SEQ ID NO: 687103 - DNA, 20 bp, mouse
ggtccaggggcggcccagcg

SEQ ID NO: 687104 - DNA, 20 bp, mouse
ggcagcggagtggggcatgc

SEQ ID NO: 687105 - DNA, 20 bp, mouse
gacagcgccgatgggcgtgt

SEQ ID NO: 687106 - DNA, 20 bp, mouse
gcaaactctccgtaccccgg

SEQ ID NO: 687107 - DNA, 20 bp, mouse
gactctgagccgccggggta

SEQ ID NO: 687108 - DNA, 20 bp, mouse
ggactcactctgagccgccg

SEQ ID NO: 687109 - DNA, 20 bp, mouse
gggctcagagtgagtcgcgc

SEQ ID NO: 687110 - DNA, 20 bp, mouse
ggaggcctgtcagatttagt

SEQ ID NO: 687111 - DNA, 20 bp, mouse
gaggacttttgtatgctctc

SEQ ID NO: 687112 - DNA, 20 bp, mouse
gtctacgcgactacaagtcc

SEQ ID NO: 687113 - DNA, 20 bp, mouse
ggggtgggacgacattcttg

SEQ ID NO: 687114 - DNA, 20 bp, mouse
gctgacaggcctcgctctgg

SEQ ID NO: 687115 - DNA, 20 bp, mouse
gaatctgacaggcctcgctc

SEQ ID NO: 687116 - DNA, 20 bp, mouse
gtgacggagaggtcggactg

SEQ ID NO: 687117 - DNA, 20 bp, mouse
ggaatcccgggcagagggca

SEQ ID NO: 687118 - DNA, 20 bp, mouse
gcaaagggcctcaccaactc

SEQ ID NO: 687119 - DNA, 20 bp, mouse
ggcgccgcgcaacacggcag

SEQ ID NO: 687120 - DNA, 20 bp, mouse
gcctcaccaactccggttga

SEQ ID NO: 687121 - DNA, 20 bp, mouse
gcggagaggtcggactgggg

SEQ ID NO: 687122 - DNA, 20 bp, mouse
ggcggcgccgtaaagtgcgt

SEQ ID NO: 687123 - DNA, 20 bp, mouse
gaaaaacaacgctacttcca

SEQ ID NO: 687124 - DNA, 20 bp, mouse
gaacgctacttccacggggt

SEQ ID NO: 687125 - DNA, 20 bp, mouse
gtagggagataggttttagc

SEQ ID NO: 687126 - DNA, 20 bp, mouse
gcggagaccaaggagctcga

SEQ ID NO: 687127 - DNA, 20 bp, mouse
gggcgcgaggccgtgggggt

SEQ ID NO: 687128 - DNA, 20 bp, mouse
ggagctccttggtctccggt

SEQ ID NO: 687129 - DNA, 20 bp, mouse
ggagtcacagaggaagtagg

SEQ ID NO: 687130 - DNA, 20 bp, mouse
gcattggcgcgaggccgtgg

SEQ ID NO: 687131 - DNA, 20 bp, mouse
gggtcggtttagagtcacag

SEQ ID NO: 687132 - DNA, 20 bp, mouse
gctaaaccgaccggagacca

SEQ ID NO: 687133 - DNA, 20 bp, mouse
gggcctcgcgccaatgcgcg

SEQ ID NO: 687134 - DNA, 20 bp, mouse
gaaaacaatccttttcacgt

SEQ ID NO: 687135 - DNA, 20 bp, mouse
gcatcagttcctacgtgaaa

SEQ ID NO: 687136 - DNA, 20 bp, mouse
gtgtccctcacaatgactct

SEQ ID NO: 687137 - DNA, 20 bp, mouse
gacgccgagagtcattgtga

SEQ ID NO: 687138 - DNA, 20 bp, mouse
ggggcaaggtaggcttgata

SEQ ID NO: 687139 - DNA, 20 bp, mouse
gagggacacagtaggctgtt

SEQ ID NO: 687140 - DNA, 20 bp, mouse
gctgcagagaactaatccga

SEQ ID NO: 687141 - DNA, 20 bp, mouse
ggggctgggctgggttccgg

SEQ ID NO: 687142 - DNA, 20 bp, mouse
gggcgccgacagctccgcat

SEQ ID NO: 687143 - DNA, 20 bp, mouse
ggcgcggcggtggacgacgc

SEQ ID NO: 687144 - DNA, 20 bp, mouse
gcctagccggcctgaaggca

SEQ ID NO: 687145 - DNA, 20 bp, mouse
gcccgcccatgcggagctgt

SEQ ID NO: 687146 - DNA, 20 bp, mouse
ggtaaaactgggtgagtctg

SEQ ID NO: 687147 - DNA, 20 bp, mouse
gccggaaggtggctacgaag

SEQ ID NO: 687148 - DNA, 20 bp, mouse
ggggaaagcttcccgtagag

SEQ ID NO: 687149 - DNA, 20 bp, mouse
gaggccctacagtgtaaaac

SEQ ID NO: 687150 - DNA, 20 bp, mouse
ggctacgaaggggctgacca

SEQ ID NO: 687151 - DNA, 20 bp, mouse
gggaacacaggaccggaagg

SEQ ID NO: 687152 - DNA, 20 bp, mouse
ggagagggcgatcagagccc

SEQ ID NO: 687153 - DNA, 20 bp, mouse
ggctctgatcgccctctcta

SEQ ID NO: 687154 - DNA, 20 bp, mouse
gctacctggcgggagaaaaa

SEQ ID NO: 687155 - DNA, 20 bp, mouse
gggcgctgccgtttacggaa

SEQ ID NO: 687156 - DNA, 20 bp, mouse
gtagagggatgcaacaatcg

SEQ ID NO: 687157 - DNA, 20 bp, mouse
gcccgcctccagtccagacg

SEQ ID NO: 687158 - DNA, 20 bp, mouse
gttaccatagcggccgcgtc

SEQ ID NO: 687159 - DNA, 20 bp, mouse
ggccgctatggtaacgcgtc

SEQ ID NO: 687160 - DNA, 20 bp, mouse
gagtccagacgcggccgcta

SEQ ID NO: 687161 - DNA, 20 bp, mouse
ggcaccttaggagatgtaga

SEQ ID NO: 687162 - DNA, 20 bp, mouse
gtaacgcgtcgggatttctg

SEQ ID NO: 687163 - DNA, 20 bp, mouse
ggatgcaacaatcgtggtgt

SEQ ID NO: 687164 - DNA, 20 bp, mouse
gccagtcgcgccctagttgt

SEQ ID NO: 687165 - DNA, 20 bp, mouse
gtaggatgaaggtgcacctt

SEQ ID NO: 687166 - DNA, 20 bp, mouse
gaggtcgagaaggtggcgtg

SEQ ID NO: 687167 - DNA, 20 bp, mouse
gcgccgaggccctggtggaa

SEQ ID NO: 687168 - DNA, 20 bp, mouse
gccagtgcccagagttccta

SEQ ID NO: 687169 - DNA, 20 bp, mouse
gtctgccagcacagcggccg

SEQ ID NO: 687170 - DNA, 20 bp, mouse
ggggcggcttctgtgtgttg

SEQ ID NO: 687171 - DNA, 20 bp, mouse
gtgaagtagcgaggtcgaga

SEQ ID NO: 687172 - DNA, 20 bp, mouse
gcagaagccgcccgaggcta

SEQ ID NO: 687173 - DNA, 20 bp, mouse
gcagcagcagccatgggcgc

SEQ ID NO: 687174 - DNA, 20 bp, mouse
gcgcgcgttgctaggagaga

SEQ ID NO: 687175 - DNA, 20 bp, mouse
gcggcctgctgacgtggacc

SEQ ID NO: 687176 - DNA, 20 bp, mouse
gtgggtcttggggtcctgtt

SEQ ID NO: 687177 - DNA, 20 bp, mouse
ggcccggttgcaggcgattg

SEQ ID NO: 687178 - DNA, 20 bp, mouse
gtggcagcagaggcacccat

SEQ ID NO: 687179 - DNA, 20 bp, mouse
gcccgggaggactgggtctt

SEQ ID NO: 687180 - DNA, 20 bp, mouse
ggggccccgcaatgacgtca

SEQ ID NO: 687181 - DNA, 20 bp, mouse
gactgagcccaggatcacag

SEQ ID NO: 687182 - DNA, 20 bp, mouse
gagactccgctcgccctccg

SEQ ID NO: 687183 - DNA, 20 bp, mouse
gaagattggtctgtacatgg

SEQ ID NO: 687184 - DNA, 20 bp, mouse
ggaaatagagcggctgtcac

SEQ ID NO: 687185 - DNA, 20 bp, mouse
gaatgtgagatgacacaagt

SEQ ID NO: 687186 - DNA, 20 bp, mouse
ggtgcagagtagaggcatta

SEQ ID NO: 687187 - DNA, 20 bp, mouse
gggacacctgcaccgtcagt

SEQ ID NO: 687188 - DNA, 20 bp, mouse
gtccggcaggtgcagagtag

SEQ ID NO: 687189 - DNA, 20 bp, mouse
ggaaccctgccctcgaaagc

SEQ ID NO: 687190 - DNA, 20 bp, mouse
gcggtgcaggtgtcccatag

SEQ ID NO: 687191 - DNA, 20 bp, mouse
gggcccagccaagtttgttt

SEQ ID NO: 687192 - DNA, 20 bp, mouse
ggagtagaggcattagggcc

SEQ ID NO: 687193 - DNA, 20 bp, mouse
gtcaaattacatacacgttg

SEQ ID NO: 687194 - DNA, 20 bp, mouse
gtgcaaggcaagttctgtca

SEQ ID NO: 687195 - DNA, 20 bp, mouse
gaaggaaagaccatctttct

SEQ ID NO: 687196 - DNA, 20 bp, mouse
gagctcgcccgggtcgtggt

SEQ ID NO: 687197 - DNA, 20 bp, mouse
gcccgcgcatgcggactcgg

SEQ ID NO: 687198 - DNA, 20 bp, mouse
gccgccgccgagcgccgagg

SEQ ID NO: 687199 - DNA, 20 bp, mouse
ggcccagctcgcccgggtcg

SEQ ID NO: 687200 - DNA, 20 bp, mouse
gggtaaggccagagagtctc

SEQ ID NO: 687201 - DNA, 20 bp, mouse
gaggctgcgtccgctggtcg

SEQ ID NO: 687202 - DNA, 20 bp, mouse
gcctgccaagccagcccgcg

SEQ ID NO: 687203 - DNA, 20 bp, mouse
gccggcccagaagggctcta

SEQ ID NO: 687204 - DNA, 20 bp, mouse
gcccgcgaggccggcccaga

SEQ ID NO: 687205 - DNA, 20 bp, mouse
ggggcccgcgcatgcggact

SEQ ID NO: 687206 - DNA, 20 bp, mouse
gctacgagatgccatctcga

SEQ ID NO: 687207 - DNA, 20 bp, mouse
ggggctctcaccagctccgg

SEQ ID NO: 687208 - DNA, 20 bp, mouse
ggcgccgaggcagccaatgg

SEQ ID NO: 687209 - DNA, 20 bp, mouse
ggaaaaggtccgcctgaggc

SEQ ID NO: 687210 - DNA, 20 bp, mouse
gtccgctgtgttcgggtctc

SEQ ID NO: 687211 - DNA, 20 bp, mouse
gggtatggcaacgctgggac

SEQ ID NO: 687212 - DNA, 20 bp, mouse
gcgttgccataccatcgaga

SEQ ID NO: 687213 - DNA, 20 bp, mouse
gccggcggtccgctgtgttc

SEQ ID NO: 687214 - DNA, 20 bp, mouse
ggagatggtggcaggtccgg

SEQ ID NO: 687215 - DNA, 20 bp, mouse
ggcgtcgcgctagtgctcgc

SEQ ID NO: 687216 - DNA, 20 bp, mouse
gcccgcgaagcggaagcatt

SEQ ID NO: 687217 - DNA, 20 bp, mouse
gagaacccgggatggatgag

SEQ ID NO: 687218 - DNA, 20 bp, mouse
ggacgccggggcccgcgaag

SEQ ID NO: 687219 - DNA, 20 bp, mouse
gcccgcccccacatgctcat

SEQ ID NO: 687220 - DNA, 20 bp, mouse
gcggaatgcgggtcacgacg

SEQ ID NO: 687221 - DNA, 20 bp, mouse
gcccaatgagggatcagggg

SEQ ID NO: 687222 - DNA, 20 bp, mouse
gtcgcagctaaaagagaggg

SEQ ID NO: 687223 - DNA, 20 bp, mouse
gacctcgcagctaaaagaga

SEQ ID NO: 687224 - DNA, 20 bp, mouse
ggcccctacccccgcctctt

SEQ ID NO: 687225 - DNA, 20 bp, mouse
gcctctgagagaacccggga

SEQ ID NO: 687226 - DNA, 20 bp, mouse
gaactggggcgcaacctttc

SEQ ID NO: 687227 - DNA, 20 bp, mouse
gtcgtgcggcgctgccacat

SEQ ID NO: 687228 - DNA, 20 bp, mouse
gcacgaaagctccggagctc

SEQ ID NO: 687229 - DNA, 20 bp, mouse
gcgggaagggttaaggtggt

SEQ ID NO: 687230 - DNA, 20 bp, mouse
gccggagctccggtagaact

SEQ ID NO: 687231 - DNA, 20 bp, mouse
gccacattggctccgactat

SEQ ID NO: 687232 - DNA, 20 bp, mouse
ggagcctgcagctactaagc

SEQ ID NO: 687233 - DNA, 20 bp, mouse
ggtagaactcggtccccgaa

SEQ ID NO: 687234 - DNA, 20 bp, mouse
gtgggcggggcctcagtgtt

SEQ ID NO: 687235 - DNA, 20 bp, mouse
ggctcccgggctgtagcttc

SEQ ID NO: 687236 - DNA, 20 bp, mouse
ggagagactgttagtgatgt

SEQ ID NO: 687237 - DNA, 20 bp, mouse
gaagatctcagctgggtagt

SEQ ID NO: 687238 - DNA, 20 bp, mouse
ggcatccccaggcaactagt

SEQ ID NO: 687239 - DNA, 20 bp, mouse
ggactgttagtgatgtgggt

SEQ ID NO: 687240 - DNA, 20 bp, mouse
gtctttccggagatttcaaa

SEQ ID NO: 687241 - DNA, 20 bp, mouse
gagtcttcaatgtttctttc

SEQ ID NO: 687242 - DNA, 20 bp, mouse
gtgggtgggaagatctcagc

SEQ ID NO: 687243 - DNA, 20 bp, mouse
gagaaagtgtgtcactatgg

SEQ ID NO: 687244 - DNA, 20 bp, mouse
ggaaacattgaagactgtgg

SEQ ID NO: 687245 - DNA, 20 bp, mouse
gcattgaagactgtggtggt

SEQ ID NO: 687246 - DNA, 20 bp, mouse
gacggtgatcgggatggtca

SEQ ID NO: 687247 - DNA, 20 bp, mouse
gagccctgagcctgagggtc

SEQ ID NO: 687248 - DNA, 20 bp, mouse
ggctgtgccttcggccctgg

SEQ ID NO: 687249 - DNA, 20 bp, mouse
gccctggagatgagatgatg

SEQ ID NO: 687250 - DNA, 20 bp, mouse
gagcctgaccctcaggctca

SEQ ID NO: 687251 - DNA, 20 bp, mouse
ggaagacccatgacggtgat

SEQ ID NO: 687252 - DNA, 20 bp, mouse
gggaccaagtgaagactctg

SEQ ID NO: 687253 - DNA, 20 bp, mouse
gaccatcccgatcaccgtca

SEQ ID NO: 687254 - DNA, 20 bp, mouse
gcgagtcgggagcccatatt

SEQ ID NO: 687255 - DNA, 20 bp, mouse
gggagatgagatgatgtgga

SEQ ID NO: 687256 - DNA, 20 bp, mouse
gcagttggatcctcactcca

SEQ ID NO: 687257 - DNA, 20 bp, mouse
gaacgtgaaccaagtctctc

SEQ ID NO: 687258 - DNA, 20 bp, mouse
gccaaaacatggcatggaac

SEQ ID NO: 687259 - DNA, 20 bp, mouse
ggggcgaagtccctcaacgc

SEQ ID NO: 687260 - DNA, 20 bp, mouse
gcaaacctaggctccagatc

SEQ ID NO: 687261 - DNA, 20 bp, mouse
gggaaccggatctggagcct

SEQ ID NO: 687262 - DNA, 20 bp, mouse
gggttcacgttgctctggga

SEQ ID NO: 687263 - DNA, 20 bp, mouse
gagtacaaagaggacgctca

SEQ ID NO: 687264 - DNA, 20 bp, mouse
gcaagaagaaactaagcagt

SEQ ID NO: 687265 - DNA, 20 bp, mouse
gtggatcctcactccaagga

SEQ ID NO: 687266 - DNA, 20 bp, mouse
gcccaagcggagcctctcgt

SEQ ID NO: 687267 - DNA, 20 bp, mouse
gcatccctggaggtccacgg

SEQ ID NO: 687268 - DNA, 20 bp, mouse
gagaccaccgtggacctcca

SEQ ID NO: 687269 - DNA, 20 bp, mouse
gttacccgtgaataggagga

SEQ ID NO: 687270 - DNA, 20 bp, mouse
gggagcctctcgttggtaga

SEQ ID NO: 687271 - DNA, 20 bp, mouse
ggagcccgtctaccaacgag

SEQ ID NO: 687272 - DNA, 20 bp, mouse
gtacgcacaggaaccgtccc

SEQ ID NO: 687273 - DNA, 20 bp, mouse
ggtaccctcctcctattcac

SEQ ID NO: 687274 - DNA, 20 bp, mouse
gcggcggcgccgcgcccaga

SEQ ID NO: 687275 - DNA, 20 bp, mouse
ggtggacctccagggatgga

SEQ ID NO: 687276 - DNA, 20 bp, mouse
ggcggggagtccgggaaggc

SEQ ID NO: 687277 - DNA, 20 bp, mouse
gccggagcacggtcgtccta

SEQ ID NO: 687278 - DNA, 20 bp, mouse
gtcgggagagagtggtgctt

SEQ ID NO: 687279 - DNA, 20 bp, mouse
gtggcctggggactgcggat

SEQ ID NO: 687280 - DNA, 20 bp, mouse
gtcgccggccccagccgcgg

SEQ ID NO: 687281 - DNA, 20 bp, mouse
gccgccagctgaacttaaag

SEQ ID NO: 687282 - DNA, 20 bp, mouse
gaggctgcgcttgcgcagaa

SEQ ID NO: 687283 - DNA, 20 bp, mouse
ggggcttgggtggttacgtg

SEQ ID NO: 687284 - DNA, 20 bp, mouse
gggcccgcgccgtctggcct

SEQ ID NO: 687285 - DNA, 20 bp, mouse
gtccccaggccagacggcgc

SEQ ID NO: 687286 - DNA, 20 bp, mouse
gtagtggctggcaccgggtg

SEQ ID NO: 687287 - DNA, 20 bp, mouse
gagacggcggtggcgtcttc

SEQ ID NO: 687288 - DNA, 20 bp, mouse
gaagtaaaatgagacggcgg

SEQ ID NO: 687289 - DNA, 20 bp, mouse
ggtggcgtcttctggagagg

SEQ ID NO: 687290 - DNA, 20 bp, mouse
gcgagagcgaggctgctttg

SEQ ID NO: 687291 - DNA, 20 bp, mouse
ggcgaagtaaaatgagacgg

SEQ ID NO: 687292 - DNA, 20 bp, mouse
gctgggaggaagcgcagtag

SEQ ID NO: 687293 - DNA, 20 bp, mouse
gagagagcggatgctcgggc

SEQ ID NO: 687294 - DNA, 20 bp, mouse
ggcggtggcgtcttctggag

SEQ ID NO: 687295 - DNA, 20 bp, mouse
gtcccagaggtcgtcaggta

SEQ ID NO: 687296 - DNA, 20 bp, mouse
gtacttgcgtgggtagttga

SEQ ID NO: 687297 - DNA, 20 bp, mouse
gctagcggagcattgtggga

SEQ ID NO: 687298 - DNA, 20 bp, mouse
gggcgctagcggagcattgt

SEQ ID NO: 687299 - DNA, 20 bp, mouse
gagaggttggaggaccgggg

SEQ ID NO: 687300 - DNA, 20 bp, mouse
gtccgctagcgccacccaaa

SEQ ID NO: 687301 - DNA, 20 bp, mouse
gcagagaggttggaggaccg

SEQ ID NO: 687302 - DNA, 20 bp, mouse
gcggagcattgtgggacggc

SEQ ID NO: 687303 - DNA, 20 bp, mouse
gcctggaaaaatgacgagaa

SEQ ID NO: 687304 - DNA, 20 bp, mouse
gtgcgagtttaaggcaatat

SEQ ID NO: 687305 - DNA, 20 bp, mouse
gcctgcgcactgaccccggc

SEQ ID NO: 687306 - DNA, 20 bp, mouse
gaggccggagcttacgcgag

SEQ ID NO: 687307 - DNA, 20 bp, mouse
ggagcgaagccccacctcct

SEQ ID NO: 687308 - DNA, 20 bp, mouse
ggggcgtggcttaaagaccg

SEQ ID NO: 687309 - DNA, 20 bp, mouse
gtgcctgtccgcagctgctc

SEQ ID NO: 687310 - DNA, 20 bp, mouse
gcgtggcttaaagaccgagg

SEQ ID NO: 687311 - DNA, 20 bp, mouse
gtgtccgcagctgctccggc

SEQ ID NO: 687312 - DNA, 20 bp, mouse
gcttaaagaccgaggaggtg

SEQ ID NO: 687313 - DNA, 20 bp, mouse
gacgcccctcgcgtaagctc

SEQ ID NO: 687314 - DNA, 20 bp, mouse
gccgaaggggcctaggaggc

SEQ ID NO: 687315 - DNA, 20 bp, mouse
gggaagtcccgtcccgtcac

SEQ ID NO: 687316 - DNA, 20 bp, mouse
gaggccccgccccatccatg

SEQ ID NO: 687317 - DNA, 20 bp, mouse
gcgaaacagacctaacgcta

SEQ ID NO: 687318 - DNA, 20 bp, mouse
gagactggacccctagcgtt

SEQ ID NO: 687319 - DNA, 20 bp, mouse
gagtgactctatagagtatt

SEQ ID NO: 687320 - DNA, 20 bp, mouse
gccgccccatccatggggca

SEQ ID NO: 687321 - DNA, 20 bp, mouse
gccggcaccgccttcctcag

SEQ ID NO: 687322 - DNA, 20 bp, mouse
gaacgcgcaaggaacagagc

SEQ ID NO: 687323 - DNA, 20 bp, mouse
gctaagaaacttagtgcttg

SEQ ID NO: 687324 - DNA, 20 bp, mouse
ggtagaacaaaacttgcacg

SEQ ID NO: 687325 - DNA, 20 bp, mouse
gtgacttccgttttaatcaa

SEQ ID NO: 687326 - DNA, 20 bp, mouse
gagcctgcccagggcccaat

SEQ ID NO: 687327 - DNA, 20 bp, mouse
gctgccctcactaccagggg

SEQ ID NO: 687328 - DNA, 20 bp, mouse
gcctgtgtggccatcccatt

SEQ ID NO: 687329 - DNA, 20 bp, mouse
ggtacacatgcgccctgggg

SEQ ID NO: 687330 - DNA, 20 bp, mouse
gaggggtgggtcgtaggaat

SEQ ID NO: 687331 - DNA, 20 bp, mouse
gtacttatgtctggtctagg

SEQ ID NO: 687332 - DNA, 20 bp, mouse
gcatcctgccctcactacca

SEQ ID NO: 687333 - DNA, 20 bp, mouse
ggtcgtaggaattggaggca

SEQ ID NO: 687334 - DNA, 20 bp, mouse
gaacaatagggctgcctgtg

SEQ ID NO: 687335 - DNA, 20 bp, mouse
ggtgctgacatcaacagaca

SEQ ID NO: 687336 - DNA, 20 bp, mouse
gcaaaagaaacacccatcat

SEQ ID NO: 687337 - DNA, 20 bp, mouse
gcaggcacagcctactggac

SEQ ID NO: 687338 - DNA, 20 bp, mouse
gagcctactggacagggatg

SEQ ID NO: 687339 - DNA, 20 bp, mouse
gtcttggcacgggtgatagt

SEQ ID NO: 687340 - DNA, 20 bp, mouse
gatggcccgcccctttgggt

SEQ ID NO: 687341 - DNA, 20 bp, mouse
gggtctggaaaccagctcct

SEQ ID NO: 687342 - DNA, 20 bp, mouse
gggcccaccccgcccatgat

SEQ ID NO: 687343 - DNA, 20 bp, mouse
gcacccatcatgggcggggt

SEQ ID NO: 687344 - DNA, 20 bp, mouse
gcagcaggtagccagttctc

SEQ ID NO: 687345 - DNA, 20 bp, mouse
gaggcggattcgtcgagcag

SEQ ID NO: 687346 - DNA, 20 bp, mouse
ggggaaccaccccttccatg

SEQ ID NO: 687347 - DNA, 20 bp, mouse
gatggggtggattccagaac

SEQ ID NO: 687348 - DNA, 20 bp, mouse
ggaaggggctgggctacaat

SEQ ID NO: 687349 - DNA, 20 bp, mouse
gcctgaggggatacaactct

SEQ ID NO: 687350 - DNA, 20 bp, mouse
gcgggctgacccaagttcct

SEQ ID NO: 687351 - DNA, 20 bp, mouse
gaagcaagcatcagctactc

SEQ ID NO: 687352 - DNA, 20 bp, mouse
gtatagtgttgaggtggcta

SEQ ID NO: 687353 - DNA, 20 bp, mouse
gtgggcatggctgtcccttt

SEQ ID NO: 687354 - DNA, 20 bp, mouse
ggctctgtcccttgccctct

SEQ ID NO: 687355 - DNA, 20 bp, mouse
gcctggaccaggaaggggct

SEQ ID NO: 687356 - DNA, 20 bp, mouse
gcacacagaaggaactggac

SEQ ID NO: 687357 - DNA, 20 bp, mouse
ggccaagctcatcaactctc

SEQ ID NO: 687358 - DNA, 20 bp, mouse
gcccaaggaaatgaaggtaa

SEQ ID NO: 687359 - DNA, 20 bp, mouse
gaaggtgaggtggagatccc

SEQ ID NO: 687360 - DNA, 20 bp, mouse
gccaggagcagaagcgtcac

SEQ ID NO: 687361 - DNA, 20 bp, mouse
gcccgtgggtgcataaggtc

SEQ ID NO: 687362 - DNA, 20 bp, mouse
gactctcagggagaggccca

SEQ ID NO: 687363 - DNA, 20 bp, mouse
ggactggtggagccacctgc

SEQ ID NO: 687364 - DNA, 20 bp, mouse
ggaaagtcccagggtgggca

SEQ ID NO: 687365 - DNA, 20 bp, mouse
gtctccttagcagtccccgt

SEQ ID NO: 687366 - DNA, 20 bp, mouse
ggcggggaggacattggagg

SEQ ID NO: 687367 - DNA, 20 bp, mouse
gcccgccaggcccaatacgg

SEQ ID NO: 687368 - DNA, 20 bp, mouse
ggacggggcggggaggacat

SEQ ID NO: 687369 - DNA, 20 bp, mouse
ggaagccccgcctccgtatt

SEQ ID NO: 687370 - DNA, 20 bp, mouse
gagaagcgggaggacggggc

SEQ ID NO: 687371 - DNA, 20 bp, mouse
gcaagggagaggcgtgtcca

SEQ ID NO: 687372 - DNA, 20 bp, mouse
gcggccagaagcgggaggac

SEQ ID NO: 687373 - DNA, 20 bp, mouse
gggggcggggaggacattgg

SEQ ID NO: 687374 - DNA, 20 bp, mouse
gagctgagtcggccagaagc

SEQ ID NO: 687375 - DNA, 20 bp, mouse
gtccacggatgaagcctatc

SEQ ID NO: 687376 - DNA, 20 bp, mouse
gacaggaatgcttaggggct

SEQ ID NO: 687377 - DNA, 20 bp, mouse
gaagacagtcatcatgtggc

SEQ ID NO: 687378 - DNA, 20 bp, mouse
ggatgcactgcccataatta

SEQ ID NO: 687379 - DNA, 20 bp, mouse
gtctctcacaggaatgctta

SEQ ID NO: 687380 - DNA, 20 bp, mouse
gcatcatgtggcaggagaaa

SEQ ID NO: 687381 - DNA, 20 bp, mouse
gataaagcgataaggccctg

SEQ ID NO: 687382 - DNA, 20 bp, mouse
gggaagacacaccctaatta

SEQ ID NO: 687383 - DNA, 20 bp, mouse
gaagggaagataaagcgata

SEQ ID NO: 687384 - DNA, 20 bp, mouse
ggatcaagaaagtctctcac

SEQ ID NO: 687385 - DNA, 20 bp, mouse
ggaagtggggggggtatagg

SEQ ID NO: 687386 - DNA, 20 bp, mouse
ggacaaacagatgttgagta

SEQ ID NO: 687387 - DNA, 20 bp, mouse
gatgtgaagcgctcgagaaa

SEQ ID NO: 687388 - DNA, 20 bp, mouse
ggaaaaatctggagggaaag

SEQ ID NO: 687389 - DNA, 20 bp, mouse
gtcgctgagtggtcagaacc

SEQ ID NO: 687390 - DNA, 20 bp, mouse
ggtgtgaagcgaagagtggt

SEQ ID NO: 687391 - DNA, 20 bp, mouse
gggttattaacctattacat

SEQ ID NO: 687392 - DNA, 20 bp, mouse
ggcgaagagtggttggtaaa

SEQ ID NO: 687393 - DNA, 20 bp, mouse
gaatggtgtgaagcgaagag

SEQ ID NO: 687394 - DNA, 20 bp, mouse
gctatagtagcctatgtaat

SEQ ID NO: 687395 - DNA, 20 bp, mouse
gctaattattaagaaggcaa

SEQ ID NO: 687396 - DNA, 20 bp, mouse
gcaaaactgggcggagtgga

SEQ ID NO: 687397 - DNA, 20 bp, mouse
gaaccccccacttaggaccg

SEQ ID NO: 687398 - DNA, 20 bp, mouse
gcacccacggtcctaagtgg

SEQ ID NO: 687399 - DNA, 20 bp, mouse
ggagttccatcgccaaaact

SEQ ID NO: 687400 - DNA, 20 bp, mouse
gttccatcgccaaaactggg

SEQ ID NO: 687401 - DNA, 20 bp, mouse
gagaacttgagggggcgtgg

SEQ ID NO: 687402 - DNA, 20 bp, mouse
gagggcagggaatcttccag

SEQ ID NO: 687403 - DNA, 20 bp, mouse
ggggggttcgagatttccaa

SEQ ID NO: 687404 - DNA, 20 bp, mouse
gcgccccctcaagttctcat

SEQ ID NO: 687405 - DNA, 20 bp, mouse
ggcggagtggagggagctct

SEQ ID NO: 687406 - DNA, 20 bp, mouse
gcttaaggggtcagagtcgt

SEQ ID NO: 687407 - DNA, 20 bp, mouse
ggcacagaggtgggagccgt

SEQ ID NO: 687408 - DNA, 20 bp, mouse
gcggctggaggacccgggat

SEQ ID NO: 687409 - DNA, 20 bp, mouse
gggctcccggctggaggacc

SEQ ID NO: 687410 - DNA, 20 bp, mouse
ggtctcagcaagttgcaaga

SEQ ID NO: 687411 - DNA, 20 bp, mouse
ggctgagacgcggagcagaa

SEQ ID NO: 687412 - DNA, 20 bp, mouse
gcccacggaggctgggctcc

SEQ ID NO: 687413 - DNA, 20 bp, mouse
gactctgaccccttaaggct

SEQ ID NO: 687414 - DNA, 20 bp, mouse
gagcagaagggttcccatcc

SEQ ID NO: 687415 - DNA, 20 bp, mouse
gcatctgaagcgatctcttc

SEQ ID NO: 687416 - DNA, 20 bp, mouse
ggccacacgtatcctacgtt

SEQ ID NO: 687417 - DNA, 20 bp, mouse
gtcttctgtggccctaacgt

SEQ ID NO: 687418 - DNA, 20 bp, mouse
gatgctgttcgcctcttctg

SEQ ID NO: 687419 - DNA, 20 bp, mouse
gtggcctttccatgaaactt

SEQ ID NO: 687420 - DNA, 20 bp, mouse
gtcctgatgcccaagtttca

SEQ ID NO: 687421 - DNA, 20 bp, mouse
gtaattgcatgagacttcca

SEQ ID NO: 687422 - DNA, 20 bp, mouse
gagtccgtgggcacaagcta

SEQ ID NO: 687423 - DNA, 20 bp, mouse
gtgcagtcatggtagagaga

SEQ ID NO: 687424 - DNA, 20 bp, mouse
gagactgaatatctagaatc

SEQ ID NO: 687425 - DNA, 20 bp, mouse
gcagtgactgtgtgcagtca

SEQ ID NO: 687426 - DNA, 20 bp, mouse
gcaagcggggcgacaccagg

SEQ ID NO: 687427 - DNA, 20 bp, mouse
ggggatcgcgggaatacgac

SEQ ID NO: 687428 - DNA, 20 bp, mouse
ggcagggagaaggggatcgc

SEQ ID NO: 687429 - DNA, 20 bp, mouse
ggcgacaacaccgacaccga

SEQ ID NO: 687430 - DNA, 20 bp, mouse
ggaaagcagtgcaccggtgg

SEQ ID NO: 687431 - DNA, 20 bp, mouse
gacagaaagcagtgcaccgg

SEQ ID NO: 687432 - DNA, 20 bp, mouse
gcagctggcggcagggagaa

SEQ ID NO: 687433 - DNA, 20 bp, mouse
gggccggaagcggccctctt

SEQ ID NO: 687434 - DNA, 20 bp, mouse
gggctgccgtggtaaggcca

SEQ ID NO: 687435 - DNA, 20 bp, mouse
ggctgcgcccgttaccaaaa

SEQ ID NO: 687436 - DNA, 20 bp, mouse
gcccgcgcgccatctagcgg

SEQ ID NO: 687437 - DNA, 20 bp, mouse
ggggtgctaactctagaaat

SEQ ID NO: 687438 - DNA, 20 bp, mouse
gacgcaacgcggggcgccat

SEQ ID NO: 687439 - DNA, 20 bp, mouse
ggacccgcggcgcacgcagt

SEQ ID NO: 687440 - DNA, 20 bp, mouse
gaggccttagagggaagatc

SEQ ID NO: 687441 - DNA, 20 bp, mouse
gcgcacgcagtcgggatatt

SEQ ID NO: 687442 - DNA, 20 bp, mouse
gagaaaggctaagtggacta

SEQ ID NO: 687443 - DNA, 20 bp, mouse
ggatggcgcgcggggattcg

SEQ ID NO: 687444 - DNA, 20 bp, mouse
gaaggggtctagcttatcat

SEQ ID NO: 687445 - DNA, 20 bp, mouse
gaagaaaacgacaacaccca

SEQ ID NO: 687446 - DNA, 20 bp, mouse
gcacgcgccacgacagaggt

SEQ ID NO: 687447 - DNA, 20 bp, mouse
gaggccacgcgccacgacag

SEQ ID NO: 687448 - DNA, 20 bp, mouse
ggacagaggtgggcgcgcaa

SEQ ID NO: 687449 - DNA, 20 bp, mouse
ggacctgaactgggcgggta

SEQ ID NO: 687450 - DNA, 20 bp, mouse
gcaggctgagtggaacgcga

SEQ ID NO: 687451 - DNA, 20 bp, mouse
ggctcccgaggaaagggcgg

SEQ ID NO: 687452 - DNA, 20 bp, mouse
gagcccgcacccattgggcc

SEQ ID NO: 687453 - DNA, 20 bp, mouse
ggtatcgacctgaactgggc

SEQ ID NO: 687454 - DNA, 20 bp, mouse
gggtgctggcccggcccaat

SEQ ID NO: 687455 - DNA, 20 bp, mouse
gtgggcgcgcaaaggctgcc

SEQ ID NO: 687456 - DNA, 20 bp, mouse
ggtcgcctgagaaccggatg

SEQ ID NO: 687457 - DNA, 20 bp, mouse
gcccgagcgaacaaccctcc

SEQ ID NO: 687458 - DNA, 20 bp, mouse
gccttcccggtctgacaacc

SEQ ID NO: 687459 - DNA, 20 bp, mouse
gacaaccctcccggcctccg

SEQ ID NO: 687460 - DNA, 20 bp, mouse
gaataaaaaaggcacgagga

SEQ ID NO: 687461 - DNA, 20 bp, mouse
ggaacgtgagccaataaaaa

SEQ ID NO: 687462 - DNA, 20 bp, mouse
ggctaatctcacaaattcac

SEQ ID NO: 687463 - DNA, 20 bp, mouse
gggatatagcagtagggttg

SEQ ID NO: 687464 - DNA, 20 bp, mouse
gtccgccccggaggccggga

SEQ ID NO: 687465 - DNA, 20 bp, mouse
gtcgccgcgacgcccgctcc

SEQ ID NO: 687466 - DNA, 20 bp, mouse
gtgggaggcagtccaaccgt

SEQ ID NO: 687467 - DNA, 20 bp, mouse
gggctgcgcaagcgcgtcgt

SEQ ID NO: 687468 - DNA, 20 bp, mouse
ggcgcagcccagagaggcga

SEQ ID NO: 687469 - DNA, 20 bp, mouse
gagtaggattggaaactcta

SEQ ID NO: 687470 - DNA, 20 bp, mouse
gtcaacgtgctgttagctga

SEQ ID NO: 687471 - DNA, 20 bp, mouse
gagtccaaccgtaggccagt

SEQ ID NO: 687472 - DNA, 20 bp, mouse
gcagcccagagaggcgaagg

SEQ ID NO: 687473 - DNA, 20 bp, mouse
gctggtgcgtacagtggtgg

SEQ ID NO: 687474 - DNA, 20 bp, mouse
ggcgtggcctggtcctgaga

SEQ ID NO: 687475 - DNA, 20 bp, mouse
ggtactctgccctttagcct

SEQ ID NO: 687476 - DNA, 20 bp, mouse
gctcagtgtaactctagaac

SEQ ID NO: 687477 - DNA, 20 bp, mouse
ggctttcaaagcaccagagg

SEQ ID NO: 687478 - DNA, 20 bp, mouse
gatgctgtatgtaatgtaaa

SEQ ID NO: 687479 - DNA, 20 bp, mouse
gccaagataaccataagagc

SEQ ID NO: 687480 - DNA, 20 bp, mouse
gctggctttcaaagcaccag

SEQ ID NO: 687481 - DNA, 20 bp, mouse
ggcagcaggccaggactcac

SEQ ID NO: 687482 - DNA, 20 bp, mouse
gagatctgagctaggacctc

SEQ ID NO: 687483 - DNA, 20 bp, mouse
gccataagagcaggactgta

SEQ ID NO: 687484 - DNA, 20 bp, mouse
gtatgctgttttgcatggga

SEQ ID NO: 687485 - DNA, 20 bp, mouse
ggtatgtaatgtaaagggtt

SEQ ID NO: 687486 - DNA, 20 bp, mouse
gcacacctcctggctatagt

SEQ ID NO: 687487 - DNA, 20 bp, mouse
gggagtgcgcatgcgcgcaa

SEQ ID NO: 687488 - DNA, 20 bp, mouse
ggagccacctcttcaggcaa

SEQ ID NO: 687489 - DNA, 20 bp, mouse
ggaattacaggggcttggag

SEQ ID NO: 687490 - DNA, 20 bp, mouse
gtggctcggcacttgagagc

SEQ ID NO: 687491 - DNA, 20 bp, mouse
ggaagcagcatgtaccacac

SEQ ID NO: 687492 - DNA, 20 bp, mouse
gggacgagcccactatagcc

SEQ ID NO: 687493 - DNA, 20 bp, mouse
gagaccatgctatgcccgaa

SEQ ID NO: 687494 - DNA, 20 bp, mouse
gcgagcccactatagccagg

SEQ ID NO: 687495 - DNA, 20 bp, mouse
gacctcttcaggcaaggggg

SEQ ID NO: 687496 - DNA, 20 bp, mouse
gggggcgctaggaccgtccg

SEQ ID NO: 687497 - DNA, 20 bp, mouse
ggggggggacccggcggagg

SEQ ID NO: 687498 - DNA, 20 bp, mouse
ggagcggcgggcggaggcct

SEQ ID NO: 687499 - DNA, 20 bp, mouse
gccagagccagcgcggccac

SEQ ID NO: 687500 - DNA, 20 bp, mouse
gagagggagcgcgacagcga

SEQ ID NO: 687501 - DNA, 20 bp, mouse
ggctcggatagctcccgccg

SEQ ID NO: 687502 - DNA, 20 bp, mouse
ggcccgggaggcaaccccgg

SEQ ID NO: 687503 - DNA, 20 bp, mouse
ggccacggggggcgagcggc

SEQ ID NO: 687504 - DNA, 20 bp, mouse
gggaccacccgaggggcaca

SEQ ID NO: 687505 - DNA, 20 bp, mouse
gggagcgcgacagcgacgga

SEQ ID NO: 687506 - DNA, 20 bp, mouse
gcccctcgggcccgggtgag

SEQ ID NO: 687507 - DNA, 20 bp, mouse
gccccactggagttcctggt

SEQ ID NO: 687508 - DNA, 20 bp, mouse
gcacccagagcagcggtggt

SEQ ID NO: 687509 - DNA, 20 bp, mouse
gcggggccctgggaacggac

SEQ ID NO: 687510 - DNA, 20 bp, mouse
ggggaagttggggaccttga

SEQ ID NO: 687511 - DNA, 20 bp, mouse
gcccctccagccagctctat

SEQ ID NO: 687512 - DNA, 20 bp, mouse
gaagttggggaccttgaggg

SEQ ID NO: 687513 - DNA, 20 bp, mouse
gacccgggcccgaggggcgc

SEQ ID NO: 687514 - DNA, 20 bp, mouse
gggcggagggggccagaggg

SEQ ID NO: 687515 - DNA, 20 bp, mouse
ggggggccggcctcctacgc

SEQ ID NO: 687516 - DNA, 20 bp, mouse
ggggctctggtcatctagga

SEQ ID NO: 687517 - DNA, 20 bp, mouse
gagggctgggagctatccgt

SEQ ID NO: 687518 - DNA, 20 bp, mouse
ggggcctaggggacgggcga

SEQ ID NO: 687519 - DNA, 20 bp, mouse
gaggcagggcgaggaagctc

SEQ ID NO: 687520 - DNA, 20 bp, mouse
ggggaggctcccgaggaggc

SEQ ID NO: 687521 - DNA, 20 bp, mouse
ggtgacccgcaaggcatagg

SEQ ID NO: 687522 - DNA, 20 bp, mouse
gggggtgtctcaggtggaga

SEQ ID NO: 687523 - DNA, 20 bp, mouse
ggccgggcgcgcacgggagt

SEQ ID NO: 687524 - DNA, 20 bp, mouse
ggccggccgggcctagggga

SEQ ID NO: 687525 - DNA, 20 bp, mouse
gagggtgacccgcaaggcat

SEQ ID NO: 687526 - DNA, 20 bp, mouse
gaggctggggacccacaaag

SEQ ID NO: 687527 - DNA, 20 bp, mouse
ggggaatcagagcagtctga

SEQ ID NO: 687528 - DNA, 20 bp, mouse
gtggggacccacaaagcggg

SEQ ID NO: 687529 - DNA, 20 bp, mouse
gggtaacccacccgctttgt

SEQ ID NO: 687530 - DNA, 20 bp, mouse
gccgaaggtgctctgatctc

SEQ ID NO: 687531 - DNA, 20 bp, mouse
ggtctgagggacaggatccc

SEQ ID NO: 687532 - DNA, 20 bp, mouse
ggggagggacaagcctgcaa

SEQ ID NO: 687533 - DNA, 20 bp, mouse
gctttaagaacacctagcaa

SEQ ID NO: 687534 - DNA, 20 bp, mouse
gatcaagtccagcccttgct

SEQ ID NO: 687535 - DNA, 20 bp, mouse
ggggcagaaggatacctatc

SEQ ID NO: 687536 - DNA, 20 bp, mouse
gggagctcgcggagcagcgg

SEQ ID NO: 687537 - DNA, 20 bp, mouse
gaacccgaccgaggcctgac

SEQ ID NO: 687538 - DNA, 20 bp, mouse
ggggaggagcggagcgtcag

SEQ ID NO: 687539 - DNA, 20 bp, mouse
ggcggggcgaggcctggtag

SEQ ID NO: 687540 - DNA, 20 bp, mouse
ggggcggggcgcggtgtgac

SEQ ID NO: 687541 - DNA, 20 bp, mouse
gagggggcggaacccgaccg

SEQ ID NO: 687542 - DNA, 20 bp, mouse
gggagctctcggagtagtga

SEQ ID NO: 687543 - DNA, 20 bp, mouse
ggggcgaggcctggtagagg

SEQ ID NO: 687544 - DNA, 20 bp, mouse
gaggagcggagcgtcagggg

SEQ ID NO: 687545 - DNA, 20 bp, mouse
gctagtggaacagtggggcg

SEQ ID NO: 687546 - DNA, 20 bp, mouse
gtggggaggggcaggtcacg

SEQ ID NO: 687547 - DNA, 20 bp, mouse
gctaatgagcgggttggctc

SEQ ID NO: 687548 - DNA, 20 bp, mouse
gaggagtcagaactaatgag

SEQ ID NO: 687549 - DNA, 20 bp, mouse
gtggtgtaggggatagaaga

SEQ ID NO: 687550 - DNA, 20 bp, mouse
gatccataggcaactgtgat

SEQ ID NO: 687551 - DNA, 20 bp, mouse
gggaggggcaggtcacgggg

SEQ ID NO: 687552 - DNA, 20 bp, mouse
gaagagagcgagcttgaaga

SEQ ID NO: 687553 - DNA, 20 bp, mouse
gtaggggatagaagatggat

SEQ ID NO: 687554 - DNA, 20 bp, mouse
gagtgctctcaaactctgta

SEQ ID NO: 687555 - DNA, 20 bp, mouse
gctattcaagtagttctgta

SEQ ID NO: 687556 - DNA, 20 bp, mouse
gaataacagtactcaaccag

SEQ ID NO: 687557 - DNA, 20 bp, mouse
ggggacctacaacggtggag

SEQ ID NO: 687558 - DNA, 20 bp, mouse
gaataaacttatgaagaaag

SEQ ID NO: 687559 - DNA, 20 bp, mouse
gaaacccataggtaccaccc

SEQ ID NO: 687560 - DNA, 20 bp, mouse
gtcttcataagtttattctg

SEQ ID NO: 687561 - DNA, 20 bp, mouse
ggaaagggggacctcgccac

SEQ ID NO: 687562 - DNA, 20 bp, mouse
gacagaaagaacagtgaact

SEQ ID NO: 687563 - DNA, 20 bp, mouse
ggactgccacactgatgtca

SEQ ID NO: 687564 - DNA, 20 bp, mouse
gctctcaccagcaaacccat

SEQ ID NO: 687565 - DNA, 20 bp, mouse
gcaggtcctttctcccaaaa

SEQ ID NO: 687566 - DNA, 20 bp, mouse
ggcccccgaacacccacact

SEQ ID NO: 687567 - DNA, 20 bp, mouse
gagcacggggcttcggatga

SEQ ID NO: 687568 - DNA, 20 bp, mouse
gccctgggagacaacggctg

SEQ ID NO: 687569 - DNA, 20 bp, mouse
gggtgtcggggacgacgttg

SEQ ID NO: 687570 - DNA, 20 bp, mouse
gtgcgccgtggggttgctat

SEQ ID NO: 687571 - DNA, 20 bp, mouse
gtccccagccgttgtctccc

SEQ ID NO: 687572 - DNA, 20 bp, mouse
gaccgagtgtgggtgttcgg

SEQ ID NO: 687573 - DNA, 20 bp, mouse
gccattcagtcaagggacga

SEQ ID NO: 687574 - DNA, 20 bp, mouse
ggggcgctcccgtgacgtca

SEQ ID NO: 687575 - DNA, 20 bp, mouse
gctaggagccacctcgtctt

SEQ ID NO: 687576 - DNA, 20 bp, mouse
gctgacccgcactagtccga

SEQ ID NO: 687577 - DNA, 20 bp, mouse
gcggacgagctgggaactgg

SEQ ID NO: 687578 - DNA, 20 bp, mouse
ggactagtgcgggtcagcgg

SEQ ID NO: 687579 - DNA, 20 bp, mouse
gacccgcactagtccgatgg

SEQ ID NO: 687580 - DNA, 20 bp, mouse
gtcccagctcgtccgctgtg

SEQ ID NO: 687581 - DNA, 20 bp, mouse
gggccagcggtctccgccat

SEQ ID NO: 687582 - DNA, 20 bp, mouse
gctcgctgaggaccgcacag

SEQ ID NO: 687583 - DNA, 20 bp, mouse
gaccgcacagcggacgagct

SEQ ID NO: 687584 - DNA, 20 bp, mouse
gccgctggccagaactgcag

SEQ ID NO: 687585 - DNA, 20 bp, mouse
ggggagaatcgttccttccc

SEQ ID NO: 687586 - DNA, 20 bp, mouse
ggcaaccaggccgggtggtc

SEQ ID NO: 687587 - DNA, 20 bp, mouse
ggctccagggcccgaccacc

SEQ ID NO: 687588 - DNA, 20 bp, mouse
gtggtcgggccctggagccc

SEQ ID NO: 687589 - DNA, 20 bp, mouse
gaaggcgagaggcggggcag

SEQ ID NO: 687590 - DNA, 20 bp, mouse
ggaggtgcacgccaagttct

SEQ ID NO: 687591 - DNA, 20 bp, mouse
gaggccgggtggtcgggccc

SEQ ID NO: 687592 - DNA, 20 bp, mouse
gcctacccctgggtgtccgt

SEQ ID NO: 687593 - DNA, 20 bp, mouse
gccacacccacggacaccca

SEQ ID NO: 687594 - DNA, 20 bp, mouse
gctggcccaaggctcacggg

SEQ ID NO: 687595 - DNA, 20 bp, mouse
gagaaagcaccagaggggaa

SEQ ID NO: 687596 - DNA, 20 bp, mouse
gacggcgcgctcacacacgc

SEQ ID NO: 687597 - DNA, 20 bp, mouse
gtcacccggcagcaaccaag

SEQ ID NO: 687598 - DNA, 20 bp, mouse
ggcgagcctaagtgaggcaa

SEQ ID NO: 687599 - DNA, 20 bp, mouse
gcaaccaagcggtgagtgtg

SEQ ID NO: 687600 - DNA, 20 bp, mouse
gcacacgcgggagacgcgca

SEQ ID NO: 687601 - DNA, 20 bp, mouse
ggtggaatgcagcccctcat

SEQ ID NO: 687602 - DNA, 20 bp, mouse
gactgggtgccagcccatga

SEQ ID NO: 687603 - DNA, 20 bp, mouse
gccgtgtgagcgcgaggaag

SEQ ID NO: 687604 - DNA, 20 bp, mouse
gcggagcctttgcctcactt

SEQ ID NO: 687605 - DNA, 20 bp, mouse
gcagtctgcgagcctaagtg

SEQ ID NO: 687606 - DNA, 20 bp, mouse
ggggctagaggtgacaaaag

SEQ ID NO: 687607 - DNA, 20 bp, mouse
ggtgacaaaaggggtgtgtt

SEQ ID NO: 687608 - DNA, 20 bp, mouse
gactgagcagggaggggatc

SEQ ID NO: 687609 - DNA, 20 bp, mouse
gagaagggcagaaatgtggg

SEQ ID NO: 687610 - DNA, 20 bp, mouse
gcccagcagcaggcacatga

SEQ ID NO: 687611 - DNA, 20 bp, mouse
ggagaggaaataggtgagaa

SEQ ID NO: 687612 - DNA, 20 bp, mouse
gtgctcagatggttcacctc

SEQ ID NO: 687613 - DNA, 20 bp, mouse
gatgctgtacccatttctac

SEQ ID NO: 687614 - DNA, 20 bp, mouse
ggtgttggggggggtaggca

SEQ ID NO: 687615 - DNA, 20 bp, mouse
gctgccagctggtttccttg

SEQ ID NO: 687616 - DNA, 20 bp, mouse
gggcccgccgggtccctcga

SEQ ID NO: 687617 - DNA, 20 bp, mouse
gaagcagcctgggtccctcg

SEQ ID NO: 687618 - DNA, 20 bp, mouse
gcccaggcgcgcgtgccctg

SEQ ID NO: 687619 - DNA, 20 bp, mouse
gggggcgggcggagcgtcgc

SEQ ID NO: 687620 - DNA, 20 bp, mouse
ggcagggcgtccatgggctc

SEQ ID NO: 687621 - DNA, 20 bp, mouse
ggtgcagagtagacagtgca

SEQ ID NO: 687622 - DNA, 20 bp, mouse
ggccctggggctcggcccgc

SEQ ID NO: 687623 - DNA, 20 bp, mouse
ggtccctcgagggacccggc

SEQ ID NO: 687624 - DNA, 20 bp, mouse
gcgggtccctcgagggaccc

SEQ ID NO: 687625 - DNA, 20 bp, mouse
ggtcgcgggccggatgggaa

SEQ ID NO: 687626 - DNA, 20 bp, mouse
gcgctcccgctcaagctccg

SEQ ID NO: 687627 - DNA, 20 bp, mouse
gtgagcatcggattgagaat

SEQ ID NO: 687628 - DNA, 20 bp, mouse
ggagcttgagcgggagcgaa

SEQ ID NO: 687629 - DNA, 20 bp, mouse
ggtggagaagggttgatctt

SEQ ID NO: 687630 - DNA, 20 bp, mouse
ggcgccgcccacccgcgact

SEQ ID NO: 687631 - DNA, 20 bp, mouse
gctcaatccgatgctcatag

SEQ ID NO: 687632 - DNA, 20 bp, mouse
gtctgcagcgggacgcgcgt

SEQ ID NO: 687633 - DNA, 20 bp, mouse
gacctctgacccacctccaa

SEQ ID NO: 687634 - DNA, 20 bp, mouse
gtaaggggcccagccaccag

SEQ ID NO: 687635 - DNA, 20 bp, mouse
gggccaactctgcctggcta

SEQ ID NO: 687636 - DNA, 20 bp, mouse
gctgagtggcctaagaagga

SEQ ID NO: 687637 - DNA, 20 bp, mouse
gggctgctccctctcaccaa

SEQ ID NO: 687638 - DNA, 20 bp, mouse
gcgagggtcacgcgggaaga

SEQ ID NO: 687639 - DNA, 20 bp, mouse
gagaaggagggtgtgtctcc

SEQ ID NO: 687640 - DNA, 20 bp, mouse
ggcatccgggaggcgagatg

SEQ ID NO: 687641 - DNA, 20 bp, mouse
gcctgggtggggaaatgaag

SEQ ID NO: 687642 - DNA, 20 bp, mouse
gcaccagcaacatcagctgc

SEQ ID NO: 687643 - DNA, 20 bp, mouse
gggtcggggcccttggtgag

SEQ ID NO: 687644 - DNA, 20 bp, mouse
gccaagggccccgacctgag

SEQ ID NO: 687645 - DNA, 20 bp, mouse
gccaagactagggtgtgctg

SEQ ID NO: 687646 - DNA, 20 bp, mouse
gcaggggcacacacagccaa

SEQ ID NO: 687647 - DNA, 20 bp, mouse
gccggaggaaagtggctaca

SEQ ID NO: 687648 - DNA, 20 bp, mouse
gcctccggaagagacaaatg

SEQ ID NO: 687649 - DNA, 20 bp, mouse
gaagccaacccagaccgcga

SEQ ID NO: 687650 - DNA, 20 bp, mouse
gaaactctaccctcgcggtc

SEQ ID NO: 687651 - DNA, 20 bp, mouse
gcggaagagacaaatgaggg

SEQ ID NO: 687652 - DNA, 20 bp, mouse
gctaccctcgcggtctgggt

SEQ ID NO: 687653 - DNA, 20 bp, mouse
gtaacagggttcagaagtca

SEQ ID NO: 687654 - DNA, 20 bp, mouse
gcagggaaactctaccctcg

SEQ ID NO: 687655 - DNA, 20 bp, mouse
gtgtctcttccggaggaaag

SEQ ID NO: 687656 - DNA, 20 bp, mouse
gggagggaaatctgcgagaa

SEQ ID NO: 687657 - DNA, 20 bp, mouse
gggcccgcagcggcgtctcg

SEQ ID NO: 687658 - DNA, 20 bp, mouse
gccccccccaacagagcctt

SEQ ID NO: 687659 - DNA, 20 bp, mouse
gggaccacgaccccgttctg

SEQ ID NO: 687660 - DNA, 20 bp, mouse
gaatccacgagacgccgctg

SEQ ID NO: 687661 - DNA, 20 bp, mouse
gcagccaaaggctctgttgg

SEQ ID NO: 687662 - DNA, 20 bp, mouse
gccggggctcagggagtaac

SEQ ID NO: 687663 - DNA, 20 bp, mouse
gggctcagggagtaacggga

SEQ ID NO: 687664 - DNA, 20 bp, mouse
gcatgccaggcgtactgaga

SEQ ID NO: 687665 - DNA, 20 bp, mouse
gagaggagaaccagtaaaaa

SEQ ID NO: 687666 - DNA, 20 bp, mouse
ggaaggaggcgggactacag

SEQ ID NO: 687667 - DNA, 20 bp, mouse
ggcacctcgggcacagaaga

SEQ ID NO: 687668 - DNA, 20 bp, mouse
gaacacgccggggcactcgc

SEQ ID NO: 687669 - DNA, 20 bp, mouse
gtaggctcgccacaatcgat

SEQ ID NO: 687670 - DNA, 20 bp, mouse
ggaaaggggcgggccgtagg

SEQ ID NO: 687671 - DNA, 20 bp, mouse
gaggcgggactacagcggtt

SEQ ID NO: 687672 - DNA, 20 bp, mouse
gtgggtaggcagcgctggac

SEQ ID NO: 687673 - DNA, 20 bp, mouse
gaggaactccctcagtgagg

SEQ ID NO: 687674 - DNA, 20 bp, mouse
ggggggcggggcacctagtt

SEQ ID NO: 687675 - DNA, 20 bp, mouse
gcgctcccggctccggaagg

SEQ ID NO: 687676 - DNA, 20 bp, mouse
gctcggcggcgcagcagccc

SEQ ID NO: 687677 - DNA, 20 bp, mouse
gaggagctggtgagagtcac

SEQ ID NO: 687678 - DNA, 20 bp, mouse
gcgcccggtcctcccagcgt

SEQ ID NO: 687679 - DNA, 20 bp, mouse
gcagacgctcccggaggcga

SEQ ID NO: 687680 - DNA, 20 bp, mouse
gcaatcgcagagccgacgct

SEQ ID NO: 687681 - DNA, 20 bp, mouse
gtcggcttccggctctctcg

SEQ ID NO: 687682 - DNA, 20 bp, mouse
gctgcagcagacgctcccgg

SEQ ID NO: 687683 - DNA, 20 bp, mouse
gacgctcccggaggcgaagg

SEQ ID NO: 687684 - DNA, 20 bp, mouse
gtgcgattgcccagcgctcc

SEQ ID NO: 687685 - DNA, 20 bp, mouse
gagaactggtgcaagggaca

SEQ ID NO: 687686 - DNA, 20 bp, mouse
gatgacgcggggtcttctcg

SEQ ID NO: 687687 - DNA, 20 bp, mouse
ggggaggagacagcgctgac

SEQ ID NO: 687688 - DNA, 20 bp, mouse
gccgggccaactctaggatg

SEQ ID NO: 687689 - DNA, 20 bp, mouse
gaaaggctccgccctatcta

SEQ ID NO: 687690 - DNA, 20 bp, mouse
gccagccgcggaaccaagac

SEQ ID NO: 687691 - DNA, 20 bp, mouse
ggccccgccccctccagaga

SEQ ID NO: 687692 - DNA, 20 bp, mouse
gtggggccagcattgagagt

SEQ ID NO: 687693 - DNA, 20 bp, mouse
ggcgaggccgggccaactct

SEQ ID NO: 687694 - DNA, 20 bp, mouse
gagagtgggacagaaatact

SEQ ID NO: 687695 - DNA, 20 bp, mouse
gaaccaagacgggaatgacg

SEQ ID NO: 687696 - DNA, 20 bp, mouse
gcgacgccgggtgtggaacc

SEQ ID NO: 687697 - DNA, 20 bp, mouse
gctgccctgccgccacgacc

SEQ ID NO: 687698 - DNA, 20 bp, mouse
gcagccccgcgcgcgttcgg

SEQ ID NO: 687699 - DNA, 20 bp, mouse
ggccaatcccggctggaggc

SEQ ID NO: 687700 - DNA, 20 bp, mouse
gaccgggaagacccacgacg

SEQ ID NO: 687701 - DNA, 20 bp, mouse
gttggcgcgcgaggcgaagg

SEQ ID NO: 687702 - DNA, 20 bp, mouse
gtcgcctcgcgcgccaatcc

SEQ ID NO: 687703 - DNA, 20 bp, mouse
gctccggcggccttccagcc

SEQ ID NO: 687704 - DNA, 20 bp, mouse
ggcgtcgcatcagctcccgc

SEQ ID NO: 687705 - DNA, 20 bp, mouse
gctcgcgcgccaatcccggc

SEQ ID NO: 687706 - DNA, 20 bp, mouse
gcggagccggagggcgactg

SEQ ID NO: 687707 - DNA, 20 bp, mouse
gggtcccgggtcagcggcgg

SEQ ID NO: 687708 - DNA, 20 bp, mouse
gagctggccggaaacgccgg

SEQ ID NO: 687709 - DNA, 20 bp, mouse
gtggcccctccagaccccgc

SEQ ID NO: 687710 - DNA, 20 bp, mouse
gcccgtcggtcccgggtcag

SEQ ID NO: 687711 - DNA, 20 bp, mouse
gcgcaccgagcgcttggcga

SEQ ID NO: 687712 - DNA, 20 bp, mouse
ggatccagaagcagccagcg

SEQ ID NO: 687713 - DNA, 20 bp, mouse
ggtctggaggggccacccgg

SEQ ID NO: 687714 - DNA, 20 bp, mouse
gccgacgggcacggtggctg

SEQ ID NO: 687715 - DNA, 20 bp, mouse
gccaccgtgcccgtcggtcc

SEQ ID NO: 687716 - DNA, 20 bp, mouse
ggtgtggaacagacacaatg

SEQ ID NO: 687717 - DNA, 20 bp, mouse
gccagcgaggctccctcata

SEQ ID NO: 687718 - DNA, 20 bp, mouse
gctagctgggggcttcagat

SEQ ID NO: 687719 - DNA, 20 bp, mouse
gaagcctgccgatcccagcg

SEQ ID NO: 687720 - DNA, 20 bp, mouse
gccgagaaggccagcctcta

SEQ ID NO: 687721 - DNA, 20 bp, mouse
ggagcctcgctgggatcggc

SEQ ID NO: 687722 - DNA, 20 bp, mouse
gaagcaagggtgttcccagg

SEQ ID NO: 687723 - DNA, 20 bp, mouse
gagatcggaagtccttatga

SEQ ID NO: 687724 - DNA, 20 bp, mouse
gttactacagctaggagaat

SEQ ID NO: 687725 - DNA, 20 bp, mouse
gagccaggcgacctagctgg

SEQ ID NO: 687726 - DNA, 20 bp, mouse
gggccgcgcagggaggtcgg

SEQ ID NO: 687727 - DNA, 20 bp, mouse
gggcccggggaggacacctc

SEQ ID NO: 687728 - DNA, 20 bp, mouse
ggcggcgcctgggctagctc

SEQ ID NO: 687729 - DNA, 20 bp, mouse
gcggacgccccgcccctagg

SEQ ID NO: 687730 - DNA, 20 bp, mouse
gcgcggccgcctcctagggg

SEQ ID NO: 687731 - DNA, 20 bp, mouse
gggggccgatggggcggagt

SEQ ID NO: 687732 - DNA, 20 bp, mouse
gctgcgcggccgcctcctag

SEQ ID NO: 687733 - DNA, 20 bp, mouse
gacgccccgcccctaggagg

SEQ ID NO: 687734 - DNA, 20 bp, mouse
ggaaagaggttcaggatgta

SEQ ID NO: 687735 - DNA, 20 bp, mouse
gggcgtccggcgaggtgggg

SEQ ID NO: 687736 - DNA, 20 bp, mouse
gcgcatgcgcagtgtatagt

SEQ ID NO: 687737 - DNA, 20 bp, mouse
gagaccggaagttgcttctc

SEQ ID NO: 687738 - DNA, 20 bp, mouse
gggaaccatcgtcgcgacta

SEQ ID NO: 687739 - DNA, 20 bp, mouse
gggcccggttgtgctgtgaa

SEQ ID NO: 687740 - DNA, 20 bp, mouse
gcggtcggaaactcttcttc

SEQ ID NO: 687741 - DNA, 20 bp, mouse
ggcgcagtgtatagtgggcg

SEQ ID NO: 687742 - DNA, 20 bp, mouse
ggcaacttccggtcttcctc

SEQ ID NO: 687743 - DNA, 20 bp, mouse
ggaccacacccggaacgatg

SEQ ID NO: 687744 - DNA, 20 bp, mouse
ggtcgctgccgcatcgttcc

SEQ ID NO: 687745 - DNA, 20 bp, mouse
gtggggatcaacaggatata

SEQ ID NO: 687746 - DNA, 20 bp, mouse
gaggggccctagtgcctggg

SEQ ID NO: 687747 - DNA, 20 bp, mouse
gtgtgcaccactaaagataa

SEQ ID NO: 687748 - DNA, 20 bp, mouse
ggcacacagtggcaccactc

SEQ ID NO: 687749 - DNA, 20 bp, mouse
gaagcggtgatcaccaacca

SEQ ID NO: 687750 - DNA, 20 bp, mouse
ggggcgaggctgcagggtgc

SEQ ID NO: 687751 - DNA, 20 bp, mouse
gtggaggaaaacgagccatc

SEQ ID NO: 687752 - DNA, 20 bp, mouse
gggcccctgcggcggtgatg

SEQ ID NO: 687753 - DNA, 20 bp, mouse
gaaccaggggccctagtgcc

SEQ ID NO: 687754 - DNA, 20 bp, mouse
gccctccgggccaggaagcg

SEQ ID NO: 687755 - DNA, 20 bp, mouse
gggaggggcgggcacgcctc

SEQ ID NO: 687756 - DNA, 20 bp, mouse
ggcaggatgctgagtgtgtc

SEQ ID NO: 687757 - DNA, 20 bp, mouse
gtagtctgcttgatgacgac

SEQ ID NO: 687758 - DNA, 20 bp, mouse
ggggtgagggctctacattc

SEQ ID NO: 687759 - DNA, 20 bp, mouse
gcacagagcaagaaaccaca

SEQ ID NO: 687760 - DNA, 20 bp, mouse
gtcaagaaagtccggggtga

SEQ ID NO: 687761 - DNA, 20 bp, mouse
gttgatgacgacaggctgat

SEQ ID NO: 687762 - DNA, 20 bp, mouse
gagttgttcaagaaagtccg

SEQ ID NO: 687763 - DNA, 20 bp, mouse
gtgttactcactggaaatgc

SEQ ID NO: 687764 - DNA, 20 bp, mouse
gagaaaaactctagtcagag

SEQ ID NO: 687765 - DNA, 20 bp, mouse
gtatggtgattgattccaaa

SEQ ID NO: 687766 - DNA, 20 bp, mouse
gggagcagcaagaaccctaa

SEQ ID NO: 687767 - DNA, 20 bp, mouse
ggagcccgggcttcacttaa

SEQ ID NO: 687768 - DNA, 20 bp, mouse
gcctgcctatggggagcttg

SEQ ID NO: 687769 - DNA, 20 bp, mouse
ggccagtggggtcggggatg

SEQ ID NO: 687770 - DNA, 20 bp, mouse
gagaaccaatctctccctta

SEQ ID NO: 687771 - DNA, 20 bp, mouse
gcctcctcacggtacacagc

SEQ ID NO: 687772 - DNA, 20 bp, mouse
gtgtcccttaagtgaagccc

SEQ ID NO: 687773 - DNA, 20 bp, mouse
gcaggtgcatgtgcaagagg

SEQ ID NO: 687774 - DNA, 20 bp, mouse
ggagaccatacctgcctatg

SEQ ID NO: 687775 - DNA, 20 bp, mouse
gacaccgcctggaccctccc

SEQ ID NO: 687776 - DNA, 20 bp, mouse
gacgaggcgtggctccgaga

SEQ ID NO: 687777 - DNA, 20 bp, mouse
gtcggagccacgcctcgtcc

SEQ ID NO: 687778 - DNA, 20 bp, mouse
gaggactccgggacgaggcg

SEQ ID NO: 687779 - DNA, 20 bp, mouse
gggaggagctggtgcgactg

SEQ ID NO: 687780 - DNA, 20 bp, mouse
ggcgcggggcgtggcctcaa

SEQ ID NO: 687781 - DNA, 20 bp, mouse
ggggcgggggcgtggcggtg

SEQ ID NO: 687782 - DNA, 20 bp, mouse
ggagctggtgcgactgaggt

SEQ ID NO: 687783 - DNA, 20 bp, mouse
gggtactgactcttgatgtt

SEQ ID NO: 687784 - DNA, 20 bp, mouse
gaggactgggagttgatata

SEQ ID NO: 687785 - DNA, 20 bp, mouse
gagcagatgcaagaccacgt

SEQ ID NO: 687786 - DNA, 20 bp, mouse
gaggagaaggaccagaacag

SEQ ID NO: 687787 - DNA, 20 bp, mouse
gccaggtgggcggaggccgg

SEQ ID NO: 687788 - DNA, 20 bp, mouse
ggggacgcgcagccgcccct

SEQ ID NO: 687789 - DNA, 20 bp, mouse
ggcccagaaggaggagcgca

SEQ ID NO: 687790 - DNA, 20 bp, mouse
ggggaggcgagactggagcg

SEQ ID NO: 687791 - DNA, 20 bp, mouse
ggcgcacggatcccctcccc

SEQ ID NO: 687792 - DNA, 20 bp, mouse
ggtgggatcagggcggctgg

SEQ ID NO: 687793 - DNA, 20 bp, mouse
gtgaaaatgatggggctgaa

SEQ ID NO: 687794 - DNA, 20 bp, mouse
ggagcgcggcgtcagctgac

SEQ ID NO: 687795 - DNA, 20 bp, mouse
gtcacagcagggagtcctca

SEQ ID NO: 687796 - DNA, 20 bp, mouse
gaccccgcgggcaaggggga

SEQ ID NO: 687797 - DNA, 20 bp, mouse
ggccacccgcgcctaggata

SEQ ID NO: 687798 - DNA, 20 bp, mouse
ggctccccggcgcggagaag

SEQ ID NO: 687799 - DNA, 20 bp, mouse
ggtgctggcaccactcgccc

SEQ ID NO: 687800 - DNA, 20 bp, mouse
ggggaaggccagattaacag

SEQ ID NO: 687801 - DNA, 20 bp, mouse
ggggagccatatcctaggcg

SEQ ID NO: 687802 - DNA, 20 bp, mouse
gactgtgggagccatatcct

SEQ ID NO: 687803 - DNA, 20 bp, mouse
gttgcccaagaaaagagtga

SEQ ID NO: 687804 - DNA, 20 bp, mouse
gtggccggagcgcaccatcg

SEQ ID NO: 687805 - DNA, 20 bp, mouse
gccggcgcggagaaggggga

SEQ ID NO: 687806 - DNA, 20 bp, mouse
gacacggggacctggatgtg

SEQ ID NO: 687807 - DNA, 20 bp, mouse
gagactgggcggggcacccc

SEQ ID NO: 687808 - DNA, 20 bp, mouse
gcgggcggggcgcagcgaca

SEQ ID NO: 687809 - DNA, 20 bp, mouse
gcaaggccactgccacctac

SEQ ID NO: 687810 - DNA, 20 bp, mouse
gcgcccaggacgcgtggaga

SEQ ID NO: 687811 - DNA, 20 bp, mouse
ggcgcagcgacacggggacc

SEQ ID NO: 687812 - DNA, 20 bp, mouse
gggccccatgagatggagga

SEQ ID NO: 687813 - DNA, 20 bp, mouse
gctcaggcgcccaggacgcg

SEQ ID NO: 687814 - DNA, 20 bp, mouse
gtaaagtgcaagccagtagg

SEQ ID NO: 687815 - DNA, 20 bp, mouse
gcgccctctccacgcgtcct

SEQ ID NO: 687816 - DNA, 20 bp, mouse
gcgtgtgtgaggtgcggagt

SEQ ID NO: 687817 - DNA, 20 bp, mouse
ggccgcgcgcgcgaagatgg

SEQ ID NO: 687818 - DNA, 20 bp, mouse
gagtggggcgcggcaggggg

SEQ ID NO: 687819 - DNA, 20 bp, mouse
gtcagccccgcgagcgggaa

SEQ ID NO: 687820 - DNA, 20 bp, mouse
gcgctggtgggccgtgtgtg

SEQ ID NO: 687821 - DNA, 20 bp, mouse
gtgggccgcgcgcgcgaaga

SEQ ID NO: 687822 - DNA, 20 bp, mouse
gcagtggcagagacgagccc

SEQ ID NO: 687823 - DNA, 20 bp, mouse
gtggaggatcccagtcacgt

SEQ ID NO: 687824 - DNA, 20 bp, mouse
gtggccgtgaagcgcgggct

SEQ ID NO: 687825 - DNA, 20 bp, mouse
gtgggcgggagttgggaccg

SEQ ID NO: 687826 - DNA, 20 bp, mouse
gcgtgcggcgaatcagagag

SEQ ID NO: 687827 - DNA, 20 bp, mouse
gacgccacgcacccaatccg

SEQ ID NO: 687828 - DNA, 20 bp, mouse
gcaactacctgaactcgcac

SEQ ID NO: 687829 - DNA, 20 bp, mouse
gtgggtgcgtggcgtctccc

SEQ ID NO: 687830 - DNA, 20 bp, mouse
gtcacgacctgcacactgaa

SEQ ID NO: 687831 - DNA, 20 bp, mouse
gttagctcggcgtgtgggaa

SEQ ID NO: 687832 - DNA, 20 bp, mouse
gacctgaactcgcacgggat

SEQ ID NO: 687833 - DNA, 20 bp, mouse
gaatcaggcgctatctcggg

SEQ ID NO: 687834 - DNA, 20 bp, mouse
gacgaggcagaatgatgctg

SEQ ID NO: 687835 - DNA, 20 bp, mouse
ggtcgtgaggctggcccgtg

SEQ ID NO: 687836 - DNA, 20 bp, mouse
gcggcgcgcggcacccggta

SEQ ID NO: 687837 - DNA, 20 bp, mouse
gcggccaccgggaaatctgt

SEQ ID NO: 687838 - DNA, 20 bp, mouse
ggtcgctgagaacgcgacgg

SEQ ID NO: 687839 - DNA, 20 bp, mouse
gcgcccaacagatttcccgg

SEQ ID NO: 687840 - DNA, 20 bp, mouse
gccgacggagcatgcgtgcc

SEQ ID NO: 687841 - DNA, 20 bp, mouse
gcacgcatgctccgtcgggg

SEQ ID NO: 687842 - DNA, 20 bp, mouse
gacccggtagggctcggaaa

SEQ ID NO: 687843 - DNA, 20 bp, mouse
gggcgtcgctgagaacgcga

SEQ ID NO: 687844 - DNA, 20 bp, mouse
gactacgcccgctgccgagt

SEQ ID NO: 687845 - DNA, 20 bp, mouse
gcgccacgggcccgccccga

SEQ ID NO: 687846 - DNA, 20 bp, mouse
gtctccggtcgcccgcacga

SEQ ID NO: 687847 - DNA, 20 bp, mouse
gcggagagacggcggaggga

SEQ ID NO: 687848 - DNA, 20 bp, mouse
gcccacgccggcgtcgacgt

SEQ ID NO: 687849 - DNA, 20 bp, mouse
gcgggcgaccggagagacgg

SEQ ID NO: 687850 - DNA, 20 bp, mouse
gaggccgccgacgtcgacgc

SEQ ID NO: 687851 - DNA, 20 bp, mouse
gcgccacagcgccctcgtgc

SEQ ID NO: 687852 - DNA, 20 bp, mouse
gcatcaaaatgatggttcgc

SEQ ID NO: 687853 - DNA, 20 bp, mouse
gagccgtggccgccgagcag

SEQ ID NO: 687854 - DNA, 20 bp, mouse
ggacgcgcataaagtgctgg

SEQ ID NO: 687855 - DNA, 20 bp, mouse
ggtccccgtccgctgctcgg

SEQ ID NO: 687856 - DNA, 20 bp, mouse
gaacgggggcggagccttaa

SEQ ID NO: 687857 - DNA, 20 bp, mouse
gcgtggggcggggtccttag

SEQ ID NO: 687858 - DNA, 20 bp, mouse
gcgccctggtcagtcacata

SEQ ID NO: 687859 - DNA, 20 bp, mouse
ggggaggggccattgtaggc

SEQ ID NO: 687860 - DNA, 20 bp, mouse
gaggcgccgccataccgtta

SEQ ID NO: 687861 - DNA, 20 bp, mouse
ggggcggagccttaacggta

SEQ ID NO: 687862 - DNA, 20 bp, mouse
gtccttagcggtgactggga

SEQ ID NO: 687863 - DNA, 20 bp, mouse
ggggccggaaggcgggacct

SEQ ID NO: 687864 - DNA, 20 bp, mouse
gggaggcaggccctcggcgt

SEQ ID NO: 687865 - DNA, 20 bp, mouse
ggggactctaggcgtgtggg

SEQ ID NO: 687866 - DNA, 20 bp, mouse
ggcccccgccggaagggaag

SEQ ID NO: 687867 - DNA, 20 bp, mouse
gtcccagaacccggtgcggg

SEQ ID NO: 687868 - DNA, 20 bp, mouse
gggactgcgctacagcggga

SEQ ID NO: 687869 - DNA, 20 bp, mouse
ggaggcgcgcaggagaggtg

SEQ ID NO: 687870 - DNA, 20 bp, mouse
gccccgcccgcaccgggttc

SEQ ID NO: 687871 - DNA, 20 bp, mouse
ggggcgggactgcgctacag

SEQ ID NO: 687872 - DNA, 20 bp, mouse
gtggaattgcacatctggag

SEQ ID NO: 687873 - DNA, 20 bp, mouse
gtccccttcccttccggcgg

SEQ ID NO: 687874 - DNA, 20 bp, mouse
ggccgcgcacgtgaccgcgt

SEQ ID NO: 687875 - DNA, 20 bp, mouse
gtacgcccctaagctaacgc

SEQ ID NO: 687876 - DNA, 20 bp, mouse
ggggacccggggaaaccctg

SEQ ID NO: 687877 - DNA, 20 bp, mouse
gtgcgtgcgtcggtcggagg

SEQ ID NO: 687878 - DNA, 20 bp, mouse
gtcggaggagggcgagtcca

SEQ ID NO: 687879 - DNA, 20 bp, mouse
gcgtaagtgcgtgcgtcggt

SEQ ID NO: 687880 - DNA, 20 bp, mouse
ggacgcggggcggacggctg

SEQ ID NO: 687881 - DNA, 20 bp, mouse
ggcggcggctctagacgccc

SEQ ID NO: 687882 - DNA, 20 bp, mouse
gttgggccggcgtgaggaga

SEQ ID NO: 687883 - DNA, 20 bp, mouse
gacccggggaaaccctgcgg

SEQ ID NO: 687884 - DNA, 20 bp, mouse
gagccggaagcggggacccg

SEQ ID NO: 687885 - DNA, 20 bp, mouse
gcggctggcggcgacgtcgg

SEQ ID NO: 687886 - DNA, 20 bp, mouse
gcccaaggcttgctcctcaa

SEQ ID NO: 687887 - DNA, 20 bp, mouse
gctacacatggcctgagctc

SEQ ID NO: 687888 - DNA, 20 bp, mouse
gaggccatgtgtagcccttg

SEQ ID NO: 687889 - DNA, 20 bp, mouse
gtgctcttactgcagccctc

SEQ ID NO: 687890 - DNA, 20 bp, mouse
gcctgagctctggtggccag

SEQ ID NO: 687891 - DNA, 20 bp, mouse
gcaacagatgatcatttaga

SEQ ID NO: 687892 - DNA, 20 bp, mouse
gtacaagaaagtaaggccgg

SEQ ID NO: 687893 - DNA, 20 bp, mouse
ggggctgcatgctgaaattt

SEQ ID NO: 687894 - DNA, 20 bp, mouse
gaggatgatacaagaaagta

SEQ ID NO: 687895 - DNA, 20 bp, mouse
ggagggatcaatatcatctt

SEQ ID NO: 687896 - DNA, 20 bp, mouse
gaacgcttcctcgtaccacg

SEQ ID NO: 687897 - DNA, 20 bp, mouse
ggtgtcagccacgtggtacg

SEQ ID NO: 687898 - DNA, 20 bp, mouse
gaactcaggaacaatctgga

SEQ ID NO: 687899 - DNA, 20 bp, mouse
gggcatcccagactaagctc

SEQ ID NO: 687900 - DNA, 20 bp, mouse
gtgcagctcagagtggaaat

SEQ ID NO: 687901 - DNA, 20 bp, mouse
gaaacccacaagctcactgg

SEQ ID NO: 687902 - DNA, 20 bp, mouse
gtacgaggaagcgttcatgt

SEQ ID NO: 687903 - DNA, 20 bp, mouse
gctcgcaggtcgggtttaaa

SEQ ID NO: 687904 - DNA, 20 bp, mouse
ggggttgtgggaaaagtacc

SEQ ID NO: 687905 - DNA, 20 bp, mouse
ggtcaggaagaatgagagtg

SEQ ID NO: 687906 - DNA, 20 bp, mouse
gggagccaatgaaaacggat

SEQ ID NO: 687907 - DNA, 20 bp, mouse
gtcccccaatccgttttcat

SEQ ID NO: 687908 - DNA, 20 bp, mouse
gcccaggaccggtccaaagt

SEQ ID NO: 687909 - DNA, 20 bp, mouse
gtgcccacctccagctgtga

SEQ ID NO: 687910 - DNA, 20 bp, mouse
gtgcagccgcagcagatgta

SEQ ID NO: 687911 - DNA, 20 bp, mouse
ggatgctcccagaactttta

SEQ ID NO: 687912 - DNA, 20 bp, mouse
gcagctgctcacagtggatg

SEQ ID NO: 687913 - DNA, 20 bp, mouse
gagggagccctcacagctgg

SEQ ID NO: 687914 - DNA, 20 bp, mouse
ggtcatccggaagtgatcat

SEQ ID NO: 687915 - DNA, 20 bp, mouse
gtgaaccagggactcccagc

SEQ ID NO: 687916 - DNA, 20 bp, mouse
gtggggacacgagaaggatc

SEQ ID NO: 687917 - DNA, 20 bp, mouse
gcacaggggcgccctgataa

SEQ ID NO: 687918 - DNA, 20 bp, mouse
gccagcccctacagaagaaa

SEQ ID NO: 687919 - DNA, 20 bp, mouse
gcacccctttggtggaaccc

SEQ ID NO: 687920 - DNA, 20 bp, mouse
gggtacctgggttccaccaa

SEQ ID NO: 687921 - DNA, 20 bp, mouse
gagaagaaagggctagtact

SEQ ID NO: 687922 - DNA, 20 bp, mouse
gctgcggtctcccattatca

SEQ ID NO: 687923 - DNA, 20 bp, mouse
gtgagtaaggggcgtggagc

SEQ ID NO: 687924 - DNA, 20 bp, mouse
gctagccctttcttctgtag

SEQ ID NO: 687925 - DNA, 20 bp, mouse
gcttctgtaggggctggatc

SEQ ID NO: 687926 - DNA, 20 bp, mouse
gtagaagcttaggaagaaac

SEQ ID NO: 687927 - DNA, 20 bp, mouse
gccccaagacagactcagaa

SEQ ID NO: 687928 - DNA, 20 bp, mouse
gacactgggcgttgctgtgt

SEQ ID NO: 687929 - DNA, 20 bp, mouse
gctggtgcatctgcccctgg

SEQ ID NO: 687930 - DNA, 20 bp, mouse
gaacactggaagttgtaaac

SEQ ID NO: 687931 - DNA, 20 bp, mouse
gaagcagtttgcttatcatc

SEQ ID NO: 687932 - DNA, 20 bp, mouse
ggccccttctgagtctgtct

SEQ ID NO: 687933 - DNA, 20 bp, mouse
gagcgcagatgataccacac

SEQ ID NO: 687934 - DNA, 20 bp, mouse
ggttggccaggtagaagctt

SEQ ID NO: 687935 - DNA, 20 bp, mouse
gtaaaggtaccaagcctcca

SEQ ID NO: 687936 - DNA, 20 bp, mouse
gtctctgggtcagccgtctg

SEQ ID NO: 687937 - DNA, 20 bp, mouse
ggtaacgcagagcatccggt

SEQ ID NO: 687938 - DNA, 20 bp, mouse
gcagagcatccggtggggtc

SEQ ID NO: 687939 - DNA, 20 bp, mouse
gggatgctctgcgttactga

SEQ ID NO: 687940 - DNA, 20 bp, mouse
gcggtggggtccgggtctct

SEQ ID NO: 687941 - DNA, 20 bp, mouse
ggggaccggtcagaagacgg

SEQ ID NO: 687942 - DNA, 20 bp, mouse
gagtgccaaggagagcagac

SEQ ID NO: 687943 - DNA, 20 bp, mouse
gcagccgtctggggaatgat

SEQ ID NO: 687944 - DNA, 20 bp, mouse
gggagccacaagaggagttt

SEQ ID NO: 687945 - DNA, 20 bp, mouse
gtggggaatgataggccttt

SEQ ID NO: 687946 - DNA, 20 bp, mouse
ggaccctgaaactgccttaa

SEQ ID NO: 687947 - DNA, 20 bp, mouse
gaaacagggtggggcttgta

SEQ ID NO: 687948 - DNA, 20 bp, mouse
ggctcaggctggaaacaggg

SEQ ID NO: 687949 - DNA, 20 bp, mouse
gtccccatgcctcctgagga

SEQ ID NO: 687950 - DNA, 20 bp, mouse
gctttctccaggatcagccc

SEQ ID NO: 687951 - DNA, 20 bp, mouse
ggggtggggcttgtaaggac

SEQ ID NO: 687952 - DNA, 20 bp, mouse
gaagggctcaggctggaaac

SEQ ID NO: 687953 - DNA, 20 bp, mouse
gtgaaactgccttaagggat

SEQ ID NO: 687954 - DNA, 20 bp, mouse
gaaaactggatcctctccag

SEQ ID NO: 687955 - DNA, 20 bp, mouse
ggacaggaactaagtccttg

SEQ ID NO: 687956 - DNA, 20 bp, mouse
gggggcgcccttctacttgg

SEQ ID NO: 687957 - DNA, 20 bp, mouse
gtcaactacctcattgtttg

SEQ ID NO: 687958 - DNA, 20 bp, mouse
gagacccgccaggcccaagg

SEQ ID NO: 687959 - DNA, 20 bp, mouse
gcacacataggtctggccag

SEQ ID NO: 687960 - DNA, 20 bp, mouse
gtccgctcccccaagtagaa

SEQ ID NO: 687961 - DNA, 20 bp, mouse
gagtagaagggcgccccctt

SEQ ID NO: 687962 - DNA, 20 bp, mouse
gtacaagcgcagtcgctaga

SEQ ID NO: 687963 - DNA, 20 bp, mouse
gttcaggcactaacacacat

SEQ ID NO: 687964 - DNA, 20 bp, mouse
gagtgctggtgccttcagtg

SEQ ID NO: 687965 - DNA, 20 bp, mouse
gcagagacccgccaggccca

SEQ ID NO: 687966 - DNA, 20 bp, mouse
gcccgccctgccatcctgat

SEQ ID NO: 687967 - DNA, 20 bp, mouse
gtgcatgcgtctgtgcacgt

SEQ ID NO: 687968 - DNA, 20 bp, mouse
gtcctccgacccagggggtg

SEQ ID NO: 687969 - DNA, 20 bp, mouse
ggcgggtcctccgacccagg

SEQ ID NO: 687970 - DNA, 20 bp, mouse
gcgggagtggtagtccctag

SEQ ID NO: 687971 - DNA, 20 bp, mouse
gtgggtcggaggacccgcta

SEQ ID NO: 687972 - DNA, 20 bp, mouse
gaccccaccccctgggtcgg

SEQ ID NO: 687973 - DNA, 20 bp, mouse
ggggactaccactcccggca

SEQ ID NO: 687974 - DNA, 20 bp, mouse
gcgggccgcccaggccatgc

SEQ ID NO: 687975 - DNA, 20 bp, mouse
gtgcgtgaaggtggggtgaa

SEQ ID NO: 687976 - DNA, 20 bp, mouse
ggggagtatggcgtactcat

SEQ ID NO: 687977 - DNA, 20 bp, mouse
ggcccgagggcgcccctgta

SEQ ID NO: 687978 - DNA, 20 bp, mouse
ggggacgtgtagtccctaca

SEQ ID NO: 687979 - DNA, 20 bp, mouse
gcgacgggacctggagtcta

SEQ ID NO: 687980 - DNA, 20 bp, mouse
ggacccaggcatccccagag

SEQ ID NO: 687981 - DNA, 20 bp, mouse
ggagtacgccatactcccaa

SEQ ID NO: 687982 - DNA, 20 bp, mouse
gtccctacaggggcgccctc

SEQ ID NO: 687983 - DNA, 20 bp, mouse
ggttgctggggatacagggc

SEQ ID NO: 687984 - DNA, 20 bp, mouse
ggggatgtggatgacccaca

SEQ ID NO: 687985 - DNA, 20 bp, mouse
gtagggactacacgtcccag

SEQ ID NO: 687986 - DNA, 20 bp, mouse
gggtcctcgaccctctgcgc

SEQ ID NO: 687987 - DNA, 20 bp, mouse
gagggggtgcgcgcacgcac

SEQ ID NO: 687988 - DNA, 20 bp, mouse
gctctgcgcaggcgcagcta

SEQ ID NO: 687989 - DNA, 20 bp, mouse
gagccacgaggttgacacac

SEQ ID NO: 687990 - DNA, 20 bp, mouse
gtccctgtgtgtcaacctcg

SEQ ID NO: 687991 - DNA, 20 bp, mouse
gaggaccctgtgtcctgaga

SEQ ID NO: 687992 - DNA, 20 bp, mouse
gacacacagggagagattgg

SEQ ID NO: 687993 - DNA, 20 bp, mouse
ggcgcctgcgcagagggtcg

SEQ ID NO: 687994 - DNA, 20 bp, mouse
gtgggaacagaggtacctaa

SEQ ID NO: 687995 - DNA, 20 bp, mouse
ggtgaaaaggccacgcggat

SEQ ID NO: 687996 - DNA, 20 bp, mouse
ggctctcgggctctacaaaa

SEQ ID NO: 687997 - DNA, 20 bp, mouse
gagagcgagcaggtcttaaa

SEQ ID NO: 687998 - DNA, 20 bp, mouse
gtaaaagggcgctactaaca

SEQ ID NO: 687999 - DNA, 20 bp, mouse
gacaaaagggagtgacctct

SEQ ID NO: 688000 - DNA, 20 bp, mouse
gctgcgtggtggtagttatt

SEQ ID NO: 688001 - DNA, 20 bp, mouse
ggaactcgtggagacaacat

SEQ ID NO: 688002 - DNA, 20 bp, mouse
ggctggtcgccaagtgggcg

SEQ ID NO: 688003 - DNA, 20 bp, mouse
gagaaaccgcccggggaagg

SEQ ID NO: 688004 - DNA, 20 bp, mouse
gtggtgtacaaggagctcgg

SEQ ID NO: 688005 - DNA, 20 bp, mouse
gggcgcggctggtcgccaag

SEQ ID NO: 688006 - DNA, 20 bp, mouse
gtagcagggcggtgactaaa

SEQ ID NO: 688007 - DNA, 20 bp, mouse
ggcggtgctgcaatgggcac

SEQ ID NO: 688008 - DNA, 20 bp, mouse
gaccactaggagacgctgag

SEQ ID NO: 688009 - DNA, 20 bp, mouse
ggagaagagcgtgagagcaa

SEQ ID NO: 688010 - DNA, 20 bp, mouse
ggggcaccggttggtacaaa

SEQ ID NO: 688011 - DNA, 20 bp, mouse
ggagggcggagattctagca

SEQ ID NO: 688012 - DNA, 20 bp, mouse
gaagagggcggtgctgcaat

SEQ ID NO: 688013 - DNA, 20 bp, mouse
ggaaacggggtgcaacagga

SEQ ID NO: 688014 - DNA, 20 bp, mouse
ggagagcaagggggaccact

SEQ ID NO: 688015 - DNA, 20 bp, mouse
gggcggagattctagcaggg

SEQ ID NO: 688016 - DNA, 20 bp, mouse
gcaccggcaggctggcctta

SEQ ID NO: 688017 - DNA, 20 bp, mouse
gtaccctaaggccagcctgc

SEQ ID NO: 688018 - DNA, 20 bp, mouse
gctagtgattggttctctgt

SEQ ID NO: 688019 - DNA, 20 bp, mouse
gaccctgtttcagattctgg

SEQ ID NO: 688020 - DNA, 20 bp, mouse
gctaggacccgaggacaggt

SEQ ID NO: 688021 - DNA, 20 bp, mouse
gtgacctcgaggacttttga

SEQ ID NO: 688022 - DNA, 20 bp, mouse
gaagtgccgcaaagccttgt

SEQ ID NO: 688023 - DNA, 20 bp, mouse
ggatcctaggacccgaggac

SEQ ID NO: 688024 - DNA, 20 bp, mouse
gtccgtaggtccatgtgtag

SEQ ID NO: 688025 - DNA, 20 bp, mouse
gtggaaccacaacacccaca

SEQ ID NO: 688026 - DNA, 20 bp, mouse
gtccggggcccggggagttt

SEQ ID NO: 688027 - DNA, 20 bp, mouse
ggtcgctggcacccagtgga

SEQ ID NO: 688028 - DNA, 20 bp, mouse
gtgacgtaaccgccatgaga

SEQ ID NO: 688029 - DNA, 20 bp, mouse
gcagcgaccaatagtgtgaa

SEQ ID NO: 688030 - DNA, 20 bp, mouse
gcaaaagggtgacccggtcg

SEQ ID NO: 688031 - DNA, 20 bp, mouse
gagcgctgtgggccgagaac

SEQ ID NO: 688032 - DNA, 20 bp, mouse
ggctacgccctcttgaaagg

SEQ ID NO: 688033 - DNA, 20 bp, mouse
gtctaccgccgcggccaaaa

SEQ ID NO: 688034 - DNA, 20 bp, mouse
gggcccggggagtttgggct

SEQ ID NO: 688035 - DNA, 20 bp, mouse
ggtcgccatggagatagcgc

SEQ ID NO: 688036 - DNA, 20 bp, mouse
gactcaggcagggtagaccc

SEQ ID NO: 688037 - DNA, 20 bp, mouse
gtatacatatcatataagtg

SEQ ID NO: 688038 - DNA, 20 bp, mouse
gtagcaagtaagattgtggt

SEQ ID NO: 688039 - DNA, 20 bp, mouse
ggaactcactagttccataa

SEQ ID NO: 688040 - DNA, 20 bp, mouse
gtcaatggaaataactatgg

SEQ ID NO: 688041 - DNA, 20 bp, mouse
gagtgtagcaagtaagattg

SEQ ID NO: 688042 - DNA, 20 bp, mouse
ggcctagctgcactcaggca

SEQ ID NO: 688043 - DNA, 20 bp, mouse
gtaaatcagtccagcttcaa

SEQ ID NO: 688044 - DNA, 20 bp, mouse
gggaataaatggttcttata

SEQ ID NO: 688045 - DNA, 20 bp, mouse
gtgaaatcttatttatctat

SEQ ID NO: 688046 - DNA, 20 bp, mouse
gggagtcagcgagtcctgga

SEQ ID NO: 688047 - DNA, 20 bp, mouse
gagtcctggagggccttgcg

SEQ ID NO: 688048 - DNA, 20 bp, mouse
gaccccccgcaaggccctcc

SEQ ID NO: 688049 - DNA, 20 bp, mouse
gggcacgctgggtcctttcc

SEQ ID NO: 688050 - DNA, 20 bp, mouse
gctcgctgactcccgggcag

SEQ ID NO: 688051 - DNA, 20 bp, mouse
gagcaaacgcggggtcggtc

SEQ ID NO: 688052 - DNA, 20 bp, mouse
gcctgccagtgtgcgtctgg

SEQ ID NO: 688053 - DNA, 20 bp, mouse
gaggactcaaacatccccaa

SEQ ID NO: 688054 - DNA, 20 bp, mouse
ggggctgtgactccttctag

SEQ ID NO: 688055 - DNA, 20 bp, mouse
gacatccccaaagggcgtcc

SEQ ID NO: 688056 - DNA, 20 bp, mouse
ggggcagtaggcatggtcga

SEQ ID NO: 688057 - DNA, 20 bp, mouse
gtgttcagcaaggtgctgaa

SEQ ID NO: 688058 - DNA, 20 bp, mouse
gaagggaagggcatggtcct

SEQ ID NO: 688059 - DNA, 20 bp, mouse
gtacacccgggtgttcagca

SEQ ID NO: 688060 - DNA, 20 bp, mouse
gaaggtgctgaaggggcagt

SEQ ID NO: 688061 - DNA, 20 bp, mouse
gagcaccttgctgaacaccc

SEQ ID NO: 688062 - DNA, 20 bp, mouse
gatcccgggcctggcgtctg

SEQ ID NO: 688063 - DNA, 20 bp, mouse
gcgtgtaggtccagtcgccg

SEQ ID NO: 688064 - DNA, 20 bp, mouse
gtgagggtgctgggattgtc

SEQ ID NO: 688065 - DNA, 20 bp, mouse
gccagtcgccgcgggatccc

SEQ ID NO: 688066 - DNA, 20 bp, mouse
gcaaggtcacgagttactgg

SEQ ID NO: 688067 - DNA, 20 bp, mouse
ggagcaagaatcaatcgttt

SEQ ID NO: 688068 - DNA, 20 bp, mouse
gccgaccctccgaagattcc

SEQ ID NO: 688069 - DNA, 20 bp, mouse
gctacaggctggaggaccat

SEQ ID NO: 688070 - DNA, 20 bp, mouse
ggagggtcggcagtgactga

SEQ ID NO: 688071 - DNA, 20 bp, mouse
gtctctgtaccgggaatctt

SEQ ID NO: 688072 - DNA, 20 bp, mouse
gtgtaccgggaatcttcgga

SEQ ID NO: 688073 - DNA, 20 bp, mouse
gcacagtcgtgccaagtgcg

SEQ ID NO: 688074 - DNA, 20 bp, mouse
gtgcgccgcctacaggctgg

SEQ ID NO: 688075 - DNA, 20 bp, mouse
gcggcgcagcgtctctgtac

SEQ ID NO: 688076 - DNA, 20 bp, mouse
gggacccggagcggacgctc

SEQ ID NO: 688077 - DNA, 20 bp, mouse
gccccgggccgcgctgtcgc

SEQ ID NO: 688078 - DNA, 20 bp, mouse
ggggaagggacttccgtttc

SEQ ID NO: 688079 - DNA, 20 bp, mouse
gcggcggcggtgctcgtggt

SEQ ID NO: 688080 - DNA, 20 bp, mouse
gaaggcagctacgtcctccg

SEQ ID NO: 688081 - DNA, 20 bp, mouse
gccggggaagccgtcacgat

SEQ ID NO: 688082 - DNA, 20 bp, mouse
gggagcccgagcgtccgctc

SEQ ID NO: 688083 - DNA, 20 bp, mouse
gctcaagcggaggctggccg

SEQ ID NO: 688084 - DNA, 20 bp, mouse
gggctccggctcggctgtca

SEQ ID NO: 688085 - DNA, 20 bp, mouse
gggccggcgtaggcaggctg

SEQ ID NO: 688086 - DNA, 20 bp, mouse
ggggaaatgtagtttctgca

SEQ ID NO: 688087 - DNA, 20 bp, mouse
ggtttgggaagggtctgaca

SEQ ID NO: 688088 - DNA, 20 bp, mouse
gtccgggacttccaactctg

SEQ ID NO: 688089 - DNA, 20 bp, mouse
gtttcccgacatgcactgga

SEQ ID NO: 688090 - DNA, 20 bp, mouse
gccgccctccagtgcatgtc

SEQ ID NO: 688091 - DNA, 20 bp, mouse
ggtttctgcagggaactgta

SEQ ID NO: 688092 - DNA, 20 bp, mouse
gactcgtctgagctgacgtg

SEQ ID NO: 688093 - DNA, 20 bp, mouse
gtgcagggaactgtagggcc

SEQ ID NO: 688094 - DNA, 20 bp, mouse
ggccgggagctcagactttc

SEQ ID NO: 688095 - DNA, 20 bp, mouse
gcactctggcttgggactgt

SEQ ID NO: 688096 - DNA, 20 bp, mouse
gggaacttgtggacaatcgg

SEQ ID NO: 688097 - DNA, 20 bp, mouse
gaaaaagggcggtagtagaa

SEQ ID NO: 688098 - DNA, 20 bp, mouse
gttccagccggtatcgatgt

SEQ ID NO: 688099 - DNA, 20 bp, mouse
ggctggaacttgtggacaat

SEQ ID NO: 688100 - DNA, 20 bp, mouse
gaggcagcccggaaaaaggg

SEQ ID NO: 688101 - DNA, 20 bp, mouse
gagagtggaaagacggaaat

SEQ ID NO: 688102 - DNA, 20 bp, mouse
gtggagacccacatcgatac

SEQ ID NO: 688103 - DNA, 20 bp, mouse
gcgaaacgctgcgttaagat

SEQ ID NO: 688104 - DNA, 20 bp, mouse
gggcacacggaggtacgctt

SEQ ID NO: 688105 - DNA, 20 bp, mouse
ggagcagtgtataaccaacc

SEQ ID NO: 688106 - DNA, 20 bp, mouse
gctagtgcaaaaacccttgg

SEQ ID NO: 688107 - DNA, 20 bp, mouse
gagcaggggtagcaggggag

SEQ ID NO: 688108 - DNA, 20 bp, mouse
gagtgctggagcatgcctag

SEQ ID NO: 688109 - DNA, 20 bp, mouse
ggggaacaagggctagatta

SEQ ID NO: 688110 - DNA, 20 bp, mouse
gtccccgcctggggccccac

SEQ ID NO: 688111 - DNA, 20 bp, mouse
gctccccactggtgtagccc

SEQ ID NO: 688112 - DNA, 20 bp, mouse
gggaaggggagcgccaggga

SEQ ID NO: 688113 - DNA, 20 bp, mouse
gacccttggtggctccagag

SEQ ID NO: 688114 - DNA, 20 bp, mouse
ggcaccgccgccggccctcg

SEQ ID NO: 688115 - DNA, 20 bp, mouse
gtggataaaacccggagaaa

SEQ ID NO: 688116 - DNA, 20 bp, mouse
gggggcggggagaagatgag

SEQ ID NO: 688117 - DNA, 20 bp, mouse
gccgacccgtagtcgcccca

SEQ ID NO: 688118 - DNA, 20 bp, mouse
gtccccgcccccaagcgcta

SEQ ID NO: 688119 - DNA, 20 bp, mouse
gccacgcctctgtgcagtga

SEQ ID NO: 688120 - DNA, 20 bp, mouse
gaccccgcgtggctgctgtc

SEQ ID NO: 688121 - DNA, 20 bp, mouse
ggcaccacccgtagcgcttg

SEQ ID NO: 688122 - DNA, 20 bp, mouse
gaggcctcgcggtccttgca

SEQ ID NO: 688123 - DNA, 20 bp, mouse
gcacccgtagcgcttggggg

SEQ ID NO: 688124 - DNA, 20 bp, mouse
gtgatccctggggcgactac

SEQ ID NO: 688125 - DNA, 20 bp, mouse
ggctgtccgtctgatccctg

SEQ ID NO: 688126 - DNA, 20 bp, mouse
ggcagggcccccatgagtga

SEQ ID NO: 688127 - DNA, 20 bp, mouse
gcccccatgagtgagggata

SEQ ID NO: 688128 - DNA, 20 bp, mouse
ggcagccgacccagcgcggt

SEQ ID NO: 688129 - DNA, 20 bp, mouse
gtggtcctaccgcgctgggt

SEQ ID NO: 688130 - DNA, 20 bp, mouse
gagccaggaagtagcacgca

SEQ ID NO: 688131 - DNA, 20 bp, mouse
gggccctgcgtgctacttcc

SEQ ID NO: 688132 - DNA, 20 bp, mouse
gccagcgcggtaggaccact

SEQ ID NO: 688133 - DNA, 20 bp, mouse
ggaaacttggcggcgagctc

SEQ ID NO: 688134 - DNA, 20 bp, mouse
gaggcagctgaggttcaagc

SEQ ID NO: 688135 - DNA, 20 bp, mouse
gtcggtgcacagtgtgagcg

SEQ ID NO: 688136 - DNA, 20 bp, mouse
gcggtgacctggattcatga

SEQ ID NO: 688137 - DNA, 20 bp, mouse
gctggtcagggggatcaaga

SEQ ID NO: 688138 - DNA, 20 bp, mouse
gcgcggcagcggacaggagg

SEQ ID NO: 688139 - DNA, 20 bp, mouse
gtacaaaatgcaggtggtta

SEQ ID NO: 688140 - DNA, 20 bp, mouse
gtgcagcagtactagtccta

SEQ ID NO: 688141 - DNA, 20 bp, mouse
gtggggcgggggccgcggaa

SEQ ID NO: 688142 - DNA, 20 bp, mouse
gaggaaaccttcatgaatcc

SEQ ID NO: 688143 - DNA, 20 bp, mouse
gctatggctcccacctggtc

SEQ ID NO: 688144 - DNA, 20 bp, mouse
gtaggccttaggaatttctg

SEQ ID NO: 688145 - DNA, 20 bp, mouse
gtagtcctatggctcccacc

SEQ ID NO: 688146 - DNA, 20 bp, mouse
ggccgggcggggatgagaag

SEQ ID NO: 688147 - DNA, 20 bp, mouse
gcggggatgagaagaggagc

SEQ ID NO: 688148 - DNA, 20 bp, mouse
ggggctggggcactcataga

SEQ ID NO: 688149 - DNA, 20 bp, mouse
ggataccagaagcacactaa

SEQ ID NO: 688150 - DNA, 20 bp, mouse
gaccagaagcacactaaggg

SEQ ID NO: 688151 - DNA, 20 bp, mouse
gtagttggtgccaaataatg

SEQ ID NO: 688152 - DNA, 20 bp, mouse
gcccggcagcgcagaagcca

SEQ ID NO: 688153 - DNA, 20 bp, mouse
gagaggagctggtatctagt

SEQ ID NO: 688154 - DNA, 20 bp, mouse
gatgttcggcctcactaaag

SEQ ID NO: 688155 - DNA, 20 bp, mouse
ggctggctaccctactgaga

SEQ ID NO: 688156 - DNA, 20 bp, mouse
gcatctctgtggaaacaagt

SEQ ID NO: 688157 - DNA, 20 bp, mouse
ggcagccagtggaacatgtg

SEQ ID NO: 688158 - DNA, 20 bp, mouse
gaaggataccgcagtcccta

SEQ ID NO: 688159 - DNA, 20 bp, mouse
gtcacgtgatagtctggcgg

SEQ ID NO: 688160 - DNA, 20 bp, mouse
ggtggggcttgcaaccccta

SEQ ID NO: 688161 - DNA, 20 bp, mouse
gagtaccacaaggtgatggg

SEQ ID NO: 688162 - DNA, 20 bp, mouse
ggcagcatcacgtgatagtc

SEQ ID NO: 688163 - DNA, 20 bp, mouse
gggacacttgggagatcata

SEQ ID NO: 688164 - DNA, 20 bp, mouse
gaagtaggagcccagaaatt

SEQ ID NO: 688165 - DNA, 20 bp, mouse
ggactgcggtatccttccgt

SEQ ID NO: 688166 - DNA, 20 bp, mouse
gacctcctcccgccgctcgg

SEQ ID NO: 688167 - DNA, 20 bp, mouse
gccacagcgccaccgagcgg

SEQ ID NO: 688168 - DNA, 20 bp, mouse
gctagcggccggaccaagaa

SEQ ID NO: 688169 - DNA, 20 bp, mouse
gctgtcaggcagtccacgtg

SEQ ID NO: 688170 - DNA, 20 bp, mouse
gagggcggggctcggggaac

SEQ ID NO: 688171 - DNA, 20 bp, mouse
gtgagtagctaacagaggtg

SEQ ID NO: 688172 - DNA, 20 bp, mouse
ggccaccgagcggcgggagg

SEQ ID NO: 688173 - DNA, 20 bp, mouse
ggagccccgccctccgacag

SEQ ID NO: 688174 - DNA, 20 bp, mouse
gagcgccaccgagcggcggg

SEQ ID NO: 688175 - DNA, 20 bp, mouse
gtcagcaggtacaggcacct

SEQ ID NO: 688176 - DNA, 20 bp, mouse
gtcctctcccagacagcaag

SEQ ID NO: 688177 - DNA, 20 bp, mouse
ggccagcagaactggagcag

SEQ ID NO: 688178 - DNA, 20 bp, mouse
gactctaggggacaatgctc

SEQ ID NO: 688179 - DNA, 20 bp, mouse
gaacgtccgtgaaactctag

SEQ ID NO: 688180 - DNA, 20 bp, mouse
gctggtggccccttgctgtc

SEQ ID NO: 688181 - DNA, 20 bp, mouse
gcgtcttagggctgaaggca

SEQ ID NO: 688182 - DNA, 20 bp, mouse
gggtcactgcagggtcgagc

SEQ ID NO: 688183 - DNA, 20 bp, mouse
gcgaaggcggcggacaccgg

SEQ ID NO: 688184 - DNA, 20 bp, mouse
gcaatgctcaggagcgtctt

SEQ ID NO: 688185 - DNA, 20 bp, mouse
gagaacccggggccaccttt

SEQ ID NO: 688186 - DNA, 20 bp, mouse
gactaggagcccataagaat

SEQ ID NO: 688187 - DNA, 20 bp, mouse
gtcaactcccccattcttat

SEQ ID NO: 688188 - DNA, 20 bp, mouse
ggtgagaggagatctttcaa

SEQ ID NO: 688189 - DNA, 20 bp, mouse
gaaggtggatctgcattgta

SEQ ID NO: 688190 - DNA, 20 bp, mouse
gtagggagtgcaagctatgg

SEQ ID NO: 688191 - DNA, 20 bp, mouse
ggtaatggggaggcaagaga

SEQ ID NO: 688192 - DNA, 20 bp, mouse
gaccagccctctagatttat

SEQ ID NO: 688193 - DNA, 20 bp, mouse
gaccaggaattcctggaata

SEQ ID NO: 688194 - DNA, 20 bp, mouse
gtgaatgctgaacccaggta

SEQ ID NO: 688195 - DNA, 20 bp, mouse
gttaccctctagttgaaaga

SEQ ID NO: 688196 - DNA, 20 bp, mouse
gctagcatgcgccaccctga

SEQ ID NO: 688197 - DNA, 20 bp, mouse
gtaacacagaaggagtggaa

SEQ ID NO: 688198 - DNA, 20 bp, mouse
gttaaaggagaaggtgtggc

SEQ ID NO: 688199 - DNA, 20 bp, mouse
gcatgcgccaccctgaggga

SEQ ID NO: 688200 - DNA, 20 bp, mouse
gaatcacgtcaaagagaaga

SEQ ID NO: 688201 - DNA, 20 bp, mouse
gacaggaggaccctccctca

SEQ ID NO: 688202 - DNA, 20 bp, mouse
gaagagcttaattgggccac

SEQ ID NO: 688203 - DNA, 20 bp, mouse
gggagggggaagagcttaat

SEQ ID NO: 688204 - DNA, 20 bp, mouse
gcggatgcagaaatagcagc

SEQ ID NO: 688205 - DNA, 20 bp, mouse
gggaggaccctccctcaggg

SEQ ID NO: 688206 - DNA, 20 bp, mouse
gatcccagccagttccaggg

SEQ ID NO: 688207 - DNA, 20 bp, mouse
ggaactggctgggattgcgc

SEQ ID NO: 688208 - DNA, 20 bp, mouse
gagcctccctggaactggct

SEQ ID NO: 688209 - DNA, 20 bp, mouse
gccagccctagtcacaaaat

SEQ ID NO: 688210 - DNA, 20 bp, mouse
gccgcctaaaggtgtagctc

SEQ ID NO: 688211 - DNA, 20 bp, mouse
gaggccccgcctccgcctaa

SEQ ID NO: 688212 - DNA, 20 bp, mouse
gccctagtcacaaaatggga

SEQ ID NO: 688213 - DNA, 20 bp, mouse
gtagcattaaagtagcctgg

SEQ ID NO: 688214 - DNA, 20 bp, mouse
ggctaatgagcagtgattac

SEQ ID NO: 688215 - DNA, 20 bp, mouse
gggttagttttaaccgagag

SEQ ID NO: 688216 - DNA, 20 bp, mouse
gctaaatcgcagtattccgg

SEQ ID NO: 688217 - DNA, 20 bp, mouse
gacaaagcgcatttctggcc

SEQ ID NO: 688218 - DNA, 20 bp, mouse
gtcacaattttgttgagggt

SEQ ID NO: 688219 - DNA, 20 bp, mouse
gtcctggcaactgtagatct

SEQ ID NO: 688220 - DNA, 20 bp, mouse
gatgctaaaatctccttttg

SEQ ID NO: 688221 - DNA, 20 bp, mouse
gtagcatcacaattttgttg

SEQ ID NO: 688222 - DNA, 20 bp, mouse
gtcccagatctacagttgcc

SEQ ID NO: 688223 - DNA, 20 bp, mouse
gtctacagttgccaggagca

SEQ ID NO: 688224 - DNA, 20 bp, mouse
gaatatacaaagcgcatttc

SEQ ID NO: 688225 - DNA, 20 bp, mouse
gttaaaactgtaattattgc

SEQ ID NO: 688226 - DNA, 20 bp, mouse
gcccgcaggctatgcccctg

SEQ ID NO: 688227 - DNA, 20 bp, mouse
gtatggggcccaatcccagg

SEQ ID NO: 688228 - DNA, 20 bp, mouse
gtcctatggggcccaatccc

SEQ ID NO: 688229 - DNA, 20 bp, mouse
gggtctgaaccccaaaaaag

SEQ ID NO: 688230 - DNA, 20 bp, mouse
gtagcctgcgggagccgcct

SEQ ID NO: 688231 - DNA, 20 bp, mouse
gtgcgggagccgcctgggat

SEQ ID NO: 688232 - DNA, 20 bp, mouse
gcccgtcagttcccagagga

SEQ ID NO: 688233 - DNA, 20 bp, mouse
gaacctagttagcttgaatc

SEQ ID NO: 688234 - DNA, 20 bp, mouse
gagaccccgtcagttcccag

SEQ ID NO: 688235 - DNA, 20 bp, mouse
gcactagggcccgcctccta

SEQ ID NO: 688236 - DNA, 20 bp, mouse
gtccccagagaatcacttca

SEQ ID NO: 688237 - DNA, 20 bp, mouse
ggagaatcacttcacggaga

SEQ ID NO: 688238 - DNA, 20 bp, mouse
gtccgtgaagtgattctctg

SEQ ID NO: 688239 - DNA, 20 bp, mouse
gggcagcatgccgagagatg

SEQ ID NO: 688240 - DNA, 20 bp, mouse
ggacatgtggttcccagatg

SEQ ID NO: 688241 - DNA, 20 bp, mouse
gagaacagctaccagatacc

SEQ ID NO: 688242 - DNA, 20 bp, mouse
gttgctagtaagaaggggcg

SEQ ID NO: 688243 - DNA, 20 bp, mouse
gcgtccagcttgttttaagg

SEQ ID NO: 688244 - DNA, 20 bp, mouse
gagagtggagcagctgcctc

SEQ ID NO: 688245 - DNA, 20 bp, mouse
gagatgagggaaggataggt

SEQ ID NO: 688246 - DNA, 20 bp, mouse
gaacccgagagcggcaacgg

SEQ ID NO: 688247 - DNA, 20 bp, mouse
gacaacggaacgccgcgggg

SEQ ID NO: 688248 - DNA, 20 bp, mouse
gcacgcgcgggctaccagcg

SEQ ID NO: 688249 - DNA, 20 bp, mouse
gggagtccggcgccgcctct

SEQ ID NO: 688250 - DNA, 20 bp, mouse
ggccgctgcctaccgcgtgg

SEQ ID NO: 688251 - DNA, 20 bp, mouse
gccagatccccggttcccga

SEQ ID NO: 688252 - DNA, 20 bp, mouse
ggcgcccgggcgcgctccag

SEQ ID NO: 688253 - DNA, 20 bp, mouse
gctaccgcgtggcggccgag

SEQ ID NO: 688254 - DNA, 20 bp, mouse
gctccgccgttgccgctctc

SEQ ID NO: 688255 - DNA, 20 bp, mouse
gggcaacccgagagcggcaa

SEQ ID NO: 688256 - DNA, 20 bp, mouse
gaacgcccagaccctgggga

SEQ ID NO: 688257 - DNA, 20 bp, mouse
ggtcctgtaggggaaaacct

SEQ ID NO: 688258 - DNA, 20 bp, mouse
ggggaggcatggatttgtgg

SEQ ID NO: 688259 - DNA, 20 bp, mouse
gaactccaacgcccagaccc

SEQ ID NO: 688260 - DNA, 20 bp, mouse
ggagaatgcaaggtcaggac

SEQ ID NO: 688261 - DNA, 20 bp, mouse
gaaagagctctgtcctgtag

SEQ ID NO: 688262 - DNA, 20 bp, mouse
gaagacctggaacgtggtgg

SEQ ID NO: 688263 - DNA, 20 bp, mouse
gaagaggtgtagccttcccc

SEQ ID NO: 688264 - DNA, 20 bp, mouse
gtgggcgttggagttcgcct

SEQ ID NO: 688265 - DNA, 20 bp, mouse
gagcccgcgcgcccctgagc

SEQ ID NO: 688266 - DNA, 20 bp, mouse
gtcgtgcggcgcacaccgga

SEQ ID NO: 688267 - DNA, 20 bp, mouse
gtgccccgccccgtctcgtg

SEQ ID NO: 688268 - DNA, 20 bp, mouse
gggtgtgcgccgcacgagac

SEQ ID NO: 688269 - DNA, 20 bp, mouse
gtgcgccgcacgagacgggg

SEQ ID NO: 688270 - DNA, 20 bp, mouse
gggcgcacaccggaaggaag

SEQ ID NO: 688271 - DNA, 20 bp, mouse
ggggaaggtcccccgagact

SEQ ID NO: 688272 - DNA, 20 bp, mouse
gccgctcagagggctgtttt

SEQ ID NO: 688273 - DNA, 20 bp, mouse
gcaccagggactccgaacac

SEQ ID NO: 688274 - DNA, 20 bp, mouse
gaaaggttacccagtctcgg

SEQ ID NO: 688275 - DNA, 20 bp, mouse
gactgggtaacctttcttcg

SEQ ID NO: 688276 - DNA, 20 bp, mouse
gaaaagaaggctgacgatgg

SEQ ID NO: 688277 - DNA, 20 bp, mouse
gagctggagggtgagactgg

SEQ ID NO: 688278 - DNA, 20 bp, mouse
gtgcagtcccgccagctgga

SEQ ID NO: 688279 - DNA, 20 bp, mouse
ggtctcaccctccagctggc

SEQ ID NO: 688280 - DNA, 20 bp, mouse
gtgggcgtttcaacaaaagt

SEQ ID NO: 688281 - DNA, 20 bp, mouse
gtgcctgcagtcccgccagc

SEQ ID NO: 688282 - DNA, 20 bp, mouse
gaccaaaagaaggctgacga

SEQ ID NO: 688283 - DNA, 20 bp, mouse
gctcgctatgttaagatttc

SEQ ID NO: 688284 - DNA, 20 bp, mouse
gctgagaactctcatcgctt

SEQ ID NO: 688285 - DNA, 20 bp, mouse
gtaggtccagtggtgatttg

SEQ ID NO: 688286 - DNA, 20 bp, mouse
ggccatcccgtggccatcgt

SEQ ID NO: 688287 - DNA, 20 bp, mouse
gcagcaaggagcgagggcgg

SEQ ID NO: 688288 - DNA, 20 bp, mouse
ggggtccctccaaggcgctc

SEQ ID NO: 688289 - DNA, 20 bp, mouse
ggcccacgatggccacggga

SEQ ID NO: 688290 - DNA, 20 bp, mouse
ggcctcagccatgcccacga

SEQ ID NO: 688291 - DNA, 20 bp, mouse
gctccgggaaccagagtgca

SEQ ID NO: 688292 - DNA, 20 bp, mouse
ggcgctctagcgaaacgctc

SEQ ID NO: 688293 - DNA, 20 bp, mouse
gcggacatagggactggatc

SEQ ID NO: 688294 - DNA, 20 bp, mouse
gcgccttggagggacccagt

SEQ ID NO: 688295 - DNA, 20 bp, mouse
gctccctgcactctggttcc

SEQ ID NO: 688296 - DNA, 20 bp, mouse
gaggcgtaggcccacttagg

SEQ ID NO: 688297 - DNA, 20 bp, mouse
gtgcccgagcccgcctaagt

SEQ ID NO: 688298 - DNA, 20 bp, mouse
gccgcgcaccgcagaggcgt

SEQ ID NO: 688299 - DNA, 20 bp, mouse
gcagaggcgtaggcccactt

SEQ ID NO: 688300 - DNA, 20 bp, mouse
gggcaccccgcgcaccgcag

SEQ ID NO: 688301 - DNA, 20 bp, mouse
ggcgcgacgtccctcactta

SEQ ID NO: 688302 - DNA, 20 bp, mouse
gtcgtggcacctggaagtga

SEQ ID NO: 688303 - DNA, 20 bp, mouse
gagaaagatctacggcaggg

SEQ ID NO: 688304 - DNA, 20 bp, mouse
gctggaagtgacggtccccg

SEQ ID NO: 688305 - DNA, 20 bp, mouse
gaggagaaagatctacggca

SEQ ID NO: 688306 - DNA, 20 bp, mouse
gtgggaccagtggaacggtg

SEQ ID NO: 688307 - DNA, 20 bp, mouse
ggaacagagcccggcagctt

SEQ ID NO: 688308 - DNA, 20 bp, mouse
gtggggcggggcaacgctca

SEQ ID NO: 688309 - DNA, 20 bp, mouse
gtgctccccaaggttgagtt

SEQ ID NO: 688310 - DNA, 20 bp, mouse
gcgcctaccaaactcaacct

SEQ ID NO: 688311 - DNA, 20 bp, mouse
gctctgttccagagaatttc

SEQ ID NO: 688312 - DNA, 20 bp, mouse
gagccaaggcaatatggaag

SEQ ID NO: 688313 - DNA, 20 bp, mouse
gcctctggccaccagcaaat

SEQ ID NO: 688314 - DNA, 20 bp, mouse
gcctggtccctggagagttc

SEQ ID NO: 688315 - DNA, 20 bp, mouse
gcaaggcaatatggaagggg

SEQ ID NO: 688316 - DNA, 20 bp, mouse
gtgtggactcataaactcag

SEQ ID NO: 688317 - DNA, 20 bp, mouse
gcaccccgacttattgtaac

SEQ ID NO: 688318 - DNA, 20 bp, mouse
gtgctaggggttgtgcttaa

SEQ ID NO: 688319 - DNA, 20 bp, mouse
gggtggcaggtgaggtacaa

SEQ ID NO: 688320 - DNA, 20 bp, mouse
gttatgagtccacagagggg

SEQ ID NO: 688321 - DNA, 20 bp, mouse
gaggcttgaggggtaatcaa

SEQ ID NO: 688322 - DNA, 20 bp, mouse
ggtagctccacctcagggca

SEQ ID NO: 688323 - DNA, 20 bp, mouse
gcatccagttacaataagtc

SEQ ID NO: 688324 - DNA, 20 bp, mouse
gtgtgcttaagggtttgtcc

SEQ ID NO: 688325 - DNA, 20 bp, mouse
ggagtttatgagtccacaga

SEQ ID NO: 688326 - DNA, 20 bp, mouse
gccgcccgggctcacagaaa

SEQ ID NO: 688327 - DNA, 20 bp, mouse
gcgtcccgggagggtgagga

SEQ ID NO: 688328 - DNA, 20 bp, mouse
gctcacagaaagggcgcgaa

SEQ ID NO: 688329 - DNA, 20 bp, mouse
ggaggggtgatcgtcccggg

SEQ ID NO: 688330 - DNA, 20 bp, mouse
ggcgagaggcgctcactgat

SEQ ID NO: 688331 - DNA, 20 bp, mouse
gactgattggtcagaatcgt

SEQ ID NO: 688332 - DNA, 20 bp, mouse
ggacgatcacccctccattg

SEQ ID NO: 688333 - DNA, 20 bp, mouse
ggtgggatatgcaaattaga

SEQ ID NO: 688334 - DNA, 20 bp, mouse
gcaatgcaggccacaatgga

SEQ ID NO: 688335 - DNA, 20 bp, mouse
gaactgctgcagtgcgcgca

SEQ ID NO: 688336 - DNA, 20 bp, mouse
gggaccccgtaaggcaggaa

SEQ ID NO: 688337 - DNA, 20 bp, mouse
gcgtgaacgccagtggagga

SEQ ID NO: 688338 - DNA, 20 bp, mouse
ggagctggcaatagagggag

SEQ ID NO: 688339 - DNA, 20 bp, mouse
gccctcccgggctcccgcgg

SEQ ID NO: 688340 - DNA, 20 bp, mouse
gcgggcgtgaacgccagtgg

SEQ ID NO: 688341 - DNA, 20 bp, mouse
ggcaaagaagaaaatcaata

SEQ ID NO: 688342 - DNA, 20 bp, mouse
gtggaggagggtgcgagtgg

SEQ ID NO: 688343 - DNA, 20 bp, mouse
gaggagggtgcgagtggcgg

SEQ ID NO: 688344 - DNA, 20 bp, mouse
gagccgggcgtgaacgccag

SEQ ID NO: 688345 - DNA, 20 bp, mouse
gtcggggcgaagggggactg

SEQ ID NO: 688346 - DNA, 20 bp, mouse
ggcaccccggtccacctgtg

SEQ ID NO: 688347 - DNA, 20 bp, mouse
gcacctgtgcggagtagaga

SEQ ID NO: 688348 - DNA, 20 bp, mouse
gccaggatgctcttggggaa

SEQ ID NO: 688349 - DNA, 20 bp, mouse
gactccgcacaggtggaccg

SEQ ID NO: 688350 - DNA, 20 bp, mouse
gcaggtggaccggggtgcag

SEQ ID NO: 688351 - DNA, 20 bp, mouse
ggtcccagcctgtggcctcc

SEQ ID NO: 688352 - DNA, 20 bp, mouse
gcccggatgcaaatgacggt

SEQ ID NO: 688353 - DNA, 20 bp, mouse
gcatcctggaggccacaggc

SEQ ID NO: 688354 - DNA, 20 bp, mouse
gtggtgtgaccgcgggacta

SEQ ID NO: 688355 - DNA, 20 bp, mouse
gggggcccggatgcaaatga

SEQ ID NO: 688356 - DNA, 20 bp, mouse
ggggccaatcacggatccga

SEQ ID NO: 688357 - DNA, 20 bp, mouse
ggagccgcctgggccaatca

SEQ ID NO: 688358 - DNA, 20 bp, mouse
gcggtggcggggtctctccg

SEQ ID NO: 688359 - DNA, 20 bp, mouse
gaggtggcgagcacttgggg

SEQ ID NO: 688360 - DNA, 20 bp, mouse
gcggacccggggcctgcaaa

SEQ ID NO: 688361 - DNA, 20 bp, mouse
gctcgagctagcaggttagg

SEQ ID NO: 688362 - DNA, 20 bp, mouse
gcaggccccgggtccgagaa

SEQ ID NO: 688363 - DNA, 20 bp, mouse
ggagctagcaggttaggcgg

SEQ ID NO: 688364 - DNA, 20 bp, mouse
gtcgaggtggcgagcacttg

SEQ ID NO: 688365 - DNA, 20 bp, mouse
gagtcccgagtggcgagcgg

SEQ ID NO: 688366 - DNA, 20 bp, mouse
gtgggtgagaatggtcaaaa

SEQ ID NO: 688367 - DNA, 20 bp, mouse
gggctcagttatacaagctc

SEQ ID NO: 688368 - DNA, 20 bp, mouse
gaattccggccccatccggg

SEQ ID NO: 688369 - DNA, 20 bp, mouse
gctgaccaaggtggagcaaa

SEQ ID NO: 688370 - DNA, 20 bp, mouse
gcccagctcaattatagtgt

SEQ ID NO: 688371 - DNA, 20 bp, mouse
ggtaaattccggccccatcc

SEQ ID NO: 688372 - DNA, 20 bp, mouse
gtcaggaacctgctttccat

SEQ ID NO: 688373 - DNA, 20 bp, mouse
gcagttatacaagctcaggg

SEQ ID NO: 688374 - DNA, 20 bp, mouse
gaacaacaggccggatgagt

SEQ ID NO: 688375 - DNA, 20 bp, mouse
ggggttgaagactacaatat

SEQ ID NO: 688376 - DNA, 20 bp, mouse
gggctcccgcccgtccggga

SEQ ID NO: 688377 - DNA, 20 bp, mouse
gagcggcaggcggaagctgc

SEQ ID NO: 688378 - DNA, 20 bp, mouse
ggagctccagggcccgacgg

SEQ ID NO: 688379 - DNA, 20 bp, mouse
gacccggcgtctcctccgtc

SEQ ID NO: 688380 - DNA, 20 bp, mouse
gagcgagctccagggcccga

SEQ ID NO: 688381 - DNA, 20 bp, mouse
gacgccgggtcgccgtgcgt

SEQ ID NO: 688382 - DNA, 20 bp, mouse
gcccgcggctcccgcccgtc

SEQ ID NO: 688383 - DNA, 20 bp, mouse
ggggcagaagggcccgcgga

SEQ ID NO: 688384 - DNA, 20 bp, mouse
gggcccgacggaggagacgc

SEQ ID NO: 688385 - DNA, 20 bp, mouse
gcccctaccccctcccggac

SEQ ID NO: 688386 - DNA, 20 bp, mouse
ggtcccgcgtggcgtggcgt

SEQ ID NO: 688387 - DNA, 20 bp, mouse
gggtggggcgcgggcggtcc

SEQ ID NO: 688388 - DNA, 20 bp, mouse
ggctctggaaggaagctcag

SEQ ID NO: 688389 - DNA, 20 bp, mouse
ggaagccgagcggtcccgcg

SEQ ID NO: 688390 - DNA, 20 bp, mouse
ggaagcgctcagagacccga

SEQ ID NO: 688391 - DNA, 20 bp, mouse
gaggcccagccccggaggga

SEQ ID NO: 688392 - DNA, 20 bp, mouse
gaaccggtgaagtcacaaag

SEQ ID NO: 688393 - DNA, 20 bp, mouse
gggtcccgctatgggttctg

SEQ ID NO: 688394 - DNA, 20 bp, mouse
gcgggacagagactccggga

SEQ ID NO: 688395 - DNA, 20 bp, mouse
gacgggcagccgggtgggtg

SEQ ID NO: 688396 - DNA, 20 bp, mouse
gagcccggagcccacgccct

SEQ ID NO: 688397 - DNA, 20 bp, mouse
ggcgccgagggcgtgggctc

SEQ ID NO: 688398 - DNA, 20 bp, mouse
gtccgcctccgccgcgccga

SEQ ID NO: 688399 - DNA, 20 bp, mouse
gtcagcgagccgccattcag

SEQ ID NO: 688400 - DNA, 20 bp, mouse
gtccgggggcccctgaatgg

SEQ ID NO: 688401 - DNA, 20 bp, mouse
gtcgccggagcgacaatgtg

SEQ ID NO: 688402 - DNA, 20 bp, mouse
gctagagggcggaggggcaa

SEQ ID NO: 688403 - DNA, 20 bp, mouse
ggcaccgcggggctcaatcg

SEQ ID NO: 688404 - DNA, 20 bp, mouse
gcgcggcggaggcggaccca

SEQ ID NO: 688405 - DNA, 20 bp, mouse
gctgccgcacattgtcgctc

SEQ ID NO: 688406 - DNA, 20 bp, mouse
gcgactgagtgactgatagg

SEQ ID NO: 688407 - DNA, 20 bp, mouse
gggaaggggcggggatgttg

SEQ ID NO: 688408 - DNA, 20 bp, mouse
gctaacccccggtgagccga

SEQ ID NO: 688409 - DNA, 20 bp, mouse
ggggcgacggccagtcccga

SEQ ID NO: 688410 - DNA, 20 bp, mouse
ggcccggcctagggaagggg

SEQ ID NO: 688411 - DNA, 20 bp, mouse
ggggttgtgggcacggcgag

SEQ ID NO: 688412 - DNA, 20 bp, mouse
ggctctgggctagacagaac

SEQ ID NO: 688413 - DNA, 20 bp, mouse
gccgaaggctccggagtcgg

SEQ ID NO: 688414 - DNA, 20 bp, mouse
gccagccctcggctcaccgg

SEQ ID NO: 688415 - DNA, 20 bp, mouse
gtggacccgccagacaaggt

SEQ ID NO: 688416 - DNA, 20 bp, mouse
gaaggggcgggcagcgtcca

SEQ ID NO: 688417 - DNA, 20 bp, mouse
gggccagaggcggaaccaga

SEQ ID NO: 688418 - DNA, 20 bp, mouse
gggaaccagaaggctagggg

SEQ ID NO: 688419 - DNA, 20 bp, mouse
gcggcggcgcagcagatccc

SEQ ID NO: 688420 - DNA, 20 bp, mouse
gaggcggaaccagaaggcta

SEQ ID NO: 688421 - DNA, 20 bp, mouse
gaccagaaggctaggggcgg

SEQ ID NO: 688422 - DNA, 20 bp, mouse
gaccctgcgggaagtggtgt

SEQ ID NO: 688423 - DNA, 20 bp, mouse
gcctcccgggattctcgcgc

SEQ ID NO: 688424 - DNA, 20 bp, mouse
gggcgggcagcgtccagggg

SEQ ID NO: 688425 - DNA, 20 bp, mouse
gtggcgggaccctaagatgg

SEQ ID NO: 688426 - DNA, 20 bp, mouse
ggcagcgcccgcagcgcacg

SEQ ID NO: 688427 - DNA, 20 bp, mouse
gcgcagggaggggacgtagg

SEQ ID NO: 688428 - DNA, 20 bp, mouse
ggcggcggcgccaaggcctc

SEQ ID NO: 688429 - DNA, 20 bp, mouse
gcggcgagcgcagctggcta

SEQ ID NO: 688430 - DNA, 20 bp, mouse
gcgaggcgggcccgctcctc

SEQ ID NO: 688431 - DNA, 20 bp, mouse
ggggacggaagaaatgcccg

SEQ ID NO: 688432 - DNA, 20 bp, mouse
ggccccggggcgcgtgggac

SEQ ID NO: 688433 - DNA, 20 bp, mouse
ggccaagccccgtgcgctgc

SEQ ID NO: 688434 - DNA, 20 bp, mouse
gtgtctgccccgcgccctgg

SEQ ID NO: 688435 - DNA, 20 bp, mouse
gggccttggcgccgccgcca

SEQ ID NO: 688436 - DNA, 20 bp, mouse
gcagtcacctgacccatctc

SEQ ID NO: 688437 - DNA, 20 bp, mouse
ggcgacagctagccagagat

SEQ ID NO: 688438 - DNA, 20 bp, mouse
ggattccccttgcctgaagt

SEQ ID NO: 688439 - DNA, 20 bp, mouse
gggctgacttgaccccacga

SEQ ID NO: 688440 - DNA, 20 bp, mouse
gagtgcctgacagagaagct

SEQ ID NO: 688441 - DNA, 20 bp, mouse
gcccttgcctgaagttggtt

SEQ ID NO: 688442 - DNA, 20 bp, mouse
gaggaacaagccgttgccaa

SEQ ID NO: 688443 - DNA, 20 bp, mouse
gtcaaagcagcagtctgcgg

SEQ ID NO: 688444 - DNA, 20 bp, mouse
gttgaccccacgaaggcaga

SEQ ID NO: 688445 - DNA, 20 bp, mouse
ggactgctttcccttggcaa

SEQ ID NO: 688446 - DNA, 20 bp, mouse
gtgtgtgtaaccaagatgca

SEQ ID NO: 688447 - DNA, 20 bp, mouse
gaccccgcctgcgccctagc

SEQ ID NO: 688448 - DNA, 20 bp, mouse
ggcggggtgtaggaaaccag

SEQ ID NO: 688449 - DNA, 20 bp, mouse
gaatctggacggtgagaggc

SEQ ID NO: 688450 - DNA, 20 bp, mouse
gctagcaggttcagatcaca

SEQ ID NO: 688451 - DNA, 20 bp, mouse
gacagggaaaagcatggtcg

SEQ ID NO: 688452 - DNA, 20 bp, mouse
gtacccggcgccctctgccg

SEQ ID NO: 688453 - DNA, 20 bp, mouse
ggaacctgctagggcgcagg

SEQ ID NO: 688454 - DNA, 20 bp, mouse
gtgtaggaaaccagaggccc

SEQ ID NO: 688455 - DNA, 20 bp, mouse
gccagaatctggacggtgag

SEQ ID NO: 688456 - DNA, 20 bp, mouse
gtagcactggggccctgggt

SEQ ID NO: 688457 - DNA, 20 bp, mouse
gggaaccccgcccctgggac

SEQ ID NO: 688458 - DNA, 20 bp, mouse
ggccctgattcctcaaagga

SEQ ID NO: 688459 - DNA, 20 bp, mouse
ggagacacagcatccgtttc

SEQ ID NO: 688460 - DNA, 20 bp, mouse
gctcaaaggaggggatcgac

SEQ ID NO: 688461 - DNA, 20 bp, mouse
gcccgggcgcctcgtggcca

SEQ ID NO: 688462 - DNA, 20 bp, mouse
gcgcccgggaaccccgcccc

SEQ ID NO: 688463 - DNA, 20 bp, mouse
ggtgggtggggcctgtccca

SEQ ID NO: 688464 - DNA, 20 bp, mouse
gcttggccctgattcctcaa

SEQ ID NO: 688465 - DNA, 20 bp, mouse
gcgccgcgcgcgcaggaggg

SEQ ID NO: 688466 - DNA, 20 bp, mouse
gtcccatagaggcttcctaa

SEQ ID NO: 688467 - DNA, 20 bp, mouse
ggaagcctctatgggaattg

SEQ ID NO: 688468 - DNA, 20 bp, mouse
gctccccccaattcccatag

SEQ ID NO: 688469 - DNA, 20 bp, mouse
gtgggcgaacacagacaaca

SEQ ID NO: 688470 - DNA, 20 bp, mouse
gaacaggtaattcttccctt

SEQ ID NO: 688471 - DNA, 20 bp, mouse
gggagatgttccatcagtat

SEQ ID NO: 688472 - DNA, 20 bp, mouse
ggcactgcctgctattatat

SEQ ID NO: 688473 - DNA, 20 bp, mouse
gaagaactggaaatacattt

SEQ ID NO: 688474 - DNA, 20 bp, mouse
gtcccttaggaagcctctat

SEQ ID NO: 688475 - DNA, 20 bp, mouse
gaaatcagaaatgggagttg

SEQ ID NO: 688476 - DNA, 20 bp, mouse
gcacaaactagccccgatga

SEQ ID NO: 688477 - DNA, 20 bp, mouse
gctgatgtgtcccctcatcg

SEQ ID NO: 688478 - DNA, 20 bp, mouse
gtggctggctctgacgaatc

SEQ ID NO: 688479 - DNA, 20 bp, mouse
gaactctaggaaattggcag

SEQ ID NO: 688480 - DNA, 20 bp, mouse
gcgaagtgactggcataaaa

SEQ ID NO: 688481 - DNA, 20 bp, mouse
gacaacctgcttttctacct

SEQ ID NO: 688482 - DNA, 20 bp, mouse
gcccctgcctgcaaatcccc

SEQ ID NO: 688483 - DNA, 20 bp, mouse
gagttcagaaattcaagccg

SEQ ID NO: 688484 - DNA, 20 bp, mouse
ggcggctctccaagatacct

SEQ ID NO: 688485 - DNA, 20 bp, mouse
gagagccagccatcccatcc

SEQ ID NO: 688486 - DNA, 20 bp, mouse
gcgcgcgggccgcagaagcg

SEQ ID NO: 688487 - DNA, 20 bp, mouse
ggaagcgtggctgataggag

SEQ ID NO: 688488 - DNA, 20 bp, mouse
gcgccctcccacctgcgtcc

SEQ ID NO: 688489 - DNA, 20 bp, mouse
gttccaggacgcaggtggga

SEQ ID NO: 688490 - DNA, 20 bp, mouse
ggggcggggtccagagtcgc

SEQ ID NO: 688491 - DNA, 20 bp, mouse
gccgcagaagcgtggctgat

SEQ ID NO: 688492 - DNA, 20 bp, mouse
gtgtgtgtggcctctaaagt

SEQ ID NO: 688493 - DNA, 20 bp, mouse
gccactctcggatctgtgtg

SEQ ID NO: 688494 - DNA, 20 bp, mouse
gtcgccccaagcccaggaac

SEQ ID NO: 688495 - DNA, 20 bp, mouse
ggcagagcggccgccaacgg

SEQ ID NO: 688496 - DNA, 20 bp, mouse
gtggcgggacagggaggagt

SEQ ID NO: 688497 - DNA, 20 bp, mouse
ggtcgctcgggccaacttcc

SEQ ID NO: 688498 - DNA, 20 bp, mouse
gttggcccgagcgaccgctc

SEQ ID NO: 688499 - DNA, 20 bp, mouse
gcgctctggtcacctcactg

SEQ ID NO: 688500 - DNA, 20 bp, mouse
gagggaggagtcggcggaga

SEQ ID NO: 688501 - DNA, 20 bp, mouse
ggggcgagcgcaggtccggc

SEQ ID NO: 688502 - DNA, 20 bp, mouse
ggctgggcacgggagtcgaa

SEQ ID NO: 688503 - DNA, 20 bp, mouse
ggaaggggcgagcgcaggtc

SEQ ID NO: 688504 - DNA, 20 bp, mouse
ggtgaccagagcggtcgctc

SEQ ID NO: 688505 - DNA, 20 bp, mouse
gcgtcggcgcggacttctcg

SEQ ID NO: 688506 - DNA, 20 bp, mouse
gcagctggacgaggtaggaa

SEQ ID NO: 688507 - DNA, 20 bp, mouse
gcatcgcagctggacgaggt

SEQ ID NO: 688508 - DNA, 20 bp, mouse
gagcatccgggtcttgactt

SEQ ID NO: 688509 - DNA, 20 bp, mouse
gcccggatgctcatcgcagc

SEQ ID NO: 688510 - DNA, 20 bp, mouse
gggagtccgggcacaccacg

SEQ ID NO: 688511 - DNA, 20 bp, mouse
gctcccggtgctacgagatt

SEQ ID NO: 688512 - DNA, 20 bp, mouse
gtggacgaggtaggaacgga

SEQ ID NO: 688513 - DNA, 20 bp, mouse
gccaggaagcgcaccaagaa

SEQ ID NO: 688514 - DNA, 20 bp, mouse
ggtagcaccgggagctcggg

SEQ ID NO: 688515 - DNA, 20 bp, mouse
gtgctcatcgcagctggacg

SEQ ID NO: 688516 - DNA, 20 bp, mouse
gcgcccccaaggcacgatcg

SEQ ID NO: 688517 - DNA, 20 bp, mouse
gtggaggacgacacggtgga

SEQ ID NO: 688518 - DNA, 20 bp, mouse
gggcggatcagcgagagtga

SEQ ID NO: 688519 - DNA, 20 bp, mouse
ggctcacccggttgcgcttc

SEQ ID NO: 688520 - DNA, 20 bp, mouse
gacctgtagacaatgtcgat

SEQ ID NO: 688521 - DNA, 20 bp, mouse
gccccaaggcacgatcgcgg

SEQ ID NO: 688522 - DNA, 20 bp, mouse
gcccggttgcgcttccggat

SEQ ID NO: 688523 - DNA, 20 bp, mouse
ggcaccttttgcaccgtgat

SEQ ID NO: 688524 - DNA, 20 bp, mouse
gagaaatccggacctgggga

SEQ ID NO: 688525 - DNA, 20 bp, mouse
ggcggaaacgcgcgctcacc

SEQ ID NO: 688526 - DNA, 20 bp, mouse
gagcagctcggagagggcgg

SEQ ID NO: 688527 - DNA, 20 bp, mouse
gaacacagagcagctcggag

SEQ ID NO: 688528 - DNA, 20 bp, mouse
gggtacccaaggtacagtct

SEQ ID NO: 688529 - DNA, 20 bp, mouse
gtcgaagcagaagagcaaag

SEQ ID NO: 688530 - DNA, 20 bp, mouse
gtctaggagggagtgactac

SEQ ID NO: 688531 - DNA, 20 bp, mouse
gctgggtatgtgcaagtcgg

SEQ ID NO: 688532 - DNA, 20 bp, mouse
gacacactgaaggtctagga

SEQ ID NO: 688533 - DNA, 20 bp, mouse
gaaggaggagaggcttccac

SEQ ID NO: 688534 - DNA, 20 bp, mouse
gagaggcttccactgggagg

SEQ ID NO: 688535 - DNA, 20 bp, mouse
gacagcaccattccgacctc

SEQ ID NO: 688536 - DNA, 20 bp, mouse
ggtgggaggacataataact

SEQ ID NO: 688537 - DNA, 20 bp, mouse
gggggcaaggcaggttatta

SEQ ID NO: 688538 - DNA, 20 bp, mouse
gtctacctgggggtaaaggg

SEQ ID NO: 688539 - DNA, 20 bp, mouse
gggaggacataataactggg

SEQ ID NO: 688540 - DNA, 20 bp, mouse
gcctgggggtaaagggagga

SEQ ID NO: 688541 - DNA, 20 bp, mouse
gttattaaggccaagaagga

SEQ ID NO: 688542 - DNA, 20 bp, mouse
gacaccccatgcccagccac

SEQ ID NO: 688543 - DNA, 20 bp, mouse
gttgccccccgggtgcaaac

SEQ ID NO: 688544 - DNA, 20 bp, mouse
ggctgggcatggggtgtcct

SEQ ID NO: 688545 - DNA, 20 bp, mouse
ggtaactggaaggagacgac

SEQ ID NO: 688546 - DNA, 20 bp, mouse
gaaccggtgggaactccctc

SEQ ID NO: 688547 - DNA, 20 bp, mouse
gcctgctagaccgccatctg

SEQ ID NO: 688548 - DNA, 20 bp, mouse
ggggcttttcctctgtccga

SEQ ID NO: 688549 - DNA, 20 bp, mouse
gtgaaagggtggcggccaga

SEQ ID NO: 688550 - DNA, 20 bp, mouse
gaacccccaggtaactccac

SEQ ID NO: 688551 - DNA, 20 bp, mouse
gtgccggtggagttacctgg

SEQ ID NO: 688552 - DNA, 20 bp, mouse
gagtacaggtgaaagggtgg

SEQ ID NO: 688553 - DNA, 20 bp, mouse
gatacctagtacaggtgaaa

SEQ ID NO: 688554 - DNA, 20 bp, mouse
gaagtccaaaagactcgaat

SEQ ID NO: 688555 - DNA, 20 bp, mouse
ggctagaccgccatctgggg

SEQ ID NO: 688556 - DNA, 20 bp, mouse
ggccccgcggggcagaaaag

SEQ ID NO: 688557 - DNA, 20 bp, mouse
gcggggcagaaaaggggtgt

SEQ ID NO: 688558 - DNA, 20 bp, mouse
ggacccgggaccgctttcct

SEQ ID NO: 688559 - DNA, 20 bp, mouse
ggagctcactcccaggaaag

SEQ ID NO: 688560 - DNA, 20 bp, mouse
ggcaggctcaggcatctcca

SEQ ID NO: 688561 - DNA, 20 bp, mouse
gagcgaaagggacgcgggta

SEQ ID NO: 688562 - DNA, 20 bp, mouse
gagttggcaaagggtggacc

SEQ ID NO: 688563 - DNA, 20 bp, mouse
ggggccacccagcgtctcct

SEQ ID NO: 688564 - DNA, 20 bp, mouse
gtggcggccgcggggagctc

SEQ ID NO: 688565 - DNA, 20 bp, mouse
gcggctccaggttccgtagt

SEQ ID NO: 688566 - DNA, 20 bp, mouse
gggggctgaccactccggaa

SEQ ID NO: 688567 - DNA, 20 bp, mouse
gacgcagtcggcgggaccca

SEQ ID NO: 688568 - DNA, 20 bp, mouse
gaagagctctctgacttcac

SEQ ID NO: 688569 - DNA, 20 bp, mouse
gggccgggggctgaccactc

SEQ ID NO: 688570 - DNA, 20 bp, mouse
gcagcagcagaggagtgcgg

SEQ ID NO: 688571 - DNA, 20 bp, mouse
gtgcctagctggcacccttc

SEQ ID NO: 688572 - DNA, 20 bp, mouse
gaagtcagagagctcttccc

SEQ ID NO: 688573 - DNA, 20 bp, mouse
ggaacagagctacacacgat

SEQ ID NO: 688574 - DNA, 20 bp, mouse
gctaggcagaggtgaccgcg

SEQ ID NO: 688575 - DNA, 20 bp, mouse
gcgccccagcggccagagca

SEQ ID NO: 688576 - DNA, 20 bp, mouse
gactaagtgaccccaggctg

SEQ ID NO: 688577 - DNA, 20 bp, mouse
gcccccgcgacaccccgggg

SEQ ID NO: 688578 - DNA, 20 bp, mouse
gccagccccccgcgacaccc

SEQ ID NO: 688579 - DNA, 20 bp, mouse
gtcaccaccccggggtgtcg

SEQ ID NO: 688580 - DNA, 20 bp, mouse
gtgtgggactaagtgacccc

SEQ ID NO: 688581 - DNA, 20 bp, mouse
ggagcaggatcgagactgtc

SEQ ID NO: 688582 - DNA, 20 bp, mouse
gggagtagcactcaccaccc

SEQ ID NO: 688583 - DNA, 20 bp, mouse
ggatcgagactgtctggtca

SEQ ID NO: 688584 - DNA, 20 bp, mouse
ggccgcctagcccagccccg

SEQ ID NO: 688585 - DNA, 20 bp, mouse
gctgctcctctggtcgagag

SEQ ID NO: 688586 - DNA, 20 bp, mouse
ggggacttgcacgctgtcag

SEQ ID NO: 688587 - DNA, 20 bp, mouse
gtgggcacagggtggcggaa

SEQ ID NO: 688588 - DNA, 20 bp, mouse
gccgccccggaagtcggctc

SEQ ID NO: 688589 - DNA, 20 bp, mouse
ggggacccagaattgctaac

SEQ ID NO: 688590 - DNA, 20 bp, mouse
gtgcaagtccccggttgctg

SEQ ID NO: 688591 - DNA, 20 bp, mouse
ggggcgtgtcccgaggaagt

SEQ ID NO: 688592 - DNA, 20 bp, mouse
gccgcccgagccgacttccg

SEQ ID NO: 688593 - DNA, 20 bp, mouse
gcgaggaaaaggagctttgg

SEQ ID NO: 688594 - DNA, 20 bp, mouse
ggagctttggcgggaaagaa

SEQ ID NO: 688595 - DNA, 20 bp, mouse
gccccatgaggactccagga

SEQ ID NO: 688596 - DNA, 20 bp, mouse
gacgccctgtgcccgaagga

SEQ ID NO: 688597 - DNA, 20 bp, mouse
gcctccggcgccttccgcag

SEQ ID NO: 688598 - DNA, 20 bp, mouse
ggacgcggctacagggatgg

SEQ ID NO: 688599 - DNA, 20 bp, mouse
gtcgcgccgcacagcccgac

SEQ ID NO: 688600 - DNA, 20 bp, mouse
gggaggggcgggttcgtagg

SEQ ID NO: 688601 - DNA, 20 bp, mouse
ggacgcagagccaaggtttc

SEQ ID NO: 688602 - DNA, 20 bp, mouse
ggagtccgtgccaaccgcag

SEQ ID NO: 688603 - DNA, 20 bp, mouse
gaaccttggctctgcgtcgt

SEQ ID NO: 688604 - DNA, 20 bp, mouse
gcccgcgcttgcgacctgct

SEQ ID NO: 688605 - DNA, 20 bp, mouse
gcgcagtggtggcacgtgac

SEQ ID NO: 688606 - DNA, 20 bp, mouse
gccaatccggacctccgcac

SEQ ID NO: 688607 - DNA, 20 bp, mouse
ggagccgtgatctggggcgc

SEQ ID NO: 688608 - DNA, 20 bp, mouse
gcggactgggcggagaccgt

SEQ ID NO: 688609 - DNA, 20 bp, mouse
gagcccgggaggcgaggatg

SEQ ID NO: 688610 - DNA, 20 bp, mouse
gacccccgcccagcccaatc

SEQ ID NO: 688611 - DNA, 20 bp, mouse
gcggaggtccggattgggct

SEQ ID NO: 688612 - DNA, 20 bp, mouse
gccgggccgcagcgaccgga

SEQ ID NO: 688613 - DNA, 20 bp, mouse
gcgcgtggagccgtgatctg

SEQ ID NO: 688614 - DNA, 20 bp, mouse
gactgggcggagaccgtcgg

SEQ ID NO: 688615 - DNA, 20 bp, mouse
gcctccggcgccccagatca

SEQ ID NO: 688616 - DNA, 20 bp, mouse
ggcgccccgcagaaaggctg

SEQ ID NO: 688617 - DNA, 20 bp, mouse
gggcggggcgccccgcagaa

SEQ ID NO: 688618 - DNA, 20 bp, mouse
gccgcccgcgcactgccagt

SEQ ID NO: 688619 - DNA, 20 bp, mouse
gccgcccactggcagtgcgc

SEQ ID NO: 688620 - DNA, 20 bp, mouse
gtgtccagaggcggggtctt

SEQ ID NO: 688621 - DNA, 20 bp, mouse
gggcggctcaggcctttccc

SEQ ID NO: 688622 - DNA, 20 bp, mouse
gtagacagatgcaaagacaa

SEQ ID NO: 688623 - DNA, 20 bp, mouse
gaaagcctggccccgcccac

SEQ ID NO: 688624 - DNA, 20 bp, mouse
gaaaacgcccgcctagcggc

SEQ ID NO: 688625 - DNA, 20 bp, mouse
gacaacccagttggatttca

SEQ ID NO: 688626 - DNA, 20 bp, mouse
gtgtcccttcacttttacct

SEQ ID NO: 688627 - DNA, 20 bp, mouse
gctgctctctgtatgggggt

SEQ ID NO: 688628 - DNA, 20 bp, mouse
gaaagctgctctctgtatgg

SEQ ID NO: 688629 - DNA, 20 bp, mouse
ggcaggagacacttgtgctt

SEQ ID NO: 688630 - DNA, 20 bp, mouse
gaagttctcagctcctcacc

SEQ ID NO: 688631 - DNA, 20 bp, mouse
gcttttggtgacagtcaaaa

SEQ ID NO: 688632 - DNA, 20 bp, mouse
gttgtcttattatcctggtg

SEQ ID NO: 688633 - DNA, 20 bp, mouse
gataataagacaagtgtatt

SEQ ID NO: 688634 - DNA, 20 bp, mouse
gtacacttgtcttattatcc

SEQ ID NO: 688635 - DNA, 20 bp, mouse
ggctcccaggtaaaagtgaa

SEQ ID NO: 688636 - DNA, 20 bp, mouse
ggctcccaggtaaaagctaa

SEQ ID NO: 688637 - DNA, 20 bp, mouse
gtgtcccttagcttttacct

SEQ ID NO: 688638 - DNA, 20 bp, mouse
gaagctgctctctgtgtggg

SEQ ID NO: 688639 - DNA, 20 bp, mouse
gcaaaccctcaggtcccagt

SEQ ID NO: 688640 - DNA, 20 bp, mouse
gtttagggtggagatccaac

SEQ ID NO: 688641 - DNA, 20 bp, mouse
gaaagcttataatttcctac

SEQ ID NO: 688642 - DNA, 20 bp, mouse
gttctctactgaaggctttt

SEQ ID NO: 688643 - DNA, 20 bp, mouse
gttaataagagaagtatatt

SEQ ID NO: 688644 - DNA, 20 bp, mouse
gctttcagcacaagcaggag

SEQ ID NO: 688645 - DNA, 20 bp, mouse
gaatttcctactgggacctg

SEQ ID NO: 688646 - DNA, 20 bp, mouse
gaatgacccggggattagtg

SEQ ID NO: 688647 - DNA, 20 bp, mouse
gggcgtgccccactaatccc

SEQ ID NO: 688648 - DNA, 20 bp, mouse
gagaacatctaaatgacccg

SEQ ID NO: 688649 - DNA, 20 bp, mouse
gcagctcaagtttttagggt

SEQ ID NO: 688650 - DNA, 20 bp, mouse
gttcttacatgtaggcttgg

SEQ ID NO: 688651 - DNA, 20 bp, mouse
ggatgaaaagatgctctctg

SEQ ID NO: 688652 - DNA, 20 bp, mouse
gatgttcttacatgtaggct

SEQ ID NO: 688653 - DNA, 20 bp, mouse
gagtgtctcttagctttaac

SEQ ID NO: 688654 - DNA, 20 bp, mouse
ggatatcagctcaagttttt

SEQ ID NO: 688655 - DNA, 20 bp, mouse
gcaaaatggctaaagcatag

SEQ ID NO: 688656 - DNA, 20 bp, mouse
gcacccaaggtcccctgcgg

SEQ ID NO: 688657 - DNA, 20 bp, mouse
ggtcccccgcaggggacctt

SEQ ID NO: 688658 - DNA, 20 bp, mouse
gggaagggacacgacgggga

SEQ ID NO: 688659 - DNA, 20 bp, mouse
gtcaccagccccaggtgcgg

SEQ ID NO: 688660 - DNA, 20 bp, mouse
gttcccgccctccgcacctg

SEQ ID NO: 688661 - DNA, 20 bp, mouse
gcgcaaggctgaggtgataa

SEQ ID NO: 688662 - DNA, 20 bp, mouse
gaggaggaagggacacgacg

SEQ ID NO: 688663 - DNA, 20 bp, mouse
gggctggtgacgtcccccgc

SEQ ID NO: 688664 - DNA, 20 bp, mouse
gggtctgtacagtgactaga

SEQ ID NO: 688665 - DNA, 20 bp, mouse
gccaatcgaggtgatcccag

SEQ ID NO: 688666 - DNA, 20 bp, mouse
gctaaagacaagagctgaat

SEQ ID NO: 688667 - DNA, 20 bp, mouse
gtggggaggaacagactaac

SEQ ID NO: 688668 - DNA, 20 bp, mouse
gggcacagaggtgcaagagc

SEQ ID NO: 688669 - DNA, 20 bp, mouse
gggccaccaggagagtcctg

SEQ ID NO: 688670 - DNA, 20 bp, mouse
ggagaccaatccttggcttg

SEQ ID NO: 688671 - DNA, 20 bp, mouse
gacctcagttcctacagcaa

SEQ ID NO: 688672 - DNA, 20 bp, mouse
gcaaaggattccattgctgt

SEQ ID NO: 688673 - DNA, 20 bp, mouse
gcccaccccaagccaaggat

SEQ ID NO: 688674 - DNA, 20 bp, mouse
gtccattgctgtaggaactg

SEQ ID NO: 688675 - DNA, 20 bp, mouse
gagttaaatgagaggttcac

SEQ ID NO: 688676 - DNA, 20 bp, mouse
gagtgagggcaagatttata

SEQ ID NO: 688677 - DNA, 20 bp, mouse
gactctgtaagatttttctt

SEQ ID NO: 688678 - DNA, 20 bp, mouse
gcaggccagcccaggagctt

SEQ ID NO: 688679 - DNA, 20 bp, mouse
gctggaaggctggcattgtt

SEQ ID NO: 688680 - DNA, 20 bp, mouse
gtgcaataagaatcaaggtg

SEQ ID NO: 688681 - DNA, 20 bp, mouse
gacactagggcctatcatca

SEQ ID NO: 688682 - DNA, 20 bp, mouse
ggaaaaatcttacagagtga

SEQ ID NO: 688683 - DNA, 20 bp, mouse
gttctccaccccaagctcct

SEQ ID NO: 688684 - DNA, 20 bp, mouse
ggctggcattgttgggctct

SEQ ID NO: 688685 - DNA, 20 bp, mouse
gtttctttggtgtccaacaa

SEQ ID NO: 688686 - DNA, 20 bp, mouse
gcgcacgcgcagttgttcgg

SEQ ID NO: 688687 - DNA, 20 bp, mouse
ggggtgaaaacggtaggaca

SEQ ID NO: 688688 - DNA, 20 bp, mouse
gcacatctgcagctacgtcc

SEQ ID NO: 688689 - DNA, 20 bp, mouse
ggcagcggggaaccccgaac

SEQ ID NO: 688690 - DNA, 20 bp, mouse
ggtagctgggtgaaaacggt

SEQ ID NO: 688691 - DNA, 20 bp, mouse
ggcaaactggtgttttggag

SEQ ID NO: 688692 - DNA, 20 bp, mouse
ggggccagaacgttaaatcc

SEQ ID NO: 688693 - DNA, 20 bp, mouse
gcccgcgtcagtccggttcg

SEQ ID NO: 688694 - DNA, 20 bp, mouse
gggcgctccgccggaggcac

SEQ ID NO: 688695 - DNA, 20 bp, mouse
gaccccgaaccggactgacg

SEQ ID NO: 688696 - DNA, 20 bp, mouse
gcggagccgcaggttgggga

SEQ ID NO: 688697 - DNA, 20 bp, mouse
ggggtcgcagccctccgacg

SEQ ID NO: 688698 - DNA, 20 bp, mouse
gcccaggcgtcggtgacacg

SEQ ID NO: 688699 - DNA, 20 bp, mouse
ggcgtcggtgacacgcgggg

SEQ ID NO: 688700 - DNA, 20 bp, mouse
gcgactggatccccgtcgga

SEQ ID NO: 688701 - DNA, 20 bp, mouse
gaccccgcgggacttgcttc

SEQ ID NO: 688702 - DNA, 20 bp, mouse
gcgcccaggccacacctggt

SEQ ID NO: 688703 - DNA, 20 bp, mouse
ggaagcctgagcagaggcga

SEQ ID NO: 688704 - DNA, 20 bp, mouse
ggcctctgctcaggcttcgg

SEQ ID NO: 688705 - DNA, 20 bp, mouse
gagccacagtggcacacctt

SEQ ID NO: 688706 - DNA, 20 bp, mouse
gccaacgtaccggcgagcga

SEQ ID NO: 688707 - DNA, 20 bp, mouse
gtaccggcgagcgagggagt

SEQ ID NO: 688708 - DNA, 20 bp, mouse
gagggatcctaagcagtgat

SEQ ID NO: 688709 - DNA, 20 bp, mouse
gtctcagtgagccaacgtac

SEQ ID NO: 688710 - DNA, 20 bp, mouse
gggcgttattacagcctcat

SEQ ID NO: 688711 - DNA, 20 bp, mouse
gaagagtcagtgtgcctatg

SEQ ID NO: 688712 - DNA, 20 bp, mouse
gaagacccctatcattcctg

SEQ ID NO: 688713 - DNA, 20 bp, mouse
gtctttaaacccccacatca

SEQ ID NO: 688714 - DNA, 20 bp, mouse
gtgtacctcaggaatgatag

SEQ ID NO: 688715 - DNA, 20 bp, mouse
gcttaggatccctgatgtgg

SEQ ID NO: 688716 - DNA, 20 bp, mouse
gtcctccgatgccctaagat

SEQ ID NO: 688717 - DNA, 20 bp, mouse
gccccgggaagggaagtagt

SEQ ID NO: 688718 - DNA, 20 bp, mouse
gggtcccgtgtctactgagg

SEQ ID NO: 688719 - DNA, 20 bp, mouse
gccgggtcccgtgtctactg

SEQ ID NO: 688720 - DNA, 20 bp, mouse
gtcccagcgcggtttctatt

SEQ ID NO: 688721 - DNA, 20 bp, mouse
gtgggacccacaacaggtgc

SEQ ID NO: 688722 - DNA, 20 bp, mouse
ggatgccctaagatgggctg

SEQ ID NO: 688723 - DNA, 20 bp, mouse
gcctcccgggcgggcgtctg

SEQ ID NO: 688724 - DNA, 20 bp, mouse
ggaggtggcagggtgaatca

SEQ ID NO: 688725 - DNA, 20 bp, mouse
ggctggaagctctccacccc

SEQ ID NO: 688726 - DNA, 20 bp, mouse
gcctgggtggggcctgtctg

SEQ ID NO: 688727 - DNA, 20 bp, mouse
gcgggctgctgctccgtgaa

SEQ ID NO: 688728 - DNA, 20 bp, mouse
gagggcagggccagattccc

SEQ ID NO: 688729 - DNA, 20 bp, mouse
gcactccccttaactggaga

SEQ ID NO: 688730 - DNA, 20 bp, mouse
gcagttgtctggagactatt

SEQ ID NO: 688731 - DNA, 20 bp, mouse
ggctgctgctccgtgaaggg

SEQ ID NO: 688732 - DNA, 20 bp, mouse
gaaacccctctccagttaag

SEQ ID NO: 688733 - DNA, 20 bp, mouse
gcaggccggcctccccagac

SEQ ID NO: 688734 - DNA, 20 bp, mouse
gggcagctcgagcttattaa

SEQ ID NO: 688735 - DNA, 20 bp, mouse
gctccgtgaagggtggacac

SEQ ID NO: 688736 - DNA, 20 bp, mouse
gctcgtccctggctccgctg

SEQ ID NO: 688737 - DNA, 20 bp, mouse
gggggagcggagtaaggttc

SEQ ID NO: 688738 - DNA, 20 bp, mouse
ggcctctgtgagctcgtccc

SEQ ID NO: 688739 - DNA, 20 bp, mouse
gtcagccgcggcagtgacgg

SEQ ID NO: 688740 - DNA, 20 bp, mouse
gccagcctccgtcactgccg

SEQ ID NO: 688741 - DNA, 20 bp, mouse
ggtaagcacagggatcagta

SEQ ID NO: 688742 - DNA, 20 bp, mouse
gccgctccccagcggagcca

SEQ ID NO: 688743 - DNA, 20 bp, mouse
gcccctgccggcgctccgcg

SEQ ID NO: 688744 - DNA, 20 bp, mouse
gagcccagactacaagtccc

SEQ ID NO: 688745 - DNA, 20 bp, mouse
gtccgctggggagcggagta

SEQ ID NO: 688746 - DNA, 20 bp, mouse
ggggcggcgcctaccacaaa

SEQ ID NO: 688747 - DNA, 20 bp, mouse
gaatgagtgtctggacatag

SEQ ID NO: 688748 - DNA, 20 bp, mouse
gaaggagttcaggggtggat

SEQ ID NO: 688749 - DNA, 20 bp, mouse
gtgggcgggacgcagctctg

SEQ ID NO: 688750 - DNA, 20 bp, mouse
gtcggccacacctatccaat

SEQ ID NO: 688751 - DNA, 20 bp, mouse
gtgacatgggcggggccaat

SEQ ID NO: 688752 - DNA, 20 bp, mouse
gttggaaaatctgtgaccgg

SEQ ID NO: 688753 - DNA, 20 bp, mouse
ggggacgcagctctgtggaa

SEQ ID NO: 688754 - DNA, 20 bp, mouse
gggggccaattggataggtg

SEQ ID NO: 688755 - DNA, 20 bp, mouse
gtgggcggggccaattggat

SEQ ID NO: 688756 - DNA, 20 bp, mouse
gactccggagagccaggcgg

SEQ ID NO: 688757 - DNA, 20 bp, mouse
ggggcctccgcctggctctc

SEQ ID NO: 688758 - DNA, 20 bp, mouse
gaggccccgcccacttaggt

SEQ ID NO: 688759 - DNA, 20 bp, mouse
gtaggtggggccacgagcag

SEQ ID NO: 688760 - DNA, 20 bp, mouse
gctcgtggccccacctaagt

SEQ ID NO: 688761 - DNA, 20 bp, mouse
ggtagggtctcatagagtcg

SEQ ID NO: 688762 - DNA, 20 bp, mouse
gactaaaaacgaggcattcg

SEQ ID NO: 688763 - DNA, 20 bp, mouse
gggcattcgaggatgagatt

SEQ ID NO: 688764 - DNA, 20 bp, mouse
ggagattaggttaaagaagg

SEQ ID NO: 688765 - DNA, 20 bp, mouse
gatgtggaattgaccagctt

SEQ ID NO: 688766 - DNA, 20 bp, mouse
ggcgggaacccaaggttcac

SEQ ID NO: 688767 - DNA, 20 bp, mouse
gtccctgagcgcctgcgcgg

SEQ ID NO: 688768 - DNA, 20 bp, mouse
gagaccgcggcgggagaaga

SEQ ID NO: 688769 - DNA, 20 bp, mouse
gtgcgcgggggggcccagag

SEQ ID NO: 688770 - DNA, 20 bp, mouse
ggcgaaccgcggggcgaccg

SEQ ID NO: 688771 - DNA, 20 bp, mouse
gagggaggcggagcttagga

SEQ ID NO: 688772 - DNA, 20 bp, mouse
gccccccgcgcaggcgctca

SEQ ID NO: 688773 - DNA, 20 bp, mouse
gcggttcgccagttcctctc

SEQ ID NO: 688774 - DNA, 20 bp, mouse
gggcgagtcgggtaactgtc

SEQ ID NO: 688775 - DNA, 20 bp, mouse
gcagcgtcctggcgcctcga

SEQ ID NO: 688776 - DNA, 20 bp, mouse
gcacacgaggatacaggtaa

SEQ ID NO: 688777 - DNA, 20 bp, mouse
ggcaagctgaagatcagctg

SEQ ID NO: 688778 - DNA, 20 bp, mouse
ggaaatgggcggaagctccc

SEQ ID NO: 688779 - DNA, 20 bp, mouse
gtctgccagtgggacttcag

SEQ ID NO: 688780 - DNA, 20 bp, mouse
ggctgatcttcagcttgcaa

SEQ ID NO: 688781 - DNA, 20 bp, mouse
gtcccactggcagatgcctt

SEQ ID NO: 688782 - DNA, 20 bp, mouse
gggtttctgtccgtgaggtg

SEQ ID NO: 688783 - DNA, 20 bp, mouse
ggcagccagagcttggcaaa

SEQ ID NO: 688784 - DNA, 20 bp, mouse
ggaagccatttgccaagctc

SEQ ID NO: 688785 - DNA, 20 bp, mouse
gccattggtgagtttaccaa

SEQ ID NO: 688786 - DNA, 20 bp, mouse
gtccccgccccctctcgcgg

SEQ ID NO: 688787 - DNA, 20 bp, mouse
gagggggcgcgcgaacccgc

SEQ ID NO: 688788 - DNA, 20 bp, mouse
gcggccgagtgccctcccgc

SEQ ID NO: 688789 - DNA, 20 bp, mouse
ggccgcccggcagctacctg

SEQ ID NO: 688790 - DNA, 20 bp, mouse
gggcgcgcgaacccgcggga

SEQ ID NO: 688791 - DNA, 20 bp, mouse
gcgcgagggcgcgagggcga

SEQ ID NO: 688792 - DNA, 20 bp, mouse
gcgcacagcagaggcccgga

SEQ ID NO: 688793 - DNA, 20 bp, mouse
ggggcttccgccgcgagagg

SEQ ID NO: 688794 - DNA, 20 bp, mouse
gcgcggccggcgcacagcag

SEQ ID NO: 688795 - DNA, 20 bp, mouse
ggcaatgtggaaagtcactc

SEQ ID NO: 688796 - DNA, 20 bp, mouse
ggcagtgcggcgctcagggg

SEQ ID NO: 688797 - DNA, 20 bp, mouse
gctcgcccgctctgcagaca

SEQ ID NO: 688798 - DNA, 20 bp, mouse
gctcgcgcggcgccgagggg

SEQ ID NO: 688799 - DNA, 20 bp, mouse
gtcccgccctgtctgcagag

SEQ ID NO: 688800 - DNA, 20 bp, mouse
ggcccgctctgcagacaggg

SEQ ID NO: 688801 - DNA, 20 bp, mouse
gcgctcaggggaggctcgcg

SEQ ID NO: 688802 - DNA, 20 bp, mouse
gagcgctgcgggaatctcct

SEQ ID NO: 688803 - DNA, 20 bp, mouse
gtgcagacagggcgggaagc

SEQ ID NO: 688804 - DNA, 20 bp, mouse
gtgctctgaggataactgaa

SEQ ID NO: 688805 - DNA, 20 bp, mouse
gcagccgcagtgcggcgctc

SEQ ID NO: 688806 - DNA, 20 bp, mouse
gctcagagggagaatcccgt

SEQ ID NO: 688807 - DNA, 20 bp, mouse
ggtcacccgggaagcgaagg

SEQ ID NO: 688808 - DNA, 20 bp, mouse
ggaccacggcgcatgctcag

SEQ ID NO: 688809 - DNA, 20 bp, mouse
ggccacggggaagctgacca

SEQ ID NO: 688810 - DNA, 20 bp, mouse
gggagcgcgtggagcggagg

SEQ ID NO: 688811 - DNA, 20 bp, mouse
gtgggcccccagcgcaactg

SEQ ID NO: 688812 - DNA, 20 bp, mouse
gcccgggtgacctgttccaa

SEQ ID NO: 688813 - DNA, 20 bp, mouse
gaatcccgtgggcgagcagg

SEQ ID NO: 688814 - DNA, 20 bp, mouse
gcccgccctccggtgttctg

SEQ ID NO: 688815 - DNA, 20 bp, mouse
gcgcaactggggacgtgttc

SEQ ID NO: 688816 - DNA, 20 bp, mouse
gcgcgcgcacgtcacgtagg

SEQ ID NO: 688817 - DNA, 20 bp, mouse
gaaggagattgtgagcctag

SEQ ID NO: 688818 - DNA, 20 bp, mouse
gaagaagcctattggtgtgt

SEQ ID NO: 688819 - DNA, 20 bp, mouse
gggcgccacgcgctgaggaa

SEQ ID NO: 688820 - DNA, 20 bp, mouse
gggccgaggagcgaactctc

SEQ ID NO: 688821 - DNA, 20 bp, mouse
gcgtgcgcgcgcctagaacc

SEQ ID NO: 688822 - DNA, 20 bp, mouse
gagcaacccaacacaccaat

SEQ ID NO: 688823 - DNA, 20 bp, mouse
ggcagagcaaagcgtcaggg

SEQ ID NO: 688824 - DNA, 20 bp, mouse
ggccactgaaaactgatccg

SEQ ID NO: 688825 - DNA, 20 bp, mouse
gcggcgctccttccatgcga

SEQ ID NO: 688826 - DNA, 20 bp, mouse
gaacggatctgatgcctcgt

SEQ ID NO: 688827 - DNA, 20 bp, mouse
gggtgactcgcgtgtcacag

SEQ ID NO: 688828 - DNA, 20 bp, mouse
gtcacagcggctgggcggat

SEQ ID NO: 688829 - DNA, 20 bp, mouse
ggggaaagatgaggctgtgt

SEQ ID NO: 688830 - DNA, 20 bp, mouse
gtgcctcgtgggcccagccg

SEQ ID NO: 688831 - DNA, 20 bp, mouse
gagtcaccgagtccccggct

SEQ ID NO: 688832 - DNA, 20 bp, mouse
ggtccccggctgggcccacg

SEQ ID NO: 688833 - DNA, 20 bp, mouse
gcgcgtcgctgggatcccgc

SEQ ID NO: 688834 - DNA, 20 bp, mouse
ggtggaggcggcctcggggc

SEQ ID NO: 688835 - DNA, 20 bp, mouse
gaaggccactggccaactac

SEQ ID NO: 688836 - DNA, 20 bp, mouse
gtgaaggtggacacggagaa

SEQ ID NO: 688837 - DNA, 20 bp, mouse
ggcgacgccgagtttcactc

SEQ ID NO: 688838 - DNA, 20 bp, mouse
gtcccagaaggcactgcgtg

SEQ ID NO: 688839 - DNA, 20 bp, mouse
ggagtcggagacatactcga

SEQ ID NO: 688840 - DNA, 20 bp, mouse
gagttctgatgaagctgagt

SEQ ID NO: 688841 - DNA, 20 bp, mouse
gcagcctggggtcccgaggg

SEQ ID NO: 688842 - DNA, 20 bp, mouse
ggtcccgctcaccgagtctg

SEQ ID NO: 688843 - DNA, 20 bp, mouse
ggcccagcctggggtcccga

SEQ ID NO: 688844 - DNA, 20 bp, mouse
gtatatctgctggtgtgctt

SEQ ID NO: 688845 - DNA, 20 bp, mouse
gaggcagccggagtgaaact

SEQ ID NO: 688846 - DNA, 20 bp, mouse
gggggtgcagaccgagagaa

SEQ ID NO: 688847 - DNA, 20 bp, mouse
gcaggggctcccgggtagga

SEQ ID NO: 688848 - DNA, 20 bp, mouse
ggaggcaggggctcccgggt

SEQ ID NO: 688849 - DNA, 20 bp, mouse
gtatcacccaccaaggggag

SEQ ID NO: 688850 - DNA, 20 bp, mouse
gggaaggaggcaagagttga

SEQ ID NO: 688851 - DNA, 20 bp, mouse
gcctaagagtgcaacgcagt

SEQ ID NO: 688852 - DNA, 20 bp, mouse
gccgggtaggagggggtcaa

SEQ ID NO: 688853 - DNA, 20 bp, mouse
ggaggcgcagttccagtctt

SEQ ID NO: 688854 - DNA, 20 bp, mouse
ggcactcttaggaactggta

SEQ ID NO: 688855 - DNA, 20 bp, mouse
gccttagcaacaaggggcgg

SEQ ID NO: 688856 - DNA, 20 bp, mouse
ggagcgtgcgaactactcac

SEQ ID NO: 688857 - DNA, 20 bp, mouse
ggctctgcggagaacaagga

SEQ ID NO: 688858 - DNA, 20 bp, mouse
gcgaactactcaccgggtga

SEQ ID NO: 688859 - DNA, 20 bp, mouse
gggcagagcaagacaggcgg

SEQ ID NO: 688860 - DNA, 20 bp, mouse
gcgatcctgcaagaatagaa

SEQ ID NO: 688861 - DNA, 20 bp, mouse
ggagtagttcgcacgctcgg

SEQ ID NO: 688862 - DNA, 20 bp, mouse
gagttcgcacgctcggcggt

SEQ ID NO: 688863 - DNA, 20 bp, mouse
gagggcgacctgccaccgta

SEQ ID NO: 688864 - DNA, 20 bp, mouse
ggtcgcccttctattcttgc

SEQ ID NO: 688865 - DNA, 20 bp, mouse
gagggtggagcggaatagag

SEQ ID NO: 688866 - DNA, 20 bp, mouse
gcatcgagagccagtgccaa

SEQ ID NO: 688867 - DNA, 20 bp, mouse
gctagggaacggtgcagacg

SEQ ID NO: 688868 - DNA, 20 bp, mouse
gcgcagggaacccttggcac

SEQ ID NO: 688869 - DNA, 20 bp, mouse
gggtccaaatcctcaagtgc

SEQ ID NO: 688870 - DNA, 20 bp, mouse
gaaagtgggttctgactaag

SEQ ID NO: 688871 - DNA, 20 bp, mouse
gctcgatggtcacaagtgtg

SEQ ID NO: 688872 - DNA, 20 bp, mouse
ggagacctggtctggatatg

SEQ ID NO: 688873 - DNA, 20 bp, mouse
gcatggaagctctagatcgc

SEQ ID NO: 688874 - DNA, 20 bp, mouse
gtgatcatcaatggctaaag

SEQ ID NO: 688875 - DNA, 20 bp, mouse
gatcctcaagtgcaggtcaa

SEQ ID NO: 688876 - DNA, 20 bp, mouse
gttaaggactgtggttgcgc

SEQ ID NO: 688877 - DNA, 20 bp, mouse
gcccctaagcgcgctactga

SEQ ID NO: 688878 - DNA, 20 bp, mouse
gcaaccacagtccttaagat

SEQ ID NO: 688879 - DNA, 20 bp, mouse
gccgaagagcaccaatctta

SEQ ID NO: 688880 - DNA, 20 bp, mouse
gactgtggttgcgcaggctc

SEQ ID NO: 688881 - DNA, 20 bp, mouse
gggaagttcgagacctgtaa

SEQ ID NO: 688882 - DNA, 20 bp, mouse
gggttggaaaacgaattctg

SEQ ID NO: 688883 - DNA, 20 bp, mouse
gtgcgcaggctctggtcacg

SEQ ID NO: 688884 - DNA, 20 bp, mouse
gcgtgacgtaatctaggccc

SEQ ID NO: 688885 - DNA, 20 bp, mouse
ggattggtgctcttcgggag

SEQ ID NO: 688886 - DNA, 20 bp, mouse
ggaatcaagactagggagat

SEQ ID NO: 688887 - DNA, 20 bp, mouse
gggccgaagcaagggtgtcc

SEQ ID NO: 688888 - DNA, 20 bp, mouse
gaacctggacacccttgctt

SEQ ID NO: 688889 - DNA, 20 bp, mouse
gtggctccagagccgaggcc

SEQ ID NO: 688890 - DNA, 20 bp, mouse
gcctctaagaatcaagacta

SEQ ID NO: 688891 - DNA, 20 bp, mouse
gagagactcactctctcgga

SEQ ID NO: 688892 - DNA, 20 bp, mouse
gtagctgaggaacccagctg

SEQ ID NO: 688893 - DNA, 20 bp, mouse
gtcggcccagctccccacag

SEQ ID NO: 688894 - DNA, 20 bp, mouse
gtgcaatggagcagcctctg

SEQ ID NO: 688895 - DNA, 20 bp, mouse
gttcactggctccagagccg

SEQ ID NO: 688896 - DNA, 20 bp, mouse
gtgaggtcatgcaaacgaag

SEQ ID NO: 688897 - DNA, 20 bp, mouse
gcacgctcctataaaaggag

SEQ ID NO: 688898 - DNA, 20 bp, mouse
ggtgaacgggcatccaggaa

SEQ ID NO: 688899 - DNA, 20 bp, mouse
gtaggcaggacgaagagcga

SEQ ID NO: 688900 - DNA, 20 bp, mouse
gcaggggcggcgtccaaacc

SEQ ID NO: 688901 - DNA, 20 bp, mouse
gcaggtagcagggtcctgtc

SEQ ID NO: 688902 - DNA, 20 bp, mouse
gctgcccacgctcctataaa

SEQ ID NO: 688903 - DNA, 20 bp, mouse
ggaacactgcgtgaagtcgc

SEQ ID NO: 688904 - DNA, 20 bp, mouse
gttgcggtcgagttaaggac

SEQ ID NO: 688905 - DNA, 20 bp, mouse
gggcgcgagcgacacctgct

SEQ ID NO: 688906 - DNA, 20 bp, mouse
gtcggagcacccactttcgt

SEQ ID NO: 688907 - DNA, 20 bp, mouse
gtctcctggcccacgaaagt

SEQ ID NO: 688908 - DNA, 20 bp, mouse
gtatccgcagtcccaggctg

SEQ ID NO: 688909 - DNA, 20 bp, mouse
ggggccaggagaaatgttca

SEQ ID NO: 688910 - DNA, 20 bp, mouse
ggtagcccgctcctccgttc

SEQ ID NO: 688911 - DNA, 20 bp, mouse
gtaggctcctggatgactcc

SEQ ID NO: 688912 - DNA, 20 bp, mouse
gtcgccccagcctgggactg

SEQ ID NO: 688913 - DNA, 20 bp, mouse
gcccctagagccctctctct

SEQ ID NO: 688914 - DNA, 20 bp, mouse
gggagaagctgccagaacgg

SEQ ID NO: 688915 - DNA, 20 bp, mouse
ggagcgggctacagcgaacc

SEQ ID NO: 688916 - DNA, 20 bp, mouse
gtcgcctcatcccacaatag

SEQ ID NO: 688917 - DNA, 20 bp, mouse
gtgggatgaggcgaagggtc

SEQ ID NO: 688918 - DNA, 20 bp, mouse
gggtaagccgagtgcgaaca

SEQ ID NO: 688919 - DNA, 20 bp, mouse
gcagtgagatacaccatgat

SEQ ID NO: 688920 - DNA, 20 bp, mouse
gtccctaaatggacttggaa

SEQ ID NO: 688921 - DNA, 20 bp, mouse
gcgtcaccgctgtccctaaa

SEQ ID NO: 688922 - DNA, 20 bp, mouse
gcagacatgggctagcgagt

SEQ ID NO: 688923 - DNA, 20 bp, mouse
gccctgagaggtgtgagcca

SEQ ID NO: 688924 - DNA, 20 bp, mouse
gagtctgtcaaccactattg

SEQ ID NO: 688925 - DNA, 20 bp, mouse
gtgtagtggggactgattcg

SEQ ID NO: 688926 - DNA, 20 bp, mouse
gtgaggtcatgcaaacgaag

SEQ ID NO: 688927 - DNA, 20 bp, mouse
gtaggcaggacgaagagcga

SEQ ID NO: 688928 - DNA, 20 bp, mouse
ggtgaacgggcatccaggaa

SEQ ID NO: 688929 - DNA, 20 bp, mouse
gttgcggtcgagttaaggac

SEQ ID NO: 688930 - DNA, 20 bp, mouse
gggcgcgagcgacacctgct

SEQ ID NO: 688931 - DNA, 20 bp, mouse
gcaggtagcagggtcctgtc

SEQ ID NO: 688932 - DNA, 20 bp, mouse
gcgaagagcgaagggtgaac

SEQ ID NO: 688933 - DNA, 20 bp, mouse
gtgtgtgaatcagaggtttg

SEQ ID NO: 688934 - DNA, 20 bp, mouse
gcaggggcggcgtccaaacc

SEQ ID NO: 688935 - DNA, 20 bp, mouse
gcacgctcctataaaaggag

SEQ ID NO: 688936 - DNA, 20 bp, mouse
ggccacatgtcctgtatctg

SEQ ID NO: 688937 - DNA, 20 bp, mouse
gctgagacagagcccttaga

SEQ ID NO: 688938 - DNA, 20 bp, mouse
gactcaagcagtcctgtacc

SEQ ID NO: 688939 - DNA, 20 bp, mouse
gtgagccagagacaaacatg

SEQ ID NO: 688940 - DNA, 20 bp, mouse
gtgaaccctgaggcctccta

SEQ ID NO: 688941 - DNA, 20 bp, mouse
ggtgtctgcaggccctctaa

SEQ ID NO: 688942 - DNA, 20 bp, mouse
ggccacagatacaggacatg

SEQ ID NO: 688943 - DNA, 20 bp, mouse
gatgaccgggctgggggccg

SEQ ID NO: 688944 - DNA, 20 bp, mouse
gcagagagagctgcggtaga

SEQ ID NO: 688945 - DNA, 20 bp, mouse
ggatgaagcgaggtgtctgc

SEQ ID NO: 688946 - DNA, 20 bp, mouse
gcctccgagtgccaattgtc

SEQ ID NO: 688947 - DNA, 20 bp, mouse
ggaagggacagcgtgacccc

SEQ ID NO: 688948 - DNA, 20 bp, mouse
gaggcgctccgcaccgtctg

SEQ ID NO: 688949 - DNA, 20 bp, mouse
gctggattgcggaggtgggt

SEQ ID NO: 688950 - DNA, 20 bp, mouse
ggcgcctggcagtacgcttc

SEQ ID NO: 688951 - DNA, 20 bp, mouse
gaacagactgcgcatgcccg

SEQ ID NO: 688952 - DNA, 20 bp, mouse
ggattgcggaggtgggttgg

SEQ ID NO: 688953 - DNA, 20 bp, mouse
gggctgctcctggattgcgg

SEQ ID NO: 688954 - DNA, 20 bp, mouse
ggctgaagggaccggccttg

SEQ ID NO: 688955 - DNA, 20 bp, mouse
gcagaaccaagggctgctcc

SEQ ID NO: 688956 - DNA, 20 bp, mouse
gggaacgcgcaccactggca

SEQ ID NO: 688957 - DNA, 20 bp, mouse
gcccgcggaacgcgcaccac

SEQ ID NO: 688958 - DNA, 20 bp, mouse
gctaacgccagcagccgcga

SEQ ID NO: 688959 - DNA, 20 bp, mouse
ggaccggggcgcactagcac

SEQ ID NO: 688960 - DNA, 20 bp, mouse
gtggccgctgcaaactccca

SEQ ID NO: 688961 - DNA, 20 bp, mouse
gtcccctgctggtctcggcg

SEQ ID NO: 688962 - DNA, 20 bp, mouse
gaccactggcaaggactggt

SEQ ID NO: 688963 - DNA, 20 bp, mouse
ggccgcgccgagaccagcag

SEQ ID NO: 688964 - DNA, 20 bp, mouse
ggcaccactaggttccgtcg

SEQ ID NO: 688965 - DNA, 20 bp, mouse
ggagcctcgacggaacctag

SEQ ID NO: 688966 - DNA, 20 bp, mouse
gcgcgcgtgcgcacgaccgt

SEQ ID NO: 688967 - DNA, 20 bp, mouse
gaggaaacggaagtgctcaa

SEQ ID NO: 688968 - DNA, 20 bp, mouse
gaagtgctcaagggtcccgg

SEQ ID NO: 688969 - DNA, 20 bp, mouse
ggatccgtggaagtgaatct

SEQ ID NO: 688970 - DNA, 20 bp, mouse
gcggaagtgctcaagggtcc

SEQ ID NO: 688971 - DNA, 20 bp, mouse
ggtgggtcactcttgatccg

SEQ ID NO: 688972 - DNA, 20 bp, mouse
ggccaaggctgcgcaggaaa

SEQ ID NO: 688973 - DNA, 20 bp, mouse
gtgaccgacaagaacccctc

SEQ ID NO: 688974 - DNA, 20 bp, mouse
gggcgtgcgcaacaccgctc

SEQ ID NO: 688975 - DNA, 20 bp, mouse
gacccccagattcacttcca

SEQ ID NO: 688976 - DNA, 20 bp, mouse
gctgcaggacggtaaggcgt

SEQ ID NO: 688977 - DNA, 20 bp, mouse
gaccgtgcaggcgatcctgc

SEQ ID NO: 688978 - DNA, 20 bp, mouse
gagggtgagttcacacttct

SEQ ID NO: 688979 - DNA, 20 bp, mouse
gacggtcgccgccactactg

SEQ ID NO: 688980 - DNA, 20 bp, mouse
gtgggggaccaggacaatcc

SEQ ID NO: 688981 - DNA, 20 bp, mouse
gacggtaaggcgtcggacgg

SEQ ID NO: 688982 - DNA, 20 bp, mouse
ggtagcaggccgtggggctt

SEQ ID NO: 688983 - DNA, 20 bp, mouse
gtcttcccgtgggtgtcttg

SEQ ID NO: 688984 - DNA, 20 bp, mouse
gaggaactgagcagcagtag

SEQ ID NO: 688985 - DNA, 20 bp, mouse
gaacccggcacttgccaaca

SEQ ID NO: 688986 - DNA, 20 bp, mouse
gccaaaagcaaagacgtcat

SEQ ID NO: 688987 - DNA, 20 bp, mouse
gtggcggcgccaagctcggt

SEQ ID NO: 688988 - DNA, 20 bp, mouse
gcccgggcgcggcacagaag

SEQ ID NO: 688989 - DNA, 20 bp, mouse
gcgagcgcgcagtgaaggac

SEQ ID NO: 688990 - DNA, 20 bp, mouse
gtgcgagcccagaggacagg

SEQ ID NO: 688991 - DNA, 20 bp, mouse
gccagaggacaggagggtgg

SEQ ID NO: 688992 - DNA, 20 bp, mouse
gggtctccgccgaacgagcg

SEQ ID NO: 688993 - DNA, 20 bp, mouse
gcatcggcctaggagcctct

SEQ ID NO: 688994 - DNA, 20 bp, mouse
ggagcagggcaggtgtcctc

SEQ ID NO: 688995 - DNA, 20 bp, mouse
ggggcgcggcacagaagcgg

SEQ ID NO: 688996 - DNA, 20 bp, mouse
gaccaataagaagccgagga

SEQ ID NO: 688997 - DNA, 20 bp, mouse
ggcagcctctgggtcttcat

SEQ ID NO: 688998 - DNA, 20 bp, mouse
ggcgaggcctcgccttggga

SEQ ID NO: 688999 - DNA, 20 bp, mouse
gaaggggcgaggcctcgcct

SEQ ID NO: 689000 - DNA, 20 bp, mouse
ggccgcccgctacatcacag

SEQ ID NO: 689001 - DNA, 20 bp, mouse
gcccactagcgggtccgagc

SEQ ID NO: 689002 - DNA, 20 bp, mouse
gtacgccaatgaagacccag

SEQ ID NO: 689003 - DNA, 20 bp, mouse
gtcggacccgctagtgggtt

SEQ ID NO: 689004 - DNA, 20 bp, mouse
gaacacaccaaacccactag

SEQ ID NO: 689005 - DNA, 20 bp, mouse
gcggcctccctcccaaggcg

SEQ ID NO: 689006 - DNA, 20 bp, mouse
gacgcgtcgacgtctcgcta

SEQ ID NO: 689007 - DNA, 20 bp, mouse
ggcagcacagtcgaaaccga

SEQ ID NO: 689008 - DNA, 20 bp, mouse
gcctctgccctgcacgacag

SEQ ID NO: 689009 - DNA, 20 bp, mouse
gacacgtcgcactgaaagta

SEQ ID NO: 689010 - DNA, 20 bp, mouse
ggctgcacttagctggaggc

SEQ ID NO: 689011 - DNA, 20 bp, mouse
gctgtgctgcacttagctgg

SEQ ID NO: 689012 - DNA, 20 bp, mouse
ggaagtccctctgtcgtgca

SEQ ID NO: 689013 - DNA, 20 bp, mouse
gcgactgtgctgcacttagc

SEQ ID NO: 689014 - DNA, 20 bp, mouse
gacgtgtgtcgtcagcacgg

SEQ ID NO: 689015 - DNA, 20 bp, mouse
gtcgtcagcacggcggggca

SEQ ID NO: 689016 - DNA, 20 bp, mouse
gtaagcacacagcccgagca

SEQ ID NO: 689017 - DNA, 20 bp, mouse
gtgggaggaccatggcaata

SEQ ID NO: 689018 - DNA, 20 bp, mouse
gcctaccagcaacggatgaa

SEQ ID NO: 689019 - DNA, 20 bp, mouse
gctgcccgccaccaagtcac

SEQ ID NO: 689020 - DNA, 20 bp, mouse
gcagcgccgtgggaggacca

SEQ ID NO: 689021 - DNA, 20 bp, mouse
gactctagccggtgacttgg

SEQ ID NO: 689022 - DNA, 20 bp, mouse
gggtgatgtgagccgtgctc

SEQ ID NO: 689023 - DNA, 20 bp, mouse
gttctgccttggactttaga

SEQ ID NO: 689024 - DNA, 20 bp, mouse
gaaatgactgcttctgggga

SEQ ID NO: 689025 - DNA, 20 bp, mouse
gctagccggtgacttggtgg

SEQ ID NO: 689026 - DNA, 20 bp, mouse
ggagagagatcgtgacttgt

SEQ ID NO: 689027 - DNA, 20 bp, mouse
gttacagaaggaactgacag

SEQ ID NO: 689028 - DNA, 20 bp, mouse
gttctcggagactttaggga

SEQ ID NO: 689029 - DNA, 20 bp, mouse
ggggatgggagtcagctcaa

SEQ ID NO: 689030 - DNA, 20 bp, mouse
gcagaaggaactgacagagg

SEQ ID NO: 689031 - DNA, 20 bp, mouse
ggtctccgagaacatggagt

SEQ ID NO: 689032 - DNA, 20 bp, mouse
gagggcaagtgctttgaaat

SEQ ID NO: 689033 - DNA, 20 bp, mouse
gcatgttctcggagacttta

SEQ ID NO: 689034 - DNA, 20 bp, mouse
ggagtccaactccatgttct

SEQ ID NO: 689035 - DNA, 20 bp, mouse
gtcctggggagttgttgcaa

SEQ ID NO: 689036 - DNA, 20 bp, mouse
gtatagagggtagattgcta

SEQ ID NO: 689037 - DNA, 20 bp, mouse
gggcctgtggagttttcacc

SEQ ID NO: 689038 - DNA, 20 bp, mouse
gccgaaaggatgagactgat

SEQ ID NO: 689039 - DNA, 20 bp, mouse
gcctgcttcgtgagagaaca

SEQ ID NO: 689040 - DNA, 20 bp, mouse
ggggactccaaatgggtcag

SEQ ID NO: 689041 - DNA, 20 bp, mouse
gatctaccctctataggtct

SEQ ID NO: 689042 - DNA, 20 bp, mouse
ggcgtgaagacacgagtcct

SEQ ID NO: 689043 - DNA, 20 bp, mouse
gccaaatgggtcagaggtag

SEQ ID NO: 689044 - DNA, 20 bp, mouse
gatccaggtgaaaactccac

SEQ ID NO: 689045 - DNA, 20 bp, mouse
gagtgagatgcacctcccag

SEQ ID NO: 689046 - DNA, 20 bp, mouse
gagggccgagagttcccggg

SEQ ID NO: 689047 - DNA, 20 bp, mouse
gacgagggccgagagttccc

SEQ ID NO: 689048 - DNA, 20 bp, mouse
gttcccatgaggtcagacga

SEQ ID NO: 689049 - DNA, 20 bp, mouse
gcacaggcggcttgacacat

SEQ ID NO: 689050 - DNA, 20 bp, mouse
gccgagagttcccgggagga

SEQ ID NO: 689051 - DNA, 20 bp, mouse
ggtgtcaagccgcctgtgca

SEQ ID NO: 689052 - DNA, 20 bp, mouse
ggacctcatgggaattctta

SEQ ID NO: 689053 - DNA, 20 bp, mouse
ggtgaggcacccccagagtg

SEQ ID NO: 689054 - DNA, 20 bp, mouse
gaagaagtggtgcctcactc

SEQ ID NO: 689055 - DNA, 20 bp, mouse
gcaacaagatgcaactcttt

SEQ ID NO: 689056 - DNA, 20 bp, mouse
gagaggcggtgattagtcac

SEQ ID NO: 689057 - DNA, 20 bp, mouse
gtccaggtgagtaggaaccg

SEQ ID NO: 689058 - DNA, 20 bp, mouse
gcgagtaagtccaggtgagt

SEQ ID NO: 689059 - DNA, 20 bp, mouse
gtccgagcgcgggcccgcag

SEQ ID NO: 689060 - DNA, 20 bp, mouse
gacgcggcttcaaggagcag

SEQ ID NO: 689061 - DNA, 20 bp, mouse
ggctgggccggaggacaacg

SEQ ID NO: 689062 - DNA, 20 bp, mouse
gggggtctgcgagtaagtcc

SEQ ID NO: 689063 - DNA, 20 bp, mouse
gcgggcccgcgctcggaaga

SEQ ID NO: 689064 - DNA, 20 bp, mouse
gcgaacgccagctcagaagc

SEQ ID NO: 689065 - DNA, 20 bp, mouse
gcccgcagcggggacgagcg

SEQ ID NO: 689066 - DNA, 20 bp, mouse
gggacaacggcagcttgttg

SEQ ID NO: 689067 - DNA, 20 bp, mouse
ggggacgccacctccggagg

SEQ ID NO: 689068 - DNA, 20 bp, mouse
gggggggcccacatgaccga

SEQ ID NO: 689069 - DNA, 20 bp, mouse
gacaagctgccgttgtcccg

SEQ ID NO: 689070 - DNA, 20 bp, mouse
gcccccgccacggcccacgg

SEQ ID NO: 689071 - DNA, 20 bp, mouse
gcccacggcccgcgggacaa

SEQ ID NO: 689072 - DNA, 20 bp, mouse
gccgtgggccccgcacactg

SEQ ID NO: 689073 - DNA, 20 bp, mouse
gccagcctgggtcccttcag

SEQ ID NO: 689074 - DNA, 20 bp, mouse
ggcggcgcctgacggtgcca

SEQ ID NO: 689075 - DNA, 20 bp, mouse
gcgtgggacgccacctccgg

SEQ ID NO: 689076 - DNA, 20 bp, mouse
gacccgagcccgcctcccgg

SEQ ID NO: 689077 - DNA, 20 bp, mouse
gggagcccgggggggaaagg

SEQ ID NO: 689078 - DNA, 20 bp, mouse
ggaaaggaggagacgggcga

SEQ ID NO: 689079 - DNA, 20 bp, mouse
gccgaggggcgggcgatgcg

SEQ ID NO: 689080 - DNA, 20 bp, mouse
ggcgggcgggccacagaccc

SEQ ID NO: 689081 - DNA, 20 bp, mouse
gcgggctcgggtcgcgtacc

SEQ ID NO: 689082 - DNA, 20 bp, mouse
gcaagcgcggatgaggtcat

SEQ ID NO: 689083 - DNA, 20 bp, mouse
gctccaatgcccccactcta

SEQ ID NO: 689084 - DNA, 20 bp, mouse
ggagcagccgcctccgtcgg

SEQ ID NO: 689085 - DNA, 20 bp, mouse
gagcggagcccgggggggaa

SEQ ID NO: 689086 - DNA, 20 bp, mouse
ggccgcaggaagtagatctg

SEQ ID NO: 689087 - DNA, 20 bp, mouse
gactggctagagagcgactc

SEQ ID NO: 689088 - DNA, 20 bp, mouse
gtgggctcggattacaggaa

SEQ ID NO: 689089 - DNA, 20 bp, mouse
ggcagagcaactatctacac

SEQ ID NO: 689090 - DNA, 20 bp, mouse
gtacactggagtgcgttgcc

SEQ ID NO: 689091 - DNA, 20 bp, mouse
gtgcttgccggttgtctccc

SEQ ID NO: 689092 - DNA, 20 bp, mouse
gctgtgtagcggtctctgac

SEQ ID NO: 689093 - DNA, 20 bp, mouse
ggtgttgcctaggagacgaa

SEQ ID NO: 689094 - DNA, 20 bp, mouse
gacgcctaaagactgtcacg

SEQ ID NO: 689095 - DNA, 20 bp, mouse
gcttcagtcaaatgggactt

SEQ ID NO: 689096 - DNA, 20 bp, mouse
ggacccggggagcgggagtg

SEQ ID NO: 689097 - DNA, 20 bp, mouse
gccagagaagagcacagccc

SEQ ID NO: 689098 - DNA, 20 bp, mouse
gaaacgaggggcagcccctg

SEQ ID NO: 689099 - DNA, 20 bp, mouse
gacggaagttgggggtcttc

SEQ ID NO: 689100 - DNA, 20 bp, mouse
gattaaaaaaccaagagtga

SEQ ID NO: 689101 - DNA, 20 bp, mouse
ggctgtgctcttctctggaa

SEQ ID NO: 689102 - DNA, 20 bp, mouse
gtagttttggacccggggag

SEQ ID NO: 689103 - DNA, 20 bp, mouse
gctcatctgacggaagttgg

SEQ ID NO: 689104 - DNA, 20 bp, mouse
gatgagaaacggcatccaat

SEQ ID NO: 689105 - DNA, 20 bp, mouse
gttgtaaggtgagagctgat

SEQ ID NO: 689106 - DNA, 20 bp, mouse
ggggctccctgagcggacag

SEQ ID NO: 689107 - DNA, 20 bp, mouse
ggcccccggggctccctgag

SEQ ID NO: 689108 - DNA, 20 bp, mouse
gcgcccccgcggcttcacgt

SEQ ID NO: 689109 - DNA, 20 bp, mouse
gtccgctcagggagccccgg

SEQ ID NO: 689110 - DNA, 20 bp, mouse
ggggcggggcatcaggggga

SEQ ID NO: 689111 - DNA, 20 bp, mouse
ggacacgcgggggaagaaac

SEQ ID NO: 689112 - DNA, 20 bp, mouse
gccctcgggtcaccatacaa

SEQ ID NO: 689113 - DNA, 20 bp, mouse
gacactggagagacgtgggt

SEQ ID NO: 689114 - DNA, 20 bp, mouse
gtccaggccgacacttgtca

SEQ ID NO: 689115 - DNA, 20 bp, mouse
ggcggcttcacgtgggactc

SEQ ID NO: 689116 - DNA, 20 bp, mouse
gcacaaggcttgtgcttttg

SEQ ID NO: 689117 - DNA, 20 bp, mouse
gaaagaactaacagggaggg

SEQ ID NO: 689118 - DNA, 20 bp, mouse
ggacacatgggtagtagaag

SEQ ID NO: 689119 - DNA, 20 bp, mouse
gaaccacaaagactaggagg

SEQ ID NO: 689120 - DNA, 20 bp, mouse
gggtaaccattgtgacacat

SEQ ID NO: 689121 - DNA, 20 bp, mouse
gcttttgggcaaaactagct

SEQ ID NO: 689122 - DNA, 20 bp, mouse
gtactacccatgtgtcacaa

SEQ ID NO: 689123 - DNA, 20 bp, mouse
gcccaaacccgaggaggctc

SEQ ID NO: 689124 - DNA, 20 bp, mouse
gtgtgacatctgggcattga

SEQ ID NO: 689125 - DNA, 20 bp, mouse
gaccaaccacaaagactagg

SEQ ID NO: 689126 - DNA, 20 bp, mouse
ggaggcaggcgcagcggtag

SEQ ID NO: 689127 - DNA, 20 bp, mouse
ggggacgcggcattactgtc

SEQ ID NO: 689128 - DNA, 20 bp, mouse
gcgcgcgtgcgcaaactgca

SEQ ID NO: 689129 - DNA, 20 bp, mouse
gcaggggagcccctctaaca

SEQ ID NO: 689130 - DNA, 20 bp, mouse
gaaactgcagggttgtaggc

SEQ ID NO: 689131 - DNA, 20 bp, mouse
ggcgcaaactgcagggttgt

SEQ ID NO: 689132 - DNA, 20 bp, mouse
gtggacggaggcaggcgcag

SEQ ID NO: 689133 - DNA, 20 bp, mouse
gccctctaacaggggagtca

SEQ ID NO: 689134 - DNA, 20 bp, mouse
gaaggagcatgctctgggaa

SEQ ID NO: 689135 - DNA, 20 bp, mouse
gcgcgctgggcgtccggccg

SEQ ID NO: 689136 - DNA, 20 bp, mouse
ggagcagggcactcgttgat

SEQ ID NO: 689137 - DNA, 20 bp, mouse
gtgccctgctcgcgtccgtt

SEQ ID NO: 689138 - DNA, 20 bp, mouse
ggctaagacggctccaaggc

SEQ ID NO: 689139 - DNA, 20 bp, mouse
gaagagaccaggccgttagg

SEQ ID NO: 689140 - DNA, 20 bp, mouse
ggggctctgctgctccctgg

SEQ ID NO: 689141 - DNA, 20 bp, mouse
ggtggggaggagcgtcacgg

SEQ ID NO: 689142 - DNA, 20 bp, mouse
gcggggctaagacggctcca

SEQ ID NO: 689143 - DNA, 20 bp, mouse
gggagcaattaattggttcc

SEQ ID NO: 689144 - DNA, 20 bp, mouse
gcagcccaacggacgcgagc

SEQ ID NO: 689145 - DNA, 20 bp, mouse
gagggcactcgttgataggc

SEQ ID NO: 689146 - DNA, 20 bp, mouse
gccgcctcgcgtgcacgcca

SEQ ID NO: 689147 - DNA, 20 bp, mouse
gtgcgcggggctgtaaacag

SEQ ID NO: 689148 - DNA, 20 bp, mouse
gtgcacgcgaggcggggctg

SEQ ID NO: 689149 - DNA, 20 bp, mouse
gcagccctggcgtgcacgcg

SEQ ID NO: 689150 - DNA, 20 bp, mouse
gctagcgcgtagaaaagagt

SEQ ID NO: 689151 - DNA, 20 bp, mouse
gtctggaaaggcttgcaaca

SEQ ID NO: 689152 - DNA, 20 bp, mouse
ggtaaacgctattaatagta

SEQ ID NO: 689153 - DNA, 20 bp, mouse
gcggggctgcgggcctgcgc

SEQ ID NO: 689154 - DNA, 20 bp, mouse
gtataaaagtcccctaagac

SEQ ID NO: 689155 - DNA, 20 bp, mouse
ggcgtagaaaagagtagggc

SEQ ID NO: 689156 - DNA, 20 bp, mouse
ggtctgagaatcagccggaa

SEQ ID NO: 689157 - DNA, 20 bp, mouse
gaccagggccatgaatggtg

SEQ ID NO: 689158 - DNA, 20 bp, mouse
gaggatggcagctctctggg

SEQ ID NO: 689159 - DNA, 20 bp, mouse
gttagcagtgggtttagaac

SEQ ID NO: 689160 - DNA, 20 bp, mouse
gcagagagctgccatcctat

SEQ ID NO: 689161 - DNA, 20 bp, mouse
gagaatcagccggaagggaa

SEQ ID NO: 689162 - DNA, 20 bp, mouse
gttacctcatagcatcttgg

SEQ ID NO: 689163 - DNA, 20 bp, mouse
ggcgggagatggttttctct

SEQ ID NO: 689164 - DNA, 20 bp, mouse
gagggagtaacgtaagaatt

SEQ ID NO: 689165 - DNA, 20 bp, mouse
gcacttaaccctttcccttc

SEQ ID NO: 689166 - DNA, 20 bp, mouse
gtagagctgcaactgacctg

SEQ ID NO: 689167 - DNA, 20 bp, mouse
ggggccggcagctggcgatt

SEQ ID NO: 689168 - DNA, 20 bp, mouse
ggggaggccctgtcatgcct

SEQ ID NO: 689169 - DNA, 20 bp, mouse
gtagtcacccgtctagacca

SEQ ID NO: 689170 - DNA, 20 bp, mouse
gcctgagccgaggacaggaa

SEQ ID NO: 689171 - DNA, 20 bp, mouse
gttggtgagggtcaaggggt

SEQ ID NO: 689172 - DNA, 20 bp, mouse
gtgactagcctctttggtga

SEQ ID NO: 689173 - DNA, 20 bp, mouse
ggacgggtgactagcctctt

SEQ ID NO: 689174 - DNA, 20 bp, mouse
ggcgacctcaccagctcgtt

SEQ ID NO: 689175 - DNA, 20 bp, mouse
ggattggctaaattgacagt

SEQ ID NO: 689176 - DNA, 20 bp, mouse
gggaccccggggcacgttcc

SEQ ID NO: 689177 - DNA, 20 bp, mouse
gtagccagggtgaatgagta

SEQ ID NO: 689178 - DNA, 20 bp, mouse
gtgctggtgtgcagcgagaa

SEQ ID NO: 689179 - DNA, 20 bp, mouse
gcaagcgccgcaggaccccg

SEQ ID NO: 689180 - DNA, 20 bp, mouse
ggtcacgctaggcagcgcag

SEQ ID NO: 689181 - DNA, 20 bp, mouse
gtgaatgagtacggatgaca

SEQ ID NO: 689182 - DNA, 20 bp, mouse
gaggcgggcccactgggtgc

SEQ ID NO: 689183 - DNA, 20 bp, mouse
gcacgggagtgatggcatct

SEQ ID NO: 689184 - DNA, 20 bp, mouse
gtacccaggcgtcccgcatt

SEQ ID NO: 689185 - DNA, 20 bp, mouse
gtcggccaggaacgtgcccc

SEQ ID NO: 689186 - DNA, 20 bp, mouse
gccccctcgcacccagtcac

SEQ ID NO: 689187 - DNA, 20 bp, mouse
gtaaacagggcgctcggtgc

SEQ ID NO: 689188 - DNA, 20 bp, mouse
gtccccgtgactgggtgcga

SEQ ID NO: 689189 - DNA, 20 bp, mouse
gccccaccccggctcgtgaa

SEQ ID NO: 689190 - DNA, 20 bp, mouse
ggggcgggaagcttgcgttg

SEQ ID NO: 689191 - DNA, 20 bp, mouse
gacaaagagaggagtaaaca

SEQ ID NO: 689192 - DNA, 20 bp, mouse
gccggggctgaggaaggaca

SEQ ID NO: 689193 - DNA, 20 bp, mouse
gcggctcgcgggcgggtcgg

SEQ ID NO: 689194 - DNA, 20 bp, mouse
gggctcggggactttgtgaa

SEQ ID NO: 689195 - DNA, 20 bp, mouse
ggactcgacgtcacaaagag

SEQ ID NO: 689196 - DNA, 20 bp, mouse
gcgccgggccccccgagaga

SEQ ID NO: 689197 - DNA, 20 bp, mouse
ggcccgcaagctccacccat

SEQ ID NO: 689198 - DNA, 20 bp, mouse
gccgcctccacccaaggagc

SEQ ID NO: 689199 - DNA, 20 bp, mouse
gctccagcctgctccttggg

SEQ ID NO: 689200 - DNA, 20 bp, mouse
gacactccaccggtagtccg

SEQ ID NO: 689201 - DNA, 20 bp, mouse
gcctggctgaccacgcccat

SEQ ID NO: 689202 - DNA, 20 bp, mouse
ggcgtcttagagcgagaaag

SEQ ID NO: 689203 - DNA, 20 bp, mouse
ggggctccgtagcgcggcca

SEQ ID NO: 689204 - DNA, 20 bp, mouse
gtcctcttcccgcacggcgt

SEQ ID NO: 689205 - DNA, 20 bp, mouse
gacgcatcaccccggactac

SEQ ID NO: 689206 - DNA, 20 bp, mouse
gaatgagcgcgctgcggaag

SEQ ID NO: 689207 - DNA, 20 bp, mouse
gccaacccggtgtttctcgc

SEQ ID NO: 689208 - DNA, 20 bp, mouse
ggggctgttgccgtggggac

SEQ ID NO: 689209 - DNA, 20 bp, mouse
gagagcacaccccctgtgcg

SEQ ID NO: 689210 - DNA, 20 bp, mouse
gaggagctgcctcgcacagg

SEQ ID NO: 689211 - DNA, 20 bp, mouse
gcggaaggggctgttgccgt

SEQ ID NO: 689212 - DNA, 20 bp, mouse
gcaactgcgggctcggcggg

SEQ ID NO: 689213 - DNA, 20 bp, mouse
ggtgcgaggcagctcctcaa

SEQ ID NO: 689214 - DNA, 20 bp, mouse
gtgcaaacaagctgcaactg

SEQ ID NO: 689215 - DNA, 20 bp, mouse
ggagcagggcacataaacca

SEQ ID NO: 689216 - DNA, 20 bp, mouse
gggcccgcctagccgggacc

SEQ ID NO: 689217 - DNA, 20 bp, mouse
gtaggcgggcccgtaggagc

SEQ ID NO: 689218 - DNA, 20 bp, mouse
gaggcggcctcgcagatctc

SEQ ID NO: 689219 - DNA, 20 bp, mouse
gacctggctaccacctgccc

SEQ ID NO: 689220 - DNA, 20 bp, mouse
gcgcccgggcgtcctccggg

SEQ ID NO: 689221 - DNA, 20 bp, mouse
gcgccctcggccggctccta

SEQ ID NO: 689222 - DNA, 20 bp, mouse
ggctcccgcgccgcttgcgg

SEQ ID NO: 689223 - DNA, 20 bp, mouse
gcggagccgcggtttaattg

SEQ ID NO: 689224 - DNA, 20 bp, mouse
gcctcccccgcaagcggcgc

SEQ ID NO: 689225 - DNA, 20 bp, mouse
ggccgccttggctcgcccct

SEQ ID NO: 689226 - DNA, 20 bp, mouse
ggggtgcggagccctggcgg

SEQ ID NO: 689227 - DNA, 20 bp, mouse
ggacgtcacctgcccccgag

SEQ ID NO: 689228 - DNA, 20 bp, mouse
ggcgaggcagagggttcttg

SEQ ID NO: 689229 - DNA, 20 bp, mouse
gcccgagaagcttggggcgc

SEQ ID NO: 689230 - DNA, 20 bp, mouse
ggccccgggcctgtcactcg

SEQ ID NO: 689231 - DNA, 20 bp, mouse
ggcggtggcagagagaccca

SEQ ID NO: 689232 - DNA, 20 bp, mouse
gccccaagcttctcgggcat

SEQ ID NO: 689233 - DNA, 20 bp, mouse
ggcggagcgggcgctgggtg

SEQ ID NO: 689234 - DNA, 20 bp, mouse
gaatcagagtgagccgctcg

SEQ ID NO: 689235 - DNA, 20 bp, mouse
gggagggcggggctgccggt

SEQ ID NO: 689236 - DNA, 20 bp, mouse
gcagaggccaagggcaggtc

SEQ ID NO: 689237 - DNA, 20 bp, mouse
gcccaggcgggacagggtca

SEQ ID NO: 689238 - DNA, 20 bp, mouse
gcttccacccaggcgggaca

SEQ ID NO: 689239 - DNA, 20 bp, mouse
gtgagctagggcttccaccc

SEQ ID NO: 689240 - DNA, 20 bp, mouse
gggagagccaaccagggcta

SEQ ID NO: 689241 - DNA, 20 bp, mouse
gccagactggcgccaagcag

SEQ ID NO: 689242 - DNA, 20 bp, mouse
gtgggcccccgacctgccct

SEQ ID NO: 689243 - DNA, 20 bp, mouse
gggtgggagttgcaagccgc

SEQ ID NO: 689244 - DNA, 20 bp, mouse
gcgactaagtagcagctcaa

SEQ ID NO: 689245 - DNA, 20 bp, mouse
gaaggcacaaggcagctcct

SEQ ID NO: 689246 - DNA, 20 bp, mouse
ggggacgcggccttccgcaa

SEQ ID NO: 689247 - DNA, 20 bp, mouse
gccctcctcggggtccgcaa

SEQ ID NO: 689248 - DNA, 20 bp, mouse
gctcgccaggctcccctcct

SEQ ID NO: 689249 - DNA, 20 bp, mouse
gctcgagcgcggcctagagg

SEQ ID NO: 689250 - DNA, 20 bp, mouse
gagcaggtaacggtgagcca

SEQ ID NO: 689251 - DNA, 20 bp, mouse
gagggcctggcctgcagcgc

SEQ ID NO: 689252 - DNA, 20 bp, mouse
gaggaggcaccgacctcgcc

SEQ ID NO: 689253 - DNA, 20 bp, mouse
gcgcggggacgagtccattg

SEQ ID NO: 689254 - DNA, 20 bp, mouse
ggggcggggcagcggcctca

SEQ ID NO: 689255 - DNA, 20 bp, mouse
gagggagccctggtctgagc

SEQ ID NO: 689256 - DNA, 20 bp, mouse
gacagcaaacaatgaagagg

SEQ ID NO: 689257 - DNA, 20 bp, mouse
gagcacagcaaacaatgaag

SEQ ID NO: 689258 - DNA, 20 bp, mouse
gacagaggagaagttgaagt

SEQ ID NO: 689259 - DNA, 20 bp, mouse
gcatatacagagaggtgtta

SEQ ID NO: 689260 - DNA, 20 bp, mouse
gttgactaacacagccacct

SEQ ID NO: 689261 - DNA, 20 bp, mouse
gtcttcaaattcctcctagg

SEQ ID NO: 689262 - DNA, 20 bp, mouse
gggaagagtgcagattcttc

SEQ ID NO: 689263 - DNA, 20 bp, mouse
gccgttaagctgtctctctg

SEQ ID NO: 689264 - DNA, 20 bp, mouse
gactaacacagccacctagg

SEQ ID NO: 689265 - DNA, 20 bp, mouse
ggagagacagcttaacggaa

SEQ ID NO: 689266 - DNA, 20 bp, mouse
gggaaagaaaacaacctgaa

SEQ ID NO: 689267 - DNA, 20 bp, mouse
gacccagcctgtctgagtct

SEQ ID NO: 689268 - DNA, 20 bp, mouse
ggaaaggaacaggaggtacc

SEQ ID NO: 689269 - DNA, 20 bp, mouse
gaacccagactcagacaggc

SEQ ID NO: 689270 - DNA, 20 bp, mouse
gaaaacaacctgaaaggaac

SEQ ID NO: 689271 - DNA, 20 bp, mouse
gtatcactgagctgcagtcc

SEQ ID NO: 689272 - DNA, 20 bp, mouse
gacaacctgaaaggaacagg

SEQ ID NO: 689273 - DNA, 20 bp, mouse
gacagcaaacaatgaagagg

SEQ ID NO: 689274 - DNA, 20 bp, mouse
gttggaacccagactcagac

SEQ ID NO: 689275 - DNA, 20 bp, mouse
gagcacagcaaacaatgaag

SEQ ID NO: 689276 - DNA, 20 bp, mouse
gacccagcctgtctgagtct

SEQ ID NO: 689277 - DNA, 20 bp, mouse
gaacccagactcagacaggc

SEQ ID NO: 689278 - DNA, 20 bp, mouse
gtatcactgagctgcagtcc

SEQ ID NO: 689279 - DNA, 20 bp, mouse
gttggaacccagactcagac

SEQ ID NO: 689280 - DNA, 20 bp, mouse
gacagcaaacaatgaagagg

SEQ ID NO: 689281 - DNA, 20 bp, mouse
gagcacagcaaacaatgaag

SEQ ID NO: 689282 - DNA, 20 bp, mouse
gttgtttgctgtgcttgggt

SEQ ID NO: 689283 - DNA, 20 bp, mouse
gacagaggagaagttgaagt

SEQ ID NO: 689284 - DNA, 20 bp, mouse
gcatatacagagaggtgtta

SEQ ID NO: 689285 - DNA, 20 bp, mouse
gttgactaacacagccacct

SEQ ID NO: 689286 - DNA, 20 bp, mouse
gaaccggggtgggactgggc

SEQ ID NO: 689287 - DNA, 20 bp, mouse
gcgggcggggcaaccggggt

SEQ ID NO: 689288 - DNA, 20 bp, mouse
ggggactgggcgggctcaga

SEQ ID NO: 689289 - DNA, 20 bp, mouse
gcgcacgcgcagagcgggtc

SEQ ID NO: 689290 - DNA, 20 bp, mouse
ggggcaaccggggtgggact

SEQ ID NO: 689291 - DNA, 20 bp, mouse
gagcccgcccagtcccaccc

SEQ ID NO: 689292 - DNA, 20 bp, mouse
gcgcacgggcggggcaaccg

SEQ ID NO: 689293 - DNA, 20 bp, mouse
gctctccgagcgctgtcttg

SEQ ID NO: 689294 - DNA, 20 bp, mouse
ggggcgactagtgacgtcac

SEQ ID NO: 689295 - DNA, 20 bp, mouse
gcggagagacccgaccggcc

SEQ ID NO: 689296 - DNA, 20 bp, mouse
gttgggggcggagtcgtcta

SEQ ID NO: 689297 - DNA, 20 bp, mouse
gataagaggggcggggatat

SEQ ID NO: 689298 - DNA, 20 bp, mouse
gaagtcacgtgaagcacagt

SEQ ID NO: 689299 - DNA, 20 bp, mouse
ggggcgggttgtacacgttt

SEQ ID NO: 689300 - DNA, 20 bp, mouse
ggcgcaaagtgggcgggctt

SEQ ID NO: 689301 - DNA, 20 bp, mouse
gtgaccactgccttgagcaa

SEQ ID NO: 689302 - DNA, 20 bp, mouse
ggtgctgctcgcgacgtccg

SEQ ID NO: 689303 - DNA, 20 bp, mouse
gagaccgttgctcaaggcag

SEQ ID NO: 689304 - DNA, 20 bp, mouse
gtcggctgcgcaaagtgggc

SEQ ID NO: 689305 - DNA, 20 bp, mouse
ggccctcgactgtgcggtct

SEQ ID NO: 689306 - DNA, 20 bp, mouse
gcggccgcaagcagccagcg

SEQ ID NO: 689307 - DNA, 20 bp, mouse
gggacccagcgccgccctgt

SEQ ID NO: 689308 - DNA, 20 bp, mouse
gaggcggggcggggccgcac

SEQ ID NO: 689309 - DNA, 20 bp, mouse
ggaaccgtgtgcagggtccc

SEQ ID NO: 689310 - DNA, 20 bp, mouse
gtgcccgcccacccacaggg

SEQ ID NO: 689311 - DNA, 20 bp, mouse
gccggtggcctgggccctcc

SEQ ID NO: 689312 - DNA, 20 bp, mouse
gctggcgatcgcgactcttc

SEQ ID NO: 689313 - DNA, 20 bp, mouse
gagccagcgcggctcggagg

SEQ ID NO: 689314 - DNA, 20 bp, mouse
ggctcggcccagagccggga

SEQ ID NO: 689315 - DNA, 20 bp, mouse
ggagccgcgctggctgcttg

SEQ ID NO: 689316 - DNA, 20 bp, mouse
gggtgcgggcgacggaagtg

SEQ ID NO: 689317 - DNA, 20 bp, mouse
ggtcgggagccaatcagcag

SEQ ID NO: 689318 - DNA, 20 bp, mouse
gccccagtgagcgctctggt

SEQ ID NO: 689319 - DNA, 20 bp, mouse
gcgcccgcaccgctgctgat

SEQ ID NO: 689320 - DNA, 20 bp, mouse
gcaagcgcgtggtcaggtcc

SEQ ID NO: 689321 - DNA, 20 bp, mouse
ggcgccggggcccgtgagag

SEQ ID NO: 689322 - DNA, 20 bp, mouse
gaggtccgggtggagagcga

SEQ ID NO: 689323 - DNA, 20 bp, mouse
gcgcgccccagtgagcgctc

SEQ ID NO: 689324 - DNA, 20 bp, mouse
gggtatccacccttggagga

SEQ ID NO: 689325 - DNA, 20 bp, mouse
gtcccgaagaccgcgtcttc

SEQ ID NO: 689326 - DNA, 20 bp, mouse
gaattcgcgcagtgggagtg

SEQ ID NO: 689327 - DNA, 20 bp, mouse
gatggggcacgcacgcagat

SEQ ID NO: 689328 - DNA, 20 bp, mouse
ggtgcgcactgtaggggatg

SEQ ID NO: 689329 - DNA, 20 bp, mouse
gatgggagaaccagatttat

SEQ ID NO: 689330 - DNA, 20 bp, mouse
gaaaggggaattcgcgcagt

SEQ ID NO: 689331 - DNA, 20 bp, mouse
gtccacagggctcctatcta

SEQ ID NO: 689332 - DNA, 20 bp, mouse
gaaacagcgggacagagact

SEQ ID NO: 689333 - DNA, 20 bp, mouse
ggcaacgggacgcgactcac

SEQ ID NO: 689334 - DNA, 20 bp, mouse
ggcttggagtgcgcactgta

SEQ ID NO: 689335 - DNA, 20 bp, mouse
gaaagctgcaagcttgttgt

SEQ ID NO: 689336 - DNA, 20 bp, mouse
gtatcccacagcatcacttc

SEQ ID NO: 689337 - DNA, 20 bp, mouse
gttagtgtggcattctgtct

SEQ ID NO: 689338 - DNA, 20 bp, mouse
gccacctgaagtgatgctgt

SEQ ID NO: 689339 - DNA, 20 bp, mouse
gtcctaataggtgtcaagag

SEQ ID NO: 689340 - DNA, 20 bp, mouse
gtaagtggcaacagcagaca

SEQ ID NO: 689341 - DNA, 20 bp, mouse
ggacacctattaggaaatct

SEQ ID NO: 689342 - DNA, 20 bp, mouse
gagaggctcatttactttac

SEQ ID NO: 689343 - DNA, 20 bp, mouse
gtctatgacatagacaacag

SEQ ID NO: 689344 - DNA, 20 bp, mouse
gaggtcctggagagaaactc

SEQ ID NO: 689345 - DNA, 20 bp, mouse
gtacagagaaaataaggtcc

SEQ ID NO: 689346 - DNA, 20 bp, mouse
gtggttgcccgggagacgct

SEQ ID NO: 689347 - DNA, 20 bp, mouse
gcatcctcctagcgtctccc

SEQ ID NO: 689348 - DNA, 20 bp, mouse
ggacgcgtctggggaccgaa

SEQ ID NO: 689349 - DNA, 20 bp, mouse
gactgagagctcttgcgcat

SEQ ID NO: 689350 - DNA, 20 bp, mouse
ggggcaaccacatagccacg

SEQ ID NO: 689351 - DNA, 20 bp, mouse
gggtaacttaattgagacta

SEQ ID NO: 689352 - DNA, 20 bp, mouse
gcccaggagcctagaggttt

SEQ ID NO: 689353 - DNA, 20 bp, mouse
gccagcagcgggcggtcccg

SEQ ID NO: 689354 - DNA, 20 bp, mouse
gttgcccgggagacgctagg

SEQ ID NO: 689355 - DNA, 20 bp, mouse
gcgctaggaggatggaacgc

SEQ ID NO: 689356 - DNA, 20 bp, mouse
gtaagcaaatagaaggatta

SEQ ID NO: 689357 - DNA, 20 bp, mouse
ggggtgttgactaaattcaa

SEQ ID NO: 689358 - DNA, 20 bp, mouse
ggaaactctggctccgttgt

SEQ ID NO: 689359 - DNA, 20 bp, mouse
gtccctaattattcatattg

SEQ ID NO: 689360 - DNA, 20 bp, mouse
ggctgggaatatagaaactc

SEQ ID NO: 689361 - DNA, 20 bp, mouse
ggcttgttcagaagcctcgt

SEQ ID NO: 689362 - DNA, 20 bp, mouse
gtaattagggagtggctttg

SEQ ID NO: 689363 - DNA, 20 bp, mouse
gacagtttaggaatcccacg

SEQ ID NO: 689364 - DNA, 20 bp, mouse
gataagacatgccgagattt

SEQ ID NO: 689365 - DNA, 20 bp, mouse
gctatacctaagcaaataga

SEQ ID NO: 689366 - DNA, 20 bp, mouse
gtacgcatgcgactggaggc

SEQ ID NO: 689367 - DNA, 20 bp, mouse
gacgttacgcatgcgactgg

SEQ ID NO: 689368 - DNA, 20 bp, mouse
gcggcgccgcgtggcctttt

SEQ ID NO: 689369 - DNA, 20 bp, mouse
gctggaggcggggctatgtg

SEQ ID NO: 689370 - DNA, 20 bp, mouse
gaccggcgcccgctcgcggt

SEQ ID NO: 689371 - DNA, 20 bp, mouse
gctggcaatgaagacagacg

SEQ ID NO: 689372 - DNA, 20 bp, mouse
gaggaactggcgtctgagga

SEQ ID NO: 689373 - DNA, 20 bp, mouse
gtccgactacaagtcccaaa

SEQ ID NO: 689374 - DNA, 20 bp, mouse
gggagcggcggcctttaggg

SEQ ID NO: 689375 - DNA, 20 bp, mouse
ggctgaggaactggcgtctg

SEQ ID NO: 689376 - DNA, 20 bp, mouse
gcccggggacagtcagtcct

SEQ ID NO: 689377 - DNA, 20 bp, mouse
gctctccttggcagtaacta

SEQ ID NO: 689378 - DNA, 20 bp, mouse
gcacaccttagttactgcca

SEQ ID NO: 689379 - DNA, 20 bp, mouse
gcgggaggcgcgggtgtgga

SEQ ID NO: 689380 - DNA, 20 bp, mouse
gtacaggtacggttgaacat

SEQ ID NO: 689381 - DNA, 20 bp, mouse
gtcgggccagcctggcaagg

SEQ ID NO: 689382 - DNA, 20 bp, mouse
gtgtgcggaggccctcccgc

SEQ ID NO: 689383 - DNA, 20 bp, mouse
ggcaccgcctcgggccagcc

SEQ ID NO: 689384 - DNA, 20 bp, mouse
ggccccgcagccctggtgtt

SEQ ID NO: 689385 - DNA, 20 bp, mouse
ggcggtgctgcgctgtgcgg

SEQ ID NO: 689386 - DNA, 20 bp, mouse
ggggacttgaagttctctgg

SEQ ID NO: 689387 - DNA, 20 bp, mouse
gtgggcgagcgaagctctgt

SEQ ID NO: 689388 - DNA, 20 bp, mouse
gagaggccgcccctctgcgc

SEQ ID NO: 689389 - DNA, 20 bp, mouse
ggaaacagatacaccggccc

SEQ ID NO: 689390 - DNA, 20 bp, mouse
gggctccgccccaggatgtg

SEQ ID NO: 689391 - DNA, 20 bp, mouse
ggcccgaagcgtttccgctt

SEQ ID NO: 689392 - DNA, 20 bp, mouse
ggcaaccaggcgccctgcct

SEQ ID NO: 689393 - DNA, 20 bp, mouse
gaacgcttcgggccccgggc

SEQ ID NO: 689394 - DNA, 20 bp, mouse
gccggtgtatctgtttcaac

SEQ ID NO: 689395 - DNA, 20 bp, mouse
ggccgcccagcgcagagggg

SEQ ID NO: 689396 - DNA, 20 bp, mouse
ggggcaaccgggatgacggg

SEQ ID NO: 689397 - DNA, 20 bp, mouse
gaggccgcgcatgcgcgacc

SEQ ID NO: 689398 - DNA, 20 bp, mouse
gatgacgggtggtgcacttt

SEQ ID NO: 689399 - DNA, 20 bp, mouse
ggggaccaagcctgagggcg

SEQ ID NO: 689400 - DNA, 20 bp, mouse
ggggcggggaccaagcctga

SEQ ID NO: 689401 - DNA, 20 bp, mouse
gcccacttggcccaactgaa

SEQ ID NO: 689402 - DNA, 20 bp, mouse
gcggcgggcaaccgggatga

SEQ ID NO: 689403 - DNA, 20 bp, mouse
gcacatgcgcggcagcagac

SEQ ID NO: 689404 - DNA, 20 bp, mouse
ggagccgaccgcgcctgcgg

SEQ ID NO: 689405 - DNA, 20 bp, mouse
gttaccgccccactgaaagg

SEQ ID NO: 689406 - DNA, 20 bp, mouse
gcggtgtcctcgtgcgtctg

SEQ ID NO: 689407 - DNA, 20 bp, mouse
gcgcgctggcgacccctgca

SEQ ID NO: 689408 - DNA, 20 bp, mouse
gcgccagcgcgctctcggtc

SEQ ID NO: 689409 - DNA, 20 bp, mouse
gaggacaccgcgggcccgtc

SEQ ID NO: 689410 - DNA, 20 bp, mouse
gcctcccgcgtaaggctgtc

SEQ ID NO: 689411 - DNA, 20 bp, mouse
gccgcagctagggacgttgc

SEQ ID NO: 689412 - DNA, 20 bp, mouse
gggtccttgcgggtcctcgg

SEQ ID NO: 689413 - DNA, 20 bp, mouse
gcagccggacagccttacgc

SEQ ID NO: 689414 - DNA, 20 bp, mouse
gtacgcgggaggtggagccg

SEQ ID NO: 689415 - DNA, 20 bp, mouse
gcagcaatgggcagctggtg

SEQ ID NO: 689416 - DNA, 20 bp, mouse
gcgcctgccggggaccgcag

SEQ ID NO: 689417 - DNA, 20 bp, mouse
gctaaagaggagacccgggg

SEQ ID NO: 689418 - DNA, 20 bp, mouse
gcccctaaagaggagacccg

SEQ ID NO: 689419 - DNA, 20 bp, mouse
gcccggaaccgcccctaaag

SEQ ID NO: 689420 - DNA, 20 bp, mouse
ggctaaggccggcggtgtcg

SEQ ID NO: 689421 - DNA, 20 bp, mouse
gctgccggggaccgcagcgg

SEQ ID NO: 689422 - DNA, 20 bp, mouse
gtagacagggcggccgggga

SEQ ID NO: 689423 - DNA, 20 bp, mouse
gagcgcagcgctaaggccgg

SEQ ID NO: 689424 - DNA, 20 bp, mouse
gtctaccttgccggggaagg

SEQ ID NO: 689425 - DNA, 20 bp, mouse
gggagcgcgatacccctccc

SEQ ID NO: 689426 - DNA, 20 bp, mouse
gaggcctgcaaggtaggctg

SEQ ID NO: 689427 - DNA, 20 bp, mouse
gaccggaagtaggacatctg

SEQ ID NO: 689428 - DNA, 20 bp, mouse
gcatctgaggcctgcaaggt

SEQ ID NO: 689429 - DNA, 20 bp, mouse
gcgaccctgatacttgattg

SEQ ID NO: 689430 - DNA, 20 bp, mouse
gttgcacgagaagtggaaac

SEQ ID NO: 689431 - DNA, 20 bp, mouse
ggattcctgcactcatcgat

SEQ ID NO: 689432 - DNA, 20 bp, mouse
gaatcctcagcctaccttgc

SEQ ID NO: 689433 - DNA, 20 bp, mouse
gccctcccctaagtggggat

SEQ ID NO: 689434 - DNA, 20 bp, mouse
gaggacatctgaggcctgca

SEQ ID NO: 689435 - DNA, 20 bp, mouse
gcaagcatgatggtctacga

SEQ ID NO: 689436 - DNA, 20 bp, mouse
gtcccaaagagcagcctcat

SEQ ID NO: 689437 - DNA, 20 bp, mouse
gcctaggatgccagatgata

SEQ ID NO: 689438 - DNA, 20 bp, mouse
gtagggcttgatgctgaata

SEQ ID NO: 689439 - DNA, 20 bp, mouse
gcggagaagtaagccgaagg

SEQ ID NO: 689440 - DNA, 20 bp, mouse
gagtaacgataagagagcag

SEQ ID NO: 689441 - DNA, 20 bp, mouse
gggcaacgacgtcacggccg

SEQ ID NO: 689442 - DNA, 20 bp, mouse
gccagagaatgcaggctcct

SEQ ID NO: 689443 - DNA, 20 bp, mouse
gttcccatgaggctgctctt

SEQ ID NO: 689444 - DNA, 20 bp, mouse
gataagagagcagaggctcc

SEQ ID NO: 689445 - DNA, 20 bp, mouse
ggagaactacacttcccatg

SEQ ID NO: 689446 - DNA, 20 bp, mouse
gaccgccagcctctcccgat

SEQ ID NO: 689447 - DNA, 20 bp, mouse
ggacccggggctccgccttc

SEQ ID NO: 689448 - DNA, 20 bp, mouse
gaatgcaccgcgcacagcgt

SEQ ID NO: 689449 - DNA, 20 bp, mouse
gggcccacacaccctgaagg

SEQ ID NO: 689450 - DNA, 20 bp, mouse
ggggcctagggattaggcgg

SEQ ID NO: 689451 - DNA, 20 bp, mouse
gtggtctgcaacaaaacgcg

SEQ ID NO: 689452 - DNA, 20 bp, mouse
gcgcgggggaaagatcctga

SEQ ID NO: 689453 - DNA, 20 bp, mouse
ggagccagccactcgacccg

SEQ ID NO: 689454 - DNA, 20 bp, mouse
ggcgatgcgcggcacgcgtg

SEQ ID NO: 689455 - DNA, 20 bp, mouse
ggagccccgggtcgagtggc

SEQ ID NO: 689456 - DNA, 20 bp, mouse
gaatgcctcggggcggagga

SEQ ID NO: 689457 - DNA, 20 bp, mouse
ggggagaagcccgcagtgcg

SEQ ID NO: 689458 - DNA, 20 bp, mouse
gcgggcgggcgcagccaatg

SEQ ID NO: 689459 - DNA, 20 bp, mouse
gggggcggggctctatttca

SEQ ID NO: 689460 - DNA, 20 bp, mouse
gacaagatgtggagcgagag

SEQ ID NO: 689461 - DNA, 20 bp, mouse
ggccaaggaaaaaagaatgg

SEQ ID NO: 689462 - DNA, 20 bp, mouse
ggtcccacaatgcctcgggg

SEQ ID NO: 689463 - DNA, 20 bp, mouse
gcgccgtccgcgctccccat

SEQ ID NO: 689464 - DNA, 20 bp, mouse
ggaagcccgcagtgcggggc

SEQ ID NO: 689465 - DNA, 20 bp, mouse
gcggagaggcctgactcggg

SEQ ID NO: 689466 - DNA, 20 bp, mouse
gaagcaaggactcaaccctt

SEQ ID NO: 689467 - DNA, 20 bp, mouse
gactgtgcgcaggctcagaa

SEQ ID NO: 689468 - DNA, 20 bp, mouse
ggacaactcgtcctcaccga

SEQ ID NO: 689469 - DNA, 20 bp, mouse
gaggagccagcagtgatggg

SEQ ID NO: 689470 - DNA, 20 bp, mouse
gtccacaaaggactgtgcgc

SEQ ID NO: 689471 - DNA, 20 bp, mouse
ggacgggagtcaacgaagca

SEQ ID NO: 689472 - DNA, 20 bp, mouse
gctcagaagggcggggaacg

SEQ ID NO: 689473 - DNA, 20 bp, mouse
ggatctgtccgtctccacaa

SEQ ID NO: 689474 - DNA, 20 bp, mouse
gatcaggagccagcagtgat

SEQ ID NO: 689475 - DNA, 20 bp, mouse
gcctgggcgtgtaagatgtg

SEQ ID NO: 689476 - DNA, 20 bp, mouse
gcaacctgccacatgcaggg

SEQ ID NO: 689477 - DNA, 20 bp, mouse
gcccaggaacctcaaggcga

SEQ ID NO: 689478 - DNA, 20 bp, mouse
gggcacggacgttccttccc

SEQ ID NO: 689479 - DNA, 20 bp, mouse
gaaggcgatggggtcgtggc

SEQ ID NO: 689480 - DNA, 20 bp, mouse
ggcaggatacagtctctcct

SEQ ID NO: 689481 - DNA, 20 bp, mouse
gaagcaacctgccacatgca

SEQ ID NO: 689482 - DNA, 20 bp, mouse
gtttccgccctgcatgtggc

SEQ ID NO: 689483 - DNA, 20 bp, mouse
gctgcgcctgcgcaacggtt

SEQ ID NO: 689484 - DNA, 20 bp, mouse
gacatgcagggcggaaaagc

SEQ ID NO: 689485 - DNA, 20 bp, mouse
gatgggctgcgcctgcgcaa

SEQ ID NO: 689486 - DNA, 20 bp, mouse
gagggtccctggcgccgggg

SEQ ID NO: 689487 - DNA, 20 bp, mouse
gcagaaccacctaacctctc

SEQ ID NO: 689488 - DNA, 20 bp, mouse
ggtcagggtccctggcgccg

SEQ ID NO: 689489 - DNA, 20 bp, mouse
gtacgaagtgagagattctg

SEQ ID NO: 689490 - DNA, 20 bp, mouse
ggacacccagagaggttagg

SEQ ID NO: 689491 - DNA, 20 bp, mouse
gtagaggagacaccacactc

SEQ ID NO: 689492 - DNA, 20 bp, mouse
gcaattggcagcctctgcaa

SEQ ID NO: 689493 - DNA, 20 bp, mouse
ggatgacacccagagaggtt

SEQ ID NO: 689494 - DNA, 20 bp, mouse
gttatacgcagcctttgcag

SEQ ID NO: 689495 - DNA, 20 bp, mouse
gagaccatggtgcaggtaac

SEQ ID NO: 689496 - DNA, 20 bp, mouse
gcggggccctagagcgtagg

SEQ ID NO: 689497 - DNA, 20 bp, mouse
gggactgcgcaggcgcggtc

SEQ ID NO: 689498 - DNA, 20 bp, mouse
gacaaaagctggtctctgag

SEQ ID NO: 689499 - DNA, 20 bp, mouse
gggagcctttggtggagggg

SEQ ID NO: 689500 - DNA, 20 bp, mouse
gcagctatctgcacaaaagt

SEQ ID NO: 689501 - DNA, 20 bp, mouse
gggaggagcctttggtggag

SEQ ID NO: 689502 - DNA, 20 bp, mouse
gtgcagatagctgatccgca

SEQ ID NO: 689503 - DNA, 20 bp, mouse
ggtctctgaggggaagaaag

SEQ ID NO: 689504 - DNA, 20 bp, mouse
gacacacaagccctgttact

SEQ ID NO: 689505 - DNA, 20 bp, mouse
ggacaacccaaaccaaacaa

SEQ ID NO: 689506 - DNA, 20 bp, mouse
gaaaaaagaagaaggaagtt

SEQ ID NO: 689507 - DNA, 20 bp, mouse
ggtgagcgggagggaggacc

SEQ ID NO: 689508 - DNA, 20 bp, mouse
gaggacctctttcttgccct

SEQ ID NO: 689509 - DNA, 20 bp, mouse
gctctgagccctctgggatt

SEQ ID NO: 689510 - DNA, 20 bp, mouse
ggagcagcaggcgcggccga

SEQ ID NO: 689511 - DNA, 20 bp, mouse
gcagctatctgcacaaaagt

SEQ ID NO: 689512 - DNA, 20 bp, mouse
gtgcagatagctgatccgca

SEQ ID NO: 689513 - DNA, 20 bp, mouse
gaacaaaagctggtctccga

SEQ ID NO: 689514 - DNA, 20 bp, mouse
ggtctccgagggcaagaaag

SEQ ID NO: 689515 - DNA, 20 bp, mouse
gttggaaaccaaatcccaga

SEQ ID NO: 689516 - DNA, 20 bp, mouse
gttggttcagatagctgatc

SEQ ID NO: 689517 - DNA, 20 bp, mouse
gagctatctgaaccaaagtt

SEQ ID NO: 689518 - DNA, 20 bp, mouse
gttcagatagctgatccgga

SEQ ID NO: 689519 - DNA, 20 bp, mouse
gacaaaagctggtctccgag

SEQ ID NO: 689520 - DNA, 20 bp, mouse
ggtctccgaggggaagaaag

SEQ ID NO: 689521 - DNA, 20 bp, mouse
gtgtttagagagaggttagg

SEQ ID NO: 689522 - DNA, 20 bp, mouse
gaggacctctttcttcccct

SEQ ID NO: 689523 - DNA, 20 bp, mouse
ggttgtcggtgtttagagag

SEQ ID NO: 689524 - DNA, 20 bp, mouse
ggacaacccaaaccaaacaa

SEQ ID NO: 689525 - DNA, 20 bp, mouse
gcaaacaaaggaacaaaagc

SEQ ID NO: 689526 - DNA, 20 bp, mouse
gagggcggggttaaaggaca

SEQ ID NO: 689527 - DNA, 20 bp, mouse
gtacccttagccccgctaaa

SEQ ID NO: 689528 - DNA, 20 bp, mouse
gagggcggggttaaaagagc

SEQ ID NO: 689529 - DNA, 20 bp, mouse
gtgcgtaaacgccctgggtc

SEQ ID NO: 689530 - DNA, 20 bp, mouse
gcggggttaaaagagcaggg

SEQ ID NO: 689531 - DNA, 20 bp, mouse
ggcggggttaaaggacaggg

SEQ ID NO: 689532 - DNA, 20 bp, mouse
gaaacgccctgggtctggag

SEQ ID NO: 689533 - DNA, 20 bp, mouse
gagctagcacaggtgatttt

SEQ ID NO: 689534 - DNA, 20 bp, mouse
gtgcacttaaaacctagcag

SEQ ID NO: 689535 - DNA, 20 bp, mouse
gagggcctgcgtaaacgccc

SEQ ID NO: 689536 - DNA, 20 bp, mouse
ggggcctgttgctcgggtaa

SEQ ID NO: 689537 - DNA, 20 bp, mouse
ggtcacgtgaaggataaatt

SEQ ID NO: 689538 - DNA, 20 bp, mouse
gccgctatgagtgtcagagg

SEQ ID NO: 689539 - DNA, 20 bp, mouse
gggcccgctatgagtgtcag

SEQ ID NO: 689540 - DNA, 20 bp, mouse
gcgcgcggcccgggaaggaa

SEQ ID NO: 689541 - DNA, 20 bp, mouse
ggagggcgcgtgattcgctc

SEQ ID NO: 689542 - DNA, 20 bp, mouse
gtatccttcacgtgacctga

SEQ ID NO: 689543 - DNA, 20 bp, mouse
gcgccggcttggggccggga

SEQ ID NO: 689544 - DNA, 20 bp, mouse
gggccccgcccgccggcttg

SEQ ID NO: 689545 - DNA, 20 bp, mouse
gcctcccagggccgcgaggt

SEQ ID NO: 689546 - DNA, 20 bp, mouse
ggggctgggccgtagggcga

SEQ ID NO: 689547 - DNA, 20 bp, mouse
gagcacacaaagttgatcaa

SEQ ID NO: 689548 - DNA, 20 bp, mouse
gggagcatgcaccatgtgac

SEQ ID NO: 689549 - DNA, 20 bp, mouse
gtgaccggatgaaactttcc

SEQ ID NO: 689550 - DNA, 20 bp, mouse
gcgtgcggagcagccaccaa

SEQ ID NO: 689551 - DNA, 20 bp, mouse
gagtgggcaggtctgagctc

SEQ ID NO: 689552 - DNA, 20 bp, mouse
gaggtcacgtgaatgatgtg

SEQ ID NO: 689553 - DNA, 20 bp, mouse
gtagcaataggcaccagaca

SEQ ID NO: 689554 - DNA, 20 bp, mouse
gccggccagtggagtcccgg

SEQ ID NO: 689555 - DNA, 20 bp, mouse
gtacccacgccctcaggtaa

SEQ ID NO: 689556 - DNA, 20 bp, mouse
gcggctctgcggaagatcgg

SEQ ID NO: 689557 - DNA, 20 bp, mouse
gaggggcgtcgcaggggcga

SEQ ID NO: 689558 - DNA, 20 bp, mouse
ggggcggctctgcggaagat

SEQ ID NO: 689559 - DNA, 20 bp, mouse
gccggagtcgcagttttcct

SEQ ID NO: 689560 - DNA, 20 bp, mouse
gtcgccctgtgcctccccta

SEQ ID NO: 689561 - DNA, 20 bp, mouse
gctctgcggaagatcggagg

SEQ ID NO: 689562 - DNA, 20 bp, mouse
gtagagggcagatggccgta

SEQ ID NO: 689563 - DNA, 20 bp, mouse
ggggtggccgccagcctgtg

SEQ ID NO: 689564 - DNA, 20 bp, mouse
ggactcccggggtggcgggt

SEQ ID NO: 689565 - DNA, 20 bp, mouse
gtggccgtaggggaggcaca

SEQ ID NO: 689566 - DNA, 20 bp, mouse
gcgaggggcgtgctgttcct

SEQ ID NO: 689567 - DNA, 20 bp, mouse
gcggggaggaggcggagcga

SEQ ID NO: 689568 - DNA, 20 bp, mouse
gctcccgcgtggtctccctg

SEQ ID NO: 689569 - DNA, 20 bp, mouse
gaacgccgccttggagggag

SEQ ID NO: 689570 - DNA, 20 bp, mouse
gggtccgcagggagaccacg

SEQ ID NO: 689571 - DNA, 20 bp, mouse
gggtgaatacgaagaagcgt

SEQ ID NO: 689572 - DNA, 20 bp, mouse
gctgcgcaacgccgccttgg

SEQ ID NO: 689573 - DNA, 20 bp, mouse
gaactgcgagcacaccaccc

SEQ ID NO: 689574 - DNA, 20 bp, mouse
gactcccatgtttggtttca

SEQ ID NO: 689575 - DNA, 20 bp, mouse
gtagccgtgaaaccaaacat

SEQ ID NO: 689576 - DNA, 20 bp, mouse
gggagagagaaaacgaggtt

SEQ ID NO: 689577 - DNA, 20 bp, mouse
gcagctcagagtcacaaaaa

SEQ ID NO: 689578 - DNA, 20 bp, mouse
gcccctctgcgcctggttga

SEQ ID NO: 689579 - DNA, 20 bp, mouse
ggaattggagagagaaaacg

SEQ ID NO: 689580 - DNA, 20 bp, mouse
gaataggcttaccccactta

SEQ ID NO: 689581 - DNA, 20 bp, mouse
gggggagagatgtattcttt

SEQ ID NO: 689582 - DNA, 20 bp, mouse
gtgggctctgataccaggaa

SEQ ID NO: 689583 - DNA, 20 bp, mouse
gccaattcatggatcaccca

SEQ ID NO: 689584 - DNA, 20 bp, mouse
gcccaaaccatctttcgcat

SEQ ID NO: 689585 - DNA, 20 bp, mouse
ggtactcagctaaatgtcta

SEQ ID NO: 689586 - DNA, 20 bp, mouse
gctgcgaggtactggatgag

SEQ ID NO: 689587 - DNA, 20 bp, mouse
gaaacgctgctgcgaggtac

SEQ ID NO: 689588 - DNA, 20 bp, mouse
gcactggtgccttgttctga

SEQ ID NO: 689589 - DNA, 20 bp, mouse
gtgagtggctggcaagaaca

SEQ ID NO: 689590 - DNA, 20 bp, mouse
ggaggagcaaggaattactc

SEQ ID NO: 689591 - DNA, 20 bp, mouse
gcctgggtccgccctcaggg

SEQ ID NO: 689592 - DNA, 20 bp, mouse
gctcagggcggtggccaagg

SEQ ID NO: 689593 - DNA, 20 bp, mouse
ggggataaggtacacccagg

SEQ ID NO: 689594 - DNA, 20 bp, mouse
gccggcctgggtccgccctc

SEQ ID NO: 689595 - DNA, 20 bp, mouse
gctcactagcagttgtgcct

SEQ ID NO: 689596 - DNA, 20 bp, mouse
gtactgctccctaagctcta

SEQ ID NO: 689597 - DNA, 20 bp, mouse
gacttgggattcggggttct

SEQ ID NO: 689598 - DNA, 20 bp, mouse
gttgctaggtgctatcactt

SEQ ID NO: 689599 - DNA, 20 bp, mouse
gagagtcaccatagagctta

SEQ ID NO: 689600 - DNA, 20 bp, mouse
gaagcatcccccagttctgc

SEQ ID NO: 689601 - DNA, 20 bp, mouse
gatccagaaaagagttacat

SEQ ID NO: 689602 - DNA, 20 bp, mouse
gcatgaaactaatacggaaa

SEQ ID NO: 689603 - DNA, 20 bp, mouse
gtgctatcacttgggattcg

SEQ ID NO: 689604 - DNA, 20 bp, mouse
gttagtttcatgtaatgagg

SEQ ID NO: 689605 - DNA, 20 bp, mouse
gttcccatgtaactcttttc

SEQ ID NO: 689606 - DNA, 20 bp, mouse
ggcagaacacggaaacgaga

SEQ ID NO: 689607 - DNA, 20 bp, mouse
ggggagaccgagggtcctac

SEQ ID NO: 689608 - DNA, 20 bp, mouse
gacaggagactgccgtgcgc

SEQ ID NO: 689609 - DNA, 20 bp, mouse
gacggaaacgagagggctcg

SEQ ID NO: 689610 - DNA, 20 bp, mouse
gcttgagagacgccgagcac

SEQ ID NO: 689611 - DNA, 20 bp, mouse
ggggaagcagtgcctgcgca

SEQ ID NO: 689612 - DNA, 20 bp, mouse
gcgtgtgagtgcggtgccct

SEQ ID NO: 689613 - DNA, 20 bp, mouse
gcctcgaactcggatcctct

SEQ ID NO: 689614 - DNA, 20 bp, mouse
gcaacatagtgggagaccga

SEQ ID NO: 689615 - DNA, 20 bp, mouse
gtccgggtcaggggtccagt

SEQ ID NO: 689616 - DNA, 20 bp, mouse
gcgggagccgagcagatgat

SEQ ID NO: 689617 - DNA, 20 bp, mouse
ggaaacgcaagctgcagcgg

SEQ ID NO: 689618 - DNA, 20 bp, mouse
gggaggcgggtaccagacgg

SEQ ID NO: 689619 - DNA, 20 bp, mouse
ggcagccagagacaagggcg

SEQ ID NO: 689620 - DNA, 20 bp, mouse
gcgcgctgggccttcttcat

SEQ ID NO: 689621 - DNA, 20 bp, mouse
gcgccgagaaggcatattct

SEQ ID NO: 689622 - DNA, 20 bp, mouse
gtccctgccaatcatctgct

SEQ ID NO: 689623 - DNA, 20 bp, mouse
gtgggccttcttcatcggat

SEQ ID NO: 689624 - DNA, 20 bp, mouse
gggagcgcgctggaagtctc

SEQ ID NO: 689625 - DNA, 20 bp, mouse
gccagccccgcccttgtctc

SEQ ID NO: 689626 - DNA, 20 bp, mouse
gaacccagattcacttctac

SEQ ID NO: 689627 - DNA, 20 bp, mouse
gggctctgggtgctagcccc

SEQ ID NO: 689628 - DNA, 20 bp, mouse
gaccctgtagaagtgaatct

SEQ ID NO: 689629 - DNA, 20 bp, mouse
ggccaccagaagaccgtaga

SEQ ID NO: 689630 - DNA, 20 bp, mouse
ggccagaggagccgggtaag

SEQ ID NO: 689631 - DNA, 20 bp, mouse
gaatcacagctgcccttcag

SEQ ID NO: 689632 - DNA, 20 bp, mouse
gagctcgctgattcctctga

SEQ ID NO: 689633 - DNA, 20 bp, mouse
gagaagaccgtagaggggag

SEQ ID NO: 689634 - DNA, 20 bp, mouse
gcccctctacggtcttctgg

SEQ ID NO: 689635 - DNA, 20 bp, mouse
gccgggtaagcggagagaag

SEQ ID NO: 689636 - DNA, 20 bp, mouse
ggaccccaggcctgagctac

SEQ ID NO: 689637 - DNA, 20 bp, mouse
gctgccgctcatcaaggcct

SEQ ID NO: 689638 - DNA, 20 bp, mouse
gcatccacccacagcagagg

SEQ ID NO: 689639 - DNA, 20 bp, mouse
ggggaagcaccgcagacccc

SEQ ID NO: 689640 - DNA, 20 bp, mouse
gtggcggggagagacgcgta

SEQ ID NO: 689641 - DNA, 20 bp, mouse
gtgagtctggacttgcggat

SEQ ID NO: 689642 - DNA, 20 bp, mouse
gcccgccagtagctcaggcc

SEQ ID NO: 689643 - DNA, 20 bp, mouse
gttagagttgcaagggaggg

SEQ ID NO: 689644 - DNA, 20 bp, mouse
ggagacgcgtagggtccgcg

SEQ ID NO: 689645 - DNA, 20 bp, mouse
ggggcaacgttaatggataa

SEQ ID NO: 689646 - DNA, 20 bp, mouse
gtgggactgcagtcggtgat

SEQ ID NO: 689647 - DNA, 20 bp, mouse
ggaccgctgaagacagaggg

SEQ ID NO: 689648 - DNA, 20 bp, mouse
ggccaggcgcaagaggggtg

SEQ ID NO: 689649 - DNA, 20 bp, mouse
gccccgccgcagtccccctt

SEQ ID NO: 689650 - DNA, 20 bp, mouse
gcggcgaccgctgaagacag

SEQ ID NO: 689651 - DNA, 20 bp, mouse
gaagctgccaggcgcaagag

SEQ ID NO: 689652 - DNA, 20 bp, mouse
gtcctgttccggtcggactc

SEQ ID NO: 689653 - DNA, 20 bp, mouse
gaccccagcgcctggaaccc

SEQ ID NO: 689654 - DNA, 20 bp, mouse
ggaaaacaggaggggaccga

SEQ ID NO: 689655 - DNA, 20 bp, mouse
gactgcagtcggtgattggc

SEQ ID NO: 689656 - DNA, 20 bp, mouse
gtggggacgggtatcagttt

SEQ ID NO: 689657 - DNA, 20 bp, mouse
gttcaaacatgggtggaagt

SEQ ID NO: 689658 - DNA, 20 bp, mouse
gtggtgacttcaaacatggg

SEQ ID NO: 689659 - DNA, 20 bp, mouse
gtatcagtttgggatagatg

SEQ ID NO: 689660 - DNA, 20 bp, mouse
gaactggtgacttcaaacat

SEQ ID NO: 689661 - DNA, 20 bp, mouse
gtaaccctgtcccttggata

SEQ ID NO: 689662 - DNA, 20 bp, mouse
gaaacctgagccatctgcag

SEQ ID NO: 689663 - DNA, 20 bp, mouse
ggggataggtccctttcaaa

SEQ ID NO: 689664 - DNA, 20 bp, mouse
gggcccctatccaagggaca

SEQ ID NO: 689665 - DNA, 20 bp, mouse
gaaaggctaagatatgtaaa

SEQ ID NO: 689666 - DNA, 20 bp, mouse
gtgggagaatggggcctctt

SEQ ID NO: 689667 - DNA, 20 bp, mouse
gcagtggcctaggccaaagt

SEQ ID NO: 689668 - DNA, 20 bp, mouse
gtacctgttgtgggagaatg

SEQ ID NO: 689669 - DNA, 20 bp, mouse
ggaaaacacttacctgttgt

SEQ ID NO: 689670 - DNA, 20 bp, mouse
gacataggccatgagaccta

SEQ ID NO: 689671 - DNA, 20 bp, mouse
gagggagaggttgggatact

SEQ ID NO: 689672 - DNA, 20 bp, mouse
gaggttgggatacttgggtt

SEQ ID NO: 689673 - DNA, 20 bp, mouse
gctacaggaggccagcaacc

SEQ ID NO: 689674 - DNA, 20 bp, mouse
gtctcatggcctatgtaata

SEQ ID NO: 689675 - DNA, 20 bp, mouse
gggccccattctcccacaac

SEQ ID NO: 689676 - DNA, 20 bp, mouse
gaagaaggaagatacgtgat

SEQ ID NO: 689677 - DNA, 20 bp, mouse
gtcaacaaggcctccctgaa

SEQ ID NO: 689678 - DNA, 20 bp, mouse
gacagagagtggtctcaccc

SEQ ID NO: 689679 - DNA, 20 bp, mouse
ggaagaacaggggttccccc

SEQ ID NO: 689680 - DNA, 20 bp, mouse
gtaaggtgagagctacaaga

SEQ ID NO: 689681 - DNA, 20 bp, mouse
gaggccttgttgaatctgtc

SEQ ID NO: 689682 - DNA, 20 bp, mouse
gcgagaagcctggaagaaca

SEQ ID NO: 689683 - DNA, 20 bp, mouse
gactgttccggaaggaggaa

SEQ ID NO: 689684 - DNA, 20 bp, mouse
ggactcactgtcactgtccc

SEQ ID NO: 689685 - DNA, 20 bp, mouse
gggtctcaccctggctgtac

SEQ ID NO: 689686 - DNA, 20 bp, mouse
gcaggtggcatagatgatgg

SEQ ID NO: 689687 - DNA, 20 bp, mouse
gtggcagaagcatttcccaa

SEQ ID NO: 689688 - DNA, 20 bp, mouse
gtcctatgaagaggagcaac

SEQ ID NO: 689689 - DNA, 20 bp, mouse
ggctctgttacttcatcttg

SEQ ID NO: 689690 - DNA, 20 bp, mouse
gagggagaggaagtggaaac

SEQ ID NO: 689691 - DNA, 20 bp, mouse
gcaggaaaagtcctatgaag

SEQ ID NO: 689692 - DNA, 20 bp, mouse
gtgggtccatctggagttct

SEQ ID NO: 689693 - DNA, 20 bp, mouse
gaatcaggtggcatagatga

SEQ ID NO: 689694 - DNA, 20 bp, mouse
gtggggaatactagacccct

SEQ ID NO: 689695 - DNA, 20 bp, mouse
gtccacttcctctccctaaa

SEQ ID NO: 689696 - DNA, 20 bp, mouse
gtacccctcagggcccacgc

SEQ ID NO: 689697 - DNA, 20 bp, mouse
gggtaaactgaccccaagat

SEQ ID NO: 689698 - DNA, 20 bp, mouse
gcacgctggctgactgccgt

SEQ ID NO: 689699 - DNA, 20 bp, mouse
gctgcagcctcagggctaag

SEQ ID NO: 689700 - DNA, 20 bp, mouse
gcccttagctaggctcaagg

SEQ ID NO: 689701 - DNA, 20 bp, mouse
ggctgactgccgtgggcaga

SEQ ID NO: 689702 - DNA, 20 bp, mouse
gaggctgcagacctatcttg

SEQ ID NO: 689703 - DNA, 20 bp, mouse
gtctaggagtactcactcac

SEQ ID NO: 689704 - DNA, 20 bp, mouse
gtaggctcaaggaggcagta

SEQ ID NO: 689705 - DNA, 20 bp, mouse
gtaagtggaagcccttagct

SEQ ID NO: 689706 - DNA, 20 bp, mouse
gacttcaagagacagagact

SEQ ID NO: 689707 - DNA, 20 bp, mouse
gtaggactgggttatgcaag

SEQ ID NO: 689708 - DNA, 20 bp, mouse
gaacgttagatcacgtcctt

SEQ ID NO: 689709 - DNA, 20 bp, mouse
gttagatcacgtccttgggc

SEQ ID NO: 689710 - DNA, 20 bp, mouse
ggctactgaaaatctttctg

SEQ ID NO: 689711 - DNA, 20 bp, mouse
gtaacgtttgtttactccag

SEQ ID NO: 689712 - DNA, 20 bp, mouse
gtaccagagcacgtggtaag

SEQ ID NO: 689713 - DNA, 20 bp, mouse
gcacatctgcaggcctcatc

SEQ ID NO: 689714 - DNA, 20 bp, mouse
gacagctggatggccaactc

SEQ ID NO: 689715 - DNA, 20 bp, mouse
gcagctgtatacagttatgt

SEQ ID NO: 689716 - DNA, 20 bp, mouse
gcgagtagaggggagaatga

SEQ ID NO: 689717 - DNA, 20 bp, mouse
ggggagctggtggaacccga

SEQ ID NO: 689718 - DNA, 20 bp, mouse
gactcgtcgcgcggagtacg

SEQ ID NO: 689719 - DNA, 20 bp, mouse
gacctgggggagttcggaac

SEQ ID NO: 689720 - DNA, 20 bp, mouse
gccgctctgcgaccccacat

SEQ ID NO: 689721 - DNA, 20 bp, mouse
ggaagaggagggatctccgg

SEQ ID NO: 689722 - DNA, 20 bp, mouse
gggggaagaggagggatctc

SEQ ID NO: 689723 - DNA, 20 bp, mouse
gccgcgcgacgagtcaggga

SEQ ID NO: 689724 - DNA, 20 bp, mouse
gcagctgagaacaacgatat

SEQ ID NO: 689725 - DNA, 20 bp, mouse
gcacgcgcgcgcgcgggaaa

SEQ ID NO: 689726 - DNA, 20 bp, mouse
gaatgccctaagggctcggg

SEQ ID NO: 689727 - DNA, 20 bp, mouse
ggcccagacgaatgccctaa

SEQ ID NO: 689728 - DNA, 20 bp, mouse
gaccgcgcgacaatcgaaga

SEQ ID NO: 689729 - DNA, 20 bp, mouse
gctggcagcgtgaggaatgc

SEQ ID NO: 689730 - DNA, 20 bp, mouse
ggcaaccagttcgtctcgtg

SEQ ID NO: 689731 - DNA, 20 bp, mouse
gagcccttagggcattcgtc

SEQ ID NO: 689732 - DNA, 20 bp, mouse
gcgaaagtactggcagcgtg

SEQ ID NO: 689733 - DNA, 20 bp, mouse
gcataccacacgagacgaac

SEQ ID NO: 689734 - DNA, 20 bp, mouse
gaaaagtcgctctcaagaag

SEQ ID NO: 689735 - DNA, 20 bp, mouse
gcgtctcgtgtggtatggat

SEQ ID NO: 689736 - DNA, 20 bp, mouse
gcgcgcgggtggaagtgcga

SEQ ID NO: 689737 - DNA, 20 bp, mouse
gggctggagggcggagagca

SEQ ID NO: 689738 - DNA, 20 bp, mouse
ggccgtgccgccagaggggt

SEQ ID NO: 689739 - DNA, 20 bp, mouse
gagcagggacgcgtggatct

SEQ ID NO: 689740 - DNA, 20 bp, mouse
gtctgtgtgcggaatgggga

SEQ ID NO: 689741 - DNA, 20 bp, mouse
ggctcctggtggcctgttga

SEQ ID NO: 689742 - DNA, 20 bp, mouse
gtgccccaataccagcgccg

SEQ ID NO: 689743 - DNA, 20 bp, mouse
ggcagcgcccaatcagaggc

SEQ ID NO: 689744 - DNA, 20 bp, mouse
gtgtgtgtctgtgtgcggaa

SEQ ID NO: 689745 - DNA, 20 bp, mouse
gtgcgagcccgcctctgatt

SEQ ID NO: 689746 - DNA, 20 bp, mouse
gtaagccagggcagttatgg

SEQ ID NO: 689747 - DNA, 20 bp, mouse
gccaggatttaggtgcaaat

SEQ ID NO: 689748 - DNA, 20 bp, mouse
ggctgaggccgagtctccat

SEQ ID NO: 689749 - DNA, 20 bp, mouse
gcctccccccataactgccc

SEQ ID NO: 689750 - DNA, 20 bp, mouse
gccctccgcccatggagact

SEQ ID NO: 689751 - DNA, 20 bp, mouse
ggccgagtctccatgggcgg

SEQ ID NO: 689752 - DNA, 20 bp, mouse
ggtgatgacctcgtacaacc

SEQ ID NO: 689753 - DNA, 20 bp, mouse
gtgaatgccccctccgccca

SEQ ID NO: 689754 - DNA, 20 bp, mouse
ggaatcgtaaacaatttgta

SEQ ID NO: 689755 - DNA, 20 bp, mouse
gaaaactccactgtaagcca

SEQ ID NO: 689756 - DNA, 20 bp, mouse
gtagaccgcgtcggtacagg

SEQ ID NO: 689757 - DNA, 20 bp, mouse
gccagcctcctgtaccgacg

SEQ ID NO: 689758 - DNA, 20 bp, mouse
gggactagaaagcgtctcca

SEQ ID NO: 689759 - DNA, 20 bp, mouse
gcaacactggctggaggtta

SEQ ID NO: 689760 - DNA, 20 bp, mouse
gccgtggcaggcacatgctg

SEQ ID NO: 689761 - DNA, 20 bp, mouse
gcacatgctgagggtaagaa

SEQ ID NO: 689762 - DNA, 20 bp, mouse
gaaatgaaaactatagacta

SEQ ID NO: 689763 - DNA, 20 bp, mouse
gagatctgacagacaggtgg

SEQ ID NO: 689764 - DNA, 20 bp, mouse
ggtcaggatttagaccgcgt

SEQ ID NO: 689765 - DNA, 20 bp, mouse
gccggattcaacagcagtga

SEQ ID NO: 689766 - DNA, 20 bp, mouse
gctgaggactaacaggagta

SEQ ID NO: 689767 - DNA, 20 bp, mouse
gttaaaaacagcaaggggcg

SEQ ID NO: 689768 - DNA, 20 bp, mouse
gtgaagaaccgggttcatga

SEQ ID NO: 689769 - DNA, 20 bp, mouse
ggaggtgccacggccccgat

SEQ ID NO: 689770 - DNA, 20 bp, mouse
gcagactgccaagtttctca

SEQ ID NO: 689771 - DNA, 20 bp, mouse
gtgactcgttgtgaagaacc

SEQ ID NO: 689772 - DNA, 20 bp, mouse
gtctcctcccatcggggccg

SEQ ID NO: 689773 - DNA, 20 bp, mouse
gccacgttaaaaacagcaag

SEQ ID NO: 689774 - DNA, 20 bp, mouse
gtgtgctctctctttgactt

SEQ ID NO: 689775 - DNA, 20 bp, mouse
ggcgcactttctcctcccat

SEQ ID NO: 689776 - DNA, 20 bp, mouse
gccagaggatgtgtacgtgt

SEQ ID NO: 689777 - DNA, 20 bp, mouse
gggatgccccaggtctggaa

SEQ ID NO: 689778 - DNA, 20 bp, mouse
ggatcgggatgccccaggtc

SEQ ID NO: 689779 - DNA, 20 bp, mouse
ggggcatcccgatcgttgtt

SEQ ID NO: 689780 - DNA, 20 bp, mouse
gcggactccaaacaacgatc

SEQ ID NO: 689781 - DNA, 20 bp, mouse
gtgggtgattaattaggtcc

SEQ ID NO: 689782 - DNA, 20 bp, mouse
gaaagatcagtcaatcccag

SEQ ID NO: 689783 - DNA, 20 bp, mouse
gcaaactcagacagaaaagg

SEQ ID NO: 689784 - DNA, 20 bp, mouse
gaggcagccacccccaccaa

SEQ ID NO: 689785 - DNA, 20 bp, mouse
gggtaactctggaaactcgg

SEQ ID NO: 689786 - DNA, 20 bp, mouse
gggcgctcgctgccctgagg

SEQ ID NO: 689787 - DNA, 20 bp, mouse
gggcaccggaagcgctcctc

SEQ ID NO: 689788 - DNA, 20 bp, mouse
gcggcccccgtcgctccgac

SEQ ID NO: 689789 - DNA, 20 bp, mouse
gctcaggcggcgggacctac

SEQ ID NO: 689790 - DNA, 20 bp, mouse
ggtacctgtcggagcgacgg

SEQ ID NO: 689791 - DNA, 20 bp, mouse
gggaagcgctcctcaggcgg

SEQ ID NO: 689792 - DNA, 20 bp, mouse
gcgcggcgctcgctgccctg

SEQ ID NO: 689793 - DNA, 20 bp, mouse
ggccgagctcggccggctcc

SEQ ID NO: 689794 - DNA, 20 bp, mouse
gagcggacacgcgtggaaag

SEQ ID NO: 689795 - DNA, 20 bp, mouse
gcgggtcgagcgccttccgc

SEQ ID NO: 689796 - DNA, 20 bp, mouse
gagagcacgtcctggttgga

SEQ ID NO: 689797 - DNA, 20 bp, mouse
ggcccgcaggggccaagctc

SEQ ID NO: 689798 - DNA, 20 bp, mouse
ggtcttcgcaagagtttctc

SEQ ID NO: 689799 - DNA, 20 bp, mouse
ggatcagagcacgtcctggt

SEQ ID NO: 689800 - DNA, 20 bp, mouse
ggggcgatcagagcacgtcc

SEQ ID NO: 689801 - DNA, 20 bp, mouse
gaacagaaggatcagggcgt

SEQ ID NO: 689802 - DNA, 20 bp, mouse
gaggcttgggtgcgtggtgc

SEQ ID NO: 689803 - DNA, 20 bp, mouse
gtgcggccgcgcgctctcgt

SEQ ID NO: 689804 - DNA, 20 bp, mouse
ggaaactcttgcgaagacgg

SEQ ID NO: 689805 - DNA, 20 bp, mouse
gactcggaggtgttctgagc

SEQ ID NO: 689806 - DNA, 20 bp, mouse
gtgcgaaggcccggatcctg

SEQ ID NO: 689807 - DNA, 20 bp, mouse
gaggggaaccctgggacctc

SEQ ID NO: 689808 - DNA, 20 bp, mouse
gtagtcgtctgtggtgtctc

SEQ ID NO: 689809 - DNA, 20 bp, mouse
gccagccagggccggatccg

SEQ ID NO: 689810 - DNA, 20 bp, mouse
gacctggggcgctcggggag

SEQ ID NO: 689811 - DNA, 20 bp, mouse
gtcggggagccccaggatcc

SEQ ID NO: 689812 - DNA, 20 bp, mouse
gtgctgctcgcggggtgcga

SEQ ID NO: 689813 - DNA, 20 bp, mouse
gggacagcgcccaggcccac

SEQ ID NO: 689814 - DNA, 20 bp, mouse
ggaatcctcggatccggccc

SEQ ID NO: 689815 - DNA, 20 bp, mouse
gggcgctgcctcacttagag

SEQ ID NO: 689816 - DNA, 20 bp, mouse
gactctgcggggttcctgga

SEQ ID NO: 689817 - DNA, 20 bp, mouse
gaggaaccccgcagagtctc

SEQ ID NO: 689818 - DNA, 20 bp, mouse
gggaccgcgcatgctcagag

SEQ ID NO: 689819 - DNA, 20 bp, mouse
gagccctggcgtctctgctc

SEQ ID NO: 689820 - DNA, 20 bp, mouse
ggattcccgggctgccttcc

SEQ ID NO: 689821 - DNA, 20 bp, mouse
gcctaggtagcgggattccc

SEQ ID NO: 689822 - DNA, 20 bp, mouse
gtgggtggggatcctgccac

SEQ ID NO: 689823 - DNA, 20 bp, mouse
gtccctgagcagagacgcca

SEQ ID NO: 689824 - DNA, 20 bp, mouse
gcagagtctccggtactccc

SEQ ID NO: 689825 - DNA, 20 bp, mouse
ggagtaccggagactctgcg

SEQ ID NO: 689826 - DNA, 20 bp, mouse
ggagtgcaaacgcccagaat

SEQ ID NO: 689827 - DNA, 20 bp, mouse
gtgcaaacgcccagaatggg

SEQ ID NO: 689828 - DNA, 20 bp, mouse
gttagaactagcctggtctg

SEQ ID NO: 689829 - DNA, 20 bp, mouse
gtgtctctgcgtgtccttgg

SEQ ID NO: 689830 - DNA, 20 bp, mouse
gccggggtccccgcccattc

SEQ ID NO: 689831 - DNA, 20 bp, mouse
gagcagaagcctctgtatgg

SEQ ID NO: 689832 - DNA, 20 bp, mouse
gcgacccctaccgcccacca

SEQ ID NO: 689833 - DNA, 20 bp, mouse
gcgctgcgctgcacggctcc

SEQ ID NO: 689834 - DNA, 20 bp, mouse
gtaggggtcgctgcgctgca

SEQ ID NO: 689835 - DNA, 20 bp, mouse
gggctggcttggtaccacca

SEQ ID NO: 689836 - DNA, 20 bp, mouse
gagggatggggcaacacgag

SEQ ID NO: 689837 - DNA, 20 bp, mouse
gcctaggcaacgcgagggat

SEQ ID NO: 689838 - DNA, 20 bp, mouse
ggcaacagcagaggcccacg

SEQ ID NO: 689839 - DNA, 20 bp, mouse
ggttcccaaaagctagtagg

SEQ ID NO: 689840 - DNA, 20 bp, mouse
gtaacctcctactagctttt

SEQ ID NO: 689841 - DNA, 20 bp, mouse
gtgagaaggaagtgtgctca

SEQ ID NO: 689842 - DNA, 20 bp, mouse
gatcttgactgttgtggtca

SEQ ID NO: 689843 - DNA, 20 bp, mouse
gctgctgttgctgagtgacc

SEQ ID NO: 689844 - DNA, 20 bp, mouse
gccgtgcaacaatgagagac

SEQ ID NO: 689845 - DNA, 20 bp, mouse
ggtgacctggctccctgaga

SEQ ID NO: 689846 - DNA, 20 bp, mouse
ggccaagcatgggattcccc

SEQ ID NO: 689847 - DNA, 20 bp, mouse
gagaggcaggtccaagagaa

SEQ ID NO: 689848 - DNA, 20 bp, mouse
ggacctacttagctggaaaa

SEQ ID NO: 689849 - DNA, 20 bp, mouse
gggccgtggaggccaagcat

SEQ ID NO: 689850 - DNA, 20 bp, mouse
gagggggcggacccggactc

SEQ ID NO: 689851 - DNA, 20 bp, mouse
gggagaagcagcaaactccc

SEQ ID NO: 689852 - DNA, 20 bp, mouse
gcgcccttttccagctaagt

SEQ ID NO: 689853 - DNA, 20 bp, mouse
gcagctaagtaggtcgactc

SEQ ID NO: 689854 - DNA, 20 bp, mouse
gccagcagcaaccaatcccg

SEQ ID NO: 689855 - DNA, 20 bp, mouse
gaagtaggtcgactcgggtt

SEQ ID NO: 689856 - DNA, 20 bp, mouse
gaatcaggtaagagtgtcgt

SEQ ID NO: 689857 - DNA, 20 bp, mouse
gaggcagctccgtaccctca

SEQ ID NO: 689858 - DNA, 20 bp, mouse
gagcgagccccttgagggta

SEQ ID NO: 689859 - DNA, 20 bp, mouse
gtacttgcctagtgagtgag

SEQ ID NO: 689860 - DNA, 20 bp, mouse
gggaaaggtggtgagcaaaa

SEQ ID NO: 689861 - DNA, 20 bp, mouse
gcatgctcggcaagcaacac

SEQ ID NO: 689862 - DNA, 20 bp, mouse
gtaagagtgtcgtgggggac

SEQ ID NO: 689863 - DNA, 20 bp, mouse
ggtagaagtggtgtcaagtc

SEQ ID NO: 689864 - DNA, 20 bp, mouse
gaaaaagatagatttggaaa

SEQ ID NO: 689865 - DNA, 20 bp, mouse
ggaagaagaaggcctaagga

SEQ ID NO: 689866 - DNA, 20 bp, mouse
gagacggagggtgggaccag

SEQ ID NO: 689867 - DNA, 20 bp, mouse
gggggcggctgtgacgacgg

SEQ ID NO: 689868 - DNA, 20 bp, mouse
gcgagtgggcggtgaagggg

SEQ ID NO: 689869 - DNA, 20 bp, mouse
ggggcacggcgagaggcaga

SEQ ID NO: 689870 - DNA, 20 bp, mouse
ggacccgccacccatcgagt

SEQ ID NO: 689871 - DNA, 20 bp, mouse
gggcggggtggccaatcccg

SEQ ID NO: 689872 - DNA, 20 bp, mouse
ggtgacgacggaggctccga

SEQ ID NO: 689873 - DNA, 20 bp, mouse
gcggagggtgggaccagggg

SEQ ID NO: 689874 - DNA, 20 bp, mouse
ggggtggccaatcccggggc

SEQ ID NO: 689875 - DNA, 20 bp, mouse
gtctctgggctgtaaactga

SEQ ID NO: 689876 - DNA, 20 bp, mouse
gcaagggacgggaactagag

SEQ ID NO: 689877 - DNA, 20 bp, mouse
ggacgcccgccgggcaaggc

SEQ ID NO: 689878 - DNA, 20 bp, mouse
gaggtggcactgccaggagt

SEQ ID NO: 689879 - DNA, 20 bp, mouse
gggagatcgcgtggcacagg

SEQ ID NO: 689880 - DNA, 20 bp, mouse
ggcgcacaggacacccttcg

SEQ ID NO: 689881 - DNA, 20 bp, mouse
gcccggcgggcgtccattgg

SEQ ID NO: 689882 - DNA, 20 bp, mouse
gcacttgagggtcaagactc

SEQ ID NO: 689883 - DNA, 20 bp, mouse
ggaaaatgccgcgcctcgat

SEQ ID NO: 689884 - DNA, 20 bp, mouse
gggagcttagtggcttaaag

SEQ ID NO: 689885 - DNA, 20 bp, mouse
gcccgtgcgtgaaagcgtcc

SEQ ID NO: 689886 - DNA, 20 bp, mouse
gggtaccgaagtaaggcgac

SEQ ID NO: 689887 - DNA, 20 bp, mouse
ggatccctgtcgccttactt

SEQ ID NO: 689888 - DNA, 20 bp, mouse
gctgtgggaacagtcctcgg

SEQ ID NO: 689889 - DNA, 20 bp, mouse
ggaagcagagcaggcttctt

SEQ ID NO: 689890 - DNA, 20 bp, mouse
gccagtggcgacctcgctcc

SEQ ID NO: 689891 - DNA, 20 bp, mouse
ggggcggagatatgcaaata

SEQ ID NO: 689892 - DNA, 20 bp, mouse
gggcgacctcgctccaggat

SEQ ID NO: 689893 - DNA, 20 bp, mouse
gcagtcctcggcgggttgag

SEQ ID NO: 689894 - DNA, 20 bp, mouse
gtcctcggcgggttgagggg

SEQ ID NO: 689895 - DNA, 20 bp, mouse
ggactgttcccacagtccat

SEQ ID NO: 689896 - DNA, 20 bp, mouse
gcacgtgtgcgaaacgtcac

SEQ ID NO: 689897 - DNA, 20 bp, mouse
gccgccctccgtcgccgggg

SEQ ID NO: 689898 - DNA, 20 bp, mouse
gtggcggcgggacgggaacc

SEQ ID NO: 689899 - DNA, 20 bp, mouse
gcggcgggtcccggagagaa

SEQ ID NO: 689900 - DNA, 20 bp, mouse
ggaggacgcgcctgtgactg

SEQ ID NO: 689901 - DNA, 20 bp, mouse
gaagggacagatcctggcgg

SEQ ID NO: 689902 - DNA, 20 bp, mouse
ggcgctggggccttgctctc

SEQ ID NO: 689903 - DNA, 20 bp, mouse
gccgcccccccggcgacgga

SEQ ID NO: 689904 - DNA, 20 bp, mouse
gaaggggagaggcgggtcaa

SEQ ID NO: 689905 - DNA, 20 bp, mouse
gctccccgcccccccggcga

SEQ ID NO: 689906 - DNA, 20 bp, mouse
ggatccggacgcaaaactcc

SEQ ID NO: 689907 - DNA, 20 bp, mouse
ggaaaccaaaacaactcctt

SEQ ID NO: 689908 - DNA, 20 bp, mouse
gcaaaactccgggggaccgt

SEQ ID NO: 689909 - DNA, 20 bp, mouse
gggaaggcgcgagacggaag

SEQ ID NO: 689910 - DNA, 20 bp, mouse
gctgccctaaggagttgttt

SEQ ID NO: 689911 - DNA, 20 bp, mouse
gcgggccaccggagctatca

SEQ ID NO: 689912 - DNA, 20 bp, mouse
gaccctgggaaggcgcgaga

SEQ ID NO: 689913 - DNA, 20 bp, mouse
gtccgtctcgcgccttccca

SEQ ID NO: 689914 - DNA, 20 bp, mouse
ggtggcccggcgactaggaa

SEQ ID NO: 689915 - DNA, 20 bp, mouse
gcaactcccgtctgctgatc

SEQ ID NO: 689916 - DNA, 20 bp, mouse
gatcaggtgcaagtattgta

SEQ ID NO: 689917 - DNA, 20 bp, mouse
gcaaaagcacgctccgcctg

SEQ ID NO: 689918 - DNA, 20 bp, mouse
gtggacgcggggcgcgccgt

SEQ ID NO: 689919 - DNA, 20 bp, mouse
gggggcagtcgggttccctc

SEQ ID NO: 689920 - DNA, 20 bp, mouse
gcctagtaacgcactctccg

SEQ ID NO: 689921 - DNA, 20 bp, mouse
gggcggagcgtgcttttggt

SEQ ID NO: 689922 - DNA, 20 bp, mouse
gaaactcgggcccaccctcg

SEQ ID NO: 689923 - DNA, 20 bp, mouse
ggggcccgagtttaaatggc

SEQ ID NO: 689924 - DNA, 20 bp, mouse
ggagaacgccgcgtcccgga

SEQ ID NO: 689925 - DNA, 20 bp, mouse
gccccgcgtccaccagtccc

SEQ ID NO: 689926 - DNA, 20 bp, mouse
gaacctgcagtccgctggtt

SEQ ID NO: 689927 - DNA, 20 bp, mouse
gaacacccgggcgtcggcag

SEQ ID NO: 689928 - DNA, 20 bp, mouse
gaggtggagcagggattccg

SEQ ID NO: 689929 - DNA, 20 bp, mouse
gtctccaaggatccatcctc

SEQ ID NO: 689930 - DNA, 20 bp, mouse
gagcgcctgctccgatcccc

SEQ ID NO: 689931 - DNA, 20 bp, mouse
ggctctctagtcccaaccag

SEQ ID NO: 689932 - DNA, 20 bp, mouse
ggtgtgtggtgggatgggtt

SEQ ID NO: 689933 - DNA, 20 bp, mouse
gtgccccggggcgatgatgg

SEQ ID NO: 689934 - DNA, 20 bp, mouse
gtccttggagaggatggcgg

SEQ ID NO: 689935 - DNA, 20 bp, mouse
gggcgaggaccggtgtgcgc

SEQ ID NO: 689936 - DNA, 20 bp, mouse
ggggcgaggcgacaacaatc

SEQ ID NO: 689937 - DNA, 20 bp, mouse
gccgagcgccaagacagcga

SEQ ID NO: 689938 - DNA, 20 bp, mouse
gcccccttccgggtacctgg

SEQ ID NO: 689939 - DNA, 20 bp, mouse
gcggacgcgggaagccgggg

SEQ ID NO: 689940 - DNA, 20 bp, mouse
gcgccaagacagcgaggggc

SEQ ID NO: 689941 - DNA, 20 bp, mouse
ggcggggcggtgccgaccaa

SEQ ID NO: 689942 - DNA, 20 bp, mouse
ggtgccgccgcgccattggt

SEQ ID NO: 689943 - DNA, 20 bp, mouse
gcgggccggcgcgctctccg

SEQ ID NO: 689944 - DNA, 20 bp, mouse
ggcggtgccgaccaatggcg

SEQ ID NO: 689945 - DNA, 20 bp, mouse
ggacaccgcgggtggagcgg

SEQ ID NO: 689946 - DNA, 20 bp, mouse
ggggacctctagccaatcgc

SEQ ID NO: 689947 - DNA, 20 bp, mouse
gaaggcctgcgattggctag

SEQ ID NO: 689948 - DNA, 20 bp, mouse
gtggctagaggtccccaagg

SEQ ID NO: 689949 - DNA, 20 bp, mouse
ggcaccgcccccgagtgcgc

SEQ ID NO: 689950 - DNA, 20 bp, mouse
gcgccccgccggggcccgtg

SEQ ID NO: 689951 - DNA, 20 bp, mouse
gagagggaacggtgtcgcta

SEQ ID NO: 689952 - DNA, 20 bp, mouse
gggaaggtccggccccgcct

SEQ ID NO: 689953 - DNA, 20 bp, mouse
gcccggtgaaggcctgcgat

SEQ ID NO: 689954 - DNA, 20 bp, mouse
gcttcaccgggcttactgat

SEQ ID NO: 689955 - DNA, 20 bp, mouse
gctccagccccgcgcactcg

SEQ ID NO: 689956 - DNA, 20 bp, mouse
gaagcccggaccaggccacg

SEQ ID NO: 689957 - DNA, 20 bp, mouse
gcagagctgaagcccggacc

SEQ ID NO: 689958 - DNA, 20 bp, mouse
gacggggcgctgaacccgtg

SEQ ID NO: 689959 - DNA, 20 bp, mouse
gtgcgctggtgtccgagcag

SEQ ID NO: 689960 - DNA, 20 bp, mouse
gctggtgtccgagcaggggc

SEQ ID NO: 689961 - DNA, 20 bp, mouse
gcgggaccaagcaagtgcgc

SEQ ID NO: 689962 - DNA, 20 bp, mouse
ggcgccccgtggcctggtcc

SEQ ID NO: 689963 - DNA, 20 bp, mouse
gcgtcctgcaccctacacta

SEQ ID NO: 689964 - DNA, 20 bp, mouse
gcccgccctgccgctttctg

SEQ ID NO: 689965 - DNA, 20 bp, mouse
gtctggaaggtggcccgcac

SEQ ID NO: 689966 - DNA, 20 bp, mouse
gtgaccgggatattctgtgg

SEQ ID NO: 689967 - DNA, 20 bp, mouse
gcatgagaaccacttgtgtc

SEQ ID NO: 689968 - DNA, 20 bp, mouse
gggcaccaacgcaaatgatc

SEQ ID NO: 689969 - DNA, 20 bp, mouse
gatctgaccgggatattctg

SEQ ID NO: 689970 - DNA, 20 bp, mouse
gaatcctccacagaatatcc

SEQ ID NO: 689971 - DNA, 20 bp, mouse
ggccacgtttacaatctgac

SEQ ID NO: 689972 - DNA, 20 bp, mouse
gaaacaaatcaagaccattt

SEQ ID NO: 689973 - DNA, 20 bp, mouse
gcgttggtgcctgacacaag

SEQ ID NO: 689974 - DNA, 20 bp, mouse
gttgaagttcagtactaaat

SEQ ID NO: 689975 - DNA, 20 bp, mouse
gcagacctgatcatttgcgt

SEQ ID NO: 689976 - DNA, 20 bp, mouse
gttgtattgtgagacatcat

SEQ ID NO: 689977 - DNA, 20 bp, mouse
gaaaccagctctgatctcta

SEQ ID NO: 689978 - DNA, 20 bp, mouse
gtgtttgcttggtatttttt

SEQ ID NO: 689979 - DNA, 20 bp, mouse
gaggaactccacttctcccc

SEQ ID NO: 689980 - DNA, 20 bp, mouse
gcatacacacatgaacttac

SEQ ID NO: 689981 - DNA, 20 bp, mouse
gtttgtatgtgtattgttac

SEQ ID NO: 689982 - DNA, 20 bp, mouse
gggttgtagttatatatatt

SEQ ID NO: 689983 - DNA, 20 bp, mouse
ggtctcacaatacaatgctc

SEQ ID NO: 689984 - DNA, 20 bp, mouse
gcattgacacatcaatccag

SEQ ID NO: 689985 - DNA, 20 bp, mouse
gcatcaatccaggggagaag

SEQ ID NO: 689986 - DNA, 20 bp, mouse
gaaagaatgactctagtcaa

SEQ ID NO: 689987 - DNA, 20 bp, mouse
gtcccacagacagctccttc

SEQ ID NO: 689988 - DNA, 20 bp, mouse
gctagtcaaaggataccgga

SEQ ID NO: 689989 - DNA, 20 bp, mouse
gaaacggtgtctttcttggt

SEQ ID NO: 689990 - DNA, 20 bp, mouse
gcatggcagctgggagagta

SEQ ID NO: 689991 - DNA, 20 bp, mouse
gtcaccttgttgctagaagc

SEQ ID NO: 689992 - DNA, 20 bp, mouse
gtagcccgcttctagcaaca

SEQ ID NO: 689993 - DNA, 20 bp, mouse
gtcatggggtagactaactg

SEQ ID NO: 689994 - DNA, 20 bp, mouse
gactccaaacctagtacata

SEQ ID NO: 689995 - DNA, 20 bp, mouse
ggtactaggtttggagtcat

SEQ ID NO: 689996 - DNA, 20 bp, mouse
gcgtgcctggtgagatgata

SEQ ID NO: 689997 - DNA, 20 bp, mouse
gtacgccatatcatctcacc

SEQ ID NO: 689998 - DNA, 20 bp, mouse
gtgatatggcgtactgtgag

SEQ ID NO: 689999 - DNA, 20 bp, mouse
gatggcgtactgtgagtggt

SEQ ID NO: 690000 - DNA, 20 bp, mouse
gtctgtatgcaagctactgc

SEQ ID NO: 690001 - DNA, 20 bp, mouse
gtgcaggtgtagcacgatgc

SEQ ID NO: 690002 - DNA, 20 bp, mouse
gcagtcacaagatggcacct

SEQ ID NO: 690003 - DNA, 20 bp, mouse
gtggtggggtcagaatgaat

SEQ ID NO: 690004 - DNA, 20 bp, mouse
gagaagggaggcagttaggg

SEQ ID NO: 690005 - DNA, 20 bp, mouse
gtactgctggtgagttatca

SEQ ID NO: 690006 - DNA, 20 bp, mouse
gaacagctgaggtttgctac

SEQ ID NO: 690007 - DNA, 20 bp, mouse
gtcacaaggctgcacaaact

SEQ ID NO: 690008 - DNA, 20 bp, mouse
gaagttcagctgctatcaca

SEQ ID NO: 690009 - DNA, 20 bp, mouse
ggagaccaacaacatcattg

SEQ ID NO: 690010 - DNA, 20 bp, mouse
gcacttgcatgaagaatctg

SEQ ID NO: 690011 - DNA, 20 bp, mouse
gttcacctcaatgatgttgt

SEQ ID NO: 690012 - DNA, 20 bp, mouse
ggtagttgaagtcacccagg

SEQ ID NO: 690013 - DNA, 20 bp, mouse
gcacggctctctcagcattc

SEQ ID NO: 690014 - DNA, 20 bp, mouse
gattcttcatgcaagtgccc

SEQ ID NO: 690015 - DNA, 20 bp, mouse
gacccttcagagactctacc

SEQ ID NO: 690016 - DNA, 20 bp, mouse
gaacggaatgagatattcct

SEQ ID NO: 690017 - DNA, 20 bp, mouse
ggaaaggaggagttgctcat

SEQ ID NO: 690018 - DNA, 20 bp, mouse
gcagctgtagatgatggtac

SEQ ID NO: 690019 - DNA, 20 bp, mouse
gcatccaggaagtaccagca

SEQ ID NO: 690020 - DNA, 20 bp, mouse
gcaagcctagagcaaatctc

SEQ ID NO: 690021 - DNA, 20 bp, mouse
gaatgagatattcctgggca

SEQ ID NO: 690022 - DNA, 20 bp, mouse
gaacagtgagaaatcacacc

SEQ ID NO: 690023 - DNA, 20 bp, mouse
gtcatcctccacactcaccc

SEQ ID NO: 690024 - DNA, 20 bp, mouse
gaagccctgctggtacttcc

SEQ ID NO: 690025 - DNA, 20 bp, mouse
gtccaagcagctgtagatga

SEQ ID NO: 690026 - DNA, 20 bp, mouse
ggaagtggacgtgcctatgt

SEQ ID NO: 690027 - DNA, 20 bp, mouse
gccgcccaaggttacgtcac

SEQ ID NO: 690028 - DNA, 20 bp, mouse
ggtatcgtgcagttgaggaa

SEQ ID NO: 690029 - DNA, 20 bp, mouse
gatccctggggtcccgccca

SEQ ID NO: 690030 - DNA, 20 bp, mouse
gggcgggaccccagggatca

SEQ ID NO: 690031 - DNA, 20 bp, mouse
gctggagtccccgcccacat

SEQ ID NO: 690032 - DNA, 20 bp, mouse
gactttggccattttggatg

SEQ ID NO: 690033 - DNA, 20 bp, mouse
gcgcgagtatcgtgcagttg

SEQ ID NO: 690034 - DNA, 20 bp, mouse
gaatccggtgacgtaacctt

SEQ ID NO: 690035 - DNA, 20 bp, mouse
ggttacgtcaccggatttcc

SEQ ID NO: 690036 - DNA, 20 bp, mouse
ggggctgaggaaaggagtcg

SEQ ID NO: 690037 - DNA, 20 bp, mouse
ggtccccagagcacagaggg

SEQ ID NO: 690038 - DNA, 20 bp, mouse
gggtctgggcgtgcgacgtt

SEQ ID NO: 690039 - DNA, 20 bp, mouse
gggtgaagaggctcaggccc

SEQ ID NO: 690040 - DNA, 20 bp, mouse
gatccaggaggaaccgtgat

SEQ ID NO: 690041 - DNA, 20 bp, mouse
gcgccccttggtcacgtgac

SEQ ID NO: 690042 - DNA, 20 bp, mouse
ggttcctcctggatcttacc

SEQ ID NO: 690043 - DNA, 20 bp, mouse
gtatgctcacatatgatcac

SEQ ID NO: 690044 - DNA, 20 bp, mouse
gacccgcagcaactagacgg

SEQ ID NO: 690045 - DNA, 20 bp, mouse
ggccggctagacccctatca

SEQ ID NO: 690046 - DNA, 20 bp, mouse
gaggcaaaaaggcggggcta

SEQ ID NO: 690047 - DNA, 20 bp, mouse
gcggtctagcgcgtcagtag

SEQ ID NO: 690048 - DNA, 20 bp, mouse
gtaacaacgggccgcaccga

SEQ ID NO: 690049 - DNA, 20 bp, mouse
gcgtcagtagaggtggagct

SEQ ID NO: 690050 - DNA, 20 bp, mouse
ggcaacgcgccacaggaaga

SEQ ID NO: 690051 - DNA, 20 bp, mouse
gccacttccgccctgatgtc

SEQ ID NO: 690052 - DNA, 20 bp, mouse
gcgagggctgcgtgtccgac

SEQ ID NO: 690053 - DNA, 20 bp, mouse
gtctagcgcgtcagtagagg

SEQ ID NO: 690054 - DNA, 20 bp, mouse
gtggcgcgttgcgacatgga

SEQ ID NO: 690055 - DNA, 20 bp, mouse
ggctgcgtgtccgacaggca

SEQ ID NO: 690056 - DNA, 20 bp, mouse
gtggtccaggaatcactaag

SEQ ID NO: 690057 - DNA, 20 bp, mouse
gtacagtacagtttcgttag

SEQ ID NO: 690058 - DNA, 20 bp, mouse
gctcttcttttaggcgggaa

SEQ ID NO: 690059 - DNA, 20 bp, mouse
gtttttctcttcttttaggc

SEQ ID NO: 690060 - DNA, 20 bp, mouse
ggattcctggaccatgctgc

SEQ ID NO: 690061 - DNA, 20 bp, mouse
ggaaactttgtcagcaaggt

SEQ ID NO: 690062 - DNA, 20 bp, mouse
gtatcttagaattcaaactg

SEQ ID NO: 690063 - DNA, 20 bp, mouse
ggtcagaaactttgtcagca

SEQ ID NO: 690064 - DNA, 20 bp, mouse
gacggcaaagtgcttgtgct

SEQ ID NO: 690065 - DNA, 20 bp, mouse
gtggccctggaccagcagca

SEQ ID NO: 690066 - DNA, 20 bp, mouse
gtggacgcgagtttgaatgt

SEQ ID NO: 690067 - DNA, 20 bp, mouse
gagggtctcgggcatgtcca

SEQ ID NO: 690068 - DNA, 20 bp, mouse
ggacatgcccgagaccctag

SEQ ID NO: 690069 - DNA, 20 bp, mouse
gtccccaacggaaatagcgg

SEQ ID NO: 690070 - DNA, 20 bp, mouse
gaaactgaaggaagcgtcgt

SEQ ID NO: 690071 - DNA, 20 bp, mouse
ggcacttccggcattgggga

SEQ ID NO: 690072 - DNA, 20 bp, mouse
gcctgggagctcagagcgtg

SEQ ID NO: 690073 - DNA, 20 bp, mouse
gcatggagagagagttctcc

SEQ ID NO: 690074 - DNA, 20 bp, mouse
ggcccccgctatttccgttg

SEQ ID NO: 690075 - DNA, 20 bp, mouse
gcccaatgccggaagtgcag

SEQ ID NO: 690076 - DNA, 20 bp, mouse
gggtcgggccctgaggtgga

SEQ ID NO: 690077 - DNA, 20 bp, mouse
gaagactcggggcgctccaa

SEQ ID NO: 690078 - DNA, 20 bp, mouse
gccctgaggtggacggacgc

SEQ ID NO: 690079 - DNA, 20 bp, mouse
gcgtcgcgacgcacacagct

SEQ ID NO: 690080 - DNA, 20 bp, mouse
gggtaacagacccgagatgg

SEQ ID NO: 690081 - DNA, 20 bp, mouse
gtgcgggtcgggccctgagg

SEQ ID NO: 690082 - DNA, 20 bp, mouse
gggcggagaccgcctcgctg

SEQ ID NO: 690083 - DNA, 20 bp, mouse
gtggaggaaaggccctaggg

SEQ ID NO: 690084 - DNA, 20 bp, mouse
gccgccaggcagttctgccc

SEQ ID NO: 690085 - DNA, 20 bp, mouse
gcgcgacgcacacagctcgg

SEQ ID NO: 690086 - DNA, 20 bp, mouse
ggacaaggatgcaagagacg

SEQ ID NO: 690087 - DNA, 20 bp, mouse
gcgggcggaagtggagtctc

SEQ ID NO: 690088 - DNA, 20 bp, mouse
ggggctacataactggttac

SEQ ID NO: 690089 - DNA, 20 bp, mouse
ggaaggactcgcagtacggg

SEQ ID NO: 690090 - DNA, 20 bp, mouse
gaactggttacaggttagac

SEQ ID NO: 690091 - DNA, 20 bp, mouse
gcgcaagccgtccagtgaca

SEQ ID NO: 690092 - DNA, 20 bp, mouse
gtaaagcttaagttaagagg

SEQ ID NO: 690093 - DNA, 20 bp, mouse
gatgcaagagacggggcgtg

SEQ ID NO: 690094 - DNA, 20 bp, mouse
gagacaactgctattttcag

SEQ ID NO: 690095 - DNA, 20 bp, mouse
gctctgcttaccgtgacctg

SEQ ID NO: 690096 - DNA, 20 bp, mouse
gtggtgcagaatgtacagat

SEQ ID NO: 690097 - DNA, 20 bp, mouse
gaggggttatacacagatgc

SEQ ID NO: 690098 - DNA, 20 bp, mouse
gggaagtactgctgagtttt

SEQ ID NO: 690099 - DNA, 20 bp, mouse
gagacaagtttataccataa

SEQ ID NO: 690100 - DNA, 20 bp, mouse
gcaatggaaatgctttgtat

SEQ ID NO: 690101 - DNA, 20 bp, mouse
gccttggaaatcatgataaa

SEQ ID NO: 690102 - DNA, 20 bp, mouse
gagtttttggttcagtttta

SEQ ID NO: 690103 - DNA, 20 bp, mouse
gttcagttttaaggttatgt

SEQ ID NO: 690104 - DNA, 20 bp, mouse
gaaatcatgataaaaggcaa

SEQ ID NO: 690105 - DNA, 20 bp, mouse
gatctgtgtataacccctta

SEQ ID NO: 690106 - DNA, 20 bp, mouse
gtcaatatctcttatgatcc

SEQ ID NO: 690107 - DNA, 20 bp, mouse
gtcaaactgcattgcataaa

SEQ ID NO: 690108 - DNA, 20 bp, mouse
gtgcattgcataaaaggact

SEQ ID NO: 690109 - DNA, 20 bp, mouse
gatgttgtagtgtgcagaga

SEQ ID NO: 690110 - DNA, 20 bp, mouse
gtaggtgctgaaaccaacgt

SEQ ID NO: 690111 - DNA, 20 bp, mouse
gttatgactgttctcggtaa

SEQ ID NO: 690112 - DNA, 20 bp, mouse
gtggatttgattcctcaaaa

SEQ ID NO: 690113 - DNA, 20 bp, mouse
gtgtcctgaaatgcagttgc

SEQ ID NO: 690114 - DNA, 20 bp, mouse
ggcacacttatgactgttct

SEQ ID NO: 690115 - DNA, 20 bp, mouse
gctgcctgcaactgcatttc

SEQ ID NO: 690116 - DNA, 20 bp, mouse
gtctaagcctgggacaagag

SEQ ID NO: 690117 - DNA, 20 bp, mouse
gtccctgtgggtccatggtc

SEQ ID NO: 690118 - DNA, 20 bp, mouse
gtggaaaactgagatagggt

SEQ ID NO: 690119 - DNA, 20 bp, mouse
ggccagaccatggacccaca

SEQ ID NO: 690120 - DNA, 20 bp, mouse
ggaaggctggttgtatgagt

SEQ ID NO: 690121 - DNA, 20 bp, mouse
gaagatggaaaactgagata

SEQ ID NO: 690122 - DNA, 20 bp, mouse
ggcctgagttatagatcctg

SEQ ID NO: 690123 - DNA, 20 bp, mouse
gcaggctctgttggtggaac

SEQ ID NO: 690124 - DNA, 20 bp, mouse
gtccaagagaagccagacca

SEQ ID NO: 690125 - DNA, 20 bp, mouse
ggaaaccttgtccttatatt

SEQ ID NO: 690126 - DNA, 20 bp, mouse
gagaagacatgagatgtcct

SEQ ID NO: 690127 - DNA, 20 bp, mouse
gtgtcctgggatgaagttac

SEQ ID NO: 690128 - DNA, 20 bp, mouse
gttgcctgtaacttcatccc

SEQ ID NO: 690129 - DNA, 20 bp, mouse
ggtcttctaatagcatctgt

SEQ ID NO: 690130 - DNA, 20 bp, mouse
gttgctactgttttcagtaa

SEQ ID NO: 690131 - DNA, 20 bp, mouse
gttggtttcagcacctgagc

SEQ ID NO: 690132 - DNA, 20 bp, mouse
gattgtaagccatccagctc

SEQ ID NO: 690133 - DNA, 20 bp, mouse
gtctcttattgccttttgat

SEQ ID NO: 690134 - DNA, 20 bp, mouse
gcatctttaaaattatatga

SEQ ID NO: 690135 - DNA, 20 bp, mouse
gtttcagcacctgagctgga

SEQ ID NO: 690136 - DNA, 20 bp, mouse
gagccagaagcaccatgact

SEQ ID NO: 690137 - DNA, 20 bp, mouse
gggccaagtcatggtgcttc

SEQ ID NO: 690138 - DNA, 20 bp, mouse
gcccaggctaatagaaaact

SEQ ID NO: 690139 - DNA, 20 bp, mouse
gctgtgctgaaaccaatctt

SEQ ID NO: 690140 - DNA, 20 bp, mouse
gctcccagagcacccaagat

SEQ ID NO: 690141 - DNA, 20 bp, mouse
gtatttctaactgtgtaccc

SEQ ID NO: 690142 - DNA, 20 bp, mouse
gtgacctggaataaagttac

SEQ ID NO: 690143 - DNA, 20 bp, mouse
gaaccaatcttgggtgctct

SEQ ID NO: 690144 - DNA, 20 bp, mouse
gttggtttcagcacagatgc

SEQ ID NO: 690145 - DNA, 20 bp, mouse
gacatagaaatccttttgat

SEQ ID NO: 690146 - DNA, 20 bp, mouse
gagtgtgtagtcaggctaat

SEQ ID NO: 690147 - DNA, 20 bp, mouse
gctgttgactgttttcagta

SEQ ID NO: 690148 - DNA, 20 bp, mouse
ggtcttctaatagcatcttt

SEQ ID NO: 690149 - DNA, 20 bp, mouse
gttgcttttaactccatccc

SEQ ID NO: 690150 - DNA, 20 bp, mouse
gagaagacatgagatgtcct

SEQ ID NO: 690151 - DNA, 20 bp, mouse
gatgctctccagaggaccca

SEQ ID NO: 690152 - DNA, 20 bp, mouse
ggaggtctgcagagatagct

SEQ ID NO: 690153 - DNA, 20 bp, mouse
gagtacttgatgctctccag

SEQ ID NO: 690154 - DNA, 20 bp, mouse
gtttaagatgcaagacagaa

SEQ ID NO: 690155 - DNA, 20 bp, mouse
ggacatgagatgtcctggga

SEQ ID NO: 690156 - DNA, 20 bp, mouse
gctcacgcccctctggacta

SEQ ID NO: 690157 - DNA, 20 bp, mouse
gcatcgccgccctagtccag

SEQ ID NO: 690158 - DNA, 20 bp, mouse
gcgtgagcagcccagatagg

SEQ ID NO: 690159 - DNA, 20 bp, mouse
gtgggctgctcacgcccctc

SEQ ID NO: 690160 - DNA, 20 bp, mouse
ggcgctcggtccccgagcgg

SEQ ID NO: 690161 - DNA, 20 bp, mouse
gccgccgggaagaagcgagc

SEQ ID NO: 690162 - DNA, 20 bp, mouse
gcggcccctgcggtcgtggt

SEQ ID NO: 690163 - DNA, 20 bp, mouse
gcggcgatgcgccgccgctc

SEQ ID NO: 690164 - DNA, 20 bp, mouse
ggggcgtgagcagcccagat

SEQ ID NO: 690165 - DNA, 20 bp, mouse
gaggcccggtcccacgaccc

SEQ ID NO: 690166 - DNA, 20 bp, mouse
gcggggccagggcggagcta

SEQ ID NO: 690167 - DNA, 20 bp, mouse
gaagtacggggcgacccaga

SEQ ID NO: 690168 - DNA, 20 bp, mouse
gagggtctgggcggggaaac

SEQ ID NO: 690169 - DNA, 20 bp, mouse
gcacgcccctatgcactcat

SEQ ID NO: 690170 - DNA, 20 bp, mouse
gtctgggcggggaaacgggc

SEQ ID NO: 690171 - DNA, 20 bp, mouse
gcggagctagggcggggtcc

SEQ ID NO: 690172 - DNA, 20 bp, mouse
gaagtacgagaggcagagtg

SEQ ID NO: 690173 - DNA, 20 bp, mouse
gaccgggtcaggaggcgggt

SEQ ID NO: 690174 - DNA, 20 bp, mouse
ggcgagctcgaggcagacag

SEQ ID NO: 690175 - DNA, 20 bp, mouse
gtggagacagggtctgggcg

SEQ ID NO: 690176 - DNA, 20 bp, mouse
gcccctgcgccacaaggaga

SEQ ID NO: 690177 - DNA, 20 bp, mouse
gttaatgagggagtgtggcc

SEQ ID NO: 690178 - DNA, 20 bp, mouse
ggaggtatcctgagtcgaag

SEQ ID NO: 690179 - DNA, 20 bp, mouse
gccagctcgggagctgcgat

SEQ ID NO: 690180 - DNA, 20 bp, mouse
gtggccttagagagcgagag

SEQ ID NO: 690181 - DNA, 20 bp, mouse
gactttgccgggaactttgg

SEQ ID NO: 690182 - DNA, 20 bp, mouse
gaaggagaaggatgttaatg

SEQ ID NO: 690183 - DNA, 20 bp, mouse
gggggagccgccaaagttcc

SEQ ID NO: 690184 - DNA, 20 bp, mouse
gccggcaaagtggcgagcaa

SEQ ID NO: 690185 - DNA, 20 bp, mouse
gtcgcgctcagggctcggaa

SEQ ID NO: 690186 - DNA, 20 bp, mouse
gccgaagtccgggaggtgaa

SEQ ID NO: 690187 - DNA, 20 bp, mouse
gccactcaggccaaacactc

SEQ ID NO: 690188 - DNA, 20 bp, mouse
gaaacactcgggactctggt

SEQ ID NO: 690189 - DNA, 20 bp, mouse
gggtcgggactcggtgcttg

SEQ ID NO: 690190 - DNA, 20 bp, mouse
gaatctgtagggtctcccgc

SEQ ID NO: 690191 - DNA, 20 bp, mouse
gcggctctgggcaagctggg

SEQ ID NO: 690192 - DNA, 20 bp, mouse
gcgggactctggtcgggact

SEQ ID NO: 690193 - DNA, 20 bp, mouse
gaaagcttggctaacgccgc

SEQ ID NO: 690194 - DNA, 20 bp, mouse
gctgggcggacgtcctcccg

SEQ ID NO: 690195 - DNA, 20 bp, mouse
gccccgggaatgaatctgta

SEQ ID NO: 690196 - DNA, 20 bp, mouse
ggcgccgtcaggcagtcagt

SEQ ID NO: 690197 - DNA, 20 bp, mouse
gtgtcagagggtgacgtcgg

SEQ ID NO: 690198 - DNA, 20 bp, mouse
ggggcggccgctcccatata

SEQ ID NO: 690199 - DNA, 20 bp, mouse
gagtcagtcggcgagcgcgg

SEQ ID NO: 690200 - DNA, 20 bp, mouse
gggaggcggcggggctcgct

SEQ ID NO: 690201 - DNA, 20 bp, mouse
gcgggagcggcgctgtcaga

SEQ ID NO: 690202 - DNA, 20 bp, mouse
gtcgccgactgactgcctga

SEQ ID NO: 690203 - DNA, 20 bp, mouse
gcctgcgccatatatgggag

SEQ ID NO: 690204 - DNA, 20 bp, mouse
gtgcgcccgggactgcgccg

SEQ ID NO: 690205 - DNA, 20 bp, mouse
ggccggctcgcggcgccgtc

SEQ ID NO: 690206 - DNA, 20 bp, mouse
gagggacgtgacatcatcgg

SEQ ID NO: 690207 - DNA, 20 bp, mouse
gcccggctacggactcgtca

SEQ ID NO: 690208 - DNA, 20 bp, mouse
ggtggcccccagcccggcta

SEQ ID NO: 690209 - DNA, 20 bp, mouse
gtcccggcgcccctccaccg

SEQ ID NO: 690210 - DNA, 20 bp, mouse
ggccagggacgtgacatcat

SEQ ID NO: 690211 - DNA, 20 bp, mouse
gaccctgacgagtccgtagc

SEQ ID NO: 690212 - DNA, 20 bp, mouse
gaggaagcccggcctaagca

SEQ ID NO: 690213 - DNA, 20 bp, mouse
gcgcccctccaccgaggccg

SEQ ID NO: 690214 - DNA, 20 bp, mouse
gccacgctggggaatcacca

SEQ ID NO: 690215 - DNA, 20 bp, mouse
ggggccacggcctcggtgga

SEQ ID NO: 690216 - DNA, 20 bp, mouse
gaacggggaagccccaggaa

SEQ ID NO: 690217 - DNA, 20 bp, mouse
gtagaaggagggccccaaaa

SEQ ID NO: 690218 - DNA, 20 bp, mouse
gtgagattgtaagtggtgag

SEQ ID NO: 690219 - DNA, 20 bp, mouse
gaaggccttgaggtagaagg

SEQ ID NO: 690220 - DNA, 20 bp, mouse
gtggccaacggggaagcccc

SEQ ID NO: 690221 - DNA, 20 bp, mouse
ggggacactgttctagaaac

SEQ ID NO: 690222 - DNA, 20 bp, mouse
gcatcaggccccagacaaca

SEQ ID NO: 690223 - DNA, 20 bp, mouse
gagttgctccttgttgtctg

SEQ ID NO: 690224 - DNA, 20 bp, mouse
ggcttgggtgagattgtaag

SEQ ID NO: 690225 - DNA, 20 bp, mouse
gctggggcctgatgcagctt

SEQ ID NO: 690226 - DNA, 20 bp, mouse
gccaccgccctcagatcctt

SEQ ID NO: 690227 - DNA, 20 bp, mouse
gagactacgtagggatcagt

SEQ ID NO: 690228 - DNA, 20 bp, mouse
gtgggttactagactacgta

SEQ ID NO: 690229 - DNA, 20 bp, mouse
gagcggagctagcggggcag

SEQ ID NO: 690230 - DNA, 20 bp, mouse
gccttccgccccgcgaggtt

SEQ ID NO: 690231 - DNA, 20 bp, mouse
gtccgactctgaaagcggag

SEQ ID NO: 690232 - DNA, 20 bp, mouse
gaggggcgggccggggccat

SEQ ID NO: 690233 - DNA, 20 bp, mouse
ggggcgtgcccggattgctt

SEQ ID NO: 690234 - DNA, 20 bp, mouse
gccgccctcagatccttagg

SEQ ID NO: 690235 - DNA, 20 bp, mouse
gtggcctcagatcaagaggt

SEQ ID NO: 690236 - DNA, 20 bp, mouse
gtgagaccaagtcaggagta

SEQ ID NO: 690237 - DNA, 20 bp, mouse
gagaaagcgcccacagacct

SEQ ID NO: 690238 - DNA, 20 bp, mouse
gagtagggtggagacctcca

SEQ ID NO: 690239 - DNA, 20 bp, mouse
ggacaccataggcgaggaca

SEQ ID NO: 690240 - DNA, 20 bp, mouse
gggagtcctccgaatgtcgc

SEQ ID NO: 690241 - DNA, 20 bp, mouse
gaagcgcccacagaccttgg

SEQ ID NO: 690242 - DNA, 20 bp, mouse
ggacttggtctcagccaaca

SEQ ID NO: 690243 - DNA, 20 bp, mouse
gctagcgcttccccgcccga

SEQ ID NO: 690244 - DNA, 20 bp, mouse
gcagggcctgcgacattcgg

SEQ ID NO: 690245 - DNA, 20 bp, mouse
gggacagggcctgcgacatt

SEQ ID NO: 690246 - DNA, 20 bp, mouse
gggaaccatcaggacagaat

SEQ ID NO: 690247 - DNA, 20 bp, mouse
gcggccttccggcccattgc

SEQ ID NO: 690248 - DNA, 20 bp, mouse
gcggaaggccggcccctcgg

SEQ ID NO: 690249 - DNA, 20 bp, mouse
ggcagcccattctgtcctga

SEQ ID NO: 690250 - DNA, 20 bp, mouse
gggaagtctgacatctaatg

SEQ ID NO: 690251 - DNA, 20 bp, mouse
gaagtgaagtccaaacggtg

SEQ ID NO: 690252 - DNA, 20 bp, mouse
gagctgcctccaaaagatac

SEQ ID NO: 690253 - DNA, 20 bp, mouse
gctagactgctcaaacacaa

SEQ ID NO: 690254 - DNA, 20 bp, mouse
gggctgcaccgatccggcaa

SEQ ID NO: 690255 - DNA, 20 bp, mouse
gctcaaacacaatggttgaa

SEQ ID NO: 690256 - DNA, 20 bp, mouse
gtaagcgacggggcgagacg

SEQ ID NO: 690257 - DNA, 20 bp, mouse
gctggccgcagaggagaaaa

SEQ ID NO: 690258 - DNA, 20 bp, mouse
gaggtcggaagactatagag

SEQ ID NO: 690259 - DNA, 20 bp, mouse
ggggcgagacggggcgagac

SEQ ID NO: 690260 - DNA, 20 bp, mouse
gcggtccggaatctaagcga

SEQ ID NO: 690261 - DNA, 20 bp, mouse
gactatagagtgggaactct

SEQ ID NO: 690262 - DNA, 20 bp, mouse
gtccgctcatgagaggaagg

SEQ ID NO: 690263 - DNA, 20 bp, mouse
gactctgggaggtggcggtc

SEQ ID NO: 690264 - DNA, 20 bp, mouse
ggacggggccggtaggtggc

SEQ ID NO: 690265 - DNA, 20 bp, mouse
gcctatgtctgggacgggaa

SEQ ID NO: 690266 - DNA, 20 bp, mouse
gagcccgcggaggtgtgggg

SEQ ID NO: 690267 - DNA, 20 bp, mouse
gaaccaatacagaagtgcgg

SEQ ID NO: 690268 - DNA, 20 bp, mouse
gccaagggttaaggagcccg

SEQ ID NO: 690269 - DNA, 20 bp, mouse
gcagcgctccagcatgccaa

SEQ ID NO: 690270 - DNA, 20 bp, mouse
gctcgccgggaccctctcga

SEQ ID NO: 690271 - DNA, 20 bp, mouse
gactcccccccacacctccg

SEQ ID NO: 690272 - DNA, 20 bp, mouse
gagcccccgcacttctgtat

SEQ ID NO: 690273 - DNA, 20 bp, mouse
gaaggagcccgcggaggtgt

SEQ ID NO: 690274 - DNA, 20 bp, mouse
gaaccccaactgggcgcagg

SEQ ID NO: 690275 - DNA, 20 bp, mouse
gcccgcacccctggacccac

SEQ ID NO: 690276 - DNA, 20 bp, mouse
gcaccgaggtaagaaatgga

SEQ ID NO: 690277 - DNA, 20 bp, mouse
ggggctccttagtcccgccc

SEQ ID NO: 690278 - DNA, 20 bp, mouse
gcctcgtggcaaaccggatc

SEQ ID NO: 690279 - DNA, 20 bp, mouse
gctaaggagcccaatcaccg

SEQ ID NO: 690280 - DNA, 20 bp, mouse
gaaggtgctccaaaaatctt

SEQ ID NO: 690281 - DNA, 20 bp, mouse
gcacgtctagtgaccagatc

SEQ ID NO: 690282 - DNA, 20 bp, mouse
gagatgtggtcgagtttaga

SEQ ID NO: 690283 - DNA, 20 bp, mouse
gactctgggcataggcagag

SEQ ID NO: 690284 - DNA, 20 bp, mouse
gtactgcatcctctcgtgtt

SEQ ID NO: 690285 - DNA, 20 bp, mouse
ggctgggaagctgaattact

SEQ ID NO: 690286 - DNA, 20 bp, mouse
gtatgggtggcttgcctgag

SEQ ID NO: 690287 - DNA, 20 bp, mouse
ggttgcgcggaacgtggtct

SEQ ID NO: 690288 - DNA, 20 bp, mouse
gcgcccgggggtgggagcga

SEQ ID NO: 690289 - DNA, 20 bp, mouse
gcgacccagcggcgcgcccg

SEQ ID NO: 690290 - DNA, 20 bp, mouse
gctgggacataactcctcta

SEQ ID NO: 690291 - DNA, 20 bp, mouse
gatggagagcagcggttgcg

SEQ ID NO: 690292 - DNA, 20 bp, mouse
gcggggagacctgagaaagc

SEQ ID NO: 690293 - DNA, 20 bp, mouse
gtgctgttgtagatatccta

SEQ ID NO: 690294 - DNA, 20 bp, mouse
gtctgggcgcggatgctggc

SEQ ID NO: 690295 - DNA, 20 bp, mouse
ggcggaacgtggtctgggcg

SEQ ID NO: 690296 - DNA, 20 bp, mouse
gcctcctcccgggacagatc

SEQ ID NO: 690297 - DNA, 20 bp, mouse
gaagctggtgcatcactctc

SEQ ID NO: 690298 - DNA, 20 bp, mouse
gctccagcagtgcggaggtg

SEQ ID NO: 690299 - DNA, 20 bp, mouse
ggaggtggggatggcgaccg

SEQ ID NO: 690300 - DNA, 20 bp, mouse
ggcccattggagtcctccct

SEQ ID NO: 690301 - DNA, 20 bp, mouse
gagcccagggaggactccaa

SEQ ID NO: 690302 - DNA, 20 bp, mouse
gtggaggccagagggaagtc

SEQ ID NO: 690303 - DNA, 20 bp, mouse
gaggttgcaagtagaggctg

SEQ ID NO: 690304 - DNA, 20 bp, mouse
gagtccagatctgtcccggg

SEQ ID NO: 690305 - DNA, 20 bp, mouse
ggtcagctccagcagtgcgg

SEQ ID NO: 690306 - DNA, 20 bp, mouse
gggacctcgctgctaaaggg

SEQ ID NO: 690307 - DNA, 20 bp, mouse
gcgttcgccatgttggtcaa

SEQ ID NO: 690308 - DNA, 20 bp, mouse
gtaaagatggcgaactaggt

SEQ ID NO: 690309 - DNA, 20 bp, mouse
gccttcgtgtctcatgtgtt

SEQ ID NO: 690310 - DNA, 20 bp, mouse
gcagacaactgaaatagtca

SEQ ID NO: 690311 - DNA, 20 bp, mouse
ggtgggacctcgctgctaaa

SEQ ID NO: 690312 - DNA, 20 bp, mouse
gagttcgccatctttactaa

SEQ ID NO: 690313 - DNA, 20 bp, mouse
gcagcgtcccactgggccaa

SEQ ID NO: 690314 - DNA, 20 bp, mouse
gtcccgaagaaaaacttagg

SEQ ID NO: 690315 - DNA, 20 bp, mouse
gtctcaggccagcgtcccac

SEQ ID NO: 690316 - DNA, 20 bp, mouse
gcgggccggcggtaaggctg

SEQ ID NO: 690317 - DNA, 20 bp, mouse
ggggctgcgggccggcggta

SEQ ID NO: 690318 - DNA, 20 bp, mouse
gaaggctgcggccaagtgac

SEQ ID NO: 690319 - DNA, 20 bp, mouse
gctcgcgcgcagcggaaggt

SEQ ID NO: 690320 - DNA, 20 bp, mouse
gcgcgctggccagggtgcgg

SEQ ID NO: 690321 - DNA, 20 bp, mouse
gaaggtggggtgcgggaaga

SEQ ID NO: 690322 - DNA, 20 bp, mouse
gagcggaaacaggcccggag

SEQ ID NO: 690323 - DNA, 20 bp, mouse
ggcgctgtggcgtgattggg

SEQ ID NO: 690324 - DNA, 20 bp, mouse
gggatcccggggagcatacc

SEQ ID NO: 690325 - DNA, 20 bp, mouse
gccggggagcataccaggag

SEQ ID NO: 690326 - DNA, 20 bp, mouse
gacaaggtctgctgtcctag

SEQ ID NO: 690327 - DNA, 20 bp, mouse
gtggtctgcacccactgaca

SEQ ID NO: 690328 - DNA, 20 bp, mouse
ggatgaaatgacatgatctg

SEQ ID NO: 690329 - DNA, 20 bp, mouse
gcacctacgggcggagagaa

SEQ ID NO: 690330 - DNA, 20 bp, mouse
ggcgggcgaggcctcgccaa

SEQ ID NO: 690331 - DNA, 20 bp, mouse
gtcgccaagggctccaccta

SEQ ID NO: 690332 - DNA, 20 bp, mouse
ggacagcagaccttgtcagt

SEQ ID NO: 690333 - DNA, 20 bp, mouse
gcagctccttcgtgaaatct

SEQ ID NO: 690334 - DNA, 20 bp, mouse
ggaaaatcgtagttccgggg

SEQ ID NO: 690335 - DNA, 20 bp, mouse
gcaagggctccacctacggg

SEQ ID NO: 690336 - DNA, 20 bp, mouse
ggaaactagtggagcggggc

SEQ ID NO: 690337 - DNA, 20 bp, mouse
ggagccacgcccccaaaccc

SEQ ID NO: 690338 - DNA, 20 bp, mouse
gagctcctgccactcatcac

SEQ ID NO: 690339 - DNA, 20 bp, mouse
ggggctcggggccctgccct

SEQ ID NO: 690340 - DNA, 20 bp, mouse
gctgcgaaactagtggagcg

SEQ ID NO: 690341 - DNA, 20 bp, mouse
gctagtggagcggggcgggt

SEQ ID NO: 690342 - DNA, 20 bp, mouse
ggtgacctacacccagggca

SEQ ID NO: 690343 - DNA, 20 bp, mouse
gaggctgtgaaggagtttaa

SEQ ID NO: 690344 - DNA, 20 bp, mouse
ggggtggggccctgaaggcg

SEQ ID NO: 690345 - DNA, 20 bp, mouse
gggggcgtggctccaggaga

SEQ ID NO: 690346 - DNA, 20 bp, mouse
ggggcggggtggggcagcgt

SEQ ID NO: 690347 - DNA, 20 bp, mouse
gtaaaccgggcacccgccaa

SEQ ID NO: 690348 - DNA, 20 bp, mouse
gggtggacccgtgacctgag

SEQ ID NO: 690349 - DNA, 20 bp, mouse
gatcccaggcgggatgaaga

SEQ ID NO: 690350 - DNA, 20 bp, mouse
gctggtacagagggcggggt

SEQ ID NO: 690351 - DNA, 20 bp, mouse
gtaccagcccgctcaggtca

SEQ ID NO: 690352 - DNA, 20 bp, mouse
gacagccatgtctcccagtc

SEQ ID NO: 690353 - DNA, 20 bp, mouse
gcctctgtaccagcccgctc

SEQ ID NO: 690354 - DNA, 20 bp, mouse
ggaagccagactgggagaca

SEQ ID NO: 690355 - DNA, 20 bp, mouse
gtcatcccgcctgggatctg

SEQ ID NO: 690356 - DNA, 20 bp, mouse
gccgcagcgtccagaggact

SEQ ID NO: 690357 - DNA, 20 bp, mouse
gcccctgtgccagttagggc

SEQ ID NO: 690358 - DNA, 20 bp, mouse
gcacttgcagagctgggatt

SEQ ID NO: 690359 - DNA, 20 bp, mouse
gcagcacaggggtgactggg

SEQ ID NO: 690360 - DNA, 20 bp, mouse
ggaggaggagtctgcaaggc

SEQ ID NO: 690361 - DNA, 20 bp, mouse
gaccctgccctaactggcac

SEQ ID NO: 690362 - DNA, 20 bp, mouse
gtcctctggacgctgcggac

SEQ ID NO: 690363 - DNA, 20 bp, mouse
gtaaccttggccttgtgggg

SEQ ID NO: 690364 - DNA, 20 bp, mouse
gggattaggaccataaatca

SEQ ID NO: 690365 - DNA, 20 bp, mouse
gcagaggcacttgcagagct

SEQ ID NO: 690366 - DNA, 20 bp, mouse
ggacccggggacaaaaagac

SEQ ID NO: 690367 - DNA, 20 bp, mouse
gcggcctgtgaaaggacccg

SEQ ID NO: 690368 - DNA, 20 bp, mouse
gctagtcgcacccctgccca

SEQ ID NO: 690369 - DNA, 20 bp, mouse
gtgggtggggccagggttca

SEQ ID NO: 690370 - DNA, 20 bp, mouse
gtgtccccgggtcctttcac

SEQ ID NO: 690371 - DNA, 20 bp, mouse
gcgcccattctcaactctga

SEQ ID NO: 690372 - DNA, 20 bp, mouse
gtggatgtgagccctgggca

SEQ ID NO: 690373 - DNA, 20 bp, mouse
gagactggcggagataatct

SEQ ID NO: 690374 - DNA, 20 bp, mouse
gcacgcccggagcgcacctc

SEQ ID NO: 690375 - DNA, 20 bp, mouse
gctccttcagagttgagaat

SEQ ID NO: 690376 - DNA, 20 bp, mouse
gtgggggcgtggtctgagtt

SEQ ID NO: 690377 - DNA, 20 bp, mouse
ggtctgagttgggcccgaga

SEQ ID NO: 690378 - DNA, 20 bp, mouse
gttgggcccgagaaggtttc

SEQ ID NO: 690379 - DNA, 20 bp, mouse
gagccgagacgcttaagaat

SEQ ID NO: 690380 - DNA, 20 bp, mouse
gaagaatgggtggaatcggt

SEQ ID NO: 690381 - DNA, 20 bp, mouse
gcggtgggaggaactgggca

SEQ ID NO: 690382 - DNA, 20 bp, mouse
ggagtggaacgaaagactcc

SEQ ID NO: 690383 - DNA, 20 bp, mouse
gaatgggtggaatcggtggg

SEQ ID NO: 690384 - DNA, 20 bp, mouse
gccgagaaggtttcagggat

SEQ ID NO: 690385 - DNA, 20 bp, mouse
gctgcggggaagtccattat

SEQ ID NO: 690386 - DNA, 20 bp, mouse
gaaggaggctccaggagtct

SEQ ID NO: 690387 - DNA, 20 bp, mouse
gctgggaagaatggaggtga

SEQ ID NO: 690388 - DNA, 20 bp, mouse
gcccctccaaactgatgcag

SEQ ID NO: 690389 - DNA, 20 bp, mouse
gaaactgatgcagaggatca

SEQ ID NO: 690390 - DNA, 20 bp, mouse
gctccttagcctgggaagaa

SEQ ID NO: 690391 - DNA, 20 bp, mouse
gccagcaagggcactgcctc

SEQ ID NO: 690392 - DNA, 20 bp, mouse
ggaaactgaggcacaaatta

SEQ ID NO: 690393 - DNA, 20 bp, mouse
ggatctgacactctcctgag

SEQ ID NO: 690394 - DNA, 20 bp, mouse
gcatggagcaagttgtcatc

SEQ ID NO: 690395 - DNA, 20 bp, mouse
gacactctcctgagtgggag

SEQ ID NO: 690396 - DNA, 20 bp, mouse
gagcgggagttgggcggggt

SEQ ID NO: 690397 - DNA, 20 bp, mouse
ggaaaacatcagcgggagtt

SEQ ID NO: 690398 - DNA, 20 bp, mouse
gaacatcagcgggagttggg

SEQ ID NO: 690399 - DNA, 20 bp, mouse
gcaaatctccagtagtttgt

SEQ ID NO: 690400 - DNA, 20 bp, mouse
gaaaagtggaaaacatcagc

SEQ ID NO: 690401 - DNA, 20 bp, mouse
gggagatacatacaggttgt

SEQ ID NO: 690402 - DNA, 20 bp, mouse
gtagggaaaatggtttccaa

SEQ ID NO: 690403 - DNA, 20 bp, mouse
gtcagccaaagaagtaacta

SEQ ID NO: 690404 - DNA, 20 bp, mouse
gaaaaaatttttttaatcac

SEQ ID NO: 690405 - DNA, 20 bp, mouse
gtgaaaggcgtttatcccaa

SEQ ID NO: 690406 - DNA, 20 bp, mouse
gccggctgacatcctcatct

SEQ ID NO: 690407 - DNA, 20 bp, mouse
ggtccccacaaccactgctc

SEQ ID NO: 690408 - DNA, 20 bp, mouse
gtcagccggagcagtggttg

SEQ ID NO: 690409 - DNA, 20 bp, mouse
gtcagcacacagcccagatg

SEQ ID NO: 690410 - DNA, 20 bp, mouse
gtggttgtggggactggcga

SEQ ID NO: 690411 - DNA, 20 bp, mouse
gtgggctgtgtgctgaaccg

SEQ ID NO: 690412 - DNA, 20 bp, mouse
ggaaggaaacagattgggac

SEQ ID NO: 690413 - DNA, 20 bp, mouse
gagaagagagagggagtact

SEQ ID NO: 690414 - DNA, 20 bp, mouse
ggagaggaaggtagtgttgg

SEQ ID NO: 690415 - DNA, 20 bp, mouse
ggactggcgagggcctttct

SEQ ID NO: 690416 - DNA, 20 bp, mouse
gcgctccagcgcctccgtac

SEQ ID NO: 690417 - DNA, 20 bp, mouse
ggataccagtacggaggcgc

SEQ ID NO: 690418 - DNA, 20 bp, mouse
ggggcgggacctatcgtcac

SEQ ID NO: 690419 - DNA, 20 bp, mouse
gtctccccccttcctattgg

SEQ ID NO: 690420 - DNA, 20 bp, mouse
ggggttccccggcgtccgtc

SEQ ID NO: 690421 - DNA, 20 bp, mouse
ggccgccctgggctccgaac

SEQ ID NO: 690422 - DNA, 20 bp, mouse
ggacgataggtcccgccctc

SEQ ID NO: 690423 - DNA, 20 bp, mouse
ggatccaccaataggaaggg

SEQ ID NO: 690424 - DNA, 20 bp, mouse
gggcgctggagcgggttccc

SEQ ID NO: 690425 - DNA, 20 bp, mouse
gactttggataccagtacgg

SEQ ID NO: 690426 - DNA, 20 bp, mouse
gcctcccgaaggcagacgtt

SEQ ID NO: 690427 - DNA, 20 bp, mouse
gtggagcgtgcgaacgtcgg

SEQ ID NO: 690428 - DNA, 20 bp, mouse
gggctggagcgtgcgaacgt

SEQ ID NO: 690429 - DNA, 20 bp, mouse
gcggcggagtgcccggatgt

SEQ ID NO: 690430 - DNA, 20 bp, mouse
gcctcctcaagcccacatcc

SEQ ID NO: 690431 - DNA, 20 bp, mouse
ggatgcagcaggtgtttctg

SEQ ID NO: 690432 - DNA, 20 bp, mouse
gagaccgttcatcaggaact

SEQ ID NO: 690433 - DNA, 20 bp, mouse
ggcacgctccagccgtttac

SEQ ID NO: 690434 - DNA, 20 bp, mouse
ggtctgccttcgggaggcgc

SEQ ID NO: 690435 - DNA, 20 bp, mouse
gtcgggaggcgccggctgat

SEQ ID NO: 690436 - DNA, 20 bp, mouse
gggagtgcagcaccgagcaa

SEQ ID NO: 690437 - DNA, 20 bp, mouse
gccaccacgccccacaggtc

SEQ ID NO: 690438 - DNA, 20 bp, mouse
ggctcggtgctgcactccag

SEQ ID NO: 690439 - DNA, 20 bp, mouse
gaagggacaccggacctgtg

SEQ ID NO: 690440 - DNA, 20 bp, mouse
gctgaagcaaagaccgaggt

SEQ ID NO: 690441 - DNA, 20 bp, mouse
ggatccagctgcaactgcct

SEQ ID NO: 690442 - DNA, 20 bp, mouse
gaaagaccgaggttggccac

SEQ ID NO: 690443 - DNA, 20 bp, mouse
gtagaacttgagagaacaga

SEQ ID NO: 690444 - DNA, 20 bp, mouse
gtgcttcaggaggctcctga

SEQ ID NO: 690445 - DNA, 20 bp, mouse
gggtcccaggcagttgcagc

SEQ ID NO: 690446 - DNA, 20 bp, mouse
gggcccgagtggaacggcag

SEQ ID NO: 690447 - DNA, 20 bp, mouse
ggctggaggcccgagtggaa

SEQ ID NO: 690448 - DNA, 20 bp, mouse
gcactccgaggggtgggaaa

SEQ ID NO: 690449 - DNA, 20 bp, mouse
ggcggccagagagggaatga

SEQ ID NO: 690450 - DNA, 20 bp, mouse
gcggccgggacgcccaacca

SEQ ID NO: 690451 - DNA, 20 bp, mouse
gcgccccatgcctcaagggg

SEQ ID NO: 690452 - DNA, 20 bp, mouse
ggccccctgccgttccactc

SEQ ID NO: 690453 - DNA, 20 bp, mouse
ggcgctgaagggttaaaccg

SEQ ID NO: 690454 - DNA, 20 bp, mouse
ggcctggcgggcccgtggtt

SEQ ID NO: 690455 - DNA, 20 bp, mouse
gccacggctggaggcccgag

SEQ ID NO: 690456 - DNA, 20 bp, mouse
gggaactgaagctgggtcta

SEQ ID NO: 690457 - DNA, 20 bp, mouse
ggagtctggcgggtaaacac

SEQ ID NO: 690458 - DNA, 20 bp, mouse
gttagatctagcctaatctg

SEQ ID NO: 690459 - DNA, 20 bp, mouse
gaccggccaagtcacaagtc

SEQ ID NO: 690460 - DNA, 20 bp, mouse
gaataaaccccgcccctgaa

SEQ ID NO: 690461 - DNA, 20 bp, mouse
ggccagacttgtgacttggc

SEQ ID NO: 690462 - DNA, 20 bp, mouse
gccccgtcccctcccctgta

SEQ ID NO: 690463 - DNA, 20 bp, mouse
gagactcacactgtcctttc

SEQ ID NO: 690464 - DNA, 20 bp, mouse
gcccttcctccccacagatt

SEQ ID NO: 690465 - DNA, 20 bp, mouse
gaagctccaggaactgaagc

SEQ ID NO: 690466 - DNA, 20 bp, mouse
gaggacttcctgccccttaa

SEQ ID NO: 690467 - DNA, 20 bp, mouse
gagagcctgaggctgtgccc

SEQ ID NO: 690468 - DNA, 20 bp, mouse
gtgccccttaagggacaagc

SEQ ID NO: 690469 - DNA, 20 bp, mouse
gcactcagcggcagagcctg

SEQ ID NO: 690470 - DNA, 20 bp, mouse
gtagaggccgcgccaggcat

SEQ ID NO: 690471 - DNA, 20 bp, mouse
ggacccccacgcactccaaa

SEQ ID NO: 690472 - DNA, 20 bp, mouse
ggcctggcgcggcctctagg

SEQ ID NO: 690473 - DNA, 20 bp, mouse
gctcctgcactgccgatgcc

SEQ ID NO: 690474 - DNA, 20 bp, mouse
ggcctctaggtggcgcgggt

SEQ ID NO: 690475 - DNA, 20 bp, mouse
gcgggtgggtttgaagcgag

SEQ ID NO: 690476 - DNA, 20 bp, mouse
ggggcacgagaggacaccga

SEQ ID NO: 690477 - DNA, 20 bp, mouse
gactctggagaggattccgt

SEQ ID NO: 690478 - DNA, 20 bp, mouse
ggtgctccttgcacaggccc

SEQ ID NO: 690479 - DNA, 20 bp, mouse
gcctgtgcaaggagcacgct

SEQ ID NO: 690480 - DNA, 20 bp, mouse
gagcagggcaagtgctccgg

SEQ ID NO: 690481 - DNA, 20 bp, mouse
gtagaaccctggtcttacca

SEQ ID NO: 690482 - DNA, 20 bp, mouse
gaccagcagggcaagtgctc

SEQ ID NO: 690483 - DNA, 20 bp, mouse
gaaccctggtcttaccacgg

SEQ ID NO: 690484 - DNA, 20 bp, mouse
gcacgcgcgggtggctttcc

SEQ ID NO: 690485 - DNA, 20 bp, mouse
gagagactcgcgccgggaag

SEQ ID NO: 690486 - DNA, 20 bp, mouse
gagagcttggggtaatgtta

SEQ ID NO: 690487 - DNA, 20 bp, mouse
gtggctccgccctgtgtcaa

SEQ ID NO: 690488 - DNA, 20 bp, mouse
gtgggaggaaggaactatgc

SEQ ID NO: 690489 - DNA, 20 bp, mouse
ggtggagtaagaaagagaat

SEQ ID NO: 690490 - DNA, 20 bp, mouse
gaagcagccgccacctccgc

SEQ ID NO: 690491 - DNA, 20 bp, mouse
gtgggcgtgaagcccctcgg

SEQ ID NO: 690492 - DNA, 20 bp, mouse
ggggcctaggctattgtaac

SEQ ID NO: 690493 - DNA, 20 bp, mouse
gccgggaaatttgagagctt

SEQ ID NO: 690494 - DNA, 20 bp, mouse
gaacggaagtgacatcactc

SEQ ID NO: 690495 - DNA, 20 bp, mouse
gtctgtgtgtgaaatctgag

SEQ ID NO: 690496 - DNA, 20 bp, mouse
ggagccccagttcctatcag

SEQ ID NO: 690497 - DNA, 20 bp, mouse
gctgcctctgataggaactg

SEQ ID NO: 690498 - DNA, 20 bp, mouse
gtatcagaggcagcctccgt

SEQ ID NO: 690499 - DNA, 20 bp, mouse
gtagatctccagagatggta

SEQ ID NO: 690500 - DNA, 20 bp, mouse
gtccgggagcgaaggtcagt

SEQ ID NO: 690501 - DNA, 20 bp, mouse
gtacaactaccgcagaagaa

SEQ ID NO: 690502 - DNA, 20 bp, mouse
gcctaaaaccctaccatctc

SEQ ID NO: 690503 - DNA, 20 bp, mouse
ggccaggagcaagcagccta

SEQ ID NO: 690504 - DNA, 20 bp, mouse
ggtgaagtttagccactact

SEQ ID NO: 690505 - DNA, 20 bp, mouse
gactacctgagtggtaaagt

SEQ ID NO: 690506 - DNA, 20 bp, mouse
gtcccctaaggctactctca

SEQ ID NO: 690507 - DNA, 20 bp, mouse
gcaccctgagagtagcctta

SEQ ID NO: 690508 - DNA, 20 bp, mouse
gtggggagaggtgactccag

SEQ ID NO: 690509 - DNA, 20 bp, mouse
gggagatctgcaaacatcaa

SEQ ID NO: 690510 - DNA, 20 bp, mouse
gaaaggatgaacagccacga

SEQ ID NO: 690511 - DNA, 20 bp, mouse
gtgtttgcagatctccccta

SEQ ID NO: 690512 - DNA, 20 bp, mouse
ggcggcggggagtccatgca

SEQ ID NO: 690513 - DNA, 20 bp, mouse
gctcctcatgcggaacactc

SEQ ID NO: 690514 - DNA, 20 bp, mouse
gctttcagggagtgcgggga

SEQ ID NO: 690515 - DNA, 20 bp, mouse
gtaagctttcagggagtgcg

SEQ ID NO: 690516 - DNA, 20 bp, mouse
gcgcggccggggactccctc

SEQ ID NO: 690517 - DNA, 20 bp, mouse
gggtggaggccaatccccgg

SEQ ID NO: 690518 - DNA, 20 bp, mouse
gtggccccgcgttcgcccgc

SEQ ID NO: 690519 - DNA, 20 bp, mouse
gcggccgcgcccctcgaggc

SEQ ID NO: 690520 - DNA, 20 bp, mouse
gcggggccttgcagtccggg

SEQ ID NO: 690521 - DNA, 20 bp, mouse
gtagagccggagggagtccc

SEQ ID NO: 690522 - DNA, 20 bp, mouse
gcgggccggtcccgtccgcg

SEQ ID NO: 690523 - DNA, 20 bp, mouse
gtcacgagggagttccttaa

SEQ ID NO: 690524 - DNA, 20 bp, mouse
gtgtcccccgccccgcggac

SEQ ID NO: 690525 - DNA, 20 bp, mouse
ggccggtcccgtccgcgggg

SEQ ID NO: 690526 - DNA, 20 bp, mouse
gaagcccaggatgcaatggg

SEQ ID NO: 690527 - DNA, 20 bp, mouse
gagaaccagccgcggctcgg

SEQ ID NO: 690528 - DNA, 20 bp, mouse
gcctggcaaaagagcatctc

SEQ ID NO: 690529 - DNA, 20 bp, mouse
gccaccgcccattgcatcct

SEQ ID NO: 690530 - DNA, 20 bp, mouse
gcaccacgacgcctgcgcgt

SEQ ID NO: 690531 - DNA, 20 bp, mouse
gtgctcaacaaacagaaact

SEQ ID NO: 690532 - DNA, 20 bp, mouse
gtccccggaagaaccagccg

SEQ ID NO: 690533 - DNA, 20 bp, mouse
ggcgtcgtggtgcgtatccc

SEQ ID NO: 690534 - DNA, 20 bp, mouse
ggcccaacgcgcaggcgtcg

SEQ ID NO: 690535 - DNA, 20 bp, mouse
gcaacgtgtcttaaagacag

SEQ ID NO: 690536 - DNA, 20 bp, mouse
ggggtcggaggtggatcgaa

SEQ ID NO: 690537 - DNA, 20 bp, mouse
gtggcaactcctggggtcgg

SEQ ID NO: 690538 - DNA, 20 bp, mouse
ggggactagtagttcctagg

SEQ ID NO: 690539 - DNA, 20 bp, mouse
gtagcaaggcgcctgcgcgt

SEQ ID NO: 690540 - DNA, 20 bp, mouse
gtggagacagcctcggagag

SEQ ID NO: 690541 - DNA, 20 bp, mouse
gtagcattggcccagagaag

SEQ ID NO: 690542 - DNA, 20 bp, mouse
gcagctacaggacctagcat

SEQ ID NO: 690543 - DNA, 20 bp, mouse
gaggggctggccgcagctac

SEQ ID NO: 690544 - DNA, 20 bp, mouse
gggcccagagaagcgggacg

SEQ ID NO: 690545 - DNA, 20 bp, mouse
gggaggaagcggtgcacctt

SEQ ID NO: 690546 - DNA, 20 bp, mouse
gctagtctagggacccgcgg

SEQ ID NO: 690547 - DNA, 20 bp, mouse
gggacacgggactggaaccg

SEQ ID NO: 690548 - DNA, 20 bp, mouse
gtccgcacccggctagtcta

SEQ ID NO: 690549 - DNA, 20 bp, mouse
gaagagagctggggcggaga

SEQ ID NO: 690550 - DNA, 20 bp, mouse
ggggagtgaggcacggagaa

SEQ ID NO: 690551 - DNA, 20 bp, mouse
gagccacagggacacgggac

SEQ ID NO: 690552 - DNA, 20 bp, mouse
gggaacacaggtatctgcga

SEQ ID NO: 690553 - DNA, 20 bp, mouse
ggaattgtgtggggatcgaa

SEQ ID NO: 690554 - DNA, 20 bp, mouse
gtggaaccgtggcggcgatc

SEQ ID NO: 690555 - DNA, 20 bp, mouse
gtccctagactagccgggtg

SEQ ID NO: 690556 - DNA, 20 bp, mouse
gggagaaggcaataagaaga

SEQ ID NO: 690557 - DNA, 20 bp, mouse
gtagtggcaggtatcagtca

SEQ ID NO: 690558 - DNA, 20 bp, mouse
gggggcgcccaaagccagct

SEQ ID NO: 690559 - DNA, 20 bp, mouse
gaataagaagagggagggta

SEQ ID NO: 690560 - DNA, 20 bp, mouse
gagccaccttccaaagctgg

SEQ ID NO: 690561 - DNA, 20 bp, mouse
ggaacttagcagatagtggc

SEQ ID NO: 690562 - DNA, 20 bp, mouse
gactgagcctagctggcttt

SEQ ID NO: 690563 - DNA, 20 bp, mouse
ggcgcactgtgtacaaacag

SEQ ID NO: 690564 - DNA, 20 bp, mouse
gtggctttgggcgcccccgg

SEQ ID NO: 690565 - DNA, 20 bp, mouse
gaggagccaccttccaaagc

SEQ ID NO: 690566 - DNA, 20 bp, mouse
gcccctggattgtcagacgg

SEQ ID NO: 690567 - DNA, 20 bp, mouse
ggtctgacaatccaggggca

SEQ ID NO: 690568 - DNA, 20 bp, mouse
ggcccgccgtctgacaatcc

SEQ ID NO: 690569 - DNA, 20 bp, mouse
gtgcagccagagataagacc

SEQ ID NO: 690570 - DNA, 20 bp, mouse
gtagagccgggtcttatctc

SEQ ID NO: 690571 - DNA, 20 bp, mouse
gccggctctagaggaaatca

SEQ ID NO: 690572 - DNA, 20 bp, mouse
gtgtgtgattagtcacccac

SEQ ID NO: 690573 - DNA, 20 bp, mouse
gtctggctgcacgttgcctg

SEQ ID NO: 690574 - DNA, 20 bp, mouse
gggctggcagctagcaaaag

SEQ ID NO: 690575 - DNA, 20 bp, mouse
gagctagcaaaaggggaagc

SEQ ID NO: 690576 - DNA, 20 bp, mouse
gcgccctggcctcccggtga

SEQ ID NO: 690577 - DNA, 20 bp, mouse
ggggccgggtaccacaactt

SEQ ID NO: 690578 - DNA, 20 bp, mouse
gaggcggggctgcaccagta

SEQ ID NO: 690579 - DNA, 20 bp, mouse
gggagcctgcagagtcctga

SEQ ID NO: 690580 - DNA, 20 bp, mouse
ggtgttgcagagaagcgcag

SEQ ID NO: 690581 - DNA, 20 bp, mouse
gaacaccttcaggactctgc

SEQ ID NO: 690582 - DNA, 20 bp, mouse
gccctctccccctcaccggg

SEQ ID NO: 690583 - DNA, 20 bp, mouse
gccccctcaccgggaggcca

SEQ ID NO: 690584 - DNA, 20 bp, mouse
ggagtgctagtcagagagta

SEQ ID NO: 690585 - DNA, 20 bp, mouse
gccctgcctggtattataag

SEQ ID NO: 690586 - DNA, 20 bp, mouse
ggggacgccgcgctccccgt

SEQ ID NO: 690587 - DNA, 20 bp, mouse
gtcgccccaggcttacccag

SEQ ID NO: 690588 - DNA, 20 bp, mouse
gcttacccaggggtagagag

SEQ ID NO: 690589 - DNA, 20 bp, mouse
gcccgtgggtggatggggta

SEQ ID NO: 690590 - DNA, 20 bp, mouse
gtctacccctgggtaagcct

SEQ ID NO: 690591 - DNA, 20 bp, mouse
gcgcctccccgcccctccga

SEQ ID NO: 690592 - DNA, 20 bp, mouse
gcgctccccgtgggtggatg

SEQ ID NO: 690593 - DNA, 20 bp, mouse
gcccgcctctctctacccct

SEQ ID NO: 690594 - DNA, 20 bp, mouse
ggggtcgctttgcaagcgca

SEQ ID NO: 690595 - DNA, 20 bp, mouse
gtcttggtgctcttggggtg

SEQ ID NO: 690596 - DNA, 20 bp, mouse
gctagactaaccaacttctc

SEQ ID NO: 690597 - DNA, 20 bp, mouse
gtaggagcctgtggagtcta

SEQ ID NO: 690598 - DNA, 20 bp, mouse
gaagttggttagtctaggat

SEQ ID NO: 690599 - DNA, 20 bp, mouse
gcaaactctcccgtactcac

SEQ ID NO: 690600 - DNA, 20 bp, mouse
gcacttgagcccgtgagtac

SEQ ID NO: 690601 - DNA, 20 bp, mouse
ggagcaacagaccagactca

SEQ ID NO: 690602 - DNA, 20 bp, mouse
gagacacagcccaaattccc

SEQ ID NO: 690603 - DNA, 20 bp, mouse
gcagggcacaaccttgagtc

SEQ ID NO: 690604 - DNA, 20 bp, mouse
gaatggggagacccttcaga

SEQ ID NO: 690605 - DNA, 20 bp, mouse
ggggagagtttgatcagcag

SEQ ID NO: 690606 - DNA, 20 bp, mouse
ggggaggagcattcgggcag

SEQ ID NO: 690607 - DNA, 20 bp, mouse
gccggagtgaaggcacctag

SEQ ID NO: 690608 - DNA, 20 bp, mouse
gccctcccagcggtcagctg

SEQ ID NO: 690609 - DNA, 20 bp, mouse
ggggtgttccagactgggga

SEQ ID NO: 690610 - DNA, 20 bp, mouse
gcctgccgtagaccagtcgg

SEQ ID NO: 690611 - DNA, 20 bp, mouse
gagaaaacgcgggaggagtc

SEQ ID NO: 690612 - DNA, 20 bp, mouse
gctgtccaggcgtcgcccaa

SEQ ID NO: 690613 - DNA, 20 bp, mouse
ggaccccgctcaagctgctg

SEQ ID NO: 690614 - DNA, 20 bp, mouse
gtgaaggcacctagcggcca

SEQ ID NO: 690615 - DNA, 20 bp, mouse
gcgcccaagggaaaaggttg

SEQ ID NO: 690616 - DNA, 20 bp, mouse
gtcctcggcctgtccatccg

SEQ ID NO: 690617 - DNA, 20 bp, mouse
gcccgcggatggacaggccg

SEQ ID NO: 690618 - DNA, 20 bp, mouse
gccctgctcgggaatgttga

SEQ ID NO: 690619 - DNA, 20 bp, mouse
gcccgcccggggccgagggg

SEQ ID NO: 690620 - DNA, 20 bp, mouse
gtgggtgccggaccctgctc

SEQ ID NO: 690621 - DNA, 20 bp, mouse
gtgtccatccgcggggaggg

SEQ ID NO: 690622 - DNA, 20 bp, mouse
gcccgcccgcccggggccga

SEQ ID NO: 690623 - DNA, 20 bp, mouse
ggcctgtccatccgcgggga

SEQ ID NO: 690624 - DNA, 20 bp, mouse
gcggggctagtgtgagagac

SEQ ID NO: 690625 - DNA, 20 bp, mouse
gccaaggtccaagctctcgg

SEQ ID NO: 690626 - DNA, 20 bp, mouse
gagacgaggcggaactcaaa

SEQ ID NO: 690627 - DNA, 20 bp, mouse
ggcaaacgaacgaaagtctg

SEQ ID NO: 690628 - DNA, 20 bp, mouse
gtcggtgcaaagtgtcgaga

SEQ ID NO: 690629 - DNA, 20 bp, mouse
ggcagcgggtcggagatcga

SEQ ID NO: 690630 - DNA, 20 bp, mouse
gggcccaccactgctcccga

SEQ ID NO: 690631 - DNA, 20 bp, mouse
gcaccactgctcccgaggga

SEQ ID NO: 690632 - DNA, 20 bp, mouse
gcactgctcccgagggaggg

SEQ ID NO: 690633 - DNA, 20 bp, mouse
gccgtccatgtgcccgatgg

SEQ ID NO: 690634 - DNA, 20 bp, mouse
gctaggcgctggtggggaag

SEQ ID NO: 690635 - DNA, 20 bp, mouse
gccagcgcctagagacgagg

SEQ ID NO: 690636 - DNA, 20 bp, mouse
gtgcgaggagcatgcgctca

SEQ ID NO: 690637 - DNA, 20 bp, mouse
ggaccctggtcgtgggggga

SEQ ID NO: 690638 - DNA, 20 bp, mouse
gggaggggcgcactgagcgg

SEQ ID NO: 690639 - DNA, 20 bp, mouse
gcacacaagctcatagaccc

SEQ ID NO: 690640 - DNA, 20 bp, mouse
gttcgcctggggaagtccca

SEQ ID NO: 690641 - DNA, 20 bp, mouse
ggctcatagaccctggtcgt

SEQ ID NO: 690642 - DNA, 20 bp, mouse
gagctggcgcggggcaaact

SEQ ID NO: 690643 - DNA, 20 bp, mouse
ggccgccccaccctccgcta

SEQ ID NO: 690644 - DNA, 20 bp, mouse
gcgcccctccccccacgacc

SEQ ID NO: 690645 - DNA, 20 bp, mouse
gcatagaccctggtcgtggg

SEQ ID NO: 690646 - DNA, 20 bp, mouse
ggtgcagcgcgcagaggtgg

SEQ ID NO: 690647 - DNA, 20 bp, mouse
ggacgcgggccggcgtaatg

SEQ ID NO: 690648 - DNA, 20 bp, mouse
gtacgccggcccgcgtccgt

SEQ ID NO: 690649 - DNA, 20 bp, mouse
gcgccgagcggctggcagat

SEQ ID NO: 690650 - DNA, 20 bp, mouse
ggccgcgcacccacggacgc

SEQ ID NO: 690651 - DNA, 20 bp, mouse
gcggcaatgcggtaccggag

SEQ ID NO: 690652 - DNA, 20 bp, mouse
ggcaatgatgcaccggagcg

SEQ ID NO: 690653 - DNA, 20 bp, mouse
gcagtacggcaatgcggtac

SEQ ID NO: 690654 - DNA, 20 bp, mouse
ggaaagatgcgtggacgcag

SEQ ID NO: 690655 - DNA, 20 bp, mouse
gggcgtaatgaggatccgag

SEQ ID NO: 690656 - DNA, 20 bp, mouse
gaaggccggcggacgacctg

SEQ ID NO: 690657 - DNA, 20 bp, mouse
gagggcgtttcccttcgttt

SEQ ID NO: 690658 - DNA, 20 bp, mouse
gggagctggtacccagtcaa

SEQ ID NO: 690659 - DNA, 20 bp, mouse
gtacgcggaggaccgagact

SEQ ID NO: 690660 - DNA, 20 bp, mouse
ggggcccacaggtcgtccgc

SEQ ID NO: 690661 - DNA, 20 bp, mouse
gagcccaccgagtagttccg

SEQ ID NO: 690662 - DNA, 20 bp, mouse
gggagacccggacaggtccg

SEQ ID NO: 690663 - DNA, 20 bp, mouse
gaaagacaagggaaggccgg

SEQ ID NO: 690664 - DNA, 20 bp, mouse
gaagtcgcagtggtacgcgg

SEQ ID NO: 690665 - DNA, 20 bp, mouse
ggcaaggcctcggctacttc

SEQ ID NO: 690666 - DNA, 20 bp, mouse
gaggtgaagcgcggctctca

SEQ ID NO: 690667 - DNA, 20 bp, mouse
gcagctcccggaaaacgcag

SEQ ID NO: 690668 - DNA, 20 bp, mouse
gcactcttcgagctgaggag

SEQ ID NO: 690669 - DNA, 20 bp, mouse
gcatcgtgatgcacgctctg

SEQ ID NO: 690670 - DNA, 20 bp, mouse
ggtcgctaggagcggagaac

SEQ ID NO: 690671 - DNA, 20 bp, mouse
gcaactcttgaggtgaagcg

SEQ ID NO: 690672 - DNA, 20 bp, mouse
gctcctagcgacaactcttg

SEQ ID NO: 690673 - DNA, 20 bp, mouse
gaccacgaaaggcacggcgg

SEQ ID NO: 690674 - DNA, 20 bp, mouse
gaccaccatggtagaagcaa

SEQ ID NO: 690675 - DNA, 20 bp, mouse
gttcgagctgaggaggggtt

SEQ ID NO: 690676 - DNA, 20 bp, mouse
gaaggggcggagtcagctca

SEQ ID NO: 690677 - DNA, 20 bp, mouse
gaaccacattcggagtccgg

SEQ ID NO: 690678 - DNA, 20 bp, mouse
gggagtcagctcaaggcagg

SEQ ID NO: 690679 - DNA, 20 bp, mouse
gaagcgcgcctgcgcgaaag

SEQ ID NO: 690680 - DNA, 20 bp, mouse
gccggtggattgctcacagt

SEQ ID NO: 690681 - DNA, 20 bp, mouse
ggggggcggttcgtaattaa

SEQ ID NO: 690682 - DNA, 20 bp, mouse
gcgcgcctgcgcgaaagggg

SEQ ID NO: 690683 - DNA, 20 bp, mouse
ggccaaccacattcggagtc

SEQ ID NO: 690684 - DNA, 20 bp, mouse
ggggcggggccaaccacatt

SEQ ID NO: 690685 - DNA, 20 bp, mouse
gggcggagtcagctcaaggc

SEQ ID NO: 690686 - DNA, 20 bp, mouse
gcgcctgcgtagtataactc

SEQ ID NO: 690687 - DNA, 20 bp, mouse
gaggagacggagctcaccca

SEQ ID NO: 690688 - DNA, 20 bp, mouse
gaggggtggggcccgcagcc

SEQ ID NO: 690689 - DNA, 20 bp, mouse
gtaagccgcaaaggagacaa

SEQ ID NO: 690690 - DNA, 20 bp, mouse
gttggaaaaagcgaggggtg

SEQ ID NO: 690691 - DNA, 20 bp, mouse
ggctgagttggaaaaagcga

SEQ ID NO: 690692 - DNA, 20 bp, mouse
gaaagcgaggacggcataaa

SEQ ID NO: 690693 - DNA, 20 bp, mouse
ggaaaagtgtgagaacccgg

SEQ ID NO: 690694 - DNA, 20 bp, mouse
ggaccaatcggaagcctgat

SEQ ID NO: 690695 - DNA, 20 bp, mouse
gcccctcgaaggctggtatc

SEQ ID NO: 690696 - DNA, 20 bp, mouse
ggaccctgggccaagatcca

SEQ ID NO: 690697 - DNA, 20 bp, mouse
ggcgtggctagctcagtctc

SEQ ID NO: 690698 - DNA, 20 bp, mouse
ggactgagctagccacgccc

SEQ ID NO: 690699 - DNA, 20 bp, mouse
gcgcgccgcagccactccca

SEQ ID NO: 690700 - DNA, 20 bp, mouse
gctaggagccagctgtggac

SEQ ID NO: 690701 - DNA, 20 bp, mouse
gggctcctagccaacccggc

SEQ ID NO: 690702 - DNA, 20 bp, mouse
ggtcacgtgacgcacccaac

SEQ ID NO: 690703 - DNA, 20 bp, mouse
gtgggccaagatccacggat

SEQ ID NO: 690704 - DNA, 20 bp, mouse
gactgccgtgggagtggctg

SEQ ID NO: 690705 - DNA, 20 bp, mouse
gttaacacttgaactgccgt

SEQ ID NO: 690706 - DNA, 20 bp, mouse
gaggggcaggaaccagatgt

SEQ ID NO: 690707 - DNA, 20 bp, mouse
gtgactcaaacgtacaaccc

SEQ ID NO: 690708 - DNA, 20 bp, mouse
gccaacttggcaggcatcgg

SEQ ID NO: 690709 - DNA, 20 bp, mouse
gccagatgtcggcccaagat

SEQ ID NO: 690710 - DNA, 20 bp, mouse
gggttcctgcccctgctgtg

SEQ ID NO: 690711 - DNA, 20 bp, mouse
gtcaatagcaccccacagca

SEQ ID NO: 690712 - DNA, 20 bp, mouse
gtcacctgtggtggggggat

SEQ ID NO: 690713 - DNA, 20 bp, mouse
gctactgtgaagttcacctg

SEQ ID NO: 690714 - DNA, 20 bp, mouse
gtgacttgagcctcaagata

SEQ ID NO: 690715 - DNA, 20 bp, mouse
ggctagaagaccctatcttg

SEQ ID NO: 690716 - DNA, 20 bp, mouse
gcagccgccgtgttgtcttc

SEQ ID NO: 690717 - DNA, 20 bp, mouse
ggagccagaagacaacacgg

SEQ ID NO: 690718 - DNA, 20 bp, mouse
gggaagcgttcaacaggcgg

SEQ ID NO: 690719 - DNA, 20 bp, mouse
gtgtctaggaagcgttcaac

SEQ ID NO: 690720 - DNA, 20 bp, mouse
ggaaatctaacgttagaccc

SEQ ID NO: 690721 - DNA, 20 bp, mouse
gggctcacgtggccgtcccc

SEQ ID NO: 690722 - DNA, 20 bp, mouse
gcaacacggcggctgcatgg

SEQ ID NO: 690723 - DNA, 20 bp, mouse
gctggggcgggactgacgca

SEQ ID NO: 690724 - DNA, 20 bp, mouse
gtcacgtggccgtccccggg

SEQ ID NO: 690725 - DNA, 20 bp, mouse
ggaacgcttcctagacacct

SEQ ID NO: 690726 - DNA, 20 bp, mouse
gactttgtggcgtggggagc

SEQ ID NO: 690727 - DNA, 20 bp, mouse
gcacagggcgggacaagagc

SEQ ID NO: 690728 - DNA, 20 bp, mouse
gaagagccggcctgctacct

SEQ ID NO: 690729 - DNA, 20 bp, mouse
gtggcagagcgcacacaggg

SEQ ID NO: 690730 - DNA, 20 bp, mouse
gtggcgagactttgtggcgt

SEQ ID NO: 690731 - DNA, 20 bp, mouse
gtctcgccagtctgagatta

SEQ ID NO: 690732 - DNA, 20 bp, mouse
gcacggaagcttccgccctc

SEQ ID NO: 690733 - DNA, 20 bp, mouse
gtgagtggaatgatgaaagg

SEQ ID NO: 690734 - DNA, 20 bp, mouse
gctatggcagagcgcacaca

SEQ ID NO: 690735 - DNA, 20 bp, mouse
ggaagcttccgtgccggaac

SEQ ID NO: 690736 - DNA, 20 bp, mouse
gcaggggcgggatcattggt

SEQ ID NO: 690737 - DNA, 20 bp, mouse
ggcgccaggggcgggatcat

SEQ ID NO: 690738 - DNA, 20 bp, mouse
gcggggcttgggcactgggc

SEQ ID NO: 690739 - DNA, 20 bp, mouse
gagggcggggcttgggcact

SEQ ID NO: 690740 - DNA, 20 bp, mouse
gtccccgcggcacgtagggg

SEQ ID NO: 690741 - DNA, 20 bp, mouse
gcgcctccccgcggcacgta

SEQ ID NO: 690742 - DNA, 20 bp, mouse
gtgggcactgggcgggcaga

SEQ ID NO: 690743 - DNA, 20 bp, mouse
ggggcgggacgcgagcgcca

SEQ ID NO: 690744 - DNA, 20 bp, mouse
gggacgcgagcgccaggggc

SEQ ID NO: 690745 - DNA, 20 bp, mouse
gaacataactagagcttggt

SEQ ID NO: 690746 - DNA, 20 bp, mouse
ggcaacgcctcaggtgaaag

SEQ ID NO: 690747 - DNA, 20 bp, mouse
gctgggcagtcaggactggc

SEQ ID NO: 690748 - DNA, 20 bp, mouse
gggctgggtgggacactgat

SEQ ID NO: 690749 - DNA, 20 bp, mouse
gcaggcacagtgtctgtgct

SEQ ID NO: 690750 - DNA, 20 bp, mouse
ggagcagccatggcaacggc

SEQ ID NO: 690751 - DNA, 20 bp, mouse
gaggctgaaacgctgcaact

SEQ ID NO: 690752 - DNA, 20 bp, mouse
gtcccacccagccgttgcca

SEQ ID NO: 690753 - DNA, 20 bp, mouse
gttcacctgaggcgttgcca

SEQ ID NO: 690754 - DNA, 20 bp, mouse
gagccatggcaacggctggg

SEQ ID NO: 690755 - DNA, 20 bp, mouse
gtctctcccccctccttctt

SEQ ID NO: 690756 - DNA, 20 bp, mouse
gcctgccagggcaaccctga

SEQ ID NO: 690757 - DNA, 20 bp, mouse
gttcctcaggggtgtggaag

SEQ ID NO: 690758 - DNA, 20 bp, mouse
gagcacgaaaggggcggagt

SEQ ID NO: 690759 - DNA, 20 bp, mouse
ggatgcagttgccaacacag

SEQ ID NO: 690760 - DNA, 20 bp, mouse
gtggcaggaggtctcaggta

SEQ ID NO: 690761 - DNA, 20 bp, mouse
gacgtgaatgagcacgaaag

SEQ ID NO: 690762 - DNA, 20 bp, mouse
ggcggagttgggccccctgg

SEQ ID NO: 690763 - DNA, 20 bp, mouse
gtggaagattaagggttcaa

SEQ ID NO: 690764 - DNA, 20 bp, mouse
gagggggttgtcctggtacc

SEQ ID NO: 690765 - DNA, 20 bp, mouse
gacttgggggtggaagatta

SEQ ID NO: 690766 - DNA, 20 bp, mouse
gcggggccaaggtctgggag

SEQ ID NO: 690767 - DNA, 20 bp, mouse
gaaggcccgctcccagacct

SEQ ID NO: 690768 - DNA, 20 bp, mouse
ggaaggcgatgcctgacgtg

SEQ ID NO: 690769 - DNA, 20 bp, mouse
gtcgtactgtcattggttaa

SEQ ID NO: 690770 - DNA, 20 bp, mouse
gtaaaggcgctgtttaacga

SEQ ID NO: 690771 - DNA, 20 bp, mouse
gagtacgaaatcaacgccag

SEQ ID NO: 690772 - DNA, 20 bp, mouse
ggacaagaaaaatcgagtag

SEQ ID NO: 690773 - DNA, 20 bp, mouse
gtggctcggagactgaccaa

SEQ ID NO: 690774 - DNA, 20 bp, mouse
gaagggaggtctggtacctc

SEQ ID NO: 690775 - DNA, 20 bp, mouse
gcgaagttgagtcccagcgg

SEQ ID NO: 690776 - DNA, 20 bp, mouse
gcctcccaaacccggaagtc

SEQ ID NO: 690777 - DNA, 20 bp, mouse
gctgaagataagatctgtga

SEQ ID NO: 690778 - DNA, 20 bp, mouse
gcgccgaagctcctgacttc

SEQ ID NO: 690779 - DNA, 20 bp, mouse
gtccacttgcaagaaggagg

SEQ ID NO: 690780 - DNA, 20 bp, mouse
ggtgctatgactgggtgtta

SEQ ID NO: 690781 - DNA, 20 bp, mouse
gctgcagcttacaagaaaat

SEQ ID NO: 690782 - DNA, 20 bp, mouse
gagcgcttccacttgcaaga

SEQ ID NO: 690783 - DNA, 20 bp, mouse
ggctcctgacttccgggttt

SEQ ID NO: 690784 - DNA, 20 bp, mouse
gtcccgcgctgggatacaag

SEQ ID NO: 690785 - DNA, 20 bp, mouse
gcttcagaatagggggccat

SEQ ID NO: 690786 - DNA, 20 bp, mouse
ggggcggggcctactaactg

SEQ ID NO: 690787 - DNA, 20 bp, mouse
ggtcagccgcggtccgacag

SEQ ID NO: 690788 - DNA, 20 bp, mouse
gtggggaggtggaacgttaa

SEQ ID NO: 690789 - DNA, 20 bp, mouse
gaggagggcgcgtgtggtgc

SEQ ID NO: 690790 - DNA, 20 bp, mouse
gcgcggctctggctcgtgct

SEQ ID NO: 690791 - DNA, 20 bp, mouse
gtggaacgttaaaggggccg

SEQ ID NO: 690792 - DNA, 20 bp, mouse
gccccgcccctgtcggaccg

SEQ ID NO: 690793 - DNA, 20 bp, mouse
gagccgcggtccgacagggg

SEQ ID NO: 690794 - DNA, 20 bp, mouse
gtcacgcaggagggcgcgtg

SEQ ID NO: 690795 - DNA, 20 bp, mouse
ggtctggagccacagttagt

SEQ ID NO: 690796 - DNA, 20 bp, mouse
gaggtctgcgcccggttctg

SEQ ID NO: 690797 - DNA, 20 bp, mouse
ggaaccctgcgggaccccgc

SEQ ID NO: 690798 - DNA, 20 bp, mouse
gttctggggcgcacctgaga

SEQ ID NO: 690799 - DNA, 20 bp, mouse
gacaaggcctggctcgggtg

SEQ ID NO: 690800 - DNA, 20 bp, mouse
gcgggcctcggttctggtgg

SEQ ID NO: 690801 - DNA, 20 bp, mouse
gcccgcccccaccagaaccg

SEQ ID NO: 690802 - DNA, 20 bp, mouse
gaaagcccctggatgcacgg

SEQ ID NO: 690803 - DNA, 20 bp, mouse
ggggccgccaggtctgcgcc

SEQ ID NO: 690804 - DNA, 20 bp, mouse
gcccctaggcccaaagaacg

SEQ ID NO: 690805 - DNA, 20 bp, mouse
gagtggctccgctcaggaga

SEQ ID NO: 690806 - DNA, 20 bp, mouse
gtagaacctaccatcaagct

SEQ ID NO: 690807 - DNA, 20 bp, mouse
gtggagacgctcaacaattt

SEQ ID NO: 690808 - DNA, 20 bp, mouse
gtactgtgaaattgtcccca

SEQ ID NO: 690809 - DNA, 20 bp, mouse
gtctgaggcaatgacccggg

SEQ ID NO: 690810 - DNA, 20 bp, mouse
gggttctgaggcaatgaccc

SEQ ID NO: 690811 - DNA, 20 bp, mouse
ggattctgaacgctgtgtaa

SEQ ID NO: 690812 - DNA, 20 bp, mouse
gcccggggttacagtaaatg

SEQ ID NO: 690813 - DNA, 20 bp, mouse
gtgttcttctggggtaccga

SEQ ID NO: 690814 - DNA, 20 bp, mouse
gggtaccccagaagaacacg

SEQ ID NO: 690815 - DNA, 20 bp, mouse
gcccgagcccaggtctgagc

SEQ ID NO: 690816 - DNA, 20 bp, mouse
gcctcccaaaaggagcacag

SEQ ID NO: 690817 - DNA, 20 bp, mouse
gcaaccgttattgttggcta

SEQ ID NO: 690818 - DNA, 20 bp, mouse
gggggcacagtcctaatcgg

SEQ ID NO: 690819 - DNA, 20 bp, mouse
gtgccctcagcactcctcat

SEQ ID NO: 690820 - DNA, 20 bp, mouse
gagcccctagccaacaataa

SEQ ID NO: 690821 - DNA, 20 bp, mouse
gcacaacaggcttgctgtat

SEQ ID NO: 690822 - DNA, 20 bp, mouse
ggacctgggacagcaggact

SEQ ID NO: 690823 - DNA, 20 bp, mouse
gccctttgggaggagcaagt

SEQ ID NO: 690824 - DNA, 20 bp, mouse
gccaacaataacggttgttc

SEQ ID NO: 690825 - DNA, 20 bp, mouse
gcaggcttgctgtatgggac

SEQ ID NO: 690826 - DNA, 20 bp, mouse
gaggctgagactctggggta

SEQ ID NO: 690827 - DNA, 20 bp, mouse
gaaagtctgctgcaggataa

SEQ ID NO: 690828 - DNA, 20 bp, mouse
ggtggttagaacagagggaa

SEQ ID NO: 690829 - DNA, 20 bp, mouse
gacactgtggttagaacaga

SEQ ID NO: 690830 - DNA, 20 bp, mouse
gtatgctagggggataggtc

SEQ ID NO: 690831 - DNA, 20 bp, mouse
gccccctagcataagctatc

SEQ ID NO: 690832 - DNA, 20 bp, mouse
gggtgggtctagagtgtgtg

SEQ ID NO: 690833 - DNA, 20 bp, mouse
gaggttgccactctgtgtgg

SEQ ID NO: 690834 - DNA, 20 bp, mouse
gtgctcagtggtaccatcag

SEQ ID NO: 690835 - DNA, 20 bp, mouse
gacatcagatgcccttcagg

SEQ ID NO: 690836 - DNA, 20 bp, mouse
gtatagacgaaagtgatctg

SEQ ID NO: 690837 - DNA, 20 bp, mouse
gaatacccgggcgtacctgc

SEQ ID NO: 690838 - DNA, 20 bp, mouse
gttgtcctgaggaccctcca

SEQ ID NO: 690839 - DNA, 20 bp, mouse
gcagagggatcagatgtctt

SEQ ID NO: 690840 - DNA, 20 bp, mouse
gttgtccagcaggtacgccc

SEQ ID NO: 690841 - DNA, 20 bp, mouse
ggttcaaagtacagctgccg

SEQ ID NO: 690842 - DNA, 20 bp, mouse
gtattcagtgtcatgctttc

SEQ ID NO: 690843 - DNA, 20 bp, mouse
gaagctccctagggatgact

SEQ ID NO: 690844 - DNA, 20 bp, mouse
gcacgagtgtaggtacccgc

SEQ ID NO: 690845 - DNA, 20 bp, mouse
gtttagccaagtcatcccta

SEQ ID NO: 690846 - DNA, 20 bp, mouse
gggggcaggtccatgggaca

SEQ ID NO: 690847 - DNA, 20 bp, mouse
gcctccggaaatgctgtccc

SEQ ID NO: 690848 - DNA, 20 bp, mouse
gacaccccacacctctccca

SEQ ID NO: 690849 - DNA, 20 bp, mouse
gagggtacgtcccaggtgga

SEQ ID NO: 690850 - DNA, 20 bp, mouse
ggcggagccagacaagattc

SEQ ID NO: 690851 - DNA, 20 bp, mouse
gtccggaggaagtccttcct

SEQ ID NO: 690852 - DNA, 20 bp, mouse
gcctaggcccgaatcttgtc

SEQ ID NO: 690853 - DNA, 20 bp, mouse
gctcccagggacagcatttc

SEQ ID NO: 690854 - DNA, 20 bp, mouse
gaaccagggtacgtcccagg

SEQ ID NO: 690855 - DNA, 20 bp, mouse
ggagttgcgattggccaagg

SEQ ID NO: 690856 - DNA, 20 bp, mouse
gcgtgcgctgcatgcggctg

SEQ ID NO: 690857 - DNA, 20 bp, mouse
gaaatggtgcagggagtcta

SEQ ID NO: 690858 - DNA, 20 bp, mouse
gcacaaaacagcaacgtctg

SEQ ID NO: 690859 - DNA, 20 bp, mouse
gctcgcgcggagactgtttc

SEQ ID NO: 690860 - DNA, 20 bp, mouse
gaacagcaacgtctggggaa

SEQ ID NO: 690861 - DNA, 20 bp, mouse
gtctggggaagggataccta

SEQ ID NO: 690862 - DNA, 20 bp, mouse
gatgtccacaatagtgagga

SEQ ID NO: 690863 - DNA, 20 bp, mouse
ggagggtcgtgcgctgcatg

SEQ ID NO: 690864 - DNA, 20 bp, mouse
ggtgttggaagggtagaggt

SEQ ID NO: 690865 - DNA, 20 bp, mouse
gacgaccctcctcactattg

SEQ ID NO: 690866 - DNA, 20 bp, mouse
ggaaaaagagccacggaaaa

SEQ ID NO: 690867 - DNA, 20 bp, mouse
gaagagacaggatgtggtac

SEQ ID NO: 690868 - DNA, 20 bp, mouse
gagtagttacagtcggttgt

SEQ ID NO: 690869 - DNA, 20 bp, mouse
gcagttaaaaactcccgcag

SEQ ID NO: 690870 - DNA, 20 bp, mouse
gaggtttctgccgttttccg

SEQ ID NO: 690871 - DNA, 20 bp, mouse
ggaattgtattggccttgaa

SEQ ID NO: 690872 - DNA, 20 bp, mouse
gttaactatatgaattgtat

SEQ ID NO: 690873 - DNA, 20 bp, mouse
gaaaacactcacacatagct

SEQ ID NO: 690874 - DNA, 20 bp, mouse
gcaattcctagcagccaaga

SEQ ID NO: 690875 - DNA, 20 bp, mouse
gcatgtatgtctatgtattg

SEQ ID NO: 690876 - DNA, 20 bp, mouse
gacaggatgcccagacaaga

SEQ ID NO: 690877 - DNA, 20 bp, mouse
ggggcatcctgtgattagaa

SEQ ID NO: 690878 - DNA, 20 bp, mouse
gacaataagggtgaatggaa

SEQ ID NO: 690879 - DNA, 20 bp, mouse
ggaaagacccacagtgaagc

SEQ ID NO: 690880 - DNA, 20 bp, mouse
gatgacctggcagaactgga

SEQ ID NO: 690881 - DNA, 20 bp, mouse
gcaagtgcatccttcttgtc

SEQ ID NO: 690882 - DNA, 20 bp, mouse
gcttggggagccatgctaaa

SEQ ID NO: 690883 - DNA, 20 bp, mouse
gaaaaatgccataagaagtc

SEQ ID NO: 690884 - DNA, 20 bp, mouse
gctgagtgccacagcagctt

SEQ ID NO: 690885 - DNA, 20 bp, mouse
ggggccaggatattgattgt

SEQ ID NO: 690886 - DNA, 20 bp, mouse
ggacgcgggcggctgtctga

SEQ ID NO: 690887 - DNA, 20 bp, mouse
ggagctacgcgctctagtaa

SEQ ID NO: 690888 - DNA, 20 bp, mouse
gaggaactggttacagtgat

SEQ ID NO: 690889 - DNA, 20 bp, mouse
gtagctccagcgcctcccat

SEQ ID NO: 690890 - DNA, 20 bp, mouse
gagggcaaaagaactgagtc

SEQ ID NO: 690891 - DNA, 20 bp, mouse
ggatagggatggggagcgat

SEQ ID NO: 690892 - DNA, 20 bp, mouse
gtctggtgacaatagcggaa

SEQ ID NO: 690893 - DNA, 20 bp, mouse
ggggctgggcggccacggtc

SEQ ID NO: 690894 - DNA, 20 bp, mouse
ggcagagaacggccggccga

SEQ ID NO: 690895 - DNA, 20 bp, mouse
gcagcctctggtgacaatag

SEQ ID NO: 690896 - DNA, 20 bp, mouse
gcccaggcttccaaccacgc

SEQ ID NO: 690897 - DNA, 20 bp, mouse
gaaggcgcgccttttggcgt

SEQ ID NO: 690898 - DNA, 20 bp, mouse
ggcgcgccttcccgcgtggt

SEQ ID NO: 690899 - DNA, 20 bp, mouse
gcctaatgcagaggataact

SEQ ID NO: 690900 - DNA, 20 bp, mouse
ggaagtagggcgaagggggg

SEQ ID NO: 690901 - DNA, 20 bp, mouse
gtgtgaatcagggtaccaag

SEQ ID NO: 690902 - DNA, 20 bp, mouse
ggcaaagtctaaaagctcca

SEQ ID NO: 690903 - DNA, 20 bp, mouse
gttttggcgttggggtctag

SEQ ID NO: 690904 - DNA, 20 bp, mouse
gggagaagtagggcgaaggg

SEQ ID NO: 690905 - DNA, 20 bp, mouse
gtctcaaattcctgtgaatc

SEQ ID NO: 690906 - DNA, 20 bp, mouse
ggggtcggggtccctccccc

SEQ ID NO: 690907 - DNA, 20 bp, mouse
ggggagggaccccgaccccc

SEQ ID NO: 690908 - DNA, 20 bp, mouse
gcggaggcacaggttagata

SEQ ID NO: 690909 - DNA, 20 bp, mouse
gtggcccccaaactcaccta

SEQ ID NO: 690910 - DNA, 20 bp, mouse
ggattcctgagcccgcgcca

SEQ ID NO: 690911 - DNA, 20 bp, mouse
gcggagaagccggggggtcg

SEQ ID NO: 690912 - DNA, 20 bp, mouse
ggcgccgcgggggaccgggt

SEQ ID NO: 690913 - DNA, 20 bp, mouse
gggctcaggaatccgccgaa

SEQ ID NO: 690914 - DNA, 20 bp, mouse
ggaggcgccggggtgggccg

SEQ ID NO: 690915 - DNA, 20 bp, mouse
ggcacagcatgggattccgg

SEQ ID NO: 690916 - DNA, 20 bp, mouse
gccctggagaaagctttcaa

SEQ ID NO: 690917 - DNA, 20 bp, mouse
gggagcacgaaacagaaact

SEQ ID NO: 690918 - DNA, 20 bp, mouse
gcagactgatgctagggaga

SEQ ID NO: 690919 - DNA, 20 bp, mouse
gacaaaagccagatagtcgc

SEQ ID NO: 690920 - DNA, 20 bp, mouse
gaatgtgcgagggagaagtt

SEQ ID NO: 690921 - DNA, 20 bp, mouse
gtatccacctgaatgtgcga

SEQ ID NO: 690922 - DNA, 20 bp, mouse
gagggagaagttggggattc

SEQ ID NO: 690923 - DNA, 20 bp, mouse
gtccagggcccgcgactatc

SEQ ID NO: 690924 - DNA, 20 bp, mouse
ggagtgtataacttgggaaa

SEQ ID NO: 690925 - DNA, 20 bp, mouse
gcgccccaagtctgtttccc

SEQ ID NO: 690926 - DNA, 20 bp, mouse
gaggaggggaggatgttagg

SEQ ID NO: 690927 - DNA, 20 bp, mouse
gaggacgtggctaatgggtg

SEQ ID NO: 690928 - DNA, 20 bp, mouse
gggctcgcgcagtgaggtct

SEQ ID NO: 690929 - DNA, 20 bp, mouse
gacactagtcgagagagggg

SEQ ID NO: 690930 - DNA, 20 bp, mouse
gagtcagtagtgctgtgcgc

SEQ ID NO: 690931 - DNA, 20 bp, mouse
ggaggatgcaacctaggggt

SEQ ID NO: 690932 - DNA, 20 bp, mouse
gcgggcctctccagactccc

SEQ ID NO: 690933 - DNA, 20 bp, mouse
gtcccagaggatgcaaccta

SEQ ID NO: 690934 - DNA, 20 bp, mouse
gggccacaggacgtggctaa

SEQ ID NO: 690935 - DNA, 20 bp, mouse
gaggggtgggctgaagaaag

SEQ ID NO: 690936 - DNA, 20 bp, mouse
gagtggaggtggggacgacg

SEQ ID NO: 690937 - DNA, 20 bp, mouse
ggggcggggtcgagtccgca

SEQ ID NO: 690938 - DNA, 20 bp, mouse
ggggtcttagggcggaacca

SEQ ID NO: 690939 - DNA, 20 bp, mouse
gggcggaaccatggtctggg

SEQ ID NO: 690940 - DNA, 20 bp, mouse
ggaggtggggacgacggggc

SEQ ID NO: 690941 - DNA, 20 bp, mouse
ggaccagtggggtcagaaac

SEQ ID NO: 690942 - DNA, 20 bp, mouse
ggggtagggtaggggtctta

SEQ ID NO: 690943 - DNA, 20 bp, mouse
gccggagatagcgtcatgga

SEQ ID NO: 690944 - DNA, 20 bp, mouse
gttagggcggaaccatggtc

SEQ ID NO: 690945 - DNA, 20 bp, mouse
gggaggggctaagataggcg

SEQ ID NO: 690946 - DNA, 20 bp, mouse
gtctactggacaggggacaa

SEQ ID NO: 690947 - DNA, 20 bp, mouse
gaggactatctactggacag

SEQ ID NO: 690948 - DNA, 20 bp, mouse
ggggatcaccagttcccaaa

SEQ ID NO: 690949 - DNA, 20 bp, mouse
gcggagctgcggctttaagg

SEQ ID NO: 690950 - DNA, 20 bp, mouse
gtcagggtccatgtctggac

SEQ ID NO: 690951 - DNA, 20 bp, mouse
ggagtgtctgcgcgtcctag

SEQ ID NO: 690952 - DNA, 20 bp, mouse
ggtgcagtaggactatctac

SEQ ID NO: 690953 - DNA, 20 bp, mouse
gggaatcgctcggggcccgg

SEQ ID NO: 690954 - DNA, 20 bp, mouse
gaggccgcgagctccctggt

SEQ ID NO: 690955 - DNA, 20 bp, mouse
gaagagcaagagttgatttc

SEQ ID NO: 690956 - DNA, 20 bp, mouse
gagggaggggaacgatgatg

SEQ ID NO: 690957 - DNA, 20 bp, mouse
ggaccctcttccctcccgaa

SEQ ID NO: 690958 - DNA, 20 bp, mouse
gccccctccggggatagaga

SEQ ID NO: 690959 - DNA, 20 bp, mouse
gcctggcggcggggagtgtc

SEQ ID NO: 690960 - DNA, 20 bp, mouse
gacccggcacgcggcaaagg

SEQ ID NO: 690961 - DNA, 20 bp, mouse
ggccctgaaggtgggactta

SEQ ID NO: 690962 - DNA, 20 bp, mouse
gcggcacgcggcaaaggcgg

SEQ ID NO: 690963 - DNA, 20 bp, mouse
ggggaacgatgatgaggagc

SEQ ID NO: 690964 - DNA, 20 bp, mouse
gaacccttcgggagggaaga

SEQ ID NO: 690965 - DNA, 20 bp, mouse
gggaggtggctgtgtgttca

SEQ ID NO: 690966 - DNA, 20 bp, mouse
ggactcccatatctcagcga

SEQ ID NO: 690967 - DNA, 20 bp, mouse
gggcttgatggctacgttgg

SEQ ID NO: 690968 - DNA, 20 bp, mouse
gggaggatctgtgcagaccc

SEQ ID NO: 690969 - DNA, 20 bp, mouse
ggaggaagggaaaaagactc

SEQ ID NO: 690970 - DNA, 20 bp, mouse
gctctccgtcgctgagatat

SEQ ID NO: 690971 - DNA, 20 bp, mouse
gtcagcgacggagagcgctc

SEQ ID NO: 690972 - DNA, 20 bp, mouse
gatggctacgttggaggtgg

SEQ ID NO: 690973 - DNA, 20 bp, mouse
gtgggtgtgaatctcaggaa

SEQ ID NO: 690974 - DNA, 20 bp, mouse
gaagtgagcacacacagcta

SEQ ID NO: 690975 - DNA, 20 bp, mouse
ggctgtgtgtgctcacttac

SEQ ID NO: 690976 - DNA, 20 bp, mouse
gggcccccgccgtagaccgc

SEQ ID NO: 690977 - DNA, 20 bp, mouse
gccagcggggacaaaggcga

SEQ ID NO: 690978 - DNA, 20 bp, mouse
gcgcccgcggtctacggcgg

SEQ ID NO: 690979 - DNA, 20 bp, mouse
gaccctccaagacgctccag

SEQ ID NO: 690980 - DNA, 20 bp, mouse
ggcgggaccctggggatccg

SEQ ID NO: 690981 - DNA, 20 bp, mouse
gtctcggcgcccgcggtcta

SEQ ID NO: 690982 - DNA, 20 bp, mouse
gcggcgctccgcccgctcgg

SEQ ID NO: 690983 - DNA, 20 bp, mouse
gccgccgccgcctggtttct

SEQ ID NO: 690984 - DNA, 20 bp, mouse
gcgcggggcagaggcccgag

SEQ ID NO: 690985 - DNA, 20 bp, mouse
gaggctagggcgggaccctg

SEQ ID NO: 690986 - DNA, 20 bp, mouse
gcgcgctctgggctcaagtg

SEQ ID NO: 690987 - DNA, 20 bp, mouse
ggaggcgcgttgttcctaaa

SEQ ID NO: 690988 - DNA, 20 bp, mouse
gtgggcgtgactaagattgg

SEQ ID NO: 690989 - DNA, 20 bp, mouse
gcccctggcgcgctcacgcg

SEQ ID NO: 690990 - DNA, 20 bp, mouse
ggctctgggctcaagtgggg

SEQ ID NO: 690991 - DNA, 20 bp, mouse
gctaaaggggctacacagta

SEQ ID NO: 690992 - DNA, 20 bp, mouse
gcccagagcgcgccgcgcgt

SEQ ID NO: 690993 - DNA, 20 bp, mouse
gtcaacgcccccacactcta

SEQ ID NO: 690994 - DNA, 20 bp, mouse
gggcgcgcccagaagggcgg

SEQ ID NO: 690995 - DNA, 20 bp, mouse
gccccagaaggtgacactct

SEQ ID NO: 690996 - DNA, 20 bp, mouse
gagcacagtgagataacaaa

SEQ ID NO: 690997 - DNA, 20 bp, mouse
gggcggagacaagttttcat

SEQ ID NO: 690998 - DNA, 20 bp, mouse
gagataacaaagggacgctt

SEQ ID NO: 690999 - DNA, 20 bp, mouse
gttggcgctgagtagagagg

SEQ ID NO: 691000 - DNA, 20 bp, mouse
gcggggcacaggaagcacaa

SEQ ID NO: 691001 - DNA, 20 bp, mouse
ggggggtggggggtacggaa

SEQ ID NO: 691002 - DNA, 20 bp, mouse
gcctgtgccccgagcgctcc

SEQ ID NO: 691003 - DNA, 20 bp, mouse
ggctcctagaccacagccct

SEQ ID NO: 691004 - DNA, 20 bp, mouse
gacaaagggttaacaagagt

SEQ ID NO: 691005 - DNA, 20 bp, mouse
gctggaagagggtggcatgg

SEQ ID NO: 691006 - DNA, 20 bp, mouse
gggcctgtcgagtccagagg

SEQ ID NO: 691007 - DNA, 20 bp, mouse
gcgccccctctggactcgac

SEQ ID NO: 691008 - DNA, 20 bp, mouse
ggcaatgtccaggcctgaga

SEQ ID NO: 691009 - DNA, 20 bp, mouse
gggacagtaaggtgattgtg

SEQ ID NO: 691010 - DNA, 20 bp, mouse
gacaacttggggttgttggg

SEQ ID NO: 691011 - DNA, 20 bp, mouse
gctcacttccacactcctag

SEQ ID NO: 691012 - DNA, 20 bp, mouse
ggatgctgcctgcaatgtcc

SEQ ID NO: 691013 - DNA, 20 bp, mouse
gccacactcctagaggatgt

SEQ ID NO: 691014 - DNA, 20 bp, mouse
gaggagagggcacccctctc

SEQ ID NO: 691015 - DNA, 20 bp, mouse
ggaggatgtgggatagtatt

SEQ ID NO: 691016 - DNA, 20 bp, mouse
ggggcttcggggagctcata

SEQ ID NO: 691017 - DNA, 20 bp, mouse
gccctgggaaccagactaag

SEQ ID NO: 691018 - DNA, 20 bp, mouse
gaaggacgctgctctctcga

SEQ ID NO: 691019 - DNA, 20 bp, mouse
gcaggcaggctgacagaagt

SEQ ID NO: 691020 - DNA, 20 bp, mouse
ggctctgtgggcgtggtatg

SEQ ID NO: 691021 - DNA, 20 bp, mouse
gacggggtccaacagagtgt

SEQ ID NO: 691022 - DNA, 20 bp, mouse
gtggcacgaatctgaatgtg

SEQ ID NO: 691023 - DNA, 20 bp, mouse
gggcaccgagtgggattctg

SEQ ID NO: 691024 - DNA, 20 bp, mouse
gagtgggccgggtgctgacc

SEQ ID NO: 691025 - DNA, 20 bp, mouse
gacagaagtgggcaccgagt

SEQ ID NO: 691026 - DNA, 20 bp, mouse
ggcccagcggggctcgtcct

SEQ ID NO: 691027 - DNA, 20 bp, mouse
gacactgggcacccagaggt

SEQ ID NO: 691028 - DNA, 20 bp, mouse
gtagggggcggcagactgac

SEQ ID NO: 691029 - DNA, 20 bp, mouse
ggggtgcccagtgtcgggta

SEQ ID NO: 691030 - DNA, 20 bp, mouse
gaggcgaccaaccctgtgcc

SEQ ID NO: 691031 - DNA, 20 bp, mouse
gccgccccctacccgacact

SEQ ID NO: 691032 - DNA, 20 bp, mouse
gtcaggggcgccctacctct

SEQ ID NO: 691033 - DNA, 20 bp, mouse
gtctcgccctatcctagcga

SEQ ID NO: 691034 - DNA, 20 bp, mouse
ggtgaccctgctggtgcgag

SEQ ID NO: 691035 - DNA, 20 bp, mouse
gccgctgggcgccgggcaca

SEQ ID NO: 691036 - DNA, 20 bp, mouse
gaggcggggtggcggacggg

SEQ ID NO: 691037 - DNA, 20 bp, mouse
ggcgaggcggggtggcggac

SEQ ID NO: 691038 - DNA, 20 bp, mouse
ggaggtgtgcgaggtgaggg

SEQ ID NO: 691039 - DNA, 20 bp, mouse
gacgggaggtgtgcgaggtg

SEQ ID NO: 691040 - DNA, 20 bp, mouse
gcaaacgctcgggcaatcgg

SEQ ID NO: 691041 - DNA, 20 bp, mouse
gagctggagcacagtcggag

SEQ ID NO: 691042 - DNA, 20 bp, mouse
gggcggacgggaggtgtgcg

SEQ ID NO: 691043 - DNA, 20 bp, mouse
gctctggcagtgtccgtctc

SEQ ID NO: 691044 - DNA, 20 bp, mouse
gcggacactgccagagacaa

SEQ ID NO: 691045 - DNA, 20 bp, mouse
gaagggggaaggttttttcg

SEQ ID NO: 691046 - DNA, 20 bp, mouse
gcccccaagcggtgactgct

SEQ ID NO: 691047 - DNA, 20 bp, mouse
gttaactccaaggtcacttt

SEQ ID NO: 691048 - DNA, 20 bp, mouse
gtacctgcagagtgggcagc

SEQ ID NO: 691049 - DNA, 20 bp, mouse
gttcctgctgcccactctgc

SEQ ID NO: 691050 - DNA, 20 bp, mouse
gtggcccttacctgcagagt

SEQ ID NO: 691051 - DNA, 20 bp, mouse
gacggggcgcggatcacggc

SEQ ID NO: 691052 - DNA, 20 bp, mouse
ggcccaccgcgtcgtcgacg

SEQ ID NO: 691053 - DNA, 20 bp, mouse
ggccccgtcgacgacgcggt

SEQ ID NO: 691054 - DNA, 20 bp, mouse
ggggctttccgacacaaatc

SEQ ID NO: 691055 - DNA, 20 bp, mouse
gagatccgaacgggagcctg

SEQ ID NO: 691056 - DNA, 20 bp, mouse
gccaggagctggaattcgga

SEQ ID NO: 691057 - DNA, 20 bp, mouse
gagagggtccgggatggagg

SEQ ID NO: 691058 - DNA, 20 bp, mouse
ggcagcccgccagtggccaa

SEQ ID NO: 691059 - DNA, 20 bp, mouse
ggggcgtcaggtaggtaaaa

SEQ ID NO: 691060 - DNA, 20 bp, mouse
ggcttcctggggcgtcaggt

SEQ ID NO: 691061 - DNA, 20 bp, mouse
gcccgccgccggccccccat

SEQ ID NO: 691062 - DNA, 20 bp, mouse
ggcggcgggcgggacagagc

SEQ ID NO: 691063 - DNA, 20 bp, mouse
gcgcccccttggccactggc

SEQ ID NO: 691064 - DNA, 20 bp, mouse
gctctggtccgcaagctagg

SEQ ID NO: 691065 - DNA, 20 bp, mouse
gcaagctaggcggcgcgcag

SEQ ID NO: 691066 - DNA, 20 bp, mouse
gccgccgcgcgctagggtcc

SEQ ID NO: 691067 - DNA, 20 bp, mouse
gcaggggctcaaaccggctg

SEQ ID NO: 691068 - DNA, 20 bp, mouse
gccgcgcgctagggtcccgg

SEQ ID NO: 691069 - DNA, 20 bp, mouse
ggggaggtccagagggccac

SEQ ID NO: 691070 - DNA, 20 bp, mouse
gtgagccggggaggtccaga

SEQ ID NO: 691071 - DNA, 20 bp, mouse
gactttgcaggggctcaaac

SEQ ID NO: 691072 - DNA, 20 bp, mouse
gctcgggaaagacagatgtg

SEQ ID NO: 691073 - DNA, 20 bp, mouse
gtcagcgtgctcaaaccgcc

SEQ ID NO: 691074 - DNA, 20 bp, mouse
ggggctcaaaccggctgcgg

SEQ ID NO: 691075 - DNA, 20 bp, mouse
gagaggcgtggggctggcgg

SEQ ID NO: 691076 - DNA, 20 bp, mouse
gcgtccccctccgcaggctt

SEQ ID NO: 691077 - DNA, 20 bp, mouse
gccgccgcgcacacccccta

SEQ ID NO: 691078 - DNA, 20 bp, mouse
gctccagcgtccccctccgc

SEQ ID NO: 691079 - DNA, 20 bp, mouse
gtagcagagcataaggtcgg

SEQ ID NO: 691080 - DNA, 20 bp, mouse
gacagcgtccgccgtcgtca

SEQ ID NO: 691081 - DNA, 20 bp, mouse
gcagcctaagcctgcggagg

SEQ ID NO: 691082 - DNA, 20 bp, mouse
gcgcggaactccaagttgaa

SEQ ID NO: 691083 - DNA, 20 bp, mouse
gtctcctccggttcaggcaa

SEQ ID NO: 691084 - DNA, 20 bp, mouse
gtccgcggtcgccttgacga

SEQ ID NO: 691085 - DNA, 20 bp, mouse
gaggcaagggagtccttagg

SEQ ID NO: 691086 - DNA, 20 bp, mouse
gtggccccggagacagaaat

SEQ ID NO: 691087 - DNA, 20 bp, mouse
gtcgccggaccgcctcgcct

SEQ ID NO: 691088 - DNA, 20 bp, mouse
gaggccggaggattctgatc

SEQ ID NO: 691089 - DNA, 20 bp, mouse
ggccttcgggccggtcacgt

SEQ ID NO: 691090 - DNA, 20 bp, mouse
gccggcgcccggcgctagga

SEQ ID NO: 691091 - DNA, 20 bp, mouse
gaggaccccgagcgcgtcgc

SEQ ID NO: 691092 - DNA, 20 bp, mouse
ggaacagcttcgagaaattc

SEQ ID NO: 691093 - DNA, 20 bp, mouse
gcgccttaggacagcctgaa

SEQ ID NO: 691094 - DNA, 20 bp, mouse
ggcgcctgatcagaatcctc

SEQ ID NO: 691095 - DNA, 20 bp, mouse
gggagtccaagactgggtga

SEQ ID NO: 691096 - DNA, 20 bp, mouse
ggtagcagctatctcctctc

SEQ ID NO: 691097 - DNA, 20 bp, mouse
gagggggaaagagcaatttg

SEQ ID NO: 691098 - DNA, 20 bp, mouse
gggcacagctaatggttcca

SEQ ID NO: 691099 - DNA, 20 bp, mouse
gcctgccttcctgcttgctc

SEQ ID NO: 691100 - DNA, 20 bp, mouse
gaaaatattcagggtagaga

SEQ ID NO: 691101 - DNA, 20 bp, mouse
ggggggtgtggcacagctaa

SEQ ID NO: 691102 - DNA, 20 bp, mouse
gagccagaagagctttaaaa

SEQ ID NO: 691103 - DNA, 20 bp, mouse
gggctacagggatttccctt

SEQ ID NO: 691104 - DNA, 20 bp, mouse
ggacataagcagtactcagc

SEQ ID NO: 691105 - DNA, 20 bp, mouse
gtctcatggtgtttgcaaag

SEQ ID NO: 691106 - DNA, 20 bp, mouse
gtggccaccacgcgctcctt

SEQ ID NO: 691107 - DNA, 20 bp, mouse
gtgacagcccaaggagcgcg

SEQ ID NO: 691108 - DNA, 20 bp, mouse
gggggcggaggatgctcaaa

SEQ ID NO: 691109 - DNA, 20 bp, mouse
gtcagctccctcccacctgg

SEQ ID NO: 691110 - DNA, 20 bp, mouse
gtaagcgctccggaggggct

SEQ ID NO: 691111 - DNA, 20 bp, mouse
gtccaaggggctccgggcgg

SEQ ID NO: 691112 - DNA, 20 bp, mouse
gcagcccaaggagcgcgtgg

SEQ ID NO: 691113 - DNA, 20 bp, mouse
gggaggatgctcaaagggtt

SEQ ID NO: 691114 - DNA, 20 bp, mouse
gtcacagcctccaggtggga

SEQ ID NO: 691115 - DNA, 20 bp, mouse
gccccaaggcccttccagaa

SEQ ID NO: 691116 - DNA, 20 bp, mouse
gggtgctggcggggacttgg

SEQ ID NO: 691117 - DNA, 20 bp, mouse
ggcctcgtgggtcgtcctgg

SEQ ID NO: 691118 - DNA, 20 bp, mouse
ggggagcgtggaggagttac

SEQ ID NO: 691119 - DNA, 20 bp, mouse
gagtgagtgaactgaagcgg

SEQ ID NO: 691120 - DNA, 20 bp, mouse
ggcctccaggacgacccacg

SEQ ID NO: 691121 - DNA, 20 bp, mouse
ggggtgagagaagagcgtgg

SEQ ID NO: 691122 - DNA, 20 bp, mouse
ggcaactgagcacatctggc

SEQ ID NO: 691123 - DNA, 20 bp, mouse
gcgctccggtgcaccagcga

SEQ ID NO: 691124 - DNA, 20 bp, mouse
gccctggagagatactctgt

SEQ ID NO: 691125 - DNA, 20 bp, mouse
gtgtagtgagtgaactgaag

SEQ ID NO: 691126 - DNA, 20 bp, mouse
ggggctgaggaggtcattaa

SEQ ID NO: 691127 - DNA, 20 bp, mouse
gtgaccaaactgtggaggag

SEQ ID NO: 691128 - DNA, 20 bp, mouse
gtgaggaggtcattaaggga

SEQ ID NO: 691129 - DNA, 20 bp, mouse
gcgaacaaacaggaggccaa

SEQ ID NO: 691130 - DNA, 20 bp, mouse
ggatccgtcagcgaacaaac

SEQ ID NO: 691131 - DNA, 20 bp, mouse
ggagctgcgtgcaaccaggg

SEQ ID NO: 691132 - DNA, 20 bp, mouse
ggggccacaagacatccatg

SEQ ID NO: 691133 - DNA, 20 bp, mouse
gggggtctctgactgcttca

SEQ ID NO: 691134 - DNA, 20 bp, mouse
gggaggtcattaagggaggg

SEQ ID NO: 691135 - DNA, 20 bp, mouse
ggttgctcctgaacataggt

SEQ ID NO: 691136 - DNA, 20 bp, mouse
ggggcctaacttcccatcaa

SEQ ID NO: 691137 - DNA, 20 bp, mouse
gctactggagggatagaaca

SEQ ID NO: 691138 - DNA, 20 bp, mouse
ggggaagttaggcccagcct

SEQ ID NO: 691139 - DNA, 20 bp, mouse
gaatgaccagtcctcactga

SEQ ID NO: 691140 - DNA, 20 bp, mouse
gtggtggttggcctagggac

SEQ ID NO: 691141 - DNA, 20 bp, mouse
ggagctaaacagcaaaaagg

SEQ ID NO: 691142 - DNA, 20 bp, mouse
ggcagctggctcatatgcct

SEQ ID NO: 691143 - DNA, 20 bp, mouse
gaggtgctgcatggactgat

SEQ ID NO: 691144 - DNA, 20 bp, mouse
gcagcttggtggttggccta

SEQ ID NO: 691145 - DNA, 20 bp, mouse
gtcccatcaaaggatgcgcc

SEQ ID NO: 691146 - DNA, 20 bp, mouse
gagactgtgggataatgtga

SEQ ID NO: 691147 - DNA, 20 bp, mouse
ggagccgggaacttctgatt

SEQ ID NO: 691148 - DNA, 20 bp, mouse
gcacttggctgaagagaaga

SEQ ID NO: 691149 - DNA, 20 bp, mouse
ggggacctccgaaattgtgt

SEQ ID NO: 691150 - DNA, 20 bp, mouse
ggtcctgctggagcaacact

SEQ ID NO: 691151 - DNA, 20 bp, mouse
gagtctcttaggctgaaagg

SEQ ID NO: 691152 - DNA, 20 bp, mouse
ggggcagcccaaggcaccaa

SEQ ID NO: 691153 - DNA, 20 bp, mouse
gtagctcctcagacccaggc

SEQ ID NO: 691154 - DNA, 20 bp, mouse
gtcttgatggcatttgttgg

SEQ ID NO: 691155 - DNA, 20 bp, mouse
gacaaagcaagagcaggtca

SEQ ID NO: 691156 - DNA, 20 bp, mouse
gctaggtcacccgcggggaa

SEQ ID NO: 691157 - DNA, 20 bp, mouse
gtagtggaagaacgaggggc

SEQ ID NO: 691158 - DNA, 20 bp, mouse
gactgcgggcccagggtcct

SEQ ID NO: 691159 - DNA, 20 bp, mouse
ggggcccgcagtctgagtca

SEQ ID NO: 691160 - DNA, 20 bp, mouse
ggcaccaaaccaaaagttaa

SEQ ID NO: 691161 - DNA, 20 bp, mouse
ggggagcaagccacctagag

SEQ ID NO: 691162 - DNA, 20 bp, mouse
gggtcgagccgccctccctc

SEQ ID NO: 691163 - DNA, 20 bp, mouse
gggctgtcggcgccggaggt

SEQ ID NO: 691164 - DNA, 20 bp, mouse
ggcactggccgccggaggga

SEQ ID NO: 691165 - DNA, 20 bp, mouse
gagtggacgctgagagccga

SEQ ID NO: 691166 - DNA, 20 bp, mouse
gaaagcaggcagtgaccgga

SEQ ID NO: 691167 - DNA, 20 bp, mouse
gaggctctgggggcgagttc

SEQ ID NO: 691168 - DNA, 20 bp, mouse
gatcgaaagcaggcagtgac

SEQ ID NO: 691169 - DNA, 20 bp, mouse
gaccactagacaaggctctg

SEQ ID NO: 691170 - DNA, 20 bp, mouse
gctccgcgaggatcgaaagc

SEQ ID NO: 691171 - DNA, 20 bp, mouse
ggctgtgtgcagcgggtcag

SEQ ID NO: 691172 - DNA, 20 bp, mouse
gaggtggtggtggatggcct

SEQ ID NO: 691173 - DNA, 20 bp, mouse
gtagctcgggtcgggactgg

SEQ ID NO: 691174 - DNA, 20 bp, mouse
ggagttctggctgtgtgcag

SEQ ID NO: 691175 - DNA, 20 bp, mouse
ggaggagaatgtcaggagag

SEQ ID NO: 691176 - DNA, 20 bp, mouse
gccccggcgacccggcgcgc

SEQ ID NO: 691177 - DNA, 20 bp, mouse
gtgcacgtacaccacggccc

SEQ ID NO: 691178 - DNA, 20 bp, mouse
ggcccgccggcagcgctccg

SEQ ID NO: 691179 - DNA, 20 bp, mouse
gggcccagccggctgcgtcg

SEQ ID NO: 691180 - DNA, 20 bp, mouse
ggcggcgggccgggcctagc

SEQ ID NO: 691181 - DNA, 20 bp, mouse
gccggcgggcccggacaggc

SEQ ID NO: 691182 - DNA, 20 bp, mouse
ggctgccggcgggcccggac

SEQ ID NO: 691183 - DNA, 20 bp, mouse
gcggcgacgcgcgccccggg

SEQ ID NO: 691184 - DNA, 20 bp, mouse
gcgccccgacgcagccggct

SEQ ID NO: 691185 - DNA, 20 bp, mouse
gccggcccgccgcgtgcgcg

SEQ ID NO: 691186 - DNA, 20 bp, mouse
gcgaaccgcacgttgacagg

SEQ ID NO: 691187 - DNA, 20 bp, mouse
gcacgcgaaagcagacacgc

SEQ ID NO: 691188 - DNA, 20 bp, mouse
gcccaagaagtgagctggtc

SEQ ID NO: 691189 - DNA, 20 bp, mouse
gtgagctggtccgggacgcg

SEQ ID NO: 691190 - DNA, 20 bp, mouse
ggacacgcaggttcagtaaa

SEQ ID NO: 691191 - DNA, 20 bp, mouse
gtgtctgctttcgcgtggaa

SEQ ID NO: 691192 - DNA, 20 bp, mouse
ggtcacgtgcccagcgggcg

SEQ ID NO: 691193 - DNA, 20 bp, mouse
gtgctttcgcgtggaagggg

SEQ ID NO: 691194 - DNA, 20 bp, mouse
gtgcccagcgggcgaggcgg

SEQ ID NO: 691195 - DNA, 20 bp, mouse
gcactgcccaagaagtgagc

SEQ ID NO: 691196 - DNA, 20 bp, mouse
gcggaggagggcagtcccgg

SEQ ID NO: 691197 - DNA, 20 bp, mouse
gtccaagaggaagagcccgg

SEQ ID NO: 691198 - DNA, 20 bp, mouse
gtccgcagcaccagtccaag

SEQ ID NO: 691199 - DNA, 20 bp, mouse
gacacacaggttagctagag

SEQ ID NO: 691200 - DNA, 20 bp, mouse
gtctgggctagtcacctctc

SEQ ID NO: 691201 - DNA, 20 bp, mouse
gcctgtgtgtgacccaagaa

SEQ ID NO: 691202 - DNA, 20 bp, mouse
gaagaggaagagcccggagg

SEQ ID NO: 691203 - DNA, 20 bp, mouse
gctggtgctgcggagcatct

SEQ ID NO: 691204 - DNA, 20 bp, mouse
gtggctctgcatctccaaaa

SEQ ID NO: 691205 - DNA, 20 bp, mouse
gggtgtgtatcccctgagaa

SEQ ID NO: 691206 - DNA, 20 bp, mouse
gcctcccatccaagagtggt

SEQ ID NO: 691207 - DNA, 20 bp, mouse
gggagcgggtcgcagggtgg

SEQ ID NO: 691208 - DNA, 20 bp, mouse
gagcgctcgcgatgccggag

SEQ ID NO: 691209 - DNA, 20 bp, mouse
ggtgcccaccactcttggat

SEQ ID NO: 691210 - DNA, 20 bp, mouse
gaagccctcccatccaagag

SEQ ID NO: 691211 - DNA, 20 bp, mouse
gagccctaatatggaaggac

SEQ ID NO: 691212 - DNA, 20 bp, mouse
ggatgccggagcgggtcgca

SEQ ID NO: 691213 - DNA, 20 bp, mouse
ggaagcaggaagccctaata

SEQ ID NO: 691214 - DNA, 20 bp, mouse
ggccctgccgcttccggctc

SEQ ID NO: 691215 - DNA, 20 bp, mouse
ggccggagcgggtcgcaggg

SEQ ID NO: 691216 - DNA, 20 bp, mouse
ggacccgggtggttgtccac

SEQ ID NO: 691217 - DNA, 20 bp, mouse
gggacaaccacccgggtctg

SEQ ID NO: 691218 - DNA, 20 bp, mouse
gcatacgggcttggctgcgc

SEQ ID NO: 691219 - DNA, 20 bp, mouse
gagccggtggacaaccaccc

SEQ ID NO: 691220 - DNA, 20 bp, mouse
ggagtccccgctgcaggcag

SEQ ID NO: 691221 - DNA, 20 bp, mouse
ggccgccgtgagttcaccca

SEQ ID NO: 691222 - DNA, 20 bp, mouse
gctaccagcgcggccgccgt

SEQ ID NO: 691223 - DNA, 20 bp, mouse
gtggactgaggaacagggct

SEQ ID NO: 691224 - DNA, 20 bp, mouse
ggccgccgtgggtgaactca

SEQ ID NO: 691225 - DNA, 20 bp, mouse
ggccaagcccgtatgcaaat

SEQ ID NO: 691226 - DNA, 20 bp, mouse
gcccgggcggcggagagaat

SEQ ID NO: 691227 - DNA, 20 bp, mouse
ggcccgggagctccccctcg

SEQ ID NO: 691228 - DNA, 20 bp, mouse
gcgggagctccccctcgggg

SEQ ID NO: 691229 - DNA, 20 bp, mouse
ggcgctgtcgccaaccccgc

SEQ ID NO: 691230 - DNA, 20 bp, mouse
gagggcaagacgcccgatga

SEQ ID NO: 691231 - DNA, 20 bp, mouse
ggggaggcaggtgctaatag

SEQ ID NO: 691232 - DNA, 20 bp, mouse
ggagcagggaagccagccca

SEQ ID NO: 691233 - DNA, 20 bp, mouse
gtgactggagcgcgggaagc

SEQ ID NO: 691234 - DNA, 20 bp, mouse
gccgctaccaaccttcgcag

SEQ ID NO: 691235 - DNA, 20 bp, mouse
ggtagaactgactggagcgc

SEQ ID NO: 691236 - DNA, 20 bp, mouse
gcggtgcgacgctgggtcgt

SEQ ID NO: 691237 - DNA, 20 bp, mouse
ggtggggcgtgtgcgaggag

SEQ ID NO: 691238 - DNA, 20 bp, mouse
ggcaaagagggtaatcctct

SEQ ID NO: 691239 - DNA, 20 bp, mouse
gggctggtgcggtgcgacgc

SEQ ID NO: 691240 - DNA, 20 bp, mouse
gcgtgtgcgaggagtgggat

SEQ ID NO: 691241 - DNA, 20 bp, mouse
ggcggctgtggcagatcggg

SEQ ID NO: 691242 - DNA, 20 bp, mouse
ggaggggatctattcttttt

SEQ ID NO: 691243 - DNA, 20 bp, mouse
gtgggctgggggggtgatct

SEQ ID NO: 691244 - DNA, 20 bp, mouse
ggggtgatctaggctccagg

SEQ ID NO: 691245 - DNA, 20 bp, mouse
ggcggcggctgtggcagatc

SEQ ID NO: 691246 - DNA, 20 bp, mouse
ggcggcggcagcaacgtcac

SEQ ID NO: 691247 - DNA, 20 bp, mouse
gactcccgaaaaggaaagct

SEQ ID NO: 691248 - DNA, 20 bp, mouse
gcacgaggctccacgctctg

SEQ ID NO: 691249 - DNA, 20 bp, mouse
gggacacaggatgtatgccg

SEQ ID NO: 691250 - DNA, 20 bp, mouse
gcgcatcccgggtgctcaca

SEQ ID NO: 691251 - DNA, 20 bp, mouse
gatgccggggactcccgaaa

SEQ ID NO: 691252 - DNA, 20 bp, mouse
ggggccggggcctcccgaaa

SEQ ID NO: 691253 - DNA, 20 bp, mouse
ggggcctcccgaaatggcag

SEQ ID NO: 691254 - DNA, 20 bp, mouse
ggcacgcagcggcgcgagcc

SEQ ID NO: 691255 - DNA, 20 bp, mouse
gtttccttttcgggagtccc

SEQ ID NO: 691256 - DNA, 20 bp, mouse
gctcccgcagactcggccaa

SEQ ID NO: 691257 - DNA, 20 bp, mouse
ggacgagcgaggcactccat

SEQ ID NO: 691258 - DNA, 20 bp, mouse
gtcctcggcgggcgggcctt

SEQ ID NO: 691259 - DNA, 20 bp, mouse
gccgccattggccgagtctg

SEQ ID NO: 691260 - DNA, 20 bp, mouse
gctgaaccgcggctctggca

SEQ ID NO: 691261 - DNA, 20 bp, mouse
gtcggccaatggcggcgagg

SEQ ID NO: 691262 - DNA, 20 bp, mouse
ggctctggcagggctcgctc

SEQ ID NO: 691263 - DNA, 20 bp, mouse
ggcggcgggggaggtaatga

SEQ ID NO: 691264 - DNA, 20 bp, mouse
gacactaaccctacccacgg

SEQ ID NO: 691265 - DNA, 20 bp, mouse
gggatctgggcgctgaaccg

SEQ ID NO: 691266 - DNA, 20 bp, mouse
gcgcgagtcaaatggggtta

SEQ ID NO: 691267 - DNA, 20 bp, mouse
gacacccgggtacccggttc

SEQ ID NO: 691268 - DNA, 20 bp, mouse
ggggcgcccgcgagtcaaat

SEQ ID NO: 691269 - DNA, 20 bp, mouse
ggtacccgggtgtccaagtc

SEQ ID NO: 691270 - DNA, 20 bp, mouse
ggagggtggcaccaagttga

SEQ ID NO: 691271 - DNA, 20 bp, mouse
gcgggtacccggttcggggg

SEQ ID NO: 691272 - DNA, 20 bp, mouse
ggcggggcgaccctgcttcc

SEQ ID NO: 691273 - DNA, 20 bp, mouse
gttcggacgcggggcgaggg

SEQ ID NO: 691274 - DNA, 20 bp, mouse
gcgtccggacttggacaccc

SEQ ID NO: 691275 - DNA, 20 bp, mouse
gaccaaggttgcagatataa

SEQ ID NO: 691276 - DNA, 20 bp, mouse
gataaaggggcggctcgacg

SEQ ID NO: 691277 - DNA, 20 bp, mouse
gaggacgtggcacgcgaatg

SEQ ID NO: 691278 - DNA, 20 bp, mouse
gcaggcgcaggctcgagggc

SEQ ID NO: 691279 - DNA, 20 bp, mouse
ggtgcgggaacgccgggctc

SEQ ID NO: 691280 - DNA, 20 bp, mouse
gcgggccagcctcgaggcgg

SEQ ID NO: 691281 - DNA, 20 bp, mouse
gcgcgcaggcgcaggctcga

SEQ ID NO: 691282 - DNA, 20 bp, mouse
gacgtggcacgcgaatgggg

SEQ ID NO: 691283 - DNA, 20 bp, mouse
gttcgcgcgaccctcggcag

SEQ ID NO: 691284 - DNA, 20 bp, mouse
gtcgaggctggcccgagagg

SEQ ID NO: 691285 - DNA, 20 bp, mouse
gtctcgggccagcctcgagg

SEQ ID NO: 691286 - DNA, 20 bp, mouse
gtggggctcacactgaacta

SEQ ID NO: 691287 - DNA, 20 bp, mouse
gagagggagccaaaagctgg

SEQ ID NO: 691288 - DNA, 20 bp, mouse
gttagcaaataagttgacag

SEQ ID NO: 691289 - DNA, 20 bp, mouse
ggagccaaaagctggaggat

SEQ ID NO: 691290 - DNA, 20 bp, mouse
ggctggcgcgggctaggaca

SEQ ID NO: 691291 - DNA, 20 bp, mouse
gagccccatcctccagcttt

SEQ ID NO: 691292 - DNA, 20 bp, mouse
gaagccagctggaccgcgtg

SEQ ID NO: 691293 - DNA, 20 bp, mouse
ggcactgtgaaaacgcgcac

SEQ ID NO: 691294 - DNA, 20 bp, mouse
ggatcagacaaattattggt

SEQ ID NO: 691295 - DNA, 20 bp, mouse
gcagctggaccgcgtggggg

SEQ ID NO: 691296 - DNA, 20 bp, mouse
gagggcgccgccatgtctat

SEQ ID NO: 691297 - DNA, 20 bp, mouse
ggctcccaagtcaaatcccc

SEQ ID NO: 691298 - DNA, 20 bp, mouse
gccggccagctccacggtca

SEQ ID NO: 691299 - DNA, 20 bp, mouse
ggggcggcgggatgctgctg

SEQ ID NO: 691300 - DNA, 20 bp, mouse
gtcagggcgacgcgaagcca

SEQ ID NO: 691301 - DNA, 20 bp, mouse
gaaaacggtagagtaggtca

SEQ ID NO: 691302 - DNA, 20 bp, mouse
gggcgacgcgaagccaagga

SEQ ID NO: 691303 - DNA, 20 bp, mouse
gagtctcaaaacggtagagt

SEQ ID NO: 691304 - DNA, 20 bp, mouse
gtccctggggatactaatat

SEQ ID NO: 691305 - DNA, 20 bp, mouse
ggagcgcctgcccatagaca

SEQ ID NO: 691306 - DNA, 20 bp, mouse
gggcaaacgcccaatgagga

SEQ ID NO: 691307 - DNA, 20 bp, mouse
gatgacggcatcggtctaga

SEQ ID NO: 691308 - DNA, 20 bp, mouse
ggggtggaagctctagccaa

SEQ ID NO: 691309 - DNA, 20 bp, mouse
gctacccgggtacatccttc

SEQ ID NO: 691310 - DNA, 20 bp, mouse
gtgacgcagcggctgatgat

SEQ ID NO: 691311 - DNA, 20 bp, mouse
gggcggcgagagctactgtc

SEQ ID NO: 691312 - DNA, 20 bp, mouse
ggacacaggcgcgtctaccc

SEQ ID NO: 691313 - DNA, 20 bp, mouse
gagagcttccacccagtcgc

SEQ ID NO: 691314 - DNA, 20 bp, mouse
gcgctggcaaacgcccaatg

SEQ ID NO: 691315 - DNA, 20 bp, mouse
gagtccaggcggggtgacac

SEQ ID NO: 691316 - DNA, 20 bp, mouse
gaacagaggcgacctgttaa

SEQ ID NO: 691317 - DNA, 20 bp, mouse
gaggagggggaagtgactta

SEQ ID NO: 691318 - DNA, 20 bp, mouse
gttagggaattcccggttgg

SEQ ID NO: 691319 - DNA, 20 bp, mouse
gaagtgacttagggaattcc

SEQ ID NO: 691320 - DNA, 20 bp, mouse
gtgaacactaacgtctgagt

SEQ ID NO: 691321 - DNA, 20 bp, mouse
ggacttagggaattcccggt

SEQ ID NO: 691322 - DNA, 20 bp, mouse
gtcagcttagaggcagtttc

SEQ ID NO: 691323 - DNA, 20 bp, mouse
gggcgacctgttaatggatg

SEQ ID NO: 691324 - DNA, 20 bp, mouse
gtgcaggtacccggcgtgga

SEQ ID NO: 691325 - DNA, 20 bp, mouse
gaataaaggattacaaacat

SEQ ID NO: 691326 - DNA, 20 bp, mouse
gcagggagcacgaagtgcaa

SEQ ID NO: 691327 - DNA, 20 bp, mouse
gtgccccaggctgttttaga

SEQ ID NO: 691328 - DNA, 20 bp, mouse
gacagaactagagaaggccg

SEQ ID NO: 691329 - DNA, 20 bp, mouse
ggtggtgtgacccagcagtt

SEQ ID NO: 691330 - DNA, 20 bp, mouse
gcggtagcagcggctcccat

SEQ ID NO: 691331 - DNA, 20 bp, mouse
gcacaggcaagccaaactgc

SEQ ID NO: 691332 - DNA, 20 bp, mouse
ggtgaacatgtgattgacgt

SEQ ID NO: 691333 - DNA, 20 bp, mouse
gaggaactgcacacatatta

SEQ ID NO: 691334 - DNA, 20 bp, mouse
gtggagcgcagcccgcccca

SEQ ID NO: 691335 - DNA, 20 bp, mouse
gctgggccgccctgagagga

SEQ ID NO: 691336 - DNA, 20 bp, mouse
gtggcctcgcctccagacgc

SEQ ID NO: 691337 - DNA, 20 bp, mouse
ggcgccgcacgggtgggtcc

SEQ ID NO: 691338 - DNA, 20 bp, mouse
ggcaccgggacccacccgtg

SEQ ID NO: 691339 - DNA, 20 bp, mouse
ggcctcgcggcctaggtccg

SEQ ID NO: 691340 - DNA, 20 bp, mouse
gcagccgcgggtgctcacgc

SEQ ID NO: 691341 - DNA, 20 bp, mouse
gtcagcgcgcaggcgccacc

SEQ ID NO: 691342 - DNA, 20 bp, mouse
ggcgcgctgaaattcaacct

SEQ ID NO: 691343 - DNA, 20 bp, mouse
ggtgcggcgcctgcgtctgg

SEQ ID NO: 691344 - DNA, 20 bp, mouse
gtcgcggcctaggtccgggg

SEQ ID NO: 691345 - DNA, 20 bp, mouse
gacgcaggcgccgcacgggt

SEQ ID NO: 691346 - DNA, 20 bp, mouse
gagcaagggtgaggctcgac

SEQ ID NO: 691347 - DNA, 20 bp, mouse
ggccctggaggtccagaact

SEQ ID NO: 691348 - DNA, 20 bp, mouse
gtgggctccgccgggagcaa

SEQ ID NO: 691349 - DNA, 20 bp, mouse
gtccagaactggggcctgta

SEQ ID NO: 691350 - DNA, 20 bp, mouse
gaaggggcgacagagactca

SEQ ID NO: 691351 - DNA, 20 bp, mouse
ggtgaggctcgactgggctg

SEQ ID NO: 691352 - DNA, 20 bp, mouse
ggcacacgcggcagctgcaa

SEQ ID NO: 691353 - DNA, 20 bp, mouse
gccccccagaatggccctgg

SEQ ID NO: 691354 - DNA, 20 bp, mouse
gccccagttctggacctcca

SEQ ID NO: 691355 - DNA, 20 bp, mouse
gcgaacgccctctcccctac

SEQ ID NO: 691356 - DNA, 20 bp, mouse
gagggcggggccataccggg

SEQ ID NO: 691357 - DNA, 20 bp, mouse
gaggtagggcggggccatac

SEQ ID NO: 691358 - DNA, 20 bp, mouse
ggatcgctcaacagtgagaa

SEQ ID NO: 691359 - DNA, 20 bp, mouse
ggggcggggctagcgaggta

SEQ ID NO: 691360 - DNA, 20 bp, mouse
gagaatgagtctggactctg

SEQ ID NO: 691361 - DNA, 20 bp, mouse
ggggcagctgggaagtcggg

SEQ ID NO: 691362 - DNA, 20 bp, mouse
gcggggctagcgaggtaggg

SEQ ID NO: 691363 - DNA, 20 bp, mouse
gagtgagaaggggtttgact

SEQ ID NO: 691364 - DNA, 20 bp, mouse
gacggggcagctgggaagtc

SEQ ID NO: 691365 - DNA, 20 bp, mouse
ggagaaggggtttgactagg

SEQ ID NO: 691366 - DNA, 20 bp, mouse
ggggagtccgggaaacatag

SEQ ID NO: 691367 - DNA, 20 bp, mouse
gaggccgcttggtccacggg

SEQ ID NO: 691368 - DNA, 20 bp, mouse
gcccccccccgtggaccaag

SEQ ID NO: 691369 - DNA, 20 bp, mouse
gaagcatcgcgggtcctgag

SEQ ID NO: 691370 - DNA, 20 bp, mouse
gggcgcgtgcgcaggcgagt

SEQ ID NO: 691371 - DNA, 20 bp, mouse
gttcacgtgcgcaaacgggt

SEQ ID NO: 691372 - DNA, 20 bp, mouse
gcgtgcgtgtgctggcgagt

SEQ ID NO: 691373 - DNA, 20 bp, mouse
gtcaccagcggaagcatcgc

SEQ ID NO: 691374 - DNA, 20 bp, mouse
gcgtgcgcaaacgggtaggc

SEQ ID NO: 691375 - DNA, 20 bp, mouse
gagtaggccgcttggtccac

SEQ ID NO: 691376 - DNA, 20 bp, mouse
gctcgccagcaaatgcccgg

SEQ ID NO: 691377 - DNA, 20 bp, mouse
gagcgcaatgcgcacgggta

SEQ ID NO: 691378 - DNA, 20 bp, mouse
gtgcgcaggcgtagctccaa

SEQ ID NO: 691379 - DNA, 20 bp, mouse
gagctccaacggcgaagccg

SEQ ID NO: 691380 - DNA, 20 bp, mouse
gacgcgtgcgcactgctcct

SEQ ID NO: 691381 - DNA, 20 bp, mouse
gctgctaggtagcaatctca

SEQ ID NO: 691382 - DNA, 20 bp, mouse
gtgctcctcggcttcgccgt

SEQ ID NO: 691383 - DNA, 20 bp, mouse
gagtgcgcacgcgtgtcctc

SEQ ID NO: 691384 - DNA, 20 bp, mouse
gcatcctttctgttgaaggg

SEQ ID NO: 691385 - DNA, 20 bp, mouse
gccacgagcgcaatgcgcac

SEQ ID NO: 691386 - DNA, 20 bp, mouse
gcctgctggttcagaacttg

SEQ ID NO: 691387 - DNA, 20 bp, mouse
gctagagggcgatagaggtc

SEQ ID NO: 691388 - DNA, 20 bp, mouse
ggaggcggccgtggcggtaa

SEQ ID NO: 691389 - DNA, 20 bp, mouse
gcacccctagagggcgatag

SEQ ID NO: 691390 - DNA, 20 bp, mouse
ggctggttcagaacttgagg

SEQ ID NO: 691391 - DNA, 20 bp, mouse
gggcacatggcacccctaga

SEQ ID NO: 691392 - DNA, 20 bp, mouse
gtgcgcgggcctcggcgccc

SEQ ID NO: 691393 - DNA, 20 bp, mouse
gtcagaacttgaggcggccg

SEQ ID NO: 691394 - DNA, 20 bp, mouse
gtatgtgatgccgcccctgc

SEQ ID NO: 691395 - DNA, 20 bp, mouse
gccgtggcggtaatggcaca

SEQ ID NO: 691396 - DNA, 20 bp, mouse
ggacgcgtgcgcactgggtt

SEQ ID NO: 691397 - DNA, 20 bp, mouse
gcggccgcgaaaactggcgg

SEQ ID NO: 691398 - DNA, 20 bp, mouse
gtggtcggggggcggagtca

SEQ ID NO: 691399 - DNA, 20 bp, mouse
ggaccccaacagggtcaaga

SEQ ID NO: 691400 - DNA, 20 bp, mouse
gactccgccccccgaccaat

SEQ ID NO: 691401 - DNA, 20 bp, mouse
ggcggcttcctattggtcgg

SEQ ID NO: 691402 - DNA, 20 bp, mouse
ggggtggggccgagacgtga

SEQ ID NO: 691403 - DNA, 20 bp, mouse
gaatacgtgcagagaagggt

SEQ ID NO: 691404 - DNA, 20 bp, mouse
gtccgggagcttgactccat

SEQ ID NO: 691405 - DNA, 20 bp, mouse
gcagcgcgctggcgtcacag

SEQ ID NO: 691406 - DNA, 20 bp, mouse
ggacccggatgtggtatctg

SEQ ID NO: 691407 - DNA, 20 bp, mouse
gagcacctacgcggaagggg

SEQ ID NO: 691408 - DNA, 20 bp, mouse
gagacccggcaaagcggcgg

SEQ ID NO: 691409 - DNA, 20 bp, mouse
gggctccagtgacccggatg

SEQ ID NO: 691410 - DNA, 20 bp, mouse
ggggagacccggcaaagcgg

SEQ ID NO: 691411 - DNA, 20 bp, mouse
gaaggcgaggcgatgcagtg

SEQ ID NO: 691412 - DNA, 20 bp, mouse
gaggcgatgcagtgaggacg

SEQ ID NO: 691413 - DNA, 20 bp, mouse
ggaagcgcgtgaggcctccg

SEQ ID NO: 691414 - DNA, 20 bp, mouse
gtaggtgctcgctgtacttc

SEQ ID NO: 691415 - DNA, 20 bp, mouse
gggaagacccgaggggcagt

SEQ ID NO: 691416 - DNA, 20 bp, mouse
gcagcggcccttccggtctg

SEQ ID NO: 691417 - DNA, 20 bp, mouse
ggaaaacgcattctcctcgg

SEQ ID NO: 691418 - DNA, 20 bp, mouse
gaggccggcagcccgagtga

SEQ ID NO: 691419 - DNA, 20 bp, mouse
gtgccccgcactcggaactt

SEQ ID NO: 691420 - DNA, 20 bp, mouse
gcagacctcaagctacgaga

SEQ ID NO: 691421 - DNA, 20 bp, mouse
gctccggtgagcgtgagaag

SEQ ID NO: 691422 - DNA, 20 bp, mouse
gtctgtgtagccagggtcgc

SEQ ID NO: 691423 - DNA, 20 bp, mouse
ggagaagcggagtggtgctc

SEQ ID NO: 691424 - DNA, 20 bp, mouse
gccagccgcggcgcccacgg

SEQ ID NO: 691425 - DNA, 20 bp, mouse
gcaggaaaacgcattctcct

SEQ ID NO: 691426 - DNA, 20 bp, mouse
ggggccctgcgtcacagtgg

SEQ ID NO: 691427 - DNA, 20 bp, mouse
gccagtgggcacgcagtagg

SEQ ID NO: 691428 - DNA, 20 bp, mouse
gtcccgcgactctaaggcgc

SEQ ID NO: 691429 - DNA, 20 bp, mouse
gccaaggggcagtcctaggg

SEQ ID NO: 691430 - DNA, 20 bp, mouse
gcctagggagaagcctgcca

SEQ ID NO: 691431 - DNA, 20 bp, mouse
ggggcctccggcgtccggaa

SEQ ID NO: 691432 - DNA, 20 bp, mouse
gccagcctcccgcgactcta

SEQ ID NO: 691433 - DNA, 20 bp, mouse
ggggcacgcagtaggtggag

SEQ ID NO: 691434 - DNA, 20 bp, mouse
gctgccagtgggcacgcagt

SEQ ID NO: 691435 - DNA, 20 bp, mouse
gcaaccaagctggaaatcta

SEQ ID NO: 691436 - DNA, 20 bp, mouse
ggcgagaaacgtgcccccgg

SEQ ID NO: 691437 - DNA, 20 bp, mouse
gcctcgggcgggacggaccg

SEQ ID NO: 691438 - DNA, 20 bp, mouse
ggaggcgcttccgggtgcaa

SEQ ID NO: 691439 - DNA, 20 bp, mouse
gaatcccggggcttggagga

SEQ ID NO: 691440 - DNA, 20 bp, mouse
ggcgcgcggggctaaatacg

SEQ ID NO: 691441 - DNA, 20 bp, mouse
ggaccgcggctgcccgcagt

SEQ ID NO: 691442 - DNA, 20 bp, mouse
gtgcaagtccagacccccgg

SEQ ID NO: 691443 - DNA, 20 bp, mouse
gctgcagcatcggaatcccg

SEQ ID NO: 691444 - DNA, 20 bp, mouse
gagcgggcgggagcccactg

SEQ ID NO: 691445 - DNA, 20 bp, mouse
gtccgcccggcgcctcgggc

SEQ ID NO: 691446 - DNA, 20 bp, mouse
gggcgctcgccctccctctc

SEQ ID NO: 691447 - DNA, 20 bp, mouse
gactccgcccgctccggaga

SEQ ID NO: 691448 - DNA, 20 bp, mouse
gaccccgccccgcggaagtg

SEQ ID NO: 691449 - DNA, 20 bp, mouse
gcgcgctcgggaaccagacg

SEQ ID NO: 691450 - DNA, 20 bp, mouse
gacgcggagcgctggaacac

SEQ ID NO: 691451 - DNA, 20 bp, mouse
gcggtcccgggccaccggga

SEQ ID NO: 691452 - DNA, 20 bp, mouse
gctcggggccaatccacgtc

SEQ ID NO: 691453 - DNA, 20 bp, mouse
ggccaggctcttccccgctc

SEQ ID NO: 691454 - DNA, 20 bp, mouse
gtggggtgagagttcaagaa

SEQ ID NO: 691455 - DNA, 20 bp, mouse
gtccggagcggggaagagcc

SEQ ID NO: 691456 - DNA, 20 bp, mouse
ggagtgggcaggacaagcag

SEQ ID NO: 691457 - DNA, 20 bp, mouse
gaagcaggggtgtgctggcg

SEQ ID NO: 691458 - DNA, 20 bp, mouse
gtgaccctgtgggttgtgtc

SEQ ID NO: 691459 - DNA, 20 bp, mouse
gactgcgggtgtgccccgag

SEQ ID NO: 691460 - DNA, 20 bp, mouse
gtgaccaggaagtttctgta

SEQ ID NO: 691461 - DNA, 20 bp, mouse
ggaaccagacacaacccaca

SEQ ID NO: 691462 - DNA, 20 bp, mouse
gatgcctacagggataatat

SEQ ID NO: 691463 - DNA, 20 bp, mouse
ggtgctggcgcggcgtggtg

SEQ ID NO: 691464 - DNA, 20 bp, mouse
gaaaactgatgttggggcaa

SEQ ID NO: 691465 - DNA, 20 bp, mouse
gcggcgctgcctgtgtagga

SEQ ID NO: 691466 - DNA, 20 bp, mouse
gcacccgcgagaagtcaggt

SEQ ID NO: 691467 - DNA, 20 bp, mouse
ggggaggcgggcccggacct

SEQ ID NO: 691468 - DNA, 20 bp, mouse
gctcccgcgctggggtacag

SEQ ID NO: 691469 - DNA, 20 bp, mouse
gagcgcgggagccaaggtcc

SEQ ID NO: 691470 - DNA, 20 bp, mouse
gtactgcagttgcacaggag

SEQ ID NO: 691471 - DNA, 20 bp, mouse
gggctagcaggtaactgctg

SEQ ID NO: 691472 - DNA, 20 bp, mouse
ggcagttactgcagttgcac

SEQ ID NO: 691473 - DNA, 20 bp, mouse
gccaggaagtgtccgaaacc

SEQ ID NO: 691474 - DNA, 20 bp, mouse
gggtgcgagccggtgcggga

SEQ ID NO: 691475 - DNA, 20 bp, mouse
gcgcctacctgacttctcgc

SEQ ID NO: 691476 - DNA, 20 bp, mouse
gtgaggggcgaggccaatca

SEQ ID NO: 691477 - DNA, 20 bp, mouse
gggggaggggcatttctcat

SEQ ID NO: 691478 - DNA, 20 bp, mouse
gtggccgtcgttcccggaaa

SEQ ID NO: 691479 - DNA, 20 bp, mouse
gcgttccagaagtggcatta

SEQ ID NO: 691480 - DNA, 20 bp, mouse
ggcctaagaagactctgggg

SEQ ID NO: 691481 - DNA, 20 bp, mouse
gaaagggccggactgccaca

SEQ ID NO: 691482 - DNA, 20 bp, mouse
gtctcattggccgtcgttcc

SEQ ID NO: 691483 - DNA, 20 bp, mouse
gggcctcgcccctcaaagtg

SEQ ID NO: 691484 - DNA, 20 bp, mouse
gtcccagcgcctcactttga

SEQ ID NO: 691485 - DNA, 20 bp, mouse
ggggaaaactacaatttgat

SEQ ID NO: 691486 - DNA, 20 bp, mouse
gctgaaggcggggttctccg

SEQ ID NO: 691487 - DNA, 20 bp, mouse
gcagcgggagacgaacctgg

SEQ ID NO: 691488 - DNA, 20 bp, mouse
gcgagctgatgacaggtcta

SEQ ID NO: 691489 - DNA, 20 bp, mouse
gtaggggcgtgactctgagc

SEQ ID NO: 691490 - DNA, 20 bp, mouse
gcgagctgaagaccgaccta

SEQ ID NO: 691491 - DNA, 20 bp, mouse
gcagacccgcctcctggcct

SEQ ID NO: 691492 - DNA, 20 bp, mouse
gcccgcccactggccttctc

SEQ ID NO: 691493 - DNA, 20 bp, mouse
gctccagcgggagacgaacc

SEQ ID NO: 691494 - DNA, 20 bp, mouse
gcagagtcacgcccctaggt

SEQ ID NO: 691495 - DNA, 20 bp, mouse
gggggcctcgagctgatgac

SEQ ID NO: 691496 - DNA, 20 bp, mouse
gtggccgctgacggtgaggg

SEQ ID NO: 691497 - DNA, 20 bp, mouse
gcggaggcgtagggaagcaa

SEQ ID NO: 691498 - DNA, 20 bp, mouse
gcgtgcgtggcgtcactcgt

SEQ ID NO: 691499 - DNA, 20 bp, mouse
gcaatggccgctgacggtga

SEQ ID NO: 691500 - DNA, 20 bp, mouse
gaagcgccgcccacgggcca

SEQ ID NO: 691501 - DNA, 20 bp, mouse
gaacgcggagccgggcggga

SEQ ID NO: 691502 - DNA, 20 bp, mouse
gggtggcatggatcgaaacg

SEQ ID NO: 691503 - DNA, 20 bp, mouse
gcgtgggcggcgcttcacgg

SEQ ID NO: 691504 - DNA, 20 bp, mouse
gccaaggcgcactcgatttc

SEQ ID NO: 691505 - DNA, 20 bp, mouse
gcggcgcttcacggaggcgt

SEQ ID NO: 691506 - DNA, 20 bp, mouse
gtcggcgcgcagactcccaa

SEQ ID NO: 691507 - DNA, 20 bp, mouse
ggcgcaccgccgggaagtga

SEQ ID NO: 691508 - DNA, 20 bp, mouse
gacggctggaagggtcccct

SEQ ID NO: 691509 - DNA, 20 bp, mouse
ggccctgcgaccagcagaag

SEQ ID NO: 691510 - DNA, 20 bp, mouse
gcgggaagtgacggctggaa

SEQ ID NO: 691511 - DNA, 20 bp, mouse
gaccgccgggaagtgacggc

SEQ ID NO: 691512 - DNA, 20 bp, mouse
gtcctccgggcctcccggct

SEQ ID NO: 691513 - DNA, 20 bp, mouse
ggaggcgtctgccaagcatc

SEQ ID NO: 691514 - DNA, 20 bp, mouse
gcggagctgggcgcaccgcc

SEQ ID NO: 691515 - DNA, 20 bp, mouse
ggccaatcagaaacgtgtta

SEQ ID NO: 691516 - DNA, 20 bp, mouse
gacgacgcgccgactcagga

SEQ ID NO: 691517 - DNA, 20 bp, mouse
gtcgtcggtcgcttggtctc

SEQ ID NO: 691518 - DNA, 20 bp, mouse
gccaagcgaccgacgagccg

SEQ ID NO: 691519 - DNA, 20 bp, mouse
ggtgaggctgggatttagaa

SEQ ID NO: 691520 - DNA, 20 bp, mouse
gactccacgccacggctcgt

SEQ ID NO: 691521 - DNA, 20 bp, mouse
gcaggcgcgcggtggccgag

SEQ ID NO: 691522 - DNA, 20 bp, mouse
gcaagagcgcaggcgcgcgg

SEQ ID NO: 691523 - DNA, 20 bp, mouse
gcgaaacgttagagattgaa

SEQ ID NO: 691524 - DNA, 20 bp, mouse
gcctcacggcactgtaaatt

SEQ ID NO: 691525 - DNA, 20 bp, mouse
gcgaccgacgagccgtggcg

SEQ ID NO: 691526 - DNA, 20 bp, mouse
ggggagctgtagtcgagcgc

SEQ ID NO: 691527 - DNA, 20 bp, mouse
ggctctgcgagcagcaacct

SEQ ID NO: 691528 - DNA, 20 bp, mouse
ggccggagacgctcctaatt

SEQ ID NO: 691529 - DNA, 20 bp, mouse
ggtgaggaccaaaggatgtt

SEQ ID NO: 691530 - DNA, 20 bp, mouse
ggggtcgcggtgaggaccaa

SEQ ID NO: 691531 - DNA, 20 bp, mouse
gtcccaattaggagcgtctc

SEQ ID NO: 691532 - DNA, 20 bp, mouse
gactccgcgggaggcatcag

SEQ ID NO: 691533 - DNA, 20 bp, mouse
gaaaatggcgagctgggctg

SEQ ID NO: 691534 - DNA, 20 bp, mouse
gttggtgggcctgaactccg

SEQ ID NO: 691535 - DNA, 20 bp, mouse
gtcaccgcgacccgtagtcc

SEQ ID NO: 691536 - DNA, 20 bp, mouse
gcccgtgcaagaccagggcg

SEQ ID NO: 691537 - DNA, 20 bp, mouse
gcccaccccgtgcaagacca

SEQ ID NO: 691538 - DNA, 20 bp, mouse
ggaggtgtatgcaccccaga

SEQ ID NO: 691539 - DNA, 20 bp, mouse
gtgactaagtagacaacggt

SEQ ID NO: 691540 - DNA, 20 bp, mouse
ggaccgcagtaggtgctact

SEQ ID NO: 691541 - DNA, 20 bp, mouse
gcggtgggatctcacccctc

SEQ ID NO: 691542 - DNA, 20 bp, mouse
gaacgcgaaggtgtagttgc

SEQ ID NO: 691543 - DNA, 20 bp, mouse
gctcccagtagcacctactg

SEQ ID NO: 691544 - DNA, 20 bp, mouse
gtggataggcttgtgatcgc

SEQ ID NO: 691545 - DNA, 20 bp, mouse
gtcactgactaagtagacaa

SEQ ID NO: 691546 - DNA, 20 bp, mouse
gtccctaactacagacccgc

SEQ ID NO: 691547 - DNA, 20 bp, mouse
gtacagacccgcaggctcct

SEQ ID NO: 691548 - DNA, 20 bp, mouse
gagcctgcgggtctgtagtt

SEQ ID NO: 691549 - DNA, 20 bp, mouse
gaactgacgcagcgccaggt

SEQ ID NO: 691550 - DNA, 20 bp, mouse
gccggttccaagtggaagag

SEQ ID NO: 691551 - DNA, 20 bp, mouse
gccaagtggaagagcgggag

SEQ ID NO: 691552 - DNA, 20 bp, mouse
ggacgcagcgccaggtgggg

SEQ ID NO: 691553 - DNA, 20 bp, mouse
gacgccgtatctaaagcgga

SEQ ID NO: 691554 - DNA, 20 bp, mouse
gctggcgctgcgtcagttcc

SEQ ID NO: 691555 - DNA, 20 bp, mouse
ggctccatccgctttagata

SEQ ID NO: 691556 - DNA, 20 bp, mouse
gtatgggcggtgtgaaccaa

SEQ ID NO: 691557 - DNA, 20 bp, mouse
gcctccctccggcgagtcgc

SEQ ID NO: 691558 - DNA, 20 bp, mouse
gggcacccagcacgctctga

SEQ ID NO: 691559 - DNA, 20 bp, mouse
gagggcgctgtgacgaatgg

SEQ ID NO: 691560 - DNA, 20 bp, mouse
gggttcacaccgcccatatt

SEQ ID NO: 691561 - DNA, 20 bp, mouse
gacgctctgagggatgggtc

SEQ ID NO: 691562 - DNA, 20 bp, mouse
ggagccacctctcactgcgc

SEQ ID NO: 691563 - DNA, 20 bp, mouse
gctgagggatgggtcaggag

SEQ ID NO: 691564 - DNA, 20 bp, mouse
gaccaagactctatggttag

SEQ ID NO: 691565 - DNA, 20 bp, mouse
ggccccccggcgagacaatc

SEQ ID NO: 691566 - DNA, 20 bp, mouse
gtgcgcttcgggagtttcga

SEQ ID NO: 691567 - DNA, 20 bp, mouse
gccccggcgccgggcatact

SEQ ID NO: 691568 - DNA, 20 bp, mouse
gagcacttttcgaacctctt

SEQ ID NO: 691569 - DNA, 20 bp, mouse
gtcccgaagcgcacaagcgc

SEQ ID NO: 691570 - DNA, 20 bp, mouse
gtctcgtggcgcgagttatt

SEQ ID NO: 691571 - DNA, 20 bp, mouse
ggctccacgggttcatatta

SEQ ID NO: 691572 - DNA, 20 bp, mouse
ggcgccacgagaagcacgta

SEQ ID NO: 691573 - DNA, 20 bp, mouse
ggaccggcgcttgtgcgctt

SEQ ID NO: 691574 - DNA, 20 bp, mouse
ggagttattcggcgactccc

SEQ ID NO: 691575 - DNA, 20 bp, mouse
gagcgtgaactcagctccac

SEQ ID NO: 691576 - DNA, 20 bp, mouse
ggggcctacggtatgtcagg

SEQ ID NO: 691577 - DNA, 20 bp, mouse
gcccaggaaaggcccctcga

SEQ ID NO: 691578 - DNA, 20 bp, mouse
gcgaaggggaagcggcggga

SEQ ID NO: 691579 - DNA, 20 bp, mouse
ggaaaggcccctcgagggga

SEQ ID NO: 691580 - DNA, 20 bp, mouse
ggcggcgggaaggcggactg

SEQ ID NO: 691581 - DNA, 20 bp, mouse
ggccccttgggcggagcgaa

SEQ ID NO: 691582 - DNA, 20 bp, mouse
gtggccacgctcgaccggag

SEQ ID NO: 691583 - DNA, 20 bp, mouse
ggtccagagctccggcaagg

SEQ ID NO: 691584 - DNA, 20 bp, mouse
ggctccgcccaaggggccta

SEQ ID NO: 691585 - DNA, 20 bp, mouse
gaaggggcctacggtatgtc

SEQ ID NO: 691586 - DNA, 20 bp, mouse
gtaaaggctgactaagaatc

SEQ ID NO: 691587 - DNA, 20 bp, mouse
gtatgggcggggctgtaaaa

SEQ ID NO: 691588 - DNA, 20 bp, mouse
gttagtgcaggcaacgtcaa

SEQ ID NO: 691589 - DNA, 20 bp, mouse
gaagaacgggcagtaaacat

SEQ ID NO: 691590 - DNA, 20 bp, mouse
ggggcggggctgtaaaatgg

SEQ ID NO: 691591 - DNA, 20 bp, mouse
gcaagtgtctgagacactaa

SEQ ID NO: 691592 - DNA, 20 bp, mouse
gaatcccgccccgtagttgg

SEQ ID NO: 691593 - DNA, 20 bp, mouse
gctgtaaaatggcggattaa

SEQ ID NO: 691594 - DNA, 20 bp, mouse
gtcacccccaactacggggc

SEQ ID NO: 691595 - DNA, 20 bp, mouse
gaacgcacaagcctatgggc

SEQ ID NO: 691596 - DNA, 20 bp, mouse
gcagaggtggtcggagaaaa

SEQ ID NO: 691597 - DNA, 20 bp, mouse
gccccccgcggacacagagt

SEQ ID NO: 691598 - DNA, 20 bp, mouse
gcgcgctggcgtctcgagcg

SEQ ID NO: 691599 - DNA, 20 bp, mouse
gcgcgagctgtggtgttctt

SEQ ID NO: 691600 - DNA, 20 bp, mouse
gggcctgcctcctacatccg

SEQ ID NO: 691601 - DNA, 20 bp, mouse
gaaaggcggaacatgcgcaa

SEQ ID NO: 691602 - DNA, 20 bp, mouse
gtcccactctgtgtccgcgg

SEQ ID NO: 691603 - DNA, 20 bp, mouse
gtctcgagcgcgggctgacg

SEQ ID NO: 691604 - DNA, 20 bp, mouse
gccgccgcgagggaatcacg

SEQ ID NO: 691605 - DNA, 20 bp, mouse
gcccgagccccggatgtagg

SEQ ID NO: 691606 - DNA, 20 bp, mouse
gccagcgggcgctacgggga

SEQ ID NO: 691607 - DNA, 20 bp, mouse
ggtaccaagatgtggctcgg

SEQ ID NO: 691608 - DNA, 20 bp, mouse
gggctgatcgtgaggaatga

SEQ ID NO: 691609 - DNA, 20 bp, mouse
gcgcccgctgggagaggcaa

SEQ ID NO: 691610 - DNA, 20 bp, mouse
ggggaaggactgtactatct

SEQ ID NO: 691611 - DNA, 20 bp, mouse
gtcgtgaggaatgagggcgt

SEQ ID NO: 691612 - DNA, 20 bp, mouse
ggcggcgcgcggtgacttct

SEQ ID NO: 691613 - DNA, 20 bp, mouse
gagccatgtgcgtgcagcga

SEQ ID NO: 691614 - DNA, 20 bp, mouse
gtgacggggcaaaagaacga

SEQ ID NO: 691615 - DNA, 20 bp, mouse
gtctcccccgagccacatct

SEQ ID NO: 691616 - DNA, 20 bp, mouse
gcactaggaccgcccggact

SEQ ID NO: 691617 - DNA, 20 bp, mouse
gtcggctactaattcgtccc

SEQ ID NO: 691618 - DNA, 20 bp, mouse
gtcttgcagcctagtccggg

SEQ ID NO: 691619 - DNA, 20 bp, mouse
gaattacagacgtgcaccat

SEQ ID NO: 691620 - DNA, 20 bp, mouse
gcaggccgtgtatagcgcaa

SEQ ID NO: 691621 - DNA, 20 bp, mouse
gtcagtcttgcagcctagtc

SEQ ID NO: 691622 - DNA, 20 bp, mouse
gcgccggaagaggaaaaggt

SEQ ID NO: 691623 - DNA, 20 bp, mouse
ggctgctcactaggaccgcc

SEQ ID NO: 691624 - DNA, 20 bp, mouse
ggactgactggctgctcact

SEQ ID NO: 691625 - DNA, 20 bp, mouse
gcttcaccctttctagtgta

SEQ ID NO: 691626 - DNA, 20 bp, mouse
gcaggggccggtgccgtaaa

SEQ ID NO: 691627 - DNA, 20 bp, mouse
gaggtgccagacacaagtga

SEQ ID NO: 691628 - DNA, 20 bp, mouse
gagtgaggggattacgtcag

SEQ ID NO: 691629 - DNA, 20 bp, mouse
gctggccccagcgtggtcgt

SEQ ID NO: 691630 - DNA, 20 bp, mouse
gggcacctcaggggcgaacg

SEQ ID NO: 691631 - DNA, 20 bp, mouse
gctccccgccccggcttctc

SEQ ID NO: 691632 - DNA, 20 bp, mouse
gcgctcggggccagagaagc

SEQ ID NO: 691633 - DNA, 20 bp, mouse
gaagatgcgcgcgcaggggc

SEQ ID NO: 691634 - DNA, 20 bp, mouse
gagcctggcgcgaagcatta

SEQ ID NO: 691635 - DNA, 20 bp, mouse
gccgtaaagtgagacacaac

SEQ ID NO: 691636 - DNA, 20 bp, mouse
gccacccagaaggcgtgggg

SEQ ID NO: 691637 - DNA, 20 bp, mouse
gcagaaggcgtggggaggga

SEQ ID NO: 691638 - DNA, 20 bp, mouse
gagccccacccagaaggcgt

SEQ ID NO: 691639 - DNA, 20 bp, mouse
ggcggggcctgtccgcctct

SEQ ID NO: 691640 - DNA, 20 bp, mouse
gcactgcgcatgtgcagtag

SEQ ID NO: 691641 - DNA, 20 bp, mouse
gaaaactagcttttctttat

SEQ ID NO: 691642 - DNA, 20 bp, mouse
gagcctgcctgacatctacg

SEQ ID NO: 691643 - DNA, 20 bp, mouse
gagtttgagccccacccaga

SEQ ID NO: 691644 - DNA, 20 bp, mouse
gcaacggcagcagttgcgcg

SEQ ID NO: 691645 - DNA, 20 bp, mouse
gcggcagcagttgcgcgtgg

SEQ ID NO: 691646 - DNA, 20 bp, mouse
ggcggcacagagtagtgtaa

SEQ ID NO: 691647 - DNA, 20 bp, mouse
gaagttactaggaactactc

SEQ ID NO: 691648 - DNA, 20 bp, mouse
gcgatgcgcactcagtgtgt

SEQ ID NO: 691649 - DNA, 20 bp, mouse
gagtaactttaggacttcct

SEQ ID NO: 691650 - DNA, 20 bp, mouse
ggacttcctggggtgggaat

SEQ ID NO: 691651 - DNA, 20 bp, mouse
gactctgtgccgccacctgg

SEQ ID NO: 691652 - DNA, 20 bp, mouse
gcaacctaacctatatggct

SEQ ID NO: 691653 - DNA, 20 bp, mouse
gaatctacacagttgccacc

SEQ ID NO: 691654 - DNA, 20 bp, mouse
gcaggccaacctaacctata

SEQ ID NO: 691655 - DNA, 20 bp, mouse
gacgcctagccatataggtt

SEQ ID NO: 691656 - DNA, 20 bp, mouse
ggtctagccccattacccaa

SEQ ID NO: 691657 - DNA, 20 bp, mouse
gctgagatccaacctggaaa

SEQ ID NO: 691658 - DNA, 20 bp, mouse
gagcgcctccctgcggacaa

SEQ ID NO: 691659 - DNA, 20 bp, mouse
ggcctagagcggccagaccg

SEQ ID NO: 691660 - DNA, 20 bp, mouse
ggcctccctgcggacaaagg

SEQ ID NO: 691661 - DNA, 20 bp, mouse
gaaagcgctgagatccaacc

SEQ ID NO: 691662 - DNA, 20 bp, mouse
ggcggacaaaggtggacacg

SEQ ID NO: 691663 - DNA, 20 bp, mouse
ggtctggccgctctaggctg

SEQ ID NO: 691664 - DNA, 20 bp, mouse
ggctcacgagcagtattccc

SEQ ID NO: 691665 - DNA, 20 bp, mouse
gtagccccattacccaaagg

SEQ ID NO: 691666 - DNA, 20 bp, mouse
ggaggattcccacaatctca

SEQ ID NO: 691667 - DNA, 20 bp, mouse
gtgaccctaatcaattactg

SEQ ID NO: 691668 - DNA, 20 bp, mouse
gactgtgggttgagcagtac

SEQ ID NO: 691669 - DNA, 20 bp, mouse
gggagggagaaacaccaccg

SEQ ID NO: 691670 - DNA, 20 bp, mouse
gctgagtgggtgtagaataa

SEQ ID NO: 691671 - DNA, 20 bp, mouse
ggattcccacaatctcaggg

SEQ ID NO: 691672 - DNA, 20 bp, mouse
gcacaatctcagggagggtt

SEQ ID NO: 691673 - DNA, 20 bp, mouse
gcgccggaagcggaactacg

SEQ ID NO: 691674 - DNA, 20 bp, mouse
ggggagaaacaccaccgagg

SEQ ID NO: 691675 - DNA, 20 bp, mouse
gaaactccgcgcgtgcgcag

SEQ ID NO: 691676 - DNA, 20 bp, mouse
ggggcggccgaagtgagacc

SEQ ID NO: 691677 - DNA, 20 bp, mouse
gcctccgcgggctccgactc

SEQ ID NO: 691678 - DNA, 20 bp, mouse
gcgaccgatcacagcccggc

SEQ ID NO: 691679 - DNA, 20 bp, mouse
gcagcccggcgggaagaggg

SEQ ID NO: 691680 - DNA, 20 bp, mouse
gaggaggctcgcttcagcag

SEQ ID NO: 691681 - DNA, 20 bp, mouse
gagtcacccgggtcctcctc

SEQ ID NO: 691682 - DNA, 20 bp, mouse
ggggcccggctacccacccc

SEQ ID NO: 691683 - DNA, 20 bp, mouse
gagagctcccgagccagagt

SEQ ID NO: 691684 - DNA, 20 bp, mouse
ggggcctggcgttttcatgg

SEQ ID NO: 691685 - DNA, 20 bp, mouse
gtcacagcccggcgggaaga

SEQ ID NO: 691686 - DNA, 20 bp, mouse
ggccgcgcgcgtcgcccgtg

SEQ ID NO: 691687 - DNA, 20 bp, mouse
gcaggacttcgggtgatcac

SEQ ID NO: 691688 - DNA, 20 bp, mouse
ggcgcgcgtcgcccgtgggg

SEQ ID NO: 691689 - DNA, 20 bp, mouse
ggacgctgggctgggagacg

SEQ ID NO: 691690 - DNA, 20 bp, mouse
ggaagtgcgcacgcgtgagt

SEQ ID NO: 691691 - DNA, 20 bp, mouse
gtgcgcacgcgtgagtcggg

SEQ ID NO: 691692 - DNA, 20 bp, mouse
gggacagggcagatatcccg

SEQ ID NO: 691693 - DNA, 20 bp, mouse
gaccccccgcgagaagagaa

SEQ ID NO: 691694 - DNA, 20 bp, mouse
gggtggggcgacgctgggct

SEQ ID NO: 691695 - DNA, 20 bp, mouse
gcccgaatgctaggaggcca

SEQ ID NO: 691696 - DNA, 20 bp, mouse
gagcagatgtataaacacat

SEQ ID NO: 691697 - DNA, 20 bp, mouse
gagttacctacatgtgtcat

SEQ ID NO: 691698 - DNA, 20 bp, mouse
gagaaggtatagggcagtac

SEQ ID NO: 691699 - DNA, 20 bp, mouse
ggggaagtgattgctcttct

SEQ ID NO: 691700 - DNA, 20 bp, mouse
gaatcctagatagaaggtat

SEQ ID NO: 691701 - DNA, 20 bp, mouse
gtgccctataccttctatct

SEQ ID NO: 691702 - DNA, 20 bp, mouse
gaagtcacagattttgtgat

SEQ ID NO: 691703 - DNA, 20 bp, mouse
gttcttcatggagtggtaag

SEQ ID NO: 691704 - DNA, 20 bp, mouse
gacatgtgtcataggttgaa

SEQ ID NO: 691705 - DNA, 20 bp, mouse
gctagaccataaccaaagac

SEQ ID NO: 691706 - DNA, 20 bp, mouse
gtcctggcgcctgcgtagta

SEQ ID NO: 691707 - DNA, 20 bp, mouse
gcgtgcgctggagttgtacg

SEQ ID NO: 691708 - DNA, 20 bp, mouse
gctgtctcaggcacccaagt

SEQ ID NO: 691709 - DNA, 20 bp, mouse
gctgctggaaggaaatcacg

SEQ ID NO: 691710 - DNA, 20 bp, mouse
gagaccaatagcgtgagaaa

SEQ ID NO: 691711 - DNA, 20 bp, mouse
gaaccgagtggggaccagcg

SEQ ID NO: 691712 - DNA, 20 bp, mouse
gcctccagctcctacaagga

SEQ ID NO: 691713 - DNA, 20 bp, mouse
gtagcagtacggaaccgagt

SEQ ID NO: 691714 - DNA, 20 bp, mouse
gtaagcgtttagccccgtga

SEQ ID NO: 691715 - DNA, 20 bp, mouse
gctacgcaggcgccaggagg

SEQ ID NO: 691716 - DNA, 20 bp, mouse
gggtgtgcacgcagaagtag

SEQ ID NO: 691717 - DNA, 20 bp, mouse
gaggggcgggcaagcgataa

SEQ ID NO: 691718 - DNA, 20 bp, mouse
gctgcccgaaagcctttccg

SEQ ID NO: 691719 - DNA, 20 bp, mouse
gtgcacgcagaagtaggggc

SEQ ID NO: 691720 - DNA, 20 bp, mouse
gcgaagtagctctgattgga

SEQ ID NO: 691721 - DNA, 20 bp, mouse
ggcctccgccatccttgaga

SEQ ID NO: 691722 - DNA, 20 bp, mouse
ggaagcgaagtagctctgat

SEQ ID NO: 691723 - DNA, 20 bp, mouse
gaaaggctttcgggcaggtt

SEQ ID NO: 691724 - DNA, 20 bp, mouse
gttccccggcgaccccggaa

SEQ ID NO: 691725 - DNA, 20 bp, mouse
gcgaccccggaaaggctttc

SEQ ID NO: 691726 - DNA, 20 bp, mouse
gagaggggaagatttcaggt

SEQ ID NO: 691727 - DNA, 20 bp, mouse
gccacgaggcccgccctctg

SEQ ID NO: 691728 - DNA, 20 bp, mouse
gtctccccggaaacttaggt

SEQ ID NO: 691729 - DNA, 20 bp, mouse
gagggcgggcctcgtgggcg

SEQ ID NO: 691730 - DNA, 20 bp, mouse
gggggaggaagtagtactgt

SEQ ID NO: 691731 - DNA, 20 bp, mouse
ggagctgaagcagaggcccg

SEQ ID NO: 691732 - DNA, 20 bp, mouse
gcaacccacctaagtttccg

SEQ ID NO: 691733 - DNA, 20 bp, mouse
gcgaagctttggcccaggta

SEQ ID NO: 691734 - DNA, 20 bp, mouse
ggaggcagcaagagctctct

SEQ ID NO: 691735 - DNA, 20 bp, mouse
ggtagggttccgtgacccgc

SEQ ID NO: 691736 - DNA, 20 bp, mouse
gggcggggctaggccatgat

SEQ ID NO: 691737 - DNA, 20 bp, mouse
gccccgccctatggcctcat

SEQ ID NO: 691738 - DNA, 20 bp, mouse
gatggcctagccccgcccta

SEQ ID NO: 691739 - DNA, 20 bp, mouse
gaagggtccgcctttctcgc

SEQ ID NO: 691740 - DNA, 20 bp, mouse
gacttccgcaccagcgagaa

SEQ ID NO: 691741 - DNA, 20 bp, mouse
gttagttcggacgccctatt

SEQ ID NO: 691742 - DNA, 20 bp, mouse
gggtggccaagccaatgcga

SEQ ID NO: 691743 - DNA, 20 bp, mouse
gagccaatgaggccataggg

SEQ ID NO: 691744 - DNA, 20 bp, mouse
gtccgcacgtgtaaaggtgc

SEQ ID NO: 691745 - DNA, 20 bp, mouse
ggcggacccttcagccaatg

SEQ ID NO: 691746 - DNA, 20 bp, mouse
gcgccagcgaacagcgccac

SEQ ID NO: 691747 - DNA, 20 bp, mouse
gaaaccccgtaggagcaggg

SEQ ID NO: 691748 - DNA, 20 bp, mouse
gcacgaatcgggaacgggtc

SEQ ID NO: 691749 - DNA, 20 bp, mouse
gagggccgcggaaaccccgt

SEQ ID NO: 691750 - DNA, 20 bp, mouse
gttcccggagatccacgaat

SEQ ID NO: 691751 - DNA, 20 bp, mouse
ggccctgccgcagaggccgg

SEQ ID NO: 691752 - DNA, 20 bp, mouse
gaccggaggtgaagccctac

SEQ ID NO: 691753 - DNA, 20 bp, mouse
ggagccctgggcgcttaggg

SEQ ID NO: 691754 - DNA, 20 bp, mouse
gtccgtgccggaacagaata

SEQ ID NO: 691755 - DNA, 20 bp, mouse
gcaagggcacgctgacgcgc

SEQ ID NO: 691756 - DNA, 20 bp, mouse
ggcaacgcagtcagctgcga

SEQ ID NO: 691757 - DNA, 20 bp, mouse
ggacgccagggtgtccccga

SEQ ID NO: 691758 - DNA, 20 bp, mouse
gggaagagcgtcaagagggg

SEQ ID NO: 691759 - DNA, 20 bp, mouse
gagccggctgcggacatcca

SEQ ID NO: 691760 - DNA, 20 bp, mouse
gccgcggaagagcgtcaaga

SEQ ID NO: 691761 - DNA, 20 bp, mouse
gtccgcagccggctcgggat

SEQ ID NO: 691762 - DNA, 20 bp, mouse
gtcagagtgactggggtcag

SEQ ID NO: 691763 - DNA, 20 bp, mouse
gctccgcgggattcggcgag

SEQ ID NO: 691764 - DNA, 20 bp, mouse
gcgggattcggcgagaggct

SEQ ID NO: 691765 - DNA, 20 bp, mouse
ggatagggatgtgggtctct

SEQ ID NO: 691766 - DNA, 20 bp, mouse
ggggcccgacgtaaagcgaa

SEQ ID NO: 691767 - DNA, 20 bp, mouse
ggggtggcgcggcgtccgac

SEQ ID NO: 691768 - DNA, 20 bp, mouse
ggtcgcgcaggtcttcccgt

SEQ ID NO: 691769 - DNA, 20 bp, mouse
gggttcgtaaagcagcgcga

SEQ ID NO: 691770 - DNA, 20 bp, mouse
gcgcccggggcggagtctcc

SEQ ID NO: 691771 - DNA, 20 bp, mouse
gtacgaacccagcgcggcgg

SEQ ID NO: 691772 - DNA, 20 bp, mouse
gctgcgcgacatgtggccga

SEQ ID NO: 691773 - DNA, 20 bp, mouse
gagctcagactccacccctt

SEQ ID NO: 691774 - DNA, 20 bp, mouse
gggaagacctgcgcgacatg

SEQ ID NO: 691775 - DNA, 20 bp, mouse
gcgacatgtggccgaagggg

SEQ ID NO: 691776 - DNA, 20 bp, mouse
gactggcgcgtgctgggcgt

SEQ ID NO: 691777 - DNA, 20 bp, mouse
gaatcccgatactttgtggg

SEQ ID NO: 691778 - DNA, 20 bp, mouse
gcggagggagctggtcctta

SEQ ID NO: 691779 - DNA, 20 bp, mouse
gctgcgcttcaaaagaccca

SEQ ID NO: 691780 - DNA, 20 bp, mouse
gtgaacttgaggtatagggg

SEQ ID NO: 691781 - DNA, 20 bp, mouse
ggggattactggcgcgtgct

SEQ ID NO: 691782 - DNA, 20 bp, mouse
ggccttgaacttgaggtata

SEQ ID NO: 691783 - DNA, 20 bp, mouse
gagtaatcccgatactttgt

SEQ ID NO: 691784 - DNA, 20 bp, mouse
gacaccgatgcagttttaaa

SEQ ID NO: 691785 - DNA, 20 bp, mouse
gtaagacactgttaaggctt

SEQ ID NO: 691786 - DNA, 20 bp, mouse
gtgaagagatggtgtgaaag

SEQ ID NO: 691787 - DNA, 20 bp, mouse
gctcacctgtctgcccaggt

SEQ ID NO: 691788 - DNA, 20 bp, mouse
gtaaagtaagggtcaacatt

SEQ ID NO: 691789 - DNA, 20 bp, mouse
gtgaacggttaccttctaac

SEQ ID NO: 691790 - DNA, 20 bp, mouse
gctgttcttgggacctactc

SEQ ID NO: 691791 - DNA, 20 bp, mouse
gtagggacttacctgttaga

SEQ ID NO: 691792 - DNA, 20 bp, mouse
gaagagaagccagtcccacc

SEQ ID NO: 691793 - DNA, 20 bp, mouse
gccagtaccaagtactgacg

SEQ ID NO: 691794 - DNA, 20 bp, mouse
gataagctctcttacagctc

SEQ ID NO: 691795 - DNA, 20 bp, mouse
gaacatttggggtctgttct

SEQ ID NO: 691796 - DNA, 20 bp, mouse
gtcgtcccgggccacccgtc

SEQ ID NO: 691797 - DNA, 20 bp, mouse
gacagcgcttgttccgaccg

SEQ ID NO: 691798 - DNA, 20 bp, mouse
gacggggaggttaaagtgga

SEQ ID NO: 691799 - DNA, 20 bp, mouse
gcgcgggcgcaggaaggctc

SEQ ID NO: 691800 - DNA, 20 bp, mouse
gctaccgggtcccatcgcta

SEQ ID NO: 691801 - DNA, 20 bp, mouse
gccggcgggagcggtcccgg

SEQ ID NO: 691802 - DNA, 20 bp, mouse
ggcggggcctctttcccgga

SEQ ID NO: 691803 - DNA, 20 bp, mouse
gacaccaagacagccccggt

SEQ ID NO: 691804 - DNA, 20 bp, mouse
gtgcgcccgcgggcccgacg

SEQ ID NO: 691805 - DNA, 20 bp, mouse
gtggctggcgaggcgctcag

SEQ ID NO: 691806 - DNA, 20 bp, mouse
gccgggagcagaggacccga

SEQ ID NO: 691807 - DNA, 20 bp, mouse
gcagaggacccgagggagaa

SEQ ID NO: 691808 - DNA, 20 bp, mouse
gccaacagggcgagagagga

SEQ ID NO: 691809 - DNA, 20 bp, mouse
gcggcaagcccctgcagctg

SEQ ID NO: 691810 - DNA, 20 bp, mouse
ggggcagaggaacagtcacc

SEQ ID NO: 691811 - DNA, 20 bp, mouse
gggcggaggccggtcggggt

SEQ ID NO: 691812 - DNA, 20 bp, mouse
gccctgccccagtccaacaa

SEQ ID NO: 691813 - DNA, 20 bp, mouse
gcaaggacagatggaaggtc

SEQ ID NO: 691814 - DNA, 20 bp, mouse
gctggcgccgggagactact

SEQ ID NO: 691815 - DNA, 20 bp, mouse
gcccggcctttgttggactg

SEQ ID NO: 691816 - DNA, 20 bp, mouse
gaacccaaggggcccacact

SEQ ID NO: 691817 - DNA, 20 bp, mouse
gactctgggaagatctaggt

SEQ ID NO: 691818 - DNA, 20 bp, mouse
gggaggaaccagggaaccca

SEQ ID NO: 691819 - DNA, 20 bp, mouse
gcgggcggaccgcaagtctc

SEQ ID NO: 691820 - DNA, 20 bp, mouse
gggttcctccccgagactct

SEQ ID NO: 691821 - DNA, 20 bp, mouse
gaccccagtgtgggcccctt

SEQ ID NO: 691822 - DNA, 20 bp, mouse
gcgagactctgggaagatct

SEQ ID NO: 691823 - DNA, 20 bp, mouse
ggcggaccgcaagtctcagg

SEQ ID NO: 691824 - DNA, 20 bp, mouse
gtcttcccagagtctcgggg

SEQ ID NO: 691825 - DNA, 20 bp, mouse
gaagatctaggtagggatga

SEQ ID NO: 691826 - DNA, 20 bp, mouse
gcgggagcaaggggtagtag

SEQ ID NO: 691827 - DNA, 20 bp, mouse
ggcgagtgggcgggtagctg

SEQ ID NO: 691828 - DNA, 20 bp, mouse
gtgaggcagccgaaggctag

SEQ ID NO: 691829 - DNA, 20 bp, mouse
gtgggcgggactttgagggg

SEQ ID NO: 691830 - DNA, 20 bp, mouse
ggtagctgggggcgtgactg

SEQ ID NO: 691831 - DNA, 20 bp, mouse
gcggtcgaaggcgggagcaa

SEQ ID NO: 691832 - DNA, 20 bp, mouse
gagggtgaacccggaaatcc

SEQ ID NO: 691833 - DNA, 20 bp, mouse
gaagccggacgtgacgttgg

SEQ ID NO: 691834 - DNA, 20 bp, mouse
gcgtgtctgaggcgagtggg

SEQ ID NO: 691835 - DNA, 20 bp, mouse
gtggaagccggacgtgacgt

SEQ ID NO: 691836 - DNA, 20 bp, mouse
gcactggccagtcaacttga

SEQ ID NO: 691837 - DNA, 20 bp, mouse
gtaaacttctcaacgtctct

SEQ ID NO: 691838 - DNA, 20 bp, mouse
gcggatcctgagagttccgt

SEQ ID NO: 691839 - DNA, 20 bp, mouse
gaaactggagactggagtag

SEQ ID NO: 691840 - DNA, 20 bp, mouse
gtacacccggggcaggccac

SEQ ID NO: 691841 - DNA, 20 bp, mouse
gttccgcccacggaactctc

SEQ ID NO: 691842 - DNA, 20 bp, mouse
ggttagacttggatgttggg

SEQ ID NO: 691843 - DNA, 20 bp, mouse
gttccgtgggcggaacaggt

SEQ ID NO: 691844 - DNA, 20 bp, mouse
gctcgttagacttggatgtt

SEQ ID NO: 691845 - DNA, 20 bp, mouse
gagcatagcaggaaggtcag

SEQ ID NO: 691846 - DNA, 20 bp, mouse
ggtcctgcgcgctgcgaggg

SEQ ID NO: 691847 - DNA, 20 bp, mouse
gcccccgccaagcaccgcgg

SEQ ID NO: 691848 - DNA, 20 bp, mouse
gcgagcggggtggtctgggt

SEQ ID NO: 691849 - DNA, 20 bp, mouse
ggccgcgctgggttccgcgt

SEQ ID NO: 691850 - DNA, 20 bp, mouse
ggcggtgcctgggtcccccg

SEQ ID NO: 691851 - DNA, 20 bp, mouse
gacgggaaggtgatcgcgac

SEQ ID NO: 691852 - DNA, 20 bp, mouse
ggcaccgctgcggacacccc

SEQ ID NO: 691853 - DNA, 20 bp, mouse
gtttctgccaggcaccgctg

SEQ ID NO: 691854 - DNA, 20 bp, mouse
gcggcgcccgggctcaaagg

SEQ ID NO: 691855 - DNA, 20 bp, mouse
ggggcacggcggctacggga

SEQ ID NO: 691856 - DNA, 20 bp, mouse
ggcagtgggtgtcacgtgat

SEQ ID NO: 691857 - DNA, 20 bp, mouse
gtggcgccggggaagcacat

SEQ ID NO: 691858 - DNA, 20 bp, mouse
gagccagcgccccacgtgac

SEQ ID NO: 691859 - DNA, 20 bp, mouse
gcccaggccgaccccctctg

SEQ ID NO: 691860 - DNA, 20 bp, mouse
gtgagtgctaagtgaagtgc

SEQ ID NO: 691861 - DNA, 20 bp, mouse
ggagttccaaagttcgggag

SEQ ID NO: 691862 - DNA, 20 bp, mouse
gaccgccagagcctcagagg

SEQ ID NO: 691863 - DNA, 20 bp, mouse
gcccacgtgaccggcgcaga

SEQ ID NO: 691864 - DNA, 20 bp, mouse
gtccccgcacagatcccgct

SEQ ID NO: 691865 - DNA, 20 bp, mouse
gcctgggagttccaaagttc

SEQ ID NO: 691866 - DNA, 20 bp, mouse
gaccaatccgcgcagggcgg

SEQ ID NO: 691867 - DNA, 20 bp, mouse
ggccctgcgcggattggtag

SEQ ID NO: 691868 - DNA, 20 bp, mouse
gcaagccagtggcgtaaggg

SEQ ID NO: 691869 - DNA, 20 bp, mouse
gcccgccgcccttacgccac

SEQ ID NO: 691870 - DNA, 20 bp, mouse
gcccggcggcgcacactcac

SEQ ID NO: 691871 - DNA, 20 bp, mouse
ggcgaaggagccactcgggg

SEQ ID NO: 691872 - DNA, 20 bp, mouse
gcagcgggcaagctcggttg

SEQ ID NO: 691873 - DNA, 20 bp, mouse
gccactagagcctccccgag

SEQ ID NO: 691874 - DNA, 20 bp, mouse
gcgcaaagccatattcgcga

SEQ ID NO: 691875 - DNA, 20 bp, mouse
gcccgggcctggcgtcctga

SEQ ID NO: 691876 - DNA, 20 bp, mouse
ggtactaaaatgggtggccg

SEQ ID NO: 691877 - DNA, 20 bp, mouse
gaagaccggcggtgctacaa

SEQ ID NO: 691878 - DNA, 20 bp, mouse
ggcgccctgtgtaaaaggaa

SEQ ID NO: 691879 - DNA, 20 bp, mouse
ggctacaagggatatgtctg

SEQ ID NO: 691880 - DNA, 20 bp, mouse
gagaatccacggggctaaac

SEQ ID NO: 691881 - DNA, 20 bp, mouse
gaatactaagagaatccacg

SEQ ID NO: 691882 - DNA, 20 bp, mouse
gaggaagcagccgtattatg

SEQ ID NO: 691883 - DNA, 20 bp, mouse
gcacacgcgccctgtgtaaa

SEQ ID NO: 691884 - DNA, 20 bp, mouse
gtctgcggtactaaaatggg

SEQ ID NO: 691885 - DNA, 20 bp, mouse
gttcaaccagctgcagtgct

SEQ ID NO: 691886 - DNA, 20 bp, mouse
gaaagatcggtgatccggga

SEQ ID NO: 691887 - DNA, 20 bp, mouse
gagctgagggagagaccgaa

SEQ ID NO: 691888 - DNA, 20 bp, mouse
gggacggctgaggatctccg

SEQ ID NO: 691889 - DNA, 20 bp, mouse
ggcggcgcggtgcggagctg

SEQ ID NO: 691890 - DNA, 20 bp, mouse
ggcgagcggccgggcttctt

SEQ ID NO: 691891 - DNA, 20 bp, mouse
gaccgaagggcacgtctgta

SEQ ID NO: 691892 - DNA, 20 bp, mouse
gaggagctgacactctttct

SEQ ID NO: 691893 - DNA, 20 bp, mouse
gagcaagcgtcgagaggcgg

SEQ ID NO: 691894 - DNA, 20 bp, mouse
gcggtgatccgggacggctg

SEQ ID NO: 691895 - DNA, 20 bp, mouse
gagcgccttcggccgctgtt

SEQ ID NO: 691896 - DNA, 20 bp, mouse
ggccggccgccgcaccacgt

SEQ ID NO: 691897 - DNA, 20 bp, mouse
gcagcaagctagcacacaat

SEQ ID NO: 691898 - DNA, 20 bp, mouse
gctctgcggcccacgtggtg

SEQ ID NO: 691899 - DNA, 20 bp, mouse
gctggccccggcgcgctctg

SEQ ID NO: 691900 - DNA, 20 bp, mouse
gccgaggggtaggtgaccac

SEQ ID NO: 691901 - DNA, 20 bp, mouse
gagctggggcgctgtagctg

SEQ ID NO: 691902 - DNA, 20 bp, mouse
gtgcggcccacgtggtgcgg

SEQ ID NO: 691903 - DNA, 20 bp, mouse
gggccagcagcgggccccgt

SEQ ID NO: 691904 - DNA, 20 bp, mouse
ggggaggaggagttatattg

SEQ ID NO: 691905 - DNA, 20 bp, mouse
gtgggccgcagagcgcgccg

SEQ ID NO: 691906 - DNA, 20 bp, mouse
gcctctgggaaggacggagt

SEQ ID NO: 691907 - DNA, 20 bp, mouse
gagggcctgcggccaataag

SEQ ID NO: 691908 - DNA, 20 bp, mouse
gcccgccccgagagaggact

SEQ ID NO: 691909 - DNA, 20 bp, mouse
gtcagggagaggcaccatat

SEQ ID NO: 691910 - DNA, 20 bp, mouse
gaccgcgaaggcctctggga

SEQ ID NO: 691911 - DNA, 20 bp, mouse
ggcgagaccgcgaaggcctc

SEQ ID NO: 691912 - DNA, 20 bp, mouse
gagaccacgagtggagcccc

SEQ ID NO: 691913 - DNA, 20 bp, mouse
gtgggaaggacggagttggg

SEQ ID NO: 691914 - DNA, 20 bp, mouse
ggccgggccggctatgtcca

SEQ ID NO: 691915 - DNA, 20 bp, mouse
gctcaagctaccctcggccc

SEQ ID NO: 691916 - DNA, 20 bp, mouse
gagagggtggagatcgggga

SEQ ID NO: 691917 - DNA, 20 bp, mouse
gcgcttgcgcagtgcggggg

SEQ ID NO: 691918 - DNA, 20 bp, mouse
ggagctgtcgctcaagggga

SEQ ID NO: 691919 - DNA, 20 bp, mouse
gctctctcccacctacccat

SEQ ID NO: 691920 - DNA, 20 bp, mouse
gagagcgagctgtcgctcaa

SEQ ID NO: 691921 - DNA, 20 bp, mouse
ggggctgcttggttggtcag

SEQ ID NO: 691922 - DNA, 20 bp, mouse
gcgcttgcgcggctgtcata

SEQ ID NO: 691923 - DNA, 20 bp, mouse
ggcgcctgcgcattgccgac

SEQ ID NO: 691924 - DNA, 20 bp, mouse
gcgactggttggaagcacta

SEQ ID NO: 691925 - DNA, 20 bp, mouse
gcgtcatccgatgggtaggt

SEQ ID NO: 691926 - DNA, 20 bp, mouse
gagggcgagcttcacgtgac

SEQ ID NO: 691927 - DNA, 20 bp, mouse
gcgagcttcacgtgacgggg

SEQ ID NO: 691928 - DNA, 20 bp, mouse
gctggcaaccccacgtgctg

SEQ ID NO: 691929 - DNA, 20 bp, mouse
ggggcgccgaactgaagatg

SEQ ID NO: 691930 - DNA, 20 bp, mouse
gccgcctccaggtcgcccat

SEQ ID NO: 691931 - DNA, 20 bp, mouse
gtatcccggaagtgtggtcg

SEQ ID NO: 691932 - DNA, 20 bp, mouse
gggcgcgccggggcctatcc

SEQ ID NO: 691933 - DNA, 20 bp, mouse
gcactaatccgcagcacgtg

SEQ ID NO: 691934 - DNA, 20 bp, mouse
gctgcggattagtgcacttc

SEQ ID NO: 691935 - DNA, 20 bp, mouse
gtggtccaggagacggggcg

SEQ ID NO: 691936 - DNA, 20 bp, mouse
gagcgccgcgcaccgacgtc

SEQ ID NO: 691937 - DNA, 20 bp, mouse
gggtgcgcggcgctcacttg

SEQ ID NO: 691938 - DNA, 20 bp, mouse
ggggcgcggctcatcgagag

SEQ ID NO: 691939 - DNA, 20 bp, mouse
ggtagagccgccggccaggt

SEQ ID NO: 691940 - DNA, 20 bp, mouse
ggggcgcctgggttcccacc

SEQ ID NO: 691941 - DNA, 20 bp, mouse
gcgaaagccagccccgggaa

SEQ ID NO: 691942 - DNA, 20 bp, mouse
ggccgcgcaccgacgtccgg

SEQ ID NO: 691943 - DNA, 20 bp, mouse
gcggcgctcacttgcggcga

SEQ ID NO: 691944 - DNA, 20 bp, mouse
ggctgaggccgcgtaggcag

SEQ ID NO: 691945 - DNA, 20 bp, mouse
gcgccccgccgcctcggcgt

SEQ ID NO: 691946 - DNA, 20 bp, mouse
gcgtgcggacggatccctcc

SEQ ID NO: 691947 - DNA, 20 bp, mouse
gtcgcagggcgagaggactt

SEQ ID NO: 691948 - DNA, 20 bp, mouse
gcactctagccccacccttt

SEQ ID NO: 691949 - DNA, 20 bp, mouse
gaacgtgcaggaggcggggt

SEQ ID NO: 691950 - DNA, 20 bp, mouse
gagaaaacgtgcaggaggcg

SEQ ID NO: 691951 - DNA, 20 bp, mouse
gcctgcgcgctcccggaagc

SEQ ID NO: 691952 - DNA, 20 bp, mouse
gtggaggagaaagggttcta

SEQ ID NO: 691953 - DNA, 20 bp, mouse
ggcatctgaggggcccgaga

SEQ ID NO: 691954 - DNA, 20 bp, mouse
gcgagtcctcccaaagggtg

SEQ ID NO: 691955 - DNA, 20 bp, mouse
gcggccacgcggacggaagt

SEQ ID NO: 691956 - DNA, 20 bp, mouse
gagccagcgcattagggagc

SEQ ID NO: 691957 - DNA, 20 bp, mouse
gctccggctccctaatgcgc

SEQ ID NO: 691958 - DNA, 20 bp, mouse
gctgcgatgcgtgcctgctg

SEQ ID NO: 691959 - DNA, 20 bp, mouse
gctcgcccgggctggctgcg

SEQ ID NO: 691960 - DNA, 20 bp, mouse
ggcggccgctctaggagcgc

SEQ ID NO: 691961 - DNA, 20 bp, mouse
gagcgcgggaggtgcgcggg

SEQ ID NO: 691962 - DNA, 20 bp, mouse
gccgcggggcggcgcacttc

SEQ ID NO: 691963 - DNA, 20 bp, mouse
gggggctcctgaccccgaag

SEQ ID NO: 691964 - DNA, 20 bp, mouse
gtaggagcgcgggaggtgcg

SEQ ID NO: 691965 - DNA, 20 bp, mouse
gcatcgcagccagcgcatta

SEQ ID NO: 691966 - DNA, 20 bp, mouse
ggggaaagccggaaccggtg

SEQ ID NO: 691967 - DNA, 20 bp, mouse
gaaagctagagcgtcgccgg

SEQ ID NO: 691968 - DNA, 20 bp, mouse
ggaggccccgcccccctcac

SEQ ID NO: 691969 - DNA, 20 bp, mouse
gtaaccggaaaacgtcaaca

SEQ ID NO: 691970 - DNA, 20 bp, mouse
gaaagccggaaccggtgagg

SEQ ID NO: 691971 - DNA, 20 bp, mouse
ggctcggagtctgtcaatca

SEQ ID NO: 691972 - DNA, 20 bp, mouse
gctccaaggctcgttacgat

SEQ ID NO: 691973 - DNA, 20 bp, mouse
gtggatgcggagctttggat

SEQ ID NO: 691974 - DNA, 20 bp, mouse
gcggagtctgtcaatcaagg

SEQ ID NO: 691975 - DNA, 20 bp, mouse
gtccgccaagtgacagtaac

SEQ ID NO: 691976 - DNA, 20 bp, mouse
gcctccctgggacacgacag

SEQ ID NO: 691977 - DNA, 20 bp, mouse
gcacgacagtgggggtgtca

SEQ ID NO: 691978 - DNA, 20 bp, mouse
gggagagatgtgtgcccctc

SEQ ID NO: 691979 - DNA, 20 bp, mouse
gacagccctacttcctccct

SEQ ID NO: 691980 - DNA, 20 bp, mouse
gccaggatggggcaatacaa

SEQ ID NO: 691981 - DNA, 20 bp, mouse
gagcatggatgatgctgaca

SEQ ID NO: 691982 - DNA, 20 bp, mouse
gcccccactgtcgtgtccca

SEQ ID NO: 691983 - DNA, 20 bp, mouse
gctggttccagctataagta

SEQ ID NO: 691984 - DNA, 20 bp, mouse
gtcattggtattcagcagca

SEQ ID NO: 691985 - DNA, 20 bp, mouse
gggggcaatacaacggcctc

SEQ ID NO: 691986 - DNA, 20 bp, mouse
ggcccagtggagtcgcgaag

SEQ ID NO: 691987 - DNA, 20 bp, mouse
gtccagacggcgtccactgc

SEQ ID NO: 691988 - DNA, 20 bp, mouse
ggagagggtgagttggagcc

SEQ ID NO: 691989 - DNA, 20 bp, mouse
gttcctgtcggcgtcgtccg

SEQ ID NO: 691990 - DNA, 20 bp, mouse
gtgggcgccttggtccaccg

SEQ ID NO: 691991 - DNA, 20 bp, mouse
gcgtcgtccgcggtggacca

SEQ ID NO: 691992 - DNA, 20 bp, mouse
gacggcgtccactgcgggcc

SEQ ID NO: 691993 - DNA, 20 bp, mouse
gcatggctgtcgcggtacgc

SEQ ID NO: 691994 - DNA, 20 bp, mouse
gagccacttcgcgactccac

SEQ ID NO: 691995 - DNA, 20 bp, mouse
ggctggcgatggccgcggag

SEQ ID NO: 691996 - DNA, 20 bp, mouse
gcgaagctctgctaggtgat

SEQ ID NO: 691997 - DNA, 20 bp, mouse
gtgcacacacggcagtgcgg

SEQ ID NO: 691998 - DNA, 20 bp, mouse
ggggcgagacgcttctattg

SEQ ID NO: 691999 - DNA, 20 bp, mouse
gacctagcagagcttcgcct

SEQ ID NO: 692000 - DNA, 20 bp, mouse
gagagagagagcaacgtggg

SEQ ID NO: 692001 - DNA, 20 bp, mouse
ggctgcccgggataggactc

SEQ ID NO: 692002 - DNA, 20 bp, mouse
gatcgccccaggtttctgat

SEQ ID NO: 692003 - DNA, 20 bp, mouse
ggccaaagatgcagccgtga

SEQ ID NO: 692004 - DNA, 20 bp, mouse
gtcgcccaatcagaaacctg

SEQ ID NO: 692005 - DNA, 20 bp, mouse
ggcaacatgctcatcgcccc

SEQ ID NO: 692006 - DNA, 20 bp, mouse
gcggcaggtggaagcgagtg

SEQ ID NO: 692007 - DNA, 20 bp, mouse
gcagcgccggcgtcgctcat

SEQ ID NO: 692008 - DNA, 20 bp, mouse
gctggcagctgcctctataa

SEQ ID NO: 692009 - DNA, 20 bp, mouse
gaggatgaggcatcagatct

SEQ ID NO: 692010 - DNA, 20 bp, mouse
gctgcgtgccaaaagagaat

SEQ ID NO: 692011 - DNA, 20 bp, mouse
gctaaagtaatactcgagag

SEQ ID NO: 692012 - DNA, 20 bp, mouse
ggggtgcatgggtgatgtct

SEQ ID NO: 692013 - DNA, 20 bp, mouse
ggtgacccaaacacaaccag

SEQ ID NO: 692014 - DNA, 20 bp, mouse
ggccaaaagagaataggatg

SEQ ID NO: 692015 - DNA, 20 bp, mouse
gcggctcccgacggcgcggc

SEQ ID NO: 692016 - DNA, 20 bp, mouse
gaaggacactcccactgcga

SEQ ID NO: 692017 - DNA, 20 bp, mouse
gtggctggggaaacgaaggg

SEQ ID NO: 692018 - DNA, 20 bp, mouse
gcccaccctcggcttttatg

SEQ ID NO: 692019 - DNA, 20 bp, mouse
gaggcggcttgtatgtgtag

SEQ ID NO: 692020 - DNA, 20 bp, mouse
ggattggctggggaaacgaa

SEQ ID NO: 692021 - DNA, 20 bp, mouse
ggaaaaagccctctatcgga

SEQ ID NO: 692022 - DNA, 20 bp, mouse
ggggtggatgcagcagggtt

SEQ ID NO: 692023 - DNA, 20 bp, mouse
gtgtcacaactgcaggtcat

SEQ ID NO: 692024 - DNA, 20 bp, mouse
gctggtctctgttgttgtag

SEQ ID NO: 692025 - DNA, 20 bp, mouse
gggggactgcgcagtcaaaa

SEQ ID NO: 692026 - DNA, 20 bp, mouse
ggaaaatgggggccaggcat

SEQ ID NO: 692027 - DNA, 20 bp, mouse
gtgggggccaggcattggac

SEQ ID NO: 692028 - DNA, 20 bp, mouse
ggcaaatgcacaggtgaaaa

SEQ ID NO: 692029 - DNA, 20 bp, mouse
gaatgcacaggtgaaaatgg

SEQ ID NO: 692030 - DNA, 20 bp, mouse
ggtcaaacatgcaaatgcac

SEQ ID NO: 692031 - DNA, 20 bp, mouse
gcaggcattggacaggagcg

SEQ ID NO: 692032 - DNA, 20 bp, mouse
gaccacagcaacggacggac

SEQ ID NO: 692033 - DNA, 20 bp, mouse
gagaaaacgtgagggatgaa

SEQ ID NO: 692034 - DNA, 20 bp, mouse
gcggacgggtgtgtccaacc

SEQ ID NO: 692035 - DNA, 20 bp, mouse
gtggacccaattattctgct

SEQ ID NO: 692036 - DNA, 20 bp, mouse
gggaaacgccgtacccgggg

SEQ ID NO: 692037 - DNA, 20 bp, mouse
gaggtggggtcggtataaag

SEQ ID NO: 692038 - DNA, 20 bp, mouse
gcgtggaaacgccgtacccg

SEQ ID NO: 692039 - DNA, 20 bp, mouse
gcggtctcggcgtccccccc

SEQ ID NO: 692040 - DNA, 20 bp, mouse
gcgccgagaccgagaggtcc

SEQ ID NO: 692041 - DNA, 20 bp, mouse
gtccgccggtggctcaagcc

SEQ ID NO: 692042 - DNA, 20 bp, mouse
gagtaccgccccgtggggga

SEQ ID NO: 692043 - DNA, 20 bp, mouse
ggccgcgagtaccgccccgt

SEQ ID NO: 692044 - DNA, 20 bp, mouse
gcatcagtgagcgggatcgc

SEQ ID NO: 692045 - DNA, 20 bp, mouse
gggccgccgtagtccacccg

SEQ ID NO: 692046 - DNA, 20 bp, mouse
gcagtgcagcgcgcgacgtg

SEQ ID NO: 692047 - DNA, 20 bp, mouse
gcgcccgaacccgcctgctc

SEQ ID NO: 692048 - DNA, 20 bp, mouse
ggtcccgctccgcgtccccg

SEQ ID NO: 692049 - DNA, 20 bp, mouse
gcacctgagcaggcgggttc

SEQ ID NO: 692050 - DNA, 20 bp, mouse
gaagccccggggacgcggag

SEQ ID NO: 692051 - DNA, 20 bp, mouse
gggagtccggagttggaagg

SEQ ID NO: 692052 - DNA, 20 bp, mouse
gtggggaagccccggggacg

SEQ ID NO: 692053 - DNA, 20 bp, mouse
gcgcgcgctgcactgcgctg

SEQ ID NO: 692054 - DNA, 20 bp, mouse
ggttggaaggggggtgatga

SEQ ID NO: 692055 - DNA, 20 bp, mouse
gcgggaccagcgcgtgggga

SEQ ID NO: 692056 - DNA, 20 bp, mouse
ggacagggagcccagtctga

SEQ ID NO: 692057 - DNA, 20 bp, mouse
gtgctaggatctgggccaag

SEQ ID NO: 692058 - DNA, 20 bp, mouse
gggcccaaccccagagggtg

SEQ ID NO: 692059 - DNA, 20 bp, mouse
gtgtcattccgcaccctctg

SEQ ID NO: 692060 - DNA, 20 bp, mouse
ggggacgtacgccgaagacc

SEQ ID NO: 692061 - DNA, 20 bp, mouse
gtggcccagatcctagcagg

SEQ ID NO: 692062 - DNA, 20 bp, mouse
ggtacgccgaagacctggag

SEQ ID NO: 692063 - DNA, 20 bp, mouse
gcccccaggaagaatttcca

SEQ ID NO: 692064 - DNA, 20 bp, mouse
gcccagggcccaaccccaga

SEQ ID NO: 692065 - DNA, 20 bp, mouse
gggatctgggccaagtggca

SEQ ID NO: 692066 - DNA, 20 bp, mouse
gagcccgtggtccctcccgt

SEQ ID NO: 692067 - DNA, 20 bp, mouse
ggggaccacgggctagcggg

SEQ ID NO: 692068 - DNA, 20 bp, mouse
gctggcgaccgtggcggggt

SEQ ID NO: 692069 - DNA, 20 bp, mouse
gacggtcgccagcacggcag

SEQ ID NO: 692070 - DNA, 20 bp, mouse
gctggaaggcggtactccga

SEQ ID NO: 692071 - DNA, 20 bp, mouse
ggagggactgaagagcggga

SEQ ID NO: 692072 - DNA, 20 bp, mouse
ggagggagggaccgacggga

SEQ ID NO: 692073 - DNA, 20 bp, mouse
gccttgccaggggcccgcgc

SEQ ID NO: 692074 - DNA, 20 bp, mouse
ggggagggaccacgggctag

SEQ ID NO: 692075 - DNA, 20 bp, mouse
gccgtgctggcgaccgtggc

SEQ ID NO: 692076 - DNA, 20 bp, mouse
ggggagctgggcacaaaagc

SEQ ID NO: 692077 - DNA, 20 bp, mouse
gggtcccctcggtgggtggt

SEQ ID NO: 692078 - DNA, 20 bp, mouse
gttgcccccggggggataag

SEQ ID NO: 692079 - DNA, 20 bp, mouse
gagctcccaccacccaccga

SEQ ID NO: 692080 - DNA, 20 bp, mouse
gacttggccagcccaggcaa

SEQ ID NO: 692081 - DNA, 20 bp, mouse
gactccacttatccccccgg

SEQ ID NO: 692082 - DNA, 20 bp, mouse
gcgtatgtcaccgtcatcaa

SEQ ID NO: 692083 - DNA, 20 bp, mouse
gggggggataagtggagtgc

SEQ ID NO: 692084 - DNA, 20 bp, mouse
gcctgggtcccctcggtggg

SEQ ID NO: 692085 - DNA, 20 bp, mouse
gggtgacatacggtgtgaca

SEQ ID NO: 692086 - DNA, 20 bp, mouse
gaaggggcgcggtagggaat

SEQ ID NO: 692087 - DNA, 20 bp, mouse
ggcaccttcccattcccgga

SEQ ID NO: 692088 - DNA, 20 bp, mouse
gacacacagaggctagtggg

SEQ ID NO: 692089 - DNA, 20 bp, mouse
gcacacacacagaggctagt

SEQ ID NO: 692090 - DNA, 20 bp, mouse
ggatccaagtcatccctctg

SEQ ID NO: 692091 - DNA, 20 bp, mouse
ggggaggggaatccactact

SEQ ID NO: 692092 - DNA, 20 bp, mouse
gcccggaaggttccgagtag

SEQ ID NO: 692093 - DNA, 20 bp, mouse
ggagagagcaagtccctggt

SEQ ID NO: 692094 - DNA, 20 bp, mouse
ggaaccttccgggaatggga

SEQ ID NO: 692095 - DNA, 20 bp, mouse
gtgtcacagctccacccgca

SEQ ID NO: 692096 - DNA, 20 bp, mouse
ggctgggcggaggacctcag

SEQ ID NO: 692097 - DNA, 20 bp, mouse
ggaagcagacggcggagggg

SEQ ID NO: 692098 - DNA, 20 bp, mouse
gagagggcccgggtgctggg

SEQ ID NO: 692099 - DNA, 20 bp, mouse
ggagggtctgcagcggagag

SEQ ID NO: 692100 - DNA, 20 bp, mouse
gcctccgccgtctgcttcca

SEQ ID NO: 692101 - DNA, 20 bp, mouse
gtagggctgctgcccgcaga

SEQ ID NO: 692102 - DNA, 20 bp, mouse
gagaggcctgtgaagggatc

SEQ ID NO: 692103 - DNA, 20 bp, mouse
gaggtcctccgcccagcacc

SEQ ID NO: 692104 - DNA, 20 bp, mouse
gcagtgatcgccagcccctg

SEQ ID NO: 692105 - DNA, 20 bp, mouse
gggcggaggacctcaggggc

SEQ ID NO: 692106 - DNA, 20 bp, mouse
gaggatggaggggtggtgat

SEQ ID NO: 692107 - DNA, 20 bp, mouse
gcacccaggcccctgtgctt

SEQ ID NO: 692108 - DNA, 20 bp, mouse
gcgctcacgtgggctctcat

SEQ ID NO: 692109 - DNA, 20 bp, mouse
gcctcacgccgattgggtca

SEQ ID NO: 692110 - DNA, 20 bp, mouse
gaagccaatcggtgtgaact

SEQ ID NO: 692111 - DNA, 20 bp, mouse
gagacagtcccagaggatgg

SEQ ID NO: 692112 - DNA, 20 bp, mouse
ggagcggtggggaaacgcag

SEQ ID NO: 692113 - DNA, 20 bp, mouse
gaacagagctgtaacacaat

SEQ ID NO: 692114 - DNA, 20 bp, mouse
gctagtgcctcacgccgatt

SEQ ID NO: 692115 - DNA, 20 bp, mouse
gagagcccacgtgagcggtg

SEQ ID NO: 692116 - DNA, 20 bp, mouse
gcccccgccgagtggagaga

SEQ ID NO: 692117 - DNA, 20 bp, mouse
gggtatgcgcgggtctgggc

SEQ ID NO: 692118 - DNA, 20 bp, mouse
gctggggaataatgcagtaa

SEQ ID NO: 692119 - DNA, 20 bp, mouse
gccgccgagtggagagacgg

SEQ ID NO: 692120 - DNA, 20 bp, mouse
gcagccccggcgcacagccg

SEQ ID NO: 692121 - DNA, 20 bp, mouse
gcggcccgggcgcacggcgc

SEQ ID NO: 692122 - DNA, 20 bp, mouse
gtaaaggaagtgagcaggct

SEQ ID NO: 692123 - DNA, 20 bp, mouse
ggcctggccggcgggtcccc

SEQ ID NO: 692124 - DNA, 20 bp, mouse
ggtagagaaaagctcgctta

SEQ ID NO: 692125 - DNA, 20 bp, mouse
ggtccccaggctcctcccct

SEQ ID NO: 692126 - DNA, 20 bp, mouse
gtgcacgggacggactaaca

SEQ ID NO: 692127 - DNA, 20 bp, mouse
gagtccccggagcgagtgca

SEQ ID NO: 692128 - DNA, 20 bp, mouse
ggcggcggagctgacgtgtg

SEQ ID NO: 692129 - DNA, 20 bp, mouse
ggagccctaagcaggacttt

SEQ ID NO: 692130 - DNA, 20 bp, mouse
gccgtcccgtgcactcgctc

SEQ ID NO: 692131 - DNA, 20 bp, mouse
gccggggcccgagaaagcgg

SEQ ID NO: 692132 - DNA, 20 bp, mouse
gaggcccaaagtcctgctta

SEQ ID NO: 692133 - DNA, 20 bp, mouse
gagggtacgtacgggagccc

SEQ ID NO: 692134 - DNA, 20 bp, mouse
ggtcccggccgcgtgtgcga

SEQ ID NO: 692135 - DNA, 20 bp, mouse
gggccccggcagtgccgggg

SEQ ID NO: 692136 - DNA, 20 bp, mouse
gtggcctcgcgagaccctta

SEQ ID NO: 692137 - DNA, 20 bp, mouse
gaaggcacgcgcgcccggag

SEQ ID NO: 692138 - DNA, 20 bp, mouse
gcgggcctgtaagtgcttgg

SEQ ID NO: 692139 - DNA, 20 bp, mouse
gacaggtcgcgaggctgaga

SEQ ID NO: 692140 - DNA, 20 bp, mouse
gcgcaactggccactcccta

SEQ ID NO: 692141 - DNA, 20 bp, mouse
gaggctgagagggctttgct

SEQ ID NO: 692142 - DNA, 20 bp, mouse
gggggcgtggccatctgtgc

SEQ ID NO: 692143 - DNA, 20 bp, mouse
gacaggcccgctctcgggac

SEQ ID NO: 692144 - DNA, 20 bp, mouse
gcgtgcgggcgcagtcgctg

SEQ ID NO: 692145 - DNA, 20 bp, mouse
gtcgcgagacccttagggag

SEQ ID NO: 692146 - DNA, 20 bp, mouse
ggggcggggcccaaagtcgc

SEQ ID NO: 692147 - DNA, 20 bp, mouse
ggggacgtccgacagaggag

SEQ ID NO: 692148 - DNA, 20 bp, mouse
gagaggagaggttgacgtcg

SEQ ID NO: 692149 - DNA, 20 bp, mouse
gaggacgggacgtccgacag

SEQ ID NO: 692150 - DNA, 20 bp, mouse
gtggctgctcttcacctcaa

SEQ ID NO: 692151 - DNA, 20 bp, mouse
gtcgcaggagttttgctctc

SEQ ID NO: 692152 - DNA, 20 bp, mouse
ggaccaatgaacagagtcca

SEQ ID NO: 692153 - DNA, 20 bp, mouse
gccaatgagggaggctctgt

SEQ ID NO: 692154 - DNA, 20 bp, mouse
gcgccctggactctgttcat

SEQ ID NO: 692155 - DNA, 20 bp, mouse
gtttgggccccgcccccttg

SEQ ID NO: 692156 - DNA, 20 bp, mouse
ggagaaaggatctgcttcga

SEQ ID NO: 692157 - DNA, 20 bp, mouse
gagggtctgacctgtcaccc

SEQ ID NO: 692158 - DNA, 20 bp, mouse
gggcagtattggacactatg

SEQ ID NO: 692159 - DNA, 20 bp, mouse
ggtggagggcgggacagacc

SEQ ID NO: 692160 - DNA, 20 bp, mouse
gaggtaccgcccacaaggcc

SEQ ID NO: 692161 - DNA, 20 bp, mouse
ggaggcagaacaagacatcc

SEQ ID NO: 692162 - DNA, 20 bp, mouse
gcaggggagggaatcgagac

SEQ ID NO: 692163 - DNA, 20 bp, mouse
gacactatgaggagcattcc

SEQ ID NO: 692164 - DNA, 20 bp, mouse
gtcagcagacgcagcaactc

SEQ ID NO: 692165 - DNA, 20 bp, mouse
gaatcaagaagaaaccgctt

SEQ ID NO: 692166 - DNA, 20 bp, mouse
ggggactccaaaaaagtcgt

SEQ ID NO: 692167 - DNA, 20 bp, mouse
ggaactctgggcagccgatg

SEQ ID NO: 692168 - DNA, 20 bp, mouse
gggcggcggcaactccgcat

SEQ ID NO: 692169 - DNA, 20 bp, mouse
gggggggcgggcagcagtgc

SEQ ID NO: 692170 - DNA, 20 bp, mouse
ggcgagctgccgcgaactct

SEQ ID NO: 692171 - DNA, 20 bp, mouse
gagtcctaggcactgtgcag

SEQ ID NO: 692172 - DNA, 20 bp, mouse
gtgggtgcccacgacttttt

SEQ ID NO: 692173 - DNA, 20 bp, mouse
ggtgtccgcgcgcaggtgcc

SEQ ID NO: 692174 - DNA, 20 bp, mouse
gtagatgcaagatgtgtctc

SEQ ID NO: 692175 - DNA, 20 bp, mouse
gcgcgcggacacgcgtttgt

SEQ ID NO: 692176 - DNA, 20 bp, mouse
gccagcccgcgccctcagtt

SEQ ID NO: 692177 - DNA, 20 bp, mouse
gtggcccctcccctccgcgg

SEQ ID NO: 692178 - DNA, 20 bp, mouse
gaggcctccgcggaggggag

SEQ ID NO: 692179 - DNA, 20 bp, mouse
ggcgcgggctggagcgacgc

SEQ ID NO: 692180 - DNA, 20 bp, mouse
gcgggcctaactgagggcgc

SEQ ID NO: 692181 - DNA, 20 bp, mouse
gagggaggcgggcctaactg

SEQ ID NO: 692182 - DNA, 20 bp, mouse
gtctctttaagaggcctccg

SEQ ID NO: 692183 - DNA, 20 bp, mouse
gcaggagggcggggcagacg

SEQ ID NO: 692184 - DNA, 20 bp, mouse
gtgaagccccgccctgcgaa

SEQ ID NO: 692185 - DNA, 20 bp, mouse
gttaagaggcctccgcggag

SEQ ID NO: 692186 - DNA, 20 bp, mouse
gactgggtgggtcaccttac

SEQ ID NO: 692187 - DNA, 20 bp, mouse
ggggcccctacctgggacgc

SEQ ID NO: 692188 - DNA, 20 bp, mouse
gtgggtcaccttactggaat

SEQ ID NO: 692189 - DNA, 20 bp, mouse
gaccaaggtgcagcaggtag

SEQ ID NO: 692190 - DNA, 20 bp, mouse
gcaggcaggcctctacgggg

SEQ ID NO: 692191 - DNA, 20 bp, mouse
gagcaacaatccagcgtccc

SEQ ID NO: 692192 - DNA, 20 bp, mouse
gcctaaggctatctctgatc

SEQ ID NO: 692193 - DNA, 20 bp, mouse
gggctgcagggtgagcaggt

SEQ ID NO: 692194 - DNA, 20 bp, mouse
gcctgctgcaccttggtgtg

SEQ ID NO: 692195 - DNA, 20 bp, mouse
gctggccccgccccacacca

SEQ ID NO: 692196 - DNA, 20 bp, mouse
gggcccccgcgccagaatgt

SEQ ID NO: 692197 - DNA, 20 bp, mouse
gggcggggaggagtgagctc

SEQ ID NO: 692198 - DNA, 20 bp, mouse
gccacccctaaagaagtcca

SEQ ID NO: 692199 - DNA, 20 bp, mouse
ggggattcctgaagaatcta

SEQ ID NO: 692200 - DNA, 20 bp, mouse
gcctgggagcaagacgctgg

SEQ ID NO: 692201 - DNA, 20 bp, mouse
gactcctgcacagttaaact

SEQ ID NO: 692202 - DNA, 20 bp, mouse
gaggcgaccgagagcagctg

SEQ ID NO: 692203 - DNA, 20 bp, mouse
gcccgcgcccgcagccagtg

SEQ ID NO: 692204 - DNA, 20 bp, mouse
ggggttgcaccctgggcagc

SEQ ID NO: 692205 - DNA, 20 bp, mouse
gttcccacattctggcgcgg

SEQ ID NO: 692206 - DNA, 20 bp, mouse
gtatcgccggcgcggaagga

SEQ ID NO: 692207 - DNA, 20 bp, mouse
gcggccgccgccgttgccat

SEQ ID NO: 692208 - DNA, 20 bp, mouse
gaggcgcgccagacgctgga

SEQ ID NO: 692209 - DNA, 20 bp, mouse
ggtctggcgcgcctgcccgc

SEQ ID NO: 692210 - DNA, 20 bp, mouse
ggggcaggcgcgccagacgc

SEQ ID NO: 692211 - DNA, 20 bp, mouse
gctcgctctcagcctatcgc

SEQ ID NO: 692212 - DNA, 20 bp, mouse
ggagtccacagggaactcgt

SEQ ID NO: 692213 - DNA, 20 bp, mouse
ggacccggaagtccgcacgg

SEQ ID NO: 692214 - DNA, 20 bp, mouse
gagacgctggacggttccca

SEQ ID NO: 692215 - DNA, 20 bp, mouse
gaggctgagagcgagccaat

SEQ ID NO: 692216 - DNA, 20 bp, mouse
ggatccacatgttgctgcca

SEQ ID NO: 692217 - DNA, 20 bp, mouse
gactccaaggacgaactaga

SEQ ID NO: 692218 - DNA, 20 bp, mouse
gggcgtgagtcaaaatgctt

SEQ ID NO: 692219 - DNA, 20 bp, mouse
gcaagtctggtattactcca

SEQ ID NO: 692220 - DNA, 20 bp, mouse
gcgcccctctagttcgtcct

SEQ ID NO: 692221 - DNA, 20 bp, mouse
gtccccgaaccccttcgccg

SEQ ID NO: 692222 - DNA, 20 bp, mouse
gtgcacggctgcgcgaaaag

SEQ ID NO: 692223 - DNA, 20 bp, mouse
gaaggcccacgtagaccctg

SEQ ID NO: 692224 - DNA, 20 bp, mouse
gagctcggcttttatagctg

SEQ ID NO: 692225 - DNA, 20 bp, mouse
gcgagacaggcgacactgca

SEQ ID NO: 692226 - DNA, 20 bp, mouse
gctgcagcaccgggaaccga

SEQ ID NO: 692227 - DNA, 20 bp, mouse
ggcaccgggaaccgagggtc

SEQ ID NO: 692228 - DNA, 20 bp, mouse
gttccccaagagcagagtga

SEQ ID NO: 692229 - DNA, 20 bp, mouse
ggaaccgagggtctggctgg

SEQ ID NO: 692230 - DNA, 20 bp, mouse
gaggtggcgttggagcctag

SEQ ID NO: 692231 - DNA, 20 bp, mouse
ggcctaggggctgagttcaa

SEQ ID NO: 692232 - DNA, 20 bp, mouse
gcgagcaggcggcgcggtcc

SEQ ID NO: 692233 - DNA, 20 bp, mouse
gctcttggggaaagtgcgat

SEQ ID NO: 692234 - DNA, 20 bp, mouse
gcgagctgctgggtcacagc

SEQ ID NO: 692235 - DNA, 20 bp, mouse
gtgagtctaaaaggtggcgt

SEQ ID NO: 692236 - DNA, 20 bp, mouse
gagccttgcaagtggaggta

SEQ ID NO: 692237 - DNA, 20 bp, mouse
gcacttcctgcgaccaaata

SEQ ID NO: 692238 - DNA, 20 bp, mouse
ggcgtctttaaacctcgggg

SEQ ID NO: 692239 - DNA, 20 bp, mouse
ggggaggcgtctttaaacct

SEQ ID NO: 692240 - DNA, 20 bp, mouse
ggacagttgtgctgatgaag

SEQ ID NO: 692241 - DNA, 20 bp, mouse
gcatcagcacaactgtctcg

SEQ ID NO: 692242 - DNA, 20 bp, mouse
gtgtgcgcgcgcccccgcca

SEQ ID NO: 692243 - DNA, 20 bp, mouse
gctgctggaaatccccagcc

SEQ ID NO: 692244 - DNA, 20 bp, mouse
gcgcccccgccatggcgaag

SEQ ID NO: 692245 - DNA, 20 bp, mouse
ggggcggcctctctgcctgc

SEQ ID NO: 692246 - DNA, 20 bp, mouse
ggaggcagattcagcctagg

SEQ ID NO: 692247 - DNA, 20 bp, mouse
ggggagggggcaattacgaa

SEQ ID NO: 692248 - DNA, 20 bp, mouse
gccagacttgcaagcctcct

SEQ ID NO: 692249 - DNA, 20 bp, mouse
ggagagggcgggtgagagga

SEQ ID NO: 692250 - DNA, 20 bp, mouse
ggaaaatagacccatagtcg

SEQ ID NO: 692251 - DNA, 20 bp, mouse
gagggaaagcgggaaagcga

SEQ ID NO: 692252 - DNA, 20 bp, mouse
ggtcgaggcagattcagcct

SEQ ID NO: 692253 - DNA, 20 bp, mouse
gaggcccagtgtggggacac

SEQ ID NO: 692254 - DNA, 20 bp, mouse
gctgaatctgcctcgactat

SEQ ID NO: 692255 - DNA, 20 bp, mouse
gaaagcgggaaagcgatggg

SEQ ID NO: 692256 - DNA, 20 bp, mouse
gaatccaggaagatgattac

SEQ ID NO: 692257 - DNA, 20 bp, mouse
gtcccaactcgtctcttcta

SEQ ID NO: 692258 - DNA, 20 bp, mouse
ggaccccgcctccaactacc

SEQ ID NO: 692259 - DNA, 20 bp, mouse
gggagggtagggaaaatcta

SEQ ID NO: 692260 - DNA, 20 bp, mouse
ggaagagacgagttgggaga

SEQ ID NO: 692261 - DNA, 20 bp, mouse
gccttaaccaggatgagtac

SEQ ID NO: 692262 - DNA, 20 bp, mouse
gatattggagtgagcatgga

SEQ ID NO: 692263 - DNA, 20 bp, mouse
gcaatcacaagcaaaatcct

SEQ ID NO: 692264 - DNA, 20 bp, mouse
gctcctgggtgaagcggcct

SEQ ID NO: 692265 - DNA, 20 bp, mouse
gagccaaggccgcttcaccc

SEQ ID NO: 692266 - DNA, 20 bp, mouse
ggggcgggtcgccagatccc

SEQ ID NO: 692267 - DNA, 20 bp, mouse
gctgagagatgcgaaggaag

SEQ ID NO: 692268 - DNA, 20 bp, mouse
gcctgtcccgccgatgacta

SEQ ID NO: 692269 - DNA, 20 bp, mouse
ggggccgtccagcgcctgcc

SEQ ID NO: 692270 - DNA, 20 bp, mouse
gggggcgcctgctgattggg

SEQ ID NO: 692271 - DNA, 20 bp, mouse
gaccacgaatggggccatgc

SEQ ID NO: 692272 - DNA, 20 bp, mouse
gggccctggggacttctctc

SEQ ID NO: 692273 - DNA, 20 bp, mouse
gcgggccaagccatagtcat

SEQ ID NO: 692274 - DNA, 20 bp, mouse
gtggacagaggaccacgaat

SEQ ID NO: 692275 - DNA, 20 bp, mouse
gcggccaggcaggcgctgga

SEQ ID NO: 692276 - DNA, 20 bp, mouse
gtggctggtcagaggtggtg

SEQ ID NO: 692277 - DNA, 20 bp, mouse
gtcctctaggcattgacctg

SEQ ID NO: 692278 - DNA, 20 bp, mouse
gacgttgggcatggggtgga

SEQ ID NO: 692279 - DNA, 20 bp, mouse
gctcccgcccccgctacgtt

SEQ ID NO: 692280 - DNA, 20 bp, mouse
gcccccgctacgttgggcat

SEQ ID NO: 692281 - DNA, 20 bp, mouse
gcgtcctggccagaagtttc

SEQ ID NO: 692282 - DNA, 20 bp, mouse
gcacccttccctaccaggga

SEQ ID NO: 692283 - DNA, 20 bp, mouse
gcaccccatgcccaacgtag

SEQ ID NO: 692284 - DNA, 20 bp, mouse
gttatctggctggtcagagg

SEQ ID NO: 692285 - DNA, 20 bp, mouse
gaacttctggccaggacgtc

SEQ ID NO: 692286 - DNA, 20 bp, mouse
gtggccctcggaggggacca

SEQ ID NO: 692287 - DNA, 20 bp, mouse
ggggacgcgcaggcctctgg

SEQ ID NO: 692288 - DNA, 20 bp, mouse
gcggccgcgatgcgctgtcc

SEQ ID NO: 692289 - DNA, 20 bp, mouse
ggcgcggcgcagaaggaagg

SEQ ID NO: 692290 - DNA, 20 bp, mouse
ggccccgcgccgctggccct

SEQ ID NO: 692291 - DNA, 20 bp, mouse
gactccgtggtcccctccga

SEQ ID NO: 692292 - DNA, 20 bp, mouse
ggcgccgctggccctcggag

SEQ ID NO: 692293 - DNA, 20 bp, mouse
ggtggcgcggcgcagaagga

SEQ ID NO: 692294 - DNA, 20 bp, mouse
ggggcccacggcctcgcggc

SEQ ID NO: 692295 - DNA, 20 bp, mouse
gaaacggcccggagcgggca

SEQ ID NO: 692296 - DNA, 20 bp, mouse
gtctgactgatcagtctcag

SEQ ID NO: 692297 - DNA, 20 bp, mouse
ggaaggaaggaggcgggtgg

SEQ ID NO: 692298 - DNA, 20 bp, mouse
ggggcaaacttggttcttag

SEQ ID NO: 692299 - DNA, 20 bp, mouse
gcaaacttggttcttagggg

SEQ ID NO: 692300 - DNA, 20 bp, mouse
ggcgggacagagatgtccct

SEQ ID NO: 692301 - DNA, 20 bp, mouse
gactaaactgggaacccagg

SEQ ID NO: 692302 - DNA, 20 bp, mouse
gcgggtggggggaacggatt

SEQ ID NO: 692303 - DNA, 20 bp, mouse
gagctggccttgcaccgcct

SEQ ID NO: 692304 - DNA, 20 bp, mouse
gtgggtactcggtgaaatca

SEQ ID NO: 692305 - DNA, 20 bp, mouse
gtgggaacccaggcggtgca

SEQ ID NO: 692306 - DNA, 20 bp, mouse
gtgggccacaggaacgccgc

SEQ ID NO: 692307 - DNA, 20 bp, mouse
gcccgcgcggccacgtgatg

SEQ ID NO: 692308 - DNA, 20 bp, mouse
gcagccccgggccaccacct

SEQ ID NO: 692309 - DNA, 20 bp, mouse
gtccccctgcggcgttcctg

SEQ ID NO: 692310 - DNA, 20 bp, mouse
ggggaggaggactgggtacg

SEQ ID NO: 692311 - DNA, 20 bp, mouse
ggcaacgtgggaaaccggac

SEQ ID NO: 692312 - DNA, 20 bp, mouse
gaacagaggtaaccgtgggc

SEQ ID NO: 692313 - DNA, 20 bp, mouse
gggtacgaggtgtccccctg

SEQ ID NO: 692314 - DNA, 20 bp, mouse
gcggatgcaacgtgggaaac

SEQ ID NO: 692315 - DNA, 20 bp, mouse
ggggatgctgcggtcgcgag

SEQ ID NO: 692316 - DNA, 20 bp, mouse
gccagccaatccgagcccgg

SEQ ID NO: 692317 - DNA, 20 bp, mouse
gaaccacaggagaccaaccc

SEQ ID NO: 692318 - DNA, 20 bp, mouse
gaatcagatgcggtgagcag

SEQ ID NO: 692319 - DNA, 20 bp, mouse
ggcagcttcaaccccggcgt

SEQ ID NO: 692320 - DNA, 20 bp, mouse
gcgccccaggattggttcca

SEQ ID NO: 692321 - DNA, 20 bp, mouse
gcgtcccacgcaggcttatt

SEQ ID NO: 692322 - DNA, 20 bp, mouse
gaaaagggtccccttcacaa

SEQ ID NO: 692323 - DNA, 20 bp, mouse
gcagactctgcgtcccacgc

SEQ ID NO: 692324 - DNA, 20 bp, mouse
gacgaaagttctatcgcccc

SEQ ID NO: 692325 - DNA, 20 bp, mouse
gggccttggaaccaatcctg

SEQ ID NO: 692326 - DNA, 20 bp, mouse
gaaggtggttggtggactgg

SEQ ID NO: 692327 - DNA, 20 bp, mouse
gggcccaagaggtggcgaat

SEQ ID NO: 692328 - DNA, 20 bp, mouse
ggggaagggcgccaagaggg

SEQ ID NO: 692329 - DNA, 20 bp, mouse
gaaactatcccccagggcga

SEQ ID NO: 692330 - DNA, 20 bp, mouse
gggagggaagggcgccaaga

SEQ ID NO: 692331 - DNA, 20 bp, mouse
ggtaaacaaaactatccccc

SEQ ID NO: 692332 - DNA, 20 bp, mouse
gctacctggccctaaggtca

SEQ ID NO: 692333 - DNA, 20 bp, mouse
gtcctccccctcgtgcgatc

SEQ ID NO: 692334 - DNA, 20 bp, mouse
gctgcgccctctcgcgcaaa

SEQ ID NO: 692335 - DNA, 20 bp, mouse
gaagaaggtggttggtggac

SEQ ID NO: 692336 - DNA, 20 bp, mouse
gcaacccagggtgcagtagg

SEQ ID NO: 692337 - DNA, 20 bp, mouse
ggccgccaggtgacgccgag

SEQ ID NO: 692338 - DNA, 20 bp, mouse
gccaggtgacgccgaggggt

SEQ ID NO: 692339 - DNA, 20 bp, mouse
gcggccccctactgcaccct

SEQ ID NO: 692340 - DNA, 20 bp, mouse
gcggtcccgggtgacgcgcg

SEQ ID NO: 692341 - DNA, 20 bp, mouse
gtcacctggcggcgacgggc

SEQ ID NO: 692342 - DNA, 20 bp, mouse
gcggggccaggctctacccg

SEQ ID NO: 692343 - DNA, 20 bp, mouse
gcctggccccgagcaaccca

SEQ ID NO: 692344 - DNA, 20 bp, mouse
gaggggcggaggcggtaggg

SEQ ID NO: 692345 - DNA, 20 bp, mouse
ggctctacccgcggcgaggg

SEQ ID NO: 692346 - DNA, 20 bp, mouse
ggtaggcagggcactctcga

SEQ ID NO: 692347 - DNA, 20 bp, mouse
ggggcccgatggaaccgtct

SEQ ID NO: 692348 - DNA, 20 bp, mouse
gtgatgcgcgaggcgagcga

SEQ ID NO: 692349 - DNA, 20 bp, mouse
gctgctggcgtggttctctt

SEQ ID NO: 692350 - DNA, 20 bp, mouse
gcggccacgcccccgtctgc

SEQ ID NO: 692351 - DNA, 20 bp, mouse
gctaagaagcccagctccgc

SEQ ID NO: 692352 - DNA, 20 bp, mouse
ggcgaatgccggagtatccg

SEQ ID NO: 692353 - DNA, 20 bp, mouse
gaggcctgaccgctgtaggc

SEQ ID NO: 692354 - DNA, 20 bp, mouse
gagaaccacgccagcagacg

SEQ ID NO: 692355 - DNA, 20 bp, mouse
ggctcgccgcgatggagggg

SEQ ID NO: 692356 - DNA, 20 bp, mouse
ggagccccgccctgtctagg

SEQ ID NO: 692357 - DNA, 20 bp, mouse
ggggcattggagaattcctg

SEQ ID NO: 692358 - DNA, 20 bp, mouse
ggggagctgccacctagaca

SEQ ID NO: 692359 - DNA, 20 bp, mouse
ggatgtgcacagtgatttag

SEQ ID NO: 692360 - DNA, 20 bp, mouse
ggctccgcgctccgccttct

SEQ ID NO: 692361 - DNA, 20 bp, mouse
gtaggagctaaatggatctc

SEQ ID NO: 692362 - DNA, 20 bp, mouse
gtcaacaccccgggtgtcag

SEQ ID NO: 692363 - DNA, 20 bp, mouse
gagctgccacctagacaggg

SEQ ID NO: 692364 - DNA, 20 bp, mouse
gagcagccgtaaagccgccc

SEQ ID NO: 692365 - DNA, 20 bp, mouse
gcagtgatttagtggggcat

SEQ ID NO: 692366 - DNA, 20 bp, mouse
ggcggtgcgtaaagctggag

SEQ ID NO: 692367 - DNA, 20 bp, mouse
gccctggtccgtctgagtcc

SEQ ID NO: 692368 - DNA, 20 bp, mouse
gggagagcgccaactcgcag

SEQ ID NO: 692369 - DNA, 20 bp, mouse
gtctctctgctaaacagcag

SEQ ID NO: 692370 - DNA, 20 bp, mouse
gggaggggtgtacgcggccc

SEQ ID NO: 692371 - DNA, 20 bp, mouse
gagtcccgcctacacgccat

SEQ ID NO: 692372 - DNA, 20 bp, mouse
ggctgccaatggcgtgtagg

SEQ ID NO: 692373 - DNA, 20 bp, mouse
gaaagtgcggtgcgtaaagc

SEQ ID NO: 692374 - DNA, 20 bp, mouse
ggaaggacggtacccacctg

SEQ ID NO: 692375 - DNA, 20 bp, mouse
gtgagaacccagggttaggt

SEQ ID NO: 692376 - DNA, 20 bp, mouse
gggactgtgtacagagactc

SEQ ID NO: 692377 - DNA, 20 bp, mouse
ggggccgcggcgattctcgg

SEQ ID NO: 692378 - DNA, 20 bp, mouse
gtgtaagccccctgagaata

SEQ ID NO: 692379 - DNA, 20 bp, mouse
gctcagggggcttacacgga

SEQ ID NO: 692380 - DNA, 20 bp, mouse
gctaccggaagtaatgtcag

SEQ ID NO: 692381 - DNA, 20 bp, mouse
ggagggaaacagcaatcccg

SEQ ID NO: 692382 - DNA, 20 bp, mouse
gccactgataactgttccaa

SEQ ID NO: 692383 - DNA, 20 bp, mouse
ggagaagccaggcgccgtgt

SEQ ID NO: 692384 - DNA, 20 bp, mouse
ggggcccccgagaatcgccg

SEQ ID NO: 692385 - DNA, 20 bp, mouse
gtcccctctgacattacttc

SEQ ID NO: 692386 - DNA, 20 bp, mouse
gacccggaggtgcggaggga

SEQ ID NO: 692387 - DNA, 20 bp, mouse
gcctactgagagcagcacaa

SEQ ID NO: 692388 - DNA, 20 bp, mouse
gcgaatgagagatcgctcta

SEQ ID NO: 692389 - DNA, 20 bp, mouse
gtgctcgtgctaaatcgtga

SEQ ID NO: 692390 - DNA, 20 bp, mouse
gggactcgagtcagccaatc

SEQ ID NO: 692391 - DNA, 20 bp, mouse
gtggagcaactaagacccgg

SEQ ID NO: 692392 - DNA, 20 bp, mouse
ggtgctgctctcagtaggtg

SEQ ID NO: 692393 - DNA, 20 bp, mouse
gctaagacccggaggtgcgg

SEQ ID NO: 692394 - DNA, 20 bp, mouse
ggagtcagccaatcaggctt

SEQ ID NO: 692395 - DNA, 20 bp, mouse
gcgatctctcattcgggcaa

SEQ ID NO: 692396 - DNA, 20 bp, mouse
ggggacagagcgagaccctg

SEQ ID NO: 692397 - DNA, 20 bp, mouse
gcctggctgccggacggacg

SEQ ID NO: 692398 - DNA, 20 bp, mouse
gtctgcaggccacgtccgtc

SEQ ID NO: 692399 - DNA, 20 bp, mouse
ggctggaaggagttcccaat

SEQ ID NO: 692400 - DNA, 20 bp, mouse
gcaggctgagactggagtcc

SEQ ID NO: 692401 - DNA, 20 bp, mouse
gtgcacggcccagactctgc

SEQ ID NO: 692402 - DNA, 20 bp, mouse
gaaggggcctggctgccgga

SEQ ID NO: 692403 - DNA, 20 bp, mouse
gtccctgtcagattacagat

SEQ ID NO: 692404 - DNA, 20 bp, mouse
gtgtggccacaggctgagac

SEQ ID NO: 692405 - DNA, 20 bp, mouse
gccaggctgtttgggtgaag

SEQ ID NO: 692406 - DNA, 20 bp, mouse
gcctctggctaacacaggtt

SEQ ID NO: 692407 - DNA, 20 bp, mouse
gtaccccatcacctcccgga

SEQ ID NO: 692408 - DNA, 20 bp, mouse
gtgcgctgggagcgtctcgg

SEQ ID NO: 692409 - DNA, 20 bp, mouse
ggggctgcataattgatgga

SEQ ID NO: 692410 - DNA, 20 bp, mouse
gcggatgtgctgtgcaacct

SEQ ID NO: 692411 - DNA, 20 bp, mouse
gtggctaacacaggttgggg

SEQ ID NO: 692412 - DNA, 20 bp, mouse
gtggggagttgcaacccctc

SEQ ID NO: 692413 - DNA, 20 bp, mouse
ggcagcccgcagcccgctac

SEQ ID NO: 692414 - DNA, 20 bp, mouse
ggtgggggcgggagaggatt

SEQ ID NO: 692415 - DNA, 20 bp, mouse
gtggggagggacctagctcc

SEQ ID NO: 692416 - DNA, 20 bp, mouse
gagcgcaggcggggaagaga

SEQ ID NO: 692417 - DNA, 20 bp, mouse
ggctccgcccagtgtcctga

SEQ ID NO: 692418 - DNA, 20 bp, mouse
gacactgggcggagcgcagg

SEQ ID NO: 692419 - DNA, 20 bp, mouse
gggaagccgccgggactgga

SEQ ID NO: 692420 - DNA, 20 bp, mouse
gctggagggacccgggacct

SEQ ID NO: 692421 - DNA, 20 bp, mouse
gaggacactgggcggagcgc

SEQ ID NO: 692422 - DNA, 20 bp, mouse
gcgggtccctccagtcccgg

SEQ ID NO: 692423 - DNA, 20 bp, mouse
gaagtggccttcaggacact

SEQ ID NO: 692424 - DNA, 20 bp, mouse
gacgccggggcctctccgag

SEQ ID NO: 692425 - DNA, 20 bp, mouse
ggagaggaaccggttcgcga

SEQ ID NO: 692426 - DNA, 20 bp, mouse
gggggcgtggcgatgaaggg

SEQ ID NO: 692427 - DNA, 20 bp, mouse
gcaggtgagaccagttctga

SEQ ID NO: 692428 - DNA, 20 bp, mouse
gaagggcggtcgagatctta

SEQ ID NO: 692429 - DNA, 20 bp, mouse
gaacgtgagccctagagacc

SEQ ID NO: 692430 - DNA, 20 bp, mouse
gaggaacgccgagtgaagcc

SEQ ID NO: 692431 - DNA, 20 bp, mouse
gggccggggcgtggcgatga

SEQ ID NO: 692432 - DNA, 20 bp, mouse
gccgcctgctcccgcagtca

SEQ ID NO: 692433 - DNA, 20 bp, mouse
gttctccatccgggtctcta

SEQ ID NO: 692434 - DNA, 20 bp, mouse
gtgagccctagagacccgga

SEQ ID NO: 692435 - DNA, 20 bp, mouse
gactgcgggagcaggcggac

SEQ ID NO: 692436 - DNA, 20 bp, mouse
gctggccactcagacctctc

SEQ ID NO: 692437 - DNA, 20 bp, mouse
gagctgaggctgaggtactt

SEQ ID NO: 692438 - DNA, 20 bp, mouse
gtctgagtggccagactagt

SEQ ID NO: 692439 - DNA, 20 bp, mouse
gggggccagcggggagctga

SEQ ID NO: 692440 - DNA, 20 bp, mouse
gtagtgggaagaagccggag

SEQ ID NO: 692441 - DNA, 20 bp, mouse
gcggcttcttcccactagtc

SEQ ID NO: 692442 - DNA, 20 bp, mouse
gagctccctcagctccccgc

SEQ ID NO: 692443 - DNA, 20 bp, mouse
gttcacccgcgaccgggaag

SEQ ID NO: 692444 - DNA, 20 bp, mouse
gtgagtggtttacaaatgag

SEQ ID NO: 692445 - DNA, 20 bp, mouse
gggctgaggtacttgggctg

SEQ ID NO: 692446 - DNA, 20 bp, mouse
gcgggaaagtcgaaaacgaa

SEQ ID NO: 692447 - DNA, 20 bp, mouse
gacgaagggaagcaactggc

SEQ ID NO: 692448 - DNA, 20 bp, mouse
gggaaacactagaacaagtc

SEQ ID NO: 692449 - DNA, 20 bp, mouse
gcgcccgcaccggaagttga

SEQ ID NO: 692450 - DNA, 20 bp, mouse
gaagcaactggcgggtcccc

SEQ ID NO: 692451 - DNA, 20 bp, mouse
gaggccgtcaacttccggtg

SEQ ID NO: 692452 - DNA, 20 bp, mouse
gcctaaaaagccactaacct

SEQ ID NO: 692453 - DNA, 20 bp, mouse
gctgacagccacttttcaga

SEQ ID NO: 692454 - DNA, 20 bp, mouse
gtggcgggtccccaggttag

SEQ ID NO: 692455 - DNA, 20 bp, mouse
ggtatctctccgaagtcaga

SEQ ID NO: 692456 - DNA, 20 bp, mouse
gagtgagaggtgtactcgca

SEQ ID NO: 692457 - DNA, 20 bp, mouse
ggagaggtgtactcgcaggg

SEQ ID NO: 692458 - DNA, 20 bp, mouse
ggcggcgaacgcgaggaagt

SEQ ID NO: 692459 - DNA, 20 bp, mouse
ggtggacacggagtactcag

SEQ ID NO: 692460 - DNA, 20 bp, mouse
gacccaccgaggtagactct

SEQ ID NO: 692461 - DNA, 20 bp, mouse
ggctcaaggtcacccaattc

SEQ ID NO: 692462 - DNA, 20 bp, mouse
gaggttgaataattcgctca

SEQ ID NO: 692463 - DNA, 20 bp, mouse
gcctggggttatccggaatt

SEQ ID NO: 692464 - DNA, 20 bp, mouse
ggttcgccgcagtgcacttc

SEQ ID NO: 692465 - DNA, 20 bp, mouse
gtggcacagtaagtaatgaa

SEQ ID NO: 692466 - DNA, 20 bp, mouse
gcggccgcgggcattctcgc

SEQ ID NO: 692467 - DNA, 20 bp, mouse
ggggacttgtgtgctgaagt

SEQ ID NO: 692468 - DNA, 20 bp, mouse
gcacacaagtcccgggactc

SEQ ID NO: 692469 - DNA, 20 bp, mouse
ggccctccctggttaacaaa

SEQ ID NO: 692470 - DNA, 20 bp, mouse
ggcgcaagcgtaggagggtg

SEQ ID NO: 692471 - DNA, 20 bp, mouse
ggggagggctcggtttgcgc

SEQ ID NO: 692472 - DNA, 20 bp, mouse
gcccgaggcgcaagcgtagg

SEQ ID NO: 692473 - DNA, 20 bp, mouse
ggtaactccgcgagcctgtc

SEQ ID NO: 692474 - DNA, 20 bp, mouse
gcctgtctgagggaacacga

SEQ ID NO: 692475 - DNA, 20 bp, mouse
ggcgcccgaggcgcaagcgt

SEQ ID NO: 692476 - DNA, 20 bp, mouse
gcggtcacaacttctctccg

SEQ ID NO: 692477 - DNA, 20 bp, mouse
gcaacgctccgaatgaccca

SEQ ID NO: 692478 - DNA, 20 bp, mouse
gcccagggctggggcttaaa

SEQ ID NO: 692479 - DNA, 20 bp, mouse
gagggctggggcttaaaagg

SEQ ID NO: 692480 - DNA, 20 bp, mouse
gccggggcgtggacaagctc

SEQ ID NO: 692481 - DNA, 20 bp, mouse
gtccgggccggatccggctc

SEQ ID NO: 692482 - DNA, 20 bp, mouse
ggctgactaatcaggagaag

SEQ ID NO: 692483 - DNA, 20 bp, mouse
gacaagctccgggccggatc

SEQ ID NO: 692484 - DNA, 20 bp, mouse
gctcgggatgatgacgacat

SEQ ID NO: 692485 - DNA, 20 bp, mouse
ggctccgaatgacccagggc

SEQ ID NO: 692486 - DNA, 20 bp, mouse
gcccgcgctctgaaacggac

SEQ ID NO: 692487 - DNA, 20 bp, mouse
gcccgccccgcgctctgaaa

SEQ ID NO: 692488 - DNA, 20 bp, mouse
gcaccccagggtgtagaggg

SEQ ID NO: 692489 - DNA, 20 bp, mouse
ggcgaagcatcgcgggaatc

SEQ ID NO: 692490 - DNA, 20 bp, mouse
gcggagccgcgaagcatcgc

SEQ ID NO: 692491 - DNA, 20 bp, mouse
gcgcaaccggaagaccaaga

SEQ ID NO: 692492 - DNA, 20 bp, mouse
ggagcaccccagggtgtaga

SEQ ID NO: 692493 - DNA, 20 bp, mouse
ggggcggtaactgtcgcgaa

SEQ ID NO: 692494 - DNA, 20 bp, mouse
gaccctggggtgctcgcgac

SEQ ID NO: 692495 - DNA, 20 bp, mouse
ggcgaccgccctctacaccc

SEQ ID NO: 692496 - DNA, 20 bp, mouse
ggaggcgggactcttggtta

SEQ ID NO: 692497 - DNA, 20 bp, mouse
gctccgcagtactctctgat

SEQ ID NO: 692498 - DNA, 20 bp, mouse
gcccgggagtggctagagag

SEQ ID NO: 692499 - DNA, 20 bp, mouse
gagagaggggagtgattaga

SEQ ID NO: 692500 - DNA, 20 bp, mouse
gtgtggtggcacagggtcta

SEQ ID NO: 692501 - DNA, 20 bp, mouse
gggcaggcgcacttgctccc

SEQ ID NO: 692502 - DNA, 20 bp, mouse
gaacccgccaagtcagaact

SEQ ID NO: 692503 - DNA, 20 bp, mouse
gactgcggaggcgggactct

SEQ ID NO: 692504 - DNA, 20 bp, mouse
gcttgctcccaggccagctc

SEQ ID NO: 692505 - DNA, 20 bp, mouse
gtgtccctgcaccatagata

SEQ ID NO: 692506 - DNA, 20 bp, mouse
ggtcaggatgggatttgaac

SEQ ID NO: 692507 - DNA, 20 bp, mouse
gccccccaggtcggctgaaa

SEQ ID NO: 692508 - DNA, 20 bp, mouse
gaccaagtagccccccaggt

SEQ ID NO: 692509 - DNA, 20 bp, mouse
gtctctgctgacctcccaaa

SEQ ID NO: 692510 - DNA, 20 bp, mouse
gaagagacccttcttgagaa

SEQ ID NO: 692511 - DNA, 20 bp, mouse
gaaaaggctgtgacttccca

SEQ ID NO: 692512 - DNA, 20 bp, mouse
gcctcaccaagtagcccccc

SEQ ID NO: 692513 - DNA, 20 bp, mouse
ggaaatacacgcactccctt

SEQ ID NO: 692514 - DNA, 20 bp, mouse
gaaaaaaagaagttcctgta

SEQ ID NO: 692515 - DNA, 20 bp, mouse
gtacacgcactccctttggg

SEQ ID NO: 692516 - DNA, 20 bp, mouse
gccggtctagctgagggaac

SEQ ID NO: 692517 - DNA, 20 bp, mouse
gcagaacggccggtgcagac

SEQ ID NO: 692518 - DNA, 20 bp, mouse
gccaaactagccagaacggc

SEQ ID NO: 692519 - DNA, 20 bp, mouse
gtgagagattggctcgaaca

SEQ ID NO: 692520 - DNA, 20 bp, mouse
gtgagagctaggccgccgag

SEQ ID NO: 692521 - DNA, 20 bp, mouse
gggctgtgacgcaaatgtga

SEQ ID NO: 692522 - DNA, 20 bp, mouse
gtgcagaccggtctagctga

SEQ ID NO: 692523 - DNA, 20 bp, mouse
gattggctcgaacagggaga

SEQ ID NO: 692524 - DNA, 20 bp, mouse
gaggcccaaactagccagaa

SEQ ID NO: 692525 - DNA, 20 bp, mouse
gaggttgcgcgcgctcctca

SEQ ID NO: 692526 - DNA, 20 bp, mouse
ggaggctgggagatggaaac

SEQ ID NO: 692527 - DNA, 20 bp, mouse
ggatacggggaagaagtgag

SEQ ID NO: 692528 - DNA, 20 bp, mouse
gaggggctccggacctttgg

SEQ ID NO: 692529 - DNA, 20 bp, mouse
gggagacagtcgccctccaa

SEQ ID NO: 692530 - DNA, 20 bp, mouse
gcggtcacgtgacacgttgt

SEQ ID NO: 692531 - DNA, 20 bp, mouse
gcccatggtgaacctagata

SEQ ID NO: 692532 - DNA, 20 bp, mouse
gcagtcgccctccaaaggtc

SEQ ID NO: 692533 - DNA, 20 bp, mouse
gtgtgggcggtgcttgcgga

SEQ ID NO: 692534 - DNA, 20 bp, mouse
gggcggtgcttgcggagggt

SEQ ID NO: 692535 - DNA, 20 bp, mouse
gattgcgaggcgagacagca

SEQ ID NO: 692536 - DNA, 20 bp, mouse
gtacccgcaagtcctggctg

SEQ ID NO: 692537 - DNA, 20 bp, mouse
ggcggaagaaagtaagaccc

SEQ ID NO: 692538 - DNA, 20 bp, mouse
ggcagccggcgaccggagtg

SEQ ID NO: 692539 - DNA, 20 bp, mouse
ggcccaggccgaacaagggg

SEQ ID NO: 692540 - DNA, 20 bp, mouse
gcccaccctggactatacat

SEQ ID NO: 692541 - DNA, 20 bp, mouse
gccggccgcactccggtcgc

SEQ ID NO: 692542 - DNA, 20 bp, mouse
gtggagtaaggacactgaca

SEQ ID NO: 692543 - DNA, 20 bp, mouse
gcgtagagctgcgaatctcg

SEQ ID NO: 692544 - DNA, 20 bp, mouse
gcgtaccggcagccggcgac

SEQ ID NO: 692545 - DNA, 20 bp, mouse
gacaccggccgcttccggaa

SEQ ID NO: 692546 - DNA, 20 bp, mouse
gcccgtacggaagcctctcc

SEQ ID NO: 692547 - DNA, 20 bp, mouse
gcggaagtcccgcctcttgg

SEQ ID NO: 692548 - DNA, 20 bp, mouse
gggccctgaactccgcgcac

SEQ ID NO: 692549 - DNA, 20 bp, mouse
gaagtcccgcctcttggtgg

SEQ ID NO: 692550 - DNA, 20 bp, mouse
ggggccgcccgggcggaggg

SEQ ID NO: 692551 - DNA, 20 bp, mouse
ggcggcaccagcggtcagga

SEQ ID NO: 692552 - DNA, 20 bp, mouse
gttagagctcgcgggagaaa

SEQ ID NO: 692553 - DNA, 20 bp, mouse
gtgaactccgcgcacaggaa

SEQ ID NO: 692554 - DNA, 20 bp, mouse
ggagttcagggccgcccggg

SEQ ID NO: 692555 - DNA, 20 bp, mouse
gaggtctgtaagctggagcg

SEQ ID NO: 692556 - DNA, 20 bp, mouse
gcagcgttgcggggacgagg

SEQ ID NO: 692557 - DNA, 20 bp, mouse
gcgtccagaggcgatcgctc

SEQ ID NO: 692558 - DNA, 20 bp, mouse
ggctctggagtggtgggttc

SEQ ID NO: 692559 - DNA, 20 bp, mouse
gcccacctgagccgcagact

SEQ ID NO: 692560 - DNA, 20 bp, mouse
gctggagggcgtcctggcgg

SEQ ID NO: 692561 - DNA, 20 bp, mouse
ggagtggtgggttcaggtcc

SEQ ID NO: 692562 - DNA, 20 bp, mouse
gtagtcagggcaggatgtat

SEQ ID NO: 692563 - DNA, 20 bp, mouse
ggaagcctgtgttaggtcga

SEQ ID NO: 692564 - DNA, 20 bp, mouse
gtcccagtctgcggctcagg

SEQ ID NO: 692565 - DNA, 20 bp, mouse
gggcgcgcagagccggttcc

SEQ ID NO: 692566 - DNA, 20 bp, mouse
gactcccaggggcacccatg

SEQ ID NO: 692567 - DNA, 20 bp, mouse
gaggctgcagccagcacaca

SEQ ID NO: 692568 - DNA, 20 bp, mouse
gaagaggccaagtaaaggga

SEQ ID NO: 692569 - DNA, 20 bp, mouse
ggactccagacctctttaac

SEQ ID NO: 692570 - DNA, 20 bp, mouse
gggtaagttgagtccaggtg

SEQ ID NO: 692571 - DNA, 20 bp, mouse
gccaacaagaggccaagtaa

SEQ ID NO: 692572 - DNA, 20 bp, mouse
gagtgaatagagttatacat

SEQ ID NO: 692573 - DNA, 20 bp, mouse
ggcaggtcagcctgttaaag

SEQ ID NO: 692574 - DNA, 20 bp, mouse
gcatgtgtccaggactccca

SEQ ID NO: 692575 - DNA, 20 bp, mouse
gactggggaaatggcgaggg

SEQ ID NO: 692576 - DNA, 20 bp, mouse
gaggctggcctcaagcccgg

SEQ ID NO: 692577 - DNA, 20 bp, mouse
gtccatgtggcctgtctgag

SEQ ID NO: 692578 - DNA, 20 bp, mouse
gggaccgccagccagacagg

SEQ ID NO: 692579 - DNA, 20 bp, mouse
gtaactccgggaaagagggg

SEQ ID NO: 692580 - DNA, 20 bp, mouse
gtggtcagagcaggactctt

SEQ ID NO: 692581 - DNA, 20 bp, mouse
gtggcgcacgatggttggag

SEQ ID NO: 692582 - DNA, 20 bp, mouse
gagatgtggcgcacgatggt

SEQ ID NO: 692583 - DNA, 20 bp, mouse
ggaaatgtggagttgccgcc

SEQ ID NO: 692584 - DNA, 20 bp, mouse
gaagcagatgtggcgcacga

SEQ ID NO: 692585 - DNA, 20 bp, mouse
gtcctgctctgaccaaccca

SEQ ID NO: 692586 - DNA, 20 bp, mouse
gaccccggttcctaaccctt

SEQ ID NO: 692587 - DNA, 20 bp, mouse
ggggaaagagccaaagggtt

SEQ ID NO: 692588 - DNA, 20 bp, mouse
gatcccccggggcctctctc

SEQ ID NO: 692589 - DNA, 20 bp, mouse
gccccctgccgagaggcgat

SEQ ID NO: 692590 - DNA, 20 bp, mouse
gaaagagggcggcacccggg

SEQ ID NO: 692591 - DNA, 20 bp, mouse
ggcctctcggcagggggttc

SEQ ID NO: 692592 - DNA, 20 bp, mouse
ggggacctgtgcgtcattga

SEQ ID NO: 692593 - DNA, 20 bp, mouse
ggcccatcgcctctcggcag

SEQ ID NO: 692594 - DNA, 20 bp, mouse
gggggggggcaataactgat

SEQ ID NO: 692595 - DNA, 20 bp, mouse
gggccccgggggatcgaggt

SEQ ID NO: 692596 - DNA, 20 bp, mouse
gctccaagctgacgcccgaa

SEQ ID NO: 692597 - DNA, 20 bp, mouse
gagggccgcgtgcaaacacg

SEQ ID NO: 692598 - DNA, 20 bp, mouse
ggtaccctaaaagtacacag

SEQ ID NO: 692599 - DNA, 20 bp, mouse
gaacgagcaggcgggacgca

SEQ ID NO: 692600 - DNA, 20 bp, mouse
gcagcccctgtgtactttta

SEQ ID NO: 692601 - DNA, 20 bp, mouse
gacgcagggcgctaaattcc

SEQ ID NO: 692602 - DNA, 20 bp, mouse
gaggttaagaaacgagcagg

SEQ ID NO: 692603 - DNA, 20 bp, mouse
ggacactctggctggggaaa

SEQ ID NO: 692604 - DNA, 20 bp, mouse
gggcccttcgggcgtcagct

SEQ ID NO: 692605 - DNA, 20 bp, mouse
gcagggcgctaaattccagg

SEQ ID NO: 692606 - DNA, 20 bp, mouse
gaggaccagggaggggacca

SEQ ID NO: 692607 - DNA, 20 bp, mouse
gggtccctggggtccgggaa

SEQ ID NO: 692608 - DNA, 20 bp, mouse
gcctcggtggcatggtccgg

SEQ ID NO: 692609 - DNA, 20 bp, mouse
gcggcctcggtggcatggtc

SEQ ID NO: 692610 - DNA, 20 bp, mouse
gccgcccgccacgtctcctc

SEQ ID NO: 692611 - DNA, 20 bp, mouse
gcacccgcgctgcccgcgag

SEQ ID NO: 692612 - DNA, 20 bp, mouse
gaggcagaatgctacggggt

SEQ ID NO: 692613 - DNA, 20 bp, mouse
gggtccggaggagacgtggc

SEQ ID NO: 692614 - DNA, 20 bp, mouse
gacagctcgagggggagaaa

SEQ ID NO: 692615 - DNA, 20 bp, mouse
gcgcagagctgggcgagcct

SEQ ID NO: 692616 - DNA, 20 bp, mouse
gaggaacccgaggtagaagt

SEQ ID NO: 692617 - DNA, 20 bp, mouse
gagtcccattgccgggacca

SEQ ID NO: 692618 - DNA, 20 bp, mouse
ggtggcgcgggcgactccca

SEQ ID NO: 692619 - DNA, 20 bp, mouse
ggttgatagcacagactcag

SEQ ID NO: 692620 - DNA, 20 bp, mouse
ggacacaagactctttgtat

SEQ ID NO: 692621 - DNA, 20 bp, mouse
gctgcaggggtcagccgcgg

SEQ ID NO: 692622 - DNA, 20 bp, mouse
ggattccttggtcccggcaa

SEQ ID NO: 692623 - DNA, 20 bp, mouse
ggccggtccgggctccaccc

SEQ ID NO: 692624 - DNA, 20 bp, mouse
ggtcactgagtcccattgcc

SEQ ID NO: 692625 - DNA, 20 bp, mouse
ggactctttgtatagggtga

SEQ ID NO: 692626 - DNA, 20 bp, mouse
ggatgcggacgggtttgaag

SEQ ID NO: 692627 - DNA, 20 bp, mouse
ggtcgcccctcagctctgga

SEQ ID NO: 692628 - DNA, 20 bp, mouse
gagctgaggggcgacgcttc

SEQ ID NO: 692629 - DNA, 20 bp, mouse
gaacccgtccgcatccttat

SEQ ID NO: 692630 - DNA, 20 bp, mouse
gctgcgcgacagactctcat

SEQ ID NO: 692631 - DNA, 20 bp, mouse
ggtcgtgcgaggggacttat

SEQ ID NO: 692632 - DNA, 20 bp, mouse
gggttcctaacgggagagga

SEQ ID NO: 692633 - DNA, 20 bp, mouse
gagaggaggctttcgggaat

SEQ ID NO: 692634 - DNA, 20 bp, mouse
gcggacgggtttgaaggggc

SEQ ID NO: 692635 - DNA, 20 bp, mouse
gtcctccgccaataaggatg

SEQ ID NO: 692636 - DNA, 20 bp, mouse
gcaagagcctggcggggtga

SEQ ID NO: 692637 - DNA, 20 bp, mouse
ggacccgaggctcaggccgg

SEQ ID NO: 692638 - DNA, 20 bp, mouse
gcagggcggggtcacgaaat

SEQ ID NO: 692639 - DNA, 20 bp, mouse
gcggaagccgggcaagagcc

SEQ ID NO: 692640 - DNA, 20 bp, mouse
gtcgggtcccggacagggaa

SEQ ID NO: 692641 - DNA, 20 bp, mouse
ggggcggggcctttcctaaa

SEQ ID NO: 692642 - DNA, 20 bp, mouse
gcgtcccctcccaggtcctc

SEQ ID NO: 692643 - DNA, 20 bp, mouse
gctcccagaggacctgggag

SEQ ID NO: 692644 - DNA, 20 bp, mouse
ggacgtagagcttgagatct

SEQ ID NO: 692645 - DNA, 20 bp, mouse
gggccggaggcggggacaca

SEQ ID NO: 692646 - DNA, 20 bp, mouse
gagagggaggggcgtgtcgc

SEQ ID NO: 692647 - DNA, 20 bp, mouse
gccgtcacgtggggcgggat

SEQ ID NO: 692648 - DNA, 20 bp, mouse
gccgccccacgtgacggaac

SEQ ID NO: 692649 - DNA, 20 bp, mouse
gccgccccgttccgtcacgt

SEQ ID NO: 692650 - DNA, 20 bp, mouse
gaaactgggtctgagtggac

SEQ ID NO: 692651 - DNA, 20 bp, mouse
gggaaagaatcccacagtgc

SEQ ID NO: 692652 - DNA, 20 bp, mouse
gtgctccgcgggcttcccag

SEQ ID NO: 692653 - DNA, 20 bp, mouse
gtcgggctggagaatcctgg

SEQ ID NO: 692654 - DNA, 20 bp, mouse
gctgagtggacggggctcgt

SEQ ID NO: 692655 - DNA, 20 bp, mouse
ggaatcctggtggcgaaacc

SEQ ID NO: 692656 - DNA, 20 bp, mouse
gaggggcggggccacctgag

SEQ ID NO: 692657 - DNA, 20 bp, mouse
gggaacgggtgcttagatct

SEQ ID NO: 692658 - DNA, 20 bp, mouse
gcggggccacctgagaggtg

SEQ ID NO: 692659 - DNA, 20 bp, mouse
ggggtgcttagatcttggta

SEQ ID NO: 692660 - DNA, 20 bp, mouse
gttggtagggaggactgcgt

SEQ ID NO: 692661 - DNA, 20 bp, mouse
ggtctcgcgagggtgggaac

SEQ ID NO: 692662 - DNA, 20 bp, mouse
gaatccaggtctcgcgaggg

SEQ ID NO: 692663 - DNA, 20 bp, mouse
gcgcccctcccggagtagag

SEQ ID NO: 692664 - DNA, 20 bp, mouse
gtggggctagcgcaggggag

SEQ ID NO: 692665 - DNA, 20 bp, mouse
gtgaaatagctgaggtctaa

SEQ ID NO: 692666 - DNA, 20 bp, mouse
gttacgcggcgaaattgcgc

SEQ ID NO: 692667 - DNA, 20 bp, mouse
gggaacaggcgggcaaaggg

SEQ ID NO: 692668 - DNA, 20 bp, mouse
ggaaacgcagacgcctccta

SEQ ID NO: 692669 - DNA, 20 bp, mouse
gcaggggcggggccagcgca

SEQ ID NO: 692670 - DNA, 20 bp, mouse
gagcgcagggaagagttacg

SEQ ID NO: 692671 - DNA, 20 bp, mouse
ggggacttgtagtacactag

SEQ ID NO: 692672 - DNA, 20 bp, mouse
gtccaagatgcatagggaac

SEQ ID NO: 692673 - DNA, 20 bp, mouse
gaaacctaacccgggagcgc

SEQ ID NO: 692674 - DNA, 20 bp, mouse
gggcgtctgcgtttccgaac

SEQ ID NO: 692675 - DNA, 20 bp, mouse
gtggccccgcccctggagcc

SEQ ID NO: 692676 - DNA, 20 bp, mouse
ggagctacgccctgctaagt

SEQ ID NO: 692677 - DNA, 20 bp, mouse
gagtcagagggagctacaac

SEQ ID NO: 692678 - DNA, 20 bp, mouse
gaccggctgccaacttagca

SEQ ID NO: 692679 - DNA, 20 bp, mouse
ggcagccggtcagatgtggc

SEQ ID NO: 692680 - DNA, 20 bp, mouse
gtagggcaaaacacaggtta

SEQ ID NO: 692681 - DNA, 20 bp, mouse
ggttggcagccggtcagatg

SEQ ID NO: 692682 - DNA, 20 bp, mouse
ggccctgctaagttggcagc

SEQ ID NO: 692683 - DNA, 20 bp, mouse
gggtcaggggcacaagggtc

SEQ ID NO: 692684 - DNA, 20 bp, mouse
ggggtagtagaactgggctt

SEQ ID NO: 692685 - DNA, 20 bp, mouse
ggacaaccgaggctccttct

SEQ ID NO: 692686 - DNA, 20 bp, mouse
ggtcccgccccctggatcgg

SEQ ID NO: 692687 - DNA, 20 bp, mouse
gggcccagcaaggggaggtg

SEQ ID NO: 692688 - DNA, 20 bp, mouse
gtggacggcccagcaagggg

SEQ ID NO: 692689 - DNA, 20 bp, mouse
gctgctggacggcccagcaa

SEQ ID NO: 692690 - DNA, 20 bp, mouse
gggggcggcagagatgagaa

SEQ ID NO: 692691 - DNA, 20 bp, mouse
gtcaggagccgccgatccag

SEQ ID NO: 692692 - DNA, 20 bp, mouse
gcctgcccgcccgtgatgtc

SEQ ID NO: 692693 - DNA, 20 bp, mouse
gagcactctgtaaagttcga

SEQ ID NO: 692694 - DNA, 20 bp, mouse
gcagggggcgggaccacggg

SEQ ID NO: 692695 - DNA, 20 bp, mouse
gccctgcagtcaggagaaga

SEQ ID NO: 692696 - DNA, 20 bp, mouse
ggggcctcagagtggaagga

SEQ ID NO: 692697 - DNA, 20 bp, mouse
gggagaaggcagacggagaa

SEQ ID NO: 692698 - DNA, 20 bp, mouse
gaggctaaagtggatataaa

SEQ ID NO: 692699 - DNA, 20 bp, mouse
gagctgaggtctccagtcag

SEQ ID NO: 692700 - DNA, 20 bp, mouse
gaaagtggatataaaagggt

SEQ ID NO: 692701 - DNA, 20 bp, mouse
gtgaggtctccagtcagggg

SEQ ID NO: 692702 - DNA, 20 bp, mouse
ggagaagggtgggtattaaa

SEQ ID NO: 692703 - DNA, 20 bp, mouse
gaaggcagacggagaagggt

SEQ ID NO: 692704 - DNA, 20 bp, mouse
gaacatgccttctgtgtgac

SEQ ID NO: 692705 - DNA, 20 bp, mouse
gagaagcagaaaaccaccag

SEQ ID NO: 692706 - DNA, 20 bp, mouse
ggctgagttgccaccatcag

SEQ ID NO: 692707 - DNA, 20 bp, mouse
ggagttgccaccatcagagg

SEQ ID NO: 692708 - DNA, 20 bp, mouse
gggacactagccagatttaa

SEQ ID NO: 692709 - DNA, 20 bp, mouse
gccagtctgtccacctctga

SEQ ID NO: 692710 - DNA, 20 bp, mouse
ggtaatgttgaaaaaaagaa

SEQ ID NO: 692711 - DNA, 20 bp, mouse
gtggtaagagatggagaaag

SEQ ID NO: 692712 - DNA, 20 bp, mouse
ggcagcaagctcatggatcc

SEQ ID NO: 692713 - DNA, 20 bp, mouse
gcctttaaaagcttgctttg

SEQ ID NO: 692714 - DNA, 20 bp, mouse
gacatgcaatctcacttgtt

SEQ ID NO: 692715 - DNA, 20 bp, mouse
ggagtggattgacttcactg

SEQ ID NO: 692716 - DNA, 20 bp, mouse
gtcactgaccataagtctga

SEQ ID NO: 692717 - DNA, 20 bp, mouse
gtggtggtctacaaatagca

SEQ ID NO: 692718 - DNA, 20 bp, mouse
ggggagtccatacagaagtt

SEQ ID NO: 692719 - DNA, 20 bp, mouse
gaggagaactaattagagtt

SEQ ID NO: 692720 - DNA, 20 bp, mouse
gcacgagagaactgaacttt

SEQ ID NO: 692721 - DNA, 20 bp, mouse
gtctgctttacactagtaaa

SEQ ID NO: 692722 - DNA, 20 bp, mouse
gcatatgattgccttgtctg

SEQ ID NO: 692723 - DNA, 20 bp, mouse
gtgtctcaatgcattcctta

SEQ ID NO: 692724 - DNA, 20 bp, mouse
gacattacctaggaatacac

SEQ ID NO: 692725 - DNA, 20 bp, mouse
ggtattcctaggtaatgtat

SEQ ID NO: 692726 - DNA, 20 bp, mouse
ggggcggggcgatggatggc

SEQ ID NO: 692727 - DNA, 20 bp, mouse
gcggggcgatggatggcggg

SEQ ID NO: 692728 - DNA, 20 bp, mouse
gtccccctcagagcagagtg

SEQ ID NO: 692729 - DNA, 20 bp, mouse
gtcggaggcaaaagccggac

SEQ ID NO: 692730 - DNA, 20 bp, mouse
gaagggagggggttcaactg

SEQ ID NO: 692731 - DNA, 20 bp, mouse
gtctgcgaggagagagttag

SEQ ID NO: 692732 - DNA, 20 bp, mouse
ggaatacggtccccagtcgg

SEQ ID NO: 692733 - DNA, 20 bp, mouse
gcgctcacctgccccaaggt

SEQ ID NO: 692734 - DNA, 20 bp, mouse
gtacgtgcttgaagagggtt

SEQ ID NO: 692735 - DNA, 20 bp, mouse
gtgaggtacgtgcttgaaga

SEQ ID NO: 692736 - DNA, 20 bp, mouse
gcgaacgcctgggaacccgg

SEQ ID NO: 692737 - DNA, 20 bp, mouse
gaacccggaggcctggatcc

SEQ ID NO: 692738 - DNA, 20 bp, mouse
gaggcgaacgcctgggaacc

SEQ ID NO: 692739 - DNA, 20 bp, mouse
gtactcgccctgaggtggaa

SEQ ID NO: 692740 - DNA, 20 bp, mouse
ggcccagaatggaacggagt

SEQ ID NO: 692741 - DNA, 20 bp, mouse
ggcgggcgccgcaggagcga

SEQ ID NO: 692742 - DNA, 20 bp, mouse
ggggacccgggtgccccggt

SEQ ID NO: 692743 - DNA, 20 bp, mouse
gtcctccgaagcctggtaaa

SEQ ID NO: 692744 - DNA, 20 bp, mouse
gcgcccggccgccgacctct

SEQ ID NO: 692745 - DNA, 20 bp, mouse
gatccgggcccagaatggaa

SEQ ID NO: 692746 - DNA, 20 bp, mouse
ggggcgcgcgcgggactttg

SEQ ID NO: 692747 - DNA, 20 bp, mouse
gtcagtccggatctgaaggg

SEQ ID NO: 692748 - DNA, 20 bp, mouse
gagggcaggccggacgtacg

SEQ ID NO: 692749 - DNA, 20 bp, mouse
gggaaaagggagcccggcac

SEQ ID NO: 692750 - DNA, 20 bp, mouse
gggcggccgtgggtggagag

SEQ ID NO: 692751 - DNA, 20 bp, mouse
gttgcggataaataatccgg

SEQ ID NO: 692752 - DNA, 20 bp, mouse
gggctcaggccccgtacgtc

SEQ ID NO: 692753 - DNA, 20 bp, mouse
gagaactcgcgctgacactc

SEQ ID NO: 692754 - DNA, 20 bp, mouse
gcccctccccccttcagatc

SEQ ID NO: 692755 - DNA, 20 bp, mouse
gcggataaataatccggggg

SEQ ID NO: 692756 - DNA, 20 bp, mouse
ggcccgagccgcatgagtga

SEQ ID NO: 692757 - DNA, 20 bp, mouse
gggcgcgtcacgtggatgag

SEQ ID NO: 692758 - DNA, 20 bp, mouse
gcccgcggcagcttggtgac

SEQ ID NO: 692759 - DNA, 20 bp, mouse
gctgccgcgggcgcgtcacg

SEQ ID NO: 692760 - DNA, 20 bp, mouse
gtgggcacggccactttaaa

SEQ ID NO: 692761 - DNA, 20 bp, mouse
gtggcccgaggcacgtgtcc

SEQ ID NO: 692762 - DNA, 20 bp, mouse
ggcacggccactttaaaggg

SEQ ID NO: 692763 - DNA, 20 bp, mouse
gcatccacgtgacgcgcccg

SEQ ID NO: 692764 - DNA, 20 bp, mouse
gctcccgcccctcactcatg

SEQ ID NO: 692765 - DNA, 20 bp, mouse
ggctgcctcggctttcgcgc

SEQ ID NO: 692766 - DNA, 20 bp, mouse
gaggggcgttgcgcacgagg

SEQ ID NO: 692767 - DNA, 20 bp, mouse
gaacgcccctcgccccggga

SEQ ID NO: 692768 - DNA, 20 bp, mouse
gggcaggagagcgcggtcaa

SEQ ID NO: 692769 - DNA, 20 bp, mouse
gtgcgcaacgcccctcgccc

SEQ ID NO: 692770 - DNA, 20 bp, mouse
gccgacgcgcgcacagtact

SEQ ID NO: 692771 - DNA, 20 bp, mouse
ggccccccgcggtcggaggg

SEQ ID NO: 692772 - DNA, 20 bp, mouse
gccgggtgggcggcaacaaa

SEQ ID NO: 692773 - DNA, 20 bp, mouse
ggcccccctccgaccgcggg

SEQ ID NO: 692774 - DNA, 20 bp, mouse
gcgcgccccccgcggtcgga

SEQ ID NO: 692775 - DNA, 20 bp, mouse
ggcgaggggcgttgcgcacg

SEQ ID NO: 692776 - DNA, 20 bp, mouse
ggatttgtgtcagtagcata

SEQ ID NO: 692777 - DNA, 20 bp, mouse
gtacagcagtaagatttaga

SEQ ID NO: 692778 - DNA, 20 bp, mouse
gataagagactccattccac

SEQ ID NO: 692779 - DNA, 20 bp, mouse
gttgccatcacaagagttag

SEQ ID NO: 692780 - DNA, 20 bp, mouse
gggccaccatcaaaaggttt

SEQ ID NO: 692781 - DNA, 20 bp, mouse
ggcacagcaaataactgagt

SEQ ID NO: 692782 - DNA, 20 bp, mouse
gatcactggccaccatcaaa

SEQ ID NO: 692783 - DNA, 20 bp, mouse
gtttccactaactcttgtga

SEQ ID NO: 692784 - DNA, 20 bp, mouse
gtgagagttacttgtcattt

SEQ ID NO: 692785 - DNA, 20 bp, mouse
gtaaaaaggaactataccct

SEQ ID NO: 692786 - DNA, 20 bp, mouse
gtatgcaaagagactcgcta

SEQ ID NO: 692787 - DNA, 20 bp, mouse
ggagtggggcggggagcgaa

SEQ ID NO: 692788 - DNA, 20 bp, mouse
gttagccggagaggaactag

SEQ ID NO: 692789 - DNA, 20 bp, mouse
gggagcgaacggagacaaag

SEQ ID NO: 692790 - DNA, 20 bp, mouse
ggctggggcacccaactcag

SEQ ID NO: 692791 - DNA, 20 bp, mouse
gcggaggcgctgcagagacc

SEQ ID NO: 692792 - DNA, 20 bp, mouse
gaggaagcgcgtccactacg

SEQ ID NO: 692793 - DNA, 20 bp, mouse
gccactacgcgggcaggagc

SEQ ID NO: 692794 - DNA, 20 bp, mouse
gtataagttgcgcccgggag

SEQ ID NO: 692795 - DNA, 20 bp, mouse
gcggagaggaactaggggag

SEQ ID NO: 692796 - DNA, 20 bp, mouse
gggcaggtgtccggtctcca

SEQ ID NO: 692797 - DNA, 20 bp, mouse
gcagcgccgcggcaggtgtc

SEQ ID NO: 692798 - DNA, 20 bp, mouse
ggtgtccggtctccaggggt

SEQ ID NO: 692799 - DNA, 20 bp, mouse
gagccagtccagcgcggagg

SEQ ID NO: 692800 - DNA, 20 bp, mouse
gctccccctccgcgctggac

SEQ ID NO: 692801 - DNA, 20 bp, mouse
gcagcgcggagggggagctc

SEQ ID NO: 692802 - DNA, 20 bp, mouse
gtccgcctccaccccgaaga

SEQ ID NO: 692803 - DNA, 20 bp, mouse
gcaccaggttcctccgggat

SEQ ID NO: 692804 - DNA, 20 bp, mouse
gtccccatcccggaggaacc

SEQ ID NO: 692805 - DNA, 20 bp, mouse
gagcactgcagccatcttcg

SEQ ID NO: 692806 - DNA, 20 bp, mouse
ggaggggtctgacagatctg

SEQ ID NO: 692807 - DNA, 20 bp, mouse
gggagggtgggtgcacctga

SEQ ID NO: 692808 - DNA, 20 bp, mouse
ggggccatgtgaggtgtaca

SEQ ID NO: 692809 - DNA, 20 bp, mouse
gtcgccatgtacacctcaca

SEQ ID NO: 692810 - DNA, 20 bp, mouse
gggcagctgaagggcgtcgg

SEQ ID NO: 692811 - DNA, 20 bp, mouse
gtgaggtgtacatggcgagg

SEQ ID NO: 692812 - DNA, 20 bp, mouse
gttagccagcccctgaccta

SEQ ID NO: 692813 - DNA, 20 bp, mouse
ggaccaatggcaagcgagta

SEQ ID NO: 692814 - DNA, 20 bp, mouse
gcgtttggtggcaggagggt

SEQ ID NO: 692815 - DNA, 20 bp, mouse
gcccgacgtggaacgaccaa

SEQ ID NO: 692816 - DNA, 20 bp, mouse
gtgtaaccccaggcatctta

SEQ ID NO: 692817 - DNA, 20 bp, mouse
gcccactcaccctcttaata

SEQ ID NO: 692818 - DNA, 20 bp, mouse
gggaagccaccagatgatgg

SEQ ID NO: 692819 - DNA, 20 bp, mouse
gtttgcctgtaaatcagcgt

SEQ ID NO: 692820 - DNA, 20 bp, mouse
gacttcctgtccctattaag

SEQ ID NO: 692821 - DNA, 20 bp, mouse
gggacccacctctccctggg

SEQ ID NO: 692822 - DNA, 20 bp, mouse
gccatcccacgctgatttac

SEQ ID NO: 692823 - DNA, 20 bp, mouse
ggcatcttaaggctgccatt

SEQ ID NO: 692824 - DNA, 20 bp, mouse
gcgaaatcactgctaatagt

SEQ ID NO: 692825 - DNA, 20 bp, mouse
gcaaaggctctgcctctggt

SEQ ID NO: 692826 - DNA, 20 bp, mouse
gggagggatcacagatggat

SEQ ID NO: 692827 - DNA, 20 bp, mouse
gtgaccaccgccattcgaat

SEQ ID NO: 692828 - DNA, 20 bp, mouse
gtaagagaaggtgactaagc

SEQ ID NO: 692829 - DNA, 20 bp, mouse
ggcactaatgtgttcctctt

SEQ ID NO: 692830 - DNA, 20 bp, mouse
gaatgcttgctatttgtagc

SEQ ID NO: 692831 - DNA, 20 bp, mouse
gctacccccagtcccagacc

SEQ ID NO: 692832 - DNA, 20 bp, mouse
gctgtttgaagcctaagaga

SEQ ID NO: 692833 - DNA, 20 bp, mouse
gtaggcttcaaacagctgtg

SEQ ID NO: 692834 - DNA, 20 bp, mouse
gacaccaggacttgtggatc

SEQ ID NO: 692835 - DNA, 20 bp, mouse
gacaccagatccacaagtcc

SEQ ID NO: 692836 - DNA, 20 bp, mouse
gtgtgcgccaacccacctac

SEQ ID NO: 692837 - DNA, 20 bp, mouse
gtcccgtcccgtaggtgggt

SEQ ID NO: 692838 - DNA, 20 bp, mouse
gcgtccctccgcttcagctg

SEQ ID NO: 692839 - DNA, 20 bp, mouse
gcgccaacccacctacggga

SEQ ID NO: 692840 - DNA, 20 bp, mouse
gggcgtcccgtcccgtaggt

SEQ ID NO: 692841 - DNA, 20 bp, mouse
gtgccggcgtcccgtcccgt

SEQ ID NO: 692842 - DNA, 20 bp, mouse
gccaggtaaggcgcagagct

SEQ ID NO: 692843 - DNA, 20 bp, mouse
gaaaccctgtcgctgtggaa

SEQ ID NO: 692844 - DNA, 20 bp, mouse
ggcaacctcagctgaagcgg

SEQ ID NO: 692845 - DNA, 20 bp, mouse
gtcctctggcggccgctcag

SEQ ID NO: 692846 - DNA, 20 bp, mouse
gcaccagccagccttggcaa

SEQ ID NO: 692847 - DNA, 20 bp, mouse
gtggagggtggggtgcatgg

SEQ ID NO: 692848 - DNA, 20 bp, mouse
gcttggcaagggtaggtgga

SEQ ID NO: 692849 - DNA, 20 bp, mouse
gtggcccggccccttctcta

SEQ ID NO: 692850 - DNA, 20 bp, mouse
ggcaagggtaggtggagggt

SEQ ID NO: 692851 - DNA, 20 bp, mouse
gctgcctgccaggcgagtag

SEQ ID NO: 692852 - DNA, 20 bp, mouse
gaccctacctccccatccca

SEQ ID NO: 692853 - DNA, 20 bp, mouse
gagccagccttggcaagggt

SEQ ID NO: 692854 - DNA, 20 bp, mouse
gtcgctgggtggggggccct

SEQ ID NO: 692855 - DNA, 20 bp, mouse
gcacctacccttgccaaggc

SEQ ID NO: 692856 - DNA, 20 bp, mouse
gagacggggcgggacctgat

SEQ ID NO: 692857 - DNA, 20 bp, mouse
gaggtcccgccccgtctctc

SEQ ID NO: 692858 - DNA, 20 bp, mouse
ggttggctcgcaccgagttc

SEQ ID NO: 692859 - DNA, 20 bp, mouse
gtgggcggggtctaggagaa

SEQ ID NO: 692860 - DNA, 20 bp, mouse
gaataaccggagagacgggg

SEQ ID NO: 692861 - DNA, 20 bp, mouse
gaacgtggacagatcctagc

SEQ ID NO: 692862 - DNA, 20 bp, mouse
gttaaataaccggagagacg

SEQ ID NO: 692863 - DNA, 20 bp, mouse
gtgcgtggatcctgagccca

SEQ ID NO: 692864 - DNA, 20 bp, mouse
gccaaggagccagggaccca

SEQ ID NO: 692865 - DNA, 20 bp, mouse
gctcgcaccgagttccggct

SEQ ID NO: 692866 - DNA, 20 bp, mouse
ggaggaggcgccgccccagg

SEQ ID NO: 692867 - DNA, 20 bp, mouse
ggcaggagcgtcgaggagtt

SEQ ID NO: 692868 - DNA, 20 bp, mouse
gctagcggccccggccgcgg

SEQ ID NO: 692869 - DNA, 20 bp, mouse
ggagctagcggccccggccg

SEQ ID NO: 692870 - DNA, 20 bp, mouse
gagcgtcgaggagttcggct

SEQ ID NO: 692871 - DNA, 20 bp, mouse
ggcacctcctccccctgggg

SEQ ID NO: 692872 - DNA, 20 bp, mouse
gggctacggcgggagggagt

SEQ ID NO: 692873 - DNA, 20 bp, mouse
ggggctcggctacggcggga

SEQ ID NO: 692874 - DNA, 20 bp, mouse
ggctgcgcggcccaggggga

SEQ ID NO: 692875 - DNA, 20 bp, mouse
gcgggcacctcctccccctg

SEQ ID NO: 692876 - DNA, 20 bp, mouse
ggtaggggagacaggttgag

SEQ ID NO: 692877 - DNA, 20 bp, mouse
gaggagtgattctaagtctc

SEQ ID NO: 692878 - DNA, 20 bp, mouse
gctcaggcccagagcggggc

SEQ ID NO: 692879 - DNA, 20 bp, mouse
gctggtactcagtgctggta

SEQ ID NO: 692880 - DNA, 20 bp, mouse
gttctctgatcaactgtcga

SEQ ID NO: 692881 - DNA, 20 bp, mouse
gaaacctcaggcccagagcg

SEQ ID NO: 692882 - DNA, 20 bp, mouse
ggtcaggggtcaaatgacta

SEQ ID NO: 692883 - DNA, 20 bp, mouse
gtcaaagctcgggagatgga

SEQ ID NO: 692884 - DNA, 20 bp, mouse
ggcagccagaaacccagaat

SEQ ID NO: 692885 - DNA, 20 bp, mouse
gctaagtctcgggtctcaac

SEQ ID NO: 692886 - DNA, 20 bp, mouse
gcggaggtggagcgatcgac

SEQ ID NO: 692887 - DNA, 20 bp, mouse
gtggagcgatcgacggggaa

SEQ ID NO: 692888 - DNA, 20 bp, mouse
gaggggcgcggcctgaatgt

SEQ ID NO: 692889 - DNA, 20 bp, mouse
gggaggagcctcggggtaat

SEQ ID NO: 692890 - DNA, 20 bp, mouse
gggtaatgggcggggcgtct

SEQ ID NO: 692891 - DNA, 20 bp, mouse
gcgccccgcccattaccccg

SEQ ID NO: 692892 - DNA, 20 bp, mouse
ggagcctcggggtaatgggc

SEQ ID NO: 692893 - DNA, 20 bp, mouse
ggggaaggggaggagcctcg

SEQ ID NO: 692894 - DNA, 20 bp, mouse
gtctgtctgagaaaaacgta

SEQ ID NO: 692895 - DNA, 20 bp, mouse
gcccgcacccaaacattttg

SEQ ID NO: 692896 - DNA, 20 bp, mouse
gctgcccagactaggggcga

SEQ ID NO: 692897 - DNA, 20 bp, mouse
ggctcggcctgcccagacta

SEQ ID NO: 692898 - DNA, 20 bp, mouse
gactaggggcgagggcacgg

SEQ ID NO: 692899 - DNA, 20 bp, mouse
gggaatgcctggcgagcctc

SEQ ID NO: 692900 - DNA, 20 bp, mouse
ggggcccggccgagggtcta

SEQ ID NO: 692901 - DNA, 20 bp, mouse
ggggagggcgggcccgaaag

SEQ ID NO: 692902 - DNA, 20 bp, mouse
gggtctacggagcccggatg

SEQ ID NO: 692903 - DNA, 20 bp, mouse
ggtgccctcgcccctagtct

SEQ ID NO: 692904 - DNA, 20 bp, mouse
ggaacctggggcccggccga

SEQ ID NO: 692905 - DNA, 20 bp, mouse
gtccgggctccgtagaccct

SEQ ID NO: 692906 - DNA, 20 bp, mouse
gtggtggtggggaacggaac

SEQ ID NO: 692907 - DNA, 20 bp, mouse
gtacgagcgcgggtggtggt

SEQ ID NO: 692908 - DNA, 20 bp, mouse
ggctggggcgatccaggacc

SEQ ID NO: 692909 - DNA, 20 bp, mouse
gaacggaacgggtgggggaa

SEQ ID NO: 692910 - DNA, 20 bp, mouse
ggagacgcatgtacgagcgc

SEQ ID NO: 692911 - DNA, 20 bp, mouse
gggcgcctatagagccggga

SEQ ID NO: 692912 - DNA, 20 bp, mouse
gggaagggctggggcgatcc

SEQ ID NO: 692913 - DNA, 20 bp, mouse
gtggaaaagcccacccacag

SEQ ID NO: 692914 - DNA, 20 bp, mouse
gggagggcgcatgtgacccg

SEQ ID NO: 692915 - DNA, 20 bp, mouse
gtggtggggaacggaacggg

SEQ ID NO: 692916 - DNA, 20 bp, mouse
ggtacacgccccagggcccc

SEQ ID NO: 692917 - DNA, 20 bp, mouse
gtcaaagtagagacttttat

SEQ ID NO: 692918 - DNA, 20 bp, mouse
ggactgagggtacttgagag

SEQ ID NO: 692919 - DNA, 20 bp, mouse
gaaccctcgattctcttgat

SEQ ID NO: 692920 - DNA, 20 bp, mouse
gtacccctggcctttctaaa

SEQ ID NO: 692921 - DNA, 20 bp, mouse
ggataaatgcccagtctgag

SEQ ID NO: 692922 - DNA, 20 bp, mouse
gtgctggcttggaaaaagtg

SEQ ID NO: 692923 - DNA, 20 bp, mouse
ggaagcaaaagctcctgacc

SEQ ID NO: 692924 - DNA, 20 bp, mouse
ggaggagggggcctaggaag

SEQ ID NO: 692925 - DNA, 20 bp, mouse
gaaatgcccagtctgagagg

SEQ ID NO: 692926 - DNA, 20 bp, mouse
gcgaggaacagtgacaaacg

SEQ ID NO: 692927 - DNA, 20 bp, mouse
ggacctccacggctcaggaa

SEQ ID NO: 692928 - DNA, 20 bp, mouse
gccgtctgcaaaactgtccg

SEQ ID NO: 692929 - DNA, 20 bp, mouse
gagagcgaagcattgaagaa

SEQ ID NO: 692930 - DNA, 20 bp, mouse
gagtgcggacgggacaacga

SEQ ID NO: 692931 - DNA, 20 bp, mouse
ggtgcagcaagcacagtgcg

SEQ ID NO: 692932 - DNA, 20 bp, mouse
ggaagcctcgcgagatctag

SEQ ID NO: 692933 - DNA, 20 bp, mouse
ggacaacgatgggtcccgaa

SEQ ID NO: 692934 - DNA, 20 bp, mouse
gttaactgcaagagttgaag

SEQ ID NO: 692935 - DNA, 20 bp, mouse
gacgacccctagatctcgcg

SEQ ID NO: 692936 - DNA, 20 bp, mouse
ggggaaggggtcaggtgccg

SEQ ID NO: 692937 - DNA, 20 bp, mouse
gtcccgggcgcgccactcaa

SEQ ID NO: 692938 - DNA, 20 bp, mouse
gaccacgtgggcagccggag

SEQ ID NO: 692939 - DNA, 20 bp, mouse
gggctccagcaggctgcgga

SEQ ID NO: 692940 - DNA, 20 bp, mouse
gctcccgcgcaggctccagc

SEQ ID NO: 692941 - DNA, 20 bp, mouse
ggggctccgggattcaaagg

SEQ ID NO: 692942 - DNA, 20 bp, mouse
gcaggtgccggggaagacaa

SEQ ID NO: 692943 - DNA, 20 bp, mouse
gaaaataggcctcgcgtggg

SEQ ID NO: 692944 - DNA, 20 bp, mouse
gcgaacccgtcggtcaaaat

SEQ ID NO: 692945 - DNA, 20 bp, mouse
ggtgccaaggtgcacgcggt

SEQ ID NO: 692946 - DNA, 20 bp, mouse
ggaagcggagagatgctcgt

SEQ ID NO: 692947 - DNA, 20 bp, mouse
gcgcgcgcgcccaggagtgg

SEQ ID NO: 692948 - DNA, 20 bp, mouse
gcgtaaagcggtgaaaggat

SEQ ID NO: 692949 - DNA, 20 bp, mouse
gcgctcctccggctccagat

SEQ ID NO: 692950 - DNA, 20 bp, mouse
ggatcgcgctattccctcgg

SEQ ID NO: 692951 - DNA, 20 bp, mouse
gggagtggggggagtcgcga

SEQ ID NO: 692952 - DNA, 20 bp, mouse
ggcgctcgagctccggatcc

SEQ ID NO: 692953 - DNA, 20 bp, mouse
gtggggggagtcgcgagggg

SEQ ID NO: 692954 - DNA, 20 bp, mouse
gcccccggaaatccgtaaag

SEQ ID NO: 692955 - DNA, 20 bp, mouse
gcctccggctccagatcggc

SEQ ID NO: 692956 - DNA, 20 bp, mouse
gatgccctagccaatgggag

SEQ ID NO: 692957 - DNA, 20 bp, mouse
gcaaatattggatacttctg

SEQ ID NO: 692958 - DNA, 20 bp, mouse
gtggcctaggccaggcaatg

SEQ ID NO: 692959 - DNA, 20 bp, mouse
gagctggactctaacctacc

SEQ ID NO: 692960 - DNA, 20 bp, mouse
gcccatgaagacacatgctc

SEQ ID NO: 692961 - DNA, 20 bp, mouse
gtcaggaagcttggtgtgag

SEQ ID NO: 692962 - DNA, 20 bp, mouse
ggcttcaatagtcacctggt

SEQ ID NO: 692963 - DNA, 20 bp, mouse
gctgctatctagcctagaac

SEQ ID NO: 692964 - DNA, 20 bp, mouse
gaggtatcaagggatgctag

SEQ ID NO: 692965 - DNA, 20 bp, mouse
gccatctagtagaaggtgca

SEQ ID NO: 692966 - DNA, 20 bp, mouse
gcaatacagcaaaggggtgg

SEQ ID NO: 692967 - DNA, 20 bp, mouse
gaaacagggcttgagcttat

SEQ ID NO: 692968 - DNA, 20 bp, mouse
ggccctagatctgatggcaa

SEQ ID NO: 692969 - DNA, 20 bp, mouse
gtatcggccaatacagcaaa

SEQ ID NO: 692970 - DNA, 20 bp, mouse
gccgggctctctcagccaaa

SEQ ID NO: 692971 - DNA, 20 bp, mouse
gtctgaagctgacagaggtt

SEQ ID NO: 692972 - DNA, 20 bp, mouse
gggaccaggtagtccaaggc

SEQ ID NO: 692973 - DNA, 20 bp, mouse
gacctttgccatcagatcta

SEQ ID NO: 692974 - DNA, 20 bp, mouse
gaggcctgccccttctgaac

SEQ ID NO: 692975 - DNA, 20 bp, mouse
gtaactcgctccagttcaga

SEQ ID NO: 692976 - DNA, 20 bp, mouse
gcgcgggcggggacagggtt

SEQ ID NO: 692977 - DNA, 20 bp, mouse
gacgcggggggattccgcaa

SEQ ID NO: 692978 - DNA, 20 bp, mouse
ggctcaacgccccgggtatt

SEQ ID NO: 692979 - DNA, 20 bp, mouse
gccagggcccgaaatcagac

SEQ ID NO: 692980 - DNA, 20 bp, mouse
gcgcgtagcccaacgaggac

SEQ ID NO: 692981 - DNA, 20 bp, mouse
gacaggaagccaaatacccg

SEQ ID NO: 692982 - DNA, 20 bp, mouse
gggattccgcaagggttcgt

SEQ ID NO: 692983 - DNA, 20 bp, mouse
gtgggcgcgtgggctatttt

SEQ ID NO: 692984 - DNA, 20 bp, mouse
gccccccgcgtagcccaacg

SEQ ID NO: 692985 - DNA, 20 bp, mouse
gttaaagacacgcccacgtc

SEQ ID NO: 692986 - DNA, 20 bp, mouse
gcaaggggaggggccggtcg

SEQ ID NO: 692987 - DNA, 20 bp, mouse
gaaagtgtctgttcaagggg

SEQ ID NO: 692988 - DNA, 20 bp, mouse
gcatgaaagtgtctgttcaa

SEQ ID NO: 692989 - DNA, 20 bp, mouse
gcgagctgatgggaaattct

SEQ ID NO: 692990 - DNA, 20 bp, mouse
gtctgagcagaagaggctta

SEQ ID NO: 692991 - DNA, 20 bp, mouse
ggaggggccggtcggggggt

SEQ ID NO: 692992 - DNA, 20 bp, mouse
ggaagtcctccggttgccaa

SEQ ID NO: 692993 - DNA, 20 bp, mouse
gcttaaggcaacatccttct

SEQ ID NO: 692994 - DNA, 20 bp, mouse
gtcccacctgggaagttgac

SEQ ID NO: 692995 - DNA, 20 bp, mouse
gatgcgcctgtcaacttccc

SEQ ID NO: 692996 - DNA, 20 bp, mouse
gccagaaagcaaccgagctg

SEQ ID NO: 692997 - DNA, 20 bp, mouse
gagtaataatgcatactaat

SEQ ID NO: 692998 - DNA, 20 bp, mouse
gagcgattggtcaattgaag

SEQ ID NO: 692999 - DNA, 20 bp, mouse
gacaatgtccgagagagaaa

SEQ ID NO: 693000 - DNA, 20 bp, mouse
gagaaatggactttattctg

SEQ ID NO: 693001 - DNA, 20 bp, mouse
gagcagagctctgtagcgat

SEQ ID NO: 693002 - DNA, 20 bp, mouse
ggaaagcaaccgagctgggg

SEQ ID NO: 693003 - DNA, 20 bp, mouse
gctgacaagaagccctgtac

SEQ ID NO: 693004 - DNA, 20 bp, mouse
gtgtacaaactccctgtaca

SEQ ID NO: 693005 - DNA, 20 bp, mouse
gaaaaccactctgactaaca

SEQ ID NO: 693006 - DNA, 20 bp, mouse
gacgccgcagagagcgcctg

SEQ ID NO: 693007 - DNA, 20 bp, mouse
gcgggtacgcgtctcacact

SEQ ID NO: 693008 - DNA, 20 bp, mouse
gtcccagtgcgcagctgctg

SEQ ID NO: 693009 - DNA, 20 bp, mouse
ggctccgcggagcgcttcct

SEQ ID NO: 693010 - DNA, 20 bp, mouse
gctcccggccactatctggt

SEQ ID NO: 693011 - DNA, 20 bp, mouse
ggtgagacgcgtacccggat

SEQ ID NO: 693012 - DNA, 20 bp, mouse
gcgcgggcccccgcagagac

SEQ ID NO: 693013 - DNA, 20 bp, mouse
ggtacgcgtctcacactcgg

SEQ ID NO: 693014 - DNA, 20 bp, mouse
gcgggctcgggcatccaatc

SEQ ID NO: 693015 - DNA, 20 bp, mouse
ggggcagcgccagtctctgc

SEQ ID NO: 693016 - DNA, 20 bp, mouse
ggctgcgtgggtttgaagga

SEQ ID NO: 693017 - DNA, 20 bp, mouse
ggggcgctgcgtgggtttga

SEQ ID NO: 693018 - DNA, 20 bp, mouse
gaggggggcgggcgctgcgt

SEQ ID NO: 693019 - DNA, 20 bp, mouse
gaggcagcacagctactcct

SEQ ID NO: 693020 - DNA, 20 bp, mouse
gcccgctgctggaacgccat

SEQ ID NO: 693021 - DNA, 20 bp, mouse
ggatagggatgggtggctgg

SEQ ID NO: 693022 - DNA, 20 bp, mouse
gcgggctgcagcgacgagtc

SEQ ID NO: 693023 - DNA, 20 bp, mouse
gtcaattagcggaagcaggg

SEQ ID NO: 693024 - DNA, 20 bp, mouse
gttagcggaagcaggggggc

SEQ ID NO: 693025 - DNA, 20 bp, mouse
gctgtcaattagcggaagca

SEQ ID NO: 693026 - DNA, 20 bp, mouse
gagaccgactacctctagat

SEQ ID NO: 693027 - DNA, 20 bp, mouse
gtcggtctctgggttttgtg

SEQ ID NO: 693028 - DNA, 20 bp, mouse
gctagaggtagtcggtctct

SEQ ID NO: 693029 - DNA, 20 bp, mouse
gcccttgcaaagcctgagga

SEQ ID NO: 693030 - DNA, 20 bp, mouse
gtgccctatctagaggtagt

SEQ ID NO: 693031 - DNA, 20 bp, mouse
gtgaaggcaaaaatcagtag

SEQ ID NO: 693032 - DNA, 20 bp, mouse
gcaagctagaattaacacag

SEQ ID NO: 693033 - DNA, 20 bp, mouse
gttaaattctgaagtgaact

SEQ ID NO: 693034 - DNA, 20 bp, mouse
ggagatcctgccctatctag

SEQ ID NO: 693035 - DNA, 20 bp, mouse
gcggtggacgttcatattta

SEQ ID NO: 693036 - DNA, 20 bp, mouse
gtcaaagtgagtagcatgat

SEQ ID NO: 693037 - DNA, 20 bp, mouse
gtatctctaacggagatccc

SEQ ID NO: 693038 - DNA, 20 bp, mouse
gggctcactcttccccagga

SEQ ID NO: 693039 - DNA, 20 bp, mouse
gtgttggaggaagtcacagg

SEQ ID NO: 693040 - DNA, 20 bp, mouse
gttcagagatgggcggttac

SEQ ID NO: 693041 - DNA, 20 bp, mouse
ggatgctggaaggccttggt

SEQ ID NO: 693042 - DNA, 20 bp, mouse
ggggcaagacttggggttct

SEQ ID NO: 693043 - DNA, 20 bp, mouse
ggccctgtgggcaagacttg

SEQ ID NO: 693044 - DNA, 20 bp, mouse
gcccatctctgaagatgcac

SEQ ID NO: 693045 - DNA, 20 bp, mouse
gaagtgagtagcatgatggg

SEQ ID NO: 693046 - DNA, 20 bp, mouse
gggcaagctagaacaccaac

SEQ ID NO: 693047 - DNA, 20 bp, mouse
gggggcggtctcaacgtcac

SEQ ID NO: 693048 - DNA, 20 bp, mouse
gaaagcctgcatggacctta

SEQ ID NO: 693049 - DNA, 20 bp, mouse
gtaaagaatccgcccacctc

SEQ ID NO: 693050 - DNA, 20 bp, mouse
gcagcgacttgcccaggatc

SEQ ID NO: 693051 - DNA, 20 bp, mouse
gataagcgttggccggaggt

SEQ ID NO: 693052 - DNA, 20 bp, mouse
gctgcccctaaggtccatgc

SEQ ID NO: 693053 - DNA, 20 bp, mouse
gaatgagagtgggcttgacg

SEQ ID NO: 693054 - DNA, 20 bp, mouse
gaggcttttaattggttctg

SEQ ID NO: 693055 - DNA, 20 bp, mouse
gcacaccaataagcgttggc

SEQ ID NO: 693056 - DNA, 20 bp, mouse
ggaaggaaaggactctatat

SEQ ID NO: 693057 - DNA, 20 bp, mouse
gaactcgtactccttgtcaa

SEQ ID NO: 693058 - DNA, 20 bp, mouse
gctcaggctggtgatgtgac

SEQ ID NO: 693059 - DNA, 20 bp, mouse
gggtgtgcttaggataaaca

SEQ ID NO: 693060 - DNA, 20 bp, mouse
ggtgatgtgacaggctttct

SEQ ID NO: 693061 - DNA, 20 bp, mouse
ggaacagggttctgggtacg

SEQ ID NO: 693062 - DNA, 20 bp, mouse
gtcagctatccagagaatat

SEQ ID NO: 693063 - DNA, 20 bp, mouse
gaaagtatcgatttcctgca

SEQ ID NO: 693064 - DNA, 20 bp, mouse
gaggaaatcgatactttacc

SEQ ID NO: 693065 - DNA, 20 bp, mouse
gtttgagagcggcagaactt

SEQ ID NO: 693066 - DNA, 20 bp, mouse
gaaggggcgggcacgaaggc

SEQ ID NO: 693067 - DNA, 20 bp, mouse
gctcggggaaggctcggaaa

SEQ ID NO: 693068 - DNA, 20 bp, mouse
gagcaagagacggacaagaa

SEQ ID NO: 693069 - DNA, 20 bp, mouse
gtctgtgaacggagcggtgt

SEQ ID NO: 693070 - DNA, 20 bp, mouse
ggccgccagatgctcgggga

SEQ ID NO: 693071 - DNA, 20 bp, mouse
gcgaccaattacagaagcac

SEQ ID NO: 693072 - DNA, 20 bp, mouse
ggcgccctcgagagcctaaa

SEQ ID NO: 693073 - DNA, 20 bp, mouse
gggtccttttaggctctcga

SEQ ID NO: 693074 - DNA, 20 bp, mouse
gaaccagaaaataggatagg

SEQ ID NO: 693075 - DNA, 20 bp, mouse
ggggaagacgggacagtaca

SEQ ID NO: 693076 - DNA, 20 bp, mouse
gggtgagagatctataacgg

SEQ ID NO: 693077 - DNA, 20 bp, mouse
ggtaactaggggaaatgagc

SEQ ID NO: 693078 - DNA, 20 bp, mouse
gtctgcgagagaggtactca

SEQ ID NO: 693079 - DNA, 20 bp, mouse
gtgagctttcgagtaactag

SEQ ID NO: 693080 - DNA, 20 bp, mouse
gggaaggggtcagctctatg

SEQ ID NO: 693081 - DNA, 20 bp, mouse
gagagatataacagacccta

SEQ ID NO: 693082 - DNA, 20 bp, mouse
gctaggggaaatgagctggc

SEQ ID NO: 693083 - DNA, 20 bp, mouse
ggggggtgagagatctataa

SEQ ID NO: 693084 - DNA, 20 bp, mouse
gaaacacccaagacagacga

SEQ ID NO: 693085 - DNA, 20 bp, mouse
gtagccagcccggtttcgga

SEQ ID NO: 693086 - DNA, 20 bp, mouse
ggatacccggtgttggggtt

SEQ ID NO: 693087 - DNA, 20 bp, mouse
gcaagccaagaacctgcgga

SEQ ID NO: 693088 - DNA, 20 bp, mouse
ggggcattccctatgctggg

SEQ ID NO: 693089 - DNA, 20 bp, mouse
gcactccttccgcaggttct

SEQ ID NO: 693090 - DNA, 20 bp, mouse
gctccctctttggaagactc

SEQ ID NO: 693091 - DNA, 20 bp, mouse
gaaaaggatacccggtgttg

SEQ ID NO: 693092 - DNA, 20 bp, mouse
gccgccccggagcctaactc

SEQ ID NO: 693093 - DNA, 20 bp, mouse
gggtgggagggccttaacgt

SEQ ID NO: 693094 - DNA, 20 bp, mouse
ggggccccagagttaggctc

SEQ ID NO: 693095 - DNA, 20 bp, mouse
gccctggccagaaacaaatt

SEQ ID NO: 693096 - DNA, 20 bp, mouse
gaggcggagcgaggtggcgt

SEQ ID NO: 693097 - DNA, 20 bp, mouse
gggaatcattgccacgtggg

SEQ ID NO: 693098 - DNA, 20 bp, mouse
gcctcatgccggacaggctg

SEQ ID NO: 693099 - DNA, 20 bp, mouse
gaaacaaggcctgaaaggat

SEQ ID NO: 693100 - DNA, 20 bp, mouse
gaaaagcggaggcgcctctg

SEQ ID NO: 693101 - DNA, 20 bp, mouse
gtccccctccatcctcatgc

SEQ ID NO: 693102 - DNA, 20 bp, mouse
gccccagcgcttgcgggagg

SEQ ID NO: 693103 - DNA, 20 bp, mouse
gtgggtggcgcagcctgcta

SEQ ID NO: 693104 - DNA, 20 bp, mouse
gtcccgcaagcgctggggcc

SEQ ID NO: 693105 - DNA, 20 bp, mouse
gaccgcctcccgcaagcgct

SEQ ID NO: 693106 - DNA, 20 bp, mouse
gatcacagtcaggtggtgta

SEQ ID NO: 693107 - DNA, 20 bp, mouse
gcccacataggatcacagtc

SEQ ID NO: 693108 - DNA, 20 bp, mouse
gaacccagtagtccccacat

SEQ ID NO: 693109 - DNA, 20 bp, mouse
gatctctggcagcatgaaat

SEQ ID NO: 693110 - DNA, 20 bp, mouse
ggtacccaggatgaactcaa

SEQ ID NO: 693111 - DNA, 20 bp, mouse
gctggggccttcatggagtc

SEQ ID NO: 693112 - DNA, 20 bp, mouse
gaatgacagaatcagagctg

SEQ ID NO: 693113 - DNA, 20 bp, mouse
gatcctatgtggggactact

SEQ ID NO: 693114 - DNA, 20 bp, mouse
gggccaaggaggaaagtagg

SEQ ID NO: 693115 - DNA, 20 bp, mouse
gtcaagagatgctgagagcc

SEQ ID NO: 693116 - DNA, 20 bp, mouse
ggagcctagcaggagtcggg

SEQ ID NO: 693117 - DNA, 20 bp, mouse
gagggagcctagcaggagtc

SEQ ID NO: 693118 - DNA, 20 bp, mouse
gtagcctcccgactcctgct

SEQ ID NO: 693119 - DNA, 20 bp, mouse
ggcagggcctaccggatgat

SEQ ID NO: 693120 - DNA, 20 bp, mouse
gctcgttcactcagcaccga

SEQ ID NO: 693121 - DNA, 20 bp, mouse
gagcaccgagggagcctagc

SEQ ID NO: 693122 - DNA, 20 bp, mouse
gcaaggtgatggtgagaccg

SEQ ID NO: 693123 - DNA, 20 bp, mouse
gacaaggcctagaccttggt

SEQ ID NO: 693124 - DNA, 20 bp, mouse
ggggaaaaacggacctgcgt

SEQ ID NO: 693125 - DNA, 20 bp, mouse
gcaaccaggctagccagaag

SEQ ID NO: 693126 - DNA, 20 bp, mouse
ggaagtcaagatgccggcga

SEQ ID NO: 693127 - DNA, 20 bp, mouse
gtgggccgactccgtctcta

SEQ ID NO: 693128 - DNA, 20 bp, mouse
gacggagtcggcccaggtgg

SEQ ID NO: 693129 - DNA, 20 bp, mouse
ggccggcatcttgacttctg

SEQ ID NO: 693130 - DNA, 20 bp, mouse
gcccgcagaagtcaagatgc

SEQ ID NO: 693131 - DNA, 20 bp, mouse
ggagacggagtcggcccagg

SEQ ID NO: 693132 - DNA, 20 bp, mouse
gggcccaggtggcggccacc

SEQ ID NO: 693133 - DNA, 20 bp, mouse
gtagcgccgcaaaatgacaa

SEQ ID NO: 693134 - DNA, 20 bp, mouse
ggtcctggtggccgccacct

SEQ ID NO: 693135 - DNA, 20 bp, mouse
ggccctccgcgtgccctcaa

SEQ ID NO: 693136 - DNA, 20 bp, mouse
gccctccccgccatgagaca

SEQ ID NO: 693137 - DNA, 20 bp, mouse
gctggggaggtaggaacagt

SEQ ID NO: 693138 - DNA, 20 bp, mouse
gatcatgtatgcagaaaaaa

SEQ ID NO: 693139 - DNA, 20 bp, mouse
gctcagttataaagtagcac

SEQ ID NO: 693140 - DNA, 20 bp, mouse
ggaaaccctgtctcatggcg

SEQ ID NO: 693141 - DNA, 20 bp, mouse
gaacagaattattgtccatt

SEQ ID NO: 693142 - DNA, 20 bp, mouse
ggcagcaccaatagcccata

SEQ ID NO: 693143 - DNA, 20 bp, mouse
ggtgtctgatgacagtggac

SEQ ID NO: 693144 - DNA, 20 bp, mouse
gagcaaggcttgtttcagaa

SEQ ID NO: 693145 - DNA, 20 bp, mouse
gttaatggacttctacccta

SEQ ID NO: 693146 - DNA, 20 bp, mouse
gctacagaaggacgaggtga

SEQ ID NO: 693147 - DNA, 20 bp, mouse
gcaggaggaaagcctacaga

SEQ ID NO: 693148 - DNA, 20 bp, mouse
ggacgcaaagtgcacgtagg

SEQ ID NO: 693149 - DNA, 20 bp, mouse
gaaaagaagcaactcgggtg

SEQ ID NO: 693150 - DNA, 20 bp, mouse
gaaagtaaaagaagcaactc

SEQ ID NO: 693151 - DNA, 20 bp, mouse
ggaagcaactcgggtgtgga

SEQ ID NO: 693152 - DNA, 20 bp, mouse
ggcaatagccatgtgctctt

SEQ ID NO: 693153 - DNA, 20 bp, mouse
gggtgacgcaaagtgcacgt

SEQ ID NO: 693154 - DNA, 20 bp, mouse
gcctaactgcagcgagactc

SEQ ID NO: 693155 - DNA, 20 bp, mouse
gctaacaagtcctgaggtgt

SEQ ID NO: 693156 - DNA, 20 bp, mouse
ggactcccggccgtgaccaa

SEQ ID NO: 693157 - DNA, 20 bp, mouse
gcacccaggctccgcctgga

SEQ ID NO: 693158 - DNA, 20 bp, mouse
gtcgtggccaggcacctttg

SEQ ID NO: 693159 - DNA, 20 bp, mouse
ggcggcttcgccggtggctc

SEQ ID NO: 693160 - DNA, 20 bp, mouse
gggtcacggccgggagtcca

SEQ ID NO: 693161 - DNA, 20 bp, mouse
gaccgccgcggcttcgccgg

SEQ ID NO: 693162 - DNA, 20 bp, mouse
ggccaccggcgaagccgcgg

SEQ ID NO: 693163 - DNA, 20 bp, mouse
gcgccctccaggcggagcct

SEQ ID NO: 693164 - DNA, 20 bp, mouse
ggactgcaggggacccggag

SEQ ID NO: 693165 - DNA, 20 bp, mouse
gccgggtcccctgcagtcat

SEQ ID NO: 693166 - DNA, 20 bp, mouse
gtggcctggcccaagtaaga

SEQ ID NO: 693167 - DNA, 20 bp, mouse
gcacagccccaggttcaagt

SEQ ID NO: 693168 - DNA, 20 bp, mouse
gtgagcgtccagaggctaca

SEQ ID NO: 693169 - DNA, 20 bp, mouse
gtacatcttgctcctgtgga

SEQ ID NO: 693170 - DNA, 20 bp, mouse
gcgtccagaggctacagggc

SEQ ID NO: 693171 - DNA, 20 bp, mouse
gggactttggaactgacctg

SEQ ID NO: 693172 - DNA, 20 bp, mouse
gaggtccacagtaagcggga

SEQ ID NO: 693173 - DNA, 20 bp, mouse
ggttcaagtaggtggagacg

SEQ ID NO: 693174 - DNA, 20 bp, mouse
ggcccaagtaagaagggcag

SEQ ID NO: 693175 - DNA, 20 bp, mouse
gagtacaaagccagcttgta

SEQ ID NO: 693176 - DNA, 20 bp, mouse
ggggccgagcgaccagaagg

SEQ ID NO: 693177 - DNA, 20 bp, mouse
gtggcgccgcagagtcgtct

SEQ ID NO: 693178 - DNA, 20 bp, mouse
gtccgggcagccgaagagtg

SEQ ID NO: 693179 - DNA, 20 bp, mouse
gccgcagagtcgtctgggat

SEQ ID NO: 693180 - DNA, 20 bp, mouse
ggcggcgccacgtctcttct

SEQ ID NO: 693181 - DNA, 20 bp, mouse
ggggccgccttctggtcgct

SEQ ID NO: 693182 - DNA, 20 bp, mouse
gtctggtcgctcggccctct

SEQ ID NO: 693183 - DNA, 20 bp, mouse
gtggaactgaggctgggaaa

SEQ ID NO: 693184 - DNA, 20 bp, mouse
gctggacttccttacccaga

SEQ ID NO: 693185 - DNA, 20 bp, mouse
gctactgagggtctaagtcc

SEQ ID NO: 693186 - DNA, 20 bp, mouse
ggtcccggaggggatgtagg

SEQ ID NO: 693187 - DNA, 20 bp, mouse
gggatcaggctgtgggtcac

SEQ ID NO: 693188 - DNA, 20 bp, mouse
gcgggtgtccccagtggatc

SEQ ID NO: 693189 - DNA, 20 bp, mouse
gaccttggcccggggctcaa

SEQ ID NO: 693190 - DNA, 20 bp, mouse
gacacccagcgaccagagtc

SEQ ID NO: 693191 - DNA, 20 bp, mouse
gtgtaggcgggtgtccccag

SEQ ID NO: 693192 - DNA, 20 bp, mouse
gcctccgggacgtgggacac

SEQ ID NO: 693193 - DNA, 20 bp, mouse
gacccacagcctgatccact

SEQ ID NO: 693194 - DNA, 20 bp, mouse
gtacatcccctccgggacgt

SEQ ID NO: 693195 - DNA, 20 bp, mouse
gagagtaggcaggcagacta

SEQ ID NO: 693196 - DNA, 20 bp, mouse
gggggtgcaaatctagggga

SEQ ID NO: 693197 - DNA, 20 bp, mouse
ggcaaagtcccctagccatg

SEQ ID NO: 693198 - DNA, 20 bp, mouse
gccagccgagaggaaatggc

SEQ ID NO: 693199 - DNA, 20 bp, mouse
gagggtgtgcgcagagactt

SEQ ID NO: 693200 - DNA, 20 bp, mouse
ggcaaccagccatttcctct

SEQ ID NO: 693201 - DNA, 20 bp, mouse
ggaaacttgtgagcggtggt

SEQ ID NO: 693202 - DNA, 20 bp, mouse
gggctaggggactttgctat

SEQ ID NO: 693203 - DNA, 20 bp, mouse
gagagtgctcgcggaggagg

SEQ ID NO: 693204 - DNA, 20 bp, mouse
gcttcgcagccccatggcta

SEQ ID NO: 693205 - DNA, 20 bp, mouse
gggtgtacccggtggctcta

SEQ ID NO: 693206 - DNA, 20 bp, mouse
gctaccgcgttggggccctt

SEQ ID NO: 693207 - DNA, 20 bp, mouse
gcggtgccggctccaatcac

SEQ ID NO: 693208 - DNA, 20 bp, mouse
gctcccccggcgtcactcgg

SEQ ID NO: 693209 - DNA, 20 bp, mouse
gggggaggggccgagaaaca

SEQ ID NO: 693210 - DNA, 20 bp, mouse
ggccttgcagctcacacaat

SEQ ID NO: 693211 - DNA, 20 bp, mouse
gaggaggagggcggctctca

SEQ ID NO: 693212 - DNA, 20 bp, mouse
gtggagctcgccggcccgaa

SEQ ID NO: 693213 - DNA, 20 bp, mouse
gccgcccaagggccccaacg

SEQ ID NO: 693214 - DNA, 20 bp, mouse
ggagctcagtgtggccatta

SEQ ID NO: 693215 - DNA, 20 bp, mouse
gccgctaccgctatcctgta

SEQ ID NO: 693216 - DNA, 20 bp, mouse
gcggctgcgagcggccctac

SEQ ID NO: 693217 - DNA, 20 bp, mouse
gggcggaggcaggaccgaag

SEQ ID NO: 693218 - DNA, 20 bp, mouse
ggtacgaggcgggaccgctt

SEQ ID NO: 693219 - DNA, 20 bp, mouse
gtcggcgcacgcgcagggaa

SEQ ID NO: 693220 - DNA, 20 bp, mouse
ggcgagcggccctacaggat

SEQ ID NO: 693221 - DNA, 20 bp, mouse
gggtccgcccccaactgacg

SEQ ID NO: 693222 - DNA, 20 bp, mouse
gttaagcaggcggttagggg

SEQ ID NO: 693223 - DNA, 20 bp, mouse
gtaggggcggagctgtatgc

SEQ ID NO: 693224 - DNA, 20 bp, mouse
ggggctgaggcggtgcacgc

SEQ ID NO: 693225 - DNA, 20 bp, mouse
gaggcgggaccgcttcggac

SEQ ID NO: 693226 - DNA, 20 bp, mouse
ggaggccggacattcgagag

SEQ ID NO: 693227 - DNA, 20 bp, mouse
ggacactgccgaggattgta

SEQ ID NO: 693228 - DNA, 20 bp, mouse
gggcgcgggagtgggacatc

SEQ ID NO: 693229 - DNA, 20 bp, mouse
gcagtctcaggacactgccg

SEQ ID NO: 693230 - DNA, 20 bp, mouse
gccgtccgagtttttaaagt

SEQ ID NO: 693231 - DNA, 20 bp, mouse
gacggccgcctcaggagagc

SEQ ID NO: 693232 - DNA, 20 bp, mouse
gctcgaatgtccggcctcct

SEQ ID NO: 693233 - DNA, 20 bp, mouse
gggactccggagctgtacac

SEQ ID NO: 693234 - DNA, 20 bp, mouse
ggaggcggccgtacaatcct

SEQ ID NO: 693235 - DNA, 20 bp, mouse
gtgtggccgcgcctccctat

SEQ ID NO: 693236 - DNA, 20 bp, mouse
gtagcccgactgtcgcaacc

SEQ ID NO: 693237 - DNA, 20 bp, mouse
gacccagagcaatcagggga

SEQ ID NO: 693238 - DNA, 20 bp, mouse
gcgactgtcgcaaccgggaa

SEQ ID NO: 693239 - DNA, 20 bp, mouse
gtgtcgcaaccgggaagggg

SEQ ID NO: 693240 - DNA, 20 bp, mouse
gcaactgccaatctttgggg

SEQ ID NO: 693241 - DNA, 20 bp, mouse
gacaggacctcccgagggga

SEQ ID NO: 693242 - DNA, 20 bp, mouse
gcctcgggaggtcctgtaat

SEQ ID NO: 693243 - DNA, 20 bp, mouse
gtgctctaggctgggcgtcc

SEQ ID NO: 693244 - DNA, 20 bp, mouse
gcaggtggaggcccccggcg

SEQ ID NO: 693245 - DNA, 20 bp, mouse
gaggggaaacatggagttcc

SEQ ID NO: 693246 - DNA, 20 bp, mouse
gccgcggcccgccagagcat

SEQ ID NO: 693247 - DNA, 20 bp, mouse
ggacgcggggagcccgaaca

SEQ ID NO: 693248 - DNA, 20 bp, mouse
gccctagagcggtaaggaga

SEQ ID NO: 693249 - DNA, 20 bp, mouse
gagggcctcagccaatgctc

SEQ ID NO: 693250 - DNA, 20 bp, mouse
gggagggggaggtaagacgc

SEQ ID NO: 693251 - DNA, 20 bp, mouse
ggggaagaagccgtgatctg

SEQ ID NO: 693252 - DNA, 20 bp, mouse
gtccttaccgctctagggga

SEQ ID NO: 693253 - DNA, 20 bp, mouse
gtcgtctcgcggaggaaagg

SEQ ID NO: 693254 - DNA, 20 bp, mouse
gcctattgggccgtgcggga

SEQ ID NO: 693255 - DNA, 20 bp, mouse
gcattggctgaggccctgtt

SEQ ID NO: 693256 - DNA, 20 bp, mouse
gagcttgcaggggagtgaaa

SEQ ID NO: 693257 - DNA, 20 bp, mouse
ggaaggggacccgactctgt

SEQ ID NO: 693258 - DNA, 20 bp, mouse
gggagtgaaagggatcggta

SEQ ID NO: 693259 - DNA, 20 bp, mouse
gggacccgactctgtgggat

SEQ ID NO: 693260 - DNA, 20 bp, mouse
ggcaggggagtgaaagggat

SEQ ID NO: 693261 - DNA, 20 bp, mouse
gaagaacgctgcatctcagg

SEQ ID NO: 693262 - DNA, 20 bp, mouse
gcctcccatcccacagagtc

SEQ ID NO: 693263 - DNA, 20 bp, mouse
gaccctagggacactcatgc

SEQ ID NO: 693264 - DNA, 20 bp, mouse
gtcaccgaggcacataggta

SEQ ID NO: 693265 - DNA, 20 bp, mouse
gatccggcatgagtgtccct

SEQ ID NO: 693266 - DNA, 20 bp, mouse
ggggccaggcagcgtccgaa

SEQ ID NO: 693267 - DNA, 20 bp, mouse
gccagggaggggaactcgga

SEQ ID NO: 693268 - DNA, 20 bp, mouse
gagcaggcgcgtccgatccc

SEQ ID NO: 693269 - DNA, 20 bp, mouse
ggatcccagggaggggaact

SEQ ID NO: 693270 - DNA, 20 bp, mouse
gtcgctactcgcacaccctt

SEQ ID NO: 693271 - DNA, 20 bp, mouse
gagccgagctgcccaggagc

SEQ ID NO: 693272 - DNA, 20 bp, mouse
gcctgggcagctcggctctt

SEQ ID NO: 693273 - DNA, 20 bp, mouse
gccgctggcttcccccacgt

SEQ ID NO: 693274 - DNA, 20 bp, mouse
gatcggacgcgcctgctcct

SEQ ID NO: 693275 - DNA, 20 bp, mouse
gggcgcgtccgatcccaggg

SEQ ID NO: 693276 - DNA, 20 bp, mouse
gccccggcgcctgctggcgt

SEQ ID NO: 693277 - DNA, 20 bp, mouse
gcacccctgcggcggggcac

SEQ ID NO: 693278 - DNA, 20 bp, mouse
gagagccgcgcgaacccctc

SEQ ID NO: 693279 - DNA, 20 bp, mouse
ggcgaaacgcacccctgcgg

SEQ ID NO: 693280 - DNA, 20 bp, mouse
gagggcgaaacgcacccctg

SEQ ID NO: 693281 - DNA, 20 bp, mouse
gctcccacgccagcaggcgc

SEQ ID NO: 693282 - DNA, 20 bp, mouse
ggggcgtggcctgcccgcgg

SEQ ID NO: 693283 - DNA, 20 bp, mouse
gccttcccgaggggttcgcg

SEQ ID NO: 693284 - DNA, 20 bp, mouse
gacgcctcgcacacgtgcac

SEQ ID NO: 693285 - DNA, 20 bp, mouse
gatctccagggtcgctccga

SEQ ID NO: 693286 - DNA, 20 bp, mouse
gtccccacggggatctctaa

SEQ ID NO: 693287 - DNA, 20 bp, mouse
gcgggagggaagccaggacg

SEQ ID NO: 693288 - DNA, 20 bp, mouse
gagggaagccaggacgaggt

SEQ ID NO: 693289 - DNA, 20 bp, mouse
gacgcccagactccgagcga

SEQ ID NO: 693290 - DNA, 20 bp, mouse
gcggggatctctaaagggag

SEQ ID NO: 693291 - DNA, 20 bp, mouse
gaggggggccaacctcgtcc

SEQ ID NO: 693292 - DNA, 20 bp, mouse
gatctctaaagggagaggag

SEQ ID NO: 693293 - DNA, 20 bp, mouse
gcctctagaacctagctctg

SEQ ID NO: 693294 - DNA, 20 bp, mouse
gaggagccacactccccacg

SEQ ID NO: 693295 - DNA, 20 bp, mouse
gtcctggcttccctcccgcg

SEQ ID NO: 693296 - DNA, 20 bp, mouse
gagggcggggtctcaatgga

SEQ ID NO: 693297 - DNA, 20 bp, mouse
ggagaccccgccctgaaggg

SEQ ID NO: 693298 - DNA, 20 bp, mouse
ggccggggctggctgtacct

SEQ ID NO: 693299 - DNA, 20 bp, mouse
gcgctcgggtcaccgtcccg

SEQ ID NO: 693300 - DNA, 20 bp, mouse
gccaaccttccggtctccct

SEQ ID NO: 693301 - DNA, 20 bp, mouse
gtgggaagcagcagcgaatt

SEQ ID NO: 693302 - DNA, 20 bp, mouse
gcttcagggcggggtctcaa

SEQ ID NO: 693303 - DNA, 20 bp, mouse
ggacccgagcgccccccttc

SEQ ID NO: 693304 - DNA, 20 bp, mouse
gcgagcgccccccttcaggg

SEQ ID NO: 693305 - DNA, 20 bp, mouse
ggaggacgcaccaccgagtg

SEQ ID NO: 693306 - DNA, 20 bp, mouse
ggcggcggcctcggctgggg

SEQ ID NO: 693307 - DNA, 20 bp, mouse
ggcgcggcgggcactgacgg

SEQ ID NO: 693308 - DNA, 20 bp, mouse
gcccgccgagagtagccgcg

SEQ ID NO: 693309 - DNA, 20 bp, mouse
gctggggcgggagcgagccc

SEQ ID NO: 693310 - DNA, 20 bp, mouse
ggcggcgcggcgggcactga

SEQ ID NO: 693311 - DNA, 20 bp, mouse
gctcccgcgggctgcggccc

SEQ ID NO: 693312 - DNA, 20 bp, mouse
ggccccgcgaagagcgccgc

SEQ ID NO: 693313 - DNA, 20 bp, mouse
gggccgcccgcgggacgcgt

SEQ ID NO: 693314 - DNA, 20 bp, mouse
gagaacgcgcacaggcggcc

SEQ ID NO: 693315 - DNA, 20 bp, mouse
gtggggcggtcggtcggtgc

SEQ ID NO: 693316 - DNA, 20 bp, mouse
gtaagctggcaacaccagat

SEQ ID NO: 693317 - DNA, 20 bp, mouse
ggggacgctccgctcttaaa

SEQ ID NO: 693318 - DNA, 20 bp, mouse
ggagcgtcccgcccttcggg

SEQ ID NO: 693319 - DNA, 20 bp, mouse
ggggcggccggggtcctccg

SEQ ID NO: 693320 - DNA, 20 bp, mouse
ggcccagccggctagaggag

SEQ ID NO: 693321 - DNA, 20 bp, mouse
gcccaccctgcgctaatccc

SEQ ID NO: 693322 - DNA, 20 bp, mouse
ggtcctccggggattagcgc

SEQ ID NO: 693323 - DNA, 20 bp, mouse
gatggcaccgccccggaaat

SEQ ID NO: 693324 - DNA, 20 bp, mouse
gaggaggccgatttccgggg

SEQ ID NO: 693325 - DNA, 20 bp, mouse
gaggggcaatggcaccgccc

SEQ ID NO: 693326 - DNA, 20 bp, mouse
gtaggagatagcagcaggga

SEQ ID NO: 693327 - DNA, 20 bp, mouse
gcggcatcatgagagaggaa

SEQ ID NO: 693328 - DNA, 20 bp, mouse
ggatctagcctgacagacag

SEQ ID NO: 693329 - DNA, 20 bp, mouse
gcctaggcctcctgcctaag

SEQ ID NO: 693330 - DNA, 20 bp, mouse
gcaggctcacaggaggagtg

SEQ ID NO: 693331 - DNA, 20 bp, mouse
ggacagacagaggcctgcct

SEQ ID NO: 693332 - DNA, 20 bp, mouse
gtggcctaggagatagcagc

SEQ ID NO: 693333 - DNA, 20 bp, mouse
ggatgctgctgtataaacag

SEQ ID NO: 693334 - DNA, 20 bp, mouse
gctctctcatgatgccgctt

SEQ ID NO: 693335 - DNA, 20 bp, mouse
gagcctgctggcaggtgtct

SEQ ID NO: 693336 - DNA, 20 bp, mouse
gggaaggccggcgcgtagag

SEQ ID NO: 693337 - DNA, 20 bp, mouse
gcctcgcttgagcaccgcgc

SEQ ID NO: 693338 - DNA, 20 bp, mouse
gtagagcggctgggatgctc

SEQ ID NO: 693339 - DNA, 20 bp, mouse
gcgcgatgcagtgtggggaa

SEQ ID NO: 693340 - DNA, 20 bp, mouse
gggggagcgcgggctcgagc

SEQ ID NO: 693341 - DNA, 20 bp, mouse
gtcgctgcgcgatgcagtgt

SEQ ID NO: 693342 - DNA, 20 bp, mouse
gctacgcgccggccttccca

SEQ ID NO: 693343 - DNA, 20 bp, mouse
gagcgggcgggcgaggccgg

SEQ ID NO: 693344 - DNA, 20 bp, mouse
gcagcgacgcgggcacgcgc

SEQ ID NO: 693345 - DNA, 20 bp, mouse
ggtcctgcgcggccgcccag

SEQ ID NO: 693346 - DNA, 20 bp, mouse
gacagtgactagcacaacaa

SEQ ID NO: 693347 - DNA, 20 bp, mouse
ggacgcccgggcccttctcc

SEQ ID NO: 693348 - DNA, 20 bp, mouse
gccagcccggagaagggccc

SEQ ID NO: 693349 - DNA, 20 bp, mouse
gctggagagtgcagacgccc

SEQ ID NO: 693350 - DNA, 20 bp, mouse
gggcgcgtggggagcttcac

SEQ ID NO: 693351 - DNA, 20 bp, mouse
gtccagagcccggtgtaaaa

SEQ ID NO: 693352 - DNA, 20 bp, mouse
gcgactgtgccattttacac

SEQ ID NO: 693353 - DNA, 20 bp, mouse
gcgctggcgggcgagagggc

SEQ ID NO: 693354 - DNA, 20 bp, mouse
gggcgcgcacgcccattggc

SEQ ID NO: 693355 - DNA, 20 bp, mouse
gggcgtgcccagatgctccg

SEQ ID NO: 693356 - DNA, 20 bp, mouse
gagagcgagccgagtcccgg

SEQ ID NO: 693357 - DNA, 20 bp, mouse
gtcccggtggccctcctcgg

SEQ ID NO: 693358 - DNA, 20 bp, mouse
gggactcggctcgctctcgc

SEQ ID NO: 693359 - DNA, 20 bp, mouse
gcccgcgcggagcgagtcgg

SEQ ID NO: 693360 - DNA, 20 bp, mouse
gtgcccacccactctctccg

SEQ ID NO: 693361 - DNA, 20 bp, mouse
gtcgccgcggagagagtggg

SEQ ID NO: 693362 - DNA, 20 bp, mouse
ggcctcgccgcggagagagt

SEQ ID NO: 693363 - DNA, 20 bp, mouse
ggaggagggccaccgggact

SEQ ID NO: 693364 - DNA, 20 bp, mouse
ggggctgtgcctctcggcgt

SEQ ID NO: 693365 - DNA, 20 bp, mouse
ggccaggtgcgctcggtccc

SEQ ID NO: 693366 - DNA, 20 bp, mouse
gagcaggtgggccctactgg

SEQ ID NO: 693367 - DNA, 20 bp, mouse
ggcagccgataggccgatac

SEQ ID NO: 693368 - DNA, 20 bp, mouse
gcccaccggtatcggcctat

SEQ ID NO: 693369 - DNA, 20 bp, mouse
gctaagacagcgcagccgat

SEQ ID NO: 693370 - DNA, 20 bp, mouse
ggggtcagaggatccctaac

SEQ ID NO: 693371 - DNA, 20 bp, mouse
gtccagcaggtgggccctac

SEQ ID NO: 693372 - DNA, 20 bp, mouse
gtctcagatcagcagggtga

SEQ ID NO: 693373 - DNA, 20 bp, mouse
ggccgataggccgataccgg

SEQ ID NO: 693374 - DNA, 20 bp, mouse
gcccccgcccaattctagtg

SEQ ID NO: 693375 - DNA, 20 bp, mouse
gttcagcccccagtttgggt

SEQ ID NO: 693376 - DNA, 20 bp, mouse
gaaagggcatcgcacttaaa

SEQ ID NO: 693377 - DNA, 20 bp, mouse
gactgcaacccccctcaagg

SEQ ID NO: 693378 - DNA, 20 bp, mouse
gaacccccctcaaggaggac

SEQ ID NO: 693379 - DNA, 20 bp, mouse
gagaggtgtggcacattctc

SEQ ID NO: 693380 - DNA, 20 bp, mouse
gagaactgcaacccccctca

SEQ ID NO: 693381 - DNA, 20 bp, mouse
ggcacttaaagggtttggga

SEQ ID NO: 693382 - DNA, 20 bp, mouse
ggctcctgtcctccttgagg

SEQ ID NO: 693383 - DNA, 20 bp, mouse
gctgccaacaggaaacgcag

SEQ ID NO: 693384 - DNA, 20 bp, mouse
gaaggggtaattctctgaga

SEQ ID NO: 693385 - DNA, 20 bp, mouse
gtgagactcaggcctgagat

SEQ ID NO: 693386 - DNA, 20 bp, mouse
gggcgggccctgagccagaa

SEQ ID NO: 693387 - DNA, 20 bp, mouse
gcggaggcggggagagtgct

SEQ ID NO: 693388 - DNA, 20 bp, mouse
ggaggtggaggttcaccctg

SEQ ID NO: 693389 - DNA, 20 bp, mouse
gcacgcaagccgcccagttc

SEQ ID NO: 693390 - DNA, 20 bp, mouse
ggcggggagagtgctagggc

SEQ ID NO: 693391 - DNA, 20 bp, mouse
gccaggaggccggaactggg

SEQ ID NO: 693392 - DNA, 20 bp, mouse
ggccacgccctgtgaaccgc

SEQ ID NO: 693393 - DNA, 20 bp, mouse
ggccgtacgggctgcaactt

SEQ ID NO: 693394 - DNA, 20 bp, mouse
gacagggcgtggccggaggc

SEQ ID NO: 693395 - DNA, 20 bp, mouse
gtgccatcctactgccagag

SEQ ID NO: 693396 - DNA, 20 bp, mouse
gggcactcgcacacttgttt

SEQ ID NO: 693397 - DNA, 20 bp, mouse
gaagttctctcttgaaacac

SEQ ID NO: 693398 - DNA, 20 bp, mouse
gcaagtgtgcgagtgcccgc

SEQ ID NO: 693399 - DNA, 20 bp, mouse
ggcagacaagataatctggt

SEQ ID NO: 693400 - DNA, 20 bp, mouse
gaacagcagacaagataatc

SEQ ID NO: 693401 - DNA, 20 bp, mouse
gtagtctactagaaaagctg

SEQ ID NO: 693402 - DNA, 20 bp, mouse
gacgcttcgtgaaatataaa

SEQ ID NO: 693403 - DNA, 20 bp, mouse
gcatggacaattatgcccac
